United States Patent 7,250,289 (METHODS OF GENETIC ANALYSIS OF MOUSE) - sequence listing, part 16

SEQ ID NO: 603601 - DNA, 25 bp, Mus musculus
ggatccagttgtgcagtagagttca

SEQ ID NO: 603602 - DNA, 25 bp, Mus musculus
ggatccatagcgctcgcaacaatag

SEQ ID NO: 603603 - DNA, 25 bp, Mus musculus
ggatccatagcggtcgcaacaatag

SEQ ID NO: 603604 - DNA, 25 bp, Mus musculus
ggatccatattcagacccttttaaa

SEQ ID NO: 603605 - DNA, 25 bp, Mus musculus
ggatccatattctgacccttttaaa

SEQ ID NO: 603606 - DNA, 25 bp, Mus musculus
ggatccatcatgagatacaccatta

SEQ ID NO: 603607 - DNA, 25 bp, Mus musculus
ggatccatcatgctagctcctgaga

SEQ ID NO: 603608 - DNA, 25 bp, Mus musculus
ggatccatcatggtagctcctgaga

SEQ ID NO: 603609 - DNA, 25 bp, Mus musculus
ggatccatcatgtgatacaccatta

SEQ ID NO: 603610 - DNA, 25 bp, Mus musculus
ggatccatccaaccattctagaaag

SEQ ID NO: 603611 - DNA, 25 bp, Mus musculus
ggatccatccaagcattctagaaag

SEQ ID NO: 603612 - DNA, 25 bp, Mus musculus
ggatccatccatatcccaggaaatg

SEQ ID NO: 603613 - DNA, 25 bp, Mus musculus
ggatccatccatttcccaggaaatg

SEQ ID NO: 603614 - DNA, 25 bp, Mus musculus
ggatccatctgtctttgagacctag

SEQ ID NO: 603615 - DNA, 25 bp, Mus musculus
ggatccatctgtgtttgagacctag

SEQ ID NO: 603616 - DNA, 25 bp, Mus musculus
ggatccatcttaagcacatcaccag

SEQ ID NO: 603617 - DNA, 25 bp, Mus musculus
ggatccatcttatgcacatcaccag

SEQ ID NO: 603618 - DNA, 25 bp, Mus musculus
ggatccatgaccaaaacacagtcgt

SEQ ID NO: 603619 - DNA, 25 bp, Mus musculus
ggatccatgacctaaacacagtcgt

SEQ ID NO: 603620 - DNA, 25 bp, Mus musculus
ggatccatgataatcaggacagcta

SEQ ID NO: 603621 - DNA, 25 bp, Mus musculus
ggatccatgatattcaggacagcta

SEQ ID NO: 603622 - DNA, 25 bp, Mus musculus
ggatccatgtatactgtatctgtga

SEQ ID NO: 603623 - DNA, 25 bp, Mus musculus
ggatccatgtattctgtatctgtga

SEQ ID NO: 603624 - DNA, 25 bp, Mus musculus
ggatccattcatctctatgttacct

SEQ ID NO: 603625 - DNA, 25 bp, Mus musculus
ggatccattcatgtctatgttacct

SEQ ID NO: 603626 - DNA, 25 bp, Mus musculus
ggatccattgaaaagtccctgaatt

SEQ ID NO: 603627 - DNA, 25 bp, Mus musculus
ggatccattgaatagtccctgaatt

SEQ ID NO: 603628 - DNA, 25 bp, Mus musculus
ggatccatttgaaccaagtgcagac

SEQ ID NO: 603629 - DNA, 25 bp, Mus musculus
ggatccatttgatccaagtgcagac

SEQ ID NO: 603630 - DNA, 25 bp, Mus musculus
ggatccattttgatcgtggactcac

SEQ ID NO: 603631 - DNA, 25 bp, Mus musculus
ggatccattttgttcgtggactcac

SEQ ID NO: 603632 - DNA, 25 bp, Mus musculus
ggatcccaaaaccacgcatgcggtt

SEQ ID NO: 603633 - DNA, 25 bp, Mus musculus
ggatcccaaaacgacgcatgcggtt

SEQ ID NO: 603634 - DNA, 25 bp, Mus musculus
ggatcccaaagtctgattgctcctt

SEQ ID NO: 603635 - DNA, 25 bp, Mus musculus
ggatcccaaagtgtgattgctcctt

SEQ ID NO: 603636 - DNA, 25 bp, Mus musculus
ggatcccaccagcatttgtgtggat

SEQ ID NO: 603637 - DNA, 25 bp, Mus musculus
ggatcccaccaggatttgtgtggat

SEQ ID NO: 603638 - DNA, 25 bp, Mus musculus
ggatcccacccaaagaatccaggta

SEQ ID NO: 603639 - DNA, 25 bp, Mus musculus
ggatcccacccatagaatccaggta

SEQ ID NO: 603640 - DNA, 25 bp, Mus musculus
ggatcccacctcacgtgtgatgcta

SEQ ID NO: 603641 - DNA, 25 bp, Mus musculus
ggatcccacctctcgtgtgatgcta

SEQ ID NO: 603642 - DNA, 25 bp, Mus musculus
ggatcccactcaccattatcagagt

SEQ ID NO: 603643 - DNA, 25 bp, Mus musculus
ggatcccactcagcattatcagagt

SEQ ID NO: 603644 - DNA, 25 bp, Mus musculus
ggatcccactgaaatgacaagccat

SEQ ID NO: 603645 - DNA, 25 bp, Mus musculus
ggatcccactgatatgacaagccat

SEQ ID NO: 603646 - DNA, 25 bp, Mus musculus
ggatcccagagaacaggccccaaag

SEQ ID NO: 603647 - DNA, 25 bp, Mus musculus
ggatcccagagacatagcttagctt

SEQ ID NO: 603648 - DNA, 25 bp, Mus musculus
ggatcccagagagatagcttagctt

SEQ ID NO: 603649 - DNA, 25 bp, Mus musculus
ggatcccagagatcaggccccaaag

SEQ ID NO: 603650 - DNA, 25 bp, Mus musculus
ggatcccagagtcgttgtagttacc

SEQ ID NO: 603651 - DNA, 25 bp, Mus musculus
ggatcccagagtggttgtagttacc

SEQ ID NO: 603652 - DNA, 25 bp, Mus musculus
ggatcccagattctgatgacttatt

SEQ ID NO: 603653 - DNA, 25 bp, Mus musculus
ggatcccagattgtgatgacttatt

SEQ ID NO: 603654 - DNA, 25 bp, Mus musculus
ggatcccagcaacttgttctctgat

SEQ ID NO: 603655 - DNA, 25 bp, Mus musculus
ggatcccagcaagttgttctctgat

SEQ ID NO: 603656 - DNA, 25 bp, Mus musculus
ggatcccagcagatggttgctgacc

SEQ ID NO: 603657 - DNA, 25 bp, Mus musculus
ggatcccagcagcaacttaggaaac

SEQ ID NO: 603658 - DNA, 25 bp, Mus musculus
ggatcccagcaggaacttaggaaac

SEQ ID NO: 603659 - DNA, 25 bp, Mus musculus
ggatcccagcagttggttgctgacc

SEQ ID NO: 603660 - DNA, 25 bp, Mus musculus
ggatcccagctcagatcaagtgaga

SEQ ID NO: 603661 - DNA, 25 bp, Mus musculus
ggatcccagctctgatcaagtgaga

SEQ ID NO: 603662 - DNA, 25 bp, Mus musculus
ggatcccaggatcttcaggtcgcag

SEQ ID NO: 603663 - DNA, 25 bp, Mus musculus
ggatcccaggatgttcaggtcgcag

SEQ ID NO: 603664 - DNA, 25 bp, Mus musculus
ggatcccaggccacaggactagtgc

SEQ ID NO: 603665 - DNA, 25 bp, Mus musculus
ggatcccaggcctcaggactagtgc

SEQ ID NO: 603666 - DNA, 25 bp, Mus musculus
ggatcccagttgaaggcctcctaag

SEQ ID NO: 603667 - DNA, 25 bp, Mus musculus
ggatcccagttgtaggcctcctaag

SEQ ID NO: 603668 - DNA, 25 bp, Mus musculus
ggatcccatctgctgtcaacgacac

SEQ ID NO: 603669 - DNA, 25 bp, Mus musculus
ggatcccatctggtgtcaacgacac

SEQ ID NO: 603670 - DNA, 25 bp, Mus musculus
ggatcccatggtcgctggagaatat

SEQ ID NO: 603671 - DNA, 25 bp, Mus musculus
ggatcccatggtggctggagaatat

SEQ ID NO: 603672 - DNA, 25 bp, Mus musculus
ggatcccattacaaatcatgtccag

SEQ ID NO: 603673 - DNA, 25 bp, Mus musculus
ggatcccattactaatcatgtccag

SEQ ID NO: 603674 - DNA, 25 bp, Mus musculus
ggatccccacctcctggatatgaag

SEQ ID NO: 603675 - DNA, 25 bp, Mus musculus
ggatccccacctgctggatatgaag

SEQ ID NO: 603676 - DNA, 25 bp, Mus musculus
ggatccccagcacacattaaagcta

SEQ ID NO: 603677 - DNA, 25 bp, Mus musculus
ggatccccagcagacattaaagcta

SEQ ID NO: 603678 - DNA, 25 bp, Mus musculus
ggatccccaggccagtcaagtctct

SEQ ID NO: 603679 - DNA, 25 bp, Mus musculus
ggatccccaggcgagtcaagtctct

SEQ ID NO: 603680 - DNA, 25 bp, Mus musculus
ggatccccagttccagatagttcca

SEQ ID NO: 603681 - DNA, 25 bp, Mus musculus
ggatccccagttgcagatagttcca

SEQ ID NO: 603682 - DNA, 25 bp, Mus musculus
ggatccccatcacaatcttacagta

SEQ ID NO: 603683 - DNA, 25 bp, Mus musculus
ggatccccatcagaatcttacagta

SEQ ID NO: 603684 - DNA, 25 bp, Mus musculus
ggatccccattcagtcgtcagaaca

SEQ ID NO: 603685 - DNA, 25 bp, Mus musculus
ggatccccattctgtcgtcagaaca

SEQ ID NO: 603686 - DNA, 25 bp, Mus musculus
ggatcccctgaaatcccggagaaga

SEQ ID NO: 603687 - DNA, 25 bp, Mus musculus
ggatcccctgaattcccggagaaga

SEQ ID NO: 603688 - DNA, 25 bp, Mus musculus
ggatcccctggcattatagaagact

SEQ ID NO: 603689 - DNA, 25 bp, Mus musculus
ggatcccctggctttatagaagact

SEQ ID NO: 603690 - DNA, 25 bp, Mus musculus
ggatcccgacacacagctgtggtga

SEQ ID NO: 603691 - DNA, 25 bp, Mus musculus
ggatcccgacactcagctgtggtga

SEQ ID NO: 603692 - DNA, 25 bp, Mus musculus
ggatcccggaatagctgtactgaca

SEQ ID NO: 603693 - DNA, 25 bp, Mus musculus
ggatcccggaattgctgtactgaca

SEQ ID NO: 603694 - DNA, 25 bp, Mus musculus
ggatcccggcacacttaaggaactg

SEQ ID NO: 603695 - DNA, 25 bp, Mus musculus
ggatcccggcactcttaaggaactg

SEQ ID NO: 603696 - DNA, 25 bp, Mus musculus
ggatcccgggccacgacatggaaga

SEQ ID NO: 603697 - DNA, 25 bp, Mus musculus
ggatcccgggcctcgacatggaaga

SEQ ID NO: 603698 - DNA, 25 bp, Mus musculus
ggatcccgttgtcccaccattgaga

SEQ ID NO: 603699 - DNA, 25 bp, Mus musculus
ggatcccgttgtgccaccattgaga

SEQ ID NO: 603700 - DNA, 25 bp, Mus musculus
ggatccctaaagctacagtccaggc

SEQ ID NO: 603701 - DNA, 25 bp, Mus musculus
ggatccctaaaggtacagtccaggc

SEQ ID NO: 603702 - DNA, 25 bp, Mus musculus
ggatccctacacatgcttctggata

SEQ ID NO: 603703 - DNA, 25 bp, Mus musculus
ggatccctacacttgcttctggata

SEQ ID NO: 603704 - DNA, 25 bp, Mus musculus
ggatccctacccaagagttgctgag

SEQ ID NO: 603705 - DNA, 25 bp, Mus musculus
ggatccctaccctagagttgctgag

SEQ ID NO: 603706 - DNA, 25 bp, Mus musculus
ggatccctagacacttgatgccgat

SEQ ID NO: 603707 - DNA, 25 bp, Mus musculus
ggatccctagactcttgatgccgat

SEQ ID NO: 603708 - DNA, 25 bp, Mus musculus
ggatccctagagattggagcttcat

SEQ ID NO: 603709 - DNA, 25 bp, Mus musculus
ggatccctagagtttggagcttcat

SEQ ID NO: 603710 - DNA, 25 bp, Mus musculus
ggatccctagatacggtaggcccag

SEQ ID NO: 603711 - DNA, 25 bp, Mus musculus
ggatccctagattcggtaggcccag

SEQ ID NO: 603712 - DNA, 25 bp, Mus musculus
ggatccctaggtcggtgtgaccctt

SEQ ID NO: 603713 - DNA, 25 bp, Mus musculus
ggatccctaggtgggtgtgaccctt

SEQ ID NO: 603714 - DNA, 25 bp, Mus musculus
ggatccctatggagggagtgcccat

SEQ ID NO: 603715 - DNA, 25 bp, Mus musculus
ggatccctatggtgggagtgcccat

SEQ ID NO: 603716 - DNA, 25 bp, Mus musculus
ggatccctattcacctgtggagcac

SEQ ID NO: 603717 - DNA, 25 bp, Mus musculus
ggatccctattctcctgtggagcac

SEQ ID NO: 603718 - DNA, 25 bp, Mus musculus
ggatccctcaaaattgacttgtctt

SEQ ID NO: 603719 - DNA, 25 bp, Mus musculus
ggatccctcaaatttgacttgtctt

SEQ ID NO: 603720 - DNA, 25 bp, Mus musculus
ggatccctccacaagattctggcaa

SEQ ID NO: 603721 - DNA, 25 bp, Mus musculus
ggatccctccactagattctggcaa

SEQ ID NO: 603722 - DNA, 25 bp, Mus musculus
ggatccctcctacgttatgactttt

SEQ ID NO: 603723 - DNA, 25 bp, Mus musculus
ggatccctcctaggttatgactttt

SEQ ID NO: 603724 - DNA, 25 bp, Mus musculus
ggatccctcgtgaatccgagagacg

SEQ ID NO: 603725 - DNA, 25 bp, Mus musculus
ggatccctcgtgtatccgagagacg

SEQ ID NO: 603726 - DNA, 25 bp, Mus musculus
ggatccctgaacctggtgctgataa

SEQ ID NO: 603727 - DNA, 25 bp, Mus musculus
ggatccctgaacgtggtgctgataa

SEQ ID NO: 603728 - DNA, 25 bp, Mus musculus
ggatccctgatccagggcctagaag

SEQ ID NO: 603729 - DNA, 25 bp, Mus musculus
ggatccctgatcgagggcctagaag

SEQ ID NO: 603730 - DNA, 25 bp, Mus musculus
ggatccctgattccctccatgtgga

SEQ ID NO: 603731 - DNA, 25 bp, Mus musculus
ggatccctgattgcctccatgtgga

SEQ ID NO: 603732 - DNA, 25 bp, Mus musculus
ggatccctggacacttacattcaat

SEQ ID NO: 603733 - DNA, 25 bp, Mus musculus
ggatccctggactcttacattcaat

SEQ ID NO: 603734 - DNA, 25 bp, Mus musculus
ggatccctggttatctccaagaagg

SEQ ID NO: 603735 - DNA, 25 bp, Mus musculus
ggatccctggttttctccaagaagg

SEQ ID NO: 603736 - DNA, 25 bp, Mus musculus
ggatcccttactactttcaggtact

SEQ ID NO: 603737 - DNA, 25 bp, Mus musculus
ggatcccttacttctttcaggtact

SEQ ID NO: 603738 - DNA, 25 bp, Mus musculus
ggatcccttagcagaaccacacatg

SEQ ID NO: 603739 - DNA, 25 bp, Mus musculus
ggatcccttagctgaaccacacatg

SEQ ID NO: 603740 - DNA, 25 bp, Mus musculus
ggatcccttaggcacttcagtcacc

SEQ ID NO: 603741 - DNA, 25 bp, Mus musculus
ggatcccttagggacttcagtcacc

SEQ ID NO: 603742 - DNA, 25 bp, Mus musculus
ggatcccttattcgattagtccagg

SEQ ID NO: 603743 - DNA, 25 bp, Mus musculus
ggatcccttattggattagtccagg

SEQ ID NO: 603744 - DNA, 25 bp, Mus musculus
ggatccgaactcagttcttcagtat

SEQ ID NO: 603745 - DNA, 25 bp, Mus musculus
ggatccgaactctgttcttcagtat

SEQ ID NO: 603746 - DNA, 25 bp, Mus musculus
ggatccgaatctatcttaacataag

SEQ ID NO: 603747 - DNA, 25 bp, Mus musculus
ggatccgaatctttcttaacataag

SEQ ID NO: 603748 - DNA, 25 bp, Mus musculus
ggatccgaattacctggacactcaa

SEQ ID NO: 603749 - DNA, 25 bp, Mus musculus
ggatccgaattagctggacactcaa

SEQ ID NO: 603750 - DNA, 25 bp, Mus musculus
ggatccgatggaccatatcagactt

SEQ ID NO: 603751 - DNA, 25 bp, Mus musculus
ggatccgatggagcatatcagactt

SEQ ID NO: 603752 - DNA, 25 bp, Mus musculus
ggatccgcaagtaccagattctcaa

SEQ ID NO: 603753 - DNA, 25 bp, Mus musculus
ggatccgcaagttccagattctcaa

SEQ ID NO: 603754 - DNA, 25 bp, Mus musculus
ggatccgcaatccacgtgggctaga

SEQ ID NO: 603755 - DNA, 25 bp, Mus musculus
ggatccgcaatcgacgtgggctaga

SEQ ID NO: 603756 - DNA, 25 bp, Mus musculus
ggatccgcatttcggtggactctgc

SEQ ID NO: 603757 - DNA, 25 bp, Mus musculus
ggatccgcatttgggtggactctgc

SEQ ID NO: 603758 - DNA, 25 bp, Mus musculus
ggatccgctcgacaagacaggtgaa

SEQ ID NO: 603759 - DNA, 25 bp, Mus musculus
ggatccgctcgagaagacaggtgaa

SEQ ID NO: 603760 - DNA, 25 bp, Mus musculus
ggatccgcttctacctgcaggagaa

SEQ ID NO: 603761 - DNA, 25 bp, Mus musculus
ggatccgcttcttcctgcaggagaa

SEQ ID NO: 603762 - DNA, 25 bp, Mus musculus
ggatccggagtcaggttgccacctt

SEQ ID NO: 603763 - DNA, 25 bp, Mus musculus
ggatccggagtctggttgccacctt

SEQ ID NO: 603764 - DNA, 25 bp, Mus musculus
ggatccggagttcggaacacgcata

SEQ ID NO: 603765 - DNA, 25 bp, Mus musculus
ggatccggagttgggaacacgcata

SEQ ID NO: 603766 - DNA, 25 bp, Mus musculus
ggatccggatgaaaaaccaagatat

SEQ ID NO: 603767 - DNA, 25 bp, Mus musculus
ggatccggatgataaaccaagatat

SEQ ID NO: 603768 - DNA, 25 bp, Mus musculus
ggatccggcacaacccagatgaaat

SEQ ID NO: 603769 - DNA, 25 bp, Mus musculus
ggatccggcacatcccagatgaaat

SEQ ID NO: 603770 - DNA, 25 bp, Mus musculus
ggatccggcagcatgtccgaataga

SEQ ID NO: 603771 - DNA, 25 bp, Mus musculus
ggatccggcagcttgtccgaataga

SEQ ID NO: 603772 - DNA, 25 bp, Mus musculus
ggatccgggtgtccagcacccagta

SEQ ID NO: 603773 - DNA, 25 bp, Mus musculus
ggatccgggtgtgcagcacccagta

SEQ ID NO: 603774 - DNA, 25 bp, Mus musculus
ggatccggtgaaccctttatttagc

SEQ ID NO: 603775 - DNA, 25 bp, Mus musculus
ggatccggtgaagcctttatttagc

SEQ ID NO: 603776 - DNA, 25 bp, Mus musculus
ggatccggtgccaggtaacatcaaa

SEQ ID NO: 603777 - DNA, 25 bp, Mus musculus
ggatccggtgcctggtaacatcaaa

SEQ ID NO: 603778 - DNA, 25 bp, Mus musculus
ggatccgtcaagctaactggactat

SEQ ID NO: 603779 - DNA, 25 bp, Mus musculus
ggatccgtcaaggtaactggactat

SEQ ID NO: 603780 - DNA, 25 bp, Mus musculus
ggatccgtcttacatgcaattgctg

SEQ ID NO: 603781 - DNA, 25 bp, Mus musculus
ggatccgtcttagatgcaattgctg

SEQ ID NO: 603782 - DNA, 25 bp, Mus musculus
ggatcctaacaccaagatgaatatt

SEQ ID NO: 603783 - DNA, 25 bp, Mus musculus
ggatcctaacacgaagatgaatatt

SEQ ID NO: 603784 - DNA, 25 bp, Mus musculus
ggatcctaacggagccgacctgcct

SEQ ID NO: 603785 - DNA, 25 bp, Mus musculus
ggatcctaacggtgccgacctgcct

SEQ ID NO: 603786 - DNA, 25 bp, Mus musculus
ggatcctaactacgcttcgagatgc

SEQ ID NO: 603787 - DNA, 25 bp, Mus musculus
ggatcctaactaggcttcgagatgc

SEQ ID NO: 603788 - DNA, 25 bp, Mus musculus
ggatcctaaggtactgtgcatgcta

SEQ ID NO: 603789 - DNA, 25 bp, Mus musculus
ggatcctaaggttctgtgcatgcta

SEQ ID NO: 603790 - DNA, 25 bp, Mus musculus
ggatcctacatccattcggctctgt

SEQ ID NO: 603791 - DNA, 25 bp, Mus musculus
ggatcctacatcgattcggctctgt

SEQ ID NO: 603792 - DNA, 25 bp, Mus musculus
ggatcctagacacttacagccagaa

SEQ ID NO: 603793 - DNA, 25 bp, Mus musculus
ggatcctagacagttacagccagaa

SEQ ID NO: 603794 - DNA, 25 bp, Mus musculus
ggatcctagctgactgtgatttgct

SEQ ID NO: 603795 - DNA, 25 bp, Mus musculus
ggatcctagctgtctgtgatttgct

SEQ ID NO: 603796 - DNA, 25 bp, Mus musculus
ggatcctaggatacttggtgactct

SEQ ID NO: 603797 - DNA, 25 bp, Mus musculus
ggatcctaggattcttggtgactct

SEQ ID NO: 603798 - DNA, 25 bp, Mus musculus
ggatcctagtagaggctgccctcag

SEQ ID NO: 603799 - DNA, 25 bp, Mus musculus
ggatcctagtagtggctgccctcag

SEQ ID NO: 603800 - DNA, 25 bp, Mus musculus
ggatcctatcaaaggccgaagccat

SEQ ID NO: 603801 - DNA, 25 bp, Mus musculus
ggatcctatcaatggccgaagccat

SEQ ID NO: 603802 - DNA, 25 bp, Mus musculus
ggatcctatcatagctggtggccag

SEQ ID NO: 603803 - DNA, 25 bp, Mus musculus
ggatcctatcattgctggtggccag

SEQ ID NO: 603804 - DNA, 25 bp, Mus musculus
ggatcctatgatcaagcttagcctt

SEQ ID NO: 603805 - DNA, 25 bp, Mus musculus
ggatcctatgatgaagcttagcctt

SEQ ID NO: 603806 - DNA, 25 bp, Mus musculus
ggatcctatggtctgcaagtctaac

SEQ ID NO: 603807 - DNA, 25 bp, Mus musculus
ggatcctatggtgtgcaagtctaac

SEQ ID NO: 603808 - DNA, 25 bp, Mus musculus
ggatcctatgtgacggcttataccg

SEQ ID NO: 603809 - DNA, 25 bp, Mus musculus
ggatcctatgtgtcggcttataccg

SEQ ID NO: 603810 - DNA, 25 bp, Mus musculus
ggatcctcaaaactctactgggcac

SEQ ID NO: 603811 - DNA, 25 bp, Mus musculus
ggatcctcaaaagtctactgggcac

SEQ ID NO: 603812 - DNA, 25 bp, Mus musculus
ggatcctcaaccagctagaagccag

SEQ ID NO: 603813 - DNA, 25 bp, Mus musculus
ggatcctcaacctgctagaagccag

SEQ ID NO: 603814 - DNA, 25 bp, Mus musculus
ggatcctcaagtatgggtaccagtt

SEQ ID NO: 603815 - DNA, 25 bp, Mus musculus
ggatcctcaagtttgggtaccagtt

SEQ ID NO: 603816 - DNA, 25 bp, Mus musculus
ggatcctcacttatcagtgcgacgc

SEQ ID NO: 603817 - DNA, 25 bp, Mus musculus
ggatcctcacttttcagtgcgacgc

SEQ ID NO: 603818 - DNA, 25 bp, Mus musculus
ggatcctcagctcagatgctcagag

SEQ ID NO: 603819 - DNA, 25 bp, Mus musculus
ggatcctcagctgagatgctcagag

SEQ ID NO: 603820 - DNA, 25 bp, Mus musculus
ggatcctcagttatgaatagtatta

SEQ ID NO: 603821 - DNA, 25 bp, Mus musculus
ggatcctcagttttgaatagtatta

SEQ ID NO: 603822 - DNA, 25 bp, Mus musculus
ggatcctcattactttgagatcaat

SEQ ID NO: 603823 - DNA, 25 bp, Mus musculus
ggatcctcattagtttgagatcaat

SEQ ID NO: 603824 - DNA, 25 bp, Mus musculus
ggatcctccaatcctggaaggtgca

SEQ ID NO: 603825 - DNA, 25 bp, Mus musculus
ggatcctccaatgctggaaggtgca

SEQ ID NO: 603826 - DNA, 25 bp, Mus musculus
ggatcctccaccatgactgggaaaa

SEQ ID NO: 603827 - DNA, 25 bp, Mus musculus
ggatcctccaccttgactgggaaaa

SEQ ID NO: 603828 - DNA, 25 bp, Mus musculus
ggatcctccagcagagtggacacgg

SEQ ID NO: 603829 - DNA, 25 bp, Mus musculus
ggatcctccagctgagtggacacgg

SEQ ID NO: 603830 - DNA, 25 bp, Mus musculus
ggatcctccaggctcagaagtacta

SEQ ID NO: 603831 - DNA, 25 bp, Mus musculus
ggatcctccagggtcagaagtacta

SEQ ID NO: 603832 - DNA, 25 bp, Mus musculus
ggatcctcccaaatattaatgcatg

SEQ ID NO: 603833 - DNA, 25 bp, Mus musculus
ggatcctcccaattattaatgcatg

SEQ ID NO: 603834 - DNA, 25 bp, Mus musculus
ggatcctcccgtacagggagtattt

SEQ ID NO: 603835 - DNA, 25 bp, Mus musculus
ggatcctcccgttcagggagtattt

SEQ ID NO: 603836 - DNA, 25 bp, Mus musculus
ggatcctcctctccaggtggtggta

SEQ ID NO: 603837 - DNA, 25 bp, Mus musculus
ggatcctcctctgcaggtggtggta

SEQ ID NO: 603838 - DNA, 25 bp, Mus musculus
ggatcctcctgccaaagaaagctct

SEQ ID NO: 603839 - DNA, 25 bp, Mus musculus
ggatcctcctgcgaaagaaagctct

SEQ ID NO: 603840 - DNA, 25 bp, Mus musculus
ggatcctctcgaatgaagcctgtgt

SEQ ID NO: 603841 - DNA, 25 bp, Mus musculus
ggatcctctcgattgaagcctgtgt

SEQ ID NO: 603842 - DNA, 25 bp, Mus musculus
ggatcctctctgcagccacagctaa

SEQ ID NO: 603843 - DNA, 25 bp, Mus musculus
ggatcctctctggagccacagctaa

SEQ ID NO: 603844 - DNA, 25 bp, Mus musculus
ggatcctctgtaaggctggtagata

SEQ ID NO: 603845 - DNA, 25 bp, Mus musculus
ggatcctctgtatggctggtagata

SEQ ID NO: 603846 - DNA, 25 bp, Mus musculus
ggatcctcttcaagccaaatagcaa

SEQ ID NO: 603847 - DNA, 25 bp, Mus musculus
ggatcctcttcatgccaaatagcaa

SEQ ID NO: 603848 - DNA, 25 bp, Mus musculus
ggatcctgaaacagactcgctggac

SEQ ID NO: 603849 - DNA, 25 bp, Mus musculus
ggatcctgaaactgactcgctggac

SEQ ID NO: 603850 - DNA, 25 bp, Mus musculus
ggatcctgaacgctagaggccaagc

SEQ ID NO: 603851 - DNA, 25 bp, Mus musculus
ggatcctgaacggtagaggccaagc

SEQ ID NO: 603852 - DNA, 25 bp, Mus musculus
ggatcctgaagtattttcccagcct

SEQ ID NO: 603853 - DNA, 25 bp, Mus musculus
ggatcctgaagttttttcccagcct

SEQ ID NO: 603854 - DNA, 25 bp, Mus musculus
ggatcctgacttaaaattgagacac

SEQ ID NO: 603855 - DNA, 25 bp, Mus musculus
ggatcctgacttacagactaagaac

SEQ ID NO: 603856 - DNA, 25 bp, Mus musculus
ggatcctgactttaaattgagacac

SEQ ID NO: 603857 - DNA, 25 bp, Mus musculus
ggatcctgactttcagactaagaac

SEQ ID NO: 603858 - DNA, 25 bp, Mus musculus
ggatcctgagatcaaccactttcct

SEQ ID NO: 603859 - DNA, 25 bp, Mus musculus
ggatcctgagatgaaccactttcct

SEQ ID NO: 603860 - DNA, 25 bp, Mus musculus
ggatcctgagccacgggcttagagt

SEQ ID NO: 603861 - DNA, 25 bp, Mus musculus
ggatcctgagcctcgggcttagagt

SEQ ID NO: 603862 - DNA, 25 bp, Mus musculus
ggatcctgatgcagatgtgtgtatt

SEQ ID NO: 603863 - DNA, 25 bp, Mus musculus
ggatcctgatgctgatgtgtgtatt

SEQ ID NO: 603864 - DNA, 25 bp, Mus musculus
ggatcctgatttcggctctcaactg

SEQ ID NO: 603865 - DNA, 25 bp, Mus musculus
ggatcctgatttgggctctcaactg

SEQ ID NO: 603866 - DNA, 25 bp, Mus musculus
ggatcctgcaagattctcagggaca

SEQ ID NO: 603867 - DNA, 25 bp, Mus musculus
ggatcctgcaagtttctcagggaca

SEQ ID NO: 603868 - DNA, 25 bp, Mus musculus
ggatcctgcagtagcacttgcttta

SEQ ID NO: 603869 - DNA, 25 bp, Mus musculus
ggatcctgcagttgcacttgcttta

SEQ ID NO: 603870 - DNA, 25 bp, Mus musculus
ggatcctgcatcagaccttgtctat

SEQ ID NO: 603871 - DNA, 25 bp, Mus musculus
ggatcctgcatctgaccttgtctat

SEQ ID NO: 603872 - DNA, 25 bp, Mus musculus
ggatcctgccagagtaagatgtcaa

SEQ ID NO: 603873 - DNA, 25 bp, Mus musculus
ggatcctgccagtgtaagatgtcaa

SEQ ID NO: 603874 - DNA, 25 bp, Mus musculus
ggatcctgctccctaggatggtgaa

SEQ ID NO: 603875 - DNA, 25 bp, Mus musculus
ggatcctgctccgtaggatggtgaa

SEQ ID NO: 603876 - DNA, 25 bp, Mus musculus
ggatcctggaaaactcttctcggga

SEQ ID NO: 603877 - DNA, 25 bp, Mus musculus
ggatcctggaaatctcttctcggga

SEQ ID NO: 603878 - DNA, 25 bp, Mus musculus
ggatcctggataagctagtcccttc

SEQ ID NO: 603879 - DNA, 25 bp, Mus musculus
ggatcctggatacttatggctggct

SEQ ID NO: 603880 - DNA, 25 bp, Mus musculus
ggatcctggatagttatggctggct

SEQ ID NO: 603881 - DNA, 25 bp, Mus musculus
ggatcctggatatgctagtcccttc

SEQ ID NO: 603882 - DNA, 25 bp, Mus musculus
ggatcctggatgctaggaacccata

SEQ ID NO: 603883 - DNA, 25 bp, Mus musculus
ggatcctggatggtaggaacccata

SEQ ID NO: 603884 - DNA, 25 bp, Mus musculus
ggatcctggcacacaaactgacaat

SEQ ID NO: 603885 - DNA, 25 bp, Mus musculus
ggatcctggcactcaaactgacaat

SEQ ID NO: 603886 - DNA, 25 bp, Mus musculus
ggatcctggcgcagtccggcagttt

SEQ ID NO: 603887 - DNA, 25 bp, Mus musculus
ggatcctggcgctgtccggcagttt

SEQ ID NO: 603888 - DNA, 25 bp, Mus musculus
ggatcctgtactaggcaactgtagc

SEQ ID NO: 603889 - DNA, 25 bp, Mus musculus
ggatcctgtacttggcaactgtagc

SEQ ID NO: 603890 - DNA, 25 bp, Mus musculus
ggatcctgtcggagttaaactgttt

SEQ ID NO: 603891 - DNA, 25 bp, Mus musculus
ggatcctgtcggtgttaaactgttt

SEQ ID NO: 603892 - DNA, 25 bp, Mus musculus
ggatcctgtggcactcaggtgtaaa

SEQ ID NO: 603893 - DNA, 25 bp, Mus musculus
ggatcctgtggctctcaggtgtaaa

SEQ ID NO: 603894 - DNA, 25 bp, Mus musculus
ggatccttaaccagtacacatatag

SEQ ID NO: 603895 - DNA, 25 bp, Mus musculus
ggatccttaacctgtacacatatag

SEQ ID NO: 603896 - DNA, 25 bp, Mus musculus
ggatccttaatcagatggtctcttc

SEQ ID NO: 603897 - DNA, 25 bp, Mus musculus
ggatccttaatctgatggtctcttc

SEQ ID NO: 603898 - DNA, 25 bp, Mus musculus
ggatccttatgccaattcagctact

SEQ ID NO: 603899 - DNA, 25 bp, Mus musculus
ggatccttatgccttttctgtagga

SEQ ID NO: 603900 - DNA, 25 bp, Mus musculus
ggatccttatgcgaattcagctact

SEQ ID NO: 603901 - DNA, 25 bp, Mus musculus
ggatccttatgcgttttctgtagga

SEQ ID NO: 603902 - DNA, 25 bp, Mus musculus
ggatccttcaaaactgtcttgcctt

SEQ ID NO: 603903 - DNA, 25 bp, Mus musculus
ggatccttcaaatctgtcttgcctt

SEQ ID NO: 603904 - DNA, 25 bp, Mus musculus
ggatccttcactcatggagatgttt

SEQ ID NO: 603905 - DNA, 25 bp, Mus musculus
ggatccttcactgatggagatgttt

SEQ ID NO: 603906 - DNA, 25 bp, Mus musculus
ggatccttcagaaagtggacagaca

SEQ ID NO: 603907 - DNA, 25 bp, Mus musculus
ggatccttcagatagtggacagaca

SEQ ID NO: 603908 - DNA, 25 bp, Mus musculus
ggatccttccagaaaccacagggca

SEQ ID NO: 603909 - DNA, 25 bp, Mus musculus
ggatccttccagtaaccacagggca

SEQ ID NO: 603910 - DNA, 25 bp, Mus musculus
ggatccttcctacagtggaatgtca

SEQ ID NO: 603911 - DNA, 25 bp, Mus musculus
ggatccttcctagagtggaatgtca

SEQ ID NO: 603912 - DNA, 25 bp, Mus musculus
ggatccttcgaaacctgaagattat

SEQ ID NO: 603913 - DNA, 25 bp, Mus musculus
ggatccttcgaatcctgaagattat

SEQ ID NO: 603914 - DNA, 25 bp, Mus musculus
ggatccttctcaagggtccacgggc

SEQ ID NO: 603915 - DNA, 25 bp, Mus musculus
ggatccttctcatgggtccacgggc

SEQ ID NO: 603916 - DNA, 25 bp, Mus musculus
ggatccttctctaccctgaatggag

SEQ ID NO: 603917 - DNA, 25 bp, Mus musculus
ggatccttctcttccctgaatggag

SEQ ID NO: 603918 - DNA, 25 bp, Mus musculus
ggatccttcttgactcaatgacgtg

SEQ ID NO: 603919 - DNA, 25 bp, Mus musculus
ggatccttcttgtctcaatgacgtg

SEQ ID NO: 603920 - DNA, 25 bp, Mus musculus
ggatccttgggacaagccactacgg

SEQ ID NO: 603921 - DNA, 25 bp, Mus musculus
ggatccttgggagaagccactacgg

SEQ ID NO: 603922 - DNA, 25 bp, Mus musculus
ggatcctttcagagtgagctccaaa

SEQ ID NO: 603923 - DNA, 25 bp, Mus musculus
ggatcctttcagtgtgagctccaaa

SEQ ID NO: 603924 - DNA, 25 bp, Mus musculus
ggatcctttgagctgctatttagga

SEQ ID NO: 603925 - DNA, 25 bp, Mus musculus
ggatcctttgaggtgctatttagga

SEQ ID NO: 603926 - DNA, 25 bp, Mus musculus
ggatcgaaatacaacctctatacat

SEQ ID NO: 603927 - DNA, 25 bp, Mus musculus
ggatcgaaatactacctctatacat

SEQ ID NO: 603928 - DNA, 25 bp, Mus musculus
ggatcgaaattcaaggcaagcctgt

SEQ ID NO: 603929 - DNA, 25 bp, Mus musculus
ggatcgaaattctaggcaagcctgt

SEQ ID NO: 603930 - DNA, 25 bp, Mus musculus
ggatcgaagaaactcacacgtgaat

SEQ ID NO: 603931 - DNA, 25 bp, Mus musculus
ggatcgaagaaagtcacacgtgaat

SEQ ID NO: 603932 - DNA, 25 bp, Mus musculus
ggatcgaagacacaacctgctggat

SEQ ID NO: 603933 - DNA, 25 bp, Mus musculus
ggatcgaagacagaacctgctggat

SEQ ID NO: 603934 - DNA, 25 bp, Mus musculus
ggatcgaatgcgatgggaacccctt

SEQ ID NO: 603935 - DNA, 25 bp, Mus musculus
ggatcgaatgcgttgggaacccctt

SEQ ID NO: 603936 - DNA, 25 bp, Mus musculus
ggatcgacacggacctcagcaaagt

SEQ ID NO: 603937 - DNA, 25 bp, Mus musculus
ggatcgacacggtcctcagcaaagt

SEQ ID NO: 603938 - DNA, 25 bp, Mus musculus
ggatcgacactgctggtctgcgaat

SEQ ID NO: 603939 - DNA, 25 bp, Mus musculus
ggatcgacactggtggtctgcgaat

SEQ ID NO: 603940 - DNA, 25 bp, Mus musculus
ggatcgacagtgatatcccacacat

SEQ ID NO: 603941 - DNA, 25 bp, Mus musculus
ggatcgacagtgttatcccacacat

SEQ ID NO: 603942 - DNA, 25 bp, Mus musculus
ggatcgacatccatcgtttgctcct

SEQ ID NO: 603943 - DNA, 25 bp, Mus musculus
ggatcgacatccttcgtttgctcct

SEQ ID NO: 603944 - DNA, 25 bp, Mus musculus
ggatcgacatctccaataggctctc

SEQ ID NO: 603945 - DNA, 25 bp, Mus musculus
ggatcgacatctgcaataggctctc

SEQ ID NO: 603946 - DNA, 25 bp, Mus musculus
ggatcgaccaatcttttcttaatgt

SEQ ID NO: 603947 - DNA, 25 bp, Mus musculus
ggatcgaccaatgttttcttaatgt

SEQ ID NO: 603948 - DNA, 25 bp, Mus musculus
ggatcgactttaaattctgatgtat

SEQ ID NO: 603949 - DNA, 25 bp, Mus musculus
ggatcgactttatattctgatgtat

SEQ ID NO: 603950 - DNA, 25 bp, Mus musculus
ggatcgagaccaagacctgaccaag

SEQ ID NO: 603951 - DNA, 25 bp, Mus musculus
ggatcgagaccatgacctgaccaag

SEQ ID NO: 603952 - DNA, 25 bp, Mus musculus
ggatcgagcgtacattcagaactct

SEQ ID NO: 603953 - DNA, 25 bp, Mus musculus
ggatcgagcgtagattcagaactct

SEQ ID NO: 603954 - DNA, 25 bp, Mus musculus
ggatcgatcacaatcgttcatcaag

SEQ ID NO: 603955 - DNA, 25 bp, Mus musculus
ggatcgatcacactggacctgttgt

SEQ ID NO: 603956 - DNA, 25 bp, Mus musculus
ggatcgatcacagtggacctgttgt

SEQ ID NO: 603957 - DNA, 25 bp, Mus musculus
ggatcgatcacattcgttcatcaag

SEQ ID NO: 603958 - DNA, 25 bp, Mus musculus
ggatcgatcactacttctgtgaact

SEQ ID NO: 603959 - DNA, 25 bp, Mus musculus
ggatcgatcacttcttctgtgaact

SEQ ID NO: 603960 - DNA, 25 bp, Mus musculus
ggatcgatcgctcgtggacctgaca

SEQ ID NO: 603961 - DNA, 25 bp, Mus musculus
ggatcgatcgctggtggacctgaca

SEQ ID NO: 603962 - DNA, 25 bp, Mus musculus
ggatcgatgaacactctgcccggga

SEQ ID NO: 603963 - DNA, 25 bp, Mus musculus
ggatcgatgaactctctgcccggga

SEQ ID NO: 603964 - DNA, 25 bp, Mus musculus
ggatcgatgctgatgattgttgaaa

SEQ ID NO: 603965 - DNA, 25 bp, Mus musculus
ggatcgatgctgttgattgttgaaa

SEQ ID NO: 603966 - DNA, 25 bp, Mus musculus
ggatcgattccacatgaggatccac

SEQ ID NO: 603967 - DNA, 25 bp, Mus musculus
ggatcgattccagatgaggatccac

SEQ ID NO: 603968 - DNA, 25 bp, Mus musculus
ggatcgcagaaccagggcatctccc

SEQ ID NO: 603969 - DNA, 25 bp, Mus musculus
ggatcgcagaaccagggcatctgcc

SEQ ID NO: 603970 - DNA, 25 bp, Mus musculus
ggatcgcagaacgagggcatctccc

SEQ ID NO: 603971 - DNA, 25 bp, Mus musculus
ggatcgcagaacgagggcatctgcc

SEQ ID NO: 603972 - DNA, 25 bp, Mus musculus
ggatcgcaggaaaaccctgttggca

SEQ ID NO: 603973 - DNA, 25 bp, Mus musculus
ggatcgcaggaataccctgttggca

SEQ ID NO: 603974 - DNA, 25 bp, Mus musculus
ggatcgcccctgaagctctacttca

SEQ ID NO: 603975 - DNA, 25 bp, Mus musculus
ggatcgcccctgtagctctacttca

SEQ ID NO: 603976 - DNA, 25 bp, Mus musculus
ggatcgcgcatcacatctgaataaa

SEQ ID NO: 603977 - DNA, 25 bp, Mus musculus
ggatcgcgcatctcatctgaataaa

SEQ ID NO: 603978 - DNA, 25 bp, Mus musculus
ggatcgcggaacacaagcagtttct

SEQ ID NO: 603979 - DNA, 25 bp, Mus musculus
ggatcgcggaactcaagcagtttct

SEQ ID NO: 603980 - DNA, 25 bp, Mus musculus
ggatcgcggttgcttaactgcctga

SEQ ID NO: 603981 - DNA, 25 bp, Mus musculus
ggatcgcggttggttaactgcctga

SEQ ID NO: 603982 - DNA, 25 bp, Mus musculus
ggatcgcgttgcagagactcaggtc

SEQ ID NO: 603983 - DNA, 25 bp, Mus musculus
ggatcgcgttgctgagactcaggtc

SEQ ID NO: 603984 - DNA, 25 bp, Mus musculus
ggatcgctattacaattcctcgtgc

SEQ ID NO: 603985 - DNA, 25 bp, Mus musculus
ggatcgctattagaattcctcgtgc

SEQ ID NO: 603986 - DNA, 25 bp, Mus musculus
ggatcgctcagtatacacagagtct

SEQ ID NO: 603987 - DNA, 25 bp, Mus musculus
ggatcgctcagtttacacagagtct

SEQ ID NO: 603988 - DNA, 25 bp, Mus musculus
ggatcgctcgacagacattgtgaaa

SEQ ID NO: 603989 - DNA, 25 bp, Mus musculus
ggatcgctcgactgacattgtgaaa

SEQ ID NO: 603990 - DNA, 25 bp, Mus musculus
ggatcgctgatccagaagagagttc

SEQ ID NO: 603991 - DNA, 25 bp, Mus musculus
ggatcgctgatcgagaagagagttc

SEQ ID NO: 603992 - DNA, 25 bp, Mus musculus
ggatcggaacctaccatgtttatca

SEQ ID NO: 603993 - DNA, 25 bp, Mus musculus
ggatcggaaccttccatgtttatca

SEQ ID NO: 603994 - DNA, 25 bp, Mus musculus
ggatcggaagtgaaggaaacagcta

SEQ ID NO: 603995 - DNA, 25 bp, Mus musculus
ggatcggaagtgtaggaaacagcta

SEQ ID NO: 603996 - DNA, 25 bp, Mus musculus
ggatcgggacgtccaattactattg

SEQ ID NO: 603997 - DNA, 25 bp, Mus musculus
ggatcgggacgtgcaattactattg

SEQ ID NO: 603998 - DNA, 25 bp, Mus musculus
ggatcgggcgcgctactcagccttt

SEQ ID NO: 603999 - DNA, 25 bp, Mus musculus
ggatcgggcgcggtactcagccttt

SEQ ID NO: 604000 - DNA, 25 bp, Mus musculus
ggatcggtcccacagcaatggctca

SEQ ID NO: 604001 - DNA, 25 bp, Mus musculus
ggatcggtcccagagcaatggctca

SEQ ID NO: 604002 - DNA, 25 bp, Mus musculus
ggatcgtagaacatactccttctct

SEQ ID NO: 604003 - DNA, 25 bp, Mus musculus
ggatcgtagaacttactccttctct

SEQ ID NO: 604004 - DNA, 25 bp, Mus musculus
ggatcgtcccagaatgggtcacata

SEQ ID NO: 604005 - DNA, 25 bp, Mus musculus
ggatcgtcccagtatgggtcacata

SEQ ID NO: 604006 - DNA, 25 bp, Mus musculus
ggatcgtcctacaacacgctttcaa

SEQ ID NO: 604007 - DNA, 25 bp, Mus musculus
ggatcgtcctactacacgctttcaa

SEQ ID NO: 604008 - DNA, 25 bp, Mus musculus
ggatcgtctcaaagatcttccgttt

SEQ ID NO: 604009 - DNA, 25 bp, Mus musculus
ggatcgtctcaatgatcttccgttt

SEQ ID NO: 604010 - DNA, 25 bp, Mus musculus
ggatcgtctcctccatcataatgat

SEQ ID NO: 604011 - DNA, 25 bp, Mus musculus
ggatcgtctcctgcatcataatgat

SEQ ID NO: 604012 - DNA, 25 bp, Mus musculus
ggatcgtgcttgcttttctgagaat

SEQ ID NO: 604013 - DNA, 25 bp, Mus musculus
ggatcgtgcttggttttctgagaat

SEQ ID NO: 604014 - DNA, 25 bp, Mus musculus
ggatcgtggagcagctgggtcagct

SEQ ID NO: 604015 - DNA, 25 bp, Mus musculus
ggatcgtggagctgctgggtcagct

SEQ ID NO: 604016 - DNA, 25 bp, Mus musculus
ggatcgttcccacatcaatcctgaa

SEQ ID NO: 604017 - DNA, 25 bp, Mus musculus
ggatcgttcccagatcaatcctgaa

SEQ ID NO: 604018 - DNA, 25 bp, Mus musculus
ggatcgttcgaaagagcctctgtgg

SEQ ID NO: 604019 - DNA, 25 bp, Mus musculus
ggatcgttcgaatgagcctctgtgg

SEQ ID NO: 604020 - DNA, 25 bp, Mus musculus
ggatcgttttccaagccacaagaca

SEQ ID NO: 604021 - DNA, 25 bp, Mus musculus
ggatcgttttcctagccacaagaca

SEQ ID NO: 604022 - DNA, 25 bp, Mus musculus
ggatctaaagccaacaaccaccaag

SEQ ID NO: 604023 - DNA, 25 bp, Mus musculus
ggatctaaagcctacaaccaccaag

SEQ ID NO: 604024 - DNA, 25 bp, Mus musculus
ggatctaaataacccctctgtcatc

SEQ ID NO: 604025 - DNA, 25 bp, Mus musculus
ggatctaaataagccctctgtcatc

SEQ ID NO: 604026 - DNA, 25 bp, Mus musculus
ggatctaacacaaccaacacaattt

SEQ ID NO: 604027 - DNA, 25 bp, Mus musculus
ggatctaacacatccaacacaattt

SEQ ID NO: 604028 - DNA, 25 bp, Mus musculus
ggatctaagttaagtctttcagcaa

SEQ ID NO: 604029 - DNA, 25 bp, Mus musculus
ggatctaagttatgtctttcagcaa

SEQ ID NO: 604030 - DNA, 25 bp, Mus musculus
ggatctaataggacttctgtttgga

SEQ ID NO: 604031 - DNA, 25 bp, Mus musculus
ggatctaataggtcttctgtttgga

SEQ ID NO: 604032 - DNA, 25 bp, Mus musculus
ggatctaatcttattaaatggcaca

SEQ ID NO: 604033 - DNA, 25 bp, Mus musculus
ggatctaatctttttaaatggcaca

SEQ ID NO: 604034 - DNA, 25 bp, Mus musculus
ggatctaatgacaggtaagtgctaa

SEQ ID NO: 604035 - DNA, 25 bp, Mus musculus
ggatctaatgactggtaagtgctaa

SEQ ID NO: 604036 - DNA, 25 bp, Mus musculus
ggatctaattccctgtgtgttacga

SEQ ID NO: 604037 - DNA, 25 bp, Mus musculus
ggatctaattccgtgtgtgttacga

SEQ ID NO: 604038 - DNA, 25 bp, Mus musculus
ggatctacaacaccagccagcagtg

SEQ ID NO: 604039 - DNA, 25 bp, Mus musculus
ggatctacaacagcagccagcagtg

SEQ ID NO: 604040 - DNA, 25 bp, Mus musculus
ggatctacaattatcccatgtgtgc

SEQ ID NO: 604041 - DNA, 25 bp, Mus musculus
ggatctacaattttcccatgtgtgc

SEQ ID NO: 604042 - DNA, 25 bp, Mus musculus
ggatctacacacaccagagcgatgt

SEQ ID NO: 604043 - DNA, 25 bp, Mus musculus
ggatctacacactccagagcgatgt

SEQ ID NO: 604044 - DNA, 25 bp, Mus musculus
ggatctacacgcaatgtggcagaga

SEQ ID NO: 604045 - DNA, 25 bp, Mus musculus
ggatctacacgctatgtggcagaga

SEQ ID NO: 604046 - DNA, 25 bp, Mus musculus
ggatctacacttatcatgcacatgg

SEQ ID NO: 604047 - DNA, 25 bp, Mus musculus
ggatctacacttttcatgcacatgg

SEQ ID NO: 604048 - DNA, 25 bp, Mus musculus
ggatctacagacacccgagaaggat

SEQ ID NO: 604049 - DNA, 25 bp, Mus musculus
ggatctacagactcccgagaaggat

SEQ ID NO: 604050 - DNA, 25 bp, Mus musculus
ggatctacagcaacagcccctcacc

SEQ ID NO: 604051 - DNA, 25 bp, Mus musculus
ggatctacagcatcagcccctcacc

SEQ ID NO: 604052 - DNA, 25 bp, Mus musculus
ggatctaccacacttctgtgaaagc

SEQ ID NO: 604053 - DNA, 25 bp, Mus musculus
ggatctaccacagttctgtgaaagc

SEQ ID NO: 604054 - DNA, 25 bp, Mus musculus
ggatctaccagcaaatgagggcgaa

SEQ ID NO: 604055 - DNA, 25 bp, Mus musculus
ggatctaccagctaatgagggcgaa

SEQ ID NO: 604056 - DNA, 25 bp, Mus musculus
ggatctaccctgcttcactggatga

SEQ ID NO: 604057 - DNA, 25 bp, Mus musculus
ggatctaccctggttcactggatga

SEQ ID NO: 604058 - DNA, 25 bp, Mus musculus
ggatctaccgaaagtgaccatctgc

SEQ ID NO: 604059 - DNA, 25 bp, Mus musculus
ggatctaccgaatgtgaccatctgc

SEQ ID NO: 604060 - DNA, 25 bp, Mus musculus
ggatctacgaaaaagatgacttcag

SEQ ID NO: 604061 - DNA, 25 bp, Mus musculus
ggatctacgaaatagatgacttcag

SEQ ID NO: 604062 - DNA, 25 bp, Mus musculus
ggatctactgatatccatctctcca

SEQ ID NO: 604063 - DNA, 25 bp, Mus musculus
ggatctactgatcggcaggttacca

SEQ ID NO: 604064 - DNA, 25 bp, Mus musculus
ggatctactgatgggcaggttacca

SEQ ID NO: 604065 - DNA, 25 bp, Mus musculus
ggatctactgatttccatctctcca

SEQ ID NO: 604066 - DNA, 25 bp, Mus musculus
ggatctagactacacttgggtgacc

SEQ ID NO: 604067 - DNA, 25 bp, Mus musculus
ggatctagactactcctttctgaga

SEQ ID NO: 604068 - DNA, 25 bp, Mus musculus
ggatctagactagacttgggtgacc

SEQ ID NO: 604069 - DNA, 25 bp, Mus musculus
ggatctagactagtcctttctgaga

SEQ ID NO: 604070 - DNA, 25 bp, Mus musculus
ggatctagatcccagcgaagcctat

SEQ ID NO: 604071 - DNA, 25 bp, Mus musculus
ggatctagatccgagcgaagcctat

SEQ ID NO: 604072 - DNA, 25 bp, Mus musculus
ggatctagcctcagttaccaacagt

SEQ ID NO: 604073 - DNA, 25 bp, Mus musculus
ggatctagcctctgttaccaacagt

SEQ ID NO: 604074 - DNA, 25 bp, Mus musculus
ggatctagcctgactgatacgcagt

SEQ ID NO: 604075 - DNA, 25 bp, Mus musculus
ggatctagcctgtctgatacgcagt

SEQ ID NO: 604076 - DNA, 25 bp, Mus musculus
ggatctagctagatatttttgttgt

SEQ ID NO: 604077 - DNA, 25 bp, Mus musculus
ggatctagctagttatttttgttgt

SEQ ID NO: 604078 - DNA, 25 bp, Mus musculus
ggatctagcttcaagactgtgttct

SEQ ID NO: 604079 - DNA, 25 bp, Mus musculus
ggatctagcttctagactgtgttct

SEQ ID NO: 604080 - DNA, 25 bp, Mus musculus
ggatctagtaccctcagaactgttt

SEQ ID NO: 604081 - DNA, 25 bp, Mus musculus
ggatctagtaccgtcagaactgttt

SEQ ID NO: 604082 - DNA, 25 bp, Mus musculus
ggatctagtcccagatttgagtaac

SEQ ID NO: 604083 - DNA, 25 bp, Mus musculus
ggatctagtccctgatttgagtaac

SEQ ID NO: 604084 - DNA, 25 bp, Mus musculus
ggatctagtgtcacctggtccaagg

SEQ ID NO: 604085 - DNA, 25 bp, Mus musculus
ggatctagtgtctcctggtccaagg

SEQ ID NO: 604086 - DNA, 25 bp, Mus musculus
ggatctataaggactacatccggga

SEQ ID NO: 604087 - DNA, 25 bp, Mus musculus
ggatctataaggtctacatccggga

SEQ ID NO: 604088 - DNA, 25 bp, Mus musculus
ggatctatataaccaatgagttgat

SEQ ID NO: 604089 - DNA, 25 bp, Mus musculus
ggatctatataagcaatgagttgat

SEQ ID NO: 604090 - DNA, 25 bp, Mus musculus
ggatctatatctcttctgctgagct

SEQ ID NO: 604091 - DNA, 25 bp, Mus musculus
ggatctatatctgttctgctgagct

SEQ ID NO: 604092 - DNA, 25 bp, Mus musculus
ggatctatcaccactcttaaaactg

SEQ ID NO: 604093 - DNA, 25 bp, Mus musculus
ggatctatcacctctcttaaaactg

SEQ ID NO: 604094 - DNA, 25 bp, Mus musculus
ggatctatcagcaccaggaacacat

SEQ ID NO: 604095 - DNA, 25 bp, Mus musculus
ggatctatcagctccaggaacacat

SEQ ID NO: 604096 - DNA, 25 bp, Mus musculus
ggatctatctatcaaagcttgctgc

SEQ ID NO: 604097 - DNA, 25 bp, Mus musculus
ggatctatctatgaaagcttgctgc

SEQ ID NO: 604098 - DNA, 25 bp, Mus musculus
ggatctatgaatatttgacctacgt

SEQ ID NO: 604099 - DNA, 25 bp, Mus musculus
ggatctatgaatttttgacctacgt

SEQ ID NO: 604100 - DNA, 25 bp, Mus musculus
ggatctatgactctctgtggctgac

SEQ ID NO: 604101 - DNA, 25 bp, Mus musculus
ggatctatgactgtctgtggctgac

SEQ ID NO: 604102 - DNA, 25 bp, Mus musculus
ggatctatggaactacaagctcatt

SEQ ID NO: 604103 - DNA, 25 bp, Mus musculus
ggatctatggaagtacaagctcatt

SEQ ID NO: 604104 - DNA, 25 bp, Mus musculus
ggatctatgtatcttggacactgat

SEQ ID NO: 604105 - DNA, 25 bp, Mus musculus
ggatctatgtatgttggacactgat

SEQ ID NO: 604106 - DNA, 25 bp, Mus musculus
ggatctcaaaaacattcaggctggt

SEQ ID NO: 604107 - DNA, 25 bp, Mus musculus
ggatctcaaaaagattcaggctggt

SEQ ID NO: 604108 - DNA, 25 bp, Mus musculus
ggatctcaaagcactctgagttcat

SEQ ID NO: 604109 - DNA, 25 bp, Mus musculus
ggatctcaaagcatattttgtagga

SEQ ID NO: 604110 - DNA, 25 bp, Mus musculus
ggatctcaaagctctctgagttcat

SEQ ID NO: 604111 - DNA, 25 bp, Mus musculus
ggatctcaaagcttattttgtagga

SEQ ID NO: 604112 - DNA, 25 bp, Mus musculus
ggatctcaaccaagttcgtattcta

SEQ ID NO: 604113 - DNA, 25 bp, Mus musculus
ggatctcaaccatgttcgtattcta

SEQ ID NO: 604114 - DNA, 25 bp, Mus musculus
ggatctcaagagctttttatgacag

SEQ ID NO: 604115 - DNA, 25 bp, Mus musculus
ggatctcaagaggtttttatgacag

SEQ ID NO: 604116 - DNA, 25 bp, Mus musculus
ggatctcaatgccttgacatcttct

SEQ ID NO: 604117 - DNA, 25 bp, Mus musculus
ggatctcaatgcgttgacatcttct

SEQ ID NO: 604118 - DNA, 25 bp, Mus musculus
ggatctcaccgtagagggctttcag

SEQ ID NO: 604119 - DNA, 25 bp, Mus musculus
ggatctcaccgttgagggctttcag

SEQ ID NO: 604120 - DNA, 25 bp, Mus musculus
ggatctcactgccagactttatgaa

SEQ ID NO: 604121 - DNA, 25 bp, Mus musculus
ggatctcactgcgagactttatgaa

SEQ ID NO: 604122 - DNA, 25 bp, Mus musculus
ggatctcacttcagcacttggtaaa

SEQ ID NO: 604123 - DNA, 25 bp, Mus musculus
ggatctcacttccatcacaatgtac

SEQ ID NO: 604124 - DNA, 25 bp, Mus musculus
ggatctcacttcgatcacaatgtac

SEQ ID NO: 604125 - DNA, 25 bp, Mus musculus
ggatctcacttctgcacttggtaaa

SEQ ID NO: 604126 - DNA, 25 bp, Mus musculus
ggatctcaggcgaagggtgcacccc

SEQ ID NO: 604127 - DNA, 25 bp, Mus musculus
ggatctcaggcgtagggtgcacccc

SEQ ID NO: 604128 - DNA, 25 bp, Mus musculus
ggatctcagggccaggaactcagct

SEQ ID NO: 604129 - DNA, 25 bp, Mus musculus
ggatctcagggcgaggaactcagct

SEQ ID NO: 604130 - DNA, 25 bp, Mus musculus
ggatctcagtgtaacttttgagcta

SEQ ID NO: 604131 - DNA, 25 bp, Mus musculus
ggatctcagtgttacttttgagcta

SEQ ID NO: 604132 - DNA, 25 bp, Mus musculus
ggatctcatctgatttcatggaggg

SEQ ID NO: 604133 - DNA, 25 bp, Mus musculus
ggatctcatctgctgtggtgccatc

SEQ ID NO: 604134 - DNA, 25 bp, Mus musculus
ggatctcatctggtgtggtgccatc

SEQ ID NO: 604135 - DNA, 25 bp, Mus musculus
ggatctcatctgttttcatggaggg

SEQ ID NO: 604136 - DNA, 25 bp, Mus musculus
ggatctcatcttccaggacttctgt

SEQ ID NO: 604137 - DNA, 25 bp, Mus musculus
ggatctcatcttgcaggacttctgt

SEQ ID NO: 604138 - DNA, 25 bp, Mus musculus
ggatctcattccataatgcttttga

SEQ ID NO: 604139 - DNA, 25 bp, Mus musculus
ggatctcattcccagactaccgaga

SEQ ID NO: 604140 - DNA, 25 bp, Mus musculus
ggatctcattccgagactaccgaga

SEQ ID NO: 604141 - DNA, 25 bp, Mus musculus
ggatctcattccttaatgcttttga

SEQ ID NO: 604142 - DNA, 25 bp, Mus musculus
ggatctccaactccatgccagagta

SEQ ID NO: 604143 - DNA, 25 bp, Mus musculus
ggatctccaactgcatgccagagta

SEQ ID NO: 604144 - DNA, 25 bp, Mus musculus
ggatctccaccaaagagtagtgtat

SEQ ID NO: 604145 - DNA, 25 bp, Mus musculus
ggatctccaccatagagtagtgtat

SEQ ID NO: 604146 - DNA, 25 bp, Mus musculus
ggatctccacggcttagttaccgct

SEQ ID NO: 604147 - DNA, 25 bp, Mus musculus
ggatctccacgggttagttaccgct

SEQ ID NO: 604148 - DNA, 25 bp, Mus musculus
ggatctccatatctaattgtccaga

SEQ ID NO: 604149 - DNA, 25 bp, Mus musculus
ggatctccatatgtaattgtccaga

SEQ ID NO: 604150 - DNA, 25 bp, Mus musculus
ggatctccatgcacttgagaggcaa

SEQ ID NO: 604151 - DNA, 25 bp, Mus musculus
ggatctccatgctcttgagaggcaa

SEQ ID NO: 604152 - DNA, 25 bp, Mus musculus
ggatctccatgtaacttgggacagt

SEQ ID NO: 604153 - DNA, 25 bp, Mus musculus
ggatctccatgttacttgggacagt

SEQ ID NO: 604154 - DNA, 25 bp, Mus musculus
ggatctccccagctcacacagtagg

SEQ ID NO: 604155 - DNA, 25 bp, Mus musculus
ggatctccccaggtcacacagtagg

SEQ ID NO: 604156 - DNA, 25 bp, Mus musculus
ggatctccgagaaatcagcaagcca

SEQ ID NO: 604157 - DNA, 25 bp, Mus musculus
ggatctccgagatatcagcaagcca

SEQ ID NO: 604158 - DNA, 25 bp, Mus musculus
ggatctccggacattgggtcagtta

SEQ ID NO: 604159 - DNA, 25 bp, Mus musculus
ggatctccggactttgggtcagtta

SEQ ID NO: 604160 - DNA, 25 bp, Mus musculus
ggatctcctaaaaatttaaggtgat

SEQ ID NO: 604161 - DNA, 25 bp, Mus musculus
ggatctcctaaatatttaaggtgat

SEQ ID NO: 604162 - DNA, 25 bp, Mus musculus
ggatctcctcacactggtaatgtct

SEQ ID NO: 604163 - DNA, 25 bp, Mus musculus
ggatctcctcactctggtaatgtct

SEQ ID NO: 604164 - DNA, 25 bp, Mus musculus
ggatctcctccgcggcaccgcccag

SEQ ID NO: 604165 - DNA, 25 bp, Mus musculus
ggatctcctccggggcaccgcccag

SEQ ID NO: 604166 - DNA, 25 bp, Mus musculus
ggatctcctgagaatctttttctcc

SEQ ID NO: 604167 - DNA, 25 bp, Mus musculus
ggatctcctgagtatctttttctcc

SEQ ID NO: 604168 - DNA, 25 bp, Mus musculus
ggatctcctgctaaattgcctaggc

SEQ ID NO: 604169 - DNA, 25 bp, Mus musculus
ggatctcctgcttaattgcctaggc

SEQ ID NO: 604170 - DNA, 25 bp, Mus musculus
ggatctccttacatagcatccaaaa

SEQ ID NO: 604171 - DNA, 25 bp, Mus musculus
ggatctccttacttagcatccaaaa

SEQ ID NO: 604172 - DNA, 25 bp, Mus musculus
ggatctccttggacacgaaaaccat

SEQ ID NO: 604173 - DNA, 25 bp, Mus musculus
ggatctccttggtcacgaaaaccat

SEQ ID NO: 604174 - DNA, 25 bp, Mus musculus
ggatctcgcctgcaaacagagggaa

SEQ ID NO: 604175 - DNA, 25 bp, Mus musculus
ggatctcgcctggaaacagagggaa

SEQ ID NO: 604176 - DNA, 25 bp, Mus musculus
ggatctcggaagcttctggttgata

SEQ ID NO: 604177 - DNA, 25 bp, Mus musculus
ggatctcggaaggttctggttgata

SEQ ID NO: 604178 - DNA, 25 bp, Mus musculus
ggatctcggaataatgttctaccag

SEQ ID NO: 604179 - DNA, 25 bp, Mus musculus
ggatctcggaattatgttctaccag

SEQ ID NO: 604180 - DNA, 25 bp, Mus musculus
ggatctcgtcgaaggtcaccggctg

SEQ ID NO: 604181 - DNA, 25 bp, Mus musculus
ggatctcgtcgatggtcaccggctg

SEQ ID NO: 604182 - DNA, 25 bp, Mus musculus
ggatctcgtgggatctgataaggac

SEQ ID NO: 604183 - DNA, 25 bp, Mus musculus
ggatctcgtgggttctgataaggac

SEQ ID NO: 604184 - DNA, 25 bp, Mus musculus
ggatctcgtttaaccttcaacttga

SEQ ID NO: 604185 - DNA, 25 bp, Mus musculus
ggatctcgtttatccttcaacttga

SEQ ID NO: 604186 - DNA, 25 bp, Mus musculus
ggatctctaagtataaaccaggctg

SEQ ID NO: 604187 - DNA, 25 bp, Mus musculus
ggatctctaagtttaaaccaggctg

SEQ ID NO: 604188 - DNA, 25 bp, Mus musculus
ggatctctagcacactagtcactga

SEQ ID NO: 604189 - DNA, 25 bp, Mus musculus
ggatctctagcagactagtcactga

SEQ ID NO: 604190 - DNA, 25 bp, Mus musculus
ggatctctcaccatagagggaggtg

SEQ ID NO: 604191 - DNA, 25 bp, Mus musculus
ggatctctcaccttagagggaggtg

SEQ ID NO: 604192 - DNA, 25 bp, Mus musculus
ggatctctcactattaaggctactg

SEQ ID NO: 604193 - DNA, 25 bp, Mus musculus
ggatctctcactcgagtcatggctc

SEQ ID NO: 604194 - DNA, 25 bp, Mus musculus
ggatctctcactggagtcatggctc

SEQ ID NO: 604195 - DNA, 25 bp, Mus musculus
ggatctctcacttttaaggctactg

SEQ ID NO: 604196 - DNA, 25 bp, Mus musculus
ggatctctcataactaaagcgaaat

SEQ ID NO: 604197 - DNA, 25 bp, Mus musculus
ggatctctcatatctaaagcgaaat

SEQ ID NO: 604198 - DNA, 25 bp, Mus musculus
ggatctctccaaatcctgtgtaatt

SEQ ID NO: 604199 - DNA, 25 bp, Mus musculus
ggatctctccaattcctgtgtaatt

SEQ ID NO: 604200 - DNA, 25 bp, Mus musculus
ggatctctccagatggttttccaga

SEQ ID NO: 604201 - DNA, 25 bp, Mus musculus
ggatctctccagttggttttccaga

SEQ ID NO: 604202 - DNA, 25 bp, Mus musculus
ggatctctgacaaagacaacggcac

SEQ ID NO: 604203 - DNA, 25 bp, Mus musculus
ggatctctgacatagacaacggcac

SEQ ID NO: 604204 - DNA, 25 bp, Mus musculus
ggatctctgaccatgtatcactgaa

SEQ ID NO: 604205 - DNA, 25 bp, Mus musculus
ggatctctgaccttgtatcactgaa

SEQ ID NO: 604206 - DNA, 25 bp, Mus musculus
ggatctcttaacaagagttttgcct

SEQ ID NO: 604207 - DNA, 25 bp, Mus musculus
ggatctcttaactagagttttgcct

SEQ ID NO: 604208 - DNA, 25 bp, Mus musculus
ggatctcttacaagtgcatctcact

SEQ ID NO: 604209 - DNA, 25 bp, Mus musculus
ggatctcttacatgtgcatctcact

SEQ ID NO: 604210 - DNA, 25 bp, Mus musculus
ggatctcttcagctcaggcgtctgc

SEQ ID NO: 604211 - DNA, 25 bp, Mus musculus
ggatctcttcaggtcaggcgtctgc

SEQ ID NO: 604212 - DNA, 25 bp, Mus musculus
ggatctcttcccatcagacttcaag

SEQ ID NO: 604213 - DNA, 25 bp, Mus musculus
ggatctcttcccttcagacttcaag

SEQ ID NO: 604214 - DNA, 25 bp, Mus musculus
ggatctcttccgcatgtttgacaaa

SEQ ID NO: 604215 - DNA, 25 bp, Mus musculus
ggatctcttccggatgtttgacaaa

SEQ ID NO: 604216 - DNA, 25 bp, Mus musculus
ggatctcttctgagttcccactact

SEQ ID NO: 604217 - DNA, 25 bp, Mus musculus
ggatctcttctgtgttcccactact

SEQ ID NO: 604218 - DNA, 25 bp, Mus musculus
ggatctcttgaaagacagacagctt

SEQ ID NO: 604219 - DNA, 25 bp, Mus musculus
ggatctcttgaatgacagacagctt

SEQ ID NO: 604220 - DNA, 25 bp, Mus musculus
ggatctcttgccagagaggccatgt

SEQ ID NO: 604221 - DNA, 25 bp, Mus musculus
ggatctcttgcctgagaggccatgt

SEQ ID NO: 604222 - DNA, 25 bp, Mus musculus
ggatctcttgtaaagacgtaccaaa

SEQ ID NO: 604223 - DNA, 25 bp, Mus musculus
ggatctcttgtatagacgtaccaaa

SEQ ID NO: 604224 - DNA, 25 bp, Mus musculus
ggatctctttcgatcaagacttggg

SEQ ID NO: 604225 - DNA, 25 bp, Mus musculus
ggatctctttcgttcaagacttggg

SEQ ID NO: 604226 - DNA, 25 bp, Mus musculus
ggatctctttttaactatggaacat

SEQ ID NO: 604227 - DNA, 25 bp, Mus musculus
ggatctcttttttactatggaacat

SEQ ID NO: 604228 - DNA, 25 bp, Mus musculus
ggatctgaaactaaacccctagatt

SEQ ID NO: 604229 - DNA, 25 bp, Mus musculus
ggatctgaaacttaacccctagatt

SEQ ID NO: 604230 - DNA, 25 bp, Mus musculus
ggatctgaacccaacgaccaatggc

SEQ ID NO: 604231 - DNA, 25 bp, Mus musculus
ggatctgaaccctacgaccaatggc

SEQ ID NO: 604232 - DNA, 25 bp, Mus musculus
ggatctgaacgacacgctgctgcgc

SEQ ID NO: 604233 - DNA, 25 bp, Mus musculus
ggatctgaacgactacatggaccat

SEQ ID NO: 604234 - DNA, 25 bp, Mus musculus
ggatctgaacgagacgctgctgcgc

SEQ ID NO: 604235 - DNA, 25 bp, Mus musculus
ggatctgaacgagtacatggaccat

SEQ ID NO: 604236 - DNA, 25 bp, Mus musculus
ggatctgaacttcaagtggctcttc

SEQ ID NO: 604237 - DNA, 25 bp, Mus musculus
ggatctgaacttgaagtggctcttc

SEQ ID NO: 604238 - DNA, 25 bp, Mus musculus
ggatctgaatccaagctcgagtctc

SEQ ID NO: 604239 - DNA, 25 bp, Mus musculus
ggatctgaatcctagctcgagtctc

SEQ ID NO: 604240 - DNA, 25 bp, Mus musculus
ggatctgacaatctacttcacaaga

SEQ ID NO: 604241 - DNA, 25 bp, Mus musculus
ggatctgacaatgtacttcacaaga

SEQ ID NO: 604242 - DNA, 25 bp, Mus musculus
ggatctgacctcataccatcagtgg

SEQ ID NO: 604243 - DNA, 25 bp, Mus musculus
ggatctgacctcttaccatcagtgg

SEQ ID NO: 604244 - DNA, 25 bp, Mus musculus
ggatctgagaccatggggattcaca

SEQ ID NO: 604245 - DNA, 25 bp, Mus musculus
ggatctgagaccttggggattcaca

SEQ ID NO: 604246 - DNA, 25 bp, Mus musculus
ggatctgaggtcagctccaatggaa

SEQ ID NO: 604247 - DNA, 25 bp, Mus musculus
ggatctgaggtctgctccaatggaa

SEQ ID NO: 604248 - DNA, 25 bp, Mus musculus
ggatctgatataagtctctccacag

SEQ ID NO: 604249 - DNA, 25 bp, Mus musculus
ggatctgatatatgtctctccacag

SEQ ID NO: 604250 - DNA, 25 bp, Mus musculus
ggatctgatctgaaagtacattgga

SEQ ID NO: 604251 - DNA, 25 bp, Mus musculus
ggatctgatctgtaagtacattgga

SEQ ID NO: 604252 - DNA, 25 bp, Mus musculus
ggatctgatgaacgacctggcctgt

SEQ ID NO: 604253 - DNA, 25 bp, Mus musculus
ggatctgatgaaggacctggcctgt

SEQ ID NO: 604254 - DNA, 25 bp, Mus musculus
ggatctgatgccactgactccaagg

SEQ ID NO: 604255 - DNA, 25 bp, Mus musculus
ggatctgatgcctctgactccaagg

SEQ ID NO: 604256 - DNA, 25 bp, Mus musculus
ggatctgatgctacatctgacatgc

SEQ ID NO: 604257 - DNA, 25 bp, Mus musculus
ggatctgatgcttcatctgacatgc

SEQ ID NO: 604258 - DNA, 25 bp, Mus musculus
ggatctgattttcagactgacttga

SEQ ID NO: 604259 - DNA, 25 bp, Mus musculus
ggatctgattttgagactgacttga

SEQ ID NO: 604260 - DNA, 25 bp, Mus musculus
ggatctgcaacacatttcactctga

SEQ ID NO: 604261 - DNA, 25 bp, Mus musculus
ggatctgcaacagatttcactctga

SEQ ID NO: 604262 - DNA, 25 bp, Mus musculus
ggatctgcaatgaggctggctttag

SEQ ID NO: 604263 - DNA, 25 bp, Mus musculus
ggatctgcaatgtggctggctttag

SEQ ID NO: 604264 - DNA, 25 bp, Mus musculus
ggatctgcagcacgattcattgcta

SEQ ID NO: 604265 - DNA, 25 bp, Mus musculus
ggatctgcagcaggattcattgcta

SEQ ID NO: 604266 - DNA, 25 bp, Mus musculus
ggatctgcagccaccattcaagtca

SEQ ID NO: 604267 - DNA, 25 bp, Mus musculus
ggatctgcagcctccattcaagtca

SEQ ID NO: 604268 - DNA, 25 bp, Mus musculus
ggatctgcattcatttgtatttttc

SEQ ID NO: 604269 - DNA, 25 bp, Mus musculus
ggatctgcattcttttgtatttttc

SEQ ID NO: 604270 - DNA, 25 bp, Mus musculus
ggatctgccaaaagaccctgataca

SEQ ID NO: 604271 - DNA, 25 bp, Mus musculus
ggatctgccaaatgaccctgataca

SEQ ID NO: 604272 - DNA, 25 bp, Mus musculus
ggatctgccagcattaaaagggcag

SEQ ID NO: 604273 - DNA, 25 bp, Mus musculus
ggatctgccagctttaaaagggcag

SEQ ID NO: 604274 - DNA, 25 bp, Mus musculus
ggatctgcccctcataatggtgtta

SEQ ID NO: 604275 - DNA, 25 bp, Mus musculus
ggatctgcccctgataatggtgtta

SEQ ID NO: 604276 - DNA, 25 bp, Mus musculus
ggatctgcccttcaaagggctcaga

SEQ ID NO: 604277 - DNA, 25 bp, Mus musculus
ggatctgcccttgaaagggctcaga

SEQ ID NO: 604278 - DNA, 25 bp, Mus musculus
ggatctgcctctctttatagattct

SEQ ID NO: 604279 - DNA, 25 bp, Mus musculus
ggatctgcctctgtttatagattct

SEQ ID NO: 604280 - DNA, 25 bp, Mus musculus
ggatctgccttcaggcttgaggctg

SEQ ID NO: 604281 - DNA, 25 bp, Mus musculus
ggatctgccttctggcttgaggctg

SEQ ID NO: 604282 - DNA, 25 bp, Mus musculus
ggatctgctactcgagatgttcagc

SEQ ID NO: 604283 - DNA, 25 bp, Mus musculus
ggatctgctactggagatgttcagc

SEQ ID NO: 604284 - DNA, 25 bp, Mus musculus
ggatctgctagacatctcaggatgt

SEQ ID NO: 604285 - DNA, 25 bp, Mus musculus
ggatctgctagagatctcaggatgt

SEQ ID NO: 604286 - DNA, 25 bp, Mus musculus
ggatctgctcagctctatgtttgag

SEQ ID NO: 604287 - DNA, 25 bp, Mus musculus
ggatctgctcaggtctatgtttgag

SEQ ID NO: 604288 - DNA, 25 bp, Mus musculus
ggatctgctgatctacagtgccttt

SEQ ID NO: 604289 - DNA, 25 bp, Mus musculus
ggatctgctgatgtacagtgccttt

SEQ ID NO: 604290 - DNA, 25 bp, Mus musculus
ggatctgctgggagcacagaagcca

SEQ ID NO: 604291 - DNA, 25 bp, Mus musculus
ggatctgctgggtgcacagaagcca

SEQ ID NO: 604292 - DNA, 25 bp, Mus musculus
ggatctgctgttagaagcgcagcag

SEQ ID NO: 604293 - DNA, 25 bp, Mus musculus
ggatctgctgtttgaagcgcagcag

SEQ ID NO: 604294 - DNA, 25 bp, Mus musculus
ggatctgcttcccaactgttaaatg

SEQ ID NO: 604295 - DNA, 25 bp, Mus musculus
ggatctgcttccgaactgttaaatg

SEQ ID NO: 604296 - DNA, 25 bp, Mus musculus
ggatctgcttttccactgtggagag

SEQ ID NO: 604297 - DNA, 25 bp, Mus musculus
ggatctgcttttgcactgtggagag

SEQ ID NO: 604298 - DNA, 25 bp, Mus musculus
ggatctggaacactcagacagctaa

SEQ ID NO: 604299 - DNA, 25 bp, Mus musculus
ggatctggaacagtcagacagctaa

SEQ ID NO: 604300 - DNA, 25 bp, Mus musculus
ggatctggaactcctaagccatctc

SEQ ID NO: 604301 - DNA, 25 bp, Mus musculus
ggatctggaactgctaagccatctc

SEQ ID NO: 604302 - DNA, 25 bp, Mus musculus
ggatctggagcccacagaccaagac

SEQ ID NO: 604303 - DNA, 25 bp, Mus musculus
ggatctggagccgacagaccaagac

SEQ ID NO: 604304 - DNA, 25 bp, Mus musculus
ggatctggatccaagcctgagcgag

SEQ ID NO: 604305 - DNA, 25 bp, Mus musculus
ggatctggatcctagcctgagcgag

SEQ ID NO: 604306 - DNA, 25 bp, Mus musculus
ggatctggcaataggcttacgtaaa

SEQ ID NO: 604307 - DNA, 25 bp, Mus musculus
ggatctggcaattggcttacgtaaa

SEQ ID NO: 604308 - DNA, 25 bp, Mus musculus
ggatctggctaccagatgacctcac

SEQ ID NO: 604309 - DNA, 25 bp, Mus musculus
ggatctggctacgagatgacctcac

SEQ ID NO: 604310 - DNA, 25 bp, Mus musculus
ggatctggctccaatggacgcctgg

SEQ ID NO: 604311 - DNA, 25 bp, Mus musculus
ggatctggctcctatggacgcctgg

SEQ ID NO: 604312 - DNA, 25 bp, Mus musculus
ggatctggctctactagtgaggcaa

SEQ ID NO: 604313 - DNA, 25 bp, Mus musculus
ggatctggctcttctagtgaggcaa

SEQ ID NO: 604314 - DNA, 25 bp, Mus musculus
ggatctgggcatatcatcactgtaa

SEQ ID NO: 604315 - DNA, 25 bp, Mus musculus
ggatctgggcatttcatcactgtaa

SEQ ID NO: 604316 - DNA, 25 bp, Mus musculus
ggatctgggctgacactacgataat

SEQ ID NO: 604317 - DNA, 25 bp, Mus musculus
ggatctgggctgtcactacgataat

SEQ ID NO: 604318 - DNA, 25 bp, Mus musculus
ggatctgggttgactggcctttgtc

SEQ ID NO: 604319 - DNA, 25 bp, Mus musculus
ggatctgggttgtctggcctttgtc

SEQ ID NO: 604320 - DNA, 25 bp, Mus musculus
ggatctggtcacactttccaaggca

SEQ ID NO: 604321 - DNA, 25 bp, Mus musculus
ggatctggtcactctttccaaggca

SEQ ID NO: 604322 - DNA, 25 bp, Mus musculus
ggatctggtctcctgaaatacgtcc

SEQ ID NO: 604323 - DNA, 25 bp, Mus musculus
ggatctggtctcgtgaaatacgtcc

SEQ ID NO: 604324 - DNA, 25 bp, Mus musculus
ggatctggttgtaaagcactctggt

SEQ ID NO: 604325 - DNA, 25 bp, Mus musculus
ggatctggttgttaagcactctggt

SEQ ID NO: 604326 - DNA, 25 bp, Mus musculus
ggatctgtacataattgttgctggt

SEQ ID NO: 604327 - DNA, 25 bp, Mus musculus
ggatctgtacattattgttgctggt

SEQ ID NO: 604328 - DNA, 25 bp, Mus musculus
ggatctgtagacacctgtctcatga

SEQ ID NO: 604329 - DNA, 25 bp, Mus musculus
ggatctgtagactcctgtctcatga

SEQ ID NO: 604330 - DNA, 25 bp, Mus musculus
ggatctgtatagaccccagtgtgga

SEQ ID NO: 604331 - DNA, 25 bp, Mus musculus
ggatctgtatagtccccagtgtgga

SEQ ID NO: 604332 - DNA, 25 bp, Mus musculus
ggatctgtcaagagagcttttccta

SEQ ID NO: 604333 - DNA, 25 bp, Mus musculus
ggatctgtcaagtgagcttttccta

SEQ ID NO: 604334 - DNA, 25 bp, Mus musculus
ggatctgtcactatctggatgctta

SEQ ID NO: 604335 - DNA, 25 bp, Mus musculus
ggatctgtcactttctggatgctta

SEQ ID NO: 604336 - DNA, 25 bp, Mus musculus
ggatctgtcaggctgcgtatttatt

SEQ ID NO: 604337 - DNA, 25 bp, Mus musculus
ggatctgtcagggtgcgtatttatt

SEQ ID NO: 604338 - DNA, 25 bp, Mus musculus
ggatctgtcagtagctatgtttctt

SEQ ID NO: 604339 - DNA, 25 bp, Mus musculus
ggatctgtcagttgctatgtttctt

SEQ ID NO: 604340 - DNA, 25 bp, Mus musculus
ggatctgtcatccaaccggaagctg

SEQ ID NO: 604341 - DNA, 25 bp, Mus musculus
ggatctgtcatcgaaccggaagctg

SEQ ID NO: 604342 - DNA, 25 bp, Mus musculus
ggatctgtcattctctctactttat

SEQ ID NO: 604343 - DNA, 25 bp, Mus musculus
ggatctgtcattgtctctactttat

SEQ ID NO: 604344 - DNA, 25 bp, Mus musculus
ggatctgtcgctatggacctgtaca

SEQ ID NO: 604345 - DNA, 25 bp, Mus musculus
ggatctgtcgctttggacctgtaca

SEQ ID NO: 604346 - DNA, 25 bp, Mus musculus
ggatctgtgagcatgggatcactga

SEQ ID NO: 604347 - DNA, 25 bp, Mus musculus
ggatctgtgagcttgggatcactga

SEQ ID NO: 604348 - DNA, 25 bp, Mus musculus
ggatctgtgatcatttgattcccct

SEQ ID NO: 604349 - DNA, 25 bp, Mus musculus
ggatctgtgatcttttgattcccct

SEQ ID NO: 604350 - DNA, 25 bp, Mus musculus
ggatctgtgccactttatcggctaa

SEQ ID NO: 604351 - DNA, 25 bp, Mus musculus
ggatctgtgccagtttatcggctaa

SEQ ID NO: 604352 - DNA, 25 bp, Mus musculus
ggatctgtgctaatggactctgtat

SEQ ID NO: 604353 - DNA, 25 bp, Mus musculus
ggatctgtgctattggactctgtat

SEQ ID NO: 604354 - DNA, 25 bp, Mus musculus
ggatctgtggtacagtttctgccct

SEQ ID NO: 604355 - DNA, 25 bp, Mus musculus
ggatctgtggtagagtttctgccct

SEQ ID NO: 604356 - DNA, 25 bp, Mus musculus
ggatctgtggttaaggatactggct

SEQ ID NO: 604357 - DNA, 25 bp, Mus musculus
ggatctgtggtttaggatactggct

SEQ ID NO: 604358 - DNA, 25 bp, Mus musculus
ggatctgtgtagacctcgggaaatc

SEQ ID NO: 604359 - DNA, 25 bp, Mus musculus
ggatctgtgtagtcctcgggaaatc

SEQ ID NO: 604360 - DNA, 25 bp, Mus musculus
ggatctgtgttcaactgacgaatta

SEQ ID NO: 604361 - DNA, 25 bp, Mus musculus
ggatctgtgttctactgacgaatta

SEQ ID NO: 604362 - DNA, 25 bp, Mus musculus
ggatctgtgttgaagaatctgccat

SEQ ID NO: 604363 - DNA, 25 bp, Mus musculus
ggatctgtgttgtagaatctgccat

SEQ ID NO: 604364 - DNA, 25 bp, Mus musculus
ggatctgtgtttaaacgcttacatt

SEQ ID NO: 604365 - DNA, 25 bp, Mus musculus
ggatctgtgttttaacgcttacatt

SEQ ID NO: 604366 - DNA, 25 bp, Mus musculus
ggatctgttaccatactctgaggct

SEQ ID NO: 604367 - DNA, 25 bp, Mus musculus
ggatctgttaccttactctgaggct

SEQ ID NO: 604368 - DNA, 25 bp, Mus musculus
ggatctgttactagagagcacacgt

SEQ ID NO: 604369 - DNA, 25 bp, Mus musculus
ggatctgttacttgagagcacacgt

SEQ ID NO: 604370 - DNA, 25 bp, Mus musculus
ggatctgttgtcaaagagccctcac

SEQ ID NO: 604371 - DNA, 25 bp, Mus musculus
ggatctgttgtctaagagccctcac

SEQ ID NO: 604372 - DNA, 25 bp, Mus musculus
ggatctgttttcattcatgtttcta

SEQ ID NO: 604373 - DNA, 25 bp, Mus musculus
ggatctgttttctttcatgtttcta

SEQ ID NO: 604374 - DNA, 25 bp, Mus musculus
ggatctgttttgatgctcaattttc

SEQ ID NO: 604375 - DNA, 25 bp, Mus musculus
ggatctgttttgttgctcaattttc

SEQ ID NO: 604376 - DNA, 25 bp, Mus musculus
ggatcttaaatacacatcactagcc

SEQ ID NO: 604377 - DNA, 25 bp, Mus musculus
ggatcttaaatagacatcactagcc

SEQ ID NO: 604378 - DNA, 25 bp, Mus musculus
ggatcttaccaaacctgggatggtc

SEQ ID NO: 604379 - DNA, 25 bp, Mus musculus
ggatcttaccaatcctgggatggtc

SEQ ID NO: 604380 - DNA, 25 bp, Mus musculus
ggatcttactcacgaaaccctgttt

SEQ ID NO: 604381 - DNA, 25 bp, Mus musculus
ggatcttactcaggaaaccctgttt

SEQ ID NO: 604382 - DNA, 25 bp, Mus musculus
ggatcttatgagagtgcttctatca

SEQ ID NO: 604383 - DNA, 25 bp, Mus musculus
ggatcttatgagtgtgcttctatca

SEQ ID NO: 604384 - DNA, 25 bp, Mus musculus
ggatcttatggtacaccagaaactt

SEQ ID NO: 604385 - DNA, 25 bp, Mus musculus
ggatcttatggttcaccagaaactt

SEQ ID NO: 604386 - DNA, 25 bp, Mus musculus
ggatcttatgtgcactctccctaca

SEQ ID NO: 604387 - DNA, 25 bp, Mus musculus
ggatcttatgtggactctccctaca

SEQ ID NO: 604388 - DNA, 25 bp, Mus musculus
ggatcttattcaaggacatctttca

SEQ ID NO: 604389 - DNA, 25 bp, Mus musculus
ggatcttattcatggacatctttca

SEQ ID NO: 604390 - DNA, 25 bp, Mus musculus
ggatcttcacagactatttgctcaa

SEQ ID NO: 604391 - DNA, 25 bp, Mus musculus
ggatcttcacagtctatttgctcaa

SEQ ID NO: 604392 - DNA, 25 bp, Mus musculus
ggatcttcacttcgtaccgcaagaa

SEQ ID NO: 604393 - DNA, 25 bp, Mus musculus
ggatcttcacttggtaccgcaagaa

SEQ ID NO: 604394 - DNA, 25 bp, Mus musculus
ggatcttcagaaatactgggactta

SEQ ID NO: 604395 - DNA, 25 bp, Mus musculus
ggatcttcagaattactgggactta

SEQ ID NO: 604396 - DNA, 25 bp, Mus musculus
ggatcttcagacacagttgttcttt

SEQ ID NO: 604397 - DNA, 25 bp, Mus musculus
ggatcttcagacacatctaccttga

SEQ ID NO: 604398 - DNA, 25 bp, Mus musculus
ggatcttcagactcagttgttcttt

SEQ ID NO: 604399 - DNA, 25 bp, Mus musculus
ggatcttcagactcatctaccttga

SEQ ID NO: 604400 - DNA, 25 bp, Mus musculus
ggatcttcagctaaggaattgcctc

SEQ ID NO: 604401 - DNA, 25 bp, Mus musculus
ggatcttcagcttaggaattgcctc

SEQ ID NO: 604402 - DNA, 25 bp, Mus musculus
ggatcttcatgtatgtgtctcaagc

SEQ ID NO: 604403 - DNA, 25 bp, Mus musculus
ggatcttcatgtttgtgtctcaagc

SEQ ID NO: 604404 - DNA, 25 bp, Mus musculus
ggatcttcattgacccggaggcttt

SEQ ID NO: 604405 - DNA, 25 bp, Mus musculus
ggatcttcattgtcccggaggcttt

SEQ ID NO: 604406 - DNA, 25 bp, Mus musculus
ggatcttccagaagaacaaggtcaa

SEQ ID NO: 604407 - DNA, 25 bp, Mus musculus
ggatcttccagatgaacaaggtcaa

SEQ ID NO: 604408 - DNA, 25 bp, Mus musculus
ggatcttcccctctgtcagcaaagg

SEQ ID NO: 604409 - DNA, 25 bp, Mus musculus
ggatcttcccctgtgtcagcaaagg

SEQ ID NO: 604410 - DNA, 25 bp, Mus musculus
ggatcttcccgaccatttgggtcac

SEQ ID NO: 604411 - DNA, 25 bp, Mus musculus
ggatcttcccgagcatttgggtcac

SEQ ID NO: 604412 - DNA, 25 bp, Mus musculus
ggatcttccctgatggctgtgagca

SEQ ID NO: 604413 - DNA, 25 bp, Mus musculus
ggatcttccctgttggctgtgagca

SEQ ID NO: 604414 - DNA, 25 bp, Mus musculus
ggatcttcccttaagaactgtcttc

SEQ ID NO: 604415 - DNA, 25 bp, Mus musculus
ggatcttccctttagaactgtcttc

SEQ ID NO: 604416 - DNA, 25 bp, Mus musculus
ggatcttcctacaaacggttcacac

SEQ ID NO: 604417 - DNA, 25 bp, Mus musculus
ggatcttcctactaacggttcacac

SEQ ID NO: 604418 - DNA, 25 bp, Mus musculus
ggatcttcctctaattgacagccta

SEQ ID NO: 604419 - DNA, 25 bp, Mus musculus
ggatcttcctcttattgacagccta

SEQ ID NO: 604420 - DNA, 25 bp, Mus musculus
ggatcttcctgcagggtgtctacaa

SEQ ID NO: 604421 - DNA, 25 bp, Mus musculus
ggatcttcctgctgggtgtctacaa

SEQ ID NO: 604422 - DNA, 25 bp, Mus musculus
ggatcttcgaacatggtctgcatgg

SEQ ID NO: 604423 - DNA, 25 bp, Mus musculus
ggatcttcgaacttggtctgcatgg

SEQ ID NO: 604424 - DNA, 25 bp, Mus musculus
ggatcttcgtaccaagagcaccgga

SEQ ID NO: 604425 - DNA, 25 bp, Mus musculus
ggatcttcgtacgaagagcaccgga

SEQ ID NO: 604426 - DNA, 25 bp, Mus musculus
ggatcttctagaaaagagtggtctt

SEQ ID NO: 604427 - DNA, 25 bp, Mus musculus
ggatcttctagataagagtggtctt

SEQ ID NO: 604428 - DNA, 25 bp, Mus musculus
ggatcttctcccaagaatgatacat

SEQ ID NO: 604429 - DNA, 25 bp, Mus musculus
ggatcttctccctagaatgatacat

SEQ ID NO: 604430 - DNA, 25 bp, Mus musculus
ggatcttctgacacataaacttcgt

SEQ ID NO: 604431 - DNA, 25 bp, Mus musculus
ggatcttctgactcataaacttcgt

SEQ ID NO: 604432 - DNA, 25 bp, Mus musculus
ggatcttctgatcttccacagccac

SEQ ID NO: 604433 - DNA, 25 bp, Mus musculus
ggatcttctgatgttccacagccac

SEQ ID NO: 604434 - DNA, 25 bp, Mus musculus
ggatcttctgtacgcatgtgtctgc

SEQ ID NO: 604435 - DNA, 25 bp, Mus musculus
ggatcttctgtaggcatgtgtctgc

SEQ ID NO: 604436 - DNA, 25 bp, Mus musculus
ggatcttctgtcctcaaggaatcga

SEQ ID NO: 604437 - DNA, 25 bp, Mus musculus
ggatcttctgtcgtcaaggaatcga

SEQ ID NO: 604438 - DNA, 25 bp, Mus musculus
ggatcttcttatcaataagcttcaa

SEQ ID NO: 604439 - DNA, 25 bp, Mus musculus
ggatcttcttatgaataagcttcaa

SEQ ID NO: 604440 - DNA, 25 bp, Mus musculus
ggatcttcttcaagactttctactt

SEQ ID NO: 604441 - DNA, 25 bp, Mus musculus
ggatcttcttcatgactttctactt

SEQ ID NO: 604442 - DNA, 25 bp, Mus musculus
ggatcttcttttacagctgtctgtt

SEQ ID NO: 604443 - DNA, 25 bp, Mus musculus
ggatcttctttttcagctgtctgtt

SEQ ID NO: 604444 - DNA, 25 bp, Mus musculus
ggatcttgaacacctatggttgtca

SEQ ID NO: 604445 - DNA, 25 bp, Mus musculus
ggatcttgaacagctatggttgtca

SEQ ID NO: 604446 - DNA, 25 bp, Mus musculus
ggatcttgaactcaaccactctgga

SEQ ID NO: 604447 - DNA, 25 bp, Mus musculus
ggatcttgaactgaaccactctgga

SEQ ID NO: 604448 - DNA, 25 bp, Mus musculus
ggatcttgacgcaggaccacgggat

SEQ ID NO: 604449 - DNA, 25 bp, Mus musculus
ggatcttgacgctggaccacgggat

SEQ ID NO: 604450 - DNA, 25 bp, Mus musculus
ggatcttgccctcagcaaacgcttt

SEQ ID NO: 604451 - DNA, 25 bp, Mus musculus
ggatcttgccctgagcaaacgcttt

SEQ ID NO: 604452 - DNA, 25 bp, Mus musculus
ggatcttgctatatggcccagacta

SEQ ID NO: 604453 - DNA, 25 bp, Mus musculus
ggatcttgctatcactgtaaccaac

SEQ ID NO: 604454 - DNA, 25 bp, Mus musculus
ggatcttgctatgactgtaaccaac

SEQ ID NO: 604455 - DNA, 25 bp, Mus musculus
ggatcttgctatttggcccagacta

SEQ ID NO: 604456 - DNA, 25 bp, Mus musculus
ggatcttggcacaggaaattgtgaa

SEQ ID NO: 604457 - DNA, 25 bp, Mus musculus
ggatcttggcactggaaattgtgaa

SEQ ID NO: 604458 - DNA, 25 bp, Mus musculus
ggatcttgggataatcttggtttca

SEQ ID NO: 604459 - DNA, 25 bp, Mus musculus
ggatcttgggattatcttggtttca

SEQ ID NO: 604460 - DNA, 25 bp, Mus musculus
ggatcttggtccaaagcttgtgttt

SEQ ID NO: 604461 - DNA, 25 bp, Mus musculus
ggatcttggtcctaagcttgtgttt

SEQ ID NO: 604462 - DNA, 25 bp, Mus musculus
ggatcttgtcaaaaaccagtctgtg

SEQ ID NO: 604463 - DNA, 25 bp, Mus musculus
ggatcttgtcaataaccagtctgtg

SEQ ID NO: 604464 - DNA, 25 bp, Mus musculus
ggatcttgtccaccaggccagagat

SEQ ID NO: 604465 - DNA, 25 bp, Mus musculus
ggatcttgtccagcaggccagagat

SEQ ID NO: 604466 - DNA, 25 bp, Mus musculus
ggatcttgtgccatttaaagtccct

SEQ ID NO: 604467 - DNA, 25 bp, Mus musculus
ggatcttgtgcccaaagtctctaaa

SEQ ID NO: 604468 - DNA, 25 bp, Mus musculus
ggatcttgtgccgaaagtctctaaa

SEQ ID NO: 604469 - DNA, 25 bp, Mus musculus
ggatcttgtgccttttaaagtccct

SEQ ID NO: 604470 - DNA, 25 bp, Mus musculus
ggatcttgtgttcgattggcttcag

SEQ ID NO: 604471 - DNA, 25 bp, Mus musculus
ggatcttgtgttggattggcttcag

SEQ ID NO: 604472 - DNA, 25 bp, Mus musculus
ggatcttgttaccttgctgttctaa

SEQ ID NO: 604473 - DNA, 25 bp, Mus musculus
ggatcttgttacgttgctgttctaa

SEQ ID NO: 604474 - DNA, 25 bp, Mus musculus
ggatcttgtttcctctgagacagat

SEQ ID NO: 604475 - DNA, 25 bp, Mus musculus
ggatcttgtttcgtctgagacagat

SEQ ID NO: 604476 - DNA, 25 bp, Mus musculus
ggatctttaacaacaagggctcgcg

SEQ ID NO: 604477 - DNA, 25 bp, Mus musculus
ggatctttaacatcaagggctcgcg

SEQ ID NO: 604478 - DNA, 25 bp, Mus musculus
ggatctttaattcctagccaggaaa

SEQ ID NO: 604479 - DNA, 25 bp, Mus musculus
ggatctttaattgctagccaggaaa

SEQ ID NO: 604480 - DNA, 25 bp, Mus musculus
ggatctttagtactgtgagccaagg

SEQ ID NO: 604481 - DNA, 25 bp, Mus musculus
ggatctttagtagtgtgagccaagg

SEQ ID NO: 604482 - DNA, 25 bp, Mus musculus
ggatctttatgacgtcaagcccagc

SEQ ID NO: 604483 - DNA, 25 bp, Mus musculus
ggatctttatgaggtcaagcccagc

SEQ ID NO: 604484 - DNA, 25 bp, Mus musculus
ggatctttcaagaccattcacatat

SEQ ID NO: 604485 - DNA, 25 bp, Mus musculus
ggatctttcaagatttgcatgctgc

SEQ ID NO: 604486 - DNA, 25 bp, Mus musculus
ggatctttcaagctttccaccatgg

SEQ ID NO: 604487 - DNA, 25 bp, Mus musculus
ggatctttcaaggtttccaccatgg

SEQ ID NO: 604488 - DNA, 25 bp, Mus musculus
ggatctttcaagtccattcacatat

SEQ ID NO: 604489 - DNA, 25 bp, Mus musculus
ggatctttcaagttttgcatgctgc

SEQ ID NO: 604490 - DNA, 25 bp, Mus musculus
ggatctttcagacttcgaaggcaag

SEQ ID NO: 604491 - DNA, 25 bp, Mus musculus
ggatctttcagagttcgaaggcaag

SEQ ID NO: 604492 - DNA, 25 bp, Mus musculus
ggatctttcatgcttttctttgatt

SEQ ID NO: 604493 - DNA, 25 bp, Mus musculus
ggatctttcatggttttctttgatt

SEQ ID NO: 604494 - DNA, 25 bp, Mus musculus
ggatctttcattatccaaaacggag

SEQ ID NO: 604495 - DNA, 25 bp, Mus musculus
ggatctttcattttccaaaacggag

SEQ ID NO: 604496 - DNA, 25 bp, Mus musculus
ggatctttccaaacatgactttgag

SEQ ID NO: 604497 - DNA, 25 bp, Mus musculus
ggatctttccaatcatgactttgag

SEQ ID NO: 604498 - DNA, 25 bp, Mus musculus
ggatctttccaccaagccatacaaa

SEQ ID NO: 604499 - DNA, 25 bp, Mus musculus
ggatctttccacgaagccatacaaa

SEQ ID NO: 604500 - DNA, 25 bp, Mus musculus
ggatctttccgccatgcagctacca

SEQ ID NO: 604501 - DNA, 25 bp, Mus musculus
ggatctttccgcgatgcagctacca

SEQ ID NO: 604502 - DNA, 25 bp, Mus musculus
ggatctttccggctccagagagacg

SEQ ID NO: 604503 - DNA, 25 bp, Mus musculus
ggatctttccgggtccagagagacg

SEQ ID NO: 604504 - DNA, 25 bp, Mus musculus
ggatctttcgagatatcagctgtat

SEQ ID NO: 604505 - DNA, 25 bp, Mus musculus
ggatctttcgagttatcagctgtat

SEQ ID NO: 604506 - DNA, 25 bp, Mus musculus
ggatctttctgaaccatttgtttct

SEQ ID NO: 604507 - DNA, 25 bp, Mus musculus
ggatctttctgatccatttgtttct

SEQ ID NO: 604508 - DNA, 25 bp, Mus musculus
ggatctttctttaacatcatttatc

SEQ ID NO: 604509 - DNA, 25 bp, Mus musculus
ggatctttcttttacatcatttatc

SEQ ID NO: 604510 - DNA, 25 bp, Mus musculus
ggatctttgataactcaggtcgtga

SEQ ID NO: 604511 - DNA, 25 bp, Mus musculus
ggatctttgatatctcaggtcgtga

SEQ ID NO: 604512 - DNA, 25 bp, Mus musculus
ggatctttggtcagatgagactaac

SEQ ID NO: 604513 - DNA, 25 bp, Mus musculus
ggatctttggtctgatgagactaac

SEQ ID NO: 604514 - DNA, 25 bp, Mus musculus
ggatctttgtccataagtgcattat

SEQ ID NO: 604515 - DNA, 25 bp, Mus musculus
ggatctttgtccttaagtgcattat

SEQ ID NO: 604516 - DNA, 25 bp, Mus musculus
ggatctttgtgaattcgaagccaac

SEQ ID NO: 604517 - DNA, 25 bp, Mus musculus
ggatctttgtgatttcgaagccaac

SEQ ID NO: 604518 - DNA, 25 bp, Mus musculus
ggatcttttacaatatcagcataat

SEQ ID NO: 604519 - DNA, 25 bp, Mus musculus
ggatcttttacattatcagcataat

SEQ ID NO: 604520 - DNA, 25 bp, Mus musculus
ggatcttttagcaaacctagtcaaa

SEQ ID NO: 604521 - DNA, 25 bp, Mus musculus
ggatcttttagctaacctagtcaaa

SEQ ID NO: 604522 - DNA, 25 bp, Mus musculus
ggatcttttattcccaggcaggcct

SEQ ID NO: 604523 - DNA, 25 bp, Mus musculus
ggatcttttattgccaggcaggcct

SEQ ID NO: 604524 - DNA, 25 bp, Mus musculus
ggatcttttccacacagttgcacat

SEQ ID NO: 604525 - DNA, 25 bp, Mus musculus
ggatcttttccagacagttgcacat

SEQ ID NO: 604526 - DNA, 25 bp, Mus musculus
ggatcttttctaaatgttattactt

SEQ ID NO: 604527 - DNA, 25 bp, Mus musculus
ggatcttttctatatgttattactt

SEQ ID NO: 604528 - DNA, 25 bp, Mus musculus
ggatgaaaacgcagtttccctccgt

SEQ ID NO: 604529 - DNA, 25 bp, Mus musculus
ggatgaaaacgctgtttccctccgt

SEQ ID NO: 604530 - DNA, 25 bp, Mus musculus
ggatgaaaactcctaccttggccag

SEQ ID NO: 604531 - DNA, 25 bp, Mus musculus
ggatgaaaactcgtaccttggccag

SEQ ID NO: 604532 - DNA, 25 bp, Mus musculus
ggatgaaaacttacagccgctgggc

SEQ ID NO: 604533 - DNA, 25 bp, Mus musculus
ggatgaaaactttcagccgctgggc

SEQ ID NO: 604534 - DNA, 25 bp, Mus musculus
ggatgaaaccatcttcttactggaa

SEQ ID NO: 604535 - DNA, 25 bp, Mus musculus
ggatgaaaccatgttcttactggaa

SEQ ID NO: 604536 - DNA, 25 bp, Mus musculus
ggatgaaagccaaaggcctcccttc

SEQ ID NO: 604537 - DNA, 25 bp, Mus musculus
ggatgaaagccataggcctcccttc

SEQ ID NO: 604538 - DNA, 25 bp, Mus musculus
ggatgaaaggaaccctcggccccga

SEQ ID NO: 604539 - DNA, 25 bp, Mus musculus
ggatgaaaggaagcctcggccccga

SEQ ID NO: 604540 - DNA, 25 bp, Mus musculus
ggatgaaataaaagacgatgctctc

SEQ ID NO: 604541 - DNA, 25 bp, Mus musculus
ggatgaaataaatgacgatgctctc

SEQ ID NO: 604542 - DNA, 25 bp, Mus musculus
ggatgaaataccacatcaaggcagt

SEQ ID NO: 604543 - DNA, 25 bp, Mus musculus
ggatgaaatacctcatcaaggcagt

SEQ ID NO: 604544 - DNA, 25 bp, Mus musculus
ggatgaaattctcgcgggcaatgct

SEQ ID NO: 604545 - DNA, 25 bp, Mus musculus
ggatgaaattctggcgggcaatgct

SEQ ID NO: 604546 - DNA, 25 bp, Mus musculus
ggatgaacacggactctgggccatt

SEQ ID NO: 604547 - DNA, 25 bp, Mus musculus
ggatgaacacggtctctgggccatt

SEQ ID NO: 604548 - DNA, 25 bp, Mus musculus
ggatgaacactacctttccaaactc

SEQ ID NO: 604549 - DNA, 25 bp, Mus musculus
ggatgaacactagctttccaaactc

SEQ ID NO: 604550 - DNA, 25 bp, Mus musculus
ggatgaacatgtagcttgctgctga

SEQ ID NO: 604551 - DNA, 25 bp, Mus musculus
ggatgaacatgttgcttgctgctga

SEQ ID NO: 604552 - DNA, 25 bp, Mus musculus
ggatgaaccaacagtcggctaccat

SEQ ID NO: 604553 - DNA, 25 bp, Mus musculus
ggatgaaccaactgtcggctaccat

SEQ ID NO: 604554 - DNA, 25 bp, Mus musculus
ggatgaaccatgctgtcattttcta

SEQ ID NO: 604555 - DNA, 25 bp, Mus musculus
ggatgaaccatggtgtcattttcta

SEQ ID NO: 604556 - DNA, 25 bp, Mus musculus
ggatgaacctcaaaaaattcttttc

SEQ ID NO: 604557 - DNA, 25 bp, Mus musculus
ggatgaacctcataaaattcttttc

SEQ ID NO: 604558 - DNA, 25 bp, Mus musculus
ggatgaacctgactgcgcagcctgt

SEQ ID NO: 604559 - DNA, 25 bp, Mus musculus
ggatgaacctgagtgcgcagcctgt

SEQ ID NO: 604560 - DNA, 25 bp, Mus musculus
ggatgaaccttcctagtggactcca

SEQ ID NO: 604561 - DNA, 25 bp, Mus musculus
ggatgaaccttcgtagtggactcca

SEQ ID NO: 604562 - DNA, 25 bp, Mus musculus
ggatgaaccttgagatacctcaaat

SEQ ID NO: 604563 - DNA, 25 bp, Mus musculus
ggatgaaccttgtgatacctcaaat

SEQ ID NO: 604564 - DNA, 25 bp, Mus musculus
ggatgaacgaacagtgtagcagtat

SEQ ID NO: 604565 - DNA, 25 bp, Mus musculus
ggatgaacgaactgtgtagcagtat

SEQ ID NO: 604566 - DNA, 25 bp, Mus musculus
ggatgaacgggcatccgaaacactc

SEQ ID NO: 604567 - DNA, 25 bp, Mus musculus
ggatgaacgggcttccgaaacactc

SEQ ID NO: 604568 - DNA, 25 bp, Mus musculus
ggatgaactagcataccagaggccc

SEQ ID NO: 604569 - DNA, 25 bp, Mus musculus
ggatgaactagcttaccagaggccc

SEQ ID NO: 604570 - DNA, 25 bp, Mus musculus
ggatgaactcccaaggtggctactc

SEQ ID NO: 604571 - DNA, 25 bp, Mus musculus
ggatgaactccctaggtggctactc

SEQ ID NO: 604572 - DNA, 25 bp, Mus musculus
ggatgaactggccagaactgacctt

SEQ ID NO: 604573 - DNA, 25 bp, Mus musculus
ggatgaactggcgagaactgacctt

SEQ ID NO: 604574 - DNA, 25 bp, Mus musculus
ggatgaacttctatagcttttttag

SEQ ID NO: 604575 - DNA, 25 bp, Mus musculus
ggatgaacttctttagcttttttag

SEQ ID NO: 604576 - DNA, 25 bp, Mus musculus
ggatgaacttgtcctccaaactgac

SEQ ID NO: 604577 - DNA, 25 bp, Mus musculus
ggatgaacttgtgctccaaactgac

SEQ ID NO: 604578 - DNA, 25 bp, Mus musculus
ggatgaactttcagacagtcttgga

SEQ ID NO: 604579 - DNA, 25 bp, Mus musculus
ggatgaactttctgacagtcttgga

SEQ ID NO: 604580 - DNA, 25 bp, Mus musculus
ggatgaagaaccatagcctgcctcc

SEQ ID NO: 604581 - DNA, 25 bp, Mus musculus
ggatgaagaacccaggccttcgact

SEQ ID NO: 604582 - DNA, 25 bp, Mus musculus
ggatgaagaaccgaggccttcgact

SEQ ID NO: 604583 - DNA, 25 bp, Mus musculus
ggatgaagaaccttagcctgcctcc

SEQ ID NO: 604584 - DNA, 25 bp, Mus musculus
ggatgaagaagtcccccagtcacgg

SEQ ID NO: 604585 - DNA, 25 bp, Mus musculus
ggatgaagaagtgccccagtcacgg

SEQ ID NO: 604586 - DNA, 25 bp, Mus musculus
ggatgaagacatcggcccaggactc

SEQ ID NO: 604587 - DNA, 25 bp, Mus musculus
ggatgaagacatgggcccaggactc

SEQ ID NO: 604588 - DNA, 25 bp, Mus musculus
ggatgaagacctcctgttcgaatag

SEQ ID NO: 604589 - DNA, 25 bp, Mus musculus
ggatgaagacctgctgttcgaatag

SEQ ID NO: 604590 - DNA, 25 bp, Mus musculus
ggatgaagacggattcctctacatg

SEQ ID NO: 604591 - DNA, 25 bp, Mus musculus
ggatgaagacggtttcctctacatg

SEQ ID NO: 604592 - DNA, 25 bp, Mus musculus
ggatgaagacttcaatagttacttt

SEQ ID NO: 604593 - DNA, 25 bp, Mus musculus
ggatgaagacttgaatagttacttt

SEQ ID NO: 604594 - DNA, 25 bp, Mus musculus
ggatgaagcaataacctggtttaat

SEQ ID NO: 604595 - DNA, 25 bp, Mus musculus
ggatgaagcaattacctggtttaat

SEQ ID NO: 604596 - DNA, 25 bp, Mus musculus
ggatgaagcattccagcaccctttc

SEQ ID NO: 604597 - DNA, 25 bp, Mus musculus
ggatgaagcattgcagcaccctttc

SEQ ID NO: 604598 - DNA, 25 bp, Mus musculus
ggatgaagcccaagcccacattgat

SEQ ID NO: 604599 - DNA, 25 bp, Mus musculus
ggatgaagcccatgcccacattgat

SEQ ID NO: 604600 - DNA, 25 bp, Mus musculus
ggatgaagccttccgaaagtttcta

SEQ ID NO: 604601 - DNA, 25 bp, Mus musculus
ggatgaagccttgcgaaagtttcta

SEQ ID NO: 604602 - DNA, 25 bp, Mus musculus
ggatgaagcgcacatctccaggctc

SEQ ID NO: 604603 - DNA, 25 bp, Mus musculus
ggatgaagcgcagatctccaggctc

SEQ ID NO: 604604 - DNA, 25 bp, Mus musculus
ggatgaagcggacagcatcttccct

SEQ ID NO: 604605 - DNA, 25 bp, Mus musculus
ggatgaagcggagagcatcttccct

SEQ ID NO: 604606 - DNA, 25 bp, Mus musculus
ggatgaagcttcaacttgtgcccaa

SEQ ID NO: 604607 - DNA, 25 bp, Mus musculus
ggatgaagcttctacttgtgcccaa

SEQ ID NO: 604608 - DNA, 25 bp, Mus musculus
ggatgaaggaacagcccctgaccca

SEQ ID NO: 604609 - DNA, 25 bp, Mus musculus
ggatgaaggaactgcccctgaccca

SEQ ID NO: 604610 - DNA, 25 bp, Mus musculus
ggatgaaggccaccaagcttgacaa

SEQ ID NO: 604611 - DNA, 25 bp, Mus musculus
ggatgaaggccagcaagcttgacaa

SEQ ID NO: 604612 - DNA, 25 bp, Mus musculus
ggatgaaggcttacgaggactcgtc

SEQ ID NO: 604613 - DNA, 25 bp, Mus musculus
ggatgaaggctttcgaggactcgtc

SEQ ID NO: 604614 - DNA, 25 bp, Mus musculus
ggatgaagggccatgctgccaagcc

SEQ ID NO: 604615 - DNA, 25 bp, Mus musculus
ggatgaagggccttgctgccaagcc

SEQ ID NO: 604616 - DNA, 25 bp, Mus musculus
ggatgaagtgcccacaaggcttccc

SEQ ID NO: 604617 - DNA, 25 bp, Mus musculus
ggatgaagtgccgacaaggcttccc

SEQ ID NO: 604618 - DNA, 25 bp, Mus musculus
ggatgaagttttacctcattgccct

SEQ ID NO: 604619 - DNA, 25 bp, Mus musculus
ggatgaagtttttcctcattgccct

SEQ ID NO: 604620 - DNA, 25 bp, Mus musculus
ggatgaataccaacccctcccgagg

SEQ ID NO: 604621 - DNA, 25 bp, Mus musculus
ggatgaataccatcccctcccgagg

SEQ ID NO: 604622 - DNA, 25 bp, Mus musculus
ggatgaatactgagtgctctgagca

SEQ ID NO: 604623 - DNA, 25 bp, Mus musculus
ggatgaatactgtgtgctctgagca

SEQ ID NO: 604624 - DNA, 25 bp, Mus musculus
ggatgaatattcacatgtacttttt

SEQ ID NO: 604625 - DNA, 25 bp, Mus musculus
ggatgaatattctcatgtacttttt

SEQ ID NO: 604626 - DNA, 25 bp, Mus musculus
ggatgaatcagcaagcaaacagcat

SEQ ID NO: 604627 - DNA, 25 bp, Mus musculus
ggatgaatcagctagcaaacagcat

SEQ ID NO: 604628 - DNA, 25 bp, Mus musculus
ggatgaatcttcaaaaccgaactct

SEQ ID NO: 604629 - DNA, 25 bp, Mus musculus
ggatgaatcttctaaaccgaactct

SEQ ID NO: 604630 - DNA, 25 bp, Mus musculus
ggatgaatggacacaaccctgctgt

SEQ ID NO: 604631 - DNA, 25 bp, Mus musculus
ggatgaatggactcaaccctgctgt

SEQ ID NO: 604632 - DNA, 25 bp, Mus musculus
ggatgaatggccatttttagttgta

SEQ ID NO: 604633 - DNA, 25 bp, Mus musculus
ggatgaatggccttttttagttgta

SEQ ID NO: 604634 - DNA, 25 bp, Mus musculus
ggatgaatgggcaaacccctagata

SEQ ID NO: 604635 - DNA, 25 bp, Mus musculus
ggatgaatgggctaacccctagata

SEQ ID NO: 604636 - DNA, 25 bp, Mus musculus
ggatgaatgtggatgcaatgctctt

SEQ ID NO: 604637 - DNA, 25 bp, Mus musculus
ggatgaatgtggttgcaatgctctt

SEQ ID NO: 604638 - DNA, 25 bp, Mus musculus
ggatgaattcacaactgccgatgtt

SEQ ID NO: 604639 - DNA, 25 bp, Mus musculus
ggatgaattcactactgccgatgtt

SEQ ID NO: 604640 - DNA, 25 bp, Mus musculus
ggatgaatttatatggcaggcccca

SEQ ID NO: 604641 - DNA, 25 bp, Mus musculus
ggatgaatttatttggcaggcccca

SEQ ID NO: 604642 - DNA, 25 bp, Mus musculus
ggatgacaaggcctgtgcacacttc

SEQ ID NO: 604643 - DNA, 25 bp, Mus musculus
ggatgacaaggcgtgtgcacacttc

SEQ ID NO: 604644 - DNA, 25 bp, Mus musculus
ggatgacaatctacctgatgtaaat

SEQ ID NO: 604645 - DNA, 25 bp, Mus musculus
ggatgacaatcttcctgatgtaaat

SEQ ID NO: 604646 - DNA, 25 bp, Mus musculus
ggatgacaccccatttcttgaaagg

SEQ ID NO: 604647 - DNA, 25 bp, Mus musculus
ggatgacaccccttttcttgaaagg

SEQ ID NO: 604648 - DNA, 25 bp, Mus musculus
ggatgacacggacgccatgagcaac

SEQ ID NO: 604649 - DNA, 25 bp, Mus musculus
ggatgacacggaggccatgagcaac

SEQ ID NO: 604650 - DNA, 25 bp, Mus musculus
ggatgacacttgcaggtgaccagct

SEQ ID NO: 604651 - DNA, 25 bp, Mus musculus
ggatgacacttggaggtgaccagct

SEQ ID NO: 604652 - DNA, 25 bp, Mus musculus
ggatgacagatgatgccggctagac

SEQ ID NO: 604653 - DNA, 25 bp, Mus musculus
ggatgacagatgttgccggctagac

SEQ ID NO: 604654 - DNA, 25 bp, Mus musculus
ggatgacagcaccaattccacactg

SEQ ID NO: 604655 - DNA, 25 bp, Mus musculus
ggatgacagcacgaattccacactg

SEQ ID NO: 604656 - DNA, 25 bp, Mus musculus
ggatgacagcctcaagcaccaacaa

SEQ ID NO: 604657 - DNA, 25 bp, Mus musculus
ggatgacagcctgaagcaccaacaa

SEQ ID NO: 604658 - DNA, 25 bp, Mus musculus
ggatgacagcttatacccttgggat

SEQ ID NO: 604659 - DNA, 25 bp, Mus musculus
ggatgacagcttttacccttgggat

SEQ ID NO: 604660 - DNA, 25 bp, Mus musculus
ggatgacagtaactgccctgtggcc

SEQ ID NO: 604661 - DNA, 25 bp, Mus musculus
ggatgacagtaagtgccctgtggcc

SEQ ID NO: 604662 - DNA, 25 bp, Mus musculus
ggatgacagtgtccctattttcgcc

SEQ ID NO: 604663 - DNA, 25 bp, Mus musculus
ggatgacagtgtgcctattttcgcc

SEQ ID NO: 604664 - DNA, 25 bp, Mus musculus
ggatgacatccgaagggcctttttc

SEQ ID NO: 604665 - DNA, 25 bp, Mus musculus
ggatgacatccgtagggcctttttc

SEQ ID NO: 604666 - DNA, 25 bp, Mus musculus
ggatgacatcctccagctctctgca

SEQ ID NO: 604667 - DNA, 25 bp, Mus musculus
ggatgacatcctccctgagcttggg

SEQ ID NO: 604668 - DNA, 25 bp, Mus musculus
ggatgacatcctgcagctctctgca

SEQ ID NO: 604669 - DNA, 25 bp, Mus musculus
ggatgacatcctgcctgagcttggg

SEQ ID NO: 604670 - DNA, 25 bp, Mus musculus
ggatgacatggcagacacttgcggt

SEQ ID NO: 604671 - DNA, 25 bp, Mus musculus
ggatgacatggctgacacttgcggt

SEQ ID NO: 604672 - DNA, 25 bp, Mus musculus
ggatgacatggtcccgtacattaaa

SEQ ID NO: 604673 - DNA, 25 bp, Mus musculus
ggatgacatggtgccgtacattaaa

SEQ ID NO: 604674 - DNA, 25 bp, Mus musculus
ggatgacatgtaatgggccactagc

SEQ ID NO: 604675 - DNA, 25 bp, Mus musculus
ggatgacatgtattgggccactagc

SEQ ID NO: 604676 - DNA, 25 bp, Mus musculus
ggatgacattcacatgtttcatgac

SEQ ID NO: 604677 - DNA, 25 bp, Mus musculus
ggatgacattcagatgtttcatgac

SEQ ID NO: 604678 - DNA, 25 bp, Mus musculus
ggatgaccaaacagcacatgagcca

SEQ ID NO: 604679 - DNA, 25 bp, Mus musculus
ggatgaccaaactgcacatgagcca

SEQ ID NO: 604680 - DNA, 25 bp, Mus musculus
ggatgaccaacaattccagggacca

SEQ ID NO: 604681 - DNA, 25 bp, Mus musculus
ggatgaccaacatttccagggacca

SEQ ID NO: 604682 - DNA, 25 bp, Mus musculus
ggatgaccaactcaattaccaccca

SEQ ID NO: 604683 - DNA, 25 bp, Mus musculus
ggatgaccaactgaattaccaccca

SEQ ID NO: 604684 - DNA, 25 bp, Mus musculus
ggatgaccagacctttctaacctta

SEQ ID NO: 604685 - DNA, 25 bp, Mus musculus
ggatgaccagacgtttctaacctta

SEQ ID NO: 604686 - DNA, 25 bp, Mus musculus
ggatgaccagatccgcacgtcactt

SEQ ID NO: 604687 - DNA, 25 bp, Mus musculus
ggatgaccagatgcgcacgtcactt

SEQ ID NO: 604688 - DNA, 25 bp, Mus musculus
ggatgaccagcacatctcagacagg

SEQ ID NO: 604689 - DNA, 25 bp, Mus musculus
ggatgaccagcagatctcagacagg

SEQ ID NO: 604690 - DNA, 25 bp, Mus musculus
ggatgaccagctcttacagaagaac

SEQ ID NO: 604691 - DNA, 25 bp, Mus musculus
ggatgaccagctgttacagaagaac

SEQ ID NO: 604692 - DNA, 25 bp, Mus musculus
ggatgaccatcgcacagagcctgga

SEQ ID NO: 604693 - DNA, 25 bp, Mus musculus
ggatgaccatcggacagagcctgga

SEQ ID NO: 604694 - DNA, 25 bp, Mus musculus
ggatgaccatgtccccacagagaac

SEQ ID NO: 604695 - DNA, 25 bp, Mus musculus
ggatgaccatgtgcccacagagaac

SEQ ID NO: 604696 - DNA, 25 bp, Mus musculus
ggatgacccaaaattccagtcctaa

SEQ ID NO: 604697 - DNA, 25 bp, Mus musculus
ggatgacccaaatttccagtcctaa

SEQ ID NO: 604698 - DNA, 25 bp, Mus musculus
ggatgacccactcgaggcattcaaa

SEQ ID NO: 604699 - DNA, 25 bp, Mus musculus
ggatgacccactggaggcattcaaa

SEQ ID NO: 604700 - DNA, 25 bp, Mus musculus
ggatgaccccaaaactccacgagtg

SEQ ID NO: 604701 - DNA, 25 bp, Mus musculus
ggatgaccccaatactccacgagtg

SEQ ID NO: 604702 - DNA, 25 bp, Mus musculus
ggatgacccggaagatagcagtgat

SEQ ID NO: 604703 - DNA, 25 bp, Mus musculus
ggatgacccggatgatagcagtgat

SEQ ID NO: 604704 - DNA, 25 bp, Mus musculus
ggatgaccctgacgtcattaacccc

SEQ ID NO: 604705 - DNA, 25 bp, Mus musculus
ggatgaccctgaggtcattaacccc

SEQ ID NO: 604706 - DNA, 25 bp, Mus musculus
ggatgaccgggtaccacattcgaat

SEQ ID NO: 604707 - DNA, 25 bp, Mus musculus
ggatgaccgggttccacattcgaat

SEQ ID NO: 604708 - DNA, 25 bp, Mus musculus
ggatgaccgtgtctgatatcaggat

SEQ ID NO: 604709 - DNA, 25 bp, Mus musculus
ggatgaccgtgtgtgatatcaggat

SEQ ID NO: 604710 - DNA, 25 bp, Mus musculus
ggatgaccgtttaccaaccaagaat

SEQ ID NO: 604711 - DNA, 25 bp, Mus musculus
ggatgaccgttttccaaccaagaat

SEQ ID NO: 604712 - DNA, 25 bp, Mus musculus
ggatgacctcatcaactgggcacgc

SEQ ID NO: 604713 - DNA, 25 bp, Mus musculus
ggatgacctcatccttattaaacta

SEQ ID NO: 604714 - DNA, 25 bp, Mus musculus
ggatgacctcatgaactgggcacgc

SEQ ID NO: 604715 - DNA, 25 bp, Mus musculus
ggatgacctcatgcttattaaacta

SEQ ID NO: 604716 - DNA, 25 bp, Mus musculus
ggatgacctcggaggcaacagccaa

SEQ ID NO: 604717 - DNA, 25 bp, Mus musculus
ggatgacctcggtggcaacagccaa

SEQ ID NO: 604718 - DNA, 25 bp, Mus musculus
ggatgacctggaaatgtcctccgat

SEQ ID NO: 604719 - DNA, 25 bp, Mus musculus
ggatgacctggatatgtcctccgat

SEQ ID NO: 604720 - DNA, 25 bp, Mus musculus
ggatgacctgtacctgtttcactga

SEQ ID NO: 604721 - DNA, 25 bp, Mus musculus
ggatgacctgtagctgtttcactga

SEQ ID NO: 604722 - DNA, 25 bp, Mus musculus
ggatgacctttaccaacaaacagtg

SEQ ID NO: 604723 - DNA, 25 bp, Mus musculus
ggatgacctttagcaacaaacagtg

SEQ ID NO: 604724 - DNA, 25 bp, Mus musculus
ggatgacgagacaggactctccggt

SEQ ID NO: 604725 - DNA, 25 bp, Mus musculus
ggatgacgagactggactctccggt

SEQ ID NO: 604726 - DNA, 25 bp, Mus musculus
ggatgacgccttcatttctaggaat

SEQ ID NO: 604727 - DNA, 25 bp, Mus musculus
ggatgacgccttgatttctaggaat

SEQ ID NO: 604728 - DNA, 25 bp, Mus musculus
ggatgacggcagacgtatccgagaa

SEQ ID NO: 604729 - DNA, 25 bp, Mus musculus
ggatgacggcagtcgtatccgagaa

SEQ ID NO: 604730 - DNA, 25 bp, Mus musculus
ggatgacgtacgcagaactctccat

SEQ ID NO: 604731 - DNA, 25 bp, Mus musculus
ggatgacgtacggagaactctccat

SEQ ID NO: 604732 - DNA, 25 bp, Mus musculus
ggatgacgtagtaatgccctggtat

SEQ ID NO: 604733 - DNA, 25 bp, Mus musculus
ggatgacgtagttatgccctggtat

SEQ ID NO: 604734 - DNA, 25 bp, Mus musculus
ggatgactaaccagttcacagcctg

SEQ ID NO: 604735 - DNA, 25 bp, Mus musculus
ggatgactaacctgttcacagcctg

SEQ ID NO: 604736 - DNA, 25 bp, Mus musculus
ggatgactaatcactctacttccac

SEQ ID NO: 604737 - DNA, 25 bp, Mus musculus
ggatgactaatctctctacttccac

SEQ ID NO: 604738 - DNA, 25 bp, Mus musculus
ggatgactaatgctaggccgctgcc

SEQ ID NO: 604739 - DNA, 25 bp, Mus musculus
ggatgactaatggtaggccgctgcc

SEQ ID NO: 604740 - DNA, 25 bp, Mus musculus
ggatgactcacacacaggcggttaa

SEQ ID NO: 604741 - DNA, 25 bp, Mus musculus
ggatgactcacagacaggcggttaa

SEQ ID NO: 604742 - DNA, 25 bp, Mus musculus
ggatgactcctacctaagttattgc

SEQ ID NO: 604743 - DNA, 25 bp, Mus musculus
ggatgactcctagctaagttattgc

SEQ ID NO: 604744 - DNA, 25 bp, Mus musculus
ggatgactcctgaaggcttctactg

SEQ ID NO: 604745 - DNA, 25 bp, Mus musculus
ggatgactcctgtaggcttctactg

SEQ ID NO: 604746 - DNA, 25 bp, Mus musculus
ggatgactctgaagctgtcggactt

SEQ ID NO: 604747 - DNA, 25 bp, Mus musculus
ggatgactctgaagtaccgctactg

SEQ ID NO: 604748 - DNA, 25 bp, Mus musculus
ggatgactctgaagtgggcaaggct

SEQ ID NO: 604749 - DNA, 25 bp, Mus musculus
ggatgactctgatgctgtcggactt

SEQ ID NO: 604750 - DNA, 25 bp, Mus musculus
ggatgactctgatgtaccgctactg

SEQ ID NO: 604751 - DNA, 25 bp, Mus musculus
ggatgactctgatgtgggcaaggct

SEQ ID NO: 604752 - DNA, 25 bp, Mus musculus
ggatgactgaccacaaactcactat

SEQ ID NO: 604753 - DNA, 25 bp, Mus musculus
ggatgactgacctcaaactcactat

SEQ ID NO: 604754 - DNA, 25 bp, Mus musculus
ggatgactgagtccttcataccagc

SEQ ID NO: 604755 - DNA, 25 bp, Mus musculus
ggatgactgagtgcttcataccagc

SEQ ID NO: 604756 - DNA, 25 bp, Mus musculus
ggatgactgattattgttgtcttaa

SEQ ID NO: 604757 - DNA, 25 bp, Mus musculus
ggatgactgatttttgttgtcttaa

SEQ ID NO: 604758 - DNA, 25 bp, Mus musculus
ggatgactgcaacctcctcaatggg

SEQ ID NO: 604759 - DNA, 25 bp, Mus musculus
ggatgactgcaagctcctcaatggg

SEQ ID NO: 604760 - DNA, 25 bp, Mus musculus
ggatgactgcagagggcctctgcca

SEQ ID NO: 604761 - DNA, 25 bp, Mus musculus
ggatgactgcagtgggcctctgcca

SEQ ID NO: 604762 - DNA, 25 bp, Mus musculus
ggatgactgcctagattcccatggg

SEQ ID NO: 604763 - DNA, 25 bp, Mus musculus
ggatgactgccttgattcccatggg

SEQ ID NO: 604764 - DNA, 25 bp, Mus musculus
ggatgactgtcaattctgggaagca

SEQ ID NO: 604765 - DNA, 25 bp, Mus musculus
ggatgactgtcatttctgggaagca

SEQ ID NO: 604766 - DNA, 25 bp, Mus musculus
ggatgactgtgtattctgaatacaa

SEQ ID NO: 604767 - DNA, 25 bp, Mus musculus
ggatgactgtgttttctgaatacaa

SEQ ID NO: 604768 - DNA, 25 bp, Mus musculus
ggatgacttaccagagaactcaccc

SEQ ID NO: 604769 - DNA, 25 bp, Mus musculus
ggatgacttacctgagaactcaccc

SEQ ID NO: 604770 - DNA, 25 bp, Mus musculus
ggatgacttatcattgtccttgtgt

SEQ ID NO: 604771 - DNA, 25 bp, Mus musculus
ggatgacttatctttgtccttgtgt

SEQ ID NO: 604772 - DNA, 25 bp, Mus musculus
ggatgacttggtcccattggaaatc

SEQ ID NO: 604773 - DNA, 25 bp, Mus musculus
ggatgacttggtgccattggaaatc

SEQ ID NO: 604774 - DNA, 25 bp, Mus musculus
ggatgactttgcacagttcctggat

SEQ ID NO: 604775 - DNA, 25 bp, Mus musculus
ggatgactttgctcagttcctggat

SEQ ID NO: 604776 - DNA, 25 bp, Mus musculus
ggatgactttttctcaccctaaaga

SEQ ID NO: 604777 - DNA, 25 bp, Mus musculus
ggatgactttttgtcaccctaaaga

SEQ ID NO: 604778 - DNA, 25 bp, Mus musculus
ggatgagaacacatttgataccaac

SEQ ID NO: 604779 - DNA, 25 bp, Mus musculus
ggatgagaacacttttgataccaac

SEQ ID NO: 604780 - DNA, 25 bp, Mus musculus
ggatgagaactacgtgactcccatt

SEQ ID NO: 604781 - DNA, 25 bp, Mus musculus
ggatgagaactaggtgactcccatt

SEQ ID NO: 604782 - DNA, 25 bp, Mus musculus
ggatgagaactgctgccgtcaatca

SEQ ID NO: 604783 - DNA, 25 bp, Mus musculus
ggatgagaactggtgccgtcaatca

SEQ ID NO: 604784 - DNA, 25 bp, Mus musculus
ggatgagaagagcagctaccacctg

SEQ ID NO: 604785 - DNA, 25 bp, Mus musculus
ggatgagaagaggagctaccacctg

SEQ ID NO: 604786 - DNA, 25 bp, Mus musculus
ggatgagacagactctttcagctga

SEQ ID NO: 604787 - DNA, 25 bp, Mus musculus
ggatgagacagagtctttcagctga

SEQ ID NO: 604788 - DNA, 25 bp, Mus musculus
ggatgagacagccatccattctgcc

SEQ ID NO: 604789 - DNA, 25 bp, Mus musculus
ggatgagacagcgatccattctgcc

SEQ ID NO: 604790 - DNA, 25 bp, Mus musculus
ggatgagacataatcgaaaactgca

SEQ ID NO: 604791 - DNA, 25 bp, Mus musculus
ggatgagacatattcgaaaactgca

SEQ ID NO: 604792 - DNA, 25 bp, Mus musculus
ggatgagaccgtcctgttccgctac

SEQ ID NO: 604793 - DNA, 25 bp, Mus musculus
ggatgagaccgtgctgttccgctac

SEQ ID NO: 604794 - DNA, 25 bp, Mus musculus
ggatgagactacaggcccactgcct

SEQ ID NO: 604795 - DNA, 25 bp, Mus musculus
ggatgagactactggcccactgcct

SEQ ID NO: 604796 - DNA, 25 bp, Mus musculus
ggatgagacttcatcttgaacagtg

SEQ ID NO: 604797 - DNA, 25 bp, Mus musculus
ggatgagacttcttcttgaacagtg

SEQ ID NO: 604798 - DNA, 25 bp, Mus musculus
ggatgagagacccttgctcttccca

SEQ ID NO: 604799 - DNA, 25 bp, Mus musculus
ggatgagagaccgttgctcttccca

SEQ ID NO: 604800 - DNA, 25 bp, Mus musculus
ggatgagagctcatcaccatcaccg

SEQ ID NO: 604801 - DNA, 25 bp, Mus musculus
ggatgagagctcttcaccatcaccg

SEQ ID NO: 604802 - DNA, 25 bp, Mus musculus
ggatgagagtccacagaaggctctg

SEQ ID NO: 604803 - DNA, 25 bp, Mus musculus
ggatgagagtcctcagaaggctctg

SEQ ID NO: 604804 - DNA, 25 bp, Mus musculus
ggatgagatcatcgccatcaatggc

SEQ ID NO: 604805 - DNA, 25 bp, Mus musculus
ggatgagatcatggccatcaatggc

SEQ ID NO: 604806 - DNA, 25 bp, Mus musculus
ggatgagatcctatccctgaacgga

SEQ ID NO: 604807 - DNA, 25 bp, Mus musculus
ggatgagatcctttccctgaacgga

SEQ ID NO: 604808 - DNA, 25 bp, Mus musculus
ggatgagatggacccgcctctgaat

SEQ ID NO: 604809 - DNA, 25 bp, Mus musculus
ggatgagatggagccgcctctgaat

SEQ ID NO: 604810 - DNA, 25 bp, Mus musculus
ggatgagcaaatcactgaatcttct

SEQ ID NO: 604811 - DNA, 25 bp, Mus musculus
ggatgagcaaatgactgaatcttct

SEQ ID NO: 604812 - DNA, 25 bp, Mus musculus
ggatgagcacatagatagtcctgag

SEQ ID NO: 604813 - DNA, 25 bp, Mus musculus
ggatgagcacatccgcacagactgc

SEQ ID NO: 604814 - DNA, 25 bp, Mus musculus
ggatgagcacatgcgcacagactgc

SEQ ID NO: 604815 - DNA, 25 bp, Mus musculus
ggatgagcacattgatagtcctgag

SEQ ID NO: 604816 - DNA, 25 bp, Mus musculus
ggatgagcacgtcacttgacggtca

SEQ ID NO: 604817 - DNA, 25 bp, Mus musculus
ggatgagcacgtgacttgacggtca

SEQ ID NO: 604818 - DNA, 25 bp, Mus musculus
ggatgagcagccaaagattccagct

SEQ ID NO: 604819 - DNA, 25 bp, Mus musculus
ggatgagcagcctaagattccagct

SEQ ID NO: 604820 - DNA, 25 bp, Mus musculus
ggatgagcaggccaagctccccgac

SEQ ID NO: 604821 - DNA, 25 bp, Mus musculus
ggatgagcaggcgaagctccccgac

SEQ ID NO: 604822 - DNA, 25 bp, Mus musculus
ggatgagccaccaaaattcactcct

SEQ ID NO: 604823 - DNA, 25 bp, Mus musculus
ggatgagccacctaaattcactcct

SEQ ID NO: 604824 - DNA, 25 bp, Mus musculus
ggatgagcccatcgccaagaagcct

SEQ ID NO: 604825 - DNA, 25 bp, Mus musculus
ggatgagcccatggccaagaagcct

SEQ ID NO: 604826 - DNA, 25 bp, Mus musculus
ggatgagccccaagaacctcaagag

SEQ ID NO: 604827 - DNA, 25 bp, Mus musculus
ggatgagccccatgaacctcaagag

SEQ ID NO: 604828 - DNA, 25 bp, Mus musculus
ggatgagcccttctttcatcatgga

SEQ ID NO: 604829 - DNA, 25 bp, Mus musculus
ggatgagcccttgtttcatcatgga

SEQ ID NO: 604830 - DNA, 25 bp, Mus musculus
ggatgagcctgcagatttggtttca

SEQ ID NO: 604831 - DNA, 25 bp, Mus musculus
ggatgagcctgctgatttggtttca

SEQ ID NO: 604832 - DNA, 25 bp, Mus musculus
ggatgagcgcagcagatgtctttca

SEQ ID NO: 604833 - DNA, 25 bp, Mus musculus
ggatgagcgcaggagatgtctttca

SEQ ID NO: 604834 - DNA, 25 bp, Mus musculus
ggatgagcgtctacccaggacagca

SEQ ID NO: 604835 - DNA, 25 bp, Mus musculus
ggatgagcgtcttcccaggacagca

SEQ ID NO: 604836 - DNA, 25 bp, Mus musculus
ggatgagctcaccatgatatacatg

SEQ ID NO: 604837 - DNA, 25 bp, Mus musculus
ggatgagctcacgatgatatacatg

SEQ ID NO: 604838 - DNA, 25 bp, Mus musculus
ggatgagctgcccttctgaaccgta

SEQ ID NO: 604839 - DNA, 25 bp, Mus musculus
ggatgagctgccgttctgaaccgta

SEQ ID NO: 604840 - DNA, 25 bp, Mus musculus
ggatgagctgggaacaaacttgtgt

SEQ ID NO: 604841 - DNA, 25 bp, Mus musculus
ggatgagctgggtacaaacttgtgt

SEQ ID NO: 604842 - DNA, 25 bp, Mus musculus
ggatgagctgtgatcactatttaga

SEQ ID NO: 604843 - DNA, 25 bp, Mus musculus
ggatgagctgtgttcactatttaga

SEQ ID NO: 604844 - DNA, 25 bp, Mus musculus
ggatgagcttcgatcttaacccagc

SEQ ID NO: 604845 - DNA, 25 bp, Mus musculus
ggatgagcttcgttcttaacccagc

SEQ ID NO: 604846 - DNA, 25 bp, Mus musculus
ggatgagctttcctgaaccagcaac

SEQ ID NO: 604847 - DNA, 25 bp, Mus musculus
ggatgagctttcgtgaaccagcaac

SEQ ID NO: 604848 - DNA, 25 bp, Mus musculus
ggatgaggaacactctcgcctggta

SEQ ID NO: 604849 - DNA, 25 bp, Mus musculus
ggatgaggaacagtctcgcctggta

SEQ ID NO: 604850 - DNA, 25 bp, Mus musculus
ggatgaggatccagcgccggcttct

SEQ ID NO: 604851 - DNA, 25 bp, Mus musculus
ggatgaggatcctgcgccggcttct

SEQ ID NO: 604852 - DNA, 25 bp, Mus musculus
ggatgagggcgcaagcgaccttacc

SEQ ID NO: 604853 - DNA, 25 bp, Mus musculus
ggatgagggcgctagcgaccttacc

SEQ ID NO: 604854 - DNA, 25 bp, Mus musculus
ggatgagggtacacagccgcgttaa

SEQ ID NO: 604855 - DNA, 25 bp, Mus musculus
ggatgagggtactcagccgcgttaa

SEQ ID NO: 604856 - DNA, 25 bp, Mus musculus
ggatgaggtcacatgatctcctggg

SEQ ID NO: 604857 - DNA, 25 bp, Mus musculus
ggatgaggtcacttgatctcctggg

SEQ ID NO: 604858 - DNA, 25 bp, Mus musculus
ggatgaggtcttcatcaagctggat

SEQ ID NO: 604859 - DNA, 25 bp, Mus musculus
ggatgaggtcttgatcaagctggat

SEQ ID NO: 604860 - DNA, 25 bp, Mus musculus
ggatgagtaagtatcgtcccagaaa

SEQ ID NO: 604861 - DNA, 25 bp, Mus musculus
ggatgagtaagtttcgtcccagaaa

SEQ ID NO: 604862 - DNA, 25 bp, Mus musculus
ggatgagtccagacgctttgcccag

SEQ ID NO: 604863 - DNA, 25 bp, Mus musculus
ggatgagtccagtcgctttgcccag

SEQ ID NO: 604864 - DNA, 25 bp, Mus musculus
ggatgagtccttaggtggccctcta

SEQ ID NO: 604865 - DNA, 25 bp, Mus musculus
ggatgagtcctttggtggccctcta

SEQ ID NO: 604866 - DNA, 25 bp, Mus musculus
ggatgagtctagactgcacctcaaa

SEQ ID NO: 604867 - DNA, 25 bp, Mus musculus
ggatgagtctagtctgcacctcaaa

SEQ ID NO: 604868 - DNA, 25 bp, Mus musculus
ggatgagtgagtcatggctcctctt

SEQ ID NO: 604869 - DNA, 25 bp, Mus musculus
ggatgagtgagtgatggctcctctt

SEQ ID NO: 604870 - DNA, 25 bp, Mus musculus
ggatgagtgcatcccctgggaggtg

SEQ ID NO: 604871 - DNA, 25 bp, Mus musculus
ggatgagtgcatgccctgggaggtg

SEQ ID NO: 604872 - DNA, 25 bp, Mus musculus
ggatgagtgctaaagttggctacta

SEQ ID NO: 604873 - DNA, 25 bp, Mus musculus
ggatgagtgctatagttggctacta

SEQ ID NO: 604874 - DNA, 25 bp, Mus musculus
ggatgagttcccaattaatcatagt

SEQ ID NO: 604875 - DNA, 25 bp, Mus musculus
ggatgagttccctattaatcatagt

SEQ ID NO: 604876 - DNA, 25 bp, Mus musculus
ggatgagttcctcttcagcgacctg

SEQ ID NO: 604877 - DNA, 25 bp, Mus musculus
ggatgagttcctgttcagcgacctg

SEQ ID NO: 604878 - DNA, 25 bp, Mus musculus
ggatgagttctgctttggtccacac

SEQ ID NO: 604879 - DNA, 25 bp, Mus musculus
ggatgagttctggtttggtccacac

SEQ ID NO: 604880 - DNA, 25 bp, Mus musculus
ggatgagttcttctgctcacactgc

SEQ ID NO: 604881 - DNA, 25 bp, Mus musculus
ggatgagttcttgtgctcacactgc

SEQ ID NO: 604882 - DNA, 25 bp, Mus musculus
ggatgagttgtcagcacagtgtttt

SEQ ID NO: 604883 - DNA, 25 bp, Mus musculus
ggatgagttgtctgcacagtgtttt

SEQ ID NO: 604884 - DNA, 25 bp, Mus musculus
ggatgagtttgacctggagcttatt

SEQ ID NO: 604885 - DNA, 25 bp, Mus musculus
ggatgagtttgagctggagcttatt

SEQ ID NO: 604886 - DNA, 25 bp, Mus musculus
ggatgatacactatctgctgacaca

SEQ ID NO: 604887 - DNA, 25 bp, Mus musculus
ggatgatacactttctgctgacaca

SEQ ID NO: 604888 - DNA, 25 bp, Mus musculus
ggatgatagtgccaactgctactag

SEQ ID NO: 604889 - DNA, 25 bp, Mus musculus
ggatgatagtgcgaactgctactag

SEQ ID NO: 604890 - DNA, 25 bp, Mus musculus
ggatgatatcttcggccttatttgt

SEQ ID NO: 604891 - DNA, 25 bp, Mus musculus
ggatgatatcttgggccttatttgt

SEQ ID NO: 604892 - DNA, 25 bp, Mus musculus
ggatgatattacatgtccctccatt

SEQ ID NO: 604893 - DNA, 25 bp, Mus musculus
ggatgatattacttgtccctccatt

SEQ ID NO: 604894 - DNA, 25 bp, Mus musculus
ggatgatattccactttcggaattt

SEQ ID NO: 604895 - DNA, 25 bp, Mus musculus
ggatgatattcctctttcggaattt

SEQ ID NO: 604896 - DNA, 25 bp, Mus musculus
ggatgatattgcaatgacattctta

SEQ ID NO: 604897 - DNA, 25 bp, Mus musculus
ggatgatattgctatgacattctta

SEQ ID NO: 604898 - DNA, 25 bp, Mus musculus
ggatgatcacggacgtgcagctcgc

SEQ ID NO: 604899 - DNA, 25 bp, Mus musculus
ggatgatcacggtcgtgcagctcgc

SEQ ID NO: 604900 - DNA, 25 bp, Mus musculus
ggatgatcagtccggggcgctgcat

SEQ ID NO: 604901 - DNA, 25 bp, Mus musculus
ggatgatcagtcgggggcgctgcat

SEQ ID NO: 604902 - DNA, 25 bp, Mus musculus
ggatgatccagactgtgccctgcac

SEQ ID NO: 604903 - DNA, 25 bp, Mus musculus
ggatgatccagagtgtgccctgcac

SEQ ID NO: 604904 - DNA, 25 bp, Mus musculus
ggatgatcccgccaattacagagac

SEQ ID NO: 604905 - DNA, 25 bp, Mus musculus
ggatgatcccgcgaattacagagac

SEQ ID NO: 604906 - DNA, 25 bp, Mus musculus
ggatgatctaaccaaggaggacctg

SEQ ID NO: 604907 - DNA, 25 bp, Mus musculus
ggatgatctaacgaaggaggacctg

SEQ ID NO: 604908 - DNA, 25 bp, Mus musculus
ggatgatctagtattgcccaacgta

SEQ ID NO: 604909 - DNA, 25 bp, Mus musculus
ggatgatctagttttgcccaacgta

SEQ ID NO: 604910 - DNA, 25 bp, Mus musculus
ggatgatctgttaacctctagagat

SEQ ID NO: 604911 - DNA, 25 bp, Mus musculus
ggatgatctgtttacctctagagat

SEQ ID NO: 604912 - DNA, 25 bp, Mus musculus
ggatgatgaaaacctaactgccttc

SEQ ID NO: 604913 - DNA, 25 bp, Mus musculus
ggatgatgaaaagctaactgccttc

SEQ ID NO: 604914 - DNA, 25 bp, Mus musculus
ggatgatgaacaacaccccagaggt

SEQ ID NO: 604915 - DNA, 25 bp, Mus musculus
ggatgatgaacatcaccccagaggt

SEQ ID NO: 604916 - DNA, 25 bp, Mus musculus
ggatgatgacaaaaaccgctgctat

SEQ ID NO: 604917 - DNA, 25 bp, Mus musculus
ggatgatgacaataaccgctgctat

SEQ ID NO: 604918 - DNA, 25 bp, Mus musculus
ggatgatgacttcatggacgtatga

SEQ ID NO: 604919 - DNA, 25 bp, Mus musculus
ggatgatgacttgatggacgtatga

SEQ ID NO: 604920 - DNA, 25 bp, Mus musculus
ggatgatgatatacgccaccaaatg

SEQ ID NO: 604921 - DNA, 25 bp, Mus musculus
ggatgatgatattcgccaccaaatg

SEQ ID NO: 604922 - DNA, 25 bp, Mus musculus
ggatgatgatccagatggccttcta

SEQ ID NO: 604923 - DNA, 25 bp, Mus musculus
ggatgatgatcctgatggccttcta

SEQ ID NO: 604924 - DNA, 25 bp, Mus musculus
ggatgatgatgtaccagatcttgta

SEQ ID NO: 604925 - DNA, 25 bp, Mus musculus
ggatgatgatgttccagatcttgta

SEQ ID NO: 604926 - DNA, 25 bp, Mus musculus
ggatgatgcctgagattccaccagc

SEQ ID NO: 604927 - DNA, 25 bp, Mus musculus
ggatgatgcctgtgattccaccagc

SEQ ID NO: 604928 - DNA, 25 bp, Mus musculus
ggatgatgcgatattggagtgatta

SEQ ID NO: 604929 - DNA, 25 bp, Mus musculus
ggatgatgcgattttggagtgatta

SEQ ID NO: 604930 - DNA, 25 bp, Mus musculus
ggatgatgcgcaactgcttgaggaa

SEQ ID NO: 604931 - DNA, 25 bp, Mus musculus
ggatgatgcgcatctgcttgaggaa

SEQ ID NO: 604932 - DNA, 25 bp, Mus musculus
ggatgatgctggaaaaatagaacat

SEQ ID NO: 604933 - DNA, 25 bp, Mus musculus
ggatgatgctggtaaaatagaacat

SEQ ID NO: 604934 - DNA, 25 bp, Mus musculus
ggatgatggattaccctcgtatgct

SEQ ID NO: 604935 - DNA, 25 bp, Mus musculus
ggatgatggatttccctcgtatgct

SEQ ID NO: 604936 - DNA, 25 bp, Mus musculus
ggatgatggcctacaagctctaagg

SEQ ID NO: 604937 - DNA, 25 bp, Mus musculus
ggatgatggccttcaagctctaagg

SEQ ID NO: 604938 - DNA, 25 bp, Mus musculus
ggatgatgtcacagtgtaactcaca

SEQ ID NO: 604939 - DNA, 25 bp, Mus musculus
ggatgatgtcactgtgtaactcaca

SEQ ID NO: 604940 - DNA, 25 bp, Mus musculus
ggatgatgtccccatcgctgcgtgc

SEQ ID NO: 604941 - DNA, 25 bp, Mus musculus
ggatgatgtcccgatcgctgcgtgc

SEQ ID NO: 604942 - DNA, 25 bp, Mus musculus
ggatgatgtctcatatcccttatcc

SEQ ID NO: 604943 - DNA, 25 bp, Mus musculus
ggatgatgtctcttatcccttatcc

SEQ ID NO: 604944 - DNA, 25 bp, Mus musculus
ggatgatgttgcaatctctgctatt

SEQ ID NO: 604945 - DNA, 25 bp, Mus musculus
ggatgatgttgctatctctgctatt

SEQ ID NO: 604946 - DNA, 25 bp, Mus musculus
ggatgattaaccatttccaaatgaa

SEQ ID NO: 604947 - DNA, 25 bp, Mus musculus
ggatgattaaccttttccaaatgaa

SEQ ID NO: 604948 - DNA, 25 bp, Mus musculus
ggatgattactacgacaccggcgag

SEQ ID NO: 604949 - DNA, 25 bp, Mus musculus
ggatgattactaggacaccggcgag

SEQ ID NO: 604950 - DNA, 25 bp, Mus musculus
ggatgattcaacatgttattctata

SEQ ID NO: 604951 - DNA, 25 bp, Mus musculus
ggatgattcaacttgttattctata

SEQ ID NO: 604952 - DNA, 25 bp, Mus musculus
ggatgattcagaaccctggtgggca

SEQ ID NO: 604953 - DNA, 25 bp, Mus musculus
ggatgattcagatccctggtgggca

SEQ ID NO: 604954 - DNA, 25 bp, Mus musculus
ggatgattcatacaaggccctagtt

SEQ ID NO: 604955 - DNA, 25 bp, Mus musculus
ggatgattcatagaaggccctagtt

SEQ ID NO: 604956 - DNA, 25 bp, Mus musculus
ggatgattcgtactcgcctgaaacc

SEQ ID NO: 604957 - DNA, 25 bp, Mus musculus
ggatgattcgtagtcgcctgaaacc

SEQ ID NO: 604958 - DNA, 25 bp, Mus musculus
ggatgattctgacagctaactagct

SEQ ID NO: 604959 - DNA, 25 bp, Mus musculus
ggatgattctgagagctaactagct

SEQ ID NO: 604960 - DNA, 25 bp, Mus musculus
ggatgattcttgcaatctaccattt

SEQ ID NO: 604961 - DNA, 25 bp, Mus musculus
ggatgattcttggaatctaccattt

SEQ ID NO: 604962 - DNA, 25 bp, Mus musculus
ggatgattctttcagcatagttctt

SEQ ID NO: 604963 - DNA, 25 bp, Mus musculus
ggatgattctttgagcatagttctt

SEQ ID NO: 604964 - DNA, 25 bp, Mus musculus
ggatgattgcccagagtgtgacagc

SEQ ID NO: 604965 - DNA, 25 bp, Mus musculus
ggatgattgccctgagtgtgacagc

SEQ ID NO: 604966 - DNA, 25 bp, Mus musculus
ggatgattgctactgttcatgtgca

SEQ ID NO: 604967 - DNA, 25 bp, Mus musculus
ggatgattgctagtgttcatgtgca

SEQ ID NO: 604968 - DNA, 25 bp, Mus musculus
ggatgatttaagacccgaatgctgg

SEQ ID NO: 604969 - DNA, 25 bp, Mus musculus
ggatgatttaagtcccgaatgctgg

SEQ ID NO: 604970 - DNA, 25 bp, Mus musculus
ggatgatttcataaggttctctgat

SEQ ID NO: 604971 - DNA, 25 bp, Mus musculus
ggatgatttcattaggttctctgat

SEQ ID NO: 604972 - DNA, 25 bp, Mus musculus
ggatgatttccccattgtgttggtt

SEQ ID NO: 604973 - DNA, 25 bp, Mus musculus
ggatgatttcccgattgtgttggtt

SEQ ID NO: 604974 - DNA, 25 bp, Mus musculus
ggatgatttgctcttggctcttctg

SEQ ID NO: 604975 - DNA, 25 bp, Mus musculus
ggatgatttgctgttggctcttctg

SEQ ID NO: 604976 - DNA, 25 bp, Mus musculus
ggatgatttgtacttgcttacattt

SEQ ID NO: 604977 - DNA, 25 bp, Mus musculus
ggatgatttgtagttgcttacattt

SEQ ID NO: 604978 - DNA, 25 bp, Mus musculus
ggatgattttgtctttggcgatcaa

SEQ ID NO: 604979 - DNA, 25 bp, Mus musculus
ggatgattttgtgtttggcgatcaa

SEQ ID NO: 604980 - DNA, 25 bp, Mus musculus
ggatgcaaagatagccaggcccttc

SEQ ID NO: 604981 - DNA, 25 bp, Mus musculus
ggatgcaaagattgccaggcccttc

SEQ ID NO: 604982 - DNA, 25 bp, Mus musculus
ggatgcaaatgcactcctctaagag

SEQ ID NO: 604983 - DNA, 25 bp, Mus musculus
ggatgcaaatgctctcctctaagag

SEQ ID NO: 604984 - DNA, 25 bp, Mus musculus
ggatgcaacccgactgcgtgtctgg

SEQ ID NO: 604985 - DNA, 25 bp, Mus musculus
ggatgcaacccgtctgcgtgtctgg

SEQ ID NO: 604986 - DNA, 25 bp, Mus musculus
ggatgcaacgatatgcccagcagca

SEQ ID NO: 604987 - DNA, 25 bp, Mus musculus
ggatgcaacgatttgcccagcagca

SEQ ID NO: 604988 - DNA, 25 bp, Mus musculus
ggatgcaactaaccttactccaaga

SEQ ID NO: 604989 - DNA, 25 bp, Mus musculus
ggatgcaactaagcttactccaaga

SEQ ID NO: 604990 - DNA, 25 bp, Mus musculus
ggatgcaactggagttttggatttt

SEQ ID NO: 604991 - DNA, 25 bp, Mus musculus
ggatgcaactggtgttttggatttt

SEQ ID NO: 604992 - DNA, 25 bp, Mus musculus
ggatgcaacttaccttaacagtgta

SEQ ID NO: 604993 - DNA, 25 bp, Mus musculus
ggatgcaacttagcttaacagtgta

SEQ ID NO: 604994 - DNA, 25 bp, Mus musculus
ggatgcaacttcagaaattccttgg

SEQ ID NO: 604995 - DNA, 25 bp, Mus musculus
ggatgcaacttctgaaattccttgg

SEQ ID NO: 604996 - DNA, 25 bp, Mus musculus
ggatgcaactttagaaggctctcgc

SEQ ID NO: 604997 - DNA, 25 bp, Mus musculus
ggatgcaacttttgaaggctctcgc

SEQ ID NO: 604998 - DNA, 25 bp, Mus musculus
ggatgcaagttcagctccaagcaac

SEQ ID NO: 604999 - DNA, 25 bp, Mus musculus
ggatgcaagttctgctccaagcaac

SEQ ID NO: 605000 - DNA, 25 bp, Mus musculus
ggatgcaatattatcccttataatg

SEQ ID NO: 605001 - DNA, 25 bp, Mus musculus
ggatgcaatattttcccttataatg

SEQ ID NO: 605002 - DNA, 25 bp, Mus musculus
ggatgcacaacgctatcaaaagcta

SEQ ID NO: 605003 - DNA, 25 bp, Mus musculus
ggatgcacaacggtatcaaaagcta

SEQ ID NO: 605004 - DNA, 25 bp, Mus musculus
ggatgcacacacatggaccaagacc

SEQ ID NO: 605005 - DNA, 25 bp, Mus musculus
ggatgcacacacttggaccaagacc

SEQ ID NO: 605006 - DNA, 25 bp, Mus musculus
ggatgcacactgaccacagggcctg

SEQ ID NO: 605007 - DNA, 25 bp, Mus musculus
ggatgcacactgtccacagggcctg

SEQ ID NO: 605008 - DNA, 25 bp, Mus musculus
ggatgcacagcaactccatacagat

SEQ ID NO: 605009 - DNA, 25 bp, Mus musculus
ggatgcacagcactgtcacccaagc

SEQ ID NO: 605010 - DNA, 25 bp, Mus musculus
ggatgcacagcagtgtcacccaagc

SEQ ID NO: 605011 - DNA, 25 bp, Mus musculus
ggatgcacagcatctccatacagat

SEQ ID NO: 605012 - DNA, 25 bp, Mus musculus
ggatgcacagttactccagatctac

SEQ ID NO: 605013 - DNA, 25 bp, Mus musculus
ggatgcacagtttctccagatctac

SEQ ID NO: 605014 - DNA, 25 bp, Mus musculus
ggatgcacattaccctgtattccag

SEQ ID NO: 605015 - DNA, 25 bp, Mus musculus
ggatgcacattagcctgtattccag

SEQ ID NO: 605016 - DNA, 25 bp, Mus musculus
ggatgcaccacaccacagagcaggg

SEQ ID NO: 605017 - DNA, 25 bp, Mus musculus
ggatgcaccacagcacagagcaggg

SEQ ID NO: 605018 - DNA, 25 bp, Mus musculus
ggatgcacctagaattaaaattgct

SEQ ID NO: 605019 - DNA, 25 bp, Mus musculus
ggatgcacctagtattaaaattgct

SEQ ID NO: 605020 - DNA, 25 bp, Mus musculus
ggatgcacctatatctttcttctct

SEQ ID NO: 605021 - DNA, 25 bp, Mus musculus
ggatgcacctatttctttcttctct

SEQ ID NO: 605022 - DNA, 25 bp, Mus musculus
ggatgcacggatcgactacctgaga

SEQ ID NO: 605023 - DNA, 25 bp, Mus musculus
ggatgcacggatggactacctgaga

SEQ ID NO: 605024 - DNA, 25 bp, Mus musculus
ggatgcacgtcaaaccagtagcccg

SEQ ID NO: 605025 - DNA, 25 bp, Mus musculus
ggatgcacgtcataccagtagcccg

SEQ ID NO: 605026 - DNA, 25 bp, Mus musculus
ggatgcacgtgacactgactgactt

SEQ ID NO: 605027 - DNA, 25 bp, Mus musculus
ggatgcacgtgagactgactgactt

SEQ ID NO: 605028 - DNA, 25 bp, Mus musculus
ggatgcactaagaattgctcttgtt

SEQ ID NO: 605029 - DNA, 25 bp, Mus musculus
ggatgcactaagtattgctcttgtt

SEQ ID NO: 605030 - DNA, 25 bp, Mus musculus
ggatgcactatgatggcctcagaaa

SEQ ID NO: 605031 - DNA, 25 bp, Mus musculus
ggatgcactatgttggcctcagaaa

SEQ ID NO: 605032 - DNA, 25 bp, Mus musculus
ggatgcactcaacaacctgaggtta

SEQ ID NO: 605033 - DNA, 25 bp, Mus musculus
ggatgcactcaagaacctgaggtta

SEQ ID NO: 605034 - DNA, 25 bp, Mus musculus
ggatgcactgtgagttcagagcctt

SEQ ID NO: 605035 - DNA, 25 bp, Mus musculus
ggatgcactgtgatactctccagga

SEQ ID NO: 605036 - DNA, 25 bp, Mus musculus
ggatgcactgtgtgttcagagcctt

SEQ ID NO: 605037 - DNA, 25 bp, Mus musculus
ggatgcactgtgttactctccagga

SEQ ID NO: 605038 - DNA, 25 bp, Mus musculus
ggatgcacttgaatagctggatctt

SEQ ID NO: 605039 - DNA, 25 bp, Mus musculus
ggatgcacttgattagctggatctt

SEQ ID NO: 605040 - DNA, 25 bp, Mus musculus
ggatgcagacggagagctcccttct

SEQ ID NO: 605041 - DNA, 25 bp, Mus musculus
ggatgcagacggtgagctcccttct

SEQ ID NO: 605042 - DNA, 25 bp, Mus musculus
ggatgcagagacctatttcaactac

SEQ ID NO: 605043 - DNA, 25 bp, Mus musculus
ggatgcagagacgtatttcaactac

SEQ ID NO: 605044 - DNA, 25 bp, Mus musculus
ggatgcagagcacccgtgtcttcat

SEQ ID NO: 605045 - DNA, 25 bp, Mus musculus
ggatgcagagcagccgtgtcttcat

SEQ ID NO: 605046 - DNA, 25 bp, Mus musculus
ggatgcagagccctcttgtgatgaa

SEQ ID NO: 605047 - DNA, 25 bp, Mus musculus
ggatgcagagccgtcttgtgatgaa

SEQ ID NO: 605048 - DNA, 25 bp, Mus musculus
ggatgcagaggcatgtttgtctcat

SEQ ID NO: 605049 - DNA, 25 bp, Mus musculus
ggatgcagaggcttgtttgtctcat

SEQ ID NO: 605050 - DNA, 25 bp, Mus musculus
ggatgcagatcaagacccattttcc

SEQ ID NO: 605051 - DNA, 25 bp, Mus musculus
ggatgcagatcatgacccattttcc

SEQ ID NO: 605052 - DNA, 25 bp, Mus musculus
ggatgcagatttccacatatggact

SEQ ID NO: 605053 - DNA, 25 bp, Mus musculus
ggatgcagatttgcacatatggact

SEQ ID NO: 605054 - DNA, 25 bp, Mus musculus
ggatgcagcacccataatataattt

SEQ ID NO: 605055 - DNA, 25 bp, Mus musculus
ggatgcagcaccgataatataattt

SEQ ID NO: 605056 - DNA, 25 bp, Mus musculus
ggatgcagcactcgaggctgaccta

SEQ ID NO: 605057 - DNA, 25 bp, Mus musculus
ggatgcagcactggaggctgaccta

SEQ ID NO: 605058 - DNA, 25 bp, Mus musculus
ggatgcagcataattcttggcacag

SEQ ID NO: 605059 - DNA, 25 bp, Mus musculus
ggatgcagcataatttcagaacaga

SEQ ID NO: 605060 - DNA, 25 bp, Mus musculus
ggatgcagcatatttcttggcacag

SEQ ID NO: 605061 - DNA, 25 bp, Mus musculus
ggatgcagcatattttcagaacaga

SEQ ID NO: 605062 - DNA, 25 bp, Mus musculus
ggatgcagccctcatctgaaattac

SEQ ID NO: 605063 - DNA, 25 bp, Mus musculus
ggatgcagccctgatctgaaattac

SEQ ID NO: 605064 - DNA, 25 bp, Mus musculus
ggatgcagcctcactgtaggaatat

SEQ ID NO: 605065 - DNA, 25 bp, Mus musculus
ggatgcagcctctctgtaggaatat

SEQ ID NO: 605066 - DNA, 25 bp, Mus musculus
ggatgcagccttcaatgatctcctt

SEQ ID NO: 605067 - DNA, 25 bp, Mus musculus
ggatgcagccttgaatgatctcctt

SEQ ID NO: 605068 - DNA, 25 bp, Mus musculus
ggatgcagctcccttcaaggccgag

SEQ ID NO: 605069 - DNA, 25 bp, Mus musculus
ggatgcagctccgttcaaggccgag

SEQ ID NO: 605070 - DNA, 25 bp, Mus musculus
ggatgcaggactaccttcctatgaa

SEQ ID NO: 605071 - DNA, 25 bp, Mus musculus
ggatgcaggacttccttcctatgaa

SEQ ID NO: 605072 - DNA, 25 bp, Mus musculus
ggatgcaggatcaaaaaccttctga

SEQ ID NO: 605073 - DNA, 25 bp, Mus musculus
ggatgcaggatctaaaaccttctga

SEQ ID NO: 605074 - DNA, 25 bp, Mus musculus
ggatgcaggatgatctaggccgtta

SEQ ID NO: 605075 - DNA, 25 bp, Mus musculus
ggatgcaggatgttctaggccgtta

SEQ ID NO: 605076 - DNA, 25 bp, Mus musculus
ggatgcaggccaaccttgctgaaaa

SEQ ID NO: 605077 - DNA, 25 bp, Mus musculus
ggatgcaggccatccttgctgaaaa

SEQ ID NO: 605078 - DNA, 25 bp, Mus musculus
ggatgcaggcgcacagctgacactt

SEQ ID NO: 605079 - DNA, 25 bp, Mus musculus
ggatgcaggcgctcagctgacactt

SEQ ID NO: 605080 - DNA, 25 bp, Mus musculus
ggatgcagtattcagcagccagctg

SEQ ID NO: 605081 - DNA, 25 bp, Mus musculus
ggatgcagtattgagcagccagctg

SEQ ID NO: 605082 - DNA, 25 bp, Mus musculus
ggatgcagtcacatctgtactacaa

SEQ ID NO: 605083 - DNA, 25 bp, Mus musculus
ggatgcagtcacttctgtactacaa

SEQ ID NO: 605084 - DNA, 25 bp, Mus musculus
ggatgcagtcagaactaaatgtcga

SEQ ID NO: 605085 - DNA, 25 bp, Mus musculus
ggatgcagtcagtactaaatgtcga

SEQ ID NO: 605086 - DNA, 25 bp, Mus musculus
ggatgcagtccacagaaaccacaat

SEQ ID NO: 605087 - DNA, 25 bp, Mus musculus
ggatgcagtccagagaaaccacaat

SEQ ID NO: 605088 - DNA, 25 bp, Mus musculus
ggatgcagtgacagtcttaaccttt

SEQ ID NO: 605089 - DNA, 25 bp, Mus musculus
ggatgcagtgactgtcttaaccttt

SEQ ID NO: 605090 - DNA, 25 bp, Mus musculus
ggatgcataaacaatcttgtctcat

SEQ ID NO: 605091 - DNA, 25 bp, Mus musculus
ggatgcataaactatcttgtctcat

SEQ ID NO: 605092 - DNA, 25 bp, Mus musculus
ggatgcataggacccaagatgtcag

SEQ ID NO: 605093 - DNA, 25 bp, Mus musculus
ggatgcataggagccaagatgtcag

SEQ ID NO: 605094 - DNA, 25 bp, Mus musculus
ggatgcatattcctaactactgtat

SEQ ID NO: 605095 - DNA, 25 bp, Mus musculus
ggatgcatattcgtaactactgtat

SEQ ID NO: 605096 - DNA, 25 bp, Mus musculus
ggatgcatcacactggtatgaaact

SEQ ID NO: 605097 - DNA, 25 bp, Mus musculus
ggatgcatcacagtggtatgaaact

SEQ ID NO: 605098 - DNA, 25 bp, Mus musculus
ggatgcatcagcagaacctgtgcat

SEQ ID NO: 605099 - DNA, 25 bp, Mus musculus
ggatgcatcagctgaacctgtgcat

SEQ ID NO: 605100 - DNA, 25 bp, Mus musculus
ggatgcatcatgacaaggatacaaa

SEQ ID NO: 605101 - DNA, 25 bp, Mus musculus
ggatgcatcatgtcaaggatacaaa

SEQ ID NO: 605102 - DNA, 25 bp, Mus musculus
ggatgcatccacattgtgacaagca

SEQ ID NO: 605103 - DNA, 25 bp, Mus musculus
ggatgcatccactttgtgacaagca

SEQ ID NO: 605104 - DNA, 25 bp, Mus musculus
ggatgcatcctgaatagcttgacta

SEQ ID NO: 605105 - DNA, 25 bp, Mus musculus
ggatgcatcctgtatagcttgacta

SEQ ID NO: 605106 - DNA, 25 bp, Mus musculus
ggatgcatctaacgataagcaattt

SEQ ID NO: 605107 - DNA, 25 bp, Mus musculus
ggatgcatctaaggataagcaattt

SEQ ID NO: 605108 - DNA, 25 bp, Mus musculus
ggatgcatcttgactttggtccaaa

SEQ ID NO: 605109 - DNA, 25 bp, Mus musculus
ggatgcatcttgtctttggtccaaa

SEQ ID NO: 605110 - DNA, 25 bp, Mus musculus
ggatgcatgaatatccccataagtc

SEQ ID NO: 605111 - DNA, 25 bp, Mus musculus
ggatgcatgaatttccccataagtc

SEQ ID NO: 605112 - DNA, 25 bp, Mus musculus
ggatgcatgaccaaactcgatcact

SEQ ID NO: 605113 - DNA, 25 bp, Mus musculus
ggatgcatgacctaactcgatcact

SEQ ID NO: 605114 - DNA, 25 bp, Mus musculus
ggatgcatgcaactttcaccacagc

SEQ ID NO: 605115 - DNA, 25 bp, Mus musculus
ggatgcatgcaagtttcaccacagc

SEQ ID NO: 605116 - DNA, 25 bp, Mus musculus
ggatgcatgcagatggttctggaaa

SEQ ID NO: 605117 - DNA, 25 bp, Mus musculus
ggatgcatgcagttggttctggaaa

SEQ ID NO: 605118 - DNA, 25 bp, Mus musculus
ggatgcatgctgacttttttatttt

SEQ ID NO: 605119 - DNA, 25 bp, Mus musculus
ggatgcatgctgcttattggcaaac

SEQ ID NO: 605120 - DNA, 25 bp, Mus musculus
ggatgcatgctggttattggcaaac

SEQ ID NO: 605121 - DNA, 25 bp, Mus musculus
ggatgcatgctgtcttttttatttt

SEQ ID NO: 605122 - DNA, 25 bp, Mus musculus
ggatgcattctccatacacatatga

SEQ ID NO: 605123 - DNA, 25 bp, Mus musculus
ggatgcattctcgatacacatatga

SEQ ID NO: 605124 - DNA, 25 bp, Mus musculus
ggatgcattcttattcttctggaac

SEQ ID NO: 605125 - DNA, 25 bp, Mus musculus
ggatgcattctttttcttctggaac

SEQ ID NO: 605126 - DNA, 25 bp, Mus musculus
ggatgcatttccagagagcgagtgt

SEQ ID NO: 605127 - DNA, 25 bp, Mus musculus
ggatgcatttcctgagagcgagtgt

SEQ ID NO: 605128 - DNA, 25 bp, Mus musculus
ggatgccaaatgactccctagagag

SEQ ID NO: 605129 - DNA, 25 bp, Mus musculus
ggatgccaaatgtctccctagagag

SEQ ID NO: 605130 - DNA, 25 bp, Mus musculus
ggatgccaaattacaacttcatact

SEQ ID NO: 605131 - DNA, 25 bp, Mus musculus
ggatgccaaatttcaacttcatact

SEQ ID NO: 605132 - DNA, 25 bp, Mus musculus
ggatgccaacagatttgccagctac

SEQ ID NO: 605133 - DNA, 25 bp, Mus musculus
ggatgccaacagcaagctatcatct

SEQ ID NO: 605134 - DNA, 25 bp, Mus musculus
ggatgccaacaggaagctatcatct

SEQ ID NO: 605135 - DNA, 25 bp, Mus musculus
ggatgccaacagttttgccagctac

SEQ ID NO: 605136 - DNA, 25 bp, Mus musculus
ggatgccaacatcagacctgtaata

SEQ ID NO: 605137 - DNA, 25 bp, Mus musculus
ggatgccaacatgagacctgtaata

SEQ ID NO: 605138 - DNA, 25 bp, Mus musculus
ggatgccaaccccaagagaacaaga

SEQ ID NO: 605139 - DNA, 25 bp, Mus musculus
ggatgccaacccgaagagaacaaga

SEQ ID NO: 605140 - DNA, 25 bp, Mus musculus
ggatgccaagaaaaaccagccttct

SEQ ID NO: 605141 - DNA, 25 bp, Mus musculus
ggatgccaagaataaccagccttct

SEQ ID NO: 605142 - DNA, 25 bp, Mus musculus
ggatgccaagatagattctaaacta

SEQ ID NO: 605143 - DNA, 25 bp, Mus musculus
ggatgccaagattgattctaaacta

SEQ ID NO: 605144 - DNA, 25 bp, Mus musculus
ggatgccaagcacacagcacaagac

SEQ ID NO: 605145 - DNA, 25 bp, Mus musculus
ggatgccaagcagacagcacaagac

SEQ ID NO: 605146 - DNA, 25 bp, Mus musculus
ggatgccaagctacacaatcagaag

SEQ ID NO: 605147 - DNA, 25 bp, Mus musculus
ggatgccaagcttcacaatcagaag

SEQ ID NO: 605148 - DNA, 25 bp, Mus musculus
ggatgccaaggtaggccgctactaa

SEQ ID NO: 605149 - DNA, 25 bp, Mus musculus
ggatgccaaggttggccgctactaa

SEQ ID NO: 605150 - DNA, 25 bp, Mus musculus
ggatgccacagactaactcattaca

SEQ ID NO: 605151 - DNA, 25 bp, Mus musculus
ggatgccacagagtaactcattaca

SEQ ID NO: 605152 - DNA, 25 bp, Mus musculus
ggatgccacaggaagttctgcacat

SEQ ID NO: 605153 - DNA, 25 bp, Mus musculus
ggatgccacaggtagttctgcacat

SEQ ID NO: 605154 - DNA, 25 bp, Mus musculus
ggatgccaccacagatatcggtgtt

SEQ ID NO: 605155 - DNA, 25 bp, Mus musculus
ggatgccaccactgatatcggtgtt

SEQ ID NO: 605156 - DNA, 25 bp, Mus musculus
ggatgccaccgacgaccagttgtgc

SEQ ID NO: 605157 - DNA, 25 bp, Mus musculus
ggatgccaccgaggaccagttgtgc

SEQ ID NO: 605158 - DNA, 25 bp, Mus musculus
ggatgccactatcaacgctgacatt

SEQ ID NO: 605159 - DNA, 25 bp, Mus musculus
ggatgccactatgaacgctgacatt

SEQ ID NO: 605160 - DNA, 25 bp, Mus musculus
ggatgccactccagtgcagtgcaaa

SEQ ID NO: 605161 - DNA, 25 bp, Mus musculus
ggatgccactcctgtgcagtgcaaa

SEQ ID NO: 605162 - DNA, 25 bp, Mus musculus
ggatgccactgaagagtcacggaga

SEQ ID NO: 605163 - DNA, 25 bp, Mus musculus
ggatgccactgatgagtcacggaga

SEQ ID NO: 605164 - DNA, 25 bp, Mus musculus
ggatgccactggaaagaccacactg

SEQ ID NO: 605165 - DNA, 25 bp, Mus musculus
ggatgccactggtaagaccacactg

SEQ ID NO: 605166 - DNA, 25 bp, Mus musculus
ggatgccacttgcagcgactttaat

SEQ ID NO: 605167 - DNA, 25 bp, Mus musculus
ggatgccacttggagcgactttaat

SEQ ID NO: 605168 - DNA, 25 bp, Mus musculus
ggatgccagaacaccttcgtcagga

SEQ ID NO: 605169 - DNA, 25 bp, Mus musculus
ggatgccagaactccttcgtcagga

SEQ ID NO: 605170 - DNA, 25 bp, Mus musculus
ggatgccagacaaccatttcacagg

SEQ ID NO: 605171 - DNA, 25 bp, Mus musculus
ggatgccagacatccatttcacagg

SEQ ID NO: 605172 - DNA, 25 bp, Mus musculus
ggatgccagaggagacttcgctcag

SEQ ID NO: 605173 - DNA, 25 bp, Mus musculus
ggatgccagaggagtattcaacatt

SEQ ID NO: 605174 - DNA, 25 bp, Mus musculus
ggatgccagaggtgacttcgctcag

SEQ ID NO: 605175 - DNA, 25 bp, Mus musculus
ggatgccagaggtgtattcaacatt

SEQ ID NO: 605176 - DNA, 25 bp, Mus musculus
ggatgccagcagcacctgctcctcc

SEQ ID NO: 605177 - DNA, 25 bp, Mus musculus
ggatgccagcaggacctgctcctcc

SEQ ID NO: 605178 - DNA, 25 bp, Mus musculus
ggatgccagcctaactctagacttg

SEQ ID NO: 605179 - DNA, 25 bp, Mus musculus
ggatgccagccttactctagacttg

SEQ ID NO: 605180 - DNA, 25 bp, Mus musculus
ggatgccagcgaaaggcctggccaa

SEQ ID NO: 605181 - DNA, 25 bp, Mus musculus
ggatgccagcgataggcctggccaa

SEQ ID NO: 605182 - DNA, 25 bp, Mus musculus
ggatgccaggttagcttgccaagag

SEQ ID NO: 605183 - DNA, 25 bp, Mus musculus
ggatgccaggtttgcttgccaagag

SEQ ID NO: 605184 - DNA, 25 bp, Mus musculus
ggatgccagtttatgttatgaccct

SEQ ID NO: 605185 - DNA, 25 bp, Mus musculus
ggatgccagtttttgttatgaccct

SEQ ID NO: 605186 - DNA, 25 bp, Mus musculus
ggatgccatagacacgatgcagcga

SEQ ID NO: 605187 - DNA, 25 bp, Mus musculus
ggatgccatagagacgatgcagcga

SEQ ID NO: 605188 - DNA, 25 bp, Mus musculus
ggatgccatgatcttcaactttctt

SEQ ID NO: 605189 - DNA, 25 bp, Mus musculus
ggatgccatgatgttcaactttctt

SEQ ID NO: 605190 - DNA, 25 bp, Mus musculus
ggatgccatgccactgaaatattat

SEQ ID NO: 605191 - DNA, 25 bp, Mus musculus
ggatgccatgcctctgaaatattat

SEQ ID NO: 605192 - DNA, 25 bp, Mus musculus
ggatgccatggccactggaagacca

SEQ ID NO: 605193 - DNA, 25 bp, Mus musculus
ggatgccatggcgactggaagacca

SEQ ID NO: 605194 - DNA, 25 bp, Mus musculus
ggatgccattatatggcatgcaaat

SEQ ID NO: 605195 - DNA, 25 bp, Mus musculus
ggatgccattatttggcatgcaaat

SEQ ID NO: 605196 - DNA, 25 bp, Mus musculus
ggatgccattgcacataggtcaaca

SEQ ID NO: 605197 - DNA, 25 bp, Mus musculus
ggatgccattgctcataggtcaaca

SEQ ID NO: 605198 - DNA, 25 bp, Mus musculus
ggatgcccaagcacaaacacgtgtc

SEQ ID NO: 605199 - DNA, 25 bp, Mus musculus
ggatgcccaagctcaaacacgtgtc

SEQ ID NO: 605200 - DNA, 25 bp, Mus musculus
ggatgcccaaggatctgcttatggc

SEQ ID NO: 605201 - DNA, 25 bp, Mus musculus
ggatgcccaaggttctgcttatggc

SEQ ID NO: 605202 - DNA, 25 bp, Mus musculus
ggatgcccacaaatgtcatctttcc

SEQ ID NO: 605203 - DNA, 25 bp, Mus musculus
ggatgcccacaattgtcatctttcc

SEQ ID NO: 605204 - DNA, 25 bp, Mus musculus
ggatgcccagctcgatgcttatcag

SEQ ID NO: 605205 - DNA, 25 bp, Mus musculus
ggatgcccagctggatgcttatcag

SEQ ID NO: 605206 - DNA, 25 bp, Mus musculus
ggatgcccatagcagaaagctagta

SEQ ID NO: 605207 - DNA, 25 bp, Mus musculus
ggatgcccataggagaaagctagta

SEQ ID NO: 605208 - DNA, 25 bp, Mus musculus
ggatgcccatgaactcaggtccatt

SEQ ID NO: 605209 - DNA, 25 bp, Mus musculus
ggatgcccatgaactggccgcagtt

SEQ ID NO: 605210 - DNA, 25 bp, Mus musculus
ggatgcccatgatctcaggtccatt

SEQ ID NO: 605211 - DNA, 25 bp, Mus musculus
ggatgcccatgatctggccgcagtt

SEQ ID NO: 605212 - DNA, 25 bp, Mus musculus
ggatgcccatgtacttactgtattt

SEQ ID NO: 605213 - DNA, 25 bp, Mus musculus
ggatgcccatgttcttactgtattt

SEQ ID NO: 605214 - DNA, 25 bp, Mus musculus
ggatgcccatttatgtctgttgaaa

SEQ ID NO: 605215 - DNA, 25 bp, Mus musculus
ggatgcccatttttgtctgttgaaa

SEQ ID NO: 605216 - DNA, 25 bp, Mus musculus
ggatgccccaagaagattgctatga

SEQ ID NO: 605217 - DNA, 25 bp, Mus musculus
ggatgccccaagtagattgctatga

SEQ ID NO: 605218 - DNA, 25 bp, Mus musculus
ggatgccccggaagatgttgacttc

SEQ ID NO: 605219 - DNA, 25 bp, Mus musculus
ggatgccccggatgatgttgacttc

SEQ ID NO: 605220 - DNA, 25 bp, Mus musculus
ggatgcccggaacccgaagcgcaaa

SEQ ID NO: 605221 - DNA, 25 bp, Mus musculus
ggatgcccggaagccgaagcgcaaa

SEQ ID NO: 605222 - DNA, 25 bp, Mus musculus
ggatgcccgtgaaccagagcactta

SEQ ID NO: 605223 - DNA, 25 bp, Mus musculus
ggatgcccgtgatccagagcactta

SEQ ID NO: 605224 - DNA, 25 bp, Mus musculus
ggatgccctaggatctgagagttga

SEQ ID NO: 605225 - DNA, 25 bp, Mus musculus
ggatgccctaggttctgagagttga

SEQ ID NO: 605226 - DNA, 25 bp, Mus musculus
ggatgccctcatctttaggaatcta

SEQ ID NO: 605227 - DNA, 25 bp, Mus musculus
ggatgccctcatgtttaggaatcta

SEQ ID NO: 605228 - DNA, 25 bp, Mus musculus
ggatgccctccacatggccagactt

SEQ ID NO: 605229 - DNA, 25 bp, Mus musculus
ggatgccctccagatggccagactt

SEQ ID NO: 605230 - DNA, 25 bp, Mus musculus
ggatgccctgcaagagatgtacaag

SEQ ID NO: 605231 - DNA, 25 bp, Mus musculus
ggatgccctgcaatacctaaacttc

SEQ ID NO: 605232 - DNA, 25 bp, Mus musculus
ggatgccctgcatgagatgtacaag

SEQ ID NO: 605233 - DNA, 25 bp, Mus musculus
ggatgccctgcattacctaaacttc

SEQ ID NO: 605234 - DNA, 25 bp, Mus musculus
ggatgccctgttcgaaagatggata

SEQ ID NO: 605235 - DNA, 25 bp, Mus musculus
ggatgccctgttggaaagatggata

SEQ ID NO: 605236 - DNA, 25 bp, Mus musculus
ggatgcccttcactcgaggccagag

SEQ ID NO: 605237 - DNA, 25 bp, Mus musculus
ggatgcccttcagtcgaggccagag

SEQ ID NO: 605238 - DNA, 25 bp, Mus musculus
ggatgccgaggaagagcgctcccca

SEQ ID NO: 605239 - DNA, 25 bp, Mus musculus
ggatgccgaggatgagcgctcccca

SEQ ID NO: 605240 - DNA, 25 bp, Mus musculus
ggatgccgagtaaatcagtgcttta

SEQ ID NO: 605241 - DNA, 25 bp, Mus musculus
ggatgccgagtatatcagtgcttta

SEQ ID NO: 605242 - DNA, 25 bp, Mus musculus
ggatgccgatggagcaccaactaca

SEQ ID NO: 605243 - DNA, 25 bp, Mus musculus
ggatgccgatggtgcaccaactaca

SEQ ID NO: 605244 - DNA, 25 bp, Mus musculus
ggatgccgccttcaaacagtgcact

SEQ ID NO: 605245 - DNA, 25 bp, Mus musculus
ggatgccgccttgaaacagtgcact

SEQ ID NO: 605246 - DNA, 25 bp, Mus musculus
ggatgccggcctaccagcgcttcat

SEQ ID NO: 605247 - DNA, 25 bp, Mus musculus
ggatgccggccttccagcgcttcat

SEQ ID NO: 605248 - DNA, 25 bp, Mus musculus
ggatgccgtgagaaggcctgtccac

SEQ ID NO: 605249 - DNA, 25 bp, Mus musculus
ggatgccgtgagtaggcctgtccac

SEQ ID NO: 605250 - DNA, 25 bp, Mus musculus
ggatgcctaactagttttagttcta

SEQ ID NO: 605251 - DNA, 25 bp, Mus musculus
ggatgcctaacttgttttagttcta

SEQ ID NO: 605252 - DNA, 25 bp, Mus musculus
ggatgcctacccagcaaatataatt

SEQ ID NO: 605253 - DNA, 25 bp, Mus musculus
ggatgcctaccctgcaaatataatt

SEQ ID NO: 605254 - DNA, 25 bp, Mus musculus
ggatgcctagagatctgcaggacac

SEQ ID NO: 605255 - DNA, 25 bp, Mus musculus
ggatgcctagagttctgcaggacac

SEQ ID NO: 605256 - DNA, 25 bp, Mus musculus
ggatgcctatagcaacctcgttagt

SEQ ID NO: 605257 - DNA, 25 bp, Mus musculus
ggatgcctataggaacctcgttagt

SEQ ID NO: 605258 - DNA, 25 bp, Mus musculus
ggatgcctccagaatgcaagagaat

SEQ ID NO: 605259 - DNA, 25 bp, Mus musculus
ggatgcctccagaattgtgactgaa

SEQ ID NO: 605260 - DNA, 25 bp, Mus musculus
ggatgcctccagtatgcaagagaat

SEQ ID NO: 605261 - DNA, 25 bp, Mus musculus
ggatgcctccagtattgtgactgaa

SEQ ID NO: 605262 - DNA, 25 bp, Mus musculus
ggatgcctccggaatttggatattt

SEQ ID NO: 605263 - DNA, 25 bp, Mus musculus
ggatgcctccggtatttggatattt

SEQ ID NO: 605264 - DNA, 25 bp, Mus musculus
ggatgcctctgtccagctcactttg

SEQ ID NO: 605265 - DNA, 25 bp, Mus musculus
ggatgcctctgtgcagctcactttg

SEQ ID NO: 605266 - DNA, 25 bp, Mus musculus
ggatgcctgacaccatattttctgt

SEQ ID NO: 605267 - DNA, 25 bp, Mus musculus
ggatgcctgacactttatactggaa

SEQ ID NO: 605268 - DNA, 25 bp, Mus musculus
ggatgcctgacagcatattttctgt

SEQ ID NO: 605269 - DNA, 25 bp, Mus musculus
ggatgcctgacagtttatactggaa

SEQ ID NO: 605270 - DNA, 25 bp, Mus musculus
ggatgcctgcttaaagatctcctgg

SEQ ID NO: 605271 - DNA, 25 bp, Mus musculus
ggatgcctgctttaagatctcctgg

SEQ ID NO: 605272 - DNA, 25 bp, Mus musculus
ggatgcctggaaacacacctaggtc

SEQ ID NO: 605273 - DNA, 25 bp, Mus musculus
ggatgcctggaatcacacctaggtc

SEQ ID NO: 605274 - DNA, 25 bp, Mus musculus
ggatgcctggacaaggtttctcatt

SEQ ID NO: 605275 - DNA, 25 bp, Mus musculus
ggatgcctggacagttacttggaaa

SEQ ID NO: 605276 - DNA, 25 bp, Mus musculus
ggatgcctggactaggtttctcatt

SEQ ID NO: 605277 - DNA, 25 bp, Mus musculus
ggatgcctggactgttacttggaaa

SEQ ID NO: 605278 - DNA, 25 bp, Mus musculus
ggatgcctggataccttattatctc

SEQ ID NO: 605279 - DNA, 25 bp, Mus musculus
ggatgcctggattccttattatctc

SEQ ID NO: 605280 - DNA, 25 bp, Mus musculus
ggatgccttacaagatttactttat

SEQ ID NO: 605281 - DNA, 25 bp, Mus musculus
ggatgccttacatgatttactttat

SEQ ID NO: 605282 - DNA, 25 bp, Mus musculus
ggatgccttagactgagaacctgtt

SEQ ID NO: 605283 - DNA, 25 bp, Mus musculus
ggatgccttagagtgagaacctgtt

SEQ ID NO: 605284 - DNA, 25 bp, Mus musculus
ggatgccttatacttgttctttact

SEQ ID NO: 605285 - DNA, 25 bp, Mus musculus
ggatgccttatagttgttctttact

SEQ ID NO: 605286 - DNA, 25 bp, Mus musculus
ggatgccttcaaaactagcattggg

SEQ ID NO: 605287 - DNA, 25 bp, Mus musculus
ggatgccttcaatactagcattggg

SEQ ID NO: 605288 - DNA, 25 bp, Mus musculus
ggatgccttcctcagcataaagcag

SEQ ID NO: 605289 - DNA, 25 bp, Mus musculus
ggatgccttcctgagcataaagcag

SEQ ID NO: 605290 - DNA, 25 bp, Mus musculus
ggatgccttctgcagactcgacaag

SEQ ID NO: 605291 - DNA, 25 bp, Mus musculus
ggatgccttctgcagtgtgagcaaa

SEQ ID NO: 605292 - DNA, 25 bp, Mus musculus
ggatgccttctggagactcgacaag

SEQ ID NO: 605293 - DNA, 25 bp, Mus musculus
ggatgccttctggagtgtgagcaaa

SEQ ID NO: 605294 - DNA, 25 bp, Mus musculus
ggatgccttgcccaaaatcactgca

SEQ ID NO: 605295 - DNA, 25 bp, Mus musculus
ggatgccttgccgaaaatcactgca

SEQ ID NO: 605296 - DNA, 25 bp, Mus musculus
ggatgccttgctatatgtactgaag

SEQ ID NO: 605297 - DNA, 25 bp, Mus musculus
ggatgccttgctttatgtactgaag

SEQ ID NO: 605298 - DNA, 25 bp, Mus musculus
ggatgccttggtaggactgtcttat

SEQ ID NO: 605299 - DNA, 25 bp, Mus musculus
ggatgccttggttggactgtcttat

SEQ ID NO: 605300 - DNA, 25 bp, Mus musculus
ggatgcctttttcgtgttgtatccc

SEQ ID NO: 605301 - DNA, 25 bp, Mus musculus
ggatgcctttttggtgttgtatccc

SEQ ID NO: 605302 - DNA, 25 bp, Mus musculus
ggatgcgaccagaagctcatgagta

SEQ ID NO: 605303 - DNA, 25 bp, Mus musculus
ggatgcgaccagtagctcatgagta

SEQ ID NO: 605304 - DNA, 25 bp, Mus musculus
ggatgcgagatgatctgctactgca

SEQ ID NO: 605305 - DNA, 25 bp, Mus musculus
ggatgcgagatgttctgctactgca

SEQ ID NO: 605306 - DNA, 25 bp, Mus musculus
ggatgcgatcctcgatatcctacat

SEQ ID NO: 605307 - DNA, 25 bp, Mus musculus
ggatgcgatcctggatatcctacat

SEQ ID NO: 605308 - DNA, 25 bp, Mus musculus
ggatgcgatctaatttcctcctagc

SEQ ID NO: 605309 - DNA, 25 bp, Mus musculus
ggatgcgatctattttcctcctagc

SEQ ID NO: 605310 - DNA, 25 bp, Mus musculus
ggatgcgattcacccagagtactaa

SEQ ID NO: 605311 - DNA, 25 bp, Mus musculus
ggatgcgattcagccagagtactaa

SEQ ID NO: 605312 - DNA, 25 bp, Mus musculus
ggatgcgcacgaaaaccttgcaggt

SEQ ID NO: 605313 - DNA, 25 bp, Mus musculus
ggatgcgcacgataaccttgcaggt

SEQ ID NO: 605314 - DNA, 25 bp, Mus musculus
ggatgcggacatagaagactttaaa

SEQ ID NO: 605315 - DNA, 25 bp, Mus musculus
ggatgcggacattgaagactttaaa

SEQ ID NO: 605316 - DNA, 25 bp, Mus musculus
ggatgcggcagacccctttgatttc

SEQ ID NO: 605317 - DNA, 25 bp, Mus musculus
ggatgcggcagagccctttgatttc

SEQ ID NO: 605318 - DNA, 25 bp, Mus musculus
ggatgcggtatcaggtggcctctta

SEQ ID NO: 605319 - DNA, 25 bp, Mus musculus
ggatgcggtatctggtggcctctta

SEQ ID NO: 605320 - DNA, 25 bp, Mus musculus
ggatgcggtttccagaattccattt

SEQ ID NO: 605321 - DNA, 25 bp, Mus musculus
ggatgcggtttcgagaattccattt

SEQ ID NO: 605322 - DNA, 25 bp, Mus musculus
ggatgcgtcacgaatacagtggaca

SEQ ID NO: 605323 - DNA, 25 bp, Mus musculus
ggatgcgtcacgtatacagtggaca

SEQ ID NO: 605324 - DNA, 25 bp, Mus musculus
ggatgctaaacaccttctgatggag

SEQ ID NO: 605325 - DNA, 25 bp, Mus musculus
ggatgctaaacagcttctgatggag

SEQ ID NO: 605326 - DNA, 25 bp, Mus musculus
ggatgctaacagcatgcctctgacg

SEQ ID NO: 605327 - DNA, 25 bp, Mus musculus
ggatgctaacaggatgcctctgacg

SEQ ID NO: 605328 - DNA, 25 bp, Mus musculus
ggatgctaacataacgtcacaacta

SEQ ID NO: 605329 - DNA, 25 bp, Mus musculus
ggatgctaacattacgtcacaacta

SEQ ID NO: 605330 - DNA, 25 bp, Mus musculus
ggatgctaactgcacacatgctgaa

SEQ ID NO: 605331 - DNA, 25 bp, Mus musculus
ggatgctaactggacacatgctgaa

SEQ ID NO: 605332 - DNA, 25 bp, Mus musculus
ggatgctaagcgcatgtctgcaaga

SEQ ID NO: 605333 - DNA, 25 bp, Mus musculus
ggatgctaagcggatgtctgcaaga

SEQ ID NO: 605334 - DNA, 25 bp, Mus musculus
ggatgctaatttaatcacacacaat

SEQ ID NO: 605335 - DNA, 25 bp, Mus musculus
ggatgctaatttatgtgctcccagc

SEQ ID NO: 605336 - DNA, 25 bp, Mus musculus
ggatgctaattttatcacacacaat

SEQ ID NO: 605337 - DNA, 25 bp, Mus musculus
ggatgctaatttttgtgctcccagc

SEQ ID NO: 605338 - DNA, 25 bp, Mus musculus
ggatgctacatacccatctccagat

SEQ ID NO: 605339 - DNA, 25 bp, Mus musculus
ggatgctacatagccatctccagat

SEQ ID NO: 605340 - DNA, 25 bp, Mus musculus
ggatgctaccgacgaccaacatggt

SEQ ID NO: 605341 - DNA, 25 bp, Mus musculus
ggatgctaccgaggaccaacatggt

SEQ ID NO: 605342 - DNA, 25 bp, Mus musculus
ggatgctagaggatctctgccgcta

SEQ ID NO: 605343 - DNA, 25 bp, Mus musculus
ggatgctagaggttctctgccgcta

SEQ ID NO: 605344 - DNA, 25 bp, Mus musculus
ggatgctagattaatgctttgtctg

SEQ ID NO: 605345 - DNA, 25 bp, Mus musculus
ggatgctagatttatgctttgtctg

SEQ ID NO: 605346 - DNA, 25 bp, Mus musculus
ggatgctaggacaccatctttagct

SEQ ID NO: 605347 - DNA, 25 bp, Mus musculus
ggatgctaggactccatctttagct

SEQ ID NO: 605348 - DNA, 25 bp, Mus musculus
ggatgctaggtcctctgactgacat

SEQ ID NO: 605349 - DNA, 25 bp, Mus musculus
ggatgctaggtcgtctgactgacat

SEQ ID NO: 605350 - DNA, 25 bp, Mus musculus
ggatgctatccaatagagaaccatg

SEQ ID NO: 605351 - DNA, 25 bp, Mus musculus
ggatgctatccattagagaaccatg

SEQ ID NO: 605352 - DNA, 25 bp, Mus musculus
ggatgctatgttccagtttgtttgc

SEQ ID NO: 605353 - DNA, 25 bp, Mus musculus
ggatgctatgttgcagtttgtttgc

SEQ ID NO: 605354 - DNA, 25 bp, Mus musculus
ggatgctcaaagcactccaagccaa

SEQ ID NO: 605355 - DNA, 25 bp, Mus musculus
ggatgctcaaaggactccaagccaa

SEQ ID NO: 605356 - DNA, 25 bp, Mus musculus
ggatgctcaattaccaccttgagca

SEQ ID NO: 605357 - DNA, 25 bp, Mus musculus
ggatgctcaatttccaccttgagca

SEQ ID NO: 605358 - DNA, 25 bp, Mus musculus
ggatgctcacagatatctataagat

SEQ ID NO: 605359 - DNA, 25 bp, Mus musculus
ggatgctcacagttatctataagat

SEQ ID NO: 605360 - DNA, 25 bp, Mus musculus
ggatgctcaccaagtacactgagaa

SEQ ID NO: 605361 - DNA, 25 bp, Mus musculus
ggatgctcaccatgtacactgagaa

SEQ ID NO: 605362 - DNA, 25 bp, Mus musculus
ggatgctcagccagtatgcagggca

SEQ ID NO: 605363 - DNA, 25 bp, Mus musculus
ggatgctcagcctgtatgcagggca

SEQ ID NO: 605364 - DNA, 25 bp, Mus musculus
ggatgctcagctagggttacagcca

SEQ ID NO: 605365 - DNA, 25 bp, Mus musculus
ggatgctcagcttgggttacagcca

SEQ ID NO: 605366 - DNA, 25 bp, Mus musculus
ggatgctcatctatggtgtcgagaa

SEQ ID NO: 605367 - DNA, 25 bp, Mus musculus
ggatgctcatctttggtgtcgagaa

SEQ ID NO: 605368 - DNA, 25 bp, Mus musculus
ggatgctccacaaggcacttcagaa

SEQ ID NO: 605369 - DNA, 25 bp, Mus musculus
ggatgctccacatggcacttcagaa

SEQ ID NO: 605370 - DNA, 25 bp, Mus musculus
ggatgctccagactcagacgcatgt

SEQ ID NO: 605371 - DNA, 25 bp, Mus musculus
ggatgctccagagtcagacgcatgt

SEQ ID NO: 605372 - DNA, 25 bp, Mus musculus
ggatgctcccgacaaagtagccgat

SEQ ID NO: 605373 - DNA, 25 bp, Mus musculus
ggatgctcccgagaaagtagccgat

SEQ ID NO: 605374 - DNA, 25 bp, Mus musculus
ggatgctccgtgaccattgagaaaa

SEQ ID NO: 605375 - DNA, 25 bp, Mus musculus
ggatgctccgtgtccattgagaaaa

SEQ ID NO: 605376 - DNA, 25 bp, Mus musculus
ggatgctcctaaaagcagcgtgatt

SEQ ID NO: 605377 - DNA, 25 bp, Mus musculus
ggatgctcctaatagcagcgtgatt

SEQ ID NO: 605378 - DNA, 25 bp, Mus musculus
ggatgctcctgccatggcacactgg

SEQ ID NO: 605379 - DNA, 25 bp, Mus musculus
ggatgctcctgcgatggcacactgg

SEQ ID NO: 605380 - DNA, 25 bp, Mus musculus
ggatgctcgaggcatccagcttgct

SEQ ID NO: 605381 - DNA, 25 bp, Mus musculus
ggatgctcgagggatccagcttgct

SEQ ID NO: 605382 - DNA, 25 bp, Mus musculus
ggatgctcgcacaccactaactagg

SEQ ID NO: 605383 - DNA, 25 bp, Mus musculus
ggatgctcgcactccactaactagg

SEQ ID NO: 605384 - DNA, 25 bp, Mus musculus
ggatgctcgccaaacacaagcgcat

SEQ ID NO: 605385 - DNA, 25 bp, Mus musculus
ggatgctcgccatacacaagcgcat

SEQ ID NO: 605386 - DNA, 25 bp, Mus musculus
ggatgctcgggtccagccgatctac

SEQ ID NO: 605387 - DNA, 25 bp, Mus musculus
ggatgctcgggtccttatggttata

SEQ ID NO: 605388 - DNA, 25 bp, Mus musculus
ggatgctcgggtgcagccgatctac

SEQ ID NO: 605389 - DNA, 25 bp, Mus musculus
ggatgctcgggtgcttatggttata

SEQ ID NO: 605390 - DNA, 25 bp, Mus musculus
ggatgctctaatacccaagtactgg

SEQ ID NO: 605391 - DNA, 25 bp, Mus musculus
ggatgctctaattcccaagtactgg

SEQ ID NO: 605392 - DNA, 25 bp, Mus musculus
ggatgctctactcgttgtttccaca

SEQ ID NO: 605393 - DNA, 25 bp, Mus musculus
ggatgctctactggttgtttccaca

SEQ ID NO: 605394 - DNA, 25 bp, Mus musculus
ggatgctctagtaccattatctctt

SEQ ID NO: 605395 - DNA, 25 bp, Mus musculus
ggatgctctagttccattatctctt

SEQ ID NO: 605396 - DNA, 25 bp, Mus musculus
ggatgctctatcaagaattctcctt

SEQ ID NO: 605397 - DNA, 25 bp, Mus musculus
ggatgctctatctagaattctcctt

SEQ ID NO: 605398 - DNA, 25 bp, Mus musculus
ggatgctctcatagcacagctgaaa

SEQ ID NO: 605399 - DNA, 25 bp, Mus musculus
ggatgctctcattgcacagctgaaa

SEQ ID NO: 605400 - DNA, 25 bp, Mus musculus
ggatgctctctaattagcggagaaa

SEQ ID NO: 605401 - DNA, 25 bp, Mus musculus
ggatgctctctatttagcggagaaa

SEQ ID NO: 605402 - DNA, 25 bp, Mus musculus
ggatgctctcttacagctggtttgt

SEQ ID NO: 605403 - DNA, 25 bp, Mus musculus
ggatgctctctttcagctggtttgt

SEQ ID NO: 605404 - DNA, 25 bp, Mus musculus
ggatgctcttacaggctcattattg

SEQ ID NO: 605405 - DNA, 25 bp, Mus musculus
ggatgctcttacctgttttacattg

SEQ ID NO: 605406 - DNA, 25 bp, Mus musculus
ggatgctcttacgtgttttacattg

SEQ ID NO: 605407 - DNA, 25 bp, Mus musculus
ggatgctcttactggctcattattg

SEQ ID NO: 605408 - DNA, 25 bp, Mus musculus
ggatgctcttcgaatccagatggaa

SEQ ID NO: 605409 - DNA, 25 bp, Mus musculus
ggatgctcttcgtatccagatggaa

SEQ ID NO: 605410 - DNA, 25 bp, Mus musculus
ggatgctcttctatactggacttct

SEQ ID NO: 605411 - DNA, 25 bp, Mus musculus
ggatgctcttctttactggacttct

SEQ ID NO: 605412 - DNA, 25 bp, Mus musculus
ggatgctcttgaacaggctcgtaaa

SEQ ID NO: 605413 - DNA, 25 bp, Mus musculus
ggatgctcttgatcaggctcgtaaa

SEQ ID NO: 605414 - DNA, 25 bp, Mus musculus
ggatgctgaactccatgggctacaa

SEQ ID NO: 605415 - DNA, 25 bp, Mus musculus
ggatgctgaactgcatgggctacaa

SEQ ID NO: 605416 - DNA, 25 bp, Mus musculus
ggatgctgaagaagcgctcacgtta

SEQ ID NO: 605417 - DNA, 25 bp, Mus musculus
ggatgctgaagatgcgctcacgtta

SEQ ID NO: 605418 - DNA, 25 bp, Mus musculus
ggatgctgacagatgaggctttaaa

SEQ ID NO: 605419 - DNA, 25 bp, Mus musculus
ggatgctgacagttgaggctttaaa

SEQ ID NO: 605420 - DNA, 25 bp, Mus musculus
ggatgctgacccaggtagcctcaag

SEQ ID NO: 605421 - DNA, 25 bp, Mus musculus
ggatgctgaccctggtagcctcaag

SEQ ID NO: 605422 - DNA, 25 bp, Mus musculus
ggatgctgacctaagccagagccat

SEQ ID NO: 605423 - DNA, 25 bp, Mus musculus
ggatgctgaccttagccagagccat

SEQ ID NO: 605424 - DNA, 25 bp, Mus musculus
ggatgctgagttatccaatttcaaa

SEQ ID NO: 605425 - DNA, 25 bp, Mus musculus
ggatgctgagttttccaatttcaaa

SEQ ID NO: 605426 - DNA, 25 bp, Mus musculus
ggatgctgatagctgctctgtcctg

SEQ ID NO: 605427 - DNA, 25 bp, Mus musculus
ggatgctgataggtgctctgtcctg

SEQ ID NO: 605428 - DNA, 25 bp, Mus musculus
ggatgctgatctctttctgtggttc

SEQ ID NO: 605429 - DNA, 25 bp, Mus musculus
ggatgctgatctgtttctgtggttc

SEQ ID NO: 605430 - DNA, 25 bp, Mus musculus
ggatgctgatgtaccaacaccaaaa

SEQ ID NO: 605431 - DNA, 25 bp, Mus musculus
ggatgctgatgttccaacaccaaaa

SEQ ID NO: 605432 - DNA, 25 bp, Mus musculus
ggatgctgcaagactggacccagaa

SEQ ID NO: 605433 - DNA, 25 bp, Mus musculus
ggatgctgcaagtctggacccagaa

SEQ ID NO: 605434 - DNA, 25 bp, Mus musculus
ggatgctgcagcagagcacgtacct

SEQ ID NO: 605435 - DNA, 25 bp, Mus musculus
ggatgctgcagctgagcacgtacct

SEQ ID NO: 605436 - DNA, 25 bp, Mus musculus
ggatgctgcatcatcaggcaactat

SEQ ID NO: 605437 - DNA, 25 bp, Mus musculus
ggatgctgcatcttcaggcaactat

SEQ ID NO: 605438 - DNA, 25 bp, Mus musculus
ggatgctgccacaaacttcagtgta

SEQ ID NO: 605439 - DNA, 25 bp, Mus musculus
ggatgctgccactaacttcagtgta

SEQ ID NO: 605440 - DNA, 25 bp, Mus musculus
ggatgctgccggcaagaccaccatc

SEQ ID NO: 605441 - DNA, 25 bp, Mus musculus
ggatgctgccgggaagaccaccatc

SEQ ID NO: 605442 - DNA, 25 bp, Mus musculus
ggatgctgcctactgctttagaaat

SEQ ID NO: 605443 - DNA, 25 bp, Mus musculus
ggatgctgcctagtgctttagaaat

SEQ ID NO: 605444 - DNA, 25 bp, Mus musculus
ggatgctgcgttcagccattccaca

SEQ ID NO: 605445 - DNA, 25 bp, Mus musculus
ggatgctgcgttgagccattccaca

SEQ ID NO: 605446 - DNA, 25 bp, Mus musculus
ggatgctgctgacgcttgctcgcca

SEQ ID NO: 605447 - DNA, 25 bp, Mus musculus
ggatgctgctgaggcttgctcgcca

SEQ ID NO: 605448 - DNA, 25 bp, Mus musculus
ggatgctgctgcacttcgcaagctg

SEQ ID NO: 605449 - DNA, 25 bp, Mus musculus
ggatgctgctgccaaagtctggaat

SEQ ID NO: 605450 - DNA, 25 bp, Mus musculus
ggatgctgctgcgaaagtctggaat

SEQ ID NO: 605451 - DNA, 25 bp, Mus musculus
ggatgctgctgctcttcgcaagctg

SEQ ID NO: 605452 - DNA, 25 bp, Mus musculus
ggatgctgcttccaaagggatcaat

SEQ ID NO: 605453 - DNA, 25 bp, Mus musculus
ggatgctgcttcgaaagggatcaat

SEQ ID NO: 605454 - DNA, 25 bp, Mus musculus
ggatgctggaagacacgctaacaca

SEQ ID NO: 605455 - DNA, 25 bp, Mus musculus
ggatgctggaagtcacgctaacaca

SEQ ID NO: 605456 - DNA, 25 bp, Mus musculus
ggatgctggacaatacaaactcaca

SEQ ID NO: 605457 - DNA, 25 bp, Mus musculus
ggatgctggacattacaaactcaca

SEQ ID NO: 605458 - DNA, 25 bp, Mus musculus
ggatgctggaccacttgaccaagaa

SEQ ID NO: 605459 - DNA, 25 bp, Mus musculus
ggatgctggacctcttgaccaagaa

SEQ ID NO: 605460 - DNA, 25 bp, Mus musculus
ggatgctggcaccagggttcacacc

SEQ ID NO: 605461 - DNA, 25 bp, Mus musculus
ggatgctggcacgagggttcacacc

SEQ ID NO: 605462 - DNA, 25 bp, Mus musculus
ggatgctggcatccttacagcccag

SEQ ID NO: 605463 - DNA, 25 bp, Mus musculus
ggatgctggcatgcttacagcccag

SEQ ID NO: 605464 - DNA, 25 bp, Mus musculus
ggatgctggctaacaaactagggtc

SEQ ID NO: 605465 - DNA, 25 bp, Mus musculus
ggatgctggctacttaaaggtccca

SEQ ID NO: 605466 - DNA, 25 bp, Mus musculus
ggatgctggctagttaaaggtccca

SEQ ID NO: 605467 - DNA, 25 bp, Mus musculus
ggatgctggctatcaaactagggtc

SEQ ID NO: 605468 - DNA, 25 bp, Mus musculus
ggatgctggctgacagtggaattac

SEQ ID NO: 605469 - DNA, 25 bp, Mus musculus
ggatgctggctgtcagtggaattac

SEQ ID NO: 605470 - DNA, 25 bp, Mus musculus
ggatgctgggccaccgtttacatgg

SEQ ID NO: 605471 - DNA, 25 bp, Mus musculus
ggatgctgggcctccgtttacatgg

SEQ ID NO: 605472 - DNA, 25 bp, Mus musculus
ggatgctggtacagaaaactcgatt

SEQ ID NO: 605473 - DNA, 25 bp, Mus musculus
ggatgctggtactgaaaactcgatt

SEQ ID NO: 605474 - DNA, 25 bp, Mus musculus
ggatgctggtccattgatactcagc

SEQ ID NO: 605475 - DNA, 25 bp, Mus musculus
ggatgctggtcctttgatactcagc

SEQ ID NO: 605476 - DNA, 25 bp, Mus musculus
ggatgctgtaatctacacagaaaat

SEQ ID NO: 605477 - DNA, 25 bp, Mus musculus
ggatgctgtaatgtacacagaaaat

SEQ ID NO: 605478 - DNA, 25 bp, Mus musculus
ggatgctgtacacaaacattcacgc

SEQ ID NO: 605479 - DNA, 25 bp, Mus musculus
ggatgctgtacagaaacattcacgc

SEQ ID NO: 605480 - DNA, 25 bp, Mus musculus
ggatgctgtagaagtatgtctctct

SEQ ID NO: 605481 - DNA, 25 bp, Mus musculus
ggatgctgtagatgtatgtctctct

SEQ ID NO: 605482 - DNA, 25 bp, Mus musculus
ggatgctgtcagagcggcatctgaa

SEQ ID NO: 605483 - DNA, 25 bp, Mus musculus
ggatgctgtcagtgcggcatctgaa

SEQ ID NO: 605484 - DNA, 25 bp, Mus musculus
ggatgctgtgaccacgaacccaaat

SEQ ID NO: 605485 - DNA, 25 bp, Mus musculus
ggatgctgtgacgacgaacccaaat

SEQ ID NO: 605486 - DNA, 25 bp, Mus musculus
ggatgctgtgcaaaactttcagtgt

SEQ ID NO: 605487 - DNA, 25 bp, Mus musculus
ggatgctgtgcataactttcagtgt

SEQ ID NO: 605488 - DNA, 25 bp, Mus musculus
ggatgctgtgctacgtgtgaaatct

SEQ ID NO: 605489 - DNA, 25 bp, Mus musculus
ggatgctgtgcttcgtgtgaaatct

SEQ ID NO: 605490 - DNA, 25 bp, Mus musculus
ggatgctgtgtcaagtttgcctacc

SEQ ID NO: 605491 - DNA, 25 bp, Mus musculus
ggatgctgtgtctagtttgcctacc

SEQ ID NO: 605492 - DNA, 25 bp, Mus musculus
ggatgcttacataaacagccttcgg

SEQ ID NO: 605493 - DNA, 25 bp, Mus musculus
ggatgcttacataccagttagcaga

SEQ ID NO: 605494 - DNA, 25 bp, Mus musculus
ggatgcttacattaacagccttcgg

SEQ ID NO: 605495 - DNA, 25 bp, Mus musculus
ggatgcttacattccagttagcaga

SEQ ID NO: 605496 - DNA, 25 bp, Mus musculus
ggatgcttagcaaaccctatcccag

SEQ ID NO: 605497 - DNA, 25 bp, Mus musculus
ggatgcttagcataccctatcccag

SEQ ID NO: 605498 - DNA, 25 bp, Mus musculus
ggatgcttcctcaagtcgagtggca

SEQ ID NO: 605499 - DNA, 25 bp, Mus musculus
ggatgcttcctctagtcgagtggca

SEQ ID NO: 605500 - DNA, 25 bp, Mus musculus
ggatgcttccttaaacagattcagt

SEQ ID NO: 605501 - DNA, 25 bp, Mus musculus
ggatgcttcctttaacagattcagt

SEQ ID NO: 605502 - DNA, 25 bp, Mus musculus
ggatgcttcgggaggcctgacacaa

SEQ ID NO: 605503 - DNA, 25 bp, Mus musculus
ggatgcttcgggtggcctgacacaa

SEQ ID NO: 605504 - DNA, 25 bp, Mus musculus
ggatgcttctgtataagccgctgat

SEQ ID NO: 605505 - DNA, 25 bp, Mus musculus
ggatgcttctgtttaagccgctgat

SEQ ID NO: 605506 - DNA, 25 bp, Mus musculus
ggatgcttgagtatggcagccacct

SEQ ID NO: 605507 - DNA, 25 bp, Mus musculus
ggatgcttgagtttggcagccacct

SEQ ID NO: 605508 - DNA, 25 bp, Mus musculus
ggatgcttggtccttccacaaggga

SEQ ID NO: 605509 - DNA, 25 bp, Mus musculus
ggatgcttggtcgttccacaaggga

SEQ ID NO: 605510 - DNA, 25 bp, Mus musculus
ggatgcttgtatactttgctccacc

SEQ ID NO: 605511 - DNA, 25 bp, Mus musculus
ggatgcttgtattctttgctccacc

SEQ ID NO: 605512 - DNA, 25 bp, Mus musculus
ggatgcttgtccacttaaactcaca

SEQ ID NO: 605513 - DNA, 25 bp, Mus musculus
ggatgcttgtcctcttaaactcaca

SEQ ID NO: 605514 - DNA, 25 bp, Mus musculus
ggatgcttgtggagtcccagacgct

SEQ ID NO: 605515 - DNA, 25 bp, Mus musculus
ggatgcttgtggtgtcccagacgct

SEQ ID NO: 605516 - DNA, 25 bp, Mus musculus
ggatgctttaaaagcagaagttcat

SEQ ID NO: 605517 - DNA, 25 bp, Mus musculus
ggatgctttaaatgcagaagttcat

SEQ ID NO: 605518 - DNA, 25 bp, Mus musculus
ggatgctttaccatctcaggagatt

SEQ ID NO: 605519 - DNA, 25 bp, Mus musculus
ggatgctttaccttctcaggagatt

SEQ ID NO: 605520 - DNA, 25 bp, Mus musculus
ggatgctttccacgatagatcatgt

SEQ ID NO: 605521 - DNA, 25 bp, Mus musculus
ggatgctttccaggatagatcatgt

SEQ ID NO: 605522 - DNA, 25 bp, Mus musculus
ggatgctttgcacaattgaacttag

SEQ ID NO: 605523 - DNA, 25 bp, Mus musculus
ggatgctttgcagaattgaacttag

SEQ ID NO: 605524 - DNA, 25 bp, Mus musculus
ggatgctttgttcttatctggaaat

SEQ ID NO: 605525 - DNA, 25 bp, Mus musculus
ggatgctttgttgttatctggaaat

SEQ ID NO: 605526 - DNA, 25 bp, Mus musculus
ggatgcttttaacgtctctggaagc

SEQ ID NO: 605527 - DNA, 25 bp, Mus musculus
ggatgcttttaaggtctctggaagc

SEQ ID NO: 605528 - DNA, 25 bp, Mus musculus
ggatgcttttataagccggtgcttc

SEQ ID NO: 605529 - DNA, 25 bp, Mus musculus
ggatgcttttattagccggtgcttc

SEQ ID NO: 605530 - DNA, 25 bp, Mus musculus
ggatgcttttcactatcttaagttt

SEQ ID NO: 605531 - DNA, 25 bp, Mus musculus
ggatgcttttcagtatcttaagttt

SEQ ID NO: 605532 - DNA, 25 bp, Mus musculus
ggatggaaacaacacacttaacata

SEQ ID NO: 605533 - DNA, 25 bp, Mus musculus
ggatggaaacaagacacttaacata

SEQ ID NO: 605534 - DNA, 25 bp, Mus musculus
ggatggaaaccaatctttatattga

SEQ ID NO: 605535 - DNA, 25 bp, Mus musculus
ggatggaaaccacaccctcaatgag

SEQ ID NO: 605536 - DNA, 25 bp, Mus musculus
ggatggaaaccagaccctcaatgag

SEQ ID NO: 605537 - DNA, 25 bp, Mus musculus
ggatggaaaccattctttatattga

SEQ ID NO: 605538 - DNA, 25 bp, Mus musculus
ggatggaaactgaccccttgagatc

SEQ ID NO: 605539 - DNA, 25 bp, Mus musculus
ggatggaaactgtccccttgagatc

SEQ ID NO: 605540 - DNA, 25 bp, Mus musculus
ggatggaaatctagttccctcagcc

SEQ ID NO: 605541 - DNA, 25 bp, Mus musculus
ggatggaaatcttgttccctcagcc

SEQ ID NO: 605542 - DNA, 25 bp, Mus musculus
ggatggaaattcactaaacttgaca

SEQ ID NO: 605543 - DNA, 25 bp, Mus musculus
ggatggaaattctctaaacttgaca

SEQ ID NO: 605544 - DNA, 25 bp, Mus musculus
ggatggaactgccaatcagcttccc

SEQ ID NO: 605545 - DNA, 25 bp, Mus musculus
ggatggaactgcgaatcagcttccc

SEQ ID NO: 605546 - DNA, 25 bp, Mus musculus
ggatggaactggctcccatctagtg

SEQ ID NO: 605547 - DNA, 25 bp, Mus musculus
ggatggaactgggtcccatctagtg

SEQ ID NO: 605548 - DNA, 25 bp, Mus musculus
ggatggaagaccacaacttgctttt

SEQ ID NO: 605549 - DNA, 25 bp, Mus musculus
ggatggaagacctcaacttgctttt

SEQ ID NO: 605550 - DNA, 25 bp, Mus musculus
ggatggaagataccctctcagaaag

SEQ ID NO: 605551 - DNA, 25 bp, Mus musculus
ggatggaagatagcctctcagaaag

SEQ ID NO: 605552 - DNA, 25 bp, Mus musculus
ggatggaagcatacccatgtgcccc

SEQ ID NO: 605553 - DNA, 25 bp, Mus musculus
ggatggaagcattcccatgtgcccc

SEQ ID NO: 605554 - DNA, 25 bp, Mus musculus
ggatggaagggccagatacccctcc

SEQ ID NO: 605555 - DNA, 25 bp, Mus musculus
ggatggaagggcgagatacccctcc

SEQ ID NO: 605556 - DNA, 25 bp, Mus musculus
ggatggaagtcaaacactgctcccc

SEQ ID NO: 605557 - DNA, 25 bp, Mus musculus
ggatggaagtcatacactgctcccc

SEQ ID NO: 605558 - DNA, 25 bp, Mus musculus
ggatggaagtttagccgtctgagat

SEQ ID NO: 605559 - DNA, 25 bp, Mus musculus
ggatggaagttttgccgtctgagat

SEQ ID NO: 605560 - DNA, 25 bp, Mus musculus
ggatggaattgtcggtcaccccagc

SEQ ID NO: 605561 - DNA, 25 bp, Mus musculus
ggatggaattgtgggtcaccccagc

SEQ ID NO: 605562 - DNA, 25 bp, Mus musculus
ggatggacaaagactagtttcgaca

SEQ ID NO: 605563 - DNA, 25 bp, Mus musculus
ggatggacaaagtctagtttcgaca

SEQ ID NO: 605564 - DNA, 25 bp, Mus musculus
ggatggacacaacacatcacacctc

SEQ ID NO: 605565 - DNA, 25 bp, Mus musculus
ggatggacacaagacatcacacctc

SEQ ID NO: 605566 - DNA, 25 bp, Mus musculus
ggatggacacacaaccagaccgtaa

SEQ ID NO: 605567 - DNA, 25 bp, Mus musculus
ggatggacacactaccagaccgtaa

SEQ ID NO: 605568 - DNA, 25 bp, Mus musculus
ggatggacaccacctaaacaactga

SEQ ID NO: 605569 - DNA, 25 bp, Mus musculus
ggatggacaccagctaaacaactga

SEQ ID NO: 605570 - DNA, 25 bp, Mus musculus
ggatggacacgtagaaactgcctct

SEQ ID NO: 605571 - DNA, 25 bp, Mus musculus
ggatggacacgttgaaactgcctct

SEQ ID NO: 605572 - DNA, 25 bp, Mus musculus
ggatggacagacaacttcagaacac

SEQ ID NO: 605573 - DNA, 25 bp, Mus musculus
ggatggacagacagttcccaacctt

SEQ ID NO: 605574 - DNA, 25 bp, Mus musculus
ggatggacagactacttcagaacac

SEQ ID NO: 605575 - DNA, 25 bp, Mus musculus
ggatggacagactgttcccaacctt

SEQ ID NO: 605576 - DNA, 25 bp, Mus musculus
ggatggacagcaatacgctacgcta

SEQ ID NO: 605577 - DNA, 25 bp, Mus musculus
ggatggacagcattacgctacgcta

SEQ ID NO: 605578 - DNA, 25 bp, Mus musculus
ggatggaccaggaatttcctgccac

SEQ ID NO: 605579 - DNA, 25 bp, Mus musculus
ggatggaccaggtatttcctgccac

SEQ ID NO: 605580 - DNA, 25 bp, Mus musculus
ggatggaccctaagatggagcatga

SEQ ID NO: 605581 - DNA, 25 bp, Mus musculus
ggatggaccctatgatggagcatga

SEQ ID NO: 605582 - DNA, 25 bp, Mus musculus
ggatggaccgagaaaccccgcagtg

SEQ ID NO: 605583 - DNA, 25 bp, Mus musculus
ggatggaccgagtaaccccgcagtg

SEQ ID NO: 605584 - DNA, 25 bp, Mus musculus
ggatggacctaaaccctaggctgag

SEQ ID NO: 605585 - DNA, 25 bp, Mus musculus
ggatggacctaatccctaggctgag

SEQ ID NO: 605586 - DNA, 25 bp, Mus musculus
ggatggacgagtagcctcctcaaag

SEQ ID NO: 605587 - DNA, 25 bp, Mus musculus
ggatggacgagttgcctcctcaaag

SEQ ID NO: 605588 - DNA, 25 bp, Mus musculus
ggatggactatgcagagctctacct

SEQ ID NO: 605589 - DNA, 25 bp, Mus musculus
ggatggactatggagagctctacct

SEQ ID NO: 605590 - DNA, 25 bp, Mus musculus
ggatggactctcaatgtccttagct

SEQ ID NO: 605591 - DNA, 25 bp, Mus musculus
ggatggactctctatgtccttagct

SEQ ID NO: 605592 - DNA, 25 bp, Mus musculus
ggatggactcttcggatggactctt

SEQ ID NO: 605593 - DNA, 25 bp, Mus musculus
ggatggactcttgggatggactctt

SEQ ID NO: 605594 - DNA, 25 bp, Mus musculus
ggatggactgatcagctctatgact

SEQ ID NO: 605595 - DNA, 25 bp, Mus musculus
ggatggactgatgagctctatgact

SEQ ID NO: 605596 - DNA, 25 bp, Mus musculus
ggatggagacccagacggccccact

SEQ ID NO: 605597 - DNA, 25 bp, Mus musculus
ggatggagaccctgacggccccact

SEQ ID NO: 605598 - DNA, 25 bp, Mus musculus
ggatggagacctatgaccctaacat

SEQ ID NO: 605599 - DNA, 25 bp, Mus musculus
ggatggagacctttgaccctaacat

SEQ ID NO: 605600 - DNA, 25 bp, Mus musculus
ggatggagacttactcgtcggcgca

SEQ ID NO: 605601 - DNA, 25 bp, Mus musculus
ggatggagactttctcgtcggcgca

SEQ ID NO: 605602 - DNA, 25 bp, Mus musculus
ggatggagagcactctagactcttt

SEQ ID NO: 605603 - DNA, 25 bp, Mus musculus
ggatggagagcagtctagactcttt

SEQ ID NO: 605604 - DNA, 25 bp, Mus musculus
ggatggagagccctagagactacaa

SEQ ID NO: 605605 - DNA, 25 bp, Mus musculus
ggatggagagccgtagagactacaa

SEQ ID NO: 605606 - DNA, 25 bp, Mus musculus
ggatggagagctactcccgctgtag

SEQ ID NO: 605607 - DNA, 25 bp, Mus musculus
ggatggagagcttctcccgctgtag

SEQ ID NO: 605608 - DNA, 25 bp, Mus musculus
ggatggagcacacagttacttacct

SEQ ID NO: 605609 - DNA, 25 bp, Mus musculus
ggatggagcacagagttacttacct

SEQ ID NO: 605610 - DNA, 25 bp, Mus musculus
ggatggagcagactttcacttagca

SEQ ID NO: 605611 - DNA, 25 bp, Mus musculus
ggatggagcagagtttcacttagca

SEQ ID NO: 605612 - DNA, 25 bp, Mus musculus
ggatggagcagcagaagaccttcct

SEQ ID NO: 605613 - DNA, 25 bp, Mus musculus
ggatggagcagctgaagaccttcct

SEQ ID NO: 605614 - DNA, 25 bp, Mus musculus
ggatggagcccaaagacatagcata

SEQ ID NO: 605615 - DNA, 25 bp, Mus musculus
ggatggagcccatagacatagcata

SEQ ID NO: 605616 - DNA, 25 bp, Mus musculus
ggatggaggattccggtactaacct

SEQ ID NO: 605617 - DNA, 25 bp, Mus musculus
ggatggaggattgcggtactaacct

SEQ ID NO: 605618 - DNA, 25 bp, Mus musculus
ggatggaggtgcatcttgtcactgc

SEQ ID NO: 605619 - DNA, 25 bp, Mus musculus
ggatggaggtgcttcttgtcactgc

SEQ ID NO: 605620 - DNA, 25 bp, Mus musculus
ggatggagtcctcgcaccaatagct

SEQ ID NO: 605621 - DNA, 25 bp, Mus musculus
ggatggagtcctggcaccaatagct

SEQ ID NO: 605622 - DNA, 25 bp, Mus musculus
ggatggataacaccatctgtctctt

SEQ ID NO: 605623 - DNA, 25 bp, Mus musculus
ggatggataacagcatctgtctctt

SEQ ID NO: 605624 - DNA, 25 bp, Mus musculus
ggatggatacccaggaacccaccag

SEQ ID NO: 605625 - DNA, 25 bp, Mus musculus
ggatggataccctggaacccaccag

SEQ ID NO: 605626 - DNA, 25 bp, Mus musculus
ggatggatagagactctgtttttaa

SEQ ID NO: 605627 - DNA, 25 bp, Mus musculus
ggatggatagagtctctgtttttaa

SEQ ID NO: 605628 - DNA, 25 bp, Mus musculus
ggatggatagctcagtcaggactct

SEQ ID NO: 605629 - DNA, 25 bp, Mus musculus
ggatggatagctgagtcaggactct

SEQ ID NO: 605630 - DNA, 25 bp, Mus musculus
ggatggatatgacacagcccgctat

SEQ ID NO: 605631 - DNA, 25 bp, Mus musculus
ggatggatatgagacagcccgctat

SEQ ID NO: 605632 - DNA, 25 bp, Mus musculus
ggatggatatgtatgccgcttccta

SEQ ID NO: 605633 - DNA, 25 bp, Mus musculus
ggatggatatgtttgccgcttccta

SEQ ID NO: 605634 - DNA, 25 bp, Mus musculus
ggatggatcaggattccagtggcaa

SEQ ID NO: 605635 - DNA, 25 bp, Mus musculus
ggatggatcaggtttccagtggcaa

SEQ ID NO: 605636 - DNA, 25 bp, Mus musculus
ggatggatcatcatttctaaaacaa

SEQ ID NO: 605637 - DNA, 25 bp, Mus musculus
ggatggatcatcttttctaaaacaa

SEQ ID NO: 605638 - DNA, 25 bp, Mus musculus
ggatggatcctacagttacaccagt

SEQ ID NO: 605639 - DNA, 25 bp, Mus musculus
ggatggatcctagagttacaccagt

SEQ ID NO: 605640 - DNA, 25 bp, Mus musculus
ggatggatccttctaagagccaact

SEQ ID NO: 605641 - DNA, 25 bp, Mus musculus
ggatggatccttgtaagagccaact

SEQ ID NO: 605642 - DNA, 25 bp, Mus musculus
ggatggatcgcacaaatcagtgtct

SEQ ID NO: 605643 - DNA, 25 bp, Mus musculus
ggatggatcgcagaaatcagtgtct

SEQ ID NO: 605644 - DNA, 25 bp, Mus musculus
ggatggatcgttcttcacatgcctc

SEQ ID NO: 605645 - DNA, 25 bp, Mus musculus
ggatggatcgttgttcacatgcctc

SEQ ID NO: 605646 - DNA, 25 bp, Mus musculus
ggatggatctgactcaaggctgaaa

SEQ ID NO: 605647 - DNA, 25 bp, Mus musculus
ggatggatctgagtcaaggctgaaa

SEQ ID NO: 605648 - DNA, 25 bp, Mus musculus
ggatggatctggagctacacccaac

SEQ ID NO: 605649 - DNA, 25 bp, Mus musculus
ggatggatctggtgctacacccaac

SEQ ID NO: 605650 - DNA, 25 bp, Mus musculus
ggatggatgcaaccttgaaagaact

SEQ ID NO: 605651 - DNA, 25 bp, Mus musculus
ggatggatgcaagcttgaaagaact

SEQ ID NO: 605652 - DNA, 25 bp, Mus musculus
ggatggatgcatcaacaggtataga

SEQ ID NO: 605653 - DNA, 25 bp, Mus musculus
ggatggatgcatgaacaggtataga

SEQ ID NO: 605654 - DNA, 25 bp, Mus musculus
ggatggatgttcatgctcggcagat

SEQ ID NO: 605655 - DNA, 25 bp, Mus musculus
ggatggatgttcttgctcggcagat

SEQ ID NO: 605656 - DNA, 25 bp, Mus musculus
ggatggattcacactgcagggactt

SEQ ID NO: 605657 - DNA, 25 bp, Mus musculus
ggatggattcactctgcagggactt

SEQ ID NO: 605658 - DNA, 25 bp, Mus musculus
ggatggcaaaacagacgagctttaa

SEQ ID NO: 605659 - DNA, 25 bp, Mus musculus
ggatggcaaaactgacgagctttaa

SEQ ID NO: 605660 - DNA, 25 bp, Mus musculus
ggatggcaaagtaggccctaaccta

SEQ ID NO: 605661 - DNA, 25 bp, Mus musculus
ggatggcaaagttggccctaaccta

SEQ ID NO: 605662 - DNA, 25 bp, Mus musculus
ggatggcaactacctacactgtttt

SEQ ID NO: 605663 - DNA, 25 bp, Mus musculus
ggatggcaactagctacactgtttt

SEQ ID NO: 605664 - DNA, 25 bp, Mus musculus
ggatggcaagtcattttcccaggac

SEQ ID NO: 605665 - DNA, 25 bp, Mus musculus
ggatggcaagtctttttcccaggac

SEQ ID NO: 605666 - DNA, 25 bp, Mus musculus
ggatggcaatggattatcaactact

SEQ ID NO: 605667 - DNA, 25 bp, Mus musculus
ggatggcaatggtttatcaactact

SEQ ID NO: 605668 - DNA, 25 bp, Mus musculus
ggatggcacaaacagcggacacgaa

SEQ ID NO: 605669 - DNA, 25 bp, Mus musculus
ggatggcacaaagagcggacacgaa

SEQ ID NO: 605670 - DNA, 25 bp, Mus musculus
ggatggcacaagatctcattaacat

SEQ ID NO: 605671 - DNA, 25 bp, Mus musculus
ggatggcacaagttctcattaacat

SEQ ID NO: 605672 - DNA, 25 bp, Mus musculus
ggatggcacaataatacttagtttt

SEQ ID NO: 605673 - DNA, 25 bp, Mus musculus
ggatggcacaattatacttagtttt

SEQ ID NO: 605674 - DNA, 25 bp, Mus musculus
ggatggcacgttcttctattttgat

SEQ ID NO: 605675 - DNA, 25 bp, Mus musculus
ggatggcacgttgttctattttgat

SEQ ID NO: 605676 - DNA, 25 bp, Mus musculus
ggatggcagacaccctgcattctcc

SEQ ID NO: 605677 - DNA, 25 bp, Mus musculus
ggatggcagacagcctgcattctcc

SEQ ID NO: 605678 - DNA, 25 bp, Mus musculus
ggatggcagcacatcatcagcttta

SEQ ID NO: 605679 - DNA, 25 bp, Mus musculus
ggatggcagcacttcatcagcttta

SEQ ID NO: 605680 - DNA, 25 bp, Mus musculus
ggatggcagccacacatcagtatta

SEQ ID NO: 605681 - DNA, 25 bp, Mus musculus
ggatggcagccagacatcagtatta

SEQ ID NO: 605682 - DNA, 25 bp, Mus musculus
ggatggcagtgcagttgccaatgaa

SEQ ID NO: 605683 - DNA, 25 bp, Mus musculus
ggatggcagtgctgttgccaatgaa

SEQ ID NO: 605684 - DNA, 25 bp, Mus musculus
ggatggcattgcctgttttgccaac

SEQ ID NO: 605685 - DNA, 25 bp, Mus musculus
ggatggcattgcgtgttttgccaac

SEQ ID NO: 605686 - DNA, 25 bp, Mus musculus
ggatggcatttaatcttgatataca

SEQ ID NO: 605687 - DNA, 25 bp, Mus musculus
ggatggcatttattcttgatataca

SEQ ID NO: 605688 - DNA, 25 bp, Mus musculus
ggatggccacttacacactactagt

SEQ ID NO: 605689 - DNA, 25 bp, Mus musculus
ggatggccactttcacactactagt

SEQ ID NO: 605690 - DNA, 25 bp, Mus musculus
ggatggccatctcaaacatttgtcc

SEQ ID NO: 605691 - DNA, 25 bp, Mus musculus
ggatggccatctgaaacatttgtcc

SEQ ID NO: 605692 - DNA, 25 bp, Mus musculus
ggatggccattgcagacagctctag

SEQ ID NO: 605693 - DNA, 25 bp, Mus musculus
ggatggccattggagacagctctag

SEQ ID NO: 605694 - DNA, 25 bp, Mus musculus
ggatggcccaggacctcagtgagaa

SEQ ID NO: 605695 - DNA, 25 bp, Mus musculus
ggatggcccaggtcctcagtgagaa

SEQ ID NO: 605696 - DNA, 25 bp, Mus musculus
ggatggccccagatcgtcggctgac

SEQ ID NO: 605697 - DNA, 25 bp, Mus musculus
ggatggccccagttcgtcggctgac

SEQ ID NO: 605698 - DNA, 25 bp, Mus musculus
ggatggcccctgatgaactaatgtt

SEQ ID NO: 605699 - DNA, 25 bp, Mus musculus
ggatggcccctgttgaactaatgtt

SEQ ID NO: 605700 - DNA, 25 bp, Mus musculus
ggatggcctcccaatgaaggtgcta

SEQ ID NO: 605701 - DNA, 25 bp, Mus musculus
ggatggcctccctatgaaggtgcta

SEQ ID NO: 605702 - DNA, 25 bp, Mus musculus
ggatggcctggaagctgataacaca

SEQ ID NO: 605703 - DNA, 25 bp, Mus musculus
ggatggcctggactcttctgacacc

SEQ ID NO: 605704 - DNA, 25 bp, Mus musculus
ggatggcctggagtcttctgacacc

SEQ ID NO: 605705 - DNA, 25 bp, Mus musculus
ggatggcctggatgctgataacaca

SEQ ID NO: 605706 - DNA, 25 bp, Mus musculus
ggatggcctttccacgcaatagcat

SEQ ID NO: 605707 - DNA, 25 bp, Mus musculus
ggatggcctttcgacgcaatagcat

SEQ ID NO: 605708 - DNA, 25 bp, Mus musculus
ggatggcctttgattatatcatggg

SEQ ID NO: 605709 - DNA, 25 bp, Mus musculus
ggatggcctttgtttatatcatggg

SEQ ID NO: 605710 - DNA, 25 bp, Mus musculus
ggatggcgacgtctgcgagggcggc

SEQ ID NO: 605711 - DNA, 25 bp, Mus musculus
ggatggcgacgtgtgcgagggcggc

SEQ ID NO: 605712 - DNA, 25 bp, Mus musculus
ggatggcgatgtctggtctctccac

SEQ ID NO: 605713 - DNA, 25 bp, Mus musculus
ggatggcgatgtgtggtctctccac

SEQ ID NO: 605714 - DNA, 25 bp, Mus musculus
ggatggcgccgtatttgtaaaacac

SEQ ID NO: 605715 - DNA, 25 bp, Mus musculus
ggatggcgccgtttttgtaaaacac

SEQ ID NO: 605716 - DNA, 25 bp, Mus musculus
ggatggcgccttacatgctgaaaac

SEQ ID NO: 605717 - DNA, 25 bp, Mus musculus
ggatggcgcctttcatgctgaaaac

SEQ ID NO: 605718 - DNA, 25 bp, Mus musculus
ggatggcggagaaaaccatctcaga

SEQ ID NO: 605719 - DNA, 25 bp, Mus musculus
ggatggcggagataaccatctcaga

SEQ ID NO: 605720 - DNA, 25 bp, Mus musculus
ggatggcgtgtgagacctcagcctc

SEQ ID NO: 605721 - DNA, 25 bp, Mus musculus
ggatggcgtgtgtgacctcagcctc

SEQ ID NO: 605722 - DNA, 25 bp, Mus musculus
ggatggctaaacctgggaattctaa

SEQ ID NO: 605723 - DNA, 25 bp, Mus musculus
ggatggctaaacgtgggaattctaa

SEQ ID NO: 605724 - DNA, 25 bp, Mus musculus
ggatggctaagaccaaacctcaagg

SEQ ID NO: 605725 - DNA, 25 bp, Mus musculus
ggatggctaagagcaaacctcaagg

SEQ ID NO: 605726 - DNA, 25 bp, Mus musculus
ggatggctaatgctgagtccctgca

SEQ ID NO: 605727 - DNA, 25 bp, Mus musculus
ggatggctaatggtgagtccctgca

SEQ ID NO: 605728 - DNA, 25 bp, Mus musculus
ggatggctacacacagtacactcaa

SEQ ID NO: 605729 - DNA, 25 bp, Mus musculus
ggatggctacactcagtacactcaa

SEQ ID NO: 605730 - DNA, 25 bp, Mus musculus
ggatggctcaagctcttggctcaaa

SEQ ID NO: 605731 - DNA, 25 bp, Mus musculus
ggatggctcaaggtcttggctcaaa

SEQ ID NO: 605732 - DNA, 25 bp, Mus musculus
ggatggctcagacacctagactcct

SEQ ID NO: 605733 - DNA, 25 bp, Mus musculus
ggatggctcagagacctagactcct

SEQ ID NO: 605734 - DNA, 25 bp, Mus musculus
ggatggctcagcctacaatgccaca

SEQ ID NO: 605735 - DNA, 25 bp, Mus musculus
ggatggctcagcgtacaatgccaca

SEQ ID NO: 605736 - DNA, 25 bp, Mus musculus
ggatggctcaggatcataaagacat

SEQ ID NO: 605737 - DNA, 25 bp, Mus musculus
ggatggctcaggttcataaagacat

SEQ ID NO: 605738 - DNA, 25 bp, Mus musculus
ggatggctcggaacatggaaccgct

SEQ ID NO: 605739 - DNA, 25 bp, Mus musculus
ggatggctcggatcatggaaccgct

SEQ ID NO: 605740 - DNA, 25 bp, Mus musculus
ggatggctcgtccaagatctcagag

SEQ ID NO: 605741 - DNA, 25 bp, Mus musculus
ggatggctcgtcgaagatctcagag

SEQ ID NO: 605742 - DNA, 25 bp, Mus musculus
ggatggctcgtgattccagtcccaa

SEQ ID NO: 605743 - DNA, 25 bp, Mus musculus
ggatggctcgtgtttccagtcccaa

SEQ ID NO: 605744 - DNA, 25 bp, Mus musculus
ggatggctctgactctgtgttttta

SEQ ID NO: 605745 - DNA, 25 bp, Mus musculus
ggatggctctgagtctgtgttttta

SEQ ID NO: 605746 - DNA, 25 bp, Mus musculus
ggatggctctttcattttggactct

SEQ ID NO: 605747 - DNA, 25 bp, Mus musculus
ggatggctctttgattttggactct

SEQ ID NO: 605748 - DNA, 25 bp, Mus musculus
ggatggctgccaacactggagcaaa

SEQ ID NO: 605749 - DNA, 25 bp, Mus musculus
ggatggctgccatcactggagcaaa

SEQ ID NO: 605750 - DNA, 25 bp, Mus musculus
ggatggctgcctatcatatgaatac

SEQ ID NO: 605751 - DNA, 25 bp, Mus musculus
ggatggctgcctttcatatgaatac

SEQ ID NO: 605752 - DNA, 25 bp, Mus musculus
ggatggctgctcaatcttacagcga

SEQ ID NO: 605753 - DNA, 25 bp, Mus musculus
ggatggctgctctatcttacagcga

SEQ ID NO: 605754 - DNA, 25 bp, Mus musculus
ggatggctgctgaccacttacaatg

SEQ ID NO: 605755 - DNA, 25 bp, Mus musculus
ggatggctgctgtccacttacaatg

SEQ ID NO: 605756 - DNA, 25 bp, Mus musculus
ggatggctgtagatcttcatagtca

SEQ ID NO: 605757 - DNA, 25 bp, Mus musculus
ggatggctgtagttcttcatagtca

SEQ ID NO: 605758 - DNA, 25 bp, Mus musculus
ggatggctgtttactatgctgtaag

SEQ ID NO: 605759 - DNA, 25 bp, Mus musculus
ggatggctgttttctatgctgtaag

SEQ ID NO: 605760 - DNA, 25 bp, Mus musculus
ggatggcttactaggtgacacctct

SEQ ID NO: 605761 - DNA, 25 bp, Mus musculus
ggatggcttacttggtgacacctct

SEQ ID NO: 605762 - DNA, 25 bp, Mus musculus
ggatggcttagtcccagttgtgccc

SEQ ID NO: 605763 - DNA, 25 bp, Mus musculus
ggatggcttagtgccagttgtgccc

SEQ ID NO: 605764 - DNA, 25 bp, Mus musculus
ggatggcttatgaaaccacaaacat

SEQ ID NO: 605765 - DNA, 25 bp, Mus musculus
ggatggcttatgtaaccacaaacat

SEQ ID NO: 605766 - DNA, 25 bp, Mus musculus
ggatggcttcagaaaaaggactcaa

SEQ ID NO: 605767 - DNA, 25 bp, Mus musculus
ggatggcttcagtaaaaggactcaa

SEQ ID NO: 605768 - DNA, 25 bp, Mus musculus
ggatggcttcccaagaacatactgt

SEQ ID NO: 605769 - DNA, 25 bp, Mus musculus
ggatggcttccctagaacatactgt

SEQ ID NO: 605770 - DNA, 25 bp, Mus musculus
ggatggcttcgaacttctgactttc

SEQ ID NO: 605771 - DNA, 25 bp, Mus musculus
ggatggcttcgatcttctgactttc

SEQ ID NO: 605772 - DNA, 25 bp, Mus musculus
ggatggcttcttcgcacgttagcca

SEQ ID NO: 605773 - DNA, 25 bp, Mus musculus
ggatggcttcttggcacgttagcca

SEQ ID NO: 605774 - DNA, 25 bp, Mus musculus
ggatggcttgaactgatcagctcca

SEQ ID NO: 605775 - DNA, 25 bp, Mus musculus
ggatggcttgaagtgatcagctcca

SEQ ID NO: 605776 - DNA, 25 bp, Mus musculus
ggatggctttcaagcatgcatcaat

SEQ ID NO: 605777 - DNA, 25 bp, Mus musculus
ggatggctttcaattgcatctccac

SEQ ID NO: 605778 - DNA, 25 bp, Mus musculus
ggatggctttcatgcatgcatcaat

SEQ ID NO: 605779 - DNA, 25 bp, Mus musculus
ggatggctttcatttgcatctccac

SEQ ID NO: 605780 - DNA, 25 bp, Mus musculus
ggatggctttccaagcgcggtgctc

SEQ ID NO: 605781 - DNA, 25 bp, Mus musculus
ggatggctttcctagcgcggtgctc

SEQ ID NO: 605782 - DNA, 25 bp, Mus musculus
ggatggctttgcaatatgtacaatt

SEQ ID NO: 605783 - DNA, 25 bp, Mus musculus
ggatggctttgctatatgtacaatt

SEQ ID NO: 605784 - DNA, 25 bp, Mus musculus
ggatggctttggagtttctaattta

SEQ ID NO: 605785 - DNA, 25 bp, Mus musculus
ggatggctttggtgtttctaattta

SEQ ID NO: 605786 - DNA, 25 bp, Mus musculus
ggatggcttttacaattcctgcctg

SEQ ID NO: 605787 - DNA, 25 bp, Mus musculus
ggatggcttttagaattcctgcctg

SEQ ID NO: 605788 - DNA, 25 bp, Mus musculus
ggatgggaacatctcctaggaaact

SEQ ID NO: 605789 - DNA, 25 bp, Mus musculus
ggatgggaacatgtcctaggaaact

SEQ ID NO: 605790 - DNA, 25 bp, Mus musculus
ggatgggaaccacgaccttatcagg

SEQ ID NO: 605791 - DNA, 25 bp, Mus musculus
ggatgggaaccaggaccttatcagg

SEQ ID NO: 605792 - DNA, 25 bp, Mus musculus
ggatgggaacccacatcccaagggt

SEQ ID NO: 605793 - DNA, 25 bp, Mus musculus
ggatgggaaccctcatcccaagggt

SEQ ID NO: 605794 - DNA, 25 bp, Mus musculus
ggatgggaccatcaatctttccgag

SEQ ID NO: 605795 - DNA, 25 bp, Mus musculus
ggatgggaccatgaatctttccgag

SEQ ID NO: 605796 - DNA, 25 bp, Mus musculus
ggatgggactcaacttctttcagat

SEQ ID NO: 605797 - DNA, 25 bp, Mus musculus
ggatgggactcatcttctttcagat

SEQ ID NO: 605798 - DNA, 25 bp, Mus musculus
ggatgggactgcacactttttatat

SEQ ID NO: 605799 - DNA, 25 bp, Mus musculus
ggatgggactgctcactttttatat

SEQ ID NO: 605800 - DNA, 25 bp, Mus musculus
ggatgggacttactgtgcttcctgt

SEQ ID NO: 605801 - DNA, 25 bp, Mus musculus
ggatgggacttagtgtgcttcctgt

SEQ ID NO: 605802 - DNA, 25 bp, Mus musculus
ggatgggagaaacttgatttttatt

SEQ ID NO: 605803 - DNA, 25 bp, Mus musculus
ggatgggagaaagttgatttttatt

SEQ ID NO: 605804 - DNA, 25 bp, Mus musculus
ggatgggagaccattcatatcacct

SEQ ID NO: 605805 - DNA, 25 bp, Mus musculus
ggatgggagacctttcatatcacct

SEQ ID NO: 605806 - DNA, 25 bp, Mus musculus
ggatgggagactatacagaatgttt

SEQ ID NO: 605807 - DNA, 25 bp, Mus musculus
ggatgggagactttacagaatgttt

SEQ ID NO: 605808 - DNA, 25 bp, Mus musculus
ggatgggagcccagcaaggttctca

SEQ ID NO: 605809 - DNA, 25 bp, Mus musculus
ggatgggagccctgcaaggttctca

SEQ ID NO: 605810 - DNA, 25 bp, Mus musculus
ggatgggagcctcctggcctcacca

SEQ ID NO: 605811 - DNA, 25 bp, Mus musculus
ggatgggagcctgctggcctcacca

SEQ ID NO: 605812 - DNA, 25 bp, Mus musculus
ggatgggatctcaaaacccacccac

SEQ ID NO: 605813 - DNA, 25 bp, Mus musculus
ggatgggatctctaaacccacccac

SEQ ID NO: 605814 - DNA, 25 bp, Mus musculus
ggatgggatgaaccgctcttgacta

SEQ ID NO: 605815 - DNA, 25 bp, Mus musculus
ggatgggatgaagcgctcttgacta

SEQ ID NO: 605816 - DNA, 25 bp, Mus musculus
ggatgggatggtatagtttcctgcc

SEQ ID NO: 605817 - DNA, 25 bp, Mus musculus
ggatgggatggtttagtttcctgcc

SEQ ID NO: 605818 - DNA, 25 bp, Mus musculus
ggatgggatttaactctggcctcca

SEQ ID NO: 605819 - DNA, 25 bp, Mus musculus
ggatgggatttatctctggcctcca

SEQ ID NO: 605820 - DNA, 25 bp, Mus musculus
ggatgggcaactacatttttaacag

SEQ ID NO: 605821 - DNA, 25 bp, Mus musculus
ggatgggcaacttcatttttaacag

SEQ ID NO: 605822 - DNA, 25 bp, Mus musculus
ggatgggcacaaagacacgggctta

SEQ ID NO: 605823 - DNA, 25 bp, Mus musculus
ggatgggcacaatgacacgggctta

SEQ ID NO: 605824 - DNA, 25 bp, Mus musculus
ggatgggcacatctcacgtgaatga

SEQ ID NO: 605825 - DNA, 25 bp, Mus musculus
ggatgggcacatgtcacgtgaatga

SEQ ID NO: 605826 - DNA, 25 bp, Mus musculus
ggatgggcagacattcctattgctg

SEQ ID NO: 605827 - DNA, 25 bp, Mus musculus
ggatgggcagactttcctattgctg

SEQ ID NO: 605828 - DNA, 25 bp, Mus musculus
ggatgggcattcagcatagtacact

SEQ ID NO: 605829 - DNA, 25 bp, Mus musculus
ggatgggcattctgcatagtacact

SEQ ID NO: 605830 - DNA, 25 bp, Mus musculus
ggatgggccataatgtcctagtccc

SEQ ID NO: 605831 - DNA, 25 bp, Mus musculus
ggatgggccatattgtcctagtccc

SEQ ID NO: 605832 - DNA, 25 bp, Mus musculus
ggatgggcccacacttgactgtata

SEQ ID NO: 605833 - DNA, 25 bp, Mus musculus
ggatgggcccactcttgactgtata

SEQ ID NO: 605834 - DNA, 25 bp, Mus musculus
ggatgggcggatactacggcttccc

SEQ ID NO: 605835 - DNA, 25 bp, Mus musculus
ggatgggcggattctacggcttccc

SEQ ID NO: 605836 - DNA, 25 bp, Mus musculus
ggatgggctactaaaactcattcta

SEQ ID NO: 605837 - DNA, 25 bp, Mus musculus
ggatgggctacttaaactcattcta

SEQ ID NO: 605838 - DNA, 25 bp, Mus musculus
ggatgggctcccacatttatcaaga

SEQ ID NO: 605839 - DNA, 25 bp, Mus musculus
ggatgggctccctcatttatcaaga

SEQ ID NO: 605840 - DNA, 25 bp, Mus musculus
ggatgggctgttatgatgtcactct

SEQ ID NO: 605841 - DNA, 25 bp, Mus musculus
ggatgggctgttttgatgtcactct

SEQ ID NO: 605842 - DNA, 25 bp, Mus musculus
ggatgggcttccctgtagatgccac

SEQ ID NO: 605843 - DNA, 25 bp, Mus musculus
ggatgggcttccgtgtagatgccac

SEQ ID NO: 605844 - DNA, 25 bp, Mus musculus
ggatgggtaaatacacaccaactaa

SEQ ID NO: 605845 - DNA, 25 bp, Mus musculus
ggatgggtaaattcacaccaactaa

SEQ ID NO: 605846 - DNA, 25 bp, Mus musculus
ggatgggtatgactactccttccta

SEQ ID NO: 605847 - DNA, 25 bp, Mus musculus
ggatgggtatgagtactccttccta

SEQ ID NO: 605848 - DNA, 25 bp, Mus musculus
ggatgggtattcaccataattggtc

SEQ ID NO: 605849 - DNA, 25 bp, Mus musculus
ggatgggtattctccataattggtc

SEQ ID NO: 605850 - DNA, 25 bp, Mus musculus
ggatgggtctctcagacatgcataa

SEQ ID NO: 605851 - DNA, 25 bp, Mus musculus
ggatgggtctctgagacatgcataa

SEQ ID NO: 605852 - DNA, 25 bp, Mus musculus
ggatgggtgacgacattgttacaaa

SEQ ID NO: 605853 - DNA, 25 bp, Mus musculus
ggatgggtgacgtcattgttacaaa

SEQ ID NO: 605854 - DNA, 25 bp, Mus musculus
ggatgggtgcatatatacactctag

SEQ ID NO: 605855 - DNA, 25 bp, Mus musculus
ggatgggtgcatttatacactctag

SEQ ID NO: 605856 - DNA, 25 bp, Mus musculus
ggatgggtgtccaccaccaggagaa

SEQ ID NO: 605857 - DNA, 25 bp, Mus musculus
ggatgggtgtcctccaccaggagaa

SEQ ID NO: 605858 - DNA, 25 bp, Mus musculus
ggatgggtttgaatcagcttaatac

SEQ ID NO: 605859 - DNA, 25 bp, Mus musculus
ggatgggtttgattcagcttaatac

SEQ ID NO: 605860 - DNA, 25 bp, Mus musculus
ggatggtaaagcaagagaaacagtt

SEQ ID NO: 605861 - DNA, 25 bp, Mus musculus
ggatggtaaagctagagaaacagtt

SEQ ID NO: 605862 - DNA, 25 bp, Mus musculus
ggatggtaatgactgttcccagtta

SEQ ID NO: 605863 - DNA, 25 bp, Mus musculus
ggatggtaatgagtgttcccagtta

SEQ ID NO: 605864 - DNA, 25 bp, Mus musculus
ggatggtacacacggcttctaccta

SEQ ID NO: 605865 - DNA, 25 bp, Mus musculus
ggatggtacacagggcttctaccta

SEQ ID NO: 605866 - DNA, 25 bp, Mus musculus
ggatggtacattatctgtgtgtcat

SEQ ID NO: 605867 - DNA, 25 bp, Mus musculus
ggatggtacattttctgtgtgtcat

SEQ ID NO: 605868 - DNA, 25 bp, Mus musculus
ggatggtaccagcagacttccaacc

SEQ ID NO: 605869 - DNA, 25 bp, Mus musculus
ggatggtaccaggagacttccaacc

SEQ ID NO: 605870 - DNA, 25 bp, Mus musculus
ggatggtagaccacacctgcatggt

SEQ ID NO: 605871 - DNA, 25 bp, Mus musculus
ggatggtagacctcacctgcatggt

SEQ ID NO: 605872 - DNA, 25 bp, Mus musculus
ggatggtagagtagtctcgtctcaa

SEQ ID NO: 605873 - DNA, 25 bp, Mus musculus
ggatggtagagttgtctcgtctcaa

SEQ ID NO: 605874 - DNA, 25 bp, Mus musculus
ggatggtaggttccagccaaagccc

SEQ ID NO: 605875 - DNA, 25 bp, Mus musculus
ggatggtaggttgcagccaaagccc

SEQ ID NO: 605876 - DNA, 25 bp, Mus musculus
ggatggtatcatctttcaccggcac

SEQ ID NO: 605877 - DNA, 25 bp, Mus musculus
ggatggtatcatgtttcaccggcac

SEQ ID NO: 605878 - DNA, 25 bp, Mus musculus
ggatggtatggacgacaggtagcat

SEQ ID NO: 605879 - DNA, 25 bp, Mus musculus
ggatggtatggaggacaggtagcat

SEQ ID NO: 605880 - DNA, 25 bp, Mus musculus
ggatggtatgtgaccctcagacatt

SEQ ID NO: 605881 - DNA, 25 bp, Mus musculus
ggatggtatgtgtccctcagacatt

SEQ ID NO: 605882 - DNA, 25 bp, Mus musculus
ggatggtattctatcctaactccct

SEQ ID NO: 605883 - DNA, 25 bp, Mus musculus
ggatggtattctttcctaactccct

SEQ ID NO: 605884 - DNA, 25 bp, Mus musculus
ggatggtcaagccagtccactaatg

SEQ ID NO: 605885 - DNA, 25 bp, Mus musculus
ggatggtcaagcgagtccactaatg

SEQ ID NO: 605886 - DNA, 25 bp, Mus musculus
ggatggtcaaggatccaagccagaa

SEQ ID NO: 605887 - DNA, 25 bp, Mus musculus
ggatggtcaaggttccaagccagaa

SEQ ID NO: 605888 - DNA, 25 bp, Mus musculus
ggatggtcagaaccatgtccatgga

SEQ ID NO: 605889 - DNA, 25 bp, Mus musculus
ggatggtcagaagcatgtccatgga

SEQ ID NO: 605890 - DNA, 25 bp, Mus musculus
ggatggtcatgcagttgtggtcaac

SEQ ID NO: 605891 - DNA, 25 bp, Mus musculus
ggatggtcatgctgttgtggtcaac

SEQ ID NO: 605892 - DNA, 25 bp, Mus musculus
ggatggtccaccatgcctagaacca

SEQ ID NO: 605893 - DNA, 25 bp, Mus musculus
ggatggtccaccttgcctagaacca

SEQ ID NO: 605894 - DNA, 25 bp, Mus musculus
ggatggtccacgacttcagtacctt

SEQ ID NO: 605895 - DNA, 25 bp, Mus musculus
ggatggtccacgtcttcagtacctt

SEQ ID NO: 605896 - DNA, 25 bp, Mus musculus
ggatggtccagaccaggtgcctccc

SEQ ID NO: 605897 - DNA, 25 bp, Mus musculus
ggatggtccagagcaggtgcctccc

SEQ ID NO: 605898 - DNA, 25 bp, Mus musculus
ggatggtccatcattccgtcaattg

SEQ ID NO: 605899 - DNA, 25 bp, Mus musculus
ggatggtccatctttccgtcaattg

SEQ ID NO: 605900 - DNA, 25 bp, Mus musculus
ggatggtccctcaacggaattgagc

SEQ ID NO: 605901 - DNA, 25 bp, Mus musculus
ggatggtccctctacggaattgagc

SEQ ID NO: 605902 - DNA, 25 bp, Mus musculus
ggatggtccgccaaggccccttaag

SEQ ID NO: 605903 - DNA, 25 bp, Mus musculus
ggatggtccgcctaggccccttaag

SEQ ID NO: 605904 - DNA, 25 bp, Mus musculus
ggatggtccgttaacttaacagcgt

SEQ ID NO: 605905 - DNA, 25 bp, Mus musculus
ggatggtccgtttacttaacagcgt

SEQ ID NO: 605906 - DNA, 25 bp, Mus musculus
ggatggtcctgacccaagcgcctat

SEQ ID NO: 605907 - DNA, 25 bp, Mus musculus
ggatggtcctgagccaagcgcctat

SEQ ID NO: 605908 - DNA, 25 bp, Mus musculus
ggatggtcctgtatagctcgttctc

SEQ ID NO: 605909 - DNA, 25 bp, Mus musculus
ggatggtcctgtttagctcgttctc

SEQ ID NO: 605910 - DNA, 25 bp, Mus musculus
ggatggtctcaaaaacacggtcatt

SEQ ID NO: 605911 - DNA, 25 bp, Mus musculus
ggatggtctcaataacacggtcatt

SEQ ID NO: 605912 - DNA, 25 bp, Mus musculus
ggatggtctgctattacatatctga

SEQ ID NO: 605913 - DNA, 25 bp, Mus musculus
ggatggtctgcttttacatatctga

SEQ ID NO: 605914 - DNA, 25 bp, Mus musculus
ggatggtctggtactagcgatactt

SEQ ID NO: 605915 - DNA, 25 bp, Mus musculus
ggatggtctggttctagcgatactt

SEQ ID NO: 605916 - DNA, 25 bp, Mus musculus
ggatggtcttgactgctacccacac

SEQ ID NO: 605917 - DNA, 25 bp, Mus musculus
ggatggtcttgagtgctacccacac

SEQ ID NO: 605918 - DNA, 25 bp, Mus musculus
ggatggtgacatcattccgtctctg

SEQ ID NO: 605919 - DNA, 25 bp, Mus musculus
ggatggtgacatgattccgtctctg

SEQ ID NO: 605920 - DNA, 25 bp, Mus musculus
ggatggtgacccaacaaacttcaat

SEQ ID NO: 605921 - DNA, 25 bp, Mus musculus
ggatggtgaccccactctcaaatgc

SEQ ID NO: 605922 - DNA, 25 bp, Mus musculus
ggatggtgacccgactctcaaatgc

SEQ ID NO: 605923 - DNA, 25 bp, Mus musculus
ggatggtgaccctacaaacttcaat

SEQ ID NO: 605924 - DNA, 25 bp, Mus musculus
ggatggtgaccgcaacatcccgtgt

SEQ ID NO: 605925 - DNA, 25 bp, Mus musculus
ggatggtgaccggaacatcccgtgt

SEQ ID NO: 605926 - DNA, 25 bp, Mus musculus
ggatggtgagttactatccaacccc

SEQ ID NO: 605927 - DNA, 25 bp, Mus musculus
ggatggtgagtttctatccaacccc

SEQ ID NO: 605928 - DNA, 25 bp, Mus musculus
ggatggtgattaacactggaccacc

SEQ ID NO: 605929 - DNA, 25 bp, Mus musculus
ggatggtgattatcactggaccacc

SEQ ID NO: 605930 - DNA, 25 bp, Mus musculus
ggatggtgatttctttcctggtttt

SEQ ID NO: 605931 - DNA, 25 bp, Mus musculus
ggatggtgatttgtttcctggtttt

SEQ ID NO: 605932 - DNA, 25 bp, Mus musculus
ggatggtgcagcatgtctccacgtt

SEQ ID NO: 605933 - DNA, 25 bp, Mus musculus
ggatggtgcagcttgtctccacgtt

SEQ ID NO: 605934 - DNA, 25 bp, Mus musculus
ggatggtgctcaagtctccagcgag

SEQ ID NO: 605935 - DNA, 25 bp, Mus musculus
ggatggtgctcatgtctccagcgag

SEQ ID NO: 605936 - DNA, 25 bp, Mus musculus
ggatggtgtcttattccacagcaac

SEQ ID NO: 605937 - DNA, 25 bp, Mus musculus
ggatggtgtctttttccacagcaac

SEQ ID NO: 605938 - DNA, 25 bp, Mus musculus
ggatggtgttctacggcttgcaagc

SEQ ID NO: 605939 - DNA, 25 bp, Mus musculus
ggatggtgttcttcggcttgcaagc

SEQ ID NO: 605940 - DNA, 25 bp, Mus musculus
ggatggtgttttctgaactctgtaa

SEQ ID NO: 605941 - DNA, 25 bp, Mus musculus
ggatggtgttttgtgaactctgtaa

SEQ ID NO: 605942 - DNA, 25 bp, Mus musculus
ggatggttactgacacccaaactgc

SEQ ID NO: 605943 - DNA, 25 bp, Mus musculus
ggatggttactgtcacccaaactgc

SEQ ID NO: 605944 - DNA, 25 bp, Mus musculus
ggatggttatgaagcctacctgttt

SEQ ID NO: 605945 - DNA, 25 bp, Mus musculus
ggatggttatgatgcctacctgttt

SEQ ID NO: 605946 - DNA, 25 bp, Mus musculus
ggatggttattgacttttcgagata

SEQ ID NO: 605947 - DNA, 25 bp, Mus musculus
ggatggttattgtcttttcgagata

SEQ ID NO: 605948 - DNA, 25 bp, Mus musculus
ggatggttcaccaacgcaacatgat

SEQ ID NO: 605949 - DNA, 25 bp, Mus musculus
ggatggttcacctacgcaacatgat

SEQ ID NO: 605950 - DNA, 25 bp, Mus musculus
ggatggttcagcacttttaaatctt

SEQ ID NO: 605951 - DNA, 25 bp, Mus musculus
ggatggttcagctcttttaaatctt

SEQ ID NO: 605952 - DNA, 25 bp, Mus musculus
ggatggttccatattgacagtgact

SEQ ID NO: 605953 - DNA, 25 bp, Mus musculus
ggatggttccattttgacagtgact

SEQ ID NO: 605954 - DNA, 25 bp, Mus musculus
ggatggttcttcaaaatgaagcagc

SEQ ID NO: 605955 - DNA, 25 bp, Mus musculus
ggatggttcttctaaatgaagcagc

SEQ ID NO: 605956 - DNA, 25 bp, Mus musculus
ggatggtttgctcatatctgctgaa

SEQ ID NO: 605957 - DNA, 25 bp, Mus musculus
ggatggtttgctgatatctgctgaa

SEQ ID NO: 605958 - DNA, 25 bp, Mus musculus
ggatggttttcaatccacttcagtc

SEQ ID NO: 605959 - DNA, 25 bp, Mus musculus
ggatggttttcattccacttcagtc

SEQ ID NO: 605960 - DNA, 25 bp, Mus musculus
ggatggttttcgcatacttctgctc

SEQ ID NO: 605961 - DNA, 25 bp, Mus musculus
ggatggttttcggatacttctgctc

SEQ ID NO: 605962 - DNA, 25 bp, Mus musculus
ggatgtaaactgagtgggtgccctt

SEQ ID NO: 605963 - DNA, 25 bp, Mus musculus
ggatgtaaactgtgtgggtgccctt

SEQ ID NO: 605964 - DNA, 25 bp, Mus musculus
ggatgtaaccacaactaaacagttt

SEQ ID NO: 605965 - DNA, 25 bp, Mus musculus
ggatgtaaccactactaaacagttt

SEQ ID NO: 605966 - DNA, 25 bp, Mus musculus
ggatgtaacgtcctcactagatagg

SEQ ID NO: 605967 - DNA, 25 bp, Mus musculus
ggatgtaacgtcgtcactagatagg

SEQ ID NO: 605968 - DNA, 25 bp, Mus musculus
ggatgtaacttcactatgtaagtgg

SEQ ID NO: 605969 - DNA, 25 bp, Mus musculus
ggatgtaacttctctatgtaagtgg

SEQ ID NO: 605970 - DNA, 25 bp, Mus musculus
ggatgtaagtgtcttctcacctgca

SEQ ID NO: 605971 - DNA, 25 bp, Mus musculus
ggatgtaagtgtgttctcacctgca

SEQ ID NO: 605972 - DNA, 25 bp, Mus musculus
ggatgtaagttactgcctctggccc

SEQ ID NO: 605973 - DNA, 25 bp, Mus musculus
ggatgtaagttagtgcctctggccc

SEQ ID NO: 605974 - DNA, 25 bp, Mus musculus
ggatgtaattaccatacgcttgcta

SEQ ID NO: 605975 - DNA, 25 bp, Mus musculus
ggatgtaattacgatacgcttgcta

SEQ ID NO: 605976 - DNA, 25 bp, Mus musculus
ggatgtaattgtctccaccttccac

SEQ ID NO: 605977 - DNA, 25 bp, Mus musculus
ggatgtaattgtgtccaccttccac

SEQ ID NO: 605978 - DNA, 25 bp, Mus musculus
ggatgtaatttaaaaccgggctgaa

SEQ ID NO: 605979 - DNA, 25 bp, Mus musculus
ggatgtaatttataaccgggctgaa

SEQ ID NO: 605980 - DNA, 25 bp, Mus musculus
ggatgtacaaataccctgcgcaggc

SEQ ID NO: 605981 - DNA, 25 bp, Mus musculus
ggatgtacaaattccctgcgcaggc

SEQ ID NO: 605982 - DNA, 25 bp, Mus musculus
ggatgtacacagactacaattggaa

SEQ ID NO: 605983 - DNA, 25 bp, Mus musculus
ggatgtacacagtctacaattggaa

SEQ ID NO: 605984 - DNA, 25 bp, Mus musculus
ggatgtacagccaatcagggtccca

SEQ ID NO: 605985 - DNA, 25 bp, Mus musculus
ggatgtacagcctatcagggtccca

SEQ ID NO: 605986 - DNA, 25 bp, Mus musculus
ggatgtacatatccgtccttgccca

SEQ ID NO: 605987 - DNA, 25 bp, Mus musculus
ggatgtacatatgcgtccttgccca

SEQ ID NO: 605988 - DNA, 25 bp, Mus musculus
ggatgtacatgcagtctgtctctgg

SEQ ID NO: 605989 - DNA, 25 bp, Mus musculus
ggatgtacatgctgtctgtctctgg

SEQ ID NO: 605990 - DNA, 25 bp, Mus musculus
ggatgtacatggacagatcactgtt

SEQ ID NO: 605991 - DNA, 25 bp, Mus musculus
ggatgtacatggtcagatcactgtt

SEQ ID NO: 605992 - DNA, 25 bp, Mus musculus
ggatgtaccagaagatgttgctcaa

SEQ ID NO: 605993 - DNA, 25 bp, Mus musculus
ggatgtaccagatgatgttgctcaa

SEQ ID NO: 605994 - DNA, 25 bp, Mus musculus
ggatgtaccaggagtacagccacca

SEQ ID NO: 605995 - DNA, 25 bp, Mus musculus
ggatgtaccaggtgtacagccacca

SEQ ID NO: 605996 - DNA, 25 bp, Mus musculus
ggatgtacccggagggcaccctgaa

SEQ ID NO: 605997 - DNA, 25 bp, Mus musculus
ggatgtacccggtgggcaccctgaa

SEQ ID NO: 605998 - DNA, 25 bp, Mus musculus
ggatgtacctaccttcaaaccactg

SEQ ID NO: 605999 - DNA, 25 bp, Mus musculus
ggatgtacctacgttcaaaccactg

SEQ ID NO: 606000 - DNA, 25 bp, Mus musculus
ggatgtacgtttccattgctgttat

SEQ ID NO: 606001 - DNA, 25 bp, Mus musculus
ggatgtacgtttgcattgctgttat

SEQ ID NO: 606002 - DNA, 25 bp, Mus musculus
ggatgtactaacaggcagccgggtc

SEQ ID NO: 606003 - DNA, 25 bp, Mus musculus
ggatgtactaactggcagccgggtc

SEQ ID NO: 606004 - DNA, 25 bp, Mus musculus
ggatgtactacaagcacactcgaag

SEQ ID NO: 606005 - DNA, 25 bp, Mus musculus
ggatgtactacatgcacactcgaag

SEQ ID NO: 606006 - DNA, 25 bp, Mus musculus
ggatgtactattcttcctggtccaa

SEQ ID NO: 606007 - DNA, 25 bp, Mus musculus
ggatgtactattgttcctggtccaa

SEQ ID NO: 606008 - DNA, 25 bp, Mus musculus
ggatgtactttcaaattccacaatt

SEQ ID NO: 606009 - DNA, 25 bp, Mus musculus
ggatgtactttctaattccacaatt

SEQ ID NO: 606010 - DNA, 25 bp, Mus musculus
ggatgtagatcaatcatgcccaccc

SEQ ID NO: 606011 - DNA, 25 bp, Mus musculus
ggatgtagatcaccaccggaattta

SEQ ID NO: 606012 - DNA, 25 bp, Mus musculus
ggatgtagatcagcaccggaattta

SEQ ID NO: 606013 - DNA, 25 bp, Mus musculus
ggatgtagatcattcatgcccaccc

SEQ ID NO: 606014 - DNA, 25 bp, Mus musculus
ggatgtagcctaagtgtgacagact

SEQ ID NO: 606015 - DNA, 25 bp, Mus musculus
ggatgtagcctatgtgtgacagact

SEQ ID NO: 606016 - DNA, 25 bp, Mus musculus
ggatgtagcctcaagaatagacgga

SEQ ID NO: 606017 - DNA, 25 bp, Mus musculus
ggatgtagcctctagaatagacgga

SEQ ID NO: 606018 - DNA, 25 bp, Mus musculus
ggatgtagcttgcttgggagcgttt

SEQ ID NO: 606019 - DNA, 25 bp, Mus musculus
ggatgtagcttggttgggagcgttt

SEQ ID NO: 606020 - DNA, 25 bp, Mus musculus
ggatgtatagcaagtaaattatttc

SEQ ID NO: 606021 - DNA, 25 bp, Mus musculus
ggatgtatagcatgtaaattatttc

SEQ ID NO: 606022 - DNA, 25 bp, Mus musculus
ggatgtatcaatcccactgagttgt

SEQ ID NO: 606023 - DNA, 25 bp, Mus musculus
ggatgtatcaatgccactgagttgt

SEQ ID NO: 606024 - DNA, 25 bp, Mus musculus
ggatgtatcattcgctcctatgtcc

SEQ ID NO: 606025 - DNA, 25 bp, Mus musculus
ggatgtatcattggctcctatgtcc

SEQ ID NO: 606026 - DNA, 25 bp, Mus musculus
ggatgtatggcaccatcttcttcat

SEQ ID NO: 606027 - DNA, 25 bp, Mus musculus
ggatgtatggcagcatcttcttcat

SEQ ID NO: 606028 - DNA, 25 bp, Mus musculus
ggatgtattacactcttctaattta

SEQ ID NO: 606029 - DNA, 25 bp, Mus musculus
ggatgtattacagtcttctaattta

SEQ ID NO: 606030 - DNA, 25 bp, Mus musculus
ggatgtattcatagccagttttcta

SEQ ID NO: 606031 - DNA, 25 bp, Mus musculus
ggatgtattcattgccagttttcta

SEQ ID NO: 606032 - DNA, 25 bp, Mus musculus
ggatgtattccaatttgccaacagc

SEQ ID NO: 606033 - DNA, 25 bp, Mus musculus
ggatgtattccattttgccaacagc

SEQ ID NO: 606034 - DNA, 25 bp, Mus musculus
ggatgtattcctctctcatttttca

SEQ ID NO: 606035 - DNA, 25 bp, Mus musculus
ggatgtattcctgtctcatttttca

SEQ ID NO: 606036 - DNA, 25 bp, Mus musculus
ggatgtattcttcacaacgatttta

SEQ ID NO: 606037 - DNA, 25 bp, Mus musculus
ggatgtattcttgacaacgatttta

SEQ ID NO: 606038 - DNA, 25 bp, Mus musculus
ggatgtatttccatgtgtatcaact

SEQ ID NO: 606039 - DNA, 25 bp, Mus musculus
ggatgtatttccttgtgtatcaact

SEQ ID NO: 606040 - DNA, 25 bp, Mus musculus
ggatgtcaagatcctcccacagact

SEQ ID NO: 606041 - DNA, 25 bp, Mus musculus
ggatgtcaagatgctcccacagact

SEQ ID NO: 606042 - DNA, 25 bp, Mus musculus
ggatgtcaagtcactattcaatctg

SEQ ID NO: 606043 - DNA, 25 bp, Mus musculus
ggatgtcaagtctctattcaatctg

SEQ ID NO: 606044 - DNA, 25 bp, Mus musculus
ggatgtcaatacagcctacaccaga

SEQ ID NO: 606045 - DNA, 25 bp, Mus musculus
ggatgtcaatactgcctacaccaga

SEQ ID NO: 606046 - DNA, 25 bp, Mus musculus
ggatgtcacatcaaagggaaactca

SEQ ID NO: 606047 - DNA, 25 bp, Mus musculus
ggatgtcacatctaagggaaactca

SEQ ID NO: 606048 - DNA, 25 bp, Mus musculus
ggatgtcacctgacagatctgtgtt

SEQ ID NO: 606049 - DNA, 25 bp, Mus musculus
ggatgtcacctgagtccctgaagga

SEQ ID NO: 606050 - DNA, 25 bp, Mus musculus
ggatgtcacctgtcagatctgtgtt

SEQ ID NO: 606051 - DNA, 25 bp, Mus musculus
ggatgtcacctgtgtccctgaagga

SEQ ID NO: 606052 - DNA, 25 bp, Mus musculus
ggatgtcactccagttgacaacatc

SEQ ID NO: 606053 - DNA, 25 bp, Mus musculus
ggatgtcactcctgttgacaacatc

SEQ ID NO: 606054 - DNA, 25 bp, Mus musculus
ggatgtcactgcagcgcttgctaag

SEQ ID NO: 606055 - DNA, 25 bp, Mus musculus
ggatgtcactgctgcgcttgctaag

SEQ ID NO: 606056 - DNA, 25 bp, Mus musculus
ggatgtcactggcactcctaaatca

SEQ ID NO: 606057 - DNA, 25 bp, Mus musculus
ggatgtcactgggactcctaaatca

SEQ ID NO: 606058 - DNA, 25 bp, Mus musculus
ggatgtcagaggcacctgtttctag

SEQ ID NO: 606059 - DNA, 25 bp, Mus musculus
ggatgtcagagggacctgtttctag

SEQ ID NO: 606060 - DNA, 25 bp, Mus musculus
ggatgtcaggaaatctgttctaaag

SEQ ID NO: 606061 - DNA, 25 bp, Mus musculus
ggatgtcaggaattctgttctaaag

SEQ ID NO: 606062 - DNA, 25 bp, Mus musculus
ggatgtcaggcaccactaccaagga

SEQ ID NO: 606063 - DNA, 25 bp, Mus musculus
ggatgtcaggcagcactaccaagga

SEQ ID NO: 606064 - DNA, 25 bp, Mus musculus
ggatgtcagtgaacgtaaggccaga

SEQ ID NO: 606065 - DNA, 25 bp, Mus musculus
ggatgtcagtgatcgtaaggccaga

SEQ ID NO: 606066 - DNA, 25 bp, Mus musculus
ggatgtcatattctgccaccatggg

SEQ ID NO: 606067 - DNA, 25 bp, Mus musculus
ggatgtcatattgtgccaccatggg

SEQ ID NO: 606068 - DNA, 25 bp, Mus musculus
ggatgtcatcctagatacctagaaa

SEQ ID NO: 606069 - DNA, 25 bp, Mus musculus
ggatgtcatccttgatacctagaaa

SEQ ID NO: 606070 - DNA, 25 bp, Mus musculus
ggatgtcatcttagccgatgtggcc

SEQ ID NO: 606071 - DNA, 25 bp, Mus musculus
ggatgtcatctttgccgatgtggcc

SEQ ID NO: 606072 - DNA, 25 bp, Mus musculus
ggatgtcattaaacctaagcaaaga

SEQ ID NO: 606073 - DNA, 25 bp, Mus musculus
ggatgtcattaatcctaagcaaaga

SEQ ID NO: 606074 - DNA, 25 bp, Mus musculus
ggatgtcattaccagatttccctga

SEQ ID NO: 606075 - DNA, 25 bp, Mus musculus
ggatgtcattacgagatttccctga

SEQ ID NO: 606076 - DNA, 25 bp, Mus musculus
ggatgtcattcacttcttcctgatg

SEQ ID NO: 606077 - DNA, 25 bp, Mus musculus
ggatgtcattcagttcttcctgatg

SEQ ID NO: 606078 - DNA, 25 bp, Mus musculus
ggatgtcattttctgcctagggagc

SEQ ID NO: 606079 - DNA, 25 bp, Mus musculus
ggatgtcattttgtgcctagggagc

SEQ ID NO: 606080 - DNA, 25 bp, Mus musculus
ggatgtccaaacagcactgggctct

SEQ ID NO: 606081 - DNA, 25 bp, Mus musculus
ggatgtccaaactgcactgggctct

SEQ ID NO: 606082 - DNA, 25 bp, Mus musculus
ggatgtccaattattgctgtgctgt

SEQ ID NO: 606083 - DNA, 25 bp, Mus musculus
ggatgtccaattatttgctgtgctg

SEQ ID NO: 606084 - DNA, 25 bp, Mus musculus
ggatgtccaatttttgctgtgctgt

SEQ ID NO: 606085 - DNA, 25 bp, Mus musculus
ggatgtccaattttttgctgtgctg

SEQ ID NO: 606086 - DNA, 25 bp, Mus musculus
ggatgtccacatagctcccgggctc

SEQ ID NO: 606087 - DNA, 25 bp, Mus musculus
ggatgtccacattgctcccgggctc

SEQ ID NO: 606088 - DNA, 25 bp, Mus musculus
ggatgtccacgtcattgcgcacgcg

SEQ ID NO: 606089 - DNA, 25 bp, Mus musculus
ggatgtccacgtgattgcgcacgcg

SEQ ID NO: 606090 - DNA, 25 bp, Mus musculus
ggatgtccactaagactccaaagat

SEQ ID NO: 606091 - DNA, 25 bp, Mus musculus
ggatgtccactatgactccaaagat

SEQ ID NO: 606092 - DNA, 25 bp, Mus musculus
ggatgtccactcctcattctggaag

SEQ ID NO: 606093 - DNA, 25 bp, Mus musculus
ggatgtccactcgtcattctggaag

SEQ ID NO: 606094 - DNA, 25 bp, Mus musculus
ggatgtccacttcatttcacagtag

SEQ ID NO: 606095 - DNA, 25 bp, Mus musculus
ggatgtccacttcttccggcaggcg

SEQ ID NO: 606096 - DNA, 25 bp, Mus musculus
ggatgtccacttgatttcacagtag

SEQ ID NO: 606097 - DNA, 25 bp, Mus musculus
ggatgtccacttgttccggcaggcg

SEQ ID NO: 606098 - DNA, 25 bp, Mus musculus
ggatgtcccaccatgctgggcagaa

SEQ ID NO: 606099 - DNA, 25 bp, Mus musculus
ggatgtcccaccttgctgggcagaa

SEQ ID NO: 606100 - DNA, 25 bp, Mus musculus
ggatgtcccaggattatcttagcca

SEQ ID NO: 606101 - DNA, 25 bp, Mus musculus
ggatgtcccaggtttatcttagcca

SEQ ID NO: 606102 - DNA, 25 bp, Mus musculus
ggatgtcccatactatacttgtaca

SEQ ID NO: 606103 - DNA, 25 bp, Mus musculus
ggatgtcccatagtatacttgtaca

SEQ ID NO: 606104 - DNA, 25 bp, Mus musculus
ggatgtcccatcctaactatgagtg

SEQ ID NO: 606105 - DNA, 25 bp, Mus musculus
ggatgtcccatcgtaactatgagtg

SEQ ID NO: 606106 - DNA, 25 bp, Mus musculus
ggatgtccccaacaggatggccttg

SEQ ID NO: 606107 - DNA, 25 bp, Mus musculus
ggatgtccccaagaggatggccttg

SEQ ID NO: 606108 - DNA, 25 bp, Mus musculus
ggatgtccctgacacagggcaacag

SEQ ID NO: 606109 - DNA, 25 bp, Mus musculus
ggatgtccctgagacagggcaacag

SEQ ID NO: 606110 - DNA, 25 bp, Mus musculus
ggatgtccctttctgttcgattgac

SEQ ID NO: 606111 - DNA, 25 bp, Mus musculus
ggatgtccctttgtgttcgattgac

SEQ ID NO: 606112 - DNA, 25 bp, Mus musculus
ggatgtcctaaacaccattcctctg

SEQ ID NO: 606113 - DNA, 25 bp, Mus musculus
ggatgtcctaaagaccattcctctg

SEQ ID NO: 606114 - DNA, 25 bp, Mus musculus
ggatgtcctgatcggaccctctgga

SEQ ID NO: 606115 - DNA, 25 bp, Mus musculus
ggatgtcctgatgggaccctctgga

SEQ ID NO: 606116 - DNA, 25 bp, Mus musculus
ggatgtcctggcagcagggaccttc

SEQ ID NO: 606117 - DNA, 25 bp, Mus musculus
ggatgtcctggctgcagggaccttc

SEQ ID NO: 606118 - DNA, 25 bp, Mus musculus
ggatgtcctgggaccatgctctaga

SEQ ID NO: 606119 - DNA, 25 bp, Mus musculus
ggatgtcctgggtccatgctctaga

SEQ ID NO: 606120 - DNA, 25 bp, Mus musculus
ggatgtcctggtccacagtggcctc

SEQ ID NO: 606121 - DNA, 25 bp, Mus musculus
ggatgtcctggtgcacagtggcctc

SEQ ID NO: 606122 - DNA, 25 bp, Mus musculus
ggatgtcgtcagcattggaactatt

SEQ ID NO: 606123 - DNA, 25 bp, Mus musculus
ggatgtcgtcagctcttaaggctga

SEQ ID NO: 606124 - DNA, 25 bp, Mus musculus
ggatgtcgtcaggattggaactatt

SEQ ID NO: 606125 - DNA, 25 bp, Mus musculus
ggatgtcgtcaggtcttaaggctga

SEQ ID NO: 606126 - DNA, 25 bp, Mus musculus
ggatgtctaactagagttgccgagc

SEQ ID NO: 606127 - DNA, 25 bp, Mus musculus
ggatgtctaacttgagttgccgagc

SEQ ID NO: 606128 - DNA, 25 bp, Mus musculus
ggatgtctaagcctcggacagcgat

SEQ ID NO: 606129 - DNA, 25 bp, Mus musculus
ggatgtctaagcgtcggacagcgat

SEQ ID NO: 606130 - DNA, 25 bp, Mus musculus
ggatgtctacctagaaagcctggtt

SEQ ID NO: 606131 - DNA, 25 bp, Mus musculus
ggatgtctaccttgaaagcctggtt

SEQ ID NO: 606132 - DNA, 25 bp, Mus musculus
ggatgtctactcaaatcaccaccct

SEQ ID NO: 606133 - DNA, 25 bp, Mus musculus
ggatgtctactctaatcaccaccct

SEQ ID NO: 606134 - DNA, 25 bp, Mus musculus
ggatgtctagaaaagtgttcccagt

SEQ ID NO: 606135 - DNA, 25 bp, Mus musculus
ggatgtctagaatagtgttcccagt

SEQ ID NO: 606136 - DNA, 25 bp, Mus musculus
ggatgtctagctatcttgcttttca

SEQ ID NO: 606137 - DNA, 25 bp, Mus musculus
ggatgtctagctttcttgcttttca

SEQ ID NO: 606138 - DNA, 25 bp, Mus musculus
ggatgtctagtcaacccagatggtt

SEQ ID NO: 606139 - DNA, 25 bp, Mus musculus
ggatgtctagtctacccagatggtt

SEQ ID NO: 606140 - DNA, 25 bp, Mus musculus
ggatgtctagtgaatctgagatagc

SEQ ID NO: 606141 - DNA, 25 bp, Mus musculus
ggatgtctagtgtatctgagatagc

SEQ ID NO: 606142 - DNA, 25 bp, Mus musculus
ggatgtctatatcttgcctttttga

SEQ ID NO: 606143 - DNA, 25 bp, Mus musculus
ggatgtctatatgttgcctttttga

SEQ ID NO: 606144 - DNA, 25 bp, Mus musculus
ggatgtctatttatggtcactccat

SEQ ID NO: 606145 - DNA, 25 bp, Mus musculus
ggatgtctatttttggtcactccat

SEQ ID NO: 606146 - DNA, 25 bp, Mus musculus
ggatgtctcaagcaggtttccatag

SEQ ID NO: 606147 - DNA, 25 bp, Mus musculus
ggatgtctcaaggaggtttccatag

SEQ ID NO: 606148 - DNA, 25 bp, Mus musculus
ggatgtctcagacgcacaatgaggt

SEQ ID NO: 606149 - DNA, 25 bp, Mus musculus
ggatgtctcagaggcacaatgaggt

SEQ ID NO: 606150 - DNA, 25 bp, Mus musculus
ggatgtctcagcagtgttactctgg

SEQ ID NO: 606151 - DNA, 25 bp, Mus musculus
ggatgtctcagctgtgttactctgg

SEQ ID NO: 606152 - DNA, 25 bp, Mus musculus
ggatgtctcattccagttctcagga

SEQ ID NO: 606153 - DNA, 25 bp, Mus musculus
ggatgtctcattgcagttctcagga

SEQ ID NO: 606154 - DNA, 25 bp, Mus musculus
ggatgtctcctgaagtgccttggat

SEQ ID NO: 606155 - DNA, 25 bp, Mus musculus
ggatgtctcctgtagtgccttggat

SEQ ID NO: 606156 - DNA, 25 bp, Mus musculus
ggatgtctcgacagttggctacata

SEQ ID NO: 606157 - DNA, 25 bp, Mus musculus
ggatgtctcgactgttggctacata

SEQ ID NO: 606158 - DNA, 25 bp, Mus musculus
ggatgtctcgggaaactctcttaag

SEQ ID NO: 606159 - DNA, 25 bp, Mus musculus
ggatgtctcgggtaactctcttaag

SEQ ID NO: 606160 - DNA, 25 bp, Mus musculus
ggatgtctctatcaacaaccttcca

SEQ ID NO: 606161 - DNA, 25 bp, Mus musculus
ggatgtctctatgaacaaccttcca

SEQ ID NO: 606162 - DNA, 25 bp, Mus musculus
ggatgtctggcaagagtcccacttt

SEQ ID NO: 606163 - DNA, 25 bp, Mus musculus
ggatgtctggcatgagtcccacttt

SEQ ID NO: 606164 - DNA, 25 bp, Mus musculus
ggatgtctgtctatgttggaggaaa

SEQ ID NO: 606165 - DNA, 25 bp, Mus musculus
ggatgtctgtctttgttggaggaaa

SEQ ID NO: 606166 - DNA, 25 bp, Mus musculus
ggatgtctgtgaaggttaccaaaaa

SEQ ID NO: 606167 - DNA, 25 bp, Mus musculus
ggatgtctgtgatggttaccaaaaa

SEQ ID NO: 606168 - DNA, 25 bp, Mus musculus
ggatgtctgtgcaggtagaatttaa

SEQ ID NO: 606169 - DNA, 25 bp, Mus musculus
ggatgtctgtgctggtagaatttaa

SEQ ID NO: 606170 - DNA, 25 bp, Mus musculus
ggatgtcttaggattattttctttc

SEQ ID NO: 606171 - DNA, 25 bp, Mus musculus
ggatgtcttaggtttattttctttc

SEQ ID NO: 606172 - DNA, 25 bp, Mus musculus
ggatgtcttatcatttacagtctgg

SEQ ID NO: 606173 - DNA, 25 bp, Mus musculus
ggatgtcttatcttttacagtctgg

SEQ ID NO: 606174 - DNA, 25 bp, Mus musculus
ggatgtcttatgcaaattcactatt

SEQ ID NO: 606175 - DNA, 25 bp, Mus musculus
ggatgtcttatggaaattcactatt

SEQ ID NO: 606176 - DNA, 25 bp, Mus musculus
ggatgtcttcctagtatggacagca

SEQ ID NO: 606177 - DNA, 25 bp, Mus musculus
ggatgtcttcctcatttatgctgga

SEQ ID NO: 606178 - DNA, 25 bp, Mus musculus
ggatgtcttcctgatttatgctgga

SEQ ID NO: 606179 - DNA, 25 bp, Mus musculus
ggatgtcttccttgtatggacagca

SEQ ID NO: 606180 - DNA, 25 bp, Mus musculus
ggatgtcttcttcactgttcttggg

SEQ ID NO: 606181 - DNA, 25 bp, Mus musculus
ggatgtcttcttgactgttcttggg

SEQ ID NO: 606182 - DNA, 25 bp, Mus musculus
ggatgtcttgatatcgaggccattc

SEQ ID NO: 606183 - DNA, 25 bp, Mus musculus
ggatgtcttgatttcgaggccattc

SEQ ID NO: 606184 - DNA, 25 bp, Mus musculus
ggatgtcttgcacccagcaaaacct

SEQ ID NO: 606185 - DNA, 25 bp, Mus musculus
ggatgtcttgcagccagcaaaacct

SEQ ID NO: 606186 - DNA, 25 bp, Mus musculus
ggatgtcttgccagccttgataaaa

SEQ ID NO: 606187 - DNA, 25 bp, Mus musculus
ggatgtcttgcctgccttgataaaa

SEQ ID NO: 606188 - DNA, 25 bp, Mus musculus
ggatgtcttgctctgactggctccc

SEQ ID NO: 606189 - DNA, 25 bp, Mus musculus
ggatgtcttgctgtgactggctccc

SEQ ID NO: 606190 - DNA, 25 bp, Mus musculus
ggatgtcttttacatcttacctctt

SEQ ID NO: 606191 - DNA, 25 bp, Mus musculus
ggatgtcttttagatcttacctctt

SEQ ID NO: 606192 - DNA, 25 bp, Mus musculus
ggatgtgaaaacactgtggacagca

SEQ ID NO: 606193 - DNA, 25 bp, Mus musculus
ggatgtgaaaactctgtggacagca

SEQ ID NO: 606194 - DNA, 25 bp, Mus musculus
ggatgtgaaaatcccacaccgttcc

SEQ ID NO: 606195 - DNA, 25 bp, Mus musculus
ggatgtgaaaatgccacaccgttcc

SEQ ID NO: 606196 - DNA, 25 bp, Mus musculus
ggatgtgaaactatgtgctgtttga

SEQ ID NO: 606197 - DNA, 25 bp, Mus musculus
ggatgtgaaactttgtgctgtttga

SEQ ID NO: 606198 - DNA, 25 bp, Mus musculus
ggatgtgaacatcgaggacctatac

SEQ ID NO: 606199 - DNA, 25 bp, Mus musculus
ggatgtgaacatggaggacctatac

SEQ ID NO: 606200 - DNA, 25 bp, Mus musculus
ggatgtgaagccctgcaatctgagc

SEQ ID NO: 606201 - DNA, 25 bp, Mus musculus
ggatgtgaagccgtgcaatctgagc

SEQ ID NO: 606202 - DNA, 25 bp, Mus musculus
ggatgtgaatcacttcttcagaaca

SEQ ID NO: 606203 - DNA, 25 bp, Mus musculus
ggatgtgaatcagttcttcagaaca

SEQ ID NO: 606204 - DNA, 25 bp, Mus musculus
ggatgtgacaagagacgccagctaa

SEQ ID NO: 606205 - DNA, 25 bp, Mus musculus
ggatgtgacaagtgacgccagctaa

SEQ ID NO: 606206 - DNA, 25 bp, Mus musculus
ggatgtgacaccactatttcgcaga

SEQ ID NO: 606207 - DNA, 25 bp, Mus musculus
ggatgtgacacctctatttcgcaga

SEQ ID NO: 606208 - DNA, 25 bp, Mus musculus
ggatgtgaccaaagactctgaggta

SEQ ID NO: 606209 - DNA, 25 bp, Mus musculus
ggatgtgaccaaaggaagaccccac

SEQ ID NO: 606210 - DNA, 25 bp, Mus musculus
ggatgtgaccaatgactctgaggta

SEQ ID NO: 606211 - DNA, 25 bp, Mus musculus
ggatgtgaccaatggaagaccccac

SEQ ID NO: 606212 - DNA, 25 bp, Mus musculus
ggatgtgaccagctggatccaacca

SEQ ID NO: 606213 - DNA, 25 bp, Mus musculus
ggatgtgaccaggtggatccaacca

SEQ ID NO: 606214 - DNA, 25 bp, Mus musculus
ggatgtgacccaaccaaggatgcgc

SEQ ID NO: 606215 - DNA, 25 bp, Mus musculus
ggatgtgacccatccaaggatgcgc

SEQ ID NO: 606216 - DNA, 25 bp, Mus musculus
ggatgtgacctgattgacttactgt

SEQ ID NO: 606217 - DNA, 25 bp, Mus musculus
ggatgtgacctgtttgacttactgt

SEQ ID NO: 606218 - DNA, 25 bp, Mus musculus
ggatgtgacgcgctctgctgtcctc

SEQ ID NO: 606219 - DNA, 25 bp, Mus musculus
ggatgtgacgcggtctgctgtcctc

SEQ ID NO: 606220 - DNA, 25 bp, Mus musculus
ggatgtgactggagtccaacctgcc

SEQ ID NO: 606221 - DNA, 25 bp, Mus musculus
ggatgtgactggtgtccaacctgcc

SEQ ID NO: 606222 - DNA, 25 bp, Mus musculus
ggatgtgactgtaacgccgaccgag

SEQ ID NO: 606223 - DNA, 25 bp, Mus musculus
ggatgtgactgttacgccgaccgag

SEQ ID NO: 606224 - DNA, 25 bp, Mus musculus
ggatgtgacttgctcagggacaccc

SEQ ID NO: 606225 - DNA, 25 bp, Mus musculus
ggatgtgacttggtcagggacaccc

SEQ ID NO: 606226 - DNA, 25 bp, Mus musculus
ggatgtgagccacagactagcctgt

SEQ ID NO: 606227 - DNA, 25 bp, Mus musculus
ggatgtgagccagagactagcctgt

SEQ ID NO: 606228 - DNA, 25 bp, Mus musculus
ggatgtgaggcccagcagcaatact

SEQ ID NO: 606229 - DNA, 25 bp, Mus musculus
ggatgtgaggccgagcagcaatact

SEQ ID NO: 606230 - DNA, 25 bp, Mus musculus
ggatgtgagtccatgcaagcaagcc

SEQ ID NO: 606231 - DNA, 25 bp, Mus musculus
ggatgtgagtccttgcaagcaagcc

SEQ ID NO: 606232 - DNA, 25 bp, Mus musculus
ggatgtgatcacaaggcccaaggac

SEQ ID NO: 606233 - DNA, 25 bp, Mus musculus
ggatgtgatcacacacttagaccaa

SEQ ID NO: 606234 - DNA, 25 bp, Mus musculus
ggatgtgatcacaggagccttcaag

SEQ ID NO: 606235 - DNA, 25 bp, Mus musculus
ggatgtgatcactaggcccaaggac

SEQ ID NO: 606236 - DNA, 25 bp, Mus musculus
ggatgtgatcactcacttagaccaa

SEQ ID NO: 606237 - DNA, 25 bp, Mus musculus
ggatgtgatcactggagccttcaag

SEQ ID NO: 606238 - DNA, 25 bp, Mus musculus
ggatgtgatcatctcccacaggcat

SEQ ID NO: 606239 - DNA, 25 bp, Mus musculus
ggatgtgatcatgtcccacaggcat

SEQ ID NO: 606240 - DNA, 25 bp, Mus musculus
ggatgtgatccaccttgggattttt

SEQ ID NO: 606241 - DNA, 25 bp, Mus musculus
ggatgtgatccagcttgggattttt

SEQ ID NO: 606242 - DNA, 25 bp, Mus musculus
ggatgtgatcctactgacagccatt

SEQ ID NO: 606243 - DNA, 25 bp, Mus musculus
ggatgtgatccttctgacagccatt

SEQ ID NO: 606244 - DNA, 25 bp, Mus musculus
ggatgtgatgttacaaatgctgttt

SEQ ID NO: 606245 - DNA, 25 bp, Mus musculus
ggatgtgatgtttcaaatgctgttt

SEQ ID NO: 606246 - DNA, 25 bp, Mus musculus
ggatgtgattctaaagtcttttatt

SEQ ID NO: 606247 - DNA, 25 bp, Mus musculus
ggatgtgattcttaagtcttttatt

SEQ ID NO: 606248 - DNA, 25 bp, Mus musculus
ggatgtgattgcagaccgacccttc

SEQ ID NO: 606249 - DNA, 25 bp, Mus musculus
ggatgtgattgctgaccgacccttc

SEQ ID NO: 606250 - DNA, 25 bp, Mus musculus
ggatgtgcaaagacatagctatcat

SEQ ID NO: 606251 - DNA, 25 bp, Mus musculus
ggatgtgcaaagtcatagctatcat

SEQ ID NO: 606252 - DNA, 25 bp, Mus musculus
ggatgtgcacacatgaccactaggt

SEQ ID NO: 606253 - DNA, 25 bp, Mus musculus
ggatgtgcacacttgaccactaggt

SEQ ID NO: 606254 - DNA, 25 bp, Mus musculus
ggatgtgcacagagtatccacccag

SEQ ID NO: 606255 - DNA, 25 bp, Mus musculus
ggatgtgcacagtgtatccacccag

SEQ ID NO: 606256 - DNA, 25 bp, Mus musculus
ggatgtgcacatcggtgatgcttac

SEQ ID NO: 606257 - DNA, 25 bp, Mus musculus
ggatgtgcacatgggtgatgcttac

SEQ ID NO: 606258 - DNA, 25 bp, Mus musculus
ggatgtgcaccaagaaggcccaact

SEQ ID NO: 606259 - DNA, 25 bp, Mus musculus
ggatgtgcaccacgcagcatagaca

SEQ ID NO: 606260 - DNA, 25 bp, Mus musculus
ggatgtgcaccaggcagcatagaca

SEQ ID NO: 606261 - DNA, 25 bp, Mus musculus
ggatgtgcaccatgaaggcccaact

SEQ ID NO: 606262 - DNA, 25 bp, Mus musculus
ggatgtgcactgaagattgagcttt

SEQ ID NO: 606263 - DNA, 25 bp, Mus musculus
ggatgtgcactgtagattgagcttt

SEQ ID NO: 606264 - DNA, 25 bp, Mus musculus
ggatgtgcagtgcttttgactatct

SEQ ID NO: 606265 - DNA, 25 bp, Mus musculus
ggatgtgcagtggttttgactatct

SEQ ID NO: 606266 - DNA, 25 bp, Mus musculus
ggatgtgcatatagtacttaggagt

SEQ ID NO: 606267 - DNA, 25 bp, Mus musculus
ggatgtgcatattgtacttaggagt

SEQ ID NO: 606268 - DNA, 25 bp, Mus musculus
ggatgtgcattcagtgaccctttga

SEQ ID NO: 606269 - DNA, 25 bp, Mus musculus
ggatgtgcattctgtgaccctttga

SEQ ID NO: 606270 - DNA, 25 bp, Mus musculus
ggatgtgccaaaatagcccctaggg

SEQ ID NO: 606271 - DNA, 25 bp, Mus musculus
ggatgtgccaaattagcccctaggg

SEQ ID NO: 606272 - DNA, 25 bp, Mus musculus
ggatgtgccctacaggataagcctg

SEQ ID NO: 606273 - DNA, 25 bp, Mus musculus
ggatgtgccctagaggataagcctg

SEQ ID NO: 606274 - DNA, 25 bp, Mus musculus
ggatgtgcctaaatcctccttgatt

SEQ ID NO: 606275 - DNA, 25 bp, Mus musculus
ggatgtgcctaattcctccttgatt

SEQ ID NO: 606276 - DNA, 25 bp, Mus musculus
ggatgtgcctacattttgtagtgga

SEQ ID NO: 606277 - DNA, 25 bp, Mus musculus
ggatgtgcctactttttgtagtgga

SEQ ID NO: 606278 - DNA, 25 bp, Mus musculus
ggatgtgcctttcatgcaaatctga

SEQ ID NO: 606279 - DNA, 25 bp, Mus musculus
ggatgtgcctttgatgcaaatctga

SEQ ID NO: 606280 - DNA, 25 bp, Mus musculus
ggatgtgcgtccagcctttgattca

SEQ ID NO: 606281 - DNA, 25 bp, Mus musculus
ggatgtgcgtcctgcctttgattca

SEQ ID NO: 606282 - DNA, 25 bp, Mus musculus
ggatgtgctaccacaaaccatgcca

SEQ ID NO: 606283 - DNA, 25 bp, Mus musculus
ggatgtgctacctcaaaccatgcca

SEQ ID NO: 606284 - DNA, 25 bp, Mus musculus
ggatgtgctatcacctgattgctca

SEQ ID NO: 606285 - DNA, 25 bp, Mus musculus
ggatgtgctatctcctgattgctca

SEQ ID NO: 606286 - DNA, 25 bp, Mus musculus
ggatgtgctgtcaatcattggcatt

SEQ ID NO: 606287 - DNA, 25 bp, Mus musculus
ggatgtgctgtctatcattggcatt

SEQ ID NO: 606288 - DNA, 25 bp, Mus musculus
ggatgtggaagaacccgtgtaccag

SEQ ID NO: 606289 - DNA, 25 bp, Mus musculus
ggatgtggaagatcccgtgtaccag

SEQ ID NO: 606290 - DNA, 25 bp, Mus musculus
ggatgtggagccacacttggacacc

SEQ ID NO: 606291 - DNA, 25 bp, Mus musculus
ggatgtggagcctcacttggacacc

SEQ ID NO: 606292 - DNA, 25 bp, Mus musculus
ggatgtggatctactgtaatctcag

SEQ ID NO: 606293 - DNA, 25 bp, Mus musculus
ggatgtggatcttctgtaatctcag

SEQ ID NO: 606294 - DNA, 25 bp, Mus musculus
ggatgtggcaacacttctaagttca

SEQ ID NO: 606295 - DNA, 25 bp, Mus musculus
ggatgtggcaactcttctaagttca

SEQ ID NO: 606296 - DNA, 25 bp, Mus musculus
ggatgtggcacaccgtatccatgct

SEQ ID NO: 606297 - DNA, 25 bp, Mus musculus
ggatgtggcacagcgtatccatgct

SEQ ID NO: 606298 - DNA, 25 bp, Mus musculus
ggatgtggcactctgagcttgacca

SEQ ID NO: 606299 - DNA, 25 bp, Mus musculus
ggatgtggcactgtgagcttgacca

SEQ ID NO: 606300 - DNA, 25 bp, Mus musculus
ggatgtggccatctcaaccagtgct

SEQ ID NO: 606301 - DNA, 25 bp, Mus musculus
ggatgtggccatgtcaaccagtgct

SEQ ID NO: 606302 - DNA, 25 bp, Mus musculus
ggatgtgggcacagcagcttttatt

SEQ ID NO: 606303 - DNA, 25 bp, Mus musculus
ggatgtgggcactgcagcttttatt

SEQ ID NO: 606304 - DNA, 25 bp, Mus musculus
ggatgtgggcatacagctccgacga

SEQ ID NO: 606305 - DNA, 25 bp, Mus musculus
ggatgtgggcattcagctccgacga

SEQ ID NO: 606306 - DNA, 25 bp, Mus musculus
ggatgtgggccaattactcagtaat

SEQ ID NO: 606307 - DNA, 25 bp, Mus musculus
ggatgtgggccatttactcagtaat

SEQ ID NO: 606308 - DNA, 25 bp, Mus musculus
ggatgtggtagtacaccagtgacta

SEQ ID NO: 606309 - DNA, 25 bp, Mus musculus
ggatgtggtagttcaccagtgacta

SEQ ID NO: 606310 - DNA, 25 bp, Mus musculus
ggatgtggtccactgagatttcaac

SEQ ID NO: 606311 - DNA, 25 bp, Mus musculus
ggatgtggtccagtgagatttcaac

SEQ ID NO: 606312 - DNA, 25 bp, Mus musculus
ggatgtggtggtatacgcctataat

SEQ ID NO: 606313 - DNA, 25 bp, Mus musculus
ggatgtggtggtttacgcctataat

SEQ ID NO: 606314 - DNA, 25 bp, Mus musculus
ggatgtggttacatattatagtgta

SEQ ID NO: 606315 - DNA, 25 bp, Mus musculus
ggatgtggttaccaagtatctgtaa

SEQ ID NO: 606316 - DNA, 25 bp, Mus musculus
ggatgtggttacgaagtatctgtaa

SEQ ID NO: 606317 - DNA, 25 bp, Mus musculus
ggatgtggttacttattatagtgta

SEQ ID NO: 606318 - DNA, 25 bp, Mus musculus
ggatgtggttgaaagctttggaaca

SEQ ID NO: 606319 - DNA, 25 bp, Mus musculus
ggatgtggttgatagctttggaaca

SEQ ID NO: 606320 - DNA, 25 bp, Mus musculus
ggatgtgtacttccttcctaagaag

SEQ ID NO: 606321 - DNA, 25 bp, Mus musculus
ggatgtgtacttgcttcctaagaag

SEQ ID NO: 606322 - DNA, 25 bp, Mus musculus
ggatgtgtatccatatcaaacaaga

SEQ ID NO: 606323 - DNA, 25 bp, Mus musculus
ggatgtgtatccttatcaaacaaga

SEQ ID NO: 606324 - DNA, 25 bp, Mus musculus
ggatgtgtcccaacatttctatggc

SEQ ID NO: 606325 - DNA, 25 bp, Mus musculus
ggatgtgtcccacgtgatgtatatt

SEQ ID NO: 606326 - DNA, 25 bp, Mus musculus
ggatgtgtcccaggtgatgtatatt

SEQ ID NO: 606327 - DNA, 25 bp, Mus musculus
ggatgtgtcccatcatttctatggc

SEQ ID NO: 606328 - DNA, 25 bp, Mus musculus
ggatgtgtccctcggatgtattcac

SEQ ID NO: 606329 - DNA, 25 bp, Mus musculus
ggatgtgtccctgggatgtattcac

SEQ ID NO: 606330 - DNA, 25 bp, Mus musculus
ggatgtgtctttcctaaagttgcac

SEQ ID NO: 606331 - DNA, 25 bp, Mus musculus
ggatgtgtctttgctaaagttgcac

SEQ ID NO: 606332 - DNA, 25 bp, Mus musculus
ggatgtgtgggtaccaccagtcaat

SEQ ID NO: 606333 - DNA, 25 bp, Mus musculus
ggatgtgtgggttccaccagtcaat

SEQ ID NO: 606334 - DNA, 25 bp, Mus musculus
ggatgtgttcatcggcatctctaca

SEQ ID NO: 606335 - DNA, 25 bp, Mus musculus
ggatgtgttcatgggcatctctaca

SEQ ID NO: 606336 - DNA, 25 bp, Mus musculus
ggatgtgttcctcccgaatgttaaa

SEQ ID NO: 606337 - DNA, 25 bp, Mus musculus
ggatgtgttcctgccgaatgttaaa

SEQ ID NO: 606338 - DNA, 25 bp, Mus musculus
ggatgtgttctcatgcaagcgaata

SEQ ID NO: 606339 - DNA, 25 bp, Mus musculus
ggatgtgttctcttgcaagcgaata

SEQ ID NO: 606340 - DNA, 25 bp, Mus musculus
ggatgtgttctgacttttaccagac

SEQ ID NO: 606341 - DNA, 25 bp, Mus musculus
ggatgtgttctgtcttttaccagac

SEQ ID NO: 606342 - DNA, 25 bp, Mus musculus
ggatgtgttgctaactgctaggtga

SEQ ID NO: 606343 - DNA, 25 bp, Mus musculus
ggatgtgttgcttactgctaggtga

SEQ ID NO: 606344 - DNA, 25 bp, Mus musculus
ggatgtgtttacattgagacactct

SEQ ID NO: 606345 - DNA, 25 bp, Mus musculus
ggatgtgtttactttgagacactct

SEQ ID NO: 606346 - DNA, 25 bp, Mus musculus
ggatgtgttttgacccaccttagtc

SEQ ID NO: 606347 - DNA, 25 bp, Mus musculus
ggatgtgttttgtcccaccttagtc

SEQ ID NO: 606348 - DNA, 25 bp, Mus musculus
ggatgttaagacagttttaagagat

SEQ ID NO: 606349 - DNA, 25 bp, Mus musculus
ggatgttaagactgttttaagagat

SEQ ID NO: 606350 - DNA, 25 bp, Mus musculus
ggatgttacacacaagagccttctt

SEQ ID NO: 606351 - DNA, 25 bp, Mus musculus
ggatgttacacagaagagccttctt

SEQ ID NO: 606352 - DNA, 25 bp, Mus musculus
ggatgttagctgctggctccccatg

SEQ ID NO: 606353 - DNA, 25 bp, Mus musculus
ggatgttagctggtggctccccatg

SEQ ID NO: 606354 - DNA, 25 bp, Mus musculus
ggatgttagggccaagctcatttcc

SEQ ID NO: 606355 - DNA, 25 bp, Mus musculus
ggatgttagggcgaagctcatttcc

SEQ ID NO: 606356 - DNA, 25 bp, Mus musculus
ggatgttagttcatgtgtgcacttg

SEQ ID NO: 606357 - DNA, 25 bp, Mus musculus
ggatgttagttcttgtgtgcacttg

SEQ ID NO: 606358 - DNA, 25 bp, Mus musculus
ggatgttataggccagagcaagtca

SEQ ID NO: 606359 - DNA, 25 bp, Mus musculus
ggatgttatagggcagagcaagtca

SEQ ID NO: 606360 - DNA, 25 bp, Mus musculus
ggatgttatcaaccgtcctgccagc

SEQ ID NO: 606361 - DNA, 25 bp, Mus musculus
ggatgttatcaagcgtcctgccagc

SEQ ID NO: 606362 - DNA, 25 bp, Mus musculus
ggatgttatttgctatctagtccat

SEQ ID NO: 606363 - DNA, 25 bp, Mus musculus
ggatgttatttggtatctagtccat

SEQ ID NO: 606364 - DNA, 25 bp, Mus musculus
ggatgttcaaccaaaacgaggcctt

SEQ ID NO: 606365 - DNA, 25 bp, Mus musculus
ggatgttcaacctaaacgaggcctt

SEQ ID NO: 606366 - DNA, 25 bp, Mus musculus
ggatgttcagctcacacgagcagaa

SEQ ID NO: 606367 - DNA, 25 bp, Mus musculus
ggatgttcagctgacacgagcagaa

SEQ ID NO: 606368 - DNA, 25 bp, Mus musculus
ggatgttccagaaacttcactttaa

SEQ ID NO: 606369 - DNA, 25 bp, Mus musculus
ggatgttccagatacttcactttaa

SEQ ID NO: 606370 - DNA, 25 bp, Mus musculus
ggatgttcccaaatgtttctttatt

SEQ ID NO: 606371 - DNA, 25 bp, Mus musculus
ggatgttcccaattgtttctttatt

SEQ ID NO: 606372 - DNA, 25 bp, Mus musculus
ggatgttcctagcttccacagcaaa

SEQ ID NO: 606373 - DNA, 25 bp, Mus musculus
ggatgttcctaggttccacagcaaa

SEQ ID NO: 606374 - DNA, 25 bp, Mus musculus
ggatgttcctctccagcgatacgag

SEQ ID NO: 606375 - DNA, 25 bp, Mus musculus
ggatgttcctctcctaatttctgaa

SEQ ID NO: 606376 - DNA, 25 bp, Mus musculus
ggatgttcctctgcagcgatacgag

SEQ ID NO: 606377 - DNA, 25 bp, Mus musculus
ggatgttcctctgctaatttctgaa

SEQ ID NO: 606378 - DNA, 25 bp, Mus musculus
ggatgttctcagatcattcatttac

SEQ ID NO: 606379 - DNA, 25 bp, Mus musculus
ggatgttctcagttcattcatttac

SEQ ID NO: 606380 - DNA, 25 bp, Mus musculus
ggatgttctgacacatgtctaaccg

SEQ ID NO: 606381 - DNA, 25 bp, Mus musculus
ggatgttctgactcatgtctaaccg

SEQ ID NO: 606382 - DNA, 25 bp, Mus musculus
ggatgttctgagcagttccactttc

SEQ ID NO: 606383 - DNA, 25 bp, Mus musculus
ggatgttctgaggagttccactttc

SEQ ID NO: 606384 - DNA, 25 bp, Mus musculus
ggatgttctgctacagagacccaag

SEQ ID NO: 606385 - DNA, 25 bp, Mus musculus
ggatgttctgcttcagagacccaag

SEQ ID NO: 606386 - DNA, 25 bp, Mus musculus
ggatgttctgtaaggtctccagcca

SEQ ID NO: 606387 - DNA, 25 bp, Mus musculus
ggatgttctgtatggtctccagcca

SEQ ID NO: 606388 - DNA, 25 bp, Mus musculus
ggatgttctgtgaacatgtatgtct

SEQ ID NO: 606389 - DNA, 25 bp, Mus musculus
ggatgttctgtgtacatgtatgtct

SEQ ID NO: 606390 - DNA, 25 bp, Mus musculus
ggatgttcttcaacaactcttcctc

SEQ ID NO: 606391 - DNA, 25 bp, Mus musculus
ggatgttcttcactctgcatggatt

SEQ ID NO: 606392 - DNA, 25 bp, Mus musculus
ggatgttcttcagtctgcatggatt

SEQ ID NO: 606393 - DNA, 25 bp, Mus musculus
ggatgttcttcatcaactcttcctc

SEQ ID NO: 606394 - DNA, 25 bp, Mus musculus
ggatgttcttcccacatctagtatg

SEQ ID NO: 606395 - DNA, 25 bp, Mus musculus
ggatgttcttccgacatctagtatg

SEQ ID NO: 606396 - DNA, 25 bp, Mus musculus
ggatgttctttactacgtcacacgt

SEQ ID NO: 606397 - DNA, 25 bp, Mus musculus
ggatgttctttagtacgtcacacgt

SEQ ID NO: 606398 - DNA, 25 bp, Mus musculus
ggatgttgaattcccgcctgtttgt

SEQ ID NO: 606399 - DNA, 25 bp, Mus musculus
ggatgttgaattgccgcctgtttgt

SEQ ID NO: 606400 - DNA, 25 bp, Mus musculus
ggatgttgagctacaggatccagct

SEQ ID NO: 606401 - DNA, 25 bp, Mus musculus
ggatgttgagcttcaggatccagct

SEQ ID NO: 606402 - DNA, 25 bp, Mus musculus
ggatgttgataaccacttcctacaa

SEQ ID NO: 606403 - DNA, 25 bp, Mus musculus
ggatgttgataagcacttcctacaa

SEQ ID NO: 606404 - DNA, 25 bp, Mus musculus
ggatgttgcagaattacagccgtct

SEQ ID NO: 606405 - DNA, 25 bp, Mus musculus
ggatgttgcagatttacagccgtct

SEQ ID NO: 606406 - DNA, 25 bp, Mus musculus
ggatgttgcattatgtgtgaccgtc

SEQ ID NO: 606407 - DNA, 25 bp, Mus musculus
ggatgttgcattttgtgtgaccgtc

SEQ ID NO: 606408 - DNA, 25 bp, Mus musculus
ggatgttgctatagtgacatgcagt

SEQ ID NO: 606409 - DNA, 25 bp, Mus musculus
ggatgttgctattgtgacatgcagt

SEQ ID NO: 606410 - DNA, 25 bp, Mus musculus
ggatgttgctgaccccaacaaggtc

SEQ ID NO: 606411 - DNA, 25 bp, Mus musculus
ggatgttgctgagcccaacaaggtc

SEQ ID NO: 606412 - DNA, 25 bp, Mus musculus
ggatgttggatgaatctggcaccta

SEQ ID NO: 606413 - DNA, 25 bp, Mus musculus
ggatgttggatgtatctggcaccta

SEQ ID NO: 606414 - DNA, 25 bp, Mus musculus
ggatgttggcacagggtatctgttt

SEQ ID NO: 606415 - DNA, 25 bp, Mus musculus
ggatgttggcactgggtatctgttt

SEQ ID NO: 606416 - DNA, 25 bp, Mus musculus
ggatgttgggtgatcaagcccagaa

SEQ ID NO: 606417 - DNA, 25 bp, Mus musculus
ggatgttgggtgttcaagcccagaa

SEQ ID NO: 606418 - DNA, 25 bp, Mus musculus
ggatgttggtacagctagccttgtg

SEQ ID NO: 606419 - DNA, 25 bp, Mus musculus
ggatgttggtactgctagccttgtg

SEQ ID NO: 606420 - DNA, 25 bp, Mus musculus
ggatgttgtcatcgctgaccacaga

SEQ ID NO: 606421 - DNA, 25 bp, Mus musculus
ggatgttgtcatggctgaccacaga

SEQ ID NO: 606422 - DNA, 25 bp, Mus musculus
ggatgtttaaagctaccctgagcta

SEQ ID NO: 606423 - DNA, 25 bp, Mus musculus
ggatgtttaaaggtaccctgagcta

SEQ ID NO: 606424 - DNA, 25 bp, Mus musculus
ggatgtttacagaatacgtctttag

SEQ ID NO: 606425 - DNA, 25 bp, Mus musculus
ggatgtttacagacttgccaagggt

SEQ ID NO: 606426 - DNA, 25 bp, Mus musculus
ggatgtttacagtatacgtctttag

SEQ ID NO: 606427 - DNA, 25 bp, Mus musculus
ggatgtttacagtcttgccaagggt

SEQ ID NO: 606428 - DNA, 25 bp, Mus musculus
ggatgtttagaaacctttcttctct

SEQ ID NO: 606429 - DNA, 25 bp, Mus musculus
ggatgtttagaatcctttcttctct

SEQ ID NO: 606430 - DNA, 25 bp, Mus musculus
ggatgtttcacactcaggcggttta

SEQ ID NO: 606431 - DNA, 25 bp, Mus musculus
ggatgtttcacagtcaggcggttta

SEQ ID NO: 606432 - DNA, 25 bp, Mus musculus
ggatgtttcactcctgacactggag

SEQ ID NO: 606433 - DNA, 25 bp, Mus musculus
ggatgtttcactgctgacactggag

SEQ ID NO: 606434 - DNA, 25 bp, Mus musculus
ggatgtttccacaaaggtactctgt

SEQ ID NO: 606435 - DNA, 25 bp, Mus musculus
ggatgtttccacaataatgaagttt

SEQ ID NO: 606436 - DNA, 25 bp, Mus musculus
ggatgtttccactaaggtactctgt

SEQ ID NO: 606437 - DNA, 25 bp, Mus musculus
ggatgtttccactataatgaagttt

SEQ ID NO: 606438 - DNA, 25 bp, Mus musculus
ggatgtttccagaaacaccgaacta

SEQ ID NO: 606439 - DNA, 25 bp, Mus musculus
ggatgtttccagcaattaaactttt

SEQ ID NO: 606440 - DNA, 25 bp, Mus musculus
ggatgtttccaggaattaaactttt

SEQ ID NO: 606441 - DNA, 25 bp, Mus musculus
ggatgtttccagtaacaccgaacta

SEQ ID NO: 606442 - DNA, 25 bp, Mus musculus
ggatgtttccatatacctcatgcat

SEQ ID NO: 606443 - DNA, 25 bp, Mus musculus
ggatgtttccatttacctcatgcat

SEQ ID NO: 606444 - DNA, 25 bp, Mus musculus
ggatgtttcctcctgatgtatagta

SEQ ID NO: 606445 - DNA, 25 bp, Mus musculus
ggatgtttcctcgtgatgtatagta

SEQ ID NO: 606446 - DNA, 25 bp, Mus musculus
ggatgtttcctgctttgctcccaaa

SEQ ID NO: 606447 - DNA, 25 bp, Mus musculus
ggatgtttcctggtttgctcccaaa

SEQ ID NO: 606448 - DNA, 25 bp, Mus musculus
ggatgtttctatcgacgtttcttct

SEQ ID NO: 606449 - DNA, 25 bp, Mus musculus
ggatgtttctatggacgtttcttct

SEQ ID NO: 606450 - DNA, 25 bp, Mus musculus
ggatgtttctgcaatgtttagaatc

SEQ ID NO: 606451 - DNA, 25 bp, Mus musculus
ggatgtttctgctatgtttagaatc

SEQ ID NO: 606452 - DNA, 25 bp, Mus musculus
ggatgtttgagaatcatctccctaa

SEQ ID NO: 606453 - DNA, 25 bp, Mus musculus
ggatgtttgagattcatctccctaa

SEQ ID NO: 606454 - DNA, 25 bp, Mus musculus
ggatgtttgcaaaaatggccccaag

SEQ ID NO: 606455 - DNA, 25 bp, Mus musculus
ggatgtttgcaataatggccccaag

SEQ ID NO: 606456 - DNA, 25 bp, Mus musculus
ggatgtttgggcagtttgatttctt

SEQ ID NO: 606457 - DNA, 25 bp, Mus musculus
ggatgtttgggctgtttgatttctt

SEQ ID NO: 606458 - DNA, 25 bp, Mus musculus
ggatgtttgtcccacactacaggag

SEQ ID NO: 606459 - DNA, 25 bp, Mus musculus
ggatgtttgtccgacactacaggag

SEQ ID NO: 606460 - DNA, 25 bp, Mus musculus
ggatgtttgttgatgactagttgac

SEQ ID NO: 606461 - DNA, 25 bp, Mus musculus
ggatgtttgttgttgactagttgac

SEQ ID NO: 606462 - DNA, 25 bp, Mus musculus
ggatgttttaatacccctcatcttt

SEQ ID NO: 606463 - DNA, 25 bp, Mus musculus
ggatgttttaattcccctcatcttt

SEQ ID NO: 606464 - DNA, 25 bp, Mus musculus
ggatgttttcaaactagggcttcaa

SEQ ID NO: 606465 - DNA, 25 bp, Mus musculus
ggatgttttcaatctagggcttcaa

SEQ ID NO: 606466 - DNA, 25 bp, Mus musculus
ggatgttttcgtcagcagtgtgctt

SEQ ID NO: 606467 - DNA, 25 bp, Mus musculus
ggatgttttcgtgagcagtgtgctt

SEQ ID NO: 606468 - DNA, 25 bp, Mus musculus
ggatgttttggaccgagtagaggca

SEQ ID NO: 606469 - DNA, 25 bp, Mus musculus
ggatgttttggagcgagtagaggca

SEQ ID NO: 606470 - DNA, 25 bp, Mus musculus
ggatgttttgtcattgtcacagctg

SEQ ID NO: 606471 - DNA, 25 bp, Mus musculus
ggatgttttgtctttgtcacagctg

SEQ ID NO: 606472 - DNA, 25 bp, Mus musculus
ggatgttttgtgaagtaacttggca

SEQ ID NO: 606473 - DNA, 25 bp, Mus musculus
ggatgttttgtgtagtaacttggca

SEQ ID NO: 606474 - DNA, 25 bp, Mus musculus
ggatgtttttgcaagctccctcttg

SEQ ID NO: 606475 - DNA, 25 bp, Mus musculus
ggatgtttttgctagctccctcttg

SEQ ID NO: 606476 - DNA, 25 bp, Mus musculus
ggattaaaagtcatttggattaaga

SEQ ID NO: 606477 - DNA, 25 bp, Mus musculus
ggattaaaagtcttttggattaaga

SEQ ID NO: 606478 - DNA, 25 bp, Mus musculus
ggattaaaagtgagccgctaatttt

SEQ ID NO: 606479 - DNA, 25 bp, Mus musculus
ggattaaaagtgtgccgctaatttt

SEQ ID NO: 606480 - DNA, 25 bp, Mus musculus
ggattaaaatctcttctgtgcacaa

SEQ ID NO: 606481 - DNA, 25 bp, Mus musculus
ggattaaaatctgttctgtgcacaa

SEQ ID NO: 606482 - DNA, 25 bp, Mus musculus
ggattaaaatttcgattctctgata

SEQ ID NO: 606483 - DNA, 25 bp, Mus musculus
ggattaaaatttggattctctgata

SEQ ID NO: 606484 - DNA, 25 bp, Mus musculus
ggattaaacagcacctgtaccagtt

SEQ ID NO: 606485 - DNA, 25 bp, Mus musculus
ggattaaacagctcctgtaccagtt

SEQ ID NO: 606486 - DNA, 25 bp, Mus musculus
ggattaaagaccaaaacatgaagat

SEQ ID NO: 606487 - DNA, 25 bp, Mus musculus
ggattaaagacctaaacatgaagat

SEQ ID NO: 606488 - DNA, 25 bp, Mus musculus
ggattaaagcctctgttttacacct

SEQ ID NO: 606489 - DNA, 25 bp, Mus musculus
ggattaaagcctgtgttttacacct

SEQ ID NO: 606490 - DNA, 25 bp, Mus musculus
ggattaaaggtaacacgttcgcctc

SEQ ID NO: 606491 - DNA, 25 bp, Mus musculus
ggattaaaggtatcacgttcgcctc

SEQ ID NO: 606492 - DNA, 25 bp, Mus musculus
ggattaaatatcaacagacacgctg

SEQ ID NO: 606493 - DNA, 25 bp, Mus musculus
ggattaaatatctacagacacgctg

SEQ ID NO: 606494 - DNA, 25 bp, Mus musculus
ggattaacactcctgaacagactgt

SEQ ID NO: 606495 - DNA, 25 bp, Mus musculus
ggattaacactcgtgaacagactgt

SEQ ID NO: 606496 - DNA, 25 bp, Mus musculus
ggattaacactgcagaacatgggaa

SEQ ID NO: 606497 - DNA, 25 bp, Mus musculus
ggattaacactggagaacatgggaa

SEQ ID NO: 606498 - DNA, 25 bp, Mus musculus
ggattaacatcaaatttcaacgcaa

SEQ ID NO: 606499 - DNA, 25 bp, Mus musculus
ggattaacatcatatttcaacgcaa

SEQ ID NO: 606500 - DNA, 25 bp, Mus musculus
ggattaaccctcaatgacactgttc

SEQ ID NO: 606501 - DNA, 25 bp, Mus musculus
ggattaaccctctatgacactgttc

SEQ ID NO: 606502 - DNA, 25 bp, Mus musculus
ggattaaccgtgatttcagtgtact

SEQ ID NO: 606503 - DNA, 25 bp, Mus musculus
ggattaaccgtgttttcagtgtact

SEQ ID NO: 606504 - DNA, 25 bp, Mus musculus
ggattaaccttcagccagggtctaa

SEQ ID NO: 606505 - DNA, 25 bp, Mus musculus
ggattaaccttctgccagggtctaa

SEQ ID NO: 606506 - DNA, 25 bp, Mus musculus
ggattaactaccagttcattctcaa

SEQ ID NO: 606507 - DNA, 25 bp, Mus musculus
ggattaactacctgttcattctcaa

SEQ ID NO: 606508 - DNA, 25 bp, Mus musculus
ggattaagaacaatgcacccgtgac

SEQ ID NO: 606509 - DNA, 25 bp, Mus musculus
ggattaagaacattgcacccgtgac

SEQ ID NO: 606510 - DNA, 25 bp, Mus musculus
ggattaagccagagctgtcccatgg

SEQ ID NO: 606511 - DNA, 25 bp, Mus musculus
ggattaagccagtgctgtcccatgg

SEQ ID NO: 606512 - DNA, 25 bp, Mus musculus
ggattaagcctaagaccttgtgtat

SEQ ID NO: 606513 - DNA, 25 bp, Mus musculus
ggattaagcctatgaccttgtgtat

SEQ ID NO: 606514 - DNA, 25 bp, Mus musculus
ggattaagccttacctgtcgtctct

SEQ ID NO: 606515 - DNA, 25 bp, Mus musculus
ggattaagcctttcctgtcgtctct

SEQ ID NO: 606516 - DNA, 25 bp, Mus musculus
ggattaagtcagaacaacaattgtg

SEQ ID NO: 606517 - DNA, 25 bp, Mus musculus
ggattaagtcagtacaacaattgtg

SEQ ID NO: 606518 - DNA, 25 bp, Mus musculus
ggattaagtgccctcatgatgggtt

SEQ ID NO: 606519 - DNA, 25 bp, Mus musculus
ggattaagtgccgtcatgatgggtt

SEQ ID NO: 606520 - DNA, 25 bp, Mus musculus
ggattaagttaccacagccaagcaa

SEQ ID NO: 606521 - DNA, 25 bp, Mus musculus
ggattaagttacgacagccaagcaa

SEQ ID NO: 606522 - DNA, 25 bp, Mus musculus
ggattaagtttcatctctcacaaag

SEQ ID NO: 606523 - DNA, 25 bp, Mus musculus
ggattaagtttcttctctcacaaag

SEQ ID NO: 606524 - DNA, 25 bp, Mus musculus
ggattaataccaatcttcaactatc

SEQ ID NO: 606525 - DNA, 25 bp, Mus musculus
ggattaataccattcttcaactatc

SEQ ID NO: 606526 - DNA, 25 bp, Mus musculus
ggattaatacctcaactattccaaa

SEQ ID NO: 606527 - DNA, 25 bp, Mus musculus
ggattaatacctgaactattccaaa

SEQ ID NO: 606528 - DNA, 25 bp, Mus musculus
ggattaatagttcttgtctgccctc

SEQ ID NO: 606529 - DNA, 25 bp, Mus musculus
ggattaatagttgttgtctgccctc

SEQ ID NO: 606530 - DNA, 25 bp, Mus musculus
ggattaatatacacccaacattcag

SEQ ID NO: 606531 - DNA, 25 bp, Mus musculus
ggattaatatactcccaacattcag

SEQ ID NO: 606532 - DNA, 25 bp, Mus musculus
ggattaatcattctgtagctatctg

SEQ ID NO: 606533 - DNA, 25 bp, Mus musculus
ggattaatcattgtgtagctatctg

SEQ ID NO: 606534 - DNA, 25 bp, Mus musculus
ggattaatgggcaccagctaaagaa

SEQ ID NO: 606535 - DNA, 25 bp, Mus musculus
ggattaatgggctccagctaaagaa

SEQ ID NO: 606536 - DNA, 25 bp, Mus musculus
ggattacaaaagctgcccttaccac

SEQ ID NO: 606537 - DNA, 25 bp, Mus musculus
ggattacaaaaggtgcccttaccac

SEQ ID NO: 606538 - DNA, 25 bp, Mus musculus
ggattacaaaatacaggctggaggc

SEQ ID NO: 606539 - DNA, 25 bp, Mus musculus
ggattacaaaattcaggctggaggc

SEQ ID NO: 606540 - DNA, 25 bp, Mus musculus
ggattacaaattcgagccctacacc

SEQ ID NO: 606541 - DNA, 25 bp, Mus musculus
ggattacaaattggagccctacacc

SEQ ID NO: 606542 - DNA, 25 bp, Mus musculus
ggattacaacctatcagacgacata

SEQ ID NO: 606543 - DNA, 25 bp, Mus musculus
ggattacaacctttcagacgacata

SEQ ID NO: 606544 - DNA, 25 bp, Mus musculus
ggattacaactacccactgtgtgca

SEQ ID NO: 606545 - DNA, 25 bp, Mus musculus
ggattacaactagccactgtgtgca

SEQ ID NO: 606546 - DNA, 25 bp, Mus musculus
ggattacaagatacttaaagacaga

SEQ ID NO: 606547 - DNA, 25 bp, Mus musculus
ggattacaagattcttaaagacaga

SEQ ID NO: 606548 - DNA, 25 bp, Mus musculus
ggattacaagccatattgaacacca

SEQ ID NO: 606549 - DNA, 25 bp, Mus musculus
ggattacaagccttattgaacacca

SEQ ID NO: 606550 - DNA, 25 bp, Mus musculus
ggattacaccacaatgcagctattt

SEQ ID NO: 606551 - DNA, 25 bp, Mus musculus
ggattacaccactatgcagctattt

SEQ ID NO: 606552 - DNA, 25 bp, Mus musculus
ggattacaggccaatctgagctgaa

SEQ ID NO: 606553 - DNA, 25 bp, Mus musculus
ggattacaggcctatctgagctgaa

SEQ ID NO: 606554 - DNA, 25 bp, Mus musculus
ggattacagtatcatctgcctggaa

SEQ ID NO: 606555 - DNA, 25 bp, Mus musculus
ggattacagtatcatttcctaattc

SEQ ID NO: 606556 - DNA, 25 bp, Mus musculus
ggattacagtatgatctgcctggaa

SEQ ID NO: 606557 - DNA, 25 bp, Mus musculus
ggattacagtatgatttcctaattc

SEQ ID NO: 606558 - DNA, 25 bp, Mus musculus
ggattacagtcacacggcagccctg

SEQ ID NO: 606559 - DNA, 25 bp, Mus musculus
ggattacagtcagacggcagccctg

SEQ ID NO: 606560 - DNA, 25 bp, Mus musculus
ggattacagttgaatgacatcatcc

SEQ ID NO: 606561 - DNA, 25 bp, Mus musculus
ggattacagttgtatgacatcatcc

SEQ ID NO: 606562 - DNA, 25 bp, Mus musculus
ggattacagtttctaagcctgtctt

SEQ ID NO: 606563 - DNA, 25 bp, Mus musculus
ggattacagtttgtaagcctgtctt

SEQ ID NO: 606564 - DNA, 25 bp, Mus musculus
ggattacatactcctattgatatta

SEQ ID NO: 606565 - DNA, 25 bp, Mus musculus
ggattacatactgctattgatatta

SEQ ID NO: 606566 - DNA, 25 bp, Mus musculus
ggattaccaaccctcagattcagag

SEQ ID NO: 606567 - DNA, 25 bp, Mus musculus
ggattaccaaccgtcagattcagag

SEQ ID NO: 606568 - DNA, 25 bp, Mus musculus
ggattaccaagtcgccaccagtgca

SEQ ID NO: 606569 - DNA, 25 bp, Mus musculus
ggattaccaagtggccaccagtgca

SEQ ID NO: 606570 - DNA, 25 bp, Mus musculus
ggattaccaggtatgtgtagctgat

SEQ ID NO: 606571 - DNA, 25 bp, Mus musculus
ggattaccaggtttgtgtagctgat

SEQ ID NO: 606572 - DNA, 25 bp, Mus musculus
ggattaccatcaacatggcatggca

SEQ ID NO: 606573 - DNA, 25 bp, Mus musculus
ggattaccatcatcatggcatggca

SEQ ID NO: 606574 - DNA, 25 bp, Mus musculus
ggattaccatctccaactggtttga

SEQ ID NO: 606575 - DNA, 25 bp, Mus musculus
ggattaccatctgcaactggtttga

SEQ ID NO: 606576 - DNA, 25 bp, Mus musculus
ggattacccctgcacactgagctca

SEQ ID NO: 606577 - DNA, 25 bp, Mus musculus
ggattacccctggacactgagctca

SEQ ID NO: 606578 - DNA, 25 bp, Mus musculus
ggattacccgatagaaaccttgcaa

SEQ ID NO: 606579 - DNA, 25 bp, Mus musculus
ggattacccgattgaaaccttgcaa

SEQ ID NO: 606580 - DNA, 25 bp, Mus musculus
ggattacctctgaatgttagcagct

SEQ ID NO: 606581 - DNA, 25 bp, Mus musculus
ggattacctctgtatgttagcagct

SEQ ID NO: 606582 - DNA, 25 bp, Mus musculus
ggattacctggaaactgatacatct

SEQ ID NO: 606583 - DNA, 25 bp, Mus musculus
ggattacctggatactgatacatct

SEQ ID NO: 606584 - DNA, 25 bp, Mus musculus
ggattaccttcaaagacagttctga

SEQ ID NO: 606585 - DNA, 25 bp, Mus musculus
ggattaccttcatagacagttctga

SEQ ID NO: 606586 - DNA, 25 bp, Mus musculus
ggattacggcacaatggcatgagca

SEQ ID NO: 606587 - DNA, 25 bp, Mus musculus
ggattacggcactatggcatgagca

SEQ ID NO: 606588 - DNA, 25 bp, Mus musculus
ggattacgtactaccttttcatcat

SEQ ID NO: 606589 - DNA, 25 bp, Mus musculus
ggattacgtacttccttttcatcat

SEQ ID NO: 606590 - DNA, 25 bp, Mus musculus
ggattacgtgttccgcatcatctac

SEQ ID NO: 606591 - DNA, 25 bp, Mus musculus
ggattacgtgttgcgcatcatctac

SEQ ID NO: 606592 - DNA, 25 bp, Mus musculus
ggattactacatccagctcactagg

SEQ ID NO: 606593 - DNA, 25 bp, Mus musculus
ggattactacatgcagctcactagg

SEQ ID NO: 606594 - DNA, 25 bp, Mus musculus
ggattactacttcttgtgttatcga

SEQ ID NO: 606595 - DNA, 25 bp, Mus musculus
ggattactacttgttgtgttatcga

SEQ ID NO: 606596 - DNA, 25 bp, Mus musculus
ggattactataacgccagtctggct

SEQ ID NO: 606597 - DNA, 25 bp, Mus musculus
ggattactataaggccagtctggct

SEQ ID NO: 606598 - DNA, 25 bp, Mus musculus
ggattactatagaatacaactgcat

SEQ ID NO: 606599 - DNA, 25 bp, Mus musculus
ggattactatagtatacaactgcat

SEQ ID NO: 606600 - DNA, 25 bp, Mus musculus
ggattactcattcctacatctagaa

SEQ ID NO: 606601 - DNA, 25 bp, Mus musculus
ggattactcattgctacatctagaa

SEQ ID NO: 606602 - DNA, 25 bp, Mus musculus
ggattactcctacgtttcaccataa

SEQ ID NO: 606603 - DNA, 25 bp, Mus musculus
ggattactcctaggtttcaccataa

SEQ ID NO: 606604 - DNA, 25 bp, Mus musculus
ggattactgaccctgatgtacccag

SEQ ID NO: 606605 - DNA, 25 bp, Mus musculus
ggattactgaccgtgatgtacccag

SEQ ID NO: 606606 - DNA, 25 bp, Mus musculus
ggattactgagtactgtgcttccca

SEQ ID NO: 606607 - DNA, 25 bp, Mus musculus
ggattactgagttctgtgcttccca

SEQ ID NO: 606608 - DNA, 25 bp, Mus musculus
ggattactggcgactactgaaccct

SEQ ID NO: 606609 - DNA, 25 bp, Mus musculus
ggattactggcgtctactgaaccct

SEQ ID NO: 606610 - DNA, 25 bp, Mus musculus
ggattactggctagaattgtgggca

SEQ ID NO: 606611 - DNA, 25 bp, Mus musculus
ggattactggcttgaattgtgggca

SEQ ID NO: 606612 - DNA, 25 bp, Mus musculus
ggattactggtcacccagttctggg

SEQ ID NO: 606613 - DNA, 25 bp, Mus musculus
ggattactggtctcccagttctggg

SEQ ID NO: 606614 - DNA, 25 bp, Mus musculus
ggattagaacacaagccatacaaac

SEQ ID NO: 606615 - DNA, 25 bp, Mus musculus
ggattagaacactagccatacaaac

SEQ ID NO: 606616 - DNA, 25 bp, Mus musculus
ggattagacctgagtgcaccctgac

SEQ ID NO: 606617 - DNA, 25 bp, Mus musculus
ggattagacctgtgtgcaccctgac

SEQ ID NO: 606618 - DNA, 25 bp, Mus musculus
ggattagactctcgccaagggatct

SEQ ID NO: 606619 - DNA, 25 bp, Mus musculus
ggattagactctggccaagggatct

SEQ ID NO: 606620 - DNA, 25 bp, Mus musculus
ggattagagaaacctcttaactcca

SEQ ID NO: 606621 - DNA, 25 bp, Mus musculus
ggattagagaaagctcttaactcca

SEQ ID NO: 606622 - DNA, 25 bp, Mus musculus
ggattagagaacaccggcttctgta

SEQ ID NO: 606623 - DNA, 25 bp, Mus musculus
ggattagagaactccggcttctgta

SEQ ID NO: 606624 - DNA, 25 bp, Mus musculus
ggattagatagcattctttccattt

SEQ ID NO: 606625 - DNA, 25 bp, Mus musculus
ggattagatagctttctttccattt

SEQ ID NO: 606626 - DNA, 25 bp, Mus musculus
ggattagatgctcctgcatttgtga

SEQ ID NO: 606627 - DNA, 25 bp, Mus musculus
ggattagatgctgctgcatttgtga

SEQ ID NO: 606628 - DNA, 25 bp, Mus musculus
ggattagccctaaacatttttgctt

SEQ ID NO: 606629 - DNA, 25 bp, Mus musculus
ggattagccctatacatttttgctt

SEQ ID NO: 606630 - DNA, 25 bp, Mus musculus
ggattagcgtgaaagtgaccttgtt

SEQ ID NO: 606631 - DNA, 25 bp, Mus musculus
ggattagcgtgatagtgaccttgtt

SEQ ID NO: 606632 - DNA, 25 bp, Mus musculus
ggattaggaattcttgtgtaacaac

SEQ ID NO: 606633 - DNA, 25 bp, Mus musculus
ggattaggaattgttgtgtaacaac

SEQ ID NO: 606634 - DNA, 25 bp, Mus musculus
ggattaggcatgactttacctgtaa

SEQ ID NO: 606635 - DNA, 25 bp, Mus musculus
ggattaggcatgtctttacctgtaa

SEQ ID NO: 606636 - DNA, 25 bp, Mus musculus
ggattaggcctcatactgattgtct

SEQ ID NO: 606637 - DNA, 25 bp, Mus musculus
ggattaggcctcttactgattgtct

SEQ ID NO: 606638 - DNA, 25 bp, Mus musculus
ggattaggctcaccctggctgtgca

SEQ ID NO: 606639 - DNA, 25 bp, Mus musculus
ggattaggctcagcctggctgtgca

SEQ ID NO: 606640 - DNA, 25 bp, Mus musculus
ggattagtagtgctctctgtggctt

SEQ ID NO: 606641 - DNA, 25 bp, Mus musculus
ggattagtagtggtctctgtggctt

SEQ ID NO: 606642 - DNA, 25 bp, Mus musculus
ggattagtccaaaacactgttctga

SEQ ID NO: 606643 - DNA, 25 bp, Mus musculus
ggattagtccaatacactgttctga

SEQ ID NO: 606644 - DNA, 25 bp, Mus musculus
ggattagtccaccatctcaagtggt

SEQ ID NO: 606645 - DNA, 25 bp, Mus musculus
ggattagtccacgatctcaagtggt

SEQ ID NO: 606646 - DNA, 25 bp, Mus musculus
ggattagttccaagttagtataata

SEQ ID NO: 606647 - DNA, 25 bp, Mus musculus
ggattagttccatgttagtataata

SEQ ID NO: 606648 - DNA, 25 bp, Mus musculus
ggattagttgcccattatagtctaa

SEQ ID NO: 606649 - DNA, 25 bp, Mus musculus
ggattagttgccgattatagtctaa

SEQ ID NO: 606650 - DNA, 25 bp, Mus musculus
ggattataacacaggcgaccggttt

SEQ ID NO: 606651 - DNA, 25 bp, Mus musculus
ggattataacactggcgaccggttt

SEQ ID NO: 606652 - DNA, 25 bp, Mus musculus
ggattataacctagtgccacgatgc

SEQ ID NO: 606653 - DNA, 25 bp, Mus musculus
ggattataaccttgtgccacgatgc

SEQ ID NO: 606654 - DNA, 25 bp, Mus musculus
ggattataagcccacacacttctat

SEQ ID NO: 606655 - DNA, 25 bp, Mus musculus
ggattataagccgacacacttctat

SEQ ID NO: 606656 - DNA, 25 bp, Mus musculus
ggattatacactcgctttgcagcta

SEQ ID NO: 606657 - DNA, 25 bp, Mus musculus
ggattatacactggctttgcagcta

SEQ ID NO: 606658 - DNA, 25 bp, Mus musculus
ggattatacagcagacgcatacttt

SEQ ID NO: 606659 - DNA, 25 bp, Mus musculus
ggattatacagctgacgcatacttt

SEQ ID NO: 606660 - DNA, 25 bp, Mus musculus
ggattatacagtaagcctgtgccca

SEQ ID NO: 606661 - DNA, 25 bp, Mus musculus
ggattatacagttagcctgtgccca

SEQ ID NO: 606662 - DNA, 25 bp, Mus musculus
ggattatacattagcacaccacctc

SEQ ID NO: 606663 - DNA, 25 bp, Mus musculus
ggattatacatttgcacaccacctc

SEQ ID NO: 606664 - DNA, 25 bp, Mus musculus
ggattataccttcatcgggatcttc

SEQ ID NO: 606665 - DNA, 25 bp, Mus musculus
ggattataccttgatcgggatcttc

SEQ ID NO: 606666 - DNA, 25 bp, Mus musculus
ggattatagaccaccagtgcacgag

SEQ ID NO: 606667 - DNA, 25 bp, Mus musculus
ggattatagaccagtgcacctgcca

SEQ ID NO: 606668 - DNA, 25 bp, Mus musculus
ggattatagacctccagtgcacgag

SEQ ID NO: 606669 - DNA, 25 bp, Mus musculus
ggattatagacctgtgcacctgcca

SEQ ID NO: 606670 - DNA, 25 bp, Mus musculus
ggattataggcacggatgcaccacc

SEQ ID NO: 606671 - DNA, 25 bp, Mus musculus
ggattataggcagggatgcaccacc

SEQ ID NO: 606672 - DNA, 25 bp, Mus musculus
ggattatatggcaagcactctattt

SEQ ID NO: 606673 - DNA, 25 bp, Mus musculus
ggattatatggctagcactctattt

SEQ ID NO: 606674 - DNA, 25 bp, Mus musculus
ggattatattagatctgctgagatt

SEQ ID NO: 606675 - DNA, 25 bp, Mus musculus
ggattatattagttctgctgagatt

SEQ ID NO: 606676 - DNA, 25 bp, Mus musculus
ggattatcaactacccttattccac

SEQ ID NO: 606677 - DNA, 25 bp, Mus musculus
ggattatcaacttcccttattccac

SEQ ID NO: 606678 - DNA, 25 bp, Mus musculus
ggattatcaataaccatttgtcaag

SEQ ID NO: 606679 - DNA, 25 bp, Mus musculus
ggattatcaatatccatttgtcaag

SEQ ID NO: 606680 - DNA, 25 bp, Mus musculus
ggattatcacgccagaactctaaga

SEQ ID NO: 606681 - DNA, 25 bp, Mus musculus
ggattatcacgcgagaactctaaga

SEQ ID NO: 606682 - DNA, 25 bp, Mus musculus
ggattatcatatagccctgtttata

SEQ ID NO: 606683 - DNA, 25 bp, Mus musculus
ggattatcatattgccctgtttata

SEQ ID NO: 606684 - DNA, 25 bp, Mus musculus
ggattatcatttacagagcaacgca

SEQ ID NO: 606685 - DNA, 25 bp, Mus musculus
ggattatcattttcagagcaacgca

SEQ ID NO: 606686 - DNA, 25 bp, Mus musculus
ggattatccacactcccagaaatgg

SEQ ID NO: 606687 - DNA, 25 bp, Mus musculus
ggattatccacagtcccagaaatgg

SEQ ID NO: 606688 - DNA, 25 bp, Mus musculus
ggattatccaccacaaagatccctt

SEQ ID NO: 606689 - DNA, 25 bp, Mus musculus
ggattatccacctcaaagatccctt

SEQ ID NO: 606690 - DNA, 25 bp, Mus musculus
ggattatccataccctcattgtgga

SEQ ID NO: 606691 - DNA, 25 bp, Mus musculus
ggattatccatagcctcattgtgga

SEQ ID NO: 606692 - DNA, 25 bp, Mus musculus
ggattatccctgcttgtttctttac

SEQ ID NO: 606693 - DNA, 25 bp, Mus musculus
ggattatccctggttgtttctttac

SEQ ID NO: 606694 - DNA, 25 bp, Mus musculus
ggattatctaggacacagactcaaa

SEQ ID NO: 606695 - DNA, 25 bp, Mus musculus
ggattatctaggtcacagactcaaa

SEQ ID NO: 606696 - DNA, 25 bp, Mus musculus
ggattatctccgatttacagttttg

SEQ ID NO: 606697 - DNA, 25 bp, Mus musculus
ggattatctccgttttacagttttg

SEQ ID NO: 606698 - DNA, 25 bp, Mus musculus
ggattatctctgcaggctgaaggca

SEQ ID NO: 606699 - DNA, 25 bp, Mus musculus
ggattatctctggaggctgaaggca

SEQ ID NO: 606700 - DNA, 25 bp, Mus musculus
ggattatctgttcgccatactttta

SEQ ID NO: 606701 - DNA, 25 bp, Mus musculus
ggattatctgttggccatactttta

SEQ ID NO: 606702 - DNA, 25 bp, Mus musculus
ggattatgacagactacgaccgcta

SEQ ID NO: 606703 - DNA, 25 bp, Mus musculus
ggattatgacagtctacgaccgcta

SEQ ID NO: 606704 - DNA, 25 bp, Mus musculus
ggattatgacatagaagctagtaag

SEQ ID NO: 606705 - DNA, 25 bp, Mus musculus
ggattatgacattgaagctagtaag

SEQ ID NO: 606706 - DNA, 25 bp, Mus musculus
ggattatgactcctcctctaagaac

SEQ ID NO: 606707 - DNA, 25 bp, Mus musculus
ggattatgactcgtcctctaagaac

SEQ ID NO: 606708 - DNA, 25 bp, Mus musculus
ggattatgatccagtatctgctcag

SEQ ID NO: 606709 - DNA, 25 bp, Mus musculus
ggattatgatcctgtatctgctcag

SEQ ID NO: 606710 - DNA, 25 bp, Mus musculus
ggattatgccgcagtggagcttcac

SEQ ID NO: 606711 - DNA, 25 bp, Mus musculus
ggattatgccgctgtggagcttcac

SEQ ID NO: 606712 - DNA, 25 bp, Mus musculus
ggattatgcctgcagtttacgctgg

SEQ ID NO: 606713 - DNA, 25 bp, Mus musculus
ggattatgcctggagtttacgctgg

SEQ ID NO: 606714 - DNA, 25 bp, Mus musculus
ggattatgggacactctgagagctc

SEQ ID NO: 606715 - DNA, 25 bp, Mus musculus
ggattatgggactctctgagagctc

SEQ ID NO: 606716 - DNA, 25 bp, Mus musculus
ggattatgggttcatgccaccaggc

SEQ ID NO: 606717 - DNA, 25 bp, Mus musculus
ggattatgggttgatgccaccaggc

SEQ ID NO: 606718 - DNA, 25 bp, Mus musculus
ggattatgtcacaagcctggaagct

SEQ ID NO: 606719 - DNA, 25 bp, Mus musculus
ggattatgtcactagcctggaagct

SEQ ID NO: 606720 - DNA, 25 bp, Mus musculus
ggattatgtcatctccatgtatcga

SEQ ID NO: 606721 - DNA, 25 bp, Mus musculus
ggattatgtcatgtccatgtatcga

SEQ ID NO: 606722 - DNA, 25 bp, Mus musculus
ggattatgtttgcagttccaggtaa

SEQ ID NO: 606723 - DNA, 25 bp, Mus musculus
ggattatgtttggagttccaggtaa

SEQ ID NO: 606724 - DNA, 25 bp, Mus musculus
ggattattagccagcaacttgtagc

SEQ ID NO: 606725 - DNA, 25 bp, Mus musculus
ggattattagcctgcaacttgtagc

SEQ ID NO: 606726 - DNA, 25 bp, Mus musculus
ggattattcaagcatgagagattac

SEQ ID NO: 606727 - DNA, 25 bp, Mus musculus
ggattattcaaggatgagagattac

SEQ ID NO: 606728 - DNA, 25 bp, Mus musculus
ggattattcagacttccaaattgta

SEQ ID NO: 606729 - DNA, 25 bp, Mus musculus
ggattattcagagttccaaattgta

SEQ ID NO: 606730 - DNA, 25 bp, Mus musculus
ggattattctaacccagactgagca

SEQ ID NO: 606731 - DNA, 25 bp, Mus musculus
ggattattctaagccagactgagca

SEQ ID NO: 606732 - DNA, 25 bp, Mus musculus
ggattattctgaactacatggatta

SEQ ID NO: 606733 - DNA, 25 bp, Mus musculus
ggattattctgaccttgactgtcaa

SEQ ID NO: 606734 - DNA, 25 bp, Mus musculus
ggattattctgagcttgactgtcaa

SEQ ID NO: 606735 - DNA, 25 bp, Mus musculus
ggattattctgatctacatggatta

SEQ ID NO: 606736 - DNA, 25 bp, Mus musculus
ggattattcttgaccctgagaaggt

SEQ ID NO: 606737 - DNA, 25 bp, Mus musculus
ggattattcttgtccctgagaaggt

SEQ ID NO: 606738 - DNA, 25 bp, Mus musculus
ggattattgatgctacctccaaaga

SEQ ID NO: 606739 - DNA, 25 bp, Mus musculus
ggattattgatggtacctccaaaga

SEQ ID NO: 606740 - DNA, 25 bp, Mus musculus
ggattattgctccagcatcgcacag

SEQ ID NO: 606741 - DNA, 25 bp, Mus musculus
ggattattgctcgagcatcgcacag

SEQ ID NO: 606742 - DNA, 25 bp, Mus musculus
ggattattggttcttcagtgcccct

SEQ ID NO: 606743 - DNA, 25 bp, Mus musculus
ggattattggttgttcagtgcccct

SEQ ID NO: 606744 - DNA, 25 bp, Mus musculus
ggattatttattatacaggaagaca

SEQ ID NO: 606745 - DNA, 25 bp, Mus musculus
ggattatttattttacaggaagaca

SEQ ID NO: 606746 - DNA, 25 bp, Mus musculus
ggattatttctgcaacccttgatgg

SEQ ID NO: 606747 - DNA, 25 bp, Mus musculus
ggattatttctggaacccttgatgg

SEQ ID NO: 606748 - DNA, 25 bp, Mus musculus
ggattatttgttcgtgttgcgatac

SEQ ID NO: 606749 - DNA, 25 bp, Mus musculus
ggattatttgttggtgttgcgatac

SEQ ID NO: 606750 - DNA, 25 bp, Mus musculus
ggattatttttgctgtaaccctggg

SEQ ID NO: 606751 - DNA, 25 bp, Mus musculus
ggattatttttggtgtaaccctggg

SEQ ID NO: 606752 - DNA, 25 bp, Mus musculus
ggattcaaaactaccttttccagat

SEQ ID NO: 606753 - DNA, 25 bp, Mus musculus
ggattcaaaacttccttttccagat

SEQ ID NO: 606754 - DNA, 25 bp, Mus musculus
ggattcaaacatatacgtagtagtc

SEQ ID NO: 606755 - DNA, 25 bp, Mus musculus
ggattcaaacatttacgtagtagtc

SEQ ID NO: 606756 - DNA, 25 bp, Mus musculus
ggattcaaatccatcagtcactgac

SEQ ID NO: 606757 - DNA, 25 bp, Mus musculus
ggattcaaatccttcagtcactgac

SEQ ID NO: 606758 - DNA, 25 bp, Mus musculus
ggattcaaccccatgagtgactata

SEQ ID NO: 606759 - DNA, 25 bp, Mus musculus
ggattcaaccccttgagtgactata

SEQ ID NO: 606760 - DNA, 25 bp, Mus musculus
ggattcaacgttagtaacagatacc

SEQ ID NO: 606761 - DNA, 25 bp, Mus musculus
ggattcaacgtttgtaacagatacc

SEQ ID NO: 606762 - DNA, 25 bp, Mus musculus
ggattcaactgaagcaacctcccat

SEQ ID NO: 606763 - DNA, 25 bp, Mus musculus
ggattcaactgatgcaacctcccat

SEQ ID NO: 606764 - DNA, 25 bp, Mus musculus
ggattcaagagtacctcagaaaaat

SEQ ID NO: 606765 - DNA, 25 bp, Mus musculus
ggattcaagagttcctcagaaaaat

SEQ ID NO: 606766 - DNA, 25 bp, Mus musculus
ggattcaagcccagggaatagccct

SEQ ID NO: 606767 - DNA, 25 bp, Mus musculus
ggattcaagccctgggaatagccct

SEQ ID NO: 606768 - DNA, 25 bp, Mus musculus
ggattcaagcttcaccttatcagag

SEQ ID NO: 606769 - DNA, 25 bp, Mus musculus
ggattcaagcttgaccttatcagag

SEQ ID NO: 606770 - DNA, 25 bp, Mus musculus
ggattcaaggccagcatcactccga

SEQ ID NO: 606771 - DNA, 25 bp, Mus musculus
ggattcaaggcctgcatcactccga

SEQ ID NO: 606772 - DNA, 25 bp, Mus musculus
ggattcaaggttaccatgacttcat

SEQ ID NO: 606773 - DNA, 25 bp, Mus musculus
ggattcaaggtttccatgacttcat

SEQ ID NO: 606774 - DNA, 25 bp, Mus musculus
ggattcaagtttccttacaccagtc

SEQ ID NO: 606775 - DNA, 25 bp, Mus musculus
ggattcaagtttgcttacaccagtc

SEQ ID NO: 606776 - DNA, 25 bp, Mus musculus
ggattcaatacgcactataggtttt

SEQ ID NO: 606777 - DNA, 25 bp, Mus musculus
ggattcaatacggactataggtttt

SEQ ID NO: 606778 - DNA, 25 bp, Mus musculus
ggattcaatcacaagtactgccata

SEQ ID NO: 606779 - DNA, 25 bp, Mus musculus
ggattcaatcactagtactgccata

SEQ ID NO: 606780 - DNA, 25 bp, Mus musculus
ggattcaatctccaataatgcataa

SEQ ID NO: 606781 - DNA, 25 bp, Mus musculus
ggattcaatctcgaataatgcataa

SEQ ID NO: 606782 - DNA, 25 bp, Mus musculus
ggattcacaagaactctactatcga

SEQ ID NO: 606783 - DNA, 25 bp, Mus musculus
ggattcacaagatctctactatcga

SEQ ID NO: 606784 - DNA, 25 bp, Mus musculus
ggattcacaagccatttaccataag

SEQ ID NO: 606785 - DNA, 25 bp, Mus musculus
ggattcacaagcgatttaccataag

SEQ ID NO: 606786 - DNA, 25 bp, Mus musculus
ggattcacaatgaactgcagcgaaa

SEQ ID NO: 606787 - DNA, 25 bp, Mus musculus
ggattcacaatgtactgcagcgaaa

SEQ ID NO: 606788 - DNA, 25 bp, Mus musculus
ggattcacacagcatgcaaagctag

SEQ ID NO: 606789 - DNA, 25 bp, Mus musculus
ggattcacacaggatgcaaagctag

SEQ ID NO: 606790 - DNA, 25 bp, Mus musculus
ggattcacacggcagtcacttgttg

SEQ ID NO: 606791 - DNA, 25 bp, Mus musculus
ggattcacacgggagtcacttgttg

SEQ ID NO: 606792 - DNA, 25 bp, Mus musculus
ggattcacacttagtggttcccagg

SEQ ID NO: 606793 - DNA, 25 bp, Mus musculus
ggattcacactttgtggttcccagg

SEQ ID NO: 606794 - DNA, 25 bp, Mus musculus
ggattcacagaactccatctggcat

SEQ ID NO: 606795 - DNA, 25 bp, Mus musculus
ggattcacagaactttattcacttg

SEQ ID NO: 606796 - DNA, 25 bp, Mus musculus
ggattcacagaagtccatctggcat

SEQ ID NO: 606797 - DNA, 25 bp, Mus musculus
ggattcacagaagtttattcacttg

SEQ ID NO: 606798 - DNA, 25 bp, Mus musculus
ggattcacagccatacacatctgga

SEQ ID NO: 606799 - DNA, 25 bp, Mus musculus
ggattcacagccttacacatctgga

SEQ ID NO: 606800 - DNA, 25 bp, Mus musculus
ggattcaccaacaccatgcgtgtag

SEQ ID NO: 606801 - DNA, 25 bp, Mus musculus
ggattcaccaactccatgcgtgtag

SEQ ID NO: 606802 - DNA, 25 bp, Mus musculus
ggattcaccactatttctagcaaca

SEQ ID NO: 606803 - DNA, 25 bp, Mus musculus
ggattcaccactttttctagcaaca

SEQ ID NO: 606804 - DNA, 25 bp, Mus musculus
ggattcacccaacctatgtttatta

SEQ ID NO: 606805 - DNA, 25 bp, Mus musculus
ggattcacccaagctatgtttatta

SEQ ID NO: 606806 - DNA, 25 bp, Mus musculus
ggattcaccccgagtctaccatggt

SEQ ID NO: 606807 - DNA, 25 bp, Mus musculus
ggattcaccccgtgtctaccatggt

SEQ ID NO: 606808 - DNA, 25 bp, Mus musculus
ggattcacccctatttcaagactat

SEQ ID NO: 606809 - DNA, 25 bp, Mus musculus
ggattcacccctttttcaagactat

SEQ ID NO: 606810 - DNA, 25 bp, Mus musculus
ggattcaccctcagtgacggatgtg

SEQ ID NO: 606811 - DNA, 25 bp, Mus musculus
ggattcaccctctgtgacggatgtg

SEQ ID NO: 606812 - DNA, 25 bp, Mus musculus
ggattcaccgacctaggaaatacag

SEQ ID NO: 606813 - DNA, 25 bp, Mus musculus
ggattcaccgacgtaggaaatacag

SEQ ID NO: 606814 - DNA, 25 bp, Mus musculus
ggattcaccttgctttcttaatgga

SEQ ID NO: 606815 - DNA, 25 bp, Mus musculus
ggattcaccttggtttcttaatgga

SEQ ID NO: 606816 - DNA, 25 bp, Mus musculus
ggattcacgggcatcagaatttctg

SEQ ID NO: 606817 - DNA, 25 bp, Mus musculus
ggattcacgggcttcagaatttctg

SEQ ID NO: 606818 - DNA, 25 bp, Mus musculus
ggattcactgttaactgcaaacgtc

SEQ ID NO: 606819 - DNA, 25 bp, Mus musculus
ggattcactgtttactgcaaacgtc

SEQ ID NO: 606820 - DNA, 25 bp, Mus musculus
ggattcagaagccaaactcaccctt

SEQ ID NO: 606821 - DNA, 25 bp, Mus musculus
ggattcagaagcgaaactcaccctt

SEQ ID NO: 606822 - DNA, 25 bp, Mus musculus
ggattcagaataagtcctaactgta

SEQ ID NO: 606823 - DNA, 25 bp, Mus musculus
ggattcagaatatgtcctaactgta

SEQ ID NO: 606824 - DNA, 25 bp, Mus musculus
ggattcagaatcaacccttttgttc

SEQ ID NO: 606825 - DNA, 25 bp, Mus musculus
ggattcagaatctacccttttgttc

SEQ ID NO: 606826 - DNA, 25 bp, Mus musculus
ggattcagactcagcaatggtgcca

SEQ ID NO: 606827 - DNA, 25 bp, Mus musculus
ggattcagactctgcaatggtgcca

SEQ ID NO: 606828 - DNA, 25 bp, Mus musculus
ggattcagagccattttctgcagat

SEQ ID NO: 606829 - DNA, 25 bp, Mus musculus
ggattcagagcctttttctgcagat

SEQ ID NO: 606830 - DNA, 25 bp, Mus musculus
ggattcagagtccacatagcctggg

SEQ ID NO: 606831 - DNA, 25 bp, Mus musculus
ggattcagagtcgacatagcctggg

SEQ ID NO: 606832 - DNA, 25 bp, Mus musculus
ggattcagatagagctagtgagcta

SEQ ID NO: 606833 - DNA, 25 bp, Mus musculus
ggattcagatagtgctagtgagcta

SEQ ID NO: 606834 - DNA, 25 bp, Mus musculus
ggattcagatatactggctgctctt

SEQ ID NO: 606835 - DNA, 25 bp, Mus musculus
ggattcagatattctggctgctctt

SEQ ID NO: 606836 - DNA, 25 bp, Mus musculus
ggattcagatcacgtttcatacaga

SEQ ID NO: 606837 - DNA, 25 bp, Mus musculus
ggattcagatcaggtttcatacaga

SEQ ID NO: 606838 - DNA, 25 bp, Mus musculus
ggattcagcagaaggtaactcctct

SEQ ID NO: 606839 - DNA, 25 bp, Mus musculus
ggattcagcagatggtaactcctct

SEQ ID NO: 606840 - DNA, 25 bp, Mus musculus
ggattcagccagacttgaaacacaa

SEQ ID NO: 606841 - DNA, 25 bp, Mus musculus
ggattcagccagtcttgaaacacaa

SEQ ID NO: 606842 - DNA, 25 bp, Mus musculus
ggattcagcgagagaccttgtctta

SEQ ID NO: 606843 - DNA, 25 bp, Mus musculus
ggattcagcgagtgaccttgtctta

SEQ ID NO: 606844 - DNA, 25 bp, Mus musculus
ggattcagcttgactggtgctcaga

SEQ ID NO: 606845 - DNA, 25 bp, Mus musculus
ggattcagcttgtctggtgctcaga

SEQ ID NO: 606846 - DNA, 25 bp, Mus musculus
ggattcaggaaaagcgtggccattt

SEQ ID NO: 606847 - DNA, 25 bp, Mus musculus
ggattcaggaaatgcgtggccattt

SEQ ID NO: 606848 - DNA, 25 bp, Mus musculus
ggattcaggacaagccggtcaggaa

SEQ ID NO: 606849 - DNA, 25 bp, Mus musculus
ggattcaggacatgccggtcaggaa

SEQ ID NO: 606850 - DNA, 25 bp, Mus musculus
ggattcaggaccaagcagcaccatg

SEQ ID NO: 606851 - DNA, 25 bp, Mus musculus
ggattcaggacctagcagcaccatg

SEQ ID NO: 606852 - DNA, 25 bp, Mus musculus
ggattcagggctattgttatacaga

SEQ ID NO: 606853 - DNA, 25 bp, Mus musculus
ggattcagggcttttgttatacaga

SEQ ID NO: 606854 - DNA, 25 bp, Mus musculus
ggattcagtattcctttctccaaag

SEQ ID NO: 606855 - DNA, 25 bp, Mus musculus
ggattcagtattgctttctccaaag

SEQ ID NO: 606856 - DNA, 25 bp, Mus musculus
ggattcagtcataggcaggtatcta

SEQ ID NO: 606857 - DNA, 25 bp, Mus musculus
ggattcagtcattggcaggtatcta

SEQ ID NO: 606858 - DNA, 25 bp, Mus musculus
ggattcagtgcaacagatggaccat

SEQ ID NO: 606859 - DNA, 25 bp, Mus musculus
ggattcagtgcatcagatggaccat

SEQ ID NO: 606860 - DNA, 25 bp, Mus musculus
ggattcagtgccattttacttcctg

SEQ ID NO: 606861 - DNA, 25 bp, Mus musculus
ggattcagtgcctttttacttcctg

SEQ ID NO: 606862 - DNA, 25 bp, Mus musculus
ggattcagttcaccagtaccaatta

SEQ ID NO: 606863 - DNA, 25 bp, Mus musculus
ggattcagttcagcagtaccaatta

SEQ ID NO: 606864 - DNA, 25 bp, Mus musculus
ggattcagttctcatattttcgtta

SEQ ID NO: 606865 - DNA, 25 bp, Mus musculus
ggattcagttctgatattttcgtta

SEQ ID NO: 606866 - DNA, 25 bp, Mus musculus
ggattcagtttaatcatccttatgt

SEQ ID NO: 606867 - DNA, 25 bp, Mus musculus
ggattcagtttattcatccttatgt

SEQ ID NO: 606868 - DNA, 25 bp, Mus musculus
ggattcatagcactccaatttgtaa

SEQ ID NO: 606869 - DNA, 25 bp, Mus musculus
ggattcatagcagtccaatttgtaa

SEQ ID NO: 606870 - DNA, 25 bp, Mus musculus
ggattcatcgataagctgcaccatg

SEQ ID NO: 606871 - DNA, 25 bp, Mus musculus
ggattcatcgattagctgcaccatg

SEQ ID NO: 606872 - DNA, 25 bp, Mus musculus
ggattcatctcaatctgggtttgtc

SEQ ID NO: 606873 - DNA, 25 bp, Mus musculus
ggattcatctcattctgggtttgtc

SEQ ID NO: 606874 - DNA, 25 bp, Mus musculus
ggattcatctctaggcctttaaaca

SEQ ID NO: 606875 - DNA, 25 bp, Mus musculus
ggattcatctcttggcctttaaaca

SEQ ID NO: 606876 - DNA, 25 bp, Mus musculus
ggattcatcttaacttctctttcat

SEQ ID NO: 606877 - DNA, 25 bp, Mus musculus
ggattcatcttatcttctctttcat

SEQ ID NO: 606878 - DNA, 25 bp, Mus musculus
ggattcatgaatcgcccttagcatt

SEQ ID NO: 606879 - DNA, 25 bp, Mus musculus
ggattcatgaatggcccttagcatt

SEQ ID NO: 606880 - DNA, 25 bp, Mus musculus
ggattcatgagtcttagcgctggct

SEQ ID NO: 606881 - DNA, 25 bp, Mus musculus
ggattcatgagtgttagcgctggct

SEQ ID NO: 606882 - DNA, 25 bp, Mus musculus
ggattcatgtaaacaggcctcttcc

SEQ ID NO: 606883 - DNA, 25 bp, Mus musculus
ggattcatgtaatcaggcctcttcc

SEQ ID NO: 606884 - DNA, 25 bp, Mus musculus
ggattcatgtgtacagtgccatctg

SEQ ID NO: 606885 - DNA, 25 bp, Mus musculus
ggattcatgtgttcagtgccatctg

SEQ ID NO: 606886 - DNA, 25 bp, Mus musculus
ggattcattaagagcattttctgct

SEQ ID NO: 606887 - DNA, 25 bp, Mus musculus
ggattcattaagtgcattttctgct

SEQ ID NO: 606888 - DNA, 25 bp, Mus musculus
ggattcattatgcactacctttgga

SEQ ID NO: 606889 - DNA, 25 bp, Mus musculus
ggattcattatggactacctttgga

SEQ ID NO: 606890 - DNA, 25 bp, Mus musculus
ggattcattctcctttgagttctca

SEQ ID NO: 606891 - DNA, 25 bp, Mus musculus
ggattcattctcgtttgagttctca

SEQ ID NO: 606892 - DNA, 25 bp, Mus musculus
ggattccaaaacagtgatgatgctc

SEQ ID NO: 606893 - DNA, 25 bp, Mus musculus
ggattccaaaacctccaactctgtt

SEQ ID NO: 606894 - DNA, 25 bp, Mus musculus
ggattccaaaacgtccaactctgtt

SEQ ID NO: 606895 - DNA, 25 bp, Mus musculus
ggattccaaaactgtgatgatgctc

SEQ ID NO: 606896 - DNA, 25 bp, Mus musculus
ggattccaaagcctgggcgagttta

SEQ ID NO: 606897 - DNA, 25 bp, Mus musculus
ggattccaaagcgtgggcgagttta

SEQ ID NO: 606898 - DNA, 25 bp, Mus musculus
ggattccaacaaacgatgagctgct

SEQ ID NO: 606899 - DNA, 25 bp, Mus musculus
ggattccaacaatcgatgagctgct

SEQ ID NO: 606900 - DNA, 25 bp, Mus musculus
ggattccaagcaagtcacctggctt

SEQ ID NO: 606901 - DNA, 25 bp, Mus musculus
ggattccaagcatgtcacctggctt

SEQ ID NO: 606902 - DNA, 25 bp, Mus musculus
ggattccaaggtccatcacacctgg

SEQ ID NO: 606903 - DNA, 25 bp, Mus musculus
ggattccaaggtgcatcacacctgg

SEQ ID NO: 606904 - DNA, 25 bp, Mus musculus
ggattccaagttcgccccacaagaa

SEQ ID NO: 606905 - DNA, 25 bp, Mus musculus
ggattccaagttggccccacaagaa

SEQ ID NO: 606906 - DNA, 25 bp, Mus musculus
ggattccacactcgaggatgctgac

SEQ ID NO: 606907 - DNA, 25 bp, Mus musculus
ggattccacactggaggatgctgac

SEQ ID NO: 606908 - DNA, 25 bp, Mus musculus
ggattccacgtacttttgcagctga

SEQ ID NO: 606909 - DNA, 25 bp, Mus musculus
ggattccacgtagttttgcagctga

SEQ ID NO: 606910 - DNA, 25 bp, Mus musculus
ggattccactggcattcagtagcca

SEQ ID NO: 606911 - DNA, 25 bp, Mus musculus
ggattccactgggattcagtagcca

SEQ ID NO: 606912 - DNA, 25 bp, Mus musculus
ggattccactgtagacctgaacccc

SEQ ID NO: 606913 - DNA, 25 bp, Mus musculus
ggattccactgttgacctgaacccc

SEQ ID NO: 606914 - DNA, 25 bp, Mus musculus
ggattccagaagagccgtcgcaagt

SEQ ID NO: 606915 - DNA, 25 bp, Mus musculus
ggattccagaagtgccgtcgcaagt

SEQ ID NO: 606916 - DNA, 25 bp, Mus musculus
ggattccagcatctggctaacttca

SEQ ID NO: 606917 - DNA, 25 bp, Mus musculus
ggattccagcatgtggctaacttca

SEQ ID NO: 606918 - DNA, 25 bp, Mus musculus
ggattccaggcaccaaactcatgct

SEQ ID NO: 606919 - DNA, 25 bp, Mus musculus
ggattccaggcagcaaactcatgct

SEQ ID NO: 606920 - DNA, 25 bp, Mus musculus
ggattccaggtgacaaactcaagtt

SEQ ID NO: 606921 - DNA, 25 bp, Mus musculus
ggattccaggtgtcaaactcaagtt

SEQ ID NO: 606922 - DNA, 25 bp, Mus musculus
ggattccatgtactgtggtgacccc

SEQ ID NO: 606923 - DNA, 25 bp, Mus musculus
ggattccatgtagtgtggtgacccc

SEQ ID NO: 606924 - DNA, 25 bp, Mus musculus
ggattccattacagacttctgcatc

SEQ ID NO: 606925 - DNA, 25 bp, Mus musculus
ggattccattactgacttctgcatc

SEQ ID NO: 606926 - DNA, 25 bp, Mus musculus
ggattccattcccaaattcaactgc

SEQ ID NO: 606927 - DNA, 25 bp, Mus musculus
ggattccattccgaaattcaactgc

SEQ ID NO: 606928 - DNA, 25 bp, Mus musculus
ggattcccaaggagtgagctcaaga

SEQ ID NO: 606929 - DNA, 25 bp, Mus musculus
ggattcccaaggatgaagccttcag

SEQ ID NO: 606930 - DNA, 25 bp, Mus musculus
ggattcccaaggtgtgagctcaaga

SEQ ID NO: 606931 - DNA, 25 bp, Mus musculus
ggattcccaaggttgaagccttcag

SEQ ID NO: 606932 - DNA, 25 bp, Mus musculus
ggattcccactgaacctgagagtta

SEQ ID NO: 606933 - DNA, 25 bp, Mus musculus
ggattcccactgtacctgagagtta

SEQ ID NO: 606934 - DNA, 25 bp, Mus musculus
ggattcccaggacaagctgctagca

SEQ ID NO: 606935 - DNA, 25 bp, Mus musculus
ggattcccaggagaagctgctagca

SEQ ID NO: 606936 - DNA, 25 bp, Mus musculus
ggattcccaggccattctgtgagaa

SEQ ID NO: 606937 - DNA, 25 bp, Mus musculus
ggattcccaggcgattctgtgagaa

SEQ ID NO: 606938 - DNA, 25 bp, Mus musculus
ggattcccagtacattgtcacagct

SEQ ID NO: 606939 - DNA, 25 bp, Mus musculus
ggattcccagtagattgtcacagct

SEQ ID NO: 606940 - DNA, 25 bp, Mus musculus
ggattcccagtcaggcatcatgcta

SEQ ID NO: 606941 - DNA, 25 bp, Mus musculus
ggattcccagtctggcatcatgcta

SEQ ID NO: 606942 - DNA, 25 bp, Mus musculus
ggattccccactcagcaggctgcag

SEQ ID NO: 606943 - DNA, 25 bp, Mus musculus
ggattccccactgagcaggctgcag

SEQ ID NO: 606944 - DNA, 25 bp, Mus musculus
ggattccccagtcagatcatctaga

SEQ ID NO: 606945 - DNA, 25 bp, Mus musculus
ggattccccagtcatcactaattaa

SEQ ID NO: 606946 - DNA, 25 bp, Mus musculus
ggattccccagtgagatcatctaga

SEQ ID NO: 606947 - DNA, 25 bp, Mus musculus
ggattccccagtgatcactaattaa

SEQ ID NO: 606948 - DNA, 25 bp, Mus musculus
ggattcccctgtaatgagcaggtct

SEQ ID NO: 606949 - DNA, 25 bp, Mus musculus
ggattcccctgttatgagcaggtct

SEQ ID NO: 606950 - DNA, 25 bp, Mus musculus
ggattcccgaagacctgaatgtgat

SEQ ID NO: 606951 - DNA, 25 bp, Mus musculus
ggattcccgaagtcctgaatgtgat

SEQ ID NO: 606952 - DNA, 25 bp, Mus musculus
ggattcccgcgaccgtttggtcact

SEQ ID NO: 606953 - DNA, 25 bp, Mus musculus
ggattcccgcgagcgtttggtcact

SEQ ID NO: 606954 - DNA, 25 bp, Mus musculus
ggattccctgtgctcagataacata

SEQ ID NO: 606955 - DNA, 25 bp, Mus musculus
ggattccctgtggtcagataacata

SEQ ID NO: 606956 - DNA, 25 bp, Mus musculus
ggattcccttctaatcattgaattg

SEQ ID NO: 606957 - DNA, 25 bp, Mus musculus
ggattcccttcttatcattgaattg

SEQ ID NO: 606958 - DNA, 25 bp, Mus musculus
ggattccgaagtcacagccacaatg

SEQ ID NO: 606959 - DNA, 25 bp, Mus musculus
ggattccgaagtgacagccacaatg

SEQ ID NO: 606960 - DNA, 25 bp, Mus musculus
ggattccgagaaccacgggatgttc

SEQ ID NO: 606961 - DNA, 25 bp, Mus musculus
ggattccgagaagcacgggatgttc

SEQ ID NO: 606962 - DNA, 25 bp, Mus musculus
ggattccgtgttaagcacagtgcct

SEQ ID NO: 606963 - DNA, 25 bp, Mus musculus
ggattccgtgtttagcacagtgcct

SEQ ID NO: 606964 - DNA, 25 bp, Mus musculus
ggattccgttggagaacttgtacaa

SEQ ID NO: 606965 - DNA, 25 bp, Mus musculus
ggattccgttggtgaacttgtacaa

SEQ ID NO: 606966 - DNA, 25 bp, Mus musculus
ggattcctaagactttgagccagct

SEQ ID NO: 606967 - DNA, 25 bp, Mus musculus
ggattcctaagagtttgagccagct

SEQ ID NO: 606968 - DNA, 25 bp, Mus musculus
ggattcctaatgcaacttctctgcc

SEQ ID NO: 606969 - DNA, 25 bp, Mus musculus
ggattcctaatggaacttctctgcc

SEQ ID NO: 606970 - DNA, 25 bp, Mus musculus
ggattcctaattatccagccccaat

SEQ ID NO: 606971 - DNA, 25 bp, Mus musculus
ggattcctaattttccagccccaat

SEQ ID NO: 606972 - DNA, 25 bp, Mus musculus
ggattcctaccacaaatttaattgt

SEQ ID NO: 606973 - DNA, 25 bp, Mus musculus
ggattcctaccagaaatttaattgt

SEQ ID NO: 606974 - DNA, 25 bp, Mus musculus
ggattcctatagacccaggcaggtg

SEQ ID NO: 606975 - DNA, 25 bp, Mus musculus
ggattcctatagattctggtcatga

SEQ ID NO: 606976 - DNA, 25 bp, Mus musculus
ggattcctatagtcccaggcaggtg

SEQ ID NO: 606977 - DNA, 25 bp, Mus musculus
ggattcctatagtttctggtcatga

SEQ ID NO: 606978 - DNA, 25 bp, Mus musculus
ggattcctatccaggtagagcaaaa

SEQ ID NO: 606979 - DNA, 25 bp, Mus musculus
ggattcctatcctggtagagcaaaa

SEQ ID NO: 606980 - DNA, 25 bp, Mus musculus
ggattcctcagcaatttttctggag

SEQ ID NO: 606981 - DNA, 25 bp, Mus musculus
ggattcctcagctatttttctggag

SEQ ID NO: 606982 - DNA, 25 bp, Mus musculus
ggattcctcagtactaacatgtggt

SEQ ID NO: 606983 - DNA, 25 bp, Mus musculus
ggattcctcagttctaacatgtggt

SEQ ID NO: 606984 - DNA, 25 bp, Mus musculus
ggattcctcatacgcagaactcgtc

SEQ ID NO: 606985 - DNA, 25 bp, Mus musculus
ggattcctcatactattctgatgtt

SEQ ID NO: 606986 - DNA, 25 bp, Mus musculus
ggattcctcataggcagaactcgtc

SEQ ID NO: 606987 - DNA, 25 bp, Mus musculus
ggattcctcatagtattctgatgtt

SEQ ID NO: 606988 - DNA, 25 bp, Mus musculus
ggattcctccatagtttcttcttaa

SEQ ID NO: 606989 - DNA, 25 bp, Mus musculus
ggattcctccatctgtgtattctaa

SEQ ID NO: 606990 - DNA, 25 bp, Mus musculus
ggattcctccatgtgtgtattctaa

SEQ ID NO: 606991 - DNA, 25 bp, Mus musculus
ggattcctccattgtttcttcttaa

SEQ ID NO: 606992 - DNA, 25 bp, Mus musculus
ggattcctgaaaagcgccgggcgac

SEQ ID NO: 606993 - DNA, 25 bp, Mus musculus
ggattcctgaaatgcgccgggcgac

SEQ ID NO: 606994 - DNA, 25 bp, Mus musculus
ggattcctgaacactctgaagctaa

SEQ ID NO: 606995 - DNA, 25 bp, Mus musculus
ggattcctgaactctctgaagctaa

SEQ ID NO: 606996 - DNA, 25 bp, Mus musculus
ggattcctgagtcttggcttgagta

SEQ ID NO: 606997 - DNA, 25 bp, Mus musculus
ggattcctgagtgttggcttgagta

SEQ ID NO: 606998 - DNA, 25 bp, Mus musculus
ggattcctgatcaaaccagcctgtt

SEQ ID NO: 606999 - DNA, 25 bp, Mus musculus
ggattcctgatctaaccagcctgtt

SEQ ID NO: 607000 - DNA, 25 bp, Mus musculus
ggattcctgattacttcatgaagca

SEQ ID NO: 607001 - DNA, 25 bp, Mus musculus
ggattcctgatttcttcatgaagca

SEQ ID NO: 607002 - DNA, 25 bp, Mus musculus
ggattcctgcctaaagacaagcttt

SEQ ID NO: 607003 - DNA, 25 bp, Mus musculus
ggattcctgccttaagacaagcttt

SEQ ID NO: 607004 - DNA, 25 bp, Mus musculus
ggattcctgcgcagcggaacaacta

SEQ ID NO: 607005 - DNA, 25 bp, Mus musculus
ggattcctgcgctgcggaacaacta

SEQ ID NO: 607006 - DNA, 25 bp, Mus musculus
ggattcctggccataactagtcagt

SEQ ID NO: 607007 - DNA, 25 bp, Mus musculus
ggattcctggccttaactagtcagt

SEQ ID NO: 607008 - DNA, 25 bp, Mus musculus
ggattcctggtcctttgatttgcca

SEQ ID NO: 607009 - DNA, 25 bp, Mus musculus
ggattcctggtcgtttgatttgcca

SEQ ID NO: 607010 - DNA, 25 bp, Mus musculus
ggattcctgtccagaggcatcaaag

SEQ ID NO: 607011 - DNA, 25 bp, Mus musculus
ggattcctgtcctgaggcatcaaag

SEQ ID NO: 607012 - DNA, 25 bp, Mus musculus
ggattcctgtgactgcaaggcagca

SEQ ID NO: 607013 - DNA, 25 bp, Mus musculus
ggattcctgtgagtgcaaggcagca

SEQ ID NO: 607014 - DNA, 25 bp, Mus musculus
ggattccttatgaggtatgttttaa

SEQ ID NO: 607015 - DNA, 25 bp, Mus musculus
ggattccttatgtggtatgttttaa

SEQ ID NO: 607016 - DNA, 25 bp, Mus musculus
ggattccttcataaacctaggctgg

SEQ ID NO: 607017 - DNA, 25 bp, Mus musculus
ggattccttcattaacctaggctgg

SEQ ID NO: 607018 - DNA, 25 bp, Mus musculus
ggattccttccaaattgatatgaca

SEQ ID NO: 607019 - DNA, 25 bp, Mus musculus
ggattccttccatattgatatgaca

SEQ ID NO: 607020 - DNA, 25 bp, Mus musculus
ggattccttcctagctatttatgag

SEQ ID NO: 607021 - DNA, 25 bp, Mus musculus
ggattccttccttgctatttatgag

SEQ ID NO: 607022 - DNA, 25 bp, Mus musculus
ggattccttgtacaccaggcaggca

SEQ ID NO: 607023 - DNA, 25 bp, Mus musculus
ggattccttgtagaccaggcaggca

SEQ ID NO: 607024 - DNA, 25 bp, Mus musculus
ggattccttgtgataagtgccacac

SEQ ID NO: 607025 - DNA, 25 bp, Mus musculus
ggattccttgtgttaagtgccacac

SEQ ID NO: 607026 - DNA, 25 bp, Mus musculus
ggattccttgttacatggtataaat

SEQ ID NO: 607027 - DNA, 25 bp, Mus musculus
ggattccttgtttcatggtataaat

SEQ ID NO: 607028 - DNA, 25 bp, Mus musculus
ggattcctttttagatggctttgtt

SEQ ID NO: 607029 - DNA, 25 bp, Mus musculus
ggattccttttttgatggctttgtt

SEQ ID NO: 607030 - DNA, 25 bp, Mus musculus
ggattcgacactcttgtccttgact

SEQ ID NO: 607031 - DNA, 25 bp, Mus musculus
ggattcgacactgttgtccttgact

SEQ ID NO: 607032 - DNA, 25 bp, Mus musculus
ggattcgatgttagtaacagatacg

SEQ ID NO: 607033 - DNA, 25 bp, Mus musculus
ggattcgatgtttgtaacagatacg

SEQ ID NO: 607034 - DNA, 25 bp, Mus musculus
ggattcgattggagcggctgtcatt

SEQ ID NO: 607035 - DNA, 25 bp, Mus musculus
ggattcgattggtgcggctgtcatt

SEQ ID NO: 607036 - DNA, 25 bp, Mus musculus
ggattcggaacacatccaccctgaa

SEQ ID NO: 607037 - DNA, 25 bp, Mus musculus
ggattcggaacagatccaccctgaa

SEQ ID NO: 607038 - DNA, 25 bp, Mus musculus
ggattcggccgtagagaagctgaaa

SEQ ID NO: 607039 - DNA, 25 bp, Mus musculus
ggattcggccgttgagaagctgaaa

SEQ ID NO: 607040 - DNA, 25 bp, Mus musculus
ggattcggcttcagaagtaacagtg

SEQ ID NO: 607041 - DNA, 25 bp, Mus musculus
ggattcggcttctgaagtaacagtg

SEQ ID NO: 607042 - DNA, 25 bp, Mus musculus
ggattcgggcagagttgcgcctccc

SEQ ID NO: 607043 - DNA, 25 bp, Mus musculus
ggattcgggcagtgttgcgcctccc

SEQ ID NO: 607044 - DNA, 25 bp, Mus musculus
ggattcgggcataacctgaaccaaa

SEQ ID NO: 607045 - DNA, 25 bp, Mus musculus
ggattcgggcattacctgaaccaaa

SEQ ID NO: 607046 - DNA, 25 bp, Mus musculus
ggattctaaattactcatacaaagt

SEQ ID NO: 607047 - DNA, 25 bp, Mus musculus
ggattctaaatttctcatacaaagt

SEQ ID NO: 607048 - DNA, 25 bp, Mus musculus
ggattctaacccagaggaccaacca

SEQ ID NO: 607049 - DNA, 25 bp, Mus musculus
ggattctaaccctgaggaccaacca

SEQ ID NO: 607050 - DNA, 25 bp, Mus musculus
ggattctaacctattgagccctttt

SEQ ID NO: 607051 - DNA, 25 bp, Mus musculus
ggattctaaccttttgagccctttt

SEQ ID NO: 607052 - DNA, 25 bp, Mus musculus
ggattctaagtgctgttccctgaca

SEQ ID NO: 607053 - DNA, 25 bp, Mus musculus
ggattctaagtggtgttccctgaca

SEQ ID NO: 607054 - DNA, 25 bp, Mus musculus
ggattctaatacaacatagcctcac

SEQ ID NO: 607055 - DNA, 25 bp, Mus musculus
ggattctaatactacatagcctcac

SEQ ID NO: 607056 - DNA, 25 bp, Mus musculus
ggattctaatctatgcagctgtctg

SEQ ID NO: 607057 - DNA, 25 bp, Mus musculus
ggattctaatctttgcagctgtctg

SEQ ID NO: 607058 - DNA, 25 bp, Mus musculus
ggattctactcaagccttctggaaa

SEQ ID NO: 607059 - DNA, 25 bp, Mus musculus
ggattctactcatgccttctggaaa

SEQ ID NO: 607060 - DNA, 25 bp, Mus musculus
ggattctagaaaactctacacagtg

SEQ ID NO: 607061 - DNA, 25 bp, Mus musculus
ggattctagaaatctctacacagtg

SEQ ID NO: 607062 - DNA, 25 bp, Mus musculus
ggattctagaagacctgccaggtag

SEQ ID NO: 607063 - DNA, 25 bp, Mus musculus
ggattctagaagtcctgccaggtag

SEQ ID NO: 607064 - DNA, 25 bp, Mus musculus
ggattctagacacggttctcggtat

SEQ ID NO: 607065 - DNA, 25 bp, Mus musculus
ggattctagacagggttctcggtat

SEQ ID NO: 607066 - DNA, 25 bp, Mus musculus
ggattctagagcagacgagccacat

SEQ ID NO: 607067 - DNA, 25 bp, Mus musculus
ggattctagagctgacgagccacat

SEQ ID NO: 607068 - DNA, 25 bp, Mus musculus
ggattctaggcacagcaggcgtcta

SEQ ID NO: 607069 - DNA, 25 bp, Mus musculus
ggattctaggcagagcaggcgtcta

SEQ ID NO: 607070 - DNA, 25 bp, Mus musculus
ggattctagtgtaagctttcatctt

SEQ ID NO: 607071 - DNA, 25 bp, Mus musculus
ggattctagtgttagctttcatctt

SEQ ID NO: 607072 - DNA, 25 bp, Mus musculus
ggattctatcaccagtcggattgct

SEQ ID NO: 607073 - DNA, 25 bp, Mus musculus
ggattctatcacgagtcggattgct

SEQ ID NO: 607074 - DNA, 25 bp, Mus musculus
ggattctatgcactgtgatcctaag

SEQ ID NO: 607075 - DNA, 25 bp, Mus musculus
ggattctatgcagtgtgatcctaag

SEQ ID NO: 607076 - DNA, 25 bp, Mus musculus
ggattctcaaataacatcagatcta

SEQ ID NO: 607077 - DNA, 25 bp, Mus musculus
ggattctcaaattacatcagatcta

SEQ ID NO: 607078 - DNA, 25 bp, Mus musculus
ggattctcagagactttaacttaat

SEQ ID NO: 607079 - DNA, 25 bp, Mus musculus
ggattctcagagtctttaacttaat

SEQ ID NO: 607080 - DNA, 25 bp, Mus musculus
ggattctcagcgctttggatgtcac

SEQ ID NO: 607081 - DNA, 25 bp, Mus musculus
ggattctcagcggtttggatgtcac

SEQ ID NO: 607082 - DNA, 25 bp, Mus musculus
ggattctcagggagccctctgtggc

SEQ ID NO: 607083 - DNA, 25 bp, Mus musculus
ggattctcagggtgccctctgtggc

SEQ ID NO: 607084 - DNA, 25 bp, Mus musculus
ggattctcatccactgagtcggaga

SEQ ID NO: 607085 - DNA, 25 bp, Mus musculus
ggattctcatcctctgagtcggaga

SEQ ID NO: 607086 - DNA, 25 bp, Mus musculus
ggattctccaccatctactgaaagg

SEQ ID NO: 607087 - DNA, 25 bp, Mus musculus
ggattctccaccttctactgaaagg

SEQ ID NO: 607088 - DNA, 25 bp, Mus musculus
ggattctcccagcaggacaatggcc

SEQ ID NO: 607089 - DNA, 25 bp, Mus musculus
ggattctcccaggaggacaatggcc

SEQ ID NO: 607090 - DNA, 25 bp, Mus musculus
ggattctcccgaatctactgaaatg

SEQ ID NO: 607091 - DNA, 25 bp, Mus musculus
ggattctcccgattctactgaaatg

SEQ ID NO: 607092 - DNA, 25 bp, Mus musculus
ggattctccctaaatttagcagtat

SEQ ID NO: 607093 - DNA, 25 bp, Mus musculus
ggattctccctatatttagcagtat

SEQ ID NO: 607094 - DNA, 25 bp, Mus musculus
ggattctccgccagtttttctctgg

SEQ ID NO: 607095 - DNA, 25 bp, Mus musculus
ggattctccgcctgtttttctctgg

SEQ ID NO: 607096 - DNA, 25 bp, Mus musculus
ggattctcctcacaaaaagccttat

SEQ ID NO: 607097 - DNA, 25 bp, Mus musculus
ggattctcctcagaaaaagccttat

SEQ ID NO: 607098 - DNA, 25 bp, Mus musculus
ggattctcgtcgcaacaagcagcag

SEQ ID NO: 607099 - DNA, 25 bp, Mus musculus
ggattctcgtcggaacaagcagcag

SEQ ID NO: 607100 - DNA, 25 bp, Mus musculus
ggattctctgacactggacttacaa

SEQ ID NO: 607101 - DNA, 25 bp, Mus musculus
ggattctctgactctggacttacaa

SEQ ID NO: 607102 - DNA, 25 bp, Mus musculus
ggattctctgataaatgtaaagcaa

SEQ ID NO: 607103 - DNA, 25 bp, Mus musculus
ggattctctgataacgaggaatttc

SEQ ID NO: 607104 - DNA, 25 bp, Mus musculus
ggattctctgatcaaagctaccatt

SEQ ID NO: 607105 - DNA, 25 bp, Mus musculus
ggattctctgatgaaagctaccatt

SEQ ID NO: 607106 - DNA, 25 bp, Mus musculus
ggattctctgattaatgtaaagcaa

SEQ ID NO: 607107 - DNA, 25 bp, Mus musculus
ggattctctgattacgaggaatttc

SEQ ID NO: 607108 - DNA, 25 bp, Mus musculus
ggattctctgcacctatgttgcttc

SEQ ID NO: 607109 - DNA, 25 bp, Mus musculus
ggattctctgcagctatgttgcttc

SEQ ID NO: 607110 - DNA, 25 bp, Mus musculus
ggattctcttacacccttaccctgg

SEQ ID NO: 607111 - DNA, 25 bp, Mus musculus
ggattctcttactcccttaccctgg

SEQ ID NO: 607112 - DNA, 25 bp, Mus musculus
ggattctcttatcaaggccaccata

SEQ ID NO: 607113 - DNA, 25 bp, Mus musculus
ggattctcttatgaaggccaccata

SEQ ID NO: 607114 - DNA, 25 bp, Mus musculus
ggattctcttcaaggccgtgccaaa

SEQ ID NO: 607115 - DNA, 25 bp, Mus musculus
ggattctcttcatggccgtgccaaa

SEQ ID NO: 607116 - DNA, 25 bp, Mus musculus
ggattctctttaaggcttttggaca

SEQ ID NO: 607117 - DNA, 25 bp, Mus musculus
ggattctctttatggcttttggaca

SEQ ID NO: 607118 - DNA, 25 bp, Mus musculus
ggattctgaagtctcaagccagcat

SEQ ID NO: 607119 - DNA, 25 bp, Mus musculus
ggattctgaagtgtcaagccagcat

SEQ ID NO: 607120 - DNA, 25 bp, Mus musculus
ggattctgacatctgccttggaaga

SEQ ID NO: 607121 - DNA, 25 bp, Mus musculus
ggattctgacatgtgccttggaaga

SEQ ID NO: 607122 - DNA, 25 bp, Mus musculus
ggattctgaccaattatacctcata

SEQ ID NO: 607123 - DNA, 25 bp, Mus musculus
ggattctgaccatttatacctcata

SEQ ID NO: 607124 - DNA, 25 bp, Mus musculus
ggattctgagagcatggtacccttc

SEQ ID NO: 607125 - DNA, 25 bp, Mus musculus
ggattctgagaggatggtacccttc

SEQ ID NO: 607126 - DNA, 25 bp, Mus musculus
ggattctgagcacccagtgttgtca

SEQ ID NO: 607127 - DNA, 25 bp, Mus musculus
ggattctgagcagccagtgttgtca

SEQ ID NO: 607128 - DNA, 25 bp, Mus musculus
ggattctgatggatccataccttta

SEQ ID NO: 607129 - DNA, 25 bp, Mus musculus
ggattctgatggttccataccttta

SEQ ID NO: 607130 - DNA, 25 bp, Mus musculus
ggattctgcaaaccaaactcgtcag

SEQ ID NO: 607131 - DNA, 25 bp, Mus musculus
ggattctgcaaagcaaactcgtcag

SEQ ID NO: 607132 - DNA, 25 bp, Mus musculus
ggattctgcttaaactgaaaaccat

SEQ ID NO: 607133 - DNA, 25 bp, Mus musculus
ggattctgcttatactgaaaaccat

SEQ ID NO: 607134 - DNA, 25 bp, Mus musculus
ggattctgcttcagagaatgctcag

SEQ ID NO: 607135 - DNA, 25 bp, Mus musculus
ggattctgcttctgagaatgctcag

SEQ ID NO: 607136 - DNA, 25 bp, Mus musculus
ggattctggcccctaaaatatgttc

SEQ ID NO: 607137 - DNA, 25 bp, Mus musculus
ggattctggcccgtaaaatatgttc

SEQ ID NO: 607138 - DNA, 25 bp, Mus musculus
ggattctggctgagggtgcctcccc

SEQ ID NO: 607139 - DNA, 25 bp, Mus musculus
ggattctggctgtgggtgcctcccc

SEQ ID NO: 607140 - DNA, 25 bp, Mus musculus
ggattctggtagaagtcactccact

SEQ ID NO: 607141 - DNA, 25 bp, Mus musculus
ggattctggtagtagtcactccact

SEQ ID NO: 607142 - DNA, 25 bp, Mus musculus
ggattctgtaaacagtcagggcgtt

SEQ ID NO: 607143 - DNA, 25 bp, Mus musculus
ggattctgtaaagagtcagggcgtt

SEQ ID NO: 607144 - DNA, 25 bp, Mus musculus
ggattctgtacactaatgcctgcac

SEQ ID NO: 607145 - DNA, 25 bp, Mus musculus
ggattctgtacagtaatgcctgcac

SEQ ID NO: 607146 - DNA, 25 bp, Mus musculus
ggattctgtgaacgaggatttcaaa

SEQ ID NO: 607147 - DNA, 25 bp, Mus musculus
ggattctgtgaaggaggatttcaaa

SEQ ID NO: 607148 - DNA, 25 bp, Mus musculus
ggattctgtttgactcctagtaccc

SEQ ID NO: 607149 - DNA, 25 bp, Mus musculus
ggattctgtttgtctcctagtaccc

SEQ ID NO: 607150 - DNA, 25 bp, Mus musculus
ggattcttaaagcttcttcattgta

SEQ ID NO: 607151 - DNA, 25 bp, Mus musculus
ggattcttaaaggttcttcattgta

SEQ ID NO: 607152 - DNA, 25 bp, Mus musculus
ggattcttaacaatctggtcatatg

SEQ ID NO: 607153 - DNA, 25 bp, Mus musculus
ggattcttaacattctggtcatatg

SEQ ID NO: 607154 - DNA, 25 bp, Mus musculus
ggattcttacggatctctgatggac

SEQ ID NO: 607155 - DNA, 25 bp, Mus musculus
ggattcttacggttctctgatggac

SEQ ID NO: 607156 - DNA, 25 bp, Mus musculus
ggattcttcactaacaacatgcatg

SEQ ID NO: 607157 - DNA, 25 bp, Mus musculus
ggattcttcacttacaacatgcatg

SEQ ID NO: 607158 - DNA, 25 bp, Mus musculus
ggattcttccctcagaaggctttgt

SEQ ID NO: 607159 - DNA, 25 bp, Mus musculus
ggattcttccctgagaaggctttgt

SEQ ID NO: 607160 - DNA, 25 bp, Mus musculus
ggattcttccggacattaaatggct

SEQ ID NO: 607161 - DNA, 25 bp, Mus musculus
ggattcttccggtcattaaatggct

SEQ ID NO: 607162 - DNA, 25 bp, Mus musculus
ggattcttctataggtcttgtctat

SEQ ID NO: 607163 - DNA, 25 bp, Mus musculus
ggattcttctattggtcttgtctat

SEQ ID NO: 607164 - DNA, 25 bp, Mus musculus
ggattcttctgtcggtggtaactac

SEQ ID NO: 607165 - DNA, 25 bp, Mus musculus
ggattcttctgtgggtggtaactac

SEQ ID NO: 607166 - DNA, 25 bp, Mus musculus
ggattcttggcaacattctatttca

SEQ ID NO: 607167 - DNA, 25 bp, Mus musculus
ggattcttggcatcattctatttca

SEQ ID NO: 607168 - DNA, 25 bp, Mus musculus
ggattcttgtcccattggaaccatg

SEQ ID NO: 607169 - DNA, 25 bp, Mus musculus
ggattcttgtccgattggaaccatg

SEQ ID NO: 607170 - DNA, 25 bp, Mus musculus
ggattctttaagctaactgactatg

SEQ ID NO: 607171 - DNA, 25 bp, Mus musculus
ggattctttaaggtaactgactatg

SEQ ID NO: 607172 - DNA, 25 bp, Mus musculus
ggattctttattcgcagactcctgg

SEQ ID NO: 607173 - DNA, 25 bp, Mus musculus
ggattctttattggcagactcctgg

SEQ ID NO: 607174 - DNA, 25 bp, Mus musculus
ggattctttcgtaatttttatatag

SEQ ID NO: 607175 - DNA, 25 bp, Mus musculus
ggattctttcgttatttttatatag

SEQ ID NO: 607176 - DNA, 25 bp, Mus musculus
ggattctttgctatagacattgctg

SEQ ID NO: 607177 - DNA, 25 bp, Mus musculus
ggattctttgctttagacattgctg

SEQ ID NO: 607178 - DNA, 25 bp, Mus musculus
ggattctttggccattgttggacta

SEQ ID NO: 607179 - DNA, 25 bp, Mus musculus
ggattctttggcgattgttggacta

SEQ ID NO: 607180 - DNA, 25 bp, Mus musculus
ggattctttggtcatctagagcctg

SEQ ID NO: 607181 - DNA, 25 bp, Mus musculus
ggattctttggtcgctaacttgata

SEQ ID NO: 607182 - DNA, 25 bp, Mus musculus
ggattctttggtgatctagagcctg

SEQ ID NO: 607183 - DNA, 25 bp, Mus musculus
ggattctttggtggctaacttgata

SEQ ID NO: 607184 - DNA, 25 bp, Mus musculus
ggattgaacctaatcagctttgttt

SEQ ID NO: 607185 - DNA, 25 bp, Mus musculus
ggattgaacctattcagctttgttt

SEQ ID NO: 607186 - DNA, 25 bp, Mus musculus
ggattgaagctgagcagcagtcaat

SEQ ID NO: 607187 - DNA, 25 bp, Mus musculus
ggattgaagctgtgcagcagtcaat

SEQ ID NO: 607188 - DNA, 25 bp, Mus musculus
ggattgaatcacagttgacctttaa

SEQ ID NO: 607189 - DNA, 25 bp, Mus musculus
ggattgaatcactgttgacctttaa

SEQ ID NO: 607190 - DNA, 25 bp, Mus musculus
ggattgaattctcgttccaaattaa

SEQ ID NO: 607191 - DNA, 25 bp, Mus musculus
ggattgaattctggttccaaattaa

SEQ ID NO: 607192 - DNA, 25 bp, Mus musculus
ggattgacaatcacccatctaagct

SEQ ID NO: 607193 - DNA, 25 bp, Mus musculus
ggattgacaatctcccatctaagct

SEQ ID NO: 607194 - DNA, 25 bp, Mus musculus
ggattgacacataatattactgcaa

SEQ ID NO: 607195 - DNA, 25 bp, Mus musculus
ggattgacacattatattactgcaa

SEQ ID NO: 607196 - DNA, 25 bp, Mus musculus
ggattgacactgagatggattcccc

SEQ ID NO: 607197 - DNA, 25 bp, Mus musculus
ggattgacactgtgatggattcccc

SEQ ID NO: 607198 - DNA, 25 bp, Mus musculus
ggattgacattaacgccttagactg

SEQ ID NO: 607199 - DNA, 25 bp, Mus musculus
ggattgacattatcgccttagactg

SEQ ID NO: 607200 - DNA, 25 bp, Mus musculus
ggattgacatttcttagttggctga

SEQ ID NO: 607201 - DNA, 25 bp, Mus musculus
ggattgacatttgttagttggctga

SEQ ID NO: 607202 - DNA, 25 bp, Mus musculus
ggattgaccatcatgctgttgtaca

SEQ ID NO: 607203 - DNA, 25 bp, Mus musculus
ggattgaccatcttgctgttgtaca

SEQ ID NO: 607204 - DNA, 25 bp, Mus musculus
ggattgaccccaagtgagcacaaaa

SEQ ID NO: 607205 - DNA, 25 bp, Mus musculus
ggattgaccccatgtgagcacaaaa

SEQ ID NO: 607206 - DNA, 25 bp, Mus musculus
ggattgactccaagtgtctgcactt

SEQ ID NO: 607207 - DNA, 25 bp, Mus musculus
ggattgactccatgtgtctgcactt

SEQ ID NO: 607208 - DNA, 25 bp, Mus musculus
ggattgactcggaaacccttggcat

SEQ ID NO: 607209 - DNA, 25 bp, Mus musculus
ggattgactcggtaacccttggcat

SEQ ID NO: 607210 - DNA, 25 bp, Mus musculus
ggattgagaaataaggctaggcctg

SEQ ID NO: 607211 - DNA, 25 bp, Mus musculus
ggattgagaaattaggctaggcctg

SEQ ID NO: 607212 - DNA, 25 bp, Mus musculus
ggattgagaaccaccagcagagaga

SEQ ID NO: 607213 - DNA, 25 bp, Mus musculus
ggattgagaacctccagcagagaga

SEQ ID NO: 607214 - DNA, 25 bp, Mus musculus
ggattgagccataccacaactaaaa

SEQ ID NO: 607215 - DNA, 25 bp, Mus musculus
ggattgagccattccacaactaaaa

SEQ ID NO: 607216 - DNA, 25 bp, Mus musculus
ggattgaggaaccaacaccttgctt

SEQ ID NO: 607217 - DNA, 25 bp, Mus musculus
ggattgaggaacgaacaccttgctt

SEQ ID NO: 607218 - DNA, 25 bp, Mus musculus
ggattgaggattcacaccagggcct

SEQ ID NO: 607219 - DNA, 25 bp, Mus musculus
ggattgaggattgacaccagggcct

SEQ ID NO: 607220 - DNA, 25 bp, Mus musculus
ggattgagttgaacctctccagctc

SEQ ID NO: 607221 - DNA, 25 bp, Mus musculus
ggattgagttgatcctctccagctc

SEQ ID NO: 607222 - DNA, 25 bp, Mus musculus
ggattgataaacaccagccttctga

SEQ ID NO: 607223 - DNA, 25 bp, Mus musculus
ggattgataaactccagccttctga

SEQ ID NO: 607224 - DNA, 25 bp, Mus musculus
ggattgatagacacggtctccatga

SEQ ID NO: 607225 - DNA, 25 bp, Mus musculus
ggattgatagactcggtctccatga

SEQ ID NO: 607226 - DNA, 25 bp, Mus musculus
ggattgatagtgatcctctggtgga

SEQ ID NO: 607227 - DNA, 25 bp, Mus musculus
ggattgatagtgttcctctggtgga

SEQ ID NO: 607228 - DNA, 25 bp, Mus musculus
ggattgatatccaggactctgccct

SEQ ID NO: 607229 - DNA, 25 bp, Mus musculus
ggattgatatcctggactctgccct

SEQ ID NO: 607230 - DNA, 25 bp, Mus musculus
ggattgatcatgattaactcagcgt

SEQ ID NO: 607231 - DNA, 25 bp, Mus musculus
ggattgatcatgtttaactcagcgt

SEQ ID NO: 607232 - DNA, 25 bp, Mus musculus
ggattgatcttccatctttattgaa

SEQ ID NO: 607233 - DNA, 25 bp, Mus musculus
ggattgatcttcgatctttattgaa

SEQ ID NO: 607234 - DNA, 25 bp, Mus musculus
ggattgatgcgcatctctagatgat

SEQ ID NO: 607235 - DNA, 25 bp, Mus musculus
ggattgatgcgcttctctagatgat

SEQ ID NO: 607236 - DNA, 25 bp, Mus musculus
ggattgcaaaaacgtccccatgctt

SEQ ID NO: 607237 - DNA, 25 bp, Mus musculus
ggattgcaaaaaggtccccatgctt

SEQ ID NO: 607238 - DNA, 25 bp, Mus musculus
ggattgcacaacagaacagcagaag

SEQ ID NO: 607239 - DNA, 25 bp, Mus musculus
ggattgcacaactgaacagcagaag

SEQ ID NO: 607240 - DNA, 25 bp, Mus musculus
ggattgcacatcagtatcagagtat

SEQ ID NO: 607241 - DNA, 25 bp, Mus musculus
ggattgcacatctgtatcagagtat

SEQ ID NO: 607242 - DNA, 25 bp, Mus musculus
ggattgcagattacttttttgtaca

SEQ ID NO: 607243 - DNA, 25 bp, Mus musculus
ggattgcagatttcttttttgtaca

SEQ ID NO: 607244 - DNA, 25 bp, Mus musculus
ggattgcagcctcagtcattccaat

SEQ ID NO: 607245 - DNA, 25 bp, Mus musculus
ggattgcagcctctcaattcaatgt

SEQ ID NO: 607246 - DNA, 25 bp, Mus musculus
ggattgcagcctgagtcattccaat

SEQ ID NO: 607247 - DNA, 25 bp, Mus musculus
ggattgcagcctgtcaattcaatgt

SEQ ID NO: 607248 - DNA, 25 bp, Mus musculus
ggattgcagcttattgaattgtcat

SEQ ID NO: 607249 - DNA, 25 bp, Mus musculus
ggattgcagctttttgaattgtcat

SEQ ID NO: 607250 - DNA, 25 bp, Mus musculus
ggattgcaggttagaggtcactgta

SEQ ID NO: 607251 - DNA, 25 bp, Mus musculus
ggattgcaggtttgaggtcactgta

SEQ ID NO: 607252 - DNA, 25 bp, Mus musculus
ggattgcatacaaaagaatgccact

SEQ ID NO: 607253 - DNA, 25 bp, Mus musculus
ggattgcatacataagaatgccact

SEQ ID NO: 607254 - DNA, 25 bp, Mus musculus
ggattgcatgccacactatagtctg

SEQ ID NO: 607255 - DNA, 25 bp, Mus musculus
ggattgcatgcctcactatagtctg

SEQ ID NO: 607256 - DNA, 25 bp, Mus musculus
ggattgcatgtgaggatctccattt

SEQ ID NO: 607257 - DNA, 25 bp, Mus musculus
ggattgcatgtgtggatctccattt

SEQ ID NO: 607258 - DNA, 25 bp, Mus musculus
ggattgcattccatcacatacatat

SEQ ID NO: 607259 - DNA, 25 bp, Mus musculus
ggattgcattccttcacatacatat

SEQ ID NO: 607260 - DNA, 25 bp, Mus musculus
ggattgccacacatgttggctccac

SEQ ID NO: 607261 - DNA, 25 bp, Mus musculus
ggattgccacacttgttggctccac

SEQ ID NO: 607262 - DNA, 25 bp, Mus musculus
ggattgcccacaccccaagaataga

SEQ ID NO: 607263 - DNA, 25 bp, Mus musculus
ggattgcccacagcccaagaataga

SEQ ID NO: 607264 - DNA, 25 bp, Mus musculus
ggattgcctgttcggagactagcct

SEQ ID NO: 607265 - DNA, 25 bp, Mus musculus
ggattgcctgttgggagactagcct

SEQ ID NO: 607266 - DNA, 25 bp, Mus musculus
ggattgcgactgagacgtcttcaaa

SEQ ID NO: 607267 - DNA, 25 bp, Mus musculus
ggattgcgactgtgacgtcttcaaa

SEQ ID NO: 607268 - DNA, 25 bp, Mus musculus
ggattgcgagagacctgtgcacgta

SEQ ID NO: 607269 - DNA, 25 bp, Mus musculus
ggattgcgagagtcctgtgcacgta

SEQ ID NO: 607270 - DNA, 25 bp, Mus musculus
ggattgcgagctcgtgtccacgtta

SEQ ID NO: 607271 - DNA, 25 bp, Mus musculus
ggattgcgagctggtgtccacgtta

SEQ ID NO: 607272 - DNA, 25 bp, Mus musculus
ggattgcgccggcaaaagcatcaac

SEQ ID NO: 607273 - DNA, 25 bp, Mus musculus
ggattgcgccgggaaaagcatcaac

SEQ ID NO: 607274 - DNA, 25 bp, Mus musculus
ggattgcgcttcattgaacctgcag

SEQ ID NO: 607275 - DNA, 25 bp, Mus musculus
ggattgcgcttctttgaacctgcag

SEQ ID NO: 607276 - DNA, 25 bp, Mus musculus
ggattgcgttaaattgccatctccc

SEQ ID NO: 607277 - DNA, 25 bp, Mus musculus
ggattgcgttaatttgccatctccc

SEQ ID NO: 607278 - DNA, 25 bp, Mus musculus
ggattgcgtttgatttaccattgtg

SEQ ID NO: 607279 - DNA, 25 bp, Mus musculus
ggattgcgtttgttttaccattgtg

SEQ ID NO: 607280 - DNA, 25 bp, Mus musculus
ggattgctaaccagagtacctctat

SEQ ID NO: 607281 - DNA, 25 bp, Mus musculus
ggattgctaaccataagtttctgaa

SEQ ID NO: 607282 - DNA, 25 bp, Mus musculus
ggattgctaacctgagtacctctat

SEQ ID NO: 607283 - DNA, 25 bp, Mus musculus
ggattgctaaccttaagtttctgaa

SEQ ID NO: 607284 - DNA, 25 bp, Mus musculus
ggattgctacaaccatctttatgct

SEQ ID NO: 607285 - DNA, 25 bp, Mus musculus
ggattgctacaagcatctttatgct

SEQ ID NO: 607286 - DNA, 25 bp, Mus musculus
ggattgctacttactcattgtctag

SEQ ID NO: 607287 - DNA, 25 bp, Mus musculus
ggattgctactttctcattgtctag

SEQ ID NO: 607288 - DNA, 25 bp, Mus musculus
ggattgctccaaattctaggctagt

SEQ ID NO: 607289 - DNA, 25 bp, Mus musculus
ggattgctccaatttctaggctagt

SEQ ID NO: 607290 - DNA, 25 bp, Mus musculus
ggattgctccatctaatcagtcatt

SEQ ID NO: 607291 - DNA, 25 bp, Mus musculus
ggattgctccatgtaatcagtcatt

SEQ ID NO: 607292 - DNA, 25 bp, Mus musculus
ggattgctgcatactttagtacgtt

SEQ ID NO: 607293 - DNA, 25 bp, Mus musculus
ggattgctgcattctttagtacgtt

SEQ ID NO: 607294 - DNA, 25 bp, Mus musculus
ggattgctgcctccctagagtgcat

SEQ ID NO: 607295 - DNA, 25 bp, Mus musculus
ggattgctgcctgcctagagtgcat

SEQ ID NO: 607296 - DNA, 25 bp, Mus musculus
ggattgctggagaacactgcgagct

SEQ ID NO: 607297 - DNA, 25 bp, Mus musculus
ggattgctggagtacactgcgagct

SEQ ID NO: 607298 - DNA, 25 bp, Mus musculus
ggattgctggcaagctgtaccctca

SEQ ID NO: 607299 - DNA, 25 bp, Mus musculus
ggattgctggcatgctgtaccctca

SEQ ID NO: 607300 - DNA, 25 bp, Mus musculus
ggattgctgtcgcagccattgttat

SEQ ID NO: 607301 - DNA, 25 bp, Mus musculus
ggattgctgtcggagccattgttat

SEQ ID NO: 607302 - DNA, 25 bp, Mus musculus
ggattgctgtgaatttacagttaaa

SEQ ID NO: 607303 - DNA, 25 bp, Mus musculus
ggattgctgtgattttacagttaaa

SEQ ID NO: 607304 - DNA, 25 bp, Mus musculus
ggattgcttaacctagttcagttgt

SEQ ID NO: 607305 - DNA, 25 bp, Mus musculus
ggattgcttaacgtagttcagttgt

SEQ ID NO: 607306 - DNA, 25 bp, Mus musculus
ggattgcttaggaaagtccctttgc

SEQ ID NO: 607307 - DNA, 25 bp, Mus musculus
ggattgcttaggtaagtccctttgc

SEQ ID NO: 607308 - DNA, 25 bp, Mus musculus
ggattgcttcagatggtttgccgta

SEQ ID NO: 607309 - DNA, 25 bp, Mus musculus
ggattgcttcagttggtttgccgta

SEQ ID NO: 607310 - DNA, 25 bp, Mus musculus
ggattgcttctcacctttaagacac

SEQ ID NO: 607311 - DNA, 25 bp, Mus musculus
ggattgcttctctcctttaagacac

SEQ ID NO: 607312 - DNA, 25 bp, Mus musculus
ggattgcttgcaatggacttaccag

SEQ ID NO: 607313 - DNA, 25 bp, Mus musculus
ggattgcttgcattggacttaccag

SEQ ID NO: 607314 - DNA, 25 bp, Mus musculus
ggattgctttcaagtactattctgt

SEQ ID NO: 607315 - DNA, 25 bp, Mus musculus
ggattgctttcatgtactattctgt

SEQ ID NO: 607316 - DNA, 25 bp, Mus musculus
ggattggaaccacaatgtttaacta

SEQ ID NO: 607317 - DNA, 25 bp, Mus musculus
ggattggaaccagaatgtttaacta

SEQ ID NO: 607318 - DNA, 25 bp, Mus musculus
ggattggaactaatctgtacctact

SEQ ID NO: 607319 - DNA, 25 bp, Mus musculus
ggattggaactattctgtacctact

SEQ ID NO: 607320 - DNA, 25 bp, Mus musculus
ggattggaagttatttgcacttgaa

SEQ ID NO: 607321 - DNA, 25 bp, Mus musculus
ggattggaagttttttgcacttgaa

SEQ ID NO: 607322 - DNA, 25 bp, Mus musculus
ggattggacacaaacacagcatgtt

SEQ ID NO: 607323 - DNA, 25 bp, Mus musculus
ggattggacacatacacagcatgtt

SEQ ID NO: 607324 - DNA, 25 bp, Mus musculus
ggattggactccatgatctgtcact

SEQ ID NO: 607325 - DNA, 25 bp, Mus musculus
ggattggactccttgatctgtcact

SEQ ID NO: 607326 - DNA, 25 bp, Mus musculus
ggattggactgccactactgattct

SEQ ID NO: 607327 - DNA, 25 bp, Mus musculus
ggattggactgcgactactgattct

SEQ ID NO: 607328 - DNA, 25 bp, Mus musculus
ggattggagccaatgtctccaactt

SEQ ID NO: 607329 - DNA, 25 bp, Mus musculus
ggattggagccattgtctccaactt

SEQ ID NO: 607330 - DNA, 25 bp, Mus musculus
ggattggatttcacccacttgtaac

SEQ ID NO: 607331 - DNA, 25 bp, Mus musculus
ggattggatttctcccacttgtaac

SEQ ID NO: 607332 - DNA, 25 bp, Mus musculus
ggattggcaaaaaagcccctcacgt

SEQ ID NO: 607333 - DNA, 25 bp, Mus musculus
ggattggcaaaatagcccctcacgt

SEQ ID NO: 607334 - DNA, 25 bp, Mus musculus
ggattggcacaacgctgttctgttt

SEQ ID NO: 607335 - DNA, 25 bp, Mus musculus
ggattggcacaaggctgttctgttt

SEQ ID NO: 607336 - DNA, 25 bp, Mus musculus
ggattggcacctcatttcccagcat

SEQ ID NO: 607337 - DNA, 25 bp, Mus musculus
ggattggcacctgatttcccagcat

SEQ ID NO: 607338 - DNA, 25 bp, Mus musculus
ggattggcagctctctctgccataa

SEQ ID NO: 607339 - DNA, 25 bp, Mus musculus
ggattggcagctgtctctgccataa

SEQ ID NO: 607340 - DNA, 25 bp, Mus musculus
ggattggcagttctcacatggcctt

SEQ ID NO: 607341 - DNA, 25 bp, Mus musculus
ggattggcagttgtcacatggcctt

SEQ ID NO: 607342 - DNA, 25 bp, Mus musculus
ggattggcataactcccactattat

SEQ ID NO: 607343 - DNA, 25 bp, Mus musculus
ggattggcataagtcccactattat

SEQ ID NO: 607344 - DNA, 25 bp, Mus musculus
ggattggcatgaatgatccttccaa

SEQ ID NO: 607345 - DNA, 25 bp, Mus musculus
ggattggcatgattgatccttccaa

SEQ ID NO: 607346 - DNA, 25 bp, Mus musculus
ggattggcatttcacagccccagag

SEQ ID NO: 607347 - DNA, 25 bp, Mus musculus
ggattggcatttgacagccccagag

SEQ ID NO: 607348 - DNA, 25 bp, Mus musculus
ggattggccgctagtcgggaaaatc

SEQ ID NO: 607349 - DNA, 25 bp, Mus musculus
ggattggccgcttgtcgggaaaatc

SEQ ID NO: 607350 - DNA, 25 bp, Mus musculus
ggattggctaggcacacctgaacat

SEQ ID NO: 607351 - DNA, 25 bp, Mus musculus
ggattggctagggacacctgaacat

SEQ ID NO: 607352 - DNA, 25 bp, Mus musculus
ggattggctgtcaaatgaactttca

SEQ ID NO: 607353 - DNA, 25 bp, Mus musculus
ggattggctgtctaatgaactttca

SEQ ID NO: 607354 - DNA, 25 bp, Mus musculus
ggattggcttccagcagctgactag

SEQ ID NO: 607355 - DNA, 25 bp, Mus musculus
ggattggcttcctgcagctgactag

SEQ ID NO: 607356 - DNA, 25 bp, Mus musculus
ggattgggacacctccgccgcagca

SEQ ID NO: 607357 - DNA, 25 bp, Mus musculus
ggattgggacacgtccgccgcagca

SEQ ID NO: 607358 - DNA, 25 bp, Mus musculus
ggattgggccttagtcccacataag

SEQ ID NO: 607359 - DNA, 25 bp, Mus musculus
ggattgggccttcaatactaccact

SEQ ID NO: 607360 - DNA, 25 bp, Mus musculus
ggattgggccttgaatactaccact

SEQ ID NO: 607361 - DNA, 25 bp, Mus musculus
ggattgggcctttgtcccacataag

SEQ ID NO: 607362 - DNA, 25 bp, Mus musculus
ggattgggtcatatgcttttccggt

SEQ ID NO: 607363 - DNA, 25 bp, Mus musculus
ggattgggtcatttgcttttccggt

SEQ ID NO: 607364 - DNA, 25 bp, Mus musculus
ggattgggttccagaatgcaccata

SEQ ID NO: 607365 - DNA, 25 bp, Mus musculus
ggattgggttcctgaatgcaccata

SEQ ID NO: 607366 - DNA, 25 bp, Mus musculus
ggattggtcatcagattgtcacaga

SEQ ID NO: 607367 - DNA, 25 bp, Mus musculus
ggattggtcatctgattgtcacaga

SEQ ID NO: 607368 - DNA, 25 bp, Mus musculus
ggattggtccttcgctggttttctc

SEQ ID NO: 607369 - DNA, 25 bp, Mus musculus
ggattggtccttggctggttttctc

SEQ ID NO: 607370 - DNA, 25 bp, Mus musculus
ggattggtctttacagacactatca

SEQ ID NO: 607371 - DNA, 25 bp, Mus musculus
ggattggtcttttcagacactatca

SEQ ID NO: 607372 - DNA, 25 bp, Mus musculus
ggattggtgactccctcttgcagct

SEQ ID NO: 607373 - DNA, 25 bp, Mus musculus
ggattggtgactgcctcttgcagct

SEQ ID NO: 607374 - DNA, 25 bp, Mus musculus
ggattggttcctctacttagcattt

SEQ ID NO: 607375 - DNA, 25 bp, Mus musculus
ggattggttcctcttttggatttca

SEQ ID NO: 607376 - DNA, 25 bp, Mus musculus
ggattggttcctgtacttagcattt

SEQ ID NO: 607377 - DNA, 25 bp, Mus musculus
ggattggttcctgttttggatttca

SEQ ID NO: 607378 - DNA, 25 bp, Mus musculus
ggattgtaagtgattgtcaccatat

SEQ ID NO: 607379 - DNA, 25 bp, Mus musculus
ggattgtaagtgtttgtcaccatat

SEQ ID NO: 607380 - DNA, 25 bp, Mus musculus
ggattgtaccggacaggcgagccct

SEQ ID NO: 607381 - DNA, 25 bp, Mus musculus
ggattgtaccggtcaggcgagccct

SEQ ID NO: 607382 - DNA, 25 bp, Mus musculus
ggattgtactatcgcctgttgtgag

SEQ ID NO: 607383 - DNA, 25 bp, Mus musculus
ggattgtactatggcctgttgtgag

SEQ ID NO: 607384 - DNA, 25 bp, Mus musculus
ggattgtactttctgcttcaactat

SEQ ID NO: 607385 - DNA, 25 bp, Mus musculus
ggattgtactttgtgcttcaactat

SEQ ID NO: 607386 - DNA, 25 bp, Mus musculus
ggattgtagcccagatctcagagcc

SEQ ID NO: 607387 - DNA, 25 bp, Mus musculus
ggattgtagccctgatctcagagcc

SEQ ID NO: 607388 - DNA, 25 bp, Mus musculus
ggattgtaggcaagcgctacactca

SEQ ID NO: 607389 - DNA, 25 bp, Mus musculus
ggattgtaggcatgcgctacactca

SEQ ID NO: 607390 - DNA, 25 bp, Mus musculus
ggattgtcaaagatgcggctgtcat

SEQ ID NO: 607391 - DNA, 25 bp, Mus musculus
ggattgtcaaagttgcggctgtcat

SEQ ID NO: 607392 - DNA, 25 bp, Mus musculus
ggattgtcaacgagcagttcctgct

SEQ ID NO: 607393 - DNA, 25 bp, Mus musculus
ggattgtcaacgtgcagttcctgct

SEQ ID NO: 607394 - DNA, 25 bp, Mus musculus
ggattgtcaccacgccccaatggaa

SEQ ID NO: 607395 - DNA, 25 bp, Mus musculus
ggattgtcaccaggccccaatggaa

SEQ ID NO: 607396 - DNA, 25 bp, Mus musculus
ggattgtcactgagagccccaggag

SEQ ID NO: 607397 - DNA, 25 bp, Mus musculus
ggattgtcactgtgagccccaggag

SEQ ID NO: 607398 - DNA, 25 bp, Mus musculus
ggattgtcatttcttccacatttgt

SEQ ID NO: 607399 - DNA, 25 bp, Mus musculus
ggattgtcatttgttccacatttgt

SEQ ID NO: 607400 - DNA, 25 bp, Mus musculus
ggattgtctcagattttgtggtggc

SEQ ID NO: 607401 - DNA, 25 bp, Mus musculus
ggattgtctcagtttttgtggtggc

SEQ ID NO: 607402 - DNA, 25 bp, Mus musculus
ggattgtgacccagaatgcccacac

SEQ ID NO: 607403 - DNA, 25 bp, Mus musculus
ggattgtgaccctgaatgcccacac

SEQ ID NO: 607404 - DNA, 25 bp, Mus musculus
ggattgtgattccttcatgtttgct

SEQ ID NO: 607405 - DNA, 25 bp, Mus musculus
ggattgtgattcgttcatgtttgct

SEQ ID NO: 607406 - DNA, 25 bp, Mus musculus
ggattgtgcattaagctcttcataa

SEQ ID NO: 607407 - DNA, 25 bp, Mus musculus
ggattgtgcatttagctcttcataa

SEQ ID NO: 607408 - DNA, 25 bp, Mus musculus
ggattgtgccaacgctttccttgtt

SEQ ID NO: 607409 - DNA, 25 bp, Mus musculus
ggattgtgccaaggctttccttgtt

SEQ ID NO: 607410 - DNA, 25 bp, Mus musculus
ggattgtgccccaggcccagagttt

SEQ ID NO: 607411 - DNA, 25 bp, Mus musculus
ggattgtgcccctggcccagagttt

SEQ ID NO: 607412 - DNA, 25 bp, Mus musculus
ggattgtgtggcctctaatcgatat

SEQ ID NO: 607413 - DNA, 25 bp, Mus musculus
ggattgtgtggcgtctaatcgatat

SEQ ID NO: 607414 - DNA, 25 bp, Mus musculus
ggattgtgttctcttatgatgttaa

SEQ ID NO: 607415 - DNA, 25 bp, Mus musculus
ggattgtgttctgttatgatgttaa

SEQ ID NO: 607416 - DNA, 25 bp, Mus musculus
ggattgtgtttgcacccacccttct

SEQ ID NO: 607417 - DNA, 25 bp, Mus musculus
ggattgtgtttggacccacccttct

SEQ ID NO: 607418 - DNA, 25 bp, Mus musculus
ggattgttaaaccatctatatagta

SEQ ID NO: 607419 - DNA, 25 bp, Mus musculus
ggattgttaaacgatctatatagta

SEQ ID NO: 607420 - DNA, 25 bp, Mus musculus
ggattgttacccatctgtttatgag

SEQ ID NO: 607421 - DNA, 25 bp, Mus musculus
ggattgttacccttctgtttatgag

SEQ ID NO: 607422 - DNA, 25 bp, Mus musculus
ggattgttcaaccacttagttctaa

SEQ ID NO: 607423 - DNA, 25 bp, Mus musculus
ggattgttcaacgacttagttctaa

SEQ ID NO: 607424 - DNA, 25 bp, Mus musculus
ggattgttcagtaatactccacccc

SEQ ID NO: 607425 - DNA, 25 bp, Mus musculus
ggattgttcagttatactccacccc

SEQ ID NO: 607426 - DNA, 25 bp, Mus musculus
ggattgttcccaaccttagtataca

SEQ ID NO: 607427 - DNA, 25 bp, Mus musculus
ggattgttcccatccttagtataca

SEQ ID NO: 607428 - DNA, 25 bp, Mus musculus
ggattgttccttcagtatcttgtgt

SEQ ID NO: 607429 - DNA, 25 bp, Mus musculus
ggattgttccttgagtatcttgtgt

SEQ ID NO: 607430 - DNA, 25 bp, Mus musculus
ggattgttctcaaatcctgagctaa

SEQ ID NO: 607431 - DNA, 25 bp, Mus musculus
ggattgttctcatatcctgagctaa

SEQ ID NO: 607432 - DNA, 25 bp, Mus musculus
ggattgttctttagggcataatagt

SEQ ID NO: 607433 - DNA, 25 bp, Mus musculus
ggattgttcttttgggcataatagt

SEQ ID NO: 607434 - DNA, 25 bp, Mus musculus
ggattgttgacccattgcatggata

SEQ ID NO: 607435 - DNA, 25 bp, Mus musculus
ggattgttgaccgattgcatggata

SEQ ID NO: 607436 - DNA, 25 bp, Mus musculus
ggattgttggagattatgacttcac

SEQ ID NO: 607437 - DNA, 25 bp, Mus musculus
ggattgttggagtttatgacttcac

SEQ ID NO: 607438 - DNA, 25 bp, Mus musculus
ggattgttggccagcattcaccaca

SEQ ID NO: 607439 - DNA, 25 bp, Mus musculus
ggattgttggcctgcattcaccaca

SEQ ID NO: 607440 - DNA, 25 bp, Mus musculus
ggattgttgggcaaagcaccacata

SEQ ID NO: 607441 - DNA, 25 bp, Mus musculus
ggattgttgggctaagcaccacata

SEQ ID NO: 607442 - DNA, 25 bp, Mus musculus
ggattgttggtgattaacttcttga

SEQ ID NO: 607443 - DNA, 25 bp, Mus musculus
ggattgttggtgtttaacttcttga

SEQ ID NO: 607444 - DNA, 25 bp, Mus musculus
ggattgttgtccaggttatatctac

SEQ ID NO: 607445 - DNA, 25 bp, Mus musculus
ggattgttgtcctggttatatctac

SEQ ID NO: 607446 - DNA, 25 bp, Mus musculus
ggattgtttacccaacacaattcta

SEQ ID NO: 607447 - DNA, 25 bp, Mus musculus
ggattgtttaccgaacacaattcta

SEQ ID NO: 607448 - DNA, 25 bp, Mus musculus
ggattgtttcatacacatcttctcc

SEQ ID NO: 607449 - DNA, 25 bp, Mus musculus
ggattgtttcattcacatcttctcc

SEQ ID NO: 607450 - DNA, 25 bp, Mus musculus
ggattgtttcttacttctcatgtat

SEQ ID NO: 607451 - DNA, 25 bp, Mus musculus
ggattgtttcttattctatttttat

SEQ ID NO: 607452 - DNA, 25 bp, Mus musculus
ggattgtttctttcttctcatgtat

SEQ ID NO: 607453 - DNA, 25 bp, Mus musculus
ggattgtttctttttctatttttat

SEQ ID NO: 607454 - DNA, 25 bp, Mus musculus
ggattgtttgcccagcttccatgac

SEQ ID NO: 607455 - DNA, 25 bp, Mus musculus
ggattgtttgccgagcttccatgac

SEQ ID NO: 607456 - DNA, 25 bp, Mus musculus
ggattgtttggaactgctcagactg

SEQ ID NO: 607457 - DNA, 25 bp, Mus musculus
ggattgtttggatctgctcagactg

SEQ ID NO: 607458 - DNA, 25 bp, Mus musculus
ggatttaaaacaacttacctcacag

SEQ ID NO: 607459 - DNA, 25 bp, Mus musculus
ggatttaaaacatcttacctcacag

SEQ ID NO: 607460 - DNA, 25 bp, Mus musculus
ggatttaaaatcacactgtagcact

SEQ ID NO: 607461 - DNA, 25 bp, Mus musculus
ggatttaaaatctcactgtagcact

SEQ ID NO: 607462 - DNA, 25 bp, Mus musculus
ggatttaaacacataagttcatctt

SEQ ID NO: 607463 - DNA, 25 bp, Mus musculus
ggatttaaacacttaagttcatctt

SEQ ID NO: 607464 - DNA, 25 bp, Mus musculus
ggatttaaagctcggcatgctgacc

SEQ ID NO: 607465 - DNA, 25 bp, Mus musculus
ggatttaaagctgggcatgctgacc

SEQ ID NO: 607466 - DNA, 25 bp, Mus musculus
ggatttaaagggaaggacctctgct

SEQ ID NO: 607467 - DNA, 25 bp, Mus musculus
ggatttaaagggtaggacctctgct

SEQ ID NO: 607468 - DNA, 25 bp, Mus musculus
ggatttaacctgctcatgacgctga

SEQ ID NO: 607469 - DNA, 25 bp, Mus musculus
ggatttaacctggtcatgacgctga

SEQ ID NO: 607470 - DNA, 25 bp, Mus musculus
ggatttaacgtcaggtgctgcccga

SEQ ID NO: 607471 - DNA, 25 bp, Mus musculus
ggatttaacgtctggtgctgcccga

SEQ ID NO: 607472 - DNA, 25 bp, Mus musculus
ggatttaaggccaaccactttcaga

SEQ ID NO: 607473 - DNA, 25 bp, Mus musculus
ggatttaaggcctaccactttcaga

SEQ ID NO: 607474 - DNA, 25 bp, Mus musculus
ggatttaagtctatgttcacctgaa

SEQ ID NO: 607475 - DNA, 25 bp, Mus musculus
ggatttaagtctttgttcacctgaa

SEQ ID NO: 607476 - DNA, 25 bp, Mus musculus
ggatttaagtttccaacccatgact

SEQ ID NO: 607477 - DNA, 25 bp, Mus musculus
ggatttaagtttgcaacccatgact

SEQ ID NO: 607478 - DNA, 25 bp, Mus musculus
ggatttaatgctcacaccatgctat

SEQ ID NO: 607479 - DNA, 25 bp, Mus musculus
ggatttaatgctgacaccatgctat

SEQ ID NO: 607480 - DNA, 25 bp, Mus musculus
ggatttaattcacttctccctggcc

SEQ ID NO: 607481 - DNA, 25 bp, Mus musculus
ggatttaattcagttctccctggcc

SEQ ID NO: 607482 - DNA, 25 bp, Mus musculus
ggatttaatttacgtgctgtcccta

SEQ ID NO: 607483 - DNA, 25 bp, Mus musculus
ggatttaatttaggtgctgtcccta

SEQ ID NO: 607484 - DNA, 25 bp, Mus musculus
ggatttacactgacagtagccggct

SEQ ID NO: 607485 - DNA, 25 bp, Mus musculus
ggatttacactgtcagtagccggct

SEQ ID NO: 607486 - DNA, 25 bp, Mus musculus
ggatttaccaaacttcagcggccgg

SEQ ID NO: 607487 - DNA, 25 bp, Mus musculus
ggatttaccaaagttcagcggccgg

SEQ ID NO: 607488 - DNA, 25 bp, Mus musculus
ggatttaccatccaactgctatcat

SEQ ID NO: 607489 - DNA, 25 bp, Mus musculus
ggatttaccatcgaactgctatcat

SEQ ID NO: 607490 - DNA, 25 bp, Mus musculus
ggatttacgattatcagtaacagaa

SEQ ID NO: 607491 - DNA, 25 bp, Mus musculus
ggatttacgattttcagtaacagaa

SEQ ID NO: 607492 - DNA, 25 bp, Mus musculus
ggatttacggtcaccaaagcactgt

SEQ ID NO: 607493 - DNA, 25 bp, Mus musculus
ggatttacggtctccaaagcactgt

SEQ ID NO: 607494 - DNA, 25 bp, Mus musculus
ggatttactactctcatagcatttg

SEQ ID NO: 607495 - DNA, 25 bp, Mus musculus
ggatttactactgtcatagcatttg

SEQ ID NO: 607496 - DNA, 25 bp, Mus musculus
ggatttactctaaagatttcacgag

SEQ ID NO: 607497 - DNA, 25 bp, Mus musculus
ggatttactctatagatttcacgag

SEQ ID NO: 607498 - DNA, 25 bp, Mus musculus
ggatttactgtaacatttggaaaag

SEQ ID NO: 607499 - DNA, 25 bp, Mus musculus
ggatttactgtatcatttggaaaag

SEQ ID NO: 607500 - DNA, 25 bp, Mus musculus
ggatttagacacaagctattgattc

SEQ ID NO: 607501 - DNA, 25 bp, Mus musculus
ggatttagacactagctattgattc

SEQ ID NO: 607502 - DNA, 25 bp, Mus musculus
ggatttagacagatcacatctggaa

SEQ ID NO: 607503 - DNA, 25 bp, Mus musculus
ggatttagacagttcacatctggaa

SEQ ID NO: 607504 - DNA, 25 bp, Mus musculus
ggatttagaggtacaccctccatct

SEQ ID NO: 607505 - DNA, 25 bp, Mus musculus
ggatttagaggttcaccctccatct

SEQ ID NO: 607506 - DNA, 25 bp, Mus musculus
ggatttagcagacagccttctatct

SEQ ID NO: 607507 - DNA, 25 bp, Mus musculus
ggatttagcagagagccttctatct

SEQ ID NO: 607508 - DNA, 25 bp, Mus musculus
ggatttagctacaagccacgctcat

SEQ ID NO: 607509 - DNA, 25 bp, Mus musculus
ggatttagctactagccacgctcat

SEQ ID NO: 607510 - DNA, 25 bp, Mus musculus
ggatttagctcactggtagagcgct

SEQ ID NO: 607511 - DNA, 25 bp, Mus musculus
ggatttagctcagtggtagagcgct

SEQ ID NO: 607512 - DNA, 25 bp, Mus musculus
ggatttagtatccaacccttgtgtg

SEQ ID NO: 607513 - DNA, 25 bp, Mus musculus
ggatttagtatcgaacccttgtgtg

SEQ ID NO: 607514 - DNA, 25 bp, Mus musculus
ggatttagtgccagaacatttcttt

SEQ ID NO: 607515 - DNA, 25 bp, Mus musculus
ggatttagtgcctgaacatttcttt

SEQ ID NO: 607516 - DNA, 25 bp, Mus musculus
ggatttagtgttcatttacctcagt

SEQ ID NO: 607517 - DNA, 25 bp, Mus musculus
ggatttagtgttgatttacctcagt

SEQ ID NO: 607518 - DNA, 25 bp, Mus musculus
ggatttagttcacacagactatgcc

SEQ ID NO: 607519 - DNA, 25 bp, Mus musculus
ggatttagttcagacagactatgcc

SEQ ID NO: 607520 - DNA, 25 bp, Mus musculus
ggatttagttgaagggacttcatat

SEQ ID NO: 607521 - DNA, 25 bp, Mus musculus
ggatttagttgatgggacttcatat

SEQ ID NO: 607522 - DNA, 25 bp, Mus musculus
ggatttataagcctgccttcctaac

SEQ ID NO: 607523 - DNA, 25 bp, Mus musculus
ggatttataagcgtgccttcctaac

SEQ ID NO: 607524 - DNA, 25 bp, Mus musculus
ggatttataatactgacatggtctc

SEQ ID NO: 607525 - DNA, 25 bp, Mus musculus
ggatttataatagtgacatggtctc

SEQ ID NO: 607526 - DNA, 25 bp, Mus musculus
ggatttatactgaattgtcatcaat

SEQ ID NO: 607527 - DNA, 25 bp, Mus musculus
ggatttatactgtattgtcatcaat

SEQ ID NO: 607528 - DNA, 25 bp, Mus musculus
ggatttatccacagaagtgcctcaa

SEQ ID NO: 607529 - DNA, 25 bp, Mus musculus
ggatttatccactgaagtgcctcaa

SEQ ID NO: 607530 - DNA, 25 bp, Mus musculus
ggatttatctcaatgggttctactt

SEQ ID NO: 607531 - DNA, 25 bp, Mus musculus
ggatttatctcattgggttctactt

SEQ ID NO: 607532 - DNA, 25 bp, Mus musculus
ggatttatgtccacactctgctgga

SEQ ID NO: 607533 - DNA, 25 bp, Mus musculus
ggatttatgtcctcactctgctgga

SEQ ID NO: 607534 - DNA, 25 bp, Mus musculus
ggatttattccacttcttcagattc

SEQ ID NO: 607535 - DNA, 25 bp, Mus musculus
ggatttattccagttcttcagattc

SEQ ID NO: 607536 - DNA, 25 bp, Mus musculus
ggatttatttggacagcatcgcctg

SEQ ID NO: 607537 - DNA, 25 bp, Mus musculus
ggatttatttggtcagcatcgcctg

SEQ ID NO: 607538 - DNA, 25 bp, Mus musculus
ggatttattttcaaggccttctggg

SEQ ID NO: 607539 - DNA, 25 bp, Mus musculus
ggatttattttctaggccttctggg

SEQ ID NO: 607540 - DNA, 25 bp, Mus musculus
ggatttcaaaagctttgcagcatag

SEQ ID NO: 607541 - DNA, 25 bp, Mus musculus
ggatttcaaaaggtttgcagcatag

SEQ ID NO: 607542 - DNA, 25 bp, Mus musculus
ggatttcaaagcagccttgaaggca

SEQ ID NO: 607543 - DNA, 25 bp, Mus musculus
ggatttcaaagctgccttgaaggca

SEQ ID NO: 607544 - DNA, 25 bp, Mus musculus
ggatttcaaagtcttacctcaagag

SEQ ID NO: 607545 - DNA, 25 bp, Mus musculus
ggatttcaaagtgttacctcaagag

SEQ ID NO: 607546 - DNA, 25 bp, Mus musculus
ggatttcaactccaggcccgaggaa

SEQ ID NO: 607547 - DNA, 25 bp, Mus musculus
ggatttcaactcgaggcccgaggaa

SEQ ID NO: 607548 - DNA, 25 bp, Mus musculus
ggatttcaactgagtgggaccacac

SEQ ID NO: 607549 - DNA, 25 bp, Mus musculus
ggatttcaactgtgtgggaccacac

SEQ ID NO: 607550 - DNA, 25 bp, Mus musculus
ggatttcaataccacgctacacagg

SEQ ID NO: 607551 - DNA, 25 bp, Mus musculus
ggatttcaatacgacgctacacagg

SEQ ID NO: 607552 - DNA, 25 bp, Mus musculus
ggatttcacattactactggctggg

SEQ ID NO: 607553 - DNA, 25 bp, Mus musculus
ggatttcacatttctactggctggg

SEQ ID NO: 607554 - DNA, 25 bp, Mus musculus
ggatttcaccgtacaccagtgtcga

SEQ ID NO: 607555 - DNA, 25 bp, Mus musculus
ggatttcaccgttcaccagtgtcga

SEQ ID NO: 607556 - DNA, 25 bp, Mus musculus
ggatttcactgtcactgtgcatttc

SEQ ID NO: 607557 - DNA, 25 bp, Mus musculus
ggatttcactgtgactgtgcatttc

SEQ ID NO: 607558 - DNA, 25 bp, Mus musculus
ggatttcagaaaacttctgtgtctt

SEQ ID NO: 607559 - DNA, 25 bp, Mus musculus
ggatttcagaaatcttctgtgtctt

SEQ ID NO: 607560 - DNA, 25 bp, Mus musculus
ggatttcagagaaattctactgcta

SEQ ID NO: 607561 - DNA, 25 bp, Mus musculus
ggatttcagagatattctactgcta

SEQ ID NO: 607562 - DNA, 25 bp, Mus musculus
ggatttcagggcaattgccatctct

SEQ ID NO: 607563 - DNA, 25 bp, Mus musculus
ggatttcagggcagttcctggagta

SEQ ID NO: 607564 - DNA, 25 bp, Mus musculus
ggatttcagggctattgccatctct

SEQ ID NO: 607565 - DNA, 25 bp, Mus musculus
ggatttcagggctgttcctggagta

SEQ ID NO: 607566 - DNA, 25 bp, Mus musculus
ggatttcaggttagtgccactaagc

SEQ ID NO: 607567 - DNA, 25 bp, Mus musculus
ggatttcaggtttgtgccactaagc

SEQ ID NO: 607568 - DNA, 25 bp, Mus musculus
ggatttcagttcatatctctgtcag

SEQ ID NO: 607569 - DNA, 25 bp, Mus musculus
ggatttcagttcttatctctgtcag

SEQ ID NO: 607570 - DNA, 25 bp, Mus musculus
ggatttcatactcagccatgagctt

SEQ ID NO: 607571 - DNA, 25 bp, Mus musculus
ggatttcatactgagccatgagctt

SEQ ID NO: 607572 - DNA, 25 bp, Mus musculus
ggatttcatcagaggacagctcctg

SEQ ID NO: 607573 - DNA, 25 bp, Mus musculus
ggatttcatcagagttcttcgagga

SEQ ID NO: 607574 - DNA, 25 bp, Mus musculus
ggatttcatcagcactgtggcactg

SEQ ID NO: 607575 - DNA, 25 bp, Mus musculus
ggatttcatcaggactgtggcactg

SEQ ID NO: 607576 - DNA, 25 bp, Mus musculus
ggatttcatcagtggacagctcctg

SEQ ID NO: 607577 - DNA, 25 bp, Mus musculus
ggatttcatcagtgttcttcgagga

SEQ ID NO: 607578 - DNA, 25 bp, Mus musculus
ggatttcatcttacaaagtgggaag

SEQ ID NO: 607579 - DNA, 25 bp, Mus musculus
ggatttcatctttcaaagtgggaag

SEQ ID NO: 607580 - DNA, 25 bp, Mus musculus
ggatttcatggtcatattttcatat

SEQ ID NO: 607581 - DNA, 25 bp, Mus musculus
ggatttcatggtgatattttcatat

SEQ ID NO: 607582 - DNA, 25 bp, Mus musculus
ggatttcatgttctaacagcttcat

SEQ ID NO: 607583 - DNA, 25 bp, Mus musculus
ggatttcatgttgtaacagcttcat

SEQ ID NO: 607584 - DNA, 25 bp, Mus musculus
ggatttcattctcctttaaatactg

SEQ ID NO: 607585 - DNA, 25 bp, Mus musculus
ggatttcattctgctttaaatactg

SEQ ID NO: 607586 - DNA, 25 bp, Mus musculus
ggatttcattgtacaatatgcattc

SEQ ID NO: 607587 - DNA, 25 bp, Mus musculus
ggatttcattgttcaatatgcattc

SEQ ID NO: 607588 - DNA, 25 bp, Mus musculus
ggatttcatttaatcactgttcagt

SEQ ID NO: 607589 - DNA, 25 bp, Mus musculus
ggatttcatttattcactgttcagt

SEQ ID NO: 607590 - DNA, 25 bp, Mus musculus
ggatttcatttgatcccaagactgg

SEQ ID NO: 607591 - DNA, 25 bp, Mus musculus
ggatttcatttgttcccaagactgg

SEQ ID NO: 607592 - DNA, 25 bp, Mus musculus
ggatttccaaaacttctaggccagc

SEQ ID NO: 607593 - DNA, 25 bp, Mus musculus
ggatttccaaaagttctaggccagc

SEQ ID NO: 607594 - DNA, 25 bp, Mus musculus
ggatttccaaatactagccctttga

SEQ ID NO: 607595 - DNA, 25 bp, Mus musculus
ggatttccaaattctagccctttga

SEQ ID NO: 607596 - DNA, 25 bp, Mus musculus
ggatttccaaccctggaaggcagct

SEQ ID NO: 607597 - DNA, 25 bp, Mus musculus
ggatttccaaccgtggaaggcagct

SEQ ID NO: 607598 - DNA, 25 bp, Mus musculus
ggatttccaaggacacttccacagg

SEQ ID NO: 607599 - DNA, 25 bp, Mus musculus
ggatttccaaggtcacttccacagg

SEQ ID NO: 607600 - DNA, 25 bp, Mus musculus
ggatttccagacacaatcaagcgtg

SEQ ID NO: 607601 - DNA, 25 bp, Mus musculus
ggatttccagactcaatcaagcgtg

SEQ ID NO: 607602 - DNA, 25 bp, Mus musculus
ggatttccaggaagctcttgataga

SEQ ID NO: 607603 - DNA, 25 bp, Mus musculus
ggatttccaggatgctcttgataga

SEQ ID NO: 607604 - DNA, 25 bp, Mus musculus
ggatttccatgcaggctctcatcat

SEQ ID NO: 607605 - DNA, 25 bp, Mus musculus
ggatttccatgctggctctcatcat

SEQ ID NO: 607606 - DNA, 25 bp, Mus musculus
ggatttccatgtagctgtggtgcta

SEQ ID NO: 607607 - DNA, 25 bp, Mus musculus
ggatttccatgttgctgtggtgcta

SEQ ID NO: 607608 - DNA, 25 bp, Mus musculus
ggatttcccacactcagaacattta

SEQ ID NO: 607609 - DNA, 25 bp, Mus musculus
ggatttcccacagtcagaacattta

SEQ ID NO: 607610 - DNA, 25 bp, Mus musculus
ggatttcccatcatgtcttacctgt

SEQ ID NO: 607611 - DNA, 25 bp, Mus musculus
ggatttcccatcttgtcttacctgt

SEQ ID NO: 607612 - DNA, 25 bp, Mus musculus
ggatttccccgaaaatctaccatct

SEQ ID NO: 607613 - DNA, 25 bp, Mus musculus
ggatttccccgataatctaccatct

SEQ ID NO: 607614 - DNA, 25 bp, Mus musculus
ggatttcccggaaaacactgcagga

SEQ ID NO: 607615 - DNA, 25 bp, Mus musculus
ggatttcccggataacactgcagga

SEQ ID NO: 607616 - DNA, 25 bp, Mus musculus
ggatttcccttcatagtatgcttca

SEQ ID NO: 607617 - DNA, 25 bp, Mus musculus
ggatttcccttcttagtatgcttca

SEQ ID NO: 607618 - DNA, 25 bp, Mus musculus
ggatttcctaataccaaacggcgcg

SEQ ID NO: 607619 - DNA, 25 bp, Mus musculus
ggatttcctaattccaaacggcgcg

SEQ ID NO: 607620 - DNA, 25 bp, Mus musculus
ggatttcctattataaaaccatgca

SEQ ID NO: 607621 - DNA, 25 bp, Mus musculus
ggatttcctattttaaaaccatgca

SEQ ID NO: 607622 - DNA, 25 bp, Mus musculus
ggatttcctgaaatgaaaggtgctg

SEQ ID NO: 607623 - DNA, 25 bp, Mus musculus
ggatttcctgaattgaaaggtgctg

SEQ ID NO: 607624 - DNA, 25 bp, Mus musculus
ggatttcctgtgaacctggtagtgt

SEQ ID NO: 607625 - DNA, 25 bp, Mus musculus
ggatttcctgtgtacctggtagtgt

SEQ ID NO: 607626 - DNA, 25 bp, Mus musculus
ggatttccttatagtgactcccaca

SEQ ID NO: 607627 - DNA, 25 bp, Mus musculus
ggatttccttattgtgactcccaca

SEQ ID NO: 607628 - DNA, 25 bp, Mus musculus
ggatttcctttccaatggcactacc

SEQ ID NO: 607629 - DNA, 25 bp, Mus musculus
ggatttcctttcgaatggcactacc

SEQ ID NO: 607630 - DNA, 25 bp, Mus musculus
ggatttcgaacactctctggacctc

SEQ ID NO: 607631 - DNA, 25 bp, Mus musculus
ggatttcgaacagtctctggacctc

SEQ ID NO: 607632 - DNA, 25 bp, Mus musculus
ggatttcgatctctagccagagtgt

SEQ ID NO: 607633 - DNA, 25 bp, Mus musculus
ggatttcgatctgtagccagagtgt

SEQ ID NO: 607634 - DNA, 25 bp, Mus musculus
ggatttcgggcaactgctgtaacat

SEQ ID NO: 607635 - DNA, 25 bp, Mus musculus
ggatttcgggcatctgctgtaacat

SEQ ID NO: 607636 - DNA, 25 bp, Mus musculus
ggatttcgtgcaagttccatgtcac

SEQ ID NO: 607637 - DNA, 25 bp, Mus musculus
ggatttcgtgcatgttccatgtcac

SEQ ID NO: 607638 - DNA, 25 bp, Mus musculus
ggatttcgttaaccaccttggccag

SEQ ID NO: 607639 - DNA, 25 bp, Mus musculus
ggatttcgttaagcaccttggccag

SEQ ID NO: 607640 - DNA, 25 bp, Mus musculus
ggatttctaagccagtagcaatact

SEQ ID NO: 607641 - DNA, 25 bp, Mus musculus
ggatttctaagccttcttgattaat

SEQ ID NO: 607642 - DNA, 25 bp, Mus musculus
ggatttctaagcgagtagcaatact

SEQ ID NO: 607643 - DNA, 25 bp, Mus musculus
ggatttctaagcgttcttgattaat

SEQ ID NO: 607644 - DNA, 25 bp, Mus musculus
ggatttctacctcggatattcacga

SEQ ID NO: 607645 - DNA, 25 bp, Mus musculus
ggatttctacctgggatattcacga

SEQ ID NO: 607646 - DNA, 25 bp, Mus musculus
ggatttctataaacactcgatgtga

SEQ ID NO: 607647 - DNA, 25 bp, Mus musculus
ggatttctataatcactcgatgtga

SEQ ID NO: 607648 - DNA, 25 bp, Mus musculus
ggatttctatgtagctagtttcagc

SEQ ID NO: 607649 - DNA, 25 bp, Mus musculus
ggatttctatgttgctagtttcagc

SEQ ID NO: 607650 - DNA, 25 bp, Mus musculus
ggatttctcactacagatgccatgt

SEQ ID NO: 607651 - DNA, 25 bp, Mus musculus
ggatttctcacttcagatgccatgt

SEQ ID NO: 607652 - DNA, 25 bp, Mus musculus
ggatttctccacagacaaagcttat

SEQ ID NO: 607653 - DNA, 25 bp, Mus musculus
ggatttctccactgacaaagcttat

SEQ ID NO: 607654 - DNA, 25 bp, Mus musculus
ggatttctctataacttcttaacgt

SEQ ID NO: 607655 - DNA, 25 bp, Mus musculus
ggatttctctatatggctacttgtg

SEQ ID NO: 607656 - DNA, 25 bp, Mus musculus
ggatttctctattacttcttaacgt

SEQ ID NO: 607657 - DNA, 25 bp, Mus musculus
ggatttctctatttggctacttgtg

SEQ ID NO: 607658 - DNA, 25 bp, Mus musculus
ggatttctctgccatctatgtaatt

SEQ ID NO: 607659 - DNA, 25 bp, Mus musculus
ggatttctctgccatgaccaagcac

SEQ ID NO: 607660 - DNA, 25 bp, Mus musculus
ggatttctctgcgatctatgtaatt

SEQ ID NO: 607661 - DNA, 25 bp, Mus musculus
ggatttctctgcgatgaccaagcac

SEQ ID NO: 607662 - DNA, 25 bp, Mus musculus
ggatttctgataaatgacccttgtt

SEQ ID NO: 607663 - DNA, 25 bp, Mus musculus
ggatttctgatatatgacccttgtt

SEQ ID NO: 607664 - DNA, 25 bp, Mus musculus
ggatttctgcccaaggatttgcaaa

SEQ ID NO: 607665 - DNA, 25 bp, Mus musculus
ggatttctgccctaggatttgcaaa

SEQ ID NO: 607666 - DNA, 25 bp, Mus musculus
ggatttctggaaattgagtgtggca

SEQ ID NO: 607667 - DNA, 25 bp, Mus musculus
ggatttctggaatttgagtgtggca

SEQ ID NO: 607668 - DNA, 25 bp, Mus musculus
ggatttctggcaagcttggattttt

SEQ ID NO: 607669 - DNA, 25 bp, Mus musculus
ggatttctggcacacagcaacagtt

SEQ ID NO: 607670 - DNA, 25 bp, Mus musculus
ggatttctggcagacagcaacagtt

SEQ ID NO: 607671 - DNA, 25 bp, Mus musculus
ggatttctggcatgcttggattttt

SEQ ID NO: 607672 - DNA, 25 bp, Mus musculus
ggatttctgggactggacgatttct

SEQ ID NO: 607673 - DNA, 25 bp, Mus musculus
ggatttctgggagtggacgatttct

SEQ ID NO: 607674 - DNA, 25 bp, Mus musculus
ggatttctgtgcctagtattaccca

SEQ ID NO: 607675 - DNA, 25 bp, Mus musculus
ggatttctgtgcgtagtattaccca

SEQ ID NO: 607676 - DNA, 25 bp, Mus musculus
ggatttctgtgtcggagacgccctc

SEQ ID NO: 607677 - DNA, 25 bp, Mus musculus
ggatttctgtgtgggagacgccctc

SEQ ID NO: 607678 - DNA, 25 bp, Mus musculus
ggatttctgttacaatctctgagta

SEQ ID NO: 607679 - DNA, 25 bp, Mus musculus
ggatttctgttagaatctctgagta

SEQ ID NO: 607680 - DNA, 25 bp, Mus musculus
ggatttcttatccagacttagagga

SEQ ID NO: 607681 - DNA, 25 bp, Mus musculus
ggatttcttatcgagacttagagga

SEQ ID NO: 607682 - DNA, 25 bp, Mus musculus
ggatttcttattctgaacatgcttg

SEQ ID NO: 607683 - DNA, 25 bp, Mus musculus
ggatttcttattgtgaacatgcttg

SEQ ID NO: 607684 - DNA, 25 bp, Mus musculus
ggatttcttcaaatgcagcgagtac

SEQ ID NO: 607685 - DNA, 25 bp, Mus musculus
ggatttcttcaattgcagcgagtac

SEQ ID NO: 607686 - DNA, 25 bp, Mus musculus
ggatttcttggcatatacctctacc

SEQ ID NO: 607687 - DNA, 25 bp, Mus musculus
ggatttcttggcttatacctctacc

SEQ ID NO: 607688 - DNA, 25 bp, Mus musculus
ggatttcttggtccagtgttattta

SEQ ID NO: 607689 - DNA, 25 bp, Mus musculus
ggatttcttggtgcagtgttattta

SEQ ID NO: 607690 - DNA, 25 bp, Mus musculus
ggatttctttcaacgttggaagcag

SEQ ID NO: 607691 - DNA, 25 bp, Mus musculus
ggatttctttcactgccatttagca

SEQ ID NO: 607692 - DNA, 25 bp, Mus musculus
ggatttctttcagtgccatttagca

SEQ ID NO: 607693 - DNA, 25 bp, Mus musculus
ggatttctttcatcgttggaagcag

SEQ ID NO: 607694 - DNA, 25 bp, Mus musculus
ggatttctttccaatttgcatttat

SEQ ID NO: 607695 - DNA, 25 bp, Mus musculus
ggatttctttcctatttgcatttat

SEQ ID NO: 607696 - DNA, 25 bp, Mus musculus
ggatttctttgcattattcagtgaa

SEQ ID NO: 607697 - DNA, 25 bp, Mus musculus
ggatttctttgctttattcagtgaa

SEQ ID NO: 607698 - DNA, 25 bp, Mus musculus
ggatttctttgtctactgcttgttt

SEQ ID NO: 607699 - DNA, 25 bp, Mus musculus
ggatttctttgtgtactgcttgttt

SEQ ID NO: 607700 - DNA, 25 bp, Mus musculus
ggatttcttttgaaccagcttacct

SEQ ID NO: 607701 - DNA, 25 bp, Mus musculus
ggatttcttttgtaccagcttacct

SEQ ID NO: 607702 - DNA, 25 bp, Mus musculus
ggatttctttttcccacattcagat

SEQ ID NO: 607703 - DNA, 25 bp, Mus musculus
ggatttctttttgccacattcagat

SEQ ID NO: 607704 - DNA, 25 bp, Mus musculus
ggatttgaaaacactagatgccact

SEQ ID NO: 607705 - DNA, 25 bp, Mus musculus
ggatttgaaaactctagatgccact

SEQ ID NO: 607706 - DNA, 25 bp, Mus musculus
ggatttgaaagcacatgcctgccct

SEQ ID NO: 607707 - DNA, 25 bp, Mus musculus
ggatttgaaagctcatgcctgccct

SEQ ID NO: 607708 - DNA, 25 bp, Mus musculus
ggatttgaacccatttacatattta

SEQ ID NO: 607709 - DNA, 25 bp, Mus musculus
ggatttgaacccttttacatattta

SEQ ID NO: 607710 - DNA, 25 bp, Mus musculus
ggatttgaacttcagctctttcctc

SEQ ID NO: 607711 - DNA, 25 bp, Mus musculus
ggatttgaacttctgccctgcaaat

SEQ ID NO: 607712 - DNA, 25 bp, Mus musculus
ggatttgaacttgagctctttcctc

SEQ ID NO: 607713 - DNA, 25 bp, Mus musculus
ggatttgaacttgtgccctgcaaat

SEQ ID NO: 607714 - DNA, 25 bp, Mus musculus
ggatttgaagaacgctccgagctca

SEQ ID NO: 607715 - DNA, 25 bp, Mus musculus
ggatttgaagaaggctccgagctca

SEQ ID NO: 607716 - DNA, 25 bp, Mus musculus
ggatttgaccccaactactgccaaa

SEQ ID NO: 607717 - DNA, 25 bp, Mus musculus
ggatttgacccctactactgccaaa

SEQ ID NO: 607718 - DNA, 25 bp, Mus musculus
ggatttgacctgagacacaaccgaa

SEQ ID NO: 607719 - DNA, 25 bp, Mus musculus
ggatttgacctgcattttctacata

SEQ ID NO: 607720 - DNA, 25 bp, Mus musculus
ggatttgacctggattttctacata

SEQ ID NO: 607721 - DNA, 25 bp, Mus musculus
ggatttgacctgtgacacaaccgaa

SEQ ID NO: 607722 - DNA, 25 bp, Mus musculus
ggatttgactaacatagggtccaga

SEQ ID NO: 607723 - DNA, 25 bp, Mus musculus
ggatttgactaagatagggtccaga

SEQ ID NO: 607724 - DNA, 25 bp, Mus musculus
ggatttgactatatggctatgtcta

SEQ ID NO: 607725 - DNA, 25 bp, Mus musculus
ggatttgactatttggctatgtcta

SEQ ID NO: 607726 - DNA, 25 bp, Mus musculus
ggatttgagaaaatgcccgcagcat

SEQ ID NO: 607727 - DNA, 25 bp, Mus musculus
ggatttgagaaattgcccgcagcat

SEQ ID NO: 607728 - DNA, 25 bp, Mus musculus
ggatttgagcttaaagtatatgtta

SEQ ID NO: 607729 - DNA, 25 bp, Mus musculus
ggatttgagctttaagtatatgtta

SEQ ID NO: 607730 - DNA, 25 bp, Mus musculus
ggatttgatccgaaagtctttgtct

SEQ ID NO: 607731 - DNA, 25 bp, Mus musculus
ggatttgatccgtaagtctttgtct

SEQ ID NO: 607732 - DNA, 25 bp, Mus musculus
ggatttgatgaactagtgcctatga

SEQ ID NO: 607733 - DNA, 25 bp, Mus musculus
ggatttgatgaagtagtgcctatga

SEQ ID NO: 607734 - DNA, 25 bp, Mus musculus
ggatttgatgtcagcagttgctggt

SEQ ID NO: 607735 - DNA, 25 bp, Mus musculus
ggatttgatgtctgcagttgctggt

SEQ ID NO: 607736 - DNA, 25 bp, Mus musculus
ggatttgcaaagctttctcacactg

SEQ ID NO: 607737 - DNA, 25 bp, Mus musculus
ggatttgcaaaggtttctcacactg

SEQ ID NO: 607738 - DNA, 25 bp, Mus musculus
ggatttgcacaaattccaagccaaa

SEQ ID NO: 607739 - DNA, 25 bp, Mus musculus
ggatttgcacaatttccaagccaaa

SEQ ID NO: 607740 - DNA, 25 bp, Mus musculus
ggatttgcacacacctgggagggtt

SEQ ID NO: 607741 - DNA, 25 bp, Mus musculus
ggatttgcacactcctgggagggtt

SEQ ID NO: 607742 - DNA, 25 bp, Mus musculus
ggatttgcacctcccaaggttttca

SEQ ID NO: 607743 - DNA, 25 bp, Mus musculus
ggatttgcacctgccaaggttttca

SEQ ID NO: 607744 - DNA, 25 bp, Mus musculus
ggatttgccaatccccagcagagga

SEQ ID NO: 607745 - DNA, 25 bp, Mus musculus
ggatttgccaatgcccagcagagga

SEQ ID NO: 607746 - DNA, 25 bp, Mus musculus
ggatttgccacactcttatattcat

SEQ ID NO: 607747 - DNA, 25 bp, Mus musculus
ggatttgccacagtcttatattcat

SEQ ID NO: 607748 - DNA, 25 bp, Mus musculus
ggatttgccaggactgaatcttccc

SEQ ID NO: 607749 - DNA, 25 bp, Mus musculus
ggatttgccaggtctgaatcttccc

SEQ ID NO: 607750 - DNA, 25 bp, Mus musculus
ggatttgccattactaataatttaa

SEQ ID NO: 607751 - DNA, 25 bp, Mus musculus
ggatttgccatttctaataatttaa

SEQ ID NO: 607752 - DNA, 25 bp, Mus musculus
ggatttgcccagcttagtgcattta

SEQ ID NO: 607753 - DNA, 25 bp, Mus musculus
ggatttgcccaggttagtgcattta

SEQ ID NO: 607754 - DNA, 25 bp, Mus musculus
ggatttgcccttcgaaactggctct

SEQ ID NO: 607755 - DNA, 25 bp, Mus musculus
ggatttgcccttggaaactggctct

SEQ ID NO: 607756 - DNA, 25 bp, Mus musculus
ggatttgccgaactctatggttcca

SEQ ID NO: 607757 - DNA, 25 bp, Mus musculus
ggatttgccgaagtctatggttcca

SEQ ID NO: 607758 - DNA, 25 bp, Mus musculus
ggatttgcctctattgactccacaa

SEQ ID NO: 607759 - DNA, 25 bp, Mus musculus
ggatttgcctcttttgactccacaa

SEQ ID NO: 607760 - DNA, 25 bp, Mus musculus
ggatttgcgttaactggaccaggtt

SEQ ID NO: 607761 - DNA, 25 bp, Mus musculus
ggatttgcgttatctggaccaggtt

SEQ ID NO: 607762 - DNA, 25 bp, Mus musculus
ggatttgctaatctctgatgatcat

SEQ ID NO: 607763 - DNA, 25 bp, Mus musculus
ggatttgctaatgtctgatgatcat

SEQ ID NO: 607764 - DNA, 25 bp, Mus musculus
ggatttgctagtcaggatgagaaca

SEQ ID NO: 607765 - DNA, 25 bp, Mus musculus
ggatttgctagtgaggatgagaaca

SEQ ID NO: 607766 - DNA, 25 bp, Mus musculus
ggatttgctattcaatctccacccc

SEQ ID NO: 607767 - DNA, 25 bp, Mus musculus
ggatttgctattgaatctccacccc

SEQ ID NO: 607768 - DNA, 25 bp, Mus musculus
ggatttgcttcaatgtttgacatca

SEQ ID NO: 607769 - DNA, 25 bp, Mus musculus
ggatttgcttcattgtttgacatca

SEQ ID NO: 607770 - DNA, 25 bp, Mus musculus
ggatttgcttccaattttcaccagt

SEQ ID NO: 607771 - DNA, 25 bp, Mus musculus
ggatttgcttcctattttcaccagt

SEQ ID NO: 607772 - DNA, 25 bp, Mus musculus
ggatttgcttctcggtcactgcacg

SEQ ID NO: 607773 - DNA, 25 bp, Mus musculus
ggatttgcttctgggtcactgcacg

SEQ ID NO: 607774 - DNA, 25 bp, Mus musculus
ggatttgctttcatgggatcaggga

SEQ ID NO: 607775 - DNA, 25 bp, Mus musculus
ggatttgctttcttgggatcaggga

SEQ ID NO: 607776 - DNA, 25 bp, Mus musculus
ggatttggagccagattaacttctt

SEQ ID NO: 607777 - DNA, 25 bp, Mus musculus
ggatttggagcctgattaacttctt

SEQ ID NO: 607778 - DNA, 25 bp, Mus musculus
ggatttggcagaccaataacagtga

SEQ ID NO: 607779 - DNA, 25 bp, Mus musculus
ggatttggcagagcaataacagtga

SEQ ID NO: 607780 - DNA, 25 bp, Mus musculus
ggatttggcataagtccatcaactg

SEQ ID NO: 607781 - DNA, 25 bp, Mus musculus
ggatttggcatatgtccatcaactg

SEQ ID NO: 607782 - DNA, 25 bp, Mus musculus
ggatttggccacagcatataacaac

SEQ ID NO: 607783 - DNA, 25 bp, Mus musculus
ggatttggccactgcatataacaac

SEQ ID NO: 607784 - DNA, 25 bp, Mus musculus
ggatttggctacagatgtattggta

SEQ ID NO: 607785 - DNA, 25 bp, Mus musculus
ggatttggctactgatgtattggta

SEQ ID NO: 607786 - DNA, 25 bp, Mus musculus
ggatttggctataagggttcctcct

SEQ ID NO: 607787 - DNA, 25 bp, Mus musculus
ggatttggctattagggttcctcct

SEQ ID NO: 607788 - DNA, 25 bp, Mus musculus
ggatttggcttcaaagtacatcatt

SEQ ID NO: 607789 - DNA, 25 bp, Mus musculus
ggatttggcttctaagtacatcatt

SEQ ID NO: 607790 - DNA, 25 bp, Mus musculus
ggatttgggaacctactcaaccaat

SEQ ID NO: 607791 - DNA, 25 bp, Mus musculus
ggatttgggaacgtactcaaccaat

SEQ ID NO: 607792 - DNA, 25 bp, Mus musculus
ggatttggtgccaggctagactaca

SEQ ID NO: 607793 - DNA, 25 bp, Mus musculus
ggatttggtgcctggctagactaca

SEQ ID NO: 607794 - DNA, 25 bp, Mus musculus
ggatttggttctcgtgtgctgcctc

SEQ ID NO: 607795 - DNA, 25 bp, Mus musculus
ggatttggttctggtgtgctgcctc

SEQ ID NO: 607796 - DNA, 25 bp, Mus musculus
ggatttggttgacatgtaacatgaa

SEQ ID NO: 607797 - DNA, 25 bp, Mus musculus
ggatttggttgagatgtaacatgaa

SEQ ID NO: 607798 - DNA, 25 bp, Mus musculus
ggatttgtaacgctagagaacgctt

SEQ ID NO: 607799 - DNA, 25 bp, Mus musculus
ggatttgtaacggtagagaacgctt

SEQ ID NO: 607800 - DNA, 25 bp, Mus musculus
ggatttgtcagtaatatgttgttct

SEQ ID NO: 607801 - DNA, 25 bp, Mus musculus
ggatttgtcagttatatgttgttct

SEQ ID NO: 607802 - DNA, 25 bp, Mus musculus
ggatttgtccggaacattggagagc

SEQ ID NO: 607803 - DNA, 25 bp, Mus musculus
ggatttgtccggtacattggagagc

SEQ ID NO: 607804 - DNA, 25 bp, Mus musculus
ggatttgtcggcatcttggattata

SEQ ID NO: 607805 - DNA, 25 bp, Mus musculus
ggatttgtcggcttcttggattata

SEQ ID NO: 607806 - DNA, 25 bp, Mus musculus
ggatttgtcttacactaagttacac

SEQ ID NO: 607807 - DNA, 25 bp, Mus musculus
ggatttgtcttagactaagttacac

SEQ ID NO: 607808 - DNA, 25 bp, Mus musculus
ggatttgtggctcatttcctctggc

SEQ ID NO: 607809 - DNA, 25 bp, Mus musculus
ggatttgtggctgatttcctctggc

SEQ ID NO: 607810 - DNA, 25 bp, Mus musculus
ggatttgtgtctactcttacttgag

SEQ ID NO: 607811 - DNA, 25 bp, Mus musculus
ggatttgtgtcttctcttacttgag

SEQ ID NO: 607812 - DNA, 25 bp, Mus musculus
ggatttgtgttgactgttgatactt

SEQ ID NO: 607813 - DNA, 25 bp, Mus musculus
ggatttgtgttgtctgttgatactt

SEQ ID NO: 607814 - DNA, 25 bp, Mus musculus
ggatttgttctccttgtaaagctaa

SEQ ID NO: 607815 - DNA, 25 bp, Mus musculus
ggatttgttctcgttgtaaagctaa

SEQ ID NO: 607816 - DNA, 25 bp, Mus musculus
ggatttgttctgctcacatgcattt

SEQ ID NO: 607817 - DNA, 25 bp, Mus musculus
ggatttgttctggtcacatgcattt

SEQ ID NO: 607818 - DNA, 25 bp, Mus musculus
ggatttgttttaatcttgttactgg

SEQ ID NO: 607819 - DNA, 25 bp, Mus musculus
ggatttgttttattcttgttactgg

SEQ ID NO: 607820 - DNA, 25 bp, Mus musculus
ggattttacaaacactccctacctg

SEQ ID NO: 607821 - DNA, 25 bp, Mus musculus
ggattttacaaagactccctacctg

SEQ ID NO: 607822 - DNA, 25 bp, Mus musculus
ggattttacaccagctcattcaaag

SEQ ID NO: 607823 - DNA, 25 bp, Mus musculus
ggattttacacctgctcattcaaag

SEQ ID NO: 607824 - DNA, 25 bp, Mus musculus
ggattttacagaagtggccaagcta

SEQ ID NO: 607825 - DNA, 25 bp, Mus musculus
ggattttacagatgtggccaagcta

SEQ ID NO: 607826 - DNA, 25 bp, Mus musculus
ggattttacatcaactcaggaacct

SEQ ID NO: 607827 - DNA, 25 bp, Mus musculus
ggattttacatctactcaggaacct

SEQ ID NO: 607828 - DNA, 25 bp, Mus musculus
ggattttacgggattgcccagtgct

SEQ ID NO: 607829 - DNA, 25 bp, Mus musculus
ggattttacgggtttgcccagtgct

SEQ ID NO: 607830 - DNA, 25 bp, Mus musculus
ggattttagaacagctcacgcgact

SEQ ID NO: 607831 - DNA, 25 bp, Mus musculus
ggattttagaactgctcacgcgact

SEQ ID NO: 607832 - DNA, 25 bp, Mus musculus
ggattttagcaacgagttacatttt

SEQ ID NO: 607833 - DNA, 25 bp, Mus musculus
ggattttagcaaggagttacatttt

SEQ ID NO: 607834 - DNA, 25 bp, Mus musculus
ggattttataatatcatatcagcgg

SEQ ID NO: 607835 - DNA, 25 bp, Mus musculus
ggattttataatttcatatcagcgg

SEQ ID NO: 607836 - DNA, 25 bp, Mus musculus
ggattttatcctaagcaaaggctac

SEQ ID NO: 607837 - DNA, 25 bp, Mus musculus
ggattttatccttagcaaaggctac

SEQ ID NO: 607838 - DNA, 25 bp, Mus musculus
ggattttatctcacttgaggtcata

SEQ ID NO: 607839 - DNA, 25 bp, Mus musculus
ggattttatctctcttgaggtcata

SEQ ID NO: 607840 - DNA, 25 bp, Mus musculus
ggattttatgtgacagtatcttgct

SEQ ID NO: 607841 - DNA, 25 bp, Mus musculus
ggattttatgtgtcagtatcttgct

SEQ ID NO: 607842 - DNA, 25 bp, Mus musculus
ggattttattcgaaacacaggttgg

SEQ ID NO: 607843 - DNA, 25 bp, Mus musculus
ggattttattcgtaacacaggttgg

SEQ ID NO: 607844 - DNA, 25 bp, Mus musculus
ggattttcaaaactatagtcctggg

SEQ ID NO: 607845 - DNA, 25 bp, Mus musculus
ggattttcaaaagtatagtcctggg

SEQ ID NO: 607846 - DNA, 25 bp, Mus musculus
ggattttcaaatatgttctctgtca

SEQ ID NO: 607847 - DNA, 25 bp, Mus musculus
ggattttcaaatttgttctctgtca

SEQ ID NO: 607848 - DNA, 25 bp, Mus musculus
ggattttcaaggcactcgtatctta

SEQ ID NO: 607849 - DNA, 25 bp, Mus musculus
ggattttcaaggctttaaacagcat

SEQ ID NO: 607850 - DNA, 25 bp, Mus musculus
ggattttcaagggactcgtatctta

SEQ ID NO: 607851 - DNA, 25 bp, Mus musculus
ggattttcaagggtttaaacagcat

SEQ ID NO: 607852 - DNA, 25 bp, Mus musculus
ggattttcaccaacagcctgatgtt

SEQ ID NO: 607853 - DNA, 25 bp, Mus musculus
ggattttcaccatcagcctgatgtt

SEQ ID NO: 607854 - DNA, 25 bp, Mus musculus
ggattttcactgataagatcgacaa

SEQ ID NO: 607855 - DNA, 25 bp, Mus musculus
ggattttcactgttaagatcgacaa

SEQ ID NO: 607856 - DNA, 25 bp, Mus musculus
ggattttcagaacacccacgtataa

SEQ ID NO: 607857 - DNA, 25 bp, Mus musculus
ggattttcagaagacccacgtataa

SEQ ID NO: 607858 - DNA, 25 bp, Mus musculus
ggattttcagagctacacggttaga

SEQ ID NO: 607859 - DNA, 25 bp, Mus musculus
ggattttcagaggtacacggttaga

SEQ ID NO: 607860 - DNA, 25 bp, Mus musculus
ggattttcaggcatttccagaatgt

SEQ ID NO: 607861 - DNA, 25 bp, Mus musculus
ggattttcaggcttttccagaatgt

SEQ ID NO: 607862 - DNA, 25 bp, Mus musculus
ggattttcatccagcccaagagaga

SEQ ID NO: 607863 - DNA, 25 bp, Mus musculus
ggattttcatcctgcccaagagaga

SEQ ID NO: 607864 - DNA, 25 bp, Mus musculus
ggattttccaagaatcttggaccct

SEQ ID NO: 607865 - DNA, 25 bp, Mus musculus
ggattttccaagtatcttggaccct

SEQ ID NO: 607866 - DNA, 25 bp, Mus musculus
ggattttccacaattggttggcaac

SEQ ID NO: 607867 - DNA, 25 bp, Mus musculus
ggattttccacatttggttggcaac

SEQ ID NO: 607868 - DNA, 25 bp, Mus musculus
ggattttccatgctccttaacagaa

SEQ ID NO: 607869 - DNA, 25 bp, Mus musculus
ggattttccatggtccttaacagaa

SEQ ID NO: 607870 - DNA, 25 bp, Mus musculus
ggattttccattcagggtcctctgg

SEQ ID NO: 607871 - DNA, 25 bp, Mus musculus
ggattttccattgagggtcctctgg

SEQ ID NO: 607872 - DNA, 25 bp, Mus musculus
ggattttcccagaatgtcctcaagc

SEQ ID NO: 607873 - DNA, 25 bp, Mus musculus
ggattttcccagtatgtcctcaagc

SEQ ID NO: 607874 - DNA, 25 bp, Mus musculus
ggattttcccatcgatccatatttt

SEQ ID NO: 607875 - DNA, 25 bp, Mus musculus
ggattttcccatggatccatatttt

SEQ ID NO: 607876 - DNA, 25 bp, Mus musculus
ggattttccctacaggtttcacaag

SEQ ID NO: 607877 - DNA, 25 bp, Mus musculus
ggattttccctagaggtttcacaag

SEQ ID NO: 607878 - DNA, 25 bp, Mus musculus
ggattttccgaaatctgaagcttgc

SEQ ID NO: 607879 - DNA, 25 bp, Mus musculus
ggattttccgaattctgaagcttgc

SEQ ID NO: 607880 - DNA, 25 bp, Mus musculus
ggattttccggaatttactgtgtat

SEQ ID NO: 607881 - DNA, 25 bp, Mus musculus
ggattttccggattttactgtgtat

SEQ ID NO: 607882 - DNA, 25 bp, Mus musculus
ggattttcctaaagactcctatcaa

SEQ ID NO: 607883 - DNA, 25 bp, Mus musculus
ggattttcctaatgactcctatcaa

SEQ ID NO: 607884 - DNA, 25 bp, Mus musculus
ggattttcctgtcaccagctgacat

SEQ ID NO: 607885 - DNA, 25 bp, Mus musculus
ggattttcctgtgaccagctgacat

SEQ ID NO: 607886 - DNA, 25 bp, Mus musculus
ggattttcggagcacacacacgttg

SEQ ID NO: 607887 - DNA, 25 bp, Mus musculus
ggattttcggaggacacacacgttg

SEQ ID NO: 607888 - DNA, 25 bp, Mus musculus
ggattttcgtgtacccaggacatga

SEQ ID NO: 607889 - DNA, 25 bp, Mus musculus
ggattttcgtgttcccaggacatga

SEQ ID NO: 607890 - DNA, 25 bp, Mus musculus
ggattttctatgagctacccaacta

SEQ ID NO: 607891 - DNA, 25 bp, Mus musculus
ggattttctatgtgctacccaacta

SEQ ID NO: 607892 - DNA, 25 bp, Mus musculus
ggattttctcacctatgatgtcttg

SEQ ID NO: 607893 - DNA, 25 bp, Mus musculus
ggattttctcacgtatgatgtcttg

SEQ ID NO: 607894 - DNA, 25 bp, Mus musculus
ggattttctccaccgtttctgatta

SEQ ID NO: 607895 - DNA, 25 bp, Mus musculus
ggattttctccagcgtttctgatta

SEQ ID NO: 607896 - DNA, 25 bp, Mus musculus
ggattttctcctattagcaatcgta

SEQ ID NO: 607897 - DNA, 25 bp, Mus musculus
ggattttctcctcgaaacaccacag

SEQ ID NO: 607898 - DNA, 25 bp, Mus musculus
ggattttctcctggaaacaccacag

SEQ ID NO: 607899 - DNA, 25 bp, Mus musculus
ggattttctccttttagcaatcgta

SEQ ID NO: 607900 - DNA, 25 bp, Mus musculus
ggattttctgatccccaagggcacg

SEQ ID NO: 607901 - DNA, 25 bp, Mus musculus
ggattttctgatgcccaagggcacg

SEQ ID NO: 607902 - DNA, 25 bp, Mus musculus
ggattttctgccattaatgagccca

SEQ ID NO: 607903 - DNA, 25 bp, Mus musculus
ggattttctgcctttaatgagccca

SEQ ID NO: 607904 - DNA, 25 bp, Mus musculus
ggattttgaaggagcccttccgaga

SEQ ID NO: 607905 - DNA, 25 bp, Mus musculus
ggattttgaaggtgcccttccgaga

SEQ ID NO: 607906 - DNA, 25 bp, Mus musculus
ggattttgaggcaccttagatctcc

SEQ ID NO: 607907 - DNA, 25 bp, Mus musculus
ggattttgaggctccttagatctcc

SEQ ID NO: 607908 - DNA, 25 bp, Mus musculus
ggattttgatcaaccctctgaggaa

SEQ ID NO: 607909 - DNA, 25 bp, Mus musculus
ggattttgatcatccctctgaggaa

SEQ ID NO: 607910 - DNA, 25 bp, Mus musculus
ggattttgcctcagttttaactaca

SEQ ID NO: 607911 - DNA, 25 bp, Mus musculus
ggattttgcctctgttttaactaca

SEQ ID NO: 607912 - DNA, 25 bp, Mus musculus
ggattttggcacacctgttcctaag

SEQ ID NO: 607913 - DNA, 25 bp, Mus musculus
ggattttggcactcctgttcctaag

SEQ ID NO: 607914 - DNA, 25 bp, Mus musculus
ggattttggctaacagactgacagt

SEQ ID NO: 607915 - DNA, 25 bp, Mus musculus
ggattttggctatcagactgacagt

SEQ ID NO: 607916 - DNA, 25 bp, Mus musculus
ggattttggctcctaatagtaatta

SEQ ID NO: 607917 - DNA, 25 bp, Mus musculus
ggattttggctcgtaatagtaatta

SEQ ID NO: 607918 - DNA, 25 bp, Mus musculus
ggattttgttgtaccaggttttgca

SEQ ID NO: 607919 - DNA, 25 bp, Mus musculus
ggattttgttgttccaggttttgca

SEQ ID NO: 607920 - DNA, 25 bp, Mus musculus
ggattttgttttcctaacctgataa

SEQ ID NO: 607921 - DNA, 25 bp, Mus musculus
ggattttgttttgctaacctgataa

SEQ ID NO: 607922 - DNA, 25 bp, Mus musculus
ggatttttaaatcactgattactat

SEQ ID NO: 607923 - DNA, 25 bp, Mus musculus
ggatttttaaatgactgattactat

SEQ ID NO: 607924 - DNA, 25 bp, Mus musculus
ggatttttaagtccgtaagtgcata

SEQ ID NO: 607925 - DNA, 25 bp, Mus musculus
ggatttttaagtgcgtaagtgcata

SEQ ID NO: 607926 - DNA, 25 bp, Mus musculus
ggatttttactacccaatcaccaag

SEQ ID NO: 607927 - DNA, 25 bp, Mus musculus
ggatttttactagccaatcaccaag

SEQ ID NO: 607928 - DNA, 25 bp, Mus musculus
ggatttttagccaggtacctgaaga

SEQ ID NO: 607929 - DNA, 25 bp, Mus musculus
ggatttttagcctggtacctgaaga

SEQ ID NO: 607930 - DNA, 25 bp, Mus musculus
ggatttttatctcgagcacctcaag

SEQ ID NO: 607931 - DNA, 25 bp, Mus musculus
ggatttttatctggagcacctcaag

SEQ ID NO: 607932 - DNA, 25 bp, Mus musculus
ggatttttatgaacacccgatttct

SEQ ID NO: 607933 - DNA, 25 bp, Mus musculus
ggatttttatgatcacccgatttct

SEQ ID NO: 607934 - DNA, 25 bp, Mus musculus
ggatttttatgtctttcaccatctt

SEQ ID NO: 607935 - DNA, 25 bp, Mus musculus
ggatttttatgtgtttcaccatctt

SEQ ID NO: 607936 - DNA, 25 bp, Mus musculus
ggatttttattcacttttcagacat

SEQ ID NO: 607937 - DNA, 25 bp, Mus musculus
ggatttttattctcttttcagacat

SEQ ID NO: 607938 - DNA, 25 bp, Mus musculus
ggatttttcagaccaactctctagc

SEQ ID NO: 607939 - DNA, 25 bp, Mus musculus
ggatttttcagagcaactctctagc

SEQ ID NO: 607940 - DNA, 25 bp, Mus musculus
ggatttttccaactaccatgtagat

SEQ ID NO: 607941 - DNA, 25 bp, Mus musculus
ggatttttccaagtaccatgtagat

SEQ ID NO: 607942 - DNA, 25 bp, Mus musculus
ggatttttccacaaatgtgaacttc

SEQ ID NO: 607943 - DNA, 25 bp, Mus musculus
ggatttttccactaatgtgaacttc

SEQ ID NO: 607944 - DNA, 25 bp, Mus musculus
ggatttttccatatctgctaagtct

SEQ ID NO: 607945 - DNA, 25 bp, Mus musculus
ggatttttccatttctgctaagtct

SEQ ID NO: 607946 - DNA, 25 bp, Mus musculus
ggatttttcccaaaggactccattg

SEQ ID NO: 607947 - DNA, 25 bp, Mus musculus
ggatttttcccataggactccattg

SEQ ID NO: 607948 - DNA, 25 bp, Mus musculus
ggatttttccccataacatcacata

SEQ ID NO: 607949 - DNA, 25 bp, Mus musculus
ggatttttccccttaacatcacata

SEQ ID NO: 607950 - DNA, 25 bp, Mus musculus
ggatttttctgcaccatccgagaag

SEQ ID NO: 607951 - DNA, 25 bp, Mus musculus
ggatttttctgctccatccgagaag

SEQ ID NO: 607952 - DNA, 25 bp, Mus musculus
ggatttttctggatgtctttttatc

SEQ ID NO: 607953 - DNA, 25 bp, Mus musculus
ggatttttctggcagcctgttaaaa

SEQ ID NO: 607954 - DNA, 25 bp, Mus musculus
ggatttttctgggagcctgttaaaa

SEQ ID NO: 607955 - DNA, 25 bp, Mus musculus
ggatttttctggttgtctttttatc

SEQ ID NO: 607956 - DNA, 25 bp, Mus musculus
ggatttttgagacccctggctgtcc

SEQ ID NO: 607957 - DNA, 25 bp, Mus musculus
ggatttttgagagccctggctgtcc

SEQ ID NO: 607958 - DNA, 25 bp, Mus musculus
ggattttttcagagtcgcagacttc

SEQ ID NO: 607959 - DNA, 25 bp, Mus musculus
ggattttttcagtgtcgcagacttc

SEQ ID NO: 607960 - DNA, 25 bp, Mus musculus
ggcaaaaaacttcatcactcgggag

SEQ ID NO: 607961 - DNA, 25 bp, Mus musculus
ggcaaaaaacttgatcactcgggag

SEQ ID NO: 607962 - DNA, 25 bp, Mus musculus
ggcaaaaaagcacacccacgacctt

SEQ ID NO: 607963 - DNA, 25 bp, Mus musculus
ggcaaaaaagcagacccacgacctt

SEQ ID NO: 607964 - DNA, 25 bp, Mus musculus
ggcaaaaactagagcaacccaaact

SEQ ID NO: 607965 - DNA, 25 bp, Mus musculus
ggcaaaaactagtgcaacccaaact

SEQ ID NO: 607966 - DNA, 25 bp, Mus musculus
ggcaaaaactctactgaactcagat

SEQ ID NO: 607967 - DNA, 25 bp, Mus musculus
ggcaaaaactcttctgaactcagat

SEQ ID NO: 607968 - DNA, 25 bp, Mus musculus
ggcaaaaataatcctccttgtcaca

SEQ ID NO: 607969 - DNA, 25 bp, Mus musculus
ggcaaaaataatgctccttgtcaca

SEQ ID NO: 607970 - DNA, 25 bp, Mus musculus
ggcaaaacaagtctacctagactca

SEQ ID NO: 607971 - DNA, 25 bp, Mus musculus
ggcaaaacaagtgtacctagactca

SEQ ID NO: 607972 - DNA, 25 bp, Mus musculus
ggcaaaacactgatttcctcagaaa

SEQ ID NO: 607973 - DNA, 25 bp, Mus musculus
ggcaaaacactgttttcctcagaaa

SEQ ID NO: 607974 - DNA, 25 bp, Mus musculus
ggcaaaaccacaaattctgactcat

SEQ ID NO: 607975 - DNA, 25 bp, Mus musculus
ggcaaaaccacaacagtgactctgt

SEQ ID NO: 607976 - DNA, 25 bp, Mus musculus
ggcaaaaccacatattctgactcat

SEQ ID NO: 607977 - DNA, 25 bp, Mus musculus
ggcaaaaccacatcagtgactctgt

SEQ ID NO: 607978 - DNA, 25 bp, Mus musculus
ggcaaaacctgcatacatttccatt

SEQ ID NO: 607979 - DNA, 25 bp, Mus musculus
ggcaaaacctgcttacatttccatt

SEQ ID NO: 607980 - DNA, 25 bp, Mus musculus
ggcaaaacgccaccctgctaaagag

SEQ ID NO: 607981 - DNA, 25 bp, Mus musculus
ggcaaaacgccagcctgctaaagag

SEQ ID NO: 607982 - DNA, 25 bp, Mus musculus
ggcaaaactggccacttttcttgtt

SEQ ID NO: 607983 - DNA, 25 bp, Mus musculus
ggcaaaactggcgacttttcttgtt

SEQ ID NO: 607984 - DNA, 25 bp, Mus musculus
ggcaaaacttctcttctatgctcta

SEQ ID NO: 607985 - DNA, 25 bp, Mus musculus
ggcaaaacttctgttctatgctcta

SEQ ID NO: 607986 - DNA, 25 bp, Mus musculus
ggcaaaacttggacctgaggcaata

SEQ ID NO: 607987 - DNA, 25 bp, Mus musculus
ggcaaaacttggtcctgaggcaata

SEQ ID NO: 607988 - DNA, 25 bp, Mus musculus
ggcaaaactttcctatccatattga

SEQ ID NO: 607989 - DNA, 25 bp, Mus musculus
ggcaaaactttcgtatccatattga

SEQ ID NO: 607990 - DNA, 25 bp, Mus musculus
ggcaaaagccttaggcctacaagcc

SEQ ID NO: 607991 - DNA, 25 bp, Mus musculus
ggcaaaagccttctatttatgacaa

SEQ ID NO: 607992 - DNA, 25 bp, Mus musculus
ggcaaaagccttgtatttatgacaa

SEQ ID NO: 607993 - DNA, 25 bp, Mus musculus
ggcaaaagcctttggcctacaagcc

SEQ ID NO: 607994 - DNA, 25 bp, Mus musculus
ggcaaaagctacatgacttatcact

SEQ ID NO: 607995 - DNA, 25 bp, Mus musculus
ggcaaaagctacttgacttatcact

SEQ ID NO: 607996 - DNA, 25 bp, Mus musculus
ggcaaaaggcgacaccctgcttcca

SEQ ID NO: 607997 - DNA, 25 bp, Mus musculus
ggcaaaaggcgagaccctgcttcca

SEQ ID NO: 607998 - DNA, 25 bp, Mus musculus
ggcaaaaggcttacagccctcaaga

SEQ ID NO: 607999 - DNA, 25 bp, Mus musculus
ggcaaaaggctttcagccctcaaga

SEQ ID NO: 608000 - DNA, 25 bp, Mus musculus
ggcaaaatcactcataatccccagg

SEQ ID NO: 608001 - DNA, 25 bp, Mus musculus
ggcaaaatcactgataatccccagg

SEQ ID NO: 608002 - DNA, 25 bp, Mus musculus
ggcaaaatcattatcctcaactgta

SEQ ID NO: 608003 - DNA, 25 bp, Mus musculus
ggcaaaatcattttcctcaactgta

SEQ ID NO: 608004 - DNA, 25 bp, Mus musculus
ggcaaaatccagatttgctgaagtc

SEQ ID NO: 608005 - DNA, 25 bp, Mus musculus
ggcaaaatccagttttgctgaagtc

SEQ ID NO: 608006 - DNA, 25 bp, Mus musculus
ggcaaaatcgccatctcaagaataa

SEQ ID NO: 608007 - DNA, 25 bp, Mus musculus
ggcaaaatcgccttctcaagaataa

SEQ ID NO: 608008 - DNA, 25 bp, Mus musculus
ggcaaaatctaacccctctgtgagc

SEQ ID NO: 608009 - DNA, 25 bp, Mus musculus
ggcaaaatctaagccctctgtgagc

SEQ ID NO: 608010 - DNA, 25 bp, Mus musculus
ggcaaaatcttcacaacccctggag

SEQ ID NO: 608011 - DNA, 25 bp, Mus musculus
ggcaaaatcttctcaacccctggag

SEQ ID NO: 608012 - DNA, 25 bp, Mus musculus
ggcaaaatggccctgaagcacccgt

SEQ ID NO: 608013 - DNA, 25 bp, Mus musculus
ggcaaaatggccgtgaagcacccgt

SEQ ID NO: 608014 - DNA, 25 bp, Mus musculus
ggcaaaattaggcacccctgtggtg

SEQ ID NO: 608015 - DNA, 25 bp, Mus musculus
ggcaaaattagggacccctgtggtg

SEQ ID NO: 608016 - DNA, 25 bp, Mus musculus
ggcaaaattgtaaagtagcttgtga

SEQ ID NO: 608017 - DNA, 25 bp, Mus musculus
ggcaaaattgtatagtagcttgtga

SEQ ID NO: 608018 - DNA, 25 bp, Mus musculus
ggcaaaattgtcacacctctacagt

SEQ ID NO: 608019 - DNA, 25 bp, Mus musculus
ggcaaaattgtctcacctctacagt

SEQ ID NO: 608020 - DNA, 25 bp, Mus musculus
ggcaaaatttctcgtgactcaagga

SEQ ID NO: 608021 - DNA, 25 bp, Mus musculus
ggcaaaatttctggtgactcaagga

SEQ ID NO: 608022 - DNA, 25 bp, Mus musculus
ggcaaacaaacccaaaagtgcattt

SEQ ID NO: 608023 - DNA, 25 bp, Mus musculus
ggcaaacaaaccgaaaagtgcattt

SEQ ID NO: 608024 - DNA, 25 bp, Mus musculus
ggcaaacaaagtctcatctctcaaa

SEQ ID NO: 608025 - DNA, 25 bp, Mus musculus
ggcaaacaaagtgtcatctctcaaa

SEQ ID NO: 608026 - DNA, 25 bp, Mus musculus
ggcaaacaagccaccgagtcaccag

SEQ ID NO: 608027 - DNA, 25 bp, Mus musculus
ggcaaacaagcctccgagtcaccag

SEQ ID NO: 608028 - DNA, 25 bp, Mus musculus
ggcaaacaaggcagttcaagagcaa

SEQ ID NO: 608029 - DNA, 25 bp, Mus musculus
ggcaaacaaggctgttcaagagcaa

SEQ ID NO: 608030 - DNA, 25 bp, Mus musculus
ggcaaacacaacatagcccctgagt

SEQ ID NO: 608031 - DNA, 25 bp, Mus musculus
ggcaaacacaacttagcccctgagt

SEQ ID NO: 608032 - DNA, 25 bp, Mus musculus
ggcaaacaccacctggctgcaggag

SEQ ID NO: 608033 - DNA, 25 bp, Mus musculus
ggcaaacaccacgtggctgcaggag

SEQ ID NO: 608034 - DNA, 25 bp, Mus musculus
ggcaaacaccatccagggattctgc

SEQ ID NO: 608035 - DNA, 25 bp, Mus musculus
ggcaaacaccatgcagggattctgc

SEQ ID NO: 608036 - DNA, 25 bp, Mus musculus
ggcaaacacccaaaccaggaaaata

SEQ ID NO: 608037 - DNA, 25 bp, Mus musculus
ggcaaacacccataccaggaaaata

SEQ ID NO: 608038 - DNA, 25 bp, Mus musculus
ggcaaacactgtcttacggatcctt

SEQ ID NO: 608039 - DNA, 25 bp, Mus musculus
ggcaaacactgtgttacggatcctt

SEQ ID NO: 608040 - DNA, 25 bp, Mus musculus
ggcaaacacttcaatgctgagtcat

SEQ ID NO: 608041 - DNA, 25 bp, Mus musculus
ggcaaacacttctatgctgagtcat

SEQ ID NO: 608042 - DNA, 25 bp, Mus musculus
ggcaaacagactagttttccaacca

SEQ ID NO: 608043 - DNA, 25 bp, Mus musculus
ggcaaacagacttgttttccaacca

SEQ ID NO: 608044 - DNA, 25 bp, Mus musculus
ggcaaacagcttaaagtgcactttc

SEQ ID NO: 608045 - DNA, 25 bp, Mus musculus
ggcaaacagctttaagtgcactttc

SEQ ID NO: 608046 - DNA, 25 bp, Mus musculus
ggcaaacaggaaacttctgtagtat

SEQ ID NO: 608047 - DNA, 25 bp, Mus musculus
ggcaaacaggaatcttctgtagtat

SEQ ID NO: 608048 - DNA, 25 bp, Mus musculus
ggcaaacagtccagtgtgcacagga

SEQ ID NO: 608049 - DNA, 25 bp, Mus musculus
ggcaaacagtcctgtgtgcacagga

SEQ ID NO: 608050 - DNA, 25 bp, Mus musculus
ggcaaacagtttaccaccctggaca

SEQ ID NO: 608051 - DNA, 25 bp, Mus musculus
ggcaaacagttttccaccctggaca

SEQ ID NO: 608052 - DNA, 25 bp, Mus musculus
ggcaaacatccgaatgaattctctt

SEQ ID NO: 608053 - DNA, 25 bp, Mus musculus
ggcaaacatccgtatgaattctctt

SEQ ID NO: 608054 - DNA, 25 bp, Mus musculus
ggcaaacatcttatagcaccctgtg

SEQ ID NO: 608055 - DNA, 25 bp, Mus musculus
ggcaaacatcttttagcaccctgtg

SEQ ID NO: 608056 - DNA, 25 bp, Mus musculus
ggcaaacattcaaatttttacttca

SEQ ID NO: 608057 - DNA, 25 bp, Mus musculus
ggcaaacattcatatttttacttca

SEQ ID NO: 608058 - DNA, 25 bp, Mus musculus
ggcaaacattgcctttatgaccaag

SEQ ID NO: 608059 - DNA, 25 bp, Mus musculus
ggcaaacattgcgtttatgaccaag

SEQ ID NO: 608060 - DNA, 25 bp, Mus musculus
ggcaaaccaagaccctgattccatt

SEQ ID NO: 608061 - DNA, 25 bp, Mus musculus
ggcaaaccaagagcctgattccatt

SEQ ID NO: 608062 - DNA, 25 bp, Mus musculus
ggcaaaccattactctggctgtgac

SEQ ID NO: 608063 - DNA, 25 bp, Mus musculus
ggcaaaccattagtctggctgtgac

SEQ ID NO: 608064 - DNA, 25 bp, Mus musculus
ggcaaaccattgctatgttcatctt

SEQ ID NO: 608065 - DNA, 25 bp, Mus musculus
ggcaaaccattggtatgttcatctt

SEQ ID NO: 608066 - DNA, 25 bp, Mus musculus
ggcaaacccacaaggcacagtcaga

SEQ ID NO: 608067 - DNA, 25 bp, Mus musculus
ggcaaacccacatggcacagtcaga

SEQ ID NO: 608068 - DNA, 25 bp, Mus musculus
ggcaaacccaccaggcatatatttt

SEQ ID NO: 608069 - DNA, 25 bp, Mus musculus
ggcaaacccacctggcatatatttt

SEQ ID NO: 608070 - DNA, 25 bp, Mus musculus
ggcaaaccccatactgtaatgcagt

SEQ ID NO: 608071 - DNA, 25 bp, Mus musculus
ggcaaaccccattctgtaatgcagt

SEQ ID NO: 608072 - DNA, 25 bp, Mus musculus
ggcaaacctcagagcccatgggctc

SEQ ID NO: 608073 - DNA, 25 bp, Mus musculus
ggcaaacctcagtgcccatgggctc

SEQ ID NO: 608074 - DNA, 25 bp, Mus musculus
ggcaaacctcctattagaattctgc

SEQ ID NO: 608075 - DNA, 25 bp, Mus musculus
ggcaaacctccttttagaattctgc

SEQ ID NO: 608076 - DNA, 25 bp, Mus musculus
ggcaaaccttaacgcagaactcctg

SEQ ID NO: 608077 - DNA, 25 bp, Mus musculus
ggcaaaccttaaggcagaactcctg

SEQ ID NO: 608078 - DNA, 25 bp, Mus musculus
ggcaaaccttcacccctagggttga

SEQ ID NO: 608079 - DNA, 25 bp, Mus musculus
ggcaaaccttcagccctagggttga

SEQ ID NO: 608080 - DNA, 25 bp, Mus musculus
ggcaaacgctgaagctcaccgacgt

SEQ ID NO: 608081 - DNA, 25 bp, Mus musculus
ggcaaacgctgatgctcaccgacgt

SEQ ID NO: 608082 - DNA, 25 bp, Mus musculus
ggcaaacgggaaccaatcctctgta

SEQ ID NO: 608083 - DNA, 25 bp, Mus musculus
ggcaaacgggaagcaatcctctgta

SEQ ID NO: 608084 - DNA, 25 bp, Mus musculus
ggcaaacgtctaagattctcctaag

SEQ ID NO: 608085 - DNA, 25 bp, Mus musculus
ggcaaacgtctatgattctcctaag

SEQ ID NO: 608086 - DNA, 25 bp, Mus musculus
ggcaaactcatccatcagctaacgt

SEQ ID NO: 608087 - DNA, 25 bp, Mus musculus
ggcaaactcatccatgtgcagaagt

SEQ ID NO: 608088 - DNA, 25 bp, Mus musculus
ggcaaactcatcgatcagctaacgt

SEQ ID NO: 608089 - DNA, 25 bp, Mus musculus
ggcaaactcatcgatgtgcagaagt

SEQ ID NO: 608090 - DNA, 25 bp, Mus musculus
ggcaaactccaaccatgcattgtaa

SEQ ID NO: 608091 - DNA, 25 bp, Mus musculus
ggcaaactccaagcatgcattgtaa

SEQ ID NO: 608092 - DNA, 25 bp, Mus musculus
ggcaaactccatacctcatattaaa

SEQ ID NO: 608093 - DNA, 25 bp, Mus musculus
ggcaaactccattcctcatattaaa

SEQ ID NO: 608094 - DNA, 25 bp, Mus musculus
ggcaaactctatcctgactgagcca

SEQ ID NO: 608095 - DNA, 25 bp, Mus musculus
ggcaaactctatgctgactgagcca

SEQ ID NO: 608096 - DNA, 25 bp, Mus musculus
ggcaaactctgacgaccggcatttg

SEQ ID NO: 608097 - DNA, 25 bp, Mus musculus
ggcaaactctgaggaccggcatttg

SEQ ID NO: 608098 - DNA, 25 bp, Mus musculus
ggcaaactctttcggctgagtccat

SEQ ID NO: 608099 - DNA, 25 bp, Mus musculus
ggcaaactctttgggctgagtccat

SEQ ID NO: 608100 - DNA, 25 bp, Mus musculus
ggcaaactgaataaccctggacctt

SEQ ID NO: 608101 - DNA, 25 bp, Mus musculus
ggcaaactgaattaccctggacctt

SEQ ID NO: 608102 - DNA, 25 bp, Mus musculus
ggcaaactgagtaggacggtccact

SEQ ID NO: 608103 - DNA, 25 bp, Mus musculus
ggcaaactgagttggacggtccact

SEQ ID NO: 608104 - DNA, 25 bp, Mus musculus
ggcaaactgcaaagtctcgacctgt

SEQ ID NO: 608105 - DNA, 25 bp, Mus musculus
ggcaaactgcaatgtctcgacctgt

SEQ ID NO: 608106 - DNA, 25 bp, Mus musculus
ggcaaactgcctcaattgacaagat

SEQ ID NO: 608107 - DNA, 25 bp, Mus musculus
ggcaaactgcctgaattgacaagat

SEQ ID NO: 608108 - DNA, 25 bp, Mus musculus
ggcaaactgcttcacctagaggatt

SEQ ID NO: 608109 - DNA, 25 bp, Mus musculus
ggcaaactgcttgacctagaggatt

SEQ ID NO: 608110 - DNA, 25 bp, Mus musculus
ggcaaacttagtcttaacaggtgag

SEQ ID NO: 608111 - DNA, 25 bp, Mus musculus
ggcaaacttagtgttaacaggtgag

SEQ ID NO: 608112 - DNA, 25 bp, Mus musculus
ggcaaacttctcaagcatgtgctga

SEQ ID NO: 608113 - DNA, 25 bp, Mus musculus
ggcaaacttctctagcatgtgctga

SEQ ID NO: 608114 - DNA, 25 bp, Mus musculus
ggcaaacttctgagctcttgggcaa

SEQ ID NO: 608115 - DNA, 25 bp, Mus musculus
ggcaaacttctgtgctcttgggcaa

SEQ ID NO: 608116 - DNA, 25 bp, Mus musculus
ggcaaactttgtagtagtcgttgta

SEQ ID NO: 608117 - DNA, 25 bp, Mus musculus
ggcaaactttgttgtagtcgttgta

SEQ ID NO: 608118 - DNA, 25 bp, Mus musculus
ggcaaacttttaaggcctgtcccat

SEQ ID NO: 608119 - DNA, 25 bp, Mus musculus
ggcaaacttttatggcctgtcccat

SEQ ID NO: 608120 - DNA, 25 bp, Mus musculus
ggcaaagaaaccacactgttgctga

SEQ ID NO: 608121 - DNA, 25 bp, Mus musculus
ggcaaagaaacctcactgttgctga

SEQ ID NO: 608122 - DNA, 25 bp, Mus musculus
ggcaaagaactcatccatatacatt

SEQ ID NO: 608123 - DNA, 25 bp, Mus musculus
ggcaaagaactcttccatatacatt

SEQ ID NO: 608124 - DNA, 25 bp, Mus musculus
ggcaaagacaccaggttaccaagaa

SEQ ID NO: 608125 - DNA, 25 bp, Mus musculus
ggcaaagacacctggttaccaagaa

SEQ ID NO: 608126 - DNA, 25 bp, Mus musculus
ggcaaagacagaaatcccagtaaca

SEQ ID NO: 608127 - DNA, 25 bp, Mus musculus
ggcaaagacagatatcccagtaaca

SEQ ID NO: 608128 - DNA, 25 bp, Mus musculus
ggcaaagacatgagaatctctgagt

SEQ ID NO: 608129 - DNA, 25 bp, Mus musculus
ggcaaagacatgagacccacaagtg

SEQ ID NO: 608130 - DNA, 25 bp, Mus musculus
ggcaaagacatgtgaatctctgagt

SEQ ID NO: 608131 - DNA, 25 bp, Mus musculus
ggcaaagacatgtgacccacaagtg

SEQ ID NO: 608132 - DNA, 25 bp, Mus musculus
ggcaaagacggaaattttatgcata

SEQ ID NO: 608133 - DNA, 25 bp, Mus musculus
ggcaaagacggatattttatgcata

SEQ ID NO: 608134 - DNA, 25 bp, Mus musculus
ggcaaagacgttattgctcggcttt

SEQ ID NO: 608135 - DNA, 25 bp, Mus musculus
ggcaaagacgtttttgctcggcttt

SEQ ID NO: 608136 - DNA, 25 bp, Mus musculus
ggcaaagactgcagagacccatgtg

SEQ ID NO: 608137 - DNA, 25 bp, Mus musculus
ggcaaagactgctgagacccatgtg

SEQ ID NO: 608138 - DNA, 25 bp, Mus musculus
ggcaaagagagacctcatagataac

SEQ ID NO: 608139 - DNA, 25 bp, Mus musculus
ggcaaagagagagctcatagataac

SEQ ID NO: 608140 - DNA, 25 bp, Mus musculus
ggcaaagatgaactcactccctcac

SEQ ID NO: 608141 - DNA, 25 bp, Mus musculus
ggcaaagatgaagtcactccctcac

SEQ ID NO: 608142 - DNA, 25 bp, Mus musculus
ggcaaagattttaatcaccgtgaat

SEQ ID NO: 608143 - DNA, 25 bp, Mus musculus
ggcaaagatttttatcaccgtgaat

SEQ ID NO: 608144 - DNA, 25 bp, Mus musculus
ggcaaagcaattcacgtgacccagc

SEQ ID NO: 608145 - DNA, 25 bp, Mus musculus
ggcaaagcaattgacgtgacccagc

SEQ ID NO: 608146 - DNA, 25 bp, Mus musculus
ggcaaagcagagctctgtgccttct

SEQ ID NO: 608147 - DNA, 25 bp, Mus musculus
ggcaaagcagaggtctgtgccttct

SEQ ID NO: 608148 - DNA, 25 bp, Mus musculus
ggcaaagcatcactaagtcctggga

SEQ ID NO: 608149 - DNA, 25 bp, Mus musculus
ggcaaagcatcagtaagtcctggga

SEQ ID NO: 608150 - DNA, 25 bp, Mus musculus
ggcaaagccaaacctgacatccagg

SEQ ID NO: 608151 - DNA, 25 bp, Mus musculus
ggcaaagccaaagctgacatccagg

SEQ ID NO: 608152 - DNA, 25 bp, Mus musculus
ggcaaagccgagaccatggatgtaa

SEQ ID NO: 608153 - DNA, 25 bp, Mus musculus
ggcaaagccgagtccatggatgtaa

SEQ ID NO: 608154 - DNA, 25 bp, Mus musculus
ggcaaagccttcagatcccaaacag

SEQ ID NO: 608155 - DNA, 25 bp, Mus musculus
ggcaaagccttctgatcccaaacag

SEQ ID NO: 608156 - DNA, 25 bp, Mus musculus
ggcaaagcctttcatccaacttatg

SEQ ID NO: 608157 - DNA, 25 bp, Mus musculus
ggcaaagcctttgatccaacttatg

SEQ ID NO: 608158 - DNA, 25 bp, Mus musculus
ggcaaagctagtagtatccttaaca

SEQ ID NO: 608159 - DNA, 25 bp, Mus musculus
ggcaaagctagttgtatccttaaca

SEQ ID NO: 608160 - DNA, 25 bp, Mus musculus
ggcaaagctcctaaagtagccctgt

SEQ ID NO: 608161 - DNA, 25 bp, Mus musculus
ggcaaagctccttaagtagccctgt

SEQ ID NO: 608162 - DNA, 25 bp, Mus musculus
ggcaaagctgctagtttccttaatg

SEQ ID NO: 608163 - DNA, 25 bp, Mus musculus
ggcaaagctgcttgtttccttaatg

SEQ ID NO: 608164 - DNA, 25 bp, Mus musculus
ggcaaagcttatatctctaactcaa

SEQ ID NO: 608165 - DNA, 25 bp, Mus musculus
ggcaaagcttatcctgatttccgta

SEQ ID NO: 608166 - DNA, 25 bp, Mus musculus
ggcaaagcttatgctgatttccgta

SEQ ID NO: 608167 - DNA, 25 bp, Mus musculus
ggcaaagcttatttctctaactcaa

SEQ ID NO: 608168 - DNA, 25 bp, Mus musculus
ggcaaaggacctagtgggaatctaa

SEQ ID NO: 608169 - DNA, 25 bp, Mus musculus
ggcaaaggaccttgtgggaatctaa

SEQ ID NO: 608170 - DNA, 25 bp, Mus musculus
ggcaaaggcaatcccagcttggtct

SEQ ID NO: 608171 - DNA, 25 bp, Mus musculus
ggcaaaggcaatgccagcttggtct

SEQ ID NO: 608172 - DNA, 25 bp, Mus musculus
ggcaaaggcacaactgttttctcta

SEQ ID NO: 608173 - DNA, 25 bp, Mus musculus
ggcaaaggcacatctgttttctcta

SEQ ID NO: 608174 - DNA, 25 bp, Mus musculus
ggcaaaggccgtaatctgcagatga

SEQ ID NO: 608175 - DNA, 25 bp, Mus musculus
ggcaaaggccgttatctgcagatga

SEQ ID NO: 608176 - DNA, 25 bp, Mus musculus
ggcaaaggctcacatgttatacaga

SEQ ID NO: 608177 - DNA, 25 bp, Mus musculus
ggcaaaggctcagatgttatacaga

SEQ ID NO: 608178 - DNA, 25 bp, Mus musculus
ggcaaaggcttgctgatctgtcagt

SEQ ID NO: 608179 - DNA, 25 bp, Mus musculus
ggcaaaggcttggtgatctgtcagt

SEQ ID NO: 608180 - DNA, 25 bp, Mus musculus
ggcaaagggcagagattgaatctat

SEQ ID NO: 608181 - DNA, 25 bp, Mus musculus
ggcaaagggcagtgattgaatctat

SEQ ID NO: 608182 - DNA, 25 bp, Mus musculus
ggcaaagggcatcgtacgccatctc

SEQ ID NO: 608183 - DNA, 25 bp, Mus musculus
ggcaaagggcatggtacgccatctc

SEQ ID NO: 608184 - DNA, 25 bp, Mus musculus
ggcaaaggtactacttaaacagtag

SEQ ID NO: 608185 - DNA, 25 bp, Mus musculus
ggcaaaggtacttcttaaacagtag

SEQ ID NO: 608186 - DNA, 25 bp, Mus musculus
ggcaaaggtatgctctggcccacac

SEQ ID NO: 608187 - DNA, 25 bp, Mus musculus
ggcaaaggtatggtctggcccacac

SEQ ID NO: 608188 - DNA, 25 bp, Mus musculus
ggcaaaggttagagcctagcgttgt

SEQ ID NO: 608189 - DNA, 25 bp, Mus musculus
ggcaaaggttagtgcctagcgttgt

SEQ ID NO: 608190 - DNA, 25 bp, Mus musculus
ggcaaaggttggcatcattcttaca

SEQ ID NO: 608191 - DNA, 25 bp, Mus musculus
ggcaaaggttgggatcattcttaca

SEQ ID NO: 608192 - DNA, 25 bp, Mus musculus
ggcaaagtagtgctctttccgtttc

SEQ ID NO: 608193 - DNA, 25 bp, Mus musculus
ggcaaagtagtggtctttccgtttc

SEQ ID NO: 608194 - DNA, 25 bp, Mus musculus
ggcaaagtatccctcttatgggcat

SEQ ID NO: 608195 - DNA, 25 bp, Mus musculus
ggcaaagtatccgtcttatgggcat

SEQ ID NO: 608196 - DNA, 25 bp, Mus musculus
ggcaaagtccttaaccgagttgtga

SEQ ID NO: 608197 - DNA, 25 bp, Mus musculus
ggcaaagtcctttaccgagttgtga

SEQ ID NO: 608198 - DNA, 25 bp, Mus musculus
ggcaaagtgcacctagagctgtagc

SEQ ID NO: 608199 - DNA, 25 bp, Mus musculus
ggcaaagtgcacgtagagctgtagc

SEQ ID NO: 608200 - DNA, 25 bp, Mus musculus
ggcaaagtgcagatccaaataagga

SEQ ID NO: 608201 - DNA, 25 bp, Mus musculus
ggcaaagtgcagttccaaataagga

SEQ ID NO: 608202 - DNA, 25 bp, Mus musculus
ggcaaagtgccccatcttgagaaga

SEQ ID NO: 608203 - DNA, 25 bp, Mus musculus
ggcaaagtgcccgatcttgagaaga

SEQ ID NO: 608204 - DNA, 25 bp, Mus musculus
ggcaaagtgctgaattgtagttcat

SEQ ID NO: 608205 - DNA, 25 bp, Mus musculus
ggcaaagtgctgtattgtagttcat

SEQ ID NO: 608206 - DNA, 25 bp, Mus musculus
ggcaaagtggttcctccctataatt

SEQ ID NO: 608207 - DNA, 25 bp, Mus musculus
ggcaaagtggttgctccctataatt

SEQ ID NO: 608208 - DNA, 25 bp, Mus musculus
ggcaaagttcgaaggactggctctc

SEQ ID NO: 608209 - DNA, 25 bp, Mus musculus
ggcaaagttcgatggactggctctc

SEQ ID NO: 608210 - DNA, 25 bp, Mus musculus
ggcaaagttgaacctgcatattctt

SEQ ID NO: 608211 - DNA, 25 bp, Mus musculus
ggcaaagttgaagctgcatattctt

SEQ ID NO: 608212 - DNA, 25 bp, Mus musculus
ggcaaagttgtacagatttctatat

SEQ ID NO: 608213 - DNA, 25 bp, Mus musculus
ggcaaagttgtagagatttctatat

SEQ ID NO: 608214 - DNA, 25 bp, Mus musculus
ggcaaagttgtgaattccctatgga

SEQ ID NO: 608215 - DNA, 25 bp, Mus musculus
ggcaaagttgtgacacctgggagaa

SEQ ID NO: 608216 - DNA, 25 bp, Mus musculus
ggcaaagttgtgtattccctatgga

SEQ ID NO: 608217 - DNA, 25 bp, Mus musculus
ggcaaagttgtgtcacctgggagaa

SEQ ID NO: 608218 - DNA, 25 bp, Mus musculus
ggcaaagttttgatcgatctccatc

SEQ ID NO: 608219 - DNA, 25 bp, Mus musculus
ggcaaagttttgttcgatctccatc

SEQ ID NO: 608220 - DNA, 25 bp, Mus musculus
ggcaaataatgcaacccctgatcac

SEQ ID NO: 608221 - DNA, 25 bp, Mus musculus
ggcaaataatgctacccctgatcac

SEQ ID NO: 608222 - DNA, 25 bp, Mus musculus
ggcaaatacacaaactatctcacat

SEQ ID NO: 608223 - DNA, 25 bp, Mus musculus
ggcaaatacacatactatctcacat

SEQ ID NO: 608224 - DNA, 25 bp, Mus musculus
ggcaaatactgcaactcagggctaa

SEQ ID NO: 608225 - DNA, 25 bp, Mus musculus
ggcaaatactgctactcagggctaa

SEQ ID NO: 608226 - DNA, 25 bp, Mus musculus
ggcaaatagactcagcaccctgaca

SEQ ID NO: 608227 - DNA, 25 bp, Mus musculus
ggcaaatagactgagcaccctgaca

SEQ ID NO: 608228 - DNA, 25 bp, Mus musculus
ggcaaatagctcactgtgaatctga

SEQ ID NO: 608229 - DNA, 25 bp, Mus musculus
ggcaaatagctctctgtgaatctga

SEQ ID NO: 608230 - DNA, 25 bp, Mus musculus
ggcaaatatggtaatgtccttcgga

SEQ ID NO: 608231 - DNA, 25 bp, Mus musculus
ggcaaatatggttatgtccttcgga

SEQ ID NO: 608232 - DNA, 25 bp, Mus musculus
ggcaaatatgttaacttgttgaatc

SEQ ID NO: 608233 - DNA, 25 bp, Mus musculus
ggcaaatatgtttacttgttgaatc

SEQ ID NO: 608234 - DNA, 25 bp, Mus musculus
ggcaaatatttccttttagcgtgat

SEQ ID NO: 608235 - DNA, 25 bp, Mus musculus
ggcaaatatttcgttttagcgtgat

SEQ ID NO: 608236 - DNA, 25 bp, Mus musculus
ggcaaatcacaaagctgttccttga

SEQ ID NO: 608237 - DNA, 25 bp, Mus musculus
ggcaaatcacaatgctgttccttga

SEQ ID NO: 608238 - DNA, 25 bp, Mus musculus
ggcaaatcatggacagttactgcag

SEQ ID NO: 608239 - DNA, 25 bp, Mus musculus
ggcaaatcatggtcagttactgcag

SEQ ID NO: 608240 - DNA, 25 bp, Mus musculus
ggcaaatcatgtctgccccttaggg

SEQ ID NO: 608241 - DNA, 25 bp, Mus musculus
ggcaaatcatgtgtgccccttaggg

SEQ ID NO: 608242 - DNA, 25 bp, Mus musculus
ggcaaatcattcctttactcagcaa

SEQ ID NO: 608243 - DNA, 25 bp, Mus musculus
ggcaaatcattcgtttactcagcaa

SEQ ID NO: 608244 - DNA, 25 bp, Mus musculus
ggcaaatccccgagagccacctggg

SEQ ID NO: 608245 - DNA, 25 bp, Mus musculus
ggcaaatccccgtgagccacctggg

SEQ ID NO: 608246 - DNA, 25 bp, Mus musculus
ggcaaatccgtgaataccagctcta

SEQ ID NO: 608247 - DNA, 25 bp, Mus musculus
ggcaaatccgtgtataccagctcta

SEQ ID NO: 608248 - DNA, 25 bp, Mus musculus
ggcaaatccttgaagtgcttcacac

SEQ ID NO: 608249 - DNA, 25 bp, Mus musculus
ggcaaatccttgtagtgcttcacac

SEQ ID NO: 608250 - DNA, 25 bp, Mus musculus
ggcaaatcgtgcatagccgtgcgtc

SEQ ID NO: 608251 - DNA, 25 bp, Mus musculus
ggcaaatcgtgcttagccgtgcgtc

SEQ ID NO: 608252 - DNA, 25 bp, Mus musculus
ggcaaatctgtcagtcttatcatgt

SEQ ID NO: 608253 - DNA, 25 bp, Mus musculus
ggcaaatctgtctgtcttatcatgt

SEQ ID NO: 608254 - DNA, 25 bp, Mus musculus
ggcaaatcttttactcgatgctcat

SEQ ID NO: 608255 - DNA, 25 bp, Mus musculus
ggcaaatctttttctcgatgctcat

SEQ ID NO: 608256 - DNA, 25 bp, Mus musculus
ggcaaatgaatcatctgggatttca

SEQ ID NO: 608257 - DNA, 25 bp, Mus musculus
ggcaaatgaatcttctgggatttca

SEQ ID NO: 608258 - DNA, 25 bp, Mus musculus
ggcaaatgaattaatttcgtcagct

SEQ ID NO: 608259 - DNA, 25 bp, Mus musculus
ggcaaatgaattcactgtacctcag

SEQ ID NO: 608260 - DNA, 25 bp, Mus musculus
ggcaaatgaattgactgtacctcag

SEQ ID NO: 608261 - DNA, 25 bp, Mus musculus
ggcaaatgaatttatttcgtcagct

SEQ ID NO: 608262 - DNA, 25 bp, Mus musculus
ggcaaatgacatattctctgcttgg

SEQ ID NO: 608263 - DNA, 25 bp, Mus musculus
ggcaaatgacattttctctgcttgg

SEQ ID NO: 608264 - DNA, 25 bp, Mus musculus
ggcaaatgacttatttaccagtgct

SEQ ID NO: 608265 - DNA, 25 bp, Mus musculus
ggcaaatgacttttttaccagtgct

SEQ ID NO: 608266 - DNA, 25 bp, Mus musculus
ggcaaatgattactgtcctttgtag

SEQ ID NO: 608267 - DNA, 25 bp, Mus musculus
ggcaaatgattagtgtcctttgtag

SEQ ID NO: 608268 - DNA, 25 bp, Mus musculus
ggcaaatgcaaaatcctacactgac

SEQ ID NO: 608269 - DNA, 25 bp, Mus musculus
ggcaaatgcaaattcctacactgac

SEQ ID NO: 608270 - DNA, 25 bp, Mus musculus
ggcaaatgcagtaccattcgttttc

SEQ ID NO: 608271 - DNA, 25 bp, Mus musculus
ggcaaatgcagttccattcgttttc

SEQ ID NO: 608272 - DNA, 25 bp, Mus musculus
ggcaaatgcctcacactaactctaa

SEQ ID NO: 608273 - DNA, 25 bp, Mus musculus
ggcaaatgcctctcactaactctaa

SEQ ID NO: 608274 - DNA, 25 bp, Mus musculus
ggcaaatgctttcccgaacagaacc

SEQ ID NO: 608275 - DNA, 25 bp, Mus musculus
ggcaaatgctttgccgaacagaacc

SEQ ID NO: 608276 - DNA, 25 bp, Mus musculus
ggcaaatggacaaaccttcaggatt

SEQ ID NO: 608277 - DNA, 25 bp, Mus musculus
ggcaaatggacataccttcaggatt

SEQ ID NO: 608278 - DNA, 25 bp, Mus musculus
ggcaaatggatgactaacctgttga

SEQ ID NO: 608279 - DNA, 25 bp, Mus musculus
ggcaaatggatgtctaacctgttga

SEQ ID NO: 608280 - DNA, 25 bp, Mus musculus
ggcaaatggcaaacttttgcttttt

SEQ ID NO: 608281 - DNA, 25 bp, Mus musculus
ggcaaatggcaatcttttgcttttt

SEQ ID NO: 608282 - DNA, 25 bp, Mus musculus
ggcaaatggcttcgatctaggcaaa

SEQ ID NO: 608283 - DNA, 25 bp, Mus musculus
ggcaaatggcttggatctaggcaaa

SEQ ID NO: 608284 - DNA, 25 bp, Mus musculus
ggcaaatggtacacctatcacccag

SEQ ID NO: 608285 - DNA, 25 bp, Mus musculus
ggcaaatggtactcctatcacccag

SEQ ID NO: 608286 - DNA, 25 bp, Mus musculus
ggcaaatggtttaggtacaggcttt

SEQ ID NO: 608287 - DNA, 25 bp, Mus musculus
ggcaaatggttttggtacaggcttt

SEQ ID NO: 608288 - DNA, 25 bp, Mus musculus
ggcaaatgtaacacttctcttgata

SEQ ID NO: 608289 - DNA, 25 bp, Mus musculus
ggcaaatgtaactcttctcttgata

SEQ ID NO: 608290 - DNA, 25 bp, Mus musculus
ggcaaatgtagtctctcacagcctg

SEQ ID NO: 608291 - DNA, 25 bp, Mus musculus
ggcaaatgtagtgtctcacagcctg

SEQ ID NO: 608292 - DNA, 25 bp, Mus musculus
ggcaaatgtcttctatcctagtata

SEQ ID NO: 608293 - DNA, 25 bp, Mus musculus
ggcaaatgtcttgtatcctagtata

SEQ ID NO: 608294 - DNA, 25 bp, Mus musculus
ggcaaattaaaaagcatgtcctttc

SEQ ID NO: 608295 - DNA, 25 bp, Mus musculus
ggcaaattaaaatgcatgtcctttc

SEQ ID NO: 608296 - DNA, 25 bp, Mus musculus
ggcaaattaagacacctcagtggga

SEQ ID NO: 608297 - DNA, 25 bp, Mus musculus
ggcaaattaagagacctcagtggga

SEQ ID NO: 608298 - DNA, 25 bp, Mus musculus
ggcaaattaagtccctgcaggtgct

SEQ ID NO: 608299 - DNA, 25 bp, Mus musculus
ggcaaattaagtgcctgcaggtgct

SEQ ID NO: 608300 - DNA, 25 bp, Mus musculus
ggcaaattcaacctccctcgtggga

SEQ ID NO: 608301 - DNA, 25 bp, Mus musculus
ggcaaattcaacgtccctcgtggga

SEQ ID NO: 608302 - DNA, 25 bp, Mus musculus
ggcaaattcatcattgtccactctc

SEQ ID NO: 608303 - DNA, 25 bp, Mus musculus
ggcaaattcatctttgtccactctc

SEQ ID NO: 608304 - DNA, 25 bp, Mus musculus
ggcaaattccgcagtttattacagg

SEQ ID NO: 608305 - DNA, 25 bp, Mus musculus
ggcaaattccgctgtttattacagg

SEQ ID NO: 608306 - DNA, 25 bp, Mus musculus
ggcaaattgagtcttgtcctgtctt

SEQ ID NO: 608307 - DNA, 25 bp, Mus musculus
ggcaaattgagtgttgtcctgtctt

SEQ ID NO: 608308 - DNA, 25 bp, Mus musculus
ggcaaattgtacaggtttcattcat

SEQ ID NO: 608309 - DNA, 25 bp, Mus musculus
ggcaaattgtactggtttcattcat

SEQ ID NO: 608310 - DNA, 25 bp, Mus musculus
ggcaaatttgcgcactccccaagat

SEQ ID NO: 608311 - DNA, 25 bp, Mus musculus
ggcaaatttgcggactccccaagat

SEQ ID NO: 608312 - DNA, 25 bp, Mus musculus
ggcaaatttgtgctcagggtcacat

SEQ ID NO: 608313 - DNA, 25 bp, Mus musculus
ggcaaatttgtggtcagggtcacat

SEQ ID NO: 608314 - DNA, 25 bp, Mus musculus
ggcaacaaaattaacctttgctttg

SEQ ID NO: 608315 - DNA, 25 bp, Mus musculus
ggcaacaaaatttacctttgctttg

SEQ ID NO: 608316 - DNA, 25 bp, Mus musculus
ggcaacaaactgcacatgatttcac

SEQ ID NO: 608317 - DNA, 25 bp, Mus musculus
ggcaacaaactggacatgatttcac

SEQ ID NO: 608318 - DNA, 25 bp, Mus musculus
ggcaacaaatccaagtccagaaact

SEQ ID NO: 608319 - DNA, 25 bp, Mus musculus
ggcaacaaatcctagtccagaaact

SEQ ID NO: 608320 - DNA, 25 bp, Mus musculus
ggcaacaaatttcaatgacttttaa

SEQ ID NO: 608321 - DNA, 25 bp, Mus musculus
ggcaacaaatttgaatgacttttaa

SEQ ID NO: 608322 - DNA, 25 bp, Mus musculus
ggcaacaacgctcctaagcgaggaa

SEQ ID NO: 608323 - DNA, 25 bp, Mus musculus
ggcaacaacgctgctaagcgaggaa

SEQ ID NO: 608324 - DNA, 25 bp, Mus musculus
ggcaacaactatccttacttggaac

SEQ ID NO: 608325 - DNA, 25 bp, Mus musculus
ggcaacaactatgcttacttggaac

SEQ ID NO: 608326 - DNA, 25 bp, Mus musculus
ggcaacaatgccaaagaccctcgag

SEQ ID NO: 608327 - DNA, 25 bp, Mus musculus
ggcaacaatgcctaagaccctcgag

SEQ ID NO: 608328 - DNA, 25 bp, Mus musculus
ggcaacacaaagcacaacatcgaaa

SEQ ID NO: 608329 - DNA, 25 bp, Mus musculus
ggcaacacaaaggacaacatcgaaa

SEQ ID NO: 608330 - DNA, 25 bp, Mus musculus
ggcaacacaactcaatgtactccaa

SEQ ID NO: 608331 - DNA, 25 bp, Mus musculus
ggcaacacaactgaatgtactccaa

SEQ ID NO: 608332 - DNA, 25 bp, Mus musculus
ggcaacacaaggaactgcttcgatt

SEQ ID NO: 608333 - DNA, 25 bp, Mus musculus
ggcaacacaaggtactgcttcgatt

SEQ ID NO: 608334 - DNA, 25 bp, Mus musculus
ggcaacacagagaaccccatgtctc

SEQ ID NO: 608335 - DNA, 25 bp, Mus musculus
ggcaacacagagtaccccatgtctc

SEQ ID NO: 608336 - DNA, 25 bp, Mus musculus
ggcaacacaggcatgtttgtccttc

SEQ ID NO: 608337 - DNA, 25 bp, Mus musculus
ggcaacacaggcttgtttgtccttc

SEQ ID NO: 608338 - DNA, 25 bp, Mus musculus
ggcaacacagtcaaactgtcaaaca

SEQ ID NO: 608339 - DNA, 25 bp, Mus musculus
ggcaacacagtctaactgtcaaaca

SEQ ID NO: 608340 - DNA, 25 bp, Mus musculus
ggcaacacagtgatctcattcagaa

SEQ ID NO: 608341 - DNA, 25 bp, Mus musculus
ggcaacacagtgttctcattcagaa

SEQ ID NO: 608342 - DNA, 25 bp, Mus musculus
ggcaacacattcctacacttttaat

SEQ ID NO: 608343 - DNA, 25 bp, Mus musculus
ggcaacacattcgtacacttttaat

SEQ ID NO: 608344 - DNA, 25 bp, Mus musculus
ggcaacaccagtcgagttgtctctg

SEQ ID NO: 608345 - DNA, 25 bp, Mus musculus
ggcaacaccagtggagttgtctctg

SEQ ID NO: 608346 - DNA, 25 bp, Mus musculus
ggcaacaccgatcacagcctcgcag

SEQ ID NO: 608347 - DNA, 25 bp, Mus musculus
ggcaacaccgatgacagcctcgcag

SEQ ID NO: 608348 - DNA, 25 bp, Mus musculus
ggcaacaccgtgagagcatctccaa

SEQ ID NO: 608349 - DNA, 25 bp, Mus musculus
ggcaacaccgtgtgagcatctccaa

SEQ ID NO: 608350 - DNA, 25 bp, Mus musculus
ggcaacactcgtcagattggcagtt

SEQ ID NO: 608351 - DNA, 25 bp, Mus musculus
ggcaacactcgtgagattggcagtt

SEQ ID NO: 608352 - DNA, 25 bp, Mus musculus
ggcaacactgccaacagctttaaca

SEQ ID NO: 608353 - DNA, 25 bp, Mus musculus
ggcaacactgcccattcaattgaat

SEQ ID NO: 608354 - DNA, 25 bp, Mus musculus
ggcaacactgccgattcaattgaat

SEQ ID NO: 608355 - DNA, 25 bp, Mus musculus
ggcaacactgcctacagctttaaca

SEQ ID NO: 608356 - DNA, 25 bp, Mus musculus
ggcaacagaagacccacggtgattg

SEQ ID NO: 608357 - DNA, 25 bp, Mus musculus
ggcaacagaagagccacggtgattg

SEQ ID NO: 608358 - DNA, 25 bp, Mus musculus
ggcaacagacaacttgaagatctca

SEQ ID NO: 608359 - DNA, 25 bp, Mus musculus
ggcaacagacaagttgaagatctca

SEQ ID NO: 608360 - DNA, 25 bp, Mus musculus
ggcaacagcagtatctgagtggact

SEQ ID NO: 608361 - DNA, 25 bp, Mus musculus
ggcaacagcagtttctgagtggact

SEQ ID NO: 608362 - DNA, 25 bp, Mus musculus
ggcaacagccgcatacaggtattcg

SEQ ID NO: 608363 - DNA, 25 bp, Mus musculus
ggcaacagccgcttacaggtattcg

SEQ ID NO: 608364 - DNA, 25 bp, Mus musculus
ggcaacagcctgattgacgattaaa

SEQ ID NO: 608365 - DNA, 25 bp, Mus musculus
ggcaacagcctgtttgacgattaaa

SEQ ID NO: 608366 - DNA, 25 bp, Mus musculus
ggcaacagcgatccttttcactgat

SEQ ID NO: 608367 - DNA, 25 bp, Mus musculus
ggcaacagcgatgcttttcactgat

SEQ ID NO: 608368 - DNA, 25 bp, Mus musculus
ggcaacagcgctcataactaaccat

SEQ ID NO: 608369 - DNA, 25 bp, Mus musculus
ggcaacagcgctgataactaaccat

SEQ ID NO: 608370 - DNA, 25 bp, Mus musculus
ggcaacagctgtattaattaggttt

SEQ ID NO: 608371 - DNA, 25 bp, Mus musculus
ggcaacagctgttttaattaggttt

SEQ ID NO: 608372 - DNA, 25 bp, Mus musculus
ggcaacaggacaagccctcatggtt

SEQ ID NO: 608373 - DNA, 25 bp, Mus musculus
ggcaacaggacacttcccctataag

SEQ ID NO: 608374 - DNA, 25 bp, Mus musculus
ggcaacaggacagttcccctataag

SEQ ID NO: 608375 - DNA, 25 bp, Mus musculus
ggcaacaggacatgccctcatggtt

SEQ ID NO: 608376 - DNA, 25 bp, Mus musculus
ggcaacaggccgatgcacaccgtca

SEQ ID NO: 608377 - DNA, 25 bp, Mus musculus
ggcaacaggccgttgcacaccgtca

SEQ ID NO: 608378 - DNA, 25 bp, Mus musculus
ggcaacaggtatcaaaagcctcaag

SEQ ID NO: 608379 - DNA, 25 bp, Mus musculus
ggcaacaggtatgaaaagcctcaag

SEQ ID NO: 608380 - DNA, 25 bp, Mus musculus
ggcaacagtaacatccctaaggagc

SEQ ID NO: 608381 - DNA, 25 bp, Mus musculus
ggcaacagtaacttccctaaggagc

SEQ ID NO: 608382 - DNA, 25 bp, Mus musculus
ggcaacagtaccaaagacagaaatt

SEQ ID NO: 608383 - DNA, 25 bp, Mus musculus
ggcaacagtacctaagacagaaatt

SEQ ID NO: 608384 - DNA, 25 bp, Mus musculus
ggcaacatatccatttcttgggaaa

SEQ ID NO: 608385 - DNA, 25 bp, Mus musculus
ggcaacatatccttttcttgggaaa

SEQ ID NO: 608386 - DNA, 25 bp, Mus musculus
ggcaacatcaagaaccctgccttgt

SEQ ID NO: 608387 - DNA, 25 bp, Mus musculus
ggcaacatcaagtaccctgccttgt

SEQ ID NO: 608388 - DNA, 25 bp, Mus musculus
ggcaacatcaatactttcttcctcc

SEQ ID NO: 608389 - DNA, 25 bp, Mus musculus
ggcaacatcaattctttcttcctcc

SEQ ID NO: 608390 - DNA, 25 bp, Mus musculus
ggcaacatcagaataaacctctttg

SEQ ID NO: 608391 - DNA, 25 bp, Mus musculus
ggcaacatcagaattgaatggaatt

SEQ ID NO: 608392 - DNA, 25 bp, Mus musculus
ggcaacatcagattaaacctctttg

SEQ ID NO: 608393 - DNA, 25 bp, Mus musculus
ggcaacatcagatttgaatggaatt

SEQ ID NO: 608394 - DNA, 25 bp, Mus musculus
ggcaacatcgttaactgggaagtat

SEQ ID NO: 608395 - DNA, 25 bp, Mus musculus
ggcaacatcgtttactgggaagtat

SEQ ID NO: 608396 - DNA, 25 bp, Mus musculus
ggcaacatgaccagctcccatggaa

SEQ ID NO: 608397 - DNA, 25 bp, Mus musculus
ggcaacatgacctgctcccatggaa

SEQ ID NO: 608398 - DNA, 25 bp, Mus musculus
ggcaacatggaaatactggttccgt

SEQ ID NO: 608399 - DNA, 25 bp, Mus musculus
ggcaacatggaaatagaagcaaagg

SEQ ID NO: 608400 - DNA, 25 bp, Mus musculus
ggcaacatggaattactggttccgt

SEQ ID NO: 608401 - DNA, 25 bp, Mus musculus
ggcaacatggaattagaagcaaagg

SEQ ID NO: 608402 - DNA, 25 bp, Mus musculus
ggcaacatttctccttttttgtcgt

SEQ ID NO: 608403 - DNA, 25 bp, Mus musculus
ggcaacatttctgcttttttgtcgt

SEQ ID NO: 608404 - DNA, 25 bp, Mus musculus
ggcaaccaagccatctcaggaattc

SEQ ID NO: 608405 - DNA, 25 bp, Mus musculus
ggcaaccaagccatgacacatcatt

SEQ ID NO: 608406 - DNA, 25 bp, Mus musculus
ggcaaccaagccttctcaggaattc

SEQ ID NO: 608407 - DNA, 25 bp, Mus musculus
ggcaaccaagccttgacacatcatt

SEQ ID NO: 608408 - DNA, 25 bp, Mus musculus
ggcaaccacatgactgcacagacat

SEQ ID NO: 608409 - DNA, 25 bp, Mus musculus
ggcaaccacatgtctgcacagacat

SEQ ID NO: 608410 - DNA, 25 bp, Mus musculus
ggcaaccactgcatattttctattt

SEQ ID NO: 608411 - DNA, 25 bp, Mus musculus
ggcaaccactgcttattttctattt

SEQ ID NO: 608412 - DNA, 25 bp, Mus musculus
ggcaaccagatgatcagtccttctc

SEQ ID NO: 608413 - DNA, 25 bp, Mus musculus
ggcaaccagatgttcagtccttctc

SEQ ID NO: 608414 - DNA, 25 bp, Mus musculus
ggcaaccagccccaggagagctgac

SEQ ID NO: 608415 - DNA, 25 bp, Mus musculus
ggcaaccagcccgaggagagctgac

SEQ ID NO: 608416 - DNA, 25 bp, Mus musculus
ggcaaccaggcgaggatcccagata

SEQ ID NO: 608417 - DNA, 25 bp, Mus musculus
ggcaaccaggcgtggatcccagata

SEQ ID NO: 608418 - DNA, 25 bp, Mus musculus
ggcaaccataataaaactcagtaga

SEQ ID NO: 608419 - DNA, 25 bp, Mus musculus
ggcaaccataattaaactcagtaga

SEQ ID NO: 608420 - DNA, 25 bp, Mus musculus
ggcaaccatattaacctctagaaca

SEQ ID NO: 608421 - DNA, 25 bp, Mus musculus
ggcaaccatatttacctctagaaca

SEQ ID NO: 608422 - DNA, 25 bp, Mus musculus
ggcaaccatgtgagttggcacttaa

SEQ ID NO: 608423 - DNA, 25 bp, Mus musculus
ggcaaccatgtgtgttggcacttaa

SEQ ID NO: 608424 - DNA, 25 bp, Mus musculus
ggcaaccatgttacttgacttcatc

SEQ ID NO: 608425 - DNA, 25 bp, Mus musculus
ggcaaccatgtttcttgacttcatc

SEQ ID NO: 608426 - DNA, 25 bp, Mus musculus
ggcaacccagctaatactggctgag

SEQ ID NO: 608427 - DNA, 25 bp, Mus musculus
ggcaacccagcttatactggctgag

SEQ ID NO: 608428 - DNA, 25 bp, Mus musculus
ggcaacccaggtacattcaactagg

SEQ ID NO: 608429 - DNA, 25 bp, Mus musculus
ggcaacccaggttcattcaactagg

SEQ ID NO: 608430 - DNA, 25 bp, Mus musculus
ggcaacccagtgacgatgaggacga

SEQ ID NO: 608431 - DNA, 25 bp, Mus musculus
ggcaacccagtgtcgatgaggacga

SEQ ID NO: 608432 - DNA, 25 bp, Mus musculus
ggcaaccccgagcttctagaaatga

SEQ ID NO: 608433 - DNA, 25 bp, Mus musculus
ggcaaccccgaggttctagaaatga

SEQ ID NO: 608434 - DNA, 25 bp, Mus musculus
ggcaacccgagccttgatggtaatt

SEQ ID NO: 608435 - DNA, 25 bp, Mus musculus
ggcaacccgagcgttgatggtaatt

SEQ ID NO: 608436 - DNA, 25 bp, Mus musculus
ggcaacccgcacagttacgaaagga

SEQ ID NO: 608437 - DNA, 25 bp, Mus musculus
ggcaacccgcactgttacgaaagga

SEQ ID NO: 608438 - DNA, 25 bp, Mus musculus
ggcaaccctggtactgaagctgagc

SEQ ID NO: 608439 - DNA, 25 bp, Mus musculus
ggcaaccctggttctgaagctgagc

SEQ ID NO: 608440 - DNA, 25 bp, Mus musculus
ggcaacccttgaccgactgaagaaa

SEQ ID NO: 608441 - DNA, 25 bp, Mus musculus
ggcaacccttgagcgactgaagaaa

SEQ ID NO: 608442 - DNA, 25 bp, Mus musculus
ggcaaccgagaaagcttgacagcaa

SEQ ID NO: 608443 - DNA, 25 bp, Mus musculus
ggcaaccgagaatgcttgacagcaa

SEQ ID NO: 608444 - DNA, 25 bp, Mus musculus
ggcaaccgagccacagagggtccag

SEQ ID NO: 608445 - DNA, 25 bp, Mus musculus
ggcaaccgagcctcagagggtccag

SEQ ID NO: 608446 - DNA, 25 bp, Mus musculus
ggcaaccgaggacatcatcagtaca

SEQ ID NO: 608447 - DNA, 25 bp, Mus musculus
ggcaaccgaggagatcatcagtaca

SEQ ID NO: 608448 - DNA, 25 bp, Mus musculus
ggcaaccgtacaactgagctatctt

SEQ ID NO: 608449 - DNA, 25 bp, Mus musculus
ggcaaccgtacatctgagctatctt

SEQ ID NO: 608450 - DNA, 25 bp, Mus musculus
ggcaaccgtgagaatgttcctgaac

SEQ ID NO: 608451 - DNA, 25 bp, Mus musculus
ggcaaccgtgagtatgttcctgaac

SEQ ID NO: 608452 - DNA, 25 bp, Mus musculus
ggcaacctaataaggccctgctttg

SEQ ID NO: 608453 - DNA, 25 bp, Mus musculus
ggcaacctaatatggccctgctttg

SEQ ID NO: 608454 - DNA, 25 bp, Mus musculus
ggcaacctaggaattgatttacttt

SEQ ID NO: 608455 - DNA, 25 bp, Mus musculus
ggcaacctaggatttgatttacttt

SEQ ID NO: 608456 - DNA, 25 bp, Mus musculus
ggcaacctatgcaaccaaatataaa

SEQ ID NO: 608457 - DNA, 25 bp, Mus musculus
ggcaacctatgctaccaaatataaa

SEQ ID NO: 608458 - DNA, 25 bp, Mus musculus
ggcaacctatggaatctgcttctat

SEQ ID NO: 608459 - DNA, 25 bp, Mus musculus
ggcaacctatggtatctgcttctat

SEQ ID NO: 608460 - DNA, 25 bp, Mus musculus
ggcaacctcaagaatctttcctggg

SEQ ID NO: 608461 - DNA, 25 bp, Mus musculus
ggcaacctcaagtatctttcctggg

SEQ ID NO: 608462 - DNA, 25 bp, Mus musculus
ggcaacctggaaactgtcagccaag

SEQ ID NO: 608463 - DNA, 25 bp, Mus musculus
ggcaacctggaatctgtcagccaag

SEQ ID NO: 608464 - DNA, 25 bp, Mus musculus
ggcaacctgggcaccttgtctgtga

SEQ ID NO: 608465 - DNA, 25 bp, Mus musculus
ggcaacctgggctccttgtctgtga

SEQ ID NO: 608466 - DNA, 25 bp, Mus musculus
ggcaacctgtgcatggtaaccggag

SEQ ID NO: 608467 - DNA, 25 bp, Mus musculus
ggcaacctgtgcttggtaaccggag

SEQ ID NO: 608468 - DNA, 25 bp, Mus musculus
ggcaacctgtggcaactatggcttc

SEQ ID NO: 608469 - DNA, 25 bp, Mus musculus
ggcaacctgtgggaactatggcttc

SEQ ID NO: 608470 - DNA, 25 bp, Mus musculus
ggcaaccttcggcagacatggacaa

SEQ ID NO: 608471 - DNA, 25 bp, Mus musculus
ggcaaccttcgggagacatggacaa

SEQ ID NO: 608472 - DNA, 25 bp, Mus musculus
ggcaaccttgggagttcttcctcag

SEQ ID NO: 608473 - DNA, 25 bp, Mus musculus
ggcaaccttgggtgttcttcctcag

SEQ ID NO: 608474 - DNA, 25 bp, Mus musculus
ggcaacctttctcctgtcagaggga

SEQ ID NO: 608475 - DNA, 25 bp, Mus musculus
ggcaacctttctgctgtcagaggga

SEQ ID NO: 608476 - DNA, 25 bp, Mus musculus
ggcaaccttttgctctattttagtg

SEQ ID NO: 608477 - DNA, 25 bp, Mus musculus
ggcaaccttttggtctattttagtg

SEQ ID NO: 608478 - DNA, 25 bp, Mus musculus
ggcaacgaacttctttatcagaaca

SEQ ID NO: 608479 - DNA, 25 bp, Mus musculus
ggcaacgaacttgtttatcagaaca

SEQ ID NO: 608480 - DNA, 25 bp, Mus musculus
ggcaacgaagtacttctagacgaca

SEQ ID NO: 608481 - DNA, 25 bp, Mus musculus
ggcaacgaagtagttctagacgaca

SEQ ID NO: 608482 - DNA, 25 bp, Mus musculus
ggcaacgacgagacccggacacagg

SEQ ID NO: 608483 - DNA, 25 bp, Mus musculus
ggcaacgacgagtcccggacacagg

SEQ ID NO: 608484 - DNA, 25 bp, Mus musculus
ggcaacgagcggatccgatgccctg

SEQ ID NO: 608485 - DNA, 25 bp, Mus musculus
ggcaacgagcggttccgatgccctg

SEQ ID NO: 608486 - DNA, 25 bp, Mus musculus
ggcaacgagtccaaagtgtgctcct

SEQ ID NO: 608487 - DNA, 25 bp, Mus musculus
ggcaacgagtcctaagtgtgctcct

SEQ ID NO: 608488 - DNA, 25 bp, Mus musculus
ggcaacgatgccaagcgcttggagc

SEQ ID NO: 608489 - DNA, 25 bp, Mus musculus
ggcaacgatgcctagcgcttggagc

SEQ ID NO: 608490 - DNA, 25 bp, Mus musculus
ggcaacgcatcacggacaggtctgt

SEQ ID NO: 608491 - DNA, 25 bp, Mus musculus
ggcaacgcatcagggacaggtctgt

SEQ ID NO: 608492 - DNA, 25 bp, Mus musculus
ggcaacgcattgatcacccatagat

SEQ ID NO: 608493 - DNA, 25 bp, Mus musculus
ggcaacgcattgttcacccatagat

SEQ ID NO: 608494 - DNA, 25 bp, Mus musculus
ggcaacgcatttaatactcctctat

SEQ ID NO: 608495 - DNA, 25 bp, Mus musculus
ggcaacgcattttatactcctctat

SEQ ID NO: 608496 - DNA, 25 bp, Mus musculus
ggcaacgcggaacatggcaccaagt

SEQ ID NO: 608497 - DNA, 25 bp, Mus musculus
ggcaacgcggaagatggcaccaagt

SEQ ID NO: 608498 - DNA, 25 bp, Mus musculus
ggcaacgctaacacagaacactacc

SEQ ID NO: 608499 - DNA, 25 bp, Mus musculus
ggcaacgctaactcagaacactacc

SEQ ID NO: 608500 - DNA, 25 bp, Mus musculus
ggcaacgctgtcagaacgggtcaaa

SEQ ID NO: 608501 - DNA, 25 bp, Mus musculus
ggcaacgctgtctgaacgggtcaaa

SEQ ID NO: 608502 - DNA, 25 bp, Mus musculus
ggcaacgcttctcccacaagggcaa

SEQ ID NO: 608503 - DNA, 25 bp, Mus musculus
ggcaacgcttctgccacaagggcaa

SEQ ID NO: 608504 - DNA, 25 bp, Mus musculus
ggcaacggactcctgtgttgttcta

SEQ ID NO: 608505 - DNA, 25 bp, Mus musculus
ggcaacggactcgtgtgttgttcta

SEQ ID NO: 608506 - DNA, 25 bp, Mus musculus
ggcaacggcagcatgaatctcaaat

SEQ ID NO: 608507 - DNA, 25 bp, Mus musculus
ggcaacggcagcttgaatctcaaat

SEQ ID NO: 608508 - DNA, 25 bp, Mus musculus
ggcaacggtcagaccagcaagtgta

SEQ ID NO: 608509 - DNA, 25 bp, Mus musculus
ggcaacggtcagtccagcaagtgta

SEQ ID NO: 608510 - DNA, 25 bp, Mus musculus
ggcaacgtatctataaacttccgac

SEQ ID NO: 608511 - DNA, 25 bp, Mus musculus
ggcaacgtatctttaaacttccgac

SEQ ID NO: 608512 - DNA, 25 bp, Mus musculus
ggcaacgtcgctaagacctcgagaa

SEQ ID NO: 608513 - DNA, 25 bp, Mus musculus
ggcaacgtcgcttagacctcgagaa

SEQ ID NO: 608514 - DNA, 25 bp, Mus musculus
ggcaacgtttgaaatatactgagac

SEQ ID NO: 608515 - DNA, 25 bp, Mus musculus
ggcaacgtttgatatatactgagac

SEQ ID NO: 608516 - DNA, 25 bp, Mus musculus
ggcaactaaatcacctcacaggtgg

SEQ ID NO: 608517 - DNA, 25 bp, Mus musculus
ggcaactaaatctcctcacaggtgg

SEQ ID NO: 608518 - DNA, 25 bp, Mus musculus
ggcaactaacatcgctctgcagctt

SEQ ID NO: 608519 - DNA, 25 bp, Mus musculus
ggcaactaacatggctctgcagctt

SEQ ID NO: 608520 - DNA, 25 bp, Mus musculus
ggcaactaatcgaaggaacccacgt

SEQ ID NO: 608521 - DNA, 25 bp, Mus musculus
ggcaactaatcgtaggaacccacgt

SEQ ID NO: 608522 - DNA, 25 bp, Mus musculus
ggcaactacagcactttggtaacta

SEQ ID NO: 608523 - DNA, 25 bp, Mus musculus
ggcaactacagctctttggtaacta

SEQ ID NO: 608524 - DNA, 25 bp, Mus musculus
ggcaactacagtcaaatcttctaag

SEQ ID NO: 608525 - DNA, 25 bp, Mus musculus
ggcaactacagtgaaatcttctaag

SEQ ID NO: 608526 - DNA, 25 bp, Mus musculus
ggcaactaggataacagacatccct

SEQ ID NO: 608527 - DNA, 25 bp, Mus musculus
ggcaactaggattacagacatccct

SEQ ID NO: 608528 - DNA, 25 bp, Mus musculus
ggcaactatatacccattacacctt

SEQ ID NO: 608529 - DNA, 25 bp, Mus musculus
ggcaactatatagccattacacctt

SEQ ID NO: 608530 - DNA, 25 bp, Mus musculus
ggcaactatccacacttttaaaaat

SEQ ID NO: 608531 - DNA, 25 bp, Mus musculus
ggcaactatccagacttttaaaaat

SEQ ID NO: 608532 - DNA, 25 bp, Mus musculus
ggcaactatggccttggtcaagtag

SEQ ID NO: 608533 - DNA, 25 bp, Mus musculus
ggcaactatggcgttggtcaagtag

SEQ ID NO: 608534 - DNA, 25 bp, Mus musculus
ggcaactcagatcaccgggtcttgc

SEQ ID NO: 608535 - DNA, 25 bp, Mus musculus
ggcaactcagatgaccgggtcttgc

SEQ ID NO: 608536 - DNA, 25 bp, Mus musculus
ggcaactccgttaatgatgatatat

SEQ ID NO: 608537 - DNA, 25 bp, Mus musculus
ggcaactccgtttatgatgatatat

SEQ ID NO: 608538 - DNA, 25 bp, Mus musculus
ggcaactctccaaagctgagataga

SEQ ID NO: 608539 - DNA, 25 bp, Mus musculus
ggcaactctccatagctgagataga

SEQ ID NO: 608540 - DNA, 25 bp, Mus musculus
ggcaactgatagaagggacccttta

SEQ ID NO: 608541 - DNA, 25 bp, Mus musculus
ggcaactgatagtagggacccttta

SEQ ID NO: 608542 - DNA, 25 bp, Mus musculus
ggcaactgatttagctctctttgga

SEQ ID NO: 608543 - DNA, 25 bp, Mus musculus
ggcaactgattttgctctctttgga

SEQ ID NO: 608544 - DNA, 25 bp, Mus musculus
ggcaactgcgctctaatgtcacctg

SEQ ID NO: 608545 - DNA, 25 bp, Mus musculus
ggcaactgcgctgtaatgtcacctg

SEQ ID NO: 608546 - DNA, 25 bp, Mus musculus
ggcaactggcaaccatcgggtctga

SEQ ID NO: 608547 - DNA, 25 bp, Mus musculus
ggcaactggcaagcatcgggtctga

SEQ ID NO: 608548 - DNA, 25 bp, Mus musculus
ggcaactggttaaatcacattggct

SEQ ID NO: 608549 - DNA, 25 bp, Mus musculus
ggcaactggttatatcacattggct

SEQ ID NO: 608550 - DNA, 25 bp, Mus musculus
ggcaactgtctcctgcatggaaaag

SEQ ID NO: 608551 - DNA, 25 bp, Mus musculus
ggcaactgtctcctgtaactgttgg

SEQ ID NO: 608552 - DNA, 25 bp, Mus musculus
ggcaactgtctcgtgcatggaaaag

SEQ ID NO: 608553 - DNA, 25 bp, Mus musculus
ggcaactgtctcgtgtaactgttgg

SEQ ID NO: 608554 - DNA, 25 bp, Mus musculus
ggcaactgtcttcccacaaaaacaa

SEQ ID NO: 608555 - DNA, 25 bp, Mus musculus
ggcaactgtcttgccacaaaaacaa

SEQ ID NO: 608556 - DNA, 25 bp, Mus musculus
ggcaactgtgccaagcagcaggata

SEQ ID NO: 608557 - DNA, 25 bp, Mus musculus
ggcaactgtgcctagcagcaggata

SEQ ID NO: 608558 - DNA, 25 bp, Mus musculus
ggcaactgttctctcattatcaatt

SEQ ID NO: 608559 - DNA, 25 bp, Mus musculus
ggcaactgttctgtcattatcaatt

SEQ ID NO: 608560 - DNA, 25 bp, Mus musculus
ggcaactgttggcttctgttacaaa

SEQ ID NO: 608561 - DNA, 25 bp, Mus musculus
ggcaactgttgggttctgttacaaa

SEQ ID NO: 608562 - DNA, 25 bp, Mus musculus
ggcaacttaagaaaatcctgcgtaa

SEQ ID NO: 608563 - DNA, 25 bp, Mus musculus
ggcaacttaagataatcctgcgtaa

SEQ ID NO: 608564 - DNA, 25 bp, Mus musculus
ggcaacttagacaacaggaatctgt

SEQ ID NO: 608565 - DNA, 25 bp, Mus musculus
ggcaacttagactacaggaatctgt

SEQ ID NO: 608566 - DNA, 25 bp, Mus musculus
ggcaacttagcaaaatccagtctca

SEQ ID NO: 608567 - DNA, 25 bp, Mus musculus
ggcaacttagcaaatggatccggaa

SEQ ID NO: 608568 - DNA, 25 bp, Mus musculus
ggcaacttagcataatccagtctca

SEQ ID NO: 608569 - DNA, 25 bp, Mus musculus
ggcaacttagcatatggatccggaa

SEQ ID NO: 608570 - DNA, 25 bp, Mus musculus
ggcaacttagctcaccattatctga

SEQ ID NO: 608571 - DNA, 25 bp, Mus musculus
ggcaacttagctgaccattatctga

SEQ ID NO: 608572 - DNA, 25 bp, Mus musculus
ggcaacttcgttctagactttcgca

SEQ ID NO: 608573 - DNA, 25 bp, Mus musculus
ggcaacttcgttgtagactttcgca

SEQ ID NO: 608574 - DNA, 25 bp, Mus musculus
ggcaacttgaagcaaagccccagct

SEQ ID NO: 608575 - DNA, 25 bp, Mus musculus
ggcaacttgaaggaaagccccagct

SEQ ID NO: 608576 - DNA, 25 bp, Mus musculus
ggcaacttgcatcccctctgaaaga

SEQ ID NO: 608577 - DNA, 25 bp, Mus musculus
ggcaacttgcatgccctctgaaaga

SEQ ID NO: 608578 - DNA, 25 bp, Mus musculus
ggcaacttggtgactatgtaatttt

SEQ ID NO: 608579 - DNA, 25 bp, Mus musculus
ggcaacttggtgtctatgtaatttt

SEQ ID NO: 608580 - DNA, 25 bp, Mus musculus
ggcaactttactaaagatttcctgt

SEQ ID NO: 608581 - DNA, 25 bp, Mus musculus
ggcaactttacttaagatttcctgt

SEQ ID NO: 608582 - DNA, 25 bp, Mus musculus
ggcaactttcaaacccttactatag

SEQ ID NO: 608583 - DNA, 25 bp, Mus musculus
ggcaactttcaatcccttactatag

SEQ ID NO: 608584 - DNA, 25 bp, Mus musculus
ggcaactttctgaacatcccacagc

SEQ ID NO: 608585 - DNA, 25 bp, Mus musculus
ggcaactttctgtacatcccacagc

SEQ ID NO: 608586 - DNA, 25 bp, Mus musculus
ggcaactttgctaaggccacctttg

SEQ ID NO: 608587 - DNA, 25 bp, Mus musculus
ggcaactttgcttaggccacctttg

SEQ ID NO: 608588 - DNA, 25 bp, Mus musculus
ggcaagaaaccgctcttttctcgga

SEQ ID NO: 608589 - DNA, 25 bp, Mus musculus
ggcaagaaaccggtcttttctcgga

SEQ ID NO: 608590 - DNA, 25 bp, Mus musculus
ggcaagaaactacttacacaaaata

SEQ ID NO: 608591 - DNA, 25 bp, Mus musculus
ggcaagaaactagttacacaaaata

SEQ ID NO: 608592 - DNA, 25 bp, Mus musculus
ggcaagaacaagcaaaggacaagta

SEQ ID NO: 608593 - DNA, 25 bp, Mus musculus
ggcaagaacaaggaaaggacaagta

SEQ ID NO: 608594 - DNA, 25 bp, Mus musculus
ggcaagaaccccatgaaagccgtgg

SEQ ID NO: 608595 - DNA, 25 bp, Mus musculus
ggcaagaaccccttgaaagccgtgg

SEQ ID NO: 608596 - DNA, 25 bp, Mus musculus
ggcaagaacgagaacagctgctctt

SEQ ID NO: 608597 - DNA, 25 bp, Mus musculus
ggcaagaacgagtacagctgctctt

SEQ ID NO: 608598 - DNA, 25 bp, Mus musculus
ggcaagaacggtagggagccctctt

SEQ ID NO: 608599 - DNA, 25 bp, Mus musculus
ggcaagaacggttgggagccctctt

SEQ ID NO: 608600 - DNA, 25 bp, Mus musculus
ggcaagaagaagatcgccaagcgat

SEQ ID NO: 608601 - DNA, 25 bp, Mus musculus
ggcaagaagaagttcgccaagcgat

SEQ ID NO: 608602 - DNA, 25 bp, Mus musculus
ggcaagaagcttcctgaatagtcta

SEQ ID NO: 608603 - DNA, 25 bp, Mus musculus
ggcaagaagcttgctgaatagtcta

SEQ ID NO: 608604 - DNA, 25 bp, Mus musculus
ggcaagaaggatcgccgatgcgctg

SEQ ID NO: 608605 - DNA, 25 bp, Mus musculus
ggcaagaaggatggccgatgcgctg

SEQ ID NO: 608606 - DNA, 25 bp, Mus musculus
ggcaagaaggcaattcagttcagtt

SEQ ID NO: 608607 - DNA, 25 bp, Mus musculus
ggcaagaaggcatttcagttcagtt

SEQ ID NO: 608608 - DNA, 25 bp, Mus musculus
ggcaagaatagtcctttggcatttt

SEQ ID NO: 608609 - DNA, 25 bp, Mus musculus
ggcaagaatagtgctttggcatttt

SEQ ID NO: 608610 - DNA, 25 bp, Mus musculus
ggcaagaatcctcaagaagtatcca

SEQ ID NO: 608611 - DNA, 25 bp, Mus musculus
ggcaagaatcctgaagaagtatcca

SEQ ID NO: 608612 - DNA, 25 bp, Mus musculus
ggcaagaatcttacaccactaatgt

SEQ ID NO: 608613 - DNA, 25 bp, Mus musculus
ggcaagaatctttcaccactaatgt

SEQ ID NO: 608614 - DNA, 25 bp, Mus musculus
ggcaagaattagattctccctagga

SEQ ID NO: 608615 - DNA, 25 bp, Mus musculus
ggcaagaattagtttctccctagga

SEQ ID NO: 608616 - DNA, 25 bp, Mus musculus
ggcaagaatttgcagagtcacacat

SEQ ID NO: 608617 - DNA, 25 bp, Mus musculus
ggcaagaatttggagagtcacacat

SEQ ID NO: 608618 - DNA, 25 bp, Mus musculus
ggcaagacagccacacacatagaaa

SEQ ID NO: 608619 - DNA, 25 bp, Mus musculus
ggcaagacagcctcacacatagaaa

SEQ ID NO: 608620 - DNA, 25 bp, Mus musculus
ggcaagacataaccagctccctgtg

SEQ ID NO: 608621 - DNA, 25 bp, Mus musculus
ggcaagacataagcagctccctgtg

SEQ ID NO: 608622 - DNA, 25 bp, Mus musculus
ggcaagacatggaactccccggtcc

SEQ ID NO: 608623 - DNA, 25 bp, Mus musculus
ggcaagacatggtactccccggtcc

SEQ ID NO: 608624 - DNA, 25 bp, Mus musculus
ggcaagaccaaaccatgtgatagaa

SEQ ID NO: 608625 - DNA, 25 bp, Mus musculus
ggcaagaccaaagcatgtgatagaa

SEQ ID NO: 608626 - DNA, 25 bp, Mus musculus
ggcaagaccaagcatgctctccctg

SEQ ID NO: 608627 - DNA, 25 bp, Mus musculus
ggcaagaccaaggatgctctccctg

SEQ ID NO: 608628 - DNA, 25 bp, Mus musculus
ggcaagacccagaaggatatccaat

SEQ ID NO: 608629 - DNA, 25 bp, Mus musculus
ggcaagacccagtaggatatccaat

SEQ ID NO: 608630 - DNA, 25 bp, Mus musculus
ggcaagaccctcacagaaaacccaa

SEQ ID NO: 608631 - DNA, 25 bp, Mus musculus
ggcaagaccctctcagaaaacccaa

SEQ ID NO: 608632 - DNA, 25 bp, Mus musculus
ggcaagaccgtcatcgagtaccgat

SEQ ID NO: 608633 - DNA, 25 bp, Mus musculus
ggcaagaccgtcttcgagtaccgat

SEQ ID NO: 608634 - DNA, 25 bp, Mus musculus
ggcaagacggtccacatttctgttt

SEQ ID NO: 608635 - DNA, 25 bp, Mus musculus
ggcaagacggtcgacatttctgttt

SEQ ID NO: 608636 - DNA, 25 bp, Mus musculus
ggcaagactattctcaatgtggaac

SEQ ID NO: 608637 - DNA, 25 bp, Mus musculus
ggcaagactattgtcaatgtggaac

SEQ ID NO: 608638 - DNA, 25 bp, Mus musculus
ggcaagactccaatttgattacagt

SEQ ID NO: 608639 - DNA, 25 bp, Mus musculus
ggcaagactccattttgattacagt

SEQ ID NO: 608640 - DNA, 25 bp, Mus musculus
ggcaagactcttacgacccatgctc

SEQ ID NO: 608641 - DNA, 25 bp, Mus musculus
ggcaagactctttcgacccatgctc

SEQ ID NO: 608642 - DNA, 25 bp, Mus musculus
ggcaagactgccaggacggagacaa

SEQ ID NO: 608643 - DNA, 25 bp, Mus musculus
ggcaagactgcctggacggagacaa

SEQ ID NO: 608644 - DNA, 25 bp, Mus musculus
ggcaagactgttccattttacgtta

SEQ ID NO: 608645 - DNA, 25 bp, Mus musculus
ggcaagactgttgcattttacgtta

SEQ ID NO: 608646 - DNA, 25 bp, Mus musculus
ggcaagagacaacgtcagcctccat

SEQ ID NO: 608647 - DNA, 25 bp, Mus musculus
ggcaagagacaaggtcagcctccat

SEQ ID NO: 608648 - DNA, 25 bp, Mus musculus
ggcaagagactgctgatccccgttg

SEQ ID NO: 608649 - DNA, 25 bp, Mus musculus
ggcaagagactggtgatccccgttg

SEQ ID NO: 608650 - DNA, 25 bp, Mus musculus
ggcaagagccggcataaactccctt

SEQ ID NO: 608651 - DNA, 25 bp, Mus musculus
ggcaagagccgggataaactccctt

SEQ ID NO: 608652 - DNA, 25 bp, Mus musculus
ggcaagagctacagcctcatggcta

SEQ ID NO: 608653 - DNA, 25 bp, Mus musculus
ggcaagagctactgcctcatggcta

SEQ ID NO: 608654 - DNA, 25 bp, Mus musculus
ggcaagagcttccaaccattgtgaa

SEQ ID NO: 608655 - DNA, 25 bp, Mus musculus
ggcaagagcttcgaaccattgtgaa

SEQ ID NO: 608656 - DNA, 25 bp, Mus musculus
ggcaagaggcggacatcacattcca

SEQ ID NO: 608657 - DNA, 25 bp, Mus musculus
ggcaagaggcggtcatcacattcca

SEQ ID NO: 608658 - DNA, 25 bp, Mus musculus
ggcaagagggatagagattatgtca

SEQ ID NO: 608659 - DNA, 25 bp, Mus musculus
ggcaagagggattgagattatgtca

SEQ ID NO: 608660 - DNA, 25 bp, Mus musculus
ggcaagagggttccccatgagttca

SEQ ID NO: 608661 - DNA, 25 bp, Mus musculus
ggcaagagggttgcccatgagttca

SEQ ID NO: 608662 - DNA, 25 bp, Mus musculus
ggcaagatacccagtgttgacctct

SEQ ID NO: 608663 - DNA, 25 bp, Mus musculus
ggcaagataccctgtgttgacctct

SEQ ID NO: 608664 - DNA, 25 bp, Mus musculus
ggcaagatattaatcaacccctctt

SEQ ID NO: 608665 - DNA, 25 bp, Mus musculus
ggcaagatattattcaacccctctt

SEQ ID NO: 608666 - DNA, 25 bp, Mus musculus
ggcaagatctacaactcgcgggtcc

SEQ ID NO: 608667 - DNA, 25 bp, Mus musculus
ggcaagatctactactcgcgggtcc

SEQ ID NO: 608668 - DNA, 25 bp, Mus musculus
ggcaagatgattcggctcctggcaa

SEQ ID NO: 608669 - DNA, 25 bp, Mus musculus
ggcaagatgattgggctcctggcaa

SEQ ID NO: 608670 - DNA, 25 bp, Mus musculus
ggcaagatggccaagtctacttttt

SEQ ID NO: 608671 - DNA, 25 bp, Mus musculus
ggcaagatggcctagtctacttttt

SEQ ID NO: 608672 - DNA, 25 bp, Mus musculus
ggcaagatgtccacacatagctcta

SEQ ID NO: 608673 - DNA, 25 bp, Mus musculus
ggcaagatgtcctcacatagctcta

SEQ ID NO: 608674 - DNA, 25 bp, Mus musculus
ggcaagattgtcactagatgaaaat

SEQ ID NO: 608675 - DNA, 25 bp, Mus musculus
ggcaagattgtctctagatgaaaat

SEQ ID NO: 608676 - DNA, 25 bp, Mus musculus
ggcaagcaagagaaatttttgtgta

SEQ ID NO: 608677 - DNA, 25 bp, Mus musculus
ggcaagcaagagtaatttttgtgta

SEQ ID NO: 608678 - DNA, 25 bp, Mus musculus
ggcaagcaagctcacaccagccaag

SEQ ID NO: 608679 - DNA, 25 bp, Mus musculus
ggcaagcaagctgacaccagccaag

SEQ ID NO: 608680 - DNA, 25 bp, Mus musculus
ggcaagcaaggcctcttgacatttt

SEQ ID NO: 608681 - DNA, 25 bp, Mus musculus
ggcaagcaaggcgtcttgacatttt

SEQ ID NO: 608682 - DNA, 25 bp, Mus musculus
ggcaagcaattcaccctgtaaaagt

SEQ ID NO: 608683 - DNA, 25 bp, Mus musculus
ggcaagcaattctccctgtaaaagt

SEQ ID NO: 608684 - DNA, 25 bp, Mus musculus
ggcaagcacagcatcacaagtccct

SEQ ID NO: 608685 - DNA, 25 bp, Mus musculus
ggcaagcacagccaattgctctgta

SEQ ID NO: 608686 - DNA, 25 bp, Mus musculus
ggcaagcacagcctttatcaccagt

SEQ ID NO: 608687 - DNA, 25 bp, Mus musculus
ggcaagcacagcgaattgctctgta

SEQ ID NO: 608688 - DNA, 25 bp, Mus musculus
ggcaagcacagcgtttatcaccagt

SEQ ID NO: 608689 - DNA, 25 bp, Mus musculus
ggcaagcacagcttcacaagtccct

SEQ ID NO: 608690 - DNA, 25 bp, Mus musculus
ggcaagcactacatcatcgaggtca

SEQ ID NO: 608691 - DNA, 25 bp, Mus musculus
ggcaagcactacttcatcgaggtca

SEQ ID NO: 608692 - DNA, 25 bp, Mus musculus
ggcaagcagccaaaggaaccagcag

SEQ ID NO: 608693 - DNA, 25 bp, Mus musculus
ggcaagcagccataggaaccagcag

SEQ ID NO: 608694 - DNA, 25 bp, Mus musculus
ggcaagcaggatcccaaacgtcatt

SEQ ID NO: 608695 - DNA, 25 bp, Mus musculus
ggcaagcaggatcggactgctcact

SEQ ID NO: 608696 - DNA, 25 bp, Mus musculus
ggcaagcaggatgccaaacgtcatt

SEQ ID NO: 608697 - DNA, 25 bp, Mus musculus
ggcaagcaggatgggactgctcact

SEQ ID NO: 608698 - DNA, 25 bp, Mus musculus
ggcaagcaggctaactaggcataca

SEQ ID NO: 608699 - DNA, 25 bp, Mus musculus
ggcaagcaggcttactaggcataca

SEQ ID NO: 608700 - DNA, 25 bp, Mus musculus
ggcaagcagggcaactgtttcagaa

SEQ ID NO: 608701 - DNA, 25 bp, Mus musculus
ggcaagcagggctactgtttcagaa

SEQ ID NO: 608702 - DNA, 25 bp, Mus musculus
ggcaagcagtgtatcagtccacaga

SEQ ID NO: 608703 - DNA, 25 bp, Mus musculus
ggcaagcagtgtttcagtccacaga

SEQ ID NO: 608704 - DNA, 25 bp, Mus musculus
ggcaagcagttcatcaccaaggcag

SEQ ID NO: 608705 - DNA, 25 bp, Mus musculus
ggcaagcagttcttcaccaaggcag

SEQ ID NO: 608706 - DNA, 25 bp, Mus musculus
ggcaagcagttgctattgttaactt

SEQ ID NO: 608707 - DNA, 25 bp, Mus musculus
ggcaagcagttggtattgttaactt

SEQ ID NO: 608708 - DNA, 25 bp, Mus musculus
ggcaagcatcatatcctacgggcaa

SEQ ID NO: 608709 - DNA, 25 bp, Mus musculus
ggcaagcatcatctgcatgttgtgt

SEQ ID NO: 608710 - DNA, 25 bp, Mus musculus
ggcaagcatcatgtgcatgttgtgt

SEQ ID NO: 608711 - DNA, 25 bp, Mus musculus
ggcaagcatcatttcctacgggcaa

SEQ ID NO: 608712 - DNA, 25 bp, Mus musculus
ggcaagcatctaaatggtccctgtg

SEQ ID NO: 608713 - DNA, 25 bp, Mus musculus
ggcaagcatctatatggtccctgtg

SEQ ID NO: 608714 - DNA, 25 bp, Mus musculus
ggcaagcatgcgcaccagagttcaa

SEQ ID NO: 608715 - DNA, 25 bp, Mus musculus
ggcaagcatgcggaccagagttcaa

SEQ ID NO: 608716 - DNA, 25 bp, Mus musculus
ggcaagcatttacaactggtagttt

SEQ ID NO: 608717 - DNA, 25 bp, Mus musculus
ggcaagcatttagaactggtagttt

SEQ ID NO: 608718 - DNA, 25 bp, Mus musculus
ggcaagccaactccgggcagccatt

SEQ ID NO: 608719 - DNA, 25 bp, Mus musculus
ggcaagccaactgcgggcagccatt

SEQ ID NO: 608720 - DNA, 25 bp, Mus musculus
ggcaagccagagcacacttttgttt

SEQ ID NO: 608721 - DNA, 25 bp, Mus musculus
ggcaagccagaggacacttttgttt

SEQ ID NO: 608722 - DNA, 25 bp, Mus musculus
ggcaagccagcacagtacaagtcga

SEQ ID NO: 608723 - DNA, 25 bp, Mus musculus
ggcaagccagcagagtacaagtcga

SEQ ID NO: 608724 - DNA, 25 bp, Mus musculus
ggcaagcccaagactttgtaatttt

SEQ ID NO: 608725 - DNA, 25 bp, Mus musculus
ggcaagcccaagtctttgtaatttt

SEQ ID NO: 608726 - DNA, 25 bp, Mus musculus
ggcaagccgcaaacacaagtctaag

SEQ ID NO: 608727 - DNA, 25 bp, Mus musculus
ggcaagccgcaatcacaagtctaag

SEQ ID NO: 608728 - DNA, 25 bp, Mus musculus
ggcaagccgtgtctgtatctaaagt

SEQ ID NO: 608729 - DNA, 25 bp, Mus musculus
ggcaagccgtgtgtgtatctaaagt

SEQ ID NO: 608730 - DNA, 25 bp, Mus musculus
ggcaagccgttgctaggtaactaat

SEQ ID NO: 608731 - DNA, 25 bp, Mus musculus
ggcaagccgttggtaggtaactaat

SEQ ID NO: 608732 - DNA, 25 bp, Mus musculus
ggcaagcctatacaaactctctgtc

SEQ ID NO: 608733 - DNA, 25 bp, Mus musculus
ggcaagcctatagaaactctctgtc

SEQ ID NO: 608734 - DNA, 25 bp, Mus musculus
ggcaagcctgctattgtacacaaaa

SEQ ID NO: 608735 - DNA, 25 bp, Mus musculus
ggcaagcctgcttttgtacacaaaa

SEQ ID NO: 608736 - DNA, 25 bp, Mus musculus
ggcaagcctgggacgtctggtctaa

SEQ ID NO: 608737 - DNA, 25 bp, Mus musculus
ggcaagcctgggtcgtctggtctaa

SEQ ID NO: 608738 - DNA, 25 bp, Mus musculus
ggcaagcctgtgaggtcttttactt

SEQ ID NO: 608739 - DNA, 25 bp, Mus musculus
ggcaagcctgtgtggtcttttactt

SEQ ID NO: 608740 - DNA, 25 bp, Mus musculus
ggcaagccttcaatacacacacaca

SEQ ID NO: 608741 - DNA, 25 bp, Mus musculus
ggcaagccttcattacacacacaca

SEQ ID NO: 608742 - DNA, 25 bp, Mus musculus
ggcaagcctttgacatttttcactt

SEQ ID NO: 608743 - DNA, 25 bp, Mus musculus
ggcaagcctttgtcatttttcactt

SEQ ID NO: 608744 - DNA, 25 bp, Mus musculus
ggcaagcgctttagggctgagccac

SEQ ID NO: 608745 - DNA, 25 bp, Mus musculus
ggcaagcgcttttgggctgagccac

SEQ ID NO: 608746 - DNA, 25 bp, Mus musculus
ggcaagctacagagcaaagcaatat

SEQ ID NO: 608747 - DNA, 25 bp, Mus musculus
ggcaagctacagtgcaaagcaatat

SEQ ID NO: 608748 - DNA, 25 bp, Mus musculus
ggcaagctacttccaagcaatttta

SEQ ID NO: 608749 - DNA, 25 bp, Mus musculus
ggcaagctacttgcaagcaatttta

SEQ ID NO: 608750 - DNA, 25 bp, Mus musculus
ggcaagctagctaaagtaacgccat

SEQ ID NO: 608751 - DNA, 25 bp, Mus musculus
ggcaagctagcttaagtaacgccat

SEQ ID NO: 608752 - DNA, 25 bp, Mus musculus
ggcaagctaggcctcatggatctgc

SEQ ID NO: 608753 - DNA, 25 bp, Mus musculus
ggcaagctaggcgtcatggatctgc

SEQ ID NO: 608754 - DNA, 25 bp, Mus musculus
ggcaagctccagaaagataaatggc

SEQ ID NO: 608755 - DNA, 25 bp, Mus musculus
ggcaagctccagtaagataaatggc

SEQ ID NO: 608756 - DNA, 25 bp, Mus musculus
ggcaagctcgggagcagacacagct

SEQ ID NO: 608757 - DNA, 25 bp, Mus musculus
ggcaagctcgggtgcagacacagct

SEQ ID NO: 608758 - DNA, 25 bp, Mus musculus
ggcaagctctaaatcactgcactgt

SEQ ID NO: 608759 - DNA, 25 bp, Mus musculus
ggcaagctctaattcactgcactgt

SEQ ID NO: 608760 - DNA, 25 bp, Mus musculus
ggcaagctctataccctgggcaaag

SEQ ID NO: 608761 - DNA, 25 bp, Mus musculus
ggcaagctctattccctgggcaaag

SEQ ID NO: 608762 - DNA, 25 bp, Mus musculus
ggcaagctgccgacagtggcgtaaa

SEQ ID NO: 608763 - DNA, 25 bp, Mus musculus
ggcaagctgccgtcagtggcgtaaa

SEQ ID NO: 608764 - DNA, 25 bp, Mus musculus
ggcaagctgcttcattgacatctgt

SEQ ID NO: 608765 - DNA, 25 bp, Mus musculus
ggcaagctgcttgattgacatctgt

SEQ ID NO: 608766 - DNA, 25 bp, Mus musculus
ggcaagctggaaaagattctcttct

SEQ ID NO: 608767 - DNA, 25 bp, Mus musculus
ggcaagctggaatagattctcttct

SEQ ID NO: 608768 - DNA, 25 bp, Mus musculus
ggcaagctggccagacaatctgact

SEQ ID NO: 608769 - DNA, 25 bp, Mus musculus
ggcaagctggcctgacaatctgact

SEQ ID NO: 608770 - DNA, 25 bp, Mus musculus
ggcaagctggtactgtagttagaac

SEQ ID NO: 608771 - DNA, 25 bp, Mus musculus
ggcaagctggtagtgtagttagaac

SEQ ID NO: 608772 - DNA, 25 bp, Mus musculus
ggcaagctgtgtcataccatgggct

SEQ ID NO: 608773 - DNA, 25 bp, Mus musculus
ggcaagctgtgtgataccatgggct

SEQ ID NO: 608774 - DNA, 25 bp, Mus musculus
ggcaagcttccccacacagtgagct

SEQ ID NO: 608775 - DNA, 25 bp, Mus musculus
ggcaagcttcccgacacagtgagct

SEQ ID NO: 608776 - DNA, 25 bp, Mus musculus
ggcaagctttttcgcgtgagacttt

SEQ ID NO: 608777 - DNA, 25 bp, Mus musculus
ggcaagctttttggcgtgagacttt

SEQ ID NO: 608778 - DNA, 25 bp, Mus musculus
ggcaaggaactgatactctttctcc

SEQ ID NO: 608779 - DNA, 25 bp, Mus musculus
ggcaaggaactgttactctttctcc

SEQ ID NO: 608780 - DNA, 25 bp, Mus musculus
ggcaaggaaggcaatgtccaaactg

SEQ ID NO: 608781 - DNA, 25 bp, Mus musculus
ggcaaggaaggcattccctaagaat

SEQ ID NO: 608782 - DNA, 25 bp, Mus musculus
ggcaaggaaggctatgtccaaactg

SEQ ID NO: 608783 - DNA, 25 bp, Mus musculus
ggcaaggaaggctttccctaagaat

SEQ ID NO: 608784 - DNA, 25 bp, Mus musculus
ggcaaggacacacgcattccatcag

SEQ ID NO: 608785 - DNA, 25 bp, Mus musculus
ggcaaggacacaggcattccatcag

SEQ ID NO: 608786 - DNA, 25 bp, Mus musculus
ggcaaggacacccaatcaacctaat

SEQ ID NO: 608787 - DNA, 25 bp, Mus musculus
ggcaaggacaccgaatcaacctaat

SEQ ID NO: 608788 - DNA, 25 bp, Mus musculus
ggcaaggacagcatctgtcttgtct

SEQ ID NO: 608789 - DNA, 25 bp, Mus musculus
ggcaaggacagcttctgtcttgtct

SEQ ID NO: 608790 - DNA, 25 bp, Mus musculus
ggcaaggactttcttccatcaaatt

SEQ ID NO: 608791 - DNA, 25 bp, Mus musculus
ggcaaggactttgttccatcaaatt

SEQ ID NO: 608792 - DNA, 25 bp, Mus musculus
ggcaaggatgccagctttggtgact

SEQ ID NO: 608793 - DNA, 25 bp, Mus musculus
ggcaaggatgcctgctttggtgact

SEQ ID NO: 608794 - DNA, 25 bp, Mus musculus
ggcaaggattccctgtatgcccaag

SEQ ID NO: 608795 - DNA, 25 bp, Mus musculus
ggcaaggattccgtgtatgcccaag

SEQ ID NO: 608796 - DNA, 25 bp, Mus musculus
ggcaaggatttacgccaggcccctg

SEQ ID NO: 608797 - DNA, 25 bp, Mus musculus
ggcaaggatttaggccaggcccctg

SEQ ID NO: 608798 - DNA, 25 bp, Mus musculus
ggcaaggcagaaccatcataagagc

SEQ ID NO: 608799 - DNA, 25 bp, Mus musculus
ggcaaggcagaagcatcataagagc

SEQ ID NO: 608800 - DNA, 25 bp, Mus musculus
ggcaaggcagtgacctcctactgac

SEQ ID NO: 608801 - DNA, 25 bp, Mus musculus
ggcaaggcagtgtcctcctactgac

SEQ ID NO: 608802 - DNA, 25 bp, Mus musculus
ggcaaggcattaaacccatcaggca

SEQ ID NO: 608803 - DNA, 25 bp, Mus musculus
ggcaaggcattatacccatcaggca

SEQ ID NO: 608804 - DNA, 25 bp, Mus musculus
ggcaaggccaggaacgaggatcccc

SEQ ID NO: 608805 - DNA, 25 bp, Mus musculus
ggcaaggccaggtacgaggatcccc

SEQ ID NO: 608806 - DNA, 25 bp, Mus musculus
ggcaaggcctggagatccccacgag

SEQ ID NO: 608807 - DNA, 25 bp, Mus musculus
ggcaaggcctggtgatccccacgag

SEQ ID NO: 608808 - DNA, 25 bp, Mus musculus
ggcaaggccttcaaactgtccatct

SEQ ID NO: 608809 - DNA, 25 bp, Mus musculus
ggcaaggccttcagcgtcaaacaca

SEQ ID NO: 608810 - DNA, 25 bp, Mus musculus
ggcaaggccttctaactgtccatct

SEQ ID NO: 608811 - DNA, 25 bp, Mus musculus
ggcaaggccttctgcgtcaaacaca

SEQ ID NO: 608812 - DNA, 25 bp, Mus musculus
ggcaaggcgaaccagcatgaactca

SEQ ID NO: 608813 - DNA, 25 bp, Mus musculus
ggcaaggcgaacgagcatgaactca

SEQ ID NO: 608814 - DNA, 25 bp, Mus musculus
ggcaaggcgatcacctgtcaggctc

SEQ ID NO: 608815 - DNA, 25 bp, Mus musculus
ggcaaggcgatctcctgtcaggctc

SEQ ID NO: 608816 - DNA, 25 bp, Mus musculus
ggcaaggctattcaacagtcatgat

SEQ ID NO: 608817 - DNA, 25 bp, Mus musculus
ggcaaggctattgaacagtcatgat

SEQ ID NO: 608818 - DNA, 25 bp, Mus musculus
ggcaaggctgtaacgatctacccat

SEQ ID NO: 608819 - DNA, 25 bp, Mus musculus
ggcaaggctgtatcgatctacccat

SEQ ID NO: 608820 - DNA, 25 bp, Mus musculus
ggcaaggctgttaggctcagttcaa

SEQ ID NO: 608821 - DNA, 25 bp, Mus musculus
ggcaaggctgtttggctcagttcaa

SEQ ID NO: 608822 - DNA, 25 bp, Mus musculus
ggcaaggcttaactctaccgaactt

SEQ ID NO: 608823 - DNA, 25 bp, Mus musculus
ggcaaggcttaagtctaccgaactt

SEQ ID NO: 608824 - DNA, 25 bp, Mus musculus
ggcaaggctttacttttcacaggat

SEQ ID NO: 608825 - DNA, 25 bp, Mus musculus
ggcaaggctttagttttcacaggat

SEQ ID NO: 608826 - DNA, 25 bp, Mus musculus
ggcaaggcttttactctatgattat

SEQ ID NO: 608827 - DNA, 25 bp, Mus musculus
ggcaaggctttttctctatgattat

SEQ ID NO: 608828 - DNA, 25 bp, Mus musculus
ggcaagggacccatctgctactctg

SEQ ID NO: 608829 - DNA, 25 bp, Mus musculus
ggcaagggacccttctgctactctg

SEQ ID NO: 608830 - DNA, 25 bp, Mus musculus
ggcaagggcagaactggaatgcatt

SEQ ID NO: 608831 - DNA, 25 bp, Mus musculus
ggcaagggcagatctggaatgcatt

SEQ ID NO: 608832 - DNA, 25 bp, Mus musculus
ggcaagggccacaaagggcagccca

SEQ ID NO: 608833 - DNA, 25 bp, Mus musculus
ggcaagggccactaagggcagccca

SEQ ID NO: 608834 - DNA, 25 bp, Mus musculus
ggcaagggccagatctgtcaaccaa

SEQ ID NO: 608835 - DNA, 25 bp, Mus musculus
ggcaagggccagttctgtcaaccaa

SEQ ID NO: 608836 - DNA, 25 bp, Mus musculus
ggcaagggcttaatgttcctgacaa

SEQ ID NO: 608837 - DNA, 25 bp, Mus musculus
ggcaagggcttattgttcctgacaa

SEQ ID NO: 608838 - DNA, 25 bp, Mus musculus
ggcaagggtgaacatgagctgtctc

SEQ ID NO: 608839 - DNA, 25 bp, Mus musculus
ggcaagggtgaagatgagctgtctc

SEQ ID NO: 608840 - DNA, 25 bp, Mus musculus
ggcaagggttcaaatccaaaatata

SEQ ID NO: 608841 - DNA, 25 bp, Mus musculus
ggcaagggttcatatccaaaatata

SEQ ID NO: 608842 - DNA, 25 bp, Mus musculus
ggcaagggtttgcacaacccctgcg

SEQ ID NO: 608843 - DNA, 25 bp, Mus musculus
ggcaagggtttggacaacccctgcg

SEQ ID NO: 608844 - DNA, 25 bp, Mus musculus
ggcaaggtaacccttcaggatgttc

SEQ ID NO: 608845 - DNA, 25 bp, Mus musculus
ggcaaggtaaccgttcaggatgttc

SEQ ID NO: 608846 - DNA, 25 bp, Mus musculus
ggcaaggtataaactgcagcacttt

SEQ ID NO: 608847 - DNA, 25 bp, Mus musculus
ggcaaggtataatctgcagcacttt

SEQ ID NO: 608848 - DNA, 25 bp, Mus musculus
ggcaaggtcaaccatgatggagctt

SEQ ID NO: 608849 - DNA, 25 bp, Mus musculus
ggcaaggtcaacgatgatggagctt

SEQ ID NO: 608850 - DNA, 25 bp, Mus musculus
ggcaaggtcaccagcatttatttat

SEQ ID NO: 608851 - DNA, 25 bp, Mus musculus
ggcaaggtcacctgcatttatttat

SEQ ID NO: 608852 - DNA, 25 bp, Mus musculus
ggcaaggtcatcccagagctgaacg

SEQ ID NO: 608853 - DNA, 25 bp, Mus musculus
ggcaaggtcatcgcagagctgaacg

SEQ ID NO: 608854 - DNA, 25 bp, Mus musculus
ggcaaggtcctcaggactcgggatt

SEQ ID NO: 608855 - DNA, 25 bp, Mus musculus
ggcaaggtcctctggactcgggatt

SEQ ID NO: 608856 - DNA, 25 bp, Mus musculus
ggcaaggtctgtacaaataatcact

SEQ ID NO: 608857 - DNA, 25 bp, Mus musculus
ggcaaggtctgttcaaataatcact

SEQ ID NO: 608858 - DNA, 25 bp, Mus musculus
ggcaaggtcttgagtatggcccctg

SEQ ID NO: 608859 - DNA, 25 bp, Mus musculus
ggcaaggtcttgcttttaccagagt

SEQ ID NO: 608860 - DNA, 25 bp, Mus musculus
ggcaaggtcttggttttaccagagt

SEQ ID NO: 608861 - DNA, 25 bp, Mus musculus
ggcaaggtcttgtgtatggcccctg

SEQ ID NO: 608862 - DNA, 25 bp, Mus musculus
ggcaaggtgaatctcccaaggcttc

SEQ ID NO: 608863 - DNA, 25 bp, Mus musculus
ggcaaggtgaatgtcccaaggcttc

SEQ ID NO: 608864 - DNA, 25 bp, Mus musculus
ggcaaggtggccacatagcctggtt

SEQ ID NO: 608865 - DNA, 25 bp, Mus musculus
ggcaaggtggcctcatagcctggtt

SEQ ID NO: 608866 - DNA, 25 bp, Mus musculus
ggcaaggttgtcacggagtcactgt

SEQ ID NO: 608867 - DNA, 25 bp, Mus musculus
ggcaaggttgtctcggagtcactgt

SEQ ID NO: 608868 - DNA, 25 bp, Mus musculus
ggcaaggtttatctggatcactttc

SEQ ID NO: 608869 - DNA, 25 bp, Mus musculus
ggcaaggtttatgtggatcactttc

SEQ ID NO: 608870 - DNA, 25 bp, Mus musculus
ggcaagtaaaaaacctagtgcttct

SEQ ID NO: 608871 - DNA, 25 bp, Mus musculus
ggcaagtaaaaatcctagtgcttct

SEQ ID NO: 608872 - DNA, 25 bp, Mus musculus
ggcaagtaaaggaaactgtgacatc

SEQ ID NO: 608873 - DNA, 25 bp, Mus musculus
ggcaagtaaaggtaactgtgacatc

SEQ ID NO: 608874 - DNA, 25 bp, Mus musculus
ggcaagtaactcatcctggtgagct

SEQ ID NO: 608875 - DNA, 25 bp, Mus musculus
ggcaagtaactcttcctggtgagct

SEQ ID NO: 608876 - DNA, 25 bp, Mus musculus
ggcaagtaacttaaaacagtggcta

SEQ ID NO: 608877 - DNA, 25 bp, Mus musculus
ggcaagtaactttaaacagtggcta

SEQ ID NO: 608878 - DNA, 25 bp, Mus musculus
ggcaagtaagaaagtcccatatgtt

SEQ ID NO: 608879 - DNA, 25 bp, Mus musculus
ggcaagtaagaatgtcccatatgtt

SEQ ID NO: 608880 - DNA, 25 bp, Mus musculus
ggcaagtaagtgctcacttctccag

SEQ ID NO: 608881 - DNA, 25 bp, Mus musculus
ggcaagtaagtggtcacttctccag

SEQ ID NO: 608882 - DNA, 25 bp, Mus musculus
ggcaagtaccaaatgcagagccagg

SEQ ID NO: 608883 - DNA, 25 bp, Mus musculus
ggcaagtaccaattgcagagccagg

SEQ ID NO: 608884 - DNA, 25 bp, Mus musculus
ggcaagtagcagctgggccttccaa

SEQ ID NO: 608885 - DNA, 25 bp, Mus musculus
ggcaagtagcaggtgggccttccaa

SEQ ID NO: 608886 - DNA, 25 bp, Mus musculus
ggcaagtagggcctgactccagaat

SEQ ID NO: 608887 - DNA, 25 bp, Mus musculus
ggcaagtagggcgtgactccagaat

SEQ ID NO: 608888 - DNA, 25 bp, Mus musculus
ggcaagtcacagatcgatgggctta

SEQ ID NO: 608889 - DNA, 25 bp, Mus musculus
ggcaagtcacagttcgatgggctta

SEQ ID NO: 608890 - DNA, 25 bp, Mus musculus
ggcaagtcattgaacatttctcagt

SEQ ID NO: 608891 - DNA, 25 bp, Mus musculus
ggcaagtcattgtacatttctcagt

SEQ ID NO: 608892 - DNA, 25 bp, Mus musculus
ggcaagtccaatctctgttgtcagg

SEQ ID NO: 608893 - DNA, 25 bp, Mus musculus
ggcaagtccaatgtctgttgtcagg

SEQ ID NO: 608894 - DNA, 25 bp, Mus musculus
ggcaagtccgtgacggtggcaactt

SEQ ID NO: 608895 - DNA, 25 bp, Mus musculus
ggcaagtccgtgtcggtggcaactt

SEQ ID NO: 608896 - DNA, 25 bp, Mus musculus
ggcaagtcctggaatcaggtccaaa

SEQ ID NO: 608897 - DNA, 25 bp, Mus musculus
ggcaagtcctggtatcaggtccaaa

SEQ ID NO: 608898 - DNA, 25 bp, Mus musculus
ggcaagtcgagcacctgggtttaat

SEQ ID NO: 608899 - DNA, 25 bp, Mus musculus
ggcaagtcgagctcctgggtttaat

SEQ ID NO: 608900 - DNA, 25 bp, Mus musculus
ggcaagtctagcacctctgtaggtt

SEQ ID NO: 608901 - DNA, 25 bp, Mus musculus
ggcaagtctagctcctctgtaggtt

SEQ ID NO: 608902 - DNA, 25 bp, Mus musculus
ggcaagtctgtaacaggctatccta

SEQ ID NO: 608903 - DNA, 25 bp, Mus musculus
ggcaagtctgtatcaggctatccta

SEQ ID NO: 608904 - DNA, 25 bp, Mus musculus
ggcaagtctgtcagtgaatgtcagt

SEQ ID NO: 608905 - DNA, 25 bp, Mus musculus
ggcaagtctgtctgtgaatgtcagt

SEQ ID NO: 608906 - DNA, 25 bp, Mus musculus
ggcaagtcttagagcagaacccaca

SEQ ID NO: 608907 - DNA, 25 bp, Mus musculus
ggcaagtcttagtgcagaacccaca

SEQ ID NO: 608908 - DNA, 25 bp, Mus musculus
ggcaagtgacacagtggacctcggt

SEQ ID NO: 608909 - DNA, 25 bp, Mus musculus
ggcaagtgacactgtggacctcggt

SEQ ID NO: 608910 - DNA, 25 bp, Mus musculus
ggcaagtgatagactctcagtactc

SEQ ID NO: 608911 - DNA, 25 bp, Mus musculus
ggcaagtgatagtctctcagtactc

SEQ ID NO: 608912 - DNA, 25 bp, Mus musculus
ggcaagtgccctcattatccctaga

SEQ ID NO: 608913 - DNA, 25 bp, Mus musculus
ggcaagtgccctgattatccctaga

SEQ ID NO: 608914 - DNA, 25 bp, Mus musculus
ggcaagtgctgaatattctccagat

SEQ ID NO: 608915 - DNA, 25 bp, Mus musculus
ggcaagtgctgattattctccagat

SEQ ID NO: 608916 - DNA, 25 bp, Mus musculus
ggcaagtgcttgcaagggctcctct

SEQ ID NO: 608917 - DNA, 25 bp, Mus musculus
ggcaagtgcttggaagggctcctct

SEQ ID NO: 608918 - DNA, 25 bp, Mus musculus
ggcaagtgtagccagaggctcaaca

SEQ ID NO: 608919 - DNA, 25 bp, Mus musculus
ggcaagtgtagcgagaggctcaaca

SEQ ID NO: 608920 - DNA, 25 bp, Mus musculus
ggcaagtgtgcgatctatttttaat

SEQ ID NO: 608921 - DNA, 25 bp, Mus musculus
ggcaagtgtgcgttctatttttaat

SEQ ID NO: 608922 - DNA, 25 bp, Mus musculus
ggcaagtgtgtactttagggtaata

SEQ ID NO: 608923 - DNA, 25 bp, Mus musculus
ggcaagtgtgtagtttagggtaata

SEQ ID NO: 608924 - DNA, 25 bp, Mus musculus
ggcaagtgtgttccaagtaatcaaa

SEQ ID NO: 608925 - DNA, 25 bp, Mus musculus
ggcaagtgtgttgcaagtaatcaaa

SEQ ID NO: 608926 - DNA, 25 bp, Mus musculus
ggcaagttacggagcctcaacaact

SEQ ID NO: 608927 - DNA, 25 bp, Mus musculus
ggcaagttacggtgcctcaacaact

SEQ ID NO: 608928 - DNA, 25 bp, Mus musculus
ggcaagttcaaacccaacagtgtca

SEQ ID NO: 608929 - DNA, 25 bp, Mus musculus
ggcaagttcaaagccaacagtgtca

SEQ ID NO: 608930 - DNA, 25 bp, Mus musculus
ggcaagttcaagatccacatccctg

SEQ ID NO: 608931 - DNA, 25 bp, Mus musculus
ggcaagttcaagttccacatccctg

SEQ ID NO: 608932 - DNA, 25 bp, Mus musculus
ggcaagttcaccaatgcaagtgcta

SEQ ID NO: 608933 - DNA, 25 bp, Mus musculus
ggcaagttcacctatgcaagtgcta

SEQ ID NO: 608934 - DNA, 25 bp, Mus musculus
ggcaagttcataccacactccaagc

SEQ ID NO: 608935 - DNA, 25 bp, Mus musculus
ggcaagttcatagcacactccaagc

SEQ ID NO: 608936 - DNA, 25 bp, Mus musculus
ggcaagttcgatcgccccaaagatt

SEQ ID NO: 608937 - DNA, 25 bp, Mus musculus
ggcaagttcgatggccccaaagatt

SEQ ID NO: 608938 - DNA, 25 bp, Mus musculus
ggcaagttcttgcaagttacaattt

SEQ ID NO: 608939 - DNA, 25 bp, Mus musculus
ggcaagttcttggaagttacaattt

SEQ ID NO: 608940 - DNA, 25 bp, Mus musculus
ggcaagttgcgaccgctctgctgtt

SEQ ID NO: 608941 - DNA, 25 bp, Mus musculus
ggcaagttgcgagcgctctgctgtt

SEQ ID NO: 608942 - DNA, 25 bp, Mus musculus
ggcaagttgcttaactataaccaca

SEQ ID NO: 608943 - DNA, 25 bp, Mus musculus
ggcaagttgctttactataaccaca

SEQ ID NO: 608944 - DNA, 25 bp, Mus musculus
ggcaagtttagtctttccattccca

SEQ ID NO: 608945 - DNA, 25 bp, Mus musculus
ggcaagtttagtgtttccattccca

SEQ ID NO: 608946 - DNA, 25 bp, Mus musculus
ggcaagtttatccagaaaaagtgtc

SEQ ID NO: 608947 - DNA, 25 bp, Mus musculus
ggcaagtttatcgagaaaaagtgtc

SEQ ID NO: 608948 - DNA, 25 bp, Mus musculus
ggcaagtttcacagtgtgtgtaaaa

SEQ ID NO: 608949 - DNA, 25 bp, Mus musculus
ggcaagtttcactgtgtgtgtaaaa

SEQ ID NO: 608950 - DNA, 25 bp, Mus musculus
ggcaagtttgccactccatttttgt

SEQ ID NO: 608951 - DNA, 25 bp, Mus musculus
ggcaagtttgcctctccatttttgt

SEQ ID NO: 608952 - DNA, 25 bp, Mus musculus
ggcaagtttgctactccatagacag

SEQ ID NO: 608953 - DNA, 25 bp, Mus musculus
ggcaagtttgcttctccatagacag

SEQ ID NO: 608954 - DNA, 25 bp, Mus musculus
ggcaagtttgttaacctgctaagcc

SEQ ID NO: 608955 - DNA, 25 bp, Mus musculus
ggcaagtttgtttacctgctaagcc

SEQ ID NO: 608956 - DNA, 25 bp, Mus musculus
ggcaataaccagactctgtaccact

SEQ ID NO: 608957 - DNA, 25 bp, Mus musculus
ggcaataaccagtctctgtaccact

SEQ ID NO: 608958 - DNA, 25 bp, Mus musculus
ggcaataagcatccctaaggtttgt

SEQ ID NO: 608959 - DNA, 25 bp, Mus musculus
ggcaataagcatgcctaaggtttgt

SEQ ID NO: 608960 - DNA, 25 bp, Mus musculus
ggcaataatcaaacctttagcaaat

SEQ ID NO: 608961 - DNA, 25 bp, Mus musculus
ggcaataatcaatcctttagcaaat

SEQ ID NO: 608962 - DNA, 25 bp, Mus musculus
ggcaataatcgactctttagctttt

SEQ ID NO: 608963 - DNA, 25 bp, Mus musculus
ggcaataatcgagtctttagctttt

SEQ ID NO: 608964 - DNA, 25 bp, Mus musculus
ggcaataattacactggtgcttttt

SEQ ID NO: 608965 - DNA, 25 bp, Mus musculus
ggcaataattactctggtgcttttt

SEQ ID NO: 608966 - DNA, 25 bp, Mus musculus
ggcaatacattccaaaactcgtact

SEQ ID NO: 608967 - DNA, 25 bp, Mus musculus
ggcaatacattcgaaaactcgtact

SEQ ID NO: 608968 - DNA, 25 bp, Mus musculus
ggcaataccattcttaacgcttcca

SEQ ID NO: 608969 - DNA, 25 bp, Mus musculus
ggcaataccattgttaacgcttcca

SEQ ID NO: 608970 - DNA, 25 bp, Mus musculus
ggcaatacccgacatcagcagtgat

SEQ ID NO: 608971 - DNA, 25 bp, Mus musculus
ggcaatacccgagatcagcagtgat

SEQ ID NO: 608972 - DNA, 25 bp, Mus musculus
ggcaatactcctcttaagccattag

SEQ ID NO: 608973 - DNA, 25 bp, Mus musculus
ggcaatactcctgttaagccattag

SEQ ID NO: 608974 - DNA, 25 bp, Mus musculus
ggcaatagaacgattccggatactt

SEQ ID NO: 608975 - DNA, 25 bp, Mus musculus
ggcaatagaacgtttccggatactt

SEQ ID NO: 608976 - DNA, 25 bp, Mus musculus
ggcaatagagctacagattgagcaa

SEQ ID NO: 608977 - DNA, 25 bp, Mus musculus
ggcaatagagcttcagattgagcaa

SEQ ID NO: 608978 - DNA, 25 bp, Mus musculus
ggcaatagaggcaggtcacgcatca

SEQ ID NO: 608979 - DNA, 25 bp, Mus musculus
ggcaatagaggctggtcacgcatca

SEQ ID NO: 608980 - DNA, 25 bp, Mus musculus
ggcaataggcacagattagccccta

SEQ ID NO: 608981 - DNA, 25 bp, Mus musculus
ggcaataggcactgattagccccta

SEQ ID NO: 608982 - DNA, 25 bp, Mus musculus
ggcaatagggaaaatgactgcttct

SEQ ID NO: 608983 - DNA, 25 bp, Mus musculus
ggcaatagggaatatgactgcttct

SEQ ID NO: 608984 - DNA, 25 bp, Mus musculus
ggcaatagggcccagtggtcataaa

SEQ ID NO: 608985 - DNA, 25 bp, Mus musculus
ggcaatagggccgagtggtcataaa

SEQ ID NO: 608986 - DNA, 25 bp, Mus musculus
ggcaatagtagtaggccatgtttat

SEQ ID NO: 608987 - DNA, 25 bp, Mus musculus
ggcaatagtagttggccatgtttat

SEQ ID NO: 608988 - DNA, 25 bp, Mus musculus
ggcaatagtcccaaatgaatgttta

SEQ ID NO: 608989 - DNA, 25 bp, Mus musculus
ggcaatagtccctaatgaatgttta

SEQ ID NO: 608990 - DNA, 25 bp, Mus musculus
ggcaatatcagccacggccaagttt

SEQ ID NO: 608991 - DNA, 25 bp, Mus musculus
ggcaatatcagcgacggccaagttt

SEQ ID NO: 608992 - DNA, 25 bp, Mus musculus
ggcaatatgaccaagatggactgtt

SEQ ID NO: 608993 - DNA, 25 bp, Mus musculus
ggcaatatgacctagatggactgtt

SEQ ID NO: 608994 - DNA, 25 bp, Mus musculus
ggcaatatgcaacaacacacgtcca

SEQ ID NO: 608995 - DNA, 25 bp, Mus musculus
ggcaatatgcaagaacacacgtcca

SEQ ID NO: 608996 - DNA, 25 bp, Mus musculus
ggcaatatggacaagagcgctcaca

SEQ ID NO: 608997 - DNA, 25 bp, Mus musculus
ggcaatatggactagagcgctcaca

SEQ ID NO: 608998 - DNA, 25 bp, Mus musculus
ggcaatatgtaaactaaccagggct

SEQ ID NO: 608999 - DNA, 25 bp, Mus musculus
ggcaatatgtaatctaaccagggct

SEQ ID NO: 609000 - DNA, 25 bp, Mus musculus
ggcaatatgttacaaaccttcccta

SEQ ID NO: 609001 - DNA, 25 bp, Mus musculus
ggcaatatgttagaaaccttcccta

SEQ ID NO: 609002 - DNA, 25 bp, Mus musculus
ggcaatattctcaaaacttctcctg

SEQ ID NO: 609003 - DNA, 25 bp, Mus musculus
ggcaatattctctaaacttctcctg

SEQ ID NO: 609004 - DNA, 25 bp, Mus musculus
ggcaatattgcaacctacaagaatt

SEQ ID NO: 609005 - DNA, 25 bp, Mus musculus
ggcaatattgcatcctacaagaatt

SEQ ID NO: 609006 - DNA, 25 bp, Mus musculus
ggcaatattgtgagaagatttactt

SEQ ID NO: 609007 - DNA, 25 bp, Mus musculus
ggcaatattgtgtgaagatttactt

SEQ ID NO: 609008 - DNA, 25 bp, Mus musculus
ggcaatatttgcagactttctttcc

SEQ ID NO: 609009 - DNA, 25 bp, Mus musculus
ggcaatatttgctgactttctttcc

SEQ ID NO: 609010 - DNA, 25 bp, Mus musculus
ggcaatcacggtaccaagttcctgt

SEQ ID NO: 609011 - DNA, 25 bp, Mus musculus
ggcaatcacggttccaagttcctgt

SEQ ID NO: 609012 - DNA, 25 bp, Mus musculus
ggcaatcacgtgcaacgactgggaa

SEQ ID NO: 609013 - DNA, 25 bp, Mus musculus
ggcaatcacgtggaacgactgggaa

SEQ ID NO: 609014 - DNA, 25 bp, Mus musculus
ggcaatcactgcaagtttatcacca

SEQ ID NO: 609015 - DNA, 25 bp, Mus musculus
ggcaatcactgctagtttatcacca

SEQ ID NO: 609016 - DNA, 25 bp, Mus musculus
ggcaatcagaaaagttactttaaat

SEQ ID NO: 609017 - DNA, 25 bp, Mus musculus
ggcaatcagaaatgttactttaaat

SEQ ID NO: 609018 - DNA, 25 bp, Mus musculus
ggcaatcaggccaggttcaaatatc

SEQ ID NO: 609019 - DNA, 25 bp, Mus musculus
ggcaatcaggcctggttcaaatatc

SEQ ID NO: 609020 - DNA, 25 bp, Mus musculus
ggcaatcatgctatggtcatctaga

SEQ ID NO: 609021 - DNA, 25 bp, Mus musculus
ggcaatcatgctttggtcatctaga

SEQ ID NO: 609022 - DNA, 25 bp, Mus musculus
ggcaatccgatgacctggatcagca

SEQ ID NO: 609023 - DNA, 25 bp, Mus musculus
ggcaatccgatgtcctggatcagca

SEQ ID NO: 609024 - DNA, 25 bp, Mus musculus
ggcaatcgaatcctgagcatcaaga

SEQ ID NO: 609025 - DNA, 25 bp, Mus musculus
ggcaatcgaatcgtgagcatcaaga

SEQ ID NO: 609026 - DNA, 25 bp, Mus musculus
ggcaatctagctccattaagggcaa

SEQ ID NO: 609027 - DNA, 25 bp, Mus musculus
ggcaatctagctgcattaagggcaa

SEQ ID NO: 609028 - DNA, 25 bp, Mus musculus
ggcaatctcacacatagatcacatg

SEQ ID NO: 609029 - DNA, 25 bp, Mus musculus
ggcaatctcacagatagatcacatg

SEQ ID NO: 609030 - DNA, 25 bp, Mus musculus
ggcaatctcattattctacaccaaa

SEQ ID NO: 609031 - DNA, 25 bp, Mus musculus
ggcaatctcatttttctacaccaaa

SEQ ID NO: 609032 - DNA, 25 bp, Mus musculus
ggcaatctcttcatcctaattgaga

SEQ ID NO: 609033 - DNA, 25 bp, Mus musculus
ggcaatctcttcttcctaattgaga

SEQ ID NO: 609034 - DNA, 25 bp, Mus musculus
ggcaatctggatccaatgctcactg

SEQ ID NO: 609035 - DNA, 25 bp, Mus musculus
ggcaatctggatgcaatgctcactg

SEQ ID NO: 609036 - DNA, 25 bp, Mus musculus
ggcaatctgtgaattctctgactga

SEQ ID NO: 609037 - DNA, 25 bp, Mus musculus
ggcaatctgtgatttctctgactga

SEQ ID NO: 609038 - DNA, 25 bp, Mus musculus
ggcaatcttccactgcattaacatt

SEQ ID NO: 609039 - DNA, 25 bp, Mus musculus
ggcaatcttccagtgcattaacatt

SEQ ID NO: 609040 - DNA, 25 bp, Mus musculus
ggcaatcttcttccactgtgacaga

SEQ ID NO: 609041 - DNA, 25 bp, Mus musculus
ggcaatcttcttgcactgtgacaga

SEQ ID NO: 609042 - DNA, 25 bp, Mus musculus
ggcaatctttttctatctgcgggtg

SEQ ID NO: 609043 - DNA, 25 bp, Mus musculus
ggcaatctttttgtatctgcgggtg

SEQ ID NO: 609044 - DNA, 25 bp, Mus musculus
ggcaatgaacacatattagcagtgt

SEQ ID NO: 609045 - DNA, 25 bp, Mus musculus
ggcaatgaacacttattagcagtgt

SEQ ID NO: 609046 - DNA, 25 bp, Mus musculus
ggcaatgaacccacaggatcttcag

SEQ ID NO: 609047 - DNA, 25 bp, Mus musculus
ggcaatgaaccctcaggatcttcag

SEQ ID NO: 609048 - DNA, 25 bp, Mus musculus
ggcaatgaactgaatctcaccatgt

SEQ ID NO: 609049 - DNA, 25 bp, Mus musculus
ggcaatgaactgtatctcaccatgt

SEQ ID NO: 609050 - DNA, 25 bp, Mus musculus
ggcaatgaagtcactttgtcccaca

SEQ ID NO: 609051 - DNA, 25 bp, Mus musculus
ggcaatgaagtctctttgtcccaca

SEQ ID NO: 609052 - DNA, 25 bp, Mus musculus
ggcaatgaatataactccagcttct

SEQ ID NO: 609053 - DNA, 25 bp, Mus musculus
ggcaatgaatattactccagcttct

SEQ ID NO: 609054 - DNA, 25 bp, Mus musculus
ggcaatgaatggcaatctttctagt

SEQ ID NO: 609055 - DNA, 25 bp, Mus musculus
ggcaatgaatgggaatctttctagt

SEQ ID NO: 609056 - DNA, 25 bp, Mus musculus
ggcaatgacgtcatctggaggaaca

SEQ ID NO: 609057 - DNA, 25 bp, Mus musculus
ggcaatgacgtcttctggaggaaca

SEQ ID NO: 609058 - DNA, 25 bp, Mus musculus
ggcaatgactaaccaaccaaaccag

SEQ ID NO: 609059 - DNA, 25 bp, Mus musculus
ggcaatgactaagcaaccaaaccag

SEQ ID NO: 609060 - DNA, 25 bp, Mus musculus
ggcaatgagacgacctatgaggacg

SEQ ID NO: 609061 - DNA, 25 bp, Mus musculus
ggcaatgagacgtcctatgaggacg

SEQ ID NO: 609062 - DNA, 25 bp, Mus musculus
ggcaatgaggccatccatggacaga

SEQ ID NO: 609063 - DNA, 25 bp, Mus musculus
ggcaatgaggccttccatggacaga

SEQ ID NO: 609064 - DNA, 25 bp, Mus musculus
ggcaatgattaaacccagcttagca

SEQ ID NO: 609065 - DNA, 25 bp, Mus musculus
ggcaatgattaatcccagcttagca

SEQ ID NO: 609066 - DNA, 25 bp, Mus musculus
ggcaatgattccactttaggttcaa

SEQ ID NO: 609067 - DNA, 25 bp, Mus musculus
ggcaatgattcctctttaggttcaa

SEQ ID NO: 609068 - DNA, 25 bp, Mus musculus
ggcaatgattctcacttatatagtc

SEQ ID NO: 609069 - DNA, 25 bp, Mus musculus
ggcaatgattctgacttatatagtc

SEQ ID NO: 609070 - DNA, 25 bp, Mus musculus
ggcaatgcaaatctgtcaaagactt

SEQ ID NO: 609071 - DNA, 25 bp, Mus musculus
ggcaatgcaaatgtgtcaaagactt

SEQ ID NO: 609072 - DNA, 25 bp, Mus musculus
ggcaatgcacacagtaggctctcaa

SEQ ID NO: 609073 - DNA, 25 bp, Mus musculus
ggcaatgcacactgtaggctctcaa

SEQ ID NO: 609074 - DNA, 25 bp, Mus musculus
ggcaatgcatccctaaacctgagtt

SEQ ID NO: 609075 - DNA, 25 bp, Mus musculus
ggcaatgcatccgtaaacctgagtt

SEQ ID NO: 609076 - DNA, 25 bp, Mus musculus
ggcaatgcattaatgtgtagccaca

SEQ ID NO: 609077 - DNA, 25 bp, Mus musculus
ggcaatgcattattgtgtagccaca

SEQ ID NO: 609078 - DNA, 25 bp, Mus musculus
ggcaatgccttcagttaaagttcag

SEQ ID NO: 609079 - DNA, 25 bp, Mus musculus
ggcaatgccttctgttaaagttcag

SEQ ID NO: 609080 - DNA, 25 bp, Mus musculus
ggcaatgcggctccactggtggaag

SEQ ID NO: 609081 - DNA, 25 bp, Mus musculus
ggcaatgcggctgcactggtggaag

SEQ ID NO: 609082 - DNA, 25 bp, Mus musculus
ggcaatgctcacaggactgaactta

SEQ ID NO: 609083 - DNA, 25 bp, Mus musculus
ggcaatgctcactggactgaactta

SEQ ID NO: 609084 - DNA, 25 bp, Mus musculus
ggcaatgctctgatagttaatgggt

SEQ ID NO: 609085 - DNA, 25 bp, Mus musculus
ggcaatgctctgttagttaatgggt

SEQ ID NO: 609086 - DNA, 25 bp, Mus musculus
ggcaatgctgcactatcatggtaac

SEQ ID NO: 609087 - DNA, 25 bp, Mus musculus
ggcaatgctgcagtatcatggtaac

SEQ ID NO: 609088 - DNA, 25 bp, Mus musculus
ggcaatgcttccaccgggatggtga

SEQ ID NO: 609089 - DNA, 25 bp, Mus musculus
ggcaatgcttcctccgggatggtga

SEQ ID NO: 609090 - DNA, 25 bp, Mus musculus
ggcaatggaaacctcagcttggctt

SEQ ID NO: 609091 - DNA, 25 bp, Mus musculus
ggcaatggaaacgtcagcttggctt

SEQ ID NO: 609092 - DNA, 25 bp, Mus musculus
ggcaatggaacgacaactgggacat

SEQ ID NO: 609093 - DNA, 25 bp, Mus musculus
ggcaatggaacgtcaactgggacat

SEQ ID NO: 609094 - DNA, 25 bp, Mus musculus
ggcaatggagctccttaagtccctc

SEQ ID NO: 609095 - DNA, 25 bp, Mus musculus
ggcaatggagctctctaaggaacct

SEQ ID NO: 609096 - DNA, 25 bp, Mus musculus
ggcaatggagctgcttaagtccctc

SEQ ID NO: 609097 - DNA, 25 bp, Mus musculus
ggcaatggagctgtctaaggaacct

SEQ ID NO: 609098 - DNA, 25 bp, Mus musculus
ggcaatggagtcaccttagagccaa

SEQ ID NO: 609099 - DNA, 25 bp, Mus musculus
ggcaatggagtctccttagagccaa

SEQ ID NO: 609100 - DNA, 25 bp, Mus musculus
ggcaatggatccctagaacctgagt

SEQ ID NO: 609101 - DNA, 25 bp, Mus musculus
ggcaatggatccgtagaacctgagt

SEQ ID NO: 609102 - DNA, 25 bp, Mus musculus
ggcaatggcatacaagcagtatata

SEQ ID NO: 609103 - DNA, 25 bp, Mus musculus
ggcaatggcatagaagcagtatata

SEQ ID NO: 609104 - DNA, 25 bp, Mus musculus
ggcaatggccgacaacaaggctcac

SEQ ID NO: 609105 - DNA, 25 bp, Mus musculus
ggcaatggccgagaacaaggctcac

SEQ ID NO: 609106 - DNA, 25 bp, Mus musculus
ggcaatggctgccagatggctatat

SEQ ID NO: 609107 - DNA, 25 bp, Mus musculus
ggcaatggctgcgagatggctatat

SEQ ID NO: 609108 - DNA, 25 bp, Mus musculus
ggcaatggctggactatgcgattac

SEQ ID NO: 609109 - DNA, 25 bp, Mus musculus
ggcaatggctggtctatgcgattac

SEQ ID NO: 609110 - DNA, 25 bp, Mus musculus
ggcaatgggattacctcatccttat

SEQ ID NO: 609111 - DNA, 25 bp, Mus musculus
ggcaatgggatttcctcatccttat

SEQ ID NO: 609112 - DNA, 25 bp, Mus musculus
ggcaatgggcaaccctggcggtact

SEQ ID NO: 609113 - DNA, 25 bp, Mus musculus
ggcaatgggcaagcctggcggtact

SEQ ID NO: 609114 - DNA, 25 bp, Mus musculus
ggcaatgtaccacacataactcctt

SEQ ID NO: 609115 - DNA, 25 bp, Mus musculus
ggcaatgtaccagacataactcctt

SEQ ID NO: 609116 - DNA, 25 bp, Mus musculus
ggcaatgtactgaacagtgcccatc

SEQ ID NO: 609117 - DNA, 25 bp, Mus musculus
ggcaatgtactgtacagtgcccatc

SEQ ID NO: 609118 - DNA, 25 bp, Mus musculus
ggcaatgtagctagctgcctgttgc

SEQ ID NO: 609119 - DNA, 25 bp, Mus musculus
ggcaatgtagcttgctgcctgttgc

SEQ ID NO: 609120 - DNA, 25 bp, Mus musculus
ggcaatgtatgcaaccactgagcca

SEQ ID NO: 609121 - DNA, 25 bp, Mus musculus
ggcaatgtatgctaccactgagcca

SEQ ID NO: 609122 - DNA, 25 bp, Mus musculus
ggcaatgtcaacagtctctggcact

SEQ ID NO: 609123 - DNA, 25 bp, Mus musculus
ggcaatgtcaactgtctctggcact

SEQ ID NO: 609124 - DNA, 25 bp, Mus musculus
ggcaatgtctatactctgtaatggt

SEQ ID NO: 609125 - DNA, 25 bp, Mus musculus
ggcaatgtctattctctgtaatggt

SEQ ID NO: 609126 - DNA, 25 bp, Mus musculus
ggcaatgtgaccatatcggcagaac

SEQ ID NO: 609127 - DNA, 25 bp, Mus musculus
ggcaatgtgaccttatcggcagaac

SEQ ID NO: 609128 - DNA, 25 bp, Mus musculus
ggcaatgtgacgactctgcagctaa

SEQ ID NO: 609129 - DNA, 25 bp, Mus musculus
ggcaatgtgacgtctctgcagctaa

SEQ ID NO: 609130 - DNA, 25 bp, Mus musculus
ggcaatgtgagaacttttcaggaga

SEQ ID NO: 609131 - DNA, 25 bp, Mus musculus
ggcaatgtgagatcttttcaggaga

SEQ ID NO: 609132 - DNA, 25 bp, Mus musculus
ggcaatgtgcttcctttacatcggc

SEQ ID NO: 609133 - DNA, 25 bp, Mus musculus
ggcaatgtgcttgctttacatcggc

SEQ ID NO: 609134 - DNA, 25 bp, Mus musculus
ggcaatgtggacatgattgggtttc

SEQ ID NO: 609135 - DNA, 25 bp, Mus musculus
ggcaatgtggacttgattgggtttc

SEQ ID NO: 609136 - DNA, 25 bp, Mus musculus
ggcaatgttcaacctttctcactgc

SEQ ID NO: 609137 - DNA, 25 bp, Mus musculus
ggcaatgttcaagctttctcactgc

SEQ ID NO: 609138 - DNA, 25 bp, Mus musculus
ggcaatgttctcagcgacagagcag

SEQ ID NO: 609139 - DNA, 25 bp, Mus musculus
ggcaatgttctctgcgacagagcag

SEQ ID NO: 609140 - DNA, 25 bp, Mus musculus
ggcaatgttgcaccaagggcagctt

SEQ ID NO: 609141 - DNA, 25 bp, Mus musculus
ggcaatgttgcagcaagggcagctt

SEQ ID NO: 609142 - DNA, 25 bp, Mus musculus
ggcaattacaacaatcagtcttcca

SEQ ID NO: 609143 - DNA, 25 bp, Mus musculus
ggcaattacaactatcagtcttcca

SEQ ID NO: 609144 - DNA, 25 bp, Mus musculus
ggcaattacatgctgacgtgctctg

SEQ ID NO: 609145 - DNA, 25 bp, Mus musculus
ggcaattacatggtgacgtgctctg

SEQ ID NO: 609146 - DNA, 25 bp, Mus musculus
ggcaattaccctccatgtttggatg

SEQ ID NO: 609147 - DNA, 25 bp, Mus musculus
ggcaattaccctgcatgtttggatg

SEQ ID NO: 609148 - DNA, 25 bp, Mus musculus
ggcaattacgcaaacacagcaacaa

SEQ ID NO: 609149 - DNA, 25 bp, Mus musculus
ggcaattacgcatacacagcaacaa

SEQ ID NO: 609150 - DNA, 25 bp, Mus musculus
ggcaattatacccaaccctgtgaat

SEQ ID NO: 609151 - DNA, 25 bp, Mus musculus
ggcaattataccgaaccctgtgaat

SEQ ID NO: 609152 - DNA, 25 bp, Mus musculus
ggcaattcacatcccagactgcatt

SEQ ID NO: 609153 - DNA, 25 bp, Mus musculus
ggcaattcacatgccagactgcatt

SEQ ID NO: 609154 - DNA, 25 bp, Mus musculus
ggcaattcagcacccattttatgtc

SEQ ID NO: 609155 - DNA, 25 bp, Mus musculus
ggcaattcagcagccattttatgtc

SEQ ID NO: 609156 - DNA, 25 bp, Mus musculus
ggcaattcaggccttagcccagtga

SEQ ID NO: 609157 - DNA, 25 bp, Mus musculus
ggcaattcaggcgttagcccagtga

SEQ ID NO: 609158 - DNA, 25 bp, Mus musculus
ggcaattcagttcagttcagcatga

SEQ ID NO: 609159 - DNA, 25 bp, Mus musculus
ggcaattcagttgagttcagcatga

SEQ ID NO: 609160 - DNA, 25 bp, Mus musculus
ggcaattccagtccattgtgctatg

SEQ ID NO: 609161 - DNA, 25 bp, Mus musculus
ggcaattccagtgcattgtgctatg

SEQ ID NO: 609162 - DNA, 25 bp, Mus musculus
ggcaattccattcgcctgctttcag

SEQ ID NO: 609163 - DNA, 25 bp, Mus musculus
ggcaattccattggcctgctttcag

SEQ ID NO: 609164 - DNA, 25 bp, Mus musculus
ggcaattctgaacatctaccatcat

SEQ ID NO: 609165 - DNA, 25 bp, Mus musculus
ggcaattctgaagatctaccatcat

SEQ ID NO: 609166 - DNA, 25 bp, Mus musculus
ggcaattgaggtccagagatgttaa

SEQ ID NO: 609167 - DNA, 25 bp, Mus musculus
ggcaattgaggtgcagagatgttaa

SEQ ID NO: 609168 - DNA, 25 bp, Mus musculus
ggcaattgccagacacatcgataga

SEQ ID NO: 609169 - DNA, 25 bp, Mus musculus
ggcaattgccagtcacatcgataga

SEQ ID NO: 609170 - DNA, 25 bp, Mus musculus
ggcaattgctaacacgaggactcat

SEQ ID NO: 609171 - DNA, 25 bp, Mus musculus
ggcaattgctaagacgaggactcat

SEQ ID NO: 609172 - DNA, 25 bp, Mus musculus
ggcaattgcttacgttattctactt

SEQ ID NO: 609173 - DNA, 25 bp, Mus musculus
ggcaattgcttaggttattctactt

SEQ ID NO: 609174 - DNA, 25 bp, Mus musculus
ggcaattggagcattttcgaagttt

SEQ ID NO: 609175 - DNA, 25 bp, Mus musculus
ggcaattggagctttttcgaagttt

SEQ ID NO: 609176 - DNA, 25 bp, Mus musculus
ggcaattgtattaaagattcctggg

SEQ ID NO: 609177 - DNA, 25 bp, Mus musculus
ggcaattgtatttaagattcctggg

SEQ ID NO: 609178 - DNA, 25 bp, Mus musculus
ggcaattgtgctctcaaaaaacccc

SEQ ID NO: 609179 - DNA, 25 bp, Mus musculus
ggcaattgtgctgtcaaaaaacccc

SEQ ID NO: 609180 - DNA, 25 bp, Mus musculus
ggcaattgtgtactaattagcttta

SEQ ID NO: 609181 - DNA, 25 bp, Mus musculus
ggcaattgtgtagtaattagcttta

SEQ ID NO: 609182 - DNA, 25 bp, Mus musculus
ggcaattgttatctgattactctaa

SEQ ID NO: 609183 - DNA, 25 bp, Mus musculus
ggcaattgttatgtgattactctaa

SEQ ID NO: 609184 - DNA, 25 bp, Mus musculus
ggcaatttaaacaccagtctctaag

SEQ ID NO: 609185 - DNA, 25 bp, Mus musculus
ggcaatttaaactccagtctctaag

SEQ ID NO: 609186 - DNA, 25 bp, Mus musculus
ggcaatttacagaactctcactcct

SEQ ID NO: 609187 - DNA, 25 bp, Mus musculus
ggcaatttacagtactctcactcct

SEQ ID NO: 609188 - DNA, 25 bp, Mus musculus
ggcaatttacccacaaagtcatttt

SEQ ID NO: 609189 - DNA, 25 bp, Mus musculus
ggcaatttaccctcaaagtcatttt

SEQ ID NO: 609190 - DNA, 25 bp, Mus musculus
ggcaatttacctaagtcagcttctg

SEQ ID NO: 609191 - DNA, 25 bp, Mus musculus
ggcaatttaccttagtcagcttctg

SEQ ID NO: 609192 - DNA, 25 bp, Mus musculus
ggcaatttacgtaatccctctcaaa

SEQ ID NO: 609193 - DNA, 25 bp, Mus musculus
ggcaatttacgttatccctctcaaa

SEQ ID NO: 609194 - DNA, 25 bp, Mus musculus
ggcaatttagctacctactgtgtgt

SEQ ID NO: 609195 - DNA, 25 bp, Mus musculus
ggcaatttagcttcctactgtgtgt

SEQ ID NO: 609196 - DNA, 25 bp, Mus musculus
ggcaatttgcttccaagtctttctg

SEQ ID NO: 609197 - DNA, 25 bp, Mus musculus
ggcaatttgcttgcaagtctttctg

SEQ ID NO: 609198 - DNA, 25 bp, Mus musculus
ggcaatttggacaaataactccact

SEQ ID NO: 609199 - DNA, 25 bp, Mus musculus
ggcaatttggactaataactccact

SEQ ID NO: 609200 - DNA, 25 bp, Mus musculus
ggcaatttgtttcgtgaaatggccc

SEQ ID NO: 609201 - DNA, 25 bp, Mus musculus
ggcaatttgtttggtgaaatggccc

SEQ ID NO: 609202 - DNA, 25 bp, Mus musculus
ggcaattttatgacagttcctcaga

SEQ ID NO: 609203 - DNA, 25 bp, Mus musculus
ggcaattttatgtcagttcctcaga

SEQ ID NO: 609204 - DNA, 25 bp, Mus musculus
ggcaattttgtcattcgtcctgagt

SEQ ID NO: 609205 - DNA, 25 bp, Mus musculus
ggcaattttgtctttcgtcctgagt

SEQ ID NO: 609206 - DNA, 25 bp, Mus musculus
ggcacaaaactacctctgatacaga

SEQ ID NO: 609207 - DNA, 25 bp, Mus musculus
ggcacaaaactagctctgatacaga

SEQ ID NO: 609208 - DNA, 25 bp, Mus musculus
ggcacaaaactgagactgcagagta

SEQ ID NO: 609209 - DNA, 25 bp, Mus musculus
ggcacaaaactgtgactgcagagta

SEQ ID NO: 609210 - DNA, 25 bp, Mus musculus
ggcacaaaccgtcggtacactctgt

SEQ ID NO: 609211 - DNA, 25 bp, Mus musculus
ggcacaaaccgtgggtacactctgt

SEQ ID NO: 609212 - DNA, 25 bp, Mus musculus
ggcacaaacctcataaaccaacagt

SEQ ID NO: 609213 - DNA, 25 bp, Mus musculus
ggcacaaacctcttaaaccaacagt

SEQ ID NO: 609214 - DNA, 25 bp, Mus musculus
ggcacaaactctcagttactcagtc

SEQ ID NO: 609215 - DNA, 25 bp, Mus musculus
ggcacaaactctgagttactcagtc

SEQ ID NO: 609216 - DNA, 25 bp, Mus musculus
ggcacaaagcctctgggcccgagtt

SEQ ID NO: 609217 - DNA, 25 bp, Mus musculus
ggcacaaagcctgtgggcccgagtt

SEQ ID NO: 609218 - DNA, 25 bp, Mus musculus
ggcacaaagtgcagaacaggcatct

SEQ ID NO: 609219 - DNA, 25 bp, Mus musculus
ggcacaaagtgctgaacaggcatct

SEQ ID NO: 609220 - DNA, 25 bp, Mus musculus
ggcacaaatcatactctacatagca

SEQ ID NO: 609221 - DNA, 25 bp, Mus musculus
ggcacaaatcattctctacatagca

SEQ ID NO: 609222 - DNA, 25 bp, Mus musculus
ggcacaacaatcatgtttgtactta

SEQ ID NO: 609223 - DNA, 25 bp, Mus musculus
ggcacaacaatcttgtttgtactta

SEQ ID NO: 609224 - DNA, 25 bp, Mus musculus
ggcacaacacccagtctgaagatat

SEQ ID NO: 609225 - DNA, 25 bp, Mus musculus
ggcacaacaccctgtctgaagatat

SEQ ID NO: 609226 - DNA, 25 bp, Mus musculus
ggcacaacactgacacctatggaag

SEQ ID NO: 609227 - DNA, 25 bp, Mus musculus
ggcacaacactgtcacctatggaag

SEQ ID NO: 609228 - DNA, 25 bp, Mus musculus
ggcacaacagtgctttctacgggca

SEQ ID NO: 609229 - DNA, 25 bp, Mus musculus
ggcacaacagtggtttctacgggca

SEQ ID NO: 609230 - DNA, 25 bp, Mus musculus
ggcacaaccttgagaagccccaggt

SEQ ID NO: 609231 - DNA, 25 bp, Mus musculus
ggcacaaccttgtgaagccccaggt

SEQ ID NO: 609232 - DNA, 25 bp, Mus musculus
ggcacaactgcactacacatgtcat

SEQ ID NO: 609233 - DNA, 25 bp, Mus musculus
ggcacaactgcagtacacatgtcat

SEQ ID NO: 609234 - DNA, 25 bp, Mus musculus
ggcacaactggactacattggctta

SEQ ID NO: 609235 - DNA, 25 bp, Mus musculus
ggcacaactggagtacattggctta

SEQ ID NO: 609236 - DNA, 25 bp, Mus musculus
ggcacaactgtgatgctcagatgta

SEQ ID NO: 609237 - DNA, 25 bp, Mus musculus
ggcacaactgtgttgctcagatgta

SEQ ID NO: 609238 - DNA, 25 bp, Mus musculus
ggcacaacttgtcgtccagactatt

SEQ ID NO: 609239 - DNA, 25 bp, Mus musculus
ggcacaacttgtggtccagactatt

SEQ ID NO: 609240 - DNA, 25 bp, Mus musculus
ggcacaagacagaaagcaagcagct

SEQ ID NO: 609241 - DNA, 25 bp, Mus musculus
ggcacaagacagtaagcaagcagct

SEQ ID NO: 609242 - DNA, 25 bp, Mus musculus
ggcacaagacttcggcaggtcactc

SEQ ID NO: 609243 - DNA, 25 bp, Mus musculus
ggcacaagacttgggcaggtcactc

SEQ ID NO: 609244 - DNA, 25 bp, Mus musculus
ggcacaagatcacacatggtagtat

SEQ ID NO: 609245 - DNA, 25 bp, Mus musculus
ggcacaagatcagacatggtagtat

SEQ ID NO: 609246 - DNA, 25 bp, Mus musculus
ggcacaagcacgagtttgaactgtt

SEQ ID NO: 609247 - DNA, 25 bp, Mus musculus
ggcacaagcacgtgtttgaactgtt

SEQ ID NO: 609248 - DNA, 25 bp, Mus musculus
ggcacaagcctaaaatcgcatctct

SEQ ID NO: 609249 - DNA, 25 bp, Mus musculus
ggcacaagcctataatcgcatctct

SEQ ID NO: 609250 - DNA, 25 bp, Mus musculus
ggcacaagctaaaccatggcaatta

SEQ ID NO: 609251 - DNA, 25 bp, Mus musculus
ggcacaagctaatccatggcaatta

SEQ ID NO: 609252 - DNA, 25 bp, Mus musculus
ggcacaagctacctctcgtagtaaa

SEQ ID NO: 609253 - DNA, 25 bp, Mus musculus
ggcacaagctacgtctcgtagtaaa

SEQ ID NO: 609254 - DNA, 25 bp, Mus musculus
ggcacaaggcaactgactagctgat

SEQ ID NO: 609255 - DNA, 25 bp, Mus musculus
ggcacaaggcaagtgactagctgat

SEQ ID NO: 609256 - DNA, 25 bp, Mus musculus
ggcacaaggtccagatctttaatca

SEQ ID NO: 609257 - DNA, 25 bp, Mus musculus
ggcacaaggtcctgatctttaatca

SEQ ID NO: 609258 - DNA, 25 bp, Mus musculus
ggcacaagtgccctcaccttttttc

SEQ ID NO: 609259 - DNA, 25 bp, Mus musculus
ggcacaagtgccgtcaccttttttc

SEQ ID NO: 609260 - DNA, 25 bp, Mus musculus
ggcacaagtgttccagtttgtccca

SEQ ID NO: 609261 - DNA, 25 bp, Mus musculus
ggcacaagtgttgcagtttgtccca

SEQ ID NO: 609262 - DNA, 25 bp, Mus musculus
ggcacaagttaaacagcccagtact

SEQ ID NO: 609263 - DNA, 25 bp, Mus musculus
ggcacaagttaatcagcccagtact

SEQ ID NO: 609264 - DNA, 25 bp, Mus musculus
ggcacaagttatagtcattttggaa

SEQ ID NO: 609265 - DNA, 25 bp, Mus musculus
ggcacaagttattgtcattttggaa

SEQ ID NO: 609266 - DNA, 25 bp, Mus musculus
ggcacaatagcaccctgtagaaatt

SEQ ID NO: 609267 - DNA, 25 bp, Mus musculus
ggcacaatagcagcctgtagaaatt

SEQ ID NO: 609268 - DNA, 25 bp, Mus musculus
ggcacaatatcaagtacttccctga

SEQ ID NO: 609269 - DNA, 25 bp, Mus musculus
ggcacaatatcatgtacttccctga

SEQ ID NO: 609270 - DNA, 25 bp, Mus musculus
ggcacaatccagagtcatttagagt

SEQ ID NO: 609271 - DNA, 25 bp, Mus musculus
ggcacaatccagtgtcatttagagt

SEQ ID NO: 609272 - DNA, 25 bp, Mus musculus
ggcacaatgatcaaacagagaccca

SEQ ID NO: 609273 - DNA, 25 bp, Mus musculus
ggcacaatgatctaacagagaccca

SEQ ID NO: 609274 - DNA, 25 bp, Mus musculus
ggcacaatggacacagtcaggtctg

SEQ ID NO: 609275 - DNA, 25 bp, Mus musculus
ggcacaatggactcagtcaggtctg

SEQ ID NO: 609276 - DNA, 25 bp, Mus musculus
ggcacaattaccatagctgagcaga

SEQ ID NO: 609277 - DNA, 25 bp, Mus musculus
ggcacaattaccttagctgagcaga

SEQ ID NO: 609278 - DNA, 25 bp, Mus musculus
ggcacaattgagaccattttcacat

SEQ ID NO: 609279 - DNA, 25 bp, Mus musculus
ggcacaattgagtccattttcacat

SEQ ID NO: 609280 - DNA, 25 bp, Mus musculus
ggcacaattggaagcatctagtagt

SEQ ID NO: 609281 - DNA, 25 bp, Mus musculus
ggcacaattggatgcatctagtagt

SEQ ID NO: 609282 - DNA, 25 bp, Mus musculus
ggcacacaaaaacagttactttctt

SEQ ID NO: 609283 - DNA, 25 bp, Mus musculus
ggcacacaaaaagagttactttctt

SEQ ID NO: 609284 - DNA, 25 bp, Mus musculus
ggcacacaaaatccttcatctctga

SEQ ID NO: 609285 - DNA, 25 bp, Mus musculus
ggcacacaaaatgcttcatctctga

SEQ ID NO: 609286 - DNA, 25 bp, Mus musculus
ggcacacaaaggaaaaagcacctaa

SEQ ID NO: 609287 - DNA, 25 bp, Mus musculus
ggcacacaaaggtaaaagcacctaa

SEQ ID NO: 609288 - DNA, 25 bp, Mus musculus
ggcacacaacatccacttagatcct

SEQ ID NO: 609289 - DNA, 25 bp, Mus musculus
ggcacacaacatctagtgtcctgat

SEQ ID NO: 609290 - DNA, 25 bp, Mus musculus
ggcacacaacatgcacttagatcct

SEQ ID NO: 609291 - DNA, 25 bp, Mus musculus
ggcacacaacatgtagtgtcctgat

SEQ ID NO: 609292 - DNA, 25 bp, Mus musculus
ggcacacaatcacataccccaattg

SEQ ID NO: 609293 - DNA, 25 bp, Mus musculus
ggcacacaatcagataccccaattg

SEQ ID NO: 609294 - DNA, 25 bp, Mus musculus
ggcacacacaaacactcaataagaa

SEQ ID NO: 609295 - DNA, 25 bp, Mus musculus
ggcacacacaaagactcaataagaa

SEQ ID NO: 609296 - DNA, 25 bp, Mus musculus
ggcacacacctgaagtgactttccc

SEQ ID NO: 609297 - DNA, 25 bp, Mus musculus
ggcacacacctgtagtgactttccc

SEQ ID NO: 609298 - DNA, 25 bp, Mus musculus
ggcacacactgtatcacttgagatg

SEQ ID NO: 609299 - DNA, 25 bp, Mus musculus
ggcacacactgtttcacttgagatg

SEQ ID NO: 609300 - DNA, 25 bp, Mus musculus
ggcacacagacacacctgggatcag

SEQ ID NO: 609301 - DNA, 25 bp, Mus musculus
ggcacacagacagacctgggatcag

SEQ ID NO: 609302 - DNA, 25 bp, Mus musculus
ggcacacagatgacactcaccactg

SEQ ID NO: 609303 - DNA, 25 bp, Mus musculus
ggcacacagatgtcactcaccactg

SEQ ID NO: 609304 - DNA, 25 bp, Mus musculus
ggcacacagcatatacgtcaacaca

SEQ ID NO: 609305 - DNA, 25 bp, Mus musculus
ggcacacagcatttacgtcaacaca

SEQ ID NO: 609306 - DNA, 25 bp, Mus musculus
ggcacacagccaatttctttcattg

SEQ ID NO: 609307 - DNA, 25 bp, Mus musculus
ggcacacagccattttctttcattg

SEQ ID NO: 609308 - DNA, 25 bp, Mus musculus
ggcacacagctaactagcactctga

SEQ ID NO: 609309 - DNA, 25 bp, Mus musculus
ggcacacagctatctagcactctga

SEQ ID NO: 609310 - DNA, 25 bp, Mus musculus
ggcacacagctcacttgggtaattg

SEQ ID NO: 609311 - DNA, 25 bp, Mus musculus
ggcacacagctctcttgggtaattg

SEQ ID NO: 609312 - DNA, 25 bp, Mus musculus
ggcacacagtataccctcaagatca

SEQ ID NO: 609313 - DNA, 25 bp, Mus musculus
ggcacacagtattccctcaagatca

SEQ ID NO: 609314 - DNA, 25 bp, Mus musculus
ggcacacagtcaagcctatggccaa

SEQ ID NO: 609315 - DNA, 25 bp, Mus musculus
ggcacacagtcatgcctatggccaa

SEQ ID NO: 609316 - DNA, 25 bp, Mus musculus
ggcacacagtctactatcacggaca

SEQ ID NO: 609317 - DNA, 25 bp, Mus musculus
ggcacacagtcttctatcacggaca

SEQ ID NO: 609318 - DNA, 25 bp, Mus musculus
ggcacacagtgcagaccttatagac

SEQ ID NO: 609319 - DNA, 25 bp, Mus musculus
ggcacacagtgcagctttagttgaa

SEQ ID NO: 609320 - DNA, 25 bp, Mus musculus
ggcacacagtgctgaccttatagac

SEQ ID NO: 609321 - DNA, 25 bp, Mus musculus
ggcacacagtgctgctttagttgaa

SEQ ID NO: 609322 - DNA, 25 bp, Mus musculus
ggcacacagtgtcacaaccagtggt

SEQ ID NO: 609323 - DNA, 25 bp, Mus musculus
ggcacacagtgtctttcactcacat

SEQ ID NO: 609324 - DNA, 25 bp, Mus musculus
ggcacacagtgtgacaaccagtggt

SEQ ID NO: 609325 - DNA, 25 bp, Mus musculus
ggcacacagtgtgtttcactcacat

SEQ ID NO: 609326 - DNA, 25 bp, Mus musculus
ggcacacatcagcatgtactccatt

SEQ ID NO: 609327 - DNA, 25 bp, Mus musculus
ggcacacatcaggatgtactccatt

SEQ ID NO: 609328 - DNA, 25 bp, Mus musculus
ggcacacatgaacttgcacttgtct

SEQ ID NO: 609329 - DNA, 25 bp, Mus musculus
ggcacacatgaagttgcacttgtct

SEQ ID NO: 609330 - DNA, 25 bp, Mus musculus
ggcacacatggacccgtttgaagtt

SEQ ID NO: 609331 - DNA, 25 bp, Mus musculus
ggcacacatggagccgtttgaagtt

SEQ ID NO: 609332 - DNA, 25 bp, Mus musculus
ggcacacatgtgatccgtatctact

SEQ ID NO: 609333 - DNA, 25 bp, Mus musculus
ggcacacatgtgttccgtatctact

SEQ ID NO: 609334 - DNA, 25 bp, Mus musculus
ggcacaccaaacatcacagccgcgc

SEQ ID NO: 609335 - DNA, 25 bp, Mus musculus
ggcacaccaaacttcacagccgcgc

SEQ ID NO: 609336 - DNA, 25 bp, Mus musculus
ggcacaccaagtatgtaaacgacta

SEQ ID NO: 609337 - DNA, 25 bp, Mus musculus
ggcacaccaagtttgtaaacgacta

SEQ ID NO: 609338 - DNA, 25 bp, Mus musculus
ggcacaccaattccagggcttagag

SEQ ID NO: 609339 - DNA, 25 bp, Mus musculus
ggcacaccaattgcagggcttagag

SEQ ID NO: 609340 - DNA, 25 bp, Mus musculus
ggcacaccagtgcaatcccataaat

SEQ ID NO: 609341 - DNA, 25 bp, Mus musculus
ggcacaccagtggaatcccataaat

SEQ ID NO: 609342 - DNA, 25 bp, Mus musculus
ggcacaccagttataaagtttattt

SEQ ID NO: 609343 - DNA, 25 bp, Mus musculus
ggcacaccagttttaaagtttattt

SEQ ID NO: 609344 - DNA, 25 bp, Mus musculus
ggcacaccatctcctaagtttgttg

SEQ ID NO: 609345 - DNA, 25 bp, Mus musculus
ggcacaccatctgctaagtttgttg

SEQ ID NO: 609346 - DNA, 25 bp, Mus musculus
ggcacaccatgaacaaccactagag

SEQ ID NO: 609347 - DNA, 25 bp, Mus musculus
ggcacaccatgaagtgactcttcat

SEQ ID NO: 609348 - DNA, 25 bp, Mus musculus
ggcacaccatgatcaaccactagag

SEQ ID NO: 609349 - DNA, 25 bp, Mus musculus
ggcacaccatgatgtgactcttcat

SEQ ID NO: 609350 - DNA, 25 bp, Mus musculus
ggcacaccattgatttccagctgct

SEQ ID NO: 609351 - DNA, 25 bp, Mus musculus
ggcacaccattgttttccagctgct

SEQ ID NO: 609352 - DNA, 25 bp, Mus musculus
ggcacaccgaataccagtttcgaat

SEQ ID NO: 609353 - DNA, 25 bp, Mus musculus
ggcacaccgaattccagtttcgaat

SEQ ID NO: 609354 - DNA, 25 bp, Mus musculus
ggcacaccgtctcccagggagcttt

SEQ ID NO: 609355 - DNA, 25 bp, Mus musculus
ggcacaccgtctgccagggagcttt

SEQ ID NO: 609356 - DNA, 25 bp, Mus musculus
ggcacacctccacttcgaaatggga

SEQ ID NO: 609357 - DNA, 25 bp, Mus musculus
ggcacacctccagttcgaaatggga

SEQ ID NO: 609358 - DNA, 25 bp, Mus musculus
ggcacacgatggacacattcagttt

SEQ ID NO: 609359 - DNA, 25 bp, Mus musculus
ggcacacgatggtcacattcagttt

SEQ ID NO: 609360 - DNA, 25 bp, Mus musculus
ggcacacgccccaaggaaagtatat

SEQ ID NO: 609361 - DNA, 25 bp, Mus musculus
ggcacacgcccctaggaaagtatat

SEQ ID NO: 609362 - DNA, 25 bp, Mus musculus
ggcacacgggtaccaacatcaaagt

SEQ ID NO: 609363 - DNA, 25 bp, Mus musculus
ggcacacgggtagcaacatcaaagt

SEQ ID NO: 609364 - DNA, 25 bp, Mus musculus
ggcacacgtagtattgcctgtatat

SEQ ID NO: 609365 - DNA, 25 bp, Mus musculus
ggcacacgtagttttgcctgtatat

SEQ ID NO: 609366 - DNA, 25 bp, Mus musculus
ggcacacgtgagacctgggtgctac

SEQ ID NO: 609367 - DNA, 25 bp, Mus musculus
ggcacacgtgagtcctgggtgctac

SEQ ID NO: 609368 - DNA, 25 bp, Mus musculus
ggcacactaattattggtgttttca

SEQ ID NO: 609369 - DNA, 25 bp, Mus musculus
ggcacactaatttttggtgttttca

SEQ ID NO: 609370 - DNA, 25 bp, Mus musculus
ggcacactccctccacaagtgaaaa

SEQ ID NO: 609371 - DNA, 25 bp, Mus musculus
ggcacactccctgcacaagtgaaaa

SEQ ID NO: 609372 - DNA, 25 bp, Mus musculus
ggcacactctcgcatctaagggaga

SEQ ID NO: 609373 - DNA, 25 bp, Mus musculus
ggcacactctcggatctaagggaga

SEQ ID NO: 609374 - DNA, 25 bp, Mus musculus
ggcacactcttccaagaatggcctt

SEQ ID NO: 609375 - DNA, 25 bp, Mus musculus
ggcacactcttcgaagaatggcctt

SEQ ID NO: 609376 - DNA, 25 bp, Mus musculus
ggcacactgataattgggctctcga

SEQ ID NO: 609377 - DNA, 25 bp, Mus musculus
ggcacactgatactttctgacccat

SEQ ID NO: 609378 - DNA, 25 bp, Mus musculus
ggcacactgatagtttctgacccat

SEQ ID NO: 609379 - DNA, 25 bp, Mus musculus
ggcacactgatatttgggctctcga

SEQ ID NO: 609380 - DNA, 25 bp, Mus musculus
ggcacactgcctaataaatacttgt

SEQ ID NO: 609381 - DNA, 25 bp, Mus musculus
ggcacactgccttataaatacttgt

SEQ ID NO: 609382 - DNA, 25 bp, Mus musculus
ggcacactggaaccctgaacttgga

SEQ ID NO: 609383 - DNA, 25 bp, Mus musculus
ggcacactggaagcctgaacttgga

SEQ ID NO: 609384 - DNA, 25 bp, Mus musculus
ggcacactggtcaaggcaagggctt

SEQ ID NO: 609385 - DNA, 25 bp, Mus musculus
ggcacactggtctaggcaagggctt

SEQ ID NO: 609386 - DNA, 25 bp, Mus musculus
ggcacactgtaacaggtccctagtc

SEQ ID NO: 609387 - DNA, 25 bp, Mus musculus
ggcacactgtaagaggtccctagtc

SEQ ID NO: 609388 - DNA, 25 bp, Mus musculus
ggcacacttaaacatgtctggagtt

SEQ ID NO: 609389 - DNA, 25 bp, Mus musculus
ggcacacttaaagatgtctggagtt

SEQ ID NO: 609390 - DNA, 25 bp, Mus musculus
ggcacacttctcaggacaatgaatc

SEQ ID NO: 609391 - DNA, 25 bp, Mus musculus
ggcacacttctctggacaatgaatc

SEQ ID NO: 609392 - DNA, 25 bp, Mus musculus
ggcacacttgcactttatgcagctg

SEQ ID NO: 609393 - DNA, 25 bp, Mus musculus
ggcacacttgcagtttatgcagctg

SEQ ID NO: 609394 - DNA, 25 bp, Mus musculus
ggcacacttgcccatacgacatcat

SEQ ID NO: 609395 - DNA, 25 bp, Mus musculus
ggcacacttgccgatacgacatcat

SEQ ID NO: 609396 - DNA, 25 bp, Mus musculus
ggcacacttggacccctgtgttcca

SEQ ID NO: 609397 - DNA, 25 bp, Mus musculus
ggcacacttggagccctgtgttcca

SEQ ID NO: 609398 - DNA, 25 bp, Mus musculus
ggcacacttgttaaatcttagcacc

SEQ ID NO: 609399 - DNA, 25 bp, Mus musculus
ggcacacttgtttaatcttagcacc

SEQ ID NO: 609400 - DNA, 25 bp, Mus musculus
ggcacactttgtcgatcttttcctt

SEQ ID NO: 609401 - DNA, 25 bp, Mus musculus
ggcacactttgtggatcttttcctt

SEQ ID NO: 609402 - DNA, 25 bp, Mus musculus
ggcacagaaatgatcatcacaccaa

SEQ ID NO: 609403 - DNA, 25 bp, Mus musculus
ggcacagaaatgttcatcacaccaa

SEQ ID NO: 609404 - DNA, 25 bp, Mus musculus
ggcacagaactactttggatccatt

SEQ ID NO: 609405 - DNA, 25 bp, Mus musculus
ggcacagaactagtttggatccatt

SEQ ID NO: 609406 - DNA, 25 bp, Mus musculus
ggcacagaagaaccttgaaaggaaa

SEQ ID NO: 609407 - DNA, 25 bp, Mus musculus
ggcacagaagaagcttgaaaggaaa

SEQ ID NO: 609408 - DNA, 25 bp, Mus musculus
ggcacagaagcaattaggatgggta

SEQ ID NO: 609409 - DNA, 25 bp, Mus musculus
ggcacagaagcatttaggatgggta

SEQ ID NO: 609410 - DNA, 25 bp, Mus musculus
ggcacagacattcgactccaagttc

SEQ ID NO: 609411 - DNA, 25 bp, Mus musculus
ggcacagacattggactccaagttc

SEQ ID NO: 609412 - DNA, 25 bp, Mus musculus
ggcacagaccaacgagtactccctg

SEQ ID NO: 609413 - DNA, 25 bp, Mus musculus
ggcacagaccaaggagtactccctg

SEQ ID NO: 609414 - DNA, 25 bp, Mus musculus
ggcacagactgccttactttgtcgg

SEQ ID NO: 609415 - DNA, 25 bp, Mus musculus
ggcacagactgcgttactttgtcgg

SEQ ID NO: 609416 - DNA, 25 bp, Mus musculus
ggcacagactggacttgcagttctg

SEQ ID NO: 609417 - DNA, 25 bp, Mus musculus
ggcacagactggtcttgcagttctg

SEQ ID NO: 609418 - DNA, 25 bp, Mus musculus
ggcacagagccccaggaactggcat

SEQ ID NO: 609419 - DNA, 25 bp, Mus musculus
ggcacagagcccgaggaactggcat

SEQ ID NO: 609420 - DNA, 25 bp, Mus musculus
ggcacagagctgctaaaattaaaac

SEQ ID NO: 609421 - DNA, 25 bp, Mus musculus
ggcacagagctggtaaaattaaaac

SEQ ID NO: 609422 - DNA, 25 bp, Mus musculus
ggcacagaggacatggcccctgtct

SEQ ID NO: 609423 - DNA, 25 bp, Mus musculus
ggcacagaggacttggcccctgtct

SEQ ID NO: 609424 - DNA, 25 bp, Mus musculus
ggcacagagtctctccagcagtctg

SEQ ID NO: 609425 - DNA, 25 bp, Mus musculus
ggcacagagtctgtccagcagtctg

SEQ ID NO: 609426 - DNA, 25 bp, Mus musculus
ggcacagatacacgtggctctttgt

SEQ ID NO: 609427 - DNA, 25 bp, Mus musculus
ggcacagatacactgtctgacaccg

SEQ ID NO: 609428 - DNA, 25 bp, Mus musculus
ggcacagatacaggtggctctttgt

SEQ ID NO: 609429 - DNA, 25 bp, Mus musculus
ggcacagatacagtgtctgacaccg

SEQ ID NO: 609430 - DNA, 25 bp, Mus musculus
ggcacagatcagaagagtacccatg

SEQ ID NO: 609431 - DNA, 25 bp, Mus musculus
ggcacagatcagtagagtacccatg

SEQ ID NO: 609432 - DNA, 25 bp, Mus musculus
ggcacagatctgaaattctagcact

SEQ ID NO: 609433 - DNA, 25 bp, Mus musculus
ggcacagatctgtaattctagcact

SEQ ID NO: 609434 - DNA, 25 bp, Mus musculus
ggcacagatgctagcttaggatctt

SEQ ID NO: 609435 - DNA, 25 bp, Mus musculus
ggcacagatgcttgcttaggatctt

SEQ ID NO: 609436 - DNA, 25 bp, Mus musculus
ggcacagattagcatagacatttaa

SEQ ID NO: 609437 - DNA, 25 bp, Mus musculus
ggcacagattaggatagacatttaa

SEQ ID NO: 609438 - DNA, 25 bp, Mus musculus
ggcacagcaactccggaaaaagcag

SEQ ID NO: 609439 - DNA, 25 bp, Mus musculus
ggcacagcaactgcggaaaaagcag

SEQ ID NO: 609440 - DNA, 25 bp, Mus musculus
ggcacagcagatcacaggcactaag

SEQ ID NO: 609441 - DNA, 25 bp, Mus musculus
ggcacagcagatcactacctttggc

SEQ ID NO: 609442 - DNA, 25 bp, Mus musculus
ggcacagcagatgacaggcactaag

SEQ ID NO: 609443 - DNA, 25 bp, Mus musculus
ggcacagcagatgactacctttggc

SEQ ID NO: 609444 - DNA, 25 bp, Mus musculus
ggcacagcagccatactcatagata

SEQ ID NO: 609445 - DNA, 25 bp, Mus musculus
ggcacagcagccctctaagggtttt

SEQ ID NO: 609446 - DNA, 25 bp, Mus musculus
ggcacagcagccgtctaagggtttt

SEQ ID NO: 609447 - DNA, 25 bp, Mus musculus
ggcacagcagccttactcatagata

SEQ ID NO: 609448 - DNA, 25 bp, Mus musculus
ggcacagcagggacattcttactga

SEQ ID NO: 609449 - DNA, 25 bp, Mus musculus
ggcacagcagggtcattcttactga

SEQ ID NO: 609450 - DNA, 25 bp, Mus musculus
ggcacagcaggtagaccatccttaa

SEQ ID NO: 609451 - DNA, 25 bp, Mus musculus
ggcacagcaggttgaccatccttaa

SEQ ID NO: 609452 - DNA, 25 bp, Mus musculus
ggcacagccaaaatgtaagttgtta

SEQ ID NO: 609453 - DNA, 25 bp, Mus musculus
ggcacagccaaattgtaagttgtta

SEQ ID NO: 609454 - DNA, 25 bp, Mus musculus
ggcacagccataaccactggaagta

SEQ ID NO: 609455 - DNA, 25 bp, Mus musculus
ggcacagccatatccactggaagta

SEQ ID NO: 609456 - DNA, 25 bp, Mus musculus
ggcacagccatgatcgctgttttta

SEQ ID NO: 609457 - DNA, 25 bp, Mus musculus
ggcacagccatgttcgctgttttta

SEQ ID NO: 609458 - DNA, 25 bp, Mus musculus
ggcacagcccacaaggagtcctaat

SEQ ID NO: 609459 - DNA, 25 bp, Mus musculus
ggcacagcccactaggagtcctaat

SEQ ID NO: 609460 - DNA, 25 bp, Mus musculus
ggcacagccctgaatgtgaatttgt

SEQ ID NO: 609461 - DNA, 25 bp, Mus musculus
ggcacagccctgtatgtgaatttgt

SEQ ID NO: 609462 - DNA, 25 bp, Mus musculus
ggcacagcccttataatttcaacaa

SEQ ID NO: 609463 - DNA, 25 bp, Mus musculus
ggcacagcccttttaatttcaacaa

SEQ ID NO: 609464 - DNA, 25 bp, Mus musculus
ggcacagccgtaaggaataccccag

SEQ ID NO: 609465 - DNA, 25 bp, Mus musculus
ggcacagccgtatggaataccccag

SEQ ID NO: 609466 - DNA, 25 bp, Mus musculus
ggcacagcctctatatatttctttt

SEQ ID NO: 609467 - DNA, 25 bp, Mus musculus
ggcacagcctctttatatttctttt

SEQ ID NO: 609468 - DNA, 25 bp, Mus musculus
ggcacagccttgctgaaaacccaca

SEQ ID NO: 609469 - DNA, 25 bp, Mus musculus
ggcacagccttggtgaaaacccaca

SEQ ID NO: 609470 - DNA, 25 bp, Mus musculus
ggcacagcctttcgaactcactcta

SEQ ID NO: 609471 - DNA, 25 bp, Mus musculus
ggcacagcctttggaactcactcta

SEQ ID NO: 609472 - DNA, 25 bp, Mus musculus
ggcacagctacacttgtggcctgaa

SEQ ID NO: 609473 - DNA, 25 bp, Mus musculus
ggcacagctacagttgtggcctgaa

SEQ ID NO: 609474 - DNA, 25 bp, Mus musculus
ggcacagctcacagcattcttacaa

SEQ ID NO: 609475 - DNA, 25 bp, Mus musculus
ggcacagctcactgcattcttacaa

SEQ ID NO: 609476 - DNA, 25 bp, Mus musculus
ggcacagctgaaaagctcactggtg

SEQ ID NO: 609477 - DNA, 25 bp, Mus musculus
ggcacagctgaatagctcactggtg

SEQ ID NO: 609478 - DNA, 25 bp, Mus musculus
ggcacagcttgtctgatctttctat

SEQ ID NO: 609479 - DNA, 25 bp, Mus musculus
ggcacagcttgtgtgatctttctat

SEQ ID NO: 609480 - DNA, 25 bp, Mus musculus
ggcacaggacaacaaatcccaggct

SEQ ID NO: 609481 - DNA, 25 bp, Mus musculus
ggcacaggacaagaaatcccaggct

SEQ ID NO: 609482 - DNA, 25 bp, Mus musculus
ggcacaggaccgagatgttacataa

SEQ ID NO: 609483 - DNA, 25 bp, Mus musculus
ggcacaggaccgtgatgttacataa

SEQ ID NO: 609484 - DNA, 25 bp, Mus musculus
ggcacaggagccatcacctttggat

SEQ ID NO: 609485 - DNA, 25 bp, Mus musculus
ggcacaggagccttcacctttggat

SEQ ID NO: 609486 - DNA, 25 bp, Mus musculus
ggcacaggcacacgcctaggctcag

SEQ ID NO: 609487 - DNA, 25 bp, Mus musculus
ggcacaggcacaggcctaggctcag

SEQ ID NO: 609488 - DNA, 25 bp, Mus musculus
ggcacaggcagaaactctcttgaag

SEQ ID NO: 609489 - DNA, 25 bp, Mus musculus
ggcacaggcagatactctcttgaag

SEQ ID NO: 609490 - DNA, 25 bp, Mus musculus
ggcacaggcatgatacattacacta

SEQ ID NO: 609491 - DNA, 25 bp, Mus musculus
ggcacaggcatgttacattacacta

SEQ ID NO: 609492 - DNA, 25 bp, Mus musculus
ggcacaggccctcagaactgaactc

SEQ ID NO: 609493 - DNA, 25 bp, Mus musculus
ggcacaggccctgagaactgaactc

SEQ ID NO: 609494 - DNA, 25 bp, Mus musculus
ggcacaggcctacgctcaggctcag

SEQ ID NO: 609495 - DNA, 25 bp, Mus musculus
ggcacaggcctaggctcaggctcag

SEQ ID NO: 609496 - DNA, 25 bp, Mus musculus
ggcacaggcctgagtaggacactgt

SEQ ID NO: 609497 - DNA, 25 bp, Mus musculus
ggcacaggcctgtgtaggacactgt

SEQ ID NO: 609498 - DNA, 25 bp, Mus musculus
ggcacaggctacactgtcctgcaga

SEQ ID NO: 609499 - DNA, 25 bp, Mus musculus
ggcacaggctactctgtcctgcaga

SEQ ID NO: 609500 - DNA, 25 bp, Mus musculus
ggcacaggcttacgttccagatgat

SEQ ID NO: 609501 - DNA, 25 bp, Mus musculus
ggcacaggcttaggttccagatgat

SEQ ID NO: 609502 - DNA, 25 bp, Mus musculus
ggcacagggccaagtacaacgggat

SEQ ID NO: 609503 - DNA, 25 bp, Mus musculus
ggcacagggccatgtacaacgggat

SEQ ID NO: 609504 - DNA, 25 bp, Mus musculus
ggcacaggtaagagcttcaccactt

SEQ ID NO: 609505 - DNA, 25 bp, Mus musculus
ggcacaggtaagtgcttcaccactt

SEQ ID NO: 609506 - DNA, 25 bp, Mus musculus
ggcacaggtgacatttgggcctact

SEQ ID NO: 609507 - DNA, 25 bp, Mus musculus
ggcacaggtgacttttgggcctact

SEQ ID NO: 609508 - DNA, 25 bp, Mus musculus
ggcacaggttcactttcaggttact

SEQ ID NO: 609509 - DNA, 25 bp, Mus musculus
ggcacaggttcagtttcaggttact

SEQ ID NO: 609510 - DNA, 25 bp, Mus musculus
ggcacagtacccagcatttcagtaa

SEQ ID NO: 609511 - DNA, 25 bp, Mus musculus
ggcacagtacccatggcctggcaag

SEQ ID NO: 609512 - DNA, 25 bp, Mus musculus
ggcacagtaccctgcatttcagtaa

SEQ ID NO: 609513 - DNA, 25 bp, Mus musculus
ggcacagtacccttggcctggcaag

SEQ ID NO: 609514 - DNA, 25 bp, Mus musculus
ggcacagtacttcgtgctgcttcaa

SEQ ID NO: 609515 - DNA, 25 bp, Mus musculus
ggcacagtacttggtgctgcttcaa

SEQ ID NO: 609516 - DNA, 25 bp, Mus musculus
ggcacagtaggtacctggatgttca

SEQ ID NO: 609517 - DNA, 25 bp, Mus musculus
ggcacagtaggttcctggatgttca

SEQ ID NO: 609518 - DNA, 25 bp, Mus musculus
ggcacagtagtgatcacccagaatc

SEQ ID NO: 609519 - DNA, 25 bp, Mus musculus
ggcacagtagtgttcacccagaatc

SEQ ID NO: 609520 - DNA, 25 bp, Mus musculus
ggcacagtatcaaaggcacacacct

SEQ ID NO: 609521 - DNA, 25 bp, Mus musculus
ggcacagtatcataggcacacacct

SEQ ID NO: 609522 - DNA, 25 bp, Mus musculus
ggcacagtctttagggcatcccgac

SEQ ID NO: 609523 - DNA, 25 bp, Mus musculus
ggcacagtcttttgggcatcccgac

SEQ ID NO: 609524 - DNA, 25 bp, Mus musculus
ggcacagtgaaacccaacgcaaaca

SEQ ID NO: 609525 - DNA, 25 bp, Mus musculus
ggcacagtgaaagccaacgcaaaca

SEQ ID NO: 609526 - DNA, 25 bp, Mus musculus
ggcacagtgagtcgtctttccttta

SEQ ID NO: 609527 - DNA, 25 bp, Mus musculus
ggcacagtgagtggtctttccttta

SEQ ID NO: 609528 - DNA, 25 bp, Mus musculus
ggcacagtgatccttgagcatagtc

SEQ ID NO: 609529 - DNA, 25 bp, Mus musculus
ggcacagtgatcgttgagcatagtc

SEQ ID NO: 609530 - DNA, 25 bp, Mus musculus
ggcacagtgccccttaacttctaac

SEQ ID NO: 609531 - DNA, 25 bp, Mus musculus
ggcacagtgcccgttaacttctaac

SEQ ID NO: 609532 - DNA, 25 bp, Mus musculus
ggcacagtggccagattgtatttca

SEQ ID NO: 609533 - DNA, 25 bp, Mus musculus
ggcacagtggccagggttcacattg

SEQ ID NO: 609534 - DNA, 25 bp, Mus musculus
ggcacagtggccatattgactttac

SEQ ID NO: 609535 - DNA, 25 bp, Mus musculus
ggcacagtggcctgattgtatttca

SEQ ID NO: 609536 - DNA, 25 bp, Mus musculus
ggcacagtggcctgggttcacattg

SEQ ID NO: 609537 - DNA, 25 bp, Mus musculus
ggcacagtggccttattgactttac

SEQ ID NO: 609538 - DNA, 25 bp, Mus musculus
ggcacagtgggaagctttgccctcc

SEQ ID NO: 609539 - DNA, 25 bp, Mus musculus
ggcacagtgggatgctttgccctcc

SEQ ID NO: 609540 - DNA, 25 bp, Mus musculus
ggcacagttcataggtcctctggtg

SEQ ID NO: 609541 - DNA, 25 bp, Mus musculus
ggcacagttcattggtcctctggtg

SEQ ID NO: 609542 - DNA, 25 bp, Mus musculus
ggcacagttccaccagttgaacatt

SEQ ID NO: 609543 - DNA, 25 bp, Mus musculus
ggcacagttccagcagttgaacatt

SEQ ID NO: 609544 - DNA, 25 bp, Mus musculus
ggcacagttcctaagaagtccaggg

SEQ ID NO: 609545 - DNA, 25 bp, Mus musculus
ggcacagttccttagaagtccaggg

SEQ ID NO: 609546 - DNA, 25 bp, Mus musculus
ggcacagttcttaagaccatttatg

SEQ ID NO: 609547 - DNA, 25 bp, Mus musculus
ggcacagttctttagaccatttatg

SEQ ID NO: 609548 - DNA, 25 bp, Mus musculus
ggcacagttggaccagttgtcttaa

SEQ ID NO: 609549 - DNA, 25 bp, Mus musculus
ggcacagttggagcagttgtcttaa

SEQ ID NO: 609550 - DNA, 25 bp, Mus musculus
ggcacagtttgcataggattgaaaa

SEQ ID NO: 609551 - DNA, 25 bp, Mus musculus
ggcacagtttgcttaggattgaaaa

SEQ ID NO: 609552 - DNA, 25 bp, Mus musculus
ggcacagttttcactgaactctgga

SEQ ID NO: 609553 - DNA, 25 bp, Mus musculus
ggcacagttttctctgaactctgga

SEQ ID NO: 609554 - DNA, 25 bp, Mus musculus
ggcacagttttgctactgctactta

SEQ ID NO: 609555 - DNA, 25 bp, Mus musculus
ggcacagttttggtactgctactta

SEQ ID NO: 609556 - DNA, 25 bp, Mus musculus
ggcacataaagtctctgttgtctgt

SEQ ID NO: 609557 - DNA, 25 bp, Mus musculus
ggcacataaagtgtctgttgtctgt

SEQ ID NO: 609558 - DNA, 25 bp, Mus musculus
ggcacataacttacagcacagcact

SEQ ID NO: 609559 - DNA, 25 bp, Mus musculus
ggcacataactttcagcacagcact

SEQ ID NO: 609560 - DNA, 25 bp, Mus musculus
ggcacatacctgaaaacctagcatt

SEQ ID NO: 609561 - DNA, 25 bp, Mus musculus
ggcacatacctgtaaacctagcatt

SEQ ID NO: 609562 - DNA, 25 bp, Mus musculus
ggcacatactgaccagacgtcagtc

SEQ ID NO: 609563 - DNA, 25 bp, Mus musculus
ggcacatactgagcagacgtcagtc

SEQ ID NO: 609564 - DNA, 25 bp, Mus musculus
ggcacatactgtatctatgaccagg

SEQ ID NO: 609565 - DNA, 25 bp, Mus musculus
ggcacatactgtcaaagggccttgt

SEQ ID NO: 609566 - DNA, 25 bp, Mus musculus
ggcacatactgtgaaagggccttgt

SEQ ID NO: 609567 - DNA, 25 bp, Mus musculus
ggcacatactgtttctatgaccagg

SEQ ID NO: 609568 - DNA, 25 bp, Mus musculus
ggcacatacttgagaccaggcacct

SEQ ID NO: 609569 - DNA, 25 bp, Mus musculus
ggcacatacttgctacacagatata

SEQ ID NO: 609570 - DNA, 25 bp, Mus musculus
ggcacatacttggtacacagatata

SEQ ID NO: 609571 - DNA, 25 bp, Mus musculus
ggcacatacttgtgaccaggcacct

SEQ ID NO: 609572 - DNA, 25 bp, Mus musculus
ggcacatagccacttaaccaataat

SEQ ID NO: 609573 - DNA, 25 bp, Mus musculus
ggcacatagccagttaaccaataat

SEQ ID NO: 609574 - DNA, 25 bp, Mus musculus
ggcacataggcacagtcacgggaat

SEQ ID NO: 609575 - DNA, 25 bp, Mus musculus
ggcacataggcagagtcacgggaat

SEQ ID NO: 609576 - DNA, 25 bp, Mus musculus
ggcacatagtaaatcccaggtcatt

SEQ ID NO: 609577 - DNA, 25 bp, Mus musculus
ggcacatagtaattcccaggtcatt

SEQ ID NO: 609578 - DNA, 25 bp, Mus musculus
ggcacatagttcaccacagagcatt

SEQ ID NO: 609579 - DNA, 25 bp, Mus musculus
ggcacatagttctccacagagcatt

SEQ ID NO: 609580 - DNA, 25 bp, Mus musculus
ggcacatatcttaaccatataactt

SEQ ID NO: 609581 - DNA, 25 bp, Mus musculus
ggcacatatctttaccatataactt

SEQ ID NO: 609582 - DNA, 25 bp, Mus musculus
ggcacatcaatgactctccatttgg

SEQ ID NO: 609583 - DNA, 25 bp, Mus musculus
ggcacatcaatgtctctccatttgg

SEQ ID NO: 609584 - DNA, 25 bp, Mus musculus
ggcacatcacacaacctgaagtcct

SEQ ID NO: 609585 - DNA, 25 bp, Mus musculus
ggcacatcacactacctgaagtcct

SEQ ID NO: 609586 - DNA, 25 bp, Mus musculus
ggcacatcagcacgatttctgttta

SEQ ID NO: 609587 - DNA, 25 bp, Mus musculus
ggcacatcagcaggatttctgttta

SEQ ID NO: 609588 - DNA, 25 bp, Mus musculus
ggcacatcccttaaggaggcagaga

SEQ ID NO: 609589 - DNA, 25 bp, Mus musculus
ggcacatccctttaggaggcagaga

SEQ ID NO: 609590 - DNA, 25 bp, Mus musculus
ggcacatcctctccgtgggaaaatc

SEQ ID NO: 609591 - DNA, 25 bp, Mus musculus
ggcacatcctctgcgtgggaaaatc

SEQ ID NO: 609592 - DNA, 25 bp, Mus musculus
ggcacatcctggctgctcgattggc

SEQ ID NO: 609593 - DNA, 25 bp, Mus musculus
ggcacatcctgggtgctcgattggc

SEQ ID NO: 609594 - DNA, 25 bp, Mus musculus
ggcacatcgagccttgtcgcttctt

SEQ ID NO: 609595 - DNA, 25 bp, Mus musculus
ggcacatcgagcgttgtcgcttctt

SEQ ID NO: 609596 - DNA, 25 bp, Mus musculus
ggcacatctaccaccttgaggagaa

SEQ ID NO: 609597 - DNA, 25 bp, Mus musculus
ggcacatctacctccttgaggagaa

SEQ ID NO: 609598 - DNA, 25 bp, Mus musculus
ggcacatctatcaggactggcactc

SEQ ID NO: 609599 - DNA, 25 bp, Mus musculus
ggcacatctatctggactggcactc

SEQ ID NO: 609600 - DNA, 25 bp, Mus musculus
ggcacatctgcgcatgtgcaagcgt

SEQ ID NO: 609601 - DNA, 25 bp, Mus musculus
ggcacatctgcggatgtgcaagcgt

SEQ ID NO: 609602 - DNA, 25 bp, Mus musculus
ggcacatctggaacagttgcttact

SEQ ID NO: 609603 - DNA, 25 bp, Mus musculus
ggcacatctggatcagttgcttact

SEQ ID NO: 609604 - DNA, 25 bp, Mus musculus
ggcacatctgggacaacttctggga

SEQ ID NO: 609605 - DNA, 25 bp, Mus musculus
ggcacatctgggtcaacttctggga

SEQ ID NO: 609606 - DNA, 25 bp, Mus musculus
ggcacatctgttatctctaacctgt

SEQ ID NO: 609607 - DNA, 25 bp, Mus musculus
ggcacatctgttcctggttggatac

SEQ ID NO: 609608 - DNA, 25 bp, Mus musculus
ggcacatctgttgctggttggatac

SEQ ID NO: 609609 - DNA, 25 bp, Mus musculus
ggcacatctgttttctctaacctgt

SEQ ID NO: 609610 - DNA, 25 bp, Mus musculus
ggcacatcttaactctttcgattca

SEQ ID NO: 609611 - DNA, 25 bp, Mus musculus
ggcacatcttaagtctttcgattca

SEQ ID NO: 609612 - DNA, 25 bp, Mus musculus
ggcacatcttctatataaattctac

SEQ ID NO: 609613 - DNA, 25 bp, Mus musculus
ggcacatcttctttataaattctac

SEQ ID NO: 609614 - DNA, 25 bp, Mus musculus
ggcacatgaactcgcattggcgtgt

SEQ ID NO: 609615 - DNA, 25 bp, Mus musculus
ggcacatgaactggcattggcgtgt

SEQ ID NO: 609616 - DNA, 25 bp, Mus musculus
ggcacatgacacatgccagcaaggc

SEQ ID NO: 609617 - DNA, 25 bp, Mus musculus
ggcacatgacacttgccagcaaggc

SEQ ID NO: 609618 - DNA, 25 bp, Mus musculus
ggcacatgacctacaatgagtactt

SEQ ID NO: 609619 - DNA, 25 bp, Mus musculus
ggcacatgaccttcaatgagtactt

SEQ ID NO: 609620 - DNA, 25 bp, Mus musculus
ggcacatgcacaaactactgagcac

SEQ ID NO: 609621 - DNA, 25 bp, Mus musculus
ggcacatgcacatactactgagcac

SEQ ID NO: 609622 - DNA, 25 bp, Mus musculus
ggcacatgcgcaccacaacattctg

SEQ ID NO: 609623 - DNA, 25 bp, Mus musculus
ggcacatgcgcagcacaacattctg

SEQ ID NO: 609624 - DNA, 25 bp, Mus musculus
ggcacatgcttaaagctcctaattt

SEQ ID NO: 609625 - DNA, 25 bp, Mus musculus
ggcacatgcttatagctcctaattt

SEQ ID NO: 609626 - DNA, 25 bp, Mus musculus
ggcacatgcttgaactttagtgacg

SEQ ID NO: 609627 - DNA, 25 bp, Mus musculus
ggcacatgcttgactccccagaaca

SEQ ID NO: 609628 - DNA, 25 bp, Mus musculus
ggcacatgcttgtactttagtgacg

SEQ ID NO: 609629 - DNA, 25 bp, Mus musculus
ggcacatgcttgtctccccagaaca

SEQ ID NO: 609630 - DNA, 25 bp, Mus musculus
ggcacatgggcgcaaaaaattattg

SEQ ID NO: 609631 - DNA, 25 bp, Mus musculus
ggcacatgggcggaaaaaattattg

SEQ ID NO: 609632 - DNA, 25 bp, Mus musculus
ggcacatgtgccagtcaagggacat

SEQ ID NO: 609633 - DNA, 25 bp, Mus musculus
ggcacatgtgcctgtcaagggacat

SEQ ID NO: 609634 - DNA, 25 bp, Mus musculus
ggcacatgtggaattgcttctattg

SEQ ID NO: 609635 - DNA, 25 bp, Mus musculus
ggcacatgtggatttgcttctattg

SEQ ID NO: 609636 - DNA, 25 bp, Mus musculus
ggcacatgtgtacgctgcaagtcct

SEQ ID NO: 609637 - DNA, 25 bp, Mus musculus
ggcacatgtgtaggctgcaagtcct

SEQ ID NO: 609638 - DNA, 25 bp, Mus musculus
ggcacatgttcacaagccaagcaca

SEQ ID NO: 609639 - DNA, 25 bp, Mus musculus
ggcacatgttcagaagccaagcaca

SEQ ID NO: 609640 - DNA, 25 bp, Mus musculus
ggcacattcaacatgatctcctgtt

SEQ ID NO: 609641 - DNA, 25 bp, Mus musculus
ggcacattcaacttgatctcctgtt

SEQ ID NO: 609642 - DNA, 25 bp, Mus musculus
ggcacattcagaaggactttggtta

SEQ ID NO: 609643 - DNA, 25 bp, Mus musculus
ggcacattcagatggactttggtta

SEQ ID NO: 609644 - DNA, 25 bp, Mus musculus
ggcacattcctgattactttttggg

SEQ ID NO: 609645 - DNA, 25 bp, Mus musculus
ggcacattcctgtttactttttggg

SEQ ID NO: 609646 - DNA, 25 bp, Mus musculus
ggcacattctatcattgtcataact

SEQ ID NO: 609647 - DNA, 25 bp, Mus musculus
ggcacattctatgattgtcataact

SEQ ID NO: 609648 - DNA, 25 bp, Mus musculus
ggcacattgactccttcagagtatg

SEQ ID NO: 609649 - DNA, 25 bp, Mus musculus
ggcacattgactgcttcagagtatg

SEQ ID NO: 609650 - DNA, 25 bp, Mus musculus
ggcacattgcttagaatgtctccca

SEQ ID NO: 609651 - DNA, 25 bp, Mus musculus
ggcacattgcttatgttctacttta

SEQ ID NO: 609652 - DNA, 25 bp, Mus musculus
ggcacattgctttgaatgtctccca

SEQ ID NO: 609653 - DNA, 25 bp, Mus musculus
ggcacattgcttttgttctacttta

SEQ ID NO: 609654 - DNA, 25 bp, Mus musculus
ggcacattgttcactggctcacaga

SEQ ID NO: 609655 - DNA, 25 bp, Mus musculus
ggcacattgttctctggctcacaga

SEQ ID NO: 609656 - DNA, 25 bp, Mus musculus
ggcacatttcacacagaagaccata

SEQ ID NO: 609657 - DNA, 25 bp, Mus musculus
ggcacatttcactcagaagaccata

SEQ ID NO: 609658 - DNA, 25 bp, Mus musculus
ggcacatttcccatcagttggaatt

SEQ ID NO: 609659 - DNA, 25 bp, Mus musculus
ggcacatttcccttcagttggaatt

SEQ ID NO: 609660 - DNA, 25 bp, Mus musculus
ggcacatttcttaactagctacaat

SEQ ID NO: 609661 - DNA, 25 bp, Mus musculus
ggcacatttctttactagctacaat

SEQ ID NO: 609662 - DNA, 25 bp, Mus musculus
ggcacatttgctatgaaactaccag

SEQ ID NO: 609663 - DNA, 25 bp, Mus musculus
ggcacatttgctttgaaactaccag

SEQ ID NO: 609664 - DNA, 25 bp, Mus musculus
ggcacattttaaatccagtctgcga

SEQ ID NO: 609665 - DNA, 25 bp, Mus musculus
ggcacattttaattccagtctgcga

SEQ ID NO: 609666 - DNA, 25 bp, Mus musculus
ggcacatttttactcattagctgga

SEQ ID NO: 609667 - DNA, 25 bp, Mus musculus
ggcacatttttagtcattagctgga

SEQ ID NO: 609668 - DNA, 25 bp, Mus musculus
ggcacatttttgacctatcagttgt

SEQ ID NO: 609669 - DNA, 25 bp, Mus musculus
ggcacatttttgctgtgtctccagc

SEQ ID NO: 609670 - DNA, 25 bp, Mus musculus
ggcacatttttggtgtgtctccagc

SEQ ID NO: 609671 - DNA, 25 bp, Mus musculus
ggcacatttttgtcctatcagttgt

SEQ ID NO: 609672 - DNA, 25 bp, Mus musculus
ggcaccaaaatcacttttccgaggg

SEQ ID NO: 609673 - DNA, 25 bp, Mus musculus
ggcaccaaaatctcttttccgaggg

SEQ ID NO: 609674 - DNA, 25 bp, Mus musculus
ggcaccaagcacacatgtgttgcat

SEQ ID NO: 609675 - DNA, 25 bp, Mus musculus
ggcaccaagcactcatgtgttgcat

SEQ ID NO: 609676 - DNA, 25 bp, Mus musculus
ggcaccaagcatccaagtggtccac

SEQ ID NO: 609677 - DNA, 25 bp, Mus musculus
ggcaccaagcatcggcatgttacat

SEQ ID NO: 609678 - DNA, 25 bp, Mus musculus
ggcaccaagcatgcaagtggtccac

SEQ ID NO: 609679 - DNA, 25 bp, Mus musculus
ggcaccaagcatgggcatgttacat

SEQ ID NO: 609680 - DNA, 25 bp, Mus musculus
ggcaccaagccaaaggacggtattt

SEQ ID NO: 609681 - DNA, 25 bp, Mus musculus
ggcaccaagccataggacggtattt

SEQ ID NO: 609682 - DNA, 25 bp, Mus musculus
ggcaccaaggaaagcaggccttcag

SEQ ID NO: 609683 - DNA, 25 bp, Mus musculus
ggcaccaaggaatgcaggccttcag

SEQ ID NO: 609684 - DNA, 25 bp, Mus musculus
ggcaccaagtggatcgctaacaact

SEQ ID NO: 609685 - DNA, 25 bp, Mus musculus
ggcaccaagtggttcgctaacaact

SEQ ID NO: 609686 - DNA, 25 bp, Mus musculus
ggcaccaatgctatatattactgtg

SEQ ID NO: 609687 - DNA, 25 bp, Mus musculus
ggcaccaatgctttatattactgtg

SEQ ID NO: 609688 - DNA, 25 bp, Mus musculus
ggcaccacaggaccctggccagtgt

SEQ ID NO: 609689 - DNA, 25 bp, Mus musculus
ggcaccacaggagcctggccagtgt

SEQ ID NO: 609690 - DNA, 25 bp, Mus musculus
ggcaccacccatagtatactggctg

SEQ ID NO: 609691 - DNA, 25 bp, Mus musculus
ggcaccacccattgtatactggctg

SEQ ID NO: 609692 - DNA, 25 bp, Mus musculus
ggcaccaccggcaagttaggcacca

SEQ ID NO: 609693 - DNA, 25 bp, Mus musculus
ggcaccaccggctagttaggcacca

SEQ ID NO: 609694 - DNA, 25 bp, Mus musculus
ggcaccaccttccttgatcactaat

SEQ ID NO: 609695 - DNA, 25 bp, Mus musculus
ggcaccaccttcgttgatcactaat

SEQ ID NO: 609696 - DNA, 25 bp, Mus musculus
ggcaccacgtcaccaagagttgttt

SEQ ID NO: 609697 - DNA, 25 bp, Mus musculus
ggcaccacgtcagcaagagttgttt

SEQ ID NO: 609698 - DNA, 25 bp, Mus musculus
ggcaccacgtggagacactttagct

SEQ ID NO: 609699 - DNA, 25 bp, Mus musculus
ggcaccacgtggtgacactttagct

SEQ ID NO: 609700 - DNA, 25 bp, Mus musculus
ggcaccactagtaccagggagggac

SEQ ID NO: 609701 - DNA, 25 bp, Mus musculus
ggcaccactagttccagggagggac

SEQ ID NO: 609702 - DNA, 25 bp, Mus musculus
ggcaccactggacaaggcctgtgca

SEQ ID NO: 609703 - DNA, 25 bp, Mus musculus
ggcaccactggagaaggcctgtgca

SEQ ID NO: 609704 - DNA, 25 bp, Mus musculus
ggcaccacttcgactttaagcatga

SEQ ID NO: 609705 - DNA, 25 bp, Mus musculus
ggcaccacttcgtctttaagcatga

SEQ ID NO: 609706 - DNA, 25 bp, Mus musculus
ggcaccacttttaagctttgagctt

SEQ ID NO: 609707 - DNA, 25 bp, Mus musculus
ggcaccactttttagctttgagctt

SEQ ID NO: 609708 - DNA, 25 bp, Mus musculus
ggcaccagaccaaacaatgtgtatc

SEQ ID NO: 609709 - DNA, 25 bp, Mus musculus
ggcaccagaccatacaatgtgtatc

SEQ ID NO: 609710 - DNA, 25 bp, Mus musculus
ggcaccagatgcaaaactttcctaa

SEQ ID NO: 609711 - DNA, 25 bp, Mus musculus
ggcaccagatgctaaactttcctaa

SEQ ID NO: 609712 - DNA, 25 bp, Mus musculus
ggcaccagattcatcgtgggcagat

SEQ ID NO: 609713 - DNA, 25 bp, Mus musculus
ggcaccagattcttcgtgggcagat

SEQ ID NO: 609714 - DNA, 25 bp, Mus musculus
ggcaccagccaaaaagatgaccact

SEQ ID NO: 609715 - DNA, 25 bp, Mus musculus
ggcaccagccaataagatgaccact

SEQ ID NO: 609716 - DNA, 25 bp, Mus musculus
ggcaccagctccaacagattattga

SEQ ID NO: 609717 - DNA, 25 bp, Mus musculus
ggcaccagctcctacagattattga

SEQ ID NO: 609718 - DNA, 25 bp, Mus musculus
ggcaccaggaaaagagagcctttct

SEQ ID NO: 609719 - DNA, 25 bp, Mus musculus
ggcaccaggaaatgagagcctttct

SEQ ID NO: 609720 - DNA, 25 bp, Mus musculus
ggcaccaggcttcaatctctgagaa

SEQ ID NO: 609721 - DNA, 25 bp, Mus musculus
ggcaccaggcttgaatctctgagaa

SEQ ID NO: 609722 - DNA, 25 bp, Mus musculus
ggcaccagggagagttatgtcctca

SEQ ID NO: 609723 - DNA, 25 bp, Mus musculus
ggcaccagggagtgttatgtcctca

SEQ ID NO: 609724 - DNA, 25 bp, Mus musculus
ggcaccagggctcaaggccgcaaaa

SEQ ID NO: 609725 - DNA, 25 bp, Mus musculus
ggcaccagggctccattttgatttc

SEQ ID NO: 609726 - DNA, 25 bp, Mus musculus
ggcaccagggctgaaggccgcaaaa

SEQ ID NO: 609727 - DNA, 25 bp, Mus musculus
ggcaccagggctgcattttgatttc

SEQ ID NO: 609728 - DNA, 25 bp, Mus musculus
ggcaccaggtgaaccaggctaagtt

SEQ ID NO: 609729 - DNA, 25 bp, Mus musculus
ggcaccaggtgatccaggctaagtt

SEQ ID NO: 609730 - DNA, 25 bp, Mus musculus
ggcaccaggtggattttgaggacat

SEQ ID NO: 609731 - DNA, 25 bp, Mus musculus
ggcaccaggtggtttttgaggacat

SEQ ID NO: 609732 - DNA, 25 bp, Mus musculus
ggcaccagtggaattgtgaccatga

SEQ ID NO: 609733 - DNA, 25 bp, Mus musculus
ggcaccagtggatttgtgaccatga

SEQ ID NO: 609734 - DNA, 25 bp, Mus musculus
ggcaccataacccagtagagtagat

SEQ ID NO: 609735 - DNA, 25 bp, Mus musculus
ggcaccataaccgagtagagtagat

SEQ ID NO: 609736 - DNA, 25 bp, Mus musculus
ggcaccatacacattaaggcttcaa

SEQ ID NO: 609737 - DNA, 25 bp, Mus musculus
ggcaccatacactttaaggcttcaa

SEQ ID NO: 609738 - DNA, 25 bp, Mus musculus
ggcaccataggtcttgctaaccaag

SEQ ID NO: 609739 - DNA, 25 bp, Mus musculus
ggcaccataggtgttgctaaccaag

SEQ ID NO: 609740 - DNA, 25 bp, Mus musculus
ggcaccatatttcgcctagcaggat

SEQ ID NO: 609741 - DNA, 25 bp, Mus musculus
ggcaccatatttggcctagcaggat

SEQ ID NO: 609742 - DNA, 25 bp, Mus musculus
ggcaccatcacgagctttacaggga

SEQ ID NO: 609743 - DNA, 25 bp, Mus musculus
ggcaccatcacgtgctttacaggga

SEQ ID NO: 609744 - DNA, 25 bp, Mus musculus
ggcaccatctctcccattattttac

SEQ ID NO: 609745 - DNA, 25 bp, Mus musculus
ggcaccatctctgccattattttac

SEQ ID NO: 609746 - DNA, 25 bp, Mus musculus
ggcaccatctggattaccttattga

SEQ ID NO: 609747 - DNA, 25 bp, Mus musculus
ggcaccatctggtttaccttattga

SEQ ID NO: 609748 - DNA, 25 bp, Mus musculus
ggcaccatctttacctgtgaagtca

SEQ ID NO: 609749 - DNA, 25 bp, Mus musculus
ggcaccatcttttcctgtgaagtca

SEQ ID NO: 609750 - DNA, 25 bp, Mus musculus
ggcaccatgccaaagactggatgac

SEQ ID NO: 609751 - DNA, 25 bp, Mus musculus
ggcaccatgccatagactggatgac

SEQ ID NO: 609752 - DNA, 25 bp, Mus musculus
ggcaccatggttcgctaccgaatga

SEQ ID NO: 609753 - DNA, 25 bp, Mus musculus
ggcaccatggttggctaccgaatga

SEQ ID NO: 609754 - DNA, 25 bp, Mus musculus
ggcaccatgtgcacagtcttaagaa

SEQ ID NO: 609755 - DNA, 25 bp, Mus musculus
ggcaccatgtgctcagtcttaagaa

SEQ ID NO: 609756 - DNA, 25 bp, Mus musculus
ggcaccattaggaacgtttgaccaa

SEQ ID NO: 609757 - DNA, 25 bp, Mus musculus
ggcaccattaggtacgtttgaccaa

SEQ ID NO: 609758 - DNA, 25 bp, Mus musculus
ggcaccattatcaagacagattccg

SEQ ID NO: 609759 - DNA, 25 bp, Mus musculus
ggcaccattatctagacagattccg

SEQ ID NO: 609760 - DNA, 25 bp, Mus musculus
ggcaccattctaacccctttaagag

SEQ ID NO: 609761 - DNA, 25 bp, Mus musculus
ggcaccattctaaggaacaggtttg

SEQ ID NO: 609762 - DNA, 25 bp, Mus musculus
ggcaccattctatcccctttaagag

SEQ ID NO: 609763 - DNA, 25 bp, Mus musculus
ggcaccattctatggaacaggtttg

SEQ ID NO: 609764 - DNA, 25 bp, Mus musculus
ggcaccattgatcaaattttgtttt

SEQ ID NO: 609765 - DNA, 25 bp, Mus musculus
ggcaccattgatgaaattttgtttt

SEQ ID NO: 609766 - DNA, 25 bp, Mus musculus
ggcaccattgccattcaagttggac

SEQ ID NO: 609767 - DNA, 25 bp, Mus musculus
ggcaccattgcctttcaagttggac

SEQ ID NO: 609768 - DNA, 25 bp, Mus musculus
ggcaccattggcagttgttagacta

SEQ ID NO: 609769 - DNA, 25 bp, Mus musculus
ggcaccattggctgttgttagacta

SEQ ID NO: 609770 - DNA, 25 bp, Mus musculus
ggcaccatttgcctaggctggatat

SEQ ID NO: 609771 - DNA, 25 bp, Mus musculus
ggcaccatttgcgtaggctggatat

SEQ ID NO: 609772 - DNA, 25 bp, Mus musculus
ggcacccaagagcagtctggcctat

SEQ ID NO: 609773 - DNA, 25 bp, Mus musculus
ggcacccaagaggagtctggcctat

SEQ ID NO: 609774 - DNA, 25 bp, Mus musculus
ggcacccaaggactagctaaccagg

SEQ ID NO: 609775 - DNA, 25 bp, Mus musculus
ggcacccaaggagtagctaaccagg

SEQ ID NO: 609776 - DNA, 25 bp, Mus musculus
ggcacccaagtcattaggctcagag

SEQ ID NO: 609777 - DNA, 25 bp, Mus musculus
ggcacccaagtctttaggctcagag

SEQ ID NO: 609778 - DNA, 25 bp, Mus musculus
ggcacccagccactactggatgtga

SEQ ID NO: 609779 - DNA, 25 bp, Mus musculus
ggcacccagccagtactggatgtga

SEQ ID NO: 609780 - DNA, 25 bp, Mus musculus
ggcacccaggtaagcacaaggcata

SEQ ID NO: 609781 - DNA, 25 bp, Mus musculus
ggcacccaggtatgcacaaggcata

SEQ ID NO: 609782 - DNA, 25 bp, Mus musculus
ggcacccatgatcccggtggaaaag

SEQ ID NO: 609783 - DNA, 25 bp, Mus musculus
ggcacccatgatgccggtggaaaag

SEQ ID NO: 609784 - DNA, 25 bp, Mus musculus
ggcaccccaattataattcatggac

SEQ ID NO: 609785 - DNA, 25 bp, Mus musculus
ggcaccccaattttaattcatggac

SEQ ID NO: 609786 - DNA, 25 bp, Mus musculus
ggcaccccagagaaatggctgctat

SEQ ID NO: 609787 - DNA, 25 bp, Mus musculus
ggcaccccagagtaatggctgctat

SEQ ID NO: 609788 - DNA, 25 bp, Mus musculus
ggcaccccagctattgacaattatt

SEQ ID NO: 609789 - DNA, 25 bp, Mus musculus
ggcaccccagcttttgacaattatt

SEQ ID NO: 609790 - DNA, 25 bp, Mus musculus
ggcaccccatcaaggtaaaccatac

SEQ ID NO: 609791 - DNA, 25 bp, Mus musculus
ggcaccccatcatggtaaaccatac

SEQ ID NO: 609792 - DNA, 25 bp, Mus musculus
ggcaccccgcagacagagctagaga

SEQ ID NO: 609793 - DNA, 25 bp, Mus musculus
ggcaccccgcagtcagagctagaga

SEQ ID NO: 609794 - DNA, 25 bp, Mus musculus
ggcaccccggaaacctgattgggat

SEQ ID NO: 609795 - DNA, 25 bp, Mus musculus
ggcaccccggaatcctgattgggat

SEQ ID NO: 609796 - DNA, 25 bp, Mus musculus
ggcacccctattagtgattctatgg

SEQ ID NO: 609797 - DNA, 25 bp, Mus musculus
ggcacccctatttgtgattctatgg

SEQ ID NO: 609798 - DNA, 25 bp, Mus musculus
ggcacccctgacaggagctgagcag

SEQ ID NO: 609799 - DNA, 25 bp, Mus musculus
ggcacccctgactggagctgagcag

SEQ ID NO: 609800 - DNA, 25 bp, Mus musculus
ggcacccgaccaaggcgacggtgaa

SEQ ID NO: 609801 - DNA, 25 bp, Mus musculus
ggcacccgaccatggcgacggtgaa

SEQ ID NO: 609802 - DNA, 25 bp, Mus musculus
ggcacccgtggaagatgtatacatt

SEQ ID NO: 609803 - DNA, 25 bp, Mus musculus
ggcacccgtggatgatgtatacatt

SEQ ID NO: 609804 - DNA, 25 bp, Mus musculus
ggcaccctaataatagttccgtcac

SEQ ID NO: 609805 - DNA, 25 bp, Mus musculus
ggcaccctaatattagttccgtcac

SEQ ID NO: 609806 - DNA, 25 bp, Mus musculus
ggcaccctcagaaggtcagacacca

SEQ ID NO: 609807 - DNA, 25 bp, Mus musculus
ggcaccctcagatggtcagacacca

SEQ ID NO: 609808 - DNA, 25 bp, Mus musculus
ggcaccctcatcatttggtgacata

SEQ ID NO: 609809 - DNA, 25 bp, Mus musculus
ggcaccctcatcttttggtgacata

SEQ ID NO: 609810 - DNA, 25 bp, Mus musculus
ggcaccctgaacctcaggccctgtg

SEQ ID NO: 609811 - DNA, 25 bp, Mus musculus
ggcaccctgaacgtcaggccctgtg

SEQ ID NO: 609812 - DNA, 25 bp, Mus musculus
ggcaccctgatgaatgtttaaagcc

SEQ ID NO: 609813 - DNA, 25 bp, Mus musculus
ggcaccctgatgtatgtttaaagcc

SEQ ID NO: 609814 - DNA, 25 bp, Mus musculus
ggcaccctgcttcgtagaagctcaa

SEQ ID NO: 609815 - DNA, 25 bp, Mus musculus
ggcaccctgcttggtagaagctcaa

SEQ ID NO: 609816 - DNA, 25 bp, Mus musculus
ggcaccctggttataatcccttgag

SEQ ID NO: 609817 - DNA, 25 bp, Mus musculus
ggcaccctggttttaatcccttgag

SEQ ID NO: 609818 - DNA, 25 bp, Mus musculus
ggcaccctgtctaaccagaatggat

SEQ ID NO: 609819 - DNA, 25 bp, Mus musculus
ggcaccctgtcttaccagaatggat

SEQ ID NO: 609820 - DNA, 25 bp, Mus musculus
ggcacccttagaacaggacaccggt

SEQ ID NO: 609821 - DNA, 25 bp, Mus musculus
ggcacccttagatcaggacaccggt

SEQ ID NO: 609822 - DNA, 25 bp, Mus musculus
ggcaccgaataaacctgagctcaga

SEQ ID NO: 609823 - DNA, 25 bp, Mus musculus
ggcaccgaataatcctgagctcaga

SEQ ID NO: 609824 - DNA, 25 bp, Mus musculus
ggcaccgatgcaactgtttcatagc

SEQ ID NO: 609825 - DNA, 25 bp, Mus musculus
ggcaccgatgcatctgtttcatagc

SEQ ID NO: 609826 - DNA, 25 bp, Mus musculus
ggcaccgcggataagatttcttcag

SEQ ID NO: 609827 - DNA, 25 bp, Mus musculus
ggcaccgcggattagatttcttcag

SEQ ID NO: 609828 - DNA, 25 bp, Mus musculus
ggcaccggaagaatgctatgaacat

SEQ ID NO: 609829 - DNA, 25 bp, Mus musculus
ggcaccggaagattgctatgaacat

SEQ ID NO: 609830 - DNA, 25 bp, Mus musculus
ggcaccggaattatatgcgatgggt

SEQ ID NO: 609831 - DNA, 25 bp, Mus musculus
ggcaccggaattttatgcgatgggt

SEQ ID NO: 609832 - DNA, 25 bp, Mus musculus
ggcaccggagaccttggaaccagaa

SEQ ID NO: 609833 - DNA, 25 bp, Mus musculus
ggcaccggagacgttggaaccagaa

SEQ ID NO: 609834 - DNA, 25 bp, Mus musculus
ggcaccggatccaagggaaaaagag

SEQ ID NO: 609835 - DNA, 25 bp, Mus musculus
ggcaccggatcctagggaaaaagag

SEQ ID NO: 609836 - DNA, 25 bp, Mus musculus
ggcaccggcaaacctgaagtggtta

SEQ ID NO: 609837 - DNA, 25 bp, Mus musculus
ggcaccggcaaagctgaagtggtta

SEQ ID NO: 609838 - DNA, 25 bp, Mus musculus
ggcaccgggcccagattttattggg

SEQ ID NO: 609839 - DNA, 25 bp, Mus musculus
ggcaccgggccctgattttattggg

SEQ ID NO: 609840 - DNA, 25 bp, Mus musculus
ggcaccggtgggatctaggaacaca

SEQ ID NO: 609841 - DNA, 25 bp, Mus musculus
ggcaccggtgggttctaggaacaca

SEQ ID NO: 609842 - DNA, 25 bp, Mus musculus
ggcaccgtgagtagggcctgaccac

SEQ ID NO: 609843 - DNA, 25 bp, Mus musculus
ggcaccgtgagttgggcctgaccac

SEQ ID NO: 609844 - DNA, 25 bp, Mus musculus
ggcaccgtggaaatggttcctcata

SEQ ID NO: 609845 - DNA, 25 bp, Mus musculus
ggcaccgtggaattggttcctcata

SEQ ID NO: 609846 - DNA, 25 bp, Mus musculus
ggcaccgttgtcatgtcgagagcaa

SEQ ID NO: 609847 - DNA, 25 bp, Mus musculus
ggcaccgttgtcttgtcgagagcaa

SEQ ID NO: 609848 - DNA, 25 bp, Mus musculus
ggcacctaaagaatttctaccgcag

SEQ ID NO: 609849 - DNA, 25 bp, Mus musculus
ggcacctaaagattttctaccgcag

SEQ ID NO: 609850 - DNA, 25 bp, Mus musculus
ggcacctaagccagatggcccagga

SEQ ID NO: 609851 - DNA, 25 bp, Mus musculus
ggcacctaagcctgatggcccagga

SEQ ID NO: 609852 - DNA, 25 bp, Mus musculus
ggcacctaccgtacaagagttggct

SEQ ID NO: 609853 - DNA, 25 bp, Mus musculus
ggcacctaccgttcaagagttggct

SEQ ID NO: 609854 - DNA, 25 bp, Mus musculus
ggcacctactacattcaaacctgtg

SEQ ID NO: 609855 - DNA, 25 bp, Mus musculus
ggcacctactactttcaaacctgtg

SEQ ID NO: 609856 - DNA, 25 bp, Mus musculus
ggcacctactagaattggacaccgt

SEQ ID NO: 609857 - DNA, 25 bp, Mus musculus
ggcacctactagtattggacaccgt

SEQ ID NO: 609858 - DNA, 25 bp, Mus musculus
ggcacctacttactgtatcttgatt

SEQ ID NO: 609859 - DNA, 25 bp, Mus musculus
ggcacctacttagtgtatcttgatt

SEQ ID NO: 609860 - DNA, 25 bp, Mus musculus
ggcacctaggatatggacgcgcaac

SEQ ID NO: 609861 - DNA, 25 bp, Mus musculus
ggcacctaggatttggacgcgcaac

SEQ ID NO: 609862 - DNA, 25 bp, Mus musculus
ggcacctataggattttgaacagat

SEQ ID NO: 609863 - DNA, 25 bp, Mus musculus
ggcacctataggtttttgaacagat

SEQ ID NO: 609864 - DNA, 25 bp, Mus musculus
ggcacctatcctcatgtacatatat

SEQ ID NO: 609865 - DNA, 25 bp, Mus musculus
ggcacctatcctgatgtacatatat

SEQ ID NO: 609866 - DNA, 25 bp, Mus musculus
ggcacctattggcttggagctgtaa

SEQ ID NO: 609867 - DNA, 25 bp, Mus musculus
ggcacctattgggttggagctgtaa

SEQ ID NO: 609868 - DNA, 25 bp, Mus musculus
ggcacctcaagcattgctttatgtt

SEQ ID NO: 609869 - DNA, 25 bp, Mus musculus
ggcacctcaagctttgctttatgtt

SEQ ID NO: 609870 - DNA, 25 bp, Mus musculus
ggcacctcagatctaatctgcccaa

SEQ ID NO: 609871 - DNA, 25 bp, Mus musculus
ggcacctcagatgtaatctgcccaa

SEQ ID NO: 609872 - DNA, 25 bp, Mus musculus
ggcacctcagttaagtcaataagca

SEQ ID NO: 609873 - DNA, 25 bp, Mus musculus
ggcacctcagtttagtcaataagca

SEQ ID NO: 609874 - DNA, 25 bp, Mus musculus
ggcacctcatccagggcttgcagaa

SEQ ID NO: 609875 - DNA, 25 bp, Mus musculus
ggcacctcatcctgggcttgcagaa

SEQ ID NO: 609876 - DNA, 25 bp, Mus musculus
ggcacctcatttaggtagcagtatt

SEQ ID NO: 609877 - DNA, 25 bp, Mus musculus
ggcacctcattttggtagcagtatt

SEQ ID NO: 609878 - DNA, 25 bp, Mus musculus
ggcacctccctgatggtggacggtt

SEQ ID NO: 609879 - DNA, 25 bp, Mus musculus
ggcacctccctgttggtggacggtt

SEQ ID NO: 609880 - DNA, 25 bp, Mus musculus
ggcacctccgtgagcataatgtcaa

SEQ ID NO: 609881 - DNA, 25 bp, Mus musculus
ggcacctccgtgtgcataatgtcaa

SEQ ID NO: 609882 - DNA, 25 bp, Mus musculus
ggcacctctactaacttatcattgt

SEQ ID NO: 609883 - DNA, 25 bp, Mus musculus
ggcacctctacttacttatcattgt

SEQ ID NO: 609884 - DNA, 25 bp, Mus musculus
ggcacctctcataccttatgatgat

SEQ ID NO: 609885 - DNA, 25 bp, Mus musculus
ggcacctctcattccttatgatgat

SEQ ID NO: 609886 - DNA, 25 bp, Mus musculus
ggcacctgaagcactgagtcctgga

SEQ ID NO: 609887 - DNA, 25 bp, Mus musculus
ggcacctgaagctctgagtcctgga

SEQ ID NO: 609888 - DNA, 25 bp, Mus musculus
ggcacctgacaaccggctcaaggca

SEQ ID NO: 609889 - DNA, 25 bp, Mus musculus
ggcacctgacaagcggctcaaggca

SEQ ID NO: 609890 - DNA, 25 bp, Mus musculus
ggcacctgacagcaatcatacctaa

SEQ ID NO: 609891 - DNA, 25 bp, Mus musculus
ggcacctgacaggaatcatacctaa

SEQ ID NO: 609892 - DNA, 25 bp, Mus musculus
ggcacctgagaaaatgggtaacctc

SEQ ID NO: 609893 - DNA, 25 bp, Mus musculus
ggcacctgagaatatgggtaacctc

SEQ ID NO: 609894 - DNA, 25 bp, Mus musculus
ggcacctgagcactgatgatctgtt

SEQ ID NO: 609895 - DNA, 25 bp, Mus musculus
ggcacctgagcagtgatgatctgtt

SEQ ID NO: 609896 - DNA, 25 bp, Mus musculus
ggcacctgatgcatttagttctgaa

SEQ ID NO: 609897 - DNA, 25 bp, Mus musculus
ggcacctgatgcttttagttctgaa

SEQ ID NO: 609898 - DNA, 25 bp, Mus musculus
ggcacctgatttaaatccttgagtc

SEQ ID NO: 609899 - DNA, 25 bp, Mus musculus
ggcacctgattttaatccttgagtc

SEQ ID NO: 609900 - DNA, 25 bp, Mus musculus
ggcacctgcctaaagggttacggtt

SEQ ID NO: 609901 - DNA, 25 bp, Mus musculus
ggcacctgcctatagggttacggtt

SEQ ID NO: 609902 - DNA, 25 bp, Mus musculus
ggcacctgctatagaccatgctagc

SEQ ID NO: 609903 - DNA, 25 bp, Mus musculus
ggcacctgctattgaccatgctagc

SEQ ID NO: 609904 - DNA, 25 bp, Mus musculus
ggcacctgctgcagttagggccaat

SEQ ID NO: 609905 - DNA, 25 bp, Mus musculus
ggcacctgctgctgttagggccaat

SEQ ID NO: 609906 - DNA, 25 bp, Mus musculus
ggcacctgctgtactttcagagagc

SEQ ID NO: 609907 - DNA, 25 bp, Mus musculus
ggcacctgctgttctttcagagagc

SEQ ID NO: 609908 - DNA, 25 bp, Mus musculus
ggcacctggatgacctacagtgtca

SEQ ID NO: 609909 - DNA, 25 bp, Mus musculus
ggcacctggatgtcctacagtgtca

SEQ ID NO: 609910 - DNA, 25 bp, Mus musculus
ggcacctgggcaatgactttgtttc

SEQ ID NO: 609911 - DNA, 25 bp, Mus musculus
ggcacctgggcattgactttgtttc

SEQ ID NO: 609912 - DNA, 25 bp, Mus musculus
ggcacctgtaacaggccatagtgtc

SEQ ID NO: 609913 - DNA, 25 bp, Mus musculus
ggcacctgtaactggccatagtgtc

SEQ ID NO: 609914 - DNA, 25 bp, Mus musculus
ggcacctgtactcatatttgtaaac

SEQ ID NO: 609915 - DNA, 25 bp, Mus musculus
ggcacctgtactgatatttgtaaac

SEQ ID NO: 609916 - DNA, 25 bp, Mus musculus
ggcacctgtgatctccatgtttaga

SEQ ID NO: 609917 - DNA, 25 bp, Mus musculus
ggcacctgtgatgtccatgtttaga

SEQ ID NO: 609918 - DNA, 25 bp, Mus musculus
ggcacctgtgtcaacgtgggttgca

SEQ ID NO: 609919 - DNA, 25 bp, Mus musculus
ggcacctgtgtctacgtgggttgca

SEQ ID NO: 609920 - DNA, 25 bp, Mus musculus
ggcacctgtgtgaaaagtcgggcat

SEQ ID NO: 609921 - DNA, 25 bp, Mus musculus
ggcacctgtgtgtaaagtcgggcat

SEQ ID NO: 609922 - DNA, 25 bp, Mus musculus
ggcaccttcggaatgtcctcagtga

SEQ ID NO: 609923 - DNA, 25 bp, Mus musculus
ggcaccttcggattgtcctcagtga

SEQ ID NO: 609924 - DNA, 25 bp, Mus musculus
ggcaccttctgcctgagattaaaga

SEQ ID NO: 609925 - DNA, 25 bp, Mus musculus
ggcaccttctgcgtgagattaaaga

SEQ ID NO: 609926 - DNA, 25 bp, Mus musculus
ggcaccttctttcttccataagaac

SEQ ID NO: 609927 - DNA, 25 bp, Mus musculus
ggcaccttctttgttccataagaac

SEQ ID NO: 609928 - DNA, 25 bp, Mus musculus
ggcaccttgactctttgaaccaaag

SEQ ID NO: 609929 - DNA, 25 bp, Mus musculus
ggcaccttgactgtttgaaccaaag

SEQ ID NO: 609930 - DNA, 25 bp, Mus musculus
ggcaccttgcctcatcaaagatgtt

SEQ ID NO: 609931 - DNA, 25 bp, Mus musculus
ggcaccttgcctgatcaaagatgtt

SEQ ID NO: 609932 - DNA, 25 bp, Mus musculus
ggcaccttggctcttaatatctttc

SEQ ID NO: 609933 - DNA, 25 bp, Mus musculus
ggcaccttggctgttaatatctttc

SEQ ID NO: 609934 - DNA, 25 bp, Mus musculus
ggcaccttgtagagcaaatcagcac

SEQ ID NO: 609935 - DNA, 25 bp, Mus musculus
ggcaccttgtagtgcaaatcagcac

SEQ ID NO: 609936 - DNA, 25 bp, Mus musculus
ggcacctttggtcgtctattccaag

SEQ ID NO: 609937 - DNA, 25 bp, Mus musculus
ggcacctttggtggtctattccaag

SEQ ID NO: 609938 - DNA, 25 bp, Mus musculus
ggcacctttgtgatacctgtatgct

SEQ ID NO: 609939 - DNA, 25 bp, Mus musculus
ggcacctttgtgttacctgtatgct

SEQ ID NO: 609940 - DNA, 25 bp, Mus musculus
ggcaccttttcaaaaacacgttgct

SEQ ID NO: 609941 - DNA, 25 bp, Mus musculus
ggcaccttttcataaacacgttgct

SEQ ID NO: 609942 - DNA, 25 bp, Mus musculus
ggcacgacaagcacagttggcacaa

SEQ ID NO: 609943 - DNA, 25 bp, Mus musculus
ggcacgacaagctcagttggcacaa

SEQ ID NO: 609944 - DNA, 25 bp, Mus musculus
ggcacgactcctcctttaagaaaca

SEQ ID NO: 609945 - DNA, 25 bp, Mus musculus
ggcacgactcctgctttaagaaaca

SEQ ID NO: 609946 - DNA, 25 bp, Mus musculus
ggcacgagaagaaccacaccactgg

SEQ ID NO: 609947 - DNA, 25 bp, Mus musculus
ggcacgagaagatccacaccactgg

SEQ ID NO: 609948 - DNA, 25 bp, Mus musculus
ggcacgagccaaaaaccatgcacgg

SEQ ID NO: 609949 - DNA, 25 bp, Mus musculus
ggcacgagccaataaccatgcacgg

SEQ ID NO: 609950 - DNA, 25 bp, Mus musculus
ggcacgaggcatacatctccatgga

SEQ ID NO: 609951 - DNA, 25 bp, Mus musculus
ggcacgaggcattcatctccatgga

SEQ ID NO: 609952 - DNA, 25 bp, Mus musculus
ggcacgatgcagacatgttttcaca

SEQ ID NO: 609953 - DNA, 25 bp, Mus musculus
ggcacgatgcagtcatgttttcaca

SEQ ID NO: 609954 - DNA, 25 bp, Mus musculus
ggcacgatggcacgtttgagcccat

SEQ ID NO: 609955 - DNA, 25 bp, Mus musculus
ggcacgatggcaggtttgagcccat

SEQ ID NO: 609956 - DNA, 25 bp, Mus musculus
ggcacgatgtgaatacttaatttct

SEQ ID NO: 609957 - DNA, 25 bp, Mus musculus
ggcacgatgtgattacttaatttct

SEQ ID NO: 609958 - DNA, 25 bp, Mus musculus
ggcacgattaatcctgtgatcctca

SEQ ID NO: 609959 - DNA, 25 bp, Mus musculus
ggcacgattaatgctgtgatcctca

SEQ ID NO: 609960 - DNA, 25 bp, Mus musculus
ggcacgattagcagctctggatatt

SEQ ID NO: 609961 - DNA, 25 bp, Mus musculus
ggcacgattagctgctctggatatt

SEQ ID NO: 609962 - DNA, 25 bp, Mus musculus
ggcacgatttcaatgcatcctagac

SEQ ID NO: 609963 - DNA, 25 bp, Mus musculus
ggcacgatttcattgcatcctagac

SEQ ID NO: 609964 - DNA, 25 bp, Mus musculus
ggcacgatttccaagcttgacggct

SEQ ID NO: 609965 - DNA, 25 bp, Mus musculus
ggcacgatttcctagcttgacggct

SEQ ID NO: 609966 - DNA, 25 bp, Mus musculus
ggcacgcactcactacaagtctaga

SEQ ID NO: 609967 - DNA, 25 bp, Mus musculus
ggcacgcactcagtacaagtctaga

SEQ ID NO: 609968 - DNA, 25 bp, Mus musculus
ggcacgccactgaagtgtcatatct

SEQ ID NO: 609969 - DNA, 25 bp, Mus musculus
ggcacgccactgtagtgtcatatct

SEQ ID NO: 609970 - DNA, 25 bp, Mus musculus
ggcacgccgggcaacctggaacaag

SEQ ID NO: 609971 - DNA, 25 bp, Mus musculus
ggcacgccgggctacctggaacaag

SEQ ID NO: 609972 - DNA, 25 bp, Mus musculus
ggcacgctagctatctctgtcactc

SEQ ID NO: 609973 - DNA, 25 bp, Mus musculus
ggcacgctagctttctctgtcactc

SEQ ID NO: 609974 - DNA, 25 bp, Mus musculus
ggcacgctagtcagaaggtcctgat

SEQ ID NO: 609975 - DNA, 25 bp, Mus musculus
ggcacgctagtctgaaggtcctgat

SEQ ID NO: 609976 - DNA, 25 bp, Mus musculus
ggcacgctccaccacagggacaggt

SEQ ID NO: 609977 - DNA, 25 bp, Mus musculus
ggcacgctccacgacagggacaggt

SEQ ID NO: 609978 - DNA, 25 bp, Mus musculus
ggcacgctgattatcacctttaaaa

SEQ ID NO: 609979 - DNA, 25 bp, Mus musculus
ggcacgctgattttcacctttaaaa

SEQ ID NO: 609980 - DNA, 25 bp, Mus musculus
ggcacgcttagcagacaggacacag

SEQ ID NO: 609981 - DNA, 25 bp, Mus musculus
ggcacgcttagctgacaggacacag

SEQ ID NO: 609982 - DNA, 25 bp, Mus musculus
ggcacgcttttccaatttcttcagg

SEQ ID NO: 609983 - DNA, 25 bp, Mus musculus
ggcacgcttttcgaatttcttcagg

SEQ ID NO: 609984 - DNA, 25 bp, Mus musculus
ggcacggaaacactatgcttctgag

SEQ ID NO: 609985 - DNA, 25 bp, Mus musculus
ggcacggaaacagtatgcttctgag

SEQ ID NO: 609986 - DNA, 25 bp, Mus musculus
ggcacggagcgtaaaccacacctta

SEQ ID NO: 609987 - DNA, 25 bp, Mus musculus
ggcacggagcgttaaccacacctta

SEQ ID NO: 609988 - DNA, 25 bp, Mus musculus
ggcacggaggctattctcagtctca

SEQ ID NO: 609989 - DNA, 25 bp, Mus musculus
ggcacggaggcttttctcagtctca

SEQ ID NO: 609990 - DNA, 25 bp, Mus musculus
ggcacggcaatgaggataccatcag

SEQ ID NO: 609991 - DNA, 25 bp, Mus musculus
ggcacggcaatgtggataccatcag

SEQ ID NO: 609992 - DNA, 25 bp, Mus musculus
ggcacggcacccagtggagatcaga

SEQ ID NO: 609993 - DNA, 25 bp, Mus musculus
ggcacggcaccctgtggagatcaga

SEQ ID NO: 609994 - DNA, 25 bp, Mus musculus
ggcacggcagcaccaagtagcactt

SEQ ID NO: 609995 - DNA, 25 bp, Mus musculus
ggcacggcagcagcaagtagcactt

SEQ ID NO: 609996 - DNA, 25 bp, Mus musculus
ggcacggccactagtccgacttgcg

SEQ ID NO: 609997 - DNA, 25 bp, Mus musculus
ggcacggccacttgtccgacttgcg

SEQ ID NO: 609998 - DNA, 25 bp, Mus musculus
ggcacggctgaccaggcccggacgg

SEQ ID NO: 609999 - DNA, 25 bp, Mus musculus
ggcacggctgacgaggcccggacgg

SEQ ID NO: 610000 - DNA, 25 bp, Mus musculus
ggcacggctgctctgattgtgaata

SEQ ID NO: 610001 - DNA, 25 bp, Mus musculus
ggcacggctgctgtgattgtgaata

SEQ ID NO: 610002 - DNA, 25 bp, Mus musculus
ggcacgggaagcagaaccgtctctg

SEQ ID NO: 610003 - DNA, 25 bp, Mus musculus
ggcacgggaagctgaaccgtctctg

SEQ ID NO: 610004 - DNA, 25 bp, Mus musculus
ggcacgggtggaccgtataaaaaca

SEQ ID NO: 610005 - DNA, 25 bp, Mus musculus
ggcacgggtggagcgtataaaaaca

SEQ ID NO: 610006 - DNA, 25 bp, Mus musculus
ggcacggtagtactatgcccaattt

SEQ ID NO: 610007 - DNA, 25 bp, Mus musculus
ggcacggtagtagtatgcccaattt

SEQ ID NO: 610008 - DNA, 25 bp, Mus musculus
ggcacggtgaacatccgcacgagag

SEQ ID NO: 610009 - DNA, 25 bp, Mus musculus
ggcacggtgaacttccgcacgagag

SEQ ID NO: 610010 - DNA, 25 bp, Mus musculus
ggcacggtggctcaacagctttaat

SEQ ID NO: 610011 - DNA, 25 bp, Mus musculus
ggcacggtggctgaacagctttaat

SEQ ID NO: 610012 - DNA, 25 bp, Mus musculus
ggcacggttccacttcaaatgacat

SEQ ID NO: 610013 - DNA, 25 bp, Mus musculus
ggcacggttccagttcaaatgacat

SEQ ID NO: 610014 - DNA, 25 bp, Mus musculus
ggcacggttcccacaatggtgtaca

SEQ ID NO: 610015 - DNA, 25 bp, Mus musculus
ggcacggttccctcaatggtgtaca

SEQ ID NO: 610016 - DNA, 25 bp, Mus musculus
ggcacggttgtcattaggcacactt

SEQ ID NO: 610017 - DNA, 25 bp, Mus musculus
ggcacggttgtctttaggcacactt

SEQ ID NO: 610018 - DNA, 25 bp, Mus musculus
ggcacgtaggaaagcaccgcaacca

SEQ ID NO: 610019 - DNA, 25 bp, Mus musculus
ggcacgtaggaatgcaccgcaacca

SEQ ID NO: 610020 - DNA, 25 bp, Mus musculus
ggcacgtgagaaagtatcccgttga

SEQ ID NO: 610021 - DNA, 25 bp, Mus musculus
ggcacgtgagaatgtatcccgttga

SEQ ID NO: 610022 - DNA, 25 bp, Mus musculus
ggcacgtgcaatattcattgttcta

SEQ ID NO: 610023 - DNA, 25 bp, Mus musculus
ggcacgtgcaattttcattgttcta

SEQ ID NO: 610024 - DNA, 25 bp, Mus musculus
ggcacgtgttttaatattcaggaga

SEQ ID NO: 610025 - DNA, 25 bp, Mus musculus
ggcacgtgtttttatattcaggaga

SEQ ID NO: 610026 - DNA, 25 bp, Mus musculus
ggcacgttacgacctgtgggtttcc

SEQ ID NO: 610027 - DNA, 25 bp, Mus musculus
ggcacgttacgagctgtgggtttcc

SEQ ID NO: 610028 - DNA, 25 bp, Mus musculus
ggcacgttcaatctgacatgtcaga

SEQ ID NO: 610029 - DNA, 25 bp, Mus musculus
ggcacgttcaatgtgacatgtcaga

SEQ ID NO: 610030 - DNA, 25 bp, Mus musculus
ggcacgttccacatataaattgtaa

SEQ ID NO: 610031 - DNA, 25 bp, Mus musculus
ggcacgttccacttataaattgtaa

SEQ ID NO: 610032 - DNA, 25 bp, Mus musculus
ggcacgttgccaatctggatgtcat

SEQ ID NO: 610033 - DNA, 25 bp, Mus musculus
ggcacgttgccattctggatgtcat

SEQ ID NO: 610034 - DNA, 25 bp, Mus musculus
ggcacgtttctgattgcattgtgaa

SEQ ID NO: 610035 - DNA, 25 bp, Mus musculus
ggcacgtttctgtttgcattgtgaa

SEQ ID NO: 610036 - DNA, 25 bp, Mus musculus
ggcacgtttggaatgatgtcagcag

SEQ ID NO: 610037 - DNA, 25 bp, Mus musculus
ggcacgtttggattgatgtcagcag

SEQ ID NO: 610038 - DNA, 25 bp, Mus musculus
ggcacgtttggtcaggctgcatccc

SEQ ID NO: 610039 - DNA, 25 bp, Mus musculus
ggcacgtttggtgaggctgcatccc

SEQ ID NO: 610040 - DNA, 25 bp, Mus musculus
ggcactaagaccagttttgttttca

SEQ ID NO: 610041 - DNA, 25 bp, Mus musculus
ggcactaagacctgttttgttttca

SEQ ID NO: 610042 - DNA, 25 bp, Mus musculus
ggcactaagcagatagcccatctat

SEQ ID NO: 610043 - DNA, 25 bp, Mus musculus
ggcactaagcagttagcccatctat

SEQ ID NO: 610044 - DNA, 25 bp, Mus musculus
ggcactaagcctaatttgaagatca

SEQ ID NO: 610045 - DNA, 25 bp, Mus musculus
ggcactaagccttatttgaagatca

SEQ ID NO: 610046 - DNA, 25 bp, Mus musculus
ggcactaagtaaacctgaccaatta

SEQ ID NO: 610047 - DNA, 25 bp, Mus musculus
ggcactaagtaatcctgaccaatta

SEQ ID NO: 610048 - DNA, 25 bp, Mus musculus
ggcactaatacaccccatggctgtt

SEQ ID NO: 610049 - DNA, 25 bp, Mus musculus
ggcactaatacagcccatggctgtt

SEQ ID NO: 610050 - DNA, 25 bp, Mus musculus
ggcactaatcttactcatgaggctt

SEQ ID NO: 610051 - DNA, 25 bp, Mus musculus
ggcactaatctttctcatgaggctt

SEQ ID NO: 610052 - DNA, 25 bp, Mus musculus
ggcactaatgccaatactttctccc

SEQ ID NO: 610053 - DNA, 25 bp, Mus musculus
ggcactaatgcctatactttctccc

SEQ ID NO: 610054 - DNA, 25 bp, Mus musculus
ggcactaattctcggaaccggcaca

SEQ ID NO: 610055 - DNA, 25 bp, Mus musculus
ggcactaattctgggaaccggcaca

SEQ ID NO: 610056 - DNA, 25 bp, Mus musculus
ggcactaatttgatcagggatctca

SEQ ID NO: 610057 - DNA, 25 bp, Mus musculus
ggcactaatttgttcagggatctca

SEQ ID NO: 610058 - DNA, 25 bp, Mus musculus
ggcactacagctcttcttatcttag

SEQ ID NO: 610059 - DNA, 25 bp, Mus musculus
ggcactacagctgttcttatcttag

SEQ ID NO: 610060 - DNA, 25 bp, Mus musculus
ggcactaccgcgaggcgacctgctg

SEQ ID NO: 610061 - DNA, 25 bp, Mus musculus
ggcactaccgcgtggcgacctgctg

SEQ ID NO: 610062 - DNA, 25 bp, Mus musculus
ggcactagaaaacatgtctttgcaa

SEQ ID NO: 610063 - DNA, 25 bp, Mus musculus
ggcactagaaaagatgtctttgcaa

SEQ ID NO: 610064 - DNA, 25 bp, Mus musculus
ggcactagaaatattcctgcaataa

SEQ ID NO: 610065 - DNA, 25 bp, Mus musculus
ggcactagaaattttcctgcaataa

SEQ ID NO: 610066 - DNA, 25 bp, Mus musculus
ggcactagacgaacttttgttttta

SEQ ID NO: 610067 - DNA, 25 bp, Mus musculus
ggcactagacgatcttttgttttta

SEQ ID NO: 610068 - DNA, 25 bp, Mus musculus
ggcactagagttagtgtgctagccc

SEQ ID NO: 610069 - DNA, 25 bp, Mus musculus
ggcactagagtttgtgtgctagccc

SEQ ID NO: 610070 - DNA, 25 bp, Mus musculus
ggcactagtgacacctggtaccagg

SEQ ID NO: 610071 - DNA, 25 bp, Mus musculus
ggcactagtgactcctggtaccagg

SEQ ID NO: 610072 - DNA, 25 bp, Mus musculus
ggcactatccatactgagcctagaa

SEQ ID NO: 610073 - DNA, 25 bp, Mus musculus
ggcactatccattctgagcctagaa

SEQ ID NO: 610074 - DNA, 25 bp, Mus musculus
ggcactatctccctaaaatgtctac

SEQ ID NO: 610075 - DNA, 25 bp, Mus musculus
ggcactatctccgtaaaatgtctac

SEQ ID NO: 610076 - DNA, 25 bp, Mus musculus
ggcactatgagtaagaagcttttct

SEQ ID NO: 610077 - DNA, 25 bp, Mus musculus
ggcactatgagttagaagcttttct

SEQ ID NO: 610078 - DNA, 25 bp, Mus musculus
ggcactatgatacacctggacccag

SEQ ID NO: 610079 - DNA, 25 bp, Mus musculus
ggcactatgatagacctggacccag

SEQ ID NO: 610080 - DNA, 25 bp, Mus musculus
ggcactatggagattcccttgtggt

SEQ ID NO: 610081 - DNA, 25 bp, Mus musculus
ggcactatggagtttcccttgtggt

SEQ ID NO: 610082 - DNA, 25 bp, Mus musculus
ggcactattaacattctgaccataa

SEQ ID NO: 610083 - DNA, 25 bp, Mus musculus
ggcactattaactttctgaccataa

SEQ ID NO: 610084 - DNA, 25 bp, Mus musculus
ggcactattaagaattgtgaccttg

SEQ ID NO: 610085 - DNA, 25 bp, Mus musculus
ggcactattaagtattgtgaccttg

SEQ ID NO: 610086 - DNA, 25 bp, Mus musculus
ggcactcaacagcagtcttgcttag

SEQ ID NO: 610087 - DNA, 25 bp, Mus musculus
ggcactcaacagctctgaggaggat

SEQ ID NO: 610088 - DNA, 25 bp, Mus musculus
ggcactcaacaggagtcttgcttag

SEQ ID NO: 610089 - DNA, 25 bp, Mus musculus
ggcactcaacaggtctgaggaggat

SEQ ID NO: 610090 - DNA, 25 bp, Mus musculus
ggcactcaacatagctctgcaggta

SEQ ID NO: 610091 - DNA, 25 bp, Mus musculus
ggcactcaacattgctctgcaggta

SEQ ID NO: 610092 - DNA, 25 bp, Mus musculus
ggcactcaagcccaacaaactgagt

SEQ ID NO: 610093 - DNA, 25 bp, Mus musculus
ggcactcaagccgaacaaactgagt

SEQ ID NO: 610094 - DNA, 25 bp, Mus musculus
ggcactcaagtgaatgtcttcctga

SEQ ID NO: 610095 - DNA, 25 bp, Mus musculus
ggcactcaagtgtatgtcttcctga

SEQ ID NO: 610096 - DNA, 25 bp, Mus musculus
ggcactcaccaacctaggaaggctt

SEQ ID NO: 610097 - DNA, 25 bp, Mus musculus
ggcactcaccaagctaggaaggctt

SEQ ID NO: 610098 - DNA, 25 bp, Mus musculus
ggcactcaccgcacaggtagttggt

SEQ ID NO: 610099 - DNA, 25 bp, Mus musculus
ggcactcaccgctcaggtagttggt

SEQ ID NO: 610100 - DNA, 25 bp, Mus musculus
ggcactcacggcacattgtgcttgg

SEQ ID NO: 610101 - DNA, 25 bp, Mus musculus
ggcactcacggctcattgtgcttgg

SEQ ID NO: 610102 - DNA, 25 bp, Mus musculus
ggcactcactaccatgttcgacaaa

SEQ ID NO: 610103 - DNA, 25 bp, Mus musculus
ggcactcactacgatgttcgacaaa

SEQ ID NO: 610104 - DNA, 25 bp, Mus musculus
ggcactcagcatagttttcctaaca

SEQ ID NO: 610105 - DNA, 25 bp, Mus musculus
ggcactcagcatcttcagggacatc

SEQ ID NO: 610106 - DNA, 25 bp, Mus musculus
ggcactcagcatgttcagggacatc

SEQ ID NO: 610107 - DNA, 25 bp, Mus musculus
ggcactcagcattgttttcctaaca

SEQ ID NO: 610108 - DNA, 25 bp, Mus musculus
ggcactcaggataattgtttctggc

SEQ ID NO: 610109 - DNA, 25 bp, Mus musculus
ggcactcaggatcggagcaagcact

SEQ ID NO: 610110 - DNA, 25 bp, Mus musculus
ggcactcaggatgggagcaagcact

SEQ ID NO: 610111 - DNA, 25 bp, Mus musculus
ggcactcaggattattgtttctggc

SEQ ID NO: 610112 - DNA, 25 bp, Mus musculus
ggcactcagtaaaccttcttttggg

SEQ ID NO: 610113 - DNA, 25 bp, Mus musculus
ggcactcagtaatccttcttttggg

SEQ ID NO: 610114 - DNA, 25 bp, Mus musculus
ggcactcagtggcacgccaaatgaa

SEQ ID NO: 610115 - DNA, 25 bp, Mus musculus
ggcactcagtgggacgccaaatgaa

SEQ ID NO: 610116 - DNA, 25 bp, Mus musculus
ggcactcagttaaaatcccatatgg

SEQ ID NO: 610117 - DNA, 25 bp, Mus musculus
ggcactcagttataatcccatatgg

SEQ ID NO: 610118 - DNA, 25 bp, Mus musculus
ggcactcagtttagctcatatttga

SEQ ID NO: 610119 - DNA, 25 bp, Mus musculus
ggcactcagttttgctcatatttga

SEQ ID NO: 610120 - DNA, 25 bp, Mus musculus
ggcactcataaccaagccttgtgac

SEQ ID NO: 610121 - DNA, 25 bp, Mus musculus
ggcactcataacgaagccttgtgac

SEQ ID NO: 610122 - DNA, 25 bp, Mus musculus
ggcactcatgttagacatctgaatt

SEQ ID NO: 610123 - DNA, 25 bp, Mus musculus
ggcactcatgtttgacatctgaatt

SEQ ID NO: 610124 - DNA, 25 bp, Mus musculus
ggcactcattccattttcctataga

SEQ ID NO: 610125 - DNA, 25 bp, Mus musculus
ggcactcattcctttttcctataga

SEQ ID NO: 610126 - DNA, 25 bp, Mus musculus
ggcactcattttaccatacattgaa

SEQ ID NO: 610127 - DNA, 25 bp, Mus musculus
ggcactcatttttccatacattgaa

SEQ ID NO: 610128 - DNA, 25 bp, Mus musculus
ggcactccaaaaaagctacaagatg

SEQ ID NO: 610129 - DNA, 25 bp, Mus musculus
ggcactccaaaatagctacaagatg

SEQ ID NO: 610130 - DNA, 25 bp, Mus musculus
ggcactccagtcagcttaactgttg

SEQ ID NO: 610131 - DNA, 25 bp, Mus musculus
ggcactccagtctgcttaactgttg

SEQ ID NO: 610132 - DNA, 25 bp, Mus musculus
ggcactcccatgactgatttgacag

SEQ ID NO: 610133 - DNA, 25 bp, Mus musculus
ggcactcccatgtctgatttgacag

SEQ ID NO: 610134 - DNA, 25 bp, Mus musculus
ggcactccgaggacatcttggtagt

SEQ ID NO: 610135 - DNA, 25 bp, Mus musculus
ggcactccgaggtcatcttggtagt

SEQ ID NO: 610136 - DNA, 25 bp, Mus musculus
ggcactccttagcacggacttctaa

SEQ ID NO: 610137 - DNA, 25 bp, Mus musculus
ggcactccttaggacggacttctaa

SEQ ID NO: 610138 - DNA, 25 bp, Mus musculus
ggcactcgatccatggaaacgggtt

SEQ ID NO: 610139 - DNA, 25 bp, Mus musculus
ggcactcgatccttggaaacgggtt

SEQ ID NO: 610140 - DNA, 25 bp, Mus musculus
ggcactcggcaacaagggctcccta

SEQ ID NO: 610141 - DNA, 25 bp, Mus musculus
ggcactcggcaagaagggctcccta

SEQ ID NO: 610142 - DNA, 25 bp, Mus musculus
ggcactcggctacctagcgaatata

SEQ ID NO: 610143 - DNA, 25 bp, Mus musculus
ggcactcggctagctagcgaatata

SEQ ID NO: 610144 - DNA, 25 bp, Mus musculus
ggcactcgtgcaataaaaatggtgt

SEQ ID NO: 610145 - DNA, 25 bp, Mus musculus
ggcactcgtgcattaaaaatggtgt

SEQ ID NO: 610146 - DNA, 25 bp, Mus musculus
ggcactctactaatgatccgaacgg

SEQ ID NO: 610147 - DNA, 25 bp, Mus musculus
ggcactctactattgatccgaacgg

SEQ ID NO: 610148 - DNA, 25 bp, Mus musculus
ggcactctagacacgcatgcctggt

SEQ ID NO: 610149 - DNA, 25 bp, Mus musculus
ggcactctagactcgcatgcctggt

SEQ ID NO: 610150 - DNA, 25 bp, Mus musculus
ggcactctctacactcttgtgtaaa

SEQ ID NO: 610151 - DNA, 25 bp, Mus musculus
ggcactctctactctcttgtgtaaa

SEQ ID NO: 610152 - DNA, 25 bp, Mus musculus
ggcactctgcagctttagttactga

SEQ ID NO: 610153 - DNA, 25 bp, Mus musculus
ggcactctgcaggtttagttactga

SEQ ID NO: 610154 - DNA, 25 bp, Mus musculus
ggcactctggcaccaaagttggcta

SEQ ID NO: 610155 - DNA, 25 bp, Mus musculus
ggcactctggcagcaaagttggcta

SEQ ID NO: 610156 - DNA, 25 bp, Mus musculus
ggcactctgggaccccataaggaca

SEQ ID NO: 610157 - DNA, 25 bp, Mus musculus
ggcactctgggagcccataaggaca

SEQ ID NO: 610158 - DNA, 25 bp, Mus musculus
ggcactctgtgcagtttgtacttga

SEQ ID NO: 610159 - DNA, 25 bp, Mus musculus
ggcactctgtgctgtttgtacttga

SEQ ID NO: 610160 - DNA, 25 bp, Mus musculus
ggcactcttattattgcacactcat

SEQ ID NO: 610161 - DNA, 25 bp, Mus musculus
ggcactcttatttttgcacactcat

SEQ ID NO: 610162 - DNA, 25 bp, Mus musculus
ggcactcttcaaatcatctagcaat

SEQ ID NO: 610163 - DNA, 25 bp, Mus musculus
ggcactcttcaattcatctagcaat

SEQ ID NO: 610164 - DNA, 25 bp, Mus musculus
ggcactcttgacatataattttata

SEQ ID NO: 610165 - DNA, 25 bp, Mus musculus
ggcactcttgacttataattttata

SEQ ID NO: 610166 - DNA, 25 bp, Mus musculus
ggcactcttggtctagactcaccaa

SEQ ID NO: 610167 - DNA, 25 bp, Mus musculus
ggcactcttggtgtagactcaccaa

SEQ ID NO: 610168 - DNA, 25 bp, Mus musculus
ggcactctttgtcttggaagcctat

SEQ ID NO: 610169 - DNA, 25 bp, Mus musculus
ggcactctttgtgttggaagcctat

SEQ ID NO: 610170 - DNA, 25 bp, Mus musculus
ggcactgaaatgactagcctcccct

SEQ ID NO: 610171 - DNA, 25 bp, Mus musculus
ggcactgaaatgtctagcctcccct

SEQ ID NO: 610172 - DNA, 25 bp, Mus musculus
ggcactgaaccaatgagcctgagac

SEQ ID NO: 610173 - DNA, 25 bp, Mus musculus
ggcactgaaccattgagcctgagac

SEQ ID NO: 610174 - DNA, 25 bp, Mus musculus
ggcactgaacgccacatttattaca

SEQ ID NO: 610175 - DNA, 25 bp, Mus musculus
ggcactgaacgcgacatttattaca

SEQ ID NO: 610176 - DNA, 25 bp, Mus musculus
ggcactgaacttattgataaccaat

SEQ ID NO: 610177 - DNA, 25 bp, Mus musculus
ggcactgaactttttgataaccaat

SEQ ID NO: 610178 - DNA, 25 bp, Mus musculus
ggcactgaatgcacaggcggcgctc

SEQ ID NO: 610179 - DNA, 25 bp, Mus musculus
ggcactgaatgctcaggcggcgctc

SEQ ID NO: 610180 - DNA, 25 bp, Mus musculus
ggcactgaattcctgatccttctgt

SEQ ID NO: 610181 - DNA, 25 bp, Mus musculus
ggcactgaattcgtgatccttctgt

SEQ ID NO: 610182 - DNA, 25 bp, Mus musculus
ggcactgacaggatttgtcgtttac

SEQ ID NO: 610183 - DNA, 25 bp, Mus musculus
ggcactgacaggttttgtcgtttac

SEQ ID NO: 610184 - DNA, 25 bp, Mus musculus
ggcactgacgttaggttttgcaatt

SEQ ID NO: 610185 - DNA, 25 bp, Mus musculus
ggcactgacgtttggttttgcaatt

SEQ ID NO: 610186 - DNA, 25 bp, Mus musculus
ggcactgactacagcaggtggagat

SEQ ID NO: 610187 - DNA, 25 bp, Mus musculus
ggcactgactactgcaggtggagat

SEQ ID NO: 610188 - DNA, 25 bp, Mus musculus
ggcactgactgtccaagctgatcaa

SEQ ID NO: 610189 - DNA, 25 bp, Mus musculus
ggcactgactgtgcaagctgatcaa

SEQ ID NO: 610190 - DNA, 25 bp, Mus musculus
ggcactgagagacaacaggagcaaa

SEQ ID NO: 610191 - DNA, 25 bp, Mus musculus
ggcactgagagagaacaggagcaaa

SEQ ID NO: 610192 - DNA, 25 bp, Mus musculus
ggcactgagcaacaaggacctgcaa

SEQ ID NO: 610193 - DNA, 25 bp, Mus musculus
ggcactgagcaagaaggacctgcaa

SEQ ID NO: 610194 - DNA, 25 bp, Mus musculus
ggcactgagcatactgtaatattct

SEQ ID NO: 610195 - DNA, 25 bp, Mus musculus
ggcactgagcattctgtaatattct

SEQ ID NO: 610196 - DNA, 25 bp, Mus musculus
ggcactgatcgtcattgctttgaca

SEQ ID NO: 610197 - DNA, 25 bp, Mus musculus
ggcactgatcgtgattgctttgaca

SEQ ID NO: 610198 - DNA, 25 bp, Mus musculus
ggcactgatgataaagctttccaaa

SEQ ID NO: 610199 - DNA, 25 bp, Mus musculus
ggcactgatgattaagctttccaaa

SEQ ID NO: 610200 - DNA, 25 bp, Mus musculus
ggcactgatgctactgtgctgtttc

SEQ ID NO: 610201 - DNA, 25 bp, Mus musculus
ggcactgatgcttctgtgctgtttc

SEQ ID NO: 610202 - DNA, 25 bp, Mus musculus
ggcactgattagcacactgacgggt

SEQ ID NO: 610203 - DNA, 25 bp, Mus musculus
ggcactgattaggacactgacgggt

SEQ ID NO: 610204 - DNA, 25 bp, Mus musculus
ggcactgcaatcaagctttgcctaa

SEQ ID NO: 610205 - DNA, 25 bp, Mus musculus
ggcactgcaatctagctttgcctaa

SEQ ID NO: 610206 - DNA, 25 bp, Mus musculus
ggcactgcacagcaacacatggtta

SEQ ID NO: 610207 - DNA, 25 bp, Mus musculus
ggcactgcacaggaacacatggtta

SEQ ID NO: 610208 - DNA, 25 bp, Mus musculus
ggcactgcacttcgagcggctgaca

SEQ ID NO: 610209 - DNA, 25 bp, Mus musculus
ggcactgcacttggagcggctgaca

SEQ ID NO: 610210 - DNA, 25 bp, Mus musculus
ggcactgcagctcaggaacctgcta

SEQ ID NO: 610211 - DNA, 25 bp, Mus musculus
ggcactgcagctgaggaacctgcta

SEQ ID NO: 610212 - DNA, 25 bp, Mus musculus
ggcactgcagtcctgaggctaatta

SEQ ID NO: 610213 - DNA, 25 bp, Mus musculus
ggcactgcagtcgtgaggctaatta

SEQ ID NO: 610214 - DNA, 25 bp, Mus musculus
ggcactgcattgagggccgaaactt

SEQ ID NO: 610215 - DNA, 25 bp, Mus musculus
ggcactgcattgtgggccgaaactt

SEQ ID NO: 610216 - DNA, 25 bp, Mus musculus
ggcactgccagaagtgcatcagctt

SEQ ID NO: 610217 - DNA, 25 bp, Mus musculus
ggcactgccagatgtgcatcagctt

SEQ ID NO: 610218 - DNA, 25 bp, Mus musculus
ggcactgccataattttgggagcac

SEQ ID NO: 610219 - DNA, 25 bp, Mus musculus
ggcactgccatatttttgggagcac

SEQ ID NO: 610220 - DNA, 25 bp, Mus musculus
ggcactgccatcagcatactgtaag

SEQ ID NO: 610221 - DNA, 25 bp, Mus musculus
ggcactgccatctgcatactgtaag

SEQ ID NO: 610222 - DNA, 25 bp, Mus musculus
ggcactgccctaagcctacttggat

SEQ ID NO: 610223 - DNA, 25 bp, Mus musculus
ggcactgccctatgcctacttggat

SEQ ID NO: 610224 - DNA, 25 bp, Mus musculus
ggcactgcgctcaacgaagctgtgg

SEQ ID NO: 610225 - DNA, 25 bp, Mus musculus
ggcactgcgctctacgaagctgtgg

SEQ ID NO: 610226 - DNA, 25 bp, Mus musculus
ggcactgcggaaatacagctaccat

SEQ ID NO: 610227 - DNA, 25 bp, Mus musculus
ggcactgcggaattacagctaccat

SEQ ID NO: 610228 - DNA, 25 bp, Mus musculus
ggcactgctatgcaatttggtctca

SEQ ID NO: 610229 - DNA, 25 bp, Mus musculus
ggcactgctatggaatttggtctca

SEQ ID NO: 610230 - DNA, 25 bp, Mus musculus
ggcactgctcttctgagctatactc

SEQ ID NO: 610231 - DNA, 25 bp, Mus musculus
ggcactgctcttgtgagctatactc

SEQ ID NO: 610232 - DNA, 25 bp, Mus musculus
ggcactgctgttcctaagctttgaa

SEQ ID NO: 610233 - DNA, 25 bp, Mus musculus
ggcactgctgttgctaagctttgaa

SEQ ID NO: 610234 - DNA, 25 bp, Mus musculus
ggcactggaagtaccgtggacacac

SEQ ID NO: 610235 - DNA, 25 bp, Mus musculus
ggcactggaagttccgtggacacac

SEQ ID NO: 610236 - DNA, 25 bp, Mus musculus
ggcactggacacatgctttggatta

SEQ ID NO: 610237 - DNA, 25 bp, Mus musculus
ggcactggacacttgctttggatta

SEQ ID NO: 610238 - DNA, 25 bp, Mus musculus
ggcactggacatatgcttgcttatc

SEQ ID NO: 610239 - DNA, 25 bp, Mus musculus
ggcactggacatttgcttgcttatc

SEQ ID NO: 610240 - DNA, 25 bp, Mus musculus
ggcactggagatctcaagcttctga

SEQ ID NO: 610241 - DNA, 25 bp, Mus musculus
ggcactggagatgtcaagcttctga

SEQ ID NO: 610242 - DNA, 25 bp, Mus musculus
ggcactggagcaaatccctgagcta

SEQ ID NO: 610243 - DNA, 25 bp, Mus musculus
ggcactggagcatatccctgagcta

SEQ ID NO: 610244 - DNA, 25 bp, Mus musculus
ggcactggagctaacacagcacaca

SEQ ID NO: 610245 - DNA, 25 bp, Mus musculus
ggcactggagcttacacagcacaca

SEQ ID NO: 610246 - DNA, 25 bp, Mus musculus
ggcactggaggcaacatgcaggcta

SEQ ID NO: 610247 - DNA, 25 bp, Mus musculus
ggcactggaggctacatgcaggcta

SEQ ID NO: 610248 - DNA, 25 bp, Mus musculus
ggcactggagtaaacctcaggctct

SEQ ID NO: 610249 - DNA, 25 bp, Mus musculus
ggcactggagtatacctcaggctct

SEQ ID NO: 610250 - DNA, 25 bp, Mus musculus
ggcactggatctcgattctattgat

SEQ ID NO: 610251 - DNA, 25 bp, Mus musculus
ggcactggatctggattctattgat

SEQ ID NO: 610252 - DNA, 25 bp, Mus musculus
ggcactggcctaaactccaaagact

SEQ ID NO: 610253 - DNA, 25 bp, Mus musculus
ggcactggcctatactccaaagact

SEQ ID NO: 610254 - DNA, 25 bp, Mus musculus
ggcactggctataatacttggaatt

SEQ ID NO: 610255 - DNA, 25 bp, Mus musculus
ggcactggctattatacttggaatt

SEQ ID NO: 610256 - DNA, 25 bp, Mus musculus
ggcactgggcaaccaactgcaatga

SEQ ID NO: 610257 - DNA, 25 bp, Mus musculus
ggcactgggcaagcaactgcaatga

SEQ ID NO: 610258 - DNA, 25 bp, Mus musculus
ggcactgggcacactgtatggcaac

SEQ ID NO: 610259 - DNA, 25 bp, Mus musculus
ggcactgggcactctgtatggcaac

SEQ ID NO: 610260 - DNA, 25 bp, Mus musculus
ggcactgggccacgataacttagct

SEQ ID NO: 610261 - DNA, 25 bp, Mus musculus
ggcactgggccaggataacttagct

SEQ ID NO: 610262 - DNA, 25 bp, Mus musculus
ggcactgggttaatcaggcttggca

SEQ ID NO: 610263 - DNA, 25 bp, Mus musculus
ggcactgggttattcaggcttggca

SEQ ID NO: 610264 - DNA, 25 bp, Mus musculus
ggcactggtatcacattattgctta

SEQ ID NO: 610265 - DNA, 25 bp, Mus musculus
ggcactggtatctcattattgctta

SEQ ID NO: 610266 - DNA, 25 bp, Mus musculus
ggcactggtgttcgcattctgattc

SEQ ID NO: 610267 - DNA, 25 bp, Mus musculus
ggcactggtgttggcattctgattc

SEQ ID NO: 610268 - DNA, 25 bp, Mus musculus
ggcactggttcacaagcgccattac

SEQ ID NO: 610269 - DNA, 25 bp, Mus musculus
ggcactggttcagaagcgccattac

SEQ ID NO: 610270 - DNA, 25 bp, Mus musculus
ggcactgtaagcatattctatgtca

SEQ ID NO: 610271 - DNA, 25 bp, Mus musculus
ggcactgtaagcttattctatgtca

SEQ ID NO: 610272 - DNA, 25 bp, Mus musculus
ggcactgtacagagggccaaagtat

SEQ ID NO: 610273 - DNA, 25 bp, Mus musculus
ggcactgtacagtgggccaaagtat

SEQ ID NO: 610274 - DNA, 25 bp, Mus musculus
ggcactgtaccccactctgggctaa

SEQ ID NO: 610275 - DNA, 25 bp, Mus musculus
ggcactgtacccgactctgggctaa

SEQ ID NO: 610276 - DNA, 25 bp, Mus musculus
ggcactgtagcccacctggtggcat

SEQ ID NO: 610277 - DNA, 25 bp, Mus musculus
ggcactgtagcccatgttttatagt

SEQ ID NO: 610278 - DNA, 25 bp, Mus musculus
ggcactgtagccgacctggtggcat

SEQ ID NO: 610279 - DNA, 25 bp, Mus musculus
ggcactgtagccgatgttttatagt

SEQ ID NO: 610280 - DNA, 25 bp, Mus musculus
ggcactgtatttctacctcatggag

SEQ ID NO: 610281 - DNA, 25 bp, Mus musculus
ggcactgtatttgtacctcatggag

SEQ ID NO: 610282 - DNA, 25 bp, Mus musculus
ggcactgtccaacctttgttgtatt

SEQ ID NO: 610283 - DNA, 25 bp, Mus musculus
ggcactgtccaagctttgttgtatt

SEQ ID NO: 610284 - DNA, 25 bp, Mus musculus
ggcactgtcctaaaatatgttgaga

SEQ ID NO: 610285 - DNA, 25 bp, Mus musculus
ggcactgtcctataatatgttgaga

SEQ ID NO: 610286 - DNA, 25 bp, Mus musculus
ggcactgtctggagcccagggaatt

SEQ ID NO: 610287 - DNA, 25 bp, Mus musculus
ggcactgtctggtgcccagggaatt

SEQ ID NO: 610288 - DNA, 25 bp, Mus musculus
ggcactgtctttatgttcataggct

SEQ ID NO: 610289 - DNA, 25 bp, Mus musculus
ggcactgtctttttgttcataggct

SEQ ID NO: 610290 - DNA, 25 bp, Mus musculus
ggcactgtgactagatactttacat

SEQ ID NO: 610291 - DNA, 25 bp, Mus musculus
ggcactgtgacttgatactttacat

SEQ ID NO: 610292 - DNA, 25 bp, Mus musculus
ggcactgtgagcatgaccagctcag

SEQ ID NO: 610293 - DNA, 25 bp, Mus musculus
ggcactgtgagcttgaccagctcag

SEQ ID NO: 610294 - DNA, 25 bp, Mus musculus
ggcactgtgggacagattctcttct

SEQ ID NO: 610295 - DNA, 25 bp, Mus musculus
ggcactgtgggagagattctcttct

SEQ ID NO: 610296 - DNA, 25 bp, Mus musculus
ggcactgttcacagttgagttatct

SEQ ID NO: 610297 - DNA, 25 bp, Mus musculus
ggcactgttcactgttgagttatct

SEQ ID NO: 610298 - DNA, 25 bp, Mus musculus
ggcactgttccaagcaggtctaaca

SEQ ID NO: 610299 - DNA, 25 bp, Mus musculus
ggcactgttccatgcaggtctaaca

SEQ ID NO: 610300 - DNA, 25 bp, Mus musculus
ggcactgttgaaaaggatctctcac

SEQ ID NO: 610301 - DNA, 25 bp, Mus musculus
ggcactgttgaataggatctctcac

SEQ ID NO: 610302 - DNA, 25 bp, Mus musculus
ggcactgtttccacggctgaagttg

SEQ ID NO: 610303 - DNA, 25 bp, Mus musculus
ggcactgtttcctcggctgaagttg

SEQ ID NO: 610304 - DNA, 25 bp, Mus musculus
ggcactgttttaatcatctgtatcc

SEQ ID NO: 610305 - DNA, 25 bp, Mus musculus
ggcactgttttattcatctgtatcc

SEQ ID NO: 610306 - DNA, 25 bp, Mus musculus
ggcacttaagatacttttcctatgt

SEQ ID NO: 610307 - DNA, 25 bp, Mus musculus
ggcacttaagattcttttcctatgt

SEQ ID NO: 610308 - DNA, 25 bp, Mus musculus
ggcacttaagctagatactaccgat

SEQ ID NO: 610309 - DNA, 25 bp, Mus musculus
ggcacttaagcttgatactaccgat

SEQ ID NO: 610310 - DNA, 25 bp, Mus musculus
ggcacttaaggaaaagctgctcttt

SEQ ID NO: 610311 - DNA, 25 bp, Mus musculus
ggcacttaaggataagctgctcttt

SEQ ID NO: 610312 - DNA, 25 bp, Mus musculus
ggcacttagcatccagtctgcatta

SEQ ID NO: 610313 - DNA, 25 bp, Mus musculus
ggcacttagcatgcagtctgcatta

SEQ ID NO: 610314 - DNA, 25 bp, Mus musculus
ggcacttaggaaaagagctctcagt

SEQ ID NO: 610315 - DNA, 25 bp, Mus musculus
ggcacttaggaatagagctctcagt

SEQ ID NO: 610316 - DNA, 25 bp, Mus musculus
ggcacttaggatatgctttatgcaa

SEQ ID NO: 610317 - DNA, 25 bp, Mus musculus
ggcacttaggatttgctttatgcaa

SEQ ID NO: 610318 - DNA, 25 bp, Mus musculus
ggcacttaggttcactggacacact

SEQ ID NO: 610319 - DNA, 25 bp, Mus musculus
ggcacttaggttgactggacacact

SEQ ID NO: 610320 - DNA, 25 bp, Mus musculus
ggcacttatcctaatctgaactctg

SEQ ID NO: 610321 - DNA, 25 bp, Mus musculus
ggcacttatccttatctgaactctg

SEQ ID NO: 610322 - DNA, 25 bp, Mus musculus
ggcacttatgctcccattcagtgaa

SEQ ID NO: 610323 - DNA, 25 bp, Mus musculus
ggcacttatgctgccattcagtgaa

SEQ ID NO: 610324 - DNA, 25 bp, Mus musculus
ggcacttattccagttctttggctc

SEQ ID NO: 610325 - DNA, 25 bp, Mus musculus
ggcacttattcctgttctttggctc

SEQ ID NO: 610326 - DNA, 25 bp, Mus musculus
ggcacttcaagcagagccagagccc

SEQ ID NO: 610327 - DNA, 25 bp, Mus musculus
ggcacttcaagctgagccagagccc

SEQ ID NO: 610328 - DNA, 25 bp, Mus musculus
ggcacttcagccatttatacttgat

SEQ ID NO: 610329 - DNA, 25 bp, Mus musculus
ggcacttcagccttttatacttgat

SEQ ID NO: 610330 - DNA, 25 bp, Mus musculus
ggcacttcagtcctgcttaaaaaga

SEQ ID NO: 610331 - DNA, 25 bp, Mus musculus
ggcacttcagtcgtgcttaaaaaga

SEQ ID NO: 610332 - DNA, 25 bp, Mus musculus
ggcacttcatgcaggtactatctca

SEQ ID NO: 610333 - DNA, 25 bp, Mus musculus
ggcacttcatgctggtactatctca

SEQ ID NO: 610334 - DNA, 25 bp, Mus musculus
ggcacttcctggctaggacaatgga

SEQ ID NO: 610335 - DNA, 25 bp, Mus musculus
ggcacttcctgggtaggacaatgga

SEQ ID NO: 610336 - DNA, 25 bp, Mus musculus
ggcacttccttcacttcctagggat

SEQ ID NO: 610337 - DNA, 25 bp, Mus musculus
ggcacttccttctcttcctagggat

SEQ ID NO: 610338 - DNA, 25 bp, Mus musculus
ggcacttcgatcctctcggtaacct

SEQ ID NO: 610339 - DNA, 25 bp, Mus musculus
ggcacttcgatcgtctcggtaacct

SEQ ID NO: 610340 - DNA, 25 bp, Mus musculus
ggcacttctagaacgaagccttgca

SEQ ID NO: 610341 - DNA, 25 bp, Mus musculus
ggcacttctagatcgaagccttgca

SEQ ID NO: 610342 - DNA, 25 bp, Mus musculus
ggcacttctctaatttacttcttga

SEQ ID NO: 610343 - DNA, 25 bp, Mus musculus
ggcacttctctattttacttcttga

SEQ ID NO: 610344 - DNA, 25 bp, Mus musculus
ggcacttcttgtaccagcttgagga

SEQ ID NO: 610345 - DNA, 25 bp, Mus musculus
ggcacttcttgttccagcttgagga

SEQ ID NO: 610346 - DNA, 25 bp, Mus musculus
ggcacttgacaaacacagttcacca

SEQ ID NO: 610347 - DNA, 25 bp, Mus musculus
ggcacttgacaatcacagttcacca

SEQ ID NO: 610348 - DNA, 25 bp, Mus musculus
ggcacttgaggcaccatactagaaa

SEQ ID NO: 610349 - DNA, 25 bp, Mus musculus
ggcacttgaggctccatactagaaa

SEQ ID NO: 610350 - DNA, 25 bp, Mus musculus
ggcacttgatgactcttaatctagc

SEQ ID NO: 610351 - DNA, 25 bp, Mus musculus
ggcacttgatgagtcttaatctagc

SEQ ID NO: 610352 - DNA, 25 bp, Mus musculus
ggcacttgcaaaccttgtctctagg

SEQ ID NO: 610353 - DNA, 25 bp, Mus musculus
ggcacttgcaaagcttgtctctagg

SEQ ID NO: 610354 - DNA, 25 bp, Mus musculus
ggcacttgcacaattccacatgtat

SEQ ID NO: 610355 - DNA, 25 bp, Mus musculus
ggcacttgcacatttccacatgtat

SEQ ID NO: 610356 - DNA, 25 bp, Mus musculus
ggcacttgcactacagtttggcaaa

SEQ ID NO: 610357 - DNA, 25 bp, Mus musculus
ggcacttgcacttcagtttggcaaa

SEQ ID NO: 610358 - DNA, 25 bp, Mus musculus
ggcacttgctaaattgaacctgagt

SEQ ID NO: 610359 - DNA, 25 bp, Mus musculus
ggcacttgctaatttgaacctgagt

SEQ ID NO: 610360 - DNA, 25 bp, Mus musculus
ggcacttgctggaaaactggactac

SEQ ID NO: 610361 - DNA, 25 bp, Mus musculus
ggcacttgctggtaaactggactac

SEQ ID NO: 610362 - DNA, 25 bp, Mus musculus
ggcacttggcacagctaagcagcag

SEQ ID NO: 610363 - DNA, 25 bp, Mus musculus
ggcacttggcactgctaagcagcag

SEQ ID NO: 610364 - DNA, 25 bp, Mus musculus
ggcacttgggacaattgacattggt

SEQ ID NO: 610365 - DNA, 25 bp, Mus musculus
ggcacttgggactattgacattggt

SEQ ID NO: 610366 - DNA, 25 bp, Mus musculus
ggcacttgggatcagaatgtccaca

SEQ ID NO: 610367 - DNA, 25 bp, Mus musculus
ggcacttgggatgagaatgtccaca

SEQ ID NO: 610368 - DNA, 25 bp, Mus musculus
ggcacttgggccaggactgtaaaag

SEQ ID NO: 610369 - DNA, 25 bp, Mus musculus
ggcacttgggcctggactgtaaaag

SEQ ID NO: 610370 - DNA, 25 bp, Mus musculus
ggcacttggtggaggtatactttta

SEQ ID NO: 610371 - DNA, 25 bp, Mus musculus
ggcacttggtggtggtatactttta

SEQ ID NO: 610372 - DNA, 25 bp, Mus musculus
ggcacttgtattagttcatcttcaa

SEQ ID NO: 610373 - DNA, 25 bp, Mus musculus
ggcacttgtatttgttcatcttcaa

SEQ ID NO: 610374 - DNA, 25 bp, Mus musculus
ggcacttgtcaaatatgctgctttt

SEQ ID NO: 610375 - DNA, 25 bp, Mus musculus
ggcacttgtcaattatgctgctttt

SEQ ID NO: 610376 - DNA, 25 bp, Mus musculus
ggcacttgtgaaacttctttgataa

SEQ ID NO: 610377 - DNA, 25 bp, Mus musculus
ggcacttgtgaatcttctttgataa

SEQ ID NO: 610378 - DNA, 25 bp, Mus musculus
ggcacttgtgatatttgtactaaat

SEQ ID NO: 610379 - DNA, 25 bp, Mus musculus
ggcacttgtgatttttgtactaaat

SEQ ID NO: 610380 - DNA, 25 bp, Mus musculus
ggcactttaaagatcacgaagaaca

SEQ ID NO: 610381 - DNA, 25 bp, Mus musculus
ggcactttaaagttcacgaagaaca

SEQ ID NO: 610382 - DNA, 25 bp, Mus musculus
ggcactttaaccagggcatatgttt

SEQ ID NO: 610383 - DNA, 25 bp, Mus musculus
ggcactttaacctgggcatatgttt

SEQ ID NO: 610384 - DNA, 25 bp, Mus musculus
ggcactttacccatggagctgtttc

SEQ ID NO: 610385 - DNA, 25 bp, Mus musculus
ggcactttacccttggagctgtttc

SEQ ID NO: 610386 - DNA, 25 bp, Mus musculus
ggcactttagttcaataccaagcgt

SEQ ID NO: 610387 - DNA, 25 bp, Mus musculus
ggcactttagttgaataccaagcgt

SEQ ID NO: 610388 - DNA, 25 bp, Mus musculus
ggcactttatagaaaccaacctggc

SEQ ID NO: 610389 - DNA, 25 bp, Mus musculus
ggcactttatagtaaccaacctggc

SEQ ID NO: 610390 - DNA, 25 bp, Mus musculus
ggcactttcactcaggagcactttc

SEQ ID NO: 610391 - DNA, 25 bp, Mus musculus
ggcactttcactgaggagcactttc

SEQ ID NO: 610392 - DNA, 25 bp, Mus musculus
ggcactttctagatgagaacggaaa

SEQ ID NO: 610393 - DNA, 25 bp, Mus musculus
ggcactttctagttgagaacggaaa

SEQ ID NO: 610394 - DNA, 25 bp, Mus musculus
ggcactttgacaccggtgtgcttta

SEQ ID NO: 610395 - DNA, 25 bp, Mus musculus
ggcactttgacactaaccgtcttca

SEQ ID NO: 610396 - DNA, 25 bp, Mus musculus
ggcactttgacagcggtgtgcttta

SEQ ID NO: 610397 - DNA, 25 bp, Mus musculus
ggcactttgacagtaaccgtcttca

SEQ ID NO: 610398 - DNA, 25 bp, Mus musculus
ggcactttgcaccagaagcatatca

SEQ ID NO: 610399 - DNA, 25 bp, Mus musculus
ggcactttgcacgagaagcatatca

SEQ ID NO: 610400 - DNA, 25 bp, Mus musculus
ggcactttgcagaacacacacactt

SEQ ID NO: 610401 - DNA, 25 bp, Mus musculus
ggcactttgcagtacacacacactt

SEQ ID NO: 610402 - DNA, 25 bp, Mus musculus
ggcactttgggaaagagcttatgtc

SEQ ID NO: 610403 - DNA, 25 bp, Mus musculus
ggcactttgggatagagcttatgtc

SEQ ID NO: 610404 - DNA, 25 bp, Mus musculus
ggcacttttaaaacagattgaccca

SEQ ID NO: 610405 - DNA, 25 bp, Mus musculus
ggcacttttaaatcagattgaccca

SEQ ID NO: 610406 - DNA, 25 bp, Mus musculus
ggcacttttcacaatctcattcttg

SEQ ID NO: 610407 - DNA, 25 bp, Mus musculus
ggcacttttcactatctcattcttg

SEQ ID NO: 610408 - DNA, 25 bp, Mus musculus
ggcacttttcttcctcttgggtgtc

SEQ ID NO: 610409 - DNA, 25 bp, Mus musculus
ggcacttttcttgctcttgggtgtc

SEQ ID NO: 610410 - DNA, 25 bp, Mus musculus
ggcacttttgggattttacactgac

SEQ ID NO: 610411 - DNA, 25 bp, Mus musculus
ggcacttttgggtttttacactgac

SEQ ID NO: 610412 - DNA, 25 bp, Mus musculus
ggcacttttgtcatgtagctatttt

SEQ ID NO: 610413 - DNA, 25 bp, Mus musculus
ggcacttttgtcttgtagctatttt

SEQ ID NO: 610414 - DNA, 25 bp, Mus musculus
ggcactttttcaccttgctataacc

SEQ ID NO: 610415 - DNA, 25 bp, Mus musculus
ggcactttttcagcttgctataacc

SEQ ID NO: 610416 - DNA, 25 bp, Mus musculus
ggcactttttccaggactccaggca

SEQ ID NO: 610417 - DNA, 25 bp, Mus musculus
ggcactttttcctggactccaggca

SEQ ID NO: 610418 - DNA, 25 bp, Mus musculus
ggcagaaaagcaagcacctcctcag

SEQ ID NO: 610419 - DNA, 25 bp, Mus musculus
ggcagaaaagcatgcacctcctcag

SEQ ID NO: 610420 - DNA, 25 bp, Mus musculus
ggcagaaacacaacccatttgacat

SEQ ID NO: 610421 - DNA, 25 bp, Mus musculus
ggcagaaacacatcccatttgacat

SEQ ID NO: 610422 - DNA, 25 bp, Mus musculus
ggcagaaacaggcatcttctcttgc

SEQ ID NO: 610423 - DNA, 25 bp, Mus musculus
ggcagaaacagggatcttctcttgc

SEQ ID NO: 610424 - DNA, 25 bp, Mus musculus
ggcagaaaccccacttctgtaagag

SEQ ID NO: 610425 - DNA, 25 bp, Mus musculus
ggcagaaacccctcttctgtaagag

SEQ ID NO: 610426 - DNA, 25 bp, Mus musculus
ggcagaaaccgtacttatcacgaga

SEQ ID NO: 610427 - DNA, 25 bp, Mus musculus
ggcagaaaccgttcttatcacgaga

SEQ ID NO: 610428 - DNA, 25 bp, Mus musculus
ggcagaaaccttagtgttacacttc

SEQ ID NO: 610429 - DNA, 25 bp, Mus musculus
ggcagaaacctttgtgttacacttc

SEQ ID NO: 610430 - DNA, 25 bp, Mus musculus
ggcagaaacggtacacattccatta

SEQ ID NO: 610431 - DNA, 25 bp, Mus musculus
ggcagaaacggttcacattccatta

SEQ ID NO: 610432 - DNA, 25 bp, Mus musculus
ggcagaaagagtccttctttactat

SEQ ID NO: 610433 - DNA, 25 bp, Mus musculus
ggcagaaagagtgcttctttactat

SEQ ID NO: 610434 - DNA, 25 bp, Mus musculus
ggcagaaagcagataaccccgtcct

SEQ ID NO: 610435 - DNA, 25 bp, Mus musculus
ggcagaaagcagcagctagcacctt

SEQ ID NO: 610436 - DNA, 25 bp, Mus musculus
ggcagaaagcaggagctagcacctt

SEQ ID NO: 610437 - DNA, 25 bp, Mus musculus
ggcagaaagcagttaaccccgtcct

SEQ ID NO: 610438 - DNA, 25 bp, Mus musculus
ggcagaaaggcccatttcttaccta

SEQ ID NO: 610439 - DNA, 25 bp, Mus musculus
ggcagaaaggccgatttcttaccta

SEQ ID NO: 610440 - DNA, 25 bp, Mus musculus
ggcagaaagtgaccagatcctgtgt

SEQ ID NO: 610441 - DNA, 25 bp, Mus musculus
ggcagaaagtgagcagatcctgtgt

SEQ ID NO: 610442 - DNA, 25 bp, Mus musculus
ggcagaaagtggacaaatcccagca

SEQ ID NO: 610443 - DNA, 25 bp, Mus musculus
ggcagaaagtggtcaaatcccagca

SEQ ID NO: 610444 - DNA, 25 bp, Mus musculus
ggcagaaatagcatcaactcctagg

SEQ ID NO: 610445 - DNA, 25 bp, Mus musculus
ggcagaaatagcttcaactcctagg

SEQ ID NO: 610446 - DNA, 25 bp, Mus musculus
ggcagaaatccaaatctaggtagtc

SEQ ID NO: 610447 - DNA, 25 bp, Mus musculus
ggcagaaatccatatctaggtagtc

SEQ ID NO: 610448 - DNA, 25 bp, Mus musculus
ggcagaaatcgcctgtgggtcccta

SEQ ID NO: 610449 - DNA, 25 bp, Mus musculus
ggcagaaatcgcgtgtgggtcccta

SEQ ID NO: 610450 - DNA, 25 bp, Mus musculus
ggcagaacagccatacttgtaaaat

SEQ ID NO: 610451 - DNA, 25 bp, Mus musculus
ggcagaacagccttacttgtaaaat

SEQ ID NO: 610452 - DNA, 25 bp, Mus musculus
ggcagaacagggactttagcccaca

SEQ ID NO: 610453 - DNA, 25 bp, Mus musculus
ggcagaacagggtctttagcccaca

SEQ ID NO: 610454 - DNA, 25 bp, Mus musculus
ggcagaacagtcagtgtccactgga

SEQ ID NO: 610455 - DNA, 25 bp, Mus musculus
ggcagaacagtctgtgtccactgga

SEQ ID NO: 610456 - DNA, 25 bp, Mus musculus
ggcagaacatgtcatctactgtgaa

SEQ ID NO: 610457 - DNA, 25 bp, Mus musculus
ggcagaacatgtgatctactgtgaa

SEQ ID NO: 610458 - DNA, 25 bp, Mus musculus
ggcagaaccacaaagtgcggctaga

SEQ ID NO: 610459 - DNA, 25 bp, Mus musculus
ggcagaaccacatagtgcggctaga

SEQ ID NO: 610460 - DNA, 25 bp, Mus musculus
ggcagaaccaggcaacgtttttcca

SEQ ID NO: 610461 - DNA, 25 bp, Mus musculus
ggcagaaccagggaacgtttttcca

SEQ ID NO: 610462 - DNA, 25 bp, Mus musculus
ggcagaacccagacactagcatcag

SEQ ID NO: 610463 - DNA, 25 bp, Mus musculus
ggcagaacccagtcactagcatcag

SEQ ID NO: 610464 - DNA, 25 bp, Mus musculus
ggcagaacccatcttaatgacaagt

SEQ ID NO: 610465 - DNA, 25 bp, Mus musculus
ggcagaacccatgttaatgacaagt

SEQ ID NO: 610466 - DNA, 25 bp, Mus musculus
ggcagaaccgacagagtaaaactca

SEQ ID NO: 610467 - DNA, 25 bp, Mus musculus
ggcagaaccgactgagtaaaactca

SEQ ID NO: 610468 - DNA, 25 bp, Mus musculus
ggcagaaccttaatatctccttctt

SEQ ID NO: 610469 - DNA, 25 bp, Mus musculus
ggcagaaccttattatctccttctt

SEQ ID NO: 610470 - DNA, 25 bp, Mus musculus
ggcagaacctttattgcacacttaa

SEQ ID NO: 610471 - DNA, 25 bp, Mus musculus
ggcagaaccttttttgcacacttaa

SEQ ID NO: 610472 - DNA, 25 bp, Mus musculus
ggcagaacgactcccacagctcaga

SEQ ID NO: 610473 - DNA, 25 bp, Mus musculus
ggcagaacgactgccacagctcaga

SEQ ID NO: 610474 - DNA, 25 bp, Mus musculus
ggcagaactccaaatcttggtcagg

SEQ ID NO: 610475 - DNA, 25 bp, Mus musculus
ggcagaactccatatcttggtcagg

SEQ ID NO: 610476 - DNA, 25 bp, Mus musculus
ggcagaactctacttcttcaggcaa

SEQ ID NO: 610477 - DNA, 25 bp, Mus musculus
ggcagaactctagttcttcaggcaa

SEQ ID NO: 610478 - DNA, 25 bp, Mus musculus
ggcagaactgagacctctgtctagt

SEQ ID NO: 610479 - DNA, 25 bp, Mus musculus
ggcagaactgagtcctctgtctagt

SEQ ID NO: 610480 - DNA, 25 bp, Mus musculus
ggcagaactgcactgataacctttg

SEQ ID NO: 610481 - DNA, 25 bp, Mus musculus
ggcagaactgcagtgataacctttg

SEQ ID NO: 610482 - DNA, 25 bp, Mus musculus
ggcagaactgccacaaactgttgtt

SEQ ID NO: 610483 - DNA, 25 bp, Mus musculus
ggcagaactgcctcaaactgttgtt

SEQ ID NO: 610484 - DNA, 25 bp, Mus musculus
ggcagaacttcaatccctttttaat

SEQ ID NO: 610485 - DNA, 25 bp, Mus musculus
ggcagaacttcattccctttttaat

SEQ ID NO: 610486 - DNA, 25 bp, Mus musculus
ggcagaagaagtacaaggcaggatt

SEQ ID NO: 610487 - DNA, 25 bp, Mus musculus
ggcagaagaagttcaaggcaggatt

SEQ ID NO: 610488 - DNA, 25 bp, Mus musculus
ggcagaagcagtcaccttaggacaa

SEQ ID NO: 610489 - DNA, 25 bp, Mus musculus
ggcagaagcagtgaccttaggacaa

SEQ ID NO: 610490 - DNA, 25 bp, Mus musculus
ggcagaagcattagaccaaccacag

SEQ ID NO: 610491 - DNA, 25 bp, Mus musculus
ggcagaagcatttgaccaaccacag

SEQ ID NO: 610492 - DNA, 25 bp, Mus musculus
ggcagaagccgacacctgaattcaa

SEQ ID NO: 610493 - DNA, 25 bp, Mus musculus
ggcagaagccgagacctgaattcaa

SEQ ID NO: 610494 - DNA, 25 bp, Mus musculus
ggcagaagccttagcgtgtagtccc

SEQ ID NO: 610495 - DNA, 25 bp, Mus musculus
ggcagaagccttccagatgtaccag

SEQ ID NO: 610496 - DNA, 25 bp, Mus musculus
ggcagaagccttgcagatgtaccag

SEQ ID NO: 610497 - DNA, 25 bp, Mus musculus
ggcagaagcctttgcgtgtagtccc

SEQ ID NO: 610498 - DNA, 25 bp, Mus musculus
ggcagaaggactcgctttggcttta

SEQ ID NO: 610499 - DNA, 25 bp, Mus musculus
ggcagaaggactggctttggcttta

SEQ ID NO: 610500 - DNA, 25 bp, Mus musculus
ggcagaaggagaagcgcatgacccc

SEQ ID NO: 610501 - DNA, 25 bp, Mus musculus
ggcagaaggagatgcgcatgacccc

SEQ ID NO: 610502 - DNA, 25 bp, Mus musculus
ggcagaaggcacagtctaaaacagt

SEQ ID NO: 610503 - DNA, 25 bp, Mus musculus
ggcagaaggcactgtctaaaacagt

SEQ ID NO: 610504 - DNA, 25 bp, Mus musculus
ggcagaaggccaaattggttcatat

SEQ ID NO: 610505 - DNA, 25 bp, Mus musculus
ggcagaaggccatattggttcatat

SEQ ID NO: 610506 - DNA, 25 bp, Mus musculus
ggcagaaggcctccctaaactggca

SEQ ID NO: 610507 - DNA, 25 bp, Mus musculus
ggcagaaggcctgcctaaactggca

SEQ ID NO: 610508 - DNA, 25 bp, Mus musculus
ggcagaaggtgaccccgcggcgtcg

SEQ ID NO: 610509 - DNA, 25 bp, Mus musculus
ggcagaaggtgagcccgcggcgtcg

SEQ ID NO: 610510 - DNA, 25 bp, Mus musculus
ggcagaaggttgatgtcacggcaaa

SEQ ID NO: 610511 - DNA, 25 bp, Mus musculus
ggcagaaggttgttgtcacggcaaa

SEQ ID NO: 610512 - DNA, 25 bp, Mus musculus
ggcagaaggtttccaatctcagata

SEQ ID NO: 610513 - DNA, 25 bp, Mus musculus
ggcagaaggtttgcaatctcagata

SEQ ID NO: 610514 - DNA, 25 bp, Mus musculus
ggcagaagtcacactgtatagctct

SEQ ID NO: 610515 - DNA, 25 bp, Mus musculus
ggcagaagtcactctgtatagctct

SEQ ID NO: 610516 - DNA, 25 bp, Mus musculus
ggcagaagtgaacctgagagccttt

SEQ ID NO: 610517 - DNA, 25 bp, Mus musculus
ggcagaagtgaagctgagagccttt

SEQ ID NO: 610518 - DNA, 25 bp, Mus musculus
ggcagaagtgttatagcagtagaaa

SEQ ID NO: 610519 - DNA, 25 bp, Mus musculus
ggcagaagtgttttagcagtagaaa

SEQ ID NO: 610520 - DNA, 25 bp, Mus musculus
ggcagaatacaaatcccatatgtgg

SEQ ID NO: 610521 - DNA, 25 bp, Mus musculus
ggcagaatacaattcccatatgtgg

SEQ ID NO: 610522 - DNA, 25 bp, Mus musculus
ggcagaatacatcctgagcagcctg

SEQ ID NO: 610523 - DNA, 25 bp, Mus musculus
ggcagaatacatgctgagcagcctg

SEQ ID NO: 610524 - DNA, 25 bp, Mus musculus
ggcagaataccgaggcatagcctgt

SEQ ID NO: 610525 - DNA, 25 bp, Mus musculus
ggcagaataccgtggcatagcctgt

SEQ ID NO: 610526 - DNA, 25 bp, Mus musculus
ggcagaatattcatttccctaagca

SEQ ID NO: 610527 - DNA, 25 bp, Mus musculus
ggcagaatattcttttccctaagca

SEQ ID NO: 610528 - DNA, 25 bp, Mus musculus
ggcagaatcatcaaaccatggttca

SEQ ID NO: 610529 - DNA, 25 bp, Mus musculus
ggcagaatcatctaaccatggttca

SEQ ID NO: 610530 - DNA, 25 bp, Mus musculus
ggcagaatcatgcatggcagcagat

SEQ ID NO: 610531 - DNA, 25 bp, Mus musculus
ggcagaatcatggatggcagcagat

SEQ ID NO: 610532 - DNA, 25 bp, Mus musculus
ggcagaatcattcagcttttaggct

SEQ ID NO: 610533 - DNA, 25 bp, Mus musculus
ggcagaatcattgagcttttaggct

SEQ ID NO: 610534 - DNA, 25 bp, Mus musculus
ggcagaatccacataggctttaatt

SEQ ID NO: 610535 - DNA, 25 bp, Mus musculus
ggcagaatccacttaggctttaatt

SEQ ID NO: 610536 - DNA, 25 bp, Mus musculus
ggcagaatcgccacctatgtcatgg

SEQ ID NO: 610537 - DNA, 25 bp, Mus musculus
ggcagaatcgcctcctatgtcatgg

SEQ ID NO: 610538 - DNA, 25 bp, Mus musculus
ggcagaatgcccatcatgctccgaa

SEQ ID NO: 610539 - DNA, 25 bp, Mus musculus
ggcagaatgcccttcatgctccgaa

SEQ ID NO: 610540 - DNA, 25 bp, Mus musculus
ggcagaatgggcatccaccaaggcc

SEQ ID NO: 610541 - DNA, 25 bp, Mus musculus
ggcagaatgggcttccaccaaggcc

SEQ ID NO: 610542 - DNA, 25 bp, Mus musculus
ggcagaatgtgtatactactaggca

SEQ ID NO: 610543 - DNA, 25 bp, Mus musculus
ggcagaatgtgtttactactaggca

SEQ ID NO: 610544 - DNA, 25 bp, Mus musculus
ggcagacaaagaaggctcccgagta

SEQ ID NO: 610545 - DNA, 25 bp, Mus musculus
ggcagacaaagatggctcccgagta

SEQ ID NO: 610546 - DNA, 25 bp, Mus musculus
ggcagacaaagccaatctttcgaaa

SEQ ID NO: 610547 - DNA, 25 bp, Mus musculus
ggcagacaaagcgaatctttcgaaa

SEQ ID NO: 610548 - DNA, 25 bp, Mus musculus
ggcagacaaccacactcgggacaca

SEQ ID NO: 610549 - DNA, 25 bp, Mus musculus
ggcagacaaccagactcgggacaca

SEQ ID NO: 610550 - DNA, 25 bp, Mus musculus
ggcagacaacccataatcatagcac

SEQ ID NO: 610551 - DNA, 25 bp, Mus musculus
ggcagacaacccttaatcatagcac

SEQ ID NO: 610552 - DNA, 25 bp, Mus musculus
ggcagacaagaacatctctatgaat

SEQ ID NO: 610553 - DNA, 25 bp, Mus musculus
ggcagacaagaagatctctatgaat

SEQ ID NO: 610554 - DNA, 25 bp, Mus musculus
ggcagacaattcacaatccggagcg

SEQ ID NO: 610555 - DNA, 25 bp, Mus musculus
ggcagacaattcctcacataccaat

SEQ ID NO: 610556 - DNA, 25 bp, Mus musculus
ggcagacaattcgtcacataccaat

SEQ ID NO: 610557 - DNA, 25 bp, Mus musculus
ggcagacaattctcaatccggagcg

SEQ ID NO: 610558 - DNA, 25 bp, Mus musculus
ggcagacaattgagaccacaggttt

SEQ ID NO: 610559 - DNA, 25 bp, Mus musculus
ggcagacaattgtgaccacaggttt

SEQ ID NO: 610560 - DNA, 25 bp, Mus musculus
ggcagacacagtcgacttttgtgaa

SEQ ID NO: 610561 - DNA, 25 bp, Mus musculus
ggcagacacagtggacttttgtgaa

SEQ ID NO: 610562 - DNA, 25 bp, Mus musculus
ggcagacaccagctttgaagccaag

SEQ ID NO: 610563 - DNA, 25 bp, Mus musculus
ggcagacaccaggtttgaagccaag

SEQ ID NO: 610564 - DNA, 25 bp, Mus musculus
ggcagacaccatctaagttataagt

SEQ ID NO: 610565 - DNA, 25 bp, Mus musculus
ggcagacaccatgtaagttataagt

SEQ ID NO: 610566 - DNA, 25 bp, Mus musculus
ggcagacacgccagagctgcagaga

SEQ ID NO: 610567 - DNA, 25 bp, Mus musculus
ggcagacacgcctgagctgcagaga

SEQ ID NO: 610568 - DNA, 25 bp, Mus musculus
ggcagacactgaactcttggcggtt

SEQ ID NO: 610569 - DNA, 25 bp, Mus musculus
ggcagacactgatctcttggcggtt

SEQ ID NO: 610570 - DNA, 25 bp, Mus musculus
ggcagacagaacaacaatccgcaga

SEQ ID NO: 610571 - DNA, 25 bp, Mus musculus
ggcagacagaactacaatccgcaga

SEQ ID NO: 610572 - DNA, 25 bp, Mus musculus
ggcagacagactcggcagaagcatc

SEQ ID NO: 610573 - DNA, 25 bp, Mus musculus
ggcagacagactgggcagaagcatc

SEQ ID NO: 610574 - DNA, 25 bp, Mus musculus
ggcagacagattaccacaccgtggc

SEQ ID NO: 610575 - DNA, 25 bp, Mus musculus
ggcagacagattcatctttgctcac

SEQ ID NO: 610576 - DNA, 25 bp, Mus musculus
ggcagacagattgatctttgctcac

SEQ ID NO: 610577 - DNA, 25 bp, Mus musculus
ggcagacagatttccacaccgtggc

SEQ ID NO: 610578 - DNA, 25 bp, Mus musculus
ggcagacagcaccatgatcgacaca

SEQ ID NO: 610579 - DNA, 25 bp, Mus musculus
ggcagacagcacgatgatcgacaca

SEQ ID NO: 610580 - DNA, 25 bp, Mus musculus
ggcagacagcctacaaattattcca

SEQ ID NO: 610581 - DNA, 25 bp, Mus musculus
ggcagacagccttcaaattattcca

SEQ ID NO: 610582 - DNA, 25 bp, Mus musculus
ggcagacagctcataacgtggtgtt

SEQ ID NO: 610583 - DNA, 25 bp, Mus musculus
ggcagacagctcttaacgtggtgtt

SEQ ID NO: 610584 - DNA, 25 bp, Mus musculus
ggcagacagcttcgactcttcaggc

SEQ ID NO: 610585 - DNA, 25 bp, Mus musculus
ggcagacagcttggactcttcaggc

SEQ ID NO: 610586 - DNA, 25 bp, Mus musculus
ggcagacatacaacatttaaaggag

SEQ ID NO: 610587 - DNA, 25 bp, Mus musculus
ggcagacatacatcatttaaaggag

SEQ ID NO: 610588 - DNA, 25 bp, Mus musculus
ggcagacatattacagcacctgaga

SEQ ID NO: 610589 - DNA, 25 bp, Mus musculus
ggcagacatatttcagcacctgaga

SEQ ID NO: 610590 - DNA, 25 bp, Mus musculus
ggcagacatctaccgtgagctatac

SEQ ID NO: 610591 - DNA, 25 bp, Mus musculus
ggcagacatctagcgtgagctatac

SEQ ID NO: 610592 - DNA, 25 bp, Mus musculus
ggcagacatgccacaatggtgtgaa

SEQ ID NO: 610593 - DNA, 25 bp, Mus musculus
ggcagacatgcctcaatggtgtgaa

SEQ ID NO: 610594 - DNA, 25 bp, Mus musculus
ggcagacatgctctgatttgtttgt

SEQ ID NO: 610595 - DNA, 25 bp, Mus musculus
ggcagacatgctgtgatttgtttgt

SEQ ID NO: 610596 - DNA, 25 bp, Mus musculus
ggcagacattgaaccaactctccgg

SEQ ID NO: 610597 - DNA, 25 bp, Mus musculus
ggcagacattgatccaactctccgg

SEQ ID NO: 610598 - DNA, 25 bp, Mus musculus
ggcagacattgccatcccaatgcag

SEQ ID NO: 610599 - DNA, 25 bp, Mus musculus
ggcagacattgcgatcccaatgcag

SEQ ID NO: 610600 - DNA, 25 bp, Mus musculus
ggcagacattttagactttaaggca

SEQ ID NO: 610601 - DNA, 25 bp, Mus musculus
ggcagacatttttgactttaaggca

SEQ ID NO: 610602 - DNA, 25 bp, Mus musculus
ggcagaccaggccagtcctttattc

SEQ ID NO: 610603 - DNA, 25 bp, Mus musculus
ggcagaccaggcgagtcctttattc

SEQ ID NO: 610604 - DNA, 25 bp, Mus musculus
ggcagaccatgcattttactttcgt

SEQ ID NO: 610605 - DNA, 25 bp, Mus musculus
ggcagaccatgctttttactttcgt

SEQ ID NO: 610606 - DNA, 25 bp, Mus musculus
ggcagaccatggagagcccattggc

SEQ ID NO: 610607 - DNA, 25 bp, Mus musculus
ggcagaccatggtgagcccattggc

SEQ ID NO: 610608 - DNA, 25 bp, Mus musculus
ggcagacccaaaacgcgaatgtcaa

SEQ ID NO: 610609 - DNA, 25 bp, Mus musculus
ggcagacccaaatcgcgaatgtcaa

SEQ ID NO: 610610 - DNA, 25 bp, Mus musculus
ggcagacccaggctgttctgactgc

SEQ ID NO: 610611 - DNA, 25 bp, Mus musculus
ggcagacccagggtgttctgactgc

SEQ ID NO: 610612 - DNA, 25 bp, Mus musculus
ggcagaccctaaacagtcacatggt

SEQ ID NO: 610613 - DNA, 25 bp, Mus musculus
ggcagaccctaatcagtcacatggt

SEQ ID NO: 610614 - DNA, 25 bp, Mus musculus
ggcagacccttacacatggcaggca

SEQ ID NO: 610615 - DNA, 25 bp, Mus musculus
ggcagacccttagacatggcaggca

SEQ ID NO: 610616 - DNA, 25 bp, Mus musculus
ggcagaccgcctcaaaacatgtaat

SEQ ID NO: 610617 - DNA, 25 bp, Mus musculus
ggcagaccgcctgaaaacatgtaat

SEQ ID NO: 610618 - DNA, 25 bp, Mus musculus
ggcagacctataatacttgatttca

SEQ ID NO: 610619 - DNA, 25 bp, Mus musculus
ggcagacctatattacttgatttca

SEQ ID NO: 610620 - DNA, 25 bp, Mus musculus
ggcagacctcaaaacactgttgtca

SEQ ID NO: 610621 - DNA, 25 bp, Mus musculus
ggcagacctcaatacactgttgtca

SEQ ID NO: 610622 - DNA, 25 bp, Mus musculus
ggcagacctttaactcccagagatc

SEQ ID NO: 610623 - DNA, 25 bp, Mus musculus
ggcagacctttatctcccagagatc

SEQ ID NO: 610624 - DNA, 25 bp, Mus musculus
ggcagacctttgctaatcacatgct

SEQ ID NO: 610625 - DNA, 25 bp, Mus musculus
ggcagacctttggtaatcacatgct

SEQ ID NO: 610626 - DNA, 25 bp, Mus musculus
ggcagacgaattacccgatttctac

SEQ ID NO: 610627 - DNA, 25 bp, Mus musculus
ggcagacgaatttcccgatttctac

SEQ ID NO: 610628 - DNA, 25 bp, Mus musculus
ggcagacgtgaacttggtgaacgct

SEQ ID NO: 610629 - DNA, 25 bp, Mus musculus
ggcagacgtgaagttggtgaacgct

SEQ ID NO: 610630 - DNA, 25 bp, Mus musculus
ggcagacgtgctaagaggaccacaa

SEQ ID NO: 610631 - DNA, 25 bp, Mus musculus
ggcagacgtgcttagaggaccacaa

SEQ ID NO: 610632 - DNA, 25 bp, Mus musculus
ggcagacgttgcaacccagcgtgga

SEQ ID NO: 610633 - DNA, 25 bp, Mus musculus
ggcagacgttgctacccagcgtgga

SEQ ID NO: 610634 - DNA, 25 bp, Mus musculus
ggcagacgttggagccttacaggca

SEQ ID NO: 610635 - DNA, 25 bp, Mus musculus
ggcagacgttggtgccttacaggca

SEQ ID NO: 610636 - DNA, 25 bp, Mus musculus
ggcagactaaccacatagtggtcaa

SEQ ID NO: 610637 - DNA, 25 bp, Mus musculus
ggcagactaacctcatagtggtcaa

SEQ ID NO: 610638 - DNA, 25 bp, Mus musculus
ggcagactaattaccagtttctctt

SEQ ID NO: 610639 - DNA, 25 bp, Mus musculus
ggcagactaatttccagtttctctt

SEQ ID NO: 610640 - DNA, 25 bp, Mus musculus
ggcagactacatagcatttttgaag

SEQ ID NO: 610641 - DNA, 25 bp, Mus musculus
ggcagactacattgcatttttgaag

SEQ ID NO: 610642 - DNA, 25 bp, Mus musculus
ggcagactccagaggaacaactctt

SEQ ID NO: 610643 - DNA, 25 bp, Mus musculus
ggcagactccagtggaacaactctt

SEQ ID NO: 610644 - DNA, 25 bp, Mus musculus
ggcagactctccaggatatataatt

SEQ ID NO: 610645 - DNA, 25 bp, Mus musculus
ggcagactctcctggatatataatt

SEQ ID NO: 610646 - DNA, 25 bp, Mus musculus
ggcagactctctccatttagatccc

SEQ ID NO: 610647 - DNA, 25 bp, Mus musculus
ggcagactctctgcatttagatccc

SEQ ID NO: 610648 - DNA, 25 bp, Mus musculus
ggcagactgcaacaacacatcacaa

SEQ ID NO: 610649 - DNA, 25 bp, Mus musculus
ggcagactgcaagaacacatcacaa

SEQ ID NO: 610650 - DNA, 25 bp, Mus musculus
ggcagactgcctcagacactgtgat

SEQ ID NO: 610651 - DNA, 25 bp, Mus musculus
ggcagactgcctgagacactgtgat

SEQ ID NO: 610652 - DNA, 25 bp, Mus musculus
ggcagactgcgcagagttttcccca

SEQ ID NO: 610653 - DNA, 25 bp, Mus musculus
ggcagactgcgctgagttttcccca

SEQ ID NO: 610654 - DNA, 25 bp, Mus musculus
ggcagactgcttacttagctagcat

SEQ ID NO: 610655 - DNA, 25 bp, Mus musculus
ggcagactgctttcttagctagcat

SEQ ID NO: 610656 - DNA, 25 bp, Mus musculus
ggcagactggcaacactgggttgct

SEQ ID NO: 610657 - DNA, 25 bp, Mus musculus
ggcagactggcatcactgggttgct

SEQ ID NO: 610658 - DNA, 25 bp, Mus musculus
ggcagactgtcacatcaataatctt

SEQ ID NO: 610659 - DNA, 25 bp, Mus musculus
ggcagactgtcagatcaataatctt

SEQ ID NO: 610660 - DNA, 25 bp, Mus musculus
ggcagactgttaactgaacgcgcat

SEQ ID NO: 610661 - DNA, 25 bp, Mus musculus
ggcagactgttatctgaacgcgcat

SEQ ID NO: 610662 - DNA, 25 bp, Mus musculus
ggcagacttcctagtcatcttctgg

SEQ ID NO: 610663 - DNA, 25 bp, Mus musculus
ggcagacttcctcactgacaggcag

SEQ ID NO: 610664 - DNA, 25 bp, Mus musculus
ggcagacttcctgactgacaggcag

SEQ ID NO: 610665 - DNA, 25 bp, Mus musculus
ggcagacttccttgtcatcttctgg

SEQ ID NO: 610666 - DNA, 25 bp, Mus musculus
ggcagacttcgcctgctgatttgcc

SEQ ID NO: 610667 - DNA, 25 bp, Mus musculus
ggcagacttcgcgtgctgatttgcc

SEQ ID NO: 610668 - DNA, 25 bp, Mus musculus
ggcagacttctcctttcaggatgat

SEQ ID NO: 610669 - DNA, 25 bp, Mus musculus
ggcagacttctcgtttcaggatgat

SEQ ID NO: 610670 - DNA, 25 bp, Mus musculus
ggcagacttgccagcccaagggtgc

SEQ ID NO: 610671 - DNA, 25 bp, Mus musculus
ggcagacttgcctgcccaagggtgc

SEQ ID NO: 610672 - DNA, 25 bp, Mus musculus
ggcagacttggcacactaaggctga

SEQ ID NO: 610673 - DNA, 25 bp, Mus musculus
ggcagacttggctcactaaggctga

SEQ ID NO: 610674 - DNA, 25 bp, Mus musculus
ggcagactttatcttcgtttagaac

SEQ ID NO: 610675 - DNA, 25 bp, Mus musculus
ggcagactttatgttcgtttagaac

SEQ ID NO: 610676 - DNA, 25 bp, Mus musculus
ggcagagaaatgaccgaaccttaag

SEQ ID NO: 610677 - DNA, 25 bp, Mus musculus
ggcagagaaatgtccgaaccttaag

SEQ ID NO: 610678 - DNA, 25 bp, Mus musculus
ggcagagaactcatcgatgacccct

SEQ ID NO: 610679 - DNA, 25 bp, Mus musculus
ggcagagaactcttcgatgacccct

SEQ ID NO: 610680 - DNA, 25 bp, Mus musculus
ggcagagaagacaactttccttcct

SEQ ID NO: 610681 - DNA, 25 bp, Mus musculus
ggcagagaagactactttccttcct

SEQ ID NO: 610682 - DNA, 25 bp, Mus musculus
ggcagagaagccattcgatgacctt

SEQ ID NO: 610683 - DNA, 25 bp, Mus musculus
ggcagagaagcctttcgatgacctt

SEQ ID NO: 610684 - DNA, 25 bp, Mus musculus
ggcagagaattcagcttcctactga

SEQ ID NO: 610685 - DNA, 25 bp, Mus musculus
ggcagagaattctgcttcctactga

SEQ ID NO: 610686 - DNA, 25 bp, Mus musculus
ggcagagacaatagcaggcggtcct

SEQ ID NO: 610687 - DNA, 25 bp, Mus musculus
ggcagagacaattgcaggcggtcct

SEQ ID NO: 610688 - DNA, 25 bp, Mus musculus
ggcagagacaccagaacacctgtga

SEQ ID NO: 610689 - DNA, 25 bp, Mus musculus
ggcagagacacctgaacacctgtga

SEQ ID NO: 610690 - DNA, 25 bp, Mus musculus
ggcagagacagcaaagctaggcaga

SEQ ID NO: 610691 - DNA, 25 bp, Mus musculus
ggcagagacagcagggtgcttccca

SEQ ID NO: 610692 - DNA, 25 bp, Mus musculus
ggcagagacagctaagctaggcaga

SEQ ID NO: 610693 - DNA, 25 bp, Mus musculus
ggcagagacagctgggtgcttccca

SEQ ID NO: 610694 - DNA, 25 bp, Mus musculus
ggcagagacagtcagccttgctgcc

SEQ ID NO: 610695 - DNA, 25 bp, Mus musculus
ggcagagacagtgagccttgctgcc

SEQ ID NO: 610696 - DNA, 25 bp, Mus musculus
ggcagagacattattacttattcta

SEQ ID NO: 610697 - DNA, 25 bp, Mus musculus
ggcagagacatttttacttattcta

SEQ ID NO: 610698 - DNA, 25 bp, Mus musculus
ggcagagagatcatccccgaataaa

SEQ ID NO: 610699 - DNA, 25 bp, Mus musculus
ggcagagagatcttccccgaataaa

SEQ ID NO: 610700 - DNA, 25 bp, Mus musculus
ggcagagagcaaattttagtagctt

SEQ ID NO: 610701 - DNA, 25 bp, Mus musculus
ggcagagagcaatttttagtagctt

SEQ ID NO: 610702 - DNA, 25 bp, Mus musculus
ggcagagagcagctatacatattat

SEQ ID NO: 610703 - DNA, 25 bp, Mus musculus
ggcagagagcaggtatacatattat

SEQ ID NO: 610704 - DNA, 25 bp, Mus musculus
ggcagagagcataaacaccatttgt

SEQ ID NO: 610705 - DNA, 25 bp, Mus musculus
ggcagagagcattaacaccatttgt

SEQ ID NO: 610706 - DNA, 25 bp, Mus musculus
ggcagagagccacactactcagaat

SEQ ID NO: 610707 - DNA, 25 bp, Mus musculus
ggcagagagccagactactcagaat

SEQ ID NO: 610708 - DNA, 25 bp, Mus musculus
ggcagagagcctcatggcttaactt

SEQ ID NO: 610709 - DNA, 25 bp, Mus musculus
ggcagagagcctgatggcttaactt

SEQ ID NO: 610710 - DNA, 25 bp, Mus musculus
ggcagagagcgaacttcctctttgt

SEQ ID NO: 610711 - DNA, 25 bp, Mus musculus
ggcagagagcgatcttcctctttgt

SEQ ID NO: 610712 - DNA, 25 bp, Mus musculus
ggcagagagtgcaaccggacatcag

SEQ ID NO: 610713 - DNA, 25 bp, Mus musculus
ggcagagagtgctaccggacatcag

SEQ ID NO: 610714 - DNA, 25 bp, Mus musculus
ggcagagagttgagggattcaccca

SEQ ID NO: 610715 - DNA, 25 bp, Mus musculus
ggcagagagttgtgggattcaccca

SEQ ID NO: 610716 - DNA, 25 bp, Mus musculus
ggcagagatagtaaatgttcataat

SEQ ID NO: 610717 - DNA, 25 bp, Mus musculus
ggcagagatagttaatgttcataat

SEQ ID NO: 610718 - DNA, 25 bp, Mus musculus
ggcagagatccactccacttattga

SEQ ID NO: 610719 - DNA, 25 bp, Mus musculus
ggcagagatccagtccacttattga

SEQ ID NO: 610720 - DNA, 25 bp, Mus musculus
ggcagagatcgaaacacataaccct

SEQ ID NO: 610721 - DNA, 25 bp, Mus musculus
ggcagagatcgatacacataaccct

SEQ ID NO: 610722 - DNA, 25 bp, Mus musculus
ggcagagatctaattatggtcctaa

SEQ ID NO: 610723 - DNA, 25 bp, Mus musculus
ggcagagatctatttatggtcctaa

SEQ ID NO: 610724 - DNA, 25 bp, Mus musculus
ggcagagatgtcctgagacacccag

SEQ ID NO: 610725 - DNA, 25 bp, Mus musculus
ggcagagatgtcgtgagacacccag

SEQ ID NO: 610726 - DNA, 25 bp, Mus musculus
ggcagagatgtgatatcagttccat

SEQ ID NO: 610727 - DNA, 25 bp, Mus musculus
ggcagagatgtgttatcagttccat

SEQ ID NO: 610728 - DNA, 25 bp, Mus musculus
ggcagagattacattcattgacagg

SEQ ID NO: 610729 - DNA, 25 bp, Mus musculus
ggcagagattactttcattgacagg

SEQ ID NO: 610730 - DNA, 25 bp, Mus musculus
ggcagagattagcagttccaaattt

SEQ ID NO: 610731 - DNA, 25 bp, Mus musculus
ggcagagattaggagttccaaattt

SEQ ID NO: 610732 - DNA, 25 bp, Mus musculus
ggcagagcacagacgcccttgtggg

SEQ ID NO: 610733 - DNA, 25 bp, Mus musculus
ggcagagcacagtcgcccttgtggg

SEQ ID NO: 610734 - DNA, 25 bp, Mus musculus
ggcagagcacccaccagcaaggaac

SEQ ID NO: 610735 - DNA, 25 bp, Mus musculus
ggcagagcaccctccagcaaggaac

SEQ ID NO: 610736 - DNA, 25 bp, Mus musculus
ggcagagcagaacatccgctactat

SEQ ID NO: 610737 - DNA, 25 bp, Mus musculus
ggcagagcagaaccacagtttcgtt

SEQ ID NO: 610738 - DNA, 25 bp, Mus musculus
ggcagagcagaagatccgctactat

SEQ ID NO: 610739 - DNA, 25 bp, Mus musculus
ggcagagcagaagcacagtttcgtt

SEQ ID NO: 610740 - DNA, 25 bp, Mus musculus
ggcagagcatcgcagccttccagaa

SEQ ID NO: 610741 - DNA, 25 bp, Mus musculus
ggcagagcatcggagccttccagaa

SEQ ID NO: 610742 - DNA, 25 bp, Mus musculus
ggcagagcatctccggctccctaga

SEQ ID NO: 610743 - DNA, 25 bp, Mus musculus
ggcagagcatctgcggctccctaga

SEQ ID NO: 610744 - DNA, 25 bp, Mus musculus
ggcagagcatgccaagtctcaaaga

SEQ ID NO: 610745 - DNA, 25 bp, Mus musculus
ggcagagcatgcgaagtctcaaaga

SEQ ID NO: 610746 - DNA, 25 bp, Mus musculus
ggcagagcattacgcagctggtaat

SEQ ID NO: 610747 - DNA, 25 bp, Mus musculus
ggcagagcattaggcagctggtaat

SEQ ID NO: 610748 - DNA, 25 bp, Mus musculus
ggcagagccatgaacatactcagtg

SEQ ID NO: 610749 - DNA, 25 bp, Mus musculus
ggcagagccatgtacatactcagtg

SEQ ID NO: 610750 - DNA, 25 bp, Mus musculus
ggcagagccccacaattatgaattg

SEQ ID NO: 610751 - DNA, 25 bp, Mus musculus
ggcagagccccagaattatgaattg

SEQ ID NO: 610752 - DNA, 25 bp, Mus musculus
ggcagagcccgacaaatggttcaaa

SEQ ID NO: 610753 - DNA, 25 bp, Mus musculus
ggcagagcccgagaaatggttcaaa

SEQ ID NO: 610754 - DNA, 25 bp, Mus musculus
ggcagagcccttcccaaaatcaaca

SEQ ID NO: 610755 - DNA, 25 bp, Mus musculus
ggcagagcccttgccaaaatcaaca

SEQ ID NO: 610756 - DNA, 25 bp, Mus musculus
ggcagagccggaacctatgcacaga

SEQ ID NO: 610757 - DNA, 25 bp, Mus musculus
ggcagagccggatcctatgcacaga

SEQ ID NO: 610758 - DNA, 25 bp, Mus musculus
ggcagagcctgacacctcagaggtt

SEQ ID NO: 610759 - DNA, 25 bp, Mus musculus
ggcagagcctgagacctcagaggtt

SEQ ID NO: 610760 - DNA, 25 bp, Mus musculus
ggcagagcgttgcacatcctgattt

SEQ ID NO: 610761 - DNA, 25 bp, Mus musculus
ggcagagcgttggacatcctgattt

SEQ ID NO: 610762 - DNA, 25 bp, Mus musculus
ggcagagctaccactggctgtccag

SEQ ID NO: 610763 - DNA, 25 bp, Mus musculus
ggcagagctacctctggctgtccag

SEQ ID NO: 610764 - DNA, 25 bp, Mus musculus
ggcagagctagccttgcagagactt

SEQ ID NO: 610765 - DNA, 25 bp, Mus musculus
ggcagagctagcgttgcagagactt

SEQ ID NO: 610766 - DNA, 25 bp, Mus musculus
ggcagagctataagcttccatcttt

SEQ ID NO: 610767 - DNA, 25 bp, Mus musculus
ggcagagctatatgcttccatcttt

SEQ ID NO: 610768 - DNA, 25 bp, Mus musculus
ggcagagctctaagcttacagccgc

SEQ ID NO: 610769 - DNA, 25 bp, Mus musculus
ggcagagctctacttggacacaggt

SEQ ID NO: 610770 - DNA, 25 bp, Mus musculus
ggcagagctctagttggacacaggt

SEQ ID NO: 610771 - DNA, 25 bp, Mus musculus
ggcagagctctatgcttacagccgc

SEQ ID NO: 610772 - DNA, 25 bp, Mus musculus
ggcagagctgaaatcagaccgtgtg

SEQ ID NO: 610773 - DNA, 25 bp, Mus musculus
ggcagagctgaattcagaccgtgtg

SEQ ID NO: 610774 - DNA, 25 bp, Mus musculus
ggcagagctggcaacagtcccttat

SEQ ID NO: 610775 - DNA, 25 bp, Mus musculus
ggcagagctggctacagtcccttat

SEQ ID NO: 610776 - DNA, 25 bp, Mus musculus
ggcagagctggtatttctttgtttc

SEQ ID NO: 610777 - DNA, 25 bp, Mus musculus
ggcagagctggtttttctttgtttc

SEQ ID NO: 610778 - DNA, 25 bp, Mus musculus
ggcagagctgttcacatagccctcc

SEQ ID NO: 610779 - DNA, 25 bp, Mus musculus
ggcagagctgttgacatagccctcc

SEQ ID NO: 610780 - DNA, 25 bp, Mus musculus
ggcagagcttgtacccatggagtat

SEQ ID NO: 610781 - DNA, 25 bp, Mus musculus
ggcagagcttgttcccatggagtat

SEQ ID NO: 610782 - DNA, 25 bp, Mus musculus
ggcagagctttcatgggtgttgaaa

SEQ ID NO: 610783 - DNA, 25 bp, Mus musculus
ggcagagctttcttgggtgttgaaa

SEQ ID NO: 610784 - DNA, 25 bp, Mus musculus
ggcagaggacagagagattagtttc

SEQ ID NO: 610785 - DNA, 25 bp, Mus musculus
ggcagaggacagtgagattagtttc

SEQ ID NO: 610786 - DNA, 25 bp, Mus musculus
ggcagaggatccagacactcttctt

SEQ ID NO: 610787 - DNA, 25 bp, Mus musculus
ggcagaggatcctgacactcttctt

SEQ ID NO: 610788 - DNA, 25 bp, Mus musculus
ggcagaggattcctaaacttcagat

SEQ ID NO: 610789 - DNA, 25 bp, Mus musculus
ggcagaggattcgtaaacttcagat

SEQ ID NO: 610790 - DNA, 25 bp, Mus musculus
ggcagaggcagcaggatctgatttt

SEQ ID NO: 610791 - DNA, 25 bp, Mus musculus
ggcagaggcagctggatctgatttt

SEQ ID NO: 610792 - DNA, 25 bp, Mus musculus
ggcagaggcatgaggttcaccaatg

SEQ ID NO: 610793 - DNA, 25 bp, Mus musculus
ggcagaggcatgtggttcaccaatg

SEQ ID NO: 610794 - DNA, 25 bp, Mus musculus
ggcagaggccaccatcaggaaacaa

SEQ ID NO: 610795 - DNA, 25 bp, Mus musculus
ggcagaggccacgatcaggaaacaa

SEQ ID NO: 610796 - DNA, 25 bp, Mus musculus
ggcagaggctgtcgctgacctggaa

SEQ ID NO: 610797 - DNA, 25 bp, Mus musculus
ggcagaggctgtggctgacctggaa

SEQ ID NO: 610798 - DNA, 25 bp, Mus musculus
ggcagaggctttactctagaggctt

SEQ ID NO: 610799 - DNA, 25 bp, Mus musculus
ggcagaggcttttctctagaggctt

SEQ ID NO: 610800 - DNA, 25 bp, Mus musculus
ggcagagggagaacttccctaacct

SEQ ID NO: 610801 - DNA, 25 bp, Mus musculus
ggcagagggagatcttccctaacct

SEQ ID NO: 610802 - DNA, 25 bp, Mus musculus
ggcagagggcaaatgattacttaat

SEQ ID NO: 610803 - DNA, 25 bp, Mus musculus
ggcagagggcaattgattacttaat

SEQ ID NO: 610804 - DNA, 25 bp, Mus musculus
ggcagagggcgcattaatttcaaaa

SEQ ID NO: 610805 - DNA, 25 bp, Mus musculus
ggcagagggcgctttaatttcaaaa

SEQ ID NO: 610806 - DNA, 25 bp, Mus musculus
ggcagaggtccaccgaaggtacaaa

SEQ ID NO: 610807 - DNA, 25 bp, Mus musculus
ggcagaggtccagcgaaggtacaaa

SEQ ID NO: 610808 - DNA, 25 bp, Mus musculus
ggcagaggtgccaaatataccacag

SEQ ID NO: 610809 - DNA, 25 bp, Mus musculus
ggcagaggtgcctaatataccacag

SEQ ID NO: 610810 - DNA, 25 bp, Mus musculus
ggcagaggtggtctcctatgttacc

SEQ ID NO: 610811 - DNA, 25 bp, Mus musculus
ggcagaggtggtgtcctatgttacc

SEQ ID NO: 610812 - DNA, 25 bp, Mus musculus
ggcagagtcactacatgggcaccgg

SEQ ID NO: 610813 - DNA, 25 bp, Mus musculus
ggcagagtcactccagaatccagaa

SEQ ID NO: 610814 - DNA, 25 bp, Mus musculus
ggcagagtcactgcagaatccagaa

SEQ ID NO: 610815 - DNA, 25 bp, Mus musculus
ggcagagtcacttcatgggcaccgg

SEQ ID NO: 610816 - DNA, 25 bp, Mus musculus
ggcagagtcagtatctgtacccctt

SEQ ID NO: 610817 - DNA, 25 bp, Mus musculus
ggcagagtcagtttctgtacccctt

SEQ ID NO: 610818 - DNA, 25 bp, Mus musculus
ggcagagtcatgattctttccctaa

SEQ ID NO: 610819 - DNA, 25 bp, Mus musculus
ggcagagtcatgtttctttccctaa

SEQ ID NO: 610820 - DNA, 25 bp, Mus musculus
ggcagagtccatcctgacacagctg

SEQ ID NO: 610821 - DNA, 25 bp, Mus musculus
ggcagagtccatgctgacacagctg

SEQ ID NO: 610822 - DNA, 25 bp, Mus musculus
ggcagagtcttgctcagcctgaacc

SEQ ID NO: 610823 - DNA, 25 bp, Mus musculus
ggcagagtcttggtcagcctgaacc

SEQ ID NO: 610824 - DNA, 25 bp, Mus musculus
ggcagagtgcagcaattccgcacat

SEQ ID NO: 610825 - DNA, 25 bp, Mus musculus
ggcagagtgcaggaattccgcacat

SEQ ID NO: 610826 - DNA, 25 bp, Mus musculus
ggcagagtggccattgttgaagcaa

SEQ ID NO: 610827 - DNA, 25 bp, Mus musculus
ggcagagtggcctttgttgaagcaa

SEQ ID NO: 610828 - DNA, 25 bp, Mus musculus
ggcagagtgggtctcgggcaggtag

SEQ ID NO: 610829 - DNA, 25 bp, Mus musculus
ggcagagtgggtgtcgggcaggtag

SEQ ID NO: 610830 - DNA, 25 bp, Mus musculus
ggcagagttaaacgcatacttgcaa

SEQ ID NO: 610831 - DNA, 25 bp, Mus musculus
ggcagagttaaaggcatacttgcaa

SEQ ID NO: 610832 - DNA, 25 bp, Mus musculus
ggcagagttacaaccccggtaccca

SEQ ID NO: 610833 - DNA, 25 bp, Mus musculus
ggcagagttacatccccggtaccca

SEQ ID NO: 610834 - DNA, 25 bp, Mus musculus
ggcagagttatcactccagacacat

SEQ ID NO: 610835 - DNA, 25 bp, Mus musculus
ggcagagttatctctccagacacat

SEQ ID NO: 610836 - DNA, 25 bp, Mus musculus
ggcagagttgagatacttggcactt

SEQ ID NO: 610837 - DNA, 25 bp, Mus musculus
ggcagagttgagttacttggcactt

SEQ ID NO: 610838 - DNA, 25 bp, Mus musculus
ggcagataaagacttccatgcaccg

SEQ ID NO: 610839 - DNA, 25 bp, Mus musculus
ggcagataaagagttccatgcaccg

SEQ ID NO: 610840 - DNA, 25 bp, Mus musculus
ggcagataaagcataccagattgta

SEQ ID NO: 610841 - DNA, 25 bp, Mus musculus
ggcagataaagcttaccagattgta

SEQ ID NO: 610842 - DNA, 25 bp, Mus musculus
ggcagatactatcactgggacccac

SEQ ID NO: 610843 - DNA, 25 bp, Mus musculus
ggcagatactatgactgggacccac

SEQ ID NO: 610844 - DNA, 25 bp, Mus musculus
ggcagatactgtagttttcattttc

SEQ ID NO: 610845 - DNA, 25 bp, Mus musculus
ggcagatactgttgttttcattttc

SEQ ID NO: 610846 - DNA, 25 bp, Mus musculus
ggcagataggttcttggtagtctct

SEQ ID NO: 610847 - DNA, 25 bp, Mus musculus
ggcagataggttgttggtagtctct

SEQ ID NO: 610848 - DNA, 25 bp, Mus musculus
ggcagatatggaagagctcttctct

SEQ ID NO: 610849 - DNA, 25 bp, Mus musculus
ggcagatatggatgagctcttctct

SEQ ID NO: 610850 - DNA, 25 bp, Mus musculus
ggcagatatgtcacggagttaccaa

SEQ ID NO: 610851 - DNA, 25 bp, Mus musculus
ggcagatatgtctcggagttaccaa

SEQ ID NO: 610852 - DNA, 25 bp, Mus musculus
ggcagatatttgaggctttcgagct

SEQ ID NO: 610853 - DNA, 25 bp, Mus musculus
ggcagatatttgtggctttcgagct

SEQ ID NO: 610854 - DNA, 25 bp, Mus musculus
ggcagatcaactacatgctgcagtt

SEQ ID NO: 610855 - DNA, 25 bp, Mus musculus
ggcagatcaacttcatgctgcagtt

SEQ ID NO: 610856 - DNA, 25 bp, Mus musculus
ggcagatcaccaatgacgacttcct

SEQ ID NO: 610857 - DNA, 25 bp, Mus musculus
ggcagatcaccattgacgacttcct

SEQ ID NO: 610858 - DNA, 25 bp, Mus musculus
ggcagatcatgaactggagtctcgt

SEQ ID NO: 610859 - DNA, 25 bp, Mus musculus
ggcagatcatgatctggagtctcgt

SEQ ID NO: 610860 - DNA, 25 bp, Mus musculus
ggcagatcatttctatgggctagat

SEQ ID NO: 610861 - DNA, 25 bp, Mus musculus
ggcagatcatttgtatgggctagat

SEQ ID NO: 610862 - DNA, 25 bp, Mus musculus
ggcagatccaaccagcaaccagagg

SEQ ID NO: 610863 - DNA, 25 bp, Mus musculus
ggcagatccaacgagcaaccagagg

SEQ ID NO: 610864 - DNA, 25 bp, Mus musculus
ggcagatccaccaacaggctggcga

SEQ ID NO: 610865 - DNA, 25 bp, Mus musculus
ggcagatccacctacaggctggcga

SEQ ID NO: 610866 - DNA, 25 bp, Mus musculus
ggcagatcccaaaaggaaacgatca

SEQ ID NO: 610867 - DNA, 25 bp, Mus musculus
ggcagatcccaataggaaacgatca

SEQ ID NO: 610868 - DNA, 25 bp, Mus musculus
ggcagatcccgtcgaacctcaagta

SEQ ID NO: 610869 - DNA, 25 bp, Mus musculus
ggcagatcccgtggaacctcaagta

SEQ ID NO: 610870 - DNA, 25 bp, Mus musculus
ggcagatccctgaaagtttgtttga

SEQ ID NO: 610871 - DNA, 25 bp, Mus musculus
ggcagatccctgcaggctatcaaga

SEQ ID NO: 610872 - DNA, 25 bp, Mus musculus
ggcagatccctggaggctatcaaga

SEQ ID NO: 610873 - DNA, 25 bp, Mus musculus
ggcagatccctgtaagtttgtttga

SEQ ID NO: 610874 - DNA, 25 bp, Mus musculus
ggcagatccgatattaatacccatt

SEQ ID NO: 610875 - DNA, 25 bp, Mus musculus
ggcagatccgattttaatacccatt

SEQ ID NO: 610876 - DNA, 25 bp, Mus musculus
ggcagatcctcaagttaacagtata

SEQ ID NO: 610877 - DNA, 25 bp, Mus musculus
ggcagatcctcatgttaacagtata

SEQ ID NO: 610878 - DNA, 25 bp, Mus musculus
ggcagatcgaatattggcagcagtc

SEQ ID NO: 610879 - DNA, 25 bp, Mus musculus
ggcagatcgaattttggcagcagtc

SEQ ID NO: 610880 - DNA, 25 bp, Mus musculus
ggcagatcgctaagggcgccttgac

SEQ ID NO: 610881 - DNA, 25 bp, Mus musculus
ggcagatcgctatgggcgccttgac

SEQ ID NO: 610882 - DNA, 25 bp, Mus musculus
ggcagatcgtgtaagagctccagga

SEQ ID NO: 610883 - DNA, 25 bp, Mus musculus
ggcagatcgtgttagagctccagga

SEQ ID NO: 610884 - DNA, 25 bp, Mus musculus
ggcagatcgttaactatgagctagc

SEQ ID NO: 610885 - DNA, 25 bp, Mus musculus
ggcagatcgttatctatgagctagc

SEQ ID NO: 610886 - DNA, 25 bp, Mus musculus
ggcagatctctgaaactttgaagat

SEQ ID NO: 610887 - DNA, 25 bp, Mus musculus
ggcagatctctgtaactttgaagat

SEQ ID NO: 610888 - DNA, 25 bp, Mus musculus
ggcagatctcttctagcctggtcta

SEQ ID NO: 610889 - DNA, 25 bp, Mus musculus
ggcagatctcttgtagcctggtcta

SEQ ID NO: 610890 - DNA, 25 bp, Mus musculus
ggcagatcttcaaagttctggcttt

SEQ ID NO: 610891 - DNA, 25 bp, Mus musculus
ggcagatcttcatagttctggcttt

SEQ ID NO: 610892 - DNA, 25 bp, Mus musculus
ggcagatctttgctatctttagctt

SEQ ID NO: 610893 - DNA, 25 bp, Mus musculus
ggcagatctttggtatctttagctt

SEQ ID NO: 610894 - DNA, 25 bp, Mus musculus
ggcagatgaaatcaccttcttcccc

SEQ ID NO: 610895 - DNA, 25 bp, Mus musculus
ggcagatgaaatgaccttcttcccc

SEQ ID NO: 610896 - DNA, 25 bp, Mus musculus
ggcagatgaacacccagctaagatt

SEQ ID NO: 610897 - DNA, 25 bp, Mus musculus
ggcagatgaacagccagctaagatt

SEQ ID NO: 610898 - DNA, 25 bp, Mus musculus
ggcagatgagatcccaacactacca

SEQ ID NO: 610899 - DNA, 25 bp, Mus musculus
ggcagatgagatgccaacactacca

SEQ ID NO: 610900 - DNA, 25 bp, Mus musculus
ggcagatgagctctggcactgtaat

SEQ ID NO: 610901 - DNA, 25 bp, Mus musculus
ggcagatgagctgtggcactgtaat

SEQ ID NO: 610902 - DNA, 25 bp, Mus musculus
ggcagatgcagaactatgttagttc

SEQ ID NO: 610903 - DNA, 25 bp, Mus musculus
ggcagatgcagatctatgttagttc

SEQ ID NO: 610904 - DNA, 25 bp, Mus musculus
ggcagatgccacagccttcagaaaa

SEQ ID NO: 610905 - DNA, 25 bp, Mus musculus
ggcagatgccactgccttcagaaaa

SEQ ID NO: 610906 - DNA, 25 bp, Mus musculus
ggcagatgcccaagactatgaccga

SEQ ID NO: 610907 - DNA, 25 bp, Mus musculus
ggcagatgcccatgactatgaccga

SEQ ID NO: 610908 - DNA, 25 bp, Mus musculus
ggcagatgcctccatttggaagctt

SEQ ID NO: 610909 - DNA, 25 bp, Mus musculus
ggcagatgcctcgatttggaagctt

SEQ ID NO: 610910 - DNA, 25 bp, Mus musculus
ggcagatgcgtaactcaatgacttc

SEQ ID NO: 610911 - DNA, 25 bp, Mus musculus
ggcagatgcgtatctcaatgacttc

SEQ ID NO: 610912 - DNA, 25 bp, Mus musculus
ggcagatgcgtccttttgaatagac

SEQ ID NO: 610913 - DNA, 25 bp, Mus musculus
ggcagatgcgtcgttttgaatagac

SEQ ID NO: 610914 - DNA, 25 bp, Mus musculus
ggcagatgctaacctgttgctgttt

SEQ ID NO: 610915 - DNA, 25 bp, Mus musculus
ggcagatgctaagctgttgctgttt

SEQ ID NO: 610916 - DNA, 25 bp, Mus musculus
ggcagatgctccagtttcacttaag

SEQ ID NO: 610917 - DNA, 25 bp, Mus musculus
ggcagatgctcctgtttcacttaag

SEQ ID NO: 610918 - DNA, 25 bp, Mus musculus
ggcagatgctgaatagacccacctt

SEQ ID NO: 610919 - DNA, 25 bp, Mus musculus
ggcagatgctgattagacccacctt

SEQ ID NO: 610920 - DNA, 25 bp, Mus musculus
ggcagatggcaaacactgacttgta

SEQ ID NO: 610921 - DNA, 25 bp, Mus musculus
ggcagatggcaatcactgacttgta

SEQ ID NO: 610922 - DNA, 25 bp, Mus musculus
ggcagatggccacatagcggtcata

SEQ ID NO: 610923 - DNA, 25 bp, Mus musculus
ggcagatggccagatagcggtcata

SEQ ID NO: 610924 - DNA, 25 bp, Mus musculus
ggcagatggctcacgcccaggaagt

SEQ ID NO: 610925 - DNA, 25 bp, Mus musculus
ggcagatggctctcgcccaggaagt

SEQ ID NO: 610926 - DNA, 25 bp, Mus musculus
ggcagatgtcaacgagatagtcccc

SEQ ID NO: 610927 - DNA, 25 bp, Mus musculus
ggcagatgtcaaggagatagtcccc

SEQ ID NO: 610928 - DNA, 25 bp, Mus musculus
ggcagatgtctacgcatcctggcca

SEQ ID NO: 610929 - DNA, 25 bp, Mus musculus
ggcagatgtctaggcatcctggcca

SEQ ID NO: 610930 - DNA, 25 bp, Mus musculus
ggcagatgtctgaattacaggccag

SEQ ID NO: 610931 - DNA, 25 bp, Mus musculus
ggcagatgtctgtattacaggccag

SEQ ID NO: 610932 - DNA, 25 bp, Mus musculus
ggcagatgtgcccatggagtactct

SEQ ID NO: 610933 - DNA, 25 bp, Mus musculus
ggcagatgtgccgatggagtactct

SEQ ID NO: 610934 - DNA, 25 bp, Mus musculus
ggcagatgtgtacgatatttccaac

SEQ ID NO: 610935 - DNA, 25 bp, Mus musculus
ggcagatgtgtaggatatttccaac

SEQ ID NO: 610936 - DNA, 25 bp, Mus musculus
ggcagatgttaaagtccccagacat

SEQ ID NO: 610937 - DNA, 25 bp, Mus musculus
ggcagatgttaatgtccccagacat

SEQ ID NO: 610938 - DNA, 25 bp, Mus musculus
ggcagatgttccagtgacacctcat

SEQ ID NO: 610939 - DNA, 25 bp, Mus musculus
ggcagatgttcctgtgacacctcat

SEQ ID NO: 610940 - DNA, 25 bp, Mus musculus
ggcagatgtttaaggatttcaggct

SEQ ID NO: 610941 - DNA, 25 bp, Mus musculus
ggcagatgtttatggatttcaggct

SEQ ID NO: 610942 - DNA, 25 bp, Mus musculus
ggcagatgtttgaccagagagtcaa

SEQ ID NO: 610943 - DNA, 25 bp, Mus musculus
ggcagatgtttgtccagagagtcaa

SEQ ID NO: 610944 - DNA, 25 bp, Mus musculus
ggcagattagcaatctcccaggtca

SEQ ID NO: 610945 - DNA, 25 bp, Mus musculus
ggcagattagcattctcccaggtca

SEQ ID NO: 610946 - DNA, 25 bp, Mus musculus
ggcagattatagcaggccataatac

SEQ ID NO: 610947 - DNA, 25 bp, Mus musculus
ggcagattataggaggccataatac

SEQ ID NO: 610948 - DNA, 25 bp, Mus musculus
ggcagattatatcttttagaaggtt

SEQ ID NO: 610949 - DNA, 25 bp, Mus musculus
ggcagattatatgttttagaaggtt

SEQ ID NO: 610950 - DNA, 25 bp, Mus musculus
ggcagattatgtagtcctcacagaa

SEQ ID NO: 610951 - DNA, 25 bp, Mus musculus
ggcagattatgttgtcctcacagaa

SEQ ID NO: 610952 - DNA, 25 bp, Mus musculus
ggcagattcagtatccattaggaga

SEQ ID NO: 610953 - DNA, 25 bp, Mus musculus
ggcagattcagtttccattaggaga

SEQ ID NO: 610954 - DNA, 25 bp, Mus musculus
ggcagattcccaacgttttagacaa

SEQ ID NO: 610955 - DNA, 25 bp, Mus musculus
ggcagattcccatcgttttagacaa

SEQ ID NO: 610956 - DNA, 25 bp, Mus musculus
ggcagattctcgaacatttgtttca

SEQ ID NO: 610957 - DNA, 25 bp, Mus musculus
ggcagattctcgtacatttgtttca

SEQ ID NO: 610958 - DNA, 25 bp, Mus musculus
ggcagattctgcctaacgtggcatc

SEQ ID NO: 610959 - DNA, 25 bp, Mus musculus
ggcagattctgcgtaacgtggcatc

SEQ ID NO: 610960 - DNA, 25 bp, Mus musculus
ggcagattgcagaacggccttcagc

SEQ ID NO: 610961 - DNA, 25 bp, Mus musculus
ggcagattgcagtacggccttcagc

SEQ ID NO: 610962 - DNA, 25 bp, Mus musculus
ggcagattgctaaccagtgtccaga

SEQ ID NO: 610963 - DNA, 25 bp, Mus musculus
ggcagattgctatccagtgtccaga

SEQ ID NO: 610964 - DNA, 25 bp, Mus musculus
ggcagattggccagagtcttttgct

SEQ ID NO: 610965 - DNA, 25 bp, Mus musculus
ggcagattggcctgagtcttttgct

SEQ ID NO: 610966 - DNA, 25 bp, Mus musculus
ggcagattggctcatcgatccagaa

SEQ ID NO: 610967 - DNA, 25 bp, Mus musculus
ggcagattggctgatcgatccagaa

SEQ ID NO: 610968 - DNA, 25 bp, Mus musculus
ggcagattgtttcctcagccaagat

SEQ ID NO: 610969 - DNA, 25 bp, Mus musculus
ggcagattgtttgctcagccaagat

SEQ ID NO: 610970 - DNA, 25 bp, Mus musculus
ggcagatttagacacctgggattac

SEQ ID NO: 610971 - DNA, 25 bp, Mus musculus
ggcagatttagagacctgggattac

SEQ ID NO: 610972 - DNA, 25 bp, Mus musculus
ggcagatttattcacacacccatac

SEQ ID NO: 610973 - DNA, 25 bp, Mus musculus
ggcagatttattgacacacccatac

SEQ ID NO: 610974 - DNA, 25 bp, Mus musculus
ggcagatttctgaaagagagaggac

SEQ ID NO: 610975 - DNA, 25 bp, Mus musculus
ggcagatttctgtaagagagaggac

SEQ ID NO: 610976 - DNA, 25 bp, Mus musculus
ggcagatttgcaagtttacaccttt

SEQ ID NO: 610977 - DNA, 25 bp, Mus musculus
ggcagatttgcatgtttacaccttt

SEQ ID NO: 610978 - DNA, 25 bp, Mus musculus
ggcagatttgctatgcagctggcaa

SEQ ID NO: 610979 - DNA, 25 bp, Mus musculus
ggcagatttgctttgcagctggcaa

SEQ ID NO: 610980 - DNA, 25 bp, Mus musculus
ggcagatttggcagcccaggcagaa

SEQ ID NO: 610981 - DNA, 25 bp, Mus musculus
ggcagatttggctgcccaggcagaa

SEQ ID NO: 610982 - DNA, 25 bp, Mus musculus
ggcagattttcaaaaggctttttca

SEQ ID NO: 610983 - DNA, 25 bp, Mus musculus
ggcagattttcataaggctttttca

SEQ ID NO: 610984 - DNA, 25 bp, Mus musculus
ggcagattttcccattgtctactga

SEQ ID NO: 610985 - DNA, 25 bp, Mus musculus
ggcagattttccgattgtctactga

SEQ ID NO: 610986 - DNA, 25 bp, Mus musculus
ggcagcaaaaatctccaatgcggat

SEQ ID NO: 610987 - DNA, 25 bp, Mus musculus
ggcagcaaaaatgtccaatgcggat

SEQ ID NO: 610988 - DNA, 25 bp, Mus musculus
ggcagcaaaccccaattctgggaag

SEQ ID NO: 610989 - DNA, 25 bp, Mus musculus
ggcagcaaacccgaattctgggaag

SEQ ID NO: 610990 - DNA, 25 bp, Mus musculus
ggcagcaaagctatccagaaccatc

SEQ ID NO: 610991 - DNA, 25 bp, Mus musculus
ggcagcaaagctttccagaaccatc

SEQ ID NO: 610992 - DNA, 25 bp, Mus musculus
ggcagcaaatggctactctccggtg

SEQ ID NO: 610993 - DNA, 25 bp, Mus musculus
ggcagcaaatgggtactctccggtg

SEQ ID NO: 610994 - DNA, 25 bp, Mus musculus
ggcagcaaattcagccccgttgaaa

SEQ ID NO: 610995 - DNA, 25 bp, Mus musculus
ggcagcaaattctgccccgttgaaa

SEQ ID NO: 610996 - DNA, 25 bp, Mus musculus
ggcagcaaattgcacacctgtgaga

SEQ ID NO: 610997 - DNA, 25 bp, Mus musculus
ggcagcaaattggacacctgtgaga

SEQ ID NO: 610998 - DNA, 25 bp, Mus musculus
ggcagcaacataagcctggcgcagc

SEQ ID NO: 610999 - DNA, 25 bp, Mus musculus
ggcagcaacatatgcctggcgcagc

SEQ ID NO: 611000 - DNA, 25 bp, Mus musculus
ggcagcaaccttcagtattgtagct

SEQ ID NO: 611001 - DNA, 25 bp, Mus musculus
ggcagcaaccttgagtattgtagct

SEQ ID NO: 611002 - DNA, 25 bp, Mus musculus
ggcagcaacgctcgacgctgatgct

SEQ ID NO: 611003 - DNA, 25 bp, Mus musculus
ggcagcaacgctggacgctgatgct

SEQ ID NO: 611004 - DNA, 25 bp, Mus musculus
ggcagcaagaacacactgtggtcca

SEQ ID NO: 611005 - DNA, 25 bp, Mus musculus
ggcagcaagaactcactgtggtcca

SEQ ID NO: 611006 - DNA, 25 bp, Mus musculus
ggcagcaagaccagggtcggaacca

SEQ ID NO: 611007 - DNA, 25 bp, Mus musculus
ggcagcaagacctgggtcggaacca

SEQ ID NO: 611008 - DNA, 25 bp, Mus musculus
ggcagcaagagcatccagacctctg

SEQ ID NO: 611009 - DNA, 25 bp, Mus musculus
ggcagcaagagcttccagacctctg

SEQ ID NO: 611010 - DNA, 25 bp, Mus musculus
ggcagcaagaggcacatgccaagct

SEQ ID NO: 611011 - DNA, 25 bp, Mus musculus
ggcagcaagagggacatgccaagct

SEQ ID NO: 611012 - DNA, 25 bp, Mus musculus
ggcagcaagctgattttccttctgt

SEQ ID NO: 611013 - DNA, 25 bp, Mus musculus
ggcagcaagctgtttttccttctgt

SEQ ID NO: 611014 - DNA, 25 bp, Mus musculus
ggcagcaataccaactctagcagta

SEQ ID NO: 611015 - DNA, 25 bp, Mus musculus
ggcagcaatacctactctagcagta

SEQ ID NO: 611016 - DNA, 25 bp, Mus musculus
ggcagcaatctgaaggtcactctcc

SEQ ID NO: 611017 - DNA, 25 bp, Mus musculus
ggcagcaatctgtaggtcactctcc

SEQ ID NO: 611018 - DNA, 25 bp, Mus musculus
ggcagcaatggactctaggcagctc

SEQ ID NO: 611019 - DNA, 25 bp, Mus musculus
ggcagcaatggagtctaggcagctc

SEQ ID NO: 611020 - DNA, 25 bp, Mus musculus
ggcagcaattagaacccgcagcttt

SEQ ID NO: 611021 - DNA, 25 bp, Mus musculus
ggcagcaattagtacccgcagcttt

SEQ ID NO: 611022 - DNA, 25 bp, Mus musculus
ggcagcaattgcattaacccagtaa

SEQ ID NO: 611023 - DNA, 25 bp, Mus musculus
ggcagcaattgctttaacccagtaa

SEQ ID NO: 611024 - DNA, 25 bp, Mus musculus
ggcagcaatttcaatttcatggtta

SEQ ID NO: 611025 - DNA, 25 bp, Mus musculus
ggcagcaatttctatttcatggtta

SEQ ID NO: 611026 - DNA, 25 bp, Mus musculus
ggcagcacaaaacatagtccagact

SEQ ID NO: 611027 - DNA, 25 bp, Mus musculus
ggcagcacaaaagatagtccagact

SEQ ID NO: 611028 - DNA, 25 bp, Mus musculus
ggcagcaccaacattcctagacatg

SEQ ID NO: 611029 - DNA, 25 bp, Mus musculus
ggcagcaccaactttcctagacatg

SEQ ID NO: 611030 - DNA, 25 bp, Mus musculus
ggcagcaccaagctctaaacacaga

SEQ ID NO: 611031 - DNA, 25 bp, Mus musculus
ggcagcaccaaggtctaaacacaga

SEQ ID NO: 611032 - DNA, 25 bp, Mus musculus
ggcagcaccatactctctaaggcag

SEQ ID NO: 611033 - DNA, 25 bp, Mus musculus
ggcagcaccatagtctctaaggcag

SEQ ID NO: 611034 - DNA, 25 bp, Mus musculus
ggcagcaccatcagcacaaaattct

SEQ ID NO: 611035 - DNA, 25 bp, Mus musculus
ggcagcaccatctgcacaaaattct

SEQ ID NO: 611036 - DNA, 25 bp, Mus musculus
ggcagcaccatgaaagcttccttgg

SEQ ID NO: 611037 - DNA, 25 bp, Mus musculus
ggcagcaccatgtaagcttccttgg

SEQ ID NO: 611038 - DNA, 25 bp, Mus musculus
ggcagcaccattccttagttaggag

SEQ ID NO: 611039 - DNA, 25 bp, Mus musculus
ggcagcaccattgcttagttaggag

SEQ ID NO: 611040 - DNA, 25 bp, Mus musculus
ggcagcacccaacaaagacatttaa

SEQ ID NO: 611041 - DNA, 25 bp, Mus musculus
ggcagcacccaagaaagacatttaa

SEQ ID NO: 611042 - DNA, 25 bp, Mus musculus
ggcagcacccgcaccgtagctggag

SEQ ID NO: 611043 - DNA, 25 bp, Mus musculus
ggcagcacccgctccgtagctggag

SEQ ID NO: 611044 - DNA, 25 bp, Mus musculus
ggcagcacccttactctagaactag

SEQ ID NO: 611045 - DNA, 25 bp, Mus musculus
ggcagcaccctttctctagaactag

SEQ ID NO: 611046 - DNA, 25 bp, Mus musculus
ggcagcaccgagagcccaaggaata

SEQ ID NO: 611047 - DNA, 25 bp, Mus musculus
ggcagcaccgagtgcccaaggaata

SEQ ID NO: 611048 - DNA, 25 bp, Mus musculus
ggcagcacctggaggttaccaaagt

SEQ ID NO: 611049 - DNA, 25 bp, Mus musculus
ggcagcacctggtggttaccaaagt

SEQ ID NO: 611050 - DNA, 25 bp, Mus musculus
ggcagcactgctctggaaccagaga

SEQ ID NO: 611051 - DNA, 25 bp, Mus musculus
ggcagcactgctgtggaaccagaga

SEQ ID NO: 611052 - DNA, 25 bp, Mus musculus
ggcagcactggccttggagagcatc

SEQ ID NO: 611053 - DNA, 25 bp, Mus musculus
ggcagcactggcgttggagagcatc

SEQ ID NO: 611054 - DNA, 25 bp, Mus musculus
ggcagcactgtacatgttacctcaa

SEQ ID NO: 611055 - DNA, 25 bp, Mus musculus
ggcagcactgtagatgttacctcaa

SEQ ID NO: 611056 - DNA, 25 bp, Mus musculus
ggcagcactgtgattccaactaggt

SEQ ID NO: 611057 - DNA, 25 bp, Mus musculus
ggcagcactgtgtttccaactaggt

SEQ ID NO: 611058 - DNA, 25 bp, Mus musculus
ggcagcacttgaccttataagcaga

SEQ ID NO: 611059 - DNA, 25 bp, Mus musculus
ggcagcacttgagcttataagcaga

SEQ ID NO: 611060 - DNA, 25 bp, Mus musculus
ggcagcacttgccagatggcctcag

SEQ ID NO: 611061 - DNA, 25 bp, Mus musculus
ggcagcacttgcgagatggcctcag

SEQ ID NO: 611062 - DNA, 25 bp, Mus musculus
ggcagcagaaacatctgcagactta

SEQ ID NO: 611063 - DNA, 25 bp, Mus musculus
ggcagcagaaacttctgcagactta

SEQ ID NO: 611064 - DNA, 25 bp, Mus musculus
ggcagcagaaagcaccagctctcgg

SEQ ID NO: 611065 - DNA, 25 bp, Mus musculus
ggcagcagaaaggaccagctctcgg

SEQ ID NO: 611066 - DNA, 25 bp, Mus musculus
ggcagcagaaccaccaaggctaaga

SEQ ID NO: 611067 - DNA, 25 bp, Mus musculus
ggcagcagaacctccaaggctaaga

SEQ ID NO: 611068 - DNA, 25 bp, Mus musculus
ggcagcagacatctcctgtcctcat

SEQ ID NO: 611069 - DNA, 25 bp, Mus musculus
ggcagcagacatgtcctgtcctcat

SEQ ID NO: 611070 - DNA, 25 bp, Mus musculus
ggcagcagactgaccatttcccaga

SEQ ID NO: 611071 - DNA, 25 bp, Mus musculus
ggcagcagactgcttaggagcaatt

SEQ ID NO: 611072 - DNA, 25 bp, Mus musculus
ggcagcagactggttaggagcaatt

SEQ ID NO: 611073 - DNA, 25 bp, Mus musculus
ggcagcagactgtccatttcccaga

SEQ ID NO: 611074 - DNA, 25 bp, Mus musculus
ggcagcagagctatgatctcttggt

SEQ ID NO: 611075 - DNA, 25 bp, Mus musculus
ggcagcagagctttgatctcttggt

SEQ ID NO: 611076 - DNA, 25 bp, Mus musculus
ggcagcagatcaatgtataccacaa

SEQ ID NO: 611077 - DNA, 25 bp, Mus musculus
ggcagcagatcattgtataccacaa

SEQ ID NO: 611078 - DNA, 25 bp, Mus musculus
ggcagcagatctatgtggatgtcaa

SEQ ID NO: 611079 - DNA, 25 bp, Mus musculus
ggcagcagatctttgtggatgtcaa

SEQ ID NO: 611080 - DNA, 25 bp, Mus musculus
ggcagcagcaaacttctacagcttt

SEQ ID NO: 611081 - DNA, 25 bp, Mus musculus
ggcagcagcaaagttctacagcttt

SEQ ID NO: 611082 - DNA, 25 bp, Mus musculus
ggcagcagcatgacggacggcactc

SEQ ID NO: 611083 - DNA, 25 bp, Mus musculus
ggcagcagcatgtcggacggcactc

SEQ ID NO: 611084 - DNA, 25 bp, Mus musculus
ggcagcagccctagagattgagcta

SEQ ID NO: 611085 - DNA, 25 bp, Mus musculus
ggcagcagcccttgagattgagcta

SEQ ID NO: 611086 - DNA, 25 bp, Mus musculus
ggcagcagccgcacctgaggcagca

SEQ ID NO: 611087 - DNA, 25 bp, Mus musculus
ggcagcagccgcacctgaggtagca

SEQ ID NO: 611088 - DNA, 25 bp, Mus musculus
ggcagcagccgctcctgaggcagca

SEQ ID NO: 611089 - DNA, 25 bp, Mus musculus
ggcagcagccgctcctgaggtagca

SEQ ID NO: 611090 - DNA, 25 bp, Mus musculus
ggcagcagctatatgtaatcaacag

SEQ ID NO: 611091 - DNA, 25 bp, Mus musculus
ggcagcagctatttgtaatcaacag

SEQ ID NO: 611092 - DNA, 25 bp, Mus musculus
ggcagcagctgcactgcatagattt

SEQ ID NO: 611093 - DNA, 25 bp, Mus musculus
ggcagcagctgctctgcatagattt

SEQ ID NO: 611094 - DNA, 25 bp, Mus musculus
ggcagcagctgtatcatatccaaaa

SEQ ID NO: 611095 - DNA, 25 bp, Mus musculus
ggcagcagctgtttcatatccaaaa

SEQ ID NO: 611096 - DNA, 25 bp, Mus musculus
ggcagcaggactcaccaagtgacta

SEQ ID NO: 611097 - DNA, 25 bp, Mus musculus
ggcagcaggactgaccaagtgacta

SEQ ID NO: 611098 - DNA, 25 bp, Mus musculus
ggcagcaggcacatccagattggca

SEQ ID NO: 611099 - DNA, 25 bp, Mus musculus
ggcagcaggcacttccagattggca

SEQ ID NO: 611100 - DNA, 25 bp, Mus musculus
ggcagcaggtgaagacataagccta

SEQ ID NO: 611101 - DNA, 25 bp, Mus musculus
ggcagcaggtgatgacataagccta

SEQ ID NO: 611102 - DNA, 25 bp, Mus musculus
ggcagcaggtggacgagcctcctct

SEQ ID NO: 611103 - DNA, 25 bp, Mus musculus
ggcagcaggtggtcgagcctcctct

SEQ ID NO: 611104 - DNA, 25 bp, Mus musculus
ggcagcaggttaacctggtctacat

SEQ ID NO: 611105 - DNA, 25 bp, Mus musculus
ggcagcaggttatcctggtctacat

SEQ ID NO: 611106 - DNA, 25 bp, Mus musculus
ggcagcaggttgaatttgttaagca

SEQ ID NO: 611107 - DNA, 25 bp, Mus musculus
ggcagcaggttgtatttgttaagca

SEQ ID NO: 611108 - DNA, 25 bp, Mus musculus
ggcagcaggtttcacccagagtagc

SEQ ID NO: 611109 - DNA, 25 bp, Mus musculus
ggcagcaggtttgacccagagtagc

SEQ ID NO: 611110 - DNA, 25 bp, Mus musculus
ggcagcagtgccaataatgaagaca

SEQ ID NO: 611111 - DNA, 25 bp, Mus musculus
ggcagcagtgcctataatgaagaca

SEQ ID NO: 611112 - DNA, 25 bp, Mus musculus
ggcagcagtgctcgcatccatatga

SEQ ID NO: 611113 - DNA, 25 bp, Mus musculus
ggcagcagtgctggcatccatatga

SEQ ID NO: 611114 - DNA, 25 bp, Mus musculus
ggcagcagtttaagttctgatctgt

SEQ ID NO: 611115 - DNA, 25 bp, Mus musculus
ggcagcagtttatgttctgatctgt

SEQ ID NO: 611116 - DNA, 25 bp, Mus musculus
ggcagcatacaacgcatatcctgaa

SEQ ID NO: 611117 - DNA, 25 bp, Mus musculus
ggcagcatacaaggcatatcctgaa

SEQ ID NO: 611118 - DNA, 25 bp, Mus musculus
ggcagcatacctatcctaagcgagg

SEQ ID NO: 611119 - DNA, 25 bp, Mus musculus
ggcagcatacctttcctaagcgagg

SEQ ID NO: 611120 - DNA, 25 bp, Mus musculus
ggcagcatactcctgaatattctga

SEQ ID NO: 611121 - DNA, 25 bp, Mus musculus
ggcagcatactcgtgaatattctga

SEQ ID NO: 611122 - DNA, 25 bp, Mus musculus
ggcagcatactgagccagccatgca

SEQ ID NO: 611123 - DNA, 25 bp, Mus musculus
ggcagcatactgtgccagccatgca

SEQ ID NO: 611124 - DNA, 25 bp, Mus musculus
ggcagcatagatcagctctgtgctc

SEQ ID NO: 611125 - DNA, 25 bp, Mus musculus
ggcagcatagatgagctctgtgctc

SEQ ID NO: 611126 - DNA, 25 bp, Mus musculus
ggcagcatagtgagcccactgataa

SEQ ID NO: 611127 - DNA, 25 bp, Mus musculus
ggcagcatagtgtgcccactgataa

SEQ ID NO: 611128 - DNA, 25 bp, Mus musculus
ggcagcatcaaaagtttcagcttta

SEQ ID NO: 611129 - DNA, 25 bp, Mus musculus
ggcagcatcaaatgtttcagcttta

SEQ ID NO: 611130 - DNA, 25 bp, Mus musculus
ggcagcatcaagagtctccaaagga

SEQ ID NO: 611131 - DNA, 25 bp, Mus musculus
ggcagcatcaagtgtctccaaagga

SEQ ID NO: 611132 - DNA, 25 bp, Mus musculus
ggcagcatcctgactacagagagca

SEQ ID NO: 611133 - DNA, 25 bp, Mus musculus
ggcagcatcctgtctacagagagca

SEQ ID NO: 611134 - DNA, 25 bp, Mus musculus
ggcagcatctcacgtctacagaaca

SEQ ID NO: 611135 - DNA, 25 bp, Mus musculus
ggcagcatctcaggtctacagaaca

SEQ ID NO: 611136 - DNA, 25 bp, Mus musculus
ggcagcatctgcacagcacatggaa

SEQ ID NO: 611137 - DNA, 25 bp, Mus musculus
ggcagcatctgctcagcacatggaa

SEQ ID NO: 611138 - DNA, 25 bp, Mus musculus
ggcagcatgcatattttgaaagcta

SEQ ID NO: 611139 - DNA, 25 bp, Mus musculus
ggcagcatgcatctcacatctctga

SEQ ID NO: 611140 - DNA, 25 bp, Mus musculus
ggcagcatgcatgtcacatctctga

SEQ ID NO: 611141 - DNA, 25 bp, Mus musculus
ggcagcatgcattttttgaaagcta

SEQ ID NO: 611142 - DNA, 25 bp, Mus musculus
ggcagcatgtcgctctcaggtcaga

SEQ ID NO: 611143 - DNA, 25 bp, Mus musculus
ggcagcatgtcggtctcaggtcaga

SEQ ID NO: 611144 - DNA, 25 bp, Mus musculus
ggcagcattacacccaatcgtgtga

SEQ ID NO: 611145 - DNA, 25 bp, Mus musculus
ggcagcattacacccgtcaaatatg

SEQ ID NO: 611146 - DNA, 25 bp, Mus musculus
ggcagcattacagccaatcgtgtga

SEQ ID NO: 611147 - DNA, 25 bp, Mus musculus
ggcagcattacagccgtcaaatatg

SEQ ID NO: 611148 - DNA, 25 bp, Mus musculus
ggcagcattctgcagttcatgccct

SEQ ID NO: 611149 - DNA, 25 bp, Mus musculus
ggcagcattctggagttcatgccct

SEQ ID NO: 611150 - DNA, 25 bp, Mus musculus
ggcagcattgcaagattctccagtg

SEQ ID NO: 611151 - DNA, 25 bp, Mus musculus
ggcagcattgcatgattctccagtg

SEQ ID NO: 611152 - DNA, 25 bp, Mus musculus
ggcagcattgccatttatattacgt

SEQ ID NO: 611153 - DNA, 25 bp, Mus musculus
ggcagcattgccttttatattacgt

SEQ ID NO: 611154 - DNA, 25 bp, Mus musculus
ggcagcatttgtcatgggttgtaac

SEQ ID NO: 611155 - DNA, 25 bp, Mus musculus
ggcagcatttgtgatgggttgtaac

SEQ ID NO: 611156 - DNA, 25 bp, Mus musculus
ggcagccaaagcaggcctcctgggc

SEQ ID NO: 611157 - DNA, 25 bp, Mus musculus
ggcagccaaagctggcctcctgggc

SEQ ID NO: 611158 - DNA, 25 bp, Mus musculus
ggcagccaagccaagttattgtatc

SEQ ID NO: 611159 - DNA, 25 bp, Mus musculus
ggcagccaagcctagttattgtatc

SEQ ID NO: 611160 - DNA, 25 bp, Mus musculus
ggcagccaaggcacagatgtcccta

SEQ ID NO: 611161 - DNA, 25 bp, Mus musculus
ggcagccaaggccacttattaaaat

SEQ ID NO: 611162 - DNA, 25 bp, Mus musculus
ggcagccaaggcgacttattaaaat

SEQ ID NO: 611163 - DNA, 25 bp, Mus musculus
ggcagccaaggctcagatgtcccta

SEQ ID NO: 611164 - DNA, 25 bp, Mus musculus
ggcagccaatgacaaggccgttcat

SEQ ID NO: 611165 - DNA, 25 bp, Mus musculus
ggcagccaatgagaaggccgttcat

SEQ ID NO: 611166 - DNA, 25 bp, Mus musculus
ggcagccacactacgagcacagaaa

SEQ ID NO: 611167 - DNA, 25 bp, Mus musculus
ggcagccacacttcgagcacagaaa

SEQ ID NO: 611168 - DNA, 25 bp, Mus musculus
ggcagccacggtcttagccacagtg

SEQ ID NO: 611169 - DNA, 25 bp, Mus musculus
ggcagccacggtgttagccacagtg

SEQ ID NO: 611170 - DNA, 25 bp, Mus musculus
ggcagccactccacatggacaaaga

SEQ ID NO: 611171 - DNA, 25 bp, Mus musculus
ggcagccactcctcatggacaaaga

SEQ ID NO: 611172 - DNA, 25 bp, Mus musculus
ggcagccactgtagttcttactgta

SEQ ID NO: 611173 - DNA, 25 bp, Mus musculus
ggcagccactgttgttcttactgta

SEQ ID NO: 611174 - DNA, 25 bp, Mus musculus
ggcagccagacaaacacatcaataa

SEQ ID NO: 611175 - DNA, 25 bp, Mus musculus
ggcagccagacatacacatcaataa

SEQ ID NO: 611176 - DNA, 25 bp, Mus musculus
ggcagccagaggactacactgagca

SEQ ID NO: 611177 - DNA, 25 bp, Mus musculus
ggcagccagaggtctacactgagca

SEQ ID NO: 611178 - DNA, 25 bp, Mus musculus
ggcagccagcggagaactacaagaa

SEQ ID NO: 611179 - DNA, 25 bp, Mus musculus
ggcagccagcggtgaactacaagaa

SEQ ID NO: 611180 - DNA, 25 bp, Mus musculus
ggcagccagggacaaacttattcaa

SEQ ID NO: 611181 - DNA, 25 bp, Mus musculus
ggcagccagggagaaacttattcaa

SEQ ID NO: 611182 - DNA, 25 bp, Mus musculus
ggcagccagtgacctacaaagtcag

SEQ ID NO: 611183 - DNA, 25 bp, Mus musculus
ggcagccagtgagctacaaagtcag

SEQ ID NO: 611184 - DNA, 25 bp, Mus musculus
ggcagccagtgtataaccagtcctt

SEQ ID NO: 611185 - DNA, 25 bp, Mus musculus
ggcagccagtgtttaaccagtcctt

SEQ ID NO: 611186 - DNA, 25 bp, Mus musculus
ggcagccatagcaacttttgctact

SEQ ID NO: 611187 - DNA, 25 bp, Mus musculus
ggcagccatagctacttttgctact

SEQ ID NO: 611188 - DNA, 25 bp, Mus musculus
ggcagccatcaaagagtcctggaca

SEQ ID NO: 611189 - DNA, 25 bp, Mus musculus
ggcagccatcaatgagtcctggaca

SEQ ID NO: 611190 - DNA, 25 bp, Mus musculus
ggcagccatcttctctgctaactga

SEQ ID NO: 611191 - DNA, 25 bp, Mus musculus
ggcagccatcttgtctgctaactga

SEQ ID NO: 611192 - DNA, 25 bp, Mus musculus
ggcagccatgtgctgcatatgcatt

SEQ ID NO: 611193 - DNA, 25 bp, Mus musculus
ggcagccatgtggtgcatatgcatt

SEQ ID NO: 611194 - DNA, 25 bp, Mus musculus
ggcagccattccagagggcatgaga

SEQ ID NO: 611195 - DNA, 25 bp, Mus musculus
ggcagccattcctgagggcatgaga

SEQ ID NO: 611196 - DNA, 25 bp, Mus musculus
ggcagccattttactgtagcaggac

SEQ ID NO: 611197 - DNA, 25 bp, Mus musculus
ggcagccatttttctgtagcaggac

SEQ ID NO: 611198 - DNA, 25 bp, Mus musculus
ggcagcccacggaggttttaccatg

SEQ ID NO: 611199 - DNA, 25 bp, Mus musculus
ggcagcccacggtggttttaccatg

SEQ ID NO: 611200 - DNA, 25 bp, Mus musculus
ggcagcccagatcactgagtgctac

SEQ ID NO: 611201 - DNA, 25 bp, Mus musculus
ggcagcccagatgactgagtgctac

SEQ ID NO: 611202 - DNA, 25 bp, Mus musculus
ggcagcccaggacgagtacatcaag

SEQ ID NO: 611203 - DNA, 25 bp, Mus musculus
ggcagcccaggaggagtacatcaag

SEQ ID NO: 611204 - DNA, 25 bp, Mus musculus
ggcagcccagggagagatgctctac

SEQ ID NO: 611205 - DNA, 25 bp, Mus musculus
ggcagcccagggtgagatgctctac

SEQ ID NO: 611206 - DNA, 25 bp, Mus musculus
ggcagcccatcaagcttttcatgac

SEQ ID NO: 611207 - DNA, 25 bp, Mus musculus
ggcagcccatcatgcttttcatgac

SEQ ID NO: 611208 - DNA, 25 bp, Mus musculus
ggcagcccatcgagcactacagatg

SEQ ID NO: 611209 - DNA, 25 bp, Mus musculus
ggcagcccatcgtgcactacagatg

SEQ ID NO: 611210 - DNA, 25 bp, Mus musculus
ggcagccccaaactacatactgaaa

SEQ ID NO: 611211 - DNA, 25 bp, Mus musculus
ggcagccccaaagtacatactgaaa

SEQ ID NO: 611212 - DNA, 25 bp, Mus musculus
ggcagccccacaacactgaagaaaa

SEQ ID NO: 611213 - DNA, 25 bp, Mus musculus
ggcagccccacatcactgaagaaaa

SEQ ID NO: 611214 - DNA, 25 bp, Mus musculus
ggcagcccgaatagattaaccttaa

SEQ ID NO: 611215 - DNA, 25 bp, Mus musculus
ggcagcccgaattgattaaccttaa

SEQ ID NO: 611216 - DNA, 25 bp, Mus musculus
ggcagcccggctcgtaagttgggca

SEQ ID NO: 611217 - DNA, 25 bp, Mus musculus
ggcagcccggctggtaagttgggca

SEQ ID NO: 611218 - DNA, 25 bp, Mus musculus
ggcagccctaataatactattctta

SEQ ID NO: 611219 - DNA, 25 bp, Mus musculus
ggcagccctaattatactattctta

SEQ ID NO: 611220 - DNA, 25 bp, Mus musculus
ggcagccctcgaagtcatccaggag

SEQ ID NO: 611221 - DNA, 25 bp, Mus musculus
ggcagccctcgatgtcatccaggag

SEQ ID NO: 611222 - DNA, 25 bp, Mus musculus
ggcagccctgacaatcgagttgtta

SEQ ID NO: 611223 - DNA, 25 bp, Mus musculus
ggcagccctgacacttaacctggga

SEQ ID NO: 611224 - DNA, 25 bp, Mus musculus
ggcagccctgactatcgagttgtta

SEQ ID NO: 611225 - DNA, 25 bp, Mus musculus
ggcagccctgactcttaacctggga

SEQ ID NO: 611226 - DNA, 25 bp, Mus musculus
ggcagccctgagagttctcaattaa

SEQ ID NO: 611227 - DNA, 25 bp, Mus musculus
ggcagccctgagtgttctcaattaa

SEQ ID NO: 611228 - DNA, 25 bp, Mus musculus
ggcagccctgataataaagtcccta

SEQ ID NO: 611229 - DNA, 25 bp, Mus musculus
ggcagccctgattataaagtcccta

SEQ ID NO: 611230 - DNA, 25 bp, Mus musculus
ggcagccctggaccgtcaaatgaaa

SEQ ID NO: 611231 - DNA, 25 bp, Mus musculus
ggcagccctggagcgtcaaatgaaa

SEQ ID NO: 611232 - DNA, 25 bp, Mus musculus
ggcagccctgtgacttcatcaaaat

SEQ ID NO: 611233 - DNA, 25 bp, Mus musculus
ggcagccctgtgtcttcatcaaaat

SEQ ID NO: 611234 - DNA, 25 bp, Mus musculus
ggcagccgagctcaaaacacaacta

SEQ ID NO: 611235 - DNA, 25 bp, Mus musculus
ggcagccgagctgaaaacacaacta

SEQ ID NO: 611236 - DNA, 25 bp, Mus musculus
ggcagccgatctactctaggaccag

SEQ ID NO: 611237 - DNA, 25 bp, Mus musculus
ggcagccgatcttctctaggaccag

SEQ ID NO: 611238 - DNA, 25 bp, Mus musculus
ggcagccgccggcaaacagctagaa

SEQ ID NO: 611239 - DNA, 25 bp, Mus musculus
ggcagccgccgggaaacagctagaa

SEQ ID NO: 611240 - DNA, 25 bp, Mus musculus
ggcagccgcctcacttgaagggtga

SEQ ID NO: 611241 - DNA, 25 bp, Mus musculus
ggcagccgcctctcttgaagggtga

SEQ ID NO: 611242 - DNA, 25 bp, Mus musculus
ggcagccgggctacaagagcaacat

SEQ ID NO: 611243 - DNA, 25 bp, Mus musculus
ggcagccgggcttcaagagcaacat

SEQ ID NO: 611244 - DNA, 25 bp, Mus musculus
ggcagccgtatccttcctatggtta

SEQ ID NO: 611245 - DNA, 25 bp, Mus musculus
ggcagccgtatcgttcctatggtta

SEQ ID NO: 611246 - DNA, 25 bp, Mus musculus
ggcagccgtcggaatagatttgaga

SEQ ID NO: 611247 - DNA, 25 bp, Mus musculus
ggcagccgtcggtatagatttgaga

SEQ ID NO: 611248 - DNA, 25 bp, Mus musculus
ggcagccgtgcaccatgaagtagat

SEQ ID NO: 611249 - DNA, 25 bp, Mus musculus
ggcagccgtgcagcatgaagtagat

SEQ ID NO: 611250 - DNA, 25 bp, Mus musculus
ggcagccgtggaaccaacaaggatt

SEQ ID NO: 611251 - DNA, 25 bp, Mus musculus
ggcagccgtggatccaacaaggatt

SEQ ID NO: 611252 - DNA, 25 bp, Mus musculus
ggcagccgtggcatagataccacat

SEQ ID NO: 611253 - DNA, 25 bp, Mus musculus
ggcagccgtggcttagataccacat

SEQ ID NO: 611254 - DNA, 25 bp, Mus musculus
ggcagccgtggtccacgccttgaat

SEQ ID NO: 611255 - DNA, 25 bp, Mus musculus
ggcagccgtggtgcacgccttgaat

SEQ ID NO: 611256 - DNA, 25 bp, Mus musculus
ggcagccgtgttacagcgtgcaaga

SEQ ID NO: 611257 - DNA, 25 bp, Mus musculus
ggcagccgtgtttcagcgtgcaaga

SEQ ID NO: 611258 - DNA, 25 bp, Mus musculus
ggcagcctaaagaccacttagaaat

SEQ ID NO: 611259 - DNA, 25 bp, Mus musculus
ggcagcctaaagtccacttagaaat

SEQ ID NO: 611260 - DNA, 25 bp, Mus musculus
ggcagcctaacacccttggttgcta

SEQ ID NO: 611261 - DNA, 25 bp, Mus musculus
ggcagcctaacagccttggttgcta

SEQ ID NO: 611262 - DNA, 25 bp, Mus musculus
ggcagcctacaacctcgatgcttat

SEQ ID NO: 611263 - DNA, 25 bp, Mus musculus
ggcagcctacaagctcgatgcttat

SEQ ID NO: 611264 - DNA, 25 bp, Mus musculus
ggcagcctcagaaatgagtcagcct

SEQ ID NO: 611265 - DNA, 25 bp, Mus musculus
ggcagcctcagatatgagtcagcct

SEQ ID NO: 611266 - DNA, 25 bp, Mus musculus
ggcagcctccgtatgatggtgaaga

SEQ ID NO: 611267 - DNA, 25 bp, Mus musculus
ggcagcctccgtttgatggtgaaga

SEQ ID NO: 611268 - DNA, 25 bp, Mus musculus
ggcagcctctgtcaagcagcaccat

SEQ ID NO: 611269 - DNA, 25 bp, Mus musculus
ggcagcctctgtgaagcagcaccat

SEQ ID NO: 611270 - DNA, 25 bp, Mus musculus
ggcagcctgaaacagctggatcact

SEQ ID NO: 611271 - DNA, 25 bp, Mus musculus
ggcagcctgaaagagctggatcact

SEQ ID NO: 611272 - DNA, 25 bp, Mus musculus
ggcagcctgaagctcaataacctga

SEQ ID NO: 611273 - DNA, 25 bp, Mus musculus
ggcagcctgaaggtcaataacctga

SEQ ID NO: 611274 - DNA, 25 bp, Mus musculus
ggcagcctgcagatctgacaatggt

SEQ ID NO: 611275 - DNA, 25 bp, Mus musculus
ggcagcctgcagttctgacaatggt

SEQ ID NO: 611276 - DNA, 25 bp, Mus musculus
ggcagcctgcgcaaggtgttttcag

SEQ ID NO: 611277 - DNA, 25 bp, Mus musculus
ggcagcctgcgctaggtgttttcag

SEQ ID NO: 611278 - DNA, 25 bp, Mus musculus
ggcagcctggacagttccaccgttt

SEQ ID NO: 611279 - DNA, 25 bp, Mus musculus
ggcagcctggacataaacgatggac

SEQ ID NO: 611280 - DNA, 25 bp, Mus musculus
ggcagcctggactgttccaccgttt

SEQ ID NO: 611281 - DNA, 25 bp, Mus musculus
ggcagcctggacttaaacgatggac

SEQ ID NO: 611282 - DNA, 25 bp, Mus musculus
ggcagcctggcaatttatgttacct

SEQ ID NO: 611283 - DNA, 25 bp, Mus musculus
ggcagcctggcattttatgttacct

SEQ ID NO: 611284 - DNA, 25 bp, Mus musculus
ggcagcctgtatcagctcactgtga

SEQ ID NO: 611285 - DNA, 25 bp, Mus musculus
ggcagcctgtatgagctcactgtga

SEQ ID NO: 611286 - DNA, 25 bp, Mus musculus
ggcagcctgttcattggttacctga

SEQ ID NO: 611287 - DNA, 25 bp, Mus musculus
ggcagcctgttctttggttacctga

SEQ ID NO: 611288 - DNA, 25 bp, Mus musculus
ggcagccttaggatcatagttttat

SEQ ID NO: 611289 - DNA, 25 bp, Mus musculus
ggcagccttaggttcatagttttat

SEQ ID NO: 611290 - DNA, 25 bp, Mus musculus
ggcagccttcctaaacttcatatga

SEQ ID NO: 611291 - DNA, 25 bp, Mus musculus
ggcagccttccttaacttcatatga

SEQ ID NO: 611292 - DNA, 25 bp, Mus musculus
ggcagccttcggatgtcagcctgag

SEQ ID NO: 611293 - DNA, 25 bp, Mus musculus
ggcagccttcggttgtcagcctgag

SEQ ID NO: 611294 - DNA, 25 bp, Mus musculus
ggcagccttgctccaagctcaggaa

SEQ ID NO: 611295 - DNA, 25 bp, Mus musculus
ggcagccttgctgcaagctcaggaa

SEQ ID NO: 611296 - DNA, 25 bp, Mus musculus
ggcagcctttaacagttgagcacat

SEQ ID NO: 611297 - DNA, 25 bp, Mus musculus
ggcagcctttaagagttgagcacat

SEQ ID NO: 611298 - DNA, 25 bp, Mus musculus
ggcagcctttggacatcggcagggc

SEQ ID NO: 611299 - DNA, 25 bp, Mus musculus
ggcagcctttggctttacggcttta

SEQ ID NO: 611300 - DNA, 25 bp, Mus musculus
ggcagcctttgggtttacggcttta

SEQ ID NO: 611301 - DNA, 25 bp, Mus musculus
ggcagcctttggtcatcggcagggc

SEQ ID NO: 611302 - DNA, 25 bp, Mus musculus
ggcagcgaacagatctctgttttag

SEQ ID NO: 611303 - DNA, 25 bp, Mus musculus
ggcagcgaacagttctctgttttag

SEQ ID NO: 611304 - DNA, 25 bp, Mus musculus
ggcagcgacacccatagattccggg

SEQ ID NO: 611305 - DNA, 25 bp, Mus musculus
ggcagcgacaccgatagattccggg

SEQ ID NO: 611306 - DNA, 25 bp, Mus musculus
ggcagcgacgccaggaagcagtaca

SEQ ID NO: 611307 - DNA, 25 bp, Mus musculus
ggcagcgacgcctggaagcagtaca

SEQ ID NO: 611308 - DNA, 25 bp, Mus musculus
ggcagcgcagatccgaagctcaaaa

SEQ ID NO: 611309 - DNA, 25 bp, Mus musculus
ggcagcgcagatgcgaagctcaaaa

SEQ ID NO: 611310 - DNA, 25 bp, Mus musculus
ggcagcgcctcccacagtgtggctt

SEQ ID NO: 611311 - DNA, 25 bp, Mus musculus
ggcagcgcctccgacagtgtggctt

SEQ ID NO: 611312 - DNA, 25 bp, Mus musculus
ggcagcgcctgcagcactatgccaa

SEQ ID NO: 611313 - DNA, 25 bp, Mus musculus
ggcagcgcctgctgcactatgccaa

SEQ ID NO: 611314 - DNA, 25 bp, Mus musculus
ggcagcgctaagaccagtgcaggaa

SEQ ID NO: 611315 - DNA, 25 bp, Mus musculus
ggcagcgctaagtccagtgcaggaa

SEQ ID NO: 611316 - DNA, 25 bp, Mus musculus
ggcagcgctctgagcagtagttcat

SEQ ID NO: 611317 - DNA, 25 bp, Mus musculus
ggcagcgctctgtgcagtagttcat

SEQ ID NO: 611318 - DNA, 25 bp, Mus musculus
ggcagcgctgggacttctacctcct

SEQ ID NO: 611319 - DNA, 25 bp, Mus musculus
ggcagcgctgggtcttctacctcct

SEQ ID NO: 611320 - DNA, 25 bp, Mus musculus
ggcagcgcttataaatcaacctaac

SEQ ID NO: 611321 - DNA, 25 bp, Mus musculus
ggcagcgcttattaatcaacctaac

SEQ ID NO: 611322 - DNA, 25 bp, Mus musculus
ggcagcgcttgtatctaatgagact

SEQ ID NO: 611323 - DNA, 25 bp, Mus musculus
ggcagcgcttgtttctaatgagact

SEQ ID NO: 611324 - DNA, 25 bp, Mus musculus
ggcagcggaaatacagcaccatgga

SEQ ID NO: 611325 - DNA, 25 bp, Mus musculus
ggcagcggaaattcagcaccatgga

SEQ ID NO: 611326 - DNA, 25 bp, Mus musculus
ggcagcggctacatgctcagcaagt

SEQ ID NO: 611327 - DNA, 25 bp, Mus musculus
ggcagcggctacttgctcagcaagt

SEQ ID NO: 611328 - DNA, 25 bp, Mus musculus
ggcagcggcttccaagcaaactgga

SEQ ID NO: 611329 - DNA, 25 bp, Mus musculus
ggcagcggcttcgaagcaaactgga

SEQ ID NO: 611330 - DNA, 25 bp, Mus musculus
ggcagcgggagaaagcacacatgat

SEQ ID NO: 611331 - DNA, 25 bp, Mus musculus
ggcagcgggagatagcacacatgat

SEQ ID NO: 611332 - DNA, 25 bp, Mus musculus
ggcagcggttttatcaactgacaaa

SEQ ID NO: 611333 - DNA, 25 bp, Mus musculus
ggcagcggttttttcaactgacaaa

SEQ ID NO: 611334 - DNA, 25 bp, Mus musculus
ggcagcgtcagaactatgtgcgcat

SEQ ID NO: 611335 - DNA, 25 bp, Mus musculus
ggcagcgtcagatctatgtgcgcat

SEQ ID NO: 611336 - DNA, 25 bp, Mus musculus
ggcagcgtcgggatctgtcagccac

SEQ ID NO: 611337 - DNA, 25 bp, Mus musculus
ggcagcgtcgggttctgtcagccac

SEQ ID NO: 611338 - DNA, 25 bp, Mus musculus
ggcagcgtgggcctcctccattgat

SEQ ID NO: 611339 - DNA, 25 bp, Mus musculus
ggcagcgtgggcgtcctccattgat

SEQ ID NO: 611340 - DNA, 25 bp, Mus musculus
ggcagcgttaatatcattcctgtga

SEQ ID NO: 611341 - DNA, 25 bp, Mus musculus
ggcagcgttaatttcattcctgtga

SEQ ID NO: 611342 - DNA, 25 bp, Mus musculus
ggcagcgttcggatatcgactttca

SEQ ID NO: 611343 - DNA, 25 bp, Mus musculus
ggcagcgttcggttatcgactttca

SEQ ID NO: 611344 - DNA, 25 bp, Mus musculus
ggcagcgttgctcaacaatctaagt

SEQ ID NO: 611345 - DNA, 25 bp, Mus musculus
ggcagcgttgctgaacaatctaagt

SEQ ID NO: 611346 - DNA, 25 bp, Mus musculus
ggcagcgtttgcaatagcacagaac

SEQ ID NO: 611347 - DNA, 25 bp, Mus musculus
ggcagcgtttgctatagcacagaac

SEQ ID NO: 611348 - DNA, 25 bp, Mus musculus
ggcagctaaaatcagcagctcccaa

SEQ ID NO: 611349 - DNA, 25 bp, Mus musculus
ggcagctaaaatgagcagctcccaa

SEQ ID NO: 611350 - DNA, 25 bp, Mus musculus
ggcagctaactccaagggatgtctt

SEQ ID NO: 611351 - DNA, 25 bp, Mus musculus
ggcagctaactcgaagggatgtctt

SEQ ID NO: 611352 - DNA, 25 bp, Mus musculus
ggcagctaagctctttgacctacag

SEQ ID NO: 611353 - DNA, 25 bp, Mus musculus
ggcagctaagctgtttgacctacag

SEQ ID NO: 611354 - DNA, 25 bp, Mus musculus
ggcagctaattgacttaagtttcgt

SEQ ID NO: 611355 - DNA, 25 bp, Mus musculus
ggcagctaattgtcttaagtttcgt

SEQ ID NO: 611356 - DNA, 25 bp, Mus musculus
ggcagctacagaaacacagattact

SEQ ID NO: 611357 - DNA, 25 bp, Mus musculus
ggcagctacagatacacagattact

SEQ ID NO: 611358 - DNA, 25 bp, Mus musculus
ggcagctacctgcactctaaaactg

SEQ ID NO: 611359 - DNA, 25 bp, Mus musculus
ggcagctacctggactctaaaactg

SEQ ID NO: 611360 - DNA, 25 bp, Mus musculus
ggcagctactaaacgcccagataga

SEQ ID NO: 611361 - DNA, 25 bp, Mus musculus
ggcagctactaatcgcccagataga

SEQ ID NO: 611362 - DNA, 25 bp, Mus musculus
ggcagctactgaaggtgatagtaac

SEQ ID NO: 611363 - DNA, 25 bp, Mus musculus
ggcagctactgatggtgatagtaac

SEQ ID NO: 611364 - DNA, 25 bp, Mus musculus
ggcagctagacaaggtgatacacac

SEQ ID NO: 611365 - DNA, 25 bp, Mus musculus
ggcagctagacatggtgatacacac

SEQ ID NO: 611366 - DNA, 25 bp, Mus musculus
ggcagctagacccagacattctgaa

SEQ ID NO: 611367 - DNA, 25 bp, Mus musculus
ggcagctagaccgagacattctgaa

SEQ ID NO: 611368 - DNA, 25 bp, Mus musculus
ggcagctagctcactgacaactaaa

SEQ ID NO: 611369 - DNA, 25 bp, Mus musculus
ggcagctagctctctgacaactaaa

SEQ ID NO: 611370 - DNA, 25 bp, Mus musculus
ggcagctagtaaccactttcagcag

SEQ ID NO: 611371 - DNA, 25 bp, Mus musculus
ggcagctagtaagcactttcagcag

SEQ ID NO: 611372 - DNA, 25 bp, Mus musculus
ggcagctagtcaaacgttttctcct

SEQ ID NO: 611373 - DNA, 25 bp, Mus musculus
ggcagctagtcatacgttttctcct

SEQ ID NO: 611374 - DNA, 25 bp, Mus musculus
ggcagctatacaattgatcccgtga

SEQ ID NO: 611375 - DNA, 25 bp, Mus musculus
ggcagctatacatttgatcccgtga

SEQ ID NO: 611376 - DNA, 25 bp, Mus musculus
ggcagctataggcaactcaggtaaa

SEQ ID NO: 611377 - DNA, 25 bp, Mus musculus
ggcagctatagggaactcaggtaaa

SEQ ID NO: 611378 - DNA, 25 bp, Mus musculus
ggcagctatcacaagcatctgggat

SEQ ID NO: 611379 - DNA, 25 bp, Mus musculus
ggcagctatcactagcatctgggat

SEQ ID NO: 611380 - DNA, 25 bp, Mus musculus
ggcagctatgctctacttatatata

SEQ ID NO: 611381 - DNA, 25 bp, Mus musculus
ggcagctatgctgtacttatatata

SEQ ID NO: 611382 - DNA, 25 bp, Mus musculus
ggcagctatggcaaccctctgggta

SEQ ID NO: 611383 - DNA, 25 bp, Mus musculus
ggcagctatggcattcatgcaaaaa

SEQ ID NO: 611384 - DNA, 25 bp, Mus musculus
ggcagctatggctaccctctgggta

SEQ ID NO: 611385 - DNA, 25 bp, Mus musculus
ggcagctatggctttcatgcaaaaa

SEQ ID NO: 611386 - DNA, 25 bp, Mus musculus
ggcagctattatatcttcactgatt

SEQ ID NO: 611387 - DNA, 25 bp, Mus musculus
ggcagctattatttcttcactgatt

SEQ ID NO: 611388 - DNA, 25 bp, Mus musculus
ggcagctattctagcaaggccagaa

SEQ ID NO: 611389 - DNA, 25 bp, Mus musculus
ggcagctattcttgcaaggccagaa

SEQ ID NO: 611390 - DNA, 25 bp, Mus musculus
ggcagctcaagtcatctgcatcagt

SEQ ID NO: 611391 - DNA, 25 bp, Mus musculus
ggcagctcaagtgatctgcatcagt

SEQ ID NO: 611392 - DNA, 25 bp, Mus musculus
ggcagctcagatcctgtaatcccaa

SEQ ID NO: 611393 - DNA, 25 bp, Mus musculus
ggcagctcagatgctgtaatcccaa

SEQ ID NO: 611394 - DNA, 25 bp, Mus musculus
ggcagctcatgacatgtccataact

SEQ ID NO: 611395 - DNA, 25 bp, Mus musculus
ggcagctcatgagatgtccataact

SEQ ID NO: 611396 - DNA, 25 bp, Mus musculus
ggcagctccacgatgaagctcggaa

SEQ ID NO: 611397 - DNA, 25 bp, Mus musculus
ggcagctccacgttgaagctcggaa

SEQ ID NO: 611398 - DNA, 25 bp, Mus musculus
ggcagctccattaaagtgagtttca

SEQ ID NO: 611399 - DNA, 25 bp, Mus musculus
ggcagctccatttaagtgagtttca

SEQ ID NO: 611400 - DNA, 25 bp, Mus musculus
ggcagctccgtgagtggtaaccgtt

SEQ ID NO: 611401 - DNA, 25 bp, Mus musculus
ggcagctccgtgtgtggtaaccgtt

SEQ ID NO: 611402 - DNA, 25 bp, Mus musculus
ggcagctcctagatgatatatttga

SEQ ID NO: 611403 - DNA, 25 bp, Mus musculus
ggcagctcctagcatttgtcacgaa

SEQ ID NO: 611404 - DNA, 25 bp, Mus musculus
ggcagctcctaggatttgtcacgaa

SEQ ID NO: 611405 - DNA, 25 bp, Mus musculus
ggcagctcctagttgatatatttga

SEQ ID NO: 611406 - DNA, 25 bp, Mus musculus
ggcagctcctgcattggcggccagc

SEQ ID NO: 611407 - DNA, 25 bp, Mus musculus
ggcagctcctgctttggcggccagc

SEQ ID NO: 611408 - DNA, 25 bp, Mus musculus
ggcagctcctgtatatagctaagca

SEQ ID NO: 611409 - DNA, 25 bp, Mus musculus
ggcagctcctgtttatagctaagca

SEQ ID NO: 611410 - DNA, 25 bp, Mus musculus
ggcagctctaatacaccaagcagat

SEQ ID NO: 611411 - DNA, 25 bp, Mus musculus
ggcagctctaattcaccaagcagat

SEQ ID NO: 611412 - DNA, 25 bp, Mus musculus
ggcagctctactatggtgaaggctc

SEQ ID NO: 611413 - DNA, 25 bp, Mus musculus
ggcagctctactttggtgaaggctc

SEQ ID NO: 611414 - DNA, 25 bp, Mus musculus
ggcagctctcccagaatgggagaat

SEQ ID NO: 611415 - DNA, 25 bp, Mus musculus
ggcagctctccctgaatgggagaat

SEQ ID NO: 611416 - DNA, 25 bp, Mus musculus
ggcagctctgacattataaaaccta

SEQ ID NO: 611417 - DNA, 25 bp, Mus musculus
ggcagctctgactttataaaaccta

SEQ ID NO: 611418 - DNA, 25 bp, Mus musculus
ggcagctctgctatagtgggttagc

SEQ ID NO: 611419 - DNA, 25 bp, Mus musculus
ggcagctctgctttagtgggttagc

SEQ ID NO: 611420 - DNA, 25 bp, Mus musculus
ggcagctctgttaagtgtctacatc

SEQ ID NO: 611421 - DNA, 25 bp, Mus musculus
ggcagctctgtttagtgtctacatc

SEQ ID NO: 611422 - DNA, 25 bp, Mus musculus
ggcagctgaatgcagtttggttctt

SEQ ID NO: 611423 - DNA, 25 bp, Mus musculus
ggcagctgaatggagtttggttctt

SEQ ID NO: 611424 - DNA, 25 bp, Mus musculus
ggcagctgacacatgatctcactta

SEQ ID NO: 611425 - DNA, 25 bp, Mus musculus
ggcagctgacacttgatctcactta

SEQ ID NO: 611426 - DNA, 25 bp, Mus musculus
ggcagctgagcacttttccatggtc

SEQ ID NO: 611427 - DNA, 25 bp, Mus musculus
ggcagctgagcagttttccatggtc

SEQ ID NO: 611428 - DNA, 25 bp, Mus musculus
ggcagctgagcccacaaaaccgacg

SEQ ID NO: 611429 - DNA, 25 bp, Mus musculus
ggcagctgagccgacaaaaccgacg

SEQ ID NO: 611430 - DNA, 25 bp, Mus musculus
ggcagctgaggaatctagtgttagc

SEQ ID NO: 611431 - DNA, 25 bp, Mus musculus
ggcagctgaggattctagtgttagc

SEQ ID NO: 611432 - DNA, 25 bp, Mus musculus
ggcagctgagtcctttgatgatcag

SEQ ID NO: 611433 - DNA, 25 bp, Mus musculus
ggcagctgagtcgtttgatgatcag

SEQ ID NO: 611434 - DNA, 25 bp, Mus musculus
ggcagctgcaaaacatttaagtact

SEQ ID NO: 611435 - DNA, 25 bp, Mus musculus
ggcagctgcaaatcatttaagtact

SEQ ID NO: 611436 - DNA, 25 bp, Mus musculus
ggcagctgcatgatttcaccatgta

SEQ ID NO: 611437 - DNA, 25 bp, Mus musculus
ggcagctgcatgttttcaccatgta

SEQ ID NO: 611438 - DNA, 25 bp, Mus musculus
ggcagctgccaaccagccaaggaga

SEQ ID NO: 611439 - DNA, 25 bp, Mus musculus
ggcagctgccaagcagccaaggaga

SEQ ID NO: 611440 - DNA, 25 bp, Mus musculus
ggcagctgccatctaattcatagag

SEQ ID NO: 611441 - DNA, 25 bp, Mus musculus
ggcagctgccatgtaattcatagag

SEQ ID NO: 611442 - DNA, 25 bp, Mus musculus
ggcagctgcttcctgcaaggaatct

SEQ ID NO: 611443 - DNA, 25 bp, Mus musculus
ggcagctgcttcgtgcaaggaatct

SEQ ID NO: 611444 - DNA, 25 bp, Mus musculus
ggcagctgcttgaacaagttccgca

SEQ ID NO: 611445 - DNA, 25 bp, Mus musculus
ggcagctgcttgtacaagttccgca

SEQ ID NO: 611446 - DNA, 25 bp, Mus musculus
ggcagctggatcactgcggacatgc

SEQ ID NO: 611447 - DNA, 25 bp, Mus musculus
ggcagctggatctctgcggacatgc

SEQ ID NO: 611448 - DNA, 25 bp, Mus musculus
ggcagctggccaagatttgagcact

SEQ ID NO: 611449 - DNA, 25 bp, Mus musculus
ggcagctggccaagcccgttttcct

SEQ ID NO: 611450 - DNA, 25 bp, Mus musculus
ggcagctggccatgatttgagcact

SEQ ID NO: 611451 - DNA, 25 bp, Mus musculus
ggcagctggccatgcccgttttcct

SEQ ID NO: 611452 - DNA, 25 bp, Mus musculus
ggcagctggcccaatatacctgtga

SEQ ID NO: 611453 - DNA, 25 bp, Mus musculus
ggcagctggccctatatacctgtga

SEQ ID NO: 611454 - DNA, 25 bp, Mus musculus
ggcagctgggacagcacagcctgtc

SEQ ID NO: 611455 - DNA, 25 bp, Mus musculus
ggcagctgggactgcacagcctgtc

SEQ ID NO: 611456 - DNA, 25 bp, Mus musculus
ggcagctggtagaggctccaccttc

SEQ ID NO: 611457 - DNA, 25 bp, Mus musculus
ggcagctggtagtggctccaccttc

SEQ ID NO: 611458 - DNA, 25 bp, Mus musculus
ggcagctggtccagttgatgctcaa

SEQ ID NO: 611459 - DNA, 25 bp, Mus musculus
ggcagctggtcctgttgatgctcaa

SEQ ID NO: 611460 - DNA, 25 bp, Mus musculus
ggcagctggtttagtatcctagttc

SEQ ID NO: 611461 - DNA, 25 bp, Mus musculus
ggcagctggttttgtatcctagttc

SEQ ID NO: 611462 - DNA, 25 bp, Mus musculus
ggcagctgtattccaaagtcatcaa

SEQ ID NO: 611463 - DNA, 25 bp, Mus musculus
ggcagctgtattgcaaagtcatcaa

SEQ ID NO: 611464 - DNA, 25 bp, Mus musculus
ggcagctgtcctcaagtctgacaga

SEQ ID NO: 611465 - DNA, 25 bp, Mus musculus
ggcagctgtcctgaagtctgacaga

SEQ ID NO: 611466 - DNA, 25 bp, Mus musculus
ggcagctgtgcccaagagtttccag

SEQ ID NO: 611467 - DNA, 25 bp, Mus musculus
ggcagctgtgccgaagagtttccag

SEQ ID NO: 611468 - DNA, 25 bp, Mus musculus
ggcagctgtttaacaggagtggtta

SEQ ID NO: 611469 - DNA, 25 bp, Mus musculus
ggcagctgtttatcaggagtggtta

SEQ ID NO: 611470 - DNA, 25 bp, Mus musculus
ggcagcttaatgatgtgcgctaact

SEQ ID NO: 611471 - DNA, 25 bp, Mus musculus
ggcagcttaatgttgtgcgctaact

SEQ ID NO: 611472 - DNA, 25 bp, Mus musculus
ggcagcttagacaagagttctcgtg

SEQ ID NO: 611473 - DNA, 25 bp, Mus musculus
ggcagcttagactagagttctcgtg

SEQ ID NO: 611474 - DNA, 25 bp, Mus musculus
ggcagcttcaacatacttgttctaa

SEQ ID NO: 611475 - DNA, 25 bp, Mus musculus
ggcagcttcaacttacttgttctaa

SEQ ID NO: 611476 - DNA, 25 bp, Mus musculus
ggcagcttcagcatgcacttgtaga

SEQ ID NO: 611477 - DNA, 25 bp, Mus musculus
ggcagcttcagcttgcacttgtaga

SEQ ID NO: 611478 - DNA, 25 bp, Mus musculus
ggcagcttccaaacaggacagaatg

SEQ ID NO: 611479 - DNA, 25 bp, Mus musculus
ggcagcttccaatcaggacagaatg

SEQ ID NO: 611480 - DNA, 25 bp, Mus musculus
ggcagcttccaccagaacttaggtt

SEQ ID NO: 611481 - DNA, 25 bp, Mus musculus
ggcagcttccacgagaacttaggtt

SEQ ID NO: 611482 - DNA, 25 bp, Mus musculus
ggcagcttccagctgatggactttt

SEQ ID NO: 611483 - DNA, 25 bp, Mus musculus
ggcagcttccaggtgatggactttt

SEQ ID NO: 611484 - DNA, 25 bp, Mus musculus
ggcagcttcctgaaacagactacga

SEQ ID NO: 611485 - DNA, 25 bp, Mus musculus
ggcagcttcctgtaacagactacga

SEQ ID NO: 611486 - DNA, 25 bp, Mus musculus
ggcagcttcgatattaaccaagttt

SEQ ID NO: 611487 - DNA, 25 bp, Mus musculus
ggcagcttcgattttaaccaagttt

SEQ ID NO: 611488 - DNA, 25 bp, Mus musculus
ggcagcttctaaacctcatgatttg

SEQ ID NO: 611489 - DNA, 25 bp, Mus musculus
ggcagcttctaatcctcatgatttg

SEQ ID NO: 611490 - DNA, 25 bp, Mus musculus
ggcagcttctgcaccatgggcaaga

SEQ ID NO: 611491 - DNA, 25 bp, Mus musculus
ggcagcttctgcatgtgagaccagc

SEQ ID NO: 611492 - DNA, 25 bp, Mus musculus
ggcagcttctgccacaggttctgaa

SEQ ID NO: 611493 - DNA, 25 bp, Mus musculus
ggcagcttctgcgacaggttctgaa

SEQ ID NO: 611494 - DNA, 25 bp, Mus musculus
ggcagcttctgctccatgggcaaga

SEQ ID NO: 611495 - DNA, 25 bp, Mus musculus
ggcagcttctgcttgtgagaccagc

SEQ ID NO: 611496 - DNA, 25 bp, Mus musculus
ggcagcttctgtaaacagccgcaaa

SEQ ID NO: 611497 - DNA, 25 bp, Mus musculus
ggcagcttctgttaacagccgcaaa

SEQ ID NO: 611498 - DNA, 25 bp, Mus musculus
ggcagcttcttacagtcttaccttg

SEQ ID NO: 611499 - DNA, 25 bp, Mus musculus
ggcagcttcttagagtcttaccttg

SEQ ID NO: 611500 - DNA, 25 bp, Mus musculus
ggcagcttgaacaaaccaactgaga

SEQ ID NO: 611501 - DNA, 25 bp, Mus musculus
ggcagcttgaactaaccaactgaga

SEQ ID NO: 611502 - DNA, 25 bp, Mus musculus
ggcagcttgaccctctctgtgacat

SEQ ID NO: 611503 - DNA, 25 bp, Mus musculus
ggcagcttgaccgtctctgtgacat

SEQ ID NO: 611504 - DNA, 25 bp, Mus musculus
ggcagcttgagaagtcggtcctaac

SEQ ID NO: 611505 - DNA, 25 bp, Mus musculus
ggcagcttgagatgtcggtcctaac

SEQ ID NO: 611506 - DNA, 25 bp, Mus musculus
ggcagcttgaggaaccatcactcta

SEQ ID NO: 611507 - DNA, 25 bp, Mus musculus
ggcagcttgaggtaccatcactcta

SEQ ID NO: 611508 - DNA, 25 bp, Mus musculus
ggcagcttgataattaaaccacagt

SEQ ID NO: 611509 - DNA, 25 bp, Mus musculus
ggcagcttgatatttaaaccacagt

SEQ ID NO: 611510 - DNA, 25 bp, Mus musculus
ggcagcttgatgacagggctcatgt

SEQ ID NO: 611511 - DNA, 25 bp, Mus musculus
ggcagcttgatgactccttaaaact

SEQ ID NO: 611512 - DNA, 25 bp, Mus musculus
ggcagcttgatgtcagggctcatgt

SEQ ID NO: 611513 - DNA, 25 bp, Mus musculus
ggcagcttgatgtctccttaaaact

SEQ ID NO: 611514 - DNA, 25 bp, Mus musculus
ggcagcttgggtcaacacctggata

SEQ ID NO: 611515 - DNA, 25 bp, Mus musculus
ggcagcttgggtgaacacctggata

SEQ ID NO: 611516 - DNA, 25 bp, Mus musculus
ggcagcttggttcgacttgccccgt

SEQ ID NO: 611517 - DNA, 25 bp, Mus musculus
ggcagcttggttggacttgccccgt

SEQ ID NO: 611518 - DNA, 25 bp, Mus musculus
ggcagcttgtcaagagcttctggat

SEQ ID NO: 611519 - DNA, 25 bp, Mus musculus
ggcagcttgtcatgagcttctggat

SEQ ID NO: 611520 - DNA, 25 bp, Mus musculus
ggcagctttaccctggatcacggag

SEQ ID NO: 611521 - DNA, 25 bp, Mus musculus
ggcagctttaccgtggatcacggag

SEQ ID NO: 611522 - DNA, 25 bp, Mus musculus
ggcagctttcagacttagcttgttt

SEQ ID NO: 611523 - DNA, 25 bp, Mus musculus
ggcagctttcagattagggtgagac

SEQ ID NO: 611524 - DNA, 25 bp, Mus musculus
ggcagctttcagtcttagcttgttt

SEQ ID NO: 611525 - DNA, 25 bp, Mus musculus
ggcagctttcagtttagggtgagac

SEQ ID NO: 611526 - DNA, 25 bp, Mus musculus
ggcagctttccaactcagatgtatt

SEQ ID NO: 611527 - DNA, 25 bp, Mus musculus
ggcagctttccatctcagatgtatt

SEQ ID NO: 611528 - DNA, 25 bp, Mus musculus
ggcagctttgaaagaacccatcatt

SEQ ID NO: 611529 - DNA, 25 bp, Mus musculus
ggcagctttgaatgaacccatcatt

SEQ ID NO: 611530 - DNA, 25 bp, Mus musculus
ggcagctttgatatgcgcaagacag

SEQ ID NO: 611531 - DNA, 25 bp, Mus musculus
ggcagctttgatttgcgcaagacag

SEQ ID NO: 611532 - DNA, 25 bp, Mus musculus
ggcagctttgcaattgattagaatt

SEQ ID NO: 611533 - DNA, 25 bp, Mus musculus
ggcagctttgcatttgattagaatt

SEQ ID NO: 611534 - DNA, 25 bp, Mus musculus
ggcagctttgctcagttggtctcga

SEQ ID NO: 611535 - DNA, 25 bp, Mus musculus
ggcagctttgctgagttggtctcga

SEQ ID NO: 611536 - DNA, 25 bp, Mus musculus
ggcagctttggactatatatcccat

SEQ ID NO: 611537 - DNA, 25 bp, Mus musculus
ggcagctttggagtatatatcccat

SEQ ID NO: 611538 - DNA, 25 bp, Mus musculus
ggcagctttgtaatgtagtcctttt

SEQ ID NO: 611539 - DNA, 25 bp, Mus musculus
ggcagctttgtattgtagtcctttt

SEQ ID NO: 611540 - DNA, 25 bp, Mus musculus
ggcagctttgtcaccattttacagt

SEQ ID NO: 611541 - DNA, 25 bp, Mus musculus
ggcagctttgtctccattttacagt

SEQ ID NO: 611542 - DNA, 25 bp, Mus musculus
ggcagcttttgtatctttggagcaa

SEQ ID NO: 611543 - DNA, 25 bp, Mus musculus
ggcagcttttgtttctttggagcaa

SEQ ID NO: 611544 - DNA, 25 bp, Mus musculus
ggcaggaaaaatctgttctttaaca

SEQ ID NO: 611545 - DNA, 25 bp, Mus musculus
ggcaggaaaaatgtgttctttaaca

SEQ ID NO: 611546 - DNA, 25 bp, Mus musculus
ggcaggaaagtcatcccttctataa

SEQ ID NO: 611547 - DNA, 25 bp, Mus musculus
ggcaggaaagtcttcccttctataa

SEQ ID NO: 611548 - DNA, 25 bp, Mus musculus
ggcaggaaatcacttccctgcttgg

SEQ ID NO: 611549 - DNA, 25 bp, Mus musculus
ggcaggaaatcagttccctgcttgg

SEQ ID NO: 611550 - DNA, 25 bp, Mus musculus
ggcaggaaatgccacagtacttcaa

SEQ ID NO: 611551 - DNA, 25 bp, Mus musculus
ggcaggaaatgcgacagtacttcaa

SEQ ID NO: 611552 - DNA, 25 bp, Mus musculus
ggcaggaacagtcccctccttggtg

SEQ ID NO: 611553 - DNA, 25 bp, Mus musculus
ggcaggaacagtgccctccttggtg

SEQ ID NO: 611554 - DNA, 25 bp, Mus musculus
ggcaggaagacaaccgtgctgaaat

SEQ ID NO: 611555 - DNA, 25 bp, Mus musculus
ggcaggaagacatccgtgctgaaat

SEQ ID NO: 611556 - DNA, 25 bp, Mus musculus
ggcaggaagcttcaggctccgcctt

SEQ ID NO: 611557 - DNA, 25 bp, Mus musculus
ggcaggaagcttgaggctccgcctt

SEQ ID NO: 611558 - DNA, 25 bp, Mus musculus
ggcaggaatcccaggttggcagtca

SEQ ID NO: 611559 - DNA, 25 bp, Mus musculus
ggcaggaatccctggttggcagtca

SEQ ID NO: 611560 - DNA, 25 bp, Mus musculus
ggcaggaatcctctggaaccccaca

SEQ ID NO: 611561 - DNA, 25 bp, Mus musculus
ggcaggaatcctgtggaaccccaca

SEQ ID NO: 611562 - DNA, 25 bp, Mus musculus
ggcaggaatttccatgcacagccaa

SEQ ID NO: 611563 - DNA, 25 bp, Mus musculus
ggcaggaatttcgatgcacagccaa

SEQ ID NO: 611564 - DNA, 25 bp, Mus musculus
ggcaggacaagcacctcccggatga

SEQ ID NO: 611565 - DNA, 25 bp, Mus musculus
ggcaggacaagctcctcccggatga

SEQ ID NO: 611566 - DNA, 25 bp, Mus musculus
ggcaggaccaaaactcaagctagat

SEQ ID NO: 611567 - DNA, 25 bp, Mus musculus
ggcaggaccaaatctcaagctagat

SEQ ID NO: 611568 - DNA, 25 bp, Mus musculus
ggcaggaccagaaaccatataccca

SEQ ID NO: 611569 - DNA, 25 bp, Mus musculus
ggcaggaccagacctccttctggaa

SEQ ID NO: 611570 - DNA, 25 bp, Mus musculus
ggcaggaccagagctccttctggaa

SEQ ID NO: 611571 - DNA, 25 bp, Mus musculus
ggcaggaccagataccatataccca

SEQ ID NO: 611572 - DNA, 25 bp, Mus musculus
ggcaggaccctgagtttctgaagga

SEQ ID NO: 611573 - DNA, 25 bp, Mus musculus
ggcaggaccctgtgtttctgaagga

SEQ ID NO: 611574 - DNA, 25 bp, Mus musculus
ggcaggaccgtcagttagtccaaat

SEQ ID NO: 611575 - DNA, 25 bp, Mus musculus
ggcaggaccgtctgttagtccaaat

SEQ ID NO: 611576 - DNA, 25 bp, Mus musculus
ggcaggaccttacactcagttgcaa

SEQ ID NO: 611577 - DNA, 25 bp, Mus musculus
ggcaggaccttagactcagttgcaa

SEQ ID NO: 611578 - DNA, 25 bp, Mus musculus
ggcaggacgccaacttagaagccta

SEQ ID NO: 611579 - DNA, 25 bp, Mus musculus
ggcaggacgccatcttagaagccta

SEQ ID NO: 611580 - DNA, 25 bp, Mus musculus
ggcaggacgttcaaggtcatcctag

SEQ ID NO: 611581 - DNA, 25 bp, Mus musculus
ggcaggacgttctaggtcatcctag

SEQ ID NO: 611582 - DNA, 25 bp, Mus musculus
ggcaggactactaccaatgaagaac

SEQ ID NO: 611583 - DNA, 25 bp, Mus musculus
ggcaggactacttccaatgaagaac

SEQ ID NO: 611584 - DNA, 25 bp, Mus musculus
ggcaggactcacctcaccaaatgga

SEQ ID NO: 611585 - DNA, 25 bp, Mus musculus
ggcaggactcacgtcaccaaatgga

SEQ ID NO: 611586 - DNA, 25 bp, Mus musculus
ggcaggactctgcttagaggttcct

SEQ ID NO: 611587 - DNA, 25 bp, Mus musculus
ggcaggactctggttagaggttcct

SEQ ID NO: 611588 - DNA, 25 bp, Mus musculus
ggcaggacttatactcaaaatgttt

SEQ ID NO: 611589 - DNA, 25 bp, Mus musculus
ggcaggacttattctcaaaatgttt

SEQ ID NO: 611590 - DNA, 25 bp, Mus musculus
ggcaggagaagtaaacccacccaat

SEQ ID NO: 611591 - DNA, 25 bp, Mus musculus
ggcaggagaagttaacccacccaat

SEQ ID NO: 611592 - DNA, 25 bp, Mus musculus
ggcaggagaattctcagataaactt

SEQ ID NO: 611593 - DNA, 25 bp, Mus musculus
ggcaggagaattgtcagataaactt

SEQ ID NO: 611594 - DNA, 25 bp, Mus musculus
ggcaggagactcagcactgtacctc

SEQ ID NO: 611595 - DNA, 25 bp, Mus musculus
ggcaggagactcagcccgaggaaat

SEQ ID NO: 611596 - DNA, 25 bp, Mus musculus
ggcaggagactctgcactgtacctc

SEQ ID NO: 611597 - DNA, 25 bp, Mus musculus
ggcaggagactctgcccgaggaaat

SEQ ID NO: 611598 - DNA, 25 bp, Mus musculus
ggcaggagatatcgtcccctattca

SEQ ID NO: 611599 - DNA, 25 bp, Mus musculus
ggcaggagatatggtcccctattca

SEQ ID NO: 611600 - DNA, 25 bp, Mus musculus
ggcaggagccgacccttttgttgct

SEQ ID NO: 611601 - DNA, 25 bp, Mus musculus
ggcaggagccgagccttttgttgct

SEQ ID NO: 611602 - DNA, 25 bp, Mus musculus
ggcaggagcctcaatcattacttct

SEQ ID NO: 611603 - DNA, 25 bp, Mus musculus
ggcaggagcctctatcattacttct

SEQ ID NO: 611604 - DNA, 25 bp, Mus musculus
ggcaggagcgcacacccatcatcgt

SEQ ID NO: 611605 - DNA, 25 bp, Mus musculus
ggcaggagcgcagacccatcatcgt

SEQ ID NO: 611606 - DNA, 25 bp, Mus musculus
ggcaggagcgttacattccgcatct

SEQ ID NO: 611607 - DNA, 25 bp, Mus musculus
ggcaggagcgtttcattccgcatct

SEQ ID NO: 611608 - DNA, 25 bp, Mus musculus
ggcaggagctacaggattctgttga

SEQ ID NO: 611609 - DNA, 25 bp, Mus musculus
ggcaggagctactggattctgttga

SEQ ID NO: 611610 - DNA, 25 bp, Mus musculus
ggcaggagctcaaggaccctgctta

SEQ ID NO: 611611 - DNA, 25 bp, Mus musculus
ggcaggagctcatggaccctgctta

SEQ ID NO: 611612 - DNA, 25 bp, Mus musculus
ggcaggagctctatatcttcatggc

SEQ ID NO: 611613 - DNA, 25 bp, Mus musculus
ggcaggagctctttatcttcatggc

SEQ ID NO: 611614 - DNA, 25 bp, Mus musculus
ggcaggaggagactcagcaaccact

SEQ ID NO: 611615 - DNA, 25 bp, Mus musculus
ggcaggaggagagtcagcaaccact

SEQ ID NO: 611616 - DNA, 25 bp, Mus musculus
ggcaggaggattaccacgagcttga

SEQ ID NO: 611617 - DNA, 25 bp, Mus musculus
ggcaggaggattagtctccaacccc

SEQ ID NO: 611618 - DNA, 25 bp, Mus musculus
ggcaggaggatttccacgagcttga

SEQ ID NO: 611619 - DNA, 25 bp, Mus musculus
ggcaggaggatttgtctccaacccc

SEQ ID NO: 611620 - DNA, 25 bp, Mus musculus
ggcaggaggcagagtccctatacat

SEQ ID NO: 611621 - DNA, 25 bp, Mus musculus
ggcaggaggcagtgtccctatacat

SEQ ID NO: 611622 - DNA, 25 bp, Mus musculus
ggcaggaggctcacacataagtttg

SEQ ID NO: 611623 - DNA, 25 bp, Mus musculus
ggcaggaggctctcacataagtttg

SEQ ID NO: 611624 - DNA, 25 bp, Mus musculus
ggcaggagggcaaaacatcatctat

SEQ ID NO: 611625 - DNA, 25 bp, Mus musculus
ggcaggagggcataacatcatctat

SEQ ID NO: 611626 - DNA, 25 bp, Mus musculus
ggcaggagtcacaataatggcaact

SEQ ID NO: 611627 - DNA, 25 bp, Mus musculus
ggcaggagtcactataatggcaact

SEQ ID NO: 611628 - DNA, 25 bp, Mus musculus
ggcaggagtcctcaggaataccttt

SEQ ID NO: 611629 - DNA, 25 bp, Mus musculus
ggcaggagtcctgaggaataccttt

SEQ ID NO: 611630 - DNA, 25 bp, Mus musculus
ggcaggagttcaccagctaccaaga

SEQ ID NO: 611631 - DNA, 25 bp, Mus musculus
ggcaggagttcagcagctaccaaga

SEQ ID NO: 611632 - DNA, 25 bp, Mus musculus
ggcaggatcacactctcttcggtat

SEQ ID NO: 611633 - DNA, 25 bp, Mus musculus
ggcaggatcacagtctcttcggtat

SEQ ID NO: 611634 - DNA, 25 bp, Mus musculus
ggcaggatcaggaccgcggcaagga

SEQ ID NO: 611635 - DNA, 25 bp, Mus musculus
ggcaggatcaggtccgcggcaagga

SEQ ID NO: 611636 - DNA, 25 bp, Mus musculus
ggcaggatcgacccgcttctgtatg

SEQ ID NO: 611637 - DNA, 25 bp, Mus musculus
ggcaggatcgacgcgcttctgtatg

SEQ ID NO: 611638 - DNA, 25 bp, Mus musculus
ggcaggatctaaaattcctccaaaa

SEQ ID NO: 611639 - DNA, 25 bp, Mus musculus
ggcaggatctaatattcctccaaaa

SEQ ID NO: 611640 - DNA, 25 bp, Mus musculus
ggcaggatctcaagtttccaggtca

SEQ ID NO: 611641 - DNA, 25 bp, Mus musculus
ggcaggatctcatgtttccaggtca

SEQ ID NO: 611642 - DNA, 25 bp, Mus musculus
ggcaggatctggatacttttccaaa

SEQ ID NO: 611643 - DNA, 25 bp, Mus musculus
ggcaggatctggttacttttccaaa

SEQ ID NO: 611644 - DNA, 25 bp, Mus musculus
ggcaggatctttacgtctagaactt

SEQ ID NO: 611645 - DNA, 25 bp, Mus musculus
ggcaggatcttttcgtctagaactt

SEQ ID NO: 611646 - DNA, 25 bp, Mus musculus
ggcaggatgaccatggctacatttc

SEQ ID NO: 611647 - DNA, 25 bp, Mus musculus
ggcaggatgaccttggctacatttc

SEQ ID NO: 611648 - DNA, 25 bp, Mus musculus
ggcaggattaaaaagtgtttaccta

SEQ ID NO: 611649 - DNA, 25 bp, Mus musculus
ggcaggattaaatagtgtttaccta

SEQ ID NO: 611650 - DNA, 25 bp, Mus musculus
ggcaggattgcacatccctagagta

SEQ ID NO: 611651 - DNA, 25 bp, Mus musculus
ggcaggattgcagatccctagagta

SEQ ID NO: 611652 - DNA, 25 bp, Mus musculus
ggcaggattgggatcttcacattca

SEQ ID NO: 611653 - DNA, 25 bp, Mus musculus
ggcaggattgggttcttcacattca

SEQ ID NO: 611654 - DNA, 25 bp, Mus musculus
ggcaggatttcaacgctggagcaat

SEQ ID NO: 611655 - DNA, 25 bp, Mus musculus
ggcaggatttcatcgctggagcaat

SEQ ID NO: 611656 - DNA, 25 bp, Mus musculus
ggcaggatttctacgtgttttataa

SEQ ID NO: 611657 - DNA, 25 bp, Mus musculus
ggcaggatttcttcgtgttttataa

SEQ ID NO: 611658 - DNA, 25 bp, Mus musculus
ggcaggcaaacaacagtccattgga

SEQ ID NO: 611659 - DNA, 25 bp, Mus musculus
ggcaggcaaacatcagtccattgga

SEQ ID NO: 611660 - DNA, 25 bp, Mus musculus
ggcaggcaacacactgtcatttctg

SEQ ID NO: 611661 - DNA, 25 bp, Mus musculus
ggcaggcaacactctgtcatttctg

SEQ ID NO: 611662 - DNA, 25 bp, Mus musculus
ggcaggcaagaaaactcacagcttt

SEQ ID NO: 611663 - DNA, 25 bp, Mus musculus
ggcaggcaagaaccgtccttacctt

SEQ ID NO: 611664 - DNA, 25 bp, Mus musculus
ggcaggcaagaagcgtccttacctt

SEQ ID NO: 611665 - DNA, 25 bp, Mus musculus
ggcaggcaagaatactcacagcttt

SEQ ID NO: 611666 - DNA, 25 bp, Mus musculus
ggcaggcacaagaaactaaagcttt

SEQ ID NO: 611667 - DNA, 25 bp, Mus musculus
ggcaggcacaagtaactaaagcttt

SEQ ID NO: 611668 - DNA, 25 bp, Mus musculus
ggcaggcacataaagactctggaga

SEQ ID NO: 611669 - DNA, 25 bp, Mus musculus
ggcaggcacatatagactctggaga

SEQ ID NO: 611670 - DNA, 25 bp, Mus musculus
ggcaggcaccacacagggaaaactg

SEQ ID NO: 611671 - DNA, 25 bp, Mus musculus
ggcaggcaccactcagggaaaactg

SEQ ID NO: 611672 - DNA, 25 bp, Mus musculus
ggcaggcacctgctgatagaagtta

SEQ ID NO: 611673 - DNA, 25 bp, Mus musculus
ggcaggcacctggtgatagaagtta

SEQ ID NO: 611674 - DNA, 25 bp, Mus musculus
ggcaggcaccttatcagtgtaatca

SEQ ID NO: 611675 - DNA, 25 bp, Mus musculus
ggcaggcaccttttcagtgtaatca

SEQ ID NO: 611676 - DNA, 25 bp, Mus musculus
ggcaggcactccatccagtatgaag

SEQ ID NO: 611677 - DNA, 25 bp, Mus musculus
ggcaggcactccttccagtatgaag

SEQ ID NO: 611678 - DNA, 25 bp, Mus musculus
ggcaggcactcgagtgatatacata

SEQ ID NO: 611679 - DNA, 25 bp, Mus musculus
ggcaggcactcgtgtgatatacata

SEQ ID NO: 611680 - DNA, 25 bp, Mus musculus
ggcaggcactctcaagaacaaccat

SEQ ID NO: 611681 - DNA, 25 bp, Mus musculus
ggcaggcactctgaagaacaaccat

SEQ ID NO: 611682 - DNA, 25 bp, Mus musculus
ggcaggcactggaattcacaactta

SEQ ID NO: 611683 - DNA, 25 bp, Mus musculus
ggcaggcactggtattcacaactta

SEQ ID NO: 611684 - DNA, 25 bp, Mus musculus
ggcaggcagcaactcgaatggctaa

SEQ ID NO: 611685 - DNA, 25 bp, Mus musculus
ggcaggcagcaagtcgaatggctaa

SEQ ID NO: 611686 - DNA, 25 bp, Mus musculus
ggcaggcagcacatactgatctgaa

SEQ ID NO: 611687 - DNA, 25 bp, Mus musculus
ggcaggcagcacttactgatctgaa

SEQ ID NO: 611688 - DNA, 25 bp, Mus musculus
ggcaggcagcagaagccactttggt

SEQ ID NO: 611689 - DNA, 25 bp, Mus musculus
ggcaggcagcagcttgagcacattt

SEQ ID NO: 611690 - DNA, 25 bp, Mus musculus
ggcaggcagcaggttgagcacattt

SEQ ID NO: 611691 - DNA, 25 bp, Mus musculus
ggcaggcagcagtagccactttggt

SEQ ID NO: 611692 - DNA, 25 bp, Mus musculus
ggcaggcagctccaaacatggtact

SEQ ID NO: 611693 - DNA, 25 bp, Mus musculus
ggcaggcagctcgaaacatggtact

SEQ ID NO: 611694 - DNA, 25 bp, Mus musculus
ggcaggcagctgaatctggatttcc

SEQ ID NO: 611695 - DNA, 25 bp, Mus musculus
ggcaggcagctgagtatgaatatgt

SEQ ID NO: 611696 - DNA, 25 bp, Mus musculus
ggcaggcagctgtatctggatttcc

SEQ ID NO: 611697 - DNA, 25 bp, Mus musculus
ggcaggcagctgtgtatgaatatgt

SEQ ID NO: 611698 - DNA, 25 bp, Mus musculus
ggcaggcaggagactgtgttttaca

SEQ ID NO: 611699 - DNA, 25 bp, Mus musculus
ggcaggcaggagtctgtgttttaca

SEQ ID NO: 611700 - DNA, 25 bp, Mus musculus
ggcaggcagggaattatttgtaata

SEQ ID NO: 611701 - DNA, 25 bp, Mus musculus
ggcaggcagggatttatttgtaata

SEQ ID NO: 611702 - DNA, 25 bp, Mus musculus
ggcaggcagggcaagtacttcctct

SEQ ID NO: 611703 - DNA, 25 bp, Mus musculus
ggcaggcagggctagtacttcctct

SEQ ID NO: 611704 - DNA, 25 bp, Mus musculus
ggcaggcaggtcacttgatgctcaa

SEQ ID NO: 611705 - DNA, 25 bp, Mus musculus
ggcaggcaggtctcttgatgctcaa

SEQ ID NO: 611706 - DNA, 25 bp, Mus musculus
ggcaggcagtcaacagacatctgtt

SEQ ID NO: 611707 - DNA, 25 bp, Mus musculus
ggcaggcagtcaacttattctagtc

SEQ ID NO: 611708 - DNA, 25 bp, Mus musculus
ggcaggcagtcatcagacatctgtt

SEQ ID NO: 611709 - DNA, 25 bp, Mus musculus
ggcaggcagtcatcttattctagtc

SEQ ID NO: 611710 - DNA, 25 bp, Mus musculus
ggcaggcagtgacaacttcataatt

SEQ ID NO: 611711 - DNA, 25 bp, Mus musculus
ggcaggcagtgagaacttcataatt

SEQ ID NO: 611712 - DNA, 25 bp, Mus musculus
ggcaggcataaaataaagctcttca

SEQ ID NO: 611713 - DNA, 25 bp, Mus musculus
ggcaggcataaaccgagcccgtgca

SEQ ID NO: 611714 - DNA, 25 bp, Mus musculus
ggcaggcataaagcgagcccgtgca

SEQ ID NO: 611715 - DNA, 25 bp, Mus musculus
ggcaggcataaattaaagctcttca

SEQ ID NO: 611716 - DNA, 25 bp, Mus musculus
ggcaggcatctacgaaggcttgaat

SEQ ID NO: 611717 - DNA, 25 bp, Mus musculus
ggcaggcatctaggaaggcttgaat

SEQ ID NO: 611718 - DNA, 25 bp, Mus musculus
ggcaggcatctgagactcaaggaaa

SEQ ID NO: 611719 - DNA, 25 bp, Mus musculus
ggcaggcatctgtgactcaaggaaa

SEQ ID NO: 611720 - DNA, 25 bp, Mus musculus
ggcaggcatgacaaaatgatccaac

SEQ ID NO: 611721 - DNA, 25 bp, Mus musculus
ggcaggcatgactaaatgatccaac

SEQ ID NO: 611722 - DNA, 25 bp, Mus musculus
ggcaggcatgtccaaggaatactgc

SEQ ID NO: 611723 - DNA, 25 bp, Mus musculus
ggcaggcatgtcgaaggaatactgc

SEQ ID NO: 611724 - DNA, 25 bp, Mus musculus
ggcaggcattgcagctgggtccata

SEQ ID NO: 611725 - DNA, 25 bp, Mus musculus
ggcaggcattgctgctgggtccata

SEQ ID NO: 611726 - DNA, 25 bp, Mus musculus
ggcaggcatttcaccttgtgattat

SEQ ID NO: 611727 - DNA, 25 bp, Mus musculus
ggcaggcatttctccttgtgattat

SEQ ID NO: 611728 - DNA, 25 bp, Mus musculus
ggcaggccacgtagtccaaggacag

SEQ ID NO: 611729 - DNA, 25 bp, Mus musculus
ggcaggccacgttgtccaaggacag

SEQ ID NO: 611730 - DNA, 25 bp, Mus musculus
ggcaggccactcataagtgttagag

SEQ ID NO: 611731 - DNA, 25 bp, Mus musculus
ggcaggccactcttaagtgttagag

SEQ ID NO: 611732 - DNA, 25 bp, Mus musculus
ggcaggccagaacctctttccatac

SEQ ID NO: 611733 - DNA, 25 bp, Mus musculus
ggcaggccagaagctctttccatac

SEQ ID NO: 611734 - DNA, 25 bp, Mus musculus
ggcaggccagccatctgtaagggca

SEQ ID NO: 611735 - DNA, 25 bp, Mus musculus
ggcaggccagccttctgtaagggca

SEQ ID NO: 611736 - DNA, 25 bp, Mus musculus
ggcaggccatccatcttggaaatgg

SEQ ID NO: 611737 - DNA, 25 bp, Mus musculus
ggcaggccatccttcttggaaatgg

SEQ ID NO: 611738 - DNA, 25 bp, Mus musculus
ggcaggcccatacctagggaagctt

SEQ ID NO: 611739 - DNA, 25 bp, Mus musculus
ggcaggcccatagctagggaagctt

SEQ ID NO: 611740 - DNA, 25 bp, Mus musculus
ggcaggcccttcaggaacgtgatgc

SEQ ID NO: 611741 - DNA, 25 bp, Mus musculus
ggcaggcccttctggaacgtgatgc

SEQ ID NO: 611742 - DNA, 25 bp, Mus musculus
ggcaggccctttctcttaagaagat

SEQ ID NO: 611743 - DNA, 25 bp, Mus musculus
ggcaggccctttgtcttaagaagat

SEQ ID NO: 611744 - DNA, 25 bp, Mus musculus
ggcaggcctacaaattgctgtgcaa

SEQ ID NO: 611745 - DNA, 25 bp, Mus musculus
ggcaggcctacatattgctgtgcaa

SEQ ID NO: 611746 - DNA, 25 bp, Mus musculus
ggcaggcctaggacagcgacaccgc

SEQ ID NO: 611747 - DNA, 25 bp, Mus musculus
ggcaggcctaggtcagcgacaccgc

SEQ ID NO: 611748 - DNA, 25 bp, Mus musculus
ggcaggcctctacccacacagggag

SEQ ID NO: 611749 - DNA, 25 bp, Mus musculus
ggcaggcctctagccacacagggag

SEQ ID NO: 611750 - DNA, 25 bp, Mus musculus
ggcaggcctctgaattcacagccaa

SEQ ID NO: 611751 - DNA, 25 bp, Mus musculus
ggcaggcctctgtattcacagccaa

SEQ ID NO: 611752 - DNA, 25 bp, Mus musculus
ggcaggcctgctcggacttaagcta

SEQ ID NO: 611753 - DNA, 25 bp, Mus musculus
ggcaggcctgctgggacttaagcta

SEQ ID NO: 611754 - DNA, 25 bp, Mus musculus
ggcaggcctggaactgaaatccacc

SEQ ID NO: 611755 - DNA, 25 bp, Mus musculus
ggcaggcctggatctgaaatccacc

SEQ ID NO: 611756 - DNA, 25 bp, Mus musculus
ggcaggcgaaagcacgaaacatctt

SEQ ID NO: 611757 - DNA, 25 bp, Mus musculus
ggcaggcgaaaggacgaaacatctt

SEQ ID NO: 611758 - DNA, 25 bp, Mus musculus
ggcaggcgaatgatgggtctcccac

SEQ ID NO: 611759 - DNA, 25 bp, Mus musculus
ggcaggcgaatgttgggtctcccac

SEQ ID NO: 611760 - DNA, 25 bp, Mus musculus
ggcaggcgatgcactagggcaatct

SEQ ID NO: 611761 - DNA, 25 bp, Mus musculus
ggcaggcgatgcatcagaactaact

SEQ ID NO: 611762 - DNA, 25 bp, Mus musculus
ggcaggcgatgctctagggcaatct

SEQ ID NO: 611763 - DNA, 25 bp, Mus musculus
ggcaggcgatgcttcagaactaact

SEQ ID NO: 611764 - DNA, 25 bp, Mus musculus
ggcaggcggattaccaagttccaag

SEQ ID NO: 611765 - DNA, 25 bp, Mus musculus
ggcaggcggatttccaagttccaag

SEQ ID NO: 611766 - DNA, 25 bp, Mus musculus
ggcaggcgggtcacttaagttccac

SEQ ID NO: 611767 - DNA, 25 bp, Mus musculus
ggcaggcgggtctcttaagttccac

SEQ ID NO: 611768 - DNA, 25 bp, Mus musculus
ggcaggcgtgttctatatacttgtc

SEQ ID NO: 611769 - DNA, 25 bp, Mus musculus
ggcaggcgtgttgtatatacttgtc

SEQ ID NO: 611770 - DNA, 25 bp, Mus musculus
ggcaggcgttatcctctgtaacaca

SEQ ID NO: 611771 - DNA, 25 bp, Mus musculus
ggcaggcgttatgctctgtaacaca

SEQ ID NO: 611772 - DNA, 25 bp, Mus musculus
ggcaggctaggtagaccatagagct

SEQ ID NO: 611773 - DNA, 25 bp, Mus musculus
ggcaggctaggttgaccatagagct

SEQ ID NO: 611774 - DNA, 25 bp, Mus musculus
ggcaggctcaccaggtattagccct

SEQ ID NO: 611775 - DNA, 25 bp, Mus musculus
ggcaggctcacctggtattagccct

SEQ ID NO: 611776 - DNA, 25 bp, Mus musculus
ggcaggctccaactgttcaaagttc

SEQ ID NO: 611777 - DNA, 25 bp, Mus musculus
ggcaggctccaagtgttcaaagttc

SEQ ID NO: 611778 - DNA, 25 bp, Mus musculus
ggcaggctccctagcttgtaggtat

SEQ ID NO: 611779 - DNA, 25 bp, Mus musculus
ggcaggctcccttgcttgtaggtat

SEQ ID NO: 611780 - DNA, 25 bp, Mus musculus
ggcaggctcctcagctgacaaatga

SEQ ID NO: 611781 - DNA, 25 bp, Mus musculus
ggcaggctcctctgctgacaaatga

SEQ ID NO: 611782 - DNA, 25 bp, Mus musculus
ggcaggctcttgattaagctcgggc

SEQ ID NO: 611783 - DNA, 25 bp, Mus musculus
ggcaggctcttgtttaagctcgggc

SEQ ID NO: 611784 - DNA, 25 bp, Mus musculus
ggcaggctgcttaaagtcatgatat

SEQ ID NO: 611785 - DNA, 25 bp, Mus musculus
ggcaggctgcttcaacaaggacatt

SEQ ID NO: 611786 - DNA, 25 bp, Mus musculus
ggcaggctgcttgaacaaggacatt

SEQ ID NO: 611787 - DNA, 25 bp, Mus musculus
ggcaggctgctttaagtcatgatat

SEQ ID NO: 611788 - DNA, 25 bp, Mus musculus
ggcaggctggatacccaatattcag

SEQ ID NO: 611789 - DNA, 25 bp, Mus musculus
ggcaggctggattcccaatattcag

SEQ ID NO: 611790 - DNA, 25 bp, Mus musculus
ggcaggcttctgaaggaacttgtgt

SEQ ID NO: 611791 - DNA, 25 bp, Mus musculus
ggcaggcttctgtaggaacttgtgt

SEQ ID NO: 611792 - DNA, 25 bp, Mus musculus
ggcaggctttgacgattcccagcca

SEQ ID NO: 611793 - DNA, 25 bp, Mus musculus
ggcaggctttgaggattcccagcca

SEQ ID NO: 611794 - DNA, 25 bp, Mus musculus
ggcaggcttttaagggcgttttgaa

SEQ ID NO: 611795 - DNA, 25 bp, Mus musculus
ggcaggcttttatgggcgttttgaa

SEQ ID NO: 611796 - DNA, 25 bp, Mus musculus
ggcagggaagctaagctcattcatt

SEQ ID NO: 611797 - DNA, 25 bp, Mus musculus
ggcagggaagcttagctcattcatt

SEQ ID NO: 611798 - DNA, 25 bp, Mus musculus
ggcagggaaggtcaccactcaaacc

SEQ ID NO: 611799 - DNA, 25 bp, Mus musculus
ggcagggaaggtgaccactcaaacc

SEQ ID NO: 611800 - DNA, 25 bp, Mus musculus
ggcagggacagtccttaagctcatt

SEQ ID NO: 611801 - DNA, 25 bp, Mus musculus
ggcagggacagtgcttaagctcatt

SEQ ID NO: 611802 - DNA, 25 bp, Mus musculus
ggcagggacatgcacaaaatacgat

SEQ ID NO: 611803 - DNA, 25 bp, Mus musculus
ggcagggacatggacaaaatacgat

SEQ ID NO: 611804 - DNA, 25 bp, Mus musculus
ggcagggaccacacacacaaggcag

SEQ ID NO: 611805 - DNA, 25 bp, Mus musculus
ggcagggaccactcacacaaggcag

SEQ ID NO: 611806 - DNA, 25 bp, Mus musculus
ggcagggaccatcccattatggaaa

SEQ ID NO: 611807 - DNA, 25 bp, Mus musculus
ggcagggaccatgccattatggaaa

SEQ ID NO: 611808 - DNA, 25 bp, Mus musculus
ggcagggaccgactaccacctgaaa

SEQ ID NO: 611809 - DNA, 25 bp, Mus musculus
ggcagggaccgagtaccacctgaaa

SEQ ID NO: 611810 - DNA, 25 bp, Mus musculus
ggcagggacctaaacgtctgtcttt

SEQ ID NO: 611811 - DNA, 25 bp, Mus musculus
ggcagggacctaaggcagccactgt

SEQ ID NO: 611812 - DNA, 25 bp, Mus musculus
ggcagggacctatacgtctgtcttt

SEQ ID NO: 611813 - DNA, 25 bp, Mus musculus
ggcagggacctatggcagccactgt

SEQ ID NO: 611814 - DNA, 25 bp, Mus musculus
ggcagggacggcatcattgacttca

SEQ ID NO: 611815 - DNA, 25 bp, Mus musculus
ggcagggacggcttcattgacttca

SEQ ID NO: 611816 - DNA, 25 bp, Mus musculus
ggcagggactgcatatttcttagca

SEQ ID NO: 611817 - DNA, 25 bp, Mus musculus
ggcagggactgcttatttcttagca

SEQ ID NO: 611818 - DNA, 25 bp, Mus musculus
ggcagggacttcacttgtagatctt

SEQ ID NO: 611819 - DNA, 25 bp, Mus musculus
ggcagggacttctcttgtagatctt

SEQ ID NO: 611820 - DNA, 25 bp, Mus musculus
ggcagggacttgaccatgtgtctat

SEQ ID NO: 611821 - DNA, 25 bp, Mus musculus
ggcagggacttgtccatgtgtctat

SEQ ID NO: 611822 - DNA, 25 bp, Mus musculus
ggcagggatccacagcccaattcaa

SEQ ID NO: 611823 - DNA, 25 bp, Mus musculus
ggcagggatccagagcccaattcaa

SEQ ID NO: 611824 - DNA, 25 bp, Mus musculus
ggcagggatttacgctaaccaggaa

SEQ ID NO: 611825 - DNA, 25 bp, Mus musculus
ggcagggatttaggctaaccaggaa

SEQ ID NO: 611826 - DNA, 25 bp, Mus musculus
ggcagggcacccaaagcttgtcagt

SEQ ID NO: 611827 - DNA, 25 bp, Mus musculus
ggcagggcaccctaagcttgtcagt

SEQ ID NO: 611828 - DNA, 25 bp, Mus musculus
ggcagggcacggctgatggaggcat

SEQ ID NO: 611829 - DNA, 25 bp, Mus musculus
ggcagggcacgggtgatggaggcat

SEQ ID NO: 611830 - DNA, 25 bp, Mus musculus
ggcagggcagcaacgcaagttcatc

SEQ ID NO: 611831 - DNA, 25 bp, Mus musculus
ggcagggcagcatcgcaagttcatc

SEQ ID NO: 611832 - DNA, 25 bp, Mus musculus
ggcagggcaggcatttgaaaacatg

SEQ ID NO: 611833 - DNA, 25 bp, Mus musculus
ggcagggcaggcttttgaaaacatg

SEQ ID NO: 611834 - DNA, 25 bp, Mus musculus
ggcagggcattgcttctagacacac

SEQ ID NO: 611835 - DNA, 25 bp, Mus musculus
ggcagggcattggttctagacacac

SEQ ID NO: 611836 - DNA, 25 bp, Mus musculus
ggcagggccagcaatctaagtactt

SEQ ID NO: 611837 - DNA, 25 bp, Mus musculus
ggcagggccagctatctaagtactt

SEQ ID NO: 611838 - DNA, 25 bp, Mus musculus
ggcagggccctgataagcttcaaag

SEQ ID NO: 611839 - DNA, 25 bp, Mus musculus
ggcagggccctgttaagcttcaaag

SEQ ID NO: 611840 - DNA, 25 bp, Mus musculus
ggcagggccgcaactacatcctggg

SEQ ID NO: 611841 - DNA, 25 bp, Mus musculus
ggcagggccgcatctacatcctggg

SEQ ID NO: 611842 - DNA, 25 bp, Mus musculus
ggcagggcctaaccaccatacagct

SEQ ID NO: 611843 - DNA, 25 bp, Mus musculus
ggcagggcctaagcaccatacagct

SEQ ID NO: 611844 - DNA, 25 bp, Mus musculus
ggcagggcctgtcgtatctagcata

SEQ ID NO: 611845 - DNA, 25 bp, Mus musculus
ggcagggcctgtggtatctagcata

SEQ ID NO: 611846 - DNA, 25 bp, Mus musculus
ggcagggcgctgagaatgtcttcat

SEQ ID NO: 611847 - DNA, 25 bp, Mus musculus
ggcagggcgctgtgaatgtcttcat

SEQ ID NO: 611848 - DNA, 25 bp, Mus musculus
ggcagggctggcattatacgagaaa

SEQ ID NO: 611849 - DNA, 25 bp, Mus musculus
ggcagggctggctttatacgagaaa

SEQ ID NO: 611850 - DNA, 25 bp, Mus musculus
ggcagggctgggaaaactttgtaca

SEQ ID NO: 611851 - DNA, 25 bp, Mus musculus
ggcagggctgggtaaactttgtaca

SEQ ID NO: 611852 - DNA, 25 bp, Mus musculus
ggcagggtaaacaccagcaccggac

SEQ ID NO: 611853 - DNA, 25 bp, Mus musculus
ggcagggtaaactccagcaccggac

SEQ ID NO: 611854 - DNA, 25 bp, Mus musculus
ggcagggtcctgaattcaaaaggtt

SEQ ID NO: 611855 - DNA, 25 bp, Mus musculus
ggcagggtcctgtattcaaaaggtt

SEQ ID NO: 611856 - DNA, 25 bp, Mus musculus
ggcagggtctcgatttatacattta

SEQ ID NO: 611857 - DNA, 25 bp, Mus musculus
ggcagggtctcgttttatacattta

SEQ ID NO: 611858 - DNA, 25 bp, Mus musculus
ggcagggtctgaattgaatgcttat

SEQ ID NO: 611859 - DNA, 25 bp, Mus musculus
ggcagggtctgatttgaatgcttat

SEQ ID NO: 611860 - DNA, 25 bp, Mus musculus
ggcagggtctgtcactccctagttt

SEQ ID NO: 611861 - DNA, 25 bp, Mus musculus
ggcagggtctgtgactccctagttt

SEQ ID NO: 611862 - DNA, 25 bp, Mus musculus
ggcagggtgaatccccgcaatccca

SEQ ID NO: 611863 - DNA, 25 bp, Mus musculus
ggcagggtgaatgcccgcaatccca

SEQ ID NO: 611864 - DNA, 25 bp, Mus musculus
ggcagggtgacaacgacaaccatgt

SEQ ID NO: 611865 - DNA, 25 bp, Mus musculus
ggcagggtgacatcgacaaccatgt

SEQ ID NO: 611866 - DNA, 25 bp, Mus musculus
ggcagggtgtccaaccaaggaacac

SEQ ID NO: 611867 - DNA, 25 bp, Mus musculus
ggcagggtgtccatggcaactgtat

SEQ ID NO: 611868 - DNA, 25 bp, Mus musculus
ggcagggtgtcctaccaaggaacac

SEQ ID NO: 611869 - DNA, 25 bp, Mus musculus
ggcagggtgtccttggcaactgtat

SEQ ID NO: 611870 - DNA, 25 bp, Mus musculus
ggcagggttagcaagtgaccacctt

SEQ ID NO: 611871 - DNA, 25 bp, Mus musculus
ggcagggttagctagtgaccacctt

SEQ ID NO: 611872 - DNA, 25 bp, Mus musculus
ggcagggtttctcctacgactacgt

SEQ ID NO: 611873 - DNA, 25 bp, Mus musculus
ggcagggtttctgctacgactacgt

SEQ ID NO: 611874 - DNA, 25 bp, Mus musculus
ggcagggtttgtcttattaacaggt

SEQ ID NO: 611875 - DNA, 25 bp, Mus musculus
ggcagggtttgtgttattaacaggt

SEQ ID NO: 611876 - DNA, 25 bp, Mus musculus
ggcaggtacatacttggcattggta

SEQ ID NO: 611877 - DNA, 25 bp, Mus musculus
ggcaggtacatagttggcattggta

SEQ ID NO: 611878 - DNA, 25 bp, Mus musculus
ggcaggtaccaccatatacagcata

SEQ ID NO: 611879 - DNA, 25 bp, Mus musculus
ggcaggtaccacgatatacagcata

SEQ ID NO: 611880 - DNA, 25 bp, Mus musculus
ggcaggtacccacttttcgaaggat

SEQ ID NO: 611881 - DNA, 25 bp, Mus musculus
ggcaggtacccagttttcgaaggat

SEQ ID NO: 611882 - DNA, 25 bp, Mus musculus
ggcaggtacgccaactctttgagaa

SEQ ID NO: 611883 - DNA, 25 bp, Mus musculus
ggcaggtacgcctactctttgagaa

SEQ ID NO: 611884 - DNA, 25 bp, Mus musculus
ggcaggtacgggatactcaaagtat

SEQ ID NO: 611885 - DNA, 25 bp, Mus musculus
ggcaggtacgggatactcaacgcat

SEQ ID NO: 611886 - DNA, 25 bp, Mus musculus
ggcaggtacgggttactcaaagtat

SEQ ID NO: 611887 - DNA, 25 bp, Mus musculus
ggcaggtacgggttactcaacgcat

SEQ ID NO: 611888 - DNA, 25 bp, Mus musculus
ggcaggtaggtaatttaccatctta

SEQ ID NO: 611889 - DNA, 25 bp, Mus musculus
ggcaggtaggtattttaccatctta

SEQ ID NO: 611890 - DNA, 25 bp, Mus musculus
ggcaggtaggttagctgcatccctt

SEQ ID NO: 611891 - DNA, 25 bp, Mus musculus
ggcaggtaggtttgctgcatccctt

SEQ ID NO: 611892 - DNA, 25 bp, Mus musculus
ggcaggtagttcaaaattgcaagtt

SEQ ID NO: 611893 - DNA, 25 bp, Mus musculus
ggcaggtagttctaaattgcaagtt

SEQ ID NO: 611894 - DNA, 25 bp, Mus musculus
ggcaggtagtttccgaacaccacca

SEQ ID NO: 611895 - DNA, 25 bp, Mus musculus
ggcaggtagtttgcgaacaccacca

SEQ ID NO: 611896 - DNA, 25 bp, Mus musculus
ggcaggtatatcaaagtggctcagt

SEQ ID NO: 611897 - DNA, 25 bp, Mus musculus
ggcaggtatatctaagtggctcagt

SEQ ID NO: 611898 - DNA, 25 bp, Mus musculus
ggcaggtatcacatttttagggtat

SEQ ID NO: 611899 - DNA, 25 bp, Mus musculus
ggcaggtatcacttttttagggtat

SEQ ID NO: 611900 - DNA, 25 bp, Mus musculus
ggcaggtattttagacttctctctt

SEQ ID NO: 611901 - DNA, 25 bp, Mus musculus
ggcaggtatttttgacttctctctt

SEQ ID NO: 611902 - DNA, 25 bp, Mus musculus
ggcaggtcaaccactaactctaaga

SEQ ID NO: 611903 - DNA, 25 bp, Mus musculus
ggcaggtcaaccatgctcctgtgga

SEQ ID NO: 611904 - DNA, 25 bp, Mus musculus
ggcaggtcaacctctaactctaaga

SEQ ID NO: 611905 - DNA, 25 bp, Mus musculus
ggcaggtcaaccttgctcctgtgga

SEQ ID NO: 611906 - DNA, 25 bp, Mus musculus
ggcaggtcagttatgagtttgtcaa

SEQ ID NO: 611907 - DNA, 25 bp, Mus musculus
ggcaggtcagttttgagtttgtcaa

SEQ ID NO: 611908 - DNA, 25 bp, Mus musculus
ggcaggtccactcaggtaaacttca

SEQ ID NO: 611909 - DNA, 25 bp, Mus musculus
ggcaggtccactgaggtaaacttca

SEQ ID NO: 611910 - DNA, 25 bp, Mus musculus
ggcaggtccagtccaaagctttatt

SEQ ID NO: 611911 - DNA, 25 bp, Mus musculus
ggcaggtccagtgcaaagctttatt

SEQ ID NO: 611912 - DNA, 25 bp, Mus musculus
ggcaggtcccagcaatttgagcaga

SEQ ID NO: 611913 - DNA, 25 bp, Mus musculus
ggcaggtcccagcattattcagaga

SEQ ID NO: 611914 - DNA, 25 bp, Mus musculus
ggcaggtcccaggaatttgagcaga

SEQ ID NO: 611915 - DNA, 25 bp, Mus musculus
ggcaggtcccaggattattcagaga

SEQ ID NO: 611916 - DNA, 25 bp, Mus musculus
ggcaggtcccatctagccaaagctg

SEQ ID NO: 611917 - DNA, 25 bp, Mus musculus
ggcaggtcccatgtagccaaagctg

SEQ ID NO: 611918 - DNA, 25 bp, Mus musculus
ggcaggtcctgtcgcctagcagtta

SEQ ID NO: 611919 - DNA, 25 bp, Mus musculus
ggcaggtcctgtggcctagcagtta

SEQ ID NO: 611920 - DNA, 25 bp, Mus musculus
ggcaggtcgccacagatattgaaaa

SEQ ID NO: 611921 - DNA, 25 bp, Mus musculus
ggcaggtcgccagagatattgaaaa

SEQ ID NO: 611922 - DNA, 25 bp, Mus musculus
ggcaggtctccaagcatagggtctt

SEQ ID NO: 611923 - DNA, 25 bp, Mus musculus
ggcaggtctccatgcatagggtctt

SEQ ID NO: 611924 - DNA, 25 bp, Mus musculus
ggcaggtctgctaaagctctgagta

SEQ ID NO: 611925 - DNA, 25 bp, Mus musculus
ggcaggtctgcttaagctctgagta

SEQ ID NO: 611926 - DNA, 25 bp, Mus musculus
ggcaggtgaagtatgcaactgtgct

SEQ ID NO: 611927 - DNA, 25 bp, Mus musculus
ggcaggtgaagtttgcaactgtgct

SEQ ID NO: 611928 - DNA, 25 bp, Mus musculus
ggcaggtgaatgacagaggctctcc

SEQ ID NO: 611929 - DNA, 25 bp, Mus musculus
ggcaggtgaatgtcagaggctctcc

SEQ ID NO: 611930 - DNA, 25 bp, Mus musculus
ggcaggtgaattactatgactccaa

SEQ ID NO: 611931 - DNA, 25 bp, Mus musculus
ggcaggtgaatttctatgactccaa

SEQ ID NO: 611932 - DNA, 25 bp, Mus musculus
ggcaggtgacctacaaagctctcag

SEQ ID NO: 611933 - DNA, 25 bp, Mus musculus
ggcaggtgaccttcaaagctctcag

SEQ ID NO: 611934 - DNA, 25 bp, Mus musculus
ggcaggtgatatacttttctcttcc

SEQ ID NO: 611935 - DNA, 25 bp, Mus musculus
ggcaggtgatattcttttctcttcc

SEQ ID NO: 611936 - DNA, 25 bp, Mus musculus
ggcaggtgcaacatgcccagtggca

SEQ ID NO: 611937 - DNA, 25 bp, Mus musculus
ggcaggtgcaacttgcccagtggca

SEQ ID NO: 611938 - DNA, 25 bp, Mus musculus
ggcaggtgccctatatgagtatgtc

SEQ ID NO: 611939 - DNA, 25 bp, Mus musculus
ggcaggtgccctttatgagtatgtc

SEQ ID NO: 611940 - DNA, 25 bp, Mus musculus
ggcaggtgctttaactttagtctct

SEQ ID NO: 611941 - DNA, 25 bp, Mus musculus
ggcaggtgcttttactttagtctct

SEQ ID NO: 611942 - DNA, 25 bp, Mus musculus
ggcaggtggcaccaccaagcccttt

SEQ ID NO: 611943 - DNA, 25 bp, Mus musculus
ggcaggtggcacgaccaagcccttt

SEQ ID NO: 611944 - DNA, 25 bp, Mus musculus
ggcaggtggtgacttcctttgtaat

SEQ ID NO: 611945 - DNA, 25 bp, Mus musculus
ggcaggtggtgagttcctttgtaat

SEQ ID NO: 611946 - DNA, 25 bp, Mus musculus
ggcaggtgtcaaagctggctcttaa

SEQ ID NO: 611947 - DNA, 25 bp, Mus musculus
ggcaggtgtcaatgctggctcttaa

SEQ ID NO: 611948 - DNA, 25 bp, Mus musculus
ggcaggtgtgtaacgctctggactc

SEQ ID NO: 611949 - DNA, 25 bp, Mus musculus
ggcaggtgtgtatcgctctggactc

SEQ ID NO: 611950 - DNA, 25 bp, Mus musculus
ggcaggtgtgttacaagttggtttt

SEQ ID NO: 611951 - DNA, 25 bp, Mus musculus
ggcaggtgtgtttcaagttggtttt

SEQ ID NO: 611952 - DNA, 25 bp, Mus musculus
ggcaggtgttctacaggaaaggacc

SEQ ID NO: 611953 - DNA, 25 bp, Mus musculus
ggcaggtgttcttcaggaaaggacc

SEQ ID NO: 611954 - DNA, 25 bp, Mus musculus
ggcaggttaatacttctcggacacg

SEQ ID NO: 611955 - DNA, 25 bp, Mus musculus
ggcaggttaatagttctcggacacg

SEQ ID NO: 611956 - DNA, 25 bp, Mus musculus
ggcaggttaatcacttaagttcaaa

SEQ ID NO: 611957 - DNA, 25 bp, Mus musculus
ggcaggttaatccaattgctgtaaa

SEQ ID NO: 611958 - DNA, 25 bp, Mus musculus
ggcaggttaatcgaattgctgtaaa

SEQ ID NO: 611959 - DNA, 25 bp, Mus musculus
ggcaggttaatctcttaagttcaaa

SEQ ID NO: 611960 - DNA, 25 bp, Mus musculus
ggcaggttacagaacctcatttcaa

SEQ ID NO: 611961 - DNA, 25 bp, Mus musculus
ggcaggttacagtacctcatttcaa

SEQ ID NO: 611962 - DNA, 25 bp, Mus musculus
ggcaggttacctctttggcagtgac

SEQ ID NO: 611963 - DNA, 25 bp, Mus musculus
ggcaggttacctgtttggcagtgac

SEQ ID NO: 611964 - DNA, 25 bp, Mus musculus
ggcaggttattccaagctccatcta

SEQ ID NO: 611965 - DNA, 25 bp, Mus musculus
ggcaggttattcgaagctccatcta

SEQ ID NO: 611966 - DNA, 25 bp, Mus musculus
ggcaggttccagcatcctgattggt

SEQ ID NO: 611967 - DNA, 25 bp, Mus musculus
ggcaggttccaggatcctgattggt

SEQ ID NO: 611968 - DNA, 25 bp, Mus musculus
ggcaggttctgaaaccagtcctttt

SEQ ID NO: 611969 - DNA, 25 bp, Mus musculus
ggcaggttctgataccagtcctttt

SEQ ID NO: 611970 - DNA, 25 bp, Mus musculus
ggcaggttctgcagattatgtccac

SEQ ID NO: 611971 - DNA, 25 bp, Mus musculus
ggcaggttctgctgattatgtccac

SEQ ID NO: 611972 - DNA, 25 bp, Mus musculus
ggcaggttcttaatctacattttta

SEQ ID NO: 611973 - DNA, 25 bp, Mus musculus
ggcaggttcttattctacattttta

SEQ ID NO: 611974 - DNA, 25 bp, Mus musculus
ggcaggttgagaacgtgctgtcact

SEQ ID NO: 611975 - DNA, 25 bp, Mus musculus
ggcaggttgagatcgtgctgtcact

SEQ ID NO: 611976 - DNA, 25 bp, Mus musculus
ggcaggttgcctcttaaatgttgtc

SEQ ID NO: 611977 - DNA, 25 bp, Mus musculus
ggcaggttgcctgttaaatgttgtc

SEQ ID NO: 611978 - DNA, 25 bp, Mus musculus
ggcaggtttgtcagtgctcgccgat

SEQ ID NO: 611979 - DNA, 25 bp, Mus musculus
ggcaggtttgtctgtgctcgccgat

SEQ ID NO: 611980 - DNA, 25 bp, Mus musculus
ggcagtaaaatcaagttcaatatcc

SEQ ID NO: 611981 - DNA, 25 bp, Mus musculus
ggcagtaaaatctagttcaatatcc

SEQ ID NO: 611982 - DNA, 25 bp, Mus musculus
ggcagtaactacacactatgtccag

SEQ ID NO: 611983 - DNA, 25 bp, Mus musculus
ggcagtaactactcactatgtccag

SEQ ID NO: 611984 - DNA, 25 bp, Mus musculus
ggcagtaagccactacaaagtgttt

SEQ ID NO: 611985 - DNA, 25 bp, Mus musculus
ggcagtaagccagtacaaagtgttt

SEQ ID NO: 611986 - DNA, 25 bp, Mus musculus
ggcagtaaggatattcgcacaggaa

SEQ ID NO: 611987 - DNA, 25 bp, Mus musculus
ggcagtaaggattttcgcacaggaa

SEQ ID NO: 611988 - DNA, 25 bp, Mus musculus
ggcagtaatagaattgtttagcact

SEQ ID NO: 611989 - DNA, 25 bp, Mus musculus
ggcagtaatagatttgtttagcact

SEQ ID NO: 611990 - DNA, 25 bp, Mus musculus
ggcagtaatcaaactaatggtcctt

SEQ ID NO: 611991 - DNA, 25 bp, Mus musculus
ggcagtaatcaatctaatggtcctt

SEQ ID NO: 611992 - DNA, 25 bp, Mus musculus
ggcagtaattcaaggcatctgattc

SEQ ID NO: 611993 - DNA, 25 bp, Mus musculus
ggcagtaattcatggcatctgattc

SEQ ID NO: 611994 - DNA, 25 bp, Mus musculus
ggcagtacagatattcactttcttg

SEQ ID NO: 611995 - DNA, 25 bp, Mus musculus
ggcagtacagattttcactttcttg

SEQ ID NO: 611996 - DNA, 25 bp, Mus musculus
ggcagtaccagaattagccgctttt

SEQ ID NO: 611997 - DNA, 25 bp, Mus musculus
ggcagtaccagatttagccgctttt

SEQ ID NO: 611998 - DNA, 25 bp, Mus musculus
ggcagtaccatcaacagtgggcagg

SEQ ID NO: 611999 - DNA, 25 bp, Mus musculus
ggcagtaccatctacagtgggcagg

SEQ ID NO: 612000 - DNA, 25 bp, Mus musculus
ggcagtacgcgtctgtaaactcact

SEQ ID NO: 612001 - DNA, 25 bp, Mus musculus
ggcagtacgcgtgtgtaaactcact

SEQ ID NO: 612002 - DNA, 25 bp, Mus musculus
ggcagtactaatctccttatttttg

SEQ ID NO: 612003 - DNA, 25 bp, Mus musculus
ggcagtactaatgtccttatttttg

SEQ ID NO: 612004 - DNA, 25 bp, Mus musculus
ggcagtacttctaaggaacctaggg

SEQ ID NO: 612005 - DNA, 25 bp, Mus musculus
ggcagtacttcttaggaacctaggg

SEQ ID NO: 612006 - DNA, 25 bp, Mus musculus
ggcagtacttgacctttggaggaat

SEQ ID NO: 612007 - DNA, 25 bp, Mus musculus
ggcagtacttgagctttggaggaat

SEQ ID NO: 612008 - DNA, 25 bp, Mus musculus
ggcagtagaaccaactctcaaaact

SEQ ID NO: 612009 - DNA, 25 bp, Mus musculus
ggcagtagaacctactctcaaaact

SEQ ID NO: 612010 - DNA, 25 bp, Mus musculus
ggcagtagacgaatctttttgcttt

SEQ ID NO: 612011 - DNA, 25 bp, Mus musculus
ggcagtagacgattctttttgcttt

SEQ ID NO: 612012 - DNA, 25 bp, Mus musculus
ggcagtagatagcagaggctccttt

SEQ ID NO: 612013 - DNA, 25 bp, Mus musculus
ggcagtagataggagaggctccttt

SEQ ID NO: 612014 - DNA, 25 bp, Mus musculus
ggcagtagcaccactttgaaaggat

SEQ ID NO: 612015 - DNA, 25 bp, Mus musculus
ggcagtagcacctctttgaaaggat

SEQ ID NO: 612016 - DNA, 25 bp, Mus musculus
ggcagtagctccaaagtccagagca

SEQ ID NO: 612017 - DNA, 25 bp, Mus musculus
ggcagtagctcctaagtccagagca

SEQ ID NO: 612018 - DNA, 25 bp, Mus musculus
ggcagtagctggaagcccctcggaa

SEQ ID NO: 612019 - DNA, 25 bp, Mus musculus
ggcagtagctggtagcccctcggaa

SEQ ID NO: 612020 - DNA, 25 bp, Mus musculus
ggcagtagctttcccagcttcagtt

SEQ ID NO: 612021 - DNA, 25 bp, Mus musculus
ggcagtagctttgccagcttcagtt

SEQ ID NO: 612022 - DNA, 25 bp, Mus musculus
ggcagtaggcacaaacttggacgac

SEQ ID NO: 612023 - DNA, 25 bp, Mus musculus
ggcagtaggcactaacttggacgac

SEQ ID NO: 612024 - DNA, 25 bp, Mus musculus
ggcagtagtcagcacttctagatca

SEQ ID NO: 612025 - DNA, 25 bp, Mus musculus
ggcagtagtcaggacttctagatca

SEQ ID NO: 612026 - DNA, 25 bp, Mus musculus
ggcagtagtgccattgacagttgag

SEQ ID NO: 612027 - DNA, 25 bp, Mus musculus
ggcagtagtgcctttgacagttgag

SEQ ID NO: 612028 - DNA, 25 bp, Mus musculus
ggcagtagttcacatcagtcagttc

SEQ ID NO: 612029 - DNA, 25 bp, Mus musculus
ggcagtagttcagatcagtcagttc

SEQ ID NO: 612030 - DNA, 25 bp, Mus musculus
ggcagtatcaagaaaccatcaagaa

SEQ ID NO: 612031 - DNA, 25 bp, Mus musculus
ggcagtatcaagtaaccatcaagaa

SEQ ID NO: 612032 - DNA, 25 bp, Mus musculus
ggcagtatcccacgcgaatttaaac

SEQ ID NO: 612033 - DNA, 25 bp, Mus musculus
ggcagtatcccaggcgaatttaaac

SEQ ID NO: 612034 - DNA, 25 bp, Mus musculus
ggcagtatccttatgcatgaacatt

SEQ ID NO: 612035 - DNA, 25 bp, Mus musculus
ggcagtatccttttgcatgaacatt

SEQ ID NO: 612036 - DNA, 25 bp, Mus musculus
ggcagtatcgcaaggatggtcctcc

SEQ ID NO: 612037 - DNA, 25 bp, Mus musculus
ggcagtatcgcatggatggtcctcc

SEQ ID NO: 612038 - DNA, 25 bp, Mus musculus
ggcagtatcgccatatcctgaagga

SEQ ID NO: 612039 - DNA, 25 bp, Mus musculus
ggcagtatcgccttatcctgaagga

SEQ ID NO: 612040 - DNA, 25 bp, Mus musculus
ggcagtatcttactgttctttccct

SEQ ID NO: 612041 - DNA, 25 bp, Mus musculus
ggcagtatcttagtgttctttccct

SEQ ID NO: 612042 - DNA, 25 bp, Mus musculus
ggcagtatgaagcatcgacggtcaa

SEQ ID NO: 612043 - DNA, 25 bp, Mus musculus
ggcagtatgaaggatcgacggtcaa

SEQ ID NO: 612044 - DNA, 25 bp, Mus musculus
ggcagtatgacacgagactcactaa

SEQ ID NO: 612045 - DNA, 25 bp, Mus musculus
ggcagtatgacaggagactcactaa

SEQ ID NO: 612046 - DNA, 25 bp, Mus musculus
ggcagtatgactagctctccgaata

SEQ ID NO: 612047 - DNA, 25 bp, Mus musculus
ggcagtatgacttgctctccgaata

SEQ ID NO: 612048 - DNA, 25 bp, Mus musculus
ggcagtatggaacctgtggtcacta

SEQ ID NO: 612049 - DNA, 25 bp, Mus musculus
ggcagtatggaagctgtggtcacta

SEQ ID NO: 612050 - DNA, 25 bp, Mus musculus
ggcagtattgacactgtaccatcat

SEQ ID NO: 612051 - DNA, 25 bp, Mus musculus
ggcagtattgactctgtaccatcat

SEQ ID NO: 612052 - DNA, 25 bp, Mus musculus
ggcagtattttgaaggcttcatcct

SEQ ID NO: 612053 - DNA, 25 bp, Mus musculus
ggcagtattttgtaggcttcatcct

SEQ ID NO: 612054 - DNA, 25 bp, Mus musculus
ggcagtcacaatcaaaggttcacta

SEQ ID NO: 612055 - DNA, 25 bp, Mus musculus
ggcagtcacaatgaaaggttcacta

SEQ ID NO: 612056 - DNA, 25 bp, Mus musculus
ggcagtcacagtcggattctttcct

SEQ ID NO: 612057 - DNA, 25 bp, Mus musculus
ggcagtcacagtgggattctttcct

SEQ ID NO: 612058 - DNA, 25 bp, Mus musculus
ggcagtcacataagatagcccaccc

SEQ ID NO: 612059 - DNA, 25 bp, Mus musculus
ggcagtcacatatgatagcccaccc

SEQ ID NO: 612060 - DNA, 25 bp, Mus musculus
ggcagtcaccacaccatgaggatgt

SEQ ID NO: 612061 - DNA, 25 bp, Mus musculus
ggcagtcaccactccatgaggatgt

SEQ ID NO: 612062 - DNA, 25 bp, Mus musculus
ggcagtcactgcctcagtagtaact

SEQ ID NO: 612063 - DNA, 25 bp, Mus musculus
ggcagtcactgcgtcagtagtaact

SEQ ID NO: 612064 - DNA, 25 bp, Mus musculus
ggcagtcacttgaaacttatggctt

SEQ ID NO: 612065 - DNA, 25 bp, Mus musculus
ggcagtcacttgtaacttatggctt

SEQ ID NO: 612066 - DNA, 25 bp, Mus musculus
ggcagtcagaggacacttgctgaag

SEQ ID NO: 612067 - DNA, 25 bp, Mus musculus
ggcagtcagaggtcacttgctgaag

SEQ ID NO: 612068 - DNA, 25 bp, Mus musculus
ggcagtcagatcacgatgagtttaa

SEQ ID NO: 612069 - DNA, 25 bp, Mus musculus
ggcagtcagatctcgatgagtttaa

SEQ ID NO: 612070 - DNA, 25 bp, Mus musculus
ggcagtcaggaccagaccttaactt

SEQ ID NO: 612071 - DNA, 25 bp, Mus musculus
ggcagtcaggacgagaccttaactt

SEQ ID NO: 612072 - DNA, 25 bp, Mus musculus
ggcagtcagtgtatgcacacggtgt

SEQ ID NO: 612073 - DNA, 25 bp, Mus musculus
ggcagtcagtgtttgcacacggtgt

SEQ ID NO: 612074 - DNA, 25 bp, Mus musculus
ggcagtcataagctccaggttcttt

SEQ ID NO: 612075 - DNA, 25 bp, Mus musculus
ggcagtcataaggtccaggttcttt

SEQ ID NO: 612076 - DNA, 25 bp, Mus musculus
ggcagtcatagcatggcaccaaatt

SEQ ID NO: 612077 - DNA, 25 bp, Mus musculus
ggcagtcatagcttggcaccaaatt

SEQ ID NO: 612078 - DNA, 25 bp, Mus musculus
ggcagtcatgctatcttctgcctct

SEQ ID NO: 612079 - DNA, 25 bp, Mus musculus
ggcagtcatgctttcttctgcctct

SEQ ID NO: 612080 - DNA, 25 bp, Mus musculus
ggcagtcatgtcaattttatttctc

SEQ ID NO: 612081 - DNA, 25 bp, Mus musculus
ggcagtcatgtctattttatttctc

SEQ ID NO: 612082 - DNA, 25 bp, Mus musculus
ggcagtcattgaccttgctttcatc

SEQ ID NO: 612083 - DNA, 25 bp, Mus musculus
ggcagtcattgagcttgctttcatc

SEQ ID NO: 612084 - DNA, 25 bp, Mus musculus
ggcagtccagaacccatagaacaag

SEQ ID NO: 612085 - DNA, 25 bp, Mus musculus
ggcagtccagaagccatagaacaag

SEQ ID NO: 612086 - DNA, 25 bp, Mus musculus
ggcagtccaggcatcaattcaaaac

SEQ ID NO: 612087 - DNA, 25 bp, Mus musculus
ggcagtccaggcttcaattcaaaac

SEQ ID NO: 612088 - DNA, 25 bp, Mus musculus
ggcagtccatcgatgcactcaaaga

SEQ ID NO: 612089 - DNA, 25 bp, Mus musculus
ggcagtccatcgttgcactcaaaga

SEQ ID NO: 612090 - DNA, 25 bp, Mus musculus
ggcagtcccacaacatcgaaatcaa

SEQ ID NO: 612091 - DNA, 25 bp, Mus musculus
ggcagtcccacatcatcgaaatcaa

SEQ ID NO: 612092 - DNA, 25 bp, Mus musculus
ggcagtcccgaaaaactacccagag

SEQ ID NO: 612093 - DNA, 25 bp, Mus musculus
ggcagtcccgaataactacccagag

SEQ ID NO: 612094 - DNA, 25 bp, Mus musculus
ggcagtcccttactgtacatcagag

SEQ ID NO: 612095 - DNA, 25 bp, Mus musculus
ggcagtcccttagtgtacatcagag

SEQ ID NO: 612096 - DNA, 25 bp, Mus musculus
ggcagtccgtctccaggctctagag

SEQ ID NO: 612097 - DNA, 25 bp, Mus musculus
ggcagtccgtctgcaggctctagag

SEQ ID NO: 612098 - DNA, 25 bp, Mus musculus
ggcagtcctgacctctatgagtgaa

SEQ ID NO: 612099 - DNA, 25 bp, Mus musculus
ggcagtcctgacgtctatgagtgaa

SEQ ID NO: 612100 - DNA, 25 bp, Mus musculus
ggcagtcctgatccattgagatgct

SEQ ID NO: 612101 - DNA, 25 bp, Mus musculus
ggcagtcctgatgcattgagatgct

SEQ ID NO: 612102 - DNA, 25 bp, Mus musculus
ggcagtcctgcaactaaagtcacta

SEQ ID NO: 612103 - DNA, 25 bp, Mus musculus
ggcagtcctgcatctaaagtcacta

SEQ ID NO: 612104 - DNA, 25 bp, Mus musculus
ggcagtcctgtacagtaacttttct

SEQ ID NO: 612105 - DNA, 25 bp, Mus musculus
ggcagtcctgtagagtaacttttct

SEQ ID NO: 612106 - DNA, 25 bp, Mus musculus
ggcagtccttagagactccagggat

SEQ ID NO: 612107 - DNA, 25 bp, Mus musculus
ggcagtccttagtgactccagggat

SEQ ID NO: 612108 - DNA, 25 bp, Mus musculus
ggcagtcgagaacacccttgcttat

SEQ ID NO: 612109 - DNA, 25 bp, Mus musculus
ggcagtcgagaagacccttgcttat

SEQ ID NO: 612110 - DNA, 25 bp, Mus musculus
ggcagtcggctaaaccattatttta

SEQ ID NO: 612111 - DNA, 25 bp, Mus musculus
ggcagtcggctataccattatttta

SEQ ID NO: 612112 - DNA, 25 bp, Mus musculus
ggcagtcgtataatttactctagaa

SEQ ID NO: 612113 - DNA, 25 bp, Mus musculus
ggcagtcgtatattttactctagaa

SEQ ID NO: 612114 - DNA, 25 bp, Mus musculus
ggcagtctatagattcagtgcaatc

SEQ ID NO: 612115 - DNA, 25 bp, Mus musculus
ggcagtctatagtttcagtgcaatc

SEQ ID NO: 612116 - DNA, 25 bp, Mus musculus
ggcagtctccttcgtagttacaagc

SEQ ID NO: 612117 - DNA, 25 bp, Mus musculus
ggcagtctccttggtagttacaagc

SEQ ID NO: 612118 - DNA, 25 bp, Mus musculus
ggcagtctcttccttgaaatttcta

SEQ ID NO: 612119 - DNA, 25 bp, Mus musculus
ggcagtctcttcgttgaaatttcta

SEQ ID NO: 612120 - DNA, 25 bp, Mus musculus
ggcagtctgaagcacaggacacaat

SEQ ID NO: 612121 - DNA, 25 bp, Mus musculus
ggcagtctgaaggacaggacacaat

SEQ ID NO: 612122 - DNA, 25 bp, Mus musculus
ggcagtctgctaatagaccgtgaga

SEQ ID NO: 612123 - DNA, 25 bp, Mus musculus
ggcagtctgctattagaccgtgaga

SEQ ID NO: 612124 - DNA, 25 bp, Mus musculus
ggcagtctgctcaagccaggaggct

SEQ ID NO: 612125 - DNA, 25 bp, Mus musculus
ggcagtctgctctagccaggaggct

SEQ ID NO: 612126 - DNA, 25 bp, Mus musculus
ggcagtctgctgattttgttactag

SEQ ID NO: 612127 - DNA, 25 bp, Mus musculus
ggcagtctgctgtttttgttactag

SEQ ID NO: 612128 - DNA, 25 bp, Mus musculus
ggcagtctggaaatgacacttcact

SEQ ID NO: 612129 - DNA, 25 bp, Mus musculus
ggcagtctggaaccacaactgctct

SEQ ID NO: 612130 - DNA, 25 bp, Mus musculus
ggcagtctggaagcacaactgctct

SEQ ID NO: 612131 - DNA, 25 bp, Mus musculus
ggcagtctggaattgacacttcact

SEQ ID NO: 612132 - DNA, 25 bp, Mus musculus
ggcagtctgtcccatcctgcagtgt

SEQ ID NO: 612133 - DNA, 25 bp, Mus musculus
ggcagtctgtccgatcctgcagtgt

SEQ ID NO: 612134 - DNA, 25 bp, Mus musculus
ggcagtctgtgcacgtcatttgtgg

SEQ ID NO: 612135 - DNA, 25 bp, Mus musculus
ggcagtctgtgctcgtcatttgtgg

SEQ ID NO: 612136 - DNA, 25 bp, Mus musculus
ggcagtcttgccatttccctgattt

SEQ ID NO: 612137 - DNA, 25 bp, Mus musculus
ggcagtcttgccttttccctgattt

SEQ ID NO: 612138 - DNA, 25 bp, Mus musculus
ggcagtgaacacatatgaaggtaca

SEQ ID NO: 612139 - DNA, 25 bp, Mus musculus
ggcagtgaacacttatgaaggtaca

SEQ ID NO: 612140 - DNA, 25 bp, Mus musculus
ggcagtgaacatcaaccttgagagt

SEQ ID NO: 612141 - DNA, 25 bp, Mus musculus
ggcagtgaacatgaaccttgagagt

SEQ ID NO: 612142 - DNA, 25 bp, Mus musculus
ggcagtgaagaaacttggttccgtt

SEQ ID NO: 612143 - DNA, 25 bp, Mus musculus
ggcagtgaagaatcttggttccgtt

SEQ ID NO: 612144 - DNA, 25 bp, Mus musculus
ggcagtgaagtcagctagtcataca

SEQ ID NO: 612145 - DNA, 25 bp, Mus musculus
ggcagtgaagtctgctagtcataca

SEQ ID NO: 612146 - DNA, 25 bp, Mus musculus
ggcagtgacaacagggtcttgctat

SEQ ID NO: 612147 - DNA, 25 bp, Mus musculus
ggcagtgacaactgggtcttgctat

SEQ ID NO: 612148 - DNA, 25 bp, Mus musculus
ggcagtgacacgaggccagctgaaa

SEQ ID NO: 612149 - DNA, 25 bp, Mus musculus
ggcagtgacacgtggccagctgaaa

SEQ ID NO: 612150 - DNA, 25 bp, Mus musculus
ggcagtgacctacccaaagtgtcca

SEQ ID NO: 612151 - DNA, 25 bp, Mus musculus
ggcagtgacctagccaaagtgtcca

SEQ ID NO: 612152 - DNA, 25 bp, Mus musculus
ggcagtgaccttcactgtggtgtca

SEQ ID NO: 612153 - DNA, 25 bp, Mus musculus
ggcagtgaccttgactgtggtgtca

SEQ ID NO: 612154 - DNA, 25 bp, Mus musculus
ggcagtgacgaccacatggagtcca

SEQ ID NO: 612155 - DNA, 25 bp, Mus musculus
ggcagtgacgacgacatggagtcca

SEQ ID NO: 612156 - DNA, 25 bp, Mus musculus
ggcagtgactaccagggacaccatt

SEQ ID NO: 612157 - DNA, 25 bp, Mus musculus
ggcagtgactacgagggacaccatt

SEQ ID NO: 612158 - DNA, 25 bp, Mus musculus
ggcagtgactctcacctggagatat

SEQ ID NO: 612159 - DNA, 25 bp, Mus musculus
ggcagtgactctgacctggagatat

SEQ ID NO: 612160 - DNA, 25 bp, Mus musculus
ggcagtgactgacctcacctggacc

SEQ ID NO: 612161 - DNA, 25 bp, Mus musculus
ggcagtgactgacgacagacagatt

SEQ ID NO: 612162 - DNA, 25 bp, Mus musculus
ggcagtgactgagctcacctggacc

SEQ ID NO: 612163 - DNA, 25 bp, Mus musculus
ggcagtgactgaggacagacagatt

SEQ ID NO: 612164 - DNA, 25 bp, Mus musculus
ggcagtgagacaaagccctggcaga

SEQ ID NO: 612165 - DNA, 25 bp, Mus musculus
ggcagtgagacatagccctggcaga

SEQ ID NO: 612166 - DNA, 25 bp, Mus musculus
ggcagtgagccccagacaggataat

SEQ ID NO: 612167 - DNA, 25 bp, Mus musculus
ggcagtgagcccgagacaggataat

SEQ ID NO: 612168 - DNA, 25 bp, Mus musculus
ggcagtgaggaccatgtacccgatc

SEQ ID NO: 612169 - DNA, 25 bp, Mus musculus
ggcagtgaggacgatgtacccgatc

SEQ ID NO: 612170 - DNA, 25 bp, Mus musculus
ggcagtgaggtaacagatccccagg

SEQ ID NO: 612171 - DNA, 25 bp, Mus musculus
ggcagtgaggtatcagatccccagg

SEQ ID NO: 612172 - DNA, 25 bp, Mus musculus
ggcagtgaggttcgaatatcatcaa

SEQ ID NO: 612173 - DNA, 25 bp, Mus musculus
ggcagtgaggttggaatatcatcaa

SEQ ID NO: 612174 - DNA, 25 bp, Mus musculus
ggcagtgatgatcgtagcctccctg

SEQ ID NO: 612175 - DNA, 25 bp, Mus musculus
ggcagtgatgatggtagcctccctg

SEQ ID NO: 612176 - DNA, 25 bp, Mus musculus
ggcagtgatggtccaaaacgccttt

SEQ ID NO: 612177 - DNA, 25 bp, Mus musculus
ggcagtgatggtcttgactacccta

SEQ ID NO: 612178 - DNA, 25 bp, Mus musculus
ggcagtgatggtgcaaaacgccttt

SEQ ID NO: 612179 - DNA, 25 bp, Mus musculus
ggcagtgatggtgttgactacccta

SEQ ID NO: 612180 - DNA, 25 bp, Mus musculus
ggcagtgcaaaactagcctggctca

SEQ ID NO: 612181 - DNA, 25 bp, Mus musculus
ggcagtgcaaaagtagcctggctca

SEQ ID NO: 612182 - DNA, 25 bp, Mus musculus
ggcagtgcaccaacttatgtttatc

SEQ ID NO: 612183 - DNA, 25 bp, Mus musculus
ggcagtgcaccatcttatgtttatc

SEQ ID NO: 612184 - DNA, 25 bp, Mus musculus
ggcagtgcacctattctgtagttgc

SEQ ID NO: 612185 - DNA, 25 bp, Mus musculus
ggcagtgcaccttttctgtagttgc

SEQ ID NO: 612186 - DNA, 25 bp, Mus musculus
ggcagtgcactgctaagatgctgat

SEQ ID NO: 612187 - DNA, 25 bp, Mus musculus
ggcagtgcactggtaagatgctgat

SEQ ID NO: 612188 - DNA, 25 bp, Mus musculus
ggcagtgccaatcaacaagctgtgc

SEQ ID NO: 612189 - DNA, 25 bp, Mus musculus
ggcagtgccaatgaacaagctgtgc

SEQ ID NO: 612190 - DNA, 25 bp, Mus musculus
ggcagtgccactagaatgtcctgaa

SEQ ID NO: 612191 - DNA, 25 bp, Mus musculus
ggcagtgccactagcagttccaata

SEQ ID NO: 612192 - DNA, 25 bp, Mus musculus
ggcagtgccacttgaatgtcctgaa

SEQ ID NO: 612193 - DNA, 25 bp, Mus musculus
ggcagtgccacttgcagttccaata

SEQ ID NO: 612194 - DNA, 25 bp, Mus musculus
ggcagtgccgaaaagtacctcagag

SEQ ID NO: 612195 - DNA, 25 bp, Mus musculus
ggcagtgccgaatagtacctcagag

SEQ ID NO: 612196 - DNA, 25 bp, Mus musculus
ggcagtgccggacttagactcttta

SEQ ID NO: 612197 - DNA, 25 bp, Mus musculus
ggcagtgccggagttagactcttta

SEQ ID NO: 612198 - DNA, 25 bp, Mus musculus
ggcagtgcctatataggttcagaca

SEQ ID NO: 612199 - DNA, 25 bp, Mus musculus
ggcagtgcctatttaggttcagaca

SEQ ID NO: 612200 - DNA, 25 bp, Mus musculus
ggcagtgcgcgcacacctcgatgat

SEQ ID NO: 612201 - DNA, 25 bp, Mus musculus
ggcagtgcgcgctcacctcgatgat

SEQ ID NO: 612202 - DNA, 25 bp, Mus musculus
ggcagtgctgtcacatttaaggcaa

SEQ ID NO: 612203 - DNA, 25 bp, Mus musculus
ggcagtgctgtctcatttaaggcaa

SEQ ID NO: 612204 - DNA, 25 bp, Mus musculus
ggcagtggcaagaggatctcagaaa

SEQ ID NO: 612205 - DNA, 25 bp, Mus musculus
ggcagtggcaagtggatctcagaaa

SEQ ID NO: 612206 - DNA, 25 bp, Mus musculus
ggcagtggcagaaatgccttgtaaa

SEQ ID NO: 612207 - DNA, 25 bp, Mus musculus
ggcagtggcagatatgccttgtaaa

SEQ ID NO: 612208 - DNA, 25 bp, Mus musculus
ggcagtggcagcatatcctgaggcc

SEQ ID NO: 612209 - DNA, 25 bp, Mus musculus
ggcagtggcagcttatcctgaggcc

SEQ ID NO: 612210 - DNA, 25 bp, Mus musculus
ggcagtggcccaataagtcttaagt

SEQ ID NO: 612211 - DNA, 25 bp, Mus musculus
ggcagtggcccattaagtcttaagt

SEQ ID NO: 612212 - DNA, 25 bp, Mus musculus
ggcagtggcggcattgttaaccatt

SEQ ID NO: 612213 - DNA, 25 bp, Mus musculus
ggcagtggcggctttgttaaccatt

SEQ ID NO: 612214 - DNA, 25 bp, Mus musculus
ggcagtggctgcattcttggtgaat

SEQ ID NO: 612215 - DNA, 25 bp, Mus musculus
ggcagtggctgctttcttggtgaat

SEQ ID NO: 612216 - DNA, 25 bp, Mus musculus
ggcagtggcttcacctgtaaagttt

SEQ ID NO: 612217 - DNA, 25 bp, Mus musculus
ggcagtggcttctcctgtaaagttt

SEQ ID NO: 612218 - DNA, 25 bp, Mus musculus
ggcagtggctttcaccgcggccatt

SEQ ID NO: 612219 - DNA, 25 bp, Mus musculus
ggcagtggctttgaccgcggccatt

SEQ ID NO: 612220 - DNA, 25 bp, Mus musculus
ggcagtgggagcacacacacacctt

SEQ ID NO: 612221 - DNA, 25 bp, Mus musculus
ggcagtgggagctcacacacacctt

SEQ ID NO: 612222 - DNA, 25 bp, Mus musculus
ggcagtgggcagagggccaggccta

SEQ ID NO: 612223 - DNA, 25 bp, Mus musculus
ggcagtgggcagtgggccaggccta

SEQ ID NO: 612224 - DNA, 25 bp, Mus musculus
ggcagtgggcatatagttaattctc

SEQ ID NO: 612225 - DNA, 25 bp, Mus musculus
ggcagtgggcatttagttaattctc

SEQ ID NO: 612226 - DNA, 25 bp, Mus musculus
ggcagtgggtacacgtttaccagaa

SEQ ID NO: 612227 - DNA, 25 bp, Mus musculus
ggcagtgggtactcgtttaccagaa

SEQ ID NO: 612228 - DNA, 25 bp, Mus musculus
ggcagtggtaggagttacttcccta

SEQ ID NO: 612229 - DNA, 25 bp, Mus musculus
ggcagtggtaggtgttacttcccta

SEQ ID NO: 612230 - DNA, 25 bp, Mus musculus
ggcagtggtccaagtagccaagcct

SEQ ID NO: 612231 - DNA, 25 bp, Mus musculus
ggcagtggtccaagttagccagccg

SEQ ID NO: 612232 - DNA, 25 bp, Mus musculus
ggcagtggtccatgtagccaagcct

SEQ ID NO: 612233 - DNA, 25 bp, Mus musculus
ggcagtggtccatgttagccagccg

SEQ ID NO: 612234 - DNA, 25 bp, Mus musculus
ggcagtggtgaacgccattagtccc

SEQ ID NO: 612235 - DNA, 25 bp, Mus musculus
ggcagtggtgaaggccattagtccc

SEQ ID NO: 612236 - DNA, 25 bp, Mus musculus
ggcagtggtgcccatcacagcaaac

SEQ ID NO: 612237 - DNA, 25 bp, Mus musculus
ggcagtggtgccgatcacagcaaac

SEQ ID NO: 612238 - DNA, 25 bp, Mus musculus
ggcagtggtggcagaagcccttatt

SEQ ID NO: 612239 - DNA, 25 bp, Mus musculus
ggcagtggtggctgaagcccttatt

SEQ ID NO: 612240 - DNA, 25 bp, Mus musculus
ggcagtggtttgattcctagcgtca

SEQ ID NO: 612241 - DNA, 25 bp, Mus musculus
ggcagtggtttgtttcctagcgtca

SEQ ID NO: 612242 - DNA, 25 bp, Mus musculus
ggcagtgtaatcatttatcagtata

SEQ ID NO: 612243 - DNA, 25 bp, Mus musculus
ggcagtgtaatcttttatcagtata

SEQ ID NO: 612244 - DNA, 25 bp, Mus musculus
ggcagtgtacagctgctcgatttta

SEQ ID NO: 612245 - DNA, 25 bp, Mus musculus
ggcagtgtacaggtgctcgatttta

SEQ ID NO: 612246 - DNA, 25 bp, Mus musculus
ggcagtgtacccctgtgaagcagaa

SEQ ID NO: 612247 - DNA, 25 bp, Mus musculus
ggcagtgtacccgtgtgaagcagaa

SEQ ID NO: 612248 - DNA, 25 bp, Mus musculus
ggcagtgtactgagacagccttaat

SEQ ID NO: 612249 - DNA, 25 bp, Mus musculus
ggcagtgtactgtgacagccttaat

SEQ ID NO: 612250 - DNA, 25 bp, Mus musculus
ggcagtgtaggtctctgtttactct

SEQ ID NO: 612251 - DNA, 25 bp, Mus musculus
ggcagtgtaggtgtctgtttactct

SEQ ID NO: 612252 - DNA, 25 bp, Mus musculus
ggcagtgtatccactacctagataa

SEQ ID NO: 612253 - DNA, 25 bp, Mus musculus
ggcagtgtatcctctacctagataa

SEQ ID NO: 612254 - DNA, 25 bp, Mus musculus
ggcagtgtattgatacgatcccgtt

SEQ ID NO: 612255 - DNA, 25 bp, Mus musculus
ggcagtgtattgttacgatcccgtt

SEQ ID NO: 612256 - DNA, 25 bp, Mus musculus
ggcagtgtcagtccacaggtcccaa

SEQ ID NO: 612257 - DNA, 25 bp, Mus musculus
ggcagtgtcagtgcacaggtcccaa

SEQ ID NO: 612258 - DNA, 25 bp, Mus musculus
ggcagtgtccacattgactccaaag

SEQ ID NO: 612259 - DNA, 25 bp, Mus musculus
ggcagtgtccactttgactccaaag

SEQ ID NO: 612260 - DNA, 25 bp, Mus musculus
ggcagtgtccttactttactgaata

SEQ ID NO: 612261 - DNA, 25 bp, Mus musculus
ggcagtgtcctttctttactgaata

SEQ ID NO: 612262 - DNA, 25 bp, Mus musculus
ggcagtgtcggcacttggcaataaa

SEQ ID NO: 612263 - DNA, 25 bp, Mus musculus
ggcagtgtcggctcttggcaataaa

SEQ ID NO: 612264 - DNA, 25 bp, Mus musculus
ggcagtgtctgactaaattgatttc

SEQ ID NO: 612265 - DNA, 25 bp, Mus musculus
ggcagtgtctgagtaaattgatttc

SEQ ID NO: 612266 - DNA, 25 bp, Mus musculus
ggcagtgtgaggctctagctcttca

SEQ ID NO: 612267 - DNA, 25 bp, Mus musculus
ggcagtgtgagggtctagctcttca

SEQ ID NO: 612268 - DNA, 25 bp, Mus musculus
ggcagtgtgatcacagacatggcag

SEQ ID NO: 612269 - DNA, 25 bp, Mus musculus
ggcagtgtgatctcagacatggcag

SEQ ID NO: 612270 - DNA, 25 bp, Mus musculus
ggcagtgtgcaacaactcagtacaa

SEQ ID NO: 612271 - DNA, 25 bp, Mus musculus
ggcagtgtgcaagaactcagtacaa

SEQ ID NO: 612272 - DNA, 25 bp, Mus musculus
ggcagtgtgcacaaagatgtcatct

SEQ ID NO: 612273 - DNA, 25 bp, Mus musculus
ggcagtgtgcactaagatgtcatct

SEQ ID NO: 612274 - DNA, 25 bp, Mus musculus
ggcagtgtgtacattgccccttttt

SEQ ID NO: 612275 - DNA, 25 bp, Mus musculus
ggcagtgtgtactttgccccttttt

SEQ ID NO: 612276 - DNA, 25 bp, Mus musculus
ggcagtgtgtgcatacaaagctttt

SEQ ID NO: 612277 - DNA, 25 bp, Mus musculus
ggcagtgtgtgcttacaaagctttt

SEQ ID NO: 612278 - DNA, 25 bp, Mus musculus
ggcagtgttaatatcgctttgtgaa

SEQ ID NO: 612279 - DNA, 25 bp, Mus musculus
ggcagtgttaatttcgctttgtgaa

SEQ ID NO: 612280 - DNA, 25 bp, Mus musculus
ggcagtgttaccatcaggaagtcat

SEQ ID NO: 612281 - DNA, 25 bp, Mus musculus
ggcagtgttaccttcaggaagtcat

SEQ ID NO: 612282 - DNA, 25 bp, Mus musculus
ggcagtgttagcaaacagtagctat

SEQ ID NO: 612283 - DNA, 25 bp, Mus musculus
ggcagtgttagctaacagtagctat

SEQ ID NO: 612284 - DNA, 25 bp, Mus musculus
ggcagtgttaggagataccgtctac

SEQ ID NO: 612285 - DNA, 25 bp, Mus musculus
ggcagtgttaggtgataccgtctac

SEQ ID NO: 612286 - DNA, 25 bp, Mus musculus
ggcagtgttcataagcttttggttc

SEQ ID NO: 612287 - DNA, 25 bp, Mus musculus
ggcagtgttcatctactggctgtcc

SEQ ID NO: 612288 - DNA, 25 bp, Mus musculus
ggcagtgttcatgtactggctgtcc

SEQ ID NO: 612289 - DNA, 25 bp, Mus musculus
ggcagtgttcattagcttttggttc

SEQ ID NO: 612290 - DNA, 25 bp, Mus musculus
ggcagtgttcttactgaagccaccg

SEQ ID NO: 612291 - DNA, 25 bp, Mus musculus
ggcagtgttctttctgaagccaccg

SEQ ID NO: 612292 - DNA, 25 bp, Mus musculus
ggcagtgtttacagcctggaatgct

SEQ ID NO: 612293 - DNA, 25 bp, Mus musculus
ggcagtgtttactgcctggaatgct

SEQ ID NO: 612294 - DNA, 25 bp, Mus musculus
ggcagtgtttatattaatctcttat

SEQ ID NO: 612295 - DNA, 25 bp, Mus musculus
ggcagtgtttattttaatctcttat

SEQ ID NO: 612296 - DNA, 25 bp, Mus musculus
ggcagtgtttgtatgaacctgacag

SEQ ID NO: 612297 - DNA, 25 bp, Mus musculus
ggcagtgtttgtttgaacctgacag

SEQ ID NO: 612298 - DNA, 25 bp, Mus musculus
ggcagttaaaacctgcttccaattg

SEQ ID NO: 612299 - DNA, 25 bp, Mus musculus
ggcagttaaaacgtgcttccaattg

SEQ ID NO: 612300 - DNA, 25 bp, Mus musculus
ggcagttaaaatacaccttcatttt

SEQ ID NO: 612301 - DNA, 25 bp, Mus musculus
ggcagttaaaattcaccttcatttt

SEQ ID NO: 612302 - DNA, 25 bp, Mus musculus
ggcagttaagtgagtatccctagta

SEQ ID NO: 612303 - DNA, 25 bp, Mus musculus
ggcagttaagtgtgtatccctagta

SEQ ID NO: 612304 - DNA, 25 bp, Mus musculus
ggcagttacactaagggttcccaga

SEQ ID NO: 612305 - DNA, 25 bp, Mus musculus
ggcagttacacttagggttcccaga

SEQ ID NO: 612306 - DNA, 25 bp, Mus musculus
ggcagttacatccagctgttagata

SEQ ID NO: 612307 - DNA, 25 bp, Mus musculus
ggcagttacatcgagctgttagata

SEQ ID NO: 612308 - DNA, 25 bp, Mus musculus
ggcagttaccataagaaacaactac

SEQ ID NO: 612309 - DNA, 25 bp, Mus musculus
ggcagttaccatcgcgacagtgact

SEQ ID NO: 612310 - DNA, 25 bp, Mus musculus
ggcagttaccatggcgacagtgact

SEQ ID NO: 612311 - DNA, 25 bp, Mus musculus
ggcagttaccattagaaacaactac

SEQ ID NO: 612312 - DNA, 25 bp, Mus musculus
ggcagttactgtcaggccagtttct

SEQ ID NO: 612313 - DNA, 25 bp, Mus musculus
ggcagttactgtgaggccagtttct

SEQ ID NO: 612314 - DNA, 25 bp, Mus musculus
ggcagttagcttctacagaggtcta

SEQ ID NO: 612315 - DNA, 25 bp, Mus musculus
ggcagttagcttgtacagaggtcta

SEQ ID NO: 612316 - DNA, 25 bp, Mus musculus
ggcagttaggataacagctgacact

SEQ ID NO: 612317 - DNA, 25 bp, Mus musculus
ggcagttaggattacagctgacact

SEQ ID NO: 612318 - DNA, 25 bp, Mus musculus
ggcagttagtgaagctctcggaccc

SEQ ID NO: 612319 - DNA, 25 bp, Mus musculus
ggcagttagtgatgctctcggaccc

SEQ ID NO: 612320 - DNA, 25 bp, Mus musculus
ggcagttatattatacttccaccag

SEQ ID NO: 612321 - DNA, 25 bp, Mus musculus
ggcagttatattttacttccaccag

SEQ ID NO: 612322 - DNA, 25 bp, Mus musculus
ggcagttatgttcctacgttctgac

SEQ ID NO: 612323 - DNA, 25 bp, Mus musculus
ggcagttatgttgctacgttctgac

SEQ ID NO: 612324 - DNA, 25 bp, Mus musculus
ggcagttatttcaatcttacacagt

SEQ ID NO: 612325 - DNA, 25 bp, Mus musculus
ggcagttatttcacttttgctataa

SEQ ID NO: 612326 - DNA, 25 bp, Mus musculus
ggcagttatttctatcttacacagt

SEQ ID NO: 612327 - DNA, 25 bp, Mus musculus
ggcagttatttctcttttgctataa

SEQ ID NO: 612328 - DNA, 25 bp, Mus musculus
ggcagttattttctgtttgaccttg

SEQ ID NO: 612329 - DNA, 25 bp, Mus musculus
ggcagttattttgtgtttgaccttg

SEQ ID NO: 612330 - DNA, 25 bp, Mus musculus
ggcagttcacggctgcttacacagc

SEQ ID NO: 612331 - DNA, 25 bp, Mus musculus
ggcagttcacgggtgcttacacagc

SEQ ID NO: 612332 - DNA, 25 bp, Mus musculus
ggcagttcattaatgagccacttca

SEQ ID NO: 612333 - DNA, 25 bp, Mus musculus
ggcagttcattattgagccacttca

SEQ ID NO: 612334 - DNA, 25 bp, Mus musculus
ggcagttccaccacagcagagggtc

SEQ ID NO: 612335 - DNA, 25 bp, Mus musculus
ggcagttccacctcagcagagggtc

SEQ ID NO: 612336 - DNA, 25 bp, Mus musculus
ggcagttcccaaaccagacctagat

SEQ ID NO: 612337 - DNA, 25 bp, Mus musculus
ggcagttcccaatccagacctagat

SEQ ID NO: 612338 - DNA, 25 bp, Mus musculus
ggcagttccccacgaaaagcccagt

SEQ ID NO: 612339 - DNA, 25 bp, Mus musculus
ggcagttccccaggaaaagcccagt

SEQ ID NO: 612340 - DNA, 25 bp, Mus musculus
ggcagttccctgcagttcacggagc

SEQ ID NO: 612341 - DNA, 25 bp, Mus musculus
ggcagttccctggagttcacggagc

SEQ ID NO: 612342 - DNA, 25 bp, Mus musculus
ggcagttcctcgagttagcatttaa

SEQ ID NO: 612343 - DNA, 25 bp, Mus musculus
ggcagttcctcgtgttagcatttaa

SEQ ID NO: 612344 - DNA, 25 bp, Mus musculus
ggcagttcgccacctgttactccag

SEQ ID NO: 612345 - DNA, 25 bp, Mus musculus
ggcagttcgccagctgttactccag

SEQ ID NO: 612346 - DNA, 25 bp, Mus musculus
ggcagttctactccgcaatcaggaa

SEQ ID NO: 612347 - DNA, 25 bp, Mus musculus
ggcagttctactgcgcaatcaggaa

SEQ ID NO: 612348 - DNA, 25 bp, Mus musculus
ggcagttctctaagctgtctgggaa

SEQ ID NO: 612349 - DNA, 25 bp, Mus musculus
ggcagttctctatgctgtctgggaa

SEQ ID NO: 612350 - DNA, 25 bp, Mus musculus
ggcagttctttaatcgtaccaggtt

SEQ ID NO: 612351 - DNA, 25 bp, Mus musculus
ggcagttctttattcgtaccaggtt

SEQ ID NO: 612352 - DNA, 25 bp, Mus musculus
ggcagttgaccgatgaaatcagatt

SEQ ID NO: 612353 - DNA, 25 bp, Mus musculus
ggcagttgaccgttgaaatcagatt

SEQ ID NO: 612354 - DNA, 25 bp, Mus musculus
ggcagttgatgaattgtggcatctc

SEQ ID NO: 612355 - DNA, 25 bp, Mus musculus
ggcagttgatgatttgtggcatctc

SEQ ID NO: 612356 - DNA, 25 bp, Mus musculus
ggcagttgatgcattagtatttgaa

SEQ ID NO: 612357 - DNA, 25 bp, Mus musculus
ggcagttgatgctttagtatttgaa

SEQ ID NO: 612358 - DNA, 25 bp, Mus musculus
ggcagttgcaatcatgtccacacag

SEQ ID NO: 612359 - DNA, 25 bp, Mus musculus
ggcagttgcaatgatgtccacacag

SEQ ID NO: 612360 - DNA, 25 bp, Mus musculus
ggcagttgcataacacttctttttg

SEQ ID NO: 612361 - DNA, 25 bp, Mus musculus
ggcagttgcatatcacttctttttg

SEQ ID NO: 612362 - DNA, 25 bp, Mus musculus
ggcagttgcattatctctctttttg

SEQ ID NO: 612363 - DNA, 25 bp, Mus musculus
ggcagttgcattttctctctttttg

SEQ ID NO: 612364 - DNA, 25 bp, Mus musculus
ggcagttgcctcaaatcgctgggaa

SEQ ID NO: 612365 - DNA, 25 bp, Mus musculus
ggcagttgcctctaatcgctgggaa

SEQ ID NO: 612366 - DNA, 25 bp, Mus musculus
ggcagttgctggatctccctggctc

SEQ ID NO: 612367 - DNA, 25 bp, Mus musculus
ggcagttgctggttctccctggctc

SEQ ID NO: 612368 - DNA, 25 bp, Mus musculus
ggcagttggcaaccatggcactgat

SEQ ID NO: 612369 - DNA, 25 bp, Mus musculus
ggcagttggcaagcatggcactgat

SEQ ID NO: 612370 - DNA, 25 bp, Mus musculus
ggcagttgggtaaaattctgacttt

SEQ ID NO: 612371 - DNA, 25 bp, Mus musculus
ggcagttgggtataattctgacttt

SEQ ID NO: 612372 - DNA, 25 bp, Mus musculus
ggcagttgtaagatacagacaagcc

SEQ ID NO: 612373 - DNA, 25 bp, Mus musculus
ggcagttgtaagttacagacaagcc

SEQ ID NO: 612374 - DNA, 25 bp, Mus musculus
ggcagttgtatgaattgtgtaccaa

SEQ ID NO: 612375 - DNA, 25 bp, Mus musculus
ggcagttgtatgtattgtgtaccaa

SEQ ID NO: 612376 - DNA, 25 bp, Mus musculus
ggcagttgtgcaaatgcttcttctt

SEQ ID NO: 612377 - DNA, 25 bp, Mus musculus
ggcagttgtgcatatgcttcttctt

SEQ ID NO: 612378 - DNA, 25 bp, Mus musculus
ggcagttgtggacttcctttcctca

SEQ ID NO: 612379 - DNA, 25 bp, Mus musculus
ggcagttgtggagttcctttcctca

SEQ ID NO: 612380 - DNA, 25 bp, Mus musculus
ggcagttgtgggacattataagcaa

SEQ ID NO: 612381 - DNA, 25 bp, Mus musculus
ggcagttgtgggtcattataagcaa

SEQ ID NO: 612382 - DNA, 25 bp, Mus musculus
ggcagttgtttcacaggttatcttt

SEQ ID NO: 612383 - DNA, 25 bp, Mus musculus
ggcagttgtttctcaggttatcttt

SEQ ID NO: 612384 - DNA, 25 bp, Mus musculus
ggcagtttacttcagtctcgtggaa

SEQ ID NO: 612385 - DNA, 25 bp, Mus musculus
ggcagtttacttgagtctcgtggaa

SEQ ID NO: 612386 - DNA, 25 bp, Mus musculus
ggcagtttagccataaagatctgta

SEQ ID NO: 612387 - DNA, 25 bp, Mus musculus
ggcagtttagccttaaagatctgta

SEQ ID NO: 612388 - DNA, 25 bp, Mus musculus
ggcagtttcatcaggtatgacctaa

SEQ ID NO: 612389 - DNA, 25 bp, Mus musculus
ggcagtttcatctggtatgacctaa

SEQ ID NO: 612390 - DNA, 25 bp, Mus musculus
ggcagtttccttctaaggtagtaag

SEQ ID NO: 612391 - DNA, 25 bp, Mus musculus
ggcagtttccttgtaaggtagtaag

SEQ ID NO: 612392 - DNA, 25 bp, Mus musculus
ggcagtttctaaagtctttgaacct

SEQ ID NO: 612393 - DNA, 25 bp, Mus musculus
ggcagtttctaatgtctttgaacct

SEQ ID NO: 612394 - DNA, 25 bp, Mus musculus
ggcagtttctagacagtagcctact

SEQ ID NO: 612395 - DNA, 25 bp, Mus musculus
ggcagtttctagtcagtagcctact

SEQ ID NO: 612396 - DNA, 25 bp, Mus musculus
ggcagtttctggaactcctatgcaa

SEQ ID NO: 612397 - DNA, 25 bp, Mus musculus
ggcagtttctggacggttttctaag

SEQ ID NO: 612398 - DNA, 25 bp, Mus musculus
ggcagtttctggtactcctatgcaa

SEQ ID NO: 612399 - DNA, 25 bp, Mus musculus
ggcagtttctggtcggttttctaag

SEQ ID NO: 612400 - DNA, 25 bp, Mus musculus
ggcagtttgaccaggcctggcagta

SEQ ID NO: 612401 - DNA, 25 bp, Mus musculus
ggcagtttgacccttgctgcaagta

SEQ ID NO: 612402 - DNA, 25 bp, Mus musculus
ggcagtttgaccgttgctgcaagta

SEQ ID NO: 612403 - DNA, 25 bp, Mus musculus
ggcagtttgacctggcctggcagta

SEQ ID NO: 612404 - DNA, 25 bp, Mus musculus
ggcagtttgactaaggctaacccaa

SEQ ID NO: 612405 - DNA, 25 bp, Mus musculus
ggcagtttgactatttatcaagcag

SEQ ID NO: 612406 - DNA, 25 bp, Mus musculus
ggcagtttgacttaggctaacccaa

SEQ ID NO: 612407 - DNA, 25 bp, Mus musculus
ggcagtttgactttttatcaagcag

SEQ ID NO: 612408 - DNA, 25 bp, Mus musculus
ggcagtttgcttccctgatactata

SEQ ID NO: 612409 - DNA, 25 bp, Mus musculus
ggcagtttgcttgcctgatactata

SEQ ID NO: 612410 - DNA, 25 bp, Mus musculus
ggcagtttggtacatggacgcatta

SEQ ID NO: 612411 - DNA, 25 bp, Mus musculus
ggcagtttggtagatggacgcatta

SEQ ID NO: 612412 - DNA, 25 bp, Mus musculus
ggcagtttgtccacactccaaagcc

SEQ ID NO: 612413 - DNA, 25 bp, Mus musculus
ggcagtttgtcctcactccaaagcc

SEQ ID NO: 612414 - DNA, 25 bp, Mus musculus
ggcagtttgttgactgagtttttca

SEQ ID NO: 612415 - DNA, 25 bp, Mus musculus
ggcagtttgttgtctgagtttttca

SEQ ID NO: 612416 - DNA, 25 bp, Mus musculus
ggcagttttactacataacggaatt

SEQ ID NO: 612417 - DNA, 25 bp, Mus musculus
ggcagttttacttcataacggaatt

SEQ ID NO: 612418 - DNA, 25 bp, Mus musculus
ggcagttttaggaaagcataatggt

SEQ ID NO: 612419 - DNA, 25 bp, Mus musculus
ggcagttttaggtaagcataatggt

SEQ ID NO: 612420 - DNA, 25 bp, Mus musculus
ggcagttttctgacaagcgcagatt

SEQ ID NO: 612421 - DNA, 25 bp, Mus musculus
ggcagttttctgtcaagcgcagatt

SEQ ID NO: 612422 - DNA, 25 bp, Mus musculus
ggcagttttggcaaagtctgtttta

SEQ ID NO: 612423 - DNA, 25 bp, Mus musculus
ggcagttttggcagtggtacctaac

SEQ ID NO: 612424 - DNA, 25 bp, Mus musculus
ggcagttttggctaagtctgtttta

SEQ ID NO: 612425 - DNA, 25 bp, Mus musculus
ggcagttttggctgtggtacctaac

SEQ ID NO: 612426 - DNA, 25 bp, Mus musculus
ggcataaaaatcagaagcctttgtg

SEQ ID NO: 612427 - DNA, 25 bp, Mus musculus
ggcataaaaatctgaagcctttgtg

SEQ ID NO: 612428 - DNA, 25 bp, Mus musculus
ggcataaaatcacttcctctgttca

SEQ ID NO: 612429 - DNA, 25 bp, Mus musculus
ggcataaaatcagttcctctgttca

SEQ ID NO: 612430 - DNA, 25 bp, Mus musculus
ggcataaactcccttccagaatttg

SEQ ID NO: 612431 - DNA, 25 bp, Mus musculus
ggcataaactccgttccagaatttg

SEQ ID NO: 612432 - DNA, 25 bp, Mus musculus
ggcataaagtcgcttcttgctgcct

SEQ ID NO: 612433 - DNA, 25 bp, Mus musculus
ggcataaagtcggttcttgctgcct

SEQ ID NO: 612434 - DNA, 25 bp, Mus musculus
ggcataaatgctcttgtgtgcacaa

SEQ ID NO: 612435 - DNA, 25 bp, Mus musculus
ggcataaatgctgttgtgtgcacaa

SEQ ID NO: 612436 - DNA, 25 bp, Mus musculus
ggcataaatttgacctgcacgtcta

SEQ ID NO: 612437 - DNA, 25 bp, Mus musculus
ggcataaatttgtcctgcacgtcta

SEQ ID NO: 612438 - DNA, 25 bp, Mus musculus
ggcataacacttccagaggctttcc

SEQ ID NO: 612439 - DNA, 25 bp, Mus musculus
ggcataacacttgcagaggctttcc

SEQ ID NO: 612440 - DNA, 25 bp, Mus musculus
ggcataacatccagctgtgtagcct

SEQ ID NO: 612441 - DNA, 25 bp, Mus musculus
ggcataacatcctgctgtgtagcct

SEQ ID NO: 612442 - DNA, 25 bp, Mus musculus
ggcataaccaaaagaaagtcgtcga

SEQ ID NO: 612443 - DNA, 25 bp, Mus musculus
ggcataaccaaatgaaagtcgtcga

SEQ ID NO: 612444 - DNA, 25 bp, Mus musculus
ggcataacccacataggtgccacct

SEQ ID NO: 612445 - DNA, 25 bp, Mus musculus
ggcataacccacttaggtgccacct

SEQ ID NO: 612446 - DNA, 25 bp, Mus musculus
ggcataacctggaagatttccacta

SEQ ID NO: 612447 - DNA, 25 bp, Mus musculus
ggcataacctggtagatttccacta

SEQ ID NO: 612448 - DNA, 25 bp, Mus musculus
ggcataagaggtatcttcaactcat

SEQ ID NO: 612449 - DNA, 25 bp, Mus musculus
ggcataagaggtttcttcaactcat

SEQ ID NO: 612450 - DNA, 25 bp, Mus musculus
ggcataagctccagtgaatacacct

SEQ ID NO: 612451 - DNA, 25 bp, Mus musculus
ggcataagctcctgtgaatacacct

SEQ ID NO: 612452 - DNA, 25 bp, Mus musculus
ggcataaggctgccctgttcagcat

SEQ ID NO: 612453 - DNA, 25 bp, Mus musculus
ggcataaggctggcctgttcagcat

SEQ ID NO: 612454 - DNA, 25 bp, Mus musculus
ggcataagtgaaccaccacagttat

SEQ ID NO: 612455 - DNA, 25 bp, Mus musculus
ggcataagtgaagcaccacagttat

SEQ ID NO: 612456 - DNA, 25 bp, Mus musculus
ggcataatacatatcgcctgtgtta

SEQ ID NO: 612457 - DNA, 25 bp, Mus musculus
ggcataatacatttcgcctgtgtta

SEQ ID NO: 612458 - DNA, 25 bp, Mus musculus
ggcataatactgaaattctgggctt

SEQ ID NO: 612459 - DNA, 25 bp, Mus musculus
ggcataatactgtaattctgggctt

SEQ ID NO: 612460 - DNA, 25 bp, Mus musculus
ggcataatctctcacttgtttgaag

SEQ ID NO: 612461 - DNA, 25 bp, Mus musculus
ggcataatctctgacttgtttgaag

SEQ ID NO: 612462 - DNA, 25 bp, Mus musculus
ggcataatcttcatgaccgtggctt

SEQ ID NO: 612463 - DNA, 25 bp, Mus musculus
ggcataatcttcttgaccgtggctt

SEQ ID NO: 612464 - DNA, 25 bp, Mus musculus
ggcataatgccaatgaatttctcca

SEQ ID NO: 612465 - DNA, 25 bp, Mus musculus
ggcataatgccattgaatttctcca

SEQ ID NO: 612466 - DNA, 25 bp, Mus musculus
ggcataatgcctatataagagtaac

SEQ ID NO: 612467 - DNA, 25 bp, Mus musculus
ggcataatgcctttataagagtaac

SEQ ID NO: 612468 - DNA, 25 bp, Mus musculus
ggcataattgcactgaatagctcat

SEQ ID NO: 612469 - DNA, 25 bp, Mus musculus
ggcataattgcagtgaatagctcat

SEQ ID NO: 612470 - DNA, 25 bp, Mus musculus
ggcatacaaagcctcgggactgtaa

SEQ ID NO: 612471 - DNA, 25 bp, Mus musculus
ggcatacaaagcgtcgggactgtaa

SEQ ID NO: 612472 - DNA, 25 bp, Mus musculus
ggcatacaaatcattcagcactgtc

SEQ ID NO: 612473 - DNA, 25 bp, Mus musculus
ggcatacaaatctttcagcactgtc

SEQ ID NO: 612474 - DNA, 25 bp, Mus musculus
ggcatacacagtcccaaagaagacg

SEQ ID NO: 612475 - DNA, 25 bp, Mus musculus
ggcatacacagtgccaaagaagacg

SEQ ID NO: 612476 - DNA, 25 bp, Mus musculus
ggcatacaccaaaatctttcaagta

SEQ ID NO: 612477 - DNA, 25 bp, Mus musculus
ggcatacaccaatatctttcaagta

SEQ ID NO: 612478 - DNA, 25 bp, Mus musculus
ggcatacagtgtatcccaagcctga

SEQ ID NO: 612479 - DNA, 25 bp, Mus musculus
ggcatacagtgtttcccaagcctga

SEQ ID NO: 612480 - DNA, 25 bp, Mus musculus
ggcatacatacaaccacctagaaag

SEQ ID NO: 612481 - DNA, 25 bp, Mus musculus
ggcatacatacatccacctagaaag

SEQ ID NO: 612482 - DNA, 25 bp, Mus musculus
ggcatacatactactaatcccaacc

SEQ ID NO: 612483 - DNA, 25 bp, Mus musculus
ggcatacatacttctaatcccaacc

SEQ ID NO: 612484 - DNA, 25 bp, Mus musculus
ggcatacatttcacactcaagtctt

SEQ ID NO: 612485 - DNA, 25 bp, Mus musculus
ggcatacatttctcactcaagtctt

SEQ ID NO: 612486 - DNA, 25 bp, Mus musculus
ggcataccactcactgtgatctctt

SEQ ID NO: 612487 - DNA, 25 bp, Mus musculus
ggcataccactctctgtgatctctt

SEQ ID NO: 612488 - DNA, 25 bp, Mus musculus
ggcataccagtaccttcccaaatga

SEQ ID NO: 612489 - DNA, 25 bp, Mus musculus
ggcataccagtagcttcccaaatga

SEQ ID NO: 612490 - DNA, 25 bp, Mus musculus
ggcatacccaatcttgccgttttgt

SEQ ID NO: 612491 - DNA, 25 bp, Mus musculus
ggcatacccaatgttgccgttttgt

SEQ ID NO: 612492 - DNA, 25 bp, Mus musculus
ggcatacctaacctcaatactcaag

SEQ ID NO: 612493 - DNA, 25 bp, Mus musculus
ggcatacctaacgtcaatactcaag

SEQ ID NO: 612494 - DNA, 25 bp, Mus musculus
ggcatacctatcattgaactattgg

SEQ ID NO: 612495 - DNA, 25 bp, Mus musculus
ggcatacctatctttgaactattgg

SEQ ID NO: 612496 - DNA, 25 bp, Mus musculus
ggcataccttacctttataagacgg

SEQ ID NO: 612497 - DNA, 25 bp, Mus musculus
ggcataccttacgtttataagacgg

SEQ ID NO: 612498 - DNA, 25 bp, Mus musculus
ggcatacctttgcagagcaccgagt

SEQ ID NO: 612499 - DNA, 25 bp, Mus musculus
ggcatacctttggagagcaccgagt

SEQ ID NO: 612500 - DNA, 25 bp, Mus musculus
ggcatacggcgccaagcgctacagt

SEQ ID NO: 612501 - DNA, 25 bp, Mus musculus
ggcatacggcgcgaagcgctacagt

SEQ ID NO: 612502 - DNA, 25 bp, Mus musculus
ggcatacggtatcattccagatttg

SEQ ID NO: 612503 - DNA, 25 bp, Mus musculus
ggcatacggtatgattccagatttg

SEQ ID NO: 612504 - DNA, 25 bp, Mus musculus
ggcatactctcacgcagtcatatga

SEQ ID NO: 612505 - DNA, 25 bp, Mus musculus
ggcatactctcaggcagtcatatga

SEQ ID NO: 612506 - DNA, 25 bp, Mus musculus
ggcatactctgaattcaattcccgt

SEQ ID NO: 612507 - DNA, 25 bp, Mus musculus
ggcatactctgatttcaattcccgt

SEQ ID NO: 612508 - DNA, 25 bp, Mus musculus
ggcatagaaacccaatgtgaccatt

SEQ ID NO: 612509 - DNA, 25 bp, Mus musculus
ggcatagaaaccgaatgtgaccatt

SEQ ID NO: 612510 - DNA, 25 bp, Mus musculus
ggcatagaacatagcattcctcctg

SEQ ID NO: 612511 - DNA, 25 bp, Mus musculus
ggcatagaacattgcattcctcctg

SEQ ID NO: 612512 - DNA, 25 bp, Mus musculus
ggcatagaacggatgattcgtcttt

SEQ ID NO: 612513 - DNA, 25 bp, Mus musculus
ggcatagaacggttgattcgtcttt

SEQ ID NO: 612514 - DNA, 25 bp, Mus musculus
ggcatagaatatacccaaaaccaag

SEQ ID NO: 612515 - DNA, 25 bp, Mus musculus
ggcatagaatattcccaaaaccaag

SEQ ID NO: 612516 - DNA, 25 bp, Mus musculus
ggcatagagaccagaatcactgtag

SEQ ID NO: 612517 - DNA, 25 bp, Mus musculus
ggcatagagacctgaatcactgtag

SEQ ID NO: 612518 - DNA, 25 bp, Mus musculus
ggcatagataacaaaccataccctc

SEQ ID NO: 612519 - DNA, 25 bp, Mus musculus
ggcatagataactaaccataccctc

SEQ ID NO: 612520 - DNA, 25 bp, Mus musculus
ggcatagatccacattttcccaata

SEQ ID NO: 612521 - DNA, 25 bp, Mus musculus
ggcatagatccagattttcccaata

SEQ ID NO: 612522 - DNA, 25 bp, Mus musculus
ggcatagatccccttgagcagagaa

SEQ ID NO: 612523 - DNA, 25 bp, Mus musculus
ggcatagatcccgttgagcagagaa

SEQ ID NO: 612524 - DNA, 25 bp, Mus musculus
ggcatagatgtcagagcctgcactg

SEQ ID NO: 612525 - DNA, 25 bp, Mus musculus
ggcatagatgtctgagcctgcactg

SEQ ID NO: 612526 - DNA, 25 bp, Mus musculus
ggcatagattcaactgagctcccta

SEQ ID NO: 612527 - DNA, 25 bp, Mus musculus
ggcatagattcatctgagctcccta

SEQ ID NO: 612528 - DNA, 25 bp, Mus musculus
ggcatagcaagcacactgttctcag

SEQ ID NO: 612529 - DNA, 25 bp, Mus musculus
ggcatagcaagctcactgttctcag

SEQ ID NO: 612530 - DNA, 25 bp, Mus musculus
ggcatagcatgaatggacgtccatc

SEQ ID NO: 612531 - DNA, 25 bp, Mus musculus
ggcatagcatgattggacgtccatc

SEQ ID NO: 612532 - DNA, 25 bp, Mus musculus
ggcatagcattcagctgacattctt

SEQ ID NO: 612533 - DNA, 25 bp, Mus musculus
ggcatagcattctgctgacattctt

SEQ ID NO: 612534 - DNA, 25 bp, Mus musculus
ggcatagcatttcgccctgagccat

SEQ ID NO: 612535 - DNA, 25 bp, Mus musculus
ggcatagcatttggccctgagccat

SEQ ID NO: 612536 - DNA, 25 bp, Mus musculus
ggcatagcctgacttcacaatctgt

SEQ ID NO: 612537 - DNA, 25 bp, Mus musculus
ggcatagcctgagttcacaatctgt

SEQ ID NO: 612538 - DNA, 25 bp, Mus musculus
ggcatagctgttatccagtacacat

SEQ ID NO: 612539 - DNA, 25 bp, Mus musculus
ggcatagctgttttccagtacacat

SEQ ID NO: 612540 - DNA, 25 bp, Mus musculus
ggcataggctcaagcccctcagaat

SEQ ID NO: 612541 - DNA, 25 bp, Mus musculus
ggcataggctcaagctggccacaat

SEQ ID NO: 612542 - DNA, 25 bp, Mus musculus
ggcataggctcatgcccctcagaat

SEQ ID NO: 612543 - DNA, 25 bp, Mus musculus
ggcataggctcatgctggccacaat

SEQ ID NO: 612544 - DNA, 25 bp, Mus musculus
ggcataggctctacatggtcattaa

SEQ ID NO: 612545 - DNA, 25 bp, Mus musculus
ggcataggctcttcatggtcattaa

SEQ ID NO: 612546 - DNA, 25 bp, Mus musculus
ggcatagggtcaatggagattcttc

SEQ ID NO: 612547 - DNA, 25 bp, Mus musculus
ggcatagggtcattggagattcttc

SEQ ID NO: 612548 - DNA, 25 bp, Mus musculus
ggcatagggttccacaatttgttca

SEQ ID NO: 612549 - DNA, 25 bp, Mus musculus
ggcatagggttcgacaatttgttca

SEQ ID NO: 612550 - DNA, 25 bp, Mus musculus
ggcataggtcgtctctaacagtaga

SEQ ID NO: 612551 - DNA, 25 bp, Mus musculus
ggcataggtcgtgtctaacagtaga

SEQ ID NO: 612552 - DNA, 25 bp, Mus musculus
ggcatagtacttcctgcacattttt

SEQ ID NO: 612553 - DNA, 25 bp, Mus musculus
ggcatagtacttgctgcacattttt

SEQ ID NO: 612554 - DNA, 25 bp, Mus musculus
ggcatagtggccatgtcctgtaatg

SEQ ID NO: 612555 - DNA, 25 bp, Mus musculus
ggcatagtggccttgtcctgtaatg

SEQ ID NO: 612556 - DNA, 25 bp, Mus musculus
ggcatagttgtccatgataacagtt

SEQ ID NO: 612557 - DNA, 25 bp, Mus musculus
ggcatagttgtcgatgataacagtt

SEQ ID NO: 612558 - DNA, 25 bp, Mus musculus
ggcatagttttcattataccttctg

SEQ ID NO: 612559 - DNA, 25 bp, Mus musculus
ggcatagttttctttataccttctg

SEQ ID NO: 612560 - DNA, 25 bp, Mus musculus
ggcatataacagaaactaccagcag

SEQ ID NO: 612561 - DNA, 25 bp, Mus musculus
ggcatataacagtaactaccagcag

SEQ ID NO: 612562 - DNA, 25 bp, Mus musculus
ggcatataaggtaccttctatgtct

SEQ ID NO: 612563 - DNA, 25 bp, Mus musculus
ggcatataaggttccttctatgtct

SEQ ID NO: 612564 - DNA, 25 bp, Mus musculus
ggcatatacgtcccagaagaaccct

SEQ ID NO: 612565 - DNA, 25 bp, Mus musculus
ggcatatacgtcgcagaagaaccct

SEQ ID NO: 612566 - DNA, 25 bp, Mus musculus
ggcatatacttaacaggactgctat

SEQ ID NO: 612567 - DNA, 25 bp, Mus musculus
ggcatatacttatcaggactgctat

SEQ ID NO: 612568 - DNA, 25 bp, Mus musculus
ggcatatagaatctcccatgtccct

SEQ ID NO: 612569 - DNA, 25 bp, Mus musculus
ggcatatagaatgtcccatgtccct

SEQ ID NO: 612570 - DNA, 25 bp, Mus musculus
ggcatatagcagcagttacttaaga

SEQ ID NO: 612571 - DNA, 25 bp, Mus musculus
ggcatatagcaggagttacttaaga

SEQ ID NO: 612572 - DNA, 25 bp, Mus musculus
ggcatatagcatatgacttagacat

SEQ ID NO: 612573 - DNA, 25 bp, Mus musculus
ggcatatagcatttgacttagacat

SEQ ID NO: 612574 - DNA, 25 bp, Mus musculus
ggcatatagcttataatcttcagaa

SEQ ID NO: 612575 - DNA, 25 bp, Mus musculus
ggcatatagcttttaatcttcagaa

SEQ ID NO: 612576 - DNA, 25 bp, Mus musculus
ggcatatagttacccatgatagcag

SEQ ID NO: 612577 - DNA, 25 bp, Mus musculus
ggcatatagttagccatgatagcag

SEQ ID NO: 612578 - DNA, 25 bp, Mus musculus
ggcatatatatgatctgaagcaaac

SEQ ID NO: 612579 - DNA, 25 bp, Mus musculus
ggcatatatatgttctgaagcaaac

SEQ ID NO: 612580 - DNA, 25 bp, Mus musculus
ggcatatatcagacactcagtaatt

SEQ ID NO: 612581 - DNA, 25 bp, Mus musculus
ggcatatatcagtcactcagtaatt

SEQ ID NO: 612582 - DNA, 25 bp, Mus musculus
ggcatatatcttcacatctgatctt

SEQ ID NO: 612583 - DNA, 25 bp, Mus musculus
ggcatatatcttgacatctgatctt

SEQ ID NO: 612584 - DNA, 25 bp, Mus musculus
ggcatatcccacaatactgtacatt

SEQ ID NO: 612585 - DNA, 25 bp, Mus musculus
ggcatatcccactatactgtacatt

SEQ ID NO: 612586 - DNA, 25 bp, Mus musculus
ggcatatctgaaagtatggcttcta

SEQ ID NO: 612587 - DNA, 25 bp, Mus musculus
ggcatatctgaatgtatggcttcta

SEQ ID NO: 612588 - DNA, 25 bp, Mus musculus
ggcatatctgccattattgtgtttg

SEQ ID NO: 612589 - DNA, 25 bp, Mus musculus
ggcatatctgcctttattgtgtttg

SEQ ID NO: 612590 - DNA, 25 bp, Mus musculus
ggcatatcttgaactcaggtgcaga

SEQ ID NO: 612591 - DNA, 25 bp, Mus musculus
ggcatatcttgatctcaggtgcaga

SEQ ID NO: 612592 - DNA, 25 bp, Mus musculus
ggcatatctttgcatctgctctgat

SEQ ID NO: 612593 - DNA, 25 bp, Mus musculus
ggcatatctttggatctgctctgat

SEQ ID NO: 612594 - DNA, 25 bp, Mus musculus
ggcatatgacccattattttatata

SEQ ID NO: 612595 - DNA, 25 bp, Mus musculus
ggcatatgaccctttattttatata

SEQ ID NO: 612596 - DNA, 25 bp, Mus musculus
ggcatatgaccgatgtgtgtgttct

SEQ ID NO: 612597 - DNA, 25 bp, Mus musculus
ggcatatgaccgttgtgtgtgttct

SEQ ID NO: 612598 - DNA, 25 bp, Mus musculus
ggcatatgcacgatgaaatgagata

SEQ ID NO: 612599 - DNA, 25 bp, Mus musculus
ggcatatgcacgttgaaatgagata

SEQ ID NO: 612600 - DNA, 25 bp, Mus musculus
ggcatatgcatgaatcatcacaggt

SEQ ID NO: 612601 - DNA, 25 bp, Mus musculus
ggcatatgcatgtatcatcacaggt

SEQ ID NO: 612602 - DNA, 25 bp, Mus musculus
ggcatatgccaacgccctggagatt

SEQ ID NO: 612603 - DNA, 25 bp, Mus musculus
ggcatatgccaaggccctggagatt

SEQ ID NO: 612604 - DNA, 25 bp, Mus musculus
ggcatatgcctgaatcctagtactc

SEQ ID NO: 612605 - DNA, 25 bp, Mus musculus
ggcatatgcctgtatcctagtactc

SEQ ID NO: 612606 - DNA, 25 bp, Mus musculus
ggcatatgcgagcaaagcattctca

SEQ ID NO: 612607 - DNA, 25 bp, Mus musculus
ggcatatgcgaggaaagcattctca

SEQ ID NO: 612608 - DNA, 25 bp, Mus musculus
ggcatatgctatatgcctagcactt

SEQ ID NO: 612609 - DNA, 25 bp, Mus musculus
ggcatatgctatttgcctagcactt

SEQ ID NO: 612610 - DNA, 25 bp, Mus musculus
ggcatatggtgtccccagaaacgtc

SEQ ID NO: 612611 - DNA, 25 bp, Mus musculus
ggcatatggtgtgcccagaaacgtc

SEQ ID NO: 612612 - DNA, 25 bp, Mus musculus
ggcatatgtgcaaataaaacgttct

SEQ ID NO: 612613 - DNA, 25 bp, Mus musculus
ggcatatgtgcatataaaacgttct

SEQ ID NO: 612614 - DNA, 25 bp, Mus musculus
ggcatatgttgcctcccacagaata

SEQ ID NO: 612615 - DNA, 25 bp, Mus musculus
ggcatatgttgcgtcccacagaata

SEQ ID NO: 612616 - DNA, 25 bp, Mus musculus
ggcatatgttttccttataacctat

SEQ ID NO: 612617 - DNA, 25 bp, Mus musculus
ggcatatgttttgcttataacctat

SEQ ID NO: 612618 - DNA, 25 bp, Mus musculus
ggcatattagttaagtctccagtgg

SEQ ID NO: 612619 - DNA, 25 bp, Mus musculus
ggcatattagtttagtctccagtgg

SEQ ID NO: 612620 - DNA, 25 bp, Mus musculus
ggcatattcagcattgccaggtatg

SEQ ID NO: 612621 - DNA, 25 bp, Mus musculus
ggcatattcagctttgccaggtatg

SEQ ID NO: 612622 - DNA, 25 bp, Mus musculus
ggcatattctatatttctgtttgga

SEQ ID NO: 612623 - DNA, 25 bp, Mus musculus
ggcatattctatttttctgtttgga

SEQ ID NO: 612624 - DNA, 25 bp, Mus musculus
ggcatattgagtacagtccttgaga

SEQ ID NO: 612625 - DNA, 25 bp, Mus musculus
ggcatattgagttcagtccttgaga

SEQ ID NO: 612626 - DNA, 25 bp, Mus musculus
ggcatattgtgaagggccccggcct

SEQ ID NO: 612627 - DNA, 25 bp, Mus musculus
ggcatattgtgatgggccccggcct

SEQ ID NO: 612628 - DNA, 25 bp, Mus musculus
ggcatatttaatccattccctggca

SEQ ID NO: 612629 - DNA, 25 bp, Mus musculus
ggcatatttaatgcattccctggca

SEQ ID NO: 612630 - DNA, 25 bp, Mus musculus
ggcatatttagcatttatacggagt

SEQ ID NO: 612631 - DNA, 25 bp, Mus musculus
ggcatatttagcttttatacggagt

SEQ ID NO: 612632 - DNA, 25 bp, Mus musculus
ggcatatttaggacagcctagcaca

SEQ ID NO: 612633 - DNA, 25 bp, Mus musculus
ggcatatttaggtcagcctagcaca

SEQ ID NO: 612634 - DNA, 25 bp, Mus musculus
ggcatatttctcaatgtttacagca

SEQ ID NO: 612635 - DNA, 25 bp, Mus musculus
ggcatatttctctatgtttacagca

SEQ ID NO: 612636 - DNA, 25 bp, Mus musculus
ggcatattttagcaggtatcaatgt

SEQ ID NO: 612637 - DNA, 25 bp, Mus musculus
ggcatattttaggaggtatcaatgt

SEQ ID NO: 612638 - DNA, 25 bp, Mus musculus
ggcatattttcaacactggcagaga

SEQ ID NO: 612639 - DNA, 25 bp, Mus musculus
ggcatattttcatcactggcagaga

SEQ ID NO: 612640 - DNA, 25 bp, Mus musculus
ggcatattttggatcttcatgcttt

SEQ ID NO: 612641 - DNA, 25 bp, Mus musculus
ggcatattttggttcttcatgcttt

SEQ ID NO: 612642 - DNA, 25 bp, Mus musculus
ggcatcaaacttaaggtaactttag

SEQ ID NO: 612643 - DNA, 25 bp, Mus musculus
ggcatcaaactttaggtaactttag

SEQ ID NO: 612644 - DNA, 25 bp, Mus musculus
ggcatcaaatgaaaggcaccggaat

SEQ ID NO: 612645 - DNA, 25 bp, Mus musculus
ggcatcaaatgataggcaccggaat

SEQ ID NO: 612646 - DNA, 25 bp, Mus musculus
ggcatcaacagcactttttcatatt

SEQ ID NO: 612647 - DNA, 25 bp, Mus musculus
ggcatcaacagctctttttcatatt

SEQ ID NO: 612648 - DNA, 25 bp, Mus musculus
ggcatcaacattactggaaacttct

SEQ ID NO: 612649 - DNA, 25 bp, Mus musculus
ggcatcaacatttctggaaacttct

SEQ ID NO: 612650 - DNA, 25 bp, Mus musculus
ggcatcaaccagaagggatcaagat

SEQ ID NO: 612651 - DNA, 25 bp, Mus musculus
ggcatcaaccagtagggatcaagat

SEQ ID NO: 612652 - DNA, 25 bp, Mus musculus
ggcatcaactgtaccaactagtaga

SEQ ID NO: 612653 - DNA, 25 bp, Mus musculus
ggcatcaactgttccaactagtaga

SEQ ID NO: 612654 - DNA, 25 bp, Mus musculus
ggcatcaactttcctaaggttctgt

SEQ ID NO: 612655 - DNA, 25 bp, Mus musculus
ggcatcaactttgctaaggttctgt

SEQ ID NO: 612656 - DNA, 25 bp, Mus musculus
ggcatcaagcatccacatggtgtac

SEQ ID NO: 612657 - DNA, 25 bp, Mus musculus
ggcatcaagcatgcacatggtgtac

SEQ ID NO: 612658 - DNA, 25 bp, Mus musculus
ggcatcaaggtcagaggctctcaac

SEQ ID NO: 612659 - DNA, 25 bp, Mus musculus
ggcatcaaggtctgaggctctcaac

SEQ ID NO: 612660 - DNA, 25 bp, Mus musculus
ggcatcaatgtaactatttccatgt

SEQ ID NO: 612661 - DNA, 25 bp, Mus musculus
ggcatcaatgtatctatttccatgt

SEQ ID NO: 612662 - DNA, 25 bp, Mus musculus
ggcatcaatgttctcagcggtcccg

SEQ ID NO: 612663 - DNA, 25 bp, Mus musculus
ggcatcaatgttgtcagcggtcccg

SEQ ID NO: 612664 - DNA, 25 bp, Mus musculus
ggcatcaattccagatacccacggg

SEQ ID NO: 612665 - DNA, 25 bp, Mus musculus
ggcatcaattcctgatacccacggg

SEQ ID NO: 612666 - DNA, 25 bp, Mus musculus
ggcatcacacacatcattgcgaggt

SEQ ID NO: 612667 - DNA, 25 bp, Mus musculus
ggcatcacacacttcattgcgaggt

SEQ ID NO: 612668 - DNA, 25 bp, Mus musculus
ggcatcaccactcatcttactatga

SEQ ID NO: 612669 - DNA, 25 bp, Mus musculus
ggcatcaccactgatcttactatga

SEQ ID NO: 612670 - DNA, 25 bp, Mus musculus
ggcatcaccagtcgaacggttcggg

SEQ ID NO: 612671 - DNA, 25 bp, Mus musculus
ggcatcaccagtggaacggttcggg

SEQ ID NO: 612672 - DNA, 25 bp, Mus musculus
ggcatcaccctgagcttggttttga

SEQ ID NO: 612673 - DNA, 25 bp, Mus musculus
ggcatcaccctgtgcttggttttga

SEQ ID NO: 612674 - DNA, 25 bp, Mus musculus
ggcatcacgggaaatcagagaacat

SEQ ID NO: 612675 - DNA, 25 bp, Mus musculus
ggcatcacgggatatcagagaacat

SEQ ID NO: 612676 - DNA, 25 bp, Mus musculus
ggcatcactaccaagcatatttaag

SEQ ID NO: 612677 - DNA, 25 bp, Mus musculus
ggcatcactacctagcatatttaag

SEQ ID NO: 612678 - DNA, 25 bp, Mus musculus
ggcatcactccaacttgttttgaag

SEQ ID NO: 612679 - DNA, 25 bp, Mus musculus
ggcatcactccacacttaatttagt

SEQ ID NO: 612680 - DNA, 25 bp, Mus musculus
ggcatcactccagacttaatttagt

SEQ ID NO: 612681 - DNA, 25 bp, Mus musculus
ggcatcactccatcttgttttgaag

SEQ ID NO: 612682 - DNA, 25 bp, Mus musculus
ggcatcactcctagacattagtcag

SEQ ID NO: 612683 - DNA, 25 bp, Mus musculus
ggcatcactccttgacattagtcag

SEQ ID NO: 612684 - DNA, 25 bp, Mus musculus
ggcatcagaagccaatcccgagggc

SEQ ID NO: 612685 - DNA, 25 bp, Mus musculus
ggcatcagaagcgaatcccgagggc

SEQ ID NO: 612686 - DNA, 25 bp, Mus musculus
ggcatcagaagtacttggcatctta

SEQ ID NO: 612687 - DNA, 25 bp, Mus musculus
ggcatcagaagttcttggcatctta

SEQ ID NO: 612688 - DNA, 25 bp, Mus musculus
ggcatcagacatccatctggacatt

SEQ ID NO: 612689 - DNA, 25 bp, Mus musculus
ggcatcagacatgcatctggacatt

SEQ ID NO: 612690 - DNA, 25 bp, Mus musculus
ggcatcagcactaaaggtcacgcta

SEQ ID NO: 612691 - DNA, 25 bp, Mus musculus
ggcatcagcacttaaggtcacgcta

SEQ ID NO: 612692 - DNA, 25 bp, Mus musculus
ggcatcagctgactatctttcctac

SEQ ID NO: 612693 - DNA, 25 bp, Mus musculus
ggcatcagctgagtatctttcctac

SEQ ID NO: 612694 - DNA, 25 bp, Mus musculus
ggcatcagctttaactggtccttgg

SEQ ID NO: 612695 - DNA, 25 bp, Mus musculus
ggcatcagcttttactggtccttgg

SEQ ID NO: 612696 - DNA, 25 bp, Mus musculus
ggcatcaggcacctttgtgacacaa

SEQ ID NO: 612697 - DNA, 25 bp, Mus musculus
ggcatcaggcacgtttgtgacacaa

SEQ ID NO: 612698 - DNA, 25 bp, Mus musculus
ggcatcaggcatacgtgcgacacat

SEQ ID NO: 612699 - DNA, 25 bp, Mus musculus
ggcatcaggcattcgtgcgacacat

SEQ ID NO: 612700 - DNA, 25 bp, Mus musculus
ggcatcaggcccaggatagacagct

SEQ ID NO: 612701 - DNA, 25 bp, Mus musculus
ggcatcaggccctggatagacagct

SEQ ID NO: 612702 - DNA, 25 bp, Mus musculus
ggcatcagggccagaggccgccttc

SEQ ID NO: 612703 - DNA, 25 bp, Mus musculus
ggcatcagggcctgaggccgccttc

SEQ ID NO: 612704 - DNA, 25 bp, Mus musculus
ggcatcaggttaagcagtgcactca

SEQ ID NO: 612705 - DNA, 25 bp, Mus musculus
ggcatcaggttatgcagtgcactca

SEQ ID NO: 612706 - DNA, 25 bp, Mus musculus
ggcatcagtatcacagatctttcca

SEQ ID NO: 612707 - DNA, 25 bp, Mus musculus
ggcatcagtatctcagatctttcca

SEQ ID NO: 612708 - DNA, 25 bp, Mus musculus
ggcatcagtgataatgaggacaaat

SEQ ID NO: 612709 - DNA, 25 bp, Mus musculus
ggcatcagtgattatgaggacaaat

SEQ ID NO: 612710 - DNA, 25 bp, Mus musculus
ggcatcagtgccaggagtcaaatag

SEQ ID NO: 612711 - DNA, 25 bp, Mus musculus
ggcatcagtgcctggagtcaaatag

SEQ ID NO: 612712 - DNA, 25 bp, Mus musculus
ggcatcagttttccctcaagatgaa

SEQ ID NO: 612713 - DNA, 25 bp, Mus musculus
ggcatcagttttgcctcaagatgaa

SEQ ID NO: 612714 - DNA, 25 bp, Mus musculus
ggcatcatactgacccatctctaca

SEQ ID NO: 612715 - DNA, 25 bp, Mus musculus
ggcatcatactgtcccatctctaca

SEQ ID NO: 612716 - DNA, 25 bp, Mus musculus
ggcatcatatgcatcttgtctttaa

SEQ ID NO: 612717 - DNA, 25 bp, Mus musculus
ggcatcatatgcttcttgtctttaa

SEQ ID NO: 612718 - DNA, 25 bp, Mus musculus
ggcatcatatgtccttatttcccac

SEQ ID NO: 612719 - DNA, 25 bp, Mus musculus
ggcatcatatgtgcttatttcccac

SEQ ID NO: 612720 - DNA, 25 bp, Mus musculus
ggcatcatctgacctgcatcagtga

SEQ ID NO: 612721 - DNA, 25 bp, Mus musculus
ggcatcatctgagctgcatcagtga

SEQ ID NO: 612722 - DNA, 25 bp, Mus musculus
ggcatcatctggaggcttcaaattt

SEQ ID NO: 612723 - DNA, 25 bp, Mus musculus
ggcatcatctggtggcttcaaattt

SEQ ID NO: 612724 - DNA, 25 bp, Mus musculus
ggcatcatcttactctgtcacaagg

SEQ ID NO: 612725 - DNA, 25 bp, Mus musculus
ggcatcatcttagtctgtcacaagg

SEQ ID NO: 612726 - DNA, 25 bp, Mus musculus
ggcatcatcttcaagttctgctggg

SEQ ID NO: 612727 - DNA, 25 bp, Mus musculus
ggcatcatcttctagttctgctggg

SEQ ID NO: 612728 - DNA, 25 bp, Mus musculus
ggcatcatgtctaagaaccccaaac

SEQ ID NO: 612729 - DNA, 25 bp, Mus musculus
ggcatcatgtcttagaaccccaaac

SEQ ID NO: 612730 - DNA, 25 bp, Mus musculus
ggcatcattcagattggcctttttt

SEQ ID NO: 612731 - DNA, 25 bp, Mus musculus
ggcatcattcagtttggcctttttt

SEQ ID NO: 612732 - DNA, 25 bp, Mus musculus
ggcatcattgccacagttgtgttac

SEQ ID NO: 612733 - DNA, 25 bp, Mus musculus
ggcatcattgccagcatcatcaaag

SEQ ID NO: 612734 - DNA, 25 bp, Mus musculus
ggcatcattgcctcagttgtgttac

SEQ ID NO: 612735 - DNA, 25 bp, Mus musculus
ggcatcattgcctgcatcatcaaag

SEQ ID NO: 612736 - DNA, 25 bp, Mus musculus
ggcatcatttgcaacacataattat

SEQ ID NO: 612737 - DNA, 25 bp, Mus musculus
ggcatcatttgctacacataattat

SEQ ID NO: 612738 - DNA, 25 bp, Mus musculus
ggcatccaaaccacttcctgatgac

SEQ ID NO: 612739 - DNA, 25 bp, Mus musculus
ggcatccaaacctcttcctgatgac

SEQ ID NO: 612740 - DNA, 25 bp, Mus musculus
ggcatccaaatacaagcagccagga

SEQ ID NO: 612741 - DNA, 25 bp, Mus musculus
ggcatccaaatagaagcagccagga

SEQ ID NO: 612742 - DNA, 25 bp, Mus musculus
ggcatccacagtacggcacaaaagt

SEQ ID NO: 612743 - DNA, 25 bp, Mus musculus
ggcatccacagttcggcacaaaagt

SEQ ID NO: 612744 - DNA, 25 bp, Mus musculus
ggcatccacctcaacagaatacagg

SEQ ID NO: 612745 - DNA, 25 bp, Mus musculus
ggcatccacctctacagaatacagg

SEQ ID NO: 612746 - DNA, 25 bp, Mus musculus
ggcatccactgtatatgcggtttgt

SEQ ID NO: 612747 - DNA, 25 bp, Mus musculus
ggcatccactgtttatgcggtttgt

SEQ ID NO: 612748 - DNA, 25 bp, Mus musculus
ggcatccagacccagttaagtttcg

SEQ ID NO: 612749 - DNA, 25 bp, Mus musculus
ggcatccagaccgagttaagtttcg

SEQ ID NO: 612750 - DNA, 25 bp, Mus musculus
ggcatccagatcctgtgtgagactt

SEQ ID NO: 612751 - DNA, 25 bp, Mus musculus
ggcatccagatcgtgtgtgagactt

SEQ ID NO: 612752 - DNA, 25 bp, Mus musculus
ggcatccagccacaggtccaaaaga

SEQ ID NO: 612753 - DNA, 25 bp, Mus musculus
ggcatccagccagaggtccaaaaga

SEQ ID NO: 612754 - DNA, 25 bp, Mus musculus
ggcatccaggctcagaatggcacta

SEQ ID NO: 612755 - DNA, 25 bp, Mus musculus
ggcatccaggctgagaatggcacta

SEQ ID NO: 612756 - DNA, 25 bp, Mus musculus
ggcatccagtatctccgagactacc

SEQ ID NO: 612757 - DNA, 25 bp, Mus musculus
ggcatccagtatgtccgagactacc

SEQ ID NO: 612758 - DNA, 25 bp, Mus musculus
ggcatccagtttcttgtccaatacc

SEQ ID NO: 612759 - DNA, 25 bp, Mus musculus
ggcatccagtttgttgtccaatacc

SEQ ID NO: 612760 - DNA, 25 bp, Mus musculus
ggcatccatacaaataaaggacatg

SEQ ID NO: 612761 - DNA, 25 bp, Mus musculus
ggcatccatacatataaaggacatg

SEQ ID NO: 612762 - DNA, 25 bp, Mus musculus
ggcatccatagaagaaaaaccagtt

SEQ ID NO: 612763 - DNA, 25 bp, Mus musculus
ggcatccatagatgaaaaaccagtt

SEQ ID NO: 612764 - DNA, 25 bp, Mus musculus
ggcatccattaaacgccagcgagga

SEQ ID NO: 612765 - DNA, 25 bp, Mus musculus
ggcatccattaatcgccagcgagga

SEQ ID NO: 612766 - DNA, 25 bp, Mus musculus
ggcatccattgtattactttctgta

SEQ ID NO: 612767 - DNA, 25 bp, Mus musculus
ggcatccattgttttactttctgta

SEQ ID NO: 612768 - DNA, 25 bp, Mus musculus
ggcatccatttaagaccagcatcca

SEQ ID NO: 612769 - DNA, 25 bp, Mus musculus
ggcatccatttatgaccagcatcca

SEQ ID NO: 612770 - DNA, 25 bp, Mus musculus
ggcatcccaacacagggtggcgtta

SEQ ID NO: 612771 - DNA, 25 bp, Mus musculus
ggcatcccaacagagggtggcgtta

SEQ ID NO: 612772 - DNA, 25 bp, Mus musculus
ggcatcccactactttaatcttgca

SEQ ID NO: 612773 - DNA, 25 bp, Mus musculus
ggcatcccactagtttaatcttgca

SEQ ID NO: 612774 - DNA, 25 bp, Mus musculus
ggcatcccagatagacatagaagtt

SEQ ID NO: 612775 - DNA, 25 bp, Mus musculus
ggcatcccagattgacatagaagtt

SEQ ID NO: 612776 - DNA, 25 bp, Mus musculus
ggcatcccagtaaaaacccctagag

SEQ ID NO: 612777 - DNA, 25 bp, Mus musculus
ggcatcccagtataaacccctagag

SEQ ID NO: 612778 - DNA, 25 bp, Mus musculus
ggcatcccagttcgtagctgcagaa

SEQ ID NO: 612779 - DNA, 25 bp, Mus musculus
ggcatcccagttggtagctgcagaa

SEQ ID NO: 612780 - DNA, 25 bp, Mus musculus
ggcatccccatgaccaacttaaaga

SEQ ID NO: 612781 - DNA, 25 bp, Mus musculus
ggcatccccatgagcaagactacaa

SEQ ID NO: 612782 - DNA, 25 bp, Mus musculus
ggcatccccatgtccaacttaaaga

SEQ ID NO: 612783 - DNA, 25 bp, Mus musculus
ggcatccccatgtgcaagactacaa

SEQ ID NO: 612784 - DNA, 25 bp, Mus musculus
ggcatccccattattgctaattcat

SEQ ID NO: 612785 - DNA, 25 bp, Mus musculus
ggcatccccatttttgctaattcat

SEQ ID NO: 612786 - DNA, 25 bp, Mus musculus
ggcatccccgaaaaaatacccaatt

SEQ ID NO: 612787 - DNA, 25 bp, Mus musculus
ggcatccccgaataaatacccaatt

SEQ ID NO: 612788 - DNA, 25 bp, Mus musculus
ggcatccccgacaacgatgaacaga

SEQ ID NO: 612789 - DNA, 25 bp, Mus musculus
ggcatccccgactacgatgaacaga

SEQ ID NO: 612790 - DNA, 25 bp, Mus musculus
ggcatcccctacattgaaacatcag

SEQ ID NO: 612791 - DNA, 25 bp, Mus musculus
ggcatcccctactttgaaacatcag

SEQ ID NO: 612792 - DNA, 25 bp, Mus musculus
ggcatcccctgcaaatatttattgg

SEQ ID NO: 612793 - DNA, 25 bp, Mus musculus
ggcatcccctgctaatatttattgg

SEQ ID NO: 612794 - DNA, 25 bp, Mus musculus
ggcatccctgacactgaatagctga

SEQ ID NO: 612795 - DNA, 25 bp, Mus musculus
ggcatccctgactctgaatagctga

SEQ ID NO: 612796 - DNA, 25 bp, Mus musculus
ggcatccctgccagtcgggagtgac

SEQ ID NO: 612797 - DNA, 25 bp, Mus musculus
ggcatccctgcctgtcgggagtgac

SEQ ID NO: 612798 - DNA, 25 bp, Mus musculus
ggcatccgtccaaatgtatttccta

SEQ ID NO: 612799 - DNA, 25 bp, Mus musculus
ggcatccgtccatatgtatttccta

SEQ ID NO: 612800 - DNA, 25 bp, Mus musculus
ggcatccgtggaacaagactaagca

SEQ ID NO: 612801 - DNA, 25 bp, Mus musculus
ggcatccgtggatcaagactaagca

SEQ ID NO: 612802 - DNA, 25 bp, Mus musculus
ggcatccgttgaacaaacgcatttc

SEQ ID NO: 612803 - DNA, 25 bp, Mus musculus
ggcatccgttgatcaaacgcatttc

SEQ ID NO: 612804 - DNA, 25 bp, Mus musculus
ggcatcctaaagagcaatgatcctg

SEQ ID NO: 612805 - DNA, 25 bp, Mus musculus
ggcatcctaaagtgcaatgatcctg

SEQ ID NO: 612806 - DNA, 25 bp, Mus musculus
ggcatcctaacacagcacgtgagca

SEQ ID NO: 612807 - DNA, 25 bp, Mus musculus
ggcatcctaacagagcacgtgagca

SEQ ID NO: 612808 - DNA, 25 bp, Mus musculus
ggcatcctaagaacttcacttcatt

SEQ ID NO: 612809 - DNA, 25 bp, Mus musculus
ggcatcctaagatcttcacttcatt

SEQ ID NO: 612810 - DNA, 25 bp, Mus musculus
ggcatcctaatgctgactccagagg

SEQ ID NO: 612811 - DNA, 25 bp, Mus musculus
ggcatcctaatggtgactccagagg

SEQ ID NO: 612812 - DNA, 25 bp, Mus musculus
ggcatcctaccgctacagtggagtc

SEQ ID NO: 612813 - DNA, 25 bp, Mus musculus
ggcatcctaccggtacagtggagtc

SEQ ID NO: 612814 - DNA, 25 bp, Mus musculus
ggcatcctacgaagcccatgtgtat

SEQ ID NO: 612815 - DNA, 25 bp, Mus musculus
ggcatcctacgatgcccatgtgtat

SEQ ID NO: 612816 - DNA, 25 bp, Mus musculus
ggcatcctattaaccctagtatata

SEQ ID NO: 612817 - DNA, 25 bp, Mus musculus
ggcatcctattatccctagtatata

SEQ ID NO: 612818 - DNA, 25 bp, Mus musculus
ggcatcctgaatctcagccaaacta

SEQ ID NO: 612819 - DNA, 25 bp, Mus musculus
ggcatcctgaatgtcagccaaacta

SEQ ID NO: 612820 - DNA, 25 bp, Mus musculus
ggcatcctgacaagaacctgagctc

SEQ ID NO: 612821 - DNA, 25 bp, Mus musculus
ggcatcctgacatgaacctgagctc

SEQ ID NO: 612822 - DNA, 25 bp, Mus musculus
ggcatcctgacccagaccagaataa

SEQ ID NO: 612823 - DNA, 25 bp, Mus musculus
ggcatcctgaccgagaccagaataa

SEQ ID NO: 612824 - DNA, 25 bp, Mus musculus
ggcatcctgcctccattgaaacaga

SEQ ID NO: 612825 - DNA, 25 bp, Mus musculus
ggcatcctgcctgcattgaaacaga

SEQ ID NO: 612826 - DNA, 25 bp, Mus musculus
ggcatcctgctgatagtcccaggag

SEQ ID NO: 612827 - DNA, 25 bp, Mus musculus
ggcatcctgctgttagtcccaggag

SEQ ID NO: 612828 - DNA, 25 bp, Mus musculus
ggcatcctggctcacttcaagtgga

SEQ ID NO: 612829 - DNA, 25 bp, Mus musculus
ggcatcctggctgacttcaagtgga

SEQ ID NO: 612830 - DNA, 25 bp, Mus musculus
ggcatcctgggacacattcatatgt

SEQ ID NO: 612831 - DNA, 25 bp, Mus musculus
ggcatcctgggagacattcatatgt

SEQ ID NO: 612832 - DNA, 25 bp, Mus musculus
ggcatcctgtgaaaacgtccattca

SEQ ID NO: 612833 - DNA, 25 bp, Mus musculus
ggcatcctgtgataacgtccattca

SEQ ID NO: 612834 - DNA, 25 bp, Mus musculus
ggcatcctgtggactgctgaaatgt

SEQ ID NO: 612835 - DNA, 25 bp, Mus musculus
ggcatcctgtggtctgctgaaatgt

SEQ ID NO: 612836 - DNA, 25 bp, Mus musculus
ggcatcctgttgataactacttcaa

SEQ ID NO: 612837 - DNA, 25 bp, Mus musculus
ggcatcctgttgttaactacttcaa

SEQ ID NO: 612838 - DNA, 25 bp, Mus musculus
ggcatccttagtcgccctgaatgtg

SEQ ID NO: 612839 - DNA, 25 bp, Mus musculus
ggcatccttagtggccctgaatgtg

SEQ ID NO: 612840 - DNA, 25 bp, Mus musculus
ggcatcctttatcagttgtcatgac

SEQ ID NO: 612841 - DNA, 25 bp, Mus musculus
ggcatcctttatgagttgtcatgac

SEQ ID NO: 612842 - DNA, 25 bp, Mus musculus
ggcatcctttgcagcaaaccaaata

SEQ ID NO: 612843 - DNA, 25 bp, Mus musculus
ggcatcctttgctgcaaaccaaata

SEQ ID NO: 612844 - DNA, 25 bp, Mus musculus
ggcatccttttacactggagagcaa

SEQ ID NO: 612845 - DNA, 25 bp, Mus musculus
ggcatccttttagactggagagcaa

SEQ ID NO: 612846 - DNA, 25 bp, Mus musculus
ggcatccttttgattacactcttag

SEQ ID NO: 612847 - DNA, 25 bp, Mus musculus
ggcatccttttgtttacactcttag

SEQ ID NO: 612848 - DNA, 25 bp, Mus musculus
ggcatcgacatacaattgagagtct

SEQ ID NO: 612849 - DNA, 25 bp, Mus musculus
ggcatcgacatagaattgagagtct

SEQ ID NO: 612850 - DNA, 25 bp, Mus musculus
ggcatcgacccacacggagccatag

SEQ ID NO: 612851 - DNA, 25 bp, Mus musculus
ggcatcgacccagacggagccatag

SEQ ID NO: 612852 - DNA, 25 bp, Mus musculus
ggcatcgacctgatatgtggcaacg

SEQ ID NO: 612853 - DNA, 25 bp, Mus musculus
ggcatcgacctgttatgtggcaacg

SEQ ID NO: 612854 - DNA, 25 bp, Mus musculus
ggcatcgagactatttatgtaacac

SEQ ID NO: 612855 - DNA, 25 bp, Mus musculus
ggcatcgagactttttatgtaacac

SEQ ID NO: 612856 - DNA, 25 bp, Mus musculus
ggcatcgagtacaggattgtccgaa

SEQ ID NO: 612857 - DNA, 25 bp, Mus musculus
ggcatcgagtactggattgtccgaa

SEQ ID NO: 612858 - DNA, 25 bp, Mus musculus
ggcatcgctgtgagggacagtccat

SEQ ID NO: 612859 - DNA, 25 bp, Mus musculus
ggcatcgctgtgtgggacagtccat

SEQ ID NO: 612860 - DNA, 25 bp, Mus musculus
ggcatcggattccacctgcaggtgc

SEQ ID NO: 612861 - DNA, 25 bp, Mus musculus
ggcatcggattcgacctgcaggtgc

SEQ ID NO: 612862 - DNA, 25 bp, Mus musculus
ggcatcgggagaccgtttactccta

SEQ ID NO: 612863 - DNA, 25 bp, Mus musculus
ggcatcgggagagcgtttactccta

SEQ ID NO: 612864 - DNA, 25 bp, Mus musculus
ggcatcgggcacatacagaaggcac

SEQ ID NO: 612865 - DNA, 25 bp, Mus musculus
ggcatcgggcacttacagaaggcac

SEQ ID NO: 612866 - DNA, 25 bp, Mus musculus
ggcatcggtgccacgcatcttcatg

SEQ ID NO: 612867 - DNA, 25 bp, Mus musculus
ggcatcggtgcctcgcatcttcatg

SEQ ID NO: 612868 - DNA, 25 bp, Mus musculus
ggcatcgtcggcaagtacgggaccc

SEQ ID NO: 612869 - DNA, 25 bp, Mus musculus
ggcatcgtcggctagtacgggaccc

SEQ ID NO: 612870 - DNA, 25 bp, Mus musculus
ggcatcgtgttaacatctgcttatt

SEQ ID NO: 612871 - DNA, 25 bp, Mus musculus
ggcatcgtgttatcatctgcttatt

SEQ ID NO: 612872 - DNA, 25 bp, Mus musculus
ggcatctaacagcataaccaagtgt

SEQ ID NO: 612873 - DNA, 25 bp, Mus musculus
ggcatctaacaggataaccaagtgt

SEQ ID NO: 612874 - DNA, 25 bp, Mus musculus
ggcatctaagttcaggtttcctttg

SEQ ID NO: 612875 - DNA, 25 bp, Mus musculus
ggcatctaagttgaggtttcctttg

SEQ ID NO: 612876 - DNA, 25 bp, Mus musculus
ggcatctaatctcatccttctttac

SEQ ID NO: 612877 - DNA, 25 bp, Mus musculus
ggcatctaatctgatccttctttac

SEQ ID NO: 612878 - DNA, 25 bp, Mus musculus
ggcatctaatgcatcaagtccaaca

SEQ ID NO: 612879 - DNA, 25 bp, Mus musculus
ggcatctaatgccaaatgcgctgtg

SEQ ID NO: 612880 - DNA, 25 bp, Mus musculus
ggcatctaatgcgaaatgcgctgtg

SEQ ID NO: 612881 - DNA, 25 bp, Mus musculus
ggcatctaatgcttcaagtccaaca

SEQ ID NO: 612882 - DNA, 25 bp, Mus musculus
ggcatctacaatacactggagtctt

SEQ ID NO: 612883 - DNA, 25 bp, Mus musculus
ggcatctacaatcacagctgctatg

SEQ ID NO: 612884 - DNA, 25 bp, Mus musculus
ggcatctacaatgacagctgctatg

SEQ ID NO: 612885 - DNA, 25 bp, Mus musculus
ggcatctacaattcactggagtctt

SEQ ID NO: 612886 - DNA, 25 bp, Mus musculus
ggcatctacgtaagagtctccaagg

SEQ ID NO: 612887 - DNA, 25 bp, Mus musculus
ggcatctacgtatgagtctccaagg

SEQ ID NO: 612888 - DNA, 25 bp, Mus musculus
ggcatctactatcaacccaactgta

SEQ ID NO: 612889 - DNA, 25 bp, Mus musculus
ggcatctactatgaacccaactgta

SEQ ID NO: 612890 - DNA, 25 bp, Mus musculus
ggcatctacttccacaactaatacg

SEQ ID NO: 612891 - DNA, 25 bp, Mus musculus
ggcatctacttcgacaactaatacg

SEQ ID NO: 612892 - DNA, 25 bp, Mus musculus
ggcatctactttacttagcttcacc

SEQ ID NO: 612893 - DNA, 25 bp, Mus musculus
ggcatctacttttcttagcttcacc

SEQ ID NO: 612894 - DNA, 25 bp, Mus musculus
ggcatctagacactgtttcctggaa

SEQ ID NO: 612895 - DNA, 25 bp, Mus musculus
ggcatctagacagtgtttcctggaa

SEQ ID NO: 612896 - DNA, 25 bp, Mus musculus
ggcatctagacccagtgttttacac

SEQ ID NO: 612897 - DNA, 25 bp, Mus musculus
ggcatctagaccgagtgttttacac

SEQ ID NO: 612898 - DNA, 25 bp, Mus musculus
ggcatctagaggacaaaccccacag

SEQ ID NO: 612899 - DNA, 25 bp, Mus musculus
ggcatctagaggtcaaaccccacag

SEQ ID NO: 612900 - DNA, 25 bp, Mus musculus
ggcatctagcttctggggagacaat

SEQ ID NO: 612901 - DNA, 25 bp, Mus musculus
ggcatctagcttgtggggagacaat

SEQ ID NO: 612902 - DNA, 25 bp, Mus musculus
ggcatctagtgtacctcaccagagg

SEQ ID NO: 612903 - DNA, 25 bp, Mus musculus
ggcatctagtgttcctcaccagagg

SEQ ID NO: 612904 - DNA, 25 bp, Mus musculus
ggcatctagttcatataccctttgc

SEQ ID NO: 612905 - DNA, 25 bp, Mus musculus
ggcatctagttcttataccctttgc

SEQ ID NO: 612906 - DNA, 25 bp, Mus musculus
ggcatctatagtaatgacctccaga

SEQ ID NO: 612907 - DNA, 25 bp, Mus musculus
ggcatctatagttatgacctccaga

SEQ ID NO: 612908 - DNA, 25 bp, Mus musculus
ggcatctatcctaaacttggtctct

SEQ ID NO: 612909 - DNA, 25 bp, Mus musculus
ggcatctatccttaacttggtctct

SEQ ID NO: 612910 - DNA, 25 bp, Mus musculus
ggcatctatgtcagggtgcaagggt

SEQ ID NO: 612911 - DNA, 25 bp, Mus musculus
ggcatctatgtctgggtgcaagggt

SEQ ID NO: 612912 - DNA, 25 bp, Mus musculus
ggcatctcaacacattacagttcgg

SEQ ID NO: 612913 - DNA, 25 bp, Mus musculus
ggcatctcaacagattacagttcgg

SEQ ID NO: 612914 - DNA, 25 bp, Mus musculus
ggcatctcaagcctcaagtcaggca

SEQ ID NO: 612915 - DNA, 25 bp, Mus musculus
ggcatctcaagcgtcaagtcaggca

SEQ ID NO: 612916 - DNA, 25 bp, Mus musculus
ggcatctcacagattgccagatagg

SEQ ID NO: 612917 - DNA, 25 bp, Mus musculus
ggcatctcacagtttgccagatagg

SEQ ID NO: 612918 - DNA, 25 bp, Mus musculus
ggcatctcagctacacaagaggccc

SEQ ID NO: 612919 - DNA, 25 bp, Mus musculus
ggcatctcagcttcacaagaggccc

SEQ ID NO: 612920 - DNA, 25 bp, Mus musculus
ggcatctcatttccatcttgcatgc

SEQ ID NO: 612921 - DNA, 25 bp, Mus musculus
ggcatctcatttgcatcttgcatgc

SEQ ID NO: 612922 - DNA, 25 bp, Mus musculus
ggcatctcccaaagatacggcactt

SEQ ID NO: 612923 - DNA, 25 bp, Mus musculus
ggcatctcccaatgatacggcactt

SEQ ID NO: 612924 - DNA, 25 bp, Mus musculus
ggcatctccggcaaagagccaacaa

SEQ ID NO: 612925 - DNA, 25 bp, Mus musculus
ggcatctccggctaagagccaacaa

SEQ ID NO: 612926 - DNA, 25 bp, Mus musculus
ggcatctcggtgcaattgttggaca

SEQ ID NO: 612927 - DNA, 25 bp, Mus musculus
ggcatctcggtggaattgttggaca

SEQ ID NO: 612928 - DNA, 25 bp, Mus musculus
ggcatctctacacaggccaatggca

SEQ ID NO: 612929 - DNA, 25 bp, Mus musculus
ggcatctctacagaggccaatggca

SEQ ID NO: 612930 - DNA, 25 bp, Mus musculus
ggcatctctacccactctgaggtac

SEQ ID NO: 612931 - DNA, 25 bp, Mus musculus
ggcatctctaccgactctgaggtac

SEQ ID NO: 612932 - DNA, 25 bp, Mus musculus
ggcatctctcagctaaagccaagct

SEQ ID NO: 612933 - DNA, 25 bp, Mus musculus
ggcatctctcaggtaaagccaagct

SEQ ID NO: 612934 - DNA, 25 bp, Mus musculus
ggcatctctcctactaaacaaagca

SEQ ID NO: 612935 - DNA, 25 bp, Mus musculus
ggcatctctcctagaggctgtgtaa

SEQ ID NO: 612936 - DNA, 25 bp, Mus musculus
ggcatctctccttctaaacaaagca

SEQ ID NO: 612937 - DNA, 25 bp, Mus musculus
ggcatctctccttgaggctgtgtaa

SEQ ID NO: 612938 - DNA, 25 bp, Mus musculus
ggcatctctggtctctatagacata

SEQ ID NO: 612939 - DNA, 25 bp, Mus musculus
ggcatctctggtgtctatagacata

SEQ ID NO: 612940 - DNA, 25 bp, Mus musculus
ggcatctctgtgatggttccattca

SEQ ID NO: 612941 - DNA, 25 bp, Mus musculus
ggcatctctgtgttggttccattca

SEQ ID NO: 612942 - DNA, 25 bp, Mus musculus
ggcatctgaatacagagctgtcttt

SEQ ID NO: 612943 - DNA, 25 bp, Mus musculus
ggcatctgaatagagagctgtcttt

SEQ ID NO: 612944 - DNA, 25 bp, Mus musculus
ggcatctgacacattcaaccaaaat

SEQ ID NO: 612945 - DNA, 25 bp, Mus musculus
ggcatctgacactttcaaccaaaat

SEQ ID NO: 612946 - DNA, 25 bp, Mus musculus
ggcatctgagacctgtgggaatccc

SEQ ID NO: 612947 - DNA, 25 bp, Mus musculus
ggcatctgagacgtgtgggaatccc

SEQ ID NO: 612948 - DNA, 25 bp, Mus musculus
ggcatctgagcaaccttaggtcttc

SEQ ID NO: 612949 - DNA, 25 bp, Mus musculus
ggcatctgagcatccttaggtcttc

SEQ ID NO: 612950 - DNA, 25 bp, Mus musculus
ggcatctgcccaagtctaaccaggg

SEQ ID NO: 612951 - DNA, 25 bp, Mus musculus
ggcatctgcccatgtctaaccaggg

SEQ ID NO: 612952 - DNA, 25 bp, Mus musculus
ggcatctgccctaccagtattagat

SEQ ID NO: 612953 - DNA, 25 bp, Mus musculus
ggcatctgcccttccagtattagat

SEQ ID NO: 612954 - DNA, 25 bp, Mus musculus
ggcatctgcctcatcttaatagtca

SEQ ID NO: 612955 - DNA, 25 bp, Mus musculus
ggcatctgcctcttcttaatagtca

SEQ ID NO: 612956 - DNA, 25 bp, Mus musculus
ggcatctgcctgaactaatacctag

SEQ ID NO: 612957 - DNA, 25 bp, Mus musculus
ggcatctgcctgtactaatacctag

SEQ ID NO: 612958 - DNA, 25 bp, Mus musculus
ggcatctgctgcagcgacgagagct

SEQ ID NO: 612959 - DNA, 25 bp, Mus musculus
ggcatctgctgctgcgacgagagct

SEQ ID NO: 612960 - DNA, 25 bp, Mus musculus
ggcatctggcaaaaagactactaaa

SEQ ID NO: 612961 - DNA, 25 bp, Mus musculus
ggcatctggcaataagactactaaa

SEQ ID NO: 612962 - DNA, 25 bp, Mus musculus
ggcatctggtagcaacgacacacaa

SEQ ID NO: 612963 - DNA, 25 bp, Mus musculus
ggcatctggtaggaacgacacacaa

SEQ ID NO: 612964 - DNA, 25 bp, Mus musculus
ggcatctgtaaactggaacggctca

SEQ ID NO: 612965 - DNA, 25 bp, Mus musculus
ggcatctgtaaagtggaacggctca

SEQ ID NO: 612966 - DNA, 25 bp, Mus musculus
ggcatctgtaaccatcactgaggac

SEQ ID NO: 612967 - DNA, 25 bp, Mus musculus
ggcatctgtaacgatcactgaggac

SEQ ID NO: 612968 - DNA, 25 bp, Mus musculus
ggcatctgtaatactgaccctaatt

SEQ ID NO: 612969 - DNA, 25 bp, Mus musculus
ggcatctgtaattctgaccctaatt

SEQ ID NO: 612970 - DNA, 25 bp, Mus musculus
ggcatctgtagtccacatctagtta

SEQ ID NO: 612971 - DNA, 25 bp, Mus musculus
ggcatctgtagtgcacatctagtta

SEQ ID NO: 612972 - DNA, 25 bp, Mus musculus
ggcatctgtccaagatagactctaa

SEQ ID NO: 612973 - DNA, 25 bp, Mus musculus
ggcatctgtccacctaccagagaga

SEQ ID NO: 612974 - DNA, 25 bp, Mus musculus
ggcatctgtccagctaccagagaga

SEQ ID NO: 612975 - DNA, 25 bp, Mus musculus
ggcatctgtccatgatagactctaa

SEQ ID NO: 612976 - DNA, 25 bp, Mus musculus
ggcatctgttaaattcaccgtctat

SEQ ID NO: 612977 - DNA, 25 bp, Mus musculus
ggcatctgttaatttcaccgtctat

SEQ ID NO: 612978 - DNA, 25 bp, Mus musculus
ggcatctgtttacgagttgttcaaa

SEQ ID NO: 612979 - DNA, 25 bp, Mus musculus
ggcatctgtttaggagttgttcaaa

SEQ ID NO: 612980 - DNA, 25 bp, Mus musculus
ggcatcttaaatcatatctctcaga

SEQ ID NO: 612981 - DNA, 25 bp, Mus musculus
ggcatcttaaatgatatctctcaga

SEQ ID NO: 612982 - DNA, 25 bp, Mus musculus
ggcatcttaacaagggacttcccta

SEQ ID NO: 612983 - DNA, 25 bp, Mus musculus
ggcatcttaacatgggacttcccta

SEQ ID NO: 612984 - DNA, 25 bp, Mus musculus
ggcatcttactactgctgttttaaa

SEQ ID NO: 612985 - DNA, 25 bp, Mus musculus
ggcatcttactagtgctgttttaaa

SEQ ID NO: 612986 - DNA, 25 bp, Mus musculus
ggcatcttaggcagtctttctttat

SEQ ID NO: 612987 - DNA, 25 bp, Mus musculus
ggcatcttaggctgtctttctttat

SEQ ID NO: 612988 - DNA, 25 bp, Mus musculus
ggcatcttatcccaggctaggcaac

SEQ ID NO: 612989 - DNA, 25 bp, Mus musculus
ggcatcttatccgaggctaggcaac

SEQ ID NO: 612990 - DNA, 25 bp, Mus musculus
ggcatcttcagaaccggcatgctgt

SEQ ID NO: 612991 - DNA, 25 bp, Mus musculus
ggcatcttcagatccggcatgctgt

SEQ ID NO: 612992 - DNA, 25 bp, Mus musculus
ggcatcttcaggatgtaacccagat

SEQ ID NO: 612993 - DNA, 25 bp, Mus musculus
ggcatcttcaggcatgaccggcttc

SEQ ID NO: 612994 - DNA, 25 bp, Mus musculus
ggcatcttcagggatgaccggcttc

SEQ ID NO: 612995 - DNA, 25 bp, Mus musculus
ggcatcttcaggttgtaacccagat

SEQ ID NO: 612996 - DNA, 25 bp, Mus musculus
ggcatcttccatacctgttctttta

SEQ ID NO: 612997 - DNA, 25 bp, Mus musculus
ggcatcttccattcctgttctttta

SEQ ID NO: 612998 - DNA, 25 bp, Mus musculus
ggcatcttccctcaggcattttgag

SEQ ID NO: 612999 - DNA, 25 bp, Mus musculus
ggcatcttccctgaggcattttgag

SEQ ID NO: 613000 - DNA, 25 bp, Mus musculus
ggcatcttcctcaatgccatagtat

SEQ ID NO: 613001 - DNA, 25 bp, Mus musculus
ggcatcttcctctatgccatagtat

SEQ ID NO: 613002 - DNA, 25 bp, Mus musculus
ggcatcttcctgagagtgcgggaat

SEQ ID NO: 613003 - DNA, 25 bp, Mus musculus
ggcatcttcctgtgagtgcgggaat

SEQ ID NO: 613004 - DNA, 25 bp, Mus musculus
ggcatcttccttaaaaaagctacag

SEQ ID NO: 613005 - DNA, 25 bp, Mus musculus
ggcatcttcctttaaaaagctacag

SEQ ID NO: 613006 - DNA, 25 bp, Mus musculus
ggcatcttgaagaaggctcgtattg

SEQ ID NO: 613007 - DNA, 25 bp, Mus musculus
ggcatcttgaagtaggctcgtattg

SEQ ID NO: 613008 - DNA, 25 bp, Mus musculus
ggcatcttgacgcactgacttgaat

SEQ ID NO: 613009 - DNA, 25 bp, Mus musculus
ggcatcttgacggactgacttgaat

SEQ ID NO: 613010 - DNA, 25 bp, Mus musculus
ggcatcttgatcatacacttcctac

SEQ ID NO: 613011 - DNA, 25 bp, Mus musculus
ggcatcttgatcatgtcttgaccat

SEQ ID NO: 613012 - DNA, 25 bp, Mus musculus
ggcatcttgatcttacacttcctac

SEQ ID NO: 613013 - DNA, 25 bp, Mus musculus
ggcatcttgatcttgtcttgaccat

SEQ ID NO: 613014 - DNA, 25 bp, Mus musculus
ggcatcttgcctagtgcactgagta

SEQ ID NO: 613015 - DNA, 25 bp, Mus musculus
ggcatcttgccttgtgcactgagta

SEQ ID NO: 613016 - DNA, 25 bp, Mus musculus
ggcatcttggagctcacaaatgtga

SEQ ID NO: 613017 - DNA, 25 bp, Mus musculus
ggcatcttggaggtcacaaatgtga

SEQ ID NO: 613018 - DNA, 25 bp, Mus musculus
ggcatcttgtttctttaatatgata

SEQ ID NO: 613019 - DNA, 25 bp, Mus musculus
ggcatcttgtttgtttaatatgata

SEQ ID NO: 613020 - DNA, 25 bp, Mus musculus
ggcatctttattcacatctccatgc

SEQ ID NO: 613021 - DNA, 25 bp, Mus musculus
ggcatctttattgacatctccatgc

SEQ ID NO: 613022 - DNA, 25 bp, Mus musculus
ggcatctttcaaaccaatctgatag

SEQ ID NO: 613023 - DNA, 25 bp, Mus musculus
ggcatctttcaatccaatctgatag

SEQ ID NO: 613024 - DNA, 25 bp, Mus musculus
ggcatctttcctaccatattttaaa

SEQ ID NO: 613025 - DNA, 25 bp, Mus musculus
ggcatctttcctaggatttgactta

SEQ ID NO: 613026 - DNA, 25 bp, Mus musculus
ggcatctttccttccatattttaaa

SEQ ID NO: 613027 - DNA, 25 bp, Mus musculus
ggcatctttccttggatttgactta

SEQ ID NO: 613028 - DNA, 25 bp, Mus musculus
ggcatctttcgaattctgtataaaa

SEQ ID NO: 613029 - DNA, 25 bp, Mus musculus
ggcatctttcgatttctgtataaaa

SEQ ID NO: 613030 - DNA, 25 bp, Mus musculus
ggcatctttctaagagctccagcta

SEQ ID NO: 613031 - DNA, 25 bp, Mus musculus
ggcatctttctaatcacatcctcat

SEQ ID NO: 613032 - DNA, 25 bp, Mus musculus
ggcatctttctatgagctccagcta

SEQ ID NO: 613033 - DNA, 25 bp, Mus musculus
ggcatctttctattcacatcctcat

SEQ ID NO: 613034 - DNA, 25 bp, Mus musculus
ggcatctttgagacctcttggttct

SEQ ID NO: 613035 - DNA, 25 bp, Mus musculus
ggcatctttgagtcctcttggttct

SEQ ID NO: 613036 - DNA, 25 bp, Mus musculus
ggcatctttggactgacatccaagg

SEQ ID NO: 613037 - DNA, 25 bp, Mus musculus
ggcatctttggactggccacagttc

SEQ ID NO: 613038 - DNA, 25 bp, Mus musculus
ggcatctttggagtgacatccaagg

SEQ ID NO: 613039 - DNA, 25 bp, Mus musculus
ggcatctttggagtggccacagttc

SEQ ID NO: 613040 - DNA, 25 bp, Mus musculus
ggcatctttgttcatccttggtgaa

SEQ ID NO: 613041 - DNA, 25 bp, Mus musculus
ggcatctttgttgatccttggtgaa

SEQ ID NO: 613042 - DNA, 25 bp, Mus musculus
ggcatcttttagaccttttagtcca

SEQ ID NO: 613043 - DNA, 25 bp, Mus musculus
ggcatcttttagtccttttagtcca

SEQ ID NO: 613044 - DNA, 25 bp, Mus musculus
ggcatcttttttcataagcagtctg

SEQ ID NO: 613045 - DNA, 25 bp, Mus musculus
ggcatcttttttgataagcagtctg

SEQ ID NO: 613046 - DNA, 25 bp, Mus musculus
ggcatgaaacctcctttgtgtgtga

SEQ ID NO: 613047 - DNA, 25 bp, Mus musculus
ggcatgaaacctgctttgtgtgtga

SEQ ID NO: 613048 - DNA, 25 bp, Mus musculus
ggcatgaaccccagcccgtgggctt

SEQ ID NO: 613049 - DNA, 25 bp, Mus musculus
ggcatgaacccctgcccgtgggctt

SEQ ID NO: 613050 - DNA, 25 bp, Mus musculus
ggcatgaactgcactactgagaaca

SEQ ID NO: 613051 - DNA, 25 bp, Mus musculus
ggcatgaactgctctactgagaaca

SEQ ID NO: 613052 - DNA, 25 bp, Mus musculus
ggcatgaacttgatctttaggacct

SEQ ID NO: 613053 - DNA, 25 bp, Mus musculus
ggcatgaacttgttctttaggacct

SEQ ID NO: 613054 - DNA, 25 bp, Mus musculus
ggcatgaaggccagtttagcgtctg

SEQ ID NO: 613055 - DNA, 25 bp, Mus musculus
ggcatgaaggcctgtttagcgtctg

SEQ ID NO: 613056 - DNA, 25 bp, Mus musculus
ggcatgaatcccagtatttggctct

SEQ ID NO: 613057 - DNA, 25 bp, Mus musculus
ggcatgaatcccattcagaccatga

SEQ ID NO: 613058 - DNA, 25 bp, Mus musculus
ggcatgaatccctgtatttggctct

SEQ ID NO: 613059 - DNA, 25 bp, Mus musculus
ggcatgaatccctttcagaccatga

SEQ ID NO: 613060 - DNA, 25 bp, Mus musculus
ggcatgaatcctacaagacgcagta

SEQ ID NO: 613061 - DNA, 25 bp, Mus musculus
ggcatgaatccttcaagacgcagta

SEQ ID NO: 613062 - DNA, 25 bp, Mus musculus
ggcatgaatgtgctggattagtctt

SEQ ID NO: 613063 - DNA, 25 bp, Mus musculus
ggcatgaatgtggtggattagtctt

SEQ ID NO: 613064 - DNA, 25 bp, Mus musculus
ggcatgacacccactttactgaagg

SEQ ID NO: 613065 - DNA, 25 bp, Mus musculus
ggcatgacaccctctttactgaagg

SEQ ID NO: 613066 - DNA, 25 bp, Mus musculus
ggcatgacaggcaatgggcgacccc

SEQ ID NO: 613067 - DNA, 25 bp, Mus musculus
ggcatgacaggctatgggcgacccc

SEQ ID NO: 613068 - DNA, 25 bp, Mus musculus
ggcatgacagtgagtctttctgttt

SEQ ID NO: 613069 - DNA, 25 bp, Mus musculus
ggcatgacagtgtgtctttctgttt

SEQ ID NO: 613070 - DNA, 25 bp, Mus musculus
ggcatgacttgcctcagactagagc

SEQ ID NO: 613071 - DNA, 25 bp, Mus musculus
ggcatgacttgcgtcagactagagc

SEQ ID NO: 613072 - DNA, 25 bp, Mus musculus
ggcatgagcaacacaggaaatccat

SEQ ID NO: 613073 - DNA, 25 bp, Mus musculus
ggcatgagcaactcaggaaatccat

SEQ ID NO: 613074 - DNA, 25 bp, Mus musculus
ggcatgagcccgaactgaactttaa

SEQ ID NO: 613075 - DNA, 25 bp, Mus musculus
ggcatgagcccgtactgaactttaa

SEQ ID NO: 613076 - DNA, 25 bp, Mus musculus
ggcatgaggccaatttgagttcccc

SEQ ID NO: 613077 - DNA, 25 bp, Mus musculus
ggcatgaggccacccacatgacaga

SEQ ID NO: 613078 - DNA, 25 bp, Mus musculus
ggcatgaggccagccacatgacaga

SEQ ID NO: 613079 - DNA, 25 bp, Mus musculus
ggcatgaggccattttgagttcccc

SEQ ID NO: 613080 - DNA, 25 bp, Mus musculus
ggcatgaggcgtcctggacaaacat

SEQ ID NO: 613081 - DNA, 25 bp, Mus musculus
ggcatgaggcgtgctggacaaacat

SEQ ID NO: 613082 - DNA, 25 bp, Mus musculus
ggcatgaggtgtatgggcatcccaa

SEQ ID NO: 613083 - DNA, 25 bp, Mus musculus
ggcatgaggtgtttgggcatcccaa

SEQ ID NO: 613084 - DNA, 25 bp, Mus musculus
ggcatgaggttaacacaagcatttt

SEQ ID NO: 613085 - DNA, 25 bp, Mus musculus
ggcatgaggttatcacaagcatttt

SEQ ID NO: 613086 - DNA, 25 bp, Mus musculus
ggcatgagtgaccagctggacttta

SEQ ID NO: 613087 - DNA, 25 bp, Mus musculus
ggcatgagtgacgagctggacttta

SEQ ID NO: 613088 - DNA, 25 bp, Mus musculus
ggcatgagttgtctttctggactgt

SEQ ID NO: 613089 - DNA, 25 bp, Mus musculus
ggcatgagttgtgtttctggactgt

SEQ ID NO: 613090 - DNA, 25 bp, Mus musculus
ggcatgatatgcatacggtggaaac

SEQ ID NO: 613091 - DNA, 25 bp, Mus musculus
ggcatgatatgcttacggtggaaac

SEQ ID NO: 613092 - DNA, 25 bp, Mus musculus
ggcatgatcagacatgctcaccact

SEQ ID NO: 613093 - DNA, 25 bp, Mus musculus
ggcatgatcagagatgctcaccact

SEQ ID NO: 613094 - DNA, 25 bp, Mus musculus
ggcatgatccccatacatacagagg

SEQ ID NO: 613095 - DNA, 25 bp, Mus musculus
ggcatgatccccttacatacagagg

SEQ ID NO: 613096 - DNA, 25 bp, Mus musculus
ggcatgatgcttctacaaatttctg

SEQ ID NO: 613097 - DNA, 25 bp, Mus musculus
ggcatgatgcttgtacaaatttctg

SEQ ID NO: 613098 - DNA, 25 bp, Mus musculus
ggcatgatgtacattttcactacca

SEQ ID NO: 613099 - DNA, 25 bp, Mus musculus
ggcatgatgtactttttcactacca

SEQ ID NO: 613100 - DNA, 25 bp, Mus musculus
ggcatgattagcatgacccagtctc

SEQ ID NO: 613101 - DNA, 25 bp, Mus musculus
ggcatgattagcttgacccagtctc

SEQ ID NO: 613102 - DNA, 25 bp, Mus musculus
ggcatgattattatggctgtagtaa

SEQ ID NO: 613103 - DNA, 25 bp, Mus musculus
ggcatgattattttggctgtagtaa

SEQ ID NO: 613104 - DNA, 25 bp, Mus musculus
ggcatgattgagagactgtcccctg

SEQ ID NO: 613105 - DNA, 25 bp, Mus musculus
ggcatgattgagtgactgtcccctg

SEQ ID NO: 613106 - DNA, 25 bp, Mus musculus
ggcatgcaacagcacattctttggt

SEQ ID NO: 613107 - DNA, 25 bp, Mus musculus
ggcatgcaacaggacattctttggt

SEQ ID NO: 613108 - DNA, 25 bp, Mus musculus
ggcatgcaacctcgcctccatgaga

SEQ ID NO: 613109 - DNA, 25 bp, Mus musculus
ggcatgcaacctggcctccatgaga

SEQ ID NO: 613110 - DNA, 25 bp, Mus musculus
ggcatgcaacttaagtgatccaacg

SEQ ID NO: 613111 - DNA, 25 bp, Mus musculus
ggcatgcaactttagtgatccaacg

SEQ ID NO: 613112 - DNA, 25 bp, Mus musculus
ggcatgcacatgcttgtgtcttcaa

SEQ ID NO: 613113 - DNA, 25 bp, Mus musculus
ggcatgcacatggttgtgtcttcaa

SEQ ID NO: 613114 - DNA, 25 bp, Mus musculus
ggcatgcacattcacagacttacac

SEQ ID NO: 613115 - DNA, 25 bp, Mus musculus
ggcatgcacattgacagacttacac

SEQ ID NO: 613116 - DNA, 25 bp, Mus musculus
ggcatgcaccagatcactagctgaa

SEQ ID NO: 613117 - DNA, 25 bp, Mus musculus
ggcatgcaccagttcactagctgaa

SEQ ID NO: 613118 - DNA, 25 bp, Mus musculus
ggcatgcagaccagaggcccgatga

SEQ ID NO: 613119 - DNA, 25 bp, Mus musculus
ggcatgcagacctgaggcccgatga

SEQ ID NO: 613120 - DNA, 25 bp, Mus musculus
ggcatgcatatgaaccaccgagacc

SEQ ID NO: 613121 - DNA, 25 bp, Mus musculus
ggcatgcatatgagtaatctttctt

SEQ ID NO: 613122 - DNA, 25 bp, Mus musculus
ggcatgcatatgtaccaccgagacc

SEQ ID NO: 613123 - DNA, 25 bp, Mus musculus
ggcatgcatatgtgtaatctttctt

SEQ ID NO: 613124 - DNA, 25 bp, Mus musculus
ggcatgcatgcgacgtattaccaca

SEQ ID NO: 613125 - DNA, 25 bp, Mus musculus
ggcatgcatgcgtcgtattaccaca

SEQ ID NO: 613126 - DNA, 25 bp, Mus musculus
ggcatgcatgttagtgccatacaaa

SEQ ID NO: 613127 - DNA, 25 bp, Mus musculus
ggcatgcatgtttgtgccatacaaa

SEQ ID NO: 613128 - DNA, 25 bp, Mus musculus
ggcatgccacatccagtactcagaa

SEQ ID NO: 613129 - DNA, 25 bp, Mus musculus
ggcatgccacatgcagtactcagaa

SEQ ID NO: 613130 - DNA, 25 bp, Mus musculus
ggcatgccacgcaagtctagtgctt

SEQ ID NO: 613131 - DNA, 25 bp, Mus musculus
ggcatgccacgctagtctagtgctt

SEQ ID NO: 613132 - DNA, 25 bp, Mus musculus
ggcatgccagagatggctccagaca

SEQ ID NO: 613133 - DNA, 25 bp, Mus musculus
ggcatgccagagttggctccagaca

SEQ ID NO: 613134 - DNA, 25 bp, Mus musculus
ggcatgccagccagtgggtctcgac

SEQ ID NO: 613135 - DNA, 25 bp, Mus musculus
ggcatgccagcctgtgggtctcgac

SEQ ID NO: 613136 - DNA, 25 bp, Mus musculus
ggcatgccataacctgtagtgtatt

SEQ ID NO: 613137 - DNA, 25 bp, Mus musculus
ggcatgccataagctgtagtgtatt

SEQ ID NO: 613138 - DNA, 25 bp, Mus musculus
ggcatgcccttacagcatggtgttt

SEQ ID NO: 613139 - DNA, 25 bp, Mus musculus
ggcatgcccttagagcatggtgttt

SEQ ID NO: 613140 - DNA, 25 bp, Mus musculus
ggcatgccgtggaatacagcccgca

SEQ ID NO: 613141 - DNA, 25 bp, Mus musculus
ggcatgccgtggtatacagcccgca

SEQ ID NO: 613142 - DNA, 25 bp, Mus musculus
ggcatgcctagtaacgggagacctg

SEQ ID NO: 613143 - DNA, 25 bp, Mus musculus
ggcatgcctagttacgggagacctg

SEQ ID NO: 613144 - DNA, 25 bp, Mus musculus
ggcatgcctggaaagcgactgaact

SEQ ID NO: 613145 - DNA, 25 bp, Mus musculus
ggcatgcctggatagcgactgaact

SEQ ID NO: 613146 - DNA, 25 bp, Mus musculus
ggcatgcctgtaagtatctctcaag

SEQ ID NO: 613147 - DNA, 25 bp, Mus musculus
ggcatgcctgtatgtatctctcaag

SEQ ID NO: 613148 - DNA, 25 bp, Mus musculus
ggcatgcgccatacactgcccaatt

SEQ ID NO: 613149 - DNA, 25 bp, Mus musculus
ggcatgcgccattcactgcccaatt

SEQ ID NO: 613150 - DNA, 25 bp, Mus musculus
ggcatgcgtgaacgctgtcttgaat

SEQ ID NO: 613151 - DNA, 25 bp, Mus musculus
ggcatgcgtgaaggctgtcttgaat

SEQ ID NO: 613152 - DNA, 25 bp, Mus musculus
ggcatgctcactcatgtagaagggt

SEQ ID NO: 613153 - DNA, 25 bp, Mus musculus
ggcatgctcactgatgtagaagggt

SEQ ID NO: 613154 - DNA, 25 bp, Mus musculus
ggcatgctcctgcagcctctgaatg

SEQ ID NO: 613155 - DNA, 25 bp, Mus musculus
ggcatgctcctggagcctctgaatg

SEQ ID NO: 613156 - DNA, 25 bp, Mus musculus
ggcatgctgctacaataaggctcat

SEQ ID NO: 613157 - DNA, 25 bp, Mus musculus
ggcatgctgctagaataaggctcat

SEQ ID NO: 613158 - DNA, 25 bp, Mus musculus
ggcatgctggacacctagaagccat

SEQ ID NO: 613159 - DNA, 25 bp, Mus musculus
ggcatgctggactcctagaagccat

SEQ ID NO: 613160 - DNA, 25 bp, Mus musculus
ggcatgctgggaaagctttgacctc

SEQ ID NO: 613161 - DNA, 25 bp, Mus musculus
ggcatgctgggaaagttctgacttc

SEQ ID NO: 613162 - DNA, 25 bp, Mus musculus
ggcatgctgggatagctttgacctc

SEQ ID NO: 613163 - DNA, 25 bp, Mus musculus
ggcatgctgggatagttctgacttc

SEQ ID NO: 613164 - DNA, 25 bp, Mus musculus
ggcatgctgtacatagggactatcc

SEQ ID NO: 613165 - DNA, 25 bp, Mus musculus
ggcatgctgtacttagggactatcc

SEQ ID NO: 613166 - DNA, 25 bp, Mus musculus
ggcatgcttaaaacagttatttacc

SEQ ID NO: 613167 - DNA, 25 bp, Mus musculus
ggcatgcttaaatcagttatttacc

SEQ ID NO: 613168 - DNA, 25 bp, Mus musculus
ggcatgcttaagaaactaggttttc

SEQ ID NO: 613169 - DNA, 25 bp, Mus musculus
ggcatgcttaagtaactaggttttc

SEQ ID NO: 613170 - DNA, 25 bp, Mus musculus
ggcatgcttctacacttcaacattt

SEQ ID NO: 613171 - DNA, 25 bp, Mus musculus
ggcatgcttctagacttcaacattt

SEQ ID NO: 613172 - DNA, 25 bp, Mus musculus
ggcatgcttctgcagtctaagggct

SEQ ID NO: 613173 - DNA, 25 bp, Mus musculus
ggcatgcttctggagtctaagggct

SEQ ID NO: 613174 - DNA, 25 bp, Mus musculus
ggcatggaacctaagctcagaatct

SEQ ID NO: 613175 - DNA, 25 bp, Mus musculus
ggcatggaaccttagctcagaatct

SEQ ID NO: 613176 - DNA, 25 bp, Mus musculus
ggcatggacatacaagtcacacatt

SEQ ID NO: 613177 - DNA, 25 bp, Mus musculus
ggcatggacatagaagtcacacatt

SEQ ID NO: 613178 - DNA, 25 bp, Mus musculus
ggcatggactctatgtaggagactt

SEQ ID NO: 613179 - DNA, 25 bp, Mus musculus
ggcatggactctttgtaggagactt

SEQ ID NO: 613180 - DNA, 25 bp, Mus musculus
ggcatggactgcaggtctcagaact

SEQ ID NO: 613181 - DNA, 25 bp, Mus musculus
ggcatggactgctggtctcagaact

SEQ ID NO: 613182 - DNA, 25 bp, Mus musculus
ggcatggagacgaaattgtccttgc

SEQ ID NO: 613183 - DNA, 25 bp, Mus musculus
ggcatggagacgtaattgtccttgc

SEQ ID NO: 613184 - DNA, 25 bp, Mus musculus
ggcatggagagcaacgtcgtcgcca

SEQ ID NO: 613185 - DNA, 25 bp, Mus musculus
ggcatggagagctacgtcgtcgcca

SEQ ID NO: 613186 - DNA, 25 bp, Mus musculus
ggcatggagccactgtcaactataa

SEQ ID NO: 613187 - DNA, 25 bp, Mus musculus
ggcatggagccagtgtcaactataa

SEQ ID NO: 613188 - DNA, 25 bp, Mus musculus
ggcatggagcccagcacagggaatt

SEQ ID NO: 613189 - DNA, 25 bp, Mus musculus
ggcatggagccctgcacagggaatt

SEQ ID NO: 613190 - DNA, 25 bp, Mus musculus
ggcatggagtaccagagtgctttat

SEQ ID NO: 613191 - DNA, 25 bp, Mus musculus
ggcatggagtacgagagtgctttat

SEQ ID NO: 613192 - DNA, 25 bp, Mus musculus
ggcatggagttcacttcaccagcct

SEQ ID NO: 613193 - DNA, 25 bp, Mus musculus
ggcatggagttctcttcaccagcct

SEQ ID NO: 613194 - DNA, 25 bp, Mus musculus
ggcatggataataccttttagaagt

SEQ ID NO: 613195 - DNA, 25 bp, Mus musculus
ggcatggataattccttttagaagt

SEQ ID NO: 613196 - DNA, 25 bp, Mus musculus
ggcatggcaaggcacatctttccac

SEQ ID NO: 613197 - DNA, 25 bp, Mus musculus
ggcatggcaagggacatctttccac

SEQ ID NO: 613198 - DNA, 25 bp, Mus musculus
ggcatggcatgcacctcaataaacg

SEQ ID NO: 613199 - DNA, 25 bp, Mus musculus
ggcatggcatgctcctcaataaacg

SEQ ID NO: 613200 - DNA, 25 bp, Mus musculus
ggcatggccacaaaccagatacaag

SEQ ID NO: 613201 - DNA, 25 bp, Mus musculus
ggcatggccacataccagatacaag

SEQ ID NO: 613202 - DNA, 25 bp, Mus musculus
ggcatggccctgaagcacactatct

SEQ ID NO: 613203 - DNA, 25 bp, Mus musculus
ggcatggccctgtagcacactatct

SEQ ID NO: 613204 - DNA, 25 bp, Mus musculus
ggcatggccttaactggttgatgga

SEQ ID NO: 613205 - DNA, 25 bp, Mus musculus
ggcatggccttatctggttgatgga

SEQ ID NO: 613206 - DNA, 25 bp, Mus musculus
ggcatggcgatcagcgatggctcct

SEQ ID NO: 613207 - DNA, 25 bp, Mus musculus
ggcatggcgatctgcgatggctcct

SEQ ID NO: 613208 - DNA, 25 bp, Mus musculus
ggcatggcgcatatgttctgaatta

SEQ ID NO: 613209 - DNA, 25 bp, Mus musculus
ggcatggcgcatttgttctgaatta

SEQ ID NO: 613210 - DNA, 25 bp, Mus musculus
ggcatggcgcggatgttttaccata

SEQ ID NO: 613211 - DNA, 25 bp, Mus musculus
ggcatggcgcggttgttttaccata

SEQ ID NO: 613212 - DNA, 25 bp, Mus musculus
ggcatggcggcaccgtcggaagcaa

SEQ ID NO: 613213 - DNA, 25 bp, Mus musculus
ggcatggcggcagcgtcggaagcaa

SEQ ID NO: 613214 - DNA, 25 bp, Mus musculus
ggcatggctactccaaaaattttgc

SEQ ID NO: 613215 - DNA, 25 bp, Mus musculus
ggcatggctactgcaaaaattttgc

SEQ ID NO: 613216 - DNA, 25 bp, Mus musculus
ggcatggctctgacatttatgaaga

SEQ ID NO: 613217 - DNA, 25 bp, Mus musculus
ggcatggctctgtcatttatgaaga

SEQ ID NO: 613218 - DNA, 25 bp, Mus musculus
ggcatggcttgacaggaacctttat

SEQ ID NO: 613219 - DNA, 25 bp, Mus musculus
ggcatggcttgagaggaacctttat

SEQ ID NO: 613220 - DNA, 25 bp, Mus musculus
ggcatggcttttcaggactattctt

SEQ ID NO: 613221 - DNA, 25 bp, Mus musculus
ggcatggcttttgaggactattctt

SEQ ID NO: 613222 - DNA, 25 bp, Mus musculus
ggcatgggacttattgtccttggac

SEQ ID NO: 613223 - DNA, 25 bp, Mus musculus
ggcatgggactttttgtccttggac

SEQ ID NO: 613224 - DNA, 25 bp, Mus musculus
ggcatgggctttcaaattaatctcc

SEQ ID NO: 613225 - DNA, 25 bp, Mus musculus
ggcatgggctttgaaattaatctcc

SEQ ID NO: 613226 - DNA, 25 bp, Mus musculus
ggcatgggtgaaagcgttagtaact

SEQ ID NO: 613227 - DNA, 25 bp, Mus musculus
ggcatgggtgaatgcgttagtaact

SEQ ID NO: 613228 - DNA, 25 bp, Mus musculus
ggcatgggtgacagggctctcattt

SEQ ID NO: 613229 - DNA, 25 bp, Mus musculus
ggcatgggtgactgggctctcattt

SEQ ID NO: 613230 - DNA, 25 bp, Mus musculus
ggcatgggtgataccttaagtccct

SEQ ID NO: 613231 - DNA, 25 bp, Mus musculus
ggcatgggtgattccttaagtccct

SEQ ID NO: 613232 - DNA, 25 bp, Mus musculus
ggcatggtaacacacacttttcatt

SEQ ID NO: 613233 - DNA, 25 bp, Mus musculus
ggcatggtaacagacacttttcatt

SEQ ID NO: 613234 - DNA, 25 bp, Mus musculus
ggcatggtcaacactggaagcagat

SEQ ID NO: 613235 - DNA, 25 bp, Mus musculus
ggcatggtcaactctggaagcagat

SEQ ID NO: 613236 - DNA, 25 bp, Mus musculus
ggcatggtgacactcacttgggaca

SEQ ID NO: 613237 - DNA, 25 bp, Mus musculus
ggcatggtgacagtcacttgggaca

SEQ ID NO: 613238 - DNA, 25 bp, Mus musculus
ggcatggtgcatacagcttttatcc

SEQ ID NO: 613239 - DNA, 25 bp, Mus musculus
ggcatggtgcattcagcttttatcc

SEQ ID NO: 613240 - DNA, 25 bp, Mus musculus
ggcatggtgctgaagctttttatct

SEQ ID NO: 613241 - DNA, 25 bp, Mus musculus
ggcatggtgctgtagctttttatct

SEQ ID NO: 613242 - DNA, 25 bp, Mus musculus
ggcatggtggtaaggatcgttctta

SEQ ID NO: 613243 - DNA, 25 bp, Mus musculus
ggcatggtggtatggatcgttctta

SEQ ID NO: 613244 - DNA, 25 bp, Mus musculus
ggcatggtgttgaccaagctgcgca

SEQ ID NO: 613245 - DNA, 25 bp, Mus musculus
ggcatggtgttgtccaagctgcgca

SEQ ID NO: 613246 - DNA, 25 bp, Mus musculus
ggcatggttaatctgcgagccaaag

SEQ ID NO: 613247 - DNA, 25 bp, Mus musculus
ggcatggttaatgtgcgagccaaag

SEQ ID NO: 613248 - DNA, 25 bp, Mus musculus
ggcatggttcagatgcgtgtatgta

SEQ ID NO: 613249 - DNA, 25 bp, Mus musculus
ggcatggttcagttgcgtgtatgta

SEQ ID NO: 613250 - DNA, 25 bp, Mus musculus
ggcatggttctgaaaagctcttgta

SEQ ID NO: 613251 - DNA, 25 bp, Mus musculus
ggcatggttctgtaaagctcttgta

SEQ ID NO: 613252 - DNA, 25 bp, Mus musculus
ggcatggttgaacctgcctctccaa

SEQ ID NO: 613253 - DNA, 25 bp, Mus musculus
ggcatggttgaagctgcctctccaa

SEQ ID NO: 613254 - DNA, 25 bp, Mus musculus
ggcatggtttctattatatagccct

SEQ ID NO: 613255 - DNA, 25 bp, Mus musculus
ggcatggtttcttttatatagccct

SEQ ID NO: 613256 - DNA, 25 bp, Mus musculus
ggcatggtttggcttgagtacttca

SEQ ID NO: 613257 - DNA, 25 bp, Mus musculus
ggcatggtttgggttgagtacttca

SEQ ID NO: 613258 - DNA, 25 bp, Mus musculus
ggcatgtaaggcattttccttgcta

SEQ ID NO: 613259 - DNA, 25 bp, Mus musculus
ggcatgtaaggctttttccttgcta

SEQ ID NO: 613260 - DNA, 25 bp, Mus musculus
ggcatgtacatacctggagacctta

SEQ ID NO: 613261 - DNA, 25 bp, Mus musculus
ggcatgtacatagctggagacctta

SEQ ID NO: 613262 - DNA, 25 bp, Mus musculus
ggcatgtaccaacttcttttgagac

SEQ ID NO: 613263 - DNA, 25 bp, Mus musculus
ggcatgtaccaagttcttttgagac

SEQ ID NO: 613264 - DNA, 25 bp, Mus musculus
ggcatgtaccataacaggcttcagt

SEQ ID NO: 613265 - DNA, 25 bp, Mus musculus
ggcatgtaccatcggtggctctata

SEQ ID NO: 613266 - DNA, 25 bp, Mus musculus
ggcatgtaccatgggtggctctata

SEQ ID NO: 613267 - DNA, 25 bp, Mus musculus
ggcatgtaccattacaggcttcagt

SEQ ID NO: 613268 - DNA, 25 bp, Mus musculus
ggcatgtactaccaccagccagcta

SEQ ID NO: 613269 - DNA, 25 bp, Mus musculus
ggcatgtactacgaccagccagcta

SEQ ID NO: 613270 - DNA, 25 bp, Mus musculus
ggcatgtactatcagccagactgta

SEQ ID NO: 613271 - DNA, 25 bp, Mus musculus
ggcatgtactatgagccagactgta

SEQ ID NO: 613272 - DNA, 25 bp, Mus musculus
ggcatgtatcgaaccctgaaggaag

SEQ ID NO: 613273 - DNA, 25 bp, Mus musculus
ggcatgtatcgatccctgaaggaag

SEQ ID NO: 613274 - DNA, 25 bp, Mus musculus
ggcatgtatgcccactcagagatgt

SEQ ID NO: 613275 - DNA, 25 bp, Mus musculus
ggcatgtatgccgactcagagatgt

SEQ ID NO: 613276 - DNA, 25 bp, Mus musculus
ggcatgtcacaacctggatttcctt

SEQ ID NO: 613277 - DNA, 25 bp, Mus musculus
ggcatgtcacaagctggatttcctt

SEQ ID NO: 613278 - DNA, 25 bp, Mus musculus
ggcatgtcaccgacgatcctggcac

SEQ ID NO: 613279 - DNA, 25 bp, Mus musculus
ggcatgtcaccgtcgatcctggcac

SEQ ID NO: 613280 - DNA, 25 bp, Mus musculus
ggcatgtcatgcactgacacagcat

SEQ ID NO: 613281 - DNA, 25 bp, Mus musculus
ggcatgtcatgctctgacacagcat

SEQ ID NO: 613282 - DNA, 25 bp, Mus musculus
ggcatgtcatggactggcattggaa

SEQ ID NO: 613283 - DNA, 25 bp, Mus musculus
ggcatgtcatggctagcgccctgac

SEQ ID NO: 613284 - DNA, 25 bp, Mus musculus
ggcatgtcatgggtagcgccctgac

SEQ ID NO: 613285 - DNA, 25 bp, Mus musculus
ggcatgtcatggtctggcattggaa

SEQ ID NO: 613286 - DNA, 25 bp, Mus musculus
ggcatgtcatgtaacccagagaact

SEQ ID NO: 613287 - DNA, 25 bp, Mus musculus
ggcatgtcatgttacccagagaact

SEQ ID NO: 613288 - DNA, 25 bp, Mus musculus
ggcatgtcattgctggtgtcatctc

SEQ ID NO: 613289 - DNA, 25 bp, Mus musculus
ggcatgtcattggtggtgtcatctc

SEQ ID NO: 613290 - DNA, 25 bp, Mus musculus
ggcatgtcccacaatggtccagtaa

SEQ ID NO: 613291 - DNA, 25 bp, Mus musculus
ggcatgtcccactatggtccagtaa

SEQ ID NO: 613292 - DNA, 25 bp, Mus musculus
ggcatgtccctgcagaccaaagaga

SEQ ID NO: 613293 - DNA, 25 bp, Mus musculus
ggcatgtccctggagaccaaagaga

SEQ ID NO: 613294 - DNA, 25 bp, Mus musculus
ggcatgtccgaactcctgggagact

SEQ ID NO: 613295 - DNA, 25 bp, Mus musculus
ggcatgtccgaagtcctgggagact

SEQ ID NO: 613296 - DNA, 25 bp, Mus musculus
ggcatgtcctccatctgtgtaggga

SEQ ID NO: 613297 - DNA, 25 bp, Mus musculus
ggcatgtcctccttctgtgtaggga

SEQ ID NO: 613298 - DNA, 25 bp, Mus musculus
ggcatgtctaaaaggatgtcctcaa

SEQ ID NO: 613299 - DNA, 25 bp, Mus musculus
ggcatgtctaaatggatgtcctcaa

SEQ ID NO: 613300 - DNA, 25 bp, Mus musculus
ggcatgtctaatccaagcagtcaga

SEQ ID NO: 613301 - DNA, 25 bp, Mus musculus
ggcatgtctaatgcaagcagtcaga

SEQ ID NO: 613302 - DNA, 25 bp, Mus musculus
ggcatgtctgaaaccctaaaagcag

SEQ ID NO: 613303 - DNA, 25 bp, Mus musculus
ggcatgtctgaatccctaaaagcag

SEQ ID NO: 613304 - DNA, 25 bp, Mus musculus
ggcatgtctggcaaagaaaattaaa

SEQ ID NO: 613305 - DNA, 25 bp, Mus musculus
ggcatgtctggctaagaaaattaaa

SEQ ID NO: 613306 - DNA, 25 bp, Mus musculus
ggcatgtcttcacaccataaactag

SEQ ID NO: 613307 - DNA, 25 bp, Mus musculus
ggcatgtcttcagaccataaactag

SEQ ID NO: 613308 - DNA, 25 bp, Mus musculus
ggcatgtcttctagaaatcctcgat

SEQ ID NO: 613309 - DNA, 25 bp, Mus musculus
ggcatgtcttcttgaaatcctcgat

SEQ ID NO: 613310 - DNA, 25 bp, Mus musculus
ggcatgtgaacaaagtgtcctaagc

SEQ ID NO: 613311 - DNA, 25 bp, Mus musculus
ggcatgtgaacatagtgtcctaagc

SEQ ID NO: 613312 - DNA, 25 bp, Mus musculus
ggcatgtgaactactcagtaacctg

SEQ ID NO: 613313 - DNA, 25 bp, Mus musculus
ggcatgtgaacttctcagtaacctg

SEQ ID NO: 613314 - DNA, 25 bp, Mus musculus
ggcatgtgacatatttaccaatctc

SEQ ID NO: 613315 - DNA, 25 bp, Mus musculus
ggcatgtgacatttttaccaatctc

SEQ ID NO: 613316 - DNA, 25 bp, Mus musculus
ggcatgtgcggacctacaatcacct

SEQ ID NO: 613317 - DNA, 25 bp, Mus musculus
ggcatgtgcggagctacaatcacct

SEQ ID NO: 613318 - DNA, 25 bp, Mus musculus
ggcatgtgctaaacgttttcaagat

SEQ ID NO: 613319 - DNA, 25 bp, Mus musculus
ggcatgtgctaatcgttttcaagat

SEQ ID NO: 613320 - DNA, 25 bp, Mus musculus
ggcatgtgtaacatggacgtctttt

SEQ ID NO: 613321 - DNA, 25 bp, Mus musculus
ggcatgtgtaacttggacgtctttt

SEQ ID NO: 613322 - DNA, 25 bp, Mus musculus
ggcatgtgtacacggtactctctta

SEQ ID NO: 613323 - DNA, 25 bp, Mus musculus
ggcatgtgtacagggtactctctta

SEQ ID NO: 613324 - DNA, 25 bp, Mus musculus
ggcatgtgtcccctgatggatgaat

SEQ ID NO: 613325 - DNA, 25 bp, Mus musculus
ggcatgtgtcccgtgatggatgaat

SEQ ID NO: 613326 - DNA, 25 bp, Mus musculus
ggcatgtgtgcccatccaaataaaa

SEQ ID NO: 613327 - DNA, 25 bp, Mus musculus
ggcatgtgtgccgatccaaataaaa

SEQ ID NO: 613328 - DNA, 25 bp, Mus musculus
ggcatgtgtgtaccacagtgaccat

SEQ ID NO: 613329 - DNA, 25 bp, Mus musculus
ggcatgtgtgtagcacagtgaccat

SEQ ID NO: 613330 - DNA, 25 bp, Mus musculus
ggcatgtgttctcttattcactaga

SEQ ID NO: 613331 - DNA, 25 bp, Mus musculus
ggcatgtgttctgttattcactaga

SEQ ID NO: 613332 - DNA, 25 bp, Mus musculus
ggcatgttaaaaactgtcctggact

SEQ ID NO: 613333 - DNA, 25 bp, Mus musculus
ggcatgttaaaacctctctgaagta

SEQ ID NO: 613334 - DNA, 25 bp, Mus musculus
ggcatgttaaaagctctctgaagta

SEQ ID NO: 613335 - DNA, 25 bp, Mus musculus
ggcatgttaaaatctgtcctggact

SEQ ID NO: 613336 - DNA, 25 bp, Mus musculus
ggcatgttaacaaacttccataaga

SEQ ID NO: 613337 - DNA, 25 bp, Mus musculus
ggcatgttaacatacttccataaga

SEQ ID NO: 613338 - DNA, 25 bp, Mus musculus
ggcatgttagctacctctccccaag

SEQ ID NO: 613339 - DNA, 25 bp, Mus musculus
ggcatgttagcttcctctccccaag

SEQ ID NO: 613340 - DNA, 25 bp, Mus musculus
ggcatgttatggcagtacccttcaa

SEQ ID NO: 613341 - DNA, 25 bp, Mus musculus
ggcatgttatgggagtacccttcaa

SEQ ID NO: 613342 - DNA, 25 bp, Mus musculus
ggcatgttcaagactgcatctttat

SEQ ID NO: 613343 - DNA, 25 bp, Mus musculus
ggcatgttcaagtctgcatctttat

SEQ ID NO: 613344 - DNA, 25 bp, Mus musculus
ggcatgttgaatactcctttaatcc

SEQ ID NO: 613345 - DNA, 25 bp, Mus musculus
ggcatgttgaattctcctttaatcc

SEQ ID NO: 613346 - DNA, 25 bp, Mus musculus
ggcatgttgacaaagcagcgttact

SEQ ID NO: 613347 - DNA, 25 bp, Mus musculus
ggcatgttgacatagcagcgttact

SEQ ID NO: 613348 - DNA, 25 bp, Mus musculus
ggcatgtttactactagagaccaat

SEQ ID NO: 613349 - DNA, 25 bp, Mus musculus
ggcatgtttacttctagagaccaat

SEQ ID NO: 613350 - DNA, 25 bp, Mus musculus
ggcatgtttaggaagcctcctgtct

SEQ ID NO: 613351 - DNA, 25 bp, Mus musculus
ggcatgtttaggtagcctcctgtct

SEQ ID NO: 613352 - DNA, 25 bp, Mus musculus
ggcatgtttcatacggtttgtcaag

SEQ ID NO: 613353 - DNA, 25 bp, Mus musculus
ggcatgtttcattcggtttgtcaag

SEQ ID NO: 613354 - DNA, 25 bp, Mus musculus
ggcatgttttttatcaatcatcctg

SEQ ID NO: 613355 - DNA, 25 bp, Mus musculus
ggcatgttttttttcaatcatcctg

SEQ ID NO: 613356 - DNA, 25 bp, Mus musculus
ggcattaaaattcgccctcagcacg

SEQ ID NO: 613357 - DNA, 25 bp, Mus musculus
ggcattaaaattggccctcagcacg

SEQ ID NO: 613358 - DNA, 25 bp, Mus musculus
ggcattaacctgacaggctctgtgc

SEQ ID NO: 613359 - DNA, 25 bp, Mus musculus
ggcattaacctgtcaggctctgtgc

SEQ ID NO: 613360 - DNA, 25 bp, Mus musculus
ggcattaacgctaccttagatctga

SEQ ID NO: 613361 - DNA, 25 bp, Mus musculus
ggcattaacgcttccttagatctga

SEQ ID NO: 613362 - DNA, 25 bp, Mus musculus
ggcattaactagcagctcccatggt

SEQ ID NO: 613363 - DNA, 25 bp, Mus musculus
ggcattaactaggagctcccatggt

SEQ ID NO: 613364 - DNA, 25 bp, Mus musculus
ggcattaagtaccattgattccctc

SEQ ID NO: 613365 - DNA, 25 bp, Mus musculus
ggcattaagtacgattgattccctc

SEQ ID NO: 613366 - DNA, 25 bp, Mus musculus
ggcattaagttgcttcctgaggctt

SEQ ID NO: 613367 - DNA, 25 bp, Mus musculus
ggcattaagttggttcctgaggctt

SEQ ID NO: 613368 - DNA, 25 bp, Mus musculus
ggcattaataataccctggcaggga

SEQ ID NO: 613369 - DNA, 25 bp, Mus musculus
ggcattaataattccctggcaggga

SEQ ID NO: 613370 - DNA, 25 bp, Mus musculus
ggcattaatagtcttcccagttcca

SEQ ID NO: 613371 - DNA, 25 bp, Mus musculus
ggcattaatagtgttcccagttcca

SEQ ID NO: 613372 - DNA, 25 bp, Mus musculus
ggcattaatgttattgtcctaatat

SEQ ID NO: 613373 - DNA, 25 bp, Mus musculus
ggcattaatgtttttgtcctaatat

SEQ ID NO: 613374 - DNA, 25 bp, Mus musculus
ggcattacacaaatgttctttctag

SEQ ID NO: 613375 - DNA, 25 bp, Mus musculus
ggcattacacaattgttctttctag

SEQ ID NO: 613376 - DNA, 25 bp, Mus musculus
ggcattacagatctctcctgagcga

SEQ ID NO: 613377 - DNA, 25 bp, Mus musculus
ggcattacagatgtctcctgagcga

SEQ ID NO: 613378 - DNA, 25 bp, Mus musculus
ggcattaccattattcacccaagtt

SEQ ID NO: 613379 - DNA, 25 bp, Mus musculus
ggcattaccatttttcacccaagtt

SEQ ID NO: 613380 - DNA, 25 bp, Mus musculus
ggcattacgaagatctgtactctta

SEQ ID NO: 613381 - DNA, 25 bp, Mus musculus
ggcattacgaagttctgtactctta

SEQ ID NO: 613382 - DNA, 25 bp, Mus musculus
ggcattacgtgcagggtctcacata

SEQ ID NO: 613383 - DNA, 25 bp, Mus musculus
ggcattacgtgctgggtctcacata

SEQ ID NO: 613384 - DNA, 25 bp, Mus musculus
ggcattactaatcaaatacttcact

SEQ ID NO: 613385 - DNA, 25 bp, Mus musculus
ggcattactaatgaaatacttcact

SEQ ID NO: 613386 - DNA, 25 bp, Mus musculus
ggcattagcatcagcagagctcata

SEQ ID NO: 613387 - DNA, 25 bp, Mus musculus
ggcattagcatctgcagagctcata

SEQ ID NO: 613388 - DNA, 25 bp, Mus musculus
ggcattagggctctgttgtgcttaa

SEQ ID NO: 613389 - DNA, 25 bp, Mus musculus
ggcattagggctgtgttgtgcttaa

SEQ ID NO: 613390 - DNA, 25 bp, Mus musculus
ggcattagtttaacacttccatatt

SEQ ID NO: 613391 - DNA, 25 bp, Mus musculus
ggcattagtttatcacttccatatt

SEQ ID NO: 613392 - DNA, 25 bp, Mus musculus
ggcattatcatcaatagcctcaaat

SEQ ID NO: 613393 - DNA, 25 bp, Mus musculus
ggcattatcatctatagcctcaaat

SEQ ID NO: 613394 - DNA, 25 bp, Mus musculus
ggcattatcctgacttaatcaagaa

SEQ ID NO: 613395 - DNA, 25 bp, Mus musculus
ggcattatcctgtcttaatcaagaa

SEQ ID NO: 613396 - DNA, 25 bp, Mus musculus
ggcattatctcaaaatcagcagtct

SEQ ID NO: 613397 - DNA, 25 bp, Mus musculus
ggcattatctcataatcagcagtct

SEQ ID NO: 613398 - DNA, 25 bp, Mus musculus
ggcattatcttcataacccgtgtaa

SEQ ID NO: 613399 - DNA, 25 bp, Mus musculus
ggcattatcttcttaacccgtgtaa

SEQ ID NO: 613400 - DNA, 25 bp, Mus musculus
ggcattatgcttaaatacccttgaa

SEQ ID NO: 613401 - DNA, 25 bp, Mus musculus
ggcattatgctttaatacccttgaa

SEQ ID NO: 613402 - DNA, 25 bp, Mus musculus
ggcattatgtataaaacactcagtt

SEQ ID NO: 613403 - DNA, 25 bp, Mus musculus
ggcattatgtattaaacactcagtt

SEQ ID NO: 613404 - DNA, 25 bp, Mus musculus
ggcattattgccacaatctctgtca

SEQ ID NO: 613405 - DNA, 25 bp, Mus musculus
ggcattattgcctcaatctctgtca

SEQ ID NO: 613406 - DNA, 25 bp, Mus musculus
ggcattatttcgacccataagtact

SEQ ID NO: 613407 - DNA, 25 bp, Mus musculus
ggcattatttcgtcccataagtact

SEQ ID NO: 613408 - DNA, 25 bp, Mus musculus
ggcattcaaggactatacatcagca

SEQ ID NO: 613409 - DNA, 25 bp, Mus musculus
ggcattcaaggagtatacatcagca

SEQ ID NO: 613410 - DNA, 25 bp, Mus musculus
ggcattcacaaacctgattcaattc

SEQ ID NO: 613411 - DNA, 25 bp, Mus musculus
ggcattcacaaagctgattcaattc

SEQ ID NO: 613412 - DNA, 25 bp, Mus musculus
ggcattcacacaccccataaagcaa

SEQ ID NO: 613413 - DNA, 25 bp, Mus musculus
ggcattcacacagcccataaagcaa

SEQ ID NO: 613414 - DNA, 25 bp, Mus musculus
ggcattcacctaaggatgggctgta

SEQ ID NO: 613415 - DNA, 25 bp, Mus musculus
ggcattcacctatggatgggctgta

SEQ ID NO: 613416 - DNA, 25 bp, Mus musculus
ggcattcactctccttatatgcatt

SEQ ID NO: 613417 - DNA, 25 bp, Mus musculus
ggcattcactctgcttatatgcatt

SEQ ID NO: 613418 - DNA, 25 bp, Mus musculus
ggcattcagaataccctacttacta

SEQ ID NO: 613419 - DNA, 25 bp, Mus musculus
ggcattcagaattccctacttacta

SEQ ID NO: 613420 - DNA, 25 bp, Mus musculus
ggcattcagatactctggttactat

SEQ ID NO: 613421 - DNA, 25 bp, Mus musculus
ggcattcagatagtctggttactat

SEQ ID NO: 613422 - DNA, 25 bp, Mus musculus
ggcattcagatcacttgagagttca

SEQ ID NO: 613423 - DNA, 25 bp, Mus musculus
ggcattcagatctcttgagagttca

SEQ ID NO: 613424 - DNA, 25 bp, Mus musculus
ggcattcagctgaatcttaggcatg

SEQ ID NO: 613425 - DNA, 25 bp, Mus musculus
ggcattcagctgtatcttaggcatg

SEQ ID NO: 613426 - DNA, 25 bp, Mus musculus
ggcattcaggcacgaaattcatttt

SEQ ID NO: 613427 - DNA, 25 bp, Mus musculus
ggcattcaggcaggaaattcatttt

SEQ ID NO: 613428 - DNA, 25 bp, Mus musculus
ggcattcagtccacagtgtaatcga

SEQ ID NO: 613429 - DNA, 25 bp, Mus musculus
ggcattcagtcctcagtgtaatcga

SEQ ID NO: 613430 - DNA, 25 bp, Mus musculus
ggcattcatagcagaccatactttt

SEQ ID NO: 613431 - DNA, 25 bp, Mus musculus
ggcattcatagctgaccatactttt

SEQ ID NO: 613432 - DNA, 25 bp, Mus musculus
ggcattcatataagtatccattctg

SEQ ID NO: 613433 - DNA, 25 bp, Mus musculus
ggcattcatatatgtatccattctg

SEQ ID NO: 613434 - DNA, 25 bp, Mus musculus
ggcattcatgagagcattcacacac

SEQ ID NO: 613435 - DNA, 25 bp, Mus musculus
ggcattcatgagtgcattcacacac

SEQ ID NO: 613436 - DNA, 25 bp, Mus musculus
ggcattcatgatcccatcttgtctt

SEQ ID NO: 613437 - DNA, 25 bp, Mus musculus
ggcattcatgatgccatcttgtctt

SEQ ID NO: 613438 - DNA, 25 bp, Mus musculus
ggcattcattaacctctcaagaatt

SEQ ID NO: 613439 - DNA, 25 bp, Mus musculus
ggcattcattaagctctcaagaatt

SEQ ID NO: 613440 - DNA, 25 bp, Mus musculus
ggcattcattcacagattggtccaa

SEQ ID NO: 613441 - DNA, 25 bp, Mus musculus
ggcattcattcagagattggtccaa

SEQ ID NO: 613442 - DNA, 25 bp, Mus musculus
ggcattccacttattaaacccacaa

SEQ ID NO: 613443 - DNA, 25 bp, Mus musculus
ggcattccactttttaaacccacaa

SEQ ID NO: 613444 - DNA, 25 bp, Mus musculus
ggcattccatcgagccgaagaggct

SEQ ID NO: 613445 - DNA, 25 bp, Mus musculus
ggcattccatcgtgccgaagaggct

SEQ ID NO: 613446 - DNA, 25 bp, Mus musculus
ggcattccccaacatatgattggag

SEQ ID NO: 613447 - DNA, 25 bp, Mus musculus
ggcattccccaagatatgattggag

SEQ ID NO: 613448 - DNA, 25 bp, Mus musculus
ggcattcctctgatgcacaggatag

SEQ ID NO: 613449 - DNA, 25 bp, Mus musculus
ggcattcctctgttgcacaggatag

SEQ ID NO: 613450 - DNA, 25 bp, Mus musculus
ggcattcctgctcacagtatgtggg

SEQ ID NO: 613451 - DNA, 25 bp, Mus musculus
ggcattcctgctgacagtatgtggg

SEQ ID NO: 613452 - DNA, 25 bp, Mus musculus
ggcattcgatgcaactatacagtta

SEQ ID NO: 613453 - DNA, 25 bp, Mus musculus
ggcattcgatgctactatacagtta

SEQ ID NO: 613454 - DNA, 25 bp, Mus musculus
ggcattcgctcaacatttacaagtg

SEQ ID NO: 613455 - DNA, 25 bp, Mus musculus
ggcattcgctcatcatttacaagtg

SEQ ID NO: 613456 - DNA, 25 bp, Mus musculus
ggcattctaccccaggtaagacttt

SEQ ID NO: 613457 - DNA, 25 bp, Mus musculus
ggcattctacccgaggtaagacttt

SEQ ID NO: 613458 - DNA, 25 bp, Mus musculus
ggcattctacggcatcctcttcgga

SEQ ID NO: 613459 - DNA, 25 bp, Mus musculus
ggcattctacgggatcctcttcgga

SEQ ID NO: 613460 - DNA, 25 bp, Mus musculus
ggcattctactaaaatatatcttga

SEQ ID NO: 613461 - DNA, 25 bp, Mus musculus
ggcattctactataatatatcttga

SEQ ID NO: 613462 - DNA, 25 bp, Mus musculus
ggcattctagcaaatatgagctcca

SEQ ID NO: 613463 - DNA, 25 bp, Mus musculus
ggcattctagcatatatgagctcca

SEQ ID NO: 613464 - DNA, 25 bp, Mus musculus
ggcattctaggacgcgtctttgtca

SEQ ID NO: 613465 - DNA, 25 bp, Mus musculus
ggcattctaggaggcgtctttgtca

SEQ ID NO: 613466 - DNA, 25 bp, Mus musculus
ggcattctaggtaagaggccacaga

SEQ ID NO: 613467 - DNA, 25 bp, Mus musculus
ggcattctaggttagaggccacaga

SEQ ID NO: 613468 - DNA, 25 bp, Mus musculus
ggcattctatatatcctgcaatgtg

SEQ ID NO: 613469 - DNA, 25 bp, Mus musculus
ggcattctatatttcctgcaatgtg

SEQ ID NO: 613470 - DNA, 25 bp, Mus musculus
ggcattctccagagcgatccagagg

SEQ ID NO: 613471 - DNA, 25 bp, Mus musculus
ggcattctccagtgcgatccagagg

SEQ ID NO: 613472 - DNA, 25 bp, Mus musculus
ggcattctcccaattaaacttctac

SEQ ID NO: 613473 - DNA, 25 bp, Mus musculus
ggcattctcccatttaaacttctac

SEQ ID NO: 613474 - DNA, 25 bp, Mus musculus
ggcattctccttatgtcttggtaac

SEQ ID NO: 613475 - DNA, 25 bp, Mus musculus
ggcattctccttttgtcttggtaac

SEQ ID NO: 613476 - DNA, 25 bp, Mus musculus
ggcattctctttcatatgttcttgg

SEQ ID NO: 613477 - DNA, 25 bp, Mus musculus
ggcattctctttctggtctgaagga

SEQ ID NO: 613478 - DNA, 25 bp, Mus musculus
ggcattctctttgatatgttcttgg

SEQ ID NO: 613479 - DNA, 25 bp, Mus musculus
ggcattctctttgtggtctgaagga

SEQ ID NO: 613480 - DNA, 25 bp, Mus musculus
ggcattctgcttaatacatacactg

SEQ ID NO: 613481 - DNA, 25 bp, Mus musculus
ggcattctgctttatacatacactg

SEQ ID NO: 613482 - DNA, 25 bp, Mus musculus
ggcattctggccacgggctgcagct

SEQ ID NO: 613483 - DNA, 25 bp, Mus musculus
ggcattctggcctcgggctgcagct

SEQ ID NO: 613484 - DNA, 25 bp, Mus musculus
ggcattctgggaccgtgtcattact

SEQ ID NO: 613485 - DNA, 25 bp, Mus musculus
ggcattctgggagcgtgtcattact

SEQ ID NO: 613486 - DNA, 25 bp, Mus musculus
ggcattctgtggactgtcacttgaa

SEQ ID NO: 613487 - DNA, 25 bp, Mus musculus
ggcattctgtggtctgtcacttgaa

SEQ ID NO: 613488 - DNA, 25 bp, Mus musculus
ggcattctgtgtactcttatgttat

SEQ ID NO: 613489 - DNA, 25 bp, Mus musculus
ggcattctgtgttctcttatgttat

SEQ ID NO: 613490 - DNA, 25 bp, Mus musculus
ggcattcttcagaggcattgggcag

SEQ ID NO: 613491 - DNA, 25 bp, Mus musculus
ggcattcttcagtggcattgggcag

SEQ ID NO: 613492 - DNA, 25 bp, Mus musculus
ggcattcttgacagcttcaaatgtt

SEQ ID NO: 613493 - DNA, 25 bp, Mus musculus
ggcattcttgactgcttcaaatgtt

SEQ ID NO: 613494 - DNA, 25 bp, Mus musculus
ggcattcttggaataccctgaggtc

SEQ ID NO: 613495 - DNA, 25 bp, Mus musculus
ggcattcttggattaccctgaggtc

SEQ ID NO: 613496 - DNA, 25 bp, Mus musculus
ggcattcttttcacattactgtgac

SEQ ID NO: 613497 - DNA, 25 bp, Mus musculus
ggcattcttttctcattactgtgac

SEQ ID NO: 613498 - DNA, 25 bp, Mus musculus
ggcattgaaaagaccatagtgtgaa

SEQ ID NO: 613499 - DNA, 25 bp, Mus musculus
ggcattgaaaagtccatagtgtgaa

SEQ ID NO: 613500 - DNA, 25 bp, Mus musculus
ggcattgaagtacttggccaccaaa

SEQ ID NO: 613501 - DNA, 25 bp, Mus musculus
ggcattgaagtagttggccaccaaa

SEQ ID NO: 613502 - DNA, 25 bp, Mus musculus
ggcattgaagttctacaatcctgga

SEQ ID NO: 613503 - DNA, 25 bp, Mus musculus
ggcattgaagttgtacaatcctgga

SEQ ID NO: 613504 - DNA, 25 bp, Mus musculus
ggcattgaatacatcacttgcgtga

SEQ ID NO: 613505 - DNA, 25 bp, Mus musculus
ggcattgaatacttcacttgcgtga

SEQ ID NO: 613506 - DNA, 25 bp, Mus musculus
ggcattgacctgatgatgaaagatg

SEQ ID NO: 613507 - DNA, 25 bp, Mus musculus
ggcattgacctgttgatgaaagatg

SEQ ID NO: 613508 - DNA, 25 bp, Mus musculus
ggcattgacgaccaggacagcttta

SEQ ID NO: 613509 - DNA, 25 bp, Mus musculus
ggcattgacgacgaggacagcttta

SEQ ID NO: 613510 - DNA, 25 bp, Mus musculus
ggcattgactgcctttatacaaatg

SEQ ID NO: 613511 - DNA, 25 bp, Mus musculus
ggcattgactgcgtttatacaaatg

SEQ ID NO: 613512 - DNA, 25 bp, Mus musculus
ggcattgagcaaacaccccaaggtt

SEQ ID NO: 613513 - DNA, 25 bp, Mus musculus
ggcattgagcaatcaccccaaggtt

SEQ ID NO: 613514 - DNA, 25 bp, Mus musculus
ggcattgagcctactactggagaga

SEQ ID NO: 613515 - DNA, 25 bp, Mus musculus
ggcattgagccttctactggagaga

SEQ ID NO: 613516 - DNA, 25 bp, Mus musculus
ggcattgaggacaacttcacactgt

SEQ ID NO: 613517 - DNA, 25 bp, Mus musculus
ggcattgaggactacttcacactgt

SEQ ID NO: 613518 - DNA, 25 bp, Mus musculus
ggcattgataacctttcactggaca

SEQ ID NO: 613519 - DNA, 25 bp, Mus musculus
ggcattgataacgtttcactggaca

SEQ ID NO: 613520 - DNA, 25 bp, Mus musculus
ggcattgatgatatgacacattctt

SEQ ID NO: 613521 - DNA, 25 bp, Mus musculus
ggcattgatgatttgacacattctt

SEQ ID NO: 613522 - DNA, 25 bp, Mus musculus
ggcattgattaactcctgaaccatt

SEQ ID NO: 613523 - DNA, 25 bp, Mus musculus
ggcattgattaagtcctgaaccatt

SEQ ID NO: 613524 - DNA, 25 bp, Mus musculus
ggcattgcacctcacactgttataa

SEQ ID NO: 613525 - DNA, 25 bp, Mus musculus
ggcattgcacctgacactgttataa

SEQ ID NO: 613526 - DNA, 25 bp, Mus musculus
ggcattgcatccaatgtacatcgga

SEQ ID NO: 613527 - DNA, 25 bp, Mus musculus
ggcattgcatcctatgtacatcgga

SEQ ID NO: 613528 - DNA, 25 bp, Mus musculus
ggcattgcatctccttggaacttga

SEQ ID NO: 613529 - DNA, 25 bp, Mus musculus
ggcattgcatctgcttggaacttga

SEQ ID NO: 613530 - DNA, 25 bp, Mus musculus
ggcattgccttccaagccactttag

SEQ ID NO: 613531 - DNA, 25 bp, Mus musculus
ggcattgccttcgaagccactttag

SEQ ID NO: 613532 - DNA, 25 bp, Mus musculus
ggcattgcgatgacagtatttacta

SEQ ID NO: 613533 - DNA, 25 bp, Mus musculus
ggcattgcgatgtcagtatttacta

SEQ ID NO: 613534 - DNA, 25 bp, Mus musculus
ggcattgctcttatctagattgaca

SEQ ID NO: 613535 - DNA, 25 bp, Mus musculus
ggcattgctcttttctagattgaca

SEQ ID NO: 613536 - DNA, 25 bp, Mus musculus
ggcattgctgcaagtaattgtggta

SEQ ID NO: 613537 - DNA, 25 bp, Mus musculus
ggcattgctgcatgtaattgtggta

SEQ ID NO: 613538 - DNA, 25 bp, Mus musculus
ggcattgctgtacaacttgttcctg

SEQ ID NO: 613539 - DNA, 25 bp, Mus musculus
ggcattgctgtagaacttgttcctg

SEQ ID NO: 613540 - DNA, 25 bp, Mus musculus
ggcattgctgtgatagtatgtttat

SEQ ID NO: 613541 - DNA, 25 bp, Mus musculus
ggcattgctgtgcaggacctctgaa

SEQ ID NO: 613542 - DNA, 25 bp, Mus musculus
ggcattgctgtggaggacctctgaa

SEQ ID NO: 613543 - DNA, 25 bp, Mus musculus
ggcattgctgtgttagtatgtttat

SEQ ID NO: 613544 - DNA, 25 bp, Mus musculus
ggcattgcttgcattcacatggata

SEQ ID NO: 613545 - DNA, 25 bp, Mus musculus
ggcattgcttgctttcacatggata

SEQ ID NO: 613546 - DNA, 25 bp, Mus musculus
ggcattgctttccttgctgaaccca

SEQ ID NO: 613547 - DNA, 25 bp, Mus musculus
ggcattgctttcgttgctgaaccca

SEQ ID NO: 613548 - DNA, 25 bp, Mus musculus
ggcattggaagaaattcttttacat

SEQ ID NO: 613549 - DNA, 25 bp, Mus musculus
ggcattggaagatattcttttacat

SEQ ID NO: 613550 - DNA, 25 bp, Mus musculus
ggcattggagatctggcccattctc

SEQ ID NO: 613551 - DNA, 25 bp, Mus musculus
ggcattggagatgtggcccattctc

SEQ ID NO: 613552 - DNA, 25 bp, Mus musculus
ggcattggatcccatgagtttagga

SEQ ID NO: 613553 - DNA, 25 bp, Mus musculus
ggcattggatccgatgagtttagga

SEQ ID NO: 613554 - DNA, 25 bp, Mus musculus
ggcattggatctctgtgaacggtta

SEQ ID NO: 613555 - DNA, 25 bp, Mus musculus
ggcattggatctgtgtgaacggtta

SEQ ID NO: 613556 - DNA, 25 bp, Mus musculus
ggcattggccctcacctaggagtca

SEQ ID NO: 613557 - DNA, 25 bp, Mus musculus
ggcattggccctgacctaggagtca

SEQ ID NO: 613558 - DNA, 25 bp, Mus musculus
ggcattggctatcaccttgaggaca

SEQ ID NO: 613559 - DNA, 25 bp, Mus musculus
ggcattggctatgaccttgaggaca

SEQ ID NO: 613560 - DNA, 25 bp, Mus musculus
ggcattggctttcgtatcacaggga

SEQ ID NO: 613561 - DNA, 25 bp, Mus musculus
ggcattggctttggtatcacaggga

SEQ ID NO: 613562 - DNA, 25 bp, Mus musculus
ggcattggtcagattgcagtgttga

SEQ ID NO: 613563 - DNA, 25 bp, Mus musculus
ggcattggtcagtttgcagtgttga

SEQ ID NO: 613564 - DNA, 25 bp, Mus musculus
ggcattggtggtcgccagttctcaa

SEQ ID NO: 613565 - DNA, 25 bp, Mus musculus
ggcattggtggtggccagttctcaa

SEQ ID NO: 613566 - DNA, 25 bp, Mus musculus
ggcattggtttgctacagcgagctc

SEQ ID NO: 613567 - DNA, 25 bp, Mus musculus
ggcattggtttggtacagcgagctc

SEQ ID NO: 613568 - DNA, 25 bp, Mus musculus
ggcattggttttcatcaagatgtcc

SEQ ID NO: 613569 - DNA, 25 bp, Mus musculus
ggcattggttttgatcaagatgtcc

SEQ ID NO: 613570 - DNA, 25 bp, Mus musculus
ggcattgtagccctgatttcaaaaa

SEQ ID NO: 613571 - DNA, 25 bp, Mus musculus
ggcattgtagccgtgatttcaaaaa

SEQ ID NO: 613572 - DNA, 25 bp, Mus musculus
ggcattgtatagcacagagccctgg

SEQ ID NO: 613573 - DNA, 25 bp, Mus musculus
ggcattgtataggacagagccctgg

SEQ ID NO: 613574 - DNA, 25 bp, Mus musculus
ggcattgtatcgagggccggaattt

SEQ ID NO: 613575 - DNA, 25 bp, Mus musculus
ggcattgtatcgtgggccggaattt

SEQ ID NO: 613576 - DNA, 25 bp, Mus musculus
ggcattgtcacgagcttgagagcaa

SEQ ID NO: 613577 - DNA, 25 bp, Mus musculus
ggcattgtcacgtgcttgagagcaa

SEQ ID NO: 613578 - DNA, 25 bp, Mus musculus
ggcattgtccatatctcttttaacg

SEQ ID NO: 613579 - DNA, 25 bp, Mus musculus
ggcattgtccatttctcttttaacg

SEQ ID NO: 613580 - DNA, 25 bp, Mus musculus
ggcattgtccgcatactgatagatt

SEQ ID NO: 613581 - DNA, 25 bp, Mus musculus
ggcattgtccgcttactgatagatt

SEQ ID NO: 613582 - DNA, 25 bp, Mus musculus
ggcattgtctttcgtgttgttcaaa

SEQ ID NO: 613583 - DNA, 25 bp, Mus musculus
ggcattgtctttggtgttgttcaaa

SEQ ID NO: 613584 - DNA, 25 bp, Mus musculus
ggcattgtgcgcaaaagcttagaat

SEQ ID NO: 613585 - DNA, 25 bp, Mus musculus
ggcattgtgcgctaaagcttagaat

SEQ ID NO: 613586 - DNA, 25 bp, Mus musculus
ggcattgtggataatcagactctag

SEQ ID NO: 613587 - DNA, 25 bp, Mus musculus
ggcattgtggattatcagactctag

SEQ ID NO: 613588 - DNA, 25 bp, Mus musculus
ggcattgtggctatggttgaccatc

SEQ ID NO: 613589 - DNA, 25 bp, Mus musculus
ggcattgtggctttggttgaccatc

SEQ ID NO: 613590 - DNA, 25 bp, Mus musculus
ggcattgtggtgagatgtagctaac

SEQ ID NO: 613591 - DNA, 25 bp, Mus musculus
ggcattgtggtgtgatgtagctaac

SEQ ID NO: 613592 - DNA, 25 bp, Mus musculus
ggcattgttagacttacgccaagaa

SEQ ID NO: 613593 - DNA, 25 bp, Mus musculus
ggcattgttagagttacgccaagaa

SEQ ID NO: 613594 - DNA, 25 bp, Mus musculus
ggcattgttatactgagaggtctct

SEQ ID NO: 613595 - DNA, 25 bp, Mus musculus
ggcattgttatagtgagaggtctct

SEQ ID NO: 613596 - DNA, 25 bp, Mus musculus
ggcattgttccaagacctgtttgaa

SEQ ID NO: 613597 - DNA, 25 bp, Mus musculus
ggcattgttccatgacctgtttgaa

SEQ ID NO: 613598 - DNA, 25 bp, Mus musculus
ggcattgttggaagtcctacctaca

SEQ ID NO: 613599 - DNA, 25 bp, Mus musculus
ggcattgttggatgtcctacctaca

SEQ ID NO: 613600 - DNA, 25 bp, Mus musculus
ggcattgttggtaaacgttctgcag

SEQ ID NO: 613601 - DNA, 25 bp, Mus musculus
ggcattgttggttaacgttctgcag

SEQ ID NO: 613602 - DNA, 25 bp, Mus musculus
ggcatttaaagcctactgtctgtaa

SEQ ID NO: 613603 - DNA, 25 bp, Mus musculus
ggcatttaaagcgtactgtctgtaa

SEQ ID NO: 613604 - DNA, 25 bp, Mus musculus
ggcatttaaggcagccacatgaaat

SEQ ID NO: 613605 - DNA, 25 bp, Mus musculus
ggcatttaaggctgccacatgaaat

SEQ ID NO: 613606 - DNA, 25 bp, Mus musculus
ggcatttaatgtcctaccttagaga

SEQ ID NO: 613607 - DNA, 25 bp, Mus musculus
ggcatttaatgtgctaccttagaga

SEQ ID NO: 613608 - DNA, 25 bp, Mus musculus
ggcatttacagacaagcttcccgtg

SEQ ID NO: 613609 - DNA, 25 bp, Mus musculus
ggcatttacagagaagcttcccgtg

SEQ ID NO: 613610 - DNA, 25 bp, Mus musculus
ggcatttacagtccatttcctttct

SEQ ID NO: 613611 - DNA, 25 bp, Mus musculus
ggcatttacagtgcatttcctttct

SEQ ID NO: 613612 - DNA, 25 bp, Mus musculus
ggcatttaccacaaaccagaccaaa

SEQ ID NO: 613613 - DNA, 25 bp, Mus musculus
ggcatttaccactaaccagaccaaa

SEQ ID NO: 613614 - DNA, 25 bp, Mus musculus
ggcatttaccttaggaaacagtcct

SEQ ID NO: 613615 - DNA, 25 bp, Mus musculus
ggcatttacctttggaaacagtcct

SEQ ID NO: 613616 - DNA, 25 bp, Mus musculus
ggcatttacgacctgagaccctcag

SEQ ID NO: 613617 - DNA, 25 bp, Mus musculus
ggcatttacgacgtgagaccctcag

SEQ ID NO: 613618 - DNA, 25 bp, Mus musculus
ggcatttagatccaaacagagaact

SEQ ID NO: 613619 - DNA, 25 bp, Mus musculus
ggcatttagatcgaaacagagaact

SEQ ID NO: 613620 - DNA, 25 bp, Mus musculus
ggcatttatcctaggcagtactaca

SEQ ID NO: 613621 - DNA, 25 bp, Mus musculus
ggcatttatccttggcagtactaca

SEQ ID NO: 613622 - DNA, 25 bp, Mus musculus
ggcatttatcttcaagtctgctctt

SEQ ID NO: 613623 - DNA, 25 bp, Mus musculus
ggcatttatcttgaagtctgctctt

SEQ ID NO: 613624 - DNA, 25 bp, Mus musculus
ggcatttatgcaagaatcactggct

SEQ ID NO: 613625 - DNA, 25 bp, Mus musculus
ggcatttatgcatgaatcactggct

SEQ ID NO: 613626 - DNA, 25 bp, Mus musculus
ggcatttatggcaggacacagtgca

SEQ ID NO: 613627 - DNA, 25 bp, Mus musculus
ggcatttatggctggacacagtgca

SEQ ID NO: 613628 - DNA, 25 bp, Mus musculus
ggcatttcaaatcgcgttggcacgc

SEQ ID NO: 613629 - DNA, 25 bp, Mus musculus
ggcatttcaaatggcgttggcacgc

SEQ ID NO: 613630 - DNA, 25 bp, Mus musculus
ggcatttcagatcgttactgtctct

SEQ ID NO: 613631 - DNA, 25 bp, Mus musculus
ggcatttcagatggttactgtctct

SEQ ID NO: 613632 - DNA, 25 bp, Mus musculus
ggcatttcagctcacaacctgactt

SEQ ID NO: 613633 - DNA, 25 bp, Mus musculus
ggcatttcagctgacaacctgactt

SEQ ID NO: 613634 - DNA, 25 bp, Mus musculus
ggcatttcagtaatttcagcgtttt

SEQ ID NO: 613635 - DNA, 25 bp, Mus musculus
ggcatttcagtattttcagcgtttt

SEQ ID NO: 613636 - DNA, 25 bp, Mus musculus
ggcatttcataaagttcacctcatg

SEQ ID NO: 613637 - DNA, 25 bp, Mus musculus
ggcatttcataatgttcacctcatg

SEQ ID NO: 613638 - DNA, 25 bp, Mus musculus
ggcatttcattcaacatggcgctga

SEQ ID NO: 613639 - DNA, 25 bp, Mus musculus
ggcatttcattctacatggcgctga

SEQ ID NO: 613640 - DNA, 25 bp, Mus musculus
ggcatttccactctcaacaagctga

SEQ ID NO: 613641 - DNA, 25 bp, Mus musculus
ggcatttccactgtcaacaagctga

SEQ ID NO: 613642 - DNA, 25 bp, Mus musculus
ggcatttccagaacacaaaccttca

SEQ ID NO: 613643 - DNA, 25 bp, Mus musculus
ggcatttccagatcacaaaccttca

SEQ ID NO: 613644 - DNA, 25 bp, Mus musculus
ggcatttccccgatccatgaattcg

SEQ ID NO: 613645 - DNA, 25 bp, Mus musculus
ggcatttccccgttccatgaattcg

SEQ ID NO: 613646 - DNA, 25 bp, Mus musculus
ggcatttcctcaaagataaagatgt

SEQ ID NO: 613647 - DNA, 25 bp, Mus musculus
ggcatttcctcatagataaagatgt

SEQ ID NO: 613648 - DNA, 25 bp, Mus musculus
ggcatttcgtgccagtaattccagc

SEQ ID NO: 613649 - DNA, 25 bp, Mus musculus
ggcatttcgtgcgagtaattccagc

SEQ ID NO: 613650 - DNA, 25 bp, Mus musculus
ggcatttctagacagcgttcaacct

SEQ ID NO: 613651 - DNA, 25 bp, Mus musculus
ggcatttctagagagcgttcaacct

SEQ ID NO: 613652 - DNA, 25 bp, Mus musculus
ggcatttctataccctctcttagga

SEQ ID NO: 613653 - DNA, 25 bp, Mus musculus
ggcatttctatagcctctcttagga

SEQ ID NO: 613654 - DNA, 25 bp, Mus musculus
ggcatttctatcagtactgggctca

SEQ ID NO: 613655 - DNA, 25 bp, Mus musculus
ggcatttctatctgtactgggctca

SEQ ID NO: 613656 - DNA, 25 bp, Mus musculus
ggcatttctctgcaagctgtgactg

SEQ ID NO: 613657 - DNA, 25 bp, Mus musculus
ggcatttctctggaagctgtgactg

SEQ ID NO: 613658 - DNA, 25 bp, Mus musculus
ggcatttctgaaccatcgctgtttt

SEQ ID NO: 613659 - DNA, 25 bp, Mus musculus
ggcatttctgaagcatcgctgtttt

SEQ ID NO: 613660 - DNA, 25 bp, Mus musculus
ggcatttctgtactgggcaagattt

SEQ ID NO: 613661 - DNA, 25 bp, Mus musculus
ggcatttctgtacttgcacaagaac

SEQ ID NO: 613662 - DNA, 25 bp, Mus musculus
ggcatttctgtagtgggcaagattt

SEQ ID NO: 613663 - DNA, 25 bp, Mus musculus
ggcatttctgtagttgcacaagaac

SEQ ID NO: 613664 - DNA, 25 bp, Mus musculus
ggcatttgaatcacttaccttgaag

SEQ ID NO: 613665 - DNA, 25 bp, Mus musculus
ggcatttgaatctcttaccttgaag

SEQ ID NO: 613666 - DNA, 25 bp, Mus musculus
ggcatttgacataggtgcctgtctg

SEQ ID NO: 613667 - DNA, 25 bp, Mus musculus
ggcatttgacattggtgcctgtctg

SEQ ID NO: 613668 - DNA, 25 bp, Mus musculus
ggcatttgaggtcgcttaccaacta

SEQ ID NO: 613669 - DNA, 25 bp, Mus musculus
ggcatttgaggtggcttaccaacta

SEQ ID NO: 613670 - DNA, 25 bp, Mus musculus
ggcatttgataccattacctttagg

SEQ ID NO: 613671 - DNA, 25 bp, Mus musculus
ggcatttgatacgattacctttagg

SEQ ID NO: 613672 - DNA, 25 bp, Mus musculus
ggcatttgatgtacatgtatcattt

SEQ ID NO: 613673 - DNA, 25 bp, Mus musculus
ggcatttgatgttcatgtatcattt

SEQ ID NO: 613674 - DNA, 25 bp, Mus musculus
ggcatttgcaaccagtgaccaacca

SEQ ID NO: 613675 - DNA, 25 bp, Mus musculus
ggcatttgcaacgagtgaccaacca

SEQ ID NO: 613676 - DNA, 25 bp, Mus musculus
ggcatttgcacaaatatttgtactc

SEQ ID NO: 613677 - DNA, 25 bp, Mus musculus
ggcatttgcacatatatttgtactc

SEQ ID NO: 613678 - DNA, 25 bp, Mus musculus
ggcatttgcatcaaattgctgaaca

SEQ ID NO: 613679 - DNA, 25 bp, Mus musculus
ggcatttgcatctaattgctgaaca

SEQ ID NO: 613680 - DNA, 25 bp, Mus musculus
ggcatttgcattcccctgacaaagg

SEQ ID NO: 613681 - DNA, 25 bp, Mus musculus
ggcatttgcattgccctgacaaagg

SEQ ID NO: 613682 - DNA, 25 bp, Mus musculus
ggcatttgccaccaatcctaagaac

SEQ ID NO: 613683 - DNA, 25 bp, Mus musculus
ggcatttgccacgaatcctaagaac

SEQ ID NO: 613684 - DNA, 25 bp, Mus musculus
ggcatttgcggcataatcggctccg

SEQ ID NO: 613685 - DNA, 25 bp, Mus musculus
ggcatttgcggcttaatcggctccg

SEQ ID NO: 613686 - DNA, 25 bp, Mus musculus
ggcatttggaatagcgttctcccag

SEQ ID NO: 613687 - DNA, 25 bp, Mus musculus
ggcatttggaattgcgttctcccag

SEQ ID NO: 613688 - DNA, 25 bp, Mus musculus
ggcatttggactacttaaggacgtt

SEQ ID NO: 613689 - DNA, 25 bp, Mus musculus
ggcatttggacttcttaaggacgtt

SEQ ID NO: 613690 - DNA, 25 bp, Mus musculus
ggcatttggagaaacccgagcgaga

SEQ ID NO: 613691 - DNA, 25 bp, Mus musculus
ggcatttggagatacccgagcgaga

SEQ ID NO: 613692 - DNA, 25 bp, Mus musculus
ggcatttgggacattctggttgcta

SEQ ID NO: 613693 - DNA, 25 bp, Mus musculus
ggcatttgggactttctggttgcta

SEQ ID NO: 613694 - DNA, 25 bp, Mus musculus
ggcatttgggagacaacgccctctt

SEQ ID NO: 613695 - DNA, 25 bp, Mus musculus
ggcatttgggagtcaacgccctctt

SEQ ID NO: 613696 - DNA, 25 bp, Mus musculus
ggcatttgtgaaatcacaatttcat

SEQ ID NO: 613697 - DNA, 25 bp, Mus musculus
ggcatttgtgaattcacaatttcat

SEQ ID NO: 613698 - DNA, 25 bp, Mus musculus
ggcatttgtgataatctctctcctc

SEQ ID NO: 613699 - DNA, 25 bp, Mus musculus
ggcatttgtgattatctctctcctc

SEQ ID NO: 613700 - DNA, 25 bp, Mus musculus
ggcatttgttaccacgacagagtct

SEQ ID NO: 613701 - DNA, 25 bp, Mus musculus
ggcatttgttacgacgacagagtct

SEQ ID NO: 613702 - DNA, 25 bp, Mus musculus
ggcatttgtttgaaattgtattgaa

SEQ ID NO: 613703 - DNA, 25 bp, Mus musculus
ggcatttgtttgtaattgtattgaa

SEQ ID NO: 613704 - DNA, 25 bp, Mus musculus
ggcattttacctctgtggcagcaat

SEQ ID NO: 613705 - DNA, 25 bp, Mus musculus
ggcattttacctgtgtggcagcaat

SEQ ID NO: 613706 - DNA, 25 bp, Mus musculus
ggcattttatagattctgagctgga

SEQ ID NO: 613707 - DNA, 25 bp, Mus musculus
ggcattttatagtttctgagctgga

SEQ ID NO: 613708 - DNA, 25 bp, Mus musculus
ggcattttcatgaatcaactttttg

SEQ ID NO: 613709 - DNA, 25 bp, Mus musculus
ggcattttcatgtatcaactttttg

SEQ ID NO: 613710 - DNA, 25 bp, Mus musculus
ggcattttccagcattaatgtaaag

SEQ ID NO: 613711 - DNA, 25 bp, Mus musculus
ggcattttccaggattaatgtaaag

SEQ ID NO: 613712 - DNA, 25 bp, Mus musculus
ggcattttccgactggttaagtcag

SEQ ID NO: 613713 - DNA, 25 bp, Mus musculus
ggcattttccgagtggttaagtcag

SEQ ID NO: 613714 - DNA, 25 bp, Mus musculus
ggcattttctacatctaatgtggga

SEQ ID NO: 613715 - DNA, 25 bp, Mus musculus
ggcattttctacttctaatgtggga

SEQ ID NO: 613716 - DNA, 25 bp, Mus musculus
ggcattttgcacatctaacatctct

SEQ ID NO: 613717 - DNA, 25 bp, Mus musculus
ggcattttgcacttctaacatctct

SEQ ID NO: 613718 - DNA, 25 bp, Mus musculus
ggcattttgcctcaaatatatccaa

SEQ ID NO: 613719 - DNA, 25 bp, Mus musculus
ggcattttgcctgaaatatatccaa

SEQ ID NO: 613720 - DNA, 25 bp, Mus musculus
ggcattttggatcccaagccaccaa

SEQ ID NO: 613721 - DNA, 25 bp, Mus musculus
ggcattttggatgccaagccaccaa

SEQ ID NO: 613722 - DNA, 25 bp, Mus musculus
ggcattttggttatcagtcgtaaca

SEQ ID NO: 613723 - DNA, 25 bp, Mus musculus
ggcattttggttttcagtcgtaaca

SEQ ID NO: 613724 - DNA, 25 bp, Mus musculus
ggcattttgtcaccttgtcaagggt

SEQ ID NO: 613725 - DNA, 25 bp, Mus musculus
ggcattttgtcagcttgtcaagggt

SEQ ID NO: 613726 - DNA, 25 bp, Mus musculus
ggcattttgtctcttggctgcaatc

SEQ ID NO: 613727 - DNA, 25 bp, Mus musculus
ggcattttgtctgttggctgcaatc

SEQ ID NO: 613728 - DNA, 25 bp, Mus musculus
ggcattttgtggacataagcttgga

SEQ ID NO: 613729 - DNA, 25 bp, Mus musculus
ggcattttgtggtcataagcttgga

SEQ ID NO: 613730 - DNA, 25 bp, Mus musculus
ggcatttttacaactcctgggtatt

SEQ ID NO: 613731 - DNA, 25 bp, Mus musculus
ggcatttttacatctcctgggtatt

SEQ ID NO: 613732 - DNA, 25 bp, Mus musculus
ggcatttttattatcctgtgtactt

SEQ ID NO: 613733 - DNA, 25 bp, Mus musculus
ggcatttttattttcctgtgtactt

SEQ ID NO: 613734 - DNA, 25 bp, Mus musculus
ggcatttttccactctcagtgtgaa

SEQ ID NO: 613735 - DNA, 25 bp, Mus musculus
ggcatttttccagtctcagtgtgaa

SEQ ID NO: 613736 - DNA, 25 bp, Mus musculus
ggcatttttctaaagctagagattc

SEQ ID NO: 613737 - DNA, 25 bp, Mus musculus
ggcatttttctatagctagagattc

SEQ ID NO: 613738 - DNA, 25 bp, Mus musculus
ggcattttttccactttgggcattc

SEQ ID NO: 613739 - DNA, 25 bp, Mus musculus
ggcattttttcctctttgggcattc

SEQ ID NO: 613740 - DNA, 25 bp, Mus musculus
ggccaaaaatgaatgtccctcacaa

SEQ ID NO: 613741 - DNA, 25 bp, Mus musculus
ggccaaaaatgattgtccctcacaa

SEQ ID NO: 613742 - DNA, 25 bp, Mus musculus
ggccaaaacagtcttcttagccgtt

SEQ ID NO: 613743 - DNA, 25 bp, Mus musculus
ggccaaaacagtgttcttagccgtt

SEQ ID NO: 613744 - DNA, 25 bp, Mus musculus
ggccaaaaggcgctactcaactcac

SEQ ID NO: 613745 - DNA, 25 bp, Mus musculus
ggccaaaaggcggtactcaactcac

SEQ ID NO: 613746 - DNA, 25 bp, Mus musculus
ggccaaaatcacaggcaagggcaag

SEQ ID NO: 613747 - DNA, 25 bp, Mus musculus
ggccaaaatcactggcaagggcaag

SEQ ID NO: 613748 - DNA, 25 bp, Mus musculus
ggccaaaattgtactcaactgtgac

SEQ ID NO: 613749 - DNA, 25 bp, Mus musculus
ggccaaaattgttctcaactgtgac

SEQ ID NO: 613750 - DNA, 25 bp, Mus musculus
ggccaaacatatcccaccgagtggt

SEQ ID NO: 613751 - DNA, 25 bp, Mus musculus
ggccaaacatatgccaccgagtggt

SEQ ID NO: 613752 - DNA, 25 bp, Mus musculus
ggccaaacatggaactacctcacta

SEQ ID NO: 613753 - DNA, 25 bp, Mus musculus
ggccaaacatggtactacctcacta

SEQ ID NO: 613754 - DNA, 25 bp, Mus musculus
ggccaaaccgctcatgcagaaatgt

SEQ ID NO: 613755 - DNA, 25 bp, Mus musculus
ggccaaaccgctgatgcagaaatgt

SEQ ID NO: 613756 - DNA, 25 bp, Mus musculus
ggccaaacctatataaatcaacaca

SEQ ID NO: 613757 - DNA, 25 bp, Mus musculus
ggccaaacctatttaaatcaacaca

SEQ ID NO: 613758 - DNA, 25 bp, Mus musculus
ggccaaacgactcgacatacacgat

SEQ ID NO: 613759 - DNA, 25 bp, Mus musculus
ggccaaacgactggacatacacgat

SEQ ID NO: 613760 - DNA, 25 bp, Mus musculus
ggccaaactctgcagtcactgactg

SEQ ID NO: 613761 - DNA, 25 bp, Mus musculus
ggccaaactctggagtcactgactg

SEQ ID NO: 613762 - DNA, 25 bp, Mus musculus
ggccaaactgccagagatctggtgc

SEQ ID NO: 613763 - DNA, 25 bp, Mus musculus
ggccaaactgcctgagatctggtgc

SEQ ID NO: 613764 - DNA, 25 bp, Mus musculus
ggccaaagaccgcaacaacaactgt

SEQ ID NO: 613765 - DNA, 25 bp, Mus musculus
ggccaaagaccggaacaacaactgt

SEQ ID NO: 613766 - DNA, 25 bp, Mus musculus
ggccaaagcaaaagacttctgtaac

SEQ ID NO: 613767 - DNA, 25 bp, Mus musculus
ggccaaagcaaatgacttctgtaac

SEQ ID NO: 613768 - DNA, 25 bp, Mus musculus
ggccaaagcagacactaaatatttt

SEQ ID NO: 613769 - DNA, 25 bp, Mus musculus
ggccaaagcagagactaaatatttt

SEQ ID NO: 613770 - DNA, 25 bp, Mus musculus
ggccaaagcattccctgaggagttt

SEQ ID NO: 613771 - DNA, 25 bp, Mus musculus
ggccaaagcattgcctgaggagttt

SEQ ID NO: 613772 - DNA, 25 bp, Mus musculus
ggccaaaggatgcttttggaactca

SEQ ID NO: 613773 - DNA, 25 bp, Mus musculus
ggccaaaggatggttttggaactca

SEQ ID NO: 613774 - DNA, 25 bp, Mus musculus
ggccaaaggcagatatctctttccc

SEQ ID NO: 613775 - DNA, 25 bp, Mus musculus
ggccaaaggcagttatctctttccc

SEQ ID NO: 613776 - DNA, 25 bp, Mus musculus
ggccaaagtcaaaaaccccaagtag

SEQ ID NO: 613777 - DNA, 25 bp, Mus musculus
ggccaaagtcaataaccccaagtag

SEQ ID NO: 613778 - DNA, 25 bp, Mus musculus
ggccaaagtcacaaaccccaagtga

SEQ ID NO: 613779 - DNA, 25 bp, Mus musculus
ggccaaagtcactaaccccaagtga

SEQ ID NO: 613780 - DNA, 25 bp, Mus musculus
ggccaaagtcatccgcctgattttt

SEQ ID NO: 613781 - DNA, 25 bp, Mus musculus
ggccaaagtcatgcgcctgattttt

SEQ ID NO: 613782 - DNA, 25 bp, Mus musculus
ggccaaagtgccagtatatcatgtc

SEQ ID NO: 613783 - DNA, 25 bp, Mus musculus
ggccaaagtgcctgtatatcatgtc

SEQ ID NO: 613784 - DNA, 25 bp, Mus musculus
ggccaaagttcacaatgggcaggca

SEQ ID NO: 613785 - DNA, 25 bp, Mus musculus
ggccaaagttcagaatgggcaggca

SEQ ID NO: 613786 - DNA, 25 bp, Mus musculus
ggccaaatagttccacaaccaatca

SEQ ID NO: 613787 - DNA, 25 bp, Mus musculus
ggccaaatagttgcacaaccaatca

SEQ ID NO: 613788 - DNA, 25 bp, Mus musculus
ggccaaatcatcaattgacacctgt

SEQ ID NO: 613789 - DNA, 25 bp, Mus musculus
ggccaaatcatctattgacacctgt

SEQ ID NO: 613790 - DNA, 25 bp, Mus musculus
ggccaaatcttccagttaaacttga

SEQ ID NO: 613791 - DNA, 25 bp, Mus musculus
ggccaaatcttcgagttaaacttga

SEQ ID NO: 613792 - DNA, 25 bp, Mus musculus
ggccaaatgactctgggaacttcct

SEQ ID NO: 613793 - DNA, 25 bp, Mus musculus
ggccaaatgactgtgggaacttcct

SEQ ID NO: 613794 - DNA, 25 bp, Mus musculus
ggccaaatggctattgcagtccttt

SEQ ID NO: 613795 - DNA, 25 bp, Mus musculus
ggccaaatggcttttgcagtccttt

SEQ ID NO: 613796 - DNA, 25 bp, Mus musculus
ggccaaatggtcattacacaggcaa

SEQ ID NO: 613797 - DNA, 25 bp, Mus musculus
ggccaaatggtctttacacaggcaa

SEQ ID NO: 613798 - DNA, 25 bp, Mus musculus
ggccaaatgtggcagcatctgtctg

SEQ ID NO: 613799 - DNA, 25 bp, Mus musculus
ggccaaatgtgggagcatctgtctg

SEQ ID NO: 613800 - DNA, 25 bp, Mus musculus
ggccaaattcaactagttcctgggt

SEQ ID NO: 613801 - DNA, 25 bp, Mus musculus
ggccaaattcaagtagttcctgggt

SEQ ID NO: 613802 - DNA, 25 bp, Mus musculus
ggccaaattcttacagactgatcct

SEQ ID NO: 613803 - DNA, 25 bp, Mus musculus
ggccaaattctttcagactgatcct

SEQ ID NO: 613804 - DNA, 25 bp, Mus musculus
ggccaaattgacatacacacaccca

SEQ ID NO: 613805 - DNA, 25 bp, Mus musculus
ggccaaattgacttacacacaccca

SEQ ID NO: 613806 - DNA, 25 bp, Mus musculus
ggccaaattgccctacagataaatg

SEQ ID NO: 613807 - DNA, 25 bp, Mus musculus
ggccaaattgccgtacagataaatg

SEQ ID NO: 613808 - DNA, 25 bp, Mus musculus
ggccaaattgctcaacacagactgt

SEQ ID NO: 613809 - DNA, 25 bp, Mus musculus
ggccaaattgctgaacacagactgt

SEQ ID NO: 613810 - DNA, 25 bp, Mus musculus
ggccaaattgggatcctaacctaag

SEQ ID NO: 613811 - DNA, 25 bp, Mus musculus
ggccaaattgggttcctaacctaag

SEQ ID NO: 613812 - DNA, 25 bp, Mus musculus
ggccaaatttaacatgttgtttcaa

SEQ ID NO: 613813 - DNA, 25 bp, Mus musculus
ggccaaatttaagatgttgtttcaa

SEQ ID NO: 613814 - DNA, 25 bp, Mus musculus
ggccaaatttaccacaactgctgac

SEQ ID NO: 613815 - DNA, 25 bp, Mus musculus
ggccaaatttacgacaactgctgac

SEQ ID NO: 613816 - DNA, 25 bp, Mus musculus
ggccaaatttgaatccctcttcaga

SEQ ID NO: 613817 - DNA, 25 bp, Mus musculus
ggccaaatttgaccacctcaaaaga

SEQ ID NO: 613818 - DNA, 25 bp, Mus musculus
ggccaaatttgagcacctcaaaaga

SEQ ID NO: 613819 - DNA, 25 bp, Mus musculus
ggccaaatttgattccctcttcaga

SEQ ID NO: 613820 - DNA, 25 bp, Mus musculus
ggccaacaaattactccaacccagt

SEQ ID NO: 613821 - DNA, 25 bp, Mus musculus
ggccaacaaatttctccaacccagt

SEQ ID NO: 613822 - DNA, 25 bp, Mus musculus
ggccaacaataacctgcagacactg

SEQ ID NO: 613823 - DNA, 25 bp, Mus musculus
ggccaacaataagctgcagacactg

SEQ ID NO: 613824 - DNA, 25 bp, Mus musculus
ggccaacagaaccagcagtgacagc

SEQ ID NO: 613825 - DNA, 25 bp, Mus musculus
ggccaacagaacgagcagtgacagc

SEQ ID NO: 613826 - DNA, 25 bp, Mus musculus
ggccaacagagcctcacatgcatgg

SEQ ID NO: 613827 - DNA, 25 bp, Mus musculus
ggccaacagagcgtcacatgcatgg

SEQ ID NO: 613828 - DNA, 25 bp, Mus musculus
ggccaacagtgcaacccaggagaga

SEQ ID NO: 613829 - DNA, 25 bp, Mus musculus
ggccaacagtgctacccaggagaga

SEQ ID NO: 613830 - DNA, 25 bp, Mus musculus
ggccaacatatcaaatagggacaat

SEQ ID NO: 613831 - DNA, 25 bp, Mus musculus
ggccaacatatctaatagggacaat

SEQ ID NO: 613832 - DNA, 25 bp, Mus musculus
ggccaacatgagattcgtcccagga

SEQ ID NO: 613833 - DNA, 25 bp, Mus musculus
ggccaacatgagtttcgtcccagga

SEQ ID NO: 613834 - DNA, 25 bp, Mus musculus
ggccaacatgttacttcagtatctg

SEQ ID NO: 613835 - DNA, 25 bp, Mus musculus
ggccaacatgtttcttcagtatctg

SEQ ID NO: 613836 - DNA, 25 bp, Mus musculus
ggccaaccaagtcaaggcaccgctt

SEQ ID NO: 613837 - DNA, 25 bp, Mus musculus
ggccaaccaagtgaaggcaccgctt

SEQ ID NO: 613838 - DNA, 25 bp, Mus musculus
ggccaaccagagagagcaacctgag

SEQ ID NO: 613839 - DNA, 25 bp, Mus musculus
ggccaaccagagtgagcaacctgag

SEQ ID NO: 613840 - DNA, 25 bp, Mus musculus
ggccaaccagcacttcagtgtttga

SEQ ID NO: 613841 - DNA, 25 bp, Mus musculus
ggccaaccagcagttcagtgtttga

SEQ ID NO: 613842 - DNA, 25 bp, Mus musculus
ggccaacccagcagttataacttgt

SEQ ID NO: 613843 - DNA, 25 bp, Mus musculus
ggccaacccagctgttataacttgt

SEQ ID NO: 613844 - DNA, 25 bp, Mus musculus
ggccaaccccgcagagaaaatcatt

SEQ ID NO: 613845 - DNA, 25 bp, Mus musculus
ggccaaccccgctgagaaaatcatt

SEQ ID NO: 613846 - DNA, 25 bp, Mus musculus
ggccaacccgatatagaacaacaat

SEQ ID NO: 613847 - DNA, 25 bp, Mus musculus
ggccaacccgatttagaacaacaat

SEQ ID NO: 613848 - DNA, 25 bp, Mus musculus
ggccaacctacaataactcacaaat

SEQ ID NO: 613849 - DNA, 25 bp, Mus musculus
ggccaacctacattaactcacaaat

SEQ ID NO: 613850 - DNA, 25 bp, Mus musculus
ggccaacctggaaactaacaagctg

SEQ ID NO: 613851 - DNA, 25 bp, Mus musculus
ggccaacctggatactaacaagctg

SEQ ID NO: 613852 - DNA, 25 bp, Mus musculus
ggccaacctgtgctgttgcataagt

SEQ ID NO: 613853 - DNA, 25 bp, Mus musculus
ggccaacctgtggtgttgcataagt

SEQ ID NO: 613854 - DNA, 25 bp, Mus musculus
ggccaaccttgtcaatatagacact

SEQ ID NO: 613855 - DNA, 25 bp, Mus musculus
ggccaaccttgtgaatatagacact

SEQ ID NO: 613856 - DNA, 25 bp, Mus musculus
ggccaacgcctaattgctaaggtgc

SEQ ID NO: 613857 - DNA, 25 bp, Mus musculus
ggccaacgcctatttgctaaggtgc

SEQ ID NO: 613858 - DNA, 25 bp, Mus musculus
ggccaacgtgacatctctgtagaga

SEQ ID NO: 613859 - DNA, 25 bp, Mus musculus
ggccaacgtgacttctctgtagaga

SEQ ID NO: 613860 - DNA, 25 bp, Mus musculus
ggccaactactcctgggcatgggat

SEQ ID NO: 613861 - DNA, 25 bp, Mus musculus
ggccaactactcgtgggcatgggat

SEQ ID NO: 613862 - DNA, 25 bp, Mus musculus
ggccaactcgggatgccctgtctct

SEQ ID NO: 613863 - DNA, 25 bp, Mus musculus
ggccaactcgggttgccctgtctct

SEQ ID NO: 613864 - DNA, 25 bp, Mus musculus
ggccaactggagaggcttagatgtt

SEQ ID NO: 613865 - DNA, 25 bp, Mus musculus
ggccaactggagtggcttagatgtt

SEQ ID NO: 613866 - DNA, 25 bp, Mus musculus
ggccaactgtgccttgatcctgcag

SEQ ID NO: 613867 - DNA, 25 bp, Mus musculus
ggccaactgtgcgttgatcctgcag

SEQ ID NO: 613868 - DNA, 25 bp, Mus musculus
ggccaactgttaacagaatactttt

SEQ ID NO: 613869 - DNA, 25 bp, Mus musculus
ggccaactgttatcagaatactttt

SEQ ID NO: 613870 - DNA, 25 bp, Mus musculus
ggccaacttcgaagaaaagctcaaa

SEQ ID NO: 613871 - DNA, 25 bp, Mus musculus
ggccaacttcgatgaaaagctcaaa

SEQ ID NO: 613872 - DNA, 25 bp, Mus musculus
ggccaacttctacgtttcccaactg

SEQ ID NO: 613873 - DNA, 25 bp, Mus musculus
ggccaacttctaggtttcccaactg

SEQ ID NO: 613874 - DNA, 25 bp, Mus musculus
ggccaacttgagagaatactggttc

SEQ ID NO: 613875 - DNA, 25 bp, Mus musculus
ggccaacttgagtgaatactggttc

SEQ ID NO: 613876 - DNA, 25 bp, Mus musculus
ggccaactttggcagtagtcaacaa

SEQ ID NO: 613877 - DNA, 25 bp, Mus musculus
ggccaactttgggagtagtcaacaa

SEQ ID NO: 613878 - DNA, 25 bp, Mus musculus
ggccaagaaacccaaggtgaagaag

SEQ ID NO: 613879 - DNA, 25 bp, Mus musculus
ggccaagaaaccgaaggtgaagaag

SEQ ID NO: 613880 - DNA, 25 bp, Mus musculus
ggccaagaagaactttcattttcag

SEQ ID NO: 613881 - DNA, 25 bp, Mus musculus
ggccaagaagaagtttcattttcag

SEQ ID NO: 613882 - DNA, 25 bp, Mus musculus
ggccaagaagcgacccatcgtgttc

SEQ ID NO: 613883 - DNA, 25 bp, Mus musculus
ggccaagaagcgtcccatcgtgttc

SEQ ID NO: 613884 - DNA, 25 bp, Mus musculus
ggccaagaaggtatcatcagcagca

SEQ ID NO: 613885 - DNA, 25 bp, Mus musculus
ggccaagaaggtttcatcagcagca

SEQ ID NO: 613886 - DNA, 25 bp, Mus musculus
ggccaagaagtcaacatgtgggttg

SEQ ID NO: 613887 - DNA, 25 bp, Mus musculus
ggccaagaagtctacatgtgggttg

SEQ ID NO: 613888 - DNA, 25 bp, Mus musculus
ggccaagaatcaacttttgtgcatt

SEQ ID NO: 613889 - DNA, 25 bp, Mus musculus
ggccaagaatcatcttttgtgcatt

SEQ ID NO: 613890 - DNA, 25 bp, Mus musculus
ggccaagaattcatttgcaagctct

SEQ ID NO: 613891 - DNA, 25 bp, Mus musculus
ggccaagaattcttttgcaagctct

SEQ ID NO: 613892 - DNA, 25 bp, Mus musculus
ggccaagacccaagttcttgacatt

SEQ ID NO: 613893 - DNA, 25 bp, Mus musculus
ggccaagacccatgttcttgacatt

SEQ ID NO: 613894 - DNA, 25 bp, Mus musculus
ggccaagactaccagcttcagcttc

SEQ ID NO: 613895 - DNA, 25 bp, Mus musculus
ggccaagactacgagcttcagcttc

SEQ ID NO: 613896 - DNA, 25 bp, Mus musculus
ggccaagactgccagttgcttgttc

SEQ ID NO: 613897 - DNA, 25 bp, Mus musculus
ggccaagactgcgagttgcttgttc

SEQ ID NO: 613898 - DNA, 25 bp, Mus musculus
ggccaagagattcaactcacgttgt

SEQ ID NO: 613899 - DNA, 25 bp, Mus musculus
ggccaagagattgaactcacgttgt

SEQ ID NO: 613900 - DNA, 25 bp, Mus musculus
ggccaagagcccagcctgcgtgtga

SEQ ID NO: 613901 - DNA, 25 bp, Mus musculus
ggccaagagccctgcctgcgtgtga

SEQ ID NO: 613902 - DNA, 25 bp, Mus musculus
ggccaagaggctactggtttctgaa

SEQ ID NO: 613903 - DNA, 25 bp, Mus musculus
ggccaagaggcttctggtttctgaa

SEQ ID NO: 613904 - DNA, 25 bp, Mus musculus
ggccaagagtccaaggtttgtctca

SEQ ID NO: 613905 - DNA, 25 bp, Mus musculus
ggccaagagtcctaggtttgtctca

SEQ ID NO: 613906 - DNA, 25 bp, Mus musculus
ggccaagatcacatcgtatgcgatt

SEQ ID NO: 613907 - DNA, 25 bp, Mus musculus
ggccaagatcacttcgtatgcgatt

SEQ ID NO: 613908 - DNA, 25 bp, Mus musculus
ggccaagatcagatcatcaaaacat

SEQ ID NO: 613909 - DNA, 25 bp, Mus musculus
ggccaagatcagttcatcaaaacat

SEQ ID NO: 613910 - DNA, 25 bp, Mus musculus
ggccaagatccgcaaggtcatgtat

SEQ ID NO: 613911 - DNA, 25 bp, Mus musculus
ggccaagatccggaaggtcatgtat

SEQ ID NO: 613912 - DNA, 25 bp, Mus musculus
ggccaagatgtcactggatccagca

SEQ ID NO: 613913 - DNA, 25 bp, Mus musculus
ggccaagatgtctctggatccagca

SEQ ID NO: 613914 - DNA, 25 bp, Mus musculus
ggccaagattctacaacccatataa

SEQ ID NO: 613915 - DNA, 25 bp, Mus musculus
ggccaagattcttcaacccatataa

SEQ ID NO: 613916 - DNA, 25 bp, Mus musculus
ggccaagattgacagacacctaaat

SEQ ID NO: 613917 - DNA, 25 bp, Mus musculus
ggccaagattgagagacacctaaat

SEQ ID NO: 613918 - DNA, 25 bp, Mus musculus
ggccaagattgcctcatcaaccgag

SEQ ID NO: 613919 - DNA, 25 bp, Mus musculus
ggccaagattgcgtcatcaaccgag

SEQ ID NO: 613920 - DNA, 25 bp, Mus musculus
ggccaagcaagcactgcagtgaggc

SEQ ID NO: 613921 - DNA, 25 bp, Mus musculus
ggccaagcaagctctgcagtgaggc

SEQ ID NO: 613922 - DNA, 25 bp, Mus musculus
ggccaagcactaattattgatattg

SEQ ID NO: 613923 - DNA, 25 bp, Mus musculus
ggccaagcactatttattgatattg

SEQ ID NO: 613924 - DNA, 25 bp, Mus musculus
ggccaagcagaacaacccagttaga

SEQ ID NO: 613925 - DNA, 25 bp, Mus musculus
ggccaagcagaagaacccagttaga

SEQ ID NO: 613926 - DNA, 25 bp, Mus musculus
ggccaagcagcaagcctgaatattt

SEQ ID NO: 613927 - DNA, 25 bp, Mus musculus
ggccaagcagcatgcctgaatattt

SEQ ID NO: 613928 - DNA, 25 bp, Mus musculus
ggccaagcaggccagttccatgaaa

SEQ ID NO: 613929 - DNA, 25 bp, Mus musculus
ggccaagcaggcgagttccatgaaa

SEQ ID NO: 613930 - DNA, 25 bp, Mus musculus
ggccaagcatcaatgggtgtccgca

SEQ ID NO: 613931 - DNA, 25 bp, Mus musculus
ggccaagcatcattgggtgtccgca

SEQ ID NO: 613932 - DNA, 25 bp, Mus musculus
ggccaagccaggacagaggctctct

SEQ ID NO: 613933 - DNA, 25 bp, Mus musculus
ggccaagccaggtcagaggctctct

SEQ ID NO: 613934 - DNA, 25 bp, Mus musculus
ggccaagccctacgacagtgtaatt

SEQ ID NO: 613935 - DNA, 25 bp, Mus musculus
ggccaagccctaggacagtgtaatt

SEQ ID NO: 613936 - DNA, 25 bp, Mus musculus
ggccaagctactataacggtcctat

SEQ ID NO: 613937 - DNA, 25 bp, Mus musculus
ggccaagctactttaacggtcctat

SEQ ID NO: 613938 - DNA, 25 bp, Mus musculus
ggccaagctagccttgtcatcatag

SEQ ID NO: 613939 - DNA, 25 bp, Mus musculus
ggccaagctagcgttgtcatcatag

SEQ ID NO: 613940 - DNA, 25 bp, Mus musculus
ggccaagctccactaacaggactca

SEQ ID NO: 613941 - DNA, 25 bp, Mus musculus
ggccaagctccagtaacaggactca

SEQ ID NO: 613942 - DNA, 25 bp, Mus musculus
ggccaagctgacagattgtttgaca

SEQ ID NO: 613943 - DNA, 25 bp, Mus musculus
ggccaagctgactgattgtttgaca

SEQ ID NO: 613944 - DNA, 25 bp, Mus musculus
ggccaagctggactacattgctagt

SEQ ID NO: 613945 - DNA, 25 bp, Mus musculus
ggccaagctggagtacattgctagt

SEQ ID NO: 613946 - DNA, 25 bp, Mus musculus
ggccaagctgtacgataacttactg

SEQ ID NO: 613947 - DNA, 25 bp, Mus musculus
ggccaagctgtaggataacttactg

SEQ ID NO: 613948 - DNA, 25 bp, Mus musculus
ggccaagcttacacgcatgatctta

SEQ ID NO: 613949 - DNA, 25 bp, Mus musculus
ggccaagcttactcgcatgatctta

SEQ ID NO: 613950 - DNA, 25 bp, Mus musculus
ggccaaggaaccaaaagacctggag

SEQ ID NO: 613951 - DNA, 25 bp, Mus musculus
ggccaaggaacctaaagacctggag

SEQ ID NO: 613952 - DNA, 25 bp, Mus musculus
ggccaaggacttcatccgcaggctg

SEQ ID NO: 613953 - DNA, 25 bp, Mus musculus
ggccaaggacttgatccgcaggctg

SEQ ID NO: 613954 - DNA, 25 bp, Mus musculus
ggccaaggagctcgaacgcctgatt

SEQ ID NO: 613955 - DNA, 25 bp, Mus musculus
ggccaaggagctggaacgcctgatt

SEQ ID NO: 613956 - DNA, 25 bp, Mus musculus
ggccaaggaggcagatcagttaaag

SEQ ID NO: 613957 - DNA, 25 bp, Mus musculus
ggccaaggaggctgatcagttaaag

SEQ ID NO: 613958 - DNA, 25 bp, Mus musculus
ggccaaggatatacagtatgtctac

SEQ ID NO: 613959 - DNA, 25 bp, Mus musculus
ggccaaggatattcagtatgtctac

SEQ ID NO: 613960 - DNA, 25 bp, Mus musculus
ggccaaggatgtacttttctaccca

SEQ ID NO: 613961 - DNA, 25 bp, Mus musculus
ggccaaggatgttcttttctaccca

SEQ ID NO: 613962 - DNA, 25 bp, Mus musculus
ggccaaggattcacagacccaggat

SEQ ID NO: 613963 - DNA, 25 bp, Mus musculus
ggccaaggattctcagacccaggat

SEQ ID NO: 613964 - DNA, 25 bp, Mus musculus
ggccaaggcacacgagtttgtcagt

SEQ ID NO: 613965 - DNA, 25 bp, Mus musculus
ggccaaggcacactagtcacagtct

SEQ ID NO: 613966 - DNA, 25 bp, Mus musculus
ggccaaggcacaggagtttgtcagt

SEQ ID NO: 613967 - DNA, 25 bp, Mus musculus
ggccaaggcacagtagtcacagtct

SEQ ID NO: 613968 - DNA, 25 bp, Mus musculus
ggccaaggcagaagggtaaccatga

SEQ ID NO: 613969 - DNA, 25 bp, Mus musculus
ggccaaggcagatgggtaaccatga

SEQ ID NO: 613970 - DNA, 25 bp, Mus musculus
ggccaaggccagatcttcagggatg

SEQ ID NO: 613971 - DNA, 25 bp, Mus musculus
ggccaaggccagttcttcagggatg

SEQ ID NO: 613972 - DNA, 25 bp, Mus musculus
ggccaaggccatcagtccttaagac

SEQ ID NO: 613973 - DNA, 25 bp, Mus musculus
ggccaaggccatgagtccttaagac

SEQ ID NO: 613974 - DNA, 25 bp, Mus musculus
ggccaaggccctcattgtacacaga

SEQ ID NO: 613975 - DNA, 25 bp, Mus musculus
ggccaaggccctgattgtacacaga

SEQ ID NO: 613976 - DNA, 25 bp, Mus musculus
ggccaaggcctcatgggttatgtca

SEQ ID NO: 613977 - DNA, 25 bp, Mus musculus
ggccaaggcctcttgggttatgtca

SEQ ID NO: 613978 - DNA, 25 bp, Mus musculus
ggccaaggcgtcattatgcagagca

SEQ ID NO: 613979 - DNA, 25 bp, Mus musculus
ggccaaggcgtctttatgcagagca

SEQ ID NO: 613980 - DNA, 25 bp, Mus musculus
ggccaaggctagagaaccccaaaca

SEQ ID NO: 613981 - DNA, 25 bp, Mus musculus
ggccaaggctagtgaaccccaaaca

SEQ ID NO: 613982 - DNA, 25 bp, Mus musculus
ggccaaggcttcagcgagaaggact

SEQ ID NO: 613983 - DNA, 25 bp, Mus musculus
ggccaaggcttctgcgagaaggact

SEQ ID NO: 613984 - DNA, 25 bp, Mus musculus
ggccaaggctttaaggatgactcgt

SEQ ID NO: 613985 - DNA, 25 bp, Mus musculus
ggccaaggcttttaggatgactcgt

SEQ ID NO: 613986 - DNA, 25 bp, Mus musculus
ggccaagggcagcacctccaggaaa

SEQ ID NO: 613987 - DNA, 25 bp, Mus musculus
ggccaagggcaggacctccaggaaa

SEQ ID NO: 613988 - DNA, 25 bp, Mus musculus
ggccaagggcgtccagcaacgtaaa

SEQ ID NO: 613989 - DNA, 25 bp, Mus musculus
ggccaagggcgtgcagcaacgtaaa

SEQ ID NO: 613990 - DNA, 25 bp, Mus musculus
ggccaaggggtcaactatgctgctg

SEQ ID NO: 613991 - DNA, 25 bp, Mus musculus
ggccaaggggtctactatgctgctg

SEQ ID NO: 613992 - DNA, 25 bp, Mus musculus
ggccaaggttatccctgcggtgtca

SEQ ID NO: 613993 - DNA, 25 bp, Mus musculus
ggccaaggttatgcctgcggtgtca

SEQ ID NO: 613994 - DNA, 25 bp, Mus musculus
ggccaaggttccatgtagcagtcaa

SEQ ID NO: 613995 - DNA, 25 bp, Mus musculus
ggccaaggttccttgtagcagtcaa

SEQ ID NO: 613996 - DNA, 25 bp, Mus musculus
ggccaagtaataaatctgttttccg

SEQ ID NO: 613997 - DNA, 25 bp, Mus musculus
ggccaagtaatatatctgttttccg

SEQ ID NO: 613998 - DNA, 25 bp, Mus musculus
ggccaagtactacaacaaggaatca

SEQ ID NO: 613999 - DNA, 25 bp, Mus musculus
ggccaagtactagaacaaggaatca

SEQ ID NO: 614000 - DNA, 25 bp, Mus musculus
ggccaagtagccatgggatcccaga

SEQ ID NO: 614001 - DNA, 25 bp, Mus musculus
ggccaagtagccttgggatcccaga

SEQ ID NO: 614002 - DNA, 25 bp, Mus musculus
ggccaagtagtcctgacctgtagaa

SEQ ID NO: 614003 - DNA, 25 bp, Mus musculus
ggccaagtagtcgtgacctgtagaa

SEQ ID NO: 614004 - DNA, 25 bp, Mus musculus
ggccaagtatctcagaaagacccaa

SEQ ID NO: 614005 - DNA, 25 bp, Mus musculus
ggccaagtatctgagaaagacccaa

SEQ ID NO: 614006 - DNA, 25 bp, Mus musculus
ggccaagtcttcaacagcaaagtca

SEQ ID NO: 614007 - DNA, 25 bp, Mus musculus
ggccaagtcttctacagcaaagtca

SEQ ID NO: 614008 - DNA, 25 bp, Mus musculus
ggccaagtgccaccaagagtctcag

SEQ ID NO: 614009 - DNA, 25 bp, Mus musculus
ggccaagtgccagcaagagtctcag

SEQ ID NO: 614010 - DNA, 25 bp, Mus musculus
ggccaagtgggaacggaacagctct

SEQ ID NO: 614011 - DNA, 25 bp, Mus musculus
ggccaagtgggatcggaacagctct

SEQ ID NO: 614012 - DNA, 25 bp, Mus musculus
ggccaagtgtacatcactattatat

SEQ ID NO: 614013 - DNA, 25 bp, Mus musculus
ggccaagtgtacttcactattatat

SEQ ID NO: 614014 - DNA, 25 bp, Mus musculus
ggccaagttactcctgccctctaat

SEQ ID NO: 614015 - DNA, 25 bp, Mus musculus
ggccaagttactgctgccctctaat

SEQ ID NO: 614016 - DNA, 25 bp, Mus musculus
ggccaagttcccagcgctggcaaaa

SEQ ID NO: 614017 - DNA, 25 bp, Mus musculus
ggccaagttccctgcgctggcaaaa

SEQ ID NO: 614018 - DNA, 25 bp, Mus musculus
ggccaagttctacaatgacccggga

SEQ ID NO: 614019 - DNA, 25 bp, Mus musculus
ggccaagttctagaatgacccggga

SEQ ID NO: 614020 - DNA, 25 bp, Mus musculus
ggccaagttggactaagacaatctt

SEQ ID NO: 614021 - DNA, 25 bp, Mus musculus
ggccaagttggagtaagacaatctt

SEQ ID NO: 614022 - DNA, 25 bp, Mus musculus
ggccaataatacacatgcgctccag

SEQ ID NO: 614023 - DNA, 25 bp, Mus musculus
ggccaataatactcatgcgctccag

SEQ ID NO: 614024 - DNA, 25 bp, Mus musculus
ggccaataggccatgattttatgtc

SEQ ID NO: 614025 - DNA, 25 bp, Mus musculus
ggccaataggccttgattttatgtc

SEQ ID NO: 614026 - DNA, 25 bp, Mus musculus
ggccaatagtcacatgatattctat

SEQ ID NO: 614027 - DNA, 25 bp, Mus musculus
ggccaatagtcagatgatattctat

SEQ ID NO: 614028 - DNA, 25 bp, Mus musculus
ggccaatagttcattgtctagggtt

SEQ ID NO: 614029 - DNA, 25 bp, Mus musculus
ggccaatagttctttgtctagggtt

SEQ ID NO: 614030 - DNA, 25 bp, Mus musculus
ggccaatataatagtcccagttcac

SEQ ID NO: 614031 - DNA, 25 bp, Mus musculus
ggccaatataattgtcccagttcac

SEQ ID NO: 614032 - DNA, 25 bp, Mus musculus
ggccaatatttccactcctcctttt

SEQ ID NO: 614033 - DNA, 25 bp, Mus musculus
ggccaatatttcgactcctcctttt

SEQ ID NO: 614034 - DNA, 25 bp, Mus musculus
ggccaatcacccatttggactggga

SEQ ID NO: 614035 - DNA, 25 bp, Mus musculus
ggccaatcacccttttggactggga

SEQ ID NO: 614036 - DNA, 25 bp, Mus musculus
ggccaatcacgaagagcttatctcc

SEQ ID NO: 614037 - DNA, 25 bp, Mus musculus
ggccaatcacgatgagcttatctcc

SEQ ID NO: 614038 - DNA, 25 bp, Mus musculus
ggccaatcagcccatattttccaac

SEQ ID NO: 614039 - DNA, 25 bp, Mus musculus
ggccaatcagccgatattttccaac

SEQ ID NO: 614040 - DNA, 25 bp, Mus musculus
ggccaatcatgacaagagtcttcca

SEQ ID NO: 614041 - DNA, 25 bp, Mus musculus
ggccaatcatgagaagagtcttcca

SEQ ID NO: 614042 - DNA, 25 bp, Mus musculus
ggccaatccacacagtccatgaaac

SEQ ID NO: 614043 - DNA, 25 bp, Mus musculus
ggccaatccacagagtccatgaaac

SEQ ID NO: 614044 - DNA, 25 bp, Mus musculus
ggccaatccaccacagtatatattt

SEQ ID NO: 614045 - DNA, 25 bp, Mus musculus
ggccaatccacctcagtatatattt

SEQ ID NO: 614046 - DNA, 25 bp, Mus musculus
ggccaatccggactctgtgtactga

SEQ ID NO: 614047 - DNA, 25 bp, Mus musculus
ggccaatccggagtctgtgtactga

SEQ ID NO: 614048 - DNA, 25 bp, Mus musculus
ggccaatcgacaatcttaggtttga

SEQ ID NO: 614049 - DNA, 25 bp, Mus musculus
ggccaatcgacattcttaggtttga

SEQ ID NO: 614050 - DNA, 25 bp, Mus musculus
ggccaatctgaccattatattttat

SEQ ID NO: 614051 - DNA, 25 bp, Mus musculus
ggccaatctgacgattatattttat

SEQ ID NO: 614052 - DNA, 25 bp, Mus musculus
ggccaatctgccaaaaatgacaagt

SEQ ID NO: 614053 - DNA, 25 bp, Mus musculus
ggccaatctgcctaaaatgacaagt

SEQ ID NO: 614054 - DNA, 25 bp, Mus musculus
ggccaatgactaaggcactggcatt

SEQ ID NO: 614055 - DNA, 25 bp, Mus musculus
ggccaatgactatggcactggcatt

SEQ ID NO: 614056 - DNA, 25 bp, Mus musculus
ggccaatgaggcaaagactgccgag

SEQ ID NO: 614057 - DNA, 25 bp, Mus musculus
ggccaatgaggctaagactgccgag

SEQ ID NO: 614058 - DNA, 25 bp, Mus musculus
ggccaatgatagatgcatgatgaga

SEQ ID NO: 614059 - DNA, 25 bp, Mus musculus
ggccaatgatagttgcatgatgaga

SEQ ID NO: 614060 - DNA, 25 bp, Mus musculus
ggccaatgatgaattccttcatgca

SEQ ID NO: 614061 - DNA, 25 bp, Mus musculus
ggccaatgatgatttccttcatgca

SEQ ID NO: 614062 - DNA, 25 bp, Mus musculus
ggccaatgcactaccaagtaaacca

SEQ ID NO: 614063 - DNA, 25 bp, Mus musculus
ggccaatgcacttccaagtaaacca

SEQ ID NO: 614064 - DNA, 25 bp, Mus musculus
ggccaatgccaacaaccctatgaat

SEQ ID NO: 614065 - DNA, 25 bp, Mus musculus
ggccaatgccaagaaccctatgaat

SEQ ID NO: 614066 - DNA, 25 bp, Mus musculus
ggccaattaatgaacatgccctggt

SEQ ID NO: 614067 - DNA, 25 bp, Mus musculus
ggccaattaatgtacatgccctggt

SEQ ID NO: 614068 - DNA, 25 bp, Mus musculus
ggccaattcaaacttcccatcggtc

SEQ ID NO: 614069 - DNA, 25 bp, Mus musculus
ggccaattcaaagttcccatcggtc

SEQ ID NO: 614070 - DNA, 25 bp, Mus musculus
ggccaattcaacaacagagactcca

SEQ ID NO: 614071 - DNA, 25 bp, Mus musculus
ggccaattcaactacagagactcca

SEQ ID NO: 614072 - DNA, 25 bp, Mus musculus
ggccaattgactatattgtgcctgc

SEQ ID NO: 614073 - DNA, 25 bp, Mus musculus
ggccaattgactttattgtgcctgc

SEQ ID NO: 614074 - DNA, 25 bp, Mus musculus
ggccaattgcacattgtctgacaca

SEQ ID NO: 614075 - DNA, 25 bp, Mus musculus
ggccaattgcactttgtctgacaca

SEQ ID NO: 614076 - DNA, 25 bp, Mus musculus
ggccaatttagtcccttaatcaagt

SEQ ID NO: 614077 - DNA, 25 bp, Mus musculus
ggccaatttagtgccttaatcaagt

SEQ ID NO: 614078 - DNA, 25 bp, Mus musculus
ggccaatttcaaagtgactggattt

SEQ ID NO: 614079 - DNA, 25 bp, Mus musculus
ggccaatttcaatgtgactggattt

SEQ ID NO: 614080 - DNA, 25 bp, Mus musculus
ggccaatttgacagcatagagaatc

SEQ ID NO: 614081 - DNA, 25 bp, Mus musculus
ggccaatttgactgcatagagaatc

SEQ ID NO: 614082 - DNA, 25 bp, Mus musculus
ggccaatttgagattgagtaccatt

SEQ ID NO: 614083 - DNA, 25 bp, Mus musculus
ggccaatttgagtttgagtaccatt

SEQ ID NO: 614084 - DNA, 25 bp, Mus musculus
ggccacaaaacacggactgctttca

SEQ ID NO: 614085 - DNA, 25 bp, Mus musculus
ggccacaaaacagggactgctttca

SEQ ID NO: 614086 - DNA, 25 bp, Mus musculus
ggccacaaaattccacgacaagctg

SEQ ID NO: 614087 - DNA, 25 bp, Mus musculus
ggccacaaaattgcacgacaagctg

SEQ ID NO: 614088 - DNA, 25 bp, Mus musculus
ggccacaaactcatttctaacacaa

SEQ ID NO: 614089 - DNA, 25 bp, Mus musculus
ggccacaaactcttttctaacacaa

SEQ ID NO: 614090 - DNA, 25 bp, Mus musculus
ggccacaaacttcggcttgccttgg

SEQ ID NO: 614091 - DNA, 25 bp, Mus musculus
ggccacaaacttgggcttgccttgg

SEQ ID NO: 614092 - DNA, 25 bp, Mus musculus
ggccacaaagcacccattgtgtgga

SEQ ID NO: 614093 - DNA, 25 bp, Mus musculus
ggccacaaagcagccattgtgtgga

SEQ ID NO: 614094 - DNA, 25 bp, Mus musculus
ggccacaactgcctatgtagtagct

SEQ ID NO: 614095 - DNA, 25 bp, Mus musculus
ggccacaactgcgtatgtagtagct

SEQ ID NO: 614096 - DNA, 25 bp, Mus musculus
ggccacaagtctcctagttgcactt

SEQ ID NO: 614097 - DNA, 25 bp, Mus musculus
ggccacaagtctgctagttgcactt

SEQ ID NO: 614098 - DNA, 25 bp, Mus musculus
ggccacaagttcacatttttatggg

SEQ ID NO: 614099 - DNA, 25 bp, Mus musculus
ggccacaagttctcatttttatggg

SEQ ID NO: 614100 - DNA, 25 bp, Mus musculus
ggccacaatatgaccaattttaact

SEQ ID NO: 614101 - DNA, 25 bp, Mus musculus
ggccacaatatgtccaattttaact

SEQ ID NO: 614102 - DNA, 25 bp, Mus musculus
ggccacaatggcatatgaccgctac

SEQ ID NO: 614103 - DNA, 25 bp, Mus musculus
ggccacaatggcttatgaccgctac

SEQ ID NO: 614104 - DNA, 25 bp, Mus musculus
ggccacacacccatacataaagttt

SEQ ID NO: 614105 - DNA, 25 bp, Mus musculus
ggccacacacccttacataaagttt

SEQ ID NO: 614106 - DNA, 25 bp, Mus musculus
ggccacaccagaagtccagggattt

SEQ ID NO: 614107 - DNA, 25 bp, Mus musculus
ggccacaccagaccagacaggattt

SEQ ID NO: 614108 - DNA, 25 bp, Mus musculus
ggccacaccagagcagacaggattt

SEQ ID NO: 614109 - DNA, 25 bp, Mus musculus
ggccacaccagatgtccagggattt

SEQ ID NO: 614110 - DNA, 25 bp, Mus musculus
ggccacacctatattaccaaggcca

SEQ ID NO: 614111 - DNA, 25 bp, Mus musculus
ggccacacctattttaccaaggcca

SEQ ID NO: 614112 - DNA, 25 bp, Mus musculus
ggccacacggagagtttagctaagt

SEQ ID NO: 614113 - DNA, 25 bp, Mus musculus
ggccacacggagtgtttagctaagt

SEQ ID NO: 614114 - DNA, 25 bp, Mus musculus
ggccacactatgagaccttgccaaa

SEQ ID NO: 614115 - DNA, 25 bp, Mus musculus
ggccacactatgtgaccttgccaaa

SEQ ID NO: 614116 - DNA, 25 bp, Mus musculus
ggccacactcttctttattattact

SEQ ID NO: 614117 - DNA, 25 bp, Mus musculus
ggccacactcttgtttattattact

SEQ ID NO: 614118 - DNA, 25 bp, Mus musculus
ggccacactggcaagatcatcatta

SEQ ID NO: 614119 - DNA, 25 bp, Mus musculus
ggccacactggctagatcatcatta

SEQ ID NO: 614120 - DNA, 25 bp, Mus musculus
ggccacagaaacatcctggttatgt

SEQ ID NO: 614121 - DNA, 25 bp, Mus musculus
ggccacagaaacttcctggttatgt

SEQ ID NO: 614122 - DNA, 25 bp, Mus musculus
ggccacagacgcagccagagctcga

SEQ ID NO: 614123 - DNA, 25 bp, Mus musculus
ggccacagacgctgccagagctcga

SEQ ID NO: 614124 - DNA, 25 bp, Mus musculus
ggccacagactgcagagggacacca

SEQ ID NO: 614125 - DNA, 25 bp, Mus musculus
ggccacagactggagagggacacca

SEQ ID NO: 614126 - DNA, 25 bp, Mus musculus
ggccacagagatcttggagccccaa

SEQ ID NO: 614127 - DNA, 25 bp, Mus musculus
ggccacagagatgttggagccccaa

SEQ ID NO: 614128 - DNA, 25 bp, Mus musculus
ggccacagcaccagattcagtttga

SEQ ID NO: 614129 - DNA, 25 bp, Mus musculus
ggccacagcacctgattcagtttga

SEQ ID NO: 614130 - DNA, 25 bp, Mus musculus
ggccacagcagcataaagagtacgt

SEQ ID NO: 614131 - DNA, 25 bp, Mus musculus
ggccacagcagcttaaagagtacgt

SEQ ID NO: 614132 - DNA, 25 bp, Mus musculus
ggccacagcaggctcttcaagaagt

SEQ ID NO: 614133 - DNA, 25 bp, Mus musculus
ggccacagcagggtcttcaagaagt

SEQ ID NO: 614134 - DNA, 25 bp, Mus musculus
ggccacagctagattttaggtgcct

SEQ ID NO: 614135 - DNA, 25 bp, Mus musculus
ggccacagctagtttttaggtgcct

SEQ ID NO: 614136 - DNA, 25 bp, Mus musculus
ggccacagctccaatacttatggga

SEQ ID NO: 614137 - DNA, 25 bp, Mus musculus
ggccacagctccagttcggaaaact

SEQ ID NO: 614138 - DNA, 25 bp, Mus musculus
ggccacagctcctatacttatggga

SEQ ID NO: 614139 - DNA, 25 bp, Mus musculus
ggccacagctcctgttcggaaaact

SEQ ID NO: 614140 - DNA, 25 bp, Mus musculus
ggccacagctggaatcttgaatctt

SEQ ID NO: 614141 - DNA, 25 bp, Mus musculus
ggccacagctggtatcttgaatctt

SEQ ID NO: 614142 - DNA, 25 bp, Mus musculus
ggccacagcttcacaaggatcagga

SEQ ID NO: 614143 - DNA, 25 bp, Mus musculus
ggccacagcttctcaaggatcagga

SEQ ID NO: 614144 - DNA, 25 bp, Mus musculus
ggccacaggaatctcgttctctcag

SEQ ID NO: 614145 - DNA, 25 bp, Mus musculus
ggccacaggaatgtcgttctctcag

SEQ ID NO: 614146 - DNA, 25 bp, Mus musculus
ggccacaggagcactatggtcgttt

SEQ ID NO: 614147 - DNA, 25 bp, Mus musculus
ggccacaggagctctatggtcgttt

SEQ ID NO: 614148 - DNA, 25 bp, Mus musculus
ggccacaggcctccatataaaattg

SEQ ID NO: 614149 - DNA, 25 bp, Mus musculus
ggccacaggcctgcatataaaattg

SEQ ID NO: 614150 - DNA, 25 bp, Mus musculus
ggccacagggagacctccatggtgc

SEQ ID NO: 614151 - DNA, 25 bp, Mus musculus
ggccacagggagtcctccatggtgc

SEQ ID NO: 614152 - DNA, 25 bp, Mus musculus
ggccacagggataggcctggattct

SEQ ID NO: 614153 - DNA, 25 bp, Mus musculus
ggccacagggattggcctggattct

SEQ ID NO: 614154 - DNA, 25 bp, Mus musculus
ggccacaggttcaccatggagctga

SEQ ID NO: 614155 - DNA, 25 bp, Mus musculus
ggccacaggttctccatggagctga

SEQ ID NO: 614156 - DNA, 25 bp, Mus musculus
ggccacagttagaacgcacactcat

SEQ ID NO: 614157 - DNA, 25 bp, Mus musculus
ggccacagttagtacgcacactcat

SEQ ID NO: 614158 - DNA, 25 bp, Mus musculus
ggccacataataacccttcagcagc

SEQ ID NO: 614159 - DNA, 25 bp, Mus musculus
ggccacataatatcccttcagcagc

SEQ ID NO: 614160 - DNA, 25 bp, Mus musculus
ggccacataccacttgccttaagga

SEQ ID NO: 614161 - DNA, 25 bp, Mus musculus
ggccacataccagttgccttaagga

SEQ ID NO: 614162 - DNA, 25 bp, Mus musculus
ggccacatagaaagagcctgtctcg

SEQ ID NO: 614163 - DNA, 25 bp, Mus musculus
ggccacatagaatgagcctgtctcg

SEQ ID NO: 614164 - DNA, 25 bp, Mus musculus
ggccacatatgtctacctacctgaa

SEQ ID NO: 614165 - DNA, 25 bp, Mus musculus
ggccacatatgtgtacctacctgaa

SEQ ID NO: 614166 - DNA, 25 bp, Mus musculus
ggccacatcccgcatgtgttaatat

SEQ ID NO: 614167 - DNA, 25 bp, Mus musculus
ggccacatcccggatgtgttaatat

SEQ ID NO: 614168 - DNA, 25 bp, Mus musculus
ggccacatgaataatgtccgtgcca

SEQ ID NO: 614169 - DNA, 25 bp, Mus musculus
ggccacatgaattatgtccgtgcca

SEQ ID NO: 614170 - DNA, 25 bp, Mus musculus
ggccacatgagaccttacctttaaa

SEQ ID NO: 614171 - DNA, 25 bp, Mus musculus
ggccacatgagagcttacctttaaa

SEQ ID NO: 614172 - DNA, 25 bp, Mus musculus
ggccacatgctcagggatgcttgga

SEQ ID NO: 614173 - DNA, 25 bp, Mus musculus
ggccacatgctctgggatgcttgga

SEQ ID NO: 614174 - DNA, 25 bp, Mus musculus
ggccacatgcttacttcgtatttgt

SEQ ID NO: 614175 - DNA, 25 bp, Mus musculus
ggccacatgctttcttcgtatttgt

SEQ ID NO: 614176 - DNA, 25 bp, Mus musculus
ggccacatggacactgaggtaccga

SEQ ID NO: 614177 - DNA, 25 bp, Mus musculus
ggccacatggactctgaggtaccga

SEQ ID NO: 614178 - DNA, 25 bp, Mus musculus
ggccacattagtaacggctcatgat

SEQ ID NO: 614179 - DNA, 25 bp, Mus musculus
ggccacattagttacggctcatgat

SEQ ID NO: 614180 - DNA, 25 bp, Mus musculus
ggccacattcaccatgaggtctttg

SEQ ID NO: 614181 - DNA, 25 bp, Mus musculus
ggccacattcacgatgaggtctttg

SEQ ID NO: 614182 - DNA, 25 bp, Mus musculus
ggccacattctaaactgttgtaaga

SEQ ID NO: 614183 - DNA, 25 bp, Mus musculus
ggccacattctatactgttgtaaga

SEQ ID NO: 614184 - DNA, 25 bp, Mus musculus
ggccacatttctaggtctgaactat

SEQ ID NO: 614185 - DNA, 25 bp, Mus musculus
ggccacatttcttggtctgaactat

SEQ ID NO: 614186 - DNA, 25 bp, Mus musculus
ggccacattttcatgattcttactt

SEQ ID NO: 614187 - DNA, 25 bp, Mus musculus
ggccacattttcttgattcttactt

SEQ ID NO: 614188 - DNA, 25 bp, Mus musculus
ggccaccaaatcaccctatggaaat

SEQ ID NO: 614189 - DNA, 25 bp, Mus musculus
ggccaccaaatctccctatggaaat

SEQ ID NO: 614190 - DNA, 25 bp, Mus musculus
ggccaccaagatagttcacacgcat

SEQ ID NO: 614191 - DNA, 25 bp, Mus musculus
ggccaccaagattgttcacacgcat

SEQ ID NO: 614192 - DNA, 25 bp, Mus musculus
ggccaccacagaaaccaacaagttc

SEQ ID NO: 614193 - DNA, 25 bp, Mus musculus
ggccaccacagataccaacaagttc

SEQ ID NO: 614194 - DNA, 25 bp, Mus musculus
ggccaccacagcagagtcacatgta

SEQ ID NO: 614195 - DNA, 25 bp, Mus musculus
ggccaccacagctgagtcacatgta

SEQ ID NO: 614196 - DNA, 25 bp, Mus musculus
ggccaccacgatatacggcacaaat

SEQ ID NO: 614197 - DNA, 25 bp, Mus musculus
ggccaccacgatttacggcacaaat

SEQ ID NO: 614198 - DNA, 25 bp, Mus musculus
ggccaccagctgcgttggttccata

SEQ ID NO: 614199 - DNA, 25 bp, Mus musculus
ggccaccagctgggttggttccata

SEQ ID NO: 614200 - DNA, 25 bp, Mus musculus
ggccaccaggcccaaagctgtgaat

SEQ ID NO: 614201 - DNA, 25 bp, Mus musculus
ggccaccaggccgaaagctgtgaat

SEQ ID NO: 614202 - DNA, 25 bp, Mus musculus
ggccaccaggtacaaccaggtctaa

SEQ ID NO: 614203 - DNA, 25 bp, Mus musculus
ggccaccaggtagaaccaggtctaa

SEQ ID NO: 614204 - DNA, 25 bp, Mus musculus
ggccaccaggtcattgtcacagaaa

SEQ ID NO: 614205 - DNA, 25 bp, Mus musculus
ggccaccaggtctttgtcacagaaa

SEQ ID NO: 614206 - DNA, 25 bp, Mus musculus
ggccaccagtacatcctgagacgtg

SEQ ID NO: 614207 - DNA, 25 bp, Mus musculus
ggccaccagtacttcctgagacgtg

SEQ ID NO: 614208 - DNA, 25 bp, Mus musculus
ggccaccatcatctgcttcagtgaa

SEQ ID NO: 614209 - DNA, 25 bp, Mus musculus
ggccaccatcatgtgcttcagtgaa

SEQ ID NO: 614210 - DNA, 25 bp, Mus musculus
ggccaccatccactgtgtacataaa

SEQ ID NO: 614211 - DNA, 25 bp, Mus musculus
ggccaccatccagtgtgtacataaa

SEQ ID NO: 614212 - DNA, 25 bp, Mus musculus
ggccaccatgagcttggcaagctct

SEQ ID NO: 614213 - DNA, 25 bp, Mus musculus
ggccaccatgaggttggcaagctct

SEQ ID NO: 614214 - DNA, 25 bp, Mus musculus
ggccaccattgcatccttggtgaaa

SEQ ID NO: 614215 - DNA, 25 bp, Mus musculus
ggccaccattgcttccttggtgaaa

SEQ ID NO: 614216 - DNA, 25 bp, Mus musculus
ggccacccaaatatacctgtgacat

SEQ ID NO: 614217 - DNA, 25 bp, Mus musculus
ggccacccaaatttacctgtgacat

SEQ ID NO: 614218 - DNA, 25 bp, Mus musculus
ggccacccatatcgtttcggaaatg

SEQ ID NO: 614219 - DNA, 25 bp, Mus musculus
ggccacccatatggtttcggaaatg

SEQ ID NO: 614220 - DNA, 25 bp, Mus musculus
ggccacccatggaccaacctttgga

SEQ ID NO: 614221 - DNA, 25 bp, Mus musculus
ggccacccatggcaatgcagtgaaa

SEQ ID NO: 614222 - DNA, 25 bp, Mus musculus
ggccacccatgggaatgcagtgaaa

SEQ ID NO: 614223 - DNA, 25 bp, Mus musculus
ggccacccatggtccaacctttgga

SEQ ID NO: 614224 - DNA, 25 bp, Mus musculus
ggccacccattcaattaccttaagg

SEQ ID NO: 614225 - DNA, 25 bp, Mus musculus
ggccacccattctattaccttaagg

SEQ ID NO: 614226 - DNA, 25 bp, Mus musculus
ggccaccccaaaaggtttgttcttg

SEQ ID NO: 614227 - DNA, 25 bp, Mus musculus
ggccaccccaaatggtttgttcttg

SEQ ID NO: 614228 - DNA, 25 bp, Mus musculus
ggccaccccaggagcaatattgtgc

SEQ ID NO: 614229 - DNA, 25 bp, Mus musculus
ggccaccccaggtgcaatattgtgc

SEQ ID NO: 614230 - DNA, 25 bp, Mus musculus
ggccaccccataacctggaattaaa

SEQ ID NO: 614231 - DNA, 25 bp, Mus musculus
ggccaccccatatcctggaattaaa

SEQ ID NO: 614232 - DNA, 25 bp, Mus musculus
ggccaccccttgaagaccaactgat

SEQ ID NO: 614233 - DNA, 25 bp, Mus musculus
ggccaccccttgtagaccaactgat

SEQ ID NO: 614234 - DNA, 25 bp, Mus musculus
ggccaccctgataaggcacatgtga

SEQ ID NO: 614235 - DNA, 25 bp, Mus musculus
ggccaccctgattaggcacatgtga

SEQ ID NO: 614236 - DNA, 25 bp, Mus musculus
ggccaccctggacagaagaagcaca

SEQ ID NO: 614237 - DNA, 25 bp, Mus musculus
ggccaccctggagagaagaagcaca

SEQ ID NO: 614238 - DNA, 25 bp, Mus musculus
ggccaccctgtgatgtgggaactga

SEQ ID NO: 614239 - DNA, 25 bp, Mus musculus
ggccaccctgtgttgtgggaactga

SEQ ID NO: 614240 - DNA, 25 bp, Mus musculus
ggccacccttcgacatgtatgatgt

SEQ ID NO: 614241 - DNA, 25 bp, Mus musculus
ggccacccttcgtcatgtatgatgt

SEQ ID NO: 614242 - DNA, 25 bp, Mus musculus
ggccaccgaaagacaagatggagca

SEQ ID NO: 614243 - DNA, 25 bp, Mus musculus
ggccaccgaaagtcaagatggagca

SEQ ID NO: 614244 - DNA, 25 bp, Mus musculus
ggccaccgtacgcagtgaactgagt

SEQ ID NO: 614245 - DNA, 25 bp, Mus musculus
ggccaccgtacggagtgaactgagt

SEQ ID NO: 614246 - DNA, 25 bp, Mus musculus
ggccaccgtcacctatcaatttgag

SEQ ID NO: 614247 - DNA, 25 bp, Mus musculus
ggccaccgtcacgtatcaatttgag

SEQ ID NO: 614248 - DNA, 25 bp, Mus musculus
ggccacctaggaccacatagtgaca

SEQ ID NO: 614249 - DNA, 25 bp, Mus musculus
ggccacctaggagcacatagtgaca

SEQ ID NO: 614250 - DNA, 25 bp, Mus musculus
ggccacctagtgctagactcggtca

SEQ ID NO: 614251 - DNA, 25 bp, Mus musculus
ggccacctagtggtagactcggtca

SEQ ID NO: 614252 - DNA, 25 bp, Mus musculus
ggccacctcgctctgcagaagtgag

SEQ ID NO: 614253 - DNA, 25 bp, Mus musculus
ggccacctcgctgtgcagaagtgag

SEQ ID NO: 614254 - DNA, 25 bp, Mus musculus
ggccacctctcgctgatgttttaac

SEQ ID NO: 614255 - DNA, 25 bp, Mus musculus
ggccacctctcggtgatgttttaac

SEQ ID NO: 614256 - DNA, 25 bp, Mus musculus
ggccacctcttccagatggatgtgg

SEQ ID NO: 614257 - DNA, 25 bp, Mus musculus
ggccacctcttcgagatggatgtgg

SEQ ID NO: 614258 - DNA, 25 bp, Mus musculus
ggccacctgaccctggacaatttca

SEQ ID NO: 614259 - DNA, 25 bp, Mus musculus
ggccacctgaccgtggacaatttca

SEQ ID NO: 614260 - DNA, 25 bp, Mus musculus
ggccacctgctgactatttgtggtt

SEQ ID NO: 614261 - DNA, 25 bp, Mus musculus
ggccacctgctgtctatttgtggtt

SEQ ID NO: 614262 - DNA, 25 bp, Mus musculus
ggccacctggacatcagattgcatc

SEQ ID NO: 614263 - DNA, 25 bp, Mus musculus
ggccacctggacttcagattgcatc

SEQ ID NO: 614264 - DNA, 25 bp, Mus musculus
ggccaccttaacataaagccgcatg

SEQ ID NO: 614265 - DNA, 25 bp, Mus musculus
ggccaccttaacttaaagccgcatg

SEQ ID NO: 614266 - DNA, 25 bp, Mus musculus
ggccaccttaatagtattttggtct

SEQ ID NO: 614267 - DNA, 25 bp, Mus musculus
ggccaccttaattgtattttggtct

SEQ ID NO: 614268 - DNA, 25 bp, Mus musculus
ggccaccttattaactcactaactg

SEQ ID NO: 614269 - DNA, 25 bp, Mus musculus
ggccaccttatttactcactaactg

SEQ ID NO: 614270 - DNA, 25 bp, Mus musculus
ggccacgaatacatcctcttgaggc

SEQ ID NO: 614271 - DNA, 25 bp, Mus musculus
ggccacgaatacttcctcttgaggc

SEQ ID NO: 614272 - DNA, 25 bp, Mus musculus
ggccacgagcaacatcccagaggat

SEQ ID NO: 614273 - DNA, 25 bp, Mus musculus
ggccacgagcaagatcccagaggat

SEQ ID NO: 614274 - DNA, 25 bp, Mus musculus
ggccacgccgacaccaccaagtggg

SEQ ID NO: 614275 - DNA, 25 bp, Mus musculus
ggccacgccgactccaccaagtggg

SEQ ID NO: 614276 - DNA, 25 bp, Mus musculus
ggccacgctcagcacatacggattg

SEQ ID NO: 614277 - DNA, 25 bp, Mus musculus
ggccacgctcaggacatacggattg

SEQ ID NO: 614278 - DNA, 25 bp, Mus musculus
ggccacgctcctcatttaaaggaca

SEQ ID NO: 614279 - DNA, 25 bp, Mus musculus
ggccacgctcctgatttaaaggaca

SEQ ID NO: 614280 - DNA, 25 bp, Mus musculus
ggccacgctttgagggatttactgt

SEQ ID NO: 614281 - DNA, 25 bp, Mus musculus
ggccacgctttgtgggatttactgt

SEQ ID NO: 614282 - DNA, 25 bp, Mus musculus
ggccacgggaaacgctgcagaacaa

SEQ ID NO: 614283 - DNA, 25 bp, Mus musculus
ggccacgggaaaggctgcagaacaa

SEQ ID NO: 614284 - DNA, 25 bp, Mus musculus
ggccacgtctcaacgagtgcagtta

SEQ ID NO: 614285 - DNA, 25 bp, Mus musculus
ggccacgtctcatcgagtgcagtta

SEQ ID NO: 614286 - DNA, 25 bp, Mus musculus
ggccacgttctacgattctggtcat

SEQ ID NO: 614287 - DNA, 25 bp, Mus musculus
ggccacgttctaggattctggtcat

SEQ ID NO: 614288 - DNA, 25 bp, Mus musculus
ggccactaatggctgcttaggttca

SEQ ID NO: 614289 - DNA, 25 bp, Mus musculus
ggccactaatgggtgcttaggttca

SEQ ID NO: 614290 - DNA, 25 bp, Mus musculus
ggccactaatgtatctcttttttct

SEQ ID NO: 614291 - DNA, 25 bp, Mus musculus
ggccactaatgtttctcttttttct

SEQ ID NO: 614292 - DNA, 25 bp, Mus musculus
ggccactagatgaccctggggcgat

SEQ ID NO: 614293 - DNA, 25 bp, Mus musculus
ggccactagatgtccctggggcgat

SEQ ID NO: 614294 - DNA, 25 bp, Mus musculus
ggccactaggcaacctggatgtgcc

SEQ ID NO: 614295 - DNA, 25 bp, Mus musculus
ggccactaggcatcctggatgtgcc

SEQ ID NO: 614296 - DNA, 25 bp, Mus musculus
ggccactataaacaagactccatgt

SEQ ID NO: 614297 - DNA, 25 bp, Mus musculus
ggccactataaagaagactccatgt

SEQ ID NO: 614298 - DNA, 25 bp, Mus musculus
ggccactataccattgttaagatat

SEQ ID NO: 614299 - DNA, 25 bp, Mus musculus
ggccactatacctttgttaagatat

SEQ ID NO: 614300 - DNA, 25 bp, Mus musculus
ggccactcagcacttaacgtcttta

SEQ ID NO: 614301 - DNA, 25 bp, Mus musculus
ggccactcagcagttaacgtcttta

SEQ ID NO: 614302 - DNA, 25 bp, Mus musculus
ggccactcaggaacttggtttttga

SEQ ID NO: 614303 - DNA, 25 bp, Mus musculus
ggccactcaggatcttggtttttga

SEQ ID NO: 614304 - DNA, 25 bp, Mus musculus
ggccactcaggcattccaaattgga

SEQ ID NO: 614305 - DNA, 25 bp, Mus musculus
ggccactcaggctttccaaattgga

SEQ ID NO: 614306 - DNA, 25 bp, Mus musculus
ggccactcatttatcgtctttggag

SEQ ID NO: 614307 - DNA, 25 bp, Mus musculus
ggccactcatttttcgtctttggag

SEQ ID NO: 614308 - DNA, 25 bp, Mus musculus
ggccactccagtagacgagagctgc

SEQ ID NO: 614309 - DNA, 25 bp, Mus musculus
ggccactccagttgacgagagctgc

SEQ ID NO: 614310 - DNA, 25 bp, Mus musculus
ggccactcccagacaagctgcagga

SEQ ID NO: 614311 - DNA, 25 bp, Mus musculus
ggccactcccagaccgactttgaca

SEQ ID NO: 614312 - DNA, 25 bp, Mus musculus
ggccactcccagtcaagctgcagga

SEQ ID NO: 614313 - DNA, 25 bp, Mus musculus
ggccactcccagtccgactttgaca

SEQ ID NO: 614314 - DNA, 25 bp, Mus musculus
ggccactcctacacatgaggacgga

SEQ ID NO: 614315 - DNA, 25 bp, Mus musculus
ggccactcctactcatgaggacgga

SEQ ID NO: 614316 - DNA, 25 bp, Mus musculus
ggccactcggttcttgtatgatttt

SEQ ID NO: 614317 - DNA, 25 bp, Mus musculus
ggccactcggttgttgtatgatttt

SEQ ID NO: 614318 - DNA, 25 bp, Mus musculus
ggccactctaacaccttttcatagg

SEQ ID NO: 614319 - DNA, 25 bp, Mus musculus
ggccactctaactccttttcatagg

SEQ ID NO: 614320 - DNA, 25 bp, Mus musculus
ggccactctagaacccacagtaggg

SEQ ID NO: 614321 - DNA, 25 bp, Mus musculus
ggccactctagatcccacagtaggg

SEQ ID NO: 614322 - DNA, 25 bp, Mus musculus
ggccactctccaagcttgtaaagta

SEQ ID NO: 614323 - DNA, 25 bp, Mus musculus
ggccactctccatgcttgtaaagta

SEQ ID NO: 614324 - DNA, 25 bp, Mus musculus
ggccactctgcaccacaatgtgaca

SEQ ID NO: 614325 - DNA, 25 bp, Mus musculus
ggccactctgcagcacaatgtgaca

SEQ ID NO: 614326 - DNA, 25 bp, Mus musculus
ggccactctgttcccatgtaaggaa

SEQ ID NO: 614327 - DNA, 25 bp, Mus musculus
ggccactctgttgccatgtaaggaa

SEQ ID NO: 614328 - DNA, 25 bp, Mus musculus
ggccactctttgctctaggcagtag

SEQ ID NO: 614329 - DNA, 25 bp, Mus musculus
ggccactctttggtctaggcagtag

SEQ ID NO: 614330 - DNA, 25 bp, Mus musculus
ggccactgacacagatgagctgcaa

SEQ ID NO: 614331 - DNA, 25 bp, Mus musculus
ggccactgacactgatgagctgcaa

SEQ ID NO: 614332 - DNA, 25 bp, Mus musculus
ggccactgagaaactgaccatgctt

SEQ ID NO: 614333 - DNA, 25 bp, Mus musculus
ggccactgagaatctgaccatgctt

SEQ ID NO: 614334 - DNA, 25 bp, Mus musculus
ggccactgatatcctgacattggct

SEQ ID NO: 614335 - DNA, 25 bp, Mus musculus
ggccactgatatgctgacattggct

SEQ ID NO: 614336 - DNA, 25 bp, Mus musculus
ggccactgctaacaaggatttgact

SEQ ID NO: 614337 - DNA, 25 bp, Mus musculus
ggccactgctaagaaggatttgact

SEQ ID NO: 614338 - DNA, 25 bp, Mus musculus
ggccactgctgtctagcttgtgaaa

SEQ ID NO: 614339 - DNA, 25 bp, Mus musculus
ggccactgctgtgtagcttgtgaaa

SEQ ID NO: 614340 - DNA, 25 bp, Mus musculus
ggccactgcttcaggaaatgctagt

SEQ ID NO: 614341 - DNA, 25 bp, Mus musculus
ggccactgcttctggaaatgctagt

SEQ ID NO: 614342 - DNA, 25 bp, Mus musculus
ggccactgctttacctacaatcaag

SEQ ID NO: 614343 - DNA, 25 bp, Mus musculus
ggccactgcttttcctacaatcaag

SEQ ID NO: 614344 - DNA, 25 bp, Mus musculus
ggccactggcaaaatggtgttcatg

SEQ ID NO: 614345 - DNA, 25 bp, Mus musculus
ggccactggcaatatggtgttcatg

SEQ ID NO: 614346 - DNA, 25 bp, Mus musculus
ggccactggcagattatggatctaa

SEQ ID NO: 614347 - DNA, 25 bp, Mus musculus
ggccactggcagtttatggatctaa

SEQ ID NO: 614348 - DNA, 25 bp, Mus musculus
ggccactggctgagattgatctgaa

SEQ ID NO: 614349 - DNA, 25 bp, Mus musculus
ggccactggctgtgattgatctgaa

SEQ ID NO: 614350 - DNA, 25 bp, Mus musculus
ggccactggcttataatccttttca

SEQ ID NO: 614351 - DNA, 25 bp, Mus musculus
ggccactggcttttaatccttttca

SEQ ID NO: 614352 - DNA, 25 bp, Mus musculus
ggccactgtagtaagtggtcagaga

SEQ ID NO: 614353 - DNA, 25 bp, Mus musculus
ggccactgtagttagtggtcagaga

SEQ ID NO: 614354 - DNA, 25 bp, Mus musculus
ggccactgtggcattaagatcatct

SEQ ID NO: 614355 - DNA, 25 bp, Mus musculus
ggccactgtggctttaagatcatct

SEQ ID NO: 614356 - DNA, 25 bp, Mus musculus
ggccacttaaggattcacacacgga

SEQ ID NO: 614357 - DNA, 25 bp, Mus musculus
ggccacttaaggtttcacacacgga

SEQ ID NO: 614358 - DNA, 25 bp, Mus musculus
ggccacttcagaaggattctcattt

SEQ ID NO: 614359 - DNA, 25 bp, Mus musculus
ggccacttcagatggattctcattt

SEQ ID NO: 614360 - DNA, 25 bp, Mus musculus
ggccacttcctgctaaaattctggt

SEQ ID NO: 614361 - DNA, 25 bp, Mus musculus
ggccacttcctggtaaaattctggt

SEQ ID NO: 614362 - DNA, 25 bp, Mus musculus
ggccacttgactagaatccctggga

SEQ ID NO: 614363 - DNA, 25 bp, Mus musculus
ggccacttgacttgaatccctggga

SEQ ID NO: 614364 - DNA, 25 bp, Mus musculus
ggccacttgcagaactatgtcctga

SEQ ID NO: 614365 - DNA, 25 bp, Mus musculus
ggccacttgcagtactatgtcctga

SEQ ID NO: 614366 - DNA, 25 bp, Mus musculus
ggccacttgggcacctggacctgga

SEQ ID NO: 614367 - DNA, 25 bp, Mus musculus
ggccacttgggcctaaagatccaac

SEQ ID NO: 614368 - DNA, 25 bp, Mus musculus
ggccacttgggcgtaaagatccaac

SEQ ID NO: 614369 - DNA, 25 bp, Mus musculus
ggccacttgggctcctggacctgga

SEQ ID NO: 614370 - DNA, 25 bp, Mus musculus
ggccacttggtgagggcaagaaccc

SEQ ID NO: 614371 - DNA, 25 bp, Mus musculus
ggccacttggtgtgggcaagaaccc

SEQ ID NO: 614372 - DNA, 25 bp, Mus musculus
ggccacttttcaccacaaactaatt

SEQ ID NO: 614373 - DNA, 25 bp, Mus musculus
ggccacttttcagcacaaactaatt

SEQ ID NO: 614374 - DNA, 25 bp, Mus musculus
ggccacttttggatgttttgatatt

SEQ ID NO: 614375 - DNA, 25 bp, Mus musculus
ggccacttttggttgttttgatatt

SEQ ID NO: 614376 - DNA, 25 bp, Mus musculus
ggccagaaatgtatgactcctacct

SEQ ID NO: 614377 - DNA, 25 bp, Mus musculus
ggccagaaatgtttgactcctacct

SEQ ID NO: 614378 - DNA, 25 bp, Mus musculus
ggccagaacaagcagcattccatta

SEQ ID NO: 614379 - DNA, 25 bp, Mus musculus
ggccagaacaaggagcattccatta

SEQ ID NO: 614380 - DNA, 25 bp, Mus musculus
ggccagaacatcagtgtgcgtttct

SEQ ID NO: 614381 - DNA, 25 bp, Mus musculus
ggccagaacatccaattgtacccgg

SEQ ID NO: 614382 - DNA, 25 bp, Mus musculus
ggccagaacatcgaattgtacccgg

SEQ ID NO: 614383 - DNA, 25 bp, Mus musculus
ggccagaacatctgtgtgcgtttct

SEQ ID NO: 614384 - DNA, 25 bp, Mus musculus
ggccagaacccacaggcaagagctg

SEQ ID NO: 614385 - DNA, 25 bp, Mus musculus
ggccagaacccagaggcaagagctg

SEQ ID NO: 614386 - DNA, 25 bp, Mus musculus
ggccagaactgtaactgctgagaca

SEQ ID NO: 614387 - DNA, 25 bp, Mus musculus
ggccagaactgttactgctgagaca

SEQ ID NO: 614388 - DNA, 25 bp, Mus musculus
ggccagaagacaacagggtttgctt

SEQ ID NO: 614389 - DNA, 25 bp, Mus musculus
ggccagaagacatcagggtttgctt

SEQ ID NO: 614390 - DNA, 25 bp, Mus musculus
ggccagaagactaagctccatggga

SEQ ID NO: 614391 - DNA, 25 bp, Mus musculus
ggccagaagacttagctccatggga

SEQ ID NO: 614392 - DNA, 25 bp, Mus musculus
ggccagaatcgtaggcagcttttct

SEQ ID NO: 614393 - DNA, 25 bp, Mus musculus
ggccagaatcgttggcagcttttct

SEQ ID NO: 614394 - DNA, 25 bp, Mus musculus
ggccagaattttaacgaccttccat

SEQ ID NO: 614395 - DNA, 25 bp, Mus musculus
ggccagaatttttacgaccttccat

SEQ ID NO: 614396 - DNA, 25 bp, Mus musculus
ggccagacaatcagcttattcactt

SEQ ID NO: 614397 - DNA, 25 bp, Mus musculus
ggccagacaatctgcttattcactt

SEQ ID NO: 614398 - DNA, 25 bp, Mus musculus
ggccagacaattacctttcagacag

SEQ ID NO: 614399 - DNA, 25 bp, Mus musculus
ggccagacaatttcctttcagacag

SEQ ID NO: 614400 - DNA, 25 bp, Mus musculus
ggccagacacacattcataggcata

SEQ ID NO: 614401 - DNA, 25 bp, Mus musculus
ggccagacacactttcataggcata

SEQ ID NO: 614402 - DNA, 25 bp, Mus musculus
ggccagacactaacaacagacttat

SEQ ID NO: 614403 - DNA, 25 bp, Mus musculus
ggccagacactatcaacagacttat

SEQ ID NO: 614404 - DNA, 25 bp, Mus musculus
ggccagacactgcttgccaagatgg

SEQ ID NO: 614405 - DNA, 25 bp, Mus musculus
ggccagacactggttgccaagatgg

SEQ ID NO: 614406 - DNA, 25 bp, Mus musculus
ggccagacaggcaccaggagcaagt

SEQ ID NO: 614407 - DNA, 25 bp, Mus musculus
ggccagacaggctccaggagcaagt

SEQ ID NO: 614408 - DNA, 25 bp, Mus musculus
ggccagacattcacgtggtgacaga

SEQ ID NO: 614409 - DNA, 25 bp, Mus musculus
ggccagacattctcgtggtgacaga

SEQ ID NO: 614410 - DNA, 25 bp, Mus musculus
ggccagaccaagatgacgcagtttt

SEQ ID NO: 614411 - DNA, 25 bp, Mus musculus
ggccagaccaagttgacgcagtttt

SEQ ID NO: 614412 - DNA, 25 bp, Mus musculus
ggccagaccaggctactgggtaaat

SEQ ID NO: 614413 - DNA, 25 bp, Mus musculus
ggccagaccagggtactgggtaaat

SEQ ID NO: 614414 - DNA, 25 bp, Mus musculus
ggccagacctgcctggtgcactaca

SEQ ID NO: 614415 - DNA, 25 bp, Mus musculus
ggccagacctgcgtggtgcactaca

SEQ ID NO: 614416 - DNA, 25 bp, Mus musculus
ggccagactggacccattatcatag

SEQ ID NO: 614417 - DNA, 25 bp, Mus musculus
ggccagactggagccattatcatag

SEQ ID NO: 614418 - DNA, 25 bp, Mus musculus
ggccagactgtgaaaagactcagca

SEQ ID NO: 614419 - DNA, 25 bp, Mus musculus
ggccagactgtgtaaagactcagca

SEQ ID NO: 614420 - DNA, 25 bp, Mus musculus
ggccagacttcaccttttcaaagct

SEQ ID NO: 614421 - DNA, 25 bp, Mus musculus
ggccagacttcagcttttcaaagct

SEQ ID NO: 614422 - DNA, 25 bp, Mus musculus
ggccagagaatgatatgctttgaga

SEQ ID NO: 614423 - DNA, 25 bp, Mus musculus
ggccagagaatgttatgctttgaga

SEQ ID NO: 614424 - DNA, 25 bp, Mus musculus
ggccagagaggtagttggatcccat

SEQ ID NO: 614425 - DNA, 25 bp, Mus musculus
ggccagagaggttgttggatcccat

SEQ ID NO: 614426 - DNA, 25 bp, Mus musculus
ggccagagatccaagtacttatcaa

SEQ ID NO: 614427 - DNA, 25 bp, Mus musculus
ggccagagatcctagtacttatcaa

SEQ ID NO: 614428 - DNA, 25 bp, Mus musculus
ggccagagatgaccttctccatcaa

SEQ ID NO: 614429 - DNA, 25 bp, Mus musculus
ggccagagatgacgccttctgactc

SEQ ID NO: 614430 - DNA, 25 bp, Mus musculus
ggccagagatgagcttctccatcaa

SEQ ID NO: 614431 - DNA, 25 bp, Mus musculus
ggccagagatgaggccttctgactc

SEQ ID NO: 614432 - DNA, 25 bp, Mus musculus
ggccagagcgagatcgattgcttct

SEQ ID NO: 614433 - DNA, 25 bp, Mus musculus
ggccagagcgagttcgattgcttct

SEQ ID NO: 614434 - DNA, 25 bp, Mus musculus
ggccagagcgtgagggtatcatcac

SEQ ID NO: 614435 - DNA, 25 bp, Mus musculus
ggccagagcgtgtgggtatcatcac

SEQ ID NO: 614436 - DNA, 25 bp, Mus musculus
ggccagagctgcatgggcatttctt

SEQ ID NO: 614437 - DNA, 25 bp, Mus musculus
ggccagagctgcttgggcatttctt

SEQ ID NO: 614438 - DNA, 25 bp, Mus musculus
ggccagaggctgagtttaaccatta

SEQ ID NO: 614439 - DNA, 25 bp, Mus musculus
ggccagaggctgtgtttaaccatta

SEQ ID NO: 614440 - DNA, 25 bp, Mus musculus
ggccagagggacagtctcttcagac

SEQ ID NO: 614441 - DNA, 25 bp, Mus musculus
ggccagagggactgtctcttcagac

SEQ ID NO: 614442 - DNA, 25 bp, Mus musculus
ggccagagggctcacccaaacctgt

SEQ ID NO: 614443 - DNA, 25 bp, Mus musculus
ggccagagggctgacccaaacctgt

SEQ ID NO: 614444 - DNA, 25 bp, Mus musculus
ggccagaggtcccttctcacgtgtc

SEQ ID NO: 614445 - DNA, 25 bp, Mus musculus
ggccagaggtccgttctcacgtgtc

SEQ ID NO: 614446 - DNA, 25 bp, Mus musculus
ggccagagttttagacagacagaat

SEQ ID NO: 614447 - DNA, 25 bp, Mus musculus
ggccagagtttttgacagacagaat

SEQ ID NO: 614448 - DNA, 25 bp, Mus musculus
ggccagataattatagacttaacat

SEQ ID NO: 614449 - DNA, 25 bp, Mus musculus
ggccagataattttagacttaacat

SEQ ID NO: 614450 - DNA, 25 bp, Mus musculus
ggccagatcacaaattttcattcaa

SEQ ID NO: 614451 - DNA, 25 bp, Mus musculus
ggccagatcacatattttcattcaa

SEQ ID NO: 614452 - DNA, 25 bp, Mus musculus
ggccagatcgatccgagagaaacta

SEQ ID NO: 614453 - DNA, 25 bp, Mus musculus
ggccagatcgatgcgagagaaacta

SEQ ID NO: 614454 - DNA, 25 bp, Mus musculus
ggccagatcttaaacctcactcagg

SEQ ID NO: 614455 - DNA, 25 bp, Mus musculus
ggccagatcttatacctcactcagg

SEQ ID NO: 614456 - DNA, 25 bp, Mus musculus
ggccagatgagcaggatctcgtcct

SEQ ID NO: 614457 - DNA, 25 bp, Mus musculus
ggccagatgagctggatctcgtcct

SEQ ID NO: 614458 - DNA, 25 bp, Mus musculus
ggccagatggccaatgaaatagtca

SEQ ID NO: 614459 - DNA, 25 bp, Mus musculus
ggccagatggcctatgaaatagtca

SEQ ID NO: 614460 - DNA, 25 bp, Mus musculus
ggccagatggtcatctccacagtga

SEQ ID NO: 614461 - DNA, 25 bp, Mus musculus
ggccagatggtcttctccacagtga

SEQ ID NO: 614462 - DNA, 25 bp, Mus musculus
ggccagatgtcactgtgatttctct

SEQ ID NO: 614463 - DNA, 25 bp, Mus musculus
ggccagatgtcagtgtgatttctct

SEQ ID NO: 614464 - DNA, 25 bp, Mus musculus
ggccagatgtggaaactcattagaa

SEQ ID NO: 614465 - DNA, 25 bp, Mus musculus
ggccagatgtggatgagcatacgca

SEQ ID NO: 614466 - DNA, 25 bp, Mus musculus
ggccagatgtggtaactcattagaa

SEQ ID NO: 614467 - DNA, 25 bp, Mus musculus
ggccagatgtggttgagcatacgca

SEQ ID NO: 614468 - DNA, 25 bp, Mus musculus
ggccagattcccaagctaaaacctt

SEQ ID NO: 614469 - DNA, 25 bp, Mus musculus
ggccagattccctagctaaaacctt

SEQ ID NO: 614470 - DNA, 25 bp, Mus musculus
ggccagattgggattctcaatagat

SEQ ID NO: 614471 - DNA, 25 bp, Mus musculus
ggccagattgggtttctcaatagat

SEQ ID NO: 614472 - DNA, 25 bp, Mus musculus
ggccagatttaaaactcgcgtttct

SEQ ID NO: 614473 - DNA, 25 bp, Mus musculus
ggccagatttaatactcgcgtttct

SEQ ID NO: 614474 - DNA, 25 bp, Mus musculus
ggccagcaacaaccagaatttgaat

SEQ ID NO: 614475 - DNA, 25 bp, Mus musculus
ggccagcaacaagcagaatttgaat

SEQ ID NO: 614476 - DNA, 25 bp, Mus musculus
ggccagcaacataaacaggacttct

SEQ ID NO: 614477 - DNA, 25 bp, Mus musculus
ggccagcaacattaacaggacttct

SEQ ID NO: 614478 - DNA, 25 bp, Mus musculus
ggccagcaagaacatttgtgcctca

SEQ ID NO: 614479 - DNA, 25 bp, Mus musculus
ggccagcaagaagatttgtgcctca

SEQ ID NO: 614480 - DNA, 25 bp, Mus musculus
ggccagcaaggacacctccaagctg

SEQ ID NO: 614481 - DNA, 25 bp, Mus musculus
ggccagcaaggacagagcaccaact

SEQ ID NO: 614482 - DNA, 25 bp, Mus musculus
ggccagcaaggacatgcataccaaa

SEQ ID NO: 614483 - DNA, 25 bp, Mus musculus
ggccagcaaggagacctccaagctg

SEQ ID NO: 614484 - DNA, 25 bp, Mus musculus
ggccagcaaggagagagcaccaact

SEQ ID NO: 614485 - DNA, 25 bp, Mus musculus
ggccagcaaggagatgcataccaaa

SEQ ID NO: 614486 - DNA, 25 bp, Mus musculus
ggccagcacaaaatagccctccaga

SEQ ID NO: 614487 - DNA, 25 bp, Mus musculus
ggccagcacaaattagccctccaga

SEQ ID NO: 614488 - DNA, 25 bp, Mus musculus
ggccagcacaggcaacgtcaaactg

SEQ ID NO: 614489 - DNA, 25 bp, Mus musculus
ggccagcacagggaacgtcaaactg

SEQ ID NO: 614490 - DNA, 25 bp, Mus musculus
ggccagcaccataccagagacaaat

SEQ ID NO: 614491 - DNA, 25 bp, Mus musculus
ggccagcaccattccagagacaaat

SEQ ID NO: 614492 - DNA, 25 bp, Mus musculus
ggccagcacgctatctcaaaagaac

SEQ ID NO: 614493 - DNA, 25 bp, Mus musculus
ggccagcacgctttctcaaaagaac

SEQ ID NO: 614494 - DNA, 25 bp, Mus musculus
ggccagcactgactgaatgtacagt

SEQ ID NO: 614495 - DNA, 25 bp, Mus musculus
ggccagcactgagtgaatgtacagt

SEQ ID NO: 614496 - DNA, 25 bp, Mus musculus
ggccagcactgcatcgtctcagaag

SEQ ID NO: 614497 - DNA, 25 bp, Mus musculus
ggccagcactgcttcgtctcagaag

SEQ ID NO: 614498 - DNA, 25 bp, Mus musculus
ggccagcacttcatacaaggatgaa

SEQ ID NO: 614499 - DNA, 25 bp, Mus musculus
ggccagcacttcttacaaggatgaa

SEQ ID NO: 614500 - DNA, 25 bp, Mus musculus
ggccagcagaggctacaaaaactaa

SEQ ID NO: 614501 - DNA, 25 bp, Mus musculus
ggccagcagagggtacaaaaactaa

SEQ ID NO: 614502 - DNA, 25 bp, Mus musculus
ggccagcagggaatttaaccaataa

SEQ ID NO: 614503 - DNA, 25 bp, Mus musculus
ggccagcagggattttaaccaataa

SEQ ID NO: 614504 - DNA, 25 bp, Mus musculus
ggccagcagtacatctccattattt

SEQ ID NO: 614505 - DNA, 25 bp, Mus musculus
ggccagcagtacttctccattattt

SEQ ID NO: 614506 - DNA, 25 bp, Mus musculus
ggccagcagtgcaccactggagaat

SEQ ID NO: 614507 - DNA, 25 bp, Mus musculus
ggccagcagtgctccactggagaat

SEQ ID NO: 614508 - DNA, 25 bp, Mus musculus
ggccagcatgagatccctgttaaaa

SEQ ID NO: 614509 - DNA, 25 bp, Mus musculus
ggccagcatgagttccctgttaaaa

SEQ ID NO: 614510 - DNA, 25 bp, Mus musculus
ggccagcatgcaactgtgggaatgt

SEQ ID NO: 614511 - DNA, 25 bp, Mus musculus
ggccagcatgcatctgtgggaatgt

SEQ ID NO: 614512 - DNA, 25 bp, Mus musculus
ggccagcatggactatcctcaggaa

SEQ ID NO: 614513 - DNA, 25 bp, Mus musculus
ggccagcatggagtatcctcaggaa

SEQ ID NO: 614514 - DNA, 25 bp, Mus musculus
ggccagccacgcaacatggatgggc

SEQ ID NO: 614515 - DNA, 25 bp, Mus musculus
ggccagccacgctacatggatgggc

SEQ ID NO: 614516 - DNA, 25 bp, Mus musculus
ggccagccagaccagtatagattct

SEQ ID NO: 614517 - DNA, 25 bp, Mus musculus
ggccagccagacgagtatagattct

SEQ ID NO: 614518 - DNA, 25 bp, Mus musculus
ggccagccagagatctagattagtg

SEQ ID NO: 614519 - DNA, 25 bp, Mus musculus
ggccagccagagttctagattagtg

SEQ ID NO: 614520 - DNA, 25 bp, Mus musculus
ggccagccagataggactcagccag

SEQ ID NO: 614521 - DNA, 25 bp, Mus musculus
ggccagccagatccaactttgttag

SEQ ID NO: 614522 - DNA, 25 bp, Mus musculus
ggccagccagatgcaactttgttag

SEQ ID NO: 614523 - DNA, 25 bp, Mus musculus
ggccagccagattggactcagccag

SEQ ID NO: 614524 - DNA, 25 bp, Mus musculus
ggccagccaggaccagggtggccga

SEQ ID NO: 614525 - DNA, 25 bp, Mus musculus
ggccagccaggagcagggtggccga

SEQ ID NO: 614526 - DNA, 25 bp, Mus musculus
ggccagccatgcagtgaccaaagag

SEQ ID NO: 614527 - DNA, 25 bp, Mus musculus
ggccagccatgctgtgaccaaagag

SEQ ID NO: 614528 - DNA, 25 bp, Mus musculus
ggccagcccaacactttgatgtttg

SEQ ID NO: 614529 - DNA, 25 bp, Mus musculus
ggccagcccaactctttgatgtttg

SEQ ID NO: 614530 - DNA, 25 bp, Mus musculus
ggccagcccactcgatactggaaga

SEQ ID NO: 614531 - DNA, 25 bp, Mus musculus
ggccagcccactggatactggaaga

SEQ ID NO: 614532 - DNA, 25 bp, Mus musculus
ggccagccctgcagaagagagcaaa

SEQ ID NO: 614533 - DNA, 25 bp, Mus musculus
ggccagccctgctgaagagagcaaa

SEQ ID NO: 614534 - DNA, 25 bp, Mus musculus
ggccagcctactctggtcagcagga

SEQ ID NO: 614535 - DNA, 25 bp, Mus musculus
ggccagcctactgtggtcagcagga

SEQ ID NO: 614536 - DNA, 25 bp, Mus musculus
ggccagcctaggatatatattgaat

SEQ ID NO: 614537 - DNA, 25 bp, Mus musculus
ggccagcctaggttatatattgaat

SEQ ID NO: 614538 - DNA, 25 bp, Mus musculus
ggccagcctagtctaaggaagagtt

SEQ ID NO: 614539 - DNA, 25 bp, Mus musculus
ggccagcctagtgtaaggaagagtt

SEQ ID NO: 614540 - DNA, 25 bp, Mus musculus
ggccagcctcagcacgaggaaccaa

SEQ ID NO: 614541 - DNA, 25 bp, Mus musculus
ggccagcctcagctgtcttctagga

SEQ ID NO: 614542 - DNA, 25 bp, Mus musculus
ggccagcctcaggacgaggaaccaa

SEQ ID NO: 614543 - DNA, 25 bp, Mus musculus
ggccagcctcaggtgtcttctagga

SEQ ID NO: 614544 - DNA, 25 bp, Mus musculus
ggccagcctcatatacaggagacat

SEQ ID NO: 614545 - DNA, 25 bp, Mus musculus
ggccagcctcatttacaggagacat

SEQ ID NO: 614546 - DNA, 25 bp, Mus musculus
ggccagcctcccaacattctttatt

SEQ ID NO: 614547 - DNA, 25 bp, Mus musculus
ggccagcctccctacattctttatt

SEQ ID NO: 614548 - DNA, 25 bp, Mus musculus
ggccagcctgacagacatagcaagt

SEQ ID NO: 614549 - DNA, 25 bp, Mus musculus
ggccagcctgactgacatagcaagt

SEQ ID NO: 614550 - DNA, 25 bp, Mus musculus
ggccagcctgatctacacatcgagg

SEQ ID NO: 614551 - DNA, 25 bp, Mus musculus
ggccagcctgatgtacacatcgagg

SEQ ID NO: 614552 - DNA, 25 bp, Mus musculus
ggccagcctgggacataatgtaaga

SEQ ID NO: 614553 - DNA, 25 bp, Mus musculus
ggccagcctgggtcataatgtaaga

SEQ ID NO: 614554 - DNA, 25 bp, Mus musculus
ggccagccttccataatacagattt

SEQ ID NO: 614555 - DNA, 25 bp, Mus musculus
ggccagccttccttaatacagattt

SEQ ID NO: 614556 - DNA, 25 bp, Mus musculus
ggccagcgacagacaagaccaagcg

SEQ ID NO: 614557 - DNA, 25 bp, Mus musculus
ggccagcgacagtcaagaccaagcg

SEQ ID NO: 614558 - DNA, 25 bp, Mus musculus
ggccagcgtggacaggaacctttca

SEQ ID NO: 614559 - DNA, 25 bp, Mus musculus
ggccagcgtggagaggaacctttca

SEQ ID NO: 614560 - DNA, 25 bp, Mus musculus
ggccagcgtggcaatgaaattcacc

SEQ ID NO: 614561 - DNA, 25 bp, Mus musculus
ggccagcgtggctatgaaattcacc

SEQ ID NO: 614562 - DNA, 25 bp, Mus musculus
ggccagctacctaattcaaacatca

SEQ ID NO: 614563 - DNA, 25 bp, Mus musculus
ggccagctaccttattcaaacatca

SEQ ID NO: 614564 - DNA, 25 bp, Mus musculus
ggccagctcattcttaccaatctct

SEQ ID NO: 614565 - DNA, 25 bp, Mus musculus
ggccagctcattgttaccaatctct

SEQ ID NO: 614566 - DNA, 25 bp, Mus musculus
ggccagctctggcatgcttgttatt

SEQ ID NO: 614567 - DNA, 25 bp, Mus musculus
ggccagctctgggatgcttgttatt

SEQ ID NO: 614568 - DNA, 25 bp, Mus musculus
ggccagctgaacactccaaggagga

SEQ ID NO: 614569 - DNA, 25 bp, Mus musculus
ggccagctgaactctccaaggagga

SEQ ID NO: 614570 - DNA, 25 bp, Mus musculus
ggccagctgcatcgacatatcagac

SEQ ID NO: 614571 - DNA, 25 bp, Mus musculus
ggccagctgcatggacatatcagac

SEQ ID NO: 614572 - DNA, 25 bp, Mus musculus
ggccagctggacacaataggacgga

SEQ ID NO: 614573 - DNA, 25 bp, Mus musculus
ggccagctggactcaataggacgga

SEQ ID NO: 614574 - DNA, 25 bp, Mus musculus
ggccagcttatgaccttagcagctt

SEQ ID NO: 614575 - DNA, 25 bp, Mus musculus
ggccagcttatgtccttagcagctt

SEQ ID NO: 614576 - DNA, 25 bp, Mus musculus
ggccagcttcagcttcataacattg

SEQ ID NO: 614577 - DNA, 25 bp, Mus musculus
ggccagcttcaggttcataacattg

SEQ ID NO: 614578 - DNA, 25 bp, Mus musculus
ggccagcttctgcttagtgttttgt

SEQ ID NO: 614579 - DNA, 25 bp, Mus musculus
ggccagcttctggttagtgttttgt

SEQ ID NO: 614580 - DNA, 25 bp, Mus musculus
ggccagcttgctcctcaacaaagga

SEQ ID NO: 614581 - DNA, 25 bp, Mus musculus
ggccagcttgctgctcaacaaagga

SEQ ID NO: 614582 - DNA, 25 bp, Mus musculus
ggccagcttggactatatgatatga

SEQ ID NO: 614583 - DNA, 25 bp, Mus musculus
ggccagcttggagtatatgatatga

SEQ ID NO: 614584 - DNA, 25 bp, Mus musculus
ggccagcttggccaaaatcggtaag

SEQ ID NO: 614585 - DNA, 25 bp, Mus musculus
ggccagcttggcgaaaatcggtaag

SEQ ID NO: 614586 - DNA, 25 bp, Mus musculus
ggccagctttccattgttgtggtga

SEQ ID NO: 614587 - DNA, 25 bp, Mus musculus
ggccagctttcctttgttgtggtga

SEQ ID NO: 614588 - DNA, 25 bp, Mus musculus
ggccagcttttgctaaaggtccaag

SEQ ID NO: 614589 - DNA, 25 bp, Mus musculus
ggccagcttttggtaaaggtccaag

SEQ ID NO: 614590 - DNA, 25 bp, Mus musculus
ggccaggaaaatctcgagattctcc

SEQ ID NO: 614591 - DNA, 25 bp, Mus musculus
ggccaggaaaatgtcgagattctcc

SEQ ID NO: 614592 - DNA, 25 bp, Mus musculus
ggccaggaaggtctctttccaggaa

SEQ ID NO: 614593 - DNA, 25 bp, Mus musculus
ggccaggaaggtgtctttccaggaa

SEQ ID NO: 614594 - DNA, 25 bp, Mus musculus
ggccaggaatggctttgtcacagat

SEQ ID NO: 614595 - DNA, 25 bp, Mus musculus
ggccaggaatgggtttgtcacagat

SEQ ID NO: 614596 - DNA, 25 bp, Mus musculus
ggccaggacaagaggttgtcttcct

SEQ ID NO: 614597 - DNA, 25 bp, Mus musculus
ggccaggacaagtggttgtcttcct

SEQ ID NO: 614598 - DNA, 25 bp, Mus musculus
ggccaggacataacgaaaggacatt

SEQ ID NO: 614599 - DNA, 25 bp, Mus musculus
ggccaggacatatcgaaaggacatt

SEQ ID NO: 614600 - DNA, 25 bp, Mus musculus
ggccaggaccaaatcctacatcgca

SEQ ID NO: 614601 - DNA, 25 bp, Mus musculus
ggccaggaccaattcctacatcgca

SEQ ID NO: 614602 - DNA, 25 bp, Mus musculus
ggccaggacgctcgtctgccatcaa

SEQ ID NO: 614603 - DNA, 25 bp, Mus musculus
ggccaggacgctggtctgccatcaa

SEQ ID NO: 614604 - DNA, 25 bp, Mus musculus
ggccaggactggcatccaataaccc

SEQ ID NO: 614605 - DNA, 25 bp, Mus musculus
ggccaggactgggatccaataaccc

SEQ ID NO: 614606 - DNA, 25 bp, Mus musculus
ggccaggagaaactcacttctgtgt

SEQ ID NO: 614607 - DNA, 25 bp, Mus musculus
ggccaggagaaagtcacttctgtgt

SEQ ID NO: 614608 - DNA, 25 bp, Mus musculus
ggccaggagcacagtgtctccaagc

SEQ ID NO: 614609 - DNA, 25 bp, Mus musculus
ggccaggagcactgtgtctccaagc

SEQ ID NO: 614610 - DNA, 25 bp, Mus musculus
ggccaggagcatcgctccatgataa

SEQ ID NO: 614611 - DNA, 25 bp, Mus musculus
ggccaggagcatggctccatgataa

SEQ ID NO: 614612 - DNA, 25 bp, Mus musculus
ggccaggaggataattctgtgtatc

SEQ ID NO: 614613 - DNA, 25 bp, Mus musculus
ggccaggaggatcccctggatacat

SEQ ID NO: 614614 - DNA, 25 bp, Mus musculus
ggccaggaggatgccctggatacat

SEQ ID NO: 614615 - DNA, 25 bp, Mus musculus
ggccaggaggattattctgtgtatc

SEQ ID NO: 614616 - DNA, 25 bp, Mus musculus
ggccaggagggcaagaagtcacata

SEQ ID NO: 614617 - DNA, 25 bp, Mus musculus
ggccaggagggctagaagtcacata

SEQ ID NO: 614618 - DNA, 25 bp, Mus musculus
ggccaggatccacttgagcagcaga

SEQ ID NO: 614619 - DNA, 25 bp, Mus musculus
ggccaggatccagttgagcagcaga

SEQ ID NO: 614620 - DNA, 25 bp, Mus musculus
ggccaggatctactgtctcctggtc

SEQ ID NO: 614621 - DNA, 25 bp, Mus musculus
ggccaggatctagtgtctcctggtc

SEQ ID NO: 614622 - DNA, 25 bp, Mus musculus
ggccaggcaagaccatgctttctaa

SEQ ID NO: 614623 - DNA, 25 bp, Mus musculus
ggccaggcaagagcatgctttctaa

SEQ ID NO: 614624 - DNA, 25 bp, Mus musculus
ggccaggcagaaacttagacgttca

SEQ ID NO: 614625 - DNA, 25 bp, Mus musculus
ggccaggcagaatcttagacgttca

SEQ ID NO: 614626 - DNA, 25 bp, Mus musculus
ggccaggcagcgatccacggaccaa

SEQ ID NO: 614627 - DNA, 25 bp, Mus musculus
ggccaggcagcgttccacggaccaa

SEQ ID NO: 614628 - DNA, 25 bp, Mus musculus
ggccaggcagttccataaacatgca

SEQ ID NO: 614629 - DNA, 25 bp, Mus musculus
ggccaggcagttgcataaacatgca

SEQ ID NO: 614630 - DNA, 25 bp, Mus musculus
ggccaggcatcaagaacacttgtaa

SEQ ID NO: 614631 - DNA, 25 bp, Mus musculus
ggccaggcatcatgaacacttgtaa

SEQ ID NO: 614632 - DNA, 25 bp, Mus musculus
ggccaggcatccatacagagcagct

SEQ ID NO: 614633 - DNA, 25 bp, Mus musculus
ggccaggcatccttacagagcagct

SEQ ID NO: 614634 - DNA, 25 bp, Mus musculus
ggccaggccacccatcgtattcttt

SEQ ID NO: 614635 - DNA, 25 bp, Mus musculus
ggccaggccaccgatcgtattcttt

SEQ ID NO: 614636 - DNA, 25 bp, Mus musculus
ggccaggcccagagaaggaacccat

SEQ ID NO: 614637 - DNA, 25 bp, Mus musculus
ggccaggcccagtgaaggaacccat

SEQ ID NO: 614638 - DNA, 25 bp, Mus musculus
ggccaggcccgacatgacgtcattg

SEQ ID NO: 614639 - DNA, 25 bp, Mus musculus
ggccaggcccgagatgacgtcattg

SEQ ID NO: 614640 - DNA, 25 bp, Mus musculus
ggccaggccctgaagtttcaaaagt

SEQ ID NO: 614641 - DNA, 25 bp, Mus musculus
ggccaggccctgtagtttcaaaagt

SEQ ID NO: 614642 - DNA, 25 bp, Mus musculus
ggccaggcctcaagcagtaatgcta

SEQ ID NO: 614643 - DNA, 25 bp, Mus musculus
ggccaggcctcatgcagtaatgcta

SEQ ID NO: 614644 - DNA, 25 bp, Mus musculus
ggccaggccttacagcttatggaat

SEQ ID NO: 614645 - DNA, 25 bp, Mus musculus
ggccaggccttagagcttatggaat

SEQ ID NO: 614646 - DNA, 25 bp, Mus musculus
ggccaggcgcaccaagaacttataa

SEQ ID NO: 614647 - DNA, 25 bp, Mus musculus
ggccaggcgcacgaagaacttataa

SEQ ID NO: 614648 - DNA, 25 bp, Mus musculus
ggccaggcgcttaaggctgcagcca

SEQ ID NO: 614649 - DNA, 25 bp, Mus musculus
ggccaggcgctttaggctgcagcca

SEQ ID NO: 614650 - DNA, 25 bp, Mus musculus
ggccaggcgttgacgcagcagaaat

SEQ ID NO: 614651 - DNA, 25 bp, Mus musculus
ggccaggcgttgtcgcagcagaaat

SEQ ID NO: 614652 - DNA, 25 bp, Mus musculus
ggccaggctaaccagtgctaaccag

SEQ ID NO: 614653 - DNA, 25 bp, Mus musculus
ggccaggctaacgagtgctaaccag

SEQ ID NO: 614654 - DNA, 25 bp, Mus musculus
ggccaggctaatctgacgagctaat

SEQ ID NO: 614655 - DNA, 25 bp, Mus musculus
ggccaggctaatgtgacgagctaat

SEQ ID NO: 614656 - DNA, 25 bp, Mus musculus
ggccaggctctcaacaacttcaggg

SEQ ID NO: 614657 - DNA, 25 bp, Mus musculus
ggccaggctctcacagaagagtcaa

SEQ ID NO: 614658 - DNA, 25 bp, Mus musculus
ggccaggctctctacaacttcaggg

SEQ ID NO: 614659 - DNA, 25 bp, Mus musculus
ggccaggctctctcagaagagtcaa

SEQ ID NO: 614660 - DNA, 25 bp, Mus musculus
ggccaggctgatcgactgatctttg

SEQ ID NO: 614661 - DNA, 25 bp, Mus musculus
ggccaggctgatggactgatctttg

SEQ ID NO: 614662 - DNA, 25 bp, Mus musculus
ggccaggctgttaatcatcaatttc

SEQ ID NO: 614663 - DNA, 25 bp, Mus musculus
ggccaggctgttacatgtaagggct

SEQ ID NO: 614664 - DNA, 25 bp, Mus musculus
ggccaggctgtttatcatcaatttc

SEQ ID NO: 614665 - DNA, 25 bp, Mus musculus
ggccaggctgtttcatgtaagggct

SEQ ID NO: 614666 - DNA, 25 bp, Mus musculus
ggccaggcttatatgcattcgagta

SEQ ID NO: 614667 - DNA, 25 bp, Mus musculus
ggccaggcttatttgcattcgagta

SEQ ID NO: 614668 - DNA, 25 bp, Mus musculus
ggccaggcttcaatttcttgttcaa

SEQ ID NO: 614669 - DNA, 25 bp, Mus musculus
ggccaggcttcattttcttgttcaa

SEQ ID NO: 614670 - DNA, 25 bp, Mus musculus
ggccagggacctagagtacatttat

SEQ ID NO: 614671 - DNA, 25 bp, Mus musculus
ggccagggaccttgagtacatttat

SEQ ID NO: 614672 - DNA, 25 bp, Mus musculus
ggccagggagacagttgtgttatta

SEQ ID NO: 614673 - DNA, 25 bp, Mus musculus
ggccagggagactgttgtgttatta

SEQ ID NO: 614674 - DNA, 25 bp, Mus musculus
ggccagggagcccacaagcatatta

SEQ ID NO: 614675 - DNA, 25 bp, Mus musculus
ggccagggagccgacaagcatatta

SEQ ID NO: 614676 - DNA, 25 bp, Mus musculus
ggccagggattcatcctttgagaga

SEQ ID NO: 614677 - DNA, 25 bp, Mus musculus
ggccagggattcttcctttgagaga

SEQ ID NO: 614678 - DNA, 25 bp, Mus musculus
ggccagggcaagagcatgcattgtt

SEQ ID NO: 614679 - DNA, 25 bp, Mus musculus
ggccagggcaagtgcatgcattgtt

SEQ ID NO: 614680 - DNA, 25 bp, Mus musculus
ggccagggcactacttttatttatt

SEQ ID NO: 614681 - DNA, 25 bp, Mus musculus
ggccagggcacttcttttatttatt

SEQ ID NO: 614682 - DNA, 25 bp, Mus musculus
ggccagggctggagtgacgctggga

SEQ ID NO: 614683 - DNA, 25 bp, Mus musculus
ggccagggctggtgtgacgctggga

SEQ ID NO: 614684 - DNA, 25 bp, Mus musculus
ggccagggctttatatcattgccaa

SEQ ID NO: 614685 - DNA, 25 bp, Mus musculus
ggccagggctttttatcattgccaa

SEQ ID NO: 614686 - DNA, 25 bp, Mus musculus
ggccagggtgatagaatgctgacaa

SEQ ID NO: 614687 - DNA, 25 bp, Mus musculus
ggccagggtgattgaatgctgacaa

SEQ ID NO: 614688 - DNA, 25 bp, Mus musculus
ggccagggtgcaaatccagaagctg

SEQ ID NO: 614689 - DNA, 25 bp, Mus musculus
ggccagggtgcatatccagaagctg

SEQ ID NO: 614690 - DNA, 25 bp, Mus musculus
ggccagggtgctattaacattttag

SEQ ID NO: 614691 - DNA, 25 bp, Mus musculus
ggccagggtgcttttaacattttag

SEQ ID NO: 614692 - DNA, 25 bp, Mus musculus
ggccagggtgtaactcgattgtaga

SEQ ID NO: 614693 - DNA, 25 bp, Mus musculus
ggccagggtgtatctcgattgtaga

SEQ ID NO: 614694 - DNA, 25 bp, Mus musculus
ggccagggttctagggaagcacctg

SEQ ID NO: 614695 - DNA, 25 bp, Mus musculus
ggccagggttcttgggaagcacctg

SEQ ID NO: 614696 - DNA, 25 bp, Mus musculus
ggccaggtaccaatgttggctatta

SEQ ID NO: 614697 - DNA, 25 bp, Mus musculus
ggccaggtaccattgttggctatta

SEQ ID NO: 614698 - DNA, 25 bp, Mus musculus
ggccaggtacccaatcagctgagga

SEQ ID NO: 614699 - DNA, 25 bp, Mus musculus
ggccaggtaccctatcagctgagga

SEQ ID NO: 614700 - DNA, 25 bp, Mus musculus
ggccaggtcactcgttttattttct

SEQ ID NO: 614701 - DNA, 25 bp, Mus musculus
ggccaggtcactggttttattttct

SEQ ID NO: 614702 - DNA, 25 bp, Mus musculus
ggccaggtcagaagatctcaccata

SEQ ID NO: 614703 - DNA, 25 bp, Mus musculus
ggccaggtcagatgatctcaccata

SEQ ID NO: 614704 - DNA, 25 bp, Mus musculus
ggccaggtcctgctgaaactgtttt

SEQ ID NO: 614705 - DNA, 25 bp, Mus musculus
ggccaggtcctggtgaaactgtttt

SEQ ID NO: 614706 - DNA, 25 bp, Mus musculus
ggccaggtctgcatggtgtgtaaaa

SEQ ID NO: 614707 - DNA, 25 bp, Mus musculus
ggccaggtctgcttggtgtgtaaaa

SEQ ID NO: 614708 - DNA, 25 bp, Mus musculus
ggccaggtggagacatagcaattta

SEQ ID NO: 614709 - DNA, 25 bp, Mus musculus
ggccaggtggagtcatagcaattta

SEQ ID NO: 614710 - DNA, 25 bp, Mus musculus
ggccaggttataatcagcataagct

SEQ ID NO: 614711 - DNA, 25 bp, Mus musculus
ggccaggttatattcagcataagct

SEQ ID NO: 614712 - DNA, 25 bp, Mus musculus
ggccaggttcagaagtctatgtctt

SEQ ID NO: 614713 - DNA, 25 bp, Mus musculus
ggccaggttcagtagtctatgtctt

SEQ ID NO: 614714 - DNA, 25 bp, Mus musculus
ggccaggttctcagactcagaagat

SEQ ID NO: 614715 - DNA, 25 bp, Mus musculus
ggccaggttctctgactcagaagat

SEQ ID NO: 614716 - DNA, 25 bp, Mus musculus
ggccaggttgctacagcttgcttgc

SEQ ID NO: 614717 - DNA, 25 bp, Mus musculus
ggccaggttgcttcagcttgcttgc

SEQ ID NO: 614718 - DNA, 25 bp, Mus musculus
ggccaggtttccagggcgcattctt

SEQ ID NO: 614719 - DNA, 25 bp, Mus musculus
ggccaggtttcctgggcgcattctt

SEQ ID NO: 614720 - DNA, 25 bp, Mus musculus
ggccagtaactaaccttgtagctat

SEQ ID NO: 614721 - DNA, 25 bp, Mus musculus
ggccagtaactatccttgtagctat

SEQ ID NO: 614722 - DNA, 25 bp, Mus musculus
ggccagtacaccaacctgcacttcc

SEQ ID NO: 614723 - DNA, 25 bp, Mus musculus
ggccagtacacctacctgcacttcc

SEQ ID NO: 614724 - DNA, 25 bp, Mus musculus
ggccagtaccttccctttgagggta

SEQ ID NO: 614725 - DNA, 25 bp, Mus musculus
ggccagtaccttgcctttgagggta

SEQ ID NO: 614726 - DNA, 25 bp, Mus musculus
ggccagtactccagtgagcagggaa

SEQ ID NO: 614727 - DNA, 25 bp, Mus musculus
ggccagtactcctgtgagcagggaa

SEQ ID NO: 614728 - DNA, 25 bp, Mus musculus
ggccagtagagactactctctgccc

SEQ ID NO: 614729 - DNA, 25 bp, Mus musculus
ggccagtagagagtactctctgccc

SEQ ID NO: 614730 - DNA, 25 bp, Mus musculus
ggccagtagctgcaataccttgtgt

SEQ ID NO: 614731 - DNA, 25 bp, Mus musculus
ggccagtagctggaataccttgtgt

SEQ ID NO: 614732 - DNA, 25 bp, Mus musculus
ggccagtaggagattgatcagctta

SEQ ID NO: 614733 - DNA, 25 bp, Mus musculus
ggccagtaggagtttgatcagctta

SEQ ID NO: 614734 - DNA, 25 bp, Mus musculus
ggccagtagttgaatttgtccatgt

SEQ ID NO: 614735 - DNA, 25 bp, Mus musculus
ggccagtagttgtatttgtccatgt

SEQ ID NO: 614736 - DNA, 25 bp, Mus musculus
ggccagtagtttcaagccctataag

SEQ ID NO: 614737 - DNA, 25 bp, Mus musculus
ggccagtagtttgaagccctataag

SEQ ID NO: 614738 - DNA, 25 bp, Mus musculus
ggccagtcactgatgagtcctttct

SEQ ID NO: 614739 - DNA, 25 bp, Mus musculus
ggccagtcactgttgagtcctttct

SEQ ID NO: 614740 - DNA, 25 bp, Mus musculus
ggccagtcagacaatggtcagcaag

SEQ ID NO: 614741 - DNA, 25 bp, Mus musculus
ggccagtcagacagtgtgtgcacca

SEQ ID NO: 614742 - DNA, 25 bp, Mus musculus
ggccagtcagactatggtcagcaag

SEQ ID NO: 614743 - DNA, 25 bp, Mus musculus
ggccagtcagactgtgtgtgcacca

SEQ ID NO: 614744 - DNA, 25 bp, Mus musculus
ggccagtcagttacagattcatcat

SEQ ID NO: 614745 - DNA, 25 bp, Mus musculus
ggccagtcagtttcagattcatcat

SEQ ID NO: 614746 - DNA, 25 bp, Mus musculus
ggccagtccaagctcttcattgagg

SEQ ID NO: 614747 - DNA, 25 bp, Mus musculus
ggccagtccaaggtcttcattgagg

SEQ ID NO: 614748 - DNA, 25 bp, Mus musculus
ggccagtccagtaggaaaaacggag

SEQ ID NO: 614749 - DNA, 25 bp, Mus musculus
ggccagtccagttggaaaaacggag

SEQ ID NO: 614750 - DNA, 25 bp, Mus musculus
ggccagtcccagacaggaagcatat

SEQ ID NO: 614751 - DNA, 25 bp, Mus musculus
ggccagtcccagtcaggaagcatat

SEQ ID NO: 614752 - DNA, 25 bp, Mus musculus
ggccagtccttgagggtgtcatgta

SEQ ID NO: 614753 - DNA, 25 bp, Mus musculus
ggccagtccttgtgggtgtcatgta

SEQ ID NO: 614754 - DNA, 25 bp, Mus musculus
ggccagtcgaaaagcaaacccagag

SEQ ID NO: 614755 - DNA, 25 bp, Mus musculus
ggccagtcgaaatgcaaacccagag

SEQ ID NO: 614756 - DNA, 25 bp, Mus musculus
ggccagtctccaactatatgtcttt

SEQ ID NO: 614757 - DNA, 25 bp, Mus musculus
ggccagtctccatctatatgtcttt

SEQ ID NO: 614758 - DNA, 25 bp, Mus musculus
ggccagtctgatctatgtaaaaagt

SEQ ID NO: 614759 - DNA, 25 bp, Mus musculus
ggccagtctgatgtatgtaaaaagt

SEQ ID NO: 614760 - DNA, 25 bp, Mus musculus
ggccagtctggaaaagtctgagctt

SEQ ID NO: 614761 - DNA, 25 bp, Mus musculus
ggccagtctggataagtctgagctt

SEQ ID NO: 614762 - DNA, 25 bp, Mus musculus
ggccagtctttgcttctctaatgaa

SEQ ID NO: 614763 - DNA, 25 bp, Mus musculus
ggccagtctttggttctctaatgaa

SEQ ID NO: 614764 - DNA, 25 bp, Mus musculus
ggccagtgaaatccctcagtgggta

SEQ ID NO: 614765 - DNA, 25 bp, Mus musculus
ggccagtgaaatcgtttctgacatc

SEQ ID NO: 614766 - DNA, 25 bp, Mus musculus
ggccagtgaaatgcctcagtgggta

SEQ ID NO: 614767 - DNA, 25 bp, Mus musculus
ggccagtgaaatggtttctgacatc

SEQ ID NO: 614768 - DNA, 25 bp, Mus musculus
ggccagtgacatcgaagccagcctt

SEQ ID NO: 614769 - DNA, 25 bp, Mus musculus
ggccagtgacatggaagccagcctt

SEQ ID NO: 614770 - DNA, 25 bp, Mus musculus
ggccagtgagccaaaaattcagcaa

SEQ ID NO: 614771 - DNA, 25 bp, Mus musculus
ggccagtgagcctaaaattcagcaa

SEQ ID NO: 614772 - DNA, 25 bp, Mus musculus
ggccagtgagctcacttttgcacac

SEQ ID NO: 614773 - DNA, 25 bp, Mus musculus
ggccagtgagctgacttttgcacac

SEQ ID NO: 614774 - DNA, 25 bp, Mus musculus
ggccagtgcagacagaattctacca

SEQ ID NO: 614775 - DNA, 25 bp, Mus musculus
ggccagtgcagagagaattctacca

SEQ ID NO: 614776 - DNA, 25 bp, Mus musculus
ggccagtgcatacaagcttgctgcc

SEQ ID NO: 614777 - DNA, 25 bp, Mus musculus
ggccagtgcatagaagcttgctgcc

SEQ ID NO: 614778 - DNA, 25 bp, Mus musculus
ggccagtgcctgcaactacatcatc

SEQ ID NO: 614779 - DNA, 25 bp, Mus musculus
ggccagtgcctggaactacatcatc

SEQ ID NO: 614780 - DNA, 25 bp, Mus musculus
ggccagtgcggcaatgtacgtacca

SEQ ID NO: 614781 - DNA, 25 bp, Mus musculus
ggccagtgcggctatgtacgtacca

SEQ ID NO: 614782 - DNA, 25 bp, Mus musculus
ggccagtggtgtcagccaggacagg

SEQ ID NO: 614783 - DNA, 25 bp, Mus musculus
ggccagtggtgtgagccaggacagg

SEQ ID NO: 614784 - DNA, 25 bp, Mus musculus
ggccagtgtaaaccattttgcgatg

SEQ ID NO: 614785 - DNA, 25 bp, Mus musculus
ggccagtgtaaagcattttgcgatg

SEQ ID NO: 614786 - DNA, 25 bp, Mus musculus
ggccagtgtctcatcacttgtttaa

SEQ ID NO: 614787 - DNA, 25 bp, Mus musculus
ggccagtgtctcttcacttgtttaa

SEQ ID NO: 614788 - DNA, 25 bp, Mus musculus
ggccagtgttcaacttaattgttga

SEQ ID NO: 614789 - DNA, 25 bp, Mus musculus
ggccagtgttcatcttaattgttga

SEQ ID NO: 614790 - DNA, 25 bp, Mus musculus
ggccagttaattcctgtaatgtgct

SEQ ID NO: 614791 - DNA, 25 bp, Mus musculus
ggccagttaattgctgtaatgtgct

SEQ ID NO: 614792 - DNA, 25 bp, Mus musculus
ggccagttaccaacatgttctgtac

SEQ ID NO: 614793 - DNA, 25 bp, Mus musculus
ggccagttaccatcatgttctgtac

SEQ ID NO: 614794 - DNA, 25 bp, Mus musculus
ggccagttaggccttcactccttaa

SEQ ID NO: 614795 - DNA, 25 bp, Mus musculus
ggccagttaggcgttcactccttaa

SEQ ID NO: 614796 - DNA, 25 bp, Mus musculus
ggccagttatgcaccggcaagtgca

SEQ ID NO: 614797 - DNA, 25 bp, Mus musculus
ggccagttatgctccggcaagtgca

SEQ ID NO: 614798 - DNA, 25 bp, Mus musculus
ggccagttcaacattgtccatgtga

SEQ ID NO: 614799 - DNA, 25 bp, Mus musculus
ggccagttcaactttgtccatgtga

SEQ ID NO: 614800 - DNA, 25 bp, Mus musculus
ggccagttcaagagcctgggcagcc

SEQ ID NO: 614801 - DNA, 25 bp, Mus musculus
ggccagttcaagtgcctgggcagcc

SEQ ID NO: 614802 - DNA, 25 bp, Mus musculus
ggccagttcactctaacgaaggcat

SEQ ID NO: 614803 - DNA, 25 bp, Mus musculus
ggccagttcactgtaacgaaggcat

SEQ ID NO: 614804 - DNA, 25 bp, Mus musculus
ggccagttcataccaaagttgtact

SEQ ID NO: 614805 - DNA, 25 bp, Mus musculus
ggccagttcatagcaaagttgtact

SEQ ID NO: 614806 - DNA, 25 bp, Mus musculus
ggccagttcattcttggaaagcttt

SEQ ID NO: 614807 - DNA, 25 bp, Mus musculus
ggccagttcattgttggaaagcttt

SEQ ID NO: 614808 - DNA, 25 bp, Mus musculus
ggccagttccccagatgttaaaccg

SEQ ID NO: 614809 - DNA, 25 bp, Mus musculus
ggccagttcccctgatgttaaaccg

SEQ ID NO: 614810 - DNA, 25 bp, Mus musculus
ggccagttccctatcttcataagag

SEQ ID NO: 614811 - DNA, 25 bp, Mus musculus
ggccagttccctttcttcataagag

SEQ ID NO: 614812 - DNA, 25 bp, Mus musculus
ggccagttccttccatagggttaag

SEQ ID NO: 614813 - DNA, 25 bp, Mus musculus
ggccagttccttgcatagggttaag

SEQ ID NO: 614814 - DNA, 25 bp, Mus musculus
ggccagttctggaatgatgatgatt

SEQ ID NO: 614815 - DNA, 25 bp, Mus musculus
ggccagttctggtatgatgatgatt

SEQ ID NO: 614816 - DNA, 25 bp, Mus musculus
ggccagttgacaaagtttcacacaa

SEQ ID NO: 614817 - DNA, 25 bp, Mus musculus
ggccagttgacaagcccggagatgt

SEQ ID NO: 614818 - DNA, 25 bp, Mus musculus
ggccagttgacatagtttcacacaa

SEQ ID NO: 614819 - DNA, 25 bp, Mus musculus
ggccagttgacatgcccggagatgt

SEQ ID NO: 614820 - DNA, 25 bp, Mus musculus
ggccagttgagtactgcaaatgatg

SEQ ID NO: 614821 - DNA, 25 bp, Mus musculus
ggccagttgagttctgcaaatgatg

SEQ ID NO: 614822 - DNA, 25 bp, Mus musculus
ggccagttgatgaacaaatgtatgt

SEQ ID NO: 614823 - DNA, 25 bp, Mus musculus
ggccagttgatgtacaaatgtatgt

SEQ ID NO: 614824 - DNA, 25 bp, Mus musculus
ggccagttgtagcttttgctttaat

SEQ ID NO: 614825 - DNA, 25 bp, Mus musculus
ggccagttgtaggttttgctttaat

SEQ ID NO: 614826 - DNA, 25 bp, Mus musculus
ggccagtttgagagatacagccaac

SEQ ID NO: 614827 - DNA, 25 bp, Mus musculus
ggccagtttgagtgatacagccaac

SEQ ID NO: 614828 - DNA, 25 bp, Mus musculus
ggccagttttttcatcacgtgattg

SEQ ID NO: 614829 - DNA, 25 bp, Mus musculus
ggccagttttttgatcacgtgattg

SEQ ID NO: 614830 - DNA, 25 bp, Mus musculus
ggccataaacaaccatttattctcc

SEQ ID NO: 614831 - DNA, 25 bp, Mus musculus
ggccataaacaagcatttattctcc

SEQ ID NO: 614832 - DNA, 25 bp, Mus musculus
ggccataaactcagtttcctgggat

SEQ ID NO: 614833 - DNA, 25 bp, Mus musculus
ggccataaactctgtttcctgggat

SEQ ID NO: 614834 - DNA, 25 bp, Mus musculus
ggccataactttcaccttttcataa

SEQ ID NO: 614835 - DNA, 25 bp, Mus musculus
ggccataactttgaccttttcataa

SEQ ID NO: 614836 - DNA, 25 bp, Mus musculus
ggccataagattagggctgttccct

SEQ ID NO: 614837 - DNA, 25 bp, Mus musculus
ggccataagatttgggctgttccct

SEQ ID NO: 614838 - DNA, 25 bp, Mus musculus
ggccataaggccaattagctctact

SEQ ID NO: 614839 - DNA, 25 bp, Mus musculus
ggccataaggcctattagctctact

SEQ ID NO: 614840 - DNA, 25 bp, Mus musculus
ggccataatgacatactgtgtaagt

SEQ ID NO: 614841 - DNA, 25 bp, Mus musculus
ggccataatgacttactgtgtaagt

SEQ ID NO: 614842 - DNA, 25 bp, Mus musculus
ggccatacaccaagcactatagttc

SEQ ID NO: 614843 - DNA, 25 bp, Mus musculus
ggccatacaccatgcactatagttc

SEQ ID NO: 614844 - DNA, 25 bp, Mus musculus
ggccatacatatctccagctttgtg

SEQ ID NO: 614845 - DNA, 25 bp, Mus musculus
ggccatacatatgtccagctttgtg

SEQ ID NO: 614846 - DNA, 25 bp, Mus musculus
ggccataccactaccaaaaactggt

SEQ ID NO: 614847 - DNA, 25 bp, Mus musculus
ggccataccacttccaaaaactggt

SEQ ID NO: 614848 - DNA, 25 bp, Mus musculus
ggccatacccagcatggctgatgcc

SEQ ID NO: 614849 - DNA, 25 bp, Mus musculus
ggccatacccaggatggctgatgcc

SEQ ID NO: 614850 - DNA, 25 bp, Mus musculus
ggccataccttacaacctgaaaagc

SEQ ID NO: 614851 - DNA, 25 bp, Mus musculus
ggccataccttagaacctgaaaagc

SEQ ID NO: 614852 - DNA, 25 bp, Mus musculus
ggccatacgaagatcacagacctca

SEQ ID NO: 614853 - DNA, 25 bp, Mus musculus
ggccatacgaagttcacagacctca

SEQ ID NO: 614854 - DNA, 25 bp, Mus musculus
ggccatactcttaggtgggaaccca

SEQ ID NO: 614855 - DNA, 25 bp, Mus musculus
ggccatactctttggtgggaaccca

SEQ ID NO: 614856 - DNA, 25 bp, Mus musculus
ggccatactgttctgaatgcagctt

SEQ ID NO: 614857 - DNA, 25 bp, Mus musculus
ggccatactgttgtgaatgcagctt

SEQ ID NO: 614858 - DNA, 25 bp, Mus musculus
ggccatacttggattcagtcacagg

SEQ ID NO: 614859 - DNA, 25 bp, Mus musculus
ggccatacttggtttcagtcacagg

SEQ ID NO: 614860 - DNA, 25 bp, Mus musculus
ggccatagaccaaacatacgatcag

SEQ ID NO: 614861 - DNA, 25 bp, Mus musculus
ggccatagaccatacatacgatcag

SEQ ID NO: 614862 - DNA, 25 bp, Mus musculus
ggccatagacttcatctgataaaag

SEQ ID NO: 614863 - DNA, 25 bp, Mus musculus
ggccatagacttgatctgataaaag

SEQ ID NO: 614864 - DNA, 25 bp, Mus musculus
ggccatagagttctggtcatcacca

SEQ ID NO: 614865 - DNA, 25 bp, Mus musculus
ggccatagagttgtggtcatcacca

SEQ ID NO: 614866 - DNA, 25 bp, Mus musculus
ggccatagatacactttggacaccc

SEQ ID NO: 614867 - DNA, 25 bp, Mus musculus
ggccatagatactctttggacaccc

SEQ ID NO: 614868 - DNA, 25 bp, Mus musculus
ggccatagcatccactgagggaaga

SEQ ID NO: 614869 - DNA, 25 bp, Mus musculus
ggccatagcatcgactgagggaaga

SEQ ID NO: 614870 - DNA, 25 bp, Mus musculus
ggccatagcatgctggttgacccgt

SEQ ID NO: 614871 - DNA, 25 bp, Mus musculus
ggccatagcatggtggttgacccgt

SEQ ID NO: 614872 - DNA, 25 bp, Mus musculus
ggccatagggaccagaaagcagctt

SEQ ID NO: 614873 - DNA, 25 bp, Mus musculus
ggccatagggacgagaaagcagctt

SEQ ID NO: 614874 - DNA, 25 bp, Mus musculus
ggccataggtgactgtctttctcct

SEQ ID NO: 614875 - DNA, 25 bp, Mus musculus
ggccataggtgagtgtctttctcct

SEQ ID NO: 614876 - DNA, 25 bp, Mus musculus
ggccatagtaaaaatgattaccctc

SEQ ID NO: 614877 - DNA, 25 bp, Mus musculus
ggccatagtaaatatgattaccctc

SEQ ID NO: 614878 - DNA, 25 bp, Mus musculus
ggccatagtggtacagtctttaatc

SEQ ID NO: 614879 - DNA, 25 bp, Mus musculus
ggccatagtggttcagtctttaatc

SEQ ID NO: 614880 - DNA, 25 bp, Mus musculus
ggccatagtttgattactcccttat

SEQ ID NO: 614881 - DNA, 25 bp, Mus musculus
ggccatagtttgtttactcccttat

SEQ ID NO: 614882 - DNA, 25 bp, Mus musculus
ggccatataactcctggactggata

SEQ ID NO: 614883 - DNA, 25 bp, Mus musculus
ggccatataactgctggactggata

SEQ ID NO: 614884 - DNA, 25 bp, Mus musculus
ggccatatagccatactatcaagtg

SEQ ID NO: 614885 - DNA, 25 bp, Mus musculus
ggccatatagccttactatcaagtg

SEQ ID NO: 614886 - DNA, 25 bp, Mus musculus
ggccatatcataaatgcaagctggg

SEQ ID NO: 614887 - DNA, 25 bp, Mus musculus
ggccatatcatatatgcaagctggg

SEQ ID NO: 614888 - DNA, 25 bp, Mus musculus
ggccatatcatgaataattcccaca

SEQ ID NO: 614889 - DNA, 25 bp, Mus musculus
ggccatatcatgtataattcccaca

SEQ ID NO: 614890 - DNA, 25 bp, Mus musculus
ggccatatcattcatgtgagctcct

SEQ ID NO: 614891 - DNA, 25 bp, Mus musculus
ggccatatcattgatgtgagctcct

SEQ ID NO: 614892 - DNA, 25 bp, Mus musculus
ggccatatcgcgaatactacgtaga

SEQ ID NO: 614893 - DNA, 25 bp, Mus musculus
ggccatatcgcgtatactacgtaga

SEQ ID NO: 614894 - DNA, 25 bp, Mus musculus
ggccatatgttacccagagctcatt

SEQ ID NO: 614895 - DNA, 25 bp, Mus musculus
ggccatatgttagccagagctcatt

SEQ ID NO: 614896 - DNA, 25 bp, Mus musculus
ggccatattgctatcaatgaaccag

SEQ ID NO: 614897 - DNA, 25 bp, Mus musculus
ggccatattgctttcaatgaaccag

SEQ ID NO: 614898 - DNA, 25 bp, Mus musculus
ggccatattggtacatattgcatac

SEQ ID NO: 614899 - DNA, 25 bp, Mus musculus
ggccatattggttcatattgcatac

SEQ ID NO: 614900 - DNA, 25 bp, Mus musculus
ggccatatttgcagtaggggctata

SEQ ID NO: 614901 - DNA, 25 bp, Mus musculus
ggccatatttgctgtaggggctata

SEQ ID NO: 614902 - DNA, 25 bp, Mus musculus
ggccatattttaaggtcatttctcg

SEQ ID NO: 614903 - DNA, 25 bp, Mus musculus
ggccatattttatggtcatttctcg

SEQ ID NO: 614904 - DNA, 25 bp, Mus musculus
ggccatcaagccatactaccagaag

SEQ ID NO: 614905 - DNA, 25 bp, Mus musculus
ggccatcaagccttactaccagaag

SEQ ID NO: 614906 - DNA, 25 bp, Mus musculus
ggccatcaagctctcagactcacat

SEQ ID NO: 614907 - DNA, 25 bp, Mus musculus
ggccatcaagctgtcagactcacat

SEQ ID NO: 614908 - DNA, 25 bp, Mus musculus
ggccatcaatgtaccaactaatatg

SEQ ID NO: 614909 - DNA, 25 bp, Mus musculus
ggccatcaatgttccaactaatatg

SEQ ID NO: 614910 - DNA, 25 bp, Mus musculus
ggccatcacaggctctgtagagaga

SEQ ID NO: 614911 - DNA, 25 bp, Mus musculus
ggccatcacagggtctgtagagaga

SEQ ID NO: 614912 - DNA, 25 bp, Mus musculus
ggccatcacataagccaaaggattt

SEQ ID NO: 614913 - DNA, 25 bp, Mus musculus
ggccatcacatatgccaaaggattt

SEQ ID NO: 614914 - DNA, 25 bp, Mus musculus
ggccatcacatgaggcatttccaac

SEQ ID NO: 614915 - DNA, 25 bp, Mus musculus
ggccatcacatgtggcatttccaac

SEQ ID NO: 614916 - DNA, 25 bp, Mus musculus
ggccatcactgtaggacattaccat

SEQ ID NO: 614917 - DNA, 25 bp, Mus musculus
ggccatcactgttggacattaccat

SEQ ID NO: 614918 - DNA, 25 bp, Mus musculus
ggccatcagagtcaactgttctgat

SEQ ID NO: 614919 - DNA, 25 bp, Mus musculus
ggccatcagagtgaactgttctgat

SEQ ID NO: 614920 - DNA, 25 bp, Mus musculus
ggccatcaggaaaacagaagcaatt

SEQ ID NO: 614921 - DNA, 25 bp, Mus musculus
ggccatcaggaatacagaagcaatt

SEQ ID NO: 614922 - DNA, 25 bp, Mus musculus
ggccatcaggtaatcaaactcaaaa

SEQ ID NO: 614923 - DNA, 25 bp, Mus musculus
ggccatcaggtattcaaactcaaaa

SEQ ID NO: 614924 - DNA, 25 bp, Mus musculus
ggccatcaggtcaggatctgctttt

SEQ ID NO: 614925 - DNA, 25 bp, Mus musculus
ggccatcaggtctggatctgctttt

SEQ ID NO: 614926 - DNA, 25 bp, Mus musculus
ggccatcagtccactagagagctgg

SEQ ID NO: 614927 - DNA, 25 bp, Mus musculus
ggccatcagtcctctagagagctgg

SEQ ID NO: 614928 - DNA, 25 bp, Mus musculus
ggccatcatatgcttttaatcttcg

SEQ ID NO: 614929 - DNA, 25 bp, Mus musculus
ggccatcatatggttttaatcttcg

SEQ ID NO: 614930 - DNA, 25 bp, Mus musculus
ggccatcatcctaggtggttagtgc

SEQ ID NO: 614931 - DNA, 25 bp, Mus musculus
ggccatcatccttggtggttagtgc

SEQ ID NO: 614932 - DNA, 25 bp, Mus musculus
ggccatcatgacatccattattatg

SEQ ID NO: 614933 - DNA, 25 bp, Mus musculus
ggccatcatgacttccattattatg

SEQ ID NO: 614934 - DNA, 25 bp, Mus musculus
ggccatcatggacagcctgagcaaa

SEQ ID NO: 614935 - DNA, 25 bp, Mus musculus
ggccatcatggacgtctgcggacca

SEQ ID NO: 614936 - DNA, 25 bp, Mus musculus
ggccatcatggagagcctgagcaaa

SEQ ID NO: 614937 - DNA, 25 bp, Mus musculus
ggccatcatggaggtctgcggacca

SEQ ID NO: 614938 - DNA, 25 bp, Mus musculus
ggccatcatgggattcttagaggac

SEQ ID NO: 614939 - DNA, 25 bp, Mus musculus
ggccatcatgggtttcttagaggac

SEQ ID NO: 614940 - DNA, 25 bp, Mus musculus
ggccatcatgtcattgtatacttcc

SEQ ID NO: 614941 - DNA, 25 bp, Mus musculus
ggccatcatgtctttgtatacttcc

SEQ ID NO: 614942 - DNA, 25 bp, Mus musculus
ggccatcattgaacatctctgtgca

SEQ ID NO: 614943 - DNA, 25 bp, Mus musculus
ggccatcattgatcatctctgtgca

SEQ ID NO: 614944 - DNA, 25 bp, Mus musculus
ggccatcatttcctacgttgagcag

SEQ ID NO: 614945 - DNA, 25 bp, Mus musculus
ggccatcatttcgtacgttgagcag

SEQ ID NO: 614946 - DNA, 25 bp, Mus musculus
ggccatccatatcccatacggtgga

SEQ ID NO: 614947 - DNA, 25 bp, Mus musculus
ggccatccatatgccatacggtgga

SEQ ID NO: 614948 - DNA, 25 bp, Mus musculus
ggccatccatttatgtagcacactt

SEQ ID NO: 614949 - DNA, 25 bp, Mus musculus
ggccatccatttttgtagcacactt

SEQ ID NO: 614950 - DNA, 25 bp, Mus musculus
ggccatcccaagactaaactattct

SEQ ID NO: 614951 - DNA, 25 bp, Mus musculus
ggccatcccaagtctaaactattct

SEQ ID NO: 614952 - DNA, 25 bp, Mus musculus
ggccatcccggccatatagtaagac

SEQ ID NO: 614953 - DNA, 25 bp, Mus musculus
ggccatcccggcgatatagtaagac

SEQ ID NO: 614954 - DNA, 25 bp, Mus musculus
ggccatccctttacatattgatcat

SEQ ID NO: 614955 - DNA, 25 bp, Mus musculus
ggccatcccttttcatattgatcat

SEQ ID NO: 614956 - DNA, 25 bp, Mus musculus
ggccatcctttccttgtgtggaaga

SEQ ID NO: 614957 - DNA, 25 bp, Mus musculus
ggccatcctttcgttgtgtggaaga

SEQ ID NO: 614958 - DNA, 25 bp, Mus musculus
ggccatcgatcactagtagagcgtt

SEQ ID NO: 614959 - DNA, 25 bp, Mus musculus
ggccatcgatcagtagtagagcgtt

SEQ ID NO: 614960 - DNA, 25 bp, Mus musculus
ggccatctaaacactttaagtggag

SEQ ID NO: 614961 - DNA, 25 bp, Mus musculus
ggccatctaaactctttaagtggag

SEQ ID NO: 614962 - DNA, 25 bp, Mus musculus
ggccatctaactatattctgacttt

SEQ ID NO: 614963 - DNA, 25 bp, Mus musculus
ggccatctaactttattctgacttt

SEQ ID NO: 614964 - DNA, 25 bp, Mus musculus
ggccatctaaggacttgcagccttg

SEQ ID NO: 614965 - DNA, 25 bp, Mus musculus
ggccatctaaggtcttgcagccttg

SEQ ID NO: 614966 - DNA, 25 bp, Mus musculus
ggccatctctacatcctgagtggaa

SEQ ID NO: 614967 - DNA, 25 bp, Mus musculus
ggccatctctacttcctgagtggaa

SEQ ID NO: 614968 - DNA, 25 bp, Mus musculus
ggccatctctgacatggagctgaga

SEQ ID NO: 614969 - DNA, 25 bp, Mus musculus
ggccatctctgagatggagctgaga

SEQ ID NO: 614970 - DNA, 25 bp, Mus musculus
ggccatctctgtcctccaggtaatg

SEQ ID NO: 614971 - DNA, 25 bp, Mus musculus
ggccatctctgtgctccaggtaatg

SEQ ID NO: 614972 - DNA, 25 bp, Mus musculus
ggccatctcttgatctagttttacg

SEQ ID NO: 614973 - DNA, 25 bp, Mus musculus
ggccatctcttgttctagttttacg

SEQ ID NO: 614974 - DNA, 25 bp, Mus musculus
ggccatctgatactacagtctgtca

SEQ ID NO: 614975 - DNA, 25 bp, Mus musculus
ggccatctgatagtacagtctgtca

SEQ ID NO: 614976 - DNA, 25 bp, Mus musculus
ggccatctgcttatgccgctaacac

SEQ ID NO: 614977 - DNA, 25 bp, Mus musculus
ggccatctgcttttgccgctaacac

SEQ ID NO: 614978 - DNA, 25 bp, Mus musculus
ggccatcttatcaaaagtccacacc

SEQ ID NO: 614979 - DNA, 25 bp, Mus musculus
ggccatcttatctaaagtccacacc

SEQ ID NO: 614980 - DNA, 25 bp, Mus musculus
ggccatcttatgagttttatctgtg

SEQ ID NO: 614981 - DNA, 25 bp, Mus musculus
ggccatcttatgtgttttatctgtg

SEQ ID NO: 614982 - DNA, 25 bp, Mus musculus
ggccatcttattcaaaggtgactgt

SEQ ID NO: 614983 - DNA, 25 bp, Mus musculus
ggccatcttattgaaaggtgactgt

SEQ ID NO: 614984 - DNA, 25 bp, Mus musculus
ggccatcttccacacaagcagatgt

SEQ ID NO: 614985 - DNA, 25 bp, Mus musculus
ggccatcttccagacaagcagatgt

SEQ ID NO: 614986 - DNA, 25 bp, Mus musculus
ggccatcttcctcagaaatatccct

SEQ ID NO: 614987 - DNA, 25 bp, Mus musculus
ggccatcttcctgagaaatatccct

SEQ ID NO: 614988 - DNA, 25 bp, Mus musculus
ggccatcttgacctacagagtgaaa

SEQ ID NO: 614989 - DNA, 25 bp, Mus musculus
ggccatcttgacgtacagagtgaaa

SEQ ID NO: 614990 - DNA, 25 bp, Mus musculus
ggccatcttggaacttattctttag

SEQ ID NO: 614991 - DNA, 25 bp, Mus musculus
ggccatcttggatcttattctttag

SEQ ID NO: 614992 - DNA, 25 bp, Mus musculus
ggccatcttgggacgcttaaattat

SEQ ID NO: 614993 - DNA, 25 bp, Mus musculus
ggccatcttgggtcgcttaaattat

SEQ ID NO: 614994 - DNA, 25 bp, Mus musculus
ggccatctttacagcctgaagtctt

SEQ ID NO: 614995 - DNA, 25 bp, Mus musculus
ggccatctttactgcctgaagtctt

SEQ ID NO: 614996 - DNA, 25 bp, Mus musculus
ggccatctttatatcttcctgatgt

SEQ ID NO: 614997 - DNA, 25 bp, Mus musculus
ggccatctttatttcttcctgatgt

SEQ ID NO: 614998 - DNA, 25 bp, Mus musculus
ggccatcttttgctcaaatattttc

SEQ ID NO: 614999 - DNA, 25 bp, Mus musculus
ggccatcttttggtcaaatattttc

SEQ ID NO: 615000 - DNA, 25 bp, Mus musculus
ggccatgaacatcacctgtacaggc

SEQ ID NO: 615001 - DNA, 25 bp, Mus musculus
ggccatgaacatgacctgtacaggc

SEQ ID NO: 615002 - DNA, 25 bp, Mus musculus
ggccatgaaggcattttacaaggat

SEQ ID NO: 615003 - DNA, 25 bp, Mus musculus
ggccatgaaggctttttacaaggat

SEQ ID NO: 615004 - DNA, 25 bp, Mus musculus
ggccatgacaataaatatcctttat

SEQ ID NO: 615005 - DNA, 25 bp, Mus musculus
ggccatgacaattaatatcctttat

SEQ ID NO: 615006 - DNA, 25 bp, Mus musculus
ggccatgacatcacaatcttgtact

SEQ ID NO: 615007 - DNA, 25 bp, Mus musculus
ggccatgacatctcaatcttgtact

SEQ ID NO: 615008 - DNA, 25 bp, Mus musculus
ggccatgacctacacgttgttcgag

SEQ ID NO: 615009 - DNA, 25 bp, Mus musculus
ggccatgacctagacgttgttcgag

SEQ ID NO: 615010 - DNA, 25 bp, Mus musculus
ggccatgaccttctaagcagactgt

SEQ ID NO: 615011 - DNA, 25 bp, Mus musculus
ggccatgaccttgtaagcagactgt

SEQ ID NO: 615012 - DNA, 25 bp, Mus musculus
ggccatgactggcattaggataaat

SEQ ID NO: 615013 - DNA, 25 bp, Mus musculus
ggccatgactgggattaggataaat

SEQ ID NO: 615014 - DNA, 25 bp, Mus musculus
ggccatgagacaatttaccttccac

SEQ ID NO: 615015 - DNA, 25 bp, Mus musculus
ggccatgagacattttaccttccac

SEQ ID NO: 615016 - DNA, 25 bp, Mus musculus
ggccatgagaccatcctaagcagag

SEQ ID NO: 615017 - DNA, 25 bp, Mus musculus
ggccatgagaccttcctaagcagag

SEQ ID NO: 615018 - DNA, 25 bp, Mus musculus
ggccatgagcataccaacatttttt

SEQ ID NO: 615019 - DNA, 25 bp, Mus musculus
ggccatgagcattccaacatttttt

SEQ ID NO: 615020 - DNA, 25 bp, Mus musculus
ggccatgagccaagttcaggcgtca

SEQ ID NO: 615021 - DNA, 25 bp, Mus musculus
ggccatgagccatgttcaggcgtca

SEQ ID NO: 615022 - DNA, 25 bp, Mus musculus
ggccatgagcgaccagctgagtcca

SEQ ID NO: 615023 - DNA, 25 bp, Mus musculus
ggccatgagcgagcagctgagtcca

SEQ ID NO: 615024 - DNA, 25 bp, Mus musculus
ggccatgaggcgctgctattataag

SEQ ID NO: 615025 - DNA, 25 bp, Mus musculus
ggccatgaggcggtgctattataag

SEQ ID NO: 615026 - DNA, 25 bp, Mus musculus
ggccatgatccccaagtgtgtgtgt

SEQ ID NO: 615027 - DNA, 25 bp, Mus musculus
ggccatgatcccgaagtgtgtgtgt

SEQ ID NO: 615028 - DNA, 25 bp, Mus musculus
ggccatgatgagaacctataccaga

SEQ ID NO: 615029 - DNA, 25 bp, Mus musculus
ggccatgatgagtacctataccaga

SEQ ID NO: 615030 - DNA, 25 bp, Mus musculus
ggccatgatgccagccattttaatt

SEQ ID NO: 615031 - DNA, 25 bp, Mus musculus
ggccatgatgcctgccattttaatt

SEQ ID NO: 615032 - DNA, 25 bp, Mus musculus
ggccatgatggcagtacgtgtactc

SEQ ID NO: 615033 - DNA, 25 bp, Mus musculus
ggccatgatggctgtacgtgtactc

SEQ ID NO: 615034 - DNA, 25 bp, Mus musculus
ggccatgcaaaactgtacaataata

SEQ ID NO: 615035 - DNA, 25 bp, Mus musculus
ggccatgcaaaagtgtacaataata

SEQ ID NO: 615036 - DNA, 25 bp, Mus musculus
ggccatgcatgtagtcacagtagac

SEQ ID NO: 615037 - DNA, 25 bp, Mus musculus
ggccatgcatgttgtcacagtagac

SEQ ID NO: 615038 - DNA, 25 bp, Mus musculus
ggccatgccacaattaattgacttc

SEQ ID NO: 615039 - DNA, 25 bp, Mus musculus
ggccatgccacatttaattgacttc

SEQ ID NO: 615040 - DNA, 25 bp, Mus musculus
ggccatgccagaaacacactcggat

SEQ ID NO: 615041 - DNA, 25 bp, Mus musculus
ggccatgccagactcagtgttttgt

SEQ ID NO: 615042 - DNA, 25 bp, Mus musculus
ggccatgccagagtcagtgttttgt

SEQ ID NO: 615043 - DNA, 25 bp, Mus musculus
ggccatgccagatacacactcggat

SEQ ID NO: 615044 - DNA, 25 bp, Mus musculus
ggccatgcctacaacagaacctgat

SEQ ID NO: 615045 - DNA, 25 bp, Mus musculus
ggccatgcctactacagaacctgat

SEQ ID NO: 615046 - DNA, 25 bp, Mus musculus
ggccatgcctggatctgctgtctgt

SEQ ID NO: 615047 - DNA, 25 bp, Mus musculus
ggccatgcctggttctgctgtctgt

SEQ ID NO: 615048 - DNA, 25 bp, Mus musculus
ggccatgcgtgcacctacacatatt

SEQ ID NO: 615049 - DNA, 25 bp, Mus musculus
ggccatgcgtgctcctacacatatt

SEQ ID NO: 615050 - DNA, 25 bp, Mus musculus
ggccatgcgtttactgatgagtcag

SEQ ID NO: 615051 - DNA, 25 bp, Mus musculus
ggccatgcgttttctgatgagtcag

SEQ ID NO: 615052 - DNA, 25 bp, Mus musculus
ggccatgctgtgagaagtccgtgac

SEQ ID NO: 615053 - DNA, 25 bp, Mus musculus
ggccatgctgtgtgaagtccgtgac

SEQ ID NO: 615054 - DNA, 25 bp, Mus musculus
ggccatgctgttcatctgactgaag

SEQ ID NO: 615055 - DNA, 25 bp, Mus musculus
ggccatgctgttgatctgactgaag

SEQ ID NO: 615056 - DNA, 25 bp, Mus musculus
ggccatggaaataactccctttaca

SEQ ID NO: 615057 - DNA, 25 bp, Mus musculus
ggccatggaaattactccctttaca

SEQ ID NO: 615058 - DNA, 25 bp, Mus musculus
ggccatggacaaaatgtacctcagc

SEQ ID NO: 615059 - DNA, 25 bp, Mus musculus
ggccatggacaatatgtacctcagc

SEQ ID NO: 615060 - DNA, 25 bp, Mus musculus
ggccatggacacacctagaaggagc

SEQ ID NO: 615061 - DNA, 25 bp, Mus musculus
ggccatggacacagactggtttcca

SEQ ID NO: 615062 - DNA, 25 bp, Mus musculus
ggccatggacactcctagaaggagc

SEQ ID NO: 615063 - DNA, 25 bp, Mus musculus
ggccatggacactgactggtttcca

SEQ ID NO: 615064 - DNA, 25 bp, Mus musculus
ggccatggagaaagctgacttggct

SEQ ID NO: 615065 - DNA, 25 bp, Mus musculus
ggccatggagaatgctgacttggct

SEQ ID NO: 615066 - DNA, 25 bp, Mus musculus
ggccatggagctaggacctggtcta

SEQ ID NO: 615067 - DNA, 25 bp, Mus musculus
ggccatggagcttggacctggtcta

SEQ ID NO: 615068 - DNA, 25 bp, Mus musculus
ggccatggaggccacaatcacacag

SEQ ID NO: 615069 - DNA, 25 bp, Mus musculus
ggccatggaggcgacaatcacacag

SEQ ID NO: 615070 - DNA, 25 bp, Mus musculus
ggccatggatgcatacggtttaccc

SEQ ID NO: 615071 - DNA, 25 bp, Mus musculus
ggccatggatgcttacggtttaccc

SEQ ID NO: 615072 - DNA, 25 bp, Mus musculus
ggccatggatgtatcatgtctgcag

SEQ ID NO: 615073 - DNA, 25 bp, Mus musculus
ggccatggatgtttcatgtctgcag

SEQ ID NO: 615074 - DNA, 25 bp, Mus musculus
ggccatggattgcacaagtcaccaa

SEQ ID NO: 615075 - DNA, 25 bp, Mus musculus
ggccatggattggacaagtcaccaa

SEQ ID NO: 615076 - DNA, 25 bp, Mus musculus
ggccatggcattaagacaatacaat

SEQ ID NO: 615077 - DNA, 25 bp, Mus musculus
ggccatggcatttagacaatacaat

SEQ ID NO: 615078 - DNA, 25 bp, Mus musculus
ggccatggctgaatatagtcgtttt

SEQ ID NO: 615079 - DNA, 25 bp, Mus musculus
ggccatggctgattatagtcgtttt

SEQ ID NO: 615080 - DNA, 25 bp, Mus musculus
ggccatgggcagagcagccttttaa

SEQ ID NO: 615081 - DNA, 25 bp, Mus musculus
ggccatgggcagattccttaaaaat

SEQ ID NO: 615082 - DNA, 25 bp, Mus musculus
ggccatgggcagtgcagccttttaa

SEQ ID NO: 615083 - DNA, 25 bp, Mus musculus
ggccatgggcagtttccttaaaaat

SEQ ID NO: 615084 - DNA, 25 bp, Mus musculus
ggccatggtatgaaggtattccttt

SEQ ID NO: 615085 - DNA, 25 bp, Mus musculus
ggccatggtatgtaggtattccttt

SEQ ID NO: 615086 - DNA, 25 bp, Mus musculus
ggccatggtcgcagctcactccagg

SEQ ID NO: 615087 - DNA, 25 bp, Mus musculus
ggccatggtcgctgctcactccagg

SEQ ID NO: 615088 - DNA, 25 bp, Mus musculus
ggccatggtgggaacttctgtccag

SEQ ID NO: 615089 - DNA, 25 bp, Mus musculus
ggccatggtgggtacttctgtccag

SEQ ID NO: 615090 - DNA, 25 bp, Mus musculus
ggccatggtgtgacctctgttctat

SEQ ID NO: 615091 - DNA, 25 bp, Mus musculus
ggccatggtgtgattgctgaccgtc

SEQ ID NO: 615092 - DNA, 25 bp, Mus musculus
ggccatggtgtgtcctctgttctat

SEQ ID NO: 615093 - DNA, 25 bp, Mus musculus
ggccatggtgtgtttgctgaccgtc

SEQ ID NO: 615094 - DNA, 25 bp, Mus musculus
ggccatggttggaggatattcaatc

SEQ ID NO: 615095 - DNA, 25 bp, Mus musculus
ggccatggttggtggatattcaatc

SEQ ID NO: 615096 - DNA, 25 bp, Mus musculus
ggccatgtaaccaaggcattttgaa

SEQ ID NO: 615097 - DNA, 25 bp, Mus musculus
ggccatgtaacctaggcattttgaa

SEQ ID NO: 615098 - DNA, 25 bp, Mus musculus
ggccatgtaattatattcctcaaga

SEQ ID NO: 615099 - DNA, 25 bp, Mus musculus
ggccatgtaattttattcctcaaga

SEQ ID NO: 615100 - DNA, 25 bp, Mus musculus
ggccatgtacaacgagccatctctg

SEQ ID NO: 615101 - DNA, 25 bp, Mus musculus
ggccatgtacaaggagccatctctg

SEQ ID NO: 615102 - DNA, 25 bp, Mus musculus
ggccatgtacacacgggtcagcaag

SEQ ID NO: 615103 - DNA, 25 bp, Mus musculus
ggccatgtacactcgggtcagcaag

SEQ ID NO: 615104 - DNA, 25 bp, Mus musculus
ggccatgtagccacatttatttaag

SEQ ID NO: 615105 - DNA, 25 bp, Mus musculus
ggccatgtagcctcatttatttaag

SEQ ID NO: 615106 - DNA, 25 bp, Mus musculus
ggccatgtcaagatgcctgatgaag

SEQ ID NO: 615107 - DNA, 25 bp, Mus musculus
ggccatgtcaagttgcctgatgaag

SEQ ID NO: 615108 - DNA, 25 bp, Mus musculus
ggccatgtctccctcaagagaagat

SEQ ID NO: 615109 - DNA, 25 bp, Mus musculus
ggccatgtctccgtcaagagaagat

SEQ ID NO: 615110 - DNA, 25 bp, Mus musculus
ggccatgtctctagagctagcctaa

SEQ ID NO: 615111 - DNA, 25 bp, Mus musculus
ggccatgtctcttgagctagcctaa

SEQ ID NO: 615112 - DNA, 25 bp, Mus musculus
ggccatgtctgcctcatacaaagaa

SEQ ID NO: 615113 - DNA, 25 bp, Mus musculus
ggccatgtctgcgtcatacaaagaa

SEQ ID NO: 615114 - DNA, 25 bp, Mus musculus
ggccatgtctttcggactgggactt

SEQ ID NO: 615115 - DNA, 25 bp, Mus musculus
ggccatgtctttgggactgggactt

SEQ ID NO: 615116 - DNA, 25 bp, Mus musculus
ggccatgtgacaattgtcctgtgtt

SEQ ID NO: 615117 - DNA, 25 bp, Mus musculus
ggccatgtgacatttgtcctgtgtt

SEQ ID NO: 615118 - DNA, 25 bp, Mus musculus
ggccatgtggagaatgagcccaaat

SEQ ID NO: 615119 - DNA, 25 bp, Mus musculus
ggccatgtggagtatgagcccaaat

SEQ ID NO: 615120 - DNA, 25 bp, Mus musculus
ggccatgtggcccttatacagcctt

SEQ ID NO: 615121 - DNA, 25 bp, Mus musculus
ggccatgtggccgttatacagcctt

SEQ ID NO: 615122 - DNA, 25 bp, Mus musculus
ggccatgtgtgaaaccccaataaat

SEQ ID NO: 615123 - DNA, 25 bp, Mus musculus
ggccatgtgtgataccccaataaat

SEQ ID NO: 615124 - DNA, 25 bp, Mus musculus
ggccatgttcacatctgagggctgt

SEQ ID NO: 615125 - DNA, 25 bp, Mus musculus
ggccatgttcacttctgagggctgt

SEQ ID NO: 615126 - DNA, 25 bp, Mus musculus
ggccatgttcatcggctccaattga

SEQ ID NO: 615127 - DNA, 25 bp, Mus musculus
ggccatgttcatgggctccaattga

SEQ ID NO: 615128 - DNA, 25 bp, Mus musculus
ggccatgttctaaagtcatcgttcg

SEQ ID NO: 615129 - DNA, 25 bp, Mus musculus
ggccatgttctatagtcatcgttcg

SEQ ID NO: 615130 - DNA, 25 bp, Mus musculus
ggccatgttgctctttatgctattt

SEQ ID NO: 615131 - DNA, 25 bp, Mus musculus
ggccatgttgctgtttatgctattt

SEQ ID NO: 615132 - DNA, 25 bp, Mus musculus
ggccatgttggaccctcacaaagag

SEQ ID NO: 615133 - DNA, 25 bp, Mus musculus
ggccatgttggagcctcacaaagag

SEQ ID NO: 615134 - DNA, 25 bp, Mus musculus
ggccattaaactacattacagtcat

SEQ ID NO: 615135 - DNA, 25 bp, Mus musculus
ggccattaaacttcattacagtcat

SEQ ID NO: 615136 - DNA, 25 bp, Mus musculus
ggccattaaataaagcattcacaca

SEQ ID NO: 615137 - DNA, 25 bp, Mus musculus
ggccattaaatatagcattcacaca

SEQ ID NO: 615138 - DNA, 25 bp, Mus musculus
ggccattacaagaccattcccagtt

SEQ ID NO: 615139 - DNA, 25 bp, Mus musculus
ggccattacaagtccattcccagtt

SEQ ID NO: 615140 - DNA, 25 bp, Mus musculus
ggccattataatctgcaagcaattg

SEQ ID NO: 615141 - DNA, 25 bp, Mus musculus
ggccattataatgtgcaagcaattg

SEQ ID NO: 615142 - DNA, 25 bp, Mus musculus
ggccattatatactcctacccagat

SEQ ID NO: 615143 - DNA, 25 bp, Mus musculus
ggccattatatagtcctacccagat

SEQ ID NO: 615144 - DNA, 25 bp, Mus musculus
ggccattatccaatttttgttgaag

SEQ ID NO: 615145 - DNA, 25 bp, Mus musculus
ggccattatccattttttgttgaag

SEQ ID NO: 615146 - DNA, 25 bp, Mus musculus
ggccattcaactacttcgaggagga

SEQ ID NO: 615147 - DNA, 25 bp, Mus musculus
ggccattcaacttcttcgaggagga

SEQ ID NO: 615148 - DNA, 25 bp, Mus musculus
ggccattcactaatctgaggttggt

SEQ ID NO: 615149 - DNA, 25 bp, Mus musculus
ggccattcactattctgaggttggt

SEQ ID NO: 615150 - DNA, 25 bp, Mus musculus
ggccattcagtcacacatttgcaag

SEQ ID NO: 615151 - DNA, 25 bp, Mus musculus
ggccattcagtcacagttcagaaaa

SEQ ID NO: 615152 - DNA, 25 bp, Mus musculus
ggccattcagtctcacatttgcaag

SEQ ID NO: 615153 - DNA, 25 bp, Mus musculus
ggccattcagtctcagttcagaaaa

SEQ ID NO: 615154 - DNA, 25 bp, Mus musculus
ggccattcatgtacaatatgttagc

SEQ ID NO: 615155 - DNA, 25 bp, Mus musculus
ggccattcatgttcaatatgttagc

SEQ ID NO: 615156 - DNA, 25 bp, Mus musculus
ggccattccattatatctgtagcat

SEQ ID NO: 615157 - DNA, 25 bp, Mus musculus
ggccattccattttatctgtagcat

SEQ ID NO: 615158 - DNA, 25 bp, Mus musculus
ggccattcccaaaaaacagactcag

SEQ ID NO: 615159 - DNA, 25 bp, Mus musculus
ggccattcccaataaacagactcag

SEQ ID NO: 615160 - DNA, 25 bp, Mus musculus
ggccattccgaaaaaccaggttttg

SEQ ID NO: 615161 - DNA, 25 bp, Mus musculus
ggccattccgaataaccaggttttg

SEQ ID NO: 615162 - DNA, 25 bp, Mus musculus
ggccattcctaaacttgttattcct

SEQ ID NO: 615163 - DNA, 25 bp, Mus musculus
ggccattcctaatcttgttattcct

SEQ ID NO: 615164 - DNA, 25 bp, Mus musculus
ggccattcctcacgttgtgttttta

SEQ ID NO: 615165 - DNA, 25 bp, Mus musculus
ggccattcctcaggttgtgttttta

SEQ ID NO: 615166 - DNA, 25 bp, Mus musculus
ggccattcctgtaggctttcgtaca

SEQ ID NO: 615167 - DNA, 25 bp, Mus musculus
ggccattcctgttggctttcgtaca

SEQ ID NO: 615168 - DNA, 25 bp, Mus musculus
ggccattctcaaaccctggtaatca

SEQ ID NO: 615169 - DNA, 25 bp, Mus musculus
ggccattctcaaatacttttgtgtc

SEQ ID NO: 615170 - DNA, 25 bp, Mus musculus
ggccattctcaatccctggtaatca

SEQ ID NO: 615171 - DNA, 25 bp, Mus musculus
ggccattctcaattacttttgtgtc

SEQ ID NO: 615172 - DNA, 25 bp, Mus musculus
ggccattctcataagttcagtcaaa

SEQ ID NO: 615173 - DNA, 25 bp, Mus musculus
ggccattctcattagttcagtcaaa

SEQ ID NO: 615174 - DNA, 25 bp, Mus musculus
ggccattctgacaaaaggaccaagt

SEQ ID NO: 615175 - DNA, 25 bp, Mus musculus
ggccattctgactaaaggaccaagt

SEQ ID NO: 615176 - DNA, 25 bp, Mus musculus
ggccattcttggacctaaggttcat

SEQ ID NO: 615177 - DNA, 25 bp, Mus musculus
ggccattcttggtcctaaggttcat

SEQ ID NO: 615178 - DNA, 25 bp, Mus musculus
ggccattgaacacactaaggcgcaa

SEQ ID NO: 615179 - DNA, 25 bp, Mus musculus
ggccattgaacagactaaggcgcaa

SEQ ID NO: 615180 - DNA, 25 bp, Mus musculus
ggccattgaagccacaatatgcagt

SEQ ID NO: 615181 - DNA, 25 bp, Mus musculus
ggccattgaagccactcccctggag

SEQ ID NO: 615182 - DNA, 25 bp, Mus musculus
ggccattgaagcgacaatatgcagt

SEQ ID NO: 615183 - DNA, 25 bp, Mus musculus
ggccattgaagcgactcccctggag

SEQ ID NO: 615184 - DNA, 25 bp, Mus musculus
ggccattgacaaagtgtgacagtgt

SEQ ID NO: 615185 - DNA, 25 bp, Mus musculus
ggccattgacaatgtgtgacagtgt

SEQ ID NO: 615186 - DNA, 25 bp, Mus musculus
ggccattgacctagatgacttcact

SEQ ID NO: 615187 - DNA, 25 bp, Mus musculus
ggccattgaccttgatgacttcact

SEQ ID NO: 615188 - DNA, 25 bp, Mus musculus
ggccattgagaaagcatgtgagttt

SEQ ID NO: 615189 - DNA, 25 bp, Mus musculus
ggccattgagaatgcatgtgagttt

SEQ ID NO: 615190 - DNA, 25 bp, Mus musculus
ggccattgagccacggacacaagga

SEQ ID NO: 615191 - DNA, 25 bp, Mus musculus
ggccattgagcctcggacacaagga

SEQ ID NO: 615192 - DNA, 25 bp, Mus musculus
ggccattgaggccaacgacatccac

SEQ ID NO: 615193 - DNA, 25 bp, Mus musculus
ggccattgaggcgaacgacatccac

SEQ ID NO: 615194 - DNA, 25 bp, Mus musculus
ggccattgaggtaaactgctcccaa

SEQ ID NO: 615195 - DNA, 25 bp, Mus musculus
ggccattgaggttaactgctcccaa

SEQ ID NO: 615196 - DNA, 25 bp, Mus musculus
ggccattgatcaagacaagtttaaa

SEQ ID NO: 615197 - DNA, 25 bp, Mus musculus
ggccattgatcatgacaagtttaaa

SEQ ID NO: 615198 - DNA, 25 bp, Mus musculus
ggccattgcagaacagttgacctta

SEQ ID NO: 615199 - DNA, 25 bp, Mus musculus
ggccattgcagatcagttgacctta

SEQ ID NO: 615200 - DNA, 25 bp, Mus musculus
ggccattgccaaaattagctccaca

SEQ ID NO: 615201 - DNA, 25 bp, Mus musculus
ggccattgccaatattagctccaca

SEQ ID NO: 615202 - DNA, 25 bp, Mus musculus
ggccattgctgtatgctctttgtgt

SEQ ID NO: 615203 - DNA, 25 bp, Mus musculus
ggccattgctgtttgctctttgtgt

SEQ ID NO: 615204 - DNA, 25 bp, Mus musculus
ggccattggccaacaaactagcatt

SEQ ID NO: 615205 - DNA, 25 bp, Mus musculus
ggccattggccatcaaactagcatt

SEQ ID NO: 615206 - DNA, 25 bp, Mus musculus
ggccattgtaatacctaagtactgt

SEQ ID NO: 615207 - DNA, 25 bp, Mus musculus
ggccattgtaattcctaagtactgt

SEQ ID NO: 615208 - DNA, 25 bp, Mus musculus
ggccattgtaccctgggtctagttc

SEQ ID NO: 615209 - DNA, 25 bp, Mus musculus
ggccattgtaccgtgggtctagttc

SEQ ID NO: 615210 - DNA, 25 bp, Mus musculus
ggccattgtcccaattggtgttgtg

SEQ ID NO: 615211 - DNA, 25 bp, Mus musculus
ggccattgtccctattggtgttgtg

SEQ ID NO: 615212 - DNA, 25 bp, Mus musculus
ggccattgtctaattgacagtaaca

SEQ ID NO: 615213 - DNA, 25 bp, Mus musculus
ggccattgtctatttgacagtaaca

SEQ ID NO: 615214 - DNA, 25 bp, Mus musculus
ggccattgtctgcagcgtttggtac

SEQ ID NO: 615215 - DNA, 25 bp, Mus musculus
ggccattgtctggagcgtttggtac

SEQ ID NO: 615216 - DNA, 25 bp, Mus musculus
ggccattgtcttcctggtccaggca

SEQ ID NO: 615217 - DNA, 25 bp, Mus musculus
ggccattgtcttgctggtccaggca

SEQ ID NO: 615218 - DNA, 25 bp, Mus musculus
ggccattgtgttcacagtggtcttc

SEQ ID NO: 615219 - DNA, 25 bp, Mus musculus
ggccattgtgttgacagtggtcttc

SEQ ID NO: 615220 - DNA, 25 bp, Mus musculus
ggccattgttgaccaaagctggaat

SEQ ID NO: 615221 - DNA, 25 bp, Mus musculus
ggccattgttgagcaaagctggaat

SEQ ID NO: 615222 - DNA, 25 bp, Mus musculus
ggccatttaaagatatctttgctta

SEQ ID NO: 615223 - DNA, 25 bp, Mus musculus
ggccatttaaagttatctttgctta

SEQ ID NO: 615224 - DNA, 25 bp, Mus musculus
ggccatttacacctttgggtttcag

SEQ ID NO: 615225 - DNA, 25 bp, Mus musculus
ggccatttacacgtttgggtttcag

SEQ ID NO: 615226 - DNA, 25 bp, Mus musculus
ggccatttacatagcacatcattcc

SEQ ID NO: 615227 - DNA, 25 bp, Mus musculus
ggccatttacattgcacatcattcc

SEQ ID NO: 615228 - DNA, 25 bp, Mus musculus
ggccatttatggaactacagtgcta

SEQ ID NO: 615229 - DNA, 25 bp, Mus musculus
ggccatttatggtactacagtgcta

SEQ ID NO: 615230 - DNA, 25 bp, Mus musculus
ggccatttcaaaaacagcaccaggg

SEQ ID NO: 615231 - DNA, 25 bp, Mus musculus
ggccatttcaaatacagcaccaggg

SEQ ID NO: 615232 - DNA, 25 bp, Mus musculus
ggccatttcagaatgtgagctcact

SEQ ID NO: 615233 - DNA, 25 bp, Mus musculus
ggccatttcagattgtgagctcact

SEQ ID NO: 615234 - DNA, 25 bp, Mus musculus
ggccatttcagccactttcaagatg

SEQ ID NO: 615235 - DNA, 25 bp, Mus musculus
ggccatttcagcgactttcaagatg

SEQ ID NO: 615236 - DNA, 25 bp, Mus musculus
ggccatttcagtaccttttgtagaa

SEQ ID NO: 615237 - DNA, 25 bp, Mus musculus
ggccatttcagttccttttgtagaa

SEQ ID NO: 615238 - DNA, 25 bp, Mus musculus
ggccatttcctcatagtaagcacag

SEQ ID NO: 615239 - DNA, 25 bp, Mus musculus
ggccatttcctcttagtaagcacag

SEQ ID NO: 615240 - DNA, 25 bp, Mus musculus
ggccatttctccattcatatggtta

SEQ ID NO: 615241 - DNA, 25 bp, Mus musculus
ggccatttctcctttcatatggtta

SEQ ID NO: 615242 - DNA, 25 bp, Mus musculus
ggccatttctctaaatatcattctg

SEQ ID NO: 615243 - DNA, 25 bp, Mus musculus
ggccatttctcttaatatcattctg

SEQ ID NO: 615244 - DNA, 25 bp, Mus musculus
ggccatttctttctttctgagcata

SEQ ID NO: 615245 - DNA, 25 bp, Mus musculus
ggccatttctttgtttctgagcata

SEQ ID NO: 615246 - DNA, 25 bp, Mus musculus
ggccatttgatcattatttgtgtca

SEQ ID NO: 615247 - DNA, 25 bp, Mus musculus
ggccatttgatctttatttgtgtca

SEQ ID NO: 615248 - DNA, 25 bp, Mus musculus
ggccattttcataattgtcctctca

SEQ ID NO: 615249 - DNA, 25 bp, Mus musculus
ggccattttcattattgtcctctca

SEQ ID NO: 615250 - DNA, 25 bp, Mus musculus
ggccattttctgcaggatgctttca

SEQ ID NO: 615251 - DNA, 25 bp, Mus musculus
ggccattttctggaggatgctttca

SEQ ID NO: 615252 - DNA, 25 bp, Mus musculus
ggccattttgagacacctttcttca

SEQ ID NO: 615253 - DNA, 25 bp, Mus musculus
ggccattttgagtcacctttcttca

SEQ ID NO: 615254 - DNA, 25 bp, Mus musculus
ggccatttttatacagacaactaca

SEQ ID NO: 615255 - DNA, 25 bp, Mus musculus
ggccatttttattcagacaactaca

SEQ ID NO: 615256 - DNA, 25 bp, Mus musculus
ggccattttttgctgtacaacctaa

SEQ ID NO: 615257 - DNA, 25 bp, Mus musculus
ggccattttttggtgtacaacctaa

SEQ ID NO: 615258 - DNA, 25 bp, Mus musculus
ggcccaaaccgcagtgataccatat

SEQ ID NO: 615259 - DNA, 25 bp, Mus musculus
ggcccaaaccgctgtgataccatat

SEQ ID NO: 615260 - DNA, 25 bp, Mus musculus
ggcccaaaggcaccttctacctatg

SEQ ID NO: 615261 - DNA, 25 bp, Mus musculus
ggcccaaaggcagcttctacctatg

SEQ ID NO: 615262 - DNA, 25 bp, Mus musculus
ggcccaaatcatcgacaccagaaga

SEQ ID NO: 615263 - DNA, 25 bp, Mus musculus
ggcccaaatcatggacaccagaaga

SEQ ID NO: 615264 - DNA, 25 bp, Mus musculus
ggcccaaattcccagatgtctgtct

SEQ ID NO: 615265 - DNA, 25 bp, Mus musculus
ggcccaaattccgagatgtctgtct

SEQ ID NO: 615266 - DNA, 25 bp, Mus musculus
ggcccaacaccaacaaatctcagtt

SEQ ID NO: 615267 - DNA, 25 bp, Mus musculus
ggcccaacaccatcaaatctcagtt

SEQ ID NO: 615268 - DNA, 25 bp, Mus musculus
ggcccaacactaatactgagtctat

SEQ ID NO: 615269 - DNA, 25 bp, Mus musculus
ggcccaacactattactgagtctat

SEQ ID NO: 615270 - DNA, 25 bp, Mus musculus
ggcccaacagaaagagcagtgacaa

SEQ ID NO: 615271 - DNA, 25 bp, Mus musculus
ggcccaacagaatgagcagtgacaa

SEQ ID NO: 615272 - DNA, 25 bp, Mus musculus
ggcccaaccctaactgtagccacat

SEQ ID NO: 615273 - DNA, 25 bp, Mus musculus
ggcccaaccctatctgtagccacat

SEQ ID NO: 615274 - DNA, 25 bp, Mus musculus
ggcccaacgctgactgatcgtggat

SEQ ID NO: 615275 - DNA, 25 bp, Mus musculus
ggcccaacgctgtctgatcgtggat

SEQ ID NO: 615276 - DNA, 25 bp, Mus musculus
ggcccaacggttaagtgcagagtca

SEQ ID NO: 615277 - DNA, 25 bp, Mus musculus
ggcccaacggtttagtgcagagtca

SEQ ID NO: 615278 - DNA, 25 bp, Mus musculus
ggcccaactatgacaagtctttctt

SEQ ID NO: 615279 - DNA, 25 bp, Mus musculus
ggcccaactatgtcaagtctttctt

SEQ ID NO: 615280 - DNA, 25 bp, Mus musculus
ggcccaagaacaacccctagaggag

SEQ ID NO: 615281 - DNA, 25 bp, Mus musculus
ggcccaagaacatcccctagaggag

SEQ ID NO: 615282 - DNA, 25 bp, Mus musculus
ggcccaagaaggacagctagcgctt

SEQ ID NO: 615283 - DNA, 25 bp, Mus musculus
ggcccaagaaggtcagctagcgctt

SEQ ID NO: 615284 - DNA, 25 bp, Mus musculus
ggcccaagacctccgggaagaagca

SEQ ID NO: 615285 - DNA, 25 bp, Mus musculus
ggcccaagacctgcgggaagaagca

SEQ ID NO: 615286 - DNA, 25 bp, Mus musculus
ggcccaagagtgagtattccgagct

SEQ ID NO: 615287 - DNA, 25 bp, Mus musculus
ggcccaagagtgtgtattccgagct

SEQ ID NO: 615288 - DNA, 25 bp, Mus musculus
ggcccaagctgcaactctttctgga

SEQ ID NO: 615289 - DNA, 25 bp, Mus musculus
ggcccaagctgcatcacagcctcag

SEQ ID NO: 615290 - DNA, 25 bp, Mus musculus
ggcccaagctgctactctttctgga

SEQ ID NO: 615291 - DNA, 25 bp, Mus musculus
ggcccaagctgcttcacagcctcag

SEQ ID NO: 615292 - DNA, 25 bp, Mus musculus
ggcccaaggacaccctgtgaagaga

SEQ ID NO: 615293 - DNA, 25 bp, Mus musculus
ggcccaaggacagcctgtgaagaga

SEQ ID NO: 615294 - DNA, 25 bp, Mus musculus
ggcccaaggcccagtaatggacttc

SEQ ID NO: 615295 - DNA, 25 bp, Mus musculus
ggcccaaggccctgtaatggacttc

SEQ ID NO: 615296 - DNA, 25 bp, Mus musculus
ggcccaagggttacgagaacctgca

SEQ ID NO: 615297 - DNA, 25 bp, Mus musculus
ggcccaagggtttcgagaacctgca

SEQ ID NO: 615298 - DNA, 25 bp, Mus musculus
ggcccaagtgcccagcaaattagaa

SEQ ID NO: 615299 - DNA, 25 bp, Mus musculus
ggcccaagtgccgagcaaattagaa

SEQ ID NO: 615300 - DNA, 25 bp, Mus musculus
ggcccaagtgggagtgtacccctgc

SEQ ID NO: 615301 - DNA, 25 bp, Mus musculus
ggcccaagtgggtgtgtacccctgc

SEQ ID NO: 615302 - DNA, 25 bp, Mus musculus
ggcccaatagcaaccacaatttaca

SEQ ID NO: 615303 - DNA, 25 bp, Mus musculus
ggcccaatagcatccacaatttaca

SEQ ID NO: 615304 - DNA, 25 bp, Mus musculus
ggcccaatgctgaccctgaaagaag

SEQ ID NO: 615305 - DNA, 25 bp, Mus musculus
ggcccaatgctgtccctgaaagaag

SEQ ID NO: 615306 - DNA, 25 bp, Mus musculus
ggcccaatgtaacgtgtgttctcaa

SEQ ID NO: 615307 - DNA, 25 bp, Mus musculus
ggcccaatgtaaggtgtgttctcaa

SEQ ID NO: 615308 - DNA, 25 bp, Mus musculus
ggcccaatgtggaatcctgtggcga

SEQ ID NO: 615309 - DNA, 25 bp, Mus musculus
ggcccaatgtggtatcctgtggcga

SEQ ID NO: 615310 - DNA, 25 bp, Mus musculus
ggcccaattccaagccaagttattt

SEQ ID NO: 615311 - DNA, 25 bp, Mus musculus
ggcccaattccatgccaagttattt

SEQ ID NO: 615312 - DNA, 25 bp, Mus musculus
ggcccaatttgcagttttggtacag

SEQ ID NO: 615313 - DNA, 25 bp, Mus musculus
ggcccaatttgctgttttggtacag

SEQ ID NO: 615314 - DNA, 25 bp, Mus musculus
ggcccaatttgtagtttagaaagca

SEQ ID NO: 615315 - DNA, 25 bp, Mus musculus
ggcccaatttgttgtttagaaagca

SEQ ID NO: 615316 - DNA, 25 bp, Mus musculus
ggcccacactggagtataccagcaa

SEQ ID NO: 615317 - DNA, 25 bp, Mus musculus
ggcccacactggtgtataccagcaa

SEQ ID NO: 615318 - DNA, 25 bp, Mus musculus
ggcccacagatcctttgcaaagaat

SEQ ID NO: 615319 - DNA, 25 bp, Mus musculus
ggcccacagatcgtttgcaaagaat

SEQ ID NO: 615320 - DNA, 25 bp, Mus musculus
ggcccacatatgatttgtttttcca

SEQ ID NO: 615321 - DNA, 25 bp, Mus musculus
ggcccacatatgttttgtttttcca

SEQ ID NO: 615322 - DNA, 25 bp, Mus musculus
ggcccacatccaacaagaatgtctt

SEQ ID NO: 615323 - DNA, 25 bp, Mus musculus
ggcccacatccatcaagaatgtctt

SEQ ID NO: 615324 - DNA, 25 bp, Mus musculus
ggcccacccctaactcaggaggagg

SEQ ID NO: 615325 - DNA, 25 bp, Mus musculus
ggcccacccctatctcaggaggagg

SEQ ID NO: 615326 - DNA, 25 bp, Mus musculus
ggcccacccttcctaggattggata

SEQ ID NO: 615327 - DNA, 25 bp, Mus musculus
ggcccacccttcgtaggattggata

SEQ ID NO: 615328 - DNA, 25 bp, Mus musculus
ggcccacctatgctggtagcaagag

SEQ ID NO: 615329 - DNA, 25 bp, Mus musculus
ggcccacctatggtggtagcaagag

SEQ ID NO: 615330 - DNA, 25 bp, Mus musculus
ggcccacctgatctagaaaatcctt

SEQ ID NO: 615331 - DNA, 25 bp, Mus musculus
ggcccacctgatgtagaaaatcctt

SEQ ID NO: 615332 - DNA, 25 bp, Mus musculus
ggcccacctgcaacattcaggataa

SEQ ID NO: 615333 - DNA, 25 bp, Mus musculus
ggcccacctgcatcattcaggataa

SEQ ID NO: 615334 - DNA, 25 bp, Mus musculus
ggcccaccttttatagctgctgagc

SEQ ID NO: 615335 - DNA, 25 bp, Mus musculus
ggcccaccttttttagctgctgagc

SEQ ID NO: 615336 - DNA, 25 bp, Mus musculus
ggcccacgaagaacttctcattctt

SEQ ID NO: 615337 - DNA, 25 bp, Mus musculus
ggcccacgaagatcttctcattctt

SEQ ID NO: 615338 - DNA, 25 bp, Mus musculus
ggcccacgacttacagccaagaggt

SEQ ID NO: 615339 - DNA, 25 bp, Mus musculus
ggcccacgactttcagccaagaggt

SEQ ID NO: 615340 - DNA, 25 bp, Mus musculus
ggcccacgctttcttgaatttgtat

SEQ ID NO: 615341 - DNA, 25 bp, Mus musculus
ggcccacgctttgttgaatttgtat

SEQ ID NO: 615342 - DNA, 25 bp, Mus musculus
ggcccacgggagaagagaaacctca

SEQ ID NO: 615343 - DNA, 25 bp, Mus musculus
ggcccacgggagtagagaaacctca

SEQ ID NO: 615344 - DNA, 25 bp, Mus musculus
ggcccacgtcaaaggttgatgtcaa

SEQ ID NO: 615345 - DNA, 25 bp, Mus musculus
ggcccacgtcaatggttgatgtcaa

SEQ ID NO: 615346 - DNA, 25 bp, Mus musculus
ggcccactaagccttgcttttgaat

SEQ ID NO: 615347 - DNA, 25 bp, Mus musculus
ggcccactaagcgttgcttttgaat

SEQ ID NO: 615348 - DNA, 25 bp, Mus musculus
ggcccactaattcttaataatctaa

SEQ ID NO: 615349 - DNA, 25 bp, Mus musculus
ggcccactaattgttaataatctaa

SEQ ID NO: 615350 - DNA, 25 bp, Mus musculus
ggcccactacacaggtcttaaacag

SEQ ID NO: 615351 - DNA, 25 bp, Mus musculus
ggcccactacactggtcttaaacag

SEQ ID NO: 615352 - DNA, 25 bp, Mus musculus
ggcccactagaaacaccgttcagaa

SEQ ID NO: 615353 - DNA, 25 bp, Mus musculus
ggcccactagaatcaccgttcagaa

SEQ ID NO: 615354 - DNA, 25 bp, Mus musculus
ggcccactcgaacatcaggacaagt

SEQ ID NO: 615355 - DNA, 25 bp, Mus musculus
ggcccactcgaagatcaggacaagt

SEQ ID NO: 615356 - DNA, 25 bp, Mus musculus
ggcccactcgtcctccattcattca

SEQ ID NO: 615357 - DNA, 25 bp, Mus musculus
ggcccactcgtcgtccattcattca

SEQ ID NO: 615358 - DNA, 25 bp, Mus musculus
ggcccactgtggacaggaaagcaga

SEQ ID NO: 615359 - DNA, 25 bp, Mus musculus
ggcccactgtggtcaggaaagcaga

SEQ ID NO: 615360 - DNA, 25 bp, Mus musculus
ggcccagaagacctcttgtatgtgt

SEQ ID NO: 615361 - DNA, 25 bp, Mus musculus
ggcccagaagacgtcttgtatgtgt

SEQ ID NO: 615362 - DNA, 25 bp, Mus musculus
ggcccagaattgactccagttctga

SEQ ID NO: 615363 - DNA, 25 bp, Mus musculus
ggcccagaattgcatccaacgcagg

SEQ ID NO: 615364 - DNA, 25 bp, Mus musculus
ggcccagaattggatccaacgcagg

SEQ ID NO: 615365 - DNA, 25 bp, Mus musculus
ggcccagaattgtctccagttctga

SEQ ID NO: 615366 - DNA, 25 bp, Mus musculus
ggcccagacccacggatagattgga

SEQ ID NO: 615367 - DNA, 25 bp, Mus musculus
ggcccagacccagggatagattgga

SEQ ID NO: 615368 - DNA, 25 bp, Mus musculus
ggcccagaccctaagatgataactt

SEQ ID NO: 615369 - DNA, 25 bp, Mus musculus
ggcccagacccttagatgataactt

SEQ ID NO: 615370 - DNA, 25 bp, Mus musculus
ggcccagactcacagggcagtgctt

SEQ ID NO: 615371 - DNA, 25 bp, Mus musculus
ggcccagactcagagggcagtgctt

SEQ ID NO: 615372 - DNA, 25 bp, Mus musculus
ggcccagactctaacaactgtacat

SEQ ID NO: 615373 - DNA, 25 bp, Mus musculus
ggcccagactcttacaactgtacat

SEQ ID NO: 615374 - DNA, 25 bp, Mus musculus
ggcccagagcaacggcacgctcatg

SEQ ID NO: 615375 - DNA, 25 bp, Mus musculus
ggcccagagcaagggcacgctcatg

SEQ ID NO: 615376 - DNA, 25 bp, Mus musculus
ggcccagagctaatcttttggttag

SEQ ID NO: 615377 - DNA, 25 bp, Mus musculus
ggcccagagctattcttttggttag

SEQ ID NO: 615378 - DNA, 25 bp, Mus musculus
ggcccagagggaagggacattcttt

SEQ ID NO: 615379 - DNA, 25 bp, Mus musculus
ggcccagagggatgggacattcttt

SEQ ID NO: 615380 - DNA, 25 bp, Mus musculus
ggcccagatagaatgtccatcaata

SEQ ID NO: 615381 - DNA, 25 bp, Mus musculus
ggcccagatagattgtccatcaata

SEQ ID NO: 615382 - DNA, 25 bp, Mus musculus
ggcccagataggactcagctgtgtt

SEQ ID NO: 615383 - DNA, 25 bp, Mus musculus
ggcccagataggtctcagctgtgtt

SEQ ID NO: 615384 - DNA, 25 bp, Mus musculus
ggcccagattgaaaaggagagcgat

SEQ ID NO: 615385 - DNA, 25 bp, Mus musculus
ggcccagattgataaggagagcgat

SEQ ID NO: 615386 - DNA, 25 bp, Mus musculus
ggcccagcaaaccagaacttgtctt

SEQ ID NO: 615387 - DNA, 25 bp, Mus musculus
ggcccagcaaacgagaacttgtctt

SEQ ID NO: 615388 - DNA, 25 bp, Mus musculus
ggcccagcagaaagccccaagtggg

SEQ ID NO: 615389 - DNA, 25 bp, Mus musculus
ggcccagcagaatgccccaagtggg

SEQ ID NO: 615390 - DNA, 25 bp, Mus musculus
ggcccagcagggagtgtctacttta

SEQ ID NO: 615391 - DNA, 25 bp, Mus musculus
ggcccagcagggtgtgtctacttta

SEQ ID NO: 615392 - DNA, 25 bp, Mus musculus
ggcccagcatataccaccaatgaga

SEQ ID NO: 615393 - DNA, 25 bp, Mus musculus
ggcccagcatattccaccaatgaga

SEQ ID NO: 615394 - DNA, 25 bp, Mus musculus
ggcccagccagcaattcagagcagt

SEQ ID NO: 615395 - DNA, 25 bp, Mus musculus
ggcccagccagctattcagagcagt

SEQ ID NO: 615396 - DNA, 25 bp, Mus musculus
ggcccagcctatatgaagttgatta

SEQ ID NO: 615397 - DNA, 25 bp, Mus musculus
ggcccagcctatttgaagttgatta

SEQ ID NO: 615398 - DNA, 25 bp, Mus musculus
ggcccagcctggaagaaaacagcgt

SEQ ID NO: 615399 - DNA, 25 bp, Mus musculus
ggcccagcctggtagaaaacagcgt

SEQ ID NO: 615400 - DNA, 25 bp, Mus musculus
ggcccagcgggcagaagttcagaat

SEQ ID NO: 615401 - DNA, 25 bp, Mus musculus
ggcccagcgggctgaagttcagaat

SEQ ID NO: 615402 - DNA, 25 bp, Mus musculus
ggcccagcgtacacaatatcttttt

SEQ ID NO: 615403 - DNA, 25 bp, Mus musculus
ggcccagcgtactcaatatcttttt

SEQ ID NO: 615404 - DNA, 25 bp, Mus musculus
ggcccagcgtcacagagatgcgcaa

SEQ ID NO: 615405 - DNA, 25 bp, Mus musculus
ggcccagcgtcagagagatgcgcaa

SEQ ID NO: 615406 - DNA, 25 bp, Mus musculus
ggcccagcgtctagcttgttgaagc

SEQ ID NO: 615407 - DNA, 25 bp, Mus musculus
ggcccagcgtcttgcttgttgaagc

SEQ ID NO: 615408 - DNA, 25 bp, Mus musculus
ggcccagctccaatctctgatagat

SEQ ID NO: 615409 - DNA, 25 bp, Mus musculus
ggcccagctccattctctgatagat

SEQ ID NO: 615410 - DNA, 25 bp, Mus musculus
ggcccagctgtcaggattggtagac

SEQ ID NO: 615411 - DNA, 25 bp, Mus musculus
ggcccagctgtctggattggtagac

SEQ ID NO: 615412 - DNA, 25 bp, Mus musculus
ggcccagcttggatgtaatctcttt

SEQ ID NO: 615413 - DNA, 25 bp, Mus musculus
ggcccagcttggttgtaatctcttt

SEQ ID NO: 615414 - DNA, 25 bp, Mus musculus
ggcccaggaagactgcagcccagca

SEQ ID NO: 615415 - DNA, 25 bp, Mus musculus
ggcccaggaagagtgcagcccagca

SEQ ID NO: 615416 - DNA, 25 bp, Mus musculus
ggcccaggagtgatggcatccaaat

SEQ ID NO: 615417 - DNA, 25 bp, Mus musculus
ggcccaggagtgttggcatccaaat

SEQ ID NO: 615418 - DNA, 25 bp, Mus musculus
ggcccaggcatcactgggcgagtat

SEQ ID NO: 615419 - DNA, 25 bp, Mus musculus
ggcccaggcatctctgggcgagtat

SEQ ID NO: 615420 - DNA, 25 bp, Mus musculus
ggcccaggcatgataaagtccaaac

SEQ ID NO: 615421 - DNA, 25 bp, Mus musculus
ggcccaggcatgttaaagtccaaac

SEQ ID NO: 615422 - DNA, 25 bp, Mus musculus
ggcccaggcgtccactatataaaag

SEQ ID NO: 615423 - DNA, 25 bp, Mus musculus
ggcccaggcgtcgactatataaaag

SEQ ID NO: 615424 - DNA, 25 bp, Mus musculus
ggcccaggctggaagaaattcaaca

SEQ ID NO: 615425 - DNA, 25 bp, Mus musculus
ggcccaggctggtagaaattcaaca

SEQ ID NO: 615426 - DNA, 25 bp, Mus musculus
ggcccagggaatatctactttcagt

SEQ ID NO: 615427 - DNA, 25 bp, Mus musculus
ggcccagggaatttctactttcagt

SEQ ID NO: 615428 - DNA, 25 bp, Mus musculus
ggcccagggcgtaaaatttacagat

SEQ ID NO: 615429 - DNA, 25 bp, Mus musculus
ggcccagggcgttaaatttacagat

SEQ ID NO: 615430 - DNA, 25 bp, Mus musculus
ggcccaggtaaacatgccctctgag

SEQ ID NO: 615431 - DNA, 25 bp, Mus musculus
ggcccaggtaaagatgccctctgag

SEQ ID NO: 615432 - DNA, 25 bp, Mus musculus
ggcccaggtaccagtaaagaccttg

SEQ ID NO: 615433 - DNA, 25 bp, Mus musculus
ggcccaggtacctgtaaagaccttg

SEQ ID NO: 615434 - DNA, 25 bp, Mus musculus
ggcccaggtgaacccaacacttgac

SEQ ID NO: 615435 - DNA, 25 bp, Mus musculus
ggcccaggtgaagccaacacttgac

SEQ ID NO: 615436 - DNA, 25 bp, Mus musculus
ggcccaggtgagcacagagcataca

SEQ ID NO: 615437 - DNA, 25 bp, Mus musculus
ggcccaggtgaggacagagcataca

SEQ ID NO: 615438 - DNA, 25 bp, Mus musculus
ggcccaggtggtccattggtactat

SEQ ID NO: 615439 - DNA, 25 bp, Mus musculus
ggcccaggtggtgcattggtactat

SEQ ID NO: 615440 - DNA, 25 bp, Mus musculus
ggcccaggtgtgagaagccttactg

SEQ ID NO: 615441 - DNA, 25 bp, Mus musculus
ggcccaggtgtgtgaagccttactg

SEQ ID NO: 615442 - DNA, 25 bp, Mus musculus
ggcccaggtttccacagactcttca

SEQ ID NO: 615443 - DNA, 25 bp, Mus musculus
ggcccaggtttcgacagactcttca

SEQ ID NO: 615444 - DNA, 25 bp, Mus musculus
ggcccagtaccaacaatttcaacat

SEQ ID NO: 615445 - DNA, 25 bp, Mus musculus
ggcccagtaccatcaatttcaacat

SEQ ID NO: 615446 - DNA, 25 bp, Mus musculus
ggcccagtacctataatttatgtct

SEQ ID NO: 615447 - DNA, 25 bp, Mus musculus
ggcccagtacctttaatttatgtct

SEQ ID NO: 615448 - DNA, 25 bp, Mus musculus
ggcccagtactaatttaagtgcaag

SEQ ID NO: 615449 - DNA, 25 bp, Mus musculus
ggcccagtactattttaagtgcaag

SEQ ID NO: 615450 - DNA, 25 bp, Mus musculus
ggcccagtctacactggccaaatct

SEQ ID NO: 615451 - DNA, 25 bp, Mus musculus
ggcccagtctactctggccaaatct

SEQ ID NO: 615452 - DNA, 25 bp, Mus musculus
ggcccagtgcaaaatcatgccggca

SEQ ID NO: 615453 - DNA, 25 bp, Mus musculus
ggcccagtgcaatatcatgccggca

SEQ ID NO: 615454 - DNA, 25 bp, Mus musculus
ggcccagtggctctagaaccgatga

SEQ ID NO: 615455 - DNA, 25 bp, Mus musculus
ggcccagtggctgtagaaccgatga

SEQ ID NO: 615456 - DNA, 25 bp, Mus musculus
ggcccagtggttcagcataatgtgc

SEQ ID NO: 615457 - DNA, 25 bp, Mus musculus
ggcccagtggttgagcataatgtgc

SEQ ID NO: 615458 - DNA, 25 bp, Mus musculus
ggcccagtgtggattctcccagata

SEQ ID NO: 615459 - DNA, 25 bp, Mus musculus
ggcccagtgtggtttctcccagata

SEQ ID NO: 615460 - DNA, 25 bp, Mus musculus
ggcccagtgttaaggactgtccacc

SEQ ID NO: 615461 - DNA, 25 bp, Mus musculus
ggcccagtgttatggactgtccacc

SEQ ID NO: 615462 - DNA, 25 bp, Mus musculus
ggcccagttagaatctctgcaacag

SEQ ID NO: 615463 - DNA, 25 bp, Mus musculus
ggcccagttagaattagctgtcaac

SEQ ID NO: 615464 - DNA, 25 bp, Mus musculus
ggcccagttagattctctgcaacag

SEQ ID NO: 615465 - DNA, 25 bp, Mus musculus
ggcccagttagatttagctgtcaac

SEQ ID NO: 615466 - DNA, 25 bp, Mus musculus
ggcccagttcacattgcaggcaaac

SEQ ID NO: 615467 - DNA, 25 bp, Mus musculus
ggcccagttcactttgcaggcaaac

SEQ ID NO: 615468 - DNA, 25 bp, Mus musculus
ggcccagttgtgcagccaagtctaa

SEQ ID NO: 615469 - DNA, 25 bp, Mus musculus
ggcccagttgtggagccaagtctaa

SEQ ID NO: 615470 - DNA, 25 bp, Mus musculus
ggcccagtttaacacctgatgctga

SEQ ID NO: 615471 - DNA, 25 bp, Mus musculus
ggcccagtttaagacctgatgctga

SEQ ID NO: 615472 - DNA, 25 bp, Mus musculus
ggcccagtttcaactatactgctat

SEQ ID NO: 615473 - DNA, 25 bp, Mus musculus
ggcccagtttcatctatactgctat

SEQ ID NO: 615474 - DNA, 25 bp, Mus musculus
ggcccagtttccatgtatgatacac

SEQ ID NO: 615475 - DNA, 25 bp, Mus musculus
ggcccagtttccttgtatgatacac

SEQ ID NO: 615476 - DNA, 25 bp, Mus musculus
ggcccatacaaaccaattctctgtt

SEQ ID NO: 615477 - DNA, 25 bp, Mus musculus
ggcccatacaaagcaattctctgtt

SEQ ID NO: 615478 - DNA, 25 bp, Mus musculus
ggcccatagcagatggcagtttaca

SEQ ID NO: 615479 - DNA, 25 bp, Mus musculus
ggcccatagcagttggcagtttaca

SEQ ID NO: 615480 - DNA, 25 bp, Mus musculus
ggcccatagtccaaatcatcttcaa

SEQ ID NO: 615481 - DNA, 25 bp, Mus musculus
ggcccatagtcctaatcatcttcaa

SEQ ID NO: 615482 - DNA, 25 bp, Mus musculus
ggcccatagttcacactggacgtga

SEQ ID NO: 615483 - DNA, 25 bp, Mus musculus
ggcccatagttctcactggacgtga

SEQ ID NO: 615484 - DNA, 25 bp, Mus musculus
ggcccatatatgcattcaaaccgtg

SEQ ID NO: 615485 - DNA, 25 bp, Mus musculus
ggcccatatatggattcaaaccgtg

SEQ ID NO: 615486 - DNA, 25 bp, Mus musculus
ggcccatcatctcgcggctgaaact

SEQ ID NO: 615487 - DNA, 25 bp, Mus musculus
ggcccatcatctggcggctgaaact

SEQ ID NO: 615488 - DNA, 25 bp, Mus musculus
ggcccatcatgcaagtggacagcta

SEQ ID NO: 615489 - DNA, 25 bp, Mus musculus
ggcccatcatgctagtggacagcta

SEQ ID NO: 615490 - DNA, 25 bp, Mus musculus
ggcccatcccatagtggttggtggt

SEQ ID NO: 615491 - DNA, 25 bp, Mus musculus
ggcccatcccattgtggttggtggt

SEQ ID NO: 615492 - DNA, 25 bp, Mus musculus
ggcccatccgcaacatagatcggca

SEQ ID NO: 615493 - DNA, 25 bp, Mus musculus
ggcccatccgcatcatagatcggca

SEQ ID NO: 615494 - DNA, 25 bp, Mus musculus
ggcccatcctcacgagggacagtta

SEQ ID NO: 615495 - DNA, 25 bp, Mus musculus
ggcccatcctcaggagggacagtta

SEQ ID NO: 615496 - DNA, 25 bp, Mus musculus
ggcccatctcttctttctaagagct

SEQ ID NO: 615497 - DNA, 25 bp, Mus musculus
ggcccatctcttgtttctaagagct

SEQ ID NO: 615498 - DNA, 25 bp, Mus musculus
ggcccatgactactttattaatcta

SEQ ID NO: 615499 - DNA, 25 bp, Mus musculus
ggcccatgactagtttattaatcta

SEQ ID NO: 615500 - DNA, 25 bp, Mus musculus
ggcccatgagtgactcacccaaggt

SEQ ID NO: 615501 - DNA, 25 bp, Mus musculus
ggcccatgagtgtctcacccaaggt

SEQ ID NO: 615502 - DNA, 25 bp, Mus musculus
ggcccatgatccagtgatgtgctgg

SEQ ID NO: 615503 - DNA, 25 bp, Mus musculus
ggcccatgatcctgtgatgtgctgg

SEQ ID NO: 615504 - DNA, 25 bp, Mus musculus
ggcccatgatgaattgatccctgat

SEQ ID NO: 615505 - DNA, 25 bp, Mus musculus
ggcccatgatgatttgatccctgat

SEQ ID NO: 615506 - DNA, 25 bp, Mus musculus
ggcccatgattgacagttccccaca

SEQ ID NO: 615507 - DNA, 25 bp, Mus musculus
ggcccatgattgtcagttccccaca

SEQ ID NO: 615508 - DNA, 25 bp, Mus musculus
ggcccatgccccaaatttttgatgg

SEQ ID NO: 615509 - DNA, 25 bp, Mus musculus
ggcccatgcccctaatttttgatgg

SEQ ID NO: 615510 - DNA, 25 bp, Mus musculus
ggcccatggccactcagtgcaagga

SEQ ID NO: 615511 - DNA, 25 bp, Mus musculus
ggcccatggccagtcagtgcaagga

SEQ ID NO: 615512 - DNA, 25 bp, Mus musculus
ggcccatgggccaattcaatcagat

SEQ ID NO: 615513 - DNA, 25 bp, Mus musculus
ggcccatgggcctattcaatcagat

SEQ ID NO: 615514 - DNA, 25 bp, Mus musculus
ggcccatggtaaatacatttcctta

SEQ ID NO: 615515 - DNA, 25 bp, Mus musculus
ggcccatggtaattacatttcctta

SEQ ID NO: 615516 - DNA, 25 bp, Mus musculus
ggcccatggtgaccttgttctgaac

SEQ ID NO: 615517 - DNA, 25 bp, Mus musculus
ggcccatggtgagcttgttctgaac

SEQ ID NO: 615518 - DNA, 25 bp, Mus musculus
ggcccatgtcgtctccagaaatgaa

SEQ ID NO: 615519 - DNA, 25 bp, Mus musculus
ggcccatgtcgtgtccagaaatgaa

SEQ ID NO: 615520 - DNA, 25 bp, Mus musculus
ggcccatgtgaactgccaatgccct

SEQ ID NO: 615521 - DNA, 25 bp, Mus musculus
ggcccatgtgaagtgccaatgccct

SEQ ID NO: 615522 - DNA, 25 bp, Mus musculus
ggcccatgtgggagtaagcttctac

SEQ ID NO: 615523 - DNA, 25 bp, Mus musculus
ggcccatgtgggtgtaagcttctac

SEQ ID NO: 615524 - DNA, 25 bp, Mus musculus
ggcccatgtgttagacttagcggtc

SEQ ID NO: 615525 - DNA, 25 bp, Mus musculus
ggcccatgtgtttgacttagcggtc

SEQ ID NO: 615526 - DNA, 25 bp, Mus musculus
ggcccattaactctttgtctgctca

SEQ ID NO: 615527 - DNA, 25 bp, Mus musculus
ggcccattaactgtttgtctgctca

SEQ ID NO: 615528 - DNA, 25 bp, Mus musculus
ggcccattaaggacctttgtccact

SEQ ID NO: 615529 - DNA, 25 bp, Mus musculus
ggcccattaaggtcctttgtccact

SEQ ID NO: 615530 - DNA, 25 bp, Mus musculus
ggcccattacctcctgtgcatagga

SEQ ID NO: 615531 - DNA, 25 bp, Mus musculus
ggcccattacctgctgtgcatagga

SEQ ID NO: 615532 - DNA, 25 bp, Mus musculus
ggcccattatttcagccgtaacaga

SEQ ID NO: 615533 - DNA, 25 bp, Mus musculus
ggcccattatttgagccgtaacaga

SEQ ID NO: 615534 - DNA, 25 bp, Mus musculus
ggcccattcagtccacacaaagaag

SEQ ID NO: 615535 - DNA, 25 bp, Mus musculus
ggcccattcagtgcacacaaagaag

SEQ ID NO: 615536 - DNA, 25 bp, Mus musculus
ggcccattccccaaatagttttgat

SEQ ID NO: 615537 - DNA, 25 bp, Mus musculus
ggcccattcccctaatagttttgat

SEQ ID NO: 615538 - DNA, 25 bp, Mus musculus
ggcccattccttctatctggctgga

SEQ ID NO: 615539 - DNA, 25 bp, Mus musculus
ggcccattccttgtatctggctgga

SEQ ID NO: 615540 - DNA, 25 bp, Mus musculus
ggcccattctcaagtttcattcttt

SEQ ID NO: 615541 - DNA, 25 bp, Mus musculus
ggcccattctcatgtttcattcttt

SEQ ID NO: 615542 - DNA, 25 bp, Mus musculus
ggcccattctggatcttctacgcca

SEQ ID NO: 615543 - DNA, 25 bp, Mus musculus
ggcccattctggttcttctacgcca

SEQ ID NO: 615544 - DNA, 25 bp, Mus musculus
ggcccattcttgagccatgctgaaa

SEQ ID NO: 615545 - DNA, 25 bp, Mus musculus
ggcccattcttgtgccatgctgaaa

SEQ ID NO: 615546 - DNA, 25 bp, Mus musculus
ggcccatttaccacatggtataagt

SEQ ID NO: 615547 - DNA, 25 bp, Mus musculus
ggcccatttacctcatggtataagt

SEQ ID NO: 615548 - DNA, 25 bp, Mus musculus
ggcccattttccaagttcggtagag

SEQ ID NO: 615549 - DNA, 25 bp, Mus musculus
ggcccattttcctagttcggtagag

SEQ ID NO: 615550 - DNA, 25 bp, Mus musculus
ggccccaaatggacatgttcacata

SEQ ID NO: 615551 - DNA, 25 bp, Mus musculus
ggccccaaatggtcatgttcacata

SEQ ID NO: 615552 - DNA, 25 bp, Mus musculus
ggccccaacacaaacttgacatttg

SEQ ID NO: 615553 - DNA, 25 bp, Mus musculus
ggccccaacacatacttgacatttg

SEQ ID NO: 615554 - DNA, 25 bp, Mus musculus
ggccccaagaagactgccccagaga

SEQ ID NO: 615555 - DNA, 25 bp, Mus musculus
ggccccaagaagtctgccccagaga

SEQ ID NO: 615556 - DNA, 25 bp, Mus musculus
ggccccaagcaaacaggatgcgggt

SEQ ID NO: 615557 - DNA, 25 bp, Mus musculus
ggccccaagcaatcaggatgcgggt

SEQ ID NO: 615558 - DNA, 25 bp, Mus musculus
ggccccaagcagctgaggaaacatc

SEQ ID NO: 615559 - DNA, 25 bp, Mus musculus
ggccccaagcaggtgaggaaacatc

SEQ ID NO: 615560 - DNA, 25 bp, Mus musculus
ggccccaagccacagactgtgaggt

SEQ ID NO: 615561 - DNA, 25 bp, Mus musculus
ggccccaagccagagactgtgaggt

SEQ ID NO: 615562 - DNA, 25 bp, Mus musculus
ggccccaaggctcagacagcttcgt

SEQ ID NO: 615563 - DNA, 25 bp, Mus musculus
ggccccaaggctgagacagcttcgt

SEQ ID NO: 615564 - DNA, 25 bp, Mus musculus
ggccccaaggtcacgtgttaggata

SEQ ID NO: 615565 - DNA, 25 bp, Mus musculus
ggccccaaggtctcgtgttaggata

SEQ ID NO: 615566 - DNA, 25 bp, Mus musculus
ggccccaatcggctactactattga

SEQ ID NO: 615567 - DNA, 25 bp, Mus musculus
ggccccaatcgggtactactattga

SEQ ID NO: 615568 - DNA, 25 bp, Mus musculus
ggccccaatgcgctggatcattaaa

SEQ ID NO: 615569 - DNA, 25 bp, Mus musculus
ggccccaatgcggtggatcattaaa

SEQ ID NO: 615570 - DNA, 25 bp, Mus musculus
ggccccaatggccttctgtagacct

SEQ ID NO: 615571 - DNA, 25 bp, Mus musculus
ggccccaatggcgttctgtagacct

SEQ ID NO: 615572 - DNA, 25 bp, Mus musculus
ggccccaatgtcaccattgggaagg

SEQ ID NO: 615573 - DNA, 25 bp, Mus musculus
ggccccaatgtctccattgggaagg

SEQ ID NO: 615574 - DNA, 25 bp, Mus musculus
ggccccaatgtgagtcgctgtataa

SEQ ID NO: 615575 - DNA, 25 bp, Mus musculus
ggccccaatgtgtgtcgctgtataa

SEQ ID NO: 615576 - DNA, 25 bp, Mus musculus
ggccccacagtgagaccacttggaa

SEQ ID NO: 615577 - DNA, 25 bp, Mus musculus
ggccccacagtgtgaccacttggaa

SEQ ID NO: 615578 - DNA, 25 bp, Mus musculus
ggccccaccaaaatctctggataag

SEQ ID NO: 615579 - DNA, 25 bp, Mus musculus
ggccccaccaaattctctggataag

SEQ ID NO: 615580 - DNA, 25 bp, Mus musculus
ggccccaccattcttcatgatgagt

SEQ ID NO: 615581 - DNA, 25 bp, Mus musculus
ggccccaccattgttcatgatgagt

SEQ ID NO: 615582 - DNA, 25 bp, Mus musculus
ggccccacctggctcaagggttcag

SEQ ID NO: 615583 - DNA, 25 bp, Mus musculus
ggccccacctgggtcaagggttcag

SEQ ID NO: 615584 - DNA, 25 bp, Mus musculus
ggccccacgagtctccgaggattta

SEQ ID NO: 615585 - DNA, 25 bp, Mus musculus
ggccccacgagtgtccgaggattta

SEQ ID NO: 615586 - DNA, 25 bp, Mus musculus
ggccccacgcatctgcaacatagag

SEQ ID NO: 615587 - DNA, 25 bp, Mus musculus
ggccccacgcatgtgcaacatagag

SEQ ID NO: 615588 - DNA, 25 bp, Mus musculus
ggccccactgtgcttagaccaaaga

SEQ ID NO: 615589 - DNA, 25 bp, Mus musculus
ggccccactgtggttagaccaaaga

SEQ ID NO: 615590 - DNA, 25 bp, Mus musculus
ggccccagaataattacctatacgt

SEQ ID NO: 615591 - DNA, 25 bp, Mus musculus
ggccccagaatatttacctatacgt

SEQ ID NO: 615592 - DNA, 25 bp, Mus musculus
ggccccagatttacttgtagctcat

SEQ ID NO: 615593 - DNA, 25 bp, Mus musculus
ggccccagattttcttgtagctcat

SEQ ID NO: 615594 - DNA, 25 bp, Mus musculus
ggccccagcccaatgtggtgacaaa

SEQ ID NO: 615595 - DNA, 25 bp, Mus musculus
ggccccagcccactatgaaattgaa

SEQ ID NO: 615596 - DNA, 25 bp, Mus musculus
ggccccagcccagtatgaaattgaa

SEQ ID NO: 615597 - DNA, 25 bp, Mus musculus
ggccccagcccattgtggtgacaaa

SEQ ID NO: 615598 - DNA, 25 bp, Mus musculus
ggccccagcttaattctctaagcta

SEQ ID NO: 615599 - DNA, 25 bp, Mus musculus
ggccccagcttatttctctaagcta

SEQ ID NO: 615600 - DNA, 25 bp, Mus musculus
ggccccaggactagtaaatgctttc

SEQ ID NO: 615601 - DNA, 25 bp, Mus musculus
ggccccaggacttgtaaatgctttc

SEQ ID NO: 615602 - DNA, 25 bp, Mus musculus
ggccccaggccgcaggcaggagcag

SEQ ID NO: 615603 - DNA, 25 bp, Mus musculus
ggccccaggccggaggcaggagcag

SEQ ID NO: 615604 - DNA, 25 bp, Mus musculus
ggccccagtactcttgagaatgact

SEQ ID NO: 615605 - DNA, 25 bp, Mus musculus
ggccccagtactgttgagaatgact

SEQ ID NO: 615606 - DNA, 25 bp, Mus musculus
ggccccagtgcacattaaggttgag

SEQ ID NO: 615607 - DNA, 25 bp, Mus musculus
ggccccagtgcagattaaggttgag

SEQ ID NO: 615608 - DNA, 25 bp, Mus musculus
ggccccataagcaacaagcactatt

SEQ ID NO: 615609 - DNA, 25 bp, Mus musculus
ggccccataagctacaagcactatt

SEQ ID NO: 615610 - DNA, 25 bp, Mus musculus
ggccccatcatgcttctggtggtta

SEQ ID NO: 615611 - DNA, 25 bp, Mus musculus
ggccccatcatggttctggtggtta

SEQ ID NO: 615612 - DNA, 25 bp, Mus musculus
ggccccatccctattgtggaggtta

SEQ ID NO: 615613 - DNA, 25 bp, Mus musculus
ggccccatcccttttgtggaggtta

SEQ ID NO: 615614 - DNA, 25 bp, Mus musculus
ggccccatgcccagtggtagatagc

SEQ ID NO: 615615 - DNA, 25 bp, Mus musculus
ggccccatgccctgtggtagatagc

SEQ ID NO: 615616 - DNA, 25 bp, Mus musculus
ggccccatgggcaccgtggtgaagt

SEQ ID NO: 615617 - DNA, 25 bp, Mus musculus
ggccccatgggctccgtggtgaagt

SEQ ID NO: 615618 - DNA, 25 bp, Mus musculus
ggccccatggtgaccacagtcagga

SEQ ID NO: 615619 - DNA, 25 bp, Mus musculus
ggccccatggtgtccacagtcagga

SEQ ID NO: 615620 - DNA, 25 bp, Mus musculus
ggccccattagtattgtatcacgag

SEQ ID NO: 615621 - DNA, 25 bp, Mus musculus
ggccccattagttttgtatcacgag

SEQ ID NO: 615622 - DNA, 25 bp, Mus musculus
ggccccattatcattgagcatcctt

SEQ ID NO: 615623 - DNA, 25 bp, Mus musculus
ggccccattatctttgagcatcctt

SEQ ID NO: 615624 - DNA, 25 bp, Mus musculus
ggccccattggcaaaagcacatagg

SEQ ID NO: 615625 - DNA, 25 bp, Mus musculus
ggccccattggctaaagcacatagg

SEQ ID NO: 615626 - DNA, 25 bp, Mus musculus
ggccccctcgggagaaagatgactc

SEQ ID NO: 615627 - DNA, 25 bp, Mus musculus
ggccccctcgggtgaaagatgactc

SEQ ID NO: 615628 - DNA, 25 bp, Mus musculus
ggccccgaccagaggagtacgaatt

SEQ ID NO: 615629 - DNA, 25 bp, Mus musculus
ggccccgaccagtggagtacgaatt

SEQ ID NO: 615630 - DNA, 25 bp, Mus musculus
ggccccgagatgaactgctgaggac

SEQ ID NO: 615631 - DNA, 25 bp, Mus musculus
ggccccgagatgtactgctgaggac

SEQ ID NO: 615632 - DNA, 25 bp, Mus musculus
ggccccgagtgaagtgttttgccct

SEQ ID NO: 615633 - DNA, 25 bp, Mus musculus
ggccccgagtgatgtgttttgccct

SEQ ID NO: 615634 - DNA, 25 bp, Mus musculus
ggccccgcactgaatacattctttt

SEQ ID NO: 615635 - DNA, 25 bp, Mus musculus
ggccccgcactgtatacattctttt

SEQ ID NO: 615636 - DNA, 25 bp, Mus musculus
ggccccgctcgactatatggaattc

SEQ ID NO: 615637 - DNA, 25 bp, Mus musculus
ggccccgctcgagtatatggaattc

SEQ ID NO: 615638 - DNA, 25 bp, Mus musculus
ggccccggcaccaggagagtgacat

SEQ ID NO: 615639 - DNA, 25 bp, Mus musculus
ggccccggcaccatgtcggagaaga

SEQ ID NO: 615640 - DNA, 25 bp, Mus musculus
ggccccggcacctggagagtgacat

SEQ ID NO: 615641 - DNA, 25 bp, Mus musculus
ggccccggcaccttgtcggagaaga

SEQ ID NO: 615642 - DNA, 25 bp, Mus musculus
ggccccgggagcccagagacagtgg

SEQ ID NO: 615643 - DNA, 25 bp, Mus musculus
ggccccgggagcgcagagacagtgg

SEQ ID NO: 615644 - DNA, 25 bp, Mus musculus
ggccccggtagaacgcttcttcacg

SEQ ID NO: 615645 - DNA, 25 bp, Mus musculus
ggccccggtagatcgcttcttcacg

SEQ ID NO: 615646 - DNA, 25 bp, Mus musculus
ggccccgtgataattctttgttcta

SEQ ID NO: 615647 - DNA, 25 bp, Mus musculus
ggccccgtgatatttctttgttcta

SEQ ID NO: 615648 - DNA, 25 bp, Mus musculus
ggccccgtggaaccaatatcctgga

SEQ ID NO: 615649 - DNA, 25 bp, Mus musculus
ggccccgtggaagcaatatcctgga

SEQ ID NO: 615650 - DNA, 25 bp, Mus musculus
ggcccctagatgagtcctcagctaa

SEQ ID NO: 615651 - DNA, 25 bp, Mus musculus
ggcccctagatgtgtcctcagctaa

SEQ ID NO: 615652 - DNA, 25 bp, Mus musculus
ggcccctagtttccaggctgagtaa

SEQ ID NO: 615653 - DNA, 25 bp, Mus musculus
ggcccctagtttgcaggctgagtaa

SEQ ID NO: 615654 - DNA, 25 bp, Mus musculus
ggcccctatagactgaaattcctgg

SEQ ID NO: 615655 - DNA, 25 bp, Mus musculus
ggcccctatagagtgaaattcctgg

SEQ ID NO: 615656 - DNA, 25 bp, Mus musculus
ggcccctatggccagtctgagactc

SEQ ID NO: 615657 - DNA, 25 bp, Mus musculus
ggcccctatggcgagtctgagactc

SEQ ID NO: 615658 - DNA, 25 bp, Mus musculus
ggcccctatgtgatcaatgtgacca

SEQ ID NO: 615659 - DNA, 25 bp, Mus musculus
ggcccctatgtgttcaatgtgacca

SEQ ID NO: 615660 - DNA, 25 bp, Mus musculus
ggcccctcaatcactacaggaaatg

SEQ ID NO: 615661 - DNA, 25 bp, Mus musculus
ggcccctcaatctctacaggaaatg

SEQ ID NO: 615662 - DNA, 25 bp, Mus musculus
ggcccctcagtccttaactggaaag

SEQ ID NO: 615663 - DNA, 25 bp, Mus musculus
ggcccctcagtcgttaactggaaag

SEQ ID NO: 615664 - DNA, 25 bp, Mus musculus
ggcccctcatgaaccgttggtggta

SEQ ID NO: 615665 - DNA, 25 bp, Mus musculus
ggcccctcatgatccgttggtggta

SEQ ID NO: 615666 - DNA, 25 bp, Mus musculus
ggcccctcggacaacaaacgagatc

SEQ ID NO: 615667 - DNA, 25 bp, Mus musculus
ggcccctcggactacaaacgagatc

SEQ ID NO: 615668 - DNA, 25 bp, Mus musculus
ggcccctctgccaaggaatggtact

SEQ ID NO: 615669 - DNA, 25 bp, Mus musculus
ggcccctctgcctaggaatggtact

SEQ ID NO: 615670 - DNA, 25 bp, Mus musculus
ggcccctctggaaagctgtggcgtg

SEQ ID NO: 615671 - DNA, 25 bp, Mus musculus
ggcccctctggatagctgtggcgtg

SEQ ID NO: 615672 - DNA, 25 bp, Mus musculus
ggcccctctgttaactgctgaagca

SEQ ID NO: 615673 - DNA, 25 bp, Mus musculus
ggcccctctgtttactgctgaagca

SEQ ID NO: 615674 - DNA, 25 bp, Mus musculus
ggcccctgaaccagaggacgaggac

SEQ ID NO: 615675 - DNA, 25 bp, Mus musculus
ggcccctgaacctgaggacgaggac

SEQ ID NO: 615676 - DNA, 25 bp, Mus musculus
ggcccctgaagcagccgtgaaacag

SEQ ID NO: 615677 - DNA, 25 bp, Mus musculus
ggcccctgaagctgccgtgaaacag

SEQ ID NO: 615678 - DNA, 25 bp, Mus musculus
ggcccctgagctcctataaggacca

SEQ ID NO: 615679 - DNA, 25 bp, Mus musculus
ggcccctgagctgctataaggacca

SEQ ID NO: 615680 - DNA, 25 bp, Mus musculus
ggcccctgagtgcaggatcctgact

SEQ ID NO: 615681 - DNA, 25 bp, Mus musculus
ggcccctgagtggaggatcctgact

SEQ ID NO: 615682 - DNA, 25 bp, Mus musculus
ggcccctgatcgatttttattggtc

SEQ ID NO: 615683 - DNA, 25 bp, Mus musculus
ggcccctgatcgttttttattggtc

SEQ ID NO: 615684 - DNA, 25 bp, Mus musculus
ggcccctgatctatcctaagactag

SEQ ID NO: 615685 - DNA, 25 bp, Mus musculus
ggcccctgatctttcctaagactag

SEQ ID NO: 615686 - DNA, 25 bp, Mus musculus
ggcccctgattgacctcataatgaa

SEQ ID NO: 615687 - DNA, 25 bp, Mus musculus
ggcccctgattgtcctcataatgaa

SEQ ID NO: 615688 - DNA, 25 bp, Mus musculus
ggcccctgcactcccagaaaatgtg

SEQ ID NO: 615689 - DNA, 25 bp, Mus musculus
ggcccctgcactgccagaaaatgtg

SEQ ID NO: 615690 - DNA, 25 bp, Mus musculus
ggcccctgcagtacagcatgaggac

SEQ ID NO: 615691 - DNA, 25 bp, Mus musculus
ggcccctgcagttcagcatgaggac

SEQ ID NO: 615692 - DNA, 25 bp, Mus musculus
ggcccctgctctcagatcctgaaga

SEQ ID NO: 615693 - DNA, 25 bp, Mus musculus
ggcccctgctctgagatcctgaaga

SEQ ID NO: 615694 - DNA, 25 bp, Mus musculus
ggcccctgctgtagagtgcacaaga

SEQ ID NO: 615695 - DNA, 25 bp, Mus musculus
ggcccctgctgttgagtgcacaaga

SEQ ID NO: 615696 - DNA, 25 bp, Mus musculus
ggcccctggagccattctgggataa

SEQ ID NO: 615697 - DNA, 25 bp, Mus musculus
ggcccctggagcgattctgggataa

SEQ ID NO: 615698 - DNA, 25 bp, Mus musculus
ggcccctggcatccttaagtaacta

SEQ ID NO: 615699 - DNA, 25 bp, Mus musculus
ggcccctggcatgcttaagtaacta

SEQ ID NO: 615700 - DNA, 25 bp, Mus musculus
ggcccctgggtacacaaacaaagct

SEQ ID NO: 615701 - DNA, 25 bp, Mus musculus
ggcccctgggtagacaaacaaagct

SEQ ID NO: 615702 - DNA, 25 bp, Mus musculus
ggcccctgtatccacaggtgatgga

SEQ ID NO: 615703 - DNA, 25 bp, Mus musculus
ggcccctgtatcgacaggtgatgga

SEQ ID NO: 615704 - DNA, 25 bp, Mus musculus
ggcccctgtgaacgccccatagaaa

SEQ ID NO: 615705 - DNA, 25 bp, Mus musculus
ggcccctgtgaaggccccatagaaa

SEQ ID NO: 615706 - DNA, 25 bp, Mus musculus
ggcccctgtgttctactgtataaat

SEQ ID NO: 615707 - DNA, 25 bp, Mus musculus
ggcccctgtgttgtactgtataaat

SEQ ID NO: 615708 - DNA, 25 bp, Mus musculus
ggccccttaaggaggagtcaccagc

SEQ ID NO: 615709 - DNA, 25 bp, Mus musculus
ggccccttaaggtggagtcaccagc

SEQ ID NO: 615710 - DNA, 25 bp, Mus musculus
ggccccttactgaaggttggcagat

SEQ ID NO: 615711 - DNA, 25 bp, Mus musculus
ggccccttactgtaggttggcagat

SEQ ID NO: 615712 - DNA, 25 bp, Mus musculus
ggccccttagtaacatccatggaaa

SEQ ID NO: 615713 - DNA, 25 bp, Mus musculus
ggccccttagtatcatccatggaaa

SEQ ID NO: 615714 - DNA, 25 bp, Mus musculus
ggccccttcccgagagcagaaaaag

SEQ ID NO: 615715 - DNA, 25 bp, Mus musculus
ggccccttcccgtgagcagaaaaag

SEQ ID NO: 615716 - DNA, 25 bp, Mus musculus
ggccccttgaggagagtgctgcttc

SEQ ID NO: 615717 - DNA, 25 bp, Mus musculus
ggccccttgaggtgagtgctgcttc

SEQ ID NO: 615718 - DNA, 25 bp, Mus musculus
ggccccttgcccaacagggttgagg

SEQ ID NO: 615719 - DNA, 25 bp, Mus musculus
ggccccttgccctacagggttgagg

SEQ ID NO: 615720 - DNA, 25 bp, Mus musculus
ggccccttggccataagcagaacta

SEQ ID NO: 615721 - DNA, 25 bp, Mus musculus
ggccccttggccttaagcagaacta

SEQ ID NO: 615722 - DNA, 25 bp, Mus musculus
ggccccttgggacagatgctttgaa

SEQ ID NO: 615723 - DNA, 25 bp, Mus musculus
ggccccttgggagagatgctttgaa

SEQ ID NO: 615724 - DNA, 25 bp, Mus musculus
ggccccttggttcttcatgagaaag

SEQ ID NO: 615725 - DNA, 25 bp, Mus musculus
ggccccttggttgttcatgagaaag

SEQ ID NO: 615726 - DNA, 25 bp, Mus musculus
ggcccctttgtcaagtttgtattgt

SEQ ID NO: 615727 - DNA, 25 bp, Mus musculus
ggcccctttgtctagtttgtattgt

SEQ ID NO: 615728 - DNA, 25 bp, Mus musculus
ggcccgaaagccaggagcgaacctc

SEQ ID NO: 615729 - DNA, 25 bp, Mus musculus
ggcccgaaagcctggagcgaacctc

SEQ ID NO: 615730 - DNA, 25 bp, Mus musculus
ggcccgaacacgagcaatgcatgta

SEQ ID NO: 615731 - DNA, 25 bp, Mus musculus
ggcccgaacacgtgcaatgcatgta

SEQ ID NO: 615732 - DNA, 25 bp, Mus musculus
ggcccgagccccactgcatgaagag

SEQ ID NO: 615733 - DNA, 25 bp, Mus musculus
ggcccgagcccctctgcatgaagag

SEQ ID NO: 615734 - DNA, 25 bp, Mus musculus
ggcccgagcgcgattccgaaaactg

SEQ ID NO: 615735 - DNA, 25 bp, Mus musculus
ggcccgagcgcgtttccgaaaactg

SEQ ID NO: 615736 - DNA, 25 bp, Mus musculus
ggcccgaggcagaaggagctcttat

SEQ ID NO: 615737 - DNA, 25 bp, Mus musculus
ggcccgaggcagtaggagctcttat

SEQ ID NO: 615738 - DNA, 25 bp, Mus musculus
ggcccgaggtgtccacattttgctg

SEQ ID NO: 615739 - DNA, 25 bp, Mus musculus
ggcccgaggtgtgcacattttgctg

SEQ ID NO: 615740 - DNA, 25 bp, Mus musculus
ggcccgatactgaggctctttttgc

SEQ ID NO: 615741 - DNA, 25 bp, Mus musculus
ggcccgatactgtggctctttttgc

SEQ ID NO: 615742 - DNA, 25 bp, Mus musculus
ggcccgatcgccagtctgcaaagga

SEQ ID NO: 615743 - DNA, 25 bp, Mus musculus
ggcccgatcgcctgtctgcaaagga

SEQ ID NO: 615744 - DNA, 25 bp, Mus musculus
ggcccgatgggcagcagcaatgcat

SEQ ID NO: 615745 - DNA, 25 bp, Mus musculus
ggcccgatgggctgcagcaatgcat

SEQ ID NO: 615746 - DNA, 25 bp, Mus musculus
ggcccgcactgcaaatgaactggag

SEQ ID NO: 615747 - DNA, 25 bp, Mus musculus
ggcccgcactgctaatgaactggag

SEQ ID NO: 615748 - DNA, 25 bp, Mus musculus
ggcccgcctcagatacaaaacaaga

SEQ ID NO: 615749 - DNA, 25 bp, Mus musculus
ggcccgcctcagttacaaaacaaga

SEQ ID NO: 615750 - DNA, 25 bp, Mus musculus
ggcccgcgactgataacgtgaactg

SEQ ID NO: 615751 - DNA, 25 bp, Mus musculus
ggcccgcgactgttaacgtgaactg

SEQ ID NO: 615752 - DNA, 25 bp, Mus musculus
ggcccgctgccaacacgaagattgg

SEQ ID NO: 615753 - DNA, 25 bp, Mus musculus
ggcccgctgccatcacgaagattgg

SEQ ID NO: 615754 - DNA, 25 bp, Mus musculus
ggcccgcttaaaacctctatgtgta

SEQ ID NO: 615755 - DNA, 25 bp, Mus musculus
ggcccgcttaaatcctctatgtgta

SEQ ID NO: 615756 - DNA, 25 bp, Mus musculus
ggcccgcttgcacagagttatggca

SEQ ID NO: 615757 - DNA, 25 bp, Mus musculus
ggcccgcttgcagagagttatggca

SEQ ID NO: 615758 - DNA, 25 bp, Mus musculus
ggcccggaaaccattgcattataca

SEQ ID NO: 615759 - DNA, 25 bp, Mus musculus
ggcccggaaacctttgcattataca

SEQ ID NO: 615760 - DNA, 25 bp, Mus musculus
ggcccggaaagtcactatgcgctaa

SEQ ID NO: 615761 - DNA, 25 bp, Mus musculus
ggcccggaaagtgactatgcgctaa

SEQ ID NO: 615762 - DNA, 25 bp, Mus musculus
ggcccggaaatcagcccggaagttg

SEQ ID NO: 615763 - DNA, 25 bp, Mus musculus
ggcccggaaatctgcccggaagttg

SEQ ID NO: 615764 - DNA, 25 bp, Mus musculus
ggcccggaagaacaaggctctgtcc

SEQ ID NO: 615765 - DNA, 25 bp, Mus musculus
ggcccggaagaagaaggctctgtcc

SEQ ID NO: 615766 - DNA, 25 bp, Mus musculus
ggcccggaccagctagttgaaacag

SEQ ID NO: 615767 - DNA, 25 bp, Mus musculus
ggcccggaccaggtagttgaaacag

SEQ ID NO: 615768 - DNA, 25 bp, Mus musculus
ggcccggagcctacacgatatggag

SEQ ID NO: 615769 - DNA, 25 bp, Mus musculus
ggcccggagccttcacgatatggag

SEQ ID NO: 615770 - DNA, 25 bp, Mus musculus
ggcccggagtttctgcgcaagcata

SEQ ID NO: 615771 - DNA, 25 bp, Mus musculus
ggcccggagtttgtgcgcaagcata

SEQ ID NO: 615772 - DNA, 25 bp, Mus musculus
ggcccggatgtaccatcggaagcaa

SEQ ID NO: 615773 - DNA, 25 bp, Mus musculus
ggcccggatgtagcatcggaagcaa

SEQ ID NO: 615774 - DNA, 25 bp, Mus musculus
ggcccggattgacattggactgcat

SEQ ID NO: 615775 - DNA, 25 bp, Mus musculus
ggcccggattgagattggactgcat

SEQ ID NO: 615776 - DNA, 25 bp, Mus musculus
ggcccggcaactcgccatgcagata

SEQ ID NO: 615777 - DNA, 25 bp, Mus musculus
ggcccggcaactggccatgcagata

SEQ ID NO: 615778 - DNA, 25 bp, Mus musculus
ggcccggcattgatctgactgaaaa

SEQ ID NO: 615779 - DNA, 25 bp, Mus musculus
ggcccggcattgttctgactgaaaa

SEQ ID NO: 615780 - DNA, 25 bp, Mus musculus
ggcccggcggtcaacttgagccaga

SEQ ID NO: 615781 - DNA, 25 bp, Mus musculus
ggcccggcggtctacttgagccaga

SEQ ID NO: 615782 - DNA, 25 bp, Mus musculus
ggcccgggaagaattgaccagaatg

SEQ ID NO: 615783 - DNA, 25 bp, Mus musculus
ggcccgggaagatttgaccagaatg

SEQ ID NO: 615784 - DNA, 25 bp, Mus musculus
ggcccgggtgttcttgcataccaca

SEQ ID NO: 615785 - DNA, 25 bp, Mus musculus
ggcccgggtgttgttgcataccaca

SEQ ID NO: 615786 - DNA, 25 bp, Mus musculus
ggcccgtatcgtactcaccgcaggg

SEQ ID NO: 615787 - DNA, 25 bp, Mus musculus
ggcccgtatcgttctcaccgcaggg

SEQ ID NO: 615788 - DNA, 25 bp, Mus musculus
ggcccgtatgggagtgtttctataa

SEQ ID NO: 615789 - DNA, 25 bp, Mus musculus
ggcccgtatgggtgtgtttctataa

SEQ ID NO: 615790 - DNA, 25 bp, Mus musculus
ggcccgtccataaagggatccactg

SEQ ID NO: 615791 - DNA, 25 bp, Mus musculus
ggcccgtccatatagggatccactg

SEQ ID NO: 615792 - DNA, 25 bp, Mus musculus
ggcccgtctgatactgccactaaag

SEQ ID NO: 615793 - DNA, 25 bp, Mus musculus
ggcccgtctgattctgccactaaag

SEQ ID NO: 615794 - DNA, 25 bp, Mus musculus
ggcccgtggaaacctgtatgtagtt

SEQ ID NO: 615795 - DNA, 25 bp, Mus musculus
ggcccgtggaaagctgtatgtagtt

SEQ ID NO: 615796 - DNA, 25 bp, Mus musculus
ggcccgtggttgagacatagctgac

SEQ ID NO: 615797 - DNA, 25 bp, Mus musculus
ggcccgtggttgtgacatagctgac

SEQ ID NO: 615798 - DNA, 25 bp, Mus musculus
ggcccgtgtagacgggactcccaat

SEQ ID NO: 615799 - DNA, 25 bp, Mus musculus
ggcccgtgtagaggggactcccaat

SEQ ID NO: 615800 - DNA, 25 bp, Mus musculus
ggcccgtgtgatcccggttacatag

SEQ ID NO: 615801 - DNA, 25 bp, Mus musculus
ggcccgtgtgatgccggttacatag

SEQ ID NO: 615802 - DNA, 25 bp, Mus musculus
ggcccgtgtggaagcttctgaccca

SEQ ID NO: 615803 - DNA, 25 bp, Mus musculus
ggcccgtgtggatgcttctgaccca

SEQ ID NO: 615804 - DNA, 25 bp, Mus musculus
ggcccgtgtgggatgtccagaacct

SEQ ID NO: 615805 - DNA, 25 bp, Mus musculus
ggcccgtgtgggttgtccagaacct

SEQ ID NO: 615806 - DNA, 25 bp, Mus musculus
ggcccgttttagatcggctctgtca

SEQ ID NO: 615807 - DNA, 25 bp, Mus musculus
ggcccgttttagttcggctctgtca

SEQ ID NO: 615808 - DNA, 25 bp, Mus musculus
ggccctaaggcacgacattctcaaa

SEQ ID NO: 615809 - DNA, 25 bp, Mus musculus
ggccctaaggcaggacattctcaaa

SEQ ID NO: 615810 - DNA, 25 bp, Mus musculus
ggccctaatgagagggatgatttat

SEQ ID NO: 615811 - DNA, 25 bp, Mus musculus
ggccctaatgagattacagctgtaa

SEQ ID NO: 615812 - DNA, 25 bp, Mus musculus
ggccctaatgagtgggatgatttat

SEQ ID NO: 615813 - DNA, 25 bp, Mus musculus
ggccctaatgagtttacagctgtaa

SEQ ID NO: 615814 - DNA, 25 bp, Mus musculus
ggccctaatgatataatccccttag

SEQ ID NO: 615815 - DNA, 25 bp, Mus musculus
ggccctaatgatttaatccccttag

SEQ ID NO: 615816 - DNA, 25 bp, Mus musculus
ggccctaatgggatttgagcttaca

SEQ ID NO: 615817 - DNA, 25 bp, Mus musculus
ggccctaatgggttttgagcttaca

SEQ ID NO: 615818 - DNA, 25 bp, Mus musculus
ggccctaattagagccagattctta

SEQ ID NO: 615819 - DNA, 25 bp, Mus musculus
ggccctaattagtgccagattctta

SEQ ID NO: 615820 - DNA, 25 bp, Mus musculus
ggccctacaagcaggtgcagaagcg

SEQ ID NO: 615821 - DNA, 25 bp, Mus musculus
ggccctacaagctggtgcagaagcg

SEQ ID NO: 615822 - DNA, 25 bp, Mus musculus
ggccctaccccaaatctgataaagt

SEQ ID NO: 615823 - DNA, 25 bp, Mus musculus
ggccctaccccatatctgataaagt

SEQ ID NO: 615824 - DNA, 25 bp, Mus musculus
ggccctacggggagctagacaatac

SEQ ID NO: 615825 - DNA, 25 bp, Mus musculus
ggccctacggggtgctagacaatac

SEQ ID NO: 615826 - DNA, 25 bp, Mus musculus
ggccctacgtccaaacaactgaatg

SEQ ID NO: 615827 - DNA, 25 bp, Mus musculus
ggccctacgtcctaacaactgaatg

SEQ ID NO: 615828 - DNA, 25 bp, Mus musculus
ggccctactgacaggtcctccgtgt

SEQ ID NO: 615829 - DNA, 25 bp, Mus musculus
ggccctactgactggtcctccgtgt

SEQ ID NO: 615830 - DNA, 25 bp, Mus musculus
ggccctactgtactggttttcaggc

SEQ ID NO: 615831 - DNA, 25 bp, Mus musculus
ggccctactgtagtggttttcaggc

SEQ ID NO: 615832 - DNA, 25 bp, Mus musculus
ggccctagaattcgccttcatagaa

SEQ ID NO: 615833 - DNA, 25 bp, Mus musculus
ggccctagaattggccttcatagaa

SEQ ID NO: 615834 - DNA, 25 bp, Mus musculus
ggccctagaggtcccagagccactg

SEQ ID NO: 615835 - DNA, 25 bp, Mus musculus
ggccctagaggtgccagagccactg

SEQ ID NO: 615836 - DNA, 25 bp, Mus musculus
ggccctagatgtaaaccctgaaaga

SEQ ID NO: 615837 - DNA, 25 bp, Mus musculus
ggccctagatgttaaccctgaaaga

SEQ ID NO: 615838 - DNA, 25 bp, Mus musculus
ggccctagcattaatttaccctttg

SEQ ID NO: 615839 - DNA, 25 bp, Mus musculus
ggccctagcatttatttaccctttg

SEQ ID NO: 615840 - DNA, 25 bp, Mus musculus
ggccctagcctgcatggacgagaat

SEQ ID NO: 615841 - DNA, 25 bp, Mus musculus
ggccctagcctggatggacgagaat

SEQ ID NO: 615842 - DNA, 25 bp, Mus musculus
ggccctagggaacgcttcatgctgt

SEQ ID NO: 615843 - DNA, 25 bp, Mus musculus
ggccctagggaaggcttcatgctgt

SEQ ID NO: 615844 - DNA, 25 bp, Mus musculus
ggccctagggatactcatttatcat

SEQ ID NO: 615845 - DNA, 25 bp, Mus musculus
ggccctagggattctcatttatcat

SEQ ID NO: 615846 - DNA, 25 bp, Mus musculus
ggccctaggtcacctttagatcaga

SEQ ID NO: 615847 - DNA, 25 bp, Mus musculus
ggccctaggtcagctttagatcaga

SEQ ID NO: 615848 - DNA, 25 bp, Mus musculus
ggccctaggttacatttttggtgat

SEQ ID NO: 615849 - DNA, 25 bp, Mus musculus
ggccctaggttagatttttggtgat

SEQ ID NO: 615850 - DNA, 25 bp, Mus musculus
ggccctagtcaaccccgcttgaaaa

SEQ ID NO: 615851 - DNA, 25 bp, Mus musculus
ggccctagtcaagcccgcttgaaaa

SEQ ID NO: 615852 - DNA, 25 bp, Mus musculus
ggccctataagcagaaacacttcca

SEQ ID NO: 615853 - DNA, 25 bp, Mus musculus
ggccctataagctgaaacacttcca

SEQ ID NO: 615854 - DNA, 25 bp, Mus musculus
ggccctatacacattattaccgaga

SEQ ID NO: 615855 - DNA, 25 bp, Mus musculus
ggccctatacactttattaccgaga

SEQ ID NO: 615856 - DNA, 25 bp, Mus musculus
ggccctatgagaagtgctgtcacct

SEQ ID NO: 615857 - DNA, 25 bp, Mus musculus
ggccctatgagatgtgctgtcacct

SEQ ID NO: 615858 - DNA, 25 bp, Mus musculus
ggccctatgcaaataaccaagtgaa

SEQ ID NO: 615859 - DNA, 25 bp, Mus musculus
ggccctatgcaattaaccaagtgaa

SEQ ID NO: 615860 - DNA, 25 bp, Mus musculus
ggccctatgggcagcctggcaaaga

SEQ ID NO: 615861 - DNA, 25 bp, Mus musculus
ggccctatgggctgcctggcaaaga

SEQ ID NO: 615862 - DNA, 25 bp, Mus musculus
ggccctatgtctaagtactagaaca

SEQ ID NO: 615863 - DNA, 25 bp, Mus musculus
ggccctatgtcttagtactagaaca

SEQ ID NO: 615864 - DNA, 25 bp, Mus musculus
ggccctattcagaggcagcttcttg

SEQ ID NO: 615865 - DNA, 25 bp, Mus musculus
ggccctattcagtggcagcttcttg

SEQ ID NO: 615866 - DNA, 25 bp, Mus musculus
ggccctattggacgaggtattgtca

SEQ ID NO: 615867 - DNA, 25 bp, Mus musculus
ggccctattggaggaggtattgtca

SEQ ID NO: 615868 - DNA, 25 bp, Mus musculus
ggccctatttaaaagccacgcagtc

SEQ ID NO: 615869 - DNA, 25 bp, Mus musculus
ggccctatttaatagccacgcagtc

SEQ ID NO: 615870 - DNA, 25 bp, Mus musculus
ggccctcaaagccattggtgggtaa

SEQ ID NO: 615871 - DNA, 25 bp, Mus musculus
ggccctcaaagcgattggtgggtaa

SEQ ID NO: 615872 - DNA, 25 bp, Mus musculus
ggccctcaagctctggattggctgt

SEQ ID NO: 615873 - DNA, 25 bp, Mus musculus
ggccctcaagctgtggattggctgt

SEQ ID NO: 615874 - DNA, 25 bp, Mus musculus
ggccctcaaggaagagttccaccag

SEQ ID NO: 615875 - DNA, 25 bp, Mus musculus
ggccctcaaggatgagttccaccag

SEQ ID NO: 615876 - DNA, 25 bp, Mus musculus
ggccctcaagtaactgtccaggaat

SEQ ID NO: 615877 - DNA, 25 bp, Mus musculus
ggccctcaagtatctgtccaggaat

SEQ ID NO: 615878 - DNA, 25 bp, Mus musculus
ggccctcacaggcagatgatacatt

SEQ ID NO: 615879 - DNA, 25 bp, Mus musculus
ggccctcacagggagatgatacatt

SEQ ID NO: 615880 - DNA, 25 bp, Mus musculus
ggccctcacgagacagacagatgtt

SEQ ID NO: 615881 - DNA, 25 bp, Mus musculus
ggccctcacgagtcagacagatgtt

SEQ ID NO: 615882 - DNA, 25 bp, Mus musculus
ggccctcagaggatcgaagcttgga

SEQ ID NO: 615883 - DNA, 25 bp, Mus musculus
ggccctcagaggttcgaagcttgga

SEQ ID NO: 615884 - DNA, 25 bp, Mus musculus
ggccctcagagtactgtgggtctaa

SEQ ID NO: 615885 - DNA, 25 bp, Mus musculus
ggccctcagagttctgtgggtctaa

SEQ ID NO: 615886 - DNA, 25 bp, Mus musculus
ggccctcagctgaaacttctgatga

SEQ ID NO: 615887 - DNA, 25 bp, Mus musculus
ggccctcagctgcactttcttggtg

SEQ ID NO: 615888 - DNA, 25 bp, Mus musculus
ggccctcagctggactttcttggtg

SEQ ID NO: 615889 - DNA, 25 bp, Mus musculus
ggccctcagctgtaacttctgatga

SEQ ID NO: 615890 - DNA, 25 bp, Mus musculus
ggccctcagggcaaaagatatctcg

SEQ ID NO: 615891 - DNA, 25 bp, Mus musculus
ggccctcagggctaaagatatctcg

SEQ ID NO: 615892 - DNA, 25 bp, Mus musculus
ggccctcagtaaatccgaagcacag

SEQ ID NO: 615893 - DNA, 25 bp, Mus musculus
ggccctcagtaattccgaagcacag

SEQ ID NO: 615894 - DNA, 25 bp, Mus musculus
ggccctcagttcaataaccagtatc

SEQ ID NO: 615895 - DNA, 25 bp, Mus musculus
ggccctcagttctataaccagtatc

SEQ ID NO: 615896 - DNA, 25 bp, Mus musculus
ggccctcatcatccctacatagaaa

SEQ ID NO: 615897 - DNA, 25 bp, Mus musculus
ggccctcatcatgcctacatagaaa

SEQ ID NO: 615898 - DNA, 25 bp, Mus musculus
ggccctcatcttatgcagcaaatgg

SEQ ID NO: 615899 - DNA, 25 bp, Mus musculus
ggccctcatcttttgcagcaaatgg

SEQ ID NO: 615900 - DNA, 25 bp, Mus musculus
ggccctcattgcaacagagggtgat

SEQ ID NO: 615901 - DNA, 25 bp, Mus musculus
ggccctcattgctacagagggtgat

SEQ ID NO: 615902 - DNA, 25 bp, Mus musculus
ggccctcatttcaatatacctgtat

SEQ ID NO: 615903 - DNA, 25 bp, Mus musculus
ggccctcatttctatatacctgtat

SEQ ID NO: 615904 - DNA, 25 bp, Mus musculus
ggccctccacttaagtgccagtgag

SEQ ID NO: 615905 - DNA, 25 bp, Mus musculus
ggccctccactttagtgccagtgag

SEQ ID NO: 615906 - DNA, 25 bp, Mus musculus
ggccctccatttaacttctaatatc

SEQ ID NO: 615907 - DNA, 25 bp, Mus musculus
ggccctccattttacttctaatatc

SEQ ID NO: 615908 - DNA, 25 bp, Mus musculus
ggccctcccaggagtgacttaaatt

SEQ ID NO: 615909 - DNA, 25 bp, Mus musculus
ggccctcccaggtgtgacttaaatt

SEQ ID NO: 615910 - DNA, 25 bp, Mus musculus
ggccctccgaacaatactgaaaact

SEQ ID NO: 615911 - DNA, 25 bp, Mus musculus
ggccctccgaactatactgaaaact

SEQ ID NO: 615912 - DNA, 25 bp, Mus musculus
ggccctccgatactactatgacaaa

SEQ ID NO: 615913 - DNA, 25 bp, Mus musculus
ggccctccgatagtactatgacaaa

SEQ ID NO: 615914 - DNA, 25 bp, Mus musculus
ggccctcctgagattctgttcagtt

SEQ ID NO: 615915 - DNA, 25 bp, Mus musculus
ggccctcctgagtttctgttcagtt

SEQ ID NO: 615916 - DNA, 25 bp, Mus musculus
ggccctcctgtgctcttaggagaat

SEQ ID NO: 615917 - DNA, 25 bp, Mus musculus
ggccctcctgtggtcttaggagaat

SEQ ID NO: 615918 - DNA, 25 bp, Mus musculus
ggccctcctttcataagcggtagct

SEQ ID NO: 615919 - DNA, 25 bp, Mus musculus
ggccctcctttcttaagcggtagct

SEQ ID NO: 615920 - DNA, 25 bp, Mus musculus
ggccctccttttacacatgaagttt

SEQ ID NO: 615921 - DNA, 25 bp, Mus musculus
ggccctcctttttcacatgaagttt

SEQ ID NO: 615922 - DNA, 25 bp, Mus musculus
ggccctcgagacatggtagttgtca

SEQ ID NO: 615923 - DNA, 25 bp, Mus musculus
ggccctcgagacttggtagttgtca

SEQ ID NO: 615924 - DNA, 25 bp, Mus musculus
ggccctcgagttcattggattgttc

SEQ ID NO: 615925 - DNA, 25 bp, Mus musculus
ggccctcgagttgattggattgttc

SEQ ID NO: 615926 - DNA, 25 bp, Mus musculus
ggccctcgcaatatcctaaagatgt

SEQ ID NO: 615927 - DNA, 25 bp, Mus musculus
ggccctcgcaatttcctaaagatgt

SEQ ID NO: 615928 - DNA, 25 bp, Mus musculus
ggccctcggctgagtatttatagat

SEQ ID NO: 615929 - DNA, 25 bp, Mus musculus
ggccctcggctgcattagctttgta

SEQ ID NO: 615930 - DNA, 25 bp, Mus musculus
ggccctcggctggattagctttgta

SEQ ID NO: 615931 - DNA, 25 bp, Mus musculus
ggccctcggctgtgtatttatagat

SEQ ID NO: 615932 - DNA, 25 bp, Mus musculus
ggccctcgtgttcgcaaatcaaaca

SEQ ID NO: 615933 - DNA, 25 bp, Mus musculus
ggccctcgtgttggcaaatcaaaca

SEQ ID NO: 615934 - DNA, 25 bp, Mus musculus
ggccctctaggaagctggatgctga

SEQ ID NO: 615935 - DNA, 25 bp, Mus musculus
ggccctctaggatgctggatgctga

SEQ ID NO: 615936 - DNA, 25 bp, Mus musculus
ggccctctccaaatcaaggatcttt

SEQ ID NO: 615937 - DNA, 25 bp, Mus musculus
ggccctctccaattcaaggatcttt

SEQ ID NO: 615938 - DNA, 25 bp, Mus musculus
ggccctctgagacagcatccaatgt

SEQ ID NO: 615939 - DNA, 25 bp, Mus musculus
ggccctctgagagagcatccaatgt

SEQ ID NO: 615940 - DNA, 25 bp, Mus musculus
ggccctctggctaattgctgggaga

SEQ ID NO: 615941 - DNA, 25 bp, Mus musculus
ggccctctggcttattgctgggaga

SEQ ID NO: 615942 - DNA, 25 bp, Mus musculus
ggccctctggtcagcaatgtgacag

SEQ ID NO: 615943 - DNA, 25 bp, Mus musculus
ggccctctggtctgcaatgtgacag

SEQ ID NO: 615944 - DNA, 25 bp, Mus musculus
ggccctctgtggacggaatcttgga

SEQ ID NO: 615945 - DNA, 25 bp, Mus musculus
ggccctctgtggtcggaatcttgga

SEQ ID NO: 615946 - DNA, 25 bp, Mus musculus
ggccctcttaacatgcagcttgtgt

SEQ ID NO: 615947 - DNA, 25 bp, Mus musculus
ggccctcttaacttgcagcttgtgt

SEQ ID NO: 615948 - DNA, 25 bp, Mus musculus
ggccctcttggaatgcagctgcagt

SEQ ID NO: 615949 - DNA, 25 bp, Mus musculus
ggccctcttggattgcagctgcagt

SEQ ID NO: 615950 - DNA, 25 bp, Mus musculus
ggccctgaacggagctggctagaaa

SEQ ID NO: 615951 - DNA, 25 bp, Mus musculus
ggccctgaacggtgctggctagaaa

SEQ ID NO: 615952 - DNA, 25 bp, Mus musculus
ggccctgaaggtctacaagctgttt

SEQ ID NO: 615953 - DNA, 25 bp, Mus musculus
ggccctgaaggtgtacaagctgttt

SEQ ID NO: 615954 - DNA, 25 bp, Mus musculus
ggccctgaatgactacctgcggatc

SEQ ID NO: 615955 - DNA, 25 bp, Mus musculus
ggccctgaatgagtacctgcggatc

SEQ ID NO: 615956 - DNA, 25 bp, Mus musculus
ggccctgacctaaaggaagccagct

SEQ ID NO: 615957 - DNA, 25 bp, Mus musculus
ggccctgacctataggaagccagct

SEQ ID NO: 615958 - DNA, 25 bp, Mus musculus
ggccctgagagccatccttaatgat

SEQ ID NO: 615959 - DNA, 25 bp, Mus musculus
ggccctgagagcgatccttaatgat

SEQ ID NO: 615960 - DNA, 25 bp, Mus musculus
ggccctgagctgacatacatcacag

SEQ ID NO: 615961 - DNA, 25 bp, Mus musculus
ggccctgagctgcacttatatttta

SEQ ID NO: 615962 - DNA, 25 bp, Mus musculus
ggccctgagctggacttatatttta

SEQ ID NO: 615963 - DNA, 25 bp, Mus musculus
ggccctgagctgtcatacatcacag

SEQ ID NO: 615964 - DNA, 25 bp, Mus musculus
ggccctgaggttattgatgctgagc

SEQ ID NO: 615965 - DNA, 25 bp, Mus musculus
ggccctgaggtttttgatgctgagc

SEQ ID NO: 615966 - DNA, 25 bp, Mus musculus
ggccctgagtctcacaaagccttca

SEQ ID NO: 615967 - DNA, 25 bp, Mus musculus
ggccctgagtctgacaaagccttca

SEQ ID NO: 615968 - DNA, 25 bp, Mus musculus
ggccctgagttccaaccgtgacgta

SEQ ID NO: 615969 - DNA, 25 bp, Mus musculus
ggccctgagttcgaaccgtgacgta

SEQ ID NO: 615970 - DNA, 25 bp, Mus musculus
ggccctgatggcatccagagctgga

SEQ ID NO: 615971 - DNA, 25 bp, Mus musculus
ggccctgatggcttccagagctgga

SEQ ID NO: 615972 - DNA, 25 bp, Mus musculus
ggccctgatgtactgtaatcactcc

SEQ ID NO: 615973 - DNA, 25 bp, Mus musculus
ggccctgatgtagtgtaatcactcc

SEQ ID NO: 615974 - DNA, 25 bp, Mus musculus
ggccctgcaggcagaatcgtggcat

SEQ ID NO: 615975 - DNA, 25 bp, Mus musculus
ggccctgcaggctgaatcgtggcat

SEQ ID NO: 615976 - DNA, 25 bp, Mus musculus
ggccctgccagaaaagagtctccat

SEQ ID NO: 615977 - DNA, 25 bp, Mus musculus
ggccctgccagataagagtctccat

SEQ ID NO: 615978 - DNA, 25 bp, Mus musculus
ggccctgctacaccagttgcgtgaa

SEQ ID NO: 615979 - DNA, 25 bp, Mus musculus
ggccctgctacagcagttgcgtgaa

SEQ ID NO: 615980 - DNA, 25 bp, Mus musculus
ggccctgctaggcaaacagtgtctc

SEQ ID NO: 615981 - DNA, 25 bp, Mus musculus
ggccctgctagggaaacagtgtctc

SEQ ID NO: 615982 - DNA, 25 bp, Mus musculus
ggccctgctgctcgttgcggtagta

SEQ ID NO: 615983 - DNA, 25 bp, Mus musculus
ggccctgctgctggttgcggtagta

SEQ ID NO: 615984 - DNA, 25 bp, Mus musculus
ggccctgcttaaactgattcgtgat

SEQ ID NO: 615985 - DNA, 25 bp, Mus musculus
ggccctgcttaatctgattcgtgat

SEQ ID NO: 615986 - DNA, 25 bp, Mus musculus
ggccctgcttgaacactttatctag

SEQ ID NO: 615987 - DNA, 25 bp, Mus musculus
ggccctgcttgatcactttatctag

SEQ ID NO: 615988 - DNA, 25 bp, Mus musculus
ggccctggagacaggtatttaaaga

SEQ ID NO: 615989 - DNA, 25 bp, Mus musculus
ggccctggagactggtatttaaaga

SEQ ID NO: 615990 - DNA, 25 bp, Mus musculus
ggccctggagagattcgcccagctg

SEQ ID NO: 615991 - DNA, 25 bp, Mus musculus
ggccctggagagtttcgcccagctg

SEQ ID NO: 615992 - DNA, 25 bp, Mus musculus
ggccctggatggaatctggagcatt

SEQ ID NO: 615993 - DNA, 25 bp, Mus musculus
ggccctggatggtatctggagcatt

SEQ ID NO: 615994 - DNA, 25 bp, Mus musculus
ggccctggcagaaagtaattataat

SEQ ID NO: 615995 - DNA, 25 bp, Mus musculus
ggccctggcagatagtaattataat

SEQ ID NO: 615996 - DNA, 25 bp, Mus musculus
ggccctggcgggaagcaagtttcac

SEQ ID NO: 615997 - DNA, 25 bp, Mus musculus
ggccctggcgggtagcaagtttcac

SEQ ID NO: 615998 - DNA, 25 bp, Mus musculus
ggccctggctttcgccatcaaggaa

SEQ ID NO: 615999 - DNA, 25 bp, Mus musculus
ggccctggctttggccatcaaggaa

SEQ ID NO: 616000 - DNA, 25 bp, Mus musculus
ggccctgggataacagagcctgcta

SEQ ID NO: 616001 - DNA, 25 bp, Mus musculus
ggccctgggatatcagagcctgcta

SEQ ID NO: 616002 - DNA, 25 bp, Mus musculus
ggccctgggtaccatgatggcctcc

SEQ ID NO: 616003 - DNA, 25 bp, Mus musculus
ggccctgggtacgatgatggcctcc

SEQ ID NO: 616004 - DNA, 25 bp, Mus musculus
ggccctgggtataaccagtccagta

SEQ ID NO: 616005 - DNA, 25 bp, Mus musculus
ggccctgggtattaccagtccagta

SEQ ID NO: 616006 - DNA, 25 bp, Mus musculus
ggccctgggttccaattacaaacag

SEQ ID NO: 616007 - DNA, 25 bp, Mus musculus
ggccctgggttcgaattacaaacag

SEQ ID NO: 616008 - DNA, 25 bp, Mus musculus
ggccctggtggcatgcgaggaggaa

SEQ ID NO: 616009 - DNA, 25 bp, Mus musculus
ggccctggtggcttgcgaggaggaa

SEQ ID NO: 616010 - DNA, 25 bp, Mus musculus
ggccctggttttcacccaacagtat

SEQ ID NO: 616011 - DNA, 25 bp, Mus musculus
ggccctggttttgacccaacagtat

SEQ ID NO: 616012 - DNA, 25 bp, Mus musculus
ggccctgtaaggaagcctgagacaa

SEQ ID NO: 616013 - DNA, 25 bp, Mus musculus
ggccctgtaaggtagcctgagacaa

SEQ ID NO: 616014 - DNA, 25 bp, Mus musculus
ggccctgtaagtccatgccggacaa

SEQ ID NO: 616015 - DNA, 25 bp, Mus musculus
ggccctgtaagtgcatgccggacaa

SEQ ID NO: 616016 - DNA, 25 bp, Mus musculus
ggccctgtacagattgcttatttat

SEQ ID NO: 616017 - DNA, 25 bp, Mus musculus
ggccctgtacagtttgcttatttat

SEQ ID NO: 616018 - DNA, 25 bp, Mus musculus
ggccctgtaccaaagtttctcaaaa

SEQ ID NO: 616019 - DNA, 25 bp, Mus musculus
ggccctgtaccatagtttctcaaaa

SEQ ID NO: 616020 - DNA, 25 bp, Mus musculus
ggccctgtataacttgtgtgctcat

SEQ ID NO: 616021 - DNA, 25 bp, Mus musculus
ggccctgtataagttgtgtgctcat

SEQ ID NO: 616022 - DNA, 25 bp, Mus musculus
ggccctgtatgtagctgttgtcaat

SEQ ID NO: 616023 - DNA, 25 bp, Mus musculus
ggccctgtatgtcgtggaacaagaa

SEQ ID NO: 616024 - DNA, 25 bp, Mus musculus
ggccctgtatgtggtggaacaagaa

SEQ ID NO: 616025 - DNA, 25 bp, Mus musculus
ggccctgtatgttgctgttgtcaat

SEQ ID NO: 616026 - DNA, 25 bp, Mus musculus
ggccctgtcaatatcagccatgcag

SEQ ID NO: 616027 - DNA, 25 bp, Mus musculus
ggccctgtcaatttcagccatgcag

SEQ ID NO: 616028 - DNA, 25 bp, Mus musculus
ggccctgtcagacgtaagccagtct

SEQ ID NO: 616029 - DNA, 25 bp, Mus musculus
ggccctgtcagaggtaagccagtct

SEQ ID NO: 616030 - DNA, 25 bp, Mus musculus
ggccctgtctcaaatgtatctcaag

SEQ ID NO: 616031 - DNA, 25 bp, Mus musculus
ggccctgtctcatatgtatctcaag

SEQ ID NO: 616032 - DNA, 25 bp, Mus musculus
ggccctgtctgaagagcatttctgt

SEQ ID NO: 616033 - DNA, 25 bp, Mus musculus
ggccctgtctgatgagcatttctgt

SEQ ID NO: 616034 - DNA, 25 bp, Mus musculus
ggccctgtgagcaggctaattggaa

SEQ ID NO: 616035 - DNA, 25 bp, Mus musculus
ggccctgtgagctggctaattggaa

SEQ ID NO: 616036 - DNA, 25 bp, Mus musculus
ggccctgtgtcaaatcagtcacttt

SEQ ID NO: 616037 - DNA, 25 bp, Mus musculus
ggccctgtgtcatatcagtcacttt

SEQ ID NO: 616038 - DNA, 25 bp, Mus musculus
ggccctgtgtgaattaagtggacca

SEQ ID NO: 616039 - DNA, 25 bp, Mus musculus
ggccctgtgtgatttaagtggacca

SEQ ID NO: 616040 - DNA, 25 bp, Mus musculus
ggccctgtgtttcgatcagctgata

SEQ ID NO: 616041 - DNA, 25 bp, Mus musculus
ggccctgtgtttggatcagctgata

SEQ ID NO: 616042 - DNA, 25 bp, Mus musculus
ggccctgttaacagcctggcatggg

SEQ ID NO: 616043 - DNA, 25 bp, Mus musculus
ggccctgttaactgcctggcatggg

SEQ ID NO: 616044 - DNA, 25 bp, Mus musculus
ggccctgttagcagtgttggagtca

SEQ ID NO: 616045 - DNA, 25 bp, Mus musculus
ggccctgttagctgtgttggagtca

SEQ ID NO: 616046 - DNA, 25 bp, Mus musculus
ggccctgtttccacatcaggtgtaa

SEQ ID NO: 616047 - DNA, 25 bp, Mus musculus
ggccctgtttcctcatcaggtgtaa

SEQ ID NO: 616048 - DNA, 25 bp, Mus musculus
ggccctgtttgtaacacggtgtgtc

SEQ ID NO: 616049 - DNA, 25 bp, Mus musculus
ggccctgtttgttacacggtgtgtc

SEQ ID NO: 616050 - DNA, 25 bp, Mus musculus
ggccctgttttccactatgcaagat

SEQ ID NO: 616051 - DNA, 25 bp, Mus musculus
ggccctgttttcgactatgcaagat

SEQ ID NO: 616052 - DNA, 25 bp, Mus musculus
ggcccttaaaaccagcgctaatgct

SEQ ID NO: 616053 - DNA, 25 bp, Mus musculus
ggcccttaaaacgagcgctaatgct

SEQ ID NO: 616054 - DNA, 25 bp, Mus musculus
ggcccttaacacaaatataccacca

SEQ ID NO: 616055 - DNA, 25 bp, Mus musculus
ggcccttaacactaatataccacca

SEQ ID NO: 616056 - DNA, 25 bp, Mus musculus
ggcccttaccacagctttcacagtg

SEQ ID NO: 616057 - DNA, 25 bp, Mus musculus
ggcccttaccactgctttcacagtg

SEQ ID NO: 616058 - DNA, 25 bp, Mus musculus
ggcccttaggacacttactcaggaa

SEQ ID NO: 616059 - DNA, 25 bp, Mus musculus
ggcccttaggactcttactcaggaa

SEQ ID NO: 616060 - DNA, 25 bp, Mus musculus
ggcccttagtgtctggctagctgta

SEQ ID NO: 616061 - DNA, 25 bp, Mus musculus
ggcccttagtgtgtggctagctgta

SEQ ID NO: 616062 - DNA, 25 bp, Mus musculus
ggcccttcacatctggtcagacttg

SEQ ID NO: 616063 - DNA, 25 bp, Mus musculus
ggcccttcacatgtggtcagacttg

SEQ ID NO: 616064 - DNA, 25 bp, Mus musculus
ggcccttcagcaagcgacggaggat

SEQ ID NO: 616065 - DNA, 25 bp, Mus musculus
ggcccttcagcatgcgacggaggat

SEQ ID NO: 616066 - DNA, 25 bp, Mus musculus
ggcccttcatatccggcaactgtgg

SEQ ID NO: 616067 - DNA, 25 bp, Mus musculus
ggcccttcatatgcggcaactgtgg

SEQ ID NO: 616068 - DNA, 25 bp, Mus musculus
ggcccttcattcaccctaaaggagg

SEQ ID NO: 616069 - DNA, 25 bp, Mus musculus
ggcccttcattctccctaaaggagg

SEQ ID NO: 616070 - DNA, 25 bp, Mus musculus
ggcccttcccaaagtattaatgttg

SEQ ID NO: 616071 - DNA, 25 bp, Mus musculus
ggcccttcccaatgtattaatgttg

SEQ ID NO: 616072 - DNA, 25 bp, Mus musculus
ggcccttcccttactatgggattag

SEQ ID NO: 616073 - DNA, 25 bp, Mus musculus
ggcccttccctttctatgggattag

SEQ ID NO: 616074 - DNA, 25 bp, Mus musculus
ggcccttcctcaagatgtccatggg

SEQ ID NO: 616075 - DNA, 25 bp, Mus musculus
ggcccttcctcatgatgtccatggg

SEQ ID NO: 616076 - DNA, 25 bp, Mus musculus
ggcccttcctttacactgtgaatga

SEQ ID NO: 616077 - DNA, 25 bp, Mus musculus
ggcccttccttttcactgtgaatga

SEQ ID NO: 616078 - DNA, 25 bp, Mus musculus
ggcccttcgtggcagatctgattgc

SEQ ID NO: 616079 - DNA, 25 bp, Mus musculus
ggcccttcgtgggagatctgattgc

SEQ ID NO: 616080 - DNA, 25 bp, Mus musculus
ggcccttctcagagattttctaaat

SEQ ID NO: 616081 - DNA, 25 bp, Mus musculus
ggcccttctcagtgattttctaaat

SEQ ID NO: 616082 - DNA, 25 bp, Mus musculus
ggcccttctgctcacagatcggtat

SEQ ID NO: 616083 - DNA, 25 bp, Mus musculus
ggcccttctgctgacagatcggtat

SEQ ID NO: 616084 - DNA, 25 bp, Mus musculus
ggcccttctggaccaaggtctcatt

SEQ ID NO: 616085 - DNA, 25 bp, Mus musculus
ggcccttctggagcaaggtctcatt

SEQ ID NO: 616086 - DNA, 25 bp, Mus musculus
ggcccttctgggaacaactagttat

SEQ ID NO: 616087 - DNA, 25 bp, Mus musculus
ggcccttctgggtacaactagttat

SEQ ID NO: 616088 - DNA, 25 bp, Mus musculus
ggcccttctgtcaagcttagtttca

SEQ ID NO: 616089 - DNA, 25 bp, Mus musculus
ggcccttctgtctagcttagtttca

SEQ ID NO: 616090 - DNA, 25 bp, Mus musculus
ggcccttgaactagtctgcttttgg

SEQ ID NO: 616091 - DNA, 25 bp, Mus musculus
ggcccttgaacttgtctgcttttgg

SEQ ID NO: 616092 - DNA, 25 bp, Mus musculus
ggcccttgattgctggaccccgata

SEQ ID NO: 616093 - DNA, 25 bp, Mus musculus
ggcccttgattggtggaccccgata

SEQ ID NO: 616094 - DNA, 25 bp, Mus musculus
ggcccttgctatatattactgtttg

SEQ ID NO: 616095 - DNA, 25 bp, Mus musculus
ggcccttgctatttattactgtttg

SEQ ID NO: 616096 - DNA, 25 bp, Mus musculus
ggcccttgctggcacaaacacaaac

SEQ ID NO: 616097 - DNA, 25 bp, Mus musculus
ggcccttgctgggacaaacacaaac

SEQ ID NO: 616098 - DNA, 25 bp, Mus musculus
ggcccttggcacagtggttttcaaa

SEQ ID NO: 616099 - DNA, 25 bp, Mus musculus
ggcccttggcactgtggttttcaaa

SEQ ID NO: 616100 - DNA, 25 bp, Mus musculus
ggcccttggccaagtgtgaccgtgt

SEQ ID NO: 616101 - DNA, 25 bp, Mus musculus
ggcccttggccatgtgtgaccgtgt

SEQ ID NO: 616102 - DNA, 25 bp, Mus musculus
ggcccttggctcagtcagcgactgc

SEQ ID NO: 616103 - DNA, 25 bp, Mus musculus
ggcccttggctctgtcagcgactgc

SEQ ID NO: 616104 - DNA, 25 bp, Mus musculus
ggcccttggtccagttaatgtatta

SEQ ID NO: 616105 - DNA, 25 bp, Mus musculus
ggcccttggtcctgttaatgtatta

SEQ ID NO: 616106 - DNA, 25 bp, Mus musculus
ggcccttgtgtcatagaagatcata

SEQ ID NO: 616107 - DNA, 25 bp, Mus musculus
ggcccttgtgtcttagaagatcata

SEQ ID NO: 616108 - DNA, 25 bp, Mus musculus
ggcccttgttcaagtcaattttatt

SEQ ID NO: 616109 - DNA, 25 bp, Mus musculus
ggcccttgttcatgtcaattttatt

SEQ ID NO: 616110 - DNA, 25 bp, Mus musculus
ggccctttaccaattcatgcttatt

SEQ ID NO: 616111 - DNA, 25 bp, Mus musculus
ggccctttaccatttcatgcttatt

SEQ ID NO: 616112 - DNA, 25 bp, Mus musculus
ggccctttaggcactctatgacaag

SEQ ID NO: 616113 - DNA, 25 bp, Mus musculus
ggccctttaggctctctatgacaag

SEQ ID NO: 616114 - DNA, 25 bp, Mus musculus
ggccctttccacataccataggctt

SEQ ID NO: 616115 - DNA, 25 bp, Mus musculus
ggccctttccacttaccataggctt

SEQ ID NO: 616116 - DNA, 25 bp, Mus musculus
ggccctttctaaacctatgtattga

SEQ ID NO: 616117 - DNA, 25 bp, Mus musculus
ggccctttctaatcctatgtattga

SEQ ID NO: 616118 - DNA, 25 bp, Mus musculus
ggccctttctctaagttttccattg

SEQ ID NO: 616119 - DNA, 25 bp, Mus musculus
ggccctttctcttagttttccattg

SEQ ID NO: 616120 - DNA, 25 bp, Mus musculus
ggccctttctgaatcaaagtgcagc

SEQ ID NO: 616121 - DNA, 25 bp, Mus musculus
ggccctttctgattcaaagtgcagc

SEQ ID NO: 616122 - DNA, 25 bp, Mus musculus
ggccctttgatcagggactgaggcc

SEQ ID NO: 616123 - DNA, 25 bp, Mus musculus
ggccctttgatctgggactgaggcc

SEQ ID NO: 616124 - DNA, 25 bp, Mus musculus
ggccctttgcctagcatgtgtttaa

SEQ ID NO: 616125 - DNA, 25 bp, Mus musculus
ggccctttgccttgcatgtgtttaa

SEQ ID NO: 616126 - DNA, 25 bp, Mus musculus
ggccctttgggaattattggatctc

SEQ ID NO: 616127 - DNA, 25 bp, Mus musculus
ggccctttgggatttattggatctc

SEQ ID NO: 616128 - DNA, 25 bp, Mus musculus
ggccctttgtaaatagcttcatgct

SEQ ID NO: 616129 - DNA, 25 bp, Mus musculus
ggccctttgtaacttcatttcattt

SEQ ID NO: 616130 - DNA, 25 bp, Mus musculus
ggccctttgtaagttcatttcattt

SEQ ID NO: 616131 - DNA, 25 bp, Mus musculus
ggccctttgtaattagcttcatgct

SEQ ID NO: 616132 - DNA, 25 bp, Mus musculus
ggcccttttaaaaccagaatcgaat

SEQ ID NO: 616133 - DNA, 25 bp, Mus musculus
ggcccttttaaatccagaatcgaat

SEQ ID NO: 616134 - DNA, 25 bp, Mus musculus
ggcccttttataagatacattactt

SEQ ID NO: 616135 - DNA, 25 bp, Mus musculus
ggcccttttatatgatacattactt

SEQ ID NO: 616136 - DNA, 25 bp, Mus musculus
ggcccttttcaaagacaaatttcat

SEQ ID NO: 616137 - DNA, 25 bp, Mus musculus
ggcccttttcaatgacaaatttcat

SEQ ID NO: 616138 - DNA, 25 bp, Mus musculus
ggcccttttcgtcttcataacgaga

SEQ ID NO: 616139 - DNA, 25 bp, Mus musculus
ggcccttttcgtgttcataacgaga

SEQ ID NO: 616140 - DNA, 25 bp, Mus musculus
ggccgaaacccgaggctttgagatt

SEQ ID NO: 616141 - DNA, 25 bp, Mus musculus
ggccgaaacccgtggctttgagatt

SEQ ID NO: 616142 - DNA, 25 bp, Mus musculus
ggccgaaagccaacaactctgcaag

SEQ ID NO: 616143 - DNA, 25 bp, Mus musculus
ggccgaaagccatcaactctgcaag

SEQ ID NO: 616144 - DNA, 25 bp, Mus musculus
ggccgaaatgctcctcttcattgaa

SEQ ID NO: 616145 - DNA, 25 bp, Mus musculus
ggccgaaatgctgctcttcattgaa

SEQ ID NO: 616146 - DNA, 25 bp, Mus musculus
ggccgaacttttcatagtaaccaag

SEQ ID NO: 616147 - DNA, 25 bp, Mus musculus
ggccgaacttttgatagtaaccaag

SEQ ID NO: 616148 - DNA, 25 bp, Mus musculus
ggccgaagaattccctcatagaaag

SEQ ID NO: 616149 - DNA, 25 bp, Mus musculus
ggccgaagaattgcctcatagaaag

SEQ ID NO: 616150 - DNA, 25 bp, Mus musculus
ggccgaagacggacagcatcagcac

SEQ ID NO: 616151 - DNA, 25 bp, Mus musculus
ggccgaagacggtcagcatcagcac

SEQ ID NO: 616152 - DNA, 25 bp, Mus musculus
ggccgaagccatctcctacgtggat

SEQ ID NO: 616153 - DNA, 25 bp, Mus musculus
ggccgaagccatgtcctacgtggat

SEQ ID NO: 616154 - DNA, 25 bp, Mus musculus
ggccgaagtcaaatcatctggaaag

SEQ ID NO: 616155 - DNA, 25 bp, Mus musculus
ggccgaagtcaattcatctggaaag

SEQ ID NO: 616156 - DNA, 25 bp, Mus musculus
ggccgaatatgcctgcatccagaag

SEQ ID NO: 616157 - DNA, 25 bp, Mus musculus
ggccgaatatgcgtgcatccagaag

SEQ ID NO: 616158 - DNA, 25 bp, Mus musculus
ggccgaatatggcactatagttcta

SEQ ID NO: 616159 - DNA, 25 bp, Mus musculus
ggccgaatatgggactatagttcta

SEQ ID NO: 616160 - DNA, 25 bp, Mus musculus
ggccgaatgtaaaatcccttatgtt

SEQ ID NO: 616161 - DNA, 25 bp, Mus musculus
ggccgaatgtaatatcccttatgtt

SEQ ID NO: 616162 - DNA, 25 bp, Mus musculus
ggccgaatgtcgagtatcaggtctt

SEQ ID NO: 616163 - DNA, 25 bp, Mus musculus
ggccgaatgtcgtgtatcaggtctt

SEQ ID NO: 616164 - DNA, 25 bp, Mus musculus
ggccgaattccactctaacttattt

SEQ ID NO: 616165 - DNA, 25 bp, Mus musculus
ggccgaattccagtctaacttattt

SEQ ID NO: 616166 - DNA, 25 bp, Mus musculus
ggccgaattgcaatcttttactgga

SEQ ID NO: 616167 - DNA, 25 bp, Mus musculus
ggccgaattgcattcttttactgga

SEQ ID NO: 616168 - DNA, 25 bp, Mus musculus
ggccgacaagatacctctcgcatgt

SEQ ID NO: 616169 - DNA, 25 bp, Mus musculus
ggccgacaagattcctctcgcatgt

SEQ ID NO: 616170 - DNA, 25 bp, Mus musculus
ggccgaccatgcaactacgagagga

SEQ ID NO: 616171 - DNA, 25 bp, Mus musculus
ggccgaccatgctactacgagagga

SEQ ID NO: 616172 - DNA, 25 bp, Mus musculus
ggccgaccggatcaaggcgttttat

SEQ ID NO: 616173 - DNA, 25 bp, Mus musculus
ggccgaccggatgaaggcgttttat

SEQ ID NO: 616174 - DNA, 25 bp, Mus musculus
ggccgacgtggactgtttaactcta

SEQ ID NO: 616175 - DNA, 25 bp, Mus musculus
ggccgacgtggagtgtttaactcta

SEQ ID NO: 616176 - DNA, 25 bp, Mus musculus
ggccgactgggaattgaagaattct

SEQ ID NO: 616177 - DNA, 25 bp, Mus musculus
ggccgactgggatttgaagaattct

SEQ ID NO: 616178 - DNA, 25 bp, Mus musculus
ggccgacttaatcgttttgtgaatt

SEQ ID NO: 616179 - DNA, 25 bp, Mus musculus
ggccgacttaatggttttgtgaatt

SEQ ID NO: 616180 - DNA, 25 bp, Mus musculus
ggccgacttctaaaaggactttctg

SEQ ID NO: 616181 - DNA, 25 bp, Mus musculus
ggccgacttctataaggactttctg

SEQ ID NO: 616182 - DNA, 25 bp, Mus musculus
ggccgacttggacatcctacagcag

SEQ ID NO: 616183 - DNA, 25 bp, Mus musculus
ggccgacttggagatcctacagcag

SEQ ID NO: 616184 - DNA, 25 bp, Mus musculus
ggccgagaaaaaagcgctggactga

SEQ ID NO: 616185 - DNA, 25 bp, Mus musculus
ggccgagaaaaatgcgctggactga

SEQ ID NO: 616186 - DNA, 25 bp, Mus musculus
ggccgagaatctcatacttttcact

SEQ ID NO: 616187 - DNA, 25 bp, Mus musculus
ggccgagaatctgatacttttcact

SEQ ID NO: 616188 - DNA, 25 bp, Mus musculus
ggccgagatcgcagccaacatccag

SEQ ID NO: 616189 - DNA, 25 bp, Mus musculus
ggccgagatcgctgccaacatccag

SEQ ID NO: 616190 - DNA, 25 bp, Mus musculus
ggccgagattatcctgcgctttgaa

SEQ ID NO: 616191 - DNA, 25 bp, Mus musculus
ggccgagattatgctgcgctttgaa

SEQ ID NO: 616192 - DNA, 25 bp, Mus musculus
ggccgagcatagcagttttctggct

SEQ ID NO: 616193 - DNA, 25 bp, Mus musculus
ggccgagcataggagttttctggct

SEQ ID NO: 616194 - DNA, 25 bp, Mus musculus
ggccgagctgctatctggaaaagtg

SEQ ID NO: 616195 - DNA, 25 bp, Mus musculus
ggccgagctgctttctggaaaagtg

SEQ ID NO: 616196 - DNA, 25 bp, Mus musculus
ggccgaggacataaccgagatagga

SEQ ID NO: 616197 - DNA, 25 bp, Mus musculus
ggccgaggacattaccgagatagga

SEQ ID NO: 616198 - DNA, 25 bp, Mus musculus
ggccgaggagcacaaaaatcagaca

SEQ ID NO: 616199 - DNA, 25 bp, Mus musculus
ggccgaggagcagaaaaatcagaca

SEQ ID NO: 616200 - DNA, 25 bp, Mus musculus
ggccgaggcgctacttattgttaat

SEQ ID NO: 616201 - DNA, 25 bp, Mus musculus
ggccgaggcgcttcttattgttaat

SEQ ID NO: 616202 - DNA, 25 bp, Mus musculus
ggccgaggctggattctgtgtttac

SEQ ID NO: 616203 - DNA, 25 bp, Mus musculus
ggccgaggctggtttctgtgtttac

SEQ ID NO: 616204 - DNA, 25 bp, Mus musculus
ggccgagggcacatgctgaaaccac

SEQ ID NO: 616205 - DNA, 25 bp, Mus musculus
ggccgagggcacttgctgaaaccac

SEQ ID NO: 616206 - DNA, 25 bp, Mus musculus
ggccgaggtccgaaaccgagacctg

SEQ ID NO: 616207 - DNA, 25 bp, Mus musculus
ggccgaggtccgtaaccgagacctg

SEQ ID NO: 616208 - DNA, 25 bp, Mus musculus
ggccgagtatccaacgttaaccata

SEQ ID NO: 616209 - DNA, 25 bp, Mus musculus
ggccgagtatcctacgttaaccata

SEQ ID NO: 616210 - DNA, 25 bp, Mus musculus
ggccgagtctctccccggattctga

SEQ ID NO: 616211 - DNA, 25 bp, Mus musculus
ggccgagtctctgcccggattctga

SEQ ID NO: 616212 - DNA, 25 bp, Mus musculus
ggccgagtgggcattacagaccttt

SEQ ID NO: 616213 - DNA, 25 bp, Mus musculus
ggccgagtgggctttacagaccttt

SEQ ID NO: 616214 - DNA, 25 bp, Mus musculus
ggccgagtttgcatgcttcagtttc

SEQ ID NO: 616215 - DNA, 25 bp, Mus musculus
ggccgagtttgcttgcttcagtttc

SEQ ID NO: 616216 - DNA, 25 bp, Mus musculus
ggccgatagcatacattacctgtag

SEQ ID NO: 616217 - DNA, 25 bp, Mus musculus
ggccgatagcattcattacctgtag

SEQ ID NO: 616218 - DNA, 25 bp, Mus musculus
ggccgatcactaaattcactgccat

SEQ ID NO: 616219 - DNA, 25 bp, Mus musculus
ggccgatcactatattcactgccat

SEQ ID NO: 616220 - DNA, 25 bp, Mus musculus
ggccgatcatttagtacatcaggga

SEQ ID NO: 616221 - DNA, 25 bp, Mus musculus
ggccgatcatttatattctccagac

SEQ ID NO: 616222 - DNA, 25 bp, Mus musculus
ggccgatcattttgtacatcaggga

SEQ ID NO: 616223 - DNA, 25 bp, Mus musculus
ggccgatcatttttattctccagac

SEQ ID NO: 616224 - DNA, 25 bp, Mus musculus
ggccgatccatccgattacacacga

SEQ ID NO: 616225 - DNA, 25 bp, Mus musculus
ggccgatccatcggattacacacga

SEQ ID NO: 616226 - DNA, 25 bp, Mus musculus
ggccgatctgctctttcagcatcaa

SEQ ID NO: 616227 - DNA, 25 bp, Mus musculus
ggccgatctgctgtttcagcatcaa

SEQ ID NO: 616228 - DNA, 25 bp, Mus musculus
ggccgatgtcttacttcgtatggaa

SEQ ID NO: 616229 - DNA, 25 bp, Mus musculus
ggccgatgtctttcttcgtatggaa

SEQ ID NO: 616230 - DNA, 25 bp, Mus musculus
ggccgatttcttacctattggagaa

SEQ ID NO: 616231 - DNA, 25 bp, Mus musculus
ggccgatttctttcctattggagaa

SEQ ID NO: 616232 - DNA, 25 bp, Mus musculus
ggccgatttgttacaagtgacccag

SEQ ID NO: 616233 - DNA, 25 bp, Mus musculus
ggccgatttgtttcaagtgacccag

SEQ ID NO: 616234 - DNA, 25 bp, Mus musculus
ggccgcaaaaaacgcattccctata

SEQ ID NO: 616235 - DNA, 25 bp, Mus musculus
ggccgcaaaaaaggcattccctata

SEQ ID NO: 616236 - DNA, 25 bp, Mus musculus
ggccgcaactgccaagacattgatg

SEQ ID NO: 616237 - DNA, 25 bp, Mus musculus
ggccgcaactgcgaagacattgatg

SEQ ID NO: 616238 - DNA, 25 bp, Mus musculus
ggccgcaagctgacgcctcagggac

SEQ ID NO: 616239 - DNA, 25 bp, Mus musculus
ggccgcaagctgtcgcctcagggac

SEQ ID NO: 616240 - DNA, 25 bp, Mus musculus
ggccgcacgaccaagaagctgatca

SEQ ID NO: 616241 - DNA, 25 bp, Mus musculus
ggccgcacgacctagaagctgatca

SEQ ID NO: 616242 - DNA, 25 bp, Mus musculus
ggccgcagacatcttacagttatca

SEQ ID NO: 616243 - DNA, 25 bp, Mus musculus
ggccgcagacatgttacagttatca

SEQ ID NO: 616244 - DNA, 25 bp, Mus musculus
ggccgcagacgactttggacagatt

SEQ ID NO: 616245 - DNA, 25 bp, Mus musculus
ggccgcagacgagtttggacagatt

SEQ ID NO: 616246 - DNA, 25 bp, Mus musculus
ggccgcagagctattgcttatgcta

SEQ ID NO: 616247 - DNA, 25 bp, Mus musculus
ggccgcagagcttttgcttatgcta

SEQ ID NO: 616248 - DNA, 25 bp, Mus musculus
ggccgcagagtgagagcatctttct

SEQ ID NO: 616249 - DNA, 25 bp, Mus musculus
ggccgcagagtgtgagcatctttct

SEQ ID NO: 616250 - DNA, 25 bp, Mus musculus
ggccgcagatagaccagtgctgtga

SEQ ID NO: 616251 - DNA, 25 bp, Mus musculus
ggccgcagatagtccagtgctgtga

SEQ ID NO: 616252 - DNA, 25 bp, Mus musculus
ggccgcagatggacagctgcacaca

SEQ ID NO: 616253 - DNA, 25 bp, Mus musculus
ggccgcagatggtcagctgcacaca

SEQ ID NO: 616254 - DNA, 25 bp, Mus musculus
ggccgcaggtctccctgagcttagc

SEQ ID NO: 616255 - DNA, 25 bp, Mus musculus
ggccgcaggtctgcctgagcttagc

SEQ ID NO: 616256 - DNA, 25 bp, Mus musculus
ggccgcagtgacaacctgccaggaa

SEQ ID NO: 616257 - DNA, 25 bp, Mus musculus
ggccgcagtgactacctgccaggaa

SEQ ID NO: 616258 - DNA, 25 bp, Mus musculus
ggccgcagtggccaaaactttgaca

SEQ ID NO: 616259 - DNA, 25 bp, Mus musculus
ggccgcagtggcgaaaactttgaca

SEQ ID NO: 616260 - DNA, 25 bp, Mus musculus
ggccgcatctggactgaggttttaa

SEQ ID NO: 616261 - DNA, 25 bp, Mus musculus
ggccgcatctggtctgaggttttaa

SEQ ID NO: 616262 - DNA, 25 bp, Mus musculus
ggccgcatgggcatcgtacacaact

SEQ ID NO: 616263 - DNA, 25 bp, Mus musculus
ggccgcatgggcttcgtacacaact

SEQ ID NO: 616264 - DNA, 25 bp, Mus musculus
ggccgcatgttcaaacagttcaaca

SEQ ID NO: 616265 - DNA, 25 bp, Mus musculus
ggccgcatgttctaacagttcaaca

SEQ ID NO: 616266 - DNA, 25 bp, Mus musculus
ggccgccaaggacctgagaagaaca

SEQ ID NO: 616267 - DNA, 25 bp, Mus musculus
ggccgccaaggagctgagaagaaca

SEQ ID NO: 616268 - DNA, 25 bp, Mus musculus
ggccgccataggatgctgactgcat

SEQ ID NO: 616269 - DNA, 25 bp, Mus musculus
ggccgccataggttgctgactgcat

SEQ ID NO: 616270 - DNA, 25 bp, Mus musculus
ggccgccatgacaccggaagccgga

SEQ ID NO: 616271 - DNA, 25 bp, Mus musculus
ggccgccatgactccggaagccgga

SEQ ID NO: 616272 - DNA, 25 bp, Mus musculus
ggccgccatgcaaaatgacctcaaa

SEQ ID NO: 616273 - DNA, 25 bp, Mus musculus
ggccgccatgcataatgacctcaaa

SEQ ID NO: 616274 - DNA, 25 bp, Mus musculus
ggccgccccaacaagagagtgccag

SEQ ID NO: 616275 - DNA, 25 bp, Mus musculus
ggccgccccaactagagagtgccag

SEQ ID NO: 616276 - DNA, 25 bp, Mus musculus
ggccgccctgtcaaagactactttt

SEQ ID NO: 616277 - DNA, 25 bp, Mus musculus
ggccgccctgtctaagactactttt

SEQ ID NO: 616278 - DNA, 25 bp, Mus musculus
ggccgccctgtgaagagctgaagtt

SEQ ID NO: 616279 - DNA, 25 bp, Mus musculus
ggccgccctgtgtagagctgaagtt

SEQ ID NO: 616280 - DNA, 25 bp, Mus musculus
ggccgcccttgccagagttgaagca

SEQ ID NO: 616281 - DNA, 25 bp, Mus musculus
ggccgcccttgcgagagttgaagca

SEQ ID NO: 616282 - DNA, 25 bp, Mus musculus
ggccgccgcggaacacatagttgtg

SEQ ID NO: 616283 - DNA, 25 bp, Mus musculus
ggccgccgcggatcacatagttgtg

SEQ ID NO: 616284 - DNA, 25 bp, Mus musculus
ggccgccgtggactgtgcttataac

SEQ ID NO: 616285 - DNA, 25 bp, Mus musculus
ggccgccgtggagtgtgcttataac

SEQ ID NO: 616286 - DNA, 25 bp, Mus musculus
ggccgcctgcttactgactaccggg

SEQ ID NO: 616287 - DNA, 25 bp, Mus musculus
ggccgcctgctttctgactaccggg

SEQ ID NO: 616288 - DNA, 25 bp, Mus musculus
ggccgccttgaccttggctatgtgt

SEQ ID NO: 616289 - DNA, 25 bp, Mus musculus
ggccgccttgacgttggctatgtgt

SEQ ID NO: 616290 - DNA, 25 bp, Mus musculus
ggccgccttgctatcatctggttgt

SEQ ID NO: 616291 - DNA, 25 bp, Mus musculus
ggccgccttgctttcatctggttgt

SEQ ID NO: 616292 - DNA, 25 bp, Mus musculus
ggccgcctttcaaaatcacattcga

SEQ ID NO: 616293 - DNA, 25 bp, Mus musculus
ggccgcctttcataatcacattcga

SEQ ID NO: 616294 - DNA, 25 bp, Mus musculus
ggccgcgagagaccctttcgacaat

SEQ ID NO: 616295 - DNA, 25 bp, Mus musculus
ggccgcgagagagcctttcgacaat

SEQ ID NO: 616296 - DNA, 25 bp, Mus musculus
ggccgcgagtctcaagatttcctat

SEQ ID NO: 616297 - DNA, 25 bp, Mus musculus
ggccgcgagtctgaagatttcctat

SEQ ID NO: 616298 - DNA, 25 bp, Mus musculus
ggccgcgatgtgagtctttgttcaa

SEQ ID NO: 616299 - DNA, 25 bp, Mus musculus
ggccgcgatgtgtgtctttgttcaa

SEQ ID NO: 616300 - DNA, 25 bp, Mus musculus
ggccgcgccaggaattcctgcagaa

SEQ ID NO: 616301 - DNA, 25 bp, Mus musculus
ggccgcgccaggtattcctgcagaa

SEQ ID NO: 616302 - DNA, 25 bp, Mus musculus
ggccgcggttgccatgacgccgggt

SEQ ID NO: 616303 - DNA, 25 bp, Mus musculus
ggccgcggttgcgatgacgccgggt

SEQ ID NO: 616304 - DNA, 25 bp, Mus musculus
ggccgcgtacataccattcggagag

SEQ ID NO: 616305 - DNA, 25 bp, Mus musculus
ggccgcgtacattccattcggagag

SEQ ID NO: 616306 - DNA, 25 bp, Mus musculus
ggccgcgtctttctgcatattgtac

SEQ ID NO: 616307 - DNA, 25 bp, Mus musculus
ggccgcgtctttgtgcatattgtac

SEQ ID NO: 616308 - DNA, 25 bp, Mus musculus
ggccgcgttgatcagcgcactagct

SEQ ID NO: 616309 - DNA, 25 bp, Mus musculus
ggccgcgttgatgagcgcactagct

SEQ ID NO: 616310 - DNA, 25 bp, Mus musculus
ggccgctaatatataaccatctacc

SEQ ID NO: 616311 - DNA, 25 bp, Mus musculus
ggccgctaatatttaaccatctacc

SEQ ID NO: 616312 - DNA, 25 bp, Mus musculus
ggccgctaatggagttcaacgtcaa

SEQ ID NO: 616313 - DNA, 25 bp, Mus musculus
ggccgctaatggtgttcaacgtcaa

SEQ ID NO: 616314 - DNA, 25 bp, Mus musculus
ggccgctatgaccagtaccgaggct

SEQ ID NO: 616315 - DNA, 25 bp, Mus musculus
ggccgctatgacgagtaccgaggct

SEQ ID NO: 616316 - DNA, 25 bp, Mus musculus
ggccgctcactcattcaggactgga

SEQ ID NO: 616317 - DNA, 25 bp, Mus musculus
ggccgctcactctttcaggactgga

SEQ ID NO: 616318 - DNA, 25 bp, Mus musculus
ggccgctcagacagcaggtaagtga

SEQ ID NO: 616319 - DNA, 25 bp, Mus musculus
ggccgctcagactgcaggtaagtga

SEQ ID NO: 616320 - DNA, 25 bp, Mus musculus
ggccgctgctgcatattttgcacaa

SEQ ID NO: 616321 - DNA, 25 bp, Mus musculus
ggccgctgctgcttattttgcacaa

SEQ ID NO: 616322 - DNA, 25 bp, Mus musculus
ggccgctggataaagcctctcagaa

SEQ ID NO: 616323 - DNA, 25 bp, Mus musculus
ggccgctggatatagcctctcagaa

SEQ ID NO: 616324 - DNA, 25 bp, Mus musculus
ggccgctggtaaatttattgacaag

SEQ ID NO: 616325 - DNA, 25 bp, Mus musculus
ggccgctggtaattttattgacaag

SEQ ID NO: 616326 - DNA, 25 bp, Mus musculus
ggccgctgtgttaaggtttctaata

SEQ ID NO: 616327 - DNA, 25 bp, Mus musculus
ggccgctgtgtttaggtttctaata

SEQ ID NO: 616328 - DNA, 25 bp, Mus musculus
ggccgcttacagcagtctaatgaga

SEQ ID NO: 616329 - DNA, 25 bp, Mus musculus
ggccgcttacaggagtctaatgaga

SEQ ID NO: 616330 - DNA, 25 bp, Mus musculus
ggccgcttgacccaaggtagagtta

SEQ ID NO: 616331 - DNA, 25 bp, Mus musculus
ggccgcttgaccgaaggtagagtta

SEQ ID NO: 616332 - DNA, 25 bp, Mus musculus
ggccgcttgtttagtctagtgctgc

SEQ ID NO: 616333 - DNA, 25 bp, Mus musculus
ggccgcttgttttgtctagtgctgc

SEQ ID NO: 616334 - DNA, 25 bp, Mus musculus
ggccgctttcccaaagcagtagaga

SEQ ID NO: 616335 - DNA, 25 bp, Mus musculus
ggccgctttccctaagcagtagaga

SEQ ID NO: 616336 - DNA, 25 bp, Mus musculus
ggccggaactgccatagtttagaat

SEQ ID NO: 616337 - DNA, 25 bp, Mus musculus
ggccggaactgcgatagtttagaat

SEQ ID NO: 616338 - DNA, 25 bp, Mus musculus
ggccggaagcccagtctccatggtt

SEQ ID NO: 616339 - DNA, 25 bp, Mus musculus
ggccggaagccctgtctccatggtt

SEQ ID NO: 616340 - DNA, 25 bp, Mus musculus
ggccggaagtaacgcgacgccactt

SEQ ID NO: 616341 - DNA, 25 bp, Mus musculus
ggccggaagtaaggcgacgccactt

SEQ ID NO: 616342 - DNA, 25 bp, Mus musculus
ggccggacaaacaagagctagataa

SEQ ID NO: 616343 - DNA, 25 bp, Mus musculus
ggccggacaaactagagctagataa

SEQ ID NO: 616344 - DNA, 25 bp, Mus musculus
ggccggacccaacatgaaaacccag

SEQ ID NO: 616345 - DNA, 25 bp, Mus musculus
ggccggacccaagatgaaaacccag

SEQ ID NO: 616346 - DNA, 25 bp, Mus musculus
ggccggacgctactccggacgcaaa

SEQ ID NO: 616347 - DNA, 25 bp, Mus musculus
ggccggacgctagtccggacgcaaa

SEQ ID NO: 616348 - DNA, 25 bp, Mus musculus
ggccggacgggcaagtacctagctt

SEQ ID NO: 616349 - DNA, 25 bp, Mus musculus
ggccggacgggctagtacctagctt

SEQ ID NO: 616350 - DNA, 25 bp, Mus musculus
ggccggactcgccattgcgctcatt

SEQ ID NO: 616351 - DNA, 25 bp, Mus musculus
ggccggactcgcgattgcgctcatt

SEQ ID NO: 616352 - DNA, 25 bp, Mus musculus
ggccggagcctaaccactaagggag

SEQ ID NO: 616353 - DNA, 25 bp, Mus musculus
ggccggagcctatccactaagggag

SEQ ID NO: 616354 - DNA, 25 bp, Mus musculus
ggccggatccaacttcctgaggaga

SEQ ID NO: 616355 - DNA, 25 bp, Mus musculus
ggccggatccaagttcctgaggaga

SEQ ID NO: 616356 - DNA, 25 bp, Mus musculus
ggccggatcttcataggtcctgaaa

SEQ ID NO: 616357 - DNA, 25 bp, Mus musculus
ggccggatcttcttaggtcctgaaa

SEQ ID NO: 616358 - DNA, 25 bp, Mus musculus
ggccggcaaacgcttgctgcctcag

SEQ ID NO: 616359 - DNA, 25 bp, Mus musculus
ggccggcaaacggttgctgcctcag

SEQ ID NO: 616360 - DNA, 25 bp, Mus musculus
ggccggcacagacccaatgatggtt

SEQ ID NO: 616361 - DNA, 25 bp, Mus musculus
ggccggcacagagccaatgatggtt

SEQ ID NO: 616362 - DNA, 25 bp, Mus musculus
ggccggcacttgaacttttgagtgg

SEQ ID NO: 616363 - DNA, 25 bp, Mus musculus
ggccggcacttgtacttttgagtgg

SEQ ID NO: 616364 - DNA, 25 bp, Mus musculus
ggccggcagggcagcatccagtctc

SEQ ID NO: 616365 - DNA, 25 bp, Mus musculus
ggccggcagggctgcatccagtctc

SEQ ID NO: 616366 - DNA, 25 bp, Mus musculus
ggccggcagtaaacaccaggttaat

SEQ ID NO: 616367 - DNA, 25 bp, Mus musculus
ggccggcagtaatcaccaggttaat

SEQ ID NO: 616368 - DNA, 25 bp, Mus musculus
ggccggcatacacacattccagagg

SEQ ID NO: 616369 - DNA, 25 bp, Mus musculus
ggccggcatacagacattccagagg

SEQ ID NO: 616370 - DNA, 25 bp, Mus musculus
ggccggcatcagatcgtttgtataa

SEQ ID NO: 616371 - DNA, 25 bp, Mus musculus
ggccggcatcagttcgtttgtataa

SEQ ID NO: 616372 - DNA, 25 bp, Mus musculus
ggccggccctgacgaggcgctgagc

SEQ ID NO: 616373 - DNA, 25 bp, Mus musculus
ggccggccctgaggaggcgctgagc

SEQ ID NO: 616374 - DNA, 25 bp, Mus musculus
ggccggcctctgataaacctgtgga

SEQ ID NO: 616375 - DNA, 25 bp, Mus musculus
ggccggcctctgttaaacctgtgga

SEQ ID NO: 616376 - DNA, 25 bp, Mus musculus
ggccggcgctctagcaaggatttgc

SEQ ID NO: 616377 - DNA, 25 bp, Mus musculus
ggccggcgctcttgcaaggatttgc

SEQ ID NO: 616378 - DNA, 25 bp, Mus musculus
ggccggctagctccagactatttta

SEQ ID NO: 616379 - DNA, 25 bp, Mus musculus
ggccggctagctgcagactatttta

SEQ ID NO: 616380 - DNA, 25 bp, Mus musculus
ggccgggacaaaacgcttagctcga

SEQ ID NO: 616381 - DNA, 25 bp, Mus musculus
ggccgggacaaatcgcttagctcga

SEQ ID NO: 616382 - DNA, 25 bp, Mus musculus
ggccgggactacaggaagtttgaca

SEQ ID NO: 616383 - DNA, 25 bp, Mus musculus
ggccgggactactggaagtttgaca

SEQ ID NO: 616384 - DNA, 25 bp, Mus musculus
ggccgggatcgacaattctatcaaa

SEQ ID NO: 616385 - DNA, 25 bp, Mus musculus
ggccgggatcgagaattctatcaaa

SEQ ID NO: 616386 - DNA, 25 bp, Mus musculus
ggccgggcagggatacttgctttca

SEQ ID NO: 616387 - DNA, 25 bp, Mus musculus
ggccgggcagggttacttgctttca

SEQ ID NO: 616388 - DNA, 25 bp, Mus musculus
ggccgggctcttagcacagttctaa

SEQ ID NO: 616389 - DNA, 25 bp, Mus musculus
ggccgggctctttgcacagttctaa

SEQ ID NO: 616390 - DNA, 25 bp, Mus musculus
ggccggtcaagcaggttcgagttca

SEQ ID NO: 616391 - DNA, 25 bp, Mus musculus
ggccggtcaagctggttcgagttca

SEQ ID NO: 616392 - DNA, 25 bp, Mus musculus
ggccggtccttcatgtacaattatg

SEQ ID NO: 616393 - DNA, 25 bp, Mus musculus
ggccggtccttcttgtacaattatg

SEQ ID NO: 616394 - DNA, 25 bp, Mus musculus
ggccggtgaaccagtttgactatca

SEQ ID NO: 616395 - DNA, 25 bp, Mus musculus
ggccggtgaacctgtttgactatca

SEQ ID NO: 616396 - DNA, 25 bp, Mus musculus
ggccggtgacaaaagcactctgctg

SEQ ID NO: 616397 - DNA, 25 bp, Mus musculus
ggccggtgacaatagcactctgctg

SEQ ID NO: 616398 - DNA, 25 bp, Mus musculus
ggccggttttgtcttagcagcggaa

SEQ ID NO: 616399 - DNA, 25 bp, Mus musculus
ggccggttttgtgttagcagcggaa

SEQ ID NO: 616400 - DNA, 25 bp, Mus musculus
ggccgtacagtaaggacctgctgat

SEQ ID NO: 616401 - DNA, 25 bp, Mus musculus
ggccgtacagtatggacctgctgat

SEQ ID NO: 616402 - DNA, 25 bp, Mus musculus
ggccgtaggcgaagagccaccagat

SEQ ID NO: 616403 - DNA, 25 bp, Mus musculus
ggccgtaggcgatgagccaccagat

SEQ ID NO: 616404 - DNA, 25 bp, Mus musculus
ggccgtatatatccagtaattccta

SEQ ID NO: 616405 - DNA, 25 bp, Mus musculus
ggccgtatatatgcagtaattccta

SEQ ID NO: 616406 - DNA, 25 bp, Mus musculus
ggccgtatgtaacctcagccaccaa

SEQ ID NO: 616407 - DNA, 25 bp, Mus musculus
ggccgtatgtaagctcagccaccaa

SEQ ID NO: 616408 - DNA, 25 bp, Mus musculus
ggccgtcatacgagaacctcatgag

SEQ ID NO: 616409 - DNA, 25 bp, Mus musculus
ggccgtcatacgtgaacctcatgag

SEQ ID NO: 616410 - DNA, 25 bp, Mus musculus
ggccgtcatctacccattgtgaagg

SEQ ID NO: 616411 - DNA, 25 bp, Mus musculus
ggccgtcatctagccattgtgaagg

SEQ ID NO: 616412 - DNA, 25 bp, Mus musculus
ggccgtcatctcaatatctctaaga

SEQ ID NO: 616413 - DNA, 25 bp, Mus musculus
ggccgtcatctctatatctctaaga

SEQ ID NO: 616414 - DNA, 25 bp, Mus musculus
ggccgtcattaacccttactggaca

SEQ ID NO: 616415 - DNA, 25 bp, Mus musculus
ggccgtcattaagccttactggaca

SEQ ID NO: 616416 - DNA, 25 bp, Mus musculus
ggccgtcggtttactgagggaacat

SEQ ID NO: 616417 - DNA, 25 bp, Mus musculus
ggccgtcggttttctgagggaacat

SEQ ID NO: 616418 - DNA, 25 bp, Mus musculus
ggccgtgacggcatggcaataagaa

SEQ ID NO: 616419 - DNA, 25 bp, Mus musculus
ggccgtgacggcttggcaataagaa

SEQ ID NO: 616420 - DNA, 25 bp, Mus musculus
ggccgtgacttaactaaacatcttg

SEQ ID NO: 616421 - DNA, 25 bp, Mus musculus
ggccgtgacttactctcatggttaa

SEQ ID NO: 616422 - DNA, 25 bp, Mus musculus
ggccgtgacttagtctcatggttaa

SEQ ID NO: 616423 - DNA, 25 bp, Mus musculus
ggccgtgacttatctaaacatcttg

SEQ ID NO: 616424 - DNA, 25 bp, Mus musculus
ggccgtgagacgacttgctttaaac

SEQ ID NO: 616425 - DNA, 25 bp, Mus musculus
ggccgtgagacgtcttgctttaaac

SEQ ID NO: 616426 - DNA, 25 bp, Mus musculus
ggccgtgattgtcttgctctttgca

SEQ ID NO: 616427 - DNA, 25 bp, Mus musculus
ggccgtgattgtgttgctctttgca

SEQ ID NO: 616428 - DNA, 25 bp, Mus musculus
ggccgtgcactcatccaggatgtgc

SEQ ID NO: 616429 - DNA, 25 bp, Mus musculus
ggccgtgcactcttccaggatgtgc

SEQ ID NO: 616430 - DNA, 25 bp, Mus musculus
ggccgtgcccatctgtacttggaaa

SEQ ID NO: 616431 - DNA, 25 bp, Mus musculus
ggccgtgcccatgtgtacttggaaa

SEQ ID NO: 616432 - DNA, 25 bp, Mus musculus
ggccgtgcgacaattcccgaattct

SEQ ID NO: 616433 - DNA, 25 bp, Mus musculus
ggccgtgcgacatttcccgaattct

SEQ ID NO: 616434 - DNA, 25 bp, Mus musculus
ggccgtgcgtacatcgtcaccaagg

SEQ ID NO: 616435 - DNA, 25 bp, Mus musculus
ggccgtgcgtacttcgtcaccaagg

SEQ ID NO: 616436 - DNA, 25 bp, Mus musculus
ggccgtgggcatcgctatctacaat

SEQ ID NO: 616437 - DNA, 25 bp, Mus musculus
ggccgtgggcatggctatctacaat

SEQ ID NO: 616438 - DNA, 25 bp, Mus musculus
ggccgtgggcgtctcaatgcacatt

SEQ ID NO: 616439 - DNA, 25 bp, Mus musculus
ggccgtgggcgtgtcaatgcacatt

SEQ ID NO: 616440 - DNA, 25 bp, Mus musculus
ggccgtggtccaaaacactattcag

SEQ ID NO: 616441 - DNA, 25 bp, Mus musculus
ggccgtggtccataacactattcag

SEQ ID NO: 616442 - DNA, 25 bp, Mus musculus
ggccgtggtgccaggatagccatta

SEQ ID NO: 616443 - DNA, 25 bp, Mus musculus
ggccgtggtgcctggatagccatta

SEQ ID NO: 616444 - DNA, 25 bp, Mus musculus
ggccgtgtaagccacaacttgaaca

SEQ ID NO: 616445 - DNA, 25 bp, Mus musculus
ggccgtgtaagcgacaacttgaaca

SEQ ID NO: 616446 - DNA, 25 bp, Mus musculus
ggccgtgtcagtctagattctaaac

SEQ ID NO: 616447 - DNA, 25 bp, Mus musculus
ggccgtgtcagtgtagattctaaac

SEQ ID NO: 616448 - DNA, 25 bp, Mus musculus
ggccgtgtctgcaatctcagggcgt

SEQ ID NO: 616449 - DNA, 25 bp, Mus musculus
ggccgtgtctgctatctcagggcgt

SEQ ID NO: 616450 - DNA, 25 bp, Mus musculus
ggccgtgtgcttccttgaaaattct

SEQ ID NO: 616451 - DNA, 25 bp, Mus musculus
ggccgtgtgcttgcttgaaaattct

SEQ ID NO: 616452 - DNA, 25 bp, Mus musculus
ggccgtgtggaacaacatggtcttt

SEQ ID NO: 616453 - DNA, 25 bp, Mus musculus
ggccgtgtggaagaacatggtcttt

SEQ ID NO: 616454 - DNA, 25 bp, Mus musculus
ggccgttaacagatacacaggagtg

SEQ ID NO: 616455 - DNA, 25 bp, Mus musculus
ggccgttaacagttacacaggagtg

SEQ ID NO: 616456 - DNA, 25 bp, Mus musculus
ggccgttaattccaagcgccgcgaa

SEQ ID NO: 616457 - DNA, 25 bp, Mus musculus
ggccgttaattcgaagcgccgcgaa

SEQ ID NO: 616458 - DNA, 25 bp, Mus musculus
ggccgttataaaaatccttcgactg

SEQ ID NO: 616459 - DNA, 25 bp, Mus musculus
ggccgttataaatatccttcgactg

SEQ ID NO: 616460 - DNA, 25 bp, Mus musculus
ggccgttatgatcagctggctcata

SEQ ID NO: 616461 - DNA, 25 bp, Mus musculus
ggccgttatgatgagctggctcata

SEQ ID NO: 616462 - DNA, 25 bp, Mus musculus
ggccgttcaggtacagcgtgaccga

SEQ ID NO: 616463 - DNA, 25 bp, Mus musculus
ggccgttcaggttcagcgtgaccga

SEQ ID NO: 616464 - DNA, 25 bp, Mus musculus
ggccgttctatactgagctgtacac

SEQ ID NO: 616465 - DNA, 25 bp, Mus musculus
ggccgttctatagtgagctgtacac

SEQ ID NO: 616466 - DNA, 25 bp, Mus musculus
ggccgttgtctcagaagcccaacaa

SEQ ID NO: 616467 - DNA, 25 bp, Mus musculus
ggccgttgtctctgaagcccaacaa

SEQ ID NO: 616468 - DNA, 25 bp, Mus musculus
ggccgtttaactcgcagctgctcca

SEQ ID NO: 616469 - DNA, 25 bp, Mus musculus
ggccgtttaactggcagctgctcca

SEQ ID NO: 616470 - DNA, 25 bp, Mus musculus
ggccgtttgatgatggagctccacc

SEQ ID NO: 616471 - DNA, 25 bp, Mus musculus
ggccgtttgatgcacttcttggctt

SEQ ID NO: 616472 - DNA, 25 bp, Mus musculus
ggccgtttgatggacttcttggctt

SEQ ID NO: 616473 - DNA, 25 bp, Mus musculus
ggccgtttgatgttggagctccacc

SEQ ID NO: 616474 - DNA, 25 bp, Mus musculus
ggcctaaaatcacatgcctttcgga

SEQ ID NO: 616475 - DNA, 25 bp, Mus musculus
ggcctaaaatcagatgcctttcgga

SEQ ID NO: 616476 - DNA, 25 bp, Mus musculus
ggcctaaagactcccctcaatagtt

SEQ ID NO: 616477 - DNA, 25 bp, Mus musculus
ggcctaaagactgccctcaatagtt

SEQ ID NO: 616478 - DNA, 25 bp, Mus musculus
ggcctaacagccagactttcaatgt

SEQ ID NO: 616479 - DNA, 25 bp, Mus musculus
ggcctaacagcctgactttcaatgt

SEQ ID NO: 616480 - DNA, 25 bp, Mus musculus
ggcctaaccaacaagtgtctttcct

SEQ ID NO: 616481 - DNA, 25 bp, Mus musculus
ggcctaaccaactagtgtctttcct

SEQ ID NO: 616482 - DNA, 25 bp, Mus musculus
ggcctaactctgacctgaccgttct

SEQ ID NO: 616483 - DNA, 25 bp, Mus musculus
ggcctaactctgtcctgaccgttct

SEQ ID NO: 616484 - DNA, 25 bp, Mus musculus
ggcctaagccacacctgttattgaa

SEQ ID NO: 616485 - DNA, 25 bp, Mus musculus
ggcctaagccactcctgttattgaa

SEQ ID NO: 616486 - DNA, 25 bp, Mus musculus
ggcctaagcggcctgtcctcaaaag

SEQ ID NO: 616487 - DNA, 25 bp, Mus musculus
ggcctaagcggcgtgtcctcaaaag

SEQ ID NO: 616488 - DNA, 25 bp, Mus musculus
ggcctaagcttaaacattccactcg

SEQ ID NO: 616489 - DNA, 25 bp, Mus musculus
ggcctaagcttatacattccactcg

SEQ ID NO: 616490 - DNA, 25 bp, Mus musculus
ggcctaaggatgattgacagagaaa

SEQ ID NO: 616491 - DNA, 25 bp, Mus musculus
ggcctaaggatgtttgacagagaaa

SEQ ID NO: 616492 - DNA, 25 bp, Mus musculus
ggcctaattttgaaggtctccaatt

SEQ ID NO: 616493 - DNA, 25 bp, Mus musculus
ggcctaattttgtaggtctccaatt

SEQ ID NO: 616494 - DNA, 25 bp, Mus musculus
ggcctacaacccataacctagagcg

SEQ ID NO: 616495 - DNA, 25 bp, Mus musculus
ggcctacaacccttaacctagagcg

SEQ ID NO: 616496 - DNA, 25 bp, Mus musculus
ggcctacaagccatagatcttgtgt

SEQ ID NO: 616497 - DNA, 25 bp, Mus musculus
ggcctacaagccttagatcttgtgt

SEQ ID NO: 616498 - DNA, 25 bp, Mus musculus
ggcctacaaggacagcaattatagc

SEQ ID NO: 616499 - DNA, 25 bp, Mus musculus
ggcctacaaggagagcaattatagc

SEQ ID NO: 616500 - DNA, 25 bp, Mus musculus
ggcctacaaggtcgagcatctcatc

SEQ ID NO: 616501 - DNA, 25 bp, Mus musculus
ggcctacaaggtggagcatctcatc

SEQ ID NO: 616502 - DNA, 25 bp, Mus musculus
ggcctacaagtaatgaggctccctc

SEQ ID NO: 616503 - DNA, 25 bp, Mus musculus
ggcctacaagtattgaggctccctc

SEQ ID NO: 616504 - DNA, 25 bp, Mus musculus
ggcctacacgccactagatgagaaa

SEQ ID NO: 616505 - DNA, 25 bp, Mus musculus
ggcctacacgcctctagatgagaaa

SEQ ID NO: 616506 - DNA, 25 bp, Mus musculus
ggcctacacggactagagaccagca

SEQ ID NO: 616507 - DNA, 25 bp, Mus musculus
ggcctacacggagtagagaccagca

SEQ ID NO: 616508 - DNA, 25 bp, Mus musculus
ggcctacagactctttttgcagtat

SEQ ID NO: 616509 - DNA, 25 bp, Mus musculus
ggcctacagactgtttttgcagtat

SEQ ID NO: 616510 - DNA, 25 bp, Mus musculus
ggcctaccacttacagaagttgaat

SEQ ID NO: 616511 - DNA, 25 bp, Mus musculus
ggcctaccactttcagaagttgaat

SEQ ID NO: 616512 - DNA, 25 bp, Mus musculus
ggcctaccagcgcttcatgacagaa

SEQ ID NO: 616513 - DNA, 25 bp, Mus musculus
ggcctaccagcggttcatgacagaa

SEQ ID NO: 616514 - DNA, 25 bp, Mus musculus
ggcctaccctggaatgaggttgtct

SEQ ID NO: 616515 - DNA, 25 bp, Mus musculus
ggcctaccctggtatgaggttgtct

SEQ ID NO: 616516 - DNA, 25 bp, Mus musculus
ggcctacctgacagcctcggtgtgg

SEQ ID NO: 616517 - DNA, 25 bp, Mus musculus
ggcctacctgactgcctcggtgtgg

SEQ ID NO: 616518 - DNA, 25 bp, Mus musculus
ggcctacgaggtcttatcggacgtc

SEQ ID NO: 616519 - DNA, 25 bp, Mus musculus
ggcctacgaggtgttatcggacgtc

SEQ ID NO: 616520 - DNA, 25 bp, Mus musculus
ggcctacggtctaaccatgagacta

SEQ ID NO: 616521 - DNA, 25 bp, Mus musculus
ggcctacggtcttaccatgagacta

SEQ ID NO: 616522 - DNA, 25 bp, Mus musculus
ggcctactatccaagagagcagcaa

SEQ ID NO: 616523 - DNA, 25 bp, Mus musculus
ggcctactatcctagagagcagcaa

SEQ ID NO: 616524 - DNA, 25 bp, Mus musculus
ggcctactgcagagatgctggacat

SEQ ID NO: 616525 - DNA, 25 bp, Mus musculus
ggcctactgcagtgatgctggacat

SEQ ID NO: 616526 - DNA, 25 bp, Mus musculus
ggcctactgttaaagccctgagtga

SEQ ID NO: 616527 - DNA, 25 bp, Mus musculus
ggcctactgttatagccctgagtga

SEQ ID NO: 616528 - DNA, 25 bp, Mus musculus
ggcctagaaataacgtgtgtcctca

SEQ ID NO: 616529 - DNA, 25 bp, Mus musculus
ggcctagaaatatcgtgtgtcctca

SEQ ID NO: 616530 - DNA, 25 bp, Mus musculus
ggcctagaagtaaaagagggcacaa

SEQ ID NO: 616531 - DNA, 25 bp, Mus musculus
ggcctagaagtataagagggcacaa

SEQ ID NO: 616532 - DNA, 25 bp, Mus musculus
ggcctagacaccacaagatgtaatt

SEQ ID NO: 616533 - DNA, 25 bp, Mus musculus
ggcctagacacctcaagatgtaatt

SEQ ID NO: 616534 - DNA, 25 bp, Mus musculus
ggcctagaccttcatgtttagaatt

SEQ ID NO: 616535 - DNA, 25 bp, Mus musculus
ggcctagaccttgatgtttagaatt

SEQ ID NO: 616536 - DNA, 25 bp, Mus musculus
ggcctagacgtgctcccgatgaaga

SEQ ID NO: 616537 - DNA, 25 bp, Mus musculus
ggcctagacgtggtcccgatgaaga

SEQ ID NO: 616538 - DNA, 25 bp, Mus musculus
ggcctagagaccatggtggacttcc

SEQ ID NO: 616539 - DNA, 25 bp, Mus musculus
ggcctagagaccttggtggacttcc

SEQ ID NO: 616540 - DNA, 25 bp, Mus musculus
ggcctagagacgatgacccatttaa

SEQ ID NO: 616541 - DNA, 25 bp, Mus musculus
ggcctagagacgttgacccatttaa

SEQ ID NO: 616542 - DNA, 25 bp, Mus musculus
ggcctagagagactgttactgtgat

SEQ ID NO: 616543 - DNA, 25 bp, Mus musculus
ggcctagagagagtgttactgtgat

SEQ ID NO: 616544 - DNA, 25 bp, Mus musculus
ggcctagagctcaggttctcatgta

SEQ ID NO: 616545 - DNA, 25 bp, Mus musculus
ggcctagagctctggttctcatgta

SEQ ID NO: 616546 - DNA, 25 bp, Mus musculus
ggcctagattcaattcctccaagaa

SEQ ID NO: 616547 - DNA, 25 bp, Mus musculus
ggcctagattcatttcctccaagaa

SEQ ID NO: 616548 - DNA, 25 bp, Mus musculus
ggcctagcacagagaacagcttcga

SEQ ID NO: 616549 - DNA, 25 bp, Mus musculus
ggcctagcacagtgaacagcttcga

SEQ ID NO: 616550 - DNA, 25 bp, Mus musculus
ggcctagcacgcagtgtggccgcca

SEQ ID NO: 616551 - DNA, 25 bp, Mus musculus
ggcctagcacgctgtgtggccgcca

SEQ ID NO: 616552 - DNA, 25 bp, Mus musculus
ggcctagcacgtcgcatacgcgaaa

SEQ ID NO: 616553 - DNA, 25 bp, Mus musculus
ggcctagcacgtggcatacgcgaaa

SEQ ID NO: 616554 - DNA, 25 bp, Mus musculus
ggcctagccagaagattttcagact

SEQ ID NO: 616555 - DNA, 25 bp, Mus musculus
ggcctagccagatgattttcagact

SEQ ID NO: 616556 - DNA, 25 bp, Mus musculus
ggcctagcctatacccagaggcaga

SEQ ID NO: 616557 - DNA, 25 bp, Mus musculus
ggcctagcctattcccagaggcaga

SEQ ID NO: 616558 - DNA, 25 bp, Mus musculus
ggcctagccttcctggatgaagttt

SEQ ID NO: 616559 - DNA, 25 bp, Mus musculus
ggcctagccttcgtggatgaagttt

SEQ ID NO: 616560 - DNA, 25 bp, Mus musculus
ggcctagcttaaccatatgagacct

SEQ ID NO: 616561 - DNA, 25 bp, Mus musculus
ggcctagcttaagcatatgagacct

SEQ ID NO: 616562 - DNA, 25 bp, Mus musculus
ggcctaggacaaccctcagcatgga

SEQ ID NO: 616563 - DNA, 25 bp, Mus musculus
ggcctaggacaagcctcagcatgga

SEQ ID NO: 616564 - DNA, 25 bp, Mus musculus
ggcctaggagacctgaacctcgctt

SEQ ID NO: 616565 - DNA, 25 bp, Mus musculus
ggcctaggagacgtgaacctcgctt

SEQ ID NO: 616566 - DNA, 25 bp, Mus musculus
ggcctaggagtgacattacgggtac

SEQ ID NO: 616567 - DNA, 25 bp, Mus musculus
ggcctaggagtgtcattacgggtac

SEQ ID NO: 616568 - DNA, 25 bp, Mus musculus
ggcctaggattccattcatctgaat

SEQ ID NO: 616569 - DNA, 25 bp, Mus musculus
ggcctaggattcgattcatctgaat

SEQ ID NO: 616570 - DNA, 25 bp, Mus musculus
ggcctaggccttaatggaacttgtt

SEQ ID NO: 616571 - DNA, 25 bp, Mus musculus
ggcctaggcctttatggaacttgtt

SEQ ID NO: 616572 - DNA, 25 bp, Mus musculus
ggcctaggctgaaaccgcggaaaca

SEQ ID NO: 616573 - DNA, 25 bp, Mus musculus
ggcctaggctgataccgcggaaaca

SEQ ID NO: 616574 - DNA, 25 bp, Mus musculus
ggcctaggtcatataataccttgtc

SEQ ID NO: 616575 - DNA, 25 bp, Mus musculus
ggcctaggtcatttaataccttgtc

SEQ ID NO: 616576 - DNA, 25 bp, Mus musculus
ggcctaggtggaccagccattcctc

SEQ ID NO: 616577 - DNA, 25 bp, Mus musculus
ggcctaggtggagcagccattcctc

SEQ ID NO: 616578 - DNA, 25 bp, Mus musculus
ggcctagtaaatcatatcacaccaa

SEQ ID NO: 616579 - DNA, 25 bp, Mus musculus
ggcctagtaaatgatatcacaccaa

SEQ ID NO: 616580 - DNA, 25 bp, Mus musculus
ggcctagtcaagatttcagtccacc

SEQ ID NO: 616581 - DNA, 25 bp, Mus musculus
ggcctagtcaagttttcagtccacc

SEQ ID NO: 616582 - DNA, 25 bp, Mus musculus
ggcctagtgcctatatttgacctat

SEQ ID NO: 616583 - DNA, 25 bp, Mus musculus
ggcctagtgcctttatttgacctat

SEQ ID NO: 616584 - DNA, 25 bp, Mus musculus
ggcctagttactcaagcccagggta

SEQ ID NO: 616585 - DNA, 25 bp, Mus musculus
ggcctagttactgaagcccagggta

SEQ ID NO: 616586 - DNA, 25 bp, Mus musculus
ggcctataaagaatcaagaccctat

SEQ ID NO: 616587 - DNA, 25 bp, Mus musculus
ggcctataaagattcaagaccctat

SEQ ID NO: 616588 - DNA, 25 bp, Mus musculus
ggcctatacagaatgacacaagctt

SEQ ID NO: 616589 - DNA, 25 bp, Mus musculus
ggcctatacagattgacacaagctt

SEQ ID NO: 616590 - DNA, 25 bp, Mus musculus
ggcctatactgacatctgtgtctga

SEQ ID NO: 616591 - DNA, 25 bp, Mus musculus
ggcctatactgagatctgtgtctga

SEQ ID NO: 616592 - DNA, 25 bp, Mus musculus
ggcctatagggaaattgttctcact

SEQ ID NO: 616593 - DNA, 25 bp, Mus musculus
ggcctatagggatattgttctcact

SEQ ID NO: 616594 - DNA, 25 bp, Mus musculus
ggcctatagtgtccatgagatgaat

SEQ ID NO: 616595 - DNA, 25 bp, Mus musculus
ggcctatagtgtgcatgagatgaat

SEQ ID NO: 616596 - DNA, 25 bp, Mus musculus
ggcctatatcatatgtctcagctaa

SEQ ID NO: 616597 - DNA, 25 bp, Mus musculus
ggcctatatcatttgtctcagctaa

SEQ ID NO: 616598 - DNA, 25 bp, Mus musculus
ggcctatccattcctctaaagatct

SEQ ID NO: 616599 - DNA, 25 bp, Mus musculus
ggcctatccattgctctaaagatct

SEQ ID NO: 616600 - DNA, 25 bp, Mus musculus
ggcctatcgtcccagctaattggga

SEQ ID NO: 616601 - DNA, 25 bp, Mus musculus
ggcctatcgtccgagctaattggga

SEQ ID NO: 616602 - DNA, 25 bp, Mus musculus
ggcctatcttgcacagagactctag

SEQ ID NO: 616603 - DNA, 25 bp, Mus musculus
ggcctatcttgctcagagactctag

SEQ ID NO: 616604 - DNA, 25 bp, Mus musculus
ggcctatgaggacctcctggacaac

SEQ ID NO: 616605 - DNA, 25 bp, Mus musculus
ggcctatgaggagctcctggacaac

SEQ ID NO: 616606 - DNA, 25 bp, Mus musculus
ggcctatgagtaatcctggtcctta

SEQ ID NO: 616607 - DNA, 25 bp, Mus musculus
ggcctatgagtattcctggtcctta

SEQ ID NO: 616608 - DNA, 25 bp, Mus musculus
ggcctatgctgcaagtgctgcgaaa

SEQ ID NO: 616609 - DNA, 25 bp, Mus musculus
ggcctatgctgctagtgctgcgaaa

SEQ ID NO: 616610 - DNA, 25 bp, Mus musculus
ggcctatggtagatgaggtgctcaa

SEQ ID NO: 616611 - DNA, 25 bp, Mus musculus
ggcctatggtagttgaggtgctcaa

SEQ ID NO: 616612 - DNA, 25 bp, Mus musculus
ggcctatgtgaaatccgtatcatca

SEQ ID NO: 616613 - DNA, 25 bp, Mus musculus
ggcctatgtgaattccgtatcatca

SEQ ID NO: 616614 - DNA, 25 bp, Mus musculus
ggcctatgtgacattgaccccaact

SEQ ID NO: 616615 - DNA, 25 bp, Mus musculus
ggcctatgtgactttgaccccaact

SEQ ID NO: 616616 - DNA, 25 bp, Mus musculus
ggcctattacagagtgctagacata

SEQ ID NO: 616617 - DNA, 25 bp, Mus musculus
ggcctattacagtgtgctagacata

SEQ ID NO: 616618 - DNA, 25 bp, Mus musculus
ggcctattactaactaccaagcatt

SEQ ID NO: 616619 - DNA, 25 bp, Mus musculus
ggcctattactatctaccaagcatt

SEQ ID NO: 616620 - DNA, 25 bp, Mus musculus
ggcctattagtgaggacacttgaga

SEQ ID NO: 616621 - DNA, 25 bp, Mus musculus
ggcctattagtgtggacacttgaga

SEQ ID NO: 616622 - DNA, 25 bp, Mus musculus
ggcctattctggatagttctacttt

SEQ ID NO: 616623 - DNA, 25 bp, Mus musculus
ggcctattctggttagttctacttt

SEQ ID NO: 616624 - DNA, 25 bp, Mus musculus
ggcctattggagcaagtgccatact

SEQ ID NO: 616625 - DNA, 25 bp, Mus musculus
ggcctattggaggaagtgccatact

SEQ ID NO: 616626 - DNA, 25 bp, Mus musculus
ggcctattgtaacgattcccgaaga

SEQ ID NO: 616627 - DNA, 25 bp, Mus musculus
ggcctattgtaaggattcccgaaga

SEQ ID NO: 616628 - DNA, 25 bp, Mus musculus
ggcctattgtataatggagggttta

SEQ ID NO: 616629 - DNA, 25 bp, Mus musculus
ggcctattgtattatggagggttta

SEQ ID NO: 616630 - DNA, 25 bp, Mus musculus
ggcctatttcatatacctcatggtg

SEQ ID NO: 616631 - DNA, 25 bp, Mus musculus
ggcctatttcatttacctcatggtg

SEQ ID NO: 616632 - DNA, 25 bp, Mus musculus
ggcctatttcctagccttaaattat

SEQ ID NO: 616633 - DNA, 25 bp, Mus musculus
ggcctatttccttgccttaaattat

SEQ ID NO: 616634 - DNA, 25 bp, Mus musculus
ggcctatttgagacaatctccgata

SEQ ID NO: 616635 - DNA, 25 bp, Mus musculus
ggcctatttgagtcaatctccgata

SEQ ID NO: 616636 - DNA, 25 bp, Mus musculus
ggcctatttgctcttattaaaagaa

SEQ ID NO: 616637 - DNA, 25 bp, Mus musculus
ggcctatttgctgttattaaaagaa

SEQ ID NO: 616638 - DNA, 25 bp, Mus musculus
ggcctattttccagcctaaattcaa

SEQ ID NO: 616639 - DNA, 25 bp, Mus musculus
ggcctattttcctgcctaaattcaa

SEQ ID NO: 616640 - DNA, 25 bp, Mus musculus
ggcctcaaaactaaattgatagtct

SEQ ID NO: 616641 - DNA, 25 bp, Mus musculus
ggcctcaaaacttaattgatagtct

SEQ ID NO: 616642 - DNA, 25 bp, Mus musculus
ggcctcaaactcaaaggctcaagca

SEQ ID NO: 616643 - DNA, 25 bp, Mus musculus
ggcctcaaactccaagacatccaag

SEQ ID NO: 616644 - DNA, 25 bp, Mus musculus
ggcctcaaactcgaagacatccaag

SEQ ID NO: 616645 - DNA, 25 bp, Mus musculus
ggcctcaaactctaaggctcaagca

SEQ ID NO: 616646 - DNA, 25 bp, Mus musculus
ggcctcaaagtcacaccagtaacca

SEQ ID NO: 616647 - DNA, 25 bp, Mus musculus
ggcctcaaagtctcaccagtaacca

SEQ ID NO: 616648 - DNA, 25 bp, Mus musculus
ggcctcaaatatccagcagcagcaa

SEQ ID NO: 616649 - DNA, 25 bp, Mus musculus
ggcctcaaatatgcagcagcagcaa

SEQ ID NO: 616650 - DNA, 25 bp, Mus musculus
ggcctcaacccaaaactttgagaca

SEQ ID NO: 616651 - DNA, 25 bp, Mus musculus
ggcctcaacccataactttgagaca

SEQ ID NO: 616652 - DNA, 25 bp, Mus musculus
ggcctcaactttcagctctgggtac

SEQ ID NO: 616653 - DNA, 25 bp, Mus musculus
ggcctcaactttgagctctgggtac

SEQ ID NO: 616654 - DNA, 25 bp, Mus musculus
ggcctcaaggacaatgtgtatgctt

SEQ ID NO: 616655 - DNA, 25 bp, Mus musculus
ggcctcaaggactatgtgtatgctt

SEQ ID NO: 616656 - DNA, 25 bp, Mus musculus
ggcctcaatgtcaccacagggaaat

SEQ ID NO: 616657 - DNA, 25 bp, Mus musculus
ggcctcaatgtctccacagggaaat

SEQ ID NO: 616658 - DNA, 25 bp, Mus musculus
ggcctcaatgttagaatgtcacctg

SEQ ID NO: 616659 - DNA, 25 bp, Mus musculus
ggcctcaatgtttgaatgtcacctg

SEQ ID NO: 616660 - DNA, 25 bp, Mus musculus
ggcctcacacatcctaagtacatac

SEQ ID NO: 616661 - DNA, 25 bp, Mus musculus
ggcctcacacatgctaagtacatac

SEQ ID NO: 616662 - DNA, 25 bp, Mus musculus
ggcctcacactcaagcagtggtgag

SEQ ID NO: 616663 - DNA, 25 bp, Mus musculus
ggcctcacactctagcagtggtgag

SEQ ID NO: 616664 - DNA, 25 bp, Mus musculus
ggcctcacacttcacatgtagccaa

SEQ ID NO: 616665 - DNA, 25 bp, Mus musculus
ggcctcacacttgacatgtagccaa

SEQ ID NO: 616666 - DNA, 25 bp, Mus musculus
ggcctcacaggcatatagcgtgtag

SEQ ID NO: 616667 - DNA, 25 bp, Mus musculus
ggcctcacaggcttatagcgtgtag

SEQ ID NO: 616668 - DNA, 25 bp, Mus musculus
ggcctcacagtcatgatgttcagga

SEQ ID NO: 616669 - DNA, 25 bp, Mus musculus
ggcctcacagtcttgatgttcagga

SEQ ID NO: 616670 - DNA, 25 bp, Mus musculus
ggcctcacccttatgtttgatagag

SEQ ID NO: 616671 - DNA, 25 bp, Mus musculus
ggcctcacccttttgtttgatagag

SEQ ID NO: 616672 - DNA, 25 bp, Mus musculus
ggcctcactgccattgaacctgaag

SEQ ID NO: 616673 - DNA, 25 bp, Mus musculus
ggcctcactgcctttgaacctgaag

SEQ ID NO: 616674 - DNA, 25 bp, Mus musculus
ggcctcagaaagctttggtttcaat

SEQ ID NO: 616675 - DNA, 25 bp, Mus musculus
ggcctcagaaaggtttggtttcaat

SEQ ID NO: 616676 - DNA, 25 bp, Mus musculus
ggcctcagactgcaggacctgacct

SEQ ID NO: 616677 - DNA, 25 bp, Mus musculus
ggcctcagactggaggacctgacct

SEQ ID NO: 616678 - DNA, 25 bp, Mus musculus
ggcctcagacttactgtgtagcgca

SEQ ID NO: 616679 - DNA, 25 bp, Mus musculus
ggcctcagactttctgtgtagcgca

SEQ ID NO: 616680 - DNA, 25 bp, Mus musculus
ggcctcagatttacagagctctacc

SEQ ID NO: 616681 - DNA, 25 bp, Mus musculus
ggcctcagatttataccaacttact

SEQ ID NO: 616682 - DNA, 25 bp, Mus musculus
ggcctcagattttcagagctctacc

SEQ ID NO: 616683 - DNA, 25 bp, Mus musculus
ggcctcagatttttaccaacttact

SEQ ID NO: 616684 - DNA, 25 bp, Mus musculus
ggcctcagcaagagggggcccttac

SEQ ID NO: 616685 - DNA, 25 bp, Mus musculus
ggcctcagcaagtgggggcccttac

SEQ ID NO: 616686 - DNA, 25 bp, Mus musculus
ggcctcagcatcacagtgcctgaaa

SEQ ID NO: 616687 - DNA, 25 bp, Mus musculus
ggcctcagcatctcagtgcctgaaa

SEQ ID NO: 616688 - DNA, 25 bp, Mus musculus
ggcctcagcatgagtgtctggctca

SEQ ID NO: 616689 - DNA, 25 bp, Mus musculus
ggcctcagcatgtgtgtctggctca

SEQ ID NO: 616690 - DNA, 25 bp, Mus musculus
ggcctcagcctgcatcaagtgagat

SEQ ID NO: 616691 - DNA, 25 bp, Mus musculus
ggcctcagcctggatcaagtgagat

SEQ ID NO: 616692 - DNA, 25 bp, Mus musculus
ggcctcaggctacagggaccttgtt

SEQ ID NO: 616693 - DNA, 25 bp, Mus musculus
ggcctcaggctagagggaccttgtt

SEQ ID NO: 616694 - DNA, 25 bp, Mus musculus
ggcctcaggttcagcggccctggtc

SEQ ID NO: 616695 - DNA, 25 bp, Mus musculus
ggcctcaggttctgcggccctggtc

SEQ ID NO: 616696 - DNA, 25 bp, Mus musculus
ggcctcaggtttactgtgtatctct

SEQ ID NO: 616697 - DNA, 25 bp, Mus musculus
ggcctcaggttttctgtgtatctct

SEQ ID NO: 616698 - DNA, 25 bp, Mus musculus
ggcctcagtacaatagttgtcattt

SEQ ID NO: 616699 - DNA, 25 bp, Mus musculus
ggcctcagtacattagttgtcattt

SEQ ID NO: 616700 - DNA, 25 bp, Mus musculus
ggcctcagtatgaatatattgacac

SEQ ID NO: 616701 - DNA, 25 bp, Mus musculus
ggcctcagtatgtatatattgacac

SEQ ID NO: 616702 - DNA, 25 bp, Mus musculus
ggcctcagtcaacccacagtggtga

SEQ ID NO: 616703 - DNA, 25 bp, Mus musculus
ggcctcagtcaagccacagtggtga

SEQ ID NO: 616704 - DNA, 25 bp, Mus musculus
ggcctcagtcacaaatcactgctgt

SEQ ID NO: 616705 - DNA, 25 bp, Mus musculus
ggcctcagtcactaatcactgctgt

SEQ ID NO: 616706 - DNA, 25 bp, Mus musculus
ggcctcagtggcagcataataagta

SEQ ID NO: 616707 - DNA, 25 bp, Mus musculus
ggcctcagtggctgcataataagta

SEQ ID NO: 616708 - DNA, 25 bp, Mus musculus
ggcctcagtggtatgtgaacacttt

SEQ ID NO: 616709 - DNA, 25 bp, Mus musculus
ggcctcagtggtttgtgaacacttt

SEQ ID NO: 616710 - DNA, 25 bp, Mus musculus
ggcctcagtttcacaacttagaagt

SEQ ID NO: 616711 - DNA, 25 bp, Mus musculus
ggcctcagtttctcaacttagaagt

SEQ ID NO: 616712 - DNA, 25 bp, Mus musculus
ggcctcatactccacaagttgtact

SEQ ID NO: 616713 - DNA, 25 bp, Mus musculus
ggcctcatactcgacaagttgtact

SEQ ID NO: 616714 - DNA, 25 bp, Mus musculus
ggcctcatactgcaaccaatatgga

SEQ ID NO: 616715 - DNA, 25 bp, Mus musculus
ggcctcatactggaaccaatatgga

SEQ ID NO: 616716 - DNA, 25 bp, Mus musculus
ggcctcatagaccaaagtatccaat

SEQ ID NO: 616717 - DNA, 25 bp, Mus musculus
ggcctcatagacgaaagtatccaat

SEQ ID NO: 616718 - DNA, 25 bp, Mus musculus
ggcctcatagctcggttgatctcca

SEQ ID NO: 616719 - DNA, 25 bp, Mus musculus
ggcctcatagctgggttgatctcca

SEQ ID NO: 616720 - DNA, 25 bp, Mus musculus
ggcctcatatttccatatgcaccag

SEQ ID NO: 616721 - DNA, 25 bp, Mus musculus
ggcctcatatttgcatatgcaccag

SEQ ID NO: 616722 - DNA, 25 bp, Mus musculus
ggcctcatcagacctgtgagtgtct

SEQ ID NO: 616723 - DNA, 25 bp, Mus musculus
ggcctcatcagagctgtgagtgtct

SEQ ID NO: 616724 - DNA, 25 bp, Mus musculus
ggcctcatcagtctgccagggagac

SEQ ID NO: 616725 - DNA, 25 bp, Mus musculus
ggcctcatcagtgtgccagggagac

SEQ ID NO: 616726 - DNA, 25 bp, Mus musculus
ggcctcatcctgaactgcgtggtga

SEQ ID NO: 616727 - DNA, 25 bp, Mus musculus
ggcctcatcctgtactgcgtggtga

SEQ ID NO: 616728 - DNA, 25 bp, Mus musculus
ggcctcatccttcctagaggttcga

SEQ ID NO: 616729 - DNA, 25 bp, Mus musculus
ggcctcatccttgctagaggttcga

SEQ ID NO: 616730 - DNA, 25 bp, Mus musculus
ggcctcatcttaccatttcaggtga

SEQ ID NO: 616731 - DNA, 25 bp, Mus musculus
ggcctcatcttagcatttcaggtga

SEQ ID NO: 616732 - DNA, 25 bp, Mus musculus
ggcctcatgagtcccctaaaactta

SEQ ID NO: 616733 - DNA, 25 bp, Mus musculus
ggcctcatgagtgccctaaaactta

SEQ ID NO: 616734 - DNA, 25 bp, Mus musculus
ggcctcatgggcagtttgttcaaga

SEQ ID NO: 616735 - DNA, 25 bp, Mus musculus
ggcctcatgggcattggacgtcgtc

SEQ ID NO: 616736 - DNA, 25 bp, Mus musculus
ggcctcatgggctgtttgttcaaga

SEQ ID NO: 616737 - DNA, 25 bp, Mus musculus
ggcctcatgggctttggacgtcgtc

SEQ ID NO: 616738 - DNA, 25 bp, Mus musculus
ggcctcattccgacagggcagaaaa

SEQ ID NO: 616739 - DNA, 25 bp, Mus musculus
ggcctcattccgtcagggcagaaaa

SEQ ID NO: 616740 - DNA, 25 bp, Mus musculus
ggcctcattctgaagaccatctggg

SEQ ID NO: 616741 - DNA, 25 bp, Mus musculus
ggcctcattctgtagaccatctggg

SEQ ID NO: 616742 - DNA, 25 bp, Mus musculus
ggcctcattggcaatagttcacaga

SEQ ID NO: 616743 - DNA, 25 bp, Mus musculus
ggcctcattggctatagttcacaga

SEQ ID NO: 616744 - DNA, 25 bp, Mus musculus
ggcctcattgtgaacagatgtcccc

SEQ ID NO: 616745 - DNA, 25 bp, Mus musculus
ggcctcattgtgtacagatgtcccc

SEQ ID NO: 616746 - DNA, 25 bp, Mus musculus
ggcctcatttataggtcaaacccag

SEQ ID NO: 616747 - DNA, 25 bp, Mus musculus
ggcctcatttattggtcaaacccag

SEQ ID NO: 616748 - DNA, 25 bp, Mus musculus
ggcctcatttccacttgtatatttt

SEQ ID NO: 616749 - DNA, 25 bp, Mus musculus
ggcctcatttcctcttgtatatttt

SEQ ID NO: 616750 - DNA, 25 bp, Mus musculus
ggcctcatttctattactacaagga

SEQ ID NO: 616751 - DNA, 25 bp, Mus musculus
ggcctcatttcttttactacaagga

SEQ ID NO: 616752 - DNA, 25 bp, Mus musculus
ggcctccaacttcagtgggaacatc

SEQ ID NO: 616753 - DNA, 25 bp, Mus musculus
ggcctccaacttgagtgggaacatc

SEQ ID NO: 616754 - DNA, 25 bp, Mus musculus
ggcctccaaggtcatgggaagcaaa

SEQ ID NO: 616755 - DNA, 25 bp, Mus musculus
ggcctccaaggtgatgggaagcaaa

SEQ ID NO: 616756 - DNA, 25 bp, Mus musculus
ggcctccaagtaacaagatgtcctg

SEQ ID NO: 616757 - DNA, 25 bp, Mus musculus
ggcctccaagtatcaagatgtcctg

SEQ ID NO: 616758 - DNA, 25 bp, Mus musculus
ggcctccaatagcacatacatatgc

SEQ ID NO: 616759 - DNA, 25 bp, Mus musculus
ggcctccaataggacatacatatgc

SEQ ID NO: 616760 - DNA, 25 bp, Mus musculus
ggcctccaatcacagctgctggatc

SEQ ID NO: 616761 - DNA, 25 bp, Mus musculus
ggcctccaatcagagctgctggatc

SEQ ID NO: 616762 - DNA, 25 bp, Mus musculus
ggcctccaatttctggctcttttaa

SEQ ID NO: 616763 - DNA, 25 bp, Mus musculus
ggcctccaatttgtggctcttttaa

SEQ ID NO: 616764 - DNA, 25 bp, Mus musculus
ggcctccacaatagtgaaaagaaat

SEQ ID NO: 616765 - DNA, 25 bp, Mus musculus
ggcctccacaattgtgaaaagaaat

SEQ ID NO: 616766 - DNA, 25 bp, Mus musculus
ggcctccacacgcagtagaaatagt

SEQ ID NO: 616767 - DNA, 25 bp, Mus musculus
ggcctccacacggagtagaaatagt

SEQ ID NO: 616768 - DNA, 25 bp, Mus musculus
ggcctccacgccagtgattgtaaaa

SEQ ID NO: 616769 - DNA, 25 bp, Mus musculus
ggcctccacgcctgtgattgtaaaa

SEQ ID NO: 616770 - DNA, 25 bp, Mus musculus
ggcctccactgaattgctttcattg

SEQ ID NO: 616771 - DNA, 25 bp, Mus musculus
ggcctccactgatttgctttcattg

SEQ ID NO: 616772 - DNA, 25 bp, Mus musculus
ggcctccacttgcattgctaaacag

SEQ ID NO: 616773 - DNA, 25 bp, Mus musculus
ggcctccacttggattgctaaacag

SEQ ID NO: 616774 - DNA, 25 bp, Mus musculus
ggcctccagagaactttttagagta

SEQ ID NO: 616775 - DNA, 25 bp, Mus musculus
ggcctccagagatctttttagagta

SEQ ID NO: 616776 - DNA, 25 bp, Mus musculus
ggcctccagcaaactctagcaatag

SEQ ID NO: 616777 - DNA, 25 bp, Mus musculus
ggcctccagcaatctctagcaatag

SEQ ID NO: 616778 - DNA, 25 bp, Mus musculus
ggcctccaggtcactcaagtgtgaa

SEQ ID NO: 616779 - DNA, 25 bp, Mus musculus
ggcctccaggtctctcaagtgtgaa

SEQ ID NO: 616780 - DNA, 25 bp, Mus musculus
ggcctccagttaccaacacagaaat

SEQ ID NO: 616781 - DNA, 25 bp, Mus musculus
ggcctccagttagcaacacagaaat

SEQ ID NO: 616782 - DNA, 25 bp, Mus musculus
ggcctccagttcagttttacttcta

SEQ ID NO: 616783 - DNA, 25 bp, Mus musculus
ggcctccagttctgttttacttcta

SEQ ID NO: 616784 - DNA, 25 bp, Mus musculus
ggcctccagtttcccgagatgctga

SEQ ID NO: 616785 - DNA, 25 bp, Mus musculus
ggcctccagtttgccgagatgctga

SEQ ID NO: 616786 - DNA, 25 bp, Mus musculus
ggcctccataggaaccaggcacaca

SEQ ID NO: 616787 - DNA, 25 bp, Mus musculus
ggcctccataggtaccaggcacaca

SEQ ID NO: 616788 - DNA, 25 bp, Mus musculus
ggcctccatgctcctgattgtaaga

SEQ ID NO: 616789 - DNA, 25 bp, Mus musculus
ggcctccatgctgctgattgtaaga

SEQ ID NO: 616790 - DNA, 25 bp, Mus musculus
ggcctccatgtgcgaagtgtgattt

SEQ ID NO: 616791 - DNA, 25 bp, Mus musculus
ggcctccatgtgggaagtgtgattt

SEQ ID NO: 616792 - DNA, 25 bp, Mus musculus
ggcctccatgttctccaaggatcga

SEQ ID NO: 616793 - DNA, 25 bp, Mus musculus
ggcctccatgttgtccaaggatcga

SEQ ID NO: 616794 - DNA, 25 bp, Mus musculus
ggcctcccaggcatgctatgtgttt

SEQ ID NO: 616795 - DNA, 25 bp, Mus musculus
ggcctcccaggccaattggtgatga

SEQ ID NO: 616796 - DNA, 25 bp, Mus musculus
ggcctcccaggcgaattggtgatga

SEQ ID NO: 616797 - DNA, 25 bp, Mus musculus
ggcctcccaggcttgctatgtgttt

SEQ ID NO: 616798 - DNA, 25 bp, Mus musculus
ggcctcccagggacaattcagattg

SEQ ID NO: 616799 - DNA, 25 bp, Mus musculus
ggcctcccagggtcaattcagattg

SEQ ID NO: 616800 - DNA, 25 bp, Mus musculus
ggcctcccagtaattctgcaagatg

SEQ ID NO: 616801 - DNA, 25 bp, Mus musculus
ggcctcccagtatttctgcaagatg

SEQ ID NO: 616802 - DNA, 25 bp, Mus musculus
ggcctcccatcacgttgaacaagaa

SEQ ID NO: 616803 - DNA, 25 bp, Mus musculus
ggcctcccatcaggttgaacaagaa

SEQ ID NO: 616804 - DNA, 25 bp, Mus musculus
ggcctccccagacattgggtcttca

SEQ ID NO: 616805 - DNA, 25 bp, Mus musculus
ggcctccccagagattgggtcttca

SEQ ID NO: 616806 - DNA, 25 bp, Mus musculus
ggcctcccttgaagtttcatattgg

SEQ ID NO: 616807 - DNA, 25 bp, Mus musculus
ggcctcccttgatgtttcatattgg

SEQ ID NO: 616808 - DNA, 25 bp, Mus musculus
ggcctcccttggcttgaactcattg

SEQ ID NO: 616809 - DNA, 25 bp, Mus musculus
ggcctcccttgggttgaactcattg

SEQ ID NO: 616810 - DNA, 25 bp, Mus musculus
ggcctccgactccttatgtagagaa

SEQ ID NO: 616811 - DNA, 25 bp, Mus musculus
ggcctccgactcgttatgtagagaa

SEQ ID NO: 616812 - DNA, 25 bp, Mus musculus
ggcctccgctggagcgaaggaatta

SEQ ID NO: 616813 - DNA, 25 bp, Mus musculus
ggcctccgctggtgcgaaggaatta

SEQ ID NO: 616814 - DNA, 25 bp, Mus musculus
ggcctccgggtcactgtaggaaaga

SEQ ID NO: 616815 - DNA, 25 bp, Mus musculus
ggcctccgggtctctgtaggaaaga

SEQ ID NO: 616816 - DNA, 25 bp, Mus musculus
ggcctccgtcagaaaggttagaaca

SEQ ID NO: 616817 - DNA, 25 bp, Mus musculus
ggcctccgtcagtaaggttagaaca

SEQ ID NO: 616818 - DNA, 25 bp, Mus musculus
ggcctcctaaggcatgggattaaag

SEQ ID NO: 616819 - DNA, 25 bp, Mus musculus
ggcctcctaagggatgggattaaag

SEQ ID NO: 616820 - DNA, 25 bp, Mus musculus
ggcctcctacctctgagtacgaaaa

SEQ ID NO: 616821 - DNA, 25 bp, Mus musculus
ggcctcctacctgtgagtacgaaaa

SEQ ID NO: 616822 - DNA, 25 bp, Mus musculus
ggcctcctagagcaagattacattt

SEQ ID NO: 616823 - DNA, 25 bp, Mus musculus
ggcctcctagaggaagattacattt

SEQ ID NO: 616824 - DNA, 25 bp, Mus musculus
ggcctcctaggcagtgcttgaaagc

SEQ ID NO: 616825 - DNA, 25 bp, Mus musculus
ggcctcctaggctgtgcttgaaagc

SEQ ID NO: 616826 - DNA, 25 bp, Mus musculus
ggcctcctcaaaagggtgtgccgta

SEQ ID NO: 616827 - DNA, 25 bp, Mus musculus
ggcctcctcaaatgggtgtgccgta

SEQ ID NO: 616828 - DNA, 25 bp, Mus musculus
ggcctcctcagacctgagtgccaag

SEQ ID NO: 616829 - DNA, 25 bp, Mus musculus
ggcctcctcagagctgagtgccaag

SEQ ID NO: 616830 - DNA, 25 bp, Mus musculus
ggcctcctcataccaggacaagtta

SEQ ID NO: 616831 - DNA, 25 bp, Mus musculus
ggcctcctcatagcaggacaagtta

SEQ ID NO: 616832 - DNA, 25 bp, Mus musculus
ggcctcctctatagctgcttaaaaa

SEQ ID NO: 616833 - DNA, 25 bp, Mus musculus
ggcctcctctattgctgcttaaaaa

SEQ ID NO: 616834 - DNA, 25 bp, Mus musculus
ggcctcctcttacagttggtacaaa

SEQ ID NO: 616835 - DNA, 25 bp, Mus musculus
ggcctcctcttagagttggtacaaa

SEQ ID NO: 616836 - DNA, 25 bp, Mus musculus
ggcctcctctttcatcccagaataa

SEQ ID NO: 616837 - DNA, 25 bp, Mus musculus
ggcctcctctttgatcccagaataa

SEQ ID NO: 616838 - DNA, 25 bp, Mus musculus
ggcctccttaatcggtcaggctttt

SEQ ID NO: 616839 - DNA, 25 bp, Mus musculus
ggcctccttaatgggtcaggctttt

SEQ ID NO: 616840 - DNA, 25 bp, Mus musculus
ggcctccttcacagagaggtttctg

SEQ ID NO: 616841 - DNA, 25 bp, Mus musculus
ggcctccttcactgagaggtttctg

SEQ ID NO: 616842 - DNA, 25 bp, Mus musculus
ggcctccttctgcacagttagttaa

SEQ ID NO: 616843 - DNA, 25 bp, Mus musculus
ggcctccttctggacagttagttaa

SEQ ID NO: 616844 - DNA, 25 bp, Mus musculus
ggcctccttgataatgaacaccttt

SEQ ID NO: 616845 - DNA, 25 bp, Mus musculus
ggcctccttgattatgaacaccttt

SEQ ID NO: 616846 - DNA, 25 bp, Mus musculus
ggcctccttgctagttataaccaga

SEQ ID NO: 616847 - DNA, 25 bp, Mus musculus
ggcctccttgcttgttataaccaga

SEQ ID NO: 616848 - DNA, 25 bp, Mus musculus
ggcctcctttagacttatacaaatt

SEQ ID NO: 616849 - DNA, 25 bp, Mus musculus
ggcctcctttagtcttatacaaatt

SEQ ID NO: 616850 - DNA, 25 bp, Mus musculus
ggcctcctttggaagagtggatgct

SEQ ID NO: 616851 - DNA, 25 bp, Mus musculus
ggcctcctttggtagagtggatgct

SEQ ID NO: 616852 - DNA, 25 bp, Mus musculus
ggcctcgaagttccagttcatctta

SEQ ID NO: 616853 - DNA, 25 bp, Mus musculus
ggcctcgaagttgcagttcatctta

SEQ ID NO: 616854 - DNA, 25 bp, Mus musculus
ggcctcgatgagaccctcgagtgaa

SEQ ID NO: 616855 - DNA, 25 bp, Mus musculus
ggcctcgatgagtccctcgagtgaa

SEQ ID NO: 616856 - DNA, 25 bp, Mus musculus
ggcctcgcagacacttagctggcta

SEQ ID NO: 616857 - DNA, 25 bp, Mus musculus
ggcctcgcagactcttagctggcta

SEQ ID NO: 616858 - DNA, 25 bp, Mus musculus
ggcctcgccaagctatgtggaccga

SEQ ID NO: 616859 - DNA, 25 bp, Mus musculus
ggcctcgccaaggtatgtggaccga

SEQ ID NO: 616860 - DNA, 25 bp, Mus musculus
ggcctcgcttgactgaccaggagaa

SEQ ID NO: 616861 - DNA, 25 bp, Mus musculus
ggcctcgcttgagtgaccaggagaa

SEQ ID NO: 616862 - DNA, 25 bp, Mus musculus
ggcctcggaggtcgacttctatatt

SEQ ID NO: 616863 - DNA, 25 bp, Mus musculus
ggcctcggaggtggacttctatatt

SEQ ID NO: 616864 - DNA, 25 bp, Mus musculus
ggcctcggccttagatcaagatgga

SEQ ID NO: 616865 - DNA, 25 bp, Mus musculus
ggcctcggcctttgatcaagatgga

SEQ ID NO: 616866 - DNA, 25 bp, Mus musculus
ggcctcggcgtcaaagtctacgtca

SEQ ID NO: 616867 - DNA, 25 bp, Mus musculus
ggcctcggcgtctaagtctacgtca

SEQ ID NO: 616868 - DNA, 25 bp, Mus musculus
ggcctcgggaccacaagggtgacca

SEQ ID NO: 616869 - DNA, 25 bp, Mus musculus
ggcctcgggacctcaagggtgacca

SEQ ID NO: 616870 - DNA, 25 bp, Mus musculus
ggcctcggtgttccgtcactaggaa

SEQ ID NO: 616871 - DNA, 25 bp, Mus musculus
ggcctcggtgttgcgtcactaggaa

SEQ ID NO: 616872 - DNA, 25 bp, Mus musculus
ggcctcggtttgaacgcgtccttgg

SEQ ID NO: 616873 - DNA, 25 bp, Mus musculus
ggcctcggtttgtacgcgtccttgg

SEQ ID NO: 616874 - DNA, 25 bp, Mus musculus
ggcctcgtcaagagcaagtcgggtt

SEQ ID NO: 616875 - DNA, 25 bp, Mus musculus
ggcctcgtcaagtgcaagtcgggtt

SEQ ID NO: 616876 - DNA, 25 bp, Mus musculus
ggcctcgtcattatacagggatgtt

SEQ ID NO: 616877 - DNA, 25 bp, Mus musculus
ggcctcgtcattttacagggatgtt

SEQ ID NO: 616878 - DNA, 25 bp, Mus musculus
ggcctcgtcctgcagaaagagccaa

SEQ ID NO: 616879 - DNA, 25 bp, Mus musculus
ggcctcgtcctggagaaagagccaa

SEQ ID NO: 616880 - DNA, 25 bp, Mus musculus
ggcctcgtcgtcaatgcacatatat

SEQ ID NO: 616881 - DNA, 25 bp, Mus musculus
ggcctcgtcgtctatgcacatatat

SEQ ID NO: 616882 - DNA, 25 bp, Mus musculus
ggcctcgtggccatcagatgaggat

SEQ ID NO: 616883 - DNA, 25 bp, Mus musculus
ggcctcgtggccttcagatgaggat

SEQ ID NO: 616884 - DNA, 25 bp, Mus musculus
ggcctcgttttgctgtatcattaca

SEQ ID NO: 616885 - DNA, 25 bp, Mus musculus
ggcctcgttttggtgtatcattaca

SEQ ID NO: 616886 - DNA, 25 bp, Mus musculus
ggcctctaagccagttcatatgtag

SEQ ID NO: 616887 - DNA, 25 bp, Mus musculus
ggcctctaagcctgttcatatgtag

SEQ ID NO: 616888 - DNA, 25 bp, Mus musculus
ggcctctaagttcatcttttccaag

SEQ ID NO: 616889 - DNA, 25 bp, Mus musculus
ggcctctaagttgatcttttccaag

SEQ ID NO: 616890 - DNA, 25 bp, Mus musculus
ggcctctaattccagtgttcttcac

SEQ ID NO: 616891 - DNA, 25 bp, Mus musculus
ggcctctaattcgagtgttcttcac

SEQ ID NO: 616892 - DNA, 25 bp, Mus musculus
ggcctctacatacgtgtcagtctgt

SEQ ID NO: 616893 - DNA, 25 bp, Mus musculus
ggcctctacataggtgtcagtctgt

SEQ ID NO: 616894 - DNA, 25 bp, Mus musculus
ggcctctacctgaggaatgtcatta

SEQ ID NO: 616895 - DNA, 25 bp, Mus musculus
ggcctctacctgtggaatgtcatta

SEQ ID NO: 616896 - DNA, 25 bp, Mus musculus
ggcctctagtccagtatgacgtcaa

SEQ ID NO: 616897 - DNA, 25 bp, Mus musculus
ggcctctagtcctgtatgacgtcaa

SEQ ID NO: 616898 - DNA, 25 bp, Mus musculus
ggcctctatgatatcgaatactctg

SEQ ID NO: 616899 - DNA, 25 bp, Mus musculus
ggcctctatgatttcgaatactctg

SEQ ID NO: 616900 - DNA, 25 bp, Mus musculus
ggcctctatgggatctatactcaca

SEQ ID NO: 616901 - DNA, 25 bp, Mus musculus
ggcctctatgggttctatactcaca

SEQ ID NO: 616902 - DNA, 25 bp, Mus musculus
ggcctctattttaaatcactaacca

SEQ ID NO: 616903 - DNA, 25 bp, Mus musculus
ggcctctatttttaatcactaacca

SEQ ID NO: 616904 - DNA, 25 bp, Mus musculus
ggcctctcaacacctaacatagggt

SEQ ID NO: 616905 - DNA, 25 bp, Mus musculus
ggcctctcaacagctaacatagggt

SEQ ID NO: 616906 - DNA, 25 bp, Mus musculus
ggcctctccaggacggctatggacg

SEQ ID NO: 616907 - DNA, 25 bp, Mus musculus
ggcctctccaggtcggctatggacg

SEQ ID NO: 616908 - DNA, 25 bp, Mus musculus
ggcctctcctacagctgtggctgca

SEQ ID NO: 616909 - DNA, 25 bp, Mus musculus
ggcctctcctactgctgtggctgca

SEQ ID NO: 616910 - DNA, 25 bp, Mus musculus
ggcctctcctcgatttgttgtgatc

SEQ ID NO: 616911 - DNA, 25 bp, Mus musculus
ggcctctcctcgttttgttgtgatc

SEQ ID NO: 616912 - DNA, 25 bp, Mus musculus
ggcctctcctctaccaagaggcagt

SEQ ID NO: 616913 - DNA, 25 bp, Mus musculus
ggcctctcctcttccaagaggcagt

SEQ ID NO: 616914 - DNA, 25 bp, Mus musculus
ggcctctcggttacaaaatctctaa

SEQ ID NO: 616915 - DNA, 25 bp, Mus musculus
ggcctctcggtttcaaaatctctaa

SEQ ID NO: 616916 - DNA, 25 bp, Mus musculus
ggcctctctcgaatagtcatgtcaa

SEQ ID NO: 616917 - DNA, 25 bp, Mus musculus
ggcctctctcgattagtcatgtcaa

SEQ ID NO: 616918 - DNA, 25 bp, Mus musculus
ggcctctctggacgcattacttcca

SEQ ID NO: 616919 - DNA, 25 bp, Mus musculus
ggcctctctggaggcattacttcca

SEQ ID NO: 616920 - DNA, 25 bp, Mus musculus
ggcctctcttggaactgcagagaca

SEQ ID NO: 616921 - DNA, 25 bp, Mus musculus
ggcctctcttggtactgcagagaca

SEQ ID NO: 616922 - DNA, 25 bp, Mus musculus
ggcctctgatggcttactgctatga

SEQ ID NO: 616923 - DNA, 25 bp, Mus musculus
ggcctctgatgggttactgctatga

SEQ ID NO: 616924 - DNA, 25 bp, Mus musculus
ggcctctgcagacatagctgctaaa

SEQ ID NO: 616925 - DNA, 25 bp, Mus musculus
ggcctctgcagagatagctgctaaa

SEQ ID NO: 616926 - DNA, 25 bp, Mus musculus
ggcctctgccagagtacaggaaatc

SEQ ID NO: 616927 - DNA, 25 bp, Mus musculus
ggcctctgccagtgtacaggaaatc

SEQ ID NO: 616928 - DNA, 25 bp, Mus musculus
ggcctctgcgtgcttgagtgacctt

SEQ ID NO: 616929 - DNA, 25 bp, Mus musculus
ggcctctgcgtggttgagtgacctt

SEQ ID NO: 616930 - DNA, 25 bp, Mus musculus
ggcctctgctctcgatcataggagt

SEQ ID NO: 616931 - DNA, 25 bp, Mus musculus
ggcctctgctctggatcataggagt

SEQ ID NO: 616932 - DNA, 25 bp, Mus musculus
ggcctctgctgactgaacccctggt

SEQ ID NO: 616933 - DNA, 25 bp, Mus musculus
ggcctctgctgagtgaacccctggt

SEQ ID NO: 616934 - DNA, 25 bp, Mus musculus
ggcctctgctggagagcacaggtat

SEQ ID NO: 616935 - DNA, 25 bp, Mus musculus
ggcctctgctggtgagcacaggtat

SEQ ID NO: 616936 - DNA, 25 bp, Mus musculus
ggcctctggaaaagtactagtgatt

SEQ ID NO: 616937 - DNA, 25 bp, Mus musculus
ggcctctggaaatgtactagtgatt

SEQ ID NO: 616938 - DNA, 25 bp, Mus musculus
ggcctctggagcacattgatgccat

SEQ ID NO: 616939 - DNA, 25 bp, Mus musculus
ggcctctggagctcattgatgccat

SEQ ID NO: 616940 - DNA, 25 bp, Mus musculus
ggcctctgggcactgcgtatatgca

SEQ ID NO: 616941 - DNA, 25 bp, Mus musculus
ggcctctgggcagtgcgtatatgca

SEQ ID NO: 616942 - DNA, 25 bp, Mus musculus
ggcctctgtatgcaatcttggtgat

SEQ ID NO: 616943 - DNA, 25 bp, Mus musculus
ggcctctgtatggaatcttggtgat

SEQ ID NO: 616944 - DNA, 25 bp, Mus musculus
ggcctctgtctcaggacattccaga

SEQ ID NO: 616945 - DNA, 25 bp, Mus musculus
ggcctctgtctctggacattccaga

SEQ ID NO: 616946 - DNA, 25 bp, Mus musculus
ggcctctgtgataggccccttccaa

SEQ ID NO: 616947 - DNA, 25 bp, Mus musculus
ggcctctgtgattggccccttccaa

SEQ ID NO: 616948 - DNA, 25 bp, Mus musculus
ggcctctgtggtctttaaccagctc

SEQ ID NO: 616949 - DNA, 25 bp, Mus musculus
ggcctctgtggtgtttaaccagctc

SEQ ID NO: 616950 - DNA, 25 bp, Mus musculus
ggcctctgttatcttgttaccagtt

SEQ ID NO: 616951 - DNA, 25 bp, Mus musculus
ggcctctgttatgttgttaccagtt

SEQ ID NO: 616952 - DNA, 25 bp, Mus musculus
ggcctcttactgctagggtcaggaa

SEQ ID NO: 616953 - DNA, 25 bp, Mus musculus
ggcctcttactggtagggtcaggaa

SEQ ID NO: 616954 - DNA, 25 bp, Mus musculus
ggcctcttagttcagataatattgt

SEQ ID NO: 616955 - DNA, 25 bp, Mus musculus
ggcctcttagttgagataatattgt

SEQ ID NO: 616956 - DNA, 25 bp, Mus musculus
ggcctcttcgttctcaacatttctg

SEQ ID NO: 616957 - DNA, 25 bp, Mus musculus
ggcctcttcgttgtcaacatttctg

SEQ ID NO: 616958 - DNA, 25 bp, Mus musculus
ggcctcttgcctcctgttcatgatg

SEQ ID NO: 616959 - DNA, 25 bp, Mus musculus
ggcctcttgcctgctgttcatgatg

SEQ ID NO: 616960 - DNA, 25 bp, Mus musculus
ggcctcttggctatagcttaagcaa

SEQ ID NO: 616961 - DNA, 25 bp, Mus musculus
ggcctcttggctttagcttaagcaa

SEQ ID NO: 616962 - DNA, 25 bp, Mus musculus
ggcctcttgggccatggacatcctg

SEQ ID NO: 616963 - DNA, 25 bp, Mus musculus
ggcctcttgggcgatggacatcctg

SEQ ID NO: 616964 - DNA, 25 bp, Mus musculus
ggcctctttactcctttgaagtcag

SEQ ID NO: 616965 - DNA, 25 bp, Mus musculus
ggcctctttactgctttgaagtcag

SEQ ID NO: 616966 - DNA, 25 bp, Mus musculus
ggcctcttttcaatggttgatattg

SEQ ID NO: 616967 - DNA, 25 bp, Mus musculus
ggcctcttttcattggttgatattg

SEQ ID NO: 616968 - DNA, 25 bp, Mus musculus
ggcctgaaaatgacggccaccttca

SEQ ID NO: 616969 - DNA, 25 bp, Mus musculus
ggcctgaaaatgtcggccaccttca

SEQ ID NO: 616970 - DNA, 25 bp, Mus musculus
ggcctgaaatccaagcctggtttga

SEQ ID NO: 616971 - DNA, 25 bp, Mus musculus
ggcctgaaatcctagcctggtttga

SEQ ID NO: 616972 - DNA, 25 bp, Mus musculus
ggcctgaacagaaaacagccccaga

SEQ ID NO: 616973 - DNA, 25 bp, Mus musculus
ggcctgaacagataacagccccaga

SEQ ID NO: 616974 - DNA, 25 bp, Mus musculus
ggcctgaactctcgtcagatggcaa

SEQ ID NO: 616975 - DNA, 25 bp, Mus musculus
ggcctgaactctggtcagatggcaa

SEQ ID NO: 616976 - DNA, 25 bp, Mus musculus
ggcctgaactgcatgagtcagctga

SEQ ID NO: 616977 - DNA, 25 bp, Mus musculus
ggcctgaactgcttgagtcagctga

SEQ ID NO: 616978 - DNA, 25 bp, Mus musculus
ggcctgaacttgaactgagccccag

SEQ ID NO: 616979 - DNA, 25 bp, Mus musculus
ggcctgaacttgtactgagccccag

SEQ ID NO: 616980 - DNA, 25 bp, Mus musculus
ggcctgaatctgagtacttcttcaa

SEQ ID NO: 616981 - DNA, 25 bp, Mus musculus
ggcctgaatctgtgtacttcttcaa

SEQ ID NO: 616982 - DNA, 25 bp, Mus musculus
ggcctgaatgtcattgtgaagccat

SEQ ID NO: 616983 - DNA, 25 bp, Mus musculus
ggcctgaatgtctttgtgaagccat

SEQ ID NO: 616984 - DNA, 25 bp, Mus musculus
ggcctgaatgtgaacagcatgctca

SEQ ID NO: 616985 - DNA, 25 bp, Mus musculus
ggcctgaatgtgtacagcatgctca

SEQ ID NO: 616986 - DNA, 25 bp, Mus musculus
ggcctgacacgtatgacagtgaaga

SEQ ID NO: 616987 - DNA, 25 bp, Mus musculus
ggcctgacacgtttgacagtgaaga

SEQ ID NO: 616988 - DNA, 25 bp, Mus musculus
ggcctgaccacaagctggcgaccaa

SEQ ID NO: 616989 - DNA, 25 bp, Mus musculus
ggcctgaccacatgctggcgaccaa

SEQ ID NO: 616990 - DNA, 25 bp, Mus musculus
ggcctgacctgacaatacctgaaat

SEQ ID NO: 616991 - DNA, 25 bp, Mus musculus
ggcctgacctgagaatacctgaaat

SEQ ID NO: 616992 - DNA, 25 bp, Mus musculus
ggcctgacggcaagggagatcatct

SEQ ID NO: 616993 - DNA, 25 bp, Mus musculus
ggcctgacggcatgggagatcatct

SEQ ID NO: 616994 - DNA, 25 bp, Mus musculus
ggcctgactctgatggagtgatgat

SEQ ID NO: 616995 - DNA, 25 bp, Mus musculus
ggcctgactctgttggagtgatgat

SEQ ID NO: 616996 - DNA, 25 bp, Mus musculus
ggcctgactgacctgatattcaatc

SEQ ID NO: 616997 - DNA, 25 bp, Mus musculus
ggcctgactgacgtgatattcaatc

SEQ ID NO: 616998 - DNA, 25 bp, Mus musculus
ggcctgagaactccacggcagtaac

SEQ ID NO: 616999 - DNA, 25 bp, Mus musculus
ggcctgagaactgcacggcagtaac

SEQ ID NO: 617000 - DNA, 25 bp, Mus musculus
ggcctgagatgacaacgacaataaa

SEQ ID NO: 617001 - DNA, 25 bp, Mus musculus
ggcctgagatgagaacgacaataaa

SEQ ID NO: 617002 - DNA, 25 bp, Mus musculus
ggcctgagattaatcaatagattat

SEQ ID NO: 617003 - DNA, 25 bp, Mus musculus
ggcctgagattattcaatagattat

SEQ ID NO: 617004 - DNA, 25 bp, Mus musculus
ggcctgagccaacacgtgctgatta

SEQ ID NO: 617005 - DNA, 25 bp, Mus musculus
ggcctgagccaagacgtgctgatta

SEQ ID NO: 617006 - DNA, 25 bp, Mus musculus
ggcctgagccagcataccttcaaaa

SEQ ID NO: 617007 - DNA, 25 bp, Mus musculus
ggcctgagccaggataccttcaaaa

SEQ ID NO: 617008 - DNA, 25 bp, Mus musculus
ggcctgagctatacagcatgagcat

SEQ ID NO: 617009 - DNA, 25 bp, Mus musculus
ggcctgagctatctctatccaagag

SEQ ID NO: 617010 - DNA, 25 bp, Mus musculus
ggcctgagctatgtctatccaagag

SEQ ID NO: 617011 - DNA, 25 bp, Mus musculus
ggcctgagctattcagcatgagcat

SEQ ID NO: 617012 - DNA, 25 bp, Mus musculus
ggcctgaggattacggcagtgccct

SEQ ID NO: 617013 - DNA, 25 bp, Mus musculus
ggcctgaggatttcggcagtgccct

SEQ ID NO: 617014 - DNA, 25 bp, Mus musculus
ggcctgaggcggacaatgctgatgt

SEQ ID NO: 617015 - DNA, 25 bp, Mus musculus
ggcctgaggcggtcaatgctgatgt

SEQ ID NO: 617016 - DNA, 25 bp, Mus musculus
ggcctgagggttcctattggaccat

SEQ ID NO: 617017 - DNA, 25 bp, Mus musculus
ggcctgagggttgctattggaccat

SEQ ID NO: 617018 - DNA, 25 bp, Mus musculus
ggcctgaggtgtagatacacccggt

SEQ ID NO: 617019 - DNA, 25 bp, Mus musculus
ggcctgaggtgttgatacacccggt

SEQ ID NO: 617020 - DNA, 25 bp, Mus musculus
ggcctgagtcagcatggccaccgat

SEQ ID NO: 617021 - DNA, 25 bp, Mus musculus
ggcctgagtcaggatggccaccgat

SEQ ID NO: 617022 - DNA, 25 bp, Mus musculus
ggcctgagtctgcagtgattctcct

SEQ ID NO: 617023 - DNA, 25 bp, Mus musculus
ggcctgagtctggagtgattctcct

SEQ ID NO: 617024 - DNA, 25 bp, Mus musculus
ggcctgagtgacagggccaacatta

SEQ ID NO: 617025 - DNA, 25 bp, Mus musculus
ggcctgagtgactgggccaacatta

SEQ ID NO: 617026 - DNA, 25 bp, Mus musculus
ggcctgagtgtcacttgtacgcact

SEQ ID NO: 617027 - DNA, 25 bp, Mus musculus
ggcctgagtgtctcttgtacgcact

SEQ ID NO: 617028 - DNA, 25 bp, Mus musculus
ggcctgatcctgaaatagggttgtg

SEQ ID NO: 617029 - DNA, 25 bp, Mus musculus
ggcctgatcctgtaatagggttgtg

SEQ ID NO: 617030 - DNA, 25 bp, Mus musculus
ggcctgatctctctgccgcagagaa

SEQ ID NO: 617031 - DNA, 25 bp, Mus musculus
ggcctgatctctgtgccgcagagaa

SEQ ID NO: 617032 - DNA, 25 bp, Mus musculus
ggcctgatgatgcatgcctacaatc

SEQ ID NO: 617033 - DNA, 25 bp, Mus musculus
ggcctgatgatggatgcctacaatc

SEQ ID NO: 617034 - DNA, 25 bp, Mus musculus
ggcctgatgttacagcagtcgctta

SEQ ID NO: 617035 - DNA, 25 bp, Mus musculus
ggcctgatgttagagcagtcgctta

SEQ ID NO: 617036 - DNA, 25 bp, Mus musculus
ggcctgattggcagggaactcgatt

SEQ ID NO: 617037 - DNA, 25 bp, Mus musculus
ggcctgattggctgggaactcgatt

SEQ ID NO: 617038 - DNA, 25 bp, Mus musculus
ggcctgcaaggtagggctttgatcc

SEQ ID NO: 617039 - DNA, 25 bp, Mus musculus
ggcctgcaaggttgggctttgatcc

SEQ ID NO: 617040 - DNA, 25 bp, Mus musculus
ggcctgcacaggccaagccctttag

SEQ ID NO: 617041 - DNA, 25 bp, Mus musculus
ggcctgcacagggcaagccctttag

SEQ ID NO: 617042 - DNA, 25 bp, Mus musculus
ggcctgcacagtaattcctggttaa

SEQ ID NO: 617043 - DNA, 25 bp, Mus musculus
ggcctgcacagttattcctggttaa

SEQ ID NO: 617044 - DNA, 25 bp, Mus musculus
ggcctgcagaccctcaagtttgaaa

SEQ ID NO: 617045 - DNA, 25 bp, Mus musculus
ggcctgcagaccgtcaagtttgaaa

SEQ ID NO: 617046 - DNA, 25 bp, Mus musculus
ggcctgcagagtagattcctgtact

SEQ ID NO: 617047 - DNA, 25 bp, Mus musculus
ggcctgcagagtagttggtgttctt

SEQ ID NO: 617048 - DNA, 25 bp, Mus musculus
ggcctgcagagttgattcctgtact

SEQ ID NO: 617049 - DNA, 25 bp, Mus musculus
ggcctgcagagttgttggtgttctt

SEQ ID NO: 617050 - DNA, 25 bp, Mus musculus
ggcctgcagcctcacaaggtgcctg

SEQ ID NO: 617051 - DNA, 25 bp, Mus musculus
ggcctgcagcctgacaaggtgcctg

SEQ ID NO: 617052 - DNA, 25 bp, Mus musculus
ggcctgcagcgcatctcattgttag

SEQ ID NO: 617053 - DNA, 25 bp, Mus musculus
ggcctgcagcgcttctcattgttag

SEQ ID NO: 617054 - DNA, 25 bp, Mus musculus
ggcctgcagcttccaacgaacggtt

SEQ ID NO: 617055 - DNA, 25 bp, Mus musculus
ggcctgcagcttgcaacgaacggtt

SEQ ID NO: 617056 - DNA, 25 bp, Mus musculus
ggcctgcaggcgaacacagaagtga

SEQ ID NO: 617057 - DNA, 25 bp, Mus musculus
ggcctgcaggcgtacacagaagtga

SEQ ID NO: 617058 - DNA, 25 bp, Mus musculus
ggcctgcagtagatgttgatgtttc

SEQ ID NO: 617059 - DNA, 25 bp, Mus musculus
ggcctgcagtagttgttgatgtttc

SEQ ID NO: 617060 - DNA, 25 bp, Mus musculus
ggcctgcagtgcctgaaatacattg

SEQ ID NO: 617061 - DNA, 25 bp, Mus musculus
ggcctgcagtgcgtgaaatacattg

SEQ ID NO: 617062 - DNA, 25 bp, Mus musculus
ggcctgcataatatgccttcactga

SEQ ID NO: 617063 - DNA, 25 bp, Mus musculus
ggcctgcataatttgccttcactga

SEQ ID NO: 617064 - DNA, 25 bp, Mus musculus
ggcctgcatttaacaccaatgggaa

SEQ ID NO: 617065 - DNA, 25 bp, Mus musculus
ggcctgcatttatcaccaatgggaa

SEQ ID NO: 617066 - DNA, 25 bp, Mus musculus
ggcctgccagaactatcggtgattt

SEQ ID NO: 617067 - DNA, 25 bp, Mus musculus
ggcctgccagaagtatcggtgattt

SEQ ID NO: 617068 - DNA, 25 bp, Mus musculus
ggcctgccagggattggtgtacctt

SEQ ID NO: 617069 - DNA, 25 bp, Mus musculus
ggcctgccagggtttggtgtacctt

SEQ ID NO: 617070 - DNA, 25 bp, Mus musculus
ggcctgccagtgattcagggtataa

SEQ ID NO: 617071 - DNA, 25 bp, Mus musculus
ggcctgccagtgtttcagggtataa

SEQ ID NO: 617072 - DNA, 25 bp, Mus musculus
ggcctgccattgctagttgtttata

SEQ ID NO: 617073 - DNA, 25 bp, Mus musculus
ggcctgccattggtagttgtttata

SEQ ID NO: 617074 - DNA, 25 bp, Mus musculus
ggcctgccccgaagaggtcagagac

SEQ ID NO: 617075 - DNA, 25 bp, Mus musculus
ggcctgccccgatgaggtcagagac

SEQ ID NO: 617076 - DNA, 25 bp, Mus musculus
ggcctgcccggcagtgacgtcatcg

SEQ ID NO: 617077 - DNA, 25 bp, Mus musculus
ggcctgcccggctgtgacgtcatcg

SEQ ID NO: 617078 - DNA, 25 bp, Mus musculus
ggcctgccctaactggtataatcct

SEQ ID NO: 617079 - DNA, 25 bp, Mus musculus
ggcctgccctaagtggtataatcct

SEQ ID NO: 617080 - DNA, 25 bp, Mus musculus
ggcctgccgggtaggagcattcata

SEQ ID NO: 617081 - DNA, 25 bp, Mus musculus
ggcctgccgggttggagcattcata

SEQ ID NO: 617082 - DNA, 25 bp, Mus musculus
ggcctgcctaaaagatactgagttt

SEQ ID NO: 617083 - DNA, 25 bp, Mus musculus
ggcctgcctaaatgatactgagttt

SEQ ID NO: 617084 - DNA, 25 bp, Mus musculus
ggcctgcctagcacctcagtggaga

SEQ ID NO: 617085 - DNA, 25 bp, Mus musculus
ggcctgcctagctcctcagtggaga

SEQ ID NO: 617086 - DNA, 25 bp, Mus musculus
ggcctgcctcagaatgacttttcat

SEQ ID NO: 617087 - DNA, 25 bp, Mus musculus
ggcctgcctcagtatgacttttcat

SEQ ID NO: 617088 - DNA, 25 bp, Mus musculus
ggcctgcctggcagtggtatgccta

SEQ ID NO: 617089 - DNA, 25 bp, Mus musculus
ggcctgcctggctgtggtatgccta

SEQ ID NO: 617090 - DNA, 25 bp, Mus musculus
ggcctgcctgtgatactacaggatg

SEQ ID NO: 617091 - DNA, 25 bp, Mus musculus
ggcctgcctgtgttactacaggatg

SEQ ID NO: 617092 - DNA, 25 bp, Mus musculus
ggcctgctagccagtctgagaactc

SEQ ID NO: 617093 - DNA, 25 bp, Mus musculus
ggcctgctagcctgtctgagaactc

SEQ ID NO: 617094 - DNA, 25 bp, Mus musculus
ggcctgctagtcataaactttctag

SEQ ID NO: 617095 - DNA, 25 bp, Mus musculus
ggcctgctagtcttaaactttctag

SEQ ID NO: 617096 - DNA, 25 bp, Mus musculus
ggcctgctatgtactgctttcttca

SEQ ID NO: 617097 - DNA, 25 bp, Mus musculus
ggcctgctatgttctgctttcttca

SEQ ID NO: 617098 - DNA, 25 bp, Mus musculus
ggcctgctcataacttctggaacgg

SEQ ID NO: 617099 - DNA, 25 bp, Mus musculus
ggcctgctcatatcttctggaacgg

SEQ ID NO: 617100 - DNA, 25 bp, Mus musculus
ggcctgctccagctattcacaggag

SEQ ID NO: 617101 - DNA, 25 bp, Mus musculus
ggcctgctccaggtattcacaggag

SEQ ID NO: 617102 - DNA, 25 bp, Mus musculus
ggcctgctcggacattaatctttga

SEQ ID NO: 617103 - DNA, 25 bp, Mus musculus
ggcctgctcggagattaatctttga

SEQ ID NO: 617104 - DNA, 25 bp, Mus musculus
ggcctgctctccaagatgagtctga

SEQ ID NO: 617105 - DNA, 25 bp, Mus musculus
ggcctgctctcctagatgagtctga

SEQ ID NO: 617106 - DNA, 25 bp, Mus musculus
ggcctgctgagaaccatgaagtttc

SEQ ID NO: 617107 - DNA, 25 bp, Mus musculus
ggcctgctgagatccatgaagtttc

SEQ ID NO: 617108 - DNA, 25 bp, Mus musculus
ggcctgctgagcaacttttcatcaa

SEQ ID NO: 617109 - DNA, 25 bp, Mus musculus
ggcctgctgagctacttttcatcaa

SEQ ID NO: 617110 - DNA, 25 bp, Mus musculus
ggcctgctgctaaggtcagttgtca

SEQ ID NO: 617111 - DNA, 25 bp, Mus musculus
ggcctgctgctatggtcagttgtca

SEQ ID NO: 617112 - DNA, 25 bp, Mus musculus
ggcctgctggccctaaaagctacag

SEQ ID NO: 617113 - DNA, 25 bp, Mus musculus
ggcctgctggccgtaaaagctacag

SEQ ID NO: 617114 - DNA, 25 bp, Mus musculus
ggcctgctgtacaaacatctgttat

SEQ ID NO: 617115 - DNA, 25 bp, Mus musculus
ggcctgctgtactaacatctgttat

SEQ ID NO: 617116 - DNA, 25 bp, Mus musculus
ggcctgctgtgcaagtttgttgcaa

SEQ ID NO: 617117 - DNA, 25 bp, Mus musculus
ggcctgctgtgctagtttgttgcaa

SEQ ID NO: 617118 - DNA, 25 bp, Mus musculus
ggcctgcttctacttttattctgga

SEQ ID NO: 617119 - DNA, 25 bp, Mus musculus
ggcctgcttctagttttattctgga

SEQ ID NO: 617120 - DNA, 25 bp, Mus musculus
ggcctgcttgggagagtagcccata

SEQ ID NO: 617121 - DNA, 25 bp, Mus musculus
ggcctgcttgggtgagtagcccata

SEQ ID NO: 617122 - DNA, 25 bp, Mus musculus
ggcctgctttgaaagggctctgaaa

SEQ ID NO: 617123 - DNA, 25 bp, Mus musculus
ggcctgctttgatagggctctgaaa

SEQ ID NO: 617124 - DNA, 25 bp, Mus musculus
ggcctggacaagaccatgaacgcga

SEQ ID NO: 617125 - DNA, 25 bp, Mus musculus
ggcctggacaagtccatgaacgcga

SEQ ID NO: 617126 - DNA, 25 bp, Mus musculus
ggcctggacaatcacgcagtatatt

SEQ ID NO: 617127 - DNA, 25 bp, Mus musculus
ggcctggacaatgacgcagtatatt

SEQ ID NO: 617128 - DNA, 25 bp, Mus musculus
ggcctggaccttagagatcaccctg

SEQ ID NO: 617129 - DNA, 25 bp, Mus musculus
ggcctggacctttgagatcaccctg

SEQ ID NO: 617130 - DNA, 25 bp, Mus musculus
ggcctggacgatcaccttagtaaat

SEQ ID NO: 617131 - DNA, 25 bp, Mus musculus
ggcctggacgatgaccttagtaaat

SEQ ID NO: 617132 - DNA, 25 bp, Mus musculus
ggcctggactcccatccagtggatg

SEQ ID NO: 617133 - DNA, 25 bp, Mus musculus
ggcctggactccgatccagtggatg

SEQ ID NO: 617134 - DNA, 25 bp, Mus musculus
ggcctggactctcacatttatctga

SEQ ID NO: 617135 - DNA, 25 bp, Mus musculus
ggcctggactctgacatttatctga

SEQ ID NO: 617136 - DNA, 25 bp, Mus musculus
ggcctggagaaaaattcaccggtta

SEQ ID NO: 617137 - DNA, 25 bp, Mus musculus
ggcctggagaaatattcaccggtta

SEQ ID NO: 617138 - DNA, 25 bp, Mus musculus
ggcctggaggacacgtttctccaaa

SEQ ID NO: 617139 - DNA, 25 bp, Mus musculus
ggcctggaggactcgtttctccaaa

SEQ ID NO: 617140 - DNA, 25 bp, Mus musculus
ggcctggagggcaaacactgaagtc

SEQ ID NO: 617141 - DNA, 25 bp, Mus musculus
ggcctggagggctaacactgaagtc

SEQ ID NO: 617142 - DNA, 25 bp, Mus musculus
ggcctggatgacatctttctggaca

SEQ ID NO: 617143 - DNA, 25 bp, Mus musculus
ggcctggatgacttctttctggaca

SEQ ID NO: 617144 - DNA, 25 bp, Mus musculus
ggcctggattggagattaatatttt

SEQ ID NO: 617145 - DNA, 25 bp, Mus musculus
ggcctggattggtgattaatatttt

SEQ ID NO: 617146 - DNA, 25 bp, Mus musculus
ggcctggatttaactccaacatgaa

SEQ ID NO: 617147 - DNA, 25 bp, Mus musculus
ggcctggatttatctccaacatgaa

SEQ ID NO: 617148 - DNA, 25 bp, Mus musculus
ggcctggcaggcacctataagttca

SEQ ID NO: 617149 - DNA, 25 bp, Mus musculus
ggcctggcaggctcctataagttca

SEQ ID NO: 617150 - DNA, 25 bp, Mus musculus
ggcctggcagtcactgaagggcata

SEQ ID NO: 617151 - DNA, 25 bp, Mus musculus
ggcctggcagtctctgaagggcata

SEQ ID NO: 617152 - DNA, 25 bp, Mus musculus
ggcctggcatacaggaagcatttaa

SEQ ID NO: 617153 - DNA, 25 bp, Mus musculus
ggcctggcatactggaagcatttaa

SEQ ID NO: 617154 - DNA, 25 bp, Mus musculus
ggcctggccaaaaagagacacctgt

SEQ ID NO: 617155 - DNA, 25 bp, Mus musculus
ggcctggccaaatagagacacctgt

SEQ ID NO: 617156 - DNA, 25 bp, Mus musculus
ggcctggccaatagtcacaagcttt

SEQ ID NO: 617157 - DNA, 25 bp, Mus musculus
ggcctggccaattgtcacaagcttt

SEQ ID NO: 617158 - DNA, 25 bp, Mus musculus
ggcctggccgacagcctgcaactgg

SEQ ID NO: 617159 - DNA, 25 bp, Mus musculus
ggcctggccgactgcctgcaactgg

SEQ ID NO: 617160 - DNA, 25 bp, Mus musculus
ggcctggcctaactctagtactgtg

SEQ ID NO: 617161 - DNA, 25 bp, Mus musculus
ggcctggcctaagtctagtactgtg

SEQ ID NO: 617162 - DNA, 25 bp, Mus musculus
ggcctggcctcaaatagtaactcta

SEQ ID NO: 617163 - DNA, 25 bp, Mus musculus
ggcctggcctcatatagtaactcta

SEQ ID NO: 617164 - DNA, 25 bp, Mus musculus
ggcctggccttcaacgtgcaatcca

SEQ ID NO: 617165 - DNA, 25 bp, Mus musculus
ggcctggccttctacgtgcaatcca

SEQ ID NO: 617166 - DNA, 25 bp, Mus musculus
ggcctggcgctaaaataccttctca

SEQ ID NO: 617167 - DNA, 25 bp, Mus musculus
ggcctggcgctataataccttctca

SEQ ID NO: 617168 - DNA, 25 bp, Mus musculus
ggcctggctaatccgcaagtggtca

SEQ ID NO: 617169 - DNA, 25 bp, Mus musculus
ggcctggctaatcttctgggtcatt

SEQ ID NO: 617170 - DNA, 25 bp, Mus musculus
ggcctggctaatgcgcaagtggtca

SEQ ID NO: 617171 - DNA, 25 bp, Mus musculus
ggcctggctaatgttctgggtcatt

SEQ ID NO: 617172 - DNA, 25 bp, Mus musculus
ggcctggctatcctatttgttcacc

SEQ ID NO: 617173 - DNA, 25 bp, Mus musculus
ggcctggctatcgtatttgttcacc

SEQ ID NO: 617174 - DNA, 25 bp, Mus musculus
ggcctggctcacaggcactcaggaa

SEQ ID NO: 617175 - DNA, 25 bp, Mus musculus
ggcctggctcactggcactcaggaa

SEQ ID NO: 617176 - DNA, 25 bp, Mus musculus
ggcctggctcagaacctatttattg

SEQ ID NO: 617177 - DNA, 25 bp, Mus musculus
ggcctggctcagtacctatttattg

SEQ ID NO: 617178 - DNA, 25 bp, Mus musculus
ggcctggctccactgaatcaggaag

SEQ ID NO: 617179 - DNA, 25 bp, Mus musculus
ggcctggctccagtgaatcaggaag

SEQ ID NO: 617180 - DNA, 25 bp, Mus musculus
ggcctggctcgaagccttaccaaga

SEQ ID NO: 617181 - DNA, 25 bp, Mus musculus
ggcctggctcgatgccttaccaaga

SEQ ID NO: 617182 - DNA, 25 bp, Mus musculus
ggcctggctgccacataggtatgaa

SEQ ID NO: 617183 - DNA, 25 bp, Mus musculus
ggcctggctgccattaaccaaaggg

SEQ ID NO: 617184 - DNA, 25 bp, Mus musculus
ggcctggctgcctcataggtatgaa

SEQ ID NO: 617185 - DNA, 25 bp, Mus musculus
ggcctggctgcctttaaccaaaggg

SEQ ID NO: 617186 - DNA, 25 bp, Mus musculus
ggcctggctgtaaattctcagtaaa

SEQ ID NO: 617187 - DNA, 25 bp, Mus musculus
ggcctggctgtatattctcagtaaa

SEQ ID NO: 617188 - DNA, 25 bp, Mus musculus
ggcctggcttaccagaccttttgct

SEQ ID NO: 617189 - DNA, 25 bp, Mus musculus
ggcctggcttacgagaccttttgct

SEQ ID NO: 617190 - DNA, 25 bp, Mus musculus
ggcctgggaaccaggcaacctagaa

SEQ ID NO: 617191 - DNA, 25 bp, Mus musculus
ggcctgggaacctggcaacctagaa

SEQ ID NO: 617192 - DNA, 25 bp, Mus musculus
ggcctgggaggcaatgatctcaaac

SEQ ID NO: 617193 - DNA, 25 bp, Mus musculus
ggcctgggaggctatgatctcaaac

SEQ ID NO: 617194 - DNA, 25 bp, Mus musculus
ggcctgggattgagactttactgtt

SEQ ID NO: 617195 - DNA, 25 bp, Mus musculus
ggcctgggattgtgactttactgtt

SEQ ID NO: 617196 - DNA, 25 bp, Mus musculus
ggcctgggcataaattctgtgatga

SEQ ID NO: 617197 - DNA, 25 bp, Mus musculus
ggcctgggcatatattctgtgatga

SEQ ID NO: 617198 - DNA, 25 bp, Mus musculus
ggcctgggcctgaacccaggaacag

SEQ ID NO: 617199 - DNA, 25 bp, Mus musculus
ggcctgggcctgtacccaggaacag

SEQ ID NO: 617200 - DNA, 25 bp, Mus musculus
ggcctgggcgccctgagttcttcaa

SEQ ID NO: 617201 - DNA, 25 bp, Mus musculus
ggcctgggcgccgtgagttcttcaa

SEQ ID NO: 617202 - DNA, 25 bp, Mus musculus
ggcctgggtcgcaaggcccaagcaa

SEQ ID NO: 617203 - DNA, 25 bp, Mus musculus
ggcctgggtcgctaggcccaagcaa

SEQ ID NO: 617204 - DNA, 25 bp, Mus musculus
ggcctgggtctcactggtgtcctca

SEQ ID NO: 617205 - DNA, 25 bp, Mus musculus
ggcctgggtctctctggtgtcctca

SEQ ID NO: 617206 - DNA, 25 bp, Mus musculus
ggcctgggtcttcacattttggtat

SEQ ID NO: 617207 - DNA, 25 bp, Mus musculus
ggcctgggtcttgacattttggtat

SEQ ID NO: 617208 - DNA, 25 bp, Mus musculus
ggcctgggtgtgagaacctaagacc

SEQ ID NO: 617209 - DNA, 25 bp, Mus musculus
ggcctgggtgtgtgaacctaagacc

SEQ ID NO: 617210 - DNA, 25 bp, Mus musculus
ggcctggtacgactatgtacaaaat

SEQ ID NO: 617211 - DNA, 25 bp, Mus musculus
ggcctggtacgagtatgtacaaaat

SEQ ID NO: 617212 - DNA, 25 bp, Mus musculus
ggcctggtacgtattcatctgttga

SEQ ID NO: 617213 - DNA, 25 bp, Mus musculus
ggcctggtacgttttcatctgttga

SEQ ID NO: 617214 - DNA, 25 bp, Mus musculus
ggcctggtacttcgaaggtgtccta

SEQ ID NO: 617215 - DNA, 25 bp, Mus musculus
ggcctggtacttggaaggtgtccta

SEQ ID NO: 617216 - DNA, 25 bp, Mus musculus
ggcctggtatccaaaacatctcgag

SEQ ID NO: 617217 - DNA, 25 bp, Mus musculus
ggcctggtatcctaaacatctcgag

SEQ ID NO: 617218 - DNA, 25 bp, Mus musculus
ggcctggtatgcagtatcttgttac

SEQ ID NO: 617219 - DNA, 25 bp, Mus musculus
ggcctggtatgctgtatcttgttac

SEQ ID NO: 617220 - DNA, 25 bp, Mus musculus
ggcctggtatttccagcttcagtga

SEQ ID NO: 617221 - DNA, 25 bp, Mus musculus
ggcctggtatttgcagcttcagtga

SEQ ID NO: 617222 - DNA, 25 bp, Mus musculus
ggcctggtcataccctggaagccat

SEQ ID NO: 617223 - DNA, 25 bp, Mus musculus
ggcctggtcatagcctggaagccat

SEQ ID NO: 617224 - DNA, 25 bp, Mus musculus
ggcctggtgccactgcggtgggcga

SEQ ID NO: 617225 - DNA, 25 bp, Mus musculus
ggcctggtgccagtgcggtgggcga

SEQ ID NO: 617226 - DNA, 25 bp, Mus musculus
ggcctggtgttcactgtgtagctta

SEQ ID NO: 617227 - DNA, 25 bp, Mus musculus
ggcctggtgttctctgtgtagctta

SEQ ID NO: 617228 - DNA, 25 bp, Mus musculus
ggcctggttaaaatgactgactcta

SEQ ID NO: 617229 - DNA, 25 bp, Mus musculus
ggcctggttaaattgactgactcta

SEQ ID NO: 617230 - DNA, 25 bp, Mus musculus
ggcctggttactattcggaatgcat

SEQ ID NO: 617231 - DNA, 25 bp, Mus musculus
ggcctggttacttttcggaatgcat

SEQ ID NO: 617232 - DNA, 25 bp, Mus musculus
ggcctggttatgcatcaacactctt

SEQ ID NO: 617233 - DNA, 25 bp, Mus musculus
ggcctggttatggatcaacactctt

SEQ ID NO: 617234 - DNA, 25 bp, Mus musculus
ggcctggttcagaaagaactcacaa

SEQ ID NO: 617235 - DNA, 25 bp, Mus musculus
ggcctggttcagtaagaactcacaa

SEQ ID NO: 617236 - DNA, 25 bp, Mus musculus
ggcctggttcatccgtgaatccatg

SEQ ID NO: 617237 - DNA, 25 bp, Mus musculus
ggcctggttcatgcgtgaatccatg

SEQ ID NO: 617238 - DNA, 25 bp, Mus musculus
ggcctggttggactctagtacatga

SEQ ID NO: 617239 - DNA, 25 bp, Mus musculus
ggcctggttggagtctagtacatga

SEQ ID NO: 617240 - DNA, 25 bp, Mus musculus
ggcctggttggtaccctctgtgaaa

SEQ ID NO: 617241 - DNA, 25 bp, Mus musculus
ggcctggttggttccctctgtgaaa

SEQ ID NO: 617242 - DNA, 25 bp, Mus musculus
ggcctgtaaaccacagcctgcagaa

SEQ ID NO: 617243 - DNA, 25 bp, Mus musculus
ggcctgtaaacctcagcctgcagaa

SEQ ID NO: 617244 - DNA, 25 bp, Mus musculus
ggcctgtaccccacaagtggtggta

SEQ ID NO: 617245 - DNA, 25 bp, Mus musculus
ggcctgtacccctcaagtggtggta

SEQ ID NO: 617246 - DNA, 25 bp, Mus musculus
ggcctgtatgctatccagaaaaccc

SEQ ID NO: 617247 - DNA, 25 bp, Mus musculus
ggcctgtatgctttccagaaaaccc

SEQ ID NO: 617248 - DNA, 25 bp, Mus musculus
ggcctgtatggactgtaacgcgctt

SEQ ID NO: 617249 - DNA, 25 bp, Mus musculus
ggcctgtatggagtgtaacgcgctt

SEQ ID NO: 617250 - DNA, 25 bp, Mus musculus
ggcctgtcaatgctgaatttccttt

SEQ ID NO: 617251 - DNA, 25 bp, Mus musculus
ggcctgtcaatggtgaatttccttt

SEQ ID NO: 617252 - DNA, 25 bp, Mus musculus
ggcctgtcacaaatggtttggaaca

SEQ ID NO: 617253 - DNA, 25 bp, Mus musculus
ggcctgtcacaattggtttggaaca

SEQ ID NO: 617254 - DNA, 25 bp, Mus musculus
ggcctgtcacgtcatatgaaccatt

SEQ ID NO: 617255 - DNA, 25 bp, Mus musculus
ggcctgtcacgtgatatgaaccatt

SEQ ID NO: 617256 - DNA, 25 bp, Mus musculus
ggcctgtcagcaacctgtacaatta

SEQ ID NO: 617257 - DNA, 25 bp, Mus musculus
ggcctgtcagcatcctgtacaatta

SEQ ID NO: 617258 - DNA, 25 bp, Mus musculus
ggcctgtcaggcacctaacactaag

SEQ ID NO: 617259 - DNA, 25 bp, Mus musculus
ggcctgtcaggctcctaacactaag

SEQ ID NO: 617260 - DNA, 25 bp, Mus musculus
ggcctgtcagtaattattgcctcca

SEQ ID NO: 617261 - DNA, 25 bp, Mus musculus
ggcctgtcagtatttattgcctcca

SEQ ID NO: 617262 - DNA, 25 bp, Mus musculus
ggcctgtccctcatcaagttgaaga

SEQ ID NO: 617263 - DNA, 25 bp, Mus musculus
ggcctgtccctcttcaagttgaaga

SEQ ID NO: 617264 - DNA, 25 bp, Mus musculus
ggcctgtcctgactctgaatactga

SEQ ID NO: 617265 - DNA, 25 bp, Mus musculus
ggcctgtcctgagtctgaatactga

SEQ ID NO: 617266 - DNA, 25 bp, Mus musculus
ggcctgtctattcgagatactgcga

SEQ ID NO: 617267 - DNA, 25 bp, Mus musculus
ggcctgtctattggagatactgcga

SEQ ID NO: 617268 - DNA, 25 bp, Mus musculus
ggcctgtctcaacggactgaagatt

SEQ ID NO: 617269 - DNA, 25 bp, Mus musculus
ggcctgtctcaagggactgaagatt

SEQ ID NO: 617270 - DNA, 25 bp, Mus musculus
ggcctgtctcatacctgcaagagga

SEQ ID NO: 617271 - DNA, 25 bp, Mus musculus
ggcctgtctcattcctgcaagagga

SEQ ID NO: 617272 - DNA, 25 bp, Mus musculus
ggcctgtctcttacgttaaaagcca

SEQ ID NO: 617273 - DNA, 25 bp, Mus musculus
ggcctgtctctttcgttaaaagcca

SEQ ID NO: 617274 - DNA, 25 bp, Mus musculus
ggcctgtctgtaactgatattgcag

SEQ ID NO: 617275 - DNA, 25 bp, Mus musculus
ggcctgtctgtatctgatattgcag

SEQ ID NO: 617276 - DNA, 25 bp, Mus musculus
ggcctgtcttttctgagaacattgt

SEQ ID NO: 617277 - DNA, 25 bp, Mus musculus
ggcctgtcttttgtgagaacattgt

SEQ ID NO: 617278 - DNA, 25 bp, Mus musculus
ggcctgtgaaatacaccatccacac

SEQ ID NO: 617279 - DNA, 25 bp, Mus musculus
ggcctgtgaaattcaccatccacac

SEQ ID NO: 617280 - DNA, 25 bp, Mus musculus
ggcctgtgaatcaatggcgaggact

SEQ ID NO: 617281 - DNA, 25 bp, Mus musculus
ggcctgtgaatctatggcgaggact

SEQ ID NO: 617282 - DNA, 25 bp, Mus musculus
ggcctgtgaccaaatgccagcctat

SEQ ID NO: 617283 - DNA, 25 bp, Mus musculus
ggcctgtgaccatatgccagcctat

SEQ ID NO: 617284 - DNA, 25 bp, Mus musculus
ggcctgtgacgcactggacatttat

SEQ ID NO: 617285 - DNA, 25 bp, Mus musculus
ggcctgtgacgctctggacatttat

SEQ ID NO: 617286 - DNA, 25 bp, Mus musculus
ggcctgtgactacaatgtttgtttt

SEQ ID NO: 617287 - DNA, 25 bp, Mus musculus
ggcctgtgactagaatgtttgtttt

SEQ ID NO: 617288 - DNA, 25 bp, Mus musculus
ggcctgtgcaaaagtcctgtgacag

SEQ ID NO: 617289 - DNA, 25 bp, Mus musculus
ggcctgtgcaaatgtcctgtgacag

SEQ ID NO: 617290 - DNA, 25 bp, Mus musculus
ggcctgtgcagtccgacattgtgaa

SEQ ID NO: 617291 - DNA, 25 bp, Mus musculus
ggcctgtgcagtgcgacattgtgaa

SEQ ID NO: 617292 - DNA, 25 bp, Mus musculus
ggcctgtgccagcaatggtcatgca

SEQ ID NO: 617293 - DNA, 25 bp, Mus musculus
ggcctgtgccaggaatggtcatgca

SEQ ID NO: 617294 - DNA, 25 bp, Mus musculus
ggcctgtgctggagtgtcactctgc

SEQ ID NO: 617295 - DNA, 25 bp, Mus musculus
ggcctgtgctggtgtgtcactctgc

SEQ ID NO: 617296 - DNA, 25 bp, Mus musculus
ggcctgtggatccatgccagatgat

SEQ ID NO: 617297 - DNA, 25 bp, Mus musculus
ggcctgtggatcgatgccagatgat

SEQ ID NO: 617298 - DNA, 25 bp, Mus musculus
ggcctgtggccaacagtttgtacat

SEQ ID NO: 617299 - DNA, 25 bp, Mus musculus
ggcctgtggccatcagtttgtacat

SEQ ID NO: 617300 - DNA, 25 bp, Mus musculus
ggcctgtggcctcgagtcctgtaat

SEQ ID NO: 617301 - DNA, 25 bp, Mus musculus
ggcctgtggcctggagtcctgtaat

SEQ ID NO: 617302 - DNA, 25 bp, Mus musculus
ggcctgtgggtaagtctgtgcattt

SEQ ID NO: 617303 - DNA, 25 bp, Mus musculus
ggcctgtgggtatgtctgtgcattt

SEQ ID NO: 617304 - DNA, 25 bp, Mus musculus
ggcctgtgtactcggtacatgccaa

SEQ ID NO: 617305 - DNA, 25 bp, Mus musculus
ggcctgtgtactgggtacatgccaa

SEQ ID NO: 617306 - DNA, 25 bp, Mus musculus
ggcctgtgtgtgaatccaagctctt

SEQ ID NO: 617307 - DNA, 25 bp, Mus musculus
ggcctgtgtgtgtatccaagctctt

SEQ ID NO: 617308 - DNA, 25 bp, Mus musculus
ggcctgtgttgaatcttactctgaa

SEQ ID NO: 617309 - DNA, 25 bp, Mus musculus
ggcctgtgttgattcttactctgaa

SEQ ID NO: 617310 - DNA, 25 bp, Mus musculus
ggcctgttaggtcggcaccctgcag

SEQ ID NO: 617311 - DNA, 25 bp, Mus musculus
ggcctgttaggtgggcaccctgcag

SEQ ID NO: 617312 - DNA, 25 bp, Mus musculus
ggcctgttcaggcttcaaacaaaac

SEQ ID NO: 617313 - DNA, 25 bp, Mus musculus
ggcctgttcagggttcaaacaaaac

SEQ ID NO: 617314 - DNA, 25 bp, Mus musculus
ggcctgttcgttactgtcgatattt

SEQ ID NO: 617315 - DNA, 25 bp, Mus musculus
ggcctgttcgtttctgtcgatattt

SEQ ID NO: 617316 - DNA, 25 bp, Mus musculus
ggcctgttgagcaggttctccaagg

SEQ ID NO: 617317 - DNA, 25 bp, Mus musculus
ggcctgttgagctggttctccaagg

SEQ ID NO: 617318 - DNA, 25 bp, Mus musculus
ggcctgttgcccagctctgtagaca

SEQ ID NO: 617319 - DNA, 25 bp, Mus musculus
ggcctgttgccctgctctgtagaca

SEQ ID NO: 617320 - DNA, 25 bp, Mus musculus
ggcctgttgtctagacgtttggaga

SEQ ID NO: 617321 - DNA, 25 bp, Mus musculus
ggcctgttgtcttgacgtttggaga

SEQ ID NO: 617322 - DNA, 25 bp, Mus musculus
ggcctgtttatcaccattctgataa

SEQ ID NO: 617323 - DNA, 25 bp, Mus musculus
ggcctgtttatctccattctgataa

SEQ ID NO: 617324 - DNA, 25 bp, Mus musculus
ggcctgtttatgagccattcagagg

SEQ ID NO: 617325 - DNA, 25 bp, Mus musculus
ggcctgtttatgtgccattcagagg

SEQ ID NO: 617326 - DNA, 25 bp, Mus musculus
ggcctgtttgatccctctaatgtca

SEQ ID NO: 617327 - DNA, 25 bp, Mus musculus
ggcctgtttgatgcctctaatgtca

SEQ ID NO: 617328 - DNA, 25 bp, Mus musculus
ggccttaaaactagccctagccaat

SEQ ID NO: 617329 - DNA, 25 bp, Mus musculus
ggccttaaaacttgccctagccaat

SEQ ID NO: 617330 - DNA, 25 bp, Mus musculus
ggccttaagcgaactctgattctca

SEQ ID NO: 617331 - DNA, 25 bp, Mus musculus
ggccttaagcgatctctgattctca

SEQ ID NO: 617332 - DNA, 25 bp, Mus musculus
ggccttaagtcaagtcctgtaccat

SEQ ID NO: 617333 - DNA, 25 bp, Mus musculus
ggccttaagtcatgtcctgtaccat

SEQ ID NO: 617334 - DNA, 25 bp, Mus musculus
ggccttaataaacctcctcgaattc

SEQ ID NO: 617335 - DNA, 25 bp, Mus musculus
ggccttaataaagctcctcgaattc

SEQ ID NO: 617336 - DNA, 25 bp, Mus musculus
ggccttaatcacagaccgtacagta

SEQ ID NO: 617337 - DNA, 25 bp, Mus musculus
ggccttaatcactgaccgtacagta

SEQ ID NO: 617338 - DNA, 25 bp, Mus musculus
ggccttacccagacaaacggtcaat

SEQ ID NO: 617339 - DNA, 25 bp, Mus musculus
ggccttacccagtcaaacggtcaat

SEQ ID NO: 617340 - DNA, 25 bp, Mus musculus
ggccttacggatatggactcggagt

SEQ ID NO: 617341 - DNA, 25 bp, Mus musculus
ggccttacggatttggactcggagt

SEQ ID NO: 617342 - DNA, 25 bp, Mus musculus
ggccttactgcccatagcttctgtt

SEQ ID NO: 617343 - DNA, 25 bp, Mus musculus
ggccttactgccgatagcttctgtt

SEQ ID NO: 617344 - DNA, 25 bp, Mus musculus
ggccttactgtgctctgtctgaaac

SEQ ID NO: 617345 - DNA, 25 bp, Mus musculus
ggccttactgtggtctgtctgaaac

SEQ ID NO: 617346 - DNA, 25 bp, Mus musculus
ggccttactgttatcatcagggcta

SEQ ID NO: 617347 - DNA, 25 bp, Mus musculus
ggccttactgttttcatcagggcta

SEQ ID NO: 617348 - DNA, 25 bp, Mus musculus
ggccttacttaaaggagggctcgat

SEQ ID NO: 617349 - DNA, 25 bp, Mus musculus
ggccttacttaatggagggctcgat

SEQ ID NO: 617350 - DNA, 25 bp, Mus musculus
ggccttactttactctctgcttgct

SEQ ID NO: 617351 - DNA, 25 bp, Mus musculus
ggccttactttagtctctgcttgct

SEQ ID NO: 617352 - DNA, 25 bp, Mus musculus
ggccttagaaggctccatcaaccag

SEQ ID NO: 617353 - DNA, 25 bp, Mus musculus
ggccttagaagggtccatcaaccag

SEQ ID NO: 617354 - DNA, 25 bp, Mus musculus
ggccttagcgatactttcattctga

SEQ ID NO: 617355 - DNA, 25 bp, Mus musculus
ggccttagcgattctttcattctga

SEQ ID NO: 617356 - DNA, 25 bp, Mus musculus
ggccttagcggtctgtatctaaact

SEQ ID NO: 617357 - DNA, 25 bp, Mus musculus
ggccttagcggtgtgtatctaaact

SEQ ID NO: 617358 - DNA, 25 bp, Mus musculus
ggccttagctgccttatggttaaag

SEQ ID NO: 617359 - DNA, 25 bp, Mus musculus
ggccttagctgcgttatggttaaag

SEQ ID NO: 617360 - DNA, 25 bp, Mus musculus
ggccttagtgtgaaccttagttctg

SEQ ID NO: 617361 - DNA, 25 bp, Mus musculus
ggccttagtgtgtaccttagttctg

SEQ ID NO: 617362 - DNA, 25 bp, Mus musculus
ggccttatactcaacgcaactgctt

SEQ ID NO: 617363 - DNA, 25 bp, Mus musculus
ggccttatactctacgcaactgctt

SEQ ID NO: 617364 - DNA, 25 bp, Mus musculus
ggccttatatggagacaccctagtt

SEQ ID NO: 617365 - DNA, 25 bp, Mus musculus
ggccttatatggtgacaccctagtt

SEQ ID NO: 617366 - DNA, 25 bp, Mus musculus
ggccttatctatccataacgtttct

SEQ ID NO: 617367 - DNA, 25 bp, Mus musculus
ggccttatctatgcataacgtttct

SEQ ID NO: 617368 - DNA, 25 bp, Mus musculus
ggccttatgctgatgaaatatttaa

SEQ ID NO: 617369 - DNA, 25 bp, Mus musculus
ggccttatgctgttgaaatatttaa

SEQ ID NO: 617370 - DNA, 25 bp, Mus musculus
ggccttatggagaaaactttagaat

SEQ ID NO: 617371 - DNA, 25 bp, Mus musculus
ggccttatggagtaaactttagaat

SEQ ID NO: 617372 - DNA, 25 bp, Mus musculus
ggccttatgttaatactccaaccta

SEQ ID NO: 617373 - DNA, 25 bp, Mus musculus
ggccttatgttattactccaaccta

SEQ ID NO: 617374 - DNA, 25 bp, Mus musculus
ggccttatttctatataggaacaga

SEQ ID NO: 617375 - DNA, 25 bp, Mus musculus
ggccttatttctttataggaacaga

SEQ ID NO: 617376 - DNA, 25 bp, Mus musculus
ggccttcaacatcatgcacatgctt

SEQ ID NO: 617377 - DNA, 25 bp, Mus musculus
ggccttcaacatgatgcacatgctt

SEQ ID NO: 617378 - DNA, 25 bp, Mus musculus
ggccttcacagaattcttgcatgga

SEQ ID NO: 617379 - DNA, 25 bp, Mus musculus
ggccttcacagatttcttgcatgga

SEQ ID NO: 617380 - DNA, 25 bp, Mus musculus
ggccttcacataacgaggactccga

SEQ ID NO: 617381 - DNA, 25 bp, Mus musculus
ggccttcacatatcgaggactccga

SEQ ID NO: 617382 - DNA, 25 bp, Mus musculus
ggccttcacatgcatctttacaata

SEQ ID NO: 617383 - DNA, 25 bp, Mus musculus
ggccttcacatggatctttacaata

SEQ ID NO: 617384 - DNA, 25 bp, Mus musculus
ggccttcactgacacgctgtgtgtg

SEQ ID NO: 617385 - DNA, 25 bp, Mus musculus
ggccttcactgagacgctgtgtgtg

SEQ ID NO: 617386 - DNA, 25 bp, Mus musculus
ggccttcagaagcttcttggcgttt

SEQ ID NO: 617387 - DNA, 25 bp, Mus musculus
ggccttcagaaggttcttggcgttt

SEQ ID NO: 617388 - DNA, 25 bp, Mus musculus
ggccttcagataagcacacgacctt

SEQ ID NO: 617389 - DNA, 25 bp, Mus musculus
ggccttcagatatgcacacgacctt

SEQ ID NO: 617390 - DNA, 25 bp, Mus musculus
ggccttcagccactattcattccta

SEQ ID NO: 617391 - DNA, 25 bp, Mus musculus
ggccttcagccagtattcattccta

SEQ ID NO: 617392 - DNA, 25 bp, Mus musculus
ggccttcagctaagaaactatctca

SEQ ID NO: 617393 - DNA, 25 bp, Mus musculus
ggccttcagctatgaaactatctca

SEQ ID NO: 617394 - DNA, 25 bp, Mus musculus
ggccttcagcttctgatcctcctgt

SEQ ID NO: 617395 - DNA, 25 bp, Mus musculus
ggccttcagcttgtgatcctcctgt

SEQ ID NO: 617396 - DNA, 25 bp, Mus musculus
ggccttcaggataggaacaaggagc

SEQ ID NO: 617397 - DNA, 25 bp, Mus musculus
ggccttcaggatcgaggtgaacata

SEQ ID NO: 617398 - DNA, 25 bp, Mus musculus
ggccttcaggatggaggtgaacata

SEQ ID NO: 617399 - DNA, 25 bp, Mus musculus
ggccttcaggattggaacaaggagc

SEQ ID NO: 617400 - DNA, 25 bp, Mus musculus
ggccttcagtgcaggatcttgcttc

SEQ ID NO: 617401 - DNA, 25 bp, Mus musculus
ggccttcagtgctggatcttgcttc

SEQ ID NO: 617402 - DNA, 25 bp, Mus musculus
ggccttcatcagctgacttttgaaa

SEQ ID NO: 617403 - DNA, 25 bp, Mus musculus
ggccttcatcaggtgacttttgaaa

SEQ ID NO: 617404 - DNA, 25 bp, Mus musculus
ggccttcatcgactttatgtcccga

SEQ ID NO: 617405 - DNA, 25 bp, Mus musculus
ggccttcatcgagtttatgtcccga

SEQ ID NO: 617406 - DNA, 25 bp, Mus musculus
ggccttcatctaacttgtgtgtttc

SEQ ID NO: 617407 - DNA, 25 bp, Mus musculus
ggccttcatctatcttgtgtgtttc

SEQ ID NO: 617408 - DNA, 25 bp, Mus musculus
ggccttcatgtgacctattgtttca

SEQ ID NO: 617409 - DNA, 25 bp, Mus musculus
ggccttcatgtgtcctattgtttca

SEQ ID NO: 617410 - DNA, 25 bp, Mus musculus
ggccttcatttcaaggtcttcgaga

SEQ ID NO: 617411 - DNA, 25 bp, Mus musculus
ggccttcatttctaggtcttcgaga

SEQ ID NO: 617412 - DNA, 25 bp, Mus musculus
ggccttccaagcattctccacagag

SEQ ID NO: 617413 - DNA, 25 bp, Mus musculus
ggccttccaagctttctccacagag

SEQ ID NO: 617414 - DNA, 25 bp, Mus musculus
ggccttccagacagaagccgagcca

SEQ ID NO: 617415 - DNA, 25 bp, Mus musculus
ggccttccagactgaagccgagcca

SEQ ID NO: 617416 - DNA, 25 bp, Mus musculus
ggccttccaggaacaacacttgact

SEQ ID NO: 617417 - DNA, 25 bp, Mus musculus
ggccttccaggacaagtacttcatg

SEQ ID NO: 617418 - DNA, 25 bp, Mus musculus
ggccttccaggagaagtacttcatg

SEQ ID NO: 617419 - DNA, 25 bp, Mus musculus
ggccttccaggatcaacacttgact

SEQ ID NO: 617420 - DNA, 25 bp, Mus musculus
ggccttcccatacttagcaaaacat

SEQ ID NO: 617421 - DNA, 25 bp, Mus musculus
ggccttcccatagttagcaaaacat

SEQ ID NO: 617422 - DNA, 25 bp, Mus musculus
ggccttccccatacagttgcatata

SEQ ID NO: 617423 - DNA, 25 bp, Mus musculus
ggccttccccattcagttgcatata

SEQ ID NO: 617424 - DNA, 25 bp, Mus musculus
ggccttccctgccaaactggagaat

SEQ ID NO: 617425 - DNA, 25 bp, Mus musculus
ggccttccctgcgaaactggagaat

SEQ ID NO: 617426 - DNA, 25 bp, Mus musculus
ggccttccggtgaaccaagcaagtg

SEQ ID NO: 617427 - DNA, 25 bp, Mus musculus
ggccttccggtgtaccaagcaagtg

SEQ ID NO: 617428 - DNA, 25 bp, Mus musculus
ggccttccgtaaatcagcacagaga

SEQ ID NO: 617429 - DNA, 25 bp, Mus musculus
ggccttccgtaattcagcacagaga

SEQ ID NO: 617430 - DNA, 25 bp, Mus musculus
ggccttcctggtctgttggacgcct

SEQ ID NO: 617431 - DNA, 25 bp, Mus musculus
ggccttcctggtgtgttggacgcct

SEQ ID NO: 617432 - DNA, 25 bp, Mus musculus
ggccttccttgccatcatgatgaaa

SEQ ID NO: 617433 - DNA, 25 bp, Mus musculus
ggccttccttgcgatcatgatgaaa

SEQ ID NO: 617434 - DNA, 25 bp, Mus musculus
ggccttcgagccactgcagacacta

SEQ ID NO: 617435 - DNA, 25 bp, Mus musculus
ggccttcgagcctctgcagacacta

SEQ ID NO: 617436 - DNA, 25 bp, Mus musculus
ggccttcgagttcgtaactttgcct

SEQ ID NO: 617437 - DNA, 25 bp, Mus musculus
ggccttcgagttggtaactttgcct

SEQ ID NO: 617438 - DNA, 25 bp, Mus musculus
ggccttcgtagcaaagtctctgcaa

SEQ ID NO: 617439 - DNA, 25 bp, Mus musculus
ggccttcgtagctaagtctctgcaa

SEQ ID NO: 617440 - DNA, 25 bp, Mus musculus
ggccttcgtgagaaagaccagcatc

SEQ ID NO: 617441 - DNA, 25 bp, Mus musculus
ggccttcgtgagtaagaccagcatc

SEQ ID NO: 617442 - DNA, 25 bp, Mus musculus
ggccttcgttaccatagcagaccat

SEQ ID NO: 617443 - DNA, 25 bp, Mus musculus
ggccttcgttacgatagcagaccat

SEQ ID NO: 617444 - DNA, 25 bp, Mus musculus
ggccttctatgaatagttactctag

SEQ ID NO: 617445 - DNA, 25 bp, Mus musculus
ggccttctatgattagttactctag

SEQ ID NO: 617446 - DNA, 25 bp, Mus musculus
ggccttctcagacaactgcgttaag

SEQ ID NO: 617447 - DNA, 25 bp, Mus musculus
ggccttctcagagaactgcgttaag

SEQ ID NO: 617448 - DNA, 25 bp, Mus musculus
ggccttctcatcattgtctatgatg

SEQ ID NO: 617449 - DNA, 25 bp, Mus musculus
ggccttctcatctttgtctatgatg

SEQ ID NO: 617450 - DNA, 25 bp, Mus musculus
ggccttctcctgagtaggttggcag

SEQ ID NO: 617451 - DNA, 25 bp, Mus musculus
ggccttctcctgtgtaggttggcag

SEQ ID NO: 617452 - DNA, 25 bp, Mus musculus
ggccttctctagatacttccaggtt

SEQ ID NO: 617453 - DNA, 25 bp, Mus musculus
ggccttctctagttacttccaggtt

SEQ ID NO: 617454 - DNA, 25 bp, Mus musculus
ggccttctctttccgatttcagaaa

SEQ ID NO: 617455 - DNA, 25 bp, Mus musculus
ggccttctctttgcgatttcagaaa

SEQ ID NO: 617456 - DNA, 25 bp, Mus musculus
ggccttctgaccaatcagggatggg

SEQ ID NO: 617457 - DNA, 25 bp, Mus musculus
ggccttctgacctatcagggatggg

SEQ ID NO: 617458 - DNA, 25 bp, Mus musculus
ggccttctgagcaaacaggtcttga

SEQ ID NO: 617459 - DNA, 25 bp, Mus musculus
ggccttctgagctaacaggtcttga

SEQ ID NO: 617460 - DNA, 25 bp, Mus musculus
ggccttctgattataccatgtactt

SEQ ID NO: 617461 - DNA, 25 bp, Mus musculus
ggccttctgattttaccatgtactt

SEQ ID NO: 617462 - DNA, 25 bp, Mus musculus
ggccttctggtgctaaacatgcctt

SEQ ID NO: 617463 - DNA, 25 bp, Mus musculus
ggccttctggtggtaaacatgcctt

SEQ ID NO: 617464 - DNA, 25 bp, Mus musculus
ggccttctgtccaaagggcttaatg

SEQ ID NO: 617465 - DNA, 25 bp, Mus musculus
ggccttctgtcctaagggcttaatg

SEQ ID NO: 617466 - DNA, 25 bp, Mus musculus
ggccttctgttgagtggagacccaa

SEQ ID NO: 617467 - DNA, 25 bp, Mus musculus
ggccttctgttgtgtggagacccaa

SEQ ID NO: 617468 - DNA, 25 bp, Mus musculus
ggccttcttatgacacagatttcct

SEQ ID NO: 617469 - DNA, 25 bp, Mus musculus
ggccttcttatgtcacagatttcct

SEQ ID NO: 617470 - DNA, 25 bp, Mus musculus
ggccttcttccaactgataatgcag

SEQ ID NO: 617471 - DNA, 25 bp, Mus musculus
ggccttcttccatctgataatgcag

SEQ ID NO: 617472 - DNA, 25 bp, Mus musculus
ggccttcttgccatcaatgctgtga

SEQ ID NO: 617473 - DNA, 25 bp, Mus musculus
ggccttcttgccttcaatgctgtga

SEQ ID NO: 617474 - DNA, 25 bp, Mus musculus
ggccttctttgccagcaagagaatc

SEQ ID NO: 617475 - DNA, 25 bp, Mus musculus
ggccttctttgcgagcaagagaatc

SEQ ID NO: 617476 - DNA, 25 bp, Mus musculus
ggccttgaactgactatgtgtctaa

SEQ ID NO: 617477 - DNA, 25 bp, Mus musculus
ggccttgaactgtctatgtgtctaa

SEQ ID NO: 617478 - DNA, 25 bp, Mus musculus
ggccttgaagatcccatgaattggg

SEQ ID NO: 617479 - DNA, 25 bp, Mus musculus
ggccttgaagatgccatgaattggg

SEQ ID NO: 617480 - DNA, 25 bp, Mus musculus
ggccttgaagcccaacacgtagcaa

SEQ ID NO: 617481 - DNA, 25 bp, Mus musculus
ggccttgaagccgaacacgtagcaa

SEQ ID NO: 617482 - DNA, 25 bp, Mus musculus
ggccttgaatccactattaattact

SEQ ID NO: 617483 - DNA, 25 bp, Mus musculus
ggccttgaatcctctattaattact

SEQ ID NO: 617484 - DNA, 25 bp, Mus musculus
ggccttgacaaactgtaaactccct

SEQ ID NO: 617485 - DNA, 25 bp, Mus musculus
ggccttgacaaagtgtaaactccct

SEQ ID NO: 617486 - DNA, 25 bp, Mus musculus
ggccttgacccacagaagacaggaa

SEQ ID NO: 617487 - DNA, 25 bp, Mus musculus
ggccttgacccagagaagacaggaa

SEQ ID NO: 617488 - DNA, 25 bp, Mus musculus
ggccttgacctcactacttaagtgt

SEQ ID NO: 617489 - DNA, 25 bp, Mus musculus
ggccttgacctctctacttaagtgt

SEQ ID NO: 617490 - DNA, 25 bp, Mus musculus
ggccttgaccttagtaaagaactat

SEQ ID NO: 617491 - DNA, 25 bp, Mus musculus
ggccttgacctttgtaaagaactat

SEQ ID NO: 617492 - DNA, 25 bp, Mus musculus
ggccttgactccataagaaactgtt

SEQ ID NO: 617493 - DNA, 25 bp, Mus musculus
ggccttgactccttaagaaactgtt

SEQ ID NO: 617494 - DNA, 25 bp, Mus musculus
ggccttgactgtcgagacttaattt

SEQ ID NO: 617495 - DNA, 25 bp, Mus musculus
ggccttgactgtggagacttaattt

SEQ ID NO: 617496 - DNA, 25 bp, Mus musculus
ggccttgagaaaccctttgtgtcga

SEQ ID NO: 617497 - DNA, 25 bp, Mus musculus
ggccttgagaaagcctttgtgtcga

SEQ ID NO: 617498 - DNA, 25 bp, Mus musculus
ggccttgagcagcttgagatgttcc

SEQ ID NO: 617499 - DNA, 25 bp, Mus musculus
ggccttgagcaggttgagatgttcc

SEQ ID NO: 617500 - DNA, 25 bp, Mus musculus
ggccttgagccactgagaacttcgg

SEQ ID NO: 617501 - DNA, 25 bp, Mus musculus
ggccttgagccagtgagaacttcgg

SEQ ID NO: 617502 - DNA, 25 bp, Mus musculus
ggccttgagctgaccctctggtaga

SEQ ID NO: 617503 - DNA, 25 bp, Mus musculus
ggccttgagctgtccctctggtaga

SEQ ID NO: 617504 - DNA, 25 bp, Mus musculus
ggccttgatcctcatgagctatgca

SEQ ID NO: 617505 - DNA, 25 bp, Mus musculus
ggccttgatcctgatgagctatgca

SEQ ID NO: 617506 - DNA, 25 bp, Mus musculus
ggccttgatgataatttccatatcc

SEQ ID NO: 617507 - DNA, 25 bp, Mus musculus
ggccttgatgattatttccatatcc

SEQ ID NO: 617508 - DNA, 25 bp, Mus musculus
ggccttgatgtactatggacttgac

SEQ ID NO: 617509 - DNA, 25 bp, Mus musculus
ggccttgatgtagtatggacttgac

SEQ ID NO: 617510 - DNA, 25 bp, Mus musculus
ggccttgcacagattgtccttaatt

SEQ ID NO: 617511 - DNA, 25 bp, Mus musculus
ggccttgcacagtttgtccttaatt

SEQ ID NO: 617512 - DNA, 25 bp, Mus musculus
ggccttgcagacaatgccgacgatg

SEQ ID NO: 617513 - DNA, 25 bp, Mus musculus
ggccttgcagactatgccgacgatg

SEQ ID NO: 617514 - DNA, 25 bp, Mus musculus
ggccttgcagctaatggagactcat

SEQ ID NO: 617515 - DNA, 25 bp, Mus musculus
ggccttgcagcttatggagactcat

SEQ ID NO: 617516 - DNA, 25 bp, Mus musculus
ggccttgcatgaatttcctgtcatt

SEQ ID NO: 617517 - DNA, 25 bp, Mus musculus
ggccttgcatgattttcctgtcatt

SEQ ID NO: 617518 - DNA, 25 bp, Mus musculus
ggccttgcattcacaaagctctgcc

SEQ ID NO: 617519 - DNA, 25 bp, Mus musculus
ggccttgcattctcaaagctctgcc

SEQ ID NO: 617520 - DNA, 25 bp, Mus musculus
ggccttgccagaagagccaatctga

SEQ ID NO: 617521 - DNA, 25 bp, Mus musculus
ggccttgccagatgagccaatctga

SEQ ID NO: 617522 - DNA, 25 bp, Mus musculus
ggccttgctcacatgagaagtgata

SEQ ID NO: 617523 - DNA, 25 bp, Mus musculus
ggccttgctcacttgagaagtgata

SEQ ID NO: 617524 - DNA, 25 bp, Mus musculus
ggccttgctcagaagtgatccatct

SEQ ID NO: 617525 - DNA, 25 bp, Mus musculus
ggccttgctcagtagtgatccatct

SEQ ID NO: 617526 - DNA, 25 bp, Mus musculus
ggccttgctggactttgccactgag

SEQ ID NO: 617527 - DNA, 25 bp, Mus musculus
ggccttgctggagtttgccactgag

SEQ ID NO: 617528 - DNA, 25 bp, Mus musculus
ggccttgctgtactgcacatgctca

SEQ ID NO: 617529 - DNA, 25 bp, Mus musculus
ggccttgctgtagtgcacatgctca

SEQ ID NO: 617530 - DNA, 25 bp, Mus musculus
ggccttgcttgtcctacacaaaggt

SEQ ID NO: 617531 - DNA, 25 bp, Mus musculus
ggccttgcttgtgctacacaaaggt

SEQ ID NO: 617532 - DNA, 25 bp, Mus musculus
ggccttggactcatggctagacgtt

SEQ ID NO: 617533 - DNA, 25 bp, Mus musculus
ggccttggactcttggctagacgtt

SEQ ID NO: 617534 - DNA, 25 bp, Mus musculus
ggccttggatcacctagaagacagt

SEQ ID NO: 617535 - DNA, 25 bp, Mus musculus
ggccttggatcagctagaagacagt

SEQ ID NO: 617536 - DNA, 25 bp, Mus musculus
ggccttggatccagtcttgaacaaa

SEQ ID NO: 617537 - DNA, 25 bp, Mus musculus
ggccttggatcctgtcttgaacaaa

SEQ ID NO: 617538 - DNA, 25 bp, Mus musculus
ggccttggattgctagcagtctcct

SEQ ID NO: 617539 - DNA, 25 bp, Mus musculus
ggccttggattggtagcagtctcct

SEQ ID NO: 617540 - DNA, 25 bp, Mus musculus
ggccttggcattaacatcactggtg

SEQ ID NO: 617541 - DNA, 25 bp, Mus musculus
ggccttggcatttacatcactggtg

SEQ ID NO: 617542 - DNA, 25 bp, Mus musculus
ggccttggcccacttgatgaagttt

SEQ ID NO: 617543 - DNA, 25 bp, Mus musculus
ggccttggcccagttgatgaagttt

SEQ ID NO: 617544 - DNA, 25 bp, Mus musculus
ggccttggcctacgtgctcaggaaa

SEQ ID NO: 617545 - DNA, 25 bp, Mus musculus
ggccttggcctaggtgctcaggaaa

SEQ ID NO: 617546 - DNA, 25 bp, Mus musculus
ggccttggcctcaggacagcttggc

SEQ ID NO: 617547 - DNA, 25 bp, Mus musculus
ggccttggcctctggacagcttggc

SEQ ID NO: 617548 - DNA, 25 bp, Mus musculus
ggccttggcgcgcactctgcaaaga

SEQ ID NO: 617549 - DNA, 25 bp, Mus musculus
ggccttggcgcggactctgcaaaga

SEQ ID NO: 617550 - DNA, 25 bp, Mus musculus
ggccttggctacagcttgtggagat

SEQ ID NO: 617551 - DNA, 25 bp, Mus musculus
ggccttggctactgcttgtggagat

SEQ ID NO: 617552 - DNA, 25 bp, Mus musculus
ggccttggctggattttatcttcta

SEQ ID NO: 617553 - DNA, 25 bp, Mus musculus
ggccttggctggtttttatcttcta

SEQ ID NO: 617554 - DNA, 25 bp, Mus musculus
ggccttgggaatagctgtagctcca

SEQ ID NO: 617555 - DNA, 25 bp, Mus musculus
ggccttgggaattgctgtagctcca

SEQ ID NO: 617556 - DNA, 25 bp, Mus musculus
ggccttgggttaagcatacaatcct

SEQ ID NO: 617557 - DNA, 25 bp, Mus musculus
ggccttgggttatgcatacaatcct

SEQ ID NO: 617558 - DNA, 25 bp, Mus musculus
ggccttgggtttagctaaccgtgat

SEQ ID NO: 617559 - DNA, 25 bp, Mus musculus
ggccttgggttttgctaaccgtgat

SEQ ID NO: 617560 - DNA, 25 bp, Mus musculus
ggccttggttctcttggcttgacaa

SEQ ID NO: 617561 - DNA, 25 bp, Mus musculus
ggccttggttctgttggcttgacaa

SEQ ID NO: 617562 - DNA, 25 bp, Mus musculus
ggccttgtaactctcctgattggaa

SEQ ID NO: 617563 - DNA, 25 bp, Mus musculus
ggccttgtaactgtcctgattggaa

SEQ ID NO: 617564 - DNA, 25 bp, Mus musculus
ggccttgtacatcctaggtagtttc

SEQ ID NO: 617565 - DNA, 25 bp, Mus musculus
ggccttgtacatgctaggtagtttc

SEQ ID NO: 617566 - DNA, 25 bp, Mus musculus
ggccttgtactgagagctggttgtc

SEQ ID NO: 617567 - DNA, 25 bp, Mus musculus
ggccttgtactgtgagctggttgtc

SEQ ID NO: 617568 - DNA, 25 bp, Mus musculus
ggccttgtagggaatattcacagta

SEQ ID NO: 617569 - DNA, 25 bp, Mus musculus
ggccttgtagggtatattcacagta

SEQ ID NO: 617570 - DNA, 25 bp, Mus musculus
ggccttgtcacaagatgtgtatact

SEQ ID NO: 617571 - DNA, 25 bp, Mus musculus
ggccttgtcacatgatgtgtatact

SEQ ID NO: 617572 - DNA, 25 bp, Mus musculus
ggccttgtcatgctgatccctgtga

SEQ ID NO: 617573 - DNA, 25 bp, Mus musculus
ggccttgtcatggtgatccctgtga

SEQ ID NO: 617574 - DNA, 25 bp, Mus musculus
ggccttgtctgcaaaggaagattga

SEQ ID NO: 617575 - DNA, 25 bp, Mus musculus
ggccttgtctgctaaggaagattga

SEQ ID NO: 617576 - DNA, 25 bp, Mus musculus
ggccttgtctgtcttggtgaccatc

SEQ ID NO: 617577 - DNA, 25 bp, Mus musculus
ggccttgtctgtgttggtgaccatc

SEQ ID NO: 617578 - DNA, 25 bp, Mus musculus
ggccttgtgaacaccaagtcagaaa

SEQ ID NO: 617579 - DNA, 25 bp, Mus musculus
ggccttgtgaactccaagtcagaaa

SEQ ID NO: 617580 - DNA, 25 bp, Mus musculus
ggccttgtgaagcatagcacctatc

SEQ ID NO: 617581 - DNA, 25 bp, Mus musculus
ggccttgtgaaggatagcacctatc

SEQ ID NO: 617582 - DNA, 25 bp, Mus musculus
ggccttgtgcctagccatggagaca

SEQ ID NO: 617583 - DNA, 25 bp, Mus musculus
ggccttgtgccttgccatggagaca

SEQ ID NO: 617584 - DNA, 25 bp, Mus musculus
ggccttgtgtctcagcagtgagtaa

SEQ ID NO: 617585 - DNA, 25 bp, Mus musculus
ggccttgtgtctgagcagtgagtaa

SEQ ID NO: 617586 - DNA, 25 bp, Mus musculus
ggccttgttccgaaacactatgtca

SEQ ID NO: 617587 - DNA, 25 bp, Mus musculus
ggccttgttccgtaacactatgtca

SEQ ID NO: 617588 - DNA, 25 bp, Mus musculus
ggccttgttctcactatggtaaaga

SEQ ID NO: 617589 - DNA, 25 bp, Mus musculus
ggccttgttctctctatggtaaaga

SEQ ID NO: 617590 - DNA, 25 bp, Mus musculus
ggccttgttgaacactcaactgtga

SEQ ID NO: 617591 - DNA, 25 bp, Mus musculus
ggccttgttgaagactcaactgtga

SEQ ID NO: 617592 - DNA, 25 bp, Mus musculus
ggccttgttttaattcatatcaatc

SEQ ID NO: 617593 - DNA, 25 bp, Mus musculus
ggccttgttttatttcatatcaatc

SEQ ID NO: 617594 - DNA, 25 bp, Mus musculus
ggccttgttttgatctctcagagag

SEQ ID NO: 617595 - DNA, 25 bp, Mus musculus
ggccttgttttgttctctcagagag

SEQ ID NO: 617596 - DNA, 25 bp, Mus musculus
ggcctttaaaatcgactagtactca

SEQ ID NO: 617597 - DNA, 25 bp, Mus musculus
ggcctttaaaatggactagtactca

SEQ ID NO: 617598 - DNA, 25 bp, Mus musculus
ggcctttaaacacgtatgcgccaaa

SEQ ID NO: 617599 - DNA, 25 bp, Mus musculus
ggcctttaaacaggtatgcgccaaa

SEQ ID NO: 617600 - DNA, 25 bp, Mus musculus
ggcctttaccaaaatagctcagttt

SEQ ID NO: 617601 - DNA, 25 bp, Mus musculus
ggcctttaccaatatagctcagttt

SEQ ID NO: 617602 - DNA, 25 bp, Mus musculus
ggcctttacgagaaacgctgcaaac

SEQ ID NO: 617603 - DNA, 25 bp, Mus musculus
ggcctttacgagtaacgctgcaaac

SEQ ID NO: 617604 - DNA, 25 bp, Mus musculus
ggcctttactatctaagccttcaaa

SEQ ID NO: 617605 - DNA, 25 bp, Mus musculus
ggcctttactatgtaagccttcaaa

SEQ ID NO: 617606 - DNA, 25 bp, Mus musculus
ggcctttagacacgataagcatgta

SEQ ID NO: 617607 - DNA, 25 bp, Mus musculus
ggcctttagacaggataagcatgta

SEQ ID NO: 617608 - DNA, 25 bp, Mus musculus
ggcctttagaggaacaatgctcaat

SEQ ID NO: 617609 - DNA, 25 bp, Mus musculus
ggcctttagaggcaatatcctaatt

SEQ ID NO: 617610 - DNA, 25 bp, Mus musculus
ggcctttagagggaatatcctaatt

SEQ ID NO: 617611 - DNA, 25 bp, Mus musculus
ggcctttagaggtacaatgctcaat

SEQ ID NO: 617612 - DNA, 25 bp, Mus musculus
ggcctttagtctcttgatcactgtc

SEQ ID NO: 617613 - DNA, 25 bp, Mus musculus
ggcctttagtctgttgatcactgtc

SEQ ID NO: 617614 - DNA, 25 bp, Mus musculus
ggcctttatgccaagctttagggat

SEQ ID NO: 617615 - DNA, 25 bp, Mus musculus
ggcctttatgcctagctttagggat

SEQ ID NO: 617616 - DNA, 25 bp, Mus musculus
ggcctttattaaagcaggagtcggc

SEQ ID NO: 617617 - DNA, 25 bp, Mus musculus
ggcctttattaatgcaggagtcggc

SEQ ID NO: 617618 - DNA, 25 bp, Mus musculus
ggcctttcaagaacagtctccacag

SEQ ID NO: 617619 - DNA, 25 bp, Mus musculus
ggcctttcaagatcagtctccacag

SEQ ID NO: 617620 - DNA, 25 bp, Mus musculus
ggcctttcacaactgggagccactg

SEQ ID NO: 617621 - DNA, 25 bp, Mus musculus
ggcctttcacaagtgggagccactg

SEQ ID NO: 617622 - DNA, 25 bp, Mus musculus
ggcctttcagatatgacgatccatg

SEQ ID NO: 617623 - DNA, 25 bp, Mus musculus
ggcctttcagatttgacgatccatg

SEQ ID NO: 617624 - DNA, 25 bp, Mus musculus
ggcctttcagctccagatctctaag

SEQ ID NO: 617625 - DNA, 25 bp, Mus musculus
ggcctttcagctgcagatctctaag

SEQ ID NO: 617626 - DNA, 25 bp, Mus musculus
ggcctttccaaaatgtccatcggga

SEQ ID NO: 617627 - DNA, 25 bp, Mus musculus
ggcctttccaaattgtccatcggga

SEQ ID NO: 617628 - DNA, 25 bp, Mus musculus
ggcctttctctaacttcaaagtcca

SEQ ID NO: 617629 - DNA, 25 bp, Mus musculus
ggcctttctctatcttcaaagtcca

SEQ ID NO: 617630 - DNA, 25 bp, Mus musculus
ggcctttctgggaagatacacacgt

SEQ ID NO: 617631 - DNA, 25 bp, Mus musculus
ggcctttctgggtagatacacacgt

SEQ ID NO: 617632 - DNA, 25 bp, Mus musculus
ggcctttcttacaggactcaacaga

SEQ ID NO: 617633 - DNA, 25 bp, Mus musculus
ggcctttcttactggactcaacaga

SEQ ID NO: 617634 - DNA, 25 bp, Mus musculus
ggcctttgatccagcgagtaattac

SEQ ID NO: 617635 - DNA, 25 bp, Mus musculus
ggcctttgatcctgcgagtaattac

SEQ ID NO: 617636 - DNA, 25 bp, Mus musculus
ggcctttgattgcttgatgactgaa

SEQ ID NO: 617637 - DNA, 25 bp, Mus musculus
ggcctttgattggttgatgactgaa

SEQ ID NO: 617638 - DNA, 25 bp, Mus musculus
ggcctttgatttatgcatagagtaa

SEQ ID NO: 617639 - DNA, 25 bp, Mus musculus
ggcctttgatttttgcatagagtaa

SEQ ID NO: 617640 - DNA, 25 bp, Mus musculus
ggcctttgcagtagataccctgagg

SEQ ID NO: 617641 - DNA, 25 bp, Mus musculus
ggcctttgcagttgataccctgagg

SEQ ID NO: 617642 - DNA, 25 bp, Mus musculus
ggcctttgccataaaacacaatttt

SEQ ID NO: 617643 - DNA, 25 bp, Mus musculus
ggcctttgccattaaacacaatttt

SEQ ID NO: 617644 - DNA, 25 bp, Mus musculus
ggcctttgctcgatatattgtgatc

SEQ ID NO: 617645 - DNA, 25 bp, Mus musculus
ggcctttgctcgttatattgtgatc

SEQ ID NO: 617646 - DNA, 25 bp, Mus musculus
ggcctttgctttaagcagcttctag

SEQ ID NO: 617647 - DNA, 25 bp, Mus musculus
ggcctttgcttttagcagcttctag

SEQ ID NO: 617648 - DNA, 25 bp, Mus musculus
ggcctttggaggctcaaacaaatca

SEQ ID NO: 617649 - DNA, 25 bp, Mus musculus
ggcctttggagggtcaaacaaatca

SEQ ID NO: 617650 - DNA, 25 bp, Mus musculus
ggcctttggcttacactggtggaga

SEQ ID NO: 617651 - DNA, 25 bp, Mus musculus
ggcctttggctttcactggtggaga

SEQ ID NO: 617652 - DNA, 25 bp, Mus musculus
ggcctttgggcacagttcagcactc

SEQ ID NO: 617653 - DNA, 25 bp, Mus musculus
ggcctttgggcagagttcagcactc

SEQ ID NO: 617654 - DNA, 25 bp, Mus musculus
ggcctttggtagacagacattgctg

SEQ ID NO: 617655 - DNA, 25 bp, Mus musculus
ggcctttggtagtcagacattgctg

SEQ ID NO: 617656 - DNA, 25 bp, Mus musculus
ggcctttggtggcaatgatgacatc

SEQ ID NO: 617657 - DNA, 25 bp, Mus musculus
ggcctttggtgggaatgatgacatc

SEQ ID NO: 617658 - DNA, 25 bp, Mus musculus
ggcctttgtcagaatggcaactcca

SEQ ID NO: 617659 - DNA, 25 bp, Mus musculus
ggcctttgtcagtatggcaactcca

SEQ ID NO: 617660 - DNA, 25 bp, Mus musculus
ggccttttataacgtaatcaccttg

SEQ ID NO: 617661 - DNA, 25 bp, Mus musculus
ggccttttataaggtaatcaccttg

SEQ ID NO: 617662 - DNA, 25 bp, Mus musculus
ggccttttatctcagggctttttct

SEQ ID NO: 617663 - DNA, 25 bp, Mus musculus
ggccttttatctgagggctttttct

SEQ ID NO: 617664 - DNA, 25 bp, Mus musculus
ggccttttcagactcttttgcagaa

SEQ ID NO: 617665 - DNA, 25 bp, Mus musculus
ggccttttcagagtcttttgcagaa

SEQ ID NO: 617666 - DNA, 25 bp, Mus musculus
ggccttttcaggctggacctcagca

SEQ ID NO: 617667 - DNA, 25 bp, Mus musculus
ggccttttcagggtggacctcagca

SEQ ID NO: 617668 - DNA, 25 bp, Mus musculus
ggccttttccagaaaaccaattgag

SEQ ID NO: 617669 - DNA, 25 bp, Mus musculus
ggccttttccagtaaaccaattgag

SEQ ID NO: 617670 - DNA, 25 bp, Mus musculus
ggccttttccatatatctataattt

SEQ ID NO: 617671 - DNA, 25 bp, Mus musculus
ggccttttccatttatctataattt

SEQ ID NO: 617672 - DNA, 25 bp, Mus musculus
ggccttttctacatgtttcttgaat

SEQ ID NO: 617673 - DNA, 25 bp, Mus musculus
ggccttttctacttgtttcttgaat

SEQ ID NO: 617674 - DNA, 25 bp, Mus musculus
ggccttttctatattctttgattaa

SEQ ID NO: 617675 - DNA, 25 bp, Mus musculus
ggccttttctattttctttgattaa

SEQ ID NO: 617676 - DNA, 25 bp, Mus musculus
ggccttttgcacaccggttttgaga

SEQ ID NO: 617677 - DNA, 25 bp, Mus musculus
ggccttttgcactccggttttgaga

SEQ ID NO: 617678 - DNA, 25 bp, Mus musculus
ggccttttgccaaccatctttcgac

SEQ ID NO: 617679 - DNA, 25 bp, Mus musculus
ggccttttgccatccatctttcgac

SEQ ID NO: 617680 - DNA, 25 bp, Mus musculus
ggccttttgtgtcctgctatgctaa

SEQ ID NO: 617681 - DNA, 25 bp, Mus musculus
ggccttttgtgtgctgctatgctaa

SEQ ID NO: 617682 - DNA, 25 bp, Mus musculus
ggccttttgttgagttgtatttttg

SEQ ID NO: 617683 - DNA, 25 bp, Mus musculus
ggccttttgttgtgttgtatttttg

SEQ ID NO: 617684 - DNA, 25 bp, Mus musculus
ggcctttttaatcagtattccacaa

SEQ ID NO: 617685 - DNA, 25 bp, Mus musculus
ggcctttttaatgagtattccacaa

SEQ ID NO: 617686 - DNA, 25 bp, Mus musculus
ggcctttttatcctttcacttgtat

SEQ ID NO: 617687 - DNA, 25 bp, Mus musculus
ggcctttttatcgtttcacttgtat

SEQ ID NO: 617688 - DNA, 25 bp, Mus musculus
ggcgaaaaacggatcctgcactaac

SEQ ID NO: 617689 - DNA, 25 bp, Mus musculus
ggcgaaaaacggttcctgcactaac

SEQ ID NO: 617690 - DNA, 25 bp, Mus musculus
ggcgaaaagcttctgtttgatccaa

SEQ ID NO: 617691 - DNA, 25 bp, Mus musculus
ggcgaaaagcttgtgtttgatccaa

SEQ ID NO: 617692 - DNA, 25 bp, Mus musculus
ggcgaaaatacaacttgccttctgt

SEQ ID NO: 617693 - DNA, 25 bp, Mus musculus
ggcgaaaatacatcttgccttctgt

SEQ ID NO: 617694 - DNA, 25 bp, Mus musculus
ggcgaaaccgaaagaggtcagaaag

SEQ ID NO: 617695 - DNA, 25 bp, Mus musculus
ggcgaaaccgaatgaggtcagaaag

SEQ ID NO: 617696 - DNA, 25 bp, Mus musculus
ggcgaaactagcaaatcttggcatt

SEQ ID NO: 617697 - DNA, 25 bp, Mus musculus
ggcgaaactagctaatcttggcatt

SEQ ID NO: 617698 - DNA, 25 bp, Mus musculus
ggcgaaactggactcgtacgactct

SEQ ID NO: 617699 - DNA, 25 bp, Mus musculus
ggcgaaactggagtcgtacgactct

SEQ ID NO: 617700 - DNA, 25 bp, Mus musculus
ggcgaaatacaactccctgcaaaga

SEQ ID NO: 617701 - DNA, 25 bp, Mus musculus
ggcgaaatacaagtccctgcaaaga

SEQ ID NO: 617702 - DNA, 25 bp, Mus musculus
ggcgaacagtcccttaccgtgtgat

SEQ ID NO: 617703 - DNA, 25 bp, Mus musculus
ggcgaacagtccgttaccgtgtgat

SEQ ID NO: 617704 - DNA, 25 bp, Mus musculus
ggcgaaccaatgaatatcccacttt

SEQ ID NO: 617705 - DNA, 25 bp, Mus musculus
ggcgaaccaatgtatatcccacttt

SEQ ID NO: 617706 - DNA, 25 bp, Mus musculus
ggcgaacctgaacctttcaagatcc

SEQ ID NO: 617707 - DNA, 25 bp, Mus musculus
ggcgaacctgaagctttcaagatcc

SEQ ID NO: 617708 - DNA, 25 bp, Mus musculus
ggcgaacctgatagttcagtttttc

SEQ ID NO: 617709 - DNA, 25 bp, Mus musculus
ggcgaacctgattgttcagtttttc

SEQ ID NO: 617710 - DNA, 25 bp, Mus musculus
ggcgaacgagctcggtccggcggct

SEQ ID NO: 617711 - DNA, 25 bp, Mus musculus
ggcgaacgagctgggtccggcggct

SEQ ID NO: 617712 - DNA, 25 bp, Mus musculus
ggcgaactacacacagcttgcacat

SEQ ID NO: 617713 - DNA, 25 bp, Mus musculus
ggcgaactacactcagcttgcacat

SEQ ID NO: 617714 - DNA, 25 bp, Mus musculus
ggcgaactcagacagacctgcagta

SEQ ID NO: 617715 - DNA, 25 bp, Mus musculus
ggcgaactcagagagacctgcagta

SEQ ID NO: 617716 - DNA, 25 bp, Mus musculus
ggcgaacttaaccagaagctgaata

SEQ ID NO: 617717 - DNA, 25 bp, Mus musculus
ggcgaacttaacgagaagctgaata

SEQ ID NO: 617718 - DNA, 25 bp, Mus musculus
ggcgaagaagacaacccacgtggta

SEQ ID NO: 617719 - DNA, 25 bp, Mus musculus
ggcgaagaagactacccacgtggta

SEQ ID NO: 617720 - DNA, 25 bp, Mus musculus
ggcgaagatcgaccacctgcaggaa

SEQ ID NO: 617721 - DNA, 25 bp, Mus musculus
ggcgaagatcgagcacctgcaggaa

SEQ ID NO: 617722 - DNA, 25 bp, Mus musculus
ggcgaagcattcaacacattggtgt

SEQ ID NO: 617723 - DNA, 25 bp, Mus musculus
ggcgaagcattctacacattggtgt

SEQ ID NO: 617724 - DNA, 25 bp, Mus musculus
ggcgaagccaggactgatgatacaa

SEQ ID NO: 617725 - DNA, 25 bp, Mus musculus
ggcgaagccaggtctgatgatacaa

SEQ ID NO: 617726 - DNA, 25 bp, Mus musculus
ggcgaagctgagacacgaaacccaa

SEQ ID NO: 617727 - DNA, 25 bp, Mus musculus
ggcgaagctgagtcacgaaacccaa

SEQ ID NO: 617728 - DNA, 25 bp, Mus musculus
ggcgaagctggtactctcagagtta

SEQ ID NO: 617729 - DNA, 25 bp, Mus musculus
ggcgaagctggttctctcagagtta

SEQ ID NO: 617730 - DNA, 25 bp, Mus musculus
ggcgaaggactgatttccccaccaa

SEQ ID NO: 617731 - DNA, 25 bp, Mus musculus
ggcgaaggactgttttccccaccaa

SEQ ID NO: 617732 - DNA, 25 bp, Mus musculus
ggcgaagtcatcaccgatacaaacg

SEQ ID NO: 617733 - DNA, 25 bp, Mus musculus
ggcgaagtcatctccgatacaaacg

SEQ ID NO: 617734 - DNA, 25 bp, Mus musculus
ggcgaagttactcgccttcgggatc

SEQ ID NO: 617735 - DNA, 25 bp, Mus musculus
ggcgaagttactggccttcgggatc

SEQ ID NO: 617736 - DNA, 25 bp, Mus musculus
ggcgaatacatgcttgcttccagag

SEQ ID NO: 617737 - DNA, 25 bp, Mus musculus
ggcgaatacatggttgcttccagag

SEQ ID NO: 617738 - DNA, 25 bp, Mus musculus
ggcgaatactatcgtccattcaaac

SEQ ID NO: 617739 - DNA, 25 bp, Mus musculus
ggcgaatactatggtccattcaaac

SEQ ID NO: 617740 - DNA, 25 bp, Mus musculus
ggcgaatagatgattgcctccctag

SEQ ID NO: 617741 - DNA, 25 bp, Mus musculus
ggcgaatagatgtttgcctccctag

SEQ ID NO: 617742 - DNA, 25 bp, Mus musculus
ggcgaatcattacattagtctgctg

SEQ ID NO: 617743 - DNA, 25 bp, Mus musculus
ggcgaatcattagattagtctgctg

SEQ ID NO: 617744 - DNA, 25 bp, Mus musculus
ggcgaatctcccaggtgtcctctgg

SEQ ID NO: 617745 - DNA, 25 bp, Mus musculus
ggcgaatctccctggtgtcctctgg

SEQ ID NO: 617746 - DNA, 25 bp, Mus musculus
ggcgaatctgatctaccctgaagta

SEQ ID NO: 617747 - DNA, 25 bp, Mus musculus
ggcgaatctgatgtaccctgaagta

SEQ ID NO: 617748 - DNA, 25 bp, Mus musculus
ggcgaatcttggctctgaaatgtat

SEQ ID NO: 617749 - DNA, 25 bp, Mus musculus
ggcgaatcttgggtctgaaatgtat

SEQ ID NO: 617750 - DNA, 25 bp, Mus musculus
ggcgaatctttcaaacaactttgtt

SEQ ID NO: 617751 - DNA, 25 bp, Mus musculus
ggcgaatctttctaacaactttgtt

SEQ ID NO: 617752 - DNA, 25 bp, Mus musculus
ggcgaatggcacactttcaatgatt

SEQ ID NO: 617753 - DNA, 25 bp, Mus musculus
ggcgaatggcactctttcaatgatt

SEQ ID NO: 617754 - DNA, 25 bp, Mus musculus
ggcgacaaaattcacttctactgca

SEQ ID NO: 617755 - DNA, 25 bp, Mus musculus
ggcgacaaaattgacttctactgca

SEQ ID NO: 617756 - DNA, 25 bp, Mus musculus
ggcgacaagtcactgtacaatttca

SEQ ID NO: 617757 - DNA, 25 bp, Mus musculus
ggcgacaagtcagtgtacaatttca

SEQ ID NO: 617758 - DNA, 25 bp, Mus musculus
ggcgacacagtgaccaggacaataa

SEQ ID NO: 617759 - DNA, 25 bp, Mus musculus
ggcgacacagtgtccaggacaataa

SEQ ID NO: 617760 - DNA, 25 bp, Mus musculus
ggcgacagatgtaccccgtaagtgt

SEQ ID NO: 617761 - DNA, 25 bp, Mus musculus
ggcgacagatgttccccgtaagtgt

SEQ ID NO: 617762 - DNA, 25 bp, Mus musculus
ggcgacagccatcaataccgggtgt

SEQ ID NO: 617763 - DNA, 25 bp, Mus musculus
ggcgacagccatgaataccgggtgt

SEQ ID NO: 617764 - DNA, 25 bp, Mus musculus
ggcgacaggcctaacacgtacatat

SEQ ID NO: 617765 - DNA, 25 bp, Mus musculus
ggcgacaggccttacacgtacatat

SEQ ID NO: 617766 - DNA, 25 bp, Mus musculus
ggcgacatattaatacgaagttcat

SEQ ID NO: 617767 - DNA, 25 bp, Mus musculus
ggcgacatattattacgaagttcat

SEQ ID NO: 617768 - DNA, 25 bp, Mus musculus
ggcgacatgctacgaaaaccccaga

SEQ ID NO: 617769 - DNA, 25 bp, Mus musculus
ggcgacatgctaggaaaaccccaga

SEQ ID NO: 617770 - DNA, 25 bp, Mus musculus
ggcgaccattacactgatcttccat

SEQ ID NO: 617771 - DNA, 25 bp, Mus musculus
ggcgaccattactctgatcttccat

SEQ ID NO: 617772 - DNA, 25 bp, Mus musculus
ggcgaccgtgctctgtgacgtcata

SEQ ID NO: 617773 - DNA, 25 bp, Mus musculus
ggcgaccgtgctgtgtgacgtcata

SEQ ID NO: 617774 - DNA, 25 bp, Mus musculus
ggcgacgaagtcacctataagatgt

SEQ ID NO: 617775 - DNA, 25 bp, Mus musculus
ggcgacgaagtctcctataagatgt

SEQ ID NO: 617776 - DNA, 25 bp, Mus musculus
ggcgacgcaagtaccactgaagagg

SEQ ID NO: 617777 - DNA, 25 bp, Mus musculus
ggcgacgcaagttccactgaagagg

SEQ ID NO: 617778 - DNA, 25 bp, Mus musculus
ggcgacgcagagagggcaacaccca

SEQ ID NO: 617779 - DNA, 25 bp, Mus musculus
ggcgacgcagagtgggcaacaccca

SEQ ID NO: 617780 - DNA, 25 bp, Mus musculus
ggcgacgcattgattggtcaacata

SEQ ID NO: 617781 - DNA, 25 bp, Mus musculus
ggcgacgcattgtttggtcaacata

SEQ ID NO: 617782 - DNA, 25 bp, Mus musculus
ggcgacgtcggtccctgaaagacat

SEQ ID NO: 617783 - DNA, 25 bp, Mus musculus
ggcgacgtcggtgcctgaaagacat

SEQ ID NO: 617784 - DNA, 25 bp, Mus musculus
ggcgactatgagatccagacctctt

SEQ ID NO: 617785 - DNA, 25 bp, Mus musculus
ggcgactatgagttccagacctctt

SEQ ID NO: 617786 - DNA, 25 bp, Mus musculus
ggcgactcaggtagcaggaccccag

SEQ ID NO: 617787 - DNA, 25 bp, Mus musculus
ggcgactcaggttgcaggaccccag

SEQ ID NO: 617788 - DNA, 25 bp, Mus musculus
ggcgactcggccatagacaaactca

SEQ ID NO: 617789 - DNA, 25 bp, Mus musculus
ggcgactcggccttagacaaactca

SEQ ID NO: 617790 - DNA, 25 bp, Mus musculus
ggcgactcgggcaaacagcatttac

SEQ ID NO: 617791 - DNA, 25 bp, Mus musculus
ggcgactcgggctaacagcatttac

SEQ ID NO: 617792 - DNA, 25 bp, Mus musculus
ggcgactctgccagaatctgtgtgt

SEQ ID NO: 617793 - DNA, 25 bp, Mus musculus
ggcgactctgcctgaatctgtgtgt

SEQ ID NO: 617794 - DNA, 25 bp, Mus musculus
ggcgactcttttaatagcgactttc

SEQ ID NO: 617795 - DNA, 25 bp, Mus musculus
ggcgactctttttatagcgactttc

SEQ ID NO: 617796 - DNA, 25 bp, Mus musculus
ggcgactgctcacggatccaggtca

SEQ ID NO: 617797 - DNA, 25 bp, Mus musculus
ggcgactgctcagggatccaggtca

SEQ ID NO: 617798 - DNA, 25 bp, Mus musculus
ggcgactggaggatacatctctgga

SEQ ID NO: 617799 - DNA, 25 bp, Mus musculus
ggcgactggaggttacatctctgga

SEQ ID NO: 617800 - DNA, 25 bp, Mus musculus
ggcgactgtgtccgtctatacgcat

SEQ ID NO: 617801 - DNA, 25 bp, Mus musculus
ggcgactgtgtcggtctatacgcat

SEQ ID NO: 617802 - DNA, 25 bp, Mus musculus
ggcgacttcgatcgaggaaactttt

SEQ ID NO: 617803 - DNA, 25 bp, Mus musculus
ggcgacttcgatggaggaaactttt

SEQ ID NO: 617804 - DNA, 25 bp, Mus musculus
ggcgagaaaacgactcacttctctt

SEQ ID NO: 617805 - DNA, 25 bp, Mus musculus
ggcgagaaaacgtctcacttctctt

SEQ ID NO: 617806 - DNA, 25 bp, Mus musculus
ggcgagaaacttagatttcccagaa

SEQ ID NO: 617807 - DNA, 25 bp, Mus musculus
ggcgagaaactttgatttcccagaa

SEQ ID NO: 617808 - DNA, 25 bp, Mus musculus
ggcgagaagtttatatttagaccct

SEQ ID NO: 617809 - DNA, 25 bp, Mus musculus
ggcgagaagtttttatttagaccct

SEQ ID NO: 617810 - DNA, 25 bp, Mus musculus
ggcgagacagggacaatggcttcaa

SEQ ID NO: 617811 - DNA, 25 bp, Mus musculus
ggcgagacagggtcaatggcttcaa

SEQ ID NO: 617812 - DNA, 25 bp, Mus musculus
ggcgagatgaacctcaccctgggca

SEQ ID NO: 617813 - DNA, 25 bp, Mus musculus
ggcgagatgaacgtcaccctgggca

SEQ ID NO: 617814 - DNA, 25 bp, Mus musculus
ggcgagattccccactgcaagtgga

SEQ ID NO: 617815 - DNA, 25 bp, Mus musculus
ggcgagattcccgactgcaagtgga

SEQ ID NO: 617816 - DNA, 25 bp, Mus musculus
ggcgagatttttaagctctccccta

SEQ ID NO: 617817 - DNA, 25 bp, Mus musculus
ggcgagattttttagctctccccta

SEQ ID NO: 617818 - DNA, 25 bp, Mus musculus
ggcgagcaaggcaatcgaatcctga

SEQ ID NO: 617819 - DNA, 25 bp, Mus musculus
ggcgagcaaggctatcgaatcctga

SEQ ID NO: 617820 - DNA, 25 bp, Mus musculus
ggcgagcatatcagcctgatggcta

SEQ ID NO: 617821 - DNA, 25 bp, Mus musculus
ggcgagcatatccatttcactgggc

SEQ ID NO: 617822 - DNA, 25 bp, Mus musculus
ggcgagcatatcgatttcactgggc

SEQ ID NO: 617823 - DNA, 25 bp, Mus musculus
ggcgagcatatctgcctgatggcta

SEQ ID NO: 617824 - DNA, 25 bp, Mus musculus
ggcgagcatcgcaattgacaatgga

SEQ ID NO: 617825 - DNA, 25 bp, Mus musculus
ggcgagcatcgctattgacaatgga

SEQ ID NO: 617826 - DNA, 25 bp, Mus musculus
ggcgagcatgttacactcagcacat

SEQ ID NO: 617827 - DNA, 25 bp, Mus musculus
ggcgagcatgtttcactcagcacat

SEQ ID NO: 617828 - DNA, 25 bp, Mus musculus
ggcgagcattgacccatgtctggta

SEQ ID NO: 617829 - DNA, 25 bp, Mus musculus
ggcgagcattgagccatgtctggta

SEQ ID NO: 617830 - DNA, 25 bp, Mus musculus
ggcgagccgggcactgatagcataa

SEQ ID NO: 617831 - DNA, 25 bp, Mus musculus
ggcgagccgggctctgatagcataa

SEQ ID NO: 617832 - DNA, 25 bp, Mus musculus
ggcgagcgccatacgatggatctca

SEQ ID NO: 617833 - DNA, 25 bp, Mus musculus
ggcgagcgccattcgatggatctca

SEQ ID NO: 617834 - DNA, 25 bp, Mus musculus
ggcgagctaactaacctattgtctt

SEQ ID NO: 617835 - DNA, 25 bp, Mus musculus
ggcgagctaacttacctattgtctt

SEQ ID NO: 617836 - DNA, 25 bp, Mus musculus
ggcgagcttgccacagccactgctg

SEQ ID NO: 617837 - DNA, 25 bp, Mus musculus
ggcgagcttgcctcagccactgctg

SEQ ID NO: 617838 - DNA, 25 bp, Mus musculus
ggcgaggaaagccttctacgtaaag

SEQ ID NO: 617839 - DNA, 25 bp, Mus musculus
ggcgaggaaagcgttctacgtaaag

SEQ ID NO: 617840 - DNA, 25 bp, Mus musculus
ggcgaggatgtaattgggctatacc

SEQ ID NO: 617841 - DNA, 25 bp, Mus musculus
ggcgaggatgtatttgggctatacc

SEQ ID NO: 617842 - DNA, 25 bp, Mus musculus
ggcgaggcctcacctacacgttgca

SEQ ID NO: 617843 - DNA, 25 bp, Mus musculus
ggcgaggcctcagctacacgttgca

SEQ ID NO: 617844 - DNA, 25 bp, Mus musculus
ggcgagggacatcatttcaaccata

SEQ ID NO: 617845 - DNA, 25 bp, Mus musculus
ggcgagggacatgatttcaaccata

SEQ ID NO: 617846 - DNA, 25 bp, Mus musculus
ggcgagggtacacatttcctttgta

SEQ ID NO: 617847 - DNA, 25 bp, Mus musculus
ggcgagggtacagatttcctttgta

SEQ ID NO: 617848 - DNA, 25 bp, Mus musculus
ggcgaggtgatcatagtcgttacaa

SEQ ID NO: 617849 - DNA, 25 bp, Mus musculus
ggcgaggtgatcttagtcgttacaa

SEQ ID NO: 617850 - DNA, 25 bp, Mus musculus
ggcgaggtgcacagtacatgtaact

SEQ ID NO: 617851 - DNA, 25 bp, Mus musculus
ggcgaggtgcactgtacatgtaact

SEQ ID NO: 617852 - DNA, 25 bp, Mus musculus
ggcgagtaaactcaccctggaccaa

SEQ ID NO: 617853 - DNA, 25 bp, Mus musculus
ggcgagtaaactgaccctggaccaa

SEQ ID NO: 617854 - DNA, 25 bp, Mus musculus
ggcgagtaaaggatgcagctaagac

SEQ ID NO: 617855 - DNA, 25 bp, Mus musculus
ggcgagtaaaggttgcagctaagac

SEQ ID NO: 617856 - DNA, 25 bp, Mus musculus
ggcgagtacttcctcaagtgtgaca

SEQ ID NO: 617857 - DNA, 25 bp, Mus musculus
ggcgagtacttcgtcaagtgtgaca

SEQ ID NO: 617858 - DNA, 25 bp, Mus musculus
ggcgagtagttaatggtctctataa

SEQ ID NO: 617859 - DNA, 25 bp, Mus musculus
ggcgagtagttattggtctctataa

SEQ ID NO: 617860 - DNA, 25 bp, Mus musculus
ggcgagtatctcattgagcgcctca

SEQ ID NO: 617861 - DNA, 25 bp, Mus musculus
ggcgagtatctctttgagcgcctca

SEQ ID NO: 617862 - DNA, 25 bp, Mus musculus
ggcgagtcagatcattttattttcc

SEQ ID NO: 617863 - DNA, 25 bp, Mus musculus
ggcgagtcagatgattttattttcc

SEQ ID NO: 617864 - DNA, 25 bp, Mus musculus
ggcgagtcagctcaaatccagtcaa

SEQ ID NO: 617865 - DNA, 25 bp, Mus musculus
ggcgagtcagctgaaatccagtcaa

SEQ ID NO: 617866 - DNA, 25 bp, Mus musculus
ggcgagtcaggaaattaaaagctat

SEQ ID NO: 617867 - DNA, 25 bp, Mus musculus
ggcgagtcaggatattaaaagctat

SEQ ID NO: 617868 - DNA, 25 bp, Mus musculus
ggcgagtgcctgaattatgtcttga

SEQ ID NO: 617869 - DNA, 25 bp, Mus musculus
ggcgagtgcctgtattatgtcttga

SEQ ID NO: 617870 - DNA, 25 bp, Mus musculus
ggcgagtgctgtcctactattccat

SEQ ID NO: 617871 - DNA, 25 bp, Mus musculus
ggcgagtgctgtgctactattccat

SEQ ID NO: 617872 - DNA, 25 bp, Mus musculus
ggcgagtgtttcagctgcactgcca

SEQ ID NO: 617873 - DNA, 25 bp, Mus musculus
ggcgagtgtttctgctgcactgcca

SEQ ID NO: 617874 - DNA, 25 bp, Mus musculus
ggcgagttatatcctacagccctga

SEQ ID NO: 617875 - DNA, 25 bp, Mus musculus
ggcgagttatatgctacagccctga

SEQ ID NO: 617876 - DNA, 25 bp, Mus musculus
ggcgagttatgacacctgagctgca

SEQ ID NO: 617877 - DNA, 25 bp, Mus musculus
ggcgagttatgagacctgagctgca

SEQ ID NO: 617878 - DNA, 25 bp, Mus musculus
ggcgagtttaagctacttgggaatc

SEQ ID NO: 617879 - DNA, 25 bp, Mus musculus
ggcgagtttaaggtacttgggaatc

SEQ ID NO: 617880 - DNA, 25 bp, Mus musculus
ggcgagtttcatctagctactataa

SEQ ID NO: 617881 - DNA, 25 bp, Mus musculus
ggcgagtttcatgtagctactataa

SEQ ID NO: 617882 - DNA, 25 bp, Mus musculus
ggcgagttttaaagccaaatgtcct

SEQ ID NO: 617883 - DNA, 25 bp, Mus musculus
ggcgagttttaatgccaaatgtcct

SEQ ID NO: 617884 - DNA, 25 bp, Mus musculus
ggcgataagaagcatcccctggatg

SEQ ID NO: 617885 - DNA, 25 bp, Mus musculus
ggcgataagaaggatcccctggatg

SEQ ID NO: 617886 - DNA, 25 bp, Mus musculus
ggcgataccatccacagtgagatgt

SEQ ID NO: 617887 - DNA, 25 bp, Mus musculus
ggcgataccatcgacagtgagatgt

SEQ ID NO: 617888 - DNA, 25 bp, Mus musculus
ggcgatacctacagaagaaaaaaca

SEQ ID NO: 617889 - DNA, 25 bp, Mus musculus
ggcgatacctactgaagaaaaaaca

SEQ ID NO: 617890 - DNA, 25 bp, Mus musculus
ggcgatacttctccaagttccagat

SEQ ID NO: 617891 - DNA, 25 bp, Mus musculus
ggcgatacttctgcaagttccagat

SEQ ID NO: 617892 - DNA, 25 bp, Mus musculus
ggcgatagatcactggcccagcact

SEQ ID NO: 617893 - DNA, 25 bp, Mus musculus
ggcgatagatcagtggcccagcact

SEQ ID NO: 617894 - DNA, 25 bp, Mus musculus
ggcgatagccttcatcaggatcaca

SEQ ID NO: 617895 - DNA, 25 bp, Mus musculus
ggcgatagccttgatcaggatcaca

SEQ ID NO: 617896 - DNA, 25 bp, Mus musculus
ggcgatatccagactggctgcaacg

SEQ ID NO: 617897 - DNA, 25 bp, Mus musculus
ggcgatatccagtctggctgcaacg

SEQ ID NO: 617898 - DNA, 25 bp, Mus musculus
ggcgatatgggcattagggacttac

SEQ ID NO: 617899 - DNA, 25 bp, Mus musculus
ggcgatatgggctttagggacttac

SEQ ID NO: 617900 - DNA, 25 bp, Mus musculus
ggcgatcaatggcaccatctactga

SEQ ID NO: 617901 - DNA, 25 bp, Mus musculus
ggcgatcaatgggaccatctactga

SEQ ID NO: 617902 - DNA, 25 bp, Mus musculus
ggcgatcagaatcagcggtttcttc

SEQ ID NO: 617903 - DNA, 25 bp, Mus musculus
ggcgatcagaatgagcggtttcttc

SEQ ID NO: 617904 - DNA, 25 bp, Mus musculus
ggcgatcagggaatcttcacagaca

SEQ ID NO: 617905 - DNA, 25 bp, Mus musculus
ggcgatcagggattcttcacagaca

SEQ ID NO: 617906 - DNA, 25 bp, Mus musculus
ggcgatcagggcaggccgaccctaa

SEQ ID NO: 617907 - DNA, 25 bp, Mus musculus
ggcgatcagggctggccgaccctaa

SEQ ID NO: 617908 - DNA, 25 bp, Mus musculus
ggcgatccactgagcgcaggtcgtt

SEQ ID NO: 617909 - DNA, 25 bp, Mus musculus
ggcgatccactgtgcgcaggtcgtt

SEQ ID NO: 617910 - DNA, 25 bp, Mus musculus
ggcgatccatatatttctaagtcct

SEQ ID NO: 617911 - DNA, 25 bp, Mus musculus
ggcgatccatatttttctaagtcct

SEQ ID NO: 617912 - DNA, 25 bp, Mus musculus
ggcgatctcatgagattgggccatt

SEQ ID NO: 617913 - DNA, 25 bp, Mus musculus
ggcgatctcatgtgattgggccatt

SEQ ID NO: 617914 - DNA, 25 bp, Mus musculus
ggcgatcttaagctctgctcatgga

SEQ ID NO: 617915 - DNA, 25 bp, Mus musculus
ggcgatcttaaggtctgctcatgga

SEQ ID NO: 617916 - DNA, 25 bp, Mus musculus
ggcgatcttcttatgatgggtagtt

SEQ ID NO: 617917 - DNA, 25 bp, Mus musculus
ggcgatcttcttttgatgggtagtt

SEQ ID NO: 617918 - DNA, 25 bp, Mus musculus
ggcgatgaacctcgatccctggttt

SEQ ID NO: 617919 - DNA, 25 bp, Mus musculus
ggcgatgaacctggatccctggttt

SEQ ID NO: 617920 - DNA, 25 bp, Mus musculus
ggcgatgaattactgctcctgcttt

SEQ ID NO: 617921 - DNA, 25 bp, Mus musculus
ggcgatgaattagtgctcctgcttt

SEQ ID NO: 617922 - DNA, 25 bp, Mus musculus
ggcgatgagactccaaaccacacaa

SEQ ID NO: 617923 - DNA, 25 bp, Mus musculus
ggcgatgagactgcaaaccacacaa

SEQ ID NO: 617924 - DNA, 25 bp, Mus musculus
ggcgatgagcttatttcaccagagt

SEQ ID NO: 617925 - DNA, 25 bp, Mus musculus
ggcgatgagcttttttcaccagagt

SEQ ID NO: 617926 - DNA, 25 bp, Mus musculus
ggcgatgagggcattttcatttcct

SEQ ID NO: 617927 - DNA, 25 bp, Mus musculus
ggcgatgagggctttttcatttcct

SEQ ID NO: 617928 - DNA, 25 bp, Mus musculus
ggcgatgagtttcaagctaggcttc

SEQ ID NO: 617929 - DNA, 25 bp, Mus musculus
ggcgatgagtttgaagctaggcttc

SEQ ID NO: 617930 - DNA, 25 bp, Mus musculus
ggcgatgcagatcgattcttcactt

SEQ ID NO: 617931 - DNA, 25 bp, Mus musculus
ggcgatgcagatggattcttcactt

SEQ ID NO: 617932 - DNA, 25 bp, Mus musculus
ggcgatgccactcaggagagacccc

SEQ ID NO: 617933 - DNA, 25 bp, Mus musculus
ggcgatgccactgaggagagacccc

SEQ ID NO: 617934 - DNA, 25 bp, Mus musculus
ggcgatgcccagacagtggtcacca

SEQ ID NO: 617935 - DNA, 25 bp, Mus musculus
ggcgatgcccagtcagtggtcacca

SEQ ID NO: 617936 - DNA, 25 bp, Mus musculus
ggcgatgctgagagtgcgtcctcta

SEQ ID NO: 617937 - DNA, 25 bp, Mus musculus
ggcgatgctgagtgtgcgtcctcta

SEQ ID NO: 617938 - DNA, 25 bp, Mus musculus
ggcgatgcttcacaagagcttccag

SEQ ID NO: 617939 - DNA, 25 bp, Mus musculus
ggcgatgcttcagaagagcttccag

SEQ ID NO: 617940 - DNA, 25 bp, Mus musculus
ggcgatggcatcagcactattgacc

SEQ ID NO: 617941 - DNA, 25 bp, Mus musculus
ggcgatggcatctgcactattgacc

SEQ ID NO: 617942 - DNA, 25 bp, Mus musculus
ggcgatggccatcagactctgagac

SEQ ID NO: 617943 - DNA, 25 bp, Mus musculus
ggcgatggccatgagactctgagac

SEQ ID NO: 617944 - DNA, 25 bp, Mus musculus
ggcgatgtaaatacagatcggccgg

SEQ ID NO: 617945 - DNA, 25 bp, Mus musculus
ggcgatgtaaattcagatcggccgg

SEQ ID NO: 617946 - DNA, 25 bp, Mus musculus
ggcgatgtagaaatgactgtggatt

SEQ ID NO: 617947 - DNA, 25 bp, Mus musculus
ggcgatgtagaattgactgtggatt

SEQ ID NO: 617948 - DNA, 25 bp, Mus musculus
ggcgatgtcaagattcacaatggat

SEQ ID NO: 617949 - DNA, 25 bp, Mus musculus
ggcgatgtcaagtttcacaatggat

SEQ ID NO: 617950 - DNA, 25 bp, Mus musculus
ggcgatgttacactgaattctcagg

SEQ ID NO: 617951 - DNA, 25 bp, Mus musculus
ggcgatgttacagtgaattctcagg

SEQ ID NO: 617952 - DNA, 25 bp, Mus musculus
ggcgattaaactcccctgagtccaa

SEQ ID NO: 617953 - DNA, 25 bp, Mus musculus
ggcgattaaactgccctgagtccaa

SEQ ID NO: 617954 - DNA, 25 bp, Mus musculus
ggcgattactacctgtgttgttctt

SEQ ID NO: 617955 - DNA, 25 bp, Mus musculus
ggcgattactacgtgtgttgttctt

SEQ ID NO: 617956 - DNA, 25 bp, Mus musculus
ggcgattattgacatccttactcat

SEQ ID NO: 617957 - DNA, 25 bp, Mus musculus
ggcgattattgagatccttactcat

SEQ ID NO: 617958 - DNA, 25 bp, Mus musculus
ggcgattcacaacccaaatttacct

SEQ ID NO: 617959 - DNA, 25 bp, Mus musculus
ggcgattcacaagccaaatttacct

SEQ ID NO: 617960 - DNA, 25 bp, Mus musculus
ggcgattcattcaacattctcttaa

SEQ ID NO: 617961 - DNA, 25 bp, Mus musculus
ggcgattcattctacattctcttaa

SEQ ID NO: 617962 - DNA, 25 bp, Mus musculus
ggcgattcctgtactgagatctcag

SEQ ID NO: 617963 - DNA, 25 bp, Mus musculus
ggcgattcctgttctgagatctcag

SEQ ID NO: 617964 - DNA, 25 bp, Mus musculus
ggcgattctacacggaagattcccc

SEQ ID NO: 617965 - DNA, 25 bp, Mus musculus
ggcgattctacagggaagattcccc

SEQ ID NO: 617966 - DNA, 25 bp, Mus musculus
ggcgatttcttcagagactaggact

SEQ ID NO: 617967 - DNA, 25 bp, Mus musculus
ggcgatttcttctgagactaggact

SEQ ID NO: 617968 - DNA, 25 bp, Mus musculus
ggcgatttgaatccatagttctttg

SEQ ID NO: 617969 - DNA, 25 bp, Mus musculus
ggcgatttgaatgcatagttctttg

SEQ ID NO: 617970 - DNA, 25 bp, Mus musculus
ggcgattttattccagcaagtactg

SEQ ID NO: 617971 - DNA, 25 bp, Mus musculus
ggcgattttattgcagcaagtactg

SEQ ID NO: 617972 - DNA, 25 bp, Mus musculus
ggcgcaaacaaaagcacgtgctgct

SEQ ID NO: 617973 - DNA, 25 bp, Mus musculus
ggcgcaaacaaatgcacgtgctgct

SEQ ID NO: 617974 - DNA, 25 bp, Mus musculus
ggcgcaagaaccattggaatcctca

SEQ ID NO: 617975 - DNA, 25 bp, Mus musculus
ggcgcaagaacctttggaatcctca

SEQ ID NO: 617976 - DNA, 25 bp, Mus musculus
ggcgcaagtggaacagatttctcaa

SEQ ID NO: 617977 - DNA, 25 bp, Mus musculus
ggcgcaagtggatcagatttctcaa

SEQ ID NO: 617978 - DNA, 25 bp, Mus musculus
ggcgcacaatgtctccaaggataac

SEQ ID NO: 617979 - DNA, 25 bp, Mus musculus
ggcgcacaatgtgtccaaggataac

SEQ ID NO: 617980 - DNA, 25 bp, Mus musculus
ggcgcacacagtaccttaacatagt

SEQ ID NO: 617981 - DNA, 25 bp, Mus musculus
ggcgcacacagttccttaacatagt

SEQ ID NO: 617982 - DNA, 25 bp, Mus musculus
ggcgcacagagacagcttcctagta

SEQ ID NO: 617983 - DNA, 25 bp, Mus musculus
ggcgcacagagagagcttcctagta

SEQ ID NO: 617984 - DNA, 25 bp, Mus musculus
ggcgcacagcagcaggcctgcttct

SEQ ID NO: 617985 - DNA, 25 bp, Mus musculus
ggcgcacagcaggaggcctgcttct

SEQ ID NO: 617986 - DNA, 25 bp, Mus musculus
ggcgcacaggttcgtgtcctcaaac

SEQ ID NO: 617987 - DNA, 25 bp, Mus musculus
ggcgcacaggttggtgtcctcaaac

SEQ ID NO: 617988 - DNA, 25 bp, Mus musculus
ggcgcacccggaacatttcatagta

SEQ ID NO: 617989 - DNA, 25 bp, Mus musculus
ggcgcacccggatcatttcatagta

SEQ ID NO: 617990 - DNA, 25 bp, Mus musculus
ggcgcaccctgtatacatttcagaa

SEQ ID NO: 617991 - DNA, 25 bp, Mus musculus
ggcgcaccctgtttacatttcagaa

SEQ ID NO: 617992 - DNA, 25 bp, Mus musculus
ggcgcaccggaaacattagtgagaa

SEQ ID NO: 617993 - DNA, 25 bp, Mus musculus
ggcgcaccggaatcattagtgagaa

SEQ ID NO: 617994 - DNA, 25 bp, Mus musculus
ggcgcacctacgcatcattgatggg

SEQ ID NO: 617995 - DNA, 25 bp, Mus musculus
ggcgcacctacggatcattgatggg

SEQ ID NO: 617996 - DNA, 25 bp, Mus musculus
ggcgcacgatataactttttctctt

SEQ ID NO: 617997 - DNA, 25 bp, Mus musculus
ggcgcacgatattactttttctctt

SEQ ID NO: 617998 - DNA, 25 bp, Mus musculus
ggcgcactgagcatgaacggtgttt

SEQ ID NO: 617999 - DNA, 25 bp, Mus musculus
ggcgcactgagcttgaacggtgttt

SEQ ID NO: 618000 - DNA, 25 bp, Mus musculus
ggcgcactgcaaaaccatggttagt

SEQ ID NO: 618001 - DNA, 25 bp, Mus musculus
ggcgcactgcaataccatggttagt

SEQ ID NO: 618002 - DNA, 25 bp, Mus musculus
ggcgcactggtcattgggaattttc

SEQ ID NO: 618003 - DNA, 25 bp, Mus musculus
ggcgcactggtctttgggaattttc

SEQ ID NO: 618004 - DNA, 25 bp, Mus musculus
ggcgcagaacgccttcaagggtaac

SEQ ID NO: 618005 - DNA, 25 bp, Mus musculus
ggcgcagaacgcgttcaagggtaac

SEQ ID NO: 618006 - DNA, 25 bp, Mus musculus
ggcgcagaagccacagtacgacatc

SEQ ID NO: 618007 - DNA, 25 bp, Mus musculus
ggcgcagaagcctcagtacgacatc

SEQ ID NO: 618008 - DNA, 25 bp, Mus musculus
ggcgcagaagcgatagctccagatc

SEQ ID NO: 618009 - DNA, 25 bp, Mus musculus
ggcgcagaagcgttagctccagatc

SEQ ID NO: 618010 - DNA, 25 bp, Mus musculus
ggcgcagaatccagcctccaggctg

SEQ ID NO: 618011 - DNA, 25 bp, Mus musculus
ggcgcagaatcctgcctccaggctg

SEQ ID NO: 618012 - DNA, 25 bp, Mus musculus
ggcgcagacaacaccaggacctgga

SEQ ID NO: 618013 - DNA, 25 bp, Mus musculus
ggcgcagacaactccaggacctgga

SEQ ID NO: 618014 - DNA, 25 bp, Mus musculus
ggcgcagacgtcagcaagtccatgt

SEQ ID NO: 618015 - DNA, 25 bp, Mus musculus
ggcgcagacgtctgcaagtccatgt

SEQ ID NO: 618016 - DNA, 25 bp, Mus musculus
ggcgcaggcactccaagctctgcag

SEQ ID NO: 618017 - DNA, 25 bp, Mus musculus
ggcgcaggcactgcaagctctgcag

SEQ ID NO: 618018 - DNA, 25 bp, Mus musculus
ggcgcagtagtcaactactttgttt

SEQ ID NO: 618019 - DNA, 25 bp, Mus musculus
ggcgcagtagtctactactttgttt

SEQ ID NO: 618020 - DNA, 25 bp, Mus musculus
ggcgcagtgccgaggactacgaata

SEQ ID NO: 618021 - DNA, 25 bp, Mus musculus
ggcgcagtgccgtggactacgaata

SEQ ID NO: 618022 - DNA, 25 bp, Mus musculus
ggcgcagtggtgaacacagtcacat

SEQ ID NO: 618023 - DNA, 25 bp, Mus musculus
ggcgcagtggtgtacacagtcacat

SEQ ID NO: 618024 - DNA, 25 bp, Mus musculus
ggcgcagttcctacattcacgttat

SEQ ID NO: 618025 - DNA, 25 bp, Mus musculus
ggcgcagttccttcattcacgttat

SEQ ID NO: 618026 - DNA, 25 bp, Mus musculus
ggcgcagttggcacgacatttgtca

SEQ ID NO: 618027 - DNA, 25 bp, Mus musculus
ggcgcagttggctcgacatttgtca

SEQ ID NO: 618028 - DNA, 25 bp, Mus musculus
ggcgcataataaaacagaacctaga

SEQ ID NO: 618029 - DNA, 25 bp, Mus musculus
ggcgcataataatacagaacctaga

SEQ ID NO: 618030 - DNA, 25 bp, Mus musculus
ggcgcatcctagaggctgtgcaccg

SEQ ID NO: 618031 - DNA, 25 bp, Mus musculus
ggcgcatcctagtggctgtgcaccg

SEQ ID NO: 618032 - DNA, 25 bp, Mus musculus
ggcgcatgatatagatgttgagtca

SEQ ID NO: 618033 - DNA, 25 bp, Mus musculus
ggcgcatgatattgatgttgagtca

SEQ ID NO: 618034 - DNA, 25 bp, Mus musculus
ggcgcatggttgaaaagtccttatt

SEQ ID NO: 618035 - DNA, 25 bp, Mus musculus
ggcgcatggttgtaaagtccttatt

SEQ ID NO: 618036 - DNA, 25 bp, Mus musculus
ggcgcattgattaacaatccttggt

SEQ ID NO: 618037 - DNA, 25 bp, Mus musculus
ggcgcattgatttacaatccttggt

SEQ ID NO: 618038 - DNA, 25 bp, Mus musculus
ggcgccaaagctccacttaagcatt

SEQ ID NO: 618039 - DNA, 25 bp, Mus musculus
ggcgccaaagctgcacttaagcatt

SEQ ID NO: 618040 - DNA, 25 bp, Mus musculus
ggcgccaacctgctctatggcagaa

SEQ ID NO: 618041 - DNA, 25 bp, Mus musculus
ggcgccaacctggtctatggcagaa

SEQ ID NO: 618042 - DNA, 25 bp, Mus musculus
ggcgccaagcgcaacagttacctaa

SEQ ID NO: 618043 - DNA, 25 bp, Mus musculus
ggcgccaagcgctacagttacctaa

SEQ ID NO: 618044 - DNA, 25 bp, Mus musculus
ggcgccaaggatcctatcccaatgt

SEQ ID NO: 618045 - DNA, 25 bp, Mus musculus
ggcgccaaggatgctatcccaatgt

SEQ ID NO: 618046 - DNA, 25 bp, Mus musculus
ggcgccaccacactattgtcgattt

SEQ ID NO: 618047 - DNA, 25 bp, Mus musculus
ggcgccaccacagtattgtcgattt

SEQ ID NO: 618048 - DNA, 25 bp, Mus musculus
ggcgccaccatgctaaccaagtagg

SEQ ID NO: 618049 - DNA, 25 bp, Mus musculus
ggcgccaccatggtaaccaagtagg

SEQ ID NO: 618050 - DNA, 25 bp, Mus musculus
ggcgccacggtcaacgttatttcaa

SEQ ID NO: 618051 - DNA, 25 bp, Mus musculus
ggcgccacggtctacgttatttcaa

SEQ ID NO: 618052 - DNA, 25 bp, Mus musculus
ggcgccagaaagaacattacagatc

SEQ ID NO: 618053 - DNA, 25 bp, Mus musculus
ggcgccagaaagtacattacagatc

SEQ ID NO: 618054 - DNA, 25 bp, Mus musculus
ggcgccagaaggagaaacgcatcaa

SEQ ID NO: 618055 - DNA, 25 bp, Mus musculus
ggcgccagaaggtgaaacgcatcaa

SEQ ID NO: 618056 - DNA, 25 bp, Mus musculus
ggcgccagcatcctgtataagcatg

SEQ ID NO: 618057 - DNA, 25 bp, Mus musculus
ggcgccagcatcgtgtataagcatg

SEQ ID NO: 618058 - DNA, 25 bp, Mus musculus
ggcgccagctggagttctcgggtgc

SEQ ID NO: 618059 - DNA, 25 bp, Mus musculus
ggcgccagctggtgttctcgggtgc

SEQ ID NO: 618060 - DNA, 25 bp, Mus musculus
ggcgccagtatcaaccgggcaatga

SEQ ID NO: 618061 - DNA, 25 bp, Mus musculus
ggcgccagtatctaccgggcaatga

SEQ ID NO: 618062 - DNA, 25 bp, Mus musculus
ggcgccatcatcaagtacacggtgt

SEQ ID NO: 618063 - DNA, 25 bp, Mus musculus
ggcgccatcatctagtacacggtgt

SEQ ID NO: 618064 - DNA, 25 bp, Mus musculus
ggcgccatttggaattactgacttc

SEQ ID NO: 618065 - DNA, 25 bp, Mus musculus
ggcgccatttggtattactgacttc

SEQ ID NO: 618066 - DNA, 25 bp, Mus musculus
ggcgcccaaggaaccgaagctgtac

SEQ ID NO: 618067 - DNA, 25 bp, Mus musculus
ggcgcccaaggatccgaagctgtac

SEQ ID NO: 618068 - DNA, 25 bp, Mus musculus
ggcgcccaagggagcctctggctca

SEQ ID NO: 618069 - DNA, 25 bp, Mus musculus
ggcgcccaagggtgcctctggctca

SEQ ID NO: 618070 - DNA, 25 bp, Mus musculus
ggcgcccagagcaacatgaacgccg

SEQ ID NO: 618071 - DNA, 25 bp, Mus musculus
ggcgcccagagctacatgaacgccg

SEQ ID NO: 618072 - DNA, 25 bp, Mus musculus
ggcgccccatagacacaaggtttga

SEQ ID NO: 618073 - DNA, 25 bp, Mus musculus
ggcgccccatagtcacaaggtttga

SEQ ID NO: 618074 - DNA, 25 bp, Mus musculus
ggcgcccctgcaatgtgaagccaaa

SEQ ID NO: 618075 - DNA, 25 bp, Mus musculus
ggcgcccctgcattgtgaagccaaa

SEQ ID NO: 618076 - DNA, 25 bp, Mus musculus
ggcgcccgcggccatggtatataca

SEQ ID NO: 618077 - DNA, 25 bp, Mus musculus
ggcgcccgcggcgatggtatataca

SEQ ID NO: 618078 - DNA, 25 bp, Mus musculus
ggcgcccttccaattttatctaatt

SEQ ID NO: 618079 - DNA, 25 bp, Mus musculus
ggcgcccttccatttttatctaatt

SEQ ID NO: 618080 - DNA, 25 bp, Mus musculus
ggcgcccttggcaggatttggttat

SEQ ID NO: 618081 - DNA, 25 bp, Mus musculus
ggcgcccttggctggatttggttat

SEQ ID NO: 618082 - DNA, 25 bp, Mus musculus
ggcgccgagtgcaaacagaccatga

SEQ ID NO: 618083 - DNA, 25 bp, Mus musculus
ggcgccgagtgctaacagaccatga

SEQ ID NO: 618084 - DNA, 25 bp, Mus musculus
ggcgccggaagtcctcacagacaca

SEQ ID NO: 618085 - DNA, 25 bp, Mus musculus
ggcgccggaagtgctcacagacaca

SEQ ID NO: 618086 - DNA, 25 bp, Mus musculus
ggcgccggacccagattctctctgt

SEQ ID NO: 618087 - DNA, 25 bp, Mus musculus
ggcgccggaccctgattctctctgt

SEQ ID NO: 618088 - DNA, 25 bp, Mus musculus
ggcgccgtcggaatgaaatcgctca

SEQ ID NO: 618089 - DNA, 25 bp, Mus musculus
ggcgccgtcggattgaaatcgctca

SEQ ID NO: 618090 - DNA, 25 bp, Mus musculus
ggcgcctaagtgacctttgtgagct

SEQ ID NO: 618091 - DNA, 25 bp, Mus musculus
ggcgcctaagtgtcctttgtgagct

SEQ ID NO: 618092 - DNA, 25 bp, Mus musculus
ggcgcctaatagatttcctggagtc

SEQ ID NO: 618093 - DNA, 25 bp, Mus musculus
ggcgcctaatagttttcctggagtc

SEQ ID NO: 618094 - DNA, 25 bp, Mus musculus
ggcgcctcgctgatcgtggactcca

SEQ ID NO: 618095 - DNA, 25 bp, Mus musculus
ggcgcctcgctgttcgtggactcca

SEQ ID NO: 618096 - DNA, 25 bp, Mus musculus
ggcgcctcgcttctagcttagctgt

SEQ ID NO: 618097 - DNA, 25 bp, Mus musculus
ggcgcctcgcttgtagcttagctgt

SEQ ID NO: 618098 - DNA, 25 bp, Mus musculus
ggcgcctgatggaaagccacggctt

SEQ ID NO: 618099 - DNA, 25 bp, Mus musculus
ggcgcctgatggtaagccacggctt

SEQ ID NO: 618100 - DNA, 25 bp, Mus musculus
ggcgcctgtctaacaagggcttgtt

SEQ ID NO: 618101 - DNA, 25 bp, Mus musculus
ggcgcctgtctatcaagggcttgtt

SEQ ID NO: 618102 - DNA, 25 bp, Mus musculus
ggcgcctgtctcagtcctctttgga

SEQ ID NO: 618103 - DNA, 25 bp, Mus musculus
ggcgcctgtctctgtcctctttgga

SEQ ID NO: 618104 - DNA, 25 bp, Mus musculus
ggcgccttagggaatatgtttgcat

SEQ ID NO: 618105 - DNA, 25 bp, Mus musculus
ggcgccttagggtatatgtttgcat

SEQ ID NO: 618106 - DNA, 25 bp, Mus musculus
ggcgccttgagtaggtggtagacta

SEQ ID NO: 618107 - DNA, 25 bp, Mus musculus
ggcgccttgagttggtggtagacta

SEQ ID NO: 618108 - DNA, 25 bp, Mus musculus
ggcgccttgcacatagaaggtccga

SEQ ID NO: 618109 - DNA, 25 bp, Mus musculus
ggcgccttgcacttagaaggtccga

SEQ ID NO: 618110 - DNA, 25 bp, Mus musculus
ggcgccttgccaaacatctgttaag

SEQ ID NO: 618111 - DNA, 25 bp, Mus musculus
ggcgccttgccatacatctgttaag

SEQ ID NO: 618112 - DNA, 25 bp, Mus musculus
ggcgcctttgcaaatctaaacctaa

SEQ ID NO: 618113 - DNA, 25 bp, Mus musculus
ggcgcctttgcatatctaaacctaa

SEQ ID NO: 618114 - DNA, 25 bp, Mus musculus
ggcgcgcgcggtcgccgggcagcat

SEQ ID NO: 618115 - DNA, 25 bp, Mus musculus
ggcgcgcgcggtggccgggcagcat

SEQ ID NO: 618116 - DNA, 25 bp, Mus musculus
ggcgcgcgctttatgcggaatttga

SEQ ID NO: 618117 - DNA, 25 bp, Mus musculus
ggcgcgcgctttttgcggaatttga

SEQ ID NO: 618118 - DNA, 25 bp, Mus musculus
ggcgcggagtggacgagcagcccag

SEQ ID NO: 618119 - DNA, 25 bp, Mus musculus
ggcgcggagtggtcgagcagcccag

SEQ ID NO: 618120 - DNA, 25 bp, Mus musculus
ggcgcggataaacgcaaagacttat

SEQ ID NO: 618121 - DNA, 25 bp, Mus musculus
ggcgcggataaaggcaaagacttat

SEQ ID NO: 618122 - DNA, 25 bp, Mus musculus
ggcgcggatcacagctggagtttac

SEQ ID NO: 618123 - DNA, 25 bp, Mus musculus
ggcgcggatcactgctggagtttac

SEQ ID NO: 618124 - DNA, 25 bp, Mus musculus
ggcgcggcacacatccagaggaaaa

SEQ ID NO: 618125 - DNA, 25 bp, Mus musculus
ggcgcggcacacttccagaggaaaa

SEQ ID NO: 618126 - DNA, 25 bp, Mus musculus
ggcgcggcagagaagcatccttgct

SEQ ID NO: 618127 - DNA, 25 bp, Mus musculus
ggcgcggcagagtagcatccttgct

SEQ ID NO: 618128 - DNA, 25 bp, Mus musculus
ggcgcggcagtgatgaccaatgtca

SEQ ID NO: 618129 - DNA, 25 bp, Mus musculus
ggcgcggcagtgttgaccaatgtca

SEQ ID NO: 618130 - DNA, 25 bp, Mus musculus
ggcgcgggcacaacattgctccgag

SEQ ID NO: 618131 - DNA, 25 bp, Mus musculus
ggcgcgggcacatcattgctccgag

SEQ ID NO: 618132 - DNA, 25 bp, Mus musculus
ggcgcggtgtttagactttactgat

SEQ ID NO: 618133 - DNA, 25 bp, Mus musculus
ggcgcggtgttttgactttactgat

SEQ ID NO: 618134 - DNA, 25 bp, Mus musculus
ggcgcgtcagcccaaagtctttggt

SEQ ID NO: 618135 - DNA, 25 bp, Mus musculus
ggcgcgtcagccgaaagtctttggt

SEQ ID NO: 618136 - DNA, 25 bp, Mus musculus
ggcgcgtgtcccaggacgtcaacca

SEQ ID NO: 618137 - DNA, 25 bp, Mus musculus
ggcgcgtgtccctggacgtcaacca

SEQ ID NO: 618138 - DNA, 25 bp, Mus musculus
ggcgcgttcatcagagcactaggct

SEQ ID NO: 618139 - DNA, 25 bp, Mus musculus
ggcgcgttcatctgagcactaggct

SEQ ID NO: 618140 - DNA, 25 bp, Mus musculus
ggcgctaaagcgagtccagtgctgc

SEQ ID NO: 618141 - DNA, 25 bp, Mus musculus
ggcgctaaagcgtgtccagtgctgc

SEQ ID NO: 618142 - DNA, 25 bp, Mus musculus
ggcgctaaccatatgacctggtagt

SEQ ID NO: 618143 - DNA, 25 bp, Mus musculus
ggcgctaaccatttgacctggtagt

SEQ ID NO: 618144 - DNA, 25 bp, Mus musculus
ggcgctaccagaagtcgaccgagct

SEQ ID NO: 618145 - DNA, 25 bp, Mus musculus
ggcgctaccagatgtcgaccgagct

SEQ ID NO: 618146 - DNA, 25 bp, Mus musculus
ggcgctaccgcaccgagagccagaa

SEQ ID NO: 618147 - DNA, 25 bp, Mus musculus
ggcgctaccgcagcgagagccagaa

SEQ ID NO: 618148 - DNA, 25 bp, Mus musculus
ggcgctacgagtacgaccactggga

SEQ ID NO: 618149 - DNA, 25 bp, Mus musculus
ggcgctacgagttcgaccactggga

SEQ ID NO: 618150 - DNA, 25 bp, Mus musculus
ggcgctagccaaaggaatttccaga

SEQ ID NO: 618151 - DNA, 25 bp, Mus musculus
ggcgctagccaatggaatttccaga

SEQ ID NO: 618152 - DNA, 25 bp, Mus musculus
ggcgctaggaagatcaaacaccatt

SEQ ID NO: 618153 - DNA, 25 bp, Mus musculus
ggcgctaggaagttcaaacaccatt

SEQ ID NO: 618154 - DNA, 25 bp, Mus musculus
ggcgctagttaaaggccagcctgac

SEQ ID NO: 618155 - DNA, 25 bp, Mus musculus
ggcgctagttaatggccagcctgac

SEQ ID NO: 618156 - DNA, 25 bp, Mus musculus
ggcgctatgagccagctgctagaat

SEQ ID NO: 618157 - DNA, 25 bp, Mus musculus
ggcgctatgagcgagctgctagaat

SEQ ID NO: 618158 - DNA, 25 bp, Mus musculus
ggcgctatgccacacacgagaggaa

SEQ ID NO: 618159 - DNA, 25 bp, Mus musculus
ggcgctatgccagacacgagaggaa

SEQ ID NO: 618160 - DNA, 25 bp, Mus musculus
ggcgctattattattgttactgtca

SEQ ID NO: 618161 - DNA, 25 bp, Mus musculus
ggcgctattatttttgttactgtca

SEQ ID NO: 618162 - DNA, 25 bp, Mus musculus
ggcgctcagcagaaatgacccccat

SEQ ID NO: 618163 - DNA, 25 bp, Mus musculus
ggcgctcagcagtaatgacccccat

SEQ ID NO: 618164 - DNA, 25 bp, Mus musculus
ggcgctcagtacagttcacctatag

SEQ ID NO: 618165 - DNA, 25 bp, Mus musculus
ggcgctcagtactgttcacctatag

SEQ ID NO: 618166 - DNA, 25 bp, Mus musculus
ggcgctcataacagcctagctaagg

SEQ ID NO: 618167 - DNA, 25 bp, Mus musculus
ggcgctcataactgcctagctaagg

SEQ ID NO: 618168 - DNA, 25 bp, Mus musculus
ggcgctccgttcagcatctggaaga

SEQ ID NO: 618169 - DNA, 25 bp, Mus musculus
ggcgctccgttctgcatctggaaga

SEQ ID NO: 618170 - DNA, 25 bp, Mus musculus
ggcgctcctgcacaggactatctaa

SEQ ID NO: 618171 - DNA, 25 bp, Mus musculus
ggcgctcctgcagaggactatctaa

SEQ ID NO: 618172 - DNA, 25 bp, Mus musculus
ggcgctcgagtgaccatttaagcat

SEQ ID NO: 618173 - DNA, 25 bp, Mus musculus
ggcgctcgagtgtccatttaagcat

SEQ ID NO: 618174 - DNA, 25 bp, Mus musculus
ggcgctcttcaaataactggcttcc

SEQ ID NO: 618175 - DNA, 25 bp, Mus musculus
ggcgctcttcaattaactggcttcc

SEQ ID NO: 618176 - DNA, 25 bp, Mus musculus
ggcgctcttgttctagtttgtatta

SEQ ID NO: 618177 - DNA, 25 bp, Mus musculus
ggcgctcttgttgtagtttgtatta

SEQ ID NO: 618178 - DNA, 25 bp, Mus musculus
ggcgctctttacaacagctgtctgg

SEQ ID NO: 618179 - DNA, 25 bp, Mus musculus
ggcgctctttactacagctgtctgg

SEQ ID NO: 618180 - DNA, 25 bp, Mus musculus
ggcgctgagttgatgattgtttgct

SEQ ID NO: 618181 - DNA, 25 bp, Mus musculus
ggcgctgagttgttgattgtttgct

SEQ ID NO: 618182 - DNA, 25 bp, Mus musculus
ggcgctgatcagcatatctccttaa

SEQ ID NO: 618183 - DNA, 25 bp, Mus musculus
ggcgctgatcaggatatctccttaa

SEQ ID NO: 618184 - DNA, 25 bp, Mus musculus
ggcgctgatgtccagtgtgctccat

SEQ ID NO: 618185 - DNA, 25 bp, Mus musculus
ggcgctgatgtcgagtgtgctccat

SEQ ID NO: 618186 - DNA, 25 bp, Mus musculus
ggcgctgcaagcattgatattttat

SEQ ID NO: 618187 - DNA, 25 bp, Mus musculus
ggcgctgcaagctttgatattttat

SEQ ID NO: 618188 - DNA, 25 bp, Mus musculus
ggcgctgcacagaggctaagatgct

SEQ ID NO: 618189 - DNA, 25 bp, Mus musculus
ggcgctgcacagtggctaagatgct

SEQ ID NO: 618190 - DNA, 25 bp, Mus musculus
ggcgctgcagcaagcgaggacccca

SEQ ID NO: 618191 - DNA, 25 bp, Mus musculus
ggcgctgcagcacgccatagagaaa

SEQ ID NO: 618192 - DNA, 25 bp, Mus musculus
ggcgctgcagcaggccatagagaaa

SEQ ID NO: 618193 - DNA, 25 bp, Mus musculus
ggcgctgcagcatgcgaggacccca

SEQ ID NO: 618194 - DNA, 25 bp, Mus musculus
ggcgctgcagcccaagagatcaaca

SEQ ID NO: 618195 - DNA, 25 bp, Mus musculus
ggcgctgcagccgaagagatcaaca

SEQ ID NO: 618196 - DNA, 25 bp, Mus musculus
ggcgctgcaggcaaagactttaaaa

SEQ ID NO: 618197 - DNA, 25 bp, Mus musculus
ggcgctgcaggctaagactttaaaa

SEQ ID NO: 618198 - DNA, 25 bp, Mus musculus
ggcgctgcccttcagaacagactga

SEQ ID NO: 618199 - DNA, 25 bp, Mus musculus
ggcgctgcccttgagaacagactga

SEQ ID NO: 618200 - DNA, 25 bp, Mus musculus
ggcgctgcgagaagactcagtccta

SEQ ID NO: 618201 - DNA, 25 bp, Mus musculus
ggcgctgcgagatgactcagtccta

SEQ ID NO: 618202 - DNA, 25 bp, Mus musculus
ggcgctgctattatatacatggctg

SEQ ID NO: 618203 - DNA, 25 bp, Mus musculus
ggcgctgctattttatacatggctg

SEQ ID NO: 618204 - DNA, 25 bp, Mus musculus
ggcgctgctcctaggcaaatggaaa

SEQ ID NO: 618205 - DNA, 25 bp, Mus musculus
ggcgctgctccttggcaaatggaaa

SEQ ID NO: 618206 - DNA, 25 bp, Mus musculus
ggcgctggagtcagacaggcacact

SEQ ID NO: 618207 - DNA, 25 bp, Mus musculus
ggcgctggagtctgacaggcacact

SEQ ID NO: 618208 - DNA, 25 bp, Mus musculus
ggcgctggatccaacacgggaagaa

SEQ ID NO: 618209 - DNA, 25 bp, Mus musculus
ggcgctggatcctacacgggaagaa

SEQ ID NO: 618210 - DNA, 25 bp, Mus musculus
ggcgctggattcactggacatggat

SEQ ID NO: 618211 - DNA, 25 bp, Mus musculus
ggcgctggattctctggacatggat

SEQ ID NO: 618212 - DNA, 25 bp, Mus musculus
ggcgctggcacgcatgtgcatatat

SEQ ID NO: 618213 - DNA, 25 bp, Mus musculus
ggcgctggcacggatgtgcatatat

SEQ ID NO: 618214 - DNA, 25 bp, Mus musculus
ggcgctgggcagatgaagcttacca

SEQ ID NO: 618215 - DNA, 25 bp, Mus musculus
ggcgctgggcagttgaagcttacca

SEQ ID NO: 618216 - DNA, 25 bp, Mus musculus
ggcgctggtttaacctctgtaagac

SEQ ID NO: 618217 - DNA, 25 bp, Mus musculus
ggcgctggtttatcctctgtaagac

SEQ ID NO: 618218 - DNA, 25 bp, Mus musculus
ggcgctgtacaactcaccttgtata

SEQ ID NO: 618219 - DNA, 25 bp, Mus musculus
ggcgctgtacaagtcaccttgtata

SEQ ID NO: 618220 - DNA, 25 bp, Mus musculus
ggcgctgtcattacaggccattggt

SEQ ID NO: 618221 - DNA, 25 bp, Mus musculus
ggcgctgtcatttcaggccattggt

SEQ ID NO: 618222 - DNA, 25 bp, Mus musculus
ggcgctgtccaaaggcggctttgat

SEQ ID NO: 618223 - DNA, 25 bp, Mus musculus
ggcgctgtccaatggcggctttgat

SEQ ID NO: 618224 - DNA, 25 bp, Mus musculus
ggcgctgtcggcatgctaaacactt

SEQ ID NO: 618225 - DNA, 25 bp, Mus musculus
ggcgctgtcggcttgctaaacactt

SEQ ID NO: 618226 - DNA, 25 bp, Mus musculus
ggcgctgtgcaaatcatgatgacca

SEQ ID NO: 618227 - DNA, 25 bp, Mus musculus
ggcgctgtgcaattcatgatgacca

SEQ ID NO: 618228 - DNA, 25 bp, Mus musculus
ggcgctgtgcgcaaggtctgaaacc

SEQ ID NO: 618229 - DNA, 25 bp, Mus musculus
ggcgctgtgcgctaggtctgaaacc

SEQ ID NO: 618230 - DNA, 25 bp, Mus musculus
ggcgctgtggttagtgccattagcc

SEQ ID NO: 618231 - DNA, 25 bp, Mus musculus
ggcgctgtggtttgtgccattagcc

SEQ ID NO: 618232 - DNA, 25 bp, Mus musculus
ggcgctgttaatacacagtacttca

SEQ ID NO: 618233 - DNA, 25 bp, Mus musculus
ggcgctgttaattcacagtacttca

SEQ ID NO: 618234 - DNA, 25 bp, Mus musculus
ggcgcttaatataaaaacctggtgt

SEQ ID NO: 618235 - DNA, 25 bp, Mus musculus
ggcgcttaatattaaaacctggtgt

SEQ ID NO: 618236 - DNA, 25 bp, Mus musculus
ggcgcttagttaattctctttggaa

SEQ ID NO: 618237 - DNA, 25 bp, Mus musculus
ggcgcttagttatttctctttggaa

SEQ ID NO: 618238 - DNA, 25 bp, Mus musculus
ggcgcttcaagcctgtgctccagaa

SEQ ID NO: 618239 - DNA, 25 bp, Mus musculus
ggcgcttcaagcgtgtgctccagaa

SEQ ID NO: 618240 - DNA, 25 bp, Mus musculus
ggcgcttcctcaacaaattgtgtga

SEQ ID NO: 618241 - DNA, 25 bp, Mus musculus
ggcgcttcctcatcaaattgtgtga

SEQ ID NO: 618242 - DNA, 25 bp, Mus musculus
ggcgcttctttgcaaaagatcctgt

SEQ ID NO: 618243 - DNA, 25 bp, Mus musculus
ggcgcttctttggaaaagatcctgt

SEQ ID NO: 618244 - DNA, 25 bp, Mus musculus
ggcgcttgaaccattttgccctgaa

SEQ ID NO: 618245 - DNA, 25 bp, Mus musculus
ggcgcttgaacctttttgccctgaa

SEQ ID NO: 618246 - DNA, 25 bp, Mus musculus
ggcgcttgccagcatgctgacagat

SEQ ID NO: 618247 - DNA, 25 bp, Mus musculus
ggcgcttgccaggatgctgacagat

SEQ ID NO: 618248 - DNA, 25 bp, Mus musculus
ggcgcttggaaaaccctggtcacgg

SEQ ID NO: 618249 - DNA, 25 bp, Mus musculus
ggcgcttggaaatccctggtcacgg

SEQ ID NO: 618250 - DNA, 25 bp, Mus musculus
ggcgcttggacaatcttcatggtgt

SEQ ID NO: 618251 - DNA, 25 bp, Mus musculus
ggcgcttggacattcttcatggtgt

SEQ ID NO: 618252 - DNA, 25 bp, Mus musculus
ggcgcttggagaagcctggatcttt

SEQ ID NO: 618253 - DNA, 25 bp, Mus musculus
ggcgcttggagatgcctggatcttt

SEQ ID NO: 618254 - DNA, 25 bp, Mus musculus
ggcgcttgggctaataacgcacttt

SEQ ID NO: 618255 - DNA, 25 bp, Mus musculus
ggcgcttgggcttataacgcacttt

SEQ ID NO: 618256 - DNA, 25 bp, Mus musculus
ggcgcttgtgacattggaaagtcaa

SEQ ID NO: 618257 - DNA, 25 bp, Mus musculus
ggcgcttgtgactttggaaagtcaa

SEQ ID NO: 618258 - DNA, 25 bp, Mus musculus
ggcgcttgttcaacattttacaggc

SEQ ID NO: 618259 - DNA, 25 bp, Mus musculus
ggcgcttgttcatcattttacaggc

SEQ ID NO: 618260 - DNA, 25 bp, Mus musculus
ggcgctttaggtccttgcaggcaaa

SEQ ID NO: 618261 - DNA, 25 bp, Mus musculus
ggcgctttaggtgcttgcaggcaaa

SEQ ID NO: 618262 - DNA, 25 bp, Mus musculus
ggcgctttcccacactagggtatgg

SEQ ID NO: 618263 - DNA, 25 bp, Mus musculus
ggcgctttcccagactagggtatgg

SEQ ID NO: 618264 - DNA, 25 bp, Mus musculus
ggcggaaactccatgcttgttaaaa

SEQ ID NO: 618265 - DNA, 25 bp, Mus musculus
ggcggaaactccttgcttgttaaaa

SEQ ID NO: 618266 - DNA, 25 bp, Mus musculus
ggcggaactttacggacctcaggct

SEQ ID NO: 618267 - DNA, 25 bp, Mus musculus
ggcggaactttagggacctcaggct

SEQ ID NO: 618268 - DNA, 25 bp, Mus musculus
ggcggaagacgaatcctccattgaa

SEQ ID NO: 618269 - DNA, 25 bp, Mus musculus
ggcggaagacgattcctccattgaa

SEQ ID NO: 618270 - DNA, 25 bp, Mus musculus
ggcggaagcaacactcactgctcaa

SEQ ID NO: 618271 - DNA, 25 bp, Mus musculus
ggcggaagcaactctcactgctcaa

SEQ ID NO: 618272 - DNA, 25 bp, Mus musculus
ggcggaagcagaactctggaatcaa

SEQ ID NO: 618273 - DNA, 25 bp, Mus musculus
ggcggaagcagatctctggaatcaa

SEQ ID NO: 618274 - DNA, 25 bp, Mus musculus
ggcggaagcgaacctgcctggctgg

SEQ ID NO: 618275 - DNA, 25 bp, Mus musculus
ggcggaagcgaagctgcctggctgg

SEQ ID NO: 618276 - DNA, 25 bp, Mus musculus
ggcggaagctatatttagccacatt

SEQ ID NO: 618277 - DNA, 25 bp, Mus musculus
ggcggaagctatttttagccacatt

SEQ ID NO: 618278 - DNA, 25 bp, Mus musculus
ggcggaagctcaagatgacagcatt

SEQ ID NO: 618279 - DNA, 25 bp, Mus musculus
ggcggaagctcatgatgacagcatt

SEQ ID NO: 618280 - DNA, 25 bp, Mus musculus
ggcggaaggtcaagctggccttacc

SEQ ID NO: 618281 - DNA, 25 bp, Mus musculus
ggcggaaggtcatgctggccttacc

SEQ ID NO: 618282 - DNA, 25 bp, Mus musculus
ggcggacaagaacaccagaatcgaa

SEQ ID NO: 618283 - DNA, 25 bp, Mus musculus
ggcggacaagaagaccagaatcgaa

SEQ ID NO: 618284 - DNA, 25 bp, Mus musculus
ggcggacactggctactggctacca

SEQ ID NO: 618285 - DNA, 25 bp, Mus musculus
ggcggacactgggtactggctacca

SEQ ID NO: 618286 - DNA, 25 bp, Mus musculus
ggcggacagtagaaggcctgggccc

SEQ ID NO: 618287 - DNA, 25 bp, Mus musculus
ggcggacagtagtaggcctgggccc

SEQ ID NO: 618288 - DNA, 25 bp, Mus musculus
ggcggacatgtaaggacatcagtga

SEQ ID NO: 618289 - DNA, 25 bp, Mus musculus
ggcggacatgtatggacatcagtga

SEQ ID NO: 618290 - DNA, 25 bp, Mus musculus
ggcggacatttgagtggttccatct

SEQ ID NO: 618291 - DNA, 25 bp, Mus musculus
ggcggacatttgtgtggttccatct

SEQ ID NO: 618292 - DNA, 25 bp, Mus musculus
ggcggacctgcgctccctgatgatc

SEQ ID NO: 618293 - DNA, 25 bp, Mus musculus
ggcggacctgcggtccctgatgatc

SEQ ID NO: 618294 - DNA, 25 bp, Mus musculus
ggcggacctttccttcaagaggagt

SEQ ID NO: 618295 - DNA, 25 bp, Mus musculus
ggcggacctttcgttcaagaggagt

SEQ ID NO: 618296 - DNA, 25 bp, Mus musculus
ggcggactcagaaatgaccattcag

SEQ ID NO: 618297 - DNA, 25 bp, Mus musculus
ggcggactcagatatgaccattcag

SEQ ID NO: 618298 - DNA, 25 bp, Mus musculus
ggcggactccaacagctcgtgacaa

SEQ ID NO: 618299 - DNA, 25 bp, Mus musculus
ggcggactccaagagctcgtgacaa

SEQ ID NO: 618300 - DNA, 25 bp, Mus musculus
ggcggactgttactgagctgcgttt

SEQ ID NO: 618301 - DNA, 25 bp, Mus musculus
ggcggactgttagtgagctgcgttt

SEQ ID NO: 618302 - DNA, 25 bp, Mus musculus
ggcggacttcaacatccctatggag

SEQ ID NO: 618303 - DNA, 25 bp, Mus musculus
ggcggacttcaagatccctatggag

SEQ ID NO: 618304 - DNA, 25 bp, Mus musculus
ggcggacttgcaacgagtgttcacc

SEQ ID NO: 618305 - DNA, 25 bp, Mus musculus
ggcggacttgcatcgagtgttcacc

SEQ ID NO: 618306 - DNA, 25 bp, Mus musculus
ggcggagaatcacctcacatgttac

SEQ ID NO: 618307 - DNA, 25 bp, Mus musculus
ggcggagaatcagctcacatgttac

SEQ ID NO: 618308 - DNA, 25 bp, Mus musculus
ggcggagacctcctccattcagtct

SEQ ID NO: 618309 - DNA, 25 bp, Mus musculus
ggcggagacctcgtccattcagtct

SEQ ID NO: 618310 - DNA, 25 bp, Mus musculus
ggcggagactctaggtgactgataa

SEQ ID NO: 618311 - DNA, 25 bp, Mus musculus
ggcggagactcttggtgactgataa

SEQ ID NO: 618312 - DNA, 25 bp, Mus musculus
ggcggagcgaataatcaagtaacat

SEQ ID NO: 618313 - DNA, 25 bp, Mus musculus
ggcggagcgaattatcaagtaacat

SEQ ID NO: 618314 - DNA, 25 bp, Mus musculus
ggcggagctctaccctgaagatata

SEQ ID NO: 618315 - DNA, 25 bp, Mus musculus
ggcggagctctagcctgaagatata

SEQ ID NO: 618316 - DNA, 25 bp, Mus musculus
ggcggaggacccatgcagctctcgc

SEQ ID NO: 618317 - DNA, 25 bp, Mus musculus
ggcggaggacccttgcagctctcgc

SEQ ID NO: 618318 - DNA, 25 bp, Mus musculus
ggcggaggagaacctcaactacaag

SEQ ID NO: 618319 - DNA, 25 bp, Mus musculus
ggcggaggagaagctcaactacaag

SEQ ID NO: 618320 - DNA, 25 bp, Mus musculus
ggcggaggtgctagatccacagaac

SEQ ID NO: 618321 - DNA, 25 bp, Mus musculus
ggcggaggtgcttgatccacagaac

SEQ ID NO: 618322 - DNA, 25 bp, Mus musculus
ggcggagtcaccctgccagctcgaa

SEQ ID NO: 618323 - DNA, 25 bp, Mus musculus
ggcggagtcaccgtgccagctcgaa

SEQ ID NO: 618324 - DNA, 25 bp, Mus musculus
ggcggagtttctaacatgcaaccaa

SEQ ID NO: 618325 - DNA, 25 bp, Mus musculus
ggcggagtttcttacatgcaaccaa

SEQ ID NO: 618326 - DNA, 25 bp, Mus musculus
ggcggataagtgcagctgttcatat

SEQ ID NO: 618327 - DNA, 25 bp, Mus musculus
ggcggataagtggagctgttcatat

SEQ ID NO: 618328 - DNA, 25 bp, Mus musculus
ggcggatactttaatatgaatctca

SEQ ID NO: 618329 - DNA, 25 bp, Mus musculus
ggcggatacttttatatgaatctca

SEQ ID NO: 618330 - DNA, 25 bp, Mus musculus
ggcggatccaacactcggagaggaa

SEQ ID NO: 618331 - DNA, 25 bp, Mus musculus
ggcggatccaactctcggagaggaa

SEQ ID NO: 618332 - DNA, 25 bp, Mus musculus
ggcggatctaccatcaaatgaccac

SEQ ID NO: 618333 - DNA, 25 bp, Mus musculus
ggcggatctaccttcaaatgaccac

SEQ ID NO: 618334 - DNA, 25 bp, Mus musculus
ggcggatgtattaattgtacaaacc

SEQ ID NO: 618335 - DNA, 25 bp, Mus musculus
ggcggatgtatttattgtacaaacc

SEQ ID NO: 618336 - DNA, 25 bp, Mus musculus
ggcggattttgcaacaccaagctca

SEQ ID NO: 618337 - DNA, 25 bp, Mus musculus
ggcggattttgctacaccaagctca

SEQ ID NO: 618338 - DNA, 25 bp, Mus musculus
ggcggcaaacagacagacatcactt

SEQ ID NO: 618339 - DNA, 25 bp, Mus musculus
ggcggcaaacagtcagacatcactt

SEQ ID NO: 618340 - DNA, 25 bp, Mus musculus
ggcggcaaatgtctttagtcccagc

SEQ ID NO: 618341 - DNA, 25 bp, Mus musculus
ggcggcaaatgtgtttagtcccagc

SEQ ID NO: 618342 - DNA, 25 bp, Mus musculus
ggcggcaaatttacaaacgttcaag

SEQ ID NO: 618343 - DNA, 25 bp, Mus musculus
ggcggcaaattttcaaacgttcaag

SEQ ID NO: 618344 - DNA, 25 bp, Mus musculus
ggcggcaagctgagtacacacctaa

SEQ ID NO: 618345 - DNA, 25 bp, Mus musculus
ggcggcaagctgtgtacacacctaa

SEQ ID NO: 618346 - DNA, 25 bp, Mus musculus
ggcggcacactactggtaaattcaa

SEQ ID NO: 618347 - DNA, 25 bp, Mus musculus
ggcggcacactagtggtaaattcaa

SEQ ID NO: 618348 - DNA, 25 bp, Mus musculus
ggcggcacctgcaattgaccatgct

SEQ ID NO: 618349 - DNA, 25 bp, Mus musculus
ggcggcacctgctattgaccatgct

SEQ ID NO: 618350 - DNA, 25 bp, Mus musculus
ggcggcacctggaaacacttatacg

SEQ ID NO: 618351 - DNA, 25 bp, Mus musculus
ggcggcacctggtaacacttatacg

SEQ ID NO: 618352 - DNA, 25 bp, Mus musculus
ggcggcacgttcaatgtgacatgtc

SEQ ID NO: 618353 - DNA, 25 bp, Mus musculus
ggcggcacgttctatgtgacatgtc

SEQ ID NO: 618354 - DNA, 25 bp, Mus musculus
ggcggcacgtttcgcactttcatgg

SEQ ID NO: 618355 - DNA, 25 bp, Mus musculus
ggcggcacgtttggcactttcatgg

SEQ ID NO: 618356 - DNA, 25 bp, Mus musculus
ggcggcactaatctatttactcatc

SEQ ID NO: 618357 - DNA, 25 bp, Mus musculus
ggcggcactaatgtatttactcatc

SEQ ID NO: 618358 - DNA, 25 bp, Mus musculus
ggcggcacttctctcatcaaagagg

SEQ ID NO: 618359 - DNA, 25 bp, Mus musculus
ggcggcacttctgtcatcaaagagg

SEQ ID NO: 618360 - DNA, 25 bp, Mus musculus
ggcggcagccgcctataaggtctct

SEQ ID NO: 618361 - DNA, 25 bp, Mus musculus
ggcggcagccgcgtataaggtctct

SEQ ID NO: 618362 - DNA, 25 bp, Mus musculus
ggcggcaggaacatgaaatcgtaat

SEQ ID NO: 618363 - DNA, 25 bp, Mus musculus
ggcggcaggaacttgaaatcgtaat

SEQ ID NO: 618364 - DNA, 25 bp, Mus musculus
ggcggcagtagcaaccggcgaaaca

SEQ ID NO: 618365 - DNA, 25 bp, Mus musculus
ggcggcagtagctaccggcgaaaca

SEQ ID NO: 618366 - DNA, 25 bp, Mus musculus
ggcggcatagacatggctttcccac

SEQ ID NO: 618367 - DNA, 25 bp, Mus musculus
ggcggcatagacttggctttcccac

SEQ ID NO: 618368 - DNA, 25 bp, Mus musculus
ggcggcatccacagagaactcggaa

SEQ ID NO: 618369 - DNA, 25 bp, Mus musculus
ggcggcatccactgagaactcggaa

SEQ ID NO: 618370 - DNA, 25 bp, Mus musculus
ggcggcatgattcaggaactctcta

SEQ ID NO: 618371 - DNA, 25 bp, Mus musculus
ggcggcatgattgaggaactctcta

SEQ ID NO: 618372 - DNA, 25 bp, Mus musculus
ggcggcatgtgaatgtgctctcaga

SEQ ID NO: 618373 - DNA, 25 bp, Mus musculus
ggcggcatgtgattgtgctctcaga

SEQ ID NO: 618374 - DNA, 25 bp, Mus musculus
ggcggcattctgacatttacacatg

SEQ ID NO: 618375 - DNA, 25 bp, Mus musculus
ggcggcattctgtcatttacacatg

SEQ ID NO: 618376 - DNA, 25 bp, Mus musculus
ggcggccaaatcctatattcagtcc

SEQ ID NO: 618377 - DNA, 25 bp, Mus musculus
ggcggccaaatcgtatattcagtcc

SEQ ID NO: 618378 - DNA, 25 bp, Mus musculus
ggcggccacataaaaaggcaatttt

SEQ ID NO: 618379 - DNA, 25 bp, Mus musculus
ggcggccacatataaaggcaatttt

SEQ ID NO: 618380 - DNA, 25 bp, Mus musculus
ggcggccatggcatccgaccctagg

SEQ ID NO: 618381 - DNA, 25 bp, Mus musculus
ggcggccatggcttccgaccctagg

SEQ ID NO: 618382 - DNA, 25 bp, Mus musculus
ggcggccattgcctttgttaagtac

SEQ ID NO: 618383 - DNA, 25 bp, Mus musculus
ggcggccattgcgtttgttaagtac

SEQ ID NO: 618384 - DNA, 25 bp, Mus musculus
ggcggcccgactcttaagcttgtat

SEQ ID NO: 618385 - DNA, 25 bp, Mus musculus
ggcggcccgactgttaagcttgtat

SEQ ID NO: 618386 - DNA, 25 bp, Mus musculus
ggcggccggcacatgtacttttgag

SEQ ID NO: 618387 - DNA, 25 bp, Mus musculus
ggcggccggcacttgtacttttgag

SEQ ID NO: 618388 - DNA, 25 bp, Mus musculus
ggcggcctagctaccggaaccggca

SEQ ID NO: 618389 - DNA, 25 bp, Mus musculus
ggcggcctagcttccggaaccggca

SEQ ID NO: 618390 - DNA, 25 bp, Mus musculus
ggcggcctcttaacattacagactt

SEQ ID NO: 618391 - DNA, 25 bp, Mus musculus
ggcggcctcttatcattacagactt

SEQ ID NO: 618392 - DNA, 25 bp, Mus musculus
ggcggcctttcgcaatgttgtctct

SEQ ID NO: 618393 - DNA, 25 bp, Mus musculus
ggcggcctttcggaatgttgtctct

SEQ ID NO: 618394 - DNA, 25 bp, Mus musculus
ggcggcgatgtcattagacattttc

SEQ ID NO: 618395 - DNA, 25 bp, Mus musculus
ggcggcgatgtctttagacattttc

SEQ ID NO: 618396 - DNA, 25 bp, Mus musculus
ggcggcgccaacaagaagctgagta

SEQ ID NO: 618397 - DNA, 25 bp, Mus musculus
ggcggcgccaactagaagctgagta

SEQ ID NO: 618398 - DNA, 25 bp, Mus musculus
ggcggcgcctgtccttccgcgaggg

SEQ ID NO: 618399 - DNA, 25 bp, Mus musculus
ggcggcgcctgtgcttccgcgaggg

SEQ ID NO: 618400 - DNA, 25 bp, Mus musculus
ggcggcgcgattctgaggtggctgc

SEQ ID NO: 618401 - DNA, 25 bp, Mus musculus
ggcggcgcgattgtgaggtggctgc

SEQ ID NO: 618402 - DNA, 25 bp, Mus musculus
ggcggcgcgcagagaaaccctgacc

SEQ ID NO: 618403 - DNA, 25 bp, Mus musculus
ggcggcgcgcagtgaaaccctgacc

SEQ ID NO: 618404 - DNA, 25 bp, Mus musculus
ggcggcgcttcacgtccgtttctcg

SEQ ID NO: 618405 - DNA, 25 bp, Mus musculus
ggcggcgcttcaggtccgtttctcg

SEQ ID NO: 618406 - DNA, 25 bp, Mus musculus
ggcggcggccgcaaagaactcaagc

SEQ ID NO: 618407 - DNA, 25 bp, Mus musculus
ggcggcggccgctaagaactcaagc

SEQ ID NO: 618408 - DNA, 25 bp, Mus musculus
ggcggcgggccgcaggacgctaaga

SEQ ID NO: 618409 - DNA, 25 bp, Mus musculus
ggcggcgggccggaggacgctaaga

SEQ ID NO: 618410 - DNA, 25 bp, Mus musculus
ggcggcggtcctacataatgtgctg

SEQ ID NO: 618411 - DNA, 25 bp, Mus musculus
ggcggcggtccttcataatgtgctg

SEQ ID NO: 618412 - DNA, 25 bp, Mus musculus
ggcggctcaagcattcatgatggcc

SEQ ID NO: 618413 - DNA, 25 bp, Mus musculus
ggcggctcaagctttcatgatggcc

SEQ ID NO: 618414 - DNA, 25 bp, Mus musculus
ggcggctcacatattggtttgccaa

SEQ ID NO: 618415 - DNA, 25 bp, Mus musculus
ggcggctcacattttggtttgccaa

SEQ ID NO: 618416 - DNA, 25 bp, Mus musculus
ggcggctcccaacaagttgtgatag

SEQ ID NO: 618417 - DNA, 25 bp, Mus musculus
ggcggctcccaacatttttgaaatt

SEQ ID NO: 618418 - DNA, 25 bp, Mus musculus
ggcggctcccaagaagttgtgatag

SEQ ID NO: 618419 - DNA, 25 bp, Mus musculus
ggcggctcccaagatttttgaaatt

SEQ ID NO: 618420 - DNA, 25 bp, Mus musculus
ggcggctctcctagctctggaagaa

SEQ ID NO: 618421 - DNA, 25 bp, Mus musculus
ggcggctctccttgctctggaagaa

SEQ ID NO: 618422 - DNA, 25 bp, Mus musculus
ggcggctgacgcagtcagaagccca

SEQ ID NO: 618423 - DNA, 25 bp, Mus musculus
ggcggctgacgctgtcagaagccca

SEQ ID NO: 618424 - DNA, 25 bp, Mus musculus
ggcggctgtcacacggagaccaaat

SEQ ID NO: 618425 - DNA, 25 bp, Mus musculus
ggcggctgtcactcggagaccaaat

SEQ ID NO: 618426 - DNA, 25 bp, Mus musculus
ggcggctgttccagcagagctgtcc

SEQ ID NO: 618427 - DNA, 25 bp, Mus musculus
ggcggctgttcctgcagagctgtcc

SEQ ID NO: 618428 - DNA, 25 bp, Mus musculus
ggcggctttgccactgagatcagct

SEQ ID NO: 618429 - DNA, 25 bp, Mus musculus
ggcggctttgcctctgagatcagct

SEQ ID NO: 618430 - DNA, 25 bp, Mus musculus
ggcggctttgttaaccattccagag

SEQ ID NO: 618431 - DNA, 25 bp, Mus musculus
ggcggctttgtttaccattccagag

SEQ ID NO: 618432 - DNA, 25 bp, Mus musculus
ggcgggaaacacaagacaggtccaa

SEQ ID NO: 618433 - DNA, 25 bp, Mus musculus
ggcgggaaacactagacaggtccaa

SEQ ID NO: 618434 - DNA, 25 bp, Mus musculus
ggcgggaacaacaccgcgtcgtccg

SEQ ID NO: 618435 - DNA, 25 bp, Mus musculus
ggcgggaacaactccgcgtcgtccg

SEQ ID NO: 618436 - DNA, 25 bp, Mus musculus
ggcgggaaggcaatttcttagaata

SEQ ID NO: 618437 - DNA, 25 bp, Mus musculus
ggcgggaaggcattttcttagaata

SEQ ID NO: 618438 - DNA, 25 bp, Mus musculus
ggcgggaccagcaagcctcgacagc

SEQ ID NO: 618439 - DNA, 25 bp, Mus musculus
ggcgggaccagctagcctcgacagc

SEQ ID NO: 618440 - DNA, 25 bp, Mus musculus
ggcgggaccgaaagcaacctctgtg

SEQ ID NO: 618441 - DNA, 25 bp, Mus musculus
ggcgggaccgaatgcaacctctgtg

SEQ ID NO: 618442 - DNA, 25 bp, Mus musculus
ggcgggacgagaaatggatataaca

SEQ ID NO: 618443 - DNA, 25 bp, Mus musculus
ggcgggacgagatatggatataaca

SEQ ID NO: 618444 - DNA, 25 bp, Mus musculus
ggcgggagcaaccacaatcaaacct

SEQ ID NO: 618445 - DNA, 25 bp, Mus musculus
ggcgggagcaacgacaatcaaacct

SEQ ID NO: 618446 - DNA, 25 bp, Mus musculus
ggcgggagccctcaagcatgatcca

SEQ ID NO: 618447 - DNA, 25 bp, Mus musculus
ggcgggagccctgaagcatgatcca

SEQ ID NO: 618448 - DNA, 25 bp, Mus musculus
ggcgggatgggtagctaaatcttaa

SEQ ID NO: 618449 - DNA, 25 bp, Mus musculus
ggcgggatgggttgctaaatcttaa

SEQ ID NO: 618450 - DNA, 25 bp, Mus musculus
ggcgggcaactcattttcaaaacct

SEQ ID NO: 618451 - DNA, 25 bp, Mus musculus
ggcgggcaactctttttcaaaacct

SEQ ID NO: 618452 - DNA, 25 bp, Mus musculus
ggcgggcacaagaatataagcaaca

SEQ ID NO: 618453 - DNA, 25 bp, Mus musculus
ggcgggcacaagtatataagcaaca

SEQ ID NO: 618454 - DNA, 25 bp, Mus musculus
ggcgggcacaggacgttgtaattat

SEQ ID NO: 618455 - DNA, 25 bp, Mus musculus
ggcgggcacaggtcgttgtaattat

SEQ ID NO: 618456 - DNA, 25 bp, Mus musculus
ggcgggcactttatcagcttgctat

SEQ ID NO: 618457 - DNA, 25 bp, Mus musculus
ggcgggcactttttcagcttgctat

SEQ ID NO: 618458 - DNA, 25 bp, Mus musculus
ggcgggcatcttaaatccagactgg

SEQ ID NO: 618459 - DNA, 25 bp, Mus musculus
ggcgggcatctttaatccagactgg

SEQ ID NO: 618460 - DNA, 25 bp, Mus musculus
ggcgggccagacaatccaggcgctc

SEQ ID NO: 618461 - DNA, 25 bp, Mus musculus
ggcgggccagactatccaggcgctc

SEQ ID NO: 618462 - DNA, 25 bp, Mus musculus
ggcgggccagccactaatttgcaca

SEQ ID NO: 618463 - DNA, 25 bp, Mus musculus
ggcgggccagcctctaatttgcaca

SEQ ID NO: 618464 - DNA, 25 bp, Mus musculus
ggcgggccatctccaaaccaagaaa

SEQ ID NO: 618465 - DNA, 25 bp, Mus musculus
ggcgggccatctgcaaaccaagaaa

SEQ ID NO: 618466 - DNA, 25 bp, Mus musculus
ggcgggcgtgagcttccagaagaca

SEQ ID NO: 618467 - DNA, 25 bp, Mus musculus
ggcgggcgtgaggttccagaagaca

SEQ ID NO: 618468 - DNA, 25 bp, Mus musculus
ggcggggagacgatgcccacaccct

SEQ ID NO: 618469 - DNA, 25 bp, Mus musculus
ggcggggagacgttgcccacaccct

SEQ ID NO: 618470 - DNA, 25 bp, Mus musculus
ggcgggtaccatagatatgactctt

SEQ ID NO: 618471 - DNA, 25 bp, Mus musculus
ggcgggtaccattgatatgactctt

SEQ ID NO: 618472 - DNA, 25 bp, Mus musculus
ggcgggtactccagcagtttccctg

SEQ ID NO: 618473 - DNA, 25 bp, Mus musculus
ggcgggtactcctgcagtttccctg

SEQ ID NO: 618474 - DNA, 25 bp, Mus musculus
ggcgggtatcagaaaatcgtggttt

SEQ ID NO: 618475 - DNA, 25 bp, Mus musculus
ggcgggtatcagtaaatcgtggttt

SEQ ID NO: 618476 - DNA, 25 bp, Mus musculus
ggcgggtatctcacctgctcaccat

SEQ ID NO: 618477 - DNA, 25 bp, Mus musculus
ggcgggtatctctcctgctcaccat

SEQ ID NO: 618478 - DNA, 25 bp, Mus musculus
ggcgggtcaccaagtacttctgcag

SEQ ID NO: 618479 - DNA, 25 bp, Mus musculus
ggcgggtcaccatgtacttctgcag

SEQ ID NO: 618480 - DNA, 25 bp, Mus musculus
ggcgggtcatatacaggaatggctt

SEQ ID NO: 618481 - DNA, 25 bp, Mus musculus
ggcgggtcatattcaggaatggctt

SEQ ID NO: 618482 - DNA, 25 bp, Mus musculus
ggcgggtggcacataaagccagcaa

SEQ ID NO: 618483 - DNA, 25 bp, Mus musculus
ggcgggtggcacttaaagccagcaa

SEQ ID NO: 618484 - DNA, 25 bp, Mus musculus
ggcgggtgtgtgaatagcatatatt

SEQ ID NO: 618485 - DNA, 25 bp, Mus musculus
ggcgggtgtgtgtatagcatatatt

SEQ ID NO: 618486 - DNA, 25 bp, Mus musculus
ggcgggttccttctcattgtattga

SEQ ID NO: 618487 - DNA, 25 bp, Mus musculus
ggcgggttccttgtcattgtattga

SEQ ID NO: 618488 - DNA, 25 bp, Mus musculus
ggcgggttctaaagtctttttctgg

SEQ ID NO: 618489 - DNA, 25 bp, Mus musculus
ggcgggttctaatgtctttttctgg

SEQ ID NO: 618490 - DNA, 25 bp, Mus musculus
ggcgggtttcagcaaccaactccag

SEQ ID NO: 618491 - DNA, 25 bp, Mus musculus
ggcgggtttcaggaaccaactccag

SEQ ID NO: 618492 - DNA, 25 bp, Mus musculus
ggcgggtttctcatgcattggaaac

SEQ ID NO: 618493 - DNA, 25 bp, Mus musculus
ggcgggtttctcttgcattggaaac

SEQ ID NO: 618494 - DNA, 25 bp, Mus musculus
ggcgggtttctgagtgtgagttcca

SEQ ID NO: 618495 - DNA, 25 bp, Mus musculus
ggcgggtttctgtgtgtgagttcca

SEQ ID NO: 618496 - DNA, 25 bp, Mus musculus
ggcggtaacagcactggttccagtt

SEQ ID NO: 618497 - DNA, 25 bp, Mus musculus
ggcggtaacagctctggttccagtt

SEQ ID NO: 618498 - DNA, 25 bp, Mus musculus
ggcggtaacagtacatttctttcat

SEQ ID NO: 618499 - DNA, 25 bp, Mus musculus
ggcggtaacagttcatttctttcat

SEQ ID NO: 618500 - DNA, 25 bp, Mus musculus
ggcggtacatctcccttgaaatcat

SEQ ID NO: 618501 - DNA, 25 bp, Mus musculus
ggcggtacatctgccttgaaatcat

SEQ ID NO: 618502 - DNA, 25 bp, Mus musculus
ggcggtacatgtcgccttgtgccca

SEQ ID NO: 618503 - DNA, 25 bp, Mus musculus
ggcggtacatgtggccttgtgccca

SEQ ID NO: 618504 - DNA, 25 bp, Mus musculus
ggcggtagctgaatctggaagcaac

SEQ ID NO: 618505 - DNA, 25 bp, Mus musculus
ggcggtagctgattctggaagcaac

SEQ ID NO: 618506 - DNA, 25 bp, Mus musculus
ggcggtatcaacaactatttaacct

SEQ ID NO: 618507 - DNA, 25 bp, Mus musculus
ggcggtatcaactactatttaacct

SEQ ID NO: 618508 - DNA, 25 bp, Mus musculus
ggcggtattagtccctgtgctctac

SEQ ID NO: 618509 - DNA, 25 bp, Mus musculus
ggcggtattagtgcctgtgctctac

SEQ ID NO: 618510 - DNA, 25 bp, Mus musculus
ggcggtcaaatacaaaaggctccgt

SEQ ID NO: 618511 - DNA, 25 bp, Mus musculus
ggcggtcaaatagaaaaggctccgt

SEQ ID NO: 618512 - DNA, 25 bp, Mus musculus
ggcggtcagcacctaaacaccacag

SEQ ID NO: 618513 - DNA, 25 bp, Mus musculus
ggcggtcagcacgtaaacaccacag

SEQ ID NO: 618514 - DNA, 25 bp, Mus musculus
ggcggtcatcgcacaacaggatagc

SEQ ID NO: 618515 - DNA, 25 bp, Mus musculus
ggcggtcatcgctcaacaggatagc

SEQ ID NO: 618516 - DNA, 25 bp, Mus musculus
ggcggtcctgcaccaatgtattgga

SEQ ID NO: 618517 - DNA, 25 bp, Mus musculus
ggcggtcctgcagcaatgtattgga

SEQ ID NO: 618518 - DNA, 25 bp, Mus musculus
ggcggtctataactacagtccaaac

SEQ ID NO: 618519 - DNA, 25 bp, Mus musculus
ggcggtctataagtacagtccaaac

SEQ ID NO: 618520 - DNA, 25 bp, Mus musculus
ggcggtctgcaccactgggaacaaa

SEQ ID NO: 618521 - DNA, 25 bp, Mus musculus
ggcggtctgcacgactgggaacaaa

SEQ ID NO: 618522 - DNA, 25 bp, Mus musculus
ggcggtctgtgcaggtgttatccca

SEQ ID NO: 618523 - DNA, 25 bp, Mus musculus
ggcggtctgtgctggtgttatccca

SEQ ID NO: 618524 - DNA, 25 bp, Mus musculus
ggcggtctgtggatattcatgcccc

SEQ ID NO: 618525 - DNA, 25 bp, Mus musculus
ggcggtctgtggttattcatgcccc

SEQ ID NO: 618526 - DNA, 25 bp, Mus musculus
ggcggtgatgtcagccgggcgctgt

SEQ ID NO: 618527 - DNA, 25 bp, Mus musculus
ggcggtgatgtctgccgggcgctgt

SEQ ID NO: 618528 - DNA, 25 bp, Mus musculus
ggcggtgatgttaatgtcaggacct

SEQ ID NO: 618529 - DNA, 25 bp, Mus musculus
ggcggtgatgtttatgtcaggacct

SEQ ID NO: 618530 - DNA, 25 bp, Mus musculus
ggcggtgcagatcccttgatcgaaa

SEQ ID NO: 618531 - DNA, 25 bp, Mus musculus
ggcggtgcagatgccttgatcgaaa

SEQ ID NO: 618532 - DNA, 25 bp, Mus musculus
ggcggtgcatacctggattctcaga

SEQ ID NO: 618533 - DNA, 25 bp, Mus musculus
ggcggtgcatacgtggattctcaga

SEQ ID NO: 618534 - DNA, 25 bp, Mus musculus
ggcggtggacccacacctgtagtct

SEQ ID NO: 618535 - DNA, 25 bp, Mus musculus
ggcggtggaccctcacctgtagtct

SEQ ID NO: 618536 - DNA, 25 bp, Mus musculus
ggcggtggtgtacatattcagcccc

SEQ ID NO: 618537 - DNA, 25 bp, Mus musculus
ggcggtggtgtagatattcagcccc

SEQ ID NO: 618538 - DNA, 25 bp, Mus musculus
ggcggtgtagccataactttctgat

SEQ ID NO: 618539 - DNA, 25 bp, Mus musculus
ggcggtgtagccttaactttctgat

SEQ ID NO: 618540 - DNA, 25 bp, Mus musculus
ggcggttactgcactgtgctataaa

SEQ ID NO: 618541 - DNA, 25 bp, Mus musculus
ggcggttactgctctgtgctataaa

SEQ ID NO: 618542 - DNA, 25 bp, Mus musculus
ggcggttaggatcccaccatgctct

SEQ ID NO: 618543 - DNA, 25 bp, Mus musculus
ggcggttaggatgccaccatgctct

SEQ ID NO: 618544 - DNA, 25 bp, Mus musculus
ggcggttcgcttacttatgatacaa

SEQ ID NO: 618545 - DNA, 25 bp, Mus musculus
ggcggttcgctttcttatgatacaa

SEQ ID NO: 618546 - DNA, 25 bp, Mus musculus
ggcggttctccaccaagtcggatgt

SEQ ID NO: 618547 - DNA, 25 bp, Mus musculus
ggcggttctccagcaagtcggatgt

SEQ ID NO: 618548 - DNA, 25 bp, Mus musculus
ggcggttctcttcccaaagtggaag

SEQ ID NO: 618549 - DNA, 25 bp, Mus musculus
ggcggttctcttgccaaagtggaag

SEQ ID NO: 618550 - DNA, 25 bp, Mus musculus
ggcggttgattcacgagtctcgctc

SEQ ID NO: 618551 - DNA, 25 bp, Mus musculus
ggcggttgattctcgagtctcgctc

SEQ ID NO: 618552 - DNA, 25 bp, Mus musculus
ggcggttgtcaaaatctgcagcttc

SEQ ID NO: 618553 - DNA, 25 bp, Mus musculus
ggcggttgtcaatatctgcagcttc

SEQ ID NO: 618554 - DNA, 25 bp, Mus musculus
ggcggtttggatatctttgctcaga

SEQ ID NO: 618555 - DNA, 25 bp, Mus musculus
ggcggtttggatttctttgctcaga

SEQ ID NO: 618556 - DNA, 25 bp, Mus musculus
ggcgtaaaagtcagttgtttctaat

SEQ ID NO: 618557 - DNA, 25 bp, Mus musculus
ggcgtaaaagtctgttgtttctaat

SEQ ID NO: 618558 - DNA, 25 bp, Mus musculus
ggcgtaactgttacatctttaagta

SEQ ID NO: 618559 - DNA, 25 bp, Mus musculus
ggcgtaactgtttcatctttaagta

SEQ ID NO: 618560 - DNA, 25 bp, Mus musculus
ggcgtaatttatacgcattgaccta

SEQ ID NO: 618561 - DNA, 25 bp, Mus musculus
ggcgtaatttattcgcattgaccta

SEQ ID NO: 618562 - DNA, 25 bp, Mus musculus
ggcgtacaagggatgtcaccaggtt

SEQ ID NO: 618563 - DNA, 25 bp, Mus musculus
ggcgtacaagggttgtcaccaggtt

SEQ ID NO: 618564 - DNA, 25 bp, Mus musculus
ggcgtacacggtccacaaaatttga

SEQ ID NO: 618565 - DNA, 25 bp, Mus musculus
ggcgtacacggtgcacaaaatttga

SEQ ID NO: 618566 - DNA, 25 bp, Mus musculus
ggcgtaccttttagtgtccacatgc

SEQ ID NO: 618567 - DNA, 25 bp, Mus musculus
ggcgtacctttttgtgtccacatgc

SEQ ID NO: 618568 - DNA, 25 bp, Mus musculus
ggcgtacgtcttcctttgcagctag

SEQ ID NO: 618569 - DNA, 25 bp, Mus musculus
ggcgtacgtcttgctttgcagctag

SEQ ID NO: 618570 - DNA, 25 bp, Mus musculus
ggcgtactcaaacaatcctatttat

SEQ ID NO: 618571 - DNA, 25 bp, Mus musculus
ggcgtactcaaagaatcctatttat

SEQ ID NO: 618572 - DNA, 25 bp, Mus musculus
ggcgtactccccaccatgataaaaa

SEQ ID NO: 618573 - DNA, 25 bp, Mus musculus
ggcgtactcccctccatgataaaaa

SEQ ID NO: 618574 - DNA, 25 bp, Mus musculus
ggcgtagcccatattccaaatcaaa

SEQ ID NO: 618575 - DNA, 25 bp, Mus musculus
ggcgtagcccattttccaaatcaaa

SEQ ID NO: 618576 - DNA, 25 bp, Mus musculus
ggcgtagtgtgcaaggcaaaccttt

SEQ ID NO: 618577 - DNA, 25 bp, Mus musculus
ggcgtagtgtgctaggcaaaccttt

SEQ ID NO: 618578 - DNA, 25 bp, Mus musculus
ggcgtatgtcaccatgatccaacta

SEQ ID NO: 618579 - DNA, 25 bp, Mus musculus
ggcgtatgtcacgatgatccaacta

SEQ ID NO: 618580 - DNA, 25 bp, Mus musculus
ggcgtattcaggacagtggccataa

SEQ ID NO: 618581 - DNA, 25 bp, Mus musculus
ggcgtattcaggtcagtggccataa

SEQ ID NO: 618582 - DNA, 25 bp, Mus musculus
ggcgtattggttagtccccatcgtg

SEQ ID NO: 618583 - DNA, 25 bp, Mus musculus
ggcgtattggtttgtccccatcgtg

SEQ ID NO: 618584 - DNA, 25 bp, Mus musculus
ggcgtatttttcaaatctcagtatt

SEQ ID NO: 618585 - DNA, 25 bp, Mus musculus
ggcgtatttttctaatctcagtatt

SEQ ID NO: 618586 - DNA, 25 bp, Mus musculus
ggcgtcaaagtcacgctggcagaag

SEQ ID NO: 618587 - DNA, 25 bp, Mus musculus
ggcgtcaaagtctcgctggcagaag

SEQ ID NO: 618588 - DNA, 25 bp, Mus musculus
ggcgtcaaatctcatcatgggtgat

SEQ ID NO: 618589 - DNA, 25 bp, Mus musculus
ggcgtcaaatctgatcatgggtgat

SEQ ID NO: 618590 - DNA, 25 bp, Mus musculus
ggcgtcaacggcacggtgcccctga

SEQ ID NO: 618591 - DNA, 25 bp, Mus musculus
ggcgtcaacggctcggtgcccctga

SEQ ID NO: 618592 - DNA, 25 bp, Mus musculus
ggcgtcaatgaaattacccatcagt

SEQ ID NO: 618593 - DNA, 25 bp, Mus musculus
ggcgtcaatgaatttacccatcagt

SEQ ID NO: 618594 - DNA, 25 bp, Mus musculus
ggcgtcacagagagatcatatggaa

SEQ ID NO: 618595 - DNA, 25 bp, Mus musculus
ggcgtcacagagtgatcatatggaa

SEQ ID NO: 618596 - DNA, 25 bp, Mus musculus
ggcgtcacccggatttcgctgacgt

SEQ ID NO: 618597 - DNA, 25 bp, Mus musculus
ggcgtcacccggttttcgctgacgt

SEQ ID NO: 618598 - DNA, 25 bp, Mus musculus
ggcgtcaccgcgagtataagttggt

SEQ ID NO: 618599 - DNA, 25 bp, Mus musculus
ggcgtcaccgcgtgtataagttggt

SEQ ID NO: 618600 - DNA, 25 bp, Mus musculus
ggcgtcacggtcacagtcaccggac

SEQ ID NO: 618601 - DNA, 25 bp, Mus musculus
ggcgtcacggtctcagtcaccggac

SEQ ID NO: 618602 - DNA, 25 bp, Mus musculus
ggcgtcactacacattgtgggagta

SEQ ID NO: 618603 - DNA, 25 bp, Mus musculus
ggcgtcactacagattgtgggagta

SEQ ID NO: 618604 - DNA, 25 bp, Mus musculus
ggcgtcactcacacttgtggtgtga

SEQ ID NO: 618605 - DNA, 25 bp, Mus musculus
ggcgtcactcactcttgtggtgtga

SEQ ID NO: 618606 - DNA, 25 bp, Mus musculus
ggcgtcactgctctttaaggatttc

SEQ ID NO: 618607 - DNA, 25 bp, Mus musculus
ggcgtcactgctgtttaaggatttc

SEQ ID NO: 618608 - DNA, 25 bp, Mus musculus
ggcgtcagataaaactcttcatttt

SEQ ID NO: 618609 - DNA, 25 bp, Mus musculus
ggcgtcagataatactcttcatttt

SEQ ID NO: 618610 - DNA, 25 bp, Mus musculus
ggcgtcagcaacatgtgcggcccgc

SEQ ID NO: 618611 - DNA, 25 bp, Mus musculus
ggcgtcagcaacttgtgcggcccgc

SEQ ID NO: 618612 - DNA, 25 bp, Mus musculus
ggcgtcagccatcgagtttactaaa

SEQ ID NO: 618613 - DNA, 25 bp, Mus musculus
ggcgtcagccatggagtttactaaa

SEQ ID NO: 618614 - DNA, 25 bp, Mus musculus
ggcgtcagctgtatttagtttggga

SEQ ID NO: 618615 - DNA, 25 bp, Mus musculus
ggcgtcagctgtttttagtttggga

SEQ ID NO: 618616 - DNA, 25 bp, Mus musculus
ggcgtcatctcccacatgacacaga

SEQ ID NO: 618617 - DNA, 25 bp, Mus musculus
ggcgtcatctccgacatgacacaga

SEQ ID NO: 618618 - DNA, 25 bp, Mus musculus
ggcgtcatggtgacccaccgatctg

SEQ ID NO: 618619 - DNA, 25 bp, Mus musculus
ggcgtcatggtgtcccaccgatctg

SEQ ID NO: 618620 - DNA, 25 bp, Mus musculus
ggcgtccacataaacccaaagttag

SEQ ID NO: 618621 - DNA, 25 bp, Mus musculus
ggcgtccacatatacccaaagttag

SEQ ID NO: 618622 - DNA, 25 bp, Mus musculus
ggcgtccatcttcgaacatacttta

SEQ ID NO: 618623 - DNA, 25 bp, Mus musculus
ggcgtccatcttggaacatacttta

SEQ ID NO: 618624 - DNA, 25 bp, Mus musculus
ggcgtccatgcaactgtagaaacta

SEQ ID NO: 618625 - DNA, 25 bp, Mus musculus
ggcgtccatgcatctgtagaaacta

SEQ ID NO: 618626 - DNA, 25 bp, Mus musculus
ggcgtccgcgagatcacctgtgaga

SEQ ID NO: 618627 - DNA, 25 bp, Mus musculus
ggcgtccgcgagttcacctgtgaga

SEQ ID NO: 618628 - DNA, 25 bp, Mus musculus
ggcgtcctttttaatcagtgtgtaa

SEQ ID NO: 618629 - DNA, 25 bp, Mus musculus
ggcgtccttttttatcagtgtgtaa

SEQ ID NO: 618630 - DNA, 25 bp, Mus musculus
ggcgtcgctcaaagaaggctcaatg

SEQ ID NO: 618631 - DNA, 25 bp, Mus musculus
ggcgtcgctcaatgaaggctcaatg

SEQ ID NO: 618632 - DNA, 25 bp, Mus musculus
ggcgtctacccacagcacaatgagt

SEQ ID NO: 618633 - DNA, 25 bp, Mus musculus
ggcgtctacccagagcacaatgagt

SEQ ID NO: 618634 - DNA, 25 bp, Mus musculus
ggcgtctacgacaacattggaatcc

SEQ ID NO: 618635 - DNA, 25 bp, Mus musculus
ggcgtctacgactacattggaatcc

SEQ ID NO: 618636 - DNA, 25 bp, Mus musculus
ggcgtctagaccagcttgctagcaa

SEQ ID NO: 618637 - DNA, 25 bp, Mus musculus
ggcgtctagacctgcttgctagcaa

SEQ ID NO: 618638 - DNA, 25 bp, Mus musculus
ggcgtctagcagaaatccagtcatt

SEQ ID NO: 618639 - DNA, 25 bp, Mus musculus
ggcgtctagcagtaatccagtcatt

SEQ ID NO: 618640 - DNA, 25 bp, Mus musculus
ggcgtctatcagacccaatatgttc

SEQ ID NO: 618641 - DNA, 25 bp, Mus musculus
ggcgtctatcagtcccaatatgttc

SEQ ID NO: 618642 - DNA, 25 bp, Mus musculus
ggcgtctcaggcactgtgttggtaa

SEQ ID NO: 618643 - DNA, 25 bp, Mus musculus
ggcgtctcaggctctgtgttggtaa

SEQ ID NO: 618644 - DNA, 25 bp, Mus musculus
ggcgtctcctgcagtcgaatgtgag

SEQ ID NO: 618645 - DNA, 25 bp, Mus musculus
ggcgtctcctgctgtcgaatgtgag

SEQ ID NO: 618646 - DNA, 25 bp, Mus musculus
ggcgtctcctggcatactgtgagca

SEQ ID NO: 618647 - DNA, 25 bp, Mus musculus
ggcgtctcctgggatactgtgagca

SEQ ID NO: 618648 - DNA, 25 bp, Mus musculus
ggcgtctctgacagcttagtcataa

SEQ ID NO: 618649 - DNA, 25 bp, Mus musculus
ggcgtctctgactgcttagtcataa

SEQ ID NO: 618650 - DNA, 25 bp, Mus musculus
ggcgtctgacttatatttcagcctt

SEQ ID NO: 618651 - DNA, 25 bp, Mus musculus
ggcgtctgacttttatttcagcctt

SEQ ID NO: 618652 - DNA, 25 bp, Mus musculus
ggcgtctgataacatcttctggtgt

SEQ ID NO: 618653 - DNA, 25 bp, Mus musculus
ggcgtctgataagatcttctggtgt

SEQ ID NO: 618654 - DNA, 25 bp, Mus musculus
ggcgtctgctaccagaaagctgttc

SEQ ID NO: 618655 - DNA, 25 bp, Mus musculus
ggcgtctgctacgagaaagctgttc

SEQ ID NO: 618656 - DNA, 25 bp, Mus musculus
ggcgtcttctctaggacttgttaag

SEQ ID NO: 618657 - DNA, 25 bp, Mus musculus
ggcgtcttctcttggacttgttaag

SEQ ID NO: 618658 - DNA, 25 bp, Mus musculus
ggcgtcttcttaaccagcatgtatt

SEQ ID NO: 618659 - DNA, 25 bp, Mus musculus
ggcgtcttcttatccagcatgtatt

SEQ ID NO: 618660 - DNA, 25 bp, Mus musculus
ggcgtgaactctctctcaagatgct

SEQ ID NO: 618661 - DNA, 25 bp, Mus musculus
ggcgtgaactctgtctcaagatgct

SEQ ID NO: 618662 - DNA, 25 bp, Mus musculus
ggcgtgaagatccaggcatccgaca

SEQ ID NO: 618663 - DNA, 25 bp, Mus musculus
ggcgtgaagatcgaggcatccgaca

SEQ ID NO: 618664 - DNA, 25 bp, Mus musculus
ggcgtgacaaataggtggcctgcac

SEQ ID NO: 618665 - DNA, 25 bp, Mus musculus
ggcgtgacaaattggtggcctgcac

SEQ ID NO: 618666 - DNA, 25 bp, Mus musculus
ggcgtgacagttaatcatgaccgtg

SEQ ID NO: 618667 - DNA, 25 bp, Mus musculus
ggcgtgacagtttatcatgaccgtg

SEQ ID NO: 618668 - DNA, 25 bp, Mus musculus
ggcgtgacgccaagaatccttacac

SEQ ID NO: 618669 - DNA, 25 bp, Mus musculus
ggcgtgacgccatgaatccttacac

SEQ ID NO: 618670 - DNA, 25 bp, Mus musculus
ggcgtgacggttatgtcaccagcaa

SEQ ID NO: 618671 - DNA, 25 bp, Mus musculus
ggcgtgacggttttgtcaccagcaa

SEQ ID NO: 618672 - DNA, 25 bp, Mus musculus
ggcgtgactatcaagccaacaatag

SEQ ID NO: 618673 - DNA, 25 bp, Mus musculus
ggcgtgactatctagccaacaatag

SEQ ID NO: 618674 - DNA, 25 bp, Mus musculus
ggcgtgacttccacaagagtttatg

SEQ ID NO: 618675 - DNA, 25 bp, Mus musculus
ggcgtgacttcctcaagagtttatg

SEQ ID NO: 618676 - DNA, 25 bp, Mus musculus
ggcgtgaggcctaattttcagttct

SEQ ID NO: 618677 - DNA, 25 bp, Mus musculus
ggcgtgaggccttattttcagttct

SEQ ID NO: 618678 - DNA, 25 bp, Mus musculus
ggcgtgaggcgtctcccagaggaag

SEQ ID NO: 618679 - DNA, 25 bp, Mus musculus
ggcgtgaggcgtgtcccagaggaag

SEQ ID NO: 618680 - DNA, 25 bp, Mus musculus
ggcgtgattcggatcaccggcgaaa

SEQ ID NO: 618681 - DNA, 25 bp, Mus musculus
ggcgtgattcggttcaccggcgaaa

SEQ ID NO: 618682 - DNA, 25 bp, Mus musculus
ggcgtgcattttatcctacagagac

SEQ ID NO: 618683 - DNA, 25 bp, Mus musculus
ggcgtgcattttttcctacagagac

SEQ ID NO: 618684 - DNA, 25 bp, Mus musculus
ggcgtgccagggaccattgtcaatg

SEQ ID NO: 618685 - DNA, 25 bp, Mus musculus
ggcgtgccagggtccattgtcaatg

SEQ ID NO: 618686 - DNA, 25 bp, Mus musculus
ggcgtgccattaagttttccagaca

SEQ ID NO: 618687 - DNA, 25 bp, Mus musculus
ggcgtgccattatgttttccagaca

SEQ ID NO: 618688 - DNA, 25 bp, Mus musculus
ggcgtgccgttcaaccagcatttgg

SEQ ID NO: 618689 - DNA, 25 bp, Mus musculus
ggcgtgccgttctaccagcatttgg

SEQ ID NO: 618690 - DNA, 25 bp, Mus musculus
ggcgtgcggagcagccggaaggacc

SEQ ID NO: 618691 - DNA, 25 bp, Mus musculus
ggcgtgcggagctgccggaaggacc

SEQ ID NO: 618692 - DNA, 25 bp, Mus musculus
ggcgtgctagtaattcaatttgctc

SEQ ID NO: 618693 - DNA, 25 bp, Mus musculus
ggcgtgctagtatttcaatttgctc

SEQ ID NO: 618694 - DNA, 25 bp, Mus musculus
ggcgtgctcgccacaatccactggt

SEQ ID NO: 618695 - DNA, 25 bp, Mus musculus
ggcgtgctcgcctcaatccactggt

SEQ ID NO: 618696 - DNA, 25 bp, Mus musculus
ggcgtgctctgcaggcttcacagaa

SEQ ID NO: 618697 - DNA, 25 bp, Mus musculus
ggcgtgctctgctggcttcacagaa

SEQ ID NO: 618698 - DNA, 25 bp, Mus musculus
ggcgtgctggaaatggatgccacat

SEQ ID NO: 618699 - DNA, 25 bp, Mus musculus
ggcgtgctggaattggatgccacat

SEQ ID NO: 618700 - DNA, 25 bp, Mus musculus
ggcgtgctgtggaccgcaggaactg

SEQ ID NO: 618701 - DNA, 25 bp, Mus musculus
ggcgtgctgtggtccgcaggaactg

SEQ ID NO: 618702 - DNA, 25 bp, Mus musculus
ggcgtggaacccatttggaatcatg

SEQ ID NO: 618703 - DNA, 25 bp, Mus musculus
ggcgtggaacccttttggaatcatg

SEQ ID NO: 618704 - DNA, 25 bp, Mus musculus
ggcgtggcacaaaatcaccatcgaa

SEQ ID NO: 618705 - DNA, 25 bp, Mus musculus
ggcgtggcacaatatcaccatcgaa

SEQ ID NO: 618706 - DNA, 25 bp, Mus musculus
ggcgtggctgatccctatagcactg

SEQ ID NO: 618707 - DNA, 25 bp, Mus musculus
ggcgtggctgatgcctatagcactg

SEQ ID NO: 618708 - DNA, 25 bp, Mus musculus
ggcgtggctgtcacaagatgtgttc

SEQ ID NO: 618709 - DNA, 25 bp, Mus musculus
ggcgtggctgtctcaagatgtgttc

SEQ ID NO: 618710 - DNA, 25 bp, Mus musculus
ggcgtgggccttagagactctgaac

SEQ ID NO: 618711 - DNA, 25 bp, Mus musculus
ggcgtgggcctttgagactctgaac

SEQ ID NO: 618712 - DNA, 25 bp, Mus musculus
ggcgtgggcggacatatggtcatgt

SEQ ID NO: 618713 - DNA, 25 bp, Mus musculus
ggcgtgggcggagatatggtcatgt

SEQ ID NO: 618714 - DNA, 25 bp, Mus musculus
ggcgtggtcctcactctaagactgt

SEQ ID NO: 618715 - DNA, 25 bp, Mus musculus
ggcgtggtcctctctctaagactgt

SEQ ID NO: 618716 - DNA, 25 bp, Mus musculus
ggcgtggtcgacaccgagctgtacc

SEQ ID NO: 618717 - DNA, 25 bp, Mus musculus
ggcgtggtcgactccgagctgtacc

SEQ ID NO: 618718 - DNA, 25 bp, Mus musculus
ggcgtggtcttaagtctacacccaa

SEQ ID NO: 618719 - DNA, 25 bp, Mus musculus
ggcgtggtcttatgtctacacccaa

SEQ ID NO: 618720 - DNA, 25 bp, Mus musculus
ggcgtggtgacgattacatgactaa

SEQ ID NO: 618721 - DNA, 25 bp, Mus musculus
ggcgtggtgacgtttacatgactaa

SEQ ID NO: 618722 - DNA, 25 bp, Mus musculus
ggcgtggtggccacagtaatgtata

SEQ ID NO: 618723 - DNA, 25 bp, Mus musculus
ggcgtggtggcctcagtaatgtata

SEQ ID NO: 618724 - DNA, 25 bp, Mus musculus
ggcgtggtggtaccgagggcaatga

SEQ ID NO: 618725 - DNA, 25 bp, Mus musculus
ggcgtggtggtagcgagggcaatga

SEQ ID NO: 618726 - DNA, 25 bp, Mus musculus
ggcgtgtaaacacagatccccgggc

SEQ ID NO: 618727 - DNA, 25 bp, Mus musculus
ggcgtgtaaacagagatccccgggc

SEQ ID NO: 618728 - DNA, 25 bp, Mus musculus
ggcgtgtacctgattatctgtaact

SEQ ID NO: 618729 - DNA, 25 bp, Mus musculus
ggcgtgtacctgtttatctgtaact

SEQ ID NO: 618730 - DNA, 25 bp, Mus musculus
ggcgtgtatacaaatcttatctgga

SEQ ID NO: 618731 - DNA, 25 bp, Mus musculus
ggcgtgtatacatatcttatctgga

SEQ ID NO: 618732 - DNA, 25 bp, Mus musculus
ggcgtgtcttctcatcctatcagaa

SEQ ID NO: 618733 - DNA, 25 bp, Mus musculus
ggcgtgtcttctgatcctatcagaa

SEQ ID NO: 618734 - DNA, 25 bp, Mus musculus
ggcgtgtgcactacacctgaagatc

SEQ ID NO: 618735 - DNA, 25 bp, Mus musculus
ggcgtgtgcacttcacctgaagatc

SEQ ID NO: 618736 - DNA, 25 bp, Mus musculus
ggcgttaagtccactggcagttcta

SEQ ID NO: 618737 - DNA, 25 bp, Mus musculus
ggcgttaagtcctctggcagttcta

SEQ ID NO: 618738 - DNA, 25 bp, Mus musculus
ggcgttaatccccaaatagacattt

SEQ ID NO: 618739 - DNA, 25 bp, Mus musculus
ggcgttaatcccgaaatagacattt

SEQ ID NO: 618740 - DNA, 25 bp, Mus musculus
ggcgttactcagagatcacgggtaa

SEQ ID NO: 618741 - DNA, 25 bp, Mus musculus
ggcgttactcagtgatcacgggtaa

SEQ ID NO: 618742 - DNA, 25 bp, Mus musculus
ggcgttactggcatccttgaacagc

SEQ ID NO: 618743 - DNA, 25 bp, Mus musculus
ggcgttactggcttccttgaacagc

SEQ ID NO: 618744 - DNA, 25 bp, Mus musculus
ggcgttcaaggcagagtccacaggt

SEQ ID NO: 618745 - DNA, 25 bp, Mus musculus
ggcgttcaaggctgagtccacaggt

SEQ ID NO: 618746 - DNA, 25 bp, Mus musculus
ggcgttcagttcagatccaatgcag

SEQ ID NO: 618747 - DNA, 25 bp, Mus musculus
ggcgttcagttctgatccaatgcag

SEQ ID NO: 618748 - DNA, 25 bp, Mus musculus
ggcgttccaataatcttaactgtta

SEQ ID NO: 618749 - DNA, 25 bp, Mus musculus
ggcgttccaatattcttaactgtta

SEQ ID NO: 618750 - DNA, 25 bp, Mus musculus
ggcgttcctgcaaggtggtaccagt

SEQ ID NO: 618751 - DNA, 25 bp, Mus musculus
ggcgttcctgcatggtggtaccagt

SEQ ID NO: 618752 - DNA, 25 bp, Mus musculus
ggcgttcgttgtattgaaattctct

SEQ ID NO: 618753 - DNA, 25 bp, Mus musculus
ggcgttcgttgttttgaaattctct

SEQ ID NO: 618754 - DNA, 25 bp, Mus musculus
ggcgttctgtagacaccttgttcat

SEQ ID NO: 618755 - DNA, 25 bp, Mus musculus
ggcgttctgtagtcaccttgttcat

SEQ ID NO: 618756 - DNA, 25 bp, Mus musculus
ggcgttcttgcaaggtgtgatcaca

SEQ ID NO: 618757 - DNA, 25 bp, Mus musculus
ggcgttcttgcatggtgtgatcaca

SEQ ID NO: 618758 - DNA, 25 bp, Mus musculus
ggcgttcttgcccaaactcgggagc

SEQ ID NO: 618759 - DNA, 25 bp, Mus musculus
ggcgttcttgccgaaactcgggagc

SEQ ID NO: 618760 - DNA, 25 bp, Mus musculus
ggcgttgaccagagtgttcctgtat

SEQ ID NO: 618761 - DNA, 25 bp, Mus musculus
ggcgttgaccagtgtgttcctgtat

SEQ ID NO: 618762 - DNA, 25 bp, Mus musculus
ggcgttgacgcaccagaaattacca

SEQ ID NO: 618763 - DNA, 25 bp, Mus musculus
ggcgttgacgcagcagaaattacca

SEQ ID NO: 618764 - DNA, 25 bp, Mus musculus
ggcgttgacttgcttatgagcttgt

SEQ ID NO: 618765 - DNA, 25 bp, Mus musculus
ggcgttgacttggttatgagcttgt

SEQ ID NO: 618766 - DNA, 25 bp, Mus musculus
ggcgttgattgaaccacgtgcttga

SEQ ID NO: 618767 - DNA, 25 bp, Mus musculus
ggcgttgattgatccacgtgcttga

SEQ ID NO: 618768 - DNA, 25 bp, Mus musculus
ggcgttgcagcaactcttgacggaa

SEQ ID NO: 618769 - DNA, 25 bp, Mus musculus
ggcgttgcagcatctcttgacggaa

SEQ ID NO: 618770 - DNA, 25 bp, Mus musculus
ggcgttggacctagttagtaattag

SEQ ID NO: 618771 - DNA, 25 bp, Mus musculus
ggcgttggaccttgttagtaattag

SEQ ID NO: 618772 - DNA, 25 bp, Mus musculus
ggcgttgtagaaacggactccattt

SEQ ID NO: 618773 - DNA, 25 bp, Mus musculus
ggcgttgtagaatcggactccattt

SEQ ID NO: 618774 - DNA, 25 bp, Mus musculus
ggcgttgtagcacccctatactaag

SEQ ID NO: 618775 - DNA, 25 bp, Mus musculus
ggcgttgtagcagccctatactaag

SEQ ID NO: 618776 - DNA, 25 bp, Mus musculus
ggcgttgtcctcctggagttagatc

SEQ ID NO: 618777 - DNA, 25 bp, Mus musculus
ggcgttgtcctcgtggagttagatc

SEQ ID NO: 618778 - DNA, 25 bp, Mus musculus
ggcgttgtctccatctacaacataa

SEQ ID NO: 618779 - DNA, 25 bp, Mus musculus
ggcgttgtctccttctacaacataa

SEQ ID NO: 618780 - DNA, 25 bp, Mus musculus
ggcgtttaacatctagtttacccat

SEQ ID NO: 618781 - DNA, 25 bp, Mus musculus
ggcgtttaacatgtagtttacccat

SEQ ID NO: 618782 - DNA, 25 bp, Mus musculus
ggcgtttacataaactacactaagc

SEQ ID NO: 618783 - DNA, 25 bp, Mus musculus
ggcgtttacatatactacactaagc

SEQ ID NO: 618784 - DNA, 25 bp, Mus musculus
ggcgtttatgaaaagcttcctggaa

SEQ ID NO: 618785 - DNA, 25 bp, Mus musculus
ggcgtttatgaaacccagtcagaga

SEQ ID NO: 618786 - DNA, 25 bp, Mus musculus
ggcgtttatgaatagcttcctggaa

SEQ ID NO: 618787 - DNA, 25 bp, Mus musculus
ggcgtttatgaatcccagtcagaga

SEQ ID NO: 618788 - DNA, 25 bp, Mus musculus
ggcgtttatgtcagtaaagtatcaa

SEQ ID NO: 618789 - DNA, 25 bp, Mus musculus
ggcgtttatgtctgtaaagtatcaa

SEQ ID NO: 618790 - DNA, 25 bp, Mus musculus
ggcgtttcccttccatagaatcaag

SEQ ID NO: 618791 - DNA, 25 bp, Mus musculus
ggcgtttcccttgcatagaatcaag

SEQ ID NO: 618792 - DNA, 25 bp, Mus musculus
ggcgtttcctgaagaagagggttac

SEQ ID NO: 618793 - DNA, 25 bp, Mus musculus
ggcgtttcctgatgaagagggttac

SEQ ID NO: 618794 - DNA, 25 bp, Mus musculus
ggcgtttccttcactagcggttgaa

SEQ ID NO: 618795 - DNA, 25 bp, Mus musculus
ggcgtttccttctctagcggttgaa

SEQ ID NO: 618796 - DNA, 25 bp, Mus musculus
ggcgtttgccctaagtcctctttag

SEQ ID NO: 618797 - DNA, 25 bp, Mus musculus
ggcgtttgcccttagtcctctttag

SEQ ID NO: 618798 - DNA, 25 bp, Mus musculus
ggcgtttgcctacagtatgagtgta

SEQ ID NO: 618799 - DNA, 25 bp, Mus musculus
ggcgtttgcctagagtatgagtgta

SEQ ID NO: 618800 - DNA, 25 bp, Mus musculus
ggcgtttgctgaagaaccacctgaa

SEQ ID NO: 618801 - DNA, 25 bp, Mus musculus
ggcgtttgctgatgaaccacctgaa

SEQ ID NO: 618802 - DNA, 25 bp, Mus musculus
ggcgttttagggaatctcacagtca

SEQ ID NO: 618803 - DNA, 25 bp, Mus musculus
ggcgttttagggtatctcacagtca

SEQ ID NO: 618804 - DNA, 25 bp, Mus musculus
ggcgttttatacaattctttggcaa

SEQ ID NO: 618805 - DNA, 25 bp, Mus musculus
ggcgttttatactattctttggcaa

SEQ ID NO: 618806 - DNA, 25 bp, Mus musculus
ggcgttttcttgacccagattctgg

SEQ ID NO: 618807 - DNA, 25 bp, Mus musculus
ggcgttttcttgtcccagattctgg

SEQ ID NO: 618808 - DNA, 25 bp, Mus musculus
ggctaaaaccacactgaaatccact

SEQ ID NO: 618809 - DNA, 25 bp, Mus musculus
ggctaaaaccactctgaaatccact

SEQ ID NO: 618810 - DNA, 25 bp, Mus musculus
ggctaaaacttgagtgctgtgcaca

SEQ ID NO: 618811 - DNA, 25 bp, Mus musculus
ggctaaaacttgtgtgctgtgcaca

SEQ ID NO: 618812 - DNA, 25 bp, Mus musculus
ggctaaaagttcaggatccccgact

SEQ ID NO: 618813 - DNA, 25 bp, Mus musculus
ggctaaaagttctggatccccgact

SEQ ID NO: 618814 - DNA, 25 bp, Mus musculus
ggctaaacaaccaccgagcatgtgt

SEQ ID NO: 618815 - DNA, 25 bp, Mus musculus
ggctaaacaacctccgagcatgtgt

SEQ ID NO: 618816 - DNA, 25 bp, Mus musculus
ggctaaacatctcaagttcattgcc

SEQ ID NO: 618817 - DNA, 25 bp, Mus musculus
ggctaaacatctgaagttcattgcc

SEQ ID NO: 618818 - DNA, 25 bp, Mus musculus
ggctaaaccatgatgcctttggcta

SEQ ID NO: 618819 - DNA, 25 bp, Mus musculus
ggctaaaccatgttgcctttggcta

SEQ ID NO: 618820 - DNA, 25 bp, Mus musculus
ggctaaacccagaactggtagaggg

SEQ ID NO: 618821 - DNA, 25 bp, Mus musculus
ggctaaacccagaggcttcttagga

SEQ ID NO: 618822 - DNA, 25 bp, Mus musculus
ggctaaacccagtactggtagaggg

SEQ ID NO: 618823 - DNA, 25 bp, Mus musculus
ggctaaacccagtggcttcttagga

SEQ ID NO: 618824 - DNA, 25 bp, Mus musculus
ggctaaagacaacgagaggaccgat

SEQ ID NO: 618825 - DNA, 25 bp, Mus musculus
ggctaaagacaaggagaggaccgat

SEQ ID NO: 618826 - DNA, 25 bp, Mus musculus
ggctaaaggaaactcacctctcacc

SEQ ID NO: 618827 - DNA, 25 bp, Mus musculus
ggctaaaggaaagtcacctctcacc

SEQ ID NO: 618828 - DNA, 25 bp, Mus musculus
ggctaaagtcccctatccgaggaga

SEQ ID NO: 618829 - DNA, 25 bp, Mus musculus
ggctaaagtcccgtatccgaggaga

SEQ ID NO: 618830 - DNA, 25 bp, Mus musculus
ggctaaagtctcatctgaatggctt

SEQ ID NO: 618831 - DNA, 25 bp, Mus musculus
ggctaaagtctcttctgaatggctt

SEQ ID NO: 618832 - DNA, 25 bp, Mus musculus
ggctaaagttagacagctggcagct

SEQ ID NO: 618833 - DNA, 25 bp, Mus musculus
ggctaaagttagtcagctggcagct

SEQ ID NO: 618834 - DNA, 25 bp, Mus musculus
ggctaaatactcctgattgaccgat

SEQ ID NO: 618835 - DNA, 25 bp, Mus musculus
ggctaaatactcgtgattgaccgat

SEQ ID NO: 618836 - DNA, 25 bp, Mus musculus
ggctaaatctggacgtctaactgta

SEQ ID NO: 618837 - DNA, 25 bp, Mus musculus
ggctaaatctggtcgtctaactgta

SEQ ID NO: 618838 - DNA, 25 bp, Mus musculus
ggctaaatctgtctccttgtctctg

SEQ ID NO: 618839 - DNA, 25 bp, Mus musculus
ggctaaatctgtgtccttgtctctg

SEQ ID NO: 618840 - DNA, 25 bp, Mus musculus
ggctaaatgaagagaccttttcctt

SEQ ID NO: 618841 - DNA, 25 bp, Mus musculus
ggctaaatgaagtgaccttttcctt

SEQ ID NO: 618842 - DNA, 25 bp, Mus musculus
ggctaaatgcaaattgacatacttt

SEQ ID NO: 618843 - DNA, 25 bp, Mus musculus
ggctaaatgcaatttgacatacttt

SEQ ID NO: 618844 - DNA, 25 bp, Mus musculus
ggctaaatgcttaaaagtgatacta

SEQ ID NO: 618845 - DNA, 25 bp, Mus musculus
ggctaaatgcttagctacctgagaa

SEQ ID NO: 618846 - DNA, 25 bp, Mus musculus
ggctaaatgctttaaagtgatacta

SEQ ID NO: 618847 - DNA, 25 bp, Mus musculus
ggctaaatgctttgctacctgagaa

SEQ ID NO: 618848 - DNA, 25 bp, Mus musculus
ggctaaatgttcaccttgcaaatca

SEQ ID NO: 618849 - DNA, 25 bp, Mus musculus
ggctaaatgttctccttgcaaatca

SEQ ID NO: 618850 - DNA, 25 bp, Mus musculus
ggctaaattcccatcaggcagatct

SEQ ID NO: 618851 - DNA, 25 bp, Mus musculus
ggctaaattcccttcaggcagatct

SEQ ID NO: 618852 - DNA, 25 bp, Mus musculus
ggctaaattgccaatttgacagtag

SEQ ID NO: 618853 - DNA, 25 bp, Mus musculus
ggctaaattgcctatttgacagtag

SEQ ID NO: 618854 - DNA, 25 bp, Mus musculus
ggctaacacagacgtcggagtaaat

SEQ ID NO: 618855 - DNA, 25 bp, Mus musculus
ggctaacacagaggtcggagtaaat

SEQ ID NO: 618856 - DNA, 25 bp, Mus musculus
ggctaacagccgcagaatgtgtcta

SEQ ID NO: 618857 - DNA, 25 bp, Mus musculus
ggctaacagccggagaatgtgtcta

SEQ ID NO: 618858 - DNA, 25 bp, Mus musculus
ggctaacagggacgtcccatttctt

SEQ ID NO: 618859 - DNA, 25 bp, Mus musculus
ggctaacagggaggtcccatttctt

SEQ ID NO: 618860 - DNA, 25 bp, Mus musculus
ggctaacataccatgactcgagttt

SEQ ID NO: 618861 - DNA, 25 bp, Mus musculus
ggctaacataccttgactcgagttt

SEQ ID NO: 618862 - DNA, 25 bp, Mus musculus
ggctaaccacacagctttatttcat

SEQ ID NO: 618863 - DNA, 25 bp, Mus musculus
ggctaaccacactgctttatttcat

SEQ ID NO: 618864 - DNA, 25 bp, Mus musculus
ggctaaccctgacaactgagtgctt

SEQ ID NO: 618865 - DNA, 25 bp, Mus musculus
ggctaaccctgagaactgagtgctt

SEQ ID NO: 618866 - DNA, 25 bp, Mus musculus
ggctaacccttaagctcgtaaccgt

SEQ ID NO: 618867 - DNA, 25 bp, Mus musculus
ggctaacccttatgctcgtaaccgt

SEQ ID NO: 618868 - DNA, 25 bp, Mus musculus
ggctaaccggatcgcagacaccctg

SEQ ID NO: 618869 - DNA, 25 bp, Mus musculus
ggctaaccggatggcagacaccctg

SEQ ID NO: 618870 - DNA, 25 bp, Mus musculus
ggctaacgatgccaccgtcaaagga

SEQ ID NO: 618871 - DNA, 25 bp, Mus musculus
ggctaacgatgcgaccgtcaaagga

SEQ ID NO: 618872 - DNA, 25 bp, Mus musculus
ggctaacggccacagagaacttgct

SEQ ID NO: 618873 - DNA, 25 bp, Mus musculus
ggctaacggccagagagaacttgct

SEQ ID NO: 618874 - DNA, 25 bp, Mus musculus
ggctaacgtgtgaatcccatgtaaa

SEQ ID NO: 618875 - DNA, 25 bp, Mus musculus
ggctaacgtgtgtatcccatgtaaa

SEQ ID NO: 618876 - DNA, 25 bp, Mus musculus
ggctaactaggcatacactgacaaa

SEQ ID NO: 618877 - DNA, 25 bp, Mus musculus
ggctaactaggcttacactgacaaa

SEQ ID NO: 618878 - DNA, 25 bp, Mus musculus
ggctaactctatcagatccacaaca

SEQ ID NO: 618879 - DNA, 25 bp, Mus musculus
ggctaactctatgagatccacaaca

SEQ ID NO: 618880 - DNA, 25 bp, Mus musculus
ggctaactctggatctgaccatatg

SEQ ID NO: 618881 - DNA, 25 bp, Mus musculus
ggctaactctggttctgaccatatg

SEQ ID NO: 618882 - DNA, 25 bp, Mus musculus
ggctaactggacattcattgtgggt

SEQ ID NO: 618883 - DNA, 25 bp, Mus musculus
ggctaactggactttcattgtgggt

SEQ ID NO: 618884 - DNA, 25 bp, Mus musculus
ggctaactgtgtcgaagatggcttc

SEQ ID NO: 618885 - DNA, 25 bp, Mus musculus
ggctaactgtgtggaagatggcttc

SEQ ID NO: 618886 - DNA, 25 bp, Mus musculus
ggctaactgttcactcataggtttg

SEQ ID NO: 618887 - DNA, 25 bp, Mus musculus
ggctaactgttcatggtttctaagc

SEQ ID NO: 618888 - DNA, 25 bp, Mus musculus
ggctaactgttctctcataggtttg

SEQ ID NO: 618889 - DNA, 25 bp, Mus musculus
ggctaactgttcttggtttctaagc

SEQ ID NO: 618890 - DNA, 25 bp, Mus musculus
ggctaacttcttaatcttgggctac

SEQ ID NO: 618891 - DNA, 25 bp, Mus musculus
ggctaacttcttatcactgttgtga

SEQ ID NO: 618892 - DNA, 25 bp, Mus musculus
ggctaacttctttatcttgggctac

SEQ ID NO: 618893 - DNA, 25 bp, Mus musculus
ggctaacttcttttcactgttgtga

SEQ ID NO: 618894 - DNA, 25 bp, Mus musculus
ggctaagaaaagctgctgagtccag

SEQ ID NO: 618895 - DNA, 25 bp, Mus musculus
ggctaagaaaaggtgctgagtccag

SEQ ID NO: 618896 - DNA, 25 bp, Mus musculus
ggctaagaacacacccaagttacat

SEQ ID NO: 618897 - DNA, 25 bp, Mus musculus
ggctaagaacaccttacctggtaga

SEQ ID NO: 618898 - DNA, 25 bp, Mus musculus
ggctaagaacacgttacctggtaga

SEQ ID NO: 618899 - DNA, 25 bp, Mus musculus
ggctaagaacactcccaagttacat

SEQ ID NO: 618900 - DNA, 25 bp, Mus musculus
ggctaagaactgctttcatctaccc

SEQ ID NO: 618901 - DNA, 25 bp, Mus musculus
ggctaagaactggtttcatctaccc

SEQ ID NO: 618902 - DNA, 25 bp, Mus musculus
ggctaagaagccagcatccaatggg

SEQ ID NO: 618903 - DNA, 25 bp, Mus musculus
ggctaagaagcctgcatccaatggg

SEQ ID NO: 618904 - DNA, 25 bp, Mus musculus
ggctaagaagttccagggtttcctg

SEQ ID NO: 618905 - DNA, 25 bp, Mus musculus
ggctaagaagttgcagggtttcctg

SEQ ID NO: 618906 - DNA, 25 bp, Mus musculus
ggctaagaatccacctgagacagac

SEQ ID NO: 618907 - DNA, 25 bp, Mus musculus
ggctaagaatcctcctgagacagac

SEQ ID NO: 618908 - DNA, 25 bp, Mus musculus
ggctaagaatgtataccagggttta

SEQ ID NO: 618909 - DNA, 25 bp, Mus musculus
ggctaagaatgtttaccagggttta

SEQ ID NO: 618910 - DNA, 25 bp, Mus musculus
ggctaagactcaccacgtggaaagt

SEQ ID NO: 618911 - DNA, 25 bp, Mus musculus
ggctaagactcagcacgtggaaagt

SEQ ID NO: 618912 - DNA, 25 bp, Mus musculus
ggctaagactctccaccattgaaat

SEQ ID NO: 618913 - DNA, 25 bp, Mus musculus
ggctaagactctgcaccattgaaat

SEQ ID NO: 618914 - DNA, 25 bp, Mus musculus
ggctaagactgccaagtgtctcaaa

SEQ ID NO: 618915 - DNA, 25 bp, Mus musculus
ggctaagactgcgaagtgtctcaaa

SEQ ID NO: 618916 - DNA, 25 bp, Mus musculus
ggctaagagacgaaacactaccggg

SEQ ID NO: 618917 - DNA, 25 bp, Mus musculus
ggctaagagacgtaacactaccggg

SEQ ID NO: 618918 - DNA, 25 bp, Mus musculus
ggctaagatctaacatttacaggta

SEQ ID NO: 618919 - DNA, 25 bp, Mus musculus
ggctaagatctatcatttacaggta

SEQ ID NO: 618920 - DNA, 25 bp, Mus musculus
ggctaagatctgagttgtccctgta

SEQ ID NO: 618921 - DNA, 25 bp, Mus musculus
ggctaagatctgtgttgtccctgta

SEQ ID NO: 618922 - DNA, 25 bp, Mus musculus
ggctaagattagaacatattccttg

SEQ ID NO: 618923 - DNA, 25 bp, Mus musculus
ggctaagattagtacatattccttg

SEQ ID NO: 618924 - DNA, 25 bp, Mus musculus
ggctaagattcaagagaccccaaac

SEQ ID NO: 618925 - DNA, 25 bp, Mus musculus
ggctaagattcatgagaccccaaac

SEQ ID NO: 618926 - DNA, 25 bp, Mus musculus
ggctaagattctcgtgatacccacc

SEQ ID NO: 618927 - DNA, 25 bp, Mus musculus
ggctaagattctggtgatacccacc

SEQ ID NO: 618928 - DNA, 25 bp, Mus musculus
ggctaagcaacaacatcggcatcat

SEQ ID NO: 618929 - DNA, 25 bp, Mus musculus
ggctaagcaacatcatcggcatcat

SEQ ID NO: 618930 - DNA, 25 bp, Mus musculus
ggctaagcaaccagtagccccaatt

SEQ ID NO: 618931 - DNA, 25 bp, Mus musculus
ggctaagcaacctgtagccccaatt

SEQ ID NO: 618932 - DNA, 25 bp, Mus musculus
ggctaagcactaaggaaacaggcac

SEQ ID NO: 618933 - DNA, 25 bp, Mus musculus
ggctaagcactatggaaacaggcac

SEQ ID NO: 618934 - DNA, 25 bp, Mus musculus
ggctaagcagaaagtgcccatttga

SEQ ID NO: 618935 - DNA, 25 bp, Mus musculus
ggctaagcagaatgtgcccatttga

SEQ ID NO: 618936 - DNA, 25 bp, Mus musculus
ggctaagcagagagcacccacggtt

SEQ ID NO: 618937 - DNA, 25 bp, Mus musculus
ggctaagcagagtgcacccacggtt

SEQ ID NO: 618938 - DNA, 25 bp, Mus musculus
ggctaagcagctactattagatagt

SEQ ID NO: 618939 - DNA, 25 bp, Mus musculus
ggctaagcagcttctattagatagt

SEQ ID NO: 618940 - DNA, 25 bp, Mus musculus
ggctaagcagtactgaatcccagaa

SEQ ID NO: 618941 - DNA, 25 bp, Mus musculus
ggctaagcagtagtgaatcccagaa

SEQ ID NO: 618942 - DNA, 25 bp, Mus musculus
ggctaagcagtcatcaaggccagct

SEQ ID NO: 618943 - DNA, 25 bp, Mus musculus
ggctaagcagtcttcaaggccagct

SEQ ID NO: 618944 - DNA, 25 bp, Mus musculus
ggctaagccagaaccttgcttttga

SEQ ID NO: 618945 - DNA, 25 bp, Mus musculus
ggctaagccagatccttgcttttga

SEQ ID NO: 618946 - DNA, 25 bp, Mus musculus
ggctaagccctgaaagcagtgccac

SEQ ID NO: 618947 - DNA, 25 bp, Mus musculus
ggctaagccctgtaagcagtgccac

SEQ ID NO: 618948 - DNA, 25 bp, Mus musculus
ggctaagcctcccactattatagtg

SEQ ID NO: 618949 - DNA, 25 bp, Mus musculus
ggctaagcctccgactattatagtg

SEQ ID NO: 618950 - DNA, 25 bp, Mus musculus
ggctaagctcagatacacctttgaa

SEQ ID NO: 618951 - DNA, 25 bp, Mus musculus
ggctaagctcagttacacctttgaa

SEQ ID NO: 618952 - DNA, 25 bp, Mus musculus
ggctaagctggtcatgtatgcatcc

SEQ ID NO: 618953 - DNA, 25 bp, Mus musculus
ggctaagctggtgatgtatgcatcc

SEQ ID NO: 618954 - DNA, 25 bp, Mus musculus
ggctaaggaaccactcttccgagtt

SEQ ID NO: 618955 - DNA, 25 bp, Mus musculus
ggctaaggaacctctcttccgagtt

SEQ ID NO: 618956 - DNA, 25 bp, Mus musculus
ggctaaggatacaaaagcttgcatt

SEQ ID NO: 618957 - DNA, 25 bp, Mus musculus
ggctaaggatactaaagcttgcatt

SEQ ID NO: 618958 - DNA, 25 bp, Mus musculus
ggctaaggcaagaagactagggctt

SEQ ID NO: 618959 - DNA, 25 bp, Mus musculus
ggctaaggcaagtagactagggctt

SEQ ID NO: 618960 - DNA, 25 bp, Mus musculus
ggctaagggagcacacaggacactg

SEQ ID NO: 618961 - DNA, 25 bp, Mus musculus
ggctaagggagctcacaggacactg

SEQ ID NO: 618962 - DNA, 25 bp, Mus musculus
ggctaagggatcatgcgctaagtat

SEQ ID NO: 618963 - DNA, 25 bp, Mus musculus
ggctaagggatcttgcgctaagtat

SEQ ID NO: 618964 - DNA, 25 bp, Mus musculus
ggctaaggtaccacatggaacccag

SEQ ID NO: 618965 - DNA, 25 bp, Mus musculus
ggctaaggtacctcatggaacccag

SEQ ID NO: 618966 - DNA, 25 bp, Mus musculus
ggctaaggtagacgaccgcttctat

SEQ ID NO: 618967 - DNA, 25 bp, Mus musculus
ggctaaggtagaggaccgcttctat

SEQ ID NO: 618968 - DNA, 25 bp, Mus musculus
ggctaaggtcatagctcatcatgaa

SEQ ID NO: 618969 - DNA, 25 bp, Mus musculus
ggctaaggtcattgctcatcatgaa

SEQ ID NO: 618970 - DNA, 25 bp, Mus musculus
ggctaaggtcttaatgctggatatt

SEQ ID NO: 618971 - DNA, 25 bp, Mus musculus
ggctaaggtctttatgctggatatt

SEQ ID NO: 618972 - DNA, 25 bp, Mus musculus
ggctaagtaataatccactgcatct

SEQ ID NO: 618973 - DNA, 25 bp, Mus musculus
ggctaagtaatattccactgcatct

SEQ ID NO: 618974 - DNA, 25 bp, Mus musculus
ggctaagtctggctcaactgagtta

SEQ ID NO: 618975 - DNA, 25 bp, Mus musculus
ggctaagtctgggtcaactgagtta

SEQ ID NO: 618976 - DNA, 25 bp, Mus musculus
ggctaagtgctaacttgtgtgtcat

SEQ ID NO: 618977 - DNA, 25 bp, Mus musculus
ggctaagtgctatcttgtgtgtcat

SEQ ID NO: 618978 - DNA, 25 bp, Mus musculus
ggctaagtttcgatttcctgtccca

SEQ ID NO: 618979 - DNA, 25 bp, Mus musculus
ggctaagtttcgttttcctgtccca

SEQ ID NO: 618980 - DNA, 25 bp, Mus musculus
ggctaagtttgcactctgtaatgta

SEQ ID NO: 618981 - DNA, 25 bp, Mus musculus
ggctaagtttgctctctgtaatgta

SEQ ID NO: 618982 - DNA, 25 bp, Mus musculus
ggctaataggcccattgattgtttg

SEQ ID NO: 618983 - DNA, 25 bp, Mus musculus
ggctaataggccgattgattgtttg

SEQ ID NO: 618984 - DNA, 25 bp, Mus musculus
ggctaatagtttagagggagcttcc

SEQ ID NO: 618985 - DNA, 25 bp, Mus musculus
ggctaatagttttgagggagcttcc

SEQ ID NO: 618986 - DNA, 25 bp, Mus musculus
ggctaatatcacactctcaattggg

SEQ ID NO: 618987 - DNA, 25 bp, Mus musculus
ggctaatatcactctctcaattggg

SEQ ID NO: 618988 - DNA, 25 bp, Mus musculus
ggctaatatggaataacagcttgtt

SEQ ID NO: 618989 - DNA, 25 bp, Mus musculus
ggctaatatggattaacagcttgtt

SEQ ID NO: 618990 - DNA, 25 bp, Mus musculus
ggctaatcagctctctaaaacttca

SEQ ID NO: 618991 - DNA, 25 bp, Mus musculus
ggctaatcagctgtctaaaacttca

SEQ ID NO: 618992 - DNA, 25 bp, Mus musculus
ggctaatcattaaacctcttgtgca

SEQ ID NO: 618993 - DNA, 25 bp, Mus musculus
ggctaatcattatacctcttgtgca

SEQ ID NO: 618994 - DNA, 25 bp, Mus musculus
ggctaatcctgacccttgtaagtaa

SEQ ID NO: 618995 - DNA, 25 bp, Mus musculus
ggctaatcctgagccttgtaagtaa

SEQ ID NO: 618996 - DNA, 25 bp, Mus musculus
ggctaatctaggatatgccccaaga

SEQ ID NO: 618997 - DNA, 25 bp, Mus musculus
ggctaatctaggttatgccccaaga

SEQ ID NO: 618998 - DNA, 25 bp, Mus musculus
ggctaatcttcccaattctttccat

SEQ ID NO: 618999 - DNA, 25 bp, Mus musculus
ggctaatcttccgaattctttccat

SEQ ID NO: 619000 - DNA, 25 bp, Mus musculus
ggctaatcttgcatatccatacatg

SEQ ID NO: 619001 - DNA, 25 bp, Mus musculus
ggctaatcttgccaccttgatagga

SEQ ID NO: 619002 - DNA, 25 bp, Mus musculus
ggctaatcttgcgaccttgatagga

SEQ ID NO: 619003 - DNA, 25 bp, Mus musculus
ggctaatcttgcttatccatacatg

SEQ ID NO: 619004 - DNA, 25 bp, Mus musculus
ggctaatgacatcttttaccaacct

SEQ ID NO: 619005 - DNA, 25 bp, Mus musculus
ggctaatgacatgttttaccaacct

SEQ ID NO: 619006 - DNA, 25 bp, Mus musculus
ggctaatgaccacagtccattccta

SEQ ID NO: 619007 - DNA, 25 bp, Mus musculus
ggctaatgaccagagtccattccta

SEQ ID NO: 619008 - DNA, 25 bp, Mus musculus
ggctaatgactcaatcctggacttt

SEQ ID NO: 619009 - DNA, 25 bp, Mus musculus
ggctaatgactctatcctggacttt

SEQ ID NO: 619010 - DNA, 25 bp, Mus musculus
ggctaatgtactccacaaattgctt

SEQ ID NO: 619011 - DNA, 25 bp, Mus musculus
ggctaatgtactgcacaaattgctt

SEQ ID NO: 619012 - DNA, 25 bp, Mus musculus
ggctaatgtagacatctctccctct

SEQ ID NO: 619013 - DNA, 25 bp, Mus musculus
ggctaatgtagagatctctccctct

SEQ ID NO: 619014 - DNA, 25 bp, Mus musculus
ggctaatgtgctaggttcttatttc

SEQ ID NO: 619015 - DNA, 25 bp, Mus musculus
ggctaatgtgcttggttcttatttc

SEQ ID NO: 619016 - DNA, 25 bp, Mus musculus
ggctaattaaagctctgccctcagg

SEQ ID NO: 619017 - DNA, 25 bp, Mus musculus
ggctaattaaaggtctgccctcagg

SEQ ID NO: 619018 - DNA, 25 bp, Mus musculus
ggctaattactccatggtctacctc

SEQ ID NO: 619019 - DNA, 25 bp, Mus musculus
ggctaattactcgatggtctacctc

SEQ ID NO: 619020 - DNA, 25 bp, Mus musculus
ggctaattatacctgccatgtggag

SEQ ID NO: 619021 - DNA, 25 bp, Mus musculus
ggctaattatacgtgccatgtggag

SEQ ID NO: 619022 - DNA, 25 bp, Mus musculus
ggctaattatagattcttctccctt

SEQ ID NO: 619023 - DNA, 25 bp, Mus musculus
ggctaattatagtttcttctccctt

SEQ ID NO: 619024 - DNA, 25 bp, Mus musculus
ggctaattatttagtctcacgctaa

SEQ ID NO: 619025 - DNA, 25 bp, Mus musculus
ggctaattattttgtctcacgctaa

SEQ ID NO: 619026 - DNA, 25 bp, Mus musculus
ggctaattccaaatgcttgctttcg

SEQ ID NO: 619027 - DNA, 25 bp, Mus musculus
ggctaattccaattgcttgctttcg

SEQ ID NO: 619028 - DNA, 25 bp, Mus musculus
ggctaattgctcatggcacgtggac

SEQ ID NO: 619029 - DNA, 25 bp, Mus musculus
ggctaattgctcttggcacgtggac

SEQ ID NO: 619030 - DNA, 25 bp, Mus musculus
ggctaatttagccagcacatttaag

SEQ ID NO: 619031 - DNA, 25 bp, Mus musculus
ggctaatttagcgagcacatttaag

SEQ ID NO: 619032 - DNA, 25 bp, Mus musculus
ggctaatttagtcgtacctcaaaca

SEQ ID NO: 619033 - DNA, 25 bp, Mus musculus
ggctaatttagtggtacctcaaaca

SEQ ID NO: 619034 - DNA, 25 bp, Mus musculus
ggctaatttctcaggtgggccaaga

SEQ ID NO: 619035 - DNA, 25 bp, Mus musculus
ggctaatttctctggtgggccaaga

SEQ ID NO: 619036 - DNA, 25 bp, Mus musculus
ggctaatttttcaatcccgataaga

SEQ ID NO: 619037 - DNA, 25 bp, Mus musculus
ggctaatttttctatcccgataaga

SEQ ID NO: 619038 - DNA, 25 bp, Mus musculus
ggctacaaaaggctgcatataattc

SEQ ID NO: 619039 - DNA, 25 bp, Mus musculus
ggctacaaaagggtgcatataattc

SEQ ID NO: 619040 - DNA, 25 bp, Mus musculus
ggctacaaagatcatggaagacctt

SEQ ID NO: 619041 - DNA, 25 bp, Mus musculus
ggctacaaagatgatggaagacctt

SEQ ID NO: 619042 - DNA, 25 bp, Mus musculus
ggctacaaaggacttcctatgatca

SEQ ID NO: 619043 - DNA, 25 bp, Mus musculus
ggctacaaaggagttcctatgatca

SEQ ID NO: 619044 - DNA, 25 bp, Mus musculus
ggctacaaatttatactcaggcttt

SEQ ID NO: 619045 - DNA, 25 bp, Mus musculus
ggctacaaatttttactcaggcttt

SEQ ID NO: 619046 - DNA, 25 bp, Mus musculus
ggctacaacacactttcgaagaatc

SEQ ID NO: 619047 - DNA, 25 bp, Mus musculus
ggctacaacacagtttcgaagaatc

SEQ ID NO: 619048 - DNA, 25 bp, Mus musculus
ggctacaactggactatcgattcat

SEQ ID NO: 619049 - DNA, 25 bp, Mus musculus
ggctacaactggtctatcgattcat

SEQ ID NO: 619050 - DNA, 25 bp, Mus musculus
ggctacaagaatacacccactattt

SEQ ID NO: 619051 - DNA, 25 bp, Mus musculus
ggctacaagaattcacccactattt

SEQ ID NO: 619052 - DNA, 25 bp, Mus musculus
ggctacaagatgcagacatcatagc

SEQ ID NO: 619053 - DNA, 25 bp, Mus musculus
ggctacaagatggagacatcatagc

SEQ ID NO: 619054 - DNA, 25 bp, Mus musculus
ggctacaatagtacccacattctga

SEQ ID NO: 619055 - DNA, 25 bp, Mus musculus
ggctacaatagttcccacattctga

SEQ ID NO: 619056 - DNA, 25 bp, Mus musculus
ggctacaatcggaaactgcgcattt

SEQ ID NO: 619057 - DNA, 25 bp, Mus musculus
ggctacaatcggtaactgcgcattt

SEQ ID NO: 619058 - DNA, 25 bp, Mus musculus
ggctacacacaacccacgtggagat

SEQ ID NO: 619059 - DNA, 25 bp, Mus musculus
ggctacacacaagccacgtggagat

SEQ ID NO: 619060 - DNA, 25 bp, Mus musculus
ggctacacagaactcactagtccat

SEQ ID NO: 619061 - DNA, 25 bp, Mus musculus
ggctacacagaagtcactagtccat

SEQ ID NO: 619062 - DNA, 25 bp, Mus musculus
ggctacacagagaccagtccaagtt

SEQ ID NO: 619063 - DNA, 25 bp, Mus musculus
ggctacacagagtccagtccaagtt

SEQ ID NO: 619064 - DNA, 25 bp, Mus musculus
ggctacacagatactagtccctttg

SEQ ID NO: 619065 - DNA, 25 bp, Mus musculus
ggctacacagattctagtccctttg

SEQ ID NO: 619066 - DNA, 25 bp, Mus musculus
ggctacacaggtaatctcactttga

SEQ ID NO: 619067 - DNA, 25 bp, Mus musculus
ggctacacaggttatctcactttga

SEQ ID NO: 619068 - DNA, 25 bp, Mus musculus
ggctacacagtacttccaatacaga

SEQ ID NO: 619069 - DNA, 25 bp, Mus musculus
ggctacacagtagttccaatacaga

SEQ ID NO: 619070 - DNA, 25 bp, Mus musculus
ggctacacagtcatacaacaacctt

SEQ ID NO: 619071 - DNA, 25 bp, Mus musculus
ggctacacagtccacacagatgaca

SEQ ID NO: 619072 - DNA, 25 bp, Mus musculus
ggctacacagtcgacacagatgaca

SEQ ID NO: 619073 - DNA, 25 bp, Mus musculus
ggctacacagtcttacaacaacctt

SEQ ID NO: 619074 - DNA, 25 bp, Mus musculus
ggctacacataaatcccgtcttaaa

SEQ ID NO: 619075 - DNA, 25 bp, Mus musculus
ggctacacataattcccgtcttaaa

SEQ ID NO: 619076 - DNA, 25 bp, Mus musculus
ggctacacattccactaagtgcagc

SEQ ID NO: 619077 - DNA, 25 bp, Mus musculus
ggctacacattcgactaagtgcagc

SEQ ID NO: 619078 - DNA, 25 bp, Mus musculus
ggctacacctttagatggcatcccg

SEQ ID NO: 619079 - DNA, 25 bp, Mus musculus
ggctacaccttttgatggcatcccg

SEQ ID NO: 619080 - DNA, 25 bp, Mus musculus
ggctacactatcaaggcatattttc

SEQ ID NO: 619081 - DNA, 25 bp, Mus musculus
ggctacactatctaggcatattttc

SEQ ID NO: 619082 - DNA, 25 bp, Mus musculus
ggctacactggaatgatcaacgcgg

SEQ ID NO: 619083 - DNA, 25 bp, Mus musculus
ggctacactggattgatcaacgcgg

SEQ ID NO: 619084 - DNA, 25 bp, Mus musculus
ggctacactgggatcttgaacacct

SEQ ID NO: 619085 - DNA, 25 bp, Mus musculus
ggctacactgggttcttgaacacct

SEQ ID NO: 619086 - DNA, 25 bp, Mus musculus
ggctacagagcgagaaacaccggaa

SEQ ID NO: 619087 - DNA, 25 bp, Mus musculus
ggctacagagcgtgaaacaccggaa

SEQ ID NO: 619088 - DNA, 25 bp, Mus musculus
ggctacagagtacacttcccagcta

SEQ ID NO: 619089 - DNA, 25 bp, Mus musculus
ggctacagagtagacttcccagcta

SEQ ID NO: 619090 - DNA, 25 bp, Mus musculus
ggctacagatagagccactactcct

SEQ ID NO: 619091 - DNA, 25 bp, Mus musculus
ggctacagatagaggctgccttgga

SEQ ID NO: 619092 - DNA, 25 bp, Mus musculus
ggctacagatagtgccactactcct

SEQ ID NO: 619093 - DNA, 25 bp, Mus musculus
ggctacagatagtggctgccttgga

SEQ ID NO: 619094 - DNA, 25 bp, Mus musculus
ggctacagcaggattcaaagatcta

SEQ ID NO: 619095 - DNA, 25 bp, Mus musculus
ggctacagcaggtttcaaagatcta

SEQ ID NO: 619096 - DNA, 25 bp, Mus musculus
ggctacagcctgaatagtccatgcc

SEQ ID NO: 619097 - DNA, 25 bp, Mus musculus
ggctacagcctgagtgaagaatttc

SEQ ID NO: 619098 - DNA, 25 bp, Mus musculus
ggctacagcctgtatagtccatgcc

SEQ ID NO: 619099 - DNA, 25 bp, Mus musculus
ggctacagcctgtgtgaagaatttc

SEQ ID NO: 619100 - DNA, 25 bp, Mus musculus
ggctacagctgccactacaattgtt

SEQ ID NO: 619101 - DNA, 25 bp, Mus musculus
ggctacagctgcgactacaattgtt

SEQ ID NO: 619102 - DNA, 25 bp, Mus musculus
ggctacagctggctcaggatttttg

SEQ ID NO: 619103 - DNA, 25 bp, Mus musculus
ggctacagctgggtcaggatttttg

SEQ ID NO: 619104 - DNA, 25 bp, Mus musculus
ggctacaggtgaagatcccggatct

SEQ ID NO: 619105 - DNA, 25 bp, Mus musculus
ggctacaggtgatgatcccggatct

SEQ ID NO: 619106 - DNA, 25 bp, Mus musculus
ggctacagtctcagactttgtggca

SEQ ID NO: 619107 - DNA, 25 bp, Mus musculus
ggctacagtctctgactttgtggca

SEQ ID NO: 619108 - DNA, 25 bp, Mus musculus
ggctacagtgaaagttggttatggt

SEQ ID NO: 619109 - DNA, 25 bp, Mus musculus
ggctacagtgaatgttggttatggt

SEQ ID NO: 619110 - DNA, 25 bp, Mus musculus
ggctacagtgccaagtaggtcagaa

SEQ ID NO: 619111 - DNA, 25 bp, Mus musculus
ggctacagtgcctagtaggtcagaa

SEQ ID NO: 619112 - DNA, 25 bp, Mus musculus
ggctacagtttcagtggctcagggc

SEQ ID NO: 619113 - DNA, 25 bp, Mus musculus
ggctacagtttctgtggctcagggc

SEQ ID NO: 619114 - DNA, 25 bp, Mus musculus
ggctacataaacactgtcacacata

SEQ ID NO: 619115 - DNA, 25 bp, Mus musculus
ggctacataaacctataatcacaga

SEQ ID NO: 619116 - DNA, 25 bp, Mus musculus
ggctacataaacgtataatcacaga

SEQ ID NO: 619117 - DNA, 25 bp, Mus musculus
ggctacataaactctgtcacacata

SEQ ID NO: 619118 - DNA, 25 bp, Mus musculus
ggctacataatcctcaaattggcat

SEQ ID NO: 619119 - DNA, 25 bp, Mus musculus
ggctacataatcgtcaaattggcat

SEQ ID NO: 619120 - DNA, 25 bp, Mus musculus
ggctacataccgaaaacttgtgcca

SEQ ID NO: 619121 - DNA, 25 bp, Mus musculus
ggctacataccgtaaacttgtgcca

SEQ ID NO: 619122 - DNA, 25 bp, Mus musculus
ggctacatagcgagtgaacccatcc

SEQ ID NO: 619123 - DNA, 25 bp, Mus musculus
ggctacatagcgtgtgaacccatcc

SEQ ID NO: 619124 - DNA, 25 bp, Mus musculus
ggctacatagtgcaattgcatctga

SEQ ID NO: 619125 - DNA, 25 bp, Mus musculus
ggctacatagtggaattgcatctga

SEQ ID NO: 619126 - DNA, 25 bp, Mus musculus
ggctacatataacacctcactgctc

SEQ ID NO: 619127 - DNA, 25 bp, Mus musculus
ggctacatataagacctcactgctc

SEQ ID NO: 619128 - DNA, 25 bp, Mus musculus
ggctacatatgacctagtacacttg

SEQ ID NO: 619129 - DNA, 25 bp, Mus musculus
ggctacatatgagctagtacacttg

SEQ ID NO: 619130 - DNA, 25 bp, Mus musculus
ggctacatcgtcatctttctctttt

SEQ ID NO: 619131 - DNA, 25 bp, Mus musculus
ggctacatcgtcttctttctctttt

SEQ ID NO: 619132 - DNA, 25 bp, Mus musculus
ggctacatctacatctaccagagag

SEQ ID NO: 619133 - DNA, 25 bp, Mus musculus
ggctacatctacttctaccagagag

SEQ ID NO: 619134 - DNA, 25 bp, Mus musculus
ggctacatctcccaatgcaggaaga

SEQ ID NO: 619135 - DNA, 25 bp, Mus musculus
ggctacatctccgaatgcaggaaga

SEQ ID NO: 619136 - DNA, 25 bp, Mus musculus
ggctacatctgaatatccatactca

SEQ ID NO: 619137 - DNA, 25 bp, Mus musculus
ggctacatctgattatccatactca

SEQ ID NO: 619138 - DNA, 25 bp, Mus musculus
ggctacatgagtacacctttcaagt

SEQ ID NO: 619139 - DNA, 25 bp, Mus musculus
ggctacatgagttcacctttcaagt

SEQ ID NO: 619140 - DNA, 25 bp, Mus musculus
ggctacatgatgacctaagagcaat

SEQ ID NO: 619141 - DNA, 25 bp, Mus musculus
ggctacatgatgtcctaagagcaat

SEQ ID NO: 619142 - DNA, 25 bp, Mus musculus
ggctacatggtccagagaagagttc

SEQ ID NO: 619143 - DNA, 25 bp, Mus musculus
ggctacatggtcgagagaagagttc

SEQ ID NO: 619144 - DNA, 25 bp, Mus musculus
ggctacatggtgacactttgtctca

SEQ ID NO: 619145 - DNA, 25 bp, Mus musculus
ggctacatggtgtcactttgtctca

SEQ ID NO: 619146 - DNA, 25 bp, Mus musculus
ggctacatgtgtcagcttccagact

SEQ ID NO: 619147 - DNA, 25 bp, Mus musculus
ggctacatgtgtgagcttccagact

SEQ ID NO: 619148 - DNA, 25 bp, Mus musculus
ggctacattcttaattctgcggtga

SEQ ID NO: 619149 - DNA, 25 bp, Mus musculus
ggctacattctttattctgcggtga

SEQ ID NO: 619150 - DNA, 25 bp, Mus musculus
ggctacatttcaattccaccaaaga

SEQ ID NO: 619151 - DNA, 25 bp, Mus musculus
ggctacatttcatttccaccaaaga

SEQ ID NO: 619152 - DNA, 25 bp, Mus musculus
ggctaccaataaacttcttctgagg

SEQ ID NO: 619153 - DNA, 25 bp, Mus musculus
ggctaccaataatcttcttctgagg

SEQ ID NO: 619154 - DNA, 25 bp, Mus musculus
ggctaccacaagactgtgataggat

SEQ ID NO: 619155 - DNA, 25 bp, Mus musculus
ggctaccacaagtctgtgataggat

SEQ ID NO: 619156 - DNA, 25 bp, Mus musculus
ggctaccacagtaactatgaaacct

SEQ ID NO: 619157 - DNA, 25 bp, Mus musculus
ggctaccacagttactatgaaacct

SEQ ID NO: 619158 - DNA, 25 bp, Mus musculus
ggctaccagccaagaatgcacctaa

SEQ ID NO: 619159 - DNA, 25 bp, Mus musculus
ggctaccagccaagctccaagttgt

SEQ ID NO: 619160 - DNA, 25 bp, Mus musculus
ggctaccagccatgaatgcacctaa

SEQ ID NO: 619161 - DNA, 25 bp, Mus musculus
ggctaccagccatgctccaagttgt

SEQ ID NO: 619162 - DNA, 25 bp, Mus musculus
ggctaccagccgcagcatatagact

SEQ ID NO: 619163 - DNA, 25 bp, Mus musculus
ggctaccagccggagcatatagact

SEQ ID NO: 619164 - DNA, 25 bp, Mus musculus
ggctaccagctacggctctagagaa

SEQ ID NO: 619165 - DNA, 25 bp, Mus musculus
ggctaccagctagggctctagagaa

SEQ ID NO: 619166 - DNA, 25 bp, Mus musculus
ggctaccaggttctaaactcccata

SEQ ID NO: 619167 - DNA, 25 bp, Mus musculus
ggctaccaggttgtaaactcccata

SEQ ID NO: 619168 - DNA, 25 bp, Mus musculus
ggctaccatgagatctgtactgatg

SEQ ID NO: 619169 - DNA, 25 bp, Mus musculus
ggctaccatgagttctgtactgatg

SEQ ID NO: 619170 - DNA, 25 bp, Mus musculus
ggctaccatgttactgccaaatgtt

SEQ ID NO: 619171 - DNA, 25 bp, Mus musculus
ggctaccatgttcggaagtggcttt

SEQ ID NO: 619172 - DNA, 25 bp, Mus musculus
ggctaccatgttgggaagtggcttt

SEQ ID NO: 619173 - DNA, 25 bp, Mus musculus
ggctaccatgtttctgccaaatgtt

SEQ ID NO: 619174 - DNA, 25 bp, Mus musculus
ggctaccattggatacctgttatgt

SEQ ID NO: 619175 - DNA, 25 bp, Mus musculus
ggctaccattggttacctgttatgt

SEQ ID NO: 619176 - DNA, 25 bp, Mus musculus
ggctacccaaccatttacaggagag

SEQ ID NO: 619177 - DNA, 25 bp, Mus musculus
ggctacccaaccttttacaggagag

SEQ ID NO: 619178 - DNA, 25 bp, Mus musculus
ggctacccagccaaactaaagacac

SEQ ID NO: 619179 - DNA, 25 bp, Mus musculus
ggctacccagcctaactaaagacac

SEQ ID NO: 619180 - DNA, 25 bp, Mus musculus
ggctacccagggacagacttagtgg

SEQ ID NO: 619181 - DNA, 25 bp, Mus musculus
ggctacccagggagcgcgatagaat

SEQ ID NO: 619182 - DNA, 25 bp, Mus musculus
ggctacccagggtcagacttagtgg

SEQ ID NO: 619183 - DNA, 25 bp, Mus musculus
ggctacccagggtgcgcgatagaat

SEQ ID NO: 619184 - DNA, 25 bp, Mus musculus
ggctacccctatcgtgagtggaact

SEQ ID NO: 619185 - DNA, 25 bp, Mus musculus
ggctacccctatggtgagtggaact

SEQ ID NO: 619186 - DNA, 25 bp, Mus musculus
ggctacccggccaaagagaattttg

SEQ ID NO: 619187 - DNA, 25 bp, Mus musculus
ggctacccggcctaagagaattttg

SEQ ID NO: 619188 - DNA, 25 bp, Mus musculus
ggctaccctgtgaatcagtgagcga

SEQ ID NO: 619189 - DNA, 25 bp, Mus musculus
ggctaccctgtgtatcagtgagcga

SEQ ID NO: 619190 - DNA, 25 bp, Mus musculus
ggctaccgccggaacactccagcct

SEQ ID NO: 619191 - DNA, 25 bp, Mus musculus
ggctaccgccggtacactccagcct

SEQ ID NO: 619192 - DNA, 25 bp, Mus musculus
ggctaccgccttaaataagatcaaa

SEQ ID NO: 619193 - DNA, 25 bp, Mus musculus
ggctaccgcctttaataagatcaaa

SEQ ID NO: 619194 - DNA, 25 bp, Mus musculus
ggctaccgcgtacctctccgggaga

SEQ ID NO: 619195 - DNA, 25 bp, Mus musculus
ggctaccgcgtagctctccgggaga

SEQ ID NO: 619196 - DNA, 25 bp, Mus musculus
ggctaccggcgaaactttcgatgga

SEQ ID NO: 619197 - DNA, 25 bp, Mus musculus
ggctaccggcgatactttcgatgga

SEQ ID NO: 619198 - DNA, 25 bp, Mus musculus
ggctacctccgaagacagaaacgtg

SEQ ID NO: 619199 - DNA, 25 bp, Mus musculus
ggctacctccgatgacagaaacgtg

SEQ ID NO: 619200 - DNA, 25 bp, Mus musculus
ggctacctccttacgtgtgttggta

SEQ ID NO: 619201 - DNA, 25 bp, Mus musculus
ggctacctcctttcgtgtgttggta

SEQ ID NO: 619202 - DNA, 25 bp, Mus musculus
ggctacctcgagagtacagttttat

SEQ ID NO: 619203 - DNA, 25 bp, Mus musculus
ggctacctcgagtgtacagttttat

SEQ ID NO: 619204 - DNA, 25 bp, Mus musculus
ggctacctctacagatccaagggca

SEQ ID NO: 619205 - DNA, 25 bp, Mus musculus
ggctacctctactgatccaagggca

SEQ ID NO: 619206 - DNA, 25 bp, Mus musculus
ggctacctctggatgatgactttct

SEQ ID NO: 619207 - DNA, 25 bp, Mus musculus
ggctacctctggttgatgactttct

SEQ ID NO: 619208 - DNA, 25 bp, Mus musculus
ggctacctgactctggacaatttta

SEQ ID NO: 619209 - DNA, 25 bp, Mus musculus
ggctacctgactgtggacaatttta

SEQ ID NO: 619210 - DNA, 25 bp, Mus musculus
ggctacctgttcacacaagacacaa

SEQ ID NO: 619211 - DNA, 25 bp, Mus musculus
ggctacctgttctcacaagacacaa

SEQ ID NO: 619212 - DNA, 25 bp, Mus musculus
ggctacctgttgcttctgtaaacac

SEQ ID NO: 619213 - DNA, 25 bp, Mus musculus
ggctacctgttggttctgtaaacac

SEQ ID NO: 619214 - DNA, 25 bp, Mus musculus
ggctaccttggaccgaagcaatttt

SEQ ID NO: 619215 - DNA, 25 bp, Mus musculus
ggctaccttggagcgaagcaatttt

SEQ ID NO: 619216 - DNA, 25 bp, Mus musculus
ggctaccttggccttgtcttgggac

SEQ ID NO: 619217 - DNA, 25 bp, Mus musculus
ggctaccttggcgttgtcttgggac

SEQ ID NO: 619218 - DNA, 25 bp, Mus musculus
ggctacctttgtaaaatctgcactt

SEQ ID NO: 619219 - DNA, 25 bp, Mus musculus
ggctacctttgttaaatctgcactt

SEQ ID NO: 619220 - DNA, 25 bp, Mus musculus
ggctacgaaggcaatgctgtcatac

SEQ ID NO: 619221 - DNA, 25 bp, Mus musculus
ggctacgaaggctatgctgtcatac

SEQ ID NO: 619222 - DNA, 25 bp, Mus musculus
ggctacgagcctccttctgtagaca

SEQ ID NO: 619223 - DNA, 25 bp, Mus musculus
ggctacgagcctgcttctgtagaca

SEQ ID NO: 619224 - DNA, 25 bp, Mus musculus
ggctacgatatgcacactgcttggt

SEQ ID NO: 619225 - DNA, 25 bp, Mus musculus
ggctacgatatggacactgcttggt

SEQ ID NO: 619226 - DNA, 25 bp, Mus musculus
ggctacgatctgaaccgcctgagat

SEQ ID NO: 619227 - DNA, 25 bp, Mus musculus
ggctacgatctgtaccgcctgagat

SEQ ID NO: 619228 - DNA, 25 bp, Mus musculus
ggctacgatgttcattttccacgga

SEQ ID NO: 619229 - DNA, 25 bp, Mus musculus
ggctacgatgttgattttccacgga

SEQ ID NO: 619230 - DNA, 25 bp, Mus musculus
ggctacgccggcaacatacctcagg

SEQ ID NO: 619231 - DNA, 25 bp, Mus musculus
ggctacgccggctacatacctcagg

SEQ ID NO: 619232 - DNA, 25 bp, Mus musculus
ggctacggcaaaaactggtaaccca

SEQ ID NO: 619233 - DNA, 25 bp, Mus musculus
ggctacggcaaatactggtaaccca

SEQ ID NO: 619234 - DNA, 25 bp, Mus musculus
ggctacggcggcatcccttacggcg

SEQ ID NO: 619235 - DNA, 25 bp, Mus musculus
ggctacggcggcttcccttacggcg

SEQ ID NO: 619236 - DNA, 25 bp, Mus musculus
ggctacgggaacacggccgccgcag

SEQ ID NO: 619237 - DNA, 25 bp, Mus musculus
ggctacgggaactcggccgccgcag

SEQ ID NO: 619238 - DNA, 25 bp, Mus musculus
ggctacgggtataaatgtgctgtaa

SEQ ID NO: 619239 - DNA, 25 bp, Mus musculus
ggctacgggtattaatgtgctgtaa

SEQ ID NO: 619240 - DNA, 25 bp, Mus musculus
ggctacgtatacaaccagatattgt

SEQ ID NO: 619241 - DNA, 25 bp, Mus musculus
ggctacgtatactaccagatattgt

SEQ ID NO: 619242 - DNA, 25 bp, Mus musculus
ggctacgtcactcgattttgttctg

SEQ ID NO: 619243 - DNA, 25 bp, Mus musculus
ggctacgtcactggattttgttctg

SEQ ID NO: 619244 - DNA, 25 bp, Mus musculus
ggctacgtcatactttatttctgaa

SEQ ID NO: 619245 - DNA, 25 bp, Mus musculus
ggctacgtcatagtttatttctgaa

SEQ ID NO: 619246 - DNA, 25 bp, Mus musculus
ggctacgtctccagggtagagccac

SEQ ID NO: 619247 - DNA, 25 bp, Mus musculus
ggctacgtctcctgggtagagccac

SEQ ID NO: 619248 - DNA, 25 bp, Mus musculus
ggctacgtgatcaacattgcaccta

SEQ ID NO: 619249 - DNA, 25 bp, Mus musculus
ggctacgtgatctacattgcaccta

SEQ ID NO: 619250 - DNA, 25 bp, Mus musculus
ggctacgttatacacccaaatccta

SEQ ID NO: 619251 - DNA, 25 bp, Mus musculus
ggctacgttatagacccaaatccta

SEQ ID NO: 619252 - DNA, 25 bp, Mus musculus
ggctactaactgcatccaggaaaaa

SEQ ID NO: 619253 - DNA, 25 bp, Mus musculus
ggctactaactggatccaggaaaaa

SEQ ID NO: 619254 - DNA, 25 bp, Mus musculus
ggctactaatttaattgccaggttg

SEQ ID NO: 619255 - DNA, 25 bp, Mus musculus
ggctactaattttattgccaggttg

SEQ ID NO: 619256 - DNA, 25 bp, Mus musculus
ggctactactatctcaacaactttg

SEQ ID NO: 619257 - DNA, 25 bp, Mus musculus
ggctactactatgtcaacaactttg

SEQ ID NO: 619258 - DNA, 25 bp, Mus musculus
ggctactacttcattattgtgctct

SEQ ID NO: 619259 - DNA, 25 bp, Mus musculus
ggctactacttctttattgtgctct

SEQ ID NO: 619260 - DNA, 25 bp, Mus musculus
ggctactagacacacataagatggt

SEQ ID NO: 619261 - DNA, 25 bp, Mus musculus
ggctactagacagacataagatggt

SEQ ID NO: 619262 - DNA, 25 bp, Mus musculus
ggctactagcagaaaggttatgaca

SEQ ID NO: 619263 - DNA, 25 bp, Mus musculus
ggctactagcagtaaggttatgaca

SEQ ID NO: 619264 - DNA, 25 bp, Mus musculus
ggctactagctacctcaggtgtcca

SEQ ID NO: 619265 - DNA, 25 bp, Mus musculus
ggctactagctagctcaggtgtcca

SEQ ID NO: 619266 - DNA, 25 bp, Mus musculus
ggctactatgtaagtctcaccaagt

SEQ ID NO: 619267 - DNA, 25 bp, Mus musculus
ggctactatgtatgtctcaccaagt

SEQ ID NO: 619268 - DNA, 25 bp, Mus musculus
ggctactcacaaaaggtgttaccca

SEQ ID NO: 619269 - DNA, 25 bp, Mus musculus
ggctactcacaataggtgttaccca

SEQ ID NO: 619270 - DNA, 25 bp, Mus musculus
ggctactcagtactgtgacacacac

SEQ ID NO: 619271 - DNA, 25 bp, Mus musculus
ggctactcagtagtgtgacacacac

SEQ ID NO: 619272 - DNA, 25 bp, Mus musculus
ggctactcatctactggaaaaattt

SEQ ID NO: 619273 - DNA, 25 bp, Mus musculus
ggctactcatcttctggaaaaattt

SEQ ID NO: 619274 - DNA, 25 bp, Mus musculus
ggctactccataagggccaaacatt

SEQ ID NO: 619275 - DNA, 25 bp, Mus musculus
ggctactccatatgggccaaacatt

SEQ ID NO: 619276 - DNA, 25 bp, Mus musculus
ggctactccattcacacttacctgt

SEQ ID NO: 619277 - DNA, 25 bp, Mus musculus
ggctactccattgacacttacctgt

SEQ ID NO: 619278 - DNA, 25 bp, Mus musculus
ggctactccgaccaactatgttgtt

SEQ ID NO: 619279 - DNA, 25 bp, Mus musculus
ggctactccgacgaactatgttgtt

SEQ ID NO: 619280 - DNA, 25 bp, Mus musculus
ggctactcctctaatattaatgcat

SEQ ID NO: 619281 - DNA, 25 bp, Mus musculus
ggctactcctcttatattaatgcat

SEQ ID NO: 619282 - DNA, 25 bp, Mus musculus
ggctactcgccaaccgcagggagcg

SEQ ID NO: 619283 - DNA, 25 bp, Mus musculus
ggctactcgccatccgcagggagcg

SEQ ID NO: 619284 - DNA, 25 bp, Mus musculus
ggctactcgtggcttttggtactct

SEQ ID NO: 619285 - DNA, 25 bp, Mus musculus
ggctactcgtgggttttggtactct

SEQ ID NO: 619286 - DNA, 25 bp, Mus musculus
ggctactctaaaagagatcccctgt

SEQ ID NO: 619287 - DNA, 25 bp, Mus musculus
ggctactctaaatgagatcccctgt

SEQ ID NO: 619288 - DNA, 25 bp, Mus musculus
ggctactcttccaaaggacgaccta

SEQ ID NO: 619289 - DNA, 25 bp, Mus musculus
ggctactcttcctaaggacgaccta

SEQ ID NO: 619290 - DNA, 25 bp, Mus musculus
ggctactgaagaatttcgaccacta

SEQ ID NO: 619291 - DNA, 25 bp, Mus musculus
ggctactgaagattttcgaccacta

SEQ ID NO: 619292 - DNA, 25 bp, Mus musculus
ggctactgacaacaatgatccccac

SEQ ID NO: 619293 - DNA, 25 bp, Mus musculus
ggctactgacaagaatgatccccac

SEQ ID NO: 619294 - DNA, 25 bp, Mus musculus
ggctactgcatcattcacaagtact

SEQ ID NO: 619295 - DNA, 25 bp, Mus musculus
ggctactgcatctttcacaagtact

SEQ ID NO: 619296 - DNA, 25 bp, Mus musculus
ggctactgcctcataaatacaggaa

SEQ ID NO: 619297 - DNA, 25 bp, Mus musculus
ggctactgcctcttaaatacaggaa

SEQ ID NO: 619298 - DNA, 25 bp, Mus musculus
ggctactggctcatttcttaggaag

SEQ ID NO: 619299 - DNA, 25 bp, Mus musculus
ggctactggctcttttcttaggaag

SEQ ID NO: 619300 - DNA, 25 bp, Mus musculus
ggctactggctgatatatgcatctt

SEQ ID NO: 619301 - DNA, 25 bp, Mus musculus
ggctactggctgttatatgcatctt

SEQ ID NO: 619302 - DNA, 25 bp, Mus musculus
ggctactggtcgcaggtcctggctt

SEQ ID NO: 619303 - DNA, 25 bp, Mus musculus
ggctactggtcggaggtcctggctt

SEQ ID NO: 619304 - DNA, 25 bp, Mus musculus
ggctactgtccccataggtatcaga

SEQ ID NO: 619305 - DNA, 25 bp, Mus musculus
ggctactgtcccgataggtatcaga

SEQ ID NO: 619306 - DNA, 25 bp, Mus musculus
ggctactgtgggaaccaggcctgta

SEQ ID NO: 619307 - DNA, 25 bp, Mus musculus
ggctactgtgggtaccaggcctgta

SEQ ID NO: 619308 - DNA, 25 bp, Mus musculus
ggctactgtgtcagattttccacga

SEQ ID NO: 619309 - DNA, 25 bp, Mus musculus
ggctactgtgtctgattttccacga

SEQ ID NO: 619310 - DNA, 25 bp, Mus musculus
ggctactgttaaccttggacttgta

SEQ ID NO: 619311 - DNA, 25 bp, Mus musculus
ggctactgttaagcttggacttgta

SEQ ID NO: 619312 - DNA, 25 bp, Mus musculus
ggctacttagccacgatcacgatgg

SEQ ID NO: 619313 - DNA, 25 bp, Mus musculus
ggctacttagcctcgatcacgatgg

SEQ ID NO: 619314 - DNA, 25 bp, Mus musculus
ggctacttcaggaataactaccatt

SEQ ID NO: 619315 - DNA, 25 bp, Mus musculus
ggctacttcaggtataactaccatt

SEQ ID NO: 619316 - DNA, 25 bp, Mus musculus
ggctacttcagtagcctgacaagat

SEQ ID NO: 619317 - DNA, 25 bp, Mus musculus
ggctacttcagtctcacaactcagt

SEQ ID NO: 619318 - DNA, 25 bp, Mus musculus
ggctacttcagtgtcacaactcagt

SEQ ID NO: 619319 - DNA, 25 bp, Mus musculus
ggctacttcagttgcctgacaagat

SEQ ID NO: 619320 - DNA, 25 bp, Mus musculus
ggctacttcctgagttcaaaacctg

SEQ ID NO: 619321 - DNA, 25 bp, Mus musculus
ggctacttcctgtgttcaaaacctg

SEQ ID NO: 619322 - DNA, 25 bp, Mus musculus
ggctacttcgatctcatgggccagt

SEQ ID NO: 619323 - DNA, 25 bp, Mus musculus
ggctacttcgatgtcatgggccagt

SEQ ID NO: 619324 - DNA, 25 bp, Mus musculus
ggctacttcgtacgtcagcatgtct

SEQ ID NO: 619325 - DNA, 25 bp, Mus musculus
ggctacttcgtaggtcagcatgtct

SEQ ID NO: 619326 - DNA, 25 bp, Mus musculus
ggctacttctgacgtgaaaccaaaa

SEQ ID NO: 619327 - DNA, 25 bp, Mus musculus
ggctacttctgaggtgaaaccaaaa

SEQ ID NO: 619328 - DNA, 25 bp, Mus musculus
ggctacttcttaatgttttaccttg

SEQ ID NO: 619329 - DNA, 25 bp, Mus musculus
ggctacttcttattgttttaccttg

SEQ ID NO: 619330 - DNA, 25 bp, Mus musculus
ggctacttctttcttactttaacat

SEQ ID NO: 619331 - DNA, 25 bp, Mus musculus
ggctacttctttgttactttaacat

SEQ ID NO: 619332 - DNA, 25 bp, Mus musculus
ggctacttgcaccaggactgctgcg

SEQ ID NO: 619333 - DNA, 25 bp, Mus musculus
ggctacttgcacgaggactgctgcg

SEQ ID NO: 619334 - DNA, 25 bp, Mus musculus
ggctacttgttcatgttagctgaag

SEQ ID NO: 619335 - DNA, 25 bp, Mus musculus
ggctacttgttcctgtttagaatca

SEQ ID NO: 619336 - DNA, 25 bp, Mus musculus
ggctacttgttcgtgtttagaatca

SEQ ID NO: 619337 - DNA, 25 bp, Mus musculus
ggctacttgttcttgttagctgaag

SEQ ID NO: 619338 - DNA, 25 bp, Mus musculus
ggctactttattacacaacactaca

SEQ ID NO: 619339 - DNA, 25 bp, Mus musculus
ggctactttattattcttgagactt

SEQ ID NO: 619340 - DNA, 25 bp, Mus musculus
ggctactttatttcacaacactaca

SEQ ID NO: 619341 - DNA, 25 bp, Mus musculus
ggctactttatttttcttgagactt

SEQ ID NO: 619342 - DNA, 25 bp, Mus musculus
ggctactttcagaattggcttccag

SEQ ID NO: 619343 - DNA, 25 bp, Mus musculus
ggctactttcagtattggcttccag

SEQ ID NO: 619344 - DNA, 25 bp, Mus musculus
ggctactttgagactgtgctttacc

SEQ ID NO: 619345 - DNA, 25 bp, Mus musculus
ggctactttgagtctgtgctttacc

SEQ ID NO: 619346 - DNA, 25 bp, Mus musculus
ggctactttggaatcactcagcata

SEQ ID NO: 619347 - DNA, 25 bp, Mus musculus
ggctactttggattcactcagcata

SEQ ID NO: 619348 - DNA, 25 bp, Mus musculus
ggctactttgtgatgctggctgtca

SEQ ID NO: 619349 - DNA, 25 bp, Mus musculus
ggctactttgtgttgctggctgtca

SEQ ID NO: 619350 - DNA, 25 bp, Mus musculus
ggctacttttcaaggacacacacac

SEQ ID NO: 619351 - DNA, 25 bp, Mus musculus
ggctacttttcatggacacacacac

SEQ ID NO: 619352 - DNA, 25 bp, Mus musculus
ggctagaaacaaacctgtagaacat

SEQ ID NO: 619353 - DNA, 25 bp, Mus musculus
ggctagaaacaatcctgtagaacat

SEQ ID NO: 619354 - DNA, 25 bp, Mus musculus
ggctagaaccagacacaacttcaaa

SEQ ID NO: 619355 - DNA, 25 bp, Mus musculus
ggctagaaccagtcacaacttcaaa

SEQ ID NO: 619356 - DNA, 25 bp, Mus musculus
ggctagaaggcccaatgctgtaaat

SEQ ID NO: 619357 - DNA, 25 bp, Mus musculus
ggctagaaggccgaatgctgtaaat

SEQ ID NO: 619358 - DNA, 25 bp, Mus musculus
ggctagaatggccagaattccacaa

SEQ ID NO: 619359 - DNA, 25 bp, Mus musculus
ggctagaatggcgagaattccacaa

SEQ ID NO: 619360 - DNA, 25 bp, Mus musculus
ggctagacaattcccaaacttatgt

SEQ ID NO: 619361 - DNA, 25 bp, Mus musculus
ggctagacaattgccaaacttatgt

SEQ ID NO: 619362 - DNA, 25 bp, Mus musculus
ggctagacagatcgatcgatgctaa

SEQ ID NO: 619363 - DNA, 25 bp, Mus musculus
ggctagacagatggatcgatgctaa

SEQ ID NO: 619364 - DNA, 25 bp, Mus musculus
ggctagacagttaggcctggccctc

SEQ ID NO: 619365 - DNA, 25 bp, Mus musculus
ggctagacagtttggcctggccctc

SEQ ID NO: 619366 - DNA, 25 bp, Mus musculus
ggctagacattcacttgaacactgt

SEQ ID NO: 619367 - DNA, 25 bp, Mus musculus
ggctagacattctcttgaacactgt

SEQ ID NO: 619368 - DNA, 25 bp, Mus musculus
ggctagaccgaaagctgtggccctt

SEQ ID NO: 619369 - DNA, 25 bp, Mus musculus
ggctagaccgaatgctgtggccctt

SEQ ID NO: 619370 - DNA, 25 bp, Mus musculus
ggctagacgtttctatgccatctaa

SEQ ID NO: 619371 - DNA, 25 bp, Mus musculus
ggctagacgtttgtatgccatctaa

SEQ ID NO: 619372 - DNA, 25 bp, Mus musculus
ggctagactactagtttgtttactt

SEQ ID NO: 619373 - DNA, 25 bp, Mus musculus
ggctagactacttgtttgtttactt

SEQ ID NO: 619374 - DNA, 25 bp, Mus musculus
ggctagactctaaactccttgagca

SEQ ID NO: 619375 - DNA, 25 bp, Mus musculus
ggctagactctatactccttgagca

SEQ ID NO: 619376 - DNA, 25 bp, Mus musculus
ggctagactgtgaacttaacttttg

SEQ ID NO: 619377 - DNA, 25 bp, Mus musculus
ggctagactgtgtacttaacttttg

SEQ ID NO: 619378 - DNA, 25 bp, Mus musculus
ggctagagacttcgtttttcctcga

SEQ ID NO: 619379 - DNA, 25 bp, Mus musculus
ggctagagacttggtttttcctcga

SEQ ID NO: 619380 - DNA, 25 bp, Mus musculus
ggctagagccggagccggcgagcaa

SEQ ID NO: 619381 - DNA, 25 bp, Mus musculus
ggctagagccggtgccggcgagcaa

SEQ ID NO: 619382 - DNA, 25 bp, Mus musculus
ggctagaggccacaagactcaggat

SEQ ID NO: 619383 - DNA, 25 bp, Mus musculus
ggctagaggccagaagactcaggat

SEQ ID NO: 619384 - DNA, 25 bp, Mus musculus
ggctagagtggaaatttgcaaaccc

SEQ ID NO: 619385 - DNA, 25 bp, Mus musculus
ggctagagtggatatttgcaaaccc

SEQ ID NO: 619386 - DNA, 25 bp, Mus musculus
ggctagatcctaaccagtactaatt

SEQ ID NO: 619387 - DNA, 25 bp, Mus musculus
ggctagatcctatccagtactaatt

SEQ ID NO: 619388 - DNA, 25 bp, Mus musculus
ggctagattgtaatcttcagatatt

SEQ ID NO: 619389 - DNA, 25 bp, Mus musculus
ggctagattgtattcttcagatatt

SEQ ID NO: 619390 - DNA, 25 bp, Mus musculus
ggctagcaatgtaatttattcagac

SEQ ID NO: 619391 - DNA, 25 bp, Mus musculus
ggctagcaatgttatttattcagac

SEQ ID NO: 619392 - DNA, 25 bp, Mus musculus
ggctagcacgtccaatatgatatta

SEQ ID NO: 619393 - DNA, 25 bp, Mus musculus
ggctagcacgtcgaatatgatatta

SEQ ID NO: 619394 - DNA, 25 bp, Mus musculus
ggctagcactatatactcaggctta

SEQ ID NO: 619395 - DNA, 25 bp, Mus musculus
ggctagcactatttactcaggctta

SEQ ID NO: 619396 - DNA, 25 bp, Mus musculus
ggctagcactctcgtcagggtaccc

SEQ ID NO: 619397 - DNA, 25 bp, Mus musculus
ggctagcactctggtcagggtaccc

SEQ ID NO: 619398 - DNA, 25 bp, Mus musculus
ggctagcactgtatttaccctagtg

SEQ ID NO: 619399 - DNA, 25 bp, Mus musculus
ggctagcactgtttttaccctagtg

SEQ ID NO: 619400 - DNA, 25 bp, Mus musculus
ggctagcagcaaatggtggacacct

SEQ ID NO: 619401 - DNA, 25 bp, Mus musculus
ggctagcagcaattggtggacacct

SEQ ID NO: 619402 - DNA, 25 bp, Mus musculus
ggctagccaggtatgccgtgacagc

SEQ ID NO: 619403 - DNA, 25 bp, Mus musculus
ggctagccaggtttgccgtgacagc

SEQ ID NO: 619404 - DNA, 25 bp, Mus musculus
ggctagccccagattcccggctgaa

SEQ ID NO: 619405 - DNA, 25 bp, Mus musculus
ggctagccccagtttcccggctgaa

SEQ ID NO: 619406 - DNA, 25 bp, Mus musculus
ggctagcccgaacatgaaacatgtt

SEQ ID NO: 619407 - DNA, 25 bp, Mus musculus
ggctagcccgaagatgaaacatgtt

SEQ ID NO: 619408 - DNA, 25 bp, Mus musculus
ggctagccctaaaaccagaggactt

SEQ ID NO: 619409 - DNA, 25 bp, Mus musculus
ggctagccctaataccagaggactt

SEQ ID NO: 619410 - DNA, 25 bp, Mus musculus
ggctagcctaggatctaccattatc

SEQ ID NO: 619411 - DNA, 25 bp, Mus musculus
ggctagcctaggttctaccattatc

SEQ ID NO: 619412 - DNA, 25 bp, Mus musculus
ggctagcctattatctatcctaata

SEQ ID NO: 619413 - DNA, 25 bp, Mus musculus
ggctagcctattttctatcctaata

SEQ ID NO: 619414 - DNA, 25 bp, Mus musculus
ggctagcctcaaacatgaggtcctt

SEQ ID NO: 619415 - DNA, 25 bp, Mus musculus
ggctagcctcaatcatgaggtcctt

SEQ ID NO: 619416 - DNA, 25 bp, Mus musculus
ggctagcctcacaggagatccacct

SEQ ID NO: 619417 - DNA, 25 bp, Mus musculus
ggctagcctcactggagatccacct

SEQ ID NO: 619418 - DNA, 25 bp, Mus musculus
ggctagcctctaatacattcacttg

SEQ ID NO: 619419 - DNA, 25 bp, Mus musculus
ggctagcctctattacattcacttg

SEQ ID NO: 619420 - DNA, 25 bp, Mus musculus
ggctagcctggaactgtggcgtcca

SEQ ID NO: 619421 - DNA, 25 bp, Mus musculus
ggctagcctggatctgtggcgtcca

SEQ ID NO: 619422 - DNA, 25 bp, Mus musculus
ggctagcctggcctatttagtatgt

SEQ ID NO: 619423 - DNA, 25 bp, Mus musculus
ggctagcctggcgtatttagtatgt

SEQ ID NO: 619424 - DNA, 25 bp, Mus musculus
ggctagccttagagaactgactgtt

SEQ ID NO: 619425 - DNA, 25 bp, Mus musculus
ggctagccttagtgaactgactgtt

SEQ ID NO: 619426 - DNA, 25 bp, Mus musculus
ggctagccttgacccgagatgcata

SEQ ID NO: 619427 - DNA, 25 bp, Mus musculus
ggctagccttgacctgcttgctgac

SEQ ID NO: 619428 - DNA, 25 bp, Mus musculus
ggctagccttgagccgagatgcata

SEQ ID NO: 619429 - DNA, 25 bp, Mus musculus
ggctagccttgagctgcttgctgac

SEQ ID NO: 619430 - DNA, 25 bp, Mus musculus
ggctagcgatttcccctctctgagc

SEQ ID NO: 619431 - DNA, 25 bp, Mus musculus
ggctagcgatttgccctctctgagc

SEQ ID NO: 619432 - DNA, 25 bp, Mus musculus
ggctagctaaaactggtctctttgt

SEQ ID NO: 619433 - DNA, 25 bp, Mus musculus
ggctagctaaaagtggtctctttgt

SEQ ID NO: 619434 - DNA, 25 bp, Mus musculus
ggctagctaaacaaaccatatgggc

SEQ ID NO: 619435 - DNA, 25 bp, Mus musculus
ggctagctaaactaaccatatgggc

SEQ ID NO: 619436 - DNA, 25 bp, Mus musculus
ggctagctatacagtaagaccctgt

SEQ ID NO: 619437 - DNA, 25 bp, Mus musculus
ggctagctatactgtaagaccctgt

SEQ ID NO: 619438 - DNA, 25 bp, Mus musculus
ggctagctattcagctgggttctaa

SEQ ID NO: 619439 - DNA, 25 bp, Mus musculus
ggctagctattctgctgggttctaa

SEQ ID NO: 619440 - DNA, 25 bp, Mus musculus
ggctagctcaagctcatcaatgtaa

SEQ ID NO: 619441 - DNA, 25 bp, Mus musculus
ggctagctcaaggtcatcaatgtaa

SEQ ID NO: 619442 - DNA, 25 bp, Mus musculus
ggctagctcagactcacaaacagct

SEQ ID NO: 619443 - DNA, 25 bp, Mus musculus
ggctagctcagagtcacaaacagct

SEQ ID NO: 619444 - DNA, 25 bp, Mus musculus
ggctagctcattaatactcgtggtt

SEQ ID NO: 619445 - DNA, 25 bp, Mus musculus
ggctagctcatttatactcgtggtt

SEQ ID NO: 619446 - DNA, 25 bp, Mus musculus
ggctagctcctcagttctgaagaac

SEQ ID NO: 619447 - DNA, 25 bp, Mus musculus
ggctagctcctctgttctgaagaac

SEQ ID NO: 619448 - DNA, 25 bp, Mus musculus
ggctagctcgccacaaatgaagcaa

SEQ ID NO: 619449 - DNA, 25 bp, Mus musculus
ggctagctcgcctcaaatgaagcaa

SEQ ID NO: 619450 - DNA, 25 bp, Mus musculus
ggctagctcggacgcccggagcgag

SEQ ID NO: 619451 - DNA, 25 bp, Mus musculus
ggctagctcggaggcccggagcgag

SEQ ID NO: 619452 - DNA, 25 bp, Mus musculus
ggctagctctgtccagataggacct

SEQ ID NO: 619453 - DNA, 25 bp, Mus musculus
ggctagctctgtgcagataggacct

SEQ ID NO: 619454 - DNA, 25 bp, Mus musculus
ggctagcttatcatacttgttcacc

SEQ ID NO: 619455 - DNA, 25 bp, Mus musculus
ggctagcttatcttacttgttcacc

SEQ ID NO: 619456 - DNA, 25 bp, Mus musculus
ggctagcttgctaatcagacctttt

SEQ ID NO: 619457 - DNA, 25 bp, Mus musculus
ggctagcttgcttatcagacctttt

SEQ ID NO: 619458 - DNA, 25 bp, Mus musculus
ggctagctttctataatggcaactt

SEQ ID NO: 619459 - DNA, 25 bp, Mus musculus
ggctagctttctttaatggcaactt

SEQ ID NO: 619460 - DNA, 25 bp, Mus musculus
ggctagctttgaacacacagatctg

SEQ ID NO: 619461 - DNA, 25 bp, Mus musculus
ggctagctttgatcacacagatctg

SEQ ID NO: 619462 - DNA, 25 bp, Mus musculus
ggctaggaacagatatcacggtcat

SEQ ID NO: 619463 - DNA, 25 bp, Mus musculus
ggctaggaacagttatcacggtcat

SEQ ID NO: 619464 - DNA, 25 bp, Mus musculus
ggctaggaatgtcactttacactgt

SEQ ID NO: 619465 - DNA, 25 bp, Mus musculus
ggctaggaatgtgactttacactgt

SEQ ID NO: 619466 - DNA, 25 bp, Mus musculus
ggctaggacatcaaattttgctcca

SEQ ID NO: 619467 - DNA, 25 bp, Mus musculus
ggctaggacatctaattttgctcca

SEQ ID NO: 619468 - DNA, 25 bp, Mus musculus
ggctaggacctcattacagagctca

SEQ ID NO: 619469 - DNA, 25 bp, Mus musculus
ggctaggacctctttacagagctca

SEQ ID NO: 619470 - DNA, 25 bp, Mus musculus
ggctaggagtatagattgggtttat

SEQ ID NO: 619471 - DNA, 25 bp, Mus musculus
ggctaggagtattgattgggtttat

SEQ ID NO: 619472 - DNA, 25 bp, Mus musculus
ggctaggatctgacagtggccatca

SEQ ID NO: 619473 - DNA, 25 bp, Mus musculus
ggctaggatctgtcagtggccatca

SEQ ID NO: 619474 - DNA, 25 bp, Mus musculus
ggctaggatgccctgcaatacctaa

SEQ ID NO: 619475 - DNA, 25 bp, Mus musculus
ggctaggatgccgtgcaatacctaa

SEQ ID NO: 619476 - DNA, 25 bp, Mus musculus
ggctaggattacaattcctgtgatg

SEQ ID NO: 619477 - DNA, 25 bp, Mus musculus
ggctaggattactattcctgtgatg

SEQ ID NO: 619478 - DNA, 25 bp, Mus musculus
ggctaggcaaaaccaaattgtcttt

SEQ ID NO: 619479 - DNA, 25 bp, Mus musculus
ggctaggcaaaagcaaattgtcttt

SEQ ID NO: 619480 - DNA, 25 bp, Mus musculus
ggctaggcacacatatcgcacacag

SEQ ID NO: 619481 - DNA, 25 bp, Mus musculus
ggctaggcacacttatcgcacacag

SEQ ID NO: 619482 - DNA, 25 bp, Mus musculus
ggctaggcactgagattggcagctt

SEQ ID NO: 619483 - DNA, 25 bp, Mus musculus
ggctaggcactgtgattggcagctt

SEQ ID NO: 619484 - DNA, 25 bp, Mus musculus
ggctaggcatagaaccattattcat

SEQ ID NO: 619485 - DNA, 25 bp, Mus musculus
ggctaggcatagtaccattattcat

SEQ ID NO: 619486 - DNA, 25 bp, Mus musculus
ggctaggccaggacggagactcttt

SEQ ID NO: 619487 - DNA, 25 bp, Mus musculus
ggctaggccaggtcggagactcttt

SEQ ID NO: 619488 - DNA, 25 bp, Mus musculus
ggctaggcccatagtatgtgagaca

SEQ ID NO: 619489 - DNA, 25 bp, Mus musculus
ggctaggcccattgtatgtgagaca

SEQ ID NO: 619490 - DNA, 25 bp, Mus musculus
ggctaggctatgaatgtttcattgt

SEQ ID NO: 619491 - DNA, 25 bp, Mus musculus
ggctaggctatgtatgtttcattgt

SEQ ID NO: 619492 - DNA, 25 bp, Mus musculus
ggctaggctcaaaggcccaaagaga

SEQ ID NO: 619493 - DNA, 25 bp, Mus musculus
ggctaggctcaatggcccaaagaga

SEQ ID NO: 619494 - DNA, 25 bp, Mus musculus
ggctaggcttccaaatacagtttaa

SEQ ID NO: 619495 - DNA, 25 bp, Mus musculus
ggctaggcttcctaatacagtttaa

SEQ ID NO: 619496 - DNA, 25 bp, Mus musculus
ggctagggaacacccatcagctgga

SEQ ID NO: 619497 - DNA, 25 bp, Mus musculus
ggctagggaacagccatcagctgga

SEQ ID NO: 619498 - DNA, 25 bp, Mus musculus
ggctagggaagtcgctctcttgata

SEQ ID NO: 619499 - DNA, 25 bp, Mus musculus
ggctagggaagtggctctcttgata

SEQ ID NO: 619500 - DNA, 25 bp, Mus musculus
ggctagggcttcagaggacaccgca

SEQ ID NO: 619501 - DNA, 25 bp, Mus musculus
ggctagggcttctgaggacaccgca

SEQ ID NO: 619502 - DNA, 25 bp, Mus musculus
ggctagggtcctctatgattatgat

SEQ ID NO: 619503 - DNA, 25 bp, Mus musculus
ggctagggtcctgtatgattatgat

SEQ ID NO: 619504 - DNA, 25 bp, Mus musculus
ggctaggtagctcagcttgcttaca

SEQ ID NO: 619505 - DNA, 25 bp, Mus musculus
ggctaggtagctgagcttgcttaca

SEQ ID NO: 619506 - DNA, 25 bp, Mus musculus
ggctaggttttcacttggttcaagt

SEQ ID NO: 619507 - DNA, 25 bp, Mus musculus
ggctaggttttctcttggttcaagt

SEQ ID NO: 619508 - DNA, 25 bp, Mus musculus
ggctagtaaccactaggccagatta

SEQ ID NO: 619509 - DNA, 25 bp, Mus musculus
ggctagtaaccagtaggccagatta

SEQ ID NO: 619510 - DNA, 25 bp, Mus musculus
ggctagtaggaactaacaccagtat

SEQ ID NO: 619511 - DNA, 25 bp, Mus musculus
ggctagtaggaagtaacaccagtat

SEQ ID NO: 619512 - DNA, 25 bp, Mus musculus
ggctagtatcctctattgactgtgg

SEQ ID NO: 619513 - DNA, 25 bp, Mus musculus
ggctagtatcctgtattgactgtgg

SEQ ID NO: 619514 - DNA, 25 bp, Mus musculus
ggctagtctacgatttctttctttc

SEQ ID NO: 619515 - DNA, 25 bp, Mus musculus
ggctagtctacgttttctttctttc

SEQ ID NO: 619516 - DNA, 25 bp, Mus musculus
ggctagtcttccacccagatgagaa

SEQ ID NO: 619517 - DNA, 25 bp, Mus musculus
ggctagtcttcctcccagatgagaa

SEQ ID NO: 619518 - DNA, 25 bp, Mus musculus
ggctagtgatgcagagtttgaacaa

SEQ ID NO: 619519 - DNA, 25 bp, Mus musculus
ggctagtgatgctgagtttgaacaa

SEQ ID NO: 619520 - DNA, 25 bp, Mus musculus
ggctagtggcatagaccagtcatct

SEQ ID NO: 619521 - DNA, 25 bp, Mus musculus
ggctagtggcattgaccagtcatct

SEQ ID NO: 619522 - DNA, 25 bp, Mus musculus
ggctagtggtggctcttcctctgct

SEQ ID NO: 619523 - DNA, 25 bp, Mus musculus
ggctagtggtgggtcttcctctgct

SEQ ID NO: 619524 - DNA, 25 bp, Mus musculus
ggctagttagcaatcacgtttgttc

SEQ ID NO: 619525 - DNA, 25 bp, Mus musculus
ggctagttagcattcacgtttgttc

SEQ ID NO: 619526 - DNA, 25 bp, Mus musculus
ggctagttataaatgcattgttgta

SEQ ID NO: 619527 - DNA, 25 bp, Mus musculus
ggctagttataattgcattgttgta

SEQ ID NO: 619528 - DNA, 25 bp, Mus musculus
ggctagttcagaacttatgtcttca

SEQ ID NO: 619529 - DNA, 25 bp, Mus musculus
ggctagttcagatcttatgtcttca

SEQ ID NO: 619530 - DNA, 25 bp, Mus musculus
ggctagttcagcatgcattcattta

SEQ ID NO: 619531 - DNA, 25 bp, Mus musculus
ggctagttcagcttgcattcattta

SEQ ID NO: 619532 - DNA, 25 bp, Mus musculus
ggctagttcatgagctttaaaccaa

SEQ ID NO: 619533 - DNA, 25 bp, Mus musculus
ggctagttcatgtgctttaaaccaa

SEQ ID NO: 619534 - DNA, 25 bp, Mus musculus
ggctagttcctaaagttcttagatg

SEQ ID NO: 619535 - DNA, 25 bp, Mus musculus
ggctagttcctatagttcttagatg

SEQ ID NO: 619536 - DNA, 25 bp, Mus musculus
ggctagttgaccacagaattttatt

SEQ ID NO: 619537 - DNA, 25 bp, Mus musculus
ggctagttgacctcagaattttatt

SEQ ID NO: 619538 - DNA, 25 bp, Mus musculus
ggctagttgctgaatttgccaccaa

SEQ ID NO: 619539 - DNA, 25 bp, Mus musculus
ggctagttgctgtatttgccaccaa

SEQ ID NO: 619540 - DNA, 25 bp, Mus musculus
ggctagttgtgacgaacttccccaa

SEQ ID NO: 619541 - DNA, 25 bp, Mus musculus
ggctagttgtgaggaacttccccaa

SEQ ID NO: 619542 - DNA, 25 bp, Mus musculus
ggctagtttcagactcatggacact

SEQ ID NO: 619543 - DNA, 25 bp, Mus musculus
ggctagtttcagtctcatggacact

SEQ ID NO: 619544 - DNA, 25 bp, Mus musculus
ggctagtttgcaacagctcggaaaa

SEQ ID NO: 619545 - DNA, 25 bp, Mus musculus
ggctagtttgcatcagctcggaaaa

SEQ ID NO: 619546 - DNA, 25 bp, Mus musculus
ggctagtttgtactccacatgtatg

SEQ ID NO: 619547 - DNA, 25 bp, Mus musculus
ggctagtttgtagtccacatgtatg

SEQ ID NO: 619548 - DNA, 25 bp, Mus musculus
ggctataaaacccacagctcttaac

SEQ ID NO: 619549 - DNA, 25 bp, Mus musculus
ggctataaaaccgacagctcttaac

SEQ ID NO: 619550 - DNA, 25 bp, Mus musculus
ggctataaatgcacagaaatttcct

SEQ ID NO: 619551 - DNA, 25 bp, Mus musculus
ggctataaatgctcagaaatttcct

SEQ ID NO: 619552 - DNA, 25 bp, Mus musculus
ggctataaattcacatatcccaaca

SEQ ID NO: 619553 - DNA, 25 bp, Mus musculus
ggctataaattctcatatcccaaca

SEQ ID NO: 619554 - DNA, 25 bp, Mus musculus
ggctataacagcacttcacagaact

SEQ ID NO: 619555 - DNA, 25 bp, Mus musculus
ggctataacagctcttcacagaact

SEQ ID NO: 619556 - DNA, 25 bp, Mus musculus
ggctataagccacagatgcgccttc

SEQ ID NO: 619557 - DNA, 25 bp, Mus musculus
ggctataagccagagatgcgccttc

SEQ ID NO: 619558 - DNA, 25 bp, Mus musculus
ggctataattatacacctttagctt

SEQ ID NO: 619559 - DNA, 25 bp, Mus musculus
ggctataattattcacctttagctt

SEQ ID NO: 619560 - DNA, 25 bp, Mus musculus
ggctataattgaagcagctcccaag

SEQ ID NO: 619561 - DNA, 25 bp, Mus musculus
ggctataattgatgcagctcccaag

SEQ ID NO: 619562 - DNA, 25 bp, Mus musculus
ggctataatttactgtccactgcat

SEQ ID NO: 619563 - DNA, 25 bp, Mus musculus
ggctataatttagtgtccactgcat

SEQ ID NO: 619564 - DNA, 25 bp, Mus musculus
ggctataatttgctgctaagactca

SEQ ID NO: 619565 - DNA, 25 bp, Mus musculus
ggctataatttggtgctaagactca

SEQ ID NO: 619566 - DNA, 25 bp, Mus musculus
ggctatacagacaatcaaggcagag

SEQ ID NO: 619567 - DNA, 25 bp, Mus musculus
ggctatacagactatcaaggcagag

SEQ ID NO: 619568 - DNA, 25 bp, Mus musculus
ggctatacatatacctcattcacaa

SEQ ID NO: 619569 - DNA, 25 bp, Mus musculus
ggctatacatattcctcattcacaa

SEQ ID NO: 619570 - DNA, 25 bp, Mus musculus
ggctatacatgaaccttggagtata

SEQ ID NO: 619571 - DNA, 25 bp, Mus musculus
ggctatacatgatccttggagtata

SEQ ID NO: 619572 - DNA, 25 bp, Mus musculus
ggctataccaacattatgcgggtgc

SEQ ID NO: 619573 - DNA, 25 bp, Mus musculus
ggctataccaactttatgcgggtgc

SEQ ID NO: 619574 - DNA, 25 bp, Mus musculus
ggctatacccttatattctaagtgg

SEQ ID NO: 619575 - DNA, 25 bp, Mus musculus
ggctatacccttttattctaagtgg

SEQ ID NO: 619576 - DNA, 25 bp, Mus musculus
ggctatacggtcatcagggtcaaca

SEQ ID NO: 619577 - DNA, 25 bp, Mus musculus
ggctatacggtcttcagggtcaaca

SEQ ID NO: 619578 - DNA, 25 bp, Mus musculus
ggctatactctgatgctgagacttg

SEQ ID NO: 619579 - DNA, 25 bp, Mus musculus
ggctatactctgttgctgagacttg

SEQ ID NO: 619580 - DNA, 25 bp, Mus musculus
ggctatactgccacagacttgaact

SEQ ID NO: 619581 - DNA, 25 bp, Mus musculus
ggctatactgcctcagacttgaact

SEQ ID NO: 619582 - DNA, 25 bp, Mus musculus
ggctatacttctactcttgcttgtc

SEQ ID NO: 619583 - DNA, 25 bp, Mus musculus
ggctatacttcttctcttgcttgtc

SEQ ID NO: 619584 - DNA, 25 bp, Mus musculus
ggctatagactaaaagtttcctgga

SEQ ID NO: 619585 - DNA, 25 bp, Mus musculus
ggctatagactaatccgctggcagg

SEQ ID NO: 619586 - DNA, 25 bp, Mus musculus
ggctatagactataagtttcctgga

SEQ ID NO: 619587 - DNA, 25 bp, Mus musculus
ggctatagactattccgctggcagg

SEQ ID NO: 619588 - DNA, 25 bp, Mus musculus
ggctatagatctaccatttgttcag

SEQ ID NO: 619589 - DNA, 25 bp, Mus musculus
ggctatagatcttccatttgttcag

SEQ ID NO: 619590 - DNA, 25 bp, Mus musculus
ggctatagcccaagggccactgaaa

SEQ ID NO: 619591 - DNA, 25 bp, Mus musculus
ggctatagcccatgggccactgaaa

SEQ ID NO: 619592 - DNA, 25 bp, Mus musculus
ggctatagtagtctgtcttggtcat

SEQ ID NO: 619593 - DNA, 25 bp, Mus musculus
ggctatagtagtgtgtcttggtcat

SEQ ID NO: 619594 - DNA, 25 bp, Mus musculus
ggctatagtcagagttgtaggtcat

SEQ ID NO: 619595 - DNA, 25 bp, Mus musculus
ggctatagtcagtgttgtaggtcat

SEQ ID NO: 619596 - DNA, 25 bp, Mus musculus
ggctatatatagattgcatccatgt

SEQ ID NO: 619597 - DNA, 25 bp, Mus musculus
ggctatatatagtttgcatccatgt

SEQ ID NO: 619598 - DNA, 25 bp, Mus musculus
ggctatatccagatgctataagcac

SEQ ID NO: 619599 - DNA, 25 bp, Mus musculus
ggctatatccagttgctataagcac

SEQ ID NO: 619600 - DNA, 25 bp, Mus musculus
ggctatatcctgagattctggccag

SEQ ID NO: 619601 - DNA, 25 bp, Mus musculus
ggctatatcctgtgattctggccag

SEQ ID NO: 619602 - DNA, 25 bp, Mus musculus
ggctatatctaaccccgtctgcaca

SEQ ID NO: 619603 - DNA, 25 bp, Mus musculus
ggctatatctaagcccgtctgcaca

SEQ ID NO: 619604 - DNA, 25 bp, Mus musculus
ggctatatctccaacatactgctat

SEQ ID NO: 619605 - DNA, 25 bp, Mus musculus
ggctatatctcctacatactgctat

SEQ ID NO: 619606 - DNA, 25 bp, Mus musculus
ggctatatgagacccgcctccaaaa

SEQ ID NO: 619607 - DNA, 25 bp, Mus musculus
ggctatatgagagccgcctccaaaa

SEQ ID NO: 619608 - DNA, 25 bp, Mus musculus
ggctatatgctgcttagggaattca

SEQ ID NO: 619609 - DNA, 25 bp, Mus musculus
ggctatatgctggttagggaattca

SEQ ID NO: 619610 - DNA, 25 bp, Mus musculus
ggctatatggctatactgtggaact

SEQ ID NO: 619611 - DNA, 25 bp, Mus musculus
ggctatatggctttactgtggaact

SEQ ID NO: 619612 - DNA, 25 bp, Mus musculus
ggctatattacacatatctccacag

SEQ ID NO: 619613 - DNA, 25 bp, Mus musculus
ggctatattacagatatctccacag

SEQ ID NO: 619614 - DNA, 25 bp, Mus musculus
ggctatcaaactagggtccctcatg

SEQ ID NO: 619615 - DNA, 25 bp, Mus musculus
ggctatcaaacttgggtccctcatg

SEQ ID NO: 619616 - DNA, 25 bp, Mus musculus
ggctatcaagaactcgggtcatcca

SEQ ID NO: 619617 - DNA, 25 bp, Mus musculus
ggctatcaagaagtcgggtcatcca

SEQ ID NO: 619618 - DNA, 25 bp, Mus musculus
ggctatcaagccctgcttagcatgg

SEQ ID NO: 619619 - DNA, 25 bp, Mus musculus
ggctatcaagccgtgcttagcatgg

SEQ ID NO: 619620 - DNA, 25 bp, Mus musculus
ggctatcaagcgagactttgggtct

SEQ ID NO: 619621 - DNA, 25 bp, Mus musculus
ggctatcaagcgtgactttgggtct

SEQ ID NO: 619622 - DNA, 25 bp, Mus musculus
ggctatcaaggcagggccctagcat

SEQ ID NO: 619623 - DNA, 25 bp, Mus musculus
ggctatcaaggctgggccctagcat

SEQ ID NO: 619624 - DNA, 25 bp, Mus musculus
ggctatcaatgaaagacctgtgctg

SEQ ID NO: 619625 - DNA, 25 bp, Mus musculus
ggctatcaatgatagacctgtgctg

SEQ ID NO: 619626 - DNA, 25 bp, Mus musculus
ggctatcaattacatggttgtccta

SEQ ID NO: 619627 - DNA, 25 bp, Mus musculus
ggctatcaattagatggttgtccta

SEQ ID NO: 619628 - DNA, 25 bp, Mus musculus
ggctatcaccatatcttaactgcat

SEQ ID NO: 619629 - DNA, 25 bp, Mus musculus
ggctatcaccatttcttaactgcat

SEQ ID NO: 619630 - DNA, 25 bp, Mus musculus
ggctatcacgccaattattgtgagg

SEQ ID NO: 619631 - DNA, 25 bp, Mus musculus
ggctatcacgcctattattgtgagg

SEQ ID NO: 619632 - DNA, 25 bp, Mus musculus
ggctatcactgcactttgggactca

SEQ ID NO: 619633 - DNA, 25 bp, Mus musculus
ggctatcactgcaggcagcaagtga

SEQ ID NO: 619634 - DNA, 25 bp, Mus musculus
ggctatcactgctctttgggactca

SEQ ID NO: 619635 - DNA, 25 bp, Mus musculus
ggctatcactgctggcagcaagtga

SEQ ID NO: 619636 - DNA, 25 bp, Mus musculus
ggctatcactgtcaaaattacctac

SEQ ID NO: 619637 - DNA, 25 bp, Mus musculus
ggctatcactgtgaaaattacctac

SEQ ID NO: 619638 - DNA, 25 bp, Mus musculus
ggctatcagagacacccaaggaaga

SEQ ID NO: 619639 - DNA, 25 bp, Mus musculus
ggctatcagagagacccaaggaaga

SEQ ID NO: 619640 - DNA, 25 bp, Mus musculus
ggctatcaggccatcgtctgctggg

SEQ ID NO: 619641 - DNA, 25 bp, Mus musculus
ggctatcaggccttcgtctgctggg

SEQ ID NO: 619642 - DNA, 25 bp, Mus musculus
ggctatcagggcagccaaggaagca

SEQ ID NO: 619643 - DNA, 25 bp, Mus musculus
ggctatcagggctgccaaggaagca

SEQ ID NO: 619644 - DNA, 25 bp, Mus musculus
ggctatcatcacagctatactttac

SEQ ID NO: 619645 - DNA, 25 bp, Mus musculus
ggctatcatcactgctatactttac

SEQ ID NO: 619646 - DNA, 25 bp, Mus musculus
ggctatcatctacatttttactctc

SEQ ID NO: 619647 - DNA, 25 bp, Mus musculus
ggctatcatctagatttttactctc

SEQ ID NO: 619648 - DNA, 25 bp, Mus musculus
ggctatccagagatacgtgcagctc

SEQ ID NO: 619649 - DNA, 25 bp, Mus musculus
ggctatccagagttacgtgcagctc

SEQ ID NO: 619650 - DNA, 25 bp, Mus musculus
ggctatccagccaaatcttaatgta

SEQ ID NO: 619651 - DNA, 25 bp, Mus musculus
ggctatccagcctaatcttaatgta

SEQ ID NO: 619652 - DNA, 25 bp, Mus musculus
ggctatccataacaacctttgggtg

SEQ ID NO: 619653 - DNA, 25 bp, Mus musculus
ggctatccataagaacctttgggtg

SEQ ID NO: 619654 - DNA, 25 bp, Mus musculus
ggctatcccagaattgacccttggg

SEQ ID NO: 619655 - DNA, 25 bp, Mus musculus
ggctatcccagatttgacccttggg

SEQ ID NO: 619656 - DNA, 25 bp, Mus musculus
ggctatccctttacatggtggattt

SEQ ID NO: 619657 - DNA, 25 bp, Mus musculus
ggctatcccttttcatggtggattt

SEQ ID NO: 619658 - DNA, 25 bp, Mus musculus
ggctatccggatcccaatggtcaca

SEQ ID NO: 619659 - DNA, 25 bp, Mus musculus
ggctatccggatgccaatggtcaca

SEQ ID NO: 619660 - DNA, 25 bp, Mus musculus
ggctatcctctgagaggcccaacaa

SEQ ID NO: 619661 - DNA, 25 bp, Mus musculus
ggctatcctctgtgaggcccaacaa

SEQ ID NO: 619662 - DNA, 25 bp, Mus musculus
ggctatcctgagctatgagactcta

SEQ ID NO: 619663 - DNA, 25 bp, Mus musculus
ggctatcctgaggtatgagactcta

SEQ ID NO: 619664 - DNA, 25 bp, Mus musculus
ggctatcctttcatatatctacacg

SEQ ID NO: 619665 - DNA, 25 bp, Mus musculus
ggctatcctttcttatatctacacg

SEQ ID NO: 619666 - DNA, 25 bp, Mus musculus
ggctatcgaaaacacatgaccatgt

SEQ ID NO: 619667 - DNA, 25 bp, Mus musculus
ggctatcgaaaagacatgaccatgt

SEQ ID NO: 619668 - DNA, 25 bp, Mus musculus
ggctatcgggctctctgtgactgat

SEQ ID NO: 619669 - DNA, 25 bp, Mus musculus
ggctatcgggctgtctgtgactgat

SEQ ID NO: 619670 - DNA, 25 bp, Mus musculus
ggctatctactgcttatgattgggt

SEQ ID NO: 619671 - DNA, 25 bp, Mus musculus
ggctatctactggttatgattgggt

SEQ ID NO: 619672 - DNA, 25 bp, Mus musculus
ggctatctgacgcaactgctgctaa

SEQ ID NO: 619673 - DNA, 25 bp, Mus musculus
ggctatctgacggaactgctgctaa

SEQ ID NO: 619674 - DNA, 25 bp, Mus musculus
ggctatctggcaaatggtttctcat

SEQ ID NO: 619675 - DNA, 25 bp, Mus musculus
ggctatctggcatatggtttctcat

SEQ ID NO: 619676 - DNA, 25 bp, Mus musculus
ggctatctggctaatgacagactct

SEQ ID NO: 619677 - DNA, 25 bp, Mus musculus
ggctatctggcttatgacagactct

SEQ ID NO: 619678 - DNA, 25 bp, Mus musculus
ggctatcttcatcaacccgtggtgc

SEQ ID NO: 619679 - DNA, 25 bp, Mus musculus
ggctatcttcatgaacccgtggtgc

SEQ ID NO: 619680 - DNA, 25 bp, Mus musculus
ggctatctttggacatattctctgc

SEQ ID NO: 619681 - DNA, 25 bp, Mus musculus
ggctatctttggtcatattctctgc

SEQ ID NO: 619682 - DNA, 25 bp, Mus musculus
ggctatctttgtactattaaattgt

SEQ ID NO: 619683 - DNA, 25 bp, Mus musculus
ggctatctttgtactgtgctgattt

SEQ ID NO: 619684 - DNA, 25 bp, Mus musculus
ggctatctttgttctattaaattgt

SEQ ID NO: 619685 - DNA, 25 bp, Mus musculus
ggctatctttgttctgtgctgattt

SEQ ID NO: 619686 - DNA, 25 bp, Mus musculus
ggctatgaacccaacagaggtggat

SEQ ID NO: 619687 - DNA, 25 bp, Mus musculus
ggctatgaacccaatgaagacggca

SEQ ID NO: 619688 - DNA, 25 bp, Mus musculus
ggctatgaaccctacagaggtggat

SEQ ID NO: 619689 - DNA, 25 bp, Mus musculus
ggctatgaaccctatgaagacggca

SEQ ID NO: 619690 - DNA, 25 bp, Mus musculus
ggctatgaacgtccagccataccat

SEQ ID NO: 619691 - DNA, 25 bp, Mus musculus
ggctatgaacgtgcagccataccat

SEQ ID NO: 619692 - DNA, 25 bp, Mus musculus
ggctatgaagcacaatgctctactt

SEQ ID NO: 619693 - DNA, 25 bp, Mus musculus
ggctatgaagcagaatgctctactt

SEQ ID NO: 619694 - DNA, 25 bp, Mus musculus
ggctatgacacacactgatccctct

SEQ ID NO: 619695 - DNA, 25 bp, Mus musculus
ggctatgacacagactgatccctct

SEQ ID NO: 619696 - DNA, 25 bp, Mus musculus
ggctatgacatcctcattgaccagg

SEQ ID NO: 619697 - DNA, 25 bp, Mus musculus
ggctatgacatcgtcattgaccagg

SEQ ID NO: 619698 - DNA, 25 bp, Mus musculus
ggctatgacatgcatcaggttactg

SEQ ID NO: 619699 - DNA, 25 bp, Mus musculus
ggctatgacatggatcaggttactg

SEQ ID NO: 619700 - DNA, 25 bp, Mus musculus
ggctatgaccgcaactcaggaggaa

SEQ ID NO: 619701 - DNA, 25 bp, Mus musculus
ggctatgaccgctactcaggaggaa

SEQ ID NO: 619702 - DNA, 25 bp, Mus musculus
ggctatgacttaatggtgcggtcca

SEQ ID NO: 619703 - DNA, 25 bp, Mus musculus
ggctatgacttattggtgcggtcca

SEQ ID NO: 619704 - DNA, 25 bp, Mus musculus
ggctatgagcaaccatgtaggttct

SEQ ID NO: 619705 - DNA, 25 bp, Mus musculus
ggctatgagcaacgtcttccaggag

SEQ ID NO: 619706 - DNA, 25 bp, Mus musculus
ggctatgagcaagcatgtaggttct

SEQ ID NO: 619707 - DNA, 25 bp, Mus musculus
ggctatgagcaaggtcttccaggag

SEQ ID NO: 619708 - DNA, 25 bp, Mus musculus
ggctatgagcaccacgagacatttt

SEQ ID NO: 619709 - DNA, 25 bp, Mus musculus
ggctatgagcacgacgagacatttt

SEQ ID NO: 619710 - DNA, 25 bp, Mus musculus
ggctatgagggtcatgtattccacc

SEQ ID NO: 619711 - DNA, 25 bp, Mus musculus
ggctatgagggtgatgtattccacc

SEQ ID NO: 619712 - DNA, 25 bp, Mus musculus
ggctatgagtgtaatttggctggta

SEQ ID NO: 619713 - DNA, 25 bp, Mus musculus
ggctatgagtgttatttggctggta

SEQ ID NO: 619714 - DNA, 25 bp, Mus musculus
ggctatgagttcattgccaagagac

SEQ ID NO: 619715 - DNA, 25 bp, Mus musculus
ggctatgagttctttgccaagagac

SEQ ID NO: 619716 - DNA, 25 bp, Mus musculus
ggctatgataatacatcctggcttt

SEQ ID NO: 619717 - DNA, 25 bp, Mus musculus
ggctatgataattcatcctggcttt

SEQ ID NO: 619718 - DNA, 25 bp, Mus musculus
ggctatgcaaacaaccccgaaggaa

SEQ ID NO: 619719 - DNA, 25 bp, Mus musculus
ggctatgcaaactaccccgaaggaa

SEQ ID NO: 619720 - DNA, 25 bp, Mus musculus
ggctatgcacaactagaccttctcg

SEQ ID NO: 619721 - DNA, 25 bp, Mus musculus
ggctatgcacaagtagaccttctcg

SEQ ID NO: 619722 - DNA, 25 bp, Mus musculus
ggctatgcacacaggtagaagatat

SEQ ID NO: 619723 - DNA, 25 bp, Mus musculus
ggctatgcacactggtagaagatat

SEQ ID NO: 619724 - DNA, 25 bp, Mus musculus
ggctatgccacaaggtataccatca

SEQ ID NO: 619725 - DNA, 25 bp, Mus musculus
ggctatgccacatggtataccatca

SEQ ID NO: 619726 - DNA, 25 bp, Mus musculus
ggctatgccgatcctgcccactgga

SEQ ID NO: 619727 - DNA, 25 bp, Mus musculus
ggctatgccgatgctgcccactgga

SEQ ID NO: 619728 - DNA, 25 bp, Mus musculus
ggctatgcgcccataatggagacag

SEQ ID NO: 619729 - DNA, 25 bp, Mus musculus
ggctatgcgcccttaatggagacag

SEQ ID NO: 619730 - DNA, 25 bp, Mus musculus
ggctatgctacccaagagtctggaa

SEQ ID NO: 619731 - DNA, 25 bp, Mus musculus
ggctatgctaccgaagagtctggaa

SEQ ID NO: 619732 - DNA, 25 bp, Mus musculus
ggctatgctgcaaccaggtcttgat

SEQ ID NO: 619733 - DNA, 25 bp, Mus musculus
ggctatgctgcatccaggtcttgat

SEQ ID NO: 619734 - DNA, 25 bp, Mus musculus
ggctatgctggtctctatttctgga

SEQ ID NO: 619735 - DNA, 25 bp, Mus musculus
ggctatgctggtgtctatttctgga

SEQ ID NO: 619736 - DNA, 25 bp, Mus musculus
ggctatgcttccattgatgacatat

SEQ ID NO: 619737 - DNA, 25 bp, Mus musculus
ggctatgcttcctttgatgacatat

SEQ ID NO: 619738 - DNA, 25 bp, Mus musculus
ggctatggaggcatcagctctggct

SEQ ID NO: 619739 - DNA, 25 bp, Mus musculus
ggctatggaggcttcagctctggct

SEQ ID NO: 619740 - DNA, 25 bp, Mus musculus
ggctatggcaacaggccagaccaca

SEQ ID NO: 619741 - DNA, 25 bp, Mus musculus
ggctatggcaactggccagaccaca

SEQ ID NO: 619742 - DNA, 25 bp, Mus musculus
ggctatggcctccaacctaggtgct

SEQ ID NO: 619743 - DNA, 25 bp, Mus musculus
ggctatggcctcgaacctaggtgct

SEQ ID NO: 619744 - DNA, 25 bp, Mus musculus
ggctatggctataggctaagtggct

SEQ ID NO: 619745 - DNA, 25 bp, Mus musculus
ggctatggctattggctaagtggct

SEQ ID NO: 619746 - DNA, 25 bp, Mus musculus
ggctatggctctagaagctgctacc

SEQ ID NO: 619747 - DNA, 25 bp, Mus musculus
ggctatggctcttgaagctgctacc

SEQ ID NO: 619748 - DNA, 25 bp, Mus musculus
ggctatggctgcaggagctgttcat

SEQ ID NO: 619749 - DNA, 25 bp, Mus musculus
ggctatggctgctggagctgttcat

SEQ ID NO: 619750 - DNA, 25 bp, Mus musculus
ggctatggtaaaagctacaatgttc

SEQ ID NO: 619751 - DNA, 25 bp, Mus musculus
ggctatggtaaatgctacaatgttc

SEQ ID NO: 619752 - DNA, 25 bp, Mus musculus
ggctatggtgctcctgactcactgt

SEQ ID NO: 619753 - DNA, 25 bp, Mus musculus
ggctatggtgctgctgactcactgt

SEQ ID NO: 619754 - DNA, 25 bp, Mus musculus
ggctatgtacagagtgcaaatgttt

SEQ ID NO: 619755 - DNA, 25 bp, Mus musculus
ggctatgtacagtgtgcaaatgttt

SEQ ID NO: 619756 - DNA, 25 bp, Mus musculus
ggctatgtagcccaaattctcaatc

SEQ ID NO: 619757 - DNA, 25 bp, Mus musculus
ggctatgtagccgaaattctcaatc

SEQ ID NO: 619758 - DNA, 25 bp, Mus musculus
ggctatgtagtaagcatccgtgaca

SEQ ID NO: 619759 - DNA, 25 bp, Mus musculus
ggctatgtagtatgcatccgtgaca

SEQ ID NO: 619760 - DNA, 25 bp, Mus musculus
ggctatgtattcagttttcatggaa

SEQ ID NO: 619761 - DNA, 25 bp, Mus musculus
ggctatgtattctgttttcatggaa

SEQ ID NO: 619762 - DNA, 25 bp, Mus musculus
ggctatgtcacgcatctgatgaagc

SEQ ID NO: 619763 - DNA, 25 bp, Mus musculus
ggctatgtcacggatctgatgaagc

SEQ ID NO: 619764 - DNA, 25 bp, Mus musculus
ggctatgtccaaactgggtcttcga

SEQ ID NO: 619765 - DNA, 25 bp, Mus musculus
ggctatgtccaatctgggtcttcga

SEQ ID NO: 619766 - DNA, 25 bp, Mus musculus
ggctatgtccttactgtgtggagca

SEQ ID NO: 619767 - DNA, 25 bp, Mus musculus
ggctatgtcctttctgtgtggagca

SEQ ID NO: 619768 - DNA, 25 bp, Mus musculus
ggctatgtgactcattggcatttaa

SEQ ID NO: 619769 - DNA, 25 bp, Mus musculus
ggctatgtgactgattggcatttaa

SEQ ID NO: 619770 - DNA, 25 bp, Mus musculus
ggctatgtgccccagttgtgaaaaa

SEQ ID NO: 619771 - DNA, 25 bp, Mus musculus
ggctatgtgcccgagttgtgaaaaa

SEQ ID NO: 619772 - DNA, 25 bp, Mus musculus
ggctatgtgcttcacctggttacta

SEQ ID NO: 619773 - DNA, 25 bp, Mus musculus
ggctatgtgcttgacctggttacta

SEQ ID NO: 619774 - DNA, 25 bp, Mus musculus
ggctatgttagcaacaatagtcatt

SEQ ID NO: 619775 - DNA, 25 bp, Mus musculus
ggctatgttagctacaatagtcatt

SEQ ID NO: 619776 - DNA, 25 bp, Mus musculus
ggctattaagcaatcatttacccag

SEQ ID NO: 619777 - DNA, 25 bp, Mus musculus
ggctattaagcattcatttacccag

SEQ ID NO: 619778 - DNA, 25 bp, Mus musculus
ggctattaagcccttttatcagaat

SEQ ID NO: 619779 - DNA, 25 bp, Mus musculus
ggctattaagccgttttatcagaat

SEQ ID NO: 619780 - DNA, 25 bp, Mus musculus
ggctattacacaccatggccagcac

SEQ ID NO: 619781 - DNA, 25 bp, Mus musculus
ggctattacacagcatggccagcac

SEQ ID NO: 619782 - DNA, 25 bp, Mus musculus
ggctattaccctcgacaactggcaa

SEQ ID NO: 619783 - DNA, 25 bp, Mus musculus
ggctattaccctggacaactggcaa

SEQ ID NO: 619784 - DNA, 25 bp, Mus musculus
ggctattacgttcaatcccaagact

SEQ ID NO: 619785 - DNA, 25 bp, Mus musculus
ggctattacgttgaatcccaagact

SEQ ID NO: 619786 - DNA, 25 bp, Mus musculus
ggctattaggttccttcacgttcac

SEQ ID NO: 619787 - DNA, 25 bp, Mus musculus
ggctattaggttgcttcacgttcac

SEQ ID NO: 619788 - DNA, 25 bp, Mus musculus
ggctattataaacaaattgccctaa

SEQ ID NO: 619789 - DNA, 25 bp, Mus musculus
ggctattataaagaaattgccctaa

SEQ ID NO: 619790 - DNA, 25 bp, Mus musculus
ggctattattgacttcctttactta

SEQ ID NO: 619791 - DNA, 25 bp, Mus musculus
ggctattattgagttcctttactta

SEQ ID NO: 619792 - DNA, 25 bp, Mus musculus
ggctattattttagctccttgttta

SEQ ID NO: 619793 - DNA, 25 bp, Mus musculus
ggctattatttttgctccttgttta

SEQ ID NO: 619794 - DNA, 25 bp, Mus musculus
ggctattcaaagcacctgagacttc

SEQ ID NO: 619795 - DNA, 25 bp, Mus musculus
ggctattcaaaggacctgagacttc

SEQ ID NO: 619796 - DNA, 25 bp, Mus musculus
ggctattcacgcaacacgtcagaga

SEQ ID NO: 619797 - DNA, 25 bp, Mus musculus
ggctattcacgctacacgtcagaga

SEQ ID NO: 619798 - DNA, 25 bp, Mus musculus
ggctattcataaatactaccagagg

SEQ ID NO: 619799 - DNA, 25 bp, Mus musculus
ggctattcataattactaccagagg

SEQ ID NO: 619800 - DNA, 25 bp, Mus musculus
ggctattccccaagtacatcaacaa

SEQ ID NO: 619801 - DNA, 25 bp, Mus musculus
ggctattccccatgtacatcaacaa

SEQ ID NO: 619802 - DNA, 25 bp, Mus musculus
ggctattccctgactggaatccatt

SEQ ID NO: 619803 - DNA, 25 bp, Mus musculus
ggctattccctgtctggaatccatt

SEQ ID NO: 619804 - DNA, 25 bp, Mus musculus
ggctattcctggaatctttcaaagg

SEQ ID NO: 619805 - DNA, 25 bp, Mus musculus
ggctattcctggtatctttcaaagg

SEQ ID NO: 619806 - DNA, 25 bp, Mus musculus
ggctattcgaaacgcagatacggta

SEQ ID NO: 619807 - DNA, 25 bp, Mus musculus
ggctattcgaaaggcagatacggta

SEQ ID NO: 619808 - DNA, 25 bp, Mus musculus
ggctattctattatcacacgtgagt

SEQ ID NO: 619809 - DNA, 25 bp, Mus musculus
ggctattctattttcacacgtgagt

SEQ ID NO: 619810 - DNA, 25 bp, Mus musculus
ggctattctcttctttcctgttatt

SEQ ID NO: 619811 - DNA, 25 bp, Mus musculus
ggctattctcttgtttcctgttatt

SEQ ID NO: 619812 - DNA, 25 bp, Mus musculus
ggctattctgaacttgggtgcctca

SEQ ID NO: 619813 - DNA, 25 bp, Mus musculus
ggctattctgaagttgggtgcctca

SEQ ID NO: 619814 - DNA, 25 bp, Mus musculus
ggctattctgccctcagtatgacat

SEQ ID NO: 619815 - DNA, 25 bp, Mus musculus
ggctattctgccgtcagtatgacat

SEQ ID NO: 619816 - DNA, 25 bp, Mus musculus
ggctattctgtcacattactgtcca

SEQ ID NO: 619817 - DNA, 25 bp, Mus musculus
ggctattctgtctcattactgtcca

SEQ ID NO: 619818 - DNA, 25 bp, Mus musculus
ggctattgatgaagactgtaaccag

SEQ ID NO: 619819 - DNA, 25 bp, Mus musculus
ggctattgatgatgactgtaaccag

SEQ ID NO: 619820 - DNA, 25 bp, Mus musculus
ggctattgcaaccatcaagacaaag

SEQ ID NO: 619821 - DNA, 25 bp, Mus musculus
ggctattgcaacgatcaagacaaag

SEQ ID NO: 619822 - DNA, 25 bp, Mus musculus
ggctattgcaagatggaatcctttc

SEQ ID NO: 619823 - DNA, 25 bp, Mus musculus
ggctattgcaagttggaatcctttc

SEQ ID NO: 619824 - DNA, 25 bp, Mus musculus
ggctattgctttcttatggattcat

SEQ ID NO: 619825 - DNA, 25 bp, Mus musculus
ggctattgctttgttatggattcat

SEQ ID NO: 619826 - DNA, 25 bp, Mus musculus
ggctattggaaacccttagctagat

SEQ ID NO: 619827 - DNA, 25 bp, Mus musculus
ggctattggaaagccttagctagat

SEQ ID NO: 619828 - DNA, 25 bp, Mus musculus
ggctattggctgacaaagccccttc

SEQ ID NO: 619829 - DNA, 25 bp, Mus musculus
ggctattggctgtcaaagccccttc

SEQ ID NO: 619830 - DNA, 25 bp, Mus musculus
ggctattggcttctcgggcctgaac

SEQ ID NO: 619831 - DNA, 25 bp, Mus musculus
ggctattggcttgtcgggcctgaac

SEQ ID NO: 619832 - DNA, 25 bp, Mus musculus
ggctattgtattacttgggtcctaa

SEQ ID NO: 619833 - DNA, 25 bp, Mus musculus
ggctattgtatttcttgggtcctaa

SEQ ID NO: 619834 - DNA, 25 bp, Mus musculus
ggctattgtggcatatacagacccc

SEQ ID NO: 619835 - DNA, 25 bp, Mus musculus
ggctattgtggcttatacagacccc

SEQ ID NO: 619836 - DNA, 25 bp, Mus musculus
ggctattgttgtcgtgtccagataa

SEQ ID NO: 619837 - DNA, 25 bp, Mus musculus
ggctattgttgtggtgtccagataa

SEQ ID NO: 619838 - DNA, 25 bp, Mus musculus
ggctatttaaaacctggcgctgtta

SEQ ID NO: 619839 - DNA, 25 bp, Mus musculus
ggctatttaaaagctggcgctgtta

SEQ ID NO: 619840 - DNA, 25 bp, Mus musculus
ggctatttaaagctctggtaaccga

SEQ ID NO: 619841 - DNA, 25 bp, Mus musculus
ggctatttaaaggtctggtaaccga

SEQ ID NO: 619842 - DNA, 25 bp, Mus musculus
ggctatttaacaatctgggatcctg

SEQ ID NO: 619843 - DNA, 25 bp, Mus musculus
ggctatttaacattctgggatcctg

SEQ ID NO: 619844 - DNA, 25 bp, Mus musculus
ggctatttacttaatcctttgaggc

SEQ ID NO: 619845 - DNA, 25 bp, Mus musculus
ggctatttactttatcctttgaggc

SEQ ID NO: 619846 - DNA, 25 bp, Mus musculus
ggctatttagtaagctttcctttct

SEQ ID NO: 619847 - DNA, 25 bp, Mus musculus
ggctatttagtatgctttcctttct

SEQ ID NO: 619848 - DNA, 25 bp, Mus musculus
ggctatttccagcttgtcttgagaa

SEQ ID NO: 619849 - DNA, 25 bp, Mus musculus
ggctatttccaggttgtcttgagaa

SEQ ID NO: 619850 - DNA, 25 bp, Mus musculus
ggctatttccataagacgtgcacag

SEQ ID NO: 619851 - DNA, 25 bp, Mus musculus
ggctatttccattagacgtgcacag

SEQ ID NO: 619852 - DNA, 25 bp, Mus musculus
ggctatttccctcttttatgtacta

SEQ ID NO: 619853 - DNA, 25 bp, Mus musculus
ggctatttccctgttttatgtacta

SEQ ID NO: 619854 - DNA, 25 bp, Mus musculus
ggctatttcctcagaggtagcagtt

SEQ ID NO: 619855 - DNA, 25 bp, Mus musculus
ggctatttcctctgaggtagcagtt

SEQ ID NO: 619856 - DNA, 25 bp, Mus musculus
ggctatttctgtcccttccactgtt

SEQ ID NO: 619857 - DNA, 25 bp, Mus musculus
ggctatttctgtgccttccactgtt

SEQ ID NO: 619858 - DNA, 25 bp, Mus musculus
ggctatttgctcaactggcatcttt

SEQ ID NO: 619859 - DNA, 25 bp, Mus musculus
ggctatttgctctactggcatcttt

SEQ ID NO: 619860 - DNA, 25 bp, Mus musculus
ggctatttggagaattgctatatct

SEQ ID NO: 619861 - DNA, 25 bp, Mus musculus
ggctatttggagtattgctatatct

SEQ ID NO: 619862 - DNA, 25 bp, Mus musculus
ggctatttgggtatccattgtcaat

SEQ ID NO: 619863 - DNA, 25 bp, Mus musculus
ggctatttgggtttccattgtcaat

SEQ ID NO: 619864 - DNA, 25 bp, Mus musculus
ggctatttgtacctttttgtaactg

SEQ ID NO: 619865 - DNA, 25 bp, Mus musculus
ggctatttgtacgtttttgtaactg

SEQ ID NO: 619866 - DNA, 25 bp, Mus musculus
ggctatttgtccatcattttattta

SEQ ID NO: 619867 - DNA, 25 bp, Mus musculus
ggctatttgtccttcattttattta

SEQ ID NO: 619868 - DNA, 25 bp, Mus musculus
ggctatttgttaagggctctcctga

SEQ ID NO: 619869 - DNA, 25 bp, Mus musculus
ggctatttgttatgggctctcctga

SEQ ID NO: 619870 - DNA, 25 bp, Mus musculus
ggctattttaggattcttcgaggag

SEQ ID NO: 619871 - DNA, 25 bp, Mus musculus
ggctattttaggtttcttcgaggag

SEQ ID NO: 619872 - DNA, 25 bp, Mus musculus
ggctattttagtcacatatgttcta

SEQ ID NO: 619873 - DNA, 25 bp, Mus musculus
ggctattttagtgacatatgttcta

SEQ ID NO: 619874 - DNA, 25 bp, Mus musculus
ggctattttccaacgacttagtttt

SEQ ID NO: 619875 - DNA, 25 bp, Mus musculus
ggctattttccatcgacttagtttt

SEQ ID NO: 619876 - DNA, 25 bp, Mus musculus
ggctattttgtaatccatcatctat

SEQ ID NO: 619877 - DNA, 25 bp, Mus musculus
ggctattttgtattccatcatctat

SEQ ID NO: 619878 - DNA, 25 bp, Mus musculus
ggctattttgtcctgaatcttaccc

SEQ ID NO: 619879 - DNA, 25 bp, Mus musculus
ggctattttgtcgtgaatcttaccc

SEQ ID NO: 619880 - DNA, 25 bp, Mus musculus
ggctcaaaagtaaccagggttcata

SEQ ID NO: 619881 - DNA, 25 bp, Mus musculus
ggctcaaaagtatccagggttcata

SEQ ID NO: 619882 - DNA, 25 bp, Mus musculus
ggctcaaacagccaccctgatgaga

SEQ ID NO: 619883 - DNA, 25 bp, Mus musculus
ggctcaaacagcgaccctgatgaga

SEQ ID NO: 619884 - DNA, 25 bp, Mus musculus
ggctcaaacttaagggtactgtctt

SEQ ID NO: 619885 - DNA, 25 bp, Mus musculus
ggctcaaacttatgggtactgtctt

SEQ ID NO: 619886 - DNA, 25 bp, Mus musculus
ggctcaaagcctaacacagaagcag

SEQ ID NO: 619887 - DNA, 25 bp, Mus musculus
ggctcaaagccttacacagaagcag

SEQ ID NO: 619888 - DNA, 25 bp, Mus musculus
ggctcaaaggagaagcacaaattct

SEQ ID NO: 619889 - DNA, 25 bp, Mus musculus
ggctcaaaggagtagcacaaattct

SEQ ID NO: 619890 - DNA, 25 bp, Mus musculus
ggctcaaagttaaaactgctctcag

SEQ ID NO: 619891 - DNA, 25 bp, Mus musculus
ggctcaaagttataactgctctcag

SEQ ID NO: 619892 - DNA, 25 bp, Mus musculus
ggctcaaatgttactatttctaagt

SEQ ID NO: 619893 - DNA, 25 bp, Mus musculus
ggctcaaatgtttctatttctaagt

SEQ ID NO: 619894 - DNA, 25 bp, Mus musculus
ggctcaacaaataccatcagtgctt

SEQ ID NO: 619895 - DNA, 25 bp, Mus musculus
ggctcaacaaattccatcagtgctt

SEQ ID NO: 619896 - DNA, 25 bp, Mus musculus
ggctcaacaattaagattgcttgtt

SEQ ID NO: 619897 - DNA, 25 bp, Mus musculus
ggctcaacaatttagattgcttgtt

SEQ ID NO: 619898 - DNA, 25 bp, Mus musculus
ggctcaacacgaacctaaactctga

SEQ ID NO: 619899 - DNA, 25 bp, Mus musculus
ggctcaacacgatcctaaactctga

SEQ ID NO: 619900 - DNA, 25 bp, Mus musculus
ggctcaacattgctcctgggaaaaa

SEQ ID NO: 619901 - DNA, 25 bp, Mus musculus
ggctcaacattggtcctgggaaaaa

SEQ ID NO: 619902 - DNA, 25 bp, Mus musculus
ggctcaacctctctatctaattgta

SEQ ID NO: 619903 - DNA, 25 bp, Mus musculus
ggctcaacctctgtatctaattgta

SEQ ID NO: 619904 - DNA, 25 bp, Mus musculus
ggctcaacttcaccggcttcggcta

SEQ ID NO: 619905 - DNA, 25 bp, Mus musculus
ggctcaacttcagcggcttcggcta

SEQ ID NO: 619906 - DNA, 25 bp, Mus musculus
ggctcaagacgcctatatgatgcag

SEQ ID NO: 619907 - DNA, 25 bp, Mus musculus
ggctcaagacgcgtatatgatgcag

SEQ ID NO: 619908 - DNA, 25 bp, Mus musculus
ggctcaagagcccttgtacatcaga

SEQ ID NO: 619909 - DNA, 25 bp, Mus musculus
ggctcaagagccgttgtacatcaga

SEQ ID NO: 619910 - DNA, 25 bp, Mus musculus
ggctcaagaggcacaacgggacaaa

SEQ ID NO: 619911 - DNA, 25 bp, Mus musculus
ggctcaagaggctcaacgggacaaa

SEQ ID NO: 619912 - DNA, 25 bp, Mus musculus
ggctcaagatgtattgtttccctga

SEQ ID NO: 619913 - DNA, 25 bp, Mus musculus
ggctcaagatgttttgtttccctga

SEQ ID NO: 619914 - DNA, 25 bp, Mus musculus
ggctcaagcaatctctggtctcaac

SEQ ID NO: 619915 - DNA, 25 bp, Mus musculus
ggctcaagcaatgtctggtctcaac

SEQ ID NO: 619916 - DNA, 25 bp, Mus musculus
ggctcaagccaccaagtctgggaat

SEQ ID NO: 619917 - DNA, 25 bp, Mus musculus
ggctcaagccacgaagtctgggaat

SEQ ID NO: 619918 - DNA, 25 bp, Mus musculus
ggctcaagctaacagcaagctccag

SEQ ID NO: 619919 - DNA, 25 bp, Mus musculus
ggctcaagctaagagcaagctccag

SEQ ID NO: 619920 - DNA, 25 bp, Mus musculus
ggctcaaggattccacttgttttta

SEQ ID NO: 619921 - DNA, 25 bp, Mus musculus
ggctcaaggattgcacttgttttta

SEQ ID NO: 619922 - DNA, 25 bp, Mus musculus
ggctcaagtataagtcccacagtta

SEQ ID NO: 619923 - DNA, 25 bp, Mus musculus
ggctcaagtatatgtcccacagtta

SEQ ID NO: 619924 - DNA, 25 bp, Mus musculus
ggctcaagtcttaattcccaacacg

SEQ ID NO: 619925 - DNA, 25 bp, Mus musculus
ggctcaagtctttattcccaacacg

SEQ ID NO: 619926 - DNA, 25 bp, Mus musculus
ggctcaagtgtgaactcaggttcct

SEQ ID NO: 619927 - DNA, 25 bp, Mus musculus
ggctcaagtgtgtactcaggttcct

SEQ ID NO: 619928 - DNA, 25 bp, Mus musculus
ggctcaatactacacaaacaacaaa

SEQ ID NO: 619929 - DNA, 25 bp, Mus musculus
ggctcaatactagacaaacaacaaa

SEQ ID NO: 619930 - DNA, 25 bp, Mus musculus
ggctcaatcacgaggctgtagcagt

SEQ ID NO: 619931 - DNA, 25 bp, Mus musculus
ggctcaatcacgtggctgtagcagt

SEQ ID NO: 619932 - DNA, 25 bp, Mus musculus
ggctcaatcagcaaccgacaactgt

SEQ ID NO: 619933 - DNA, 25 bp, Mus musculus
ggctcaatcagctaccgacaactgt

SEQ ID NO: 619934 - DNA, 25 bp, Mus musculus
ggctcaatctttcaccaccagaggg

SEQ ID NO: 619935 - DNA, 25 bp, Mus musculus
ggctcaatctttgaccaccagaggg

SEQ ID NO: 619936 - DNA, 25 bp, Mus musculus
ggctcaatgaaactcactgtctcaa

SEQ ID NO: 619937 - DNA, 25 bp, Mus musculus
ggctcaatgaaagtcactgtctcaa

SEQ ID NO: 619938 - DNA, 25 bp, Mus musculus
ggctcaatgagcagtttcattctcc

SEQ ID NO: 619939 - DNA, 25 bp, Mus musculus
ggctcaatgagctgtttcattctcc

SEQ ID NO: 619940 - DNA, 25 bp, Mus musculus
ggctcaatggacagtacacacctgt

SEQ ID NO: 619941 - DNA, 25 bp, Mus musculus
ggctcaatggactgtacacacctgt

SEQ ID NO: 619942 - DNA, 25 bp, Mus musculus
ggctcaatggatacagttcttcttc

SEQ ID NO: 619943 - DNA, 25 bp, Mus musculus
ggctcaatggattcagttcttcttc

SEQ ID NO: 619944 - DNA, 25 bp, Mus musculus
ggctcaattaagaacctaggactat

SEQ ID NO: 619945 - DNA, 25 bp, Mus musculus
ggctcaattaagtacctaggactat

SEQ ID NO: 619946 - DNA, 25 bp, Mus musculus
ggctcaatttccaaacacttccttt

SEQ ID NO: 619947 - DNA, 25 bp, Mus musculus
ggctcaatttcctaacacttccttt

SEQ ID NO: 619948 - DNA, 25 bp, Mus musculus
ggctcaatttgacttctttatggat

SEQ ID NO: 619949 - DNA, 25 bp, Mus musculus
ggctcaatttgagttctttatggat

SEQ ID NO: 619950 - DNA, 25 bp, Mus musculus
ggctcacaaactcagcagtgggtct

SEQ ID NO: 619951 - DNA, 25 bp, Mus musculus
ggctcacaaactgagcagtgggtct

SEQ ID NO: 619952 - DNA, 25 bp, Mus musculus
ggctcacaaccaaaagtataaaact

SEQ ID NO: 619953 - DNA, 25 bp, Mus musculus
ggctcacaaccataagtataaaact

SEQ ID NO: 619954 - DNA, 25 bp, Mus musculus
ggctcacaagacaccactaaagttc

SEQ ID NO: 619955 - DNA, 25 bp, Mus musculus
ggctcacaagactccactaaagttc

SEQ ID NO: 619956 - DNA, 25 bp, Mus musculus
ggctcacaatacagctcacgagaag

SEQ ID NO: 619957 - DNA, 25 bp, Mus musculus
ggctcacaatactgctcacgagaag

SEQ ID NO: 619958 - DNA, 25 bp, Mus musculus
ggctcacaatcacccataagtctag

SEQ ID NO: 619959 - DNA, 25 bp, Mus musculus
ggctcacaatcagccataagtctag

SEQ ID NO: 619960 - DNA, 25 bp, Mus musculus
ggctcacacactcgtttccatgtaa

SEQ ID NO: 619961 - DNA, 25 bp, Mus musculus
ggctcacacactggtttccatgtaa

SEQ ID NO: 619962 - DNA, 25 bp, Mus musculus
ggctcacacatgatgtagcatcatc

SEQ ID NO: 619963 - DNA, 25 bp, Mus musculus
ggctcacacatgttgtagcatcatc

SEQ ID NO: 619964 - DNA, 25 bp, Mus musculus
ggctcacaccttaagaggcaaatgg

SEQ ID NO: 619965 - DNA, 25 bp, Mus musculus
ggctcacacctttagaggcaaatgg

SEQ ID NO: 619966 - DNA, 25 bp, Mus musculus
ggctcacacgtaaatacacatgtga

SEQ ID NO: 619967 - DNA, 25 bp, Mus musculus
ggctcacacgtatatacacatgtga

SEQ ID NO: 619968 - DNA, 25 bp, Mus musculus
ggctcacagaccacagtcatgtgat

SEQ ID NO: 619969 - DNA, 25 bp, Mus musculus
ggctcacagacctcagtcatgtgat

SEQ ID NO: 619970 - DNA, 25 bp, Mus musculus
ggctcacagagcctccctagggata

SEQ ID NO: 619971 - DNA, 25 bp, Mus musculus
ggctcacagagcgtccctagggata

SEQ ID NO: 619972 - DNA, 25 bp, Mus musculus
ggctcacagatccttttgccactta

SEQ ID NO: 619973 - DNA, 25 bp, Mus musculus
ggctcacagatcgttttgccactta

SEQ ID NO: 619974 - DNA, 25 bp, Mus musculus
ggctcacagcaaatatagtccagtt

SEQ ID NO: 619975 - DNA, 25 bp, Mus musculus
ggctcacagcaattatagtccagtt

SEQ ID NO: 619976 - DNA, 25 bp, Mus musculus
ggctcacaggaaacatcagtatcat

SEQ ID NO: 619977 - DNA, 25 bp, Mus musculus
ggctcacaggaacactccagacctt

SEQ ID NO: 619978 - DNA, 25 bp, Mus musculus
ggctcacaggaagactccagacctt

SEQ ID NO: 619979 - DNA, 25 bp, Mus musculus
ggctcacaggaatcatcagtatcat

SEQ ID NO: 619980 - DNA, 25 bp, Mus musculus
ggctcacagggtacacgtctaaaaa

SEQ ID NO: 619981 - DNA, 25 bp, Mus musculus
ggctcacagggttcacgtctaaaaa

SEQ ID NO: 619982 - DNA, 25 bp, Mus musculus
ggctcacaggtacaaacactttttt

SEQ ID NO: 619983 - DNA, 25 bp, Mus musculus
ggctcacaggtagaaacactttttt

SEQ ID NO: 619984 - DNA, 25 bp, Mus musculus
ggctcacaggtcatcctcaggagaa

SEQ ID NO: 619985 - DNA, 25 bp, Mus musculus
ggctcacaggtcttcctcaggagaa

SEQ ID NO: 619986 - DNA, 25 bp, Mus musculus
ggctcacagtggatcatttgttata

SEQ ID NO: 619987 - DNA, 25 bp, Mus musculus
ggctcacagtggttcatttgttata

SEQ ID NO: 619988 - DNA, 25 bp, Mus musculus
ggctcacatggtaaacctctaacta

SEQ ID NO: 619989 - DNA, 25 bp, Mus musculus
ggctcacatggttaacctctaacta

SEQ ID NO: 619990 - DNA, 25 bp, Mus musculus
ggctcacatgtgcacttttgtttgt

SEQ ID NO: 619991 - DNA, 25 bp, Mus musculus
ggctcacatgtggacttttgtttgt

SEQ ID NO: 619992 - DNA, 25 bp, Mus musculus
ggctcacattacattctcttgtttg

SEQ ID NO: 619993 - DNA, 25 bp, Mus musculus
ggctcacattactttctcttgtttg

SEQ ID NO: 619994 - DNA, 25 bp, Mus musculus
ggctcaccaaaaatgctgagatggt

SEQ ID NO: 619995 - DNA, 25 bp, Mus musculus
ggctcaccaaaattgctgagatggt

SEQ ID NO: 619996 - DNA, 25 bp, Mus musculus
ggctcaccaagcacgaggagaagct

SEQ ID NO: 619997 - DNA, 25 bp, Mus musculus
ggctcaccaagctcgaggagaagct

SEQ ID NO: 619998 - DNA, 25 bp, Mus musculus
ggctcaccagacagccaagtggcga

SEQ ID NO: 619999 - DNA, 25 bp, Mus musculus
ggctcaccagactgccaagtggcga

SEQ ID NO: 620000 - DNA, 25 bp, Mus musculus
ggctcaccagatatagcacggtcat

SEQ ID NO: 620001 - DNA, 25 bp, Mus musculus
ggctcaccagatttagcacggtcat

SEQ ID NO: 620002 - DNA, 25 bp, Mus musculus
ggctcaccagcaacttgtggacttt

SEQ ID NO: 620003 - DNA, 25 bp, Mus musculus
ggctcaccagcatcttgtggacttt

SEQ ID NO: 620004 - DNA, 25 bp, Mus musculus
ggctcaccagtcagcggatgcagca

SEQ ID NO: 620005 - DNA, 25 bp, Mus musculus
ggctcaccagtctgcggatgcagca

SEQ ID NO: 620006 - DNA, 25 bp, Mus musculus
ggctcaccagttctcatttactgag

SEQ ID NO: 620007 - DNA, 25 bp, Mus musculus
ggctcaccagttgtcatttactgag

SEQ ID NO: 620008 - DNA, 25 bp, Mus musculus
ggctcaccccgcaaataaattcttg

SEQ ID NO: 620009 - DNA, 25 bp, Mus musculus
ggctcaccccgctaataaattcttg

SEQ ID NO: 620010 - DNA, 25 bp, Mus musculus
ggctcacccctgcttttggatgcag

SEQ ID NO: 620011 - DNA, 25 bp, Mus musculus
ggctcacccctggttttggatgcag

SEQ ID NO: 620012 - DNA, 25 bp, Mus musculus
ggctcaccctgacgcatagcatgaa

SEQ ID NO: 620013 - DNA, 25 bp, Mus musculus
ggctcaccctgaggcatagcatgaa

SEQ ID NO: 620014 - DNA, 25 bp, Mus musculus
ggctcaccctgcatgctttatagaa

SEQ ID NO: 620015 - DNA, 25 bp, Mus musculus
ggctcaccctgcttgctttatagaa

SEQ ID NO: 620016 - DNA, 25 bp, Mus musculus
ggctcacctataagcccaggaatat

SEQ ID NO: 620017 - DNA, 25 bp, Mus musculus
ggctcacctatatgcccaggaatat

SEQ ID NO: 620018 - DNA, 25 bp, Mus musculus
ggctcacctcgaacgtgttccgaga

SEQ ID NO: 620019 - DNA, 25 bp, Mus musculus
ggctcacctcgatcgtgttccgaga

SEQ ID NO: 620020 - DNA, 25 bp, Mus musculus
ggctcacctgcaataaccttcatag

SEQ ID NO: 620021 - DNA, 25 bp, Mus musculus
ggctcacctgcattaaccttcatag

SEQ ID NO: 620022 - DNA, 25 bp, Mus musculus
ggctcacctgccagcattgaaggag

SEQ ID NO: 620023 - DNA, 25 bp, Mus musculus
ggctcacctgcctgcattgaaggag

SEQ ID NO: 620024 - DNA, 25 bp, Mus musculus
ggctcacctgtcaatgctttacaaa

SEQ ID NO: 620025 - DNA, 25 bp, Mus musculus
ggctcacctgtctatgctttacaaa

SEQ ID NO: 620026 - DNA, 25 bp, Mus musculus
ggctcaccttcgaggccgtggtcgc

SEQ ID NO: 620027 - DNA, 25 bp, Mus musculus
ggctcaccttcgtggccgtggtcgc

SEQ ID NO: 620028 - DNA, 25 bp, Mus musculus
ggctcacgacttactggagcaggat

SEQ ID NO: 620029 - DNA, 25 bp, Mus musculus
ggctcacgactttctggagcaggat

SEQ ID NO: 620030 - DNA, 25 bp, Mus musculus
ggctcacgaggcacttagggaccag

SEQ ID NO: 620031 - DNA, 25 bp, Mus musculus
ggctcacgaggctcttagggaccag

SEQ ID NO: 620032 - DNA, 25 bp, Mus musculus
ggctcacgcttccacaacaagaata

SEQ ID NO: 620033 - DNA, 25 bp, Mus musculus
ggctcacgcttcgacaacaagaata

SEQ ID NO: 620034 - DNA, 25 bp, Mus musculus
ggctcacggattcgaagccaagtga

SEQ ID NO: 620035 - DNA, 25 bp, Mus musculus
ggctcacggattggaagccaagtga

SEQ ID NO: 620036 - DNA, 25 bp, Mus musculus
ggctcacggctccataccacatata

SEQ ID NO: 620037 - DNA, 25 bp, Mus musculus
ggctcacggctcgataccacatata

SEQ ID NO: 620038 - DNA, 25 bp, Mus musculus
ggctcacgtcttatggttccaataa

SEQ ID NO: 620039 - DNA, 25 bp, Mus musculus
ggctcacgtcttttggttccaataa

SEQ ID NO: 620040 - DNA, 25 bp, Mus musculus
ggctcacgtgctcacagaactgact

SEQ ID NO: 620041 - DNA, 25 bp, Mus musculus
ggctcacgtgctgacagaactgact

SEQ ID NO: 620042 - DNA, 25 bp, Mus musculus
ggctcactcactattggtttccttg

SEQ ID NO: 620043 - DNA, 25 bp, Mus musculus
ggctcactcacttttggtttccttg

SEQ ID NO: 620044 - DNA, 25 bp, Mus musculus
ggctcactcagcatcatttattgtg

SEQ ID NO: 620045 - DNA, 25 bp, Mus musculus
ggctcactcagcttcatttattgtg

SEQ ID NO: 620046 - DNA, 25 bp, Mus musculus
ggctcactcatgactactggcaaag

SEQ ID NO: 620047 - DNA, 25 bp, Mus musculus
ggctcactcatgtctactggcaaag

SEQ ID NO: 620048 - DNA, 25 bp, Mus musculus
ggctcactcctcacataaggtctat

SEQ ID NO: 620049 - DNA, 25 bp, Mus musculus
ggctcactcctctcataaggtctat

SEQ ID NO: 620050 - DNA, 25 bp, Mus musculus
ggctcactctggctctatacaagaa

SEQ ID NO: 620051 - DNA, 25 bp, Mus musculus
ggctcactctgggtctatacaagaa

SEQ ID NO: 620052 - DNA, 25 bp, Mus musculus
ggctcactgccccaaggcagaagtt

SEQ ID NO: 620053 - DNA, 25 bp, Mus musculus
ggctcactgcccgaaggcagaagtt

SEQ ID NO: 620054 - DNA, 25 bp, Mus musculus
ggctcactggctataccattatagg

SEQ ID NO: 620055 - DNA, 25 bp, Mus musculus
ggctcactggctttaccattatagg

SEQ ID NO: 620056 - DNA, 25 bp, Mus musculus
ggctcactgtagctctttgttgcac

SEQ ID NO: 620057 - DNA, 25 bp, Mus musculus
ggctcactgtaggtctttgttgcac

SEQ ID NO: 620058 - DNA, 25 bp, Mus musculus
ggctcactgttcagggttattattt

SEQ ID NO: 620059 - DNA, 25 bp, Mus musculus
ggctcactgttctgggttattattt

SEQ ID NO: 620060 - DNA, 25 bp, Mus musculus
ggctcactttctctgttttggaggc

SEQ ID NO: 620061 - DNA, 25 bp, Mus musculus
ggctcactttctgtgttttggaggc

SEQ ID NO: 620062 - DNA, 25 bp, Mus musculus
ggctcagaaagaaaggcccactgaa

SEQ ID NO: 620063 - DNA, 25 bp, Mus musculus
ggctcagaaagataggcccactgaa

SEQ ID NO: 620064 - DNA, 25 bp, Mus musculus
ggctcagaaatgacctacataccta

SEQ ID NO: 620065 - DNA, 25 bp, Mus musculus
ggctcagaaatgtcctacataccta

SEQ ID NO: 620066 - DNA, 25 bp, Mus musculus
ggctcagaacaaataagcactgcct

SEQ ID NO: 620067 - DNA, 25 bp, Mus musculus
ggctcagaacaattaagcactgcct

SEQ ID NO: 620068 - DNA, 25 bp, Mus musculus
ggctcagaactcctagaatcaaatg

SEQ ID NO: 620069 - DNA, 25 bp, Mus musculus
ggctcagaactcgtagaatcaaatg

SEQ ID NO: 620070 - DNA, 25 bp, Mus musculus
ggctcagaagagaactaggcagatt

SEQ ID NO: 620071 - DNA, 25 bp, Mus musculus
ggctcagaagagtactaggcagatt

SEQ ID NO: 620072 - DNA, 25 bp, Mus musculus
ggctcagaagctaatgttgtgtctt

SEQ ID NO: 620073 - DNA, 25 bp, Mus musculus
ggctcagaagcttatgttgtgtctt

SEQ ID NO: 620074 - DNA, 25 bp, Mus musculus
ggctcagaatgacaggcggtcccca

SEQ ID NO: 620075 - DNA, 25 bp, Mus musculus
ggctcagaatgagaggcggtcccca

SEQ ID NO: 620076 - DNA, 25 bp, Mus musculus
ggctcagaattcctccagatacaga

SEQ ID NO: 620077 - DNA, 25 bp, Mus musculus
ggctcagaattcgtccagatacaga

SEQ ID NO: 620078 - DNA, 25 bp, Mus musculus
ggctcagacctgcaacctccggatg

SEQ ID NO: 620079 - DNA, 25 bp, Mus musculus
ggctcagacctggaacctccggatg

SEQ ID NO: 620080 - DNA, 25 bp, Mus musculus
ggctcagactttagctaacatccta

SEQ ID NO: 620081 - DNA, 25 bp, Mus musculus
ggctcagacttttgctaacatccta

SEQ ID NO: 620082 - DNA, 25 bp, Mus musculus
ggctcagagatccaacttgctttaa

SEQ ID NO: 620083 - DNA, 25 bp, Mus musculus
ggctcagagatcgaacttgctttaa

SEQ ID NO: 620084 - DNA, 25 bp, Mus musculus
ggctcagaggatataggtgcttgct

SEQ ID NO: 620085 - DNA, 25 bp, Mus musculus
ggctcagaggatttaggtgcttgct

SEQ ID NO: 620086 - DNA, 25 bp, Mus musculus
ggctcagaggtgcttcgaatccaga

SEQ ID NO: 620087 - DNA, 25 bp, Mus musculus
ggctcagaggtggttcgaatccaga

SEQ ID NO: 620088 - DNA, 25 bp, Mus musculus
ggctcagagtaaactattgttcatt

SEQ ID NO: 620089 - DNA, 25 bp, Mus musculus
ggctcagagtaatctattgttcatt

SEQ ID NO: 620090 - DNA, 25 bp, Mus musculus
ggctcagagtacatctaacccaatg

SEQ ID NO: 620091 - DNA, 25 bp, Mus musculus
ggctcagagtacttctaacccaatg

SEQ ID NO: 620092 - DNA, 25 bp, Mus musculus
ggctcagattccaagaacgaggact

SEQ ID NO: 620093 - DNA, 25 bp, Mus musculus
ggctcagattcctagaacgaggact

SEQ ID NO: 620094 - DNA, 25 bp, Mus musculus
ggctcagcaacaaaggacgatgtct

SEQ ID NO: 620095 - DNA, 25 bp, Mus musculus
ggctcagcaacataggacgatgtct

SEQ ID NO: 620096 - DNA, 25 bp, Mus musculus
ggctcagcaactcaaatgtttctca

SEQ ID NO: 620097 - DNA, 25 bp, Mus musculus
ggctcagcaactgaaatgtttctca

SEQ ID NO: 620098 - DNA, 25 bp, Mus musculus
ggctcagcactgcattgcttctata

SEQ ID NO: 620099 - DNA, 25 bp, Mus musculus
ggctcagcactggattgcttctata

SEQ ID NO: 620100 - DNA, 25 bp, Mus musculus
ggctcagcacttattgctcacttcc

SEQ ID NO: 620101 - DNA, 25 bp, Mus musculus
ggctcagcactttttgctcacttcc

SEQ ID NO: 620102 - DNA, 25 bp, Mus musculus
ggctcagcaggcctctacgagacaa

SEQ ID NO: 620103 - DNA, 25 bp, Mus musculus
ggctcagcaggcgtctacgagacaa

SEQ ID NO: 620104 - DNA, 25 bp, Mus musculus
ggctcagcaggtacatgattgtttt

SEQ ID NO: 620105 - DNA, 25 bp, Mus musculus
ggctcagcaggtatcactgaattca

SEQ ID NO: 620106 - DNA, 25 bp, Mus musculus
ggctcagcaggttcatgattgtttt

SEQ ID NO: 620107 - DNA, 25 bp, Mus musculus
ggctcagcaggtttcactgaattca

SEQ ID NO: 620108 - DNA, 25 bp, Mus musculus
ggctcagcagtccttctgcaaagga

SEQ ID NO: 620109 - DNA, 25 bp, Mus musculus
ggctcagcagtcgttctgcaaagga

SEQ ID NO: 620110 - DNA, 25 bp, Mus musculus
ggctcagcagtgcatgaccaagtca

SEQ ID NO: 620111 - DNA, 25 bp, Mus musculus
ggctcagcagtggatgaccaagtca

SEQ ID NO: 620112 - DNA, 25 bp, Mus musculus
ggctcagcagttcaagaaccttctg

SEQ ID NO: 620113 - DNA, 25 bp, Mus musculus
ggctcagcagttgaagaaccttctg

SEQ ID NO: 620114 - DNA, 25 bp, Mus musculus
ggctcagcatagcaagtctcaggaa

SEQ ID NO: 620115 - DNA, 25 bp, Mus musculus
ggctcagcataggaagtctcaggaa

SEQ ID NO: 620116 - DNA, 25 bp, Mus musculus
ggctcagccacacaggaggccagta

SEQ ID NO: 620117 - DNA, 25 bp, Mus musculus
ggctcagccacagaggaggccagta

SEQ ID NO: 620118 - DNA, 25 bp, Mus musculus
ggctcagccattaattagctgtgac

SEQ ID NO: 620119 - DNA, 25 bp, Mus musculus
ggctcagccatttattagctgtgac

SEQ ID NO: 620120 - DNA, 25 bp, Mus musculus
ggctcagcccgacggacaggtcaaa

SEQ ID NO: 620121 - DNA, 25 bp, Mus musculus
ggctcagcccgagggacaggtcaaa

SEQ ID NO: 620122 - DNA, 25 bp, Mus musculus
ggctcagcccggatggacgaactcg

SEQ ID NO: 620123 - DNA, 25 bp, Mus musculus
ggctcagcccggttggacgaactcg

SEQ ID NO: 620124 - DNA, 25 bp, Mus musculus
ggctcagccctgacttcatgattgg

SEQ ID NO: 620125 - DNA, 25 bp, Mus musculus
ggctcagccctgtcttcatgattgg

SEQ ID NO: 620126 - DNA, 25 bp, Mus musculus
ggctcagcccttcctgaagagctgg

SEQ ID NO: 620127 - DNA, 25 bp, Mus musculus
ggctcagcccttgctgaagagctgg

SEQ ID NO: 620128 - DNA, 25 bp, Mus musculus
ggctcagccgttatgaacatttctt

SEQ ID NO: 620129 - DNA, 25 bp, Mus musculus
ggctcagccgttttgaacatttctt

SEQ ID NO: 620130 - DNA, 25 bp, Mus musculus
ggctcagccttcaagtgcaacagat

SEQ ID NO: 620131 - DNA, 25 bp, Mus musculus
ggctcagccttctagtgcaacagat

SEQ ID NO: 620132 - DNA, 25 bp, Mus musculus
ggctcagcctttatggaatcctcaa

SEQ ID NO: 620133 - DNA, 25 bp, Mus musculus
ggctcagcctttttggaatcctcaa

SEQ ID NO: 620134 - DNA, 25 bp, Mus musculus
ggctcagcgacgaacagtcagcatt

SEQ ID NO: 620135 - DNA, 25 bp, Mus musculus
ggctcagcgacgtacagtcagcatt

SEQ ID NO: 620136 - DNA, 25 bp, Mus musculus
ggctcagctaaccaagtttctgcaa

SEQ ID NO: 620137 - DNA, 25 bp, Mus musculus
ggctcagctaacgaagtttctgcaa

SEQ ID NO: 620138 - DNA, 25 bp, Mus musculus
ggctcagctaagaaatacgtcccgc

SEQ ID NO: 620139 - DNA, 25 bp, Mus musculus
ggctcagctaagtaatacgtcccgc

SEQ ID NO: 620140 - DNA, 25 bp, Mus musculus
ggctcagctagaccaagggcttttc

SEQ ID NO: 620141 - DNA, 25 bp, Mus musculus
ggctcagctagagcaagggcttttc

SEQ ID NO: 620142 - DNA, 25 bp, Mus musculus
ggctcagctaggagctactctttga

SEQ ID NO: 620143 - DNA, 25 bp, Mus musculus
ggctcagctaggtgctactctttga

SEQ ID NO: 620144 - DNA, 25 bp, Mus musculus
ggctcagctcaaccaggactctgat

SEQ ID NO: 620145 - DNA, 25 bp, Mus musculus
ggctcagctcaagcaggactctgat

SEQ ID NO: 620146 - DNA, 25 bp, Mus musculus
ggctcagctcctaaagatgccggat

SEQ ID NO: 620147 - DNA, 25 bp, Mus musculus
ggctcagctccttaagatgccggat

SEQ ID NO: 620148 - DNA, 25 bp, Mus musculus
ggctcagctgataggcagcatggaa

SEQ ID NO: 620149 - DNA, 25 bp, Mus musculus
ggctcagctgattggcagcatggaa

SEQ ID NO: 620150 - DNA, 25 bp, Mus musculus
ggctcagctggtactacctgacatc

SEQ ID NO: 620151 - DNA, 25 bp, Mus musculus
ggctcagctggttctacctgacatc

SEQ ID NO: 620152 - DNA, 25 bp, Mus musculus
ggctcagctttacactccaggagtt

SEQ ID NO: 620153 - DNA, 25 bp, Mus musculus
ggctcagctttagactccaggagtt

SEQ ID NO: 620154 - DNA, 25 bp, Mus musculus
ggctcaggacataccctccagagca

SEQ ID NO: 620155 - DNA, 25 bp, Mus musculus
ggctcaggacattccctccagagca

SEQ ID NO: 620156 - DNA, 25 bp, Mus musculus
ggctcaggaccaagcttgtgtgtgc

SEQ ID NO: 620157 - DNA, 25 bp, Mus musculus
ggctcaggaccatgcttgtgtgtgc

SEQ ID NO: 620158 - DNA, 25 bp, Mus musculus
ggctcaggactgcttacaactccag

SEQ ID NO: 620159 - DNA, 25 bp, Mus musculus
ggctcaggactggttacaactccag

SEQ ID NO: 620160 - DNA, 25 bp, Mus musculus
ggctcaggacttcatctttgaaatt

SEQ ID NO: 620161 - DNA, 25 bp, Mus musculus
ggctcaggacttgatctttgaaatt

SEQ ID NO: 620162 - DNA, 25 bp, Mus musculus
ggctcaggagccacgggaaagaact

SEQ ID NO: 620163 - DNA, 25 bp, Mus musculus
ggctcaggagcctcgggaaagaact

SEQ ID NO: 620164 - DNA, 25 bp, Mus musculus
ggctcaggatcccatttgatctccc

SEQ ID NO: 620165 - DNA, 25 bp, Mus musculus
ggctcaggatccgatttgatctccc

SEQ ID NO: 620166 - DNA, 25 bp, Mus musculus
ggctcaggcaataagctctatataa

SEQ ID NO: 620167 - DNA, 25 bp, Mus musculus
ggctcaggcaattagctctatataa

SEQ ID NO: 620168 - DNA, 25 bp, Mus musculus
ggctcaggcatcactacctggatgg

SEQ ID NO: 620169 - DNA, 25 bp, Mus musculus
ggctcaggcatctctacctggatgg

SEQ ID NO: 620170 - DNA, 25 bp, Mus musculus
ggctcaggcattaatccttactgtg

SEQ ID NO: 620171 - DNA, 25 bp, Mus musculus
ggctcaggcatttatccttactgtg

SEQ ID NO: 620172 - DNA, 25 bp, Mus musculus
ggctcaggccacaactgttgtatta

SEQ ID NO: 620173 - DNA, 25 bp, Mus musculus
ggctcaggccactactgttgtatta

SEQ ID NO: 620174 - DNA, 25 bp, Mus musculus
ggctcaggcgcaacggaaacttttt

SEQ ID NO: 620175 - DNA, 25 bp, Mus musculus
ggctcaggcgcatcggaaacttttt

SEQ ID NO: 620176 - DNA, 25 bp, Mus musculus
ggctcaggcgcccactgtaggtcaa

SEQ ID NO: 620177 - DNA, 25 bp, Mus musculus
ggctcaggcgccgactgtaggtcaa

SEQ ID NO: 620178 - DNA, 25 bp, Mus musculus
ggctcaggctgtagattagaatttc

SEQ ID NO: 620179 - DNA, 25 bp, Mus musculus
ggctcaggctgttgattagaatttc

SEQ ID NO: 620180 - DNA, 25 bp, Mus musculus
ggctcaggctttcttaaaacagaaa

SEQ ID NO: 620181 - DNA, 25 bp, Mus musculus
ggctcaggctttgttaaaacagaaa

SEQ ID NO: 620182 - DNA, 25 bp, Mus musculus
ggctcagggaaccataccatccagc

SEQ ID NO: 620183 - DNA, 25 bp, Mus musculus
ggctcagggaacgataccatccagc

SEQ ID NO: 620184 - DNA, 25 bp, Mus musculus
ggctcagggacccattccacaagct

SEQ ID NO: 620185 - DNA, 25 bp, Mus musculus
ggctcagggaccgattccacaagct

SEQ ID NO: 620186 - DNA, 25 bp, Mus musculus
ggctcagggatcctgtgtttgccta

SEQ ID NO: 620187 - DNA, 25 bp, Mus musculus
ggctcagggatcgtgtgtttgccta

SEQ ID NO: 620188 - DNA, 25 bp, Mus musculus
ggctcagggtagatcccaggttacc

SEQ ID NO: 620189 - DNA, 25 bp, Mus musculus
ggctcagggtagttcccaggttacc

SEQ ID NO: 620190 - DNA, 25 bp, Mus musculus
ggctcagggttaaggtccctcttga

SEQ ID NO: 620191 - DNA, 25 bp, Mus musculus
ggctcagggttatggtccctcttga

SEQ ID NO: 620192 - DNA, 25 bp, Mus musculus
ggctcaggtaaacattctgcttgtg

SEQ ID NO: 620193 - DNA, 25 bp, Mus musculus
ggctcaggtaaagattctgcttgtg

SEQ ID NO: 620194 - DNA, 25 bp, Mus musculus
ggctcaggtcatactgtctcaggaa

SEQ ID NO: 620195 - DNA, 25 bp, Mus musculus
ggctcaggtcattctgtctcaggaa

SEQ ID NO: 620196 - DNA, 25 bp, Mus musculus
ggctcagtagacaaagggactcctt

SEQ ID NO: 620197 - DNA, 25 bp, Mus musculus
ggctcagtagactaagggactcctt

SEQ ID NO: 620198 - DNA, 25 bp, Mus musculus
ggctcagtatctcctggtgaacaca

SEQ ID NO: 620199 - DNA, 25 bp, Mus musculus
ggctcagtatctgctggtgaacaca

SEQ ID NO: 620200 - DNA, 25 bp, Mus musculus
ggctcagtatgacaccccaaaaggt

SEQ ID NO: 620201 - DNA, 25 bp, Mus musculus
ggctcagtatgagaccccaaaaggt

SEQ ID NO: 620202 - DNA, 25 bp, Mus musculus
ggctcagtcattaagatcacttgca

SEQ ID NO: 620203 - DNA, 25 bp, Mus musculus
ggctcagtcatttagatcacttgca

SEQ ID NO: 620204 - DNA, 25 bp, Mus musculus
ggctcagtcctacttacattatcag

SEQ ID NO: 620205 - DNA, 25 bp, Mus musculus
ggctcagtcctagttacattatcag

SEQ ID NO: 620206 - DNA, 25 bp, Mus musculus
ggctcagtctgtaaatccttctagt

SEQ ID NO: 620207 - DNA, 25 bp, Mus musculus
ggctcagtctgttaatccttctagt

SEQ ID NO: 620208 - DNA, 25 bp, Mus musculus
ggctcagtgactaaagatgcttgct

SEQ ID NO: 620209 - DNA, 25 bp, Mus musculus
ggctcagtgacttaagatgcttgct

SEQ ID NO: 620210 - DNA, 25 bp, Mus musculus
ggctcagtgatcatccctggaaaga

SEQ ID NO: 620211 - DNA, 25 bp, Mus musculus
ggctcagtgatcttccctggaaaga

SEQ ID NO: 620212 - DNA, 25 bp, Mus musculus
ggctcagtgcagataacagcagctg

SEQ ID NO: 620213 - DNA, 25 bp, Mus musculus
ggctcagtgcagttaacagcagctg

SEQ ID NO: 620214 - DNA, 25 bp, Mus musculus
ggctcagtgcctcgttatttatgtg

SEQ ID NO: 620215 - DNA, 25 bp, Mus musculus
ggctcagtgcctggttatttatgtg

SEQ ID NO: 620216 - DNA, 25 bp, Mus musculus
ggctcagtggctaaggatgcattaa

SEQ ID NO: 620217 - DNA, 25 bp, Mus musculus
ggctcagtggcttaggatgcattaa

SEQ ID NO: 620218 - DNA, 25 bp, Mus musculus
ggctcagtgggcagacatgctgatc

SEQ ID NO: 620219 - DNA, 25 bp, Mus musculus
ggctcagtgggctgacatgctgatc

SEQ ID NO: 620220 - DNA, 25 bp, Mus musculus
ggctcagttatcatcccttagttaa

SEQ ID NO: 620221 - DNA, 25 bp, Mus musculus
ggctcagttatcttcccttagttaa

SEQ ID NO: 620222 - DNA, 25 bp, Mus musculus
ggctcagttcaacaggatatagtcc

SEQ ID NO: 620223 - DNA, 25 bp, Mus musculus
ggctcagttcaagaggatatagtcc

SEQ ID NO: 620224 - DNA, 25 bp, Mus musculus
ggctcagttcatacagtgcttgcaa

SEQ ID NO: 620225 - DNA, 25 bp, Mus musculus
ggctcagttcattcagtgcttgcaa

SEQ ID NO: 620226 - DNA, 25 bp, Mus musculus
ggctcagttcctacattcagatggt

SEQ ID NO: 620227 - DNA, 25 bp, Mus musculus
ggctcagttccttcattcagatggt

SEQ ID NO: 620228 - DNA, 25 bp, Mus musculus
ggctcagttctgaagtgctaacaca

SEQ ID NO: 620229 - DNA, 25 bp, Mus musculus
ggctcagttctgtagtgctaacaca

SEQ ID NO: 620230 - DNA, 25 bp, Mus musculus
ggctcagtttgactttcacacagct

SEQ ID NO: 620231 - DNA, 25 bp, Mus musculus
ggctcagtttgagtttcacacagct

SEQ ID NO: 620232 - DNA, 25 bp, Mus musculus
ggctcagtttgtatctactttggac

SEQ ID NO: 620233 - DNA, 25 bp, Mus musculus
ggctcagtttgtttctactttggac

SEQ ID NO: 620234 - DNA, 25 bp, Mus musculus
ggctcagttttaaagcacttaagct

SEQ ID NO: 620235 - DNA, 25 bp, Mus musculus
ggctcagttttatagcacttaagct

SEQ ID NO: 620236 - DNA, 25 bp, Mus musculus
ggctcataacttaaatggcatcctt

SEQ ID NO: 620237 - DNA, 25 bp, Mus musculus
ggctcataactttaatggcatcctt

SEQ ID NO: 620238 - DNA, 25 bp, Mus musculus
ggctcataatatcagattaccattg

SEQ ID NO: 620239 - DNA, 25 bp, Mus musculus
ggctcataatatgagattaccattg

SEQ ID NO: 620240 - DNA, 25 bp, Mus musculus
ggctcatagagccaccactaagtaa

SEQ ID NO: 620241 - DNA, 25 bp, Mus musculus
ggctcatagagcgaccactaagtaa

SEQ ID NO: 620242 - DNA, 25 bp, Mus musculus
ggctcatagggcactgatgggatat

SEQ ID NO: 620243 - DNA, 25 bp, Mus musculus
ggctcatagggctctgatgggatat

SEQ ID NO: 620244 - DNA, 25 bp, Mus musculus
ggctcatatggcactatatactata

SEQ ID NO: 620245 - DNA, 25 bp, Mus musculus
ggctcatatggctctatatactata

SEQ ID NO: 620246 - DNA, 25 bp, Mus musculus
ggctcatattcaagtgtccttggta

SEQ ID NO: 620247 - DNA, 25 bp, Mus musculus
ggctcatattcatgtgtccttggta

SEQ ID NO: 620248 - DNA, 25 bp, Mus musculus
ggctcatatttacctagctttcttg

SEQ ID NO: 620249 - DNA, 25 bp, Mus musculus
ggctcatatttagctagctttcttg

SEQ ID NO: 620250 - DNA, 25 bp, Mus musculus
ggctcatcccatcgaatagacctta

SEQ ID NO: 620251 - DNA, 25 bp, Mus musculus
ggctcatcccatggaatagacctta

SEQ ID NO: 620252 - DNA, 25 bp, Mus musculus
ggctcatccttaaagattcccaatg

SEQ ID NO: 620253 - DNA, 25 bp, Mus musculus
ggctcatccttaaggattcacaaga

SEQ ID NO: 620254 - DNA, 25 bp, Mus musculus
ggctcatccttaaggtttcacacgg

SEQ ID NO: 620255 - DNA, 25 bp, Mus musculus
ggctcatccttatagattcccaatg

SEQ ID NO: 620256 - DNA, 25 bp, Mus musculus
ggctcatccttatggattcacaaga

SEQ ID NO: 620257 - DNA, 25 bp, Mus musculus
ggctcatccttatggtttcacacgg

SEQ ID NO: 620258 - DNA, 25 bp, Mus musculus
ggctcatctatgaggttttcttttg

SEQ ID NO: 620259 - DNA, 25 bp, Mus musculus
ggctcatctatgtggttttcttttg

SEQ ID NO: 620260 - DNA, 25 bp, Mus musculus
ggctcatctcaacagatgcccaggc

SEQ ID NO: 620261 - DNA, 25 bp, Mus musculus
ggctcatctcaagagatgcccaggc

SEQ ID NO: 620262 - DNA, 25 bp, Mus musculus
ggctcatctgggacctgggccagca

SEQ ID NO: 620263 - DNA, 25 bp, Mus musculus
ggctcatctgggtcctgggccagca

SEQ ID NO: 620264 - DNA, 25 bp, Mus musculus
ggctcatgatgaagctgtttttcaa

SEQ ID NO: 620265 - DNA, 25 bp, Mus musculus
ggctcatgatgatgctgtttttcaa

SEQ ID NO: 620266 - DNA, 25 bp, Mus musculus
ggctcatgattacaagctccagagt

SEQ ID NO: 620267 - DNA, 25 bp, Mus musculus
ggctcatgattagaagctccagagt

SEQ ID NO: 620268 - DNA, 25 bp, Mus musculus
ggctcatgcagcaactttcacattc

SEQ ID NO: 620269 - DNA, 25 bp, Mus musculus
ggctcatgcagctactttcacattc

SEQ ID NO: 620270 - DNA, 25 bp, Mus musculus
ggctcatgccagaaaccgagactta

SEQ ID NO: 620271 - DNA, 25 bp, Mus musculus
ggctcatgccagtaaccgagactta

SEQ ID NO: 620272 - DNA, 25 bp, Mus musculus
ggctcatgggagcacagttagacat

SEQ ID NO: 620273 - DNA, 25 bp, Mus musculus
ggctcatgggaggacagttagacat

SEQ ID NO: 620274 - DNA, 25 bp, Mus musculus
ggctcatgggcacacagtaccatgt

SEQ ID NO: 620275 - DNA, 25 bp, Mus musculus
ggctcatgggcagacagtaccatgt

SEQ ID NO: 620276 - DNA, 25 bp, Mus musculus
ggctcatgggccagctgagattcat

SEQ ID NO: 620277 - DNA, 25 bp, Mus musculus
ggctcatgggcctgctgagattcat

SEQ ID NO: 620278 - DNA, 25 bp, Mus musculus
ggctcatgtaagagccggtgtccat

SEQ ID NO: 620279 - DNA, 25 bp, Mus musculus
ggctcatgtaagtgccggtgtccat

SEQ ID NO: 620280 - DNA, 25 bp, Mus musculus
ggctcatgtatgctatctgagtaat

SEQ ID NO: 620281 - DNA, 25 bp, Mus musculus
ggctcatgtatggtatctgagtaat

SEQ ID NO: 620282 - DNA, 25 bp, Mus musculus
ggctcattagggatgccatgggatt

SEQ ID NO: 620283 - DNA, 25 bp, Mus musculus
ggctcattagggttgccatgggatt

SEQ ID NO: 620284 - DNA, 25 bp, Mus musculus
ggctcattagtgagtccctgcaggc

SEQ ID NO: 620285 - DNA, 25 bp, Mus musculus
ggctcattagtgtgtccctgcaggc

SEQ ID NO: 620286 - DNA, 25 bp, Mus musculus
ggctcattatttatcagtactgtgg

SEQ ID NO: 620287 - DNA, 25 bp, Mus musculus
ggctcattatttttcagtactgtgg

SEQ ID NO: 620288 - DNA, 25 bp, Mus musculus
ggctcattccttaaataccagtatc

SEQ ID NO: 620289 - DNA, 25 bp, Mus musculus
ggctcattcctttaataccagtatc

SEQ ID NO: 620290 - DNA, 25 bp, Mus musculus
ggctcattgctcctcttttaaaata

SEQ ID NO: 620291 - DNA, 25 bp, Mus musculus
ggctcattgctcgtcttttaaaata

SEQ ID NO: 620292 - DNA, 25 bp, Mus musculus
ggctcattgcttattccatatatgt

SEQ ID NO: 620293 - DNA, 25 bp, Mus musculus
ggctcattgctttttccatatatgt

SEQ ID NO: 620294 - DNA, 25 bp, Mus musculus
ggctcattggatatcttgggtaccc

SEQ ID NO: 620295 - DNA, 25 bp, Mus musculus
ggctcattggatttcttgggtaccc

SEQ ID NO: 620296 - DNA, 25 bp, Mus musculus
ggctcattggccaggtgtaggtcca

SEQ ID NO: 620297 - DNA, 25 bp, Mus musculus
ggctcattggcctggtgtaggtcca

SEQ ID NO: 620298 - DNA, 25 bp, Mus musculus
ggctcattgggaagttctagtgcta

SEQ ID NO: 620299 - DNA, 25 bp, Mus musculus
ggctcattgggatgttctagtgcta

SEQ ID NO: 620300 - DNA, 25 bp, Mus musculus
ggctcattgggtaaaatgtttgctg

SEQ ID NO: 620301 - DNA, 25 bp, Mus musculus
ggctcattgggttaaatgtttgctg

SEQ ID NO: 620302 - DNA, 25 bp, Mus musculus
ggctcattttgtcgtcacttgcatt

SEQ ID NO: 620303 - DNA, 25 bp, Mus musculus
ggctcattttgtggtcacttgcatt

SEQ ID NO: 620304 - DNA, 25 bp, Mus musculus
ggctcatttttaccacccataaaat

SEQ ID NO: 620305 - DNA, 25 bp, Mus musculus
ggctcatttttagcacccataaaat

SEQ ID NO: 620306 - DNA, 25 bp, Mus musculus
ggctcatttttcatgggatcttcca

SEQ ID NO: 620307 - DNA, 25 bp, Mus musculus
ggctcatttttcttgggatcttcca

SEQ ID NO: 620308 - DNA, 25 bp, Mus musculus
ggctccaaaggcacactgtggaagt

SEQ ID NO: 620309 - DNA, 25 bp, Mus musculus
ggctccaaaggctcactgtggaagt

SEQ ID NO: 620310 - DNA, 25 bp, Mus musculus
ggctccaacacaaaggccatgcttg

SEQ ID NO: 620311 - DNA, 25 bp, Mus musculus
ggctccaacacataggccatgcttg

SEQ ID NO: 620312 - DNA, 25 bp, Mus musculus
ggctccaacgtaactgcaatttaat

SEQ ID NO: 620313 - DNA, 25 bp, Mus musculus
ggctccaacgtatctgcaatttaat

SEQ ID NO: 620314 - DNA, 25 bp, Mus musculus
ggctccaacttgcatggctgacctc

SEQ ID NO: 620315 - DNA, 25 bp, Mus musculus
ggctccaacttggatggctgacctc

SEQ ID NO: 620316 - DNA, 25 bp, Mus musculus
ggctccaagagtcatgtgacgttaa

SEQ ID NO: 620317 - DNA, 25 bp, Mus musculus
ggctccaagagtgatgtgacgttaa

SEQ ID NO: 620318 - DNA, 25 bp, Mus musculus
ggctccaagcaaaaaccctaaacag

SEQ ID NO: 620319 - DNA, 25 bp, Mus musculus
ggctccaagcaataaccctaaacag

SEQ ID NO: 620320 - DNA, 25 bp, Mus musculus
ggctccaagcggaagagatcctcga

SEQ ID NO: 620321 - DNA, 25 bp, Mus musculus
ggctccaagcggtagagatcctcga

SEQ ID NO: 620322 - DNA, 25 bp, Mus musculus
ggctccaaggacactgggatcattt

SEQ ID NO: 620323 - DNA, 25 bp, Mus musculus
ggctccaaggactctgggatcattt

SEQ ID NO: 620324 - DNA, 25 bp, Mus musculus
ggctccaagggcactagggcaatgc

SEQ ID NO: 620325 - DNA, 25 bp, Mus musculus
ggctccaagggctctagggcaatgc

SEQ ID NO: 620326 - DNA, 25 bp, Mus musculus
ggctccaagtgcctgtggacatatg

SEQ ID NO: 620327 - DNA, 25 bp, Mus musculus
ggctccaagtgcgtgtggacatatg

SEQ ID NO: 620328 - DNA, 25 bp, Mus musculus
ggctccaatatcacgagtttgcgga

SEQ ID NO: 620329 - DNA, 25 bp, Mus musculus
ggctccaatatctcgagtttgcgga

SEQ ID NO: 620330 - DNA, 25 bp, Mus musculus
ggctccaatgacacatccaagaagt

SEQ ID NO: 620331 - DNA, 25 bp, Mus musculus
ggctccaatgactcatccaagaagt

SEQ ID NO: 620332 - DNA, 25 bp, Mus musculus
ggctccaatgcccatttgttgttat

SEQ ID NO: 620333 - DNA, 25 bp, Mus musculus
ggctccaatgccgatttgttgttat

SEQ ID NO: 620334 - DNA, 25 bp, Mus musculus
ggctccacaagtcataaaccctgtt

SEQ ID NO: 620335 - DNA, 25 bp, Mus musculus
ggctccacaagtgataaaccctgtt

SEQ ID NO: 620336 - DNA, 25 bp, Mus musculus
ggctccacaatccacggcagattgg

SEQ ID NO: 620337 - DNA, 25 bp, Mus musculus
ggctccacaatcgacggcagattgg

SEQ ID NO: 620338 - DNA, 25 bp, Mus musculus
ggctccacacagactaacctaggca

SEQ ID NO: 620339 - DNA, 25 bp, Mus musculus
ggctccacacagtctaacctaggca

SEQ ID NO: 620340 - DNA, 25 bp, Mus musculus
ggctccacacatcaggttctgttac

SEQ ID NO: 620341 - DNA, 25 bp, Mus musculus
ggctccacacatgaggttctgttac

SEQ ID NO: 620342 - DNA, 25 bp, Mus musculus
ggctccacacggatgttttagtctc

SEQ ID NO: 620343 - DNA, 25 bp, Mus musculus
ggctccacacggttgttttagtctc

SEQ ID NO: 620344 - DNA, 25 bp, Mus musculus
ggctccacagtgacattcatgttgc

SEQ ID NO: 620345 - DNA, 25 bp, Mus musculus
ggctccacagtgctccacataggaa

SEQ ID NO: 620346 - DNA, 25 bp, Mus musculus
ggctccacagtggtccacataggaa

SEQ ID NO: 620347 - DNA, 25 bp, Mus musculus
ggctccacagtgtcattcatgttgc

SEQ ID NO: 620348 - DNA, 25 bp, Mus musculus
ggctccacagttaagggtactcatt

SEQ ID NO: 620349 - DNA, 25 bp, Mus musculus
ggctccacagtttagggtactcatt

SEQ ID NO: 620350 - DNA, 25 bp, Mus musculus
ggctccacccagaggacagaggaca

SEQ ID NO: 620351 - DNA, 25 bp, Mus musculus
ggctccacccagtggacagaggaca

SEQ ID NO: 620352 - DNA, 25 bp, Mus musculus
ggctccacctaaccactaccttata

SEQ ID NO: 620353 - DNA, 25 bp, Mus musculus
ggctccacctaagcactaccttata

SEQ ID NO: 620354 - DNA, 25 bp, Mus musculus
ggctccacgaaacatatctctgtct

SEQ ID NO: 620355 - DNA, 25 bp, Mus musculus
ggctccacgaaagatatctctgtct

SEQ ID NO: 620356 - DNA, 25 bp, Mus musculus
ggctccacgcttatgctgtccttga

SEQ ID NO: 620357 - DNA, 25 bp, Mus musculus
ggctccacgcttttgctgtccttga

SEQ ID NO: 620358 - DNA, 25 bp, Mus musculus
ggctccacggaccaaataaaagtgt

SEQ ID NO: 620359 - DNA, 25 bp, Mus musculus
ggctccacggacgaaataaaagtgt

SEQ ID NO: 620360 - DNA, 25 bp, Mus musculus
ggctccacgggtctgtcactgcagt

SEQ ID NO: 620361 - DNA, 25 bp, Mus musculus
ggctccacgggtgtgtcactgcagt

SEQ ID NO: 620362 - DNA, 25 bp, Mus musculus
ggctccacggttacggatgtttaga

SEQ ID NO: 620363 - DNA, 25 bp, Mus musculus
ggctccacggtttcggatgtttaga

SEQ ID NO: 620364 - DNA, 25 bp, Mus musculus
ggctccacgtacagagtatgtggcc

SEQ ID NO: 620365 - DNA, 25 bp, Mus musculus
ggctccacgtactgagtatgtggcc

SEQ ID NO: 620366 - DNA, 25 bp, Mus musculus
ggctccagaaaaacccgggtgcctg

SEQ ID NO: 620367 - DNA, 25 bp, Mus musculus
ggctccagaaaatcccgggtgcctg

SEQ ID NO: 620368 - DNA, 25 bp, Mus musculus
ggctccagagagcattcattaagag

SEQ ID NO: 620369 - DNA, 25 bp, Mus musculus
ggctccagagaggattcattaagag

SEQ ID NO: 620370 - DNA, 25 bp, Mus musculus
ggctccagaggacaaagggactttt

SEQ ID NO: 620371 - DNA, 25 bp, Mus musculus
ggctccagaggagaaagggactttt

SEQ ID NO: 620372 - DNA, 25 bp, Mus musculus
ggctccagaggtataaccacagcat

SEQ ID NO: 620373 - DNA, 25 bp, Mus musculus
ggctccagaggtttaaccacagcat

SEQ ID NO: 620374 - DNA, 25 bp, Mus musculus
ggctccagagtcaggatcatgtgct

SEQ ID NO: 620375 - DNA, 25 bp, Mus musculus
ggctccagagtctggatcatgtgct

SEQ ID NO: 620376 - DNA, 25 bp, Mus musculus
ggctccagatcaaacttcacgtggt

SEQ ID NO: 620377 - DNA, 25 bp, Mus musculus
ggctccagatcatacttcacgtggt

SEQ ID NO: 620378 - DNA, 25 bp, Mus musculus
ggctccagccatccagttgatttag

SEQ ID NO: 620379 - DNA, 25 bp, Mus musculus
ggctccagccatgcagttgatttag

SEQ ID NO: 620380 - DNA, 25 bp, Mus musculus
ggctccagcttaagcagactgttga

SEQ ID NO: 620381 - DNA, 25 bp, Mus musculus
ggctccagcttactgaatccaatga

SEQ ID NO: 620382 - DNA, 25 bp, Mus musculus
ggctccagcttagtgaatccaatga

SEQ ID NO: 620383 - DNA, 25 bp, Mus musculus
ggctccagcttatgcagactgttga

SEQ ID NO: 620384 - DNA, 25 bp, Mus musculus
ggctccagcttcatagacagtgtgt

SEQ ID NO: 620385 - DNA, 25 bp, Mus musculus
ggctccagcttcttagacagtgtgt

SEQ ID NO: 620386 - DNA, 25 bp, Mus musculus
ggctccaggagaatgcttggtcagt

SEQ ID NO: 620387 - DNA, 25 bp, Mus musculus
ggctccaggagattgcttggtcagt

SEQ ID NO: 620388 - DNA, 25 bp, Mus musculus
ggctccaggagtatcttcattgggt

SEQ ID NO: 620389 - DNA, 25 bp, Mus musculus
ggctccaggagtttcttcattgggt

SEQ ID NO: 620390 - DNA, 25 bp, Mus musculus
ggctccaggatgatatacaaaagtt

SEQ ID NO: 620391 - DNA, 25 bp, Mus musculus
ggctccaggatgttatacaaaagtt

SEQ ID NO: 620392 - DNA, 25 bp, Mus musculus
ggctccaggctccatatgagacgca

SEQ ID NO: 620393 - DNA, 25 bp, Mus musculus
ggctccaggctcgatatgagacgca

SEQ ID NO: 620394 - DNA, 25 bp, Mus musculus
ggctccagggagcattttctgttgc

SEQ ID NO: 620395 - DNA, 25 bp, Mus musculus
ggctccagggaggattttctgttgc

SEQ ID NO: 620396 - DNA, 25 bp, Mus musculus
ggctccagggctccgctgtaactga

SEQ ID NO: 620397 - DNA, 25 bp, Mus musculus
ggctccagggctgcgctgtaactga

SEQ ID NO: 620398 - DNA, 25 bp, Mus musculus
ggctccaggtctcagtgaaaaacat

SEQ ID NO: 620399 - DNA, 25 bp, Mus musculus
ggctccaggtctgagtgaaaaacat

SEQ ID NO: 620400 - DNA, 25 bp, Mus musculus
ggctccagtgagacccgtggtgaac

SEQ ID NO: 620401 - DNA, 25 bp, Mus musculus
ggctccagtgagtcccgtggtgaac

SEQ ID NO: 620402 - DNA, 25 bp, Mus musculus
ggctccagtgccatatccaagaaga

SEQ ID NO: 620403 - DNA, 25 bp, Mus musculus
ggctccagtgccttatccaagaaga

SEQ ID NO: 620404 - DNA, 25 bp, Mus musculus
ggctccagtggtaccgggtctcagt

SEQ ID NO: 620405 - DNA, 25 bp, Mus musculus
ggctccagtggttccgggtctcagt

SEQ ID NO: 620406 - DNA, 25 bp, Mus musculus
ggctccagtgtcagtcaggtagcga

SEQ ID NO: 620407 - DNA, 25 bp, Mus musculus
ggctccagtgtctgtcaggtagcga

SEQ ID NO: 620408 - DNA, 25 bp, Mus musculus
ggctccagtgttattagaatgatat

SEQ ID NO: 620409 - DNA, 25 bp, Mus musculus
ggctccagtgtttttagaatgatat

SEQ ID NO: 620410 - DNA, 25 bp, Mus musculus
ggctccagttaacctctgtctgaca

SEQ ID NO: 620411 - DNA, 25 bp, Mus musculus
ggctccagttaagctctgtctgaca

SEQ ID NO: 620412 - DNA, 25 bp, Mus musculus
ggctccataaccatgtgcttgccta

SEQ ID NO: 620413 - DNA, 25 bp, Mus musculus
ggctccataaccttgtgcttgccta

SEQ ID NO: 620414 - DNA, 25 bp, Mus musculus
ggctccatactgactcaagcaagaa

SEQ ID NO: 620415 - DNA, 25 bp, Mus musculus
ggctccatactgtctcaagcaagaa

SEQ ID NO: 620416 - DNA, 25 bp, Mus musculus
ggctccatcaggagcaaaggataac

SEQ ID NO: 620417 - DNA, 25 bp, Mus musculus
ggctccatcaggtgcaaaggataac

SEQ ID NO: 620418 - DNA, 25 bp, Mus musculus
ggctccatcatgatcttatgtggga

SEQ ID NO: 620419 - DNA, 25 bp, Mus musculus
ggctccatcatgttcttatgtggga

SEQ ID NO: 620420 - DNA, 25 bp, Mus musculus
ggctccatcccaactacaggagtag

SEQ ID NO: 620421 - DNA, 25 bp, Mus musculus
ggctccatcccatctacaggagtag

SEQ ID NO: 620422 - DNA, 25 bp, Mus musculus
ggctccatcttgccctcactgtcca

SEQ ID NO: 620423 - DNA, 25 bp, Mus musculus
ggctccatcttggcctcactgtcca

SEQ ID NO: 620424 - DNA, 25 bp, Mus musculus
ggctccatgataagagcagttgcct

SEQ ID NO: 620425 - DNA, 25 bp, Mus musculus
ggctccatgatatgagcagttgcct

SEQ ID NO: 620426 - DNA, 25 bp, Mus musculus
ggctccatgctgctgcttgttaaaa

SEQ ID NO: 620427 - DNA, 25 bp, Mus musculus
ggctccatgctggtgcttgttaaaa

SEQ ID NO: 620428 - DNA, 25 bp, Mus musculus
ggctccatgcttctccaccagaagg

SEQ ID NO: 620429 - DNA, 25 bp, Mus musculus
ggctccatgcttgtccaccagaagg

SEQ ID NO: 620430 - DNA, 25 bp, Mus musculus
ggctccatgggcacccaggtatgca

SEQ ID NO: 620431 - DNA, 25 bp, Mus musculus
ggctccatgggctcccaggtatgca

SEQ ID NO: 620432 - DNA, 25 bp, Mus musculus
ggctccatgtacaagagtctttgct

SEQ ID NO: 620433 - DNA, 25 bp, Mus musculus
ggctccatgtactagagtctttgct

SEQ ID NO: 620434 - DNA, 25 bp, Mus musculus
ggctccatgtataaatccaggtgtt

SEQ ID NO: 620435 - DNA, 25 bp, Mus musculus
ggctccatgtattaatccaggtgtt

SEQ ID NO: 620436 - DNA, 25 bp, Mus musculus
ggctccatgtgccagaagctcaaat

SEQ ID NO: 620437 - DNA, 25 bp, Mus musculus
ggctccatgtgcgagaagctcaaat

SEQ ID NO: 620438 - DNA, 25 bp, Mus musculus
ggctccattggacttctttgggtaa

SEQ ID NO: 620439 - DNA, 25 bp, Mus musculus
ggctccattggagttctttgggtaa

SEQ ID NO: 620440 - DNA, 25 bp, Mus musculus
ggctccattggccacaagggtctac

SEQ ID NO: 620441 - DNA, 25 bp, Mus musculus
ggctccattggcgacaagggtctac

SEQ ID NO: 620442 - DNA, 25 bp, Mus musculus
ggctccattgttagttccaatccat

SEQ ID NO: 620443 - DNA, 25 bp, Mus musculus
ggctccattgtttgttccaatccat

SEQ ID NO: 620444 - DNA, 25 bp, Mus musculus
ggctccatttccaacagaagtgcta

SEQ ID NO: 620445 - DNA, 25 bp, Mus musculus
ggctccatttcctacagaagtgcta

SEQ ID NO: 620446 - DNA, 25 bp, Mus musculus
ggctccattttaaccaattcagtat

SEQ ID NO: 620447 - DNA, 25 bp, Mus musculus
ggctccattttatccaattcagtat

SEQ ID NO: 620448 - DNA, 25 bp, Mus musculus
ggctcccaatcccatggaacagaaa

SEQ ID NO: 620449 - DNA, 25 bp, Mus musculus
ggctcccaatccgatggaacagaaa

SEQ ID NO: 620450 - DNA, 25 bp, Mus musculus
ggctcccaattcagcttagtttgta

SEQ ID NO: 620451 - DNA, 25 bp, Mus musculus
ggctcccaattctgcttagtttgta

SEQ ID NO: 620452 - DNA, 25 bp, Mus musculus
ggctcccacactattcagatatgca

SEQ ID NO: 620453 - DNA, 25 bp, Mus musculus
ggctcccacacttttcagatatgca

SEQ ID NO: 620454 - DNA, 25 bp, Mus musculus
ggctcccacgaacccagtgtgttaa

SEQ ID NO: 620455 - DNA, 25 bp, Mus musculus
ggctcccacgaagccagtgtgttaa

SEQ ID NO: 620456 - DNA, 25 bp, Mus musculus
ggctcccacggtcacttgtttacag

SEQ ID NO: 620457 - DNA, 25 bp, Mus musculus
ggctcccacggtgacttgtttacag

SEQ ID NO: 620458 - DNA, 25 bp, Mus musculus
ggctcccactgaagcgatggttttt

SEQ ID NO: 620459 - DNA, 25 bp, Mus musculus
ggctcccactgatgcgatggttttt

SEQ ID NO: 620460 - DNA, 25 bp, Mus musculus
ggctcccagaacatacttgtctgca

SEQ ID NO: 620461 - DNA, 25 bp, Mus musculus
ggctcccagaacttacttgtctgca

SEQ ID NO: 620462 - DNA, 25 bp, Mus musculus
ggctcccagaagctagtcactcagg

SEQ ID NO: 620463 - DNA, 25 bp, Mus musculus
ggctcccagaaggtagtcactcagg

SEQ ID NO: 620464 - DNA, 25 bp, Mus musculus
ggctcccagccaactgcaacaggga

SEQ ID NO: 620465 - DNA, 25 bp, Mus musculus
ggctcccagccatctgcaacaggga

SEQ ID NO: 620466 - DNA, 25 bp, Mus musculus
ggctcccagcctatggtacgaaaga

SEQ ID NO: 620467 - DNA, 25 bp, Mus musculus
ggctcccagcctttggtacgaaaga

SEQ ID NO: 620468 - DNA, 25 bp, Mus musculus
ggctcccaggaaaggtcgctcagtg

SEQ ID NO: 620469 - DNA, 25 bp, Mus musculus
ggctcccaggaatggtcgctcagtg

SEQ ID NO: 620470 - DNA, 25 bp, Mus musculus
ggctcccaggagatgtacagacttc

SEQ ID NO: 620471 - DNA, 25 bp, Mus musculus
ggctcccaggagttgtacagacttc

SEQ ID NO: 620472 - DNA, 25 bp, Mus musculus
ggctcccaggccagtgctcagagag

SEQ ID NO: 620473 - DNA, 25 bp, Mus musculus
ggctcccaggcctgtgctcagagag

SEQ ID NO: 620474 - DNA, 25 bp, Mus musculus
ggctcccagtaacttctgacttttt

SEQ ID NO: 620475 - DNA, 25 bp, Mus musculus
ggctcccagtaagttctgacttttt

SEQ ID NO: 620476 - DNA, 25 bp, Mus musculus
ggctcccagtgaactttgtatgtga

SEQ ID NO: 620477 - DNA, 25 bp, Mus musculus
ggctcccagtgatctttgtatgtga

SEQ ID NO: 620478 - DNA, 25 bp, Mus musculus
ggctcccagtttaccagtttgaggt

SEQ ID NO: 620479 - DNA, 25 bp, Mus musculus
ggctcccagtttcgctacattatca

SEQ ID NO: 620480 - DNA, 25 bp, Mus musculus
ggctcccagtttctcctgtacaaat

SEQ ID NO: 620481 - DNA, 25 bp, Mus musculus
ggctcccagtttggctacattatca

SEQ ID NO: 620482 - DNA, 25 bp, Mus musculus
ggctcccagtttgtcctgtacaaat

SEQ ID NO: 620483 - DNA, 25 bp, Mus musculus
ggctcccagttttccagtttgaggt

SEQ ID NO: 620484 - DNA, 25 bp, Mus musculus
ggctcccatgagacttcactagaaa

SEQ ID NO: 620485 - DNA, 25 bp, Mus musculus
ggctcccatgagtcttcactagaaa

SEQ ID NO: 620486 - DNA, 25 bp, Mus musculus
ggctcccatgccaggtgtatagaca

SEQ ID NO: 620487 - DNA, 25 bp, Mus musculus
ggctcccatgcccaagtcaatgtga

SEQ ID NO: 620488 - DNA, 25 bp, Mus musculus
ggctcccatgccgaagtcaatgtga

SEQ ID NO: 620489 - DNA, 25 bp, Mus musculus
ggctcccatgcctggtgtatagaca

SEQ ID NO: 620490 - DNA, 25 bp, Mus musculus
ggctccccacagaaaggaatgctgt

SEQ ID NO: 620491 - DNA, 25 bp, Mus musculus
ggctccccacagattgtgaggccat

SEQ ID NO: 620492 - DNA, 25 bp, Mus musculus
ggctccccacagtaaggaatgctgt

SEQ ID NO: 620493 - DNA, 25 bp, Mus musculus
ggctccccacagtttgtgaggccat

SEQ ID NO: 620494 - DNA, 25 bp, Mus musculus
ggctccccagagagacgtttgaatg

SEQ ID NO: 620495 - DNA, 25 bp, Mus musculus
ggctccccagagtgacgtttgaatg

SEQ ID NO: 620496 - DNA, 25 bp, Mus musculus
ggctccccagcaaatgcacagggta

SEQ ID NO: 620497 - DNA, 25 bp, Mus musculus
ggctccccagcatatgcacagggta

SEQ ID NO: 620498 - DNA, 25 bp, Mus musculus
ggctccccggaaccattagagacta

SEQ ID NO: 620499 - DNA, 25 bp, Mus musculus
ggctccccggaagcattagagacta

SEQ ID NO: 620500 - DNA, 25 bp, Mus musculus
ggctcccctggaatatttaacctat

SEQ ID NO: 620501 - DNA, 25 bp, Mus musculus
ggctcccctggattatttaacctat

SEQ ID NO: 620502 - DNA, 25 bp, Mus musculus
ggctcccgacatcggactagaggac

SEQ ID NO: 620503 - DNA, 25 bp, Mus musculus
ggctcccgacatgggactagaggac

SEQ ID NO: 620504 - DNA, 25 bp, Mus musculus
ggctcccgaggacactgtgcagaac

SEQ ID NO: 620505 - DNA, 25 bp, Mus musculus
ggctcccgaggagactgtgcagaac

SEQ ID NO: 620506 - DNA, 25 bp, Mus musculus
ggctcccgagtaagcatgaaaccag

SEQ ID NO: 620507 - DNA, 25 bp, Mus musculus
ggctcccgagtatgcatgaaaccag

SEQ ID NO: 620508 - DNA, 25 bp, Mus musculus
ggctcccgggtgaagtttcatggta

SEQ ID NO: 620509 - DNA, 25 bp, Mus musculus
ggctcccgggtgtagtttcatggta

SEQ ID NO: 620510 - DNA, 25 bp, Mus musculus
ggctcccggtaaatccattgtacag

SEQ ID NO: 620511 - DNA, 25 bp, Mus musculus
ggctcccggtaattccattgtacag

SEQ ID NO: 620512 - DNA, 25 bp, Mus musculus
ggctccctatctctagtagaggcaa

SEQ ID NO: 620513 - DNA, 25 bp, Mus musculus
ggctccctatctgtagtagaggcaa

SEQ ID NO: 620514 - DNA, 25 bp, Mus musculus
ggctccctatgaattcaggtcaggt

SEQ ID NO: 620515 - DNA, 25 bp, Mus musculus
ggctccctatgatttcaggtcaggt

SEQ ID NO: 620516 - DNA, 25 bp, Mus musculus
ggctccctcgtacgaagcagccatg

SEQ ID NO: 620517 - DNA, 25 bp, Mus musculus
ggctccctcgtaggaagcagccatg

SEQ ID NO: 620518 - DNA, 25 bp, Mus musculus
ggctccctctgtagactaagttctg

SEQ ID NO: 620519 - DNA, 25 bp, Mus musculus
ggctccctctgttgactaagttctg

SEQ ID NO: 620520 - DNA, 25 bp, Mus musculus
ggctccctgagaatgtgtctgtcat

SEQ ID NO: 620521 - DNA, 25 bp, Mus musculus
ggctccctgagattgtgtctgtcat

SEQ ID NO: 620522 - DNA, 25 bp, Mus musculus
ggctccctgagtaaggccaagacta

SEQ ID NO: 620523 - DNA, 25 bp, Mus musculus
ggctccctgagttaggccaagacta

SEQ ID NO: 620524 - DNA, 25 bp, Mus musculus
ggctccctggatctttgtttgatca

SEQ ID NO: 620525 - DNA, 25 bp, Mus musculus
ggctccctggatgtttgtttgatca

SEQ ID NO: 620526 - DNA, 25 bp, Mus musculus
ggctccctgggcaacggctagatag

SEQ ID NO: 620527 - DNA, 25 bp, Mus musculus
ggctccctgggctacggctagatag

SEQ ID NO: 620528 - DNA, 25 bp, Mus musculus
ggctccctggtcagataggccgaga

SEQ ID NO: 620529 - DNA, 25 bp, Mus musculus
ggctccctggtctgataggccgaga

SEQ ID NO: 620530 - DNA, 25 bp, Mus musculus
ggctccctgtgaaactcttgcatac

SEQ ID NO: 620531 - DNA, 25 bp, Mus musculus
ggctccctgtgatactcttgcatac

SEQ ID NO: 620532 - DNA, 25 bp, Mus musculus
ggctcccttctaagggatccccaaa

SEQ ID NO: 620533 - DNA, 25 bp, Mus musculus
ggctcccttctatgggatccccaaa

SEQ ID NO: 620534 - DNA, 25 bp, Mus musculus
ggctcccttgaaatggaagtcagtg

SEQ ID NO: 620535 - DNA, 25 bp, Mus musculus
ggctcccttgaattggaagtcagtg

SEQ ID NO: 620536 - DNA, 25 bp, Mus musculus
ggctcccttgagcaaatggaacaaa

SEQ ID NO: 620537 - DNA, 25 bp, Mus musculus
ggctcccttgaggaaatggaacaaa

SEQ ID NO: 620538 - DNA, 25 bp, Mus musculus
ggctcccttgggaatcaatttcctg

SEQ ID NO: 620539 - DNA, 25 bp, Mus musculus
ggctcccttgggtatcaatttcctg

SEQ ID NO: 620540 - DNA, 25 bp, Mus musculus
ggctccctttctcttgagagtagta

SEQ ID NO: 620541 - DNA, 25 bp, Mus musculus
ggctccctttctgttgagagtagta

SEQ ID NO: 620542 - DNA, 25 bp, Mus musculus
ggctccgaatcactgccagtgtgca

SEQ ID NO: 620543 - DNA, 25 bp, Mus musculus
ggctccgaatcagtgccagtgtgca

SEQ ID NO: 620544 - DNA, 25 bp, Mus musculus
ggctccgaattaaatccctaacaca

SEQ ID NO: 620545 - DNA, 25 bp, Mus musculus
ggctccgaattatatccctaacaca

SEQ ID NO: 620546 - DNA, 25 bp, Mus musculus
ggctccgagaatacttggtaggact

SEQ ID NO: 620547 - DNA, 25 bp, Mus musculus
ggctccgagaattcttggtaggact

SEQ ID NO: 620548 - DNA, 25 bp, Mus musculus
ggctccgccacaatgatggtcggga

SEQ ID NO: 620549 - DNA, 25 bp, Mus musculus
ggctccgccacattgatggtcggga

SEQ ID NO: 620550 - DNA, 25 bp, Mus musculus
ggctccggaactatgtcccagagga

SEQ ID NO: 620551 - DNA, 25 bp, Mus musculus
ggctccggaactttgtcccagagga

SEQ ID NO: 620552 - DNA, 25 bp, Mus musculus
ggctccggaagtcctcgatgaaacc

SEQ ID NO: 620553 - DNA, 25 bp, Mus musculus
ggctccggaagtgctcgatgaaacc

SEQ ID NO: 620554 - DNA, 25 bp, Mus musculus
ggctccggagacaaatttctcttgt

SEQ ID NO: 620555 - DNA, 25 bp, Mus musculus
ggctccggagactaatttctcttgt

SEQ ID NO: 620556 - DNA, 25 bp, Mus musculus
ggctccggatgcaaactgctgagag

SEQ ID NO: 620557 - DNA, 25 bp, Mus musculus
ggctccggatgctaactgctgagag

SEQ ID NO: 620558 - DNA, 25 bp, Mus musculus
ggctccggtggcctgctaacctagt

SEQ ID NO: 620559 - DNA, 25 bp, Mus musculus
ggctccggtggcgtgctaacctagt

SEQ ID NO: 620560 - DNA, 25 bp, Mus musculus
ggctccgtatctactacatggaaaa

SEQ ID NO: 620561 - DNA, 25 bp, Mus musculus
ggctccgtatcttctacatggaaaa

SEQ ID NO: 620562 - DNA, 25 bp, Mus musculus
ggctccgtcactctgaatgccgact

SEQ ID NO: 620563 - DNA, 25 bp, Mus musculus
ggctccgtcactgtgaatgccgact

SEQ ID NO: 620564 - DNA, 25 bp, Mus musculus
ggctccgtcttcacttctcagggag

SEQ ID NO: 620565 - DNA, 25 bp, Mus musculus
ggctccgtcttctcttctcagggag

SEQ ID NO: 620566 - DNA, 25 bp, Mus musculus
ggctccgtgtcgctgacttctcttt

SEQ ID NO: 620567 - DNA, 25 bp, Mus musculus
ggctccgtgtcggtgacttctcttt

SEQ ID NO: 620568 - DNA, 25 bp, Mus musculus
ggctccgtttgaaccacttaaggtg

SEQ ID NO: 620569 - DNA, 25 bp, Mus musculus
ggctccgtttgatccacttaaggtg

SEQ ID NO: 620570 - DNA, 25 bp, Mus musculus
ggctcctaactaccaaacacttagt

SEQ ID NO: 620571 - DNA, 25 bp, Mus musculus
ggctcctaactagcaaacacttagt

SEQ ID NO: 620572 - DNA, 25 bp, Mus musculus
ggctcctacactactgttactggga

SEQ ID NO: 620573 - DNA, 25 bp, Mus musculus
ggctcctacacttctgttactggga

SEQ ID NO: 620574 - DNA, 25 bp, Mus musculus
ggctcctacagaccaagaattacga

SEQ ID NO: 620575 - DNA, 25 bp, Mus musculus
ggctcctacagagcaagaattacga

SEQ ID NO: 620576 - DNA, 25 bp, Mus musculus
ggctcctacttgacatttccttttt

SEQ ID NO: 620577 - DNA, 25 bp, Mus musculus
ggctcctacttgtcatttccttttt

SEQ ID NO: 620578 - DNA, 25 bp, Mus musculus
ggctcctagctcagatccgagtcat

SEQ ID NO: 620579 - DNA, 25 bp, Mus musculus
ggctcctagctctgatccgagtcat

SEQ ID NO: 620580 - DNA, 25 bp, Mus musculus
ggctcctagggcagaacacattctt

SEQ ID NO: 620581 - DNA, 25 bp, Mus musculus
ggctcctagggcagggtacctctca

SEQ ID NO: 620582 - DNA, 25 bp, Mus musculus
ggctcctagggctgaacacattctt

SEQ ID NO: 620583 - DNA, 25 bp, Mus musculus
ggctcctagggctgggtacctctca

SEQ ID NO: 620584 - DNA, 25 bp, Mus musculus
ggctcctatgaaacctcttagggaa

SEQ ID NO: 620585 - DNA, 25 bp, Mus musculus
ggctcctatgaatcctcttagggaa

SEQ ID NO: 620586 - DNA, 25 bp, Mus musculus
ggctcctattagattttgccaggtc

SEQ ID NO: 620587 - DNA, 25 bp, Mus musculus
ggctcctattagtttttgccaggtc

SEQ ID NO: 620588 - DNA, 25 bp, Mus musculus
ggctcctattgcaatttactgattc

SEQ ID NO: 620589 - DNA, 25 bp, Mus musculus
ggctcctattgctatttactgattc

SEQ ID NO: 620590 - DNA, 25 bp, Mus musculus
ggctcctcaactacagtaccaaagg

SEQ ID NO: 620591 - DNA, 25 bp, Mus musculus
ggctcctcaacttcagtaccaaagg

SEQ ID NO: 620592 - DNA, 25 bp, Mus musculus
ggctcctcagacatcaaggcttgaa

SEQ ID NO: 620593 - DNA, 25 bp, Mus musculus
ggctcctcagacttcaaggcttgaa

SEQ ID NO: 620594 - DNA, 25 bp, Mus musculus
ggctcctcatccatccaagggcagt

SEQ ID NO: 620595 - DNA, 25 bp, Mus musculus
ggctcctcatccttccaagggcagt

SEQ ID NO: 620596 - DNA, 25 bp, Mus musculus
ggctcctcatctctgaagcttgaga

SEQ ID NO: 620597 - DNA, 25 bp, Mus musculus
ggctcctcatctgtgaagcttgaga

SEQ ID NO: 620598 - DNA, 25 bp, Mus musculus
ggctcctcattaatcttctggaacc

SEQ ID NO: 620599 - DNA, 25 bp, Mus musculus
ggctcctcattattcttctggaacc

SEQ ID NO: 620600 - DNA, 25 bp, Mus musculus
ggctcctccaacacagggcaaaagt

SEQ ID NO: 620601 - DNA, 25 bp, Mus musculus
ggctcctccaactcagggcaaaagt

SEQ ID NO: 620602 - DNA, 25 bp, Mus musculus
ggctcctccaccaggtatgagacca

SEQ ID NO: 620603 - DNA, 25 bp, Mus musculus
ggctcctccacctggtatgagacca

SEQ ID NO: 620604 - DNA, 25 bp, Mus musculus
ggctcctccagcacaatggtctgaa

SEQ ID NO: 620605 - DNA, 25 bp, Mus musculus
ggctcctccagctcaatggtctgaa

SEQ ID NO: 620606 - DNA, 25 bp, Mus musculus
ggctcctccatcacggttctgaaga

SEQ ID NO: 620607 - DNA, 25 bp, Mus musculus
ggctcctccatcagtgagggcagtc

SEQ ID NO: 620608 - DNA, 25 bp, Mus musculus
ggctcctccatctcggttctgaaga

SEQ ID NO: 620609 - DNA, 25 bp, Mus musculus
ggctcctccatctgtgagggcagtc

SEQ ID NO: 620610 - DNA, 25 bp, Mus musculus
ggctcctcctaaaatgtatggcttt

SEQ ID NO: 620611 - DNA, 25 bp, Mus musculus
ggctcctcctaatatgtatggcttt

SEQ ID NO: 620612 - DNA, 25 bp, Mus musculus
ggctcctccttgatagggcctgagt

SEQ ID NO: 620613 - DNA, 25 bp, Mus musculus
ggctcctccttgttagggcctgagt

SEQ ID NO: 620614 - DNA, 25 bp, Mus musculus
ggctcctctaaaatggttccagtgg

SEQ ID NO: 620615 - DNA, 25 bp, Mus musculus
ggctcctctaaattggttccagtgg

SEQ ID NO: 620616 - DNA, 25 bp, Mus musculus
ggctcctctctgctgagtactgcaa

SEQ ID NO: 620617 - DNA, 25 bp, Mus musculus
ggctcctctctggtgagtactgcaa

SEQ ID NO: 620618 - DNA, 25 bp, Mus musculus
ggctcctctggcacaggagatgtct

SEQ ID NO: 620619 - DNA, 25 bp, Mus musculus
ggctcctctggctcaggagatgtct

SEQ ID NO: 620620 - DNA, 25 bp, Mus musculus
ggctcctctttaatgatcctggtct

SEQ ID NO: 620621 - DNA, 25 bp, Mus musculus
ggctcctctttattgatcctggtct

SEQ ID NO: 620622 - DNA, 25 bp, Mus musculus
ggctcctgaagaagtccttcctttc

SEQ ID NO: 620623 - DNA, 25 bp, Mus musculus
ggctcctgaagatgtccttcctttc

SEQ ID NO: 620624 - DNA, 25 bp, Mus musculus
ggctcctgacgtctctgtcctttaa

SEQ ID NO: 620625 - DNA, 25 bp, Mus musculus
ggctcctgacgtgtctgtcctttaa

SEQ ID NO: 620626 - DNA, 25 bp, Mus musculus
ggctcctgacttcatatttagctca

SEQ ID NO: 620627 - DNA, 25 bp, Mus musculus
ggctcctgacttgatatttagctca

SEQ ID NO: 620628 - DNA, 25 bp, Mus musculus
ggctcctgataaatcttccagagag

SEQ ID NO: 620629 - DNA, 25 bp, Mus musculus
ggctcctgataattcttccagagag

SEQ ID NO: 620630 - DNA, 25 bp, Mus musculus
ggctcctgatatcgacactctacag

SEQ ID NO: 620631 - DNA, 25 bp, Mus musculus
ggctcctgatatggacactctacag

SEQ ID NO: 620632 - DNA, 25 bp, Mus musculus
ggctcctgcagaattggtgtctgaa

SEQ ID NO: 620633 - DNA, 25 bp, Mus musculus
ggctcctgcagatttggtgtctgaa

SEQ ID NO: 620634 - DNA, 25 bp, Mus musculus
ggctcctgcattacatggtttgtgt

SEQ ID NO: 620635 - DNA, 25 bp, Mus musculus
ggctcctgcatttcatggtttgtgt

SEQ ID NO: 620636 - DNA, 25 bp, Mus musculus
ggctcctgccctctgctgtgggaac

SEQ ID NO: 620637 - DNA, 25 bp, Mus musculus
ggctcctgccctgtgctgtgggaac

SEQ ID NO: 620638 - DNA, 25 bp, Mus musculus
ggctcctgctatccagtgcaaggaa

SEQ ID NO: 620639 - DNA, 25 bp, Mus musculus
ggctcctgctatgcagtgcaaggaa

SEQ ID NO: 620640 - DNA, 25 bp, Mus musculus
ggctcctggaatctacagagctgga

SEQ ID NO: 620641 - DNA, 25 bp, Mus musculus
ggctcctggaatgtacagagctgga

SEQ ID NO: 620642 - DNA, 25 bp, Mus musculus
ggctcctggatacatgatgttgata

SEQ ID NO: 620643 - DNA, 25 bp, Mus musculus
ggctcctggatagatgatgttgata

SEQ ID NO: 620644 - DNA, 25 bp, Mus musculus
ggctcctggctgatgattcggtaac

SEQ ID NO: 620645 - DNA, 25 bp, Mus musculus
ggctcctggctgttgattcggtaac

SEQ ID NO: 620646 - DNA, 25 bp, Mus musculus
ggctcctgggaaccaatgggaatca

SEQ ID NO: 620647 - DNA, 25 bp, Mus musculus
ggctcctgggaagcaatgggaatca

SEQ ID NO: 620648 - DNA, 25 bp, Mus musculus
ggctcctgggacatacatgtagagt

SEQ ID NO: 620649 - DNA, 25 bp, Mus musculus
ggctcctgggacttacatgtagagt

SEQ ID NO: 620650 - DNA, 25 bp, Mus musculus
ggctcctggttcagtctgatactga

SEQ ID NO: 620651 - DNA, 25 bp, Mus musculus
ggctcctggttctgtctgatactga

SEQ ID NO: 620652 - DNA, 25 bp, Mus musculus
ggctcctgtaaaaggactccctaca

SEQ ID NO: 620653 - DNA, 25 bp, Mus musculus
ggctcctgtaaatggactccctaca

SEQ ID NO: 620654 - DNA, 25 bp, Mus musculus
ggctcctgtcaaagattaagttaat

SEQ ID NO: 620655 - DNA, 25 bp, Mus musculus
ggctcctgtcaatgattaagttaat

SEQ ID NO: 620656 - DNA, 25 bp, Mus musculus
ggctcctgtctgcacatttctaaag

SEQ ID NO: 620657 - DNA, 25 bp, Mus musculus
ggctcctgtctggacatttctaaag

SEQ ID NO: 620658 - DNA, 25 bp, Mus musculus
ggctcctgttaactgtgtgattcca

SEQ ID NO: 620659 - DNA, 25 bp, Mus musculus
ggctcctgttaagtgtgtgattcca

SEQ ID NO: 620660 - DNA, 25 bp, Mus musculus
ggctcctgttctagatatccaatca

SEQ ID NO: 620661 - DNA, 25 bp, Mus musculus
ggctcctgttcttgatatccaatca

SEQ ID NO: 620662 - DNA, 25 bp, Mus musculus
ggctcctgttggactttattcaaga

SEQ ID NO: 620663 - DNA, 25 bp, Mus musculus
ggctcctgttggtctttattcaaga

SEQ ID NO: 620664 - DNA, 25 bp, Mus musculus
ggctcctgttttatagctgctgttc

SEQ ID NO: 620665 - DNA, 25 bp, Mus musculus
ggctcctgttttttagctgctgttc

SEQ ID NO: 620666 - DNA, 25 bp, Mus musculus
ggctccttaatcagataccctgaga

SEQ ID NO: 620667 - DNA, 25 bp, Mus musculus
ggctccttaatctgataccctgaga

SEQ ID NO: 620668 - DNA, 25 bp, Mus musculus
ggctccttacagcaatcagcctgtt

SEQ ID NO: 620669 - DNA, 25 bp, Mus musculus
ggctccttacaggaatcagcctgtt

SEQ ID NO: 620670 - DNA, 25 bp, Mus musculus
ggctccttacatagttgtcggcaat

SEQ ID NO: 620671 - DNA, 25 bp, Mus musculus
ggctccttacattgttgtcggcaat

SEQ ID NO: 620672 - DNA, 25 bp, Mus musculus
ggctccttagacaccagggatcttt

SEQ ID NO: 620673 - DNA, 25 bp, Mus musculus
ggctccttagactccagggatcttt

SEQ ID NO: 620674 - DNA, 25 bp, Mus musculus
ggctccttagtaccaactgttccag

SEQ ID NO: 620675 - DNA, 25 bp, Mus musculus
ggctccttagtagcaactgttccag

SEQ ID NO: 620676 - DNA, 25 bp, Mus musculus
ggctccttccaaaggttcaagtgtt

SEQ ID NO: 620677 - DNA, 25 bp, Mus musculus
ggctccttccaatggttcaagtgtt

SEQ ID NO: 620678 - DNA, 25 bp, Mus musculus
ggctccttccagcagtatactggtg

SEQ ID NO: 620679 - DNA, 25 bp, Mus musculus
ggctccttccaggagtatactggtg

SEQ ID NO: 620680 - DNA, 25 bp, Mus musculus
ggctccttcctgaggctgatggaac

SEQ ID NO: 620681 - DNA, 25 bp, Mus musculus
ggctccttcctgtggctgatggaac

SEQ ID NO: 620682 - DNA, 25 bp, Mus musculus
ggctccttcgagagtttgatttgta

SEQ ID NO: 620683 - DNA, 25 bp, Mus musculus
ggctccttcgagtgtttgatttgta

SEQ ID NO: 620684 - DNA, 25 bp, Mus musculus
ggctccttcttacatcttgttcaga

SEQ ID NO: 620685 - DNA, 25 bp, Mus musculus
ggctccttcttagatcttgttcaga

SEQ ID NO: 620686 - DNA, 25 bp, Mus musculus
ggctccttgacaccttctggtggat

SEQ ID NO: 620687 - DNA, 25 bp, Mus musculus
ggctccttgacagcttctggtggat

SEQ ID NO: 620688 - DNA, 25 bp, Mus musculus
ggctccttgacccacattaaattgg

SEQ ID NO: 620689 - DNA, 25 bp, Mus musculus
ggctccttgaccgacattaaattgg

SEQ ID NO: 620690 - DNA, 25 bp, Mus musculus
ggctccttgatgacatttccagtcg

SEQ ID NO: 620691 - DNA, 25 bp, Mus musculus
ggctccttgatgtcatttccagtcg

SEQ ID NO: 620692 - DNA, 25 bp, Mus musculus
ggctccttgcataggtttcctttgt

SEQ ID NO: 620693 - DNA, 25 bp, Mus musculus
ggctccttgcattggtttcctttgt

SEQ ID NO: 620694 - DNA, 25 bp, Mus musculus
ggctccttggccactggaaactaca

SEQ ID NO: 620695 - DNA, 25 bp, Mus musculus
ggctccttggcctctggaaactaca

SEQ ID NO: 620696 - DNA, 25 bp, Mus musculus
ggctccttgggtccatgtgtatagt

SEQ ID NO: 620697 - DNA, 25 bp, Mus musculus
ggctccttgggtgcatgtgtatagt

SEQ ID NO: 620698 - DNA, 25 bp, Mus musculus
ggctcctttagtaatctgagtcaag

SEQ ID NO: 620699 - DNA, 25 bp, Mus musculus
ggctcctttagttatctgagtcaag

SEQ ID NO: 620700 - DNA, 25 bp, Mus musculus
ggctcctttcttatgggcctatgag

SEQ ID NO: 620701 - DNA, 25 bp, Mus musculus
ggctcctttcttttgggcctatgag

SEQ ID NO: 620702 - DNA, 25 bp, Mus musculus
ggctcctttgacctggtccacgtga

SEQ ID NO: 620703 - DNA, 25 bp, Mus musculus
ggctcctttgacgtggtccacgtga

SEQ ID NO: 620704 - DNA, 25 bp, Mus musculus
ggctcctttgtgaacaacatacctt

SEQ ID NO: 620705 - DNA, 25 bp, Mus musculus
ggctcctttgtgtacaacatacctt

SEQ ID NO: 620706 - DNA, 25 bp, Mus musculus
ggctcctttgttcccagacatggga

SEQ ID NO: 620707 - DNA, 25 bp, Mus musculus
ggctcctttgttgccagacatggga

SEQ ID NO: 620708 - DNA, 25 bp, Mus musculus
ggctccttttccacttggcatatta

SEQ ID NO: 620709 - DNA, 25 bp, Mus musculus
ggctccttttcctcttggcatatta

SEQ ID NO: 620710 - DNA, 25 bp, Mus musculus
ggctcctttttaaatgttcaaccaa

SEQ ID NO: 620711 - DNA, 25 bp, Mus musculus
ggctcctttttaactctttagctag

SEQ ID NO: 620712 - DNA, 25 bp, Mus musculus
ggctcctttttatatgttcaaccaa

SEQ ID NO: 620713 - DNA, 25 bp, Mus musculus
ggctcctttttatctctttagctag

SEQ ID NO: 620714 - DNA, 25 bp, Mus musculus
ggctcgaatgagatccactagcatg

SEQ ID NO: 620715 - DNA, 25 bp, Mus musculus
ggctcgaatgagttccactagcatg

SEQ ID NO: 620716 - DNA, 25 bp, Mus musculus
ggctcgacctccagggtgatggtct

SEQ ID NO: 620717 - DNA, 25 bp, Mus musculus
ggctcgacctcctgggtgatggtct

SEQ ID NO: 620718 - DNA, 25 bp, Mus musculus
ggctcgactccaataaagacttttc

SEQ ID NO: 620719 - DNA, 25 bp, Mus musculus
ggctcgactccattaaagacttttc

SEQ ID NO: 620720 - DNA, 25 bp, Mus musculus
ggctcgacttcgcatggtagacatt

SEQ ID NO: 620721 - DNA, 25 bp, Mus musculus
ggctcgacttcggatggtagacatt

SEQ ID NO: 620722 - DNA, 25 bp, Mus musculus
ggctcgagacacctttactgagcag

SEQ ID NO: 620723 - DNA, 25 bp, Mus musculus
ggctcgagacacgtttactgagcag

SEQ ID NO: 620724 - DNA, 25 bp, Mus musculus
ggctcgagctcaaaacgttccagta

SEQ ID NO: 620725 - DNA, 25 bp, Mus musculus
ggctcgagctcataacgttccagta

SEQ ID NO: 620726 - DNA, 25 bp, Mus musculus
ggctcgagctgacgttggcaattta

SEQ ID NO: 620727 - DNA, 25 bp, Mus musculus
ggctcgagctgaggttggcaattta

SEQ ID NO: 620728 - DNA, 25 bp, Mus musculus
ggctcgaggagcaggtatccacact

SEQ ID NO: 620729 - DNA, 25 bp, Mus musculus
ggctcgaggagctggtatccacact

SEQ ID NO: 620730 - DNA, 25 bp, Mus musculus
ggctcgagtctaacagccttttgtt

SEQ ID NO: 620731 - DNA, 25 bp, Mus musculus
ggctcgagtctatcagccttttgtt

SEQ ID NO: 620732 - DNA, 25 bp, Mus musculus
ggctcgcaccatcggcatctctgtg

SEQ ID NO: 620733 - DNA, 25 bp, Mus musculus
ggctcgcaccatgggcatctctgtg

SEQ ID NO: 620734 - DNA, 25 bp, Mus musculus
ggctcgcagcacatacaaacgctga

SEQ ID NO: 620735 - DNA, 25 bp, Mus musculus
ggctcgcagcacttacaaacgctga

SEQ ID NO: 620736 - DNA, 25 bp, Mus musculus
ggctcgcaggttagggaatgccacc

SEQ ID NO: 620737 - DNA, 25 bp, Mus musculus
ggctcgcaggtttgggaatgccacc

SEQ ID NO: 620738 - DNA, 25 bp, Mus musculus
ggctcgcatttccacattgtatgtg

SEQ ID NO: 620739 - DNA, 25 bp, Mus musculus
ggctcgcatttcgacattgtatgtg

SEQ ID NO: 620740 - DNA, 25 bp, Mus musculus
ggctcgcccgtgaaactttcccagg

SEQ ID NO: 620741 - DNA, 25 bp, Mus musculus
ggctcgcccgtgtaactttcccagg

SEQ ID NO: 620742 - DNA, 25 bp, Mus musculus
ggctcgcctctgacccgcatggaaa

SEQ ID NO: 620743 - DNA, 25 bp, Mus musculus
ggctcgcctctgtcccgcatggaaa

SEQ ID NO: 620744 - DNA, 25 bp, Mus musculus
ggctcgctcagcagtcagaaaaatt

SEQ ID NO: 620745 - DNA, 25 bp, Mus musculus
ggctcgctcagctgtcagaaaaatt

SEQ ID NO: 620746 - DNA, 25 bp, Mus musculus
ggctcgctctccaactccaaggagt

SEQ ID NO: 620747 - DNA, 25 bp, Mus musculus
ggctcgctctcctactccaaggagt

SEQ ID NO: 620748 - DNA, 25 bp, Mus musculus
ggctcgctgagaatgaagcccgcag

SEQ ID NO: 620749 - DNA, 25 bp, Mus musculus
ggctcgctgagattgaagcccgcag

SEQ ID NO: 620750 - DNA, 25 bp, Mus musculus
ggctcgctgcagcaacttcatgaag

SEQ ID NO: 620751 - DNA, 25 bp, Mus musculus
ggctcgctgcaggaacttcatgaag

SEQ ID NO: 620752 - DNA, 25 bp, Mus musculus
ggctcgctgctacatttagttcatt

SEQ ID NO: 620753 - DNA, 25 bp, Mus musculus
ggctcgctgctagatttagttcatt

SEQ ID NO: 620754 - DNA, 25 bp, Mus musculus
ggctcgctgggcaccctggaaatag

SEQ ID NO: 620755 - DNA, 25 bp, Mus musculus
ggctcgctgggctccctggaaatag

SEQ ID NO: 620756 - DNA, 25 bp, Mus musculus
ggctcggagcacaacttggcagtaa

SEQ ID NO: 620757 - DNA, 25 bp, Mus musculus
ggctcggagcactacttggcagtaa

SEQ ID NO: 620758 - DNA, 25 bp, Mus musculus
ggctcggataataaaagggcactag

SEQ ID NO: 620759 - DNA, 25 bp, Mus musculus
ggctcggataattaaagggcactag

SEQ ID NO: 620760 - DNA, 25 bp, Mus musculus
ggctcggctgtgactttgaagttta

SEQ ID NO: 620761 - DNA, 25 bp, Mus musculus
ggctcggctgtgtctttgaagttta

SEQ ID NO: 620762 - DNA, 25 bp, Mus musculus
ggctcgggacctccgcggcaagaag

SEQ ID NO: 620763 - DNA, 25 bp, Mus musculus
ggctcgggacctgcgcggcaagaag

SEQ ID NO: 620764 - DNA, 25 bp, Mus musculus
ggctcgggacggatcagtgtatctt

SEQ ID NO: 620765 - DNA, 25 bp, Mus musculus
ggctcgggacggttcagtgtatctt

SEQ ID NO: 620766 - DNA, 25 bp, Mus musculus
ggctcgggagttcatgatcaaaacc

SEQ ID NO: 620767 - DNA, 25 bp, Mus musculus
ggctcgggagttgatgatcaaaacc

SEQ ID NO: 620768 - DNA, 25 bp, Mus musculus
ggctcgggattcaattacctcatac

SEQ ID NO: 620769 - DNA, 25 bp, Mus musculus
ggctcgggattctattacctcatac

SEQ ID NO: 620770 - DNA, 25 bp, Mus musculus
ggctcgggattgactttgttgcaag

SEQ ID NO: 620771 - DNA, 25 bp, Mus musculus
ggctcgggattgcaccctgaacaat

SEQ ID NO: 620772 - DNA, 25 bp, Mus musculus
ggctcgggattggaccctgaacaat

SEQ ID NO: 620773 - DNA, 25 bp, Mus musculus
ggctcgggattgtctttgttgcaag

SEQ ID NO: 620774 - DNA, 25 bp, Mus musculus
ggctcgggcagcaattcaatgtcta

SEQ ID NO: 620775 - DNA, 25 bp, Mus musculus
ggctcgggcagctattcaatgtcta

SEQ ID NO: 620776 - DNA, 25 bp, Mus musculus
ggctcgggcttcaggtgctggcggc

SEQ ID NO: 620777 - DNA, 25 bp, Mus musculus
ggctcgggcttctggtgctggcggc

SEQ ID NO: 620778 - DNA, 25 bp, Mus musculus
ggctcggtattgattacatttccct

SEQ ID NO: 620779 - DNA, 25 bp, Mus musculus
ggctcggtattgtttacatttccct

SEQ ID NO: 620780 - DNA, 25 bp, Mus musculus
ggctcggtgctaaggatttgtgaca

SEQ ID NO: 620781 - DNA, 25 bp, Mus musculus
ggctcggtgctatggatttgtgaca

SEQ ID NO: 620782 - DNA, 25 bp, Mus musculus
ggctcggtggttattgctcttgcag

SEQ ID NO: 620783 - DNA, 25 bp, Mus musculus
ggctcggtggtttttgctcttgcag

SEQ ID NO: 620784 - DNA, 25 bp, Mus musculus
ggctcgtagtccactgaaagtggtt

SEQ ID NO: 620785 - DNA, 25 bp, Mus musculus
ggctcgtagtcctctgaaagtggtt

SEQ ID NO: 620786 - DNA, 25 bp, Mus musculus
ggctcgtcggcaacatgtcagggta

SEQ ID NO: 620787 - DNA, 25 bp, Mus musculus
ggctcgtcggcatcatgtcagggta

SEQ ID NO: 620788 - DNA, 25 bp, Mus musculus
ggctcgtgcctaaaactcgtacatt

SEQ ID NO: 620789 - DNA, 25 bp, Mus musculus
ggctcgtgcctataactcgtacatt

SEQ ID NO: 620790 - DNA, 25 bp, Mus musculus
ggctcgtggaccagtgacatccaga

SEQ ID NO: 620791 - DNA, 25 bp, Mus musculus
ggctcgtggacctgtgacatccaga

SEQ ID NO: 620792 - DNA, 25 bp, Mus musculus
ggctcgtgtcacagtgtgaacgcat

SEQ ID NO: 620793 - DNA, 25 bp, Mus musculus
ggctcgtgtcactgtgtgaacgcat

SEQ ID NO: 620794 - DNA, 25 bp, Mus musculus
ggctcgtgtgttctgatgctgtaat

SEQ ID NO: 620795 - DNA, 25 bp, Mus musculus
ggctcgtgtgttgtgatgctgtaat

SEQ ID NO: 620796 - DNA, 25 bp, Mus musculus
ggctcgttgccgcaaaaacaccctg

SEQ ID NO: 620797 - DNA, 25 bp, Mus musculus
ggctcgttgccggaaaaacaccctg

SEQ ID NO: 620798 - DNA, 25 bp, Mus musculus
ggctcgtttcgacaagctgcggaca

SEQ ID NO: 620799 - DNA, 25 bp, Mus musculus
ggctcgtttcgagaagctgcggaca

SEQ ID NO: 620800 - DNA, 25 bp, Mus musculus
ggctctaaactacaccttgttcatg

SEQ ID NO: 620801 - DNA, 25 bp, Mus musculus
ggctctaaactagaccttgttcatg

SEQ ID NO: 620802 - DNA, 25 bp, Mus musculus
ggctctaacagcaacatgtaccaga

SEQ ID NO: 620803 - DNA, 25 bp, Mus musculus
ggctctaacagctacatgtaccaga

SEQ ID NO: 620804 - DNA, 25 bp, Mus musculus
ggctctaagaggaccgcactccaag

SEQ ID NO: 620805 - DNA, 25 bp, Mus musculus
ggctctaagaggtccgcactccaag

SEQ ID NO: 620806 - DNA, 25 bp, Mus musculus
ggctctaaggcaatcattcagctag

SEQ ID NO: 620807 - DNA, 25 bp, Mus musculus
ggctctaaggcattcattcagctag

SEQ ID NO: 620808 - DNA, 25 bp, Mus musculus
ggctctaatagacgacgagtcctat

SEQ ID NO: 620809 - DNA, 25 bp, Mus musculus
ggctctaatagaggacgagtcctat

SEQ ID NO: 620810 - DNA, 25 bp, Mus musculus
ggctctaatgctcggtgctcagaca

SEQ ID NO: 620811 - DNA, 25 bp, Mus musculus
ggctctaatgctgggtgctcagaca

SEQ ID NO: 620812 - DNA, 25 bp, Mus musculus
ggctctaatgtaacttttccactta

SEQ ID NO: 620813 - DNA, 25 bp, Mus musculus
ggctctaatgtatcttttccactta

SEQ ID NO: 620814 - DNA, 25 bp, Mus musculus
ggctctaattacaactttttaatct

SEQ ID NO: 620815 - DNA, 25 bp, Mus musculus
ggctctaattactactttttaatct

SEQ ID NO: 620816 - DNA, 25 bp, Mus musculus
ggctctacaaataaacatgccgaga

SEQ ID NO: 620817 - DNA, 25 bp, Mus musculus
ggctctacaaatacctgtgcacttg

SEQ ID NO: 620818 - DNA, 25 bp, Mus musculus
ggctctacaaattaacatgccgaga

SEQ ID NO: 620819 - DNA, 25 bp, Mus musculus
ggctctacaaattcctgtgcacttg

SEQ ID NO: 620820 - DNA, 25 bp, Mus musculus
ggctctacacaccacctgaagtttt

SEQ ID NO: 620821 - DNA, 25 bp, Mus musculus
ggctctacacacgacctgaagtttt

SEQ ID NO: 620822 - DNA, 25 bp, Mus musculus
ggctctacagacacaccatggcaag

SEQ ID NO: 620823 - DNA, 25 bp, Mus musculus
ggctctacagactcaccatggcaag

SEQ ID NO: 620824 - DNA, 25 bp, Mus musculus
ggctctacagcgcatgctcttggca

SEQ ID NO: 620825 - DNA, 25 bp, Mus musculus
ggctctacagcggatgctcttggca

SEQ ID NO: 620826 - DNA, 25 bp, Mus musculus
ggctctacgcttatgaaccttctga

SEQ ID NO: 620827 - DNA, 25 bp, Mus musculus
ggctctacgcttttgaaccttctga

SEQ ID NO: 620828 - DNA, 25 bp, Mus musculus
ggctctactcctcttttattaccat

SEQ ID NO: 620829 - DNA, 25 bp, Mus musculus
ggctctactcctgttttattaccat

SEQ ID NO: 620830 - DNA, 25 bp, Mus musculus
ggctctactctcagaccaccaagag

SEQ ID NO: 620831 - DNA, 25 bp, Mus musculus
ggctctactctctgaccaccaagag

SEQ ID NO: 620832 - DNA, 25 bp, Mus musculus
ggctctactttaatcttttaagatc

SEQ ID NO: 620833 - DNA, 25 bp, Mus musculus
ggctctactttattcttttaagatc

SEQ ID NO: 620834 - DNA, 25 bp, Mus musculus
ggctctactttgactgttgttgaca

SEQ ID NO: 620835 - DNA, 25 bp, Mus musculus
ggctctactttgtctgttgttgaca

SEQ ID NO: 620836 - DNA, 25 bp, Mus musculus
ggctctagagcaaaaccactgtgac

SEQ ID NO: 620837 - DNA, 25 bp, Mus musculus
ggctctagagcataaccactgtgac

SEQ ID NO: 620838 - DNA, 25 bp, Mus musculus
ggctctagccaccaaggctattaca

SEQ ID NO: 620839 - DNA, 25 bp, Mus musculus
ggctctagccacgaaggctattaca

SEQ ID NO: 620840 - DNA, 25 bp, Mus musculus
ggctctagctgcattagacctgtga

SEQ ID NO: 620841 - DNA, 25 bp, Mus musculus
ggctctagctgctttagacctgtga

SEQ ID NO: 620842 - DNA, 25 bp, Mus musculus
ggctctaggaataagccctatgcct

SEQ ID NO: 620843 - DNA, 25 bp, Mus musculus
ggctctaggaattagccctatgcct

SEQ ID NO: 620844 - DNA, 25 bp, Mus musculus
ggctctaggagtacgtgtttgtttt

SEQ ID NO: 620845 - DNA, 25 bp, Mus musculus
ggctctaggagttcgtgtttgtttt

SEQ ID NO: 620846 - DNA, 25 bp, Mus musculus
ggctctagggtaatccagtgcatct

SEQ ID NO: 620847 - DNA, 25 bp, Mus musculus
ggctctagggtattccagtgcatct

SEQ ID NO: 620848 - DNA, 25 bp, Mus musculus
ggctctagtaggatccaattaatta

SEQ ID NO: 620849 - DNA, 25 bp, Mus musculus
ggctctagtaggttccaattaatta

SEQ ID NO: 620850 - DNA, 25 bp, Mus musculus
ggctctagtcacaccaccaaaagag

SEQ ID NO: 620851 - DNA, 25 bp, Mus musculus
ggctctagtcactccaccaaaagag

SEQ ID NO: 620852 - DNA, 25 bp, Mus musculus
ggctctatagctcaagatggctcca

SEQ ID NO: 620853 - DNA, 25 bp, Mus musculus
ggctctatagctctagattttggtg

SEQ ID NO: 620854 - DNA, 25 bp, Mus musculus
ggctctatagctgaagatggctcca

SEQ ID NO: 620855 - DNA, 25 bp, Mus musculus
ggctctatagctgtagattttggtg

SEQ ID NO: 620856 - DNA, 25 bp, Mus musculus
ggctctatatatccatgaaactttg

SEQ ID NO: 620857 - DNA, 25 bp, Mus musculus
ggctctatatatgcatgaaactttg

SEQ ID NO: 620858 - DNA, 25 bp, Mus musculus
ggctctatatccagcagcatgtgca

SEQ ID NO: 620859 - DNA, 25 bp, Mus musculus
ggctctatatcctgcagcatgtgca

SEQ ID NO: 620860 - DNA, 25 bp, Mus musculus
ggctctatatttcttagggtgctat

SEQ ID NO: 620861 - DNA, 25 bp, Mus musculus
ggctctatatttgttagggtgctat

SEQ ID NO: 620862 - DNA, 25 bp, Mus musculus
ggctctatcctaccatctttgggta

SEQ ID NO: 620863 - DNA, 25 bp, Mus musculus
ggctctatcctagcatctttgggta

SEQ ID NO: 620864 - DNA, 25 bp, Mus musculus
ggctctatctttccctacaattgat

SEQ ID NO: 620865 - DNA, 25 bp, Mus musculus
ggctctatctttgcctacaattgat

SEQ ID NO: 620866 - DNA, 25 bp, Mus musculus
ggctctatgagcatcttagcacttg

SEQ ID NO: 620867 - DNA, 25 bp, Mus musculus
ggctctatgagcttcttagcacttg

SEQ ID NO: 620868 - DNA, 25 bp, Mus musculus
ggctctatgctcaagtgtattgact

SEQ ID NO: 620869 - DNA, 25 bp, Mus musculus
ggctctatgctctagtgtattgact

SEQ ID NO: 620870 - DNA, 25 bp, Mus musculus
ggctctatgtaacaaactcttgctt

SEQ ID NO: 620871 - DNA, 25 bp, Mus musculus
ggctctatgtaagaaactcttgctt

SEQ ID NO: 620872 - DNA, 25 bp, Mus musculus
ggctctattgaccatgtccaatata

SEQ ID NO: 620873 - DNA, 25 bp, Mus musculus
ggctctattgacgatgtccaatata

SEQ ID NO: 620874 - DNA, 25 bp, Mus musculus
ggctctattttaaatgctcccattt

SEQ ID NO: 620875 - DNA, 25 bp, Mus musculus
ggctctattttatatgctcccattt

SEQ ID NO: 620876 - DNA, 25 bp, Mus musculus
ggctctattttcctaagtcatatag

SEQ ID NO: 620877 - DNA, 25 bp, Mus musculus
ggctctattttcgtaagtcatatag

SEQ ID NO: 620878 - DNA, 25 bp, Mus musculus
ggctctcaagttcctgtgtctggaa

SEQ ID NO: 620879 - DNA, 25 bp, Mus musculus
ggctctcaagttgctgtgtctggaa

SEQ ID NO: 620880 - DNA, 25 bp, Mus musculus
ggctctcacagaaagctttcgcaga

SEQ ID NO: 620881 - DNA, 25 bp, Mus musculus
ggctctcacagatagctttcgcaga

SEQ ID NO: 620882 - DNA, 25 bp, Mus musculus
ggctctcacaggatcagactgtacg

SEQ ID NO: 620883 - DNA, 25 bp, Mus musculus
ggctctcacaggttcagactgtacg

SEQ ID NO: 620884 - DNA, 25 bp, Mus musculus
ggctctcacagtactcaggattggg

SEQ ID NO: 620885 - DNA, 25 bp, Mus musculus
ggctctcacagttctcaggattggg

SEQ ID NO: 620886 - DNA, 25 bp, Mus musculus
ggctctcacatgagcatataagtta

SEQ ID NO: 620887 - DNA, 25 bp, Mus musculus
ggctctcacatgtgcatataagtta

SEQ ID NO: 620888 - DNA, 25 bp, Mus musculus
ggctctcaccctagattcttttaat

SEQ ID NO: 620889 - DNA, 25 bp, Mus musculus
ggctctcacccttgattcttttaat

SEQ ID NO: 620890 - DNA, 25 bp, Mus musculus
ggctctcacctccagtctatgggaa

SEQ ID NO: 620891 - DNA, 25 bp, Mus musculus
ggctctcacctcgagtctatgggaa

SEQ ID NO: 620892 - DNA, 25 bp, Mus musculus
ggctctcagaacaagaacccaagat

SEQ ID NO: 620893 - DNA, 25 bp, Mus musculus
ggctctcagaactagaacccaagat

SEQ ID NO: 620894 - DNA, 25 bp, Mus musculus
ggctctcagaagctgaatttactcc

SEQ ID NO: 620895 - DNA, 25 bp, Mus musculus
ggctctcagaaggtgaatttactcc

SEQ ID NO: 620896 - DNA, 25 bp, Mus musculus
ggctctcagatgagtgcactttgca

SEQ ID NO: 620897 - DNA, 25 bp, Mus musculus
ggctctcagatgtgtgcactttgca

SEQ ID NO: 620898 - DNA, 25 bp, Mus musculus
ggctctcagattaattgctatacca

SEQ ID NO: 620899 - DNA, 25 bp, Mus musculus
ggctctcagatttattgctatacca

SEQ ID NO: 620900 - DNA, 25 bp, Mus musculus
ggctctcagctcaacagttgatgga

SEQ ID NO: 620901 - DNA, 25 bp, Mus musculus
ggctctcagctctacagttgatgga

SEQ ID NO: 620902 - DNA, 25 bp, Mus musculus
ggctctcagtagcacaggcagcccg

SEQ ID NO: 620903 - DNA, 25 bp, Mus musculus
ggctctcagtaggacaggcagcccg

SEQ ID NO: 620904 - DNA, 25 bp, Mus musculus
ggctctcagtttaatccctggaaaa

SEQ ID NO: 620905 - DNA, 25 bp, Mus musculus
ggctctcagtttcttgcagattatg

SEQ ID NO: 620906 - DNA, 25 bp, Mus musculus
ggctctcagtttgttgcagattatg

SEQ ID NO: 620907 - DNA, 25 bp, Mus musculus
ggctctcagttttatccctggaaaa

SEQ ID NO: 620908 - DNA, 25 bp, Mus musculus
ggctctcatgcaattatactgggat

SEQ ID NO: 620909 - DNA, 25 bp, Mus musculus
ggctctcatgcatttatactgggat

SEQ ID NO: 620910 - DNA, 25 bp, Mus musculus
ggctctcatgtgcttcctccagctt

SEQ ID NO: 620911 - DNA, 25 bp, Mus musculus
ggctctcatgtggttcctccagctt

SEQ ID NO: 620912 - DNA, 25 bp, Mus musculus
ggctctcattcactttttagtaatt

SEQ ID NO: 620913 - DNA, 25 bp, Mus musculus
ggctctcattcagtttttagtaatt

SEQ ID NO: 620914 - DNA, 25 bp, Mus musculus
ggctctcattctaacttcattgact

SEQ ID NO: 620915 - DNA, 25 bp, Mus musculus
ggctctcattcttacttcattgact

SEQ ID NO: 620916 - DNA, 25 bp, Mus musculus
ggctctccacggattgtcacggttg

SEQ ID NO: 620917 - DNA, 25 bp, Mus musculus
ggctctccacggtttgtcacggttg

SEQ ID NO: 620918 - DNA, 25 bp, Mus musculus
ggctctccagtacctgacatgtgta

SEQ ID NO: 620919 - DNA, 25 bp, Mus musculus
ggctctccagtagctgacatgtgta

SEQ ID NO: 620920 - DNA, 25 bp, Mus musculus
ggctctccgcgtcgaattcaatcag

SEQ ID NO: 620921 - DNA, 25 bp, Mus musculus
ggctctccgcgtggaattcaatcag

SEQ ID NO: 620922 - DNA, 25 bp, Mus musculus
ggctctcctagcactggaagaaaac

SEQ ID NO: 620923 - DNA, 25 bp, Mus musculus
ggctctcctagctctggaagaaaac

SEQ ID NO: 620924 - DNA, 25 bp, Mus musculus
ggctctcctcttacgacacagggta

SEQ ID NO: 620925 - DNA, 25 bp, Mus musculus
ggctctcctctttcgacacagggta

SEQ ID NO: 620926 - DNA, 25 bp, Mus musculus
ggctctcctgataattgggactttt

SEQ ID NO: 620927 - DNA, 25 bp, Mus musculus
ggctctcctgattattgggactttt

SEQ ID NO: 620928 - DNA, 25 bp, Mus musculus
ggctctcctgtcctaaacgtttgag

SEQ ID NO: 620929 - DNA, 25 bp, Mus musculus
ggctctcctgtcgtaaacgtttgag

SEQ ID NO: 620930 - DNA, 25 bp, Mus musculus
ggctctcgaaacaacagtgcacgga

SEQ ID NO: 620931 - DNA, 25 bp, Mus musculus
ggctctcgaaactacagtgcacgga

SEQ ID NO: 620932 - DNA, 25 bp, Mus musculus
ggctctcgaagaacaaaatgcaaag

SEQ ID NO: 620933 - DNA, 25 bp, Mus musculus
ggctctcgaagatcaaaatgcaaag

SEQ ID NO: 620934 - DNA, 25 bp, Mus musculus
ggctctcgattgctgctgaagctaa

SEQ ID NO: 620935 - DNA, 25 bp, Mus musculus
ggctctcgattggtgctgaagctaa

SEQ ID NO: 620936 - DNA, 25 bp, Mus musculus
ggctctcgccttcatagaactttac

SEQ ID NO: 620937 - DNA, 25 bp, Mus musculus
ggctctcgccttgatagaactttac

SEQ ID NO: 620938 - DNA, 25 bp, Mus musculus
ggctctcggcttaaaattcaactat

SEQ ID NO: 620939 - DNA, 25 bp, Mus musculus
ggctctcggctttaaattcaactat

SEQ ID NO: 620940 - DNA, 25 bp, Mus musculus
ggctctcgggacagatgttttccac

SEQ ID NO: 620941 - DNA, 25 bp, Mus musculus
ggctctcgggactgatgttttccac

SEQ ID NO: 620942 - DNA, 25 bp, Mus musculus
ggctctcgtcgaactcatttataac

SEQ ID NO: 620943 - DNA, 25 bp, Mus musculus
ggctctcgtcgatctcatttataac

SEQ ID NO: 620944 - DNA, 25 bp, Mus musculus
ggctctctactcctgtatttttctt

SEQ ID NO: 620945 - DNA, 25 bp, Mus musculus
ggctctctactcgtgtatttttctt

SEQ ID NO: 620946 - DNA, 25 bp, Mus musculus
ggctctctagacatagttatgcttt

SEQ ID NO: 620947 - DNA, 25 bp, Mus musculus
ggctctctagacttagttatgcttt

SEQ ID NO: 620948 - DNA, 25 bp, Mus musculus
ggctctctagtcagacagtgtacct

SEQ ID NO: 620949 - DNA, 25 bp, Mus musculus
ggctctctagtctgacagtgtacct

SEQ ID NO: 620950 - DNA, 25 bp, Mus musculus
ggctctctcataaactctttttaag

SEQ ID NO: 620951 - DNA, 25 bp, Mus musculus
ggctctctcatatactctttttaag

SEQ ID NO: 620952 - DNA, 25 bp, Mus musculus
ggctctctgatcactaatgacttgc

SEQ ID NO: 620953 - DNA, 25 bp, Mus musculus
ggctctctgatctctaatgacttgc

SEQ ID NO: 620954 - DNA, 25 bp, Mus musculus
ggctctctggaaacatcaatgtaca

SEQ ID NO: 620955 - DNA, 25 bp, Mus musculus
ggctctctggaatcatcaatgtaca

SEQ ID NO: 620956 - DNA, 25 bp, Mus musculus
ggctctctgtggacttcgataactg

SEQ ID NO: 620957 - DNA, 25 bp, Mus musculus
ggctctctgtggtcttcgataactg

SEQ ID NO: 620958 - DNA, 25 bp, Mus musculus
ggctctcttaggactcttaggtaga

SEQ ID NO: 620959 - DNA, 25 bp, Mus musculus
ggctctcttaggtctcttaggtaga

SEQ ID NO: 620960 - DNA, 25 bp, Mus musculus
ggctctcttatgctcttagtggata

SEQ ID NO: 620961 - DNA, 25 bp, Mus musculus
ggctctcttatggtcttagtggata

SEQ ID NO: 620962 - DNA, 25 bp, Mus musculus
ggctctgaaacacgccaactcgaag

SEQ ID NO: 620963 - DNA, 25 bp, Mus musculus
ggctctgaaacaggccaactcgaag

SEQ ID NO: 620964 - DNA, 25 bp, Mus musculus
ggctctgaaattcatgctttcggac

SEQ ID NO: 620965 - DNA, 25 bp, Mus musculus
ggctctgaaattgatgctttcggac

SEQ ID NO: 620966 - DNA, 25 bp, Mus musculus
ggctctgaacaacggatatttgcat

SEQ ID NO: 620967 - DNA, 25 bp, Mus musculus
ggctctgaacaagggatatttgcat

SEQ ID NO: 620968 - DNA, 25 bp, Mus musculus
ggctctgaaccacaaaaagtgtaaa

SEQ ID NO: 620969 - DNA, 25 bp, Mus musculus
ggctctgaaccactatccggcatta

SEQ ID NO: 620970 - DNA, 25 bp, Mus musculus
ggctctgaaccagaaaaagtgtaaa

SEQ ID NO: 620971 - DNA, 25 bp, Mus musculus
ggctctgaaccagtatccggcatta

SEQ ID NO: 620972 - DNA, 25 bp, Mus musculus
ggctctgaatccatatttcccaatc

SEQ ID NO: 620973 - DNA, 25 bp, Mus musculus
ggctctgaatccttatttcccaatc

SEQ ID NO: 620974 - DNA, 25 bp, Mus musculus
ggctctgacagacttctaaacaggt

SEQ ID NO: 620975 - DNA, 25 bp, Mus musculus
ggctctgacagagttctaaacaggt

SEQ ID NO: 620976 - DNA, 25 bp, Mus musculus
ggctctgaccctctatgatgtaatt

SEQ ID NO: 620977 - DNA, 25 bp, Mus musculus
ggctctgaccctgtatgatgtaatt

SEQ ID NO: 620978 - DNA, 25 bp, Mus musculus
ggctctgacgccatgagtccctcgt

SEQ ID NO: 620979 - DNA, 25 bp, Mus musculus
ggctctgacgccttgagtccctcgt

SEQ ID NO: 620980 - DNA, 25 bp, Mus musculus
ggctctgactggacaggcgccacca

SEQ ID NO: 620981 - DNA, 25 bp, Mus musculus
ggctctgactggtcaggcgccacca

SEQ ID NO: 620982 - DNA, 25 bp, Mus musculus
ggctctgagaaaaccgatgatggtg

SEQ ID NO: 620983 - DNA, 25 bp, Mus musculus
ggctctgagaaatccgatgatggtg

SEQ ID NO: 620984 - DNA, 25 bp, Mus musculus
ggctctgagaacaaggccttatcac

SEQ ID NO: 620985 - DNA, 25 bp, Mus musculus
ggctctgagaactaggccttatcac

SEQ ID NO: 620986 - DNA, 25 bp, Mus musculus
ggctctgagagaaattgaacctgga

SEQ ID NO: 620987 - DNA, 25 bp, Mus musculus
ggctctgagagaagcagtcaccagt

SEQ ID NO: 620988 - DNA, 25 bp, Mus musculus
ggctctgagagatattgaacctgga

SEQ ID NO: 620989 - DNA, 25 bp, Mus musculus
ggctctgagagatgcagtcaccagt

SEQ ID NO: 620990 - DNA, 25 bp, Mus musculus
ggctctgagataccggttacttccc

SEQ ID NO: 620991 - DNA, 25 bp, Mus musculus
ggctctgagatagcggttacttccc

SEQ ID NO: 620992 - DNA, 25 bp, Mus musculus
ggctctgagcagctgtcatattcat

SEQ ID NO: 620993 - DNA, 25 bp, Mus musculus
ggctctgagcaggtgtcatattcat

SEQ ID NO: 620994 - DNA, 25 bp, Mus musculus
ggctctgagcccagaacagttattt

SEQ ID NO: 620995 - DNA, 25 bp, Mus musculus
ggctctgagccctgaacagttattt

SEQ ID NO: 620996 - DNA, 25 bp, Mus musculus
ggctctgaggccacatggaaactct

SEQ ID NO: 620997 - DNA, 25 bp, Mus musculus
ggctctgaggcctcatggaaactct

SEQ ID NO: 620998 - DNA, 25 bp, Mus musculus
ggctctgagggtcttacacttgtta

SEQ ID NO: 620999 - DNA, 25 bp, Mus musculus
ggctctgagggtgttacacttgtta

SEQ ID NO: 621000 - DNA, 25 bp, Mus musculus
ggctctgagttacctgccatctgag

SEQ ID NO: 621001 - DNA, 25 bp, Mus musculus
ggctctgagttagctgccatctgag

SEQ ID NO: 621002 - DNA, 25 bp, Mus musculus
ggctctgatagtaaggacacctccc

SEQ ID NO: 621003 - DNA, 25 bp, Mus musculus
ggctctgatagttaggacacctccc

SEQ ID NO: 621004 - DNA, 25 bp, Mus musculus
ggctctgatgctccaagatgtgaca

SEQ ID NO: 621005 - DNA, 25 bp, Mus musculus
ggctctgatgctgcaagatgtgaca

SEQ ID NO: 621006 - DNA, 25 bp, Mus musculus
ggctctgatgggatcccttatcgaa

SEQ ID NO: 621007 - DNA, 25 bp, Mus musculus
ggctctgatgggttcccttatcgaa

SEQ ID NO: 621008 - DNA, 25 bp, Mus musculus
ggctctgattcaaggtattcccagt

SEQ ID NO: 621009 - DNA, 25 bp, Mus musculus
ggctctgattcatggtattcccagt

SEQ ID NO: 621010 - DNA, 25 bp, Mus musculus
ggctctgcaaacacgtgttttctgc

SEQ ID NO: 621011 - DNA, 25 bp, Mus musculus
ggctctgcaaactcgtgttttctgc

SEQ ID NO: 621012 - DNA, 25 bp, Mus musculus
ggctctgcaacaactgcacttggag

SEQ ID NO: 621013 - DNA, 25 bp, Mus musculus
ggctctgcaacatctgcacttggag

SEQ ID NO: 621014 - DNA, 25 bp, Mus musculus
ggctctgcaattaagagttatttgt

SEQ ID NO: 621015 - DNA, 25 bp, Mus musculus
ggctctgcaatttagagttatttgt

SEQ ID NO: 621016 - DNA, 25 bp, Mus musculus
ggctctgcactgagttagcattcag

SEQ ID NO: 621017 - DNA, 25 bp, Mus musculus
ggctctgcactgtgttagcattcag

SEQ ID NO: 621018 - DNA, 25 bp, Mus musculus
ggctctgcagagctggagtcctcat

SEQ ID NO: 621019 - DNA, 25 bp, Mus musculus
ggctctgcagaggtggagtcctcat

SEQ ID NO: 621020 - DNA, 25 bp, Mus musculus
ggctctgcagcaaggatttcttcca

SEQ ID NO: 621021 - DNA, 25 bp, Mus musculus
ggctctgcagcatggatttcttcca

SEQ ID NO: 621022 - DNA, 25 bp, Mus musculus
ggctctgcagtgacctcgccaaagg

SEQ ID NO: 621023 - DNA, 25 bp, Mus musculus
ggctctgcagtgtcctcgccaaagg

SEQ ID NO: 621024 - DNA, 25 bp, Mus musculus
ggctctgcatctacagtagcctgaa

SEQ ID NO: 621025 - DNA, 25 bp, Mus musculus
ggctctgcatcttcagtagcctgaa

SEQ ID NO: 621026 - DNA, 25 bp, Mus musculus
ggctctgccacgatttaattttatc

SEQ ID NO: 621027 - DNA, 25 bp, Mus musculus
ggctctgccacgttttaattttatc

SEQ ID NO: 621028 - DNA, 25 bp, Mus musculus
ggctctgccagcataagggatccag

SEQ ID NO: 621029 - DNA, 25 bp, Mus musculus
ggctctgccagcatctgactaagat

SEQ ID NO: 621030 - DNA, 25 bp, Mus musculus
ggctctgccagcttaagggatccag

SEQ ID NO: 621031 - DNA, 25 bp, Mus musculus
ggctctgccagcttctgactaagat

SEQ ID NO: 621032 - DNA, 25 bp, Mus musculus
ggctctgccatgaaggatgtcctgt

SEQ ID NO: 621033 - DNA, 25 bp, Mus musculus
ggctctgccatgtaggatgtcctgt

SEQ ID NO: 621034 - DNA, 25 bp, Mus musculus
ggctctgccctaacagagctagggt

SEQ ID NO: 621035 - DNA, 25 bp, Mus musculus
ggctctgccctatcagagctagggt

SEQ ID NO: 621036 - DNA, 25 bp, Mus musculus
ggctctgccgctaactcttttcttt

SEQ ID NO: 621037 - DNA, 25 bp, Mus musculus
ggctctgccgcttactcttttcttt

SEQ ID NO: 621038 - DNA, 25 bp, Mus musculus
ggctctgccttgctctgaggattct

SEQ ID NO: 621039 - DNA, 25 bp, Mus musculus
ggctctgccttggtctgaggattct

SEQ ID NO: 621040 - DNA, 25 bp, Mus musculus
ggctctgcgagcactagtggactga

SEQ ID NO: 621041 - DNA, 25 bp, Mus musculus
ggctctgcgagctctagtggactga

SEQ ID NO: 621042 - DNA, 25 bp, Mus musculus
ggctctgcgctgaacaataaccatg

SEQ ID NO: 621043 - DNA, 25 bp, Mus musculus
ggctctgcgctgtacaataaccatg

SEQ ID NO: 621044 - DNA, 25 bp, Mus musculus
ggctctgcgtccctgcagtaaacag

SEQ ID NO: 621045 - DNA, 25 bp, Mus musculus
ggctctgcgtccgtgcagtaaacag

SEQ ID NO: 621046 - DNA, 25 bp, Mus musculus
ggctctgctaccactgtatgcaaat

SEQ ID NO: 621047 - DNA, 25 bp, Mus musculus
ggctctgctacctctgtatgcaaat

SEQ ID NO: 621048 - DNA, 25 bp, Mus musculus
ggctctgctagaccacaatgcaaat

SEQ ID NO: 621049 - DNA, 25 bp, Mus musculus
ggctctgctagagcacaatgcaaat

SEQ ID NO: 621050 - DNA, 25 bp, Mus musculus
ggctctgctgagactataatcttaa

SEQ ID NO: 621051 - DNA, 25 bp, Mus musculus
ggctctgctgagtctataatcttaa

SEQ ID NO: 621052 - DNA, 25 bp, Mus musculus
ggctctgctgtcaccagatggagtt

SEQ ID NO: 621053 - DNA, 25 bp, Mus musculus
ggctctgctgtctccagatggagtt

SEQ ID NO: 621054 - DNA, 25 bp, Mus musculus
ggctctgcttctcagggtgcccaga

SEQ ID NO: 621055 - DNA, 25 bp, Mus musculus
ggctctgcttctgagggtgcccaga

SEQ ID NO: 621056 - DNA, 25 bp, Mus musculus
ggctctggaactcatcgttgactca

SEQ ID NO: 621057 - DNA, 25 bp, Mus musculus
ggctctggaactgatcgttgactca

SEQ ID NO: 621058 - DNA, 25 bp, Mus musculus
ggctctggactccatgacagatctg

SEQ ID NO: 621059 - DNA, 25 bp, Mus musculus
ggctctggactcgatgacagatctg

SEQ ID NO: 621060 - DNA, 25 bp, Mus musculus
ggctctggagaaccttgacggatcc

SEQ ID NO: 621061 - DNA, 25 bp, Mus musculus
ggctctggagaagcttgacggatcc

SEQ ID NO: 621062 - DNA, 25 bp, Mus musculus
ggctctggagacattcagaccctga

SEQ ID NO: 621063 - DNA, 25 bp, Mus musculus
ggctctggagactttcagaccctga

SEQ ID NO: 621064 - DNA, 25 bp, Mus musculus
ggctctggatgcactggtctactca

SEQ ID NO: 621065 - DNA, 25 bp, Mus musculus
ggctctggatgctctggtctactca

SEQ ID NO: 621066 - DNA, 25 bp, Mus musculus
ggctctggcagaaggaactggacca

SEQ ID NO: 621067 - DNA, 25 bp, Mus musculus
ggctctggcagatggaactggacca

SEQ ID NO: 621068 - DNA, 25 bp, Mus musculus
ggctctggcatgaaataggtgttag

SEQ ID NO: 621069 - DNA, 25 bp, Mus musculus
ggctctggcatgtaataggtgttag

SEQ ID NO: 621070 - DNA, 25 bp, Mus musculus
ggctctggccagaaatacattttat

SEQ ID NO: 621071 - DNA, 25 bp, Mus musculus
ggctctggccagtaatacattttat

SEQ ID NO: 621072 - DNA, 25 bp, Mus musculus
ggctctggcccacatagcatacaaa

SEQ ID NO: 621073 - DNA, 25 bp, Mus musculus
ggctctggcccagatagcatacaaa

SEQ ID NO: 621074 - DNA, 25 bp, Mus musculus
ggctctggctataccaacattatgc

SEQ ID NO: 621075 - DNA, 25 bp, Mus musculus
ggctctggctatcgaagtggctgtg

SEQ ID NO: 621076 - DNA, 25 bp, Mus musculus
ggctctggctatggaagtggctgtg

SEQ ID NO: 621077 - DNA, 25 bp, Mus musculus
ggctctggctattccaacattatgc

SEQ ID NO: 621078 - DNA, 25 bp, Mus musculus
ggctctggctgcagtagctacagaa

SEQ ID NO: 621079 - DNA, 25 bp, Mus musculus
ggctctggctgctgtagctacagaa

SEQ ID NO: 621080 - DNA, 25 bp, Mus musculus
ggctctggcttaaccctgtgtagga

SEQ ID NO: 621081 - DNA, 25 bp, Mus musculus
ggctctggcttatccctgtgtagga

SEQ ID NO: 621082 - DNA, 25 bp, Mus musculus
ggctctggcttgagggccgctttat

SEQ ID NO: 621083 - DNA, 25 bp, Mus musculus
ggctctggcttgtgggccgctttat

SEQ ID NO: 621084 - DNA, 25 bp, Mus musculus
ggctctggctttatgttgccattat

SEQ ID NO: 621085 - DNA, 25 bp, Mus musculus
ggctctggctttcagaggacctaca

SEQ ID NO: 621086 - DNA, 25 bp, Mus musculus
ggctctggctttgagaggacctaca

SEQ ID NO: 621087 - DNA, 25 bp, Mus musculus
ggctctggctttttgttgccattat

SEQ ID NO: 621088 - DNA, 25 bp, Mus musculus
ggctctgggagtaataaggtcctgt

SEQ ID NO: 621089 - DNA, 25 bp, Mus musculus
ggctctgggagttataaggtcctgt

SEQ ID NO: 621090 - DNA, 25 bp, Mus musculus
ggctctgggatcagaacccacacaa

SEQ ID NO: 621091 - DNA, 25 bp, Mus musculus
ggctctgggatctgaacccacacaa

SEQ ID NO: 621092 - DNA, 25 bp, Mus musculus
ggctctgggcacactcgtttaaaca

SEQ ID NO: 621093 - DNA, 25 bp, Mus musculus
ggctctgggcactctcgtttaaaca

SEQ ID NO: 621094 - DNA, 25 bp, Mus musculus
ggctctgggctcaccatttctgttt

SEQ ID NO: 621095 - DNA, 25 bp, Mus musculus
ggctctgggctctccatttctgttt

SEQ ID NO: 621096 - DNA, 25 bp, Mus musculus
ggctctgggtcaatgagtaactctc

SEQ ID NO: 621097 - DNA, 25 bp, Mus musculus
ggctctgggtcattgagtaactctc

SEQ ID NO: 621098 - DNA, 25 bp, Mus musculus
ggctctggtaagatccattctaatg

SEQ ID NO: 621099 - DNA, 25 bp, Mus musculus
ggctctggtaagttccattctaatg

SEQ ID NO: 621100 - DNA, 25 bp, Mus musculus
ggctctggtggcagagtgtacctct

SEQ ID NO: 621101 - DNA, 25 bp, Mus musculus
ggctctggtggctgagtgtacctct

SEQ ID NO: 621102 - DNA, 25 bp, Mus musculus
ggctctggtgtacaggtatgaactc

SEQ ID NO: 621103 - DNA, 25 bp, Mus musculus
ggctctggtgtagaggtatgaactc

SEQ ID NO: 621104 - DNA, 25 bp, Mus musculus
ggctctgtactcaagtcaatctttt

SEQ ID NO: 621105 - DNA, 25 bp, Mus musculus
ggctctgtactctagtcaatctttt

SEQ ID NO: 621106 - DNA, 25 bp, Mus musculus
ggctctgtacttattgcttcggaag

SEQ ID NO: 621107 - DNA, 25 bp, Mus musculus
ggctctgtactttttgcttcggaag

SEQ ID NO: 621108 - DNA, 25 bp, Mus musculus
ggctctgtatccaggcttcttttat

SEQ ID NO: 621109 - DNA, 25 bp, Mus musculus
ggctctgtatcctggcttcttttat

SEQ ID NO: 621110 - DNA, 25 bp, Mus musculus
ggctctgtcataaaataccctaggt

SEQ ID NO: 621111 - DNA, 25 bp, Mus musculus
ggctctgtcatataataccctaggt

SEQ ID NO: 621112 - DNA, 25 bp, Mus musculus
ggctctgtcattctgaggccaccga

SEQ ID NO: 621113 - DNA, 25 bp, Mus musculus
ggctctgtcattgtgaggccaccga

SEQ ID NO: 621114 - DNA, 25 bp, Mus musculus
ggctctgtccagcaatatgaagctt

SEQ ID NO: 621115 - DNA, 25 bp, Mus musculus
ggctctgtccaggaatatgaagctt

SEQ ID NO: 621116 - DNA, 25 bp, Mus musculus
ggctctgtcgaaacggctactacac

SEQ ID NO: 621117 - DNA, 25 bp, Mus musculus
ggctctgtcgaatcggctactacac

SEQ ID NO: 621118 - DNA, 25 bp, Mus musculus
ggctctgtctcaagaaacttgaaag

SEQ ID NO: 621119 - DNA, 25 bp, Mus musculus
ggctctgtctcatgaaacttgaaag

SEQ ID NO: 621120 - DNA, 25 bp, Mus musculus
ggctctgtctctagaacactgggat

SEQ ID NO: 621121 - DNA, 25 bp, Mus musculus
ggctctgtctcttgaacactgggat

SEQ ID NO: 621122 - DNA, 25 bp, Mus musculus
ggctctgtcttaaggtaacattatt

SEQ ID NO: 621123 - DNA, 25 bp, Mus musculus
ggctctgtcttatggtaacattatt

SEQ ID NO: 621124 - DNA, 25 bp, Mus musculus
ggctctgtgagaaactccatctcaa

SEQ ID NO: 621125 - DNA, 25 bp, Mus musculus
ggctctgtgagatactccatctcaa

SEQ ID NO: 621126 - DNA, 25 bp, Mus musculus
ggctctgtgcagaacctagttgagt

SEQ ID NO: 621127 - DNA, 25 bp, Mus musculus
ggctctgtgcagtacctagttgagt

SEQ ID NO: 621128 - DNA, 25 bp, Mus musculus
ggctctgtgccacggcgtacctgaa

SEQ ID NO: 621129 - DNA, 25 bp, Mus musculus
ggctctgtgccagggcgtacctgaa

SEQ ID NO: 621130 - DNA, 25 bp, Mus musculus
ggctctgtgcctcgacataaaaatt

SEQ ID NO: 621131 - DNA, 25 bp, Mus musculus
ggctctgtgcctggacataaaaatt

SEQ ID NO: 621132 - DNA, 25 bp, Mus musculus
ggctctgtgctgctgcgtctcatcc

SEQ ID NO: 621133 - DNA, 25 bp, Mus musculus
ggctctgtgctggtgcgtctcatcc

SEQ ID NO: 621134 - DNA, 25 bp, Mus musculus
ggctctgtgcttaaaaaatccgggc

SEQ ID NO: 621135 - DNA, 25 bp, Mus musculus
ggctctgtgcttctgcacgtttgca

SEQ ID NO: 621136 - DNA, 25 bp, Mus musculus
ggctctgtgcttgtgcacgtttgca

SEQ ID NO: 621137 - DNA, 25 bp, Mus musculus
ggctctgtgctttaaaaatccgggc

SEQ ID NO: 621138 - DNA, 25 bp, Mus musculus
ggctctgtggccagggttttattca

SEQ ID NO: 621139 - DNA, 25 bp, Mus musculus
ggctctgtggcctgggttttattca

SEQ ID NO: 621140 - DNA, 25 bp, Mus musculus
ggctctgtggtcaagggcctgacac

SEQ ID NO: 621141 - DNA, 25 bp, Mus musculus
ggctctgtggtctagggcctgacac

SEQ ID NO: 621142 - DNA, 25 bp, Mus musculus
ggctctgtgtacaatgccctccaaa

SEQ ID NO: 621143 - DNA, 25 bp, Mus musculus
ggctctgtgtactatgccctccaaa

SEQ ID NO: 621144 - DNA, 25 bp, Mus musculus
ggctctgtgtgaaaacatgacctct

SEQ ID NO: 621145 - DNA, 25 bp, Mus musculus
ggctctgtgtgataacatgacctct

SEQ ID NO: 621146 - DNA, 25 bp, Mus musculus
ggctctgtgtggatattgccagttc

SEQ ID NO: 621147 - DNA, 25 bp, Mus musculus
ggctctgtgtggttattgccagttc

SEQ ID NO: 621148 - DNA, 25 bp, Mus musculus
ggctctgttagcactggccctcttg

SEQ ID NO: 621149 - DNA, 25 bp, Mus musculus
ggctctgttagctctggccctcttg

SEQ ID NO: 621150 - DNA, 25 bp, Mus musculus
ggctctgttcgtccaagaatagtca

SEQ ID NO: 621151 - DNA, 25 bp, Mus musculus
ggctctgttcgtgcaagaatagtca

SEQ ID NO: 621152 - DNA, 25 bp, Mus musculus
ggctctgttgagaatcctacttttg

SEQ ID NO: 621153 - DNA, 25 bp, Mus musculus
ggctctgttgagtatcctacttttg

SEQ ID NO: 621154 - DNA, 25 bp, Mus musculus
ggctctgtttacataagtctacacg

SEQ ID NO: 621155 - DNA, 25 bp, Mus musculus
ggctctgtttacttaagtctacacg

SEQ ID NO: 621156 - DNA, 25 bp, Mus musculus
ggctctgtttccctggatggaagac

SEQ ID NO: 621157 - DNA, 25 bp, Mus musculus
ggctctgtttccgtggatggaagac

SEQ ID NO: 621158 - DNA, 25 bp, Mus musculus
ggctcttaaaagactcaggaggcct

SEQ ID NO: 621159 - DNA, 25 bp, Mus musculus
ggctcttaaaagtctcaggaggcct

SEQ ID NO: 621160 - DNA, 25 bp, Mus musculus
ggctcttaaaggcatctgttcatga

SEQ ID NO: 621161 - DNA, 25 bp, Mus musculus
ggctcttaaagggatctgttcatga

SEQ ID NO: 621162 - DNA, 25 bp, Mus musculus
ggctcttaaggcacaggccgggccc

SEQ ID NO: 621163 - DNA, 25 bp, Mus musculus
ggctcttaaggctcaggccgggccc

SEQ ID NO: 621164 - DNA, 25 bp, Mus musculus
ggctcttaatcgctgtgcttcacat

SEQ ID NO: 621165 - DNA, 25 bp, Mus musculus
ggctcttaatcggtgtgcttcacat

SEQ ID NO: 621166 - DNA, 25 bp, Mus musculus
ggctcttaattaacctgactccatg

SEQ ID NO: 621167 - DNA, 25 bp, Mus musculus
ggctcttaattatcctgactccatg

SEQ ID NO: 621168 - DNA, 25 bp, Mus musculus
ggctcttactatccagcctagaggt

SEQ ID NO: 621169 - DNA, 25 bp, Mus musculus
ggctcttactatgcagcctagaggt

SEQ ID NO: 621170 - DNA, 25 bp, Mus musculus
ggctcttactcaatcatgtatacga

SEQ ID NO: 621171 - DNA, 25 bp, Mus musculus
ggctcttactcattcatgtatacga

SEQ ID NO: 621172 - DNA, 25 bp, Mus musculus
ggctcttagaatcggcagggatcat

SEQ ID NO: 621173 - DNA, 25 bp, Mus musculus
ggctcttagaatgggcagggatcat

SEQ ID NO: 621174 - DNA, 25 bp, Mus musculus
ggctcttagagcatttctgtgtatc

SEQ ID NO: 621175 - DNA, 25 bp, Mus musculus
ggctcttagagcttttctgtgtatc

SEQ ID NO: 621176 - DNA, 25 bp, Mus musculus
ggctcttagcaactaactgagtatt

SEQ ID NO: 621177 - DNA, 25 bp, Mus musculus
ggctcttagcaagtaactgagtatt

SEQ ID NO: 621178 - DNA, 25 bp, Mus musculus
ggctcttagggactcttgctgctat

SEQ ID NO: 621179 - DNA, 25 bp, Mus musculus
ggctcttagggagtcttgctgctat

SEQ ID NO: 621180 - DNA, 25 bp, Mus musculus
ggctcttagggtaatgtgatgtctt

SEQ ID NO: 621181 - DNA, 25 bp, Mus musculus
ggctcttagggttatgtgatgtctt

SEQ ID NO: 621182 - DNA, 25 bp, Mus musculus
ggctcttagtgccatccacaagtga

SEQ ID NO: 621183 - DNA, 25 bp, Mus musculus
ggctcttagtgcgatccacaagtga

SEQ ID NO: 621184 - DNA, 25 bp, Mus musculus
ggctcttatttcctactctatgaag

SEQ ID NO: 621185 - DNA, 25 bp, Mus musculus
ggctcttatttcgtactctatgaag

SEQ ID NO: 621186 - DNA, 25 bp, Mus musculus
ggctcttcaagcctcatgattgtac

SEQ ID NO: 621187 - DNA, 25 bp, Mus musculus
ggctcttcaagcgtcatgattgtac

SEQ ID NO: 621188 - DNA, 25 bp, Mus musculus
ggctcttcaagtaaaggctgccaag

SEQ ID NO: 621189 - DNA, 25 bp, Mus musculus
ggctcttcaagttaaggctgccaag

SEQ ID NO: 621190 - DNA, 25 bp, Mus musculus
ggctcttcaggtcctccaatgagaa

SEQ ID NO: 621191 - DNA, 25 bp, Mus musculus
ggctcttcaggtgctccaatgagaa

SEQ ID NO: 621192 - DNA, 25 bp, Mus musculus
ggctcttcatataaaatcaccatct

SEQ ID NO: 621193 - DNA, 25 bp, Mus musculus
ggctcttcatattaaatcaccatct

SEQ ID NO: 621194 - DNA, 25 bp, Mus musculus
ggctcttcattcactgctactggaa

SEQ ID NO: 621195 - DNA, 25 bp, Mus musculus
ggctcttcattctctgctactggaa

SEQ ID NO: 621196 - DNA, 25 bp, Mus musculus
ggctcttccagaacccagtgcaaag

SEQ ID NO: 621197 - DNA, 25 bp, Mus musculus
ggctcttccagatcccagtgcaaag

SEQ ID NO: 621198 - DNA, 25 bp, Mus musculus
ggctcttccagccacttgtaaggct

SEQ ID NO: 621199 - DNA, 25 bp, Mus musculus
ggctcttccagcgacttgtaaggct

SEQ ID NO: 621200 - DNA, 25 bp, Mus musculus
ggctcttccataagggcaaaaatgc

SEQ ID NO: 621201 - DNA, 25 bp, Mus musculus
ggctcttccatatgggcaaaaatgc

SEQ ID NO: 621202 - DNA, 25 bp, Mus musculus
ggctcttcccgacaggagattcgaa

SEQ ID NO: 621203 - DNA, 25 bp, Mus musculus
ggctcttcccgagaggagattcgaa

SEQ ID NO: 621204 - DNA, 25 bp, Mus musculus
ggctcttccctgaccaactgaaggg

SEQ ID NO: 621205 - DNA, 25 bp, Mus musculus
ggctcttccctgtccaactgaaggg

SEQ ID NO: 621206 - DNA, 25 bp, Mus musculus
ggctcttccgacagtttcggaccca

SEQ ID NO: 621207 - DNA, 25 bp, Mus musculus
ggctcttccgactgtttcggaccca

SEQ ID NO: 621208 - DNA, 25 bp, Mus musculus
ggctcttcctagattcaatggtttc

SEQ ID NO: 621209 - DNA, 25 bp, Mus musculus
ggctcttcctagtttcaatggtttc

SEQ ID NO: 621210 - DNA, 25 bp, Mus musculus
ggctcttcctgtaccagatacagaa

SEQ ID NO: 621211 - DNA, 25 bp, Mus musculus
ggctcttcctgttccagatacagaa

SEQ ID NO: 621212 - DNA, 25 bp, Mus musculus
ggctcttctagaacataaggtcagt

SEQ ID NO: 621213 - DNA, 25 bp, Mus musculus
ggctcttctagatcataaggtcagt

SEQ ID NO: 621214 - DNA, 25 bp, Mus musculus
ggctcttctgagcatgactgtcccc

SEQ ID NO: 621215 - DNA, 25 bp, Mus musculus
ggctcttctgaggatgactgtcccc

SEQ ID NO: 621216 - DNA, 25 bp, Mus musculus
ggctcttctggaaggctggcctgaa

SEQ ID NO: 621217 - DNA, 25 bp, Mus musculus
ggctcttctggatggctggcctgaa

SEQ ID NO: 621218 - DNA, 25 bp, Mus musculus
ggctcttctgggatcttaatatgta

SEQ ID NO: 621219 - DNA, 25 bp, Mus musculus
ggctcttctgggttcttaatatgta

SEQ ID NO: 621220 - DNA, 25 bp, Mus musculus
ggctcttcttataaaggtcctgact

SEQ ID NO: 621221 - DNA, 25 bp, Mus musculus
ggctcttcttattaaggtcctgact

SEQ ID NO: 621222 - DNA, 25 bp, Mus musculus
ggctcttgaaaaagccatcacgcag

SEQ ID NO: 621223 - DNA, 25 bp, Mus musculus
ggctcttgaaaatgccatcacgcag

SEQ ID NO: 621224 - DNA, 25 bp, Mus musculus
ggctcttgacccagtgagctgcgac

SEQ ID NO: 621225 - DNA, 25 bp, Mus musculus
ggctcttgaccctgtgagctgcgac

SEQ ID NO: 621226 - DNA, 25 bp, Mus musculus
ggctcttgactcacatctgtagaca

SEQ ID NO: 621227 - DNA, 25 bp, Mus musculus
ggctcttgactctcatctgtagaca

SEQ ID NO: 621228 - DNA, 25 bp, Mus musculus
ggctcttgagcaatgtatcctgtca

SEQ ID NO: 621229 - DNA, 25 bp, Mus musculus
ggctcttgagcattgtatcctgtca

SEQ ID NO: 621230 - DNA, 25 bp, Mus musculus
ggctcttgagcccaggaacatgcat

SEQ ID NO: 621231 - DNA, 25 bp, Mus musculus
ggctcttgagccgaggaacatgcat

SEQ ID NO: 621232 - DNA, 25 bp, Mus musculus
ggctcttgcatgaggtaaacgcgtt

SEQ ID NO: 621233 - DNA, 25 bp, Mus musculus
ggctcttgcatgtggtaaacgcgtt

SEQ ID NO: 621234 - DNA, 25 bp, Mus musculus
ggctcttgccacagtagctgagcaa

SEQ ID NO: 621235 - DNA, 25 bp, Mus musculus
ggctcttgccactgtagctgagcaa

SEQ ID NO: 621236 - DNA, 25 bp, Mus musculus
ggctcttgccagctctttcaaatac

SEQ ID NO: 621237 - DNA, 25 bp, Mus musculus
ggctcttgccaggtctttcaaatac

SEQ ID NO: 621238 - DNA, 25 bp, Mus musculus
ggctcttgccctattcaggatatga

SEQ ID NO: 621239 - DNA, 25 bp, Mus musculus
ggctcttgcccttttcaggatatga

SEQ ID NO: 621240 - DNA, 25 bp, Mus musculus
ggctcttgcggccagtattagactg

SEQ ID NO: 621241 - DNA, 25 bp, Mus musculus
ggctcttgcggcgagtattagactg

SEQ ID NO: 621242 - DNA, 25 bp, Mus musculus
ggctcttggagcaaggccgcctgtt

SEQ ID NO: 621243 - DNA, 25 bp, Mus musculus
ggctcttggagctaggccgcctgtt

SEQ ID NO: 621244 - DNA, 25 bp, Mus musculus
ggctcttggccaaggccttggacta

SEQ ID NO: 621245 - DNA, 25 bp, Mus musculus
ggctcttggccaatactcagttatt

SEQ ID NO: 621246 - DNA, 25 bp, Mus musculus
ggctcttggccatggccttggacta

SEQ ID NO: 621247 - DNA, 25 bp, Mus musculus
ggctcttggccattactcagttatt

SEQ ID NO: 621248 - DNA, 25 bp, Mus musculus
ggctcttggcctagaagctgtcaga

SEQ ID NO: 621249 - DNA, 25 bp, Mus musculus
ggctcttggccttgaagctgtcaga

SEQ ID NO: 621250 - DNA, 25 bp, Mus musculus
ggctcttgtactctatgtatccttc

SEQ ID NO: 621251 - DNA, 25 bp, Mus musculus
ggctcttgtactgtatgtatccttc

SEQ ID NO: 621252 - DNA, 25 bp, Mus musculus
ggctcttgtctacttttgtacacat

SEQ ID NO: 621253 - DNA, 25 bp, Mus musculus
ggctcttgtctagttttgtacacat

SEQ ID NO: 621254 - DNA, 25 bp, Mus musculus
ggctcttgtcttagggttacacata

SEQ ID NO: 621255 - DNA, 25 bp, Mus musculus
ggctcttgtctttgggttacacata

SEQ ID NO: 621256 - DNA, 25 bp, Mus musculus
ggctcttgtgaaactctgcttgcag

SEQ ID NO: 621257 - DNA, 25 bp, Mus musculus
ggctcttgtgaatctctgcttgcag

SEQ ID NO: 621258 - DNA, 25 bp, Mus musculus
ggctctttagacagacccgaaataa

SEQ ID NO: 621259 - DNA, 25 bp, Mus musculus
ggctctttagactgacccgaaataa

SEQ ID NO: 621260 - DNA, 25 bp, Mus musculus
ggctctttagagcagcaggacacct

SEQ ID NO: 621261 - DNA, 25 bp, Mus musculus
ggctctttagaggagcaggacacct

SEQ ID NO: 621262 - DNA, 25 bp, Mus musculus
ggctctttagctagcatctgagtga

SEQ ID NO: 621263 - DNA, 25 bp, Mus musculus
ggctctttagcttgcatctgagtga

SEQ ID NO: 621264 - DNA, 25 bp, Mus musculus
ggctctttaggacaaggtctcagtt

SEQ ID NO: 621265 - DNA, 25 bp, Mus musculus
ggctctttaggagaaggtctcagtt

SEQ ID NO: 621266 - DNA, 25 bp, Mus musculus
ggctctttagttctatgccatgaaa

SEQ ID NO: 621267 - DNA, 25 bp, Mus musculus
ggctctttagttgtatgccatgaaa

SEQ ID NO: 621268 - DNA, 25 bp, Mus musculus
ggctctttatccatgcagtttaata

SEQ ID NO: 621269 - DNA, 25 bp, Mus musculus
ggctctttatccttgcagtttaata

SEQ ID NO: 621270 - DNA, 25 bp, Mus musculus
ggctctttatttaatgctgtcttta

SEQ ID NO: 621271 - DNA, 25 bp, Mus musculus
ggctctttatttccctgattctttg

SEQ ID NO: 621272 - DNA, 25 bp, Mus musculus
ggctctttatttgcctgattctttg

SEQ ID NO: 621273 - DNA, 25 bp, Mus musculus
ggctctttattttatgctgtcttta

SEQ ID NO: 621274 - DNA, 25 bp, Mus musculus
ggctctttccctctagtctttaaga

SEQ ID NO: 621275 - DNA, 25 bp, Mus musculus
ggctctttccctgtagtctttaaga

SEQ ID NO: 621276 - DNA, 25 bp, Mus musculus
ggctctttcctcatgatccaaagat

SEQ ID NO: 621277 - DNA, 25 bp, Mus musculus
ggctctttcctcttgatccaaagat

SEQ ID NO: 621278 - DNA, 25 bp, Mus musculus
ggctctttctagaaggtggcgtttc

SEQ ID NO: 621279 - DNA, 25 bp, Mus musculus
ggctctttctagtaggtggcgtttc

SEQ ID NO: 621280 - DNA, 25 bp, Mus musculus
ggctctttgaaaagtcctctgtttg

SEQ ID NO: 621281 - DNA, 25 bp, Mus musculus
ggctctttgaaatgtcctctgtttg

SEQ ID NO: 621282 - DNA, 25 bp, Mus musculus
ggctctttgagaaaccttcttgaat

SEQ ID NO: 621283 - DNA, 25 bp, Mus musculus
ggctctttgagataccttcttgaat

SEQ ID NO: 621284 - DNA, 25 bp, Mus musculus
ggctctttggttcaaatccgaaatt

SEQ ID NO: 621285 - DNA, 25 bp, Mus musculus
ggctctttggttgaaatccgaaatt

SEQ ID NO: 621286 - DNA, 25 bp, Mus musculus
ggctctttgtctcttgctagtatta

SEQ ID NO: 621287 - DNA, 25 bp, Mus musculus
ggctctttgtctgttgctagtatta

SEQ ID NO: 621288 - DNA, 25 bp, Mus musculus
ggctctttgtgactgataattctat

SEQ ID NO: 621289 - DNA, 25 bp, Mus musculus
ggctctttgtgagtgataattctat

SEQ ID NO: 621290 - DNA, 25 bp, Mus musculus
ggctctttgtggctttgatatatcc

SEQ ID NO: 621291 - DNA, 25 bp, Mus musculus
ggctctttgtgggtttgatatatcc

SEQ ID NO: 621292 - DNA, 25 bp, Mus musculus
ggctctttgtttactactttcttat

SEQ ID NO: 621293 - DNA, 25 bp, Mus musculus
ggctctttgttttctactttcttat

SEQ ID NO: 621294 - DNA, 25 bp, Mus musculus
ggctcttttaacagaatctgccctt

SEQ ID NO: 621295 - DNA, 25 bp, Mus musculus
ggctcttttaactgaatctgccctt

SEQ ID NO: 621296 - DNA, 25 bp, Mus musculus
ggctcttttcacaatgccaggtaga

SEQ ID NO: 621297 - DNA, 25 bp, Mus musculus
ggctcttttcactatgccaggtaga

SEQ ID NO: 621298 - DNA, 25 bp, Mus musculus
ggctcttttgatactgtactgctgc

SEQ ID NO: 621299 - DNA, 25 bp, Mus musculus
ggctcttttgattctgtactgctgc

SEQ ID NO: 621300 - DNA, 25 bp, Mus musculus
ggctcttttgcccatgtcagcagag

SEQ ID NO: 621301 - DNA, 25 bp, Mus musculus
ggctcttttgccgatgtcagcagag

SEQ ID NO: 621302 - DNA, 25 bp, Mus musculus
ggctgaaaacatcgtggtcaccacc

SEQ ID NO: 621303 - DNA, 25 bp, Mus musculus
ggctgaaaacatggtggtcaccacc

SEQ ID NO: 621304 - DNA, 25 bp, Mus musculus
ggctgaaaagagacacccctctgtt

SEQ ID NO: 621305 - DNA, 25 bp, Mus musculus
ggctgaaaagagtcacccctctgtt

SEQ ID NO: 621306 - DNA, 25 bp, Mus musculus
ggctgaaaagcaacatcgactacca

SEQ ID NO: 621307 - DNA, 25 bp, Mus musculus
ggctgaaaagcatcatcgactacca

SEQ ID NO: 621308 - DNA, 25 bp, Mus musculus
ggctgaaacagtctagacctagata

SEQ ID NO: 621309 - DNA, 25 bp, Mus musculus
ggctgaaacagtgtagacctagata

SEQ ID NO: 621310 - DNA, 25 bp, Mus musculus
ggctgaaacctcatgtctgtaaact

SEQ ID NO: 621311 - DNA, 25 bp, Mus musculus
ggctgaaacctcttgtctgtaaact

SEQ ID NO: 621312 - DNA, 25 bp, Mus musculus
ggctgaaactgtcaaatacctctat

SEQ ID NO: 621313 - DNA, 25 bp, Mus musculus
ggctgaaactgtgaaatacctctat

SEQ ID NO: 621314 - DNA, 25 bp, Mus musculus
ggctgaaacttgaccatactcccta

SEQ ID NO: 621315 - DNA, 25 bp, Mus musculus
ggctgaaacttgtccatactcccta

SEQ ID NO: 621316 - DNA, 25 bp, Mus musculus
ggctgaaagaggaacagtgctatca

SEQ ID NO: 621317 - DNA, 25 bp, Mus musculus
ggctgaaagaggtacagtgctatca

SEQ ID NO: 621318 - DNA, 25 bp, Mus musculus
ggctgaaaggccatgcaaacacaac

SEQ ID NO: 621319 - DNA, 25 bp, Mus musculus
ggctgaaaggccttgcaaacacaac

SEQ ID NO: 621320 - DNA, 25 bp, Mus musculus
ggctgaaagtgtctgctcatcttct

SEQ ID NO: 621321 - DNA, 25 bp, Mus musculus
ggctgaaagtgtgtgctcatcttct

SEQ ID NO: 621322 - DNA, 25 bp, Mus musculus
ggctgaaatactaggccattctggt

SEQ ID NO: 621323 - DNA, 25 bp, Mus musculus
ggctgaaatacttggccattctggt

SEQ ID NO: 621324 - DNA, 25 bp, Mus musculus
ggctgaaatcaaccaggtgtaaaca

SEQ ID NO: 621325 - DNA, 25 bp, Mus musculus
ggctgaaatcaagcaggtgtaaaca

SEQ ID NO: 621326 - DNA, 25 bp, Mus musculus
ggctgaaatcacagaccaggaccct

SEQ ID NO: 621327 - DNA, 25 bp, Mus musculus
ggctgaaatcactgaccaggaccct

SEQ ID NO: 621328 - DNA, 25 bp, Mus musculus
ggctgaaatgttccctaggtatcct

SEQ ID NO: 621329 - DNA, 25 bp, Mus musculus
ggctgaaatgttgcctaggtatcct

SEQ ID NO: 621330 - DNA, 25 bp, Mus musculus
ggctgaaattctcctaccatgcctg

SEQ ID NO: 621331 - DNA, 25 bp, Mus musculus
ggctgaaattctgctaccatgcctg

SEQ ID NO: 621332 - DNA, 25 bp, Mus musculus
ggctgaaatttgcaccaacatgtga

SEQ ID NO: 621333 - DNA, 25 bp, Mus musculus
ggctgaaatttggaccaacatgtga

SEQ ID NO: 621334 - DNA, 25 bp, Mus musculus
ggctgaacacacatcatgttagctg

SEQ ID NO: 621335 - DNA, 25 bp, Mus musculus
ggctgaacacacttcatgttagctg

SEQ ID NO: 621336 - DNA, 25 bp, Mus musculus
ggctgaacaggtcctccaaaatttt

SEQ ID NO: 621337 - DNA, 25 bp, Mus musculus
ggctgaacaggtgctccaaaatttt

SEQ ID NO: 621338 - DNA, 25 bp, Mus musculus
ggctgaaccattagtcgtcgatctt

SEQ ID NO: 621339 - DNA, 25 bp, Mus musculus
ggctgaaccatttgtcgtcgatctt

SEQ ID NO: 621340 - DNA, 25 bp, Mus musculus
ggctgaaccggtaaccagagcactt

SEQ ID NO: 621341 - DNA, 25 bp, Mus musculus
ggctgaaccggttaccagagcactt

SEQ ID NO: 621342 - DNA, 25 bp, Mus musculus
ggctgaacctcgaggagttccagca

SEQ ID NO: 621343 - DNA, 25 bp, Mus musculus
ggctgaacctcgtggagttccagca

SEQ ID NO: 621344 - DNA, 25 bp, Mus musculus
ggctgaacctgccttcctgagacag

SEQ ID NO: 621345 - DNA, 25 bp, Mus musculus
ggctgaacctgcgttcctgagacag

SEQ ID NO: 621346 - DNA, 25 bp, Mus musculus
ggctgaacgtgcacaaggaacctta

SEQ ID NO: 621347 - DNA, 25 bp, Mus musculus
ggctgaacgtgctcaaggaacctta

SEQ ID NO: 621348 - DNA, 25 bp, Mus musculus
ggctgaactcagacattctaatcca

SEQ ID NO: 621349 - DNA, 25 bp, Mus musculus
ggctgaactcagtcattctaatcca

SEQ ID NO: 621350 - DNA, 25 bp, Mus musculus
ggctgaactctcaagatggatgaaa

SEQ ID NO: 621351 - DNA, 25 bp, Mus musculus
ggctgaactctctagatggatgaaa

SEQ ID NO: 621352 - DNA, 25 bp, Mus musculus
ggctgaacttgaaagcagacctgct

SEQ ID NO: 621353 - DNA, 25 bp, Mus musculus
ggctgaacttgacttcttccataag

SEQ ID NO: 621354 - DNA, 25 bp, Mus musculus
ggctgaacttgagttcttccataag

SEQ ID NO: 621355 - DNA, 25 bp, Mus musculus
ggctgaacttgatagcagacctgct

SEQ ID NO: 621356 - DNA, 25 bp, Mus musculus
ggctgaactttgagtgttatcctaa

SEQ ID NO: 621357 - DNA, 25 bp, Mus musculus
ggctgaactttgtgtgttatcctaa

SEQ ID NO: 621358 - DNA, 25 bp, Mus musculus
ggctgaagaaaacgatcacctacca

SEQ ID NO: 621359 - DNA, 25 bp, Mus musculus
ggctgaagaaaaggatcacctacca

SEQ ID NO: 621360 - DNA, 25 bp, Mus musculus
ggctgaagacaaacttgcggattcc

SEQ ID NO: 621361 - DNA, 25 bp, Mus musculus
ggctgaagacaatcttgcggattcc

SEQ ID NO: 621362 - DNA, 25 bp, Mus musculus
ggctgaagacctaagtatcggctgt

SEQ ID NO: 621363 - DNA, 25 bp, Mus musculus
ggctgaagaccttagtatcggctgt

SEQ ID NO: 621364 - DNA, 25 bp, Mus musculus
ggctgaagactgactgtcttcctct

SEQ ID NO: 621365 - DNA, 25 bp, Mus musculus
ggctgaagactgtctgtcttcctct

SEQ ID NO: 621366 - DNA, 25 bp, Mus musculus
ggctgaagctccagggctcctgcac

SEQ ID NO: 621367 - DNA, 25 bp, Mus musculus
ggctgaagctcctgggctcctgcac

SEQ ID NO: 621368 - DNA, 25 bp, Mus musculus
ggctgaagctctagggagcctcaga

SEQ ID NO: 621369 - DNA, 25 bp, Mus musculus
ggctgaagctcttgggagcctcaga

SEQ ID NO: 621370 - DNA, 25 bp, Mus musculus
ggctgaagcttgattccaggctgta

SEQ ID NO: 621371 - DNA, 25 bp, Mus musculus
ggctgaagcttgtttccaggctgta

SEQ ID NO: 621372 - DNA, 25 bp, Mus musculus
ggctgaaggagcagtcggactttct

SEQ ID NO: 621373 - DNA, 25 bp, Mus musculus
ggctgaaggagctgtcggactttct

SEQ ID NO: 621374 - DNA, 25 bp, Mus musculus
ggctgaaggcaaactaatctcacta

SEQ ID NO: 621375 - DNA, 25 bp, Mus musculus
ggctgaaggcaatctaatctcacta

SEQ ID NO: 621376 - DNA, 25 bp, Mus musculus
ggctgaaggcaccaccggttgaaca

SEQ ID NO: 621377 - DNA, 25 bp, Mus musculus
ggctgaaggcacgaccggttgaaca

SEQ ID NO: 621378 - DNA, 25 bp, Mus musculus
ggctgaaggcagaccatttcaagtt

SEQ ID NO: 621379 - DNA, 25 bp, Mus musculus
ggctgaaggcagtccatttcaagtt

SEQ ID NO: 621380 - DNA, 25 bp, Mus musculus
ggctgaagtccacgtcgtaagtttc

SEQ ID NO: 621381 - DNA, 25 bp, Mus musculus
ggctgaagtccaggtcgtaagtttc

SEQ ID NO: 621382 - DNA, 25 bp, Mus musculus
ggctgaagtgagctctggttctaaa

SEQ ID NO: 621383 - DNA, 25 bp, Mus musculus
ggctgaagtgaggtctggttctaaa

SEQ ID NO: 621384 - DNA, 25 bp, Mus musculus
ggctgaagtggcaagctctaactct

SEQ ID NO: 621385 - DNA, 25 bp, Mus musculus
ggctgaagtggctagctctaactct

SEQ ID NO: 621386 - DNA, 25 bp, Mus musculus
ggctgaagttgacgttgccttttaa

SEQ ID NO: 621387 - DNA, 25 bp, Mus musculus
ggctgaagttgaggttgccttttaa

SEQ ID NO: 621388 - DNA, 25 bp, Mus musculus
ggctgaagtttccttccggcaatta

SEQ ID NO: 621389 - DNA, 25 bp, Mus musculus
ggctgaagtttcgttccggcaatta

SEQ ID NO: 621390 - DNA, 25 bp, Mus musculus
ggctgaatacaaaatgcaaatgact

SEQ ID NO: 621391 - DNA, 25 bp, Mus musculus
ggctgaatacaatatgcaaatgact

SEQ ID NO: 621392 - DNA, 25 bp, Mus musculus
ggctgaatacccactgtttgctggt

SEQ ID NO: 621393 - DNA, 25 bp, Mus musculus
ggctgaataccctctgtttgctggt

SEQ ID NO: 621394 - DNA, 25 bp, Mus musculus
ggctgaatactcagatatgtaacat

SEQ ID NO: 621395 - DNA, 25 bp, Mus musculus
ggctgaatactctgatatgtaacat

SEQ ID NO: 621396 - DNA, 25 bp, Mus musculus
ggctgaatacttagcgccagcggga

SEQ ID NO: 621397 - DNA, 25 bp, Mus musculus
ggctgaatactttgcgccagcggga

SEQ ID NO: 621398 - DNA, 25 bp, Mus musculus
ggctgaatcactaatacactgctcc

SEQ ID NO: 621399 - DNA, 25 bp, Mus musculus
ggctgaatcacttatacactgctcc

SEQ ID NO: 621400 - DNA, 25 bp, Mus musculus
ggctgaatcctaaccaattttgaat

SEQ ID NO: 621401 - DNA, 25 bp, Mus musculus
ggctgaatcctatccaattttgaat

SEQ ID NO: 621402 - DNA, 25 bp, Mus musculus
ggctgaatcctcatgtgacctttta

SEQ ID NO: 621403 - DNA, 25 bp, Mus musculus
ggctgaatcctcttgtgacctttta

SEQ ID NO: 621404 - DNA, 25 bp, Mus musculus
ggctgaatctgtagccggagacaca

SEQ ID NO: 621405 - DNA, 25 bp, Mus musculus
ggctgaatctgttgccggagacaca

SEQ ID NO: 621406 - DNA, 25 bp, Mus musculus
ggctgaatgatcacgccatgcttag

SEQ ID NO: 621407 - DNA, 25 bp, Mus musculus
ggctgaatgatctcgccatgcttag

SEQ ID NO: 621408 - DNA, 25 bp, Mus musculus
ggctgaatgtccatcgagagtatct

SEQ ID NO: 621409 - DNA, 25 bp, Mus musculus
ggctgaatgtccttcgagagtatct

SEQ ID NO: 621410 - DNA, 25 bp, Mus musculus
ggctgaattataagcccttaggaat

SEQ ID NO: 621411 - DNA, 25 bp, Mus musculus
ggctgaattatatgcccttaggaat

SEQ ID NO: 621412 - DNA, 25 bp, Mus musculus
ggctgaattcccaaaggctgggtta

SEQ ID NO: 621413 - DNA, 25 bp, Mus musculus
ggctgaattccctaaggctgggtta

SEQ ID NO: 621414 - DNA, 25 bp, Mus musculus
ggctgaattcgtacctcctggcctc

SEQ ID NO: 621415 - DNA, 25 bp, Mus musculus
ggctgaattcgttcctcctggcctc

SEQ ID NO: 621416 - DNA, 25 bp, Mus musculus
ggctgaatttccatatagtttttac

SEQ ID NO: 621417 - DNA, 25 bp, Mus musculus
ggctgaatttccttatagtttttac

SEQ ID NO: 621418 - DNA, 25 bp, Mus musculus
ggctgaattttcagtggcgtgaaca

SEQ ID NO: 621419 - DNA, 25 bp, Mus musculus
ggctgaattttctgtggcgtgaaca

SEQ ID NO: 621420 - DNA, 25 bp, Mus musculus
ggctgacaaaaactttcttgctaat

SEQ ID NO: 621421 - DNA, 25 bp, Mus musculus
ggctgacaaaaagtttcttgctaat

SEQ ID NO: 621422 - DNA, 25 bp, Mus musculus
ggctgacaaagaccacccgaagttc

SEQ ID NO: 621423 - DNA, 25 bp, Mus musculus
ggctgacaaagagcacccgaagttc

SEQ ID NO: 621424 - DNA, 25 bp, Mus musculus
ggctgacaacagactttaatgtaat

SEQ ID NO: 621425 - DNA, 25 bp, Mus musculus
ggctgacaacagtctttaatgtaat

SEQ ID NO: 621426 - DNA, 25 bp, Mus musculus
ggctgacaagacctacatgttacga

SEQ ID NO: 621427 - DNA, 25 bp, Mus musculus
ggctgacaagacgtacatgttacga

SEQ ID NO: 621428 - DNA, 25 bp, Mus musculus
ggctgacaatacaatggcaaggctt

SEQ ID NO: 621429 - DNA, 25 bp, Mus musculus
ggctgacaatactatggcaaggctt

SEQ ID NO: 621430 - DNA, 25 bp, Mus musculus
ggctgacaatttcgttacccaggct

SEQ ID NO: 621431 - DNA, 25 bp, Mus musculus
ggctgacaatttggttacccaggct

SEQ ID NO: 621432 - DNA, 25 bp, Mus musculus
ggctgacacattctacacatttgtt

SEQ ID NO: 621433 - DNA, 25 bp, Mus musculus
ggctgacacattgtacacatttgtt

SEQ ID NO: 621434 - DNA, 25 bp, Mus musculus
ggctgacaccaacaagaatcgtatt

SEQ ID NO: 621435 - DNA, 25 bp, Mus musculus
ggctgacaccaagaagaatcgtatt

SEQ ID NO: 621436 - DNA, 25 bp, Mus musculus
ggctgacacccaactgcgaaatcac

SEQ ID NO: 621437 - DNA, 25 bp, Mus musculus
ggctgacacccatctgcgaaatcac

SEQ ID NO: 621438 - DNA, 25 bp, Mus musculus
ggctgacacctgaagagcttaccag

SEQ ID NO: 621439 - DNA, 25 bp, Mus musculus
ggctgacacctgtagagcttaccag

SEQ ID NO: 621440 - DNA, 25 bp, Mus musculus
ggctgacactagcttcaccaaacta

SEQ ID NO: 621441 - DNA, 25 bp, Mus musculus
ggctgacactaggttcaccaaacta

SEQ ID NO: 621442 - DNA, 25 bp, Mus musculus
ggctgacactttaagaagcgacttt

SEQ ID NO: 621443 - DNA, 25 bp, Mus musculus
ggctgacacttttagaagcgacttt

SEQ ID NO: 621444 - DNA, 25 bp, Mus musculus
ggctgacagagacacctacagaagg

SEQ ID NO: 621445 - DNA, 25 bp, Mus musculus
ggctgacagagagacctacagaagg

SEQ ID NO: 621446 - DNA, 25 bp, Mus musculus
ggctgacagagtactcattgcagtt

SEQ ID NO: 621447 - DNA, 25 bp, Mus musculus
ggctgacagagttctcattgcagtt

SEQ ID NO: 621448 - DNA, 25 bp, Mus musculus
ggctgacagcaacttacccattgat

SEQ ID NO: 621449 - DNA, 25 bp, Mus musculus
ggctgacagcaagttacccattgat

SEQ ID NO: 621450 - DNA, 25 bp, Mus musculus
ggctgacagcagaacattcttgtat

SEQ ID NO: 621451 - DNA, 25 bp, Mus musculus
ggctgacagcagtacattcttgtat

SEQ ID NO: 621452 - DNA, 25 bp, Mus musculus
ggctgacaggctagtaccccgggaa

SEQ ID NO: 621453 - DNA, 25 bp, Mus musculus
ggctgacaggcttgtaccccgggaa

SEQ ID NO: 621454 - DNA, 25 bp, Mus musculus
ggctgacaggtcaccagtcacatta

SEQ ID NO: 621455 - DNA, 25 bp, Mus musculus
ggctgacaggtctccagtcacatta

SEQ ID NO: 621456 - DNA, 25 bp, Mus musculus
ggctgacagtctccgcagctgctgt

SEQ ID NO: 621457 - DNA, 25 bp, Mus musculus
ggctgacagtctgcgcagctgctgt

SEQ ID NO: 621458 - DNA, 25 bp, Mus musculus
ggctgacatcttagctgagcttgga

SEQ ID NO: 621459 - DNA, 25 bp, Mus musculus
ggctgacatctttgctgagcttgga

SEQ ID NO: 621460 - DNA, 25 bp, Mus musculus
ggctgacatgacaaacctctgttaa

SEQ ID NO: 621461 - DNA, 25 bp, Mus musculus
ggctgacatgactaacctctgttaa

SEQ ID NO: 621462 - DNA, 25 bp, Mus musculus
ggctgacatgcaaattggaggctcc

SEQ ID NO: 621463 - DNA, 25 bp, Mus musculus
ggctgacatgcatattggaggctcc

SEQ ID NO: 621464 - DNA, 25 bp, Mus musculus
ggctgacatgtcatactgtgtggtt

SEQ ID NO: 621465 - DNA, 25 bp, Mus musculus
ggctgacatgtcttactgtgtggtt

SEQ ID NO: 621466 - DNA, 25 bp, Mus musculus
ggctgacattttaactgacccgctt

SEQ ID NO: 621467 - DNA, 25 bp, Mus musculus
ggctgacatttttactgacccgctt

SEQ ID NO: 621468 - DNA, 25 bp, Mus musculus
ggctgaccagagacgagttcttgta

SEQ ID NO: 621469 - DNA, 25 bp, Mus musculus
ggctgaccagagtcgagttcttgta

SEQ ID NO: 621470 - DNA, 25 bp, Mus musculus
ggctgaccatgcagatgagattcct

SEQ ID NO: 621471 - DNA, 25 bp, Mus musculus
ggctgaccatgctgatgagattcct

SEQ ID NO: 621472 - DNA, 25 bp, Mus musculus
ggctgacccatgcagtgctatacta

SEQ ID NO: 621473 - DNA, 25 bp, Mus musculus
ggctgacccatggagtgctatacta

SEQ ID NO: 621474 - DNA, 25 bp, Mus musculus
ggctgacccattccgaattagcaat

SEQ ID NO: 621475 - DNA, 25 bp, Mus musculus
ggctgacccattgcgaattagcaat

SEQ ID NO: 621476 - DNA, 25 bp, Mus musculus
ggctgacccgtacaagatacttgaa

SEQ ID NO: 621477 - DNA, 25 bp, Mus musculus
ggctgacccgtagaagatacttgaa

SEQ ID NO: 621478 - DNA, 25 bp, Mus musculus
ggctgaccctcacagtccatttagg

SEQ ID NO: 621479 - DNA, 25 bp, Mus musculus
ggctgaccctcagagtccatttagg

SEQ ID NO: 621480 - DNA, 25 bp, Mus musculus
ggctgaccggatactgaccatgaga

SEQ ID NO: 621481 - DNA, 25 bp, Mus musculus
ggctgaccggattctgaccatgaga

SEQ ID NO: 621482 - DNA, 25 bp, Mus musculus
ggctgacctacaaacaacgttcctt

SEQ ID NO: 621483 - DNA, 25 bp, Mus musculus
ggctgacctacatacaacgttcctt

SEQ ID NO: 621484 - DNA, 25 bp, Mus musculus
ggctgacctcataaataacctggga

SEQ ID NO: 621485 - DNA, 25 bp, Mus musculus
ggctgacctcatctgaagctggtgc

SEQ ID NO: 621486 - DNA, 25 bp, Mus musculus
ggctgacctcatgtgaagctggtgc

SEQ ID NO: 621487 - DNA, 25 bp, Mus musculus
ggctgacctcattaataacctggga

SEQ ID NO: 621488 - DNA, 25 bp, Mus musculus
ggctgacctccgcagtataaacaat

SEQ ID NO: 621489 - DNA, 25 bp, Mus musculus
ggctgacctccggagtataaacaat

SEQ ID NO: 621490 - DNA, 25 bp, Mus musculus
ggctgacctctaagcagaggctcct

SEQ ID NO: 621491 - DNA, 25 bp, Mus musculus
ggctgacctctatgcagaggctcct

SEQ ID NO: 621492 - DNA, 25 bp, Mus musculus
ggctgacctgaaatgactatgtaca

SEQ ID NO: 621493 - DNA, 25 bp, Mus musculus
ggctgacctgaattgactatgtaca

SEQ ID NO: 621494 - DNA, 25 bp, Mus musculus
ggctgacctggaatataatcacatt

SEQ ID NO: 621495 - DNA, 25 bp, Mus musculus
ggctgacctggattataatcacatt

SEQ ID NO: 621496 - DNA, 25 bp, Mus musculus
ggctgaccttggattcctaattttc

SEQ ID NO: 621497 - DNA, 25 bp, Mus musculus
ggctgaccttggctaccctgggcaa

SEQ ID NO: 621498 - DNA, 25 bp, Mus musculus
ggctgaccttgggtaccctgggcaa

SEQ ID NO: 621499 - DNA, 25 bp, Mus musculus
ggctgaccttggtttcctaattttc

SEQ ID NO: 621500 - DNA, 25 bp, Mus musculus
ggctgacgagatagccaaggctcaa

SEQ ID NO: 621501 - DNA, 25 bp, Mus musculus
ggctgacgagattgccaaggctcaa

SEQ ID NO: 621502 - DNA, 25 bp, Mus musculus
ggctgacgatcacattgccagacgt

SEQ ID NO: 621503 - DNA, 25 bp, Mus musculus
ggctgacgatcagattgccagacgt

SEQ ID NO: 621504 - DNA, 25 bp, Mus musculus
ggctgacgatctaacttgaaaacca

SEQ ID NO: 621505 - DNA, 25 bp, Mus musculus
ggctgacgatcttacttgaaaacca

SEQ ID NO: 621506 - DNA, 25 bp, Mus musculus
ggctgacggcagcagaattccttgc

SEQ ID NO: 621507 - DNA, 25 bp, Mus musculus
ggctgacggcaggagaattccttgc

SEQ ID NO: 621508 - DNA, 25 bp, Mus musculus
ggctgacggctgaagtgtctccatt

SEQ ID NO: 621509 - DNA, 25 bp, Mus musculus
ggctgacggctgtagtgtctccatt

SEQ ID NO: 621510 - DNA, 25 bp, Mus musculus
ggctgactaagcaggccgcaccttc

SEQ ID NO: 621511 - DNA, 25 bp, Mus musculus
ggctgactaagctggccgcaccttc

SEQ ID NO: 621512 - DNA, 25 bp, Mus musculus
ggctgactacatcaccgcagcatat

SEQ ID NO: 621513 - DNA, 25 bp, Mus musculus
ggctgactacatgaccgcagcatat

SEQ ID NO: 621514 - DNA, 25 bp, Mus musculus
ggctgactacctctaccggtgacca

SEQ ID NO: 621515 - DNA, 25 bp, Mus musculus
ggctgactacctgtaccggtgacca

SEQ ID NO: 621516 - DNA, 25 bp, Mus musculus
ggctgactactcaagacagttccta

SEQ ID NO: 621517 - DNA, 25 bp, Mus musculus
ggctgactactctagacagttccta

SEQ ID NO: 621518 - DNA, 25 bp, Mus musculus
ggctgactatctacacaatctctct

SEQ ID NO: 621519 - DNA, 25 bp, Mus musculus
ggctgactatcttcacaatctctct

SEQ ID NO: 621520 - DNA, 25 bp, Mus musculus
ggctgactccaaagaaccctgggtg

SEQ ID NO: 621521 - DNA, 25 bp, Mus musculus
ggctgactccaatgaaccctgggtg

SEQ ID NO: 621522 - DNA, 25 bp, Mus musculus
ggctgactccatctagtagatcctg

SEQ ID NO: 621523 - DNA, 25 bp, Mus musculus
ggctgactccatgtagtagatcctg

SEQ ID NO: 621524 - DNA, 25 bp, Mus musculus
ggctgactcctgacttgggccatag

SEQ ID NO: 621525 - DNA, 25 bp, Mus musculus
ggctgactcctgagaactgcaaaga

SEQ ID NO: 621526 - DNA, 25 bp, Mus musculus
ggctgactcctgtcttgggccatag

SEQ ID NO: 621527 - DNA, 25 bp, Mus musculus
ggctgactcctgtgaactgcaaaga

SEQ ID NO: 621528 - DNA, 25 bp, Mus musculus
ggctgactgaggcacactgtaatct

SEQ ID NO: 621529 - DNA, 25 bp, Mus musculus
ggctgactgagggacactgtaatct

SEQ ID NO: 621530 - DNA, 25 bp, Mus musculus
ggctgactgcagcttcttaacatct

SEQ ID NO: 621531 - DNA, 25 bp, Mus musculus
ggctgactgcaggttcttaacatct

SEQ ID NO: 621532 - DNA, 25 bp, Mus musculus
ggctgactggccctacatagaacag

SEQ ID NO: 621533 - DNA, 25 bp, Mus musculus
ggctgactggccgtacatagaacag

SEQ ID NO: 621534 - DNA, 25 bp, Mus musculus
ggctgactggtcaatataccaccat

SEQ ID NO: 621535 - DNA, 25 bp, Mus musculus
ggctgactggtctatataccaccat

SEQ ID NO: 621536 - DNA, 25 bp, Mus musculus
ggctgactgtaaatcccggctgtgc

SEQ ID NO: 621537 - DNA, 25 bp, Mus musculus
ggctgactgtaattcccggctgtgc

SEQ ID NO: 621538 - DNA, 25 bp, Mus musculus
ggctgactgtatcatgctgtctgga

SEQ ID NO: 621539 - DNA, 25 bp, Mus musculus
ggctgactgtatgatgctgtctgga

SEQ ID NO: 621540 - DNA, 25 bp, Mus musculus
ggctgacttcaaacaaaggcccttt

SEQ ID NO: 621541 - DNA, 25 bp, Mus musculus
ggctgacttcaatcaaaggcccttt

SEQ ID NO: 621542 - DNA, 25 bp, Mus musculus
ggctgacttcgaacttgcaatgatt

SEQ ID NO: 621543 - DNA, 25 bp, Mus musculus
ggctgacttcgatcttgcaatgatt

SEQ ID NO: 621544 - DNA, 25 bp, Mus musculus
ggctgagaacaccagactgacctct

SEQ ID NO: 621545 - DNA, 25 bp, Mus musculus
ggctgagaacacgagactgacctct

SEQ ID NO: 621546 - DNA, 25 bp, Mus musculus
ggctgagaacatcgctgacctcata

SEQ ID NO: 621547 - DNA, 25 bp, Mus musculus
ggctgagaacatggctgacctcata

SEQ ID NO: 621548 - DNA, 25 bp, Mus musculus
ggctgagaaccaaagttttagactg

SEQ ID NO: 621549 - DNA, 25 bp, Mus musculus
ggctgagaaccatagttttagactg

SEQ ID NO: 621550 - DNA, 25 bp, Mus musculus
ggctgagaacttagcttaacttgct

SEQ ID NO: 621551 - DNA, 25 bp, Mus musculus
ggctgagaacttagttgcccagagt

SEQ ID NO: 621552 - DNA, 25 bp, Mus musculus
ggctgagaactttgcttaacttgct

SEQ ID NO: 621553 - DNA, 25 bp, Mus musculus
ggctgagaactttgttgcccagagt

SEQ ID NO: 621554 - DNA, 25 bp, Mus musculus
ggctgagaaggcattctggattgtt

SEQ ID NO: 621555 - DNA, 25 bp, Mus musculus
ggctgagaaggctttctggattgtt

SEQ ID NO: 621556 - DNA, 25 bp, Mus musculus
ggctgagaataaccgtcctgctgta

SEQ ID NO: 621557 - DNA, 25 bp, Mus musculus
ggctgagaataagcgtcctgctgta

SEQ ID NO: 621558 - DNA, 25 bp, Mus musculus
ggctgagaatccaacctgagaactt

SEQ ID NO: 621559 - DNA, 25 bp, Mus musculus
ggctgagaatcctacctgagaactt

SEQ ID NO: 621560 - DNA, 25 bp, Mus musculus
ggctgagaatgaatttactccaaaa

SEQ ID NO: 621561 - DNA, 25 bp, Mus musculus
ggctgagaatgattttactccaaaa

SEQ ID NO: 621562 - DNA, 25 bp, Mus musculus
ggctgagaccacaggaatcctagac

SEQ ID NO: 621563 - DNA, 25 bp, Mus musculus
ggctgagaccactggaatcctagac

SEQ ID NO: 621564 - DNA, 25 bp, Mus musculus
ggctgagaccgcacctgagtactgg

SEQ ID NO: 621565 - DNA, 25 bp, Mus musculus
ggctgagaccgctcctgagtactgg

SEQ ID NO: 621566 - DNA, 25 bp, Mus musculus
ggctgagacgagacctgagtctcca

SEQ ID NO: 621567 - DNA, 25 bp, Mus musculus
ggctgagacgagtcctgagtctcca

SEQ ID NO: 621568 - DNA, 25 bp, Mus musculus
ggctgagagccgacgcgacttgcca

SEQ ID NO: 621569 - DNA, 25 bp, Mus musculus
ggctgagagccgctgcttcagtttt

SEQ ID NO: 621570 - DNA, 25 bp, Mus musculus
ggctgagagccggtgcttcagtttt

SEQ ID NO: 621571 - DNA, 25 bp, Mus musculus
ggctgagagccgtcgcgacttgcca

SEQ ID NO: 621572 - DNA, 25 bp, Mus musculus
ggctgagagctaatttggcccaagc

SEQ ID NO: 621573 - DNA, 25 bp, Mus musculus
ggctgagagctattttggcccaagc

SEQ ID NO: 621574 - DNA, 25 bp, Mus musculus
ggctgagagcttccgtattttcaaa

SEQ ID NO: 621575 - DNA, 25 bp, Mus musculus
ggctgagagcttgcgtattttcaaa

SEQ ID NO: 621576 - DNA, 25 bp, Mus musculus
ggctgagatcaacaaactgcttcaa

SEQ ID NO: 621577 - DNA, 25 bp, Mus musculus
ggctgagatcaagaaactgcttcaa

SEQ ID NO: 621578 - DNA, 25 bp, Mus musculus
ggctgagatcacagccacccagtgg

SEQ ID NO: 621579 - DNA, 25 bp, Mus musculus
ggctgagatcactgccacccagtgg

SEQ ID NO: 621580 - DNA, 25 bp, Mus musculus
ggctgagatctaccttacagctcat

SEQ ID NO: 621581 - DNA, 25 bp, Mus musculus
ggctgagatctagcttacagctcat

SEQ ID NO: 621582 - DNA, 25 bp, Mus musculus
ggctgagatcttatttacacacttt

SEQ ID NO: 621583 - DNA, 25 bp, Mus musculus
ggctgagatcttttttacacacttt

SEQ ID NO: 621584 - DNA, 25 bp, Mus musculus
ggctgagatgctagaagaccttcat

SEQ ID NO: 621585 - DNA, 25 bp, Mus musculus
ggctgagatgctctacaggcgaatc

SEQ ID NO: 621586 - DNA, 25 bp, Mus musculus
ggctgagatgctgtacaggcgaatc

SEQ ID NO: 621587 - DNA, 25 bp, Mus musculus
ggctgagatgcttgaagaccttcat

SEQ ID NO: 621588 - DNA, 25 bp, Mus musculus
ggctgagatggcaaagaacacaaaa

SEQ ID NO: 621589 - DNA, 25 bp, Mus musculus
ggctgagatggctaagaacacaaaa

SEQ ID NO: 621590 - DNA, 25 bp, Mus musculus
ggctgagcaagtctgtctgtttatt

SEQ ID NO: 621591 - DNA, 25 bp, Mus musculus
ggctgagcaagtgtgtctgtttatt

SEQ ID NO: 621592 - DNA, 25 bp, Mus musculus
ggctgagcagacaacagagccctgc

SEQ ID NO: 621593 - DNA, 25 bp, Mus musculus
ggctgagcagactacagagccctgc

SEQ ID NO: 621594 - DNA, 25 bp, Mus musculus
ggctgagcagccatatcgagagtca

SEQ ID NO: 621595 - DNA, 25 bp, Mus musculus
ggctgagcagccttatcgagagtca

SEQ ID NO: 621596 - DNA, 25 bp, Mus musculus
ggctgagcagtaagaccagtccatt

SEQ ID NO: 621597 - DNA, 25 bp, Mus musculus
ggctgagcagtatgaccagtccatt

SEQ ID NO: 621598 - DNA, 25 bp, Mus musculus
ggctgagccaaactgtgttctgttc

SEQ ID NO: 621599 - DNA, 25 bp, Mus musculus
ggctgagccaaagtgtgttctgttc

SEQ ID NO: 621600 - DNA, 25 bp, Mus musculus
ggctgagccaagacagttgagcatt

SEQ ID NO: 621601 - DNA, 25 bp, Mus musculus
ggctgagccaagtcagttgagcatt

SEQ ID NO: 621602 - DNA, 25 bp, Mus musculus
ggctgagccattaggcccagcgtat

SEQ ID NO: 621603 - DNA, 25 bp, Mus musculus
ggctgagccatttggcccagcgtat

SEQ ID NO: 621604 - DNA, 25 bp, Mus musculus
ggctgagcctaaaatcctgggttta

SEQ ID NO: 621605 - DNA, 25 bp, Mus musculus
ggctgagcctaatatcctgggttta

SEQ ID NO: 621606 - DNA, 25 bp, Mus musculus
ggctgagcctgaacttcaaactggg

SEQ ID NO: 621607 - DNA, 25 bp, Mus musculus
ggctgagcctgatcttcaaactggg

SEQ ID NO: 621608 - DNA, 25 bp, Mus musculus
ggctgagcctgcatgtcgaagcatc

SEQ ID NO: 621609 - DNA, 25 bp, Mus musculus
ggctgagcctgcttgtcgaagcatc

SEQ ID NO: 621610 - DNA, 25 bp, Mus musculus
ggctgagccttgaataataatgcga

SEQ ID NO: 621611 - DNA, 25 bp, Mus musculus
ggctgagccttgtataataatgcga

SEQ ID NO: 621612 - DNA, 25 bp, Mus musculus
ggctgagcggctcagtaaccatcct

SEQ ID NO: 621613 - DNA, 25 bp, Mus musculus
ggctgagcggctgagtaaccatcct

SEQ ID NO: 621614 - DNA, 25 bp, Mus musculus
ggctgagctaccacttggcacagat

SEQ ID NO: 621615 - DNA, 25 bp, Mus musculus
ggctgagctacctcttggcacagat

SEQ ID NO: 621616 - DNA, 25 bp, Mus musculus
ggctgagctatcaaaaaccctttct

SEQ ID NO: 621617 - DNA, 25 bp, Mus musculus
ggctgagctatctaaaaccctttct

SEQ ID NO: 621618 - DNA, 25 bp, Mus musculus
ggctgagctattacactgtgacctc

SEQ ID NO: 621619 - DNA, 25 bp, Mus musculus
ggctgagctatttcactgtgacctc

SEQ ID NO: 621620 - DNA, 25 bp, Mus musculus
ggctgagctcaaaggttctgcagaa

SEQ ID NO: 621621 - DNA, 25 bp, Mus musculus
ggctgagctcaatggttctgcagaa

SEQ ID NO: 621622 - DNA, 25 bp, Mus musculus
ggctgagctctcacagtgctgagaa

SEQ ID NO: 621623 - DNA, 25 bp, Mus musculus
ggctgagctctctcagtgctgagaa

SEQ ID NO: 621624 - DNA, 25 bp, Mus musculus
ggctgagctgacatgatgctcctat

SEQ ID NO: 621625 - DNA, 25 bp, Mus musculus
ggctgagctgacttgatgctcctat

SEQ ID NO: 621626 - DNA, 25 bp, Mus musculus
ggctgagctgatctctctggattca

SEQ ID NO: 621627 - DNA, 25 bp, Mus musculus
ggctgagctgatgtctctggattca

SEQ ID NO: 621628 - DNA, 25 bp, Mus musculus
ggctgagctggaacctgacaatact

SEQ ID NO: 621629 - DNA, 25 bp, Mus musculus
ggctgagctggatcctgacaatact

SEQ ID NO: 621630 - DNA, 25 bp, Mus musculus
ggctgagctggccaacttactgcgc

SEQ ID NO: 621631 - DNA, 25 bp, Mus musculus
ggctgagctggcgaacttactgcgc

SEQ ID NO: 621632 - DNA, 25 bp, Mus musculus
ggctgagcttcgagtgaaggcccat

SEQ ID NO: 621633 - DNA, 25 bp, Mus musculus
ggctgagcttcgtgtgaaggcccat

SEQ ID NO: 621634 - DNA, 25 bp, Mus musculus
ggctgaggaataagcccggctctgc

SEQ ID NO: 621635 - DNA, 25 bp, Mus musculus
ggctgaggaatatgcccggctctgc

SEQ ID NO: 621636 - DNA, 25 bp, Mus musculus
ggctgaggacatactgtatcccgag

SEQ ID NO: 621637 - DNA, 25 bp, Mus musculus
ggctgaggacattctgtatcccgag

SEQ ID NO: 621638 - DNA, 25 bp, Mus musculus
ggctgaggactacacaaaccaggtt

SEQ ID NO: 621639 - DNA, 25 bp, Mus musculus
ggctgaggactagacaaaccaggtt

SEQ ID NO: 621640 - DNA, 25 bp, Mus musculus
ggctgaggacttagtacattgtttt

SEQ ID NO: 621641 - DNA, 25 bp, Mus musculus
ggctgaggactttgtacattgtttt

SEQ ID NO: 621642 - DNA, 25 bp, Mus musculus
ggctgaggagcaagcttttctcaca

SEQ ID NO: 621643 - DNA, 25 bp, Mus musculus
ggctgaggagcatgcttttctcaca

SEQ ID NO: 621644 - DNA, 25 bp, Mus musculus
ggctgaggcaccactggagaatcct

SEQ ID NO: 621645 - DNA, 25 bp, Mus musculus
ggctgaggcacctctggagaatcct

SEQ ID NO: 621646 - DNA, 25 bp, Mus musculus
ggctgaggcccgagctgctctccaa

SEQ ID NO: 621647 - DNA, 25 bp, Mus musculus
ggctgaggcccgtgctgctctccaa

SEQ ID NO: 621648 - DNA, 25 bp, Mus musculus
ggctgaggcctgagattccagaaac

SEQ ID NO: 621649 - DNA, 25 bp, Mus musculus
ggctgaggcctgtgattccagaaac

SEQ ID NO: 621650 - DNA, 25 bp, Mus musculus
ggctgagggatgcacttcagcccct

SEQ ID NO: 621651 - DNA, 25 bp, Mus musculus
ggctgagggatggacttcagcccct

SEQ ID NO: 621652 - DNA, 25 bp, Mus musculus
ggctgagggcagagagcaattttta

SEQ ID NO: 621653 - DNA, 25 bp, Mus musculus
ggctgagggcagtgagcaattttta

SEQ ID NO: 621654 - DNA, 25 bp, Mus musculus
ggctgagggtctccagtttctgaaa

SEQ ID NO: 621655 - DNA, 25 bp, Mus musculus
ggctgagggtctgcagtttctgaaa

SEQ ID NO: 621656 - DNA, 25 bp, Mus musculus
ggctgaggttttactaccttcagac

SEQ ID NO: 621657 - DNA, 25 bp, Mus musculus
ggctgaggtttttctaccttcagac

SEQ ID NO: 621658 - DNA, 25 bp, Mus musculus
ggctgagtaaccatccttgaaatga

SEQ ID NO: 621659 - DNA, 25 bp, Mus musculus
ggctgagtaaccttccttgaaatga

SEQ ID NO: 621660 - DNA, 25 bp, Mus musculus
ggctgagtactcagcattcaagcta

SEQ ID NO: 621661 - DNA, 25 bp, Mus musculus
ggctgagtactctgcattcaagcta

SEQ ID NO: 621662 - DNA, 25 bp, Mus musculus
ggctgagtagccaaaagtctcttac

SEQ ID NO: 621663 - DNA, 25 bp, Mus musculus
ggctgagtagccacaagcagggtca

SEQ ID NO: 621664 - DNA, 25 bp, Mus musculus
ggctgagtagcctaaagtctcttac

SEQ ID NO: 621665 - DNA, 25 bp, Mus musculus
ggctgagtagcctcaagcagggtca

SEQ ID NO: 621666 - DNA, 25 bp, Mus musculus
ggctgagtatagctccactggatgt

SEQ ID NO: 621667 - DNA, 25 bp, Mus musculus
ggctgagtataggtccactggatgt

SEQ ID NO: 621668 - DNA, 25 bp, Mus musculus
ggctgagtattcagcaggctcttac

SEQ ID NO: 621669 - DNA, 25 bp, Mus musculus
ggctgagtattctgcaggctcttac

SEQ ID NO: 621670 - DNA, 25 bp, Mus musculus
ggctgagtattgatcttctttctag

SEQ ID NO: 621671 - DNA, 25 bp, Mus musculus
ggctgagtattgttcttctttctag

SEQ ID NO: 621672 - DNA, 25 bp, Mus musculus
ggctgagtcactagaatctacctcc

SEQ ID NO: 621673 - DNA, 25 bp, Mus musculus
ggctgagtcacttgaatctacctcc

SEQ ID NO: 621674 - DNA, 25 bp, Mus musculus
ggctgagtctatcgcaaacatctgt

SEQ ID NO: 621675 - DNA, 25 bp, Mus musculus
ggctgagtctatggcaaacatctgt

SEQ ID NO: 621676 - DNA, 25 bp, Mus musculus
ggctgagtcttaaggacatggattt

SEQ ID NO: 621677 - DNA, 25 bp, Mus musculus
ggctgagtcttatggacatggattt

SEQ ID NO: 621678 - DNA, 25 bp, Mus musculus
ggctgagtgaccagtattacttaac

SEQ ID NO: 621679 - DNA, 25 bp, Mus musculus
ggctgagtgacctgtattacttaac

SEQ ID NO: 621680 - DNA, 25 bp, Mus musculus
ggctgagtgctaaggattggtctat

SEQ ID NO: 621681 - DNA, 25 bp, Mus musculus
ggctgagtgctatggattggtctat

SEQ ID NO: 621682 - DNA, 25 bp, Mus musculus
ggctgagtgctcaccacatagctga

SEQ ID NO: 621683 - DNA, 25 bp, Mus musculus
ggctgagtgctctccacatagctga

SEQ ID NO: 621684 - DNA, 25 bp, Mus musculus
ggctgagttagccaccctagggatt

SEQ ID NO: 621685 - DNA, 25 bp, Mus musculus
ggctgagttagcgaccctagggatt

SEQ ID NO: 621686 - DNA, 25 bp, Mus musculus
ggctgagttgtcactttaaccagga

SEQ ID NO: 621687 - DNA, 25 bp, Mus musculus
ggctgagttgtctctttaaccagga

SEQ ID NO: 621688 - DNA, 25 bp, Mus musculus
ggctgataaccaacctataatgcat

SEQ ID NO: 621689 - DNA, 25 bp, Mus musculus
ggctgataaccatcctataatgcat

SEQ ID NO: 621690 - DNA, 25 bp, Mus musculus
ggctgataactgctccacagctgga

SEQ ID NO: 621691 - DNA, 25 bp, Mus musculus
ggctgataactggtccacagctgga

SEQ ID NO: 621692 - DNA, 25 bp, Mus musculus
ggctgataagataatcctccctatg

SEQ ID NO: 621693 - DNA, 25 bp, Mus musculus
ggctgataagattatcctccctatg

SEQ ID NO: 621694 - DNA, 25 bp, Mus musculus
ggctgataattcagattgccaaatt

SEQ ID NO: 621695 - DNA, 25 bp, Mus musculus
ggctgataattctgattgccaaatt

SEQ ID NO: 621696 - DNA, 25 bp, Mus musculus
ggctgatacagcaaacatgtctgac

SEQ ID NO: 621697 - DNA, 25 bp, Mus musculus
ggctgatacagctaacatgtctgac

SEQ ID NO: 621698 - DNA, 25 bp, Mus musculus
ggctgatagggcagtttccatataa

SEQ ID NO: 621699 - DNA, 25 bp, Mus musculus
ggctgatagggctgtttccatataa

SEQ ID NO: 621700 - DNA, 25 bp, Mus musculus
ggctgataggttagtcttttgttgt

SEQ ID NO: 621701 - DNA, 25 bp, Mus musculus
ggctgataggtttgtcttttgttgt

SEQ ID NO: 621702 - DNA, 25 bp, Mus musculus
ggctgatcacatccaaaaagtcatg

SEQ ID NO: 621703 - DNA, 25 bp, Mus musculus
ggctgatcacatgcaaaaagtcatg

SEQ ID NO: 621704 - DNA, 25 bp, Mus musculus
ggctgatcacgtccctgaggtatgc

SEQ ID NO: 621705 - DNA, 25 bp, Mus musculus
ggctgatcacgtctactatttcctg

SEQ ID NO: 621706 - DNA, 25 bp, Mus musculus
ggctgatcacgtgcctgaggtatgc

SEQ ID NO: 621707 - DNA, 25 bp, Mus musculus
ggctgatcacgtgtactatttcctg

SEQ ID NO: 621708 - DNA, 25 bp, Mus musculus
ggctgatcagtaagtggccactctt

SEQ ID NO: 621709 - DNA, 25 bp, Mus musculus
ggctgatcagtatgtggccactctt

SEQ ID NO: 621710 - DNA, 25 bp, Mus musculus
ggctgatccacaagaccagtagcat

SEQ ID NO: 621711 - DNA, 25 bp, Mus musculus
ggctgatccacatgaccagtagcat

SEQ ID NO: 621712 - DNA, 25 bp, Mus musculus
ggctgatctatactgccagctctaa

SEQ ID NO: 621713 - DNA, 25 bp, Mus musculus
ggctgatctatagtgccagctctaa

SEQ ID NO: 621714 - DNA, 25 bp, Mus musculus
ggctgatcttgactgactttcctaa

SEQ ID NO: 621715 - DNA, 25 bp, Mus musculus
ggctgatcttgagtgactttcctaa

SEQ ID NO: 621716 - DNA, 25 bp, Mus musculus
ggctgatcttggagttaaacccggt

SEQ ID NO: 621717 - DNA, 25 bp, Mus musculus
ggctgatcttggtgttaaacccggt

SEQ ID NO: 621718 - DNA, 25 bp, Mus musculus
ggctgatgacccacctaaatttaaa

SEQ ID NO: 621719 - DNA, 25 bp, Mus musculus
ggctgatgaccctcctaaatttaaa

SEQ ID NO: 621720 - DNA, 25 bp, Mus musculus
ggctgatgacttcaacttgggacta

SEQ ID NO: 621721 - DNA, 25 bp, Mus musculus
ggctgatgacttgaacttgggacta

SEQ ID NO: 621722 - DNA, 25 bp, Mus musculus
ggctgatgcacaagtaacctatttc

SEQ ID NO: 621723 - DNA, 25 bp, Mus musculus
ggctgatgcacatgtaacctatttc

SEQ ID NO: 621724 - DNA, 25 bp, Mus musculus
ggctgatgcagaacttttttgccag

SEQ ID NO: 621725 - DNA, 25 bp, Mus musculus
ggctgatgcagatcttttttgccag

SEQ ID NO: 621726 - DNA, 25 bp, Mus musculus
ggctgatgcatacctttgggtcttc

SEQ ID NO: 621727 - DNA, 25 bp, Mus musculus
ggctgatgcatagctttgggtcttc

SEQ ID NO: 621728 - DNA, 25 bp, Mus musculus
ggctgatgctcactagtgaacccca

SEQ ID NO: 621729 - DNA, 25 bp, Mus musculus
ggctgatgctcagtagtgaacccca

SEQ ID NO: 621730 - DNA, 25 bp, Mus musculus
ggctgatgctttaaatgattgttag

SEQ ID NO: 621731 - DNA, 25 bp, Mus musculus
ggctgatgcttttaatgattgttag

SEQ ID NO: 621732 - DNA, 25 bp, Mus musculus
ggctgatggctaagacctagagatc

SEQ ID NO: 621733 - DNA, 25 bp, Mus musculus
ggctgatggctatgacctagagatc

SEQ ID NO: 621734 - DNA, 25 bp, Mus musculus
ggctgatgggatccctgtcacaatt

SEQ ID NO: 621735 - DNA, 25 bp, Mus musculus
ggctgatgggatcgccacaactttg

SEQ ID NO: 621736 - DNA, 25 bp, Mus musculus
ggctgatgggatgcctgtcacaatt

SEQ ID NO: 621737 - DNA, 25 bp, Mus musculus
ggctgatgggatggccacaactttg

SEQ ID NO: 621738 - DNA, 25 bp, Mus musculus
ggctgatgtacgagtctgtgtgaat

SEQ ID NO: 621739 - DNA, 25 bp, Mus musculus
ggctgatgtacgtgtctgtgtgaat

SEQ ID NO: 621740 - DNA, 25 bp, Mus musculus
ggctgatgtattctgcttcactggg

SEQ ID NO: 621741 - DNA, 25 bp, Mus musculus
ggctgatgtattgtgcttcactggg

SEQ ID NO: 621742 - DNA, 25 bp, Mus musculus
ggctgatgtcaacagggtaacctac

SEQ ID NO: 621743 - DNA, 25 bp, Mus musculus
ggctgatgtcaagagggtaacctac

SEQ ID NO: 621744 - DNA, 25 bp, Mus musculus
ggctgatgtgatccggcacgcaaaa

SEQ ID NO: 621745 - DNA, 25 bp, Mus musculus
ggctgatgtgatgcggcacgcaaaa

SEQ ID NO: 621746 - DNA, 25 bp, Mus musculus
ggctgatgtttgcagttgactccaa

SEQ ID NO: 621747 - DNA, 25 bp, Mus musculus
ggctgatgtttggagttgactccaa

SEQ ID NO: 621748 - DNA, 25 bp, Mus musculus
ggctgattatccattgagtctctgt

SEQ ID NO: 621749 - DNA, 25 bp, Mus musculus
ggctgattatcctttgagtctctgt

SEQ ID NO: 621750 - DNA, 25 bp, Mus musculus
ggctgattatctcagattctgcccc

SEQ ID NO: 621751 - DNA, 25 bp, Mus musculus
ggctgattatctgagattctgcccc

SEQ ID NO: 621752 - DNA, 25 bp, Mus musculus
ggctgattatgactacccaccggga

SEQ ID NO: 621753 - DNA, 25 bp, Mus musculus
ggctgattatgagtacccaccggga

SEQ ID NO: 621754 - DNA, 25 bp, Mus musculus
ggctgattcaaaccaagatcactga

SEQ ID NO: 621755 - DNA, 25 bp, Mus musculus
ggctgattcaaagcaagatcactga

SEQ ID NO: 621756 - DNA, 25 bp, Mus musculus
ggctgattcactacttttgaacctt

SEQ ID NO: 621757 - DNA, 25 bp, Mus musculus
ggctgattcacttcttttgaacctt

SEQ ID NO: 621758 - DNA, 25 bp, Mus musculus
ggctgattcaggctagaaactttca

SEQ ID NO: 621759 - DNA, 25 bp, Mus musculus
ggctgattcagggtagaaactttca

SEQ ID NO: 621760 - DNA, 25 bp, Mus musculus
ggctgattcatcaattaactcttac

SEQ ID NO: 621761 - DNA, 25 bp, Mus musculus
ggctgattcatctattaactcttac

SEQ ID NO: 621762 - DNA, 25 bp, Mus musculus
ggctgattctgactttattaccaac

SEQ ID NO: 621763 - DNA, 25 bp, Mus musculus
ggctgattctgagtttattaccaac

SEQ ID NO: 621764 - DNA, 25 bp, Mus musculus
ggctgattgcctcccaaaagactat

SEQ ID NO: 621765 - DNA, 25 bp, Mus musculus
ggctgattgcctgccaaaagactat

SEQ ID NO: 621766 - DNA, 25 bp, Mus musculus
ggctgattgggaattccatgttctt

SEQ ID NO: 621767 - DNA, 25 bp, Mus musculus
ggctgattgggatttccatgttctt

SEQ ID NO: 621768 - DNA, 25 bp, Mus musculus
ggctgatttcaaaccttcctagagg

SEQ ID NO: 621769 - DNA, 25 bp, Mus musculus
ggctgatttcaatccttcctagagg

SEQ ID NO: 621770 - DNA, 25 bp, Mus musculus
ggctgatttcacatttgacaacttt

SEQ ID NO: 621771 - DNA, 25 bp, Mus musculus
ggctgatttcacttttgacaacttt

SEQ ID NO: 621772 - DNA, 25 bp, Mus musculus
ggctgatttcagacaatttgagcag

SEQ ID NO: 621773 - DNA, 25 bp, Mus musculus
ggctgatttcagtcaatttgagcag

SEQ ID NO: 621774 - DNA, 25 bp, Mus musculus
ggctgatttggaaaccaccactttg

SEQ ID NO: 621775 - DNA, 25 bp, Mus musculus
ggctgatttggataccaccactttg

SEQ ID NO: 621776 - DNA, 25 bp, Mus musculus
ggctgatttttgctcatttgcttat

SEQ ID NO: 621777 - DNA, 25 bp, Mus musculus
ggctgatttttggtcatttgcttat

SEQ ID NO: 621778 - DNA, 25 bp, Mus musculus
ggctgcaaagagacgctgcctggaa

SEQ ID NO: 621779 - DNA, 25 bp, Mus musculus
ggctgcaaagagtcgctgcctggaa

SEQ ID NO: 621780 - DNA, 25 bp, Mus musculus
ggctgcaaaggacgtgccacttgat

SEQ ID NO: 621781 - DNA, 25 bp, Mus musculus
ggctgcaaaggaggtgccacttgat

SEQ ID NO: 621782 - DNA, 25 bp, Mus musculus
ggctgcaagacacctacaatctgga

SEQ ID NO: 621783 - DNA, 25 bp, Mus musculus
ggctgcaagacagctacaatctgga

SEQ ID NO: 621784 - DNA, 25 bp, Mus musculus
ggctgcaagatgcaaagccattgct

SEQ ID NO: 621785 - DNA, 25 bp, Mus musculus
ggctgcaagatggaaagccattgct

SEQ ID NO: 621786 - DNA, 25 bp, Mus musculus
ggctgcaaggcactatggctccaaa

SEQ ID NO: 621787 - DNA, 25 bp, Mus musculus
ggctgcaaggcagtatggctccaaa

SEQ ID NO: 621788 - DNA, 25 bp, Mus musculus
ggctgcaatataaaccatgtttctg

SEQ ID NO: 621789 - DNA, 25 bp, Mus musculus
ggctgcaatatataccatgtttctg

SEQ ID NO: 621790 - DNA, 25 bp, Mus musculus
ggctgcaatggcattggatttcctt

SEQ ID NO: 621791 - DNA, 25 bp, Mus musculus
ggctgcaatggctttggatttcctt

SEQ ID NO: 621792 - DNA, 25 bp, Mus musculus
ggctgcaattctctgatgaaaccaa

SEQ ID NO: 621793 - DNA, 25 bp, Mus musculus
ggctgcaattctgtgatgaaaccaa

SEQ ID NO: 621794 - DNA, 25 bp, Mus musculus
ggctgcacaacaatatcatctccat

SEQ ID NO: 621795 - DNA, 25 bp, Mus musculus
ggctgcacaacattatcatctccat

SEQ ID NO: 621796 - DNA, 25 bp, Mus musculus
ggctgcacaaccactgcgcctactg

SEQ ID NO: 621797 - DNA, 25 bp, Mus musculus
ggctgcacaacctctgcgcctactg

SEQ ID NO: 621798 - DNA, 25 bp, Mus musculus
ggctgcacaacgaagaccaaatggc

SEQ ID NO: 621799 - DNA, 25 bp, Mus musculus
ggctgcacaacgtagaccaaatggc

SEQ ID NO: 621800 - DNA, 25 bp, Mus musculus
ggctgcacacgcctggtgactgact

SEQ ID NO: 621801 - DNA, 25 bp, Mus musculus
ggctgcacacgcgtggtgactgact

SEQ ID NO: 621802 - DNA, 25 bp, Mus musculus
ggctgcacacggatcagaatgctga

SEQ ID NO: 621803 - DNA, 25 bp, Mus musculus
ggctgcacacggttcagaatgctga

SEQ ID NO: 621804 - DNA, 25 bp, Mus musculus
ggctgcacagtccaagtctaaatga

SEQ ID NO: 621805 - DNA, 25 bp, Mus musculus
ggctgcacagtcgaagtctaaatga

SEQ ID NO: 621806 - DNA, 25 bp, Mus musculus
ggctgcacagtgaatctatgaaatt

SEQ ID NO: 621807 - DNA, 25 bp, Mus musculus
ggctgcacagtgtatctatgaaatt

SEQ ID NO: 621808 - DNA, 25 bp, Mus musculus
ggctgcacattgagtggtcgtccaa

SEQ ID NO: 621809 - DNA, 25 bp, Mus musculus
ggctgcacattgtgtggtcgtccaa

SEQ ID NO: 621810 - DNA, 25 bp, Mus musculus
ggctgcacccagcaagacctgttgg

SEQ ID NO: 621811 - DNA, 25 bp, Mus musculus
ggctgcacccaggaagacctgttgg

SEQ ID NO: 621812 - DNA, 25 bp, Mus musculus
ggctgcaccgaacaaaaacatatcc

SEQ ID NO: 621813 - DNA, 25 bp, Mus musculus
ggctgcaccgaagaaaaacatatcc

SEQ ID NO: 621814 - DNA, 25 bp, Mus musculus
ggctgcaccgtgatattgatgacct

SEQ ID NO: 621815 - DNA, 25 bp, Mus musculus
ggctgcaccgtgttattgatgacct

SEQ ID NO: 621816 - DNA, 25 bp, Mus musculus
ggctgcacctatatcctgaataaaa

SEQ ID NO: 621817 - DNA, 25 bp, Mus musculus
ggctgcacctatttcctgaataaaa

SEQ ID NO: 621818 - DNA, 25 bp, Mus musculus
ggctgcacgacaagaccaaagttta

SEQ ID NO: 621819 - DNA, 25 bp, Mus musculus
ggctgcacgacatgaccaaagttta

SEQ ID NO: 621820 - DNA, 25 bp, Mus musculus
ggctgcactcctcacagaagtgtta

SEQ ID NO: 621821 - DNA, 25 bp, Mus musculus
ggctgcactcctgacagaagtgtta

SEQ ID NO: 621822 - DNA, 25 bp, Mus musculus
ggctgcactcgtacatgcagagcta

SEQ ID NO: 621823 - DNA, 25 bp, Mus musculus
ggctgcactcgttcatgcagagcta

SEQ ID NO: 621824 - DNA, 25 bp, Mus musculus
ggctgcactcttcgcgacaagaact

SEQ ID NO: 621825 - DNA, 25 bp, Mus musculus
ggctgcactcttggcgacaagaact

SEQ ID NO: 621826 - DNA, 25 bp, Mus musculus
ggctgcactgaaagtttccgtttaa

SEQ ID NO: 621827 - DNA, 25 bp, Mus musculus
ggctgcactgaatgtttccgtttaa

SEQ ID NO: 621828 - DNA, 25 bp, Mus musculus
ggctgcactgcaccagtattgagtg

SEQ ID NO: 621829 - DNA, 25 bp, Mus musculus
ggctgcactgcagcagtattgagtg

SEQ ID NO: 621830 - DNA, 25 bp, Mus musculus
ggctgcactgctcgctgattgttta

SEQ ID NO: 621831 - DNA, 25 bp, Mus musculus
ggctgcactgctggctgattgttta

SEQ ID NO: 621832 - DNA, 25 bp, Mus musculus
ggctgcagaaccacctgtgaggata

SEQ ID NO: 621833 - DNA, 25 bp, Mus musculus
ggctgcagaacctcctgtgaggata

SEQ ID NO: 621834 - DNA, 25 bp, Mus musculus
ggctgcagaaggcaaatgctcccag

SEQ ID NO: 621835 - DNA, 25 bp, Mus musculus
ggctgcagaagggaaatgctcccag

SEQ ID NO: 621836 - DNA, 25 bp, Mus musculus
ggctgcagacccagaacagcgactg

SEQ ID NO: 621837 - DNA, 25 bp, Mus musculus
ggctgcagaccctgaacagcgactg

SEQ ID NO: 621838 - DNA, 25 bp, Mus musculus
ggctgcagactgcattcgcatcagt

SEQ ID NO: 621839 - DNA, 25 bp, Mus musculus
ggctgcagactggattcgcatcagt

SEQ ID NO: 621840 - DNA, 25 bp, Mus musculus
ggctgcagagatcaccccatgtgta

SEQ ID NO: 621841 - DNA, 25 bp, Mus musculus
ggctgcagagatgaccccatgtgta

SEQ ID NO: 621842 - DNA, 25 bp, Mus musculus
ggctgcagagcactggtctaaccct

SEQ ID NO: 621843 - DNA, 25 bp, Mus musculus
ggctgcagagcagtggtctaaccct

SEQ ID NO: 621844 - DNA, 25 bp, Mus musculus
ggctgcagatagacctattcttgac

SEQ ID NO: 621845 - DNA, 25 bp, Mus musculus
ggctgcagatagtcctattcttgac

SEQ ID NO: 621846 - DNA, 25 bp, Mus musculus
ggctgcagatggaggccattgctct

SEQ ID NO: 621847 - DNA, 25 bp, Mus musculus
ggctgcagatggatcccagaacctg

SEQ ID NO: 621848 - DNA, 25 bp, Mus musculus
ggctgcagatggtggccattgctct

SEQ ID NO: 621849 - DNA, 25 bp, Mus musculus
ggctgcagatggttcccagaacctg

SEQ ID NO: 621850 - DNA, 25 bp, Mus musculus
ggctgcagcagtaaggtggcttttt

SEQ ID NO: 621851 - DNA, 25 bp, Mus musculus
ggctgcagcagttaggtggcttttt

SEQ ID NO: 621852 - DNA, 25 bp, Mus musculus
ggctgcagcattatccccataaaaa

SEQ ID NO: 621853 - DNA, 25 bp, Mus musculus
ggctgcagcattttccccataaaaa

SEQ ID NO: 621854 - DNA, 25 bp, Mus musculus
ggctgcagccgtagcagcatccatc

SEQ ID NO: 621855 - DNA, 25 bp, Mus musculus
ggctgcagccgtcaaccaactgaga

SEQ ID NO: 621856 - DNA, 25 bp, Mus musculus
ggctgcagccgtgaaccaactgaga

SEQ ID NO: 621857 - DNA, 25 bp, Mus musculus
ggctgcagccgttgcagcatccatc

SEQ ID NO: 621858 - DNA, 25 bp, Mus musculus
ggctgcagcctactagttcaggtac

SEQ ID NO: 621859 - DNA, 25 bp, Mus musculus
ggctgcagcctagtagttcaggtac

SEQ ID NO: 621860 - DNA, 25 bp, Mus musculus
ggctgcagcgctcagtgtttagcac

SEQ ID NO: 621861 - DNA, 25 bp, Mus musculus
ggctgcagcgctgagtgtttagcac

SEQ ID NO: 621862 - DNA, 25 bp, Mus musculus
ggctgcagctctacttaaatatatg

SEQ ID NO: 621863 - DNA, 25 bp, Mus musculus
ggctgcagctcttcttaaatatatg

SEQ ID NO: 621864 - DNA, 25 bp, Mus musculus
ggctgcagctgaaccacatgctttg

SEQ ID NO: 621865 - DNA, 25 bp, Mus musculus
ggctgcagctgatccacatgctttg

SEQ ID NO: 621866 - DNA, 25 bp, Mus musculus
ggctgcagcttaaagctctgtgtta

SEQ ID NO: 621867 - DNA, 25 bp, Mus musculus
ggctgcagcttatagctctgtgtta

SEQ ID NO: 621868 - DNA, 25 bp, Mus musculus
ggctgcaggactagtgagtgatctc

SEQ ID NO: 621869 - DNA, 25 bp, Mus musculus
ggctgcaggacttgtgagtgatctc

SEQ ID NO: 621870 - DNA, 25 bp, Mus musculus
ggctgcaggccacaaggcagcacct

SEQ ID NO: 621871 - DNA, 25 bp, Mus musculus
ggctgcaggccagaaggcagcacct

SEQ ID NO: 621872 - DNA, 25 bp, Mus musculus
ggctgcaggcccaggtttagcattc

SEQ ID NO: 621873 - DNA, 25 bp, Mus musculus
ggctgcaggccctggtttagcattc

SEQ ID NO: 621874 - DNA, 25 bp, Mus musculus
ggctgcaggtgcaagccccagtttg

SEQ ID NO: 621875 - DNA, 25 bp, Mus musculus
ggctgcaggtgctagccccagtttg

SEQ ID NO: 621876 - DNA, 25 bp, Mus musculus
ggctgcagtgatatgtttttatcag

SEQ ID NO: 621877 - DNA, 25 bp, Mus musculus
ggctgcagtgatttgtttttatcag

SEQ ID NO: 621878 - DNA, 25 bp, Mus musculus
ggctgcagtgctcttcccagatgtg

SEQ ID NO: 621879 - DNA, 25 bp, Mus musculus
ggctgcagtgctgttcccagatgtg

SEQ ID NO: 621880 - DNA, 25 bp, Mus musculus
ggctgcagttgaaatgtgcagttgt

SEQ ID NO: 621881 - DNA, 25 bp, Mus musculus
ggctgcagttgatatgtgcagttgt

SEQ ID NO: 621882 - DNA, 25 bp, Mus musculus
ggctgcataattcaatcactcctac

SEQ ID NO: 621883 - DNA, 25 bp, Mus musculus
ggctgcataattgaatcactcctac

SEQ ID NO: 621884 - DNA, 25 bp, Mus musculus
ggctgcatagagaacggcccggcat

SEQ ID NO: 621885 - DNA, 25 bp, Mus musculus
ggctgcatagagtacggcccggcat

SEQ ID NO: 621886 - DNA, 25 bp, Mus musculus
ggctgcatatacagatcttcagcag

SEQ ID NO: 621887 - DNA, 25 bp, Mus musculus
ggctgcatatactgatcttcagcag

SEQ ID NO: 621888 - DNA, 25 bp, Mus musculus
ggctgcatcagaacaaaccctagag

SEQ ID NO: 621889 - DNA, 25 bp, Mus musculus
ggctgcatcagacattacctcactt

SEQ ID NO: 621890 - DNA, 25 bp, Mus musculus
ggctgcatcagagattacctcactt

SEQ ID NO: 621891 - DNA, 25 bp, Mus musculus
ggctgcatcagatcaaaccctagag

SEQ ID NO: 621892 - DNA, 25 bp, Mus musculus
ggctgcatccataacaaagtcgtta

SEQ ID NO: 621893 - DNA, 25 bp, Mus musculus
ggctgcatccattacaaagtcgtta

SEQ ID NO: 621894 - DNA, 25 bp, Mus musculus
ggctgcatccccagggaactgtcat

SEQ ID NO: 621895 - DNA, 25 bp, Mus musculus
ggctgcatcccctgggaactgtcat

SEQ ID NO: 621896 - DNA, 25 bp, Mus musculus
ggctgcatcctgctttatcaagaat

SEQ ID NO: 621897 - DNA, 25 bp, Mus musculus
ggctgcatcctggtttatcaagaat

SEQ ID NO: 621898 - DNA, 25 bp, Mus musculus
ggctgcatctctctgaatgtagtcg

SEQ ID NO: 621899 - DNA, 25 bp, Mus musculus
ggctgcatctctgtgaatgtagtcg

SEQ ID NO: 621900 - DNA, 25 bp, Mus musculus
ggctgcatctttataacaactcatt

SEQ ID NO: 621901 - DNA, 25 bp, Mus musculus
ggctgcatctttttaacaactcatt

SEQ ID NO: 621902 - DNA, 25 bp, Mus musculus
ggctgcatgaagaggcacaccgcaa

SEQ ID NO: 621903 - DNA, 25 bp, Mus musculus
ggctgcatgaagtggcacaccgcaa

SEQ ID NO: 621904 - DNA, 25 bp, Mus musculus
ggctgcatgacacacattggtttaa

SEQ ID NO: 621905 - DNA, 25 bp, Mus musculus
ggctgcatgacagacattggtttaa

SEQ ID NO: 621906 - DNA, 25 bp, Mus musculus
ggctgcatgactataccattattta

SEQ ID NO: 621907 - DNA, 25 bp, Mus musculus
ggctgcatgactttaccattattta

SEQ ID NO: 621908 - DNA, 25 bp, Mus musculus
ggctgcatgctaacctctcaggagg

SEQ ID NO: 621909 - DNA, 25 bp, Mus musculus
ggctgcatgctatcctctcaggagg

SEQ ID NO: 621910 - DNA, 25 bp, Mus musculus
ggctgcatgctgctgtcgttatgaa

SEQ ID NO: 621911 - DNA, 25 bp, Mus musculus
ggctgcatgctggtgtcgttatgaa

SEQ ID NO: 621912 - DNA, 25 bp, Mus musculus
ggctgcatggcaaagagcttccgca

SEQ ID NO: 621913 - DNA, 25 bp, Mus musculus
ggctgcatggcatagagcttccgca

SEQ ID NO: 621914 - DNA, 25 bp, Mus musculus
ggctgcatgtaaactttgtatacca

SEQ ID NO: 621915 - DNA, 25 bp, Mus musculus
ggctgcatgtaatctttgtatacca

SEQ ID NO: 621916 - DNA, 25 bp, Mus musculus
ggctgcatgtgcactgttaaactct

SEQ ID NO: 621917 - DNA, 25 bp, Mus musculus
ggctgcatgtgctctgttaaactct

SEQ ID NO: 621918 - DNA, 25 bp, Mus musculus
ggctgcattattcctttatgcccct

SEQ ID NO: 621919 - DNA, 25 bp, Mus musculus
ggctgcattattgctttatgcccct

SEQ ID NO: 621920 - DNA, 25 bp, Mus musculus
ggctgcattcatcagaaaaggaaat

SEQ ID NO: 621921 - DNA, 25 bp, Mus musculus
ggctgcattcatcctcagacgtgta

SEQ ID NO: 621922 - DNA, 25 bp, Mus musculus
ggctgcattcatgagaaaaggaaat

SEQ ID NO: 621923 - DNA, 25 bp, Mus musculus
ggctgcattcatgctcagacgtgta

SEQ ID NO: 621924 - DNA, 25 bp, Mus musculus
ggctgcattgttatttcctaaagca

SEQ ID NO: 621925 - DNA, 25 bp, Mus musculus
ggctgcattgttttttcctaaagca

SEQ ID NO: 621926 - DNA, 25 bp, Mus musculus
ggctgcatttcccaagaagcagaac

SEQ ID NO: 621927 - DNA, 25 bp, Mus musculus
ggctgcatttccgaagaagcagaac

SEQ ID NO: 621928 - DNA, 25 bp, Mus musculus
ggctgcattttcaggtgtggaacat

SEQ ID NO: 621929 - DNA, 25 bp, Mus musculus
ggctgcattttctggtgtggaacat

SEQ ID NO: 621930 - DNA, 25 bp, Mus musculus
ggctgccaaagcatgcggtttttga

SEQ ID NO: 621931 - DNA, 25 bp, Mus musculus
ggctgccaaagcttgcggtttttga

SEQ ID NO: 621932 - DNA, 25 bp, Mus musculus
ggctgccaaaggcttaatgaaccaa

SEQ ID NO: 621933 - DNA, 25 bp, Mus musculus
ggctgccaaagggttaatgaaccaa

SEQ ID NO: 621934 - DNA, 25 bp, Mus musculus
ggctgccaaattaatacctgtttct

SEQ ID NO: 621935 - DNA, 25 bp, Mus musculus
ggctgccaaatttatacctgtttct

SEQ ID NO: 621936 - DNA, 25 bp, Mus musculus
ggctgccaacaaccttcactgcaaa

SEQ ID NO: 621937 - DNA, 25 bp, Mus musculus
ggctgccaacaagcttcactgcaaa

SEQ ID NO: 621938 - DNA, 25 bp, Mus musculus
ggctgccaaggtaagagatcactta

SEQ ID NO: 621939 - DNA, 25 bp, Mus musculus
ggctgccaaggttagagatcactta

SEQ ID NO: 621940 - DNA, 25 bp, Mus musculus
ggctgccacaagcttaactactgct

SEQ ID NO: 621941 - DNA, 25 bp, Mus musculus
ggctgccacaaggttaactactgct

SEQ ID NO: 621942 - DNA, 25 bp, Mus musculus
ggctgccacatgaagcagacaggga

SEQ ID NO: 621943 - DNA, 25 bp, Mus musculus
ggctgccacatgtagcagacaggga

SEQ ID NO: 621944 - DNA, 25 bp, Mus musculus
ggctgccacgaaaactgtgacccag

SEQ ID NO: 621945 - DNA, 25 bp, Mus musculus
ggctgccacgaatactgtgacccag

SEQ ID NO: 621946 - DNA, 25 bp, Mus musculus
ggctgccactgtactttcatcaaag

SEQ ID NO: 621947 - DNA, 25 bp, Mus musculus
ggctgccactgttctttcatcaaag

SEQ ID NO: 621948 - DNA, 25 bp, Mus musculus
ggctgccagaggcacgtgttaaaaa

SEQ ID NO: 621949 - DNA, 25 bp, Mus musculus
ggctgccagaggctgcacctatatc

SEQ ID NO: 621950 - DNA, 25 bp, Mus musculus
ggctgccagagggacgtgttaaaaa

SEQ ID NO: 621951 - DNA, 25 bp, Mus musculus
ggctgccagagggtgcacctatatc

SEQ ID NO: 621952 - DNA, 25 bp, Mus musculus
ggctgccagcaaatgtacaggttat

SEQ ID NO: 621953 - DNA, 25 bp, Mus musculus
ggctgccagcaattgtacaggttat

SEQ ID NO: 621954 - DNA, 25 bp, Mus musculus
ggctgccagggcctactgctgcttt

SEQ ID NO: 621955 - DNA, 25 bp, Mus musculus
ggctgccagggcgtactgctgcttt

SEQ ID NO: 621956 - DNA, 25 bp, Mus musculus
ggctgccaggttctagtctcctgtg

SEQ ID NO: 621957 - DNA, 25 bp, Mus musculus
ggctgccaggttgtagtctcctgtg

SEQ ID NO: 621958 - DNA, 25 bp, Mus musculus
ggctgccagttacactgcgattgta

SEQ ID NO: 621959 - DNA, 25 bp, Mus musculus
ggctgccagttagactgcgattgta

SEQ ID NO: 621960 - DNA, 25 bp, Mus musculus
ggctgccatctgatttacggcatca

SEQ ID NO: 621961 - DNA, 25 bp, Mus musculus
ggctgccatctgttttacggcatca

SEQ ID NO: 621962 - DNA, 25 bp, Mus musculus
ggctgccatgcaaagttcttggtac

SEQ ID NO: 621963 - DNA, 25 bp, Mus musculus
ggctgccatgcatagttcttggtac

SEQ ID NO: 621964 - DNA, 25 bp, Mus musculus
ggctgccattagctctgtgtttcaa

SEQ ID NO: 621965 - DNA, 25 bp, Mus musculus
ggctgccattaggtctgtgtttcaa

SEQ ID NO: 621966 - DNA, 25 bp, Mus musculus
ggctgccattggatagttgtttatc

SEQ ID NO: 621967 - DNA, 25 bp, Mus musculus
ggctgccattggttagttgtttatc

SEQ ID NO: 621968 - DNA, 25 bp, Mus musculus
ggctgcccaagaaaaggacactgaa

SEQ ID NO: 621969 - DNA, 25 bp, Mus musculus
ggctgcccaagaacaagtccatgct

SEQ ID NO: 621970 - DNA, 25 bp, Mus musculus
ggctgcccaagataaggacactgaa

SEQ ID NO: 621971 - DNA, 25 bp, Mus musculus
ggctgcccaagatcaagtccatgct

SEQ ID NO: 621972 - DNA, 25 bp, Mus musculus
ggctgcccaattcgctggagctcag

SEQ ID NO: 621973 - DNA, 25 bp, Mus musculus
ggctgcccaattggctggagctcag

SEQ ID NO: 621974 - DNA, 25 bp, Mus musculus
ggctgcccacatatgtgtgagggtc

SEQ ID NO: 621975 - DNA, 25 bp, Mus musculus
ggctgcccacatttgtgtgagggtc

SEQ ID NO: 621976 - DNA, 25 bp, Mus musculus
ggctgcccaccactctctgataaga

SEQ ID NO: 621977 - DNA, 25 bp, Mus musculus
ggctgcccaccagtctctgataaga

SEQ ID NO: 621978 - DNA, 25 bp, Mus musculus
ggctgcccactccttagtgacttaa

SEQ ID NO: 621979 - DNA, 25 bp, Mus musculus
ggctgcccactcgttagtgacttaa

SEQ ID NO: 621980 - DNA, 25 bp, Mus musculus
ggctgcccacttaaagatagctaca

SEQ ID NO: 621981 - DNA, 25 bp, Mus musculus
ggctgcccactttaagatagctaca

SEQ ID NO: 621982 - DNA, 25 bp, Mus musculus
ggctgcccaggaatcagtatagctg

SEQ ID NO: 621983 - DNA, 25 bp, Mus musculus
ggctgcccaggacattcgcaacaaa

SEQ ID NO: 621984 - DNA, 25 bp, Mus musculus
ggctgcccaggagattcgcaacaaa

SEQ ID NO: 621985 - DNA, 25 bp, Mus musculus
ggctgcccaggattcagtatagctg

SEQ ID NO: 621986 - DNA, 25 bp, Mus musculus
ggctgcccatacatttgcctgagat

SEQ ID NO: 621987 - DNA, 25 bp, Mus musculus
ggctgcccatacttttgcctgagat

SEQ ID NO: 621988 - DNA, 25 bp, Mus musculus
ggctgcccatctagtagggactgga

SEQ ID NO: 621989 - DNA, 25 bp, Mus musculus
ggctgcccatcttgtagggactgga

SEQ ID NO: 621990 - DNA, 25 bp, Mus musculus
ggctgccccaagcagccagctaaga

SEQ ID NO: 621991 - DNA, 25 bp, Mus musculus
ggctgccccaaggagccagctaaga

SEQ ID NO: 621992 - DNA, 25 bp, Mus musculus
ggctgccccgggaattctgaagtac

SEQ ID NO: 621993 - DNA, 25 bp, Mus musculus
ggctgccccgggtattctgaagtac

SEQ ID NO: 621994 - DNA, 25 bp, Mus musculus
ggctgccccttcataggatttttat

SEQ ID NO: 621995 - DNA, 25 bp, Mus musculus
ggctgccccttcttaggatttttat

SEQ ID NO: 621996 - DNA, 25 bp, Mus musculus
ggctgccctatgaaggactgtgata

SEQ ID NO: 621997 - DNA, 25 bp, Mus musculus
ggctgccctatgtaggactgtgata

SEQ ID NO: 621998 - DNA, 25 bp, Mus musculus
ggctgccctgagcaaacaccatgaa

SEQ ID NO: 621999 - DNA, 25 bp, Mus musculus
ggctgccctgaggaaacaccatgaa

SEQ ID NO: 622000 - DNA, 25 bp, Mus musculus
ggctgccctgctctatttaaaagcg

SEQ ID NO: 622001 - DNA, 25 bp, Mus musculus
ggctgccctgctgtatttaaaagcg

SEQ ID NO: 622002 - DNA, 25 bp, Mus musculus
ggctgccctggcagacgcacagaac

SEQ ID NO: 622003 - DNA, 25 bp, Mus musculus
ggctgccctggctgacgcacagaac

SEQ ID NO: 622004 - DNA, 25 bp, Mus musculus
ggctgccctgggagatttgactgac

SEQ ID NO: 622005 - DNA, 25 bp, Mus musculus
ggctgccctgggtgatttgactgac

SEQ ID NO: 622006 - DNA, 25 bp, Mus musculus
ggctgccctggtctactgtgtaaag

SEQ ID NO: 622007 - DNA, 25 bp, Mus musculus
ggctgccctggtgtactgtgtaaag

SEQ ID NO: 622008 - DNA, 25 bp, Mus musculus
ggctgccgactaactgtggtggttt

SEQ ID NO: 622009 - DNA, 25 bp, Mus musculus
ggctgccgactatctgtggtggttt

SEQ ID NO: 622010 - DNA, 25 bp, Mus musculus
ggctgccgagaaagcgctacgtcag

SEQ ID NO: 622011 - DNA, 25 bp, Mus musculus
ggctgccgagaatgcgctacgtcag

SEQ ID NO: 622012 - DNA, 25 bp, Mus musculus
ggctgccgattcagttaaacgaacg

SEQ ID NO: 622013 - DNA, 25 bp, Mus musculus
ggctgccgattctgttaaacgaacg

SEQ ID NO: 622014 - DNA, 25 bp, Mus musculus
ggctgccgccataggtagagtttga

SEQ ID NO: 622015 - DNA, 25 bp, Mus musculus
ggctgccgccattggtagagtttga

SEQ ID NO: 622016 - DNA, 25 bp, Mus musculus
ggctgccgctggcttaaaggattat

SEQ ID NO: 622017 - DNA, 25 bp, Mus musculus
ggctgccgctgggttaaaggattat

SEQ ID NO: 622018 - DNA, 25 bp, Mus musculus
ggctgccggccacgtacgatgggat

SEQ ID NO: 622019 - DNA, 25 bp, Mus musculus
ggctgccggccaggtacgatgggat

SEQ ID NO: 622020 - DNA, 25 bp, Mus musculus
ggctgcctacaacaactgtgatcct

SEQ ID NO: 622021 - DNA, 25 bp, Mus musculus
ggctgcctacaagaactgtgatcct

SEQ ID NO: 622022 - DNA, 25 bp, Mus musculus
ggctgcctatacaagacctgtacaa

SEQ ID NO: 622023 - DNA, 25 bp, Mus musculus
ggctgcctatactagacctgtacaa

SEQ ID NO: 622024 - DNA, 25 bp, Mus musculus
ggctgcctatgtattctttccagca

SEQ ID NO: 622025 - DNA, 25 bp, Mus musculus
ggctgcctatgttttctttccagca

SEQ ID NO: 622026 - DNA, 25 bp, Mus musculus
ggctgcctcactcaacagatacgat

SEQ ID NO: 622027 - DNA, 25 bp, Mus musculus
ggctgcctcactgaacagatacgat

SEQ ID NO: 622028 - DNA, 25 bp, Mus musculus
ggctgcctgacgctgagtcttcaac

SEQ ID NO: 622029 - DNA, 25 bp, Mus musculus
ggctgcctgacggtgagtcttcaac

SEQ ID NO: 622030 - DNA, 25 bp, Mus musculus
ggctgcctgcagagcgaccagtcag

SEQ ID NO: 622031 - DNA, 25 bp, Mus musculus
ggctgcctgcagtgcgaccagtcag

SEQ ID NO: 622032 - DNA, 25 bp, Mus musculus
ggctgcctgccaagtgtccgggaaa

SEQ ID NO: 622033 - DNA, 25 bp, Mus musculus
ggctgcctgccatgtgtccgggaaa

SEQ ID NO: 622034 - DNA, 25 bp, Mus musculus
ggctgcctgggacgctacacaccag

SEQ ID NO: 622035 - DNA, 25 bp, Mus musculus
ggctgcctgggaggctacacaccag

SEQ ID NO: 622036 - DNA, 25 bp, Mus musculus
ggctgccttaatccctggtgaggac

SEQ ID NO: 622037 - DNA, 25 bp, Mus musculus
ggctgccttaatgcctggtgaggac

SEQ ID NO: 622038 - DNA, 25 bp, Mus musculus
ggctgccttcaaacttatagtgatc

SEQ ID NO: 622039 - DNA, 25 bp, Mus musculus
ggctgccttcaaatctaagctttgt

SEQ ID NO: 622040 - DNA, 25 bp, Mus musculus
ggctgccttcaatcttatagtgatc

SEQ ID NO: 622041 - DNA, 25 bp, Mus musculus
ggctgccttcaattctaagctttgt

SEQ ID NO: 622042 - DNA, 25 bp, Mus musculus
ggctgccttcagaaacttcagtgat

SEQ ID NO: 622043 - DNA, 25 bp, Mus musculus
ggctgccttcagtaacttcagtgat

SEQ ID NO: 622044 - DNA, 25 bp, Mus musculus
ggctgccttctacaagtaccttcag

SEQ ID NO: 622045 - DNA, 25 bp, Mus musculus
ggctgccttctagaagtaccttcag

SEQ ID NO: 622046 - DNA, 25 bp, Mus musculus
ggctgccttgccagtaactcaacaa

SEQ ID NO: 622047 - DNA, 25 bp, Mus musculus
ggctgccttgcctgtaactcaacaa

SEQ ID NO: 622048 - DNA, 25 bp, Mus musculus
ggctgccttgctcatgaaatcattg

SEQ ID NO: 622049 - DNA, 25 bp, Mus musculus
ggctgccttgctgatgaaatcattg

SEQ ID NO: 622050 - DNA, 25 bp, Mus musculus
ggctgccttgtcagcatgtaattac

SEQ ID NO: 622051 - DNA, 25 bp, Mus musculus
ggctgccttgtctgcatgtaattac

SEQ ID NO: 622052 - DNA, 25 bp, Mus musculus
ggctgccttttaatcaagtttgaat

SEQ ID NO: 622053 - DNA, 25 bp, Mus musculus
ggctgccttttacagagtctgatgc

SEQ ID NO: 622054 - DNA, 25 bp, Mus musculus
ggctgccttttagagagtctgatgc

SEQ ID NO: 622055 - DNA, 25 bp, Mus musculus
ggctgccttttattcaagtttgaat

SEQ ID NO: 622056 - DNA, 25 bp, Mus musculus
ggctgcgacaccacaactgacctgg

SEQ ID NO: 622057 - DNA, 25 bp, Mus musculus
ggctgcgacacctcaactgacctgg

SEQ ID NO: 622058 - DNA, 25 bp, Mus musculus
ggctgcgatcttctggaagtctccc

SEQ ID NO: 622059 - DNA, 25 bp, Mus musculus
ggctgcgatcttgtggaagtctccc

SEQ ID NO: 622060 - DNA, 25 bp, Mus musculus
ggctgcgcaacaagtccaacgagga

SEQ ID NO: 622061 - DNA, 25 bp, Mus musculus
ggctgcgcaacatgtccaacgagga

SEQ ID NO: 622062 - DNA, 25 bp, Mus musculus
ggctgcgcacatcttggttatagtt

SEQ ID NO: 622063 - DNA, 25 bp, Mus musculus
ggctgcgcacatgttggttatagtt

SEQ ID NO: 622064 - DNA, 25 bp, Mus musculus
ggctgcgcatagcacagggctccac

SEQ ID NO: 622065 - DNA, 25 bp, Mus musculus
ggctgcgcataggacagggctccac

SEQ ID NO: 622066 - DNA, 25 bp, Mus musculus
ggctgcgctgaaatcactttctaag

SEQ ID NO: 622067 - DNA, 25 bp, Mus musculus
ggctgcgctgaattcactttctaag

SEQ ID NO: 622068 - DNA, 25 bp, Mus musculus
ggctgcgctgccatagattttgatc

SEQ ID NO: 622069 - DNA, 25 bp, Mus musculus
ggctgcgctgccttagattttgatc

SEQ ID NO: 622070 - DNA, 25 bp, Mus musculus
ggctgcgctgtcacgggccgttact

SEQ ID NO: 622071 - DNA, 25 bp, Mus musculus
ggctgcgctgtctcgggccgttact

SEQ ID NO: 622072 - DNA, 25 bp, Mus musculus
ggctgcgctgttcctctacagggaa

SEQ ID NO: 622073 - DNA, 25 bp, Mus musculus
ggctgcgctgttgctctacagggaa

SEQ ID NO: 622074 - DNA, 25 bp, Mus musculus
ggctgcggacctccaggaaaacttt

SEQ ID NO: 622075 - DNA, 25 bp, Mus musculus
ggctgcggacctgcaggaaaacttt

SEQ ID NO: 622076 - DNA, 25 bp, Mus musculus
ggctgcggccgacacttcaagctac

SEQ ID NO: 622077 - DNA, 25 bp, Mus musculus
ggctgcggccgagacttcaagctac

SEQ ID NO: 622078 - DNA, 25 bp, Mus musculus
ggctgcgggaggatcggccaggcca

SEQ ID NO: 622079 - DNA, 25 bp, Mus musculus
ggctgcgggaggttcggccaggcca

SEQ ID NO: 622080 - DNA, 25 bp, Mus musculus
ggctgcgtagcaacttatttattta

SEQ ID NO: 622081 - DNA, 25 bp, Mus musculus
ggctgcgtagcatcttatttattta

SEQ ID NO: 622082 - DNA, 25 bp, Mus musculus
ggctgcgtctgactggacattttta

SEQ ID NO: 622083 - DNA, 25 bp, Mus musculus
ggctgcgtctgagtggacattttta

SEQ ID NO: 622084 - DNA, 25 bp, Mus musculus
ggctgcgtgctccattttatacaac

SEQ ID NO: 622085 - DNA, 25 bp, Mus musculus
ggctgcgtgctcgattttatacaac

SEQ ID NO: 622086 - DNA, 25 bp, Mus musculus
ggctgcgttttcaaaatacccaatt

SEQ ID NO: 622087 - DNA, 25 bp, Mus musculus
ggctgcgttttctaaatacccaatt

SEQ ID NO: 622088 - DNA, 25 bp, Mus musculus
ggctgctaagccaggatcctgtgca

SEQ ID NO: 622089 - DNA, 25 bp, Mus musculus
ggctgctaagcctggatcctgtgca

SEQ ID NO: 622090 - DNA, 25 bp, Mus musculus
ggctgctacagactacacgtatcaa

SEQ ID NO: 622091 - DNA, 25 bp, Mus musculus
ggctgctacagagtacacgtatcaa

SEQ ID NO: 622092 - DNA, 25 bp, Mus musculus
ggctgctacagcaggaaccttgtga

SEQ ID NO: 622093 - DNA, 25 bp, Mus musculus
ggctgctacagctggaaccttgtga

SEQ ID NO: 622094 - DNA, 25 bp, Mus musculus
ggctgctacctcaggtatttaccta

SEQ ID NO: 622095 - DNA, 25 bp, Mus musculus
ggctgctacctctggtatttaccta

SEQ ID NO: 622096 - DNA, 25 bp, Mus musculus
ggctgctaccttagtactgagctat

SEQ ID NO: 622097 - DNA, 25 bp, Mus musculus
ggctgctacctttgtactgagctat

SEQ ID NO: 622098 - DNA, 25 bp, Mus musculus
ggctgctactgcaggtaaggactga

SEQ ID NO: 622099 - DNA, 25 bp, Mus musculus
ggctgctactgctggtaaggactga

SEQ ID NO: 622100 - DNA, 25 bp, Mus musculus
ggctgctagaggagaatagaccaaa

SEQ ID NO: 622101 - DNA, 25 bp, Mus musculus
ggctgctagaggtgaatagaccaaa

SEQ ID NO: 622102 - DNA, 25 bp, Mus musculus
ggctgctagccaagtgaatattacc

SEQ ID NO: 622103 - DNA, 25 bp, Mus musculus
ggctgctagccatgtgaatattacc

SEQ ID NO: 622104 - DNA, 25 bp, Mus musculus
ggctgctattgtatcaaaatctcta

SEQ ID NO: 622105 - DNA, 25 bp, Mus musculus
ggctgctattgtttcaaaatctcta

SEQ ID NO: 622106 - DNA, 25 bp, Mus musculus
ggctgctcaagaccctatgcttcca

SEQ ID NO: 622107 - DNA, 25 bp, Mus musculus
ggctgctcaagagcctatgcttcca

SEQ ID NO: 622108 - DNA, 25 bp, Mus musculus
ggctgctcacagctaacagatagga

SEQ ID NO: 622109 - DNA, 25 bp, Mus musculus
ggctgctcacaggtaacagatagga

SEQ ID NO: 622110 - DNA, 25 bp, Mus musculus
ggctgctcagacacctgtgaaggca

SEQ ID NO: 622111 - DNA, 25 bp, Mus musculus
ggctgctcagactcctgtgaaggca

SEQ ID NO: 622112 - DNA, 25 bp, Mus musculus
ggctgctcagtaatgcttattgacc

SEQ ID NO: 622113 - DNA, 25 bp, Mus musculus
ggctgctcagtattgcttattgacc

SEQ ID NO: 622114 - DNA, 25 bp, Mus musculus
ggctgctcagttcgcattggattac

SEQ ID NO: 622115 - DNA, 25 bp, Mus musculus
ggctgctcagttggcattggattac

SEQ ID NO: 622116 - DNA, 25 bp, Mus musculus
ggctgctcatctatcaactgcagct

SEQ ID NO: 622117 - DNA, 25 bp, Mus musculus
ggctgctcatctttcaactgcagct

SEQ ID NO: 622118 - DNA, 25 bp, Mus musculus
ggctgctccaatcttgccttaacag

SEQ ID NO: 622119 - DNA, 25 bp, Mus musculus
ggctgctccaatgttgccttaacag

SEQ ID NO: 622120 - DNA, 25 bp, Mus musculus
ggctgctcccataagaccatgtata

SEQ ID NO: 622121 - DNA, 25 bp, Mus musculus
ggctgctcccattagaccatgtata

SEQ ID NO: 622122 - DNA, 25 bp, Mus musculus
ggctgctcccggagcagaacctctg

SEQ ID NO: 622123 - DNA, 25 bp, Mus musculus
ggctgctcccggtgcagaacctctg

SEQ ID NO: 622124 - DNA, 25 bp, Mus musculus
ggctgctccctgactggaggccgtc

SEQ ID NO: 622125 - DNA, 25 bp, Mus musculus
ggctgctccctgtctggaggccgtc

SEQ ID NO: 622126 - DNA, 25 bp, Mus musculus
ggctgctccgagaagccctcacaga

SEQ ID NO: 622127 - DNA, 25 bp, Mus musculus
ggctgctccgagtagccctcacaga

SEQ ID NO: 622128 - DNA, 25 bp, Mus musculus
ggctgctcctgtacacacgcgacag

SEQ ID NO: 622129 - DNA, 25 bp, Mus musculus
ggctgctcctgttcacacgcgacag

SEQ ID NO: 622130 - DNA, 25 bp, Mus musculus
ggctgctcggccagtgaaggacccc

SEQ ID NO: 622131 - DNA, 25 bp, Mus musculus
ggctgctcggcctgtgaaggacccc

SEQ ID NO: 622132 - DNA, 25 bp, Mus musculus
ggctgctctaatcgtgtcctgtgga

SEQ ID NO: 622133 - DNA, 25 bp, Mus musculus
ggctgctctaatggtgtcctgtgga

SEQ ID NO: 622134 - DNA, 25 bp, Mus musculus
ggctgctctatgatctcaaggactg

SEQ ID NO: 622135 - DNA, 25 bp, Mus musculus
ggctgctctatgttctcaaggactg

SEQ ID NO: 622136 - DNA, 25 bp, Mus musculus
ggctgctctcaacgttaattttaac

SEQ ID NO: 622137 - DNA, 25 bp, Mus musculus
ggctgctctcaaggttaattttaac

SEQ ID NO: 622138 - DNA, 25 bp, Mus musculus
ggctgctctgtcagacaacgggaca

SEQ ID NO: 622139 - DNA, 25 bp, Mus musculus
ggctgctctgtctgacaacgggaca

SEQ ID NO: 622140 - DNA, 25 bp, Mus musculus
ggctgctcttccatggcgtacaagt

SEQ ID NO: 622141 - DNA, 25 bp, Mus musculus
ggctgctcttccttggcgtacaagt

SEQ ID NO: 622142 - DNA, 25 bp, Mus musculus
ggctgctcttgaatatctgtcatta

SEQ ID NO: 622143 - DNA, 25 bp, Mus musculus
ggctgctcttgattatctgtcatta

SEQ ID NO: 622144 - DNA, 25 bp, Mus musculus
ggctgctgaagcagaggacctcagt

SEQ ID NO: 622145 - DNA, 25 bp, Mus musculus
ggctgctgaagctgaggacctcagt

SEQ ID NO: 622146 - DNA, 25 bp, Mus musculus
ggctgctgagacataaccctggcat

SEQ ID NO: 622147 - DNA, 25 bp, Mus musculus
ggctgctgagacttaaccctggcat

SEQ ID NO: 622148 - DNA, 25 bp, Mus musculus
ggctgctgaggacgattgtccacat

SEQ ID NO: 622149 - DNA, 25 bp, Mus musculus
ggctgctgaggaggattgtccacat

SEQ ID NO: 622150 - DNA, 25 bp, Mus musculus
ggctgctgaggcaaacctccaaaac

SEQ ID NO: 622151 - DNA, 25 bp, Mus musculus
ggctgctgaggctaacctccaaaac

SEQ ID NO: 622152 - DNA, 25 bp, Mus musculus
ggctgctgaggtatagacttgacat

SEQ ID NO: 622153 - DNA, 25 bp, Mus musculus
ggctgctgaggtttagacttgacat

SEQ ID NO: 622154 - DNA, 25 bp, Mus musculus
ggctgctgattaactagaacacata

SEQ ID NO: 622155 - DNA, 25 bp, Mus musculus
ggctgctgattatctagaacacata

SEQ ID NO: 622156 - DNA, 25 bp, Mus musculus
ggctgctgattcatctttttcctaa

SEQ ID NO: 622157 - DNA, 25 bp, Mus musculus
ggctgctgattcttctttttcctaa

SEQ ID NO: 622158 - DNA, 25 bp, Mus musculus
ggctgctgcagaaaacctgtcaggc

SEQ ID NO: 622159 - DNA, 25 bp, Mus musculus
ggctgctgcagataacctgtcaggc

SEQ ID NO: 622160 - DNA, 25 bp, Mus musculus
ggctgctgcagtaagtgccttggca

SEQ ID NO: 622161 - DNA, 25 bp, Mus musculus
ggctgctgcagttagtgccttggca

SEQ ID NO: 622162 - DNA, 25 bp, Mus musculus
ggctgctgccacctttagaagattt

SEQ ID NO: 622163 - DNA, 25 bp, Mus musculus
ggctgctgccacgtttagaagattt

SEQ ID NO: 622164 - DNA, 25 bp, Mus musculus
ggctgctgccatagttgccgagacc

SEQ ID NO: 622165 - DNA, 25 bp, Mus musculus
ggctgctgccatctaggtgtgcaca

SEQ ID NO: 622166 - DNA, 25 bp, Mus musculus
ggctgctgccatgtaggtgtgcaca

SEQ ID NO: 622167 - DNA, 25 bp, Mus musculus
ggctgctgccattgttgccgagacc

SEQ ID NO: 622168 - DNA, 25 bp, Mus musculus
ggctgctgcccacacaggagtgtca

SEQ ID NO: 622169 - DNA, 25 bp, Mus musculus
ggctgctgcccagacaggagtgtca

SEQ ID NO: 622170 - DNA, 25 bp, Mus musculus
ggctgctgccccagagaacaaggct

SEQ ID NO: 622171 - DNA, 25 bp, Mus musculus
ggctgctgccccattaattgagcca

SEQ ID NO: 622172 - DNA, 25 bp, Mus musculus
ggctgctgcccctgagaacaaggct

SEQ ID NO: 622173 - DNA, 25 bp, Mus musculus
ggctgctgcccctttaattgagcca

SEQ ID NO: 622174 - DNA, 25 bp, Mus musculus
ggctgctgctctctcctgagcatgc

SEQ ID NO: 622175 - DNA, 25 bp, Mus musculus
ggctgctgctctgtcctgagcatgc

SEQ ID NO: 622176 - DNA, 25 bp, Mus musculus
ggctgctgcttaacatgttcaggta

SEQ ID NO: 622177 - DNA, 25 bp, Mus musculus
ggctgctgcttatcatgttcaggta

SEQ ID NO: 622178 - DNA, 25 bp, Mus musculus
ggctgctgcttcagtgaccaagcac

SEQ ID NO: 622179 - DNA, 25 bp, Mus musculus
ggctgctgcttctgtgaccaagcac

SEQ ID NO: 622180 - DNA, 25 bp, Mus musculus
ggctgctgcttgacaccagacagaa

SEQ ID NO: 622181 - DNA, 25 bp, Mus musculus
ggctgctgcttgtcaccagacagaa

SEQ ID NO: 622182 - DNA, 25 bp, Mus musculus
ggctgctggagccactactgcagaa

SEQ ID NO: 622183 - DNA, 25 bp, Mus musculus
ggctgctggagcgactactgcagaa

SEQ ID NO: 622184 - DNA, 25 bp, Mus musculus
ggctgctggattatcaaggctttaa

SEQ ID NO: 622185 - DNA, 25 bp, Mus musculus
ggctgctggattttcaaggctttaa

SEQ ID NO: 622186 - DNA, 25 bp, Mus musculus
ggctgctggcggaggaaactacaaa

SEQ ID NO: 622187 - DNA, 25 bp, Mus musculus
ggctgctggcggtggaaactacaaa

SEQ ID NO: 622188 - DNA, 25 bp, Mus musculus
ggctgctggctgagtgtttacacat

SEQ ID NO: 622189 - DNA, 25 bp, Mus musculus
ggctgctggctgtgtgtttacacat

SEQ ID NO: 622190 - DNA, 25 bp, Mus musculus
ggctgctggcttctaagtgtgttac

SEQ ID NO: 622191 - DNA, 25 bp, Mus musculus
ggctgctggcttgtaagtgtgttac

SEQ ID NO: 622192 - DNA, 25 bp, Mus musculus
ggctgctgggcaatggacatccgtt

SEQ ID NO: 622193 - DNA, 25 bp, Mus musculus
ggctgctgggcattggacatccgtt

SEQ ID NO: 622194 - DNA, 25 bp, Mus musculus
ggctgctgggcgacaaggctcgcct

SEQ ID NO: 622195 - DNA, 25 bp, Mus musculus
ggctgctgggcgtcaaggctcgcct

SEQ ID NO: 622196 - DNA, 25 bp, Mus musculus
ggctgctgggttagcatgtttacag

SEQ ID NO: 622197 - DNA, 25 bp, Mus musculus
ggctgctgggtttgcatgtttacag

SEQ ID NO: 622198 - DNA, 25 bp, Mus musculus
ggctgctgtaacacttgcctgtaat

SEQ ID NO: 622199 - DNA, 25 bp, Mus musculus
ggctgctgtaactcttgcctgtaat

SEQ ID NO: 622200 - DNA, 25 bp, Mus musculus
ggctgctgtcgaagatcctgagtga

SEQ ID NO: 622201 - DNA, 25 bp, Mus musculus
ggctgctgtcgatgatcctgagtga

SEQ ID NO: 622202 - DNA, 25 bp, Mus musculus
ggctgctgtctaacctgcttatgag

SEQ ID NO: 622203 - DNA, 25 bp, Mus musculus
ggctgctgtctatcctgcttatgag

SEQ ID NO: 622204 - DNA, 25 bp, Mus musculus
ggctgctgtcttcctatggagagct

SEQ ID NO: 622205 - DNA, 25 bp, Mus musculus
ggctgctgtcttgctatggagagct

SEQ ID NO: 622206 - DNA, 25 bp, Mus musculus
ggctgctgtgaaatatctgtgagaa

SEQ ID NO: 622207 - DNA, 25 bp, Mus musculus
ggctgctgtgaattatctgtgagaa

SEQ ID NO: 622208 - DNA, 25 bp, Mus musculus
ggctgctgtgataccatgcctagca

SEQ ID NO: 622209 - DNA, 25 bp, Mus musculus
ggctgctgtgattccatgcctagca

SEQ ID NO: 622210 - DNA, 25 bp, Mus musculus
ggctgctgtggcatatagacctgat

SEQ ID NO: 622211 - DNA, 25 bp, Mus musculus
ggctgctgtggcttatagacctgat

SEQ ID NO: 622212 - DNA, 25 bp, Mus musculus
ggctgctgttcccagaatgtaaaag

SEQ ID NO: 622213 - DNA, 25 bp, Mus musculus
ggctgctgttccgagaatgtaaaag

SEQ ID NO: 622214 - DNA, 25 bp, Mus musculus
ggctgcttaatcaaactgaacggtc

SEQ ID NO: 622215 - DNA, 25 bp, Mus musculus
ggctgcttaatctaactgaacggtc

SEQ ID NO: 622216 - DNA, 25 bp, Mus musculus
ggctgcttagccacacaggtagggt

SEQ ID NO: 622217 - DNA, 25 bp, Mus musculus
ggctgcttagccagtgctgtgtgta

SEQ ID NO: 622218 - DNA, 25 bp, Mus musculus
ggctgcttagcctcacaggtagggt

SEQ ID NO: 622219 - DNA, 25 bp, Mus musculus
ggctgcttagcctgtgctgtgtgta

SEQ ID NO: 622220 - DNA, 25 bp, Mus musculus
ggctgcttattacagcatttgtgtt

SEQ ID NO: 622221 - DNA, 25 bp, Mus musculus
ggctgcttattagagcatttgtgtt

SEQ ID NO: 622222 - DNA, 25 bp, Mus musculus
ggctgcttattcctatttccagatt

SEQ ID NO: 622223 - DNA, 25 bp, Mus musculus
ggctgcttattcgtatttccagatt

SEQ ID NO: 622224 - DNA, 25 bp, Mus musculus
ggctgcttcaagacatcgtgcagaa

SEQ ID NO: 622225 - DNA, 25 bp, Mus musculus
ggctgcttcaagaggtgagaattcc

SEQ ID NO: 622226 - DNA, 25 bp, Mus musculus
ggctgcttcaagtcatcgtgcagaa

SEQ ID NO: 622227 - DNA, 25 bp, Mus musculus
ggctgcttcaagtggtgagaattcc

SEQ ID NO: 622228 - DNA, 25 bp, Mus musculus
ggctgcttcagcctggcactaagtt

SEQ ID NO: 622229 - DNA, 25 bp, Mus musculus
ggctgcttcagcgtggcactaagtt

SEQ ID NO: 622230 - DNA, 25 bp, Mus musculus
ggctgcttcattaaatcagtttgca

SEQ ID NO: 622231 - DNA, 25 bp, Mus musculus
ggctgcttcatttaatcagtttgca

SEQ ID NO: 622232 - DNA, 25 bp, Mus musculus
ggctgcttcgcaaggactaatgtca

SEQ ID NO: 622233 - DNA, 25 bp, Mus musculus
ggctgcttcgcatggactaatgtca

SEQ ID NO: 622234 - DNA, 25 bp, Mus musculus
ggctgcttctgactcagcacaggct

SEQ ID NO: 622235 - DNA, 25 bp, Mus musculus
ggctgcttctgagtcagcacaggct

SEQ ID NO: 622236 - DNA, 25 bp, Mus musculus
ggctgcttcttaattaatctaccca

SEQ ID NO: 622237 - DNA, 25 bp, Mus musculus
ggctgcttcttatttaatctaccca

SEQ ID NO: 622238 - DNA, 25 bp, Mus musculus
ggctgcttctttcaagcacgtcagc

SEQ ID NO: 622239 - DNA, 25 bp, Mus musculus
ggctgcttctttgaagcacgtcagc

SEQ ID NO: 622240 - DNA, 25 bp, Mus musculus
ggctgcttgatgatatgggctgtca

SEQ ID NO: 622241 - DNA, 25 bp, Mus musculus
ggctgcttgatgttatgggctgtca

SEQ ID NO: 622242 - DNA, 25 bp, Mus musculus
ggctgcttggaaaaaagtcctgttt

SEQ ID NO: 622243 - DNA, 25 bp, Mus musculus
ggctgcttggaataaagtcctgttt

SEQ ID NO: 622244 - DNA, 25 bp, Mus musculus
ggctgcttggatctcacaaagaccc

SEQ ID NO: 622245 - DNA, 25 bp, Mus musculus
ggctgcttggatgtcacaaagaccc

SEQ ID NO: 622246 - DNA, 25 bp, Mus musculus
ggctgcttggcacgtgctcagatca

SEQ ID NO: 622247 - DNA, 25 bp, Mus musculus
ggctgcttggcaggtgctcagatca

SEQ ID NO: 622248 - DNA, 25 bp, Mus musculus
ggctgcttggctaacttctttgatg

SEQ ID NO: 622249 - DNA, 25 bp, Mus musculus
ggctgcttggcttacttctttgatg

SEQ ID NO: 622250 - DNA, 25 bp, Mus musculus
ggctgctttaagaacttgggaattc

SEQ ID NO: 622251 - DNA, 25 bp, Mus musculus
ggctgctttaagtacttgggaattc

SEQ ID NO: 622252 - DNA, 25 bp, Mus musculus
ggctgctttcagctcttgacattac

SEQ ID NO: 622253 - DNA, 25 bp, Mus musculus
ggctgctttcaggtcttgacattac

SEQ ID NO: 622254 - DNA, 25 bp, Mus musculus
ggctgctttctaattgtctcagatg

SEQ ID NO: 622255 - DNA, 25 bp, Mus musculus
ggctgctttctatttgtctcagatg

SEQ ID NO: 622256 - DNA, 25 bp, Mus musculus
ggctgctttcttatagaatccaggt

SEQ ID NO: 622257 - DNA, 25 bp, Mus musculus
ggctgctttcttttagaatccaggt

SEQ ID NO: 622258 - DNA, 25 bp, Mus musculus
ggctgctttgagctttgtgaataaa

SEQ ID NO: 622259 - DNA, 25 bp, Mus musculus
ggctgctttgaggtttgtgaataaa

SEQ ID NO: 622260 - DNA, 25 bp, Mus musculus
ggctgctttggcaaaggttgcaaat

SEQ ID NO: 622261 - DNA, 25 bp, Mus musculus
ggctgctttggcatagtgaagccct

SEQ ID NO: 622262 - DNA, 25 bp, Mus musculus
ggctgctttggctaaggttgcaaat

SEQ ID NO: 622263 - DNA, 25 bp, Mus musculus
ggctgctttggcttagtgaagccct

SEQ ID NO: 622264 - DNA, 25 bp, Mus musculus
ggctgcttttatctagtcatttcaa

SEQ ID NO: 622265 - DNA, 25 bp, Mus musculus
ggctgcttttatgtagtcatttcaa

SEQ ID NO: 622266 - DNA, 25 bp, Mus musculus
ggctgcttttctaagtaaatgttca

SEQ ID NO: 622267 - DNA, 25 bp, Mus musculus
ggctgcttttcttagtaaatgttca

SEQ ID NO: 622268 - DNA, 25 bp, Mus musculus
ggctgcttttgtaccctgccaggac

SEQ ID NO: 622269 - DNA, 25 bp, Mus musculus
ggctgcttttgttccctgccaggac

SEQ ID NO: 622270 - DNA, 25 bp, Mus musculus
ggctggaaaacaactggatctctga

SEQ ID NO: 622271 - DNA, 25 bp, Mus musculus
ggctggaaaacatctggatctctga

SEQ ID NO: 622272 - DNA, 25 bp, Mus musculus
ggctggaaaactcgaaactccgcca

SEQ ID NO: 622273 - DNA, 25 bp, Mus musculus
ggctggaaaactggaaactccgcca

SEQ ID NO: 622274 - DNA, 25 bp, Mus musculus
ggctggaaaagcaatcgtcatgttt

SEQ ID NO: 622275 - DNA, 25 bp, Mus musculus
ggctggaaaagcatcagtttacctt

SEQ ID NO: 622276 - DNA, 25 bp, Mus musculus
ggctggaaaagctatcgtcatgttt

SEQ ID NO: 622277 - DNA, 25 bp, Mus musculus
ggctggaaaagcttcagtttacctt

SEQ ID NO: 622278 - DNA, 25 bp, Mus musculus
ggctggaaaccaattgacttcccgg

SEQ ID NO: 622279 - DNA, 25 bp, Mus musculus
ggctggaaaccatttgacttcccgg

SEQ ID NO: 622280 - DNA, 25 bp, Mus musculus
ggctggaaacctcgtagtgaaacaa

SEQ ID NO: 622281 - DNA, 25 bp, Mus musculus
ggctggaaacctggtagtgaaacaa

SEQ ID NO: 622282 - DNA, 25 bp, Mus musculus
ggctggaaagacataaccagtggga

SEQ ID NO: 622283 - DNA, 25 bp, Mus musculus
ggctggaaagacttaaccagtggga

SEQ ID NO: 622284 - DNA, 25 bp, Mus musculus
ggctggaaagatcgagacaaatact

SEQ ID NO: 622285 - DNA, 25 bp, Mus musculus
ggctggaaagatggagacaaatact

SEQ ID NO: 622286 - DNA, 25 bp, Mus musculus
ggctggaaagcaattttgcaagtgt

SEQ ID NO: 622287 - DNA, 25 bp, Mus musculus
ggctggaaagcatttttgcaagtgt

SEQ ID NO: 622288 - DNA, 25 bp, Mus musculus
ggctggaaagtcatatggcatcata

SEQ ID NO: 622289 - DNA, 25 bp, Mus musculus
ggctggaaagtcttatggcatcata

SEQ ID NO: 622290 - DNA, 25 bp, Mus musculus
ggctggaacgacattgccaatgccc

SEQ ID NO: 622291 - DNA, 25 bp, Mus musculus
ggctggaacgactttgccaatgccc

SEQ ID NO: 622292 - DNA, 25 bp, Mus musculus
ggctggaacttcattgatctctcga

SEQ ID NO: 622293 - DNA, 25 bp, Mus musculus
ggctggaacttctttgatctctcga

SEQ ID NO: 622294 - DNA, 25 bp, Mus musculus
ggctggaactttaaggaacggcact

SEQ ID NO: 622295 - DNA, 25 bp, Mus musculus
ggctggaacttttaggaacggcact

SEQ ID NO: 622296 - DNA, 25 bp, Mus musculus
ggctggaagagaactgccttgagct

SEQ ID NO: 622297 - DNA, 25 bp, Mus musculus
ggctggaagagatctgccttgagct

SEQ ID NO: 622298 - DNA, 25 bp, Mus musculus
ggctggaagatcattcaacctcatc

SEQ ID NO: 622299 - DNA, 25 bp, Mus musculus
ggctggaagatctttcaacctcatc

SEQ ID NO: 622300 - DNA, 25 bp, Mus musculus
ggctggaagcaacaccgtgtctatc

SEQ ID NO: 622301 - DNA, 25 bp, Mus musculus
ggctggaagcaagaccgtgtctatc

SEQ ID NO: 622302 - DNA, 25 bp, Mus musculus
ggctggaagtgcaaggaacctgact

SEQ ID NO: 622303 - DNA, 25 bp, Mus musculus
ggctggaagtgctaggaacctgact

SEQ ID NO: 622304 - DNA, 25 bp, Mus musculus
ggctggaatacgcttcatctcacaa

SEQ ID NO: 622305 - DNA, 25 bp, Mus musculus
ggctggaatacggttcatctcacaa

SEQ ID NO: 622306 - DNA, 25 bp, Mus musculus
ggctggaatcaccactcaacacatg

SEQ ID NO: 622307 - DNA, 25 bp, Mus musculus
ggctggaatcacgactcaacacatg

SEQ ID NO: 622308 - DNA, 25 bp, Mus musculus
ggctggaatgatcactgcatgcaca

SEQ ID NO: 622309 - DNA, 25 bp, Mus musculus
ggctggaatgatctggcctgccaca

SEQ ID NO: 622310 - DNA, 25 bp, Mus musculus
ggctggaatgatgactgcatgcaca

SEQ ID NO: 622311 - DNA, 25 bp, Mus musculus
ggctggaatgatgtggcctgccaca

SEQ ID NO: 622312 - DNA, 25 bp, Mus musculus
ggctggaattctagatgcccatttt

SEQ ID NO: 622313 - DNA, 25 bp, Mus musculus
ggctggaattcttgatgcccatttt

SEQ ID NO: 622314 - DNA, 25 bp, Mus musculus
ggctggacaatcacattggcatctt

SEQ ID NO: 622315 - DNA, 25 bp, Mus musculus
ggctggacaatctcattggcatctt

SEQ ID NO: 622316 - DNA, 25 bp, Mus musculus
ggctggacacaacataattcacctg

SEQ ID NO: 622317 - DNA, 25 bp, Mus musculus
ggctggacacaagataattcacctg

SEQ ID NO: 622318 - DNA, 25 bp, Mus musculus
ggctggacacacctggttgctaaga

SEQ ID NO: 622319 - DNA, 25 bp, Mus musculus
ggctggacacacgtggttgctaaga

SEQ ID NO: 622320 - DNA, 25 bp, Mus musculus
ggctggacacttccgaggttgtctt

SEQ ID NO: 622321 - DNA, 25 bp, Mus musculus
ggctggacacttgcgaggttgtctt

SEQ ID NO: 622322 - DNA, 25 bp, Mus musculus
ggctggacagccctgagagctattt

SEQ ID NO: 622323 - DNA, 25 bp, Mus musculus
ggctggacagccgtgagagctattt

SEQ ID NO: 622324 - DNA, 25 bp, Mus musculus
ggctggacatgcaggtatttgccca

SEQ ID NO: 622325 - DNA, 25 bp, Mus musculus
ggctggacatgctggtatttgccca

SEQ ID NO: 622326 - DNA, 25 bp, Mus musculus
ggctggaccaccatctgtaccgttg

SEQ ID NO: 622327 - DNA, 25 bp, Mus musculus
ggctggaccaccttctgtaccgttg

SEQ ID NO: 622328 - DNA, 25 bp, Mus musculus
ggctggaccagtagcatatagaaga

SEQ ID NO: 622329 - DNA, 25 bp, Mus musculus
ggctggaccagttgcatatagaaga

SEQ ID NO: 622330 - DNA, 25 bp, Mus musculus
ggctggaccatcaacatctgggaaa

SEQ ID NO: 622331 - DNA, 25 bp, Mus musculus
ggctggaccatctacatctgggaaa

SEQ ID NO: 622332 - DNA, 25 bp, Mus musculus
ggctggacccatcagaaacagatgg

SEQ ID NO: 622333 - DNA, 25 bp, Mus musculus
ggctggacccatgagaaacagatgg

SEQ ID NO: 622334 - DNA, 25 bp, Mus musculus
ggctggacccgtccctttgaggaaa

SEQ ID NO: 622335 - DNA, 25 bp, Mus musculus
ggctggacccgtgcctttgaggaaa

SEQ ID NO: 622336 - DNA, 25 bp, Mus musculus
ggctggaccgggacatgtcacatga

SEQ ID NO: 622337 - DNA, 25 bp, Mus musculus
ggctggaccgggtcatgtcacatga

SEQ ID NO: 622338 - DNA, 25 bp, Mus musculus
ggctggacctatcgccaaggacaca

SEQ ID NO: 622339 - DNA, 25 bp, Mus musculus
ggctggacctatggccaaggacaca

SEQ ID NO: 622340 - DNA, 25 bp, Mus musculus
ggctggaccttcaaactcatcagca

SEQ ID NO: 622341 - DNA, 25 bp, Mus musculus
ggctggaccttctaactcatcagca

SEQ ID NO: 622342 - DNA, 25 bp, Mus musculus
ggctggactcctattcaaatttatt

SEQ ID NO: 622343 - DNA, 25 bp, Mus musculus
ggctggactccttttcaaatttatt

SEQ ID NO: 622344 - DNA, 25 bp, Mus musculus
ggctggactcttcctgtaatacagt

SEQ ID NO: 622345 - DNA, 25 bp, Mus musculus
ggctggactcttgctgtaatacagt

SEQ ID NO: 622346 - DNA, 25 bp, Mus musculus
ggctggactgacaccacggagtgat

SEQ ID NO: 622347 - DNA, 25 bp, Mus musculus
ggctggactgactccacggagtgat

SEQ ID NO: 622348 - DNA, 25 bp, Mus musculus
ggctggactgttactaatgccttcc

SEQ ID NO: 622349 - DNA, 25 bp, Mus musculus
ggctggactgtttctaatgccttcc

SEQ ID NO: 622350 - DNA, 25 bp, Mus musculus
ggctggactttgagcctactttaag

SEQ ID NO: 622351 - DNA, 25 bp, Mus musculus
ggctggactttgtgcctactttaag

SEQ ID NO: 622352 - DNA, 25 bp, Mus musculus
ggctggagagggacttattttatct

SEQ ID NO: 622353 - DNA, 25 bp, Mus musculus
ggctggagagggtcttattttatct

SEQ ID NO: 622354 - DNA, 25 bp, Mus musculus
ggctggagatacaatcctgaactct

SEQ ID NO: 622355 - DNA, 25 bp, Mus musculus
ggctggagatactatcctgaactct

SEQ ID NO: 622356 - DNA, 25 bp, Mus musculus
ggctggagatccaactcaacaacca

SEQ ID NO: 622357 - DNA, 25 bp, Mus musculus
ggctggagatcctactcaacaacca

SEQ ID NO: 622358 - DNA, 25 bp, Mus musculus
ggctggagatgactactacaaacac

SEQ ID NO: 622359 - DNA, 25 bp, Mus musculus
ggctggagatgagtactacaaacac

SEQ ID NO: 622360 - DNA, 25 bp, Mus musculus
ggctggagatggaactcttactggt

SEQ ID NO: 622361 - DNA, 25 bp, Mus musculus
ggctggagatggatctatggctaaa

SEQ ID NO: 622362 - DNA, 25 bp, Mus musculus
ggctggagatggtactcttactggt

SEQ ID NO: 622363 - DNA, 25 bp, Mus musculus
ggctggagatggttctatggctaaa

SEQ ID NO: 622364 - DNA, 25 bp, Mus musculus
ggctggagcaagatatccttggtta

SEQ ID NO: 622365 - DNA, 25 bp, Mus musculus
ggctggagcaagttatccttggtta

SEQ ID NO: 622366 - DNA, 25 bp, Mus musculus
ggctggagccaaaaccaagctgatt

SEQ ID NO: 622367 - DNA, 25 bp, Mus musculus
ggctggagccaataccaagctgatt

SEQ ID NO: 622368 - DNA, 25 bp, Mus musculus
ggctggagcctaacagcaccggacc

SEQ ID NO: 622369 - DNA, 25 bp, Mus musculus
ggctggagcctatcagcaccggacc

SEQ ID NO: 622370 - DNA, 25 bp, Mus musculus
ggctggagccttccaataacaccta

SEQ ID NO: 622371 - DNA, 25 bp, Mus musculus
ggctggagccttgcaataacaccta

SEQ ID NO: 622372 - DNA, 25 bp, Mus musculus
ggctggaggaatcgcccgtctccac

SEQ ID NO: 622373 - DNA, 25 bp, Mus musculus
ggctggaggaatggcccgtctccac

SEQ ID NO: 622374 - DNA, 25 bp, Mus musculus
ggctggagggctacaccaagccctg

SEQ ID NO: 622375 - DNA, 25 bp, Mus musculus
ggctggagggcttcaccaagccctg

SEQ ID NO: 622376 - DNA, 25 bp, Mus musculus
ggctggagtcctccctgaactttag

SEQ ID NO: 622377 - DNA, 25 bp, Mus musculus
ggctggagtcctgcctgaactttag

SEQ ID NO: 622378 - DNA, 25 bp, Mus musculus
ggctggagtctcatgtgagttctca

SEQ ID NO: 622379 - DNA, 25 bp, Mus musculus
ggctggagtctcttgtgagttctca

SEQ ID NO: 622380 - DNA, 25 bp, Mus musculus
ggctggagtggaatgctatatctca

SEQ ID NO: 622381 - DNA, 25 bp, Mus musculus
ggctggagtggattgctatatctca

SEQ ID NO: 622382 - DNA, 25 bp, Mus musculus
ggctggagttttaactaccatcttt

SEQ ID NO: 622383 - DNA, 25 bp, Mus musculus
ggctggagtttttactaccatcttt

SEQ ID NO: 622384 - DNA, 25 bp, Mus musculus
ggctggatctctctcaggcctctga

SEQ ID NO: 622385 - DNA, 25 bp, Mus musculus
ggctggatctctgtcaggcctctga

SEQ ID NO: 622386 - DNA, 25 bp, Mus musculus
ggctggatgacaacctgctgtactt

SEQ ID NO: 622387 - DNA, 25 bp, Mus musculus
ggctggatgacatcctgctgtactt

SEQ ID NO: 622388 - DNA, 25 bp, Mus musculus
ggctggatgaggctggcgtggtcct

SEQ ID NO: 622389 - DNA, 25 bp, Mus musculus
ggctggatgagggtggcgtggtcct

SEQ ID NO: 622390 - DNA, 25 bp, Mus musculus
ggctggatgcttaaatctcaccttt

SEQ ID NO: 622391 - DNA, 25 bp, Mus musculus
ggctggatgctttaatctcaccttt

SEQ ID NO: 622392 - DNA, 25 bp, Mus musculus
ggctggattaataggacttgacgtt

SEQ ID NO: 622393 - DNA, 25 bp, Mus musculus
ggctggattaattggacttgacgtt

SEQ ID NO: 622394 - DNA, 25 bp, Mus musculus
ggctggattagcagctctcaagact

SEQ ID NO: 622395 - DNA, 25 bp, Mus musculus
ggctggattagctgctctcaagact

SEQ ID NO: 622396 - DNA, 25 bp, Mus musculus
ggctggattcacaccttactaaaag

SEQ ID NO: 622397 - DNA, 25 bp, Mus musculus
ggctggattcactccttactaaaag

SEQ ID NO: 622398 - DNA, 25 bp, Mus musculus
ggctggattctaactttaaccttat

SEQ ID NO: 622399 - DNA, 25 bp, Mus musculus
ggctggattctatctttaaccttat

SEQ ID NO: 622400 - DNA, 25 bp, Mus musculus
ggctggattgtcatgactgccatca

SEQ ID NO: 622401 - DNA, 25 bp, Mus musculus
ggctggattgtcttgactgccatca

SEQ ID NO: 622402 - DNA, 25 bp, Mus musculus
ggctggatttgaacttcctatgaag

SEQ ID NO: 622403 - DNA, 25 bp, Mus musculus
ggctggatttgatcttcctatgaag

SEQ ID NO: 622404 - DNA, 25 bp, Mus musculus
ggctggcaaaccacagagcccatgg

SEQ ID NO: 622405 - DNA, 25 bp, Mus musculus
ggctggcaaacctcagagcccatgg

SEQ ID NO: 622406 - DNA, 25 bp, Mus musculus
ggctggcaaccgaatataaatataa

SEQ ID NO: 622407 - DNA, 25 bp, Mus musculus
ggctggcaaccgtatataaatataa

SEQ ID NO: 622408 - DNA, 25 bp, Mus musculus
ggctggcaatcaaccggaaacagcg

SEQ ID NO: 622409 - DNA, 25 bp, Mus musculus
ggctggcaatcatccggaaacagcg

SEQ ID NO: 622410 - DNA, 25 bp, Mus musculus
ggctggcacaggagaaactcctcaa

SEQ ID NO: 622411 - DNA, 25 bp, Mus musculus
ggctggcacaggtgaaactcctcaa

SEQ ID NO: 622412 - DNA, 25 bp, Mus musculus
ggctggcagataagagcggcttcca

SEQ ID NO: 622413 - DNA, 25 bp, Mus musculus
ggctggcagatatgagcggcttcca

SEQ ID NO: 622414 - DNA, 25 bp, Mus musculus
ggctggcagctcaagtgtataaaca

SEQ ID NO: 622415 - DNA, 25 bp, Mus musculus
ggctggcagctctagtgtataaaca

SEQ ID NO: 622416 - DNA, 25 bp, Mus musculus
ggctggcatccaatggtggtcattt

SEQ ID NO: 622417 - DNA, 25 bp, Mus musculus
ggctggcatccattggtggtcattt

SEQ ID NO: 622418 - DNA, 25 bp, Mus musculus
ggctggcatcggacttgtagtgact

SEQ ID NO: 622419 - DNA, 25 bp, Mus musculus
ggctggcatcggtcttgtagtgact

SEQ ID NO: 622420 - DNA, 25 bp, Mus musculus
ggctggcattgcctatgtagtgaat

SEQ ID NO: 622421 - DNA, 25 bp, Mus musculus
ggctggcattgcgtatgtagtgaat

SEQ ID NO: 622422 - DNA, 25 bp, Mus musculus
ggctggccaagactgtaaaagctgc

SEQ ID NO: 622423 - DNA, 25 bp, Mus musculus
ggctggccaagagtgtaaaagctgc

SEQ ID NO: 622424 - DNA, 25 bp, Mus musculus
ggctggccaattatggtgacccgga

SEQ ID NO: 622425 - DNA, 25 bp, Mus musculus
ggctggccaattttggtgacccgga

SEQ ID NO: 622426 - DNA, 25 bp, Mus musculus
ggctggccagagagtgcttattgca

SEQ ID NO: 622427 - DNA, 25 bp, Mus musculus
ggctggccagagtgtgcttattgca

SEQ ID NO: 622428 - DNA, 25 bp, Mus musculus
ggctggccagcacgtgagtcttact

SEQ ID NO: 622429 - DNA, 25 bp, Mus musculus
ggctggccagcaggtgagtcttact

SEQ ID NO: 622430 - DNA, 25 bp, Mus musculus
ggctggccatagaggtacagtcttt

SEQ ID NO: 622431 - DNA, 25 bp, Mus musculus
ggctggccatagtggtacagtcttt

SEQ ID NO: 622432 - DNA, 25 bp, Mus musculus
ggctggccatcccagcagtggcaaa

SEQ ID NO: 622433 - DNA, 25 bp, Mus musculus
ggctggccatccgagcagtggcaaa

SEQ ID NO: 622434 - DNA, 25 bp, Mus musculus
ggctggccatgcatgaggtagatct

SEQ ID NO: 622435 - DNA, 25 bp, Mus musculus
ggctggccatgcttgaggtagatct

SEQ ID NO: 622436 - DNA, 25 bp, Mus musculus
ggctggccatttagccaaatcagtg

SEQ ID NO: 622437 - DNA, 25 bp, Mus musculus
ggctggccattttgccaaatcagtg

SEQ ID NO: 622438 - DNA, 25 bp, Mus musculus
ggctggcccatcaatgctaacagaa

SEQ ID NO: 622439 - DNA, 25 bp, Mus musculus
ggctggcccatctatgctaacagaa

SEQ ID NO: 622440 - DNA, 25 bp, Mus musculus
ggctggcccatgatggttttatgtt

SEQ ID NO: 622441 - DNA, 25 bp, Mus musculus
ggctggcccatgttggttttatgtt

SEQ ID NO: 622442 - DNA, 25 bp, Mus musculus
ggctggcccattacttgtcacagaa

SEQ ID NO: 622443 - DNA, 25 bp, Mus musculus
ggctggcccatttcttgtcacagaa

SEQ ID NO: 622444 - DNA, 25 bp, Mus musculus
ggctggccccggctgattttataca

SEQ ID NO: 622445 - DNA, 25 bp, Mus musculus
ggctggccccgggtgattttataca

SEQ ID NO: 622446 - DNA, 25 bp, Mus musculus
ggctggcccgtgactcaacagcaat

SEQ ID NO: 622447 - DNA, 25 bp, Mus musculus
ggctggcccgtgtctcaacagcaat

SEQ ID NO: 622448 - DNA, 25 bp, Mus musculus
ggctggccctccagaggactggctc

SEQ ID NO: 622449 - DNA, 25 bp, Mus musculus
ggctggccctcctgaggactggctc

SEQ ID NO: 622450 - DNA, 25 bp, Mus musculus
ggctggccctgaacatgacaagttc

SEQ ID NO: 622451 - DNA, 25 bp, Mus musculus
ggctggccctgatcatgacaagttc

SEQ ID NO: 622452 - DNA, 25 bp, Mus musculus
ggctggccctgcagtattatatata

SEQ ID NO: 622453 - DNA, 25 bp, Mus musculus
ggctggccctgctgtattatatata

SEQ ID NO: 622454 - DNA, 25 bp, Mus musculus
ggctggccctttagaccatcatgga

SEQ ID NO: 622455 - DNA, 25 bp, Mus musculus
ggctggcccttttgaccatcatgga

SEQ ID NO: 622456 - DNA, 25 bp, Mus musculus
ggctggcctaaactcatttgtagtc

SEQ ID NO: 622457 - DNA, 25 bp, Mus musculus
ggctggcctaaagtcatttgtagtc

SEQ ID NO: 622458 - DNA, 25 bp, Mus musculus
ggctggcctcacatagatccactgc

SEQ ID NO: 622459 - DNA, 25 bp, Mus musculus
ggctggcctcacttagatccactgc

SEQ ID NO: 622460 - DNA, 25 bp, Mus musculus
ggctggcctcatactttgtgtgtaa

SEQ ID NO: 622461 - DNA, 25 bp, Mus musculus
ggctggcctcattctttgtgtgtaa

SEQ ID NO: 622462 - DNA, 25 bp, Mus musculus
ggctggcctgccataataacacaat

SEQ ID NO: 622463 - DNA, 25 bp, Mus musculus
ggctggcctgccttaataacacaat

SEQ ID NO: 622464 - DNA, 25 bp, Mus musculus
ggctggcctgtgacatgtgtgtaca

SEQ ID NO: 622465 - DNA, 25 bp, Mus musculus
ggctggcctgtgtcatgtgtgtaca

SEQ ID NO: 622466 - DNA, 25 bp, Mus musculus
ggctggccttaactttcaatccttt

SEQ ID NO: 622467 - DNA, 25 bp, Mus musculus
ggctggccttaagtttcaatccttt

SEQ ID NO: 622468 - DNA, 25 bp, Mus musculus
ggctggccttcccatatatattggg

SEQ ID NO: 622469 - DNA, 25 bp, Mus musculus
ggctggccttccgatatatattggg

SEQ ID NO: 622470 - DNA, 25 bp, Mus musculus
ggctggccttgaactgtctgcgcct

SEQ ID NO: 622471 - DNA, 25 bp, Mus musculus
ggctggccttgacggtgcacaccct

SEQ ID NO: 622472 - DNA, 25 bp, Mus musculus
ggctggccttgagggtgcacaccct

SEQ ID NO: 622473 - DNA, 25 bp, Mus musculus
ggctggccttgatctgtctgcgcct

SEQ ID NO: 622474 - DNA, 25 bp, Mus musculus
ggctggccttgtcgtaaagctgcta

SEQ ID NO: 622475 - DNA, 25 bp, Mus musculus
ggctggccttgtggtaaagctgcta

SEQ ID NO: 622476 - DNA, 25 bp, Mus musculus
ggctggcggatcactgtccaggaca

SEQ ID NO: 622477 - DNA, 25 bp, Mus musculus
ggctggcggatctctgtccaggaca

SEQ ID NO: 622478 - DNA, 25 bp, Mus musculus
ggctggcgttctaacataatcttga

SEQ ID NO: 622479 - DNA, 25 bp, Mus musculus
ggctggcgttcttacataatcttga

SEQ ID NO: 622480 - DNA, 25 bp, Mus musculus
ggctggctaaggacgatcagctgaa

SEQ ID NO: 622481 - DNA, 25 bp, Mus musculus
ggctggctaaggtcgatcagctgaa

SEQ ID NO: 622482 - DNA, 25 bp, Mus musculus
ggctggctaattatactggtgtttt

SEQ ID NO: 622483 - DNA, 25 bp, Mus musculus
ggctggctaattttactggtgtttt

SEQ ID NO: 622484 - DNA, 25 bp, Mus musculus
ggctggctacgaaaagctctggcac

SEQ ID NO: 622485 - DNA, 25 bp, Mus musculus
ggctggctacgataagctctggcac

SEQ ID NO: 622486 - DNA, 25 bp, Mus musculus
ggctggctagctcgaacatgttact

SEQ ID NO: 622487 - DNA, 25 bp, Mus musculus
ggctggctagctggaacatgttact

SEQ ID NO: 622488 - DNA, 25 bp, Mus musculus
ggctggctatatcaaggctggctat

SEQ ID NO: 622489 - DNA, 25 bp, Mus musculus
ggctggctatatgaaggctggctat

SEQ ID NO: 622490 - DNA, 25 bp, Mus musculus
ggctggctatgtactttctgccaca

SEQ ID NO: 622491 - DNA, 25 bp, Mus musculus
ggctggctatgttctttctgccaca

SEQ ID NO: 622492 - DNA, 25 bp, Mus musculus
ggctggctcaagaagcacgcatact

SEQ ID NO: 622493 - DNA, 25 bp, Mus musculus
ggctggctcaagacaggctttgcaa

SEQ ID NO: 622494 - DNA, 25 bp, Mus musculus
ggctggctcaagtagcacgcatact

SEQ ID NO: 622495 - DNA, 25 bp, Mus musculus
ggctggctcaagtcaggctttgcaa

SEQ ID NO: 622496 - DNA, 25 bp, Mus musculus
ggctggctcacactgtgttactaac

SEQ ID NO: 622497 - DNA, 25 bp, Mus musculus
ggctggctcacagtgtgttactaac

SEQ ID NO: 622498 - DNA, 25 bp, Mus musculus
ggctggctccaaagaatagcaagtg

SEQ ID NO: 622499 - DNA, 25 bp, Mus musculus
ggctggctccaatgaatagcaagtg

SEQ ID NO: 622500 - DNA, 25 bp, Mus musculus
ggctggctccacaatgtgattggct

SEQ ID NO: 622501 - DNA, 25 bp, Mus musculus
ggctggctccactatgtgattggct

SEQ ID NO: 622502 - DNA, 25 bp, Mus musculus
ggctggctccatcttttaggtaaat

SEQ ID NO: 622503 - DNA, 25 bp, Mus musculus
ggctggctccatgttttaggtaaat

SEQ ID NO: 622504 - DNA, 25 bp, Mus musculus
ggctggctcccacgacgacatgtag

SEQ ID NO: 622505 - DNA, 25 bp, Mus musculus
ggctggctcccaggacgacatgtag

SEQ ID NO: 622506 - DNA, 25 bp, Mus musculus
ggctggctcctcatagaaaggaacc

SEQ ID NO: 622507 - DNA, 25 bp, Mus musculus
ggctggctcctcttagaaaggaacc

SEQ ID NO: 622508 - DNA, 25 bp, Mus musculus
ggctggctccttcattagaggccat

SEQ ID NO: 622509 - DNA, 25 bp, Mus musculus
ggctggctccttgattagaggccat

SEQ ID NO: 622510 - DNA, 25 bp, Mus musculus
ggctggctctaaacggatgttcatt

SEQ ID NO: 622511 - DNA, 25 bp, Mus musculus
ggctggctctaatcggatgttcatt

SEQ ID NO: 622512 - DNA, 25 bp, Mus musculus
ggctggctctggcatcattctccaa

SEQ ID NO: 622513 - DNA, 25 bp, Mus musculus
ggctggctctgggatcattctccaa

SEQ ID NO: 622514 - DNA, 25 bp, Mus musculus
ggctggctcttaacttttctgtatt

SEQ ID NO: 622515 - DNA, 25 bp, Mus musculus
ggctggctcttatcttttctgtatt

SEQ ID NO: 622516 - DNA, 25 bp, Mus musculus
ggctggctgaaaccacactgctgga

SEQ ID NO: 622517 - DNA, 25 bp, Mus musculus
ggctggctgaaagcacactgctgga

SEQ ID NO: 622518 - DNA, 25 bp, Mus musculus
ggctggctgaatattcctttgttca

SEQ ID NO: 622519 - DNA, 25 bp, Mus musculus
ggctggctgaattttcctttgttca

SEQ ID NO: 622520 - DNA, 25 bp, Mus musculus
ggctggctgacaatctgtgaaccat

SEQ ID NO: 622521 - DNA, 25 bp, Mus musculus
ggctggctgacattctgtgaaccat

SEQ ID NO: 622522 - DNA, 25 bp, Mus musculus
ggctggctgactcgcattatctatg

SEQ ID NO: 622523 - DNA, 25 bp, Mus musculus
ggctggctgactggcattatctatg

SEQ ID NO: 622524 - DNA, 25 bp, Mus musculus
ggctggctgattccctgcaaattca

SEQ ID NO: 622525 - DNA, 25 bp, Mus musculus
ggctggctgattgcctgcaaattca

SEQ ID NO: 622526 - DNA, 25 bp, Mus musculus
ggctggctgcagcaactgacttgca

SEQ ID NO: 622527 - DNA, 25 bp, Mus musculus
ggctggctgcaggaactgacttgca

SEQ ID NO: 622528 - DNA, 25 bp, Mus musculus
ggctggctggacattctgtatccca

SEQ ID NO: 622529 - DNA, 25 bp, Mus musculus
ggctggctggactttctgtatccca

SEQ ID NO: 622530 - DNA, 25 bp, Mus musculus
ggctggctggccataagccccattg

SEQ ID NO: 622531 - DNA, 25 bp, Mus musculus
ggctggctggccttaagccccattg

SEQ ID NO: 622532 - DNA, 25 bp, Mus musculus
ggctggctgggcactcctatctctc

SEQ ID NO: 622533 - DNA, 25 bp, Mus musculus
ggctggctgggctctcctatctctc

SEQ ID NO: 622534 - DNA, 25 bp, Mus musculus
ggctggctggttatatctgaatgca

SEQ ID NO: 622535 - DNA, 25 bp, Mus musculus
ggctggctggttttatctgaatgca

SEQ ID NO: 622536 - DNA, 25 bp, Mus musculus
ggctggctgtagagatgaaaccctt

SEQ ID NO: 622537 - DNA, 25 bp, Mus musculus
ggctggctgtagtgatgaaaccctt

SEQ ID NO: 622538 - DNA, 25 bp, Mus musculus
ggctggctgtgcaaagttgtttcta

SEQ ID NO: 622539 - DNA, 25 bp, Mus musculus
ggctggctgtgctaagttgtttcta

SEQ ID NO: 622540 - DNA, 25 bp, Mus musculus
ggctggctgttcatgtcaaggactc

SEQ ID NO: 622541 - DNA, 25 bp, Mus musculus
ggctggctgttcttgtcaaggactc

SEQ ID NO: 622542 - DNA, 25 bp, Mus musculus
ggctggcttaagaataaatttgttt

SEQ ID NO: 622543 - DNA, 25 bp, Mus musculus
ggctggcttaagtataaatttgttt

SEQ ID NO: 622544 - DNA, 25 bp, Mus musculus
ggctggcttctcagactcaagccaa

SEQ ID NO: 622545 - DNA, 25 bp, Mus musculus
ggctggcttctctgactcaagccaa

SEQ ID NO: 622546 - DNA, 25 bp, Mus musculus
ggctggcttcttatgaagtgacaac

SEQ ID NO: 622547 - DNA, 25 bp, Mus musculus
ggctggcttcttttgaagtgacaac

SEQ ID NO: 622548 - DNA, 25 bp, Mus musculus
ggctggcttgacagcctgagcacaa

SEQ ID NO: 622549 - DNA, 25 bp, Mus musculus
ggctggcttgactgcctgagcacaa

SEQ ID NO: 622550 - DNA, 25 bp, Mus musculus
ggctggcttggaactcattttttaa

SEQ ID NO: 622551 - DNA, 25 bp, Mus musculus
ggctggcttggatctcattttttaa

SEQ ID NO: 622552 - DNA, 25 bp, Mus musculus
ggctggcttggcatcaataaggagc

SEQ ID NO: 622553 - DNA, 25 bp, Mus musculus
ggctggcttggcttcaataaggagc

SEQ ID NO: 622554 - DNA, 25 bp, Mus musculus
ggctggcttgggaacaaatggctct

SEQ ID NO: 622555 - DNA, 25 bp, Mus musculus
ggctggcttgggtacaaatggctct

SEQ ID NO: 622556 - DNA, 25 bp, Mus musculus
ggctggcttgtacctccagaggttc

SEQ ID NO: 622557 - DNA, 25 bp, Mus musculus
ggctggcttgtagctccagaggttc

SEQ ID NO: 622558 - DNA, 25 bp, Mus musculus
ggctggcttgttagggaactcttga

SEQ ID NO: 622559 - DNA, 25 bp, Mus musculus
ggctggcttgttatctcatctctaa

SEQ ID NO: 622560 - DNA, 25 bp, Mus musculus
ggctggcttgtttgggaactcttga

SEQ ID NO: 622561 - DNA, 25 bp, Mus musculus
ggctggcttgttttctcatctctaa

SEQ ID NO: 622562 - DNA, 25 bp, Mus musculus
ggctggctttaaactagcaaccttc

SEQ ID NO: 622563 - DNA, 25 bp, Mus musculus
ggctggctttaatctagcaaccttc

SEQ ID NO: 622564 - DNA, 25 bp, Mus musculus
ggctggctttagcagacctgaatga

SEQ ID NO: 622565 - DNA, 25 bp, Mus musculus
ggctggctttaggagacctgaatga

SEQ ID NO: 622566 - DNA, 25 bp, Mus musculus
ggctggcttttaatcacctattgtg

SEQ ID NO: 622567 - DNA, 25 bp, Mus musculus
ggctggcttttattcacctattgtg

SEQ ID NO: 622568 - DNA, 25 bp, Mus musculus
ggctgggaaattaggcttctactgt

SEQ ID NO: 622569 - DNA, 25 bp, Mus musculus
ggctgggaaatttggcttctactgt

SEQ ID NO: 622570 - DNA, 25 bp, Mus musculus
ggctgggaactcaccaaagcccgaa

SEQ ID NO: 622571 - DNA, 25 bp, Mus musculus
ggctgggaactctccaaagcccgaa

SEQ ID NO: 622572 - DNA, 25 bp, Mus musculus
ggctgggaagaaagtgccccttcag

SEQ ID NO: 622573 - DNA, 25 bp, Mus musculus
ggctgggaagaatgtgccccttcag

SEQ ID NO: 622574 - DNA, 25 bp, Mus musculus
ggctgggaagtgacttgcaattgtc

SEQ ID NO: 622575 - DNA, 25 bp, Mus musculus
ggctgggaagtgtcttgcaattgtc

SEQ ID NO: 622576 - DNA, 25 bp, Mus musculus
ggctgggaattcactttgaagccca

SEQ ID NO: 622577 - DNA, 25 bp, Mus musculus
ggctgggaattctctttgaagccca

SEQ ID NO: 622578 - DNA, 25 bp, Mus musculus
ggctgggacaataacttttgactga

SEQ ID NO: 622579 - DNA, 25 bp, Mus musculus
ggctgggacaattacttttgactga

SEQ ID NO: 622580 - DNA, 25 bp, Mus musculus
ggctgggacacccttaactatgtca

SEQ ID NO: 622581 - DNA, 25 bp, Mus musculus
ggctgggacaccgttaactatgtca

SEQ ID NO: 622582 - DNA, 25 bp, Mus musculus
ggctgggaccgcaggatcgtacacc

SEQ ID NO: 622583 - DNA, 25 bp, Mus musculus
ggctgggaccgctggatcgtacacc

SEQ ID NO: 622584 - DNA, 25 bp, Mus musculus
ggctgggactccaaatcattggtcc

SEQ ID NO: 622585 - DNA, 25 bp, Mus musculus
ggctgggactcctaatcattggtcc

SEQ ID NO: 622586 - DNA, 25 bp, Mus musculus
ggctgggagatcacagacaccttgt

SEQ ID NO: 622587 - DNA, 25 bp, Mus musculus
ggctgggagatctcagacaccttgt

SEQ ID NO: 622588 - DNA, 25 bp, Mus musculus
ggctgggagcagatcgattttacct

SEQ ID NO: 622589 - DNA, 25 bp, Mus musculus
ggctgggagcagttcgattttacct

SEQ ID NO: 622590 - DNA, 25 bp, Mus musculus
ggctgggagtgtactcagagtctca

SEQ ID NO: 622591 - DNA, 25 bp, Mus musculus
ggctgggagtgttctcagagtctca

SEQ ID NO: 622592 - DNA, 25 bp, Mus musculus
ggctgggatcccatctaaaggagtg

SEQ ID NO: 622593 - DNA, 25 bp, Mus musculus
ggctgggatcccttctaaaggagtg

SEQ ID NO: 622594 - DNA, 25 bp, Mus musculus
ggctgggatcctagaaacggcctcc

SEQ ID NO: 622595 - DNA, 25 bp, Mus musculus
ggctgggatccttgaaacggcctcc

SEQ ID NO: 622596 - DNA, 25 bp, Mus musculus
ggctgggatctgacccgagtctcaa

SEQ ID NO: 622597 - DNA, 25 bp, Mus musculus
ggctgggatctgtcccgagtctcaa

SEQ ID NO: 622598 - DNA, 25 bp, Mus musculus
ggctgggatgacataagatgtatat

SEQ ID NO: 622599 - DNA, 25 bp, Mus musculus
ggctgggatgacttaagatgtatat

SEQ ID NO: 622600 - DNA, 25 bp, Mus musculus
ggctgggatgccaatgggacataat

SEQ ID NO: 622601 - DNA, 25 bp, Mus musculus
ggctgggatgccattgtggaactat

SEQ ID NO: 622602 - DNA, 25 bp, Mus musculus
ggctgggatgcctatgggacataat

SEQ ID NO: 622603 - DNA, 25 bp, Mus musculus
ggctgggatgcctttgtggaactat

SEQ ID NO: 622604 - DNA, 25 bp, Mus musculus
ggctgggatgtaagggcaggaccct

SEQ ID NO: 622605 - DNA, 25 bp, Mus musculus
ggctgggatgtatgggcaggaccct

SEQ ID NO: 622606 - DNA, 25 bp, Mus musculus
ggctgggcaatactcaatgcacttt

SEQ ID NO: 622607 - DNA, 25 bp, Mus musculus
ggctgggcaatagtcaatgcacttt

SEQ ID NO: 622608 - DNA, 25 bp, Mus musculus
ggctgggcaattaactactctacta

SEQ ID NO: 622609 - DNA, 25 bp, Mus musculus
ggctgggcaattcaattatggcttt

SEQ ID NO: 622610 - DNA, 25 bp, Mus musculus
ggctgggcaattgaattatggcttt

SEQ ID NO: 622611 - DNA, 25 bp, Mus musculus
ggctgggcaatttactactctacta

SEQ ID NO: 622612 - DNA, 25 bp, Mus musculus
ggctgggcagcaagagatagcttat

SEQ ID NO: 622613 - DNA, 25 bp, Mus musculus
ggctgggcagcatgagatagcttat

SEQ ID NO: 622614 - DNA, 25 bp, Mus musculus
ggctgggcatatctcggcctcttgt

SEQ ID NO: 622615 - DNA, 25 bp, Mus musculus
ggctgggcatatgtcggcctcttgt

SEQ ID NO: 622616 - DNA, 25 bp, Mus musculus
ggctgggcatctactgtggcatgaa

SEQ ID NO: 622617 - DNA, 25 bp, Mus musculus
ggctgggcatcttctgtggcatgaa

SEQ ID NO: 622618 - DNA, 25 bp, Mus musculus
ggctgggccaagagaaatgattttt

SEQ ID NO: 622619 - DNA, 25 bp, Mus musculus
ggctgggccaagagttagatgaaca

SEQ ID NO: 622620 - DNA, 25 bp, Mus musculus
ggctgggccaagatctctaacatga

SEQ ID NO: 622621 - DNA, 25 bp, Mus musculus
ggctgggccaagtgaaatgattttt

SEQ ID NO: 622622 - DNA, 25 bp, Mus musculus
ggctgggccaagtgttagatgaaca

SEQ ID NO: 622623 - DNA, 25 bp, Mus musculus
ggctgggccaagttctctaacatga

SEQ ID NO: 622624 - DNA, 25 bp, Mus musculus
ggctgggccataagaccactgttgt

SEQ ID NO: 622625 - DNA, 25 bp, Mus musculus
ggctgggccatatgaccactgttgt

SEQ ID NO: 622626 - DNA, 25 bp, Mus musculus
ggctgggcccaaccagtgctgttca

SEQ ID NO: 622627 - DNA, 25 bp, Mus musculus
ggctgggcccaagcagtgctgttca

SEQ ID NO: 622628 - DNA, 25 bp, Mus musculus
ggctgggcctggaacctgtgcatca

SEQ ID NO: 622629 - DNA, 25 bp, Mus musculus
ggctgggcctggtacctgtgcatca

SEQ ID NO: 622630 - DNA, 25 bp, Mus musculus
ggctgggcgtttccttatgtgcaaa

SEQ ID NO: 622631 - DNA, 25 bp, Mus musculus
ggctgggcgtttgcttatgtgcaaa

SEQ ID NO: 622632 - DNA, 25 bp, Mus musculus
ggctgggctattcgaactgaaagca

SEQ ID NO: 622633 - DNA, 25 bp, Mus musculus
ggctgggctattggaactgaaagca

SEQ ID NO: 622634 - DNA, 25 bp, Mus musculus
ggctgggctcatccgaagtcgaaca

SEQ ID NO: 622635 - DNA, 25 bp, Mus musculus
ggctgggctcatgcgaagtcgaaca

SEQ ID NO: 622636 - DNA, 25 bp, Mus musculus
ggctgggctccaaatcaagattctc

SEQ ID NO: 622637 - DNA, 25 bp, Mus musculus
ggctgggctccatatcaagattctc

SEQ ID NO: 622638 - DNA, 25 bp, Mus musculus
ggctgggctgaaaggctccagtgaa

SEQ ID NO: 622639 - DNA, 25 bp, Mus musculus
ggctgggctgaatggctccagtgaa

SEQ ID NO: 622640 - DNA, 25 bp, Mus musculus
ggctgggctgacaagcgctgaccct

SEQ ID NO: 622641 - DNA, 25 bp, Mus musculus
ggctgggctgactagcgctgaccct

SEQ ID NO: 622642 - DNA, 25 bp, Mus musculus
ggctgggcttcactcaggttgtata

SEQ ID NO: 622643 - DNA, 25 bp, Mus musculus
ggctgggcttcagtcaggttgtata

SEQ ID NO: 622644 - DNA, 25 bp, Mus musculus
ggctgggcttgtataagtccctttt

SEQ ID NO: 622645 - DNA, 25 bp, Mus musculus
ggctgggcttgtttaagtccctttt

SEQ ID NO: 622646 - DNA, 25 bp, Mus musculus
ggctgggtaggcctgtccaacacca

SEQ ID NO: 622647 - DNA, 25 bp, Mus musculus
ggctgggtaggcgtgtccaacacca

SEQ ID NO: 622648 - DNA, 25 bp, Mus musculus
ggctgggtagttaggcttagatcct

SEQ ID NO: 622649 - DNA, 25 bp, Mus musculus
ggctgggtagtttggcttagatcct

SEQ ID NO: 622650 - DNA, 25 bp, Mus musculus
ggctgggtcataagtatttgcagaa

SEQ ID NO: 622651 - DNA, 25 bp, Mus musculus
ggctgggtcatatgtatttgcagaa

SEQ ID NO: 622652 - DNA, 25 bp, Mus musculus
ggctgggtcctaatccaattttact

SEQ ID NO: 622653 - DNA, 25 bp, Mus musculus
ggctgggtcctattccaattttact

SEQ ID NO: 622654 - DNA, 25 bp, Mus musculus
ggctgggtgacgcatacactcttta

SEQ ID NO: 622655 - DNA, 25 bp, Mus musculus
ggctgggtgacggatacactcttta

SEQ ID NO: 622656 - DNA, 25 bp, Mus musculus
ggctgggtgattaggatcccgactc

SEQ ID NO: 622657 - DNA, 25 bp, Mus musculus
ggctgggtgatttggatcccgactc

SEQ ID NO: 622658 - DNA, 25 bp, Mus musculus
ggctgggtgcgcagagtttcctatc

SEQ ID NO: 622659 - DNA, 25 bp, Mus musculus
ggctgggtgcgctgagtttcctatc

SEQ ID NO: 622660 - DNA, 25 bp, Mus musculus
ggctgggtgctcagactcttaacaa

SEQ ID NO: 622661 - DNA, 25 bp, Mus musculus
ggctgggtgctctgactcttaacaa

SEQ ID NO: 622662 - DNA, 25 bp, Mus musculus
ggctgggtgcttctatatgtgtctc

SEQ ID NO: 622663 - DNA, 25 bp, Mus musculus
ggctgggtgcttgtatatgtgtctc

SEQ ID NO: 622664 - DNA, 25 bp, Mus musculus
ggctgggtggaaaattgtttctcaa

SEQ ID NO: 622665 - DNA, 25 bp, Mus musculus
ggctgggtggaatattgtttctcaa

SEQ ID NO: 622666 - DNA, 25 bp, Mus musculus
ggctgggtggatcgaacttcttctg

SEQ ID NO: 622667 - DNA, 25 bp, Mus musculus
ggctgggtggatggaacttcttctg

SEQ ID NO: 622668 - DNA, 25 bp, Mus musculus
ggctgggtgtttaagagcccttgtt

SEQ ID NO: 622669 - DNA, 25 bp, Mus musculus
ggctgggtgttttagagcccttgtt

SEQ ID NO: 622670 - DNA, 25 bp, Mus musculus
ggctgggttaaactaccacactcaa

SEQ ID NO: 622671 - DNA, 25 bp, Mus musculus
ggctgggttaaagtaccacactcaa

SEQ ID NO: 622672 - DNA, 25 bp, Mus musculus
ggctgggttaccagggaaagccaca

SEQ ID NO: 622673 - DNA, 25 bp, Mus musculus
ggctgggttacctgggaaagccaca

SEQ ID NO: 622674 - DNA, 25 bp, Mus musculus
ggctgggttccaaaatacttgcttt

SEQ ID NO: 622675 - DNA, 25 bp, Mus musculus
ggctgggttccataatacttgcttt

SEQ ID NO: 622676 - DNA, 25 bp, Mus musculus
ggctgggttcttagcattgttgcta

SEQ ID NO: 622677 - DNA, 25 bp, Mus musculus
ggctgggttctttgcattgttgcta

SEQ ID NO: 622678 - DNA, 25 bp, Mus musculus
ggctgggttttcagctttccacagt

SEQ ID NO: 622679 - DNA, 25 bp, Mus musculus
ggctgggttttcagtgctgaataaa

SEQ ID NO: 622680 - DNA, 25 bp, Mus musculus
ggctgggttttctgctttccacagt

SEQ ID NO: 622681 - DNA, 25 bp, Mus musculus
ggctgggttttctgtgctgaataaa

SEQ ID NO: 622682 - DNA, 25 bp, Mus musculus
ggctggtaaccactcaatttgaagg

SEQ ID NO: 622683 - DNA, 25 bp, Mus musculus
ggctggtaaccagtcaatttgaagg

SEQ ID NO: 622684 - DNA, 25 bp, Mus musculus
ggctggtacatacccgtacacatta

SEQ ID NO: 622685 - DNA, 25 bp, Mus musculus
ggctggtacatagccgtacacatta

SEQ ID NO: 622686 - DNA, 25 bp, Mus musculus
ggctggtaccagaatgcattgatgt

SEQ ID NO: 622687 - DNA, 25 bp, Mus musculus
ggctggtaccagtatgcattgatgt

SEQ ID NO: 622688 - DNA, 25 bp, Mus musculus
ggctggtacgtcagtgacattcaaa

SEQ ID NO: 622689 - DNA, 25 bp, Mus musculus
ggctggtacgtctgtgacattcaaa

SEQ ID NO: 622690 - DNA, 25 bp, Mus musculus
ggctggtacttgctacacaataata

SEQ ID NO: 622691 - DNA, 25 bp, Mus musculus
ggctggtacttggtacacaataata

SEQ ID NO: 622692 - DNA, 25 bp, Mus musculus
ggctggtagccaaaagcaagaacta

SEQ ID NO: 622693 - DNA, 25 bp, Mus musculus
ggctggtagccataagcaagaacta

SEQ ID NO: 622694 - DNA, 25 bp, Mus musculus
ggctggtagctcaaagcacaccgtg

SEQ ID NO: 622695 - DNA, 25 bp, Mus musculus
ggctggtagctctaagcacaccgtg

SEQ ID NO: 622696 - DNA, 25 bp, Mus musculus
ggctggtatagcatcgagactgttg

SEQ ID NO: 622697 - DNA, 25 bp, Mus musculus
ggctggtatagcttcgagactgttg

SEQ ID NO: 622698 - DNA, 25 bp, Mus musculus
ggctggtatcggcaacgacacaaag

SEQ ID NO: 622699 - DNA, 25 bp, Mus musculus
ggctggtatcgggaacgacacaaag

SEQ ID NO: 622700 - DNA, 25 bp, Mus musculus
ggctggtcacgtcatggacaattcc

SEQ ID NO: 622701 - DNA, 25 bp, Mus musculus
ggctggtcacgtgatggacaattcc

SEQ ID NO: 622702 - DNA, 25 bp, Mus musculus
ggctggtcagacacatggactccaa

SEQ ID NO: 622703 - DNA, 25 bp, Mus musculus
ggctggtcagactcatggactccaa

SEQ ID NO: 622704 - DNA, 25 bp, Mus musculus
ggctggtcatccctcagagacttta

SEQ ID NO: 622705 - DNA, 25 bp, Mus musculus
ggctggtcatccgtcagagacttta

SEQ ID NO: 622706 - DNA, 25 bp, Mus musculus
ggctggtccctaaagatgcatgcca

SEQ ID NO: 622707 - DNA, 25 bp, Mus musculus
ggctggtccctatagatgcatgcca

SEQ ID NO: 622708 - DNA, 25 bp, Mus musculus
ggctggtccggcatgcctgtatgta

SEQ ID NO: 622709 - DNA, 25 bp, Mus musculus
ggctggtccggcttgcctgtatgta

SEQ ID NO: 622710 - DNA, 25 bp, Mus musculus
ggctggtcctagaaacctgctgcag

SEQ ID NO: 622711 - DNA, 25 bp, Mus musculus
ggctggtcctagtaacctgctgcag

SEQ ID NO: 622712 - DNA, 25 bp, Mus musculus
ggctggtcctatatggatcttaaat

SEQ ID NO: 622713 - DNA, 25 bp, Mus musculus
ggctggtcctatttggatcttaaat

SEQ ID NO: 622714 - DNA, 25 bp, Mus musculus
ggctggtccttaagtttgcatgaaa

SEQ ID NO: 622715 - DNA, 25 bp, Mus musculus
ggctggtccttatgtttgcatgaaa

SEQ ID NO: 622716 - DNA, 25 bp, Mus musculus
ggctggtcgccaaccgaaacaagat

SEQ ID NO: 622717 - DNA, 25 bp, Mus musculus
ggctggtcgccatccgaaacaagat

SEQ ID NO: 622718 - DNA, 25 bp, Mus musculus
ggctggtctcaaatttgcagcaaac

SEQ ID NO: 622719 - DNA, 25 bp, Mus musculus
ggctggtctcaactcattatgtagc

SEQ ID NO: 622720 - DNA, 25 bp, Mus musculus
ggctggtctcaagtcattatgtagc

SEQ ID NO: 622721 - DNA, 25 bp, Mus musculus
ggctggtctcaattttgcagcaaac

SEQ ID NO: 622722 - DNA, 25 bp, Mus musculus
ggctggtctgatcaagtgcctgctt

SEQ ID NO: 622723 - DNA, 25 bp, Mus musculus
ggctggtctgatgaagtgcctgctt

SEQ ID NO: 622724 - DNA, 25 bp, Mus musculus
ggctggtctgcaactcaaagcgatt

SEQ ID NO: 622725 - DNA, 25 bp, Mus musculus
ggctggtctgcatctcaaagcgatt

SEQ ID NO: 622726 - DNA, 25 bp, Mus musculus
ggctggtctggacctccctttgtga

SEQ ID NO: 622727 - DNA, 25 bp, Mus musculus
ggctggtctggagctccctttgtga

SEQ ID NO: 622728 - DNA, 25 bp, Mus musculus
ggctggtctgtcatcctagggaagt

SEQ ID NO: 622729 - DNA, 25 bp, Mus musculus
ggctggtctgtcttcctagggaagt

SEQ ID NO: 622730 - DNA, 25 bp, Mus musculus
ggctggtcttacctccaggcagaag

SEQ ID NO: 622731 - DNA, 25 bp, Mus musculus
ggctggtcttacgtccaggcagaag

SEQ ID NO: 622732 - DNA, 25 bp, Mus musculus
ggctggtcttccatttacagtgtca

SEQ ID NO: 622733 - DNA, 25 bp, Mus musculus
ggctggtcttccttttacagtgtca

SEQ ID NO: 622734 - DNA, 25 bp, Mus musculus
ggctggtctttaagatgtgtttaac

SEQ ID NO: 622735 - DNA, 25 bp, Mus musculus
ggctggtctttatgatgtgtttaac

SEQ ID NO: 622736 - DNA, 25 bp, Mus musculus
ggctggtgagttaggcgaactttcc

SEQ ID NO: 622737 - DNA, 25 bp, Mus musculus
ggctggtgagtttggcgaactttcc

SEQ ID NO: 622738 - DNA, 25 bp, Mus musculus
ggctggtgatccaggttcggtaaaa

SEQ ID NO: 622739 - DNA, 25 bp, Mus musculus
ggctggtgatcctggttcggtaaaa

SEQ ID NO: 622740 - DNA, 25 bp, Mus musculus
ggctggtgatggatgcataccttta

SEQ ID NO: 622741 - DNA, 25 bp, Mus musculus
ggctggtgatggttgcataccttta

SEQ ID NO: 622742 - DNA, 25 bp, Mus musculus
ggctggtgccgtctcttgaatttta

SEQ ID NO: 622743 - DNA, 25 bp, Mus musculus
ggctggtgccgtgtcttgaatttta

SEQ ID NO: 622744 - DNA, 25 bp, Mus musculus
ggctggtgctctaccagttgacaga

SEQ ID NO: 622745 - DNA, 25 bp, Mus musculus
ggctggtgctcttccagttgacaga

SEQ ID NO: 622746 - DNA, 25 bp, Mus musculus
ggctggtgggcactacgaactcaat

SEQ ID NO: 622747 - DNA, 25 bp, Mus musculus
ggctggtgggcagtacgaactcaat

SEQ ID NO: 622748 - DNA, 25 bp, Mus musculus
ggctggtggtctatcttggaattga

SEQ ID NO: 622749 - DNA, 25 bp, Mus musculus
ggctggtggtctttcttggaattga

SEQ ID NO: 622750 - DNA, 25 bp, Mus musculus
ggctggtgttttacgtgccattgat

SEQ ID NO: 622751 - DNA, 25 bp, Mus musculus
ggctggtgtttttcgtgccattgat

SEQ ID NO: 622752 - DNA, 25 bp, Mus musculus
ggctggttaaagatcgctggccttt

SEQ ID NO: 622753 - DNA, 25 bp, Mus musculus
ggctggttaaagttcgctggccttt

SEQ ID NO: 622754 - DNA, 25 bp, Mus musculus
ggctggttaggtcctttactttact

SEQ ID NO: 622755 - DNA, 25 bp, Mus musculus
ggctggttaggtgctttactttact

SEQ ID NO: 622756 - DNA, 25 bp, Mus musculus
ggctggttcagaccccaaattctta

SEQ ID NO: 622757 - DNA, 25 bp, Mus musculus
ggctggttcagagcccaaattctta

SEQ ID NO: 622758 - DNA, 25 bp, Mus musculus
ggctggttcattaggttgacactga

SEQ ID NO: 622759 - DNA, 25 bp, Mus musculus
ggctggttcatttggttgacactga

SEQ ID NO: 622760 - DNA, 25 bp, Mus musculus
ggctggttccttctgacagatgtct

SEQ ID NO: 622761 - DNA, 25 bp, Mus musculus
ggctggttccttgtgacagatgtct

SEQ ID NO: 622762 - DNA, 25 bp, Mus musculus
ggctggttgccacatattctcaatg

SEQ ID NO: 622763 - DNA, 25 bp, Mus musculus
ggctggttgccagatattctcaatg

SEQ ID NO: 622764 - DNA, 25 bp, Mus musculus
ggctggttggacaggtttgaatcaa

SEQ ID NO: 622765 - DNA, 25 bp, Mus musculus
ggctggttggactggtttgaatcaa

SEQ ID NO: 622766 - DNA, 25 bp, Mus musculus
ggctggtttcttcaacatgcgttcc

SEQ ID NO: 622767 - DNA, 25 bp, Mus musculus
ggctggtttcttgaacatgcgttcc

SEQ ID NO: 622768 - DNA, 25 bp, Mus musculus
ggctgtaaagcacttcatagatgta

SEQ ID NO: 622769 - DNA, 25 bp, Mus musculus
ggctgtaaagcagttcatagatgta

SEQ ID NO: 622770 - DNA, 25 bp, Mus musculus
ggctgtaaagccaactagcaggaat

SEQ ID NO: 622771 - DNA, 25 bp, Mus musculus
ggctgtaaagcctactagcaggaat

SEQ ID NO: 622772 - DNA, 25 bp, Mus musculus
ggctgtaaaggtctagcagtttcct

SEQ ID NO: 622773 - DNA, 25 bp, Mus musculus
ggctgtaaaggtgtagcagtttcct

SEQ ID NO: 622774 - DNA, 25 bp, Mus musculus
ggctgtaaatgaagtacacgctgta

SEQ ID NO: 622775 - DNA, 25 bp, Mus musculus
ggctgtaaatgatgtacacgctgta

SEQ ID NO: 622776 - DNA, 25 bp, Mus musculus
ggctgtaacctgacctttgatgtaa

SEQ ID NO: 622777 - DNA, 25 bp, Mus musculus
ggctgtaacctgattgtaacctcct

SEQ ID NO: 622778 - DNA, 25 bp, Mus musculus
ggctgtaacctgtcctttgatgtaa

SEQ ID NO: 622779 - DNA, 25 bp, Mus musculus
ggctgtaacctgtttgtaacctcct

SEQ ID NO: 622780 - DNA, 25 bp, Mus musculus
ggctgtaactctcctcttaaactag

SEQ ID NO: 622781 - DNA, 25 bp, Mus musculus
ggctgtaactctgctcttaaactag

SEQ ID NO: 622782 - DNA, 25 bp, Mus musculus
ggctgtaagactccgtaaagagaac

SEQ ID NO: 622783 - DNA, 25 bp, Mus musculus
ggctgtaagactgcgtaaagagaac

SEQ ID NO: 622784 - DNA, 25 bp, Mus musculus
ggctgtaagctgagacccctgggat

SEQ ID NO: 622785 - DNA, 25 bp, Mus musculus
ggctgtaagctgtgacccctgggat

SEQ ID NO: 622786 - DNA, 25 bp, Mus musculus
ggctgtaatacacctgactctgtac

SEQ ID NO: 622787 - DNA, 25 bp, Mus musculus
ggctgtaatacagctgactctgtac

SEQ ID NO: 622788 - DNA, 25 bp, Mus musculus
ggctgtaatacccacagattatgct

SEQ ID NO: 622789 - DNA, 25 bp, Mus musculus
ggctgtaataccgacagattatgct

SEQ ID NO: 622790 - DNA, 25 bp, Mus musculus
ggctgtaatatcagaactcctggag

SEQ ID NO: 622791 - DNA, 25 bp, Mus musculus
ggctgtaatatctgaactcctggag

SEQ ID NO: 622792 - DNA, 25 bp, Mus musculus
ggctgtaatgacctgcccaacaatc

SEQ ID NO: 622793 - DNA, 25 bp, Mus musculus
ggctgtaatgacgtgcccaacaatc

SEQ ID NO: 622794 - DNA, 25 bp, Mus musculus
ggctgtaattaacatccactcctgg

SEQ ID NO: 622795 - DNA, 25 bp, Mus musculus
ggctgtaattaagatccactcctgg

SEQ ID NO: 622796 - DNA, 25 bp, Mus musculus
ggctgtacagagactctattttaat

SEQ ID NO: 622797 - DNA, 25 bp, Mus musculus
ggctgtacagagtctctattttaat

SEQ ID NO: 622798 - DNA, 25 bp, Mus musculus
ggctgtacagggagccagatagatt

SEQ ID NO: 622799 - DNA, 25 bp, Mus musculus
ggctgtacagggtgccagatagatt

SEQ ID NO: 622800 - DNA, 25 bp, Mus musculus
ggctgtacagtaagacgcggtctca

SEQ ID NO: 622801 - DNA, 25 bp, Mus musculus
ggctgtacagtatgacgcggtctca

SEQ ID NO: 622802 - DNA, 25 bp, Mus musculus
ggctgtacatcaatgactcctggac

SEQ ID NO: 622803 - DNA, 25 bp, Mus musculus
ggctgtacatcattgactcctggac

SEQ ID NO: 622804 - DNA, 25 bp, Mus musculus
ggctgtaccacgctcttggcaagac

SEQ ID NO: 622805 - DNA, 25 bp, Mus musculus
ggctgtaccacggtcttggcaagac

SEQ ID NO: 622806 - DNA, 25 bp, Mus musculus
ggctgtacccaaatagaacgtcatt

SEQ ID NO: 622807 - DNA, 25 bp, Mus musculus
ggctgtacccaacaacaaggctgtc

SEQ ID NO: 622808 - DNA, 25 bp, Mus musculus
ggctgtacccaagaacaaggctgtc

SEQ ID NO: 622809 - DNA, 25 bp, Mus musculus
ggctgtacccaattagaacgtcatt

SEQ ID NO: 622810 - DNA, 25 bp, Mus musculus
ggctgtacctgtccaaatgtgcagt

SEQ ID NO: 622811 - DNA, 25 bp, Mus musculus
ggctgtacctgtgcaaatgtgcagt

SEQ ID NO: 622812 - DNA, 25 bp, Mus musculus
ggctgtaccttcacatatgatggag

SEQ ID NO: 622813 - DNA, 25 bp, Mus musculus
ggctgtaccttctcatatgatggag

SEQ ID NO: 622814 - DNA, 25 bp, Mus musculus
ggctgtacgactccatgaagggcaa

SEQ ID NO: 622815 - DNA, 25 bp, Mus musculus
ggctgtacgactgcatgaagggcaa

SEQ ID NO: 622816 - DNA, 25 bp, Mus musculus
ggctgtacgtttccattgattttca

SEQ ID NO: 622817 - DNA, 25 bp, Mus musculus
ggctgtacgtttgcattgattttca

SEQ ID NO: 622818 - DNA, 25 bp, Mus musculus
ggctgtactaaaattcatcaatcta

SEQ ID NO: 622819 - DNA, 25 bp, Mus musculus
ggctgtactaaatttcatcaatcta

SEQ ID NO: 622820 - DNA, 25 bp, Mus musculus
ggctgtactgacctgggagtttcaa

SEQ ID NO: 622821 - DNA, 25 bp, Mus musculus
ggctgtactgacgtgggagtttcaa

SEQ ID NO: 622822 - DNA, 25 bp, Mus musculus
ggctgtactgagctagtctaacctc

SEQ ID NO: 622823 - DNA, 25 bp, Mus musculus
ggctgtactgaggtagtctaacctc

SEQ ID NO: 622824 - DNA, 25 bp, Mus musculus
ggctgtactgtgagacatcctgcaa

SEQ ID NO: 622825 - DNA, 25 bp, Mus musculus
ggctgtactgtgtgacatcctgcaa

SEQ ID NO: 622826 - DNA, 25 bp, Mus musculus
ggctgtagatccaacacaacgcttg

SEQ ID NO: 622827 - DNA, 25 bp, Mus musculus
ggctgtagatcctacacaacgcttg

SEQ ID NO: 622828 - DNA, 25 bp, Mus musculus
ggctgtagatgtcttagttctcaca

SEQ ID NO: 622829 - DNA, 25 bp, Mus musculus
ggctgtagatgtgttagttctcaca

SEQ ID NO: 622830 - DNA, 25 bp, Mus musculus
ggctgtagcacaccaacccgtgaaa

SEQ ID NO: 622831 - DNA, 25 bp, Mus musculus
ggctgtagcacagcaacccgtgaaa

SEQ ID NO: 622832 - DNA, 25 bp, Mus musculus
ggctgtagcaggcaccatcatcttg

SEQ ID NO: 622833 - DNA, 25 bp, Mus musculus
ggctgtagcagggaccatcatcttg

SEQ ID NO: 622834 - DNA, 25 bp, Mus musculus
ggctgtagcgcaaccattccttcag

SEQ ID NO: 622835 - DNA, 25 bp, Mus musculus
ggctgtagcgcatccattccttcag

SEQ ID NO: 622836 - DNA, 25 bp, Mus musculus
ggctgtagctcaccatttttactgt

SEQ ID NO: 622837 - DNA, 25 bp, Mus musculus
ggctgtagctcagcatttttactgt

SEQ ID NO: 622838 - DNA, 25 bp, Mus musculus
ggctgtagctgactgctggagttct

SEQ ID NO: 622839 - DNA, 25 bp, Mus musculus
ggctgtagctgagtgctggagttct

SEQ ID NO: 622840 - DNA, 25 bp, Mus musculus
ggctgtagctgcaccagactcagaa

SEQ ID NO: 622841 - DNA, 25 bp, Mus musculus
ggctgtagctgctccagactcagaa

SEQ ID NO: 622842 - DNA, 25 bp, Mus musculus
ggctgtagcttcctgaccagagcat

SEQ ID NO: 622843 - DNA, 25 bp, Mus musculus
ggctgtagcttcgtgaccagagcat

SEQ ID NO: 622844 - DNA, 25 bp, Mus musculus
ggctgtaggagaacacgctaggcaa

SEQ ID NO: 622845 - DNA, 25 bp, Mus musculus
ggctgtaggagatcacgctaggcaa

SEQ ID NO: 622846 - DNA, 25 bp, Mus musculus
ggctgtaggcagatttattcatcaa

SEQ ID NO: 622847 - DNA, 25 bp, Mus musculus
ggctgtaggcagttttattcatcaa

SEQ ID NO: 622848 - DNA, 25 bp, Mus musculus
ggctgtagtaaactggtgtccttgt

SEQ ID NO: 622849 - DNA, 25 bp, Mus musculus
ggctgtagtaaagtggtgtccttgt

SEQ ID NO: 622850 - DNA, 25 bp, Mus musculus
ggctgtagtactagagcaagctgga

SEQ ID NO: 622851 - DNA, 25 bp, Mus musculus
ggctgtagtacttgagcaagctgga

SEQ ID NO: 622852 - DNA, 25 bp, Mus musculus
ggctgtagtccaacctactgaagaa

SEQ ID NO: 622853 - DNA, 25 bp, Mus musculus
ggctgtagtccatcctactgaagaa

SEQ ID NO: 622854 - DNA, 25 bp, Mus musculus
ggctgtagttggctaacactagttc

SEQ ID NO: 622855 - DNA, 25 bp, Mus musculus
ggctgtagttgggtaacactagttc

SEQ ID NO: 622856 - DNA, 25 bp, Mus musculus
ggctgtataagcatttcccagtata

SEQ ID NO: 622857 - DNA, 25 bp, Mus musculus
ggctgtataagcttttcccagtata

SEQ ID NO: 622858 - DNA, 25 bp, Mus musculus
ggctgtataagtcagggttctctat

SEQ ID NO: 622859 - DNA, 25 bp, Mus musculus
ggctgtataagtgagggttctctat

SEQ ID NO: 622860 - DNA, 25 bp, Mus musculus
ggctgtataataataatctcccatc

SEQ ID NO: 622861 - DNA, 25 bp, Mus musculus
ggctgtataatattaatctcccatc

SEQ ID NO: 622862 - DNA, 25 bp, Mus musculus
ggctgtatagtgagaacgactgaga

SEQ ID NO: 622863 - DNA, 25 bp, Mus musculus
ggctgtatagtgtgaacgactgaga

SEQ ID NO: 622864 - DNA, 25 bp, Mus musculus
ggctgtatcaaaccatgcactgtga

SEQ ID NO: 622865 - DNA, 25 bp, Mus musculus
ggctgtatcaaagcatgcactgtga

SEQ ID NO: 622866 - DNA, 25 bp, Mus musculus
ggctgtatcagaagccttccagaag

SEQ ID NO: 622867 - DNA, 25 bp, Mus musculus
ggctgtatcagatgccttccagaag

SEQ ID NO: 622868 - DNA, 25 bp, Mus musculus
ggctgtatcatacaaacggcttcaa

SEQ ID NO: 622869 - DNA, 25 bp, Mus musculus
ggctgtatcatagaaacggcttcaa

SEQ ID NO: 622870 - DNA, 25 bp, Mus musculus
ggctgtatcctgagacttgggagac

SEQ ID NO: 622871 - DNA, 25 bp, Mus musculus
ggctgtatcctgtgacttgggagac

SEQ ID NO: 622872 - DNA, 25 bp, Mus musculus
ggctgtatcttacatttctgccaca

SEQ ID NO: 622873 - DNA, 25 bp, Mus musculus
ggctgtatcttagatttctgccaca

SEQ ID NO: 622874 - DNA, 25 bp, Mus musculus
ggctgtatgaaaataccctcctaaa

SEQ ID NO: 622875 - DNA, 25 bp, Mus musculus
ggctgtatgaaattaccctcctaaa

SEQ ID NO: 622876 - DNA, 25 bp, Mus musculus
ggctgtatggccaagctggaacagt

SEQ ID NO: 622877 - DNA, 25 bp, Mus musculus
ggctgtatggcctagctggaacagt

SEQ ID NO: 622878 - DNA, 25 bp, Mus musculus
ggctgtatgtgtaccaatctcaacc

SEQ ID NO: 622879 - DNA, 25 bp, Mus musculus
ggctgtatgtgttccaatctcaacc

SEQ ID NO: 622880 - DNA, 25 bp, Mus musculus
ggctgtattctaccgagacaccgtt

SEQ ID NO: 622881 - DNA, 25 bp, Mus musculus
ggctgtattctagcgagacaccgtt

SEQ ID NO: 622882 - DNA, 25 bp, Mus musculus
ggctgtattctgacctcaaactacg

SEQ ID NO: 622883 - DNA, 25 bp, Mus musculus
ggctgtattctgtcctcaaactacg

SEQ ID NO: 622884 - DNA, 25 bp, Mus musculus
ggctgtcaacacatcggtacatggt

SEQ ID NO: 622885 - DNA, 25 bp, Mus musculus
ggctgtcaacacttcggtacatggt

SEQ ID NO: 622886 - DNA, 25 bp, Mus musculus
ggctgtcaacccaagacttgagagt

SEQ ID NO: 622887 - DNA, 25 bp, Mus musculus
ggctgtcaacccaggattccagtgt

SEQ ID NO: 622888 - DNA, 25 bp, Mus musculus
ggctgtcaaccctagacttgagagt

SEQ ID NO: 622889 - DNA, 25 bp, Mus musculus
ggctgtcaaccctggattccagtgt

SEQ ID NO: 622890 - DNA, 25 bp, Mus musculus
ggctgtcaagctaacttctctagaa

SEQ ID NO: 622891 - DNA, 25 bp, Mus musculus
ggctgtcaagcttacttctctagaa

SEQ ID NO: 622892 - DNA, 25 bp, Mus musculus
ggctgtcaagtaatttcatgatatg

SEQ ID NO: 622893 - DNA, 25 bp, Mus musculus
ggctgtcaagtattttcatgatatg

SEQ ID NO: 622894 - DNA, 25 bp, Mus musculus
ggctgtcacagcaggcgtcacacta

SEQ ID NO: 622895 - DNA, 25 bp, Mus musculus
ggctgtcacagcattgctatatgga

SEQ ID NO: 622896 - DNA, 25 bp, Mus musculus
ggctgtcacagctggcgtcacacta

SEQ ID NO: 622897 - DNA, 25 bp, Mus musculus
ggctgtcacagctttgctatatgga

SEQ ID NO: 622898 - DNA, 25 bp, Mus musculus
ggctgtcacagtactcagtgactga

SEQ ID NO: 622899 - DNA, 25 bp, Mus musculus
ggctgtcacagttctcagtgactga

SEQ ID NO: 622900 - DNA, 25 bp, Mus musculus
ggctgtcaccgcagttgctaagagc

SEQ ID NO: 622901 - DNA, 25 bp, Mus musculus
ggctgtcaccgctgttgctaagagc

SEQ ID NO: 622902 - DNA, 25 bp, Mus musculus
ggctgtcactatcgcccattacaaa

SEQ ID NO: 622903 - DNA, 25 bp, Mus musculus
ggctgtcactatggcccattacaaa

SEQ ID NO: 622904 - DNA, 25 bp, Mus musculus
ggctgtcactggcaagtgccatcca

SEQ ID NO: 622905 - DNA, 25 bp, Mus musculus
ggctgtcactgggaagtgccatcca

SEQ ID NO: 622906 - DNA, 25 bp, Mus musculus
ggctgtcagacactatctttgaatc

SEQ ID NO: 622907 - DNA, 25 bp, Mus musculus
ggctgtcagacagtatctttgaatc

SEQ ID NO: 622908 - DNA, 25 bp, Mus musculus
ggctgtcagactaccaagggatcca

SEQ ID NO: 622909 - DNA, 25 bp, Mus musculus
ggctgtcagacttccaagggatcca

SEQ ID NO: 622910 - DNA, 25 bp, Mus musculus
ggctgtcagctgagatctctaggag

SEQ ID NO: 622911 - DNA, 25 bp, Mus musculus
ggctgtcagctgatccaagcattga

SEQ ID NO: 622912 - DNA, 25 bp, Mus musculus
ggctgtcagctgtgatctctaggag

SEQ ID NO: 622913 - DNA, 25 bp, Mus musculus
ggctgtcagctgttccaagcattga

SEQ ID NO: 622914 - DNA, 25 bp, Mus musculus
ggctgtcagcttacctttattaaac

SEQ ID NO: 622915 - DNA, 25 bp, Mus musculus
ggctgtcagctttcctttattaaac

SEQ ID NO: 622916 - DNA, 25 bp, Mus musculus
ggctgtcagtggaattacacttcag

SEQ ID NO: 622917 - DNA, 25 bp, Mus musculus
ggctgtcagtggtattacacttcag

SEQ ID NO: 622918 - DNA, 25 bp, Mus musculus
ggctgtcagtttagaattcctccat

SEQ ID NO: 622919 - DNA, 25 bp, Mus musculus
ggctgtcagttttgaattcctccat

SEQ ID NO: 622920 - DNA, 25 bp, Mus musculus
ggctgtcatcgccactgaattgaag

SEQ ID NO: 622921 - DNA, 25 bp, Mus musculus
ggctgtcatcgcgactgaattgaag

SEQ ID NO: 622922 - DNA, 25 bp, Mus musculus
ggctgtcatgagcatcatgctattt

SEQ ID NO: 622923 - DNA, 25 bp, Mus musculus
ggctgtcatgaggatcatgctattt

SEQ ID NO: 622924 - DNA, 25 bp, Mus musculus
ggctgtcatgcaacttaatacatag

SEQ ID NO: 622925 - DNA, 25 bp, Mus musculus
ggctgtcatgcatcttaatacatag

SEQ ID NO: 622926 - DNA, 25 bp, Mus musculus
ggctgtcatgcgctgccttctagca

SEQ ID NO: 622927 - DNA, 25 bp, Mus musculus
ggctgtcatgcggtgccttctagca

SEQ ID NO: 622928 - DNA, 25 bp, Mus musculus
ggctgtcatggcagtagctgtcagc

SEQ ID NO: 622929 - DNA, 25 bp, Mus musculus
ggctgtcatggctgtagctgtcagc

SEQ ID NO: 622930 - DNA, 25 bp, Mus musculus
ggctgtcattctcgtgctcatgata

SEQ ID NO: 622931 - DNA, 25 bp, Mus musculus
ggctgtcattctggtgctcatgata

SEQ ID NO: 622932 - DNA, 25 bp, Mus musculus
ggctgtcatttcataaatggcagtt

SEQ ID NO: 622933 - DNA, 25 bp, Mus musculus
ggctgtcatttcttaaatggcagtt

SEQ ID NO: 622934 - DNA, 25 bp, Mus musculus
ggctgtcattttatgtatattacca

SEQ ID NO: 622935 - DNA, 25 bp, Mus musculus
ggctgtcattttttgtatattacca

SEQ ID NO: 622936 - DNA, 25 bp, Mus musculus
ggctgtccaaccacttgcttataga

SEQ ID NO: 622937 - DNA, 25 bp, Mus musculus
ggctgtccaacctcttgcttataga

SEQ ID NO: 622938 - DNA, 25 bp, Mus musculus
ggctgtccaagtctgaatatttcat

SEQ ID NO: 622939 - DNA, 25 bp, Mus musculus
ggctgtccaagtgtgaatatttcat

SEQ ID NO: 622940 - DNA, 25 bp, Mus musculus
ggctgtccacacaattgccagattg

SEQ ID NO: 622941 - DNA, 25 bp, Mus musculus
ggctgtccacactattgccagattg

SEQ ID NO: 622942 - DNA, 25 bp, Mus musculus
ggctgtccactaatgggacccgtga

SEQ ID NO: 622943 - DNA, 25 bp, Mus musculus
ggctgtccactattgggacccgtga

SEQ ID NO: 622944 - DNA, 25 bp, Mus musculus
ggctgtccagctactaatttctaaa

SEQ ID NO: 622945 - DNA, 25 bp, Mus musculus
ggctgtccagcttctaatttctaaa

SEQ ID NO: 622946 - DNA, 25 bp, Mus musculus
ggctgtccagggagtagtaagtcct

SEQ ID NO: 622947 - DNA, 25 bp, Mus musculus
ggctgtccagggtgtagtaagtcct

SEQ ID NO: 622948 - DNA, 25 bp, Mus musculus
ggctgtccagtgaccggagattgca

SEQ ID NO: 622949 - DNA, 25 bp, Mus musculus
ggctgtccagtgtccggagattgca

SEQ ID NO: 622950 - DNA, 25 bp, Mus musculus
ggctgtccattcactagatacattg

SEQ ID NO: 622951 - DNA, 25 bp, Mus musculus
ggctgtccattctctagatacattg

SEQ ID NO: 622952 - DNA, 25 bp, Mus musculus
ggctgtccatttacccgaaaacatt

SEQ ID NO: 622953 - DNA, 25 bp, Mus musculus
ggctgtccattttcccgaaaacatt

SEQ ID NO: 622954 - DNA, 25 bp, Mus musculus
ggctgtccccatctcataactgaag

SEQ ID NO: 622955 - DNA, 25 bp, Mus musculus
ggctgtccccatgtcataactgaag

SEQ ID NO: 622956 - DNA, 25 bp, Mus musculus
ggctgtcccgaacacctcaaaggat

SEQ ID NO: 622957 - DNA, 25 bp, Mus musculus
ggctgtcccgaagacctcaaaggat

SEQ ID NO: 622958 - DNA, 25 bp, Mus musculus
ggctgtcccttaaacttggtggaga

SEQ ID NO: 622959 - DNA, 25 bp, Mus musculus
ggctgtcccttatacttggtggaga

SEQ ID NO: 622960 - DNA, 25 bp, Mus musculus
ggctgtccggaaccagaaactatct

SEQ ID NO: 622961 - DNA, 25 bp, Mus musculus
ggctgtccggaagcagaaactatct

SEQ ID NO: 622962 - DNA, 25 bp, Mus musculus
ggctgtcctagcactgtactgtaag

SEQ ID NO: 622963 - DNA, 25 bp, Mus musculus
ggctgtcctagctctgtactgtaag

SEQ ID NO: 622964 - DNA, 25 bp, Mus musculus
ggctgtcctatgctatcctcagtgt

SEQ ID NO: 622965 - DNA, 25 bp, Mus musculus
ggctgtcctatggtatcctcagtgt

SEQ ID NO: 622966 - DNA, 25 bp, Mus musculus
ggctgtcctccaaatagattttcct

SEQ ID NO: 622967 - DNA, 25 bp, Mus musculus
ggctgtcctccatatagattttcct

SEQ ID NO: 622968 - DNA, 25 bp, Mus musculus
ggctgtcctctgagatgtatgacag

SEQ ID NO: 622969 - DNA, 25 bp, Mus musculus
ggctgtcctctgtgatgtatgacag

SEQ ID NO: 622970 - DNA, 25 bp, Mus musculus
ggctgtcctgagacgtattgttcca

SEQ ID NO: 622971 - DNA, 25 bp, Mus musculus
ggctgtcctgagtcgtattgttcca

SEQ ID NO: 622972 - DNA, 25 bp, Mus musculus
ggctgtcctggacaacagaatcatc

SEQ ID NO: 622973 - DNA, 25 bp, Mus musculus
ggctgtcctggagaacagaatcatc

SEQ ID NO: 622974 - DNA, 25 bp, Mus musculus
ggctgtcctggtctagagatctgcc

SEQ ID NO: 622975 - DNA, 25 bp, Mus musculus
ggctgtcctggtgtagagatctgcc

SEQ ID NO: 622976 - DNA, 25 bp, Mus musculus
ggctgtcgggacatactttctacat

SEQ ID NO: 622977 - DNA, 25 bp, Mus musculus
ggctgtcgggacttactttctacat

SEQ ID NO: 622978 - DNA, 25 bp, Mus musculus
ggctgtcgtggtaaagttcactcca

SEQ ID NO: 622979 - DNA, 25 bp, Mus musculus
ggctgtcgtggttaagttcactcca

SEQ ID NO: 622980 - DNA, 25 bp, Mus musculus
ggctgtctcaacactagaatgtcaa

SEQ ID NO: 622981 - DNA, 25 bp, Mus musculus
ggctgtctcaactctagaatgtcaa

SEQ ID NO: 622982 - DNA, 25 bp, Mus musculus
ggctgtctccagagttagaccgtgg

SEQ ID NO: 622983 - DNA, 25 bp, Mus musculus
ggctgtctccagcaggcccgagaac

SEQ ID NO: 622984 - DNA, 25 bp, Mus musculus
ggctgtctccaggaggcccgagaac

SEQ ID NO: 622985 - DNA, 25 bp, Mus musculus
ggctgtctccagtgttagaccgtgg

SEQ ID NO: 622986 - DNA, 25 bp, Mus musculus
ggctgtctctaaaatggaacttcct

SEQ ID NO: 622987 - DNA, 25 bp, Mus musculus
ggctgtctctaatatggaacttcct

SEQ ID NO: 622988 - DNA, 25 bp, Mus musculus
ggctgtctctagaacacatcttatg

SEQ ID NO: 622989 - DNA, 25 bp, Mus musculus
ggctgtctctagtacacatcttatg

SEQ ID NO: 622990 - DNA, 25 bp, Mus musculus
ggctgtctgaataaagtccatctta

SEQ ID NO: 622991 - DNA, 25 bp, Mus musculus
ggctgtctgaatccgtcctgctaat

SEQ ID NO: 622992 - DNA, 25 bp, Mus musculus
ggctgtctgaatgcgtcctgctaat

SEQ ID NO: 622993 - DNA, 25 bp, Mus musculus
ggctgtctgaattaagtccatctta

SEQ ID NO: 622994 - DNA, 25 bp, Mus musculus
ggctgtctgatcacctagaactgta

SEQ ID NO: 622995 - DNA, 25 bp, Mus musculus
ggctgtctgatctcctagaactgta

SEQ ID NO: 622996 - DNA, 25 bp, Mus musculus
ggctgtctgcagaactgctgttgta

SEQ ID NO: 622997 - DNA, 25 bp, Mus musculus
ggctgtctgcagtactgctgttgta

SEQ ID NO: 622998 - DNA, 25 bp, Mus musculus
ggctgtctgcctcaatgtagtcaca

SEQ ID NO: 622999 - DNA, 25 bp, Mus musculus
ggctgtctgcctgaatgtagtcaca

SEQ ID NO: 623000 - DNA, 25 bp, Mus musculus
ggctgtctgtgtatagcatggctct

SEQ ID NO: 623001 - DNA, 25 bp, Mus musculus
ggctgtctgtgtttagcatggctct

SEQ ID NO: 623002 - DNA, 25 bp, Mus musculus
ggctgtcttagcctctcaggtaatg

SEQ ID NO: 623003 - DNA, 25 bp, Mus musculus
ggctgtcttagcgtctcaggtaatg

SEQ ID NO: 623004 - DNA, 25 bp, Mus musculus
ggctgtcttattagttggttaccgt

SEQ ID NO: 623005 - DNA, 25 bp, Mus musculus
ggctgtcttatttgttggttaccgt

SEQ ID NO: 623006 - DNA, 25 bp, Mus musculus
ggctgtcttcaaatttgtgcccatc

SEQ ID NO: 623007 - DNA, 25 bp, Mus musculus
ggctgtcttcaattttgtgcccatc

SEQ ID NO: 623008 - DNA, 25 bp, Mus musculus
ggctgtcttcatcatgcaggacctg

SEQ ID NO: 623009 - DNA, 25 bp, Mus musculus
ggctgtcttcatgatgcaggacctg

SEQ ID NO: 623010 - DNA, 25 bp, Mus musculus
ggctgtcttctaattccaaagggtt

SEQ ID NO: 623011 - DNA, 25 bp, Mus musculus
ggctgtcttctatttccaaagggtt

SEQ ID NO: 623012 - DNA, 25 bp, Mus musculus
ggctgtcttcttctggacctacctc

SEQ ID NO: 623013 - DNA, 25 bp, Mus musculus
ggctgtcttcttgtggacctacctc

SEQ ID NO: 623014 - DNA, 25 bp, Mus musculus
ggctgtcttgaacgcagataagatc

SEQ ID NO: 623015 - DNA, 25 bp, Mus musculus
ggctgtcttgaaggcagataagatc

SEQ ID NO: 623016 - DNA, 25 bp, Mus musculus
ggctgtctttctcccagtccaattg

SEQ ID NO: 623017 - DNA, 25 bp, Mus musculus
ggctgtctttctgccagtccaattg

SEQ ID NO: 623018 - DNA, 25 bp, Mus musculus
ggctgtctttgcacttttgttcatg

SEQ ID NO: 623019 - DNA, 25 bp, Mus musculus
ggctgtctttgctcttttgttcatg

SEQ ID NO: 623020 - DNA, 25 bp, Mus musculus
ggctgtgaaaacaccctagtctttt

SEQ ID NO: 623021 - DNA, 25 bp, Mus musculus
ggctgtgaaaactccctagtctttt

SEQ ID NO: 623022 - DNA, 25 bp, Mus musculus
ggctgtgaaacactctttcctagaa

SEQ ID NO: 623023 - DNA, 25 bp, Mus musculus
ggctgtgaaacagtctttcctagaa

SEQ ID NO: 623024 - DNA, 25 bp, Mus musculus
ggctgtgaacacaaggtgacatcca

SEQ ID NO: 623025 - DNA, 25 bp, Mus musculus
ggctgtgaacactaggtgacatcca

SEQ ID NO: 623026 - DNA, 25 bp, Mus musculus
ggctgtgaactacagattctcctgc

SEQ ID NO: 623027 - DNA, 25 bp, Mus musculus
ggctgtgaactagagattctcctgc

SEQ ID NO: 623028 - DNA, 25 bp, Mus musculus
ggctgtgaactcagtccaatgtggc

SEQ ID NO: 623029 - DNA, 25 bp, Mus musculus
ggctgtgaactctgtccaatgtggc

SEQ ID NO: 623030 - DNA, 25 bp, Mus musculus
ggctgtgaacttcaatgaccactgc

SEQ ID NO: 623031 - DNA, 25 bp, Mus musculus
ggctgtgaacttgaatgaccactgc

SEQ ID NO: 623032 - DNA, 25 bp, Mus musculus
ggctgtgacccaacatatgagtctt

SEQ ID NO: 623033 - DNA, 25 bp, Mus musculus
ggctgtgacccatcatatgagtctt

SEQ ID NO: 623034 - DNA, 25 bp, Mus musculus
ggctgtgaccccaagctggaaaagt

SEQ ID NO: 623035 - DNA, 25 bp, Mus musculus
ggctgtgacccctagctggaaaagt

SEQ ID NO: 623036 - DNA, 25 bp, Mus musculus
ggctgtgaccgactaccaagattct

SEQ ID NO: 623037 - DNA, 25 bp, Mus musculus
ggctgtgaccgagtaccaagattct

SEQ ID NO: 623038 - DNA, 25 bp, Mus musculus
ggctgtgacctgcatttcccgattc

SEQ ID NO: 623039 - DNA, 25 bp, Mus musculus
ggctgtgacctgcttttaagaatga

SEQ ID NO: 623040 - DNA, 25 bp, Mus musculus
ggctgtgacctggatttcccgattc

SEQ ID NO: 623041 - DNA, 25 bp, Mus musculus
ggctgtgacctggttttaagaatga

SEQ ID NO: 623042 - DNA, 25 bp, Mus musculus
ggctgtgacgtcatcgcccgcgtca

SEQ ID NO: 623043 - DNA, 25 bp, Mus musculus
ggctgtgacgtcttcgcccgcgtca

SEQ ID NO: 623044 - DNA, 25 bp, Mus musculus
ggctgtgactgacgaaactgctttc

SEQ ID NO: 623045 - DNA, 25 bp, Mus musculus
ggctgtgactgaggaaactgctttc

SEQ ID NO: 623046 - DNA, 25 bp, Mus musculus
ggctgtgacttgcaggatcccaccc

SEQ ID NO: 623047 - DNA, 25 bp, Mus musculus
ggctgtgacttggaggatcccaccc

SEQ ID NO: 623048 - DNA, 25 bp, Mus musculus
ggctgtgactttcatactctgctct

SEQ ID NO: 623049 - DNA, 25 bp, Mus musculus
ggctgtgactttccaattggtctat

SEQ ID NO: 623050 - DNA, 25 bp, Mus musculus
ggctgtgactttccagtttcaccaa

SEQ ID NO: 623051 - DNA, 25 bp, Mus musculus
ggctgtgactttgatactctgctct

SEQ ID NO: 623052 - DNA, 25 bp, Mus musculus
ggctgtgactttgcaattggtctat

SEQ ID NO: 623053 - DNA, 25 bp, Mus musculus
ggctgtgactttgcagtttcaccaa

SEQ ID NO: 623054 - DNA, 25 bp, Mus musculus
ggctgtgagcaaccaagtttccaaa

SEQ ID NO: 623055 - DNA, 25 bp, Mus musculus
ggctgtgagcaagcaagtttccaaa

SEQ ID NO: 623056 - DNA, 25 bp, Mus musculus
ggctgtgagccacctttgtaaagct

SEQ ID NO: 623057 - DNA, 25 bp, Mus musculus
ggctgtgagccagctttgtaaagct

SEQ ID NO: 623058 - DNA, 25 bp, Mus musculus
ggctgtgagcctatgcagaatttga

SEQ ID NO: 623059 - DNA, 25 bp, Mus musculus
ggctgtgagcctttgcagaatttga

SEQ ID NO: 623060 - DNA, 25 bp, Mus musculus
ggctgtgagctgaccaccctcctga

SEQ ID NO: 623061 - DNA, 25 bp, Mus musculus
ggctgtgagctgtccaccctcctga

SEQ ID NO: 623062 - DNA, 25 bp, Mus musculus
ggctgtgaggaccactacaactact

SEQ ID NO: 623063 - DNA, 25 bp, Mus musculus
ggctgtgaggaccatttttggcatt

SEQ ID NO: 623064 - DNA, 25 bp, Mus musculus
ggctgtgaggacgactacaactact

SEQ ID NO: 623065 - DNA, 25 bp, Mus musculus
ggctgtgaggacgatttttggcatt

SEQ ID NO: 623066 - DNA, 25 bp, Mus musculus
ggctgtgaggccaggttctcagact

SEQ ID NO: 623067 - DNA, 25 bp, Mus musculus
ggctgtgaggcctggttctcagact

SEQ ID NO: 623068 - DNA, 25 bp, Mus musculus
ggctgtgaggctagatcccagtttc

SEQ ID NO: 623069 - DNA, 25 bp, Mus musculus
ggctgtgaggcttgatcccagtttc

SEQ ID NO: 623070 - DNA, 25 bp, Mus musculus
ggctgtgagggcagctactacgatt

SEQ ID NO: 623071 - DNA, 25 bp, Mus musculus
ggctgtgagggcatatttctctgct

SEQ ID NO: 623072 - DNA, 25 bp, Mus musculus
ggctgtgagggctgctactacgatt

SEQ ID NO: 623073 - DNA, 25 bp, Mus musculus
ggctgtgagggcttatttctctgct

SEQ ID NO: 623074 - DNA, 25 bp, Mus musculus
ggctgtgaggtcatctcaggatgat

SEQ ID NO: 623075 - DNA, 25 bp, Mus musculus
ggctgtgaggtcttctcaggatgat

SEQ ID NO: 623076 - DNA, 25 bp, Mus musculus
ggctgtgagtccaggattcagagtt

SEQ ID NO: 623077 - DNA, 25 bp, Mus musculus
ggctgtgagtcctggattcagagtt

SEQ ID NO: 623078 - DNA, 25 bp, Mus musculus
ggctgtgatatcagtatggcttctg

SEQ ID NO: 623079 - DNA, 25 bp, Mus musculus
ggctgtgatatctgtatggcttctg

SEQ ID NO: 623080 - DNA, 25 bp, Mus musculus
ggctgtgatctactgttttaacaaa

SEQ ID NO: 623081 - DNA, 25 bp, Mus musculus
ggctgtgatctagtgttttaacaaa

SEQ ID NO: 623082 - DNA, 25 bp, Mus musculus
ggctgtgatggaatttcacgtttct

SEQ ID NO: 623083 - DNA, 25 bp, Mus musculus
ggctgtgatggattttcacgtttct

SEQ ID NO: 623084 - DNA, 25 bp, Mus musculus
ggctgtgatgtaaccttcaatggac

SEQ ID NO: 623085 - DNA, 25 bp, Mus musculus
ggctgtgatgtatccttcaatggac

SEQ ID NO: 623086 - DNA, 25 bp, Mus musculus
ggctgtgattttaagctctttgctt

SEQ ID NO: 623087 - DNA, 25 bp, Mus musculus
ggctgtgatttttagctctttgctt

SEQ ID NO: 623088 - DNA, 25 bp, Mus musculus
ggctgtgcaagaagttctacgccat

SEQ ID NO: 623089 - DNA, 25 bp, Mus musculus
ggctgtgcaagatgttctacgccat

SEQ ID NO: 623090 - DNA, 25 bp, Mus musculus
ggctgtgcacacagactcctaaaat

SEQ ID NO: 623091 - DNA, 25 bp, Mus musculus
ggctgtgcacactgactcctaaaat

SEQ ID NO: 623092 - DNA, 25 bp, Mus musculus
ggctgtgcagtcactgtatgcacca

SEQ ID NO: 623093 - DNA, 25 bp, Mus musculus
ggctgtgcagtctctgtatgcacca

SEQ ID NO: 623094 - DNA, 25 bp, Mus musculus
ggctgtgcatgtactgtccatccat

SEQ ID NO: 623095 - DNA, 25 bp, Mus musculus
ggctgtgcatgttctgtccatccat

SEQ ID NO: 623096 - DNA, 25 bp, Mus musculus
ggctgtgccgagagttctgctgcta

SEQ ID NO: 623097 - DNA, 25 bp, Mus musculus
ggctgtgccgagtgttctgctgcta

SEQ ID NO: 623098 - DNA, 25 bp, Mus musculus
ggctgtgccggaactcactgtaaga

SEQ ID NO: 623099 - DNA, 25 bp, Mus musculus
ggctgtgccggatctcactgtaaga

SEQ ID NO: 623100 - DNA, 25 bp, Mus musculus
ggctgtgcctgcctaagctttggca

SEQ ID NO: 623101 - DNA, 25 bp, Mus musculus
ggctgtgcctgcgtaagctttggca

SEQ ID NO: 623102 - DNA, 25 bp, Mus musculus
ggctgtgccttgagtcctgtcctga

SEQ ID NO: 623103 - DNA, 25 bp, Mus musculus
ggctgtgccttgtgtcctgtcctga

SEQ ID NO: 623104 - DNA, 25 bp, Mus musculus
ggctgtgctaaccttcttaattttg

SEQ ID NO: 623105 - DNA, 25 bp, Mus musculus
ggctgtgctaacgttcttaattttg

SEQ ID NO: 623106 - DNA, 25 bp, Mus musculus
ggctgtgctctcacaggagacgaaa

SEQ ID NO: 623107 - DNA, 25 bp, Mus musculus
ggctgtgctctcagtattgtacatt

SEQ ID NO: 623108 - DNA, 25 bp, Mus musculus
ggctgtgctctctcaggagacgaaa

SEQ ID NO: 623109 - DNA, 25 bp, Mus musculus
ggctgtgctctctgtattgtacatt

SEQ ID NO: 623110 - DNA, 25 bp, Mus musculus
ggctgtgctgatccctggagacatc

SEQ ID NO: 623111 - DNA, 25 bp, Mus musculus
ggctgtgctgatgcctggagacatc

SEQ ID NO: 623112 - DNA, 25 bp, Mus musculus
ggctgtgcttaaaaggttgcatact

SEQ ID NO: 623113 - DNA, 25 bp, Mus musculus
ggctgtgcttaataggttgcatact

SEQ ID NO: 623114 - DNA, 25 bp, Mus musculus
ggctgtgcttacatgtagtttcctc

SEQ ID NO: 623115 - DNA, 25 bp, Mus musculus
ggctgtgcttacttgtagtttcctc

SEQ ID NO: 623116 - DNA, 25 bp, Mus musculus
ggctgtgcttataggtccctacaga

SEQ ID NO: 623117 - DNA, 25 bp, Mus musculus
ggctgtgcttattggtccctacaga

SEQ ID NO: 623118 - DNA, 25 bp, Mus musculus
ggctgtgcttcacatagtccaacaa

SEQ ID NO: 623119 - DNA, 25 bp, Mus musculus
ggctgtgcttcagatagtccaacaa

SEQ ID NO: 623120 - DNA, 25 bp, Mus musculus
ggctgtgctttgaagttggcgattc

SEQ ID NO: 623121 - DNA, 25 bp, Mus musculus
ggctgtgctttgtagttggcgattc

SEQ ID NO: 623122 - DNA, 25 bp, Mus musculus
ggctgtggacagaactctgctcaaa

SEQ ID NO: 623123 - DNA, 25 bp, Mus musculus
ggctgtggacagtactctgctcaaa

SEQ ID NO: 623124 - DNA, 25 bp, Mus musculus
ggctgtggactaaccttcgcatgaa

SEQ ID NO: 623125 - DNA, 25 bp, Mus musculus
ggctgtggactatccttcgcatgaa

SEQ ID NO: 623126 - DNA, 25 bp, Mus musculus
ggctgtggagcgaacccggaccatc

SEQ ID NO: 623127 - DNA, 25 bp, Mus musculus
ggctgtggagcgtacccggaccatc

SEQ ID NO: 623128 - DNA, 25 bp, Mus musculus
ggctgtggaggcatagctatcccta

SEQ ID NO: 623129 - DNA, 25 bp, Mus musculus
ggctgtggaggcttagctatcccta

SEQ ID NO: 623130 - DNA, 25 bp, Mus musculus
ggctgtggcaaaatacccacttctg

SEQ ID NO: 623131 - DNA, 25 bp, Mus musculus
ggctgtggcaaattacccacttctg

SEQ ID NO: 623132 - DNA, 25 bp, Mus musculus
ggctgtggcagtcgacctgttccca

SEQ ID NO: 623133 - DNA, 25 bp, Mus musculus
ggctgtggcagtggacctgttccca

SEQ ID NO: 623134 - DNA, 25 bp, Mus musculus
ggctgtggcatgacgttcacagata

SEQ ID NO: 623135 - DNA, 25 bp, Mus musculus
ggctgtggcatgtcgttcacagata

SEQ ID NO: 623136 - DNA, 25 bp, Mus musculus
ggctgtggccaaatgggtattttct

SEQ ID NO: 623137 - DNA, 25 bp, Mus musculus
ggctgtggccaattgggtattttct

SEQ ID NO: 623138 - DNA, 25 bp, Mus musculus
ggctgtggccatactttagttctgt

SEQ ID NO: 623139 - DNA, 25 bp, Mus musculus
ggctgtggccattctttagttctgt

SEQ ID NO: 623140 - DNA, 25 bp, Mus musculus
ggctgtggctatcgtagcacctact

SEQ ID NO: 623141 - DNA, 25 bp, Mus musculus
ggctgtggctatggtagcacctact

SEQ ID NO: 623142 - DNA, 25 bp, Mus musculus
ggctgtggcttgaacctttaactac

SEQ ID NO: 623143 - DNA, 25 bp, Mus musculus
ggctgtggcttgtacctttaactac

SEQ ID NO: 623144 - DNA, 25 bp, Mus musculus
ggctgtggctttaccattagtaaac

SEQ ID NO: 623145 - DNA, 25 bp, Mus musculus
ggctgtggctttcatgcctgaagat

SEQ ID NO: 623146 - DNA, 25 bp, Mus musculus
ggctgtggctttgatgcctgaagat

SEQ ID NO: 623147 - DNA, 25 bp, Mus musculus
ggctgtggcttttccattagtaaac

SEQ ID NO: 623148 - DNA, 25 bp, Mus musculus
ggctgtgggatgagttttgtcccac

SEQ ID NO: 623149 - DNA, 25 bp, Mus musculus
ggctgtgggatgtgttttgtcccac

SEQ ID NO: 623150 - DNA, 25 bp, Mus musculus
ggctgtgggcctcctcatcgcctaa

SEQ ID NO: 623151 - DNA, 25 bp, Mus musculus
ggctgtgggcctgctcatcgcctaa

SEQ ID NO: 623152 - DNA, 25 bp, Mus musculus
ggctgtgggcttccccatgatgatt

SEQ ID NO: 623153 - DNA, 25 bp, Mus musculus
ggctgtgggcttgcccatgatgatt

SEQ ID NO: 623154 - DNA, 25 bp, Mus musculus
ggctgtggtaatcaagcctcatttt

SEQ ID NO: 623155 - DNA, 25 bp, Mus musculus
ggctgtggtaatgaagcctcatttt

SEQ ID NO: 623156 - DNA, 25 bp, Mus musculus
ggctgtggtatcatcgatgctcacc

SEQ ID NO: 623157 - DNA, 25 bp, Mus musculus
ggctgtggtatcttcgatgctcacc

SEQ ID NO: 623158 - DNA, 25 bp, Mus musculus
ggctgtggtctccagcaatcccggc

SEQ ID NO: 623159 - DNA, 25 bp, Mus musculus
ggctgtggtctcgagcaatcccggc

SEQ ID NO: 623160 - DNA, 25 bp, Mus musculus
ggctgtggtgatagatccctttaat

SEQ ID NO: 623161 - DNA, 25 bp, Mus musculus
ggctgtggtgatcctagttctttac

SEQ ID NO: 623162 - DNA, 25 bp, Mus musculus
ggctgtggtgatgctagttctttac

SEQ ID NO: 623163 - DNA, 25 bp, Mus musculus
ggctgtggtgattgatccctttaat

SEQ ID NO: 623164 - DNA, 25 bp, Mus musculus
ggctgtggttcaaacttgccaggat

SEQ ID NO: 623165 - DNA, 25 bp, Mus musculus
ggctgtggttcatacttgccaggat

SEQ ID NO: 623166 - DNA, 25 bp, Mus musculus
ggctgtggttccatagtagatacct

SEQ ID NO: 623167 - DNA, 25 bp, Mus musculus
ggctgtggttccttagtagatacct

SEQ ID NO: 623168 - DNA, 25 bp, Mus musculus
ggctgtggttgtatacctctatact

SEQ ID NO: 623169 - DNA, 25 bp, Mus musculus
ggctgtggttgtttacctctatact

SEQ ID NO: 623170 - DNA, 25 bp, Mus musculus
ggctgtggtttccatgtttactcta

SEQ ID NO: 623171 - DNA, 25 bp, Mus musculus
ggctgtggtttcgatgtttactcta

SEQ ID NO: 623172 - DNA, 25 bp, Mus musculus
ggctgtggttttaatttctgccatt

SEQ ID NO: 623173 - DNA, 25 bp, Mus musculus
ggctgtggtttttatttctgccatt

SEQ ID NO: 623174 - DNA, 25 bp, Mus musculus
ggctgtgtaataccctgatccctga

SEQ ID NO: 623175 - DNA, 25 bp, Mus musculus
ggctgtgtaatagcctgatccctga

SEQ ID NO: 623176 - DNA, 25 bp, Mus musculus
ggctgtgtactgagtacccacctgg

SEQ ID NO: 623177 - DNA, 25 bp, Mus musculus
ggctgtgtactgtgtacccacctgg

SEQ ID NO: 623178 - DNA, 25 bp, Mus musculus
ggctgtgtagacaccagcgttgtcc

SEQ ID NO: 623179 - DNA, 25 bp, Mus musculus
ggctgtgtagactccagcgttgtcc

SEQ ID NO: 623180 - DNA, 25 bp, Mus musculus
ggctgtgtatataactgctgtgtag

SEQ ID NO: 623181 - DNA, 25 bp, Mus musculus
ggctgtgtatattactgctgtgtag

SEQ ID NO: 623182 - DNA, 25 bp, Mus musculus
ggctgtgtatcgctgtaattatcca

SEQ ID NO: 623183 - DNA, 25 bp, Mus musculus
ggctgtgtatcggtgtaattatcca

SEQ ID NO: 623184 - DNA, 25 bp, Mus musculus
ggctgtgtattcaaccaaaagagag

SEQ ID NO: 623185 - DNA, 25 bp, Mus musculus
ggctgtgtattctaccaaaagagag

SEQ ID NO: 623186 - DNA, 25 bp, Mus musculus
ggctgtgtcatacatcagtacccta

SEQ ID NO: 623187 - DNA, 25 bp, Mus musculus
ggctgtgtcatagatcagtacccta

SEQ ID NO: 623188 - DNA, 25 bp, Mus musculus
ggctgtgtccaaagtgacctaaaat

SEQ ID NO: 623189 - DNA, 25 bp, Mus musculus
ggctgtgtccaatgtgacctaaaat

SEQ ID NO: 623190 - DNA, 25 bp, Mus musculus
ggctgtgtgacacaggaacaccgta

SEQ ID NO: 623191 - DNA, 25 bp, Mus musculus
ggctgtgtgacagaggaacaccgta

SEQ ID NO: 623192 - DNA, 25 bp, Mus musculus
ggctgtgtgatgcaaggatcttcca

SEQ ID NO: 623193 - DNA, 25 bp, Mus musculus
ggctgtgtgatggaaggatcttcca

SEQ ID NO: 623194 - DNA, 25 bp, Mus musculus
ggctgtgtgattcttgacaaactgt

SEQ ID NO: 623195 - DNA, 25 bp, Mus musculus
ggctgtgtgattgttgacaaactgt

SEQ ID NO: 623196 - DNA, 25 bp, Mus musculus
ggctgtgtggccactggatttttaa

SEQ ID NO: 623197 - DNA, 25 bp, Mus musculus
ggctgtgtggcctctggatttttaa

SEQ ID NO: 623198 - DNA, 25 bp, Mus musculus
ggctgtgtggttaaagtactcttct

SEQ ID NO: 623199 - DNA, 25 bp, Mus musculus
ggctgtgtggtttaagtactcttct

SEQ ID NO: 623200 - DNA, 25 bp, Mus musculus
ggctgtgtgtctagaactcatggtc

SEQ ID NO: 623201 - DNA, 25 bp, Mus musculus
ggctgtgtgtcttgaactcatggtc

SEQ ID NO: 623202 - DNA, 25 bp, Mus musculus
ggctgtgtgttaactcagtgtttct

SEQ ID NO: 623203 - DNA, 25 bp, Mus musculus
ggctgtgtgttatctcagtgtttct

SEQ ID NO: 623204 - DNA, 25 bp, Mus musculus
ggctgtgttaaccaaagcaaatgtg

SEQ ID NO: 623205 - DNA, 25 bp, Mus musculus
ggctgtgttaacgaaagcaaatgtg

SEQ ID NO: 623206 - DNA, 25 bp, Mus musculus
ggctgtgttacactactgtttctaa

SEQ ID NO: 623207 - DNA, 25 bp, Mus musculus
ggctgtgttacagtactgtttctaa

SEQ ID NO: 623208 - DNA, 25 bp, Mus musculus
ggctgtgttactaaccatgttttca

SEQ ID NO: 623209 - DNA, 25 bp, Mus musculus
ggctgtgttacttaccatgttttca

SEQ ID NO: 623210 - DNA, 25 bp, Mus musculus
ggctgtgttcagaagcatcctgcag

SEQ ID NO: 623211 - DNA, 25 bp, Mus musculus
ggctgtgttcagtagcatcctgcag

SEQ ID NO: 623212 - DNA, 25 bp, Mus musculus
ggctgtgttcatactcacatcgcag

SEQ ID NO: 623213 - DNA, 25 bp, Mus musculus
ggctgtgttcattctcacatcgcag

SEQ ID NO: 623214 - DNA, 25 bp, Mus musculus
ggctgtgttctaatctatggtgtca

SEQ ID NO: 623215 - DNA, 25 bp, Mus musculus
ggctgtgttctattctatggtgtca

SEQ ID NO: 623216 - DNA, 25 bp, Mus musculus
ggctgtgttctgcagtgagctaact

SEQ ID NO: 623217 - DNA, 25 bp, Mus musculus
ggctgtgttctggagtgagctaact

SEQ ID NO: 623218 - DNA, 25 bp, Mus musculus
ggctgtgtttgtcttctgtacagag

SEQ ID NO: 623219 - DNA, 25 bp, Mus musculus
ggctgtgtttgtgttctgtacagag

SEQ ID NO: 623220 - DNA, 25 bp, Mus musculus
ggctgttaaattaagcgagcacctt

SEQ ID NO: 623221 - DNA, 25 bp, Mus musculus
ggctgttaaatttagcgagcacctt

SEQ ID NO: 623222 - DNA, 25 bp, Mus musculus
ggctgttaacaaacccatgcagtat

SEQ ID NO: 623223 - DNA, 25 bp, Mus musculus
ggctgttaacaatcccatgcagtat

SEQ ID NO: 623224 - DNA, 25 bp, Mus musculus
ggctgttaatacacctcagagccat

SEQ ID NO: 623225 - DNA, 25 bp, Mus musculus
ggctgttaatactcctcagagccat

SEQ ID NO: 623226 - DNA, 25 bp, Mus musculus
ggctgttaattcaagttcctgactt

SEQ ID NO: 623227 - DNA, 25 bp, Mus musculus
ggctgttaattctagttcctgactt

SEQ ID NO: 623228 - DNA, 25 bp, Mus musculus
ggctgttaattgagttgtatatcta

SEQ ID NO: 623229 - DNA, 25 bp, Mus musculus
ggctgttaattgtgttgtatatcta

SEQ ID NO: 623230 - DNA, 25 bp, Mus musculus
ggctgttacaagcatggtgtgaatt

SEQ ID NO: 623231 - DNA, 25 bp, Mus musculus
ggctgttacaaggatggtgtgaatt

SEQ ID NO: 623232 - DNA, 25 bp, Mus musculus
ggctgttacacactcactcagatgc

SEQ ID NO: 623233 - DNA, 25 bp, Mus musculus
ggctgttacacagtcactcagatgc

SEQ ID NO: 623234 - DNA, 25 bp, Mus musculus
ggctgttacataaaagctgtgagca

SEQ ID NO: 623235 - DNA, 25 bp, Mus musculus
ggctgttacatataagctgtgagca

SEQ ID NO: 623236 - DNA, 25 bp, Mus musculus
ggctgttaccttcttatttcttatt

SEQ ID NO: 623237 - DNA, 25 bp, Mus musculus
ggctgttaccttgttatttcttatt

SEQ ID NO: 623238 - DNA, 25 bp, Mus musculus
ggctgttactccacaggaaaattct

SEQ ID NO: 623239 - DNA, 25 bp, Mus musculus
ggctgttactcctcaggaaaattct

SEQ ID NO: 623240 - DNA, 25 bp, Mus musculus
ggctgttagcttaatgggctgtgca

SEQ ID NO: 623241 - DNA, 25 bp, Mus musculus
ggctgttagctttatgggctgtgca

SEQ ID NO: 623242 - DNA, 25 bp, Mus musculus
ggctgttattcaagcaccatgtgaa

SEQ ID NO: 623243 - DNA, 25 bp, Mus musculus
ggctgttattcatgcaccatgtgaa

SEQ ID NO: 623244 - DNA, 25 bp, Mus musculus
ggctgttattttactggcattacta

SEQ ID NO: 623245 - DNA, 25 bp, Mus musculus
ggctgttatttttctggcattacta

SEQ ID NO: 623246 - DNA, 25 bp, Mus musculus
ggctgttcagctatactgatccaaa

SEQ ID NO: 623247 - DNA, 25 bp, Mus musculus
ggctgttcagctttactgatccaaa

SEQ ID NO: 623248 - DNA, 25 bp, Mus musculus
ggctgttccagacctgtgatactgt

SEQ ID NO: 623249 - DNA, 25 bp, Mus musculus
ggctgttccagacgctttatttcta

SEQ ID NO: 623250 - DNA, 25 bp, Mus musculus
ggctgttccagagctgtgatactgt

SEQ ID NO: 623251 - DNA, 25 bp, Mus musculus
ggctgttccagaggctttatttcta

SEQ ID NO: 623252 - DNA, 25 bp, Mus musculus
ggctgttcctcaacccgtacatctt

SEQ ID NO: 623253 - DNA, 25 bp, Mus musculus
ggctgttcctcatcccgtacatctt

SEQ ID NO: 623254 - DNA, 25 bp, Mus musculus
ggctgttcctgaactagctctgtag

SEQ ID NO: 623255 - DNA, 25 bp, Mus musculus
ggctgttcctgatctagctctgtag

SEQ ID NO: 623256 - DNA, 25 bp, Mus musculus
ggctgttcctggcaagaagcacttg

SEQ ID NO: 623257 - DNA, 25 bp, Mus musculus
ggctgttcctgggaagaagcacttg

SEQ ID NO: 623258 - DNA, 25 bp, Mus musculus
ggctgttcgctactggctgataata

SEQ ID NO: 623259 - DNA, 25 bp, Mus musculus
ggctgttcgctagtggctgataata

SEQ ID NO: 623260 - DNA, 25 bp, Mus musculus
ggctgttcggccctggaaaacatta

SEQ ID NO: 623261 - DNA, 25 bp, Mus musculus
ggctgttcggccgtggaaaacatta

SEQ ID NO: 623262 - DNA, 25 bp, Mus musculus
ggctgttcggttacctgataaaaat

SEQ ID NO: 623263 - DNA, 25 bp, Mus musculus
ggctgttcggtttcctgataaaaat

SEQ ID NO: 623264 - DNA, 25 bp, Mus musculus
ggctgttctaggagcctcttgtctc

SEQ ID NO: 623265 - DNA, 25 bp, Mus musculus
ggctgttctaggtgcctcttgtctc

SEQ ID NO: 623266 - DNA, 25 bp, Mus musculus
ggctgttctccgaccaatggaaatt

SEQ ID NO: 623267 - DNA, 25 bp, Mus musculus
ggctgttctccgtccaatggaaatt

SEQ ID NO: 623268 - DNA, 25 bp, Mus musculus
ggctgttctgaaaccctagagatct

SEQ ID NO: 623269 - DNA, 25 bp, Mus musculus
ggctgttctgaatccctagagatct

SEQ ID NO: 623270 - DNA, 25 bp, Mus musculus
ggctgttctgatcctctataaaaca

SEQ ID NO: 623271 - DNA, 25 bp, Mus musculus
ggctgttctgatgctctataaaaca

SEQ ID NO: 623272 - DNA, 25 bp, Mus musculus
ggctgttctgtgctttgctgactgt

SEQ ID NO: 623273 - DNA, 25 bp, Mus musculus
ggctgttctgtggtttgctgactgt

SEQ ID NO: 623274 - DNA, 25 bp, Mus musculus
ggctgttcttgtagatagaccttca

SEQ ID NO: 623275 - DNA, 25 bp, Mus musculus
ggctgttcttgttgatagaccttca

SEQ ID NO: 623276 - DNA, 25 bp, Mus musculus
ggctgttgatgcatattctctgtaa

SEQ ID NO: 623277 - DNA, 25 bp, Mus musculus
ggctgttgatgcttattctctgtaa

SEQ ID NO: 623278 - DNA, 25 bp, Mus musculus
ggctgttgcaaaacttctgccacta

SEQ ID NO: 623279 - DNA, 25 bp, Mus musculus
ggctgttgcaaatcttctgccacta

SEQ ID NO: 623280 - DNA, 25 bp, Mus musculus
ggctgttgcagcagatccttcggaa

SEQ ID NO: 623281 - DNA, 25 bp, Mus musculus
ggctgttgcagctgatccttcggaa

SEQ ID NO: 623282 - DNA, 25 bp, Mus musculus
ggctgttgctctcatatggctgtta

SEQ ID NO: 623283 - DNA, 25 bp, Mus musculus
ggctgttgctctgatatggctgtta

SEQ ID NO: 623284 - DNA, 25 bp, Mus musculus
ggctgttgcttgcaggtgcccacca

SEQ ID NO: 623285 - DNA, 25 bp, Mus musculus
ggctgttgcttggaggtgcccacca

SEQ ID NO: 623286 - DNA, 25 bp, Mus musculus
ggctgttgctttcatagcatctcag

SEQ ID NO: 623287 - DNA, 25 bp, Mus musculus
ggctgttgctttgatagcatctcag

SEQ ID NO: 623288 - DNA, 25 bp, Mus musculus
ggctgttggacaccgagaccatgca

SEQ ID NO: 623289 - DNA, 25 bp, Mus musculus
ggctgttggacagcgagaccatgca

SEQ ID NO: 623290 - DNA, 25 bp, Mus musculus
ggctgttgtcatactcaattgctca

SEQ ID NO: 623291 - DNA, 25 bp, Mus musculus
ggctgttgtcattctcaattgctca

SEQ ID NO: 623292 - DNA, 25 bp, Mus musculus
ggctgttgtccccacaagagtagga

SEQ ID NO: 623293 - DNA, 25 bp, Mus musculus
ggctgttgtcccgacaagagtagga

SEQ ID NO: 623294 - DNA, 25 bp, Mus musculus
ggctgttgtcgcatatgttgttgca

SEQ ID NO: 623295 - DNA, 25 bp, Mus musculus
ggctgttgtcgcttatgttgttgca

SEQ ID NO: 623296 - DNA, 25 bp, Mus musculus
ggctgttgtctgagttagctgtcac

SEQ ID NO: 623297 - DNA, 25 bp, Mus musculus
ggctgttgtctgtgttagctgtcac

SEQ ID NO: 623298 - DNA, 25 bp, Mus musculus
ggctgttgtcttagtgaaatccggg

SEQ ID NO: 623299 - DNA, 25 bp, Mus musculus
ggctgttgtctttgtgaaatccggg

SEQ ID NO: 623300 - DNA, 25 bp, Mus musculus
ggctgtttaaaactcatacctgatg

SEQ ID NO: 623301 - DNA, 25 bp, Mus musculus
ggctgtttaaaagtcatacctgatg

SEQ ID NO: 623302 - DNA, 25 bp, Mus musculus
ggctgtttaaagatgtcggactgct

SEQ ID NO: 623303 - DNA, 25 bp, Mus musculus
ggctgtttaaagttgtcggactgct

SEQ ID NO: 623304 - DNA, 25 bp, Mus musculus
ggctgtttactgagacaactggtga

SEQ ID NO: 623305 - DNA, 25 bp, Mus musculus
ggctgtttactgtgacaactggtga

SEQ ID NO: 623306 - DNA, 25 bp, Mus musculus
ggctgtttagctcccaggacaacac

SEQ ID NO: 623307 - DNA, 25 bp, Mus musculus
ggctgtttagctgccaggacaacac

SEQ ID NO: 623308 - DNA, 25 bp, Mus musculus
ggctgtttatctcactgttatcatg

SEQ ID NO: 623309 - DNA, 25 bp, Mus musculus
ggctgtttatctcgtttttgccaaa

SEQ ID NO: 623310 - DNA, 25 bp, Mus musculus
ggctgtttatctgactgttatcatg

SEQ ID NO: 623311 - DNA, 25 bp, Mus musculus
ggctgtttatctggtttttgccaaa

SEQ ID NO: 623312 - DNA, 25 bp, Mus musculus
ggctgtttattcacacaagtcttca

SEQ ID NO: 623313 - DNA, 25 bp, Mus musculus
ggctgtttattctcacaagtcttca

SEQ ID NO: 623314 - DNA, 25 bp, Mus musculus
ggctgtttcactacgtgccaggaag

SEQ ID NO: 623315 - DNA, 25 bp, Mus musculus
ggctgtttcacttcgtgccaggaag

SEQ ID NO: 623316 - DNA, 25 bp, Mus musculus
ggctgtttcaggagaaattcaaaag

SEQ ID NO: 623317 - DNA, 25 bp, Mus musculus
ggctgtttcaggtgaaattcaaaag

SEQ ID NO: 623318 - DNA, 25 bp, Mus musculus
ggctgtttcataaggcgactgttaa

SEQ ID NO: 623319 - DNA, 25 bp, Mus musculus
ggctgtttcatatggcgactgttaa

SEQ ID NO: 623320 - DNA, 25 bp, Mus musculus
ggctgtttccctagcaatttgtgca

SEQ ID NO: 623321 - DNA, 25 bp, Mus musculus
ggctgtttcccttgcaatttgtgca

SEQ ID NO: 623322 - DNA, 25 bp, Mus musculus
ggctgtttcgtcagtaatttcggaa

SEQ ID NO: 623323 - DNA, 25 bp, Mus musculus
ggctgtttcgtctgtaatttcggaa

SEQ ID NO: 623324 - DNA, 25 bp, Mus musculus
ggctgtttctcacatggtcactaag

SEQ ID NO: 623325 - DNA, 25 bp, Mus musculus
ggctgtttctcagatggtcactaag

SEQ ID NO: 623326 - DNA, 25 bp, Mus musculus
ggctgtttctcccatcagagacaag

SEQ ID NO: 623327 - DNA, 25 bp, Mus musculus
ggctgtttctccgatcagagacaag

SEQ ID NO: 623328 - DNA, 25 bp, Mus musculus
ggctgtttctgaaaggagttattta

SEQ ID NO: 623329 - DNA, 25 bp, Mus musculus
ggctgtttctgataggagttattta

SEQ ID NO: 623330 - DNA, 25 bp, Mus musculus
ggctgtttgaaacctagacacgata

SEQ ID NO: 623331 - DNA, 25 bp, Mus musculus
ggctgtttgaaagctagacacgata

SEQ ID NO: 623332 - DNA, 25 bp, Mus musculus
ggctgtttgacacgcctggctaagc

SEQ ID NO: 623333 - DNA, 25 bp, Mus musculus
ggctgtttgacaggcctggctaagc

SEQ ID NO: 623334 - DNA, 25 bp, Mus musculus
ggctgtttgagcatcatttgaattc

SEQ ID NO: 623335 - DNA, 25 bp, Mus musculus
ggctgtttgagcttcatttgaattc

SEQ ID NO: 623336 - DNA, 25 bp, Mus musculus
ggctgtttgcaaagtctatagtcct

SEQ ID NO: 623337 - DNA, 25 bp, Mus musculus
ggctgtttgcaatgtctatagtcct

SEQ ID NO: 623338 - DNA, 25 bp, Mus musculus
ggctgtttggctcaagtgaaaagaa

SEQ ID NO: 623339 - DNA, 25 bp, Mus musculus
ggctgtttggctgaagtgaaaagaa

SEQ ID NO: 623340 - DNA, 25 bp, Mus musculus
ggctgtttgggcattctatacctgc

SEQ ID NO: 623341 - DNA, 25 bp, Mus musculus
ggctgtttgggctttctatacctgc

SEQ ID NO: 623342 - DNA, 25 bp, Mus musculus
ggctgtttgtacaagctgtgaggct

SEQ ID NO: 623343 - DNA, 25 bp, Mus musculus
ggctgtttgtactagctgtgaggct

SEQ ID NO: 623344 - DNA, 25 bp, Mus musculus
ggctgtttgtgaagttggcgcccca

SEQ ID NO: 623345 - DNA, 25 bp, Mus musculus
ggctgtttgtgatgttggcgcccca

SEQ ID NO: 623346 - DNA, 25 bp, Mus musculus
ggctgttttagacaggtctgtccct

SEQ ID NO: 623347 - DNA, 25 bp, Mus musculus
ggctgttttagagaggtctgtccct

SEQ ID NO: 623348 - DNA, 25 bp, Mus musculus
ggctgttttcatatgcatctttgat

SEQ ID NO: 623349 - DNA, 25 bp, Mus musculus
ggctgttttcatttgcatctttgat

SEQ ID NO: 623350 - DNA, 25 bp, Mus musculus
ggctgttttccaatcatattaatct

SEQ ID NO: 623351 - DNA, 25 bp, Mus musculus
ggctgttttccattcatattaatct

SEQ ID NO: 623352 - DNA, 25 bp, Mus musculus
ggctgttttctcacctgagcagagg

SEQ ID NO: 623353 - DNA, 25 bp, Mus musculus
ggctgttttctctcctgagcagagg

SEQ ID NO: 623354 - DNA, 25 bp, Mus musculus
ggctgttttcttcccaaggtctaat

SEQ ID NO: 623355 - DNA, 25 bp, Mus musculus
ggctgttttcttctcagtttgacaa

SEQ ID NO: 623356 - DNA, 25 bp, Mus musculus
ggctgttttcttgccaaggtctaat

SEQ ID NO: 623357 - DNA, 25 bp, Mus musculus
ggctgttttcttgtcagtttgacaa

SEQ ID NO: 623358 - DNA, 25 bp, Mus musculus
ggctgttttgaactctgccttttca

SEQ ID NO: 623359 - DNA, 25 bp, Mus musculus
ggctgttttgaagtctgccttttca

SEQ ID NO: 623360 - DNA, 25 bp, Mus musculus
ggctgttttgctcctagctagtttg

SEQ ID NO: 623361 - DNA, 25 bp, Mus musculus
ggctgttttgctgctagctagtttg

SEQ ID NO: 623362 - DNA, 25 bp, Mus musculus
ggctgttttgttagtaccaccgtct

SEQ ID NO: 623363 - DNA, 25 bp, Mus musculus
ggctgttttgtttgtaccaccgtct

SEQ ID NO: 623364 - DNA, 25 bp, Mus musculus
ggctgtttttggactcaacgagcag

SEQ ID NO: 623365 - DNA, 25 bp, Mus musculus
ggctgtttttggtctcaacgagcag

SEQ ID NO: 623366 - DNA, 25 bp, Mus musculus
ggctgttttttaaattcttgtgaat

SEQ ID NO: 623367 - DNA, 25 bp, Mus musculus
ggctgttttttatattcttgtgaat

SEQ ID NO: 623368 - DNA, 25 bp, Mus musculus
ggcttaaaacagatgccgcggactg

SEQ ID NO: 623369 - DNA, 25 bp, Mus musculus
ggcttaaaacagttgccgcggactg

SEQ ID NO: 623370 - DNA, 25 bp, Mus musculus
ggcttaaaattccaggccactgtcc

SEQ ID NO: 623371 - DNA, 25 bp, Mus musculus
ggcttaaaattcgaggccactgtcc

SEQ ID NO: 623372 - DNA, 25 bp, Mus musculus
ggcttaaacatacacactttctcac

SEQ ID NO: 623373 - DNA, 25 bp, Mus musculus
ggcttaaacatagacactttctcac

SEQ ID NO: 623374 - DNA, 25 bp, Mus musculus
ggcttaaacccaatttgcttgttag

SEQ ID NO: 623375 - DNA, 25 bp, Mus musculus
ggcttaaacccattttgcttgttag

SEQ ID NO: 623376 - DNA, 25 bp, Mus musculus
ggcttaaagcacaaagggccacgct

SEQ ID NO: 623377 - DNA, 25 bp, Mus musculus
ggcttaaagcactaagggccacgct

SEQ ID NO: 623378 - DNA, 25 bp, Mus musculus
ggcttaaagtgaaatacctccccta

SEQ ID NO: 623379 - DNA, 25 bp, Mus musculus
ggcttaaagtgatatacctccccta

SEQ ID NO: 623380 - DNA, 25 bp, Mus musculus
ggcttaactcaaataacatggcttc

SEQ ID NO: 623381 - DNA, 25 bp, Mus musculus
ggcttaactcaattaacatggcttc

SEQ ID NO: 623382 - DNA, 25 bp, Mus musculus
ggcttaactgcaccgttggaacctt

SEQ ID NO: 623383 - DNA, 25 bp, Mus musculus
ggcttaactgcagcgttggaacctt

SEQ ID NO: 623384 - DNA, 25 bp, Mus musculus
ggcttaactggacactactcacaaa

SEQ ID NO: 623385 - DNA, 25 bp, Mus musculus
ggcttaactggagactactcacaaa

SEQ ID NO: 623386 - DNA, 25 bp, Mus musculus
ggcttaactgtaactgctagtactt

SEQ ID NO: 623387 - DNA, 25 bp, Mus musculus
ggcttaactgtatctgctagtactt

SEQ ID NO: 623388 - DNA, 25 bp, Mus musculus
ggcttaacttaccatctctagatga

SEQ ID NO: 623389 - DNA, 25 bp, Mus musculus
ggcttaacttacgatctctagatga

SEQ ID NO: 623390 - DNA, 25 bp, Mus musculus
ggcttaagaccaaccctgcaagaaa

SEQ ID NO: 623391 - DNA, 25 bp, Mus musculus
ggcttaagaccatccctgcaagaaa

SEQ ID NO: 623392 - DNA, 25 bp, Mus musculus
ggcttaagtaacactcctgttgcag

SEQ ID NO: 623393 - DNA, 25 bp, Mus musculus
ggcttaagtaactctcctgttgcag

SEQ ID NO: 623394 - DNA, 25 bp, Mus musculus
ggcttaagtagcaccggtgacagaa

SEQ ID NO: 623395 - DNA, 25 bp, Mus musculus
ggcttaagtagctccggtgacagaa

SEQ ID NO: 623396 - DNA, 25 bp, Mus musculus
ggcttaagttgacagtgccctacac

SEQ ID NO: 623397 - DNA, 25 bp, Mus musculus
ggcttaagttgagagtgccctacac

SEQ ID NO: 623398 - DNA, 25 bp, Mus musculus
ggcttaatacatcatctagtcccag

SEQ ID NO: 623399 - DNA, 25 bp, Mus musculus
ggcttaatacatgatctagtcccag

SEQ ID NO: 623400 - DNA, 25 bp, Mus musculus
ggcttaataccgagagttccttcct

SEQ ID NO: 623401 - DNA, 25 bp, Mus musculus
ggcttaataccgtgagttccttcct

SEQ ID NO: 623402 - DNA, 25 bp, Mus musculus
ggcttaatagacacgaacacacttg

SEQ ID NO: 623403 - DNA, 25 bp, Mus musculus
ggcttaatagactcgaacacacttg

SEQ ID NO: 623404 - DNA, 25 bp, Mus musculus
ggcttaatcaaaatcatgctggttc

SEQ ID NO: 623405 - DNA, 25 bp, Mus musculus
ggcttaatcaaattcatgctggttc

SEQ ID NO: 623406 - DNA, 25 bp, Mus musculus
ggcttaatccatctacttgtagacc

SEQ ID NO: 623407 - DNA, 25 bp, Mus musculus
ggcttaatccatgtacttgtagacc

SEQ ID NO: 623408 - DNA, 25 bp, Mus musculus
ggcttaatctttatatcctggatgt

SEQ ID NO: 623409 - DNA, 25 bp, Mus musculus
ggcttaatctttttatcctggatgt

SEQ ID NO: 623410 - DNA, 25 bp, Mus musculus
ggcttaatgaatccctgtgtttctc

SEQ ID NO: 623411 - DNA, 25 bp, Mus musculus
ggcttaatgaatgcctgtgtttctc

SEQ ID NO: 623412 - DNA, 25 bp, Mus musculus
ggcttaattaagaaatgactataca

SEQ ID NO: 623413 - DNA, 25 bp, Mus musculus
ggcttaattaagtaatgactataca

SEQ ID NO: 623414 - DNA, 25 bp, Mus musculus
ggcttacaactgaatatctggtcca

SEQ ID NO: 623415 - DNA, 25 bp, Mus musculus
ggcttacaactgctcctaaccgcag

SEQ ID NO: 623416 - DNA, 25 bp, Mus musculus
ggcttacaactggtcctaaccgcag

SEQ ID NO: 623417 - DNA, 25 bp, Mus musculus
ggcttacaactgtatatctggtcca

SEQ ID NO: 623418 - DNA, 25 bp, Mus musculus
ggcttacaagaacttctacgctaaa

SEQ ID NO: 623419 - DNA, 25 bp, Mus musculus
ggcttacaagaagttctacgctaaa

SEQ ID NO: 623420 - DNA, 25 bp, Mus musculus
ggcttacaagcaagctactgctctt

SEQ ID NO: 623421 - DNA, 25 bp, Mus musculus
ggcttacaagcatgctactgctctt

SEQ ID NO: 623422 - DNA, 25 bp, Mus musculus
ggcttacaagccctggagtatgctc

SEQ ID NO: 623423 - DNA, 25 bp, Mus musculus
ggcttacaagccgtggagtatgctc

SEQ ID NO: 623424 - DNA, 25 bp, Mus musculus
ggcttacaattgcaaccacaggact

SEQ ID NO: 623425 - DNA, 25 bp, Mus musculus
ggcttacaattggaaccacaggact

SEQ ID NO: 623426 - DNA, 25 bp, Mus musculus
ggcttacagaaccctcttctctcaa

SEQ ID NO: 623427 - DNA, 25 bp, Mus musculus
ggcttacagaacgctcttctctcaa

SEQ ID NO: 623428 - DNA, 25 bp, Mus musculus
ggcttacagcctcttgtgttctcaa

SEQ ID NO: 623429 - DNA, 25 bp, Mus musculus
ggcttacagcctgttgtgttctcaa

SEQ ID NO: 623430 - DNA, 25 bp, Mus musculus
ggcttacaggaaccgctgtctggat

SEQ ID NO: 623431 - DNA, 25 bp, Mus musculus
ggcttacaggaagcgctgtctggat

SEQ ID NO: 623432 - DNA, 25 bp, Mus musculus
ggcttacaggcaagatcttacctag

SEQ ID NO: 623433 - DNA, 25 bp, Mus musculus
ggcttacaggcatgatcttacctag

SEQ ID NO: 623434 - DNA, 25 bp, Mus musculus
ggcttacaggttatcatgcaggcaa

SEQ ID NO: 623435 - DNA, 25 bp, Mus musculus
ggcttacaggttttcatgcaggcaa

SEQ ID NO: 623436 - DNA, 25 bp, Mus musculus
ggcttacagtggatcagtgtgtcat

SEQ ID NO: 623437 - DNA, 25 bp, Mus musculus
ggcttacagtggttcagtgtgtcat

SEQ ID NO: 623438 - DNA, 25 bp, Mus musculus
ggcttacagttcacaaaaggataca

SEQ ID NO: 623439 - DNA, 25 bp, Mus musculus
ggcttacagttctcaaaaggataca

SEQ ID NO: 623440 - DNA, 25 bp, Mus musculus
ggcttacataggattgatcacattc

SEQ ID NO: 623441 - DNA, 25 bp, Mus musculus
ggcttacataggtttgatcacattc

SEQ ID NO: 623442 - DNA, 25 bp, Mus musculus
ggcttacatctacaagtgtgtcaac

SEQ ID NO: 623443 - DNA, 25 bp, Mus musculus
ggcttacatctagaagtgtgtcaac

SEQ ID NO: 623444 - DNA, 25 bp, Mus musculus
ggcttacattgacttgcagtggctt

SEQ ID NO: 623445 - DNA, 25 bp, Mus musculus
ggcttacattgagttgcagtggctt

SEQ ID NO: 623446 - DNA, 25 bp, Mus musculus
ggcttaccacagcacacaggcggac

SEQ ID NO: 623447 - DNA, 25 bp, Mus musculus
ggcttaccacaggacacaggcggac

SEQ ID NO: 623448 - DNA, 25 bp, Mus musculus
ggcttaccactgagactgcaagttt

SEQ ID NO: 623449 - DNA, 25 bp, Mus musculus
ggcttaccactgtgactgcaagttt

SEQ ID NO: 623450 - DNA, 25 bp, Mus musculus
ggcttacccacgagggtgttcaatt

SEQ ID NO: 623451 - DNA, 25 bp, Mus musculus
ggcttacccacgtgggtgttcaatt

SEQ ID NO: 623452 - DNA, 25 bp, Mus musculus
ggcttacccttgcaaggcagccaca

SEQ ID NO: 623453 - DNA, 25 bp, Mus musculus
ggcttacccttggaaggcagccaca

SEQ ID NO: 623454 - DNA, 25 bp, Mus musculus
ggcttaccgtaccttccaagggatg

SEQ ID NO: 623455 - DNA, 25 bp, Mus musculus
ggcttaccgtacgttccaagggatg

SEQ ID NO: 623456 - DNA, 25 bp, Mus musculus
ggcttacctcagcaagacttaacag

SEQ ID NO: 623457 - DNA, 25 bp, Mus musculus
ggcttacctcaggaagacttaacag

SEQ ID NO: 623458 - DNA, 25 bp, Mus musculus
ggcttacctccaatatagaaaccta

SEQ ID NO: 623459 - DNA, 25 bp, Mus musculus
ggcttacctccattatagaaaccta

SEQ ID NO: 623460 - DNA, 25 bp, Mus musculus
ggcttacctttcatcatgacaggga

SEQ ID NO: 623461 - DNA, 25 bp, Mus musculus
ggcttacctttcttcatgacaggga

SEQ ID NO: 623462 - DNA, 25 bp, Mus musculus
ggcttactaaatacttaggccagct

SEQ ID NO: 623463 - DNA, 25 bp, Mus musculus
ggcttactaaattcttaggccagct

SEQ ID NO: 623464 - DNA, 25 bp, Mus musculus
ggcttactcagccaggacaatcagc

SEQ ID NO: 623465 - DNA, 25 bp, Mus musculus
ggcttactcagcgaggacaatcagc

SEQ ID NO: 623466 - DNA, 25 bp, Mus musculus
ggcttactgagaaaactaatggcta

SEQ ID NO: 623467 - DNA, 25 bp, Mus musculus
ggcttactgagataactaatggcta

SEQ ID NO: 623468 - DNA, 25 bp, Mus musculus
ggcttactgagcatttgcggagttt

SEQ ID NO: 623469 - DNA, 25 bp, Mus musculus
ggcttactgagcttttgcggagttt

SEQ ID NO: 623470 - DNA, 25 bp, Mus musculus
ggcttactgcttataacaaagggaa

SEQ ID NO: 623471 - DNA, 25 bp, Mus musculus
ggcttactgcttttaacaaagggaa

SEQ ID NO: 623472 - DNA, 25 bp, Mus musculus
ggcttactggtacatgggccacagt

SEQ ID NO: 623473 - DNA, 25 bp, Mus musculus
ggcttactggtagatgggccacagt

SEQ ID NO: 623474 - DNA, 25 bp, Mus musculus
ggcttactgtatactcttggtggat

SEQ ID NO: 623475 - DNA, 25 bp, Mus musculus
ggcttactgtattctcttggtggat

SEQ ID NO: 623476 - DNA, 25 bp, Mus musculus
ggcttactgtgtaggcccagaatgg

SEQ ID NO: 623477 - DNA, 25 bp, Mus musculus
ggcttactgtgttggcccagaatgg

SEQ ID NO: 623478 - DNA, 25 bp, Mus musculus
ggcttacttaccacagaatcctttt

SEQ ID NO: 623479 - DNA, 25 bp, Mus musculus
ggcttacttacctcagaatcctttt

SEQ ID NO: 623480 - DNA, 25 bp, Mus musculus
ggcttagaaaacacgagcttccttc

SEQ ID NO: 623481 - DNA, 25 bp, Mus musculus
ggcttagaaaactcgagcttccttc

SEQ ID NO: 623482 - DNA, 25 bp, Mus musculus
ggcttagaaaggcacctagaaacaa

SEQ ID NO: 623483 - DNA, 25 bp, Mus musculus
ggcttagaaagggacctagaaacaa

SEQ ID NO: 623484 - DNA, 25 bp, Mus musculus
ggcttagaactgaatcaaggccttt

SEQ ID NO: 623485 - DNA, 25 bp, Mus musculus
ggcttagaactgtatcaaggccttt

SEQ ID NO: 623486 - DNA, 25 bp, Mus musculus
ggcttagaatgtctccatccaggga

SEQ ID NO: 623487 - DNA, 25 bp, Mus musculus
ggcttagaatgtgtccatccaggga

SEQ ID NO: 623488 - DNA, 25 bp, Mus musculus
ggcttagacaagatgggtaccagtg

SEQ ID NO: 623489 - DNA, 25 bp, Mus musculus
ggcttagacaagttgggtaccagtg

SEQ ID NO: 623490 - DNA, 25 bp, Mus musculus
ggcttagacttgcagatataaactt

SEQ ID NO: 623491 - DNA, 25 bp, Mus musculus
ggcttagacttggagatataaactt

SEQ ID NO: 623492 - DNA, 25 bp, Mus musculus
ggcttagagaatccacagctctccg

SEQ ID NO: 623493 - DNA, 25 bp, Mus musculus
ggcttagagaatgcacagctctccg

SEQ ID NO: 623494 - DNA, 25 bp, Mus musculus
ggcttagcactcaatttgcttttgc

SEQ ID NO: 623495 - DNA, 25 bp, Mus musculus
ggcttagcactccacaaactcaaaa

SEQ ID NO: 623496 - DNA, 25 bp, Mus musculus
ggcttagcactcgacaaactcaaaa

SEQ ID NO: 623497 - DNA, 25 bp, Mus musculus
ggcttagcactctatttgcttttgc

SEQ ID NO: 623498 - DNA, 25 bp, Mus musculus
ggcttagcagcaagaacctttgcct

SEQ ID NO: 623499 - DNA, 25 bp, Mus musculus
ggcttagcagcatgaacctttgcct

SEQ ID NO: 623500 - DNA, 25 bp, Mus musculus
ggcttagccctcatttcaaacgaag

SEQ ID NO: 623501 - DNA, 25 bp, Mus musculus
ggcttagccctcttttcaaacgaag

SEQ ID NO: 623502 - DNA, 25 bp, Mus musculus
ggcttagctcaaagtgccaacctcc

SEQ ID NO: 623503 - DNA, 25 bp, Mus musculus
ggcttagctcaatgtgccaacctcc

SEQ ID NO: 623504 - DNA, 25 bp, Mus musculus
ggcttagctcacagctacttggaaa

SEQ ID NO: 623505 - DNA, 25 bp, Mus musculus
ggcttagctcactgctacttggaaa

SEQ ID NO: 623506 - DNA, 25 bp, Mus musculus
ggcttagctcatatttgtcatggca

SEQ ID NO: 623507 - DNA, 25 bp, Mus musculus
ggcttagctcatttttgtcatggca

SEQ ID NO: 623508 - DNA, 25 bp, Mus musculus
ggcttagctcgacacattcatcata

SEQ ID NO: 623509 - DNA, 25 bp, Mus musculus
ggcttagctcgagacattcatcata

SEQ ID NO: 623510 - DNA, 25 bp, Mus musculus
ggcttagctgtcactttatctacaa

SEQ ID NO: 623511 - DNA, 25 bp, Mus musculus
ggcttagctgtctctttatctacaa

SEQ ID NO: 623512 - DNA, 25 bp, Mus musculus
ggcttaggacatcagctctgtttct

SEQ ID NO: 623513 - DNA, 25 bp, Mus musculus
ggcttaggacatgagctctgtttct

SEQ ID NO: 623514 - DNA, 25 bp, Mus musculus
ggcttaggatcgaccggctgcgcaa

SEQ ID NO: 623515 - DNA, 25 bp, Mus musculus
ggcttaggatcgtccggctgcgcaa

SEQ ID NO: 623516 - DNA, 25 bp, Mus musculus
ggcttagtaattctgtgaaggcgaa

SEQ ID NO: 623517 - DNA, 25 bp, Mus musculus
ggcttagtaattgtgtgaaggcgaa

SEQ ID NO: 623518 - DNA, 25 bp, Mus musculus
ggcttagtacttaatgttgtctctc

SEQ ID NO: 623519 - DNA, 25 bp, Mus musculus
ggcttagtactttatgttgtctctc

SEQ ID NO: 623520 - DNA, 25 bp, Mus musculus
ggcttagtagaaacccgcaagcttt

SEQ ID NO: 623521 - DNA, 25 bp, Mus musculus
ggcttagtagaatcccgcaagcttt

SEQ ID NO: 623522 - DNA, 25 bp, Mus musculus
ggcttagtaggtaaggcacttcact

SEQ ID NO: 623523 - DNA, 25 bp, Mus musculus
ggcttagtaggttaggcacttcact

SEQ ID NO: 623524 - DNA, 25 bp, Mus musculus
ggcttagtataaagcattctcacca

SEQ ID NO: 623525 - DNA, 25 bp, Mus musculus
ggcttagtataatgcattctcacca

SEQ ID NO: 623526 - DNA, 25 bp, Mus musculus
ggcttagtatgtagtattctcccag

SEQ ID NO: 623527 - DNA, 25 bp, Mus musculus
ggcttagtatgttgtattctcccag

SEQ ID NO: 623528 - DNA, 25 bp, Mus musculus
ggcttagtcatgagagcatgctctt

SEQ ID NO: 623529 - DNA, 25 bp, Mus musculus
ggcttagtcatgtgagcatgctctt

SEQ ID NO: 623530 - DNA, 25 bp, Mus musculus
ggcttagtccagactcttctgaagt

SEQ ID NO: 623531 - DNA, 25 bp, Mus musculus
ggcttagtccagtctcttctgaagt

SEQ ID NO: 623532 - DNA, 25 bp, Mus musculus
ggcttagtgctgatggctgacattt

SEQ ID NO: 623533 - DNA, 25 bp, Mus musculus
ggcttagtgctgttggctgacattt

SEQ ID NO: 623534 - DNA, 25 bp, Mus musculus
ggcttagtggccagttgttcctgag

SEQ ID NO: 623535 - DNA, 25 bp, Mus musculus
ggcttagtggcctgttgttcctgag

SEQ ID NO: 623536 - DNA, 25 bp, Mus musculus
ggcttagttcccagcatatcagata

SEQ ID NO: 623537 - DNA, 25 bp, Mus musculus
ggcttagttccctgcatatcagata

SEQ ID NO: 623538 - DNA, 25 bp, Mus musculus
ggcttagttgccatcaatacattga

SEQ ID NO: 623539 - DNA, 25 bp, Mus musculus
ggcttagttgccttcaatacattga

SEQ ID NO: 623540 - DNA, 25 bp, Mus musculus
ggcttagttggccaagtacttgctt

SEQ ID NO: 623541 - DNA, 25 bp, Mus musculus
ggcttagttggcgaagtacttgctt

SEQ ID NO: 623542 - DNA, 25 bp, Mus musculus
ggcttataaggcagtacatcccaga

SEQ ID NO: 623543 - DNA, 25 bp, Mus musculus
ggcttataaggctgtacatcccaga

SEQ ID NO: 623544 - DNA, 25 bp, Mus musculus
ggcttataatctcttcaccaagtca

SEQ ID NO: 623545 - DNA, 25 bp, Mus musculus
ggcttataatctgttcaccaagtca

SEQ ID NO: 623546 - DNA, 25 bp, Mus musculus
ggcttataattccttacaccaagat

SEQ ID NO: 623547 - DNA, 25 bp, Mus musculus
ggcttataattcgttacaccaagat

SEQ ID NO: 623548 - DNA, 25 bp, Mus musculus
ggcttatacggccagttccatggca

SEQ ID NO: 623549 - DNA, 25 bp, Mus musculus
ggcttatacggcgagttccatggca

SEQ ID NO: 623550 - DNA, 25 bp, Mus musculus
ggcttatactcccaaaccctgagtg

SEQ ID NO: 623551 - DNA, 25 bp, Mus musculus
ggcttatactccgaaaccctgagtg

SEQ ID NO: 623552 - DNA, 25 bp, Mus musculus
ggcttatagcagcagtattatgacc

SEQ ID NO: 623553 - DNA, 25 bp, Mus musculus
ggcttatagcaggagtattatgacc

SEQ ID NO: 623554 - DNA, 25 bp, Mus musculus
ggcttatagttcaatggctgagaat

SEQ ID NO: 623555 - DNA, 25 bp, Mus musculus
ggcttatagttctatggctgagaat

SEQ ID NO: 623556 - DNA, 25 bp, Mus musculus
ggcttatcatccatcccttttaact

SEQ ID NO: 623557 - DNA, 25 bp, Mus musculus
ggcttatcatccttcccttttaact

SEQ ID NO: 623558 - DNA, 25 bp, Mus musculus
ggcttatccaatctccccacggagt

SEQ ID NO: 623559 - DNA, 25 bp, Mus musculus
ggcttatccaatgtccccacggagt

SEQ ID NO: 623560 - DNA, 25 bp, Mus musculus
ggcttatccttgactgattggcaac

SEQ ID NO: 623561 - DNA, 25 bp, Mus musculus
ggcttatccttgtctgattggcaac

SEQ ID NO: 623562 - DNA, 25 bp, Mus musculus
ggcttatctccacaaccaaaacaga

SEQ ID NO: 623563 - DNA, 25 bp, Mus musculus
ggcttatctccagaaccaaaacaga

SEQ ID NO: 623564 - DNA, 25 bp, Mus musculus
ggcttatctgatcaccatgtcctca

SEQ ID NO: 623565 - DNA, 25 bp, Mus musculus
ggcttatctgatgaccatgtcctca

SEQ ID NO: 623566 - DNA, 25 bp, Mus musculus
ggcttatgaccacctctcaaaatta

SEQ ID NO: 623567 - DNA, 25 bp, Mus musculus
ggcttatgaccagctctcaaaatta

SEQ ID NO: 623568 - DNA, 25 bp, Mus musculus
ggcttatgagaaaactcccatttgg

SEQ ID NO: 623569 - DNA, 25 bp, Mus musculus
ggcttatgagaatactcccatttgg

SEQ ID NO: 623570 - DNA, 25 bp, Mus musculus
ggcttatgcaaaatagggtccggat

SEQ ID NO: 623571 - DNA, 25 bp, Mus musculus
ggcttatgcaaattagggtccggat

SEQ ID NO: 623572 - DNA, 25 bp, Mus musculus
ggcttatgccacaatctactgagga

SEQ ID NO: 623573 - DNA, 25 bp, Mus musculus
ggcttatgccactatctactgagga

SEQ ID NO: 623574 - DNA, 25 bp, Mus musculus
ggcttatggcatctccagtgtgcat

SEQ ID NO: 623575 - DNA, 25 bp, Mus musculus
ggcttatggcatgtccagtgtgcat

SEQ ID NO: 623576 - DNA, 25 bp, Mus musculus
ggcttatgtcaaactctcaactgaa

SEQ ID NO: 623577 - DNA, 25 bp, Mus musculus
ggcttatgtcaatctctcaactgaa

SEQ ID NO: 623578 - DNA, 25 bp, Mus musculus
ggcttatgtgccatctgagagtaat

SEQ ID NO: 623579 - DNA, 25 bp, Mus musculus
ggcttatgtgccttctgagagtaat

SEQ ID NO: 623580 - DNA, 25 bp, Mus musculus
ggcttattaaggagtgactcctgct

SEQ ID NO: 623581 - DNA, 25 bp, Mus musculus
ggcttattaaggtgtgactcctgct

SEQ ID NO: 623582 - DNA, 25 bp, Mus musculus
ggcttattaatcatctctctttcac

SEQ ID NO: 623583 - DNA, 25 bp, Mus musculus
ggcttattaatcttctctctttcac

SEQ ID NO: 623584 - DNA, 25 bp, Mus musculus
ggcttattaccaaacttcggatact

SEQ ID NO: 623585 - DNA, 25 bp, Mus musculus
ggcttattaccacagtgagcggagt

SEQ ID NO: 623586 - DNA, 25 bp, Mus musculus
ggcttattaccagagtgagcggagt

SEQ ID NO: 623587 - DNA, 25 bp, Mus musculus
ggcttattaccatacttcggatact

SEQ ID NO: 623588 - DNA, 25 bp, Mus musculus
ggcttattacccagtgtcattttaa

SEQ ID NO: 623589 - DNA, 25 bp, Mus musculus
ggcttattaccctgtgtcattttaa

SEQ ID NO: 623590 - DNA, 25 bp, Mus musculus
ggcttattagttagactcctcgaac

SEQ ID NO: 623591 - DNA, 25 bp, Mus musculus
ggcttattagtttgactcctcgaac

SEQ ID NO: 623592 - DNA, 25 bp, Mus musculus
ggcttattatgcccacactttgtgt

SEQ ID NO: 623593 - DNA, 25 bp, Mus musculus
ggcttattatgcgcacactttgtgt

SEQ ID NO: 623594 - DNA, 25 bp, Mus musculus
ggcttattctgtaatttcctctggt

SEQ ID NO: 623595 - DNA, 25 bp, Mus musculus
ggcttattctgttatttcctctggt

SEQ ID NO: 623596 - DNA, 25 bp, Mus musculus
ggcttattgagcaccttgtgtattc

SEQ ID NO: 623597 - DNA, 25 bp, Mus musculus
ggcttattgagctccttgtgtattc

SEQ ID NO: 623598 - DNA, 25 bp, Mus musculus
ggcttattgctcatgcaggttctct

SEQ ID NO: 623599 - DNA, 25 bp, Mus musculus
ggcttattgctcttgcaggttctct

SEQ ID NO: 623600 - DNA, 25 bp, Mus musculus
ggcttattggctaattggtggatag

SEQ ID NO: 623601 - DNA, 25 bp, Mus musculus
ggcttattggcttattggtggatag

SEQ ID NO: 623602 - DNA, 25 bp, Mus musculus
ggcttattgtatagtcctgaccctt

SEQ ID NO: 623603 - DNA, 25 bp, Mus musculus
ggcttattgtatagtctgtccagaa

SEQ ID NO: 623604 - DNA, 25 bp, Mus musculus
ggcttattgtattgtcctgaccctt

SEQ ID NO: 623605 - DNA, 25 bp, Mus musculus
ggcttattgtattgtctgtccagaa

SEQ ID NO: 623606 - DNA, 25 bp, Mus musculus
ggcttattgttcagcggtatttgtc

SEQ ID NO: 623607 - DNA, 25 bp, Mus musculus
ggcttattgttctgcggtatttgtc

SEQ ID NO: 623608 - DNA, 25 bp, Mus musculus
ggcttattgtttctcagcactgtaa

SEQ ID NO: 623609 - DNA, 25 bp, Mus musculus
ggcttattgtttgtcagcactgtaa

SEQ ID NO: 623610 - DNA, 25 bp, Mus musculus
ggcttatttccaattatcctgcaca

SEQ ID NO: 623611 - DNA, 25 bp, Mus musculus
ggcttatttccatttatcctgcaca

SEQ ID NO: 623612 - DNA, 25 bp, Mus musculus
ggcttatttgctactcaacttcgtt

SEQ ID NO: 623613 - DNA, 25 bp, Mus musculus
ggcttatttgcttctcaacttcgtt

SEQ ID NO: 623614 - DNA, 25 bp, Mus musculus
ggcttatttggcatatttgtcttca

SEQ ID NO: 623615 - DNA, 25 bp, Mus musculus
ggcttatttggcttatttgtcttca

SEQ ID NO: 623616 - DNA, 25 bp, Mus musculus
ggcttattttccatattcttccttt

SEQ ID NO: 623617 - DNA, 25 bp, Mus musculus
ggcttattttccttattcttccttt

SEQ ID NO: 623618 - DNA, 25 bp, Mus musculus
ggcttcaaacctaccaggagagact

SEQ ID NO: 623619 - DNA, 25 bp, Mus musculus
ggcttcaaaccttccaggagagact

SEQ ID NO: 623620 - DNA, 25 bp, Mus musculus
ggcttcaaacgcaaaagtgcatttc

SEQ ID NO: 623621 - DNA, 25 bp, Mus musculus
ggcttcaaacgctaaagtgcatttc

SEQ ID NO: 623622 - DNA, 25 bp, Mus musculus
ggcttcaaagacagggagatccctt

SEQ ID NO: 623623 - DNA, 25 bp, Mus musculus
ggcttcaaagactgggagatccctt

SEQ ID NO: 623624 - DNA, 25 bp, Mus musculus
ggcttcaaatgcctgctgccggtga

SEQ ID NO: 623625 - DNA, 25 bp, Mus musculus
ggcttcaaatgcgtgctgccggtga

SEQ ID NO: 623626 - DNA, 25 bp, Mus musculus
ggcttcaaattcagtagtcctcctc

SEQ ID NO: 623627 - DNA, 25 bp, Mus musculus
ggcttcaaattctgtagtcctcctc

SEQ ID NO: 623628 - DNA, 25 bp, Mus musculus
ggcttcaaatttactttctcccatt

SEQ ID NO: 623629 - DNA, 25 bp, Mus musculus
ggcttcaaattttctttctcccatt

SEQ ID NO: 623630 - DNA, 25 bp, Mus musculus
ggcttcaacactctgactgtggata

SEQ ID NO: 623631 - DNA, 25 bp, Mus musculus
ggcttcaacactgtgactgtggata

SEQ ID NO: 623632 - DNA, 25 bp, Mus musculus
ggcttcaactcacttttaagacaag

SEQ ID NO: 623633 - DNA, 25 bp, Mus musculus
ggcttcaactcagttttaagacaag

SEQ ID NO: 623634 - DNA, 25 bp, Mus musculus
ggcttcaagaagctcgtccatgtgc

SEQ ID NO: 623635 - DNA, 25 bp, Mus musculus
ggcttcaagaaggtcgtccatgtgc

SEQ ID NO: 623636 - DNA, 25 bp, Mus musculus
ggcttcaagccacatacatacacaa

SEQ ID NO: 623637 - DNA, 25 bp, Mus musculus
ggcttcaagccagatacatacacaa

SEQ ID NO: 623638 - DNA, 25 bp, Mus musculus
ggcttcaagtaacatctatttccat

SEQ ID NO: 623639 - DNA, 25 bp, Mus musculus
ggcttcaagtaagatctatttccat

SEQ ID NO: 623640 - DNA, 25 bp, Mus musculus
ggcttcaagtcgaaacatggaattt

SEQ ID NO: 623641 - DNA, 25 bp, Mus musculus
ggcttcaagtcgtaacatggaattt

SEQ ID NO: 623642 - DNA, 25 bp, Mus musculus
ggcttcaagtctcacttaaaggcag

SEQ ID NO: 623643 - DNA, 25 bp, Mus musculus
ggcttcaagtctgacttaaaggcag

SEQ ID NO: 623644 - DNA, 25 bp, Mus musculus
ggcttcaagttaacacctcatttta

SEQ ID NO: 623645 - DNA, 25 bp, Mus musculus
ggcttcaagttatcacctcatttta

SEQ ID NO: 623646 - DNA, 25 bp, Mus musculus
ggcttcaatatcctggcaattgcct

SEQ ID NO: 623647 - DNA, 25 bp, Mus musculus
ggcttcaatatcgtggcaattgcct

SEQ ID NO: 623648 - DNA, 25 bp, Mus musculus
ggcttcaattaacatgctgcggatt

SEQ ID NO: 623649 - DNA, 25 bp, Mus musculus
ggcttcaattaagatgctgcggatt

SEQ ID NO: 623650 - DNA, 25 bp, Mus musculus
ggcttcaattctcgctatgccgtca

SEQ ID NO: 623651 - DNA, 25 bp, Mus musculus
ggcttcaattctggctatgccgtca

SEQ ID NO: 623652 - DNA, 25 bp, Mus musculus
ggcttcaatttcactcaacttctaa

SEQ ID NO: 623653 - DNA, 25 bp, Mus musculus
ggcttcaatttctctcaacttctaa

SEQ ID NO: 623654 - DNA, 25 bp, Mus musculus
ggcttcaattttacacttctttctg

SEQ ID NO: 623655 - DNA, 25 bp, Mus musculus
ggcttcaatttttcacttctttctg

SEQ ID NO: 623656 - DNA, 25 bp, Mus musculus
ggcttcacagagaccctttagggag

SEQ ID NO: 623657 - DNA, 25 bp, Mus musculus
ggcttcacagagtccctttagggag

SEQ ID NO: 623658 - DNA, 25 bp, Mus musculus
ggcttcacattcatacgactgagac

SEQ ID NO: 623659 - DNA, 25 bp, Mus musculus
ggcttcacattcttacgactgagac

SEQ ID NO: 623660 - DNA, 25 bp, Mus musculus
ggcttcaccaataaatgcacatccc

SEQ ID NO: 623661 - DNA, 25 bp, Mus musculus
ggcttcaccaattaatgcacatccc

SEQ ID NO: 623662 - DNA, 25 bp, Mus musculus
ggcttcaccacacttgtgccagaaa

SEQ ID NO: 623663 - DNA, 25 bp, Mus musculus
ggcttcaccacagttgtgccagaaa

SEQ ID NO: 623664 - DNA, 25 bp, Mus musculus
ggcttcacctctcgaaaatggtact

SEQ ID NO: 623665 - DNA, 25 bp, Mus musculus
ggcttcacctctggaaaatggtact

SEQ ID NO: 623666 - DNA, 25 bp, Mus musculus
ggcttcacgcagctgtctcggctca

SEQ ID NO: 623667 - DNA, 25 bp, Mus musculus
ggcttcacgcaggtgtctcggctca

SEQ ID NO: 623668 - DNA, 25 bp, Mus musculus
ggcttcactgacagttcctaaaact

SEQ ID NO: 623669 - DNA, 25 bp, Mus musculus
ggcttcactgactgttcctaaaact

SEQ ID NO: 623670 - DNA, 25 bp, Mus musculus
ggcttcacttttcaggtagcaaggc

SEQ ID NO: 623671 - DNA, 25 bp, Mus musculus
ggcttcacttttgaggtagcaaggc

SEQ ID NO: 623672 - DNA, 25 bp, Mus musculus
ggcttcagacatccttatacgacag

SEQ ID NO: 623673 - DNA, 25 bp, Mus musculus
ggcttcagacatgcttatacgacag

SEQ ID NO: 623674 - DNA, 25 bp, Mus musculus
ggcttcagacccaaaactaatgtta

SEQ ID NO: 623675 - DNA, 25 bp, Mus musculus
ggcttcagaccctaaactaatgtta

SEQ ID NO: 623676 - DNA, 25 bp, Mus musculus
ggcttcagaggaaggcactttcact

SEQ ID NO: 623677 - DNA, 25 bp, Mus musculus
ggcttcagaggatggcactttcact

SEQ ID NO: 623678 - DNA, 25 bp, Mus musculus
ggcttcagatccactttaggctgct

SEQ ID NO: 623679 - DNA, 25 bp, Mus musculus
ggcttcagatcctctttaggctgct

SEQ ID NO: 623680 - DNA, 25 bp, Mus musculus
ggcttcagatgcaagtaaagattat

SEQ ID NO: 623681 - DNA, 25 bp, Mus musculus
ggcttcagatgctagtaaagattat

SEQ ID NO: 623682 - DNA, 25 bp, Mus musculus
ggcttcagcaatcactccggtctgg

SEQ ID NO: 623683 - DNA, 25 bp, Mus musculus
ggcttcagcaatgactccggtctgg

SEQ ID NO: 623684 - DNA, 25 bp, Mus musculus
ggcttcagcaccaggaatcccatat

SEQ ID NO: 623685 - DNA, 25 bp, Mus musculus
ggcttcagcacctggaatcccatat

SEQ ID NO: 623686 - DNA, 25 bp, Mus musculus
ggcttcagcatgcatctcaatgttc

SEQ ID NO: 623687 - DNA, 25 bp, Mus musculus
ggcttcagcatggatctcaatgttc

SEQ ID NO: 623688 - DNA, 25 bp, Mus musculus
ggcttcagcccacgtggccaaagtg

SEQ ID NO: 623689 - DNA, 25 bp, Mus musculus
ggcttcagcccaggtggccaaagtg

SEQ ID NO: 623690 - DNA, 25 bp, Mus musculus
ggcttcagcggacgccgttcacata

SEQ ID NO: 623691 - DNA, 25 bp, Mus musculus
ggcttcagcggaggccgttcacata

SEQ ID NO: 623692 - DNA, 25 bp, Mus musculus
ggcttcagctgaaaaacgaataggc

SEQ ID NO: 623693 - DNA, 25 bp, Mus musculus
ggcttcagctgataaacgaataggc

SEQ ID NO: 623694 - DNA, 25 bp, Mus musculus
ggcttcaggcaaagaccttctggcc

SEQ ID NO: 623695 - DNA, 25 bp, Mus musculus
ggcttcaggcaatgaccttctggcc

SEQ ID NO: 623696 - DNA, 25 bp, Mus musculus
ggcttcagggtgatgccaacaacct

SEQ ID NO: 623697 - DNA, 25 bp, Mus musculus
ggcttcagggtgttgccaacaacct

SEQ ID NO: 623698 - DNA, 25 bp, Mus musculus
ggcttcagtaagctaaagtccgcgt

SEQ ID NO: 623699 - DNA, 25 bp, Mus musculus
ggcttcagtaaggtaaagtccgcgt

SEQ ID NO: 623700 - DNA, 25 bp, Mus musculus
ggcttcagtctaccatggaacccag

SEQ ID NO: 623701 - DNA, 25 bp, Mus musculus
ggcttcagtctagcatggaacccag

SEQ ID NO: 623702 - DNA, 25 bp, Mus musculus
ggcttcagtctgaacaagggccctg

SEQ ID NO: 623703 - DNA, 25 bp, Mus musculus
ggcttcagtctgtacaagggccctg

SEQ ID NO: 623704 - DNA, 25 bp, Mus musculus
ggcttcagtgccatagtgtttattt

SEQ ID NO: 623705 - DNA, 25 bp, Mus musculus
ggcttcagtgccttagtgtttattt

SEQ ID NO: 623706 - DNA, 25 bp, Mus musculus
ggcttcagtgttagtaaccctcacc

SEQ ID NO: 623707 - DNA, 25 bp, Mus musculus
ggcttcagtgttagtccagtactca

SEQ ID NO: 623708 - DNA, 25 bp, Mus musculus
ggcttcagtgtttgtaaccctcacc

SEQ ID NO: 623709 - DNA, 25 bp, Mus musculus
ggcttcagtgtttgtccagtactca

SEQ ID NO: 623710 - DNA, 25 bp, Mus musculus
ggcttcagtttaatatgaccttgga

SEQ ID NO: 623711 - DNA, 25 bp, Mus musculus
ggcttcagtttattatgaccttgga

SEQ ID NO: 623712 - DNA, 25 bp, Mus musculus
ggcttcagtttcatagtctagtcat

SEQ ID NO: 623713 - DNA, 25 bp, Mus musculus
ggcttcagtttcttagtctagtcat

SEQ ID NO: 623714 - DNA, 25 bp, Mus musculus
ggcttcataagcactcggtgaccat

SEQ ID NO: 623715 - DNA, 25 bp, Mus musculus
ggcttcataagctctcggtgaccat

SEQ ID NO: 623716 - DNA, 25 bp, Mus musculus
ggcttcatatagatccacacaggag

SEQ ID NO: 623717 - DNA, 25 bp, Mus musculus
ggcttcatatagttccacacaggag

SEQ ID NO: 623718 - DNA, 25 bp, Mus musculus
ggcttcatcagtcgtcctagagcta

SEQ ID NO: 623719 - DNA, 25 bp, Mus musculus
ggcttcatcagtggtcctagagcta

SEQ ID NO: 623720 - DNA, 25 bp, Mus musculus
ggcttcatccccagtatctaaagaa

SEQ ID NO: 623721 - DNA, 25 bp, Mus musculus
ggcttcatcccctgtatctaaagaa

SEQ ID NO: 623722 - DNA, 25 bp, Mus musculus
ggcttcatcctacagcatgaggcaa

SEQ ID NO: 623723 - DNA, 25 bp, Mus musculus
ggcttcatcctagagcatgaggcaa

SEQ ID NO: 623724 - DNA, 25 bp, Mus musculus
ggcttcatctgtaatattcagtcaa

SEQ ID NO: 623725 - DNA, 25 bp, Mus musculus
ggcttcatctgttatattcagtcaa

SEQ ID NO: 623726 - DNA, 25 bp, Mus musculus
ggcttcatgaatccgctcttaccaa

SEQ ID NO: 623727 - DNA, 25 bp, Mus musculus
ggcttcatgaatgcgctcttaccaa

SEQ ID NO: 623728 - DNA, 25 bp, Mus musculus
ggcttcatgagcattgtgacaacca

SEQ ID NO: 623729 - DNA, 25 bp, Mus musculus
ggcttcatgagctttgtgacaacca

SEQ ID NO: 623730 - DNA, 25 bp, Mus musculus
ggcttcatgattagactggttttcc

SEQ ID NO: 623731 - DNA, 25 bp, Mus musculus
ggcttcatgatttgactggttttcc

SEQ ID NO: 623732 - DNA, 25 bp, Mus musculus
ggcttcatggaacccaccaggagtg

SEQ ID NO: 623733 - DNA, 25 bp, Mus musculus
ggcttcatggaacgttcctgtttga

SEQ ID NO: 623734 - DNA, 25 bp, Mus musculus
ggcttcatggaagccaccaggagtg

SEQ ID NO: 623735 - DNA, 25 bp, Mus musculus
ggcttcatggaaggttcctgtttga

SEQ ID NO: 623736 - DNA, 25 bp, Mus musculus
ggcttcatggccaggaaggtctctt

SEQ ID NO: 623737 - DNA, 25 bp, Mus musculus
ggcttcatggcctggaaggtctctt

SEQ ID NO: 623738 - DNA, 25 bp, Mus musculus
ggcttcatggctcgctctcgagaga

SEQ ID NO: 623739 - DNA, 25 bp, Mus musculus
ggcttcatggctggctctcgagaga

SEQ ID NO: 623740 - DNA, 25 bp, Mus musculus
ggcttcatgtagatccagatgggac

SEQ ID NO: 623741 - DNA, 25 bp, Mus musculus
ggcttcatgtagttccagatgggac

SEQ ID NO: 623742 - DNA, 25 bp, Mus musculus
ggcttcatgtgaactatggtattat

SEQ ID NO: 623743 - DNA, 25 bp, Mus musculus
ggcttcatgtgatctatggtattat

SEQ ID NO: 623744 - DNA, 25 bp, Mus musculus
ggcttcattaggaattggcttggtg

SEQ ID NO: 623745 - DNA, 25 bp, Mus musculus
ggcttcattaggtattggcttggtg

SEQ ID NO: 623746 - DNA, 25 bp, Mus musculus
ggcttcattcaaaatctctctggtc

SEQ ID NO: 623747 - DNA, 25 bp, Mus musculus
ggcttcattcaatatctctctggtc

SEQ ID NO: 623748 - DNA, 25 bp, Mus musculus
ggcttcattggacccctaaagttca

SEQ ID NO: 623749 - DNA, 25 bp, Mus musculus
ggcttcattggagccctaaagttca

SEQ ID NO: 623750 - DNA, 25 bp, Mus musculus
ggcttcatttctcttgtggttttac

SEQ ID NO: 623751 - DNA, 25 bp, Mus musculus
ggcttcatttctgttgtggttttac

SEQ ID NO: 623752 - DNA, 25 bp, Mus musculus
ggcttccaaaatctaattatctgct

SEQ ID NO: 623753 - DNA, 25 bp, Mus musculus
ggcttccaaaatgtaattatctgct

SEQ ID NO: 623754 - DNA, 25 bp, Mus musculus
ggcttccaacataatccagagatat

SEQ ID NO: 623755 - DNA, 25 bp, Mus musculus
ggcttccaacattatccagagatat

SEQ ID NO: 623756 - DNA, 25 bp, Mus musculus
ggcttccaacctacgtcatatgtag

SEQ ID NO: 623757 - DNA, 25 bp, Mus musculus
ggcttccaaccttcgtcatatgtag

SEQ ID NO: 623758 - DNA, 25 bp, Mus musculus
ggcttccaagacaaaacccgagcag

SEQ ID NO: 623759 - DNA, 25 bp, Mus musculus
ggcttccaagactaaacccgagcag

SEQ ID NO: 623760 - DNA, 25 bp, Mus musculus
ggcttccaagcaaaaatcttccctg

SEQ ID NO: 623761 - DNA, 25 bp, Mus musculus
ggcttccaagcataaatcttccctg

SEQ ID NO: 623762 - DNA, 25 bp, Mus musculus
ggcttccaagggatttccatgggat

SEQ ID NO: 623763 - DNA, 25 bp, Mus musculus
ggcttccaagggttttccatgggat

SEQ ID NO: 623764 - DNA, 25 bp, Mus musculus
ggcttccaagtacctccgagtgaac

SEQ ID NO: 623765 - DNA, 25 bp, Mus musculus
ggcttccaagtagctccgagtgaac

SEQ ID NO: 623766 - DNA, 25 bp, Mus musculus
ggcttccacaacatgaatgagcttc

SEQ ID NO: 623767 - DNA, 25 bp, Mus musculus
ggcttccacaacttgaatgagcttc

SEQ ID NO: 623768 - DNA, 25 bp, Mus musculus
ggcttccacatgactgtttcttagt

SEQ ID NO: 623769 - DNA, 25 bp, Mus musculus
ggcttccacatgtctgtttcttagt

SEQ ID NO: 623770 - DNA, 25 bp, Mus musculus
ggcttccaccatcagtggattcctt

SEQ ID NO: 623771 - DNA, 25 bp, Mus musculus
ggcttccaccatccaaggtagtata

SEQ ID NO: 623772 - DNA, 25 bp, Mus musculus
ggcttccaccatgagtggattcctt

SEQ ID NO: 623773 - DNA, 25 bp, Mus musculus
ggcttccaccatgcaaggtagtata

SEQ ID NO: 623774 - DNA, 25 bp, Mus musculus
ggcttccactacaggccaagagcgg

SEQ ID NO: 623775 - DNA, 25 bp, Mus musculus
ggcttccactactggccaagagcgg

SEQ ID NO: 623776 - DNA, 25 bp, Mus musculus
ggcttccacttgaaaatatgctaag

SEQ ID NO: 623777 - DNA, 25 bp, Mus musculus
ggcttccacttgcaaggttttttag

SEQ ID NO: 623778 - DNA, 25 bp, Mus musculus
ggcttccacttgcatggctattcta

SEQ ID NO: 623779 - DNA, 25 bp, Mus musculus
ggcttccacttggaaggttttttag

SEQ ID NO: 623780 - DNA, 25 bp, Mus musculus
ggcttccacttggatggctattcta

SEQ ID NO: 623781 - DNA, 25 bp, Mus musculus
ggcttccacttgtaaatatgctaag

SEQ ID NO: 623782 - DNA, 25 bp, Mus musculus
ggcttccagacgcagatgacgacgc

SEQ ID NO: 623783 - DNA, 25 bp, Mus musculus
ggcttccagacggagatgacgacgc

SEQ ID NO: 623784 - DNA, 25 bp, Mus musculus
ggcttccagagacctcacattgtat

SEQ ID NO: 623785 - DNA, 25 bp, Mus musculus
ggcttccagagagctcacattgtat

SEQ ID NO: 623786 - DNA, 25 bp, Mus musculus
ggcttccagcgccacgaagggacta

SEQ ID NO: 623787 - DNA, 25 bp, Mus musculus
ggcttccagcgcgacgaagggacta

SEQ ID NO: 623788 - DNA, 25 bp, Mus musculus
ggcttccaggagacaggatggactt

SEQ ID NO: 623789 - DNA, 25 bp, Mus musculus
ggcttccaggagtcaggatggactt

SEQ ID NO: 623790 - DNA, 25 bp, Mus musculus
ggcttccaggctctagaactagggt

SEQ ID NO: 623791 - DNA, 25 bp, Mus musculus
ggcttccaggctgtagaactagggt

SEQ ID NO: 623792 - DNA, 25 bp, Mus musculus
ggcttccaggtcactttgtagctaa

SEQ ID NO: 623793 - DNA, 25 bp, Mus musculus
ggcttccaggtctctttgtagctaa

SEQ ID NO: 623794 - DNA, 25 bp, Mus musculus
ggcttccagtaaaccactttactct

SEQ ID NO: 623795 - DNA, 25 bp, Mus musculus
ggcttccagtaatccactttactct

SEQ ID NO: 623796 - DNA, 25 bp, Mus musculus
ggcttccagtcaaattaccttcttt

SEQ ID NO: 623797 - DNA, 25 bp, Mus musculus
ggcttccagtcatattaccttcttt

SEQ ID NO: 623798 - DNA, 25 bp, Mus musculus
ggcttccataaaagactagttgcta

SEQ ID NO: 623799 - DNA, 25 bp, Mus musculus
ggcttccataaatgactagttgcta

SEQ ID NO: 623800 - DNA, 25 bp, Mus musculus
ggcttccataccctcaagtgagcaa

SEQ ID NO: 623801 - DNA, 25 bp, Mus musculus
ggcttccataccgtcaagtgagcaa

SEQ ID NO: 623802 - DNA, 25 bp, Mus musculus
ggcttccatagaacctttgatggca

SEQ ID NO: 623803 - DNA, 25 bp, Mus musculus
ggcttccatagatcctttgatggca

SEQ ID NO: 623804 - DNA, 25 bp, Mus musculus
ggcttccatcttactgaatcgatta

SEQ ID NO: 623805 - DNA, 25 bp, Mus musculus
ggcttccatctttctgaatcgatta

SEQ ID NO: 623806 - DNA, 25 bp, Mus musculus
ggcttccatgagatttacctttgac

SEQ ID NO: 623807 - DNA, 25 bp, Mus musculus
ggcttccatgagttttacctttgac

SEQ ID NO: 623808 - DNA, 25 bp, Mus musculus
ggcttccattccagtagatggtaag

SEQ ID NO: 623809 - DNA, 25 bp, Mus musculus
ggcttccattcctgtagatggtaag

SEQ ID NO: 623810 - DNA, 25 bp, Mus musculus
ggcttccattctaatgtttcagttg

SEQ ID NO: 623811 - DNA, 25 bp, Mus musculus
ggcttccattcttatgtttcagttg

SEQ ID NO: 623812 - DNA, 25 bp, Mus musculus
ggcttcccaaacaagggcatttctg

SEQ ID NO: 623813 - DNA, 25 bp, Mus musculus
ggcttcccaaactagggcatttctg

SEQ ID NO: 623814 - DNA, 25 bp, Mus musculus
ggcttcccaaatcccttggcagaaa

SEQ ID NO: 623815 - DNA, 25 bp, Mus musculus
ggcttcccaaatgccttggcagaaa

SEQ ID NO: 623816 - DNA, 25 bp, Mus musculus
ggcttcccacgcaacatttattaaa

SEQ ID NO: 623817 - DNA, 25 bp, Mus musculus
ggcttcccacgctacatttattaaa

SEQ ID NO: 623818 - DNA, 25 bp, Mus musculus
ggcttcccagaacaggaccagagca

SEQ ID NO: 623819 - DNA, 25 bp, Mus musculus
ggcttcccagaagaggaccagagca

SEQ ID NO: 623820 - DNA, 25 bp, Mus musculus
ggcttcccagctcatgactgacaaa

SEQ ID NO: 623821 - DNA, 25 bp, Mus musculus
ggcttcccagctgatgactgacaaa

SEQ ID NO: 623822 - DNA, 25 bp, Mus musculus
ggcttcccagggaactagcactcag

SEQ ID NO: 623823 - DNA, 25 bp, Mus musculus
ggcttcccagggtactagcactcag

SEQ ID NO: 623824 - DNA, 25 bp, Mus musculus
ggcttcccaggtccatcacaggtga

SEQ ID NO: 623825 - DNA, 25 bp, Mus musculus
ggcttcccaggtgcatcacaggtga

SEQ ID NO: 623826 - DNA, 25 bp, Mus musculus
ggcttccccaatactggcatggata

SEQ ID NO: 623827 - DNA, 25 bp, Mus musculus
ggcttccccaattctggcatggata

SEQ ID NO: 623828 - DNA, 25 bp, Mus musculus
ggcttccctaacatatgccttaaga

SEQ ID NO: 623829 - DNA, 25 bp, Mus musculus
ggcttccctaacttatgccttaaga

SEQ ID NO: 623830 - DNA, 25 bp, Mus musculus
ggcttccctaagataatacctatgg

SEQ ID NO: 623831 - DNA, 25 bp, Mus musculus
ggcttccctaagttaatacctatgg

SEQ ID NO: 623832 - DNA, 25 bp, Mus musculus
ggcttccctagtaatgggctacagt

SEQ ID NO: 623833 - DNA, 25 bp, Mus musculus
ggcttccctagttatgggctacagt

SEQ ID NO: 623834 - DNA, 25 bp, Mus musculus
ggcttccctatacccatattgtatg

SEQ ID NO: 623835 - DNA, 25 bp, Mus musculus
ggcttccctatagccatattgtatg

SEQ ID NO: 623836 - DNA, 25 bp, Mus musculus
ggcttccctcgaagaccgattgtaa

SEQ ID NO: 623837 - DNA, 25 bp, Mus musculus
ggcttccctcgatgaccgattgtaa

SEQ ID NO: 623838 - DNA, 25 bp, Mus musculus
ggcttccctcggagttttactgatt

SEQ ID NO: 623839 - DNA, 25 bp, Mus musculus
ggcttccctcggtgttttactgatt

SEQ ID NO: 623840 - DNA, 25 bp, Mus musculus
ggcttccctcgtcgtttatcctggc

SEQ ID NO: 623841 - DNA, 25 bp, Mus musculus
ggcttccctcgtggtttatcctggc

SEQ ID NO: 623842 - DNA, 25 bp, Mus musculus
ggcttccctgggatataccaagaca

SEQ ID NO: 623843 - DNA, 25 bp, Mus musculus
ggcttccctgggttataccaagaca

SEQ ID NO: 623844 - DNA, 25 bp, Mus musculus
ggcttcccttgcaaataagcgcttt

SEQ ID NO: 623845 - DNA, 25 bp, Mus musculus
ggcttcccttgctaataagcgcttt

SEQ ID NO: 623846 - DNA, 25 bp, Mus musculus
ggcttccctttcaacttattcttca

SEQ ID NO: 623847 - DNA, 25 bp, Mus musculus
ggcttccctttctacttattcttca

SEQ ID NO: 623848 - DNA, 25 bp, Mus musculus
ggcttccggagcaataacccaaatg

SEQ ID NO: 623849 - DNA, 25 bp, Mus musculus
ggcttccggagctataacccaaatg

SEQ ID NO: 623850 - DNA, 25 bp, Mus musculus
ggcttccggcccaagagcaaagcaa

SEQ ID NO: 623851 - DNA, 25 bp, Mus musculus
ggcttccggccctagagcaaagcaa

SEQ ID NO: 623852 - DNA, 25 bp, Mus musculus
ggcttccggtgacgctaagcccaaa

SEQ ID NO: 623853 - DNA, 25 bp, Mus musculus
ggcttccggtgaggctaagcccaaa

SEQ ID NO: 623854 - DNA, 25 bp, Mus musculus
ggcttccgtgtgaccacgctgggtc

SEQ ID NO: 623855 - DNA, 25 bp, Mus musculus
ggcttccgtgtgtccacgctgggtc

SEQ ID NO: 623856 - DNA, 25 bp, Mus musculus
ggcttcctaaagatcctgcaatggc

SEQ ID NO: 623857 - DNA, 25 bp, Mus musculus
ggcttcctaaagttcctgcaatggc

SEQ ID NO: 623858 - DNA, 25 bp, Mus musculus
ggcttcctaaggacttaactgctat

SEQ ID NO: 623859 - DNA, 25 bp, Mus musculus
ggcttcctaaggtcttaactgctat

SEQ ID NO: 623860 - DNA, 25 bp, Mus musculus
ggcttcctaattatgttccttggat

SEQ ID NO: 623861 - DNA, 25 bp, Mus musculus
ggcttcctaattttgttccttggat

SEQ ID NO: 623862 - DNA, 25 bp, Mus musculus
ggcttcctacacagcagtgtttctg

SEQ ID NO: 623863 - DNA, 25 bp, Mus musculus
ggcttcctacactgcagtgtttctg

SEQ ID NO: 623864 - DNA, 25 bp, Mus musculus
ggcttcctactcaaacaactgcata

SEQ ID NO: 623865 - DNA, 25 bp, Mus musculus
ggcttcctactctaacaactgcata

SEQ ID NO: 623866 - DNA, 25 bp, Mus musculus
ggcttcctacttcggtatagcatgt

SEQ ID NO: 623867 - DNA, 25 bp, Mus musculus
ggcttcctacttgggtatagcatgt

SEQ ID NO: 623868 - DNA, 25 bp, Mus musculus
ggcttcctcaagcaaaggttccttt

SEQ ID NO: 623869 - DNA, 25 bp, Mus musculus
ggcttcctcaaggaaaggttccttt

SEQ ID NO: 623870 - DNA, 25 bp, Mus musculus
ggcttcctcaggaactgaatgcatg

SEQ ID NO: 623871 - DNA, 25 bp, Mus musculus
ggcttcctcaggtactgaatgcatg

SEQ ID NO: 623872 - DNA, 25 bp, Mus musculus
ggcttcctcatcctttaatgtgaca

SEQ ID NO: 623873 - DNA, 25 bp, Mus musculus
ggcttcctcatcgtttaatgtgaca

SEQ ID NO: 623874 - DNA, 25 bp, Mus musculus
ggcttcctcattatacattttcagt

SEQ ID NO: 623875 - DNA, 25 bp, Mus musculus
ggcttcctcattttacattttcagt

SEQ ID NO: 623876 - DNA, 25 bp, Mus musculus
ggcttcctccagacacaaaagtcta

SEQ ID NO: 623877 - DNA, 25 bp, Mus musculus
ggcttcctccagtcacaaaagtcta

SEQ ID NO: 623878 - DNA, 25 bp, Mus musculus
ggcttcctcccgcaatgtgtgacaa

SEQ ID NO: 623879 - DNA, 25 bp, Mus musculus
ggcttcctcccggaatgtgtgacaa

SEQ ID NO: 623880 - DNA, 25 bp, Mus musculus
ggcttcctctgcaatgtctgatata

SEQ ID NO: 623881 - DNA, 25 bp, Mus musculus
ggcttcctctgctatgtctgatata

SEQ ID NO: 623882 - DNA, 25 bp, Mus musculus
ggcttcctgaacatctgcatagatt

SEQ ID NO: 623883 - DNA, 25 bp, Mus musculus
ggcttcctgaacttctgcatagatt

SEQ ID NO: 623884 - DNA, 25 bp, Mus musculus
ggcttcctgaggatgttcattctta

SEQ ID NO: 623885 - DNA, 25 bp, Mus musculus
ggcttcctgaggttgttcattctta

SEQ ID NO: 623886 - DNA, 25 bp, Mus musculus
ggcttcctgcaaaccggactcggga

SEQ ID NO: 623887 - DNA, 25 bp, Mus musculus
ggcttcctgcaatccggactcggga

SEQ ID NO: 623888 - DNA, 25 bp, Mus musculus
ggcttcctgcagatagaggccatga

SEQ ID NO: 623889 - DNA, 25 bp, Mus musculus
ggcttcctgcagttagaggccatga

SEQ ID NO: 623890 - DNA, 25 bp, Mus musculus
ggcttcctgccaaagtcatgctgag

SEQ ID NO: 623891 - DNA, 25 bp, Mus musculus
ggcttcctgccatagtcatgctgag

SEQ ID NO: 623892 - DNA, 25 bp, Mus musculus
ggcttcctgcccatcatgaagtaaa

SEQ ID NO: 623893 - DNA, 25 bp, Mus musculus
ggcttcctgcccttcatgaagtaaa

SEQ ID NO: 623894 - DNA, 25 bp, Mus musculus
ggcttcctgcctcctagggcaggaa

SEQ ID NO: 623895 - DNA, 25 bp, Mus musculus
ggcttcctgcctgctagggcaggaa

SEQ ID NO: 623896 - DNA, 25 bp, Mus musculus
ggcttcctggacatcgacgtggaga

SEQ ID NO: 623897 - DNA, 25 bp, Mus musculus
ggcttcctggacttcgacgtggaga

SEQ ID NO: 623898 - DNA, 25 bp, Mus musculus
ggcttcctggatcaggcattcgtga

SEQ ID NO: 623899 - DNA, 25 bp, Mus musculus
ggcttcctggatgaggcattcgtga

SEQ ID NO: 623900 - DNA, 25 bp, Mus musculus
ggcttcctgggaacagcggttttta

SEQ ID NO: 623901 - DNA, 25 bp, Mus musculus
ggcttcctgggaacagtcctgtgag

SEQ ID NO: 623902 - DNA, 25 bp, Mus musculus
ggcttcctgggaattgtcataactg

SEQ ID NO: 623903 - DNA, 25 bp, Mus musculus
ggcttcctgggatcagcggttttta

SEQ ID NO: 623904 - DNA, 25 bp, Mus musculus
ggcttcctgggatcagtcctgtgag

SEQ ID NO: 623905 - DNA, 25 bp, Mus musculus
ggcttcctgggatttgtcataactg

SEQ ID NO: 623906 - DNA, 25 bp, Mus musculus
ggcttcctgggcagtgcgtttaaca

SEQ ID NO: 623907 - DNA, 25 bp, Mus musculus
ggcttcctgggctgtgcgtttaaca

SEQ ID NO: 623908 - DNA, 25 bp, Mus musculus
ggcttcctggtactagatgtcccat

SEQ ID NO: 623909 - DNA, 25 bp, Mus musculus
ggcttcctggtagtagatgtcccat

SEQ ID NO: 623910 - DNA, 25 bp, Mus musculus
ggcttcctgtcaagtacaaattaat

SEQ ID NO: 623911 - DNA, 25 bp, Mus musculus
ggcttcctgtcatgtacaaattaat

SEQ ID NO: 623912 - DNA, 25 bp, Mus musculus
ggcttcctgtgacagcttccaatga

SEQ ID NO: 623913 - DNA, 25 bp, Mus musculus
ggcttcctgtgagagcttccaatga

SEQ ID NO: 623914 - DNA, 25 bp, Mus musculus
ggcttcctgtggagctgaaccaact

SEQ ID NO: 623915 - DNA, 25 bp, Mus musculus
ggcttcctgtggatcaaaatagttc

SEQ ID NO: 623916 - DNA, 25 bp, Mus musculus
ggcttcctgtggtgctgaaccaact

SEQ ID NO: 623917 - DNA, 25 bp, Mus musculus
ggcttcctgtggttcaaaatagttc

SEQ ID NO: 623918 - DNA, 25 bp, Mus musculus
ggcttcctgtttctgtacgtccggg

SEQ ID NO: 623919 - DNA, 25 bp, Mus musculus
ggcttcctgtttgtgtacgtccggg

SEQ ID NO: 623920 - DNA, 25 bp, Mus musculus
ggcttccttacgacagcaccttctt

SEQ ID NO: 623921 - DNA, 25 bp, Mus musculus
ggcttccttacgtcagcaccttctt

SEQ ID NO: 623922 - DNA, 25 bp, Mus musculus
ggcttccttcaccacataaactagg

SEQ ID NO: 623923 - DNA, 25 bp, Mus musculus
ggcttccttcacgacataaactagg

SEQ ID NO: 623924 - DNA, 25 bp, Mus musculus
ggcttccttctgaatagcactgcat

SEQ ID NO: 623925 - DNA, 25 bp, Mus musculus
ggcttccttctgtatagcactgcat

SEQ ID NO: 623926 - DNA, 25 bp, Mus musculus
ggcttccttgagcaactgtccctaa

SEQ ID NO: 623927 - DNA, 25 bp, Mus musculus
ggcttccttgaggaactgtccctaa

SEQ ID NO: 623928 - DNA, 25 bp, Mus musculus
ggcttcctttgaacattgtacatac

SEQ ID NO: 623929 - DNA, 25 bp, Mus musculus
ggcttcctttgatcattgtacatac

SEQ ID NO: 623930 - DNA, 25 bp, Mus musculus
ggcttcctttttccaattaagtgtg

SEQ ID NO: 623931 - DNA, 25 bp, Mus musculus
ggcttcctttttgcaattaagtgtg

SEQ ID NO: 623932 - DNA, 25 bp, Mus musculus
ggcttcgacatgagactgcttttta

SEQ ID NO: 623933 - DNA, 25 bp, Mus musculus
ggcttcgacatgtgactgcttttta

SEQ ID NO: 623934 - DNA, 25 bp, Mus musculus
ggcttcgaccaaccccaaagaaaat

SEQ ID NO: 623935 - DNA, 25 bp, Mus musculus
ggcttcgaccaagcccaaagaaaat

SEQ ID NO: 623936 - DNA, 25 bp, Mus musculus
ggcttcgacttgcaccctggaacat

SEQ ID NO: 623937 - DNA, 25 bp, Mus musculus
ggcttcgacttggaccctggaacat

SEQ ID NO: 623938 - DNA, 25 bp, Mus musculus
ggcttcgagtaactctggatcctga

SEQ ID NO: 623939 - DNA, 25 bp, Mus musculus
ggcttcgagtaagtctggatcctga

SEQ ID NO: 623940 - DNA, 25 bp, Mus musculus
ggcttcgcgggccacgatgctcccc

SEQ ID NO: 623941 - DNA, 25 bp, Mus musculus
ggcttcgcgggcgacgatgctcccc

SEQ ID NO: 623942 - DNA, 25 bp, Mus musculus
ggcttcgcttcgatagatactggat

SEQ ID NO: 623943 - DNA, 25 bp, Mus musculus
ggcttcgcttcgttagatactggat

SEQ ID NO: 623944 - DNA, 25 bp, Mus musculus
ggcttcggactaaacctggagcaca

SEQ ID NO: 623945 - DNA, 25 bp, Mus musculus
ggcttcggactatacctggagcaca

SEQ ID NO: 623946 - DNA, 25 bp, Mus musculus
ggcttcggagtgaagctgttccaga

SEQ ID NO: 623947 - DNA, 25 bp, Mus musculus
ggcttcggagtgtagctgttccaga

SEQ ID NO: 623948 - DNA, 25 bp, Mus musculus
ggcttcggatgcatcaagagtgaac

SEQ ID NO: 623949 - DNA, 25 bp, Mus musculus
ggcttcggatgcttcaagagtgaac

SEQ ID NO: 623950 - DNA, 25 bp, Mus musculus
ggcttcgggaccaagtacctaagag

SEQ ID NO: 623951 - DNA, 25 bp, Mus musculus
ggcttcgggaccatctggctgagaa

SEQ ID NO: 623952 - DNA, 25 bp, Mus musculus
ggcttcgggacctagtacctaagag

SEQ ID NO: 623953 - DNA, 25 bp, Mus musculus
ggcttcgggaccttctggctgagaa

SEQ ID NO: 623954 - DNA, 25 bp, Mus musculus
ggcttcgggtgtacatctgctgtaa

SEQ ID NO: 623955 - DNA, 25 bp, Mus musculus
ggcttcgggtgttcatctgctgtaa

SEQ ID NO: 623956 - DNA, 25 bp, Mus musculus
ggcttcgtacacaacttccaggaga

SEQ ID NO: 623957 - DNA, 25 bp, Mus musculus
ggcttcgtacactacttccaggaga

SEQ ID NO: 623958 - DNA, 25 bp, Mus musculus
ggcttcgtactgctacacgtgtttt

SEQ ID NO: 623959 - DNA, 25 bp, Mus musculus
ggcttcgtactggtacacgtgtttt

SEQ ID NO: 623960 - DNA, 25 bp, Mus musculus
ggcttcgtccgcatcgaggatttca

SEQ ID NO: 623961 - DNA, 25 bp, Mus musculus
ggcttcgtccgcttcgaggatttca

SEQ ID NO: 623962 - DNA, 25 bp, Mus musculus
ggcttcgtcttaaacacatttctca

SEQ ID NO: 623963 - DNA, 25 bp, Mus musculus
ggcttcgtcttatacacatttctca

SEQ ID NO: 623964 - DNA, 25 bp, Mus musculus
ggcttcgtgatgactgtggctgtgg

SEQ ID NO: 623965 - DNA, 25 bp, Mus musculus
ggcttcgtgatgtctgtggctgtgg

SEQ ID NO: 623966 - DNA, 25 bp, Mus musculus
ggcttcgtgcgaaaggtagtctgac

SEQ ID NO: 623967 - DNA, 25 bp, Mus musculus
ggcttcgtgcgataggtagtctgac

SEQ ID NO: 623968 - DNA, 25 bp, Mus musculus
ggcttcgtggaaagtgttttgcagt

SEQ ID NO: 623969 - DNA, 25 bp, Mus musculus
ggcttcgtggaatgtgttttgcagt

SEQ ID NO: 623970 - DNA, 25 bp, Mus musculus
ggcttcgtgtccagcttgtaagaaa

SEQ ID NO: 623971 - DNA, 25 bp, Mus musculus
ggcttcgtgtcctgcttgtaagaaa

SEQ ID NO: 623972 - DNA, 25 bp, Mus musculus
ggcttcgtgttcacttgaaactcat

SEQ ID NO: 623973 - DNA, 25 bp, Mus musculus
ggcttcgtgttctcttgaaactcat

SEQ ID NO: 623974 - DNA, 25 bp, Mus musculus
ggcttcgttaagagtcttcagtgac

SEQ ID NO: 623975 - DNA, 25 bp, Mus musculus
ggcttcgttaagtgtcttcagtgac

SEQ ID NO: 623976 - DNA, 25 bp, Mus musculus
ggcttcgttaataaatgtcatgttg

SEQ ID NO: 623977 - DNA, 25 bp, Mus musculus
ggcttcgttaattaatgtcatgttg

SEQ ID NO: 623978 - DNA, 25 bp, Mus musculus
ggcttctaaaatacactcccatgga

SEQ ID NO: 623979 - DNA, 25 bp, Mus musculus
ggcttctaaaattcactcccatgga

SEQ ID NO: 623980 - DNA, 25 bp, Mus musculus
ggcttctaaacaccggagcaaagtg

SEQ ID NO: 623981 - DNA, 25 bp, Mus musculus
ggcttctaaacagcggagcaaagtg

SEQ ID NO: 623982 - DNA, 25 bp, Mus musculus
ggcttctaaggcctggctgcagaac

SEQ ID NO: 623983 - DNA, 25 bp, Mus musculus
ggcttctaaggcgtggctgcagaac

SEQ ID NO: 623984 - DNA, 25 bp, Mus musculus
ggcttctacaataaccgactgcagg

SEQ ID NO: 623985 - DNA, 25 bp, Mus musculus
ggcttctacaattaccgactgcagg

SEQ ID NO: 623986 - DNA, 25 bp, Mus musculus
ggcttctacaggatttcaaccttct

SEQ ID NO: 623987 - DNA, 25 bp, Mus musculus
ggcttctacaggttttcaaccttct

SEQ ID NO: 623988 - DNA, 25 bp, Mus musculus
ggcttctaccctctgaagattcaga

SEQ ID NO: 623989 - DNA, 25 bp, Mus musculus
ggcttctaccctgtgaagattcaga

SEQ ID NO: 623990 - DNA, 25 bp, Mus musculus
ggcttctacttccatgtgtgttgtt

SEQ ID NO: 623991 - DNA, 25 bp, Mus musculus
ggcttctacttcgatgtgtgttgtt

SEQ ID NO: 623992 - DNA, 25 bp, Mus musculus
ggcttctaggccaacaacagcacaa

SEQ ID NO: 623993 - DNA, 25 bp, Mus musculus
ggcttctaggcctacaacagcacaa

SEQ ID NO: 623994 - DNA, 25 bp, Mus musculus
ggcttctagggtacttagatcacca

SEQ ID NO: 623995 - DNA, 25 bp, Mus musculus
ggcttctagggttcttagatcacca

SEQ ID NO: 623996 - DNA, 25 bp, Mus musculus
ggcttctataacaagttggtcacac

SEQ ID NO: 623997 - DNA, 25 bp, Mus musculus
ggcttctataacctcagtagaattc

SEQ ID NO: 623998 - DNA, 25 bp, Mus musculus
ggcttctataacgtcagtagaattc

SEQ ID NO: 623999 - DNA, 25 bp, Mus musculus
ggcttctataactagttggtcacac

SEQ ID NO: 624000 - DNA, 25 bp, Mus musculus
ggcttctatccaaatgctatcgagt

SEQ ID NO: 624001 - DNA, 25 bp, Mus musculus
ggcttctatccatatgctatcgagt

SEQ ID NO: 624002 - DNA, 25 bp, Mus musculus
ggcttctatctacgacatgcctgaa

SEQ ID NO: 624003 - DNA, 25 bp, Mus musculus
ggcttctatctaggacatgcctgaa

SEQ ID NO: 624004 - DNA, 25 bp, Mus musculus
ggcttctatgaacaccccagttcta

SEQ ID NO: 624005 - DNA, 25 bp, Mus musculus
ggcttctatgaagaccccagttcta

SEQ ID NO: 624006 - DNA, 25 bp, Mus musculus
ggcttctatgttccctttcttggaa

SEQ ID NO: 624007 - DNA, 25 bp, Mus musculus
ggcttctatgttgcctttcttggaa

SEQ ID NO: 624008 - DNA, 25 bp, Mus musculus
ggcttctcacatatatagtctgtgt

SEQ ID NO: 624009 - DNA, 25 bp, Mus musculus
ggcttctcacatttatagtctgtgt

SEQ ID NO: 624010 - DNA, 25 bp, Mus musculus
ggcttctcactcaggaggtgactga

SEQ ID NO: 624011 - DNA, 25 bp, Mus musculus
ggcttctcactctggaggtgactga

SEQ ID NO: 624012 - DNA, 25 bp, Mus musculus
ggcttctcagccaggaaactatgga

SEQ ID NO: 624013 - DNA, 25 bp, Mus musculus
ggcttctcagcctggaaactatgga

SEQ ID NO: 624014 - DNA, 25 bp, Mus musculus
ggcttctcagctacaggtcactgaa

SEQ ID NO: 624015 - DNA, 25 bp, Mus musculus
ggcttctcagcttcaggtcactgaa

SEQ ID NO: 624016 - DNA, 25 bp, Mus musculus
ggcttctcaggaacctagtctccta

SEQ ID NO: 624017 - DNA, 25 bp, Mus musculus
ggcttctcaggatcctagtctccta

SEQ ID NO: 624018 - DNA, 25 bp, Mus musculus
ggcttctccatccatgtgcgagatt

SEQ ID NO: 624019 - DNA, 25 bp, Mus musculus
ggcttctccatcgatgtgcgagatt

SEQ ID NO: 624020 - DNA, 25 bp, Mus musculus
ggcttctccatgctgcatcatgagg

SEQ ID NO: 624021 - DNA, 25 bp, Mus musculus
ggcttctccatggtgcatcatgagg

SEQ ID NO: 624022 - DNA, 25 bp, Mus musculus
ggcttctcccagcatactgaatgga

SEQ ID NO: 624023 - DNA, 25 bp, Mus musculus
ggcttctcccaggatactgaatgga

SEQ ID NO: 624024 - DNA, 25 bp, Mus musculus
ggcttctcctgcacataggtcaaaa

SEQ ID NO: 624025 - DNA, 25 bp, Mus musculus
ggcttctcctgctcataggtcaaaa

SEQ ID NO: 624026 - DNA, 25 bp, Mus musculus
ggcttctcggcaatggctaaaactg

SEQ ID NO: 624027 - DNA, 25 bp, Mus musculus
ggcttctcggcattggctaaaactg

SEQ ID NO: 624028 - DNA, 25 bp, Mus musculus
ggcttctctatcctctatgggttta

SEQ ID NO: 624029 - DNA, 25 bp, Mus musculus
ggcttctctatcgtctatgggttta

SEQ ID NO: 624030 - DNA, 25 bp, Mus musculus
ggcttctctattagtctcttttctt

SEQ ID NO: 624031 - DNA, 25 bp, Mus musculus
ggcttctctatttgtctcttttctt

SEQ ID NO: 624032 - DNA, 25 bp, Mus musculus
ggcttctctcagctagtgattgtga

SEQ ID NO: 624033 - DNA, 25 bp, Mus musculus
ggcttctctcaggtagtgattgtga

SEQ ID NO: 624034 - DNA, 25 bp, Mus musculus
ggcttctctcatctacaatacttta

SEQ ID NO: 624035 - DNA, 25 bp, Mus musculus
ggcttctctcatgtacaatacttta

SEQ ID NO: 624036 - DNA, 25 bp, Mus musculus
ggcttctctgaacgtgtatccccac

SEQ ID NO: 624037 - DNA, 25 bp, Mus musculus
ggcttctctgaaggtgtatccccac

SEQ ID NO: 624038 - DNA, 25 bp, Mus musculus
ggcttctctgatcttgccatgcaag

SEQ ID NO: 624039 - DNA, 25 bp, Mus musculus
ggcttctctgatgttgccatgcaag

SEQ ID NO: 624040 - DNA, 25 bp, Mus musculus
ggcttctcttaaagatgggctggga

SEQ ID NO: 624041 - DNA, 25 bp, Mus musculus
ggcttctcttaatgatgggctggga

SEQ ID NO: 624042 - DNA, 25 bp, Mus musculus
ggcttctctttgaagtagggcttcc

SEQ ID NO: 624043 - DNA, 25 bp, Mus musculus
ggcttctctttgagcccttggacaa

SEQ ID NO: 624044 - DNA, 25 bp, Mus musculus
ggcttctctttgtagtagggcttcc

SEQ ID NO: 624045 - DNA, 25 bp, Mus musculus
ggcttctctttgtgcccttggacaa

SEQ ID NO: 624046 - DNA, 25 bp, Mus musculus
ggcttctgaatgacttggccaccat

SEQ ID NO: 624047 - DNA, 25 bp, Mus musculus
ggcttctgaatgtcttggccaccat

SEQ ID NO: 624048 - DNA, 25 bp, Mus musculus
ggcttctgaattaagcatcacttaa

SEQ ID NO: 624049 - DNA, 25 bp, Mus musculus
ggcttctgaatttagcatcacttaa

SEQ ID NO: 624050 - DNA, 25 bp, Mus musculus
ggcttctgacaacactatacaattt

SEQ ID NO: 624051 - DNA, 25 bp, Mus musculus
ggcttctgacaagactatacaattt

SEQ ID NO: 624052 - DNA, 25 bp, Mus musculus
ggcttctgagacatcgtcgtgtgga

SEQ ID NO: 624053 - DNA, 25 bp, Mus musculus
ggcttctgagacttcgtcgtgtgga

SEQ ID NO: 624054 - DNA, 25 bp, Mus musculus
ggcttctgagatcctttaatgcaac

SEQ ID NO: 624055 - DNA, 25 bp, Mus musculus
ggcttctgagatgctttaatgcaac

SEQ ID NO: 624056 - DNA, 25 bp, Mus musculus
ggcttctgaggtactcaatcttaca

SEQ ID NO: 624057 - DNA, 25 bp, Mus musculus
ggcttctgaggttctcaatcttaca

SEQ ID NO: 624058 - DNA, 25 bp, Mus musculus
ggcttctgagtgcacaacagggctc

SEQ ID NO: 624059 - DNA, 25 bp, Mus musculus
ggcttctgagtggacaacagggctc

SEQ ID NO: 624060 - DNA, 25 bp, Mus musculus
ggcttctgcaacctaccatagtgaa

SEQ ID NO: 624061 - DNA, 25 bp, Mus musculus
ggcttctgcaacgtaccatagtgaa

SEQ ID NO: 624062 - DNA, 25 bp, Mus musculus
ggcttctgcaggcatctctgtctga

SEQ ID NO: 624063 - DNA, 25 bp, Mus musculus
ggcttctgcagggatctctgtctga

SEQ ID NO: 624064 - DNA, 25 bp, Mus musculus
ggcttctgcagtcatttgttatctg

SEQ ID NO: 624065 - DNA, 25 bp, Mus musculus
ggcttctgcagtgatttgttatctg

SEQ ID NO: 624066 - DNA, 25 bp, Mus musculus
ggcttctgcctacagtttgacctat

SEQ ID NO: 624067 - DNA, 25 bp, Mus musculus
ggcttctgcctagagtttgacctat

SEQ ID NO: 624068 - DNA, 25 bp, Mus musculus
ggcttctgctgcctacaggtaggat

SEQ ID NO: 624069 - DNA, 25 bp, Mus musculus
ggcttctgctgcgtacaggtaggat

SEQ ID NO: 624070 - DNA, 25 bp, Mus musculus
ggcttctgctggcaattcaagatgg

SEQ ID NO: 624071 - DNA, 25 bp, Mus musculus
ggcttctgctgggaattcaagatgg

SEQ ID NO: 624072 - DNA, 25 bp, Mus musculus
ggcttctgcttcacttctaagatga

SEQ ID NO: 624073 - DNA, 25 bp, Mus musculus
ggcttctgcttctcttctaagatga

SEQ ID NO: 624074 - DNA, 25 bp, Mus musculus
ggcttctggcctcacaatacaatag

SEQ ID NO: 624075 - DNA, 25 bp, Mus musculus
ggcttctggcctgacaatacaatag

SEQ ID NO: 624076 - DNA, 25 bp, Mus musculus
ggcttctggctgactgaagtcaacc

SEQ ID NO: 624077 - DNA, 25 bp, Mus musculus
ggcttctggctgtctgaagtcaacc

SEQ ID NO: 624078 - DNA, 25 bp, Mus musculus
ggcttctggcttagagactcaggga

SEQ ID NO: 624079 - DNA, 25 bp, Mus musculus
ggcttctggctttgagactcaggga

SEQ ID NO: 624080 - DNA, 25 bp, Mus musculus
ggcttctggttccacaccttcagga

SEQ ID NO: 624081 - DNA, 25 bp, Mus musculus
ggcttctggttcgacaccttcagga

SEQ ID NO: 624082 - DNA, 25 bp, Mus musculus
ggcttctgtcctcattaatatatag

SEQ ID NO: 624083 - DNA, 25 bp, Mus musculus
ggcttctgtcctgattaatatatag

SEQ ID NO: 624084 - DNA, 25 bp, Mus musculus
ggcttcttaatacatctagctccca

SEQ ID NO: 624085 - DNA, 25 bp, Mus musculus
ggcttcttaatagatctagctccca

SEQ ID NO: 624086 - DNA, 25 bp, Mus musculus
ggcttcttacatcacaaggttcctg

SEQ ID NO: 624087 - DNA, 25 bp, Mus musculus
ggcttcttacatgacaaggttcctg

SEQ ID NO: 624088 - DNA, 25 bp, Mus musculus
ggcttcttaccaattattctcgatt

SEQ ID NO: 624089 - DNA, 25 bp, Mus musculus
ggcttcttaccatttattctcgatt

SEQ ID NO: 624090 - DNA, 25 bp, Mus musculus
ggcttcttacctacatattccgaga

SEQ ID NO: 624091 - DNA, 25 bp, Mus musculus
ggcttcttacctcgtttgtttacat

SEQ ID NO: 624092 - DNA, 25 bp, Mus musculus
ggcttcttacctggtttgtttacat

SEQ ID NO: 624093 - DNA, 25 bp, Mus musculus
ggcttcttaccttcatattccgaga

SEQ ID NO: 624094 - DNA, 25 bp, Mus musculus
ggcttcttagagcttctggtggtaa

SEQ ID NO: 624095 - DNA, 25 bp, Mus musculus
ggcttcttagaggttctggtggtaa

SEQ ID NO: 624096 - DNA, 25 bp, Mus musculus
ggcttcttagatacctggaccttgg

SEQ ID NO: 624097 - DNA, 25 bp, Mus musculus
ggcttcttagattcctggaccttgg

SEQ ID NO: 624098 - DNA, 25 bp, Mus musculus
ggcttcttagcaaaagtgacccaca

SEQ ID NO: 624099 - DNA, 25 bp, Mus musculus
ggcttcttagcataagtgacccaca

SEQ ID NO: 624100 - DNA, 25 bp, Mus musculus
ggcttcttaggccacatagagtcaa

SEQ ID NO: 624101 - DNA, 25 bp, Mus musculus
ggcttcttaggcgacatagagtcaa

SEQ ID NO: 624102 - DNA, 25 bp, Mus musculus
ggcttcttattgacctaggcaggta

SEQ ID NO: 624103 - DNA, 25 bp, Mus musculus
ggcttcttattgtcctaggcaggta

SEQ ID NO: 624104 - DNA, 25 bp, Mus musculus
ggcttcttcagcagctaccagcagg

SEQ ID NO: 624105 - DNA, 25 bp, Mus musculus
ggcttcttcagctgctaccagcagg

SEQ ID NO: 624106 - DNA, 25 bp, Mus musculus
ggcttcttcatcagggttgacttga

SEQ ID NO: 624107 - DNA, 25 bp, Mus musculus
ggcttcttcatcattacgttctaga

SEQ ID NO: 624108 - DNA, 25 bp, Mus musculus
ggcttcttcatctgggttgacttga

SEQ ID NO: 624109 - DNA, 25 bp, Mus musculus
ggcttcttcatctttacgttctaga

SEQ ID NO: 624110 - DNA, 25 bp, Mus musculus
ggcttcttcattccccagtaacatg

SEQ ID NO: 624111 - DNA, 25 bp, Mus musculus
ggcttcttcattgcccagtaacatg

SEQ ID NO: 624112 - DNA, 25 bp, Mus musculus
ggcttcttccagagacatgggctgt

SEQ ID NO: 624113 - DNA, 25 bp, Mus musculus
ggcttcttccagtgacatgggctgt

SEQ ID NO: 624114 - DNA, 25 bp, Mus musculus
ggcttcttcctaaatgctgtttgta

SEQ ID NO: 624115 - DNA, 25 bp, Mus musculus
ggcttcttcctacctggtggaaaca

SEQ ID NO: 624116 - DNA, 25 bp, Mus musculus
ggcttcttcctagctggtggaaaca

SEQ ID NO: 624117 - DNA, 25 bp, Mus musculus
ggcttcttcctatatgctgtttgta

SEQ ID NO: 624118 - DNA, 25 bp, Mus musculus
ggcttcttctctacagtgtccttta

SEQ ID NO: 624119 - DNA, 25 bp, Mus musculus
ggcttcttctcttcagtgtccttta

SEQ ID NO: 624120 - DNA, 25 bp, Mus musculus
ggcttcttctgtaaggctcagccca

SEQ ID NO: 624121 - DNA, 25 bp, Mus musculus
ggcttcttctgttaggctcagccca

SEQ ID NO: 624122 - DNA, 25 bp, Mus musculus
ggcttcttgaacatgaccttattca

SEQ ID NO: 624123 - DNA, 25 bp, Mus musculus
ggcttcttgaacttgaccttattca

SEQ ID NO: 624124 - DNA, 25 bp, Mus musculus
ggcttcttgagacaaatattcctgt

SEQ ID NO: 624125 - DNA, 25 bp, Mus musculus
ggcttcttgagagaaatattcctgt

SEQ ID NO: 624126 - DNA, 25 bp, Mus musculus
ggcttcttgattcaagacgcccatg

SEQ ID NO: 624127 - DNA, 25 bp, Mus musculus
ggcttcttgattgaagacgcccatg

SEQ ID NO: 624128 - DNA, 25 bp, Mus musculus
ggcttcttgcaacacatcctttcaa

SEQ ID NO: 624129 - DNA, 25 bp, Mus musculus
ggcttcttgcaagacatcctttcaa

SEQ ID NO: 624130 - DNA, 25 bp, Mus musculus
ggcttcttgccaatacttcctggga

SEQ ID NO: 624131 - DNA, 25 bp, Mus musculus
ggcttcttgccattacttcctggga

SEQ ID NO: 624132 - DNA, 25 bp, Mus musculus
ggcttcttgtacaattgaagttgga

SEQ ID NO: 624133 - DNA, 25 bp, Mus musculus
ggcttcttgtactattgaagttgga

SEQ ID NO: 624134 - DNA, 25 bp, Mus musculus
ggcttctttcaacttacttttcaca

SEQ ID NO: 624135 - DNA, 25 bp, Mus musculus
ggcttctttcaagttacttttcaca

SEQ ID NO: 624136 - DNA, 25 bp, Mus musculus
ggcttctttcacacttgcattttag

SEQ ID NO: 624137 - DNA, 25 bp, Mus musculus
ggcttctttcactcttgcattttag

SEQ ID NO: 624138 - DNA, 25 bp, Mus musculus
ggcttctttcctacctagattcata

SEQ ID NO: 624139 - DNA, 25 bp, Mus musculus
ggcttctttccttcctagattcata

SEQ ID NO: 624140 - DNA, 25 bp, Mus musculus
ggcttctttgttctaaccacatgtt

SEQ ID NO: 624141 - DNA, 25 bp, Mus musculus
ggcttctttgttgtaaccacatgtt

SEQ ID NO: 624142 - DNA, 25 bp, Mus musculus
ggcttcttttttcagcacatgtaca

SEQ ID NO: 624143 - DNA, 25 bp, Mus musculus
ggcttcttttttccatgttacagtt

SEQ ID NO: 624144 - DNA, 25 bp, Mus musculus
ggcttcttttttgagcacatgtaca

SEQ ID NO: 624145 - DNA, 25 bp, Mus musculus
ggcttcttttttgcatgttacagtt

SEQ ID NO: 624146 - DNA, 25 bp, Mus musculus
ggcttgaaaatcagctttatcattt

SEQ ID NO: 624147 - DNA, 25 bp, Mus musculus
ggcttgaaaatctgctttatcattt

SEQ ID NO: 624148 - DNA, 25 bp, Mus musculus
ggcttgaaagcgatacaggtagcta

SEQ ID NO: 624149 - DNA, 25 bp, Mus musculus
ggcttgaaagcgttacaggtagcta

SEQ ID NO: 624150 - DNA, 25 bp, Mus musculus
ggcttgaacaagaactcagggatgg

SEQ ID NO: 624151 - DNA, 25 bp, Mus musculus
ggcttgaacaagtactcagggatgg

SEQ ID NO: 624152 - DNA, 25 bp, Mus musculus
ggcttgaacatcctcccagagaaaa

SEQ ID NO: 624153 - DNA, 25 bp, Mus musculus
ggcttgaacatcgtcccagagaaaa

SEQ ID NO: 624154 - DNA, 25 bp, Mus musculus
ggcttgaaccttaccagagcatctg

SEQ ID NO: 624155 - DNA, 25 bp, Mus musculus
ggcttgaacctttccagagcatctg

SEQ ID NO: 624156 - DNA, 25 bp, Mus musculus
ggcttgaactcaccaggtgacgtga

SEQ ID NO: 624157 - DNA, 25 bp, Mus musculus
ggcttgaactcagcaggtgacgtga

SEQ ID NO: 624158 - DNA, 25 bp, Mus musculus
ggcttgaactcccagctggctgttc

SEQ ID NO: 624159 - DNA, 25 bp, Mus musculus
ggcttgaactccgagctggctgttc

SEQ ID NO: 624160 - DNA, 25 bp, Mus musculus
ggcttgaacttcaatggcatggatt

SEQ ID NO: 624161 - DNA, 25 bp, Mus musculus
ggcttgaacttctatggcatggatt

SEQ ID NO: 624162 - DNA, 25 bp, Mus musculus
ggcttgaagattacctaaggctaaa

SEQ ID NO: 624163 - DNA, 25 bp, Mus musculus
ggcttgaagatttcctaaggctaaa

SEQ ID NO: 624164 - DNA, 25 bp, Mus musculus
ggcttgaatgtaagatccacactgt

SEQ ID NO: 624165 - DNA, 25 bp, Mus musculus
ggcttgaatgtatgatccacactgt

SEQ ID NO: 624166 - DNA, 25 bp, Mus musculus
ggcttgacaaatcactagtatttac

SEQ ID NO: 624167 - DNA, 25 bp, Mus musculus
ggcttgacaaatgactagtatttac

SEQ ID NO: 624168 - DNA, 25 bp, Mus musculus
ggcttgacagcaaccttagtggaca

SEQ ID NO: 624169 - DNA, 25 bp, Mus musculus
ggcttgacagcatccttagtggaca

SEQ ID NO: 624170 - DNA, 25 bp, Mus musculus
ggcttgacccaaagataggtttcca

SEQ ID NO: 624171 - DNA, 25 bp, Mus musculus
ggcttgacccaatgataggtttcca

SEQ ID NO: 624172 - DNA, 25 bp, Mus musculus
ggcttgaccgtgatgaccccacagg

SEQ ID NO: 624173 - DNA, 25 bp, Mus musculus
ggcttgaccgtgttgaccccacagg

SEQ ID NO: 624174 - DNA, 25 bp, Mus musculus
ggcttgacctggcacttgtgttaaa

SEQ ID NO: 624175 - DNA, 25 bp, Mus musculus
ggcttgacctgggacttgtgttaaa

SEQ ID NO: 624176 - DNA, 25 bp, Mus musculus
ggcttgacctttagaacttgttaca

SEQ ID NO: 624177 - DNA, 25 bp, Mus musculus
ggcttgaccttttgaacttgttaca

SEQ ID NO: 624178 - DNA, 25 bp, Mus musculus
ggcttgacgattatgtgtacacaat

SEQ ID NO: 624179 - DNA, 25 bp, Mus musculus
ggcttgacgattttgtgtacacaat

SEQ ID NO: 624180 - DNA, 25 bp, Mus musculus
ggcttgacttccaaattctgtattc

SEQ ID NO: 624181 - DNA, 25 bp, Mus musculus
ggcttgacttcccaggatgaacaca

SEQ ID NO: 624182 - DNA, 25 bp, Mus musculus
ggcttgacttccgaggatgaacaca

SEQ ID NO: 624183 - DNA, 25 bp, Mus musculus
ggcttgacttcctaattctgtattc

SEQ ID NO: 624184 - DNA, 25 bp, Mus musculus
ggcttgagatctctggtttgactta

SEQ ID NO: 624185 - DNA, 25 bp, Mus musculus
ggcttgagatctgtggtttgactta

SEQ ID NO: 624186 - DNA, 25 bp, Mus musculus
ggcttgagatttcatctgctctcct

SEQ ID NO: 624187 - DNA, 25 bp, Mus musculus
ggcttgagatttgatctgctctcct

SEQ ID NO: 624188 - DNA, 25 bp, Mus musculus
ggcttgaggctcacatggcatgtag

SEQ ID NO: 624189 - DNA, 25 bp, Mus musculus
ggcttgaggctctcatggcatgtag

SEQ ID NO: 624190 - DNA, 25 bp, Mus musculus
ggcttgagtcagacctactatgtag

SEQ ID NO: 624191 - DNA, 25 bp, Mus musculus
ggcttgagtcagtcctactatgtag

SEQ ID NO: 624192 - DNA, 25 bp, Mus musculus
ggcttgataataccacagtggccaa

SEQ ID NO: 624193 - DNA, 25 bp, Mus musculus
ggcttgataatagcacagtggccaa

SEQ ID NO: 624194 - DNA, 25 bp, Mus musculus
ggcttgatacagcatcattgtgaga

SEQ ID NO: 624195 - DNA, 25 bp, Mus musculus
ggcttgatacaggatcattgtgaga

SEQ ID NO: 624196 - DNA, 25 bp, Mus musculus
ggcttgatcccaacaccttggaaaa

SEQ ID NO: 624197 - DNA, 25 bp, Mus musculus
ggcttgatcccatcaccttggaaaa

SEQ ID NO: 624198 - DNA, 25 bp, Mus musculus
ggcttgatccttcccgaatcgggta

SEQ ID NO: 624199 - DNA, 25 bp, Mus musculus
ggcttgatccttgccgaatcgggta

SEQ ID NO: 624200 - DNA, 25 bp, Mus musculus
ggcttgatgaagaacacaggctgat

SEQ ID NO: 624201 - DNA, 25 bp, Mus musculus
ggcttgatgaagtacacaggctgat

SEQ ID NO: 624202 - DNA, 25 bp, Mus musculus
ggcttgatgaataccagggctgtga

SEQ ID NO: 624203 - DNA, 25 bp, Mus musculus
ggcttgatgaattccagggctgtga

SEQ ID NO: 624204 - DNA, 25 bp, Mus musculus
ggcttgatgtccatatgcccaagag

SEQ ID NO: 624205 - DNA, 25 bp, Mus musculus
ggcttgatgtccttatgcccaagag

SEQ ID NO: 624206 - DNA, 25 bp, Mus musculus
ggcttgattcccaatactagatgaa

SEQ ID NO: 624207 - DNA, 25 bp, Mus musculus
ggcttgattccctatactagatgaa

SEQ ID NO: 624208 - DNA, 25 bp, Mus musculus
ggcttgatttctaatagttactgac

SEQ ID NO: 624209 - DNA, 25 bp, Mus musculus
ggcttgatttcttatagttactgac

SEQ ID NO: 624210 - DNA, 25 bp, Mus musculus
ggcttgcaaaccaacattagtcgtg

SEQ ID NO: 624211 - DNA, 25 bp, Mus musculus
ggcttgcaaacctacattagtcgtg

SEQ ID NO: 624212 - DNA, 25 bp, Mus musculus
ggcttgcaaagaccacggttcccaa

SEQ ID NO: 624213 - DNA, 25 bp, Mus musculus
ggcttgcaaagagcacggttcccaa

SEQ ID NO: 624214 - DNA, 25 bp, Mus musculus
ggcttgcaaaggcaccagtgtgtaa

SEQ ID NO: 624215 - DNA, 25 bp, Mus musculus
ggcttgcaaagggaccagtgtgtaa

SEQ ID NO: 624216 - DNA, 25 bp, Mus musculus
ggcttgcaaccacacaaatgttttg

SEQ ID NO: 624217 - DNA, 25 bp, Mus musculus
ggcttgcaaccagacaaatgttttg

SEQ ID NO: 624218 - DNA, 25 bp, Mus musculus
ggcttgcaagctaacattttccatt

SEQ ID NO: 624219 - DNA, 25 bp, Mus musculus
ggcttgcaagcttacattttccatt

SEQ ID NO: 624220 - DNA, 25 bp, Mus musculus
ggcttgcacacaatgccctaagaga

SEQ ID NO: 624221 - DNA, 25 bp, Mus musculus
ggcttgcacacattgccctaagaga

SEQ ID NO: 624222 - DNA, 25 bp, Mus musculus
ggcttgcagacactttggaactcca

SEQ ID NO: 624223 - DNA, 25 bp, Mus musculus
ggcttgcagacagtttggaactcca

SEQ ID NO: 624224 - DNA, 25 bp, Mus musculus
ggcttgcagcgcatctttgagacac

SEQ ID NO: 624225 - DNA, 25 bp, Mus musculus
ggcttgcagcgcctggcgtatccaa

SEQ ID NO: 624226 - DNA, 25 bp, Mus musculus
ggcttgcagcgcgtggcgtatccaa

SEQ ID NO: 624227 - DNA, 25 bp, Mus musculus
ggcttgcagcgcttctttgagacac

SEQ ID NO: 624228 - DNA, 25 bp, Mus musculus
ggcttgcagctgagcaccactgcat

SEQ ID NO: 624229 - DNA, 25 bp, Mus musculus
ggcttgcagctgtgcaccactgcat

SEQ ID NO: 624230 - DNA, 25 bp, Mus musculus
ggcttgcaggccacgaacgcagtgt

SEQ ID NO: 624231 - DNA, 25 bp, Mus musculus
ggcttgcaggcctcgaacgcagtgt

SEQ ID NO: 624232 - DNA, 25 bp, Mus musculus
ggcttgcatcctcttgtgtattctt

SEQ ID NO: 624233 - DNA, 25 bp, Mus musculus
ggcttgcatcctgttgtgtattctt

SEQ ID NO: 624234 - DNA, 25 bp, Mus musculus
ggcttgcatgctatgtgtttaaggc

SEQ ID NO: 624235 - DNA, 25 bp, Mus musculus
ggcttgcatgctttgtgtttaaggc

SEQ ID NO: 624236 - DNA, 25 bp, Mus musculus
ggcttgcattctaggtaacctcgaa

SEQ ID NO: 624237 - DNA, 25 bp, Mus musculus
ggcttgcattcttggtaacctcgaa

SEQ ID NO: 624238 - DNA, 25 bp, Mus musculus
ggcttgccagcacacgtacctgaga

SEQ ID NO: 624239 - DNA, 25 bp, Mus musculus
ggcttgccagcagacgtacctgaga

SEQ ID NO: 624240 - DNA, 25 bp, Mus musculus
ggcttgccatagcatctttctgaga

SEQ ID NO: 624241 - DNA, 25 bp, Mus musculus
ggcttgccataggatctttctgaga

SEQ ID NO: 624242 - DNA, 25 bp, Mus musculus
ggcttgccccaaacagttctgtaag

SEQ ID NO: 624243 - DNA, 25 bp, Mus musculus
ggcttgccccaatcagttctgtaag

SEQ ID NO: 624244 - DNA, 25 bp, Mus musculus
ggcttgcctcaacagccagctgcaa

SEQ ID NO: 624245 - DNA, 25 bp, Mus musculus
ggcttgcctcaagagccagctgcaa

SEQ ID NO: 624246 - DNA, 25 bp, Mus musculus
ggcttgcctcagactgtgtacatag

SEQ ID NO: 624247 - DNA, 25 bp, Mus musculus
ggcttgcctcagtctgtgtacatag

SEQ ID NO: 624248 - DNA, 25 bp, Mus musculus
ggcttgcgacaacgactctcagtgc

SEQ ID NO: 624249 - DNA, 25 bp, Mus musculus
ggcttgcgacaaggactctcagtgc

SEQ ID NO: 624250 - DNA, 25 bp, Mus musculus
ggcttgcgcagtagagtcaggtcat

SEQ ID NO: 624251 - DNA, 25 bp, Mus musculus
ggcttgcgcagttgagtcaggtcat

SEQ ID NO: 624252 - DNA, 25 bp, Mus musculus
ggcttgcgccaacctcagaacttga

SEQ ID NO: 624253 - DNA, 25 bp, Mus musculus
ggcttgcgccaagctcagaacttga

SEQ ID NO: 624254 - DNA, 25 bp, Mus musculus
ggcttgcggctcactgtgctagtat

SEQ ID NO: 624255 - DNA, 25 bp, Mus musculus
ggcttgcggctctctgtgctagtat

SEQ ID NO: 624256 - DNA, 25 bp, Mus musculus
ggcttgcgttcaatgctcttgagat

SEQ ID NO: 624257 - DNA, 25 bp, Mus musculus
ggcttgcgttcattgctcttgagat

SEQ ID NO: 624258 - DNA, 25 bp, Mus musculus
ggcttgctacatatacacgttcaca

SEQ ID NO: 624259 - DNA, 25 bp, Mus musculus
ggcttgctacatttacacgttcaca

SEQ ID NO: 624260 - DNA, 25 bp, Mus musculus
ggcttgctcagtccatgcaaactga

SEQ ID NO: 624261 - DNA, 25 bp, Mus musculus
ggcttgctcagtgcatgcaaactga

SEQ ID NO: 624262 - DNA, 25 bp, Mus musculus
ggcttgctccagctttgcgaggaaa

SEQ ID NO: 624263 - DNA, 25 bp, Mus musculus
ggcttgctccaggtttgcgaggaaa

SEQ ID NO: 624264 - DNA, 25 bp, Mus musculus
ggcttgctctggctaaaatctgtga

SEQ ID NO: 624265 - DNA, 25 bp, Mus musculus
ggcttgctctgggtaaaatctgtga

SEQ ID NO: 624266 - DNA, 25 bp, Mus musculus
ggcttgctcttgagattaaacactt

SEQ ID NO: 624267 - DNA, 25 bp, Mus musculus
ggcttgctcttgtgattaaacactt

SEQ ID NO: 624268 - DNA, 25 bp, Mus musculus
ggcttgctgaaaatgaccttgaact

SEQ ID NO: 624269 - DNA, 25 bp, Mus musculus
ggcttgctgaaattgaccttgaact

SEQ ID NO: 624270 - DNA, 25 bp, Mus musculus
ggcttgctgattatcactatactta

SEQ ID NO: 624271 - DNA, 25 bp, Mus musculus
ggcttgctgattttcactatactta

SEQ ID NO: 624272 - DNA, 25 bp, Mus musculus
ggcttgctgcaacttgccattatta

SEQ ID NO: 624273 - DNA, 25 bp, Mus musculus
ggcttgctgcaagttgccattatta

SEQ ID NO: 624274 - DNA, 25 bp, Mus musculus
ggcttgctggctcacctttcaagat

SEQ ID NO: 624275 - DNA, 25 bp, Mus musculus
ggcttgctggctgacctttcaagat

SEQ ID NO: 624276 - DNA, 25 bp, Mus musculus
ggcttgcttagaagtgctcattttc

SEQ ID NO: 624277 - DNA, 25 bp, Mus musculus
ggcttgcttagatgtgctcattttc

SEQ ID NO: 624278 - DNA, 25 bp, Mus musculus
ggcttgcttgctagcatagatagct

SEQ ID NO: 624279 - DNA, 25 bp, Mus musculus
ggcttgcttgcttgcatagatagct

SEQ ID NO: 624280 - DNA, 25 bp, Mus musculus
ggcttgctttataaatttgtctgtt

SEQ ID NO: 624281 - DNA, 25 bp, Mus musculus
ggcttgctttatctaggatgaaaat

SEQ ID NO: 624282 - DNA, 25 bp, Mus musculus
ggcttgctttatgtaggatgaaaat

SEQ ID NO: 624283 - DNA, 25 bp, Mus musculus
ggcttgctttattaatttgtctgtt

SEQ ID NO: 624284 - DNA, 25 bp, Mus musculus
ggcttgctttgtatcctagtttgta

SEQ ID NO: 624285 - DNA, 25 bp, Mus musculus
ggcttgctttgtttcctagtttgta

SEQ ID NO: 624286 - DNA, 25 bp, Mus musculus
ggcttgcttttaatatgtgctttcc

SEQ ID NO: 624287 - DNA, 25 bp, Mus musculus
ggcttgcttttattatgtgctttcc

SEQ ID NO: 624288 - DNA, 25 bp, Mus musculus
ggcttgctttttctgtcaaattgac

SEQ ID NO: 624289 - DNA, 25 bp, Mus musculus
ggcttgctttttgtgtcaaattgac

SEQ ID NO: 624290 - DNA, 25 bp, Mus musculus
ggcttggaacaaatttctagtcttg

SEQ ID NO: 624291 - DNA, 25 bp, Mus musculus
ggcttggaacaattttctagtcttg

SEQ ID NO: 624292 - DNA, 25 bp, Mus musculus
ggcttggaactcacgatcctgggaa

SEQ ID NO: 624293 - DNA, 25 bp, Mus musculus
ggcttggaactctcgatcctgggaa

SEQ ID NO: 624294 - DNA, 25 bp, Mus musculus
ggcttggacagccagtcatgccatg

SEQ ID NO: 624295 - DNA, 25 bp, Mus musculus
ggcttggacagcgagtcatgccatg

SEQ ID NO: 624296 - DNA, 25 bp, Mus musculus
ggcttggaccagcacatacatcatc

SEQ ID NO: 624297 - DNA, 25 bp, Mus musculus
ggcttggaccaggacatacatcatc

SEQ ID NO: 624298 - DNA, 25 bp, Mus musculus
ggcttggacgctctaggttaaaact

SEQ ID NO: 624299 - DNA, 25 bp, Mus musculus
ggcttggacgctgtaggttaaaact

SEQ ID NO: 624300 - DNA, 25 bp, Mus musculus
ggcttggactggctctgtcctctgt

SEQ ID NO: 624301 - DNA, 25 bp, Mus musculus
ggcttggactgggtctgtcctctgt

SEQ ID NO: 624302 - DNA, 25 bp, Mus musculus
ggcttggagaatacttggagttgct

SEQ ID NO: 624303 - DNA, 25 bp, Mus musculus
ggcttggagaattcttggagttgct

SEQ ID NO: 624304 - DNA, 25 bp, Mus musculus
ggcttggaggcacctgattttctta

SEQ ID NO: 624305 - DNA, 25 bp, Mus musculus
ggcttggaggcagctgattttctta

SEQ ID NO: 624306 - DNA, 25 bp, Mus musculus
ggcttggaggtcaaacattttctgg

SEQ ID NO: 624307 - DNA, 25 bp, Mus musculus
ggcttggaggtctaacattttctgg

SEQ ID NO: 624308 - DNA, 25 bp, Mus musculus
ggcttggatgaccacactgcagtga

SEQ ID NO: 624309 - DNA, 25 bp, Mus musculus
ggcttggatgacgacactgcagtga

SEQ ID NO: 624310 - DNA, 25 bp, Mus musculus
ggcttggatgtcaatcagatgcaac

SEQ ID NO: 624311 - DNA, 25 bp, Mus musculus
ggcttggatgtctatcagatgcaac

SEQ ID NO: 624312 - DNA, 25 bp, Mus musculus
ggcttggattacacagtgctgagga

SEQ ID NO: 624313 - DNA, 25 bp, Mus musculus
ggcttggattactcagtgctgagga

SEQ ID NO: 624314 - DNA, 25 bp, Mus musculus
ggcttggattcaaccagatcttaac

SEQ ID NO: 624315 - DNA, 25 bp, Mus musculus
ggcttggattcatccagatcttaac

SEQ ID NO: 624316 - DNA, 25 bp, Mus musculus
ggcttggattgcattatgtcaaatc

SEQ ID NO: 624317 - DNA, 25 bp, Mus musculus
ggcttggattgctttatgtcaaatc

SEQ ID NO: 624318 - DNA, 25 bp, Mus musculus
ggcttggattttcatacccttcacc

SEQ ID NO: 624319 - DNA, 25 bp, Mus musculus
ggcttggattttgatacccttcacc

SEQ ID NO: 624320 - DNA, 25 bp, Mus musculus
ggcttggcaaggcagttcattttac

SEQ ID NO: 624321 - DNA, 25 bp, Mus musculus
ggcttggcaagggagttcattttac

SEQ ID NO: 624322 - DNA, 25 bp, Mus musculus
ggcttggcagagaggcatgttccca

SEQ ID NO: 624323 - DNA, 25 bp, Mus musculus
ggcttggcagagtggcatgttccca

SEQ ID NO: 624324 - DNA, 25 bp, Mus musculus
ggcttggcagcaaactccttgtatc

SEQ ID NO: 624325 - DNA, 25 bp, Mus musculus
ggcttggcagcatactccttgtatc

SEQ ID NO: 624326 - DNA, 25 bp, Mus musculus
ggcttggcagtgagttcttggttac

SEQ ID NO: 624327 - DNA, 25 bp, Mus musculus
ggcttggcagtgtgttcttggttac

SEQ ID NO: 624328 - DNA, 25 bp, Mus musculus
ggcttggcccgactgactgcaaaag

SEQ ID NO: 624329 - DNA, 25 bp, Mus musculus
ggcttggcccgagtgactgcaaaag

SEQ ID NO: 624330 - DNA, 25 bp, Mus musculus
ggcttggcccttatggggagtgtga

SEQ ID NO: 624331 - DNA, 25 bp, Mus musculus
ggcttggcccttttggggagtgtga

SEQ ID NO: 624332 - DNA, 25 bp, Mus musculus
ggcttggcctcaactgggaatggtt

SEQ ID NO: 624333 - DNA, 25 bp, Mus musculus
ggcttggcctcatctgggaatggtt

SEQ ID NO: 624334 - DNA, 25 bp, Mus musculus
ggcttggccttacggactaatcaga

SEQ ID NO: 624335 - DNA, 25 bp, Mus musculus
ggcttggccttagggactaatcaga

SEQ ID NO: 624336 - DNA, 25 bp, Mus musculus
ggcttggcgcggacattttagaaat

SEQ ID NO: 624337 - DNA, 25 bp, Mus musculus
ggcttggcgcggtcattttagaaat

SEQ ID NO: 624338 - DNA, 25 bp, Mus musculus
ggcttggcgctcaggttagtactgt

SEQ ID NO: 624339 - DNA, 25 bp, Mus musculus
ggcttggcgctctggttagtactgt

SEQ ID NO: 624340 - DNA, 25 bp, Mus musculus
ggcttggcggttctggctaaaaact

SEQ ID NO: 624341 - DNA, 25 bp, Mus musculus
ggcttggcggttgtggctaaaaact

SEQ ID NO: 624342 - DNA, 25 bp, Mus musculus
ggcttggctccacaatgcatataga

SEQ ID NO: 624343 - DNA, 25 bp, Mus musculus
ggcttggctccagaatgcatataga

SEQ ID NO: 624344 - DNA, 25 bp, Mus musculus
ggcttggctgggaatggtcaatcat

SEQ ID NO: 624345 - DNA, 25 bp, Mus musculus
ggcttggctgggtatggtcaatcat

SEQ ID NO: 624346 - DNA, 25 bp, Mus musculus
ggcttggctgtaagattgaccttcc

SEQ ID NO: 624347 - DNA, 25 bp, Mus musculus
ggcttggctgtatgattgaccttcc

SEQ ID NO: 624348 - DNA, 25 bp, Mus musculus
ggcttggcttcacgacctccagctg

SEQ ID NO: 624349 - DNA, 25 bp, Mus musculus
ggcttggcttcaggacctccagctg

SEQ ID NO: 624350 - DNA, 25 bp, Mus musculus
ggcttgggactgaggactctctaaa

SEQ ID NO: 624351 - DNA, 25 bp, Mus musculus
ggcttgggactgtggactctctaaa

SEQ ID NO: 624352 - DNA, 25 bp, Mus musculus
ggcttgggcctaactttaagtattg

SEQ ID NO: 624353 - DNA, 25 bp, Mus musculus
ggcttgggcctacagaacgacagta

SEQ ID NO: 624354 - DNA, 25 bp, Mus musculus
ggcttgggcctagagaacgacagta

SEQ ID NO: 624355 - DNA, 25 bp, Mus musculus
ggcttgggcctatctttaagtattg

SEQ ID NO: 624356 - DNA, 25 bp, Mus musculus
ggcttgggctgaacgaatcggacac

SEQ ID NO: 624357 - DNA, 25 bp, Mus musculus
ggcttgggctgatcgaatcggacac

SEQ ID NO: 624358 - DNA, 25 bp, Mus musculus
ggcttgggtatgaagctcaggcttt

SEQ ID NO: 624359 - DNA, 25 bp, Mus musculus
ggcttgggtatgtagctcaggcttt

SEQ ID NO: 624360 - DNA, 25 bp, Mus musculus
ggcttgggtcttcgctaactgtgaa

SEQ ID NO: 624361 - DNA, 25 bp, Mus musculus
ggcttgggtcttggctaactgtgaa

SEQ ID NO: 624362 - DNA, 25 bp, Mus musculus
ggcttgggttttatatcgagcaaca

SEQ ID NO: 624363 - DNA, 25 bp, Mus musculus
ggcttgggttttttatcgagcaaca

SEQ ID NO: 624364 - DNA, 25 bp, Mus musculus
ggcttggtaaacagatgcctttatc

SEQ ID NO: 624365 - DNA, 25 bp, Mus musculus
ggcttggtaaactgatgcctttatc

SEQ ID NO: 624366 - DNA, 25 bp, Mus musculus
ggcttggtacctctggcctatgtga

SEQ ID NO: 624367 - DNA, 25 bp, Mus musculus
ggcttggtacctgtggcctatgtga

SEQ ID NO: 624368 - DNA, 25 bp, Mus musculus
ggcttggtagacaatccagatgatg

SEQ ID NO: 624369 - DNA, 25 bp, Mus musculus
ggcttggtagactatccagatgatg

SEQ ID NO: 624370 - DNA, 25 bp, Mus musculus
ggcttggtagccatgagcttcctgt

SEQ ID NO: 624371 - DNA, 25 bp, Mus musculus
ggcttggtagccttgagcttcctgt

SEQ ID NO: 624372 - DNA, 25 bp, Mus musculus
ggcttggtatagatcagccccgctc

SEQ ID NO: 624373 - DNA, 25 bp, Mus musculus
ggcttggtatagttcagccccgctc

SEQ ID NO: 624374 - DNA, 25 bp, Mus musculus
ggcttggtcagccataaacaggaca

SEQ ID NO: 624375 - DNA, 25 bp, Mus musculus
ggcttggtcagcgataaacaggaca

SEQ ID NO: 624376 - DNA, 25 bp, Mus musculus
ggcttggtcctcagtatgtccatga

SEQ ID NO: 624377 - DNA, 25 bp, Mus musculus
ggcttggtcctctgtatgtccatga

SEQ ID NO: 624378 - DNA, 25 bp, Mus musculus
ggcttggtcttcacaaattactctt

SEQ ID NO: 624379 - DNA, 25 bp, Mus musculus
ggcttggtcttctcaaattactctt

SEQ ID NO: 624380 - DNA, 25 bp, Mus musculus
ggcttggtgagcattctgttatttt

SEQ ID NO: 624381 - DNA, 25 bp, Mus musculus
ggcttggtgagctttctgttatttt

SEQ ID NO: 624382 - DNA, 25 bp, Mus musculus
ggcttggtgccaatcaagatctttt

SEQ ID NO: 624383 - DNA, 25 bp, Mus musculus
ggcttggtgccattcaagatctttt

SEQ ID NO: 624384 - DNA, 25 bp, Mus musculus
ggcttggtgctacatactatttggc

SEQ ID NO: 624385 - DNA, 25 bp, Mus musculus
ggcttggtgctagatactatttggc

SEQ ID NO: 624386 - DNA, 25 bp, Mus musculus
ggcttggtggacaccttttctcagg

SEQ ID NO: 624387 - DNA, 25 bp, Mus musculus
ggcttggtggactccttttctcagg

SEQ ID NO: 624388 - DNA, 25 bp, Mus musculus
ggcttggtgttcacatctgggaata

SEQ ID NO: 624389 - DNA, 25 bp, Mus musculus
ggcttggtgttctcatctgggaata

SEQ ID NO: 624390 - DNA, 25 bp, Mus musculus
ggcttggttacacgcacagagaatc

SEQ ID NO: 624391 - DNA, 25 bp, Mus musculus
ggcttggttacaggcacagagaatc

SEQ ID NO: 624392 - DNA, 25 bp, Mus musculus
ggcttggttgagcacaattctatct

SEQ ID NO: 624393 - DNA, 25 bp, Mus musculus
ggcttggttgaggacaattctatct

SEQ ID NO: 624394 - DNA, 25 bp, Mus musculus
ggcttgtaaagtaacttgccaccaa

SEQ ID NO: 624395 - DNA, 25 bp, Mus musculus
ggcttgtaaagttacttgccaccaa

SEQ ID NO: 624396 - DNA, 25 bp, Mus musculus
ggcttgtaacaacttcttctgggag

SEQ ID NO: 624397 - DNA, 25 bp, Mus musculus
ggcttgtaacaagttcttctgggag

SEQ ID NO: 624398 - DNA, 25 bp, Mus musculus
ggcttgtacattcccaggcagccat

SEQ ID NO: 624399 - DNA, 25 bp, Mus musculus
ggcttgtacattgccaggcagccat

SEQ ID NO: 624400 - DNA, 25 bp, Mus musculus
ggcttgtacgacatggcctatgaca

SEQ ID NO: 624401 - DNA, 25 bp, Mus musculus
ggcttgtacgacttggcctatgaca

SEQ ID NO: 624402 - DNA, 25 bp, Mus musculus
ggcttgtacgtcatcatgatctatg

SEQ ID NO: 624403 - DNA, 25 bp, Mus musculus
ggcttgtacgtcttcatgatctatg

SEQ ID NO: 624404 - DNA, 25 bp, Mus musculus
ggcttgtacgttctgcagtgtgttc

SEQ ID NO: 624405 - DNA, 25 bp, Mus musculus
ggcttgtacgttgtgcagtgtgttc

SEQ ID NO: 624406 - DNA, 25 bp, Mus musculus
ggcttgtactgccagtcctggctag

SEQ ID NO: 624407 - DNA, 25 bp, Mus musculus
ggcttgtactgcgagtcctggctag

SEQ ID NO: 624408 - DNA, 25 bp, Mus musculus
ggcttgtatgatatttctttcggtg

SEQ ID NO: 624409 - DNA, 25 bp, Mus musculus
ggcttgtatgatttttctttcggtg

SEQ ID NO: 624410 - DNA, 25 bp, Mus musculus
ggcttgtcacatctttcaatgtctt

SEQ ID NO: 624411 - DNA, 25 bp, Mus musculus
ggcttgtcacatgtttcaatgtctt

SEQ ID NO: 624412 - DNA, 25 bp, Mus musculus
ggcttgtcacctaagtctgatcaat

SEQ ID NO: 624413 - DNA, 25 bp, Mus musculus
ggcttgtcaccttagtctgatcaat

SEQ ID NO: 624414 - DNA, 25 bp, Mus musculus
ggcttgtcacgccaaggaaggacac

SEQ ID NO: 624415 - DNA, 25 bp, Mus musculus
ggcttgtcacgcgaaggaaggacac

SEQ ID NO: 624416 - DNA, 25 bp, Mus musculus
ggcttgtcatagcaacctaatggtt

SEQ ID NO: 624417 - DNA, 25 bp, Mus musculus
ggcttgtcataggaacctaatggtt

SEQ ID NO: 624418 - DNA, 25 bp, Mus musculus
ggcttgtcatgaaatgttaccattg

SEQ ID NO: 624419 - DNA, 25 bp, Mus musculus
ggcttgtcatgatatgttaccattg

SEQ ID NO: 624420 - DNA, 25 bp, Mus musculus
ggcttgtccacacagaagcagtctg

SEQ ID NO: 624421 - DNA, 25 bp, Mus musculus
ggcttgtccacagagaagcagtctg

SEQ ID NO: 624422 - DNA, 25 bp, Mus musculus
ggcttgtccctaattaggaactgga

SEQ ID NO: 624423 - DNA, 25 bp, Mus musculus
ggcttgtccctatttaggaactgga

SEQ ID NO: 624424 - DNA, 25 bp, Mus musculus
ggcttgtcctggatactggtagagt

SEQ ID NO: 624425 - DNA, 25 bp, Mus musculus
ggcttgtcctggttactggtagagt

SEQ ID NO: 624426 - DNA, 25 bp, Mus musculus
ggcttgtcgtcaatgtatgcctaca

SEQ ID NO: 624427 - DNA, 25 bp, Mus musculus
ggcttgtcgtcattgtatgcctaca

SEQ ID NO: 624428 - DNA, 25 bp, Mus musculus
ggcttgtctactctgtggttcctca

SEQ ID NO: 624429 - DNA, 25 bp, Mus musculus
ggcttgtctactgtgtggttcctca

SEQ ID NO: 624430 - DNA, 25 bp, Mus musculus
ggcttgtctataaaactggattctg

SEQ ID NO: 624431 - DNA, 25 bp, Mus musculus
ggcttgtctatataactggattctg

SEQ ID NO: 624432 - DNA, 25 bp, Mus musculus
ggcttgtctattcgtgatgatgtga

SEQ ID NO: 624433 - DNA, 25 bp, Mus musculus
ggcttgtctattggtgatgatgtga

SEQ ID NO: 624434 - DNA, 25 bp, Mus musculus
ggcttgtctcagcttattccagata

SEQ ID NO: 624435 - DNA, 25 bp, Mus musculus
ggcttgtctcaggttattccagata

SEQ ID NO: 624436 - DNA, 25 bp, Mus musculus
ggcttgtcttaaacttgtaatcctc

SEQ ID NO: 624437 - DNA, 25 bp, Mus musculus
ggcttgtcttaatcttgtaatcctc

SEQ ID NO: 624438 - DNA, 25 bp, Mus musculus
ggcttgtcttataaaattggatttt

SEQ ID NO: 624439 - DNA, 25 bp, Mus musculus
ggcttgtcttattaaattggatttt

SEQ ID NO: 624440 - DNA, 25 bp, Mus musculus
ggcttgtctttaatggaatgcaaga

SEQ ID NO: 624441 - DNA, 25 bp, Mus musculus
ggcttgtctttattggaatgcaaga

SEQ ID NO: 624442 - DNA, 25 bp, Mus musculus
ggcttgtgaagacaccctgggtcaa

SEQ ID NO: 624443 - DNA, 25 bp, Mus musculus
ggcttgtgaagagaccctgggtcaa

SEQ ID NO: 624444 - DNA, 25 bp, Mus musculus
ggcttgtgagaaaattgccaaaatc

SEQ ID NO: 624445 - DNA, 25 bp, Mus musculus
ggcttgtgagaatattgccaaaatc

SEQ ID NO: 624446 - DNA, 25 bp, Mus musculus
ggcttgtgagagagaaaactatcca

SEQ ID NO: 624447 - DNA, 25 bp, Mus musculus
ggcttgtgagagtgaaaactatcca

SEQ ID NO: 624448 - DNA, 25 bp, Mus musculus
ggcttgtgcacaaagtagaccctcc

SEQ ID NO: 624449 - DNA, 25 bp, Mus musculus
ggcttgtgcacatagtagaccctcc

SEQ ID NO: 624450 - DNA, 25 bp, Mus musculus
ggcttgtgcaggactactgatagat

SEQ ID NO: 624451 - DNA, 25 bp, Mus musculus
ggcttgtgcaggtctactgatagat

SEQ ID NO: 624452 - DNA, 25 bp, Mus musculus
ggcttgtgcccaacacgaaaaagat

SEQ ID NO: 624453 - DNA, 25 bp, Mus musculus
ggcttgtgcccatcacgaaaaagat

SEQ ID NO: 624454 - DNA, 25 bp, Mus musculus
ggcttgtggcatattatctgggcta

SEQ ID NO: 624455 - DNA, 25 bp, Mus musculus
ggcttgtggcattttatctgggcta

SEQ ID NO: 624456 - DNA, 25 bp, Mus musculus
ggcttgtgggatcctcttccaagtg

SEQ ID NO: 624457 - DNA, 25 bp, Mus musculus
ggcttgtgggatgctcttccaagtg

SEQ ID NO: 624458 - DNA, 25 bp, Mus musculus
ggcttgtgtcaccttttgactataa

SEQ ID NO: 624459 - DNA, 25 bp, Mus musculus
ggcttgtgtcacgttttgactataa

SEQ ID NO: 624460 - DNA, 25 bp, Mus musculus
ggcttgtgtcctcactgagtgtaga

SEQ ID NO: 624461 - DNA, 25 bp, Mus musculus
ggcttgtgtcctgactgagtgtaga

SEQ ID NO: 624462 - DNA, 25 bp, Mus musculus
ggcttgtgtctcattgttaactgga

SEQ ID NO: 624463 - DNA, 25 bp, Mus musculus
ggcttgtgtctctttgttaactgga

SEQ ID NO: 624464 - DNA, 25 bp, Mus musculus
ggcttgtgtgtgacttgattacttt

SEQ ID NO: 624465 - DNA, 25 bp, Mus musculus
ggcttgtgtgtgtcttgattacttt

SEQ ID NO: 624466 - DNA, 25 bp, Mus musculus
ggcttgttaaaaatttgcaccgtag

SEQ ID NO: 624467 - DNA, 25 bp, Mus musculus
ggcttgttaaaattttgcaccgtag

SEQ ID NO: 624468 - DNA, 25 bp, Mus musculus
ggcttgttaatgatggtgctaggat

SEQ ID NO: 624469 - DNA, 25 bp, Mus musculus
ggcttgttaatgttggtgctaggat

SEQ ID NO: 624470 - DNA, 25 bp, Mus musculus
ggcttgttacccactaactaactgt

SEQ ID NO: 624471 - DNA, 25 bp, Mus musculus
ggcttgttaccctctaactaactgt

SEQ ID NO: 624472 - DNA, 25 bp, Mus musculus
ggcttgttacttcggctggttgatt

SEQ ID NO: 624473 - DNA, 25 bp, Mus musculus
ggcttgttacttgggctggttgatt

SEQ ID NO: 624474 - DNA, 25 bp, Mus musculus
ggcttgttagagagtgcagtcagat

SEQ ID NO: 624475 - DNA, 25 bp, Mus musculus
ggcttgttagagtgtgcagtcagat

SEQ ID NO: 624476 - DNA, 25 bp, Mus musculus
ggcttgttccttctatattttggct

SEQ ID NO: 624477 - DNA, 25 bp, Mus musculus
ggcttgttccttgtatattttggct

SEQ ID NO: 624478 - DNA, 25 bp, Mus musculus
ggcttgttcttcacattcaacttta

SEQ ID NO: 624479 - DNA, 25 bp, Mus musculus
ggcttgttcttctcattcaacttta

SEQ ID NO: 624480 - DNA, 25 bp, Mus musculus
ggcttgttggcaatttacatataca

SEQ ID NO: 624481 - DNA, 25 bp, Mus musculus
ggcttgttggcattttacatataca

SEQ ID NO: 624482 - DNA, 25 bp, Mus musculus
ggcttgttgggcaccttgggtcaca

SEQ ID NO: 624483 - DNA, 25 bp, Mus musculus
ggcttgttgggctccttgggtcaca

SEQ ID NO: 624484 - DNA, 25 bp, Mus musculus
ggcttgtttaacatctcattcccat

SEQ ID NO: 624485 - DNA, 25 bp, Mus musculus
ggcttgtttaacttctcattcccat

SEQ ID NO: 624486 - DNA, 25 bp, Mus musculus
ggcttgtttcagaagtaccatcact

SEQ ID NO: 624487 - DNA, 25 bp, Mus musculus
ggcttgtttcagtagtaccatcact

SEQ ID NO: 624488 - DNA, 25 bp, Mus musculus
ggcttgtttctcaggactcaaatgt

SEQ ID NO: 624489 - DNA, 25 bp, Mus musculus
ggcttgtttctcatttcagaatcct

SEQ ID NO: 624490 - DNA, 25 bp, Mus musculus
ggcttgtttctctggactcaaatgt

SEQ ID NO: 624491 - DNA, 25 bp, Mus musculus
ggcttgtttctcttttcagaatcct

SEQ ID NO: 624492 - DNA, 25 bp, Mus musculus
ggcttgtttctgactaaggttgtgc

SEQ ID NO: 624493 - DNA, 25 bp, Mus musculus
ggcttgtttctgtctaaggttgtgc

SEQ ID NO: 624494 - DNA, 25 bp, Mus musculus
ggcttgtttgcacccagtcagtcag

SEQ ID NO: 624495 - DNA, 25 bp, Mus musculus
ggcttgtttgcagccagtcagtcag

SEQ ID NO: 624496 - DNA, 25 bp, Mus musculus
ggcttgttttcccttatgtgcattt

SEQ ID NO: 624497 - DNA, 25 bp, Mus musculus
ggcttgttttccgttatgtgcattt

SEQ ID NO: 624498 - DNA, 25 bp, Mus musculus
ggcttgttttttcgtgatggtacac

SEQ ID NO: 624499 - DNA, 25 bp, Mus musculus
ggcttgttttttggtgatggtacac

SEQ ID NO: 624500 - DNA, 25 bp, Mus musculus
ggctttaaaagcaacaccacatttg

SEQ ID NO: 624501 - DNA, 25 bp, Mus musculus
ggctttaaaagctacaccacatttg

SEQ ID NO: 624502 - DNA, 25 bp, Mus musculus
ggctttaaaaggcacgaaccaccat

SEQ ID NO: 624503 - DNA, 25 bp, Mus musculus
ggctttaaaagggacgaaccaccat

SEQ ID NO: 624504 - DNA, 25 bp, Mus musculus
ggctttaaaatactgcaggcattct

SEQ ID NO: 624505 - DNA, 25 bp, Mus musculus
ggctttaaaatagtgcaggcattct

SEQ ID NO: 624506 - DNA, 25 bp, Mus musculus
ggctttaaaatgaaccagatatggt

SEQ ID NO: 624507 - DNA, 25 bp, Mus musculus
ggctttaaaatgtaccagatatggt

SEQ ID NO: 624508 - DNA, 25 bp, Mus musculus
ggctttaaaccaacgctttcagcag

SEQ ID NO: 624509 - DNA, 25 bp, Mus musculus
ggctttaaaccatcgctttcagcag

SEQ ID NO: 624510 - DNA, 25 bp, Mus musculus
ggctttaaccggattcgcagcaaga

SEQ ID NO: 624511 - DNA, 25 bp, Mus musculus
ggctttaaccggtttcgcagcaaga

SEQ ID NO: 624512 - DNA, 25 bp, Mus musculus
ggctttaacctaaccccagggtgca

SEQ ID NO: 624513 - DNA, 25 bp, Mus musculus
ggctttaacctatccccagggtgca

SEQ ID NO: 624514 - DNA, 25 bp, Mus musculus
ggctttaactagactgggatgttag

SEQ ID NO: 624515 - DNA, 25 bp, Mus musculus
ggctttaactagtctgggatgttag

SEQ ID NO: 624516 - DNA, 25 bp, Mus musculus
ggctttaactatcacaactccactt

SEQ ID NO: 624517 - DNA, 25 bp, Mus musculus
ggctttaactatgacaactccactt

SEQ ID NO: 624518 - DNA, 25 bp, Mus musculus
ggctttaagcctcaaaactggtgat

SEQ ID NO: 624519 - DNA, 25 bp, Mus musculus
ggctttaagcctgaaaactggtgat

SEQ ID NO: 624520 - DNA, 25 bp, Mus musculus
ggctttaagcgtctgacccctggtg

SEQ ID NO: 624521 - DNA, 25 bp, Mus musculus
ggctttaagcgtgtgacccctggtg

SEQ ID NO: 624522 - DNA, 25 bp, Mus musculus
ggctttaaggcgacgtctggagaaa

SEQ ID NO: 624523 - DNA, 25 bp, Mus musculus
ggctttaaggcgtcgtctggagaaa

SEQ ID NO: 624524 - DNA, 25 bp, Mus musculus
ggctttaagtgccagcttccaagag

SEQ ID NO: 624525 - DNA, 25 bp, Mus musculus
ggctttaagtgcgagcttccaagag

SEQ ID NO: 624526 - DNA, 25 bp, Mus musculus
ggctttaatacgagagcgtgctaaa

SEQ ID NO: 624527 - DNA, 25 bp, Mus musculus
ggctttaatacgtgagcgtgctaaa

SEQ ID NO: 624528 - DNA, 25 bp, Mus musculus
ggctttaatgtcatactaattcggt

SEQ ID NO: 624529 - DNA, 25 bp, Mus musculus
ggctttaatgtcttactaattcggt

SEQ ID NO: 624530 - DNA, 25 bp, Mus musculus
ggctttacaaggctgattaccagta

SEQ ID NO: 624531 - DNA, 25 bp, Mus musculus
ggctttacaagggtgattaccagta

SEQ ID NO: 624532 - DNA, 25 bp, Mus musculus
ggctttacacgtctcaacggcttta

SEQ ID NO: 624533 - DNA, 25 bp, Mus musculus
ggctttacacgtgtcaacggcttta

SEQ ID NO: 624534 - DNA, 25 bp, Mus musculus
ggctttacatgccaatctagcactt

SEQ ID NO: 624535 - DNA, 25 bp, Mus musculus
ggctttacatgcgaatctagcactt

SEQ ID NO: 624536 - DNA, 25 bp, Mus musculus
ggctttacctttatgtatgtgaaca

SEQ ID NO: 624537 - DNA, 25 bp, Mus musculus
ggctttacctttttgtatgtgaaca

SEQ ID NO: 624538 - DNA, 25 bp, Mus musculus
ggctttactaggcagccagtgctga

SEQ ID NO: 624539 - DNA, 25 bp, Mus musculus
ggctttactagggagccagtgctga

SEQ ID NO: 624540 - DNA, 25 bp, Mus musculus
ggctttactccgaggagcagcccct

SEQ ID NO: 624541 - DNA, 25 bp, Mus musculus
ggctttactccgtggagcagcccct

SEQ ID NO: 624542 - DNA, 25 bp, Mus musculus
ggctttactgagctcttaacataac

SEQ ID NO: 624543 - DNA, 25 bp, Mus musculus
ggctttactgaggtcttaacataac

SEQ ID NO: 624544 - DNA, 25 bp, Mus musculus
ggctttactgtcatcccaaggaaat

SEQ ID NO: 624545 - DNA, 25 bp, Mus musculus
ggctttactgtcttcccaaggaaat

SEQ ID NO: 624546 - DNA, 25 bp, Mus musculus
ggctttacttctcgttaatccttga

SEQ ID NO: 624547 - DNA, 25 bp, Mus musculus
ggctttacttctggttaatccttga

SEQ ID NO: 624548 - DNA, 25 bp, Mus musculus
ggctttagaaatccaactgaggttg

SEQ ID NO: 624549 - DNA, 25 bp, Mus musculus
ggctttagaaatgcaactgaggttg

SEQ ID NO: 624550 - DNA, 25 bp, Mus musculus
ggctttagaataaatcctgtcagat

SEQ ID NO: 624551 - DNA, 25 bp, Mus musculus
ggctttagaatatatcctgtcagat

SEQ ID NO: 624552 - DNA, 25 bp, Mus musculus
ggctttagacatcttgactcctact

SEQ ID NO: 624553 - DNA, 25 bp, Mus musculus
ggctttagacatgttgactcctact

SEQ ID NO: 624554 - DNA, 25 bp, Mus musculus
ggctttagagaaaacttcagtcttc

SEQ ID NO: 624555 - DNA, 25 bp, Mus musculus
ggctttagagaatacttcagtcttc

SEQ ID NO: 624556 - DNA, 25 bp, Mus musculus
ggctttagaggcacctgactttcaa

SEQ ID NO: 624557 - DNA, 25 bp, Mus musculus
ggctttagaggctcctgactttcaa

SEQ ID NO: 624558 - DNA, 25 bp, Mus musculus
ggctttagagtactagctgctctcc

SEQ ID NO: 624559 - DNA, 25 bp, Mus musculus
ggctttagagtagtagctgctctcc

SEQ ID NO: 624560 - DNA, 25 bp, Mus musculus
ggctttagcttcaatatgatctccc

SEQ ID NO: 624561 - DNA, 25 bp, Mus musculus
ggctttagcttctatatgatctccc

SEQ ID NO: 624562 - DNA, 25 bp, Mus musculus
ggctttaggcttctcttggtttgtt

SEQ ID NO: 624563 - DNA, 25 bp, Mus musculus
ggctttaggcttgtcttggtttgtt

SEQ ID NO: 624564 - DNA, 25 bp, Mus musculus
ggctttagggccatgctctaagagt

SEQ ID NO: 624565 - DNA, 25 bp, Mus musculus
ggctttagggccttgctctaagagt

SEQ ID NO: 624566 - DNA, 25 bp, Mus musculus
ggctttagtcaccaggctgggctca

SEQ ID NO: 624567 - DNA, 25 bp, Mus musculus
ggctttagtcacgaggctgggctca

SEQ ID NO: 624568 - DNA, 25 bp, Mus musculus
ggctttagtgccaggatgcccgctt

SEQ ID NO: 624569 - DNA, 25 bp, Mus musculus
ggctttagtgcctggatgcccgctt

SEQ ID NO: 624570 - DNA, 25 bp, Mus musculus
ggctttatacttcttactttgctgt

SEQ ID NO: 624571 - DNA, 25 bp, Mus musculus
ggctttatacttgttactttgctgt

SEQ ID NO: 624572 - DNA, 25 bp, Mus musculus
ggctttatagtgaggcccctgagtc

SEQ ID NO: 624573 - DNA, 25 bp, Mus musculus
ggctttatagtgtggcccctgagtc

SEQ ID NO: 624574 - DNA, 25 bp, Mus musculus
ggctttatatacactttccatgcac

SEQ ID NO: 624575 - DNA, 25 bp, Mus musculus
ggctttatatactctttccatgcac

SEQ ID NO: 624576 - DNA, 25 bp, Mus musculus
ggctttatcattaggcgggtaccgg

SEQ ID NO: 624577 - DNA, 25 bp, Mus musculus
ggctttatcatttggcgggtaccgg

SEQ ID NO: 624578 - DNA, 25 bp, Mus musculus
ggctttatctcaattaaccttccat

SEQ ID NO: 624579 - DNA, 25 bp, Mus musculus
ggctttatctcatttaaccttccat

SEQ ID NO: 624580 - DNA, 25 bp, Mus musculus
ggctttatgacaacatttgccttgt

SEQ ID NO: 624581 - DNA, 25 bp, Mus musculus
ggctttatgacatcatttgccttgt

SEQ ID NO: 624582 - DNA, 25 bp, Mus musculus
ggctttatgagacagatgactaccg

SEQ ID NO: 624583 - DNA, 25 bp, Mus musculus
ggctttatgagagagatgactaccg

SEQ ID NO: 624584 - DNA, 25 bp, Mus musculus
ggctttatgcgtacctgaccagatg

SEQ ID NO: 624585 - DNA, 25 bp, Mus musculus
ggctttatgcgttcctgaccagatg

SEQ ID NO: 624586 - DNA, 25 bp, Mus musculus
ggctttatggatcatgcccactgtt

SEQ ID NO: 624587 - DNA, 25 bp, Mus musculus
ggctttatggatgatgcccactgtt

SEQ ID NO: 624588 - DNA, 25 bp, Mus musculus
ggctttatgtttacatgcacactca

SEQ ID NO: 624589 - DNA, 25 bp, Mus musculus
ggctttatgttttcatgcacactca

SEQ ID NO: 624590 - DNA, 25 bp, Mus musculus
ggctttattcacactttacaacggg

SEQ ID NO: 624591 - DNA, 25 bp, Mus musculus
ggctttattcactctttacaacggg

SEQ ID NO: 624592 - DNA, 25 bp, Mus musculus
ggctttattgcaatctaggtattat

SEQ ID NO: 624593 - DNA, 25 bp, Mus musculus
ggctttattgcattctaggtattat

SEQ ID NO: 624594 - DNA, 25 bp, Mus musculus
ggctttattgctacttttcactgtg

SEQ ID NO: 624595 - DNA, 25 bp, Mus musculus
ggctttattgcttcttttcactgtg

SEQ ID NO: 624596 - DNA, 25 bp, Mus musculus
ggctttatttgcataaataccttca

SEQ ID NO: 624597 - DNA, 25 bp, Mus musculus
ggctttatttgcttaaataccttca

SEQ ID NO: 624598 - DNA, 25 bp, Mus musculus
ggctttatttggaggttctttatgg

SEQ ID NO: 624599 - DNA, 25 bp, Mus musculus
ggctttatttggtggttctttatgg

SEQ ID NO: 624600 - DNA, 25 bp, Mus musculus
ggctttcaaaagctctcaacagaag

SEQ ID NO: 624601 - DNA, 25 bp, Mus musculus
ggctttcaaaaggtctcaacagaag

SEQ ID NO: 624602 - DNA, 25 bp, Mus musculus
ggctttcaaacccatgaagtacatg

SEQ ID NO: 624603 - DNA, 25 bp, Mus musculus
ggctttcaaaccgatgaagtacatg

SEQ ID NO: 624604 - DNA, 25 bp, Mus musculus
ggctttcaaatcagtacttcttgca

SEQ ID NO: 624605 - DNA, 25 bp, Mus musculus
ggctttcaaatctgtacttcttgca

SEQ ID NO: 624606 - DNA, 25 bp, Mus musculus
ggctttcaaattcgtagtgttccag

SEQ ID NO: 624607 - DNA, 25 bp, Mus musculus
ggctttcaaattggtagtgttccag

SEQ ID NO: 624608 - DNA, 25 bp, Mus musculus
ggctttcaaggcataaccatggagg

SEQ ID NO: 624609 - DNA, 25 bp, Mus musculus
ggctttcaaggcttaaccatggagg

SEQ ID NO: 624610 - DNA, 25 bp, Mus musculus
ggctttcaagtcagtacttcctaga

SEQ ID NO: 624611 - DNA, 25 bp, Mus musculus
ggctttcaagtctgtacttcctaga

SEQ ID NO: 624612 - DNA, 25 bp, Mus musculus
ggctttcaagttagctattactaag

SEQ ID NO: 624613 - DNA, 25 bp, Mus musculus
ggctttcaagtttgctattactaag

SEQ ID NO: 624614 - DNA, 25 bp, Mus musculus
ggctttcaatgaatagacactccta

SEQ ID NO: 624615 - DNA, 25 bp, Mus musculus
ggctttcaatgattagacactccta

SEQ ID NO: 624616 - DNA, 25 bp, Mus musculus
ggctttcaattactatggaagaatc

SEQ ID NO: 624617 - DNA, 25 bp, Mus musculus
ggctttcaattagtatggaagaatc

SEQ ID NO: 624618 - DNA, 25 bp, Mus musculus
ggctttcacatcagctttgagacag

SEQ ID NO: 624619 - DNA, 25 bp, Mus musculus
ggctttcacatctgctttgagacag

SEQ ID NO: 624620 - DNA, 25 bp, Mus musculus
ggctttcaccataaacagattgcat

SEQ ID NO: 624621 - DNA, 25 bp, Mus musculus
ggctttcaccattaacagattgcat

SEQ ID NO: 624622 - DNA, 25 bp, Mus musculus
ggctttcactaaacctcatcagatg

SEQ ID NO: 624623 - DNA, 25 bp, Mus musculus
ggctttcactaatcctcatcagatg

SEQ ID NO: 624624 - DNA, 25 bp, Mus musculus
ggctttcacttgattcagtagtatc

SEQ ID NO: 624625 - DNA, 25 bp, Mus musculus
ggctttcacttgtttcagtagtatc

SEQ ID NO: 624626 - DNA, 25 bp, Mus musculus
ggctttcagagacacctaccagctt

SEQ ID NO: 624627 - DNA, 25 bp, Mus musculus
ggctttcagagagacctaccagctt

SEQ ID NO: 624628 - DNA, 25 bp, Mus musculus
ggctttcagcaacagggacaacact

SEQ ID NO: 624629 - DNA, 25 bp, Mus musculus
ggctttcagcaagagggacaacact

SEQ ID NO: 624630 - DNA, 25 bp, Mus musculus
ggctttcagcccatagggtaattgt

SEQ ID NO: 624631 - DNA, 25 bp, Mus musculus
ggctttcagcccttagggtaattgt

SEQ ID NO: 624632 - DNA, 25 bp, Mus musculus
ggctttcaggcaaatgctggttcca

SEQ ID NO: 624633 - DNA, 25 bp, Mus musculus
ggctttcaggcatatgctggttcca

SEQ ID NO: 624634 - DNA, 25 bp, Mus musculus
ggctttcaggctcagctctatgtaa

SEQ ID NO: 624635 - DNA, 25 bp, Mus musculus
ggctttcaggctgagctctatgtaa

SEQ ID NO: 624636 - DNA, 25 bp, Mus musculus
ggctttcaggtgactagaaactttt

SEQ ID NO: 624637 - DNA, 25 bp, Mus musculus
ggctttcaggtgactcgttgagaaa

SEQ ID NO: 624638 - DNA, 25 bp, Mus musculus
ggctttcaggtgtctagaaactttt

SEQ ID NO: 624639 - DNA, 25 bp, Mus musculus
ggctttcaggtgtctcgttgagaaa

SEQ ID NO: 624640 - DNA, 25 bp, Mus musculus
ggctttcatacacatcagttaccat

SEQ ID NO: 624641 - DNA, 25 bp, Mus musculus
ggctttcatacagatcagttaccat

SEQ ID NO: 624642 - DNA, 25 bp, Mus musculus
ggctttcatccacagtaaaattgat

SEQ ID NO: 624643 - DNA, 25 bp, Mus musculus
ggctttcatccagagtaaaattgat

SEQ ID NO: 624644 - DNA, 25 bp, Mus musculus
ggctttcattaccatacccaatttt

SEQ ID NO: 624645 - DNA, 25 bp, Mus musculus
ggctttcattacgatacccaatttt

SEQ ID NO: 624646 - DNA, 25 bp, Mus musculus
ggctttccagagcatgcagaatcag

SEQ ID NO: 624647 - DNA, 25 bp, Mus musculus
ggctttccagaggatgcagaatcag

SEQ ID NO: 624648 - DNA, 25 bp, Mus musculus
ggctttccatgtagtctgttcatgt

SEQ ID NO: 624649 - DNA, 25 bp, Mus musculus
ggctttccatgttgtctgttcatgt

SEQ ID NO: 624650 - DNA, 25 bp, Mus musculus
ggctttcccctgagtatgccgttgc

SEQ ID NO: 624651 - DNA, 25 bp, Mus musculus
ggctttcccctgtgtatgccgttgc

SEQ ID NO: 624652 - DNA, 25 bp, Mus musculus
ggctttcccgggattctaacaagca

SEQ ID NO: 624653 - DNA, 25 bp, Mus musculus
ggctttcccgggtttctaacaagca

SEQ ID NO: 624654 - DNA, 25 bp, Mus musculus
ggctttccctatcatccatttgtga

SEQ ID NO: 624655 - DNA, 25 bp, Mus musculus
ggctttccctatgatccatttgtga

SEQ ID NO: 624656 - DNA, 25 bp, Mus musculus
ggctttcctactagctttgcagaag

SEQ ID NO: 624657 - DNA, 25 bp, Mus musculus
ggctttcctacttgctttgcagaag

SEQ ID NO: 624658 - DNA, 25 bp, Mus musculus
ggctttcctagcagatgttgtccta

SEQ ID NO: 624659 - DNA, 25 bp, Mus musculus
ggctttcctagctgatgttgtccta

SEQ ID NO: 624660 - DNA, 25 bp, Mus musculus
ggctttcctatccatgcagatgtga

SEQ ID NO: 624661 - DNA, 25 bp, Mus musculus
ggctttcctatcgatgcagatgtga

SEQ ID NO: 624662 - DNA, 25 bp, Mus musculus
ggctttcctgacatgcactgcatgt

SEQ ID NO: 624663 - DNA, 25 bp, Mus musculus
ggctttcctgacttgcactgcatgt

SEQ ID NO: 624664 - DNA, 25 bp, Mus musculus
ggctttcctggcctggtacatcaaa

SEQ ID NO: 624665 - DNA, 25 bp, Mus musculus
ggctttcctggcgtggtacatcaaa

SEQ ID NO: 624666 - DNA, 25 bp, Mus musculus
ggctttcctggtatggtaaatgtct

SEQ ID NO: 624667 - DNA, 25 bp, Mus musculus
ggctttcctggtttggtaaatgtct

SEQ ID NO: 624668 - DNA, 25 bp, Mus musculus
ggctttcctgtacacttgtaaccct

SEQ ID NO: 624669 - DNA, 25 bp, Mus musculus
ggctttcctgtagacttgtaaccct

SEQ ID NO: 624670 - DNA, 25 bp, Mus musculus
ggctttccttcgcaagaatcttttg

SEQ ID NO: 624671 - DNA, 25 bp, Mus musculus
ggctttccttcggaagaatcttttg

SEQ ID NO: 624672 - DNA, 25 bp, Mus musculus
ggctttccttggactgccaagtgag

SEQ ID NO: 624673 - DNA, 25 bp, Mus musculus
ggctttccttggtctgccaagtgag

SEQ ID NO: 624674 - DNA, 25 bp, Mus musculus
ggctttcgagctaaaaacctctgta

SEQ ID NO: 624675 - DNA, 25 bp, Mus musculus
ggctttcgagcttaaaacctctgta

SEQ ID NO: 624676 - DNA, 25 bp, Mus musculus
ggctttcgcaatcccaagaagggca

SEQ ID NO: 624677 - DNA, 25 bp, Mus musculus
ggctttcgcaatgccaagaagggca

SEQ ID NO: 624678 - DNA, 25 bp, Mus musculus
ggctttcggactactaaatatgcta

SEQ ID NO: 624679 - DNA, 25 bp, Mus musculus
ggctttcggacttctaaatatgcta

SEQ ID NO: 624680 - DNA, 25 bp, Mus musculus
ggctttcggctaattctgtcccttc

SEQ ID NO: 624681 - DNA, 25 bp, Mus musculus
ggctttcggctatttctgtcccttc

SEQ ID NO: 624682 - DNA, 25 bp, Mus musculus
ggctttcgggatcttcctatggaat

SEQ ID NO: 624683 - DNA, 25 bp, Mus musculus
ggctttcgggatgttcctatggaat

SEQ ID NO: 624684 - DNA, 25 bp, Mus musculus
ggctttcgttcaacagttcttgtta

SEQ ID NO: 624685 - DNA, 25 bp, Mus musculus
ggctttcgttcatcagttcttgtta

SEQ ID NO: 624686 - DNA, 25 bp, Mus musculus
ggctttctacaaaaattgaggcaga

SEQ ID NO: 624687 - DNA, 25 bp, Mus musculus
ggctttctacaataattgaggcaga

SEQ ID NO: 624688 - DNA, 25 bp, Mus musculus
ggctttctactgaccttatttctag

SEQ ID NO: 624689 - DNA, 25 bp, Mus musculus
ggctttctactgtccttatttctag

SEQ ID NO: 624690 - DNA, 25 bp, Mus musculus
ggctttctacttctagggactccac

SEQ ID NO: 624691 - DNA, 25 bp, Mus musculus
ggctttctacttgtagggactccac

SEQ ID NO: 624692 - DNA, 25 bp, Mus musculus
ggctttctaggacagctcacatcca

SEQ ID NO: 624693 - DNA, 25 bp, Mus musculus
ggctttctaggagagctcacatcca

SEQ ID NO: 624694 - DNA, 25 bp, Mus musculus
ggctttctatgtaccactcattggt

SEQ ID NO: 624695 - DNA, 25 bp, Mus musculus
ggctttctatgttccactcattggt

SEQ ID NO: 624696 - DNA, 25 bp, Mus musculus
ggctttctattgatactgtttttat

SEQ ID NO: 624697 - DNA, 25 bp, Mus musculus
ggctttctattgttactgtttttat

SEQ ID NO: 624698 - DNA, 25 bp, Mus musculus
ggctttctcaagcattgtgcacgac

SEQ ID NO: 624699 - DNA, 25 bp, Mus musculus
ggctttctcaaggattgtgcacgac

SEQ ID NO: 624700 - DNA, 25 bp, Mus musculus
ggctttctcacactggatgccaatt

SEQ ID NO: 624701 - DNA, 25 bp, Mus musculus
ggctttctcacagtggatgccaatt

SEQ ID NO: 624702 - DNA, 25 bp, Mus musculus
ggctttctcaccacttctgaggaga

SEQ ID NO: 624703 - DNA, 25 bp, Mus musculus
ggctttctcacctcttctgaggaga

SEQ ID NO: 624704 - DNA, 25 bp, Mus musculus
ggctttctcatgatccacagtagta

SEQ ID NO: 624705 - DNA, 25 bp, Mus musculus
ggctttctcatgttccacagtagta

SEQ ID NO: 624706 - DNA, 25 bp, Mus musculus
ggctttctccaaaattttgtcagta

SEQ ID NO: 624707 - DNA, 25 bp, Mus musculus
ggctttctccaatattttgtcagta

SEQ ID NO: 624708 - DNA, 25 bp, Mus musculus
ggctttctcccaccaatagggtcga

SEQ ID NO: 624709 - DNA, 25 bp, Mus musculus
ggctttctcccagcaatagggtcga

SEQ ID NO: 624710 - DNA, 25 bp, Mus musculus
ggctttctcctgattattcagtttc

SEQ ID NO: 624711 - DNA, 25 bp, Mus musculus
ggctttctcctgtttattcagtttc

SEQ ID NO: 624712 - DNA, 25 bp, Mus musculus
ggctttctctatactacagtttgct

SEQ ID NO: 624713 - DNA, 25 bp, Mus musculus
ggctttctctatataacaaccttgg

SEQ ID NO: 624714 - DNA, 25 bp, Mus musculus
ggctttctctattctacagtttgct

SEQ ID NO: 624715 - DNA, 25 bp, Mus musculus
ggctttctctatttaacaaccttgg

SEQ ID NO: 624716 - DNA, 25 bp, Mus musculus
ggctttctctggaactggacacata

SEQ ID NO: 624717 - DNA, 25 bp, Mus musculus
ggctttctctggtactggacacata

SEQ ID NO: 624718 - DNA, 25 bp, Mus musculus
ggctttctctgtctagaaattttca

SEQ ID NO: 624719 - DNA, 25 bp, Mus musculus
ggctttctctgtgtagaaattttca

SEQ ID NO: 624720 - DNA, 25 bp, Mus musculus
ggctttctcttccataatgtaatgg

SEQ ID NO: 624721 - DNA, 25 bp, Mus musculus
ggctttctcttcgataatgtaatgg

SEQ ID NO: 624722 - DNA, 25 bp, Mus musculus
ggctttctgagcaagtctggtgact

SEQ ID NO: 624723 - DNA, 25 bp, Mus musculus
ggctttctgagccagcgtttcgatg

SEQ ID NO: 624724 - DNA, 25 bp, Mus musculus
ggctttctgagcgagcgtttcgatg

SEQ ID NO: 624725 - DNA, 25 bp, Mus musculus
ggctttctgagctagtctggtgact

SEQ ID NO: 624726 - DNA, 25 bp, Mus musculus
ggctttctgataccttattgatgcg

SEQ ID NO: 624727 - DNA, 25 bp, Mus musculus
ggctttctgatagcttattgatgcg

SEQ ID NO: 624728 - DNA, 25 bp, Mus musculus
ggctttctgcgaaacgcacgctaag

SEQ ID NO: 624729 - DNA, 25 bp, Mus musculus
ggctttctgcgatacgcacgctaag

SEQ ID NO: 624730 - DNA, 25 bp, Mus musculus
ggctttctggcaaaattatctgact

SEQ ID NO: 624731 - DNA, 25 bp, Mus musculus
ggctttctggcataattatctgact

SEQ ID NO: 624732 - DNA, 25 bp, Mus musculus
ggctttctggtcacacaaagtacta

SEQ ID NO: 624733 - DNA, 25 bp, Mus musculus
ggctttctggtctcacaaagtacta

SEQ ID NO: 624734 - DNA, 25 bp, Mus musculus
ggctttctgttaagggttttcctgt

SEQ ID NO: 624735 - DNA, 25 bp, Mus musculus
ggctttctgttatgggttttcctgt

SEQ ID NO: 624736 - DNA, 25 bp, Mus musculus
ggctttcttacaagcctatcagagt

SEQ ID NO: 624737 - DNA, 25 bp, Mus musculus
ggctttcttacatgcctatcagagt

SEQ ID NO: 624738 - DNA, 25 bp, Mus musculus
ggctttcttagccttaagccaggct

SEQ ID NO: 624739 - DNA, 25 bp, Mus musculus
ggctttcttagcgttaagccaggct

SEQ ID NO: 624740 - DNA, 25 bp, Mus musculus
ggctttcttattatcctgtgtgcat

SEQ ID NO: 624741 - DNA, 25 bp, Mus musculus
ggctttcttattttcctgtgtgcat

SEQ ID NO: 624742 - DNA, 25 bp, Mus musculus
ggctttcttcccaggcaaatcagat

SEQ ID NO: 624743 - DNA, 25 bp, Mus musculus
ggctttcttcccagtgtggaaccat

SEQ ID NO: 624744 - DNA, 25 bp, Mus musculus
ggctttcttccctggcaaatcagat

SEQ ID NO: 624745 - DNA, 25 bp, Mus musculus
ggctttcttccctgtgtggaaccat

SEQ ID NO: 624746 - DNA, 25 bp, Mus musculus
ggctttcttctccacaaatcaggaa

SEQ ID NO: 624747 - DNA, 25 bp, Mus musculus
ggctttcttctcgacaaatcaggaa

SEQ ID NO: 624748 - DNA, 25 bp, Mus musculus
ggctttcttggcactcatttataaa

SEQ ID NO: 624749 - DNA, 25 bp, Mus musculus
ggctttcttggctctcatttataaa

SEQ ID NO: 624750 - DNA, 25 bp, Mus musculus
ggctttcttgggagatctgtctttc

SEQ ID NO: 624751 - DNA, 25 bp, Mus musculus
ggctttcttgggtgatctgtctttc

SEQ ID NO: 624752 - DNA, 25 bp, Mus musculus
ggctttctttataaatccattgttg

SEQ ID NO: 624753 - DNA, 25 bp, Mus musculus
ggctttctttattaatccattgttg

SEQ ID NO: 624754 - DNA, 25 bp, Mus musculus
ggctttctttgcagttttgaccatt

SEQ ID NO: 624755 - DNA, 25 bp, Mus musculus
ggctttctttgctgttttgaccatt

SEQ ID NO: 624756 - DNA, 25 bp, Mus musculus
ggctttcttttaactgaatcaccag

SEQ ID NO: 624757 - DNA, 25 bp, Mus musculus
ggctttcttttatctgaatcaccag

SEQ ID NO: 624758 - DNA, 25 bp, Mus musculus
ggctttgaaacaactgtttaccagt

SEQ ID NO: 624759 - DNA, 25 bp, Mus musculus
ggctttgaaacatctgtttaccagt

SEQ ID NO: 624760 - DNA, 25 bp, Mus musculus
ggctttgaaccacatagtttttaat

SEQ ID NO: 624761 - DNA, 25 bp, Mus musculus
ggctttgaaccagatagtttttaat

SEQ ID NO: 624762 - DNA, 25 bp, Mus musculus
ggctttgaactcacagagctctgcc

SEQ ID NO: 624763 - DNA, 25 bp, Mus musculus
ggctttgaactcatgcagctgaggc

SEQ ID NO: 624764 - DNA, 25 bp, Mus musculus
ggctttgaactctcagagctctgcc

SEQ ID NO: 624765 - DNA, 25 bp, Mus musculus
ggctttgaactcttgcagctgaggc

SEQ ID NO: 624766 - DNA, 25 bp, Mus musculus
ggctttgaacttcctagtctttgat

SEQ ID NO: 624767 - DNA, 25 bp, Mus musculus
ggctttgaacttgctagtctttgat

SEQ ID NO: 624768 - DNA, 25 bp, Mus musculus
ggctttgaagaactacacctgcaat

SEQ ID NO: 624769 - DNA, 25 bp, Mus musculus
ggctttgaagaagtacacctgcaat

SEQ ID NO: 624770 - DNA, 25 bp, Mus musculus
ggctttgaagcaactgattccattt

SEQ ID NO: 624771 - DNA, 25 bp, Mus musculus
ggctttgaagcatctgattccattt

SEQ ID NO: 624772 - DNA, 25 bp, Mus musculus
ggctttgaagcgcttgtatgttgtt

SEQ ID NO: 624773 - DNA, 25 bp, Mus musculus
ggctttgaagcggttgtatgttgtt

SEQ ID NO: 624774 - DNA, 25 bp, Mus musculus
ggctttgaaggcacattgtgtgcat

SEQ ID NO: 624775 - DNA, 25 bp, Mus musculus
ggctttgaaggctcattgtgtgcat

SEQ ID NO: 624776 - DNA, 25 bp, Mus musculus
ggctttgaatgaaatccagttgaat

SEQ ID NO: 624777 - DNA, 25 bp, Mus musculus
ggctttgaatgatatccagttgaat

SEQ ID NO: 624778 - DNA, 25 bp, Mus musculus
ggctttgaatgtactggaaactctt

SEQ ID NO: 624779 - DNA, 25 bp, Mus musculus
ggctttgaatgttctggaaactctt

SEQ ID NO: 624780 - DNA, 25 bp, Mus musculus
ggctttgaatttaaaacagtactca

SEQ ID NO: 624781 - DNA, 25 bp, Mus musculus
ggctttgaattttaaacagtactca

SEQ ID NO: 624782 - DNA, 25 bp, Mus musculus
ggctttgacattaaaaaacccagag

SEQ ID NO: 624783 - DNA, 25 bp, Mus musculus
ggctttgacatttaaaaacccagag

SEQ ID NO: 624784 - DNA, 25 bp, Mus musculus
ggctttgactacatgtgactctcat

SEQ ID NO: 624785 - DNA, 25 bp, Mus musculus
ggctttgactacttgtgactctcat

SEQ ID NO: 624786 - DNA, 25 bp, Mus musculus
ggctttgactatactggaactctca

SEQ ID NO: 624787 - DNA, 25 bp, Mus musculus
ggctttgactattctggaactctca

SEQ ID NO: 624788 - DNA, 25 bp, Mus musculus
ggctttgagagcatttgttaacttt

SEQ ID NO: 624789 - DNA, 25 bp, Mus musculus
ggctttgagagcttttgttaacttt

SEQ ID NO: 624790 - DNA, 25 bp, Mus musculus
ggctttgagattctgcgtccaggtc

SEQ ID NO: 624791 - DNA, 25 bp, Mus musculus
ggctttgagattgtgcgtccaggtc

SEQ ID NO: 624792 - DNA, 25 bp, Mus musculus
ggctttgagcatagccaatgtaagt

SEQ ID NO: 624793 - DNA, 25 bp, Mus musculus
ggctttgagcattgccaatgtaagt

SEQ ID NO: 624794 - DNA, 25 bp, Mus musculus
ggctttgagctgaattcccagttac

SEQ ID NO: 624795 - DNA, 25 bp, Mus musculus
ggctttgagctgtattcccagttac

SEQ ID NO: 624796 - DNA, 25 bp, Mus musculus
ggctttgaggctatggataatcata

SEQ ID NO: 624797 - DNA, 25 bp, Mus musculus
ggctttgaggctttggataatcata

SEQ ID NO: 624798 - DNA, 25 bp, Mus musculus
ggctttgagtacatcaacccacttc

SEQ ID NO: 624799 - DNA, 25 bp, Mus musculus
ggctttgagtacttcaacccacttc

SEQ ID NO: 624800 - DNA, 25 bp, Mus musculus
ggctttgatgatcgtactctcctgc

SEQ ID NO: 624801 - DNA, 25 bp, Mus musculus
ggctttgatgatggtactctcctgc

SEQ ID NO: 624802 - DNA, 25 bp, Mus musculus
ggctttgatgccacaaacatcctca

SEQ ID NO: 624803 - DNA, 25 bp, Mus musculus
ggctttgatgcctcaaacatcctca

SEQ ID NO: 624804 - DNA, 25 bp, Mus musculus
ggctttgatgctcaacaaggtctgt

SEQ ID NO: 624805 - DNA, 25 bp, Mus musculus
ggctttgatgctgaacaaggtctgt

SEQ ID NO: 624806 - DNA, 25 bp, Mus musculus
ggctttgattggctcttctggaaaa

SEQ ID NO: 624807 - DNA, 25 bp, Mus musculus
ggctttgattgggtcttctggaaaa

SEQ ID NO: 624808 - DNA, 25 bp, Mus musculus
ggctttgattttctgagctcattgt

SEQ ID NO: 624809 - DNA, 25 bp, Mus musculus
ggctttgattttgtgagctcattgt

SEQ ID NO: 624810 - DNA, 25 bp, Mus musculus
ggctttgcaaaaagacctggtcttc

SEQ ID NO: 624811 - DNA, 25 bp, Mus musculus
ggctttgcaaaatgacctggtcttc

SEQ ID NO: 624812 - DNA, 25 bp, Mus musculus
ggctttgcaagaagcggacgcccct

SEQ ID NO: 624813 - DNA, 25 bp, Mus musculus
ggctttgcaagatgcggacgcccct

SEQ ID NO: 624814 - DNA, 25 bp, Mus musculus
ggctttgcacatatgcacctgtgga

SEQ ID NO: 624815 - DNA, 25 bp, Mus musculus
ggctttgcacatttgcacctgtgga

SEQ ID NO: 624816 - DNA, 25 bp, Mus musculus
ggctttgcaccaaacttacgggact

SEQ ID NO: 624817 - DNA, 25 bp, Mus musculus
ggctttgcaccatacttacgggact

SEQ ID NO: 624818 - DNA, 25 bp, Mus musculus
ggctttgcaccgacaacagtgtgga

SEQ ID NO: 624819 - DNA, 25 bp, Mus musculus
ggctttgcaccgtcaacagtgtgga

SEQ ID NO: 624820 - DNA, 25 bp, Mus musculus
ggctttgcaggaactctgtgtccca

SEQ ID NO: 624821 - DNA, 25 bp, Mus musculus
ggctttgcaggaagacaaatccacc

SEQ ID NO: 624822 - DNA, 25 bp, Mus musculus
ggctttgcaggatctctgtgtccca

SEQ ID NO: 624823 - DNA, 25 bp, Mus musculus
ggctttgcaggatgacaaatccacc

SEQ ID NO: 624824 - DNA, 25 bp, Mus musculus
ggctttgcagtaaacgccaaggcat

SEQ ID NO: 624825 - DNA, 25 bp, Mus musculus
ggctttgcagtatacgccaaggcat

SEQ ID NO: 624826 - DNA, 25 bp, Mus musculus
ggctttgcatgccattgaaatgcta

SEQ ID NO: 624827 - DNA, 25 bp, Mus musculus
ggctttgcatgcgattgaaatgcta

SEQ ID NO: 624828 - DNA, 25 bp, Mus musculus
ggctttgcccagacggatctaagta

SEQ ID NO: 624829 - DNA, 25 bp, Mus musculus
ggctttgcccagcattgcctagacc

SEQ ID NO: 624830 - DNA, 25 bp, Mus musculus
ggctttgcccaggattgcctagacc

SEQ ID NO: 624831 - DNA, 25 bp, Mus musculus
ggctttgcccagtcggatctaagta

SEQ ID NO: 624832 - DNA, 25 bp, Mus musculus
ggctttgccctcagttgattatata

SEQ ID NO: 624833 - DNA, 25 bp, Mus musculus
ggctttgccctctgttgattatata

SEQ ID NO: 624834 - DNA, 25 bp, Mus musculus
ggctttgcctgacagatgacctcag

SEQ ID NO: 624835 - DNA, 25 bp, Mus musculus
ggctttgcctgagagatgacctcag

SEQ ID NO: 624836 - DNA, 25 bp, Mus musculus
ggctttgcctttaatgatctcttac

SEQ ID NO: 624837 - DNA, 25 bp, Mus musculus
ggctttgccttttatgatctcttac

SEQ ID NO: 624838 - DNA, 25 bp, Mus musculus
ggctttgctaaacacttcttcgtga

SEQ ID NO: 624839 - DNA, 25 bp, Mus musculus
ggctttgctaaagacttcttcgtga

SEQ ID NO: 624840 - DNA, 25 bp, Mus musculus
ggctttgctaagactggctcctgtg

SEQ ID NO: 624841 - DNA, 25 bp, Mus musculus
ggctttgctaagtctggctcctgtg

SEQ ID NO: 624842 - DNA, 25 bp, Mus musculus
ggctttgctacacatggatgccggt

SEQ ID NO: 624843 - DNA, 25 bp, Mus musculus
ggctttgctacagatggatgccggt

SEQ ID NO: 624844 - DNA, 25 bp, Mus musculus
ggctttgctaccctctgtatgaacg

SEQ ID NO: 624845 - DNA, 25 bp, Mus musculus
ggctttgctaccgtctgtatgaacg

SEQ ID NO: 624846 - DNA, 25 bp, Mus musculus
ggctttgctactagggatacttcta

SEQ ID NO: 624847 - DNA, 25 bp, Mus musculus
ggctttgctacttgggatacttcta

SEQ ID NO: 624848 - DNA, 25 bp, Mus musculus
ggctttgctcagacagaagttcctg

SEQ ID NO: 624849 - DNA, 25 bp, Mus musculus
ggctttgctcagtcagaagttcctg

SEQ ID NO: 624850 - DNA, 25 bp, Mus musculus
ggctttgctcttattctgcacacta

SEQ ID NO: 624851 - DNA, 25 bp, Mus musculus
ggctttgctctttttctgcacacta

SEQ ID NO: 624852 - DNA, 25 bp, Mus musculus
ggctttgctgggaaaggcgactcct

SEQ ID NO: 624853 - DNA, 25 bp, Mus musculus
ggctttgctgggtaaggcgactcct

SEQ ID NO: 624854 - DNA, 25 bp, Mus musculus
ggctttgctgtaaaaatctcctcga

SEQ ID NO: 624855 - DNA, 25 bp, Mus musculus
ggctttgctgtataaatctcctcga

SEQ ID NO: 624856 - DNA, 25 bp, Mus musculus
ggctttgctgtgatggttgagatta

SEQ ID NO: 624857 - DNA, 25 bp, Mus musculus
ggctttgctgtgttggttgagatta

SEQ ID NO: 624858 - DNA, 25 bp, Mus musculus
ggctttgcttaccaccattacaatg

SEQ ID NO: 624859 - DNA, 25 bp, Mus musculus
ggctttgcttacgaccattacaatg

SEQ ID NO: 624860 - DNA, 25 bp, Mus musculus
ggctttgctttgaatctaagggata

SEQ ID NO: 624861 - DNA, 25 bp, Mus musculus
ggctttgctttgacatagcatcatc

SEQ ID NO: 624862 - DNA, 25 bp, Mus musculus
ggctttgctttgtatctaagggata

SEQ ID NO: 624863 - DNA, 25 bp, Mus musculus
ggctttgctttgtcatagcatcatc

SEQ ID NO: 624864 - DNA, 25 bp, Mus musculus
ggctttggaagtccgctatacctga

SEQ ID NO: 624865 - DNA, 25 bp, Mus musculus
ggctttggaagtgcgctatacctga

SEQ ID NO: 624866 - DNA, 25 bp, Mus musculus
ggctttggaataaccttactaactg

SEQ ID NO: 624867 - DNA, 25 bp, Mus musculus
ggctttggaatatccttactaactg

SEQ ID NO: 624868 - DNA, 25 bp, Mus musculus
ggctttggacaaaattggcaccttt

SEQ ID NO: 624869 - DNA, 25 bp, Mus musculus
ggctttggacaatattggcaccttt

SEQ ID NO: 624870 - DNA, 25 bp, Mus musculus
ggctttggacacaacggacagaaca

SEQ ID NO: 624871 - DNA, 25 bp, Mus musculus
ggctttggacactacggacagaaca

SEQ ID NO: 624872 - DNA, 25 bp, Mus musculus
ggctttggcatgcttgggtttcata

SEQ ID NO: 624873 - DNA, 25 bp, Mus musculus
ggctttggcatggttgggtttcata

SEQ ID NO: 624874 - DNA, 25 bp, Mus musculus
ggctttggccagaacaacatcaggg

SEQ ID NO: 624875 - DNA, 25 bp, Mus musculus
ggctttggccagtacaacatcaggg

SEQ ID NO: 624876 - DNA, 25 bp, Mus musculus
ggctttggctataaggtggttccct

SEQ ID NO: 624877 - DNA, 25 bp, Mus musculus
ggctttggctattaggtggttccct

SEQ ID NO: 624878 - DNA, 25 bp, Mus musculus
ggctttggctccaatgagatcctta

SEQ ID NO: 624879 - DNA, 25 bp, Mus musculus
ggctttggctcctatgagatcctta

SEQ ID NO: 624880 - DNA, 25 bp, Mus musculus
ggctttgggaacactgggcaacttc

SEQ ID NO: 624881 - DNA, 25 bp, Mus musculus
ggctttgggaactctgggcaacttc

SEQ ID NO: 624882 - DNA, 25 bp, Mus musculus
ggctttgggaagacttcgcaacccg

SEQ ID NO: 624883 - DNA, 25 bp, Mus musculus
ggctttgggaagtcttcgcaacccg

SEQ ID NO: 624884 - DNA, 25 bp, Mus musculus
ggctttggtgacagtggcaaatttg

SEQ ID NO: 624885 - DNA, 25 bp, Mus musculus
ggctttggtgactgtggcaaatttg

SEQ ID NO: 624886 - DNA, 25 bp, Mus musculus
ggctttggtgccacgggtcagactt

SEQ ID NO: 624887 - DNA, 25 bp, Mus musculus
ggctttggtgcctcgggtcagactt

SEQ ID NO: 624888 - DNA, 25 bp, Mus musculus
ggctttggtgctacatcatatcagt

SEQ ID NO: 624889 - DNA, 25 bp, Mus musculus
ggctttggtgctcattatcttttaa

SEQ ID NO: 624890 - DNA, 25 bp, Mus musculus
ggctttggtgctgattatcttttaa

SEQ ID NO: 624891 - DNA, 25 bp, Mus musculus
ggctttggtgcttcatcatatcagt

SEQ ID NO: 624892 - DNA, 25 bp, Mus musculus
ggctttggttatacattgtcctgca

SEQ ID NO: 624893 - DNA, 25 bp, Mus musculus
ggctttggttattcattgtcctgca

SEQ ID NO: 624894 - DNA, 25 bp, Mus musculus
ggctttggttgtatgaccccattct

SEQ ID NO: 624895 - DNA, 25 bp, Mus musculus
ggctttggttgtttgaccccattct

SEQ ID NO: 624896 - DNA, 25 bp, Mus musculus
ggctttgtaccacaaatgctactaa

SEQ ID NO: 624897 - DNA, 25 bp, Mus musculus
ggctttgtaccactgagtatttttt

SEQ ID NO: 624898 - DNA, 25 bp, Mus musculus
ggctttgtaccagaaatgctactaa

SEQ ID NO: 624899 - DNA, 25 bp, Mus musculus
ggctttgtaccagtgagtatttttt

SEQ ID NO: 624900 - DNA, 25 bp, Mus musculus
ggctttgtacttcaaatcctcctgt

SEQ ID NO: 624901 - DNA, 25 bp, Mus musculus
ggctttgtacttgaaatcctcctgt

SEQ ID NO: 624902 - DNA, 25 bp, Mus musculus
ggctttgtataaaacccactggagt

SEQ ID NO: 624903 - DNA, 25 bp, Mus musculus
ggctttgtataatacccactggagt

SEQ ID NO: 624904 - DNA, 25 bp, Mus musculus
ggctttgtatctaacctccaatcca

SEQ ID NO: 624905 - DNA, 25 bp, Mus musculus
ggctttgtatcttacctccaatcca

SEQ ID NO: 624906 - DNA, 25 bp, Mus musculus
ggctttgtatggcttcctttgaaca

SEQ ID NO: 624907 - DNA, 25 bp, Mus musculus
ggctttgtatgggttcctttgaaca

SEQ ID NO: 624908 - DNA, 25 bp, Mus musculus
ggctttgtcaacaaggtttctctga

SEQ ID NO: 624909 - DNA, 25 bp, Mus musculus
ggctttgtcaactaggtttctctga

SEQ ID NO: 624910 - DNA, 25 bp, Mus musculus
ggctttgtccgtcgttctggaacaa

SEQ ID NO: 624911 - DNA, 25 bp, Mus musculus
ggctttgtccgtggttctggaacaa

SEQ ID NO: 624912 - DNA, 25 bp, Mus musculus
ggctttgtcctcactacagtactgc

SEQ ID NO: 624913 - DNA, 25 bp, Mus musculus
ggctttgtcctctctacagtactgc

SEQ ID NO: 624914 - DNA, 25 bp, Mus musculus
ggctttgtcctgatcgtagcataga

SEQ ID NO: 624915 - DNA, 25 bp, Mus musculus
ggctttgtcctgttcgtagcataga

SEQ ID NO: 624916 - DNA, 25 bp, Mus musculus
ggctttgtctttcaggactgtcctg

SEQ ID NO: 624917 - DNA, 25 bp, Mus musculus
ggctttgtctttgaggactgtcctg

SEQ ID NO: 624918 - DNA, 25 bp, Mus musculus
ggctttgtgccaatgtgccagtggc

SEQ ID NO: 624919 - DNA, 25 bp, Mus musculus
ggctttgtgccattgtgccagtggc

SEQ ID NO: 624920 - DNA, 25 bp, Mus musculus
ggctttgtgctaagagctctggctc

SEQ ID NO: 624921 - DNA, 25 bp, Mus musculus
ggctttgtgctacacatttcataga

SEQ ID NO: 624922 - DNA, 25 bp, Mus musculus
ggctttgtgctagacatttcataga

SEQ ID NO: 624923 - DNA, 25 bp, Mus musculus
ggctttgtgctatgagctctggctc

SEQ ID NO: 624924 - DNA, 25 bp, Mus musculus
ggctttgtgctgagtctgtcagtcc

SEQ ID NO: 624925 - DNA, 25 bp, Mus musculus
ggctttgtgctgtgtctgtcagtcc

SEQ ID NO: 624926 - DNA, 25 bp, Mus musculus
ggctttgtggatcgactcacctagt

SEQ ID NO: 624927 - DNA, 25 bp, Mus musculus
ggctttgtggatggactcacctagt

SEQ ID NO: 624928 - DNA, 25 bp, Mus musculus
ggctttgtgtgacttcagcggccat

SEQ ID NO: 624929 - DNA, 25 bp, Mus musculus
ggctttgtgtgagttcagcggccat

SEQ ID NO: 624930 - DNA, 25 bp, Mus musculus
ggctttgtgtttactgaggcagaat

SEQ ID NO: 624931 - DNA, 25 bp, Mus musculus
ggctttgtgttttctgaggcagaat

SEQ ID NO: 624932 - DNA, 25 bp, Mus musculus
ggctttgttagccacacctaggaag

SEQ ID NO: 624933 - DNA, 25 bp, Mus musculus
ggctttgttagcgacacctaggaag

SEQ ID NO: 624934 - DNA, 25 bp, Mus musculus
ggctttgttaggatagtactgatta

SEQ ID NO: 624935 - DNA, 25 bp, Mus musculus
ggctttgttaggttagtactgatta

SEQ ID NO: 624936 - DNA, 25 bp, Mus musculus
ggctttgttcccaatgacatgcaag

SEQ ID NO: 624937 - DNA, 25 bp, Mus musculus
ggctttgttccctatgacatgcaag

SEQ ID NO: 624938 - DNA, 25 bp, Mus musculus
ggctttgttctcaagttactggtcc

SEQ ID NO: 624939 - DNA, 25 bp, Mus musculus
ggctttgttctctagttactggtcc

SEQ ID NO: 624940 - DNA, 25 bp, Mus musculus
ggctttgttcttcgaagagatctca

SEQ ID NO: 624941 - DNA, 25 bp, Mus musculus
ggctttgttcttggaagagatctca

SEQ ID NO: 624942 - DNA, 25 bp, Mus musculus
ggctttgttggcacatctgggctaa

SEQ ID NO: 624943 - DNA, 25 bp, Mus musculus
ggctttgttggctcatctgggctaa

SEQ ID NO: 624944 - DNA, 25 bp, Mus musculus
ggctttgttttcagtcttcatcagg

SEQ ID NO: 624945 - DNA, 25 bp, Mus musculus
ggctttgttttctgtcttcatcagg

SEQ ID NO: 624946 - DNA, 25 bp, Mus musculus
ggcttttaaaccaagcattcgggag

SEQ ID NO: 624947 - DNA, 25 bp, Mus musculus
ggcttttaaacctagcattcgggag

SEQ ID NO: 624948 - DNA, 25 bp, Mus musculus
ggcttttaacaaattctgtatgtgt

SEQ ID NO: 624949 - DNA, 25 bp, Mus musculus
ggcttttaacaatttctgtatgtgt

SEQ ID NO: 624950 - DNA, 25 bp, Mus musculus
ggcttttaagcaatggcaccttggg

SEQ ID NO: 624951 - DNA, 25 bp, Mus musculus
ggcttttaagcattggcaccttggg

SEQ ID NO: 624952 - DNA, 25 bp, Mus musculus
ggcttttaatagctgatttatcttc

SEQ ID NO: 624953 - DNA, 25 bp, Mus musculus
ggcttttaataggtgatttatcttc

SEQ ID NO: 624954 - DNA, 25 bp, Mus musculus
ggcttttaatctcggctgtgacccc

SEQ ID NO: 624955 - DNA, 25 bp, Mus musculus
ggcttttaatctgggctgtgacccc

SEQ ID NO: 624956 - DNA, 25 bp, Mus musculus
ggcttttacgtccttgcagcagtga

SEQ ID NO: 624957 - DNA, 25 bp, Mus musculus
ggcttttacgtcgttgcagcagtga

SEQ ID NO: 624958 - DNA, 25 bp, Mus musculus
ggcttttagctactaatatgcctat

SEQ ID NO: 624959 - DNA, 25 bp, Mus musculus
ggcttttagctagtaatatgcctat

SEQ ID NO: 624960 - DNA, 25 bp, Mus musculus
ggcttttagttgcacttcaaaataa

SEQ ID NO: 624961 - DNA, 25 bp, Mus musculus
ggcttttagttggacttcaaaataa

SEQ ID NO: 624962 - DNA, 25 bp, Mus musculus
ggcttttcaaaaactcacctctaga

SEQ ID NO: 624963 - DNA, 25 bp, Mus musculus
ggcttttcaaaatctcacctctaga

SEQ ID NO: 624964 - DNA, 25 bp, Mus musculus
ggcttttcaaagctccatctacaaa

SEQ ID NO: 624965 - DNA, 25 bp, Mus musculus
ggcttttcaaaggtccatctacaaa

SEQ ID NO: 624966 - DNA, 25 bp, Mus musculus
ggcttttcaagccatattactctcc

SEQ ID NO: 624967 - DNA, 25 bp, Mus musculus
ggcttttcaagcgatattactctcc

SEQ ID NO: 624968 - DNA, 25 bp, Mus musculus
ggcttttcacataattcaaactatt

SEQ ID NO: 624969 - DNA, 25 bp, Mus musculus
ggcttttcacattattcaaactatt

SEQ ID NO: 624970 - DNA, 25 bp, Mus musculus
ggcttttcagttaatgtttccatct

SEQ ID NO: 624971 - DNA, 25 bp, Mus musculus
ggcttttcagtttatgtttccatct

SEQ ID NO: 624972 - DNA, 25 bp, Mus musculus
ggcttttcatagaccactaaccaag

SEQ ID NO: 624973 - DNA, 25 bp, Mus musculus
ggcttttcatagtccactaaccaag

SEQ ID NO: 624974 - DNA, 25 bp, Mus musculus
ggcttttccactattgcgtttcgat

SEQ ID NO: 624975 - DNA, 25 bp, Mus musculus
ggcttttccacttttgcgtttcgat

SEQ ID NO: 624976 - DNA, 25 bp, Mus musculus
ggcttttcccttcagactcaggagg

SEQ ID NO: 624977 - DNA, 25 bp, Mus musculus
ggcttttcccttgagactcaggagg

SEQ ID NO: 624978 - DNA, 25 bp, Mus musculus
ggcttttccgagcaaggctcttcat

SEQ ID NO: 624979 - DNA, 25 bp, Mus musculus
ggcttttccgaggaaggctcttcat

SEQ ID NO: 624980 - DNA, 25 bp, Mus musculus
ggcttttccttcaaaccggtgtatg

SEQ ID NO: 624981 - DNA, 25 bp, Mus musculus
ggcttttccttctaaccggtgtatg

SEQ ID NO: 624982 - DNA, 25 bp, Mus musculus
ggcttttcctttccgagaattccag

SEQ ID NO: 624983 - DNA, 25 bp, Mus musculus
ggcttttcctttgcgagaattccag

SEQ ID NO: 624984 - DNA, 25 bp, Mus musculus
ggcttttctaatatgtactgtaaca

SEQ ID NO: 624985 - DNA, 25 bp, Mus musculus
ggcttttctaatttgtactgtaaca

SEQ ID NO: 624986 - DNA, 25 bp, Mus musculus
ggcttttctacaagctgatctggac

SEQ ID NO: 624987 - DNA, 25 bp, Mus musculus
ggcttttctacatgctgatctggac

SEQ ID NO: 624988 - DNA, 25 bp, Mus musculus
ggcttttctcatatcaactcctgtg

SEQ ID NO: 624989 - DNA, 25 bp, Mus musculus
ggcttttctcatttcaactcctgtg

SEQ ID NO: 624990 - DNA, 25 bp, Mus musculus
ggcttttctctgagcaacatggaaa

SEQ ID NO: 624991 - DNA, 25 bp, Mus musculus
ggcttttctctgtgcaacatggaaa

SEQ ID NO: 624992 - DNA, 25 bp, Mus musculus
ggcttttctgagacttcaactttca

SEQ ID NO: 624993 - DNA, 25 bp, Mus musculus
ggcttttctgagtcttcaactttca

SEQ ID NO: 624994 - DNA, 25 bp, Mus musculus
ggcttttctggacagccagcaaaca

SEQ ID NO: 624995 - DNA, 25 bp, Mus musculus
ggcttttctggagagccagcaaaca

SEQ ID NO: 624996 - DNA, 25 bp, Mus musculus
ggcttttcttaaagacctgcagtta

SEQ ID NO: 624997 - DNA, 25 bp, Mus musculus
ggcttttcttaatgacctgcagtta

SEQ ID NO: 624998 - DNA, 25 bp, Mus musculus
ggcttttcttctaatccacgatcat

SEQ ID NO: 624999 - DNA, 25 bp, Mus musculus
ggcttttcttcttatccacgatcat

SEQ ID NO: 625000 - DNA, 25 bp, Mus musculus
ggcttttgaagtacaagtggccaca

SEQ ID NO: 625001 - DNA, 25 bp, Mus musculus
ggcttttgaagttcaagtggccaca

SEQ ID NO: 625002 - DNA, 25 bp, Mus musculus
ggcttttgaatccaacattccatag

SEQ ID NO: 625003 - DNA, 25 bp, Mus musculus
ggcttttgaatcgaacattccatag

SEQ ID NO: 625004 - DNA, 25 bp, Mus musculus
ggcttttgacccatgctaatgtgac

SEQ ID NO: 625005 - DNA, 25 bp, Mus musculus
ggcttttgacccttgctaatgtgac

SEQ ID NO: 625006 - DNA, 25 bp, Mus musculus
ggcttttgactcaccagactttaac

SEQ ID NO: 625007 - DNA, 25 bp, Mus musculus
ggcttttgactctccagactttaac

SEQ ID NO: 625008 - DNA, 25 bp, Mus musculus
ggcttttgagatatgataaccccta

SEQ ID NO: 625009 - DNA, 25 bp, Mus musculus
ggcttttgagatttgataaccccta

SEQ ID NO: 625010 - DNA, 25 bp, Mus musculus
ggcttttgagtcagcttttggccaa

SEQ ID NO: 625011 - DNA, 25 bp, Mus musculus
ggcttttgagtctgcttttggccaa

SEQ ID NO: 625012 - DNA, 25 bp, Mus musculus
ggcttttgattccaatgtcttttat

SEQ ID NO: 625013 - DNA, 25 bp, Mus musculus
ggcttttgattcgaatgtcttttat

SEQ ID NO: 625014 - DNA, 25 bp, Mus musculus
ggcttttgatttagttggcttaaat

SEQ ID NO: 625015 - DNA, 25 bp, Mus musculus
ggcttttgattttgttggcttaaat

SEQ ID NO: 625016 - DNA, 25 bp, Mus musculus
ggcttttgcagaaacccacagttga

SEQ ID NO: 625017 - DNA, 25 bp, Mus musculus
ggcttttgcagatacccacagttga

SEQ ID NO: 625018 - DNA, 25 bp, Mus musculus
ggcttttgccacatctggcatacta

SEQ ID NO: 625019 - DNA, 25 bp, Mus musculus
ggcttttgccacttctggcatacta

SEQ ID NO: 625020 - DNA, 25 bp, Mus musculus
ggcttttgcgctcaaggatgaccac

SEQ ID NO: 625021 - DNA, 25 bp, Mus musculus
ggcttttgcgctgaaggatgaccac

SEQ ID NO: 625022 - DNA, 25 bp, Mus musculus
ggcttttggaaacaccatcttgata

SEQ ID NO: 625023 - DNA, 25 bp, Mus musculus
ggcttttggaaagaccatcttgata

SEQ ID NO: 625024 - DNA, 25 bp, Mus musculus
ggcttttggaccagaatatttaaat

SEQ ID NO: 625025 - DNA, 25 bp, Mus musculus
ggcttttggacctgaatatttaaat

SEQ ID NO: 625026 - DNA, 25 bp, Mus musculus
ggcttttggatcacagtaactgtcg

SEQ ID NO: 625027 - DNA, 25 bp, Mus musculus
ggcttttggatctcagtaactgtcg

SEQ ID NO: 625028 - DNA, 25 bp, Mus musculus
ggcttttggtcaccatggcactacc

SEQ ID NO: 625029 - DNA, 25 bp, Mus musculus
ggcttttggtcagcatggcactacc

SEQ ID NO: 625030 - DNA, 25 bp, Mus musculus
ggcttttgtagccagttgtttcctg

SEQ ID NO: 625031 - DNA, 25 bp, Mus musculus
ggcttttgtagcgagttgtttcctg

SEQ ID NO: 625032 - DNA, 25 bp, Mus musculus
ggcttttgtgatatgatgagcttga

SEQ ID NO: 625033 - DNA, 25 bp, Mus musculus
ggcttttgtgatttgatgagcttga

SEQ ID NO: 625034 - DNA, 25 bp, Mus musculus
ggcttttgtggcaacagctttaccc

SEQ ID NO: 625035 - DNA, 25 bp, Mus musculus
ggcttttgtggctacagctttaccc

SEQ ID NO: 625036 - DNA, 25 bp, Mus musculus
ggcttttgttccatagtgtccacaa

SEQ ID NO: 625037 - DNA, 25 bp, Mus musculus
ggcttttgttccttagtgtccacaa

SEQ ID NO: 625038 - DNA, 25 bp, Mus musculus
ggcttttgtttgattattccatgag

SEQ ID NO: 625039 - DNA, 25 bp, Mus musculus
ggcttttgtttgtttattccatgag

SEQ ID NO: 625040 - DNA, 25 bp, Mus musculus
ggctttttaaaccactgccagtggc

SEQ ID NO: 625041 - DNA, 25 bp, Mus musculus
ggctttttaaacgactgccagtggc

SEQ ID NO: 625042 - DNA, 25 bp, Mus musculus
ggctttttaaatcctctacaacttt

SEQ ID NO: 625043 - DNA, 25 bp, Mus musculus
ggctttttaaatgctctacaacttt

SEQ ID NO: 625044 - DNA, 25 bp, Mus musculus
ggctttttaatgcttgcacttcatt

SEQ ID NO: 625045 - DNA, 25 bp, Mus musculus
ggctttttaatggttgcacttcatt

SEQ ID NO: 625046 - DNA, 25 bp, Mus musculus
ggctttttacagctagtcactatta

SEQ ID NO: 625047 - DNA, 25 bp, Mus musculus
ggctttttacaggtagtcactatta

SEQ ID NO: 625048 - DNA, 25 bp, Mus musculus
ggctttttacatacagaagatgctg

SEQ ID NO: 625049 - DNA, 25 bp, Mus musculus
ggctttttacattcagaagatgctg

SEQ ID NO: 625050 - DNA, 25 bp, Mus musculus
ggctttttatacattccccaatcat

SEQ ID NO: 625051 - DNA, 25 bp, Mus musculus
ggctttttatactttccccaatcat

SEQ ID NO: 625052 - DNA, 25 bp, Mus musculus
ggctttttatctccctgctatgcaa

SEQ ID NO: 625053 - DNA, 25 bp, Mus musculus
ggctttttatctgcctgctatgcaa

SEQ ID NO: 625054 - DNA, 25 bp, Mus musculus
ggctttttatgccaattagcagaat

SEQ ID NO: 625055 - DNA, 25 bp, Mus musculus
ggctttttatgcgaattagcagaat

SEQ ID NO: 625056 - DNA, 25 bp, Mus musculus
ggctttttcaaactagcctctgaaa

SEQ ID NO: 625057 - DNA, 25 bp, Mus musculus
ggctttttcaaagtagcctctgaaa

SEQ ID NO: 625058 - DNA, 25 bp, Mus musculus
ggctttttcaggcattcagacaaca

SEQ ID NO: 625059 - DNA, 25 bp, Mus musculus
ggctttttcagggattcagacaaca

SEQ ID NO: 625060 - DNA, 25 bp, Mus musculus
ggctttttccatcgctacatttatt

SEQ ID NO: 625061 - DNA, 25 bp, Mus musculus
ggctttttccatggctacatttatt

SEQ ID NO: 625062 - DNA, 25 bp, Mus musculus
ggctttttcccacgcttggatttag

SEQ ID NO: 625063 - DNA, 25 bp, Mus musculus
ggctttttcccaggcttggatttag

SEQ ID NO: 625064 - DNA, 25 bp, Mus musculus
ggctttttgaagacttcccttgact

SEQ ID NO: 625065 - DNA, 25 bp, Mus musculus
ggctttttgaagtcttcccttgact

SEQ ID NO: 625066 - DNA, 25 bp, Mus musculus
ggctttttgccacacctttatttat

SEQ ID NO: 625067 - DNA, 25 bp, Mus musculus
ggctttttgccagacctttatttat

SEQ ID NO: 625068 - DNA, 25 bp, Mus musculus
ggctttttggtgctccaatctttca

SEQ ID NO: 625069 - DNA, 25 bp, Mus musculus
ggctttttggtggtccaatctttca

SEQ ID NO: 625070 - DNA, 25 bp, Mus musculus
ggctttttgtgcacagaccacactg

SEQ ID NO: 625071 - DNA, 25 bp, Mus musculus
ggctttttgtgctcagaccacactg

SEQ ID NO: 625072 - DNA, 25 bp, Mus musculus
ggctttttgtttctacttcatattc

SEQ ID NO: 625073 - DNA, 25 bp, Mus musculus
ggctttttgtttgtacttcatattc

SEQ ID NO: 625074 - DNA, 25 bp, Mus musculus
ggcttttttaccaaggctgctttca

SEQ ID NO: 625075 - DNA, 25 bp, Mus musculus
ggcttttttacctaggctgctttca

SEQ ID NO: 625076 - DNA, 25 bp, Mus musculus
ggcttttttagtcgcctctgtgatc

SEQ ID NO: 625077 - DNA, 25 bp, Mus musculus
ggcttttttagtggcctctgtgatc

SEQ ID NO: 625078 - DNA, 25 bp, Mus musculus
ggcttttttctaataacctcatgta

SEQ ID NO: 625079 - DNA, 25 bp, Mus musculus
ggcttttttctattaacctcatgta

SEQ ID NO: 625080 - DNA, 25 bp, Mus musculus
gggaaaaaacatccctttgtaagtg

SEQ ID NO: 625081 - DNA, 25 bp, Mus musculus
gggaaaaaacatgcctttgtaagtg

SEQ ID NO: 625082 - DNA, 25 bp, Mus musculus
gggaaaaacataactgttccaagaa

SEQ ID NO: 625083 - DNA, 25 bp, Mus musculus
gggaaaaacatatctgttccaagaa

SEQ ID NO: 625084 - DNA, 25 bp, Mus musculus
gggaaaaacatcactccgggagtgc

SEQ ID NO: 625085 - DNA, 25 bp, Mus musculus
gggaaaaacatctctccgggagtgc

SEQ ID NO: 625086 - DNA, 25 bp, Mus musculus
gggaaaaattgacagcttagagaat

SEQ ID NO: 625087 - DNA, 25 bp, Mus musculus
gggaaaaattgagagcttagagaat

SEQ ID NO: 625088 - DNA, 25 bp, Mus musculus
gggaaaacacacattctatgacaaa

SEQ ID NO: 625089 - DNA, 25 bp, Mus musculus
gggaaaacacactttctatgacaaa

SEQ ID NO: 625090 - DNA, 25 bp, Mus musculus
gggaaaacactcactcacgtaaagt

SEQ ID NO: 625091 - DNA, 25 bp, Mus musculus
gggaaaacactccttatgtggttca

SEQ ID NO: 625092 - DNA, 25 bp, Mus musculus
gggaaaacactcgttatgtggttca

SEQ ID NO: 625093 - DNA, 25 bp, Mus musculus
gggaaaacactctctcacgtaaagt

SEQ ID NO: 625094 - DNA, 25 bp, Mus musculus
gggaaaacatctcatctcacgcctt

SEQ ID NO: 625095 - DNA, 25 bp, Mus musculus
gggaaaacatctgatctcacgcctt

SEQ ID NO: 625096 - DNA, 25 bp, Mus musculus
gggaaaaccacacttcacttccgtg

SEQ ID NO: 625097 - DNA, 25 bp, Mus musculus
gggaaaaccacagttcacttccgtg

SEQ ID NO: 625098 - DNA, 25 bp, Mus musculus
gggaaaaccgtacacccactgtgag

SEQ ID NO: 625099 - DNA, 25 bp, Mus musculus
gggaaaaccgtagacccactgtgag

SEQ ID NO: 625100 - DNA, 25 bp, Mus musculus
gggaaaacctgcacgaagctgaatt

SEQ ID NO: 625101 - DNA, 25 bp, Mus musculus
gggaaaacctgctcgaagctgaatt

SEQ ID NO: 625102 - DNA, 25 bp, Mus musculus
gggaaaacgtccatcaataccactg

SEQ ID NO: 625103 - DNA, 25 bp, Mus musculus
gggaaaacgtccttcaataccactg

SEQ ID NO: 625104 - DNA, 25 bp, Mus musculus
gggaaaactgctactgtggaacaaa

SEQ ID NO: 625105 - DNA, 25 bp, Mus musculus
gggaaaactgcttctgtggaacaaa

SEQ ID NO: 625106 - DNA, 25 bp, Mus musculus
gggaaaactggcaaccacaagactg

SEQ ID NO: 625107 - DNA, 25 bp, Mus musculus
gggaaaactggctaccacaagactg

SEQ ID NO: 625108 - DNA, 25 bp, Mus musculus
gggaaaactgtccccagttgtgcac

SEQ ID NO: 625109 - DNA, 25 bp, Mus musculus
gggaaaactgtcgccagttgtgcac

SEQ ID NO: 625110 - DNA, 25 bp, Mus musculus
gggaaaagaccacgcctacaggaag

SEQ ID NO: 625111 - DNA, 25 bp, Mus musculus
gggaaaagaccaggcctacaggaag

SEQ ID NO: 625112 - DNA, 25 bp, Mus musculus
gggaaaagaggcaccacagctctaa

SEQ ID NO: 625113 - DNA, 25 bp, Mus musculus
gggaaaagaggctccacagctctaa

SEQ ID NO: 625114 - DNA, 25 bp, Mus musculus
gggaaaagccttacacgtgtaacat

SEQ ID NO: 625115 - DNA, 25 bp, Mus musculus
gggaaaagccttattcgtgtaatga

SEQ ID NO: 625116 - DNA, 25 bp, Mus musculus
gggaaaagcctttcacgtgtaacat

SEQ ID NO: 625117 - DNA, 25 bp, Mus musculus
gggaaaagcctttttcgtgtaatga

SEQ ID NO: 625118 - DNA, 25 bp, Mus musculus
gggaaaaggatgcttctcctcactg

SEQ ID NO: 625119 - DNA, 25 bp, Mus musculus
gggaaaaggatggttctcctcactg

SEQ ID NO: 625120 - DNA, 25 bp, Mus musculus
gggaaaagtatgacctggagctaca

SEQ ID NO: 625121 - DNA, 25 bp, Mus musculus
gggaaaagtatgtcctggagctaca

SEQ ID NO: 625122 - DNA, 25 bp, Mus musculus
gggaaaagtctaacgcctcgtgcag

SEQ ID NO: 625123 - DNA, 25 bp, Mus musculus
gggaaaagtctatcgcctcgtgcag

SEQ ID NO: 625124 - DNA, 25 bp, Mus musculus
gggaaaagtgccatactgacttaca

SEQ ID NO: 625125 - DNA, 25 bp, Mus musculus
gggaaaagtgccttactgacttaca

SEQ ID NO: 625126 - DNA, 25 bp, Mus musculus
gggaaaataatacgcctctgatgtc

SEQ ID NO: 625127 - DNA, 25 bp, Mus musculus
gggaaaataataggcctctgatgtc

SEQ ID NO: 625128 - DNA, 25 bp, Mus musculus
gggaaaatacctcgccgaatgactc

SEQ ID NO: 625129 - DNA, 25 bp, Mus musculus
gggaaaatacctggccgaatgactc

SEQ ID NO: 625130 - DNA, 25 bp, Mus musculus
gggaaaatagccaccttgcacgcca

SEQ ID NO: 625131 - DNA, 25 bp, Mus musculus
gggaaaatagcctccttgcacgcca

SEQ ID NO: 625132 - DNA, 25 bp, Mus musculus
gggaaaatccctctgtcaactatgc

SEQ ID NO: 625133 - DNA, 25 bp, Mus musculus
gggaaaatccctgtgtcaactatgc

SEQ ID NO: 625134 - DNA, 25 bp, Mus musculus
gggaaaatcctcatcattgtgggag

SEQ ID NO: 625135 - DNA, 25 bp, Mus musculus
gggaaaatcctcttcattgtgggag

SEQ ID NO: 625136 - DNA, 25 bp, Mus musculus
gggaaaatcgatcccagccaaacct

SEQ ID NO: 625137 - DNA, 25 bp, Mus musculus
gggaaaatcgatgccagccaaacct

SEQ ID NO: 625138 - DNA, 25 bp, Mus musculus
gggaaaatctacaacctgcacttca

SEQ ID NO: 625139 - DNA, 25 bp, Mus musculus
gggaaaatctactacctgcacttca

SEQ ID NO: 625140 - DNA, 25 bp, Mus musculus
gggaaaatctataccaactgacatt

SEQ ID NO: 625141 - DNA, 25 bp, Mus musculus
gggaaaatctattccaactgacatt

SEQ ID NO: 625142 - DNA, 25 bp, Mus musculus
gggaaaatctttctaaacatgtatt

SEQ ID NO: 625143 - DNA, 25 bp, Mus musculus
gggaaaatctttgtaaacatgtatt

SEQ ID NO: 625144 - DNA, 25 bp, Mus musculus
gggaaaatgatccatattagccact

SEQ ID NO: 625145 - DNA, 25 bp, Mus musculus
gggaaaatgatcgatattagccact

SEQ ID NO: 625146 - DNA, 25 bp, Mus musculus
gggaaaatgctcaacatccacccat

SEQ ID NO: 625147 - DNA, 25 bp, Mus musculus
gggaaaatgctctacatccacccat

SEQ ID NO: 625148 - DNA, 25 bp, Mus musculus
gggaaaatggccaagctctcactgc

SEQ ID NO: 625149 - DNA, 25 bp, Mus musculus
gggaaaatggcctagctctcactgc

SEQ ID NO: 625150 - DNA, 25 bp, Mus musculus
gggaaaatggctctaaagccaacta

SEQ ID NO: 625151 - DNA, 25 bp, Mus musculus
gggaaaatggctgtaaagccaacta

SEQ ID NO: 625152 - DNA, 25 bp, Mus musculus
gggaaaatgtgaactcctggagaac

SEQ ID NO: 625153 - DNA, 25 bp, Mus musculus
gggaaaatgtgatctcctggagaac

SEQ ID NO: 625154 - DNA, 25 bp, Mus musculus
gggaaaattcaacttcattcagatc

SEQ ID NO: 625155 - DNA, 25 bp, Mus musculus
gggaaaattcaagttcattcagatc

SEQ ID NO: 625156 - DNA, 25 bp, Mus musculus
gggaaaattcctctgtttacagact

SEQ ID NO: 625157 - DNA, 25 bp, Mus musculus
gggaaaattcctgtgtttacagact

SEQ ID NO: 625158 - DNA, 25 bp, Mus musculus
gggaaacaacagaggtcaggacata

SEQ ID NO: 625159 - DNA, 25 bp, Mus musculus
gggaaacaacagtggtcaggacata

SEQ ID NO: 625160 - DNA, 25 bp, Mus musculus
gggaaacaacatcctttacaatagt

SEQ ID NO: 625161 - DNA, 25 bp, Mus musculus
gggaaacaacatgctttacaatagt

SEQ ID NO: 625162 - DNA, 25 bp, Mus musculus
gggaaacaaccaaaattcaaacatg

SEQ ID NO: 625163 - DNA, 25 bp, Mus musculus
gggaaacaaccataattcaaacatg

SEQ ID NO: 625164 - DNA, 25 bp, Mus musculus
gggaaacaattacatctcacaaact

SEQ ID NO: 625165 - DNA, 25 bp, Mus musculus
gggaaacaattagatctcacaaact

SEQ ID NO: 625166 - DNA, 25 bp, Mus musculus
gggaaacacacaccagcacggaaaa

SEQ ID NO: 625167 - DNA, 25 bp, Mus musculus
gggaaacacacagcagcacggaaaa

SEQ ID NO: 625168 - DNA, 25 bp, Mus musculus
gggaaacacattctttgtgaactgg

SEQ ID NO: 625169 - DNA, 25 bp, Mus musculus
gggaaacacattgtttgtgaactgg

SEQ ID NO: 625170 - DNA, 25 bp, Mus musculus
gggaaacaccatagctttatcagat

SEQ ID NO: 625171 - DNA, 25 bp, Mus musculus
gggaaacaccattgctttatcagat

SEQ ID NO: 625172 - DNA, 25 bp, Mus musculus
gggaaacaccgaaactgctgttgtt

SEQ ID NO: 625173 - DNA, 25 bp, Mus musculus
gggaaacaccgatactgctgttgtt

SEQ ID NO: 625174 - DNA, 25 bp, Mus musculus
gggaaacacctgctaccttgaggcc

SEQ ID NO: 625175 - DNA, 25 bp, Mus musculus
gggaaacacctggtaccttgaggcc

SEQ ID NO: 625176 - DNA, 25 bp, Mus musculus
gggaaacacgcacatttacaaacat

SEQ ID NO: 625177 - DNA, 25 bp, Mus musculus
gggaaacacgcagatttacaaacat

SEQ ID NO: 625178 - DNA, 25 bp, Mus musculus
gggaaacactgtaagcatgcatgga

SEQ ID NO: 625179 - DNA, 25 bp, Mus musculus
gggaaacactgttagcatgcatgga

SEQ ID NO: 625180 - DNA, 25 bp, Mus musculus
gggaaacagaacaaggcagtgctct

SEQ ID NO: 625181 - DNA, 25 bp, Mus musculus
gggaaacagaactaggcagtgctct

SEQ ID NO: 625182 - DNA, 25 bp, Mus musculus
gggaaacagaagacactagactcta

SEQ ID NO: 625183 - DNA, 25 bp, Mus musculus
gggaaacagaagtcactagactcta

SEQ ID NO: 625184 - DNA, 25 bp, Mus musculus
gggaaacagactactcgtggataag

SEQ ID NO: 625185 - DNA, 25 bp, Mus musculus
gggaaacagacttctcgtggataag

SEQ ID NO: 625186 - DNA, 25 bp, Mus musculus
gggaaacagcacatcgtcgttttgg

SEQ ID NO: 625187 - DNA, 25 bp, Mus musculus
gggaaacagcacttcgtcgttttgg

SEQ ID NO: 625188 - DNA, 25 bp, Mus musculus
gggaaacagcgtattcacctgcgcc

SEQ ID NO: 625189 - DNA, 25 bp, Mus musculus
gggaaacagcgttttcacctgcgcc

SEQ ID NO: 625190 - DNA, 25 bp, Mus musculus
gggaaacagctacatcaacttttta

SEQ ID NO: 625191 - DNA, 25 bp, Mus musculus
gggaaacagctagatcaacttttta

SEQ ID NO: 625192 - DNA, 25 bp, Mus musculus
gggaaacaggcacgctgagttctga

SEQ ID NO: 625193 - DNA, 25 bp, Mus musculus
gggaaacaggcaggctgagttctga

SEQ ID NO: 625194 - DNA, 25 bp, Mus musculus
gggaaacagtccctggcagagacca

SEQ ID NO: 625195 - DNA, 25 bp, Mus musculus
gggaaacagtccgtggcagagacca

SEQ ID NO: 625196 - DNA, 25 bp, Mus musculus
gggaaacagttgactgagttcaaac

SEQ ID NO: 625197 - DNA, 25 bp, Mus musculus
gggaaacagttgtctgagttcaaac

SEQ ID NO: 625198 - DNA, 25 bp, Mus musculus
gggaaacatcgcctttactctgacc

SEQ ID NO: 625199 - DNA, 25 bp, Mus musculus
gggaaacatcgcgtttactctgacc

SEQ ID NO: 625200 - DNA, 25 bp, Mus musculus
gggaaacatctcatcctatatcaga

SEQ ID NO: 625201 - DNA, 25 bp, Mus musculus
gggaaacatctcttcctatatcaga

SEQ ID NO: 625202 - DNA, 25 bp, Mus musculus
gggaaacattcaatggaggtctttt

SEQ ID NO: 625203 - DNA, 25 bp, Mus musculus
gggaaacattcattggaggtctttt

SEQ ID NO: 625204 - DNA, 25 bp, Mus musculus
gggaaaccaactagcctgcctatca

SEQ ID NO: 625205 - DNA, 25 bp, Mus musculus
gggaaaccaacttgcctgcctatca

SEQ ID NO: 625206 - DNA, 25 bp, Mus musculus
gggaaaccaataccacaatctagct

SEQ ID NO: 625207 - DNA, 25 bp, Mus musculus
gggaaaccaatagcacaatctagct

SEQ ID NO: 625208 - DNA, 25 bp, Mus musculus
gggaaaccaatgctatagcttcaga

SEQ ID NO: 625209 - DNA, 25 bp, Mus musculus
gggaaaccaatggtatagcttcaga

SEQ ID NO: 625210 - DNA, 25 bp, Mus musculus
gggaaaccaccgatctgacagcatc

SEQ ID NO: 625211 - DNA, 25 bp, Mus musculus
gggaaaccaccgttctgacagcatc

SEQ ID NO: 625212 - DNA, 25 bp, Mus musculus
gggaaaccactaaagatctcttctt

SEQ ID NO: 625213 - DNA, 25 bp, Mus musculus
gggaaaccactatagatctcttctt

SEQ ID NO: 625214 - DNA, 25 bp, Mus musculus
gggaaacccaagaccatcgactggt

SEQ ID NO: 625215 - DNA, 25 bp, Mus musculus
gggaaacccaagtccatcgactggt

SEQ ID NO: 625216 - DNA, 25 bp, Mus musculus
gggaaacccacaaatggctcacctt

SEQ ID NO: 625217 - DNA, 25 bp, Mus musculus
gggaaacccacaccagggctttaga

SEQ ID NO: 625218 - DNA, 25 bp, Mus musculus
gggaaacccacagcagggctttaga

SEQ ID NO: 625219 - DNA, 25 bp, Mus musculus
gggaaacccacatatggctcacctt

SEQ ID NO: 625220 - DNA, 25 bp, Mus musculus
gggaaacccactactattgttctgc

SEQ ID NO: 625221 - DNA, 25 bp, Mus musculus
gggaaacccacttctattgttctgc

SEQ ID NO: 625222 - DNA, 25 bp, Mus musculus
gggaaacccatcaaggccacgaatg

SEQ ID NO: 625223 - DNA, 25 bp, Mus musculus
gggaaacccatctaggccacgaatg

SEQ ID NO: 625224 - DNA, 25 bp, Mus musculus
gggaaacccctgcttgacacctgga

SEQ ID NO: 625225 - DNA, 25 bp, Mus musculus
gggaaacccctggttgacacctgga

SEQ ID NO: 625226 - DNA, 25 bp, Mus musculus
gggaaacccgttaatctaagcatat

SEQ ID NO: 625227 - DNA, 25 bp, Mus musculus
gggaaacccgtttatctaagcatat

SEQ ID NO: 625228 - DNA, 25 bp, Mus musculus
gggaaaccctataagtcactcatgg

SEQ ID NO: 625229 - DNA, 25 bp, Mus musculus
gggaaaccctattagtcactcatgg

SEQ ID NO: 625230 - DNA, 25 bp, Mus musculus
gggaaaccctccagccacgggtgct

SEQ ID NO: 625231 - DNA, 25 bp, Mus musculus
gggaaaccctcctgccacgggtgct

SEQ ID NO: 625232 - DNA, 25 bp, Mus musculus
gggaaacccttccaggagagcttca

SEQ ID NO: 625233 - DNA, 25 bp, Mus musculus
gggaaacccttcgaggagagcttca

SEQ ID NO: 625234 - DNA, 25 bp, Mus musculus
gggaaaccgacaataactcgcgcct

SEQ ID NO: 625235 - DNA, 25 bp, Mus musculus
gggaaaccgacacgagctaccagct

SEQ ID NO: 625236 - DNA, 25 bp, Mus musculus
gggaaaccgacaggagctaccagct

SEQ ID NO: 625237 - DNA, 25 bp, Mus musculus
gggaaaccgacattaactcgcgcct

SEQ ID NO: 625238 - DNA, 25 bp, Mus musculus
gggaaaccgctgacgtagacaccgc

SEQ ID NO: 625239 - DNA, 25 bp, Mus musculus
gggaaaccgctgtcgtagacaccgc

SEQ ID NO: 625240 - DNA, 25 bp, Mus musculus
gggaaaccggccacggcttctcgag

SEQ ID NO: 625241 - DNA, 25 bp, Mus musculus
gggaaaccggcctcggcttctcgag

SEQ ID NO: 625242 - DNA, 25 bp, Mus musculus
gggaaaccgtcccactctactgctt

SEQ ID NO: 625243 - DNA, 25 bp, Mus musculus
gggaaaccgtccgactctactgctt

SEQ ID NO: 625244 - DNA, 25 bp, Mus musculus
gggaaacctaacaggccagccataa

SEQ ID NO: 625245 - DNA, 25 bp, Mus musculus
gggaaacctaaccaagatccaatct

SEQ ID NO: 625246 - DNA, 25 bp, Mus musculus
gggaaacctaacgaagatccaatct

SEQ ID NO: 625247 - DNA, 25 bp, Mus musculus
gggaaacctaactggccagccataa

SEQ ID NO: 625248 - DNA, 25 bp, Mus musculus
gggaaacctagtcctcagagactga

SEQ ID NO: 625249 - DNA, 25 bp, Mus musculus
gggaaacctagtgctcagagactga

SEQ ID NO: 625250 - DNA, 25 bp, Mus musculus
gggaaaccttacaaccataccacat

SEQ ID NO: 625251 - DNA, 25 bp, Mus musculus
gggaaaccttactaccataccacat

SEQ ID NO: 625252 - DNA, 25 bp, Mus musculus
gggaaaccttgtctgtcggtgacat

SEQ ID NO: 625253 - DNA, 25 bp, Mus musculus
gggaaaccttgtgtgtcggtgacat

SEQ ID NO: 625254 - DNA, 25 bp, Mus musculus
gggaaacgaggtctctaccacacct

SEQ ID NO: 625255 - DNA, 25 bp, Mus musculus
gggaaacgaggtgtctaccacacct

SEQ ID NO: 625256 - DNA, 25 bp, Mus musculus
gggaaacgctccaatttgtgatgac

SEQ ID NO: 625257 - DNA, 25 bp, Mus musculus
gggaaacgctcctatttgtgatgac

SEQ ID NO: 625258 - DNA, 25 bp, Mus musculus
gggaaacggctcagctaaagatggt

SEQ ID NO: 625259 - DNA, 25 bp, Mus musculus
gggaaacggctctgctaaagatggt

SEQ ID NO: 625260 - DNA, 25 bp, Mus musculus
gggaaactacccctgtactcagtgt

SEQ ID NO: 625261 - DNA, 25 bp, Mus musculus
gggaaactacccgtgtactcagtgt

SEQ ID NO: 625262 - DNA, 25 bp, Mus musculus
gggaaactattcaagacgcctgagc

SEQ ID NO: 625263 - DNA, 25 bp, Mus musculus
gggaaactattctagacgcctgagc

SEQ ID NO: 625264 - DNA, 25 bp, Mus musculus
gggaaactcaaaaccttcactgagc

SEQ ID NO: 625265 - DNA, 25 bp, Mus musculus
gggaaactcaaatccttcactgagc

SEQ ID NO: 625266 - DNA, 25 bp, Mus musculus
gggaaactcagccatgaagcaccat

SEQ ID NO: 625267 - DNA, 25 bp, Mus musculus
gggaaactcagcgatgaagcaccat

SEQ ID NO: 625268 - DNA, 25 bp, Mus musculus
gggaaactcattagaatgcctcctt

SEQ ID NO: 625269 - DNA, 25 bp, Mus musculus
gggaaactcatttgaatgcctcctt

SEQ ID NO: 625270 - DNA, 25 bp, Mus musculus
gggaaactccagaagctttgctcgc

SEQ ID NO: 625271 - DNA, 25 bp, Mus musculus
gggaaactccagtagctttgctcgc

SEQ ID NO: 625272 - DNA, 25 bp, Mus musculus
gggaaactccatctgtagcaagcag

SEQ ID NO: 625273 - DNA, 25 bp, Mus musculus
gggaaactccatgtgtagcaagcag

SEQ ID NO: 625274 - DNA, 25 bp, Mus musculus
gggaaactctcccagtaagctccat

SEQ ID NO: 625275 - DNA, 25 bp, Mus musculus
gggaaactctccgagtaagctccat

SEQ ID NO: 625276 - DNA, 25 bp, Mus musculus
gggaaactgagacccaaggcagctc

SEQ ID NO: 625277 - DNA, 25 bp, Mus musculus
gggaaactgagagccaaggcagctc

SEQ ID NO: 625278 - DNA, 25 bp, Mus musculus
gggaaactgagtccccagtagaact

SEQ ID NO: 625279 - DNA, 25 bp, Mus musculus
gggaaactgagtgcccagtagaact

SEQ ID NO: 625280 - DNA, 25 bp, Mus musculus
gggaaactgcatcaatcctacagaa

SEQ ID NO: 625281 - DNA, 25 bp, Mus musculus
gggaaactgcatgaatcctacagaa

SEQ ID NO: 625282 - DNA, 25 bp, Mus musculus
gggaaactgtacacgttgcagagga

SEQ ID NO: 625283 - DNA, 25 bp, Mus musculus
gggaaactgtactcgttgcagagga

SEQ ID NO: 625284 - DNA, 25 bp, Mus musculus
gggaaactgtagctaagcatttcat

SEQ ID NO: 625285 - DNA, 25 bp, Mus musculus
gggaaactgtaggtaagcatttcat

SEQ ID NO: 625286 - DNA, 25 bp, Mus musculus
gggaaacttaggatgtgtgctatta

SEQ ID NO: 625287 - DNA, 25 bp, Mus musculus
gggaaacttaggttgtgtgctatta

SEQ ID NO: 625288 - DNA, 25 bp, Mus musculus
gggaaacttcccagaaggttgtcag

SEQ ID NO: 625289 - DNA, 25 bp, Mus musculus
gggaaacttccctgaaggttgtcag

SEQ ID NO: 625290 - DNA, 25 bp, Mus musculus
gggaaacttcttcacgtcgatgtag

SEQ ID NO: 625291 - DNA, 25 bp, Mus musculus
gggaaacttcttgacgtcgatgtag

SEQ ID NO: 625292 - DNA, 25 bp, Mus musculus
gggaaacttgtcagtgccaacccca

SEQ ID NO: 625293 - DNA, 25 bp, Mus musculus
gggaaacttgtctgtgccaacccca

SEQ ID NO: 625294 - DNA, 25 bp, Mus musculus
gggaaagaaccgaactatcagataa

SEQ ID NO: 625295 - DNA, 25 bp, Mus musculus
gggaaagaaccgtactatcagataa

SEQ ID NO: 625296 - DNA, 25 bp, Mus musculus
gggaaagaagcaccatctctcatct

SEQ ID NO: 625297 - DNA, 25 bp, Mus musculus
gggaaagaagcagcatctctcatct

SEQ ID NO: 625298 - DNA, 25 bp, Mus musculus
gggaaagaaggccatcttttgctca

SEQ ID NO: 625299 - DNA, 25 bp, Mus musculus
gggaaagaaggcgatcttttgctca

SEQ ID NO: 625300 - DNA, 25 bp, Mus musculus
gggaaagaattcagtcgcccttcga

SEQ ID NO: 625301 - DNA, 25 bp, Mus musculus
gggaaagaattctgtcgcccttcga

SEQ ID NO: 625302 - DNA, 25 bp, Mus musculus
gggaaagacaaacgtatctttgaat

SEQ ID NO: 625303 - DNA, 25 bp, Mus musculus
gggaaagacaaaggtatctttgaat

SEQ ID NO: 625304 - DNA, 25 bp, Mus musculus
gggaaagacaccaccaagcttgaca

SEQ ID NO: 625305 - DNA, 25 bp, Mus musculus
gggaaagacacctccaagcttgaca

SEQ ID NO: 625306 - DNA, 25 bp, Mus musculus
gggaaagaccacctcagatgacctc

SEQ ID NO: 625307 - DNA, 25 bp, Mus musculus
gggaaagaccacgtcagatgacctc

SEQ ID NO: 625308 - DNA, 25 bp, Mus musculus
gggaaagagctcagtgtctggaatt

SEQ ID NO: 625309 - DNA, 25 bp, Mus musculus
gggaaagagctctgtgtctggaatt

SEQ ID NO: 625310 - DNA, 25 bp, Mus musculus
gggaaagagttacaatgacctagaa

SEQ ID NO: 625311 - DNA, 25 bp, Mus musculus
gggaaagagttagaatgacctagaa

SEQ ID NO: 625312 - DNA, 25 bp, Mus musculus
gggaaagatggactggctcaactat

SEQ ID NO: 625313 - DNA, 25 bp, Mus musculus
gggaaagatggagtggctcaactat

SEQ ID NO: 625314 - DNA, 25 bp, Mus musculus
gggaaagatggcagcgccgggtctt

SEQ ID NO: 625315 - DNA, 25 bp, Mus musculus
gggaaagatggctgcgccgggtctt

SEQ ID NO: 625316 - DNA, 25 bp, Mus musculus
gggaaagatttcagcattcatcggc

SEQ ID NO: 625317 - DNA, 25 bp, Mus musculus
gggaaagatttctgcattcatcggc

SEQ ID NO: 625318 - DNA, 25 bp, Mus musculus
gggaaagcaaacaaaatactcttct

SEQ ID NO: 625319 - DNA, 25 bp, Mus musculus
gggaaagcaaactaaatactcttct

SEQ ID NO: 625320 - DNA, 25 bp, Mus musculus
gggaaagcaaccacagagcctttac

SEQ ID NO: 625321 - DNA, 25 bp, Mus musculus
gggaaagcaacctcagagcctttac

SEQ ID NO: 625322 - DNA, 25 bp, Mus musculus
gggaaagcacctaccagtgatctca

SEQ ID NO: 625323 - DNA, 25 bp, Mus musculus
gggaaagcaccttccagtgatctca

SEQ ID NO: 625324 - DNA, 25 bp, Mus musculus
gggaaagcagaaccctcgacctggc

SEQ ID NO: 625325 - DNA, 25 bp, Mus musculus
gggaaagcagaagcctcgacctggc

SEQ ID NO: 625326 - DNA, 25 bp, Mus musculus
gggaaagcagacactgcccgcagtt

SEQ ID NO: 625327 - DNA, 25 bp, Mus musculus
gggaaagcagactctgcccgcagtt

SEQ ID NO: 625328 - DNA, 25 bp, Mus musculus
gggaaagcaggcaacttcttccacc

SEQ ID NO: 625329 - DNA, 25 bp, Mus musculus
gggaaagcaggctacttcttccacc

SEQ ID NO: 625330 - DNA, 25 bp, Mus musculus
gggaaagcagttaacctgtgtccat

SEQ ID NO: 625331 - DNA, 25 bp, Mus musculus
gggaaagcagtttacctgtgtccat

SEQ ID NO: 625332 - DNA, 25 bp, Mus musculus
gggaaagcatgacccctctgcttat

SEQ ID NO: 625333 - DNA, 25 bp, Mus musculus
gggaaagcatgagccctctgcttat

SEQ ID NO: 625334 - DNA, 25 bp, Mus musculus
gggaaagcatttctggaacagcctg

SEQ ID NO: 625335 - DNA, 25 bp, Mus musculus
gggaaagcatttgtggaacagcctg

SEQ ID NO: 625336 - DNA, 25 bp, Mus musculus
gggaaagccaaaccgcctatttact

SEQ ID NO: 625337 - DNA, 25 bp, Mus musculus
gggaaagccaaagcgcctatttact

SEQ ID NO: 625338 - DNA, 25 bp, Mus musculus
gggaaagccaatcctagaggctgaa

SEQ ID NO: 625339 - DNA, 25 bp, Mus musculus
gggaaagccaatgctagaggctgaa

SEQ ID NO: 625340 - DNA, 25 bp, Mus musculus
gggaaagccagcaccgacttcagga

SEQ ID NO: 625341 - DNA, 25 bp, Mus musculus
gggaaagccagctccgacttcagga

SEQ ID NO: 625342 - DNA, 25 bp, Mus musculus
gggaaagcccacagctctgatgatg

SEQ ID NO: 625343 - DNA, 25 bp, Mus musculus
gggaaagcccactgctctgatgatg

SEQ ID NO: 625344 - DNA, 25 bp, Mus musculus
gggaaagcccagaggaaggtcacca

SEQ ID NO: 625345 - DNA, 25 bp, Mus musculus
gggaaagcccagtggaaggtcacca

SEQ ID NO: 625346 - DNA, 25 bp, Mus musculus
gggaaagcccctctgtgaattgaga

SEQ ID NO: 625347 - DNA, 25 bp, Mus musculus
gggaaagcccctgtgtgaattgaga

SEQ ID NO: 625348 - DNA, 25 bp, Mus musculus
gggaaagcccgcagcaggaaccaga

SEQ ID NO: 625349 - DNA, 25 bp, Mus musculus
gggaaagcccgctgcaggaaccaga

SEQ ID NO: 625350 - DNA, 25 bp, Mus musculus
gggaaagccctgagtgtgctcacag

SEQ ID NO: 625351 - DNA, 25 bp, Mus musculus
gggaaagccctgtgtgtgctcacag

SEQ ID NO: 625352 - DNA, 25 bp, Mus musculus
gggaaagcccttacttgttcatgaa

SEQ ID NO: 625353 - DNA, 25 bp, Mus musculus
gggaaagccctttcttgttcatgaa

SEQ ID NO: 625354 - DNA, 25 bp, Mus musculus
gggaaagccgaccagctacagccct

SEQ ID NO: 625355 - DNA, 25 bp, Mus musculus
gggaaagccgacgagctacagccct

SEQ ID NO: 625356 - DNA, 25 bp, Mus musculus
gggaaagcctacaggcacgactcct

SEQ ID NO: 625357 - DNA, 25 bp, Mus musculus
gggaaagcctactggcacgactcct

SEQ ID NO: 625358 - DNA, 25 bp, Mus musculus
gggaaagcctcaccttgcagattac

SEQ ID NO: 625359 - DNA, 25 bp, Mus musculus
gggaaagcctcagcttgcagattac

SEQ ID NO: 625360 - DNA, 25 bp, Mus musculus
gggaaagcctgacgcttgagttcaa

SEQ ID NO: 625361 - DNA, 25 bp, Mus musculus
gggaaagcctgaggcttgagttcaa

SEQ ID NO: 625362 - DNA, 25 bp, Mus musculus
gggaaagcctttacctcaggcgcag

SEQ ID NO: 625363 - DNA, 25 bp, Mus musculus
gggaaagccttttcctcaggcgcag

SEQ ID NO: 625364 - DNA, 25 bp, Mus musculus
gggaaagcgcttacccggcttgaga

SEQ ID NO: 625365 - DNA, 25 bp, Mus musculus
gggaaagcgctttcccggcttgaga

SEQ ID NO: 625366 - DNA, 25 bp, Mus musculus
gggaaagcggccctgatgaactcca

SEQ ID NO: 625367 - DNA, 25 bp, Mus musculus
gggaaagcggccgtgatgaactcca

SEQ ID NO: 625368 - DNA, 25 bp, Mus musculus
gggaaagcgggccatgtggctcatc

SEQ ID NO: 625369 - DNA, 25 bp, Mus musculus
gggaaagcgggcgatgtggctcatc

SEQ ID NO: 625370 - DNA, 25 bp, Mus musculus
gggaaagctgacacaatggcagaaa

SEQ ID NO: 625371 - DNA, 25 bp, Mus musculus
gggaaagctgactcaatggcagaaa

SEQ ID NO: 625372 - DNA, 25 bp, Mus musculus
gggaaagctgtcatcagtctctcac

SEQ ID NO: 625373 - DNA, 25 bp, Mus musculus
gggaaagctgtcttcagtctctcac

SEQ ID NO: 625374 - DNA, 25 bp, Mus musculus
gggaaagctgttacgacctactgct

SEQ ID NO: 625375 - DNA, 25 bp, Mus musculus
gggaaagctgttctaccaaacgtat

SEQ ID NO: 625376 - DNA, 25 bp, Mus musculus
gggaaagctgttgtaccaaacgtat

SEQ ID NO: 625377 - DNA, 25 bp, Mus musculus
gggaaagctgtttcgacctactgct

SEQ ID NO: 625378 - DNA, 25 bp, Mus musculus
gggaaagctttcctgtgtgttcctg

SEQ ID NO: 625379 - DNA, 25 bp, Mus musculus
gggaaagctttcgtgtgtgttcctg

SEQ ID NO: 625380 - DNA, 25 bp, Mus musculus
gggaaaggacttctgtccatccctg

SEQ ID NO: 625381 - DNA, 25 bp, Mus musculus
gggaaaggacttgtgtccatccctg

SEQ ID NO: 625382 - DNA, 25 bp, Mus musculus
gggaaaggagctcagttaactctaa

SEQ ID NO: 625383 - DNA, 25 bp, Mus musculus
gggaaaggagctgagttaactctaa

SEQ ID NO: 625384 - DNA, 25 bp, Mus musculus
gggaaaggattcagccagtcccgga

SEQ ID NO: 625385 - DNA, 25 bp, Mus musculus
gggaaaggattctgccagtcccgga

SEQ ID NO: 625386 - DNA, 25 bp, Mus musculus
gggaaaggccacaactacagacttc

SEQ ID NO: 625387 - DNA, 25 bp, Mus musculus
gggaaaggccactactacagacttc

SEQ ID NO: 625388 - DNA, 25 bp, Mus musculus
gggaaaggccgacagctttcagccc

SEQ ID NO: 625389 - DNA, 25 bp, Mus musculus
gggaaaggccgagagctttcagccc

SEQ ID NO: 625390 - DNA, 25 bp, Mus musculus
gggaaaggcctaacatcattagcaa

SEQ ID NO: 625391 - DNA, 25 bp, Mus musculus
gggaaaggcctatcatcattagcaa

SEQ ID NO: 625392 - DNA, 25 bp, Mus musculus
gggaaagggcatcaagtaaagcgtt

SEQ ID NO: 625393 - DNA, 25 bp, Mus musculus
gggaaagggcatgaagtaaagcgtt

SEQ ID NO: 625394 - DNA, 25 bp, Mus musculus
gggaaaggtcatactctctagatga

SEQ ID NO: 625395 - DNA, 25 bp, Mus musculus
gggaaaggtcattctctctagatga

SEQ ID NO: 625396 - DNA, 25 bp, Mus musculus
gggaaaggtcttcatcatcttcctc

SEQ ID NO: 625397 - DNA, 25 bp, Mus musculus
gggaaaggtcttgatcatcttcctc

SEQ ID NO: 625398 - DNA, 25 bp, Mus musculus
gggaaaggttatctgccatcgcagc

SEQ ID NO: 625399 - DNA, 25 bp, Mus musculus
gggaaaggttatgtgccatcgcagc

SEQ ID NO: 625400 - DNA, 25 bp, Mus musculus
gggaaagtaacaatcctcaccatgt

SEQ ID NO: 625401 - DNA, 25 bp, Mus musculus
gggaaagtaacattcctcaccatgt

SEQ ID NO: 625402 - DNA, 25 bp, Mus musculus
gggaaagtaactcaaatcacaaaag

SEQ ID NO: 625403 - DNA, 25 bp, Mus musculus
gggaaagtaactgaaatcacaaaag

SEQ ID NO: 625404 - DNA, 25 bp, Mus musculus
gggaaagtagctccagtccagcccc

SEQ ID NO: 625405 - DNA, 25 bp, Mus musculus
gggaaagtagctgcagtccagcccc

SEQ ID NO: 625406 - DNA, 25 bp, Mus musculus
gggaaagtcatgagtgactctccaa

SEQ ID NO: 625407 - DNA, 25 bp, Mus musculus
gggaaagtcatgtgtgactctccaa

SEQ ID NO: 625408 - DNA, 25 bp, Mus musculus
gggaaagtcctgagtaagctaataa

SEQ ID NO: 625409 - DNA, 25 bp, Mus musculus
gggaaagtcctgtgtaagctaataa

SEQ ID NO: 625410 - DNA, 25 bp, Mus musculus
gggaaagtccttcagctgccacaac

SEQ ID NO: 625411 - DNA, 25 bp, Mus musculus
gggaaagtccttgagctgccacaac

SEQ ID NO: 625412 - DNA, 25 bp, Mus musculus
gggaaagtctagaatttatgaatca

SEQ ID NO: 625413 - DNA, 25 bp, Mus musculus
gggaaagtctagtatttatgaatca

SEQ ID NO: 625414 - DNA, 25 bp, Mus musculus
gggaaagtgagcactgccattcagt

SEQ ID NO: 625415 - DNA, 25 bp, Mus musculus
gggaaagtgagctctgccattcagt

SEQ ID NO: 625416 - DNA, 25 bp, Mus musculus
gggaaagtgtccatgcatcatagaa

SEQ ID NO: 625417 - DNA, 25 bp, Mus musculus
gggaaagtgtccttgcatcatagaa

SEQ ID NO: 625418 - DNA, 25 bp, Mus musculus
gggaaagttagtccatatgattaaa

SEQ ID NO: 625419 - DNA, 25 bp, Mus musculus
gggaaagttagtgcatatgattaaa

SEQ ID NO: 625420 - DNA, 25 bp, Mus musculus
gggaaagttatgcacctcttgggat

SEQ ID NO: 625421 - DNA, 25 bp, Mus musculus
gggaaagttatggacctcttgggat

SEQ ID NO: 625422 - DNA, 25 bp, Mus musculus
gggaaagttcatctatcttgcctat

SEQ ID NO: 625423 - DNA, 25 bp, Mus musculus
gggaaagttcatgtatcttgcctat

SEQ ID NO: 625424 - DNA, 25 bp, Mus musculus
gggaaagttcctcaacaagacagca

SEQ ID NO: 625425 - DNA, 25 bp, Mus musculus
gggaaagttcctgaacaagacagca

SEQ ID NO: 625426 - DNA, 25 bp, Mus musculus
gggaaagttcgtcccgccagccttt

SEQ ID NO: 625427 - DNA, 25 bp, Mus musculus
gggaaagttcgtgccgccagccttt

SEQ ID NO: 625428 - DNA, 25 bp, Mus musculus
gggaaagttcttacctggcctactg

SEQ ID NO: 625429 - DNA, 25 bp, Mus musculus
gggaaagttctttcctggcctactg

SEQ ID NO: 625430 - DNA, 25 bp, Mus musculus
gggaaataaaggacagcagctatac

SEQ ID NO: 625431 - DNA, 25 bp, Mus musculus
gggaaataaaggtcagcagctatac

SEQ ID NO: 625432 - DNA, 25 bp, Mus musculus
gggaaataaattcttccacaatcct

SEQ ID NO: 625433 - DNA, 25 bp, Mus musculus
gggaaataaattgttccacaatcct

SEQ ID NO: 625434 - DNA, 25 bp, Mus musculus
gggaaataacttaggctaatagctt

SEQ ID NO: 625435 - DNA, 25 bp, Mus musculus
gggaaataactttggctaatagctt

SEQ ID NO: 625436 - DNA, 25 bp, Mus musculus
gggaaataagctacttgctgtatta

SEQ ID NO: 625437 - DNA, 25 bp, Mus musculus
gggaaataagcttcttgctgtatta

SEQ ID NO: 625438 - DNA, 25 bp, Mus musculus
gggaaataatgcatctcgcccacac

SEQ ID NO: 625439 - DNA, 25 bp, Mus musculus
gggaaataatgcttctcgcccacac

SEQ ID NO: 625440 - DNA, 25 bp, Mus musculus
gggaaatacggcatctacacgcatg

SEQ ID NO: 625441 - DNA, 25 bp, Mus musculus
gggaaatacggcttctacacgcatg

SEQ ID NO: 625442 - DNA, 25 bp, Mus musculus
gggaaatactccagatgccttcacc

SEQ ID NO: 625443 - DNA, 25 bp, Mus musculus
gggaaatactcctgatgccttcacc

SEQ ID NO: 625444 - DNA, 25 bp, Mus musculus
gggaaatagttcagtctagccctcc

SEQ ID NO: 625445 - DNA, 25 bp, Mus musculus
gggaaatagttctgtctagccctcc

SEQ ID NO: 625446 - DNA, 25 bp, Mus musculus
gggaaatatagtacacgtgccacgt

SEQ ID NO: 625447 - DNA, 25 bp, Mus musculus
gggaaatatagttcacgtgccacgt

SEQ ID NO: 625448 - DNA, 25 bp, Mus musculus
gggaaatatcctctgcatcagtgac

SEQ ID NO: 625449 - DNA, 25 bp, Mus musculus
gggaaatatcctgtgcatcagtgac

SEQ ID NO: 625450 - DNA, 25 bp, Mus musculus
gggaaatatgtacctttgtgggtta

SEQ ID NO: 625451 - DNA, 25 bp, Mus musculus
gggaaatatgtagctttgtgggtta

SEQ ID NO: 625452 - DNA, 25 bp, Mus musculus
gggaaatatgtcaaagtttactaag

SEQ ID NO: 625453 - DNA, 25 bp, Mus musculus
gggaaatatgtctaagtttactaag

SEQ ID NO: 625454 - DNA, 25 bp, Mus musculus
gggaaatatttcaacatgtgcatat

SEQ ID NO: 625455 - DNA, 25 bp, Mus musculus
gggaaatatttctacatgtgcatat

SEQ ID NO: 625456 - DNA, 25 bp, Mus musculus
gggaaatatttgctacacattgcct

SEQ ID NO: 625457 - DNA, 25 bp, Mus musculus
gggaaatatttggtacacattgcct

SEQ ID NO: 625458 - DNA, 25 bp, Mus musculus
gggaaatcaagtacacagtcaaatt

SEQ ID NO: 625459 - DNA, 25 bp, Mus musculus
gggaaatcaagttcacagtcaaatt

SEQ ID NO: 625460 - DNA, 25 bp, Mus musculus
gggaaatcacaccagaagcctactc

SEQ ID NO: 625461 - DNA, 25 bp, Mus musculus
gggaaatcacacgagaagcctactc

SEQ ID NO: 625462 - DNA, 25 bp, Mus musculus
gggaaatcactaagcccagacgtga

SEQ ID NO: 625463 - DNA, 25 bp, Mus musculus
gggaaatcactatgcccagacgtga

SEQ ID NO: 625464 - DNA, 25 bp, Mus musculus
gggaaatcacttccattaccacgag

SEQ ID NO: 625465 - DNA, 25 bp, Mus musculus
gggaaatcacttgcattaccacgag

SEQ ID NO: 625466 - DNA, 25 bp, Mus musculus
gggaaatcagatcccctaaggttgt

SEQ ID NO: 625467 - DNA, 25 bp, Mus musculus
gggaaatcagatgccctaaggttgt

SEQ ID NO: 625468 - DNA, 25 bp, Mus musculus
gggaaatcagtcagcctggttcaca

SEQ ID NO: 625469 - DNA, 25 bp, Mus musculus
gggaaatcagtctgcctggttcaca

SEQ ID NO: 625470 - DNA, 25 bp, Mus musculus
gggaaatcagttagtgtaccaagat

SEQ ID NO: 625471 - DNA, 25 bp, Mus musculus
gggaaatcagtttgtgtaccaagat

SEQ ID NO: 625472 - DNA, 25 bp, Mus musculus
gggaaatccaacagacatgtcgcag

SEQ ID NO: 625473 - DNA, 25 bp, Mus musculus
gggaaatccaactgacatgtcgcag

SEQ ID NO: 625474 - DNA, 25 bp, Mus musculus
gggaaatccaagactgtgctctgtt

SEQ ID NO: 625475 - DNA, 25 bp, Mus musculus
gggaaatccaagtctgtgctctgtt

SEQ ID NO: 625476 - DNA, 25 bp, Mus musculus
gggaaatccacactcccgttcatga

SEQ ID NO: 625477 - DNA, 25 bp, Mus musculus
gggaaatccacagtcccgttcatga

SEQ ID NO: 625478 - DNA, 25 bp, Mus musculus
gggaaatccagaccgtgctgcctga

SEQ ID NO: 625479 - DNA, 25 bp, Mus musculus
gggaaatccagagcgtgctgcctga

SEQ ID NO: 625480 - DNA, 25 bp, Mus musculus
gggaaatcccataaccatgttactt

SEQ ID NO: 625481 - DNA, 25 bp, Mus musculus
gggaaatcccattaccatgttactt

SEQ ID NO: 625482 - DNA, 25 bp, Mus musculus
gggaaatccgtacagtcaagagaac

SEQ ID NO: 625483 - DNA, 25 bp, Mus musculus
gggaaatccgtagagtcaagagaac

SEQ ID NO: 625484 - DNA, 25 bp, Mus musculus
gggaaatcctttagtcaatgttcaa

SEQ ID NO: 625485 - DNA, 25 bp, Mus musculus
gggaaatccttttgtcaatgttcaa

SEQ ID NO: 625486 - DNA, 25 bp, Mus musculus
gggaaatcgccaccttcgataaggc

SEQ ID NO: 625487 - DNA, 25 bp, Mus musculus
gggaaatcgccagcttcgataaggc

SEQ ID NO: 625488 - DNA, 25 bp, Mus musculus
gggaaatcgttgagtcttacttagc

SEQ ID NO: 625489 - DNA, 25 bp, Mus musculus
gggaaatcgttgtgtcttacttagc

SEQ ID NO: 625490 - DNA, 25 bp, Mus musculus
gggaaatctcctaagaccctgatct

SEQ ID NO: 625491 - DNA, 25 bp, Mus musculus
gggaaatctccttagaccctgatct

SEQ ID NO: 625492 - DNA, 25 bp, Mus musculus
gggaaatctgcaactcctgaagact

SEQ ID NO: 625493 - DNA, 25 bp, Mus musculus
gggaaatctgcaccattctttgtaa

SEQ ID NO: 625494 - DNA, 25 bp, Mus musculus
gggaaatctgcagcattctttgtaa

SEQ ID NO: 625495 - DNA, 25 bp, Mus musculus
gggaaatctgcatctcctgaagact

SEQ ID NO: 625496 - DNA, 25 bp, Mus musculus
gggaaatctgtgatgactacccttc

SEQ ID NO: 625497 - DNA, 25 bp, Mus musculus
gggaaatctgtgttgactacccttc

SEQ ID NO: 625498 - DNA, 25 bp, Mus musculus
gggaaatcttcccacctgaagacag

SEQ ID NO: 625499 - DNA, 25 bp, Mus musculus
gggaaatcttccgacctgaagacag

SEQ ID NO: 625500 - DNA, 25 bp, Mus musculus
gggaaatcttgtatgttactgtcat

SEQ ID NO: 625501 - DNA, 25 bp, Mus musculus
gggaaatcttgtttgttactgtcat

SEQ ID NO: 625502 - DNA, 25 bp, Mus musculus
gggaaatctttcagccaaacctcat

SEQ ID NO: 625503 - DNA, 25 bp, Mus musculus
gggaaatctttccaaacaccttcag

SEQ ID NO: 625504 - DNA, 25 bp, Mus musculus
gggaaatctttcgaaacaccttcag

SEQ ID NO: 625505 - DNA, 25 bp, Mus musculus
gggaaatctttctgccaaacctcat

SEQ ID NO: 625506 - DNA, 25 bp, Mus musculus
gggaaatctttgagcctgtcataca

SEQ ID NO: 625507 - DNA, 25 bp, Mus musculus
gggaaatctttgtgcctgtcataca

SEQ ID NO: 625508 - DNA, 25 bp, Mus musculus
gggaaatgacttccccgcagtcaca

SEQ ID NO: 625509 - DNA, 25 bp, Mus musculus
gggaaatgacttgcccgcagtcaca

SEQ ID NO: 625510 - DNA, 25 bp, Mus musculus
gggaaatgatatcccagtaaagtac

SEQ ID NO: 625511 - DNA, 25 bp, Mus musculus
gggaaatgatatgccagtaaagtac

SEQ ID NO: 625512 - DNA, 25 bp, Mus musculus
gggaaatgatcactgtcacctggcc

SEQ ID NO: 625513 - DNA, 25 bp, Mus musculus
gggaaatgatcagtgtcacctggcc

SEQ ID NO: 625514 - DNA, 25 bp, Mus musculus
gggaaatgatggactctcataagta

SEQ ID NO: 625515 - DNA, 25 bp, Mus musculus
gggaaatgatggtctctcataagta

SEQ ID NO: 625516 - DNA, 25 bp, Mus musculus
gggaaatgcaaacttggtgttctga

SEQ ID NO: 625517 - DNA, 25 bp, Mus musculus
gggaaatgcaaagttggtgttctga

SEQ ID NO: 625518 - DNA, 25 bp, Mus musculus
gggaaatgctatctattggtgttta

SEQ ID NO: 625519 - DNA, 25 bp, Mus musculus
gggaaatgctatgtattggtgttta

SEQ ID NO: 625520 - DNA, 25 bp, Mus musculus
gggaaatgctcacggataagtgctt

SEQ ID NO: 625521 - DNA, 25 bp, Mus musculus
gggaaatgctcagggataagtgctt

SEQ ID NO: 625522 - DNA, 25 bp, Mus musculus
gggaaatggcaccaaggactctact

SEQ ID NO: 625523 - DNA, 25 bp, Mus musculus
gggaaatggcacgaaggactctact

SEQ ID NO: 625524 - DNA, 25 bp, Mus musculus
gggaaatggcatccctgtatgaagc

SEQ ID NO: 625525 - DNA, 25 bp, Mus musculus
gggaaatggcatgcctgtatgaagc

SEQ ID NO: 625526 - DNA, 25 bp, Mus musculus
gggaaatggtaaacgctaagagctc

SEQ ID NO: 625527 - DNA, 25 bp, Mus musculus
gggaaatggtaatcgctaagagctc

SEQ ID NO: 625528 - DNA, 25 bp, Mus musculus
gggaaatggtctcagtgccttcata

SEQ ID NO: 625529 - DNA, 25 bp, Mus musculus
gggaaatggtctgagtgccttcata

SEQ ID NO: 625530 - DNA, 25 bp, Mus musculus
gggaaatgtattaggcatctgccac

SEQ ID NO: 625531 - DNA, 25 bp, Mus musculus
gggaaatgtatttggcatctgccac

SEQ ID NO: 625532 - DNA, 25 bp, Mus musculus
gggaaatgtgcacccaagtgctcta

SEQ ID NO: 625533 - DNA, 25 bp, Mus musculus
gggaaatgtgcagccaagtgctcta

SEQ ID NO: 625534 - DNA, 25 bp, Mus musculus
gggaaatgtgtgagaccattatttg

SEQ ID NO: 625535 - DNA, 25 bp, Mus musculus
gggaaatgtgtgctttgggtcctta

SEQ ID NO: 625536 - DNA, 25 bp, Mus musculus
gggaaatgtgtggtttgggtcctta

SEQ ID NO: 625537 - DNA, 25 bp, Mus musculus
gggaaatgtgtgtgaccattatttg

SEQ ID NO: 625538 - DNA, 25 bp, Mus musculus
gggaaatgttcgatgccttaaatca

SEQ ID NO: 625539 - DNA, 25 bp, Mus musculus
gggaaatgttcgttgccttaaatca

SEQ ID NO: 625540 - DNA, 25 bp, Mus musculus
gggaaatgttgaactcagccttgag

SEQ ID NO: 625541 - DNA, 25 bp, Mus musculus
gggaaatgttgatctcagccttgag

SEQ ID NO: 625542 - DNA, 25 bp, Mus musculus
gggaaattaatcctctcaacctcac

SEQ ID NO: 625543 - DNA, 25 bp, Mus musculus
gggaaattaatcgtctcaacctcac

SEQ ID NO: 625544 - DNA, 25 bp, Mus musculus
gggaaattacataacagtgctgcta

SEQ ID NO: 625545 - DNA, 25 bp, Mus musculus
gggaaattacattacagtgctgcta

SEQ ID NO: 625546 - DNA, 25 bp, Mus musculus
gggaaattacccacagagatgcaag

SEQ ID NO: 625547 - DNA, 25 bp, Mus musculus
gggaaattaccctcagagatgcaag

SEQ ID NO: 625548 - DNA, 25 bp, Mus musculus
gggaaattacgtaacatgtcaactg

SEQ ID NO: 625549 - DNA, 25 bp, Mus musculus
gggaaattacgttacatgtcaactg

SEQ ID NO: 625550 - DNA, 25 bp, Mus musculus
gggaaattcacaatctgtaactaca

SEQ ID NO: 625551 - DNA, 25 bp, Mus musculus
gggaaattcacattctgtaactaca

SEQ ID NO: 625552 - DNA, 25 bp, Mus musculus
gggaaattcccaagagccgcttgaa

SEQ ID NO: 625553 - DNA, 25 bp, Mus musculus
gggaaattcccatgagccgcttgaa

SEQ ID NO: 625554 - DNA, 25 bp, Mus musculus
gggaaattccctcaggaagccctct

SEQ ID NO: 625555 - DNA, 25 bp, Mus musculus
gggaaattccctcctgttttggctt

SEQ ID NO: 625556 - DNA, 25 bp, Mus musculus
gggaaattccctgaggaagccctct

SEQ ID NO: 625557 - DNA, 25 bp, Mus musculus
gggaaattccctgctgttttggctt

SEQ ID NO: 625558 - DNA, 25 bp, Mus musculus
gggaaattcctcaactgatgtacag

SEQ ID NO: 625559 - DNA, 25 bp, Mus musculus
gggaaattcctctactgatgtacag

SEQ ID NO: 625560 - DNA, 25 bp, Mus musculus
gggaaattctacaccctcttgtgaa

SEQ ID NO: 625561 - DNA, 25 bp, Mus musculus
gggaaattctactccctcttgtgaa

SEQ ID NO: 625562 - DNA, 25 bp, Mus musculus
gggaaattctctcgtgcttctttta

SEQ ID NO: 625563 - DNA, 25 bp, Mus musculus
gggaaattctctggtgcttctttta

SEQ ID NO: 625564 - DNA, 25 bp, Mus musculus
gggaaattgagcagtatcactgata

SEQ ID NO: 625565 - DNA, 25 bp, Mus musculus
gggaaattgagctgtatcactgata

SEQ ID NO: 625566 - DNA, 25 bp, Mus musculus
gggaaattgccacgaacctcacctg

SEQ ID NO: 625567 - DNA, 25 bp, Mus musculus
gggaaattgccaggaacctcacctg

SEQ ID NO: 625568 - DNA, 25 bp, Mus musculus
gggaaattgctgagatacctttaag

SEQ ID NO: 625569 - DNA, 25 bp, Mus musculus
gggaaattgctgtgatacctttaag

SEQ ID NO: 625570 - DNA, 25 bp, Mus musculus
gggaaattgtcccatgtgccttaca

SEQ ID NO: 625571 - DNA, 25 bp, Mus musculus
gggaaattgtccgatgtgccttaca

SEQ ID NO: 625572 - DNA, 25 bp, Mus musculus
gggaaattgtgactttcagaattga

SEQ ID NO: 625573 - DNA, 25 bp, Mus musculus
gggaaattgtgagtttcagaattga

SEQ ID NO: 625574 - DNA, 25 bp, Mus musculus
gggaaatttaccaagcctacacatt

SEQ ID NO: 625575 - DNA, 25 bp, Mus musculus
gggaaatttacctagcctacacatt

SEQ ID NO: 625576 - DNA, 25 bp, Mus musculus
gggaaatttcacatgctgttttgta

SEQ ID NO: 625577 - DNA, 25 bp, Mus musculus
gggaaatttcacttgctgttttgta

SEQ ID NO: 625578 - DNA, 25 bp, Mus musculus
gggaaattttgtatgttactgtcat

SEQ ID NO: 625579 - DNA, 25 bp, Mus musculus
gggaaattttgtttgttactgtcat

SEQ ID NO: 625580 - DNA, 25 bp, Mus musculus
gggaacaacaacatcatatttcaga

SEQ ID NO: 625581 - DNA, 25 bp, Mus musculus
gggaacaacaacttcatatttcaga

SEQ ID NO: 625582 - DNA, 25 bp, Mus musculus
gggaacaactttagggcgcacaact

SEQ ID NO: 625583 - DNA, 25 bp, Mus musculus
gggaacaacttttgggcgcacaact

SEQ ID NO: 625584 - DNA, 25 bp, Mus musculus
gggaacaagactaccaatctctgca

SEQ ID NO: 625585 - DNA, 25 bp, Mus musculus
gggaacaagacttccaatctctgca

SEQ ID NO: 625586 - DNA, 25 bp, Mus musculus
gggaacaagtccatgaagaccaatt

SEQ ID NO: 625587 - DNA, 25 bp, Mus musculus
gggaacaagtccttgaagaccaatt

SEQ ID NO: 625588 - DNA, 25 bp, Mus musculus
gggaacaatcatctgcgaaggagaa

SEQ ID NO: 625589 - DNA, 25 bp, Mus musculus
gggaacaatcatgtgcgaaggagaa

SEQ ID NO: 625590 - DNA, 25 bp, Mus musculus
gggaacaatccaatcaactcgaggg

SEQ ID NO: 625591 - DNA, 25 bp, Mus musculus
gggaacaatccattcaactcgaggg

SEQ ID NO: 625592 - DNA, 25 bp, Mus musculus
gggaacaatgtgaatcagatgattt

SEQ ID NO: 625593 - DNA, 25 bp, Mus musculus
gggaacaatgtgtatcagatgattt

SEQ ID NO: 625594 - DNA, 25 bp, Mus musculus
gggaacaattacaggccactgctga

SEQ ID NO: 625595 - DNA, 25 bp, Mus musculus
gggaacaattactggccactgctga

SEQ ID NO: 625596 - DNA, 25 bp, Mus musculus
gggaacaattctactggaatcagat

SEQ ID NO: 625597 - DNA, 25 bp, Mus musculus
gggaacaattcttctggaatcagat

SEQ ID NO: 625598 - DNA, 25 bp, Mus musculus
gggaacacaaacattcaactctgct

SEQ ID NO: 625599 - DNA, 25 bp, Mus musculus
gggaacacaaactttcaactctgct

SEQ ID NO: 625600 - DNA, 25 bp, Mus musculus
gggaacacaacaccctcataattca

SEQ ID NO: 625601 - DNA, 25 bp, Mus musculus
gggaacacaacagcctcataattca

SEQ ID NO: 625602 - DNA, 25 bp, Mus musculus
gggaacacaagcagaacttcaaata

SEQ ID NO: 625603 - DNA, 25 bp, Mus musculus
gggaacacaagctgaacttcaaata

SEQ ID NO: 625604 - DNA, 25 bp, Mus musculus
gggaacacaccacagcaggatcgaa

SEQ ID NO: 625605 - DNA, 25 bp, Mus musculus
gggaacacaccagagcaggatcgaa

SEQ ID NO: 625606 - DNA, 25 bp, Mus musculus
gggaacacactcatcaggcagccta

SEQ ID NO: 625607 - DNA, 25 bp, Mus musculus
gggaacacactcttcaggcagccta

SEQ ID NO: 625608 - DNA, 25 bp, Mus musculus
gggaacacagagaccttggctttta

SEQ ID NO: 625609 - DNA, 25 bp, Mus musculus
gggaacacagagtccttggctttta

SEQ ID NO: 625610 - DNA, 25 bp, Mus musculus
gggaacacagcgctatctccgaatt

SEQ ID NO: 625611 - DNA, 25 bp, Mus musculus
gggaacacagcggtatctccgaatt

SEQ ID NO: 625612 - DNA, 25 bp, Mus musculus
gggaacacagtccaaagccttctat

SEQ ID NO: 625613 - DNA, 25 bp, Mus musculus
gggaacacagtcgaaagccttctat

SEQ ID NO: 625614 - DNA, 25 bp, Mus musculus
gggaacacatctcggatctctgagg

SEQ ID NO: 625615 - DNA, 25 bp, Mus musculus
gggaacacatctgggatctctgagg

SEQ ID NO: 625616 - DNA, 25 bp, Mus musculus
gggaacacatttcgaggctcctttc

SEQ ID NO: 625617 - DNA, 25 bp, Mus musculus
gggaacacatttggaggctcctttc

SEQ ID NO: 625618 - DNA, 25 bp, Mus musculus
gggaacaccaatccttaagtacttt

SEQ ID NO: 625619 - DNA, 25 bp, Mus musculus
gggaacaccaatgcttaagtacttt

SEQ ID NO: 625620 - DNA, 25 bp, Mus musculus
gggaacaccagcaactctaacttat

SEQ ID NO: 625621 - DNA, 25 bp, Mus musculus
gggaacaccagctactctaacttat

SEQ ID NO: 625622 - DNA, 25 bp, Mus musculus
gggaacaccatcaggttactgccca

SEQ ID NO: 625623 - DNA, 25 bp, Mus musculus
gggaacaccatcctggcttctgaac

SEQ ID NO: 625624 - DNA, 25 bp, Mus musculus
gggaacaccatcgtggcttctgaac

SEQ ID NO: 625625 - DNA, 25 bp, Mus musculus
gggaacaccatctggttactgccca

SEQ ID NO: 625626 - DNA, 25 bp, Mus musculus
gggaacacgaggatactacagataa

SEQ ID NO: 625627 - DNA, 25 bp, Mus musculus
gggaacacgaggttactacagataa

SEQ ID NO: 625628 - DNA, 25 bp, Mus musculus
gggaacacgagtacacacggcagtt

SEQ ID NO: 625629 - DNA, 25 bp, Mus musculus
gggaacacgagttcacacggcagtt

SEQ ID NO: 625630 - DNA, 25 bp, Mus musculus
gggaacacgctgcaggttctcaaca

SEQ ID NO: 625631 - DNA, 25 bp, Mus musculus
gggaacacgctggaggttctcaaca

SEQ ID NO: 625632 - DNA, 25 bp, Mus musculus
gggaacactaataagacactggact

SEQ ID NO: 625633 - DNA, 25 bp, Mus musculus
gggaacactaattagacactggact

SEQ ID NO: 625634 - DNA, 25 bp, Mus musculus
gggaacactagccagaattatcaga

SEQ ID NO: 625635 - DNA, 25 bp, Mus musculus
gggaacactagcgagaattatcaga

SEQ ID NO: 625636 - DNA, 25 bp, Mus musculus
gggaacactcaaactttcaagggaa

SEQ ID NO: 625637 - DNA, 25 bp, Mus musculus
gggaacactcaatctttcaagggaa

SEQ ID NO: 625638 - DNA, 25 bp, Mus musculus
gggaacactccgatatggctagcag

SEQ ID NO: 625639 - DNA, 25 bp, Mus musculus
gggaacactccgttatggctagcag

SEQ ID NO: 625640 - DNA, 25 bp, Mus musculus
gggaacactcgacacttctaaacat

SEQ ID NO: 625641 - DNA, 25 bp, Mus musculus
gggaacactcgagacttctaaacat

SEQ ID NO: 625642 - DNA, 25 bp, Mus musculus
gggaacactgtgctcaaggcagcat

SEQ ID NO: 625643 - DNA, 25 bp, Mus musculus
gggaacactgtggtcaaggcagcat

SEQ ID NO: 625644 - DNA, 25 bp, Mus musculus
gggaacacttaacccacaatggaag

SEQ ID NO: 625645 - DNA, 25 bp, Mus musculus
gggaacacttaagccacaatggaag

SEQ ID NO: 625646 - DNA, 25 bp, Mus musculus
gggaacacttcacttgttttgcaag

SEQ ID NO: 625647 - DNA, 25 bp, Mus musculus
gggaacacttcagttgttttgcaag

SEQ ID NO: 625648 - DNA, 25 bp, Mus musculus
gggaacacttctaccaggattttgt

SEQ ID NO: 625649 - DNA, 25 bp, Mus musculus
gggaacacttcttccaggattttgt

SEQ ID NO: 625650 - DNA, 25 bp, Mus musculus
gggaacacttgtccttgaccctcgg

SEQ ID NO: 625651 - DNA, 25 bp, Mus musculus
gggaacacttgtgcttgaccctcgg

SEQ ID NO: 625652 - DNA, 25 bp, Mus musculus
gggaacagaaataagcgacaatact

SEQ ID NO: 625653 - DNA, 25 bp, Mus musculus
gggaacagaaattagcgacaatact

SEQ ID NO: 625654 - DNA, 25 bp, Mus musculus
gggaacagaaccatcttaagagcaa

SEQ ID NO: 625655 - DNA, 25 bp, Mus musculus
gggaacagaaccttcttaagagcaa

SEQ ID NO: 625656 - DNA, 25 bp, Mus musculus
gggaacagacccctggcctgcataa

SEQ ID NO: 625657 - DNA, 25 bp, Mus musculus
gggaacagacccgtggcctgcataa

SEQ ID NO: 625658 - DNA, 25 bp, Mus musculus
gggaacagactaccaccccatttgt

SEQ ID NO: 625659 - DNA, 25 bp, Mus musculus
gggaacagactagcaccccatttgt

SEQ ID NO: 625660 - DNA, 25 bp, Mus musculus
gggaacagactgagctatatgactt

SEQ ID NO: 625661 - DNA, 25 bp, Mus musculus
gggaacagactgtgctatatgactt

SEQ ID NO: 625662 - DNA, 25 bp, Mus musculus
gggaacagatagaccagtccacctg

SEQ ID NO: 625663 - DNA, 25 bp, Mus musculus
gggaacagatagtccagtccacctg

SEQ ID NO: 625664 - DNA, 25 bp, Mus musculus
gggaacagatgccactgcgtcgcct

SEQ ID NO: 625665 - DNA, 25 bp, Mus musculus
gggaacagatgcgactgcgtcgcct

SEQ ID NO: 625666 - DNA, 25 bp, Mus musculus
gggaacagattgacccttctaccca

SEQ ID NO: 625667 - DNA, 25 bp, Mus musculus
gggaacagattgtcccttctaccca

SEQ ID NO: 625668 - DNA, 25 bp, Mus musculus
gggaacagatttagacctagatcaa

SEQ ID NO: 625669 - DNA, 25 bp, Mus musculus
gggaacagatttatgccacaacaaa

SEQ ID NO: 625670 - DNA, 25 bp, Mus musculus
gggaacagatttcttatggcaccct

SEQ ID NO: 625671 - DNA, 25 bp, Mus musculus
gggaacagatttgttatggcaccct

SEQ ID NO: 625672 - DNA, 25 bp, Mus musculus
gggaacagattttgacctagatcaa

SEQ ID NO: 625673 - DNA, 25 bp, Mus musculus
gggaacagatttttgccacaacaaa

SEQ ID NO: 625674 - DNA, 25 bp, Mus musculus
gggaacagcacgctcagtggaaaga

SEQ ID NO: 625675 - DNA, 25 bp, Mus musculus
gggaacagcacggtcagtggaaaga

SEQ ID NO: 625676 - DNA, 25 bp, Mus musculus
gggaacagcagcaggactcctcaaa

SEQ ID NO: 625677 - DNA, 25 bp, Mus musculus
gggaacagcagctggactcctcaaa

SEQ ID NO: 625678 - DNA, 25 bp, Mus musculus
gggaacagcattatagggttccatt

SEQ ID NO: 625679 - DNA, 25 bp, Mus musculus
gggaacagcattttagggttccatt

SEQ ID NO: 625680 - DNA, 25 bp, Mus musculus
gggaacagcggacagacatgctaca

SEQ ID NO: 625681 - DNA, 25 bp, Mus musculus
gggaacagcggagagacatgctaca

SEQ ID NO: 625682 - DNA, 25 bp, Mus musculus
gggaacagctgcattaaaagttact

SEQ ID NO: 625683 - DNA, 25 bp, Mus musculus
gggaacagctgctttaaaagttact

SEQ ID NO: 625684 - DNA, 25 bp, Mus musculus
gggaacagcttaaccacactagcat

SEQ ID NO: 625685 - DNA, 25 bp, Mus musculus
gggaacagcttatccacactagcat

SEQ ID NO: 625686 - DNA, 25 bp, Mus musculus
gggaacaggatcactgggaccgcct

SEQ ID NO: 625687 - DNA, 25 bp, Mus musculus
gggaacaggatctctgggaccgcct

SEQ ID NO: 625688 - DNA, 25 bp, Mus musculus
gggaacaggttcacccatccagctg

SEQ ID NO: 625689 - DNA, 25 bp, Mus musculus
gggaacaggttctcccatccagctg

SEQ ID NO: 625690 - DNA, 25 bp, Mus musculus
gggaacaggtttacatacattcatg

SEQ ID NO: 625691 - DNA, 25 bp, Mus musculus
gggaacaggttttcatacattcatg

SEQ ID NO: 625692 - DNA, 25 bp, Mus musculus
gggaacagtcctagatcagccagcc

SEQ ID NO: 625693 - DNA, 25 bp, Mus musculus
gggaacagtccttgatcagccagcc

SEQ ID NO: 625694 - DNA, 25 bp, Mus musculus
gggaacagtcttcaagagagccttg

SEQ ID NO: 625695 - DNA, 25 bp, Mus musculus
gggaacagtcttgaagagagccttg

SEQ ID NO: 625696 - DNA, 25 bp, Mus musculus
gggaacataaccattactagcttta

SEQ ID NO: 625697 - DNA, 25 bp, Mus musculus
gggaacataacctttactagcttta

SEQ ID NO: 625698 - DNA, 25 bp, Mus musculus
gggaacatagatcaccatgcagtta

SEQ ID NO: 625699 - DNA, 25 bp, Mus musculus
gggaacatagatgaccatgcagtta

SEQ ID NO: 625700 - DNA, 25 bp, Mus musculus
gggaacatagttatctgtctcaatt

SEQ ID NO: 625701 - DNA, 25 bp, Mus musculus
gggaacatagttctggcgtttccag

SEQ ID NO: 625702 - DNA, 25 bp, Mus musculus
gggaacatagttgtggcgtttccag

SEQ ID NO: 625703 - DNA, 25 bp, Mus musculus
gggaacatagttttctgtctcaatt

SEQ ID NO: 625704 - DNA, 25 bp, Mus musculus
gggaacatattccacggatgccaat

SEQ ID NO: 625705 - DNA, 25 bp, Mus musculus
gggaacatattcgacggatgccaat

SEQ ID NO: 625706 - DNA, 25 bp, Mus musculus
gggaacatcaggaagcatacagaac

SEQ ID NO: 625707 - DNA, 25 bp, Mus musculus
gggaacatcaggacacaccatgtaa

SEQ ID NO: 625708 - DNA, 25 bp, Mus musculus
gggaacatcaggtagcatacagaac

SEQ ID NO: 625709 - DNA, 25 bp, Mus musculus
gggaacatcaggtcacaccatgtaa

SEQ ID NO: 625710 - DNA, 25 bp, Mus musculus
gggaacatccctcccgaaagctaca

SEQ ID NO: 625711 - DNA, 25 bp, Mus musculus
gggaacatccctgccgaaagctaca

SEQ ID NO: 625712 - DNA, 25 bp, Mus musculus
gggaacatcctgatagggctgagta

SEQ ID NO: 625713 - DNA, 25 bp, Mus musculus
gggaacatcctgttagggctgagta

SEQ ID NO: 625714 - DNA, 25 bp, Mus musculus
gggaacatcgcacgtttcctgttct

SEQ ID NO: 625715 - DNA, 25 bp, Mus musculus
gggaacatcgcaggtttcctgttct

SEQ ID NO: 625716 - DNA, 25 bp, Mus musculus
gggaacatcttaaggtcctgctaga

SEQ ID NO: 625717 - DNA, 25 bp, Mus musculus
gggaacatcttatggtcctgctaga

SEQ ID NO: 625718 - DNA, 25 bp, Mus musculus
gggaacatgccaacaaggaactaaa

SEQ ID NO: 625719 - DNA, 25 bp, Mus musculus
gggaacatgccactgtgcacgagta

SEQ ID NO: 625720 - DNA, 25 bp, Mus musculus
gggaacatgccagtgtgcacgagta

SEQ ID NO: 625721 - DNA, 25 bp, Mus musculus
gggaacatgccatcaaggaactaaa

SEQ ID NO: 625722 - DNA, 25 bp, Mus musculus
gggaacatggcacagcccttgccta

SEQ ID NO: 625723 - DNA, 25 bp, Mus musculus
gggaacatggcagagcccttgccta

SEQ ID NO: 625724 - DNA, 25 bp, Mus musculus
gggaacatggtgatcactcatctca

SEQ ID NO: 625725 - DNA, 25 bp, Mus musculus
gggaacatggtgttcactcatctca

SEQ ID NO: 625726 - DNA, 25 bp, Mus musculus
gggaacatgtaaccccgcataccct

SEQ ID NO: 625727 - DNA, 25 bp, Mus musculus
gggaacatgtaagcccgcataccct

SEQ ID NO: 625728 - DNA, 25 bp, Mus musculus
gggaacatgtttaacgactctactc

SEQ ID NO: 625729 - DNA, 25 bp, Mus musculus
gggaacatgttttacgactctactc

SEQ ID NO: 625730 - DNA, 25 bp, Mus musculus
gggaacattcataccacctctcaag

SEQ ID NO: 625731 - DNA, 25 bp, Mus musculus
gggaacattcattccacctctcaag

SEQ ID NO: 625732 - DNA, 25 bp, Mus musculus
gggaacattctaaaacctctctgct

SEQ ID NO: 625733 - DNA, 25 bp, Mus musculus
gggaacattctaactttctgtccaa

SEQ ID NO: 625734 - DNA, 25 bp, Mus musculus
gggaacattctataacctctctgct

SEQ ID NO: 625735 - DNA, 25 bp, Mus musculus
gggaacattctatctttctgtccaa

SEQ ID NO: 625736 - DNA, 25 bp, Mus musculus
gggaacatttcacatccaagtcaat

SEQ ID NO: 625737 - DNA, 25 bp, Mus musculus
gggaacatttcagatccaagtcaat

SEQ ID NO: 625738 - DNA, 25 bp, Mus musculus
gggaacattttcaaagttggcacat

SEQ ID NO: 625739 - DNA, 25 bp, Mus musculus
gggaacattttctaagttggcacat

SEQ ID NO: 625740 - DNA, 25 bp, Mus musculus
gggaacattttgcatgcctgcacat

SEQ ID NO: 625741 - DNA, 25 bp, Mus musculus
gggaacattttggatgcctgcacat

SEQ ID NO: 625742 - DNA, 25 bp, Mus musculus
gggaaccaaactactggtacctctg

SEQ ID NO: 625743 - DNA, 25 bp, Mus musculus
gggaaccaaacttctggtacctctg

SEQ ID NO: 625744 - DNA, 25 bp, Mus musculus
gggaaccaacacactgagctcagca

SEQ ID NO: 625745 - DNA, 25 bp, Mus musculus
gggaaccaacactctgagctcagca

SEQ ID NO: 625746 - DNA, 25 bp, Mus musculus
gggaaccaagatccagtttcctgga

SEQ ID NO: 625747 - DNA, 25 bp, Mus musculus
gggaaccaagatgcagtttcctgga

SEQ ID NO: 625748 - DNA, 25 bp, Mus musculus
gggaaccaagtaccccagttatcaa

SEQ ID NO: 625749 - DNA, 25 bp, Mus musculus
gggaaccaagtagcccagttatcaa

SEQ ID NO: 625750 - DNA, 25 bp, Mus musculus
gggaaccaagtcactcatggatgag

SEQ ID NO: 625751 - DNA, 25 bp, Mus musculus
gggaaccaagtctctcatggatgag

SEQ ID NO: 625752 - DNA, 25 bp, Mus musculus
gggaaccaattaaccttgactgcaa

SEQ ID NO: 625753 - DNA, 25 bp, Mus musculus
gggaaccaattatccttgactgcaa

SEQ ID NO: 625754 - DNA, 25 bp, Mus musculus
gggaaccacaagactttctgctgac

SEQ ID NO: 625755 - DNA, 25 bp, Mus musculus
gggaaccacaagtctttctgctgac

SEQ ID NO: 625756 - DNA, 25 bp, Mus musculus
gggaaccacacacccggaagaacat

SEQ ID NO: 625757 - DNA, 25 bp, Mus musculus
gggaaccacacagccggaagaacat

SEQ ID NO: 625758 - DNA, 25 bp, Mus musculus
gggaaccacagcaccattgtcatgg

SEQ ID NO: 625759 - DNA, 25 bp, Mus musculus
gggaaccacagctccattgtcatgg

SEQ ID NO: 625760 - DNA, 25 bp, Mus musculus
gggaaccaccaacccagatctgtta

SEQ ID NO: 625761 - DNA, 25 bp, Mus musculus
gggaaccaccaagccagatctgtta

SEQ ID NO: 625762 - DNA, 25 bp, Mus musculus
gggaaccacccaagtgtctatgaat

SEQ ID NO: 625763 - DNA, 25 bp, Mus musculus
gggaaccacccatgtgtctatgaat

SEQ ID NO: 625764 - DNA, 25 bp, Mus musculus
gggaaccacgttagctcagagccag

SEQ ID NO: 625765 - DNA, 25 bp, Mus musculus
gggaaccacgtttgctcagagccag

SEQ ID NO: 625766 - DNA, 25 bp, Mus musculus
gggaaccactagagggcactgaact

SEQ ID NO: 625767 - DNA, 25 bp, Mus musculus
gggaaccactagtgggcactgaact

SEQ ID NO: 625768 - DNA, 25 bp, Mus musculus
gggaaccactttcatactgaattac

SEQ ID NO: 625769 - DNA, 25 bp, Mus musculus
gggaaccactttgatactgaattac

SEQ ID NO: 625770 - DNA, 25 bp, Mus musculus
gggaaccagactcaaacgacctatc

SEQ ID NO: 625771 - DNA, 25 bp, Mus musculus
gggaaccagactgaaacgacctatc

SEQ ID NO: 625772 - DNA, 25 bp, Mus musculus
gggaaccagataccttcctggcata

SEQ ID NO: 625773 - DNA, 25 bp, Mus musculus
gggaaccagatagcttcctggcata

SEQ ID NO: 625774 - DNA, 25 bp, Mus musculus
gggaaccagatcatttttaaaccag

SEQ ID NO: 625775 - DNA, 25 bp, Mus musculus
gggaaccagatcttttttaaaccag

SEQ ID NO: 625776 - DNA, 25 bp, Mus musculus
gggaaccagatgcaactgcccgtgt

SEQ ID NO: 625777 - DNA, 25 bp, Mus musculus
gggaaccagatggaactgcccgtgt

SEQ ID NO: 625778 - DNA, 25 bp, Mus musculus
gggaaccagcaacacagcctgagtt

SEQ ID NO: 625779 - DNA, 25 bp, Mus musculus
gggaaccagcaagacagcctgagtt

SEQ ID NO: 625780 - DNA, 25 bp, Mus musculus
gggaaccagctcagacactagtttg

SEQ ID NO: 625781 - DNA, 25 bp, Mus musculus
gggaaccagctctgacactagtttg

SEQ ID NO: 625782 - DNA, 25 bp, Mus musculus
gggaaccaggctcctatcatggaat

SEQ ID NO: 625783 - DNA, 25 bp, Mus musculus
gggaaccaggctgctatcatggaat

SEQ ID NO: 625784 - DNA, 25 bp, Mus musculus
gggaaccaggttcactctgggaact

SEQ ID NO: 625785 - DNA, 25 bp, Mus musculus
gggaaccaggttgactctgggaact

SEQ ID NO: 625786 - DNA, 25 bp, Mus musculus
gggaaccagtcccttatggaatttg

SEQ ID NO: 625787 - DNA, 25 bp, Mus musculus
gggaaccagtccgttatggaatttg

SEQ ID NO: 625788 - DNA, 25 bp, Mus musculus
gggaaccagtgaccaagcagttaac

SEQ ID NO: 625789 - DNA, 25 bp, Mus musculus
gggaaccagtgagcaagcagttaac

SEQ ID NO: 625790 - DNA, 25 bp, Mus musculus
gggaaccataacacgagccatatat

SEQ ID NO: 625791 - DNA, 25 bp, Mus musculus
gggaaccataactcgagccatatat

SEQ ID NO: 625792 - DNA, 25 bp, Mus musculus
gggaaccatactacacagtgcgaaa

SEQ ID NO: 625793 - DNA, 25 bp, Mus musculus
gggaaccatacttcacagtgcgaaa

SEQ ID NO: 625794 - DNA, 25 bp, Mus musculus
gggaaccatccacttcgagcagaag

SEQ ID NO: 625795 - DNA, 25 bp, Mus musculus
gggaaccatccagttcgagcagaag

SEQ ID NO: 625796 - DNA, 25 bp, Mus musculus
gggaaccattacaccagcatgtgct

SEQ ID NO: 625797 - DNA, 25 bp, Mus musculus
gggaaccattactccagcatgtgct

SEQ ID NO: 625798 - DNA, 25 bp, Mus musculus
gggaaccattctcggtgtagctttg

SEQ ID NO: 625799 - DNA, 25 bp, Mus musculus
gggaaccattctgggtgtagctttg

SEQ ID NO: 625800 - DNA, 25 bp, Mus musculus
gggaaccatttaccagtgactgact

SEQ ID NO: 625801 - DNA, 25 bp, Mus musculus
gggaaccatttagcagtgactgact

SEQ ID NO: 625802 - DNA, 25 bp, Mus musculus
gggaacccacgaaaaactgcttgca

SEQ ID NO: 625803 - DNA, 25 bp, Mus musculus
gggaacccacgataaactgcttgca

SEQ ID NO: 625804 - DNA, 25 bp, Mus musculus
gggaacccagcacagcaaaggtcac

SEQ ID NO: 625805 - DNA, 25 bp, Mus musculus
gggaacccagcaccttcacagatta

SEQ ID NO: 625806 - DNA, 25 bp, Mus musculus
gggaacccagcagagcaaaggtcac

SEQ ID NO: 625807 - DNA, 25 bp, Mus musculus
gggaacccagcagcttcacagatta

SEQ ID NO: 625808 - DNA, 25 bp, Mus musculus
gggaacccaggtactcaactgcctt

SEQ ID NO: 625809 - DNA, 25 bp, Mus musculus
gggaacccaggtccctgtttggaat

SEQ ID NO: 625810 - DNA, 25 bp, Mus musculus
gggaacccaggtgcctgtttggaat

SEQ ID NO: 625811 - DNA, 25 bp, Mus musculus
gggaacccaggttctcaactgcctt

SEQ ID NO: 625812 - DNA, 25 bp, Mus musculus
gggaaccccaagagtgatgagatga

SEQ ID NO: 625813 - DNA, 25 bp, Mus musculus
gggaaccccaagtgtgatgagatga

SEQ ID NO: 625814 - DNA, 25 bp, Mus musculus
gggaaccccgagaaagcggctatgt

SEQ ID NO: 625815 - DNA, 25 bp, Mus musculus
gggaaccccgagtaagcggctatgt

SEQ ID NO: 625816 - DNA, 25 bp, Mus musculus
gggaaccccttgagagcatgctcag

SEQ ID NO: 625817 - DNA, 25 bp, Mus musculus
gggaaccccttgtgagcatgctcag

SEQ ID NO: 625818 - DNA, 25 bp, Mus musculus
gggaaccctcgaaatcaggctgtca

SEQ ID NO: 625819 - DNA, 25 bp, Mus musculus
gggaaccctcgatatcaggctgtca

SEQ ID NO: 625820 - DNA, 25 bp, Mus musculus
gggaaccctctccatgaagtataga

SEQ ID NO: 625821 - DNA, 25 bp, Mus musculus
gggaaccctctcgatgaagtataga

SEQ ID NO: 625822 - DNA, 25 bp, Mus musculus
gggaaccctgcaccttttagagacc

SEQ ID NO: 625823 - DNA, 25 bp, Mus musculus
gggaaccctgcagcttttagagacc

SEQ ID NO: 625824 - DNA, 25 bp, Mus musculus
gggaacccttagcaagtgcattaat

SEQ ID NO: 625825 - DNA, 25 bp, Mus musculus
gggaacccttaggaagtgcattaat

SEQ ID NO: 625826 - DNA, 25 bp, Mus musculus
gggaaccgacacaaggcatcacaca

SEQ ID NO: 625827 - DNA, 25 bp, Mus musculus
gggaaccgacactaggcatcacaca

SEQ ID NO: 625828 - DNA, 25 bp, Mus musculus
gggaaccgcatgattacattcggat

SEQ ID NO: 625829 - DNA, 25 bp, Mus musculus
gggaaccgcatgtttacattcggat

SEQ ID NO: 625830 - DNA, 25 bp, Mus musculus
gggaaccggagcattcactgagaca

SEQ ID NO: 625831 - DNA, 25 bp, Mus musculus
gggaaccggagctttcactgagaca

SEQ ID NO: 625832 - DNA, 25 bp, Mus musculus
gggaaccggcgtagtgactcagaac

SEQ ID NO: 625833 - DNA, 25 bp, Mus musculus
gggaaccggcgttgtgactcagaac

SEQ ID NO: 625834 - DNA, 25 bp, Mus musculus
gggaacctaacaatgacggagatga

SEQ ID NO: 625835 - DNA, 25 bp, Mus musculus
gggaacctaacattgacggagatga

SEQ ID NO: 625836 - DNA, 25 bp, Mus musculus
gggaacctacagacacagtcccact

SEQ ID NO: 625837 - DNA, 25 bp, Mus musculus
gggaacctacagtcacagtcccact

SEQ ID NO: 625838 - DNA, 25 bp, Mus musculus
gggaacctactcctgaattcaccct

SEQ ID NO: 625839 - DNA, 25 bp, Mus musculus
gggaacctactcgtgaattcaccct

SEQ ID NO: 625840 - DNA, 25 bp, Mus musculus
gggaacctagccatcatcgtgagaa

SEQ ID NO: 625841 - DNA, 25 bp, Mus musculus
gggaacctagccttcatcgtgagaa

SEQ ID NO: 625842 - DNA, 25 bp, Mus musculus
gggaacctatgcaatcagctgccaa

SEQ ID NO: 625843 - DNA, 25 bp, Mus musculus
gggaacctatgccaacggacttctc

SEQ ID NO: 625844 - DNA, 25 bp, Mus musculus
gggaacctatgcgaacggacttctc

SEQ ID NO: 625845 - DNA, 25 bp, Mus musculus
gggaacctatgctatcagctgccaa

SEQ ID NO: 625846 - DNA, 25 bp, Mus musculus
gggaacctatggcaggacagccttc

SEQ ID NO: 625847 - DNA, 25 bp, Mus musculus
gggaacctatgggaggacagccttc

SEQ ID NO: 625848 - DNA, 25 bp, Mus musculus
gggaacctcaccaaggtcgctggag

SEQ ID NO: 625849 - DNA, 25 bp, Mus musculus
gggaacctcacctaggtcgctggag

SEQ ID NO: 625850 - DNA, 25 bp, Mus musculus
gggaacctcagcacgttaggcagga

SEQ ID NO: 625851 - DNA, 25 bp, Mus musculus
gggaacctcagcagtagtatgtgaa

SEQ ID NO: 625852 - DNA, 25 bp, Mus musculus
gggaacctcagctcgttaggcagga

SEQ ID NO: 625853 - DNA, 25 bp, Mus musculus
gggaacctcagctgtagtatgtgaa

SEQ ID NO: 625854 - DNA, 25 bp, Mus musculus
gggaacctcagtctttcacattggt

SEQ ID NO: 625855 - DNA, 25 bp, Mus musculus
gggaacctcagtgtttcacattggt

SEQ ID NO: 625856 - DNA, 25 bp, Mus musculus
gggaacctcatacccaatctaaagt

SEQ ID NO: 625857 - DNA, 25 bp, Mus musculus
gggaacctcatagccaatctaaagt

SEQ ID NO: 625858 - DNA, 25 bp, Mus musculus
gggaacctccatagaataattgctt

SEQ ID NO: 625859 - DNA, 25 bp, Mus musculus
gggaacctccattgaataattgctt

SEQ ID NO: 625860 - DNA, 25 bp, Mus musculus
gggaacctccctcaggtcccaggag

SEQ ID NO: 625861 - DNA, 25 bp, Mus musculus
gggaacctccctgaggtcccaggag

SEQ ID NO: 625862 - DNA, 25 bp, Mus musculus
gggaacctgactaaagccacagctt

SEQ ID NO: 625863 - DNA, 25 bp, Mus musculus
gggaacctgacttaagccacagctt

SEQ ID NO: 625864 - DNA, 25 bp, Mus musculus
gggaacctgcatccgaccctcagaa

SEQ ID NO: 625865 - DNA, 25 bp, Mus musculus
gggaacctgcatgcgaccctcagaa

SEQ ID NO: 625866 - DNA, 25 bp, Mus musculus
gggaacctgctgagcagcctcatgg

SEQ ID NO: 625867 - DNA, 25 bp, Mus musculus
gggaacctgctgtgcagcctcatgg

SEQ ID NO: 625868 - DNA, 25 bp, Mus musculus
gggaacctggacacatcatcagatc

SEQ ID NO: 625869 - DNA, 25 bp, Mus musculus
gggaacctggactcatcatcagatc

SEQ ID NO: 625870 - DNA, 25 bp, Mus musculus
gggaacctgggcattacagttgcag

SEQ ID NO: 625871 - DNA, 25 bp, Mus musculus
gggaacctgggctttacagttgcag

SEQ ID NO: 625872 - DNA, 25 bp, Mus musculus
gggaacctggtgaatatataatgaa

SEQ ID NO: 625873 - DNA, 25 bp, Mus musculus
gggaacctggtgtatatataatgaa

SEQ ID NO: 625874 - DNA, 25 bp, Mus musculus
gggaacctgtagaatacaccctgta

SEQ ID NO: 625875 - DNA, 25 bp, Mus musculus
gggaacctgtagtatacaccctgta

SEQ ID NO: 625876 - DNA, 25 bp, Mus musculus
gggaacctgtatcggcttagaatta

SEQ ID NO: 625877 - DNA, 25 bp, Mus musculus
gggaacctgtatgggcttagaatta

SEQ ID NO: 625878 - DNA, 25 bp, Mus musculus
gggaacctgtcgaactgaagactca

SEQ ID NO: 625879 - DNA, 25 bp, Mus musculus
gggaacctgtcgtactgaagactca

SEQ ID NO: 625880 - DNA, 25 bp, Mus musculus
gggaaccttagaaactgccatagaa

SEQ ID NO: 625881 - DNA, 25 bp, Mus musculus
gggaaccttagatactgccatagaa

SEQ ID NO: 625882 - DNA, 25 bp, Mus musculus
gggaaccttgccaggatggcagcag

SEQ ID NO: 625883 - DNA, 25 bp, Mus musculus
gggaaccttgcctggatggcagcag

SEQ ID NO: 625884 - DNA, 25 bp, Mus musculus
gggaaccttgtccttaagcacttat

SEQ ID NO: 625885 - DNA, 25 bp, Mus musculus
gggaaccttgtcgttaagcacttat

SEQ ID NO: 625886 - DNA, 25 bp, Mus musculus
gggaacctttatcttgctcattaaa

SEQ ID NO: 625887 - DNA, 25 bp, Mus musculus
gggaacctttatgttgctcattaaa

SEQ ID NO: 625888 - DNA, 25 bp, Mus musculus
gggaacgactctacaatgttgtagt

SEQ ID NO: 625889 - DNA, 25 bp, Mus musculus
gggaacgactcttcaatgttgtagt

SEQ ID NO: 625890 - DNA, 25 bp, Mus musculus
gggaacgatccaagccgaatacaac

SEQ ID NO: 625891 - DNA, 25 bp, Mus musculus
gggaacgatccatgccgaatacaac

SEQ ID NO: 625892 - DNA, 25 bp, Mus musculus
gggaacgatgcaactgtgggctcat

SEQ ID NO: 625893 - DNA, 25 bp, Mus musculus
gggaacgatgcatctgtgggctcat

SEQ ID NO: 625894 - DNA, 25 bp, Mus musculus
gggaacgccagaccagaaactgtca

SEQ ID NO: 625895 - DNA, 25 bp, Mus musculus
gggaacgccagagcagaaactgtca

SEQ ID NO: 625896 - DNA, 25 bp, Mus musculus
gggaacgcgctgaccatttagagag

SEQ ID NO: 625897 - DNA, 25 bp, Mus musculus
gggaacgcgctgtccatttagagag

SEQ ID NO: 625898 - DNA, 25 bp, Mus musculus
gggaacgctgtcattaccacaatag

SEQ ID NO: 625899 - DNA, 25 bp, Mus musculus
gggaacgctgtctttaccacaatag

SEQ ID NO: 625900 - DNA, 25 bp, Mus musculus
gggaacggacatagtacactaattc

SEQ ID NO: 625901 - DNA, 25 bp, Mus musculus
gggaacggacattgtacactaattc

SEQ ID NO: 625902 - DNA, 25 bp, Mus musculus
gggaacggacttaccatctaaggat

SEQ ID NO: 625903 - DNA, 25 bp, Mus musculus
gggaacggactttccatctaaggat

SEQ ID NO: 625904 - DNA, 25 bp, Mus musculus
gggaacggtagaagacagactgaat

SEQ ID NO: 625905 - DNA, 25 bp, Mus musculus
gggaacggtagatgacagactgaat

SEQ ID NO: 625906 - DNA, 25 bp, Mus musculus
gggaacggtgtacgctggcagccgg

SEQ ID NO: 625907 - DNA, 25 bp, Mus musculus
gggaacggtgtaggctggcagccgg

SEQ ID NO: 625908 - DNA, 25 bp, Mus musculus
gggaacgtcatcaaagtttaccatg

SEQ ID NO: 625909 - DNA, 25 bp, Mus musculus
gggaacgtcatctaagtttaccatg

SEQ ID NO: 625910 - DNA, 25 bp, Mus musculus
gggaacgtgaccctgctatttattt

SEQ ID NO: 625911 - DNA, 25 bp, Mus musculus
gggaacgtgaccgtgctatttattt

SEQ ID NO: 625912 - DNA, 25 bp, Mus musculus
gggaacgtgtccattgagcctgact

SEQ ID NO: 625913 - DNA, 25 bp, Mus musculus
gggaacgtgtcctttgagcctgact

SEQ ID NO: 625914 - DNA, 25 bp, Mus musculus
gggaacgttattaaagtgcgtcagt

SEQ ID NO: 625915 - DNA, 25 bp, Mus musculus
gggaacgttatttaagtgcgtcagt

SEQ ID NO: 625916 - DNA, 25 bp, Mus musculus
gggaacgttcttacaacctacacat

SEQ ID NO: 625917 - DNA, 25 bp, Mus musculus
gggaacgttctttcaacctacacat

SEQ ID NO: 625918 - DNA, 25 bp, Mus musculus
gggaacgttgcccaggaactccaag

SEQ ID NO: 625919 - DNA, 25 bp, Mus musculus
gggaacgttgccgaggaactccaag

SEQ ID NO: 625920 - DNA, 25 bp, Mus musculus
gggaactaaacccacaacaagtgct

SEQ ID NO: 625921 - DNA, 25 bp, Mus musculus
gggaactaaaccgacaacaagtgct

SEQ ID NO: 625922 - DNA, 25 bp, Mus musculus
gggaactaacctagcatgggattta

SEQ ID NO: 625923 - DNA, 25 bp, Mus musculus
gggaactaaccttgcatgggattta

SEQ ID NO: 625924 - DNA, 25 bp, Mus musculus
gggaactaccgaactgtgcaggagt

SEQ ID NO: 625925 - DNA, 25 bp, Mus musculus
gggaactaccgatctgtgcaggagt

SEQ ID NO: 625926 - DNA, 25 bp, Mus musculus
gggaactacggcaaacagcctttgt

SEQ ID NO: 625927 - DNA, 25 bp, Mus musculus
gggaactacggcatcttggagctca

SEQ ID NO: 625928 - DNA, 25 bp, Mus musculus
gggaactacggctaacagcctttgt

SEQ ID NO: 625929 - DNA, 25 bp, Mus musculus
gggaactacggcttcttggagctca

SEQ ID NO: 625930 - DNA, 25 bp, Mus musculus
gggaactagccaaccatttccagaa

SEQ ID NO: 625931 - DNA, 25 bp, Mus musculus
gggaactagccatccatttccagaa

SEQ ID NO: 625932 - DNA, 25 bp, Mus musculus
gggaactagcccatggcccaagcca

SEQ ID NO: 625933 - DNA, 25 bp, Mus musculus
gggaactagcccttggcccaagcca

SEQ ID NO: 625934 - DNA, 25 bp, Mus musculus
gggaactaggccaggcttagaatca

SEQ ID NO: 625935 - DNA, 25 bp, Mus musculus
gggaactaggcctggcttagaatca

SEQ ID NO: 625936 - DNA, 25 bp, Mus musculus
gggaactatcacaggtatctgaagc

SEQ ID NO: 625937 - DNA, 25 bp, Mus musculus
gggaactatcactggtatctgaagc

SEQ ID NO: 625938 - DNA, 25 bp, Mus musculus
gggaactatcgccacaatgacactt

SEQ ID NO: 625939 - DNA, 25 bp, Mus musculus
gggaactatcgcgacaatgacactt

SEQ ID NO: 625940 - DNA, 25 bp, Mus musculus
gggaactattgaaactaagttattt

SEQ ID NO: 625941 - DNA, 25 bp, Mus musculus
gggaactattgatactaagttattt

SEQ ID NO: 625942 - DNA, 25 bp, Mus musculus
gggaactcaaaaccccacgtcagga

SEQ ID NO: 625943 - DNA, 25 bp, Mus musculus
gggaactcaaaagcccacgtcagga

SEQ ID NO: 625944 - DNA, 25 bp, Mus musculus
gggaactcaaccctatgtatgaagg

SEQ ID NO: 625945 - DNA, 25 bp, Mus musculus
gggaactcaaccgtatgtatgaagg

SEQ ID NO: 625946 - DNA, 25 bp, Mus musculus
gggaactcaatcactgcgtacaact

SEQ ID NO: 625947 - DNA, 25 bp, Mus musculus
gggaactcaatctctgcgtacaact

SEQ ID NO: 625948 - DNA, 25 bp, Mus musculus
gggaactcagagctttccctccacg

SEQ ID NO: 625949 - DNA, 25 bp, Mus musculus
gggaactcagaggtttccctccacg

SEQ ID NO: 625950 - DNA, 25 bp, Mus musculus
gggaactcaggtaagacatgacaga

SEQ ID NO: 625951 - DNA, 25 bp, Mus musculus
gggaactcaggttagacatgacaga

SEQ ID NO: 625952 - DNA, 25 bp, Mus musculus
gggaactcagtcactgtccagccta

SEQ ID NO: 625953 - DNA, 25 bp, Mus musculus
gggaactcagtctctgtccagccta

SEQ ID NO: 625954 - DNA, 25 bp, Mus musculus
gggaactcatccagggtggtccaag

SEQ ID NO: 625955 - DNA, 25 bp, Mus musculus
gggaactcatcctgggtggtccaag

SEQ ID NO: 625956 - DNA, 25 bp, Mus musculus
gggaactcatgaaactggaaagctt

SEQ ID NO: 625957 - DNA, 25 bp, Mus musculus
gggaactcatgacctctgtcattca

SEQ ID NO: 625958 - DNA, 25 bp, Mus musculus
gggaactcatgagctctgtcattca

SEQ ID NO: 625959 - DNA, 25 bp, Mus musculus
gggaactcatgatactggaaagctt

SEQ ID NO: 625960 - DNA, 25 bp, Mus musculus
gggaactccaatcataccagataat

SEQ ID NO: 625961 - DNA, 25 bp, Mus musculus
gggaactccaatcccgaaaactgag

SEQ ID NO: 625962 - DNA, 25 bp, Mus musculus
gggaactccaatgataccagataat

SEQ ID NO: 625963 - DNA, 25 bp, Mus musculus
gggaactccaatgccgaaaactgag

SEQ ID NO: 625964 - DNA, 25 bp, Mus musculus
gggaactccatcaaggtgaacctga

SEQ ID NO: 625965 - DNA, 25 bp, Mus musculus
gggaactccatctaggtgaacctga

SEQ ID NO: 625966 - DNA, 25 bp, Mus musculus
gggaactcctacaaaactggctctg

SEQ ID NO: 625967 - DNA, 25 bp, Mus musculus
gggaactcctacatggagtattagg

SEQ ID NO: 625968 - DNA, 25 bp, Mus musculus
gggaactcctactaaactggctctg

SEQ ID NO: 625969 - DNA, 25 bp, Mus musculus
gggaactcctacttggagtattagg

SEQ ID NO: 625970 - DNA, 25 bp, Mus musculus
gggaactcgagtagctgcgttagct

SEQ ID NO: 625971 - DNA, 25 bp, Mus musculus
gggaactcgagttgctgcgttagct

SEQ ID NO: 625972 - DNA, 25 bp, Mus musculus
gggaactcggagcagacactcacca

SEQ ID NO: 625973 - DNA, 25 bp, Mus musculus
gggaactcggaggagacactcacca

SEQ ID NO: 625974 - DNA, 25 bp, Mus musculus
gggaactctaaaacatcagcatgct

SEQ ID NO: 625975 - DNA, 25 bp, Mus musculus
gggaactctaaatcatcagcatgct

SEQ ID NO: 625976 - DNA, 25 bp, Mus musculus
gggaactctccaaataccattcaag

SEQ ID NO: 625977 - DNA, 25 bp, Mus musculus
gggaactctccatataccattcaag

SEQ ID NO: 625978 - DNA, 25 bp, Mus musculus
gggaactctctgctgtagctcaatg

SEQ ID NO: 625979 - DNA, 25 bp, Mus musculus
gggaactctctggtgtagctcaatg

SEQ ID NO: 625980 - DNA, 25 bp, Mus musculus
gggaactctcttaccatgctctctg

SEQ ID NO: 625981 - DNA, 25 bp, Mus musculus
gggaactctctttccatgctctctg

SEQ ID NO: 625982 - DNA, 25 bp, Mus musculus
gggaactctgaaagccatatttaag

SEQ ID NO: 625983 - DNA, 25 bp, Mus musculus
gggaactctgaatgccatatttaag

SEQ ID NO: 625984 - DNA, 25 bp, Mus musculus
gggaactctgtaagaggcggccaca

SEQ ID NO: 625985 - DNA, 25 bp, Mus musculus
gggaactctgtatgaggcggccaca

SEQ ID NO: 625986 - DNA, 25 bp, Mus musculus
gggaactcttctaataaattactct

SEQ ID NO: 625987 - DNA, 25 bp, Mus musculus
gggaactcttcttataaattactct

SEQ ID NO: 625988 - DNA, 25 bp, Mus musculus
gggaactcttgaagcaactctcagt

SEQ ID NO: 625989 - DNA, 25 bp, Mus musculus
gggaactcttgatgcaactctcagt

SEQ ID NO: 625990 - DNA, 25 bp, Mus musculus
gggaactcttttagacccacagatg

SEQ ID NO: 625991 - DNA, 25 bp, Mus musculus
gggaactctttttgacccacagatg

SEQ ID NO: 625992 - DNA, 25 bp, Mus musculus
gggaactgaaaaagcccccactaat

SEQ ID NO: 625993 - DNA, 25 bp, Mus musculus
gggaactgaaaatgcccccactaat

SEQ ID NO: 625994 - DNA, 25 bp, Mus musculus
gggaactgaaacctagtcctctact

SEQ ID NO: 625995 - DNA, 25 bp, Mus musculus
gggaactgaaacgtagtcctctact

SEQ ID NO: 625996 - DNA, 25 bp, Mus musculus
gggaactgacaaacgaagaggactc

SEQ ID NO: 625997 - DNA, 25 bp, Mus musculus
gggaactgacaatcgaagaggactc

SEQ ID NO: 625998 - DNA, 25 bp, Mus musculus
gggaactgactgagggcacttgcac

SEQ ID NO: 625999 - DNA, 25 bp, Mus musculus
gggaactgactgtgggcacttgcac

SEQ ID NO: 626000 - DNA, 25 bp, Mus musculus
gggaactgagcaagtcaactcttaa

SEQ ID NO: 626001 - DNA, 25 bp, Mus musculus
gggaactgagcatgtcaactcttaa

SEQ ID NO: 626002 - DNA, 25 bp, Mus musculus
gggaactgagcccaggcctctataa

SEQ ID NO: 626003 - DNA, 25 bp, Mus musculus
gggaactgagccgaggcctctataa

SEQ ID NO: 626004 - DNA, 25 bp, Mus musculus
gggaactgagctcatcgactccttg

SEQ ID NO: 626005 - DNA, 25 bp, Mus musculus
gggaactgagctgatcgactccttg

SEQ ID NO: 626006 - DNA, 25 bp, Mus musculus
gggaactgagtcaaaatttgtctga

SEQ ID NO: 626007 - DNA, 25 bp, Mus musculus
gggaactgagtctaaatttgtctga

SEQ ID NO: 626008 - DNA, 25 bp, Mus musculus
gggaactgcatcaggttgatttcat

SEQ ID NO: 626009 - DNA, 25 bp, Mus musculus
gggaactgcatctggttgatttcat

SEQ ID NO: 626010 - DNA, 25 bp, Mus musculus
gggaactgcccaagaaatatcaaat

SEQ ID NO: 626011 - DNA, 25 bp, Mus musculus
gggaactgcccatgaaatatcaaat

SEQ ID NO: 626012 - DNA, 25 bp, Mus musculus
gggaactgctaaaccgctacctata

SEQ ID NO: 626013 - DNA, 25 bp, Mus musculus
gggaactgctaatccgctacctata

SEQ ID NO: 626014 - DNA, 25 bp, Mus musculus
gggaactgctacaagctgtaccatt

SEQ ID NO: 626015 - DNA, 25 bp, Mus musculus
gggaactgctactagctgtaccatt

SEQ ID NO: 626016 - DNA, 25 bp, Mus musculus
gggaactggcatatgtggtatttca

SEQ ID NO: 626017 - DNA, 25 bp, Mus musculus
gggaactggcatttgtggtatttca

SEQ ID NO: 626018 - DNA, 25 bp, Mus musculus
gggaactgggagcttccagtcctca

SEQ ID NO: 626019 - DNA, 25 bp, Mus musculus
gggaactgggaggttccagtcctca

SEQ ID NO: 626020 - DNA, 25 bp, Mus musculus
gggaactggtacatcttccaacacc

SEQ ID NO: 626021 - DNA, 25 bp, Mus musculus
gggaactggtacttcttccaacacc

SEQ ID NO: 626022 - DNA, 25 bp, Mus musculus
gggaactggtagcacacctcaccca

SEQ ID NO: 626023 - DNA, 25 bp, Mus musculus
gggaactggtaggacacctcaccca

SEQ ID NO: 626024 - DNA, 25 bp, Mus musculus
gggaactggttcaagtaacacttct

SEQ ID NO: 626025 - DNA, 25 bp, Mus musculus
gggaactggttctagtaacacttct

SEQ ID NO: 626026 - DNA, 25 bp, Mus musculus
gggaactgtgacaaagtgaagtcct

SEQ ID NO: 626027 - DNA, 25 bp, Mus musculus
gggaactgtgactaagtgaagtcct

SEQ ID NO: 626028 - DNA, 25 bp, Mus musculus
gggaactgtggcaatgatagctcta

SEQ ID NO: 626029 - DNA, 25 bp, Mus musculus
gggaactgtggctatgatagctcta

SEQ ID NO: 626030 - DNA, 25 bp, Mus musculus
gggaactgtgtaaattctctctgca

SEQ ID NO: 626031 - DNA, 25 bp, Mus musculus
gggaactgtgtatattctctctgca

SEQ ID NO: 626032 - DNA, 25 bp, Mus musculus
gggaactgtgtgacctgtcaagcca

SEQ ID NO: 626033 - DNA, 25 bp, Mus musculus
gggaactgtgtgtcctgtcaagcca

SEQ ID NO: 626034 - DNA, 25 bp, Mus musculus
gggaactgttcacctttggagaaca

SEQ ID NO: 626035 - DNA, 25 bp, Mus musculus
gggaactgttcagctttggagaaca

SEQ ID NO: 626036 - DNA, 25 bp, Mus musculus
gggaactgttgcatgcctgttatcc

SEQ ID NO: 626037 - DNA, 25 bp, Mus musculus
gggaactgttgcttgcctgttatcc

SEQ ID NO: 626038 - DNA, 25 bp, Mus musculus
gggaacttaaaaactgctgctacat

SEQ ID NO: 626039 - DNA, 25 bp, Mus musculus
gggaacttaaaatctgctgctacat

SEQ ID NO: 626040 - DNA, 25 bp, Mus musculus
gggaacttaatgctcctgggacctt

SEQ ID NO: 626041 - DNA, 25 bp, Mus musculus
gggaacttaatggtcctgggacctt

SEQ ID NO: 626042 - DNA, 25 bp, Mus musculus
gggaacttacctagccactaaatga

SEQ ID NO: 626043 - DNA, 25 bp, Mus musculus
gggaacttaccttgccactaaatga

SEQ ID NO: 626044 - DNA, 25 bp, Mus musculus
gggaacttactcagcaatataaatt

SEQ ID NO: 626045 - DNA, 25 bp, Mus musculus
gggaacttactctgcaatataaatt

SEQ ID NO: 626046 - DNA, 25 bp, Mus musculus
gggaacttagccatcattccttgct

SEQ ID NO: 626047 - DNA, 25 bp, Mus musculus
gggaacttagccttcattccttgct

SEQ ID NO: 626048 - DNA, 25 bp, Mus musculus
gggaacttagggacatctctggtca

SEQ ID NO: 626049 - DNA, 25 bp, Mus musculus
gggaacttagggtcatctctggtca

SEQ ID NO: 626050 - DNA, 25 bp, Mus musculus
gggaacttcacaattgtccttagag

SEQ ID NO: 626051 - DNA, 25 bp, Mus musculus
gggaacttcacatttgtccttagag

SEQ ID NO: 626052 - DNA, 25 bp, Mus musculus
gggaacttcacgagcactgtctgcg

SEQ ID NO: 626053 - DNA, 25 bp, Mus musculus
gggaacttcacgtgcactgtctgcg

SEQ ID NO: 626054 - DNA, 25 bp, Mus musculus
gggaacttccacaggcattgtatgt

SEQ ID NO: 626055 - DNA, 25 bp, Mus musculus
gggaacttccactggcattgtatgt

SEQ ID NO: 626056 - DNA, 25 bp, Mus musculus
gggaacttgatactttaacctgcta

SEQ ID NO: 626057 - DNA, 25 bp, Mus musculus
gggaacttgatagtttaacctgcta

SEQ ID NO: 626058 - DNA, 25 bp, Mus musculus
gggaacttgctcacgggctcttgac

SEQ ID NO: 626059 - DNA, 25 bp, Mus musculus
gggaacttgctctcgggctcttgac

SEQ ID NO: 626060 - DNA, 25 bp, Mus musculus
gggaacttggacaacttagccactg

SEQ ID NO: 626061 - DNA, 25 bp, Mus musculus
gggaacttggactacttagccactg

SEQ ID NO: 626062 - DNA, 25 bp, Mus musculus
gggaacttggatcctcttcagaacc

SEQ ID NO: 626063 - DNA, 25 bp, Mus musculus
gggaacttggatgctcttcagaacc

SEQ ID NO: 626064 - DNA, 25 bp, Mus musculus
gggaacttggtaaatctgcctagaa

SEQ ID NO: 626065 - DNA, 25 bp, Mus musculus
gggaacttggtatatctgcctagaa

SEQ ID NO: 626066 - DNA, 25 bp, Mus musculus
gggaacttggttcttgtttctcaag

SEQ ID NO: 626067 - DNA, 25 bp, Mus musculus
gggaacttggttgttgtttctcaag

SEQ ID NO: 626068 - DNA, 25 bp, Mus musculus
gggaacttgtcgcatttctgagcat

SEQ ID NO: 626069 - DNA, 25 bp, Mus musculus
gggaacttgtcggatttctgagcat

SEQ ID NO: 626070 - DNA, 25 bp, Mus musculus
gggaactttagacacacctactgct

SEQ ID NO: 626071 - DNA, 25 bp, Mus musculus
gggaactttagagacacctactgct

SEQ ID NO: 626072 - DNA, 25 bp, Mus musculus
gggaactttgaacgctatggtgaca

SEQ ID NO: 626073 - DNA, 25 bp, Mus musculus
gggaactttgaaggctatggtgaca

SEQ ID NO: 626074 - DNA, 25 bp, Mus musculus
gggaactttgcaatttctctgagaa

SEQ ID NO: 626075 - DNA, 25 bp, Mus musculus
gggaactttgcattttctctgagaa

SEQ ID NO: 626076 - DNA, 25 bp, Mus musculus
gggaactttgccagcattgatgctc

SEQ ID NO: 626077 - DNA, 25 bp, Mus musculus
gggaactttgcctgcattgatgctc

SEQ ID NO: 626078 - DNA, 25 bp, Mus musculus
gggaactttttaaagagagctgaca

SEQ ID NO: 626079 - DNA, 25 bp, Mus musculus
gggaactttttatagagagctgaca

SEQ ID NO: 626080 - DNA, 25 bp, Mus musculus
gggaactttttcaccgagtgttgca

SEQ ID NO: 626081 - DNA, 25 bp, Mus musculus
gggaactttttctccgagtgttgca

SEQ ID NO: 626082 - DNA, 25 bp, Mus musculus
gggaagaaaacgagctctgcccttt

SEQ ID NO: 626083 - DNA, 25 bp, Mus musculus
gggaagaaaacgtgctctgcccttt

SEQ ID NO: 626084 - DNA, 25 bp, Mus musculus
gggaagaaacacattctggtgctga

SEQ ID NO: 626085 - DNA, 25 bp, Mus musculus
gggaagaaacactttctggtgctga

SEQ ID NO: 626086 - DNA, 25 bp, Mus musculus
gggaagaaacgcacagacagacagt

SEQ ID NO: 626087 - DNA, 25 bp, Mus musculus
gggaagaaacgctcagacagacagt

SEQ ID NO: 626088 - DNA, 25 bp, Mus musculus
gggaagaaaggcaaacacatcaagg

SEQ ID NO: 626089 - DNA, 25 bp, Mus musculus
gggaagaaaggctaacacatcaagg

SEQ ID NO: 626090 - DNA, 25 bp, Mus musculus
gggaagaacctactggccattctgc

SEQ ID NO: 626091 - DNA, 25 bp, Mus musculus
gggaagaacctagtggccattctgc

SEQ ID NO: 626092 - DNA, 25 bp, Mus musculus
gggaagaacctgaacaccttataca

SEQ ID NO: 626093 - DNA, 25 bp, Mus musculus
gggaagaacctgtacaccttataca

SEQ ID NO: 626094 - DNA, 25 bp, Mus musculus
gggaagaaccttcttcctgcttggg

SEQ ID NO: 626095 - DNA, 25 bp, Mus musculus
gggaagaaccttgttcctgcttggg

SEQ ID NO: 626096 - DNA, 25 bp, Mus musculus
gggaagaactctacctcacagttta

SEQ ID NO: 626097 - DNA, 25 bp, Mus musculus
gggaagaactcttcctcacagttta

SEQ ID NO: 626098 - DNA, 25 bp, Mus musculus
gggaagaactgaatcccccacgcaa

SEQ ID NO: 626099 - DNA, 25 bp, Mus musculus
gggaagaactgattcccccacgcaa

SEQ ID NO: 626100 - DNA, 25 bp, Mus musculus
gggaagaagatcatggtccattttt

SEQ ID NO: 626101 - DNA, 25 bp, Mus musculus
gggaagaagatcttggtccattttt

SEQ ID NO: 626102 - DNA, 25 bp, Mus musculus
gggaagaagccacctccgagtctgc

SEQ ID NO: 626103 - DNA, 25 bp, Mus musculus
gggaagaagccagctccgagtctgc

SEQ ID NO: 626104 - DNA, 25 bp, Mus musculus
gggaagaaggcccacaccacaacag

SEQ ID NO: 626105 - DNA, 25 bp, Mus musculus
gggaagaaggccgacaccacaacag

SEQ ID NO: 626106 - DNA, 25 bp, Mus musculus
gggaagaatagtagttaagctctgc

SEQ ID NO: 626107 - DNA, 25 bp, Mus musculus
gggaagaatagttgttaagctctgc

SEQ ID NO: 626108 - DNA, 25 bp, Mus musculus
gggaagaatcaaactgatgcattta

SEQ ID NO: 626109 - DNA, 25 bp, Mus musculus
gggaagaatcaatctgatgcattta

SEQ ID NO: 626110 - DNA, 25 bp, Mus musculus
gggaagaatcatatggcaccatcat

SEQ ID NO: 626111 - DNA, 25 bp, Mus musculus
gggaagaatcatttggcaccatcat

SEQ ID NO: 626112 - DNA, 25 bp, Mus musculus
gggaagaatgccagcgtcagctact

SEQ ID NO: 626113 - DNA, 25 bp, Mus musculus
gggaagaatgccatctgcctccctg

SEQ ID NO: 626114 - DNA, 25 bp, Mus musculus
gggaagaatgcctgcgtcagctact

SEQ ID NO: 626115 - DNA, 25 bp, Mus musculus
gggaagaatgccttctgcctccctg

SEQ ID NO: 626116 - DNA, 25 bp, Mus musculus
gggaagaattccaattgacacaatt

SEQ ID NO: 626117 - DNA, 25 bp, Mus musculus
gggaagaattcctattgacacaatt

SEQ ID NO: 626118 - DNA, 25 bp, Mus musculus
gggaagacaacgaagctctctccct

SEQ ID NO: 626119 - DNA, 25 bp, Mus musculus
gggaagacaacgtagctctctccct

SEQ ID NO: 626120 - DNA, 25 bp, Mus musculus
gggaagacacacctttcttctggat

SEQ ID NO: 626121 - DNA, 25 bp, Mus musculus
gggaagacacacgtttcttctggat

SEQ ID NO: 626122 - DNA, 25 bp, Mus musculus
gggaagacacctaaccagtagtatc

SEQ ID NO: 626123 - DNA, 25 bp, Mus musculus
gggaagacaccttaccagtagtatc

SEQ ID NO: 626124 - DNA, 25 bp, Mus musculus
gggaagacactcaactttttcatta

SEQ ID NO: 626125 - DNA, 25 bp, Mus musculus
gggaagacactctactttttcatta

SEQ ID NO: 626126 - DNA, 25 bp, Mus musculus
gggaagacagagcttactccagcat

SEQ ID NO: 626127 - DNA, 25 bp, Mus musculus
gggaagacagaggttactccagcat

SEQ ID NO: 626128 - DNA, 25 bp, Mus musculus
gggaagacagcaccacagatcgtgt

SEQ ID NO: 626129 - DNA, 25 bp, Mus musculus
gggaagacagcagcacagatcgtgt

SEQ ID NO: 626130 - DNA, 25 bp, Mus musculus
gggaagacagtcacttcaattagat

SEQ ID NO: 626131 - DNA, 25 bp, Mus musculus
gggaagacagtctcttcaattagat

SEQ ID NO: 626132 - DNA, 25 bp, Mus musculus
gggaagacatagacagcctgtatat

SEQ ID NO: 626133 - DNA, 25 bp, Mus musculus
gggaagacatagtcagcctgtatat

SEQ ID NO: 626134 - DNA, 25 bp, Mus musculus
gggaagacatgccatctgccaagca

SEQ ID NO: 626135 - DNA, 25 bp, Mus musculus
gggaagacatgcgatctgccaagca

SEQ ID NO: 626136 - DNA, 25 bp, Mus musculus
gggaagacatttattggagcagaca

SEQ ID NO: 626137 - DNA, 25 bp, Mus musculus
gggaagacattttttggagcagaca

SEQ ID NO: 626138 - DNA, 25 bp, Mus musculus
gggaagaccaacaacaacacttgct

SEQ ID NO: 626139 - DNA, 25 bp, Mus musculus
gggaagaccaactacaacacttgct

SEQ ID NO: 626140 - DNA, 25 bp, Mus musculus
gggaagaccatcaggtgttctgtaa

SEQ ID NO: 626141 - DNA, 25 bp, Mus musculus
gggaagaccatctggtgttctgtaa

SEQ ID NO: 626142 - DNA, 25 bp, Mus musculus
gggaagacccgcacattgatggaga

SEQ ID NO: 626143 - DNA, 25 bp, Mus musculus
gggaagacccgctcattgatggaga

SEQ ID NO: 626144 - DNA, 25 bp, Mus musculus
gggaagacccttacttgaacatcat

SEQ ID NO: 626145 - DNA, 25 bp, Mus musculus
gggaagaccctttcttgaacatcat

SEQ ID NO: 626146 - DNA, 25 bp, Mus musculus
gggaagacctccagaacaccaggta

SEQ ID NO: 626147 - DNA, 25 bp, Mus musculus
gggaagacctcctgaacaccaggta

SEQ ID NO: 626148 - DNA, 25 bp, Mus musculus
gggaagacgcttatgctggagcaat

SEQ ID NO: 626149 - DNA, 25 bp, Mus musculus
gggaagacgcttttgctggagcaat

SEQ ID NO: 626150 - DNA, 25 bp, Mus musculus
gggaagacggctagatctcattctc

SEQ ID NO: 626151 - DNA, 25 bp, Mus musculus
gggaagacggcttgatctcattctc

SEQ ID NO: 626152 - DNA, 25 bp, Mus musculus
gggaagacttccacttgtcttagac

SEQ ID NO: 626153 - DNA, 25 bp, Mus musculus
gggaagacttcctcttgtcttagac

SEQ ID NO: 626154 - DNA, 25 bp, Mus musculus
gggaagacttgcctagtagaagact

SEQ ID NO: 626155 - DNA, 25 bp, Mus musculus
gggaagacttgcgtagtagaagact

SEQ ID NO: 626156 - DNA, 25 bp, Mus musculus
gggaagagaagcaacgccacgtgtt

SEQ ID NO: 626157 - DNA, 25 bp, Mus musculus
gggaagagaagctacgccacgtgtt

SEQ ID NO: 626158 - DNA, 25 bp, Mus musculus
gggaagagaatccttcctcctttct

SEQ ID NO: 626159 - DNA, 25 bp, Mus musculus
gggaagagaatcgttcctcctttct

SEQ ID NO: 626160 - DNA, 25 bp, Mus musculus
gggaagagcatcctttactttactt

SEQ ID NO: 626161 - DNA, 25 bp, Mus musculus
gggaagagcatcgtttactttactt

SEQ ID NO: 626162 - DNA, 25 bp, Mus musculus
gggaagagcattctcttctcttcca

SEQ ID NO: 626163 - DNA, 25 bp, Mus musculus
gggaagagcattgtcttctcttcca

SEQ ID NO: 626164 - DNA, 25 bp, Mus musculus
gggaagaggagtactcccctctgaa

SEQ ID NO: 626165 - DNA, 25 bp, Mus musculus
gggaagaggagttctcccctctgaa

SEQ ID NO: 626166 - DNA, 25 bp, Mus musculus
gggaagaggcgcaactgtctgtcct

SEQ ID NO: 626167 - DNA, 25 bp, Mus musculus
gggaagaggcgctactgtctgtcct

SEQ ID NO: 626168 - DNA, 25 bp, Mus musculus
gggaagagtatcatcagattctgaa

SEQ ID NO: 626169 - DNA, 25 bp, Mus musculus
gggaagagtatcttcagattctgaa

SEQ ID NO: 626170 - DNA, 25 bp, Mus musculus
gggaagagttaaatctaaattcaga

SEQ ID NO: 626171 - DNA, 25 bp, Mus musculus
gggaagagttaattctaaattcaga

SEQ ID NO: 626172 - DNA, 25 bp, Mus musculus
gggaagagttatcccatcaacagca

SEQ ID NO: 626173 - DNA, 25 bp, Mus musculus
gggaagagttatgccatcaacagca

SEQ ID NO: 626174 - DNA, 25 bp, Mus musculus
gggaagagttttccttgcctctttc

SEQ ID NO: 626175 - DNA, 25 bp, Mus musculus
gggaagagttttgcttgcctctttc

SEQ ID NO: 626176 - DNA, 25 bp, Mus musculus
gggaagatactcattctcatattct

SEQ ID NO: 626177 - DNA, 25 bp, Mus musculus
gggaagatactctttctcatattct

SEQ ID NO: 626178 - DNA, 25 bp, Mus musculus
gggaagatacttattataagccaca

SEQ ID NO: 626179 - DNA, 25 bp, Mus musculus
gggaagatactttttataagccaca

SEQ ID NO: 626180 - DNA, 25 bp, Mus musculus
gggaagatatctcactctcgtacac

SEQ ID NO: 626181 - DNA, 25 bp, Mus musculus
gggaagatatctctttggctacaat

SEQ ID NO: 626182 - DNA, 25 bp, Mus musculus
gggaagatatctgactctcgtacac

SEQ ID NO: 626183 - DNA, 25 bp, Mus musculus
gggaagatatctgtttggctacaat

SEQ ID NO: 626184 - DNA, 25 bp, Mus musculus
gggaagatcaccctgagccacattt

SEQ ID NO: 626185 - DNA, 25 bp, Mus musculus
gggaagatcaccgtgagccacattt

SEQ ID NO: 626186 - DNA, 25 bp, Mus musculus
gggaagatcactagttacttcaaaa

SEQ ID NO: 626187 - DNA, 25 bp, Mus musculus
gggaagatcacttgttacttcaaaa

SEQ ID NO: 626188 - DNA, 25 bp, Mus musculus
gggaagatccaacagaagttcaact

SEQ ID NO: 626189 - DNA, 25 bp, Mus musculus
gggaagatccaagagaagttcaact

SEQ ID NO: 626190 - DNA, 25 bp, Mus musculus
gggaagatcccaccagctgttacct

SEQ ID NO: 626191 - DNA, 25 bp, Mus musculus
gggaagatcccagcagctgttacct

SEQ ID NO: 626192 - DNA, 25 bp, Mus musculus
gggaagatcggcactggaccacgat

SEQ ID NO: 626193 - DNA, 25 bp, Mus musculus
gggaagatcggctctggaccacgat

SEQ ID NO: 626194 - DNA, 25 bp, Mus musculus
gggaagatcttgatatcattttgtc

SEQ ID NO: 626195 - DNA, 25 bp, Mus musculus
gggaagatcttgttatcattttgtc

SEQ ID NO: 626196 - DNA, 25 bp, Mus musculus
gggaagatgaacaccacctgctgag

SEQ ID NO: 626197 - DNA, 25 bp, Mus musculus
gggaagatgaactccacctgctgag

SEQ ID NO: 626198 - DNA, 25 bp, Mus musculus
gggaagattagaaactgcccctctg

SEQ ID NO: 626199 - DNA, 25 bp, Mus musculus
gggaagattagatactgcccctctg

SEQ ID NO: 626200 - DNA, 25 bp, Mus musculus
gggaagattccaatacagagctaat

SEQ ID NO: 626201 - DNA, 25 bp, Mus musculus
gggaagattccattacagagctaat

SEQ ID NO: 626202 - DNA, 25 bp, Mus musculus
gggaagattgcaactgatacataaa

SEQ ID NO: 626203 - DNA, 25 bp, Mus musculus
gggaagattgcatctgatacataaa

SEQ ID NO: 626204 - DNA, 25 bp, Mus musculus
gggaagcaaccaaggttccagcttt

SEQ ID NO: 626205 - DNA, 25 bp, Mus musculus
gggaagcaaccatggttccagcttt

SEQ ID NO: 626206 - DNA, 25 bp, Mus musculus
gggaagcacagccatcatgcttagt

SEQ ID NO: 626207 - DNA, 25 bp, Mus musculus
gggaagcacagcgatcatgcttagt

SEQ ID NO: 626208 - DNA, 25 bp, Mus musculus
gggaagcacattcgtgtctgcatct

SEQ ID NO: 626209 - DNA, 25 bp, Mus musculus
gggaagcacattggtgtctgcatct

SEQ ID NO: 626210 - DNA, 25 bp, Mus musculus
gggaagcacccaacatccagtctgg

SEQ ID NO: 626211 - DNA, 25 bp, Mus musculus
gggaagcacccacaacatttctctg

SEQ ID NO: 626212 - DNA, 25 bp, Mus musculus
gggaagcacccagaacatttctctg

SEQ ID NO: 626213 - DNA, 25 bp, Mus musculus
gggaagcacccatcatccagtctgg

SEQ ID NO: 626214 - DNA, 25 bp, Mus musculus
gggaagcacctgcatgtatcaccat

SEQ ID NO: 626215 - DNA, 25 bp, Mus musculus
gggaagcacctggatgtatcaccat

SEQ ID NO: 626216 - DNA, 25 bp, Mus musculus
gggaagcacgtcattggccttcaaa

SEQ ID NO: 626217 - DNA, 25 bp, Mus musculus
gggaagcacgtctttggccttcaaa

SEQ ID NO: 626218 - DNA, 25 bp, Mus musculus
gggaagcactagacagccttaaaaa

SEQ ID NO: 626219 - DNA, 25 bp, Mus musculus
gggaagcactagtcagccttaaaaa

SEQ ID NO: 626220 - DNA, 25 bp, Mus musculus
gggaagcactgcatccttgatgtct

SEQ ID NO: 626221 - DNA, 25 bp, Mus musculus
gggaagcactgcttccttgatgtct

SEQ ID NO: 626222 - DNA, 25 bp, Mus musculus
gggaagcactgtagacctgctcagg

SEQ ID NO: 626223 - DNA, 25 bp, Mus musculus
gggaagcactgttgacctgctcagg

SEQ ID NO: 626224 - DNA, 25 bp, Mus musculus
gggaagcacttacattacttttcag

SEQ ID NO: 626225 - DNA, 25 bp, Mus musculus
gggaagcacttagattacttttcag

SEQ ID NO: 626226 - DNA, 25 bp, Mus musculus
gggaagcagcagagaccaaatgtga

SEQ ID NO: 626227 - DNA, 25 bp, Mus musculus
gggaagcagcagtgaccaaatgtga

SEQ ID NO: 626228 - DNA, 25 bp, Mus musculus
gggaagcagcccaatgacttatatg

SEQ ID NO: 626229 - DNA, 25 bp, Mus musculus
gggaagcagccctatgacttatatg

SEQ ID NO: 626230 - DNA, 25 bp, Mus musculus
gggaagcagcgaatttacagcctca

SEQ ID NO: 626231 - DNA, 25 bp, Mus musculus
gggaagcagcgattttacagcctca

SEQ ID NO: 626232 - DNA, 25 bp, Mus musculus
gggaagcaggcaaaccctccagcac

SEQ ID NO: 626233 - DNA, 25 bp, Mus musculus
gggaagcaggcataccctccagcac

SEQ ID NO: 626234 - DNA, 25 bp, Mus musculus
gggaagcaggccatctctttagaaa

SEQ ID NO: 626235 - DNA, 25 bp, Mus musculus
gggaagcaggccttctctttagaaa

SEQ ID NO: 626236 - DNA, 25 bp, Mus musculus
gggaagcagtgtccaaagcactttg

SEQ ID NO: 626237 - DNA, 25 bp, Mus musculus
gggaagcagtgtgcaaagcactttg

SEQ ID NO: 626238 - DNA, 25 bp, Mus musculus
gggaagcagttcacttatgctcaaa

SEQ ID NO: 626239 - DNA, 25 bp, Mus musculus
gggaagcagttctcttatgctcaaa

SEQ ID NO: 626240 - DNA, 25 bp, Mus musculus
gggaagcatcaactctttcgttaga

SEQ ID NO: 626241 - DNA, 25 bp, Mus musculus
gggaagcatcaagtctttcgttaga

SEQ ID NO: 626242 - DNA, 25 bp, Mus musculus
gggaagcatcctactcgggataaca

SEQ ID NO: 626243 - DNA, 25 bp, Mus musculus
gggaagcatccttctcgggataaca

SEQ ID NO: 626244 - DNA, 25 bp, Mus musculus
gggaagcatctgactcacataggct

SEQ ID NO: 626245 - DNA, 25 bp, Mus musculus
gggaagcatctgtctcacataggct

SEQ ID NO: 626246 - DNA, 25 bp, Mus musculus
gggaagcattccatgttaacagtga

SEQ ID NO: 626247 - DNA, 25 bp, Mus musculus
gggaagcattccttgttaacagtga

SEQ ID NO: 626248 - DNA, 25 bp, Mus musculus
gggaagccaaaacaggaagagctca

SEQ ID NO: 626249 - DNA, 25 bp, Mus musculus
gggaagccaaaagaggaagagctca

SEQ ID NO: 626250 - DNA, 25 bp, Mus musculus
gggaagccacaaacctttatgtgat

SEQ ID NO: 626251 - DNA, 25 bp, Mus musculus
gggaagccacaatcctttatgtgat

SEQ ID NO: 626252 - DNA, 25 bp, Mus musculus
gggaagccaccaccggtgcagctct

SEQ ID NO: 626253 - DNA, 25 bp, Mus musculus
gggaagccaccagcggtgcagctct

SEQ ID NO: 626254 - DNA, 25 bp, Mus musculus
gggaagccactcatagtgctaactg

SEQ ID NO: 626255 - DNA, 25 bp, Mus musculus
gggaagccactcttagtgctaactg

SEQ ID NO: 626256 - DNA, 25 bp, Mus musculus
gggaagccagctagtcatagactaa

SEQ ID NO: 626257 - DNA, 25 bp, Mus musculus
gggaagccagcttgtcatagactaa

SEQ ID NO: 626258 - DNA, 25 bp, Mus musculus
gggaagccaggaaccttctgctctg

SEQ ID NO: 626259 - DNA, 25 bp, Mus musculus
gggaagccaggatccttctgctctg

SEQ ID NO: 626260 - DNA, 25 bp, Mus musculus
gggaagccagttcactgcgtagttc

SEQ ID NO: 626261 - DNA, 25 bp, Mus musculus
gggaagccagttgactgcgtagttc

SEQ ID NO: 626262 - DNA, 25 bp, Mus musculus
gggaagccataccactatagtattg

SEQ ID NO: 626263 - DNA, 25 bp, Mus musculus
gggaagccatacgactatagtattg

SEQ ID NO: 626264 - DNA, 25 bp, Mus musculus
gggaagcccagcactgaagctagat

SEQ ID NO: 626265 - DNA, 25 bp, Mus musculus
gggaagcccagctctgaagctagat

SEQ ID NO: 626266 - DNA, 25 bp, Mus musculus
gggaagcccatgaagtcatcctgaa

SEQ ID NO: 626267 - DNA, 25 bp, Mus musculus
gggaagcccatgtagtcatcctgaa

SEQ ID NO: 626268 - DNA, 25 bp, Mus musculus
gggaagccccacactagtagtttag

SEQ ID NO: 626269 - DNA, 25 bp, Mus musculus
gggaagccccactctagtagtttag

SEQ ID NO: 626270 - DNA, 25 bp, Mus musculus
gggaagccccagaaactcgagcttc

SEQ ID NO: 626271 - DNA, 25 bp, Mus musculus
gggaagccccagtaactcgagcttc

SEQ ID NO: 626272 - DNA, 25 bp, Mus musculus
gggaagcccctcattttagcacagg

SEQ ID NO: 626273 - DNA, 25 bp, Mus musculus
gggaagcccctctttttagcacagg

SEQ ID NO: 626274 - DNA, 25 bp, Mus musculus
gggaagccctcaacagaccaaggag

SEQ ID NO: 626275 - DNA, 25 bp, Mus musculus
gggaagccctcatcagaccaaggag

SEQ ID NO: 626276 - DNA, 25 bp, Mus musculus
gggaagccgaacctgcattgagcca

SEQ ID NO: 626277 - DNA, 25 bp, Mus musculus
gggaagccgaacgtgcattgagcca

SEQ ID NO: 626278 - DNA, 25 bp, Mus musculus
gggaagccggagacaccattatttg

SEQ ID NO: 626279 - DNA, 25 bp, Mus musculus
gggaagccggagtcaccattatttg

SEQ ID NO: 626280 - DNA, 25 bp, Mus musculus
gggaagcctataaccctgggcctct

SEQ ID NO: 626281 - DNA, 25 bp, Mus musculus
gggaagcctatatccctgggcctct

SEQ ID NO: 626282 - DNA, 25 bp, Mus musculus
gggaagcctcccaaacagagtacaa

SEQ ID NO: 626283 - DNA, 25 bp, Mus musculus
gggaagcctccctaacagagtacaa

SEQ ID NO: 626284 - DNA, 25 bp, Mus musculus
gggaagcctgacactagctgtcaat

SEQ ID NO: 626285 - DNA, 25 bp, Mus musculus
gggaagcctgactctagctgtcaat

SEQ ID NO: 626286 - DNA, 25 bp, Mus musculus
gggaagccttccacgatacttatct

SEQ ID NO: 626287 - DNA, 25 bp, Mus musculus
gggaagccttccaggactctgaggt

SEQ ID NO: 626288 - DNA, 25 bp, Mus musculus
gggaagccttcctcgatacttatct

SEQ ID NO: 626289 - DNA, 25 bp, Mus musculus
gggaagccttcctggactctgaggt

SEQ ID NO: 626290 - DNA, 25 bp, Mus musculus
gggaagcgctttatatagacatcag

SEQ ID NO: 626291 - DNA, 25 bp, Mus musculus
gggaagcgctttttatagacatcag

SEQ ID NO: 626292 - DNA, 25 bp, Mus musculus
gggaagcgtaccaacagactatctt

SEQ ID NO: 626293 - DNA, 25 bp, Mus musculus
gggaagcgtacctacagactatctt

SEQ ID NO: 626294 - DNA, 25 bp, Mus musculus
gggaagcgtcagcagagcatcctcc

SEQ ID NO: 626295 - DNA, 25 bp, Mus musculus
gggaagcgtcaggagagcatcctcc

SEQ ID NO: 626296 - DNA, 25 bp, Mus musculus
gggaagcgtcccagttctaggcgct

SEQ ID NO: 626297 - DNA, 25 bp, Mus musculus
gggaagcgtccctgttctaggcgct

SEQ ID NO: 626298 - DNA, 25 bp, Mus musculus
gggaagcgtgatcgacttgtataaa

SEQ ID NO: 626299 - DNA, 25 bp, Mus musculus
gggaagcgtgatggacttgtataaa

SEQ ID NO: 626300 - DNA, 25 bp, Mus musculus
gggaagctaaaccagatgctcaggt

SEQ ID NO: 626301 - DNA, 25 bp, Mus musculus
gggaagctaaacgagatgctcaggt

SEQ ID NO: 626302 - DNA, 25 bp, Mus musculus
gggaagctaaccaccacagtatgag

SEQ ID NO: 626303 - DNA, 25 bp, Mus musculus
gggaagctaaccctctaaatgagaa

SEQ ID NO: 626304 - DNA, 25 bp, Mus musculus
gggaagctaaccgtctaaatgagaa

SEQ ID NO: 626305 - DNA, 25 bp, Mus musculus
gggaagctaacctccacagtatgag

SEQ ID NO: 626306 - DNA, 25 bp, Mus musculus
gggaagctaactcccatcctgtgtc

SEQ ID NO: 626307 - DNA, 25 bp, Mus musculus
gggaagctaactctgtgtgaatatc

SEQ ID NO: 626308 - DNA, 25 bp, Mus musculus
gggaagctaactgccatcctgtgtc

SEQ ID NO: 626309 - DNA, 25 bp, Mus musculus
gggaagctaactgtgtgtgaatatc

SEQ ID NO: 626310 - DNA, 25 bp, Mus musculus
gggaagctacaaacgcagctctctt

SEQ ID NO: 626311 - DNA, 25 bp, Mus musculus
gggaagctacaatcgcagctctctt

SEQ ID NO: 626312 - DNA, 25 bp, Mus musculus
gggaagctagacagagccttgccac

SEQ ID NO: 626313 - DNA, 25 bp, Mus musculus
gggaagctagactgagccttgccac

SEQ ID NO: 626314 - DNA, 25 bp, Mus musculus
gggaagctatctccatggcaattgc

SEQ ID NO: 626315 - DNA, 25 bp, Mus musculus
gggaagctatctgcatggcaattgc

SEQ ID NO: 626316 - DNA, 25 bp, Mus musculus
gggaagctatttagatttcttgtta

SEQ ID NO: 626317 - DNA, 25 bp, Mus musculus
gggaagctattttgatttcttgtta

SEQ ID NO: 626318 - DNA, 25 bp, Mus musculus
gggaagctcacacccggatgtcaga

SEQ ID NO: 626319 - DNA, 25 bp, Mus musculus
gggaagctcacagccggatgtcaga

SEQ ID NO: 626320 - DNA, 25 bp, Mus musculus
gggaagctcagaaccggtggccgcg

SEQ ID NO: 626321 - DNA, 25 bp, Mus musculus
gggaagctcagatccggtggccgcg

SEQ ID NO: 626322 - DNA, 25 bp, Mus musculus
gggaagctcagcagaagccaccctg

SEQ ID NO: 626323 - DNA, 25 bp, Mus musculus
gggaagctcagctgaagccaccctg

SEQ ID NO: 626324 - DNA, 25 bp, Mus musculus
gggaagctccatacttaacctacct

SEQ ID NO: 626325 - DNA, 25 bp, Mus musculus
gggaagctccattcttaacctacct

SEQ ID NO: 626326 - DNA, 25 bp, Mus musculus
gggaagctccttaaactcagttagt

SEQ ID NO: 626327 - DNA, 25 bp, Mus musculus
gggaagctcctttaactcagttagt

SEQ ID NO: 626328 - DNA, 25 bp, Mus musculus
gggaagctctaaatgctgcaggaaa

SEQ ID NO: 626329 - DNA, 25 bp, Mus musculus
gggaagctctaattgctgcaggaaa

SEQ ID NO: 626330 - DNA, 25 bp, Mus musculus
gggaagctctgccagcctcaagaga

SEQ ID NO: 626331 - DNA, 25 bp, Mus musculus
gggaagctctgcgagcctcaagaga

SEQ ID NO: 626332 - DNA, 25 bp, Mus musculus
gggaagctctttatcctatgcaata

SEQ ID NO: 626333 - DNA, 25 bp, Mus musculus
gggaagctctttttcctatgcaata

SEQ ID NO: 626334 - DNA, 25 bp, Mus musculus
gggaagctgagcctttttcattcac

SEQ ID NO: 626335 - DNA, 25 bp, Mus musculus
gggaagctgagcgtttttcattcac

SEQ ID NO: 626336 - DNA, 25 bp, Mus musculus
gggaagctgcacatgaaccaagggt

SEQ ID NO: 626337 - DNA, 25 bp, Mus musculus
gggaagctgcacttgaaccaagggt

SEQ ID NO: 626338 - DNA, 25 bp, Mus musculus
gggaagctgctcagttaacttgcat

SEQ ID NO: 626339 - DNA, 25 bp, Mus musculus
gggaagctgctctgttaacttgcat

SEQ ID NO: 626340 - DNA, 25 bp, Mus musculus
gggaagctggcactgttcttctgtc

SEQ ID NO: 626341 - DNA, 25 bp, Mus musculus
gggaagctggcagtgttcttctgtc

SEQ ID NO: 626342 - DNA, 25 bp, Mus musculus
gggaagctggcgacacacagatgac

SEQ ID NO: 626343 - DNA, 25 bp, Mus musculus
gggaagctggcgtcacacagatgac

SEQ ID NO: 626344 - DNA, 25 bp, Mus musculus
gggaagctgggactccatccctcga

SEQ ID NO: 626345 - DNA, 25 bp, Mus musculus
gggaagctgggagtccatccctcga

SEQ ID NO: 626346 - DNA, 25 bp, Mus musculus
gggaagctgggcactctgtcgccat

SEQ ID NO: 626347 - DNA, 25 bp, Mus musculus
gggaagctgggctctctgtcgccat

SEQ ID NO: 626348 - DNA, 25 bp, Mus musculus
gggaagctgtgcactgctgagccca

SEQ ID NO: 626349 - DNA, 25 bp, Mus musculus
gggaagctgtgctctgctgagccca

SEQ ID NO: 626350 - DNA, 25 bp, Mus musculus
gggaagctgttaaactgtcagtcaa

SEQ ID NO: 626351 - DNA, 25 bp, Mus musculus
gggaagctgttatactgtcagtcaa

SEQ ID NO: 626352 - DNA, 25 bp, Mus musculus
gggaagcttacactttatcgagcaa

SEQ ID NO: 626353 - DNA, 25 bp, Mus musculus
gggaagcttacagtttatcgagcaa

SEQ ID NO: 626354 - DNA, 25 bp, Mus musculus
gggaagcttagaaatgccaacaaca

SEQ ID NO: 626355 - DNA, 25 bp, Mus musculus
gggaagcttagatatgccaacaaca

SEQ ID NO: 626356 - DNA, 25 bp, Mus musculus
gggaagcttagtactcaggcaacag

SEQ ID NO: 626357 - DNA, 25 bp, Mus musculus
gggaagcttagttctcaggcaacag

SEQ ID NO: 626358 - DNA, 25 bp, Mus musculus
gggaagcttcccatgcaagcttgct

SEQ ID NO: 626359 - DNA, 25 bp, Mus musculus
gggaagcttcccttgcaagcttgct

SEQ ID NO: 626360 - DNA, 25 bp, Mus musculus
gggaagcttctgacgtctccgctgc

SEQ ID NO: 626361 - DNA, 25 bp, Mus musculus
gggaagcttctgtcgtctccgctgc

SEQ ID NO: 626362 - DNA, 25 bp, Mus musculus
gggaagcttgacaccatcacagtca

SEQ ID NO: 626363 - DNA, 25 bp, Mus musculus
gggaagcttgactccatcacagtca

SEQ ID NO: 626364 - DNA, 25 bp, Mus musculus
gggaagctttccaaaactgcgtgca

SEQ ID NO: 626365 - DNA, 25 bp, Mus musculus
gggaagctttcctaaactgcgtgca

SEQ ID NO: 626366 - DNA, 25 bp, Mus musculus
gggaagctttttcataccactttca

SEQ ID NO: 626367 - DNA, 25 bp, Mus musculus
gggaagctttttgataccactttca

SEQ ID NO: 626368 - DNA, 25 bp, Mus musculus
gggaaggaaccactgtgcaccagac

SEQ ID NO: 626369 - DNA, 25 bp, Mus musculus
gggaaggaaccagtgtgcaccagac

SEQ ID NO: 626370 - DNA, 25 bp, Mus musculus
gggaaggaacgcagagacaatctga

SEQ ID NO: 626371 - DNA, 25 bp, Mus musculus
gggaaggaacgctgagacaatctga

SEQ ID NO: 626372 - DNA, 25 bp, Mus musculus
gggaaggaagccatatttaccagta

SEQ ID NO: 626373 - DNA, 25 bp, Mus musculus
gggaaggaagccttatttaccagta

SEQ ID NO: 626374 - DNA, 25 bp, Mus musculus
gggaaggaagcgatagccatgctaa

SEQ ID NO: 626375 - DNA, 25 bp, Mus musculus
gggaaggaagcgttagccatgctaa

SEQ ID NO: 626376 - DNA, 25 bp, Mus musculus
gggaaggacctaccagaacatgctg

SEQ ID NO: 626377 - DNA, 25 bp, Mus musculus
gggaaggacctagcagaacatgctg

SEQ ID NO: 626378 - DNA, 25 bp, Mus musculus
gggaaggacctcagttcctattcta

SEQ ID NO: 626379 - DNA, 25 bp, Mus musculus
gggaaggacctctgttcctattcta

SEQ ID NO: 626380 - DNA, 25 bp, Mus musculus
gggaaggagattccagccccaccct

SEQ ID NO: 626381 - DNA, 25 bp, Mus musculus
gggaaggagattgcagccccaccct

SEQ ID NO: 626382 - DNA, 25 bp, Mus musculus
gggaaggagccccaacatagcagca

SEQ ID NO: 626383 - DNA, 25 bp, Mus musculus
gggaaggagcccgaacatagcagca

SEQ ID NO: 626384 - DNA, 25 bp, Mus musculus
gggaaggaggcaacacacccatcat

SEQ ID NO: 626385 - DNA, 25 bp, Mus musculus
gggaaggaggcatcacacccatcat

SEQ ID NO: 626386 - DNA, 25 bp, Mus musculus
gggaaggattttaagaccgcatctt

SEQ ID NO: 626387 - DNA, 25 bp, Mus musculus
gggaaggatttttagaccgcatctt

SEQ ID NO: 626388 - DNA, 25 bp, Mus musculus
gggaaggcacttaacacaaagacta

SEQ ID NO: 626389 - DNA, 25 bp, Mus musculus
gggaaggcactttacacaaagacta

SEQ ID NO: 626390 - DNA, 25 bp, Mus musculus
gggaaggcatttagaacagtctata

SEQ ID NO: 626391 - DNA, 25 bp, Mus musculus
gggaaggcattttgaacagtctata

SEQ ID NO: 626392 - DNA, 25 bp, Mus musculus
gggaaggcccctcctcagtcttgtc

SEQ ID NO: 626393 - DNA, 25 bp, Mus musculus
gggaaggcccctgctcagtcttgtc

SEQ ID NO: 626394 - DNA, 25 bp, Mus musculus
gggaaggccctgcacaatgtctgtt

SEQ ID NO: 626395 - DNA, 25 bp, Mus musculus
gggaaggccctggacaatgtctgtt

SEQ ID NO: 626396 - DNA, 25 bp, Mus musculus
gggaaggccggacaatcatccactg

SEQ ID NO: 626397 - DNA, 25 bp, Mus musculus
gggaaggccggagaatcatccactg

SEQ ID NO: 626398 - DNA, 25 bp, Mus musculus
gggaaggcgtctaacattcagtaga

SEQ ID NO: 626399 - DNA, 25 bp, Mus musculus
gggaaggcgtcttacattcagtaga

SEQ ID NO: 626400 - DNA, 25 bp, Mus musculus
gggaaggctaccacatagtccgcat

SEQ ID NO: 626401 - DNA, 25 bp, Mus musculus
gggaaggctacctcatagtccgcat

SEQ ID NO: 626402 - DNA, 25 bp, Mus musculus
gggaaggctcttagcaactaactga

SEQ ID NO: 626403 - DNA, 25 bp, Mus musculus
gggaaggctctttgcaactaactga

SEQ ID NO: 626404 - DNA, 25 bp, Mus musculus
gggaaggctttcaatctatgcagga

SEQ ID NO: 626405 - DNA, 25 bp, Mus musculus
gggaaggctttcagtcagtgctcag

SEQ ID NO: 626406 - DNA, 25 bp, Mus musculus
gggaaggctttctatctatgcagga

SEQ ID NO: 626407 - DNA, 25 bp, Mus musculus
gggaaggctttctgtcagtgctcag

SEQ ID NO: 626408 - DNA, 25 bp, Mus musculus
gggaaggctttgcagtttactcaag

SEQ ID NO: 626409 - DNA, 25 bp, Mus musculus
gggaaggctttggagtttactcaag

SEQ ID NO: 626410 - DNA, 25 bp, Mus musculus
gggaagggagccagatacatcagat

SEQ ID NO: 626411 - DNA, 25 bp, Mus musculus
gggaagggagcctgatacatcagat

SEQ ID NO: 626412 - DNA, 25 bp, Mus musculus
gggaagggcactaccgcctgcctct

SEQ ID NO: 626413 - DNA, 25 bp, Mus musculus
gggaagggcacttccgcctgcctct

SEQ ID NO: 626414 - DNA, 25 bp, Mus musculus
gggaagggccccagacaccaagagc

SEQ ID NO: 626415 - DNA, 25 bp, Mus musculus
gggaagggcccctgacaccaagagc

SEQ ID NO: 626416 - DNA, 25 bp, Mus musculus
gggaagggccttctcactaaaatat

SEQ ID NO: 626417 - DNA, 25 bp, Mus musculus
gggaagggccttgtcactaaaatat

SEQ ID NO: 626418 - DNA, 25 bp, Mus musculus
gggaagggcgctcgttcatctccaa

SEQ ID NO: 626419 - DNA, 25 bp, Mus musculus
gggaagggcgctggttcatctccaa

SEQ ID NO: 626420 - DNA, 25 bp, Mus musculus
gggaagggctcgatttctctccagg

SEQ ID NO: 626421 - DNA, 25 bp, Mus musculus
gggaagggctcgttttctctccagg

SEQ ID NO: 626422 - DNA, 25 bp, Mus musculus
gggaagggtcagctttattccttag

SEQ ID NO: 626423 - DNA, 25 bp, Mus musculus
gggaagggtcaggtttattccttag

SEQ ID NO: 626424 - DNA, 25 bp, Mus musculus
gggaagggttcaacttgcttttgga

SEQ ID NO: 626425 - DNA, 25 bp, Mus musculus
gggaagggttcatcttgcttttgga

SEQ ID NO: 626426 - DNA, 25 bp, Mus musculus
gggaaggtaccaagaaccgcatcat

SEQ ID NO: 626427 - DNA, 25 bp, Mus musculus
gggaaggtaccatgaaccgcatcat

SEQ ID NO: 626428 - DNA, 25 bp, Mus musculus
gggaaggtacctctagcttaggaat

SEQ ID NO: 626429 - DNA, 25 bp, Mus musculus
gggaaggtacctgtagcttaggaat

SEQ ID NO: 626430 - DNA, 25 bp, Mus musculus
gggaaggtcagtccccagccaacct

SEQ ID NO: 626431 - DNA, 25 bp, Mus musculus
gggaaggtcagtgcccagccaacct

SEQ ID NO: 626432 - DNA, 25 bp, Mus musculus
gggaaggtcctacgctactttcagt

SEQ ID NO: 626433 - DNA, 25 bp, Mus musculus
gggaaggtcctaggctactttcagt

SEQ ID NO: 626434 - DNA, 25 bp, Mus musculus
gggaaggtcgaacgactccacctca

SEQ ID NO: 626435 - DNA, 25 bp, Mus musculus
gggaaggtcgaaggactccacctca

SEQ ID NO: 626436 - DNA, 25 bp, Mus musculus
gggaaggtgaatcttaccagcctaa

SEQ ID NO: 626437 - DNA, 25 bp, Mus musculus
gggaaggtgaatgttaccagcctaa

SEQ ID NO: 626438 - DNA, 25 bp, Mus musculus
gggaaggtgtccctgtcaccccatg

SEQ ID NO: 626439 - DNA, 25 bp, Mus musculus
gggaaggtgtccgtgtcaccccatg

SEQ ID NO: 626440 - DNA, 25 bp, Mus musculus
gggaaggttttcacatgctcaggta

SEQ ID NO: 626441 - DNA, 25 bp, Mus musculus
gggaaggttttctcatgctcaggta

SEQ ID NO: 626442 - DNA, 25 bp, Mus musculus
gggaagtaacacagatctagaagac

SEQ ID NO: 626443 - DNA, 25 bp, Mus musculus
gggaagtaacactgatctagaagac

SEQ ID NO: 626444 - DNA, 25 bp, Mus musculus
gggaagtaactcacccatagccaca

SEQ ID NO: 626445 - DNA, 25 bp, Mus musculus
gggaagtaactctcccatagccaca

SEQ ID NO: 626446 - DNA, 25 bp, Mus musculus
gggaagtacaacacctcagatgtgt

SEQ ID NO: 626447 - DNA, 25 bp, Mus musculus
gggaagtacaactcctcagatgtgt

SEQ ID NO: 626448 - DNA, 25 bp, Mus musculus
gggaagtacgtaaaaataatcattg

SEQ ID NO: 626449 - DNA, 25 bp, Mus musculus
gggaagtacgtataaataatcattg

SEQ ID NO: 626450 - DNA, 25 bp, Mus musculus
gggaagtactaaacgctctaggcta

SEQ ID NO: 626451 - DNA, 25 bp, Mus musculus
gggaagtactaatcgctctaggcta

SEQ ID NO: 626452 - DNA, 25 bp, Mus musculus
gggaagtagcagacctgtctcactc

SEQ ID NO: 626453 - DNA, 25 bp, Mus musculus
gggaagtagcagtcctgtctcactc

SEQ ID NO: 626454 - DNA, 25 bp, Mus musculus
gggaagtagcatatatgtgctttaa

SEQ ID NO: 626455 - DNA, 25 bp, Mus musculus
gggaagtagcatttatgtgctttaa

SEQ ID NO: 626456 - DNA, 25 bp, Mus musculus
gggaagtaggccagttcaggccttc

SEQ ID NO: 626457 - DNA, 25 bp, Mus musculus
gggaagtaggcctgttcaggccttc

SEQ ID NO: 626458 - DNA, 25 bp, Mus musculus
gggaagtagtcacgactctttctat

SEQ ID NO: 626459 - DNA, 25 bp, Mus musculus
gggaagtagtcaggactctttctat

SEQ ID NO: 626460 - DNA, 25 bp, Mus musculus
gggaagtatctaacactggctcaca

SEQ ID NO: 626461 - DNA, 25 bp, Mus musculus
gggaagtatctatcactggctcaca

SEQ ID NO: 626462 - DNA, 25 bp, Mus musculus
gggaagtatgtaccaaatacctcct

SEQ ID NO: 626463 - DNA, 25 bp, Mus musculus
gggaagtatgtagcaaatacctcct

SEQ ID NO: 626464 - DNA, 25 bp, Mus musculus
gggaagtattctactctatacttgc

SEQ ID NO: 626465 - DNA, 25 bp, Mus musculus
gggaagtattctcctttcaagtgta

SEQ ID NO: 626466 - DNA, 25 bp, Mus musculus
gggaagtattctgctttcaagtgta

SEQ ID NO: 626467 - DNA, 25 bp, Mus musculus
gggaagtattcttctctatacttgc

SEQ ID NO: 626468 - DNA, 25 bp, Mus musculus
gggaagtattggaagctcagagaac

SEQ ID NO: 626469 - DNA, 25 bp, Mus musculus
gggaagtattggtagctcagagaac

SEQ ID NO: 626470 - DNA, 25 bp, Mus musculus
gggaagtcaaccctaactgtacaag

SEQ ID NO: 626471 - DNA, 25 bp, Mus musculus
gggaagtcaaccgtaactgtacaag

SEQ ID NO: 626472 - DNA, 25 bp, Mus musculus
gggaagtcagacatccaagcccagc

SEQ ID NO: 626473 - DNA, 25 bp, Mus musculus
gggaagtcagacttccaagcccagc

SEQ ID NO: 626474 - DNA, 25 bp, Mus musculus
gggaagtcatttacgccaaggcacc

SEQ ID NO: 626475 - DNA, 25 bp, Mus musculus
gggaagtcattttcgccaaggcacc

SEQ ID NO: 626476 - DNA, 25 bp, Mus musculus
gggaagtccaccatatacactgctg

SEQ ID NO: 626477 - DNA, 25 bp, Mus musculus
gggaagtccaccttatacactgctg

SEQ ID NO: 626478 - DNA, 25 bp, Mus musculus
gggaagtcccaacccatgtgttcaa

SEQ ID NO: 626479 - DNA, 25 bp, Mus musculus
gggaagtcccaagccatgtgttcaa

SEQ ID NO: 626480 - DNA, 25 bp, Mus musculus
gggaagtcccacagagacccaggtg

SEQ ID NO: 626481 - DNA, 25 bp, Mus musculus
gggaagtcccactgagacccaggtg

SEQ ID NO: 626482 - DNA, 25 bp, Mus musculus
gggaagtcctacagatgttctttat

SEQ ID NO: 626483 - DNA, 25 bp, Mus musculus
gggaagtcctactgatgttctttat

SEQ ID NO: 626484 - DNA, 25 bp, Mus musculus
gggaagtcctctagcacaggagaca

SEQ ID NO: 626485 - DNA, 25 bp, Mus musculus
gggaagtcctcttgcacaggagaca

SEQ ID NO: 626486 - DNA, 25 bp, Mus musculus
gggaagtccttcaacacaagaagtt

SEQ ID NO: 626487 - DNA, 25 bp, Mus musculus
gggaagtccttcagccagagtgcta

SEQ ID NO: 626488 - DNA, 25 bp, Mus musculus
gggaagtccttctacacaagaagtt

SEQ ID NO: 626489 - DNA, 25 bp, Mus musculus
gggaagtccttctgccagagtgcta

SEQ ID NO: 626490 - DNA, 25 bp, Mus musculus
gggaagtctacaactactcctgtga

SEQ ID NO: 626491 - DNA, 25 bp, Mus musculus
gggaagtctacatctactcctgtga

SEQ ID NO: 626492 - DNA, 25 bp, Mus musculus
gggaagtctctaattctacccacac

SEQ ID NO: 626493 - DNA, 25 bp, Mus musculus
gggaagtctctatttctacccacac

SEQ ID NO: 626494 - DNA, 25 bp, Mus musculus
gggaagtcttccatacagttgggta

SEQ ID NO: 626495 - DNA, 25 bp, Mus musculus
gggaagtcttccttacagttgggta

SEQ ID NO: 626496 - DNA, 25 bp, Mus musculus
gggaagtcttctccattgagaccta

SEQ ID NO: 626497 - DNA, 25 bp, Mus musculus
gggaagtcttctgcattgagaccta

SEQ ID NO: 626498 - DNA, 25 bp, Mus musculus
gggaagtgacccctacaaccttgct

SEQ ID NO: 626499 - DNA, 25 bp, Mus musculus
gggaagtgacccgtacaaccttgct

SEQ ID NO: 626500 - DNA, 25 bp, Mus musculus
gggaagtgacttctacgggacgcat

SEQ ID NO: 626501 - DNA, 25 bp, Mus musculus
gggaagtgacttgtacgggacgcat

SEQ ID NO: 626502 - DNA, 25 bp, Mus musculus
gggaagtgctaaaggccaggacata

SEQ ID NO: 626503 - DNA, 25 bp, Mus musculus
gggaagtgctaatggccaggacata

SEQ ID NO: 626504 - DNA, 25 bp, Mus musculus
gggaagtgcttcatattgctactga

SEQ ID NO: 626505 - DNA, 25 bp, Mus musculus
gggaagtgcttcttattgctactga

SEQ ID NO: 626506 - DNA, 25 bp, Mus musculus
gggaagtgctttagctgatattaaa

SEQ ID NO: 626507 - DNA, 25 bp, Mus musculus
gggaagtgcttttgctgatattaaa

SEQ ID NO: 626508 - DNA, 25 bp, Mus musculus
gggaagtggctgatctttcctcgat

SEQ ID NO: 626509 - DNA, 25 bp, Mus musculus
gggaagtggctgttctttcctcgat

SEQ ID NO: 626510 - DNA, 25 bp, Mus musculus
gggaagtgtcagacagctccttata

SEQ ID NO: 626511 - DNA, 25 bp, Mus musculus
gggaagtgtcagtcagctccttata

SEQ ID NO: 626512 - DNA, 25 bp, Mus musculus
gggaagtgtcttccaattgtctgga

SEQ ID NO: 626513 - DNA, 25 bp, Mus musculus
gggaagtgtcttgcaattgtctgga

SEQ ID NO: 626514 - DNA, 25 bp, Mus musculus
gggaagtgtgatatctgcttttgtt

SEQ ID NO: 626515 - DNA, 25 bp, Mus musculus
gggaagtgtgatttctgcttttgtt

SEQ ID NO: 626516 - DNA, 25 bp, Mus musculus
gggaagtgtggcatctgcctcttgc

SEQ ID NO: 626517 - DNA, 25 bp, Mus musculus
gggaagtgtggcttctgcctcttgc

SEQ ID NO: 626518 - DNA, 25 bp, Mus musculus
gggaagtgtgtccattcctactgca

SEQ ID NO: 626519 - DNA, 25 bp, Mus musculus
gggaagtgtgtcgattcctactgca

SEQ ID NO: 626520 - DNA, 25 bp, Mus musculus
gggaagttagctaagcttcaagtga

SEQ ID NO: 626521 - DNA, 25 bp, Mus musculus
gggaagttagcttagcttcaagtga

SEQ ID NO: 626522 - DNA, 25 bp, Mus musculus
gggaagttatgaaaacagatccatt

SEQ ID NO: 626523 - DNA, 25 bp, Mus musculus
gggaagttatgataacagatccatt

SEQ ID NO: 626524 - DNA, 25 bp, Mus musculus
gggaagttcactactcctgaggaaa

SEQ ID NO: 626525 - DNA, 25 bp, Mus musculus
gggaagttcacttctcctgaggaaa

SEQ ID NO: 626526 - DNA, 25 bp, Mus musculus
gggaagttccagcatgagtgtcatt

SEQ ID NO: 626527 - DNA, 25 bp, Mus musculus
gggaagttccaggatgagtgtcatt

SEQ ID NO: 626528 - DNA, 25 bp, Mus musculus
gggaagttcctaacgcacagaggat

SEQ ID NO: 626529 - DNA, 25 bp, Mus musculus
gggaagttcctatcgcacagaggat

SEQ ID NO: 626530 - DNA, 25 bp, Mus musculus
gggaagttcctgagagacctttgca

SEQ ID NO: 626531 - DNA, 25 bp, Mus musculus
gggaagttcctgatatactaattct

SEQ ID NO: 626532 - DNA, 25 bp, Mus musculus
gggaagttcctgtgagacctttgca

SEQ ID NO: 626533 - DNA, 25 bp, Mus musculus
gggaagttcctgttatactaattct

SEQ ID NO: 626534 - DNA, 25 bp, Mus musculus
gggaagttgactagaagtaaccata

SEQ ID NO: 626535 - DNA, 25 bp, Mus musculus
gggaagttgacttgaagtaaccata

SEQ ID NO: 626536 - DNA, 25 bp, Mus musculus
gggaagttgctgaacagaacactgc

SEQ ID NO: 626537 - DNA, 25 bp, Mus musculus
gggaagttgctgtacagaacactgc

SEQ ID NO: 626538 - DNA, 25 bp, Mus musculus
gggaagttgtccacctagcatctct

SEQ ID NO: 626539 - DNA, 25 bp, Mus musculus
gggaagttgtcctcctagcatctct

SEQ ID NO: 626540 - DNA, 25 bp, Mus musculus
gggaagttgtgacccctttaagcct

SEQ ID NO: 626541 - DNA, 25 bp, Mus musculus
gggaagttgtgagccctttaagcct

SEQ ID NO: 626542 - DNA, 25 bp, Mus musculus
gggaagttgtgcctccctcaatcat

SEQ ID NO: 626543 - DNA, 25 bp, Mus musculus
gggaagttgtgcgtccctcaatcat

SEQ ID NO: 626544 - DNA, 25 bp, Mus musculus
gggaagttgtttcccagatgtactg

SEQ ID NO: 626545 - DNA, 25 bp, Mus musculus
gggaagttgtttgccagatgtactg

SEQ ID NO: 626546 - DNA, 25 bp, Mus musculus
gggaagtttattcatcagtttgttt

SEQ ID NO: 626547 - DNA, 25 bp, Mus musculus
gggaagtttattgatcagtttgttt

SEQ ID NO: 626548 - DNA, 25 bp, Mus musculus
gggaagtttcccatgacgctgttcc

SEQ ID NO: 626549 - DNA, 25 bp, Mus musculus
gggaagtttcccttgacgctgttcc

SEQ ID NO: 626550 - DNA, 25 bp, Mus musculus
gggaagtttcgtactggctcacagt

SEQ ID NO: 626551 - DNA, 25 bp, Mus musculus
gggaagtttcgttctggctcacagt

SEQ ID NO: 626552 - DNA, 25 bp, Mus musculus
gggaataacacacttttgctatatt

SEQ ID NO: 626553 - DNA, 25 bp, Mus musculus
gggaataacacagttttgctatatt

SEQ ID NO: 626554 - DNA, 25 bp, Mus musculus
gggaataaccaaccaatgtgtgatg

SEQ ID NO: 626555 - DNA, 25 bp, Mus musculus
gggaataaccaagcaatgtgtgatg

SEQ ID NO: 626556 - DNA, 25 bp, Mus musculus
gggaataacgcaatactttacactt

SEQ ID NO: 626557 - DNA, 25 bp, Mus musculus
gggaataacgcattactttacactt

SEQ ID NO: 626558 - DNA, 25 bp, Mus musculus
gggaataacggtctgcctgcttgca

SEQ ID NO: 626559 - DNA, 25 bp, Mus musculus
gggaataacggtgtgcctgcttgca

SEQ ID NO: 626560 - DNA, 25 bp, Mus musculus
gggaataactcaactttaacgacaa

SEQ ID NO: 626561 - DNA, 25 bp, Mus musculus
gggaataactcatctttaacgacaa

SEQ ID NO: 626562 - DNA, 25 bp, Mus musculus
gggaataagagaaagctattttctt

SEQ ID NO: 626563 - DNA, 25 bp, Mus musculus
gggaataagagatagctattttctt

SEQ ID NO: 626564 - DNA, 25 bp, Mus musculus
gggaataaggacagctgccacctcc

SEQ ID NO: 626565 - DNA, 25 bp, Mus musculus
gggaataaggactgctgccacctcc

SEQ ID NO: 626566 - DNA, 25 bp, Mus musculus
gggaataaggtcaaatgattctttg

SEQ ID NO: 626567 - DNA, 25 bp, Mus musculus
gggaataaggtctaatgattctttg

SEQ ID NO: 626568 - DNA, 25 bp, Mus musculus
gggaataatccaagtctacagatca

SEQ ID NO: 626569 - DNA, 25 bp, Mus musculus
gggaataatccatgtctacagatca

SEQ ID NO: 626570 - DNA, 25 bp, Mus musculus
gggaataatcctcctacacaacctg

SEQ ID NO: 626571 - DNA, 25 bp, Mus musculus
gggaataatcctgctacacaacctg

SEQ ID NO: 626572 - DNA, 25 bp, Mus musculus
gggaataattacactgtatttcatt

SEQ ID NO: 626573 - DNA, 25 bp, Mus musculus
gggaataattactctgtatttcatt

SEQ ID NO: 626574 - DNA, 25 bp, Mus musculus
gggaataattctagtcttttggcag

SEQ ID NO: 626575 - DNA, 25 bp, Mus musculus
gggaataattcttgtcttttggcag

SEQ ID NO: 626576 - DNA, 25 bp, Mus musculus
gggaataattgtctgatactgatct

SEQ ID NO: 626577 - DNA, 25 bp, Mus musculus
gggaataattgtgtgatactgatct

SEQ ID NO: 626578 - DNA, 25 bp, Mus musculus
gggaatacaattactccacatccag

SEQ ID NO: 626579 - DNA, 25 bp, Mus musculus
gggaatacaatttctccacatccag

SEQ ID NO: 626580 - DNA, 25 bp, Mus musculus
gggaatacatttaatcttcattagt

SEQ ID NO: 626581 - DNA, 25 bp, Mus musculus
gggaatacattttatcttcattagt

SEQ ID NO: 626582 - DNA, 25 bp, Mus musculus
gggaataccagccaacagatgaaag

SEQ ID NO: 626583 - DNA, 25 bp, Mus musculus
gggaataccagcgaacagatgaaag

SEQ ID NO: 626584 - DNA, 25 bp, Mus musculus
gggaatacctatattgtaagcttca

SEQ ID NO: 626585 - DNA, 25 bp, Mus musculus
gggaatacctattttgtaagcttca

SEQ ID NO: 626586 - DNA, 25 bp, Mus musculus
gggaatacctgaacgtgcacatgag

SEQ ID NO: 626587 - DNA, 25 bp, Mus musculus
gggaatacctgatcgtgcacatgag

SEQ ID NO: 626588 - DNA, 25 bp, Mus musculus
gggaataccttccaggcctaagatc

SEQ ID NO: 626589 - DNA, 25 bp, Mus musculus
gggaataccttcgaggcctaagatc

SEQ ID NO: 626590 - DNA, 25 bp, Mus musculus
gggaatactattacctaagggccat

SEQ ID NO: 626591 - DNA, 25 bp, Mus musculus
gggaatactatttcctaagggccat

SEQ ID NO: 626592 - DNA, 25 bp, Mus musculus
gggaatactctgattcaccctttgc

SEQ ID NO: 626593 - DNA, 25 bp, Mus musculus
gggaatactctgtttcaccctttgc

SEQ ID NO: 626594 - DNA, 25 bp, Mus musculus
gggaatactgggacactcccacctt

SEQ ID NO: 626595 - DNA, 25 bp, Mus musculus
gggaatactgggtcactcccacctt

SEQ ID NO: 626596 - DNA, 25 bp, Mus musculus
gggaatactttactcctgagctgaa

SEQ ID NO: 626597 - DNA, 25 bp, Mus musculus
gggaatactttagtcctgagctgaa

SEQ ID NO: 626598 - DNA, 25 bp, Mus musculus
gggaatagccaacccggcatcagct

SEQ ID NO: 626599 - DNA, 25 bp, Mus musculus
gggaatagccaagccggcatcagct

SEQ ID NO: 626600 - DNA, 25 bp, Mus musculus
gggaatagccagagtcaccttcgac

SEQ ID NO: 626601 - DNA, 25 bp, Mus musculus
gggaatagccagtgtcaccttcgac

SEQ ID NO: 626602 - DNA, 25 bp, Mus musculus
gggaatagcctaaatttgcttgaat

SEQ ID NO: 626603 - DNA, 25 bp, Mus musculus
gggaatagcctatatttgcttgaat

SEQ ID NO: 626604 - DNA, 25 bp, Mus musculus
gggaatagggaacacaatgattttt

SEQ ID NO: 626605 - DNA, 25 bp, Mus musculus
gggaatagggaagacaatgattttt

SEQ ID NO: 626606 - DNA, 25 bp, Mus musculus
gggaatagtgccaggacttctgttt

SEQ ID NO: 626607 - DNA, 25 bp, Mus musculus
gggaatagtgcctggacttctgttt

SEQ ID NO: 626608 - DNA, 25 bp, Mus musculus
gggaatataagcacaccccagggct

SEQ ID NO: 626609 - DNA, 25 bp, Mus musculus
gggaatataagctcaccccagggct

SEQ ID NO: 626610 - DNA, 25 bp, Mus musculus
gggaatatagtactcctcatagtag

SEQ ID NO: 626611 - DNA, 25 bp, Mus musculus
gggaatatagtagtcctcatagtag

SEQ ID NO: 626612 - DNA, 25 bp, Mus musculus
gggaatatatttctctctgttatct

SEQ ID NO: 626613 - DNA, 25 bp, Mus musculus
gggaatatatttgtctctgttatct

SEQ ID NO: 626614 - DNA, 25 bp, Mus musculus
gggaatatcagacatgccataactt

SEQ ID NO: 626615 - DNA, 25 bp, Mus musculus
gggaatatcagagatgccataactt

SEQ ID NO: 626616 - DNA, 25 bp, Mus musculus
gggaatatcattattgtcctgaata

SEQ ID NO: 626617 - DNA, 25 bp, Mus musculus
gggaatatcatttttgtcctgaata

SEQ ID NO: 626618 - DNA, 25 bp, Mus musculus
gggaatatccacctcagctgagcta

SEQ ID NO: 626619 - DNA, 25 bp, Mus musculus
gggaatatccacgtcagctgagcta

SEQ ID NO: 626620 - DNA, 25 bp, Mus musculus
gggaatatcgaacctgaagtgattt

SEQ ID NO: 626621 - DNA, 25 bp, Mus musculus
gggaatatcgaagctgaagtgattt

SEQ ID NO: 626622 - DNA, 25 bp, Mus musculus
gggaatatgattcaccatcggacat

SEQ ID NO: 626623 - DNA, 25 bp, Mus musculus
gggaatatgattgaccatcggacat

SEQ ID NO: 626624 - DNA, 25 bp, Mus musculus
gggaatatgctcatttgattttcac

SEQ ID NO: 626625 - DNA, 25 bp, Mus musculus
gggaatatgctcttttgattttcac

SEQ ID NO: 626626 - DNA, 25 bp, Mus musculus
gggaatatgcttcgccgccacttct

SEQ ID NO: 626627 - DNA, 25 bp, Mus musculus
gggaatatgcttggccgccacttct

SEQ ID NO: 626628 - DNA, 25 bp, Mus musculus
gggaatatggcaatcattattgtat

SEQ ID NO: 626629 - DNA, 25 bp, Mus musculus
gggaatatggcattcattattgtat

SEQ ID NO: 626630 - DNA, 25 bp, Mus musculus
gggaatattacaatgcacctttgaa

SEQ ID NO: 626631 - DNA, 25 bp, Mus musculus
gggaatattacattgcacctttgaa

SEQ ID NO: 626632 - DNA, 25 bp, Mus musculus
gggaatattcatcttgactgctgta

SEQ ID NO: 626633 - DNA, 25 bp, Mus musculus
gggaatattcatgttgactgctgta

SEQ ID NO: 626634 - DNA, 25 bp, Mus musculus
gggaatattctcaccggagagcatg

SEQ ID NO: 626635 - DNA, 25 bp, Mus musculus
gggaatattctctccggagagcatg

SEQ ID NO: 626636 - DNA, 25 bp, Mus musculus
gggaatattcttatccatttcttat

SEQ ID NO: 626637 - DNA, 25 bp, Mus musculus
gggaatattcttttccatttcttat

SEQ ID NO: 626638 - DNA, 25 bp, Mus musculus
gggaatattgatctacatccatcag

SEQ ID NO: 626639 - DNA, 25 bp, Mus musculus
gggaatattgatgtacatccatcag

SEQ ID NO: 626640 - DNA, 25 bp, Mus musculus
gggaatattgtacgcagccccagaa

SEQ ID NO: 626641 - DNA, 25 bp, Mus musculus
gggaatattgtaggcagccccagaa

SEQ ID NO: 626642 - DNA, 25 bp, Mus musculus
gggaatatttctaggtacctcactt

SEQ ID NO: 626643 - DNA, 25 bp, Mus musculus
gggaatatttcttggtacctcactt

SEQ ID NO: 626644 - DNA, 25 bp, Mus musculus
gggaatcaaaccagataatccggaa

SEQ ID NO: 626645 - DNA, 25 bp, Mus musculus
gggaatcaaacctgataatccggaa

SEQ ID NO: 626646 - DNA, 25 bp, Mus musculus
gggaatcaagggaagaatcttcatc

SEQ ID NO: 626647 - DNA, 25 bp, Mus musculus
gggaatcaagggtagaatcttcatc

SEQ ID NO: 626648 - DNA, 25 bp, Mus musculus
gggaatcaatctcgagtccctgggc

SEQ ID NO: 626649 - DNA, 25 bp, Mus musculus
gggaatcaatctggagtccctgggc

SEQ ID NO: 626650 - DNA, 25 bp, Mus musculus
gggaatcaccttcatatcattgaga

SEQ ID NO: 626651 - DNA, 25 bp, Mus musculus
gggaatcaccttgatatcattgaga

SEQ ID NO: 626652 - DNA, 25 bp, Mus musculus
gggaatcacgccctaggagcccttg

SEQ ID NO: 626653 - DNA, 25 bp, Mus musculus
gggaatcacgccgtaggagcccttg

SEQ ID NO: 626654 - DNA, 25 bp, Mus musculus
gggaatcactgcagaggcgctactc

SEQ ID NO: 626655 - DNA, 25 bp, Mus musculus
gggaatcactgcctggtagccagct

SEQ ID NO: 626656 - DNA, 25 bp, Mus musculus
gggaatcactgcgtggtagccagct

SEQ ID NO: 626657 - DNA, 25 bp, Mus musculus
gggaatcactgctgaggcgctactc

SEQ ID NO: 626658 - DNA, 25 bp, Mus musculus
gggaatcactttaatggcacaagtt

SEQ ID NO: 626659 - DNA, 25 bp, Mus musculus
gggaatcacttttatggcacaagtt

SEQ ID NO: 626660 - DNA, 25 bp, Mus musculus
gggaatcagaaaattgccccagtga

SEQ ID NO: 626661 - DNA, 25 bp, Mus musculus
gggaatcagaaatttgccccagtga

SEQ ID NO: 626662 - DNA, 25 bp, Mus musculus
gggaatcagatcaagcccaagatgt

SEQ ID NO: 626663 - DNA, 25 bp, Mus musculus
gggaatcagatctagcccaagatgt

SEQ ID NO: 626664 - DNA, 25 bp, Mus musculus
gggaatcagcctaggacagtgccgc

SEQ ID NO: 626665 - DNA, 25 bp, Mus musculus
gggaatcagccttggacagtgccgc

SEQ ID NO: 626666 - DNA, 25 bp, Mus musculus
gggaatcagctacttttcaatctta

SEQ ID NO: 626667 - DNA, 25 bp, Mus musculus
gggaatcagctagttttcaatctta

SEQ ID NO: 626668 - DNA, 25 bp, Mus musculus
gggaatcaggacacatccacaccta

SEQ ID NO: 626669 - DNA, 25 bp, Mus musculus
gggaatcaggactcatccacaccta

SEQ ID NO: 626670 - DNA, 25 bp, Mus musculus
gggaatcaggtcaggctattgccaa

SEQ ID NO: 626671 - DNA, 25 bp, Mus musculus
gggaatcaggtctggctattgccaa

SEQ ID NO: 626672 - DNA, 25 bp, Mus musculus
gggaatcatccaaccattatacaac

SEQ ID NO: 626673 - DNA, 25 bp, Mus musculus
gggaatcatccatccattatacaac

SEQ ID NO: 626674 - DNA, 25 bp, Mus musculus
gggaatcatgacattgttcacccat

SEQ ID NO: 626675 - DNA, 25 bp, Mus musculus
gggaatcatgactttgttcacccat

SEQ ID NO: 626676 - DNA, 25 bp, Mus musculus
gggaatcatgtaccagttgatctct

SEQ ID NO: 626677 - DNA, 25 bp, Mus musculus
gggaatcatgtagcagttgatctct

SEQ ID NO: 626678 - DNA, 25 bp, Mus musculus
gggaatcattaccaagtagcctgtc

SEQ ID NO: 626679 - DNA, 25 bp, Mus musculus
gggaatcattacgaagtagcctgtc

SEQ ID NO: 626680 - DNA, 25 bp, Mus musculus
gggaatcattccattcgtgatttac

SEQ ID NO: 626681 - DNA, 25 bp, Mus musculus
gggaatcattcctttcgtgatttac

SEQ ID NO: 626682 - DNA, 25 bp, Mus musculus
gggaatccagcacaattctggtttt

SEQ ID NO: 626683 - DNA, 25 bp, Mus musculus
gggaatccagcagaattctggtttt

SEQ ID NO: 626684 - DNA, 25 bp, Mus musculus
gggaatccagctacattgttctaca

SEQ ID NO: 626685 - DNA, 25 bp, Mus musculus
gggaatccagcttcattgttctaca

SEQ ID NO: 626686 - DNA, 25 bp, Mus musculus
gggaatccaggcagtaagttgtaaa

SEQ ID NO: 626687 - DNA, 25 bp, Mus musculus
gggaatccaggctgtaagttgtaaa

SEQ ID NO: 626688 - DNA, 25 bp, Mus musculus
gggaatccaggtccttatgttgtta

SEQ ID NO: 626689 - DNA, 25 bp, Mus musculus
gggaatccaggtgcttatgttgtta

SEQ ID NO: 626690 - DNA, 25 bp, Mus musculus
gggaatcccaacactgaatctttac

SEQ ID NO: 626691 - DNA, 25 bp, Mus musculus
gggaatcccaactctgaatctttac

SEQ ID NO: 626692 - DNA, 25 bp, Mus musculus
gggaatcccaagacggtttcatcac

SEQ ID NO: 626693 - DNA, 25 bp, Mus musculus
gggaatcccaagtcggtttcatcac

SEQ ID NO: 626694 - DNA, 25 bp, Mus musculus
gggaatcccaatagagccttctgct

SEQ ID NO: 626695 - DNA, 25 bp, Mus musculus
gggaatcccaattgagccttctgct

SEQ ID NO: 626696 - DNA, 25 bp, Mus musculus
gggaatcccacaatgatctcatttt

SEQ ID NO: 626697 - DNA, 25 bp, Mus musculus
gggaatcccacattgatctcatttt

SEQ ID NO: 626698 - DNA, 25 bp, Mus musculus
gggaatcccagaaccttatatggtc

SEQ ID NO: 626699 - DNA, 25 bp, Mus musculus
gggaatcccagacatttgcccttta

SEQ ID NO: 626700 - DNA, 25 bp, Mus musculus
gggaatcccagagatttgcccttta

SEQ ID NO: 626701 - DNA, 25 bp, Mus musculus
gggaatcccagatccttatatggtc

SEQ ID NO: 626702 - DNA, 25 bp, Mus musculus
gggaatcccatcctggacattgtgt

SEQ ID NO: 626703 - DNA, 25 bp, Mus musculus
gggaatcccatcgtggacattgtgt

SEQ ID NO: 626704 - DNA, 25 bp, Mus musculus
gggaatccccagaacgggctgacca

SEQ ID NO: 626705 - DNA, 25 bp, Mus musculus
gggaatccccagtacgggctgacca

SEQ ID NO: 626706 - DNA, 25 bp, Mus musculus
gggaatcccctcacgcagtggcttc

SEQ ID NO: 626707 - DNA, 25 bp, Mus musculus
gggaatcccctctcgcagtggcttc

SEQ ID NO: 626708 - DNA, 25 bp, Mus musculus
gggaatccgtgtcctatctgttcag

SEQ ID NO: 626709 - DNA, 25 bp, Mus musculus
gggaatccgtgtgctatctgttcag

SEQ ID NO: 626710 - DNA, 25 bp, Mus musculus
gggaatcctatcagtggctacttct

SEQ ID NO: 626711 - DNA, 25 bp, Mus musculus
gggaatcctatctgtggctacttct

SEQ ID NO: 626712 - DNA, 25 bp, Mus musculus
gggaatcctcaaatgtagagctgga

SEQ ID NO: 626713 - DNA, 25 bp, Mus musculus
gggaatcctcaattgtagagctgga

SEQ ID NO: 626714 - DNA, 25 bp, Mus musculus
gggaatcctctactcaggcgaatcc

SEQ ID NO: 626715 - DNA, 25 bp, Mus musculus
gggaatcctctagtcaggcgaatcc

SEQ ID NO: 626716 - DNA, 25 bp, Mus musculus
gggaatcgaaccagtattctatgga

SEQ ID NO: 626717 - DNA, 25 bp, Mus musculus
gggaatcgaacctgtattctatgga

SEQ ID NO: 626718 - DNA, 25 bp, Mus musculus
gggaatcgcatgcttgtcttcagac

SEQ ID NO: 626719 - DNA, 25 bp, Mus musculus
gggaatcgcatggttgtcttcagac

SEQ ID NO: 626720 - DNA, 25 bp, Mus musculus
gggaatctaccactcatagcactta

SEQ ID NO: 626721 - DNA, 25 bp, Mus musculus
gggaatctaccagtcatagcactta

SEQ ID NO: 626722 - DNA, 25 bp, Mus musculus
gggaatctagttagaccacgacaca

SEQ ID NO: 626723 - DNA, 25 bp, Mus musculus
gggaatctagtttgaccacgacaca

SEQ ID NO: 626724 - DNA, 25 bp, Mus musculus
gggaatctatccctggtagcctgtc

SEQ ID NO: 626725 - DNA, 25 bp, Mus musculus
gggaatctatccgtggtagcctgtc

SEQ ID NO: 626726 - DNA, 25 bp, Mus musculus
gggaatctcaacacgtggccagggc

SEQ ID NO: 626727 - DNA, 25 bp, Mus musculus
gggaatctcaactcgtggccagggc

SEQ ID NO: 626728 - DNA, 25 bp, Mus musculus
gggaatctcactcaagaatcagaaa

SEQ ID NO: 626729 - DNA, 25 bp, Mus musculus
gggaatctcactgaagaatcagaaa

SEQ ID NO: 626730 - DNA, 25 bp, Mus musculus
gggaatctccgtattgaacaaggca

SEQ ID NO: 626731 - DNA, 25 bp, Mus musculus
gggaatctccgttttgaacaaggca

SEQ ID NO: 626732 - DNA, 25 bp, Mus musculus
gggaatctcttcaataaaggacatg

SEQ ID NO: 626733 - DNA, 25 bp, Mus musculus
gggaatctcttctataaaggacatg

SEQ ID NO: 626734 - DNA, 25 bp, Mus musculus
gggaatctctttaggtcatacagtt

SEQ ID NO: 626735 - DNA, 25 bp, Mus musculus
gggaatctctttccatttccccaat

SEQ ID NO: 626736 - DNA, 25 bp, Mus musculus
gggaatctctttgcatttccccaat

SEQ ID NO: 626737 - DNA, 25 bp, Mus musculus
gggaatctcttttggtcatacagtt

SEQ ID NO: 626738 - DNA, 25 bp, Mus musculus
gggaatctgaatcagcatagctgtg

SEQ ID NO: 626739 - DNA, 25 bp, Mus musculus
gggaatctgaatccccatctgcagc

SEQ ID NO: 626740 - DNA, 25 bp, Mus musculus
gggaatctgaatgagcatagctgtg

SEQ ID NO: 626741 - DNA, 25 bp, Mus musculus
gggaatctgaatgcccatctgcagc

SEQ ID NO: 626742 - DNA, 25 bp, Mus musculus
gggaatctgagcctcactcagcaaa

SEQ ID NO: 626743 - DNA, 25 bp, Mus musculus
gggaatctgagcgtcactcagcaaa

SEQ ID NO: 626744 - DNA, 25 bp, Mus musculus
gggaatctgaggacacatggtaaga

SEQ ID NO: 626745 - DNA, 25 bp, Mus musculus
gggaatctgaggtcacatggtaaga

SEQ ID NO: 626746 - DNA, 25 bp, Mus musculus
gggaatctgcgacttgcccggctcc

SEQ ID NO: 626747 - DNA, 25 bp, Mus musculus
gggaatctgcgagttgcccggctcc

SEQ ID NO: 626748 - DNA, 25 bp, Mus musculus
gggaatctgcttagtaatccacaac

SEQ ID NO: 626749 - DNA, 25 bp, Mus musculus
gggaatctgctttgtaatccacaac

SEQ ID NO: 626750 - DNA, 25 bp, Mus musculus
gggaatctggataacaacgcacatt

SEQ ID NO: 626751 - DNA, 25 bp, Mus musculus
gggaatctggattacaacgcacatt

SEQ ID NO: 626752 - DNA, 25 bp, Mus musculus
gggaatctgtaactctgacggacat

SEQ ID NO: 626753 - DNA, 25 bp, Mus musculus
gggaatctgtaagtctgacggacat

SEQ ID NO: 626754 - DNA, 25 bp, Mus musculus
gggaatcttacaatttcactcgaaa

SEQ ID NO: 626755 - DNA, 25 bp, Mus musculus
gggaatcttacattttcactcgaaa

SEQ ID NO: 626756 - DNA, 25 bp, Mus musculus
gggaatcttagtactctgactgagc

SEQ ID NO: 626757 - DNA, 25 bp, Mus musculus
gggaatcttagttctctgactgagc

SEQ ID NO: 626758 - DNA, 25 bp, Mus musculus
gggaatcttataagcattgctgtga

SEQ ID NO: 626759 - DNA, 25 bp, Mus musculus
gggaatcttatatgcattgctgtga

SEQ ID NO: 626760 - DNA, 25 bp, Mus musculus
gggaatctttacaagctctgtgcaa

SEQ ID NO: 626761 - DNA, 25 bp, Mus musculus
gggaatctttactagctctgtgcaa

SEQ ID NO: 626762 - DNA, 25 bp, Mus musculus
gggaatctttcacagttaatattgc

SEQ ID NO: 626763 - DNA, 25 bp, Mus musculus
gggaatctttcagagttaatattgc

SEQ ID NO: 626764 - DNA, 25 bp, Mus musculus
gggaatctttccactctcattatca

SEQ ID NO: 626765 - DNA, 25 bp, Mus musculus
gggaatctttcctctctcattatca

SEQ ID NO: 626766 - DNA, 25 bp, Mus musculus
gggaatcttttacctgctgttttta

SEQ ID NO: 626767 - DNA, 25 bp, Mus musculus
gggaatcttttagctgctgttttta

SEQ ID NO: 626768 - DNA, 25 bp, Mus musculus
gggaatgaaagaacctggcagaatg

SEQ ID NO: 626769 - DNA, 25 bp, Mus musculus
gggaatgaaagatcctggcagaatg

SEQ ID NO: 626770 - DNA, 25 bp, Mus musculus
gggaatgaacagcatggaatcaata

SEQ ID NO: 626771 - DNA, 25 bp, Mus musculus
gggaatgaacaggatggaatcaata

SEQ ID NO: 626772 - DNA, 25 bp, Mus musculus
gggaatgaacccaggcgctgagaca

SEQ ID NO: 626773 - DNA, 25 bp, Mus musculus
gggaatgaaccctggcgctgagaca

SEQ ID NO: 626774 - DNA, 25 bp, Mus musculus
gggaatgacattatgacacactgga

SEQ ID NO: 626775 - DNA, 25 bp, Mus musculus
gggaatgacattttgacacactgga

SEQ ID NO: 626776 - DNA, 25 bp, Mus musculus
gggaatgaccatcttgccaacagta

SEQ ID NO: 626777 - DNA, 25 bp, Mus musculus
gggaatgaccatgttgccaacagta

SEQ ID NO: 626778 - DNA, 25 bp, Mus musculus
gggaatgacgctatacctgagagag

SEQ ID NO: 626779 - DNA, 25 bp, Mus musculus
gggaatgacgctttacctgagagag

SEQ ID NO: 626780 - DNA, 25 bp, Mus musculus
gggaatgactgaccctaaggaatca

SEQ ID NO: 626781 - DNA, 25 bp, Mus musculus
gggaatgactgagcctaaggaatca

SEQ ID NO: 626782 - DNA, 25 bp, Mus musculus
gggaatgactgcatacctggacttg

SEQ ID NO: 626783 - DNA, 25 bp, Mus musculus
gggaatgactgcttacctggacttg

SEQ ID NO: 626784 - DNA, 25 bp, Mus musculus
gggaatgactttcctgtacatagta

SEQ ID NO: 626785 - DNA, 25 bp, Mus musculus
gggaatgactttgctgtacatagta

SEQ ID NO: 626786 - DNA, 25 bp, Mus musculus
gggaatgagattcatcactgtaata

SEQ ID NO: 626787 - DNA, 25 bp, Mus musculus
gggaatgagattgatcactgtaata

SEQ ID NO: 626788 - DNA, 25 bp, Mus musculus
gggaatgaggctagcattcctaagt

SEQ ID NO: 626789 - DNA, 25 bp, Mus musculus
gggaatgaggcttgcattcctaagt

SEQ ID NO: 626790 - DNA, 25 bp, Mus musculus
gggaatgatcctactttactttcaa

SEQ ID NO: 626791 - DNA, 25 bp, Mus musculus
gggaatgatccttctttactttcaa

SEQ ID NO: 626792 - DNA, 25 bp, Mus musculus
gggaatgatctcacctgagacctca

SEQ ID NO: 626793 - DNA, 25 bp, Mus musculus
gggaatgatctctcctgagacctca

SEQ ID NO: 626794 - DNA, 25 bp, Mus musculus
gggaatgcaatgaggcttcacccat

SEQ ID NO: 626795 - DNA, 25 bp, Mus musculus
gggaatgcaatgtggcttcacccat

SEQ ID NO: 626796 - DNA, 25 bp, Mus musculus
gggaatgcagccacagtgtctcccc

SEQ ID NO: 626797 - DNA, 25 bp, Mus musculus
gggaatgcagcctcagtgtctcccc

SEQ ID NO: 626798 - DNA, 25 bp, Mus musculus
gggaatgcatatcttgagcttgttc

SEQ ID NO: 626799 - DNA, 25 bp, Mus musculus
gggaatgcatatgttgagcttgttc

SEQ ID NO: 626800 - DNA, 25 bp, Mus musculus
gggaatgcatcacagttcctagcct

SEQ ID NO: 626801 - DNA, 25 bp, Mus musculus
gggaatgcatcagagttcctagcct

SEQ ID NO: 626802 - DNA, 25 bp, Mus musculus
gggaatgcatcgaactctgtcagcc

SEQ ID NO: 626803 - DNA, 25 bp, Mus musculus
gggaatgcatcgtactctgtcagcc

SEQ ID NO: 626804 - DNA, 25 bp, Mus musculus
gggaatgcatgcactctgtagagta

SEQ ID NO: 626805 - DNA, 25 bp, Mus musculus
gggaatgcatgctctctgtagagta

SEQ ID NO: 626806 - DNA, 25 bp, Mus musculus
gggaatgcattcactggctacaata

SEQ ID NO: 626807 - DNA, 25 bp, Mus musculus
gggaatgcattctctggctacaata

SEQ ID NO: 626808 - DNA, 25 bp, Mus musculus
gggaatgccaagaacgccaacatgt

SEQ ID NO: 626809 - DNA, 25 bp, Mus musculus
gggaatgccaagtacgccaacatgt

SEQ ID NO: 626810 - DNA, 25 bp, Mus musculus
gggaatgccagtctcagctaccact

SEQ ID NO: 626811 - DNA, 25 bp, Mus musculus
gggaatgccagtgtcagctaccact

SEQ ID NO: 626812 - DNA, 25 bp, Mus musculus
gggaatgcccatcaggtattgtcct

SEQ ID NO: 626813 - DNA, 25 bp, Mus musculus
gggaatgcccatgaggtattgtcct

SEQ ID NO: 626814 - DNA, 25 bp, Mus musculus
gggaatgcccggaagcccctattgg

SEQ ID NO: 626815 - DNA, 25 bp, Mus musculus
gggaatgcccggtagcccctattgg

SEQ ID NO: 626816 - DNA, 25 bp, Mus musculus
gggaatgcctcaatgaaattcagct

SEQ ID NO: 626817 - DNA, 25 bp, Mus musculus
gggaatgcctcattgaaattcagct

SEQ ID NO: 626818 - DNA, 25 bp, Mus musculus
gggaatgcctttcatcgggagatat

SEQ ID NO: 626819 - DNA, 25 bp, Mus musculus
gggaatgcctttgatcgggagatat

SEQ ID NO: 626820 - DNA, 25 bp, Mus musculus
gggaatgcgataccctccccggtgt

SEQ ID NO: 626821 - DNA, 25 bp, Mus musculus
gggaatgcgatagcctccccggtgt

SEQ ID NO: 626822 - DNA, 25 bp, Mus musculus
gggaatgcgcccaaacatggctgct

SEQ ID NO: 626823 - DNA, 25 bp, Mus musculus
gggaatgcgccctaacatggctgct

SEQ ID NO: 626824 - DNA, 25 bp, Mus musculus
gggaatgcgttgataccacacagaa

SEQ ID NO: 626825 - DNA, 25 bp, Mus musculus
gggaatgcgttgttaccacacagaa

SEQ ID NO: 626826 - DNA, 25 bp, Mus musculus
gggaatgcgtttccccgcaagtcac

SEQ ID NO: 626827 - DNA, 25 bp, Mus musculus
gggaatgcgtttgcccgcaagtcac

SEQ ID NO: 626828 - DNA, 25 bp, Mus musculus
gggaatgctaaaaccttactggctt

SEQ ID NO: 626829 - DNA, 25 bp, Mus musculus
gggaatgctaaatccttactggctt

SEQ ID NO: 626830 - DNA, 25 bp, Mus musculus
gggaatgctatcattttcactacca

SEQ ID NO: 626831 - DNA, 25 bp, Mus musculus
gggaatgctatctttttcactacca

SEQ ID NO: 626832 - DNA, 25 bp, Mus musculus
gggaatgctgcaacattttaatttt

SEQ ID NO: 626833 - DNA, 25 bp, Mus musculus
gggaatgctgcatcattttaatttt

SEQ ID NO: 626834 - DNA, 25 bp, Mus musculus
gggaatgctgctccctggccgacat

SEQ ID NO: 626835 - DNA, 25 bp, Mus musculus
gggaatgctgctgcctggccgacat

SEQ ID NO: 626836 - DNA, 25 bp, Mus musculus
gggaatgctggacgcatgcaccacc

SEQ ID NO: 626837 - DNA, 25 bp, Mus musculus
gggaatgctggaggcatgcaccacc

SEQ ID NO: 626838 - DNA, 25 bp, Mus musculus
gggaatgctgttaggaagttagtaa

SEQ ID NO: 626839 - DNA, 25 bp, Mus musculus
gggaatgctgtttggaagttagtaa

SEQ ID NO: 626840 - DNA, 25 bp, Mus musculus
gggaatgcttctatacttcttcacc

SEQ ID NO: 626841 - DNA, 25 bp, Mus musculus
gggaatgcttctttacttcttcacc

SEQ ID NO: 626842 - DNA, 25 bp, Mus musculus
gggaatgctttactaaccatttggt

SEQ ID NO: 626843 - DNA, 25 bp, Mus musculus
gggaatgctttagtaaccatttggt

SEQ ID NO: 626844 - DNA, 25 bp, Mus musculus
gggaatgcttttatgtttacattaa

SEQ ID NO: 626845 - DNA, 25 bp, Mus musculus
gggaatgcttttttgtttacattaa

SEQ ID NO: 626846 - DNA, 25 bp, Mus musculus
gggaatggaagaacctggcctctaa

SEQ ID NO: 626847 - DNA, 25 bp, Mus musculus
gggaatggaagatcctggcctctaa

SEQ ID NO: 626848 - DNA, 25 bp, Mus musculus
gggaatggattgacgaaatctgaaa

SEQ ID NO: 626849 - DNA, 25 bp, Mus musculus
gggaatggattgtcgaaatctgaaa

SEQ ID NO: 626850 - DNA, 25 bp, Mus musculus
gggaatggcagcatgtgcctgtaat

SEQ ID NO: 626851 - DNA, 25 bp, Mus musculus
gggaatggcagccttgtctcccagc

SEQ ID NO: 626852 - DNA, 25 bp, Mus musculus
gggaatggcagcgttgtctcccagc

SEQ ID NO: 626853 - DNA, 25 bp, Mus musculus
gggaatggcagcttgtgcctgtaat

SEQ ID NO: 626854 - DNA, 25 bp, Mus musculus
gggaatggcattaacaccctgcata

SEQ ID NO: 626855 - DNA, 25 bp, Mus musculus
gggaatggcatttacaccctgcata

SEQ ID NO: 626856 - DNA, 25 bp, Mus musculus
gggaatggccaaacagcctgtaaca

SEQ ID NO: 626857 - DNA, 25 bp, Mus musculus
gggaatggccaatcagcctgtaaca

SEQ ID NO: 626858 - DNA, 25 bp, Mus musculus
gggaatggccctcatcgtgaaaact

SEQ ID NO: 626859 - DNA, 25 bp, Mus musculus
gggaatggccctgatcgtgaaaact

SEQ ID NO: 626860 - DNA, 25 bp, Mus musculus
gggaatggccgacattttcattgga

SEQ ID NO: 626861 - DNA, 25 bp, Mus musculus
gggaatggccgagattttcattgga

SEQ ID NO: 626862 - DNA, 25 bp, Mus musculus
gggaatggcttcattcattcagaag

SEQ ID NO: 626863 - DNA, 25 bp, Mus musculus
gggaatggcttctttcattcagaag

SEQ ID NO: 626864 - DNA, 25 bp, Mus musculus
gggaatgggcccagctttttgtggc

SEQ ID NO: 626865 - DNA, 25 bp, Mus musculus
gggaatgggccctgctttttgtggc

SEQ ID NO: 626866 - DNA, 25 bp, Mus musculus
gggaatgtattcagctccagttgtt

SEQ ID NO: 626867 - DNA, 25 bp, Mus musculus
gggaatgtattctgctccagttgtt

SEQ ID NO: 626868 - DNA, 25 bp, Mus musculus
gggaatgtattgcacctgtactaaa

SEQ ID NO: 626869 - DNA, 25 bp, Mus musculus
gggaatgtattggacctgtactaaa

SEQ ID NO: 626870 - DNA, 25 bp, Mus musculus
gggaatgtcaccagcgtcttattgc

SEQ ID NO: 626871 - DNA, 25 bp, Mus musculus
gggaatgtcacctgcgtcttattgc

SEQ ID NO: 626872 - DNA, 25 bp, Mus musculus
gggaatgtcactactactgccattg

SEQ ID NO: 626873 - DNA, 25 bp, Mus musculus
gggaatgtcacttctactgccattg

SEQ ID NO: 626874 - DNA, 25 bp, Mus musculus
gggaatgtctatcaacttcagaagc

SEQ ID NO: 626875 - DNA, 25 bp, Mus musculus
gggaatgtctatgaacttcagaagc

SEQ ID NO: 626876 - DNA, 25 bp, Mus musculus
gggaatgtcttcagggcagttcaca

SEQ ID NO: 626877 - DNA, 25 bp, Mus musculus
gggaatgtcttcatgtaccattaaa

SEQ ID NO: 626878 - DNA, 25 bp, Mus musculus
gggaatgtcttctgggcagttcaca

SEQ ID NO: 626879 - DNA, 25 bp, Mus musculus
gggaatgtcttcttgtaccattaaa

SEQ ID NO: 626880 - DNA, 25 bp, Mus musculus
gggaatgtgaagacgcctgcttcga

SEQ ID NO: 626881 - DNA, 25 bp, Mus musculus
gggaatgtgaagtcgcctgcttcga

SEQ ID NO: 626882 - DNA, 25 bp, Mus musculus
gggaatgtgtccacatcactttaat

SEQ ID NO: 626883 - DNA, 25 bp, Mus musculus
gggaatgtgtcctcatcactttaat

SEQ ID NO: 626884 - DNA, 25 bp, Mus musculus
gggaatgtgttcattatcagccgcc

SEQ ID NO: 626885 - DNA, 25 bp, Mus musculus
gggaatgtgttctttatcagccgcc

SEQ ID NO: 626886 - DNA, 25 bp, Mus musculus
gggaatgttagcctctgtaattgta

SEQ ID NO: 626887 - DNA, 25 bp, Mus musculus
gggaatgttagcgtctgtaattgta

SEQ ID NO: 626888 - DNA, 25 bp, Mus musculus
gggaatgttatgatcctgccacata

SEQ ID NO: 626889 - DNA, 25 bp, Mus musculus
gggaatgttatgttcctgccacata

SEQ ID NO: 626890 - DNA, 25 bp, Mus musculus
gggaatgttggacttcatatcagat

SEQ ID NO: 626891 - DNA, 25 bp, Mus musculus
gggaatgttggagttcatatcagat

SEQ ID NO: 626892 - DNA, 25 bp, Mus musculus
gggaatgtttatcctttcatgtatt

SEQ ID NO: 626893 - DNA, 25 bp, Mus musculus
gggaatgtttatctacccctgcaca

SEQ ID NO: 626894 - DNA, 25 bp, Mus musculus
gggaatgtttatgctttcatgtatt

SEQ ID NO: 626895 - DNA, 25 bp, Mus musculus
gggaatgtttatgtacccctgcaca

SEQ ID NO: 626896 - DNA, 25 bp, Mus musculus
gggaatgtttccctgagattaaaga

SEQ ID NO: 626897 - DNA, 25 bp, Mus musculus
gggaatgtttccgtgagattaaaga

SEQ ID NO: 626898 - DNA, 25 bp, Mus musculus
gggaatgttttgagcacacttaaat

SEQ ID NO: 626899 - DNA, 25 bp, Mus musculus
gggaatgttttgtgcacacttaaat

SEQ ID NO: 626900 - DNA, 25 bp, Mus musculus
gggaattaaatacagatcctctgga

SEQ ID NO: 626901 - DNA, 25 bp, Mus musculus
gggaattaaatagagatcctctgga

SEQ ID NO: 626902 - DNA, 25 bp, Mus musculus
gggaattaacccaagtgctgtgcta

SEQ ID NO: 626903 - DNA, 25 bp, Mus musculus
gggaattaaccctagtgctgtgcta

SEQ ID NO: 626904 - DNA, 25 bp, Mus musculus
gggaattaatgcatcttgctgcttc

SEQ ID NO: 626905 - DNA, 25 bp, Mus musculus
gggaattaatgcttcttgctgcttc

SEQ ID NO: 626906 - DNA, 25 bp, Mus musculus
gggaattacactaggcactcagggt

SEQ ID NO: 626907 - DNA, 25 bp, Mus musculus
gggaattacacttggcactcagggt

SEQ ID NO: 626908 - DNA, 25 bp, Mus musculus
gggaattacagacaacataccattt

SEQ ID NO: 626909 - DNA, 25 bp, Mus musculus
gggaattacagagaacataccattt

SEQ ID NO: 626910 - DNA, 25 bp, Mus musculus
gggaattacctgaaaggcatctaaa

SEQ ID NO: 626911 - DNA, 25 bp, Mus musculus
gggaattacctgtaaggcatctaaa

SEQ ID NO: 626912 - DNA, 25 bp, Mus musculus
gggaattactacaggagaaatgatc

SEQ ID NO: 626913 - DNA, 25 bp, Mus musculus
gggaattactactggagaaatgatc

SEQ ID NO: 626914 - DNA, 25 bp, Mus musculus
gggaattactccagcggcatgcaca

SEQ ID NO: 626915 - DNA, 25 bp, Mus musculus
gggaattactcctgcggcatgcaca

SEQ ID NO: 626916 - DNA, 25 bp, Mus musculus
gggaattactttactcatccaggag

SEQ ID NO: 626917 - DNA, 25 bp, Mus musculus
gggaattacttttctcatccaggag

SEQ ID NO: 626918 - DNA, 25 bp, Mus musculus
gggaattagccaacatttctctctc

SEQ ID NO: 626919 - DNA, 25 bp, Mus musculus
gggaattagccatcatttctctctc

SEQ ID NO: 626920 - DNA, 25 bp, Mus musculus
gggaattatctcaattcgaccctga

SEQ ID NO: 626921 - DNA, 25 bp, Mus musculus
gggaattatctctattcgaccctga

SEQ ID NO: 626922 - DNA, 25 bp, Mus musculus
gggaattattcaattctggttgtct

SEQ ID NO: 626923 - DNA, 25 bp, Mus musculus
gggaattattcatttctggttgtct

SEQ ID NO: 626924 - DNA, 25 bp, Mus musculus
gggaattatttacctgcctgcacaa

SEQ ID NO: 626925 - DNA, 25 bp, Mus musculus
gggaattatttagctgcctgcacaa

SEQ ID NO: 626926 - DNA, 25 bp, Mus musculus
gggaattcaagcattctgacccaga

SEQ ID NO: 626927 - DNA, 25 bp, Mus musculus
gggaattcaagctttctgacccaga

SEQ ID NO: 626928 - DNA, 25 bp, Mus musculus
gggaattcacctaaccagaatccta

SEQ ID NO: 626929 - DNA, 25 bp, Mus musculus
gggaattcacctagctgtcagggaa

SEQ ID NO: 626930 - DNA, 25 bp, Mus musculus
gggaattcaccttaccagaatccta

SEQ ID NO: 626931 - DNA, 25 bp, Mus musculus
gggaattcaccttgctgtcagggaa

SEQ ID NO: 626932 - DNA, 25 bp, Mus musculus
gggaattcagccaggagctctcctc

SEQ ID NO: 626933 - DNA, 25 bp, Mus musculus
gggaattcagcctggagctctcctc

SEQ ID NO: 626934 - DNA, 25 bp, Mus musculus
gggaattcattgaggcaacatcatc

SEQ ID NO: 626935 - DNA, 25 bp, Mus musculus
gggaattcattgtggcaacatcatc

SEQ ID NO: 626936 - DNA, 25 bp, Mus musculus
gggaattccagaatccacgctccat

SEQ ID NO: 626937 - DNA, 25 bp, Mus musculus
gggaattccagattccacgctccat

SEQ ID NO: 626938 - DNA, 25 bp, Mus musculus
gggaattccaggcttagtccattga

SEQ ID NO: 626939 - DNA, 25 bp, Mus musculus
gggaattccagggttagtccattga

SEQ ID NO: 626940 - DNA, 25 bp, Mus musculus
gggaattccatcacttgcatatttg

SEQ ID NO: 626941 - DNA, 25 bp, Mus musculus
gggaattccatctcttgcatatttg

SEQ ID NO: 626942 - DNA, 25 bp, Mus musculus
gggaattccatgaactttgtgaacc

SEQ ID NO: 626943 - DNA, 25 bp, Mus musculus
gggaattccatgtactttgtgaacc

SEQ ID NO: 626944 - DNA, 25 bp, Mus musculus
gggaattcccaaaaacactgcacga

SEQ ID NO: 626945 - DNA, 25 bp, Mus musculus
gggaattcccaataacactgcacga

SEQ ID NO: 626946 - DNA, 25 bp, Mus musculus
gggaattcccgaagagctgtctgag

SEQ ID NO: 626947 - DNA, 25 bp, Mus musculus
gggaattcccgatgagctgtctgag

SEQ ID NO: 626948 - DNA, 25 bp, Mus musculus
gggaattccctcagcaggatctagc

SEQ ID NO: 626949 - DNA, 25 bp, Mus musculus
gggaattccctctgcaggatctagc

SEQ ID NO: 626950 - DNA, 25 bp, Mus musculus
gggaattcctcaaggcttttcatga

SEQ ID NO: 626951 - DNA, 25 bp, Mus musculus
gggaattcctcatggcttttcatga

SEQ ID NO: 626952 - DNA, 25 bp, Mus musculus
gggaattcgaagactgtccgcggat

SEQ ID NO: 626953 - DNA, 25 bp, Mus musculus
gggaattcgaagtctgtccgcggat

SEQ ID NO: 626954 - DNA, 25 bp, Mus musculus
gggaattctcggagctatagccttt

SEQ ID NO: 626955 - DNA, 25 bp, Mus musculus
gggaattctcggtgctatagccttt

SEQ ID NO: 626956 - DNA, 25 bp, Mus musculus
gggaattctctgatgcacgttattc

SEQ ID NO: 626957 - DNA, 25 bp, Mus musculus
gggaattctctgcatttgtctgtac

SEQ ID NO: 626958 - DNA, 25 bp, Mus musculus
gggaattctctggatttgtctgtac

SEQ ID NO: 626959 - DNA, 25 bp, Mus musculus
gggaattctctgttgcacgttattc

SEQ ID NO: 626960 - DNA, 25 bp, Mus musculus
gggaattctgagagacctgcctgtc

SEQ ID NO: 626961 - DNA, 25 bp, Mus musculus
gggaattctgagtgacctgcctgtc

SEQ ID NO: 626962 - DNA, 25 bp, Mus musculus
gggaattgcaatccgggttgcttcc

SEQ ID NO: 626963 - DNA, 25 bp, Mus musculus
gggaattgcaatgcgggttgcttcc

SEQ ID NO: 626964 - DNA, 25 bp, Mus musculus
gggaattgcccaattggtctgcata

SEQ ID NO: 626965 - DNA, 25 bp, Mus musculus
gggaattgcccatttggtctgcata

SEQ ID NO: 626966 - DNA, 25 bp, Mus musculus
gggaattgcctcacaaacagcgttg

SEQ ID NO: 626967 - DNA, 25 bp, Mus musculus
gggaattgcctctcaaacagcgttg

SEQ ID NO: 626968 - DNA, 25 bp, Mus musculus
gggaattgctgtcctgtgcagtaca

SEQ ID NO: 626969 - DNA, 25 bp, Mus musculus
gggaattgctgtgctgtgcagtaca

SEQ ID NO: 626970 - DNA, 25 bp, Mus musculus
gggaattgggaaccctctgacccgc

SEQ ID NO: 626971 - DNA, 25 bp, Mus musculus
gggaattgggaagcctctgacccgc

SEQ ID NO: 626972 - DNA, 25 bp, Mus musculus
gggaattgtcccaaatttagccagg

SEQ ID NO: 626973 - DNA, 25 bp, Mus musculus
gggaattgtccctaatttagccagg

SEQ ID NO: 626974 - DNA, 25 bp, Mus musculus
gggaattgttctataggctctgctt

SEQ ID NO: 626975 - DNA, 25 bp, Mus musculus
gggaattgttctttaggctctgctt

SEQ ID NO: 626976 - DNA, 25 bp, Mus musculus
gggaattgttttacagctcttcagt

SEQ ID NO: 626977 - DNA, 25 bp, Mus musculus
gggaattgtttttcagctcttcagt

SEQ ID NO: 626978 - DNA, 25 bp, Mus musculus
gggaatttcactaagttctcctatt

SEQ ID NO: 626979 - DNA, 25 bp, Mus musculus
gggaatttcacttagttctcctatt

SEQ ID NO: 626980 - DNA, 25 bp, Mus musculus
gggaatttccatatcactgaagata

SEQ ID NO: 626981 - DNA, 25 bp, Mus musculus
gggaatttccatttcactgaagata

SEQ ID NO: 626982 - DNA, 25 bp, Mus musculus
gggaatttgactcagttttgcctag

SEQ ID NO: 626983 - DNA, 25 bp, Mus musculus
gggaatttgactgagttttgcctag

SEQ ID NO: 626984 - DNA, 25 bp, Mus musculus
gggaatttgcacaattacacttgaa

SEQ ID NO: 626985 - DNA, 25 bp, Mus musculus
gggaatttgcactattacacttgaa

SEQ ID NO: 626986 - DNA, 25 bp, Mus musculus
gggaatttgcatcgatgtttaccga

SEQ ID NO: 626987 - DNA, 25 bp, Mus musculus
gggaatttgcatggatgtttaccga

SEQ ID NO: 626988 - DNA, 25 bp, Mus musculus
gggaatttgtgcattttagcccaag

SEQ ID NO: 626989 - DNA, 25 bp, Mus musculus
gggaatttgtgctttttagcccaag

SEQ ID NO: 626990 - DNA, 25 bp, Mus musculus
gggaattttactagcctttgatact

SEQ ID NO: 626991 - DNA, 25 bp, Mus musculus
gggaattttacttgcctttgatact

SEQ ID NO: 626992 - DNA, 25 bp, Mus musculus
gggaattttaggctctactgactga

SEQ ID NO: 626993 - DNA, 25 bp, Mus musculus
gggaattttagggtctactgactga

SEQ ID NO: 626994 - DNA, 25 bp, Mus musculus
gggaattttattctgttatcacacc

SEQ ID NO: 626995 - DNA, 25 bp, Mus musculus
gggaattttattgtgttatcacacc

SEQ ID NO: 626996 - DNA, 25 bp, Mus musculus
gggaattttccacgtagaatcgcca

SEQ ID NO: 626997 - DNA, 25 bp, Mus musculus
gggaattttccaggtagaatcgcca

SEQ ID NO: 626998 - DNA, 25 bp, Mus musculus
gggaattttcccataaagcatagaa

SEQ ID NO: 626999 - DNA, 25 bp, Mus musculus
gggaattttcccttaaagcatagaa

SEQ ID NO: 627000 - DNA, 25 bp, Mus musculus
gggaattttgccaccactaaatgat

SEQ ID NO: 627001 - DNA, 25 bp, Mus musculus
gggaattttgcctccactaaatgat

SEQ ID NO: 627002 - DNA, 25 bp, Mus musculus
gggacaaaaaggagcccggctgcct

SEQ ID NO: 627003 - DNA, 25 bp, Mus musculus
gggacaaaaaggtgcccggctgcct

SEQ ID NO: 627004 - DNA, 25 bp, Mus musculus
gggacaaaaatccacactcactcct

SEQ ID NO: 627005 - DNA, 25 bp, Mus musculus
gggacaaaaatcgacactcactcct

SEQ ID NO: 627006 - DNA, 25 bp, Mus musculus
gggacaaaacccacctagcatacga

SEQ ID NO: 627007 - DNA, 25 bp, Mus musculus
gggacaaaaccctcctagcatacga

SEQ ID NO: 627008 - DNA, 25 bp, Mus musculus
gggacaaaatgtcaagactcaccta

SEQ ID NO: 627009 - DNA, 25 bp, Mus musculus
gggacaaaatgtcctccatggtcaa

SEQ ID NO: 627010 - DNA, 25 bp, Mus musculus
gggacaaaatgtgaagactcaccta

SEQ ID NO: 627011 - DNA, 25 bp, Mus musculus
gggacaaaatgtgctccatggtcaa

SEQ ID NO: 627012 - DNA, 25 bp, Mus musculus
gggacaaacactcgtgtaccgacat

SEQ ID NO: 627013 - DNA, 25 bp, Mus musculus
gggacaaacactggtgtaccgacat

SEQ ID NO: 627014 - DNA, 25 bp, Mus musculus
gggacaaactcacttggtgtatgtt

SEQ ID NO: 627015 - DNA, 25 bp, Mus musculus
gggacaaactcagttggtgtatgtt

SEQ ID NO: 627016 - DNA, 25 bp, Mus musculus
gggacaaagccacatgtatggacaa

SEQ ID NO: 627017 - DNA, 25 bp, Mus musculus
gggacaaagccacttcatccagaag

SEQ ID NO: 627018 - DNA, 25 bp, Mus musculus
gggacaaagccagatgtatggacaa

SEQ ID NO: 627019 - DNA, 25 bp, Mus musculus
gggacaaagccagttcatccagaag

SEQ ID NO: 627020 - DNA, 25 bp, Mus musculus
gggacaaagcccacggagctcatct

SEQ ID NO: 627021 - DNA, 25 bp, Mus musculus
gggacaaagccctcggagctcatct

SEQ ID NO: 627022 - DNA, 25 bp, Mus musculus
gggacaaagcttcttggtaacattt

SEQ ID NO: 627023 - DNA, 25 bp, Mus musculus
gggacaaagcttgttggtaacattt

SEQ ID NO: 627024 - DNA, 25 bp, Mus musculus
gggacaaaggccacctgtccctgag

SEQ ID NO: 627025 - DNA, 25 bp, Mus musculus
gggacaaaggcctcctgtccctgag

SEQ ID NO: 627026 - DNA, 25 bp, Mus musculus
gggacaaaggttcctccagggatct

SEQ ID NO: 627027 - DNA, 25 bp, Mus musculus
gggacaaaggttgctccagggatct

SEQ ID NO: 627028 - DNA, 25 bp, Mus musculus
gggacaaatctgagccatcacttca

SEQ ID NO: 627029 - DNA, 25 bp, Mus musculus
gggacaaatctgtgccatcacttca

SEQ ID NO: 627030 - DNA, 25 bp, Mus musculus
gggacaaatggtaatctctactttt

SEQ ID NO: 627031 - DNA, 25 bp, Mus musculus
gggacaaatggttatctctactttt

SEQ ID NO: 627032 - DNA, 25 bp, Mus musculus
gggacaaatgtcatcatcctgacct

SEQ ID NO: 627033 - DNA, 25 bp, Mus musculus
gggacaaatgtcttcatcctgacct

SEQ ID NO: 627034 - DNA, 25 bp, Mus musculus
gggacaaattcacaccagctacctg

SEQ ID NO: 627035 - DNA, 25 bp, Mus musculus
gggacaaattcagaccagctacctg

SEQ ID NO: 627036 - DNA, 25 bp, Mus musculus
gggacaaattctcgattgattcaaa

SEQ ID NO: 627037 - DNA, 25 bp, Mus musculus
gggacaaattctggattgattcaaa

SEQ ID NO: 627038 - DNA, 25 bp, Mus musculus
gggacaacatttaatggcagtctta

SEQ ID NO: 627039 - DNA, 25 bp, Mus musculus
gggacaacatttatgaagaaccagt

SEQ ID NO: 627040 - DNA, 25 bp, Mus musculus
gggacaacattttatggcagtctta

SEQ ID NO: 627041 - DNA, 25 bp, Mus musculus
gggacaacatttttgaagaaccagt

SEQ ID NO: 627042 - DNA, 25 bp, Mus musculus
gggacaaccaataccgaaaagaatg

SEQ ID NO: 627043 - DNA, 25 bp, Mus musculus
gggacaaccaattccgaaaagaatg

SEQ ID NO: 627044 - DNA, 25 bp, Mus musculus
gggacaaccagtctcagagtgctct

SEQ ID NO: 627045 - DNA, 25 bp, Mus musculus
gggacaaccagtgtcagagtgctct

SEQ ID NO: 627046 - DNA, 25 bp, Mus musculus
gggacaacccaactcatttagtatt

SEQ ID NO: 627047 - DNA, 25 bp, Mus musculus
gggacaacccaagtcatttagtatt

SEQ ID NO: 627048 - DNA, 25 bp, Mus musculus
gggacaacccaccaggtggcttcaa

SEQ ID NO: 627049 - DNA, 25 bp, Mus musculus
gggacaacccacgaggtggcttcaa

SEQ ID NO: 627050 - DNA, 25 bp, Mus musculus
gggacaaccccaaggagacgatgat

SEQ ID NO: 627051 - DNA, 25 bp, Mus musculus
gggacaaccccatggagacgatgat

SEQ ID NO: 627052 - DNA, 25 bp, Mus musculus
gggacaaccctcagcatcacatgga

SEQ ID NO: 627053 - DNA, 25 bp, Mus musculus
gggacaaccctcatctgcaacctgt

SEQ ID NO: 627054 - DNA, 25 bp, Mus musculus
gggacaaccctctgcatcacatgga

SEQ ID NO: 627055 - DNA, 25 bp, Mus musculus
gggacaaccctcttctgcaacctgt

SEQ ID NO: 627056 - DNA, 25 bp, Mus musculus
gggacaacctaaaaacatcacgagc

SEQ ID NO: 627057 - DNA, 25 bp, Mus musculus
gggacaacctaataacatcacgagc

SEQ ID NO: 627058 - DNA, 25 bp, Mus musculus
gggacaacctcaagtacagcagcaa

SEQ ID NO: 627059 - DNA, 25 bp, Mus musculus
gggacaacctcatgtacagcagcaa

SEQ ID NO: 627060 - DNA, 25 bp, Mus musculus
gggacaacgtgtcgcctgactgctc

SEQ ID NO: 627061 - DNA, 25 bp, Mus musculus
gggacaacgtgtggcctgactgctc

SEQ ID NO: 627062 - DNA, 25 bp, Mus musculus
gggacaacgttaacatattcttggt

SEQ ID NO: 627063 - DNA, 25 bp, Mus musculus
gggacaacgttatcatattcttggt

SEQ ID NO: 627064 - DNA, 25 bp, Mus musculus
gggacaactgcaagtatcgccatgc

SEQ ID NO: 627065 - DNA, 25 bp, Mus musculus
gggacaactgcatgtatcgccatgc

SEQ ID NO: 627066 - DNA, 25 bp, Mus musculus
gggacaactttacaagtgcaaccag

SEQ ID NO: 627067 - DNA, 25 bp, Mus musculus
gggacaactttagaagtgcaaccag

SEQ ID NO: 627068 - DNA, 25 bp, Mus musculus
gggacaagacatctatctaacgcaa

SEQ ID NO: 627069 - DNA, 25 bp, Mus musculus
gggacaagacatgtatctaacgcaa

SEQ ID NO: 627070 - DNA, 25 bp, Mus musculus
gggacaagacccacaggctgatttc

SEQ ID NO: 627071 - DNA, 25 bp, Mus musculus
gggacaagaccctcaggctgatttc

SEQ ID NO: 627072 - DNA, 25 bp, Mus musculus
gggacaagaccgcatcctggctttg

SEQ ID NO: 627073 - DNA, 25 bp, Mus musculus
gggacaagaccggatcctggctttg

SEQ ID NO: 627074 - DNA, 25 bp, Mus musculus
gggacaagactgagtatgtgaagta

SEQ ID NO: 627075 - DNA, 25 bp, Mus musculus
gggacaagactgtgtatgtgaagta

SEQ ID NO: 627076 - DNA, 25 bp, Mus musculus
gggacaagagcaatgtgttccttcc

SEQ ID NO: 627077 - DNA, 25 bp, Mus musculus
gggacaagagcattgtgttccttcc

SEQ ID NO: 627078 - DNA, 25 bp, Mus musculus
gggacaagagcccagcctcattaaa

SEQ ID NO: 627079 - DNA, 25 bp, Mus musculus
gggacaagagccgagcctcattaaa

SEQ ID NO: 627080 - DNA, 25 bp, Mus musculus
gggacaagagctacctcaaacacaa

SEQ ID NO: 627081 - DNA, 25 bp, Mus musculus
gggacaagagcttcctcaaacacaa

SEQ ID NO: 627082 - DNA, 25 bp, Mus musculus
gggacaagatctacgtgcagttgca

SEQ ID NO: 627083 - DNA, 25 bp, Mus musculus
gggacaagatcttcgtgcagttgca

SEQ ID NO: 627084 - DNA, 25 bp, Mus musculus
gggacaagcaaacaggcccctgtgc

SEQ ID NO: 627085 - DNA, 25 bp, Mus musculus
gggacaagcaaagaggcccctgtgc

SEQ ID NO: 627086 - DNA, 25 bp, Mus musculus
gggacaagcccgagccatacagtgg

SEQ ID NO: 627087 - DNA, 25 bp, Mus musculus
gggacaagcccgtgccatacagtgg

SEQ ID NO: 627088 - DNA, 25 bp, Mus musculus
gggacaagcttacagttaggtgacc

SEQ ID NO: 627089 - DNA, 25 bp, Mus musculus
gggacaagcttagagttaggtgacc

SEQ ID NO: 627090 - DNA, 25 bp, Mus musculus
gggacaaggaagcaacacatcagtt

SEQ ID NO: 627091 - DNA, 25 bp, Mus musculus
gggacaaggaaggaacacatcagtt

SEQ ID NO: 627092 - DNA, 25 bp, Mus musculus
gggacaaggattccttctttccctg

SEQ ID NO: 627093 - DNA, 25 bp, Mus musculus
gggacaaggattgcttctttccctg

SEQ ID NO: 627094 - DNA, 25 bp, Mus musculus
gggacaagggcaagcataaaacagc

SEQ ID NO: 627095 - DNA, 25 bp, Mus musculus
gggacaagggcatgcataaaacagc

SEQ ID NO: 627096 - DNA, 25 bp, Mus musculus
gggacaagttcaactgatatctaac

SEQ ID NO: 627097 - DNA, 25 bp, Mus musculus
gggacaagttcatctgatatctaac

SEQ ID NO: 627098 - DNA, 25 bp, Mus musculus
gggacaataatcatgtttacttcct

SEQ ID NO: 627099 - DNA, 25 bp, Mus musculus
gggacaataatcttgtttacttcct

SEQ ID NO: 627100 - DNA, 25 bp, Mus musculus
gggacaataccaatttctctgccat

SEQ ID NO: 627101 - DNA, 25 bp, Mus musculus
gggacaataccattttctctgccat

SEQ ID NO: 627102 - DNA, 25 bp, Mus musculus
gggacaatatcccagatgccgtcag

SEQ ID NO: 627103 - DNA, 25 bp, Mus musculus
gggacaatatccgagatgccgtcag

SEQ ID NO: 627104 - DNA, 25 bp, Mus musculus
gggacaatatctcacctgcatgtga

SEQ ID NO: 627105 - DNA, 25 bp, Mus musculus
gggacaatatctgacctgcatgtga

SEQ ID NO: 627106 - DNA, 25 bp, Mus musculus
gggacaatattgaattcaactgttt

SEQ ID NO: 627107 - DNA, 25 bp, Mus musculus
gggacaatattgtattcaactgttt

SEQ ID NO: 627108 - DNA, 25 bp, Mus musculus
gggacaatcactatgctccacctgt

SEQ ID NO: 627109 - DNA, 25 bp, Mus musculus
gggacaatcactttgctccacctgt

SEQ ID NO: 627110 - DNA, 25 bp, Mus musculus
gggacaatccacatttctactgcct

SEQ ID NO: 627111 - DNA, 25 bp, Mus musculus
gggacaatccacttttctactgcct

SEQ ID NO: 627112 - DNA, 25 bp, Mus musculus
gggacaatctacatactaggcattc

SEQ ID NO: 627113 - DNA, 25 bp, Mus musculus
gggacaatctacttactaggcattc

SEQ ID NO: 627114 - DNA, 25 bp, Mus musculus
gggacaatctgcatgatggcccaga

SEQ ID NO: 627115 - DNA, 25 bp, Mus musculus
gggacaatctgcttgatggcccaga

SEQ ID NO: 627116 - DNA, 25 bp, Mus musculus
gggacaatcttcatagcacatgagt

SEQ ID NO: 627117 - DNA, 25 bp, Mus musculus
gggacaatcttcttagcacatgagt

SEQ ID NO: 627118 - DNA, 25 bp, Mus musculus
gggacaatgttcaatacctggccca

SEQ ID NO: 627119 - DNA, 25 bp, Mus musculus
gggacaatgttctatacctggccca

SEQ ID NO: 627120 - DNA, 25 bp, Mus musculus
gggacaatgttgagcatggccttca

SEQ ID NO: 627121 - DNA, 25 bp, Mus musculus
gggacaatgttgtgcatggccttca

SEQ ID NO: 627122 - DNA, 25 bp, Mus musculus
gggacaattctcaatctaaccacat

SEQ ID NO: 627123 - DNA, 25 bp, Mus musculus
gggacaattctctatctaaccacat

SEQ ID NO: 627124 - DNA, 25 bp, Mus musculus
gggacacaaaacaaggccttgccct

SEQ ID NO: 627125 - DNA, 25 bp, Mus musculus
gggacacaaaactaggccttgccct

SEQ ID NO: 627126 - DNA, 25 bp, Mus musculus
gggacacaagggatggcctttccat

SEQ ID NO: 627127 - DNA, 25 bp, Mus musculus
gggacacaagggttggcctttccat

SEQ ID NO: 627128 - DNA, 25 bp, Mus musculus
gggacacacacacaaggttagccaa

SEQ ID NO: 627129 - DNA, 25 bp, Mus musculus
gggacacacacagaaggttagccaa

SEQ ID NO: 627130 - DNA, 25 bp, Mus musculus
gggacacacattcacgtcatctcgt

SEQ ID NO: 627131 - DNA, 25 bp, Mus musculus
gggacacacattgacgtcatctcgt

SEQ ID NO: 627132 - DNA, 25 bp, Mus musculus
gggacacaccacctaggactgagga

SEQ ID NO: 627133 - DNA, 25 bp, Mus musculus
gggacacaccacgtaggactgagga

SEQ ID NO: 627134 - DNA, 25 bp, Mus musculus
gggacacacccaacagataagccat

SEQ ID NO: 627135 - DNA, 25 bp, Mus musculus
gggacacacccatcagataagccat

SEQ ID NO: 627136 - DNA, 25 bp, Mus musculus
gggacacaccctcatagcacaatct

SEQ ID NO: 627137 - DNA, 25 bp, Mus musculus
gggacacaccctgatagcacaatct

SEQ ID NO: 627138 - DNA, 25 bp, Mus musculus
gggacacacggtaccttcaaagtag

SEQ ID NO: 627139 - DNA, 25 bp, Mus musculus
gggacacacggttccttcaaagtag

SEQ ID NO: 627140 - DNA, 25 bp, Mus musculus
gggacacactcaccgccaagtttgg

SEQ ID NO: 627141 - DNA, 25 bp, Mus musculus
gggacacactcagcgccaagtttgg

SEQ ID NO: 627142 - DNA, 25 bp, Mus musculus
gggacacactgtaacacactgcagt

SEQ ID NO: 627143 - DNA, 25 bp, Mus musculus
gggacacactgttacacactgcagt

SEQ ID NO: 627144 - DNA, 25 bp, Mus musculus
gggacacacttcagggtcaccacct

SEQ ID NO: 627145 - DNA, 25 bp, Mus musculus
gggacacacttcatttgtatgggac

SEQ ID NO: 627146 - DNA, 25 bp, Mus musculus
gggacacacttctgggtcaccacct

SEQ ID NO: 627147 - DNA, 25 bp, Mus musculus
gggacacacttcttttgtatgggac

SEQ ID NO: 627148 - DNA, 25 bp, Mus musculus
gggacacagaaactgctttcttcaa

SEQ ID NO: 627149 - DNA, 25 bp, Mus musculus
gggacacagaaagtgctttcttcaa

SEQ ID NO: 627150 - DNA, 25 bp, Mus musculus
gggacacagactctctcaataggac

SEQ ID NO: 627151 - DNA, 25 bp, Mus musculus
gggacacagactgtctcaataggac

SEQ ID NO: 627152 - DNA, 25 bp, Mus musculus
gggacacagcacaacctggatggct

SEQ ID NO: 627153 - DNA, 25 bp, Mus musculus
gggacacagcactacctggatggct

SEQ ID NO: 627154 - DNA, 25 bp, Mus musculus
gggacacagcatacagatcaaaaca

SEQ ID NO: 627155 - DNA, 25 bp, Mus musculus
gggacacagcattcagatcaaaaca

SEQ ID NO: 627156 - DNA, 25 bp, Mus musculus
gggacacagccactacttgtctagt

SEQ ID NO: 627157 - DNA, 25 bp, Mus musculus
gggacacagccagtacttgtctagt

SEQ ID NO: 627158 - DNA, 25 bp, Mus musculus
gggacacagcttcggacacagtctc

SEQ ID NO: 627159 - DNA, 25 bp, Mus musculus
gggacacagcttgggacacagtctc

SEQ ID NO: 627160 - DNA, 25 bp, Mus musculus
gggacacaggaacctcctaatctag

SEQ ID NO: 627161 - DNA, 25 bp, Mus musculus
gggacacaggaagctcctaatctag

SEQ ID NO: 627162 - DNA, 25 bp, Mus musculus
gggacacaggcaccgctctgagata

SEQ ID NO: 627163 - DNA, 25 bp, Mus musculus
gggacacaggcagcgctctgagata

SEQ ID NO: 627164 - DNA, 25 bp, Mus musculus
gggacacagggtacatcccaggcat

SEQ ID NO: 627165 - DNA, 25 bp, Mus musculus
gggacacagggttcatcccaggcat

SEQ ID NO: 627166 - DNA, 25 bp, Mus musculus
gggacacagtcaagccgcagagcca

SEQ ID NO: 627167 - DNA, 25 bp, Mus musculus
gggacacagtcaccaccagtttgag

SEQ ID NO: 627168 - DNA, 25 bp, Mus musculus
gggacacagtcagcaccagtttgag

SEQ ID NO: 627169 - DNA, 25 bp, Mus musculus
gggacacagtcatgccgcagagcca

SEQ ID NO: 627170 - DNA, 25 bp, Mus musculus
gggacacataccaatacatatcatt

SEQ ID NO: 627171 - DNA, 25 bp, Mus musculus
gggacacatacctatacatatcatt

SEQ ID NO: 627172 - DNA, 25 bp, Mus musculus
gggacacatatccatggatggtaga

SEQ ID NO: 627173 - DNA, 25 bp, Mus musculus
gggacacatatcgatggatggtaga

SEQ ID NO: 627174 - DNA, 25 bp, Mus musculus
gggacacatgacatctatgcaactg

SEQ ID NO: 627175 - DNA, 25 bp, Mus musculus
gggacacatgacttctatgcaactg

SEQ ID NO: 627176 - DNA, 25 bp, Mus musculus
gggacacatgctcaccacgcagaga

SEQ ID NO: 627177 - DNA, 25 bp, Mus musculus
gggacacatgctgaccacgcagaga

SEQ ID NO: 627178 - DNA, 25 bp, Mus musculus
gggacacattacacccaggactctc

SEQ ID NO: 627179 - DNA, 25 bp, Mus musculus
gggacacattactcccaggactctc

SEQ ID NO: 627180 - DNA, 25 bp, Mus musculus
gggacacattcaaactggagccgat

SEQ ID NO: 627181 - DNA, 25 bp, Mus musculus
gggacacattcatactggagccgat

SEQ ID NO: 627182 - DNA, 25 bp, Mus musculus
gggacacattcgacaattctgagaa

SEQ ID NO: 627183 - DNA, 25 bp, Mus musculus
gggacacattcgtcaattctgagaa

SEQ ID NO: 627184 - DNA, 25 bp, Mus musculus
gggacacatttaactgactatctat

SEQ ID NO: 627185 - DNA, 25 bp, Mus musculus
gggacacatttatctgactatctat

SEQ ID NO: 627186 - DNA, 25 bp, Mus musculus
gggacaccacagatgaggaccaagt

SEQ ID NO: 627187 - DNA, 25 bp, Mus musculus
gggacaccacagttgaggaccaagt

SEQ ID NO: 627188 - DNA, 25 bp, Mus musculus
gggacaccacccagaaaaggagatt

SEQ ID NO: 627189 - DNA, 25 bp, Mus musculus
gggacaccaccctgaaaaggagatt

SEQ ID NO: 627190 - DNA, 25 bp, Mus musculus
gggacaccagagacacgtggctcag

SEQ ID NO: 627191 - DNA, 25 bp, Mus musculus
gggacaccagagtcacgtggctcag

SEQ ID NO: 627192 - DNA, 25 bp, Mus musculus
gggacaccagccacttctttagaca

SEQ ID NO: 627193 - DNA, 25 bp, Mus musculus
gggacaccagcctcttctttagaca

SEQ ID NO: 627194 - DNA, 25 bp, Mus musculus
gggacaccagcgattggacatccag

SEQ ID NO: 627195 - DNA, 25 bp, Mus musculus
gggacaccagcgtttggacatccag

SEQ ID NO: 627196 - DNA, 25 bp, Mus musculus
gggacaccagtgattgacattgcca

SEQ ID NO: 627197 - DNA, 25 bp, Mus musculus
gggacaccagtgtttgacattgcca

SEQ ID NO: 627198 - DNA, 25 bp, Mus musculus
gggacaccatcgacaatgtgcagca

SEQ ID NO: 627199 - DNA, 25 bp, Mus musculus
gggacaccatcgtcaatgtgcagca

SEQ ID NO: 627200 - DNA, 25 bp, Mus musculus
gggacaccattcaacaatgcccaga

SEQ ID NO: 627201 - DNA, 25 bp, Mus musculus
gggacaccattcaactttacaaggc

SEQ ID NO: 627202 - DNA, 25 bp, Mus musculus
gggacaccattctacaatgcccaga

SEQ ID NO: 627203 - DNA, 25 bp, Mus musculus
gggacaccattctactttacaaggc

SEQ ID NO: 627204 - DNA, 25 bp, Mus musculus
gggacacccaataacacagaggacg

SEQ ID NO: 627205 - DNA, 25 bp, Mus musculus
gggacacccaattacacagaggacg

SEQ ID NO: 627206 - DNA, 25 bp, Mus musculus
gggacacccagacacttctgagttt

SEQ ID NO: 627207 - DNA, 25 bp, Mus musculus
gggacacccagagacttctgagttt

SEQ ID NO: 627208 - DNA, 25 bp, Mus musculus
gggacacccaggcaaaggtcacatt

SEQ ID NO: 627209 - DNA, 25 bp, Mus musculus
gggacacccagggaaaggtcacatt

SEQ ID NO: 627210 - DNA, 25 bp, Mus musculus
gggacacccatcaatgtcactttat

SEQ ID NO: 627211 - DNA, 25 bp, Mus musculus
gggacacccatctatgtcactttat

SEQ ID NO: 627212 - DNA, 25 bp, Mus musculus
gggacacccattaaccagggccaca

SEQ ID NO: 627213 - DNA, 25 bp, Mus musculus
gggacacccatttaccagggccaca

SEQ ID NO: 627214 - DNA, 25 bp, Mus musculus
gggacaccccaaattctgtcagaag

SEQ ID NO: 627215 - DNA, 25 bp, Mus musculus
gggacaccccaatttctgtcagaag

SEQ ID NO: 627216 - DNA, 25 bp, Mus musculus
gggacacccctgcaacaaacattat

SEQ ID NO: 627217 - DNA, 25 bp, Mus musculus
gggacacccctggaacaaacattat

SEQ ID NO: 627218 - DNA, 25 bp, Mus musculus
gggacaccctagaaaactgcagtga

SEQ ID NO: 627219 - DNA, 25 bp, Mus musculus
gggacaccctagtaaactgcagtga

SEQ ID NO: 627220 - DNA, 25 bp, Mus musculus
gggacacccttcacgtcctgcaaga

SEQ ID NO: 627221 - DNA, 25 bp, Mus musculus
gggacacccttctcgtcctgcaaga

SEQ ID NO: 627222 - DNA, 25 bp, Mus musculus
gggacaccgatgattcctgtaccaa

SEQ ID NO: 627223 - DNA, 25 bp, Mus musculus
gggacaccgatgtttcctgtaccaa

SEQ ID NO: 627224 - DNA, 25 bp, Mus musculus
gggacaccgcccaaagatcagagta

SEQ ID NO: 627225 - DNA, 25 bp, Mus musculus
gggacaccgccctaagatcagagta

SEQ ID NO: 627226 - DNA, 25 bp, Mus musculus
gggacaccgtttcagttcatagacc

SEQ ID NO: 627227 - DNA, 25 bp, Mus musculus
gggacaccgtttgagttcatagacc

SEQ ID NO: 627228 - DNA, 25 bp, Mus musculus
gggacacctacactatgagcttctg

SEQ ID NO: 627229 - DNA, 25 bp, Mus musculus
gggacacctacagtatgagcttctg

SEQ ID NO: 627230 - DNA, 25 bp, Mus musculus
gggacacctagaacttgaatctcag

SEQ ID NO: 627231 - DNA, 25 bp, Mus musculus
gggacacctagatcttgaatctcag

SEQ ID NO: 627232 - DNA, 25 bp, Mus musculus
gggacacctaggacagacactacaa

SEQ ID NO: 627233 - DNA, 25 bp, Mus musculus
gggacacctaggtcagacactacaa

SEQ ID NO: 627234 - DNA, 25 bp, Mus musculus
gggacacctcatctggcttttagtc

SEQ ID NO: 627235 - DNA, 25 bp, Mus musculus
gggacacctcatgtggcttttagtc

SEQ ID NO: 627236 - DNA, 25 bp, Mus musculus
gggacacctgaaccactttattaca

SEQ ID NO: 627237 - DNA, 25 bp, Mus musculus
gggacacctgaagcactttattaca

SEQ ID NO: 627238 - DNA, 25 bp, Mus musculus
gggacacctgtgagtgagccccaca

SEQ ID NO: 627239 - DNA, 25 bp, Mus musculus
gggacacctgtgtgtgagccccaca

SEQ ID NO: 627240 - DNA, 25 bp, Mus musculus
gggacacctgttcggattccccatc

SEQ ID NO: 627241 - DNA, 25 bp, Mus musculus
gggacacctgttgggattccccatc

SEQ ID NO: 627242 - DNA, 25 bp, Mus musculus
gggacaccttatcgcagagtgacca

SEQ ID NO: 627243 - DNA, 25 bp, Mus musculus
gggacaccttatggcagagtgacca

SEQ ID NO: 627244 - DNA, 25 bp, Mus musculus
gggacaccttgaaacaaacctatat

SEQ ID NO: 627245 - DNA, 25 bp, Mus musculus
gggacaccttgatacaaacctatat

SEQ ID NO: 627246 - DNA, 25 bp, Mus musculus
gggacacctttaaatatctagagcc

SEQ ID NO: 627247 - DNA, 25 bp, Mus musculus
gggacacctttatatatctagagcc

SEQ ID NO: 627248 - DNA, 25 bp, Mus musculus
gggacacgacttcccaaagtgcaaa

SEQ ID NO: 627249 - DNA, 25 bp, Mus musculus
gggacacgacttgccaaagtgcaaa

SEQ ID NO: 627250 - DNA, 25 bp, Mus musculus
gggacacggagtcttcgtgccaaca

SEQ ID NO: 627251 - DNA, 25 bp, Mus musculus
gggacacggagtgttcgtgccaaca

SEQ ID NO: 627252 - DNA, 25 bp, Mus musculus
gggacacggccaataactgcctatg

SEQ ID NO: 627253 - DNA, 25 bp, Mus musculus
gggacacggccattaactgcctatg

SEQ ID NO: 627254 - DNA, 25 bp, Mus musculus
gggacacgggcacggacagcagcct

SEQ ID NO: 627255 - DNA, 25 bp, Mus musculus
gggacacgggcagggacagcagcct

SEQ ID NO: 627256 - DNA, 25 bp, Mus musculus
gggacacggtccaacactggccatt

SEQ ID NO: 627257 - DNA, 25 bp, Mus musculus
gggacacggtcctacactggccatt

SEQ ID NO: 627258 - DNA, 25 bp, Mus musculus
gggacactacacagaaccacagctt

SEQ ID NO: 627259 - DNA, 25 bp, Mus musculus
gggacactacactgaaccacagctt

SEQ ID NO: 627260 - DNA, 25 bp, Mus musculus
gggacactacccagaggcgctactg

SEQ ID NO: 627261 - DNA, 25 bp, Mus musculus
gggacactaccctgaggcgctactg

SEQ ID NO: 627262 - DNA, 25 bp, Mus musculus
gggacactcagtatagctcctatta

SEQ ID NO: 627263 - DNA, 25 bp, Mus musculus
gggacactcagtttagctcctatta

SEQ ID NO: 627264 - DNA, 25 bp, Mus musculus
gggacactccaaacaagaatgccaa

SEQ ID NO: 627265 - DNA, 25 bp, Mus musculus
gggacactccaatcaagaatgccaa

SEQ ID NO: 627266 - DNA, 25 bp, Mus musculus
gggacactccagaagagctatttgg

SEQ ID NO: 627267 - DNA, 25 bp, Mus musculus
gggacactccagtagagctatttgg

SEQ ID NO: 627268 - DNA, 25 bp, Mus musculus
gggacactcgaacgcactgtgacaa

SEQ ID NO: 627269 - DNA, 25 bp, Mus musculus
gggacactcgaaggcactgtgacaa

SEQ ID NO: 627270 - DNA, 25 bp, Mus musculus
gggacactcggtagcagccaacgca

SEQ ID NO: 627271 - DNA, 25 bp, Mus musculus
gggacactcggttgcagccaacgca

SEQ ID NO: 627272 - DNA, 25 bp, Mus musculus
gggacactcgttacagtagagccct

SEQ ID NO: 627273 - DNA, 25 bp, Mus musculus
gggacactcgtttcagtagagccct

SEQ ID NO: 627274 - DNA, 25 bp, Mus musculus
gggacactctgacaaggtatgcttc

SEQ ID NO: 627275 - DNA, 25 bp, Mus musculus
gggacactctgagaaggtatgcttc

SEQ ID NO: 627276 - DNA, 25 bp, Mus musculus
gggacactgaacacagatatcttca

SEQ ID NO: 627277 - DNA, 25 bp, Mus musculus
gggacactgaactcagatatcttca

SEQ ID NO: 627278 - DNA, 25 bp, Mus musculus
gggacactgactcgctgacggccat

SEQ ID NO: 627279 - DNA, 25 bp, Mus musculus
gggacactgactggctgacggccat

SEQ ID NO: 627280 - DNA, 25 bp, Mus musculus
gggacactgataaccatcctggtac

SEQ ID NO: 627281 - DNA, 25 bp, Mus musculus
gggacactgatatccatcctggtac

SEQ ID NO: 627282 - DNA, 25 bp, Mus musculus
gggacactgcaacgatcacctgcct

SEQ ID NO: 627283 - DNA, 25 bp, Mus musculus
gggacactgcaaggatcacctgcct

SEQ ID NO: 627284 - DNA, 25 bp, Mus musculus
gggacactgcagctgaatgagaaaa

SEQ ID NO: 627285 - DNA, 25 bp, Mus musculus
gggacactgcaggtgaatgagaaaa

SEQ ID NO: 627286 - DNA, 25 bp, Mus musculus
gggacactgctcatggatgccctgg

SEQ ID NO: 627287 - DNA, 25 bp, Mus musculus
gggacactgctcttggatgccctgg

SEQ ID NO: 627288 - DNA, 25 bp, Mus musculus
gggacactgctgaatgcactgtact

SEQ ID NO: 627289 - DNA, 25 bp, Mus musculus
gggacactgctgtatgcactgtact

SEQ ID NO: 627290 - DNA, 25 bp, Mus musculus
gggacactgcttactactgcaacaa

SEQ ID NO: 627291 - DNA, 25 bp, Mus musculus
gggacactgctttctactgcaacaa

SEQ ID NO: 627292 - DNA, 25 bp, Mus musculus
gggacactggaaattatctgctcta

SEQ ID NO: 627293 - DNA, 25 bp, Mus musculus
gggacactggaatttatctgctcta

SEQ ID NO: 627294 - DNA, 25 bp, Mus musculus
gggacactggagacaaccccagcag

SEQ ID NO: 627295 - DNA, 25 bp, Mus musculus
gggacactggagacttcctgcagta

SEQ ID NO: 627296 - DNA, 25 bp, Mus musculus
gggacactggagtcaaccccagcag

SEQ ID NO: 627297 - DNA, 25 bp, Mus musculus
gggacactggagtcttcctgcagta

SEQ ID NO: 627298 - DNA, 25 bp, Mus musculus
gggacactggctccttgccaagtag

SEQ ID NO: 627299 - DNA, 25 bp, Mus musculus
gggacactggctgcttgccaagtag

SEQ ID NO: 627300 - DNA, 25 bp, Mus musculus
gggacactggtgctctctactaaaa

SEQ ID NO: 627301 - DNA, 25 bp, Mus musculus
gggacactggtggtctctactaaaa

SEQ ID NO: 627302 - DNA, 25 bp, Mus musculus
gggacactgtatatgctcgcatatg

SEQ ID NO: 627303 - DNA, 25 bp, Mus musculus
gggacactgtatttgctcgcatatg

SEQ ID NO: 627304 - DNA, 25 bp, Mus musculus
gggacactgtccagaaccagctggt

SEQ ID NO: 627305 - DNA, 25 bp, Mus musculus
gggacactgtcctgaaccagctggt

SEQ ID NO: 627306 - DNA, 25 bp, Mus musculus
gggacactgtgaacagcccaagaat

SEQ ID NO: 627307 - DNA, 25 bp, Mus musculus
gggacactgtgatcagcccaagaat

SEQ ID NO: 627308 - DNA, 25 bp, Mus musculus
gggacactgttactatgcctaaaat

SEQ ID NO: 627309 - DNA, 25 bp, Mus musculus
gggacactgttagtatgcctaaaat

SEQ ID NO: 627310 - DNA, 25 bp, Mus musculus
gggacactgtttacctggctaactt

SEQ ID NO: 627311 - DNA, 25 bp, Mus musculus
gggacactgttttcctggctaactt

SEQ ID NO: 627312 - DNA, 25 bp, Mus musculus
gggacacttcacaactagacgggaa

SEQ ID NO: 627313 - DNA, 25 bp, Mus musculus
gggacacttcactactagacgggaa

SEQ ID NO: 627314 - DNA, 25 bp, Mus musculus
gggacacttcatagtcatccagatc

SEQ ID NO: 627315 - DNA, 25 bp, Mus musculus
gggacacttcattgtcatccagatc

SEQ ID NO: 627316 - DNA, 25 bp, Mus musculus
gggacacttctcaggagggacgctc

SEQ ID NO: 627317 - DNA, 25 bp, Mus musculus
gggacacttctctggagggacgctc

SEQ ID NO: 627318 - DNA, 25 bp, Mus musculus
gggacacttgaacccactagatagc

SEQ ID NO: 627319 - DNA, 25 bp, Mus musculus
gggacacttgaagccactagatagc

SEQ ID NO: 627320 - DNA, 25 bp, Mus musculus
gggacacttgcacagctgaagaaaa

SEQ ID NO: 627321 - DNA, 25 bp, Mus musculus
gggacacttgcacgcaggatcatga

SEQ ID NO: 627322 - DNA, 25 bp, Mus musculus
gggacacttgcagagctgaagaaaa

SEQ ID NO: 627323 - DNA, 25 bp, Mus musculus
gggacacttgcaggcaggatcatga

SEQ ID NO: 627324 - DNA, 25 bp, Mus musculus
gggacacttgctaacgtgaacaaag

SEQ ID NO: 627325 - DNA, 25 bp, Mus musculus
gggacacttgcttacgtgaacaaag

SEQ ID NO: 627326 - DNA, 25 bp, Mus musculus
gggacactttcaatacaggcgcggt

SEQ ID NO: 627327 - DNA, 25 bp, Mus musculus
gggacactttcattacaggcgcggt

SEQ ID NO: 627328 - DNA, 25 bp, Mus musculus
gggacactttccagtttagaattgc

SEQ ID NO: 627329 - DNA, 25 bp, Mus musculus
gggacactttcctgtttagaattgc

SEQ ID NO: 627330 - DNA, 25 bp, Mus musculus
gggacactttctcatctggatccat

SEQ ID NO: 627331 - DNA, 25 bp, Mus musculus
gggacactttctgatctggatccat

SEQ ID NO: 627332 - DNA, 25 bp, Mus musculus
gggacacttttacagggctcttgga

SEQ ID NO: 627333 - DNA, 25 bp, Mus musculus
gggacacttttagagggctcttgga

SEQ ID NO: 627334 - DNA, 25 bp, Mus musculus
gggacactttttagtcttatcacaa

SEQ ID NO: 627335 - DNA, 25 bp, Mus musculus
gggacacttttttgtcttatcacaa

SEQ ID NO: 627336 - DNA, 25 bp, Mus musculus
gggacagaaacacagacgcaacaag

SEQ ID NO: 627337 - DNA, 25 bp, Mus musculus
gggacagaaacagagacgcaacaag

SEQ ID NO: 627338 - DNA, 25 bp, Mus musculus
gggacagaaatccttctccattcct

SEQ ID NO: 627339 - DNA, 25 bp, Mus musculus
gggacagaaatcgttctccattcct

SEQ ID NO: 627340 - DNA, 25 bp, Mus musculus
gggacagaacatactcttgggctaa

SEQ ID NO: 627341 - DNA, 25 bp, Mus musculus
gggacagaacattctcttgggctaa

SEQ ID NO: 627342 - DNA, 25 bp, Mus musculus
gggacagaactgagttcccatccca

SEQ ID NO: 627343 - DNA, 25 bp, Mus musculus
gggacagaactgtgttcccatccca

SEQ ID NO: 627344 - DNA, 25 bp, Mus musculus
gggacagaaggtaccagcaccctgt

SEQ ID NO: 627345 - DNA, 25 bp, Mus musculus
gggacagaaggttccagcaccctgt

SEQ ID NO: 627346 - DNA, 25 bp, Mus musculus
gggacagaatctaccaaaccacaga

SEQ ID NO: 627347 - DNA, 25 bp, Mus musculus
gggacagaatcttccaaaccacaga

SEQ ID NO: 627348 - DNA, 25 bp, Mus musculus
gggacagacagaaaccaagataaat

SEQ ID NO: 627349 - DNA, 25 bp, Mus musculus
gggacagacagataccaagataaat

SEQ ID NO: 627350 - DNA, 25 bp, Mus musculus
gggacagacattagagaaacatttt

SEQ ID NO: 627351 - DNA, 25 bp, Mus musculus
gggacagacatttgagaaacatttt

SEQ ID NO: 627352 - DNA, 25 bp, Mus musculus
gggacagaccagacccagcagtcac

SEQ ID NO: 627353 - DNA, 25 bp, Mus musculus
gggacagaccagtcccagcagtcac

SEQ ID NO: 627354 - DNA, 25 bp, Mus musculus
gggacagacgagctgaaattcctaa

SEQ ID NO: 627355 - DNA, 25 bp, Mus musculus
gggacagacgaggtgaaattcctaa

SEQ ID NO: 627356 - DNA, 25 bp, Mus musculus
gggacagactcaccctggtgcgatt

SEQ ID NO: 627357 - DNA, 25 bp, Mus musculus
gggacagactcagcctggtgcgatt

SEQ ID NO: 627358 - DNA, 25 bp, Mus musculus
gggacagactggatgccattatttg

SEQ ID NO: 627359 - DNA, 25 bp, Mus musculus
gggacagactggttgccattatttg

SEQ ID NO: 627360 - DNA, 25 bp, Mus musculus
gggacagagacaagtcagtggttaa

SEQ ID NO: 627361 - DNA, 25 bp, Mus musculus
gggacagagacacagccacagaata

SEQ ID NO: 627362 - DNA, 25 bp, Mus musculus
gggacagagacagagccacagaata

SEQ ID NO: 627363 - DNA, 25 bp, Mus musculus
gggacagagacatgtcagtggttaa

SEQ ID NO: 627364 - DNA, 25 bp, Mus musculus
gggacagagacgatcaaaggactgt

SEQ ID NO: 627365 - DNA, 25 bp, Mus musculus
gggacagagacgttcaaaggactgt

SEQ ID NO: 627366 - DNA, 25 bp, Mus musculus
gggacagagagcacctgattccaga

SEQ ID NO: 627367 - DNA, 25 bp, Mus musculus
gggacagagagctcctgattccaga

SEQ ID NO: 627368 - DNA, 25 bp, Mus musculus
gggacagagcacattaagtttgaaa

SEQ ID NO: 627369 - DNA, 25 bp, Mus musculus
gggacagagcactttaagtttgaaa

SEQ ID NO: 627370 - DNA, 25 bp, Mus musculus
gggacagagcagaaacttgactatt

SEQ ID NO: 627371 - DNA, 25 bp, Mus musculus
gggacagagcagtaacttgactatt

SEQ ID NO: 627372 - DNA, 25 bp, Mus musculus
gggacagagccccaactcagcgaga

SEQ ID NO: 627373 - DNA, 25 bp, Mus musculus
gggacagagcccgaactcagcgaga

SEQ ID NO: 627374 - DNA, 25 bp, Mus musculus
gggacagagctaccttgaccagttc

SEQ ID NO: 627375 - DNA, 25 bp, Mus musculus
gggacagagctagcttgaccagttc

SEQ ID NO: 627376 - DNA, 25 bp, Mus musculus
gggacagagctcacagcttgggttc

SEQ ID NO: 627377 - DNA, 25 bp, Mus musculus
gggacagagctctcagcttgggttc

SEQ ID NO: 627378 - DNA, 25 bp, Mus musculus
gggacagaggcgatcacactaacgt

SEQ ID NO: 627379 - DNA, 25 bp, Mus musculus
gggacagaggcgttcacactaacgt

SEQ ID NO: 627380 - DNA, 25 bp, Mus musculus
gggacagagtccacacatgcgtgtg

SEQ ID NO: 627381 - DNA, 25 bp, Mus musculus
gggacagagtcctcacatgcgtgtg

SEQ ID NO: 627382 - DNA, 25 bp, Mus musculus
gggacagagttacacgcagctagct

SEQ ID NO: 627383 - DNA, 25 bp, Mus musculus
gggacagagttagacgcagctagct

SEQ ID NO: 627384 - DNA, 25 bp, Mus musculus
gggacagataagatctactgatcag

SEQ ID NO: 627385 - DNA, 25 bp, Mus musculus
gggacagataagttctactgatcag

SEQ ID NO: 627386 - DNA, 25 bp, Mus musculus
gggacagatacactgccgtggtaaa

SEQ ID NO: 627387 - DNA, 25 bp, Mus musculus
gggacagatacagtgccgtggtaaa

SEQ ID NO: 627388 - DNA, 25 bp, Mus musculus
gggacagatatcaccgtcatctgcc

SEQ ID NO: 627389 - DNA, 25 bp, Mus musculus
gggacagatatctccgtcatctgcc

SEQ ID NO: 627390 - DNA, 25 bp, Mus musculus
gggacagatccaagaggcgacgaaa

SEQ ID NO: 627391 - DNA, 25 bp, Mus musculus
gggacagatccatgaggcgacgaaa

SEQ ID NO: 627392 - DNA, 25 bp, Mus musculus
gggacagatctcagagccactcaag

SEQ ID NO: 627393 - DNA, 25 bp, Mus musculus
gggacagatctctgagccactcaag

SEQ ID NO: 627394 - DNA, 25 bp, Mus musculus
gggacagatctgagccttagagaga

SEQ ID NO: 627395 - DNA, 25 bp, Mus musculus
gggacagatctgtgccttagagaga

SEQ ID NO: 627396 - DNA, 25 bp, Mus musculus
gggacagattaacccatttctttca

SEQ ID NO: 627397 - DNA, 25 bp, Mus musculus
gggacagattaagccatttctttca

SEQ ID NO: 627398 - DNA, 25 bp, Mus musculus
gggacagatttacacacagacacat

SEQ ID NO: 627399 - DNA, 25 bp, Mus musculus
gggacagatttagacacagacacat

SEQ ID NO: 627400 - DNA, 25 bp, Mus musculus
gggacagatttcaaattgcatgaac

SEQ ID NO: 627401 - DNA, 25 bp, Mus musculus
gggacagatttctaattgcatgaac

SEQ ID NO: 627402 - DNA, 25 bp, Mus musculus
gggacagcaagcattagttactact

SEQ ID NO: 627403 - DNA, 25 bp, Mus musculus
gggacagcaagctttagttactact

SEQ ID NO: 627404 - DNA, 25 bp, Mus musculus
gggacagcaagtacacaacctgctt

SEQ ID NO: 627405 - DNA, 25 bp, Mus musculus
gggacagcaagttcacaacctgctt

SEQ ID NO: 627406 - DNA, 25 bp, Mus musculus
gggacagcagaacgactttcacagt

SEQ ID NO: 627407 - DNA, 25 bp, Mus musculus
gggacagcagaaggactttcacagt

SEQ ID NO: 627408 - DNA, 25 bp, Mus musculus
gggacagcagagagcctaggcctat

SEQ ID NO: 627409 - DNA, 25 bp, Mus musculus
gggacagcagagtgcctaggcctat

SEQ ID NO: 627410 - DNA, 25 bp, Mus musculus
gggacagcagccaccaggcaagtca

SEQ ID NO: 627411 - DNA, 25 bp, Mus musculus
gggacagcagccagaacttagccct

SEQ ID NO: 627412 - DNA, 25 bp, Mus musculus
gggacagcagcctccaggcaagtca

SEQ ID NO: 627413 - DNA, 25 bp, Mus musculus
gggacagcagcctgaacttagccct

SEQ ID NO: 627414 - DNA, 25 bp, Mus musculus
gggacagcaggtaccttgctgcgac

SEQ ID NO: 627415 - DNA, 25 bp, Mus musculus
gggacagcaggttccttgctgcgac

SEQ ID NO: 627416 - DNA, 25 bp, Mus musculus
gggacagcataccagtaatagcttt

SEQ ID NO: 627417 - DNA, 25 bp, Mus musculus
gggacagcatacgagtaatagcttt

SEQ ID NO: 627418 - DNA, 25 bp, Mus musculus
gggacagcatatccctatttctcca

SEQ ID NO: 627419 - DNA, 25 bp, Mus musculus
gggacagcatatgcctatttctcca

SEQ ID NO: 627420 - DNA, 25 bp, Mus musculus
gggacagcatgcacctttaactcac

SEQ ID NO: 627421 - DNA, 25 bp, Mus musculus
gggacagcatgccagaggtacaaat

SEQ ID NO: 627422 - DNA, 25 bp, Mus musculus
gggacagcatgcgagaggtacaaat

SEQ ID NO: 627423 - DNA, 25 bp, Mus musculus
gggacagcatgctcctttaactcac

SEQ ID NO: 627424 - DNA, 25 bp, Mus musculus
gggacagcatggactgcataagaca

SEQ ID NO: 627425 - DNA, 25 bp, Mus musculus
gggacagcatggtctgcataagaca

SEQ ID NO: 627426 - DNA, 25 bp, Mus musculus
gggacagccaacacctttcaaaggg

SEQ ID NO: 627427 - DNA, 25 bp, Mus musculus
gggacagccaactcctttcaaaggg

SEQ ID NO: 627428 - DNA, 25 bp, Mus musculus
gggacagccatgatatctgctttac

SEQ ID NO: 627429 - DNA, 25 bp, Mus musculus
gggacagccatgttatctgctttac

SEQ ID NO: 627430 - DNA, 25 bp, Mus musculus
gggacagcccacagaacatcaagca

SEQ ID NO: 627431 - DNA, 25 bp, Mus musculus
gggacagcccactgaacatcaagca

SEQ ID NO: 627432 - DNA, 25 bp, Mus musculus
gggacagcccagacatttcaacttc

SEQ ID NO: 627433 - DNA, 25 bp, Mus musculus
gggacagcccagtcatttcaacttc

SEQ ID NO: 627434 - DNA, 25 bp, Mus musculus
gggacagcctgaccggatcatgaac

SEQ ID NO: 627435 - DNA, 25 bp, Mus musculus
gggacagcctgagcggatcatgaac

SEQ ID NO: 627436 - DNA, 25 bp, Mus musculus
gggacagcctgccttgtctgcccag

SEQ ID NO: 627437 - DNA, 25 bp, Mus musculus
gggacagcctgcgttgtctgcccag

SEQ ID NO: 627438 - DNA, 25 bp, Mus musculus
gggacagcggatacgcatcccagca

SEQ ID NO: 627439 - DNA, 25 bp, Mus musculus
gggacagcggattcgcatcccagca

SEQ ID NO: 627440 - DNA, 25 bp, Mus musculus
gggacagcggcaaatttccagtgtt

SEQ ID NO: 627441 - DNA, 25 bp, Mus musculus
gggacagcggcatatttccagtgtt

SEQ ID NO: 627442 - DNA, 25 bp, Mus musculus
gggacagctacccacttcttacttg

SEQ ID NO: 627443 - DNA, 25 bp, Mus musculus
gggacagctaccgacttcttacttg

SEQ ID NO: 627444 - DNA, 25 bp, Mus musculus
gggacagctattcttctgacagaca

SEQ ID NO: 627445 - DNA, 25 bp, Mus musculus
gggacagctattgttctgacagaca

SEQ ID NO: 627446 - DNA, 25 bp, Mus musculus
gggacagctcatcaaagcctgcaaa

SEQ ID NO: 627447 - DNA, 25 bp, Mus musculus
gggacagctcatgaaagcctgcaaa

SEQ ID NO: 627448 - DNA, 25 bp, Mus musculus
gggacagctcgtcagcattgagaca

SEQ ID NO: 627449 - DNA, 25 bp, Mus musculus
gggacagctcgtgagcattgagaca

SEQ ID NO: 627450 - DNA, 25 bp, Mus musculus
gggacagctgaacccctcctgcaga

SEQ ID NO: 627451 - DNA, 25 bp, Mus musculus
gggacagctgaagccctcctgcaga

SEQ ID NO: 627452 - DNA, 25 bp, Mus musculus
gggacagctgccatccccggaacaa

SEQ ID NO: 627453 - DNA, 25 bp, Mus musculus
gggacagctgccttccccggaacaa

SEQ ID NO: 627454 - DNA, 25 bp, Mus musculus
gggacagctgctccgcaaagccgac

SEQ ID NO: 627455 - DNA, 25 bp, Mus musculus
gggacagctgctgcgcaaagccgac

SEQ ID NO: 627456 - DNA, 25 bp, Mus musculus
gggacagctggaccaatgacttata

SEQ ID NO: 627457 - DNA, 25 bp, Mus musculus
gggacagctggagcaatgacttata

SEQ ID NO: 627458 - DNA, 25 bp, Mus musculus
gggacagctgttaattattctttca

SEQ ID NO: 627459 - DNA, 25 bp, Mus musculus
gggacagctgtttattattctttca

SEQ ID NO: 627460 - DNA, 25 bp, Mus musculus
gggacagcttcaccttcagtgatga

SEQ ID NO: 627461 - DNA, 25 bp, Mus musculus
gggacagcttcagcttcagtgatga

SEQ ID NO: 627462 - DNA, 25 bp, Mus musculus
gggacagcttccaagagctcctgaa

SEQ ID NO: 627463 - DNA, 25 bp, Mus musculus
gggacagcttcctagagctcctgaa

SEQ ID NO: 627464 - DNA, 25 bp, Mus musculus
gggacaggaacaactgccctagtcg

SEQ ID NO: 627465 - DNA, 25 bp, Mus musculus
gggacaggaacatctgccctagtcg

SEQ ID NO: 627466 - DNA, 25 bp, Mus musculus
gggacaggaagcctcaaaacttctt

SEQ ID NO: 627467 - DNA, 25 bp, Mus musculus
gggacaggaagcgtcaaaacttctt

SEQ ID NO: 627468 - DNA, 25 bp, Mus musculus
gggacaggaatgatacattggaaag

SEQ ID NO: 627469 - DNA, 25 bp, Mus musculus
gggacaggaatgttacattggaaag

SEQ ID NO: 627470 - DNA, 25 bp, Mus musculus
gggacaggactacccggcaagcatc

SEQ ID NO: 627471 - DNA, 25 bp, Mus musculus
gggacaggactagccggcaagcatc

SEQ ID NO: 627472 - DNA, 25 bp, Mus musculus
gggacaggactccttaaggacatct

SEQ ID NO: 627473 - DNA, 25 bp, Mus musculus
gggacaggactcgttaaggacatct

SEQ ID NO: 627474 - DNA, 25 bp, Mus musculus
gggacaggacttctcttccacagca

SEQ ID NO: 627475 - DNA, 25 bp, Mus musculus
gggacaggacttgtcttccacagca

SEQ ID NO: 627476 - DNA, 25 bp, Mus musculus
gggacaggagagctctacctttcat

SEQ ID NO: 627477 - DNA, 25 bp, Mus musculus
gggacaggagaggtctacctttcat

SEQ ID NO: 627478 - DNA, 25 bp, Mus musculus
gggacaggagcaacatcggcgccat

SEQ ID NO: 627479 - DNA, 25 bp, Mus musculus
gggacaggagcatcatcggcgccat

SEQ ID NO: 627480 - DNA, 25 bp, Mus musculus
gggacaggatcactttaaccctctg

SEQ ID NO: 627481 - DNA, 25 bp, Mus musculus
gggacaggatcagtttaaccctctg

SEQ ID NO: 627482 - DNA, 25 bp, Mus musculus
gggacaggccagatgacacacacct

SEQ ID NO: 627483 - DNA, 25 bp, Mus musculus
gggacaggccagatgacatcaactt

SEQ ID NO: 627484 - DNA, 25 bp, Mus musculus
gggacaggccagttgacacacacct

SEQ ID NO: 627485 - DNA, 25 bp, Mus musculus
gggacaggccagttgacatcaactt

SEQ ID NO: 627486 - DNA, 25 bp, Mus musculus
gggacaggcctcatgatgatacaga

SEQ ID NO: 627487 - DNA, 25 bp, Mus musculus
gggacaggcctcttgatgatacaga

SEQ ID NO: 627488 - DNA, 25 bp, Mus musculus
gggacaggccttccctctttataag

SEQ ID NO: 627489 - DNA, 25 bp, Mus musculus
gggacaggccttgcctctttataag

SEQ ID NO: 627490 - DNA, 25 bp, Mus musculus
gggacagggaagatgctcactagac

SEQ ID NO: 627491 - DNA, 25 bp, Mus musculus
gggacagggaagttgctcactagac

SEQ ID NO: 627492 - DNA, 25 bp, Mus musculus
gggacagggcatagttcaacaaaag

SEQ ID NO: 627493 - DNA, 25 bp, Mus musculus
gggacagggcattgttcaacaaaag

SEQ ID NO: 627494 - DNA, 25 bp, Mus musculus
gggacagggtacacccacacccgag

SEQ ID NO: 627495 - DNA, 25 bp, Mus musculus
gggacagggtactcccacacccgag

SEQ ID NO: 627496 - DNA, 25 bp, Mus musculus
gggacagggtccacagcgatctcat

SEQ ID NO: 627497 - DNA, 25 bp, Mus musculus
gggacagggtcctcagcgatctcat

SEQ ID NO: 627498 - DNA, 25 bp, Mus musculus
gggacaggtaacaggagtacctttg

SEQ ID NO: 627499 - DNA, 25 bp, Mus musculus
gggacaggtaactggagtacctttg

SEQ ID NO: 627500 - DNA, 25 bp, Mus musculus
gggacaggtgaccatcctcaatgaa

SEQ ID NO: 627501 - DNA, 25 bp, Mus musculus
gggacaggtgacgatcctcaatgaa

SEQ ID NO: 627502 - DNA, 25 bp, Mus musculus
gggacaggttctctagtaagatagt

SEQ ID NO: 627503 - DNA, 25 bp, Mus musculus
gggacaggttctgtagtaagatagt

SEQ ID NO: 627504 - DNA, 25 bp, Mus musculus
gggacagtagcaatggttcctttaa

SEQ ID NO: 627505 - DNA, 25 bp, Mus musculus
gggacagtagcattggttcctttaa

SEQ ID NO: 627506 - DNA, 25 bp, Mus musculus
gggacagtagtaaaccataggccta

SEQ ID NO: 627507 - DNA, 25 bp, Mus musculus
gggacagtagtataccataggccta

SEQ ID NO: 627508 - DNA, 25 bp, Mus musculus
gggacagtattcatctttgggactt

SEQ ID NO: 627509 - DNA, 25 bp, Mus musculus
gggacagtattcttctttgggactt

SEQ ID NO: 627510 - DNA, 25 bp, Mus musculus
gggacagtcaacagagttgccgaaa

SEQ ID NO: 627511 - DNA, 25 bp, Mus musculus
gggacagtcaactgagttgccgaaa

SEQ ID NO: 627512 - DNA, 25 bp, Mus musculus
gggacagtcagacttcaccctggct

SEQ ID NO: 627513 - DNA, 25 bp, Mus musculus
gggacagtcagagttcaccctggct

SEQ ID NO: 627514 - DNA, 25 bp, Mus musculus
gggacagtccaaacgtgctcgattc

SEQ ID NO: 627515 - DNA, 25 bp, Mus musculus
gggacagtccaatcgtgctcgattc

SEQ ID NO: 627516 - DNA, 25 bp, Mus musculus
gggacagtcgcaaatctatcaagtg

SEQ ID NO: 627517 - DNA, 25 bp, Mus musculus
gggacagtcgcatatctatcaagtg

SEQ ID NO: 627518 - DNA, 25 bp, Mus musculus
gggacagtctgtctatcacattcac

SEQ ID NO: 627519 - DNA, 25 bp, Mus musculus
gggacagtctgtgtatcacattcac

SEQ ID NO: 627520 - DNA, 25 bp, Mus musculus
gggacagtgagcctgcctaccagca

SEQ ID NO: 627521 - DNA, 25 bp, Mus musculus
gggacagtgagcgtgcctaccagca

SEQ ID NO: 627522 - DNA, 25 bp, Mus musculus
gggacagtgcaccaacacagcatag

SEQ ID NO: 627523 - DNA, 25 bp, Mus musculus
gggacagtgcacgaacacagcatag

SEQ ID NO: 627524 - DNA, 25 bp, Mus musculus
gggacagtgcagctcagcctcaaaa

SEQ ID NO: 627525 - DNA, 25 bp, Mus musculus
gggacagtgcaggtcagcctcaaaa

SEQ ID NO: 627526 - DNA, 25 bp, Mus musculus
gggacagtgctacccaacctcctgg

SEQ ID NO: 627527 - DNA, 25 bp, Mus musculus
gggacagtgctagccaacctcctgg

SEQ ID NO: 627528 - DNA, 25 bp, Mus musculus
gggacagtgctcagaagatctatca

SEQ ID NO: 627529 - DNA, 25 bp, Mus musculus
gggacagtgctctgaagatctatca

SEQ ID NO: 627530 - DNA, 25 bp, Mus musculus
gggacagtgggtcactcagaactct

SEQ ID NO: 627531 - DNA, 25 bp, Mus musculus
gggacagtgggtgactcagaactct

SEQ ID NO: 627532 - DNA, 25 bp, Mus musculus
gggacagttacaaactatttagctc

SEQ ID NO: 627533 - DNA, 25 bp, Mus musculus
gggacagttacatactatttagctc

SEQ ID NO: 627534 - DNA, 25 bp, Mus musculus
gggacagttgcacctatctatgacg

SEQ ID NO: 627535 - DNA, 25 bp, Mus musculus
gggacagttgcagctatctatgacg

SEQ ID NO: 627536 - DNA, 25 bp, Mus musculus
gggacagttgtcaaggtgagttaac

SEQ ID NO: 627537 - DNA, 25 bp, Mus musculus
gggacagttgtctaggtgagttaac

SEQ ID NO: 627538 - DNA, 25 bp, Mus musculus
gggacagtttatcgcactccaaaat

SEQ ID NO: 627539 - DNA, 25 bp, Mus musculus
gggacagtttatggcactccaaaat

SEQ ID NO: 627540 - DNA, 25 bp, Mus musculus
gggacagtttctcgcccagggttct

SEQ ID NO: 627541 - DNA, 25 bp, Mus musculus
gggacagtttctggcccagggttct

SEQ ID NO: 627542 - DNA, 25 bp, Mus musculus
gggacataatcaccgcgtaatcagc

SEQ ID NO: 627543 - DNA, 25 bp, Mus musculus
gggacataatcagcgcgtaatcagc

SEQ ID NO: 627544 - DNA, 25 bp, Mus musculus
gggacataatctctttggcctctac

SEQ ID NO: 627545 - DNA, 25 bp, Mus musculus
gggacataatctgtttggcctctac

SEQ ID NO: 627546 - DNA, 25 bp, Mus musculus
gggacataatgaacgccagggtcat

SEQ ID NO: 627547 - DNA, 25 bp, Mus musculus
gggacataatgatcgccagggtcat

SEQ ID NO: 627548 - DNA, 25 bp, Mus musculus
gggacatacaagacaactacccaag

SEQ ID NO: 627549 - DNA, 25 bp, Mus musculus
gggacatacaagtcaactacccaag

SEQ ID NO: 627550 - DNA, 25 bp, Mus musculus
gggacatacactcgcgacaataatc

SEQ ID NO: 627551 - DNA, 25 bp, Mus musculus
gggacatacactggcgacaataatc

SEQ ID NO: 627552 - DNA, 25 bp, Mus musculus
gggacatacagcagcacggttcaaa

SEQ ID NO: 627553 - DNA, 25 bp, Mus musculus
gggacatacagctgcacggttcaaa

SEQ ID NO: 627554 - DNA, 25 bp, Mus musculus
gggacataccaacccctgtacgaga

SEQ ID NO: 627555 - DNA, 25 bp, Mus musculus
gggacataccaagccctgtacgaga

SEQ ID NO: 627556 - DNA, 25 bp, Mus musculus
gggacatagccacgccagcaattag

SEQ ID NO: 627557 - DNA, 25 bp, Mus musculus
gggacatagccaggccagcaattag

SEQ ID NO: 627558 - DNA, 25 bp, Mus musculus
gggacatagccccagaggtcacctt

SEQ ID NO: 627559 - DNA, 25 bp, Mus musculus
gggacatagcccgagaggtcacctt

SEQ ID NO: 627560 - DNA, 25 bp, Mus musculus
gggacatagtgcatctattacatca

SEQ ID NO: 627561 - DNA, 25 bp, Mus musculus
gggacatagtgcttctattacatca

SEQ ID NO: 627562 - DNA, 25 bp, Mus musculus
gggacatatcatagtgacaactttt

SEQ ID NO: 627563 - DNA, 25 bp, Mus musculus
gggacatatcattgtgacaactttt

SEQ ID NO: 627564 - DNA, 25 bp, Mus musculus
gggacatatcctccgccctgaggac

SEQ ID NO: 627565 - DNA, 25 bp, Mus musculus
gggacatatcctgcgccctgaggac

SEQ ID NO: 627566 - DNA, 25 bp, Mus musculus
gggacatattgtcctgctgcaggaa

SEQ ID NO: 627567 - DNA, 25 bp, Mus musculus
gggacatattgtgctgctgcaggaa

SEQ ID NO: 627568 - DNA, 25 bp, Mus musculus
gggacatatttcagccaattaaaga

SEQ ID NO: 627569 - DNA, 25 bp, Mus musculus
gggacatatttctgccaattaaaga

SEQ ID NO: 627570 - DNA, 25 bp, Mus musculus
gggacatcaacaccttcgaccagtg

SEQ ID NO: 627571 - DNA, 25 bp, Mus musculus
gggacatcaacagcttcgaccagtg

SEQ ID NO: 627572 - DNA, 25 bp, Mus musculus
gggacatcaactacgaggaggactt

SEQ ID NO: 627573 - DNA, 25 bp, Mus musculus
gggacatcaactccttagtcaatta

SEQ ID NO: 627574 - DNA, 25 bp, Mus musculus
gggacatcaactgcttagtcaatta

SEQ ID NO: 627575 - DNA, 25 bp, Mus musculus
gggacatcaacttcgaggaggactt

SEQ ID NO: 627576 - DNA, 25 bp, Mus musculus
gggacatcaccaacaacatgatctg

SEQ ID NO: 627577 - DNA, 25 bp, Mus musculus
gggacatcaccacttatgtccttaa

SEQ ID NO: 627578 - DNA, 25 bp, Mus musculus
gggacatcaccagttatgtccttaa

SEQ ID NO: 627579 - DNA, 25 bp, Mus musculus
gggacatcaccatcaacatgatctg

SEQ ID NO: 627580 - DNA, 25 bp, Mus musculus
gggacatcatgtatacgcagcattt

SEQ ID NO: 627581 - DNA, 25 bp, Mus musculus
gggacatcatgtttacgcagcattt

SEQ ID NO: 627582 - DNA, 25 bp, Mus musculus
gggacatccagcagatgcctcgggc

SEQ ID NO: 627583 - DNA, 25 bp, Mus musculus
gggacatccagctgatgcctcgggc

SEQ ID NO: 627584 - DNA, 25 bp, Mus musculus
gggacatccataagatagacagcta

SEQ ID NO: 627585 - DNA, 25 bp, Mus musculus
gggacatccatatgatagacagcta

SEQ ID NO: 627586 - DNA, 25 bp, Mus musculus
gggacatccatgagaaatcagagga

SEQ ID NO: 627587 - DNA, 25 bp, Mus musculus
gggacatccatgtgaaatcagagga

SEQ ID NO: 627588 - DNA, 25 bp, Mus musculus
gggacatcccataagtagtttcaag

SEQ ID NO: 627589 - DNA, 25 bp, Mus musculus
gggacatcccattagtagtttcaag

SEQ ID NO: 627590 - DNA, 25 bp, Mus musculus
gggacatccgttagactttgcccag

SEQ ID NO: 627591 - DNA, 25 bp, Mus musculus
gggacatccgtttgactttgcccag

SEQ ID NO: 627592 - DNA, 25 bp, Mus musculus
gggacatccttccagtgagcacgat

SEQ ID NO: 627593 - DNA, 25 bp, Mus musculus
gggacatccttcgagtgagcacgat

SEQ ID NO: 627594 - DNA, 25 bp, Mus musculus
gggacatcgaggaccccgagatcgt

SEQ ID NO: 627595 - DNA, 25 bp, Mus musculus
gggacatcgaggtccccgagatcgt

SEQ ID NO: 627596 - DNA, 25 bp, Mus musculus
gggacatcgtccatcatctagaagg

SEQ ID NO: 627597 - DNA, 25 bp, Mus musculus
gggacatcgtccttcatctagaagg

SEQ ID NO: 627598 - DNA, 25 bp, Mus musculus
gggacatctcctagcagtgtgaatg

SEQ ID NO: 627599 - DNA, 25 bp, Mus musculus
gggacatctccttgcagtgtgaatg

SEQ ID NO: 627600 - DNA, 25 bp, Mus musculus
gggacatctctgaagcaacaattct

SEQ ID NO: 627601 - DNA, 25 bp, Mus musculus
gggacatctctgtagcaacaattct

SEQ ID NO: 627602 - DNA, 25 bp, Mus musculus
gggacatcttataagggcacttcgt

SEQ ID NO: 627603 - DNA, 25 bp, Mus musculus
gggacatcttattagggcacttcgt

SEQ ID NO: 627604 - DNA, 25 bp, Mus musculus
gggacatcttgtcacctgagaatga

SEQ ID NO: 627605 - DNA, 25 bp, Mus musculus
gggacatcttgtgacctgagaatga

SEQ ID NO: 627606 - DNA, 25 bp, Mus musculus
gggacatgaatgaaaacctttattt

SEQ ID NO: 627607 - DNA, 25 bp, Mus musculus
gggacatgaatgtaaacctttattt

SEQ ID NO: 627608 - DNA, 25 bp, Mus musculus
gggacatgaattaggacctcactga

SEQ ID NO: 627609 - DNA, 25 bp, Mus musculus
gggacatgaatttggacctcactga

SEQ ID NO: 627610 - DNA, 25 bp, Mus musculus
gggacatgacttactttcagcactg

SEQ ID NO: 627611 - DNA, 25 bp, Mus musculus
gggacatgactttctttcagcactg

SEQ ID NO: 627612 - DNA, 25 bp, Mus musculus
gggacatgagccctttattatgaca

SEQ ID NO: 627613 - DNA, 25 bp, Mus musculus
gggacatgagccgtttattatgaca

SEQ ID NO: 627614 - DNA, 25 bp, Mus musculus
gggacatgcaaaatctcacagactc

SEQ ID NO: 627615 - DNA, 25 bp, Mus musculus
gggacatgcaaattctcacagactc

SEQ ID NO: 627616 - DNA, 25 bp, Mus musculus
gggacatgcccaccagatgaccaat

SEQ ID NO: 627617 - DNA, 25 bp, Mus musculus
gggacatgcccagcagatgaccaat

SEQ ID NO: 627618 - DNA, 25 bp, Mus musculus
gggacatgcctcacagatgacaaaa

SEQ ID NO: 627619 - DNA, 25 bp, Mus musculus
gggacatgcctctcagatgacaaaa

SEQ ID NO: 627620 - DNA, 25 bp, Mus musculus
gggacatgctagattacctttcaga

SEQ ID NO: 627621 - DNA, 25 bp, Mus musculus
gggacatgctagtttacctttcaga

SEQ ID NO: 627622 - DNA, 25 bp, Mus musculus
gggacatgctgcaaggttggcctcc

SEQ ID NO: 627623 - DNA, 25 bp, Mus musculus
gggacatgctgctaggttggcctcc

SEQ ID NO: 627624 - DNA, 25 bp, Mus musculus
gggacatgctggacccaagactctg

SEQ ID NO: 627625 - DNA, 25 bp, Mus musculus
gggacatgctggtcccaagactctg

SEQ ID NO: 627626 - DNA, 25 bp, Mus musculus
gggacatggatcaagctcagagact

SEQ ID NO: 627627 - DNA, 25 bp, Mus musculus
gggacatggatctagctcagagact

SEQ ID NO: 627628 - DNA, 25 bp, Mus musculus
gggacatggcacagaccttctactc

SEQ ID NO: 627629 - DNA, 25 bp, Mus musculus
gggacatggcactgaccttctactc

SEQ ID NO: 627630 - DNA, 25 bp, Mus musculus
gggacatgggctatccagacccttc

SEQ ID NO: 627631 - DNA, 25 bp, Mus musculus
gggacatgggctttccagacccttc

SEQ ID NO: 627632 - DNA, 25 bp, Mus musculus
gggacatggtcacggctatctgcca

SEQ ID NO: 627633 - DNA, 25 bp, Mus musculus
gggacatggtcagggctatctgcca

SEQ ID NO: 627634 - DNA, 25 bp, Mus musculus
gggacatggtctctgtggaaaatca

SEQ ID NO: 627635 - DNA, 25 bp, Mus musculus
gggacatggtctgtgtggaaaatca

SEQ ID NO: 627636 - DNA, 25 bp, Mus musculus
gggacatggtttcctgcctatgccc

SEQ ID NO: 627637 - DNA, 25 bp, Mus musculus
gggacatggtttgctgcctatgccc

SEQ ID NO: 627638 - DNA, 25 bp, Mus musculus
gggacatgtctcacttgtggaatag

SEQ ID NO: 627639 - DNA, 25 bp, Mus musculus
gggacatgtctctcttgtggaatag

SEQ ID NO: 627640 - DNA, 25 bp, Mus musculus
gggacatgttaccagaagccacaga

SEQ ID NO: 627641 - DNA, 25 bp, Mus musculus
gggacatgttacgagaagccacaga

SEQ ID NO: 627642 - DNA, 25 bp, Mus musculus
gggacatgttgtaaccagaagagga

SEQ ID NO: 627643 - DNA, 25 bp, Mus musculus
gggacatgttgttaccagaagagga

SEQ ID NO: 627644 - DNA, 25 bp, Mus musculus
gggacatgtttccaggacaccagta

SEQ ID NO: 627645 - DNA, 25 bp, Mus musculus
gggacatgtttcgaggacaccagta

SEQ ID NO: 627646 - DNA, 25 bp, Mus musculus
gggacattaactactcaggctttgg

SEQ ID NO: 627647 - DNA, 25 bp, Mus musculus
gggacattaacttctcaggctttgg

SEQ ID NO: 627648 - DNA, 25 bp, Mus musculus
gggacattaagccactttcattcat

SEQ ID NO: 627649 - DNA, 25 bp, Mus musculus
gggacattaagcgactttcattcat

SEQ ID NO: 627650 - DNA, 25 bp, Mus musculus
gggacattacagagtcacattacat

SEQ ID NO: 627651 - DNA, 25 bp, Mus musculus
gggacattacagtgtcacattacat

SEQ ID NO: 627652 - DNA, 25 bp, Mus musculus
gggacattaccaattgtctgcaagt

SEQ ID NO: 627653 - DNA, 25 bp, Mus musculus
gggacattaccatttgtctgcaagt

SEQ ID NO: 627654 - DNA, 25 bp, Mus musculus
gggacattacctcaaagtgcaagct

SEQ ID NO: 627655 - DNA, 25 bp, Mus musculus
gggacattacctgaaagtgcaagct

SEQ ID NO: 627656 - DNA, 25 bp, Mus musculus
gggacattactacctagctaccttt

SEQ ID NO: 627657 - DNA, 25 bp, Mus musculus
gggacattactagctagctaccttt

SEQ ID NO: 627658 - DNA, 25 bp, Mus musculus
gggacattagaccagacaccaccac

SEQ ID NO: 627659 - DNA, 25 bp, Mus musculus
gggacattagacgagacaccaccac

SEQ ID NO: 627660 - DNA, 25 bp, Mus musculus
gggacattagtgctggccttcttct

SEQ ID NO: 627661 - DNA, 25 bp, Mus musculus
gggacattagtggtggccttcttct

SEQ ID NO: 627662 - DNA, 25 bp, Mus musculus
gggacattatgcactgacccaagcc

SEQ ID NO: 627663 - DNA, 25 bp, Mus musculus
gggacattatgctctgacccaagcc

SEQ ID NO: 627664 - DNA, 25 bp, Mus musculus
gggacattcaagactttgagatgtt

SEQ ID NO: 627665 - DNA, 25 bp, Mus musculus
gggacattcaagtctttgagatgtt

SEQ ID NO: 627666 - DNA, 25 bp, Mus musculus
gggacattcacacccagggatggta

SEQ ID NO: 627667 - DNA, 25 bp, Mus musculus
gggacattcacagccagggatggta

SEQ ID NO: 627668 - DNA, 25 bp, Mus musculus
gggacattcacgacgaagccaggat

SEQ ID NO: 627669 - DNA, 25 bp, Mus musculus
gggacattcacgtcgaagccaggat

SEQ ID NO: 627670 - DNA, 25 bp, Mus musculus
gggacattcactcttttgaagtctg

SEQ ID NO: 627671 - DNA, 25 bp, Mus musculus
gggacattcactgttttgaagtctg

SEQ ID NO: 627672 - DNA, 25 bp, Mus musculus
gggacattcattattctcaatggct

SEQ ID NO: 627673 - DNA, 25 bp, Mus musculus
gggacattcatttttctcaatggct

SEQ ID NO: 627674 - DNA, 25 bp, Mus musculus
gggacattcggcatgttctgtgtgt

SEQ ID NO: 627675 - DNA, 25 bp, Mus musculus
gggacattcggcttgttctgtgtgt

SEQ ID NO: 627676 - DNA, 25 bp, Mus musculus
gggacattcgtcatcaatctagaag

SEQ ID NO: 627677 - DNA, 25 bp, Mus musculus
gggacattcgtcttcaatctagaag

SEQ ID NO: 627678 - DNA, 25 bp, Mus musculus
gggacattctacatcattccaagga

SEQ ID NO: 627679 - DNA, 25 bp, Mus musculus
gggacattctacttcattccaagga

SEQ ID NO: 627680 - DNA, 25 bp, Mus musculus
gggacattctcacagtttagttctt

SEQ ID NO: 627681 - DNA, 25 bp, Mus musculus
gggacattctcagagtttagttctt

SEQ ID NO: 627682 - DNA, 25 bp, Mus musculus
gggacattctctagtctggcgcatg

SEQ ID NO: 627683 - DNA, 25 bp, Mus musculus
gggacattctcttgtctggcgcatg

SEQ ID NO: 627684 - DNA, 25 bp, Mus musculus
gggacattctttaaccacccttgag

SEQ ID NO: 627685 - DNA, 25 bp, Mus musculus
gggacattctttacactttagatgc

SEQ ID NO: 627686 - DNA, 25 bp, Mus musculus
gggacattcttttaccacccttgag

SEQ ID NO: 627687 - DNA, 25 bp, Mus musculus
gggacattcttttcactttagatgc

SEQ ID NO: 627688 - DNA, 25 bp, Mus musculus
gggacattgagcagtactactccac

SEQ ID NO: 627689 - DNA, 25 bp, Mus musculus
gggacattgagctgtactactccac

SEQ ID NO: 627690 - DNA, 25 bp, Mus musculus
gggacattgatcatctttcggcctg

SEQ ID NO: 627691 - DNA, 25 bp, Mus musculus
gggacattgatcttctttcggcctg

SEQ ID NO: 627692 - DNA, 25 bp, Mus musculus
gggacattgcctcagagctcttcag

SEQ ID NO: 627693 - DNA, 25 bp, Mus musculus
gggacattgcctgagagctcttcag

SEQ ID NO: 627694 - DNA, 25 bp, Mus musculus
gggacattggcaatcaggcaggaaa

SEQ ID NO: 627695 - DNA, 25 bp, Mus musculus
gggacattggcattcaggcaggaaa

SEQ ID NO: 627696 - DNA, 25 bp, Mus musculus
gggacattgtgcatgtttacccctt

SEQ ID NO: 627697 - DNA, 25 bp, Mus musculus
gggacattgtgcttgtttacccctt

SEQ ID NO: 627698 - DNA, 25 bp, Mus musculus
gggacatttaaaccttcccacacct

SEQ ID NO: 627699 - DNA, 25 bp, Mus musculus
gggacatttaaagcttcccacacct

SEQ ID NO: 627700 - DNA, 25 bp, Mus musculus
gggacatttactcactgcgatatct

SEQ ID NO: 627701 - DNA, 25 bp, Mus musculus
gggacatttactgactgcgatatct

SEQ ID NO: 627702 - DNA, 25 bp, Mus musculus
gggacatttagcagtttagcttttt

SEQ ID NO: 627703 - DNA, 25 bp, Mus musculus
gggacatttagcatctcttgtaggt

SEQ ID NO: 627704 - DNA, 25 bp, Mus musculus
gggacatttagctgtttagcttttt

SEQ ID NO: 627705 - DNA, 25 bp, Mus musculus
gggacatttagcttctcttgtaggt

SEQ ID NO: 627706 - DNA, 25 bp, Mus musculus
gggacatttcacctcagtcattatt

SEQ ID NO: 627707 - DNA, 25 bp, Mus musculus
gggacatttcacgtcagtcattatt

SEQ ID NO: 627708 - DNA, 25 bp, Mus musculus
gggacatttcagagggcatataaat

SEQ ID NO: 627709 - DNA, 25 bp, Mus musculus
gggacatttcagtgggcatataaat

SEQ ID NO: 627710 - DNA, 25 bp, Mus musculus
gggacatttcatacccaaatagagg

SEQ ID NO: 627711 - DNA, 25 bp, Mus musculus
gggacatttcattcccaaatagagg

SEQ ID NO: 627712 - DNA, 25 bp, Mus musculus
gggacatttcctaaagccaatacaa

SEQ ID NO: 627713 - DNA, 25 bp, Mus musculus
gggacatttccttaagccaatacaa

SEQ ID NO: 627714 - DNA, 25 bp, Mus musculus
gggacatttgagattttctcctcca

SEQ ID NO: 627715 - DNA, 25 bp, Mus musculus
gggacatttgagtttttctcctcca

SEQ ID NO: 627716 - DNA, 25 bp, Mus musculus
gggacatttggacttatctcatatc

SEQ ID NO: 627717 - DNA, 25 bp, Mus musculus
gggacatttggagttatctcatatc

SEQ ID NO: 627718 - DNA, 25 bp, Mus musculus
gggacattttatatgctttgtactt

SEQ ID NO: 627719 - DNA, 25 bp, Mus musculus
gggacattttatcgtcaggaaacaa

SEQ ID NO: 627720 - DNA, 25 bp, Mus musculus
gggacattttatggtcaggaaacaa

SEQ ID NO: 627721 - DNA, 25 bp, Mus musculus
gggacattttatttgctttgtactt

SEQ ID NO: 627722 - DNA, 25 bp, Mus musculus
gggacattttccaaactgtacaatc

SEQ ID NO: 627723 - DNA, 25 bp, Mus musculus
gggacattttccaatccaggtgatt

SEQ ID NO: 627724 - DNA, 25 bp, Mus musculus
gggacattttcctaactgtacaatc

SEQ ID NO: 627725 - DNA, 25 bp, Mus musculus
gggacattttcctatccaggtgatt

SEQ ID NO: 627726 - DNA, 25 bp, Mus musculus
gggacattttctcctgagatgctgt

SEQ ID NO: 627727 - DNA, 25 bp, Mus musculus
gggacattttctgctgagatgctgt

SEQ ID NO: 627728 - DNA, 25 bp, Mus musculus
gggacattttgtacgcactgttaac

SEQ ID NO: 627729 - DNA, 25 bp, Mus musculus
gggacattttgttcgcactgttaac

SEQ ID NO: 627730 - DNA, 25 bp, Mus musculus
gggacatttttaagcttgactggat

SEQ ID NO: 627731 - DNA, 25 bp, Mus musculus
gggacatttttatgcttgactggat

SEQ ID NO: 627732 - DNA, 25 bp, Mus musculus
gggacatttttgacagtgattggta

SEQ ID NO: 627733 - DNA, 25 bp, Mus musculus
gggacatttttgagctaccatgtgg

SEQ ID NO: 627734 - DNA, 25 bp, Mus musculus
gggacatttttgtcagtgattggta

SEQ ID NO: 627735 - DNA, 25 bp, Mus musculus
gggacatttttgtgctaccatgtgg

SEQ ID NO: 627736 - DNA, 25 bp, Mus musculus
gggaccaaacctaatgccttgacta

SEQ ID NO: 627737 - DNA, 25 bp, Mus musculus
gggaccaaacctcagaagcagcttt

SEQ ID NO: 627738 - DNA, 25 bp, Mus musculus
gggaccaaacctgagaagcagcttt

SEQ ID NO: 627739 - DNA, 25 bp, Mus musculus
gggaccaaaccttatgccttgacta

SEQ ID NO: 627740 - DNA, 25 bp, Mus musculus
gggaccaaagctccggacccatcat

SEQ ID NO: 627741 - DNA, 25 bp, Mus musculus
gggaccaaagctgcggacccatcat

SEQ ID NO: 627742 - DNA, 25 bp, Mus musculus
gggaccaaagggatcttcatccgtg

SEQ ID NO: 627743 - DNA, 25 bp, Mus musculus
gggaccaaagggttcttcatccgtg

SEQ ID NO: 627744 - DNA, 25 bp, Mus musculus
gggaccaaagtcctgtcaccagtga

SEQ ID NO: 627745 - DNA, 25 bp, Mus musculus
gggaccaaagtcgtgtcaccagtga

SEQ ID NO: 627746 - DNA, 25 bp, Mus musculus
gggaccaacagacagcttcaccctt

SEQ ID NO: 627747 - DNA, 25 bp, Mus musculus
gggaccaacagagagcttcaccctt

SEQ ID NO: 627748 - DNA, 25 bp, Mus musculus
gggaccaacctgatctagttgtttg

SEQ ID NO: 627749 - DNA, 25 bp, Mus musculus
gggaccaacctgctttcacatatcc

SEQ ID NO: 627750 - DNA, 25 bp, Mus musculus
gggaccaacctggtttcacatatcc

SEQ ID NO: 627751 - DNA, 25 bp, Mus musculus
gggaccaacctgttctagttgtttg

SEQ ID NO: 627752 - DNA, 25 bp, Mus musculus
gggaccaacgcacctttcttaccaa

SEQ ID NO: 627753 - DNA, 25 bp, Mus musculus
gggaccaacgcagctttcttaccaa

SEQ ID NO: 627754 - DNA, 25 bp, Mus musculus
gggaccaactacagcctgcaaggat

SEQ ID NO: 627755 - DNA, 25 bp, Mus musculus
gggaccaactactgcctgcaaggat

SEQ ID NO: 627756 - DNA, 25 bp, Mus musculus
gggaccaactccatttagctgaaga

SEQ ID NO: 627757 - DNA, 25 bp, Mus musculus
gggaccaactccttttagctgaaga

SEQ ID NO: 627758 - DNA, 25 bp, Mus musculus
gggaccaacttcaggcaaacctgca

SEQ ID NO: 627759 - DNA, 25 bp, Mus musculus
gggaccaacttctggcaaacctgca

SEQ ID NO: 627760 - DNA, 25 bp, Mus musculus
gggaccaagacccaagtgctggcac

SEQ ID NO: 627761 - DNA, 25 bp, Mus musculus
gggaccaagaccgaagtgctggcac

SEQ ID NO: 627762 - DNA, 25 bp, Mus musculus
gggaccaagcaaatccagttctttt

SEQ ID NO: 627763 - DNA, 25 bp, Mus musculus
gggaccaagcaacgatactgttctg

SEQ ID NO: 627764 - DNA, 25 bp, Mus musculus
gggaccaagcaaggatactgttctg

SEQ ID NO: 627765 - DNA, 25 bp, Mus musculus
gggaccaagcaattccagttctttt

SEQ ID NO: 627766 - DNA, 25 bp, Mus musculus
gggaccaagcaccactcacgaggtt

SEQ ID NO: 627767 - DNA, 25 bp, Mus musculus
gggaccaagcacgactcacgaggtt

SEQ ID NO: 627768 - DNA, 25 bp, Mus musculus
gggaccaagctccagataagagact

SEQ ID NO: 627769 - DNA, 25 bp, Mus musculus
gggaccaagctcgagataagagact

SEQ ID NO: 627770 - DNA, 25 bp, Mus musculus
gggaccaaggcaacagctgtcagcg

SEQ ID NO: 627771 - DNA, 25 bp, Mus musculus
gggaccaaggcatcagctgtcagcg

SEQ ID NO: 627772 - DNA, 25 bp, Mus musculus
gggaccaagggtcacagcttacaag

SEQ ID NO: 627773 - DNA, 25 bp, Mus musculus
gggaccaagggtgacagcttacaag

SEQ ID NO: 627774 - DNA, 25 bp, Mus musculus
gggaccaagttaccatactggccaa

SEQ ID NO: 627775 - DNA, 25 bp, Mus musculus
gggaccaagttagcatactggccaa

SEQ ID NO: 627776 - DNA, 25 bp, Mus musculus
gggaccaataaccacaatttcttgt

SEQ ID NO: 627777 - DNA, 25 bp, Mus musculus
gggaccaataacgacaatttcttgt

SEQ ID NO: 627778 - DNA, 25 bp, Mus musculus
gggaccaatacaatgtatctgcata

SEQ ID NO: 627779 - DNA, 25 bp, Mus musculus
gggaccaatacattgtatctgcata

SEQ ID NO: 627780 - DNA, 25 bp, Mus musculus
gggaccaatgccatgtaagcctgga

SEQ ID NO: 627781 - DNA, 25 bp, Mus musculus
gggaccaatgccttgtaagcctgga

SEQ ID NO: 627782 - DNA, 25 bp, Mus musculus
gggaccaatgggacagcccctgcaa

SEQ ID NO: 627783 - DNA, 25 bp, Mus musculus
gggaccaatgggtcagcccctgcaa

SEQ ID NO: 627784 - DNA, 25 bp, Mus musculus
gggaccaatgttattaacgttgcat

SEQ ID NO: 627785 - DNA, 25 bp, Mus musculus
gggaccaatgtttttaacgttgcat

SEQ ID NO: 627786 - DNA, 25 bp, Mus musculus
gggaccaatttacaatcagttgcct

SEQ ID NO: 627787 - DNA, 25 bp, Mus musculus
gggaccaatttacacaacctgggct

SEQ ID NO: 627788 - DNA, 25 bp, Mus musculus
gggaccaatttagaatcagttgcct

SEQ ID NO: 627789 - DNA, 25 bp, Mus musculus
gggaccaatttagacaacctgggct

SEQ ID NO: 627790 - DNA, 25 bp, Mus musculus
gggaccaatttcatacttacagata

SEQ ID NO: 627791 - DNA, 25 bp, Mus musculus
gggaccaatttcttacttacagata

SEQ ID NO: 627792 - DNA, 25 bp, Mus musculus
gggaccacaacaatgagctctctaa

SEQ ID NO: 627793 - DNA, 25 bp, Mus musculus
gggaccacaacattgagctctctaa

SEQ ID NO: 627794 - DNA, 25 bp, Mus musculus
gggaccacaagcatgacaaccgcat

SEQ ID NO: 627795 - DNA, 25 bp, Mus musculus
gggaccacaagcttgacaaccgcat

SEQ ID NO: 627796 - DNA, 25 bp, Mus musculus
gggaccacaaggactccagggagca

SEQ ID NO: 627797 - DNA, 25 bp, Mus musculus
gggaccacaaggtctccagggagca

SEQ ID NO: 627798 - DNA, 25 bp, Mus musculus
gggaccacacaaaataggccgttgg

SEQ ID NO: 627799 - DNA, 25 bp, Mus musculus
gggaccacacaatataggccgttgg

SEQ ID NO: 627800 - DNA, 25 bp, Mus musculus
gggaccacacacatgtagcatgcat

SEQ ID NO: 627801 - DNA, 25 bp, Mus musculus
gggaccacacacttgtagcatgcat

SEQ ID NO: 627802 - DNA, 25 bp, Mus musculus
gggaccacacgaagctgatcctcag

SEQ ID NO: 627803 - DNA, 25 bp, Mus musculus
gggaccacacgatgctgatcctcag

SEQ ID NO: 627804 - DNA, 25 bp, Mus musculus
gggaccacagcaaagagtctgcctt

SEQ ID NO: 627805 - DNA, 25 bp, Mus musculus
gggaccacagcatagagtctgcctt

SEQ ID NO: 627806 - DNA, 25 bp, Mus musculus
gggaccacaggcacaagctacttaa

SEQ ID NO: 627807 - DNA, 25 bp, Mus musculus
gggaccacaggcaccagatctttgg

SEQ ID NO: 627808 - DNA, 25 bp, Mus musculus
gggaccacaggctcaagctacttaa

SEQ ID NO: 627809 - DNA, 25 bp, Mus musculus
gggaccacaggctccagatctttgg

SEQ ID NO: 627810 - DNA, 25 bp, Mus musculus
gggaccacattcaaggtatcaggct

SEQ ID NO: 627811 - DNA, 25 bp, Mus musculus
gggaccacattctaggtatcaggct

SEQ ID NO: 627812 - DNA, 25 bp, Mus musculus
gggaccaccctcaatatatctggat

SEQ ID NO: 627813 - DNA, 25 bp, Mus musculus
gggaccaccctctatatatctggat

SEQ ID NO: 627814 - DNA, 25 bp, Mus musculus
gggaccacgcaccttcactaagagt

SEQ ID NO: 627815 - DNA, 25 bp, Mus musculus
gggaccacgcacgttcactaagagt

SEQ ID NO: 627816 - DNA, 25 bp, Mus musculus
gggaccactaaacatctccaggcac

SEQ ID NO: 627817 - DNA, 25 bp, Mus musculus
gggaccactaaagatctccaggcac

SEQ ID NO: 627818 - DNA, 25 bp, Mus musculus
gggaccactaagatcacatcaactc

SEQ ID NO: 627819 - DNA, 25 bp, Mus musculus
gggaccactaagttcacatcaactc

SEQ ID NO: 627820 - DNA, 25 bp, Mus musculus
gggaccactatgagcagctgacagc

SEQ ID NO: 627821 - DNA, 25 bp, Mus musculus
gggaccactatgtgcagctgacagc

SEQ ID NO: 627822 - DNA, 25 bp, Mus musculus
gggaccactcaacaaagatcgcatt

SEQ ID NO: 627823 - DNA, 25 bp, Mus musculus
gggaccactcaagaaagatcgcatt

SEQ ID NO: 627824 - DNA, 25 bp, Mus musculus
gggaccactcctaatcgcaaagagg

SEQ ID NO: 627825 - DNA, 25 bp, Mus musculus
gggaccactccttatcgcaaagagg

SEQ ID NO: 627826 - DNA, 25 bp, Mus musculus
gggaccactctgaaaacagcatcct

SEQ ID NO: 627827 - DNA, 25 bp, Mus musculus
gggaccactctgtaaacagcatcct

SEQ ID NO: 627828 - DNA, 25 bp, Mus musculus
gggaccactcttagaagcatgccaa

SEQ ID NO: 627829 - DNA, 25 bp, Mus musculus
gggaccactcttctggaaactgtga

SEQ ID NO: 627830 - DNA, 25 bp, Mus musculus
gggaccactcttgtggaaactgtga

SEQ ID NO: 627831 - DNA, 25 bp, Mus musculus
gggaccactctttgaagcatgccaa

SEQ ID NO: 627832 - DNA, 25 bp, Mus musculus
gggaccactgtcatagctgagtagt

SEQ ID NO: 627833 - DNA, 25 bp, Mus musculus
gggaccactgtcttagctgagtagt

SEQ ID NO: 627834 - DNA, 25 bp, Mus musculus
gggaccacttatatatatcatcata

SEQ ID NO: 627835 - DNA, 25 bp, Mus musculus
gggaccacttatttatatcatcata

SEQ ID NO: 627836 - DNA, 25 bp, Mus musculus
gggaccacttgactctggaaactat

SEQ ID NO: 627837 - DNA, 25 bp, Mus musculus
gggaccacttgagtctggaaactat

SEQ ID NO: 627838 - DNA, 25 bp, Mus musculus
gggaccactttgatcatctgggttc

SEQ ID NO: 627839 - DNA, 25 bp, Mus musculus
gggaccactttgttcatctgggttc

SEQ ID NO: 627840 - DNA, 25 bp, Mus musculus
gggaccagaactcccggatgctgcc

SEQ ID NO: 627841 - DNA, 25 bp, Mus musculus
gggaccagaactgccggatgctgcc

SEQ ID NO: 627842 - DNA, 25 bp, Mus musculus
gggaccagacaaaatcagctttcat

SEQ ID NO: 627843 - DNA, 25 bp, Mus musculus
gggaccagacaatatcagctttcat

SEQ ID NO: 627844 - DNA, 25 bp, Mus musculus
gggaccagagacagtcagcacagaa

SEQ ID NO: 627845 - DNA, 25 bp, Mus musculus
gggaccagagactgtcagcacagaa

SEQ ID NO: 627846 - DNA, 25 bp, Mus musculus
gggaccagagcaacgcagtggccac

SEQ ID NO: 627847 - DNA, 25 bp, Mus musculus
gggaccagagcatcgcagtggccac

SEQ ID NO: 627848 - DNA, 25 bp, Mus musculus
gggaccagaggacgaccttgaccac

SEQ ID NO: 627849 - DNA, 25 bp, Mus musculus
gggaccagaggaggaccttgaccac

SEQ ID NO: 627850 - DNA, 25 bp, Mus musculus
gggaccagatggcacctttgcccat

SEQ ID NO: 627851 - DNA, 25 bp, Mus musculus
gggaccagatgggacctttgcccat

SEQ ID NO: 627852 - DNA, 25 bp, Mus musculus
gggaccagatgtcactctgcagcag

SEQ ID NO: 627853 - DNA, 25 bp, Mus musculus
gggaccagatgtgactctgcagcag

SEQ ID NO: 627854 - DNA, 25 bp, Mus musculus
gggaccagccgtaggacgcaatgat

SEQ ID NO: 627855 - DNA, 25 bp, Mus musculus
gggaccagccgttggacgcaatgat

SEQ ID NO: 627856 - DNA, 25 bp, Mus musculus
gggaccagctccacctggaaatgtt

SEQ ID NO: 627857 - DNA, 25 bp, Mus musculus
gggaccagctcctcctggaaatgtt

SEQ ID NO: 627858 - DNA, 25 bp, Mus musculus
gggaccagctctctgtagcaccctg

SEQ ID NO: 627859 - DNA, 25 bp, Mus musculus
gggaccagctctgtgtagcaccctg

SEQ ID NO: 627860 - DNA, 25 bp, Mus musculus
gggaccagctttcagtttgcactag

SEQ ID NO: 627861 - DNA, 25 bp, Mus musculus
gggaccagctttgagtttgcactag

SEQ ID NO: 627862 - DNA, 25 bp, Mus musculus
gggaccaggactaaacggcaccaga

SEQ ID NO: 627863 - DNA, 25 bp, Mus musculus
gggaccaggactatactacgtagat

SEQ ID NO: 627864 - DNA, 25 bp, Mus musculus
gggaccaggacttaacggcaccaga

SEQ ID NO: 627865 - DNA, 25 bp, Mus musculus
gggaccaggactttactacgtagat

SEQ ID NO: 627866 - DNA, 25 bp, Mus musculus
gggaccaggagcctctcacagtact

SEQ ID NO: 627867 - DNA, 25 bp, Mus musculus
gggaccaggagcgtctcacagtact

SEQ ID NO: 627868 - DNA, 25 bp, Mus musculus
gggaccaggccaactttggtatgaa

SEQ ID NO: 627869 - DNA, 25 bp, Mus musculus
gggaccaggccatctttggtatgaa

SEQ ID NO: 627870 - DNA, 25 bp, Mus musculus
gggaccaggcccaggaagatgccca

SEQ ID NO: 627871 - DNA, 25 bp, Mus musculus
gggaccaggccctggaagatgccca

SEQ ID NO: 627872 - DNA, 25 bp, Mus musculus
gggaccaggtaccatgcttaggcta

SEQ ID NO: 627873 - DNA, 25 bp, Mus musculus
gggaccaggtacgatgcttaggcta

SEQ ID NO: 627874 - DNA, 25 bp, Mus musculus
gggaccaggtctctacattcagtga

SEQ ID NO: 627875 - DNA, 25 bp, Mus musculus
gggaccaggtctgtacattcagtga

SEQ ID NO: 627876 - DNA, 25 bp, Mus musculus
gggaccaggtgcaaatctctacaga

SEQ ID NO: 627877 - DNA, 25 bp, Mus musculus
gggaccaggtgcacactgtggacac

SEQ ID NO: 627878 - DNA, 25 bp, Mus musculus
gggaccaggtgctaatctctacaga

SEQ ID NO: 627879 - DNA, 25 bp, Mus musculus
gggaccaggtgctcactgtggacac

SEQ ID NO: 627880 - DNA, 25 bp, Mus musculus
gggaccagtacacatttgatcgaat

SEQ ID NO: 627881 - DNA, 25 bp, Mus musculus
gggaccagtacagatttgatcgaat

SEQ ID NO: 627882 - DNA, 25 bp, Mus musculus
gggaccagtcatcagactccttgaa

SEQ ID NO: 627883 - DNA, 25 bp, Mus musculus
gggaccagtcatgagactccttgaa

SEQ ID NO: 627884 - DNA, 25 bp, Mus musculus
gggaccagtcccagtatctatttaa

SEQ ID NO: 627885 - DNA, 25 bp, Mus musculus
gggaccagtccctgtatctatttaa

SEQ ID NO: 627886 - DNA, 25 bp, Mus musculus
gggaccagtctactctgtgtagcat

SEQ ID NO: 627887 - DNA, 25 bp, Mus musculus
gggaccagtctagtctgtgtagcat

SEQ ID NO: 627888 - DNA, 25 bp, Mus musculus
gggaccagtgcgacactcagtaaag

SEQ ID NO: 627889 - DNA, 25 bp, Mus musculus
gggaccagtgcgtcactcagtaaag

SEQ ID NO: 627890 - DNA, 25 bp, Mus musculus
gggaccagtgctcttattcacacag

SEQ ID NO: 627891 - DNA, 25 bp, Mus musculus
gggaccagtgctgttattcacacag

SEQ ID NO: 627892 - DNA, 25 bp, Mus musculus
gggaccatacaaacatcctaaagga

SEQ ID NO: 627893 - DNA, 25 bp, Mus musculus
gggaccatacaatcatcctaaagga

SEQ ID NO: 627894 - DNA, 25 bp, Mus musculus
gggaccatacacaccatatctttca

SEQ ID NO: 627895 - DNA, 25 bp, Mus musculus
gggaccatacactccatatctttca

SEQ ID NO: 627896 - DNA, 25 bp, Mus musculus
gggaccatagaaccaagatgcactt

SEQ ID NO: 627897 - DNA, 25 bp, Mus musculus
gggaccatagaagcaagatgcactt

SEQ ID NO: 627898 - DNA, 25 bp, Mus musculus
gggaccataggaatcatgatttctg

SEQ ID NO: 627899 - DNA, 25 bp, Mus musculus
gggaccataggattcatgatttctg

SEQ ID NO: 627900 - DNA, 25 bp, Mus musculus
gggaccataggtctaaatcatggca

SEQ ID NO: 627901 - DNA, 25 bp, Mus musculus
gggaccataggtgtaaatcatggca

SEQ ID NO: 627902 - DNA, 25 bp, Mus musculus
gggaccatcagacaagagcctcatc

SEQ ID NO: 627903 - DNA, 25 bp, Mus musculus
gggaccatcagagaagagcctcatc

SEQ ID NO: 627904 - DNA, 25 bp, Mus musculus
gggaccatccataccatatctctca

SEQ ID NO: 627905 - DNA, 25 bp, Mus musculus
gggaccatccattccatatctctca

SEQ ID NO: 627906 - DNA, 25 bp, Mus musculus
gggaccatcctccaaggctaaatac

SEQ ID NO: 627907 - DNA, 25 bp, Mus musculus
gggaccatcctcgaaggctaaatac

SEQ ID NO: 627908 - DNA, 25 bp, Mus musculus
gggaccatctacctgacggctgagc

SEQ ID NO: 627909 - DNA, 25 bp, Mus musculus
gggaccatctacgtgacggctgagc

SEQ ID NO: 627910 - DNA, 25 bp, Mus musculus
gggaccatctttccaagtgatcaca

SEQ ID NO: 627911 - DNA, 25 bp, Mus musculus
gggaccatctttgcaagtgatcaca

SEQ ID NO: 627912 - DNA, 25 bp, Mus musculus
gggaccatgagaaagggtgaaacca

SEQ ID NO: 627913 - DNA, 25 bp, Mus musculus
gggaccatgagatagggtgaaacca

SEQ ID NO: 627914 - DNA, 25 bp, Mus musculus
gggaccatgatgactcatccagtcc

SEQ ID NO: 627915 - DNA, 25 bp, Mus musculus
gggaccatgatgattggctaccagc

SEQ ID NO: 627916 - DNA, 25 bp, Mus musculus
gggaccatgatgtctcatccagtcc

SEQ ID NO: 627917 - DNA, 25 bp, Mus musculus
gggaccatgatgtttggctaccagc

SEQ ID NO: 627918 - DNA, 25 bp, Mus musculus
gggaccatgcacaactgagcctgag

SEQ ID NO: 627919 - DNA, 25 bp, Mus musculus
gggaccatgcactactgagcctgag

SEQ ID NO: 627920 - DNA, 25 bp, Mus musculus
gggaccatgccacatgcaaacttgg

SEQ ID NO: 627921 - DNA, 25 bp, Mus musculus
gggaccatgccagatgcaaacttgg

SEQ ID NO: 627922 - DNA, 25 bp, Mus musculus
gggaccatgctactcatttgctgcc

SEQ ID NO: 627923 - DNA, 25 bp, Mus musculus
gggaccatgctagtcatttgctgcc

SEQ ID NO: 627924 - DNA, 25 bp, Mus musculus
gggaccatgcttatctacagttcca

SEQ ID NO: 627925 - DNA, 25 bp, Mus musculus
gggaccatgcttttctacagttcca

SEQ ID NO: 627926 - DNA, 25 bp, Mus musculus
gggaccatggttatattcacggtgt

SEQ ID NO: 627927 - DNA, 25 bp, Mus musculus
gggaccatggttttattcacggtgt

SEQ ID NO: 627928 - DNA, 25 bp, Mus musculus
gggaccatgtcaccaactatcttaa

SEQ ID NO: 627929 - DNA, 25 bp, Mus musculus
gggaccatgtcagcaactatcttaa

SEQ ID NO: 627930 - DNA, 25 bp, Mus musculus
gggaccatgttcaccggcttcggag

SEQ ID NO: 627931 - DNA, 25 bp, Mus musculus
gggaccatgttctccggcttcggag

SEQ ID NO: 627932 - DNA, 25 bp, Mus musculus
gggaccattcagctgacagttgttg

SEQ ID NO: 627933 - DNA, 25 bp, Mus musculus
gggaccattcaggtgacagttgttg

SEQ ID NO: 627934 - DNA, 25 bp, Mus musculus
gggaccattccaatcaggaacaaga

SEQ ID NO: 627935 - DNA, 25 bp, Mus musculus
gggaccattccattcaggaacaaga

SEQ ID NO: 627936 - DNA, 25 bp, Mus musculus
gggaccattccccaaatcattcatg

SEQ ID NO: 627937 - DNA, 25 bp, Mus musculus
gggaccattcccgaaatcattcatg

SEQ ID NO: 627938 - DNA, 25 bp, Mus musculus
gggaccattctcaaacaccgggcac

SEQ ID NO: 627939 - DNA, 25 bp, Mus musculus
gggaccattctctaacaccgggcac

SEQ ID NO: 627940 - DNA, 25 bp, Mus musculus
gggaccattgccctccggtaatcgt

SEQ ID NO: 627941 - DNA, 25 bp, Mus musculus
gggaccattgccgtccggtaatcgt

SEQ ID NO: 627942 - DNA, 25 bp, Mus musculus
gggaccattgtaaccttagccattg

SEQ ID NO: 627943 - DNA, 25 bp, Mus musculus
gggaccattgtatccttagccattg

SEQ ID NO: 627944 - DNA, 25 bp, Mus musculus
gggaccatttaacttactgctagtt

SEQ ID NO: 627945 - DNA, 25 bp, Mus musculus
gggaccatttaagttactgctagtt

SEQ ID NO: 627946 - DNA, 25 bp, Mus musculus
gggaccatttcaagcactgacctat

SEQ ID NO: 627947 - DNA, 25 bp, Mus musculus
gggaccatttcatgcactgacctat

SEQ ID NO: 627948 - DNA, 25 bp, Mus musculus
gggaccatttgcattagatcacata

SEQ ID NO: 627949 - DNA, 25 bp, Mus musculus
gggaccatttgctttagatcacata

SEQ ID NO: 627950 - DNA, 25 bp, Mus musculus
gggaccattttaaccctgatggagc

SEQ ID NO: 627951 - DNA, 25 bp, Mus musculus
gggaccattttatccctgatggagc

SEQ ID NO: 627952 - DNA, 25 bp, Mus musculus
gggacccaaaatccttgaacagagt

SEQ ID NO: 627953 - DNA, 25 bp, Mus musculus
gggacccaaaatgcttgaacagagt

SEQ ID NO: 627954 - DNA, 25 bp, Mus musculus
gggacccaatatattgtttctctga

SEQ ID NO: 627955 - DNA, 25 bp, Mus musculus
gggacccaatattttgtttctctga

SEQ ID NO: 627956 - DNA, 25 bp, Mus musculus
gggacccaattacagtgtgccacca

SEQ ID NO: 627957 - DNA, 25 bp, Mus musculus
gggacccaattagagtgtgccacca

SEQ ID NO: 627958 - DNA, 25 bp, Mus musculus
gggacccaattccatttctgccgtg

SEQ ID NO: 627959 - DNA, 25 bp, Mus musculus
gggacccaattcgatttctgccgtg

SEQ ID NO: 627960 - DNA, 25 bp, Mus musculus
gggacccacactccacaattaggag

SEQ ID NO: 627961 - DNA, 25 bp, Mus musculus
gggacccacactgcacaattaggag

SEQ ID NO: 627962 - DNA, 25 bp, Mus musculus
gggacccacaggagacaaacatgaa

SEQ ID NO: 627963 - DNA, 25 bp, Mus musculus
gggacccacaggtgacaaacatgaa

SEQ ID NO: 627964 - DNA, 25 bp, Mus musculus
gggacccacatactgtcaagagaga

SEQ ID NO: 627965 - DNA, 25 bp, Mus musculus
gggacccacatagtgtcaagagaga

SEQ ID NO: 627966 - DNA, 25 bp, Mus musculus
gggacccacatcctttgttagagtc

SEQ ID NO: 627967 - DNA, 25 bp, Mus musculus
gggacccacatcgtttgttagagtc

SEQ ID NO: 627968 - DNA, 25 bp, Mus musculus
gggacccaccagcataaaccaagtg

SEQ ID NO: 627969 - DNA, 25 bp, Mus musculus
gggacccaccaggataaaccaagtg

SEQ ID NO: 627970 - DNA, 25 bp, Mus musculus
gggacccacgctcaagactggtgaa

SEQ ID NO: 627971 - DNA, 25 bp, Mus musculus
gggacccacgctgaagactggtgaa

SEQ ID NO: 627972 - DNA, 25 bp, Mus musculus
gggacccacgttatagatgcattga

SEQ ID NO: 627973 - DNA, 25 bp, Mus musculus
gggacccacgttttagatgcattga

SEQ ID NO: 627974 - DNA, 25 bp, Mus musculus
gggacccacttgaggcttcccacgt

SEQ ID NO: 627975 - DNA, 25 bp, Mus musculus
gggacccacttgtggcttcccacgt

SEQ ID NO: 627976 - DNA, 25 bp, Mus musculus
gggacccagaagacatcggctaaga

SEQ ID NO: 627977 - DNA, 25 bp, Mus musculus
gggacccagaagtcatcggctaaga

SEQ ID NO: 627978 - DNA, 25 bp, Mus musculus
gggacccagaatctccgtgctccgg

SEQ ID NO: 627979 - DNA, 25 bp, Mus musculus
gggacccagaatgtccgtgctccgg

SEQ ID NO: 627980 - DNA, 25 bp, Mus musculus
gggacccagacccatgtttgagcca

SEQ ID NO: 627981 - DNA, 25 bp, Mus musculus
gggacccagaccgatgtttgagcca

SEQ ID NO: 627982 - DNA, 25 bp, Mus musculus
gggacccagatcatcacccagatgg

SEQ ID NO: 627983 - DNA, 25 bp, Mus musculus
gggacccagatcttcacccagatgg

SEQ ID NO: 627984 - DNA, 25 bp, Mus musculus
gggacccagcagagagtgttgggca

SEQ ID NO: 627985 - DNA, 25 bp, Mus musculus
gggacccagcagcaaaggcctgtta

SEQ ID NO: 627986 - DNA, 25 bp, Mus musculus
gggacccagcaggaaaggcctgtta

SEQ ID NO: 627987 - DNA, 25 bp, Mus musculus
gggacccagcagtgagtgttgggca

SEQ ID NO: 627988 - DNA, 25 bp, Mus musculus
gggacccagctgaacagcaagacgc

SEQ ID NO: 627989 - DNA, 25 bp, Mus musculus
gggacccagctgtacagcaagacgc

SEQ ID NO: 627990 - DNA, 25 bp, Mus musculus
gggacccagcttagaagcgcaaggc

SEQ ID NO: 627991 - DNA, 25 bp, Mus musculus
gggacccagctttgaagcgcaaggc

SEQ ID NO: 627992 - DNA, 25 bp, Mus musculus
gggacccaggcaaatgacaataaga

SEQ ID NO: 627993 - DNA, 25 bp, Mus musculus
gggacccaggcacttgtttacagac

SEQ ID NO: 627994 - DNA, 25 bp, Mus musculus
gggacccaggcagttgtttacagac

SEQ ID NO: 627995 - DNA, 25 bp, Mus musculus
gggacccaggcatatgacaataaga

SEQ ID NO: 627996 - DNA, 25 bp, Mus musculus
gggacccaggcgacatggaactaca

SEQ ID NO: 627997 - DNA, 25 bp, Mus musculus
gggacccaggcgtcatggaactaca

SEQ ID NO: 627998 - DNA, 25 bp, Mus musculus
gggacccagggaacacaggatacat

SEQ ID NO: 627999 - DNA, 25 bp, Mus musculus
gggacccagggatcacaggatacat

SEQ ID NO: 628000 - DNA, 25 bp, Mus musculus
gggacccagggcaatagcacaatgt

SEQ ID NO: 628001 - DNA, 25 bp, Mus musculus
gggacccagggctatagcacaatgt

SEQ ID NO: 628002 - DNA, 25 bp, Mus musculus
gggacccaggttctactcaaagcga

SEQ ID NO: 628003 - DNA, 25 bp, Mus musculus
gggacccaggttgtactcaaagcga

SEQ ID NO: 628004 - DNA, 25 bp, Mus musculus
gggaccccaaagagccagctgatga

SEQ ID NO: 628005 - DNA, 25 bp, Mus musculus
gggaccccaaagtgccagctgatga

SEQ ID NO: 628006 - DNA, 25 bp, Mus musculus
gggaccccaagcaggccatccggga

SEQ ID NO: 628007 - DNA, 25 bp, Mus musculus
gggaccccaagctggccatccggga

SEQ ID NO: 628008 - DNA, 25 bp, Mus musculus
gggaccccacaaatgtatataatgc

SEQ ID NO: 628009 - DNA, 25 bp, Mus musculus
gggaccccacaattgtatataatgc

SEQ ID NO: 628010 - DNA, 25 bp, Mus musculus
gggaccccacgaatggcttgcagaa

SEQ ID NO: 628011 - DNA, 25 bp, Mus musculus
gggaccccacgattggcttgcagaa

SEQ ID NO: 628012 - DNA, 25 bp, Mus musculus
gggaccccacggagaatcaattcaa

SEQ ID NO: 628013 - DNA, 25 bp, Mus musculus
gggaccccacggtgaatcaattcaa

SEQ ID NO: 628014 - DNA, 25 bp, Mus musculus
gggaccccagatatatgcttgtaat

SEQ ID NO: 628015 - DNA, 25 bp, Mus musculus
gggaccccagatttatgcttgtaat

SEQ ID NO: 628016 - DNA, 25 bp, Mus musculus
gggaccccaggactattctgaggat

SEQ ID NO: 628017 - DNA, 25 bp, Mus musculus
gggaccccaggagtattctgaggat

SEQ ID NO: 628018 - DNA, 25 bp, Mus musculus
gggacccctataccacagacaaaac

SEQ ID NO: 628019 - DNA, 25 bp, Mus musculus
gggacccctatagcacagacaaaac

SEQ ID NO: 628020 - DNA, 25 bp, Mus musculus
gggacccctctaagatgaagtacaa

SEQ ID NO: 628021 - DNA, 25 bp, Mus musculus
gggacccctctatgatgaagtacaa

SEQ ID NO: 628022 - DNA, 25 bp, Mus musculus
gggacccctgaaagatgctggaagt

SEQ ID NO: 628023 - DNA, 25 bp, Mus musculus
gggacccctgaatgatgctggaagt

SEQ ID NO: 628024 - DNA, 25 bp, Mus musculus
gggacccctgcacagaaagctagaa

SEQ ID NO: 628025 - DNA, 25 bp, Mus musculus
gggacccctgcagagaaagctagaa

SEQ ID NO: 628026 - DNA, 25 bp, Mus musculus
gggacccgagccagccaggccatgt

SEQ ID NO: 628027 - DNA, 25 bp, Mus musculus
gggacccgagcctgccaggccatgt

SEQ ID NO: 628028 - DNA, 25 bp, Mus musculus
gggacccggaacacacatgtccgag

SEQ ID NO: 628029 - DNA, 25 bp, Mus musculus
gggacccggaactcacatgtccgag

SEQ ID NO: 628030 - DNA, 25 bp, Mus musculus
gggacccggaatctactcagtgatc

SEQ ID NO: 628031 - DNA, 25 bp, Mus musculus
gggacccggaatgtactcagtgatc

SEQ ID NO: 628032 - DNA, 25 bp, Mus musculus
gggaccctaactctatggaccatct

SEQ ID NO: 628033 - DNA, 25 bp, Mus musculus
gggaccctaactgtatggaccatct

SEQ ID NO: 628034 - DNA, 25 bp, Mus musculus
gggaccctaagtataactgagagtc

SEQ ID NO: 628035 - DNA, 25 bp, Mus musculus
gggaccctaagtttaactgagagtc

SEQ ID NO: 628036 - DNA, 25 bp, Mus musculus
gggaccctaggtcaagtcaccacaa

SEQ ID NO: 628037 - DNA, 25 bp, Mus musculus
gggaccctaggtgaagtcaccacaa

SEQ ID NO: 628038 - DNA, 25 bp, Mus musculus
gggaccctcaccctttgtgtgaaag

SEQ ID NO: 628039 - DNA, 25 bp, Mus musculus
gggaccctcaccgtttgtgtgaaag

SEQ ID NO: 628040 - DNA, 25 bp, Mus musculus
gggaccctcagactcatttatgaat

SEQ ID NO: 628041 - DNA, 25 bp, Mus musculus
gggaccctcagagtcatttatgaat

SEQ ID NO: 628042 - DNA, 25 bp, Mus musculus
gggaccctcatcaacaacgtagaga

SEQ ID NO: 628043 - DNA, 25 bp, Mus musculus
gggaccctcatctacaacgtagaga

SEQ ID NO: 628044 - DNA, 25 bp, Mus musculus
gggaccctccagctaagtatggaat

SEQ ID NO: 628045 - DNA, 25 bp, Mus musculus
gggaccctccaggtaagtatggaat

SEQ ID NO: 628046 - DNA, 25 bp, Mus musculus
gggaccctccctcctagctggttgg

SEQ ID NO: 628047 - DNA, 25 bp, Mus musculus
gggaccctccctgctagctggttgg

SEQ ID NO: 628048 - DNA, 25 bp, Mus musculus
gggaccctcctgaaatacaatgtta

SEQ ID NO: 628049 - DNA, 25 bp, Mus musculus
gggaccctcctgtaatacaatgtta

SEQ ID NO: 628050 - DNA, 25 bp, Mus musculus
gggaccctcggaagttacattcatc

SEQ ID NO: 628051 - DNA, 25 bp, Mus musculus
gggaccctcggatgttacattcatc

SEQ ID NO: 628052 - DNA, 25 bp, Mus musculus
gggaccctctgaaccgagtcctggc

SEQ ID NO: 628053 - DNA, 25 bp, Mus musculus
gggaccctctgatccgagtcctggc

SEQ ID NO: 628054 - DNA, 25 bp, Mus musculus
gggaccctctggcattagtgtcaga

SEQ ID NO: 628055 - DNA, 25 bp, Mus musculus
gggaccctctgggattagtgtcaga

SEQ ID NO: 628056 - DNA, 25 bp, Mus musculus
gggaccctgaacaatggccactctg

SEQ ID NO: 628057 - DNA, 25 bp, Mus musculus
gggaccctgaacatggaggcctctt

SEQ ID NO: 628058 - DNA, 25 bp, Mus musculus
gggaccctgaactatggccactctg

SEQ ID NO: 628059 - DNA, 25 bp, Mus musculus
gggaccctgaacttggaggcctctt

SEQ ID NO: 628060 - DNA, 25 bp, Mus musculus
gggaccctgaatcatgatgcaacta

SEQ ID NO: 628061 - DNA, 25 bp, Mus musculus
gggaccctgaatgatgatgcaacta

SEQ ID NO: 628062 - DNA, 25 bp, Mus musculus
gggaccctgacaacgaagttgttga

SEQ ID NO: 628063 - DNA, 25 bp, Mus musculus
gggaccctgacatcgaagttgttga

SEQ ID NO: 628064 - DNA, 25 bp, Mus musculus
gggaccctgacgaccatcatggatc

SEQ ID NO: 628065 - DNA, 25 bp, Mus musculus
gggaccctgacgtccatcatggatc

SEQ ID NO: 628066 - DNA, 25 bp, Mus musculus
gggaccctgagacacttccctgttc

SEQ ID NO: 628067 - DNA, 25 bp, Mus musculus
gggaccctgagagacttccctgttc

SEQ ID NO: 628068 - DNA, 25 bp, Mus musculus
gggaccctgcacaacactagaataa

SEQ ID NO: 628069 - DNA, 25 bp, Mus musculus
gggaccctgcactacactagaataa

SEQ ID NO: 628070 - DNA, 25 bp, Mus musculus
gggaccctggacatatcaaacaagc

SEQ ID NO: 628071 - DNA, 25 bp, Mus musculus
gggaccctggacttatcaaacaagc

SEQ ID NO: 628072 - DNA, 25 bp, Mus musculus
gggaccctggtgaaacttgttccat

SEQ ID NO: 628073 - DNA, 25 bp, Mus musculus
gggaccctggtgattcacaagcaat

SEQ ID NO: 628074 - DNA, 25 bp, Mus musculus
gggaccctggtgtaacttgttccat

SEQ ID NO: 628075 - DNA, 25 bp, Mus musculus
gggaccctggtgtttcacaagcaat

SEQ ID NO: 628076 - DNA, 25 bp, Mus musculus
gggaccctggttagaggcaatcctt

SEQ ID NO: 628077 - DNA, 25 bp, Mus musculus
gggaccctggtttgaggcaatcctt

SEQ ID NO: 628078 - DNA, 25 bp, Mus musculus
gggacccttccgagacatcaatgaa

SEQ ID NO: 628079 - DNA, 25 bp, Mus musculus
gggacccttccgtgacatcaatgaa

SEQ ID NO: 628080 - DNA, 25 bp, Mus musculus
gggaccctttaaaactgcagcctca

SEQ ID NO: 628081 - DNA, 25 bp, Mus musculus
gggaccctttaatactgcagcctca

SEQ ID NO: 628082 - DNA, 25 bp, Mus musculus
gggacccttttcacaccagcagagg

SEQ ID NO: 628083 - DNA, 25 bp, Mus musculus
gggacccttttccaagctcctgcag

SEQ ID NO: 628084 - DNA, 25 bp, Mus musculus
gggacccttttcgaagctcctgcag

SEQ ID NO: 628085 - DNA, 25 bp, Mus musculus
gggacccttttctcaccagcagagg

SEQ ID NO: 628086 - DNA, 25 bp, Mus musculus
gggacccttttgatagtcctctaga

SEQ ID NO: 628087 - DNA, 25 bp, Mus musculus
gggacccttttgttagtcctctaga

SEQ ID NO: 628088 - DNA, 25 bp, Mus musculus
gggaccctttttcctacagacagta

SEQ ID NO: 628089 - DNA, 25 bp, Mus musculus
gggaccctttttgctacagacagta

SEQ ID NO: 628090 - DNA, 25 bp, Mus musculus
gggaccgaaccccacatggtcagtc

SEQ ID NO: 628091 - DNA, 25 bp, Mus musculus
gggaccgaacccgacatggtcagtc

SEQ ID NO: 628092 - DNA, 25 bp, Mus musculus
gggaccgacagcaagctatccttaa

SEQ ID NO: 628093 - DNA, 25 bp, Mus musculus
gggaccgacagctagctatccttaa

SEQ ID NO: 628094 - DNA, 25 bp, Mus musculus
gggaccgacctaccagatttgagga

SEQ ID NO: 628095 - DNA, 25 bp, Mus musculus
gggaccgacctagcagatttgagga

SEQ ID NO: 628096 - DNA, 25 bp, Mus musculus
gggaccgacttgatctgttactcac

SEQ ID NO: 628097 - DNA, 25 bp, Mus musculus
gggaccgacttgttctgttactcac

SEQ ID NO: 628098 - DNA, 25 bp, Mus musculus
gggaccgagatgacttaccttaaat

SEQ ID NO: 628099 - DNA, 25 bp, Mus musculus
gggaccgagatgtcttaccttaaat

SEQ ID NO: 628100 - DNA, 25 bp, Mus musculus
gggaccgatgtgctatctgtgactt

SEQ ID NO: 628101 - DNA, 25 bp, Mus musculus
gggaccgatgtggtatctgtgactt

SEQ ID NO: 628102 - DNA, 25 bp, Mus musculus
gggaccgcagtaattatggaccttt

SEQ ID NO: 628103 - DNA, 25 bp, Mus musculus
gggaccgcagtatttatggaccttt

SEQ ID NO: 628104 - DNA, 25 bp, Mus musculus
gggaccgccttcacagtgggctctg

SEQ ID NO: 628105 - DNA, 25 bp, Mus musculus
gggaccgccttctcagtgggctctg

SEQ ID NO: 628106 - DNA, 25 bp, Mus musculus
gggaccgcgccacggccatggaagc

SEQ ID NO: 628107 - DNA, 25 bp, Mus musculus
gggaccgcgccagggccatggaagc

SEQ ID NO: 628108 - DNA, 25 bp, Mus musculus
gggaccgcttgtctgcaccacagat

SEQ ID NO: 628109 - DNA, 25 bp, Mus musculus
gggaccgcttgtgtgcaccacagat

SEQ ID NO: 628110 - DNA, 25 bp, Mus musculus
gggaccggatcaacaatgccttctt

SEQ ID NO: 628111 - DNA, 25 bp, Mus musculus
gggaccggatcatcaatgccttctt

SEQ ID NO: 628112 - DNA, 25 bp, Mus musculus
gggaccggcaagcagcagcctcagc

SEQ ID NO: 628113 - DNA, 25 bp, Mus musculus
gggaccggcaaggagcagcctcagc

SEQ ID NO: 628114 - DNA, 25 bp, Mus musculus
gggaccgggacacaagaagctccac

SEQ ID NO: 628115 - DNA, 25 bp, Mus musculus
gggaccgggacagaagaagctccac

SEQ ID NO: 628116 - DNA, 25 bp, Mus musculus
gggaccgggataacagcaccacgca

SEQ ID NO: 628117 - DNA, 25 bp, Mus musculus
gggaccgggatatcagcaccacgca

SEQ ID NO: 628118 - DNA, 25 bp, Mus musculus
gggaccggtgccagttagatgaact

SEQ ID NO: 628119 - DNA, 25 bp, Mus musculus
gggaccggtgcctgttagatgaact

SEQ ID NO: 628120 - DNA, 25 bp, Mus musculus
gggaccgtgccaagttcggaagaat

SEQ ID NO: 628121 - DNA, 25 bp, Mus musculus
gggaccgtgccatgttcggaagaat

SEQ ID NO: 628122 - DNA, 25 bp, Mus musculus
gggaccgtgtatctttataatcttt

SEQ ID NO: 628123 - DNA, 25 bp, Mus musculus
gggaccgtgtatgtttataatcttt

SEQ ID NO: 628124 - DNA, 25 bp, Mus musculus
gggacctaaagcatgcttccaggaa

SEQ ID NO: 628125 - DNA, 25 bp, Mus musculus
gggacctaaagcttgcttccaggaa

SEQ ID NO: 628126 - DNA, 25 bp, Mus musculus
gggacctaagttaccagctcagagt

SEQ ID NO: 628127 - DNA, 25 bp, Mus musculus
gggacctaagtttccagctcagagt

SEQ ID NO: 628128 - DNA, 25 bp, Mus musculus
gggacctaatcaagtacattgacag

SEQ ID NO: 628129 - DNA, 25 bp, Mus musculus
gggacctaatcatgtacattgacag

SEQ ID NO: 628130 - DNA, 25 bp, Mus musculus
gggacctacaatccttacagagtta

SEQ ID NO: 628131 - DNA, 25 bp, Mus musculus
gggacctacaatgcttacagagtta

SEQ ID NO: 628132 - DNA, 25 bp, Mus musculus
gggacctacaccatacatcagcttc

SEQ ID NO: 628133 - DNA, 25 bp, Mus musculus
gggacctacaccttacatcagcttc

SEQ ID NO: 628134 - DNA, 25 bp, Mus musculus
gggacctacagcactgtcactaaat

SEQ ID NO: 628135 - DNA, 25 bp, Mus musculus
gggacctacagcagaatagctcaga

SEQ ID NO: 628136 - DNA, 25 bp, Mus musculus
gggacctacagctctgtcactaaat

SEQ ID NO: 628137 - DNA, 25 bp, Mus musculus
gggacctacagctgaatagctcaga

SEQ ID NO: 628138 - DNA, 25 bp, Mus musculus
gggacctacgtgatcaacaagcaga

SEQ ID NO: 628139 - DNA, 25 bp, Mus musculus
gggacctacgtgttcaacaagcaga

SEQ ID NO: 628140 - DNA, 25 bp, Mus musculus
gggacctactatatctttgactgtc

SEQ ID NO: 628141 - DNA, 25 bp, Mus musculus
gggacctactatccatagcattaat

SEQ ID NO: 628142 - DNA, 25 bp, Mus musculus
gggacctactatgcatagcattaat

SEQ ID NO: 628143 - DNA, 25 bp, Mus musculus
gggacctactatttctttgactgtc

SEQ ID NO: 628144 - DNA, 25 bp, Mus musculus
gggacctactgcaatgccgagaagt

SEQ ID NO: 628145 - DNA, 25 bp, Mus musculus
gggacctactgctatgccgagaagt

SEQ ID NO: 628146 - DNA, 25 bp, Mus musculus
gggacctagaatctgctgacttatt

SEQ ID NO: 628147 - DNA, 25 bp, Mus musculus
gggacctagaatgtgctgacttatt

SEQ ID NO: 628148 - DNA, 25 bp, Mus musculus
gggacctaggatatgtcctcggatc

SEQ ID NO: 628149 - DNA, 25 bp, Mus musculus
gggacctaggatttgtcctcggatc

SEQ ID NO: 628150 - DNA, 25 bp, Mus musculus
gggacctaggcaatcaatctttaat

SEQ ID NO: 628151 - DNA, 25 bp, Mus musculus
gggacctaggcattcaatctttaat

SEQ ID NO: 628152 - DNA, 25 bp, Mus musculus
gggacctagtggcagagacctcaaa

SEQ ID NO: 628153 - DNA, 25 bp, Mus musculus
gggacctagtgggagagacctcaaa

SEQ ID NO: 628154 - DNA, 25 bp, Mus musculus
gggacctataacatcatcgctgttg

SEQ ID NO: 628155 - DNA, 25 bp, Mus musculus
gggacctataacttcatcgctgttg

SEQ ID NO: 628156 - DNA, 25 bp, Mus musculus
gggacctataggctcttgcacgtcc

SEQ ID NO: 628157 - DNA, 25 bp, Mus musculus
gggacctatagggtcttgcacgtcc

SEQ ID NO: 628158 - DNA, 25 bp, Mus musculus
gggacctatcagcaactctgcatga

SEQ ID NO: 628159 - DNA, 25 bp, Mus musculus
gggacctatcaggaactctgcatga

SEQ ID NO: 628160 - DNA, 25 bp, Mus musculus
gggacctatgcgagtgaccttgagt

SEQ ID NO: 628161 - DNA, 25 bp, Mus musculus
gggacctatgcgtgtgaccttgagt

SEQ ID NO: 628162 - DNA, 25 bp, Mus musculus
gggacctatggtcaatacacaagtg

SEQ ID NO: 628163 - DNA, 25 bp, Mus musculus
gggacctatggtgaatacacaagtg

SEQ ID NO: 628164 - DNA, 25 bp, Mus musculus
gggacctatgtgatcacagactacc

SEQ ID NO: 628165 - DNA, 25 bp, Mus musculus
gggacctatgtgctgcaggacaaca

SEQ ID NO: 628166 - DNA, 25 bp, Mus musculus
gggacctatgtggtgcaggacaaca

SEQ ID NO: 628167 - DNA, 25 bp, Mus musculus
gggacctatgtgttcacagactacc

SEQ ID NO: 628168 - DNA, 25 bp, Mus musculus
gggacctatttgcattccaaaacag

SEQ ID NO: 628169 - DNA, 25 bp, Mus musculus
gggacctatttggattccaaaacag

SEQ ID NO: 628170 - DNA, 25 bp, Mus musculus
gggacctcaatgatcccatccacca

SEQ ID NO: 628171 - DNA, 25 bp, Mus musculus
gggacctcaatgttcccatccacca

SEQ ID NO: 628172 - DNA, 25 bp, Mus musculus
gggacctcacgcagatggctgatga

SEQ ID NO: 628173 - DNA, 25 bp, Mus musculus
gggacctcacgctgatggctgatga

SEQ ID NO: 628174 - DNA, 25 bp, Mus musculus
gggacctcagacaaatgggctctcc

SEQ ID NO: 628175 - DNA, 25 bp, Mus musculus
gggacctcagactaatgggctctcc

SEQ ID NO: 628176 - DNA, 25 bp, Mus musculus
gggacctcagcaaatgatggtcctt

SEQ ID NO: 628177 - DNA, 25 bp, Mus musculus
gggacctcagcatatgatggtcctt

SEQ ID NO: 628178 - DNA, 25 bp, Mus musculus
gggacctccagaatcaatccatgtg

SEQ ID NO: 628179 - DNA, 25 bp, Mus musculus
gggacctccagattcaatccatgtg

SEQ ID NO: 628180 - DNA, 25 bp, Mus musculus
gggacctccctaaagaatgagttat

SEQ ID NO: 628181 - DNA, 25 bp, Mus musculus
gggacctccctatagaatgagttat

SEQ ID NO: 628182 - DNA, 25 bp, Mus musculus
gggacctccgttcctgatatcagga

SEQ ID NO: 628183 - DNA, 25 bp, Mus musculus
gggacctccgttgctgatatcagga

SEQ ID NO: 628184 - DNA, 25 bp, Mus musculus
gggacctcctagagctgatggttat

SEQ ID NO: 628185 - DNA, 25 bp, Mus musculus
gggacctcctagtgctgatggttat

SEQ ID NO: 628186 - DNA, 25 bp, Mus musculus
gggacctcctccagactgggacgcc

SEQ ID NO: 628187 - DNA, 25 bp, Mus musculus
gggacctcctcctgactgggacgcc

SEQ ID NO: 628188 - DNA, 25 bp, Mus musculus
gggacctcgtttattccagagagaa

SEQ ID NO: 628189 - DNA, 25 bp, Mus musculus
gggacctcgttttttccagagagaa

SEQ ID NO: 628190 - DNA, 25 bp, Mus musculus
gggacctctccaagaaatgatagat

SEQ ID NO: 628191 - DNA, 25 bp, Mus musculus
gggacctctccatgaaatgatagat

SEQ ID NO: 628192 - DNA, 25 bp, Mus musculus
gggacctctcctaggtgattgtaaa

SEQ ID NO: 628193 - DNA, 25 bp, Mus musculus
gggacctctccttggtgattgtaaa

SEQ ID NO: 628194 - DNA, 25 bp, Mus musculus
gggacctctgatacatttcttttag

SEQ ID NO: 628195 - DNA, 25 bp, Mus musculus
gggacctctgattcatttcttttag

SEQ ID NO: 628196 - DNA, 25 bp, Mus musculus
gggacctctggtcagaactttgtac

SEQ ID NO: 628197 - DNA, 25 bp, Mus musculus
gggacctctggtgagaactttgtac

SEQ ID NO: 628198 - DNA, 25 bp, Mus musculus
gggacctctgtacctgcgtagacaa

SEQ ID NO: 628199 - DNA, 25 bp, Mus musculus
gggacctctgtagctgcgtagacaa

SEQ ID NO: 628200 - DNA, 25 bp, Mus musculus
gggacctcttggaaacagcattagg

SEQ ID NO: 628201 - DNA, 25 bp, Mus musculus
gggacctcttggtaacagcattagg

SEQ ID NO: 628202 - DNA, 25 bp, Mus musculus
gggacctgaaggactggatctgatt

SEQ ID NO: 628203 - DNA, 25 bp, Mus musculus
gggacctgaaggtctggatctgatt

SEQ ID NO: 628204 - DNA, 25 bp, Mus musculus
gggacctgaagtctatccgcaacga

SEQ ID NO: 628205 - DNA, 25 bp, Mus musculus
gggacctgaagtgtatccgcaacga

SEQ ID NO: 628206 - DNA, 25 bp, Mus musculus
gggacctgaataccagccattctag

SEQ ID NO: 628207 - DNA, 25 bp, Mus musculus
gggacctgaatagcagccattctag

SEQ ID NO: 628208 - DNA, 25 bp, Mus musculus
gggacctgaatgatgtcaacaatac

SEQ ID NO: 628209 - DNA, 25 bp, Mus musculus
gggacctgaatgttgtcaacaatac

SEQ ID NO: 628210 - DNA, 25 bp, Mus musculus
gggacctgaattacctcatatatgt

SEQ ID NO: 628211 - DNA, 25 bp, Mus musculus
gggacctgaatttcctcatatatgt

SEQ ID NO: 628212 - DNA, 25 bp, Mus musculus
gggacctgagaaatgtgtgctcaca

SEQ ID NO: 628213 - DNA, 25 bp, Mus musculus
gggacctgagaactaccagagactg

SEQ ID NO: 628214 - DNA, 25 bp, Mus musculus
gggacctgagaagtaccagagactg

SEQ ID NO: 628215 - DNA, 25 bp, Mus musculus
gggacctgagaattgtgtgctcaca

SEQ ID NO: 628216 - DNA, 25 bp, Mus musculus
gggacctgagctagctatcctgacc

SEQ ID NO: 628217 - DNA, 25 bp, Mus musculus
gggacctgagcttgctatcctgacc

SEQ ID NO: 628218 - DNA, 25 bp, Mus musculus
gggacctgaggaccacctatcgtag

SEQ ID NO: 628219 - DNA, 25 bp, Mus musculus
gggacctgaggagcacctatcgtag

SEQ ID NO: 628220 - DNA, 25 bp, Mus musculus
gggacctgaggtcacaagttgccat

SEQ ID NO: 628221 - DNA, 25 bp, Mus musculus
gggacctgaggtgacaagttgccat

SEQ ID NO: 628222 - DNA, 25 bp, Mus musculus
gggacctgatcccagggctgcttca

SEQ ID NO: 628223 - DNA, 25 bp, Mus musculus
gggacctgatccgagggctgcttca

SEQ ID NO: 628224 - DNA, 25 bp, Mus musculus
gggacctgatggcttacctatgcct

SEQ ID NO: 628225 - DNA, 25 bp, Mus musculus
gggacctgatgggttacctatgcct

SEQ ID NO: 628226 - DNA, 25 bp, Mus musculus
gggacctgatttccttaagtcactg

SEQ ID NO: 628227 - DNA, 25 bp, Mus musculus
gggacctgatttgcttaagtcactg

SEQ ID NO: 628228 - DNA, 25 bp, Mus musculus
gggacctgcaacaattgggttctca

SEQ ID NO: 628229 - DNA, 25 bp, Mus musculus
gggacctgcaactattgggttctca

SEQ ID NO: 628230 - DNA, 25 bp, Mus musculus
gggacctgcactacataggactcac

SEQ ID NO: 628231 - DNA, 25 bp, Mus musculus
gggacctgcactatttcagggaaga

SEQ ID NO: 628232 - DNA, 25 bp, Mus musculus
gggacctgcacttcataggactcac

SEQ ID NO: 628233 - DNA, 25 bp, Mus musculus
gggacctgcactttttcagggaaga

SEQ ID NO: 628234 - DNA, 25 bp, Mus musculus
gggacctgcagtacgtagtcctgga

SEQ ID NO: 628235 - DNA, 25 bp, Mus musculus
gggacctgcagttcgtagtcctgga

SEQ ID NO: 628236 - DNA, 25 bp, Mus musculus
gggacctgcatcactagtgagcaga

SEQ ID NO: 628237 - DNA, 25 bp, Mus musculus
gggacctgcatctctagtgagcaga

SEQ ID NO: 628238 - DNA, 25 bp, Mus musculus
gggacctgccagaacaatgtgcgct

SEQ ID NO: 628239 - DNA, 25 bp, Mus musculus
gggacctgccagtacaatgtgcgct

SEQ ID NO: 628240 - DNA, 25 bp, Mus musculus
gggacctgccgactaatccggtgga

SEQ ID NO: 628241 - DNA, 25 bp, Mus musculus
gggacctgccgagtaatccggtgga

SEQ ID NO: 628242 - DNA, 25 bp, Mus musculus
gggacctgctaccattgggttctaa

SEQ ID NO: 628243 - DNA, 25 bp, Mus musculus
gggacctgctacgattgggttctaa

SEQ ID NO: 628244 - DNA, 25 bp, Mus musculus
gggacctgctctactttgatggcct

SEQ ID NO: 628245 - DNA, 25 bp, Mus musculus
gggacctgctcttctttgatggcct

SEQ ID NO: 628246 - DNA, 25 bp, Mus musculus
gggacctgctgaagcccgacttggt

SEQ ID NO: 628247 - DNA, 25 bp, Mus musculus
gggacctgctgatgcccgacttggt

SEQ ID NO: 628248 - DNA, 25 bp, Mus musculus
gggacctggataaagtggactctct

SEQ ID NO: 628249 - DNA, 25 bp, Mus musculus
gggacctggatatagtggactctct

SEQ ID NO: 628250 - DNA, 25 bp, Mus musculus
gggacctggccaaagtccagcgagc

SEQ ID NO: 628251 - DNA, 25 bp, Mus musculus
gggacctggccatagtccagcgagc

SEQ ID NO: 628252 - DNA, 25 bp, Mus musculus
gggacctggctgaacatatgtgaat

SEQ ID NO: 628253 - DNA, 25 bp, Mus musculus
gggacctggctgtacatatgtgaat

SEQ ID NO: 628254 - DNA, 25 bp, Mus musculus
gggacctggcttagaaccttcggag

SEQ ID NO: 628255 - DNA, 25 bp, Mus musculus
gggacctggctttgaaccttcggag

SEQ ID NO: 628256 - DNA, 25 bp, Mus musculus
gggacctgtcataacatcgctgctg

SEQ ID NO: 628257 - DNA, 25 bp, Mus musculus
gggacctgtcattacatcgctgctg

SEQ ID NO: 628258 - DNA, 25 bp, Mus musculus
gggaccttaagaactgaatgggcct

SEQ ID NO: 628259 - DNA, 25 bp, Mus musculus
gggaccttaagatctgaatgggcct

SEQ ID NO: 628260 - DNA, 25 bp, Mus musculus
gggaccttacaactggctatgatga

SEQ ID NO: 628261 - DNA, 25 bp, Mus musculus
gggaccttacaagtggctatgatga

SEQ ID NO: 628262 - DNA, 25 bp, Mus musculus
gggaccttacttctgttgcttctaa

SEQ ID NO: 628263 - DNA, 25 bp, Mus musculus
gggaccttacttgtgttgcttctaa

SEQ ID NO: 628264 - DNA, 25 bp, Mus musculus
gggaccttagagcactagagcttta

SEQ ID NO: 628265 - DNA, 25 bp, Mus musculus
gggaccttagaggactagagcttta

SEQ ID NO: 628266 - DNA, 25 bp, Mus musculus
gggaccttagctactccatgaattc

SEQ ID NO: 628267 - DNA, 25 bp, Mus musculus
gggaccttagcttctccatgaattc

SEQ ID NO: 628268 - DNA, 25 bp, Mus musculus
gggaccttagtacctccaaacatca

SEQ ID NO: 628269 - DNA, 25 bp, Mus musculus
gggaccttagtagctccaaacatca

SEQ ID NO: 628270 - DNA, 25 bp, Mus musculus
gggaccttcaaaaccaagcttgctg

SEQ ID NO: 628271 - DNA, 25 bp, Mus musculus
gggaccttcaaatccaagcttgctg

SEQ ID NO: 628272 - DNA, 25 bp, Mus musculus
gggaccttcagcagcgactcactgg

SEQ ID NO: 628273 - DNA, 25 bp, Mus musculus
gggaccttcagctgcgactcactgg

SEQ ID NO: 628274 - DNA, 25 bp, Mus musculus
gggaccttccagaaagcatcgtgag

SEQ ID NO: 628275 - DNA, 25 bp, Mus musculus
gggaccttccagaatgtgtctgtta

SEQ ID NO: 628276 - DNA, 25 bp, Mus musculus
gggaccttccagtaagcatcgtgag

SEQ ID NO: 628277 - DNA, 25 bp, Mus musculus
gggaccttccagtatgtgtctgtta

SEQ ID NO: 628278 - DNA, 25 bp, Mus musculus
gggaccttcgaaccaaagcaaccat

SEQ ID NO: 628279 - DNA, 25 bp, Mus musculus
gggaccttcgaagcaaagcaaccat

SEQ ID NO: 628280 - DNA, 25 bp, Mus musculus
gggaccttcgtaacaacaagctgaa

SEQ ID NO: 628281 - DNA, 25 bp, Mus musculus
gggaccttcgtatcaacaagctgaa

SEQ ID NO: 628282 - DNA, 25 bp, Mus musculus
gggaccttctcacttaagaatgctt

SEQ ID NO: 628283 - DNA, 25 bp, Mus musculus
gggaccttctcagttaagaatgctt

SEQ ID NO: 628284 - DNA, 25 bp, Mus musculus
gggaccttctcgacgttccacagga

SEQ ID NO: 628285 - DNA, 25 bp, Mus musculus
gggaccttctcgtcgttccacagga

SEQ ID NO: 628286 - DNA, 25 bp, Mus musculus
gggaccttgagcagattttatcaca

SEQ ID NO: 628287 - DNA, 25 bp, Mus musculus
gggaccttgagctgattttatcaca

SEQ ID NO: 628288 - DNA, 25 bp, Mus musculus
gggaccttgatcagatcttgatcct

SEQ ID NO: 628289 - DNA, 25 bp, Mus musculus
gggaccttgatctgatcttgatcct

SEQ ID NO: 628290 - DNA, 25 bp, Mus musculus
gggaccttgccccaattttaagcag

SEQ ID NO: 628291 - DNA, 25 bp, Mus musculus
gggaccttgcccgaattttaagcag

SEQ ID NO: 628292 - DNA, 25 bp, Mus musculus
gggaccttggaccaacaagtgtatg

SEQ ID NO: 628293 - DNA, 25 bp, Mus musculus
gggaccttggacgaacaagtgtatg

SEQ ID NO: 628294 - DNA, 25 bp, Mus musculus
gggaccttggcaagcctgctagaca

SEQ ID NO: 628295 - DNA, 25 bp, Mus musculus
gggaccttggcatgcctgctagaca

SEQ ID NO: 628296 - DNA, 25 bp, Mus musculus
gggaccttgtcaaatacacactcat

SEQ ID NO: 628297 - DNA, 25 bp, Mus musculus
gggaccttgtcatatacacactcat

SEQ ID NO: 628298 - DNA, 25 bp, Mus musculus
gggaccttgtctatacagagattat

SEQ ID NO: 628299 - DNA, 25 bp, Mus musculus
gggaccttgtctcttctaggagata

SEQ ID NO: 628300 - DNA, 25 bp, Mus musculus
gggaccttgtctgttctaggagata

SEQ ID NO: 628301 - DNA, 25 bp, Mus musculus
gggaccttgtctttacagagattat

SEQ ID NO: 628302 - DNA, 25 bp, Mus musculus
gggaccttgtgcacagaatccagat

SEQ ID NO: 628303 - DNA, 25 bp, Mus musculus
gggaccttgtgctcagaatccagat

SEQ ID NO: 628304 - DNA, 25 bp, Mus musculus
gggacctttcagagctaaagctgat

SEQ ID NO: 628305 - DNA, 25 bp, Mus musculus
gggacctttcagtgctaaagctgat

SEQ ID NO: 628306 - DNA, 25 bp, Mus musculus
gggacctttcatctgtaagattcgg

SEQ ID NO: 628307 - DNA, 25 bp, Mus musculus
gggacctttcatgtgtaagattcgg

SEQ ID NO: 628308 - DNA, 25 bp, Mus musculus
gggacctttccactctagcctggat

SEQ ID NO: 628309 - DNA, 25 bp, Mus musculus
gggacctttccagtctagcctggat

SEQ ID NO: 628310 - DNA, 25 bp, Mus musculus
gggacctttcctagatgttccaagg

SEQ ID NO: 628311 - DNA, 25 bp, Mus musculus
gggacctttccttgatgttccaagg

SEQ ID NO: 628312 - DNA, 25 bp, Mus musculus
gggacctttctaatgtcaagaggat

SEQ ID NO: 628313 - DNA, 25 bp, Mus musculus
gggacctttctattgtcaagaggat

SEQ ID NO: 628314 - DNA, 25 bp, Mus musculus
gggacctttctgcactgggtattga

SEQ ID NO: 628315 - DNA, 25 bp, Mus musculus
gggacctttctggactgggtattga

SEQ ID NO: 628316 - DNA, 25 bp, Mus musculus
gggacctttgaacttgacagcattg

SEQ ID NO: 628317 - DNA, 25 bp, Mus musculus
gggacctttgaagttgacagcattg

SEQ ID NO: 628318 - DNA, 25 bp, Mus musculus
gggacctttgctccctgctggatgc

SEQ ID NO: 628319 - DNA, 25 bp, Mus musculus
gggacctttgctgcctgctggatgc

SEQ ID NO: 628320 - DNA, 25 bp, Mus musculus
gggacctttggtattggctaatcaa

SEQ ID NO: 628321 - DNA, 25 bp, Mus musculus
gggacctttggtcacttaggagcac

SEQ ID NO: 628322 - DNA, 25 bp, Mus musculus
gggacctttggtgacttaggagcac

SEQ ID NO: 628323 - DNA, 25 bp, Mus musculus
gggacctttggttttggctaatcaa

SEQ ID NO: 628324 - DNA, 25 bp, Mus musculus
gggacctttgttctcaagatgctgt

SEQ ID NO: 628325 - DNA, 25 bp, Mus musculus
gggacctttgttgtcaagatgctgt

SEQ ID NO: 628326 - DNA, 25 bp, Mus musculus
gggaccttttcaagctcagaagcga

SEQ ID NO: 628327 - DNA, 25 bp, Mus musculus
gggaccttttcatgctcagaagcga

SEQ ID NO: 628328 - DNA, 25 bp, Mus musculus
gggacgaaagtcctgggccaccact

SEQ ID NO: 628329 - DNA, 25 bp, Mus musculus
gggacgaaagtcgtgggccaccact

SEQ ID NO: 628330 - DNA, 25 bp, Mus musculus
gggacgaaccctcatggttccatca

SEQ ID NO: 628331 - DNA, 25 bp, Mus musculus
gggacgaaccctgatggttccatca

SEQ ID NO: 628332 - DNA, 25 bp, Mus musculus
gggacgaacctcaggctgtgaatga

SEQ ID NO: 628333 - DNA, 25 bp, Mus musculus
gggacgaacctctggctgtgaatga

SEQ ID NO: 628334 - DNA, 25 bp, Mus musculus
gggacgaaccttaatcagccaagta

SEQ ID NO: 628335 - DNA, 25 bp, Mus musculus
gggacgaacctttatcagccaagta

SEQ ID NO: 628336 - DNA, 25 bp, Mus musculus
gggacgacaacacatctcggatgta

SEQ ID NO: 628337 - DNA, 25 bp, Mus musculus
gggacgacaacagatctcggatgta

SEQ ID NO: 628338 - DNA, 25 bp, Mus musculus
gggacgacatagcttctgtactgtt

SEQ ID NO: 628339 - DNA, 25 bp, Mus musculus
gggacgacataggttctgtactgtt

SEQ ID NO: 628340 - DNA, 25 bp, Mus musculus
gggacgacctatcttcatgtacaga

SEQ ID NO: 628341 - DNA, 25 bp, Mus musculus
gggacgacctatgttcatgtacaga

SEQ ID NO: 628342 - DNA, 25 bp, Mus musculus
gggacgacgagcagacagactctga

SEQ ID NO: 628343 - DNA, 25 bp, Mus musculus
gggacgacgagctgacagactctga

SEQ ID NO: 628344 - DNA, 25 bp, Mus musculus
gggacgactcaaccctacctagaag

SEQ ID NO: 628345 - DNA, 25 bp, Mus musculus
gggacgactcaagcctacctagaag

SEQ ID NO: 628346 - DNA, 25 bp, Mus musculus
gggacgactggcaatttgaaatgaa

SEQ ID NO: 628347 - DNA, 25 bp, Mus musculus
gggacgactggctatttgaaatgaa

SEQ ID NO: 628348 - DNA, 25 bp, Mus musculus
gggacgagatcaatgcgctggtaca

SEQ ID NO: 628349 - DNA, 25 bp, Mus musculus
gggacgagatcattgcgctggtaca

SEQ ID NO: 628350 - DNA, 25 bp, Mus musculus
gggacgagcagaccgagcaaacact

SEQ ID NO: 628351 - DNA, 25 bp, Mus musculus
gggacgagcagagcgagcaaacact

SEQ ID NO: 628352 - DNA, 25 bp, Mus musculus
gggacgaggctaacttaactttgtg

SEQ ID NO: 628353 - DNA, 25 bp, Mus musculus
gggacgaggctatcttaactttgtg

SEQ ID NO: 628354 - DNA, 25 bp, Mus musculus
gggacgatacaccagacgccacttt

SEQ ID NO: 628355 - DNA, 25 bp, Mus musculus
gggacgatacacgagacgccacttt

SEQ ID NO: 628356 - DNA, 25 bp, Mus musculus
gggacgatattcacttgccccggtt

SEQ ID NO: 628357 - DNA, 25 bp, Mus musculus
gggacgatattctcttgccccggtt

SEQ ID NO: 628358 - DNA, 25 bp, Mus musculus
gggacgatatttagctgtttttaga

SEQ ID NO: 628359 - DNA, 25 bp, Mus musculus
gggacgatattttgctgtttttaga

SEQ ID NO: 628360 - DNA, 25 bp, Mus musculus
gggacgatcctcctgcaagataaac

SEQ ID NO: 628361 - DNA, 25 bp, Mus musculus
gggacgatcctcctggaggattacc

SEQ ID NO: 628362 - DNA, 25 bp, Mus musculus
gggacgatcctcgtgcaagataaac

SEQ ID NO: 628363 - DNA, 25 bp, Mus musculus
gggacgatcctcgtggaggattacc

SEQ ID NO: 628364 - DNA, 25 bp, Mus musculus
gggacgatgacgacaaaagcccatc

SEQ ID NO: 628365 - DNA, 25 bp, Mus musculus
gggacgatgacgtcaaaagcccatc

SEQ ID NO: 628366 - DNA, 25 bp, Mus musculus
gggacgatgtccacgctgataaatg

SEQ ID NO: 628367 - DNA, 25 bp, Mus musculus
gggacgatgtcctcgctgataaatg

SEQ ID NO: 628368 - DNA, 25 bp, Mus musculus
gggacgattgttcaccgccgctatc

SEQ ID NO: 628369 - DNA, 25 bp, Mus musculus
gggacgattgttgaccgccgctatc

SEQ ID NO: 628370 - DNA, 25 bp, Mus musculus
gggacgcacggcactccgctcggta

SEQ ID NO: 628371 - DNA, 25 bp, Mus musculus
gggacgcacggctctccgctcggta

SEQ ID NO: 628372 - DNA, 25 bp, Mus musculus
gggacgcagcacagcgttcccattt

SEQ ID NO: 628373 - DNA, 25 bp, Mus musculus
gggacgcagcactgcgttcccattt

SEQ ID NO: 628374 - DNA, 25 bp, Mus musculus
gggacgcagcgaagctaactaagat

SEQ ID NO: 628375 - DNA, 25 bp, Mus musculus
gggacgcagcgatgctaactaagat

SEQ ID NO: 628376 - DNA, 25 bp, Mus musculus
gggacgccaacacccgtagtcatgg

SEQ ID NO: 628377 - DNA, 25 bp, Mus musculus
gggacgccaacagccgtagtcatgg

SEQ ID NO: 628378 - DNA, 25 bp, Mus musculus
gggacgccaggtactgtaccagcag

SEQ ID NO: 628379 - DNA, 25 bp, Mus musculus
gggacgccaggttctgtaccagcag

SEQ ID NO: 628380 - DNA, 25 bp, Mus musculus
gggacgccatggaccaaagccaatg

SEQ ID NO: 628381 - DNA, 25 bp, Mus musculus
gggacgccatggtccaaagccaatg

SEQ ID NO: 628382 - DNA, 25 bp, Mus musculus
gggacgccattacaaacggtgcaga

SEQ ID NO: 628383 - DNA, 25 bp, Mus musculus
gggacgccattagaaacggtgcaga

SEQ ID NO: 628384 - DNA, 25 bp, Mus musculus
gggacgccgagcagtatggaccctt

SEQ ID NO: 628385 - DNA, 25 bp, Mus musculus
gggacgccgagctgtatggaccctt

SEQ ID NO: 628386 - DNA, 25 bp, Mus musculus
gggacgccgctgagccattgaagca

SEQ ID NO: 628387 - DNA, 25 bp, Mus musculus
gggacgccgctgtgccattgaagca

SEQ ID NO: 628388 - DNA, 25 bp, Mus musculus
gggacgcctgcaaacatgttcagtt

SEQ ID NO: 628389 - DNA, 25 bp, Mus musculus
gggacgcctgcatacatgttcagtt

SEQ ID NO: 628390 - DNA, 25 bp, Mus musculus
gggacgcctggcagtttgattaaac

SEQ ID NO: 628391 - DNA, 25 bp, Mus musculus
gggacgcctggctgtttgattaaac

SEQ ID NO: 628392 - DNA, 25 bp, Mus musculus
gggacgccttcgatactcttttcga

SEQ ID NO: 628393 - DNA, 25 bp, Mus musculus
gggacgccttcgttactcttttcga

SEQ ID NO: 628394 - DNA, 25 bp, Mus musculus
gggacgccttgcacatttcctgtgg

SEQ ID NO: 628395 - DNA, 25 bp, Mus musculus
gggacgccttgctcatttcctgtgg

SEQ ID NO: 628396 - DNA, 25 bp, Mus musculus
gggacgctcctactaatatctatgc

SEQ ID NO: 628397 - DNA, 25 bp, Mus musculus
gggacgctcctagtaatatctatgc

SEQ ID NO: 628398 - DNA, 25 bp, Mus musculus
gggacgctcctcagtcatggctgtc

SEQ ID NO: 628399 - DNA, 25 bp, Mus musculus
gggacgctcctctgtcatggctgtc

SEQ ID NO: 628400 - DNA, 25 bp, Mus musculus
gggacgctgacaatgaccatgacca

SEQ ID NO: 628401 - DNA, 25 bp, Mus musculus
gggacgctgacattgaccatgacca

SEQ ID NO: 628402 - DNA, 25 bp, Mus musculus
gggacgctgctgagcactcaccgtg

SEQ ID NO: 628403 - DNA, 25 bp, Mus musculus
gggacgctgctgtgcactcaccgtg

SEQ ID NO: 628404 - DNA, 25 bp, Mus musculus
gggacgctggtaaaccacactttaa

SEQ ID NO: 628405 - DNA, 25 bp, Mus musculus
gggacgctggtataccacactttaa

SEQ ID NO: 628406 - DNA, 25 bp, Mus musculus
gggacgctgtatccagctttgctat

SEQ ID NO: 628407 - DNA, 25 bp, Mus musculus
gggacgctgtatgcagctttgctat

SEQ ID NO: 628408 - DNA, 25 bp, Mus musculus
gggacgctgtcaatattaagcccaa

SEQ ID NO: 628409 - DNA, 25 bp, Mus musculus
gggacgctgtcattattaagcccaa

SEQ ID NO: 628410 - DNA, 25 bp, Mus musculus
gggacgctgtgcctgatgacatact

SEQ ID NO: 628411 - DNA, 25 bp, Mus musculus
gggacgctgtgcgtgatgacatact

SEQ ID NO: 628412 - DNA, 25 bp, Mus musculus
gggacgcttcttctatagtgtgtaa

SEQ ID NO: 628413 - DNA, 25 bp, Mus musculus
gggacgcttcttgtatagtgtgtaa

SEQ ID NO: 628414 - DNA, 25 bp, Mus musculus
gggacggacattagcttgactcagc

SEQ ID NO: 628415 - DNA, 25 bp, Mus musculus
gggacggacattcttcttaagttga

SEQ ID NO: 628416 - DNA, 25 bp, Mus musculus
gggacggacattgttcttaagttga

SEQ ID NO: 628417 - DNA, 25 bp, Mus musculus
gggacggacatttgcttgactcagc

SEQ ID NO: 628418 - DNA, 25 bp, Mus musculus
gggacggaccagatttgcatttaac

SEQ ID NO: 628419 - DNA, 25 bp, Mus musculus
gggacggaccagttttgcatttaac

SEQ ID NO: 628420 - DNA, 25 bp, Mus musculus
gggacggaccatctgcactgttgct

SEQ ID NO: 628421 - DNA, 25 bp, Mus musculus
gggacggaccatgtgcactgttgct

SEQ ID NO: 628422 - DNA, 25 bp, Mus musculus
gggacggcaaccacacgcttttcca

SEQ ID NO: 628423 - DNA, 25 bp, Mus musculus
gggacggcaacctcacgcttttcca

SEQ ID NO: 628424 - DNA, 25 bp, Mus musculus
gggacggcaactacggtacagctat

SEQ ID NO: 628425 - DNA, 25 bp, Mus musculus
gggacggcaacttcggtacagctat

SEQ ID NO: 628426 - DNA, 25 bp, Mus musculus
gggacggcagcactaccaggataca

SEQ ID NO: 628427 - DNA, 25 bp, Mus musculus
gggacggcagcagtaccaggataca

SEQ ID NO: 628428 - DNA, 25 bp, Mus musculus
gggacggccaacagtgagcactatg

SEQ ID NO: 628429 - DNA, 25 bp, Mus musculus
gggacggccaactgtgagcactatg

SEQ ID NO: 628430 - DNA, 25 bp, Mus musculus
gggacggcttagaaaggatcacttt

SEQ ID NO: 628431 - DNA, 25 bp, Mus musculus
gggacggcttagtaaggatcacttt

SEQ ID NO: 628432 - DNA, 25 bp, Mus musculus
gggacgggagaaaacaatgatacac

SEQ ID NO: 628433 - DNA, 25 bp, Mus musculus
gggacgggagaatacaatgatacac

SEQ ID NO: 628434 - DNA, 25 bp, Mus musculus
gggacgggattcacctaactctggg

SEQ ID NO: 628435 - DNA, 25 bp, Mus musculus
gggacgggattctcctaactctggg

SEQ ID NO: 628436 - DNA, 25 bp, Mus musculus
gggacgggcatcaaccatgaaaatc

SEQ ID NO: 628437 - DNA, 25 bp, Mus musculus
gggacgggcatctaccatgaaaatc

SEQ ID NO: 628438 - DNA, 25 bp, Mus musculus
gggacggtacaaaactcatagctag

SEQ ID NO: 628439 - DNA, 25 bp, Mus musculus
gggacggtacaatactcatagctag

SEQ ID NO: 628440 - DNA, 25 bp, Mus musculus
gggacggtatccatcactaagagtg

SEQ ID NO: 628441 - DNA, 25 bp, Mus musculus
gggacggtatccttcactaagagtg

SEQ ID NO: 628442 - DNA, 25 bp, Mus musculus
gggacggtcagaacgtgtctacttc

SEQ ID NO: 628443 - DNA, 25 bp, Mus musculus
gggacggtcagatcgtgtctacttc

SEQ ID NO: 628444 - DNA, 25 bp, Mus musculus
gggacggtgaagacctgcgcctctt

SEQ ID NO: 628445 - DNA, 25 bp, Mus musculus
gggacggtgaagtcctgcgcctctt

SEQ ID NO: 628446 - DNA, 25 bp, Mus musculus
gggacggtgcagacatccactcgga

SEQ ID NO: 628447 - DNA, 25 bp, Mus musculus
gggacggtgcagctcactgacatca

SEQ ID NO: 628448 - DNA, 25 bp, Mus musculus
gggacggtgcaggtcactgacatca

SEQ ID NO: 628449 - DNA, 25 bp, Mus musculus
gggacggtgcagtcatccactcgga

SEQ ID NO: 628450 - DNA, 25 bp, Mus musculus
gggacgtatctcagtatttggcttc

SEQ ID NO: 628451 - DNA, 25 bp, Mus musculus
gggacgtatctctgtatttggcttc

SEQ ID NO: 628452 - DNA, 25 bp, Mus musculus
gggacgtcctatacacaggcagaga

SEQ ID NO: 628453 - DNA, 25 bp, Mus musculus
gggacgtcctattcacaggcagaga

SEQ ID NO: 628454 - DNA, 25 bp, Mus musculus
gggacgtctcatagcacaagctcat

SEQ ID NO: 628455 - DNA, 25 bp, Mus musculus
gggacgtctcattgcacaagctcat

SEQ ID NO: 628456 - DNA, 25 bp, Mus musculus
gggacgtctctaagtggttgcaaaa

SEQ ID NO: 628457 - DNA, 25 bp, Mus musculus
gggacgtctctatgtggttgcaaaa

SEQ ID NO: 628458 - DNA, 25 bp, Mus musculus
gggacgtctgaaatccacttaaaga

SEQ ID NO: 628459 - DNA, 25 bp, Mus musculus
gggacgtctgaattccacttaaaga

SEQ ID NO: 628460 - DNA, 25 bp, Mus musculus
gggacgtcttttcttatgtgtgtct

SEQ ID NO: 628461 - DNA, 25 bp, Mus musculus
gggacgtcttttgttatgtgtgtct

SEQ ID NO: 628462 - DNA, 25 bp, Mus musculus
gggacgtgctttctcttactcagct

SEQ ID NO: 628463 - DNA, 25 bp, Mus musculus
gggacgtgctttgtcttactcagct

SEQ ID NO: 628464 - DNA, 25 bp, Mus musculus
gggacgtgggccaggcaccctcatt

SEQ ID NO: 628465 - DNA, 25 bp, Mus musculus
gggacgtgggcctggcaccctcatt

SEQ ID NO: 628466 - DNA, 25 bp, Mus musculus
gggacgtgtattaatccatacactc

SEQ ID NO: 628467 - DNA, 25 bp, Mus musculus
gggacgtgtatttatccatacactc

SEQ ID NO: 628468 - DNA, 25 bp, Mus musculus
gggacgttacagaatccgatacgaa

SEQ ID NO: 628469 - DNA, 25 bp, Mus musculus
gggacgttacagtatccgatacgaa

SEQ ID NO: 628470 - DNA, 25 bp, Mus musculus
gggacgttaccaaggccgctgatgt

SEQ ID NO: 628471 - DNA, 25 bp, Mus musculus
gggacgttaccatggccgctgatgt

SEQ ID NO: 628472 - DNA, 25 bp, Mus musculus
gggacgttactgacagcatgcctgc

SEQ ID NO: 628473 - DNA, 25 bp, Mus musculus
gggacgttactgtcagcatgcctgc

SEQ ID NO: 628474 - DNA, 25 bp, Mus musculus
gggacgttcagcaatcatttcgtag

SEQ ID NO: 628475 - DNA, 25 bp, Mus musculus
gggacgttcagctatcatttcgtag

SEQ ID NO: 628476 - DNA, 25 bp, Mus musculus
gggacgttggctcactcacagctgc

SEQ ID NO: 628477 - DNA, 25 bp, Mus musculus
gggacgttggctgactcacagctgc

SEQ ID NO: 628478 - DNA, 25 bp, Mus musculus
gggacgtttcgtcacacctacatcc

SEQ ID NO: 628479 - DNA, 25 bp, Mus musculus
gggacgtttcgtgacacctacatcc

SEQ ID NO: 628480 - DNA, 25 bp, Mus musculus
gggacgtttctgaagcattttctta

SEQ ID NO: 628481 - DNA, 25 bp, Mus musculus
gggacgtttctgtagcattttctta

SEQ ID NO: 628482 - DNA, 25 bp, Mus musculus
gggactaaacagactcctttattgt

SEQ ID NO: 628483 - DNA, 25 bp, Mus musculus
gggactaaacagtctcctttattgt

SEQ ID NO: 628484 - DNA, 25 bp, Mus musculus
gggactaacacaagtgcaatacaga

SEQ ID NO: 628485 - DNA, 25 bp, Mus musculus
gggactaacacatgtgcaatacaga

SEQ ID NO: 628486 - DNA, 25 bp, Mus musculus
gggactaaccacagaccagcaagcc

SEQ ID NO: 628487 - DNA, 25 bp, Mus musculus
gggactaaccactgaccagcaagcc

SEQ ID NO: 628488 - DNA, 25 bp, Mus musculus
gggactaacccacaagctggacgcc

SEQ ID NO: 628489 - DNA, 25 bp, Mus musculus
gggactaacccagaagctggacgcc

SEQ ID NO: 628490 - DNA, 25 bp, Mus musculus
gggactaacgcaccacagagtcctc

SEQ ID NO: 628491 - DNA, 25 bp, Mus musculus
gggactaacgcagcacagagtcctc

SEQ ID NO: 628492 - DNA, 25 bp, Mus musculus
gggactaacgtaacatttcactgtg

SEQ ID NO: 628493 - DNA, 25 bp, Mus musculus
gggactaacgtatcatttcactgtg

SEQ ID NO: 628494 - DNA, 25 bp, Mus musculus
gggactaacttcagatgcctattat

SEQ ID NO: 628495 - DNA, 25 bp, Mus musculus
gggactaacttctgatgcctattat

SEQ ID NO: 628496 - DNA, 25 bp, Mus musculus
gggactaagcaaagctcctggtcta

SEQ ID NO: 628497 - DNA, 25 bp, Mus musculus
gggactaagcaatgctcctggtcta

SEQ ID NO: 628498 - DNA, 25 bp, Mus musculus
gggactaagcgtctgccccacaata

SEQ ID NO: 628499 - DNA, 25 bp, Mus musculus
gggactaagcgtgtgccccacaata

SEQ ID NO: 628500 - DNA, 25 bp, Mus musculus
gggactaaggtcatttagccagtgt

SEQ ID NO: 628501 - DNA, 25 bp, Mus musculus
gggactaaggtcttttagccagtgt

SEQ ID NO: 628502 - DNA, 25 bp, Mus musculus
gggactaatccaagggtgaattgag

SEQ ID NO: 628503 - DNA, 25 bp, Mus musculus
gggactaatccatgggtgaattgag

SEQ ID NO: 628504 - DNA, 25 bp, Mus musculus
gggactaattctccattgcaacttc

SEQ ID NO: 628505 - DNA, 25 bp, Mus musculus
gggactaattctgcattgcaacttc

SEQ ID NO: 628506 - DNA, 25 bp, Mus musculus
gggactacaacaaggcaaaagcaaa

SEQ ID NO: 628507 - DNA, 25 bp, Mus musculus
gggactacaacatggcaaaagcaaa

SEQ ID NO: 628508 - DNA, 25 bp, Mus musculus
gggactacaagtcccacaatgccac

SEQ ID NO: 628509 - DNA, 25 bp, Mus musculus
gggactacaagtgccacaatgccac

SEQ ID NO: 628510 - DNA, 25 bp, Mus musculus
gggactacaccaacacagaagagct

SEQ ID NO: 628511 - DNA, 25 bp, Mus musculus
gggactacaccatcacagaagagct

SEQ ID NO: 628512 - DNA, 25 bp, Mus musculus
gggactacagtaaccatctggaata

SEQ ID NO: 628513 - DNA, 25 bp, Mus musculus
gggactacagtatccatctggaata

SEQ ID NO: 628514 - DNA, 25 bp, Mus musculus
gggactacatacaccagctagttaa

SEQ ID NO: 628515 - DNA, 25 bp, Mus musculus
gggactacatactccagctagttaa

SEQ ID NO: 628516 - DNA, 25 bp, Mus musculus
gggactacctgcagggcctcaaaag

SEQ ID NO: 628517 - DNA, 25 bp, Mus musculus
gggactacctgctgggcctcaaaag

SEQ ID NO: 628518 - DNA, 25 bp, Mus musculus
gggactacgactactcagaggagta

SEQ ID NO: 628519 - DNA, 25 bp, Mus musculus
gggactacgacttctcagaggagta

SEQ ID NO: 628520 - DNA, 25 bp, Mus musculus
gggactacgataatgcacactgtgg

SEQ ID NO: 628521 - DNA, 25 bp, Mus musculus
gggactacgatattgcacactgtgg

SEQ ID NO: 628522 - DNA, 25 bp, Mus musculus
gggactacgcggagaaaatttgata

SEQ ID NO: 628523 - DNA, 25 bp, Mus musculus
gggactacgcggtgaaaatttgata

SEQ ID NO: 628524 - DNA, 25 bp, Mus musculus
gggactacgggcatcctgtctacat

SEQ ID NO: 628525 - DNA, 25 bp, Mus musculus
gggactacgggcttcctgtctacat

SEQ ID NO: 628526 - DNA, 25 bp, Mus musculus
gggactactgcacaagcttagcccc

SEQ ID NO: 628527 - DNA, 25 bp, Mus musculus
gggactactgcagaagcttagcccc

SEQ ID NO: 628528 - DNA, 25 bp, Mus musculus
gggactagaaaccaatttgccttat

SEQ ID NO: 628529 - DNA, 25 bp, Mus musculus
gggactagaaacgaatttgccttat

SEQ ID NO: 628530 - DNA, 25 bp, Mus musculus
gggactagacaacctgccgcattag

SEQ ID NO: 628531 - DNA, 25 bp, Mus musculus
gggactagacaagctgccgcattag

SEQ ID NO: 628532 - DNA, 25 bp, Mus musculus
gggactagacatatctgtggccaaa

SEQ ID NO: 628533 - DNA, 25 bp, Mus musculus
gggactagacatttctgtggccaaa

SEQ ID NO: 628534 - DNA, 25 bp, Mus musculus
gggactagactaactagcctgaaga

SEQ ID NO: 628535 - DNA, 25 bp, Mus musculus
gggactagactatctagcctgaaga

SEQ ID NO: 628536 - DNA, 25 bp, Mus musculus
gggactagacttattattcctcaaa

SEQ ID NO: 628537 - DNA, 25 bp, Mus musculus
gggactagactttttattcctcaaa

SEQ ID NO: 628538 - DNA, 25 bp, Mus musculus
gggactagcacaaaactcatctttg

SEQ ID NO: 628539 - DNA, 25 bp, Mus musculus
gggactagcacataactcatctttg

SEQ ID NO: 628540 - DNA, 25 bp, Mus musculus
gggactagcactccatgagccagta

SEQ ID NO: 628541 - DNA, 25 bp, Mus musculus
gggactagcactgcatgagccagta

SEQ ID NO: 628542 - DNA, 25 bp, Mus musculus
gggactagctctaaggaagtttgaa

SEQ ID NO: 628543 - DNA, 25 bp, Mus musculus
gggactagctcttaggaagtttgaa

SEQ ID NO: 628544 - DNA, 25 bp, Mus musculus
gggactaggatcacttactgcctaa

SEQ ID NO: 628545 - DNA, 25 bp, Mus musculus
gggactaggatctcttactgcctaa

SEQ ID NO: 628546 - DNA, 25 bp, Mus musculus
gggactaggcctatagaacaacact

SEQ ID NO: 628547 - DNA, 25 bp, Mus musculus
gggactaggcctttagaacaacact

SEQ ID NO: 628548 - DNA, 25 bp, Mus musculus
gggactaggctcagtaggccctaca

SEQ ID NO: 628549 - DNA, 25 bp, Mus musculus
gggactaggctctgtaggccctaca

SEQ ID NO: 628550 - DNA, 25 bp, Mus musculus
gggactaggtagcattcagaattat

SEQ ID NO: 628551 - DNA, 25 bp, Mus musculus
gggactaggtaggattcagaattat

SEQ ID NO: 628552 - DNA, 25 bp, Mus musculus
gggactagtaacacccacagtgggc

SEQ ID NO: 628553 - DNA, 25 bp, Mus musculus
gggactagtaactcccacagtgggc

SEQ ID NO: 628554 - DNA, 25 bp, Mus musculus
gggactagtccaagtacctgtgagt

SEQ ID NO: 628555 - DNA, 25 bp, Mus musculus
gggactagtccatgtacctgtgagt

SEQ ID NO: 628556 - DNA, 25 bp, Mus musculus
gggactatacgaacttgctgggcat

SEQ ID NO: 628557 - DNA, 25 bp, Mus musculus
gggactatacgatcttgctgggcat

SEQ ID NO: 628558 - DNA, 25 bp, Mus musculus
gggactatactgagatgctgagcaa

SEQ ID NO: 628559 - DNA, 25 bp, Mus musculus
gggactatactgtgatgctgagcaa

SEQ ID NO: 628560 - DNA, 25 bp, Mus musculus
gggactataggcacagaaacattta

SEQ ID NO: 628561 - DNA, 25 bp, Mus musculus
gggactataggcacgggccaccatg

SEQ ID NO: 628562 - DNA, 25 bp, Mus musculus
gggactataggctcagaaacattta

SEQ ID NO: 628563 - DNA, 25 bp, Mus musculus
gggactataggctcgggccaccatg

SEQ ID NO: 628564 - DNA, 25 bp, Mus musculus
gggactatatctcactgcatctgac

SEQ ID NO: 628565 - DNA, 25 bp, Mus musculus
gggactatatctgactgcatctgac

SEQ ID NO: 628566 - DNA, 25 bp, Mus musculus
gggactatccagacccagaatccac

SEQ ID NO: 628567 - DNA, 25 bp, Mus musculus
gggactatccagtcccagaatccac

SEQ ID NO: 628568 - DNA, 25 bp, Mus musculus
gggactatccctcctatgtcactgg

SEQ ID NO: 628569 - DNA, 25 bp, Mus musculus
gggactatccctgctatgtcactgg

SEQ ID NO: 628570 - DNA, 25 bp, Mus musculus
gggactatgatcatttgtatacagc

SEQ ID NO: 628571 - DNA, 25 bp, Mus musculus
gggactatgatcttttgtatacagc

SEQ ID NO: 628572 - DNA, 25 bp, Mus musculus
gggactatgcaaagaacgctttcgt

SEQ ID NO: 628573 - DNA, 25 bp, Mus musculus
gggactatgcaatgaacgctttcgt

SEQ ID NO: 628574 - DNA, 25 bp, Mus musculus
gggactatgcagatcttgctgcaga

SEQ ID NO: 628575 - DNA, 25 bp, Mus musculus
gggactatgcagttcttgctgcaga

SEQ ID NO: 628576 - DNA, 25 bp, Mus musculus
gggactatgcatatttgatgacatc

SEQ ID NO: 628577 - DNA, 25 bp, Mus musculus
gggactatgcatttttgatgacatc

SEQ ID NO: 628578 - DNA, 25 bp, Mus musculus
gggactatggatccctacagaacca

SEQ ID NO: 628579 - DNA, 25 bp, Mus musculus
gggactatggatgcctacagaacca

SEQ ID NO: 628580 - DNA, 25 bp, Mus musculus
gggactattatcaacctctataaca

SEQ ID NO: 628581 - DNA, 25 bp, Mus musculus
gggactattatctacctctataaca

SEQ ID NO: 628582 - DNA, 25 bp, Mus musculus
gggactattcttccatcataatcct

SEQ ID NO: 628583 - DNA, 25 bp, Mus musculus
gggactattcttgcatcataatcct

SEQ ID NO: 628584 - DNA, 25 bp, Mus musculus
gggactattgacactactgatctct

SEQ ID NO: 628585 - DNA, 25 bp, Mus musculus
gggactattgactctactgatctct

SEQ ID NO: 628586 - DNA, 25 bp, Mus musculus
gggactatttatctcttggacctaa

SEQ ID NO: 628587 - DNA, 25 bp, Mus musculus
gggactatttatgtcttggacctaa

SEQ ID NO: 628588 - DNA, 25 bp, Mus musculus
gggactcaaactctatctgtaactt

SEQ ID NO: 628589 - DNA, 25 bp, Mus musculus
gggactcaaactgtatctgtaactt

SEQ ID NO: 628590 - DNA, 25 bp, Mus musculus
gggactcaaagcaatcttgacatgc

SEQ ID NO: 628591 - DNA, 25 bp, Mus musculus
gggactcaaagctatcttgacatgc

SEQ ID NO: 628592 - DNA, 25 bp, Mus musculus
gggactcaaagtcttgaagttctag

SEQ ID NO: 628593 - DNA, 25 bp, Mus musculus
gggactcaaagtgttgaagttctag

SEQ ID NO: 628594 - DNA, 25 bp, Mus musculus
gggactcaagacagctgctccaagc

SEQ ID NO: 628595 - DNA, 25 bp, Mus musculus
gggactcaagacctgtagctgtttg

SEQ ID NO: 628596 - DNA, 25 bp, Mus musculus
gggactcaagacgtgtagctgtttg

SEQ ID NO: 628597 - DNA, 25 bp, Mus musculus
gggactcaagactgctgctccaagc

SEQ ID NO: 628598 - DNA, 25 bp, Mus musculus
gggactcaaggaactgcttttccac

SEQ ID NO: 628599 - DNA, 25 bp, Mus musculus
gggactcaaggatctgcttttccac

SEQ ID NO: 628600 - DNA, 25 bp, Mus musculus
gggactcacaagatgcctgtggaac

SEQ ID NO: 628601 - DNA, 25 bp, Mus musculus
gggactcacaagttgcctgtggaac

SEQ ID NO: 628602 - DNA, 25 bp, Mus musculus
gggactcacagaccttaaaatcatg

SEQ ID NO: 628603 - DNA, 25 bp, Mus musculus
gggactcacagagcttaaaatcatg

SEQ ID NO: 628604 - DNA, 25 bp, Mus musculus
gggactcaccagaagattccttcag

SEQ ID NO: 628605 - DNA, 25 bp, Mus musculus
gggactcaccagtagattccttcag

SEQ ID NO: 628606 - DNA, 25 bp, Mus musculus
gggactcacctgaaaagtgttcttt

SEQ ID NO: 628607 - DNA, 25 bp, Mus musculus
gggactcacctgtaaagtgttcttt

SEQ ID NO: 628608 - DNA, 25 bp, Mus musculus
gggactcacgacacaatgtttgtag

SEQ ID NO: 628609 - DNA, 25 bp, Mus musculus
gggactcacgactcaatgtttgtag

SEQ ID NO: 628610 - DNA, 25 bp, Mus musculus
gggactcactcaaagtgtggtggta

SEQ ID NO: 628611 - DNA, 25 bp, Mus musculus
gggactcactcatagtgtggtggta

SEQ ID NO: 628612 - DNA, 25 bp, Mus musculus
gggactcactctaaataattgcaat

SEQ ID NO: 628613 - DNA, 25 bp, Mus musculus
gggactcactcttaataattgcaat

SEQ ID NO: 628614 - DNA, 25 bp, Mus musculus
gggactcactgacatacgattctta

SEQ ID NO: 628615 - DNA, 25 bp, Mus musculus
gggactcactgagatacgattctta

SEQ ID NO: 628616 - DNA, 25 bp, Mus musculus
gggactcactgtagggccacctgat

SEQ ID NO: 628617 - DNA, 25 bp, Mus musculus
gggactcactgttgggccacctgat

SEQ ID NO: 628618 - DNA, 25 bp, Mus musculus
gggactcagactctaacagcatgca

SEQ ID NO: 628619 - DNA, 25 bp, Mus musculus
gggactcagactgtaacagcatgca

SEQ ID NO: 628620 - DNA, 25 bp, Mus musculus
gggactcagaggcatctttgttata

SEQ ID NO: 628621 - DNA, 25 bp, Mus musculus
gggactcagagggatctttgttata

SEQ ID NO: 628622 - DNA, 25 bp, Mus musculus
gggactcagatcatctggtagctta

SEQ ID NO: 628623 - DNA, 25 bp, Mus musculus
gggactcagatcttctggtagctta

SEQ ID NO: 628624 - DNA, 25 bp, Mus musculus
gggactcagattatcacttgcttga

SEQ ID NO: 628625 - DNA, 25 bp, Mus musculus
gggactcagattttcacttgcttga

SEQ ID NO: 628626 - DNA, 25 bp, Mus musculus
gggactcagcagcatggcattttca

SEQ ID NO: 628627 - DNA, 25 bp, Mus musculus
gggactcagcaggatggcattttca

SEQ ID NO: 628628 - DNA, 25 bp, Mus musculus
gggactcagctgattgtcatacctg

SEQ ID NO: 628629 - DNA, 25 bp, Mus musculus
gggactcagctgtttgtcatacctg

SEQ ID NO: 628630 - DNA, 25 bp, Mus musculus
gggactcaggatcgaagtgcttcat

SEQ ID NO: 628631 - DNA, 25 bp, Mus musculus
gggactcaggatcgcttagtctcat

SEQ ID NO: 628632 - DNA, 25 bp, Mus musculus
gggactcaggatggaagtgcttcat

SEQ ID NO: 628633 - DNA, 25 bp, Mus musculus
gggactcaggatggcttagtctcat

SEQ ID NO: 628634 - DNA, 25 bp, Mus musculus
gggactcaggctaagggccctgaac

SEQ ID NO: 628635 - DNA, 25 bp, Mus musculus
gggactcaggcttagggccctgaac

SEQ ID NO: 628636 - DNA, 25 bp, Mus musculus
gggactcaggtcagtaactgcccag

SEQ ID NO: 628637 - DNA, 25 bp, Mus musculus
gggactcaggtctgtaactgcccag

SEQ ID NO: 628638 - DNA, 25 bp, Mus musculus
gggactcataggaaacctgcagcag

SEQ ID NO: 628639 - DNA, 25 bp, Mus musculus
gggactcataggtaacctgcagcag

SEQ ID NO: 628640 - DNA, 25 bp, Mus musculus
gggactcatatcatttgggctctgt

SEQ ID NO: 628641 - DNA, 25 bp, Mus musculus
gggactcatatcttttgggctctgt

SEQ ID NO: 628642 - DNA, 25 bp, Mus musculus
gggactcatcccattcctgacagag

SEQ ID NO: 628643 - DNA, 25 bp, Mus musculus
gggactcatccctttcctgacagag

SEQ ID NO: 628644 - DNA, 25 bp, Mus musculus
gggactcatgtaacacagggtagca

SEQ ID NO: 628645 - DNA, 25 bp, Mus musculus
gggactcatgtatcacagggtagca

SEQ ID NO: 628646 - DNA, 25 bp, Mus musculus
gggactcattgaccagacacagcca

SEQ ID NO: 628647 - DNA, 25 bp, Mus musculus
gggactcattgagcagacacagcca

SEQ ID NO: 628648 - DNA, 25 bp, Mus musculus
gggactccaagtacatctagagggc

SEQ ID NO: 628649 - DNA, 25 bp, Mus musculus
gggactccaagttcatctagagggc

SEQ ID NO: 628650 - DNA, 25 bp, Mus musculus
gggactccacttactcagtaagaag

SEQ ID NO: 628651 - DNA, 25 bp, Mus musculus
gggactccactttctcagtaagaag

SEQ ID NO: 628652 - DNA, 25 bp, Mus musculus
gggactccagacacttggtgacaca

SEQ ID NO: 628653 - DNA, 25 bp, Mus musculus
gggactccagactcttggtgacaca

SEQ ID NO: 628654 - DNA, 25 bp, Mus musculus
gggactccagtgaaccataataaac

SEQ ID NO: 628655 - DNA, 25 bp, Mus musculus
gggactccagtgagcccatatggag

SEQ ID NO: 628656 - DNA, 25 bp, Mus musculus
gggactccagtgtaccataataaac

SEQ ID NO: 628657 - DNA, 25 bp, Mus musculus
gggactccagtgtgcccatatggag

SEQ ID NO: 628658 - DNA, 25 bp, Mus musculus
gggactccatgaatttccagctggc

SEQ ID NO: 628659 - DNA, 25 bp, Mus musculus
gggactccatgattttccagctggc

SEQ ID NO: 628660 - DNA, 25 bp, Mus musculus
gggactcccaagcagacctaagaat

SEQ ID NO: 628661 - DNA, 25 bp, Mus musculus
gggactcccaaggagacctaagaat

SEQ ID NO: 628662 - DNA, 25 bp, Mus musculus
gggactcccactatttacaatgtct

SEQ ID NO: 628663 - DNA, 25 bp, Mus musculus
gggactcccactttttacaatgtct

SEQ ID NO: 628664 - DNA, 25 bp, Mus musculus
gggactcccagaatctcctgagagt

SEQ ID NO: 628665 - DNA, 25 bp, Mus musculus
gggactcccagattctcctgagagt

SEQ ID NO: 628666 - DNA, 25 bp, Mus musculus
gggactcccatcagaactcgtttgt

SEQ ID NO: 628667 - DNA, 25 bp, Mus musculus
gggactcccatctgaactcgtttgt

SEQ ID NO: 628668 - DNA, 25 bp, Mus musculus
gggactccccacactacagggttct

SEQ ID NO: 628669 - DNA, 25 bp, Mus musculus
gggactccccacagtgttaatattt

SEQ ID NO: 628670 - DNA, 25 bp, Mus musculus
gggactccccactctacagggttct

SEQ ID NO: 628671 - DNA, 25 bp, Mus musculus
gggactccccactgtgttaatattt

SEQ ID NO: 628672 - DNA, 25 bp, Mus musculus
gggactccctgaaatatgtcttgtg

SEQ ID NO: 628673 - DNA, 25 bp, Mus musculus
gggactccctgatatatgtcttgtg

SEQ ID NO: 628674 - DNA, 25 bp, Mus musculus
gggactccctgtccaaagatgacta

SEQ ID NO: 628675 - DNA, 25 bp, Mus musculus
gggactccctgtgcaaagatgacta

SEQ ID NO: 628676 - DNA, 25 bp, Mus musculus
gggactcccttacagagatctggag

SEQ ID NO: 628677 - DNA, 25 bp, Mus musculus
gggactcccttagagagatctggag

SEQ ID NO: 628678 - DNA, 25 bp, Mus musculus
gggactccgacgaaccaatgggtag

SEQ ID NO: 628679 - DNA, 25 bp, Mus musculus
gggactccgacgtaccaatgggtag

SEQ ID NO: 628680 - DNA, 25 bp, Mus musculus
gggactccggttacataggatccaa

SEQ ID NO: 628681 - DNA, 25 bp, Mus musculus
gggactccggtttcataggatccaa

SEQ ID NO: 628682 - DNA, 25 bp, Mus musculus
gggactcctaagattatagggctga

SEQ ID NO: 628683 - DNA, 25 bp, Mus musculus
gggactcctaagtttatagggctga

SEQ ID NO: 628684 - DNA, 25 bp, Mus musculus
gggactcctaataatatttcaccag

SEQ ID NO: 628685 - DNA, 25 bp, Mus musculus
gggactcctaattatatttcaccag

SEQ ID NO: 628686 - DNA, 25 bp, Mus musculus
gggactcctatgcactttctagtat

SEQ ID NO: 628687 - DNA, 25 bp, Mus musculus
gggactcctatggactttctagtat

SEQ ID NO: 628688 - DNA, 25 bp, Mus musculus
gggactcctctcaaaagcgcctgac

SEQ ID NO: 628689 - DNA, 25 bp, Mus musculus
gggactcctctcatgagtggatctg

SEQ ID NO: 628690 - DNA, 25 bp, Mus musculus
gggactcctctctaaagcgcctgac

SEQ ID NO: 628691 - DNA, 25 bp, Mus musculus
gggactcctctcttgagtggatctg

SEQ ID NO: 628692 - DNA, 25 bp, Mus musculus
gggactcctgaaagccctgaaggtt

SEQ ID NO: 628693 - DNA, 25 bp, Mus musculus
gggactcctgaatgccctgaaggtt

SEQ ID NO: 628694 - DNA, 25 bp, Mus musculus
gggactcctgaccactatagtaatt

SEQ ID NO: 628695 - DNA, 25 bp, Mus musculus
gggactcctgacgactatagtaatt

SEQ ID NO: 628696 - DNA, 25 bp, Mus musculus
gggactcctgtgagtagctagttat

SEQ ID NO: 628697 - DNA, 25 bp, Mus musculus
gggactcctgtgtgtagctagttat

SEQ ID NO: 628698 - DNA, 25 bp, Mus musculus
gggactccttggaccaatggactat

SEQ ID NO: 628699 - DNA, 25 bp, Mus musculus
gggactccttggaggcactgtgaat

SEQ ID NO: 628700 - DNA, 25 bp, Mus musculus
gggactccttggtccaatggactat

SEQ ID NO: 628701 - DNA, 25 bp, Mus musculus
gggactccttggtggcactgtgaat

SEQ ID NO: 628702 - DNA, 25 bp, Mus musculus
gggactcgcagcagtacagggctta

SEQ ID NO: 628703 - DNA, 25 bp, Mus musculus
gggactcgcagctgtacagggctta

SEQ ID NO: 628704 - DNA, 25 bp, Mus musculus
gggactcgcctacatcagattagaa

SEQ ID NO: 628705 - DNA, 25 bp, Mus musculus
gggactcgcctagatcagattagaa

SEQ ID NO: 628706 - DNA, 25 bp, Mus musculus
gggactcgcttcatcattgaaacaa

SEQ ID NO: 628707 - DNA, 25 bp, Mus musculus
gggactcgcttcttcattgaaacaa

SEQ ID NO: 628708 - DNA, 25 bp, Mus musculus
gggactcgctttatgctttgaacaa

SEQ ID NO: 628709 - DNA, 25 bp, Mus musculus
gggactcgctttttgctttgaacaa

SEQ ID NO: 628710 - DNA, 25 bp, Mus musculus
gggactcgtatgcatgtgaccacaa

SEQ ID NO: 628711 - DNA, 25 bp, Mus musculus
gggactcgtatggatgtgaccacaa

SEQ ID NO: 628712 - DNA, 25 bp, Mus musculus
gggactcgtattacatcatgatact

SEQ ID NO: 628713 - DNA, 25 bp, Mus musculus
gggactcgtatttcatcatgatact

SEQ ID NO: 628714 - DNA, 25 bp, Mus musculus
gggactcgtgcaacattattgcctt

SEQ ID NO: 628715 - DNA, 25 bp, Mus musculus
gggactcgtgcatcattattgcctt

SEQ ID NO: 628716 - DNA, 25 bp, Mus musculus
gggactcgttagactcattttcatc

SEQ ID NO: 628717 - DNA, 25 bp, Mus musculus
gggactcgttagtctcattttcatc

SEQ ID NO: 628718 - DNA, 25 bp, Mus musculus
gggactctacatacagaccctgctt

SEQ ID NO: 628719 - DNA, 25 bp, Mus musculus
gggactctacattcagaccctgctt

SEQ ID NO: 628720 - DNA, 25 bp, Mus musculus
gggactctacgtcgctgaacaattt

SEQ ID NO: 628721 - DNA, 25 bp, Mus musculus
gggactctacgtggctgaacaattt

SEQ ID NO: 628722 - DNA, 25 bp, Mus musculus
gggactctactgaccaacagtcaga

SEQ ID NO: 628723 - DNA, 25 bp, Mus musculus
gggactctactgtccaacagtcaga

SEQ ID NO: 628724 - DNA, 25 bp, Mus musculus
gggactctaggaatttctgaccttg

SEQ ID NO: 628725 - DNA, 25 bp, Mus musculus
gggactctaggattttctgaccttg

SEQ ID NO: 628726 - DNA, 25 bp, Mus musculus
gggactctaggcattatcggcatgt

SEQ ID NO: 628727 - DNA, 25 bp, Mus musculus
gggactctaggctttatcggcatgt

SEQ ID NO: 628728 - DNA, 25 bp, Mus musculus
gggactctagtgcataccagtgctg

SEQ ID NO: 628729 - DNA, 25 bp, Mus musculus
gggactctagtggataccagtgctg

SEQ ID NO: 628730 - DNA, 25 bp, Mus musculus
gggactctatctacaactcaactcc

SEQ ID NO: 628731 - DNA, 25 bp, Mus musculus
gggactctatcttcaactcaactcc

SEQ ID NO: 628732 - DNA, 25 bp, Mus musculus
gggactctcattacagccaaatagg

SEQ ID NO: 628733 - DNA, 25 bp, Mus musculus
gggactctcattatgtctttatttg

SEQ ID NO: 628734 - DNA, 25 bp, Mus musculus
gggactctcatttcagccaaatagg

SEQ ID NO: 628735 - DNA, 25 bp, Mus musculus
gggactctcattttgtctttatttg

SEQ ID NO: 628736 - DNA, 25 bp, Mus musculus
gggactctctgaagctgtgcaagcc

SEQ ID NO: 628737 - DNA, 25 bp, Mus musculus
gggactctctgacatcaggatagag

SEQ ID NO: 628738 - DNA, 25 bp, Mus musculus
gggactctctgagatcaggatagag

SEQ ID NO: 628739 - DNA, 25 bp, Mus musculus
gggactctctgatgctgtgcaagcc

SEQ ID NO: 628740 - DNA, 25 bp, Mus musculus
gggactctctgcacttctgcatgaa

SEQ ID NO: 628741 - DNA, 25 bp, Mus musculus
gggactctctgccatgtacataata

SEQ ID NO: 628742 - DNA, 25 bp, Mus musculus
gggactctctgccattatgtttaca

SEQ ID NO: 628743 - DNA, 25 bp, Mus musculus
gggactctctgcgatgtacataata

SEQ ID NO: 628744 - DNA, 25 bp, Mus musculus
gggactctctgcgattatgtttaca

SEQ ID NO: 628745 - DNA, 25 bp, Mus musculus
gggactctctgctcttctgcatgaa

SEQ ID NO: 628746 - DNA, 25 bp, Mus musculus
gggactctctgtacagatgatcctc

SEQ ID NO: 628747 - DNA, 25 bp, Mus musculus
gggactctctgttcagatgatcctc

SEQ ID NO: 628748 - DNA, 25 bp, Mus musculus
gggactctcttcattatctatgtac

SEQ ID NO: 628749 - DNA, 25 bp, Mus musculus
gggactctcttctttatctatgtac

SEQ ID NO: 628750 - DNA, 25 bp, Mus musculus
gggactctgaaaaggccgcaggttt

SEQ ID NO: 628751 - DNA, 25 bp, Mus musculus
gggactctgaaatggccgcaggttt

SEQ ID NO: 628752 - DNA, 25 bp, Mus musculus
gggactctggccaaatgtggccctg

SEQ ID NO: 628753 - DNA, 25 bp, Mus musculus
gggactctggcctaatgtggccctg

SEQ ID NO: 628754 - DNA, 25 bp, Mus musculus
gggactctgggcaacatgaagtttg

SEQ ID NO: 628755 - DNA, 25 bp, Mus musculus
gggactctgggctacatgaagtttg

SEQ ID NO: 628756 - DNA, 25 bp, Mus musculus
gggactctgtgaaacctcagaagcc

SEQ ID NO: 628757 - DNA, 25 bp, Mus musculus
gggactctgtgatacctcagaagcc

SEQ ID NO: 628758 - DNA, 25 bp, Mus musculus
gggactctgtgccaaatttatgcaa

SEQ ID NO: 628759 - DNA, 25 bp, Mus musculus
gggactctgtgcgaaatttatgcaa

SEQ ID NO: 628760 - DNA, 25 bp, Mus musculus
gggactctgtggcatttcagcacta

SEQ ID NO: 628761 - DNA, 25 bp, Mus musculus
gggactctgtgggatttcagcacta

SEQ ID NO: 628762 - DNA, 25 bp, Mus musculus
gggactctgttcattgtgagctctg

SEQ ID NO: 628763 - DNA, 25 bp, Mus musculus
gggactctgttctttgtgagctctg

SEQ ID NO: 628764 - DNA, 25 bp, Mus musculus
gggactcttcagactctgcaggatc

SEQ ID NO: 628765 - DNA, 25 bp, Mus musculus
gggactcttcagtctctgcaggatc

SEQ ID NO: 628766 - DNA, 25 bp, Mus musculus
gggactcttggtagatcggccatct

SEQ ID NO: 628767 - DNA, 25 bp, Mus musculus
gggactcttggttgatcggccatct

SEQ ID NO: 628768 - DNA, 25 bp, Mus musculus
gggactcttgtgcaatactactaca

SEQ ID NO: 628769 - DNA, 25 bp, Mus musculus
gggactcttgtggaatactactaca

SEQ ID NO: 628770 - DNA, 25 bp, Mus musculus
gggactctttacaaactggcatctt

SEQ ID NO: 628771 - DNA, 25 bp, Mus musculus
gggactctttactaactggcatctt

SEQ ID NO: 628772 - DNA, 25 bp, Mus musculus
gggactcttttgaagtcagttgtca

SEQ ID NO: 628773 - DNA, 25 bp, Mus musculus
gggactcttttgtagtcagttgtca

SEQ ID NO: 628774 - DNA, 25 bp, Mus musculus
gggactctttttcactgcggttagc

SEQ ID NO: 628775 - DNA, 25 bp, Mus musculus
gggactctttttgactgcggttagc

SEQ ID NO: 628776 - DNA, 25 bp, Mus musculus
gggactgaaaaccaccatcgatacc

SEQ ID NO: 628777 - DNA, 25 bp, Mus musculus
gggactgaaaacgaccatcgatacc

SEQ ID NO: 628778 - DNA, 25 bp, Mus musculus
gggactgaacaactgccagattctt

SEQ ID NO: 628779 - DNA, 25 bp, Mus musculus
gggactgaacaagtgccagattctt

SEQ ID NO: 628780 - DNA, 25 bp, Mus musculus
gggactgaacacatctgacttcctc

SEQ ID NO: 628781 - DNA, 25 bp, Mus musculus
gggactgaacacttctgacttcctc

SEQ ID NO: 628782 - DNA, 25 bp, Mus musculus
gggactgaacagaccgacctagagt

SEQ ID NO: 628783 - DNA, 25 bp, Mus musculus
gggactgaacagtccgacctagagt

SEQ ID NO: 628784 - DNA, 25 bp, Mus musculus
gggactgaactaagagacactgtaa

SEQ ID NO: 628785 - DNA, 25 bp, Mus musculus
gggactgaactatgagacactgtaa

SEQ ID NO: 628786 - DNA, 25 bp, Mus musculus
gggactgaactcaggttgtcgtgaa

SEQ ID NO: 628787 - DNA, 25 bp, Mus musculus
gggactgaactctggttgtcgtgaa

SEQ ID NO: 628788 - DNA, 25 bp, Mus musculus
gggactgaagaaattcatttactta

SEQ ID NO: 628789 - DNA, 25 bp, Mus musculus
gggactgaagaatttcatttactta

SEQ ID NO: 628790 - DNA, 25 bp, Mus musculus
gggactgaagacaatgttccattga

SEQ ID NO: 628791 - DNA, 25 bp, Mus musculus
gggactgaagactatgttccattga

SEQ ID NO: 628792 - DNA, 25 bp, Mus musculus
gggactgaagcaagcttttacttct

SEQ ID NO: 628793 - DNA, 25 bp, Mus musculus
gggactgaagcatgcttttacttct

SEQ ID NO: 628794 - DNA, 25 bp, Mus musculus
gggactgaaggtctttgctaccaca

SEQ ID NO: 628795 - DNA, 25 bp, Mus musculus
gggactgaaggtgtttgctaccaca

SEQ ID NO: 628796 - DNA, 25 bp, Mus musculus
gggactgaagtactcctgaagccag

SEQ ID NO: 628797 - DNA, 25 bp, Mus musculus
gggactgaagtagtcctgaagccag

SEQ ID NO: 628798 - DNA, 25 bp, Mus musculus
gggactgaatttctatcctctacaa

SEQ ID NO: 628799 - DNA, 25 bp, Mus musculus
gggactgaatttgtatcctctacaa

SEQ ID NO: 628800 - DNA, 25 bp, Mus musculus
gggactgacacgctgcccatgaaat

SEQ ID NO: 628801 - DNA, 25 bp, Mus musculus
gggactgacacggtgcccatgaaat

SEQ ID NO: 628802 - DNA, 25 bp, Mus musculus
gggactgacattcggatcccatctt

SEQ ID NO: 628803 - DNA, 25 bp, Mus musculus
gggactgacattgggatcccatctt

SEQ ID NO: 628804 - DNA, 25 bp, Mus musculus
gggactgaccttatgacaattttag

SEQ ID NO: 628805 - DNA, 25 bp, Mus musculus
gggactgaccttttgacaattttag

SEQ ID NO: 628806 - DNA, 25 bp, Mus musculus
gggactgacgcaacacacgtgtaac

SEQ ID NO: 628807 - DNA, 25 bp, Mus musculus
gggactgacgcatcacacgtgtaac

SEQ ID NO: 628808 - DNA, 25 bp, Mus musculus
gggactgactaaacttcatctgacc

SEQ ID NO: 628809 - DNA, 25 bp, Mus musculus
gggactgactaatcttcatctgacc

SEQ ID NO: 628810 - DNA, 25 bp, Mus musculus
gggactgactcaccgatgacttgga

SEQ ID NO: 628811 - DNA, 25 bp, Mus musculus
gggactgactcagcgatgacttgga

SEQ ID NO: 628812 - DNA, 25 bp, Mus musculus
gggactgactccaggcctgagtgat

SEQ ID NO: 628813 - DNA, 25 bp, Mus musculus
gggactgactccagggtagtagtaa

SEQ ID NO: 628814 - DNA, 25 bp, Mus musculus
gggactgactcctggcctgagtgat

SEQ ID NO: 628815 - DNA, 25 bp, Mus musculus
gggactgactcctgggtagtagtaa

SEQ ID NO: 628816 - DNA, 25 bp, Mus musculus
gggactgactgactgtgtcattgta

SEQ ID NO: 628817 - DNA, 25 bp, Mus musculus
gggactgactgagtgtgtcattgta

SEQ ID NO: 628818 - DNA, 25 bp, Mus musculus
gggactgactgcacccgcatgaaca

SEQ ID NO: 628819 - DNA, 25 bp, Mus musculus
gggactgactgcagattgtgcctat

SEQ ID NO: 628820 - DNA, 25 bp, Mus musculus
gggactgactgcctcagtactgtca

SEQ ID NO: 628821 - DNA, 25 bp, Mus musculus
gggactgactgcgtcagtactgtca

SEQ ID NO: 628822 - DNA, 25 bp, Mus musculus
gggactgactgctcccgcatgaaca

SEQ ID NO: 628823 - DNA, 25 bp, Mus musculus
gggactgactgctgattgtgcctat

SEQ ID NO: 628824 - DNA, 25 bp, Mus musculus
gggactgagcgacgaactactagat

SEQ ID NO: 628825 - DNA, 25 bp, Mus musculus
gggactgagcgaggaactactagat

SEQ ID NO: 628826 - DNA, 25 bp, Mus musculus
gggactgagcttatcctcactgcag

SEQ ID NO: 628827 - DNA, 25 bp, Mus musculus
gggactgagcttttcctcactgcag

SEQ ID NO: 628828 - DNA, 25 bp, Mus musculus
gggactgagtcaaatttaccttcgc

SEQ ID NO: 628829 - DNA, 25 bp, Mus musculus
gggactgagtcatatttaccttcgc

SEQ ID NO: 628830 - DNA, 25 bp, Mus musculus
gggactgagtccaggccatcaggtt

SEQ ID NO: 628831 - DNA, 25 bp, Mus musculus
gggactgagtcctggccatcaggtt

SEQ ID NO: 628832 - DNA, 25 bp, Mus musculus
gggactgagtggcaaccaccccttt

SEQ ID NO: 628833 - DNA, 25 bp, Mus musculus
gggactgagtgggaaccaccccttt

SEQ ID NO: 628834 - DNA, 25 bp, Mus musculus
gggactgagttcagtacacacttgt

SEQ ID NO: 628835 - DNA, 25 bp, Mus musculus
gggactgagttctgtacacacttgt

SEQ ID NO: 628836 - DNA, 25 bp, Mus musculus
gggactgatggtcccagtgtcattc

SEQ ID NO: 628837 - DNA, 25 bp, Mus musculus
gggactgatggtgccagtgtcattc

SEQ ID NO: 628838 - DNA, 25 bp, Mus musculus
gggactgcaaccagaagacgttaat

SEQ ID NO: 628839 - DNA, 25 bp, Mus musculus
gggactgcaacctgaagacgttaat

SEQ ID NO: 628840 - DNA, 25 bp, Mus musculus
gggactgcacaactctgggctccaa

SEQ ID NO: 628841 - DNA, 25 bp, Mus musculus
gggactgcacaagtctgggctccaa

SEQ ID NO: 628842 - DNA, 25 bp, Mus musculus
gggactgcagacacatctgggccca

SEQ ID NO: 628843 - DNA, 25 bp, Mus musculus
gggactgcagactcatctgggccca

SEQ ID NO: 628844 - DNA, 25 bp, Mus musculus
gggactgcaggaagcatgtgttcta

SEQ ID NO: 628845 - DNA, 25 bp, Mus musculus
gggactgcaggatgcatgtgttcta

SEQ ID NO: 628846 - DNA, 25 bp, Mus musculus
gggactgcagttcttatcctgaaat

SEQ ID NO: 628847 - DNA, 25 bp, Mus musculus
gggactgcagttgttatcctgaaat

SEQ ID NO: 628848 - DNA, 25 bp, Mus musculus
gggactgcataacttcttgttaatt

SEQ ID NO: 628849 - DNA, 25 bp, Mus musculus
gggactgcataagttcttgttaatt

SEQ ID NO: 628850 - DNA, 25 bp, Mus musculus
gggactgccaatatctgcttgggat

SEQ ID NO: 628851 - DNA, 25 bp, Mus musculus
gggactgccaatttctgcttgggat

SEQ ID NO: 628852 - DNA, 25 bp, Mus musculus
gggactgccaggacctatttattaa

SEQ ID NO: 628853 - DNA, 25 bp, Mus musculus
gggactgccaggtcctatttattaa

SEQ ID NO: 628854 - DNA, 25 bp, Mus musculus
gggactgcctagcagttctacacac

SEQ ID NO: 628855 - DNA, 25 bp, Mus musculus
gggactgcctaggagttctacacac

SEQ ID NO: 628856 - DNA, 25 bp, Mus musculus
gggactgcctttaatgatgtcataa

SEQ ID NO: 628857 - DNA, 25 bp, Mus musculus
gggactgcctttaccaacaagacta

SEQ ID NO: 628858 - DNA, 25 bp, Mus musculus
gggactgccttttatgatgtcataa

SEQ ID NO: 628859 - DNA, 25 bp, Mus musculus
gggactgccttttccaacaagacta

SEQ ID NO: 628860 - DNA, 25 bp, Mus musculus
gggactgcgaccaggctgctgtcat

SEQ ID NO: 628861 - DNA, 25 bp, Mus musculus
gggactgcgacctggctgctgtcat

SEQ ID NO: 628862 - DNA, 25 bp, Mus musculus
gggactgcggaaaccatcggcaccg

SEQ ID NO: 628863 - DNA, 25 bp, Mus musculus
gggactgcggaatccatcggcaccg

SEQ ID NO: 628864 - DNA, 25 bp, Mus musculus
gggactgctatgatactaccttatt

SEQ ID NO: 628865 - DNA, 25 bp, Mus musculus
gggactgctatgttactaccttatt

SEQ ID NO: 628866 - DNA, 25 bp, Mus musculus
gggactgctcacattttatatattt

SEQ ID NO: 628867 - DNA, 25 bp, Mus musculus
gggactgctcaccttaatgcgcctt

SEQ ID NO: 628868 - DNA, 25 bp, Mus musculus
gggactgctcacgttaatgcgcctt

SEQ ID NO: 628869 - DNA, 25 bp, Mus musculus
gggactgctcactttttatatattt

SEQ ID NO: 628870 - DNA, 25 bp, Mus musculus
gggactgctcctaggacatcagaga

SEQ ID NO: 628871 - DNA, 25 bp, Mus musculus
gggactgctccttggacatcagaga

SEQ ID NO: 628872 - DNA, 25 bp, Mus musculus
gggactgctgcacatggcataaaga

SEQ ID NO: 628873 - DNA, 25 bp, Mus musculus
gggactgctgcagatggcataaaga

SEQ ID NO: 628874 - DNA, 25 bp, Mus musculus
gggactgctgctcatctcaatgaga

SEQ ID NO: 628875 - DNA, 25 bp, Mus musculus
gggactgctgctgatctcaatgaga

SEQ ID NO: 628876 - DNA, 25 bp, Mus musculus
gggactgctggacttactgacttgc

SEQ ID NO: 628877 - DNA, 25 bp, Mus musculus
gggactgctggagttactgacttgc

SEQ ID NO: 628878 - DNA, 25 bp, Mus musculus
gggactgctgggatctaatgatgac

SEQ ID NO: 628879 - DNA, 25 bp, Mus musculus
gggactgctgggttctaatgatgac

SEQ ID NO: 628880 - DNA, 25 bp, Mus musculus
gggactgcttcaagataaccggcga

SEQ ID NO: 628881 - DNA, 25 bp, Mus musculus
gggactgcttcatgataaccggcga

SEQ ID NO: 628882 - DNA, 25 bp, Mus musculus
gggactgctttactccataatctgc

SEQ ID NO: 628883 - DNA, 25 bp, Mus musculus
gggactgctttagtccataatctgc

SEQ ID NO: 628884 - DNA, 25 bp, Mus musculus
gggactggacacaagagatgcttgt

SEQ ID NO: 628885 - DNA, 25 bp, Mus musculus
gggactggacactagagatgcttgt

SEQ ID NO: 628886 - DNA, 25 bp, Mus musculus
gggactggacagcagacccaacctg

SEQ ID NO: 628887 - DNA, 25 bp, Mus musculus
gggactggacaggagacccaacctg

SEQ ID NO: 628888 - DNA, 25 bp, Mus musculus
gggactggacccatacaatatgcta

SEQ ID NO: 628889 - DNA, 25 bp, Mus musculus
gggactggacccttacaatatgcta

SEQ ID NO: 628890 - DNA, 25 bp, Mus musculus
gggactggacctagaacttcatgca

SEQ ID NO: 628891 - DNA, 25 bp, Mus musculus
gggactggaccttgaacttcatgca

SEQ ID NO: 628892 - DNA, 25 bp, Mus musculus
gggactggagtcactgtgtctacac

SEQ ID NO: 628893 - DNA, 25 bp, Mus musculus
gggactggagtctctgtgtctacac

SEQ ID NO: 628894 - DNA, 25 bp, Mus musculus
gggactggatgtcaccacccctgaa

SEQ ID NO: 628895 - DNA, 25 bp, Mus musculus
gggactggatgtgaccacccctgaa

SEQ ID NO: 628896 - DNA, 25 bp, Mus musculus
gggactggcaccagaattgttcctt

SEQ ID NO: 628897 - DNA, 25 bp, Mus musculus
gggactggcacctgaattgttcctt

SEQ ID NO: 628898 - DNA, 25 bp, Mus musculus
gggactggcactcagaagactgtat

SEQ ID NO: 628899 - DNA, 25 bp, Mus musculus
gggactggcactgagaagactgtat

SEQ ID NO: 628900 - DNA, 25 bp, Mus musculus
gggactggccacaattttaaagatc

SEQ ID NO: 628901 - DNA, 25 bp, Mus musculus
gggactggccactattttaaagatc

SEQ ID NO: 628902 - DNA, 25 bp, Mus musculus
gggactggctggactttgacaacat

SEQ ID NO: 628903 - DNA, 25 bp, Mus musculus
gggactggctggtctttgacaacat

SEQ ID NO: 628904 - DNA, 25 bp, Mus musculus
gggactggcttaaaagttcagtgcc

SEQ ID NO: 628905 - DNA, 25 bp, Mus musculus
gggactggcttataagttcagtgcc

SEQ ID NO: 628906 - DNA, 25 bp, Mus musculus
gggactgggcataacatcgaaccac

SEQ ID NO: 628907 - DNA, 25 bp, Mus musculus
gggactgggcattacatcgaaccac

SEQ ID NO: 628908 - DNA, 25 bp, Mus musculus
gggactgggctcaaagaaccatttc

SEQ ID NO: 628909 - DNA, 25 bp, Mus musculus
gggactgggctctaagaaccatttc

SEQ ID NO: 628910 - DNA, 25 bp, Mus musculus
gggactgggtagaacttctgagttt

SEQ ID NO: 628911 - DNA, 25 bp, Mus musculus
gggactgggtagtacttctgagttt

SEQ ID NO: 628912 - DNA, 25 bp, Mus musculus
gggactggtgcgaccataagaactt

SEQ ID NO: 628913 - DNA, 25 bp, Mus musculus
gggactggtgcgtccataagaactt

SEQ ID NO: 628914 - DNA, 25 bp, Mus musculus
gggactggttctcctcagggtttcc

SEQ ID NO: 628915 - DNA, 25 bp, Mus musculus
gggactggttctgctcagggtttcc

SEQ ID NO: 628916 - DNA, 25 bp, Mus musculus
gggactgtaaatatagctcaccttt

SEQ ID NO: 628917 - DNA, 25 bp, Mus musculus
gggactgtaaatttagctcaccttt

SEQ ID NO: 628918 - DNA, 25 bp, Mus musculus
gggactgtaagcatcagccataatt

SEQ ID NO: 628919 - DNA, 25 bp, Mus musculus
gggactgtaagcttcagccataatt

SEQ ID NO: 628920 - DNA, 25 bp, Mus musculus
gggactgtactcaagctcggtggct

SEQ ID NO: 628921 - DNA, 25 bp, Mus musculus
gggactgtactcacctatctatctt

SEQ ID NO: 628922 - DNA, 25 bp, Mus musculus
gggactgtactctagctcggtggct

SEQ ID NO: 628923 - DNA, 25 bp, Mus musculus
gggactgtactctcctatctatctt

SEQ ID NO: 628924 - DNA, 25 bp, Mus musculus
gggactgtatatcccaactcaatgc

SEQ ID NO: 628925 - DNA, 25 bp, Mus musculus
gggactgtatatgccaactcaatgc

SEQ ID NO: 628926 - DNA, 25 bp, Mus musculus
gggactgtatgcctcatgctggcac

SEQ ID NO: 628927 - DNA, 25 bp, Mus musculus
gggactgtatgcgtcatgctggcac

SEQ ID NO: 628928 - DNA, 25 bp, Mus musculus
gggactgtatttctgagcatctaga

SEQ ID NO: 628929 - DNA, 25 bp, Mus musculus
gggactgtatttgtgagcatctaga

SEQ ID NO: 628930 - DNA, 25 bp, Mus musculus
gggactgtcaagaacctatcaatga

SEQ ID NO: 628931 - DNA, 25 bp, Mus musculus
gggactgtcaagatggccgcacctg

SEQ ID NO: 628932 - DNA, 25 bp, Mus musculus
gggactgtcaagtacctatcaatga

SEQ ID NO: 628933 - DNA, 25 bp, Mus musculus
gggactgtcaagttggccgcacctg

SEQ ID NO: 628934 - DNA, 25 bp, Mus musculus
gggactgtcacacccacatggtaaa

SEQ ID NO: 628935 - DNA, 25 bp, Mus musculus
gggactgtcacagccacatggtaaa

SEQ ID NO: 628936 - DNA, 25 bp, Mus musculus
gggactgtcagtatccccaagagtc

SEQ ID NO: 628937 - DNA, 25 bp, Mus musculus
gggactgtcagtttccccaagagtc

SEQ ID NO: 628938 - DNA, 25 bp, Mus musculus
gggactgtcattaggaaatcctcaa

SEQ ID NO: 628939 - DNA, 25 bp, Mus musculus
gggactgtcattctcagtatcatgt

SEQ ID NO: 628940 - DNA, 25 bp, Mus musculus
gggactgtcattgtcagtatcatgt

SEQ ID NO: 628941 - DNA, 25 bp, Mus musculus
gggactgtcatttggaaatcctcaa

SEQ ID NO: 628942 - DNA, 25 bp, Mus musculus
gggactgtccgaagcgatgcctgtc

SEQ ID NO: 628943 - DNA, 25 bp, Mus musculus
gggactgtccgatgcgatgcctgtc

SEQ ID NO: 628944 - DNA, 25 bp, Mus musculus
gggactgtcctcaaaaatataacct

SEQ ID NO: 628945 - DNA, 25 bp, Mus musculus
gggactgtcctcacgacctatcttg

SEQ ID NO: 628946 - DNA, 25 bp, Mus musculus
gggactgtcctctaaaatataacct

SEQ ID NO: 628947 - DNA, 25 bp, Mus musculus
gggactgtcctctcgacctatcttg

SEQ ID NO: 628948 - DNA, 25 bp, Mus musculus
gggactgtcgccagatgcgtgtccc

SEQ ID NO: 628949 - DNA, 25 bp, Mus musculus
gggactgtcgcctgatgcgtgtccc

SEQ ID NO: 628950 - DNA, 25 bp, Mus musculus
gggactgtctacattacaaactgag

SEQ ID NO: 628951 - DNA, 25 bp, Mus musculus
gggactgtctactttacaaactgag

SEQ ID NO: 628952 - DNA, 25 bp, Mus musculus
gggactgtctttactcataggaagt

SEQ ID NO: 628953 - DNA, 25 bp, Mus musculus
gggactgtcttttctcataggaagt

SEQ ID NO: 628954 - DNA, 25 bp, Mus musculus
gggactgtgccccatgcagcagtac

SEQ ID NO: 628955 - DNA, 25 bp, Mus musculus
gggactgtgcccgatgcagcagtac

SEQ ID NO: 628956 - DNA, 25 bp, Mus musculus
gggactgtgcctaaagaaccttgca

SEQ ID NO: 628957 - DNA, 25 bp, Mus musculus
gggactgtgccttaagaaccttgca

SEQ ID NO: 628958 - DNA, 25 bp, Mus musculus
gggactgtgctaaagccagccagaa

SEQ ID NO: 628959 - DNA, 25 bp, Mus musculus
gggactgtgctatagccagccagaa

SEQ ID NO: 628960 - DNA, 25 bp, Mus musculus
gggactgtggaaaatcctcttccct

SEQ ID NO: 628961 - DNA, 25 bp, Mus musculus
gggactgtggaatatcctcttccct

SEQ ID NO: 628962 - DNA, 25 bp, Mus musculus
gggactgtgtccaagcaaaaattca

SEQ ID NO: 628963 - DNA, 25 bp, Mus musculus
gggactgtgtcctagcaaaaattca

SEQ ID NO: 628964 - DNA, 25 bp, Mus musculus
gggactgtgtgtaaaggacccacct

SEQ ID NO: 628965 - DNA, 25 bp, Mus musculus
gggactgtgtgttaaggacccacct

SEQ ID NO: 628966 - DNA, 25 bp, Mus musculus
gggactgttacactgagggcaccat

SEQ ID NO: 628967 - DNA, 25 bp, Mus musculus
gggactgttacagtgagggcaccat

SEQ ID NO: 628968 - DNA, 25 bp, Mus musculus
gggactgttcgcaccgtcacctctg

SEQ ID NO: 628969 - DNA, 25 bp, Mus musculus
gggactgttcgctccgtcacctctg

SEQ ID NO: 628970 - DNA, 25 bp, Mus musculus
gggactgtttttctccgttgctctt

SEQ ID NO: 628971 - DNA, 25 bp, Mus musculus
gggactgtttttgtccgttgctctt

SEQ ID NO: 628972 - DNA, 25 bp, Mus musculus
gggacttaaagccagcaagcgacat

SEQ ID NO: 628973 - DNA, 25 bp, Mus musculus
gggacttaaagcgagcaagcgacat

SEQ ID NO: 628974 - DNA, 25 bp, Mus musculus
gggacttaaatgacctgcccgagta

SEQ ID NO: 628975 - DNA, 25 bp, Mus musculus
gggacttaaatgtcctgcccgagta

SEQ ID NO: 628976 - DNA, 25 bp, Mus musculus
gggacttaaccaaagaattcttgaa

SEQ ID NO: 628977 - DNA, 25 bp, Mus musculus
gggacttaaccatagaattcttgaa

SEQ ID NO: 628978 - DNA, 25 bp, Mus musculus
gggacttaactccagggtctaccag

SEQ ID NO: 628979 - DNA, 25 bp, Mus musculus
gggacttaactcgagggtctaccag

SEQ ID NO: 628980 - DNA, 25 bp, Mus musculus
gggacttaagctatggaccatcgtg

SEQ ID NO: 628981 - DNA, 25 bp, Mus musculus
gggacttaagctttggaccatcgtg

SEQ ID NO: 628982 - DNA, 25 bp, Mus musculus
gggacttaataacactccgaggaag

SEQ ID NO: 628983 - DNA, 25 bp, Mus musculus
gggacttaataagactccgaggaag

SEQ ID NO: 628984 - DNA, 25 bp, Mus musculus
gggacttacaagcagattcctggct

SEQ ID NO: 628985 - DNA, 25 bp, Mus musculus
gggacttacaagctcaagggccaga

SEQ ID NO: 628986 - DNA, 25 bp, Mus musculus
gggacttacaaggagattcctggct

SEQ ID NO: 628987 - DNA, 25 bp, Mus musculus
gggacttacaaggtcaagggccaga

SEQ ID NO: 628988 - DNA, 25 bp, Mus musculus
gggacttacacacacatgggtttat

SEQ ID NO: 628989 - DNA, 25 bp, Mus musculus
gggacttacacactgctcattggcc

SEQ ID NO: 628990 - DNA, 25 bp, Mus musculus
gggacttacacagacatgggtttat

SEQ ID NO: 628991 - DNA, 25 bp, Mus musculus
gggacttacacagtgctcattggcc

SEQ ID NO: 628992 - DNA, 25 bp, Mus musculus
gggacttacaccagtatgaacacct

SEQ ID NO: 628993 - DNA, 25 bp, Mus musculus
gggacttacacctgtatgaacacct

SEQ ID NO: 628994 - DNA, 25 bp, Mus musculus
gggacttaccttagatctcactcag

SEQ ID NO: 628995 - DNA, 25 bp, Mus musculus
gggacttacctttgatctcactcag

SEQ ID NO: 628996 - DNA, 25 bp, Mus musculus
gggacttactgcattcttaaacatt

SEQ ID NO: 628997 - DNA, 25 bp, Mus musculus
gggacttactgctttcttaaacatt

SEQ ID NO: 628998 - DNA, 25 bp, Mus musculus
gggacttacttgacagtggaattac

SEQ ID NO: 628999 - DNA, 25 bp, Mus musculus
gggacttacttgaggcactacgaca

SEQ ID NO: 629000 - DNA, 25 bp, Mus musculus
gggacttacttgtcagtggaattac

SEQ ID NO: 629001 - DNA, 25 bp, Mus musculus
gggacttacttgtggcactacgaca

SEQ ID NO: 629002 - DNA, 25 bp, Mus musculus
gggacttagtgacaactcggttgcc

SEQ ID NO: 629003 - DNA, 25 bp, Mus musculus
gggacttagtgagaactcggttgcc

SEQ ID NO: 629004 - DNA, 25 bp, Mus musculus
gggacttatcctattgaagatcaat

SEQ ID NO: 629005 - DNA, 25 bp, Mus musculus
gggacttatccttttgaagatcaat

SEQ ID NO: 629006 - DNA, 25 bp, Mus musculus
gggacttatctgctgtgtgacacat

SEQ ID NO: 629007 - DNA, 25 bp, Mus musculus
gggacttatctggtgtgtgacacat

SEQ ID NO: 629008 - DNA, 25 bp, Mus musculus
gggacttatgccactgggcagctaa

SEQ ID NO: 629009 - DNA, 25 bp, Mus musculus
gggacttatgccatggttcacagta

SEQ ID NO: 629010 - DNA, 25 bp, Mus musculus
gggacttatgcctctgggcagctaa

SEQ ID NO: 629011 - DNA, 25 bp, Mus musculus
gggacttatgccttggttcacagta

SEQ ID NO: 629012 - DNA, 25 bp, Mus musculus
gggacttatgtaatcaccttgactg

SEQ ID NO: 629013 - DNA, 25 bp, Mus musculus
gggacttatgtattcaccttgactg

SEQ ID NO: 629014 - DNA, 25 bp, Mus musculus
gggacttcaaccagaggccagagca

SEQ ID NO: 629015 - DNA, 25 bp, Mus musculus
gggacttcaacctgaggccagagca

SEQ ID NO: 629016 - DNA, 25 bp, Mus musculus
gggacttcaagtctcattccttaaa

SEQ ID NO: 629017 - DNA, 25 bp, Mus musculus
gggacttcaagtgtcattccttaaa

SEQ ID NO: 629018 - DNA, 25 bp, Mus musculus
gggacttcactaataccatgctggc

SEQ ID NO: 629019 - DNA, 25 bp, Mus musculus
gggacttcactattaccatgctggc

SEQ ID NO: 629020 - DNA, 25 bp, Mus musculus
gggacttcagacattttaacctcag

SEQ ID NO: 629021 - DNA, 25 bp, Mus musculus
gggacttcagactttttaacctcag

SEQ ID NO: 629022 - DNA, 25 bp, Mus musculus
gggacttcagctaaatactcgaacg

SEQ ID NO: 629023 - DNA, 25 bp, Mus musculus
gggacttcagcttaatactcgaacg

SEQ ID NO: 629024 - DNA, 25 bp, Mus musculus
gggacttcatctctcaagcccttaa

SEQ ID NO: 629025 - DNA, 25 bp, Mus musculus
gggacttcatctgtcaagcccttaa

SEQ ID NO: 629026 - DNA, 25 bp, Mus musculus
gggacttcatgcaaagtttctccag

SEQ ID NO: 629027 - DNA, 25 bp, Mus musculus
gggacttcatgctaagtttctccag

SEQ ID NO: 629028 - DNA, 25 bp, Mus musculus
gggacttccaaacgtaccgcctgag

SEQ ID NO: 629029 - DNA, 25 bp, Mus musculus
gggacttccaaaggtaccgcctgag

SEQ ID NO: 629030 - DNA, 25 bp, Mus musculus
gggacttccaagatcacagctttta

SEQ ID NO: 629031 - DNA, 25 bp, Mus musculus
gggacttccaagttcacagctttta

SEQ ID NO: 629032 - DNA, 25 bp, Mus musculus
gggacttccacaatagtcttttccg

SEQ ID NO: 629033 - DNA, 25 bp, Mus musculus
gggacttccacattagtcttttccg

SEQ ID NO: 629034 - DNA, 25 bp, Mus musculus
gggacttccagaattgcatattgca

SEQ ID NO: 629035 - DNA, 25 bp, Mus musculus
gggacttccagatttgcatattgca

SEQ ID NO: 629036 - DNA, 25 bp, Mus musculus
gggacttccagtcatttgtcaaaga

SEQ ID NO: 629037 - DNA, 25 bp, Mus musculus
gggacttccagtgatttgtcaaaga

SEQ ID NO: 629038 - DNA, 25 bp, Mus musculus
gggacttccatgattgcttcctaga

SEQ ID NO: 629039 - DNA, 25 bp, Mus musculus
gggacttccatgtttgcttcctaga

SEQ ID NO: 629040 - DNA, 25 bp, Mus musculus
gggacttcccttctttattatggca

SEQ ID NO: 629041 - DNA, 25 bp, Mus musculus
gggacttcccttgtttattatggca

SEQ ID NO: 629042 - DNA, 25 bp, Mus musculus
gggacttccggaaagccatgatcca

SEQ ID NO: 629043 - DNA, 25 bp, Mus musculus
gggacttccggatagccatgatcca

SEQ ID NO: 629044 - DNA, 25 bp, Mus musculus
gggacttcctgaatgatccagctgc

SEQ ID NO: 629045 - DNA, 25 bp, Mus musculus
gggacttcctgattgatccagctgc

SEQ ID NO: 629046 - DNA, 25 bp, Mus musculus
gggacttcctgtccgtcacttcctg

SEQ ID NO: 629047 - DNA, 25 bp, Mus musculus
gggacttcctgtgcgtcacttcctg

SEQ ID NO: 629048 - DNA, 25 bp, Mus musculus
gggacttcgcagctacagcacatct

SEQ ID NO: 629049 - DNA, 25 bp, Mus musculus
gggacttcgcaggtacagcacatct

SEQ ID NO: 629050 - DNA, 25 bp, Mus musculus
gggacttcgcatacatctactatga

SEQ ID NO: 629051 - DNA, 25 bp, Mus musculus
gggacttcgcattcatctactatga

SEQ ID NO: 629052 - DNA, 25 bp, Mus musculus
gggacttctacacactggttgctaa

SEQ ID NO: 629053 - DNA, 25 bp, Mus musculus
gggacttctacagactggttgctaa

SEQ ID NO: 629054 - DNA, 25 bp, Mus musculus
gggacttctcataatcagatgcttc

SEQ ID NO: 629055 - DNA, 25 bp, Mus musculus
gggacttctcatctttaggtaccac

SEQ ID NO: 629056 - DNA, 25 bp, Mus musculus
gggacttctcatgtttaggtaccac

SEQ ID NO: 629057 - DNA, 25 bp, Mus musculus
gggacttctcattatcagatgcttc

SEQ ID NO: 629058 - DNA, 25 bp, Mus musculus
gggacttctctcataaagcctcgtt

SEQ ID NO: 629059 - DNA, 25 bp, Mus musculus
gggacttctctcttaaagcctcgtt

SEQ ID NO: 629060 - DNA, 25 bp, Mus musculus
gggacttctgaccactggattggcc

SEQ ID NO: 629061 - DNA, 25 bp, Mus musculus
gggacttctgacgactggattggcc

SEQ ID NO: 629062 - DNA, 25 bp, Mus musculus
gggacttctgcacttgagtagctcc

SEQ ID NO: 629063 - DNA, 25 bp, Mus musculus
gggacttctgcagttgagtagctcc

SEQ ID NO: 629064 - DNA, 25 bp, Mus musculus
gggacttctgctaccctattaagat

SEQ ID NO: 629065 - DNA, 25 bp, Mus musculus
gggacttctgcttccctattaagat

SEQ ID NO: 629066 - DNA, 25 bp, Mus musculus
gggacttctggcactgtttcctgct

SEQ ID NO: 629067 - DNA, 25 bp, Mus musculus
gggacttctggcctactagtgtgtc

SEQ ID NO: 629068 - DNA, 25 bp, Mus musculus
gggacttctggcgtactagtgtgtc

SEQ ID NO: 629069 - DNA, 25 bp, Mus musculus
gggacttctggctctgtttcctgct

SEQ ID NO: 629070 - DNA, 25 bp, Mus musculus
gggacttctgtacgagacatctcac

SEQ ID NO: 629071 - DNA, 25 bp, Mus musculus
gggacttctgtaggagacatctcac

SEQ ID NO: 629072 - DNA, 25 bp, Mus musculus
gggacttcttcgacctgatgagcaa

SEQ ID NO: 629073 - DNA, 25 bp, Mus musculus
gggacttcttcgtcctgatgagcaa

SEQ ID NO: 629074 - DNA, 25 bp, Mus musculus
gggacttctttcatatgtttatata

SEQ ID NO: 629075 - DNA, 25 bp, Mus musculus
gggacttctttcttatgtttatata

SEQ ID NO: 629076 - DNA, 25 bp, Mus musculus
gggacttcttttccctgttaatgag

SEQ ID NO: 629077 - DNA, 25 bp, Mus musculus
gggacttcttttgcctgttaatgag

SEQ ID NO: 629078 - DNA, 25 bp, Mus musculus
gggacttgaagccagacaacctgtt

SEQ ID NO: 629079 - DNA, 25 bp, Mus musculus
gggacttgaagcgagacaacctgtt

SEQ ID NO: 629080 - DNA, 25 bp, Mus musculus
gggacttgacaaacatgcacatgaa

SEQ ID NO: 629081 - DNA, 25 bp, Mus musculus
gggacttgacaatcatgcacatgaa

SEQ ID NO: 629082 - DNA, 25 bp, Mus musculus
gggacttgacacacctatccagggt

SEQ ID NO: 629083 - DNA, 25 bp, Mus musculus
gggacttgacactcctatccagggt

SEQ ID NO: 629084 - DNA, 25 bp, Mus musculus
gggacttgagttcccaggaaccaga

SEQ ID NO: 629085 - DNA, 25 bp, Mus musculus
gggacttgagttgccaggaaccaga

SEQ ID NO: 629086 - DNA, 25 bp, Mus musculus
gggacttgatgtcagatctcttcaa

SEQ ID NO: 629087 - DNA, 25 bp, Mus musculus
gggacttgatgtgagatctcttcaa

SEQ ID NO: 629088 - DNA, 25 bp, Mus musculus
gggacttgcagaagaccacgacgtt

SEQ ID NO: 629089 - DNA, 25 bp, Mus musculus
gggacttgcagatgaccacgacgtt

SEQ ID NO: 629090 - DNA, 25 bp, Mus musculus
gggacttgccaaatgatctggttca

SEQ ID NO: 629091 - DNA, 25 bp, Mus musculus
gggacttgccaacctgtttctaaga

SEQ ID NO: 629092 - DNA, 25 bp, Mus musculus
gggacttgccaagctgtttctaaga

SEQ ID NO: 629093 - DNA, 25 bp, Mus musculus
gggacttgccaattgatctggttca

SEQ ID NO: 629094 - DNA, 25 bp, Mus musculus
gggacttgcgccaataaagctttgt

SEQ ID NO: 629095 - DNA, 25 bp, Mus musculus
gggacttgcgcctataaagctttgt

SEQ ID NO: 629096 - DNA, 25 bp, Mus musculus
gggacttgctctcatggacagtgct

SEQ ID NO: 629097 - DNA, 25 bp, Mus musculus
gggacttgctctcgtaaaacactga

SEQ ID NO: 629098 - DNA, 25 bp, Mus musculus
gggacttgctctgatggacagtgct

SEQ ID NO: 629099 - DNA, 25 bp, Mus musculus
gggacttgctctggtaaaacactga

SEQ ID NO: 629100 - DNA, 25 bp, Mus musculus
gggacttgctgccttgtagtccagc

SEQ ID NO: 629101 - DNA, 25 bp, Mus musculus
gggacttgctgcgttgtagtccagc

SEQ ID NO: 629102 - DNA, 25 bp, Mus musculus
gggacttggcgcacactctgggttc

SEQ ID NO: 629103 - DNA, 25 bp, Mus musculus
gggacttggcgctcactctgggttc

SEQ ID NO: 629104 - DNA, 25 bp, Mus musculus
gggacttgggaaagctcacacatgt

SEQ ID NO: 629105 - DNA, 25 bp, Mus musculus
gggacttgggaatgctcacacatgt

SEQ ID NO: 629106 - DNA, 25 bp, Mus musculus
gggacttgggccacgcgagcgggaa

SEQ ID NO: 629107 - DNA, 25 bp, Mus musculus
gggacttgggcctcgcgagcgggaa

SEQ ID NO: 629108 - DNA, 25 bp, Mus musculus
gggacttggtctcacatcactgagc

SEQ ID NO: 629109 - DNA, 25 bp, Mus musculus
gggacttggtctgacatcactgagc

SEQ ID NO: 629110 - DNA, 25 bp, Mus musculus
gggacttggttaaatcagcagttca

SEQ ID NO: 629111 - DNA, 25 bp, Mus musculus
gggacttggttatatcagcagttca

SEQ ID NO: 629112 - DNA, 25 bp, Mus musculus
gggacttggtttaggactctgatga

SEQ ID NO: 629113 - DNA, 25 bp, Mus musculus
gggacttggttttggactctgatga

SEQ ID NO: 629114 - DNA, 25 bp, Mus musculus
gggacttgtcttcgctaacagcagt

SEQ ID NO: 629115 - DNA, 25 bp, Mus musculus
gggacttgtcttggctaacagcagt

SEQ ID NO: 629116 - DNA, 25 bp, Mus musculus
gggacttgtgaaatccgttgccatg

SEQ ID NO: 629117 - DNA, 25 bp, Mus musculus
gggacttgtgaattccgttgccatg

SEQ ID NO: 629118 - DNA, 25 bp, Mus musculus
gggacttgtgcaaaactcaatcctt

SEQ ID NO: 629119 - DNA, 25 bp, Mus musculus
gggacttgtgcataactcaatcctt

SEQ ID NO: 629120 - DNA, 25 bp, Mus musculus
gggacttgtgccctctataagattg

SEQ ID NO: 629121 - DNA, 25 bp, Mus musculus
gggacttgtgccgtctataagattg

SEQ ID NO: 629122 - DNA, 25 bp, Mus musculus
gggacttgtgttacagctcagtagt

SEQ ID NO: 629123 - DNA, 25 bp, Mus musculus
gggacttgtgtttcagctcagtagt

SEQ ID NO: 629124 - DNA, 25 bp, Mus musculus
gggacttgtttcacgatgagctgga

SEQ ID NO: 629125 - DNA, 25 bp, Mus musculus
gggacttgtttccattcaatgacaa

SEQ ID NO: 629126 - DNA, 25 bp, Mus musculus
gggacttgtttcgattcaatgacaa

SEQ ID NO: 629127 - DNA, 25 bp, Mus musculus
gggacttgtttctcgatgagctgga

SEQ ID NO: 629128 - DNA, 25 bp, Mus musculus
gggacttgttttcaagcagtaaata

SEQ ID NO: 629129 - DNA, 25 bp, Mus musculus
gggacttgttttgaagcagtaaata

SEQ ID NO: 629130 - DNA, 25 bp, Mus musculus
gggactttaattactgtgtgagacc

SEQ ID NO: 629131 - DNA, 25 bp, Mus musculus
gggactttaatttctgtgtgagacc

SEQ ID NO: 629132 - DNA, 25 bp, Mus musculus
gggactttagcacacactgaatcga

SEQ ID NO: 629133 - DNA, 25 bp, Mus musculus
gggactttagcagacactgaatcga

SEQ ID NO: 629134 - DNA, 25 bp, Mus musculus
gggactttagtaagcaatggaatgc

SEQ ID NO: 629135 - DNA, 25 bp, Mus musculus
gggactttagtatgcaatggaatgc

SEQ ID NO: 629136 - DNA, 25 bp, Mus musculus
gggactttataacctcagctgggta

SEQ ID NO: 629137 - DNA, 25 bp, Mus musculus
gggactttataagctcagctgggta

SEQ ID NO: 629138 - DNA, 25 bp, Mus musculus
gggactttatcaaccaacaagctga

SEQ ID NO: 629139 - DNA, 25 bp, Mus musculus
gggactttatcatccaacaagctga

SEQ ID NO: 629140 - DNA, 25 bp, Mus musculus
gggactttcaccaagatccactaca

SEQ ID NO: 629141 - DNA, 25 bp, Mus musculus
gggactttcacctagatccactaca

SEQ ID NO: 629142 - DNA, 25 bp, Mus musculus
gggactttcagaaaattctcttagc

SEQ ID NO: 629143 - DNA, 25 bp, Mus musculus
gggactttcagataattctcttagc

SEQ ID NO: 629144 - DNA, 25 bp, Mus musculus
gggactttcatacagcacgcatttg

SEQ ID NO: 629145 - DNA, 25 bp, Mus musculus
gggactttcatagagcacgcatttg

SEQ ID NO: 629146 - DNA, 25 bp, Mus musculus
gggactttcatgcactatttgtatt

SEQ ID NO: 629147 - DNA, 25 bp, Mus musculus
gggactttcatggactatttgtatt

SEQ ID NO: 629148 - DNA, 25 bp, Mus musculus
gggactttccaaaagcaggttctgt

SEQ ID NO: 629149 - DNA, 25 bp, Mus musculus
gggactttccaatagcaggttctgt

SEQ ID NO: 629150 - DNA, 25 bp, Mus musculus
gggactttccagaagtttgctcctt

SEQ ID NO: 629151 - DNA, 25 bp, Mus musculus
gggactttccagatcagattggcct

SEQ ID NO: 629152 - DNA, 25 bp, Mus musculus
gggactttccagcaaacctgatgac

SEQ ID NO: 629153 - DNA, 25 bp, Mus musculus
gggactttccaggaaacctgatgac

SEQ ID NO: 629154 - DNA, 25 bp, Mus musculus
gggactttccagtagtttgctcctt

SEQ ID NO: 629155 - DNA, 25 bp, Mus musculus
gggactttccagttcagattggcct

SEQ ID NO: 629156 - DNA, 25 bp, Mus musculus
gggactttccataagagttcatggt

SEQ ID NO: 629157 - DNA, 25 bp, Mus musculus
gggactttccattagagttcatggt

SEQ ID NO: 629158 - DNA, 25 bp, Mus musculus
gggactttcgagaagccagcgcagt

SEQ ID NO: 629159 - DNA, 25 bp, Mus musculus
gggactttcgagtagccagcgcagt

SEQ ID NO: 629160 - DNA, 25 bp, Mus musculus
gggactttcgatcccatccacaaag

SEQ ID NO: 629161 - DNA, 25 bp, Mus musculus
gggactttcgatgccatccacaaag

SEQ ID NO: 629162 - DNA, 25 bp, Mus musculus
gggactttctccagtcgccattttc

SEQ ID NO: 629163 - DNA, 25 bp, Mus musculus
gggactttctcctgtcgccattttc

SEQ ID NO: 629164 - DNA, 25 bp, Mus musculus
gggactttctctacagcagtgacca

SEQ ID NO: 629165 - DNA, 25 bp, Mus musculus
gggactttctctagtctctgaaacc

SEQ ID NO: 629166 - DNA, 25 bp, Mus musculus
gggactttctctatgaataaccact

SEQ ID NO: 629167 - DNA, 25 bp, Mus musculus
gggactttctcttcagcagtgacca

SEQ ID NO: 629168 - DNA, 25 bp, Mus musculus
gggactttctcttgtctctgaaacc

SEQ ID NO: 629169 - DNA, 25 bp, Mus musculus
gggactttctctttgaataaccact

SEQ ID NO: 629170 - DNA, 25 bp, Mus musculus
gggactttctttagtatctgtcttg

SEQ ID NO: 629171 - DNA, 25 bp, Mus musculus
gggactttcttttgtatctgtcttg

SEQ ID NO: 629172 - DNA, 25 bp, Mus musculus
gggactttgactacgtgtctgagca

SEQ ID NO: 629173 - DNA, 25 bp, Mus musculus
gggactttgacttcgtgtctgagca

SEQ ID NO: 629174 - DNA, 25 bp, Mus musculus
gggactttgagacagacccacctcc

SEQ ID NO: 629175 - DNA, 25 bp, Mus musculus
gggactttgagagagacccacctcc

SEQ ID NO: 629176 - DNA, 25 bp, Mus musculus
gggactttgattctggctactcaca

SEQ ID NO: 629177 - DNA, 25 bp, Mus musculus
gggactttgattgtggctactcaca

SEQ ID NO: 629178 - DNA, 25 bp, Mus musculus
gggactttgccaactttttcttgca

SEQ ID NO: 629179 - DNA, 25 bp, Mus musculus
gggactttgccatctttttcttgca

SEQ ID NO: 629180 - DNA, 25 bp, Mus musculus
gggactttgcccaagatgtggagat

SEQ ID NO: 629181 - DNA, 25 bp, Mus musculus
gggactttgccctagatgtggagat

SEQ ID NO: 629182 - DNA, 25 bp, Mus musculus
gggactttgctaaaacttgtatctc

SEQ ID NO: 629183 - DNA, 25 bp, Mus musculus
gggactttgctactgcagttctcaa

SEQ ID NO: 629184 - DNA, 25 bp, Mus musculus
gggactttgctagtgcagttctcaa

SEQ ID NO: 629185 - DNA, 25 bp, Mus musculus
gggactttgctataacttgtatctc

SEQ ID NO: 629186 - DNA, 25 bp, Mus musculus
gggactttgctgctcaccccacagg

SEQ ID NO: 629187 - DNA, 25 bp, Mus musculus
gggactttgctggtcaccccacagg

SEQ ID NO: 629188 - DNA, 25 bp, Mus musculus
gggactttggccagcagggtcttac

SEQ ID NO: 629189 - DNA, 25 bp, Mus musculus
gggactttggcctgcagggtcttac

SEQ ID NO: 629190 - DNA, 25 bp, Mus musculus
gggactttgtcaactttatcctgaa

SEQ ID NO: 629191 - DNA, 25 bp, Mus musculus
gggactttgtcatctttatcctgaa

SEQ ID NO: 629192 - DNA, 25 bp, Mus musculus
gggactttgtgaacttgctcaatgc

SEQ ID NO: 629193 - DNA, 25 bp, Mus musculus
gggactttgtgatcttgctcaatgc

SEQ ID NO: 629194 - DNA, 25 bp, Mus musculus
gggactttgtgcacagtctaatggt

SEQ ID NO: 629195 - DNA, 25 bp, Mus musculus
gggactttgtgctcagtctaatggt

SEQ ID NO: 629196 - DNA, 25 bp, Mus musculus
gggacttttagcacatcacatatgt

SEQ ID NO: 629197 - DNA, 25 bp, Mus musculus
gggacttttagctcatcacatatgt

SEQ ID NO: 629198 - DNA, 25 bp, Mus musculus
gggacttttatactacttgcatgtt

SEQ ID NO: 629199 - DNA, 25 bp, Mus musculus
gggacttttatagtacttgcatgtt

SEQ ID NO: 629200 - DNA, 25 bp, Mus musculus
gggacttttatgacaagcctgcctt

SEQ ID NO: 629201 - DNA, 25 bp, Mus musculus
gggacttttatgtcaagcctgcctt

SEQ ID NO: 629202 - DNA, 25 bp, Mus musculus
gggacttttattaccatgctgctgt

SEQ ID NO: 629203 - DNA, 25 bp, Mus musculus
gggacttttatttccatgctgctgt

SEQ ID NO: 629204 - DNA, 25 bp, Mus musculus
gggacttttcctccttctgcttcaa

SEQ ID NO: 629205 - DNA, 25 bp, Mus musculus
gggacttttcctgcttctgcttcaa

SEQ ID NO: 629206 - DNA, 25 bp, Mus musculus
gggacttttctgcagcatgccagag

SEQ ID NO: 629207 - DNA, 25 bp, Mus musculus
gggacttttctggagcatgccagag

SEQ ID NO: 629208 - DNA, 25 bp, Mus musculus
gggacttttggacaactcggactga

SEQ ID NO: 629209 - DNA, 25 bp, Mus musculus
gggacttttggagaactcggactga

SEQ ID NO: 629210 - DNA, 25 bp, Mus musculus
gggactttttgaactctgttcttat

SEQ ID NO: 629211 - DNA, 25 bp, Mus musculus
gggactttttgatctctgttcttat

SEQ ID NO: 629212 - DNA, 25 bp, Mus musculus
gggagaaaactactaaccactgcaa

SEQ ID NO: 629213 - DNA, 25 bp, Mus musculus
gggagaaaactagtaaccactgcaa

SEQ ID NO: 629214 - DNA, 25 bp, Mus musculus
gggagaaaactcatcataaatcagg

SEQ ID NO: 629215 - DNA, 25 bp, Mus musculus
gggagaaaactcttcataaatcagg

SEQ ID NO: 629216 - DNA, 25 bp, Mus musculus
gggagaaaagaccacgtatcactga

SEQ ID NO: 629217 - DNA, 25 bp, Mus musculus
gggagaaaagacgacgtatcactga

SEQ ID NO: 629218 - DNA, 25 bp, Mus musculus
gggagaaacttcatagagatcaatg

SEQ ID NO: 629219 - DNA, 25 bp, Mus musculus
gggagaaacttcttagagatcaatg

SEQ ID NO: 629220 - DNA, 25 bp, Mus musculus
gggagaaactttacctgctgtttct

SEQ ID NO: 629221 - DNA, 25 bp, Mus musculus
gggagaaactttcacactgcatgtt

SEQ ID NO: 629222 - DNA, 25 bp, Mus musculus
gggagaaactttgacactgcatgtt

SEQ ID NO: 629223 - DNA, 25 bp, Mus musculus
gggagaaacttttcctgctgtttct

SEQ ID NO: 629224 - DNA, 25 bp, Mus musculus
gggagaaagagcatccaccttggcg

SEQ ID NO: 629225 - DNA, 25 bp, Mus musculus
gggagaaagagcttccaccttggcg

SEQ ID NO: 629226 - DNA, 25 bp, Mus musculus
gggagaaagcgcacagctgccctga

SEQ ID NO: 629227 - DNA, 25 bp, Mus musculus
gggagaaagcgctcagctgccctga

SEQ ID NO: 629228 - DNA, 25 bp, Mus musculus
gggagaaaggacaggatcttgcaac

SEQ ID NO: 629229 - DNA, 25 bp, Mus musculus
gggagaaaggactggatcttgcaac

SEQ ID NO: 629230 - DNA, 25 bp, Mus musculus
gggagaaatacaaacacacctaaca

SEQ ID NO: 629231 - DNA, 25 bp, Mus musculus
gggagaaatacatacacacctaaca

SEQ ID NO: 629232 - DNA, 25 bp, Mus musculus
gggagaaatataccttgctggccaa

SEQ ID NO: 629233 - DNA, 25 bp, Mus musculus
gggagaaatatagcttgctggccaa

SEQ ID NO: 629234 - DNA, 25 bp, Mus musculus
gggagaaatgacctttgattggaga

SEQ ID NO: 629235 - DNA, 25 bp, Mus musculus
gggagaaatgacgtttgattggaga

SEQ ID NO: 629236 - DNA, 25 bp, Mus musculus
gggagaaatgggattgctctcaaag

SEQ ID NO: 629237 - DNA, 25 bp, Mus musculus
gggagaaatgggtttgctctcaaag

SEQ ID NO: 629238 - DNA, 25 bp, Mus musculus
gggagaacaagaccatgtactgcat

SEQ ID NO: 629239 - DNA, 25 bp, Mus musculus
gggagaacaagagcatgtactgcat

SEQ ID NO: 629240 - DNA, 25 bp, Mus musculus
gggagaacacgtacctaccatgcac

SEQ ID NO: 629241 - DNA, 25 bp, Mus musculus
gggagaacacgtatgtgccttacat

SEQ ID NO: 629242 - DNA, 25 bp, Mus musculus
gggagaacacgttcctaccatgcac

SEQ ID NO: 629243 - DNA, 25 bp, Mus musculus
gggagaacacgtttgtgccttacat

SEQ ID NO: 629244 - DNA, 25 bp, Mus musculus
gggagaacagacacaaatcagactt

SEQ ID NO: 629245 - DNA, 25 bp, Mus musculus
gggagaacagactcaaatcagactt

SEQ ID NO: 629246 - DNA, 25 bp, Mus musculus
gggagaacatatcgacttcgccctc

SEQ ID NO: 629247 - DNA, 25 bp, Mus musculus
gggagaacatatggacttcgccctc

SEQ ID NO: 629248 - DNA, 25 bp, Mus musculus
gggagaacatcgagcgtcgccgcaa

SEQ ID NO: 629249 - DNA, 25 bp, Mus musculus
gggagaacatcgtgcgtcgccgcaa

SEQ ID NO: 629250 - DNA, 25 bp, Mus musculus
gggagaacatctcggctgcctgtca

SEQ ID NO: 629251 - DNA, 25 bp, Mus musculus
gggagaacatctgggctgcctgtca

SEQ ID NO: 629252 - DNA, 25 bp, Mus musculus
gggagaacatgcctaatgttgctaa

SEQ ID NO: 629253 - DNA, 25 bp, Mus musculus
gggagaacatgcgtaatgttgctaa

SEQ ID NO: 629254 - DNA, 25 bp, Mus musculus
gggagaacatttacgaactcctctt

SEQ ID NO: 629255 - DNA, 25 bp, Mus musculus
gggagaacattttcgaactcctctt

SEQ ID NO: 629256 - DNA, 25 bp, Mus musculus
gggagaaccaacaaacaaacactga

SEQ ID NO: 629257 - DNA, 25 bp, Mus musculus
gggagaaccaactaacaaacactga

SEQ ID NO: 629258 - DNA, 25 bp, Mus musculus
gggagaaccagccagaagatccacg

SEQ ID NO: 629259 - DNA, 25 bp, Mus musculus
gggagaaccagcgagaagatccacg

SEQ ID NO: 629260 - DNA, 25 bp, Mus musculus
gggagaaccaggctttcttggctct

SEQ ID NO: 629261 - DNA, 25 bp, Mus musculus
gggagaaccagggtttcttggctct

SEQ ID NO: 629262 - DNA, 25 bp, Mus musculus
gggagaacccagctgcatacatagc

SEQ ID NO: 629263 - DNA, 25 bp, Mus musculus
gggagaacccaggtgcatacatagc

SEQ ID NO: 629264 - DNA, 25 bp, Mus musculus
gggagaaccccacgagattgactat

SEQ ID NO: 629265 - DNA, 25 bp, Mus musculus
gggagaaccccaggagattgactat

SEQ ID NO: 629266 - DNA, 25 bp, Mus musculus
gggagaaccgtaccatgaactgcat

SEQ ID NO: 629267 - DNA, 25 bp, Mus musculus
gggagaaccgtagcatgaactgcat

SEQ ID NO: 629268 - DNA, 25 bp, Mus musculus
gggagaacctgactacaccactaca

SEQ ID NO: 629269 - DNA, 25 bp, Mus musculus
gggagaacctgagtacaccactaca

SEQ ID NO: 629270 - DNA, 25 bp, Mus musculus
gggagaaccttaattctacatgggt

SEQ ID NO: 629271 - DNA, 25 bp, Mus musculus
gggagaaccttatttctacatgggt

SEQ ID NO: 629272 - DNA, 25 bp, Mus musculus
gggagaacctttacacgtgtgtcta

SEQ ID NO: 629273 - DNA, 25 bp, Mus musculus
gggagaacctttatcaacagacact

SEQ ID NO: 629274 - DNA, 25 bp, Mus musculus
gggagaaccttttcacgtgtgtcta

SEQ ID NO: 629275 - DNA, 25 bp, Mus musculus
gggagaacctttttcaacagacact

SEQ ID NO: 629276 - DNA, 25 bp, Mus musculus
gggagaacgtttatgctttctcaca

SEQ ID NO: 629277 - DNA, 25 bp, Mus musculus
gggagaacgtttttgctttctcaca

SEQ ID NO: 629278 - DNA, 25 bp, Mus musculus
gggagaactgacaatggacctgcat

SEQ ID NO: 629279 - DNA, 25 bp, Mus musculus
gggagaactgactatggacctgcat

SEQ ID NO: 629280 - DNA, 25 bp, Mus musculus
gggagaagaagaacagatagccact

SEQ ID NO: 629281 - DNA, 25 bp, Mus musculus
gggagaagaagatcagatagccact

SEQ ID NO: 629282 - DNA, 25 bp, Mus musculus
gggagaagatgcactcgatccttta

SEQ ID NO: 629283 - DNA, 25 bp, Mus musculus
gggagaagatgctctcgatccttta

SEQ ID NO: 629284 - DNA, 25 bp, Mus musculus
gggagaagcaacaatcggccatctt

SEQ ID NO: 629285 - DNA, 25 bp, Mus musculus
gggagaagcaactatcggccatctt

SEQ ID NO: 629286 - DNA, 25 bp, Mus musculus
gggagaagcaccagtaaatcactgt

SEQ ID NO: 629287 - DNA, 25 bp, Mus musculus
gggagaagcacctgtaaatcactgt

SEQ ID NO: 629288 - DNA, 25 bp, Mus musculus
gggagaagccataggccaggccttc

SEQ ID NO: 629289 - DNA, 25 bp, Mus musculus
gggagaagccattggccaggccttc

SEQ ID NO: 629290 - DNA, 25 bp, Mus musculus
gggagaagccctagctgcggttttt

SEQ ID NO: 629291 - DNA, 25 bp, Mus musculus
gggagaagcccttgctgcggttttt

SEQ ID NO: 629292 - DNA, 25 bp, Mus musculus
gggagaagctctaccttgtccgagc

SEQ ID NO: 629293 - DNA, 25 bp, Mus musculus
gggagaagctcttccttgtccgagc

SEQ ID NO: 629294 - DNA, 25 bp, Mus musculus
gggagaagcttcactcagtgctcag

SEQ ID NO: 629295 - DNA, 25 bp, Mus musculus
gggagaagcttctctcagtgctcag

SEQ ID NO: 629296 - DNA, 25 bp, Mus musculus
gggagaaggtttccatgacatcacc

SEQ ID NO: 629297 - DNA, 25 bp, Mus musculus
gggagaaggtttgcatgacatcacc

SEQ ID NO: 629298 - DNA, 25 bp, Mus musculus
gggagaagtccaacacactggaaga

SEQ ID NO: 629299 - DNA, 25 bp, Mus musculus
gggagaagtccatcacactggaaga

SEQ ID NO: 629300 - DNA, 25 bp, Mus musculus
gggagaagtttcctacttccagctc

SEQ ID NO: 629301 - DNA, 25 bp, Mus musculus
gggagaagtttcgtacttccagctc

SEQ ID NO: 629302 - DNA, 25 bp, Mus musculus
gggagaatactactcacttaggaga

SEQ ID NO: 629303 - DNA, 25 bp, Mus musculus
gggagaatactagtcacttaggaga

SEQ ID NO: 629304 - DNA, 25 bp, Mus musculus
gggagaatatcccaccaggtgtgtt

SEQ ID NO: 629305 - DNA, 25 bp, Mus musculus
gggagaatatcccttcttaggcttc

SEQ ID NO: 629306 - DNA, 25 bp, Mus musculus
gggagaatatccgaccaggtgtgtt

SEQ ID NO: 629307 - DNA, 25 bp, Mus musculus
gggagaatatccgttcttaggcttc

SEQ ID NO: 629308 - DNA, 25 bp, Mus musculus
gggagaatcaccacggttgcccgaa

SEQ ID NO: 629309 - DNA, 25 bp, Mus musculus
gggagaatcacctcggttgcccgaa

SEQ ID NO: 629310 - DNA, 25 bp, Mus musculus
gggagaatctcaacctggctatgct

SEQ ID NO: 629311 - DNA, 25 bp, Mus musculus
gggagaatctcatcctggctatgct

SEQ ID NO: 629312 - DNA, 25 bp, Mus musculus
gggagaatgcaaacttgtccttttc

SEQ ID NO: 629313 - DNA, 25 bp, Mus musculus
gggagaatgcaatcttgtccttttc

SEQ ID NO: 629314 - DNA, 25 bp, Mus musculus
gggagaatgctcctagtcctgatag

SEQ ID NO: 629315 - DNA, 25 bp, Mus musculus
gggagaatgctcgtagtcctgatag

SEQ ID NO: 629316 - DNA, 25 bp, Mus musculus
gggagaatgcttccccaccataaca

SEQ ID NO: 629317 - DNA, 25 bp, Mus musculus
gggagaatgcttgcccaccataaca

SEQ ID NO: 629318 - DNA, 25 bp, Mus musculus
gggagaatggatcaatcagcacatt

SEQ ID NO: 629319 - DNA, 25 bp, Mus musculus
gggagaatggatgaatcagcacatt

SEQ ID NO: 629320 - DNA, 25 bp, Mus musculus
gggagaatgtcgatttcatttcaaa

SEQ ID NO: 629321 - DNA, 25 bp, Mus musculus
gggagaatgtcgttttcatttcaaa

SEQ ID NO: 629322 - DNA, 25 bp, Mus musculus
gggagaatgtgcctaaattaaactt

SEQ ID NO: 629323 - DNA, 25 bp, Mus musculus
gggagaatgtgcgtaaattaaactt

SEQ ID NO: 629324 - DNA, 25 bp, Mus musculus
gggagaattactctgaccattgctt

SEQ ID NO: 629325 - DNA, 25 bp, Mus musculus
gggagaattactgtgaccattgctt

SEQ ID NO: 629326 - DNA, 25 bp, Mus musculus
gggagaattcatataacgccgactt

SEQ ID NO: 629327 - DNA, 25 bp, Mus musculus
gggagaattcatttaacgccgactt

SEQ ID NO: 629328 - DNA, 25 bp, Mus musculus
gggagaattcccaaggtactattgt

SEQ ID NO: 629329 - DNA, 25 bp, Mus musculus
gggagaattccctaggtactattgt

SEQ ID NO: 629330 - DNA, 25 bp, Mus musculus
gggagaattctgaacatctagaact

SEQ ID NO: 629331 - DNA, 25 bp, Mus musculus
gggagaattctgtacatctagaact

SEQ ID NO: 629332 - DNA, 25 bp, Mus musculus
gggagaattgaccactgattagttc

SEQ ID NO: 629333 - DNA, 25 bp, Mus musculus
gggagaattgacgactgattagttc

SEQ ID NO: 629334 - DNA, 25 bp, Mus musculus
gggagaatttgcacaaagccacaca

SEQ ID NO: 629335 - DNA, 25 bp, Mus musculus
gggagaatttgctcaaagccacaca

SEQ ID NO: 629336 - DNA, 25 bp, Mus musculus
gggagacaacaaccatagccagatt

SEQ ID NO: 629337 - DNA, 25 bp, Mus musculus
gggagacaacaagcatagccagatt

SEQ ID NO: 629338 - DNA, 25 bp, Mus musculus
gggagacaacccagaacgccaagct

SEQ ID NO: 629339 - DNA, 25 bp, Mus musculus
gggagacaaccctgaacgccaagct

SEQ ID NO: 629340 - DNA, 25 bp, Mus musculus
gggagacaactccagcctacggtat

SEQ ID NO: 629341 - DNA, 25 bp, Mus musculus
gggagacaactcgagcctacggtat

SEQ ID NO: 629342 - DNA, 25 bp, Mus musculus
gggagacaagctcagcatcctcagt

SEQ ID NO: 629343 - DNA, 25 bp, Mus musculus
gggagacaagctgagcatcctcagt

SEQ ID NO: 629344 - DNA, 25 bp, Mus musculus
gggagacaaggtcccctgaaactca

SEQ ID NO: 629345 - DNA, 25 bp, Mus musculus
gggagacaaggtgccctgaaactca

SEQ ID NO: 629346 - DNA, 25 bp, Mus musculus
gggagacacaaacctttcttcaaga

SEQ ID NO: 629347 - DNA, 25 bp, Mus musculus
gggagacacaaagctttcttcaaga

SEQ ID NO: 629348 - DNA, 25 bp, Mus musculus
gggagacacatgagtttctttagaa

SEQ ID NO: 629349 - DNA, 25 bp, Mus musculus
gggagacacatgtgtttctttagaa

SEQ ID NO: 629350 - DNA, 25 bp, Mus musculus
gggagacaccaaatagaactgcata

SEQ ID NO: 629351 - DNA, 25 bp, Mus musculus
gggagacaccaattagaactgcata

SEQ ID NO: 629352 - DNA, 25 bp, Mus musculus
gggagacaccatagaacagcagagt

SEQ ID NO: 629353 - DNA, 25 bp, Mus musculus
gggagacaccattgaacagcagagt

SEQ ID NO: 629354 - DNA, 25 bp, Mus musculus
gggagacacctgaaatatcaacact

SEQ ID NO: 629355 - DNA, 25 bp, Mus musculus
gggagacacctgtaatatcaacact

SEQ ID NO: 629356 - DNA, 25 bp, Mus musculus
gggagacactgccatattttaaacc

SEQ ID NO: 629357 - DNA, 25 bp, Mus musculus
gggagacactgcgatattttaaacc

SEQ ID NO: 629358 - DNA, 25 bp, Mus musculus
gggagacactgtccattacagggct

SEQ ID NO: 629359 - DNA, 25 bp, Mus musculus
gggagacactgtcgcaacgcatttt

SEQ ID NO: 629360 - DNA, 25 bp, Mus musculus
gggagacactgtgcattacagggct

SEQ ID NO: 629361 - DNA, 25 bp, Mus musculus
gggagacactgtggcaacgcatttt

SEQ ID NO: 629362 - DNA, 25 bp, Mus musculus
gggagacagactattgacaaaccat

SEQ ID NO: 629363 - DNA, 25 bp, Mus musculus
gggagacagacttttgacaaaccat

SEQ ID NO: 629364 - DNA, 25 bp, Mus musculus
gggagacagtagatttcctcacaaa

SEQ ID NO: 629365 - DNA, 25 bp, Mus musculus
gggagacagtagttttcctcacaaa

SEQ ID NO: 629366 - DNA, 25 bp, Mus musculus
gggagacagttaagcaatctagtga

SEQ ID NO: 629367 - DNA, 25 bp, Mus musculus
gggagacagttacctagactaccag

SEQ ID NO: 629368 - DNA, 25 bp, Mus musculus
gggagacagttagctagactaccag

SEQ ID NO: 629369 - DNA, 25 bp, Mus musculus
gggagacagttatgcaatctagtga

SEQ ID NO: 629370 - DNA, 25 bp, Mus musculus
gggagacagtttccctactattata

SEQ ID NO: 629371 - DNA, 25 bp, Mus musculus
gggagacagtttgcctactattata

SEQ ID NO: 629372 - DNA, 25 bp, Mus musculus
gggagacatattctgccagcacacg

SEQ ID NO: 629373 - DNA, 25 bp, Mus musculus
gggagacatattgtgccagcacacg

SEQ ID NO: 629374 - DNA, 25 bp, Mus musculus
gggagacatcaacactttaactcac

SEQ ID NO: 629375 - DNA, 25 bp, Mus musculus
gggagacatcaagactttaactcac

SEQ ID NO: 629376 - DNA, 25 bp, Mus musculus
gggagacatctactgctggtcacag

SEQ ID NO: 629377 - DNA, 25 bp, Mus musculus
gggagacatctagtgctggtcacag

SEQ ID NO: 629378 - DNA, 25 bp, Mus musculus
gggagacatgcaagcctaactaaca

SEQ ID NO: 629379 - DNA, 25 bp, Mus musculus
gggagacatgcatgcctaactaaca

SEQ ID NO: 629380 - DNA, 25 bp, Mus musculus
gggagacattaactgccatatttga

SEQ ID NO: 629381 - DNA, 25 bp, Mus musculus
gggagacattaagtgccatatttga

SEQ ID NO: 629382 - DNA, 25 bp, Mus musculus
gggagacattttcaagctacagata

SEQ ID NO: 629383 - DNA, 25 bp, Mus musculus
gggagacattttgaagctacagata

SEQ ID NO: 629384 - DNA, 25 bp, Mus musculus
gggagaccaatccagctgattcaaa

SEQ ID NO: 629385 - DNA, 25 bp, Mus musculus
gggagaccaatcgagctgattcaaa

SEQ ID NO: 629386 - DNA, 25 bp, Mus musculus
gggagaccactgacactgctaatat

SEQ ID NO: 629387 - DNA, 25 bp, Mus musculus
gggagaccactgtcactgctaatat

SEQ ID NO: 629388 - DNA, 25 bp, Mus musculus
gggagaccatgtaatcgcatctgaa

SEQ ID NO: 629389 - DNA, 25 bp, Mus musculus
gggagaccatgttatcgcatctgaa

SEQ ID NO: 629390 - DNA, 25 bp, Mus musculus
gggagaccccgcagcttgggtaaat

SEQ ID NO: 629391 - DNA, 25 bp, Mus musculus
gggagaccccgctgcttgggtaaat

SEQ ID NO: 629392 - DNA, 25 bp, Mus musculus
gggagaccctccaaagtgtaatcag

SEQ ID NO: 629393 - DNA, 25 bp, Mus musculus
gggagaccctcctaagtgtaatcag

SEQ ID NO: 629394 - DNA, 25 bp, Mus musculus
gggagaccctgaacgctctcagacc

SEQ ID NO: 629395 - DNA, 25 bp, Mus musculus
gggagaccctgatcgctctcagacc

SEQ ID NO: 629396 - DNA, 25 bp, Mus musculus
gggagacccttgagcatgagaacct

SEQ ID NO: 629397 - DNA, 25 bp, Mus musculus
gggagacccttgtgcatgagaacct

SEQ ID NO: 629398 - DNA, 25 bp, Mus musculus
gggagaccctttctgaggactctgc

SEQ ID NO: 629399 - DNA, 25 bp, Mus musculus
gggagaccctttgtgaggactctgc

SEQ ID NO: 629400 - DNA, 25 bp, Mus musculus
gggagacctaagcacacgtataaag

SEQ ID NO: 629401 - DNA, 25 bp, Mus musculus
gggagacctaaggacacgtataaag

SEQ ID NO: 629402 - DNA, 25 bp, Mus musculus
gggagacctcatctccttcctggtg

SEQ ID NO: 629403 - DNA, 25 bp, Mus musculus
gggagacctcatgtccttcctggtg

SEQ ID NO: 629404 - DNA, 25 bp, Mus musculus
gggagacctccaactggaaggacat

SEQ ID NO: 629405 - DNA, 25 bp, Mus musculus
gggagacctccaaggtgcatgagct

SEQ ID NO: 629406 - DNA, 25 bp, Mus musculus
gggagacctccatctggaaggacat

SEQ ID NO: 629407 - DNA, 25 bp, Mus musculus
gggagacctccatggtgcatgagct

SEQ ID NO: 629408 - DNA, 25 bp, Mus musculus
gggagacctgggaacctcccagtgc

SEQ ID NO: 629409 - DNA, 25 bp, Mus musculus
gggagacctgggtacctcccagtgc

SEQ ID NO: 629410 - DNA, 25 bp, Mus musculus
gggagacctgtaaccgtgacttttg

SEQ ID NO: 629411 - DNA, 25 bp, Mus musculus
gggagacctgtatccgtgacttttg

SEQ ID NO: 629412 - DNA, 25 bp, Mus musculus
gggagacctgtgataccactacacg

SEQ ID NO: 629413 - DNA, 25 bp, Mus musculus
gggagacctgtgttaccactacacg

SEQ ID NO: 629414 - DNA, 25 bp, Mus musculus
gggagaccttcaacttgatttcttt

SEQ ID NO: 629415 - DNA, 25 bp, Mus musculus
gggagaccttcatcttgatttcttt

SEQ ID NO: 629416 - DNA, 25 bp, Mus musculus
gggagacctttcattccaggattct

SEQ ID NO: 629417 - DNA, 25 bp, Mus musculus
gggagacctttctttccaggattct

SEQ ID NO: 629418 - DNA, 25 bp, Mus musculus
gggagacgcttccacacaattagga

SEQ ID NO: 629419 - DNA, 25 bp, Mus musculus
gggagacgcttcgacacaattagga

SEQ ID NO: 629420 - DNA, 25 bp, Mus musculus
gggagacgcttgaatctcattaaga

SEQ ID NO: 629421 - DNA, 25 bp, Mus musculus
gggagacgcttgtatctcattaaga

SEQ ID NO: 629422 - DNA, 25 bp, Mus musculus
gggagacggatcacttcaagttcaa

SEQ ID NO: 629423 - DNA, 25 bp, Mus musculus
gggagacggatctcttcaagttcaa

SEQ ID NO: 629424 - DNA, 25 bp, Mus musculus
gggagacggcctaggacgtcctaca

SEQ ID NO: 629425 - DNA, 25 bp, Mus musculus
gggagacggccttggacgtcctaca

SEQ ID NO: 629426 - DNA, 25 bp, Mus musculus
gggagacggtctctgagcttcctac

SEQ ID NO: 629427 - DNA, 25 bp, Mus musculus
gggagacggtctgtgagcttcctac

SEQ ID NO: 629428 - DNA, 25 bp, Mus musculus
gggagacgtgacattcacaacccag

SEQ ID NO: 629429 - DNA, 25 bp, Mus musculus
gggagacgtgactttcacaacccag

SEQ ID NO: 629430 - DNA, 25 bp, Mus musculus
gggagacgttgacatcactgaactc

SEQ ID NO: 629431 - DNA, 25 bp, Mus musculus
gggagacgttgagatcactgaactc

SEQ ID NO: 629432 - DNA, 25 bp, Mus musculus
gggagactaggtctgtcctatgcat

SEQ ID NO: 629433 - DNA, 25 bp, Mus musculus
gggagactaggtgtgtcctatgcat

SEQ ID NO: 629434 - DNA, 25 bp, Mus musculus
gggagactatttattaagcattatg

SEQ ID NO: 629435 - DNA, 25 bp, Mus musculus
gggagactattttttaagcattatg

SEQ ID NO: 629436 - DNA, 25 bp, Mus musculus
gggagactcaggaggcccactgatc

SEQ ID NO: 629437 - DNA, 25 bp, Mus musculus
gggagactcaggtggcccactgatc

SEQ ID NO: 629438 - DNA, 25 bp, Mus musculus
gggagactcattcgtttccagcggc

SEQ ID NO: 629439 - DNA, 25 bp, Mus musculus
gggagactcattggtttccagcggc

SEQ ID NO: 629440 - DNA, 25 bp, Mus musculus
gggagactccacagtggttctgcaa

SEQ ID NO: 629441 - DNA, 25 bp, Mus musculus
gggagactccactgtggttctgcaa

SEQ ID NO: 629442 - DNA, 25 bp, Mus musculus
gggagactccctcctactttctgca

SEQ ID NO: 629443 - DNA, 25 bp, Mus musculus
gggagactccctgctactttctgca

SEQ ID NO: 629444 - DNA, 25 bp, Mus musculus
gggagactcgtgagtacaatctgtt

SEQ ID NO: 629445 - DNA, 25 bp, Mus musculus
gggagactcgtgtgtacaatctgtt

SEQ ID NO: 629446 - DNA, 25 bp, Mus musculus
gggagactctataaactcatgctca

SEQ ID NO: 629447 - DNA, 25 bp, Mus musculus
gggagactctattaactcatgctca

SEQ ID NO: 629448 - DNA, 25 bp, Mus musculus
gggagactctggatcaacatagcac

SEQ ID NO: 629449 - DNA, 25 bp, Mus musculus
gggagactctggttcaacatagcac

SEQ ID NO: 629450 - DNA, 25 bp, Mus musculus
gggagactgacaccctcttgtcctc

SEQ ID NO: 629451 - DNA, 25 bp, Mus musculus
gggagactgacagcctcttgtcctc

SEQ ID NO: 629452 - DNA, 25 bp, Mus musculus
gggagactgtggaaacatcactact

SEQ ID NO: 629453 - DNA, 25 bp, Mus musculus
gggagactgtggtaacatcactact

SEQ ID NO: 629454 - DNA, 25 bp, Mus musculus
gggagactgtttccctagcatacac

SEQ ID NO: 629455 - DNA, 25 bp, Mus musculus
gggagactgtttgcctagcatacac

SEQ ID NO: 629456 - DNA, 25 bp, Mus musculus
gggagacttaagctggtttttatca

SEQ ID NO: 629457 - DNA, 25 bp, Mus musculus
gggagacttaaggtggtttttatca

SEQ ID NO: 629458 - DNA, 25 bp, Mus musculus
gggagacttcacagatgacatcatt

SEQ ID NO: 629459 - DNA, 25 bp, Mus musculus
gggagacttcactgatgacatcatt

SEQ ID NO: 629460 - DNA, 25 bp, Mus musculus
gggagacttctgacctaggcattag

SEQ ID NO: 629461 - DNA, 25 bp, Mus musculus
gggagacttctgtcctaggcattag

SEQ ID NO: 629462 - DNA, 25 bp, Mus musculus
gggagacttgacagaacacctctat

SEQ ID NO: 629463 - DNA, 25 bp, Mus musculus
gggagacttgactgaacacctctat

SEQ ID NO: 629464 - DNA, 25 bp, Mus musculus
gggagactttgaacaaactatgctc

SEQ ID NO: 629465 - DNA, 25 bp, Mus musculus
gggagactttgatcaaactatgctc

SEQ ID NO: 629466 - DNA, 25 bp, Mus musculus
gggagactttttcggacacattgtt

SEQ ID NO: 629467 - DNA, 25 bp, Mus musculus
gggagactttttgggacacattgtt

SEQ ID NO: 629468 - DNA, 25 bp, Mus musculus
gggagagaaacacagatttttacac

SEQ ID NO: 629469 - DNA, 25 bp, Mus musculus
gggagagaaacagagatttttacac

SEQ ID NO: 629470 - DNA, 25 bp, Mus musculus
gggagagaactaccagcagaactgt

SEQ ID NO: 629471 - DNA, 25 bp, Mus musculus
gggagagaactacctcccaaagcta

SEQ ID NO: 629472 - DNA, 25 bp, Mus musculus
gggagagaactagcagcagaactgt

SEQ ID NO: 629473 - DNA, 25 bp, Mus musculus
gggagagaactagctcccaaagcta

SEQ ID NO: 629474 - DNA, 25 bp, Mus musculus
gggagagaactgactgcactaagtt

SEQ ID NO: 629475 - DNA, 25 bp, Mus musculus
gggagagaactgtctgcactaagtt

SEQ ID NO: 629476 - DNA, 25 bp, Mus musculus
gggagagaagctagccacctaaatg

SEQ ID NO: 629477 - DNA, 25 bp, Mus musculus
gggagagaagcttgccacctaaatg

SEQ ID NO: 629478 - DNA, 25 bp, Mus musculus
gggagagacaaactgccctctgcac

SEQ ID NO: 629479 - DNA, 25 bp, Mus musculus
gggagagacaaagtgccctctgcac

SEQ ID NO: 629480 - DNA, 25 bp, Mus musculus
gggagagacataaatcctgttttcc

SEQ ID NO: 629481 - DNA, 25 bp, Mus musculus
gggagagacatatatcctgttttcc

SEQ ID NO: 629482 - DNA, 25 bp, Mus musculus
gggagagacccactatgcagctgct

SEQ ID NO: 629483 - DNA, 25 bp, Mus musculus
gggagagacccagtatgcagctgct

SEQ ID NO: 629484 - DNA, 25 bp, Mus musculus
gggagagacctcatcagcttagact

SEQ ID NO: 629485 - DNA, 25 bp, Mus musculus
gggagagacctcttcagcttagact

SEQ ID NO: 629486 - DNA, 25 bp, Mus musculus
gggagagactcgagttctttggaaa

SEQ ID NO: 629487 - DNA, 25 bp, Mus musculus
gggagagactcgtgttctttggaaa

SEQ ID NO: 629488 - DNA, 25 bp, Mus musculus
gggagagactgacaacctattgcag

SEQ ID NO: 629489 - DNA, 25 bp, Mus musculus
gggagagactgagaacctattgcag

SEQ ID NO: 629490 - DNA, 25 bp, Mus musculus
gggagagacttcaggttgtcttaaa

SEQ ID NO: 629491 - DNA, 25 bp, Mus musculus
gggagagacttctggttgtcttaaa

SEQ ID NO: 629492 - DNA, 25 bp, Mus musculus
gggagagagaacatgcactgcctat

SEQ ID NO: 629493 - DNA, 25 bp, Mus musculus
gggagagagaacttgcactgcctat

SEQ ID NO: 629494 - DNA, 25 bp, Mus musculus
gggagagagattcacctgttataaa

SEQ ID NO: 629495 - DNA, 25 bp, Mus musculus
gggagagagattgacctgttataaa

SEQ ID NO: 629496 - DNA, 25 bp, Mus musculus
gggagagagcctagcccgcatggag

SEQ ID NO: 629497 - DNA, 25 bp, Mus musculus
gggagagagccttgcccgcatggag

SEQ ID NO: 629498 - DNA, 25 bp, Mus musculus
gggagagaggagcactggacaacat

SEQ ID NO: 629499 - DNA, 25 bp, Mus musculus
gggagagaggaggactggacaacat

SEQ ID NO: 629500 - DNA, 25 bp, Mus musculus
gggagagaggtcaagctactaaatt

SEQ ID NO: 629501 - DNA, 25 bp, Mus musculus
gggagagaggtctagctactaaatt

SEQ ID NO: 629502 - DNA, 25 bp, Mus musculus
gggagagagtggaaacctcaagatc

SEQ ID NO: 629503 - DNA, 25 bp, Mus musculus
gggagagagtggtaacctcaagatc

SEQ ID NO: 629504 - DNA, 25 bp, Mus musculus
gggagagatctactagcctaaatga

SEQ ID NO: 629505 - DNA, 25 bp, Mus musculus
gggagagatctagtagcctaaatga

SEQ ID NO: 629506 - DNA, 25 bp, Mus musculus
gggagagatgacaccctggtagcac

SEQ ID NO: 629507 - DNA, 25 bp, Mus musculus
gggagagatgactccctggtagcac

SEQ ID NO: 629508 - DNA, 25 bp, Mus musculus
gggagagattcaacattctgctatt

SEQ ID NO: 629509 - DNA, 25 bp, Mus musculus
gggagagattcatcattctgctatt

SEQ ID NO: 629510 - DNA, 25 bp, Mus musculus
gggagagcacaacccttgcagctgt

SEQ ID NO: 629511 - DNA, 25 bp, Mus musculus
gggagagcacaagccttgcagctgt

SEQ ID NO: 629512 - DNA, 25 bp, Mus musculus
gggagagcattaacaggccctggct

SEQ ID NO: 629513 - DNA, 25 bp, Mus musculus
gggagagcattatcaggccctggct

SEQ ID NO: 629514 - DNA, 25 bp, Mus musculus
gggagagcattcactgtacacacct

SEQ ID NO: 629515 - DNA, 25 bp, Mus musculus
gggagagcattccacaggccagctt

SEQ ID NO: 629516 - DNA, 25 bp, Mus musculus
gggagagcattcgacaggccagctt

SEQ ID NO: 629517 - DNA, 25 bp, Mus musculus
gggagagcattctctgtacacacct

SEQ ID NO: 629518 - DNA, 25 bp, Mus musculus
gggagagccaataatgagacttgtt

SEQ ID NO: 629519 - DNA, 25 bp, Mus musculus
gggagagccaattatgagacttgtt

SEQ ID NO: 629520 - DNA, 25 bp, Mus musculus
gggagagccatgatcacctttctac

SEQ ID NO: 629521 - DNA, 25 bp, Mus musculus
gggagagccatgttcacctttctac

SEQ ID NO: 629522 - DNA, 25 bp, Mus musculus
gggagagcccagcagatgcttcatt

SEQ ID NO: 629523 - DNA, 25 bp, Mus musculus
gggagagcccaggagatgcttcatt

SEQ ID NO: 629524 - DNA, 25 bp, Mus musculus
gggagagccccacagagttattcca

SEQ ID NO: 629525 - DNA, 25 bp, Mus musculus
gggagagccccagagagttattcca

SEQ ID NO: 629526 - DNA, 25 bp, Mus musculus
gggagagccctcagctatggtattc

SEQ ID NO: 629527 - DNA, 25 bp, Mus musculus
gggagagccctctgctatggtattc

SEQ ID NO: 629528 - DNA, 25 bp, Mus musculus
gggagagccgtcactttccgggatc

SEQ ID NO: 629529 - DNA, 25 bp, Mus musculus
gggagagccgtctctttccgggatc

SEQ ID NO: 629530 - DNA, 25 bp, Mus musculus
gggagagcctcaaacgtcacgtgaa

SEQ ID NO: 629531 - DNA, 25 bp, Mus musculus
gggagagcctcatacgtcacgtgaa

SEQ ID NO: 629532 - DNA, 25 bp, Mus musculus
gggagagcctgaatcatcactacca

SEQ ID NO: 629533 - DNA, 25 bp, Mus musculus
gggagagcctgattcatcactacca

SEQ ID NO: 629534 - DNA, 25 bp, Mus musculus
gggagagcggcactggagcgtgtct

SEQ ID NO: 629535 - DNA, 25 bp, Mus musculus
gggagagcggcagtggagcgtgtct

SEQ ID NO: 629536 - DNA, 25 bp, Mus musculus
gggagagctatgagccacctgacca

SEQ ID NO: 629537 - DNA, 25 bp, Mus musculus
gggagagctatgtgccacctgacca

SEQ ID NO: 629538 - DNA, 25 bp, Mus musculus
gggagagctcagcatgtcctccccg

SEQ ID NO: 629539 - DNA, 25 bp, Mus musculus
gggagagctcaggatgtcctccccg

SEQ ID NO: 629540 - DNA, 25 bp, Mus musculus
gggagagctctcaactgttagaatt

SEQ ID NO: 629541 - DNA, 25 bp, Mus musculus
gggagagctctctactgttagaatt

SEQ ID NO: 629542 - DNA, 25 bp, Mus musculus
gggagagctctgatagctcccaaga

SEQ ID NO: 629543 - DNA, 25 bp, Mus musculus
gggagagctctgttagctcccaaga

SEQ ID NO: 629544 - DNA, 25 bp, Mus musculus
gggagagcttgtcactcatcagaat

SEQ ID NO: 629545 - DNA, 25 bp, Mus musculus
gggagagcttgtgactcatcagaat

SEQ ID NO: 629546 - DNA, 25 bp, Mus musculus
gggagaggaaccagaacatcatcaa

SEQ ID NO: 629547 - DNA, 25 bp, Mus musculus
gggagaggaacctgaacatcatcaa

SEQ ID NO: 629548 - DNA, 25 bp, Mus musculus
gggagaggacacagataaccctgca

SEQ ID NO: 629549 - DNA, 25 bp, Mus musculus
gggagaggacactgataaccctgca

SEQ ID NO: 629550 - DNA, 25 bp, Mus musculus
gggagaggactgcacccttttgctc

SEQ ID NO: 629551 - DNA, 25 bp, Mus musculus
gggagaggactggacccttttgctc

SEQ ID NO: 629552 - DNA, 25 bp, Mus musculus
gggagaggacttagatcgtcagcaa

SEQ ID NO: 629553 - DNA, 25 bp, Mus musculus
gggagaggactttgatcgtcagcaa

SEQ ID NO: 629554 - DNA, 25 bp, Mus musculus
gggagaggagccctaaccctgaaat

SEQ ID NO: 629555 - DNA, 25 bp, Mus musculus
gggagaggagccgtaaccctgaaat

SEQ ID NO: 629556 - DNA, 25 bp, Mus musculus
gggagaggatgacgctccctcacac

SEQ ID NO: 629557 - DNA, 25 bp, Mus musculus
gggagaggatgaggctccctcacac

SEQ ID NO: 629558 - DNA, 25 bp, Mus musculus
gggagaggatgcatctagcttcaca

SEQ ID NO: 629559 - DNA, 25 bp, Mus musculus
gggagaggatgcttctagcttcaca

SEQ ID NO: 629560 - DNA, 25 bp, Mus musculus
gggagaggccatcactgaaccctac

SEQ ID NO: 629561 - DNA, 25 bp, Mus musculus
gggagaggccatgactgaaccctac

SEQ ID NO: 629562 - DNA, 25 bp, Mus musculus
gggagaggccttacctatgcagcga

SEQ ID NO: 629563 - DNA, 25 bp, Mus musculus
gggagaggcctttcctatgcagcga

SEQ ID NO: 629564 - DNA, 25 bp, Mus musculus
gggagagggagcaaaacagccagcc

SEQ ID NO: 629565 - DNA, 25 bp, Mus musculus
gggagagggagctaaacagccagcc

SEQ ID NO: 629566 - DNA, 25 bp, Mus musculus
gggagagggtataatgcctaaccaa

SEQ ID NO: 629567 - DNA, 25 bp, Mus musculus
gggagagggtattatgcctaaccaa

SEQ ID NO: 629568 - DNA, 25 bp, Mus musculus
gggagagggtcacttcaatcatact

SEQ ID NO: 629569 - DNA, 25 bp, Mus musculus
gggagagggtcagttcaatcatact

SEQ ID NO: 629570 - DNA, 25 bp, Mus musculus
gggagaggtccacaactgcctgaaa

SEQ ID NO: 629571 - DNA, 25 bp, Mus musculus
gggagaggtccacgcaacttccagc

SEQ ID NO: 629572 - DNA, 25 bp, Mus musculus
gggagaggtccagaactgcctgaaa

SEQ ID NO: 629573 - DNA, 25 bp, Mus musculus
gggagaggtccaggcaacttccagc

SEQ ID NO: 629574 - DNA, 25 bp, Mus musculus
gggagaggtcccagctgcactcgct

SEQ ID NO: 629575 - DNA, 25 bp, Mus musculus
gggagaggtccctgctgcactcgct

SEQ ID NO: 629576 - DNA, 25 bp, Mus musculus
gggagaggtgacacttccacctggt

SEQ ID NO: 629577 - DNA, 25 bp, Mus musculus
gggagaggtgactcttccacctggt

SEQ ID NO: 629578 - DNA, 25 bp, Mus musculus
gggagaggtgttaaactttctagtg

SEQ ID NO: 629579 - DNA, 25 bp, Mus musculus
gggagaggtgtttaactttctagtg

SEQ ID NO: 629580 - DNA, 25 bp, Mus musculus
gggagagtcatcatttcaggcccct

SEQ ID NO: 629581 - DNA, 25 bp, Mus musculus
gggagagtcatcttttcaggcccct

SEQ ID NO: 629582 - DNA, 25 bp, Mus musculus
gggagagtcgatacagcttcactgc

SEQ ID NO: 629583 - DNA, 25 bp, Mus musculus
gggagagtcgattcagcttcactgc

SEQ ID NO: 629584 - DNA, 25 bp, Mus musculus
gggagagtcgtgatgtatcctagca

SEQ ID NO: 629585 - DNA, 25 bp, Mus musculus
gggagagtcgtgttgtatcctagca

SEQ ID NO: 629586 - DNA, 25 bp, Mus musculus
gggagagttgccattcactacatca

SEQ ID NO: 629587 - DNA, 25 bp, Mus musculus
gggagagttgcctttcactacatca

SEQ ID NO: 629588 - DNA, 25 bp, Mus musculus
gggagataaccaccatgccaggaat

SEQ ID NO: 629589 - DNA, 25 bp, Mus musculus
gggagataaccagcatgccaggaat

SEQ ID NO: 629590 - DNA, 25 bp, Mus musculus
gggagataagcacttcctcctcagg

SEQ ID NO: 629591 - DNA, 25 bp, Mus musculus
gggagataagcagttcctcctcagg

SEQ ID NO: 629592 - DNA, 25 bp, Mus musculus
gggagataatccagacctcatgccc

SEQ ID NO: 629593 - DNA, 25 bp, Mus musculus
gggagataatcctgacctcatgccc

SEQ ID NO: 629594 - DNA, 25 bp, Mus musculus
gggagatacaaccatcacctcaaga

SEQ ID NO: 629595 - DNA, 25 bp, Mus musculus
gggagatacaacgatcacctcaaga

SEQ ID NO: 629596 - DNA, 25 bp, Mus musculus
gggagatacccaattgaggacaaca

SEQ ID NO: 629597 - DNA, 25 bp, Mus musculus
gggagatacccatttgaggacaaca

SEQ ID NO: 629598 - DNA, 25 bp, Mus musculus
gggagatacgccagtaccgaatgaa

SEQ ID NO: 629599 - DNA, 25 bp, Mus musculus
gggagatacgcctgtaccgaatgaa

SEQ ID NO: 629600 - DNA, 25 bp, Mus musculus
gggagatagcttaatgcactgtgat

SEQ ID NO: 629601 - DNA, 25 bp, Mus musculus
gggagatagctttatgcactgtgat

SEQ ID NO: 629602 - DNA, 25 bp, Mus musculus
gggagatatcgtacagagggtataa

SEQ ID NO: 629603 - DNA, 25 bp, Mus musculus
gggagatatcgttcagagggtataa

SEQ ID NO: 629604 - DNA, 25 bp, Mus musculus
gggagatatgtcaagcagttataat

SEQ ID NO: 629605 - DNA, 25 bp, Mus musculus
gggagatatgtctagcagttataat

SEQ ID NO: 629606 - DNA, 25 bp, Mus musculus
gggagatattgtaagaccatcacag

SEQ ID NO: 629607 - DNA, 25 bp, Mus musculus
gggagatattgttagaccatcacag

SEQ ID NO: 629608 - DNA, 25 bp, Mus musculus
gggagatatttccatggtagagcat

SEQ ID NO: 629609 - DNA, 25 bp, Mus musculus
gggagatatttcgatggtagagcat

SEQ ID NO: 629610 - DNA, 25 bp, Mus musculus
gggagatcaactctagccactcctt

SEQ ID NO: 629611 - DNA, 25 bp, Mus musculus
gggagatcaactgtagccactcctt

SEQ ID NO: 629612 - DNA, 25 bp, Mus musculus
gggagatcacaaaacaactttatgc

SEQ ID NO: 629613 - DNA, 25 bp, Mus musculus
gggagatcacaatacaactttatgc

SEQ ID NO: 629614 - DNA, 25 bp, Mus musculus
gggagatcaccacgcgagtctttga

SEQ ID NO: 629615 - DNA, 25 bp, Mus musculus
gggagatcaccaggcgagtctttga

SEQ ID NO: 629616 - DNA, 25 bp, Mus musculus
gggagatcactcctcactagacaga

SEQ ID NO: 629617 - DNA, 25 bp, Mus musculus
gggagatcactcgtcactagacaga

SEQ ID NO: 629618 - DNA, 25 bp, Mus musculus
gggagatcactgaaatttcaaggct

SEQ ID NO: 629619 - DNA, 25 bp, Mus musculus
gggagatcactgtaatttcaaggct

SEQ ID NO: 629620 - DNA, 25 bp, Mus musculus
gggagatcagctacaggacaaatgt

SEQ ID NO: 629621 - DNA, 25 bp, Mus musculus
gggagatcagctacgtccagcatag

SEQ ID NO: 629622 - DNA, 25 bp, Mus musculus
gggagatcagcttcaggacaaatgt

SEQ ID NO: 629623 - DNA, 25 bp, Mus musculus
gggagatcagcttcgtccagcatag

SEQ ID NO: 629624 - DNA, 25 bp, Mus musculus
gggagatcaggaccgttgctaacac

SEQ ID NO: 629625 - DNA, 25 bp, Mus musculus
gggagatcaggagcgttgctaacac

SEQ ID NO: 629626 - DNA, 25 bp, Mus musculus
gggagatcataaaaatccggagaaa

SEQ ID NO: 629627 - DNA, 25 bp, Mus musculus
gggagatcataataatccggagaaa

SEQ ID NO: 629628 - DNA, 25 bp, Mus musculus
gggagatcatgaaagcagcacagaa

SEQ ID NO: 629629 - DNA, 25 bp, Mus musculus
gggagatcatgatagcagcacagaa

SEQ ID NO: 629630 - DNA, 25 bp, Mus musculus
gggagatccaaacactgtagccgct

SEQ ID NO: 629631 - DNA, 25 bp, Mus musculus
gggagatccaaagactgtagccgct

SEQ ID NO: 629632 - DNA, 25 bp, Mus musculus
gggagatccaagcaaatacaactac

SEQ ID NO: 629633 - DNA, 25 bp, Mus musculus
gggagatccaaggaaatacaactac

SEQ ID NO: 629634 - DNA, 25 bp, Mus musculus
gggagatccattacctgactagata

SEQ ID NO: 629635 - DNA, 25 bp, Mus musculus
gggagatccatttcctgactagata

SEQ ID NO: 629636 - DNA, 25 bp, Mus musculus
gggagatcccgaaagcatgtatgtg

SEQ ID NO: 629637 - DNA, 25 bp, Mus musculus
gggagatcccgatagcatgtatgtg

SEQ ID NO: 629638 - DNA, 25 bp, Mus musculus
gggagatcctcaaccaagtgacggg

SEQ ID NO: 629639 - DNA, 25 bp, Mus musculus
gggagatcctcatccaagtgacggg

SEQ ID NO: 629640 - DNA, 25 bp, Mus musculus
gggagatcctgacccgctgttccga

SEQ ID NO: 629641 - DNA, 25 bp, Mus musculus
gggagatcctgagccgctgttccga

SEQ ID NO: 629642 - DNA, 25 bp, Mus musculus
gggagatcgcgtaccagcttgaccg

SEQ ID NO: 629643 - DNA, 25 bp, Mus musculus
gggagatcgcgttccagcttgaccg

SEQ ID NO: 629644 - DNA, 25 bp, Mus musculus
gggagatctaaccacttacgacaca

SEQ ID NO: 629645 - DNA, 25 bp, Mus musculus
gggagatctaacgacttacgacaca

SEQ ID NO: 629646 - DNA, 25 bp, Mus musculus
gggagatctactactaggtgatcaa

SEQ ID NO: 629647 - DNA, 25 bp, Mus musculus
gggagatctacttctaggtgatcaa

SEQ ID NO: 629648 - DNA, 25 bp, Mus musculus
gggagatctctcacagatcgccaga

SEQ ID NO: 629649 - DNA, 25 bp, Mus musculus
gggagatctctctcagatcgccaga

SEQ ID NO: 629650 - DNA, 25 bp, Mus musculus
gggagatctgtcacaacattaacta

SEQ ID NO: 629651 - DNA, 25 bp, Mus musculus
gggagatctgtctcaacattaacta

SEQ ID NO: 629652 - DNA, 25 bp, Mus musculus
gggagatcttgacatcactgactga

SEQ ID NO: 629653 - DNA, 25 bp, Mus musculus
gggagatcttgagatcactgactga

SEQ ID NO: 629654 - DNA, 25 bp, Mus musculus
gggagatgatgcagcgacccattaa

SEQ ID NO: 629655 - DNA, 25 bp, Mus musculus
gggagatgatgctgcgacccattaa

SEQ ID NO: 629656 - DNA, 25 bp, Mus musculus
gggagatgccaaacctttgcattta

SEQ ID NO: 629657 - DNA, 25 bp, Mus musculus
gggagatgccaatcctttgcattta

SEQ ID NO: 629658 - DNA, 25 bp, Mus musculus
gggagatgccatcatgaacgagtat

SEQ ID NO: 629659 - DNA, 25 bp, Mus musculus
gggagatgccatgatgaacgagtat

SEQ ID NO: 629660 - DNA, 25 bp, Mus musculus
gggagatgccccatggactaagcat

SEQ ID NO: 629661 - DNA, 25 bp, Mus musculus
gggagatgccccttggactaagcat

SEQ ID NO: 629662 - DNA, 25 bp, Mus musculus
gggagatgcgagattactcccttct

SEQ ID NO: 629663 - DNA, 25 bp, Mus musculus
gggagatgcgagtttactcccttct

SEQ ID NO: 629664 - DNA, 25 bp, Mus musculus
gggagatgctctatctgtcaacaga

SEQ ID NO: 629665 - DNA, 25 bp, Mus musculus
gggagatgctctttctgtcaacaga

SEQ ID NO: 629666 - DNA, 25 bp, Mus musculus
gggagatgctggaacttgttttcaa

SEQ ID NO: 629667 - DNA, 25 bp, Mus musculus
gggagatgctggtacttgttttcaa

SEQ ID NO: 629668 - DNA, 25 bp, Mus musculus
gggagatggacaacaccggacacca

SEQ ID NO: 629669 - DNA, 25 bp, Mus musculus
gggagatggacatcaccggacacca

SEQ ID NO: 629670 - DNA, 25 bp, Mus musculus
gggagatggatcacagacacctgca

SEQ ID NO: 629671 - DNA, 25 bp, Mus musculus
gggagatggatctcagacacctgca

SEQ ID NO: 629672 - DNA, 25 bp, Mus musculus
gggagatggccaactgaacgccacc

SEQ ID NO: 629673 - DNA, 25 bp, Mus musculus
gggagatggccatctgaacgccacc

SEQ ID NO: 629674 - DNA, 25 bp, Mus musculus
gggagatgggctcactcacattaaa

SEQ ID NO: 629675 - DNA, 25 bp, Mus musculus
gggagatgggctgactcacattaaa

SEQ ID NO: 629676 - DNA, 25 bp, Mus musculus
gggagatggtcacgctactgccact

SEQ ID NO: 629677 - DNA, 25 bp, Mus musculus
gggagatggtcaggctactgccact

SEQ ID NO: 629678 - DNA, 25 bp, Mus musculus
gggagatggtggagggtttgtcctt

SEQ ID NO: 629679 - DNA, 25 bp, Mus musculus
gggagatggtggtgggtttgtcctt

SEQ ID NO: 629680 - DNA, 25 bp, Mus musculus
gggagatgtgtgacccactctgaaa

SEQ ID NO: 629681 - DNA, 25 bp, Mus musculus
gggagatgtgtgtcccactctgaaa

SEQ ID NO: 629682 - DNA, 25 bp, Mus musculus
gggagattagcacactagcctttat

SEQ ID NO: 629683 - DNA, 25 bp, Mus musculus
gggagattagcagactagcctttat

SEQ ID NO: 629684 - DNA, 25 bp, Mus musculus
gggagattatccagcgtgcctattg

SEQ ID NO: 629685 - DNA, 25 bp, Mus musculus
gggagattatcctgcgtgcctattg

SEQ ID NO: 629686 - DNA, 25 bp, Mus musculus
gggagattattactacctcaatttc

SEQ ID NO: 629687 - DNA, 25 bp, Mus musculus
gggagattattagtacctcaatttc

SEQ ID NO: 629688 - DNA, 25 bp, Mus musculus
gggagattcaggcacctcaagatct

SEQ ID NO: 629689 - DNA, 25 bp, Mus musculus
gggagattcagggacctcaagatct

SEQ ID NO: 629690 - DNA, 25 bp, Mus musculus
gggagattcatcaaagccagttagt

SEQ ID NO: 629691 - DNA, 25 bp, Mus musculus
gggagattcatctaagccagttagt

SEQ ID NO: 629692 - DNA, 25 bp, Mus musculus
gggagattccacataatgggcactc

SEQ ID NO: 629693 - DNA, 25 bp, Mus musculus
gggagattccacttaatgggcactc

SEQ ID NO: 629694 - DNA, 25 bp, Mus musculus
gggagattcccacgctgttaacgcg

SEQ ID NO: 629695 - DNA, 25 bp, Mus musculus
gggagattcccaggctgttaacgcg

SEQ ID NO: 629696 - DNA, 25 bp, Mus musculus
gggagattcctgagcccagaggctt

SEQ ID NO: 629697 - DNA, 25 bp, Mus musculus
gggagattcctgtgcccagaggctt

SEQ ID NO: 629698 - DNA, 25 bp, Mus musculus
gggagattctgtacctagtgcacta

SEQ ID NO: 629699 - DNA, 25 bp, Mus musculus
gggagattctgttcctagtgcacta

SEQ ID NO: 629700 - DNA, 25 bp, Mus musculus
gggagattgccacttccacaactgc

SEQ ID NO: 629701 - DNA, 25 bp, Mus musculus
gggagattgccagttccacaactgc

SEQ ID NO: 629702 - DNA, 25 bp, Mus musculus
gggagatttactccaggctggctcc

SEQ ID NO: 629703 - DNA, 25 bp, Mus musculus
gggagatttactgcaggctggctcc

SEQ ID NO: 629704 - DNA, 25 bp, Mus musculus
gggagatttcagagccagtctcttt

SEQ ID NO: 629705 - DNA, 25 bp, Mus musculus
gggagatttcagtgccagtctcttt

SEQ ID NO: 629706 - DNA, 25 bp, Mus musculus
gggagatttcctagttttgcgattt

SEQ ID NO: 629707 - DNA, 25 bp, Mus musculus
gggagatttccttgttttgcgattt

SEQ ID NO: 629708 - DNA, 25 bp, Mus musculus
gggagatttgtgatgtttatgtcat

SEQ ID NO: 629709 - DNA, 25 bp, Mus musculus
gggagatttgtgttgtttatgtcat

SEQ ID NO: 629710 - DNA, 25 bp, Mus musculus
gggagattttatcacctgtacagag

SEQ ID NO: 629711 - DNA, 25 bp, Mus musculus
gggagattttatgacctgtacagag

SEQ ID NO: 629712 - DNA, 25 bp, Mus musculus
gggagattttcacattacctattta

SEQ ID NO: 629713 - DNA, 25 bp, Mus musculus
gggagattttcagattacctattta

SEQ ID NO: 629714 - DNA, 25 bp, Mus musculus
gggagattttgtacttaggctctac

SEQ ID NO: 629715 - DNA, 25 bp, Mus musculus
gggagattttgttcttaggctctac

SEQ ID NO: 629716 - DNA, 25 bp, Mus musculus
gggagatttttcacaccacctaagg

SEQ ID NO: 629717 - DNA, 25 bp, Mus musculus
gggagatttttctcaccacctaagg

SEQ ID NO: 629718 - DNA, 25 bp, Mus musculus
gggagcaaaagtctgtaatctatgt

SEQ ID NO: 629719 - DNA, 25 bp, Mus musculus
gggagcaaaagtgtgtaatctatgt

SEQ ID NO: 629720 - DNA, 25 bp, Mus musculus
gggagcaaacccaggatttcatgct

SEQ ID NO: 629721 - DNA, 25 bp, Mus musculus
gggagcaaaccctggatttcatgct

SEQ ID NO: 629722 - DNA, 25 bp, Mus musculus
gggagcaaacggcaaccccatggca

SEQ ID NO: 629723 - DNA, 25 bp, Mus musculus
gggagcaaacgggaaccccatggca

SEQ ID NO: 629724 - DNA, 25 bp, Mus musculus
gggagcaaatcacccatgcacatga

SEQ ID NO: 629725 - DNA, 25 bp, Mus musculus
gggagcaaatcagccatgcacatga

SEQ ID NO: 629726 - DNA, 25 bp, Mus musculus
gggagcaaatgcatctacctagaat

SEQ ID NO: 629727 - DNA, 25 bp, Mus musculus
gggagcaaatgcttctacctagaat

SEQ ID NO: 629728 - DNA, 25 bp, Mus musculus
gggagcaaccagaagggctttcctt

SEQ ID NO: 629729 - DNA, 25 bp, Mus musculus
gggagcaaccagtagggctttcctt

SEQ ID NO: 629730 - DNA, 25 bp, Mus musculus
gggagcaacctcagggttcagaatc

SEQ ID NO: 629731 - DNA, 25 bp, Mus musculus
gggagcaacctctgggttcagaatc

SEQ ID NO: 629732 - DNA, 25 bp, Mus musculus
gggagcaacctgaactgtgttatta

SEQ ID NO: 629733 - DNA, 25 bp, Mus musculus
gggagcaacctgactccctgaagac

SEQ ID NO: 629734 - DNA, 25 bp, Mus musculus
gggagcaacctgtactgtgttatta

SEQ ID NO: 629735 - DNA, 25 bp, Mus musculus
gggagcaacctgtctccctgaagac

SEQ ID NO: 629736 - DNA, 25 bp, Mus musculus
gggagcaacggtcgctttccttaat

SEQ ID NO: 629737 - DNA, 25 bp, Mus musculus
gggagcaacggtggctttccttaat

SEQ ID NO: 629738 - DNA, 25 bp, Mus musculus
gggagcaagactacatctgtatgta

SEQ ID NO: 629739 - DNA, 25 bp, Mus musculus
gggagcaagacttcatctgtatgta

SEQ ID NO: 629740 - DNA, 25 bp, Mus musculus
gggagcaagagcaatctgtttttat

SEQ ID NO: 629741 - DNA, 25 bp, Mus musculus
gggagcaagagctatctgtttttat

SEQ ID NO: 629742 - DNA, 25 bp, Mus musculus
gggagcaagagtcagcttattcagc

SEQ ID NO: 629743 - DNA, 25 bp, Mus musculus
gggagcaagagtgagcttattcagc

SEQ ID NO: 629744 - DNA, 25 bp, Mus musculus
gggagcaaggacctgttatgcattt

SEQ ID NO: 629745 - DNA, 25 bp, Mus musculus
gggagcaaggacgtgttatgcattt

SEQ ID NO: 629746 - DNA, 25 bp, Mus musculus
gggagcaaggttaacgtagcgtcac

SEQ ID NO: 629747 - DNA, 25 bp, Mus musculus
gggagcaaggtttacgtagcgtcac

SEQ ID NO: 629748 - DNA, 25 bp, Mus musculus
gggagcaagttgcagtcctttcctc

SEQ ID NO: 629749 - DNA, 25 bp, Mus musculus
gggagcaagttggagtcctttcctc

SEQ ID NO: 629750 - DNA, 25 bp, Mus musculus
gggagcaatactagaaaactcatct

SEQ ID NO: 629751 - DNA, 25 bp, Mus musculus
gggagcaatacttgaaaactcatct

SEQ ID NO: 629752 - DNA, 25 bp, Mus musculus
gggagcaatctgaacgtctgttttg

SEQ ID NO: 629753 - DNA, 25 bp, Mus musculus
gggagcaatctgtacgtctgttttg

SEQ ID NO: 629754 - DNA, 25 bp, Mus musculus
gggagcaatgtgacgccacctttta

SEQ ID NO: 629755 - DNA, 25 bp, Mus musculus
gggagcaatgtgtcgccacctttta

SEQ ID NO: 629756 - DNA, 25 bp, Mus musculus
gggagcaattacaccagctgcaggt

SEQ ID NO: 629757 - DNA, 25 bp, Mus musculus
gggagcaattactccagctgcaggt

SEQ ID NO: 629758 - DNA, 25 bp, Mus musculus
gggagcacacaaacatcctctagag

SEQ ID NO: 629759 - DNA, 25 bp, Mus musculus
gggagcacacaatcatcctctagag

SEQ ID NO: 629760 - DNA, 25 bp, Mus musculus
gggagcacagcccagcctaagtata

SEQ ID NO: 629761 - DNA, 25 bp, Mus musculus
gggagcacagccgagcctaagtata

SEQ ID NO: 629762 - DNA, 25 bp, Mus musculus
gggagcacagtcaaactcaatcaaa

SEQ ID NO: 629763 - DNA, 25 bp, Mus musculus
gggagcacagtctaactcaatcaaa

SEQ ID NO: 629764 - DNA, 25 bp, Mus musculus
gggagcacagtgcacacacttcaca

SEQ ID NO: 629765 - DNA, 25 bp, Mus musculus
gggagcacagtggacacacttcaca

SEQ ID NO: 629766 - DNA, 25 bp, Mus musculus
gggagcacatatagatgttcgtaac

SEQ ID NO: 629767 - DNA, 25 bp, Mus musculus
gggagcacatattgatgttcgtaac

SEQ ID NO: 629768 - DNA, 25 bp, Mus musculus
gggagcacattgctggtcaattact

SEQ ID NO: 629769 - DNA, 25 bp, Mus musculus
gggagcacattggtggtcaattact

SEQ ID NO: 629770 - DNA, 25 bp, Mus musculus
gggagcaccactcagaaaaacatct

SEQ ID NO: 629771 - DNA, 25 bp, Mus musculus
gggagcaccactctgtctattatgt

SEQ ID NO: 629772 - DNA, 25 bp, Mus musculus
gggagcaccactgagaaaaacatct

SEQ ID NO: 629773 - DNA, 25 bp, Mus musculus
gggagcaccactgtgtctattatgt

SEQ ID NO: 629774 - DNA, 25 bp, Mus musculus
gggagcaccagcaaccaaacagaca

SEQ ID NO: 629775 - DNA, 25 bp, Mus musculus
gggagcaccagctaccaaacagaca

SEQ ID NO: 629776 - DNA, 25 bp, Mus musculus
gggagcacccatcttgagcaattaa

SEQ ID NO: 629777 - DNA, 25 bp, Mus musculus
gggagcacccatgttgagcaattaa

SEQ ID NO: 629778 - DNA, 25 bp, Mus musculus
gggagcaccgaactcacaggcagat

SEQ ID NO: 629779 - DNA, 25 bp, Mus musculus
gggagcaccgaagtcacaggcagat

SEQ ID NO: 629780 - DNA, 25 bp, Mus musculus
gggagcaccgacagccagccacggt

SEQ ID NO: 629781 - DNA, 25 bp, Mus musculus
gggagcaccgactgccagccacggt

SEQ ID NO: 629782 - DNA, 25 bp, Mus musculus
gggagcaccttgacaattctgtttg

SEQ ID NO: 629783 - DNA, 25 bp, Mus musculus
gggagcaccttgtcaattctgtttg

SEQ ID NO: 629784 - DNA, 25 bp, Mus musculus
gggagcacggtcagagcacatttaa

SEQ ID NO: 629785 - DNA, 25 bp, Mus musculus
gggagcacggtctgagcacatttaa

SEQ ID NO: 629786 - DNA, 25 bp, Mus musculus
gggagcactattcactggacctaca

SEQ ID NO: 629787 - DNA, 25 bp, Mus musculus
gggagcactattgactggacctaca

SEQ ID NO: 629788 - DNA, 25 bp, Mus musculus
gggagcactcttcatagttctgagg

SEQ ID NO: 629789 - DNA, 25 bp, Mus musculus
gggagcactcttgatagttctgagg

SEQ ID NO: 629790 - DNA, 25 bp, Mus musculus
gggagcactgtcaagttacacttcc

SEQ ID NO: 629791 - DNA, 25 bp, Mus musculus
gggagcactgtctagttacacttcc

SEQ ID NO: 629792 - DNA, 25 bp, Mus musculus
gggagcacttccaagagctctttgc

SEQ ID NO: 629793 - DNA, 25 bp, Mus musculus
gggagcacttcctagagctctttgc

SEQ ID NO: 629794 - DNA, 25 bp, Mus musculus
gggagcagaactagacacttacatt

SEQ ID NO: 629795 - DNA, 25 bp, Mus musculus
gggagcagaacttgacacttacatt

SEQ ID NO: 629796 - DNA, 25 bp, Mus musculus
gggagcagaagtattccagccttcc

SEQ ID NO: 629797 - DNA, 25 bp, Mus musculus
gggagcagaagttttccagccttcc

SEQ ID NO: 629798 - DNA, 25 bp, Mus musculus
gggagcagacctcaaaggcgactat

SEQ ID NO: 629799 - DNA, 25 bp, Mus musculus
gggagcagacctgaaaggcgactat

SEQ ID NO: 629800 - DNA, 25 bp, Mus musculus
gggagcagagtaacatcgccaggat

SEQ ID NO: 629801 - DNA, 25 bp, Mus musculus
gggagcagagtatcatcgccaggat

SEQ ID NO: 629802 - DNA, 25 bp, Mus musculus
gggagcagagttatcatgtactact

SEQ ID NO: 629803 - DNA, 25 bp, Mus musculus
gggagcagagttcccttccaacctg

SEQ ID NO: 629804 - DNA, 25 bp, Mus musculus
gggagcagagttgccttccaacctg

SEQ ID NO: 629805 - DNA, 25 bp, Mus musculus
gggagcagagttttcatgtactact

SEQ ID NO: 629806 - DNA, 25 bp, Mus musculus
gggagcagccagaatatacgactct

SEQ ID NO: 629807 - DNA, 25 bp, Mus musculus
gggagcagccagtatatacgactct

SEQ ID NO: 629808 - DNA, 25 bp, Mus musculus
gggagcagccctcatgcactgtctt

SEQ ID NO: 629809 - DNA, 25 bp, Mus musculus
gggagcagccctgatgcactgtctt

SEQ ID NO: 629810 - DNA, 25 bp, Mus musculus
gggagcagctccaattgacctggaa

SEQ ID NO: 629811 - DNA, 25 bp, Mus musculus
gggagcagctcctattgacctggaa

SEQ ID NO: 629812 - DNA, 25 bp, Mus musculus
gggagcagctggcaggaccccagcc

SEQ ID NO: 629813 - DNA, 25 bp, Mus musculus
gggagcagctgggaggaccccagcc

SEQ ID NO: 629814 - DNA, 25 bp, Mus musculus
gggagcaggccacaaacctttccaa

SEQ ID NO: 629815 - DNA, 25 bp, Mus musculus
gggagcaggccagaaacctttccaa

SEQ ID NO: 629816 - DNA, 25 bp, Mus musculus
gggagcaggtccattcccgccaatg

SEQ ID NO: 629817 - DNA, 25 bp, Mus musculus
gggagcaggtcctttcccgccaatg

SEQ ID NO: 629818 - DNA, 25 bp, Mus musculus
gggagcagtagtattcagaaccaaa

SEQ ID NO: 629819 - DNA, 25 bp, Mus musculus
gggagcagtagttttcagaaccaaa

SEQ ID NO: 629820 - DNA, 25 bp, Mus musculus
gggagcagtttaaacctggcgtttt

SEQ ID NO: 629821 - DNA, 25 bp, Mus musculus
gggagcagtttatacctggcgtttt

SEQ ID NO: 629822 - DNA, 25 bp, Mus musculus
gggagcataaacagcactttcaggc

SEQ ID NO: 629823 - DNA, 25 bp, Mus musculus
gggagcataaactgcactttcaggc

SEQ ID NO: 629824 - DNA, 25 bp, Mus musculus
gggagcatacagagagcatccatat

SEQ ID NO: 629825 - DNA, 25 bp, Mus musculus
gggagcatacagtgagcatccatat

SEQ ID NO: 629826 - DNA, 25 bp, Mus musculus
gggagcatacttataaccaacatgg

SEQ ID NO: 629827 - DNA, 25 bp, Mus musculus
gggagcatacttttaaccaacatgg

SEQ ID NO: 629828 - DNA, 25 bp, Mus musculus
gggagcatagacagtgggtcccctc

SEQ ID NO: 629829 - DNA, 25 bp, Mus musculus
gggagcatagactgtgggtcccctc

SEQ ID NO: 629830 - DNA, 25 bp, Mus musculus
gggagcatagtgaggcatccaccca

SEQ ID NO: 629831 - DNA, 25 bp, Mus musculus
gggagcatagtgtggcatccaccca

SEQ ID NO: 629832 - DNA, 25 bp, Mus musculus
gggagcatataccactgggtgctta

SEQ ID NO: 629833 - DNA, 25 bp, Mus musculus
gggagcatatacgactgggtgctta

SEQ ID NO: 629834 - DNA, 25 bp, Mus musculus
gggagcatcaaactgcagcgttcag

SEQ ID NO: 629835 - DNA, 25 bp, Mus musculus
gggagcatcaaagtgcagcgttcag

SEQ ID NO: 629836 - DNA, 25 bp, Mus musculus
gggagcatcaagaagtcatgctctt

SEQ ID NO: 629837 - DNA, 25 bp, Mus musculus
gggagcatcaagtagtcatgctctt

SEQ ID NO: 629838 - DNA, 25 bp, Mus musculus
gggagcatccacctgagtaaacctt

SEQ ID NO: 629839 - DNA, 25 bp, Mus musculus
gggagcatccacgtgagtaaacctt

SEQ ID NO: 629840 - DNA, 25 bp, Mus musculus
gggagcatccagaaggccatatgac

SEQ ID NO: 629841 - DNA, 25 bp, Mus musculus
gggagcatccagtaggccatatgac

SEQ ID NO: 629842 - DNA, 25 bp, Mus musculus
gggagcatcccaaagtacagagaca

SEQ ID NO: 629843 - DNA, 25 bp, Mus musculus
gggagcatcccatagtacagagaca

SEQ ID NO: 629844 - DNA, 25 bp, Mus musculus
gggagcatcgctattcttccctatc

SEQ ID NO: 629845 - DNA, 25 bp, Mus musculus
gggagcatcgcttttcttccctatc

SEQ ID NO: 629846 - DNA, 25 bp, Mus musculus
gggagcatctgcatcatcaggagga

SEQ ID NO: 629847 - DNA, 25 bp, Mus musculus
gggagcatctgcttcatcaggagga

SEQ ID NO: 629848 - DNA, 25 bp, Mus musculus
gggagcatctgtacctgcttatccg

SEQ ID NO: 629849 - DNA, 25 bp, Mus musculus
gggagcatctgtctccaagtactct

SEQ ID NO: 629850 - DNA, 25 bp, Mus musculus
gggagcatctgtgtccaagtactct

SEQ ID NO: 629851 - DNA, 25 bp, Mus musculus
gggagcatctgttcctgcttatccg

SEQ ID NO: 629852 - DNA, 25 bp, Mus musculus
gggagcatctttacccagtatgcat

SEQ ID NO: 629853 - DNA, 25 bp, Mus musculus
gggagcatcttttcccagtatgcat

SEQ ID NO: 629854 - DNA, 25 bp, Mus musculus
gggagcatgctgatgccttgagtaa

SEQ ID NO: 629855 - DNA, 25 bp, Mus musculus
gggagcatgctgttgccttgagtaa

SEQ ID NO: 629856 - DNA, 25 bp, Mus musculus
gggagcattaagactttttaaggat

SEQ ID NO: 629857 - DNA, 25 bp, Mus musculus
gggagcattaagtctttttaaggat

SEQ ID NO: 629858 - DNA, 25 bp, Mus musculus
gggagcattacaaagatcaccaagc

SEQ ID NO: 629859 - DNA, 25 bp, Mus musculus
gggagcattacatagatcaccaagc

SEQ ID NO: 629860 - DNA, 25 bp, Mus musculus
gggagcattcagattgctgatacaa

SEQ ID NO: 629861 - DNA, 25 bp, Mus musculus
gggagcattcagtttgctgatacaa

SEQ ID NO: 629862 - DNA, 25 bp, Mus musculus
gggagcattccaaagcagtatattg

SEQ ID NO: 629863 - DNA, 25 bp, Mus musculus
gggagcattccatagcagtatattg

SEQ ID NO: 629864 - DNA, 25 bp, Mus musculus
gggagcattctcctgacagtgacac

SEQ ID NO: 629865 - DNA, 25 bp, Mus musculus
gggagcattctcgtgacagtgacac

SEQ ID NO: 629866 - DNA, 25 bp, Mus musculus
gggagcattgctaacagaagatttt

SEQ ID NO: 629867 - DNA, 25 bp, Mus musculus
gggagcattgcttacagaagatttt

SEQ ID NO: 629868 - DNA, 25 bp, Mus musculus
gggagcatttatcacccctgaatga

SEQ ID NO: 629869 - DNA, 25 bp, Mus musculus
gggagcatttatgacccctgaatga

SEQ ID NO: 629870 - DNA, 25 bp, Mus musculus
gggagcatttctccctgattctgga

SEQ ID NO: 629871 - DNA, 25 bp, Mus musculus
gggagcatttctgcctgattctgga

SEQ ID NO: 629872 - DNA, 25 bp, Mus musculus
gggagcattttaacaatctttgact

SEQ ID NO: 629873 - DNA, 25 bp, Mus musculus
gggagcattttatcaatctttgact

SEQ ID NO: 629874 - DNA, 25 bp, Mus musculus
gggagccaaacactctgattctgag

SEQ ID NO: 629875 - DNA, 25 bp, Mus musculus
gggagccaaacagtctgattctgag

SEQ ID NO: 629876 - DNA, 25 bp, Mus musculus
gggagccaaacccatgtatacagat

SEQ ID NO: 629877 - DNA, 25 bp, Mus musculus
gggagccaaaccgatgtatacagat

SEQ ID NO: 629878 - DNA, 25 bp, Mus musculus
gggagccaaagtactccaactgctg

SEQ ID NO: 629879 - DNA, 25 bp, Mus musculus
gggagccaaagttctccaactgctg

SEQ ID NO: 629880 - DNA, 25 bp, Mus musculus
gggagccaacatacagccaagaaca

SEQ ID NO: 629881 - DNA, 25 bp, Mus musculus
gggagccaacattcagccaagaaca

SEQ ID NO: 629882 - DNA, 25 bp, Mus musculus
gggagccaactcaccttagatatat

SEQ ID NO: 629883 - DNA, 25 bp, Mus musculus
gggagccaactcagctgatcggatc

SEQ ID NO: 629884 - DNA, 25 bp, Mus musculus
gggagccaactctccttagatatat

SEQ ID NO: 629885 - DNA, 25 bp, Mus musculus
gggagccaactctgctgatcggatc

SEQ ID NO: 629886 - DNA, 25 bp, Mus musculus
gggagccaatttcagcataccatgc

SEQ ID NO: 629887 - DNA, 25 bp, Mus musculus
gggagccaatttgagcataccatgc

SEQ ID NO: 629888 - DNA, 25 bp, Mus musculus
gggagccacacacttgctcaatctt

SEQ ID NO: 629889 - DNA, 25 bp, Mus musculus
gggagccacacagttgctcaatctt

SEQ ID NO: 629890 - DNA, 25 bp, Mus musculus
gggagccacactagtgtcagttaaa

SEQ ID NO: 629891 - DNA, 25 bp, Mus musculus
gggagccacacttgtgtcagttaaa

SEQ ID NO: 629892 - DNA, 25 bp, Mus musculus
gggagccacatgaaagacatctact

SEQ ID NO: 629893 - DNA, 25 bp, Mus musculus
gggagccacatgtaagacatctact

SEQ ID NO: 629894 - DNA, 25 bp, Mus musculus
gggagccaccagcaaagcgcaaaaa

SEQ ID NO: 629895 - DNA, 25 bp, Mus musculus
gggagccaccaggaaagcgcaaaaa

SEQ ID NO: 629896 - DNA, 25 bp, Mus musculus
gggagccaccatccttagcaaaggc

SEQ ID NO: 629897 - DNA, 25 bp, Mus musculus
gggagccaccatgcttagcaaaggc

SEQ ID NO: 629898 - DNA, 25 bp, Mus musculus
gggagccaccggaagatccagacac

SEQ ID NO: 629899 - DNA, 25 bp, Mus musculus
gggagccaccggtagatccagacac

SEQ ID NO: 629900 - DNA, 25 bp, Mus musculus
gggagccacggaactcactcatgag

SEQ ID NO: 629901 - DNA, 25 bp, Mus musculus
gggagccacggatctcactcatgag

SEQ ID NO: 629902 - DNA, 25 bp, Mus musculus
gggagccacgtgagaagcacttcga

SEQ ID NO: 629903 - DNA, 25 bp, Mus musculus
gggagccacgtgtgaagcacttcga

SEQ ID NO: 629904 - DNA, 25 bp, Mus musculus
gggagccactacattggaacatttt

SEQ ID NO: 629905 - DNA, 25 bp, Mus musculus
gggagccactactttggaacatttt

SEQ ID NO: 629906 - DNA, 25 bp, Mus musculus
gggagccactgaagaaatgaaatat

SEQ ID NO: 629907 - DNA, 25 bp, Mus musculus
gggagccactgatgaaatgaaatat

SEQ ID NO: 629908 - DNA, 25 bp, Mus musculus
gggagccactggaacttgaatgaat

SEQ ID NO: 629909 - DNA, 25 bp, Mus musculus
gggagccactggtacttgaatgaat

SEQ ID NO: 629910 - DNA, 25 bp, Mus musculus
gggagccacttgaacagactgcttt

SEQ ID NO: 629911 - DNA, 25 bp, Mus musculus
gggagccacttgtacagactgcttt

SEQ ID NO: 629912 - DNA, 25 bp, Mus musculus
gggagccagagtaaccaagctgctt

SEQ ID NO: 629913 - DNA, 25 bp, Mus musculus
gggagccagagttaccaagctgctt

SEQ ID NO: 629914 - DNA, 25 bp, Mus musculus
gggagccaggacctcagaatttata

SEQ ID NO: 629915 - DNA, 25 bp, Mus musculus
gggagccaggacgtcagaatttata

SEQ ID NO: 629916 - DNA, 25 bp, Mus musculus
gggagccagttacctgcttctctag

SEQ ID NO: 629917 - DNA, 25 bp, Mus musculus
gggagccagttagctgcttctctag

SEQ ID NO: 629918 - DNA, 25 bp, Mus musculus
gggagccatccccaagtcttagggt

SEQ ID NO: 629919 - DNA, 25 bp, Mus musculus
gggagccatcccgaagtcttagggt

SEQ ID NO: 629920 - DNA, 25 bp, Mus musculus
gggagccatccgcctccaagagcag

SEQ ID NO: 629921 - DNA, 25 bp, Mus musculus
gggagccatccggctccaagagcag

SEQ ID NO: 629922 - DNA, 25 bp, Mus musculus
gggagccatctaaagaaaggacatt

SEQ ID NO: 629923 - DNA, 25 bp, Mus musculus
gggagccatctatagaaaggacatt

SEQ ID NO: 629924 - DNA, 25 bp, Mus musculus
gggagccatttactttgccggatag

SEQ ID NO: 629925 - DNA, 25 bp, Mus musculus
gggagccatttagtttgccggatag

SEQ ID NO: 629926 - DNA, 25 bp, Mus musculus
gggagcccaaagcatctgagagaat

SEQ ID NO: 629927 - DNA, 25 bp, Mus musculus
gggagcccaaaggatctgagagaat

SEQ ID NO: 629928 - DNA, 25 bp, Mus musculus
gggagcccaaatcagactactttac

SEQ ID NO: 629929 - DNA, 25 bp, Mus musculus
gggagcccaaatgagactactttac

SEQ ID NO: 629930 - DNA, 25 bp, Mus musculus
gggagcccaaccattcgagtgcagc

SEQ ID NO: 629931 - DNA, 25 bp, Mus musculus
gggagcccaacctttcgagtgcagc

SEQ ID NO: 629932 - DNA, 25 bp, Mus musculus
gggagcccagagaatatgaaatgtc

SEQ ID NO: 629933 - DNA, 25 bp, Mus musculus
gggagcccagagtatatgaaatgtc

SEQ ID NO: 629934 - DNA, 25 bp, Mus musculus
gggagcccagctctttgcaacagat

SEQ ID NO: 629935 - DNA, 25 bp, Mus musculus
gggagcccagctgtttgcaacagat

SEQ ID NO: 629936 - DNA, 25 bp, Mus musculus
gggagcccaggcatcctcagtggaa

SEQ ID NO: 629937 - DNA, 25 bp, Mus musculus
gggagcccaggcttcctcagtggaa

SEQ ID NO: 629938 - DNA, 25 bp, Mus musculus
gggagcccagtaaatccgagctgca

SEQ ID NO: 629939 - DNA, 25 bp, Mus musculus
gggagcccagtatatccgagctgca

SEQ ID NO: 629940 - DNA, 25 bp, Mus musculus
gggagcccagtcagtttgaaacgca

SEQ ID NO: 629941 - DNA, 25 bp, Mus musculus
gggagcccagtctgtttgaaacgca

SEQ ID NO: 629942 - DNA, 25 bp, Mus musculus
gggagcccagttaccagtgggttgt

SEQ ID NO: 629943 - DNA, 25 bp, Mus musculus
gggagcccagtttccagtgggttgt

SEQ ID NO: 629944 - DNA, 25 bp, Mus musculus
gggagcccatcacgatctccgagag

SEQ ID NO: 629945 - DNA, 25 bp, Mus musculus
gggagcccatcaggatctccgagag

SEQ ID NO: 629946 - DNA, 25 bp, Mus musculus
gggagcccatcgactgtgaagagca

SEQ ID NO: 629947 - DNA, 25 bp, Mus musculus
gggagcccatcgtctgtgaagagca

SEQ ID NO: 629948 - DNA, 25 bp, Mus musculus
gggagcccattgagctaagccagtc

SEQ ID NO: 629949 - DNA, 25 bp, Mus musculus
gggagcccattgtgctaagccagtc

SEQ ID NO: 629950 - DNA, 25 bp, Mus musculus
gggagccccaaaaataattgtgcta

SEQ ID NO: 629951 - DNA, 25 bp, Mus musculus
gggagccccaaatataattgtgcta

SEQ ID NO: 629952 - DNA, 25 bp, Mus musculus
gggagccccagaacctttgaaagcc

SEQ ID NO: 629953 - DNA, 25 bp, Mus musculus
gggagccccagatcctttgaaagcc

SEQ ID NO: 629954 - DNA, 25 bp, Mus musculus
gggagcccccaactgcaaaatcagc

SEQ ID NO: 629955 - DNA, 25 bp, Mus musculus
gggagcccccaagtgcaaaatcagc

SEQ ID NO: 629956 - DNA, 25 bp, Mus musculus
gggagcccgcagagctaacttagtt

SEQ ID NO: 629957 - DNA, 25 bp, Mus musculus
gggagcccgcagtgctaacttagtt

SEQ ID NO: 629958 - DNA, 25 bp, Mus musculus
gggagcccgtatcctatatgtgtat

SEQ ID NO: 629959 - DNA, 25 bp, Mus musculus
gggagcccgtatgctatatgtgtat

SEQ ID NO: 629960 - DNA, 25 bp, Mus musculus
gggagccctacaaccgaaagacact

SEQ ID NO: 629961 - DNA, 25 bp, Mus musculus
gggagccctacatccgaaagacact

SEQ ID NO: 629962 - DNA, 25 bp, Mus musculus
gggagccctcgcatcgggactcaaa

SEQ ID NO: 629963 - DNA, 25 bp, Mus musculus
gggagccctcgcttcgggactcaaa

SEQ ID NO: 629964 - DNA, 25 bp, Mus musculus
gggagccctgaaaggtcaggtcaca

SEQ ID NO: 629965 - DNA, 25 bp, Mus musculus
gggagccctgaacatgaacctttca

SEQ ID NO: 629966 - DNA, 25 bp, Mus musculus
gggagccctgaagatgaacctttca

SEQ ID NO: 629967 - DNA, 25 bp, Mus musculus
gggagccctgaatggtcaggtcaca

SEQ ID NO: 629968 - DNA, 25 bp, Mus musculus
gggagccctggccatttgctgtacc

SEQ ID NO: 629969 - DNA, 25 bp, Mus musculus
gggagccctggcgatttgctgtacc

SEQ ID NO: 629970 - DNA, 25 bp, Mus musculus
gggagccctttcatcatgatcttaa

SEQ ID NO: 629971 - DNA, 25 bp, Mus musculus
gggagccctttcttcatgatcttaa

SEQ ID NO: 629972 - DNA, 25 bp, Mus musculus
gggagccgagaccagcatccagcac

SEQ ID NO: 629973 - DNA, 25 bp, Mus musculus
gggagccgagacgagcatccagcac

SEQ ID NO: 629974 - DNA, 25 bp, Mus musculus
gggagccgcaacatatggttccaag

SEQ ID NO: 629975 - DNA, 25 bp, Mus musculus
gggagccgcaacttatggttccaag

SEQ ID NO: 629976 - DNA, 25 bp, Mus musculus
gggagccgcattagttgatcaaatt

SEQ ID NO: 629977 - DNA, 25 bp, Mus musculus
gggagccgcatttgttgatcaaatt

SEQ ID NO: 629978 - DNA, 25 bp, Mus musculus
gggagccgcgtactataggtcttaa

SEQ ID NO: 629979 - DNA, 25 bp, Mus musculus
gggagccgcgtagtataggtcttaa

SEQ ID NO: 629980 - DNA, 25 bp, Mus musculus
gggagccgctatcaccttgagcctc

SEQ ID NO: 629981 - DNA, 25 bp, Mus musculus
gggagccgctatgaccttgagcctc

SEQ ID NO: 629982 - DNA, 25 bp, Mus musculus
gggagccggatcatttgagaccact

SEQ ID NO: 629983 - DNA, 25 bp, Mus musculus
gggagccggatcttttgagaccact

SEQ ID NO: 629984 - DNA, 25 bp, Mus musculus
gggagccggcatctttgcaaacagc

SEQ ID NO: 629985 - DNA, 25 bp, Mus musculus
gggagccggcatgtttgcaaacagc

SEQ ID NO: 629986 - DNA, 25 bp, Mus musculus
gggagccggcgcactctttcgacgc

SEQ ID NO: 629987 - DNA, 25 bp, Mus musculus
gggagccggcgctctctttcgacgc

SEQ ID NO: 629988 - DNA, 25 bp, Mus musculus
gggagcctaacaacatcggtgagga

SEQ ID NO: 629989 - DNA, 25 bp, Mus musculus
gggagcctaacatcatcggtgagga

SEQ ID NO: 629990 - DNA, 25 bp, Mus musculus
gggagcctacaacgaaaactgcagc

SEQ ID NO: 629991 - DNA, 25 bp, Mus musculus
gggagcctacaaggaaaactgcagc

SEQ ID NO: 629992 - DNA, 25 bp, Mus musculus
gggagcctagccaatttcagacagt

SEQ ID NO: 629993 - DNA, 25 bp, Mus musculus
gggagcctagcctatttcagacagt

SEQ ID NO: 629994 - DNA, 25 bp, Mus musculus
gggagcctagtgcaattcttctctt

SEQ ID NO: 629995 - DNA, 25 bp, Mus musculus
gggagcctagtggaattcttctctt

SEQ ID NO: 629996 - DNA, 25 bp, Mus musculus
gggagcctcacacattccagacggc

SEQ ID NO: 629997 - DNA, 25 bp, Mus musculus
gggagcctcacacgagcattgttta

SEQ ID NO: 629998 - DNA, 25 bp, Mus musculus
gggagcctcacagattccagacggc

SEQ ID NO: 629999 - DNA, 25 bp, Mus musculus
gggagcctcacaggagcattgttta

SEQ ID NO: 630000 - DNA, 25 bp, Mus musculus
gggagcctcatgagactgacagatt

SEQ ID NO: 630001 - DNA, 25 bp, Mus musculus
gggagcctcatgtgactgacagatt

SEQ ID NO: 630002 - DNA, 25 bp, Mus musculus
gggagcctccagaccatggtgagct

SEQ ID NO: 630003 - DNA, 25 bp, Mus musculus
gggagcctccagtccatggtgagct

SEQ ID NO: 630004 - DNA, 25 bp, Mus musculus
gggagcctcttcactgaaaaccgtg

SEQ ID NO: 630005 - DNA, 25 bp, Mus musculus
gggagcctcttctctgaaaaccgtg

SEQ ID NO: 630006 - DNA, 25 bp, Mus musculus
gggagcctctttaacctccataggc

SEQ ID NO: 630007 - DNA, 25 bp, Mus musculus
gggagcctcttttacctccataggc

SEQ ID NO: 630008 - DNA, 25 bp, Mus musculus
gggagcctgaccaacgtgtgtgtaa

SEQ ID NO: 630009 - DNA, 25 bp, Mus musculus
gggagcctgacctacgtgtgtgtaa

SEQ ID NO: 630010 - DNA, 25 bp, Mus musculus
gggagcctgaggacatgcaaagagg

SEQ ID NO: 630011 - DNA, 25 bp, Mus musculus
gggagcctgaggtcatgcaaagagg

SEQ ID NO: 630012 - DNA, 25 bp, Mus musculus
gggagcctgagtaaccagctgaatt

SEQ ID NO: 630013 - DNA, 25 bp, Mus musculus
gggagcctgagttaccagctgaatt

SEQ ID NO: 630014 - DNA, 25 bp, Mus musculus
gggagcctgcaaaatctcacagtta

SEQ ID NO: 630015 - DNA, 25 bp, Mus musculus
gggagcctgcaatatctcacagtta

SEQ ID NO: 630016 - DNA, 25 bp, Mus musculus
gggagcctgcacatgatcaaaaata

SEQ ID NO: 630017 - DNA, 25 bp, Mus musculus
gggagcctgcacttgatcaaaaata

SEQ ID NO: 630018 - DNA, 25 bp, Mus musculus
gggagcctgcccaagtcttcaactg

SEQ ID NO: 630019 - DNA, 25 bp, Mus musculus
gggagcctgccctagtcttcaactg

SEQ ID NO: 630020 - DNA, 25 bp, Mus musculus
gggagcctgctcaacccgggtctct

SEQ ID NO: 630021 - DNA, 25 bp, Mus musculus
gggagcctgctctacccgggtctct

SEQ ID NO: 630022 - DNA, 25 bp, Mus musculus
gggagcctgcttaggtactacagaa

SEQ ID NO: 630023 - DNA, 25 bp, Mus musculus
gggagcctgctttggtactacagaa

SEQ ID NO: 630024 - DNA, 25 bp, Mus musculus
gggagcctgtccaccagcgttcagc

SEQ ID NO: 630025 - DNA, 25 bp, Mus musculus
gggagcctgtcctccagcgttcagc

SEQ ID NO: 630026 - DNA, 25 bp, Mus musculus
gggagcctgtctctgatgaccgact

SEQ ID NO: 630027 - DNA, 25 bp, Mus musculus
gggagcctgtctgtgatgaccgact

SEQ ID NO: 630028 - DNA, 25 bp, Mus musculus
gggagcctgtgcataacatgtccag

SEQ ID NO: 630029 - DNA, 25 bp, Mus musculus
gggagcctgtgcttaacatgtccag

SEQ ID NO: 630030 - DNA, 25 bp, Mus musculus
gggagcctgttcatagcgcctggat

SEQ ID NO: 630031 - DNA, 25 bp, Mus musculus
gggagcctgttcttagcgcctggat

SEQ ID NO: 630032 - DNA, 25 bp, Mus musculus
gggagccttcataggagcacattta

SEQ ID NO: 630033 - DNA, 25 bp, Mus musculus
gggagccttcattggagcacattta

SEQ ID NO: 630034 - DNA, 25 bp, Mus musculus
gggagcctttctccccgtagagaaa

SEQ ID NO: 630035 - DNA, 25 bp, Mus musculus
gggagcctttctgcccgtagagaaa

SEQ ID NO: 630036 - DNA, 25 bp, Mus musculus
gggagccttttcagagtgccagctc

SEQ ID NO: 630037 - DNA, 25 bp, Mus musculus
gggagccttttctgagtgccagctc

SEQ ID NO: 630038 - DNA, 25 bp, Mus musculus
gggagcgaccgaccgcacttcttgc

SEQ ID NO: 630039 - DNA, 25 bp, Mus musculus
gggagcgaccgagcgcacttcttgc

SEQ ID NO: 630040 - DNA, 25 bp, Mus musculus
gggagcgaccttatgtgtgtaccaa

SEQ ID NO: 630041 - DNA, 25 bp, Mus musculus
gggagcgaccttttgtgtgtaccaa

SEQ ID NO: 630042 - DNA, 25 bp, Mus musculus
gggagcgagccaatcaggttctgaa

SEQ ID NO: 630043 - DNA, 25 bp, Mus musculus
gggagcgagccattcaggttctgaa

SEQ ID NO: 630044 - DNA, 25 bp, Mus musculus
gggagcgagctcaactttttcgtgt

SEQ ID NO: 630045 - DNA, 25 bp, Mus musculus
gggagcgagctctactttttcgtgt

SEQ ID NO: 630046 - DNA, 25 bp, Mus musculus
gggagcgatcctactttgggaacat

SEQ ID NO: 630047 - DNA, 25 bp, Mus musculus
gggagcgatccttctttgggaacat

SEQ ID NO: 630048 - DNA, 25 bp, Mus musculus
gggagcgatgtaattctattgttaa

SEQ ID NO: 630049 - DNA, 25 bp, Mus musculus
gggagcgatgtatttctattgttaa

SEQ ID NO: 630050 - DNA, 25 bp, Mus musculus
gggagcgcaccgcaaagcccttcaa

SEQ ID NO: 630051 - DNA, 25 bp, Mus musculus
gggagcgcaccggaaagcccttcaa

SEQ ID NO: 630052 - DNA, 25 bp, Mus musculus
gggagcgcctgcaaaggaatcttcc

SEQ ID NO: 630053 - DNA, 25 bp, Mus musculus
gggagcgcctgctaaggaatcttcc

SEQ ID NO: 630054 - DNA, 25 bp, Mus musculus
gggagcgcgtctcgataagtcctct

SEQ ID NO: 630055 - DNA, 25 bp, Mus musculus
gggagcgcgtctggataagtcctct

SEQ ID NO: 630056 - DNA, 25 bp, Mus musculus
gggagcggctcgaagcccttacctg

SEQ ID NO: 630057 - DNA, 25 bp, Mus musculus
gggagcggctcgtagcccttacctg

SEQ ID NO: 630058 - DNA, 25 bp, Mus musculus
gggagcgggcctccgagtccccgga

SEQ ID NO: 630059 - DNA, 25 bp, Mus musculus
gggagcgggcctgcgagtccccgga

SEQ ID NO: 630060 - DNA, 25 bp, Mus musculus
gggagcggtaatccgtccagcccca

SEQ ID NO: 630061 - DNA, 25 bp, Mus musculus
gggagcggtaatgcgtccagcccca

SEQ ID NO: 630062 - DNA, 25 bp, Mus musculus
gggagcgtcacaattgtaacaacac

SEQ ID NO: 630063 - DNA, 25 bp, Mus musculus
gggagcgtcacatttgtaacaacac

SEQ ID NO: 630064 - DNA, 25 bp, Mus musculus
gggagcgtcccaaaggcaggtccat

SEQ ID NO: 630065 - DNA, 25 bp, Mus musculus
gggagcgtcccataggcaggtccat

SEQ ID NO: 630066 - DNA, 25 bp, Mus musculus
gggagcgttgagagtaccccataac

SEQ ID NO: 630067 - DNA, 25 bp, Mus musculus
gggagcgttgagtgtaccccataac

SEQ ID NO: 630068 - DNA, 25 bp, Mus musculus
gggagctaaacgctgacgttgtaaa

SEQ ID NO: 630069 - DNA, 25 bp, Mus musculus
gggagctaaacggtgacgttgtaaa

SEQ ID NO: 630070 - DNA, 25 bp, Mus musculus
gggagctaacatcagctcagacttt

SEQ ID NO: 630071 - DNA, 25 bp, Mus musculus
gggagctaacatgagctcagacttt

SEQ ID NO: 630072 - DNA, 25 bp, Mus musculus
gggagctaaccaacaaaagtgcctt

SEQ ID NO: 630073 - DNA, 25 bp, Mus musculus
gggagctaaccatcaaaagtgcctt

SEQ ID NO: 630074 - DNA, 25 bp, Mus musculus
gggagctagctcacttgggtactct

SEQ ID NO: 630075 - DNA, 25 bp, Mus musculus
gggagctagctctcttgggtactct

SEQ ID NO: 630076 - DNA, 25 bp, Mus musculus
gggagctaggtcataccctatgcac

SEQ ID NO: 630077 - DNA, 25 bp, Mus musculus
gggagctaggtcttaccctatgcac

SEQ ID NO: 630078 - DNA, 25 bp, Mus musculus
gggagctataacctcaccgagaaag

SEQ ID NO: 630079 - DNA, 25 bp, Mus musculus
gggagctataacgtcaccgagaaag

SEQ ID NO: 630080 - DNA, 25 bp, Mus musculus
gggagctattgtatacatcacaaaa

SEQ ID NO: 630081 - DNA, 25 bp, Mus musculus
gggagctattgtttacatcacaaaa

SEQ ID NO: 630082 - DNA, 25 bp, Mus musculus
gggagctcaaacaaccaatgcaatc

SEQ ID NO: 630083 - DNA, 25 bp, Mus musculus
gggagctcaaactaccaatgcaatc

SEQ ID NO: 630084 - DNA, 25 bp, Mus musculus
gggagctcaaagactggcctcagaa

SEQ ID NO: 630085 - DNA, 25 bp, Mus musculus
gggagctcaaagatgcttatcgtga

SEQ ID NO: 630086 - DNA, 25 bp, Mus musculus
gggagctcaaagtctggcctcagaa

SEQ ID NO: 630087 - DNA, 25 bp, Mus musculus
gggagctcaaagttgcttatcgtga

SEQ ID NO: 630088 - DNA, 25 bp, Mus musculus
gggagctcaagaagacgctcataga

SEQ ID NO: 630089 - DNA, 25 bp, Mus musculus
gggagctcaagatgacgctcataga

SEQ ID NO: 630090 - DNA, 25 bp, Mus musculus
gggagctcaattacgtggccaggca

SEQ ID NO: 630091 - DNA, 25 bp, Mus musculus
gggagctcaatttcgtggccaggca

SEQ ID NO: 630092 - DNA, 25 bp, Mus musculus
gggagctcacccaagacaaggaact

SEQ ID NO: 630093 - DNA, 25 bp, Mus musculus
gggagctcaccctagacaaggaact

SEQ ID NO: 630094 - DNA, 25 bp, Mus musculus
gggagctcaccgagtacagttggca

SEQ ID NO: 630095 - DNA, 25 bp, Mus musculus
gggagctcaccgtgtacagttggca

SEQ ID NO: 630096 - DNA, 25 bp, Mus musculus
gggagctcacctatactgtgtgctg

SEQ ID NO: 630097 - DNA, 25 bp, Mus musculus
gggagctcacctttactgtgtgctg

SEQ ID NO: 630098 - DNA, 25 bp, Mus musculus
gggagctcacttactgcaccaagca

SEQ ID NO: 630099 - DNA, 25 bp, Mus musculus
gggagctcactttctgcaccaagca

SEQ ID NO: 630100 - DNA, 25 bp, Mus musculus
gggagctcaggcatagatcttgaat

SEQ ID NO: 630101 - DNA, 25 bp, Mus musculus
gggagctcaggcttagatcttgaat

SEQ ID NO: 630102 - DNA, 25 bp, Mus musculus
gggagctcatatagatgtgcgaaac

SEQ ID NO: 630103 - DNA, 25 bp, Mus musculus
gggagctcatattgatgtgcgaaac

SEQ ID NO: 630104 - DNA, 25 bp, Mus musculus
gggagctccaagattcttacgaagc

SEQ ID NO: 630105 - DNA, 25 bp, Mus musculus
gggagctccaagtttcttacgaagc

SEQ ID NO: 630106 - DNA, 25 bp, Mus musculus
gggagctcccatactgtatcaaaat

SEQ ID NO: 630107 - DNA, 25 bp, Mus musculus
gggagctcccattctgtatcaaaat

SEQ ID NO: 630108 - DNA, 25 bp, Mus musculus
gggagctcccgtcttgaatttatta

SEQ ID NO: 630109 - DNA, 25 bp, Mus musculus
gggagctcccgtgttgaatttatta

SEQ ID NO: 630110 - DNA, 25 bp, Mus musculus
gggagctcccttacaatgatgtgtg

SEQ ID NO: 630111 - DNA, 25 bp, Mus musculus
gggagctccctttcaatgatgtgtg

SEQ ID NO: 630112 - DNA, 25 bp, Mus musculus
gggagctccgtcacatttggccagc

SEQ ID NO: 630113 - DNA, 25 bp, Mus musculus
gggagctccgtcatcagatgctcat

SEQ ID NO: 630114 - DNA, 25 bp, Mus musculus
gggagctccgtctcatttggccagc

SEQ ID NO: 630115 - DNA, 25 bp, Mus musculus
gggagctccgtcttcagatgctcat

SEQ ID NO: 630116 - DNA, 25 bp, Mus musculus
gggagctcgaaactatgcctgcaaa

SEQ ID NO: 630117 - DNA, 25 bp, Mus musculus
gggagctcgaaagtatgcctgcaaa

SEQ ID NO: 630118 - DNA, 25 bp, Mus musculus
gggagctctaagacagacctgttct

SEQ ID NO: 630119 - DNA, 25 bp, Mus musculus
gggagctctaagtcagacctgttct

SEQ ID NO: 630120 - DNA, 25 bp, Mus musculus
gggagctctcacattgcctgtgaca

SEQ ID NO: 630121 - DNA, 25 bp, Mus musculus
gggagctctcactttgcctgtgaca

SEQ ID NO: 630122 - DNA, 25 bp, Mus musculus
gggagctctccaacaaattgatcat

SEQ ID NO: 630123 - DNA, 25 bp, Mus musculus
gggagctctccatcaaattgatcat

SEQ ID NO: 630124 - DNA, 25 bp, Mus musculus
gggagctctccgcataactctgcac

SEQ ID NO: 630125 - DNA, 25 bp, Mus musculus
gggagctctccggataactctgcac

SEQ ID NO: 630126 - DNA, 25 bp, Mus musculus
gggagctctctaagttttgtaccat

SEQ ID NO: 630127 - DNA, 25 bp, Mus musculus
gggagctctctatgttttgtaccat

SEQ ID NO: 630128 - DNA, 25 bp, Mus musculus
gggagctctgatatctccctaagca

SEQ ID NO: 630129 - DNA, 25 bp, Mus musculus
gggagctctgatttctccctaagca

SEQ ID NO: 630130 - DNA, 25 bp, Mus musculus
gggagctcttccaggtgcttaagat

SEQ ID NO: 630131 - DNA, 25 bp, Mus musculus
gggagctcttcctggtgcttaagat

SEQ ID NO: 630132 - DNA, 25 bp, Mus musculus
gggagctcttggagacgctccctcc

SEQ ID NO: 630133 - DNA, 25 bp, Mus musculus
gggagctcttggtgacgctccctcc

SEQ ID NO: 630134 - DNA, 25 bp, Mus musculus
gggagctctttcagtgttaactgag

SEQ ID NO: 630135 - DNA, 25 bp, Mus musculus
gggagctctttctgtgttaactgag

SEQ ID NO: 630136 - DNA, 25 bp, Mus musculus
gggagctgaatgataaccactctaa

SEQ ID NO: 630137 - DNA, 25 bp, Mus musculus
gggagctgaatgttaaccactctaa

SEQ ID NO: 630138 - DNA, 25 bp, Mus musculus
gggagctgaccacgaggcccctgac

SEQ ID NO: 630139 - DNA, 25 bp, Mus musculus
gggagctgaccaggaggcccctgac

SEQ ID NO: 630140 - DNA, 25 bp, Mus musculus
gggagctgaccgagttgttgccaat

SEQ ID NO: 630141 - DNA, 25 bp, Mus musculus
gggagctgaccgtgttgttgccaat

SEQ ID NO: 630142 - DNA, 25 bp, Mus musculus
gggagctgacgtaacagtgtaatga

SEQ ID NO: 630143 - DNA, 25 bp, Mus musculus
gggagctgacgttacagtgtaatga

SEQ ID NO: 630144 - DNA, 25 bp, Mus musculus
gggagctgagtcagctgcaatgaca

SEQ ID NO: 630145 - DNA, 25 bp, Mus musculus
gggagctgagtctgctgcaatgaca

SEQ ID NO: 630146 - DNA, 25 bp, Mus musculus
gggagctgatgtcttactgtgacat

SEQ ID NO: 630147 - DNA, 25 bp, Mus musculus
gggagctgatgtgttactgtgacat

SEQ ID NO: 630148 - DNA, 25 bp, Mus musculus
gggagctgattaagccttgccatgc

SEQ ID NO: 630149 - DNA, 25 bp, Mus musculus
gggagctgattatgccttgccatgc

SEQ ID NO: 630150 - DNA, 25 bp, Mus musculus
gggagctgcacaattgtctgtaatc

SEQ ID NO: 630151 - DNA, 25 bp, Mus musculus
gggagctgcacatttgtctgtaatc

SEQ ID NO: 630152 - DNA, 25 bp, Mus musculus
gggagctgccgaacccaaacctggg

SEQ ID NO: 630153 - DNA, 25 bp, Mus musculus
gggagctgccgatcccaaacctggg

SEQ ID NO: 630154 - DNA, 25 bp, Mus musculus
gggagctgctggattactaaagcca

SEQ ID NO: 630155 - DNA, 25 bp, Mus musculus
gggagctgctggtttactaaagcca

SEQ ID NO: 630156 - DNA, 25 bp, Mus musculus
gggagctgcttacgtgtgtttaacc

SEQ ID NO: 630157 - DNA, 25 bp, Mus musculus
gggagctgcttaggtgtgtttaacc

SEQ ID NO: 630158 - DNA, 25 bp, Mus musculus
gggagctgctttaggtgttcagaac

SEQ ID NO: 630159 - DNA, 25 bp, Mus musculus
gggagctgcttttggtgttcagaac

SEQ ID NO: 630160 - DNA, 25 bp, Mus musculus
gggagctggaagacacagttgctta

SEQ ID NO: 630161 - DNA, 25 bp, Mus musculus
gggagctggaagtcacagttgctta

SEQ ID NO: 630162 - DNA, 25 bp, Mus musculus
gggagctggaatcaaatttcctcaa

SEQ ID NO: 630163 - DNA, 25 bp, Mus musculus
gggagctggaatgaaatttcctcaa

SEQ ID NO: 630164 - DNA, 25 bp, Mus musculus
gggagctggagcacatccggcccaa

SEQ ID NO: 630165 - DNA, 25 bp, Mus musculus
gggagctggagcacgtcacacgccg

SEQ ID NO: 630166 - DNA, 25 bp, Mus musculus
gggagctggagctcatccggcccaa

SEQ ID NO: 630167 - DNA, 25 bp, Mus musculus
gggagctggagctcgtcacacgccg

SEQ ID NO: 630168 - DNA, 25 bp, Mus musculus
gggagctggccgcatggtgggtgga

SEQ ID NO: 630169 - DNA, 25 bp, Mus musculus
gggagctggccggatggtgggtgga

SEQ ID NO: 630170 - DNA, 25 bp, Mus musculus
gggagctggtctatcagccaccatt

SEQ ID NO: 630171 - DNA, 25 bp, Mus musculus
gggagctggtctttcagccaccatt

SEQ ID NO: 630172 - DNA, 25 bp, Mus musculus
gggagctgtctaaccaccacgatca

SEQ ID NO: 630173 - DNA, 25 bp, Mus musculus
gggagctgtctatccaccacgatca

SEQ ID NO: 630174 - DNA, 25 bp, Mus musculus
gggagctgtgaactattccattctt

SEQ ID NO: 630175 - DNA, 25 bp, Mus musculus
gggagctgtgaagtattccattctt

SEQ ID NO: 630176 - DNA, 25 bp, Mus musculus
gggagctgtgatatgcaatttatgc

SEQ ID NO: 630177 - DNA, 25 bp, Mus musculus
gggagctgtgatttgcaatttatgc

SEQ ID NO: 630178 - DNA, 25 bp, Mus musculus
gggagctgtgctaagtcaatgtaga

SEQ ID NO: 630179 - DNA, 25 bp, Mus musculus
gggagctgtgctactcactacgcta

SEQ ID NO: 630180 - DNA, 25 bp, Mus musculus
gggagctgtgcttagtcaatgtaga

SEQ ID NO: 630181 - DNA, 25 bp, Mus musculus
gggagctgtgcttctcactacgcta

SEQ ID NO: 630182 - DNA, 25 bp, Mus musculus
gggagctgttttaggcagagcctct

SEQ ID NO: 630183 - DNA, 25 bp, Mus musculus
gggagctgtttttggcagagcctct

SEQ ID NO: 630184 - DNA, 25 bp, Mus musculus
gggagcttacatattcacgtatgat

SEQ ID NO: 630185 - DNA, 25 bp, Mus musculus
gggagcttacattttcacgtatgat

SEQ ID NO: 630186 - DNA, 25 bp, Mus musculus
gggagcttactaccagtttatcaaa

SEQ ID NO: 630187 - DNA, 25 bp, Mus musculus
gggagcttactagcagtttatcaaa

SEQ ID NO: 630188 - DNA, 25 bp, Mus musculus
gggagcttaggcctgttcaccctta

SEQ ID NO: 630189 - DNA, 25 bp, Mus musculus
gggagcttaggcgtgttcaccctta

SEQ ID NO: 630190 - DNA, 25 bp, Mus musculus
gggagcttcacaaatcacagtgcaa

SEQ ID NO: 630191 - DNA, 25 bp, Mus musculus
gggagcttcacatatcacagtgcaa

SEQ ID NO: 630192 - DNA, 25 bp, Mus musculus
gggagcttcaccaaaggaattacat

SEQ ID NO: 630193 - DNA, 25 bp, Mus musculus
gggagcttcacctaaggaattacat

SEQ ID NO: 630194 - DNA, 25 bp, Mus musculus
gggagcttcactcgacttgtccagc

SEQ ID NO: 630195 - DNA, 25 bp, Mus musculus
gggagcttcactggacttgtccagc

SEQ ID NO: 630196 - DNA, 25 bp, Mus musculus
gggagcttcagcactgttggacaaa

SEQ ID NO: 630197 - DNA, 25 bp, Mus musculus
gggagcttcagctctgttggacaaa

SEQ ID NO: 630198 - DNA, 25 bp, Mus musculus
gggagcttcagtacaacttctatca

SEQ ID NO: 630199 - DNA, 25 bp, Mus musculus
gggagcttcagttcaacttctatca

SEQ ID NO: 630200 - DNA, 25 bp, Mus musculus
gggagcttcattccaaatctcatgg

SEQ ID NO: 630201 - DNA, 25 bp, Mus musculus
gggagcttcattccagctttctgca

SEQ ID NO: 630202 - DNA, 25 bp, Mus musculus
gggagcttcattgcaaatctcatgg

SEQ ID NO: 630203 - DNA, 25 bp, Mus musculus
gggagcttcattgcagctttctgca

SEQ ID NO: 630204 - DNA, 25 bp, Mus musculus
gggagcttccatacccagctgaatt

SEQ ID NO: 630205 - DNA, 25 bp, Mus musculus
gggagcttccattcccagctgaatt

SEQ ID NO: 630206 - DNA, 25 bp, Mus musculus
gggagcttccccatttttgacatca

SEQ ID NO: 630207 - DNA, 25 bp, Mus musculus
gggagcttccccttttttgacatca

SEQ ID NO: 630208 - DNA, 25 bp, Mus musculus
gggagcttccggaagtgaccaactc

SEQ ID NO: 630209 - DNA, 25 bp, Mus musculus
gggagcttccggtagtgaccaactc

SEQ ID NO: 630210 - DNA, 25 bp, Mus musculus
gggagcttccttagaggaggattct

SEQ ID NO: 630211 - DNA, 25 bp, Mus musculus
gggagcttcctttgaggaggattct

SEQ ID NO: 630212 - DNA, 25 bp, Mus musculus
gggagcttcggaaacagcactatgt

SEQ ID NO: 630213 - DNA, 25 bp, Mus musculus
gggagcttcggatacagcactatgt

SEQ ID NO: 630214 - DNA, 25 bp, Mus musculus
gggagcttctggagcgtcactatgc

SEQ ID NO: 630215 - DNA, 25 bp, Mus musculus
gggagcttctggtgcgtcactatgc

SEQ ID NO: 630216 - DNA, 25 bp, Mus musculus
gggagcttgaaacattttcctttct

SEQ ID NO: 630217 - DNA, 25 bp, Mus musculus
gggagcttgaaagattttcctttct

SEQ ID NO: 630218 - DNA, 25 bp, Mus musculus
gggagcttgagcattggttcacttt

SEQ ID NO: 630219 - DNA, 25 bp, Mus musculus
gggagcttgagctttggttcacttt

SEQ ID NO: 630220 - DNA, 25 bp, Mus musculus
gggagcttgcgcatcgcatctgtcc

SEQ ID NO: 630221 - DNA, 25 bp, Mus musculus
gggagcttgcgcttcgcatctgtcc

SEQ ID NO: 630222 - DNA, 25 bp, Mus musculus
gggagcttggatcctggccccgaag

SEQ ID NO: 630223 - DNA, 25 bp, Mus musculus
gggagcttggatgctggccccgaag

SEQ ID NO: 630224 - DNA, 25 bp, Mus musculus
gggagcttggctagaatccaagtat

SEQ ID NO: 630225 - DNA, 25 bp, Mus musculus
gggagcttggcttgaatccaagtat

SEQ ID NO: 630226 - DNA, 25 bp, Mus musculus
gggagcttgtagagtttgtgcaaca

SEQ ID NO: 630227 - DNA, 25 bp, Mus musculus
gggagcttgtagtgtttgtgcaaca

SEQ ID NO: 630228 - DNA, 25 bp, Mus musculus
gggagcttgtctcttccatagacct

SEQ ID NO: 630229 - DNA, 25 bp, Mus musculus
gggagcttgtctgttccatagacct

SEQ ID NO: 630230 - DNA, 25 bp, Mus musculus
gggagctttataacccagcacggtt

SEQ ID NO: 630231 - DNA, 25 bp, Mus musculus
gggagctttatatcccagcacggtt

SEQ ID NO: 630232 - DNA, 25 bp, Mus musculus
gggagctttcagagccctggaactc

SEQ ID NO: 630233 - DNA, 25 bp, Mus musculus
gggagctttcagtgccctggaactc

SEQ ID NO: 630234 - DNA, 25 bp, Mus musculus
gggagctttgatcttctgagccaag

SEQ ID NO: 630235 - DNA, 25 bp, Mus musculus
gggagctttgatgttctgagccaag

SEQ ID NO: 630236 - DNA, 25 bp, Mus musculus
gggagcttttgaccttgtactgaac

SEQ ID NO: 630237 - DNA, 25 bp, Mus musculus
gggagcttttgagcttgtactgaac

SEQ ID NO: 630238 - DNA, 25 bp, Mus musculus
gggaggaaagctacttcttatgttt

SEQ ID NO: 630239 - DNA, 25 bp, Mus musculus
gggaggaaagcttcttcttatgttt

SEQ ID NO: 630240 - DNA, 25 bp, Mus musculus
gggaggaaccaacccatctctgttg

SEQ ID NO: 630241 - DNA, 25 bp, Mus musculus
gggaggaaccaagccatctctgttg

SEQ ID NO: 630242 - DNA, 25 bp, Mus musculus
gggaggaatctacttccgctacact

SEQ ID NO: 630243 - DNA, 25 bp, Mus musculus
gggaggaatctagttccgctacact

SEQ ID NO: 630244 - DNA, 25 bp, Mus musculus
gggaggaattcacgcctgttcactt

SEQ ID NO: 630245 - DNA, 25 bp, Mus musculus
gggaggaattcaggcctgttcactt

SEQ ID NO: 630246 - DNA, 25 bp, Mus musculus
gggaggaatttcattccccacgtct

SEQ ID NO: 630247 - DNA, 25 bp, Mus musculus
gggaggaatttctttccccacgtct

SEQ ID NO: 630248 - DNA, 25 bp, Mus musculus
gggaggacaacacaggccacgtccc

SEQ ID NO: 630249 - DNA, 25 bp, Mus musculus
gggaggacaacagaggccacgtccc

SEQ ID NO: 630250 - DNA, 25 bp, Mus musculus
gggaggacacataccatcatcaatt

SEQ ID NO: 630251 - DNA, 25 bp, Mus musculus
gggaggacacattccatcatcaatt

SEQ ID NO: 630252 - DNA, 25 bp, Mus musculus
gggaggacaccaacaggcctggaaa

SEQ ID NO: 630253 - DNA, 25 bp, Mus musculus
gggaggacaccatcaggcctggaaa

SEQ ID NO: 630254 - DNA, 25 bp, Mus musculus
gggaggacaggcactacagctgcct

SEQ ID NO: 630255 - DNA, 25 bp, Mus musculus
gggaggacaggctctacagctgcct

SEQ ID NO: 630256 - DNA, 25 bp, Mus musculus
gggaggacagtgctacttcctgcca

SEQ ID NO: 630257 - DNA, 25 bp, Mus musculus
gggaggacagtggtacttcctgcca

SEQ ID NO: 630258 - DNA, 25 bp, Mus musculus
gggaggacataacccctgtcaggaa

SEQ ID NO: 630259 - DNA, 25 bp, Mus musculus
gggaggacataagccctgtcaggaa

SEQ ID NO: 630260 - DNA, 25 bp, Mus musculus
gggaggacatgccatccaacagtca

SEQ ID NO: 630261 - DNA, 25 bp, Mus musculus
gggaggacatgcgatccaacagtca

SEQ ID NO: 630262 - DNA, 25 bp, Mus musculus
gggaggacattgacacggcccagtc

SEQ ID NO: 630263 - DNA, 25 bp, Mus musculus
gggaggacattgtcacggcccagtc

SEQ ID NO: 630264 - DNA, 25 bp, Mus musculus
gggaggacatttagcagtaactgac

SEQ ID NO: 630265 - DNA, 25 bp, Mus musculus
gggaggacattttgcagtaactgac

SEQ ID NO: 630266 - DNA, 25 bp, Mus musculus
gggaggaccaccatctacaagatct

SEQ ID NO: 630267 - DNA, 25 bp, Mus musculus
gggaggaccaccttctacaagatct

SEQ ID NO: 630268 - DNA, 25 bp, Mus musculus
gggaggaccctcagtctagacctag

SEQ ID NO: 630269 - DNA, 25 bp, Mus musculus
gggaggaccctctgtctagacctag

SEQ ID NO: 630270 - DNA, 25 bp, Mus musculus
gggaggacccttccacacctagaga

SEQ ID NO: 630271 - DNA, 25 bp, Mus musculus
gggaggacccttgcacacctagaga

SEQ ID NO: 630272 - DNA, 25 bp, Mus musculus
gggaggaccgacactgcacaggcat

SEQ ID NO: 630273 - DNA, 25 bp, Mus musculus
gggaggaccgactctgcacaggcat

SEQ ID NO: 630274 - DNA, 25 bp, Mus musculus
gggaggaccgatagccatcggcctt

SEQ ID NO: 630275 - DNA, 25 bp, Mus musculus
gggaggaccgattgccatcggcctt

SEQ ID NO: 630276 - DNA, 25 bp, Mus musculus
gggaggaccgtcatctaccttaaag

SEQ ID NO: 630277 - DNA, 25 bp, Mus musculus
gggaggaccgtcttctaccttaaag

SEQ ID NO: 630278 - DNA, 25 bp, Mus musculus
gggaggacgacaagggtactctcct

SEQ ID NO: 630279 - DNA, 25 bp, Mus musculus
gggaggacgacatgggtactctcct

SEQ ID NO: 630280 - DNA, 25 bp, Mus musculus
gggaggacgaggacctcctgctcac

SEQ ID NO: 630281 - DNA, 25 bp, Mus musculus
gggaggacgaggtcctcctgctcac

SEQ ID NO: 630282 - DNA, 25 bp, Mus musculus
gggaggactacaactctagataaca

SEQ ID NO: 630283 - DNA, 25 bp, Mus musculus
gggaggactacatctctagataaca

SEQ ID NO: 630284 - DNA, 25 bp, Mus musculus
gggaggactcaccatttccaggagt

SEQ ID NO: 630285 - DNA, 25 bp, Mus musculus
gggaggactcacgatttccaggagt

SEQ ID NO: 630286 - DNA, 25 bp, Mus musculus
gggaggactgcaagcttcctgccca

SEQ ID NO: 630287 - DNA, 25 bp, Mus musculus
gggaggactgcatgcttcctgccca

SEQ ID NO: 630288 - DNA, 25 bp, Mus musculus
gggaggactttgcagcccaacttat

SEQ ID NO: 630289 - DNA, 25 bp, Mus musculus
gggaggactttggagcccaacttat

SEQ ID NO: 630290 - DNA, 25 bp, Mus musculus
gggaggacttttctcactcttcagc

SEQ ID NO: 630291 - DNA, 25 bp, Mus musculus
gggaggacttttgtcactcttcagc

SEQ ID NO: 630292 - DNA, 25 bp, Mus musculus
gggaggagaatcctctcagacactg

SEQ ID NO: 630293 - DNA, 25 bp, Mus musculus
gggaggagaatcgtctcagacactg

SEQ ID NO: 630294 - DNA, 25 bp, Mus musculus
gggaggagacccaaccctgtgtgat

SEQ ID NO: 630295 - DNA, 25 bp, Mus musculus
gggaggagaccctaccctgtgtgat

SEQ ID NO: 630296 - DNA, 25 bp, Mus musculus
gggaggagcaggaacccagcttctc

SEQ ID NO: 630297 - DNA, 25 bp, Mus musculus
gggaggagcaggtacccagcttctc

SEQ ID NO: 630298 - DNA, 25 bp, Mus musculus
gggaggagccttactagctaccttc

SEQ ID NO: 630299 - DNA, 25 bp, Mus musculus
gggaggagcctttctagctaccttc

SEQ ID NO: 630300 - DNA, 25 bp, Mus musculus
gggaggagctcgacaccaaaccggt

SEQ ID NO: 630301 - DNA, 25 bp, Mus musculus
gggaggagctcgtcaccaaaccggt

SEQ ID NO: 630302 - DNA, 25 bp, Mus musculus
gggaggagctctctatttagttatc

SEQ ID NO: 630303 - DNA, 25 bp, Mus musculus
gggaggagctctgtatttagttatc

SEQ ID NO: 630304 - DNA, 25 bp, Mus musculus
gggaggagggtaccccatatctctc

SEQ ID NO: 630305 - DNA, 25 bp, Mus musculus
gggaggagggtagcccatatctctc

SEQ ID NO: 630306 - DNA, 25 bp, Mus musculus
gggaggagggttccactgtgaaaga

SEQ ID NO: 630307 - DNA, 25 bp, Mus musculus
gggaggagggttgcactgtgaaaga

SEQ ID NO: 630308 - DNA, 25 bp, Mus musculus
gggaggagttagatgccctcaagtt

SEQ ID NO: 630309 - DNA, 25 bp, Mus musculus
gggaggagttagttgccctcaagtt

SEQ ID NO: 630310 - DNA, 25 bp, Mus musculus
gggaggatagcaattcctctctcca

SEQ ID NO: 630311 - DNA, 25 bp, Mus musculus
gggaggatagcatttcctctctcca

SEQ ID NO: 630312 - DNA, 25 bp, Mus musculus
gggaggatcattagtcaccgtgtat

SEQ ID NO: 630313 - DNA, 25 bp, Mus musculus
gggaggatcatttgtcaccgtgtat

SEQ ID NO: 630314 - DNA, 25 bp, Mus musculus
gggaggatctcactttcgctgatgt

SEQ ID NO: 630315 - DNA, 25 bp, Mus musculus
gggaggatctcagtttcgctgatgt

SEQ ID NO: 630316 - DNA, 25 bp, Mus musculus
gggaggatcttcagggacaacaatg

SEQ ID NO: 630317 - DNA, 25 bp, Mus musculus
gggaggatcttctgggacaacaatg

SEQ ID NO: 630318 - DNA, 25 bp, Mus musculus
gggaggatctttatactatcggaac

SEQ ID NO: 630319 - DNA, 25 bp, Mus musculus
gggaggatctttttactatcggaac

SEQ ID NO: 630320 - DNA, 25 bp, Mus musculus
gggaggatgcccacattctagacct

SEQ ID NO: 630321 - DNA, 25 bp, Mus musculus
gggaggatgccctcattctagacct

SEQ ID NO: 630322 - DNA, 25 bp, Mus musculus
gggaggatgctactcagccctacta

SEQ ID NO: 630323 - DNA, 25 bp, Mus musculus
gggaggatgctagtcagccctacta

SEQ ID NO: 630324 - DNA, 25 bp, Mus musculus
gggaggatgttcaggtcgccacaac

SEQ ID NO: 630325 - DNA, 25 bp, Mus musculus
gggaggatgttctggtcgccacaac

SEQ ID NO: 630326 - DNA, 25 bp, Mus musculus
gggaggattccccagtggaggtggt

SEQ ID NO: 630327 - DNA, 25 bp, Mus musculus
gggaggattcccgagtggaggtggt

SEQ ID NO: 630328 - DNA, 25 bp, Mus musculus
gggaggattccgcattccaaagaag

SEQ ID NO: 630329 - DNA, 25 bp, Mus musculus
gggaggattccggattccaaagaag

SEQ ID NO: 630330 - DNA, 25 bp, Mus musculus
gggaggcaactactcaactcaataa

SEQ ID NO: 630331 - DNA, 25 bp, Mus musculus
gggaggcaactagtcaactcaataa

SEQ ID NO: 630332 - DNA, 25 bp, Mus musculus
gggaggcaagcaaaagactggacca

SEQ ID NO: 630333 - DNA, 25 bp, Mus musculus
gggaggcaagcataagactggacca

SEQ ID NO: 630334 - DNA, 25 bp, Mus musculus
gggaggcaccaaacctattctgaga

SEQ ID NO: 630335 - DNA, 25 bp, Mus musculus
gggaggcaccaatcctattctgaga

SEQ ID NO: 630336 - DNA, 25 bp, Mus musculus
gggaggcactatatttccagctcta

SEQ ID NO: 630337 - DNA, 25 bp, Mus musculus
gggaggcactatttttccagctcta

SEQ ID NO: 630338 - DNA, 25 bp, Mus musculus
gggaggcacttaatcatgtgaaggc

SEQ ID NO: 630339 - DNA, 25 bp, Mus musculus
gggaggcacttattcatgtgaaggc

SEQ ID NO: 630340 - DNA, 25 bp, Mus musculus
gggaggcagaatatatcgaaaaagt

SEQ ID NO: 630341 - DNA, 25 bp, Mus musculus
gggaggcagaatttatcgaaaaagt

SEQ ID NO: 630342 - DNA, 25 bp, Mus musculus
gggaggcagacgaccgcttagtggg

SEQ ID NO: 630343 - DNA, 25 bp, Mus musculus
gggaggcagacgtccgcttagtggg

SEQ ID NO: 630344 - DNA, 25 bp, Mus musculus
gggaggcagcccaaagaactgatat

SEQ ID NO: 630345 - DNA, 25 bp, Mus musculus
gggaggcagccctaagaactgatat

SEQ ID NO: 630346 - DNA, 25 bp, Mus musculus
gggaggcagcctaaccagacagatg

SEQ ID NO: 630347 - DNA, 25 bp, Mus musculus
gggaggcagcctactttttcttggc

SEQ ID NO: 630348 - DNA, 25 bp, Mus musculus
gggaggcagccttaccagacagatg

SEQ ID NO: 630349 - DNA, 25 bp, Mus musculus
gggaggcagccttctttttcttggc

SEQ ID NO: 630350 - DNA, 25 bp, Mus musculus
gggaggcagctcagcgaaccagaca

SEQ ID NO: 630351 - DNA, 25 bp, Mus musculus
gggaggcagctccttctgaaatcca

SEQ ID NO: 630352 - DNA, 25 bp, Mus musculus
gggaggcagctcgttctgaaatcca

SEQ ID NO: 630353 - DNA, 25 bp, Mus musculus
gggaggcagctctgcgaaccagaca

SEQ ID NO: 630354 - DNA, 25 bp, Mus musculus
gggaggcagctgctaacatcacaaa

SEQ ID NO: 630355 - DNA, 25 bp, Mus musculus
gggaggcagctggtaacatcacaaa

SEQ ID NO: 630356 - DNA, 25 bp, Mus musculus
gggaggcaggacataatacacaaac

SEQ ID NO: 630357 - DNA, 25 bp, Mus musculus
gggaggcaggacttaatacacaaac

SEQ ID NO: 630358 - DNA, 25 bp, Mus musculus
gggaggcaggccctggcttggcttc

SEQ ID NO: 630359 - DNA, 25 bp, Mus musculus
gggaggcaggccgtggcttggcttc

SEQ ID NO: 630360 - DNA, 25 bp, Mus musculus
gggaggcatcagcactaaaggtcac

SEQ ID NO: 630361 - DNA, 25 bp, Mus musculus
gggaggcatcaggactaaaggtcac

SEQ ID NO: 630362 - DNA, 25 bp, Mus musculus
gggaggcatctcaatatctatacta

SEQ ID NO: 630363 - DNA, 25 bp, Mus musculus
gggaggcatctctatatctatacta

SEQ ID NO: 630364 - DNA, 25 bp, Mus musculus
gggaggcatggtcaacccattttat

SEQ ID NO: 630365 - DNA, 25 bp, Mus musculus
gggaggcatggtgaacccattttat

SEQ ID NO: 630366 - DNA, 25 bp, Mus musculus
gggaggcatgttctcttctacccaa

SEQ ID NO: 630367 - DNA, 25 bp, Mus musculus
gggaggcatgttgtcttctacccaa

SEQ ID NO: 630368 - DNA, 25 bp, Mus musculus
gggaggcattccatttatgggccag

SEQ ID NO: 630369 - DNA, 25 bp, Mus musculus
gggaggcattccttttatgggccag

SEQ ID NO: 630370 - DNA, 25 bp, Mus musculus
gggaggccaaccagcatgagttgca

SEQ ID NO: 630371 - DNA, 25 bp, Mus musculus
gggaggccaacctgcatgagttgca

SEQ ID NO: 630372 - DNA, 25 bp, Mus musculus
gggaggccacacaccgcaagtacta

SEQ ID NO: 630373 - DNA, 25 bp, Mus musculus
gggaggccacactccgcaagtacta

SEQ ID NO: 630374 - DNA, 25 bp, Mus musculus
gggaggccagtgatctagcatccaa

SEQ ID NO: 630375 - DNA, 25 bp, Mus musculus
gggaggccagtgttctagcatccaa

SEQ ID NO: 630376 - DNA, 25 bp, Mus musculus
gggaggccatagatgcaccttggcc

SEQ ID NO: 630377 - DNA, 25 bp, Mus musculus
gggaggccatagttgcaccttggcc

SEQ ID NO: 630378 - DNA, 25 bp, Mus musculus
gggaggccatggcttactttgccat

SEQ ID NO: 630379 - DNA, 25 bp, Mus musculus
gggaggccatgggttactttgccat

SEQ ID NO: 630380 - DNA, 25 bp, Mus musculus
gggaggcccaaactgtaccttccag

SEQ ID NO: 630381 - DNA, 25 bp, Mus musculus
gggaggcccaaagtgtaccttccag

SEQ ID NO: 630382 - DNA, 25 bp, Mus musculus
gggaggccctagacaacactgtgga

SEQ ID NO: 630383 - DNA, 25 bp, Mus musculus
gggaggccctagtcaacactgtgga

SEQ ID NO: 630384 - DNA, 25 bp, Mus musculus
gggaggcctataccacatgacgaat

SEQ ID NO: 630385 - DNA, 25 bp, Mus musculus
gggaggcctatagcacatgacgaat

SEQ ID NO: 630386 - DNA, 25 bp, Mus musculus
gggaggcctcagaaccttcctggac

SEQ ID NO: 630387 - DNA, 25 bp, Mus musculus
gggaggcctcagtaccttcctggac

SEQ ID NO: 630388 - DNA, 25 bp, Mus musculus
gggaggcctgatcaagtttctgctt

SEQ ID NO: 630389 - DNA, 25 bp, Mus musculus
gggaggcctgatgaagtttctgctt

SEQ ID NO: 630390 - DNA, 25 bp, Mus musculus
gggaggccttctcgaaagttccact

SEQ ID NO: 630391 - DNA, 25 bp, Mus musculus
gggaggccttctggaaagttccact

SEQ ID NO: 630392 - DNA, 25 bp, Mus musculus
gggaggcgcagaaggcggccaagct

SEQ ID NO: 630393 - DNA, 25 bp, Mus musculus
gggaggcgcagatggcggccaagct

SEQ ID NO: 630394 - DNA, 25 bp, Mus musculus
gggaggcgccttatgttgtacttgt

SEQ ID NO: 630395 - DNA, 25 bp, Mus musculus
gggaggcgccttttgttgtacttgt

SEQ ID NO: 630396 - DNA, 25 bp, Mus musculus
gggaggcgcgtcaggataaggtcct

SEQ ID NO: 630397 - DNA, 25 bp, Mus musculus
gggaggcgcgtctggataaggtcct

SEQ ID NO: 630398 - DNA, 25 bp, Mus musculus
gggaggctacacaccagggactttg

SEQ ID NO: 630399 - DNA, 25 bp, Mus musculus
gggaggctacactccagggactttg

SEQ ID NO: 630400 - DNA, 25 bp, Mus musculus
gggaggctattaaatgtactgattt

SEQ ID NO: 630401 - DNA, 25 bp, Mus musculus
gggaggctattatatgtactgattt

SEQ ID NO: 630402 - DNA, 25 bp, Mus musculus
gggaggctattgacctccttccgcg

SEQ ID NO: 630403 - DNA, 25 bp, Mus musculus
gggaggctattgatttctgccttta

SEQ ID NO: 630404 - DNA, 25 bp, Mus musculus
gggaggctattgtcctccttccgcg

SEQ ID NO: 630405 - DNA, 25 bp, Mus musculus
gggaggctattgttttctgccttta

SEQ ID NO: 630406 - DNA, 25 bp, Mus musculus
gggaggctcaccagggagacacctt

SEQ ID NO: 630407 - DNA, 25 bp, Mus musculus
gggaggctcacctgggagacacctt

SEQ ID NO: 630408 - DNA, 25 bp, Mus musculus
gggaggctcagaatgaatagctgta

SEQ ID NO: 630409 - DNA, 25 bp, Mus musculus
gggaggctcagattgaatagctgta

SEQ ID NO: 630410 - DNA, 25 bp, Mus musculus
gggaggctcccaaaggacaagacat

SEQ ID NO: 630411 - DNA, 25 bp, Mus musculus
gggaggctcccataggacaagacat

SEQ ID NO: 630412 - DNA, 25 bp, Mus musculus
gggaggctcgcaaacgacagcatca

SEQ ID NO: 630413 - DNA, 25 bp, Mus musculus
gggaggctcgcatacgacagcatca

SEQ ID NO: 630414 - DNA, 25 bp, Mus musculus
gggaggctctaccactgctctggac

SEQ ID NO: 630415 - DNA, 25 bp, Mus musculus
gggaggctctacgactgctctggac

SEQ ID NO: 630416 - DNA, 25 bp, Mus musculus
gggaggctctagagcagttcttcct

SEQ ID NO: 630417 - DNA, 25 bp, Mus musculus
gggaggctctagtgcagttcttcct

SEQ ID NO: 630418 - DNA, 25 bp, Mus musculus
gggaggctgaacctttcaatcctaa

SEQ ID NO: 630419 - DNA, 25 bp, Mus musculus
gggaggctgaacgtttcaatcctaa

SEQ ID NO: 630420 - DNA, 25 bp, Mus musculus
gggaggctgactcaggaccaccctc

SEQ ID NO: 630421 - DNA, 25 bp, Mus musculus
gggaggctgactgaggaccaccctc

SEQ ID NO: 630422 - DNA, 25 bp, Mus musculus
gggaggctgaggatacccctaccat

SEQ ID NO: 630423 - DNA, 25 bp, Mus musculus
gggaggctgaggttacccctaccat

SEQ ID NO: 630424 - DNA, 25 bp, Mus musculus
gggaggctggagaatcatgattatt

SEQ ID NO: 630425 - DNA, 25 bp, Mus musculus
gggaggctggagtatcatgattatt

SEQ ID NO: 630426 - DNA, 25 bp, Mus musculus
gggaggctggctacaaatggttatt

SEQ ID NO: 630427 - DNA, 25 bp, Mus musculus
gggaggctggcttcaaatggttatt

SEQ ID NO: 630428 - DNA, 25 bp, Mus musculus
gggaggctggttatcaataccttta

SEQ ID NO: 630429 - DNA, 25 bp, Mus musculus
gggaggctggttttcaataccttta

SEQ ID NO: 630430 - DNA, 25 bp, Mus musculus
gggaggctgtccctgtgaaccctat

SEQ ID NO: 630431 - DNA, 25 bp, Mus musculus
gggaggctgtccgtgtgaaccctat

SEQ ID NO: 630432 - DNA, 25 bp, Mus musculus
gggaggcttctcataatgggcactc

SEQ ID NO: 630433 - DNA, 25 bp, Mus musculus
gggaggcttctcttaatgggcactc

SEQ ID NO: 630434 - DNA, 25 bp, Mus musculus
gggaggcttggcacgggaggtcaca

SEQ ID NO: 630435 - DNA, 25 bp, Mus musculus
gggaggcttggctcgggaggtcaca

SEQ ID NO: 630436 - DNA, 25 bp, Mus musculus
gggaggctttacctatagtgatcta

SEQ ID NO: 630437 - DNA, 25 bp, Mus musculus
gggaggctttacgtatagtgatcta

SEQ ID NO: 630438 - DNA, 25 bp, Mus musculus
gggaggctttatatctctgaccagc

SEQ ID NO: 630439 - DNA, 25 bp, Mus musculus
gggaggctttatttctctgaccagc

SEQ ID NO: 630440 - DNA, 25 bp, Mus musculus
gggagggaacccacacctgatattc

SEQ ID NO: 630441 - DNA, 25 bp, Mus musculus
gggagggaaccctcacctgatattc

SEQ ID NO: 630442 - DNA, 25 bp, Mus musculus
gggagggaaccgctctctcctatca

SEQ ID NO: 630443 - DNA, 25 bp, Mus musculus
gggagggaaccggtctctcctatca

SEQ ID NO: 630444 - DNA, 25 bp, Mus musculus
gggagggaagatccttatgccatct

SEQ ID NO: 630445 - DNA, 25 bp, Mus musculus
gggagggaagatgcttatgccatct

SEQ ID NO: 630446 - DNA, 25 bp, Mus musculus
gggagggaatgcatttatgtttaca

SEQ ID NO: 630447 - DNA, 25 bp, Mus musculus
gggagggaatgcttttatgtttaca

SEQ ID NO: 630448 - DNA, 25 bp, Mus musculus
gggagggacaaaccccatctgcaga

SEQ ID NO: 630449 - DNA, 25 bp, Mus musculus
gggagggacaaagcccatctgcaga

SEQ ID NO: 630450 - DNA, 25 bp, Mus musculus
gggagggaccaaacctgtgacttaa

SEQ ID NO: 630451 - DNA, 25 bp, Mus musculus
gggagggaccaatcctgtgacttaa

SEQ ID NO: 630452 - DNA, 25 bp, Mus musculus
gggagggaccgcaatttcagtcagc

SEQ ID NO: 630453 - DNA, 25 bp, Mus musculus
gggagggaccgctatttcagtcagc

SEQ ID NO: 630454 - DNA, 25 bp, Mus musculus
gggagggacctaccatgggagcaaa

SEQ ID NO: 630455 - DNA, 25 bp, Mus musculus
gggagggacctagcatgggagcaaa

SEQ ID NO: 630456 - DNA, 25 bp, Mus musculus
gggagggactctaggattcagaact

SEQ ID NO: 630457 - DNA, 25 bp, Mus musculus
gggagggactcttggattcagaact

SEQ ID NO: 630458 - DNA, 25 bp, Mus musculus
gggagggagctcatccaactggaaa

SEQ ID NO: 630459 - DNA, 25 bp, Mus musculus
gggagggagctcttccaactggaaa

SEQ ID NO: 630460 - DNA, 25 bp, Mus musculus
gggagggcactcctaaactgtgctc

SEQ ID NO: 630461 - DNA, 25 bp, Mus musculus
gggagggcactcgtaaactgtgctc

SEQ ID NO: 630462 - DNA, 25 bp, Mus musculus
gggagggcagatccccgaactcata

SEQ ID NO: 630463 - DNA, 25 bp, Mus musculus
gggagggcagatgcccgaactcata

SEQ ID NO: 630464 - DNA, 25 bp, Mus musculus
gggagggcatgcaaaaactaacatt

SEQ ID NO: 630465 - DNA, 25 bp, Mus musculus
gggagggcatgctaaaactaacatt

SEQ ID NO: 630466 - DNA, 25 bp, Mus musculus
gggagggcatgtatcgaaccctgaa

SEQ ID NO: 630467 - DNA, 25 bp, Mus musculus
gggagggcatgtttcgaaccctgaa

SEQ ID NO: 630468 - DNA, 25 bp, Mus musculus
gggagggccagaatatgctactgca

SEQ ID NO: 630469 - DNA, 25 bp, Mus musculus
gggagggccagattatgctactgca

SEQ ID NO: 630470 - DNA, 25 bp, Mus musculus
gggagggccatcaagagtatttatt

SEQ ID NO: 630471 - DNA, 25 bp, Mus musculus
gggagggccatcagggcctaaactc

SEQ ID NO: 630472 - DNA, 25 bp, Mus musculus
gggagggccatctagagtatttatt

SEQ ID NO: 630473 - DNA, 25 bp, Mus musculus
gggagggccatctgggcctaaactc

SEQ ID NO: 630474 - DNA, 25 bp, Mus musculus
gggagggcctcaccctagagccaat

SEQ ID NO: 630475 - DNA, 25 bp, Mus musculus
gggagggcctcagcctagagccaat

SEQ ID NO: 630476 - DNA, 25 bp, Mus musculus
gggagggctaatccagttaccactt

SEQ ID NO: 630477 - DNA, 25 bp, Mus musculus
gggagggctaatgcagttaccactt

SEQ ID NO: 630478 - DNA, 25 bp, Mus musculus
gggagggtaccaattgtgtcaatac

SEQ ID NO: 630479 - DNA, 25 bp, Mus musculus
gggagggtaccatttgtgtcaatac

SEQ ID NO: 630480 - DNA, 25 bp, Mus musculus
gggagggtactcatatgccagcagc

SEQ ID NO: 630481 - DNA, 25 bp, Mus musculus
gggagggtactcttatgccagcagc

SEQ ID NO: 630482 - DNA, 25 bp, Mus musculus
gggagggtaggccagggctatttct

SEQ ID NO: 630483 - DNA, 25 bp, Mus musculus
gggagggtaggcgagggctatttct

SEQ ID NO: 630484 - DNA, 25 bp, Mus musculus
gggagggtatcacctgtcccatcac

SEQ ID NO: 630485 - DNA, 25 bp, Mus musculus
gggagggtatcagctgtcccatcac

SEQ ID NO: 630486 - DNA, 25 bp, Mus musculus
gggagggtcagcacttcataaggaa

SEQ ID NO: 630487 - DNA, 25 bp, Mus musculus
gggagggtcagctcttcataaggaa

SEQ ID NO: 630488 - DNA, 25 bp, Mus musculus
gggagggtccagagctttcaagctc

SEQ ID NO: 630489 - DNA, 25 bp, Mus musculus
gggagggtccagtgctttcaagctc

SEQ ID NO: 630490 - DNA, 25 bp, Mus musculus
gggagggtcctcactgagcatcaaa

SEQ ID NO: 630491 - DNA, 25 bp, Mus musculus
gggagggtcctctctgagcatcaaa

SEQ ID NO: 630492 - DNA, 25 bp, Mus musculus
gggagggtccttatcacagcatctt

SEQ ID NO: 630493 - DNA, 25 bp, Mus musculus
gggagggtccttttcacagcatctt

SEQ ID NO: 630494 - DNA, 25 bp, Mus musculus
gggagggtgtccagatcattttcga

SEQ ID NO: 630495 - DNA, 25 bp, Mus musculus
gggagggtgtcctgatcattttcga

SEQ ID NO: 630496 - DNA, 25 bp, Mus musculus
gggaggtaatcacgccttctcccgt

SEQ ID NO: 630497 - DNA, 25 bp, Mus musculus
gggaggtaatcaggccttctcccgt

SEQ ID NO: 630498 - DNA, 25 bp, Mus musculus
gggaggtacatactatccattaacc

SEQ ID NO: 630499 - DNA, 25 bp, Mus musculus
gggaggtacatagtatccattaacc

SEQ ID NO: 630500 - DNA, 25 bp, Mus musculus
gggaggtaccctaagtgagtgaaca

SEQ ID NO: 630501 - DNA, 25 bp, Mus musculus
gggaggtacccttagtgagtgaaca

SEQ ID NO: 630502 - DNA, 25 bp, Mus musculus
gggaggtagctcagacattaagtta

SEQ ID NO: 630503 - DNA, 25 bp, Mus musculus
gggaggtagctctgacattaagtta

SEQ ID NO: 630504 - DNA, 25 bp, Mus musculus
gggaggtataccaggtcttctctgc

SEQ ID NO: 630505 - DNA, 25 bp, Mus musculus
gggaggtatacctggtcttctctgc

SEQ ID NO: 630506 - DNA, 25 bp, Mus musculus
gggaggtatcttcgtatctcggtac

SEQ ID NO: 630507 - DNA, 25 bp, Mus musculus
gggaggtatcttggtatctcggtac

SEQ ID NO: 630508 - DNA, 25 bp, Mus musculus
gggaggtatttaccatgagccaaat

SEQ ID NO: 630509 - DNA, 25 bp, Mus musculus
gggaggtatttagcatgagccaaat

SEQ ID NO: 630510 - DNA, 25 bp, Mus musculus
gggaggtcaagtctccacgaagcca

SEQ ID NO: 630511 - DNA, 25 bp, Mus musculus
gggaggtcaagtgtccacgaagcca

SEQ ID NO: 630512 - DNA, 25 bp, Mus musculus
gggaggtcacgccagatcagatcac

SEQ ID NO: 630513 - DNA, 25 bp, Mus musculus
gggaggtcacgcgagatcagatcac

SEQ ID NO: 630514 - DNA, 25 bp, Mus musculus
gggaggtcagatagctgtcagacat

SEQ ID NO: 630515 - DNA, 25 bp, Mus musculus
gggaggtcagattgctgtcagacat

SEQ ID NO: 630516 - DNA, 25 bp, Mus musculus
gggaggtccagtagcctgctattat

SEQ ID NO: 630517 - DNA, 25 bp, Mus musculus
gggaggtccagtatcgaggactcaa

SEQ ID NO: 630518 - DNA, 25 bp, Mus musculus
gggaggtccagttgcctgctattat

SEQ ID NO: 630519 - DNA, 25 bp, Mus musculus
gggaggtccagtttcgaggactcaa

SEQ ID NO: 630520 - DNA, 25 bp, Mus musculus
gggaggtcccaacgcccaacactat

SEQ ID NO: 630521 - DNA, 25 bp, Mus musculus
gggaggtcccaaggcccaacactat

SEQ ID NO: 630522 - DNA, 25 bp, Mus musculus
gggaggtccttaattatgtgagcgt

SEQ ID NO: 630523 - DNA, 25 bp, Mus musculus
gggaggtccttatttatgtgagcgt

SEQ ID NO: 630524 - DNA, 25 bp, Mus musculus
gggaggtcgcaacctcctgcccaag

SEQ ID NO: 630525 - DNA, 25 bp, Mus musculus
gggaggtcgcaagctcctgcccaag

SEQ ID NO: 630526 - DNA, 25 bp, Mus musculus
gggaggtcgccacaaaaccgcccat

SEQ ID NO: 630527 - DNA, 25 bp, Mus musculus
gggaggtcgccagaaaaccgcccat

SEQ ID NO: 630528 - DNA, 25 bp, Mus musculus
gggaggtctaaaccctgaagccaca

SEQ ID NO: 630529 - DNA, 25 bp, Mus musculus
gggaggtctaaagcctgaagccaca

SEQ ID NO: 630530 - DNA, 25 bp, Mus musculus
gggaggtctacaatctgtttacgcc

SEQ ID NO: 630531 - DNA, 25 bp, Mus musculus
gggaggtctacattctgtttacgcc

SEQ ID NO: 630532 - DNA, 25 bp, Mus musculus
gggaggtctcaaattctaagccaat

SEQ ID NO: 630533 - DNA, 25 bp, Mus musculus
gggaggtctcaatttctaagccaat

SEQ ID NO: 630534 - DNA, 25 bp, Mus musculus
gggaggtcttatccaacctgtaggt

SEQ ID NO: 630535 - DNA, 25 bp, Mus musculus
gggaggtcttatgcaacctgtaggt

SEQ ID NO: 630536 - DNA, 25 bp, Mus musculus
gggaggtctttgactccagcctccc

SEQ ID NO: 630537 - DNA, 25 bp, Mus musculus
gggaggtctttgtctccagcctccc

SEQ ID NO: 630538 - DNA, 25 bp, Mus musculus
gggaggtgacacattcctgaaagaa

SEQ ID NO: 630539 - DNA, 25 bp, Mus musculus
gggaggtgacactttcctgaaagaa

SEQ ID NO: 630540 - DNA, 25 bp, Mus musculus
gggaggtgatttaccagaacctaat

SEQ ID NO: 630541 - DNA, 25 bp, Mus musculus
gggaggtgattttccagaacctaat

SEQ ID NO: 630542 - DNA, 25 bp, Mus musculus
gggaggtgctctctcatgagttcaa

SEQ ID NO: 630543 - DNA, 25 bp, Mus musculus
gggaggtgctctgtcatgagttcaa

SEQ ID NO: 630544 - DNA, 25 bp, Mus musculus
gggaggtgctttaacagaccgctaa

SEQ ID NO: 630545 - DNA, 25 bp, Mus musculus
gggaggtgcttttacagaccgctaa

SEQ ID NO: 630546 - DNA, 25 bp, Mus musculus
gggaggtggccccaagttctaccat

SEQ ID NO: 630547 - DNA, 25 bp, Mus musculus
gggaggtggcccgaagttctaccat

SEQ ID NO: 630548 - DNA, 25 bp, Mus musculus
gggaggtggtcccaaagctgaaagc

SEQ ID NO: 630549 - DNA, 25 bp, Mus musculus
gggaggtggtccgaaagctgaaagc

SEQ ID NO: 630550 - DNA, 25 bp, Mus musculus
gggaggtgtcatacagttcaatagc

SEQ ID NO: 630551 - DNA, 25 bp, Mus musculus
gggaggtgtcattcagttcaatagc

SEQ ID NO: 630552 - DNA, 25 bp, Mus musculus
gggaggtgtccaatgcccttccttc

SEQ ID NO: 630553 - DNA, 25 bp, Mus musculus
gggaggtgtccacctacatagccac

SEQ ID NO: 630554 - DNA, 25 bp, Mus musculus
gggaggtgtccagctacatagccac

SEQ ID NO: 630555 - DNA, 25 bp, Mus musculus
gggaggtgtccattgcccttccttc

SEQ ID NO: 630556 - DNA, 25 bp, Mus musculus
gggaggtgtgctacagcagtatcct

SEQ ID NO: 630557 - DNA, 25 bp, Mus musculus
gggaggtgtgcttcagcagtatcct

SEQ ID NO: 630558 - DNA, 25 bp, Mus musculus
gggaggtgtgtaagcaccagcccct

SEQ ID NO: 630559 - DNA, 25 bp, Mus musculus
gggaggtgtgtatgcaccagcccct

SEQ ID NO: 630560 - DNA, 25 bp, Mus musculus
gggaggttatccacatcttctctca

SEQ ID NO: 630561 - DNA, 25 bp, Mus musculus
gggaggttatcctcatcttctctca

SEQ ID NO: 630562 - DNA, 25 bp, Mus musculus
gggaggttccagcactctgcccttg

SEQ ID NO: 630563 - DNA, 25 bp, Mus musculus
gggaggttccaggactctgcccttg

SEQ ID NO: 630564 - DNA, 25 bp, Mus musculus
gggaggttttccagcgaggtctata

SEQ ID NO: 630565 - DNA, 25 bp, Mus musculus
gggaggttttcctgcgaggtctata

SEQ ID NO: 630566 - DNA, 25 bp, Mus musculus
gggaggtttttgacttggaccagca

SEQ ID NO: 630567 - DNA, 25 bp, Mus musculus
gggaggtttttgtcttggaccagca

SEQ ID NO: 630568 - DNA, 25 bp, Mus musculus
gggagtaagactctgcaggaaggct

SEQ ID NO: 630569 - DNA, 25 bp, Mus musculus
gggagtaagactgtgcaggaaggct

SEQ ID NO: 630570 - DNA, 25 bp, Mus musculus
gggagtaaggctattttcatgggcg

SEQ ID NO: 630571 - DNA, 25 bp, Mus musculus
gggagtaaggcttttttcatgggcg

SEQ ID NO: 630572 - DNA, 25 bp, Mus musculus
gggagtaatataagctatcatgttt

SEQ ID NO: 630573 - DNA, 25 bp, Mus musculus
gggagtaatatatgctatcatgttt

SEQ ID NO: 630574 - DNA, 25 bp, Mus musculus
gggagtacaaagacaaccggagcta

SEQ ID NO: 630575 - DNA, 25 bp, Mus musculus
gggagtacaaagtcaaccggagcta

SEQ ID NO: 630576 - DNA, 25 bp, Mus musculus
gggagtacactgaaagaacctgcct

SEQ ID NO: 630577 - DNA, 25 bp, Mus musculus
gggagtacactgtaagaacctgcct

SEQ ID NO: 630578 - DNA, 25 bp, Mus musculus
gggagtacatgacttcctctagccc

SEQ ID NO: 630579 - DNA, 25 bp, Mus musculus
gggagtacatgagttcctctagccc

SEQ ID NO: 630580 - DNA, 25 bp, Mus musculus
gggagtacatgcaaggcatcccctg

SEQ ID NO: 630581 - DNA, 25 bp, Mus musculus
gggagtacatgctaggcatcccctg

SEQ ID NO: 630582 - DNA, 25 bp, Mus musculus
gggagtaccacccaacaagagtatc

SEQ ID NO: 630583 - DNA, 25 bp, Mus musculus
gggagtaccaccgaacaagagtatc

SEQ ID NO: 630584 - DNA, 25 bp, Mus musculus
gggagtacccgaatgcaaaagctta

SEQ ID NO: 630585 - DNA, 25 bp, Mus musculus
gggagtacccgattgcaaaagctta

SEQ ID NO: 630586 - DNA, 25 bp, Mus musculus
gggagtacctgacctatgcctcgtc

SEQ ID NO: 630587 - DNA, 25 bp, Mus musculus
gggagtacctgagctatgcctcgtc

SEQ ID NO: 630588 - DNA, 25 bp, Mus musculus
gggagtactaagctgttcacattca

SEQ ID NO: 630589 - DNA, 25 bp, Mus musculus
gggagtactaaggtgttcacattca

SEQ ID NO: 630590 - DNA, 25 bp, Mus musculus
gggagtactgataacttatgcctgt

SEQ ID NO: 630591 - DNA, 25 bp, Mus musculus
gggagtactgattacttatgcctgt

SEQ ID NO: 630592 - DNA, 25 bp, Mus musculus
gggagtactgtcactttgaccttgg

SEQ ID NO: 630593 - DNA, 25 bp, Mus musculus
gggagtactgtctctttgaccttgg

SEQ ID NO: 630594 - DNA, 25 bp, Mus musculus
gggagtactttcaagattgtccaat

SEQ ID NO: 630595 - DNA, 25 bp, Mus musculus
gggagtactttctagattgtccaat

SEQ ID NO: 630596 - DNA, 25 bp, Mus musculus
gggagtagcatcagtgtggttcact

SEQ ID NO: 630597 - DNA, 25 bp, Mus musculus
gggagtagcatctgtgtggttcact

SEQ ID NO: 630598 - DNA, 25 bp, Mus musculus
gggagtagcctcctggaagctttct

SEQ ID NO: 630599 - DNA, 25 bp, Mus musculus
gggagtagcctcgtggaagctttct

SEQ ID NO: 630600 - DNA, 25 bp, Mus musculus
gggagtagctgcattttgcttctgt

SEQ ID NO: 630601 - DNA, 25 bp, Mus musculus
gggagtagctgctttttgcttctgt

SEQ ID NO: 630602 - DNA, 25 bp, Mus musculus
gggagtagctgtcgtcttcactgcc

SEQ ID NO: 630603 - DNA, 25 bp, Mus musculus
gggagtagctgtggtcttcactgcc

SEQ ID NO: 630604 - DNA, 25 bp, Mus musculus
gggagtagtttgaatctgcatttct

SEQ ID NO: 630605 - DNA, 25 bp, Mus musculus
gggagtagtttgtatctgcatttct

SEQ ID NO: 630606 - DNA, 25 bp, Mus musculus
gggagtataacaccgtccattcacc

SEQ ID NO: 630607 - DNA, 25 bp, Mus musculus
gggagtataacagcgtccattcacc

SEQ ID NO: 630608 - DNA, 25 bp, Mus musculus
gggagtatacagatctgatgtcttt

SEQ ID NO: 630609 - DNA, 25 bp, Mus musculus
gggagtatacagttctgatgtcttt

SEQ ID NO: 630610 - DNA, 25 bp, Mus musculus
gggagtatcaacatcctgggaaata

SEQ ID NO: 630611 - DNA, 25 bp, Mus musculus
gggagtatcaacttcctgggaaata

SEQ ID NO: 630612 - DNA, 25 bp, Mus musculus
gggagtatccttcgtccatcagcat

SEQ ID NO: 630613 - DNA, 25 bp, Mus musculus
gggagtatccttggtccatcagcat

SEQ ID NO: 630614 - DNA, 25 bp, Mus musculus
gggagtatgtacatgctcttgccaa

SEQ ID NO: 630615 - DNA, 25 bp, Mus musculus
gggagtatgtacttgctcttgccaa

SEQ ID NO: 630616 - DNA, 25 bp, Mus musculus
gggagtattaagcttcatttccaca

SEQ ID NO: 630617 - DNA, 25 bp, Mus musculus
gggagtattaaggttcatttccaca

SEQ ID NO: 630618 - DNA, 25 bp, Mus musculus
gggagtattacaagcatccgatatc

SEQ ID NO: 630619 - DNA, 25 bp, Mus musculus
gggagtattacatgcatccgatatc

SEQ ID NO: 630620 - DNA, 25 bp, Mus musculus
gggagtattcacaccacgaatgtaa

SEQ ID NO: 630621 - DNA, 25 bp, Mus musculus
gggagtattcactccacgaatgtaa

SEQ ID NO: 630622 - DNA, 25 bp, Mus musculus
gggagtattcatcattaaatgctgc

SEQ ID NO: 630623 - DNA, 25 bp, Mus musculus
gggagtattcatgattaaatgctgc

SEQ ID NO: 630624 - DNA, 25 bp, Mus musculus
gggagtattggtagccctacagtct

SEQ ID NO: 630625 - DNA, 25 bp, Mus musculus
gggagtattggttgccctacagtct

SEQ ID NO: 630626 - DNA, 25 bp, Mus musculus
gggagtatttagactctttaatgat

SEQ ID NO: 630627 - DNA, 25 bp, Mus musculus
gggagtatttagtctctttaatgat

SEQ ID NO: 630628 - DNA, 25 bp, Mus musculus
gggagtattttaagccacctagaag

SEQ ID NO: 630629 - DNA, 25 bp, Mus musculus
gggagtattttatgccacctagaag

SEQ ID NO: 630630 - DNA, 25 bp, Mus musculus
gggagtcaaattcctcatattgagc

SEQ ID NO: 630631 - DNA, 25 bp, Mus musculus
gggagtcaaattgctcatattgagc

SEQ ID NO: 630632 - DNA, 25 bp, Mus musculus
gggagtcaagcccaagttgttcagt

SEQ ID NO: 630633 - DNA, 25 bp, Mus musculus
gggagtcaagccgaagttgttcagt

SEQ ID NO: 630634 - DNA, 25 bp, Mus musculus
gggagtcacaagagtggctgaattt

SEQ ID NO: 630635 - DNA, 25 bp, Mus musculus
gggagtcacaagtgtggctgaattt

SEQ ID NO: 630636 - DNA, 25 bp, Mus musculus
gggagtcacacacactgttgatgtt

SEQ ID NO: 630637 - DNA, 25 bp, Mus musculus
gggagtcacacagactgttgatgtt

SEQ ID NO: 630638 - DNA, 25 bp, Mus musculus
gggagtcacagcaacttaagctgct

SEQ ID NO: 630639 - DNA, 25 bp, Mus musculus
gggagtcacagctacttaagctgct

SEQ ID NO: 630640 - DNA, 25 bp, Mus musculus
gggagtcacagtatagctcttaagt

SEQ ID NO: 630641 - DNA, 25 bp, Mus musculus
gggagtcacagtttagctcttaagt

SEQ ID NO: 630642 - DNA, 25 bp, Mus musculus
gggagtcacatgacacacagagcca

SEQ ID NO: 630643 - DNA, 25 bp, Mus musculus
gggagtcacatgtcacacagagcca

SEQ ID NO: 630644 - DNA, 25 bp, Mus musculus
gggagtcactccatcatatgtgcaa

SEQ ID NO: 630645 - DNA, 25 bp, Mus musculus
gggagtcactccttcatatgtgcaa

SEQ ID NO: 630646 - DNA, 25 bp, Mus musculus
gggagtcactcgaagttatacaaag

SEQ ID NO: 630647 - DNA, 25 bp, Mus musculus
gggagtcactcgtagttatacaaag

SEQ ID NO: 630648 - DNA, 25 bp, Mus musculus
gggagtcacttgaatctgatctgag

SEQ ID NO: 630649 - DNA, 25 bp, Mus musculus
gggagtcacttgtatctgatctgag

SEQ ID NO: 630650 - DNA, 25 bp, Mus musculus
gggagtcagacaacagtctcactga

SEQ ID NO: 630651 - DNA, 25 bp, Mus musculus
gggagtcagacatcagtctcactga

SEQ ID NO: 630652 - DNA, 25 bp, Mus musculus
gggagtcagattactcttacgtaga

SEQ ID NO: 630653 - DNA, 25 bp, Mus musculus
gggagtcagatttctcttacgtaga

SEQ ID NO: 630654 - DNA, 25 bp, Mus musculus
gggagtcaggacaagatggcatttc

SEQ ID NO: 630655 - DNA, 25 bp, Mus musculus
gggagtcaggactagatggcatttc

SEQ ID NO: 630656 - DNA, 25 bp, Mus musculus
gggagtcaggttacccattgtactg

SEQ ID NO: 630657 - DNA, 25 bp, Mus musculus
gggagtcaggtttcccattgtactg

SEQ ID NO: 630658 - DNA, 25 bp, Mus musculus
gggagtcagtaccagaacctcgtat

SEQ ID NO: 630659 - DNA, 25 bp, Mus musculus
gggagtcagtacgagaacctcgtat

SEQ ID NO: 630660 - DNA, 25 bp, Mus musculus
gggagtcagtcactacaacagcaac

SEQ ID NO: 630661 - DNA, 25 bp, Mus musculus
gggagtcagtcagtacaacagcaac

SEQ ID NO: 630662 - DNA, 25 bp, Mus musculus
gggagtcagtgtcagccctcactca

SEQ ID NO: 630663 - DNA, 25 bp, Mus musculus
gggagtcagtgtgagccctcactca

SEQ ID NO: 630664 - DNA, 25 bp, Mus musculus
gggagtcataccagtggctcagaga

SEQ ID NO: 630665 - DNA, 25 bp, Mus musculus
gggagtcatacctgtggctcagaga

SEQ ID NO: 630666 - DNA, 25 bp, Mus musculus
gggagtcatattcatccctgatcct

SEQ ID NO: 630667 - DNA, 25 bp, Mus musculus
gggagtcatattgatccctgatcct

SEQ ID NO: 630668 - DNA, 25 bp, Mus musculus
gggagtcatcatatctaagtcagcg

SEQ ID NO: 630669 - DNA, 25 bp, Mus musculus
gggagtcatcatttctaagtcagcg

SEQ ID NO: 630670 - DNA, 25 bp, Mus musculus
gggagtcatcccaaaaacatggttt

SEQ ID NO: 630671 - DNA, 25 bp, Mus musculus
gggagtcatccctaaaacatggttt

SEQ ID NO: 630672 - DNA, 25 bp, Mus musculus
gggagtcattaaccttactgtcact

SEQ ID NO: 630673 - DNA, 25 bp, Mus musculus
gggagtcattaagcttactgtcact

SEQ ID NO: 630674 - DNA, 25 bp, Mus musculus
gggagtcattgcatcactagctaca

SEQ ID NO: 630675 - DNA, 25 bp, Mus musculus
gggagtcattgcttcactagctaca

SEQ ID NO: 630676 - DNA, 25 bp, Mus musculus
gggagtcattgtcaatgtccttcaa

SEQ ID NO: 630677 - DNA, 25 bp, Mus musculus
gggagtcattgtgaatgtccttcaa

SEQ ID NO: 630678 - DNA, 25 bp, Mus musculus
gggagtccaaaaaccagggtgcaga

SEQ ID NO: 630679 - DNA, 25 bp, Mus musculus
gggagtccaaaaacctcttactctt

SEQ ID NO: 630680 - DNA, 25 bp, Mus musculus
gggagtccaaaatccagggtgcaga

SEQ ID NO: 630681 - DNA, 25 bp, Mus musculus
gggagtccaaaatcctcttactctt

SEQ ID NO: 630682 - DNA, 25 bp, Mus musculus
gggagtccacaactgctgcatatat

SEQ ID NO: 630683 - DNA, 25 bp, Mus musculus
gggagtccacaagtgctgcatatat

SEQ ID NO: 630684 - DNA, 25 bp, Mus musculus
gggagtccagggataaatcttgcaa

SEQ ID NO: 630685 - DNA, 25 bp, Mus musculus
gggagtccagggttaaatcttgcaa

SEQ ID NO: 630686 - DNA, 25 bp, Mus musculus
gggagtccatatcagcctgaagcta

SEQ ID NO: 630687 - DNA, 25 bp, Mus musculus
gggagtccatatgagcctgaagcta

SEQ ID NO: 630688 - DNA, 25 bp, Mus musculus
gggagtccatttatactcaagagca

SEQ ID NO: 630689 - DNA, 25 bp, Mus musculus
gggagtccatttttactcaagagca

SEQ ID NO: 630690 - DNA, 25 bp, Mus musculus
gggagtcccaagacacttggttgaa

SEQ ID NO: 630691 - DNA, 25 bp, Mus musculus
gggagtcccaagtcacttggttgaa

SEQ ID NO: 630692 - DNA, 25 bp, Mus musculus
gggagtccctgaactatcagcatag

SEQ ID NO: 630693 - DNA, 25 bp, Mus musculus
gggagtccctgatctatcagcatag

SEQ ID NO: 630694 - DNA, 25 bp, Mus musculus
gggagtccctgcaacagaggcaaca

SEQ ID NO: 630695 - DNA, 25 bp, Mus musculus
gggagtccctgctacagaggcaaca

SEQ ID NO: 630696 - DNA, 25 bp, Mus musculus
gggagtccgagcaacatctaaatta

SEQ ID NO: 630697 - DNA, 25 bp, Mus musculus
gggagtccgagctacatctaaatta

SEQ ID NO: 630698 - DNA, 25 bp, Mus musculus
gggagtcctgaacctacaagatgca

SEQ ID NO: 630699 - DNA, 25 bp, Mus musculus
gggagtcctgaagctacaagatgca

SEQ ID NO: 630700 - DNA, 25 bp, Mus musculus
gggagtcctggcagtgcacagatac

SEQ ID NO: 630701 - DNA, 25 bp, Mus musculus
gggagtcctggctgtgcacagatac

SEQ ID NO: 630702 - DNA, 25 bp, Mus musculus
gggagtccttccaaggaagctctgc

SEQ ID NO: 630703 - DNA, 25 bp, Mus musculus
gggagtccttcctaggaagctctgc

SEQ ID NO: 630704 - DNA, 25 bp, Mus musculus
gggagtcctttactagacatgatca

SEQ ID NO: 630705 - DNA, 25 bp, Mus musculus
gggagtcctttagtagacatgatca

SEQ ID NO: 630706 - DNA, 25 bp, Mus musculus
gggagtcctttgacacatttttcat

SEQ ID NO: 630707 - DNA, 25 bp, Mus musculus
gggagtcctttgacgagaccaacac

SEQ ID NO: 630708 - DNA, 25 bp, Mus musculus
gggagtcctttgcttgcaggtcttc

SEQ ID NO: 630709 - DNA, 25 bp, Mus musculus
gggagtcctttggttgcaggtcttc

SEQ ID NO: 630710 - DNA, 25 bp, Mus musculus
gggagtcctttgtcacatttttcat

SEQ ID NO: 630711 - DNA, 25 bp, Mus musculus
gggagtcctttgtcgagaccaacac

SEQ ID NO: 630712 - DNA, 25 bp, Mus musculus
gggagtcgaatgacgctttcacagg

SEQ ID NO: 630713 - DNA, 25 bp, Mus musculus
gggagtcgaatgtcgctttcacagg

SEQ ID NO: 630714 - DNA, 25 bp, Mus musculus
gggagtcgcaaaagccctctctggt

SEQ ID NO: 630715 - DNA, 25 bp, Mus musculus
gggagtcgcaaatgccctctctggt

SEQ ID NO: 630716 - DNA, 25 bp, Mus musculus
gggagtcgttgcaggaatttctttt

SEQ ID NO: 630717 - DNA, 25 bp, Mus musculus
gggagtcgttgctggaatttctttt

SEQ ID NO: 630718 - DNA, 25 bp, Mus musculus
gggagtctatgaagcagttgccttt

SEQ ID NO: 630719 - DNA, 25 bp, Mus musculus
gggagtctatgatgcagttgccttt

SEQ ID NO: 630720 - DNA, 25 bp, Mus musculus
gggagtctcacccagagactgcaga

SEQ ID NO: 630721 - DNA, 25 bp, Mus musculus
gggagtctcaccgagagactgcaga

SEQ ID NO: 630722 - DNA, 25 bp, Mus musculus
gggagtctcagcaagggaactgttt

SEQ ID NO: 630723 - DNA, 25 bp, Mus musculus
gggagtctcagctagggaactgttt

SEQ ID NO: 630724 - DNA, 25 bp, Mus musculus
gggagtctccagagtggccctcaga

SEQ ID NO: 630725 - DNA, 25 bp, Mus musculus
gggagtctccagtgtggccctcaga

SEQ ID NO: 630726 - DNA, 25 bp, Mus musculus
gggagtctcgccactaccgaaaacg

SEQ ID NO: 630727 - DNA, 25 bp, Mus musculus
gggagtctcgcctctaccgaaaacg

SEQ ID NO: 630728 - DNA, 25 bp, Mus musculus
gggagtctctgcattggccagtaac

SEQ ID NO: 630729 - DNA, 25 bp, Mus musculus
gggagtctctgctttggccagtaac

SEQ ID NO: 630730 - DNA, 25 bp, Mus musculus
gggagtctgaacagccattgggaac

SEQ ID NO: 630731 - DNA, 25 bp, Mus musculus
gggagtctgaactgccattgggaac

SEQ ID NO: 630732 - DNA, 25 bp, Mus musculus
gggagtctgactacaattcaggcaa

SEQ ID NO: 630733 - DNA, 25 bp, Mus musculus
gggagtctgacttcaattcaggcaa

SEQ ID NO: 630734 - DNA, 25 bp, Mus musculus
gggagtctgcaaccatgcttttcat

SEQ ID NO: 630735 - DNA, 25 bp, Mus musculus
gggagtctgcaagcatgcttttcat

SEQ ID NO: 630736 - DNA, 25 bp, Mus musculus
gggagtctgcacagactgcagtgca

SEQ ID NO: 630737 - DNA, 25 bp, Mus musculus
gggagtctgcactgactgcagtgca

SEQ ID NO: 630738 - DNA, 25 bp, Mus musculus
gggagtctgccgatgagtgcttcat

SEQ ID NO: 630739 - DNA, 25 bp, Mus musculus
gggagtctgccgttgagtgcttcat

SEQ ID NO: 630740 - DNA, 25 bp, Mus musculus
gggagtctgcgaacgactggacacc

SEQ ID NO: 630741 - DNA, 25 bp, Mus musculus
gggagtctgcgatcgactggacacc

SEQ ID NO: 630742 - DNA, 25 bp, Mus musculus
gggagtctgtagatcctggactgct

SEQ ID NO: 630743 - DNA, 25 bp, Mus musculus
gggagtctgtagttcctggactgct

SEQ ID NO: 630744 - DNA, 25 bp, Mus musculus
gggagtctgtgtacattctgtactt

SEQ ID NO: 630745 - DNA, 25 bp, Mus musculus
gggagtctgtgttcattctgtactt

SEQ ID NO: 630746 - DNA, 25 bp, Mus musculus
gggagtcttacaacccaacaagaag

SEQ ID NO: 630747 - DNA, 25 bp, Mus musculus
gggagtcttacatcccaacaagaag

SEQ ID NO: 630748 - DNA, 25 bp, Mus musculus
gggagtcttcacaactcagattggg

SEQ ID NO: 630749 - DNA, 25 bp, Mus musculus
gggagtcttcactactcagattggg

SEQ ID NO: 630750 - DNA, 25 bp, Mus musculus
gggagtcttctcctagtttaactga

SEQ ID NO: 630751 - DNA, 25 bp, Mus musculus
gggagtcttctcgtagtttaactga

SEQ ID NO: 630752 - DNA, 25 bp, Mus musculus
gggagtcttggtatgatcatcagca

SEQ ID NO: 630753 - DNA, 25 bp, Mus musculus
gggagtcttggtttgatcatcagca

SEQ ID NO: 630754 - DNA, 25 bp, Mus musculus
gggagtgaaaccacggcctcattgg

SEQ ID NO: 630755 - DNA, 25 bp, Mus musculus
gggagtgaaacctcggcctcattgg

SEQ ID NO: 630756 - DNA, 25 bp, Mus musculus
gggagtgaacttaccgtctcggaag

SEQ ID NO: 630757 - DNA, 25 bp, Mus musculus
gggagtgaactttccgtctcggaag

SEQ ID NO: 630758 - DNA, 25 bp, Mus musculus
gggagtgacatacaaccatgggcat

SEQ ID NO: 630759 - DNA, 25 bp, Mus musculus
gggagtgacatagaaccatgggcat

SEQ ID NO: 630760 - DNA, 25 bp, Mus musculus
gggagtgacccacatcagagtcgta

SEQ ID NO: 630761 - DNA, 25 bp, Mus musculus
gggagtgacccagatcagagtcgta

SEQ ID NO: 630762 - DNA, 25 bp, Mus musculus
gggagtgagtctactttctggtcat

SEQ ID NO: 630763 - DNA, 25 bp, Mus musculus
gggagtgagtcttctttctggtcat

SEQ ID NO: 630764 - DNA, 25 bp, Mus musculus
gggagtgatcatcttgataatgctc

SEQ ID NO: 630765 - DNA, 25 bp, Mus musculus
gggagtgatcatgttgataatgctc

SEQ ID NO: 630766 - DNA, 25 bp, Mus musculus
gggagtgattccaacaacttcacta

SEQ ID NO: 630767 - DNA, 25 bp, Mus musculus
gggagtgattcctacaacttcacta

SEQ ID NO: 630768 - DNA, 25 bp, Mus musculus
gggagtgcaacaacaagctactgaa

SEQ ID NO: 630769 - DNA, 25 bp, Mus musculus
gggagtgcaacatcaagctactgaa

SEQ ID NO: 630770 - DNA, 25 bp, Mus musculus
gggagtgcagagacagctcagcatt

SEQ ID NO: 630771 - DNA, 25 bp, Mus musculus
gggagtgcagagtcagctcagcatt

SEQ ID NO: 630772 - DNA, 25 bp, Mus musculus
gggagtgccaaaagttcccaggaat

SEQ ID NO: 630773 - DNA, 25 bp, Mus musculus
gggagtgccaaatgttcccaggaat

SEQ ID NO: 630774 - DNA, 25 bp, Mus musculus
gggagtgcccaacccacatagcagg

SEQ ID NO: 630775 - DNA, 25 bp, Mus musculus
gggagtgcccaagccacatagcagg

SEQ ID NO: 630776 - DNA, 25 bp, Mus musculus
gggagtgcccatcttcgctgaccag

SEQ ID NO: 630777 - DNA, 25 bp, Mus musculus
gggagtgcccatgttcgctgaccag

SEQ ID NO: 630778 - DNA, 25 bp, Mus musculus
gggagtggagccatcattctgatta

SEQ ID NO: 630779 - DNA, 25 bp, Mus musculus
gggagtggagccttcattctgatta

SEQ ID NO: 630780 - DNA, 25 bp, Mus musculus
gggagtggagctaaatactttttct

SEQ ID NO: 630781 - DNA, 25 bp, Mus musculus
gggagtggagcttaatactttttct

SEQ ID NO: 630782 - DNA, 25 bp, Mus musculus
gggagtggcaagatcacaggccaga

SEQ ID NO: 630783 - DNA, 25 bp, Mus musculus
gggagtggcaagttcacaggccaga

SEQ ID NO: 630784 - DNA, 25 bp, Mus musculus
gggagtggccatatcatacagcaaa

SEQ ID NO: 630785 - DNA, 25 bp, Mus musculus
gggagtggccatttcatacagcaaa

SEQ ID NO: 630786 - DNA, 25 bp, Mus musculus
gggagtggcctgcaccatgtattcc

SEQ ID NO: 630787 - DNA, 25 bp, Mus musculus
gggagtggcctggaccatgtattcc

SEQ ID NO: 630788 - DNA, 25 bp, Mus musculus
gggagtgggacacttcctatcctac

SEQ ID NO: 630789 - DNA, 25 bp, Mus musculus
gggagtgggacagttcctatcctac

SEQ ID NO: 630790 - DNA, 25 bp, Mus musculus
gggagtgggtagagcccacccttca

SEQ ID NO: 630791 - DNA, 25 bp, Mus musculus
gggagtgggtagtgcccacccttca

SEQ ID NO: 630792 - DNA, 25 bp, Mus musculus
gggagtggtctcatcgcatgcacct

SEQ ID NO: 630793 - DNA, 25 bp, Mus musculus
gggagtggtctcttcgcatgcacct

SEQ ID NO: 630794 - DNA, 25 bp, Mus musculus
gggagtggttagcaagtttcttcaa

SEQ ID NO: 630795 - DNA, 25 bp, Mus musculus
gggagtggttaggaagtttcttcaa

SEQ ID NO: 630796 - DNA, 25 bp, Mus musculus
gggagtgtattcagagtatgagact

SEQ ID NO: 630797 - DNA, 25 bp, Mus musculus
gggagtgtattctgagtatgagact

SEQ ID NO: 630798 - DNA, 25 bp, Mus musculus
gggagtgtccacagcaaagtgagca

SEQ ID NO: 630799 - DNA, 25 bp, Mus musculus
gggagtgtccactgcaaagtgagca

SEQ ID NO: 630800 - DNA, 25 bp, Mus musculus
gggagtgtccagagcctgttcctcc

SEQ ID NO: 630801 - DNA, 25 bp, Mus musculus
gggagtgtccagtgcctgttcctcc

SEQ ID NO: 630802 - DNA, 25 bp, Mus musculus
gggagtgtcgctagtatgttaccat

SEQ ID NO: 630803 - DNA, 25 bp, Mus musculus
gggagtgtcgcttgtatgttaccat

SEQ ID NO: 630804 - DNA, 25 bp, Mus musculus
gggagtgtcggtctgaccctcccac

SEQ ID NO: 630805 - DNA, 25 bp, Mus musculus
gggagtgtcggtgtgaccctcccac

SEQ ID NO: 630806 - DNA, 25 bp, Mus musculus
gggagtgtctacatacagatattct

SEQ ID NO: 630807 - DNA, 25 bp, Mus musculus
gggagtgtctacttacagatattct

SEQ ID NO: 630808 - DNA, 25 bp, Mus musculus
gggagtgtctgcaccttcttgctgc

SEQ ID NO: 630809 - DNA, 25 bp, Mus musculus
gggagtgtctgctccttcttgctgc

SEQ ID NO: 630810 - DNA, 25 bp, Mus musculus
gggagtgtgtttccccttatatagc

SEQ ID NO: 630811 - DNA, 25 bp, Mus musculus
gggagtgtgtttgcccttatatagc

SEQ ID NO: 630812 - DNA, 25 bp, Mus musculus
gggagttaatatactctctacttat

SEQ ID NO: 630813 - DNA, 25 bp, Mus musculus
gggagttaatattctctctacttat

SEQ ID NO: 630814 - DNA, 25 bp, Mus musculus
gggagttacttgagctatattaagg

SEQ ID NO: 630815 - DNA, 25 bp, Mus musculus
gggagttacttgatcattcaaatct

SEQ ID NO: 630816 - DNA, 25 bp, Mus musculus
gggagttacttgtgctatattaagg

SEQ ID NO: 630817 - DNA, 25 bp, Mus musculus
gggagttacttgttcattcaaatct

SEQ ID NO: 630818 - DNA, 25 bp, Mus musculus
gggagttagcttctttgttgaagta

SEQ ID NO: 630819 - DNA, 25 bp, Mus musculus
gggagttagcttgtttgttgaagta

SEQ ID NO: 630820 - DNA, 25 bp, Mus musculus
gggagttattacctcataggcaatg

SEQ ID NO: 630821 - DNA, 25 bp, Mus musculus
gggagttattacgtcataggcaatg

SEQ ID NO: 630822 - DNA, 25 bp, Mus musculus
gggagttatttgaccagcatgaaga

SEQ ID NO: 630823 - DNA, 25 bp, Mus musculus
gggagttatttgtccagcatgaaga

SEQ ID NO: 630824 - DNA, 25 bp, Mus musculus
gggagttcaactatcaatcagcctg

SEQ ID NO: 630825 - DNA, 25 bp, Mus musculus
gggagttcaactttcaatcagcctg

SEQ ID NO: 630826 - DNA, 25 bp, Mus musculus
gggagttcaagaccaacctggctaa

SEQ ID NO: 630827 - DNA, 25 bp, Mus musculus
gggagttcaagagcaacctggctaa

SEQ ID NO: 630828 - DNA, 25 bp, Mus musculus
gggagttcaggtctctgttcatacc

SEQ ID NO: 630829 - DNA, 25 bp, Mus musculus
gggagttcaggtgtctgttcatacc

SEQ ID NO: 630830 - DNA, 25 bp, Mus musculus
gggagttccaacaatggtgtcatga

SEQ ID NO: 630831 - DNA, 25 bp, Mus musculus
gggagttccaactatggtgtcatga

SEQ ID NO: 630832 - DNA, 25 bp, Mus musculus
gggagttcctagagacacttctgcc

SEQ ID NO: 630833 - DNA, 25 bp, Mus musculus
gggagttcctagtgacacttctgcc

SEQ ID NO: 630834 - DNA, 25 bp, Mus musculus
gggagttcctcaattccacgtgcaa

SEQ ID NO: 630835 - DNA, 25 bp, Mus musculus
gggagttcctcatttccacgtgcaa

SEQ ID NO: 630836 - DNA, 25 bp, Mus musculus
gggagttcggacatactgtattcta

SEQ ID NO: 630837 - DNA, 25 bp, Mus musculus
gggagttcggacttactgtattcta

SEQ ID NO: 630838 - DNA, 25 bp, Mus musculus
gggagttctcataaaacgtcaccat

SEQ ID NO: 630839 - DNA, 25 bp, Mus musculus
gggagttctcattaaacgtcaccat

SEQ ID NO: 630840 - DNA, 25 bp, Mus musculus
gggagttctctcaatagtatgagct

SEQ ID NO: 630841 - DNA, 25 bp, Mus musculus
gggagttctctctatagtatgagct

SEQ ID NO: 630842 - DNA, 25 bp, Mus musculus
gggagttctctgagtttccagtaga

SEQ ID NO: 630843 - DNA, 25 bp, Mus musculus
gggagttctctgtgtttccagtaga

SEQ ID NO: 630844 - DNA, 25 bp, Mus musculus
gggagttctgtgctgttacaaattg

SEQ ID NO: 630845 - DNA, 25 bp, Mus musculus
gggagttctgtggtgttacaaattg

SEQ ID NO: 630846 - DNA, 25 bp, Mus musculus
gggagttctgttccaagcctacttc

SEQ ID NO: 630847 - DNA, 25 bp, Mus musculus
gggagttctgttgcaagcctacttc

SEQ ID NO: 630848 - DNA, 25 bp, Mus musculus
gggagttgaagcctcgatacacaat

SEQ ID NO: 630849 - DNA, 25 bp, Mus musculus
gggagttgaagcgtcgatacacaat

SEQ ID NO: 630850 - DNA, 25 bp, Mus musculus
gggagttgaattaccccatgaaata

SEQ ID NO: 630851 - DNA, 25 bp, Mus musculus
gggagttgaatttccccatgaaata

SEQ ID NO: 630852 - DNA, 25 bp, Mus musculus
gggagttgacatcccctagctcatg

SEQ ID NO: 630853 - DNA, 25 bp, Mus musculus
gggagttgacatcggcccataaaca

SEQ ID NO: 630854 - DNA, 25 bp, Mus musculus
gggagttgacatgccctagctcatg

SEQ ID NO: 630855 - DNA, 25 bp, Mus musculus
gggagttgacatgggcccataaaca

SEQ ID NO: 630856 - DNA, 25 bp, Mus musculus
gggagttgagacattcgaaagacat

SEQ ID NO: 630857 - DNA, 25 bp, Mus musculus
gggagttgagactttcgaaagacat

SEQ ID NO: 630858 - DNA, 25 bp, Mus musculus
gggagttgattcctgttaatgccaa

SEQ ID NO: 630859 - DNA, 25 bp, Mus musculus
gggagttgattcgtgttaatgccaa

SEQ ID NO: 630860 - DNA, 25 bp, Mus musculus
gggagttgcagaaaagcctcatgtt

SEQ ID NO: 630861 - DNA, 25 bp, Mus musculus
gggagttgcagataagcctcatgtt

SEQ ID NO: 630862 - DNA, 25 bp, Mus musculus
gggagttgctagacttcacacacat

SEQ ID NO: 630863 - DNA, 25 bp, Mus musculus
gggagttgctagtcttcacacacat

SEQ ID NO: 630864 - DNA, 25 bp, Mus musculus
gggagttgggtcaccacagtctctc

SEQ ID NO: 630865 - DNA, 25 bp, Mus musculus
gggagttgggtctccacagtctctc

SEQ ID NO: 630866 - DNA, 25 bp, Mus musculus
gggagttgtttgatgttctgccatc

SEQ ID NO: 630867 - DNA, 25 bp, Mus musculus
gggagttgtttgttgttctgccatc

SEQ ID NO: 630868 - DNA, 25 bp, Mus musculus
gggagtttaatgctaggccatccat

SEQ ID NO: 630869 - DNA, 25 bp, Mus musculus
gggagtttaatggtaggccatccat

SEQ ID NO: 630870 - DNA, 25 bp, Mus musculus
gggagtttaccgaagtgtttagcag

SEQ ID NO: 630871 - DNA, 25 bp, Mus musculus
gggagtttaccgtagtgtttagcag

SEQ ID NO: 630872 - DNA, 25 bp, Mus musculus
gggagtttatgaagctctgaaccat

SEQ ID NO: 630873 - DNA, 25 bp, Mus musculus
gggagtttatgatgctctgaaccat

SEQ ID NO: 630874 - DNA, 25 bp, Mus musculus
gggagtttcacgaaggcaccgatga

SEQ ID NO: 630875 - DNA, 25 bp, Mus musculus
gggagtttcacgtaggcaccgatga

SEQ ID NO: 630876 - DNA, 25 bp, Mus musculus
gggagtttgaccattcaaccaatga

SEQ ID NO: 630877 - DNA, 25 bp, Mus musculus
gggagtttgacctttcaaccaatga

SEQ ID NO: 630878 - DNA, 25 bp, Mus musculus
gggagtttgagacctcacacacatg

SEQ ID NO: 630879 - DNA, 25 bp, Mus musculus
gggagtttgagagctcacacacatg

SEQ ID NO: 630880 - DNA, 25 bp, Mus musculus
gggagtttgcatcatcttgtcacca

SEQ ID NO: 630881 - DNA, 25 bp, Mus musculus
gggagtttgcatgatcttgtcacca

SEQ ID NO: 630882 - DNA, 25 bp, Mus musculus
gggagtttgtctcctacttttcata

SEQ ID NO: 630883 - DNA, 25 bp, Mus musculus
gggagtttgtctgctacttttcata

SEQ ID NO: 630884 - DNA, 25 bp, Mus musculus
gggagttttagacgcactggaaata

SEQ ID NO: 630885 - DNA, 25 bp, Mus musculus
gggagttttagaggcactggaaata

SEQ ID NO: 630886 - DNA, 25 bp, Mus musculus
gggagttttcccagcaggactacga

SEQ ID NO: 630887 - DNA, 25 bp, Mus musculus
gggagttttccctgcaggactacga

SEQ ID NO: 630888 - DNA, 25 bp, Mus musculus
gggagttttgatcctctcatctcat

SEQ ID NO: 630889 - DNA, 25 bp, Mus musculus
gggagttttgatgctctcatctcat

SEQ ID NO: 630890 - DNA, 25 bp, Mus musculus
gggagttttggcacatttctttact

SEQ ID NO: 630891 - DNA, 25 bp, Mus musculus
gggagttttggctcatttctttact

SEQ ID NO: 630892 - DNA, 25 bp, Mus musculus
gggataaaacatacaaactcgctaa

SEQ ID NO: 630893 - DNA, 25 bp, Mus musculus
gggataaaacattcaaactcgctaa

SEQ ID NO: 630894 - DNA, 25 bp, Mus musculus
gggataaaactgatcatgactttaa

SEQ ID NO: 630895 - DNA, 25 bp, Mus musculus
gggataaaactgttcatgactttaa

SEQ ID NO: 630896 - DNA, 25 bp, Mus musculus
gggataaaagagattgccagttcaa

SEQ ID NO: 630897 - DNA, 25 bp, Mus musculus
gggataaaagagtttgccagttcaa

SEQ ID NO: 630898 - DNA, 25 bp, Mus musculus
gggataaacagaatctcctctccaa

SEQ ID NO: 630899 - DNA, 25 bp, Mus musculus
gggataaacagattctcctctccaa

SEQ ID NO: 630900 - DNA, 25 bp, Mus musculus
gggataaaccccacattgaatagct

SEQ ID NO: 630901 - DNA, 25 bp, Mus musculus
gggataaacccctcattgaatagct

SEQ ID NO: 630902 - DNA, 25 bp, Mus musculus
gggataaagggtacaaggccaatct

SEQ ID NO: 630903 - DNA, 25 bp, Mus musculus
gggataaagggttcaaggccaatct

SEQ ID NO: 630904 - DNA, 25 bp, Mus musculus
gggataacagctatctccaggtcca

SEQ ID NO: 630905 - DNA, 25 bp, Mus musculus
gggataacagctttctccaggtcca

SEQ ID NO: 630906 - DNA, 25 bp, Mus musculus
gggataacagggacattacgcttat

SEQ ID NO: 630907 - DNA, 25 bp, Mus musculus
gggataacagggtcattacgcttat

SEQ ID NO: 630908 - DNA, 25 bp, Mus musculus
gggataacccacatagaaacactca

SEQ ID NO: 630909 - DNA, 25 bp, Mus musculus
gggataacccacttagaaacactca

SEQ ID NO: 630910 - DNA, 25 bp, Mus musculus
gggataacctcacataattcacaga

SEQ ID NO: 630911 - DNA, 25 bp, Mus musculus
gggataacctcagataattcacaga

SEQ ID NO: 630912 - DNA, 25 bp, Mus musculus
gggataacgaacaacagcaacgtct

SEQ ID NO: 630913 - DNA, 25 bp, Mus musculus
gggataacgaactacagcaacgtct

SEQ ID NO: 630914 - DNA, 25 bp, Mus musculus
gggataactgccatcttgaggatgt

SEQ ID NO: 630915 - DNA, 25 bp, Mus musculus
gggataactgccttcttgaggatgt

SEQ ID NO: 630916 - DNA, 25 bp, Mus musculus
gggataagcattagaacctgagttc

SEQ ID NO: 630917 - DNA, 25 bp, Mus musculus
gggataagcatttgaacctgagttc

SEQ ID NO: 630918 - DNA, 25 bp, Mus musculus
gggataagccatattgttttgtgat

SEQ ID NO: 630919 - DNA, 25 bp, Mus musculus
gggataagccattttgttttgtgat

SEQ ID NO: 630920 - DNA, 25 bp, Mus musculus
gggataagcttaaattggtaccaca

SEQ ID NO: 630921 - DNA, 25 bp, Mus musculus
gggataagcttatattggtaccaca

SEQ ID NO: 630922 - DNA, 25 bp, Mus musculus
gggataagggtaccttctgatgttt

SEQ ID NO: 630923 - DNA, 25 bp, Mus musculus
gggataagggtagcttctgatgttt

SEQ ID NO: 630924 - DNA, 25 bp, Mus musculus
gggataaggtagagaacggtcatca

SEQ ID NO: 630925 - DNA, 25 bp, Mus musculus
gggataaggtagtgaacggtcatca

SEQ ID NO: 630926 - DNA, 25 bp, Mus musculus
gggataataattcctgcctataaag

SEQ ID NO: 630927 - DNA, 25 bp, Mus musculus
gggataataattgctgcctataaag

SEQ ID NO: 630928 - DNA, 25 bp, Mus musculus
gggataatctgaaagcacattccta

SEQ ID NO: 630929 - DNA, 25 bp, Mus musculus
gggataatctgatagcacattccta

SEQ ID NO: 630930 - DNA, 25 bp, Mus musculus
gggataatggtacctttcaaatcat

SEQ ID NO: 630931 - DNA, 25 bp, Mus musculus
gggataatggtagctttcaaatcat

SEQ ID NO: 630932 - DNA, 25 bp, Mus musculus
gggataatggtcatcaggattccaa

SEQ ID NO: 630933 - DNA, 25 bp, Mus musculus
gggataatggtcttcaggattccaa

SEQ ID NO: 630934 - DNA, 25 bp, Mus musculus
gggataatgttacaatctgcttcct

SEQ ID NO: 630935 - DNA, 25 bp, Mus musculus
gggataatgttagaatctgcttcct

SEQ ID NO: 630936 - DNA, 25 bp, Mus musculus
gggataattccacttgacagtttag

SEQ ID NO: 630937 - DNA, 25 bp, Mus musculus
gggataattccagttgacagtttag

SEQ ID NO: 630938 - DNA, 25 bp, Mus musculus
gggataattccgacagactccgaat

SEQ ID NO: 630939 - DNA, 25 bp, Mus musculus
gggataattccgtcagactccgaat

SEQ ID NO: 630940 - DNA, 25 bp, Mus musculus
gggataattgttcagacttgccatt

SEQ ID NO: 630941 - DNA, 25 bp, Mus musculus
gggataattgttgagacttgccatt

SEQ ID NO: 630942 - DNA, 25 bp, Mus musculus
gggatacaaccgatttgctccatat

SEQ ID NO: 630943 - DNA, 25 bp, Mus musculus
gggatacaaccgttttgctccatat

SEQ ID NO: 630944 - DNA, 25 bp, Mus musculus
gggatacaaggcatgattcttattg

SEQ ID NO: 630945 - DNA, 25 bp, Mus musculus
gggatacaaggcttgattcttattg

SEQ ID NO: 630946 - DNA, 25 bp, Mus musculus
gggatacaagtcaaacacttactga

SEQ ID NO: 630947 - DNA, 25 bp, Mus musculus
gggatacaagtccatccacccaggg

SEQ ID NO: 630948 - DNA, 25 bp, Mus musculus
gggatacaagtcgatccacccaggg

SEQ ID NO: 630949 - DNA, 25 bp, Mus musculus
gggatacaagtctaacacttactga

SEQ ID NO: 630950 - DNA, 25 bp, Mus musculus
gggatacaatggattctggactaat

SEQ ID NO: 630951 - DNA, 25 bp, Mus musculus
gggatacaatggtttctggactaat

SEQ ID NO: 630952 - DNA, 25 bp, Mus musculus
gggatacacaggctaaaagtacatt

SEQ ID NO: 630953 - DNA, 25 bp, Mus musculus
gggatacacagggtaaaagtacatt

SEQ ID NO: 630954 - DNA, 25 bp, Mus musculus
gggatacaccctcgtaaactagagc

SEQ ID NO: 630955 - DNA, 25 bp, Mus musculus
gggatacaccctggtaaactagagc

SEQ ID NO: 630956 - DNA, 25 bp, Mus musculus
gggatacacgcaaggtttctcaggt

SEQ ID NO: 630957 - DNA, 25 bp, Mus musculus
gggatacacgcaatatgtacagatt

SEQ ID NO: 630958 - DNA, 25 bp, Mus musculus
gggatacacgcatggtttctcaggt

SEQ ID NO: 630959 - DNA, 25 bp, Mus musculus
gggatacacgcattatgtacagatt

SEQ ID NO: 630960 - DNA, 25 bp, Mus musculus
gggatacacttcctatagacgtcat

SEQ ID NO: 630961 - DNA, 25 bp, Mus musculus
gggatacacttcgtatagacgtcat

SEQ ID NO: 630962 - DNA, 25 bp, Mus musculus
gggatacacttgacaatggccccac

SEQ ID NO: 630963 - DNA, 25 bp, Mus musculus
gggatacacttgtcaatggccccac

SEQ ID NO: 630964 - DNA, 25 bp, Mus musculus
gggatacagtccctcattgcaggga

SEQ ID NO: 630965 - DNA, 25 bp, Mus musculus
gggatacagtccgtcattgcaggga

SEQ ID NO: 630966 - DNA, 25 bp, Mus musculus
gggatacataacatttaggtgtcaa

SEQ ID NO: 630967 - DNA, 25 bp, Mus musculus
gggatacataacttttaggtgtcaa

SEQ ID NO: 630968 - DNA, 25 bp, Mus musculus
gggatacatagtcggatcccgtctc

SEQ ID NO: 630969 - DNA, 25 bp, Mus musculus
gggatacatagtgggatcccgtctc

SEQ ID NO: 630970 - DNA, 25 bp, Mus musculus
gggatacatcctctttatatattct

SEQ ID NO: 630971 - DNA, 25 bp, Mus musculus
gggatacatcctgtttatatattct

SEQ ID NO: 630972 - DNA, 25 bp, Mus musculus
gggatacatgcgctagtaaaattca

SEQ ID NO: 630973 - DNA, 25 bp, Mus musculus
gggatacatgcggtagtaaaattca

SEQ ID NO: 630974 - DNA, 25 bp, Mus musculus
gggatacattccactattgtttgat

SEQ ID NO: 630975 - DNA, 25 bp, Mus musculus
gggatacattcctctattgtttgat

SEQ ID NO: 630976 - DNA, 25 bp, Mus musculus
gggataccaactcttacgttccata

SEQ ID NO: 630977 - DNA, 25 bp, Mus musculus
gggataccaactgttacgttccata

SEQ ID NO: 630978 - DNA, 25 bp, Mus musculus
gggataccagacactccagcgtcag

SEQ ID NO: 630979 - DNA, 25 bp, Mus musculus
gggataccagactctccagcgtcag

SEQ ID NO: 630980 - DNA, 25 bp, Mus musculus
gggataccagcaaccgagatcatca

SEQ ID NO: 630981 - DNA, 25 bp, Mus musculus
gggataccagcatccgagatcatca

SEQ ID NO: 630982 - DNA, 25 bp, Mus musculus
gggataccagctcccaaaatcctgt

SEQ ID NO: 630983 - DNA, 25 bp, Mus musculus
gggataccagctgccaaaatcctgt

SEQ ID NO: 630984 - DNA, 25 bp, Mus musculus
gggatacccaatctactgttccact

SEQ ID NO: 630985 - DNA, 25 bp, Mus musculus
gggatacccaatgtactgttccact

SEQ ID NO: 630986 - DNA, 25 bp, Mus musculus
gggataccctccagcctaacgatag

SEQ ID NO: 630987 - DNA, 25 bp, Mus musculus
gggataccctcctgcctaacgatag

SEQ ID NO: 630988 - DNA, 25 bp, Mus musculus
gggataccgttcacgttttagatca

SEQ ID NO: 630989 - DNA, 25 bp, Mus musculus
gggataccgttctcgttttagatca

SEQ ID NO: 630990 - DNA, 25 bp, Mus musculus
gggatacctaaccagtaaaggtcat

SEQ ID NO: 630991 - DNA, 25 bp, Mus musculus
gggatacctaacgagtaaaggtcat

SEQ ID NO: 630992 - DNA, 25 bp, Mus musculus
gggatacctaccctagccactgcaa

SEQ ID NO: 630993 - DNA, 25 bp, Mus musculus
gggatacctaccgtagccactgcaa

SEQ ID NO: 630994 - DNA, 25 bp, Mus musculus
gggatacctaggaaatctctgtact

SEQ ID NO: 630995 - DNA, 25 bp, Mus musculus
gggatacctaggtaatctctgtact

SEQ ID NO: 630996 - DNA, 25 bp, Mus musculus
gggatacctatcagtacatcaggct

SEQ ID NO: 630997 - DNA, 25 bp, Mus musculus
gggatacctatctgtacatcaggct

SEQ ID NO: 630998 - DNA, 25 bp, Mus musculus
gggatacctgagactctgtagtaac

SEQ ID NO: 630999 - DNA, 25 bp, Mus musculus
gggatacctgagtctctgtagtaac

SEQ ID NO: 631000 - DNA, 25 bp, Mus musculus
gggatacggtttacactccataaag

SEQ ID NO: 631001 - DNA, 25 bp, Mus musculus
gggatacggttttcactccataaag

SEQ ID NO: 631002 - DNA, 25 bp, Mus musculus
gggatactacatatctctgtgtata

SEQ ID NO: 631003 - DNA, 25 bp, Mus musculus
gggatactacatttctctgtgtata

SEQ ID NO: 631004 - DNA, 25 bp, Mus musculus
gggatactacttactaacaaggtgt

SEQ ID NO: 631005 - DNA, 25 bp, Mus musculus
gggatactactttctaacaaggtgt

SEQ ID NO: 631006 - DNA, 25 bp, Mus musculus
gggatactcaaccattacctcatct

SEQ ID NO: 631007 - DNA, 25 bp, Mus musculus
gggatactcaacgattacctcatct

SEQ ID NO: 631008 - DNA, 25 bp, Mus musculus
gggatactccagaagcctgcaacat

SEQ ID NO: 631009 - DNA, 25 bp, Mus musculus
gggatactccagtagcctgcaacat

SEQ ID NO: 631010 - DNA, 25 bp, Mus musculus
gggatactctccagcggctctgtgc

SEQ ID NO: 631011 - DNA, 25 bp, Mus musculus
gggatactctcctgcggctctgtgc

SEQ ID NO: 631012 - DNA, 25 bp, Mus musculus
gggatactgaaaaccatttgttaca

SEQ ID NO: 631013 - DNA, 25 bp, Mus musculus
gggatactgaaatccatttgttaca

SEQ ID NO: 631014 - DNA, 25 bp, Mus musculus
gggatactgagacactggacaattt

SEQ ID NO: 631015 - DNA, 25 bp, Mus musculus
gggatactgagagactggacaattt

SEQ ID NO: 631016 - DNA, 25 bp, Mus musculus
gggatactgcagatcagcatttctt

SEQ ID NO: 631017 - DNA, 25 bp, Mus musculus
gggatactgcagatctatcacacac

SEQ ID NO: 631018 - DNA, 25 bp, Mus musculus
gggatactgcagttcagcatttctt

SEQ ID NO: 631019 - DNA, 25 bp, Mus musculus
gggatactgcagttctatcacacac

SEQ ID NO: 631020 - DNA, 25 bp, Mus musculus
gggatactgggcattatgggcaaaa

SEQ ID NO: 631021 - DNA, 25 bp, Mus musculus
gggatactgggctttatgggcaaaa

SEQ ID NO: 631022 - DNA, 25 bp, Mus musculus
gggatactgggtcatagtgtacaac

SEQ ID NO: 631023 - DNA, 25 bp, Mus musculus
gggatactgggtgatagtgtacaac

SEQ ID NO: 631024 - DNA, 25 bp, Mus musculus
gggatactgtggaagatttcaggca

SEQ ID NO: 631025 - DNA, 25 bp, Mus musculus
gggatactgtggtagatttcaggca

SEQ ID NO: 631026 - DNA, 25 bp, Mus musculus
gggatacttcccatgtaatcaggaa

SEQ ID NO: 631027 - DNA, 25 bp, Mus musculus
gggatacttcccttgtaatcaggaa

SEQ ID NO: 631028 - DNA, 25 bp, Mus musculus
gggatacttgtacacctcggaacat

SEQ ID NO: 631029 - DNA, 25 bp, Mus musculus
gggatacttgtagacctcggaacat

SEQ ID NO: 631030 - DNA, 25 bp, Mus musculus
gggatactttagacaacacacttag

SEQ ID NO: 631031 - DNA, 25 bp, Mus musculus
gggatactttagtcaacacacttag

SEQ ID NO: 631032 - DNA, 25 bp, Mus musculus
gggatactttttacagccgccctgc

SEQ ID NO: 631033 - DNA, 25 bp, Mus musculus
gggatacttttttcagccgccctgc

SEQ ID NO: 631034 - DNA, 25 bp, Mus musculus
gggatagaagataccgaggccgcta

SEQ ID NO: 631035 - DNA, 25 bp, Mus musculus
gggatagaagattccgaggccgcta

SEQ ID NO: 631036 - DNA, 25 bp, Mus musculus
gggatagaatcaaacctatatctaa

SEQ ID NO: 631037 - DNA, 25 bp, Mus musculus
gggatagaatcatacctatatctaa

SEQ ID NO: 631038 - DNA, 25 bp, Mus musculus
gggatagacttgacccaaggcttct

SEQ ID NO: 631039 - DNA, 25 bp, Mus musculus
gggatagacttgtcccaaggcttct

SEQ ID NO: 631040 - DNA, 25 bp, Mus musculus
gggatagagtctctttatgcattaa

SEQ ID NO: 631041 - DNA, 25 bp, Mus musculus
gggatagagtctgtttatgcattaa

SEQ ID NO: 631042 - DNA, 25 bp, Mus musculus
gggatagatccaatcactgaccata

SEQ ID NO: 631043 - DNA, 25 bp, Mus musculus
gggatagatccattcactgaccata

SEQ ID NO: 631044 - DNA, 25 bp, Mus musculus
gggatagatcctacagcagcacggg

SEQ ID NO: 631045 - DNA, 25 bp, Mus musculus
gggatagatccttcagcagcacggg

SEQ ID NO: 631046 - DNA, 25 bp, Mus musculus
gggatagatgcgcattttcattatt

SEQ ID NO: 631047 - DNA, 25 bp, Mus musculus
gggatagatgcggattttcattatt

SEQ ID NO: 631048 - DNA, 25 bp, Mus musculus
gggatagatgctagtgcccaacaaa

SEQ ID NO: 631049 - DNA, 25 bp, Mus musculus
gggatagatgcttgtgcccaacaaa

SEQ ID NO: 631050 - DNA, 25 bp, Mus musculus
gggatagatgtgaccttctgctgcc

SEQ ID NO: 631051 - DNA, 25 bp, Mus musculus
gggatagatgtgtccttctgctgcc

SEQ ID NO: 631052 - DNA, 25 bp, Mus musculus
gggatagattcaacagcaacctaca

SEQ ID NO: 631053 - DNA, 25 bp, Mus musculus
gggatagattcatcagcaacctaca

SEQ ID NO: 631054 - DNA, 25 bp, Mus musculus
gggatagattgcaccctggagagct

SEQ ID NO: 631055 - DNA, 25 bp, Mus musculus
gggatagattgcagccccatagcat

SEQ ID NO: 631056 - DNA, 25 bp, Mus musculus
gggatagattgctccctggagagct

SEQ ID NO: 631057 - DNA, 25 bp, Mus musculus
gggatagattgctgccccatagcat

SEQ ID NO: 631058 - DNA, 25 bp, Mus musculus
gggatagcaagactttcactccgtc

SEQ ID NO: 631059 - DNA, 25 bp, Mus musculus
gggatagcaagagtttcactccgtc

SEQ ID NO: 631060 - DNA, 25 bp, Mus musculus
gggatagcaaggactaacatttgtt

SEQ ID NO: 631061 - DNA, 25 bp, Mus musculus
gggatagcaaggtctaacatttgtt

SEQ ID NO: 631062 - DNA, 25 bp, Mus musculus
gggatagcacacatcttcaacttca

SEQ ID NO: 631063 - DNA, 25 bp, Mus musculus
gggatagcacacttcttcaacttca

SEQ ID NO: 631064 - DNA, 25 bp, Mus musculus
gggatagcacgccagagctctactc

SEQ ID NO: 631065 - DNA, 25 bp, Mus musculus
gggatagcacgcgagagctctactc

SEQ ID NO: 631066 - DNA, 25 bp, Mus musculus
gggatagcactgaacatcaatacct

SEQ ID NO: 631067 - DNA, 25 bp, Mus musculus
gggatagcactgtacatcaatacct

SEQ ID NO: 631068 - DNA, 25 bp, Mus musculus
gggatagcagatcccagactttggt

SEQ ID NO: 631069 - DNA, 25 bp, Mus musculus
gggatagcagatgccagactttggt

SEQ ID NO: 631070 - DNA, 25 bp, Mus musculus
gggatagcagtcattaggcttcata

SEQ ID NO: 631071 - DNA, 25 bp, Mus musculus
gggatagcagtctttaggcttcata

SEQ ID NO: 631072 - DNA, 25 bp, Mus musculus
gggatagcccggatcaaaagcctgc

SEQ ID NO: 631073 - DNA, 25 bp, Mus musculus
gggatagcccggttcaaaagcctgc

SEQ ID NO: 631074 - DNA, 25 bp, Mus musculus
gggatagcctacattgcttttgaga

SEQ ID NO: 631075 - DNA, 25 bp, Mus musculus
gggatagcctactttgcttttgaga

SEQ ID NO: 631076 - DNA, 25 bp, Mus musculus
gggatagcctcactcagcttttagt

SEQ ID NO: 631077 - DNA, 25 bp, Mus musculus
gggatagcctcagtcagcttttagt

SEQ ID NO: 631078 - DNA, 25 bp, Mus musculus
gggatagcctgcacatatgcacctc

SEQ ID NO: 631079 - DNA, 25 bp, Mus musculus
gggatagcctgctcatatgcacctc

SEQ ID NO: 631080 - DNA, 25 bp, Mus musculus
gggatagcgacacgtccatctccat

SEQ ID NO: 631081 - DNA, 25 bp, Mus musculus
gggatagcgacaggtccatctccat

SEQ ID NO: 631082 - DNA, 25 bp, Mus musculus
gggatagcgttcaccttttactacg

SEQ ID NO: 631083 - DNA, 25 bp, Mus musculus
gggatagcgttctccttttactacg

SEQ ID NO: 631084 - DNA, 25 bp, Mus musculus
gggatagctaatcagtgcacactga

SEQ ID NO: 631085 - DNA, 25 bp, Mus musculus
gggatagctaatgagtgcacactga

SEQ ID NO: 631086 - DNA, 25 bp, Mus musculus
gggatagctcataacctgcattgtg

SEQ ID NO: 631087 - DNA, 25 bp, Mus musculus
gggatagctcattacctgcattgtg

SEQ ID NO: 631088 - DNA, 25 bp, Mus musculus
gggatagctgacaatctgtcgaatt

SEQ ID NO: 631089 - DNA, 25 bp, Mus musculus
gggatagctgactatctgtcgaatt

SEQ ID NO: 631090 - DNA, 25 bp, Mus musculus
gggatagctgcacaacttccaggcc

SEQ ID NO: 631091 - DNA, 25 bp, Mus musculus
gggatagctgcagaacttccaggcc

SEQ ID NO: 631092 - DNA, 25 bp, Mus musculus
gggataggctctcatcggaccataa

SEQ ID NO: 631093 - DNA, 25 bp, Mus musculus
gggataggctctgatcggaccataa

SEQ ID NO: 631094 - DNA, 25 bp, Mus musculus
gggataggtgctcttaactcataaa

SEQ ID NO: 631095 - DNA, 25 bp, Mus musculus
gggataggtgctgttaactcataaa

SEQ ID NO: 631096 - DNA, 25 bp, Mus musculus
gggatagtcaatcccggcaacctcc

SEQ ID NO: 631097 - DNA, 25 bp, Mus musculus
gggatagtcaatgccggcaacctcc

SEQ ID NO: 631098 - DNA, 25 bp, Mus musculus
gggatagtcacacaactatgcatta

SEQ ID NO: 631099 - DNA, 25 bp, Mus musculus
gggatagtcacagaactatgcatta

SEQ ID NO: 631100 - DNA, 25 bp, Mus musculus
gggatagtccgcaacacgaaagatg

SEQ ID NO: 631101 - DNA, 25 bp, Mus musculus
gggatagtccgctacacgaaagatg

SEQ ID NO: 631102 - DNA, 25 bp, Mus musculus
gggatagtcctcatggtaattattt

SEQ ID NO: 631103 - DNA, 25 bp, Mus musculus
gggatagtcctcttggtaattattt

SEQ ID NO: 631104 - DNA, 25 bp, Mus musculus
gggatagtggccaggtttctcttcg

SEQ ID NO: 631105 - DNA, 25 bp, Mus musculus
gggatagtggcctggtttctcttcg

SEQ ID NO: 631106 - DNA, 25 bp, Mus musculus
gggatagttaccactgtgattacca

SEQ ID NO: 631107 - DNA, 25 bp, Mus musculus
gggatagttacctctgtgattacca

SEQ ID NO: 631108 - DNA, 25 bp, Mus musculus
gggatagttcttatgctttgctgaa

SEQ ID NO: 631109 - DNA, 25 bp, Mus musculus
gggatagttcttttgctttgctgaa

SEQ ID NO: 631110 - DNA, 25 bp, Mus musculus
gggatagttgtgaactcattccaca

SEQ ID NO: 631111 - DNA, 25 bp, Mus musculus
gggatagttgtgtactcattccaca

SEQ ID NO: 631112 - DNA, 25 bp, Mus musculus
gggatataaaccaggccagcttcat

SEQ ID NO: 631113 - DNA, 25 bp, Mus musculus
gggatataaacctggccagcttcat

SEQ ID NO: 631114 - DNA, 25 bp, Mus musculus
gggatataaactatctgcccttagg

SEQ ID NO: 631115 - DNA, 25 bp, Mus musculus
gggatataaactttctgcccttagg

SEQ ID NO: 631116 - DNA, 25 bp, Mus musculus
gggatataacatactcggctttggt

SEQ ID NO: 631117 - DNA, 25 bp, Mus musculus
gggatataacattctcggctttggt

SEQ ID NO: 631118 - DNA, 25 bp, Mus musculus
gggatataaccgaaatggctgctta

SEQ ID NO: 631119 - DNA, 25 bp, Mus musculus
gggatataaccgtaatggctgctta

SEQ ID NO: 631120 - DNA, 25 bp, Mus musculus
gggatataacctagacgcaaaccaa

SEQ ID NO: 631121 - DNA, 25 bp, Mus musculus
gggatataaccttgacgcaaaccaa

SEQ ID NO: 631122 - DNA, 25 bp, Mus musculus
gggatataactacaggtcgatggta

SEQ ID NO: 631123 - DNA, 25 bp, Mus musculus
gggatataactagaggtcgatggta

SEQ ID NO: 631124 - DNA, 25 bp, Mus musculus
gggatatagtcccactgcagacgct

SEQ ID NO: 631125 - DNA, 25 bp, Mus musculus
gggatatagtccgactgcagacgct

SEQ ID NO: 631126 - DNA, 25 bp, Mus musculus
gggatatataacacattggtagaac

SEQ ID NO: 631127 - DNA, 25 bp, Mus musculus
gggatatataactcattggtagaac

SEQ ID NO: 631128 - DNA, 25 bp, Mus musculus
gggatatatatgaactgactcacta

SEQ ID NO: 631129 - DNA, 25 bp, Mus musculus
gggatatatatgacgtgttactctt

SEQ ID NO: 631130 - DNA, 25 bp, Mus musculus
gggatatatatgactctgaaagcac

SEQ ID NO: 631131 - DNA, 25 bp, Mus musculus
gggatatatatgtactgactcacta

SEQ ID NO: 631132 - DNA, 25 bp, Mus musculus
gggatatatatgtcgtgttactctt

SEQ ID NO: 631133 - DNA, 25 bp, Mus musculus
gggatatatatgtctctgaaagcac

SEQ ID NO: 631134 - DNA, 25 bp, Mus musculus
gggatatcagtaatgctcaggacct

SEQ ID NO: 631135 - DNA, 25 bp, Mus musculus
gggatatcagtattgctcaggacct

SEQ ID NO: 631136 - DNA, 25 bp, Mus musculus
gggatatcatgtcacgactgacttt

SEQ ID NO: 631137 - DNA, 25 bp, Mus musculus
gggatatcatgtgacgactgacttt

SEQ ID NO: 631138 - DNA, 25 bp, Mus musculus
gggatatccaaccttcctagctcag

SEQ ID NO: 631139 - DNA, 25 bp, Mus musculus
gggatatccaacgttcctagctcag

SEQ ID NO: 631140 - DNA, 25 bp, Mus musculus
gggatatccaagacacaggttcaag

SEQ ID NO: 631141 - DNA, 25 bp, Mus musculus
gggatatccaagtcacaggttcaag

SEQ ID NO: 631142 - DNA, 25 bp, Mus musculus
gggatatcctagagcactttctaaa

SEQ ID NO: 631143 - DNA, 25 bp, Mus musculus
gggatatcctagtgcactttctaaa

SEQ ID NO: 631144 - DNA, 25 bp, Mus musculus
gggatatcctcaattacatcatcat

SEQ ID NO: 631145 - DNA, 25 bp, Mus musculus
gggatatcctcatttacatcatcat

SEQ ID NO: 631146 - DNA, 25 bp, Mus musculus
gggatatcgtggagctctgagtatt

SEQ ID NO: 631147 - DNA, 25 bp, Mus musculus
gggatatcgtggtgctctgagtatt

SEQ ID NO: 631148 - DNA, 25 bp, Mus musculus
gggatatctactctggcttccaaaa

SEQ ID NO: 631149 - DNA, 25 bp, Mus musculus
gggatatctactgtggcttccaaaa

SEQ ID NO: 631150 - DNA, 25 bp, Mus musculus
gggatatctctgctatatgccttgc

SEQ ID NO: 631151 - DNA, 25 bp, Mus musculus
gggatatctctggtatatgccttgc

SEQ ID NO: 631152 - DNA, 25 bp, Mus musculus
gggatatctgcacgagcaatagcaa

SEQ ID NO: 631153 - DNA, 25 bp, Mus musculus
gggatatctgcaggagcaatagcaa

SEQ ID NO: 631154 - DNA, 25 bp, Mus musculus
gggatatgacccactctgaggctac

SEQ ID NO: 631155 - DNA, 25 bp, Mus musculus
gggatatgaccctctctgaggctac

SEQ ID NO: 631156 - DNA, 25 bp, Mus musculus
gggatatgactaagttgcaagaatt

SEQ ID NO: 631157 - DNA, 25 bp, Mus musculus
gggatatgactatgttgcaagaatt

SEQ ID NO: 631158 - DNA, 25 bp, Mus musculus
gggatatgccttcaaaaccatattg

SEQ ID NO: 631159 - DNA, 25 bp, Mus musculus
gggatatgccttgaaaaccatattg

SEQ ID NO: 631160 - DNA, 25 bp, Mus musculus
gggatatgctcgaatatttggccat

SEQ ID NO: 631161 - DNA, 25 bp, Mus musculus
gggatatgctcgtatatttggccat

SEQ ID NO: 631162 - DNA, 25 bp, Mus musculus
gggatatgctgtactgttccagaag

SEQ ID NO: 631163 - DNA, 25 bp, Mus musculus
gggatatgctgttctgttccagaag

SEQ ID NO: 631164 - DNA, 25 bp, Mus musculus
gggatatggattctccaccttctac

SEQ ID NO: 631165 - DNA, 25 bp, Mus musculus
gggatatggattgtccaccttctac

SEQ ID NO: 631166 - DNA, 25 bp, Mus musculus
gggatatggtaccaacctctctata

SEQ ID NO: 631167 - DNA, 25 bp, Mus musculus
gggatatggtacgaacctctctata

SEQ ID NO: 631168 - DNA, 25 bp, Mus musculus
gggatattcaagactttgcaaatac

SEQ ID NO: 631169 - DNA, 25 bp, Mus musculus
gggatattcaagtctttgcaaatac

SEQ ID NO: 631170 - DNA, 25 bp, Mus musculus
gggatattcacgaacagctcctgaa

SEQ ID NO: 631171 - DNA, 25 bp, Mus musculus
gggatattcacgtacagctcctgaa

SEQ ID NO: 631172 - DNA, 25 bp, Mus musculus
gggatattccagacagttgttgccc

SEQ ID NO: 631173 - DNA, 25 bp, Mus musculus
gggatattccagtcagttgttgccc

SEQ ID NO: 631174 - DNA, 25 bp, Mus musculus
gggatattccctacagacattttga

SEQ ID NO: 631175 - DNA, 25 bp, Mus musculus
gggatattcccttcagacattttga

SEQ ID NO: 631176 - DNA, 25 bp, Mus musculus
gggatattctgaaccgaaagtaata

SEQ ID NO: 631177 - DNA, 25 bp, Mus musculus
gggatattctgatccgaaagtaata

SEQ ID NO: 631178 - DNA, 25 bp, Mus musculus
gggatattgtatatgctgccagcct

SEQ ID NO: 631179 - DNA, 25 bp, Mus musculus
gggatattgtatttgctgccagcct

SEQ ID NO: 631180 - DNA, 25 bp, Mus musculus
gggatattgttccactaagccaatc

SEQ ID NO: 631181 - DNA, 25 bp, Mus musculus
gggatattgttccttttctctctat

SEQ ID NO: 631182 - DNA, 25 bp, Mus musculus
gggatattgttcgactaagccaatc

SEQ ID NO: 631183 - DNA, 25 bp, Mus musculus
gggatattgttcgttttctctctat

SEQ ID NO: 631184 - DNA, 25 bp, Mus musculus
gggatatttataacctcctctgtta

SEQ ID NO: 631185 - DNA, 25 bp, Mus musculus
gggatatttatatcctcctctgtta

SEQ ID NO: 631186 - DNA, 25 bp, Mus musculus
gggatattttccctggttcctctat

SEQ ID NO: 631187 - DNA, 25 bp, Mus musculus
gggatattttccgtggttcctctat

SEQ ID NO: 631188 - DNA, 25 bp, Mus musculus
gggatattttttccgtaaccactca

SEQ ID NO: 631189 - DNA, 25 bp, Mus musculus
gggatattttttgcgtaaccactca

SEQ ID NO: 631190 - DNA, 25 bp, Mus musculus
gggatcaaacacagcagtatgaaga

SEQ ID NO: 631191 - DNA, 25 bp, Mus musculus
gggatcaaacaccagttcttctaaa

SEQ ID NO: 631192 - DNA, 25 bp, Mus musculus
gggatcaaacacgagttcttctaaa

SEQ ID NO: 631193 - DNA, 25 bp, Mus musculus
gggatcaaacactgcagtatgaaga

SEQ ID NO: 631194 - DNA, 25 bp, Mus musculus
gggatcaaacccaaagcgttcagtt

SEQ ID NO: 631195 - DNA, 25 bp, Mus musculus
gggatcaaaccctaagcgttcagtt

SEQ ID NO: 631196 - DNA, 25 bp, Mus musculus
gggatcaaacttcgcttagtcacta

SEQ ID NO: 631197 - DNA, 25 bp, Mus musculus
gggatcaaacttggcttagtcacta

SEQ ID NO: 631198 - DNA, 25 bp, Mus musculus
gggatcaaatccacatagccaccaa

SEQ ID NO: 631199 - DNA, 25 bp, Mus musculus
gggatcaaatccagcactccagata

SEQ ID NO: 631200 - DNA, 25 bp, Mus musculus
gggatcaaatcctcatagccaccaa

SEQ ID NO: 631201 - DNA, 25 bp, Mus musculus
gggatcaaatcctgcactccagata

SEQ ID NO: 631202 - DNA, 25 bp, Mus musculus
gggatcaaattacacctgtccctca

SEQ ID NO: 631203 - DNA, 25 bp, Mus musculus
gggatcaaattagacctgtccctca

SEQ ID NO: 631204 - DNA, 25 bp, Mus musculus
gggatcaaatttaccagcagtctag

SEQ ID NO: 631205 - DNA, 25 bp, Mus musculus
gggatcaaattttccagcagtctag

SEQ ID NO: 631206 - DNA, 25 bp, Mus musculus
gggatcaacaagcaattcctcgatg

SEQ ID NO: 631207 - DNA, 25 bp, Mus musculus
gggatcaacaaggaattcctcgatg

SEQ ID NO: 631208 - DNA, 25 bp, Mus musculus
gggatcaagaatacaatgccatctt

SEQ ID NO: 631209 - DNA, 25 bp, Mus musculus
gggatcaagaattcaatgccatctt

SEQ ID NO: 631210 - DNA, 25 bp, Mus musculus
gggatcaagattacgactacttaaa

SEQ ID NO: 631211 - DNA, 25 bp, Mus musculus
gggatcaagatttcgactacttaaa

SEQ ID NO: 631212 - DNA, 25 bp, Mus musculus
gggatcaagcaaccaccttcagcaa

SEQ ID NO: 631213 - DNA, 25 bp, Mus musculus
gggatcaagcaagcaccttcagcaa

SEQ ID NO: 631214 - DNA, 25 bp, Mus musculus
gggatcaagcccatgtgaaccaata

SEQ ID NO: 631215 - DNA, 25 bp, Mus musculus
gggatcaagcccttgtgaaccaata

SEQ ID NO: 631216 - DNA, 25 bp, Mus musculus
gggatcaagcttcgtggctttttat

SEQ ID NO: 631217 - DNA, 25 bp, Mus musculus
gggatcaagcttggtggctttttat

SEQ ID NO: 631218 - DNA, 25 bp, Mus musculus
gggatcaagtacacatgtaattttg

SEQ ID NO: 631219 - DNA, 25 bp, Mus musculus
gggatcaagtactcatgtaattttg

SEQ ID NO: 631220 - DNA, 25 bp, Mus musculus
gggatcaagtgaccagatgcctgca

SEQ ID NO: 631221 - DNA, 25 bp, Mus musculus
gggatcaagtgagcagatgcctgca

SEQ ID NO: 631222 - DNA, 25 bp, Mus musculus
gggatcaatagcatctgccagagaa

SEQ ID NO: 631223 - DNA, 25 bp, Mus musculus
gggatcaatagcttctgccagagaa

SEQ ID NO: 631224 - DNA, 25 bp, Mus musculus
gggatcaatttcatttctcaacgag

SEQ ID NO: 631225 - DNA, 25 bp, Mus musculus
gggatcaatttcttttctcaacgag

SEQ ID NO: 631226 - DNA, 25 bp, Mus musculus
gggatcacactgaatccactcagag

SEQ ID NO: 631227 - DNA, 25 bp, Mus musculus
gggatcacactgtatccactcagag

SEQ ID NO: 631228 - DNA, 25 bp, Mus musculus
gggatcacagaaacaaactgccagg

SEQ ID NO: 631229 - DNA, 25 bp, Mus musculus
gggatcacagaatcaaactgccagg

SEQ ID NO: 631230 - DNA, 25 bp, Mus musculus
gggatcacagatagcaagacagctt

SEQ ID NO: 631231 - DNA, 25 bp, Mus musculus
gggatcacagattgcaagacagctt

SEQ ID NO: 631232 - DNA, 25 bp, Mus musculus
gggatcacagtcagtaaccactatg

SEQ ID NO: 631233 - DNA, 25 bp, Mus musculus
gggatcacagtctgtaaccactatg

SEQ ID NO: 631234 - DNA, 25 bp, Mus musculus
gggatcacagttcaggtggcctcct

SEQ ID NO: 631235 - DNA, 25 bp, Mus musculus
gggatcacagttgaggtggcctcct

SEQ ID NO: 631236 - DNA, 25 bp, Mus musculus
gggatcacatgcaccatggtgcgca

SEQ ID NO: 631237 - DNA, 25 bp, Mus musculus
gggatcacatgctccatggtgcgca

SEQ ID NO: 631238 - DNA, 25 bp, Mus musculus
gggatcaccaaaatgcagccatgtt

SEQ ID NO: 631239 - DNA, 25 bp, Mus musculus
gggatcaccaaattgcagccatgtt

SEQ ID NO: 631240 - DNA, 25 bp, Mus musculus
gggatcaccactccagtgtggaaat

SEQ ID NO: 631241 - DNA, 25 bp, Mus musculus
gggatcaccactgcagtgtggaaat

SEQ ID NO: 631242 - DNA, 25 bp, Mus musculus
gggatcaccaggattggtgcacatg

SEQ ID NO: 631243 - DNA, 25 bp, Mus musculus
gggatcaccaggtttggtgcacatg

SEQ ID NO: 631244 - DNA, 25 bp, Mus musculus
gggatcacctgaacctcagtaggtg

SEQ ID NO: 631245 - DNA, 25 bp, Mus musculus
gggatcacctgatcctcagtaggtg

SEQ ID NO: 631246 - DNA, 25 bp, Mus musculus
gggatcacctgcaacagttactgaa

SEQ ID NO: 631247 - DNA, 25 bp, Mus musculus
gggatcacctgctacagttactgaa

SEQ ID NO: 631248 - DNA, 25 bp, Mus musculus
gggatcacctggacagcatccagca

SEQ ID NO: 631249 - DNA, 25 bp, Mus musculus
gggatcacctggaccgcagagttat

SEQ ID NO: 631250 - DNA, 25 bp, Mus musculus
gggatcacctggtcagcatccagca

SEQ ID NO: 631251 - DNA, 25 bp, Mus musculus
gggatcacctggtccgcagagttat

SEQ ID NO: 631252 - DNA, 25 bp, Mus musculus
gggatcacctgtcgcttatttatac

SEQ ID NO: 631253 - DNA, 25 bp, Mus musculus
gggatcacctgtggcttatttatac

SEQ ID NO: 631254 - DNA, 25 bp, Mus musculus
gggatcactcagatacttaaaatgc

SEQ ID NO: 631255 - DNA, 25 bp, Mus musculus
gggatcactcagctattcttatgta

SEQ ID NO: 631256 - DNA, 25 bp, Mus musculus
gggatcactcaggtattcttatgta

SEQ ID NO: 631257 - DNA, 25 bp, Mus musculus
gggatcactcagttacttaaaatgc

SEQ ID NO: 631258 - DNA, 25 bp, Mus musculus
gggatcactcgaaggacgacagttc

SEQ ID NO: 631259 - DNA, 25 bp, Mus musculus
gggatcactcgatggacgacagttc

SEQ ID NO: 631260 - DNA, 25 bp, Mus musculus
gggatcactgagagagaccctcaat

SEQ ID NO: 631261 - DNA, 25 bp, Mus musculus
gggatcactgagtgagaccctcaat

SEQ ID NO: 631262 - DNA, 25 bp, Mus musculus
gggatcactggcatagtaaaaagta

SEQ ID NO: 631263 - DNA, 25 bp, Mus musculus
gggatcactggcttagtaaaaagta

SEQ ID NO: 631264 - DNA, 25 bp, Mus musculus
gggatcactggtacacaggcatact

SEQ ID NO: 631265 - DNA, 25 bp, Mus musculus
gggatcactggttcacaggcatact

SEQ ID NO: 631266 - DNA, 25 bp, Mus musculus
gggatcacttcacttggtcttgtaa

SEQ ID NO: 631267 - DNA, 25 bp, Mus musculus
gggatcacttcagttggtcttgtaa

SEQ ID NO: 631268 - DNA, 25 bp, Mus musculus
gggatcagaaaacatggtacagtga

SEQ ID NO: 631269 - DNA, 25 bp, Mus musculus
gggatcagaaaagatggtacagtga

SEQ ID NO: 631270 - DNA, 25 bp, Mus musculus
gggatcagaaatatgccttttcaat

SEQ ID NO: 631271 - DNA, 25 bp, Mus musculus
gggatcagaaatttgccttttcaat

SEQ ID NO: 631272 - DNA, 25 bp, Mus musculus
gggatcagaaccagggctctgtgca

SEQ ID NO: 631273 - DNA, 25 bp, Mus musculus
gggatcagaacctgggctctgtgca

SEQ ID NO: 631274 - DNA, 25 bp, Mus musculus
gggatcagagctcgatgccatcctc

SEQ ID NO: 631275 - DNA, 25 bp, Mus musculus
gggatcagagctggatgccatcctc

SEQ ID NO: 631276 - DNA, 25 bp, Mus musculus
gggatcagcagaaccatttcacatt

SEQ ID NO: 631277 - DNA, 25 bp, Mus musculus
gggatcagcagatccatttcacatt

SEQ ID NO: 631278 - DNA, 25 bp, Mus musculus
gggatcagccaaccgctaggaacca

SEQ ID NO: 631279 - DNA, 25 bp, Mus musculus
gggatcagccaagcgctaggaacca

SEQ ID NO: 631280 - DNA, 20 bp, Mus musculus
gggatcagccacaaacgtcg

SEQ ID NO: 631281 - DNA, 20 bp, Mus musculus
gggatcagccccaaacgtcg

SEQ ID NO: 631282 - DNA, 25 bp, Mus musculus
gggatcagccccaggtgggtaccct

SEQ ID NO: 631283 - DNA, 25 bp, Mus musculus
gggatcagcccctggtgggtaccct

SEQ ID NO: 631284 - DNA, 20 bp, Mus musculus
gggatcagccgcaaacgtcg

SEQ ID NO: 631285 - DNA, 20 bp, Mus musculus
gggatcagcctcaaacgtcg

SEQ ID NO: 631286 - DNA, 25 bp, Mus musculus
gggatcagctaaccctcttgtttgg

SEQ ID NO: 631287 - DNA, 25 bp, Mus musculus
gggatcagctaagcctcttgtttgg

SEQ ID NO: 631288 - DNA, 25 bp, Mus musculus
gggatcaggaagattcagacagtgt

SEQ ID NO: 631289 - DNA, 25 bp, Mus musculus
gggatcaggaagtttcagacagtgt

SEQ ID NO: 631290 - DNA, 25 bp, Mus musculus
gggatcagtgcaactgggttttcaa

SEQ ID NO: 631291 - DNA, 25 bp, Mus musculus
gggatcagtgcatctgggttttcaa

SEQ ID NO: 631292 - DNA, 25 bp, Mus musculus
gggatcagttaaagtgcttccctga

SEQ ID NO: 631293 - DNA, 25 bp, Mus musculus
gggatcagttaatgtgcttccctga

SEQ ID NO: 631294 - DNA, 25 bp, Mus musculus
gggatcataaccatcatttgctgaa

SEQ ID NO: 631295 - DNA, 25 bp, Mus musculus
gggatcataaccttcatttgctgaa

SEQ ID NO: 631296 - DNA, 25 bp, Mus musculus
gggatcatacttatgcaccagccac

SEQ ID NO: 631297 - DNA, 25 bp, Mus musculus
gggatcatacttttgcaccagccac

SEQ ID NO: 631298 - DNA, 25 bp, Mus musculus
gggatcatagcaccatatgctgtaa

SEQ ID NO: 631299 - DNA, 25 bp, Mus musculus
gggatcatagcagcatatgctgtaa

SEQ ID NO: 631300 - DNA, 25 bp, Mus musculus
gggatcatagccaagtttcgatttg

SEQ ID NO: 631301 - DNA, 25 bp, Mus musculus
gggatcatagcctagtttcgatttg

SEQ ID NO: 631302 - DNA, 25 bp, Mus musculus
gggatcatagctctgtgccactaga

SEQ ID NO: 631303 - DNA, 25 bp, Mus musculus
gggatcatagctgtgtgccactaga

SEQ ID NO: 631304 - DNA, 25 bp, Mus musculus
gggatcatatggcagccctatactt

SEQ ID NO: 631305 - DNA, 25 bp, Mus musculus
gggatcatatgggagccctatactt

SEQ ID NO: 631306 - DNA, 25 bp, Mus musculus
gggatcatcatactcacctatgtgc

SEQ ID NO: 631307 - DNA, 25 bp, Mus musculus
gggatcatcatagtcacctatgtgc

SEQ ID NO: 631308 - DNA, 25 bp, Mus musculus
gggatcatcccacgtacatagaggt

SEQ ID NO: 631309 - DNA, 25 bp, Mus musculus
gggatcatcccactcccaacaagag

SEQ ID NO: 631310 - DNA, 25 bp, Mus musculus
gggatcatcccaggtacatagaggt

SEQ ID NO: 631311 - DNA, 25 bp, Mus musculus
gggatcatcccagtcccaacaagag

SEQ ID NO: 631312 - DNA, 25 bp, Mus musculus
gggatcatcgatcccctaactggga

SEQ ID NO: 631313 - DNA, 25 bp, Mus musculus
gggatcatcgatgccctaactggga

SEQ ID NO: 631314 - DNA, 25 bp, Mus musculus
gggatcatctgcaaatcagacctga

SEQ ID NO: 631315 - DNA, 25 bp, Mus musculus
gggatcatctgctaatcagacctga

SEQ ID NO: 631316 - DNA, 25 bp, Mus musculus
gggatcatgcatctcctagcccaag

SEQ ID NO: 631317 - DNA, 25 bp, Mus musculus
gggatcatgcatgtcctagcccaag

SEQ ID NO: 631318 - DNA, 25 bp, Mus musculus
gggatcatgcttatccatgtgaaat

SEQ ID NO: 631319 - DNA, 25 bp, Mus musculus
gggatcatgcttttccatgtgaaat

SEQ ID NO: 631320 - DNA, 25 bp, Mus musculus
gggatcatggccaccgccactacat

SEQ ID NO: 631321 - DNA, 25 bp, Mus musculus
gggatcatggcctccgccactacat

SEQ ID NO: 631322 - DNA, 25 bp, Mus musculus
gggatcatgtcaccagaccttttat

SEQ ID NO: 631323 - DNA, 25 bp, Mus musculus
gggatcatgtcagcagaccttttat

SEQ ID NO: 631324 - DNA, 25 bp, Mus musculus
gggatcatgtcgctcacacagcaaa

SEQ ID NO: 631325 - DNA, 25 bp, Mus musculus
gggatcatgtcggtcacacagcaaa

SEQ ID NO: 631326 - DNA, 25 bp, Mus musculus
gggatcattaaaactggctcacata

SEQ ID NO: 631327 - DNA, 25 bp, Mus musculus
gggatcattaaatctggctcacata

SEQ ID NO: 631328 - DNA, 25 bp, Mus musculus
gggatcattacacggcacaacctga

SEQ ID NO: 631329 - DNA, 25 bp, Mus musculus
gggatcattacagggcacaacctga

SEQ ID NO: 631330 - DNA, 25 bp, Mus musculus
gggatcattgtgcaatcctctctta

SEQ ID NO: 631331 - DNA, 25 bp, Mus musculus
gggatcattgtggaatcctctctta

SEQ ID NO: 631332 - DNA, 25 bp, Mus musculus
gggatcatttaaagatcgcggaatg

SEQ ID NO: 631333 - DNA, 25 bp, Mus musculus
gggatcatttaatgatcgcggaatg

SEQ ID NO: 631334 - DNA, 25 bp, Mus musculus
gggatcattttgctattgacttcac

SEQ ID NO: 631335 - DNA, 25 bp, Mus musculus
gggatcattttggtattgacttcac

SEQ ID NO: 631336 - DNA, 25 bp, Mus musculus
gggatccaaaatcaggtcacagacg

SEQ ID NO: 631337 - DNA, 25 bp, Mus musculus
gggatccaaaatgaggtcacagacg

SEQ ID NO: 631338 - DNA, 25 bp, Mus musculus
gggatccaaacaaacgagcagatga

SEQ ID NO: 631339 - DNA, 25 bp, Mus musculus
gggatccaaacatacgagcagatga

SEQ ID NO: 631340 - DNA, 25 bp, Mus musculus
gggatccaacatacccggaaatgat

SEQ ID NO: 631341 - DNA, 25 bp, Mus musculus
gggatccaacattcccggaaatgat

SEQ ID NO: 631342 - DNA, 25 bp, Mus musculus
gggatccaacgacattgatacacta

SEQ ID NO: 631343 - DNA, 25 bp, Mus musculus
gggatccaacgagattgatacacta

SEQ ID NO: 631344 - DNA, 25 bp, Mus musculus
gggatccaacgtattataggttcat

SEQ ID NO: 631345 - DNA, 25 bp, Mus musculus
gggatccaacgttttataggttcat

SEQ ID NO: 631346 - DNA, 25 bp, Mus musculus
gggatccaagccattgctgatgcct

SEQ ID NO: 631347 - DNA, 25 bp, Mus musculus
gggatccaagcctttgctgatgcct

SEQ ID NO: 631348 - DNA, 25 bp, Mus musculus
gggatccaagctacgtggtctaaca

SEQ ID NO: 631349 - DNA, 25 bp, Mus musculus
gggatccaagcttcgtggtctaaca

SEQ ID NO: 631350 - DNA, 25 bp, Mus musculus
gggatccacaatccagggaccctca

SEQ ID NO: 631351 - DNA, 25 bp, Mus musculus
gggatccacaatgcagggaccctca

SEQ ID NO: 631352 - DNA, 25 bp, Mus musculus
gggatccacagaagcccttaagcat

SEQ ID NO: 631353 - DNA, 25 bp, Mus musculus
gggatccacagactatgtgttctta

SEQ ID NO: 631354 - DNA, 25 bp, Mus musculus
gggatccacagagtatgtgttctta

SEQ ID NO: 631355 - DNA, 25 bp, Mus musculus
gggatccacagatgcccttaagcat

SEQ ID NO: 631356 - DNA, 25 bp, Mus musculus
gggatccacatccaaattatcagaa

SEQ ID NO: 631357 - DNA, 25 bp, Mus musculus
gggatccacatcgaaattatcagaa

SEQ ID NO: 631358 - DNA, 25 bp, Mus musculus
gggatccactctacgctgcggtctg

SEQ ID NO: 631359 - DNA, 25 bp, Mus musculus
gggatccactcttcgctgcggtctg

SEQ ID NO: 631360 - DNA, 25 bp, Mus musculus
gggatccagacccagataaacaact

SEQ ID NO: 631361 - DNA, 25 bp, Mus musculus
gggatccagaccgagataaacaact

SEQ ID NO: 631362 - DNA, 25 bp, Mus musculus
gggatccagagacctagtcaccttg

SEQ ID NO: 631363 - DNA, 25 bp, Mus musculus
gggatccagagagctagtcaccttg

SEQ ID NO: 631364 - DNA, 25 bp, Mus musculus
gggatccagcagatctactttaaga

SEQ ID NO: 631365 - DNA, 25 bp, Mus musculus
gggatccagcagttctactttaaga

SEQ ID NO: 631366 - DNA, 25 bp, Mus musculus
gggatccaggatctctctgtgtagc

SEQ ID NO: 631367 - DNA, 25 bp, Mus musculus
gggatccaggatgtctctgtgtagc

SEQ ID NO: 631368 - DNA, 25 bp, Mus musculus
gggatccaggttcacacatcggact

SEQ ID NO: 631369 - DNA, 25 bp, Mus musculus
gggatccaggttgacacatcggact

SEQ ID NO: 631370 - DNA, 25 bp, Mus musculus
gggatccatagaccttgctggcccc

SEQ ID NO: 631371 - DNA, 25 bp, Mus musculus
gggatccatagagcttgctggcccc

SEQ ID NO: 631372 - DNA, 25 bp, Mus musculus
gggatccatcccagctattcaaaca

SEQ ID NO: 631373 - DNA, 25 bp, Mus musculus
gggatccatcccattattagctcca

SEQ ID NO: 631374 - DNA, 25 bp, Mus musculus
gggatccatccctgctattcaaaca

SEQ ID NO: 631375 - DNA, 25 bp, Mus musculus
gggatccatccctttattagctcca

SEQ ID NO: 631376 - DNA, 25 bp, Mus musculus
gggatccatggccttttatattgtg

SEQ ID NO: 631377 - DNA, 25 bp, Mus musculus
gggatccatggcgttttatattgtg

SEQ ID NO: 631378 - DNA, 25 bp, Mus musculus
gggatccatggtccaaactccatta

SEQ ID NO: 631379 - DNA, 25 bp, Mus musculus
gggatccatggtgcaaactccatta

SEQ ID NO: 631380 - DNA, 25 bp, Mus musculus
gggatccatgtgagccttccaggta

SEQ ID NO: 631381 - DNA, 25 bp, Mus musculus
gggatccatgtgtgccttccaggta

SEQ ID NO: 631382 - DNA, 25 bp, Mus musculus
gggatccattgaacccaaaggagaa

SEQ ID NO: 631383 - DNA, 25 bp, Mus musculus
gggatccattgatcccaaaggagaa

SEQ ID NO: 631384 - DNA, 25 bp, Mus musculus
gggatcccagccaggcaaacagaca

SEQ ID NO: 631385 - DNA, 25 bp, Mus musculus
gggatcccagcctggcaaacagaca

SEQ ID NO: 631386 - DNA, 25 bp, Mus musculus
gggatcccaggtaattagtatatat

SEQ ID NO: 631387 - DNA, 25 bp, Mus musculus
gggatcccaggttattagtatatat

SEQ ID NO: 631388 - DNA, 25 bp, Mus musculus
gggatcccatgcatgctgagatgat

SEQ ID NO: 631389 - DNA, 25 bp, Mus musculus
gggatcccatgcttgctgagatgat

SEQ ID NO: 631390 - DNA, 25 bp, Mus musculus
gggatccccacaattgaacaataaa

SEQ ID NO: 631391 - DNA, 25 bp, Mus musculus
gggatccccacatttgaacaataaa

SEQ ID NO: 631392 - DNA, 25 bp, Mus musculus
gggatccccattcgagcaaagccta

SEQ ID NO: 631393 - DNA, 25 bp, Mus musculus
gggatccccattggagcaaagccta

SEQ ID NO: 631394 - DNA, 25 bp, Mus musculus
gggatcccgaaactgcgaactctgt

SEQ ID NO: 631395 - DNA, 25 bp, Mus musculus
gggatcccgaaagtgcgaactctgt

SEQ ID NO: 631396 - DNA, 25 bp, Mus musculus
gggatcccgatgcagaagcctcgaa

SEQ ID NO: 631397 - DNA, 25 bp, Mus musculus
gggatcccgatggagaagcctcgaa

SEQ ID NO: 631398 - DNA, 25 bp, Mus musculus
gggatcccgcttaagcatatgcaaa

SEQ ID NO: 631399 - DNA, 25 bp, Mus musculus
gggatcccgctttagcatatgcaaa

SEQ ID NO: 631400 - DNA, 25 bp, Mus musculus
gggatcccgggacgagccgctgcgt

SEQ ID NO: 631401 - DNA, 25 bp, Mus musculus
gggatcccgggaggagccgctgcgt

SEQ ID NO: 631402 - DNA, 25 bp, Mus musculus
gggatccctctaacaaggtggactt

SEQ ID NO: 631403 - DNA, 25 bp, Mus musculus
gggatccctctatcaaggtggactt

SEQ ID NO: 631404 - DNA, 25 bp, Mus musculus
gggatccctgatcatgaaaaagtta

SEQ ID NO: 631405 - DNA, 25 bp, Mus musculus
gggatccctgatgatgaaaaagtta

SEQ ID NO: 631406 - DNA, 25 bp, Mus musculus
gggatccctgtgagctggtaccatg

SEQ ID NO: 631407 - DNA, 25 bp, Mus musculus
gggatccctgtgtgctggtaccatg

SEQ ID NO: 631408 - DNA, 25 bp, Mus musculus
gggatcccttcaatggccagagacc

SEQ ID NO: 631409 - DNA, 25 bp, Mus musculus
gggatcccttcattggccagagacc

SEQ ID NO: 631410 - DNA, 25 bp, Mus musculus
gggatcccttgacttttcagtgtta

SEQ ID NO: 631411 - DNA, 25 bp, Mus musculus
gggatcccttgagttttcagtgtta

SEQ ID NO: 631412 - DNA, 25 bp, Mus musculus
gggatccgaacacagttgactttta

SEQ ID NO: 631413 - DNA, 25 bp, Mus musculus
gggatccgaacagagttgactttta

SEQ ID NO: 631414 - DNA, 25 bp, Mus musculus
gggatccgcgacctgcagtcaagtt

SEQ ID NO: 631415 - DNA, 25 bp, Mus musculus
gggatccgcgacgtgcagtcaagtt

SEQ ID NO: 631416 - DNA, 25 bp, Mus musculus
gggatccgtagcacatggctgcgaa

SEQ ID NO: 631417 - DNA, 25 bp, Mus musculus
gggatccgtagctcatggctgcgaa

SEQ ID NO: 631418 - DNA, 25 bp, Mus musculus
gggatcctaagcaaatgccttccgt

SEQ ID NO: 631419 - DNA, 25 bp, Mus musculus
gggatcctaagccaagatgtacagc

SEQ ID NO: 631420 - DNA, 25 bp, Mus musculus
gggatcctaagcgaagatgtacagc

SEQ ID NO: 631421 - DNA, 25 bp, Mus musculus
gggatcctaagctaatgccttccgt

SEQ ID NO: 631422 - DNA, 25 bp, Mus musculus
gggatcctagaaccatccggttgga

SEQ ID NO: 631423 - DNA, 25 bp, Mus musculus
gggatcctagaagcatccggttgga

SEQ ID NO: 631424 - DNA, 25 bp, Mus musculus
gggatcctagagacaggccatccgt

SEQ ID NO: 631425 - DNA, 25 bp, Mus musculus
gggatcctagagtcaggccatccgt

SEQ ID NO: 631426 - DNA, 25 bp, Mus musculus
gggatcctcaagcatgggatcttga

SEQ ID NO: 631427 - DNA, 25 bp, Mus musculus
gggatcctcaaggatgggatcttga

SEQ ID NO: 631428 - DNA, 25 bp, Mus musculus
gggatcctcaggctatcattacctg

SEQ ID NO: 631429 - DNA, 25 bp, Mus musculus
gggatcctcagggtatcattacctg

SEQ ID NO: 631430 - DNA, 25 bp, Mus musculus
gggatcctccatccgtgtctattaa

SEQ ID NO: 631431 - DNA, 25 bp, Mus musculus
gggatcctccatgcgtgtctattaa

SEQ ID NO: 631432 - DNA, 25 bp, Mus musculus
gggatcctcccactaatttacagaa

SEQ ID NO: 631433 - DNA, 25 bp, Mus musculus
gggatcctcccagtaatttacagaa

SEQ ID NO: 631434 - DNA, 25 bp, Mus musculus
gggatcctcgaaatgtcagactaga

SEQ ID NO: 631435 - DNA, 25 bp, Mus musculus
gggatcctcgaattgtcagactaga

SEQ ID NO: 631436 - DNA, 25 bp, Mus musculus
gggatcctcttcagattatagaacc

SEQ ID NO: 631437 - DNA, 25 bp, Mus musculus
gggatcctcttctgattatagaacc

SEQ ID NO: 631438 - DNA, 25 bp, Mus musculus
gggatcctcttgacattcctcaaaa

SEQ ID NO: 631439 - DNA, 25 bp, Mus musculus
gggatcctcttgtcattcctcaaaa

SEQ ID NO: 631440 - DNA, 25 bp, Mus musculus
gggatcctgactcacgtgtcataga

SEQ ID NO: 631441 - DNA, 25 bp, Mus musculus
gggatcctgactgacgtgtcataga

SEQ ID NO: 631442 - DNA, 25 bp, Mus musculus
gggatcctgagaaaatacctcttgt

SEQ ID NO: 631443 - DNA, 25 bp, Mus musculus
gggatcctgagataatacctcttgt

SEQ ID NO: 631444 - DNA, 25 bp, Mus musculus
gggatcctgagtagatcaaccttaa

SEQ ID NO: 631445 - DNA, 25 bp, Mus musculus
gggatcctgagttgatcaaccttaa

SEQ ID NO: 631446 - DNA, 25 bp, Mus musculus
gggatcctgatcatgtactatgtga

SEQ ID NO: 631447 - DNA, 25 bp, Mus musculus
gggatcctgatcttgtactatgtga

SEQ ID NO: 631448 - DNA, 25 bp, Mus musculus
gggatcctgccgatgccactcgctg

SEQ ID NO: 631449 - DNA, 25 bp, Mus musculus
gggatcctgccgttgccactcgctg

SEQ ID NO: 631450 - DNA, 25 bp, Mus musculus
gggatcctgggaactatgtagagaa

SEQ ID NO: 631451 - DNA, 25 bp, Mus musculus
gggatcctgggatctatgtagagaa

SEQ ID NO: 631452 - DNA, 25 bp, Mus musculus
gggatcctgggcacgctgcacagca

SEQ ID NO: 631453 - DNA, 25 bp, Mus musculus
gggatcctgggctcgctgcacagca

SEQ ID NO: 631454 - DNA, 25 bp, Mus musculus
gggatcctggtgacataccatatca

SEQ ID NO: 631455 - DNA, 25 bp, Mus musculus
gggatcctggtgacctacaaagtta

SEQ ID NO: 631456 - DNA, 25 bp, Mus musculus
gggatcctggtgtcataccatatca

SEQ ID NO: 631457 - DNA, 25 bp, Mus musculus
gggatcctggtgtcctacaaagtta

SEQ ID NO: 631458 - DNA, 25 bp, Mus musculus
gggatcctggttagaccatgtgaaa

SEQ ID NO: 631459 - DNA, 25 bp, Mus musculus
gggatcctggtttgaccatgtgaaa

SEQ ID NO: 631460 - DNA, 25 bp, Mus musculus
gggatcctgtgcattttatccagag

SEQ ID NO: 631461 - DNA, 25 bp, Mus musculus
gggatcctgtgctttttatccagag

SEQ ID NO: 631462 - DNA, 25 bp, Mus musculus
gggatccttagcagagcaacgcatt

SEQ ID NO: 631463 - DNA, 25 bp, Mus musculus
gggatccttagctgagcaacgcatt

SEQ ID NO: 631464 - DNA, 25 bp, Mus musculus
gggatccttctcatgggtccacggg

SEQ ID NO: 631465 - DNA, 25 bp, Mus musculus
gggatccttctcttgggtccacggg

SEQ ID NO: 631466 - DNA, 25 bp, Mus musculus
gggatccttttgacaacagcagccg

SEQ ID NO: 631467 - DNA, 25 bp, Mus musculus
gggatccttttgtcaacagcagccg

SEQ ID NO: 631468 - DNA, 25 bp, Mus musculus
gggatcgaggaacactaacagcaat

SEQ ID NO: 631469 - DNA, 25 bp, Mus musculus
gggatcgaggaagactaacagcaat

SEQ ID NO: 631470 - DNA, 25 bp, Mus musculus
gggatcgagtctaaactctgtgcca

SEQ ID NO: 631471 - DNA, 25 bp, Mus musculus
gggatcgagtcttaactctgtgcca

SEQ ID NO: 631472 - DNA, 25 bp, Mus musculus
gggatcgcagaaccagggcatctcc

SEQ ID NO: 631473 - DNA, 25 bp, Mus musculus
gggatcgcagaagcagggcatctcc

SEQ ID NO: 631474 - DNA, 25 bp, Mus musculus
gggatcgcatgaataagctcttcaa

SEQ ID NO: 631475 - DNA, 25 bp, Mus musculus
gggatcgcatgattaagctcttcaa

SEQ ID NO: 631476 - DNA, 25 bp, Mus musculus
gggatcgcttaaagagtgcccatca

SEQ ID NO: 631477 - DNA, 25 bp, Mus musculus
gggatcgcttaatgagtgcccatca

SEQ ID NO: 631478 - DNA, 25 bp, Mus musculus
gggatcgctttgatgtgcaaggact

SEQ ID NO: 631479 - DNA, 25 bp, Mus musculus
gggatcgctttgttgtgcaaggact

SEQ ID NO: 631480 - DNA, 25 bp, Mus musculus
gggatcggaagacaccaaatcaaat

SEQ ID NO: 631481 - DNA, 25 bp, Mus musculus
gggatcggaagagaccaaatcaaat

SEQ ID NO: 631482 - DNA, 25 bp, Mus musculus
gggatcggcttcactccttacaaac

SEQ ID NO: 631483 - DNA, 25 bp, Mus musculus
gggatcggcttctctccttacaaac

SEQ ID NO: 631484 - DNA, 25 bp, Mus musculus
gggatcgttgtgcacaagccgcctt

SEQ ID NO: 631485 - DNA, 25 bp, Mus musculus
gggatcgttgtggacaagccgcctt

SEQ ID NO: 631486 - DNA, 25 bp, Mus musculus
gggatctaactccaaggtgctgttt

SEQ ID NO: 631487 - DNA, 25 bp, Mus musculus
gggatctaactcgaaggtgctgttt

SEQ ID NO: 631488 - DNA, 25 bp, Mus musculus
gggatctaatacagtcctggatata

SEQ ID NO: 631489 - DNA, 25 bp, Mus musculus
gggatctaatactgtcctggatata

SEQ ID NO: 631490 - DNA, 25 bp, Mus musculus
gggatctaatgtccctctagttaac

SEQ ID NO: 631491 - DNA, 25 bp, Mus musculus
gggatctaatgtgcctctagttaac

SEQ ID NO: 631492 - DNA, 25 bp, Mus musculus
gggatctaattcctgtggacgtcaa

SEQ ID NO: 631493 - DNA, 25 bp, Mus musculus
gggatctaattcgtgtggacgtcaa

SEQ ID NO: 631494 - DNA, 25 bp, Mus musculus
gggatctacaacatgtacggctaaa

SEQ ID NO: 631495 - DNA, 25 bp, Mus musculus
gggatctacaacttgtacggctaaa

SEQ ID NO: 631496 - DNA, 25 bp, Mus musculus
gggatctaccacatgtgtatctatg

SEQ ID NO: 631497 - DNA, 25 bp, Mus musculus
gggatctaccacttgtgtatctatg

SEQ ID NO: 631498 - DNA, 25 bp, Mus musculus
gggatctacgttcttgttcctggca

SEQ ID NO: 631499 - DNA, 25 bp, Mus musculus
gggatctacgttgttgttcctggca

SEQ ID NO: 631500 - DNA, 25 bp, Mus musculus
gggatctactggagacctcagagca

SEQ ID NO: 631501 - DNA, 25 bp, Mus musculus
gggatctactggtgacctcagagca

SEQ ID NO: 631502 - DNA, 25 bp, Mus musculus
gggatctagcacacaaatgactttc

SEQ ID NO: 631503 - DNA, 25 bp, Mus musculus
gggatctagcactcaaatgactttc

SEQ ID NO: 631504 - DNA, 25 bp, Mus musculus
gggatctaggttaacatggcctcac

SEQ ID NO: 631505 - DNA, 25 bp, Mus musculus
gggatctaggtttacatggcctcac

SEQ ID NO: 631506 - DNA, 25 bp, Mus musculus
gggatctataccactgaacaccatc

SEQ ID NO: 631507 - DNA, 25 bp, Mus musculus
gggatctatacctctgaacaccatc

SEQ ID NO: 631508 - DNA, 25 bp, Mus musculus
gggatctatccacaggtcctcgagc

SEQ ID NO: 631509 - DNA, 25 bp, Mus musculus
gggatctatccagaggtcctcgagc

SEQ ID NO: 631510 - DNA, 25 bp, Mus musculus
gggatctatcccagagttctatctc

SEQ ID NO: 631511 - DNA, 25 bp, Mus musculus
gggatctatccctgagttctatctc

SEQ ID NO: 631512 - DNA, 25 bp, Mus musculus
gggatctatttccaagatgccctta

SEQ ID NO: 631513 - DNA, 25 bp, Mus musculus
gggatctatttcgaagatgccctta

SEQ ID NO: 631514 - DNA, 25 bp, Mus musculus
gggatctcaactcactcctcttgta

SEQ ID NO: 631515 - DNA, 25 bp, Mus musculus
gggatctcaactgactcctcttgta

SEQ ID NO: 631516 - DNA, 25 bp, Mus musculus
gggatctcaatgaggctcatgaaga

SEQ ID NO: 631517 - DNA, 25 bp, Mus musculus
gggatctcaatgtggctcatgaaga

SEQ ID NO: 631518 - DNA, 25 bp, Mus musculus
gggatctcagcgcaattacagttta

SEQ ID NO: 631519 - DNA, 25 bp, Mus musculus
gggatctcagcggaattacagttta

SEQ ID NO: 631520 - DNA, 25 bp, Mus musculus
gggatctcagtacgaaactgctttt

SEQ ID NO: 631521 - DNA, 25 bp, Mus musculus
gggatctcagtaggaaactgctttt

SEQ ID NO: 631522 - DNA, 25 bp, Mus musculus
gggatctcatagagcatctcctaag

SEQ ID NO: 631523 - DNA, 25 bp, Mus musculus
gggatctcatagtgcatctcctaag

SEQ ID NO: 631524 - DNA, 25 bp, Mus musculus
gggatctcattgatatgcacacaca

SEQ ID NO: 631525 - DNA, 25 bp, Mus musculus
gggatctcattgttatgcacacaca

SEQ ID NO: 631526 - DNA, 25 bp, Mus musculus
gggatctccaggacaaaatcaatag

SEQ ID NO: 631527 - DNA, 25 bp, Mus musculus
gggatctccaggtcaaaatcaatag

SEQ ID NO: 631528 - DNA, 25 bp, Mus musculus
gggatctccgtgaattcgaggccag

SEQ ID NO: 631529 - DNA, 25 bp, Mus musculus
gggatctccgtgtattcgaggccag

SEQ ID NO: 631530 - DNA, 25 bp, Mus musculus
gggatctcgaggcttacctggattc

SEQ ID NO: 631531 - DNA, 25 bp, Mus musculus
gggatctcgagggttacctggattc

SEQ ID NO: 631532 - DNA, 25 bp, Mus musculus
gggatctcgatgctgataccacctt

SEQ ID NO: 631533 - DNA, 25 bp, Mus musculus
gggatctcgatggtgataccacctt

SEQ ID NO: 631534 - DNA, 25 bp, Mus musculus
gggatctctatgcagacaccaggta

SEQ ID NO: 631535 - DNA, 25 bp, Mus musculus
gggatctctatggagacaccaggta

SEQ ID NO: 631536 - DNA, 25 bp, Mus musculus
gggatctctctacaccataagcatt

SEQ ID NO: 631537 - DNA, 25 bp, Mus musculus
gggatctctctagaccataagcatt

SEQ ID NO: 631538 - DNA, 25 bp, Mus musculus
gggatctctctgcagtactgctaac

SEQ ID NO: 631539 - DNA, 25 bp, Mus musculus
gggatctctctggagtactgctaac

SEQ ID NO: 631540 - DNA, 25 bp, Mus musculus
gggatctctcttctttttatgatat

SEQ ID NO: 631541 - DNA, 25 bp, Mus musculus
gggatctctcttgtttttatgatat

SEQ ID NO: 631542 - DNA, 25 bp, Mus musculus
gggatctgaacaaacgccctttgta

SEQ ID NO: 631543 - DNA, 25 bp, Mus musculus
gggatctgaacatacgccctttgta

SEQ ID NO: 631544 - DNA, 25 bp, Mus musculus
gggatctgaatcctacaagctcctg

SEQ ID NO: 631545 - DNA, 25 bp, Mus musculus
gggatctgaatcgtacaagctcctg

SEQ ID NO: 631546 - DNA, 25 bp, Mus musculus
gggatctgaattctccattccttaa

SEQ ID NO: 631547 - DNA, 25 bp, Mus musculus
gggatctgaattgtccattccttaa

SEQ ID NO: 631548 - DNA, 25 bp, Mus musculus
gggatctgagggaacagccccttaa

SEQ ID NO: 631549 - DNA, 25 bp, Mus musculus
gggatctgagggtacagccccttaa

SEQ ID NO: 631550 - DNA, 25 bp, Mus musculus
gggatctgatgcaggttctgtaacg

SEQ ID NO: 631551 - DNA, 25 bp, Mus musculus
gggatctgatgccagcctaaatagg

SEQ ID NO: 631552 - DNA, 25 bp, Mus musculus
gggatctgatgcctaggtcctctac

SEQ ID NO: 631553 - DNA, 25 bp, Mus musculus
gggatctgatgcgagcctaaatagg

SEQ ID NO: 631554 - DNA, 25 bp, Mus musculus
gggatctgatgcgtaggtcctctac

SEQ ID NO: 631555 - DNA, 25 bp, Mus musculus
gggatctgatgctggttctgtaacg

SEQ ID NO: 631556 - DNA, 25 bp, Mus musculus
gggatctgcaagacttgttcctgta

SEQ ID NO: 631557 - DNA, 25 bp, Mus musculus
gggatctgcaagtcttgttcctgta

SEQ ID NO: 631558 - DNA, 25 bp, Mus musculus
gggatctgcagaatcactgcatctc

SEQ ID NO: 631559 - DNA, 25 bp, Mus musculus
gggatctgcagattcactgcatctc

SEQ ID NO: 631560 - DNA, 25 bp, Mus musculus
gggatctgcagtaccaggctcctga

SEQ ID NO: 631561 - DNA, 25 bp, Mus musculus
gggatctgcagttccaggctcctga

SEQ ID NO: 631562 - DNA, 25 bp, Mus musculus
gggatctgcatacttctctctattc

SEQ ID NO: 631563 - DNA, 25 bp, Mus musculus
gggatctgcatagttctctctattc

SEQ ID NO: 631564 - DNA, 25 bp, Mus musculus
gggatctgcatgactttgcctactg

SEQ ID NO: 631565 - DNA, 25 bp, Mus musculus
gggatctgcatgtctttgcctactg

SEQ ID NO: 631566 - DNA, 25 bp, Mus musculus
gggatctgcctaaatatgtcctatc

SEQ ID NO: 631567 - DNA, 25 bp, Mus musculus
gggatctgcctatatatgtcctatc

SEQ ID NO: 631568 - DNA, 25 bp, Mus musculus
gggatctgctctagctaataaccat

SEQ ID NO: 631569 - DNA, 25 bp, Mus musculus
gggatctgctcttgctaataaccat

SEQ ID NO: 631570 - DNA, 25 bp, Mus musculus
gggatctgcttaaaactttctgaca

SEQ ID NO: 631571 - DNA, 25 bp, Mus musculus
gggatctgcttataactttctgaca

SEQ ID NO: 631572 - DNA, 25 bp, Mus musculus
gggatctgctttagcctgataaccc

SEQ ID NO: 631573 - DNA, 25 bp, Mus musculus
gggatctgcttttgcctgataaccc

SEQ ID NO: 631574 - DNA, 25 bp, Mus musculus
gggatctggattacaaatgcctaag

SEQ ID NO: 631575 - DNA, 25 bp, Mus musculus
gggatctggatttcaaatgcctaag

SEQ ID NO: 631576 - DNA, 25 bp, Mus musculus
gggatctggcacacttctttctaac

SEQ ID NO: 631577 - DNA, 25 bp, Mus musculus
gggatctggcactcttctttctaac

SEQ ID NO: 631578 - DNA, 25 bp, Mus musculus
gggatctggcctcagcctgtccttg

SEQ ID NO: 631579 - DNA, 25 bp, Mus musculus
gggatctggcctgagcctgtccttg

SEQ ID NO: 631580 - DNA, 25 bp, Mus musculus
gggatctgggagacacatttgtcat

SEQ ID NO: 631581 - DNA, 25 bp, Mus musculus
gggatctgggagtcacatttgtcat

SEQ ID NO: 631582 - DNA, 25 bp, Mus musculus
gggatctgggtcacatgcttatcct

SEQ ID NO: 631583 - DNA, 25 bp, Mus musculus
gggatctgggtctcatgcttatcct

SEQ ID NO: 631584 - DNA, 25 bp, Mus musculus
gggatctggtctatttctgttcaca

SEQ ID NO: 631585 - DNA, 25 bp, Mus musculus
gggatctggtctttttctgttcaca

SEQ ID NO: 631586 - DNA, 25 bp, Mus musculus
gggatctggtgccatattctgacct

SEQ ID NO: 631587 - DNA, 25 bp, Mus musculus
gggatctggtgcgatattctgacct

SEQ ID NO: 631588 - DNA, 25 bp, Mus musculus
gggatctggtggatcgttgatctta

SEQ ID NO: 631589 - DNA, 25 bp, Mus musculus
gggatctggtggttcgttgatctta

SEQ ID NO: 631590 - DNA, 25 bp, Mus musculus
gggatctgtaaaaacttcttatgac

SEQ ID NO: 631591 - DNA, 25 bp, Mus musculus
gggatctgtaaatacttcttatgac

SEQ ID NO: 631592 - DNA, 25 bp, Mus musculus
gggatctgtccccatgtttgggaca

SEQ ID NO: 631593 - DNA, 25 bp, Mus musculus
gggatctgtcccgatgtttgggaca

SEQ ID NO: 631594 - DNA, 25 bp, Mus musculus
gggatctgtggcattgtacatgata

SEQ ID NO: 631595 - DNA, 25 bp, Mus musculus
gggatctgtggctttgtacatgata

SEQ ID NO: 631596 - DNA, 25 bp, Mus musculus
gggatctgttcaccaacatggaagt

SEQ ID NO: 631597 - DNA, 25 bp, Mus musculus
gggatctgttcagcaacatggaagt

SEQ ID NO: 631598 - DNA, 25 bp, Mus musculus
gggatctgtttgaagtcagctgtta

SEQ ID NO: 631599 - DNA, 25 bp, Mus musculus
gggatctgtttgtagtcagctgtta

SEQ ID NO: 631600 - DNA, 25 bp, Mus musculus
gggatcttccaaacttcaacaacat

SEQ ID NO: 631601 - DNA, 25 bp, Mus musculus
gggatcttccaatcttcaacaacat

SEQ ID NO: 631602 - DNA, 25 bp, Mus musculus
gggatcttcttgacagtttctcaag

SEQ ID NO: 631603 - DNA, 25 bp, Mus musculus
gggatcttcttgtcagtttctcaag

SEQ ID NO: 631604 - DNA, 25 bp, Mus musculus
gggatcttgagtccctacattctaa

SEQ ID NO: 631605 - DNA, 25 bp, Mus musculus
gggatcttgagtgcctacattctaa

SEQ ID NO: 631606 - DNA, 25 bp, Mus musculus
gggatcttgcagcaacccagacatc

SEQ ID NO: 631607 - DNA, 25 bp, Mus musculus
gggatcttgcaggaacccagacatc

SEQ ID NO: 631608 - DNA, 25 bp, Mus musculus
gggatcttggagctttgcctaaaaa

SEQ ID NO: 631609 - DNA, 25 bp, Mus musculus
gggatcttggaggtttgcctaaaaa

SEQ ID NO: 631610 - DNA, 25 bp, Mus musculus
gggatcttggatccccaggtgccta

SEQ ID NO: 631611 - DNA, 25 bp, Mus musculus
gggatcttggatgcccaggtgccta

SEQ ID NO: 631612 - DNA, 25 bp, Mus musculus
gggatcttggtgactgtcttaccca

SEQ ID NO: 631613 - DNA, 25 bp, Mus musculus
gggatcttggtgtctgtcttaccca

SEQ ID NO: 631614 - DNA, 25 bp, Mus musculus
gggatcttgtctacaggacacagca

SEQ ID NO: 631615 - DNA, 25 bp, Mus musculus
gggatcttgtcttcaggacacagca

SEQ ID NO: 631616 - DNA, 25 bp, Mus musculus
gggatcttgtgcaagtttctctgtc

SEQ ID NO: 631617 - DNA, 25 bp, Mus musculus
gggatcttgtgctagtttctctgtc

SEQ ID NO: 631618 - DNA, 25 bp, Mus musculus
gggatctttattccagattgtttga

SEQ ID NO: 631619 - DNA, 25 bp, Mus musculus
gggatctttattgcagattgtttga

SEQ ID NO: 631620 - DNA, 25 bp, Mus musculus
gggatctttcagaatctattcattc

SEQ ID NO: 631621 - DNA, 25 bp, Mus musculus
gggatctttcagtatctattcattc

SEQ ID NO: 631622 - DNA, 25 bp, Mus musculus
gggatgaaacccatgcctacactgc

SEQ ID NO: 631623 - DNA, 25 bp, Mus musculus
gggatgaaacccttgcctacactgc

SEQ ID NO: 631624 - DNA, 25 bp, Mus musculus
gggatgaaagaccaccagaacaact

SEQ ID NO: 631625 - DNA, 25 bp, Mus musculus
gggatgaaagacgaccagaacaact

SEQ ID NO: 631626 - DNA, 25 bp, Mus musculus
gggatgaaagccacccttctaggga

SEQ ID NO: 631627 - DNA, 25 bp, Mus musculus
gggatgaaagcctcccttctaggga

SEQ ID NO: 631628 - DNA, 25 bp, Mus musculus
gggatgaacaccagactgtggcgcc

SEQ ID NO: 631629 - DNA, 25 bp, Mus musculus
gggatgaacacctgactgtggcgcc

SEQ ID NO: 631630 - DNA, 25 bp, Mus musculus
gggatgaacagtagcctcggctaaa

SEQ ID NO: 631631 - DNA, 25 bp, Mus musculus
gggatgaacagttgcctcggctaaa

SEQ ID NO: 631632 - DNA, 25 bp, Mus musculus
gggatgaacctaactttcagtgatg

SEQ ID NO: 631633 - DNA, 25 bp, Mus musculus
gggatgaacctatctttcagtgatg

SEQ ID NO: 631634 - DNA, 25 bp, Mus musculus
gggatgaagaacagaaggcgttcct

SEQ ID NO: 631635 - DNA, 25 bp, Mus musculus
gggatgaagaactgaaggcgttcct

SEQ ID NO: 631636 - DNA, 25 bp, Mus musculus
gggatgaagagaaagctcacattct

SEQ ID NO: 631637 - DNA, 25 bp, Mus musculus
gggatgaagagatagctcacattct

SEQ ID NO: 631638 - DNA, 25 bp, Mus musculus
gggatgaagccaatgctaagaagcg

SEQ ID NO: 631639 - DNA, 25 bp, Mus musculus
gggatgaagccattgctaagaagcg

SEQ ID NO: 631640 - DNA, 25 bp, Mus musculus
gggatgaagcttactcattatcaag

SEQ ID NO: 631641 - DNA, 25 bp, Mus musculus
gggatgaagctttctcattatcaag

SEQ ID NO: 631642 - DNA, 25 bp, Mus musculus
gggatgaatatcaaactcaggaccc

SEQ ID NO: 631643 - DNA, 25 bp, Mus musculus
gggatgaatatctaactcaggaccc

SEQ ID NO: 631644 - DNA, 25 bp, Mus musculus
gggatgaatctgatagcacacctca

SEQ ID NO: 631645 - DNA, 25 bp, Mus musculus
gggatgaatctgttagcacacctca

SEQ ID NO: 631646 - DNA, 25 bp, Mus musculus
gggatgaattatcgaatctctcaaa

SEQ ID NO: 631647 - DNA, 25 bp, Mus musculus
gggatgaattatggaatctctcaaa

SEQ ID NO: 631648 - DNA, 25 bp, Mus musculus
gggatgacaaggacataacctgtat

SEQ ID NO: 631649 - DNA, 25 bp, Mus musculus
gggatgacaaggtcataacctgtat

SEQ ID NO: 631650 - DNA, 25 bp, Mus musculus
gggatgacacatcactgaccacaca

SEQ ID NO: 631651 - DNA, 25 bp, Mus musculus
gggatgacacatgactgaccacaca

SEQ ID NO: 631652 - DNA, 25 bp, Mus musculus
gggatgacagccacccttgaagtct

SEQ ID NO: 631653 - DNA, 25 bp, Mus musculus
gggatgacagcctcccttgaagtct

SEQ ID NO: 631654 - DNA, 25 bp, Mus musculus
gggatgaccacgatattaccacctt

SEQ ID NO: 631655 - DNA, 25 bp, Mus musculus
gggatgaccacgttattaccacctt

SEQ ID NO: 631656 - DNA, 25 bp, Mus musculus
gggatgaccgagatgttacatgctt

SEQ ID NO: 631657 - DNA, 25 bp, Mus musculus
gggatgaccgagttgttacatgctt

SEQ ID NO: 631658 - DNA, 25 bp, Mus musculus
gggatgaccttgaccttacaggaaa

SEQ ID NO: 631659 - DNA, 25 bp, Mus musculus
gggatgaccttgtccttacaggaaa

SEQ ID NO: 631660 - DNA, 25 bp, Mus musculus
gggatgacgcagaccctacaggcag

SEQ ID NO: 631661 - DNA, 25 bp, Mus musculus
gggatgacgcagtccctacaggcag

SEQ ID NO: 631662 - DNA, 25 bp, Mus musculus
gggatgactacccagatagccagtt

SEQ ID NO: 631663 - DNA, 25 bp, Mus musculus
gggatgactaccgagatagccagtt

SEQ ID NO: 631664 - DNA, 25 bp, Mus musculus
gggatgactatacccctacattctc

SEQ ID NO: 631665 - DNA, 25 bp, Mus musculus
gggatgactatagccctacattctc

SEQ ID NO: 631666 - DNA, 25 bp, Mus musculus
gggatgactatcacgcagctcaagt

SEQ ID NO: 631667 - DNA, 25 bp, Mus musculus
gggatgactatctcgcagctcaagt

SEQ ID NO: 631668 - DNA, 25 bp, Mus musculus
gggatgactccacccgcaagcagag

SEQ ID NO: 631669 - DNA, 25 bp, Mus musculus
gggatgactccagccgcaagcagag

SEQ ID NO: 631670 - DNA, 25 bp, Mus musculus
gggatgactcgaatccaggaccttg

SEQ ID NO: 631671 - DNA, 25 bp, Mus musculus
gggatgactcgattccaggaccttg

SEQ ID NO: 631672 - DNA, 25 bp, Mus musculus
gggatgacttcccaaccgacattcg

SEQ ID NO: 631673 - DNA, 25 bp, Mus musculus
gggatgacttccgaaccgacattcg

SEQ ID NO: 631674 - DNA, 25 bp, Mus musculus
gggatgacttttcaggccccacctg

SEQ ID NO: 631675 - DNA, 25 bp, Mus musculus
gggatgacttttgaggccccacctg

SEQ ID NO: 631676 - DNA, 25 bp, Mus musculus
gggatgagaagtcgacaatttctca

SEQ ID NO: 631677 - DNA, 25 bp, Mus musculus
gggatgagaagtggacaatttctca

SEQ ID NO: 631678 - DNA, 25 bp, Mus musculus
gggatgagactcctgtcttctcctt

SEQ ID NO: 631679 - DNA, 25 bp, Mus musculus
gggatgagactcgtgtcttctcctt

SEQ ID NO: 631680 - DNA, 25 bp, Mus musculus
gggatgagatctagcccaggcaacc

SEQ ID NO: 631681 - DNA, 25 bp, Mus musculus
gggatgagatcttgcccaggcaacc

SEQ ID NO: 631682 - DNA, 25 bp, Mus musculus
gggatgagattcaggcttctgtgct

SEQ ID NO: 631683 - DNA, 25 bp, Mus musculus
gggatgagattctggcttctgtgct

SEQ ID NO: 631684 - DNA, 25 bp, Mus musculus
gggatgagcaaaacggcttcctttg

SEQ ID NO: 631685 - DNA, 25 bp, Mus musculus
gggatgagcaaatcggcttcctttg

SEQ ID NO: 631686 - DNA, 25 bp, Mus musculus
gggatgagcacactcacccagctgt

SEQ ID NO: 631687 - DNA, 25 bp, Mus musculus
gggatgagcacagtcacccagctgt

SEQ ID NO: 631688 - DNA, 25 bp, Mus musculus
gggatgagccccatcgtcggccagt

SEQ ID NO: 631689 - DNA, 25 bp, Mus musculus
gggatgagccccatgcaacggcacc

SEQ ID NO: 631690 - DNA, 25 bp, Mus musculus
gggatgagccccttcgtcggccagt

SEQ ID NO: 631691 - DNA, 25 bp, Mus musculus
gggatgagccccttgcaacggcacc

SEQ ID NO: 631692 - DNA, 25 bp, Mus musculus
gggatgaggctaaccctgagccaat

SEQ ID NO: 631693 - DNA, 25 bp, Mus musculus
gggatgaggctatccctgagccaat

SEQ ID NO: 631694 - DNA, 25 bp, Mus musculus
gggatgaggtttaccccctctacag

SEQ ID NO: 631695 - DNA, 25 bp, Mus musculus
gggatgaggttttccccctctacag

SEQ ID NO: 631696 - DNA, 25 bp, Mus musculus
gggatgatcaagattgacctctcgt

SEQ ID NO: 631697 - DNA, 25 bp, Mus musculus
gggatgatcaagtttgacctctcgt

SEQ ID NO: 631698 - DNA, 25 bp, Mus musculus
gggatgatcacacagctaactgcgg

SEQ ID NO: 631699 - DNA, 25 bp, Mus musculus
gggatgatcacagagctaactgcgg

SEQ ID NO: 631700 - DNA, 25 bp, Mus musculus
gggatgatcataaatcaacagagct

SEQ ID NO: 631701 - DNA, 25 bp, Mus musculus
gggatgatcatatatcaacagagct

SEQ ID NO: 631702 - DNA, 25 bp, Mus musculus
gggatgatcatcagctaccaatgtg

SEQ ID NO: 631703 - DNA, 25 bp, Mus musculus
gggatgatcatcctcttgctttgaa

SEQ ID NO: 631704 - DNA, 25 bp, Mus musculus
gggatgatcatcgtcttgctttgaa

SEQ ID NO: 631705 - DNA, 25 bp, Mus musculus
gggatgatcatctgctaccaatgtg

SEQ ID NO: 631706 - DNA, 25 bp, Mus musculus
gggatgatcctcaagaaccaagctt

SEQ ID NO: 631707 - DNA, 25 bp, Mus musculus
gggatgatcctctagaaccaagctt

SEQ ID NO: 631708 - DNA, 25 bp, Mus musculus
gggatgatccttagtgtgctcacgg

SEQ ID NO: 631709 - DNA, 25 bp, Mus musculus
gggatgatcctttgtgtgctcacgg

SEQ ID NO: 631710 - DNA, 25 bp, Mus musculus
gggatgatgaaaacctggccaataa

SEQ ID NO: 631711 - DNA, 25 bp, Mus musculus
gggatgatgaaatcctggccaataa

SEQ ID NO: 631712 - DNA, 25 bp, Mus musculus
gggatgattttgcactcccagttcc

SEQ ID NO: 631713 - DNA, 25 bp, Mus musculus
gggatgattttggactcccagttcc

SEQ ID NO: 631714 - DNA, 25 bp, Mus musculus
gggatgcaacttatcagagaacctc

SEQ ID NO: 631715 - DNA, 25 bp, Mus musculus
gggatgcaacttttcagagaacctc

SEQ ID NO: 631716 - DNA, 25 bp, Mus musculus
gggatgcaagaaaggcccattttaa

SEQ ID NO: 631717 - DNA, 25 bp, Mus musculus
gggatgcaagaatggcccattttaa

SEQ ID NO: 631718 - DNA, 25 bp, Mus musculus
gggatgcacatacctcaagtttaaa

SEQ ID NO: 631719 - DNA, 25 bp, Mus musculus
gggatgcacatagctcaagtttaaa

SEQ ID NO: 631720 - DNA, 25 bp, Mus musculus
gggatgcacattaagccattcatta

SEQ ID NO: 631721 - DNA, 25 bp, Mus musculus
gggatgcacatttagccattcatta

SEQ ID NO: 631722 - DNA, 25 bp, Mus musculus
gggatgcactaaattcagagctgaa

SEQ ID NO: 631723 - DNA, 25 bp, Mus musculus
gggatgcactaatttcagagctgaa

SEQ ID NO: 631724 - DNA, 25 bp, Mus musculus
gggatgcactgaacaatatttcttt

SEQ ID NO: 631725 - DNA, 25 bp, Mus musculus
gggatgcactgatcaatatttcttt

SEQ ID NO: 631726 - DNA, 25 bp, Mus musculus
gggatgcagacccaaggtttccatt

SEQ ID NO: 631727 - DNA, 25 bp, Mus musculus
gggatgcagaccgaaggtttccatt

SEQ ID NO: 631728 - DNA, 25 bp, Mus musculus
gggatgcagagtaagagagcttctt

SEQ ID NO: 631729 - DNA, 25 bp, Mus musculus
gggatgcagagttagagagcttctt

SEQ ID NO: 631730 - DNA, 25 bp, Mus musculus
gggatgcaggcccttaattccatca

SEQ ID NO: 631731 - DNA, 25 bp, Mus musculus
gggatgcaggccgttaattccatca

SEQ ID NO: 631732 - DNA, 25 bp, Mus musculus
gggatgcatttgagctgactgtgtc

SEQ ID NO: 631733 - DNA, 25 bp, Mus musculus
gggatgcatttgtgctgactgtgtc

SEQ ID NO: 631734 - DNA, 25 bp, Mus musculus
gggatgccaacaactagcttcttcc

SEQ ID NO: 631735 - DNA, 25 bp, Mus musculus
gggatgccaacatctagcttcttcc

SEQ ID NO: 631736 - DNA, 25 bp, Mus musculus
gggatgccacatatcataactgttt

SEQ ID NO: 631737 - DNA, 25 bp, Mus musculus
gggatgccacatttcataactgttt

SEQ ID NO: 631738 - DNA, 25 bp, Mus musculus
gggatgccaccacgctaggaagctc

SEQ ID NO: 631739 - DNA, 25 bp, Mus musculus
gggatgccaccaggctaggaagctc

SEQ ID NO: 631740 - DNA, 25 bp, Mus musculus
gggatgccagcacaaccttgagacg

SEQ ID NO: 631741 - DNA, 25 bp, Mus musculus
gggatgccagcagaaccttgagacg

SEQ ID NO: 631742 - DNA, 25 bp, Mus musculus
gggatgcccaccctagagtgcagca

SEQ ID NO: 631743 - DNA, 25 bp, Mus musculus
gggatgcccaccgtagagtgcagca

SEQ ID NO: 631744 - DNA, 25 bp, Mus musculus
gggatgcccctcaggtgaaagtatc

SEQ ID NO: 631745 - DNA, 25 bp, Mus musculus
gggatgcccctctggtgaaagtatc

SEQ ID NO: 631746 - DNA, 25 bp, Mus musculus
gggatgcccgcacaaaacagctgag

SEQ ID NO: 631747 - DNA, 25 bp, Mus musculus
gggatgcccgcagaaaacagctgag

SEQ ID NO: 631748 - DNA, 25 bp, Mus musculus
gggatgcccgtcattttcatcaaac

SEQ ID NO: 631749 - DNA, 25 bp, Mus musculus
gggatgcccgtctttttcatcaaac

SEQ ID NO: 631750 - DNA, 25 bp, Mus musculus
gggatgccctgaagaccgagttcaa

SEQ ID NO: 631751 - DNA, 25 bp, Mus musculus
gggatgccctgatgaccgagttcaa

SEQ ID NO: 631752 - DNA, 25 bp, Mus musculus
gggatgcccttgaattcagtgtagt

SEQ ID NO: 631753 - DNA, 25 bp, Mus musculus
gggatgcccttgtattcagtgtagt

SEQ ID NO: 631754 - DNA, 25 bp, Mus musculus
gggatgcctcaacatccttgagatt

SEQ ID NO: 631755 - DNA, 25 bp, Mus musculus
gggatgcctcaagatccttgagatt

SEQ ID NO: 631756 - DNA, 25 bp, Mus musculus
gggatgcctccaaggagctgttcag

SEQ ID NO: 631757 - DNA, 25 bp, Mus musculus
gggatgcctccatggagctgttcag

SEQ ID NO: 631758 - DNA, 25 bp, Mus musculus
gggatgcctcccagaaatctttctt

SEQ ID NO: 631759 - DNA, 25 bp, Mus musculus
gggatgcctccctgaaatctttctt

SEQ ID NO: 631760 - DNA, 25 bp, Mus musculus
gggatgcctgacagcatattttctg

SEQ ID NO: 631761 - DNA, 25 bp, Mus musculus
gggatgcctgactgcatattttctg

SEQ ID NO: 631762 - DNA, 25 bp, Mus musculus
gggatgccttccatagatgaaatgg

SEQ ID NO: 631763 - DNA, 25 bp, Mus musculus
gggatgccttccttagatgaaatgg

SEQ ID NO: 631764 - DNA, 25 bp, Mus musculus
gggatgcggacaccctgaaactctt

SEQ ID NO: 631765 - DNA, 25 bp, Mus musculus
gggatgcggacagcctgaaactctt

SEQ ID NO: 631766 - DNA, 25 bp, Mus musculus
gggatgcggttcacgcctagcccat

SEQ ID NO: 631767 - DNA, 25 bp, Mus musculus
gggatgcggttctcgcctagcccat

SEQ ID NO: 631768 - DNA, 25 bp, Mus musculus
gggatgcgtatacttactccacaca

SEQ ID NO: 631769 - DNA, 25 bp, Mus musculus
gggatgcgtatagttactccacaca

SEQ ID NO: 631770 - DNA, 25 bp, Mus musculus
gggatgcgtctaaaaacctacgaag

SEQ ID NO: 631771 - DNA, 25 bp, Mus musculus
gggatgcgtctataaacctacgaag

SEQ ID NO: 631772 - DNA, 25 bp, Mus musculus
gggatgctaatgatcctccagcagg

SEQ ID NO: 631773 - DNA, 25 bp, Mus musculus
gggatgctaatgttcctccagcagg

SEQ ID NO: 631774 - DNA, 25 bp, Mus musculus
gggatgctaattcgacagcccttta

SEQ ID NO: 631775 - DNA, 25 bp, Mus musculus
gggatgctaattggacagcccttta

SEQ ID NO: 631776 - DNA, 25 bp, Mus musculus
gggatgctcagtatcatttgccaat

SEQ ID NO: 631777 - DNA, 25 bp, Mus musculus
gggatgctcagtttcatttgccaat

SEQ ID NO: 631778 - DNA, 25 bp, Mus musculus
gggatgctccgaatcacttcaatgc

SEQ ID NO: 631779 - DNA, 25 bp, Mus musculus
gggatgctccgattcacttcaatgc

SEQ ID NO: 631780 - DNA, 25 bp, Mus musculus
gggatgctcgaaatatggccaaaga

SEQ ID NO: 631781 - DNA, 25 bp, Mus musculus
gggatgctcgaattatggccaaaga

SEQ ID NO: 631782 - DNA, 25 bp, Mus musculus
gggatgctcgttacaagtacatggg

SEQ ID NO: 631783 - DNA, 25 bp, Mus musculus
gggatgctcgtttcaagtacatggg

SEQ ID NO: 631784 - DNA, 25 bp, Mus musculus
gggatgctctctacagttagccctg

SEQ ID NO: 631785 - DNA, 25 bp, Mus musculus
gggatgctctcttcagttagccctg

SEQ ID NO: 631786 - DNA, 25 bp, Mus musculus
gggatgctgaacatctctgaatata

SEQ ID NO: 631787 - DNA, 25 bp, Mus musculus
gggatgctgaacttctctgaatata

SEQ ID NO: 631788 - DNA, 25 bp, Mus musculus
gggatgctgcggactttttactgaa

SEQ ID NO: 631789 - DNA, 25 bp, Mus musculus
gggatgctgcggtctttttactgaa

SEQ ID NO: 631790 - DNA, 25 bp, Mus musculus
gggatgctgctcacttgtgcagtca

SEQ ID NO: 631791 - DNA, 25 bp, Mus musculus
gggatgctgctctcttgtgcagtca

SEQ ID NO: 631792 - DNA, 25 bp, Mus musculus
gggatgctgctgcaaatcgacaact

SEQ ID NO: 631793 - DNA, 25 bp, Mus musculus
gggatgctgctggaaatcgacaact

SEQ ID NO: 631794 - DNA, 25 bp, Mus musculus
gggatgctggaactactaacttgaa

SEQ ID NO: 631795 - DNA, 25 bp, Mus musculus
gggatgctggaagtactaacttgaa

SEQ ID NO: 631796 - DNA, 25 bp, Mus musculus
gggatgctgtatatcattcttgaaa

SEQ ID NO: 631797 - DNA, 25 bp, Mus musculus
gggatgctgtatttcattcttgaaa

SEQ ID NO: 631798 - DNA, 25 bp, Mus musculus
gggatgcttcatccagagagcaact

SEQ ID NO: 631799 - DNA, 25 bp, Mus musculus
gggatgcttcatcggccaagtttct

SEQ ID NO: 631800 - DNA, 25 bp, Mus musculus
gggatgcttcatgcagagagcaact

SEQ ID NO: 631801 - DNA, 25 bp, Mus musculus
gggatgcttcatgggccaagtttct

SEQ ID NO: 631802 - DNA, 25 bp, Mus musculus
gggatgcttcccattttgaagactt

SEQ ID NO: 631803 - DNA, 25 bp, Mus musculus
gggatgcttccctttttgaagactt

SEQ ID NO: 631804 - DNA, 25 bp, Mus musculus
gggatgcttcttagagctaactgaa

SEQ ID NO: 631805 - DNA, 25 bp, Mus musculus
gggatgcttctttgagctaactgaa

SEQ ID NO: 631806 - DNA, 25 bp, Mus musculus
gggatgcttgtcatccggcatgaaa

SEQ ID NO: 631807 - DNA, 25 bp, Mus musculus
gggatgcttgtcttccggcatgaaa

SEQ ID NO: 631808 - DNA, 25 bp, Mus musculus
gggatgcttgttatcattgtctcat

SEQ ID NO: 631809 - DNA, 25 bp, Mus musculus
gggatgcttgttttcattgtctcat

SEQ ID NO: 631810 - DNA, 25 bp, Mus musculus
gggatgctttatagccatagcaaat

SEQ ID NO: 631811 - DNA, 25 bp, Mus musculus
gggatgctttattgccatagcaaat

SEQ ID NO: 631812 - DNA, 25 bp, Mus musculus
gggatgctttcaatgaccttagttc

SEQ ID NO: 631813 - DNA, 25 bp, Mus musculus
gggatgctttcattgaccttagttc

SEQ ID NO: 631814 - DNA, 25 bp, Mus musculus
gggatgcttttaacgtctctggaag

SEQ ID NO: 631815 - DNA, 25 bp, Mus musculus
gggatgcttttatcgtctctggaag

SEQ ID NO: 631816 - DNA, 25 bp, Mus musculus
gggatggaaccaactttttctgtat

SEQ ID NO: 631817 - DNA, 25 bp, Mus musculus
gggatggaaccatctttttctgtat

SEQ ID NO: 631818 - DNA, 25 bp, Mus musculus
gggatggaagccagtcctcctgagt

SEQ ID NO: 631819 - DNA, 25 bp, Mus musculus
gggatggaagcctgtcctcctgagt

SEQ ID NO: 631820 - DNA, 25 bp, Mus musculus
gggatggacatgacgtgaagaaact

SEQ ID NO: 631821 - DNA, 25 bp, Mus musculus
gggatggacatgtcgtgaagaaact

SEQ ID NO: 631822 - DNA, 25 bp, Mus musculus
gggatggactccaccagtgtcagtg

SEQ ID NO: 631823 - DNA, 25 bp, Mus musculus
gggatggactcctccagtgtcagtg

SEQ ID NO: 631824 - DNA, 25 bp, Mus musculus
gggatggactgccttctacttgcta

SEQ ID NO: 631825 - DNA, 25 bp, Mus musculus
gggatggactgcgttctacttgcta

SEQ ID NO: 631826 - DNA, 25 bp, Mus musculus
gggatggagactataaacccagcat

SEQ ID NO: 631827 - DNA, 25 bp, Mus musculus
gggatggagactttaaacccagcat

SEQ ID NO: 631828 - DNA, 25 bp, Mus musculus
gggatggaggtcagagcttcacatt

SEQ ID NO: 631829 - DNA, 25 bp, Mus musculus
gggatggaggtctgagcttcacatt

SEQ ID NO: 631830 - DNA, 25 bp, Mus musculus
gggatggagtcaagctgcccaaact

SEQ ID NO: 631831 - DNA, 25 bp, Mus musculus
gggatggagtcatgctgcccaaact

SEQ ID NO: 631832 - DNA, 25 bp, Mus musculus
gggatggatatacaacctcgtttct

SEQ ID NO: 631833 - DNA, 25 bp, Mus musculus
gggatggatatagaacctcgtttct

SEQ ID NO: 631834 - DNA, 25 bp, Mus musculus
gggatggatcagcttgcacacgctt

SEQ ID NO: 631835 - DNA, 25 bp, Mus musculus
gggatggatcaggttgcacacgctt

SEQ ID NO: 631836 - DNA, 25 bp, Mus musculus
gggatggatccaataccacaaatga

SEQ ID NO: 631837 - DNA, 25 bp, Mus musculus
gggatggatccattaccacaaatga

SEQ ID NO: 631838 - DNA, 25 bp, Mus musculus
gggatggattccctaagccaagcct

SEQ ID NO: 631839 - DNA, 25 bp, Mus musculus
gggatggattccgtaagccaagcct

SEQ ID NO: 631840 - DNA, 25 bp, Mus musculus
gggatggattcgaccctagttccaa

SEQ ID NO: 631841 - DNA, 25 bp, Mus musculus
gggatggattcgtccctagttccaa

SEQ ID NO: 631842 - DNA, 25 bp, Mus musculus
gggatggatttactcactccaactt

SEQ ID NO: 631843 - DNA, 25 bp, Mus musculus
gggatggatttagtcactccaactt

SEQ ID NO: 631844 - DNA, 25 bp, Mus musculus
gggatggattttctctcagtttcct

SEQ ID NO: 631845 - DNA, 25 bp, Mus musculus
gggatggattttgtctcagtttcct

SEQ ID NO: 631846 - DNA, 25 bp, Mus musculus
gggatggcaaacatcacaagttgat

SEQ ID NO: 631847 - DNA, 25 bp, Mus musculus
gggatggcaaacttcacaagttgat

SEQ ID NO: 631848 - DNA, 25 bp, Mus musculus
gggatggcaactacctacactgttt

SEQ ID NO: 631849 - DNA, 25 bp, Mus musculus
gggatggcaacttcctacactgttt

SEQ ID NO: 631850 - DNA, 25 bp, Mus musculus
gggatggcacggaatccaaccagcc

SEQ ID NO: 631851 - DNA, 25 bp, Mus musculus
gggatggcacggtatccaaccagcc

SEQ ID NO: 631852 - DNA, 25 bp, Mus musculus
gggatggcagtcatctttccagaat

SEQ ID NO: 631853 - DNA, 25 bp, Mus musculus
gggatggcagtcttctttccagaat

SEQ ID NO: 631854 - DNA, 25 bp, Mus musculus
gggatggcagttcttcatccacatt

SEQ ID NO: 631855 - DNA, 25 bp, Mus musculus
gggatggcagttgttcatccacatt

SEQ ID NO: 631856 - DNA, 25 bp, Mus musculus
gggatggcatcaccttaccatcaga

SEQ ID NO: 631857 - DNA, 25 bp, Mus musculus
gggatggcatcagcttaccatcaga

SEQ ID NO: 631858 - DNA, 25 bp, Mus musculus
gggatggcatcgactacagccagca

SEQ ID NO: 631859 - DNA, 25 bp, Mus musculus
gggatggcatcgtctacagccagca

SEQ ID NO: 631860 - DNA, 25 bp, Mus musculus
gggatggccaagcactatttattga

SEQ ID NO: 631861 - DNA, 25 bp, Mus musculus
gggatggccaaggactatttattga

SEQ ID NO: 631862 - DNA, 25 bp, Mus musculus
gggatggccgcaccatcaatgtaaa

SEQ ID NO: 631863 - DNA, 25 bp, Mus musculus
gggatggccgcagcatcaatgtaaa

SEQ ID NO: 631864 - DNA, 25 bp, Mus musculus
gggatggccgccacccatgcctttg

SEQ ID NO: 631865 - DNA, 25 bp, Mus musculus
gggatggccgcctcccatgcctttg

SEQ ID NO: 631866 - DNA, 25 bp, Mus musculus
gggatggcgcccaggaaaacagcct

SEQ ID NO: 631867 - DNA, 25 bp, Mus musculus
gggatggcgccctggaaaacagcct

SEQ ID NO: 631868 - DNA, 25 bp, Mus musculus
gggatggcggctacacattccacta

SEQ ID NO: 631869 - DNA, 25 bp, Mus musculus
gggatggcggcttcacattccacta

SEQ ID NO: 631870 - DNA, 25 bp, Mus musculus
gggatggctgctctcaccttgacca

SEQ ID NO: 631871 - DNA, 25 bp, Mus musculus
gggatggctgctgtcaccttgacca

SEQ ID NO: 631872 - DNA, 25 bp, Mus musculus
gggatggctggcaaagaatacttac

SEQ ID NO: 631873 - DNA, 25 bp, Mus musculus
gggatggctggctaagaatacttac

SEQ ID NO: 631874 - DNA, 25 bp, Mus musculus
gggatggctgttctttcatcgtctc

SEQ ID NO: 631875 - DNA, 25 bp, Mus musculus
gggatggctgttgtttcatcgtctc

SEQ ID NO: 631876 - DNA, 25 bp, Mus musculus
gggatggcttttcagaataatactt

SEQ ID NO: 631877 - DNA, 25 bp, Mus musculus
gggatggcttttgagaataatactt

SEQ ID NO: 631878 - DNA, 25 bp, Mus musculus
gggatgggctctcctaaatcaagaa

SEQ ID NO: 631879 - DNA, 25 bp, Mus musculus
gggatgggctctgctaaatcaagaa

SEQ ID NO: 631880 - DNA, 25 bp, Mus musculus
gggatgggcttcagggcttttccaa

SEQ ID NO: 631881 - DNA, 25 bp, Mus musculus
gggatgggcttctgggcttttccaa

SEQ ID NO: 631882 - DNA, 25 bp, Mus musculus
gggatgggtccactatatgatccat

SEQ ID NO: 631883 - DNA, 25 bp, Mus musculus
gggatgggtccagtatatgatccat

SEQ ID NO: 631884 - DNA, 25 bp, Mus musculus
gggatgggtgcaaggtacacataca

SEQ ID NO: 631885 - DNA, 25 bp, Mus musculus
gggatgggtgcatggtacacataca

SEQ ID NO: 631886 - DNA, 25 bp, Mus musculus
gggatggtaagtagcctcttttatt

SEQ ID NO: 631887 - DNA, 25 bp, Mus musculus
gggatggtaagttgcctcttttatt

SEQ ID NO: 631888 - DNA, 25 bp, Mus musculus
gggatggtacttctctgttctttaa

SEQ ID NO: 631889 - DNA, 25 bp, Mus musculus
gggatggtacttgtctgttctttaa

SEQ ID NO: 631890 - DNA, 25 bp, Mus musculus
gggatggtcaatctcccagaatcct

SEQ ID NO: 631891 - DNA, 25 bp, Mus musculus
gggatggtcaatgtcccagaatcct

SEQ ID NO: 631892 - DNA, 25 bp, Mus musculus
gggatggtccacagctggatccaaa

SEQ ID NO: 631893 - DNA, 25 bp, Mus musculus
gggatggtccactgctggatccaaa

SEQ ID NO: 631894 - DNA, 25 bp, Mus musculus
gggatggtctaccttcagggacaca

SEQ ID NO: 631895 - DNA, 25 bp, Mus musculus
gggatggtctacgttcagggacaca

SEQ ID NO: 631896 - DNA, 25 bp, Mus musculus
gggatggtgattactaaagaaaagt

SEQ ID NO: 631897 - DNA, 25 bp, Mus musculus
gggatggtgatttctaaagaaaagt

SEQ ID NO: 631898 - DNA, 25 bp, Mus musculus
gggatggtggatcccttcttaaccc

SEQ ID NO: 631899 - DNA, 25 bp, Mus musculus
gggatggtggatgccttcttaaccc

SEQ ID NO: 631900 - DNA, 25 bp, Mus musculus
gggatggtgtttaatttccgacctg

SEQ ID NO: 631901 - DNA, 25 bp, Mus musculus
gggatggtgttttatttccgacctg

SEQ ID NO: 631902 - DNA, 25 bp, Mus musculus
gggatggttcagaccttaatgagct

SEQ ID NO: 631903 - DNA, 25 bp, Mus musculus
gggatggttcagtccttaatgagct

SEQ ID NO: 631904 - DNA, 25 bp, Mus musculus
gggatggttgaaagctgtattttgt

SEQ ID NO: 631905 - DNA, 25 bp, Mus musculus
gggatggttgaatgctgtattttgt

SEQ ID NO: 631906 - DNA, 25 bp, Mus musculus
gggatggttgacctgcgtggcccag

SEQ ID NO: 631907 - DNA, 25 bp, Mus musculus
gggatggttgacgtgcgtggcccag

SEQ ID NO: 631908 - DNA, 25 bp, Mus musculus
gggatggtttccaagacgctgcaca

SEQ ID NO: 631909 - DNA, 25 bp, Mus musculus
gggatggtttcctagacgctgcaca

SEQ ID NO: 631910 - DNA, 25 bp, Mus musculus
gggatggtttttcagagttgctcaa

SEQ ID NO: 631911 - DNA, 25 bp, Mus musculus
gggatggtttttgagagttgctcaa

SEQ ID NO: 631912 - DNA, 25 bp, Mus musculus
gggatgtaacatagtcatttgtgcc

SEQ ID NO: 631913 - DNA, 25 bp, Mus musculus
gggatgtaacattgtcatttgtgcc

SEQ ID NO: 631914 - DNA, 25 bp, Mus musculus
gggatgtaccacaaccatatgttaa

SEQ ID NO: 631915 - DNA, 25 bp, Mus musculus
gggatgtaccactaccatatgttaa

SEQ ID NO: 631916 - DNA, 25 bp, Mus musculus
gggatgtacctgagtgtgcgtatat

SEQ ID NO: 631917 - DNA, 25 bp, Mus musculus
gggatgtacctgtgtgtgcgtatat

SEQ ID NO: 631918 - DNA, 25 bp, Mus musculus
gggatgtacgataacaccgcccaga

SEQ ID NO: 631919 - DNA, 25 bp, Mus musculus
gggatgtacgattacaccgcccaga

SEQ ID NO: 631920 - DNA, 25 bp, Mus musculus
gggatgtagcatctgacctggactc

SEQ ID NO: 631921 - DNA, 25 bp, Mus musculus
gggatgtagcatgtgacctggactc

SEQ ID NO: 631922 - DNA, 25 bp, Mus musculus
gggatgtagctccatggtccatgct

SEQ ID NO: 631923 - DNA, 25 bp, Mus musculus
gggatgtagctcgatggtccatgct

SEQ ID NO: 631924 - DNA, 25 bp, Mus musculus
gggatgtatccaaagaatgtgcaga

SEQ ID NO: 631925 - DNA, 25 bp, Mus musculus
gggatgtatccatagaatgtgcaga

SEQ ID NO: 631926 - DNA, 25 bp, Mus musculus
gggatgtatctcaccgacttggtgt

SEQ ID NO: 631927 - DNA, 25 bp, Mus musculus
gggatgtatctctccgacttggtgt

SEQ ID NO: 631928 - DNA, 25 bp, Mus musculus
gggatgtatgagctcctaggtacaa

SEQ ID NO: 631929 - DNA, 25 bp, Mus musculus
gggatgtatgaggtcctaggtacaa

SEQ ID NO: 631930 - DNA, 25 bp, Mus musculus
gggatgtcaaacagtcagattcctt

SEQ ID NO: 631931 - DNA, 25 bp, Mus musculus
gggatgtcaaactgtcagattcctt

SEQ ID NO: 631932 - DNA, 25 bp, Mus musculus
gggatgtcaaccacagcagagcact

SEQ ID NO: 631933 - DNA, 25 bp, Mus musculus
gggatgtcaacctcagcagagcact

SEQ ID NO: 631934 - DNA, 25 bp, Mus musculus
gggatgtcagggatgcagacacata

SEQ ID NO: 631935 - DNA, 25 bp, Mus musculus
gggatgtcagggttgcagacacata

SEQ ID NO: 631936 - DNA, 25 bp, Mus musculus
gggatgtcataacacctctgcctgt

SEQ ID NO: 631937 - DNA, 25 bp, Mus musculus
gggatgtcataagacctctgcctgt

SEQ ID NO: 631938 - DNA, 25 bp, Mus musculus
gggatgtcatcacagccgccatgac

SEQ ID NO: 631939 - DNA, 25 bp, Mus musculus
gggatgtcatcagagccgccatgac

SEQ ID NO: 631940 - DNA, 25 bp, Mus musculus
gggatgtcatgtactccatagaggc

SEQ ID NO: 631941 - DNA, 25 bp, Mus musculus
gggatgtcatgttctccatagaggc

SEQ ID NO: 631942 - DNA, 25 bp, Mus musculus
gggatgtcatttcacacacgccagc

SEQ ID NO: 631943 - DNA, 25 bp, Mus musculus
gggatgtcatttgacacacgccagc

SEQ ID NO: 631944 - DNA, 25 bp, Mus musculus
gggatgtccaggcatctcgtgacta

SEQ ID NO: 631945 - DNA, 25 bp, Mus musculus
gggatgtccagggatctcgtgacta

SEQ ID NO: 631946 - DNA, 25 bp, Mus musculus
gggatgtccatgagatgttccttca

SEQ ID NO: 631947 - DNA, 25 bp, Mus musculus
gggatgtccatgtgatgttccttca

SEQ ID NO: 631948 - DNA, 25 bp, Mus musculus
gggatgtcccacatgtatcatagtt

SEQ ID NO: 631949 - DNA, 25 bp, Mus musculus
gggatgtcccacttgtatcatagtt

SEQ ID NO: 631950 - DNA, 25 bp, Mus musculus
gggatgtcccgccaagaagctgatg

SEQ ID NO: 631951 - DNA, 25 bp, Mus musculus
gggatgtcccgcgaagaagctgatg

SEQ ID NO: 631952 - DNA, 25 bp, Mus musculus
gggatgtccctgaagattaaaggca

SEQ ID NO: 631953 - DNA, 25 bp, Mus musculus
gggatgtccctgtagattaaaggca

SEQ ID NO: 631954 - DNA, 25 bp, Mus musculus
gggatgtcccttaaaaaggactgct

SEQ ID NO: 631955 - DNA, 25 bp, Mus musculus
gggatgtccctttaaaaggactgct

SEQ ID NO: 631956 - DNA, 25 bp, Mus musculus
gggatgtcctcactgctcctccatg

SEQ ID NO: 631957 - DNA, 25 bp, Mus musculus
gggatgtcctcagtgctcctccatg

SEQ ID NO: 631958 - DNA, 25 bp, Mus musculus
gggatgtcctggaccacagtggcct

SEQ ID NO: 631959 - DNA, 25 bp, Mus musculus
gggatgtcctggtccacagtggcct

SEQ ID NO: 631960 - DNA, 25 bp, Mus musculus
gggatgtcggtaaaagcacagcccc

SEQ ID NO: 631961 - DNA, 25 bp, Mus musculus
gggatgtcggtataagcacagcccc

SEQ ID NO: 631962 - DNA, 25 bp, Mus musculus
gggatgtctaaacatgactttctgt

SEQ ID NO: 631963 - DNA, 25 bp, Mus musculus
gggatgtctaaagatgactttctgt

SEQ ID NO: 631964 - DNA, 25 bp, Mus musculus
gggatgtctccaactctgtgaagta

SEQ ID NO: 631965 - DNA, 25 bp, Mus musculus
gggatgtctccatctctgtgaagta

SEQ ID NO: 631966 - DNA, 25 bp, Mus musculus
gggatgtctgggacccttggaactc

SEQ ID NO: 631967 - DNA, 25 bp, Mus musculus
gggatgtctgggtcccttggaactc

SEQ ID NO: 631968 - DNA, 25 bp, Mus musculus
gggatgtctgtaatgactgactgtg

SEQ ID NO: 631969 - DNA, 25 bp, Mus musculus
gggatgtctgtattgactgactgtg

SEQ ID NO: 631970 - DNA, 25 bp, Mus musculus
gggatgtgatttcttctagcgaagc

SEQ ID NO: 631971 - DNA, 25 bp, Mus musculus
gggatgtgatttgttctagcgaagc

SEQ ID NO: 631972 - DNA, 25 bp, Mus musculus
gggatgtgcaaccatgtccagtttt

SEQ ID NO: 631973 - DNA, 25 bp, Mus musculus
gggatgtgcaacgatgtccagtttt

SEQ ID NO: 631974 - DNA, 25 bp, Mus musculus
gggatgtgcattcctaactcaaaaa

SEQ ID NO: 631975 - DNA, 25 bp, Mus musculus
gggatgtgcattgctaactcaaaaa

SEQ ID NO: 631976 - DNA, 25 bp, Mus musculus
gggatgtggcgcacacacccttcta

SEQ ID NO: 631977 - DNA, 25 bp, Mus musculus
gggatgtggcgctcacacccttcta

SEQ ID NO: 631978 - DNA, 25 bp, Mus musculus
gggatgtgtactctttctatgggaa

SEQ ID NO: 631979 - DNA, 25 bp, Mus musculus
gggatgtgtactgtttctatgggaa

SEQ ID NO: 631980 - DNA, 25 bp, Mus musculus
gggatgtgtcacatgctcttccgtc

SEQ ID NO: 631981 - DNA, 25 bp, Mus musculus
gggatgtgtcacttgctcttccgtc

SEQ ID NO: 631982 - DNA, 25 bp, Mus musculus
gggatgtgtgccagtggccattcaa

SEQ ID NO: 631983 - DNA, 25 bp, Mus musculus
gggatgtgtgcctgtggccattcaa

SEQ ID NO: 631984 - DNA, 25 bp, Mus musculus
gggatgttaacaaacctgcttgctg

SEQ ID NO: 631985 - DNA, 25 bp, Mus musculus
gggatgttaacatacctgcttgctg

SEQ ID NO: 631986 - DNA, 25 bp, Mus musculus
gggatgttagcaagatgtttgctta

SEQ ID NO: 631987 - DNA, 25 bp, Mus musculus
gggatgttagcatgatgtttgctta

SEQ ID NO: 631988 - DNA, 25 bp, Mus musculus
gggatgttagccctaatcaacctta

SEQ ID NO: 631989 - DNA, 25 bp, Mus musculus
gggatgttagccgtaatcaacctta

SEQ ID NO: 631990 - DNA, 25 bp, Mus musculus
gggatgttagctcctggctccccat

SEQ ID NO: 631991 - DNA, 25 bp, Mus musculus
gggatgttagctgctggctccccat

SEQ ID NO: 631992 - DNA, 25 bp, Mus musculus
gggatgttgatcagttgatgcacaa

SEQ ID NO: 631993 - DNA, 25 bp, Mus musculus
gggatgttgatctgttgatgcacaa

SEQ ID NO: 631994 - DNA, 25 bp, Mus musculus
gggatgttgtatccacgcacacaca

SEQ ID NO: 631995 - DNA, 25 bp, Mus musculus
gggatgttgtatgcacgcacacaca

SEQ ID NO: 631996 - DNA, 25 bp, Mus musculus
gggatgttgtcacagccaagctttt

SEQ ID NO: 631997 - DNA, 25 bp, Mus musculus
gggatgttgtcagagccaagctttt

SEQ ID NO: 631998 - DNA, 25 bp, Mus musculus
gggatgttgttactaagccttatac

SEQ ID NO: 631999 - DNA, 25 bp, Mus musculus
gggatgttgttagtaagccttatac

SEQ ID NO: 632000 - DNA, 25 bp, Mus musculus
gggatgttgttgaactgcacatatt

SEQ ID NO: 632001 - DNA, 25 bp, Mus musculus
gggatgttgttgtactgcacatatt

SEQ ID NO: 632002 - DNA, 25 bp, Mus musculus
gggatgtttctgagatcgattctac

SEQ ID NO: 632003 - DNA, 25 bp, Mus musculus
gggatgtttctgtgatcgattctac

SEQ ID NO: 632004 - DNA, 25 bp, Mus musculus
gggatgtttcttccggaagctcccg

SEQ ID NO: 632005 - DNA, 25 bp, Mus musculus
gggatgtttcttgcggaagctcccg

SEQ ID NO: 632006 - DNA, 25 bp, Mus musculus
gggatgttttgaaattccaagtaca

SEQ ID NO: 632007 - DNA, 25 bp, Mus musculus
gggatgttttgactctgcacatatt

SEQ ID NO: 632008 - DNA, 25 bp, Mus musculus
gggatgttttgagtctgcacatatt

SEQ ID NO: 632009 - DNA, 25 bp, Mus musculus
gggatgttttgatattccaagtaca

SEQ ID NO: 632010 - DNA, 25 bp, Mus musculus
gggatgttttgtctgttcatgccag

SEQ ID NO: 632011 - DNA, 25 bp, Mus musculus
gggatgttttgtgtgttcatgccag

SEQ ID NO: 632012 - DNA, 25 bp, Mus musculus
gggatgtttttgacttatctaaata

SEQ ID NO: 632013 - DNA, 25 bp, Mus musculus
gggatgtttttgtcttatctaaata

SEQ ID NO: 632014 - DNA, 25 bp, Mus musculus
gggattaaacctcgcattctagaac

SEQ ID NO: 632015 - DNA, 25 bp, Mus musculus
gggattaaacctggcattctagaac

SEQ ID NO: 632016 - DNA, 25 bp, Mus musculus
gggattaaaggtcgtcagtcaactc

SEQ ID NO: 632017 - DNA, 25 bp, Mus musculus
gggattaaaggtggtcagtcaactc

SEQ ID NO: 632018 - DNA, 25 bp, Mus musculus
gggattaacaccatatttgtgcatt

SEQ ID NO: 632019 - DNA, 25 bp, Mus musculus
gggattaacaccttatttgtgcatt

SEQ ID NO: 632020 - DNA, 25 bp, Mus musculus
gggattaacctgcaaattggtgcta

SEQ ID NO: 632021 - DNA, 25 bp, Mus musculus
gggattaacctggaaattggtgcta

SEQ ID NO: 632022 - DNA, 25 bp, Mus musculus
gggattaactatctgctgaagacat

SEQ ID NO: 632023 - DNA, 25 bp, Mus musculus
gggattaactatgtgctgaagacat

SEQ ID NO: 632024 - DNA, 25 bp, Mus musculus
gggattaactccatgtcagtatttg

SEQ ID NO: 632025 - DNA, 25 bp, Mus musculus
gggattaactccttgtcagtatttg

SEQ ID NO: 632026 - DNA, 25 bp, Mus musculus
gggattaagttccaacatgtgaatg

SEQ ID NO: 632027 - DNA, 25 bp, Mus musculus
gggattaagttcgaacatgtgaatg

SEQ ID NO: 632028 - DNA, 25 bp, Mus musculus
gggattaatcgaccaagcagcttgc

SEQ ID NO: 632029 - DNA, 25 bp, Mus musculus
gggattaatcgagcaagcagcttgc

SEQ ID NO: 632030 - DNA, 25 bp, Mus musculus
gggattaatctcaaatattctgctt

SEQ ID NO: 632031 - DNA, 25 bp, Mus musculus
gggattaatctctaatattctgctt

SEQ ID NO: 632032 - DNA, 25 bp, Mus musculus
gggattacaattacacactatcgtt

SEQ ID NO: 632033 - DNA, 25 bp, Mus musculus
gggattacaatttcacactatcgtt

SEQ ID NO: 632034 - DNA, 25 bp, Mus musculus
gggattacacaacctgatgacaaca

SEQ ID NO: 632035 - DNA, 25 bp, Mus musculus
gggattacacaagctgatgacaaca

SEQ ID NO: 632036 - DNA, 25 bp, Mus musculus
gggattacacgcaacttttccggag

SEQ ID NO: 632037 - DNA, 25 bp, Mus musculus
gggattacacgctacttttccggag

SEQ ID NO: 632038 - DNA, 25 bp, Mus musculus
gggattacagcacctgaggcattca

SEQ ID NO: 632039 - DNA, 25 bp, Mus musculus
gggattacagcagctgaggcattca

SEQ ID NO: 632040 - DNA, 25 bp, Mus musculus
gggattacagttctctgcctagctg

SEQ ID NO: 632041 - DNA, 25 bp, Mus musculus
gggattacagttgtctgcctagctg

SEQ ID NO: 632042 - DNA, 25 bp, Mus musculus
gggattacatctaggttctgtcacc

SEQ ID NO: 632043 - DNA, 25 bp, Mus musculus
gggattacatcttggttctgtcacc

SEQ ID NO: 632044 - DNA, 25 bp, Mus musculus
gggattacccgccagcctgtggacc

SEQ ID NO: 632045 - DNA, 25 bp, Mus musculus
gggattacccgcgagcctgtggacc

SEQ ID NO: 632046 - DNA, 25 bp, Mus musculus
gggattacctctctagactcaagaa

SEQ ID NO: 632047 - DNA, 25 bp, Mus musculus
gggattacctctgtagactcaagaa

SEQ ID NO: 632048 - DNA, 25 bp, Mus musculus
gggattaccttacagatctagagct

SEQ ID NO: 632049 - DNA, 25 bp, Mus musculus
gggattaccttagagatctagagct

SEQ ID NO: 632050 - DNA, 25 bp, Mus musculus
gggattactagtatgctccaccatg

SEQ ID NO: 632051 - DNA, 25 bp, Mus musculus
gggattactagtttgctccaccatg

SEQ ID NO: 632052 - DNA, 25 bp, Mus musculus
gggattactcaacgatcattctttg

SEQ ID NO: 632053 - DNA, 25 bp, Mus musculus
gggattactcaaggatcattctttg

SEQ ID NO: 632054 - DNA, 25 bp, Mus musculus
gggattactggtcttggctagcata

SEQ ID NO: 632055 - DNA, 25 bp, Mus musculus
gggattactggtgttggctagcata

SEQ ID NO: 632056 - DNA, 25 bp, Mus musculus
gggattacttttagtgaggcacagt

SEQ ID NO: 632057 - DNA, 25 bp, Mus musculus
gggattactttttgtgaggcacagt

SEQ ID NO: 632058 - DNA, 25 bp, Mus musculus
gggattagaagccatgttagttgaa

SEQ ID NO: 632059 - DNA, 25 bp, Mus musculus
gggattagaagcgatgttagttgaa

SEQ ID NO: 632060 - DNA, 25 bp, Mus musculus
gggattagagcacccaggcctgcta

SEQ ID NO: 632061 - DNA, 25 bp, Mus musculus
gggattagagcagccaggcctgcta

SEQ ID NO: 632062 - DNA, 25 bp, Mus musculus
gggattagatccctacttttagttg

SEQ ID NO: 632063 - DNA, 25 bp, Mus musculus
gggattagatccgtacttttagttg

SEQ ID NO: 632064 - DNA, 25 bp, Mus musculus
gggattagatgaaggaactggactt

SEQ ID NO: 632065 - DNA, 25 bp, Mus musculus
gggattagatgatggaactggactt

SEQ ID NO: 632066 - DNA, 25 bp, Mus musculus
gggattagctgcctcccacagtgga

SEQ ID NO: 632067 - DNA, 25 bp, Mus musculus
gggattagctgcgtcccacagtgga

SEQ ID NO: 632068 - DNA, 25 bp, Mus musculus
gggattaggccacctgaaggacata

SEQ ID NO: 632069 - DNA, 25 bp, Mus musculus
gggattaggccagctgaaggacata

SEQ ID NO: 632070 - DNA, 25 bp, Mus musculus
gggattaggcgcctgctaccacagc

SEQ ID NO: 632071 - DNA, 25 bp, Mus musculus
gggattaggcgcgtgctaccacagc

SEQ ID NO: 632072 - DNA, 25 bp, Mus musculus
gggattagggtgatcttcaaggcct

SEQ ID NO: 632073 - DNA, 25 bp, Mus musculus
gggattagggtgttcttcaaggcct

SEQ ID NO: 632074 - DNA, 25 bp, Mus musculus
gggattaggtgcctctgtctattac

SEQ ID NO: 632075 - DNA, 25 bp, Mus musculus
gggattaggtgcgtctgtctattac

SEQ ID NO: 632076 - DNA, 25 bp, Mus musculus
gggattagtcacagcagtgcttgac

SEQ ID NO: 632077 - DNA, 25 bp, Mus musculus
gggattagtcactgcagtgcttgac

SEQ ID NO: 632078 - DNA, 25 bp, Mus musculus
gggattagttttctcatagcagttt

SEQ ID NO: 632079 - DNA, 25 bp, Mus musculus
gggattagttttgtcatagcagttt

SEQ ID NO: 632080 - DNA, 25 bp, Mus musculus
gggattatagttatctttgcttagc

SEQ ID NO: 632081 - DNA, 25 bp, Mus musculus
gggattatagttttctttgcttagc

SEQ ID NO: 632082 - DNA, 25 bp, Mus musculus
gggattatcctcatcatgaagggta

SEQ ID NO: 632083 - DNA, 25 bp, Mus musculus
gggattatcctcttcatgaagggta

SEQ ID NO: 632084 - DNA, 25 bp, Mus musculus
gggattatccttatgcgctctcgcg

SEQ ID NO: 632085 - DNA, 25 bp, Mus musculus
gggattatccttctctgggcaacat

SEQ ID NO: 632086 - DNA, 25 bp, Mus musculus
gggattatccttgtctgggcaacat

SEQ ID NO: 632087 - DNA, 25 bp, Mus musculus
gggattatccttttgcgctctcgcg

SEQ ID NO: 632088 - DNA, 25 bp, Mus musculus
gggattatctatacacagccagtag

SEQ ID NO: 632089 - DNA, 25 bp, Mus musculus
gggattatctattcacagccagtag

SEQ ID NO: 632090 - DNA, 25 bp, Mus musculus
gggattatctttacctagcggtaga

SEQ ID NO: 632091 - DNA, 25 bp, Mus musculus
gggattatcttttcctagcggtaga

SEQ ID NO: 632092 - DNA, 25 bp, Mus musculus
gggattatgagcaatcttcccatag

SEQ ID NO: 632093 - DNA, 25 bp, Mus musculus
gggattatgagctatcttcccatag

SEQ ID NO: 632094 - DNA, 25 bp, Mus musculus
gggattatgggtacatgccaccagg

SEQ ID NO: 632095 - DNA, 25 bp, Mus musculus
gggattatgggttcatgccaccagg

SEQ ID NO: 632096 - DNA, 25 bp, Mus musculus
gggattatgttgaccctgagcccaa

SEQ ID NO: 632097 - DNA, 25 bp, Mus musculus
gggattatgttgtccctgagcccaa

SEQ ID NO: 632098 - DNA, 25 bp, Mus musculus
gggattattaccctgtccagggccg

SEQ ID NO: 632099 - DNA, 25 bp, Mus musculus
gggattattaccgtgtccagggccg

SEQ ID NO: 632100 - DNA, 25 bp, Mus musculus
gggattattactccatcaaaccttc

SEQ ID NO: 632101 - DNA, 25 bp, Mus musculus
gggattattactgcatcaaaccttc

SEQ ID NO: 632102 - DNA, 25 bp, Mus musculus
gggattattgccagtctctattcag

SEQ ID NO: 632103 - DNA, 25 bp, Mus musculus
gggattattgcctgtctctattcag

SEQ ID NO: 632104 - DNA, 25 bp, Mus musculus
gggattcaaatcagcagagctacct

SEQ ID NO: 632105 - DNA, 25 bp, Mus musculus
gggattcaaatctgcagagctacct

SEQ ID NO: 632106 - DNA, 25 bp, Mus musculus
gggattcaacatatttatggagtgt

SEQ ID NO: 632107 - DNA, 25 bp, Mus musculus
gggattcaacatttttatggagtgt

SEQ ID NO: 632108 - DNA, 25 bp, Mus musculus
gggattcaaggacctctaactttga

SEQ ID NO: 632109 - DNA, 25 bp, Mus musculus
gggattcaaggagctctaactttga

SEQ ID NO: 632110 - DNA, 25 bp, Mus musculus
gggattcaaggcatctatgactgtg

SEQ ID NO: 632111 - DNA, 25 bp, Mus musculus
gggattcaaggcttctatgactgtg

SEQ ID NO: 632112 - DNA, 25 bp, Mus musculus
gggattcaagtgcattctctcagtg

SEQ ID NO: 632113 - DNA, 25 bp, Mus musculus
gggattcaagtggattctctcagtg

SEQ ID NO: 632114 - DNA, 25 bp, Mus musculus
gggattcaatctcataccttttcaa

SEQ ID NO: 632115 - DNA, 25 bp, Mus musculus
gggattcaatctgataccttttcaa

SEQ ID NO: 632116 - DNA, 25 bp, Mus musculus
gggattcacattactcagagagaca

SEQ ID NO: 632117 - DNA, 25 bp, Mus musculus
gggattcacatttctcagagagaca

SEQ ID NO: 632118 - DNA, 25 bp, Mus musculus
gggattcacccaatagaccataagc

SEQ ID NO: 632119 - DNA, 25 bp, Mus musculus
gggattcacccattagaccataagc

SEQ ID NO: 632120 - DNA, 25 bp, Mus musculus
gggattcacctacatcagattcttg

SEQ ID NO: 632121 - DNA, 25 bp, Mus musculus
gggattcacctagatcagattcttg

SEQ ID NO: 632122 - DNA, 25 bp, Mus musculus
gggattcacctgcaaaatggcattt

SEQ ID NO: 632123 - DNA, 25 bp, Mus musculus
gggattcacctggaaaatggcattt

SEQ ID NO: 632124 - DNA, 25 bp, Mus musculus
gggattcactttctattgatgtagt

SEQ ID NO: 632125 - DNA, 25 bp, Mus musculus
gggattcactttgtattgatgtagt

SEQ ID NO: 632126 - DNA, 25 bp, Mus musculus
gggattcagcccatacatacattca

SEQ ID NO: 632127 - DNA, 25 bp, Mus musculus
gggattcagcccttacatacattca

SEQ ID NO: 632128 - DNA, 25 bp, Mus musculus
gggattcagcctattatctactgct

SEQ ID NO: 632129 - DNA, 25 bp, Mus musculus
gggattcagccttttatctactgct

SEQ ID NO: 632130 - DNA, 25 bp, Mus musculus
gggattcaggatacccacagaacat

SEQ ID NO: 632131 - DNA, 25 bp, Mus musculus
gggattcaggattcccacagaacat

SEQ ID NO: 632132 - DNA, 25 bp, Mus musculus
gggattcaggcacaggtgacaacct

SEQ ID NO: 632133 - DNA, 25 bp, Mus musculus
gggattcaggcagaggtgacaacct

SEQ ID NO: 632134 - DNA, 25 bp, Mus musculus
gggattccacaaatgtgccatgtat

SEQ ID NO: 632135 - DNA, 25 bp, Mus musculus
gggattccacaattgtgccatgtat

SEQ ID NO: 632136 - DNA, 25 bp, Mus musculus
gggattccacagacaagcaacttga

SEQ ID NO: 632137 - DNA, 25 bp, Mus musculus
gggattccacagtcaagcaacttga

SEQ ID NO: 632138 - DNA, 25 bp, Mus musculus
gggattccagacaattccataggct

SEQ ID NO: 632139 - DNA, 25 bp, Mus musculus
gggattccagactattccataggct

SEQ ID NO: 632140 - DNA, 25 bp, Mus musculus
gggattccagatcctctgacaatgt

SEQ ID NO: 632141 - DNA, 25 bp, Mus musculus
gggattccagatgctctgacaatgt

SEQ ID NO: 632142 - DNA, 25 bp, Mus musculus
gggattccatataggcagctgcaga

SEQ ID NO: 632143 - DNA, 25 bp, Mus musculus
gggattccatattggcagctgcaga

SEQ ID NO: 632144 - DNA, 25 bp, Mus musculus
gggattccatcacaactcacggtgc

SEQ ID NO: 632145 - DNA, 25 bp, Mus musculus
gggattccatcagaactcacggtgc

SEQ ID NO: 632146 - DNA, 25 bp, Mus musculus
gggattccatgaagttcacgtcctt

SEQ ID NO: 632147 - DNA, 25 bp, Mus musculus
gggattccatgatgttcacgtcctt

SEQ ID NO: 632148 - DNA, 25 bp, Mus musculus
gggattccatgtagtactctgtgct

SEQ ID NO: 632149 - DNA, 25 bp, Mus musculus
gggattccatgttgtactctgtgct

SEQ ID NO: 632150 - DNA, 25 bp, Mus musculus
gggattcccaaaacatatccacaga

SEQ ID NO: 632151 - DNA, 25 bp, Mus musculus
gggattcccaaatcatatccacaga

SEQ ID NO: 632152 - DNA, 25 bp, Mus musculus
gggattccccagagaacaaactgct

SEQ ID NO: 632153 - DNA, 25 bp, Mus musculus
gggattccccagagatcactaatta

SEQ ID NO: 632154 - DNA, 25 bp, Mus musculus
gggattccccagtgaacaaactgct

SEQ ID NO: 632155 - DNA, 25 bp, Mus musculus
gggattccccagtgatcactaatta

SEQ ID NO: 632156 - DNA, 25 bp, Mus musculus
gggattcccgctctgggacttgact

SEQ ID NO: 632157 - DNA, 25 bp, Mus musculus
gggattcccgctgtgggacttgact

SEQ ID NO: 632158 - DNA, 25 bp, Mus musculus
gggattcccgtcattaagcacaagg

SEQ ID NO: 632159 - DNA, 25 bp, Mus musculus
gggattcccgtctttaagcacaagg

SEQ ID NO: 632160 - DNA, 25 bp, Mus musculus
gggattccctttacaagagcagcta

SEQ ID NO: 632161 - DNA, 25 bp, Mus musculus
gggattcccttttcaagagcagcta

SEQ ID NO: 632162 - DNA, 25 bp, Mus musculus
gggattccgaacctactaagtgctt

SEQ ID NO: 632163 - DNA, 25 bp, Mus musculus
gggattccgaacgtactaagtgctt

SEQ ID NO: 632164 - DNA, 25 bp, Mus musculus
gggattccgttccacaattgacaaa

SEQ ID NO: 632165 - DNA, 25 bp, Mus musculus
gggattccgttcgacaattgacaaa

SEQ ID NO: 632166 - DNA, 25 bp, Mus musculus
gggattcctgtcagtgcctgatcac

SEQ ID NO: 632167 - DNA, 25 bp, Mus musculus
gggattcctgtctgtgcctgatcac

SEQ ID NO: 632168 - DNA, 25 bp, Mus musculus
gggattccttcccacaaatatgacc

SEQ ID NO: 632169 - DNA, 25 bp, Mus musculus
gggattccttccgacaaatatgacc

SEQ ID NO: 632170 - DNA, 25 bp, Mus musculus
gggattcctttgagaccgttgactc

SEQ ID NO: 632171 - DNA, 25 bp, Mus musculus
gggattcctttgtgaccgttgactc

SEQ ID NO: 632172 - DNA, 25 bp, Mus musculus
gggattcgactcaggatacaactca

SEQ ID NO: 632173 - DNA, 25 bp, Mus musculus
gggattcgactctggatacaactca

SEQ ID NO: 632174 - DNA, 25 bp, Mus musculus
gggattcgagatattgacttagcta

SEQ ID NO: 632175 - DNA, 25 bp, Mus musculus
gggattcgagattttgacttagcta

SEQ ID NO: 632176 - DNA, 25 bp, Mus musculus
gggattcgatgaccaggatcttttt

SEQ ID NO: 632177 - DNA, 25 bp, Mus musculus
gggattcgatgagcaggatcttttt

SEQ ID NO: 632178 - DNA, 25 bp, Mus musculus
gggattcgctgcctgcgccatgtct

SEQ ID NO: 632179 - DNA, 25 bp, Mus musculus
gggattcgctgcgtgcgccatgtct

SEQ ID NO: 632180 - DNA, 25 bp, Mus musculus
gggattcgctttatgggaccagctc

SEQ ID NO: 632181 - DNA, 25 bp, Mus musculus
gggattcgctttttgggaccagctc

SEQ ID NO: 632182 - DNA, 25 bp, Mus musculus
gggattcggaggacaccttgcagtc

SEQ ID NO: 632183 - DNA, 25 bp, Mus musculus
gggattcggaggtcaccttgcagtc

SEQ ID NO: 632184 - DNA, 25 bp, Mus musculus
gggattctaactccctaatgggcaa

SEQ ID NO: 632185 - DNA, 25 bp, Mus musculus
gggattctaactgcctaatgggcaa

SEQ ID NO: 632186 - DNA, 25 bp, Mus musculus
gggattctatgtacaattcactcag

SEQ ID NO: 632187 - DNA, 25 bp, Mus musculus
gggattctatgttcaattcactcag

SEQ ID NO: 632188 - DNA, 25 bp, Mus musculus
gggattctccaaaagaatcttgaag

SEQ ID NO: 632189 - DNA, 25 bp, Mus musculus
gggattctccaatagaatcttgaag

SEQ ID NO: 632190 - DNA, 25 bp, Mus musculus
gggattctccttctatggttgatta

SEQ ID NO: 632191 - DNA, 25 bp, Mus musculus
gggattctccttgtatggttgatta

SEQ ID NO: 632192 - DNA, 25 bp, Mus musculus
gggattctcgacagggtgatgatta

SEQ ID NO: 632193 - DNA, 25 bp, Mus musculus
gggattctcgactgggtgatgatta

SEQ ID NO: 632194 - DNA, 25 bp, Mus musculus
gggattctctaaattcatggcctgg

SEQ ID NO: 632195 - DNA, 25 bp, Mus musculus
gggattctctaatttcatggcctgg

SEQ ID NO: 632196 - DNA, 25 bp, Mus musculus
gggattctctagatgacgtagctga

SEQ ID NO: 632197 - DNA, 25 bp, Mus musculus
gggattctctagttgacgtagctga

SEQ ID NO: 632198 - DNA, 25 bp, Mus musculus
gggattctctgcagctatgttgctt

SEQ ID NO: 632199 - DNA, 25 bp, Mus musculus
gggattctctgctgctatgttgctt

SEQ ID NO: 632200 - DNA, 25 bp, Mus musculus
gggattctgaatcttcaacgtgact

SEQ ID NO: 632201 - DNA, 25 bp, Mus musculus
gggattctgaatgttcaacgtgact

SEQ ID NO: 632202 - DNA, 25 bp, Mus musculus
gggattctgacactttatgttgacg

SEQ ID NO: 632203 - DNA, 25 bp, Mus musculus
gggattctgacagtttatgttgacg

SEQ ID NO: 632204 - DNA, 25 bp, Mus musculus
gggattctgcagcaagacgtaacta

SEQ ID NO: 632205 - DNA, 25 bp, Mus musculus
gggattctgcaggaagacgtaacta

SEQ ID NO: 632206 - DNA, 25 bp, Mus musculus
gggattctgggtaccaatcagaaat

SEQ ID NO: 632207 - DNA, 25 bp, Mus musculus
gggattctgggttccaatcagaaat

SEQ ID NO: 632208 - DNA, 25 bp, Mus musculus
gggattctggtccaatggtaccttt

SEQ ID NO: 632209 - DNA, 25 bp, Mus musculus
gggattctggtcgaatggtaccttt

SEQ ID NO: 632210 - DNA, 25 bp, Mus musculus
gggattctgtaactaatggagtcta

SEQ ID NO: 632211 - DNA, 25 bp, Mus musculus
gggattctgtaagtaatggagtcta

SEQ ID NO: 632212 - DNA, 25 bp, Mus musculus
gggattcttaaacgttcttcattgt

SEQ ID NO: 632213 - DNA, 25 bp, Mus musculus
gggattcttaaaggttcttcattgt

SEQ ID NO: 632214 - DNA, 25 bp, Mus musculus
gggattcttcaacttcagaactaga

SEQ ID NO: 632215 - DNA, 25 bp, Mus musculus
gggattcttcaagttcagaactaga

SEQ ID NO: 632216 - DNA, 25 bp, Mus musculus
gggattcttctgctcaaatatcact

SEQ ID NO: 632217 - DNA, 25 bp, Mus musculus
gggattcttctggtcaaatatcact

SEQ ID NO: 632218 - DNA, 25 bp, Mus musculus
gggattcttcttagcagttaatcat

SEQ ID NO: 632219 - DNA, 25 bp, Mus musculus
gggattcttctttgcagttaatcat

SEQ ID NO: 632220 - DNA, 25 bp, Mus musculus
gggattcttggcctacattaaccac

SEQ ID NO: 632221 - DNA, 25 bp, Mus musculus
gggattcttggcgtacattaaccac

SEQ ID NO: 632222 - DNA, 25 bp, Mus musculus
gggattctttaccaaatatctgtta

SEQ ID NO: 632223 - DNA, 25 bp, Mus musculus
gggattctttacgaaatatctgtta

SEQ ID NO: 632224 - DNA, 25 bp, Mus musculus
gggattgaacacctttcttacagga

SEQ ID NO: 632225 - DNA, 25 bp, Mus musculus
gggattgaacacgtttcttacagga

SEQ ID NO: 632226 - DNA, 25 bp, Mus musculus
gggattgaacctaggtaggcactct

SEQ ID NO: 632227 - DNA, 25 bp, Mus musculus
gggattgaacctcagtgctcgacaa

SEQ ID NO: 632228 - DNA, 25 bp, Mus musculus
gggattgaacctgagtgctcgacaa

SEQ ID NO: 632229 - DNA, 25 bp, Mus musculus
gggattgaaccttggtaggcactct

SEQ ID NO: 632230 - DNA, 25 bp, Mus musculus
gggattgaacgtcgagcctcctgtc

SEQ ID NO: 632231 - DNA, 25 bp, Mus musculus
gggattgaacgtggagcctcctgtc

SEQ ID NO: 632232 - DNA, 25 bp, Mus musculus
gggattgaacttcactgagtaccag

SEQ ID NO: 632233 - DNA, 25 bp, Mus musculus
gggattgaacttgactgagtaccag

SEQ ID NO: 632234 - DNA, 25 bp, Mus musculus
gggattgaagagagctataacacct

SEQ ID NO: 632235 - DNA, 25 bp, Mus musculus
gggattgaagagtgctataacacct

SEQ ID NO: 632236 - DNA, 25 bp, Mus musculus
gggattgaaggcctgctccactatg

SEQ ID NO: 632237 - DNA, 25 bp, Mus musculus
gggattgaaggcgtgctccactatg

SEQ ID NO: 632238 - DNA, 25 bp, Mus musculus
gggattgaatacataggatctcttt

SEQ ID NO: 632239 - DNA, 25 bp, Mus musculus
gggattgaatacttaggatctcttt

SEQ ID NO: 632240 - DNA, 25 bp, Mus musculus
gggattgaccccagggcaaaggcat

SEQ ID NO: 632241 - DNA, 25 bp, Mus musculus
gggattgacccctgggcaaaggcat

SEQ ID NO: 632242 - DNA, 25 bp, Mus musculus
gggattgactgtatgcacaagggca

SEQ ID NO: 632243 - DNA, 25 bp, Mus musculus
gggattgactgtttgcacaagggca

SEQ ID NO: 632244 - DNA, 25 bp, Mus musculus
gggattgagctacactctgactcgg

SEQ ID NO: 632245 - DNA, 25 bp, Mus musculus
gggattgagctagactctgactcgg

SEQ ID NO: 632246 - DNA, 25 bp, Mus musculus
gggattgagctcagactgttaggct

SEQ ID NO: 632247 - DNA, 25 bp, Mus musculus
gggattgagctctgactgttaggct

SEQ ID NO: 632248 - DNA, 25 bp, Mus musculus
gggattgatcacactgtccgaagag

SEQ ID NO: 632249 - DNA, 25 bp, Mus musculus
gggattgatcactctgtccgaagag

SEQ ID NO: 632250 - DNA, 25 bp, Mus musculus
gggattgatctcaagctgctgtgta

SEQ ID NO: 632251 - DNA, 25 bp, Mus musculus
gggattgatctctagctgctgtgta

SEQ ID NO: 632252 - DNA, 25 bp, Mus musculus
gggattgattctcctaagacagcta

SEQ ID NO: 632253 - DNA, 25 bp, Mus musculus
gggattgattctgctaagacagcta

SEQ ID NO: 632254 - DNA, 25 bp, Mus musculus
gggattgcaattactactttcatag

SEQ ID NO: 632255 - DNA, 25 bp, Mus musculus
gggattgcaatttctactttcatag

SEQ ID NO: 632256 - DNA, 25 bp, Mus musculus
gggattgcacacaccaggagacaga

SEQ ID NO: 632257 - DNA, 25 bp, Mus musculus
gggattgcacactccaggagacaga

SEQ ID NO: 632258 - DNA, 25 bp, Mus musculus
gggattgcagatctatgtcactgaa

SEQ ID NO: 632259 - DNA, 25 bp, Mus musculus
gggattgcagatgtatgtcactgaa

SEQ ID NO: 632260 - DNA, 25 bp, Mus musculus
gggattgcaggaacgaggccaacct

SEQ ID NO: 632261 - DNA, 25 bp, Mus musculus
gggattgcaggaccagctttgacca

SEQ ID NO: 632262 - DNA, 25 bp, Mus musculus
gggattgcaggagcagctttgacca

SEQ ID NO: 632263 - DNA, 25 bp, Mus musculus
gggattgcaggatcgaggccaacct

SEQ ID NO: 632264 - DNA, 25 bp, Mus musculus
gggattgcaggtacataccaccaca

SEQ ID NO: 632265 - DNA, 25 bp, Mus musculus
gggattgcaggttcataccaccaca

SEQ ID NO: 632266 - DNA, 25 bp, Mus musculus
gggattgcatgacaccacgtaacct

SEQ ID NO: 632267 - DNA, 25 bp, Mus musculus
gggattgcatgagaccacgtaacct

SEQ ID NO: 632268 - DNA, 25 bp, Mus musculus
gggattgccagcacggtcctaccct

SEQ ID NO: 632269 - DNA, 25 bp, Mus musculus
gggattgccagctcggtcctaccct

SEQ ID NO: 632270 - DNA, 25 bp, Mus musculus
gggattgccccaaccaaagaaatct

SEQ ID NO: 632271 - DNA, 25 bp, Mus musculus
gggattgccccatccaaagaaatct

SEQ ID NO: 632272 - DNA, 25 bp, Mus musculus
gggattgcctgaccttcttgaaaga

SEQ ID NO: 632273 - DNA, 25 bp, Mus musculus
gggattgcctgagcttcttgaaaga

SEQ ID NO: 632274 - DNA, 25 bp, Mus musculus
gggattgctacacaaccaaaccctg

SEQ ID NO: 632275 - DNA, 25 bp, Mus musculus
gggattgctacagaaccaaaccctg

SEQ ID NO: 632276 - DNA, 25 bp, Mus musculus
gggattgctatgctccaaggatcac

SEQ ID NO: 632277 - DNA, 25 bp, Mus musculus
gggattgctatggtccaaggatcac

SEQ ID NO: 632278 - DNA, 25 bp, Mus musculus
gggattgctctaattgctttcactt

SEQ ID NO: 632279 - DNA, 25 bp, Mus musculus
gggattgctctacaacactgcagat

SEQ ID NO: 632280 - DNA, 25 bp, Mus musculus
gggattgctctacactttacaaact

SEQ ID NO: 632281 - DNA, 25 bp, Mus musculus
gggattgctctagaacactgcagat

SEQ ID NO: 632282 - DNA, 25 bp, Mus musculus
gggattgctctagactttacaaact

SEQ ID NO: 632283 - DNA, 25 bp, Mus musculus
gggattgctctatttgctttcactt

SEQ ID NO: 632284 - DNA, 25 bp, Mus musculus
gggattgctctgcttatcggctgct

SEQ ID NO: 632285 - DNA, 25 bp, Mus musculus
gggattgctctggttatcggctgct

SEQ ID NO: 632286 - DNA, 25 bp, Mus musculus
gggattgctcttcgtgcccaatatt

SEQ ID NO: 632287 - DNA, 25 bp, Mus musculus
gggattgctcttggtgcccaatatt

SEQ ID NO: 632288 - DNA, 25 bp, Mus musculus
gggattgctgcaaacctactttcaa

SEQ ID NO: 632289 - DNA, 25 bp, Mus musculus
gggattgctgcatacctactttcaa

SEQ ID NO: 632290 - DNA, 25 bp, Mus musculus
gggattgcttataacaccctgttac

SEQ ID NO: 632291 - DNA, 25 bp, Mus musculus
gggattgcttattacaccctgttac

SEQ ID NO: 632292 - DNA, 25 bp, Mus musculus
gggattgcttcacgatgttcatctc

SEQ ID NO: 632293 - DNA, 25 bp, Mus musculus
gggattgcttcaggatgttcatctc

SEQ ID NO: 632294 - DNA, 25 bp, Mus musculus
gggattgcttttaatgtctagcttc

SEQ ID NO: 632295 - DNA, 25 bp, Mus musculus
gggattgctttttatgtctagcttc

SEQ ID NO: 632296 - DNA, 25 bp, Mus musculus
gggattggattgcagccaaccctaa

SEQ ID NO: 632297 - DNA, 25 bp, Mus musculus
gggattggattggagccaaccctaa

SEQ ID NO: 632298 - DNA, 25 bp, Mus musculus
gggattggcacacctgctgttgcca

SEQ ID NO: 632299 - DNA, 25 bp, Mus musculus
gggattggcacagctgctgttgcca

SEQ ID NO: 632300 - DNA, 25 bp, Mus musculus
gggattggcctcagcacctcactta

SEQ ID NO: 632301 - DNA, 25 bp, Mus musculus
gggattggcctctgcacctcactta

SEQ ID NO: 632302 - DNA, 25 bp, Mus musculus
gggattggcgcaacaattgtttcat

SEQ ID NO: 632303 - DNA, 25 bp, Mus musculus
gggattggcgcatcaattgtttcat

SEQ ID NO: 632304 - DNA, 25 bp, Mus musculus
gggattgggaaaacacagctttcaa

SEQ ID NO: 632305 - DNA, 25 bp, Mus musculus
gggattgggaaatcacagctttcaa

SEQ ID NO: 632306 - DNA, 25 bp, Mus musculus
gggattgggttcctgaatgcaccat

SEQ ID NO: 632307 - DNA, 25 bp, Mus musculus
gggattgggttcgtgaatgcaccat

SEQ ID NO: 632308 - DNA, 25 bp, Mus musculus
gggattggtcctcgtacaagtttca

SEQ ID NO: 632309 - DNA, 25 bp, Mus musculus
gggattggtcctctttgtcattcct

SEQ ID NO: 632310 - DNA, 25 bp, Mus musculus
gggattggtcctggtacaagtttca

SEQ ID NO: 632311 - DNA, 25 bp, Mus musculus
gggattggtcctgtttgtcattcct

SEQ ID NO: 632312 - DNA, 25 bp, Mus musculus
gggattggtgacctcctgagcaaga

SEQ ID NO: 632313 - DNA, 25 bp, Mus musculus
gggattggtgacgtcctgagcaaga

SEQ ID NO: 632314 - DNA, 25 bp, Mus musculus
gggattggttctatgcatggtcatt

SEQ ID NO: 632315 - DNA, 25 bp, Mus musculus
gggattggttctttgcatggtcatt

SEQ ID NO: 632316 - DNA, 25 bp, Mus musculus
gggattgtaagtcaaccccgtgatc

SEQ ID NO: 632317 - DNA, 25 bp, Mus musculus
gggattgtaagtgaaccccgtgatc

SEQ ID NO: 632318 - DNA, 25 bp, Mus musculus
gggattgtacaactgctgccagaat

SEQ ID NO: 632319 - DNA, 25 bp, Mus musculus
gggattgtacaagtgctgccagaat

SEQ ID NO: 632320 - DNA, 25 bp, Mus musculus
gggattgtacttcaacactaaaatt

SEQ ID NO: 632321 - DNA, 25 bp, Mus musculus
gggattgtacttgaacactaaaatt

SEQ ID NO: 632322 - DNA, 25 bp, Mus musculus
gggattgtcatgatggtttctacat

SEQ ID NO: 632323 - DNA, 25 bp, Mus musculus
gggattgtcatgttggtttctacat

SEQ ID NO: 632324 - DNA, 25 bp, Mus musculus
gggattgtcgttcagcactactggc

SEQ ID NO: 632325 - DNA, 25 bp, Mus musculus
gggattgtcgttgagcactactggc

SEQ ID NO: 632326 - DNA, 25 bp, Mus musculus
gggattgtctacacaggaagctgga

SEQ ID NO: 632327 - DNA, 25 bp, Mus musculus
gggattgtctactcaggaagctgga

SEQ ID NO: 632328 - DNA, 25 bp, Mus musculus
gggattgtctccaagaacttcacca

SEQ ID NO: 632329 - DNA, 25 bp, Mus musculus
gggattgtctcctagaacttcacca

SEQ ID NO: 632330 - DNA, 25 bp, Mus musculus
gggattgtctctcagatgtgaccct

SEQ ID NO: 632331 - DNA, 25 bp, Mus musculus
gggattgtctctgagatgtgaccct

SEQ ID NO: 632332 - DNA, 25 bp, Mus musculus
gggattgtctttcttgcaaggtctc

SEQ ID NO: 632333 - DNA, 25 bp, Mus musculus
gggattgtctttgttgcaaggtctc

SEQ ID NO: 632334 - DNA, 25 bp, Mus musculus
gggattgtgctaaggaacgtcttta

SEQ ID NO: 632335 - DNA, 25 bp, Mus musculus
gggattgtgctatggaacgtcttta

SEQ ID NO: 632336 - DNA, 25 bp, Mus musculus
gggattgtggttctaagccttgcat

SEQ ID NO: 632337 - DNA, 25 bp, Mus musculus
gggattgtggttgtaagccttgcat

SEQ ID NO: 632338 - DNA, 25 bp, Mus musculus
gggattgttgctcggattatatact

SEQ ID NO: 632339 - DNA, 25 bp, Mus musculus
gggattgttgctgggattatatact

SEQ ID NO: 632340 - DNA, 25 bp, Mus musculus
gggattgttttaactcggatcttca

SEQ ID NO: 632341 - DNA, 25 bp, Mus musculus
gggattgttttatctcggatcttca

SEQ ID NO: 632342 - DNA, 25 bp, Mus musculus
gggattgttttcagacctgcaatta

SEQ ID NO: 632343 - DNA, 25 bp, Mus musculus
gggattgttttctgacctgcaatta

SEQ ID NO: 632344 - DNA, 25 bp, Mus musculus
gggatttaaaatagccaatcacgag

SEQ ID NO: 632345 - DNA, 25 bp, Mus musculus
gggatttaaaatcactctgcttttt

SEQ ID NO: 632346 - DNA, 25 bp, Mus musculus
gggatttaaaatgactctgcttttt

SEQ ID NO: 632347 - DNA, 25 bp, Mus musculus
gggatttaaaattgccaatcacgag

SEQ ID NO: 632348 - DNA, 25 bp, Mus musculus
gggatttaaacaacgagtcagctct

SEQ ID NO: 632349 - DNA, 25 bp, Mus musculus
gggatttaaacatcgagtcagctct

SEQ ID NO: 632350 - DNA, 25 bp, Mus musculus
gggatttaactcaaatgacctggaa

SEQ ID NO: 632351 - DNA, 25 bp, Mus musculus
gggatttaactctaatgacctggaa

SEQ ID NO: 632352 - DNA, 25 bp, Mus musculus
gggatttaagtccacctaacacaga

SEQ ID NO: 632353 - DNA, 25 bp, Mus musculus
gggatttaagtcgacctaacacaga

SEQ ID NO: 632354 - DNA, 25 bp, Mus musculus
gggatttaattgatccctcagattt

SEQ ID NO: 632355 - DNA, 25 bp, Mus musculus
gggatttaattgttccctcagattt

SEQ ID NO: 632356 - DNA, 25 bp, Mus musculus
gggatttacccgaatgcatctcatt

SEQ ID NO: 632357 - DNA, 25 bp, Mus musculus
gggatttacccgtatgcatctcatt

SEQ ID NO: 632358 - DNA, 25 bp, Mus musculus
gggatttagaagcacttcaggctca

SEQ ID NO: 632359 - DNA, 25 bp, Mus musculus
gggatttagaaggacttcaggctca

SEQ ID NO: 632360 - DNA, 25 bp, Mus musculus
gggatttagcagcaacccggtcatc

SEQ ID NO: 632361 - DNA, 25 bp, Mus musculus
gggatttagcaggaacccggtcatc

SEQ ID NO: 632362 - DNA, 25 bp, Mus musculus
gggatttagtgtagccacagctggc

SEQ ID NO: 632363 - DNA, 25 bp, Mus musculus
gggatttagtgttgccacagctggc

SEQ ID NO: 632364 - DNA, 25 bp, Mus musculus
gggatttatgcaccatgtgtataaa

SEQ ID NO: 632365 - DNA, 25 bp, Mus musculus
gggatttatgcagcatgtgtataaa

SEQ ID NO: 632366 - DNA, 25 bp, Mus musculus
gggatttcaaacagttccatgactt

SEQ ID NO: 632367 - DNA, 25 bp, Mus musculus
gggatttcaaactgttccatgactt

SEQ ID NO: 632368 - DNA, 25 bp, Mus musculus
gggatttcaccacacaaggccgcag

SEQ ID NO: 632369 - DNA, 25 bp, Mus musculus
gggatttcaccagacaaggccgcag

SEQ ID NO: 632370 - DNA, 25 bp, Mus musculus
gggatttcagagagcctgccccgac

SEQ ID NO: 632371 - DNA, 25 bp, Mus musculus
gggatttcagagatgcccttcaccc

SEQ ID NO: 632372 - DNA, 25 bp, Mus musculus
gggatttcagagtgcctgccccgac

SEQ ID NO: 632373 - DNA, 25 bp, Mus musculus
gggatttcagagttgcccttcaccc

SEQ ID NO: 632374 - DNA, 25 bp, Mus musculus
gggatttcagatccacaccagacac

SEQ ID NO: 632375 - DNA, 25 bp, Mus musculus
gggatttcagatgcacaccagacac

SEQ ID NO: 632376 - DNA, 25 bp, Mus musculus
gggatttccaatatttcatgtgtac

SEQ ID NO: 632377 - DNA, 25 bp, Mus musculus
gggatttccaatttttcatgtgtac

SEQ ID NO: 632378 - DNA, 25 bp, Mus musculus
gggatttccctcatagagtgctact

SEQ ID NO: 632379 - DNA, 25 bp, Mus musculus
gggatttccctcttagagtgctact

SEQ ID NO: 632380 - DNA, 25 bp, Mus musculus
gggatttcccttaacaagaggctgc

SEQ ID NO: 632381 - DNA, 25 bp, Mus musculus
gggatttccctttacaagaggctgc

SEQ ID NO: 632382 - DNA, 25 bp, Mus musculus
gggatttcctatctgaagttgacag

SEQ ID NO: 632383 - DNA, 25 bp, Mus musculus
gggatttcctatgtgaagttgacag

SEQ ID NO: 632384 - DNA, 25 bp, Mus musculus
gggatttcctgcaactatgtcagat

SEQ ID NO: 632385 - DNA, 25 bp, Mus musculus
gggatttcctgctactatgtcagat

SEQ ID NO: 632386 - DNA, 25 bp, Mus musculus
gggatttccttaaacattctgtgac

SEQ ID NO: 632387 - DNA, 25 bp, Mus musculus
gggatttccttatacattctgtgac

SEQ ID NO: 632388 - DNA, 25 bp, Mus musculus
gggatttcgaatacagtacagacca

SEQ ID NO: 632389 - DNA, 25 bp, Mus musculus
gggatttcgaattcagtacagacca

SEQ ID NO: 632390 - DNA, 25 bp, Mus musculus
gggatttctattctagctaccacat

SEQ ID NO: 632391 - DNA, 25 bp, Mus musculus
gggatttctattgtagctaccacat

SEQ ID NO: 632392 - DNA, 25 bp, Mus musculus
gggatttctcacactggtctgtaca

SEQ ID NO: 632393 - DNA, 25 bp, Mus musculus
gggatttctcactctggtctgtaca

SEQ ID NO: 632394 - DNA, 25 bp, Mus musculus
gggatttctgaacgtacccagacac

SEQ ID NO: 632395 - DNA, 25 bp, Mus musculus
gggatttctgaaggtacccagacac

SEQ ID NO: 632396 - DNA, 25 bp, Mus musculus
gggatttctgatcagtaccatgtca

SEQ ID NO: 632397 - DNA, 25 bp, Mus musculus
gggatttctgatgagtaccatgtca

SEQ ID NO: 632398 - DNA, 25 bp, Mus musculus
gggatttctgccaatgtgctgctgc

SEQ ID NO: 632399 - DNA, 25 bp, Mus musculus
gggatttctgccacacaccagaaat

SEQ ID NO: 632400 - DNA, 25 bp, Mus musculus
gggatttctgcctatgtgctgctgc

SEQ ID NO: 632401 - DNA, 25 bp, Mus musculus
gggatttctgcctcacaccagaaat

SEQ ID NO: 632402 - DNA, 25 bp, Mus musculus
gggatttctggtcctcactggccag

SEQ ID NO: 632403 - DNA, 25 bp, Mus musculus
gggatttctggtgctcactggccag

SEQ ID NO: 632404 - DNA, 25 bp, Mus musculus
gggatttctgtaattactgcttttc

SEQ ID NO: 632405 - DNA, 25 bp, Mus musculus
gggatttctgtatttactgcttttc

SEQ ID NO: 632406 - DNA, 25 bp, Mus musculus
gggatttcttccaagctatcaagca

SEQ ID NO: 632407 - DNA, 25 bp, Mus musculus
gggatttcttcctagctatcaagca

SEQ ID NO: 632408 - DNA, 25 bp, Mus musculus
gggatttgaatgaccatcctccaaa

SEQ ID NO: 632409 - DNA, 25 bp, Mus musculus
gggatttgaatgacttgctgcttta

SEQ ID NO: 632410 - DNA, 25 bp, Mus musculus
gggatttgaatgtccatcctccaaa

SEQ ID NO: 632411 - DNA, 25 bp, Mus musculus
gggatttgaatgtcttgctgcttta

SEQ ID NO: 632412 - DNA, 25 bp, Mus musculus
gggatttgacacctttgaattacga

SEQ ID NO: 632413 - DNA, 25 bp, Mus musculus
gggatttgacacgtttgaattacga

SEQ ID NO: 632414 - DNA, 25 bp, Mus musculus
gggatttgatgaaccagctttgcac

SEQ ID NO: 632415 - DNA, 25 bp, Mus musculus
gggatttgatgatccagctttgcac

SEQ ID NO: 632416 - DNA, 25 bp, Mus musculus
gggatttgcactacagtcctgtcaa

SEQ ID NO: 632417 - DNA, 25 bp, Mus musculus
gggatttgcacttcagtcctgtcaa

SEQ ID NO: 632418 - DNA, 25 bp, Mus musculus
gggatttgcctcatttgactccaca

SEQ ID NO: 632419 - DNA, 25 bp, Mus musculus
gggatttgcctcttttgactccaca

SEQ ID NO: 632420 - DNA, 25 bp, Mus musculus
gggatttgccttaaccgctggttgt

SEQ ID NO: 632421 - DNA, 25 bp, Mus musculus
gggatttgcctttaccgctggttgt

SEQ ID NO: 632422 - DNA, 25 bp, Mus musculus
gggatttgcgtcatttatatacctt

SEQ ID NO: 632423 - DNA, 25 bp, Mus musculus
gggatttgcgtcttttatatacctt

SEQ ID NO: 632424 - DNA, 25 bp, Mus musculus
gggatttgctaccacagaagctaag

SEQ ID NO: 632425 - DNA, 25 bp, Mus musculus
gggatttgctacgacagaagctaag

SEQ ID NO: 632426 - DNA, 25 bp, Mus musculus
gggatttgctccatcttctctttcc

SEQ ID NO: 632427 - DNA, 25 bp, Mus musculus
gggatttgctccttcttctctttcc

SEQ ID NO: 632428 - DNA, 25 bp, Mus musculus
gggatttgctgccactagattagct

SEQ ID NO: 632429 - DNA, 25 bp, Mus musculus
gggatttgctgcgactagattagct

SEQ ID NO: 632430 - DNA, 25 bp, Mus musculus
gggatttgctgtcagaattcttata

SEQ ID NO: 632431 - DNA, 25 bp, Mus musculus
gggatttgctgtgagaattcttata

SEQ ID NO: 632432 - DNA, 25 bp, Mus musculus
gggatttgcttcagtccactaatat

SEQ ID NO: 632433 - DNA, 25 bp, Mus musculus
gggatttgcttctgtccactaatat

SEQ ID NO: 632434 - DNA, 25 bp, Mus musculus
gggatttgctttaaaccttggagag

SEQ ID NO: 632435 - DNA, 25 bp, Mus musculus
gggatttgcttttaaccttggagag

SEQ ID NO: 632436 - DNA, 25 bp, Mus musculus
gggatttggatgatgcactacccca

SEQ ID NO: 632437 - DNA, 25 bp, Mus musculus
gggatttggatgttgcactacccca

SEQ ID NO: 632438 - DNA, 25 bp, Mus musculus
gggatttgtactcattttccaagtt

SEQ ID NO: 632439 - DNA, 25 bp, Mus musculus
gggatttgtactgattttccaagtt

SEQ ID NO: 632440 - DNA, 25 bp, Mus musculus
gggatttgtcccaatggcctggtcc

SEQ ID NO: 632441 - DNA, 25 bp, Mus musculus
gggatttgtccctatggcctggtcc

SEQ ID NO: 632442 - DNA, 25 bp, Mus musculus
gggattttaaccattgaggctactc

SEQ ID NO: 632443 - DNA, 25 bp, Mus musculus
gggattttaacctttgaggctactc

SEQ ID NO: 632444 - DNA, 25 bp, Mus musculus
gggattttaatcaagccacacaggg

SEQ ID NO: 632445 - DNA, 25 bp, Mus musculus
gggattttaatcacttcttaacctg

SEQ ID NO: 632446 - DNA, 25 bp, Mus musculus
gggattttaatctagccacacaggg

SEQ ID NO: 632447 - DNA, 25 bp, Mus musculus
gggattttaatctcttcttaacctg

SEQ ID NO: 632448 - DNA, 25 bp, Mus musculus
gggattttaggcatgggccactaca

SEQ ID NO: 632449 - DNA, 25 bp, Mus musculus
gggattttaggcttgggccactaca

SEQ ID NO: 632450 - DNA, 25 bp, Mus musculus
gggattttatccataggctctttct

SEQ ID NO: 632451 - DNA, 25 bp, Mus musculus
gggattttatccttaggctctttct

SEQ ID NO: 632452 - DNA, 25 bp, Mus musculus
gggattttcagtcatttgatcactt

SEQ ID NO: 632453 - DNA, 25 bp, Mus musculus
gggattttcagtgatttgatcactt

SEQ ID NO: 632454 - DNA, 25 bp, Mus musculus
gggattttccctatcaggacaatct

SEQ ID NO: 632455 - DNA, 25 bp, Mus musculus
gggattttccctttcaggacaatct

SEQ ID NO: 632456 - DNA, 25 bp, Mus musculus
gggattttcctacccttgactatgg

SEQ ID NO: 632457 - DNA, 25 bp, Mus musculus
gggattttcctagccttgactatgg

SEQ ID NO: 632458 - DNA, 25 bp, Mus musculus
gggattttctgtctatcttgaacct

SEQ ID NO: 632459 - DNA, 25 bp, Mus musculus
gggattttctgtgtatcttgaacct

SEQ ID NO: 632460 - DNA, 25 bp, Mus musculus
gggattttcttcacagattacttct

SEQ ID NO: 632461 - DNA, 25 bp, Mus musculus
gggattttcttctcagattacttct

SEQ ID NO: 632462 - DNA, 25 bp, Mus musculus
gggattttcttgcactatgatgctg

SEQ ID NO: 632463 - DNA, 25 bp, Mus musculus
gggattttcttggactatgatgctg

SEQ ID NO: 632464 - DNA, 25 bp, Mus musculus
gggattttgaccatcctcattactc

SEQ ID NO: 632465 - DNA, 25 bp, Mus musculus
gggattttgaccttcctcattactc

SEQ ID NO: 632466 - DNA, 25 bp, Mus musculus
gggattttgatcaggaacttgaggc

SEQ ID NO: 632467 - DNA, 25 bp, Mus musculus
gggattttgatctggaacttgaggc

SEQ ID NO: 632468 - DNA, 25 bp, Mus musculus
gggattttgcaaccgtgggatcaca

SEQ ID NO: 632469 - DNA, 25 bp, Mus musculus
gggattttgcaagcgtgggatcaca

SEQ ID NO: 632470 - DNA, 25 bp, Mus musculus
gggattttgcacaccgatgttatat

SEQ ID NO: 632471 - DNA, 25 bp, Mus musculus
gggattttgcactccgatgttatat

SEQ ID NO: 632472 - DNA, 25 bp, Mus musculus
gggattttggacatccagtcagtgg

SEQ ID NO: 632473 - DNA, 25 bp, Mus musculus
gggattttggacttccagtcagtgg

SEQ ID NO: 632474 - DNA, 25 bp, Mus musculus
gggattttggttcctggacctcaat

SEQ ID NO: 632475 - DNA, 25 bp, Mus musculus
gggattttggttgctggacctcaat

SEQ ID NO: 632476 - DNA, 25 bp, Mus musculus
gggattttgtaaagttcatgtgcta

SEQ ID NO: 632477 - DNA, 25 bp, Mus musculus
gggattttgtaatgttcatgtgcta

SEQ ID NO: 632478 - DNA, 25 bp, Mus musculus
gggattttgtcaaccaggtggcttt

SEQ ID NO: 632479 - DNA, 25 bp, Mus musculus
gggattttgtcatccaggtggcttt

SEQ ID NO: 632480 - DNA, 25 bp, Mus musculus
gggattttgtgcacaggaaccatga

SEQ ID NO: 632481 - DNA, 25 bp, Mus musculus
gggattttgtgctcaggaaccatga

SEQ ID NO: 632482 - DNA, 25 bp, Mus musculus
gggattttgtgtcccaggaacaaag

SEQ ID NO: 632483 - DNA, 25 bp, Mus musculus
gggattttgtgtgccaggaacaaag

SEQ ID NO: 632484 - DNA, 25 bp, Mus musculus
gggattttgttcctagtaactagtg

SEQ ID NO: 632485 - DNA, 25 bp, Mus musculus
gggattttgttcgtagtaactagtg

SEQ ID NO: 632486 - DNA, 25 bp, Mus musculus
gggatttttaacacacagcgaccat

SEQ ID NO: 632487 - DNA, 25 bp, Mus musculus
gggatttttaactcacagcgaccat

SEQ ID NO: 632488 - DNA, 25 bp, Mus musculus
gggatttttactaccacgcggccat

SEQ ID NO: 632489 - DNA, 25 bp, Mus musculus
gggatttttacttccacgcggccat

SEQ ID NO: 632490 - DNA, 25 bp, Mus musculus
gggatttttcaacctccgagctggt

SEQ ID NO: 632491 - DNA, 25 bp, Mus musculus
gggatttttcaagctccgagctggt

SEQ ID NO: 632492 - DNA, 25 bp, Mus musculus
gggatttttccacctaatgtgcagt

SEQ ID NO: 632493 - DNA, 25 bp, Mus musculus
gggatttttccagctaatgtgcagt

SEQ ID NO: 632494 - DNA, 25 bp, Mus musculus
gggatttttctaagttggttctcag

SEQ ID NO: 632495 - DNA, 25 bp, Mus musculus
gggatttttctatgttggttctcag

SEQ ID NO: 632496 - DNA, 25 bp, Mus musculus
gggatttttctcaatgatcatttga

SEQ ID NO: 632497 - DNA, 25 bp, Mus musculus
gggatttttctctatgatcatttga

SEQ ID NO: 632498 - DNA, 25 bp, Mus musculus
gggatttttgtactgtctctttagc

SEQ ID NO: 632499 - DNA, 25 bp, Mus musculus
gggatttttgtagtgtctctttagc

SEQ ID NO: 632500 - DNA, 25 bp, Mus musculus
gggattttttacactgctttgtgga

SEQ ID NO: 632501 - DNA, 25 bp, Mus musculus
gggattttttactctgctttgtgga

SEQ ID NO: 632502 - DNA, 25 bp, Mus musculus
gggattttttagctcattaattaga

SEQ ID NO: 632503 - DNA, 25 bp, Mus musculus
gggattttttaggtcattaattaga

SEQ ID NO: 632504 - DNA, 25 bp, Mus musculus
gggcaaaaacacagacccacttgaa

SEQ ID NO: 632505 - DNA, 25 bp, Mus musculus
gggcaaaaacactgacccacttgaa

SEQ ID NO: 632506 - DNA, 25 bp, Mus musculus
gggcaaaaatttccatgtgattcga

SEQ ID NO: 632507 - DNA, 25 bp, Mus musculus
gggcaaaaatttgcatgtgattcga

SEQ ID NO: 632508 - DNA, 25 bp, Mus musculus
gggcaaaacactcaaatactcacaa

SEQ ID NO: 632509 - DNA, 25 bp, Mus musculus
gggcaaaacactgaaatactcacaa

SEQ ID NO: 632510 - DNA, 25 bp, Mus musculus
gggcaaaaccatacatcccattgcc

SEQ ID NO: 632511 - DNA, 25 bp, Mus musculus
gggcaaaaccattcatcccattgcc

SEQ ID NO: 632512 - DNA, 25 bp, Mus musculus
gggcaaaacgcaatcttgtcatttg

SEQ ID NO: 632513 - DNA, 25 bp, Mus musculus
gggcaaaacgcattcttgtcatttg

SEQ ID NO: 632514 - DNA, 25 bp, Mus musculus
gggcaaaactggctgttcatacatg

SEQ ID NO: 632515 - DNA, 25 bp, Mus musculus
gggcaaaactgggtgttcatacatg

SEQ ID NO: 632516 - DNA, 25 bp, Mus musculus
gggcaaaagcagataccataggtct

SEQ ID NO: 632517 - DNA, 25 bp, Mus musculus
gggcaaaagcagttaccataggtct

SEQ ID NO: 632518 - DNA, 25 bp, Mus musculus
gggcaaaagtcaatagtgcttcaaa

SEQ ID NO: 632519 - DNA, 25 bp, Mus musculus
gggcaaaagtcactcttgctgtgaa

SEQ ID NO: 632520 - DNA, 25 bp, Mus musculus
gggcaaaagtcagtcttgctgtgaa

SEQ ID NO: 632521 - DNA, 25 bp, Mus musculus
gggcaaaagtcattagtgcttcaaa

SEQ ID NO: 632522 - DNA, 25 bp, Mus musculus
gggcaaaagtgtcttccttgagcaa

SEQ ID NO: 632523 - DNA, 25 bp, Mus musculus
gggcaaaagtgtgttccttgagcaa

SEQ ID NO: 632524 - DNA, 25 bp, Mus musculus
gggcaaaataaaatcacactcacac

SEQ ID NO: 632525 - DNA, 25 bp, Mus musculus
gggcaaaataaattcacactcacac

SEQ ID NO: 632526 - DNA, 25 bp, Mus musculus
gggcaaaatacactcacaacttcac

SEQ ID NO: 632527 - DNA, 25 bp, Mus musculus
gggcaaaatacagtcacaacttcac

SEQ ID NO: 632528 - DNA, 25 bp, Mus musculus
gggcaaaataccaatgtgcataaga

SEQ ID NO: 632529 - DNA, 25 bp, Mus musculus
gggcaaaatacctatgtgcataaga

SEQ ID NO: 632530 - DNA, 25 bp, Mus musculus
gggcaaaatatcatcactgtaacgt

SEQ ID NO: 632531 - DNA, 25 bp, Mus musculus
gggcaaaatatcttcactgtaacgt

SEQ ID NO: 632532 - DNA, 25 bp, Mus musculus
gggcaaaattcactgacgtcctgtc

SEQ ID NO: 632533 - DNA, 25 bp, Mus musculus
gggcaaaattcagtgacgtcctgtc

SEQ ID NO: 632534 - DNA, 25 bp, Mus musculus
gggcaaaattccataggctgtgggt

SEQ ID NO: 632535 - DNA, 25 bp, Mus musculus
gggcaaaattccttaggctgtgggt

SEQ ID NO: 632536 - DNA, 25 bp, Mus musculus
gggcaaaattgcacccggtgaagaa

SEQ ID NO: 632537 - DNA, 25 bp, Mus musculus
gggcaaaattgctcccggtgaagaa

SEQ ID NO: 632538 - DNA, 25 bp, Mus musculus
gggcaaacaacaccatgacgggctg

SEQ ID NO: 632539 - DNA, 25 bp, Mus musculus
gggcaaacaacagcatgacgggctg

SEQ ID NO: 632540 - DNA, 25 bp, Mus musculus
gggcaaacaacccagtcaaggctgt

SEQ ID NO: 632541 - DNA, 25 bp, Mus musculus
gggcaaacaaccgagtcaaggctgt

SEQ ID NO: 632542 - DNA, 25 bp, Mus musculus
gggcaaacaccaactcaaacatttc

SEQ ID NO: 632543 - DNA, 25 bp, Mus musculus
gggcaaacaccatctcaaacatttc

SEQ ID NO: 632544 - DNA, 25 bp, Mus musculus
gggcaaacaccccagactcagatgt

SEQ ID NO: 632545 - DNA, 25 bp, Mus musculus
gggcaaacacccgagactcagatgt

SEQ ID NO: 632546 - DNA, 25 bp, Mus musculus
gggcaaacaccgcagctacctgaag

SEQ ID NO: 632547 - DNA, 25 bp, Mus musculus
gggcaaacaccggagctacctgaag

SEQ ID NO: 632548 - DNA, 25 bp, Mus musculus
gggcaaacagaacctaaatgactga

SEQ ID NO: 632549 - DNA, 25 bp, Mus musculus
gggcaaacagaagctaaatgactga

SEQ ID NO: 632550 - DNA, 25 bp, Mus musculus
gggcaaacatcaacatcacctgtgg

SEQ ID NO: 632551 - DNA, 25 bp, Mus musculus
gggcaaacatcatcatcacctgtgg

SEQ ID NO: 632552 - DNA, 25 bp, Mus musculus
gggcaaaccaagaacttcagcgttg

SEQ ID NO: 632553 - DNA, 25 bp, Mus musculus
gggcaaaccaagtacttcagcgttg

SEQ ID NO: 632554 - DNA, 25 bp, Mus musculus
gggcaaacccaaaggtgacacaatt

SEQ ID NO: 632555 - DNA, 25 bp, Mus musculus
gggcaaacccaatggtgacacaatt

SEQ ID NO: 632556 - DNA, 25 bp, Mus musculus
gggcaaacccccagtggatgagact

SEQ ID NO: 632557 - DNA, 25 bp, Mus musculus
gggcaaaccccctgtggatgagact

SEQ ID NO: 632558 - DNA, 25 bp, Mus musculus
gggcaaaccgttagaagtcttccag

SEQ ID NO: 632559 - DNA, 25 bp, Mus musculus
gggcaaaccgtttgaagtcttccag

SEQ ID NO: 632560 - DNA, 25 bp, Mus musculus
gggcaaacgggcactcaaccctaat

SEQ ID NO: 632561 - DNA, 25 bp, Mus musculus
gggcaaacgggctctcaaccctaat

SEQ ID NO: 632562 - DNA, 25 bp, Mus musculus
gggcaaactactctaatcacacttc

SEQ ID NO: 632563 - DNA, 25 bp, Mus musculus
gggcaaactactgtaatcacacttc

SEQ ID NO: 632564 - DNA, 25 bp, Mus musculus
gggcaaactctaaggtacatacgta

SEQ ID NO: 632565 - DNA, 25 bp, Mus musculus
gggcaaactctatggtacatacgta

SEQ ID NO: 632566 - DNA, 25 bp, Mus musculus
gggcaaactgagaacctgattagtc

SEQ ID NO: 632567 - DNA, 25 bp, Mus musculus
gggcaaactgagtacctgattagtc

SEQ ID NO: 632568 - DNA, 25 bp, Mus musculus
gggcaaactgctaatcctgaacctt

SEQ ID NO: 632569 - DNA, 25 bp, Mus musculus
gggcaaactgcttatcctgaacctt

SEQ ID NO: 632570 - DNA, 25 bp, Mus musculus
gggcaaactgtccttacaggctcca

SEQ ID NO: 632571 - DNA, 25 bp, Mus musculus
gggcaaactgtcgttacaggctcca

SEQ ID NO: 632572 - DNA, 25 bp, Mus musculus
gggcaaacttcaacgtcaaccatat

SEQ ID NO: 632573 - DNA, 25 bp, Mus musculus
gggcaaacttcatcgtcaaccatat

SEQ ID NO: 632574 - DNA, 25 bp, Mus musculus
gggcaaagaaacatccctacgtctc

SEQ ID NO: 632575 - DNA, 25 bp, Mus musculus
gggcaaagaaacttccctacgtctc

SEQ ID NO: 632576 - DNA, 25 bp, Mus musculus
gggcaaagaactcccaatgactcta

SEQ ID NO: 632577 - DNA, 25 bp, Mus musculus
gggcaaagaactgccaatgactcta

SEQ ID NO: 632578 - DNA, 25 bp, Mus musculus
gggcaaagacccagttcatcatcat

SEQ ID NO: 632579 - DNA, 25 bp, Mus musculus
gggcaaagaccctgttcatcatcat

SEQ ID NO: 632580 - DNA, 25 bp, Mus musculus
gggcaaagagatccggcccacctat

SEQ ID NO: 632581 - DNA, 25 bp, Mus musculus
gggcaaagagatgcggcccacctat

SEQ ID NO: 632582 - DNA, 25 bp, Mus musculus
gggcaaagatgcctgcccttcacat

SEQ ID NO: 632583 - DNA, 25 bp, Mus musculus
gggcaaagatgcgtgcccttcacat

SEQ ID NO: 632584 - DNA, 25 bp, Mus musculus
gggcaaagcaacagcacacaccttc

SEQ ID NO: 632585 - DNA, 25 bp, Mus musculus
gggcaaagcaactgcacacaccttc

SEQ ID NO: 632586 - DNA, 25 bp, Mus musculus
gggcaaagcaccatgaatttttcaa

SEQ ID NO: 632587 - DNA, 25 bp, Mus musculus
gggcaaagcaccttgaatttttcaa

SEQ ID NO: 632588 - DNA, 25 bp, Mus musculus
gggcaaagcactacatcactgcaaa

SEQ ID NO: 632589 - DNA, 25 bp, Mus musculus
gggcaaagcacttcatcactgcaaa

SEQ ID NO: 632590 - DNA, 25 bp, Mus musculus
gggcaaagccctacagaccatgaaa

SEQ ID NO: 632591 - DNA, 25 bp, Mus musculus
gggcaaagcccttcagaccatgaaa

SEQ ID NO: 632592 - DNA, 25 bp, Mus musculus
gggcaaagcgcaacatttggtcaaa

SEQ ID NO: 632593 - DNA, 25 bp, Mus musculus
gggcaaagcgcatcatttggtcaaa

SEQ ID NO: 632594 - DNA, 25 bp, Mus musculus
gggcaaaggaacactactggactct

SEQ ID NO: 632595 - DNA, 25 bp, Mus musculus
gggcaaaggaactctactggactct

SEQ ID NO: 632596 - DNA, 25 bp, Mus musculus
gggcaaaggcacatgatgccaaact

SEQ ID NO: 632597 - DNA, 25 bp, Mus musculus
gggcaaaggcacttgatgccaaact

SEQ ID NO: 632598 - DNA, 25 bp, Mus musculus
gggcaaaggccacggcatgtcacaa

SEQ ID NO: 632599 - DNA, 25 bp, Mus musculus
gggcaaaggccagggcatgtcacaa

SEQ ID NO: 632600 - DNA, 25 bp, Mus musculus
gggcaaaggcgccttgcacatagaa

SEQ ID NO: 632601 - DNA, 25 bp, Mus musculus
gggcaaaggcgcgttgcacatagaa

SEQ ID NO: 632602 - DNA, 25 bp, Mus musculus
gggcaaatcaacatcctgttctgcc

SEQ ID NO: 632603 - DNA, 25 bp, Mus musculus
gggcaaatcaacttcctgttctgcc

SEQ ID NO: 632604 - DNA, 25 bp, Mus musculus
gggcaaatcacaagttttaattggt

SEQ ID NO: 632605 - DNA, 25 bp, Mus musculus
gggcaaatcacatgttttaattggt

SEQ ID NO: 632606 - DNA, 25 bp, Mus musculus
gggcaaatccccaactcaaagcaca

SEQ ID NO: 632607 - DNA, 25 bp, Mus musculus
gggcaaatcccctactcaaagcaca

SEQ ID NO: 632608 - DNA, 25 bp, Mus musculus
gggcaaatctacaaatctaacatct

SEQ ID NO: 632609 - DNA, 25 bp, Mus musculus
gggcaaatctactaatctaacatct

SEQ ID NO: 632610 - DNA, 25 bp, Mus musculus
gggcaaatctgtagctcaactccat

SEQ ID NO: 632611 - DNA, 25 bp, Mus musculus
gggcaaatctgttgctcaactccat

SEQ ID NO: 632612 - DNA, 25 bp, Mus musculus
gggcaaatgcctaccagcgctggaa

SEQ ID NO: 632613 - DNA, 25 bp, Mus musculus
gggcaaatgccttccagcgctggaa

SEQ ID NO: 632614 - DNA, 25 bp, Mus musculus
gggcaaatgcggctacatctcccaa

SEQ ID NO: 632615 - DNA, 25 bp, Mus musculus
gggcaaatgcgggtacatctcccaa

SEQ ID NO: 632616 - DNA, 25 bp, Mus musculus
gggcaaatggagcaactttatctaa

SEQ ID NO: 632617 - DNA, 25 bp, Mus musculus
gggcaaatggaggaactttatctaa

SEQ ID NO: 632618 - DNA, 25 bp, Mus musculus
gggcaaatggatcagtaacaaccat

SEQ ID NO: 632619 - DNA, 25 bp, Mus musculus
gggcaaatggatgagtaacaaccat

SEQ ID NO: 632620 - DNA, 25 bp, Mus musculus
gggcaaattaccactcgttgggtgt

SEQ ID NO: 632621 - DNA, 25 bp, Mus musculus
gggcaaattacctctcgttgggtgt

SEQ ID NO: 632622 - DNA, 25 bp, Mus musculus
gggcaaattcatctcatctatacaa

SEQ ID NO: 632623 - DNA, 25 bp, Mus musculus
gggcaaattcatgtcatctatacaa

SEQ ID NO: 632624 - DNA, 25 bp, Mus musculus
gggcaaattgcacagctcttcagtc

SEQ ID NO: 632625 - DNA, 25 bp, Mus musculus
gggcaaattgcagagctcttcagtc

SEQ ID NO: 632626 - DNA, 25 bp, Mus musculus
gggcaaattggcaacctctgtgccc

SEQ ID NO: 632627 - DNA, 25 bp, Mus musculus
gggcaaattggctacctctgtgccc

SEQ ID NO: 632628 - DNA, 25 bp, Mus musculus
gggcaaatttgtcttgagatcattt

SEQ ID NO: 632629 - DNA, 25 bp, Mus musculus
gggcaaatttgtgttgagatcattt

SEQ ID NO: 632630 - DNA, 25 bp, Mus musculus
gggcaacaaattatacccaatgcag

SEQ ID NO: 632631 - DNA, 25 bp, Mus musculus
gggcaacaaattttacccaatgcag

SEQ ID NO: 632632 - DNA, 25 bp, Mus musculus
gggcaacaactgatggtgtcccttc

SEQ ID NO: 632633 - DNA, 25 bp, Mus musculus
gggcaacaactgttggtgtcccttc

SEQ ID NO: 632634 - DNA, 25 bp, Mus musculus
gggcaacaacttcttcttaggacac

SEQ ID NO: 632635 - DNA, 25 bp, Mus musculus
gggcaacaacttgttcttaggacac

SEQ ID NO: 632636 - DNA, 25 bp, Mus musculus
gggcaacacagacaaccccatgtct

SEQ ID NO: 632637 - DNA, 25 bp, Mus musculus
gggcaacacagagaaccccatgtct

SEQ ID NO: 632638 - DNA, 25 bp, Mus musculus
gggcaacaccctcagcaatggtgtg

SEQ ID NO: 632639 - DNA, 25 bp, Mus musculus
gggcaacaccctgagcaatggtgtg

SEQ ID NO: 632640 - DNA, 25 bp, Mus musculus
gggcaacacctcaatcaaagcttat

SEQ ID NO: 632641 - DNA, 25 bp, Mus musculus
gggcaacacctctatcaaagcttat

SEQ ID NO: 632642 - DNA, 25 bp, Mus musculus
gggcaacactctaagctttggtgtc

SEQ ID NO: 632643 - DNA, 25 bp, Mus musculus
gggcaacactcttagctttggtgtc

SEQ ID NO: 632644 - DNA, 25 bp, Mus musculus
gggcaacactgaaccactttagtaa

SEQ ID NO: 632645 - DNA, 25 bp, Mus musculus
gggcaacactgatccactttagtaa

SEQ ID NO: 632646 - DNA, 25 bp, Mus musculus
gggcaacactggcttcaggaaacaa

SEQ ID NO: 632647 - DNA, 25 bp, Mus musculus
gggcaacactgggttcaggaaacaa

SEQ ID NO: 632648 - DNA, 25 bp, Mus musculus
gggcaacagggaacctagaccttgt

SEQ ID NO: 632649 - DNA, 25 bp, Mus musculus
gggcaacagggatcctagaccttgt

SEQ ID NO: 632650 - DNA, 25 bp, Mus musculus
gggcaacagggccttttctgagact

SEQ ID NO: 632651 - DNA, 25 bp, Mus musculus
gggcaacagggcgttttctgagact

SEQ ID NO: 632652 - DNA, 25 bp, Mus musculus
gggcaacagtggaaacctgctgata

SEQ ID NO: 632653 - DNA, 25 bp, Mus musculus
gggcaacagtggtaacctgctgata

SEQ ID NO: 632654 - DNA, 25 bp, Mus musculus
gggcaacagttacttccagactttt

SEQ ID NO: 632655 - DNA, 25 bp, Mus musculus
gggcaacagttagttccagactttt

SEQ ID NO: 632656 - DNA, 25 bp, Mus musculus
gggcaacataacaaggtcctgtctc

SEQ ID NO: 632657 - DNA, 25 bp, Mus musculus
gggcaacataactaggtcctgtctc

SEQ ID NO: 632658 - DNA, 25 bp, Mus musculus
gggcaacatcttcggaatcctgaat

SEQ ID NO: 632659 - DNA, 25 bp, Mus musculus
gggcaacatcttgggaatcctgaat

SEQ ID NO: 632660 - DNA, 25 bp, Mus musculus
gggcaacatggcaagaaagcagctg

SEQ ID NO: 632661 - DNA, 25 bp, Mus musculus
gggcaacatggctagaaagcagctg

SEQ ID NO: 632662 - DNA, 25 bp, Mus musculus
gggcaacatgttcgtgattttcctt

SEQ ID NO: 632663 - DNA, 25 bp, Mus musculus
gggcaacatgttggtgattttcctt

SEQ ID NO: 632664 - DNA, 25 bp, Mus musculus
gggcaacattctagtgcatggcttg

SEQ ID NO: 632665 - DNA, 25 bp, Mus musculus
gggcaacattcttgtgcatggcttg

SEQ ID NO: 632666 - DNA, 25 bp, Mus musculus
gggcaacattgtcactggaactgat

SEQ ID NO: 632667 - DNA, 25 bp, Mus musculus
gggcaacattgtgactggaactgat

SEQ ID NO: 632668 - DNA, 25 bp, Mus musculus
gggcaacattttacatctgcatgtg

SEQ ID NO: 632669 - DNA, 25 bp, Mus musculus
gggcaacatttttcatctgcatgtg

SEQ ID NO: 632670 - DNA, 25 bp, Mus musculus
gggcaaccaatcatctttacagaag

SEQ ID NO: 632671 - DNA, 25 bp, Mus musculus
gggcaaccaatcttctttacagaag

SEQ ID NO: 632672 - DNA, 25 bp, Mus musculus
gggcaaccacagaaaatggctgctg

SEQ ID NO: 632673 - DNA, 25 bp, Mus musculus
gggcaaccacagtaaatggctgctg

SEQ ID NO: 632674 - DNA, 25 bp, Mus musculus
gggcaaccagcaatctcagagcact

SEQ ID NO: 632675 - DNA, 25 bp, Mus musculus
gggcaaccagcattctcagagcact

SEQ ID NO: 632676 - DNA, 25 bp, Mus musculus
gggcaaccaggtcttaaagaatcag

SEQ ID NO: 632677 - DNA, 25 bp, Mus musculus
gggcaaccaggtgttaaagaatcag

SEQ ID NO: 632678 - DNA, 25 bp, Mus musculus
gggcaaccccaccacagagaagaca

SEQ ID NO: 632679 - DNA, 25 bp, Mus musculus
gggcaaccccacgacagagaagaca

SEQ ID NO: 632680 - DNA, 25 bp, Mus musculus
gggcaaccgcaacaagatgacctac

SEQ ID NO: 632681 - DNA, 25 bp, Mus musculus
gggcaaccgcaagaagatgacctac

SEQ ID NO: 632682 - DNA, 25 bp, Mus musculus
gggcaacctactaaacttttctcat

SEQ ID NO: 632683 - DNA, 25 bp, Mus musculus
gggcaacctacttaacttttctcat

SEQ ID NO: 632684 - DNA, 25 bp, Mus musculus
gggcaacctccactatacggtaagt

SEQ ID NO: 632685 - DNA, 25 bp, Mus musculus
gggcaacctccagtatacggtaagt

SEQ ID NO: 632686 - DNA, 25 bp, Mus musculus
gggcaacctggtcggactctgtttt

SEQ ID NO: 632687 - DNA, 25 bp, Mus musculus
gggcaacctggtgggactctgtttt

SEQ ID NO: 632688 - DNA, 25 bp, Mus musculus
gggcaaccttggctgttcttcctca

SEQ ID NO: 632689 - DNA, 25 bp, Mus musculus
gggcaaccttgggtgttcttcctca

SEQ ID NO: 632690 - DNA, 25 bp, Mus musculus
gggcaacgattcactcgatcattgc

SEQ ID NO: 632691 - DNA, 25 bp, Mus musculus
gggcaacgattctctcgatcattgc

SEQ ID NO: 632692 - DNA, 25 bp, Mus musculus
gggcaacgccagagctgtcttcctc

SEQ ID NO: 632693 - DNA, 25 bp, Mus musculus
gggcaacgccagtgctgtcttcctc

SEQ ID NO: 632694 - DNA, 25 bp, Mus musculus
gggcaacggcttcaagttccaattt

SEQ ID NO: 632695 - DNA, 25 bp, Mus musculus
gggcaacggcttgaagttccaattt

SEQ ID NO: 632696 - DNA, 25 bp, Mus musculus
gggcaactaaaaacgctcaaagcct

SEQ ID NO: 632697 - DNA, 25 bp, Mus musculus
gggcaactaaaatcgctcaaagcct

SEQ ID NO: 632698 - DNA, 25 bp, Mus musculus
gggcaactacagctgttccctgatg

SEQ ID NO: 632699 - DNA, 25 bp, Mus musculus
gggcaactacaggtgttccctgatg

SEQ ID NO: 632700 - DNA, 25 bp, Mus musculus
gggcaactactgatattttcacatt

SEQ ID NO: 632701 - DNA, 25 bp, Mus musculus
gggcaactactgttattttcacatt

SEQ ID NO: 632702 - DNA, 25 bp, Mus musculus
gggcaactagccaaatgtcaatttc

SEQ ID NO: 632703 - DNA, 25 bp, Mus musculus
gggcaactagcctaatgtcaatttc

SEQ ID NO: 632704 - DNA, 25 bp, Mus musculus
gggcaactagctactacttagtaga

SEQ ID NO: 632705 - DNA, 25 bp, Mus musculus
gggcaactagcttctacttagtaga

SEQ ID NO: 632706 - DNA, 25 bp, Mus musculus
gggcaactatcaaaatcctacctgt

SEQ ID NO: 632707 - DNA, 25 bp, Mus musculus
gggcaactatcataatcctacctgt

SEQ ID NO: 632708 - DNA, 25 bp, Mus musculus
gggcaactcaacaaaactgtctcca

SEQ ID NO: 632709 - DNA, 25 bp, Mus musculus
gggcaactcaactaaactgtctcca

SEQ ID NO: 632710 - DNA, 25 bp, Mus musculus
gggcaactgcacagtttctgcagct

SEQ ID NO: 632711 - DNA, 25 bp, Mus musculus
gggcaactgcactgtttctgcagct

SEQ ID NO: 632712 - DNA, 25 bp, Mus musculus
gggcaactgtcaacatgtgctcatg

SEQ ID NO: 632713 - DNA, 25 bp, Mus musculus
gggcaactgtcatcatgtgctcatg

SEQ ID NO: 632714 - DNA, 25 bp, Mus musculus
gggcaacttagtaacagctgaccaa

SEQ ID NO: 632715 - DNA, 25 bp, Mus musculus
gggcaacttagttacagctgaccaa

SEQ ID NO: 632716 - DNA, 25 bp, Mus musculus
gggcaacttcaacattttgtcttct

SEQ ID NO: 632717 - DNA, 25 bp, Mus musculus
gggcaacttcaagattttgtcttct

SEQ ID NO: 632718 - DNA, 25 bp, Mus musculus
gggcaacttcatcctgcaaaggtag

SEQ ID NO: 632719 - DNA, 25 bp, Mus musculus
gggcaacttcatgctgcaaaggtag

SEQ ID NO: 632720 - DNA, 25 bp, Mus musculus
gggcaacttgcactggaggattaat

SEQ ID NO: 632721 - DNA, 25 bp, Mus musculus
gggcaacttgcagtggaggattaat

SEQ ID NO: 632722 - DNA, 25 bp, Mus musculus
gggcaacttggtatataccttcatc

SEQ ID NO: 632723 - DNA, 25 bp, Mus musculus
gggcaacttggtttataccttcatc

SEQ ID NO: 632724 - DNA, 25 bp, Mus musculus
gggcaagaatacactcatgcctcag

SEQ ID NO: 632725 - DNA, 25 bp, Mus musculus
gggcaagaatactctcatgcctcag

SEQ ID NO: 632726 - DNA, 25 bp, Mus musculus
gggcaagacagcaccttttattttc

SEQ ID NO: 632727 - DNA, 25 bp, Mus musculus
gggcaagacagctccttttattttc

SEQ ID NO: 632728 - DNA, 25 bp, Mus musculus
gggcaagacaggcttataatctctt

SEQ ID NO: 632729 - DNA, 25 bp, Mus musculus
gggcaagacagggttataatctctt

SEQ ID NO: 632730 - DNA, 25 bp, Mus musculus
gggcaagaccagcttctacatgggc

SEQ ID NO: 632731 - DNA, 25 bp, Mus musculus
gggcaagaccaggttctacatgggc

SEQ ID NO: 632732 - DNA, 25 bp, Mus musculus
gggcaagaccctattaagatcagct

SEQ ID NO: 632733 - DNA, 25 bp, Mus musculus
gggcaagaccctccagtcatggcgt

SEQ ID NO: 632734 - DNA, 25 bp, Mus musculus
gggcaagaccctgcagtcatggcgt

SEQ ID NO: 632735 - DNA, 25 bp, Mus musculus
gggcaagacccttttaagatcagct

SEQ ID NO: 632736 - DNA, 25 bp, Mus musculus
gggcaagactagactgaactcagtg

SEQ ID NO: 632737 - DNA, 25 bp, Mus musculus
gggcaagactagtctgaactcagtg

SEQ ID NO: 632738 - DNA, 25 bp, Mus musculus
gggcaagactcgcagcatcagcctc

SEQ ID NO: 632739 - DNA, 25 bp, Mus musculus
gggcaagactcggagcatcagcctc

SEQ ID NO: 632740 - DNA, 25 bp, Mus musculus
gggcaagagattacattggcacaaa

SEQ ID NO: 632741 - DNA, 25 bp, Mus musculus
gggcaagagatttcattggcacaaa

SEQ ID NO: 632742 - DNA, 25 bp, Mus musculus
gggcaagagcatagccccacgatag

SEQ ID NO: 632743 - DNA, 25 bp, Mus musculus
gggcaagagcattgccccacgatag

SEQ ID NO: 632744 - DNA, 25 bp, Mus musculus
gggcaagagtggcatttcttccgtt

SEQ ID NO: 632745 - DNA, 25 bp, Mus musculus
gggcaagagtgggatttcttccgtt

SEQ ID NO: 632746 - DNA, 25 bp, Mus musculus
gggcaagataccactgacctcaagg

SEQ ID NO: 632747 - DNA, 25 bp, Mus musculus
gggcaagatacctctgacctcaagg

SEQ ID NO: 632748 - DNA, 25 bp, Mus musculus
gggcaagatcagcaataaagtggaa

SEQ ID NO: 632749 - DNA, 25 bp, Mus musculus
gggcaagatcaggaataaagtggaa

SEQ ID NO: 632750 - DNA, 25 bp, Mus musculus
gggcaagatccaacctggtagacta

SEQ ID NO: 632751 - DNA, 25 bp, Mus musculus
gggcaagatccatcctggtagacta

SEQ ID NO: 632752 - DNA, 25 bp, Mus musculus
gggcaagattaaacccagcacaatc

SEQ ID NO: 632753 - DNA, 25 bp, Mus musculus
gggcaagattaatcccagcacaatc

SEQ ID NO: 632754 - DNA, 25 bp, Mus musculus
gggcaagcaatcaacgaacatatat

SEQ ID NO: 632755 - DNA, 25 bp, Mus musculus
gggcaagcaatctacgaacatatat

SEQ ID NO: 632756 - DNA, 25 bp, Mus musculus
gggcaagcacacacttatttgacca

SEQ ID NO: 632757 - DNA, 25 bp, Mus musculus
gggcaagcacactcttatttgacca

SEQ ID NO: 632758 - DNA, 25 bp, Mus musculus
gggcaagcacgaccaggaatgtctt

SEQ ID NO: 632759 - DNA, 25 bp, Mus musculus
gggcaagcacgagcaggaatgtctt

SEQ ID NO: 632760 - DNA, 25 bp, Mus musculus
gggcaagcactacaaccgacacaaa

SEQ ID NO: 632761 - DNA, 25 bp, Mus musculus
gggcaagcactagaaccgacacaaa

SEQ ID NO: 632762 - DNA, 25 bp, Mus musculus
gggcaagcacttcatcggtgacttt

SEQ ID NO: 632763 - DNA, 25 bp, Mus musculus
gggcaagcacttgatcggtgacttt

SEQ ID NO: 632764 - DNA, 25 bp, Mus musculus
gggcaagcatccattacttatcctt

SEQ ID NO: 632765 - DNA, 25 bp, Mus musculus
gggcaagcatcctttacttatcctt

SEQ ID NO: 632766 - DNA, 25 bp, Mus musculus
gggcaagccaagatgcaacctgcaa

SEQ ID NO: 632767 - DNA, 25 bp, Mus musculus
gggcaagccaagttgcaacctgcaa

SEQ ID NO: 632768 - DNA, 25 bp, Mus musculus
gggcaagccacgatgtgttctgaac

SEQ ID NO: 632769 - DNA, 25 bp, Mus musculus
gggcaagccacgttgtgttctgaac

SEQ ID NO: 632770 - DNA, 25 bp, Mus musculus
gggcaagccagtatctatgctgtaa

SEQ ID NO: 632771 - DNA, 25 bp, Mus musculus
gggcaagccagtttctatgctgtaa

SEQ ID NO: 632772 - DNA, 25 bp, Mus musculus
gggcaagccatcaccagacatcttg

SEQ ID NO: 632773 - DNA, 25 bp, Mus musculus
gggcaagccatctccagacatcttg

SEQ ID NO: 632774 - DNA, 25 bp, Mus musculus
gggcaagccctgattggttgtttaa

SEQ ID NO: 632775 - DNA, 25 bp, Mus musculus
gggcaagccctgcagtcaccaatgg

SEQ ID NO: 632776 - DNA, 25 bp, Mus musculus
gggcaagccctggagtcaccaatgg

SEQ ID NO: 632777 - DNA, 25 bp, Mus musculus
gggcaagccctgtttggttgtttaa

SEQ ID NO: 632778 - DNA, 25 bp, Mus musculus
gggcaagccgcccagtaatcacgga

SEQ ID NO: 632779 - DNA, 25 bp, Mus musculus
gggcaagccgccgagtaatcacgga

SEQ ID NO: 632780 - DNA, 25 bp, Mus musculus
gggcaagcctatagagcattttctt

SEQ ID NO: 632781 - DNA, 25 bp, Mus musculus
gggcaagcctatctaatgtgtgatt

SEQ ID NO: 632782 - DNA, 25 bp, Mus musculus
gggcaagcctatgtaatgtgtgatt

SEQ ID NO: 632783 - DNA, 25 bp, Mus musculus
gggcaagcctattgagcattttctt

SEQ ID NO: 632784 - DNA, 25 bp, Mus musculus
gggcaagcgttcctgccatagctgc

SEQ ID NO: 632785 - DNA, 25 bp, Mus musculus
gggcaagcgttcgtgccatagctgc

SEQ ID NO: 632786 - DNA, 25 bp, Mus musculus
gggcaagctccaaccagatgtaaac

SEQ ID NO: 632787 - DNA, 25 bp, Mus musculus
gggcaagctccatccagatgtaaac

SEQ ID NO: 632788 - DNA, 25 bp, Mus musculus
gggcaagctctaatctcaactgagt

SEQ ID NO: 632789 - DNA, 25 bp, Mus musculus
gggcaagctctattctcaactgagt

SEQ ID NO: 632790 - DNA, 25 bp, Mus musculus
gggcaagcttgtcttatacacacac

SEQ ID NO: 632791 - DNA, 25 bp, Mus musculus
gggcaagcttgtgttatacacacac

SEQ ID NO: 632792 - DNA, 25 bp, Mus musculus
gggcaagctttgacgtctcacaagt

SEQ ID NO: 632793 - DNA, 25 bp, Mus musculus
gggcaagctttgctgagccacctac

SEQ ID NO: 632794 - DNA, 25 bp, Mus musculus
gggcaagctttggtgagccacctac

SEQ ID NO: 632795 - DNA, 25 bp, Mus musculus
gggcaagctttgtcgtctcacaagt

SEQ ID NO: 632796 - DNA, 25 bp, Mus musculus
gggcaaggaggcacctctccttttt

SEQ ID NO: 632797 - DNA, 25 bp, Mus musculus
gggcaaggaggctcctctccttttt

SEQ ID NO: 632798 - DNA, 25 bp, Mus musculus
gggcaaggcataagaggaaagttct

SEQ ID NO: 632799 - DNA, 25 bp, Mus musculus
gggcaaggcatatgaggaaagttct

SEQ ID NO: 632800 - DNA, 25 bp, Mus musculus
gggcaaggccaaacgaagccactct

SEQ ID NO: 632801 - DNA, 25 bp, Mus musculus
gggcaaggccaatcgaagccactct

SEQ ID NO: 632802 - DNA, 25 bp, Mus musculus
gggcaaggcccaatgttagcaagag

SEQ ID NO: 632803 - DNA, 25 bp, Mus musculus
gggcaaggcccacagtgtgagggtt

SEQ ID NO: 632804 - DNA, 25 bp, Mus musculus
gggcaaggcccagagtgtgagggtt

SEQ ID NO: 632805 - DNA, 25 bp, Mus musculus
gggcaaggcccattgttagcaagag

SEQ ID NO: 632806 - DNA, 25 bp, Mus musculus
gggcaaggctacacctaaatcacag

SEQ ID NO: 632807 - DNA, 25 bp, Mus musculus
gggcaaggctactcctaaatcacag

SEQ ID NO: 632808 - DNA, 25 bp, Mus musculus
gggcaaggctctccttttcactggg

SEQ ID NO: 632809 - DNA, 25 bp, Mus musculus
gggcaaggctctgcttttcactggg

SEQ ID NO: 632810 - DNA, 25 bp, Mus musculus
gggcaaggctgtatagagactcttc

SEQ ID NO: 632811 - DNA, 25 bp, Mus musculus
gggcaaggctgtttagagactcttc

SEQ ID NO: 632812 - DNA, 25 bp, Mus musculus
gggcaaggcttgacttcctcttcac

SEQ ID NO: 632813 - DNA, 25 bp, Mus musculus
gggcaaggcttgtcttcctcttcac

SEQ ID NO: 632814 - DNA, 25 bp, Mus musculus
gggcaagggcacagtggtcatcatt

SEQ ID NO: 632815 - DNA, 25 bp, Mus musculus
gggcaagggcactgtggtcatcatt

SEQ ID NO: 632816 - DNA, 25 bp, Mus musculus
gggcaagggtgtcccaagacagggt

SEQ ID NO: 632817 - DNA, 25 bp, Mus musculus
gggcaagggtgtgccaagacagggt

SEQ ID NO: 632818 - DNA, 25 bp, Mus musculus
gggcaaggtatgacctctggtcaat

SEQ ID NO: 632819 - DNA, 25 bp, Mus musculus
gggcaaggtatgtcctctggtcaat

SEQ ID NO: 632820 - DNA, 25 bp, Mus musculus
gggcaaggtcttcccgctttactag

SEQ ID NO: 632821 - DNA, 25 bp, Mus musculus
gggcaaggtcttgccgctttactag

SEQ ID NO: 632822 - DNA, 25 bp, Mus musculus
gggcaaggtgccaattacctactta

SEQ ID NO: 632823 - DNA, 25 bp, Mus musculus
gggcaaggtgcctattacctactta

SEQ ID NO: 632824 - DNA, 25 bp, Mus musculus
gggcaagtactgagactgctgctac

SEQ ID NO: 632825 - DNA, 25 bp, Mus musculus
gggcaagtactgtgactgctgctac

SEQ ID NO: 632826 - DNA, 25 bp, Mus musculus
gggcaagtcacaaggtcagtctctc

SEQ ID NO: 632827 - DNA, 25 bp, Mus musculus
gggcaagtcacatggtcagtctctc

SEQ ID NO: 632828 - DNA, 25 bp, Mus musculus
gggcaagtctctaatattctttgtg

SEQ ID NO: 632829 - DNA, 25 bp, Mus musculus
gggcaagtctcttatattctttgtg

SEQ ID NO: 632830 - DNA, 25 bp, Mus musculus
gggcaagtcttcagaatataccttt

SEQ ID NO: 632831 - DNA, 25 bp, Mus musculus
gggcaagtcttctgaatataccttt

SEQ ID NO: 632832 - DNA, 25 bp, Mus musculus
gggcaagtgcaaacggccaaagtaa

SEQ ID NO: 632833 - DNA, 25 bp, Mus musculus
gggcaagtgcaatcggccaaagtaa

SEQ ID NO: 632834 - DNA, 25 bp, Mus musculus
gggcaagtgcatatggcacaatagc

SEQ ID NO: 632835 - DNA, 25 bp, Mus musculus
gggcaagtgcatttggcacaatagc

SEQ ID NO: 632836 - DNA, 25 bp, Mus musculus
gggcaagtgcccagcatcatacatg

SEQ ID NO: 632837 - DNA, 25 bp, Mus musculus
gggcaagtgccctgcatcatacatg

SEQ ID NO: 632838 - DNA, 25 bp, Mus musculus
gggcaagttagcactcaagggctga

SEQ ID NO: 632839 - DNA, 25 bp, Mus musculus
gggcaagttagctctcaagggctga

SEQ ID NO: 632840 - DNA, 25 bp, Mus musculus
gggcaagttcagacctgcacatagc

SEQ ID NO: 632841 - DNA, 25 bp, Mus musculus
gggcaagttcagagtatttatgtga

SEQ ID NO: 632842 - DNA, 25 bp, Mus musculus
gggcaagttcagtcctgcacatagc

SEQ ID NO: 632843 - DNA, 25 bp, Mus musculus
gggcaagttcagtgtatttatgtga

SEQ ID NO: 632844 - DNA, 25 bp, Mus musculus
gggcaagttgaaccattaccactat

SEQ ID NO: 632845 - DNA, 25 bp, Mus musculus
gggcaagttgaagcattaccactat

SEQ ID NO: 632846 - DNA, 25 bp, Mus musculus
gggcaataagtactaccggttcaat

SEQ ID NO: 632847 - DNA, 25 bp, Mus musculus
gggcaataagtagtaccggttcaat

SEQ ID NO: 632848 - DNA, 25 bp, Mus musculus
gggcaataataaagcttttgattcc

SEQ ID NO: 632849 - DNA, 25 bp, Mus musculus
gggcaataataatgcttttgattcc

SEQ ID NO: 632850 - DNA, 25 bp, Mus musculus
gggcaataccgccatctgctgacga

SEQ ID NO: 632851 - DNA, 25 bp, Mus musculus
gggcaataccgcgatctgctgacga

SEQ ID NO: 632852 - DNA, 25 bp, Mus musculus
gggcaatactatctcacccatcata

SEQ ID NO: 632853 - DNA, 25 bp, Mus musculus
gggcaatactatgtcacccatcata

SEQ ID NO: 632854 - DNA, 25 bp, Mus musculus
gggcaatactcaatgcactttggca

SEQ ID NO: 632855 - DNA, 25 bp, Mus musculus
gggcaatactcattgcactttggca

SEQ ID NO: 632856 - DNA, 25 bp, Mus musculus
gggcaatagaccagcgggcacagct

SEQ ID NO: 632857 - DNA, 25 bp, Mus musculus
gggcaatagacctgcgggcacagct

SEQ ID NO: 632858 - DNA, 25 bp, Mus musculus
gggcaatagagcatagatggaaaaa

SEQ ID NO: 632859 - DNA, 25 bp, Mus musculus
gggcaatagagcttagatggaaaaa

SEQ ID NO: 632860 - DNA, 25 bp, Mus musculus
gggcaatagctcctgagcagacttt

SEQ ID NO: 632861 - DNA, 25 bp, Mus musculus
gggcaatagctcgtgagcagacttt

SEQ ID NO: 632862 - DNA, 25 bp, Mus musculus
gggcaatagctgaaatgcagatctt

SEQ ID NO: 632863 - DNA, 25 bp, Mus musculus
gggcaatagctgtaatgcagatctt

SEQ ID NO: 632864 - DNA, 25 bp, Mus musculus
gggcaataggctaacagagaatgag

SEQ ID NO: 632865 - DNA, 25 bp, Mus musculus
gggcaataggcttacagagaatgag

SEQ ID NO: 632866 - DNA, 25 bp, Mus musculus
gggcaatagggcacttcagctggca

SEQ ID NO: 632867 - DNA, 25 bp, Mus musculus
gggcaatagggctcttcagctggca

SEQ ID NO: 632868 - DNA, 25 bp, Mus musculus
gggcaatattttaaacttgtggcaa

SEQ ID NO: 632869 - DNA, 25 bp, Mus musculus
gggcaatattttaatctatttccaa

SEQ ID NO: 632870 - DNA, 25 bp, Mus musculus
gggcaatatttttaacttgtggcaa

SEQ ID NO: 632871 - DNA, 25 bp, Mus musculus
gggcaatatttttatctatttccaa

SEQ ID NO: 632872 - DNA, 25 bp, Mus musculus
gggcaatcaatacacctctgactct

SEQ ID NO: 632873 - DNA, 25 bp, Mus musculus
gggcaatcaatagacctctgactct

SEQ ID NO: 632874 - DNA, 25 bp, Mus musculus
gggcaatcacttaaatgaaacacac

SEQ ID NO: 632875 - DNA, 25 bp, Mus musculus
gggcaatcactttaatgaaacacac

SEQ ID NO: 632876 - DNA, 25 bp, Mus musculus
gggcaatcagacacacccaatgctt

SEQ ID NO: 632877 - DNA, 25 bp, Mus musculus
gggcaatcagactcacccaatgctt

SEQ ID NO: 632878 - DNA, 25 bp, Mus musculus
gggcaatcagctaagcgtacttggt

SEQ ID NO: 632879 - DNA, 25 bp, Mus musculus
gggcaatcagcttagcgtacttggt

SEQ ID NO: 632880 - DNA, 25 bp, Mus musculus
gggcaatcagtgctagacaccacag

SEQ ID NO: 632881 - DNA, 25 bp, Mus musculus
gggcaatcagtggtagacaccacag

SEQ ID NO: 632882 - DNA, 25 bp, Mus musculus
gggcaatcatgtcactactcagtat

SEQ ID NO: 632883 - DNA, 25 bp, Mus musculus
gggcaatcatgtgactactcagtat

SEQ ID NO: 632884 - DNA, 25 bp, Mus musculus
gggcaatccaaaacagcataatata

SEQ ID NO: 632885 - DNA, 25 bp, Mus musculus
gggcaatccaaatcagcataatata

SEQ ID NO: 632886 - DNA, 25 bp, Mus musculus
gggcaatccaccatagtagaactga

SEQ ID NO: 632887 - DNA, 25 bp, Mus musculus
gggcaatccaccttagtagaactga

SEQ ID NO: 632888 - DNA, 25 bp, Mus musculus
gggcaatccatgattttggcttcca

SEQ ID NO: 632889 - DNA, 25 bp, Mus musculus
gggcaatccatgtttttggcttcca

SEQ ID NO: 632890 - DNA, 25 bp, Mus musculus
gggcaatcccaaagtgccatctatc

SEQ ID NO: 632891 - DNA, 25 bp, Mus musculus
gggcaatcccaatgtgccatctatc

SEQ ID NO: 632892 - DNA, 25 bp, Mus musculus
gggcaatcccatctcataatggctt

SEQ ID NO: 632893 - DNA, 25 bp, Mus musculus
gggcaatcccatgtcataatggctt

SEQ ID NO: 632894 - DNA, 25 bp, Mus musculus
gggcaatcctacatagtcacttact

SEQ ID NO: 632895 - DNA, 25 bp, Mus musculus
gggcaatcctacttagtcacttact

SEQ ID NO: 632896 - DNA, 25 bp, Mus musculus
gggcaatcgtaccaactactatgat

SEQ ID NO: 632897 - DNA, 25 bp, Mus musculus
gggcaatcgtacgaactactatgat

SEQ ID NO: 632898 - DNA, 25 bp, Mus musculus
gggcaatctaagctgctggcttttt

SEQ ID NO: 632899 - DNA, 25 bp, Mus musculus
gggcaatctaaggtgctggcttttt

SEQ ID NO: 632900 - DNA, 25 bp, Mus musculus
gggcaatctagcatgttgatcggta

SEQ ID NO: 632901 - DNA, 25 bp, Mus musculus
gggcaatctagcttgttgatcggta

SEQ ID NO: 632902 - DNA, 25 bp, Mus musculus
gggcaatctcttcatcctaattgag

SEQ ID NO: 632903 - DNA, 25 bp, Mus musculus
gggcaatctcttgatcctaattgag

SEQ ID NO: 632904 - DNA, 25 bp, Mus musculus
gggcaatgagcacgccaacttttgt

SEQ ID NO: 632905 - DNA, 25 bp, Mus musculus
gggcaatgagcaggccaacttttgt

SEQ ID NO: 632906 - DNA, 25 bp, Mus musculus
gggcaatgcagacacataatacaca

SEQ ID NO: 632907 - DNA, 25 bp, Mus musculus
gggcaatgcagagacataatacaca

SEQ ID NO: 632908 - DNA, 25 bp, Mus musculus
gggcaatgccaaccgctacacagct

SEQ ID NO: 632909 - DNA, 25 bp, Mus musculus
gggcaatgccaactctgagattgta

SEQ ID NO: 632910 - DNA, 25 bp, Mus musculus
gggcaatgccaagcgctacacagct

SEQ ID NO: 632911 - DNA, 25 bp, Mus musculus
gggcaatgccaagtctgagattgta

SEQ ID NO: 632912 - DNA, 25 bp, Mus musculus
gggcaatgccatatcaatgcactac

SEQ ID NO: 632913 - DNA, 25 bp, Mus musculus
gggcaatgccatttcaatgcactac

SEQ ID NO: 632914 - DNA, 25 bp, Mus musculus
gggcaatgccgtcatttcagagaga

SEQ ID NO: 632915 - DNA, 25 bp, Mus musculus
gggcaatgccgtgatttcagagaga

SEQ ID NO: 632916 - DNA, 25 bp, Mus musculus
gggcaatggtccagtataacagata

SEQ ID NO: 632917 - DNA, 25 bp, Mus musculus
gggcaatggtcctgtataacagata

SEQ ID NO: 632918 - DNA, 25 bp, Mus musculus
gggcaatggtgcatagtcacacaca

SEQ ID NO: 632919 - DNA, 25 bp, Mus musculus
gggcaatggtgcttagtcacacaca

SEQ ID NO: 632920 - DNA, 25 bp, Mus musculus
gggcaatgtgccaattctaaatatg

SEQ ID NO: 632921 - DNA, 25 bp, Mus musculus
gggcaatgtgcctattctaaatatg

SEQ ID NO: 632922 - DNA, 25 bp, Mus musculus
gggcaatgtttgaaccaaatctgga

SEQ ID NO: 632923 - DNA, 25 bp, Mus musculus
gggcaatgtttgtaccaaatctgga

SEQ ID NO: 632924 - DNA, 25 bp, Mus musculus
gggcaattaagccaccaggcatgtg

SEQ ID NO: 632925 - DNA, 25 bp, Mus musculus
gggcaattaagcgaccaggcatgtg

SEQ ID NO: 632926 - DNA, 25 bp, Mus musculus
gggcaattacatcctgacgtgctct

SEQ ID NO: 632927 - DNA, 25 bp, Mus musculus
gggcaattacatgctgacgtgctct

SEQ ID NO: 632928 - DNA, 25 bp, Mus musculus
gggcaattcaggcaccagctagatt

SEQ ID NO: 632929 - DNA, 25 bp, Mus musculus
gggcaattcagggaccagctagatt

SEQ ID NO: 632930 - DNA, 25 bp, Mus musculus
gggcaattcggaacccagtgctcct

SEQ ID NO: 632931 - DNA, 25 bp, Mus musculus
gggcaattcggatcccagtgctcct

SEQ ID NO: 632932 - DNA, 25 bp, Mus musculus
gggcaattctcacgaccgtgcagca

SEQ ID NO: 632933 - DNA, 25 bp, Mus musculus
gggcaattctcaggaccgtgcagca

SEQ ID NO: 632934 - DNA, 25 bp, Mus musculus
gggcaattcttgcatgacccaaata

SEQ ID NO: 632935 - DNA, 25 bp, Mus musculus
gggcaattcttggatgacccaaata

SEQ ID NO: 632936 - DNA, 25 bp, Mus musculus
gggcaattgccaatggtctctgggc

SEQ ID NO: 632937 - DNA, 25 bp, Mus musculus
gggcaattgccattggtctctgggc

SEQ ID NO: 632938 - DNA, 25 bp, Mus musculus
gggcaattgctaaatcttagacctg

SEQ ID NO: 632939 - DNA, 25 bp, Mus musculus
gggcaattgctatatcttagacctg

SEQ ID NO: 632940 - DNA, 25 bp, Mus musculus
gggcaatttacaaagttataggcaa

SEQ ID NO: 632941 - DNA, 25 bp, Mus musculus
gggcaatttacatagttataggcaa

SEQ ID NO: 632942 - DNA, 25 bp, Mus musculus
gggcaatttactatttgtacttcag

SEQ ID NO: 632943 - DNA, 25 bp, Mus musculus
gggcaatttactttttgtacttcag

SEQ ID NO: 632944 - DNA, 25 bp, Mus musculus
gggcaatttcacaaatcccattttt

SEQ ID NO: 632945 - DNA, 25 bp, Mus musculus
gggcaatttcactaatcccattttt

SEQ ID NO: 632946 - DNA, 25 bp, Mus musculus
gggcaatttcatactgcctcaaata

SEQ ID NO: 632947 - DNA, 25 bp, Mus musculus
gggcaatttcattctgcctcaaata

SEQ ID NO: 632948 - DNA, 25 bp, Mus musculus
gggcaatttgccaaacatcctcaag

SEQ ID NO: 632949 - DNA, 25 bp, Mus musculus
gggcaatttgcctaacatcctcaag

SEQ ID NO: 632950 - DNA, 25 bp, Mus musculus
gggcaattttacaatgtgatacatt

SEQ ID NO: 632951 - DNA, 25 bp, Mus musculus
gggcaattttactatgtgatacatt

SEQ ID NO: 632952 - DNA, 25 bp, Mus musculus
gggcacaaaactcttcatccacgga

SEQ ID NO: 632953 - DNA, 25 bp, Mus musculus
gggcacaaaactgttcatccacgga

SEQ ID NO: 632954 - DNA, 25 bp, Mus musculus
gggcacaacgtgactaccatcagat

SEQ ID NO: 632955 - DNA, 25 bp, Mus musculus
gggcacaacgtgtctaccatcagat

SEQ ID NO: 632956 - DNA, 25 bp, Mus musculus
gggcacaactgcaataacttctgac

SEQ ID NO: 632957 - DNA, 25 bp, Mus musculus
gggcacaactgctataacttctgac

SEQ ID NO: 632958 - DNA, 25 bp, Mus musculus
gggcacaacttcaacagctgggcag

SEQ ID NO: 632959 - DNA, 25 bp, Mus musculus
gggcacaacttctacagctgggcag

SEQ ID NO: 632960 - DNA, 25 bp, Mus musculus
gggcacaagatcacaattttcaaaa

SEQ ID NO: 632961 - DNA, 25 bp, Mus musculus
gggcacaagatctcaattttcaaaa

SEQ ID NO: 632962 - DNA, 25 bp, Mus musculus
gggcacaaggacctgtgtttgtcca

SEQ ID NO: 632963 - DNA, 25 bp, Mus musculus
gggcacaaggacgtgtgtttgtcca

SEQ ID NO: 632964 - DNA, 25 bp, Mus musculus
gggcacaagtatctttctctcctac

SEQ ID NO: 632965 - DNA, 25 bp, Mus musculus
gggcacaagtatgtttctctcctac

SEQ ID NO: 632966 - DNA, 25 bp, Mus musculus
gggcacaagtcaatctctttgaaca

SEQ ID NO: 632967 - DNA, 25 bp, Mus musculus
gggcacaagtcattctctttgaaca

SEQ ID NO: 632968 - DNA, 25 bp, Mus musculus
gggcacaatagtacccatcaagggc

SEQ ID NO: 632969 - DNA, 25 bp, Mus musculus
gggcacaatagttcccatcaagggc

SEQ ID NO: 632970 - DNA, 25 bp, Mus musculus
gggcacaatcagaacttttggcatt

SEQ ID NO: 632971 - DNA, 25 bp, Mus musculus
gggcacaatcagtacttttggcatt

SEQ ID NO: 632972 - DNA, 25 bp, Mus musculus
gggcacaatgttatctctcatcaac

SEQ ID NO: 632973 - DNA, 25 bp, Mus musculus
gggcacaatgttttctctcatcaac

SEQ ID NO: 632974 - DNA, 25 bp, Mus musculus
gggcacaattctcgattactagtca

SEQ ID NO: 632975 - DNA, 25 bp, Mus musculus
gggcacaattctggattactagtca

SEQ ID NO: 632976 - DNA, 25 bp, Mus musculus
gggcacacaaagcaatttacatatt

SEQ ID NO: 632977 - DNA, 25 bp, Mus musculus
gggcacacaaaggaatttacatatt

SEQ ID NO: 632978 - DNA, 25 bp, Mus musculus
gggcacacaactcgatcttacaaaa

SEQ ID NO: 632979 - DNA, 25 bp, Mus musculus
gggcacacaactggatcttacaaaa

SEQ ID NO: 632980 - DNA, 25 bp, Mus musculus
gggcacacaagtaaactctcaccag

SEQ ID NO: 632981 - DNA, 25 bp, Mus musculus
gggcacacaagttaactctcaccag

SEQ ID NO: 632982 - DNA, 25 bp, Mus musculus
gggcacacactaaggtcgtggtcat

SEQ ID NO: 632983 - DNA, 25 bp, Mus musculus
gggcacacactatggtcgtggtcat

SEQ ID NO: 632984 - DNA, 25 bp, Mus musculus
gggcacacacttcaattttgcaatt

SEQ ID NO: 632985 - DNA, 25 bp, Mus musculus
gggcacacacttgaattttgcaatt

SEQ ID NO: 632986 - DNA, 25 bp, Mus musculus
gggcacacagcccaggctcgtaaat

SEQ ID NO: 632987 - DNA, 25 bp, Mus musculus
gggcacacagccgaggctcgtaaat

SEQ ID NO: 632988 - DNA, 25 bp, Mus musculus
gggcacacatgcacacactggtgag

SEQ ID NO: 632989 - DNA, 25 bp, Mus musculus
gggcacacatgctcacactggtgag

SEQ ID NO: 632990 - DNA, 25 bp, Mus musculus
gggcacaccaagcaactcgttttta

SEQ ID NO: 632991 - DNA, 25 bp, Mus musculus
gggcacaccaaggaactcgttttta

SEQ ID NO: 632992 - DNA, 25 bp, Mus musculus
gggcacaccattctgcatagaggaa

SEQ ID NO: 632993 - DNA, 25 bp, Mus musculus
gggcacaccattgtgcatagaggaa

SEQ ID NO: 632994 - DNA, 25 bp, Mus musculus
gggcacaccgttccagcagctgaag

SEQ ID NO: 632995 - DNA, 25 bp, Mus musculus
gggcacaccgttgcagcagctgaag

SEQ ID NO: 632996 - DNA, 25 bp, Mus musculus
gggcacacgaagaccagtaagcatt

SEQ ID NO: 632997 - DNA, 25 bp, Mus musculus
gggcacacgaagtccagtaagcatt

SEQ ID NO: 632998 - DNA, 25 bp, Mus musculus
gggcacacgctgcagtaagcattta

SEQ ID NO: 632999 - DNA, 25 bp, Mus musculus
gggcacacgctggagtaagcattta

SEQ ID NO: 633000 - DNA, 25 bp, Mus musculus
gggcacacgttccacgctatttaat

SEQ ID NO: 633001 - DNA, 25 bp, Mus musculus
gggcacacgttcgacgctatttaat

SEQ ID NO: 633002 - DNA, 25 bp, Mus musculus
gggcacactacgagaaagcacagaa

SEQ ID NO: 633003 - DNA, 25 bp, Mus musculus
gggcacactacgtgaaagcacagaa

SEQ ID NO: 633004 - DNA, 25 bp, Mus musculus
gggcacactgccacagaatatgcaa

SEQ ID NO: 633005 - DNA, 25 bp, Mus musculus
gggcacactgcctcagaatatgcaa

SEQ ID NO: 633006 - DNA, 25 bp, Mus musculus
gggcacacttctcgactgtacatag

SEQ ID NO: 633007 - DNA, 25 bp, Mus musculus
gggcacacttctggactgtacatag

SEQ ID NO: 633008 - DNA, 25 bp, Mus musculus
gggcacacttgtatggcatacactg

SEQ ID NO: 633009 - DNA, 25 bp, Mus musculus
gggcacacttgtttggcatacactg

SEQ ID NO: 633010 - DNA, 25 bp, Mus musculus
gggcacacttttactgcatctccaa

SEQ ID NO: 633011 - DNA, 25 bp, Mus musculus
gggcacactttttctgcatctccaa

SEQ ID NO: 633012 - DNA, 25 bp, Mus musculus
gggcacagactcatgcattagtcca

SEQ ID NO: 633013 - DNA, 25 bp, Mus musculus
gggcacagactcttgcattagtcca

SEQ ID NO: 633014 - DNA, 25 bp, Mus musculus
gggcacagagccatatacctcgtcc

SEQ ID NO: 633015 - DNA, 25 bp, Mus musculus
gggcacagagccttatacctcgtcc

SEQ ID NO: 633016 - DNA, 25 bp, Mus musculus
gggcacagatgcagggtacctctta

SEQ ID NO: 633017 - DNA, 25 bp, Mus musculus
gggcacagatgcatcttgttacatg

SEQ ID NO: 633018 - DNA, 25 bp, Mus musculus
gggcacagatgctgggtacctctta

SEQ ID NO: 633019 - DNA, 25 bp, Mus musculus
gggcacagatgcttcttgttacatg

SEQ ID NO: 633020 - DNA, 25 bp, Mus musculus
gggcacagcaaaaaaccaataggac

SEQ ID NO: 633021 - DNA, 25 bp, Mus musculus
gggcacagcaaataaccaataggac

SEQ ID NO: 633022 - DNA, 25 bp, Mus musculus
gggcacagctcaaggcagcatacaa

SEQ ID NO: 633023 - DNA, 25 bp, Mus musculus
gggcacagctcatggcagcatacaa

SEQ ID NO: 633024 - DNA, 25 bp, Mus musculus
gggcacagctgtattctggtacaac

SEQ ID NO: 633025 - DNA, 25 bp, Mus musculus
gggcacagctgttttctggtacaac

SEQ ID NO: 633026 - DNA, 25 bp, Mus musculus
gggcacaggtacactcagaggtctg

SEQ ID NO: 633027 - DNA, 25 bp, Mus musculus
gggcacaggtactctcagaggtctg

SEQ ID NO: 633028 - DNA, 25 bp, Mus musculus
gggcacagtgtacctattttaccaa

SEQ ID NO: 633029 - DNA, 25 bp, Mus musculus
gggcacagtgtagctattttaccaa

SEQ ID NO: 633030 - DNA, 25 bp, Mus musculus
gggcacagtgtcagagaccacacca

SEQ ID NO: 633031 - DNA, 25 bp, Mus musculus
gggcacagtgtctgagaccacacca

SEQ ID NO: 633032 - DNA, 25 bp, Mus musculus
gggcacagttcaacactggaaacaa

SEQ ID NO: 633033 - DNA, 25 bp, Mus musculus
gggcacagttcatcactggaaacaa

SEQ ID NO: 633034 - DNA, 25 bp, Mus musculus
gggcacagttgtcttccaagacgct

SEQ ID NO: 633035 - DNA, 25 bp, Mus musculus
gggcacagttgtgttccaagacgct

SEQ ID NO: 633036 - DNA, 25 bp, Mus musculus
gggcacatacagctgtgtcgttcaa

SEQ ID NO: 633037 - DNA, 25 bp, Mus musculus
gggcacatacaggtgtgtcgttcaa

SEQ ID NO: 633038 - DNA, 25 bp, Mus musculus
gggcacatactcaccttcggcttta

SEQ ID NO: 633039 - DNA, 25 bp, Mus musculus
gggcacatactctccttcggcttta

SEQ ID NO: 633040 - DNA, 25 bp, Mus musculus
gggcacatcctcattggcatgcaaa

SEQ ID NO: 633041 - DNA, 25 bp, Mus musculus
gggcacatcctctttggcatgcaaa

SEQ ID NO: 633042 - DNA, 25 bp, Mus musculus
gggcacatctccaccaaatatggac

SEQ ID NO: 633043 - DNA, 25 bp, Mus musculus
gggcacatctcctccaaatatggac

SEQ ID NO: 633044 - DNA, 25 bp, Mus musculus
gggcacatctgcaggataacacgga

SEQ ID NO: 633045 - DNA, 25 bp, Mus musculus
gggcacatctgctggataacacgga

SEQ ID NO: 633046 - DNA, 25 bp, Mus musculus
gggcacatctgtcgataaggcaact

SEQ ID NO: 633047 - DNA, 25 bp, Mus musculus
gggcacatctgtggataaggcaact

SEQ ID NO: 633048 - DNA, 25 bp, Mus musculus
gggcacatcttaatggatgtctcag

SEQ ID NO: 633049 - DNA, 25 bp, Mus musculus
gggcacatcttattggatgtctcag

SEQ ID NO: 633050 - DNA, 25 bp, Mus musculus
gggcacatctttacacttagattta

SEQ ID NO: 633051 - DNA, 25 bp, Mus musculus
gggcacatcttttcacttagattta

SEQ ID NO: 633052 - DNA, 25 bp, Mus musculus
gggcacatgatcctcaccttagtgg

SEQ ID NO: 633053 - DNA, 25 bp, Mus musculus
gggcacatgatcgtcaccttagtgg

SEQ ID NO: 633054 - DNA, 25 bp, Mus musculus
gggcacatgcctcagagtaacattt

SEQ ID NO: 633055 - DNA, 25 bp, Mus musculus
gggcacatgcctgagagtaacattt

SEQ ID NO: 633056 - DNA, 25 bp, Mus musculus
gggcacatgctcatgactgtgtcac

SEQ ID NO: 633057 - DNA, 25 bp, Mus musculus
gggcacatgctcttgactgtgtcac

SEQ ID NO: 633058 - DNA, 25 bp, Mus musculus
gggcacatggataagcatcgcctct

SEQ ID NO: 633059 - DNA, 25 bp, Mus musculus
gggcacatggattagcatcgcctct

SEQ ID NO: 633060 - DNA, 25 bp, Mus musculus
gggcacatggccaccgtgtggaaaa

SEQ ID NO: 633061 - DNA, 25 bp, Mus musculus
gggcacatggcctccgtgtggaaaa

SEQ ID NO: 633062 - DNA, 25 bp, Mus musculus
gggcacattcccaatggcctgataa

SEQ ID NO: 633063 - DNA, 25 bp, Mus musculus
gggcacattccctatggcctgataa

SEQ ID NO: 633064 - DNA, 25 bp, Mus musculus
gggcacattgtacagaaggttcctc

SEQ ID NO: 633065 - DNA, 25 bp, Mus musculus
gggcacattgtagagaaggttcctc

SEQ ID NO: 633066 - DNA, 25 bp, Mus musculus
gggcacattgttagtggcttgaaat

SEQ ID NO: 633067 - DNA, 25 bp, Mus musculus
gggcacattgtttgtggcttgaaat

SEQ ID NO: 633068 - DNA, 25 bp, Mus musculus
gggcacatttcccatcagttggaat

SEQ ID NO: 633069 - DNA, 25 bp, Mus musculus
gggcacatttccgatcagttggaat

SEQ ID NO: 633070 - DNA, 25 bp, Mus musculus
gggcacatttggaaatcctgtctgt

SEQ ID NO: 633071 - DNA, 25 bp, Mus musculus
gggcacatttggtaatcctgtctgt

SEQ ID NO: 633072 - DNA, 25 bp, Mus musculus
gggcacatttgtagggatgcacata

SEQ ID NO: 633073 - DNA, 25 bp, Mus musculus
gggcacatttgttgggatgcacata

SEQ ID NO: 633074 - DNA, 25 bp, Mus musculus
gggcaccaacaacttcagtcatgta

SEQ ID NO: 633075 - DNA, 25 bp, Mus musculus
gggcaccaacaagttcagtcatgta

SEQ ID NO: 633076 - DNA, 25 bp, Mus musculus
gggcaccaaggacaaggttgctcaa

SEQ ID NO: 633077 - DNA, 25 bp, Mus musculus
gggcaccaaggagaaggttgctcaa

SEQ ID NO: 633078 - DNA, 25 bp, Mus musculus
gggcaccacatgatatgttcttctt

SEQ ID NO: 633079 - DNA, 25 bp, Mus musculus
gggcaccacatgttatgttcttctt

SEQ ID NO: 633080 - DNA, 25 bp, Mus musculus
gggcaccaccatagtaattgagttc

SEQ ID NO: 633081 - DNA, 25 bp, Mus musculus
gggcaccaccattgtaattgagttc

SEQ ID NO: 633082 - DNA, 25 bp, Mus musculus
gggcaccacttactgtccagtgaaa

SEQ ID NO: 633083 - DNA, 25 bp, Mus musculus
gggcaccacttagtgtccagtgaaa

SEQ ID NO: 633084 - DNA, 25 bp, Mus musculus
gggcaccagaaaactccatgaggaa

SEQ ID NO: 633085 - DNA, 25 bp, Mus musculus
gggcaccagaaatctccatgaggaa

SEQ ID NO: 633086 - DNA, 25 bp, Mus musculus
gggcaccagaatactaccacagaac

SEQ ID NO: 633087 - DNA, 25 bp, Mus musculus
gggcaccagaattctaccacagaac

SEQ ID NO: 633088 - DNA, 25 bp, Mus musculus
gggcaccaggccaatgtagaatatt

SEQ ID NO: 633089 - DNA, 25 bp, Mus musculus
gggcaccaggcctatgtagaatatt

SEQ ID NO: 633090 - DNA, 25 bp, Mus musculus
gggcaccaggtaccagaattgagaa

SEQ ID NO: 633091 - DNA, 25 bp, Mus musculus
gggcaccaggtagcagaattgagaa

SEQ ID NO: 633092 - DNA, 25 bp, Mus musculus
gggcaccaggtccaggattccaaat

SEQ ID NO: 633093 - DNA, 25 bp, Mus musculus
gggcaccaggtcgaggattccaaat

SEQ ID NO: 633094 - DNA, 25 bp, Mus musculus
gggcaccagtctaggcttttaggaa

SEQ ID NO: 633095 - DNA, 25 bp, Mus musculus
gggcaccagtcttggcttttaggaa

SEQ ID NO: 633096 - DNA, 25 bp, Mus musculus
gggcaccagttaaacttctgagatt

SEQ ID NO: 633097 - DNA, 25 bp, Mus musculus
gggcaccagttatacttctgagatt

SEQ ID NO: 633098 - DNA, 25 bp, Mus musculus
gggcaccagttccattaccaggatc

SEQ ID NO: 633099 - DNA, 25 bp, Mus musculus
gggcaccagttcgattaccaggatc

SEQ ID NO: 633100 - DNA, 25 bp, Mus musculus
gggcaccagttgctagcaccaagga

SEQ ID NO: 633101 - DNA, 25 bp, Mus musculus
gggcaccagttggtagcaccaagga

SEQ ID NO: 633102 - DNA, 25 bp, Mus musculus
gggcaccataagagttaaataagtt

SEQ ID NO: 633103 - DNA, 25 bp, Mus musculus
gggcaccataagtgttaaataagtt

SEQ ID NO: 633104 - DNA, 25 bp, Mus musculus
gggcaccatgaacatctttgtctac

SEQ ID NO: 633105 - DNA, 25 bp, Mus musculus
gggcaccatgaagatctttgtctac

SEQ ID NO: 633106 - DNA, 25 bp, Mus musculus
gggcaccatggtcatcaacacggag

SEQ ID NO: 633107 - DNA, 25 bp, Mus musculus
gggcaccatggtgatcaacacggag

SEQ ID NO: 633108 - DNA, 25 bp, Mus musculus
gggcaccatgtgagtctagtgcaca

SEQ ID NO: 633109 - DNA, 25 bp, Mus musculus
gggcaccatgtgtgtctagtgcaca

SEQ ID NO: 633110 - DNA, 25 bp, Mus musculus
gggcaccatgttagcagccattgct

SEQ ID NO: 633111 - DNA, 25 bp, Mus musculus
gggcaccatgtttgcagccattgct

SEQ ID NO: 633112 - DNA, 25 bp, Mus musculus
gggcaccattccaaagttattccga

SEQ ID NO: 633113 - DNA, 25 bp, Mus musculus
gggcaccattcctaagttattccga

SEQ ID NO: 633114 - DNA, 25 bp, Mus musculus
gggcaccattctatggaacaggttt

SEQ ID NO: 633115 - DNA, 25 bp, Mus musculus
gggcaccattctttggaacaggttt

SEQ ID NO: 633116 - DNA, 25 bp, Mus musculus
gggcacccacaaatgagcacataca

SEQ ID NO: 633117 - DNA, 25 bp, Mus musculus
gggcacccacaattgagcacataca

SEQ ID NO: 633118 - DNA, 25 bp, Mus musculus
gggcacccacggactgtgtgcatgt

SEQ ID NO: 633119 - DNA, 25 bp, Mus musculus
gggcacccacggtctgtgtgcatgt

SEQ ID NO: 633120 - DNA, 25 bp, Mus musculus
gggcacccagaaactgccactggaa

SEQ ID NO: 633121 - DNA, 25 bp, Mus musculus
gggcacccagaatctgccactggaa

SEQ ID NO: 633122 - DNA, 25 bp, Mus musculus
gggcacccagacatggttcccggca

SEQ ID NO: 633123 - DNA, 25 bp, Mus musculus
gggcacccagacttggttcccggca

SEQ ID NO: 633124 - DNA, 25 bp, Mus musculus
gggcacccaggtatgcacaaggcat

SEQ ID NO: 633125 - DNA, 25 bp, Mus musculus
gggcacccaggtttgcacaaggcat

SEQ ID NO: 633126 - DNA, 25 bp, Mus musculus
gggcacccatggactgtgctaactg

SEQ ID NO: 633127 - DNA, 25 bp, Mus musculus
gggcacccatggtctgtgctaactg

SEQ ID NO: 633128 - DNA, 25 bp, Mus musculus
gggcaccccaaacaatgatatgttc

SEQ ID NO: 633129 - DNA, 25 bp, Mus musculus
gggcaccccaaagaatgatatgttc

SEQ ID NO: 633130 - DNA, 25 bp, Mus musculus
gggcaccccactctgatggatgaat

SEQ ID NO: 633131 - DNA, 25 bp, Mus musculus
gggcaccccactgtgatggatgaat

SEQ ID NO: 633132 - DNA, 25 bp, Mus musculus
gggcaccccagtcgacgacttagac

SEQ ID NO: 633133 - DNA, 25 bp, Mus musculus
gggcaccccagtggacgacttagac

SEQ ID NO: 633134 - DNA, 25 bp, Mus musculus
gggcacccctgaaaagctgccaaga

SEQ ID NO: 633135 - DNA, 25 bp, Mus musculus
gggcacccctgataagctgccaaga

SEQ ID NO: 633136 - DNA, 25 bp, Mus musculus
gggcaccctgtgagtttcacgctgc

SEQ ID NO: 633137 - DNA, 25 bp, Mus musculus
gggcaccctgtgtgtttcacgctgc

SEQ ID NO: 633138 - DNA, 25 bp, Mus musculus
gggcaccctttcaagtttgtagatc

SEQ ID NO: 633139 - DNA, 25 bp, Mus musculus
gggcaccctttctagtttgtagatc

SEQ ID NO: 633140 - DNA, 25 bp, Mus musculus
gggcaccgacttatggagaaactta

SEQ ID NO: 633141 - DNA, 25 bp, Mus musculus
gggcaccgacttttggagaaactta

SEQ ID NO: 633142 - DNA, 25 bp, Mus musculus
gggcaccgagcaatagctactgaag

SEQ ID NO: 633143 - DNA, 25 bp, Mus musculus
gggcaccgagcattagctactgaag

SEQ ID NO: 633144 - DNA, 25 bp, Mus musculus
gggcaccggcaactatgatgtcaac

SEQ ID NO: 633145 - DNA, 25 bp, Mus musculus
gggcaccggcaagtatgatgtcaac

SEQ ID NO: 633146 - DNA, 25 bp, Mus musculus
gggcaccggcgcacagttaagatga

SEQ ID NO: 633147 - DNA, 25 bp, Mus musculus
gggcaccggcgctcagttaagatga

SEQ ID NO: 633148 - DNA, 25 bp, Mus musculus
gggcaccgggcacctctactttggt

SEQ ID NO: 633149 - DNA, 25 bp, Mus musculus
gggcaccgggcagctctactttggt

SEQ ID NO: 633150 - DNA, 25 bp, Mus musculus
gggcaccgtggcagaaatcactggt

SEQ ID NO: 633151 - DNA, 25 bp, Mus musculus
gggcaccgtggctgaaatcactggt

SEQ ID NO: 633152 - DNA, 25 bp, Mus musculus
gggcacctacataacctaaacagag

SEQ ID NO: 633153 - DNA, 25 bp, Mus musculus
gggcacctacattacctaaacagag

SEQ ID NO: 633154 - DNA, 25 bp, Mus musculus
gggcacctagccacatgtgcactta

SEQ ID NO: 633155 - DNA, 25 bp, Mus musculus
gggcacctagcctcatgtgcactta

SEQ ID NO: 633156 - DNA, 25 bp, Mus musculus
gggcacctatcaattccggtgagac

SEQ ID NO: 633157 - DNA, 25 bp, Mus musculus
gggcacctatcatttccggtgagac

SEQ ID NO: 633158 - DNA, 25 bp, Mus musculus
gggcacctcataatctcttgtggag

SEQ ID NO: 633159 - DNA, 25 bp, Mus musculus
gggcacctcatattctcttgtggag

SEQ ID NO: 633160 - DNA, 25 bp, Mus musculus
gggcacctcccaaaaaagatgttca

SEQ ID NO: 633161 - DNA, 25 bp, Mus musculus
gggcacctcccataaaagatgttca

SEQ ID NO: 633162 - DNA, 25 bp, Mus musculus
gggcacctccccaggcagcgaattg

SEQ ID NO: 633163 - DNA, 25 bp, Mus musculus
gggcacctcccctggcagcgaattg

SEQ ID NO: 633164 - DNA, 25 bp, Mus musculus
gggcacctctttcggatgtattaca

SEQ ID NO: 633165 - DNA, 25 bp, Mus musculus
gggcacctctttgggatgtattaca

SEQ ID NO: 633166 - DNA, 25 bp, Mus musculus
gggcacctgacaagcggctcaaggc

SEQ ID NO: 633167 - DNA, 25 bp, Mus musculus
gggcacctgacatgcggctcaaggc

SEQ ID NO: 633168 - DNA, 25 bp, Mus musculus
gggcacctgagaatacatgtttgtg

SEQ ID NO: 633169 - DNA, 25 bp, Mus musculus
gggcacctgagattacatgtttgtg

SEQ ID NO: 633170 - DNA, 25 bp, Mus musculus
gggcacctgataagtatgagtccag

SEQ ID NO: 633171 - DNA, 25 bp, Mus musculus
gggcacctgatatgtatgagtccag

SEQ ID NO: 633172 - DNA, 25 bp, Mus musculus
gggcacctgattataatccttgagt

SEQ ID NO: 633173 - DNA, 25 bp, Mus musculus
gggcacctgattttaatccttgagt

SEQ ID NO: 633174 - DNA, 25 bp, Mus musculus
gggcacctggatcgccatctgatga

SEQ ID NO: 633175 - DNA, 25 bp, Mus musculus
gggcacctggatggccatctgatga

SEQ ID NO: 633176 - DNA, 25 bp, Mus musculus
gggcacctgggtcatactctgacac

SEQ ID NO: 633177 - DNA, 25 bp, Mus musculus
gggcacctgggtgatactctgacac

SEQ ID NO: 633178 - DNA, 25 bp, Mus musculus
gggcacctgtatcaaatgtggtaaa

SEQ ID NO: 633179 - DNA, 25 bp, Mus musculus
gggcacctgtatgaaatgtggtaaa

SEQ ID NO: 633180 - DNA, 25 bp, Mus musculus
gggcacctgtgacccgtcacagctt

SEQ ID NO: 633181 - DNA, 25 bp, Mus musculus
gggcacctgtgagccgtcacagctt

SEQ ID NO: 633182 - DNA, 25 bp, Mus musculus
gggcaccttaggatcgtcttattaa

SEQ ID NO: 633183 - DNA, 25 bp, Mus musculus
gggcaccttaggttcgtcttattaa

SEQ ID NO: 633184 - DNA, 25 bp, Mus musculus
gggcaccttttcagtagagtccaag

SEQ ID NO: 633185 - DNA, 25 bp, Mus musculus
gggcaccttttctgtagagtccaag

SEQ ID NO: 633186 - DNA, 25 bp, Mus musculus
gggcacgaaattcaccatcttcgat

SEQ ID NO: 633187 - DNA, 25 bp, Mus musculus
gggcacgaaattgaccatcttcgat

SEQ ID NO: 633188 - DNA, 25 bp, Mus musculus
gggcacgcacatccgcgccaagaga

SEQ ID NO: 633189 - DNA, 25 bp, Mus musculus
gggcacgcacatgcgcgccaagaga

SEQ ID NO: 633190 - DNA, 25 bp, Mus musculus
gggcacgcccaccagaatatatatc

SEQ ID NO: 633191 - DNA, 25 bp, Mus musculus
gggcacgcccacgagaatatatatc

SEQ ID NO: 633192 - DNA, 25 bp, Mus musculus
gggcacgcctctatccattagagga

SEQ ID NO: 633193 - DNA, 25 bp, Mus musculus
gggcacgcctctttccattagagga

SEQ ID NO: 633194 - DNA, 25 bp, Mus musculus
gggcacgcgttcagggaccaataag

SEQ ID NO: 633195 - DNA, 25 bp, Mus musculus
gggcacgcgttctgggaccaataag

SEQ ID NO: 633196 - DNA, 25 bp, Mus musculus
gggcacgctcttacatgattgcaag

SEQ ID NO: 633197 - DNA, 25 bp, Mus musculus
gggcacgctctttcatgattgcaag

SEQ ID NO: 633198 - DNA, 25 bp, Mus musculus
gggcacggacacagtgagattttct

SEQ ID NO: 633199 - DNA, 25 bp, Mus musculus
gggcacggacactgtgagattttct

SEQ ID NO: 633200 - DNA, 25 bp, Mus musculus
gggcacggacatacaacattcactt

SEQ ID NO: 633201 - DNA, 25 bp, Mus musculus
gggcacggacattcaacattcactt

SEQ ID NO: 633202 - DNA, 25 bp, Mus musculus
gggcacggcagacgcactccagatc

SEQ ID NO: 633203 - DNA, 25 bp, Mus musculus
gggcacggcagaggcactccagatc

SEQ ID NO: 633204 - DNA, 25 bp, Mus musculus
gggcacgtgccaataaggcttccaa

SEQ ID NO: 633205 - DNA, 25 bp, Mus musculus
gggcacgtgccattaaggcttccaa

SEQ ID NO: 633206 - DNA, 25 bp, Mus musculus
gggcacgtggaaagtcattcccttc

SEQ ID NO: 633207 - DNA, 25 bp, Mus musculus
gggcacgtggaatgtcattcccttc

SEQ ID NO: 633208 - DNA, 25 bp, Mus musculus
gggcactaagtaacactgaggagca

SEQ ID NO: 633209 - DNA, 25 bp, Mus musculus
gggcactaagtatcactgaggagca

SEQ ID NO: 633210 - DNA, 25 bp, Mus musculus
gggcactaagttaccatttggttgt

SEQ ID NO: 633211 - DNA, 25 bp, Mus musculus
gggcactaagtttccatttggttgt

SEQ ID NO: 633212 - DNA, 25 bp, Mus musculus
gggcactaatctagttatccaagta

SEQ ID NO: 633213 - DNA, 25 bp, Mus musculus
gggcactaatcttgttatccaagta

SEQ ID NO: 633214 - DNA, 25 bp, Mus musculus
gggcactacaaaatctgtgtacatt

SEQ ID NO: 633215 - DNA, 25 bp, Mus musculus
gggcactacaaattctgtgtacatt

SEQ ID NO: 633216 - DNA, 25 bp, Mus musculus
gggcactacatcactatgggcatgt

SEQ ID NO: 633217 - DNA, 25 bp, Mus musculus
gggcactacatctctatgggcatgt

SEQ ID NO: 633218 - DNA, 25 bp, Mus musculus
gggcactagagcatgggtaccgtat

SEQ ID NO: 633219 - DNA, 25 bp, Mus musculus
gggcactagagcttgggtaccgtat

SEQ ID NO: 633220 - DNA, 25 bp, Mus musculus
gggcactatccgaaaggttcatgtt

SEQ ID NO: 633221 - DNA, 25 bp, Mus musculus
gggcactatccgtaaggttcatgtt

SEQ ID NO: 633222 - DNA, 25 bp, Mus musculus
gggcactatgcaccgagcgtcatca

SEQ ID NO: 633223 - DNA, 25 bp, Mus musculus
gggcactatgcagcgagcgtcatca

SEQ ID NO: 633224 - DNA, 25 bp, Mus musculus
gggcactatgctcatcaatttgagg

SEQ ID NO: 633225 - DNA, 25 bp, Mus musculus
gggcactatgctgatcaatttgagg

SEQ ID NO: 633226 - DNA, 25 bp, Mus musculus
gggcactcaaccattatgcaatcag

SEQ ID NO: 633227 - DNA, 25 bp, Mus musculus
gggcactcaaccctaataatgggag

SEQ ID NO: 633228 - DNA, 25 bp, Mus musculus
gggcactcaaccgtaataatgggag

SEQ ID NO: 633229 - DNA, 25 bp, Mus musculus
gggcactcaacctttatgcaatcag

SEQ ID NO: 633230 - DNA, 25 bp, Mus musculus
gggcactcaagaaatgaatcactgg

SEQ ID NO: 633231 - DNA, 25 bp, Mus musculus
gggcactcaagatatgaatcactgg

SEQ ID NO: 633232 - DNA, 25 bp, Mus musculus
gggcactcaagcaggatgcatccac

SEQ ID NO: 633233 - DNA, 25 bp, Mus musculus
gggcactcaagcatcccgtgggtga

SEQ ID NO: 633234 - DNA, 25 bp, Mus musculus
gggcactcaagctggatgcatccac

SEQ ID NO: 633235 - DNA, 25 bp, Mus musculus
gggcactcaagcttcccgtgggtga

SEQ ID NO: 633236 - DNA, 25 bp, Mus musculus
gggcactcacagattaactgatgtt

SEQ ID NO: 633237 - DNA, 25 bp, Mus musculus
gggcactcacagtttaactgatgtt

SEQ ID NO: 633238 - DNA, 25 bp, Mus musculus
gggcactcagtcatcatttccagga

SEQ ID NO: 633239 - DNA, 25 bp, Mus musculus
gggcactcagtcttcatttccagga

SEQ ID NO: 633240 - DNA, 25 bp, Mus musculus
gggcactcatgtcatgcatgggcca

SEQ ID NO: 633241 - DNA, 25 bp, Mus musculus
gggcactcatgtgatgcatgggcca

SEQ ID NO: 633242 - DNA, 25 bp, Mus musculus
gggcactccagtcccactgggcatg

SEQ ID NO: 633243 - DNA, 25 bp, Mus musculus
gggcactccagtgccactgggcatg

SEQ ID NO: 633244 - DNA, 25 bp, Mus musculus
gggcactccctacgacgctagctat

SEQ ID NO: 633245 - DNA, 25 bp, Mus musculus
gggcactccctaggacgctagctat

SEQ ID NO: 633246 - DNA, 25 bp, Mus musculus
gggcactctcaacggagcagcaaca

SEQ ID NO: 633247 - DNA, 25 bp, Mus musculus
gggcactctcaagggagcagcaaca

SEQ ID NO: 633248 - DNA, 25 bp, Mus musculus
gggcactctcggatggtttccatgg

SEQ ID NO: 633249 - DNA, 25 bp, Mus musculus
gggcactctcggttggtttccatgg

SEQ ID NO: 633250 - DNA, 25 bp, Mus musculus
gggcactctctacccattgagggtc

SEQ ID NO: 633251 - DNA, 25 bp, Mus musculus
gggcactctctagccattgagggtc

SEQ ID NO: 633252 - DNA, 25 bp, Mus musculus
gggcactctcttctgaatacaacat

SEQ ID NO: 633253 - DNA, 25 bp, Mus musculus
gggcactctcttgtgaatacaacat

SEQ ID NO: 633254 - DNA, 25 bp, Mus musculus
gggcactctgcacaaaccaacagct

SEQ ID NO: 633255 - DNA, 25 bp, Mus musculus
gggcactctgcagaaaccaacagct

SEQ ID NO: 633256 - DNA, 25 bp, Mus musculus
gggcactctgttcaattaaggattt

SEQ ID NO: 633257 - DNA, 25 bp, Mus musculus
gggcactctgttgaattaaggattt

SEQ ID NO: 633258 - DNA, 25 bp, Mus musculus
gggcactgaatgaacatgatgcaca

SEQ ID NO: 633259 - DNA, 25 bp, Mus musculus
gggcactgaatgtacatgatgcaca

SEQ ID NO: 633260 - DNA, 25 bp, Mus musculus
gggcactgactcagatgcagtcctc

SEQ ID NO: 633261 - DNA, 25 bp, Mus musculus
gggcactgactctgatgcagtcctc

SEQ ID NO: 633262 - DNA, 25 bp, Mus musculus
gggcactgactgagactctgaactt

SEQ ID NO: 633263 - DNA, 25 bp, Mus musculus
gggcactgactgtgactctgaactt

SEQ ID NO: 633264 - DNA, 25 bp, Mus musculus
gggcactgaggacttatactaaaac

SEQ ID NO: 633265 - DNA, 25 bp, Mus musculus
gggcactgaggagttatactaaaac

SEQ ID NO: 633266 - DNA, 25 bp, Mus musculus
gggcactgagtcagacactgtatta

SEQ ID NO: 633267 - DNA, 25 bp, Mus musculus
gggcactgagtctgacactgtatta

SEQ ID NO: 633268 - DNA, 25 bp, Mus musculus
gggcactgatgactccatgaccctg

SEQ ID NO: 633269 - DNA, 25 bp, Mus musculus
gggcactgatgagtccatgaccctg

SEQ ID NO: 633270 - DNA, 25 bp, Mus musculus
gggcactgcatgcagaatgtgtttt

SEQ ID NO: 633271 - DNA, 25 bp, Mus musculus
gggcactgcatggagaatgtgtttt

SEQ ID NO: 633272 - DNA, 25 bp, Mus musculus
gggcactgctcgctggagacactct

SEQ ID NO: 633273 - DNA, 25 bp, Mus musculus
gggcactgctcggtggagacactct

SEQ ID NO: 633274 - DNA, 25 bp, Mus musculus
gggcactggagcatagagtatctta

SEQ ID NO: 633275 - DNA, 25 bp, Mus musculus
gggcactggagcttagagtatctta

SEQ ID NO: 633276 - DNA, 25 bp, Mus musculus
gggcactggccccagaagatctatc

SEQ ID NO: 633277 - DNA, 25 bp, Mus musculus
gggcactggcccgagaagatctatc

SEQ ID NO: 633278 - DNA, 25 bp, Mus musculus
gggcactgggcgaggttttatccaa

SEQ ID NO: 633279 - DNA, 25 bp, Mus musculus
gggcactgggcgtggttttatccaa

SEQ ID NO: 633280 - DNA, 25 bp, Mus musculus
gggcactgtcatcagaattcgaggc

SEQ ID NO: 633281 - DNA, 25 bp, Mus musculus
gggcactgtcatgagaattcgaggc

SEQ ID NO: 633282 - DNA, 25 bp, Mus musculus
gggcactgtggcatgtcctaagatc

SEQ ID NO: 633283 - DNA, 25 bp, Mus musculus
gggcactgtggcttgtcctaagatc

SEQ ID NO: 633284 - DNA, 25 bp, Mus musculus
gggcactgttacctccagaaggcac

SEQ ID NO: 633285 - DNA, 25 bp, Mus musculus
gggcactgttacgtccagaaggcac

SEQ ID NO: 633286 - DNA, 25 bp, Mus musculus
gggcactgttagaagtttctctgca

SEQ ID NO: 633287 - DNA, 25 bp, Mus musculus
gggcactgttagtagtttctctgca

SEQ ID NO: 633288 - DNA, 25 bp, Mus musculus
gggcactgttccacctggatccagt

SEQ ID NO: 633289 - DNA, 25 bp, Mus musculus
gggcactgttcctcctggatccagt

SEQ ID NO: 633290 - DNA, 25 bp, Mus musculus
gggcacttaagcattgtaattcgtt

SEQ ID NO: 633291 - DNA, 25 bp, Mus musculus
gggcacttaagctttgtaattcgtt

SEQ ID NO: 633292 - DNA, 25 bp, Mus musculus
gggcacttacccagtgaagcatgtc

SEQ ID NO: 633293 - DNA, 25 bp, Mus musculus
gggcacttaccctgtgaagcatgtc

SEQ ID NO: 633294 - DNA, 25 bp, Mus musculus
gggcacttactactcaatgttttgt

SEQ ID NO: 633295 - DNA, 25 bp, Mus musculus
gggcacttactagtcaatgttttgt

SEQ ID NO: 633296 - DNA, 25 bp, Mus musculus
gggcacttagaaaactcataccatt

SEQ ID NO: 633297 - DNA, 25 bp, Mus musculus
gggcacttagaatactcataccatt

SEQ ID NO: 633298 - DNA, 25 bp, Mus musculus
gggcacttaggcaaacacctgcagt

SEQ ID NO: 633299 - DNA, 25 bp, Mus musculus
gggcacttaggctaacacctgcagt

SEQ ID NO: 633300 - DNA, 25 bp, Mus musculus
gggcacttcaaaagccactgtgcgg

SEQ ID NO: 633301 - DNA, 25 bp, Mus musculus
gggcacttcaaatgccactgtgcgg

SEQ ID NO: 633302 - DNA, 25 bp, Mus musculus
gggcacttccaaccgcagaaattta

SEQ ID NO: 633303 - DNA, 25 bp, Mus musculus
gggcacttccaagcgcagaaattta

SEQ ID NO: 633304 - DNA, 25 bp, Mus musculus
gggcacttccatcgccttcaaaaac

SEQ ID NO: 633305 - DNA, 25 bp, Mus musculus
gggcacttccatggccttcaaaaac

SEQ ID NO: 633306 - DNA, 25 bp, Mus musculus
gggcacttcctgaggtggattcagc

SEQ ID NO: 633307 - DNA, 25 bp, Mus musculus
gggcacttcctgtggtggattcagc

SEQ ID NO: 633308 - DNA, 25 bp, Mus musculus
gggcacttccttcgagagatatgag

SEQ ID NO: 633309 - DNA, 25 bp, Mus musculus
gggcacttccttggagagatatgag

SEQ ID NO: 633310 - DNA, 25 bp, Mus musculus
gggcacttcgaactgcctgcaaacg

SEQ ID NO: 633311 - DNA, 25 bp, Mus musculus
gggcacttcgaagtgcctgcaaacg

SEQ ID NO: 633312 - DNA, 25 bp, Mus musculus
gggcacttgaagagtctcccttgct

SEQ ID NO: 633313 - DNA, 25 bp, Mus musculus
gggcacttgaagtgtctcccttgct

SEQ ID NO: 633314 - DNA, 25 bp, Mus musculus
gggcacttgaatccctgggtgtcta

SEQ ID NO: 633315 - DNA, 25 bp, Mus musculus
gggcacttgaatgcctgggtgtcta

SEQ ID NO: 633316 - DNA, 25 bp, Mus musculus
gggcacttgagaagcttcgttttaa

SEQ ID NO: 633317 - DNA, 25 bp, Mus musculus
gggcacttgagatgcttcgttttaa

SEQ ID NO: 633318 - DNA, 25 bp, Mus musculus
gggcacttgattaatgtctcatcac

SEQ ID NO: 633319 - DNA, 25 bp, Mus musculus
gggcacttgatttatgtctcatcac

SEQ ID NO: 633320 - DNA, 25 bp, Mus musculus
gggcacttgcctcaggagttagcat

SEQ ID NO: 633321 - DNA, 25 bp, Mus musculus
gggcacttgcctgaggagttagcat

SEQ ID NO: 633322 - DNA, 25 bp, Mus musculus
gggcacttgcgccaaagctgtgaac

SEQ ID NO: 633323 - DNA, 25 bp, Mus musculus
gggcacttgcgcgaaagctgtgaac

SEQ ID NO: 633324 - DNA, 25 bp, Mus musculus
gggcacttggtgactaagcaagaat

SEQ ID NO: 633325 - DNA, 25 bp, Mus musculus
gggcacttggtgtctaagcaagaat

SEQ ID NO: 633326 - DNA, 25 bp, Mus musculus
gggcacttgtgtaattcttataagg

SEQ ID NO: 633327 - DNA, 25 bp, Mus musculus
gggcacttgtgttattcttataagg

SEQ ID NO: 633328 - DNA, 25 bp, Mus musculus
gggcactttatccacgacaaacgaa

SEQ ID NO: 633329 - DNA, 25 bp, Mus musculus
gggcactttatcgacgacaaacgaa

SEQ ID NO: 633330 - DNA, 25 bp, Mus musculus
gggcactttctcaattgagcttatc

SEQ ID NO: 633331 - DNA, 25 bp, Mus musculus
gggcactttctctattgagcttatc

SEQ ID NO: 633332 - DNA, 25 bp, Mus musculus
gggcactttgagacacctcattcag

SEQ ID NO: 633333 - DNA, 25 bp, Mus musculus
gggcactttgagtcacctcattcag

SEQ ID NO: 633334 - DNA, 25 bp, Mus musculus
gggcactttgctaggttatgttcaa

SEQ ID NO: 633335 - DNA, 25 bp, Mus musculus
gggcactttgcttggttatgttcaa

SEQ ID NO: 633336 - DNA, 25 bp, Mus musculus
gggcacttttcaagccacacacaaa

SEQ ID NO: 633337 - DNA, 25 bp, Mus musculus
gggcacttttcatgccacacacaaa

SEQ ID NO: 633338 - DNA, 25 bp, Mus musculus
gggcacttttctactgtatggctgt

SEQ ID NO: 633339 - DNA, 25 bp, Mus musculus
gggcacttttcttctgtatggctgt

SEQ ID NO: 633340 - DNA, 25 bp, Mus musculus
gggcactttttcagcttgctataac

SEQ ID NO: 633341 - DNA, 25 bp, Mus musculus
gggcactttttctgcttgctataac

SEQ ID NO: 633342 - DNA, 25 bp, Mus musculus
gggcagaaaccaagccactatggtg

SEQ ID NO: 633343 - DNA, 25 bp, Mus musculus
gggcagaaaccatgccactatggtg

SEQ ID NO: 633344 - DNA, 25 bp, Mus musculus
gggcagaaacggatcacattccatt

SEQ ID NO: 633345 - DNA, 25 bp, Mus musculus
gggcagaaacggttcacattccatt

SEQ ID NO: 633346 - DNA, 25 bp, Mus musculus
gggcagaaacttctatcagataacc

SEQ ID NO: 633347 - DNA, 25 bp, Mus musculus
gggcagaaacttgtatcagataacc

SEQ ID NO: 633348 - DNA, 25 bp, Mus musculus
gggcagaaatggcactatccataca

SEQ ID NO: 633349 - DNA, 25 bp, Mus musculus
gggcagaaatgggactatccataca

SEQ ID NO: 633350 - DNA, 25 bp, Mus musculus
gggcagaacaatccaagctcttcac

SEQ ID NO: 633351 - DNA, 25 bp, Mus musculus
gggcagaacaatgcaagctcttcac

SEQ ID NO: 633352 - DNA, 25 bp, Mus musculus
gggcagaaccttcatttatctgtgc

SEQ ID NO: 633353 - DNA, 25 bp, Mus musculus
gggcagaaccttgatttatctgtgc

SEQ ID NO: 633354 - DNA, 25 bp, Mus musculus
gggcagaacgcaagcactgaaatct

SEQ ID NO: 633355 - DNA, 25 bp, Mus musculus
gggcagaacgcatgcactgaaatct

SEQ ID NO: 633356 - DNA, 25 bp, Mus musculus
gggcagaactaacagtcctttagtg

SEQ ID NO: 633357 - DNA, 25 bp, Mus musculus
gggcagaactaagagtcctttagtg

SEQ ID NO: 633358 - DNA, 25 bp, Mus musculus
gggcagaactatcaagacagagaac

SEQ ID NO: 633359 - DNA, 25 bp, Mus musculus
gggcagaactatgaagacagagaac

SEQ ID NO: 633360 - DNA, 25 bp, Mus musculus
gggcagaagaaaaagaactccagca

SEQ ID NO: 633361 - DNA, 25 bp, Mus musculus
gggcagaagaaatagaactccagca

SEQ ID NO: 633362 - DNA, 25 bp, Mus musculus
gggcagaatgaccagaacagtgata

SEQ ID NO: 633363 - DNA, 25 bp, Mus musculus
gggcagaatgacgagaacagtgata

SEQ ID NO: 633364 - DNA, 25 bp, Mus musculus
gggcagaatgcaagtttttggaaaa

SEQ ID NO: 633365 - DNA, 25 bp, Mus musculus
gggcagaatgcatgtttttggaaaa

SEQ ID NO: 633366 - DNA, 25 bp, Mus musculus
gggcagaatgtaagccattttcaaa

SEQ ID NO: 633367 - DNA, 25 bp, Mus musculus
gggcagaatgtatgccattttcaaa

SEQ ID NO: 633368 - DNA, 25 bp, Mus musculus
gggcagaattgacaagcctatctta

SEQ ID NO: 633369 - DNA, 25 bp, Mus musculus
gggcagaattgagaagcctatctta

SEQ ID NO: 633370 - DNA, 25 bp, Mus musculus
gggcagacacagacaagtttcagtg

SEQ ID NO: 633371 - DNA, 25 bp, Mus musculus
gggcagacacagtcaagtttcagtg

SEQ ID NO: 633372 - DNA, 25 bp, Mus musculus
gggcagacacgacactccattctta

SEQ ID NO: 633373 - DNA, 25 bp, Mus musculus
gggcagacacgagactccattctta

SEQ ID NO: 633374 - DNA, 25 bp, Mus musculus
gggcagacactgacgcttagaaaga

SEQ ID NO: 633375 - DNA, 25 bp, Mus musculus
gggcagacactgctaatcaaccctg

SEQ ID NO: 633376 - DNA, 25 bp, Mus musculus
gggcagacactggtaatcaaccctg

SEQ ID NO: 633377 - DNA, 25 bp, Mus musculus
gggcagacactgtcgcttagaaaga

SEQ ID NO: 633378 - DNA, 25 bp, Mus musculus
gggcagacacttaaggtcgtcgatt

SEQ ID NO: 633379 - DNA, 25 bp, Mus musculus
gggcagacactttaggtcgtcgatt

SEQ ID NO: 633380 - DNA, 25 bp, Mus musculus
gggcagacattaaagtgggcatgat

SEQ ID NO: 633381 - DNA, 25 bp, Mus musculus
gggcagacattatagtgggcatgat

SEQ ID NO: 633382 - DNA, 25 bp, Mus musculus
gggcagacatttctgaaggttccat

SEQ ID NO: 633383 - DNA, 25 bp, Mus musculus
gggcagacatttgtgaaggttccat

SEQ ID NO: 633384 - DNA, 25 bp, Mus musculus
gggcagaccacgcagatctctagaa

SEQ ID NO: 633385 - DNA, 25 bp, Mus musculus
gggcagaccacggagatctctagaa

SEQ ID NO: 633386 - DNA, 25 bp, Mus musculus
gggcagacccctatgtagttaatgt

SEQ ID NO: 633387 - DNA, 25 bp, Mus musculus
gggcagacccctttgtagttaatgt

SEQ ID NO: 633388 - DNA, 25 bp, Mus musculus
gggcagacccgcacagtggtaatgc

SEQ ID NO: 633389 - DNA, 25 bp, Mus musculus
gggcagacccgctcagtggtaatgc

SEQ ID NO: 633390 - DNA, 25 bp, Mus musculus
gggcagacccggactcatgaggagg

SEQ ID NO: 633391 - DNA, 25 bp, Mus musculus
gggcagacccggtctcatgaggagg

SEQ ID NO: 633392 - DNA, 25 bp, Mus musculus
gggcagacccgtctttgtgtttcgt

SEQ ID NO: 633393 - DNA, 25 bp, Mus musculus
gggcagacccgtgtttgtgtttcgt

SEQ ID NO: 633394 - DNA, 25 bp, Mus musculus
gggcagaccgatagaatcattggta

SEQ ID NO: 633395 - DNA, 25 bp, Mus musculus
gggcagaccgattgaatcattggta

SEQ ID NO: 633396 - DNA, 25 bp, Mus musculus
gggcagacggcacctaattttggta

SEQ ID NO: 633397 - DNA, 25 bp, Mus musculus
gggcagacggcagctaattttggta

SEQ ID NO: 633398 - DNA, 25 bp, Mus musculus
gggcagacgtttacatggtgaaact

SEQ ID NO: 633399 - DNA, 25 bp, Mus musculus
gggcagacgttttcatggtgaaact

SEQ ID NO: 633400 - DNA, 25 bp, Mus musculus
gggcagactctacacctcatgacag

SEQ ID NO: 633401 - DNA, 25 bp, Mus musculus
gggcagactctagacctcatgacag

SEQ ID NO: 633402 - DNA, 25 bp, Mus musculus
gggcagactctgacacagcaggaat

SEQ ID NO: 633403 - DNA, 25 bp, Mus musculus
gggcagactctgtcacagcaggaat

SEQ ID NO: 633404 - DNA, 25 bp, Mus musculus
gggcagactcttcaagtagcaccaa

SEQ ID NO: 633405 - DNA, 25 bp, Mus musculus
gggcagactcttgaagtagcaccaa

SEQ ID NO: 633406 - DNA, 25 bp, Mus musculus
gggcagactgctaatcagaggaaag

SEQ ID NO: 633407 - DNA, 25 bp, Mus musculus
gggcagactgcttatcagaggaaag

SEQ ID NO: 633408 - DNA, 25 bp, Mus musculus
gggcagacttacatacagtgatcca

SEQ ID NO: 633409 - DNA, 25 bp, Mus musculus
gggcagacttacttacagtgatcca

SEQ ID NO: 633410 - DNA, 25 bp, Mus musculus
gggcagacttcactctttttactgt

SEQ ID NO: 633411 - DNA, 25 bp, Mus musculus
gggcagacttcagtctttttactgt

SEQ ID NO: 633412 - DNA, 25 bp, Mus musculus
gggcagagaaccatggctaagaaga

SEQ ID NO: 633413 - DNA, 25 bp, Mus musculus
gggcagagaaccttggctaagaaga

SEQ ID NO: 633414 - DNA, 25 bp, Mus musculus
gggcagagacagcacaaaccttagt

SEQ ID NO: 633415 - DNA, 25 bp, Mus musculus
gggcagagacaggacaaaccttagt

SEQ ID NO: 633416 - DNA, 25 bp, Mus musculus
gggcagagcactcacatctccaatg

SEQ ID NO: 633417 - DNA, 25 bp, Mus musculus
gggcagagcactgacatctccaatg

SEQ ID NO: 633418 - DNA, 25 bp, Mus musculus
gggcagagccagctagcattcactc

SEQ ID NO: 633419 - DNA, 25 bp, Mus musculus
gggcagagccaggtagcattcactc

SEQ ID NO: 633420 - DNA, 25 bp, Mus musculus
gggcagagcccaaaagtaaagacat

SEQ ID NO: 633421 - DNA, 25 bp, Mus musculus
gggcagagcccataagtaaagacat

SEQ ID NO: 633422 - DNA, 25 bp, Mus musculus
gggcagagctgcactaacttgtgtt

SEQ ID NO: 633423 - DNA, 25 bp, Mus musculus
gggcagagctgctctaacttgtgtt

SEQ ID NO: 633424 - DNA, 25 bp, Mus musculus
gggcagaggcaaaccagggttttct

SEQ ID NO: 633425 - DNA, 25 bp, Mus musculus
gggcagaggcaatccagggttttct

SEQ ID NO: 633426 - DNA, 25 bp, Mus musculus
gggcagaggttcatgcatgctatga

SEQ ID NO: 633427 - DNA, 25 bp, Mus musculus
gggcagaggttcttgcatgctatga

SEQ ID NO: 633428 - DNA, 25 bp, Mus musculus
gggcagaggtttagtcattccttca

SEQ ID NO: 633429 - DNA, 25 bp, Mus musculus
gggcagaggttttgtcattccttca

SEQ ID NO: 633430 - DNA, 25 bp, Mus musculus
gggcagagtaaacagccttgtcttg

SEQ ID NO: 633431 - DNA, 25 bp, Mus musculus
gggcagagtaaagagccttgtcttg

SEQ ID NO: 633432 - DNA, 25 bp, Mus musculus
gggcagagtaatactttaatgcaga

SEQ ID NO: 633433 - DNA, 25 bp, Mus musculus
gggcagagtaattctttaatgcaga

SEQ ID NO: 633434 - DNA, 25 bp, Mus musculus
gggcagagtagcacatagcagcaat

SEQ ID NO: 633435 - DNA, 25 bp, Mus musculus
gggcagagtagctcatagcagcaat

SEQ ID NO: 633436 - DNA, 25 bp, Mus musculus
gggcagagtaggacttccattaatt

SEQ ID NO: 633437 - DNA, 25 bp, Mus musculus
gggcagagtaggtcttccattaatt

SEQ ID NO: 633438 - DNA, 25 bp, Mus musculus
gggcagagtatcaacttacatggcc

SEQ ID NO: 633439 - DNA, 25 bp, Mus musculus
gggcagagtatctacttacatggcc

SEQ ID NO: 633440 - DNA, 25 bp, Mus musculus
gggcagagtcagcaaacagtccatg

SEQ ID NO: 633441 - DNA, 25 bp, Mus musculus
gggcagagtcaggaaacagtccatg

SEQ ID NO: 633442 - DNA, 25 bp, Mus musculus
gggcagagtcttaggagccatttta

SEQ ID NO: 633443 - DNA, 25 bp, Mus musculus
gggcagagtctttggagccatttta

SEQ ID NO: 633444 - DNA, 25 bp, Mus musculus
gggcagagtgctcactgcaaccaaa

SEQ ID NO: 633445 - DNA, 25 bp, Mus musculus
gggcagagtgctgactgcaaccaaa

SEQ ID NO: 633446 - DNA, 25 bp, Mus musculus
gggcagataataagacctccttgtg

SEQ ID NO: 633447 - DNA, 25 bp, Mus musculus
gggcagataatatgacctccttgtg

SEQ ID NO: 633448 - DNA, 25 bp, Mus musculus
gggcagataccaagacctgtctgtt

SEQ ID NO: 633449 - DNA, 25 bp, Mus musculus
gggcagataccatgacctgtctgtt

SEQ ID NO: 633450 - DNA, 25 bp, Mus musculus
gggcagatactcagaataccgtttt

SEQ ID NO: 633451 - DNA, 25 bp, Mus musculus
gggcagatactctgaataccgtttt

SEQ ID NO: 633452 - DNA, 25 bp, Mus musculus
gggcagatacttaccaatttctgga

SEQ ID NO: 633453 - DNA, 25 bp, Mus musculus
gggcagatactttccaatttctgga

SEQ ID NO: 633454 - DNA, 25 bp, Mus musculus
gggcagatcacacgtggcaccagtc

SEQ ID NO: 633455 - DNA, 25 bp, Mus musculus
gggcagatcacaggtggcaccagtc

SEQ ID NO: 633456 - DNA, 25 bp, Mus musculus
gggcagatccatacagtttgcagtg

SEQ ID NO: 633457 - DNA, 25 bp, Mus musculus
gggcagatccattcagtttgcagtg

SEQ ID NO: 633458 - DNA, 25 bp, Mus musculus
gggcagatcgatcgcctgatcacac

SEQ ID NO: 633459 - DNA, 25 bp, Mus musculus
gggcagatcgatggcctgatcacac

SEQ ID NO: 633460 - DNA, 25 bp, Mus musculus
gggcagatcgtcaccatcagcatta

SEQ ID NO: 633461 - DNA, 25 bp, Mus musculus
gggcagatcgtctccatcagcatta

SEQ ID NO: 633462 - DNA, 25 bp, Mus musculus
gggcagatctcgactgatacctata

SEQ ID NO: 633463 - DNA, 25 bp, Mus musculus
gggcagatctcgtctgatacctata

SEQ ID NO: 633464 - DNA, 25 bp, Mus musculus
gggcagatctgacacaccctagact

SEQ ID NO: 633465 - DNA, 25 bp, Mus musculus
gggcagatctgagacaccctagact

SEQ ID NO: 633466 - DNA, 25 bp, Mus musculus
gggcagatgccgatctcttgccagt

SEQ ID NO: 633467 - DNA, 25 bp, Mus musculus
gggcagatgccgttctcttgccagt

SEQ ID NO: 633468 - DNA, 25 bp, Mus musculus
gggcagatggctacaagtgcagttc

SEQ ID NO: 633469 - DNA, 25 bp, Mus musculus
gggcagatggcttcaagtgcagttc

SEQ ID NO: 633470 - DNA, 25 bp, Mus musculus
gggcagatgtgacctttccaaagct

SEQ ID NO: 633471 - DNA, 25 bp, Mus musculus
gggcagatgtgagctttccaaagct

SEQ ID NO: 633472 - DNA, 25 bp, Mus musculus
gggcagatgttgaatcttcctcacc

SEQ ID NO: 633473 - DNA, 25 bp, Mus musculus
gggcagatgttgtatcttcctcacc

SEQ ID NO: 633474 - DNA, 25 bp, Mus musculus
gggcagatttctacctaaggtctct

SEQ ID NO: 633475 - DNA, 25 bp, Mus musculus
gggcagatttcttcctaaggtctct

SEQ ID NO: 633476 - DNA, 25 bp, Mus musculus
gggcagatttgcaagtttacacctt

SEQ ID NO: 633477 - DNA, 25 bp, Mus musculus
gggcagatttgctagtttacacctt

SEQ ID NO: 633478 - DNA, 25 bp, Mus musculus
gggcagcaagcaaatgcctttagtt

SEQ ID NO: 633479 - DNA, 25 bp, Mus musculus
gggcagcaagcatatgcctttagtt

SEQ ID NO: 633480 - DNA, 25 bp, Mus musculus
gggcagcaatatagtggttataaag

SEQ ID NO: 633481 - DNA, 25 bp, Mus musculus
gggcagcaatattgtggttataaag

SEQ ID NO: 633482 - DNA, 25 bp, Mus musculus
gggcagcaatcaatctatattatac

SEQ ID NO: 633483 - DNA, 25 bp, Mus musculus
gggcagcaatcattctatattatac

SEQ ID NO: 633484 - DNA, 25 bp, Mus musculus
gggcagcaatccaggaaagctctgt

SEQ ID NO: 633485 - DNA, 25 bp, Mus musculus
gggcagcaatcctggaaagctctgt

SEQ ID NO: 633486 - DNA, 25 bp, Mus musculus
gggcagcaatggcttctactcctac

SEQ ID NO: 633487 - DNA, 25 bp, Mus musculus
gggcagcaatgggttctactcctac

SEQ ID NO: 633488 - DNA, 25 bp, Mus musculus
gggcagcacaccactgtttcacccg

SEQ ID NO: 633489 - DNA, 25 bp, Mus musculus
gggcagcacacctctgtttcacccg

SEQ ID NO: 633490 - DNA, 25 bp, Mus musculus
gggcagcacctgaacaaacacaatt

SEQ ID NO: 633491 - DNA, 25 bp, Mus musculus
gggcagcacctgacaacagagttga

SEQ ID NO: 633492 - DNA, 25 bp, Mus musculus
gggcagcacctgtacaaacacaatt

SEQ ID NO: 633493 - DNA, 25 bp, Mus musculus
gggcagcacctgtcaacagagttga

SEQ ID NO: 633494 - DNA, 25 bp, Mus musculus
gggcagcactacacccatcaagttc

SEQ ID NO: 633495 - DNA, 25 bp, Mus musculus
gggcagcactactcccatcaagttc

SEQ ID NO: 633496 - DNA, 25 bp, Mus musculus
gggcagcactgcagtctgggacctt

SEQ ID NO: 633497 - DNA, 25 bp, Mus musculus
gggcagcactgctgtctgggacctt

SEQ ID NO: 633498 - DNA, 25 bp, Mus musculus
gggcagcactgtaaagctcatatgt

SEQ ID NO: 633499 - DNA, 25 bp, Mus musculus
gggcagcactgttaagctcatatgt

SEQ ID NO: 633500 - DNA, 25 bp, Mus musculus
gggcagcacttgattggtacacttt

SEQ ID NO: 633501 - DNA, 25 bp, Mus musculus
gggcagcacttgtttggtacacttt

SEQ ID NO: 633502 - DNA, 25 bp, Mus musculus
gggcagcagccacagacaagtatca

SEQ ID NO: 633503 - DNA, 25 bp, Mus musculus
gggcagcagccagagacaagtatca

SEQ ID NO: 633504 - DNA, 25 bp, Mus musculus
gggcagcagctgactccaacatctg

SEQ ID NO: 633505 - DNA, 25 bp, Mus musculus
gggcagcagctgattgtctatgtga

SEQ ID NO: 633506 - DNA, 25 bp, Mus musculus
gggcagcagctgtctccaacatctg

SEQ ID NO: 633507 - DNA, 25 bp, Mus musculus
gggcagcagctgtttgtctatgtga

SEQ ID NO: 633508 - DNA, 25 bp, Mus musculus
gggcagcaggtcatacaggtcatca

SEQ ID NO: 633509 - DNA, 25 bp, Mus musculus
gggcagcaggtcttacaggtcatca

SEQ ID NO: 633510 - DNA, 25 bp, Mus musculus
gggcagcaggttatgtacggtacat

SEQ ID NO: 633511 - DNA, 25 bp, Mus musculus
gggcagcaggttttgtacggtacat

SEQ ID NO: 633512 - DNA, 25 bp, Mus musculus
gggcagcagtatatgatcatccagc

SEQ ID NO: 633513 - DNA, 25 bp, Mus musculus
gggcagcagtatttgatcatccagc

SEQ ID NO: 633514 - DNA, 25 bp, Mus musculus
gggcagcagtgcataccagtaatca

SEQ ID NO: 633515 - DNA, 25 bp, Mus musculus
gggcagcagtgcttaccagtaatca

SEQ ID NO: 633516 - DNA, 25 bp, Mus musculus
gggcagcagtgtaagatcctgaacg

SEQ ID NO: 633517 - DNA, 25 bp, Mus musculus
gggcagcagtgttagatcctgaacg

SEQ ID NO: 633518 - DNA, 25 bp, Mus musculus
gggcagcagttaagtgtctcccata

SEQ ID NO: 633519 - DNA, 25 bp, Mus musculus
gggcagcagttatgtgtctcccata

SEQ ID NO: 633520 - DNA, 25 bp, Mus musculus
gggcagcatctgaagcctgatgcct

SEQ ID NO: 633521 - DNA, 25 bp, Mus musculus
gggcagcatctgtagcctgatgcct

SEQ ID NO: 633522 - DNA, 25 bp, Mus musculus
gggcagcatgccatgtgcagcagaa

SEQ ID NO: 633523 - DNA, 25 bp, Mus musculus
gggcagcatgccttgtgcagcagaa

SEQ ID NO: 633524 - DNA, 25 bp, Mus musculus
gggcagcatggtaagttccaagcca

SEQ ID NO: 633525 - DNA, 25 bp, Mus musculus
gggcagcatggttagttccaagcca

SEQ ID NO: 633526 - DNA, 25 bp, Mus musculus
gggcagcattatacctgtcaagttc

SEQ ID NO: 633527 - DNA, 25 bp, Mus musculus
gggcagcattattcctgtcaagttc

SEQ ID NO: 633528 - DNA, 25 bp, Mus musculus
gggcagcattctctagatgtctcta

SEQ ID NO: 633529 - DNA, 25 bp, Mus musculus
gggcagcattctgtagatgtctcta

SEQ ID NO: 633530 - DNA, 25 bp, Mus musculus
gggcagccaaagattgctccaacat

SEQ ID NO: 633531 - DNA, 25 bp, Mus musculus
gggcagccaaagtttgctccaacat

SEQ ID NO: 633532 - DNA, 25 bp, Mus musculus
gggcagccaatcaaaggtttcttca

SEQ ID NO: 633533 - DNA, 25 bp, Mus musculus
gggcagccaatctaaggtttcttca

SEQ ID NO: 633534 - DNA, 25 bp, Mus musculus
gggcagccacagactaagacctcag

SEQ ID NO: 633535 - DNA, 25 bp, Mus musculus
gggcagccacagtctaagacctcag

SEQ ID NO: 633536 - DNA, 25 bp, Mus musculus
gggcagccagatctatcatatagaa

SEQ ID NO: 633537 - DNA, 25 bp, Mus musculus
gggcagccagatgtatcatatagaa

SEQ ID NO: 633538 - DNA, 25 bp, Mus musculus
gggcagccagggattgatctcagta

SEQ ID NO: 633539 - DNA, 25 bp, Mus musculus
gggcagccagggtttgatctcagta

SEQ ID NO: 633540 - DNA, 25 bp, Mus musculus
gggcagccatgcaccagagcaacaa

SEQ ID NO: 633541 - DNA, 25 bp, Mus musculus
gggcagccatgctccagagcaacaa

SEQ ID NO: 633542 - DNA, 25 bp, Mus musculus
gggcagccattcagaacacgttaaa

SEQ ID NO: 633543 - DNA, 25 bp, Mus musculus
gggcagccattctgaacacgttaaa

SEQ ID NO: 633544 - DNA, 25 bp, Mus musculus
gggcagcccaaaacacatactgagt

SEQ ID NO: 633545 - DNA, 25 bp, Mus musculus
gggcagcccaaatcacatactgagt

SEQ ID NO: 633546 - DNA, 25 bp, Mus musculus
gggcagcccaccaccgtaaatcaga

SEQ ID NO: 633547 - DNA, 25 bp, Mus musculus
gggcagcccacctccgtaaatcaga

SEQ ID NO: 633548 - DNA, 25 bp, Mus musculus
gggcagcccatgaccgttactataa

SEQ ID NO: 633549 - DNA, 25 bp, Mus musculus
gggcagcccatgtccgttactataa

SEQ ID NO: 633550 - DNA, 25 bp, Mus musculus
gggcagccccaaataacattagaga

SEQ ID NO: 633551 - DNA, 25 bp, Mus musculus
gggcagccccaattaacattagaga

SEQ ID NO: 633552 - DNA, 25 bp, Mus musculus
gggcagccccggaggcctttgcagc

SEQ ID NO: 633553 - DNA, 25 bp, Mus musculus
gggcagccccggtggcctttgcagc

SEQ ID NO: 633554 - DNA, 25 bp, Mus musculus
gggcagcccttacgatgtatcccct

SEQ ID NO: 633555 - DNA, 25 bp, Mus musculus
gggcagcccttaggatgtatcccct

SEQ ID NO: 633556 - DNA, 25 bp, Mus musculus
gggcagccgaagaccctcaccccag

SEQ ID NO: 633557 - DNA, 25 bp, Mus musculus
gggcagccgaagtccctcaccccag

SEQ ID NO: 633558 - DNA, 25 bp, Mus musculus
gggcagccgcatctaaataacacaa

SEQ ID NO: 633559 - DNA, 25 bp, Mus musculus
gggcagccgcatgtaaataacacaa

SEQ ID NO: 633560 - DNA, 25 bp, Mus musculus
gggcagcctaagatctttcaacaag

SEQ ID NO: 633561 - DNA, 25 bp, Mus musculus
gggcagcctaagttctttcaacaag

SEQ ID NO: 633562 - DNA, 25 bp, Mus musculus
gggcagcctactcagggtacatcta

SEQ ID NO: 633563 - DNA, 25 bp, Mus musculus
gggcagcctactgagggtacatcta

SEQ ID NO: 633564 - DNA, 25 bp, Mus musculus
gggcagcctgatccttcatttggaa

SEQ ID NO: 633565 - DNA, 25 bp, Mus musculus
gggcagcctgatgcttcatttggaa

SEQ ID NO: 633566 - DNA, 25 bp, Mus musculus
gggcagcctgcgaaattgtcaactt

SEQ ID NO: 633567 - DNA, 25 bp, Mus musculus
gggcagcctgcgtaattgtcaactt

SEQ ID NO: 633568 - DNA, 25 bp, Mus musculus
gggcagcctggcatggaaccaagca

SEQ ID NO: 633569 - DNA, 25 bp, Mus musculus
gggcagcctggcttggaaccaagca

SEQ ID NO: 633570 - DNA, 25 bp, Mus musculus
gggcagccttatatggtgttcttac

SEQ ID NO: 633571 - DNA, 25 bp, Mus musculus
gggcagccttatttggtgttcttac

SEQ ID NO: 633572 - DNA, 25 bp, Mus musculus
gggcagcgaactctgcctacagcaa

SEQ ID NO: 633573 - DNA, 25 bp, Mus musculus
gggcagcgaactgtgcctacagcaa

SEQ ID NO: 633574 - DNA, 25 bp, Mus musculus
gggcagcgcagcagatgctgatcca

SEQ ID NO: 633575 - DNA, 25 bp, Mus musculus
gggcagcgcagctgatgctgatcca

SEQ ID NO: 633576 - DNA, 25 bp, Mus musculus
gggcagcgctgtatcttaaaaatca

SEQ ID NO: 633577 - DNA, 25 bp, Mus musculus
gggcagcgctgtttcttaaaaatca

SEQ ID NO: 633578 - DNA, 25 bp, Mus musculus
gggcagcggttcataccaaggacat

SEQ ID NO: 633579 - DNA, 25 bp, Mus musculus
gggcagcggttcttaccaaggacat

SEQ ID NO: 633580 - DNA, 25 bp, Mus musculus
gggcagcgttataaacccctgaggt

SEQ ID NO: 633581 - DNA, 25 bp, Mus musculus
gggcagcgttattaacccctgaggt

SEQ ID NO: 633582 - DNA, 25 bp, Mus musculus
gggcagcgtttgctaccagattaca

SEQ ID NO: 633583 - DNA, 25 bp, Mus musculus
gggcagcgtttggtaccagattaca

SEQ ID NO: 633584 - DNA, 25 bp, Mus musculus
gggcagctaattatgcttttaccaa

SEQ ID NO: 633585 - DNA, 25 bp, Mus musculus
gggcagctaattttgcttttaccaa

SEQ ID NO: 633586 - DNA, 25 bp, Mus musculus
gggcagctatttagcatccaattcc

SEQ ID NO: 633587 - DNA, 25 bp, Mus musculus
gggcagctattttgcatccaattcc

SEQ ID NO: 633588 - DNA, 25 bp, Mus musculus
gggcagctcaggactcagccaggta

SEQ ID NO: 633589 - DNA, 25 bp, Mus musculus
gggcagctcaggtctcagccaggta

SEQ ID NO: 633590 - DNA, 25 bp, Mus musculus
gggcagctcatcattttctttagtc

SEQ ID NO: 633591 - DNA, 25 bp, Mus musculus
gggcagctcatctttttctttagtc

SEQ ID NO: 633592 - DNA, 25 bp, Mus musculus
gggcagctccccaaagacataagca

SEQ ID NO: 633593 - DNA, 25 bp, Mus musculus
gggcagctccccaatgagtggatgt

SEQ ID NO: 633594 - DNA, 25 bp, Mus musculus
gggcagctcccctaagacataagca

SEQ ID NO: 633595 - DNA, 25 bp, Mus musculus
gggcagctcccctatgagtggatgt

SEQ ID NO: 633596 - DNA, 25 bp, Mus musculus
gggcagctccgcatgctggcatcgt

SEQ ID NO: 633597 - DNA, 25 bp, Mus musculus
gggcagctccgcttgctggcatcgt

SEQ ID NO: 633598 - DNA, 25 bp, Mus musculus
gggcagctccttagttcctctggtc

SEQ ID NO: 633599 - DNA, 25 bp, Mus musculus
gggcagctcctttgttcctctggtc

SEQ ID NO: 633600 - DNA, 25 bp, Mus musculus
gggcagctcgtaatccatatgactt

SEQ ID NO: 633601 - DNA, 25 bp, Mus musculus
gggcagctcgtattccatatgactt

SEQ ID NO: 633602 - DNA, 25 bp, Mus musculus
gggcagctctacattggtgaaggct

SEQ ID NO: 633603 - DNA, 25 bp, Mus musculus
gggcagctctactttggtgaaggct

SEQ ID NO: 633604 - DNA, 25 bp, Mus musculus
gggcagctcttgattatggtaacac

SEQ ID NO: 633605 - DNA, 25 bp, Mus musculus
gggcagctcttgtttatggtaacac

SEQ ID NO: 633606 - DNA, 25 bp, Mus musculus
gggcagctgactaggtacagccatt

SEQ ID NO: 633607 - DNA, 25 bp, Mus musculus
gggcagctgacttggtacagccatt

SEQ ID NO: 633608 - DNA, 25 bp, Mus musculus
gggcagctgcaacttcgagtattaa

SEQ ID NO: 633609 - DNA, 25 bp, Mus musculus
gggcagctgcaagttcgagtattaa

SEQ ID NO: 633610 - DNA, 25 bp, Mus musculus
gggcagctgcagaaccacgataatc

SEQ ID NO: 633611 - DNA, 25 bp, Mus musculus
gggcagctgcagatgtatcttagaa

SEQ ID NO: 633612 - DNA, 25 bp, Mus musculus
gggcagctgcagtaccacgataatc

SEQ ID NO: 633613 - DNA, 25 bp, Mus musculus
gggcagctgcagttgtatcttagaa

SEQ ID NO: 633614 - DNA, 25 bp, Mus musculus
gggcagctgccaaattgatgtatta

SEQ ID NO: 633615 - DNA, 25 bp, Mus musculus
gggcagctgccatattgatgtatta

SEQ ID NO: 633616 - DNA, 25 bp, Mus musculus
gggcagctgctaactttgagacaga

SEQ ID NO: 633617 - DNA, 25 bp, Mus musculus
gggcagctgctatctttgagacaga

SEQ ID NO: 633618 - DNA, 25 bp, Mus musculus
gggcagctggacattgcatgttaga

SEQ ID NO: 633619 - DNA, 25 bp, Mus musculus
gggcagctggactttgcatgttaga

SEQ ID NO: 633620 - DNA, 25 bp, Mus musculus
gggcagctggcacccattcataaca

SEQ ID NO: 633621 - DNA, 25 bp, Mus musculus
gggcagctggcagccattcataaca

SEQ ID NO: 633622 - DNA, 25 bp, Mus musculus
gggcagctggctatggcgctttccc

SEQ ID NO: 633623 - DNA, 25 bp, Mus musculus
gggcagctggctttggcgctttccc

SEQ ID NO: 633624 - DNA, 25 bp, Mus musculus
gggcagctgggtataaatccgatga

SEQ ID NO: 633625 - DNA, 25 bp, Mus musculus
gggcagctgggtctccgtactcctc

SEQ ID NO: 633626 - DNA, 25 bp, Mus musculus
gggcagctgggtgtccgtactcctc

SEQ ID NO: 633627 - DNA, 25 bp, Mus musculus
gggcagctgggtttaaatccgatga

SEQ ID NO: 633628 - DNA, 25 bp, Mus musculus
gggcagctggtaactcactgggaat

SEQ ID NO: 633629 - DNA, 25 bp, Mus musculus
gggcagctggtatctcactgggaat

SEQ ID NO: 633630 - DNA, 25 bp, Mus musculus
gggcagctgtcccagattttgtata

SEQ ID NO: 633631 - DNA, 25 bp, Mus musculus
gggcagctgtccgagattttgtata

SEQ ID NO: 633632 - DNA, 25 bp, Mus musculus
gggcagctgttccacttaattttta

SEQ ID NO: 633633 - DNA, 25 bp, Mus musculus
gggcagctgttcgacttaattttta

SEQ ID NO: 633634 - DNA, 25 bp, Mus musculus
gggcagctgttgcatgccaattttt

SEQ ID NO: 633635 - DNA, 25 bp, Mus musculus
gggcagctgttggatgccaattttt

SEQ ID NO: 633636 - DNA, 25 bp, Mus musculus
gggcagcttaggcaatttagatctt

SEQ ID NO: 633637 - DNA, 25 bp, Mus musculus
gggcagcttagggaatttagatctt

SEQ ID NO: 633638 - DNA, 25 bp, Mus musculus
gggcagcttatacaacacatagtgt

SEQ ID NO: 633639 - DNA, 25 bp, Mus musculus
gggcagcttatagaacacatagtgt

SEQ ID NO: 633640 - DNA, 25 bp, Mus musculus
gggcagcttcgcacggtcagcaatg

SEQ ID NO: 633641 - DNA, 25 bp, Mus musculus
gggcagcttcgctcggtcagcaatg

SEQ ID NO: 633642 - DNA, 25 bp, Mus musculus
gggcagcttctgacttggcaataaa

SEQ ID NO: 633643 - DNA, 25 bp, Mus musculus
gggcagcttctgtcttggcaataaa

SEQ ID NO: 633644 - DNA, 25 bp, Mus musculus
gggcagcttcttccctattgaaaaa

SEQ ID NO: 633645 - DNA, 25 bp, Mus musculus
gggcagcttcttgcctattgaaaaa

SEQ ID NO: 633646 - DNA, 25 bp, Mus musculus
gggcagctttccaactcagatgtat

SEQ ID NO: 633647 - DNA, 25 bp, Mus musculus
gggcagctttccctagcagaggttt

SEQ ID NO: 633648 - DNA, 25 bp, Mus musculus
gggcagctttccgtagcagaggttt

SEQ ID NO: 633649 - DNA, 25 bp, Mus musculus
gggcagctttcctactcagatgtat

SEQ ID NO: 633650 - DNA, 25 bp, Mus musculus
gggcaggaaaccacactgcctgaat

SEQ ID NO: 633651 - DNA, 25 bp, Mus musculus
gggcaggaaacctcactgcctgaat

SEQ ID NO: 633652 - DNA, 25 bp, Mus musculus
gggcaggaacctactggaccccaat

SEQ ID NO: 633653 - DNA, 25 bp, Mus musculus
gggcaggaaccttctggaccccaat

SEQ ID NO: 633654 - DNA, 25 bp, Mus musculus
gggcaggaactcattgacgctgaga

SEQ ID NO: 633655 - DNA, 25 bp, Mus musculus
gggcaggaactctttgacgctgaga

SEQ ID NO: 633656 - DNA, 25 bp, Mus musculus
gggcaggaatcactgactttctcct

SEQ ID NO: 633657 - DNA, 25 bp, Mus musculus
gggcaggaatcagtgactttctcct

SEQ ID NO: 633658 - DNA, 25 bp, Mus musculus
gggcaggacaccacggcagtgaacc

SEQ ID NO: 633659 - DNA, 25 bp, Mus musculus
gggcaggacacctcggcagtgaacc

SEQ ID NO: 633660 - DNA, 25 bp, Mus musculus
gggcaggacactaatttttgttttg

SEQ ID NO: 633661 - DNA, 25 bp, Mus musculus
gggcaggacacttatttttgttttg

SEQ ID NO: 633662 - DNA, 25 bp, Mus musculus
gggcaggacagactcttactaggat

SEQ ID NO: 633663 - DNA, 25 bp, Mus musculus
gggcaggacagagtcttactaggat

SEQ ID NO: 633664 - DNA, 25 bp, Mus musculus
gggcaggacccactgctggaaaagt

SEQ ID NO: 633665 - DNA, 25 bp, Mus musculus
gggcaggacccagtgctggaaaagt

SEQ ID NO: 633666 - DNA, 25 bp, Mus musculus
gggcaggacctccaaccagaatgga

SEQ ID NO: 633667 - DNA, 25 bp, Mus musculus
gggcaggacctcgaaccagaatgga

SEQ ID NO: 633668 - DNA, 25 bp, Mus musculus
gggcaggactgcatgttcagcatct

SEQ ID NO: 633669 - DNA, 25 bp, Mus musculus
gggcaggactgcttgttcagcatct

SEQ ID NO: 633670 - DNA, 25 bp, Mus musculus
gggcaggagagaacttaccactgtt

SEQ ID NO: 633671 - DNA, 25 bp, Mus musculus
gggcaggagagatcttaccactgtt

SEQ ID NO: 633672 - DNA, 25 bp, Mus musculus
gggcaggagcatcaggacatcagag

SEQ ID NO: 633673 - DNA, 25 bp, Mus musculus
gggcaggagcatgaggacatcagag

SEQ ID NO: 633674 - DNA, 25 bp, Mus musculus
gggcaggagccaacacctggcgcct

SEQ ID NO: 633675 - DNA, 25 bp, Mus musculus
gggcaggagccatcacctggcgcct

SEQ ID NO: 633676 - DNA, 25 bp, Mus musculus
gggcaggagcccaaccacctcagaa

SEQ ID NO: 633677 - DNA, 25 bp, Mus musculus
gggcaggagcccaattcaagtaaaa

SEQ ID NO: 633678 - DNA, 25 bp, Mus musculus
gggcaggagccctaccacctcagaa

SEQ ID NO: 633679 - DNA, 25 bp, Mus musculus
gggcaggagccctattcaagtaaaa

SEQ ID NO: 633680 - DNA, 25 bp, Mus musculus
gggcaggagccgctgagctaggcag

SEQ ID NO: 633681 - DNA, 25 bp, Mus musculus
gggcaggagccggtgagctaggcag

SEQ ID NO: 633682 - DNA, 25 bp, Mus musculus
gggcaggagctcagaacctggcatt

SEQ ID NO: 633683 - DNA, 25 bp, Mus musculus
gggcaggagctctgaacctggcatt

SEQ ID NO: 633684 - DNA, 25 bp, Mus musculus
gggcaggaggagatgcctccactat

SEQ ID NO: 633685 - DNA, 25 bp, Mus musculus
gggcaggaggagttgcctccactat

SEQ ID NO: 633686 - DNA, 25 bp, Mus musculus
gggcaggatctacacacatttatat

SEQ ID NO: 633687 - DNA, 25 bp, Mus musculus
gggcaggatctagacacatttatat

SEQ ID NO: 633688 - DNA, 25 bp, Mus musculus
gggcaggcaactacccgtcctcaag

SEQ ID NO: 633689 - DNA, 25 bp, Mus musculus
gggcaggcaacttcccgtcctcaag

SEQ ID NO: 633690 - DNA, 25 bp, Mus musculus
gggcaggcaatcaactgagttctag

SEQ ID NO: 633691 - DNA, 25 bp, Mus musculus
gggcaggcaatctactgagttctag

SEQ ID NO: 633692 - DNA, 25 bp, Mus musculus
gggcaggcaggtagctactgaacat

SEQ ID NO: 633693 - DNA, 25 bp, Mus musculus
gggcaggcaggttgctactgaacat

SEQ ID NO: 633694 - DNA, 25 bp, Mus musculus
gggcaggcatcactggttataaaaa

SEQ ID NO: 633695 - DNA, 25 bp, Mus musculus
gggcaggcatcagtggttataaaaa

SEQ ID NO: 633696 - DNA, 25 bp, Mus musculus
gggcaggccagacttgtcatccaac

SEQ ID NO: 633697 - DNA, 25 bp, Mus musculus
gggcaggccagagttgtcatccaac

SEQ ID NO: 633698 - DNA, 25 bp, Mus musculus
gggcaggccaggaactcaccatgta

SEQ ID NO: 633699 - DNA, 25 bp, Mus musculus
gggcaggccaggtactcaccatgta

SEQ ID NO: 633700 - DNA, 25 bp, Mus musculus
gggcaggccattaatatcaggcatt

SEQ ID NO: 633701 - DNA, 25 bp, Mus musculus
gggcaggccatttatatcaggcatt

SEQ ID NO: 633702 - DNA, 25 bp, Mus musculus
gggcaggccctcaagagtaaagaca

SEQ ID NO: 633703 - DNA, 25 bp, Mus musculus
gggcaggccctctagagtaaagaca

SEQ ID NO: 633704 - DNA, 25 bp, Mus musculus
gggcaggcccttagtgcagcaacag

SEQ ID NO: 633705 - DNA, 25 bp, Mus musculus
gggcaggccctttgtgcagcaacag

SEQ ID NO: 633706 - DNA, 25 bp, Mus musculus
gggcaggcctgcactatagtcccaa

SEQ ID NO: 633707 - DNA, 25 bp, Mus musculus
gggcaggcctgctctatagtcccaa

SEQ ID NO: 633708 - DNA, 25 bp, Mus musculus
gggcaggcggcacaacgccggtaaa

SEQ ID NO: 633709 - DNA, 25 bp, Mus musculus
gggcaggcggcagaacgccggtaaa

SEQ ID NO: 633710 - DNA, 25 bp, Mus musculus
gggcaggctctcaggaatctaagag

SEQ ID NO: 633711 - DNA, 25 bp, Mus musculus
gggcaggctctctggaatctaagag

SEQ ID NO: 633712 - DNA, 25 bp, Mus musculus
gggcaggctggacttatctgatttt

SEQ ID NO: 633713 - DNA, 25 bp, Mus musculus
gggcaggctggagttatctgatttt

SEQ ID NO: 633714 - DNA, 25 bp, Mus musculus
gggcagggaagtcagccaacactca

SEQ ID NO: 633715 - DNA, 25 bp, Mus musculus
gggcagggaagtgagccaacactca

SEQ ID NO: 633716 - DNA, 25 bp, Mus musculus
gggcagggaatcagttacagccact

SEQ ID NO: 633717 - DNA, 25 bp, Mus musculus
gggcagggaatctgttacagccact

SEQ ID NO: 633718 - DNA, 25 bp, Mus musculus
gggcagggaccacatagaaattatt

SEQ ID NO: 633719 - DNA, 25 bp, Mus musculus
gggcagggaccagatagaaattatt

SEQ ID NO: 633720 - DNA, 25 bp, Mus musculus
gggcagggatgcagttgtatggagc

SEQ ID NO: 633721 - DNA, 25 bp, Mus musculus
gggcagggatgcatcatgtaatcaa

SEQ ID NO: 633722 - DNA, 25 bp, Mus musculus
gggcagggatgctgttgtatggagc

SEQ ID NO: 633723 - DNA, 25 bp, Mus musculus
gggcagggatgcttcatgtaatcaa

SEQ ID NO: 633724 - DNA, 25 bp, Mus musculus
gggcagggcagtaaagcacccttaa

SEQ ID NO: 633725 - DNA, 25 bp, Mus musculus
gggcagggcagttaagcacccttaa

SEQ ID NO: 633726 - DNA, 25 bp, Mus musculus
gggcagggccgactgttccaaccaa

SEQ ID NO: 633727 - DNA, 25 bp, Mus musculus
gggcagggccgagtgttccaaccaa

SEQ ID NO: 633728 - DNA, 25 bp, Mus musculus
gggcagggcctaataagtaaatatc

SEQ ID NO: 633729 - DNA, 25 bp, Mus musculus
gggcagggcctattaagtaaatatc

SEQ ID NO: 633730 - DNA, 25 bp, Mus musculus
gggcagggcttcacacctgttgaat

SEQ ID NO: 633731 - DNA, 25 bp, Mus musculus
gggcagggcttcacagatttacaca

SEQ ID NO: 633732 - DNA, 25 bp, Mus musculus
gggcagggcttctcacctgttgaat

SEQ ID NO: 633733 - DNA, 25 bp, Mus musculus
gggcagggcttctcagatttacaca

SEQ ID NO: 633734 - DNA, 25 bp, Mus musculus
gggcagggctttctatgtcctatcc

SEQ ID NO: 633735 - DNA, 25 bp, Mus musculus
gggcagggctttgtatgtcctatcc

SEQ ID NO: 633736 - DNA, 25 bp, Mus musculus
gggcagggtgtcatggcacccatgt

SEQ ID NO: 633737 - DNA, 25 bp, Mus musculus
gggcagggtgtcttggcacccatgt

SEQ ID NO: 633738 - DNA, 25 bp, Mus musculus
gggcagggttggatattctccaaga

SEQ ID NO: 633739 - DNA, 25 bp, Mus musculus
gggcagggttggttattctccaaga

SEQ ID NO: 633740 - DNA, 25 bp, Mus musculus
gggcaggtatatctgcaaaagaata

SEQ ID NO: 633741 - DNA, 25 bp, Mus musculus
gggcaggtatatgtgcaaaagaata

SEQ ID NO: 633742 - DNA, 25 bp, Mus musculus
gggcaggtatcacattcatcaaagc

SEQ ID NO: 633743 - DNA, 25 bp, Mus musculus
gggcaggtatcagattcatcaaagc

SEQ ID NO: 633744 - DNA, 25 bp, Mus musculus
gggcaggtatccaacgacgatgtct

SEQ ID NO: 633745 - DNA, 25 bp, Mus musculus
gggcaggtatcctacgacgatgtct

SEQ ID NO: 633746 - DNA, 25 bp, Mus musculus
gggcaggtcactctactgacttaag

SEQ ID NO: 633747 - DNA, 25 bp, Mus musculus
gggcaggtcactgtactgacttaag

SEQ ID NO: 633748 - DNA, 25 bp, Mus musculus
gggcaggtccctagtttgcaaattc

SEQ ID NO: 633749 - DNA, 25 bp, Mus musculus
gggcaggtcccttgtttgcaaattc

SEQ ID NO: 633750 - DNA, 25 bp, Mus musculus
gggcaggtcctaaccaaagctggca

SEQ ID NO: 633751 - DNA, 25 bp, Mus musculus
gggcaggtcctatccaaagctggca

SEQ ID NO: 633752 - DNA, 25 bp, Mus musculus
gggcaggtgacaatggtcgtcttcc

SEQ ID NO: 633753 - DNA, 25 bp, Mus musculus
gggcaggtgacattggtcgtcttcc

SEQ ID NO: 633754 - DNA, 25 bp, Mus musculus
gggcaggtgacccaatttcttcagg

SEQ ID NO: 633755 - DNA, 25 bp, Mus musculus
gggcaggtgaccgaatttcttcagg

SEQ ID NO: 633756 - DNA, 25 bp, Mus musculus
gggcaggtgatgaccatgtaaagtt

SEQ ID NO: 633757 - DNA, 25 bp, Mus musculus
gggcaggtgatgtccatgtaaagtt

SEQ ID NO: 633758 - DNA, 25 bp, Mus musculus
gggcaggtgcataaacgtctgtaaa

SEQ ID NO: 633759 - DNA, 25 bp, Mus musculus
gggcaggtgcattaacgtctgtaaa

SEQ ID NO: 633760 - DNA, 25 bp, Mus musculus
gggcaggttactctcgatgctgacc

SEQ ID NO: 633761 - DNA, 25 bp, Mus musculus
gggcaggttactgtcgatgctgacc

SEQ ID NO: 633762 - DNA, 25 bp, Mus musculus
gggcaggttcctagacctatctcta

SEQ ID NO: 633763 - DNA, 25 bp, Mus musculus
gggcaggttccttgacctatctcta

SEQ ID NO: 633764 - DNA, 25 bp, Mus musculus
gggcaggtttgcaatgtgataatca

SEQ ID NO: 633765 - DNA, 25 bp, Mus musculus
gggcaggtttgctatgtgataatca

SEQ ID NO: 633766 - DNA, 25 bp, Mus musculus
gggcaggttttacccatatatgctt

SEQ ID NO: 633767 - DNA, 25 bp, Mus musculus
gggcaggttttagccatatatgctt

SEQ ID NO: 633768 - DNA, 25 bp, Mus musculus
gggcagtaacccacttctatataag

SEQ ID NO: 633769 - DNA, 25 bp, Mus musculus
gggcagtaaccctcttctatataag

SEQ ID NO: 633770 - DNA, 25 bp, Mus musculus
gggcagtaacctcatggtgttcccc

SEQ ID NO: 633771 - DNA, 25 bp, Mus musculus
gggcagtaacctgatggtgttcccc

SEQ ID NO: 633772 - DNA, 25 bp, Mus musculus
gggcagtaatgaatgtctgttttaa

SEQ ID NO: 633773 - DNA, 25 bp, Mus musculus
gggcagtaatgattgtctgttttaa

SEQ ID NO: 633774 - DNA, 25 bp, Mus musculus
gggcagtacaatctctgagcaggtt

SEQ ID NO: 633775 - DNA, 25 bp, Mus musculus
gggcagtacaatgtctgagcaggtt

SEQ ID NO: 633776 - DNA, 25 bp, Mus musculus
gggcagtacactataccagttcttt

SEQ ID NO: 633777 - DNA, 25 bp, Mus musculus
gggcagtacactttaccagttcttt

SEQ ID NO: 633778 - DNA, 25 bp, Mus musculus
gggcagtacagacagtagagttctt

SEQ ID NO: 633779 - DNA, 25 bp, Mus musculus
gggcagtacagagagtagagttctt

SEQ ID NO: 633780 - DNA, 25 bp, Mus musculus
gggcagtacatccagccatgaaact

SEQ ID NO: 633781 - DNA, 25 bp, Mus musculus
gggcagtacatcgagccatgaaact

SEQ ID NO: 633782 - DNA, 25 bp, Mus musculus
gggcagtacatgagatcattcacat

SEQ ID NO: 633783 - DNA, 25 bp, Mus musculus
gggcagtacatgtgatcattcacat

SEQ ID NO: 633784 - DNA, 25 bp, Mus musculus
gggcagtactctcaagcaggcaaat

SEQ ID NO: 633785 - DNA, 25 bp, Mus musculus
gggcagtactctgaagcaggcaaat

SEQ ID NO: 633786 - DNA, 25 bp, Mus musculus
gggcagtactggaatgtgcctttaa

SEQ ID NO: 633787 - DNA, 25 bp, Mus musculus
gggcagtactggtatgtgcctttaa

SEQ ID NO: 633788 - DNA, 25 bp, Mus musculus
gggcagtacttgctaagcaacaact

SEQ ID NO: 633789 - DNA, 25 bp, Mus musculus
gggcagtacttggtaagcaacaact

SEQ ID NO: 633790 - DNA, 25 bp, Mus musculus
gggcagtagggtacattctcctagt

SEQ ID NO: 633791 - DNA, 25 bp, Mus musculus
gggcagtagggttcattctcctagt

SEQ ID NO: 633792 - DNA, 25 bp, Mus musculus
gggcagtagtcaatcctgacagaat

SEQ ID NO: 633793 - DNA, 25 bp, Mus musculus
gggcagtagtcattcctgacagaat

SEQ ID NO: 633794 - DNA, 25 bp, Mus musculus
gggcagtatcagcagcaaccgtagt

SEQ ID NO: 633795 - DNA, 25 bp, Mus musculus
gggcagtatcaggagcaaccgtagt

SEQ ID NO: 633796 - DNA, 25 bp, Mus musculus
gggcagtatctacccataacatatc

SEQ ID NO: 633797 - DNA, 25 bp, Mus musculus
gggcagtatctagccataacatatc

SEQ ID NO: 633798 - DNA, 25 bp, Mus musculus
gggcagtatgatcgtatcccatgtt

SEQ ID NO: 633799 - DNA, 25 bp, Mus musculus
gggcagtatgatggtatcccatgtt

SEQ ID NO: 633800 - DNA, 25 bp, Mus musculus
gggcagtcaaggcttacacaacaat

SEQ ID NO: 633801 - DNA, 25 bp, Mus musculus
gggcagtcaagggttacacaacaat

SEQ ID NO: 633802 - DNA, 25 bp, Mus musculus
gggcagtcacaacgcgtcttatagt

SEQ ID NO: 633803 - DNA, 25 bp, Mus musculus
gggcagtcacaaggcgtcttatagt

SEQ ID NO: 633804 - DNA, 25 bp, Mus musculus
gggcagtcactcactgtaaagctaa

SEQ ID NO: 633805 - DNA, 25 bp, Mus musculus
gggcagtcactctctgtaaagctaa

SEQ ID NO: 633806 - DNA, 25 bp, Mus musculus
gggcagtcactgaacggctctgtga

SEQ ID NO: 633807 - DNA, 25 bp, Mus musculus
gggcagtcactgtacggctctgtga

SEQ ID NO: 633808 - DNA, 25 bp, Mus musculus
gggcagtcaggcaacatgcagccat

SEQ ID NO: 633809 - DNA, 25 bp, Mus musculus
gggcagtcaggctacatgcagccat

SEQ ID NO: 633810 - DNA, 25 bp, Mus musculus
gggcagtcataactgggtttcatat

SEQ ID NO: 633811 - DNA, 25 bp, Mus musculus
gggcagtcataagtgggtttcatat

SEQ ID NO: 633812 - DNA, 25 bp, Mus musculus
gggcagtcattcagatgaaattcca

SEQ ID NO: 633813 - DNA, 25 bp, Mus musculus
gggcagtcattctgatgaaattcca

SEQ ID NO: 633814 - DNA, 25 bp, Mus musculus
gggcagtccatcagggaccatccat

SEQ ID NO: 633815 - DNA, 25 bp, Mus musculus
gggcagtccatctgggaccatccat

SEQ ID NO: 633816 - DNA, 25 bp, Mus musculus
gggcagtcctcgattcttatgaaga

SEQ ID NO: 633817 - DNA, 25 bp, Mus musculus
gggcagtcctcgtttcttatgaaga

SEQ ID NO: 633818 - DNA, 25 bp, Mus musculus
gggcagtcgataatagtcaaaattc

SEQ ID NO: 633819 - DNA, 25 bp, Mus musculus
gggcagtcgatattagtcaaaattc

SEQ ID NO: 633820 - DNA, 25 bp, Mus musculus
gggcagtcggcacaatcagagcctt

SEQ ID NO: 633821 - DNA, 25 bp, Mus musculus
gggcagtcggcagaatcagagcctt

SEQ ID NO: 633822 - DNA, 25 bp, Mus musculus
gggcagtctcggctcactgaaaaga

SEQ ID NO: 633823 - DNA, 25 bp, Mus musculus
gggcagtctcgggtcactgaaaaga

SEQ ID NO: 633824 - DNA, 25 bp, Mus musculus
gggcagtctctgaatagcacatgtg

SEQ ID NO: 633825 - DNA, 25 bp, Mus musculus
gggcagtctctgtatagcacatgtg

SEQ ID NO: 633826 - DNA, 25 bp, Mus musculus
gggcagtctgtccatcagttactcc

SEQ ID NO: 633827 - DNA, 25 bp, Mus musculus
gggcagtctgtcgatcagttactcc

SEQ ID NO: 633828 - DNA, 25 bp, Mus musculus
gggcagtctgtgacttaagcgcctg

SEQ ID NO: 633829 - DNA, 25 bp, Mus musculus
gggcagtctgtgtcttaagcgcctg

SEQ ID NO: 633830 - DNA, 25 bp, Mus musculus
gggcagtgaaggacttcatccccag

SEQ ID NO: 633831 - DNA, 25 bp, Mus musculus
gggcagtgaaggtcttcatccccag

SEQ ID NO: 633832 - DNA, 25 bp, Mus musculus
gggcagtgacaaagactcggacagc

SEQ ID NO: 633833 - DNA, 25 bp, Mus musculus
gggcagtgacaatgactcggacagc

SEQ ID NO: 633834 - DNA, 25 bp, Mus musculus
gggcagtgacccaaaagacctggaa

SEQ ID NO: 633835 - DNA, 25 bp, Mus musculus
gggcagtgaccctaaagacctggaa

SEQ ID NO: 633836 - DNA, 25 bp, Mus musculus
gggcagtgacctcagctagccagat

SEQ ID NO: 633837 - DNA, 25 bp, Mus musculus
gggcagtgacctgagctagccagat

SEQ ID NO: 633838 - DNA, 25 bp, Mus musculus
gggcagtgacttaccataaattgat

SEQ ID NO: 633839 - DNA, 25 bp, Mus musculus
gggcagtgacttccaagttcccagc

SEQ ID NO: 633840 - DNA, 25 bp, Mus musculus
gggcagtgacttgcaagttcccagc

SEQ ID NO: 633841 - DNA, 25 bp, Mus musculus
gggcagtgactttccataaattgat

SEQ ID NO: 633842 - DNA, 25 bp, Mus musculus
gggcagtgagctccaaacagtcaca

SEQ ID NO: 633843 - DNA, 25 bp, Mus musculus
gggcagtgagctgcaaacagtcaca

SEQ ID NO: 633844 - DNA, 25 bp, Mus musculus
gggcagtgatggcacccacttttaa

SEQ ID NO: 633845 - DNA, 25 bp, Mus musculus
gggcagtgatgggacccacttttaa

SEQ ID NO: 633846 - DNA, 25 bp, Mus musculus
gggcagtgattcagttcaataacca

SEQ ID NO: 633847 - DNA, 25 bp, Mus musculus
gggcagtgattctgttcaataacca

SEQ ID NO: 633848 - DNA, 25 bp, Mus musculus
gggcagtgatttattctctgtgatg

SEQ ID NO: 633849 - DNA, 25 bp, Mus musculus
gggcagtgattttttctctgtgatg

SEQ ID NO: 633850 - DNA, 25 bp, Mus musculus
gggcagtgcatgacctaagactcca

SEQ ID NO: 633851 - DNA, 25 bp, Mus musculus
gggcagtgcatgtcctaagactcca

SEQ ID NO: 633852 - DNA, 25 bp, Mus musculus
gggcagtgccagataggatttcatt

SEQ ID NO: 633853 - DNA, 25 bp, Mus musculus
gggcagtgccagttaggatttcatt

SEQ ID NO: 633854 - DNA, 25 bp, Mus musculus
gggcagtgcctaaactgctgtatac

SEQ ID NO: 633855 - DNA, 25 bp, Mus musculus
gggcagtgcctacgcctggcggtga

SEQ ID NO: 633856 - DNA, 25 bp, Mus musculus
gggcagtgcctaggcctggcggtga

SEQ ID NO: 633857 - DNA, 25 bp, Mus musculus
gggcagtgcctatactgctgtatac

SEQ ID NO: 633858 - DNA, 25 bp, Mus musculus
gggcagtgctcaacacagatcagtc

SEQ ID NO: 633859 - DNA, 25 bp, Mus musculus
gggcagtgctcatcacagatcagtc

SEQ ID NO: 633860 - DNA, 25 bp, Mus musculus
gggcagtgcttccaaaactggactg

SEQ ID NO: 633861 - DNA, 25 bp, Mus musculus
gggcagtgcttcgaaaactggactg

SEQ ID NO: 633862 - DNA, 25 bp, Mus musculus
gggcagtggaatatgaacccaaaca

SEQ ID NO: 633863 - DNA, 25 bp, Mus musculus
gggcagtggaatttgaacccaaaca

SEQ ID NO: 633864 - DNA, 25 bp, Mus musculus
gggcagtggctacacaattagaaca

SEQ ID NO: 633865 - DNA, 25 bp, Mus musculus
gggcagtggctagacaattagaaca

SEQ ID NO: 633866 - DNA, 25 bp, Mus musculus
gggcagtggttcatcagccaagctg

SEQ ID NO: 633867 - DNA, 25 bp, Mus musculus
gggcagtggttcttcagccaagctg

SEQ ID NO: 633868 - DNA, 25 bp, Mus musculus
gggcagtgtaacaatttccatactt

SEQ ID NO: 633869 - DNA, 25 bp, Mus musculus
gggcagtgtaactatttccatactt

SEQ ID NO: 633870 - DNA, 25 bp, Mus musculus
gggcagtgtatgaaagtcgtgtttt

SEQ ID NO: 633871 - DNA, 25 bp, Mus musculus
gggcagtgtatgtaagtcgtgtttt

SEQ ID NO: 633872 - DNA, 25 bp, Mus musculus
gggcagtgtgtcaagctccaaatta

SEQ ID NO: 633873 - DNA, 25 bp, Mus musculus
gggcagtgtgtctagctccaaatta

SEQ ID NO: 633874 - DNA, 25 bp, Mus musculus
gggcagtgtgtgacagagtcggctt

SEQ ID NO: 633875 - DNA, 25 bp, Mus musculus
gggcagtgtgtgtcagagtcggctt

SEQ ID NO: 633876 - DNA, 25 bp, Mus musculus
gggcagtgttctagctgcttttgct

SEQ ID NO: 633877 - DNA, 25 bp, Mus musculus
gggcagtgttcttgctgcttttgct

SEQ ID NO: 633878 - DNA, 25 bp, Mus musculus
gggcagtgttgaccatggaattctt

SEQ ID NO: 633879 - DNA, 25 bp, Mus musculus
gggcagtgttgagcatggaattctt

SEQ ID NO: 633880 - DNA, 25 bp, Mus musculus
gggcagtgttgcagttaccaaggat

SEQ ID NO: 633881 - DNA, 25 bp, Mus musculus
gggcagtgttgctgttaccaaggat

SEQ ID NO: 633882 - DNA, 25 bp, Mus musculus
gggcagtgtttcaaaaggtttctca

SEQ ID NO: 633883 - DNA, 25 bp, Mus musculus
gggcagtgtttctaaaggtttctca

SEQ ID NO: 633884 - DNA, 25 bp, Mus musculus
gggcagttacatactcaagttttta

SEQ ID NO: 633885 - DNA, 25 bp, Mus musculus
gggcagttacatagtgtccattgtt

SEQ ID NO: 633886 - DNA, 25 bp, Mus musculus
gggcagttacattctcaagttttta

SEQ ID NO: 633887 - DNA, 25 bp, Mus musculus
gggcagttacattgtgtccattgtt

SEQ ID NO: 633888 - DNA, 25 bp, Mus musculus
gggcagttatctacagtactattca

SEQ ID NO: 633889 - DNA, 25 bp, Mus musculus
gggcagttatcttcagtactattca

SEQ ID NO: 633890 - DNA, 25 bp, Mus musculus
gggcagttatgtcaccggcatcacc

SEQ ID NO: 633891 - DNA, 25 bp, Mus musculus
gggcagttatgtgaccggcatcacc

SEQ ID NO: 633892 - DNA, 25 bp, Mus musculus
gggcagttcacaccacactgtggtg

SEQ ID NO: 633893 - DNA, 25 bp, Mus musculus
gggcagttcacactagtagagtcaa

SEQ ID NO: 633894 - DNA, 25 bp, Mus musculus
gggcagttcacagcacactgtggtg

SEQ ID NO: 633895 - DNA, 25 bp, Mus musculus
gggcagttcacagtagtagagtcaa

SEQ ID NO: 633896 - DNA, 25 bp, Mus musculus
gggcagttcagtacttcatctttaa

SEQ ID NO: 633897 - DNA, 25 bp, Mus musculus
gggcagttcagttcttcatctttaa

SEQ ID NO: 633898 - DNA, 25 bp, Mus musculus
gggcagttccagagtgtccatgtag

SEQ ID NO: 633899 - DNA, 25 bp, Mus musculus
gggcagttccagtgtgtccatgtag

SEQ ID NO: 633900 - DNA, 25 bp, Mus musculus
gggcagttcgtaaacagcacttgtt

SEQ ID NO: 633901 - DNA, 25 bp, Mus musculus
gggcagttcgtatacagcacttgtt

SEQ ID NO: 633902 - DNA, 25 bp, Mus musculus
gggcagttctcaaattcacagtcat

SEQ ID NO: 633903 - DNA, 25 bp, Mus musculus
gggcagttctcatattcacagtcat

SEQ ID NO: 633904 - DNA, 25 bp, Mus musculus
gggcagttctttacttgaagttcct

SEQ ID NO: 633905 - DNA, 25 bp, Mus musculus
gggcagttcttttcttgaagttcct

SEQ ID NO: 633906 - DNA, 25 bp, Mus musculus
gggcagttgcatatagccagctgat

SEQ ID NO: 633907 - DNA, 25 bp, Mus musculus
gggcagttgcatttagccagctgat

SEQ ID NO: 633908 - DNA, 25 bp, Mus musculus
gggcagttgctgatgttgaatccaa

SEQ ID NO: 633909 - DNA, 25 bp, Mus musculus
gggcagttgctgttgttgaatccaa

SEQ ID NO: 633910 - DNA, 25 bp, Mus musculus
gggcagttgtctaaggtcaccaaag

SEQ ID NO: 633911 - DNA, 25 bp, Mus musculus
gggcagttgtctcctcttgttgaca

SEQ ID NO: 633912 - DNA, 25 bp, Mus musculus
gggcagttgtctgctcttgttgaca

SEQ ID NO: 633913 - DNA, 25 bp, Mus musculus
gggcagttgtcttaggtcaccaaag

SEQ ID NO: 633914 - DNA, 25 bp, Mus musculus
gggcagttgtgactgtccatcttcc

SEQ ID NO: 633915 - DNA, 25 bp, Mus musculus
gggcagttgtgagtgtccatcttcc

SEQ ID NO: 633916 - DNA, 25 bp, Mus musculus
gggcagtttaaacctgatcccctct

SEQ ID NO: 633917 - DNA, 25 bp, Mus musculus
gggcagtttaaagctgatcccctct

SEQ ID NO: 633918 - DNA, 25 bp, Mus musculus
gggcagtttccacgatgttaatcga

SEQ ID NO: 633919 - DNA, 25 bp, Mus musculus
gggcagtttccaggatgttaatcga

SEQ ID NO: 633920 - DNA, 25 bp, Mus musculus
gggcagtttcttctttttaccaatg

SEQ ID NO: 633921 - DNA, 25 bp, Mus musculus
gggcagtttcttgtttttaccaatg

SEQ ID NO: 633922 - DNA, 25 bp, Mus musculus
gggcagtttgtaccctgagcttagc

SEQ ID NO: 633923 - DNA, 25 bp, Mus musculus
gggcagtttgtagcctgagcttagc

SEQ ID NO: 633924 - DNA, 25 bp, Mus musculus
gggcagttttacatggccagaaagc

SEQ ID NO: 633925 - DNA, 25 bp, Mus musculus
gggcagttttacttggccagaaagc

SEQ ID NO: 633926 - DNA, 25 bp, Mus musculus
gggcagttttgacttaaagctccaa

SEQ ID NO: 633927 - DNA, 25 bp, Mus musculus
gggcagttttgagttaaagctccaa

SEQ ID NO: 633928 - DNA, 25 bp, Mus musculus
gggcagttttgcaaagcctatgtct

SEQ ID NO: 633929 - DNA, 25 bp, Mus musculus
gggcagttttgctaagcctatgtct

SEQ ID NO: 633930 - DNA, 25 bp, Mus musculus
gggcagtttttcctgtccttacaat

SEQ ID NO: 633931 - DNA, 25 bp, Mus musculus
gggcagtttttcgtgtccttacaat

SEQ ID NO: 633932 - DNA, 25 bp, Mus musculus
gggcataaaagaaccaacagggttt

SEQ ID NO: 633933 - DNA, 25 bp, Mus musculus
gggcataaaagatccaacagggttt

SEQ ID NO: 633934 - DNA, 25 bp, Mus musculus
gggcataaaattcggtcttgatata

SEQ ID NO: 633935 - DNA, 25 bp, Mus musculus
gggcataaaattgggtcttgatata

SEQ ID NO: 633936 - DNA, 25 bp, Mus musculus
gggcataaacaaatggcaactggga

SEQ ID NO: 633937 - DNA, 25 bp, Mus musculus
gggcataaacaattggcaactggga

SEQ ID NO: 633938 - DNA, 25 bp, Mus musculus
gggcataacggtctgagcctctcat

SEQ ID NO: 633939 - DNA, 25 bp, Mus musculus
gggcataacggtgtgagcctctcat

SEQ ID NO: 633940 - DNA, 25 bp, Mus musculus
gggcataactaaccccgaaggcaag

SEQ ID NO: 633941 - DNA, 25 bp, Mus musculus
gggcataactaagcccgaaggcaag

SEQ ID NO: 633942 - DNA, 25 bp, Mus musculus
gggcataacttcagcttttacttta

SEQ ID NO: 633943 - DNA, 25 bp, Mus musculus
gggcataacttctgcttttacttta

SEQ ID NO: 633944 - DNA, 25 bp, Mus musculus
gggcataagactccagttctgcctt

SEQ ID NO: 633945 - DNA, 25 bp, Mus musculus
gggcataagactgcagttctgcctt

SEQ ID NO: 633946 - DNA, 25 bp, Mus musculus
gggcataagcctcattactacttga

SEQ ID NO: 633947 - DNA, 25 bp, Mus musculus
gggcataagcctgattactacttga

SEQ ID NO: 633948 - DNA, 25 bp, Mus musculus
gggcataattgaactttagggcttt

SEQ ID NO: 633949 - DNA, 25 bp, Mus musculus
gggcataattgatctttagggcttt

SEQ ID NO: 633950 - DNA, 25 bp, Mus musculus
gggcatacagtgaactgcactcgaa

SEQ ID NO: 633951 - DNA, 25 bp, Mus musculus
gggcatacagtgtactgcactcgaa

SEQ ID NO: 633952 - DNA, 25 bp, Mus musculus
gggcatacatacaacgtcactcaac

SEQ ID NO: 633953 - DNA, 25 bp, Mus musculus
gggcatacatactacgtcactcaac

SEQ ID NO: 633954 - DNA, 25 bp, Mus musculus
gggcatacatccaggccatgttaac

SEQ ID NO: 633955 - DNA, 25 bp, Mus musculus
gggcatacatcctggccatgttaac

SEQ ID NO: 633956 - DNA, 25 bp, Mus musculus
gggcatacattcagtccaagatagt

SEQ ID NO: 633957 - DNA, 25 bp, Mus musculus
gggcatacattctgtccaagatagt

SEQ ID NO: 633958 - DNA, 25 bp, Mus musculus
gggcatacccaaccatggacagtgt

SEQ ID NO: 633959 - DNA, 25 bp, Mus musculus
gggcatacccaagcatggacagtgt

SEQ ID NO: 633960 - DNA, 25 bp, Mus musculus
gggcatacctctcaaaacctgatca

SEQ ID NO: 633961 - DNA, 25 bp, Mus musculus
gggcatacctctgaaaacctgatca

SEQ ID NO: 633962 - DNA, 25 bp, Mus musculus
gggcataccttgaggcagctcctgc

SEQ ID NO: 633963 - DNA, 25 bp, Mus musculus
gggcataccttgtggcagctcctgc

SEQ ID NO: 633964 - DNA, 25 bp, Mus musculus
gggcatacgatgctaattagggcta

SEQ ID NO: 633965 - DNA, 25 bp, Mus musculus
gggcatacgatggtaattagggcta

SEQ ID NO: 633966 - DNA, 25 bp, Mus musculus
gggcatacgctgagtttcaaacatt

SEQ ID NO: 633967 - DNA, 25 bp, Mus musculus
gggcatacgctgtgtttcaaacatt

SEQ ID NO: 633968 - DNA, 25 bp, Mus musculus
gggcatacgtggagctttctggact

SEQ ID NO: 633969 - DNA, 25 bp, Mus musculus
gggcatacgtggtgctttctggact

SEQ ID NO: 633970 - DNA, 25 bp, Mus musculus
gggcatagacccaaaaagcctcatg

SEQ ID NO: 633971 - DNA, 25 bp, Mus musculus
gggcatagaccctaaaagcctcatg

SEQ ID NO: 633972 - DNA, 25 bp, Mus musculus
gggcatagatgtacctgtccagcgt

SEQ ID NO: 633973 - DNA, 25 bp, Mus musculus
gggcatagatgttcctgtccagcgt

SEQ ID NO: 633974 - DNA, 25 bp, Mus musculus
gggcatagcaaccacctttttagat

SEQ ID NO: 633975 - DNA, 25 bp, Mus musculus
gggcatagcaacgacctttttagat

SEQ ID NO: 633976 - DNA, 25 bp, Mus musculus
gggcatagcaagctcatttttctca

SEQ ID NO: 633977 - DNA, 25 bp, Mus musculus
gggcatagcaaggtcatttttctca

SEQ ID NO: 633978 - DNA, 25 bp, Mus musculus
gggcatagcagcactgccatgctta

SEQ ID NO: 633979 - DNA, 25 bp, Mus musculus
gggcatagcagctctgccatgctta

SEQ ID NO: 633980 - DNA, 25 bp, Mus musculus
gggcatagccatagagcacatcctc

SEQ ID NO: 633981 - DNA, 25 bp, Mus musculus
gggcatagccattgagcacatcctc

SEQ ID NO: 633982 - DNA, 25 bp, Mus musculus
gggcatagcccaacactgaaagtat

SEQ ID NO: 633983 - DNA, 25 bp, Mus musculus
gggcatagcccatcactgaaagtat

SEQ ID NO: 633984 - DNA, 25 bp, Mus musculus
gggcatagcctcagatatacctaag

SEQ ID NO: 633985 - DNA, 25 bp, Mus musculus
gggcatagcctctgatatacctaag

SEQ ID NO: 633986 - DNA, 25 bp, Mus musculus
gggcatagtaagattcggcaagaat

SEQ ID NO: 633987 - DNA, 25 bp, Mus musculus
gggcatagtaagtttcggcaagaat

SEQ ID NO: 633988 - DNA, 25 bp, Mus musculus
gggcatagtcatctgaatggtttaa

SEQ ID NO: 633989 - DNA, 25 bp, Mus musculus
gggcatagtcatgtgaatggtttaa

SEQ ID NO: 633990 - DNA, 25 bp, Mus musculus
gggcatagtgacatctagaaaccta

SEQ ID NO: 633991 - DNA, 25 bp, Mus musculus
gggcatagtgacttctagaaaccta

SEQ ID NO: 633992 - DNA, 25 bp, Mus musculus
gggcatagtgtaattcttgagaaac

SEQ ID NO: 633993 - DNA, 25 bp, Mus musculus
gggcatagtgtatttcttgagaaac

SEQ ID NO: 633994 - DNA, 25 bp, Mus musculus
gggcatagttggctgttcattctga

SEQ ID NO: 633995 - DNA, 25 bp, Mus musculus
gggcatagttgggtgttcattctga

SEQ ID NO: 633996 - DNA, 25 bp, Mus musculus
gggcatagttttcctggctactcct

SEQ ID NO: 633997 - DNA, 25 bp, Mus musculus
gggcatagttttgctggctactcct

SEQ ID NO: 633998 - DNA, 25 bp, Mus musculus
gggcatatacatacattcaggtaaa

SEQ ID NO: 633999 - DNA, 25 bp, Mus musculus
gggcatatacattcattcaggtaaa

SEQ ID NO: 634000 - DNA, 25 bp, Mus musculus
gggcatatacctcctggttgatgga

SEQ ID NO: 634001 - DNA, 25 bp, Mus musculus
gggcatatacctgctggttgatgga

SEQ ID NO: 634002 - DNA, 25 bp, Mus musculus
gggcatatgagtaagctccagtgca

SEQ ID NO: 634003 - DNA, 25 bp, Mus musculus
gggcatatgagtatactttgtacaa

SEQ ID NO: 634004 - DNA, 25 bp, Mus musculus
gggcatatgagttagctccagtgca

SEQ ID NO: 634005 - DNA, 25 bp, Mus musculus
gggcatatgagtttactttgtacaa

SEQ ID NO: 634006 - DNA, 25 bp, Mus musculus
gggcatatgcatatcccgctcccgc

SEQ ID NO: 634007 - DNA, 25 bp, Mus musculus
gggcatatgcatctattgccacata

SEQ ID NO: 634008 - DNA, 25 bp, Mus musculus
gggcatatgcatgtattgccacata

SEQ ID NO: 634009 - DNA, 25 bp, Mus musculus
gggcatatgcatttcccgctcccgc

SEQ ID NO: 634010 - DNA, 25 bp, Mus musculus
gggcatatgttcaactgcattcagc

SEQ ID NO: 634011 - DNA, 25 bp, Mus musculus
gggcatatgttctactgcattcagc

SEQ ID NO: 634012 - DNA, 25 bp, Mus musculus
gggcatattaggaacttctcagaat

SEQ ID NO: 634013 - DNA, 25 bp, Mus musculus
gggcatattaggtacttctcagaat

SEQ ID NO: 634014 - DNA, 25 bp, Mus musculus
gggcatattcttacaggattacagg

SEQ ID NO: 634015 - DNA, 25 bp, Mus musculus
gggcatattctttcaggattacagg

SEQ ID NO: 634016 - DNA, 25 bp, Mus musculus
gggcatatttggcagctactgattt

SEQ ID NO: 634017 - DNA, 25 bp, Mus musculus
gggcatatttgggagctactgattt

SEQ ID NO: 634018 - DNA, 25 bp, Mus musculus
gggcatcaaacacacctttggctat

SEQ ID NO: 634019 - DNA, 25 bp, Mus musculus
gggcatcaaacagacctttggctat

SEQ ID NO: 634020 - DNA, 25 bp, Mus musculus
gggcatcaaaccctttggagctggt

SEQ ID NO: 634021 - DNA, 25 bp, Mus musculus
gggcatcaaaccgtttggagctggt

SEQ ID NO: 634022 - DNA, 25 bp, Mus musculus
gggcatcaacagcactactacagtg

SEQ ID NO: 634023 - DNA, 25 bp, Mus musculus
gggcatcaacaggactactacagtg

SEQ ID NO: 634024 - DNA, 25 bp, Mus musculus
gggcatcaacccaacaggaggcaag

SEQ ID NO: 634025 - DNA, 25 bp, Mus musculus
gggcatcaaccctacaggaggcaag

SEQ ID NO: 634026 - DNA, 25 bp, Mus musculus
gggcatcaactcacctgaacataaa

SEQ ID NO: 634027 - DNA, 25 bp, Mus musculus
gggcatcaactctcctgaacataaa

SEQ ID NO: 634028 - DNA, 25 bp, Mus musculus
gggcatcaagcaagcacatggtgta

SEQ ID NO: 634029 - DNA, 25 bp, Mus musculus
gggcatcaagcatgcacatggtgta

SEQ ID NO: 634030 - DNA, 25 bp, Mus musculus
gggcatcacaagaacttccaggctt

SEQ ID NO: 634031 - DNA, 25 bp, Mus musculus
gggcatcacaagtacttccaggctt

SEQ ID NO: 634032 - DNA, 25 bp, Mus musculus
gggcatcacatgcataacgttacat

SEQ ID NO: 634033 - DNA, 25 bp, Mus musculus
gggcatcacatggataacgttacat

SEQ ID NO: 634034 - DNA, 25 bp, Mus musculus
gggcatcacgaaccacagctgattt

SEQ ID NO: 634035 - DNA, 25 bp, Mus musculus
gggcatcacgaagcacagctgattt

SEQ ID NO: 634036 - DNA, 25 bp, Mus musculus
gggcatcactctatgggcaaagtgt

SEQ ID NO: 634037 - DNA, 25 bp, Mus musculus
gggcatcactctttgggcaaagtgt

SEQ ID NO: 634038 - DNA, 25 bp, Mus musculus
gggcatcagacaagtggaccacttt

SEQ ID NO: 634039 - DNA, 25 bp, Mus musculus
gggcatcagacatgtggaccacttt

SEQ ID NO: 634040 - DNA, 25 bp, Mus musculus
gggcatcagagacaccaattacctt

SEQ ID NO: 634041 - DNA, 25 bp, Mus musculus
gggcatcagagagaccaattacctt

SEQ ID NO: 634042 - DNA, 25 bp, Mus musculus
gggcatcagagtccactaggctgtt

SEQ ID NO: 634043 - DNA, 25 bp, Mus musculus
gggcatcagagtgcactaggctgtt

SEQ ID NO: 634044 - DNA, 25 bp, Mus musculus
gggcatcagcgaccacacagcagga

SEQ ID NO: 634045 - DNA, 25 bp, Mus musculus
gggcatcagcgagcacacagcagga

SEQ ID NO: 634046 - DNA, 25 bp, Mus musculus
gggcatcagggtcaccgtaacccag

SEQ ID NO: 634047 - DNA, 25 bp, Mus musculus
gggcatcagggtctgtccccaagac

SEQ ID NO: 634048 - DNA, 25 bp, Mus musculus
gggcatcagggtgaccgtaacccag

SEQ ID NO: 634049 - DNA, 25 bp, Mus musculus
gggcatcagggtgtgtccccaagac

SEQ ID NO: 634050 - DNA, 25 bp, Mus musculus
gggcatcataggatgttactatgtt

SEQ ID NO: 634051 - DNA, 25 bp, Mus musculus
gggcatcataggttgttactatgtt

SEQ ID NO: 634052 - DNA, 25 bp, Mus musculus
gggcatcatcacaccgagctctagc

SEQ ID NO: 634053 - DNA, 25 bp, Mus musculus
gggcatcatcactccgagctctagc

SEQ ID NO: 634054 - DNA, 25 bp, Mus musculus
gggcatcatgataattgttttctat

SEQ ID NO: 634055 - DNA, 25 bp, Mus musculus
gggcatcatgattattgttttctat

SEQ ID NO: 634056 - DNA, 25 bp, Mus musculus
gggcatcatgctcagttacatccga

SEQ ID NO: 634057 - DNA, 25 bp, Mus musculus
gggcatcatgctgagttacatccga

SEQ ID NO: 634058 - DNA, 25 bp, Mus musculus
gggcatcattcgaaaacccgacatc

SEQ ID NO: 634059 - DNA, 25 bp, Mus musculus
gggcatcattcgtaaacccgacatc

SEQ ID NO: 634060 - DNA, 25 bp, Mus musculus
gggcatccaaacaacacatgttctc

SEQ ID NO: 634061 - DNA, 25 bp, Mus musculus
gggcatccaaactacacatgttctc

SEQ ID NO: 634062 - DNA, 25 bp, Mus musculus
gggcatccacacagaggcttctgca

SEQ ID NO: 634063 - DNA, 25 bp, Mus musculus
gggcatccacactgaggcttctgca

SEQ ID NO: 634064 - DNA, 25 bp, Mus musculus
gggcatccactgctactcgcagctg

SEQ ID NO: 634065 - DNA, 25 bp, Mus musculus
gggcatccactggtactcgcagctg

SEQ ID NO: 634066 - DNA, 25 bp, Mus musculus
gggcatccagaacatcggcggcatc

SEQ ID NO: 634067 - DNA, 25 bp, Mus musculus
gggcatccagaagatcggcggcatc

SEQ ID NO: 634068 - DNA, 25 bp, Mus musculus
gggcatccagacagactgcgaggaa

SEQ ID NO: 634069 - DNA, 25 bp, Mus musculus
gggcatccagactgactgcgaggaa

SEQ ID NO: 634070 - DNA, 25 bp, Mus musculus
gggcatccattaacaccatcaaggg

SEQ ID NO: 634071 - DNA, 25 bp, Mus musculus
gggcatccattatcaccatcaaggg

SEQ ID NO: 634072 - DNA, 25 bp, Mus musculus
gggcatccattgctcgtattatcaa

SEQ ID NO: 634073 - DNA, 25 bp, Mus musculus
gggcatccattggtcgtattatcaa

SEQ ID NO: 634074 - DNA, 25 bp, Mus musculus
gggcatcccaagcacaggtagacct

SEQ ID NO: 634075 - DNA, 25 bp, Mus musculus
gggcatcccaaggacaggtagacct

SEQ ID NO: 634076 - DNA, 25 bp, Mus musculus
gggcatcccacgatatacccggaag

SEQ ID NO: 634077 - DNA, 25 bp, Mus musculus
gggcatcccacgttatacccggaag

SEQ ID NO: 634078 - DNA, 25 bp, Mus musculus
gggcatcctcataaaagggtccttg

SEQ ID NO: 634079 - DNA, 25 bp, Mus musculus
gggcatcctcattaaagggtccttg

SEQ ID NO: 634080 - DNA, 25 bp, Mus musculus
gggcatcctcgcaaagcaagaaacc

SEQ ID NO: 634081 - DNA, 25 bp, Mus musculus
gggcatcctcgctaagcaagaaacc

SEQ ID NO: 634082 - DNA, 25 bp, Mus musculus
gggcatcctggaattagaaaacgga

SEQ ID NO: 634083 - DNA, 25 bp, Mus musculus
gggcatcctggatttagaaaacgga

SEQ ID NO: 634084 - DNA, 25 bp, Mus musculus
gggcatcctgtcaacatcgtccagg

SEQ ID NO: 634085 - DNA, 25 bp, Mus musculus
gggcatcctgtctacatcgtccagg

SEQ ID NO: 634086 - DNA, 25 bp, Mus musculus
gggcatccttataatctctatattt

SEQ ID NO: 634087 - DNA, 25 bp, Mus musculus
gggcatccttattatctctatattt

SEQ ID NO: 634088 - DNA, 25 bp, Mus musculus
gggcatccttggcacaactggacag

SEQ ID NO: 634089 - DNA, 25 bp, Mus musculus
gggcatccttgggacaactggacag

SEQ ID NO: 634090 - DNA, 25 bp, Mus musculus
gggcatcgactccaaacactggaac

SEQ ID NO: 634091 - DNA, 25 bp, Mus musculus
gggcatcgactcgaaacactggaac

SEQ ID NO: 634092 - DNA, 25 bp, Mus musculus
gggcatcgcacaaactgggcaagct

SEQ ID NO: 634093 - DNA, 25 bp, Mus musculus
gggcatcgcacatactgggcaagct

SEQ ID NO: 634094 - DNA, 25 bp, Mus musculus
gggcatcgctgtcaatgagacacct

SEQ ID NO: 634095 - DNA, 25 bp, Mus musculus
gggcatcgctgtgaatgagacacct

SEQ ID NO: 634096 - DNA, 25 bp, Mus musculus
gggcatctacagacagaaggtatct

SEQ ID NO: 634097 - DNA, 25 bp, Mus musculus
gggcatctacagtcagaaggtatct

SEQ ID NO: 634098 - DNA, 25 bp, Mus musculus
gggcatctactacattcagcttgaa

SEQ ID NO: 634099 - DNA, 25 bp, Mus musculus
gggcatctactagattcagcttgaa

SEQ ID NO: 634100 - DNA, 25 bp, Mus musculus
gggcatctactgaggcatgaagacc

SEQ ID NO: 634101 - DNA, 25 bp, Mus musculus
gggcatctactgtggcatgaagacc

SEQ ID NO: 634102 - DNA, 25 bp, Mus musculus
gggcatctaggtaccttggttaatg

SEQ ID NO: 634103 - DNA, 25 bp, Mus musculus
gggcatctaggttccttggttaatg

SEQ ID NO: 634104 - DNA, 25 bp, Mus musculus
gggcatctatatagcatgttcaggt

SEQ ID NO: 634105 - DNA, 25 bp, Mus musculus
gggcatctatattgcatgttcaggt

SEQ ID NO: 634106 - DNA, 25 bp, Mus musculus
gggcatctattactgctggctgcaa

SEQ ID NO: 634107 - DNA, 25 bp, Mus musculus
gggcatctattagtgctggctgcaa

SEQ ID NO: 634108 - DNA, 25 bp, Mus musculus
gggcatctcaatcgcacctttgaat

SEQ ID NO: 634109 - DNA, 25 bp, Mus musculus
gggcatctcaatggcacctttgaat

SEQ ID NO: 634110 - DNA, 25 bp, Mus musculus
gggcatctcatgaataagcaaagct

SEQ ID NO: 634111 - DNA, 25 bp, Mus musculus
gggcatctcatgcttttctgtgaca

SEQ ID NO: 634112 - DNA, 25 bp, Mus musculus
gggcatctcatggttttctgtgaca

SEQ ID NO: 634113 - DNA, 25 bp, Mus musculus
gggcatctcatgtataagcaaagct

SEQ ID NO: 634114 - DNA, 25 bp, Mus musculus
gggcatctccagagggcctaacaag

SEQ ID NO: 634115 - DNA, 25 bp, Mus musculus
gggcatctccagtgggcctaacaag

SEQ ID NO: 634116 - DNA, 25 bp, Mus musculus
gggcatctccctcaactaataccta

SEQ ID NO: 634117 - DNA, 25 bp, Mus musculus
gggcatctccctgaactaataccta

SEQ ID NO: 634118 - DNA, 25 bp, Mus musculus
gggcatctctcaaagtcatgcagtt

SEQ ID NO: 634119 - DNA, 25 bp, Mus musculus
gggcatctctcatagtcatgcagtt

SEQ ID NO: 634120 - DNA, 25 bp, Mus musculus
gggcatctgacaaccaagtccttat

SEQ ID NO: 634121 - DNA, 25 bp, Mus musculus
gggcatctgacatccaagtccttat

SEQ ID NO: 634122 - DNA, 25 bp, Mus musculus
gggcatctgaggctgttgatcctaa

SEQ ID NO: 634123 - DNA, 25 bp, Mus musculus
gggcatctgagggtgttgatcctaa

SEQ ID NO: 634124 - DNA, 25 bp, Mus musculus
gggcatctgattcccaggaactagt

SEQ ID NO: 634125 - DNA, 25 bp, Mus musculus
gggcatctgattgccaggaactagt

SEQ ID NO: 634126 - DNA, 25 bp, Mus musculus
gggcatctgcctcaactaataccta

SEQ ID NO: 634127 - DNA, 25 bp, Mus musculus
gggcatctgcctgaactaataccta

SEQ ID NO: 634128 - DNA, 25 bp, Mus musculus
gggcatctgcggctctgatttagac

SEQ ID NO: 634129 - DNA, 25 bp, Mus musculus
gggcatctgcgggtctgatttagac

SEQ ID NO: 634130 - DNA, 25 bp, Mus musculus
gggcatctgggaacgtggcctatca

SEQ ID NO: 634131 - DNA, 25 bp, Mus musculus
gggcatctgggatcgtggcctatca

SEQ ID NO: 634132 - DNA, 25 bp, Mus musculus
gggcatctgtcaacagttctgggaa

SEQ ID NO: 634133 - DNA, 25 bp, Mus musculus
gggcatctgtcatcagttctgggaa

SEQ ID NO: 634134 - DNA, 25 bp, Mus musculus
gggcatctgtgccacatttgtaatc

SEQ ID NO: 634135 - DNA, 25 bp, Mus musculus
gggcatctgtgcgacatttgtaatc

SEQ ID NO: 634136 - DNA, 25 bp, Mus musculus
gggcatctgtgtaactgttactgta

SEQ ID NO: 634137 - DNA, 25 bp, Mus musculus
gggcatctgtgttactgttactgta

SEQ ID NO: 634138 - DNA, 25 bp, Mus musculus
gggcatctgtttagatggcatgcat

SEQ ID NO: 634139 - DNA, 25 bp, Mus musculus
gggcatctgttttgatggcatgcat

SEQ ID NO: 634140 - DNA, 25 bp, Mus musculus
gggcatcttaaaccagctccatgtt

SEQ ID NO: 634141 - DNA, 25 bp, Mus musculus
gggcatcttaaagcagctccatgtt

SEQ ID NO: 634142 - DNA, 25 bp, Mus musculus
gggcatcttagacctgccagtttga

SEQ ID NO: 634143 - DNA, 25 bp, Mus musculus
gggcatcttagagctgccagtttga

SEQ ID NO: 634144 - DNA, 25 bp, Mus musculus
gggcatcttgaacatcctgtgagct

SEQ ID NO: 634145 - DNA, 25 bp, Mus musculus
gggcatcttgaagatcctgtgagct

SEQ ID NO: 634146 - DNA, 25 bp, Mus musculus
gggcatcttgctaggaggtccacgt

SEQ ID NO: 634147 - DNA, 25 bp, Mus musculus
gggcatcttgcttggaggtccacgt

SEQ ID NO: 634148 - DNA, 25 bp, Mus musculus
gggcatcttgggagccatgtcaccg

SEQ ID NO: 634149 - DNA, 25 bp, Mus musculus
gggcatcttgggtgccatgtcaccg

SEQ ID NO: 634150 - DNA, 25 bp, Mus musculus
gggcatctttacagttgcatgtgta

SEQ ID NO: 634151 - DNA, 25 bp, Mus musculus
gggcatctttactgttgcatgtgta

SEQ ID NO: 634152 - DNA, 25 bp, Mus musculus
gggcatctttagagtgtatagacca

SEQ ID NO: 634153 - DNA, 25 bp, Mus musculus
gggcatctttagtgtgtatagacca

SEQ ID NO: 634154 - DNA, 25 bp, Mus musculus
gggcatctttgaaaattcacctctt

SEQ ID NO: 634155 - DNA, 25 bp, Mus musculus
gggcatctttgataattcacctctt

SEQ ID NO: 634156 - DNA, 25 bp, Mus musculus
gggcatctttggattcaggagctaa

SEQ ID NO: 634157 - DNA, 25 bp, Mus musculus
gggcatctttggtttcaggagctaa

SEQ ID NO: 634158 - DNA, 25 bp, Mus musculus
gggcatcttttgacagactatcaga

SEQ ID NO: 634159 - DNA, 25 bp, Mus musculus
gggcatcttttgtcagactatcaga

SEQ ID NO: 634160 - DNA, 25 bp, Mus musculus
gggcatgaaaagaactgatccaact

SEQ ID NO: 634161 - DNA, 25 bp, Mus musculus
gggcatgaaaagtactgatccaact

SEQ ID NO: 634162 - DNA, 25 bp, Mus musculus
gggcatgaaactagacttcactgag

SEQ ID NO: 634163 - DNA, 25 bp, Mus musculus
gggcatgaaacttgacttcactgag

SEQ ID NO: 634164 - DNA, 25 bp, Mus musculus
gggcatgaacttctatacatacact

SEQ ID NO: 634165 - DNA, 25 bp, Mus musculus
gggcatgaacttgtatacatacact

SEQ ID NO: 634166 - DNA, 25 bp, Mus musculus
gggcatgaagctatggactcggtaa

SEQ ID NO: 634167 - DNA, 25 bp, Mus musculus
gggcatgaagctttggactcggtaa

SEQ ID NO: 634168 - DNA, 25 bp, Mus musculus
gggcatgaaggaacatgtccctgct

SEQ ID NO: 634169 - DNA, 25 bp, Mus musculus
gggcatgaaggatcatgtccctgct

SEQ ID NO: 634170 - DNA, 25 bp, Mus musculus
gggcatgaagtcacatttacacaat

SEQ ID NO: 634171 - DNA, 25 bp, Mus musculus
gggcatgaagtctcatttacacaat

SEQ ID NO: 634172 - DNA, 25 bp, Mus musculus
gggcatgaatgcatagcacacaagt

SEQ ID NO: 634173 - DNA, 25 bp, Mus musculus
gggcatgaatgcttagcacacaagt

SEQ ID NO: 634174 - DNA, 25 bp, Mus musculus
gggcatgaccatcctagtgtgtaac

SEQ ID NO: 634175 - DNA, 25 bp, Mus musculus
gggcatgaccatgctagtgtgtaac

SEQ ID NO: 634176 - DNA, 25 bp, Mus musculus
gggcatgacttcattgacagcaatg

SEQ ID NO: 634177 - DNA, 25 bp, Mus musculus
gggcatgacttctttgacagcaatg

SEQ ID NO: 634178 - DNA, 25 bp, Mus musculus
gggcatgagcaaccacgtcgcgttt

SEQ ID NO: 634179 - DNA, 25 bp, Mus musculus
gggcatgagcaagcacgtcgcgttt

SEQ ID NO: 634180 - DNA, 25 bp, Mus musculus
gggcatgagggccttacgtcattct

SEQ ID NO: 634181 - DNA, 25 bp, Mus musculus
gggcatgagggcgttacgtcattct

SEQ ID NO: 634182 - DNA, 25 bp, Mus musculus
gggcatgagtcaaaacggatccaca

SEQ ID NO: 634183 - DNA, 25 bp, Mus musculus
gggcatgagtcataacggatccaca

SEQ ID NO: 634184 - DNA, 25 bp, Mus musculus
gggcatgatatccacctgtctacta

SEQ ID NO: 634185 - DNA, 25 bp, Mus musculus
gggcatgatatcgacctgtctacta

SEQ ID NO: 634186 - DNA, 25 bp, Mus musculus
gggcatgatgctatgatgttgcttt

SEQ ID NO: 634187 - DNA, 25 bp, Mus musculus
gggcatgatgctttgatgttgcttt

SEQ ID NO: 634188 - DNA, 25 bp, Mus musculus
gggcatgcagggattccccacttca

SEQ ID NO: 634189 - DNA, 25 bp, Mus musculus
gggcatgcagggtttccccacttca

SEQ ID NO: 634190 - DNA, 25 bp, Mus musculus
gggcatgcatctacaagattgcttt

SEQ ID NO: 634191 - DNA, 25 bp, Mus musculus
gggcatgcatcttcaagattgcttt

SEQ ID NO: 634192 - DNA, 25 bp, Mus musculus
gggcatgcatgtcatccctgtctct

SEQ ID NO: 634193 - DNA, 25 bp, Mus musculus
gggcatgcatgtgatccctgtctct

SEQ ID NO: 634194 - DNA, 25 bp, Mus musculus
gggcatgcattccttagctattgat

SEQ ID NO: 634195 - DNA, 25 bp, Mus musculus
gggcatgcattcgttagctattgat

SEQ ID NO: 634196 - DNA, 25 bp, Mus musculus
gggcatgccttgaactctggtgatc

SEQ ID NO: 634197 - DNA, 25 bp, Mus musculus
gggcatgccttgtactctggtgatc

SEQ ID NO: 634198 - DNA, 25 bp, Mus musculus
gggcatgcgaaccttggagcatcaa

SEQ ID NO: 634199 - DNA, 25 bp, Mus musculus
gggcatgcgaacgttggagcatcaa

SEQ ID NO: 634200 - DNA, 25 bp, Mus musculus
gggcatgctattccttagcttcata

SEQ ID NO: 634201 - DNA, 25 bp, Mus musculus
gggcatgctattctaagatcccctc

SEQ ID NO: 634202 - DNA, 25 bp, Mus musculus
gggcatgctattcttttacctagga

SEQ ID NO: 634203 - DNA, 25 bp, Mus musculus
gggcatgctattgcttagcttcata

SEQ ID NO: 634204 - DNA, 25 bp, Mus musculus
gggcatgctattgtaagatcccctc

SEQ ID NO: 634205 - DNA, 25 bp, Mus musculus
gggcatgctattgttttacctagga

SEQ ID NO: 634206 - DNA, 25 bp, Mus musculus
gggcatgctccgcaaactggacatt

SEQ ID NO: 634207 - DNA, 25 bp, Mus musculus
gggcatgctccggaaactggacatt

SEQ ID NO: 634208 - DNA, 25 bp, Mus musculus
gggcatgctggacactggatctccc

SEQ ID NO: 634209 - DNA, 25 bp, Mus musculus
gggcatgctggagactggatctccc

SEQ ID NO: 634210 - DNA, 25 bp, Mus musculus
gggcatgctgtcacatctgtaatgc

SEQ ID NO: 634211 - DNA, 25 bp, Mus musculus
gggcatgctgtctcatctgtaatgc

SEQ ID NO: 634212 - DNA, 25 bp, Mus musculus
gggcatgcttagaggccgagctctt

SEQ ID NO: 634213 - DNA, 25 bp, Mus musculus
gggcatgcttagtggccgagctctt

SEQ ID NO: 634214 - DNA, 25 bp, Mus musculus
gggcatgctttacgcttttctggac

SEQ ID NO: 634215 - DNA, 25 bp, Mus musculus
gggcatgctttaggcttttctggac

SEQ ID NO: 634216 - DNA, 25 bp, Mus musculus
gggcatggaggcactatccccaaga

SEQ ID NO: 634217 - DNA, 25 bp, Mus musculus
gggcatggaggctctatccccaaga

SEQ ID NO: 634218 - DNA, 25 bp, Mus musculus
gggcatggagttagaatccccagaa

SEQ ID NO: 634219 - DNA, 25 bp, Mus musculus
gggcatggagtttgaatccccagaa

SEQ ID NO: 634220 - DNA, 25 bp, Mus musculus
gggcatggatccactgattgtgcac

SEQ ID NO: 634221 - DNA, 25 bp, Mus musculus
gggcatggatcctctgattgtgcac

SEQ ID NO: 634222 - DNA, 25 bp, Mus musculus
gggcatggcactatgtaacataaag

SEQ ID NO: 634223 - DNA, 25 bp, Mus musculus
gggcatggcactttgtaacataaag

SEQ ID NO: 634224 - DNA, 25 bp, Mus musculus
gggcatggccatctattccgactac

SEQ ID NO: 634225 - DNA, 25 bp, Mus musculus
gggcatggccatgtattccgactac

SEQ ID NO: 634226 - DNA, 25 bp, Mus musculus
gggcatggcttgaattagttttatt

SEQ ID NO: 634227 - DNA, 25 bp, Mus musculus
gggcatggcttgtattagttttatt

SEQ ID NO: 634228 - DNA, 25 bp, Mus musculus
gggcatggctttataaagtggtaaa

SEQ ID NO: 634229 - DNA, 25 bp, Mus musculus
gggcatggctttttaaagtggtaaa

SEQ ID NO: 634230 - DNA, 25 bp, Mus musculus
gggcatgggatccacaaacttttcc

SEQ ID NO: 634231 - DNA, 25 bp, Mus musculus
gggcatgggatcgacaaacttttcc

SEQ ID NO: 634232 - DNA, 25 bp, Mus musculus
gggcatgggcacagctatggaactc

SEQ ID NO: 634233 - DNA, 25 bp, Mus musculus
gggcatgggcactgctatggaactc

SEQ ID NO: 634234 - DNA, 25 bp, Mus musculus
gggcatggtaacacacacttttcat

SEQ ID NO: 634235 - DNA, 25 bp, Mus musculus
gggcatggtaactcacacttttcat

SEQ ID NO: 634236 - DNA, 25 bp, Mus musculus
gggcatggtatgctttgcacatatc

SEQ ID NO: 634237 - DNA, 25 bp, Mus musculus
gggcatggtatggtttgcacatatc

SEQ ID NO: 634238 - DNA, 25 bp, Mus musculus
gggcatggttttaatccaggaacct

SEQ ID NO: 634239 - DNA, 25 bp, Mus musculus
gggcatggtttttatccaggaacct

SEQ ID NO: 634240 - DNA, 25 bp, Mus musculus
gggcatgtacatagtgtttccagtc

SEQ ID NO: 634241 - DNA, 25 bp, Mus musculus
gggcatgtacatatctgtggaagta

SEQ ID NO: 634242 - DNA, 25 bp, Mus musculus
gggcatgtacattgtgtttccagtc

SEQ ID NO: 634243 - DNA, 25 bp, Mus musculus
gggcatgtacatttctgtggaagta

SEQ ID NO: 634244 - DNA, 25 bp, Mus musculus
gggcatgtagcactttcagagtatc

SEQ ID NO: 634245 - DNA, 25 bp, Mus musculus
gggcatgtagcagtttcagagtatc

SEQ ID NO: 634246 - DNA, 25 bp, Mus musculus
gggcatgtagccattttctagtctc

SEQ ID NO: 634247 - DNA, 25 bp, Mus musculus
gggcatgtagcctttttctagtctc

SEQ ID NO: 634248 - DNA, 25 bp, Mus musculus
gggcatgtatccacttacaaggaaa

SEQ ID NO: 634249 - DNA, 25 bp, Mus musculus
gggcatgtatcctcttacaaggaaa

SEQ ID NO: 634250 - DNA, 25 bp, Mus musculus
gggcatgtcaaaactagctgtctag

SEQ ID NO: 634251 - DNA, 25 bp, Mus musculus
gggcatgtcaaatctagctgtctag

SEQ ID NO: 634252 - DNA, 25 bp, Mus musculus
gggcatgtcacacatccattagcgt

SEQ ID NO: 634253 - DNA, 25 bp, Mus musculus
gggcatgtcacagatccattagcgt

SEQ ID NO: 634254 - DNA, 25 bp, Mus musculus
gggcatgtcagaatttcctctcttc

SEQ ID NO: 634255 - DNA, 25 bp, Mus musculus
gggcatgtcagattttcctctcttc

SEQ ID NO: 634256 - DNA, 25 bp, Mus musculus
gggcatgtcctgcagcactctagat

SEQ ID NO: 634257 - DNA, 25 bp, Mus musculus
gggcatgtcctggagcactctagat

SEQ ID NO: 634258 - DNA, 25 bp, Mus musculus
gggcatgtctcacccctttgccaag

SEQ ID NO: 634259 - DNA, 25 bp, Mus musculus
gggcatgtctcagccctttgccaag

SEQ ID NO: 634260 - DNA, 25 bp, Mus musculus
gggcatgtctccaccaaaatggatt

SEQ ID NO: 634261 - DNA, 25 bp, Mus musculus
gggcatgtctcctccaaaatggatt

SEQ ID NO: 634262 - DNA, 25 bp, Mus musculus
gggcatgtgcccaatattgctattt

SEQ ID NO: 634263 - DNA, 25 bp, Mus musculus
gggcatgtgccctatattgctattt

SEQ ID NO: 634264 - DNA, 25 bp, Mus musculus
gggcatgttaataaggtgaaccaaa

SEQ ID NO: 634265 - DNA, 25 bp, Mus musculus
gggcatgttaattaggtgaaccaaa

SEQ ID NO: 634266 - DNA, 25 bp, Mus musculus
gggcatgttcccagatgagaagcta

SEQ ID NO: 634267 - DNA, 25 bp, Mus musculus
gggcatgttccctgatgagaagcta

SEQ ID NO: 634268 - DNA, 25 bp, Mus musculus
gggcatgttgccagctggttcccgc

SEQ ID NO: 634269 - DNA, 25 bp, Mus musculus
gggcatgttgcctgctggttcccgc

SEQ ID NO: 634270 - DNA, 25 bp, Mus musculus
gggcatgttgggaccccgcactttc

SEQ ID NO: 634271 - DNA, 25 bp, Mus musculus
gggcatgttgggtccccgcactttc

SEQ ID NO: 634272 - DNA, 25 bp, Mus musculus
gggcatgtttagatccgagtacgtg

SEQ ID NO: 634273 - DNA, 25 bp, Mus musculus
gggcatgtttagttccgagtacgtg

SEQ ID NO: 634274 - DNA, 25 bp, Mus musculus
gggcatgttttcagagtccgaggca

SEQ ID NO: 634275 - DNA, 25 bp, Mus musculus
gggcatgttttctgagtccgaggca

SEQ ID NO: 634276 - DNA, 25 bp, Mus musculus
gggcattaaaccatttgataacata

SEQ ID NO: 634277 - DNA, 25 bp, Mus musculus
gggcattaaaccttttgataacata

SEQ ID NO: 634278 - DNA, 25 bp, Mus musculus
gggcattaacggacagcaagcaact

SEQ ID NO: 634279 - DNA, 25 bp, Mus musculus
gggcattaacggtcagcaagcaact

SEQ ID NO: 634280 - DNA, 25 bp, Mus musculus
gggcattaactcatgttctttatcc

SEQ ID NO: 634281 - DNA, 25 bp, Mus musculus
gggcattaactcttgttctttatcc

SEQ ID NO: 634282 - DNA, 25 bp, Mus musculus
gggcattaagctatctcatctctga

SEQ ID NO: 634283 - DNA, 25 bp, Mus musculus
gggcattaagctttctcatctctga

SEQ ID NO: 634284 - DNA, 25 bp, Mus musculus
gggcattacaagctcgttcactctc

SEQ ID NO: 634285 - DNA, 25 bp, Mus musculus
gggcattacaaggtcgttcactctc

SEQ ID NO: 634286 - DNA, 25 bp, Mus musculus
gggcattacactcagtaggctttgc

SEQ ID NO: 634287 - DNA, 25 bp, Mus musculus
gggcattacactgagtaggctttgc

SEQ ID NO: 634288 - DNA, 25 bp, Mus musculus
gggcattacagcacattaggtgcac

SEQ ID NO: 634289 - DNA, 25 bp, Mus musculus
gggcattacagctcattaggtgcac

SEQ ID NO: 634290 - DNA, 25 bp, Mus musculus
gggcattacatcctagagcttcatt

SEQ ID NO: 634291 - DNA, 25 bp, Mus musculus
gggcattacatcgtagagcttcatt

SEQ ID NO: 634292 - DNA, 25 bp, Mus musculus
gggcattactagctctgcactgcca

SEQ ID NO: 634293 - DNA, 25 bp, Mus musculus
gggcattactaggtctgcactgcca

SEQ ID NO: 634294 - DNA, 25 bp, Mus musculus
gggcattagaatctccctagcacaa

SEQ ID NO: 634295 - DNA, 25 bp, Mus musculus
gggcattagaatgtccctagcacaa

SEQ ID NO: 634296 - DNA, 25 bp, Mus musculus
gggcattagaggagaccccacctga

SEQ ID NO: 634297 - DNA, 25 bp, Mus musculus
gggcattagaggtgaccccacctga

SEQ ID NO: 634298 - DNA, 25 bp, Mus musculus
gggcattagcctaatctttggttcc

SEQ ID NO: 634299 - DNA, 25 bp, Mus musculus
gggcattagccttatctttggttcc

SEQ ID NO: 634300 - DNA, 25 bp, Mus musculus
gggcattagcttacttgccatctgc

SEQ ID NO: 634301 - DNA, 25 bp, Mus musculus
gggcattagctttcttgccatctgc

SEQ ID NO: 634302 - DNA, 25 bp, Mus musculus
gggcattaggatctcacgtatgaat

SEQ ID NO: 634303 - DNA, 25 bp, Mus musculus
gggcattaggatgtcacgtatgaat

SEQ ID NO: 634304 - DNA, 25 bp, Mus musculus
gggcattatccccaaagtaaactat

SEQ ID NO: 634305 - DNA, 25 bp, Mus musculus
gggcattatcccgaaagtaaactat

SEQ ID NO: 634306 - DNA, 25 bp, Mus musculus
gggcattatcctctatgaatttctg

SEQ ID NO: 634307 - DNA, 25 bp, Mus musculus
gggcattatcctgtatgaatttctg

SEQ ID NO: 634308 - DNA, 25 bp, Mus musculus
gggcattatttaaggaccactttta

SEQ ID NO: 634309 - DNA, 25 bp, Mus musculus
gggcattatttatggaccactttta

SEQ ID NO: 634310 - DNA, 25 bp, Mus musculus
gggcattcaaggacatcgccagtta

SEQ ID NO: 634311 - DNA, 25 bp, Mus musculus
gggcattcaaggtcatcgccagtta

SEQ ID NO: 634312 - DNA, 25 bp, Mus musculus
gggcattcagagagggagccaactc

SEQ ID NO: 634313 - DNA, 25 bp, Mus musculus
gggcattcagagtgggagccaactc

SEQ ID NO: 634314 - DNA, 25 bp, Mus musculus
gggcattccagtatcagccagaaaa

SEQ ID NO: 634315 - DNA, 25 bp, Mus musculus
gggcattccagtttcagccagaaaa

SEQ ID NO: 634316 - DNA, 25 bp, Mus musculus
gggcattccttgacataatgtagct

SEQ ID NO: 634317 - DNA, 25 bp, Mus musculus
gggcattccttgtcataatgtagct

SEQ ID NO: 634318 - DNA, 25 bp, Mus musculus
gggcattcgattacttgtaccttat

SEQ ID NO: 634319 - DNA, 25 bp, Mus musculus
gggcattcgattcattgttatccaa

SEQ ID NO: 634320 - DNA, 25 bp, Mus musculus
gggcattcgattgattgttatccaa

SEQ ID NO: 634321 - DNA, 25 bp, Mus musculus
gggcattcgatttcttgtaccttat

SEQ ID NO: 634322 - DNA, 25 bp, Mus musculus
gggcattcgtatagcgccgctagag

SEQ ID NO: 634323 - DNA, 25 bp, Mus musculus
gggcattcgtattgcgccgctagag

SEQ ID NO: 634324 - DNA, 25 bp, Mus musculus
gggcattctcagagtgattcccctg

SEQ ID NO: 634325 - DNA, 25 bp, Mus musculus
gggcattctcagtgtgattcccctg

SEQ ID NO: 634326 - DNA, 25 bp, Mus musculus
gggcattctctgaactgatgcttag

SEQ ID NO: 634327 - DNA, 25 bp, Mus musculus
gggcattctctgagtagtctcacat

SEQ ID NO: 634328 - DNA, 25 bp, Mus musculus
gggcattctctgtactgatgcttag

SEQ ID NO: 634329 - DNA, 25 bp, Mus musculus
gggcattctctgtgtagtctcacat

SEQ ID NO: 634330 - DNA, 25 bp, Mus musculus
gggcattctggcaaacatggaagga

SEQ ID NO: 634331 - DNA, 25 bp, Mus musculus
gggcattctggctaacatggaagga

SEQ ID NO: 634332 - DNA, 25 bp, Mus musculus
gggcattctgggaagccattcagcc

SEQ ID NO: 634333 - DNA, 25 bp, Mus musculus
gggcattctgggtagccattcagcc

SEQ ID NO: 634334 - DNA, 25 bp, Mus musculus
gggcattcttcacctagcttgagaa

SEQ ID NO: 634335 - DNA, 25 bp, Mus musculus
gggcattcttcagctagcttgagaa

SEQ ID NO: 634336 - DNA, 25 bp, Mus musculus
gggcattcttttcagagaccaaacc

SEQ ID NO: 634337 - DNA, 25 bp, Mus musculus
gggcattcttttgagagaccaaacc

SEQ ID NO: 634338 - DNA, 25 bp, Mus musculus
gggcattgaagtagcatggactgat

SEQ ID NO: 634339 - DNA, 25 bp, Mus musculus
gggcattgaagttgcatggactgat

SEQ ID NO: 634340 - DNA, 25 bp, Mus musculus
gggcattgaatcatcatttgttgaa

SEQ ID NO: 634341 - DNA, 25 bp, Mus musculus
gggcattgaatcttcatttgttgaa

SEQ ID NO: 634342 - DNA, 25 bp, Mus musculus
gggcattgactactttattccagtg

SEQ ID NO: 634343 - DNA, 25 bp, Mus musculus
gggcattgactagtttattccagtg

SEQ ID NO: 634344 - DNA, 25 bp, Mus musculus
gggcattgagatatcatacaatata

SEQ ID NO: 634345 - DNA, 25 bp, Mus musculus
gggcattgagatttcatacaatata

SEQ ID NO: 634346 - DNA, 25 bp, Mus musculus
gggcattgatatctgccaataatct

SEQ ID NO: 634347 - DNA, 25 bp, Mus musculus
gggcattgatatgtgccaataatct

SEQ ID NO: 634348 - DNA, 25 bp, Mus musculus
gggcattgattaatctatttcggag

SEQ ID NO: 634349 - DNA, 25 bp, Mus musculus
gggcattgattattctatttcggag

SEQ ID NO: 634350 - DNA, 25 bp, Mus musculus
gggcattgccaaatgtatttagaaa

SEQ ID NO: 634351 - DNA, 25 bp, Mus musculus
gggcattgccaactgtacttacatt

SEQ ID NO: 634352 - DNA, 25 bp, Mus musculus
gggcattgccaagtgtacttacatt

SEQ ID NO: 634353 - DNA, 25 bp, Mus musculus
gggcattgccaattgtatttagaaa

SEQ ID NO: 634354 - DNA, 25 bp, Mus musculus
gggcattgcccacattatcgcagca

SEQ ID NO: 634355 - DNA, 25 bp, Mus musculus
gggcattgcccagattatcgcagca

SEQ ID NO: 634356 - DNA, 25 bp, Mus musculus
gggcattggaccaggaggcttccat

SEQ ID NO: 634357 - DNA, 25 bp, Mus musculus
gggcattggacctggaggcttccat

SEQ ID NO: 634358 - DNA, 25 bp, Mus musculus
gggcattggcttctttattttcatt

SEQ ID NO: 634359 - DNA, 25 bp, Mus musculus
gggcattggcttgtttattttcatt

SEQ ID NO: 634360 - DNA, 25 bp, Mus musculus
gggcattggtccagagccagaactt

SEQ ID NO: 634361 - DNA, 25 bp, Mus musculus
gggcattggtcctgagccagaactt

SEQ ID NO: 634362 - DNA, 25 bp, Mus musculus
gggcattgtactacccaaggcgcca

SEQ ID NO: 634363 - DNA, 25 bp, Mus musculus
gggcattgtacttcccaaggcgcca

SEQ ID NO: 634364 - DNA, 25 bp, Mus musculus
gggcattgtagaaccatacccacca

SEQ ID NO: 634365 - DNA, 25 bp, Mus musculus
gggcattgtagatccatacccacca

SEQ ID NO: 634366 - DNA, 25 bp, Mus musculus
gggcattgtcaaacatggcacaggg

SEQ ID NO: 634367 - DNA, 25 bp, Mus musculus
gggcattgtcaatcatggcacaggg

SEQ ID NO: 634368 - DNA, 25 bp, Mus musculus
gggcattgtgttaccacagagactt

SEQ ID NO: 634369 - DNA, 25 bp, Mus musculus
gggcattgtgtttccacagagactt

SEQ ID NO: 634370 - DNA, 25 bp, Mus musculus
gggcattgttgaatacactgtaata

SEQ ID NO: 634371 - DNA, 25 bp, Mus musculus
gggcattgttgattacactgtaata

SEQ ID NO: 634372 - DNA, 25 bp, Mus musculus
gggcatttatctctgctatgcagtg

SEQ ID NO: 634373 - DNA, 25 bp, Mus musculus
gggcatttatctgtgctatgcagtg

SEQ ID NO: 634374 - DNA, 25 bp, Mus musculus
gggcatttatgacaccagctctcta

SEQ ID NO: 634375 - DNA, 25 bp, Mus musculus
gggcatttatgagaccagctctcta

SEQ ID NO: 634376 - DNA, 25 bp, Mus musculus
gggcatttatgcagtagttcacatt

SEQ ID NO: 634377 - DNA, 25 bp, Mus musculus
gggcatttatgccttgatgcatgca

SEQ ID NO: 634378 - DNA, 25 bp, Mus musculus
gggcatttatgcgttgatgcatgca

SEQ ID NO: 634379 - DNA, 25 bp, Mus musculus
gggcatttatgctgtagttcacatt

SEQ ID NO: 634380 - DNA, 25 bp, Mus musculus
gggcatttcaaccagtagtagtaac

SEQ ID NO: 634381 - DNA, 25 bp, Mus musculus
gggcatttcaacgagtagtagtaac

SEQ ID NO: 634382 - DNA, 25 bp, Mus musculus
gggcatttcatgaatctcagtctct

SEQ ID NO: 634383 - DNA, 25 bp, Mus musculus
gggcatttcatgtatctcagtctct

SEQ ID NO: 634384 - DNA, 25 bp, Mus musculus
gggcatttcgccaaacaatactgtg

SEQ ID NO: 634385 - DNA, 25 bp, Mus musculus
gggcatttcgcctaacaatactgtg

SEQ ID NO: 634386 - DNA, 25 bp, Mus musculus
gggcatttctacctgggtcagtgaa

SEQ ID NO: 634387 - DNA, 25 bp, Mus musculus
gggcatttctacgtgggtcagtgaa

SEQ ID NO: 634388 - DNA, 25 bp, Mus musculus
gggcatttctcgatcacataatagg

SEQ ID NO: 634389 - DNA, 25 bp, Mus musculus
gggcatttctcgttcacataatagg

SEQ ID NO: 634390 - DNA, 25 bp, Mus musculus
gggcatttctctaagcagttctgtc

SEQ ID NO: 634391 - DNA, 25 bp, Mus musculus
gggcatttctcttagcagttctgtc

SEQ ID NO: 634392 - DNA, 25 bp, Mus musculus
gggcatttctgacggctaccccttt

SEQ ID NO: 634393 - DNA, 25 bp, Mus musculus
gggcatttctgagggctaccccttt

SEQ ID NO: 634394 - DNA, 25 bp, Mus musculus
gggcatttctgtcagggcatttcta

SEQ ID NO: 634395 - DNA, 25 bp, Mus musculus
gggcatttctgtgagggcatttcta

SEQ ID NO: 634396 - DNA, 25 bp, Mus musculus
gggcatttcttcacagttgtatttc

SEQ ID NO: 634397 - DNA, 25 bp, Mus musculus
gggcatttcttctcagttgtatttc

SEQ ID NO: 634398 - DNA, 25 bp, Mus musculus
gggcatttctttattgataaggtac

SEQ ID NO: 634399 - DNA, 25 bp, Mus musculus
gggcatttcttttttgataaggtac

SEQ ID NO: 634400 - DNA, 25 bp, Mus musculus
gggcatttgcaaatcttgctgcagt

SEQ ID NO: 634401 - DNA, 25 bp, Mus musculus
gggcatttgcaattcttgctgcagt

SEQ ID NO: 634402 - DNA, 25 bp, Mus musculus
gggcatttgcctacaaagggtttga

SEQ ID NO: 634403 - DNA, 25 bp, Mus musculus
gggcatttgcctcatgcagagttca

SEQ ID NO: 634404 - DNA, 25 bp, Mus musculus
gggcatttgcctgatgcagagttca

SEQ ID NO: 634405 - DNA, 25 bp, Mus musculus
gggcatttgccttcaaagggtttga

SEQ ID NO: 634406 - DNA, 25 bp, Mus musculus
gggcatttgtcccatttatacctca

SEQ ID NO: 634407 - DNA, 25 bp, Mus musculus
gggcatttgtccgatttatacctca

SEQ ID NO: 634408 - DNA, 25 bp, Mus musculus
gggcatttgttgaatgactcatctg

SEQ ID NO: 634409 - DNA, 25 bp, Mus musculus
gggcatttgttgtatgactcatctg

SEQ ID NO: 634410 - DNA, 25 bp, Mus musculus
gggcattttaatagcttacttacgt

SEQ ID NO: 634411 - DNA, 25 bp, Mus musculus
gggcattttaattgcttacttacgt

SEQ ID NO: 634412 - DNA, 25 bp, Mus musculus
gggcattttattcttcattcgacaa

SEQ ID NO: 634413 - DNA, 25 bp, Mus musculus
gggcattttattgttcattcgacaa

SEQ ID NO: 634414 - DNA, 25 bp, Mus musculus
gggcattttcccagatgtttacaga

SEQ ID NO: 634415 - DNA, 25 bp, Mus musculus
gggcattttccctgatgtttacaga

SEQ ID NO: 634416 - DNA, 25 bp, Mus musculus
gggcattttcttcatgagcaaaggc

SEQ ID NO: 634417 - DNA, 25 bp, Mus musculus
gggcattttcttgatgagcaaaggc

SEQ ID NO: 634418 - DNA, 25 bp, Mus musculus
gggcatttttaacaaccactgcttt

SEQ ID NO: 634419 - DNA, 25 bp, Mus musculus
gggcatttttaagaaccactgcttt

SEQ ID NO: 634420 - DNA, 25 bp, Mus musculus
gggccaaaacatacccaacttgaat

SEQ ID NO: 634421 - DNA, 25 bp, Mus musculus
gggccaaaacattcccaacttgaat

SEQ ID NO: 634422 - DNA, 25 bp, Mus musculus
gggccaaacaagattccattcgtag

SEQ ID NO: 634423 - DNA, 25 bp, Mus musculus
gggccaaacaagtttccattcgtag

SEQ ID NO: 634424 - DNA, 25 bp, Mus musculus
gggccaaacacacctgggacattta

SEQ ID NO: 634425 - DNA, 25 bp, Mus musculus
gggccaaacacagctgggacattta

SEQ ID NO: 634426 - DNA, 25 bp, Mus musculus
gggccaaacacgctgctcaacttaa

SEQ ID NO: 634427 - DNA, 25 bp, Mus musculus
gggccaaacacggtgctcaacttaa

SEQ ID NO: 634428 - DNA, 25 bp, Mus musculus
gggccaaacatcatgttaattattt

SEQ ID NO: 634429 - DNA, 25 bp, Mus musculus
gggccaaacatcttgttaattattt

SEQ ID NO: 634430 - DNA, 25 bp, Mus musculus
gggccaaacatgaccaaatgtaaca

SEQ ID NO: 634431 - DNA, 25 bp, Mus musculus
gggccaaacatgtccaaatgtaaca

SEQ ID NO: 634432 - DNA, 25 bp, Mus musculus
gggccaaacctcactgtgcaatctg

SEQ ID NO: 634433 - DNA, 25 bp, Mus musculus
gggccaaacctctctgtgcaatctg

SEQ ID NO: 634434 - DNA, 25 bp, Mus musculus
gggccaaagacaaagatgtatttag

SEQ ID NO: 634435 - DNA, 25 bp, Mus musculus
gggccaaagacatagatgtatttag

SEQ ID NO: 634436 - DNA, 25 bp, Mus musculus
gggccaaagagccatttcctggcaa

SEQ ID NO: 634437 - DNA, 25 bp, Mus musculus
gggccaaagagcgatttcctggcaa

SEQ ID NO: 634438 - DNA, 25 bp, Mus musculus
gggccaaagccaagacttgcacctt

SEQ ID NO: 634439 - DNA, 25 bp, Mus musculus
gggccaaagccatgacttgcacctt

SEQ ID NO: 634440 - DNA, 25 bp, Mus musculus
gggccaaaggctcacgacttactgg

SEQ ID NO: 634441 - DNA, 25 bp, Mus musculus
gggccaaaggctgacgacttactgg

SEQ ID NO: 634442 - DNA, 25 bp, Mus musculus
gggccaaataagcatactctcatac

SEQ ID NO: 634443 - DNA, 25 bp, Mus musculus
gggccaaataaggatactctcatac

SEQ ID NO: 634444 - DNA, 25 bp, Mus musculus
gggccaaatcaacgtgtcagattcc

SEQ ID NO: 634445 - DNA, 25 bp, Mus musculus
gggccaaatcaaggtgtcagattcc

SEQ ID NO: 634446 - DNA, 25 bp, Mus musculus
gggccaaatcacctgttctgcaaac

SEQ ID NO: 634447 - DNA, 25 bp, Mus musculus
gggccaaatcacgtgttctgcaaac

SEQ ID NO: 634448 - DNA, 25 bp, Mus musculus
gggccaaatcatccttaagaatgac

SEQ ID NO: 634449 - DNA, 25 bp, Mus musculus
gggccaaatcatgcttaagaatgac

SEQ ID NO: 634450 - DNA, 25 bp, Mus musculus
gggccaaatcccatatgcgttgtgg

SEQ ID NO: 634451 - DNA, 25 bp, Mus musculus
gggccaaatcccttatgcgttgtgg

SEQ ID NO: 634452 - DNA, 25 bp, Mus musculus
gggccaaatgacaggcgcagccata

SEQ ID NO: 634453 - DNA, 25 bp, Mus musculus
gggccaaatgactggcgcagccata

SEQ ID NO: 634454 - DNA, 25 bp, Mus musculus
gggccaacaaggatcaggttccatt

SEQ ID NO: 634455 - DNA, 25 bp, Mus musculus
gggccaacaaggttcaggttccatt

SEQ ID NO: 634456 - DNA, 25 bp, Mus musculus
gggccaacaccaattctgtgatcca

SEQ ID NO: 634457 - DNA, 25 bp, Mus musculus
gggccaacaccatttctgtgatcca

SEQ ID NO: 634458 - DNA, 25 bp, Mus musculus
gggccaacatgcagcacagatacat

SEQ ID NO: 634459 - DNA, 25 bp, Mus musculus
gggccaacatgctgcacagatacat

SEQ ID NO: 634460 - DNA, 25 bp, Mus musculus
gggccaacattgctgctgtcaacag

SEQ ID NO: 634461 - DNA, 25 bp, Mus musculus
gggccaacattggtgctgtcaacag

SEQ ID NO: 634462 - DNA, 25 bp, Mus musculus
gggccaaccaaactctgctaaatgt

SEQ ID NO: 634463 - DNA, 25 bp, Mus musculus
gggccaaccaaagtctgctaaatgt

SEQ ID NO: 634464 - DNA, 25 bp, Mus musculus
gggccaaccagcctgtgttgtatgt

SEQ ID NO: 634465 - DNA, 25 bp, Mus musculus
gggccaaccagcgtgtgttgtatgt

SEQ ID NO: 634466 - DNA, 25 bp, Mus musculus
gggccaaccagtaaaggtgccatgc

SEQ ID NO: 634467 - DNA, 25 bp, Mus musculus
gggccaaccagttaaggtgccatgc

SEQ ID NO: 634468 - DNA, 25 bp, Mus musculus
gggccaaccatccaggacctgagta

SEQ ID NO: 634469 - DNA, 25 bp, Mus musculus
gggccaaccatcgaggacctgagta

SEQ ID NO: 634470 - DNA, 25 bp, Mus musculus
gggccaacctcaaggacattattag

SEQ ID NO: 634471 - DNA, 25 bp, Mus musculus
gggccaacctcatggacattattag

SEQ ID NO: 634472 - DNA, 25 bp, Mus musculus
gggccaacctgtactggcagcaggc

SEQ ID NO: 634473 - DNA, 25 bp, Mus musculus
gggccaacctgttctggcagcaggc

SEQ ID NO: 634474 - DNA, 25 bp, Mus musculus
gggccaacgatcaaattccgagaat

SEQ ID NO: 634475 - DNA, 25 bp, Mus musculus
gggccaacgatctaattccgagaat

SEQ ID NO: 634476 - DNA, 25 bp, Mus musculus
gggccaactcaactttacagtcctg

SEQ ID NO: 634477 - DNA, 25 bp, Mus musculus
gggccaactcaagtttacagtcctg

SEQ ID NO: 634478 - DNA, 25 bp, Mus musculus
gggccaactccaagcattcaaagat

SEQ ID NO: 634479 - DNA, 25 bp, Mus musculus
gggccaactccatgcattcaaagat

SEQ ID NO: 634480 - DNA, 25 bp, Mus musculus
gggccaactcccagaaaaacacatt

SEQ ID NO: 634481 - DNA, 25 bp, Mus musculus
gggccaactccctgaaaaacacatt

SEQ ID NO: 634482 - DNA, 25 bp, Mus musculus
gggccaactggtctgcttagtagca

SEQ ID NO: 634483 - DNA, 25 bp, Mus musculus
gggccaactggtgtgcttagtagca

SEQ ID NO: 634484 - DNA, 25 bp, Mus musculus
gggccaacttgaatttccatgtgta

SEQ ID NO: 634485 - DNA, 25 bp, Mus musculus
gggccaacttgattttccatgtgta

SEQ ID NO: 634486 - DNA, 25 bp, Mus musculus
gggccaagacctaccatggttgttt

SEQ ID NO: 634487 - DNA, 25 bp, Mus musculus
gggccaagaccttccatggttgttt

SEQ ID NO: 634488 - DNA, 25 bp, Mus musculus
gggccaagaggacgtcttgcccctt

SEQ ID NO: 634489 - DNA, 25 bp, Mus musculus
gggccaagaggaggtcttgcccctt

SEQ ID NO: 634490 - DNA, 25 bp, Mus musculus
gggccaagagggactgtctacttta

SEQ ID NO: 634491 - DNA, 25 bp, Mus musculus
gggccaagagggtctgtctacttta

SEQ ID NO: 634492 - DNA, 25 bp, Mus musculus
gggccaagatcaagcttcctggtct

SEQ ID NO: 634493 - DNA, 25 bp, Mus musculus
gggccaagatcatgcttcctggtct

SEQ ID NO: 634494 - DNA, 25 bp, Mus musculus
gggccaagatgcacattgcgtcctt

SEQ ID NO: 634495 - DNA, 25 bp, Mus musculus
gggccaagatgctcattgcgtcctt

SEQ ID NO: 634496 - DNA, 25 bp, Mus musculus
gggccaagcaaacacacctctgcag

SEQ ID NO: 634497 - DNA, 25 bp, Mus musculus
gggccaagcaaagacacctctgcag

SEQ ID NO: 634498 - DNA, 25 bp, Mus musculus
gggccaagcagaacttgtccttcaa

SEQ ID NO: 634499 - DNA, 25 bp, Mus musculus
gggccaagcagatcttgtccttcaa

SEQ ID NO: 634500 - DNA, 25 bp, Mus musculus
gggccaagcattagcagtggatctt

SEQ ID NO: 634501 - DNA, 25 bp, Mus musculus
gggccaagcatttgcagtggatctt

SEQ ID NO: 634502 - DNA, 25 bp, Mus musculus
gggccaagcttcattacagtctatt

SEQ ID NO: 634503 - DNA, 25 bp, Mus musculus
gggccaagcttctttacagtctatt

SEQ ID NO: 634504 - DNA, 25 bp, Mus musculus
gggccaaggacaacatgcactagca

SEQ ID NO: 634505 - DNA, 25 bp, Mus musculus
gggccaaggacactcagcactgtga

SEQ ID NO: 634506 - DNA, 25 bp, Mus musculus
gggccaaggacagtcagcactgtga

SEQ ID NO: 634507 - DNA, 25 bp, Mus musculus
gggccaaggacatcatgcactagca

SEQ ID NO: 634508 - DNA, 25 bp, Mus musculus
gggccaaggattcgtggcaccaact

SEQ ID NO: 634509 - DNA, 25 bp, Mus musculus
gggccaaggattggtggcaccaact

SEQ ID NO: 634510 - DNA, 25 bp, Mus musculus
gggccaagtaaacgtcgcatgtgtt

SEQ ID NO: 634511 - DNA, 25 bp, Mus musculus
gggccaagtaaaggtcgcatgtgtt

SEQ ID NO: 634512 - DNA, 25 bp, Mus musculus
gggccaagtccacgaattgacagat

SEQ ID NO: 634513 - DNA, 25 bp, Mus musculus
gggccaagtccaggaattgacagat

SEQ ID NO: 634514 - DNA, 25 bp, Mus musculus
gggccaagtgaaagacagtcctgtc

SEQ ID NO: 634515 - DNA, 25 bp, Mus musculus
gggccaagtgaatgacagtcctgtc

SEQ ID NO: 634516 - DNA, 25 bp, Mus musculus
gggccaagttacaaaccgtctcgat

SEQ ID NO: 634517 - DNA, 25 bp, Mus musculus
gggccaagttactaaccgtctcgat

SEQ ID NO: 634518 - DNA, 25 bp, Mus musculus
gggccaagtttcaatacagctcagt

SEQ ID NO: 634519 - DNA, 25 bp, Mus musculus
gggccaagtttctatacagctcagt

SEQ ID NO: 634520 - DNA, 25 bp, Mus musculus
gggccaatagaaattgtgttacttt

SEQ ID NO: 634521 - DNA, 25 bp, Mus musculus
gggccaatagaatttgtgttacttt

SEQ ID NO: 634522 - DNA, 25 bp, Mus musculus
gggccaatagccattgctcacaaga

SEQ ID NO: 634523 - DNA, 25 bp, Mus musculus
gggccaatagcctttgctcacaaga

SEQ ID NO: 634524 - DNA, 25 bp, Mus musculus
gggccaatcactcacaaaggtcttt

SEQ ID NO: 634525 - DNA, 25 bp, Mus musculus
gggccaatcactgacaaaggtcttt

SEQ ID NO: 634526 - DNA, 25 bp, Mus musculus
gggccaatgaaaagccttcgctgcg

SEQ ID NO: 634527 - DNA, 25 bp, Mus musculus
gggccaatgaaatgccttcgctgcg

SEQ ID NO: 634528 - DNA, 25 bp, Mus musculus
gggccaatgattagtgtctctatta

SEQ ID NO: 634529 - DNA, 25 bp, Mus musculus
gggccaatgatttgtgtctctatta

SEQ ID NO: 634530 - DNA, 25 bp, Mus musculus
gggccaatgccacccacagatatga

SEQ ID NO: 634531 - DNA, 25 bp, Mus musculus
gggccaatgccagccacagatatga

SEQ ID NO: 634532 - DNA, 25 bp, Mus musculus
gggccaatggaacctacttggtcta

SEQ ID NO: 634533 - DNA, 25 bp, Mus musculus
gggccaatggaagctacttggtcta

SEQ ID NO: 634534 - DNA, 25 bp, Mus musculus
gggccaatgtcaactgaggctgcag

SEQ ID NO: 634535 - DNA, 25 bp, Mus musculus
gggccaatgtcatctgaggctgcag

SEQ ID NO: 634536 - DNA, 25 bp, Mus musculus
gggccaatgtgcagttagtgttaag

SEQ ID NO: 634537 - DNA, 25 bp, Mus musculus
gggccaatgtgctgttagtgttaag

SEQ ID NO: 634538 - DNA, 25 bp, Mus musculus
gggccaatttgtatgaaacggttag

SEQ ID NO: 634539 - DNA, 25 bp, Mus musculus
gggccaatttgtttgaaacggttag

SEQ ID NO: 634540 - DNA, 25 bp, Mus musculus
gggccacaaagtcaacaaggacttc

SEQ ID NO: 634541 - DNA, 25 bp, Mus musculus
gggccacaaagtgaacaaggacttc

SEQ ID NO: 634542 - DNA, 25 bp, Mus musculus
gggccacaaggacatactctaccag

SEQ ID NO: 634543 - DNA, 25 bp, Mus musculus
gggccacaaggaccaagttgctaat

SEQ ID NO: 634544 - DNA, 25 bp, Mus musculus
gggccacaaggagatactctaccag

SEQ ID NO: 634545 - DNA, 25 bp, Mus musculus
gggccacaaggagcaagttgctaat

SEQ ID NO: 634546 - DNA, 25 bp, Mus musculus
gggccacaagtcaatcattgcttat

SEQ ID NO: 634547 - DNA, 25 bp, Mus musculus
gggccacaagtctatcattgcttat

SEQ ID NO: 634548 - DNA, 25 bp, Mus musculus
gggccacaatggatgcactgcagtt

SEQ ID NO: 634549 - DNA, 25 bp, Mus musculus
gggccacaatggttgcactgcagtt

SEQ ID NO: 634550 - DNA, 25 bp, Mus musculus
gggccacaattcaatagaagagcac

SEQ ID NO: 634551 - DNA, 25 bp, Mus musculus
gggccacaattctatagaagagcac

SEQ ID NO: 634552 - DNA, 25 bp, Mus musculus
gggccacacacaaaatcaccaatga

SEQ ID NO: 634553 - DNA, 25 bp, Mus musculus
gggccacacacataatcaccaatga

SEQ ID NO: 634554 - DNA, 25 bp, Mus musculus
gggccacacagtagctatagtttag

SEQ ID NO: 634555 - DNA, 25 bp, Mus musculus
gggccacacagtcacgagcttgaag

SEQ ID NO: 634556 - DNA, 25 bp, Mus musculus
gggccacacagtgacgagcttgaag

SEQ ID NO: 634557 - DNA, 25 bp, Mus musculus
gggccacacagttgctatagtttag

SEQ ID NO: 634558 - DNA, 25 bp, Mus musculus
gggccacacccaaaggaatcacaga

SEQ ID NO: 634559 - DNA, 25 bp, Mus musculus
gggccacacccataggaatcacaga

SEQ ID NO: 634560 - DNA, 25 bp, Mus musculus
gggccacacttaactgagcttaaag

SEQ ID NO: 634561 - DNA, 25 bp, Mus musculus
gggccacacttatctgagcttaaag

SEQ ID NO: 634562 - DNA, 25 bp, Mus musculus
gggccacactttctagctgagcata

SEQ ID NO: 634563 - DNA, 25 bp, Mus musculus
gggccacactttgtagctgagcata

SEQ ID NO: 634564 - DNA, 25 bp, Mus musculus
gggccacagactacaccataattgt

SEQ ID NO: 634565 - DNA, 25 bp, Mus musculus
gggccacagacttcaccataattgt

SEQ ID NO: 634566 - DNA, 25 bp, Mus musculus
gggccacagcatcacttgtagggta

SEQ ID NO: 634567 - DNA, 25 bp, Mus musculus
gggccacagcatcatgggctattaa

SEQ ID NO: 634568 - DNA, 25 bp, Mus musculus
gggccacagcatgacttgtagggta

SEQ ID NO: 634569 - DNA, 25 bp, Mus musculus
gggccacagcatgatgggctattaa

SEQ ID NO: 634570 - DNA, 25 bp, Mus musculus
gggccacagccgatatcttatacga

SEQ ID NO: 634571 - DNA, 25 bp, Mus musculus
gggccacagccgttatcttatacga

SEQ ID NO: 634572 - DNA, 25 bp, Mus musculus
gggccacagcgaatttgcttggaca

SEQ ID NO: 634573 - DNA, 25 bp, Mus musculus
gggccacagcgattttgcttggaca

SEQ ID NO: 634574 - DNA, 25 bp, Mus musculus
gggccacagctccagttcggaaaac

SEQ ID NO: 634575 - DNA, 25 bp, Mus musculus
gggccacagctcgagttcggaaaac

SEQ ID NO: 634576 - DNA, 25 bp, Mus musculus
gggccacaggcaacagtgaactctc

SEQ ID NO: 634577 - DNA, 25 bp, Mus musculus
gggccacaggcatcagtgaactctc

SEQ ID NO: 634578 - DNA, 25 bp, Mus musculus
gggccacaggccatgactgaagaga

SEQ ID NO: 634579 - DNA, 25 bp, Mus musculus
gggccacaggccttgactgaagaga

SEQ ID NO: 634580 - DNA, 25 bp, Mus musculus
gggccacagggaacctcaaaaacag

SEQ ID NO: 634581 - DNA, 25 bp, Mus musculus
gggccacagggatcctcaaaaacag

SEQ ID NO: 634582 - DNA, 25 bp, Mus musculus
gggccacaggtcagtttggctgaat

SEQ ID NO: 634583 - DNA, 25 bp, Mus musculus
gggccacaggtctgtttggctgaat

SEQ ID NO: 634584 - DNA, 25 bp, Mus musculus
gggccacagtgaactgtcattctaa

SEQ ID NO: 634585 - DNA, 25 bp, Mus musculus
gggccacagtgatctgtcattctaa

SEQ ID NO: 634586 - DNA, 25 bp, Mus musculus
gggccacagtgcaccagatgtgaaa

SEQ ID NO: 634587 - DNA, 25 bp, Mus musculus
gggccacagtgctccagatgtgaaa

SEQ ID NO: 634588 - DNA, 25 bp, Mus musculus
gggccacagtggattaaagaggtaa

SEQ ID NO: 634589 - DNA, 25 bp, Mus musculus
gggccacagtggtttaaagaggtaa

SEQ ID NO: 634590 - DNA, 25 bp, Mus musculus
gggccacatagacaaccttggactg

SEQ ID NO: 634591 - DNA, 25 bp, Mus musculus
gggccacatagagaaccttggactg

SEQ ID NO: 634592 - DNA, 25 bp, Mus musculus
gggccacatatcaaaggacattctg

SEQ ID NO: 634593 - DNA, 25 bp, Mus musculus
gggccacatatctaaggacattctg

SEQ ID NO: 634594 - DNA, 25 bp, Mus musculus
gggccacatcctaaggatctgagaa

SEQ ID NO: 634595 - DNA, 25 bp, Mus musculus
gggccacatccttaggatctgagaa

SEQ ID NO: 634596 - DNA, 25 bp, Mus musculus
gggccacatgctatcttcgtatttg

SEQ ID NO: 634597 - DNA, 25 bp, Mus musculus
gggccacatgctttcttcgtatttg

SEQ ID NO: 634598 - DNA, 25 bp, Mus musculus
gggccacatggaagtctttacctat

SEQ ID NO: 634599 - DNA, 25 bp, Mus musculus
gggccacatggaccattttaacagt

SEQ ID NO: 634600 - DNA, 25 bp, Mus musculus
gggccacatggagcattttaacagt

SEQ ID NO: 634601 - DNA, 25 bp, Mus musculus
gggccacatggatgtctttacctat

SEQ ID NO: 634602 - DNA, 25 bp, Mus musculus
gggccacatgggacatctcttagta

SEQ ID NO: 634603 - DNA, 25 bp, Mus musculus
gggccacatgggtcatctcttagta

SEQ ID NO: 634604 - DNA, 25 bp, Mus musculus
gggccacattttccccaattagaaa

SEQ ID NO: 634605 - DNA, 25 bp, Mus musculus
gggccacattttgcccaattagaaa

SEQ ID NO: 634606 - DNA, 25 bp, Mus musculus
gggccaccaccaacttatggaggaa

SEQ ID NO: 634607 - DNA, 25 bp, Mus musculus
gggccaccaccatcttatggaggaa

SEQ ID NO: 634608 - DNA, 25 bp, Mus musculus
gggccaccacctcgaatgcagaagg

SEQ ID NO: 634609 - DNA, 25 bp, Mus musculus
gggccaccacctggaatgcagaagg

SEQ ID NO: 634610 - DNA, 25 bp, Mus musculus
gggccaccagacactgcagaaatta

SEQ ID NO: 634611 - DNA, 25 bp, Mus musculus
gggccaccagactctgcagaaatta

SEQ ID NO: 634612 - DNA, 25 bp, Mus musculus
gggccaccagctcggttggttccat

SEQ ID NO: 634613 - DNA, 25 bp, Mus musculus
gggccaccagctgggttggttccat

SEQ ID NO: 634614 - DNA, 25 bp, Mus musculus
gggccaccagtgcagtcaatgtgct

SEQ ID NO: 634615 - DNA, 25 bp, Mus musculus
gggccaccagtggagtcaatgtgct

SEQ ID NO: 634616 - DNA, 25 bp, Mus musculus
gggccacccgcacattaatggacat

SEQ ID NO: 634617 - DNA, 25 bp, Mus musculus
gggccacccgcagattaatggacat

SEQ ID NO: 634618 - DNA, 25 bp, Mus musculus
gggccaccgaggacgccatgattaa

SEQ ID NO: 634619 - DNA, 25 bp, Mus musculus
gggccaccgaggtcgccatgattaa

SEQ ID NO: 634620 - DNA, 25 bp, Mus musculus
gggccaccgttaagcaatgttcagc

SEQ ID NO: 634621 - DNA, 25 bp, Mus musculus
gggccaccgttatgcaatgttcagc

SEQ ID NO: 634622 - DNA, 25 bp, Mus musculus
gggccacctaaaaggtcgcaatgga

SEQ ID NO: 634623 - DNA, 25 bp, Mus musculus
gggccacctaaatggtcgcaatgga

SEQ ID NO: 634624 - DNA, 25 bp, Mus musculus
gggccacctaatagacaacctactt

SEQ ID NO: 634625 - DNA, 25 bp, Mus musculus
gggccacctaattgacaacctactt

SEQ ID NO: 634626 - DNA, 25 bp, Mus musculus
gggccacctctacatttgcggagat

SEQ ID NO: 634627 - DNA, 25 bp, Mus musculus
gggccacctctagatttgcggagat

SEQ ID NO: 634628 - DNA, 25 bp, Mus musculus
gggccacctctgagtaaacgctggg

SEQ ID NO: 634629 - DNA, 25 bp, Mus musculus
gggccacctctgtgtaaacgctggg

SEQ ID NO: 634630 - DNA, 25 bp, Mus musculus
gggccacctggaaagtagtctcctg

SEQ ID NO: 634631 - DNA, 25 bp, Mus musculus
gggccacctggatagtagtctcctg

SEQ ID NO: 634632 - DNA, 25 bp, Mus musculus
gggccacctggcaggacactaacaa

SEQ ID NO: 634633 - DNA, 25 bp, Mus musculus
gggccacctggctggacactaacaa

SEQ ID NO: 634634 - DNA, 25 bp, Mus musculus
gggccacctgttagcttatccttct

SEQ ID NO: 634635 - DNA, 25 bp, Mus musculus
gggccacctgtttgcttatccttct

SEQ ID NO: 634636 - DNA, 25 bp, Mus musculus
gggccaccttggattaattcctagc

SEQ ID NO: 634637 - DNA, 25 bp, Mus musculus
gggccaccttggtttaattcctagc

SEQ ID NO: 634638 - DNA, 25 bp, Mus musculus
gggccaccttgtccttgtgaatcag

SEQ ID NO: 634639 - DNA, 25 bp, Mus musculus
gggccaccttgtgcttgtgaatcag

SEQ ID NO: 634640 - DNA, 25 bp, Mus musculus
gggccacgaattacctctgggagaa

SEQ ID NO: 634641 - DNA, 25 bp, Mus musculus
gggccacgaatttcctctgggagaa

SEQ ID NO: 634642 - DNA, 25 bp, Mus musculus
gggccacgatgcagtcatagttaag

SEQ ID NO: 634643 - DNA, 25 bp, Mus musculus
gggccacgatgctgtcatagttaag

SEQ ID NO: 634644 - DNA, 25 bp, Mus musculus
gggccacgcagtaaatatttcagac

SEQ ID NO: 634645 - DNA, 25 bp, Mus musculus
gggccacgcagttaatatttcagac

SEQ ID NO: 634646 - DNA, 25 bp, Mus musculus
gggccacgcctgcaaaggaaatcct

SEQ ID NO: 634647 - DNA, 25 bp, Mus musculus
gggccacgcctggaaaggaaatcct

SEQ ID NO: 634648 - DNA, 25 bp, Mus musculus
gggccacggatacctgtgtgtcctc

SEQ ID NO: 634649 - DNA, 25 bp, Mus musculus
gggccacggatagctgtgtgtcctc

SEQ ID NO: 634650 - DNA, 25 bp, Mus musculus
gggccacgtcccactgtttcactgg

SEQ ID NO: 634651 - DNA, 25 bp, Mus musculus
gggccacgtccctctgtttcactgg

SEQ ID NO: 634652 - DNA, 25 bp, Mus musculus
gggccactacctagagcagaagcgg

SEQ ID NO: 634653 - DNA, 25 bp, Mus musculus
gggccactaccttgagcagaagcgg

SEQ ID NO: 634654 - DNA, 25 bp, Mus musculus
gggccactacgtatatattttagat

SEQ ID NO: 634655 - DNA, 25 bp, Mus musculus
gggccactacgtttatattttagat

SEQ ID NO: 634656 - DNA, 25 bp, Mus musculus
gggccactagcaccttgtgtgtgtc

SEQ ID NO: 634657 - DNA, 25 bp, Mus musculus
gggccactagcagcttgtgtgtgtc

SEQ ID NO: 634658 - DNA, 25 bp, Mus musculus
gggccactagccagaatattgtgct

SEQ ID NO: 634659 - DNA, 25 bp, Mus musculus
gggccactagcctgaatattgtgct

SEQ ID NO: 634660 - DNA, 25 bp, Mus musculus
gggccactattaatcctcttattga

SEQ ID NO: 634661 - DNA, 25 bp, Mus musculus
gggccactattattcctcttattga

SEQ ID NO: 634662 - DNA, 25 bp, Mus musculus
gggccactatttcgtgagagacagt

SEQ ID NO: 634663 - DNA, 25 bp, Mus musculus
gggccactatttggtgagagacagt

SEQ ID NO: 634664 - DNA, 25 bp, Mus musculus
gggccactcaggcagacaacagaga

SEQ ID NO: 634665 - DNA, 25 bp, Mus musculus
gggccactcagggagacaacagaga

SEQ ID NO: 634666 - DNA, 25 bp, Mus musculus
gggccactccttcgtaaaagtctgc

SEQ ID NO: 634667 - DNA, 25 bp, Mus musculus
gggccactccttggtaaaagtctgc

SEQ ID NO: 634668 - DNA, 25 bp, Mus musculus
gggccactctggatatgcacagtca

SEQ ID NO: 634669 - DNA, 25 bp, Mus musculus
gggccactctggttatgcacagtca

SEQ ID NO: 634670 - DNA, 25 bp, Mus musculus
gggccactgaggaaagcatttgtta

SEQ ID NO: 634671 - DNA, 25 bp, Mus musculus
gggccactgaggatgcttctaacat

SEQ ID NO: 634672 - DNA, 25 bp, Mus musculus
gggccactgaggtaagcatttgtta

SEQ ID NO: 634673 - DNA, 25 bp, Mus musculus
gggccactgaggttgcttctaacat

SEQ ID NO: 634674 - DNA, 25 bp, Mus musculus
gggccactgagtcagagtccagcca

SEQ ID NO: 634675 - DNA, 25 bp, Mus musculus
gggccactgagtgagagtccagcca

SEQ ID NO: 634676 - DNA, 25 bp, Mus musculus
gggccactgatcaacagtctttgtt

SEQ ID NO: 634677 - DNA, 25 bp, Mus musculus
gggccactgatctacagtctttgtt

SEQ ID NO: 634678 - DNA, 25 bp, Mus musculus
gggccactgatgagagaaacagctt

SEQ ID NO: 634679 - DNA, 25 bp, Mus musculus
gggccactgatgtgagaaacagctt

SEQ ID NO: 634680 - DNA, 25 bp, Mus musculus
gggccactgtacaacagccagcaag

SEQ ID NO: 634681 - DNA, 25 bp, Mus musculus
gggccactgtactacagccagcaag

SEQ ID NO: 634682 - DNA, 25 bp, Mus musculus
gggccactgtagcatctcaactatg

SEQ ID NO: 634683 - DNA, 25 bp, Mus musculus
gggccactgtaggatctcaactatg

SEQ ID NO: 634684 - DNA, 25 bp, Mus musculus
gggccactgtcaaccacacaggaag

SEQ ID NO: 634685 - DNA, 25 bp, Mus musculus
gggccactgtcatccacacaggaag

SEQ ID NO: 634686 - DNA, 25 bp, Mus musculus
gggccactgtctacctggcaaagga

SEQ ID NO: 634687 - DNA, 25 bp, Mus musculus
gggccactgtcttcctggcaaagga

SEQ ID NO: 634688 - DNA, 25 bp, Mus musculus
gggccactgtgacatccgcatgcgc

SEQ ID NO: 634689 - DNA, 25 bp, Mus musculus
gggccactgtgagatccgcatgcgc

SEQ ID NO: 634690 - DNA, 25 bp, Mus musculus
gggccactgttcactaggaatgttt

SEQ ID NO: 634691 - DNA, 25 bp, Mus musculus
gggccactgttctctaggaatgttt

SEQ ID NO: 634692 - DNA, 25 bp, Mus musculus
gggccactgtttacagattgggttc

SEQ ID NO: 634693 - DNA, 25 bp, Mus musculus
gggccactgttttcagattgggttc

SEQ ID NO: 634694 - DNA, 25 bp, Mus musculus
gggccacttagactgtatgacttga

SEQ ID NO: 634695 - DNA, 25 bp, Mus musculus
gggccacttagagtgtatgacttga

SEQ ID NO: 634696 - DNA, 25 bp, Mus musculus
gggccacttagcatcagtacagtta

SEQ ID NO: 634697 - DNA, 25 bp, Mus musculus
gggccacttagcttcagtacagtta

SEQ ID NO: 634698 - DNA, 25 bp, Mus musculus
gggccactttatattgagtccattc

SEQ ID NO: 634699 - DNA, 25 bp, Mus musculus
gggccactttattttgagtccattc

SEQ ID NO: 634700 - DNA, 25 bp, Mus musculus
gggccactttggatgaggctttcat

SEQ ID NO: 634701 - DNA, 25 bp, Mus musculus
gggccactttggttgaggctttcat

SEQ ID NO: 634702 - DNA, 25 bp, Mus musculus
gggccagaaagacgagaatgaccta

SEQ ID NO: 634703 - DNA, 25 bp, Mus musculus
gggccagaaagaggagaatgaccta

SEQ ID NO: 634704 - DNA, 25 bp, Mus musculus
gggccagaacatatcctctgagtcc

SEQ ID NO: 634705 - DNA, 25 bp, Mus musculus
gggccagaacatttcctctgagtcc

SEQ ID NO: 634706 - DNA, 25 bp, Mus musculus
gggccagaacctctccctaggacag

SEQ ID NO: 634707 - DNA, 25 bp, Mus musculus
gggccagaacctgtccctaggacag

SEQ ID NO: 634708 - DNA, 25 bp, Mus musculus
gggccagaactccataaggacttct

SEQ ID NO: 634709 - DNA, 25 bp, Mus musculus
gggccagaactcgataaggacttct

SEQ ID NO: 634710 - DNA, 25 bp, Mus musculus
gggccagaaggtcacaaagtacaaa

SEQ ID NO: 634711 - DNA, 25 bp, Mus musculus
gggccagaaggtgacaaagtacaaa

SEQ ID NO: 634712 - DNA, 25 bp, Mus musculus
gggccagaagtgacgcagcatgtcc

SEQ ID NO: 634713 - DNA, 25 bp, Mus musculus
gggccagaagtgtcgcagcatgtcc

SEQ ID NO: 634714 - DNA, 25 bp, Mus musculus
gggccagaattcaagttcccttaat

SEQ ID NO: 634715 - DNA, 25 bp, Mus musculus
gggccagaattctagttcccttaat

SEQ ID NO: 634716 - DNA, 25 bp, Mus musculus
gggccagacaaacactcggccaagg

SEQ ID NO: 634717 - DNA, 25 bp, Mus musculus
gggccagacaaagactcggccaagg

SEQ ID NO: 634718 - DNA, 25 bp, Mus musculus
gggccagacaagaaggtatccggaa

SEQ ID NO: 634719 - DNA, 25 bp, Mus musculus
gggccagacaagtaggtatccggaa

SEQ ID NO: 634720 - DNA, 25 bp, Mus musculus
gggccagacgagctaatgagtaacc

SEQ ID NO: 634721 - DNA, 25 bp, Mus musculus
gggccagacgaggtaatgagtaacc

SEQ ID NO: 634722 - DNA, 25 bp, Mus musculus
gggccagactaaagcataaaactta

SEQ ID NO: 634723 - DNA, 25 bp, Mus musculus
gggccagactaatgcataaaactta

SEQ ID NO: 634724 - DNA, 25 bp, Mus musculus
gggccagactgaattactgccttca

SEQ ID NO: 634725 - DNA, 25 bp, Mus musculus
gggccagactgatttactgccttca

SEQ ID NO: 634726 - DNA, 25 bp, Mus musculus
gggccagactgcaagctcaggtcct

SEQ ID NO: 634727 - DNA, 25 bp, Mus musculus
gggccagactgctagctcaggtcct

SEQ ID NO: 634728 - DNA, 25 bp, Mus musculus
gggccagacttgactctacagtatt

SEQ ID NO: 634729 - DNA, 25 bp, Mus musculus
gggccagacttgtctctacagtatt

SEQ ID NO: 634730 - DNA, 25 bp, Mus musculus
gggccagagaaacataccatctgtg

SEQ ID NO: 634731 - DNA, 25 bp, Mus musculus
gggccagagaaagataccatctgtg

SEQ ID NO: 634732 - DNA, 25 bp, Mus musculus
gggccagagagacccttgccttcct

SEQ ID NO: 634733 - DNA, 25 bp, Mus musculus
gggccagagagagccttgccttcct

SEQ ID NO: 634734 - DNA, 25 bp, Mus musculus
gggccagagccacgacaatacagtg

SEQ ID NO: 634735 - DNA, 25 bp, Mus musculus
gggccagagccaggacaatacagtg

SEQ ID NO: 634736 - DNA, 25 bp, Mus musculus
gggccagagccccagcagtagactc

SEQ ID NO: 634737 - DNA, 25 bp, Mus musculus
gggccagagcccgagcagtagactc

SEQ ID NO: 634738 - DNA, 25 bp, Mus musculus
gggccagatcgcatttgatgacttc

SEQ ID NO: 634739 - DNA, 25 bp, Mus musculus
gggccagatcgcttttgatgacttc

SEQ ID NO: 634740 - DNA, 25 bp, Mus musculus
gggccagatcgtcagaagcttcagt

SEQ ID NO: 634741 - DNA, 25 bp, Mus musculus
gggccagatcgtgagaagcttcagt

SEQ ID NO: 634742 - DNA, 25 bp, Mus musculus
gggccagatcttagggcctctggta

SEQ ID NO: 634743 - DNA, 25 bp, Mus musculus
gggccagatctttgggcctctggta

SEQ ID NO: 634744 - DNA, 25 bp, Mus musculus
gggccagattaactttgctacacaa

SEQ ID NO: 634745 - DNA, 25 bp, Mus musculus
gggccagattaagtttgctacacaa

SEQ ID NO: 634746 - DNA, 25 bp, Mus musculus
gggccagattcgagctcacctagag

SEQ ID NO: 634747 - DNA, 25 bp, Mus musculus
gggccagattcgtgctcacctagag

SEQ ID NO: 634748 - DNA, 25 bp, Mus musculus
gggccagcaaatccgaatgaacctt

SEQ ID NO: 634749 - DNA, 25 bp, Mus musculus
gggccagcaaatgcgaatgaacctt

SEQ ID NO: 634750 - DNA, 25 bp, Mus musculus
gggccagcaaccacagtgagcagat

SEQ ID NO: 634751 - DNA, 25 bp, Mus musculus
gggccagcaacctcagtgagcagat

SEQ ID NO: 634752 - DNA, 25 bp, Mus musculus
gggccagcacaaaattcctcagcaa

SEQ ID NO: 634753 - DNA, 25 bp, Mus musculus
gggccagcacaatattcctcagcaa

SEQ ID NO: 634754 - DNA, 25 bp, Mus musculus
gggccagcaccaagactcacggaaa

SEQ ID NO: 634755 - DNA, 25 bp, Mus musculus
gggccagcaccatgactcacggaaa

SEQ ID NO: 634756 - DNA, 25 bp, Mus musculus
gggccagcactcatagctttgataa

SEQ ID NO: 634757 - DNA, 25 bp, Mus musculus
gggccagcactcttagctttgataa

SEQ ID NO: 634758 - DNA, 25 bp, Mus musculus
gggccagcagatcatcctcacgggc

SEQ ID NO: 634759 - DNA, 25 bp, Mus musculus
gggccagcagatgatcctcacgggc

SEQ ID NO: 634760 - DNA, 25 bp, Mus musculus
gggccagcagtgcagattcactttt

SEQ ID NO: 634761 - DNA, 25 bp, Mus musculus
gggccagcagtggagattcactttt

SEQ ID NO: 634762 - DNA, 25 bp, Mus musculus
gggccagccaagaatctatgtgcaa

SEQ ID NO: 634763 - DNA, 25 bp, Mus musculus
gggccagccaagtatctatgtgcaa

SEQ ID NO: 634764 - DNA, 25 bp, Mus musculus
gggccagccagtcctatgcaagaac

SEQ ID NO: 634765 - DNA, 25 bp, Mus musculus
gggccagccagtgctatgcaagaac

SEQ ID NO: 634766 - DNA, 25 bp, Mus musculus
gggccagcccgtagtagaatgtctg

SEQ ID NO: 634767 - DNA, 25 bp, Mus musculus
gggccagcccgttgtagaatgtctg

SEQ ID NO: 634768 - DNA, 25 bp, Mus musculus
gggccagcctagactgaaaccttct

SEQ ID NO: 634769 - DNA, 25 bp, Mus musculus
gggccagcctagtctgaaaccttct

SEQ ID NO: 634770 - DNA, 25 bp, Mus musculus
gggccagccttaaagagaggctcta

SEQ ID NO: 634771 - DNA, 25 bp, Mus musculus
gggccagccttatagagaggctcta

SEQ ID NO: 634772 - DNA, 25 bp, Mus musculus
gggccagccttcatggaccatagag

SEQ ID NO: 634773 - DNA, 25 bp, Mus musculus
gggccagccttcttggaccatagag

SEQ ID NO: 634774 - DNA, 25 bp, Mus musculus
gggccagctatcctaatatacacag

SEQ ID NO: 634775 - DNA, 25 bp, Mus musculus
gggccagctatcgtaatatacacag

SEQ ID NO: 634776 - DNA, 25 bp, Mus musculus
gggccagctcaactttaagtttcat

SEQ ID NO: 634777 - DNA, 25 bp, Mus musculus
gggccagctcaagtttaagtttcat

SEQ ID NO: 634778 - DNA, 25 bp, Mus musculus
gggccagctgggatttattagataa

SEQ ID NO: 634779 - DNA, 25 bp, Mus musculus
gggccagctgggttttattagataa

SEQ ID NO: 634780 - DNA, 25 bp, Mus musculus
gggccagctggtctagaaagcattt

SEQ ID NO: 634781 - DNA, 25 bp, Mus musculus
gggccagctggtgtagaaagcattt

SEQ ID NO: 634782 - DNA, 25 bp, Mus musculus
gggccagcttgaagctttaatcttg

SEQ ID NO: 634783 - DNA, 25 bp, Mus musculus
gggccagcttgatgctttaatcttg

SEQ ID NO: 634784 - DNA, 25 bp, Mus musculus
gggccaggaaagaacctcctgtatt

SEQ ID NO: 634785 - DNA, 25 bp, Mus musculus
gggccaggaaagtacctcctgtatt

SEQ ID NO: 634786 - DNA, 25 bp, Mus musculus
gggccaggacagcagcctttcactg

SEQ ID NO: 634787 - DNA, 25 bp, Mus musculus
gggccaggacaggagcctttcactg

SEQ ID NO: 634788 - DNA, 25 bp, Mus musculus
gggccaggactgaacttctcaatgt

SEQ ID NO: 634789 - DNA, 25 bp, Mus musculus
gggccaggactgaggtgacaaccct

SEQ ID NO: 634790 - DNA, 25 bp, Mus musculus
gggccaggactgtacttctcaatgt

SEQ ID NO: 634791 - DNA, 25 bp, Mus musculus
gggccaggactgtggtgacaaccct

SEQ ID NO: 634792 - DNA, 25 bp, Mus musculus
gggccaggagacagacaagctcaaa

SEQ ID NO: 634793 - DNA, 25 bp, Mus musculus
gggccaggagactgacaagctcaaa

SEQ ID NO: 634794 - DNA, 25 bp, Mus musculus
gggccaggagcaaggctccatgata

SEQ ID NO: 634795 - DNA, 25 bp, Mus musculus
gggccaggagcatggctccatgata

SEQ ID NO: 634796 - DNA, 25 bp, Mus musculus
gggccaggagccacggtgcacacca

SEQ ID NO: 634797 - DNA, 25 bp, Mus musculus
gggccaggagcctcggtgcacacca

SEQ ID NO: 634798 - DNA, 25 bp, Mus musculus
gggccaggataacttagctgaaaac

SEQ ID NO: 634799 - DNA, 25 bp, Mus musculus
gggccaggataagttagctgaaaac

SEQ ID NO: 634800 - DNA, 25 bp, Mus musculus
gggccaggatgacagccacaccatt

SEQ ID NO: 634801 - DNA, 25 bp, Mus musculus
gggccaggatgagagccacaccatt

SEQ ID NO: 634802 - DNA, 25 bp, Mus musculus
gggccaggattcatgctttcatgct

SEQ ID NO: 634803 - DNA, 25 bp, Mus musculus
gggccaggattcttgctttcatgct

SEQ ID NO: 634804 - DNA, 25 bp, Mus musculus
gggccaggcacaatggataccacct

SEQ ID NO: 634805 - DNA, 25 bp, Mus musculus
gggccaggcacattggataccacct

SEQ ID NO: 634806 - DNA, 25 bp, Mus musculus
gggccaggcctgctcacaactaaag

SEQ ID NO: 634807 - DNA, 25 bp, Mus musculus
gggccaggcctggtcacaactaaag

SEQ ID NO: 634808 - DNA, 25 bp, Mus musculus
gggccagggaacactctaggtcatg

SEQ ID NO: 634809 - DNA, 25 bp, Mus musculus
gggccagggaactctctaggtcatg

SEQ ID NO: 634810 - DNA, 25 bp, Mus musculus
gggccagggaagagtgaaggtgtgt

SEQ ID NO: 634811 - DNA, 25 bp, Mus musculus
gggccagggaagtgtgaaggtgtgt

SEQ ID NO: 634812 - DNA, 25 bp, Mus musculus
gggccagggcataggtttctgccat

SEQ ID NO: 634813 - DNA, 25 bp, Mus musculus
gggccagggcattggtttctgccat

SEQ ID NO: 634814 - DNA, 25 bp, Mus musculus
gggccagggctacgcaggctttctt

SEQ ID NO: 634815 - DNA, 25 bp, Mus musculus
gggccagggctaggcaggctttctt

SEQ ID NO: 634816 - DNA, 25 bp, Mus musculus
gggccagggtacacaactacccaag

SEQ ID NO: 634817 - DNA, 25 bp, Mus musculus
gggccagggtactcaactacccaag

SEQ ID NO: 634818 - DNA, 25 bp, Mus musculus
gggccagggtttcgtcttatcaaca

SEQ ID NO: 634819 - DNA, 25 bp, Mus musculus
gggccagggtttggtcttatcaaca

SEQ ID NO: 634820 - DNA, 25 bp, Mus musculus
gggccaggtcacattgttaagagta

SEQ ID NO: 634821 - DNA, 25 bp, Mus musculus
gggccaggtcactttgttaagagta

SEQ ID NO: 634822 - DNA, 25 bp, Mus musculus
gggccaggtcagaaccaatgaagaa

SEQ ID NO: 634823 - DNA, 25 bp, Mus musculus
gggccaggtcagtaccaatgaagaa

SEQ ID NO: 634824 - DNA, 25 bp, Mus musculus
gggccaggtgcacataattcagttc

SEQ ID NO: 634825 - DNA, 25 bp, Mus musculus
gggccaggtgcagataattcagttc

SEQ ID NO: 634826 - DNA, 25 bp, Mus musculus
gggccaggtgtcagcactttgttct

SEQ ID NO: 634827 - DNA, 25 bp, Mus musculus
gggccaggtgtctgcactttgttct

SEQ ID NO: 634828 - DNA, 25 bp, Mus musculus
gggccaggttctctccagcaaacag

SEQ ID NO: 634829 - DNA, 25 bp, Mus musculus
gggccaggttctgtccagcaaacag

SEQ ID NO: 634830 - DNA, 25 bp, Mus musculus
gggccagtaccaatcgtctgcttac

SEQ ID NO: 634831 - DNA, 25 bp, Mus musculus
gggccagtaccattcgtctgcttac

SEQ ID NO: 634832 - DNA, 25 bp, Mus musculus
gggccagtacttaggagagcttgcc

SEQ ID NO: 634833 - DNA, 25 bp, Mus musculus
gggccagtactttggagagcttgcc

SEQ ID NO: 634834 - DNA, 25 bp, Mus musculus
gggccagtagaccaaatccaacctt

SEQ ID NO: 634835 - DNA, 25 bp, Mus musculus
gggccagtagacgaaatccaacctt

SEQ ID NO: 634836 - DNA, 25 bp, Mus musculus
gggccagtagccacctgactaaagt

SEQ ID NO: 634837 - DNA, 25 bp, Mus musculus
gggccagtagcctcctgactaaagt

SEQ ID NO: 634838 - DNA, 25 bp, Mus musculus
gggccagtagcgacttgcgactaga

SEQ ID NO: 634839 - DNA, 25 bp, Mus musculus
gggccagtagcgtcttgcgactaga

SEQ ID NO: 634840 - DNA, 25 bp, Mus musculus
gggccagtcaagactctcgtgagca

SEQ ID NO: 634841 - DNA, 25 bp, Mus musculus
gggccagtcaagtctctcgtgagca

SEQ ID NO: 634842 - DNA, 25 bp, Mus musculus
gggccagtccatcttccttaaggtt

SEQ ID NO: 634843 - DNA, 25 bp, Mus musculus
gggccagtccatgttccttaaggtt

SEQ ID NO: 634844 - DNA, 25 bp, Mus musculus
gggccagtcgagagcaaaagtcctt

SEQ ID NO: 634845 - DNA, 25 bp, Mus musculus
gggccagtcgagtgcaaaagtcctt

SEQ ID NO: 634846 - DNA, 25 bp, Mus musculus
gggccagtgaacaacctatttataa

SEQ ID NO: 634847 - DNA, 25 bp, Mus musculus
gggccagtgaactacctatttataa

SEQ ID NO: 634848 - DNA, 25 bp, Mus musculus
gggccagtgtagaccaggccacttg

SEQ ID NO: 634849 - DNA, 25 bp, Mus musculus
gggccagtgtagagccttcggtcca

SEQ ID NO: 634850 - DNA, 25 bp, Mus musculus
gggccagtgtagtccaggccacttg

SEQ ID NO: 634851 - DNA, 25 bp, Mus musculus
gggccagtgtagtgccttcggtcca

SEQ ID NO: 634852 - DNA, 25 bp, Mus musculus
gggccagttactatttagcactttg

SEQ ID NO: 634853 - DNA, 25 bp, Mus musculus
gggccagttactttttagcactttg

SEQ ID NO: 634854 - DNA, 25 bp, Mus musculus
gggccagttcaaaggccacaccaga

SEQ ID NO: 634855 - DNA, 25 bp, Mus musculus
gggccagttcaatggccacaccaga

SEQ ID NO: 634856 - DNA, 25 bp, Mus musculus
gggccagttcatagcaaagttgtac

SEQ ID NO: 634857 - DNA, 25 bp, Mus musculus
gggccagttcattgcaaagttgtac

SEQ ID NO: 634858 - DNA, 25 bp, Mus musculus
gggccagttccaccaagcataaggt

SEQ ID NO: 634859 - DNA, 25 bp, Mus musculus
gggccagttccagcaagcataaggt

SEQ ID NO: 634860 - DNA, 25 bp, Mus musculus
gggccagttggaaagcttaacagac

SEQ ID NO: 634861 - DNA, 25 bp, Mus musculus
gggccagttggatagcttaacagac

SEQ ID NO: 634862 - DNA, 25 bp, Mus musculus
gggccagtttatctaccgctattta

SEQ ID NO: 634863 - DNA, 25 bp, Mus musculus
gggccagtttatgtaccgctattta

SEQ ID NO: 634864 - DNA, 25 bp, Mus musculus
gggccagtttcgacgtcaatgtctt

SEQ ID NO: 634865 - DNA, 25 bp, Mus musculus
gggccagtttcgtcgtcaatgtctt

SEQ ID NO: 634866 - DNA, 25 bp, Mus musculus
gggccataaacgcaattttgactga

SEQ ID NO: 634867 - DNA, 25 bp, Mus musculus
gggccataaacggaattttgactga

SEQ ID NO: 634868 - DNA, 25 bp, Mus musculus
gggccataaatacagaaccttgtgt

SEQ ID NO: 634869 - DNA, 25 bp, Mus musculus
gggccataaatagagaaccttgtgt

SEQ ID NO: 634870 - DNA, 25 bp, Mus musculus
gggccataacagatggttttgcaca

SEQ ID NO: 634871 - DNA, 25 bp, Mus musculus
gggccataacagttggttttgcaca

SEQ ID NO: 634872 - DNA, 25 bp, Mus musculus
gggccataagctcggaattgcctta

SEQ ID NO: 634873 - DNA, 25 bp, Mus musculus
gggccataagctgggaattgcctta

SEQ ID NO: 634874 - DNA, 25 bp, Mus musculus
gggccataagttcaccgtaggtcat

SEQ ID NO: 634875 - DNA, 25 bp, Mus musculus
gggccataagttgaccgtaggtcat

SEQ ID NO: 634876 - DNA, 25 bp, Mus musculus
gggccataatagaggtcagtcttag

SEQ ID NO: 634877 - DNA, 25 bp, Mus musculus
gggccataatagtggtcagtcttag

SEQ ID NO: 634878 - DNA, 25 bp, Mus musculus
gggccataatggagtccgttcctgc

SEQ ID NO: 634879 - DNA, 25 bp, Mus musculus
gggccataatggtgtccgttcctgc

SEQ ID NO: 634880 - DNA, 25 bp, Mus musculus
gggccatacaaactgatacctcaga

SEQ ID NO: 634881 - DNA, 25 bp, Mus musculus
gggccatacaaagtgatacctcaga

SEQ ID NO: 634882 - DNA, 25 bp, Mus musculus
gggccatactctcttctatatatat

SEQ ID NO: 634883 - DNA, 25 bp, Mus musculus
gggccatactctgttctatatatat

SEQ ID NO: 634884 - DNA, 25 bp, Mus musculus
gggccatagtacaatctcattttct

SEQ ID NO: 634885 - DNA, 25 bp, Mus musculus
gggccatagtactatctcattttct

SEQ ID NO: 634886 - DNA, 25 bp, Mus musculus
gggccatatatccagcagtttttga

SEQ ID NO: 634887 - DNA, 25 bp, Mus musculus
gggccatatatcgagcagtttttga

SEQ ID NO: 634888 - DNA, 25 bp, Mus musculus
gggccatatctgaattaactggatc

SEQ ID NO: 634889 - DNA, 25 bp, Mus musculus
gggccatatctgtattaactggatc

SEQ ID NO: 634890 - DNA, 25 bp, Mus musculus
gggccatcaactcagccgctgaagg

SEQ ID NO: 634891 - DNA, 25 bp, Mus musculus
gggccatcaactgagccgctgaagg

SEQ ID NO: 634892 - DNA, 25 bp, Mus musculus
gggccatcacctaagatttatttct

SEQ ID NO: 634893 - DNA, 25 bp, Mus musculus
gggccatcaccttagatttatttct

SEQ ID NO: 634894 - DNA, 25 bp, Mus musculus
gggccatcactgacagagggacaag

SEQ ID NO: 634895 - DNA, 25 bp, Mus musculus
gggccatcactgtcagagggacaag

SEQ ID NO: 634896 - DNA, 25 bp, Mus musculus
gggccatcagagacctgctctccaa

SEQ ID NO: 634897 - DNA, 25 bp, Mus musculus
gggccatcagagtcctgctctccaa

SEQ ID NO: 634898 - DNA, 25 bp, Mus musculus
gggccatcagcaactcaagacttta

SEQ ID NO: 634899 - DNA, 25 bp, Mus musculus
gggccatcagcatctcaagacttta

SEQ ID NO: 634900 - DNA, 25 bp, Mus musculus
gggccatcagcgaaagtctgtatga

SEQ ID NO: 634901 - DNA, 25 bp, Mus musculus
gggccatcagcgtaagtctgtatga

SEQ ID NO: 634902 - DNA, 25 bp, Mus musculus
gggccatcatctaacagatccttaa

SEQ ID NO: 634903 - DNA, 25 bp, Mus musculus
gggccatcatcttacagatccttaa

SEQ ID NO: 634904 - DNA, 25 bp, Mus musculus
gggccatccatgaagagtgctctga

SEQ ID NO: 634905 - DNA, 25 bp, Mus musculus
gggccatccatgtagagtgctctga

SEQ ID NO: 634906 - DNA, 25 bp, Mus musculus
gggccatccccaagcaagagtcatg

SEQ ID NO: 634907 - DNA, 25 bp, Mus musculus
gggccatccccatgcaagagtcatg

SEQ ID NO: 634908 - DNA, 25 bp, Mus musculus
gggccatcgattcccaagatcatgg

SEQ ID NO: 634909 - DNA, 25 bp, Mus musculus
gggccatcgattgccaagatcatgg

SEQ ID NO: 634910 - DNA, 25 bp, Mus musculus
gggccatcggacactaacacagcaa

SEQ ID NO: 634911 - DNA, 25 bp, Mus musculus
gggccatcggactctaacacagcaa

SEQ ID NO: 634912 - DNA, 25 bp, Mus musculus
gggccatctacgatttgtcactatc

SEQ ID NO: 634913 - DNA, 25 bp, Mus musculus
gggccatctacgttttgtcactatc

SEQ ID NO: 634914 - DNA, 25 bp, Mus musculus
gggccatctgcgcaaaacgctcgga

SEQ ID NO: 634915 - DNA, 25 bp, Mus musculus
gggccatctgcggaaaacgctcgga

SEQ ID NO: 634916 - DNA, 25 bp, Mus musculus
gggccatctgtcatgctacatatat

SEQ ID NO: 634917 - DNA, 25 bp, Mus musculus
gggccatctgtcttgctacatatat

SEQ ID NO: 634918 - DNA, 25 bp, Mus musculus
gggccatgaaagctttcctccaggc

SEQ ID NO: 634919 - DNA, 25 bp, Mus musculus
gggccatgaaaggtttcctccaggc

SEQ ID NO: 634920 - DNA, 25 bp, Mus musculus
gggccatgaccaaaacgcatctaaa

SEQ ID NO: 634921 - DNA, 25 bp, Mus musculus
gggccatgaccataacgcatctaaa

SEQ ID NO: 634922 - DNA, 25 bp, Mus musculus
gggccatgagagctgtaatttttgt

SEQ ID NO: 634923 - DNA, 25 bp, Mus musculus
gggccatgagaggtgtaatttttgt

SEQ ID NO: 634924 - DNA, 25 bp, Mus musculus
gggccatgatagcacacaccgactc

SEQ ID NO: 634925 - DNA, 25 bp, Mus musculus
gggccatgataggacacaccgactc

SEQ ID NO: 634926 - DNA, 25 bp, Mus musculus
gggccatgatggaggcggccagcgt

SEQ ID NO: 634927 - DNA, 25 bp, Mus musculus
gggccatgatggtggcggccagcgt

SEQ ID NO: 634928 - DNA, 25 bp, Mus musculus
gggccatgcaggattctcaatacgg

SEQ ID NO: 634929 - DNA, 25 bp, Mus musculus
gggccatgcaggtttctcaatacgg

SEQ ID NO: 634930 - DNA, 25 bp, Mus musculus
gggccatgccccagggtctctggct

SEQ ID NO: 634931 - DNA, 25 bp, Mus musculus
gggccatgcccctgggtctctggct

SEQ ID NO: 634932 - DNA, 25 bp, Mus musculus
gggccatgcctacgtatagcataac

SEQ ID NO: 634933 - DNA, 25 bp, Mus musculus
gggccatgcctaggtatagcataac

SEQ ID NO: 634934 - DNA, 25 bp, Mus musculus
gggccatgcgcccatacaagcagga

SEQ ID NO: 634935 - DNA, 25 bp, Mus musculus
gggccatgcgccgatacaagcagga

SEQ ID NO: 634936 - DNA, 25 bp, Mus musculus
gggccatgcgctcgcctttgatcca

SEQ ID NO: 634937 - DNA, 25 bp, Mus musculus
gggccatgcgctggcctttgatcca

SEQ ID NO: 634938 - DNA, 25 bp, Mus musculus
gggccatgctatactccagggagtg

SEQ ID NO: 634939 - DNA, 25 bp, Mus musculus
gggccatgctattctccagggagtg

SEQ ID NO: 634940 - DNA, 25 bp, Mus musculus
gggccatggaatatctccttccatt

SEQ ID NO: 634941 - DNA, 25 bp, Mus musculus
gggccatggaatttctccttccatt

SEQ ID NO: 634942 - DNA, 25 bp, Mus musculus
gggccatggactaggtgtctagtaa

SEQ ID NO: 634943 - DNA, 25 bp, Mus musculus
gggccatggacttggtgtctagtaa

SEQ ID NO: 634944 - DNA, 25 bp, Mus musculus
gggccatggagcacaccaacagcaa

SEQ ID NO: 634945 - DNA, 25 bp, Mus musculus
gggccatggagctcaccaacagcaa

SEQ ID NO: 634946 - DNA, 25 bp, Mus musculus
gggccatggctaatttacatttcat

SEQ ID NO: 634947 - DNA, 25 bp, Mus musculus
gggccatggctattttacatttcat

SEQ ID NO: 634948 - DNA, 25 bp, Mus musculus
gggccatggtgcatgcagcattatg

SEQ ID NO: 634949 - DNA, 25 bp, Mus musculus
gggccatggtgcttgcagcattatg

SEQ ID NO: 634950 - DNA, 25 bp, Mus musculus
gggccatggttgaagctttctctca

SEQ ID NO: 634951 - DNA, 25 bp, Mus musculus
gggccatggttgtagctttctctca

SEQ ID NO: 634952 - DNA, 25 bp, Mus musculus
gggccatgtataattcatcaaacgg

SEQ ID NO: 634953 - DNA, 25 bp, Mus musculus
gggccatgtatatttcatcaaacgg

SEQ ID NO: 634954 - DNA, 25 bp, Mus musculus
gggccatgtcccatctattaaggac

SEQ ID NO: 634955 - DNA, 25 bp, Mus musculus
gggccatgtcccttctattaaggac

SEQ ID NO: 634956 - DNA, 25 bp, Mus musculus
gggccatgtccgcagagctgacttt

SEQ ID NO: 634957 - DNA, 25 bp, Mus musculus
gggccatgtccggagagctgacttt

SEQ ID NO: 634958 - DNA, 25 bp, Mus musculus
gggccatgtctaaggtatggagact

SEQ ID NO: 634959 - DNA, 25 bp, Mus musculus
gggccatgtctatggtatggagact

SEQ ID NO: 634960 - DNA, 25 bp, Mus musculus
gggccatgtgatagtactgctccag

SEQ ID NO: 634961 - DNA, 25 bp, Mus musculus
gggccatgtgattgtactgctccag

SEQ ID NO: 634962 - DNA, 25 bp, Mus musculus
gggccatgtgtcatgtctcaggatg

SEQ ID NO: 634963 - DNA, 25 bp, Mus musculus
gggccatgtgtcttgtctcaggatg

SEQ ID NO: 634964 - DNA, 25 bp, Mus musculus
gggccatgttcccattggcacaact

SEQ ID NO: 634965 - DNA, 25 bp, Mus musculus
gggccatgttccgattggcacaact

SEQ ID NO: 634966 - DNA, 25 bp, Mus musculus
gggccatgttggcttttttcattca

SEQ ID NO: 634967 - DNA, 25 bp, Mus musculus
gggccatgttgggttttttcattca

SEQ ID NO: 634968 - DNA, 25 bp, Mus musculus
gggccatgtttgatttcttggtact

SEQ ID NO: 634969 - DNA, 25 bp, Mus musculus
gggccatgtttgttttcttggtact

SEQ ID NO: 634970 - DNA, 25 bp, Mus musculus
gggccatgttttaaattgcattacg

SEQ ID NO: 634971 - DNA, 25 bp, Mus musculus
gggccatgtttttaattgcattacg

SEQ ID NO: 634972 - DNA, 25 bp, Mus musculus
gggccattacatattcaaacaacca

SEQ ID NO: 634973 - DNA, 25 bp, Mus musculus
gggccattacattttcaaacaacca

SEQ ID NO: 634974 - DNA, 25 bp, Mus musculus
gggccattaccgcagcagataccag

SEQ ID NO: 634975 - DNA, 25 bp, Mus musculus
gggccattaccggagcagataccag

SEQ ID NO: 634976 - DNA, 25 bp, Mus musculus
gggccattatgcaggcttgtaatcc

SEQ ID NO: 634977 - DNA, 25 bp, Mus musculus
gggccattatgctggcttgtaatcc

SEQ ID NO: 634978 - DNA, 25 bp, Mus musculus
gggccattcaataatcagttagcat

SEQ ID NO: 634979 - DNA, 25 bp, Mus musculus
gggccattcaattatcagttagcat

SEQ ID NO: 634980 - DNA, 25 bp, Mus musculus
gggccattcccaacaggcagatgaa

SEQ ID NO: 634981 - DNA, 25 bp, Mus musculus
gggccattcccaatgtgtgcaagga

SEQ ID NO: 634982 - DNA, 25 bp, Mus musculus
gggccattcccatcaggcagatgaa

SEQ ID NO: 634983 - DNA, 25 bp, Mus musculus
gggccattcccattgtgtgcaagga

SEQ ID NO: 634984 - DNA, 25 bp, Mus musculus
gggccattcctgcaacaatcgtgat

SEQ ID NO: 634985 - DNA, 25 bp, Mus musculus
gggccattcctggaacaatcgtgat

SEQ ID NO: 634986 - DNA, 25 bp, Mus musculus
gggccattcgaaagcagccttaaag

SEQ ID NO: 634987 - DNA, 25 bp, Mus musculus
gggccattcgaatgcagccttaaag

SEQ ID NO: 634988 - DNA, 25 bp, Mus musculus
gggccattgaagatttaatccgaga

SEQ ID NO: 634989 - DNA, 25 bp, Mus musculus
gggccattgaagttttaatccgaga

SEQ ID NO: 634990 - DNA, 25 bp, Mus musculus
gggccattgctgaatgctctttgtg

SEQ ID NO: 634991 - DNA, 25 bp, Mus musculus
gggccattgctgtatgctctttgtg

SEQ ID NO: 634992 - DNA, 25 bp, Mus musculus
gggccattggcccattttaacattc

SEQ ID NO: 634993 - DNA, 25 bp, Mus musculus
gggccattggccgattttaacattc

SEQ ID NO: 634994 - DNA, 25 bp, Mus musculus
gggccattggtcaattcaaagggcc

SEQ ID NO: 634995 - DNA, 25 bp, Mus musculus
gggccattggtctattcaaagggcc

SEQ ID NO: 634996 - DNA, 25 bp, Mus musculus
gggccattgtatcggtgtctccata

SEQ ID NO: 634997 - DNA, 25 bp, Mus musculus
gggccattgtatgggtgtctccata

SEQ ID NO: 634998 - DNA, 25 bp, Mus musculus
gggccattgtctcgtcaaaacttta

SEQ ID NO: 634999 - DNA, 25 bp, Mus musculus
gggccattgtctggtcaaaacttta

SEQ ID NO: 635000 - DNA, 25 bp, Mus musculus
gggccatttactactgcaaccagag

SEQ ID NO: 635001 - DNA, 25 bp, Mus musculus
gggccatttacttctgcaaccagag

SEQ ID NO: 635002 - DNA, 25 bp, Mus musculus
gggccatttagaatccacctatgct

SEQ ID NO: 635003 - DNA, 25 bp, Mus musculus
gggccatttagattccacctatgct

SEQ ID NO: 635004 - DNA, 25 bp, Mus musculus
gggccatttcccaggctgttgtgac

SEQ ID NO: 635005 - DNA, 25 bp, Mus musculus
gggccatttcccctctttgaataga

SEQ ID NO: 635006 - DNA, 25 bp, Mus musculus
gggccatttcccgtctttgaataga

SEQ ID NO: 635007 - DNA, 25 bp, Mus musculus
gggccatttccctggctgttgtgac

SEQ ID NO: 635008 - DNA, 25 bp, Mus musculus
gggcccaaaaagagctcaacagctt

SEQ ID NO: 635009 - DNA, 25 bp, Mus musculus
gggcccaaaaagtgctcaacagctt

SEQ ID NO: 635010 - DNA, 25 bp, Mus musculus
gggcccaaagacaaggtgaatccag

SEQ ID NO: 635011 - DNA, 25 bp, Mus musculus
gggcccaaagactaggtgaatccag

SEQ ID NO: 635012 - DNA, 25 bp, Mus musculus
gggcccaaagagagttcccataggt

SEQ ID NO: 635013 - DNA, 25 bp, Mus musculus
gggcccaaagagtgttcccataggt

SEQ ID NO: 635014 - DNA, 25 bp, Mus musculus
gggcccaaagctaccctttcctcat

SEQ ID NO: 635015 - DNA, 25 bp, Mus musculus
gggcccaaagcttccctttcctcat

SEQ ID NO: 635016 - DNA, 25 bp, Mus musculus
gggcccaaagtactgtagagtctag

SEQ ID NO: 635017 - DNA, 25 bp, Mus musculus
gggcccaaagtagtgtagagtctag

SEQ ID NO: 635018 - DNA, 25 bp, Mus musculus
gggcccaacctcaaggtattgggag

SEQ ID NO: 635019 - DNA, 25 bp, Mus musculus
gggcccaacctctaggtattgggag

SEQ ID NO: 635020 - DNA, 25 bp, Mus musculus
gggcccaaccttacaatcttggatt

SEQ ID NO: 635021 - DNA, 25 bp, Mus musculus
gggcccaacctttcaatcttggatt

SEQ ID NO: 635022 - DNA, 25 bp, Mus musculus
gggcccaacgaacgagccacttctg

SEQ ID NO: 635023 - DNA, 25 bp, Mus musculus
gggcccaacgaaggagccacttctg

SEQ ID NO: 635024 - DNA, 25 bp, Mus musculus
gggcccaactataggtgaatagaga

SEQ ID NO: 635025 - DNA, 25 bp, Mus musculus
gggcccaactattggtgaatagaga

SEQ ID NO: 635026 - DNA, 25 bp, Mus musculus
gggcccaactcacaaaagtcttcgt

SEQ ID NO: 635027 - DNA, 25 bp, Mus musculus
gggcccaactcagaaaagtcttcgt

SEQ ID NO: 635028 - DNA, 25 bp, Mus musculus
gggcccaagcagaaccaacactggt

SEQ ID NO: 635029 - DNA, 25 bp, Mus musculus
gggcccaagcagtaccaacactggt

SEQ ID NO: 635030 - DNA, 25 bp, Mus musculus
gggcccaagctacagccatagcaca

SEQ ID NO: 635031 - DNA, 25 bp, Mus musculus
gggcccaagctagagccatagcaca

SEQ ID NO: 635032 - DNA, 25 bp, Mus musculus
gggcccaatagaacctgctagatat

SEQ ID NO: 635033 - DNA, 25 bp, Mus musculus
gggcccaatagatcctgctagatat

SEQ ID NO: 635034 - DNA, 25 bp, Mus musculus
gggcccaatcatagaagagacagca

SEQ ID NO: 635035 - DNA, 25 bp, Mus musculus
gggcccaatcattgaagagacagca

SEQ ID NO: 635036 - DNA, 25 bp, Mus musculus
gggcccaatgtgctgccagtgttaa

SEQ ID NO: 635037 - DNA, 25 bp, Mus musculus
gggcccaatgtggtgccagtgttaa

SEQ ID NO: 635038 - DNA, 25 bp, Mus musculus
gggcccaatttgaactgctatagca

SEQ ID NO: 635039 - DNA, 25 bp, Mus musculus
gggcccaatttgtactgctatagca

SEQ ID NO: 635040 - DNA, 25 bp, Mus musculus
gggcccacaaatccctttatgggag

SEQ ID NO: 635041 - DNA, 25 bp, Mus musculus
gggcccacaaatgcctttatgggag

SEQ ID NO: 635042 - DNA, 25 bp, Mus musculus
gggcccacagcaatctaggcagaaa

SEQ ID NO: 635043 - DNA, 25 bp, Mus musculus
gggcccacagcattctaggcagaaa

SEQ ID NO: 635044 - DNA, 25 bp, Mus musculus
gggcccacagtgcatattccaataa

SEQ ID NO: 635045 - DNA, 25 bp, Mus musculus
gggcccacagtggatattccaataa

SEQ ID NO: 635046 - DNA, 25 bp, Mus musculus
gggcccacatctcaaagagcacata

SEQ ID NO: 635047 - DNA, 25 bp, Mus musculus
gggcccacatctgaaagagcacata

SEQ ID NO: 635048 - DNA, 25 bp, Mus musculus
gggcccacatggaataaggacagaa

SEQ ID NO: 635049 - DNA, 25 bp, Mus musculus
gggcccacatggtataaggacagaa

SEQ ID NO: 635050 - DNA, 25 bp, Mus musculus
gggcccacccctagacagagcagag

SEQ ID NO: 635051 - DNA, 25 bp, Mus musculus
gggcccaccccttgacagagcagag

SEQ ID NO: 635052 - DNA, 25 bp, Mus musculus
gggcccacctaacatgcagtgtaga

SEQ ID NO: 635053 - DNA, 25 bp, Mus musculus
gggcccacctaagatgcagtgtaga

SEQ ID NO: 635054 - DNA, 25 bp, Mus musculus
gggcccacggctacaagatcatgac

SEQ ID NO: 635055 - DNA, 25 bp, Mus musculus
gggcccacggcttcaagatcatgac

SEQ ID NO: 635056 - DNA, 25 bp, Mus musculus
gggcccacgtataaatcttatgtcc

SEQ ID NO: 635057 - DNA, 25 bp, Mus musculus
gggcccacgtattaatcttatgtcc

SEQ ID NO: 635058 - DNA, 25 bp, Mus musculus
gggcccactcccagttctgagaaaa

SEQ ID NO: 635059 - DNA, 25 bp, Mus musculus
gggcccactccctgttctgagaaaa

SEQ ID NO: 635060 - DNA, 25 bp, Mus musculus
gggcccactcgtatagaatggcttt

SEQ ID NO: 635061 - DNA, 25 bp, Mus musculus
gggcccactcgtttagaatggcttt

SEQ ID NO: 635062 - DNA, 25 bp, Mus musculus
gggcccactgaacggcatcttgggc

SEQ ID NO: 635063 - DNA, 25 bp, Mus musculus
gggcccactgaagggcatcttgggc

SEQ ID NO: 635064 - DNA, 25 bp, Mus musculus
gggcccacttctcagtttagaagac

SEQ ID NO: 635065 - DNA, 25 bp, Mus musculus
gggcccacttctgagtttagaagac

SEQ ID NO: 635066 - DNA, 25 bp, Mus musculus
gggcccacttttcagcaggcgcaga

SEQ ID NO: 635067 - DNA, 25 bp, Mus musculus
gggcccacttttgagcaggcgcaga

SEQ ID NO: 635068 - DNA, 25 bp, Mus musculus
gggcccagaagcatcagggagatct

SEQ ID NO: 635069 - DNA, 25 bp, Mus musculus
gggcccagaagcctctcaaatgctt

SEQ ID NO: 635070 - DNA, 25 bp, Mus musculus
gggcccagaagcgtctcaaatgctt

SEQ ID NO: 635071 - DNA, 25 bp, Mus musculus
gggcccagaagcttcagggagatct

SEQ ID NO: 635072 - DNA, 25 bp, Mus musculus
gggcccagaggtagattttagtttg

SEQ ID NO: 635073 - DNA, 25 bp, Mus musculus
gggcccagaggttgattttagtttg

SEQ ID NO: 635074 - DNA, 25 bp, Mus musculus
gggcccagagtaaaaatgctgcaag

SEQ ID NO: 635075 - DNA, 25 bp, Mus musculus
gggcccagagtataaatgctgcaag

SEQ ID NO: 635076 - DNA, 25 bp, Mus musculus
gggcccagcaagcagtcctgtctta

SEQ ID NO: 635077 - DNA, 25 bp, Mus musculus
gggcccagcaaggagtcctgtctta

SEQ ID NO: 635078 - DNA, 25 bp, Mus musculus
gggcccagcagccacatttgccttc

SEQ ID NO: 635079 - DNA, 25 bp, Mus musculus
gggcccagcagcgacatttgccttc

SEQ ID NO: 635080 - DNA, 25 bp, Mus musculus
gggcccagcagtcttccagaagccg

SEQ ID NO: 635081 - DNA, 25 bp, Mus musculus
gggcccagcagtgttccagaagccg

SEQ ID NO: 635082 - DNA, 25 bp, Mus musculus
gggcccagcttactagggagctata

SEQ ID NO: 635083 - DNA, 25 bp, Mus musculus
gggcccagcttagtagggagctata

SEQ ID NO: 635084 - DNA, 25 bp, Mus musculus
gggcccaggcatagtggtacatgct

SEQ ID NO: 635085 - DNA, 25 bp, Mus musculus
gggcccaggcattgtggtacatgct

SEQ ID NO: 635086 - DNA, 25 bp, Mus musculus
gggcccaggcttatgaagccatcaa

SEQ ID NO: 635087 - DNA, 25 bp, Mus musculus
gggcccaggcttttgaagccatcaa

SEQ ID NO: 635088 - DNA, 25 bp, Mus musculus
gggcccagggagaatgaacattgct

SEQ ID NO: 635089 - DNA, 25 bp, Mus musculus
gggcccagggagtatgaacattgct

SEQ ID NO: 635090 - DNA, 25 bp, Mus musculus
gggcccagtctcaattcttgaactc

SEQ ID NO: 635091 - DNA, 25 bp, Mus musculus
gggcccagtctctattcttgaactc

SEQ ID NO: 635092 - DNA, 25 bp, Mus musculus
gggcccagtttgatcgacatacgtc

SEQ ID NO: 635093 - DNA, 25 bp, Mus musculus
gggcccagtttgttcgacatacgtc

SEQ ID NO: 635094 - DNA, 25 bp, Mus musculus
gggcccataaagagtgactggcttt

SEQ ID NO: 635095 - DNA, 25 bp, Mus musculus
gggcccataaagtgtgactggcttt

SEQ ID NO: 635096 - DNA, 25 bp, Mus musculus
gggcccataacaccctagatttaaa

SEQ ID NO: 635097 - DNA, 25 bp, Mus musculus
gggcccataacagcctagatttaaa

SEQ ID NO: 635098 - DNA, 25 bp, Mus musculus
gggcccatagagctcctagagtcta

SEQ ID NO: 635099 - DNA, 25 bp, Mus musculus
gggcccatagaggtcctagagtcta

SEQ ID NO: 635100 - DNA, 25 bp, Mus musculus
gggcccatatatcattcttgatttg

SEQ ID NO: 635101 - DNA, 25 bp, Mus musculus
gggcccatatatgattcttgatttg

SEQ ID NO: 635102 - DNA, 25 bp, Mus musculus
gggcccatcagaaccgaacccgtgg

SEQ ID NO: 635103 - DNA, 25 bp, Mus musculus
gggcccatcagatccgaacccgtgg

SEQ ID NO: 635104 - DNA, 25 bp, Mus musculus
gggcccatcatcaggcggctgaaac

SEQ ID NO: 635105 - DNA, 25 bp, Mus musculus
gggcccatcatctggcggctgaaac

SEQ ID NO: 635106 - DNA, 25 bp, Mus musculus
gggcccatcgacaacagcaggattg

SEQ ID NO: 635107 - DNA, 25 bp, Mus musculus
gggcccatcgactacagcaggattg

SEQ ID NO: 635108 - DNA, 25 bp, Mus musculus
gggcccatctcacttggaattgaca

SEQ ID NO: 635109 - DNA, 25 bp, Mus musculus
gggcccatctcagttggaattgaca

SEQ ID NO: 635110 - DNA, 25 bp, Mus musculus
gggcccatcttaaatatttacccat

SEQ ID NO: 635111 - DNA, 25 bp, Mus musculus
gggcccatcttatatatttacccat

SEQ ID NO: 635112 - DNA, 25 bp, Mus musculus
gggcccatcttcatgggatccagag

SEQ ID NO: 635113 - DNA, 25 bp, Mus musculus
gggcccatcttccaggaaagtctaa

SEQ ID NO: 635114 - DNA, 25 bp, Mus musculus
gggcccatcttcgaggaaagtctaa

SEQ ID NO: 635115 - DNA, 25 bp, Mus musculus
gggcccatcttcttgggatccagag

SEQ ID NO: 635116 - DNA, 25 bp, Mus musculus
gggcccatggacatgtttaaattct

SEQ ID NO: 635117 - DNA, 25 bp, Mus musculus
gggcccatggacttgtttaaattct

SEQ ID NO: 635118 - DNA, 25 bp, Mus musculus
gggcccatggagaccaggaacctct

SEQ ID NO: 635119 - DNA, 25 bp, Mus musculus
gggcccatggagtccaggaacctct

SEQ ID NO: 635120 - DNA, 25 bp, Mus musculus
gggcccatgtaccacatgtgcatgg

SEQ ID NO: 635121 - DNA, 25 bp, Mus musculus
gggcccatgtacgacatgtgcatgg

SEQ ID NO: 635122 - DNA, 25 bp, Mus musculus
gggcccatgtagcttgacaaaaagt

SEQ ID NO: 635123 - DNA, 25 bp, Mus musculus
gggcccatgtaggttgacaaaaagt

SEQ ID NO: 635124 - DNA, 25 bp, Mus musculus
gggcccatgtgtaagtttcagaagc

SEQ ID NO: 635125 - DNA, 25 bp, Mus musculus
gggcccatgtgttagtttcagaagc

SEQ ID NO: 635126 - DNA, 25 bp, Mus musculus
gggcccattctaaatctggtgtttc

SEQ ID NO: 635127 - DNA, 25 bp, Mus musculus
gggcccattctatatctggtgtttc

SEQ ID NO: 635128 - DNA, 25 bp, Mus musculus
gggcccattgctcgtagcatagcac

SEQ ID NO: 635129 - DNA, 25 bp, Mus musculus
gggcccattgctggtagcatagcac

SEQ ID NO: 635130 - DNA, 25 bp, Mus musculus
gggccccaagaaatcgtctgaggtg

SEQ ID NO: 635131 - DNA, 25 bp, Mus musculus
gggccccaagaattcgtctgaggtg

SEQ ID NO: 635132 - DNA, 25 bp, Mus musculus
gggccccaaggcactgaagaggttt

SEQ ID NO: 635133 - DNA, 25 bp, Mus musculus
gggccccaaggctctgaagaggttt

SEQ ID NO: 635134 - DNA, 25 bp, Mus musculus
gggccccacaggaacctagatgctc

SEQ ID NO: 635135 - DNA, 25 bp, Mus musculus
gggccccacaggtacctagatgctc

SEQ ID NO: 635136 - DNA, 25 bp, Mus musculus
gggccccacgcaattggtaggcaag

SEQ ID NO: 635137 - DNA, 25 bp, Mus musculus
gggccccacgcatttggtaggcaag

SEQ ID NO: 635138 - DNA, 25 bp, Mus musculus
gggccccagaaaaagctcgctgtat

SEQ ID NO: 635139 - DNA, 25 bp, Mus musculus
gggccccagaaatagctcgctgtat

SEQ ID NO: 635140 - DNA, 25 bp, Mus musculus
gggccccagacaagctgacctgata

SEQ ID NO: 635141 - DNA, 25 bp, Mus musculus
gggccccagacatgctgacctgata

SEQ ID NO: 635142 - DNA, 25 bp, Mus musculus
gggccccagggactgaatcttcaac

SEQ ID NO: 635143 - DNA, 25 bp, Mus musculus
gggccccagggagtgaatcttcaac

SEQ ID NO: 635144 - DNA, 25 bp, Mus musculus
gggccccagggtctcagcaatatac

SEQ ID NO: 635145 - DNA, 25 bp, Mus musculus
gggccccagggtgtcagcaatatac

SEQ ID NO: 635146 - DNA, 25 bp, Mus musculus
gggccccagtgaagtttgacaagct

SEQ ID NO: 635147 - DNA, 25 bp, Mus musculus
gggccccagtgatgtttgacaagct

SEQ ID NO: 635148 - DNA, 25 bp, Mus musculus
gggccccatataaccacattttaaa

SEQ ID NO: 635149 - DNA, 25 bp, Mus musculus
gggccccatatatccacattttaaa

SEQ ID NO: 635150 - DNA, 25 bp, Mus musculus
gggccccatgatagtttctgcaaag

SEQ ID NO: 635151 - DNA, 25 bp, Mus musculus
gggccccatgattgtttctgcaaag

SEQ ID NO: 635152 - DNA, 25 bp, Mus musculus
gggccccattaacaggagccatgat

SEQ ID NO: 635153 - DNA, 25 bp, Mus musculus
gggccccattaagaggagccatgat

SEQ ID NO: 635154 - DNA, 25 bp, Mus musculus
gggccccgaactcgccaattgagga

SEQ ID NO: 635155 - DNA, 25 bp, Mus musculus
gggccccgaactggccaattgagga

SEQ ID NO: 635156 - DNA, 25 bp, Mus musculus
gggccccggaacactggtggagcca

SEQ ID NO: 635157 - DNA, 25 bp, Mus musculus
gggccccggaactctggtggagcca

SEQ ID NO: 635158 - DNA, 25 bp, Mus musculus
gggcccctacctatggttttacatg

SEQ ID NO: 635159 - DNA, 25 bp, Mus musculus
gggcccctacctttggttttacatg

SEQ ID NO: 635160 - DNA, 25 bp, Mus musculus
gggcccctcatcatgggtataggca

SEQ ID NO: 635161 - DNA, 25 bp, Mus musculus
gggcccctcatcttgggtataggca

SEQ ID NO: 635162 - DNA, 25 bp, Mus musculus
gggcccctcatgctggatgtattgt

SEQ ID NO: 635163 - DNA, 25 bp, Mus musculus
gggcccctcatggtggatgtattgt

SEQ ID NO: 635164 - DNA, 25 bp, Mus musculus
gggcccctggaactgcaccatttaa

SEQ ID NO: 635165 - DNA, 25 bp, Mus musculus
gggcccctggaagtgcaccatttaa

SEQ ID NO: 635166 - DNA, 25 bp, Mus musculus
gggcccctggacagatggaaagaaa

SEQ ID NO: 635167 - DNA, 25 bp, Mus musculus
gggcccctggactgatggaaagaaa

SEQ ID NO: 635168 - DNA, 25 bp, Mus musculus
gggcccctgttcacagtggcagcag

SEQ ID NO: 635169 - DNA, 25 bp, Mus musculus
gggcccctgttctcagtggcagcag

SEQ ID NO: 635170 - DNA, 25 bp, Mus musculus
gggccccttcagactttttggatgt

SEQ ID NO: 635171 - DNA, 25 bp, Mus musculus
gggccccttcagtctttttggatgt

SEQ ID NO: 635172 - DNA, 25 bp, Mus musculus
gggcccgaagcaaattggaactcta

SEQ ID NO: 635173 - DNA, 25 bp, Mus musculus
gggcccgaagcatattggaactcta

SEQ ID NO: 635174 - DNA, 25 bp, Mus musculus
gggcccgagcataaattaatacagg

SEQ ID NO: 635175 - DNA, 25 bp, Mus musculus
gggcccgagcattaattaatacagg

SEQ ID NO: 635176 - DNA, 25 bp, Mus musculus
gggcccgagggcaacattttggatt

SEQ ID NO: 635177 - DNA, 25 bp, Mus musculus
gggcccgagggctacattttggatt

SEQ ID NO: 635178 - DNA, 25 bp, Mus musculus
gggcccgcactcagaactgtgagga

SEQ ID NO: 635179 - DNA, 25 bp, Mus musculus
gggcccgcactctgaactgtgagga

SEQ ID NO: 635180 - DNA, 25 bp, Mus musculus
gggcccgccttgaccataagtttga

SEQ ID NO: 635181 - DNA, 25 bp, Mus musculus
gggcccgccttgtccataagtttga

SEQ ID NO: 635182 - DNA, 25 bp, Mus musculus
gggcccggctccagtcggtccttga

SEQ ID NO: 635183 - DNA, 25 bp, Mus musculus
gggcccggctcctgtcggtccttga

SEQ ID NO: 635184 - DNA, 25 bp, Mus musculus
gggcccggctgcacagactgaaagt

SEQ ID NO: 635185 - DNA, 25 bp, Mus musculus
gggcccggctgctcagactgaaagt

SEQ ID NO: 635186 - DNA, 25 bp, Mus musculus
gggcccggggatctgtgtttacacg

SEQ ID NO: 635187 - DNA, 25 bp, Mus musculus
gggcccggggatgtgtgtttacacg

SEQ ID NO: 635188 - DNA, 25 bp, Mus musculus
gggcccgtgcctataaatcaacact

SEQ ID NO: 635189 - DNA, 25 bp, Mus musculus
gggcccgtgcctttaaatcaacact

SEQ ID NO: 635190 - DNA, 25 bp, Mus musculus
gggccctaaaggagagtccctctga

SEQ ID NO: 635191 - DNA, 25 bp, Mus musculus
gggccctaaaggtgagtccctctga

SEQ ID NO: 635192 - DNA, 25 bp, Mus musculus
gggccctaatgaaataatcccctta

SEQ ID NO: 635193 - DNA, 25 bp, Mus musculus
gggccctaatgatataatcccctta

SEQ ID NO: 635194 - DNA, 25 bp, Mus musculus
gggccctacggactccaggaagatc

SEQ ID NO: 635195 - DNA, 25 bp, Mus musculus
gggccctacggagtccaggaagatc

SEQ ID NO: 635196 - DNA, 25 bp, Mus musculus
gggccctagagtagcaatggagtta

SEQ ID NO: 635197 - DNA, 25 bp, Mus musculus
gggccctagagttgcaatggagtta

SEQ ID NO: 635198 - DNA, 25 bp, Mus musculus
gggccctagatccagatgtgcctaa

SEQ ID NO: 635199 - DNA, 25 bp, Mus musculus
gggccctagatcgagatgtgcctaa

SEQ ID NO: 635200 - DNA, 25 bp, Mus musculus
gggccctagcaactagttctggtac

SEQ ID NO: 635201 - DNA, 25 bp, Mus musculus
gggccctagcaagtagttctggtac

SEQ ID NO: 635202 - DNA, 25 bp, Mus musculus
gggccctagccaacaggaacgtagt

SEQ ID NO: 635203 - DNA, 25 bp, Mus musculus
gggccctagccatcaggaacgtagt

SEQ ID NO: 635204 - DNA, 25 bp, Mus musculus
gggccctagctaaaaagtgtgtatt

SEQ ID NO: 635205 - DNA, 25 bp, Mus musculus
gggccctagctactggtgtcagaac

SEQ ID NO: 635206 - DNA, 25 bp, Mus musculus
gggccctagctagtggtgtcagaac

SEQ ID NO: 635207 - DNA, 25 bp, Mus musculus
gggccctagctataaagtgtgtatt

SEQ ID NO: 635208 - DNA, 25 bp, Mus musculus
gggccctagggaagacccttctgct

SEQ ID NO: 635209 - DNA, 25 bp, Mus musculus
gggccctagggatgacccttctgct

SEQ ID NO: 635210 - DNA, 25 bp, Mus musculus
gggccctagtttcagtgctcagcac

SEQ ID NO: 635211 - DNA, 25 bp, Mus musculus
gggccctagtttgagtgctcagcac

SEQ ID NO: 635212 - DNA, 25 bp, Mus musculus
gggccctatcagcagaagagcgaat

SEQ ID NO: 635213 - DNA, 25 bp, Mus musculus
gggccctatcaggagaagagcgaat

SEQ ID NO: 635214 - DNA, 25 bp, Mus musculus
gggccctattcacgcaagattttca

SEQ ID NO: 635215 - DNA, 25 bp, Mus musculus
gggccctattcaggcaagattttca

SEQ ID NO: 635216 - DNA, 25 bp, Mus musculus
gggccctcaaagattctgagtttct

SEQ ID NO: 635217 - DNA, 25 bp, Mus musculus
gggccctcaaagtttctgagtttct

SEQ ID NO: 635218 - DNA, 25 bp, Mus musculus
gggccctcaggaaaacatgatctct

SEQ ID NO: 635219 - DNA, 25 bp, Mus musculus
gggccctcaggataacatgatctct

SEQ ID NO: 635220 - DNA, 25 bp, Mus musculus
gggccctcagggaacagactttcaa

SEQ ID NO: 635221 - DNA, 25 bp, Mus musculus
gggccctcagggtacagactttcaa

SEQ ID NO: 635222 - DNA, 25 bp, Mus musculus
gggccctcatccatggatcttggag

SEQ ID NO: 635223 - DNA, 25 bp, Mus musculus
gggccctcatccttggatcttggag

SEQ ID NO: 635224 - DNA, 25 bp, Mus musculus
gggccctccacgaaagctcaaattt

SEQ ID NO: 635225 - DNA, 25 bp, Mus musculus
gggccctccacgtaagctcaaattt

SEQ ID NO: 635226 - DNA, 25 bp, Mus musculus
gggccctccagaatttctatgaact

SEQ ID NO: 635227 - DNA, 25 bp, Mus musculus
gggccctccagattttctatgaact

SEQ ID NO: 635228 - DNA, 25 bp, Mus musculus
gggccctccagtcgcgacagcaaag

SEQ ID NO: 635229 - DNA, 25 bp, Mus musculus
gggccctccagtggcgacagcaaag

SEQ ID NO: 635230 - DNA, 25 bp, Mus musculus
gggccctccataagactacatattt

SEQ ID NO: 635231 - DNA, 25 bp, Mus musculus
gggccctccatatgactacatattt

SEQ ID NO: 635232 - DNA, 25 bp, Mus musculus
gggccctcccaacataaatatcata

SEQ ID NO: 635233 - DNA, 25 bp, Mus musculus
gggccctcccaagataaatatcata

SEQ ID NO: 635234 - DNA, 25 bp, Mus musculus
gggccctcgatcaagaaaacagcat

SEQ ID NO: 635235 - DNA, 25 bp, Mus musculus
gggccctcgatctagaaaacagcat

SEQ ID NO: 635236 - DNA, 25 bp, Mus musculus
gggccctcggtcataagtagtgtat

SEQ ID NO: 635237 - DNA, 25 bp, Mus musculus
gggccctcggtcttaagtagtgtat

SEQ ID NO: 635238 - DNA, 25 bp, Mus musculus
gggccctcggttcatcttttcttgt

SEQ ID NO: 635239 - DNA, 25 bp, Mus musculus
gggccctcggttgatcttttcttgt

SEQ ID NO: 635240 - DNA, 25 bp, Mus musculus
gggccctcgtcaagaaacacaacac

SEQ ID NO: 635241 - DNA, 25 bp, Mus musculus
gggccctcgtcatgaaacacaacac

SEQ ID NO: 635242 - DNA, 25 bp, Mus musculus
gggccctctactctcagacagttga

SEQ ID NO: 635243 - DNA, 25 bp, Mus musculus
gggccctctactgtcagacagttga

SEQ ID NO: 635244 - DNA, 25 bp, Mus musculus
gggccctctgatagtacttttgtta

SEQ ID NO: 635245 - DNA, 25 bp, Mus musculus
gggccctctgattgtacttttgtta

SEQ ID NO: 635246 - DNA, 25 bp, Mus musculus
gggccctctgcacatatgtttcagt

SEQ ID NO: 635247 - DNA, 25 bp, Mus musculus
gggccctctgcagatatgtttcagt

SEQ ID NO: 635248 - DNA, 25 bp, Mus musculus
gggccctctggaatatggagacaat

SEQ ID NO: 635249 - DNA, 25 bp, Mus musculus
gggccctctggattatggagacaat

SEQ ID NO: 635250 - DNA, 25 bp, Mus musculus
gggccctctgttcactttaagattc

SEQ ID NO: 635251 - DNA, 25 bp, Mus musculus
gggccctctgttgactttaagattc

SEQ ID NO: 635252 - DNA, 25 bp, Mus musculus
gggccctctttcagagatacctgtt

SEQ ID NO: 635253 - DNA, 25 bp, Mus musculus
gggccctctttctgagatacctgtt

SEQ ID NO: 635254 - DNA, 25 bp, Mus musculus
gggccctgaagacgtccattgcaga

SEQ ID NO: 635255 - DNA, 25 bp, Mus musculus
gggccctgaagaggtccattgcaga

SEQ ID NO: 635256 - DNA, 25 bp, Mus musculus
gggccctgacataagagtcaattga

SEQ ID NO: 635257 - DNA, 25 bp, Mus musculus
gggccctgacattagagtcaattga

SEQ ID NO: 635258 - DNA, 25 bp, Mus musculus
gggccctgacttccctttagttcac

SEQ ID NO: 635259 - DNA, 25 bp, Mus musculus
gggccctgacttgcctttagttcac

SEQ ID NO: 635260 - DNA, 25 bp, Mus musculus
gggccctgagcgaatcttccccaat

SEQ ID NO: 635261 - DNA, 25 bp, Mus musculus
gggccctgagcgtatcttccccaat

SEQ ID NO: 635262 - DNA, 25 bp, Mus musculus
gggccctgagttagtagcgaatgct

SEQ ID NO: 635263 - DNA, 25 bp, Mus musculus
gggccctgagtttgtagcgaatgct

SEQ ID NO: 635264 - DNA, 25 bp, Mus musculus
gggccctgatccagtcggtgaagaa

SEQ ID NO: 635265 - DNA, 25 bp, Mus musculus
gggccctgatcctgtcggtgaagaa

SEQ ID NO: 635266 - DNA, 25 bp, Mus musculus
gggccctgattcaatctactttgaa

SEQ ID NO: 635267 - DNA, 25 bp, Mus musculus
gggccctgattctatctactttgaa

SEQ ID NO: 635268 - DNA, 25 bp, Mus musculus
gggccctgcaaaaactacagacagc

SEQ ID NO: 635269 - DNA, 25 bp, Mus musculus
gggccctgcaaatactacagacagc

SEQ ID NO: 635270 - DNA, 25 bp, Mus musculus
gggccctgcacaagctacaggagta

SEQ ID NO: 635271 - DNA, 25 bp, Mus musculus
gggccctgcacatgctacaggagta

SEQ ID NO: 635272 - DNA, 25 bp, Mus musculus
gggccctgcctgaaagaatgggttt

SEQ ID NO: 635273 - DNA, 25 bp, Mus musculus
gggccctgcctgtaagaatgggttt

SEQ ID NO: 635274 - DNA, 25 bp, Mus musculus
gggccctgctcacaacagactacag

SEQ ID NO: 635275 - DNA, 25 bp, Mus musculus
gggccctgctcagaacagactacag

SEQ ID NO: 635276 - DNA, 25 bp, Mus musculus
gggccctgctccaatgagatcaagc

SEQ ID NO: 635277 - DNA, 25 bp, Mus musculus
gggccctgctcctatgagatcaagc

SEQ ID NO: 635278 - DNA, 25 bp, Mus musculus
gggccctggaaaatgtacagcctct

SEQ ID NO: 635279 - DNA, 25 bp, Mus musculus
gggccctggaaattgtacagcctct

SEQ ID NO: 635280 - DNA, 25 bp, Mus musculus
gggccctggaagacctccttaatgc

SEQ ID NO: 635281 - DNA, 25 bp, Mus musculus
gggccctggaagtcctccttaatgc

SEQ ID NO: 635282 - DNA, 25 bp, Mus musculus
gggccctggactctgaacctgtgac

SEQ ID NO: 635283 - DNA, 25 bp, Mus musculus
gggccctggactgtgaacctgtgac

SEQ ID NO: 635284 - DNA, 25 bp, Mus musculus
gggccctggagtcatttatctgaga

SEQ ID NO: 635285 - DNA, 25 bp, Mus musculus
gggccctggagtgatttatctgaga

SEQ ID NO: 635286 - DNA, 25 bp, Mus musculus
gggccctggcccattctgagaaatg

SEQ ID NO: 635287 - DNA, 25 bp, Mus musculus
gggccctggccctttctgagaaatg

SEQ ID NO: 635288 - DNA, 25 bp, Mus musculus
gggccctggctacacaaaagcatgc

SEQ ID NO: 635289 - DNA, 25 bp, Mus musculus
gggccctggctagacaaaagcatgc

SEQ ID NO: 635290 - DNA, 25 bp, Mus musculus
gggccctgggacatgtgccgtctat

SEQ ID NO: 635291 - DNA, 25 bp, Mus musculus
gggccctgggacttgtgccgtctat

SEQ ID NO: 635292 - DNA, 25 bp, Mus musculus
gggccctgggagatgcaaccttgat

SEQ ID NO: 635293 - DNA, 25 bp, Mus musculus
gggccctgggagttgcaaccttgat

SEQ ID NO: 635294 - DNA, 25 bp, Mus musculus
gggccctgggtcatcttactagata

SEQ ID NO: 635295 - DNA, 25 bp, Mus musculus
gggccctgggtcttcttactagata

SEQ ID NO: 635296 - DNA, 25 bp, Mus musculus
gggccctgtactaggtgtggctcat

SEQ ID NO: 635297 - DNA, 25 bp, Mus musculus
gggccctgtacttggtgtggctcat

SEQ ID NO: 635298 - DNA, 25 bp, Mus musculus
gggccctgtgttaggacaagtctct

SEQ ID NO: 635299 - DNA, 25 bp, Mus musculus
gggccctgtgtttggacaagtctct

SEQ ID NO: 635300 - DNA, 25 bp, Mus musculus
gggcccttaaaaccagcgctaatgc

SEQ ID NO: 635301 - DNA, 25 bp, Mus musculus
gggcccttaaaagcagcgctaatgc

SEQ ID NO: 635302 - DNA, 25 bp, Mus musculus
gggcccttaccaagagaagttccgt

SEQ ID NO: 635303 - DNA, 25 bp, Mus musculus
gggcccttaccatgagaagttccgt

SEQ ID NO: 635304 - DNA, 25 bp, Mus musculus
gggcccttacctcgaagctctaaag

SEQ ID NO: 635305 - DNA, 25 bp, Mus musculus
gggcccttacctggaagctctaaag

SEQ ID NO: 635306 - DNA, 25 bp, Mus musculus
gggcccttagatctatcaccccagc

SEQ ID NO: 635307 - DNA, 25 bp, Mus musculus
gggcccttagatgtatcaccccagc

SEQ ID NO: 635308 - DNA, 25 bp, Mus musculus
gggcccttccatatcaaacaacaat

SEQ ID NO: 635309 - DNA, 25 bp, Mus musculus
gggcccttccatttcaaacaacaat

SEQ ID NO: 635310 - DNA, 25 bp, Mus musculus
gggcccttctacaaataagccaatg

SEQ ID NO: 635311 - DNA, 25 bp, Mus musculus
gggcccttctactaataagccaatg

SEQ ID NO: 635312 - DNA, 25 bp, Mus musculus
gggcccttctggaaacatggctgat

SEQ ID NO: 635313 - DNA, 25 bp, Mus musculus
gggcccttctggtaacatggctgat

SEQ ID NO: 635314 - DNA, 25 bp, Mus musculus
gggcccttctgtacccatgcaaacg

SEQ ID NO: 635315 - DNA, 25 bp, Mus musculus
gggcccttctgttcccatgcaaacg

SEQ ID NO: 635316 - DNA, 25 bp, Mus musculus
gggcccttgagaataaaatactgct

SEQ ID NO: 635317 - DNA, 25 bp, Mus musculus
gggcccttgagattaaaatactgct

SEQ ID NO: 635318 - DNA, 25 bp, Mus musculus
gggcccttgcttctacaggcctaag

SEQ ID NO: 635319 - DNA, 25 bp, Mus musculus
gggcccttgcttgtacaggcctaag

SEQ ID NO: 635320 - DNA, 25 bp, Mus musculus
gggcccttggccattaatttgcttt

SEQ ID NO: 635321 - DNA, 25 bp, Mus musculus
gggcccttggcctttaatttgcttt

SEQ ID NO: 635322 - DNA, 25 bp, Mus musculus
gggcccttggtcaggactgaatagc

SEQ ID NO: 635323 - DNA, 25 bp, Mus musculus
gggcccttggtctggactgaatagc

SEQ ID NO: 635324 - DNA, 25 bp, Mus musculus
gggcccttggtgaagagcaatcatc

SEQ ID NO: 635325 - DNA, 25 bp, Mus musculus
gggcccttggtgtagagcaatcatc

SEQ ID NO: 635326 - DNA, 25 bp, Mus musculus
gggcccttggttctgcttgtgggac

SEQ ID NO: 635327 - DNA, 25 bp, Mus musculus
gggcccttggttgtgcttgtgggac

SEQ ID NO: 635328 - DNA, 25 bp, Mus musculus
gggcccttgtagacgttgctatttt

SEQ ID NO: 635329 - DNA, 25 bp, Mus musculus
gggcccttgtagtcgttgctatttt

SEQ ID NO: 635330 - DNA, 25 bp, Mus musculus
gggcccttgtatctgggaacttatg

SEQ ID NO: 635331 - DNA, 25 bp, Mus musculus
gggcccttgtatgtgggaacttatg

SEQ ID NO: 635332 - DNA, 25 bp, Mus musculus
gggcccttgtcaccaataagccagt

SEQ ID NO: 635333 - DNA, 25 bp, Mus musculus
gggcccttgtcagcaataagccagt

SEQ ID NO: 635334 - DNA, 25 bp, Mus musculus
gggcccttgtgaacataggcaccaa

SEQ ID NO: 635335 - DNA, 25 bp, Mus musculus
gggcccttgtgatcataggcaccaa

SEQ ID NO: 635336 - DNA, 25 bp, Mus musculus
gggccctttataatccaagtacatt

SEQ ID NO: 635337 - DNA, 25 bp, Mus musculus
gggccctttatattccaagtacatt

SEQ ID NO: 635338 - DNA, 25 bp, Mus musculus
gggccctttgaaactgagactagat

SEQ ID NO: 635339 - DNA, 25 bp, Mus musculus
gggccctttgaatctgagactagat

SEQ ID NO: 635340 - DNA, 25 bp, Mus musculus
gggccctttggaattagcacccaga

SEQ ID NO: 635341 - DNA, 25 bp, Mus musculus
gggccctttggatttagcacccaga

SEQ ID NO: 635342 - DNA, 25 bp, Mus musculus
gggccctttggcctgtaaatgagaa

SEQ ID NO: 635343 - DNA, 25 bp, Mus musculus
gggccctttggcgtgtaaatgagaa

SEQ ID NO: 635344 - DNA, 25 bp, Mus musculus
gggcccttttctctatctgatttgt

SEQ ID NO: 635345 - DNA, 25 bp, Mus musculus
gggcccttttctgtatctgatttgt

SEQ ID NO: 635346 - DNA, 25 bp, Mus musculus
gggccgaaagttcaggctctccaga

SEQ ID NO: 635347 - DNA, 25 bp, Mus musculus
gggccgaaagttgaggctctccaga

SEQ ID NO: 635348 - DNA, 25 bp, Mus musculus
gggccgaacgcaccagagagaacca

SEQ ID NO: 635349 - DNA, 25 bp, Mus musculus
gggccgaacgcagcagagagaacca

SEQ ID NO: 635350 - DNA, 25 bp, Mus musculus
gggccgaagagtctcccagagtcat

SEQ ID NO: 635351 - DNA, 25 bp, Mus musculus
gggccgaagagtgtcccagagtcat

SEQ ID NO: 635352 - DNA, 25 bp, Mus musculus
gggccgacaccaacgtgagagacaa

SEQ ID NO: 635353 - DNA, 25 bp, Mus musculus
gggccgacaccatcgtgagagacaa

SEQ ID NO: 635354 - DNA, 25 bp, Mus musculus
gggccgacatgcagcttacgatgct

SEQ ID NO: 635355 - DNA, 25 bp, Mus musculus
gggccgacatgctgcttacgatgct

SEQ ID NO: 635356 - DNA, 25 bp, Mus musculus
gggccgacggtgacagtgatgctga

SEQ ID NO: 635357 - DNA, 25 bp, Mus musculus
gggccgacggtgtcagtgatgctga

SEQ ID NO: 635358 - DNA, 25 bp, Mus musculus
gggccgagaacaaagcagaagacaa

SEQ ID NO: 635359 - DNA, 25 bp, Mus musculus
gggccgagaacatagcagaagacaa

SEQ ID NO: 635360 - DNA, 25 bp, Mus musculus
gggccgagccatcgcagcagtcaat

SEQ ID NO: 635361 - DNA, 25 bp, Mus musculus
gggccgagccatggcagcagtcaat

SEQ ID NO: 635362 - DNA, 25 bp, Mus musculus
gggccgaggtgtactcaaacagctc

SEQ ID NO: 635363 - DNA, 25 bp, Mus musculus
gggccgaggtgttctcaaacagctc

SEQ ID NO: 635364 - DNA, 25 bp, Mus musculus
gggccgagtaaacggatcacagatt

SEQ ID NO: 635365 - DNA, 25 bp, Mus musculus
gggccgagtaaagggatcacagatt

SEQ ID NO: 635366 - DNA, 25 bp, Mus musculus
gggccgataagtccagcagtttctt

SEQ ID NO: 635367 - DNA, 25 bp, Mus musculus
gggccgataagtgcagcagtttctt

SEQ ID NO: 635368 - DNA, 25 bp, Mus musculus
gggccgatcaacagtgctaatcgag

SEQ ID NO: 635369 - DNA, 25 bp, Mus musculus
gggccgatcaactgtgctaatcgag

SEQ ID NO: 635370 - DNA, 25 bp, Mus musculus
gggccgatctccaaaggtgggacac

SEQ ID NO: 635371 - DNA, 25 bp, Mus musculus
gggccgatctcctaaggtgggacac

SEQ ID NO: 635372 - DNA, 25 bp, Mus musculus
gggccgatgtctatcttcgtatgga

SEQ ID NO: 635373 - DNA, 25 bp, Mus musculus
gggccgatgtctttcttcgtatgga

SEQ ID NO: 635374 - DNA, 25 bp, Mus musculus
gggccgattgccataccaaggatat

SEQ ID NO: 635375 - DNA, 25 bp, Mus musculus
gggccgattgccttaccaaggatat

SEQ ID NO: 635376 - DNA, 25 bp, Mus musculus
gggccgcaaccactacagtagtatc

SEQ ID NO: 635377 - DNA, 25 bp, Mus musculus
gggccgcaaccagtacagtagtatc

SEQ ID NO: 635378 - DNA, 25 bp, Mus musculus
gggccgcaggagacattcactggaa

SEQ ID NO: 635379 - DNA, 25 bp, Mus musculus
gggccgcaggagtcattcactggaa

SEQ ID NO: 635380 - DNA, 25 bp, Mus musculus
gggccgcagtgcactgttagaagca

SEQ ID NO: 635381 - DNA, 25 bp, Mus musculus
gggccgcagtgctctgttagaagca

SEQ ID NO: 635382 - DNA, 25 bp, Mus musculus
gggccgcatatcagataccctgcat

SEQ ID NO: 635383 - DNA, 25 bp, Mus musculus
gggccgcatatctgataccctgcat

SEQ ID NO: 635384 - DNA, 25 bp, Mus musculus
gggccgccgagtaggacgcggagcc

SEQ ID NO: 635385 - DNA, 25 bp, Mus musculus
gggccgccgagttggacgcggagcc

SEQ ID NO: 635386 - DNA, 25 bp, Mus musculus
gggccgcctggcactagtataacgg

SEQ ID NO: 635387 - DNA, 25 bp, Mus musculus
gggccgcctggctctagtataacgg

SEQ ID NO: 635388 - DNA, 25 bp, Mus musculus
gggccgctagtcatgttcacgtaca

SEQ ID NO: 635389 - DNA, 25 bp, Mus musculus
gggccgctagtcttgttcacgtaca

SEQ ID NO: 635390 - DNA, 25 bp, Mus musculus
gggccgctggaactctccgtgaaat

SEQ ID NO: 635391 - DNA, 25 bp, Mus musculus
gggccgctggaagtctccgtgaaat

SEQ ID NO: 635392 - DNA, 25 bp, Mus musculus
gggccgcttcgtcccctgagcagta

SEQ ID NO: 635393 - DNA, 25 bp, Mus musculus
gggccgcttcgtgccctgagcagta

SEQ ID NO: 635394 - DNA, 25 bp, Mus musculus
gggccggaacgaccagaaatcctaa

SEQ ID NO: 635395 - DNA, 25 bp, Mus musculus
gggccggaacgagcagaaatcctaa

SEQ ID NO: 635396 - DNA, 25 bp, Mus musculus
gggccggaataacgcccgctactgt

SEQ ID NO: 635397 - DNA, 25 bp, Mus musculus
gggccggaataaggcccgctactgt

SEQ ID NO: 635398 - DNA, 25 bp, Mus musculus
gggccggaggatagctctacaaagc

SEQ ID NO: 635399 - DNA, 25 bp, Mus musculus
gggccggaggattgctctacaaagc

SEQ ID NO: 635400 - DNA, 25 bp, Mus musculus
gggccggaggccacctaggaaagca

SEQ ID NO: 635401 - DNA, 25 bp, Mus musculus
gggccggaggcctcctaggaaagca

SEQ ID NO: 635402 - DNA, 25 bp, Mus musculus
gggccggagggacatatataatcaa

SEQ ID NO: 635403 - DNA, 25 bp, Mus musculus
gggccggagggagatatataatcaa

SEQ ID NO: 635404 - DNA, 25 bp, Mus musculus
gggccggctcaaatcaacaggagtt

SEQ ID NO: 635405 - DNA, 25 bp, Mus musculus
gggccggctcaattcaacaggagtt

SEQ ID NO: 635406 - DNA, 25 bp, Mus musculus
gggccgggccctctgaagtgggcac

SEQ ID NO: 635407 - DNA, 25 bp, Mus musculus
gggccgggccctgtgaagtgggcac

SEQ ID NO: 635408 - DNA, 25 bp, Mus musculus
gggccgggcctaatcacatggcaca

SEQ ID NO: 635409 - DNA, 25 bp, Mus musculus
gggccgggcctattcacatggcaca

SEQ ID NO: 635410 - DNA, 25 bp, Mus musculus
gggccggtcaatcactgctgattcc

SEQ ID NO: 635411 - DNA, 25 bp, Mus musculus
gggccggtcaatgactgctgattcc

SEQ ID NO: 635412 - DNA, 25 bp, Mus musculus
gggccggtccagaatgatgctgact

SEQ ID NO: 635413 - DNA, 25 bp, Mus musculus
gggccggtccagtatgatgctgact

SEQ ID NO: 635414 - DNA, 25 bp, Mus musculus
gggccgtacgctatgcgggaaatat

SEQ ID NO: 635415 - DNA, 25 bp, Mus musculus
gggccgtacgctttgcgggaaatat

SEQ ID NO: 635416 - DNA, 25 bp, Mus musculus
gggccgtcaaacctgacatttatta

SEQ ID NO: 635417 - DNA, 25 bp, Mus musculus
gggccgtcaaacgtgacatttatta

SEQ ID NO: 635418 - DNA, 25 bp, Mus musculus
gggccgtcagctagccagtgaacaa

SEQ ID NO: 635419 - DNA, 25 bp, Mus musculus
gggccgtcagcttgccagtgaacaa

SEQ ID NO: 635420 - DNA, 25 bp, Mus musculus
gggccgtcttgtcgcattctttgtc

SEQ ID NO: 635421 - DNA, 25 bp, Mus musculus
gggccgtcttgtggcattctttgtc

SEQ ID NO: 635422 - DNA, 25 bp, Mus musculus
gggccgtgacagctgaaatggtgat

SEQ ID NO: 635423 - DNA, 25 bp, Mus musculus
gggccgtgacaggtgaaatggtgat

SEQ ID NO: 635424 - DNA, 25 bp, Mus musculus
gggccgtggataacctactgatcag

SEQ ID NO: 635425 - DNA, 25 bp, Mus musculus
gggccgtggatatcctactgatcag

SEQ ID NO: 635426 - DNA, 25 bp, Mus musculus
gggccgtgtcaaaactccatagatg

SEQ ID NO: 635427 - DNA, 25 bp, Mus musculus
gggccgtgtcaatactccatagatg

SEQ ID NO: 635428 - DNA, 25 bp, Mus musculus
gggccgttcaccagggaagccacat

SEQ ID NO: 635429 - DNA, 25 bp, Mus musculus
gggccgttcacctgggaagccacat

SEQ ID NO: 635430 - DNA, 25 bp, Mus musculus
gggccgttgctgaaatcttaataca

SEQ ID NO: 635431 - DNA, 25 bp, Mus musculus
gggccgttgctgtaatcttaataca

SEQ ID NO: 635432 - DNA, 25 bp, Mus musculus
gggcctaaaagacccacctgcgatg

SEQ ID NO: 635433 - DNA, 25 bp, Mus musculus
gggcctaaaagagccacctgcgatg

SEQ ID NO: 635434 - DNA, 25 bp, Mus musculus
gggcctaaacccagtctgtttgcaa

SEQ ID NO: 635435 - DNA, 25 bp, Mus musculus
gggcctaaacccatcaactgggaag

SEQ ID NO: 635436 - DNA, 25 bp, Mus musculus
gggcctaaaccctgtctgtttgcaa

SEQ ID NO: 635437 - DNA, 25 bp, Mus musculus
gggcctaaacccttcaactgggaag

SEQ ID NO: 635438 - DNA, 25 bp, Mus musculus
gggcctaaagcgctactgctgccgc

SEQ ID NO: 635439 - DNA, 25 bp, Mus musculus
gggcctaaagcggtactgctgccgc

SEQ ID NO: 635440 - DNA, 25 bp, Mus musculus
gggcctaaatagagctccttacttg

SEQ ID NO: 635441 - DNA, 25 bp, Mus musculus
gggcctaaatagtgctccttacttg

SEQ ID NO: 635442 - DNA, 25 bp, Mus musculus
gggcctaacccaaagagtgacccaa

SEQ ID NO: 635443 - DNA, 25 bp, Mus musculus
gggcctaacccatagagtgacccaa

SEQ ID NO: 635444 - DNA, 25 bp, Mus musculus
gggcctaactaaaccatcaatcgta

SEQ ID NO: 635445 - DNA, 25 bp, Mus musculus
gggcctaactaatccatcaatcgta

SEQ ID NO: 635446 - DNA, 25 bp, Mus musculus
gggcctaagaaaagactcccagttt

SEQ ID NO: 635447 - DNA, 25 bp, Mus musculus
gggcctaagaaatgactcccagttt

SEQ ID NO: 635448 - DNA, 25 bp, Mus musculus
gggcctaagattcctattcacagtt

SEQ ID NO: 635449 - DNA, 25 bp, Mus musculus
gggcctaagattgctattcacagtt

SEQ ID NO: 635450 - DNA, 25 bp, Mus musculus
gggcctaagcaccatacagctctgg

SEQ ID NO: 635451 - DNA, 25 bp, Mus musculus
gggcctaagcacgatacagctctgg

SEQ ID NO: 635452 - DNA, 25 bp, Mus musculus
gggcctaaggacacaggacgccata

SEQ ID NO: 635453 - DNA, 25 bp, Mus musculus
gggcctaaggactcaggacgccata

SEQ ID NO: 635454 - DNA, 25 bp, Mus musculus
gggcctaatagaatgtcactgcaaa

SEQ ID NO: 635455 - DNA, 25 bp, Mus musculus
gggcctaatagattgtcactgcaaa

SEQ ID NO: 635456 - DNA, 25 bp, Mus musculus
gggcctaatcacatggcacagccgt

SEQ ID NO: 635457 - DNA, 25 bp, Mus musculus
gggcctaatcacttggcacagccgt

SEQ ID NO: 635458 - DNA, 25 bp, Mus musculus
gggcctaatgcactgtgagcattaa

SEQ ID NO: 635459 - DNA, 25 bp, Mus musculus
gggcctaatgcagtgtgagcattaa

SEQ ID NO: 635460 - DNA, 25 bp, Mus musculus
gggcctaatgccaaacgaagataca

SEQ ID NO: 635461 - DNA, 25 bp, Mus musculus
gggcctaatgccacaaggactgact

SEQ ID NO: 635462 - DNA, 25 bp, Mus musculus
gggcctaatgcctaacgaagataca

SEQ ID NO: 635463 - DNA, 25 bp, Mus musculus
gggcctaatgcctcaaggactgact

SEQ ID NO: 635464 - DNA, 25 bp, Mus musculus
gggcctacagatccacccaagggca

SEQ ID NO: 635465 - DNA, 25 bp, Mus musculus
gggcctacagatgcacccaagggca

SEQ ID NO: 635466 - DNA, 25 bp, Mus musculus
gggcctacatccaacttggatattt

SEQ ID NO: 635467 - DNA, 25 bp, Mus musculus
gggcctacatcctacttggatattt

SEQ ID NO: 635468 - DNA, 25 bp, Mus musculus
gggcctacccttctgtagacaggag

SEQ ID NO: 635469 - DNA, 25 bp, Mus musculus
gggcctacccttgtgtagacaggag

SEQ ID NO: 635470 - DNA, 25 bp, Mus musculus
gggcctaccgagaacagaagcacta

SEQ ID NO: 635471 - DNA, 25 bp, Mus musculus
gggcctaccgagtacagaagcacta

SEQ ID NO: 635472 - DNA, 25 bp, Mus musculus
gggcctacttaaatttatgagagag

SEQ ID NO: 635473 - DNA, 25 bp, Mus musculus
gggcctacttaattttatgagagag

SEQ ID NO: 635474 - DNA, 25 bp, Mus musculus
gggcctagaactcctcagcctggaa

SEQ ID NO: 635475 - DNA, 25 bp, Mus musculus
gggcctagaactgctcagcctggaa

SEQ ID NO: 635476 - DNA, 25 bp, Mus musculus
gggcctagacctctgtgctattgaa

SEQ ID NO: 635477 - DNA, 25 bp, Mus musculus
gggcctagacctgtgtgctattgaa

SEQ ID NO: 635478 - DNA, 25 bp, Mus musculus
gggcctagacttcgtcaacgtcaag

SEQ ID NO: 635479 - DNA, 25 bp, Mus musculus
gggcctagacttggtcaacgtcaag

SEQ ID NO: 635480 - DNA, 25 bp, Mus musculus
gggcctagaggcctatgtgtatact

SEQ ID NO: 635481 - DNA, 25 bp, Mus musculus
gggcctagaggcgtatgtgtatact

SEQ ID NO: 635482 - DNA, 25 bp, Mus musculus
gggcctagcataaactgtaaatctt

SEQ ID NO: 635483 - DNA, 25 bp, Mus musculus
gggcctagcatatactgtaaatctt

SEQ ID NO: 635484 - DNA, 25 bp, Mus musculus
gggcctagctcgcaacactaatgta

SEQ ID NO: 635485 - DNA, 25 bp, Mus musculus
gggcctagctcggaacactaatgta

SEQ ID NO: 635486 - DNA, 25 bp, Mus musculus
gggcctagctgtctaaatgaccttg

SEQ ID NO: 635487 - DNA, 25 bp, Mus musculus
gggcctagctgtgtaaatgaccttg

SEQ ID NO: 635488 - DNA, 25 bp, Mus musculus
gggcctaggaacagtccaagccgaa

SEQ ID NO: 635489 - DNA, 25 bp, Mus musculus
gggcctaggaactgtccaagccgaa

SEQ ID NO: 635490 - DNA, 25 bp, Mus musculus
gggcctaggcctcaacagtcattaa

SEQ ID NO: 635491 - DNA, 25 bp, Mus musculus
gggcctaggcctgaacagtcattaa

SEQ ID NO: 635492 - DNA, 25 bp, Mus musculus
gggcctaggtatcagaacgacacaa

SEQ ID NO: 635493 - DNA, 25 bp, Mus musculus
gggcctaggtatgagaacgacacaa

SEQ ID NO: 635494 - DNA, 25 bp, Mus musculus
gggcctaggtcaagcctatgctcac

SEQ ID NO: 635495 - DNA, 25 bp, Mus musculus
gggcctaggtcatgcctatgctcac

SEQ ID NO: 635496 - DNA, 25 bp, Mus musculus
gggcctagtcatctgtaaagtctca

SEQ ID NO: 635497 - DNA, 25 bp, Mus musculus
gggcctagtcatgtgtaaagtctca

SEQ ID NO: 635498 - DNA, 25 bp, Mus musculus
gggcctataatgacggtccaggcaa

SEQ ID NO: 635499 - DNA, 25 bp, Mus musculus
gggcctataatgtcggtccaggcaa

SEQ ID NO: 635500 - DNA, 25 bp, Mus musculus
gggcctataggcagtgttgacatgt

SEQ ID NO: 635501 - DNA, 25 bp, Mus musculus
gggcctataggctgtgttgacatgt

SEQ ID NO: 635502 - DNA, 25 bp, Mus musculus
gggcctataggtccttcactgttcc

SEQ ID NO: 635503 - DNA, 25 bp, Mus musculus
gggcctataggtgcttcactgttcc

SEQ ID NO: 635504 - DNA, 25 bp, Mus musculus
gggcctatagtcctttgtactcaat

SEQ ID NO: 635505 - DNA, 25 bp, Mus musculus
gggcctatagtcgtttgtactcaat

SEQ ID NO: 635506 - DNA, 25 bp, Mus musculus
gggcctatatcaacacaacgcactc

SEQ ID NO: 635507 - DNA, 25 bp, Mus musculus
gggcctatatcatcacaacgcactc

SEQ ID NO: 635508 - DNA, 25 bp, Mus musculus
gggcctatcatcatggaccttacag

SEQ ID NO: 635509 - DNA, 25 bp, Mus musculus
gggcctatcatcttggaccttacag

SEQ ID NO: 635510 - DNA, 25 bp, Mus musculus
gggcctatccttcacctttgaagaa

SEQ ID NO: 635511 - DNA, 25 bp, Mus musculus
gggcctatccttgacctttgaagaa

SEQ ID NO: 635512 - DNA, 25 bp, Mus musculus
gggcctatctaaagtattcagttaa

SEQ ID NO: 635513 - DNA, 25 bp, Mus musculus
gggcctatctaatgtattcagttaa

SEQ ID NO: 635514 - DNA, 25 bp, Mus musculus
gggcctatgcacctccgagaagtcg

SEQ ID NO: 635515 - DNA, 25 bp, Mus musculus
gggcctatgcacgtccgagaagtcg

SEQ ID NO: 635516 - DNA, 25 bp, Mus musculus
gggcctatggcacagcatcaatgca

SEQ ID NO: 635517 - DNA, 25 bp, Mus musculus
gggcctatggcagagcatcaatgca

SEQ ID NO: 635518 - DNA, 25 bp, Mus musculus
gggcctatggccacactagaacaag

SEQ ID NO: 635519 - DNA, 25 bp, Mus musculus
gggcctatggcctcactagaacaag

SEQ ID NO: 635520 - DNA, 25 bp, Mus musculus
gggcctattcttcgattcagtgttc

SEQ ID NO: 635521 - DNA, 25 bp, Mus musculus
gggcctattcttggattcagtgttc

SEQ ID NO: 635522 - DNA, 25 bp, Mus musculus
gggcctattgtaaggattcccgaag

SEQ ID NO: 635523 - DNA, 25 bp, Mus musculus
gggcctattgtatggattcccgaag

SEQ ID NO: 635524 - DNA, 25 bp, Mus musculus
gggcctatttatagccttcctctgc

SEQ ID NO: 635525 - DNA, 25 bp, Mus musculus
gggcctatttattgccttcctctgc

SEQ ID NO: 635526 - DNA, 25 bp, Mus musculus
gggcctattttgagacatgagaatg

SEQ ID NO: 635527 - DNA, 25 bp, Mus musculus
gggcctattttgtgacatgagaatg

SEQ ID NO: 635528 - DNA, 25 bp, Mus musculus
gggcctcaagatcacttactttgcg

SEQ ID NO: 635529 - DNA, 25 bp, Mus musculus
gggcctcaagatgacttactttgcg

SEQ ID NO: 635530 - DNA, 25 bp, Mus musculus
gggcctcaaggacatctcatgattc

SEQ ID NO: 635531 - DNA, 25 bp, Mus musculus
gggcctcaaggagatctcatgattc

SEQ ID NO: 635532 - DNA, 25 bp, Mus musculus
gggcctcaagtacctctttatcctt

SEQ ID NO: 635533 - DNA, 25 bp, Mus musculus
gggcctcaagtagctctttatcctt

SEQ ID NO: 635534 - DNA, 25 bp, Mus musculus
gggcctcaatatcctagagcacacg

SEQ ID NO: 635535 - DNA, 25 bp, Mus musculus
gggcctcaatatgctagagcacacg

SEQ ID NO: 635536 - DNA, 25 bp, Mus musculus
gggcctcaatgcaagataaattgtc

SEQ ID NO: 635537 - DNA, 25 bp, Mus musculus
gggcctcaatgctagataaattgtc

SEQ ID NO: 635538 - DNA, 25 bp, Mus musculus
gggcctcacaaccttgttgtggtta

SEQ ID NO: 635539 - DNA, 25 bp, Mus musculus
gggcctcacaacgttgttgtggtta

SEQ ID NO: 635540 - DNA, 25 bp, Mus musculus
gggcctcacatcctttgagccagaa

SEQ ID NO: 635541 - DNA, 25 bp, Mus musculus
gggcctcacatcgtttgagccagaa

SEQ ID NO: 635542 - DNA, 25 bp, Mus musculus
gggcctcagaaccattttacaagaa

SEQ ID NO: 635543 - DNA, 25 bp, Mus musculus
gggcctcagaacgattttacaagaa

SEQ ID NO: 635544 - DNA, 25 bp, Mus musculus
gggcctcagacaagtccctgttaag

SEQ ID NO: 635545 - DNA, 25 bp, Mus musculus
gggcctcagacatgtccctgttaag

SEQ ID NO: 635546 - DNA, 25 bp, Mus musculus
gggcctcagaggatctagttttggt

SEQ ID NO: 635547 - DNA, 25 bp, Mus musculus
gggcctcagaggttctagttttggt

SEQ ID NO: 635548 - DNA, 25 bp, Mus musculus
gggcctcagcatcccaggctcgaag

SEQ ID NO: 635549 - DNA, 25 bp, Mus musculus
gggcctcagcatctgtaactccagg

SEQ ID NO: 635550 - DNA, 25 bp, Mus musculus
gggcctcagcatgccaggctcgaag

SEQ ID NO: 635551 - DNA, 25 bp, Mus musculus
gggcctcagcatgtgtaactccagg

SEQ ID NO: 635552 - DNA, 25 bp, Mus musculus
gggcctcagcctatggagaaattga

SEQ ID NO: 635553 - DNA, 25 bp, Mus musculus
gggcctcagcctttggagaaattga

SEQ ID NO: 635554 - DNA, 25 bp, Mus musculus
gggcctcagctgacacagaacacct

SEQ ID NO: 635555 - DNA, 25 bp, Mus musculus
gggcctcagctgtcacagaacacct

SEQ ID NO: 635556 - DNA, 25 bp, Mus musculus
gggcctcagcttacaaatccatgaa

SEQ ID NO: 635557 - DNA, 25 bp, Mus musculus
gggcctcagctttcaaatccatgaa

SEQ ID NO: 635558 - DNA, 25 bp, Mus musculus
gggcctcaggatctgtgtcacttag

SEQ ID NO: 635559 - DNA, 25 bp, Mus musculus
gggcctcaggatgtgtgtcacttag

SEQ ID NO: 635560 - DNA, 25 bp, Mus musculus
gggcctcagtcaagttgtcctgcac

SEQ ID NO: 635561 - DNA, 25 bp, Mus musculus
gggcctcagtcatgttgtcctgcac

SEQ ID NO: 635562 - DNA, 25 bp, Mus musculus
gggcctcataggacttggatcagta

SEQ ID NO: 635563 - DNA, 25 bp, Mus musculus
gggcctcataggtcttggatcagta

SEQ ID NO: 635564 - DNA, 25 bp, Mus musculus
gggcctcatagtaagcaaaactctt

SEQ ID NO: 635565 - DNA, 25 bp, Mus musculus
gggcctcatagttagcaaaactctt

SEQ ID NO: 635566 - DNA, 25 bp, Mus musculus
gggcctcatatcagataaacctctg

SEQ ID NO: 635567 - DNA, 25 bp, Mus musculus
gggcctcatatctgataaacctctg

SEQ ID NO: 635568 - DNA, 25 bp, Mus musculus
gggcctcatattagtttacttttct

SEQ ID NO: 635569 - DNA, 25 bp, Mus musculus
gggcctcatatttgtttacttttct

SEQ ID NO: 635570 - DNA, 25 bp, Mus musculus
gggcctcatccaacatcgatgcggg

SEQ ID NO: 635571 - DNA, 25 bp, Mus musculus
gggcctcatccatcatcgatgcggg

SEQ ID NO: 635572 - DNA, 25 bp, Mus musculus
gggcctcatctacaagctgggcagt

SEQ ID NO: 635573 - DNA, 25 bp, Mus musculus
gggcctcatctagaagctgggcagt

SEQ ID NO: 635574 - DNA, 25 bp, Mus musculus
gggcctcatctcagtagtgggttag

SEQ ID NO: 635575 - DNA, 25 bp, Mus musculus
gggcctcatctctgtagtgggttag

SEQ ID NO: 635576 - DNA, 25 bp, Mus musculus
gggcctcatgcacaacttagtacca

SEQ ID NO: 635577 - DNA, 25 bp, Mus musculus
gggcctcatgcagaacttagtacca

SEQ ID NO: 635578 - DNA, 25 bp, Mus musculus
gggcctcatgctaacgaaaccaaaa

SEQ ID NO: 635579 - DNA, 25 bp, Mus musculus
gggcctcatgctctaccacaggagg

SEQ ID NO: 635580 - DNA, 25 bp, Mus musculus
gggcctcatgctgtaccacaggagg

SEQ ID NO: 635581 - DNA, 25 bp, Mus musculus
gggcctcatgcttacgaaaccaaaa

SEQ ID NO: 635582 - DNA, 25 bp, Mus musculus
gggcctcatggacatgattgctttt

SEQ ID NO: 635583 - DNA, 25 bp, Mus musculus
gggcctcatggacttggtcttgtta

SEQ ID NO: 635584 - DNA, 25 bp, Mus musculus
gggcctcatggagatgattgctttt

SEQ ID NO: 635585 - DNA, 25 bp, Mus musculus
gggcctcatggagttggtcttgtta

SEQ ID NO: 635586 - DNA, 25 bp, Mus musculus
gggcctcatggtcagactctttcaa

SEQ ID NO: 635587 - DNA, 25 bp, Mus musculus
gggcctcatggtgagactctttcaa

SEQ ID NO: 635588 - DNA, 25 bp, Mus musculus
gggcctcattccatgcagcagatgg

SEQ ID NO: 635589 - DNA, 25 bp, Mus musculus
gggcctcattccttgcagcagatgg

SEQ ID NO: 635590 - DNA, 25 bp, Mus musculus
gggcctcatttcagagacagagtaa

SEQ ID NO: 635591 - DNA, 25 bp, Mus musculus
gggcctcatttctgagacagagtaa

SEQ ID NO: 635592 - DNA, 25 bp, Mus musculus
gggcctccaaaactaattcagtcct

SEQ ID NO: 635593 - DNA, 25 bp, Mus musculus
gggcctccaaaagtaattcagtcct

SEQ ID NO: 635594 - DNA, 25 bp, Mus musculus
gggcctccaaatcttctcgagagtc

SEQ ID NO: 635595 - DNA, 25 bp, Mus musculus
gggcctccaaatgttctcgagagtc

SEQ ID NO: 635596 - DNA, 25 bp, Mus musculus
gggcctccaagtctgccgcagtgtc

SEQ ID NO: 635597 - DNA, 25 bp, Mus musculus
gggcctccaagtgtgccgcagtgtc

SEQ ID NO: 635598 - DNA, 25 bp, Mus musculus
gggcctccagataactattaagact

SEQ ID NO: 635599 - DNA, 25 bp, Mus musculus
gggcctccagatctcccaagagtag

SEQ ID NO: 635600 - DNA, 25 bp, Mus musculus
gggcctccagatgtcccaagagtag

SEQ ID NO: 635601 - DNA, 25 bp, Mus musculus
gggcctccagattactattaagact

SEQ ID NO: 635602 - DNA, 25 bp, Mus musculus
gggcctccattcataccagaatctt

SEQ ID NO: 635603 - DNA, 25 bp, Mus musculus
gggcctccattcttaccagaatctt

SEQ ID NO: 635604 - DNA, 25 bp, Mus musculus
gggcctccattgacataagtacctt

SEQ ID NO: 635605 - DNA, 25 bp, Mus musculus
gggcctccattgtcataagtacctt

SEQ ID NO: 635606 - DNA, 25 bp, Mus musculus
gggcctcccagcagcgtgtgctgag

SEQ ID NO: 635607 - DNA, 25 bp, Mus musculus
gggcctcccagctgcgtgtgctgag

SEQ ID NO: 635608 - DNA, 25 bp, Mus musculus
gggcctccctagcactggagataac

SEQ ID NO: 635609 - DNA, 25 bp, Mus musculus
gggcctccctaggactggagataac

SEQ ID NO: 635610 - DNA, 25 bp, Mus musculus
gggcctcccttcagtatctcagaag

SEQ ID NO: 635611 - DNA, 25 bp, Mus musculus
gggcctcccttctgtatctcagaag

SEQ ID NO: 635612 - DNA, 25 bp, Mus musculus
gggcctcccttgaacatgagtatta

SEQ ID NO: 635613 - DNA, 25 bp, Mus musculus
gggcctcccttgtacatgagtatta

SEQ ID NO: 635614 - DNA, 25 bp, Mus musculus
gggcctcctctacaagttcatccta

SEQ ID NO: 635615 - DNA, 25 bp, Mus musculus
gggcctcctctagaagttcatccta

SEQ ID NO: 635616 - DNA, 25 bp, Mus musculus
gggcctcctcttcacagtgttaaga

SEQ ID NO: 635617 - DNA, 25 bp, Mus musculus
gggcctcctcttgacagtgttaaga

SEQ ID NO: 635618 - DNA, 25 bp, Mus musculus
gggcctcctgacaaacttgggatgt

SEQ ID NO: 635619 - DNA, 25 bp, Mus musculus
gggcctcctgactaacttgggatgt

SEQ ID NO: 635620 - DNA, 25 bp, Mus musculus
gggcctcctgcaaggctgtgcaaaa

SEQ ID NO: 635621 - DNA, 25 bp, Mus musculus
gggcctcctgcatggctgtgcaaaa

SEQ ID NO: 635622 - DNA, 25 bp, Mus musculus
gggcctcctggcatatgtgatcaga

SEQ ID NO: 635623 - DNA, 25 bp, Mus musculus
gggcctcctggcttatgtgatcaga

SEQ ID NO: 635624 - DNA, 25 bp, Mus musculus
gggcctcctgttctacaagtggaag

SEQ ID NO: 635625 - DNA, 25 bp, Mus musculus
gggcctcctgttgtacaagtggaag

SEQ ID NO: 635626 - DNA, 25 bp, Mus musculus
gggcctcgagcaatgcctggaatgt

SEQ ID NO: 635627 - DNA, 25 bp, Mus musculus
gggcctcgagcattgcctggaatgt

SEQ ID NO: 635628 - DNA, 25 bp, Mus musculus
gggcctcgagccatgcgtcagaaga

SEQ ID NO: 635629 - DNA, 25 bp, Mus musculus
gggcctcgagccttgcgtcagaaga

SEQ ID NO: 635630 - DNA, 25 bp, Mus musculus
gggcctcgcctgaaaaaggaacaat

SEQ ID NO: 635631 - DNA, 25 bp, Mus musculus
gggcctcgcctgtaaaaggaacaat

SEQ ID NO: 635632 - DNA, 25 bp, Mus musculus
gggcctcgctataattatgcccatg

SEQ ID NO: 635633 - DNA, 25 bp, Mus musculus
gggcctcgctattattatgcccatg

SEQ ID NO: 635634 - DNA, 25 bp, Mus musculus
gggcctcgctcacacattcaaaaaa

SEQ ID NO: 635635 - DNA, 25 bp, Mus musculus
gggcctcgctcagacattcaaaaaa

SEQ ID NO: 635636 - DNA, 25 bp, Mus musculus
gggcctcggactagcttgtgtatgc

SEQ ID NO: 635637 - DNA, 25 bp, Mus musculus
gggcctcggacttgcttgtgtatgc

SEQ ID NO: 635638 - DNA, 25 bp, Mus musculus
gggcctcggtcaacaagccatttat

SEQ ID NO: 635639 - DNA, 25 bp, Mus musculus
gggcctcggtcatcaagccatttat

SEQ ID NO: 635640 - DNA, 25 bp, Mus musculus
gggcctcgtgcaaggacagtccatc

SEQ ID NO: 635641 - DNA, 25 bp, Mus musculus
gggcctcgtgcatggacagtccatc

SEQ ID NO: 635642 - DNA, 25 bp, Mus musculus
gggcctcgttcaaggtttcattcaa

SEQ ID NO: 635643 - DNA, 25 bp, Mus musculus
gggcctcgttcatggtttcattcaa

SEQ ID NO: 635644 - DNA, 25 bp, Mus musculus
gggcctctaagaaactgttacctag

SEQ ID NO: 635645 - DNA, 25 bp, Mus musculus
gggcctctaagatactgttacctag

SEQ ID NO: 635646 - DNA, 25 bp, Mus musculus
gggcctctaatacctaagactcttt

SEQ ID NO: 635647 - DNA, 25 bp, Mus musculus
gggcctctaatagctaagactcttt

SEQ ID NO: 635648 - DNA, 25 bp, Mus musculus
gggcctctacagacttaggaccctg

SEQ ID NO: 635649 - DNA, 25 bp, Mus musculus
gggcctctacagtcttaggaccctg

SEQ ID NO: 635650 - DNA, 25 bp, Mus musculus
gggcctctagggagacactgagaac

SEQ ID NO: 635651 - DNA, 25 bp, Mus musculus
gggcctctagggtgacactgagaac

SEQ ID NO: 635652 - DNA, 25 bp, Mus musculus
gggcctctatatattgtacatgtca

SEQ ID NO: 635653 - DNA, 25 bp, Mus musculus
gggcctctatattttgtacatgtca

SEQ ID NO: 635654 - DNA, 25 bp, Mus musculus
gggcctctcatgaacagagcaagca

SEQ ID NO: 635655 - DNA, 25 bp, Mus musculus
gggcctctcatgtacagagcaagca

SEQ ID NO: 635656 - DNA, 25 bp, Mus musculus
gggcctctccccctgagaagaaaag

SEQ ID NO: 635657 - DNA, 25 bp, Mus musculus
gggcctctccccgtgagaagaaaag

SEQ ID NO: 635658 - DNA, 25 bp, Mus musculus
gggcctctccttcagatctagatta

SEQ ID NO: 635659 - DNA, 25 bp, Mus musculus
gggcctctccttgagatctagatta

SEQ ID NO: 635660 - DNA, 25 bp, Mus musculus
gggcctctctggagctgttacagta

SEQ ID NO: 635661 - DNA, 25 bp, Mus musculus
gggcctctctggattgtttcacagc

SEQ ID NO: 635662 - DNA, 25 bp, Mus musculus
gggcctctctggtgctgttacagta

SEQ ID NO: 635663 - DNA, 25 bp, Mus musculus
gggcctctctggtttgtttcacagc

SEQ ID NO: 635664 - DNA, 25 bp, Mus musculus
gggcctctcttccacagttaaccag

SEQ ID NO: 635665 - DNA, 25 bp, Mus musculus
gggcctctcttcgacagttaaccag

SEQ ID NO: 635666 - DNA, 25 bp, Mus musculus
gggcctctcttgagctctgatcagt

SEQ ID NO: 635667 - DNA, 25 bp, Mus musculus
gggcctctcttgccttctgactgaa

SEQ ID NO: 635668 - DNA, 25 bp, Mus musculus
gggcctctcttggcttctgactgaa

SEQ ID NO: 635669 - DNA, 25 bp, Mus musculus
gggcctctcttgtgctctgatcagt

SEQ ID NO: 635670 - DNA, 25 bp, Mus musculus
gggcctctgatgcaagaaagctaat

SEQ ID NO: 635671 - DNA, 25 bp, Mus musculus
gggcctctgatggaagaaagctaat

SEQ ID NO: 635672 - DNA, 25 bp, Mus musculus
gggcctctgcagatatctctgggaa

SEQ ID NO: 635673 - DNA, 25 bp, Mus musculus
gggcctctgcagttatctctgggaa

SEQ ID NO: 635674 - DNA, 25 bp, Mus musculus
gggcctctggccatgaaaatcgctg

SEQ ID NO: 635675 - DNA, 25 bp, Mus musculus
gggcctctggccttgaaaatcgctg

SEQ ID NO: 635676 - DNA, 25 bp, Mus musculus
gggcctctggtcaagcaaagagctc

SEQ ID NO: 635677 - DNA, 25 bp, Mus musculus
gggcctctggtctagcaaagagctc

SEQ ID NO: 635678 - DNA, 25 bp, Mus musculus
gggcctctggttcctatcagacagg

SEQ ID NO: 635679 - DNA, 25 bp, Mus musculus
gggcctctggttgctatcagacagg

SEQ ID NO: 635680 - DNA, 25 bp, Mus musculus
gggcctctgttccagacattgtact

SEQ ID NO: 635681 - DNA, 25 bp, Mus musculus
gggcctctgttcgagacattgtact

SEQ ID NO: 635682 - DNA, 25 bp, Mus musculus
gggcctcttctaaatttgggtacag

SEQ ID NO: 635683 - DNA, 25 bp, Mus musculus
gggcctcttctatatttgggtacag

SEQ ID NO: 635684 - DNA, 25 bp, Mus musculus
gggcctcttgatcctgcacgggacc

SEQ ID NO: 635685 - DNA, 25 bp, Mus musculus
gggcctcttgatgctgcacgggacc

SEQ ID NO: 635686 - DNA, 25 bp, Mus musculus
gggcctctttaaagtcacacaccat

SEQ ID NO: 635687 - DNA, 25 bp, Mus musculus
gggcctctttaatgtcacacaccat

SEQ ID NO: 635688 - DNA, 25 bp, Mus musculus
gggcctctttacagaagcactgttt

SEQ ID NO: 635689 - DNA, 25 bp, Mus musculus
gggcctctttactgaagcactgttt

SEQ ID NO: 635690 - DNA, 25 bp, Mus musculus
gggcctctttccatcaagagtactt

SEQ ID NO: 635691 - DNA, 25 bp, Mus musculus
gggcctctttccttcaagagtactt

SEQ ID NO: 635692 - DNA, 25 bp, Mus musculus
gggcctgaaaacctagactgattcc

SEQ ID NO: 635693 - DNA, 25 bp, Mus musculus
gggcctgaaaacgtagactgattcc

SEQ ID NO: 635694 - DNA, 25 bp, Mus musculus
gggcctgaaatgctcacttctgtca

SEQ ID NO: 635695 - DNA, 25 bp, Mus musculus
gggcctgaaatggtcacttctgtca

SEQ ID NO: 635696 - DNA, 25 bp, Mus musculus
gggcctgaacagacagaccctacag

SEQ ID NO: 635697 - DNA, 25 bp, Mus musculus
gggcctgaacagtcagaccctacag

SEQ ID NO: 635698 - DNA, 25 bp, Mus musculus
gggcctgaacatctgggaaatttaa

SEQ ID NO: 635699 - DNA, 25 bp, Mus musculus
gggcctgaacatgtgggaaatttaa

SEQ ID NO: 635700 - DNA, 25 bp, Mus musculus
gggcctgaagtaagaatggatttcc

SEQ ID NO: 635701 - DNA, 25 bp, Mus musculus
gggcctgaagtatgaatggatttcc

SEQ ID NO: 635702 - DNA, 25 bp, Mus musculus
gggcctgaatgtagtatctgattac

SEQ ID NO: 635703 - DNA, 25 bp, Mus musculus
gggcctgaatgttgtatctgattac

SEQ ID NO: 635704 - DNA, 25 bp, Mus musculus
gggcctgacttccacaaagttagct

SEQ ID NO: 635705 - DNA, 25 bp, Mus musculus
gggcctgacttcgacaaagttagct

SEQ ID NO: 635706 - DNA, 25 bp, Mus musculus
gggcctgactttctagatcctcctt

SEQ ID NO: 635707 - DNA, 25 bp, Mus musculus
gggcctgactttgtagatcctcctt

SEQ ID NO: 635708 - DNA, 25 bp, Mus musculus
gggcctgagaagcttcgttgcttta

SEQ ID NO: 635709 - DNA, 25 bp, Mus musculus
gggcctgagaaggttcgttgcttta

SEQ ID NO: 635710 - DNA, 25 bp, Mus musculus
gggcctgagagcatgcaggcactta

SEQ ID NO: 635711 - DNA, 25 bp, Mus musculus
gggcctgagagcttgcaggcactta

SEQ ID NO: 635712 - DNA, 25 bp, Mus musculus
gggcctgagcagctttcttacccta

SEQ ID NO: 635713 - DNA, 25 bp, Mus musculus
gggcctgagcaggtttcttacccta

SEQ ID NO: 635714 - DNA, 25 bp, Mus musculus
gggcctgagccaacgcacataataa

SEQ ID NO: 635715 - DNA, 25 bp, Mus musculus
gggcctgagccatcgcacataataa

SEQ ID NO: 635716 - DNA, 25 bp, Mus musculus
gggcctgagctgcagaaccaacaag

SEQ ID NO: 635717 - DNA, 25 bp, Mus musculus
gggcctgagctggagaaccaacaag

SEQ ID NO: 635718 - DNA, 25 bp, Mus musculus
gggcctgaggaacatctctgcctat

SEQ ID NO: 635719 - DNA, 25 bp, Mus musculus
gggcctgaggaagatctctgcctat

SEQ ID NO: 635720 - DNA, 25 bp, Mus musculus
gggcctgagtatacgctgttgcaag

SEQ ID NO: 635721 - DNA, 25 bp, Mus musculus
gggcctgagtattcgctgttgcaag

SEQ ID NO: 635722 - DNA, 25 bp, Mus musculus
gggcctgatcccagaatccacagag

SEQ ID NO: 635723 - DNA, 25 bp, Mus musculus
gggcctgatccctgaatccacagag

SEQ ID NO: 635724 - DNA, 25 bp, Mus musculus
gggcctgatgttaacatctctgcaa

SEQ ID NO: 635725 - DNA, 25 bp, Mus musculus
gggcctgatgtttacatctctgcaa

SEQ ID NO: 635726 - DNA, 25 bp, Mus musculus
gggcctgattggaggcaacttccat

SEQ ID NO: 635727 - DNA, 25 bp, Mus musculus
gggcctgattggtggcaacttccat

SEQ ID NO: 635728 - DNA, 25 bp, Mus musculus
gggcctgattgtcagccagaagacc

SEQ ID NO: 635729 - DNA, 25 bp, Mus musculus
gggcctgattgtgagccagaagacc

SEQ ID NO: 635730 - DNA, 25 bp, Mus musculus
gggcctgcacaaacagccgggcttc

SEQ ID NO: 635731 - DNA, 25 bp, Mus musculus
gggcctgcacaatcagccgggcttc

SEQ ID NO: 635732 - DNA, 25 bp, Mus musculus
gggcctgcacagcgcaagcccttta

SEQ ID NO: 635733 - DNA, 25 bp, Mus musculus
gggcctgcacagggcaagcccttta

SEQ ID NO: 635734 - DNA, 25 bp, Mus musculus
gggcctgcagagaatgatccttctt

SEQ ID NO: 635735 - DNA, 25 bp, Mus musculus
gggcctgcagagtatgatccttctt

SEQ ID NO: 635736 - DNA, 25 bp, Mus musculus
gggcctgcagttctgaacttgattg

SEQ ID NO: 635737 - DNA, 25 bp, Mus musculus
gggcctgcagttgtgaacttgattg

SEQ ID NO: 635738 - DNA, 25 bp, Mus musculus
gggcctgcataaagcctcattttct

SEQ ID NO: 635739 - DNA, 25 bp, Mus musculus
gggcctgcataatgcctcattttct

SEQ ID NO: 635740 - DNA, 25 bp, Mus musculus
gggcctgcatcactctgggtgcata

SEQ ID NO: 635741 - DNA, 25 bp, Mus musculus
gggcctgcatcagtctgggtgcata

SEQ ID NO: 635742 - DNA, 25 bp, Mus musculus
gggcctgcatgtaatgtttatgaac

SEQ ID NO: 635743 - DNA, 25 bp, Mus musculus
gggcctgcatgttatgtttatgaac

SEQ ID NO: 635744 - DNA, 25 bp, Mus musculus
gggcctgccacccaaataagtctgg

SEQ ID NO: 635745 - DNA, 25 bp, Mus musculus
gggcctgccaccgaaataagtctgg

SEQ ID NO: 635746 - DNA, 25 bp, Mus musculus
gggcctgccacgaatcagtacttta

SEQ ID NO: 635747 - DNA, 25 bp, Mus musculus
gggcctgccacgcagatttcactgg

SEQ ID NO: 635748 - DNA, 25 bp, Mus musculus
gggcctgccacggagatttcactgg

SEQ ID NO: 635749 - DNA, 25 bp, Mus musculus
gggcctgccacgtatcagtacttta

SEQ ID NO: 635750 - DNA, 25 bp, Mus musculus
gggcctgccatgagttctgagtttc

SEQ ID NO: 635751 - DNA, 25 bp, Mus musculus
gggcctgccatgtgttctgagtttc

SEQ ID NO: 635752 - DNA, 25 bp, Mus musculus
gggcctgccattcctaatggacaat

SEQ ID NO: 635753 - DNA, 25 bp, Mus musculus
gggcctgccattgctaatggacaat

SEQ ID NO: 635754 - DNA, 25 bp, Mus musculus
gggcctgcccatcagctatgatgaa

SEQ ID NO: 635755 - DNA, 25 bp, Mus musculus
gggcctgcccatgagctatgatgaa

SEQ ID NO: 635756 - DNA, 25 bp, Mus musculus
gggcctgcctttatattggcgccac

SEQ ID NO: 635757 - DNA, 25 bp, Mus musculus
gggcctgcctttttattggcgccac

SEQ ID NO: 635758 - DNA, 25 bp, Mus musculus
gggcctgcgttgctggcacatactt

SEQ ID NO: 635759 - DNA, 25 bp, Mus musculus
gggcctgcgttggtggcacatactt

SEQ ID NO: 635760 - DNA, 25 bp, Mus musculus
gggcctgctccgagagtaaatgcat

SEQ ID NO: 635761 - DNA, 25 bp, Mus musculus
gggcctgctccgtgagtaaatgcat

SEQ ID NO: 635762 - DNA, 25 bp, Mus musculus
gggcctgctgacaggcaagtataaa

SEQ ID NO: 635763 - DNA, 25 bp, Mus musculus
gggcctgctgactggcaagtataaa

SEQ ID NO: 635764 - DNA, 25 bp, Mus musculus
gggcctgctgttcatgaggtatcca

SEQ ID NO: 635765 - DNA, 25 bp, Mus musculus
gggcctgctgttgatgaggtatcca

SEQ ID NO: 635766 - DNA, 25 bp, Mus musculus
gggcctggacagcaattgtgtttta

SEQ ID NO: 635767 - DNA, 25 bp, Mus musculus
gggcctggacaggaattgtgtttta

SEQ ID NO: 635768 - DNA, 25 bp, Mus musculus
gggcctggacatctcacaacagctc

SEQ ID NO: 635769 - DNA, 25 bp, Mus musculus
gggcctggacatgtcacaacagctc

SEQ ID NO: 635770 - DNA, 25 bp, Mus musculus
gggcctggagaaatattcaccggtt

SEQ ID NO: 635771 - DNA, 25 bp, Mus musculus
gggcctggagaattattcaccggtt

SEQ ID NO: 635772 - DNA, 25 bp, Mus musculus
gggcctggagctacgatttcaggat

SEQ ID NO: 635773 - DNA, 25 bp, Mus musculus
gggcctggagctccaataatgcttt

SEQ ID NO: 635774 - DNA, 25 bp, Mus musculus
gggcctggagctgcaataatgcttt

SEQ ID NO: 635775 - DNA, 25 bp, Mus musculus
gggcctggagcttcgatttcaggat

SEQ ID NO: 635776 - DNA, 25 bp, Mus musculus
gggcctggcaggattcgaaccctcc

SEQ ID NO: 635777 - DNA, 25 bp, Mus musculus
gggcctggcaggtttcgaaccctcc

SEQ ID NO: 635778 - DNA, 25 bp, Mus musculus
gggcctggccatctacgacacaatg

SEQ ID NO: 635779 - DNA, 25 bp, Mus musculus
gggcctggccatgtacgacacaatg

SEQ ID NO: 635780 - DNA, 25 bp, Mus musculus
gggcctggcccaccgtcacagagat

SEQ ID NO: 635781 - DNA, 25 bp, Mus musculus
gggcctggcccagcgtcacagagat

SEQ ID NO: 635782 - DNA, 25 bp, Mus musculus
gggcctggcctgctagaccttaaag

SEQ ID NO: 635783 - DNA, 25 bp, Mus musculus
gggcctggcctggtagaccttaaag

SEQ ID NO: 635784 - DNA, 25 bp, Mus musculus
gggcctggctacatttaagctctag

SEQ ID NO: 635785 - DNA, 25 bp, Mus musculus
gggcctggctacttttaagctctag

SEQ ID NO: 635786 - DNA, 25 bp, Mus musculus
gggcctggcttaccagaccttttgc

SEQ ID NO: 635787 - DNA, 25 bp, Mus musculus
gggcctggcttagcagaccttttgc

SEQ ID NO: 635788 - DNA, 25 bp, Mus musculus
gggcctgggacgataaaactgaatt

SEQ ID NO: 635789 - DNA, 25 bp, Mus musculus
gggcctgggacgttaaaactgaatt

SEQ ID NO: 635790 - DNA, 25 bp, Mus musculus
gggcctgggactacagaaactcgat

SEQ ID NO: 635791 - DNA, 25 bp, Mus musculus
gggcctgggactatttccggcaatg

SEQ ID NO: 635792 - DNA, 25 bp, Mus musculus
gggcctgggacttcagaaactcgat

SEQ ID NO: 635793 - DNA, 25 bp, Mus musculus
gggcctgggactttttccggcaatg

SEQ ID NO: 635794 - DNA, 25 bp, Mus musculus
gggcctgggttcaatcaccaacatt

SEQ ID NO: 635795 - DNA, 25 bp, Mus musculus
gggcctgggttctatcaccaacatt

SEQ ID NO: 635796 - DNA, 25 bp, Mus musculus
gggcctggtagcctccatagaatga

SEQ ID NO: 635797 - DNA, 25 bp, Mus musculus
gggcctggtagcgtccatagaatga

SEQ ID NO: 635798 - DNA, 25 bp, Mus musculus
gggcctggtcacatgatgaaccgtg

SEQ ID NO: 635799 - DNA, 25 bp, Mus musculus
gggcctggtcacttgatgaaccgtg

SEQ ID NO: 635800 - DNA, 25 bp, Mus musculus
gggcctggtcatactcattgtgata

SEQ ID NO: 635801 - DNA, 25 bp, Mus musculus
gggcctggtcattctcattgtgata

SEQ ID NO: 635802 - DNA, 25 bp, Mus musculus
gggcctggtgcactgctctcactga

SEQ ID NO: 635803 - DNA, 25 bp, Mus musculus
gggcctggtgcagtgctctcactga

SEQ ID NO: 635804 - DNA, 25 bp, Mus musculus
gggcctgtaagtcttcgagttacaa

SEQ ID NO: 635805 - DNA, 25 bp, Mus musculus
gggcctgtaagtgttcgagttacaa

SEQ ID NO: 635806 - DNA, 25 bp, Mus musculus
gggcctgtactccagtgactgctga

SEQ ID NO: 635807 - DNA, 25 bp, Mus musculus
gggcctgtactcgagtgactgctga

SEQ ID NO: 635808 - DNA, 25 bp, Mus musculus
gggcctgtagccaacgtgtgaacag

SEQ ID NO: 635809 - DNA, 25 bp, Mus musculus
gggcctgtagcctacgtgtgaacag

SEQ ID NO: 635810 - DNA, 25 bp, Mus musculus
gggcctgtagcgaggctatagccaa

SEQ ID NO: 635811 - DNA, 25 bp, Mus musculus
gggcctgtagcgtggctatagccaa

SEQ ID NO: 635812 - DNA, 25 bp, Mus musculus
gggcctgtaggaattcgttcccagc

SEQ ID NO: 635813 - DNA, 25 bp, Mus musculus
gggcctgtaggatttcgttcccagc

SEQ ID NO: 635814 - DNA, 25 bp, Mus musculus
gggcctgtccagagtcagtatgcat

SEQ ID NO: 635815 - DNA, 25 bp, Mus musculus
gggcctgtccagtgtcagtatgcat

SEQ ID NO: 635816 - DNA, 25 bp, Mus musculus
gggcctgtcttgacattctcaccta

SEQ ID NO: 635817 - DNA, 25 bp, Mus musculus
gggcctgtcttgtcattctcaccta

SEQ ID NO: 635818 - DNA, 25 bp, Mus musculus
gggcctgtgaaacacttaaaatctt

SEQ ID NO: 635819 - DNA, 25 bp, Mus musculus
gggcctgtgaaagacttaaaatctt

SEQ ID NO: 635820 - DNA, 25 bp, Mus musculus
gggcctgtgaagaccacccaaggga

SEQ ID NO: 635821 - DNA, 25 bp, Mus musculus
gggcctgtgaagtccacccaaggga

SEQ ID NO: 635822 - DNA, 25 bp, Mus musculus
gggcctgtgatgatttgtcttggac

SEQ ID NO: 635823 - DNA, 25 bp, Mus musculus
gggcctgtgatgttttgtcttggac

SEQ ID NO: 635824 - DNA, 25 bp, Mus musculus
gggcctgtgctgatgcaagactcag

SEQ ID NO: 635825 - DNA, 25 bp, Mus musculus
gggcctgtgctgttgcaagactcag

SEQ ID NO: 635826 - DNA, 25 bp, Mus musculus
gggcctgtggctccagattgtcata

SEQ ID NO: 635827 - DNA, 25 bp, Mus musculus
gggcctgtggctgcagattgtcata

SEQ ID NO: 635828 - DNA, 25 bp, Mus musculus
gggcctgtgggaaacgagctatact

SEQ ID NO: 635829 - DNA, 25 bp, Mus musculus
gggcctgtgggatacgagctatact

SEQ ID NO: 635830 - DNA, 25 bp, Mus musculus
gggcctgtggttactttctgtgatc

SEQ ID NO: 635831 - DNA, 25 bp, Mus musculus
gggcctgtggtttctttctgtgatc

SEQ ID NO: 635832 - DNA, 25 bp, Mus musculus
gggcctgtgtaaatgcaccgatggt

SEQ ID NO: 635833 - DNA, 25 bp, Mus musculus
gggcctgtgtaattgcaccgatggt

SEQ ID NO: 635834 - DNA, 25 bp, Mus musculus
gggcctgtgtatcctaagcaagtgc

SEQ ID NO: 635835 - DNA, 25 bp, Mus musculus
gggcctgtgtatgctaagcaagtgc

SEQ ID NO: 635836 - DNA, 25 bp, Mus musculus
gggcctgtgttcagagagtcaaaat

SEQ ID NO: 635837 - DNA, 25 bp, Mus musculus
gggcctgtgttctgagagtcaaaat

SEQ ID NO: 635838 - DNA, 25 bp, Mus musculus
gggcctgtgtttctacatctgtctc

SEQ ID NO: 635839 - DNA, 25 bp, Mus musculus
gggcctgtgtttgtacatctgtctc

SEQ ID NO: 635840 - DNA, 25 bp, Mus musculus
gggcctgttaggaaatgttagctca

SEQ ID NO: 635841 - DNA, 25 bp, Mus musculus
gggcctgttaggtaatgttagctca

SEQ ID NO: 635842 - DNA, 25 bp, Mus musculus
gggcctgttgttcttcccaaccaag

SEQ ID NO: 635843 - DNA, 25 bp, Mus musculus
gggcctgttgttgttcccaaccaag

SEQ ID NO: 635844 - DNA, 25 bp, Mus musculus
gggcctgtttggactcccagttgag

SEQ ID NO: 635845 - DNA, 25 bp, Mus musculus
gggcctgtttggtctcccagttgag

SEQ ID NO: 635846 - DNA, 25 bp, Mus musculus
gggcctgttttcaatccatggtcac

SEQ ID NO: 635847 - DNA, 25 bp, Mus musculus
gggcctgttttctatccatggtcac

SEQ ID NO: 635848 - DNA, 25 bp, Mus musculus
gggccttaaccacctggacagcgtg

SEQ ID NO: 635849 - DNA, 25 bp, Mus musculus
gggccttaaccagctggacagcgtg

SEQ ID NO: 635850 - DNA, 25 bp, Mus musculus
gggccttactaaattatcggtgctg

SEQ ID NO: 635851 - DNA, 25 bp, Mus musculus
gggccttactaatttatcggtgctg

SEQ ID NO: 635852 - DNA, 25 bp, Mus musculus
gggccttagattcccacctttacct

SEQ ID NO: 635853 - DNA, 25 bp, Mus musculus
gggccttagattgccacctttacct

SEQ ID NO: 635854 - DNA, 25 bp, Mus musculus
gggccttagggaaccaactgcatca

SEQ ID NO: 635855 - DNA, 25 bp, Mus musculus
gggccttagggatccaactgcatca

SEQ ID NO: 635856 - DNA, 25 bp, Mus musculus
gggccttagtatatcttgtttcaac

SEQ ID NO: 635857 - DNA, 25 bp, Mus musculus
gggccttagtatttcttgtttcaac

SEQ ID NO: 635858 - DNA, 25 bp, Mus musculus
gggccttatctcaaagatgtgtcat

SEQ ID NO: 635859 - DNA, 25 bp, Mus musculus
gggccttatctctaagatgtgtcat

SEQ ID NO: 635860 - DNA, 25 bp, Mus musculus
gggccttattatacctgtataaaca

SEQ ID NO: 635861 - DNA, 25 bp, Mus musculus
gggccttattattcctgtataaaca

SEQ ID NO: 635862 - DNA, 25 bp, Mus musculus
gggccttattttaaactggatcatc

SEQ ID NO: 635863 - DNA, 25 bp, Mus musculus
gggccttatttttaactggatcatc

SEQ ID NO: 635864 - DNA, 25 bp, Mus musculus
gggccttcaaagctgagctctccaa

SEQ ID NO: 635865 - DNA, 25 bp, Mus musculus
gggccttcaaaggtgagctctccaa

SEQ ID NO: 635866 - DNA, 25 bp, Mus musculus
gggccttcagtcatattgctctaga

SEQ ID NO: 635867 - DNA, 25 bp, Mus musculus
gggccttcagtcttattgctctaga

SEQ ID NO: 635868 - DNA, 25 bp, Mus musculus
gggccttcatatcccacaatgtatg

SEQ ID NO: 635869 - DNA, 25 bp, Mus musculus
gggccttcatatgccacaatgtatg

SEQ ID NO: 635870 - DNA, 25 bp, Mus musculus
gggccttcctgtcatgtgattatga

SEQ ID NO: 635871 - DNA, 25 bp, Mus musculus
gggccttcctgtgatgtgattatga

SEQ ID NO: 635872 - DNA, 25 bp, Mus musculus
gggccttcgatcctggatgatgtcc

SEQ ID NO: 635873 - DNA, 25 bp, Mus musculus
gggccttcgatcgtggatgatgtcc

SEQ ID NO: 635874 - DNA, 25 bp, Mus musculus
gggccttcgggaagtcagacatgta

SEQ ID NO: 635875 - DNA, 25 bp, Mus musculus
gggccttcgggatgtcagacatgta

SEQ ID NO: 635876 - DNA, 25 bp, Mus musculus
gggccttctacaaagctcaggcttt

SEQ ID NO: 635877 - DNA, 25 bp, Mus musculus
gggccttctacactttaaagcgctt

SEQ ID NO: 635878 - DNA, 25 bp, Mus musculus
gggccttctacagtttaaagcgctt

SEQ ID NO: 635879 - DNA, 25 bp, Mus musculus
gggccttctacatagctcaggcttt

SEQ ID NO: 635880 - DNA, 25 bp, Mus musculus
gggccttctgagacctgtaaatttt

SEQ ID NO: 635881 - DNA, 25 bp, Mus musculus
gggccttctgagtcctgtaaatttt

SEQ ID NO: 635882 - DNA, 25 bp, Mus musculus
gggccttctggtcgtaaacatgcct

SEQ ID NO: 635883 - DNA, 25 bp, Mus musculus
gggccttctggtggtaaacatgcct

SEQ ID NO: 635884 - DNA, 25 bp, Mus musculus
gggccttctgtcacaaagaggtctg

SEQ ID NO: 635885 - DNA, 25 bp, Mus musculus
gggccttctgtctcaaagaggtctg

SEQ ID NO: 635886 - DNA, 25 bp, Mus musculus
gggccttctgtgaggcagtttcaac

SEQ ID NO: 635887 - DNA, 25 bp, Mus musculus
gggccttctgtgtggcagtttcaac

SEQ ID NO: 635888 - DNA, 25 bp, Mus musculus
gggccttgaaccagttgacttccag

SEQ ID NO: 635889 - DNA, 25 bp, Mus musculus
gggccttgaacctgttgacttccag

SEQ ID NO: 635890 - DNA, 25 bp, Mus musculus
gggccttgacctaagcttagtacaa

SEQ ID NO: 635891 - DNA, 25 bp, Mus musculus
gggccttgaccttagcttagtacaa

SEQ ID NO: 635892 - DNA, 25 bp, Mus musculus
gggccttgagcccaagtattattca

SEQ ID NO: 635893 - DNA, 25 bp, Mus musculus
gggccttgagccgaagtattattca

SEQ ID NO: 635894 - DNA, 25 bp, Mus musculus
gggccttgatgcaactcagaacgtt

SEQ ID NO: 635895 - DNA, 25 bp, Mus musculus
gggccttgatgctactcagaacgtt

SEQ ID NO: 635896 - DNA, 25 bp, Mus musculus
gggccttgattaattcaagaaacca

SEQ ID NO: 635897 - DNA, 25 bp, Mus musculus
gggccttgattatttcaagaaacca

SEQ ID NO: 635898 - DNA, 25 bp, Mus musculus
gggccttgcaccctaggatttaagc

SEQ ID NO: 635899 - DNA, 25 bp, Mus musculus
gggccttgcaccgtaggatttaagc

SEQ ID NO: 635900 - DNA, 25 bp, Mus musculus
gggccttgcactcgtactttggaca

SEQ ID NO: 635901 - DNA, 25 bp, Mus musculus
gggccttgcactggtactttggaca

SEQ ID NO: 635902 - DNA, 25 bp, Mus musculus
gggccttgctatatcttaaaactta

SEQ ID NO: 635903 - DNA, 25 bp, Mus musculus
gggccttgctatttcttaaaactta

SEQ ID NO: 635904 - DNA, 25 bp, Mus musculus
gggccttgctgaatttcttcactac

SEQ ID NO: 635905 - DNA, 25 bp, Mus musculus
gggccttgctgattttcttcactac

SEQ ID NO: 635906 - DNA, 25 bp, Mus musculus
gggccttgctgccaggtatgaatca

SEQ ID NO: 635907 - DNA, 25 bp, Mus musculus
gggccttgctgcgaggtatgaatca

SEQ ID NO: 635908 - DNA, 25 bp, Mus musculus
gggccttgctttccctttgtttggg

SEQ ID NO: 635909 - DNA, 25 bp, Mus musculus
gggccttgctttgcctttgtttggg

SEQ ID NO: 635910 - DNA, 25 bp, Mus musculus
gggccttggcatctcagcctttaag

SEQ ID NO: 635911 - DNA, 25 bp, Mus musculus
gggccttggcatgtcagcctttaag

SEQ ID NO: 635912 - DNA, 25 bp, Mus musculus
gggccttggcctagaatcctaatag

SEQ ID NO: 635913 - DNA, 25 bp, Mus musculus
gggccttggccttgaatcctaatag

SEQ ID NO: 635914 - DNA, 25 bp, Mus musculus
gggccttggctgattctacgagatg

SEQ ID NO: 635915 - DNA, 25 bp, Mus musculus
gggccttggctgtttctacgagatg

SEQ ID NO: 635916 - DNA, 25 bp, Mus musculus
gggccttgggacaactcatcttggg

SEQ ID NO: 635917 - DNA, 25 bp, Mus musculus
gggccttgggactactcatcttggg

SEQ ID NO: 635918 - DNA, 25 bp, Mus musculus
gggccttggtagctgctaaccagac

SEQ ID NO: 635919 - DNA, 25 bp, Mus musculus
gggccttggtaggtgctaaccagac

SEQ ID NO: 635920 - DNA, 25 bp, Mus musculus
gggccttgtatgaccacctaatgga

SEQ ID NO: 635921 - DNA, 25 bp, Mus musculus
gggccttgtatgtccacctaatgga

SEQ ID NO: 635922 - DNA, 25 bp, Mus musculus
gggccttgtctaatcatacagcgcc

SEQ ID NO: 635923 - DNA, 25 bp, Mus musculus
gggccttgtctattcatacagcgcc

SEQ ID NO: 635924 - DNA, 25 bp, Mus musculus
gggccttgtgaaactgcctcacaat

SEQ ID NO: 635925 - DNA, 25 bp, Mus musculus
gggccttgtgaatctgcctcacaat

SEQ ID NO: 635926 - DNA, 25 bp, Mus musculus
gggccttgtgcaattttattgagac

SEQ ID NO: 635927 - DNA, 25 bp, Mus musculus
gggccttgtgcatttttattgagac

SEQ ID NO: 635928 - DNA, 25 bp, Mus musculus
gggccttgtgtaaaaagacgcttta

SEQ ID NO: 635929 - DNA, 25 bp, Mus musculus
gggccttgtgtataaagacgcttta

SEQ ID NO: 635930 - DNA, 25 bp, Mus musculus
gggccttgtgtcacaggtcttctgg

SEQ ID NO: 635931 - DNA, 25 bp, Mus musculus
gggccttgtgtcagagctcatggac

SEQ ID NO: 635932 - DNA, 25 bp, Mus musculus
gggccttgtgtcatcgactacatta

SEQ ID NO: 635933 - DNA, 25 bp, Mus musculus
gggccttgtgtctcaggtcttctgg

SEQ ID NO: 635934 - DNA, 25 bp, Mus musculus
gggccttgtgtctgagctcatggac

SEQ ID NO: 635935 - DNA, 25 bp, Mus musculus
gggccttgtgtcttcgactacatta

SEQ ID NO: 635936 - DNA, 25 bp, Mus musculus
gggccttgttacaagtgcaagccat

SEQ ID NO: 635937 - DNA, 25 bp, Mus musculus
gggccttgttactagtgcaagccat

SEQ ID NO: 635938 - DNA, 25 bp, Mus musculus
gggccttgttcacgagctgccactg

SEQ ID NO: 635939 - DNA, 25 bp, Mus musculus
gggccttgttcaggagctgccactg

SEQ ID NO: 635940 - DNA, 25 bp, Mus musculus
gggcctttaagccacgccgtgtgat

SEQ ID NO: 635941 - DNA, 25 bp, Mus musculus
gggcctttaagcgacgccgtgtgat

SEQ ID NO: 635942 - DNA, 25 bp, Mus musculus
gggcctttacgacaaacgctgcaaa

SEQ ID NO: 635943 - DNA, 25 bp, Mus musculus
gggcctttacgagaaacgctgcaaa

SEQ ID NO: 635944 - DNA, 25 bp, Mus musculus
gggcctttaggcattgaagcacgcc

SEQ ID NO: 635945 - DNA, 25 bp, Mus musculus
gggcctttaggctttgaagcacgcc

SEQ ID NO: 635946 - DNA, 25 bp, Mus musculus
gggcctttatcgcaaagttacatcc

SEQ ID NO: 635947 - DNA, 25 bp, Mus musculus
gggcctttatcggaaagttacatcc

SEQ ID NO: 635948 - DNA, 25 bp, Mus musculus
gggcctttatctctctcagatcagt

SEQ ID NO: 635949 - DNA, 25 bp, Mus musculus
gggcctttatctgtctcagatcagt

SEQ ID NO: 635950 - DNA, 25 bp, Mus musculus
gggcctttcactaccaaggtagtag

SEQ ID NO: 635951 - DNA, 25 bp, Mus musculus
gggcctttcacttccaaggtagtag

SEQ ID NO: 635952 - DNA, 25 bp, Mus musculus
gggcctttcagtaagagcaacatcc

SEQ ID NO: 635953 - DNA, 25 bp, Mus musculus
gggcctttcagttagagcaacatcc

SEQ ID NO: 635954 - DNA, 25 bp, Mus musculus
gggcctttcatcaaggcatgactat

SEQ ID NO: 635955 - DNA, 25 bp, Mus musculus
gggcctttcatctaggcatgactat

SEQ ID NO: 635956 - DNA, 25 bp, Mus musculus
gggcctttcctcaggtgtcacagaa

SEQ ID NO: 635957 - DNA, 25 bp, Mus musculus
gggcctttcctctggtgtcacagaa

SEQ ID NO: 635958 - DNA, 25 bp, Mus musculus
gggcctttccttcccagatgggctt

SEQ ID NO: 635959 - DNA, 25 bp, Mus musculus
gggcctttccttgccagatgggctt

SEQ ID NO: 635960 - DNA, 25 bp, Mus musculus
gggcctttctaaatgaatcctgtga

SEQ ID NO: 635961 - DNA, 25 bp, Mus musculus
gggcctttctaattgaatcctgtga

SEQ ID NO: 635962 - DNA, 25 bp, Mus musculus
gggcctttctgccttctgatataca

SEQ ID NO: 635963 - DNA, 25 bp, Mus musculus
gggcctttctgcgttctgatataca

SEQ ID NO: 635964 - DNA, 25 bp, Mus musculus
gggcctttgattaccatacgccatg

SEQ ID NO: 635965 - DNA, 25 bp, Mus musculus
gggcctttgatttccatacgccatg

SEQ ID NO: 635966 - DNA, 25 bp, Mus musculus
gggcctttgcaaacgcagcaggaaa

SEQ ID NO: 635967 - DNA, 25 bp, Mus musculus
gggcctttgcaatcgcagcaggaaa

SEQ ID NO: 635968 - DNA, 25 bp, Mus musculus
gggcctttgccaacaatgagctttt

SEQ ID NO: 635969 - DNA, 25 bp, Mus musculus
gggcctttgccatcaatgagctttt

SEQ ID NO: 635970 - DNA, 25 bp, Mus musculus
gggcctttggacaatgagcagcaga

SEQ ID NO: 635971 - DNA, 25 bp, Mus musculus
gggcctttggactatgagcagcaga

SEQ ID NO: 635972 - DNA, 25 bp, Mus musculus
gggcctttgggacacatgctagatc

SEQ ID NO: 635973 - DNA, 25 bp, Mus musculus
gggcctttgggagacatgctagatc

SEQ ID NO: 635974 - DNA, 25 bp, Mus musculus
gggcctttgtatctaccagtttgaa

SEQ ID NO: 635975 - DNA, 25 bp, Mus musculus
gggcctttgtatgtaccagtttgaa

SEQ ID NO: 635976 - DNA, 25 bp, Mus musculus
gggcctttgtccatgtaatgtccgg

SEQ ID NO: 635977 - DNA, 25 bp, Mus musculus
gggcctttgtccttgtaatgtccgg

SEQ ID NO: 635978 - DNA, 25 bp, Mus musculus
gggcctttgttgagccagagatacg

SEQ ID NO: 635979 - DNA, 25 bp, Mus musculus
gggcctttgttgtgccagagatacg

SEQ ID NO: 635980 - DNA, 25 bp, Mus musculus
gggccttttaagacgtgttccacag

SEQ ID NO: 635981 - DNA, 25 bp, Mus musculus
gggccttttaagtcgtgttccacag

SEQ ID NO: 635982 - DNA, 25 bp, Mus musculus
gggccttttaggactcggtcttgat

SEQ ID NO: 635983 - DNA, 25 bp, Mus musculus
gggccttttaggtctcggtcttgat

SEQ ID NO: 635984 - DNA, 25 bp, Mus musculus
gggccttttatcagagctgtagcat

SEQ ID NO: 635985 - DNA, 25 bp, Mus musculus
gggccttttatctgagctgtagcat

SEQ ID NO: 635986 - DNA, 25 bp, Mus musculus
gggccttttccacttcaatttcaat

SEQ ID NO: 635987 - DNA, 25 bp, Mus musculus
gggccttttccagttcaatttcaat

SEQ ID NO: 635988 - DNA, 25 bp, Mus musculus
gggccttttccccatgaataggtgt

SEQ ID NO: 635989 - DNA, 25 bp, Mus musculus
gggccttttcccgatgaataggtgt

SEQ ID NO: 635990 - DNA, 25 bp, Mus musculus
gggccttttcctcgctcagaagtat

SEQ ID NO: 635991 - DNA, 25 bp, Mus musculus
gggccttttcctggctcagaagtat

SEQ ID NO: 635992 - DNA, 25 bp, Mus musculus
gggccttttcgtcatccgatttctg

SEQ ID NO: 635993 - DNA, 25 bp, Mus musculus
gggccttttcgtgatccgatttctg

SEQ ID NO: 635994 - DNA, 25 bp, Mus musculus
gggcgaaaaaccagtagcacacaaa

SEQ ID NO: 635995 - DNA, 25 bp, Mus musculus
gggcgaaaaacctgtagcacacaaa

SEQ ID NO: 635996 - DNA, 25 bp, Mus musculus
gggcgaaacggcagtcttggtcact

SEQ ID NO: 635997 - DNA, 25 bp, Mus musculus
gggcgaaacggctgtcttggtcact

SEQ ID NO: 635998 - DNA, 25 bp, Mus musculus
gggcgaacactgagagcacctaagt

SEQ ID NO: 635999 - DNA, 25 bp, Mus musculus
gggcgaacactgtgagcacctaagt

SEQ ID NO: 636000 - DNA, 25 bp, Mus musculus
gggcgaaccccacttggcatgtccc

SEQ ID NO: 636001 - DNA, 25 bp, Mus musculus
gggcgaaccccagttggcatgtccc

SEQ ID NO: 636002 - DNA, 25 bp, Mus musculus
gggcgaactgtaaatgcacgatata

SEQ ID NO: 636003 - DNA, 25 bp, Mus musculus
gggcgaactgtatatgcacgatata

SEQ ID NO: 636004 - DNA, 25 bp, Mus musculus
gggcgaactgtccaatgagatatga

SEQ ID NO: 636005 - DNA, 25 bp, Mus musculus
gggcgaactgtcgaatgagatatga

SEQ ID NO: 636006 - DNA, 25 bp, Mus musculus
gggcgaagcgatcgccttgcttcta

SEQ ID NO: 636007 - DNA, 25 bp, Mus musculus
gggcgaagcgatggccttgcttcta

SEQ ID NO: 636008 - DNA, 25 bp, Mus musculus
gggcgaataaaaacagatcggccgg

SEQ ID NO: 636009 - DNA, 25 bp, Mus musculus
gggcgaataaaatcagatcggccgg

SEQ ID NO: 636010 - DNA, 25 bp, Mus musculus
gggcgaatatacacacatcaggaat

SEQ ID NO: 636011 - DNA, 25 bp, Mus musculus
gggcgaatatactcacatcaggaat

SEQ ID NO: 636012 - DNA, 25 bp, Mus musculus
gggcgaatcaccatccggattacag

SEQ ID NO: 636013 - DNA, 25 bp, Mus musculus
gggcgaatcaccttccggattacag

SEQ ID NO: 636014 - DNA, 25 bp, Mus musculus
gggcgaatctctcaacatgttcata

SEQ ID NO: 636015 - DNA, 25 bp, Mus musculus
gggcgaatctctgaacatgttcata

SEQ ID NO: 636016 - DNA, 25 bp, Mus musculus
gggcgaattcgcaacgcgcgtctgc

SEQ ID NO: 636017 - DNA, 25 bp, Mus musculus
gggcgaattcgctacgcgcgtctgc

SEQ ID NO: 636018 - DNA, 25 bp, Mus musculus
gggcgacaaaacatctgagcttctg

SEQ ID NO: 636019 - DNA, 25 bp, Mus musculus
gggcgacaaaacttctgagcttctg

SEQ ID NO: 636020 - DNA, 25 bp, Mus musculus
gggcgacaactgactcacgagatgg

SEQ ID NO: 636021 - DNA, 25 bp, Mus musculus
gggcgacaactgtctcacgagatgg

SEQ ID NO: 636022 - DNA, 25 bp, Mus musculus
gggcgacaagctcacatatcctgag

SEQ ID NO: 636023 - DNA, 25 bp, Mus musculus
gggcgacaagctgacatatcctgag

SEQ ID NO: 636024 - DNA, 25 bp, Mus musculus
gggcgacacaaaagacaagaaagac

SEQ ID NO: 636025 - DNA, 25 bp, Mus musculus
gggcgacacaaatgacaagaaagac

SEQ ID NO: 636026 - DNA, 25 bp, Mus musculus
gggcgacacagacaatctcagtaac

SEQ ID NO: 636027 - DNA, 25 bp, Mus musculus
gggcgacacagagaatctcagtaac

SEQ ID NO: 636028 - DNA, 25 bp, Mus musculus
gggcgacagcatctactccatcggg

SEQ ID NO: 636029 - DNA, 25 bp, Mus musculus
gggcgacagcatgtactccatcggg

SEQ ID NO: 636030 - DNA, 25 bp, Mus musculus
gggcgacatcaaagcagcaatcgaa

SEQ ID NO: 636031 - DNA, 25 bp, Mus musculus
gggcgacatcaaagcggccattgaa

SEQ ID NO: 636032 - DNA, 25 bp, Mus musculus
gggcgacatcaatgcagcaatcgaa

SEQ ID NO: 636033 - DNA, 25 bp, Mus musculus
gggcgacatcaatgcggccattgaa

SEQ ID NO: 636034 - DNA, 25 bp, Mus musculus
gggcgacattataaacgcttattgt

SEQ ID NO: 636035 - DNA, 25 bp, Mus musculus
gggcgacattattaacgcttattgt

SEQ ID NO: 636036 - DNA, 25 bp, Mus musculus
gggcgaccacaacaaaccttccagg

SEQ ID NO: 636037 - DNA, 25 bp, Mus musculus
gggcgaccacaagaaaccttccagg

SEQ ID NO: 636038 - DNA, 25 bp, Mus musculus
gggcgaccagagcacagctccctga

SEQ ID NO: 636039 - DNA, 25 bp, Mus musculus
gggcgaccagaggacagctccctga

SEQ ID NO: 636040 - DNA, 25 bp, Mus musculus
gggcgaccagccaagacttgtacat

SEQ ID NO: 636041 - DNA, 25 bp, Mus musculus
gggcgaccagcctagacttgtacat

SEQ ID NO: 636042 - DNA, 25 bp, Mus musculus
gggcgaccctcgaggctcgctcgct

SEQ ID NO: 636043 - DNA, 25 bp, Mus musculus
gggcgaccctcgtggctcgctcgct

SEQ ID NO: 636044 - DNA, 25 bp, Mus musculus
gggcgacccttcacacgagtatgaa

SEQ ID NO: 636045 - DNA, 25 bp, Mus musculus
gggcgacccttctcacgagtatgaa

SEQ ID NO: 636046 - DNA, 25 bp, Mus musculus
gggcgacgctttatacttgagcttc

SEQ ID NO: 636047 - DNA, 25 bp, Mus musculus
gggcgacgctttttacttgagcttc

SEQ ID NO: 636048 - DNA, 25 bp, Mus musculus
gggcgactcctcactaggaacacgt

SEQ ID NO: 636049 - DNA, 25 bp, Mus musculus
gggcgactcctctctaggaacacgt

SEQ ID NO: 636050 - DNA, 25 bp, Mus musculus
gggcgactgagaaccataatcttca

SEQ ID NO: 636051 - DNA, 25 bp, Mus musculus
gggcgactgagatccataatcttca

SEQ ID NO: 636052 - DNA, 25 bp, Mus musculus
gggcgacttccaaatgcaactagta

SEQ ID NO: 636053 - DNA, 25 bp, Mus musculus
gggcgacttccatatgcaactagta

SEQ ID NO: 636054 - DNA, 25 bp, Mus musculus
gggcgagacagcctcaaaagcatct

SEQ ID NO: 636055 - DNA, 25 bp, Mus musculus
gggcgagacagcgtcaaaagcatct

SEQ ID NO: 636056 - DNA, 25 bp, Mus musculus
gggcgagacgatactgcacaagcat

SEQ ID NO: 636057 - DNA, 25 bp, Mus musculus
gggcgagacgattctgcacaagcat

SEQ ID NO: 636058 - DNA, 25 bp, Mus musculus
gggcgagatcatccagccatctgag

SEQ ID NO: 636059 - DNA, 25 bp, Mus musculus
gggcgagatcatgcagccatctgag

SEQ ID NO: 636060 - DNA, 25 bp, Mus musculus
gggcgagcagagagtatccagattc

SEQ ID NO: 636061 - DNA, 25 bp, Mus musculus
gggcgagcagagtgtatccagattc

SEQ ID NO: 636062 - DNA, 25 bp, Mus musculus
gggcgagccctacatgtacctgagt

SEQ ID NO: 636063 - DNA, 25 bp, Mus musculus
gggcgagccctagatgtacctgagt

SEQ ID NO: 636064 - DNA, 25 bp, Mus musculus
gggcgagcctctcagtggattataa

SEQ ID NO: 636065 - DNA, 25 bp, Mus musculus
gggcgagcctctgagtggattataa

SEQ ID NO: 636066 - DNA, 25 bp, Mus musculus
gggcgagcgtctcccgggccgaagg

SEQ ID NO: 636067 - DNA, 25 bp, Mus musculus
gggcgagcgtctgccgggccgaagg

SEQ ID NO: 636068 - DNA, 25 bp, Mus musculus
gggcgagctctacgaagtatccaga

SEQ ID NO: 636069 - DNA, 25 bp, Mus musculus
gggcgagctctaggaagtatccaga

SEQ ID NO: 636070 - DNA, 25 bp, Mus musculus
gggcgagctgtcctgttcgcaacta

SEQ ID NO: 636071 - DNA, 25 bp, Mus musculus
gggcgagctgtcgtgttcgcaacta

SEQ ID NO: 636072 - DNA, 25 bp, Mus musculus
gggcgagcttcacccagaagccagt

SEQ ID NO: 636073 - DNA, 25 bp, Mus musculus
gggcgagcttcagccagaagccagt

SEQ ID NO: 636074 - DNA, 25 bp, Mus musculus
gggcgaggccggaaccttcgacata

SEQ ID NO: 636075 - DNA, 25 bp, Mus musculus
gggcgaggccggtaccttcgacata

SEQ ID NO: 636076 - DNA, 25 bp, Mus musculus
gggcgagggtccagtcaatcagaaa

SEQ ID NO: 636077 - DNA, 25 bp, Mus musculus
gggcgagggtcctgtcaatcagaaa

SEQ ID NO: 636078 - DNA, 25 bp, Mus musculus
gggcgaggtggtcattcacctccaa

SEQ ID NO: 636079 - DNA, 25 bp, Mus musculus
gggcgaggtggtgattcacctccaa

SEQ ID NO: 636080 - DNA, 25 bp, Mus musculus
gggcgagtaccaatcgtctgcttac

SEQ ID NO: 636081 - DNA, 25 bp, Mus musculus
gggcgagtaccattcgtctgcttac

SEQ ID NO: 636082 - DNA, 25 bp, Mus musculus
gggcgagtacccagaataccagcgt

SEQ ID NO: 636083 - DNA, 25 bp, Mus musculus
gggcgagtaccctgaataccagcgt

SEQ ID NO: 636084 - DNA, 25 bp, Mus musculus
gggcgagtctaaatgttagacattt

SEQ ID NO: 636085 - DNA, 25 bp, Mus musculus
gggcgagtctaattgttagacattt

SEQ ID NO: 636086 - DNA, 25 bp, Mus musculus
gggcgagtgaggaccgggcctccca

SEQ ID NO: 636087 - DNA, 25 bp, Mus musculus
gggcgagtgaggtccgggcctccca

SEQ ID NO: 636088 - DNA, 25 bp, Mus musculus
gggcgagttcaacctgagctccaca

SEQ ID NO: 636089 - DNA, 25 bp, Mus musculus
gggcgagttcaagctgagctccaca

SEQ ID NO: 636090 - DNA, 25 bp, Mus musculus
gggcgataagtactctagttccaaa

SEQ ID NO: 636091 - DNA, 25 bp, Mus musculus
gggcgataagtagtctagttccaaa

SEQ ID NO: 636092 - DNA, 25 bp, Mus musculus
gggcgatcagcaattcttgttctcc

SEQ ID NO: 636093 - DNA, 25 bp, Mus musculus
gggcgatcagcatttcttgttctcc

SEQ ID NO: 636094 - DNA, 25 bp, Mus musculus
gggcgatgactcagcagagcataag

SEQ ID NO: 636095 - DNA, 25 bp, Mus musculus
gggcgatgactctgcagagcataag

SEQ ID NO: 636096 - DNA, 25 bp, Mus musculus
gggcgatgataaatttctctgggca

SEQ ID NO: 636097 - DNA, 25 bp, Mus musculus
gggcgatgataattttctctgggca

SEQ ID NO: 636098 - DNA, 25 bp, Mus musculus
gggcgatgccctatgctgccgctgt

SEQ ID NO: 636099 - DNA, 25 bp, Mus musculus
gggcgatgccctttgctgccgctgt

SEQ ID NO: 636100 - DNA, 25 bp, Mus musculus
gggcgatgctagcagtcacaacttt

SEQ ID NO: 636101 - DNA, 25 bp, Mus musculus
gggcgatgctaggagtcacaacttt

SEQ ID NO: 636102 - DNA, 25 bp, Mus musculus
gggcgatggtggacccccacactca

SEQ ID NO: 636103 - DNA, 25 bp, Mus musculus
gggcgatggtggtcccccacactca

SEQ ID NO: 636104 - DNA, 25 bp, Mus musculus
gggcgatgtccacaaagaagtcatt

SEQ ID NO: 636105 - DNA, 25 bp, Mus musculus
gggcgatgtccagaaagaagtcatt

SEQ ID NO: 636106 - DNA, 25 bp, Mus musculus
gggcgattgtttatcatttccacta

SEQ ID NO: 636107 - DNA, 25 bp, Mus musculus
gggcgattgtttttcatttccacta

SEQ ID NO: 636108 - DNA, 25 bp, Mus musculus
gggcgatttcacataaatttactga

SEQ ID NO: 636109 - DNA, 25 bp, Mus musculus
gggcgatttcacttaaatttactga

SEQ ID NO: 636110 - DNA, 25 bp, Mus musculus
gggcgatttcttaggcatgtccaac

SEQ ID NO: 636111 - DNA, 25 bp, Mus musculus
gggcgatttctttggcatgtccaac

SEQ ID NO: 636112 - DNA, 25 bp, Mus musculus
gggcgatttgtaatgtgtactgtac

SEQ ID NO: 636113 - DNA, 25 bp, Mus musculus
gggcgatttgtattgtgtactgtac

SEQ ID NO: 636114 - DNA, 25 bp, Mus musculus
gggcgcaaaaatccctaccctgcac

SEQ ID NO: 636115 - DNA, 25 bp, Mus musculus
gggcgcaaaaatgcctaccctgcac

SEQ ID NO: 636116 - DNA, 25 bp, Mus musculus
gggcgcaacccaagatgagaacctc

SEQ ID NO: 636117 - DNA, 25 bp, Mus musculus
gggcgcaacccatgatgagaacctc

SEQ ID NO: 636118 - DNA, 25 bp, Mus musculus
gggcgcaagaagatcaccccagatc

SEQ ID NO: 636119 - DNA, 25 bp, Mus musculus
gggcgcaagaagttcaccccagatc

SEQ ID NO: 636120 - DNA, 25 bp, Mus musculus
gggcgcacataaacacctgacagac

SEQ ID NO: 636121 - DNA, 25 bp, Mus musculus
gggcgcacataatcacctgacagac

SEQ ID NO: 636122 - DNA, 25 bp, Mus musculus
gggcgcacatatatagacagactga

SEQ ID NO: 636123 - DNA, 25 bp, Mus musculus
gggcgcacatatttagacagactga

SEQ ID NO: 636124 - DNA, 25 bp, Mus musculus
gggcgcacctagagctctgttctgc

SEQ ID NO: 636125 - DNA, 25 bp, Mus musculus
gggcgcacctagtgctctgttctgc

SEQ ID NO: 636126 - DNA, 25 bp, Mus musculus
gggcgcacctcactagtcatgttta

SEQ ID NO: 636127 - DNA, 25 bp, Mus musculus
gggcgcacctcagtagtcatgttta

SEQ ID NO: 636128 - DNA, 25 bp, Mus musculus
gggcgcacgagcatatgctgaaacc

SEQ ID NO: 636129 - DNA, 25 bp, Mus musculus
gggcgcacgagcttatgctgaaacc

SEQ ID NO: 636130 - DNA, 25 bp, Mus musculus
gggcgcactgcaaatgataaacaat

SEQ ID NO: 636131 - DNA, 25 bp, Mus musculus
gggcgcactgcatatgataaacaat

SEQ ID NO: 636132 - DNA, 25 bp, Mus musculus
gggcgcactggaactcacagctgga

SEQ ID NO: 636133 - DNA, 25 bp, Mus musculus
gggcgcactggatctcacagctgga

SEQ ID NO: 636134 - DNA, 25 bp, Mus musculus
gggcgcagacccagaagctgtttta

SEQ ID NO: 636135 - DNA, 25 bp, Mus musculus
gggcgcagaccctgaagctgtttta

SEQ ID NO: 636136 - DNA, 25 bp, Mus musculus
gggcgcagagccagatttgtcttat

SEQ ID NO: 636137 - DNA, 25 bp, Mus musculus
gggcgcagagcctgatttgtcttat

SEQ ID NO: 636138 - DNA, 25 bp, Mus musculus
gggcgcagccaacatcactgtgcaa

SEQ ID NO: 636139 - DNA, 25 bp, Mus musculus
gggcgcagccaagatcactgtgcaa

SEQ ID NO: 636140 - DNA, 25 bp, Mus musculus
gggcgcagcgtacaacttaacgata

SEQ ID NO: 636141 - DNA, 25 bp, Mus musculus
gggcgcagcgtagaacttaacgata

SEQ ID NO: 636142 - DNA, 25 bp, Mus musculus
gggcgcatccacagggtagctaaga

SEQ ID NO: 636143 - DNA, 25 bp, Mus musculus
gggcgcatccactgggtagctaaga

SEQ ID NO: 636144 - DNA, 25 bp, Mus musculus
gggcgcatccggcagcaacaactat

SEQ ID NO: 636145 - DNA, 25 bp, Mus musculus
gggcgcatccgggagcaacaactat

SEQ ID NO: 636146 - DNA, 25 bp, Mus musculus
gggcgcatgggtcgcggcagttacc

SEQ ID NO: 636147 - DNA, 25 bp, Mus musculus
gggcgcatgggtggcggcagttacc

SEQ ID NO: 636148 - DNA, 25 bp, Mus musculus
gggcgccaagcacgcgcagccataa

SEQ ID NO: 636149 - DNA, 25 bp, Mus musculus
gggcgccaagcaggcgcagccataa

SEQ ID NO: 636150 - DNA, 25 bp, Mus musculus
gggcgccaaggtcgctgactgcatc

SEQ ID NO: 636151 - DNA, 25 bp, Mus musculus
gggcgccaaggtggctgactgcatc

SEQ ID NO: 636152 - DNA, 25 bp, Mus musculus
gggcgccaagtcagtgcgtgaattt

SEQ ID NO: 636153 - DNA, 25 bp, Mus musculus
gggcgccaagtctgtgcgtgaattt

SEQ ID NO: 636154 - DNA, 25 bp, Mus musculus
gggcgccaagttcttcacggcaatg

SEQ ID NO: 636155 - DNA, 25 bp, Mus musculus
gggcgccaagttgttcacggcaatg

SEQ ID NO: 636156 - DNA, 25 bp, Mus musculus
gggcgccacttcagtttagtcaaca

SEQ ID NO: 636157 - DNA, 25 bp, Mus musculus
gggcgccacttctgtttagtcaaca

SEQ ID NO: 636158 - DNA, 25 bp, Mus musculus
gggcgccactttcctttgggaagct

SEQ ID NO: 636159 - DNA, 25 bp, Mus musculus
gggcgccactttgctttgggaagct

SEQ ID NO: 636160 - DNA, 25 bp, Mus musculus
gggcgccatgaaatcacttacgctt

SEQ ID NO: 636161 - DNA, 25 bp, Mus musculus
gggcgccatgaaccctgtatgcctc

SEQ ID NO: 636162 - DNA, 25 bp, Mus musculus
gggcgccatgaagcctgtatgcctc

SEQ ID NO: 636163 - DNA, 25 bp, Mus musculus
gggcgccatgaattcacttacgctt

SEQ ID NO: 636164 - DNA, 25 bp, Mus musculus
gggcgccatgtcagagaacatctgg

SEQ ID NO: 636165 - DNA, 25 bp, Mus musculus
gggcgccatgtctgagaacatctgg

SEQ ID NO: 636166 - DNA, 25 bp, Mus musculus
gggcgccatttaaaccatctcagtg

SEQ ID NO: 636167 - DNA, 25 bp, Mus musculus
gggcgccatttataccatctcagtg

SEQ ID NO: 636168 - DNA, 25 bp, Mus musculus
gggcgcccaatgagtgtgacctcaa

SEQ ID NO: 636169 - DNA, 25 bp, Mus musculus
gggcgcccaatgtgtgtgacctcaa

SEQ ID NO: 636170 - DNA, 25 bp, Mus musculus
gggcgcccatggagaactttctaga

SEQ ID NO: 636171 - DNA, 25 bp, Mus musculus
gggcgcccatggtgaactttctaga

SEQ ID NO: 636172 - DNA, 25 bp, Mus musculus
gggcgcccggtaattccatagagaa

SEQ ID NO: 636173 - DNA, 25 bp, Mus musculus
gggcgcccggtatttccatagagaa

SEQ ID NO: 636174 - DNA, 25 bp, Mus musculus
gggcgccggaatcttatttctttag

SEQ ID NO: 636175 - DNA, 25 bp, Mus musculus
gggcgccggaatgttatttctttag

SEQ ID NO: 636176 - DNA, 25 bp, Mus musculus
gggcgccttcagcctgatacatttt

SEQ ID NO: 636177 - DNA, 25 bp, Mus musculus
gggcgccttcaggctgatacatttt

SEQ ID NO: 636178 - DNA, 25 bp, Mus musculus
gggcgccttgagctaagaaacattt

SEQ ID NO: 636179 - DNA, 25 bp, Mus musculus
gggcgccttgaggtaagaaacattt

SEQ ID NO: 636180 - DNA, 25 bp, Mus musculus
gggcgccttgctctgttgctcctgc

SEQ ID NO: 636181 - DNA, 25 bp, Mus musculus
gggcgccttgctgtgttgctcctgc

SEQ ID NO: 636182 - DNA, 25 bp, Mus musculus
gggcgccttgtaaatgctagacagt

SEQ ID NO: 636183 - DNA, 25 bp, Mus musculus
gggcgccttgtatatgctagacagt

SEQ ID NO: 636184 - DNA, 25 bp, Mus musculus
gggcgcgaagagacgctacattcct

SEQ ID NO: 636185 - DNA, 25 bp, Mus musculus
gggcgcgaagagtcgctacattcct

SEQ ID NO: 636186 - DNA, 25 bp, Mus musculus
gggcgcggagacagtcacacctgtt

SEQ ID NO: 636187 - DNA, 25 bp, Mus musculus
gggcgcggagactgtcacacctgtt

SEQ ID NO: 636188 - DNA, 25 bp, Mus musculus
gggcgcgggcggatacacctacttc

SEQ ID NO: 636189 - DNA, 25 bp, Mus musculus
gggcgcgggcggttacacctacttc

SEQ ID NO: 636190 - DNA, 25 bp, Mus musculus
gggcgcgttatacttttattggaca

SEQ ID NO: 636191 - DNA, 25 bp, Mus musculus
gggcgcgttatagttttattggaca

SEQ ID NO: 636192 - DNA, 25 bp, Mus musculus
gggcgctcattgacctaagacctgg

SEQ ID NO: 636193 - DNA, 25 bp, Mus musculus
gggcgctcattgtcctaagacctgg

SEQ ID NO: 636194 - DNA, 25 bp, Mus musculus
gggcgctccaagacttgtattttct

SEQ ID NO: 636195 - DNA, 25 bp, Mus musculus
gggcgctccaagtcttgtattttct

SEQ ID NO: 636196 - DNA, 25 bp, Mus musculus
gggcgctccatactgcttgacaaga

SEQ ID NO: 636197 - DNA, 25 bp, Mus musculus
gggcgctccatagtgcttgacaaga

SEQ ID NO: 636198 - DNA, 25 bp, Mus musculus
gggcgctctattactggaacaacga

SEQ ID NO: 636199 - DNA, 25 bp, Mus musculus
gggcgctctatttctggaacaacga

SEQ ID NO: 636200 - DNA, 25 bp, Mus musculus
gggcgctctcagattgctttagcca

SEQ ID NO: 636201 - DNA, 25 bp, Mus musculus
gggcgctctcagtttgctttagcca

SEQ ID NO: 636202 - DNA, 25 bp, Mus musculus
gggcgctgagcgcagccaaacaaaa

SEQ ID NO: 636203 - DNA, 25 bp, Mus musculus
gggcgctgagcggagccaaacaaaa

SEQ ID NO: 636204 - DNA, 25 bp, Mus musculus
gggcgctgaggaacaacagcagtat

SEQ ID NO: 636205 - DNA, 25 bp, Mus musculus
gggcgctgaggatcaacagcagtat

SEQ ID NO: 636206 - DNA, 25 bp, Mus musculus
gggcgctgccaaatatagcaccgac

SEQ ID NO: 636207 - DNA, 25 bp, Mus musculus
gggcgctgccaattatagcaccgac

SEQ ID NO: 636208 - DNA, 25 bp, Mus musculus
gggcgctgccgcaaagatcctctaa

SEQ ID NO: 636209 - DNA, 25 bp, Mus musculus
gggcgctgccgctaagatcctctaa

SEQ ID NO: 636210 - DNA, 25 bp, Mus musculus
gggcgcttaacaaaacctagttgca

SEQ ID NO: 636211 - DNA, 25 bp, Mus musculus
gggcgcttaacataacctagttgca

SEQ ID NO: 636212 - DNA, 25 bp, Mus musculus
gggcgcttatctcactttctgctgc

SEQ ID NO: 636213 - DNA, 25 bp, Mus musculus
gggcgcttatctgactttctgctgc

SEQ ID NO: 636214 - DNA, 25 bp, Mus musculus
gggcgcttcgaacataatccctacc

SEQ ID NO: 636215 - DNA, 25 bp, Mus musculus
gggcgcttcgaagataatccctacc

SEQ ID NO: 636216 - DNA, 25 bp, Mus musculus
gggcgcttgcctcacgcaaggactt

SEQ ID NO: 636217 - DNA, 25 bp, Mus musculus
gggcgcttgcctgacgcaaggactt

SEQ ID NO: 636218 - DNA, 25 bp, Mus musculus
gggcgcttggcaattttctcaagag

SEQ ID NO: 636219 - DNA, 25 bp, Mus musculus
gggcgcttggcatttttctcaagag

SEQ ID NO: 636220 - DNA, 25 bp, Mus musculus
gggcgctttttccttcaaggtacag

SEQ ID NO: 636221 - DNA, 25 bp, Mus musculus
gggcgctttttcgttcaaggtacag

SEQ ID NO: 636222 - DNA, 25 bp, Mus musculus
gggcggaaactgaatcctgatacct

SEQ ID NO: 636223 - DNA, 25 bp, Mus musculus
gggcggaaactgtatcctgatacct

SEQ ID NO: 636224 - DNA, 25 bp, Mus musculus
gggcggaagcttcatcttttactaa

SEQ ID NO: 636225 - DNA, 25 bp, Mus musculus
gggcggaagcttgatcttttactaa

SEQ ID NO: 636226 - DNA, 25 bp, Mus musculus
gggcggaccaccaagaggaactgct

SEQ ID NO: 636227 - DNA, 25 bp, Mus musculus
gggcggaccacctagaggaactgct

SEQ ID NO: 636228 - DNA, 25 bp, Mus musculus
gggcggacccatatcaagtatttat

SEQ ID NO: 636229 - DNA, 25 bp, Mus musculus
gggcggacccatttcaagtatttat

SEQ ID NO: 636230 - DNA, 25 bp, Mus musculus
gggcggactgaaagcatgctgttct

SEQ ID NO: 636231 - DNA, 25 bp, Mus musculus
gggcggactgaatgcatgctgttct

SEQ ID NO: 636232 - DNA, 25 bp, Mus musculus
gggcggactgagacaatcctgcaga

SEQ ID NO: 636233 - DNA, 25 bp, Mus musculus
gggcggactgagtcaatcctgcaga

SEQ ID NO: 636234 - DNA, 25 bp, Mus musculus
gggcggagacaaatgtcagccatcc

SEQ ID NO: 636235 - DNA, 25 bp, Mus musculus
gggcggagacaattgtcagccatcc

SEQ ID NO: 636236 - DNA, 25 bp, Mus musculus
gggcggagcggtattattgacttat

SEQ ID NO: 636237 - DNA, 25 bp, Mus musculus
gggcggagcggttttattgacttat

SEQ ID NO: 636238 - DNA, 25 bp, Mus musculus
gggcggagtcttaagacacagtttc

SEQ ID NO: 636239 - DNA, 25 bp, Mus musculus
gggcggagtctttagacacagtttc

SEQ ID NO: 636240 - DNA, 25 bp, Mus musculus
gggcggatccacagaagaatatacc

SEQ ID NO: 636241 - DNA, 25 bp, Mus musculus
gggcggatccactgaagaatatacc

SEQ ID NO: 636242 - DNA, 25 bp, Mus musculus
gggcggatgactcggtcttttattt

SEQ ID NO: 636243 - DNA, 25 bp, Mus musculus
gggcggatgactgggtcttttattt

SEQ ID NO: 636244 - DNA, 25 bp, Mus musculus
gggcggcaatcaccagaacaattac

SEQ ID NO: 636245 - DNA, 25 bp, Mus musculus
gggcggcaatcagcagaacaattac

SEQ ID NO: 636246 - DNA, 25 bp, Mus musculus
gggcggccactgacctacaagacgt

SEQ ID NO: 636247 - DNA, 25 bp, Mus musculus
gggcggccactgtcctacaagacgt

SEQ ID NO: 636248 - DNA, 25 bp, Mus musculus
gggcggccagatatccttgtcatgt

SEQ ID NO: 636249 - DNA, 25 bp, Mus musculus
gggcggccagatttccttgtcatgt

SEQ ID NO: 636250 - DNA, 25 bp, Mus musculus
gggcggccagttctacaactccaag

SEQ ID NO: 636251 - DNA, 25 bp, Mus musculus
gggcggccagttgtacaactccaag

SEQ ID NO: 636252 - DNA, 25 bp, Mus musculus
gggcggcctccaatataggacacct

SEQ ID NO: 636253 - DNA, 25 bp, Mus musculus
gggcggcctccattataggacacct

SEQ ID NO: 636254 - DNA, 25 bp, Mus musculus
gggcggcctcgcagaactacttaaa

SEQ ID NO: 636255 - DNA, 25 bp, Mus musculus
gggcggcctcgctgaactacttaaa

SEQ ID NO: 636256 - DNA, 25 bp, Mus musculus
gggcggctcctcacaactaaccatg

SEQ ID NO: 636257 - DNA, 25 bp, Mus musculus
gggcggctcctctcaactaaccatg

SEQ ID NO: 636258 - DNA, 25 bp, Mus musculus
gggcggctctttctggtgcacacat

SEQ ID NO: 636259 - DNA, 25 bp, Mus musculus
gggcggctctttgtggtgcacacat

SEQ ID NO: 636260 - DNA, 25 bp, Mus musculus
gggcggctgccaatataaatgtaaa

SEQ ID NO: 636261 - DNA, 25 bp, Mus musculus
gggcggctgccattataaatgtaaa

SEQ ID NO: 636262 - DNA, 25 bp, Mus musculus
gggcggcttagcaccagtcgtcctc

SEQ ID NO: 636263 - DNA, 25 bp, Mus musculus
gggcggcttagctccagtcgtcctc

SEQ ID NO: 636264 - DNA, 25 bp, Mus musculus
gggcgggaccccaggatgcggagaa

SEQ ID NO: 636265 - DNA, 25 bp, Mus musculus
gggcgggacccctggatgcggagaa

SEQ ID NO: 636266 - DNA, 25 bp, Mus musculus
gggcgggactgaagcccttcagctt

SEQ ID NO: 636267 - DNA, 25 bp, Mus musculus
gggcgggactgatgcccttcagctt

SEQ ID NO: 636268 - DNA, 25 bp, Mus musculus
gggcgggagtaaactagacattcat

SEQ ID NO: 636269 - DNA, 25 bp, Mus musculus
gggcgggagtaatctagacattcat

SEQ ID NO: 636270 - DNA, 25 bp, Mus musculus
gggcgggcacttattcagcttgcta

SEQ ID NO: 636271 - DNA, 25 bp, Mus musculus
gggcgggcactttttcagcttgcta

SEQ ID NO: 636272 - DNA, 25 bp, Mus musculus
gggcgggcttctataagtagattat

SEQ ID NO: 636273 - DNA, 25 bp, Mus musculus
gggcgggcttctttaagtagattat

SEQ ID NO: 636274 - DNA, 25 bp, Mus musculus
gggcgggtccacaggtctctgaatc

SEQ ID NO: 636275 - DNA, 25 bp, Mus musculus
gggcgggtccactggtctctgaatc

SEQ ID NO: 636276 - DNA, 25 bp, Mus musculus
gggcgggtctcgctgaaggaaccag

SEQ ID NO: 636277 - DNA, 25 bp, Mus musculus
gggcgggtctcggtgaaggaaccag

SEQ ID NO: 636278 - DNA, 25 bp, Mus musculus
gggcgggtgcctaagaatccccatg

SEQ ID NO: 636279 - DNA, 25 bp, Mus musculus
gggcgggtgccttagaatccccatg

SEQ ID NO: 636280 - DNA, 25 bp, Mus musculus
gggcggtaacacagaggaccttgca

SEQ ID NO: 636281 - DNA, 25 bp, Mus musculus
gggcggtaacactgaggaccttgca

SEQ ID NO: 636282 - DNA, 25 bp, Mus musculus
gggcggtacccgattcggcctatat

SEQ ID NO: 636283 - DNA, 25 bp, Mus musculus
gggcggtacccgtttcggcctatat

SEQ ID NO: 636284 - DNA, 25 bp, Mus musculus
gggcggtacctaaagctatcaagtc

SEQ ID NO: 636285 - DNA, 25 bp, Mus musculus
gggcggtacctatagctatcaagtc

SEQ ID NO: 636286 - DNA, 25 bp, Mus musculus
gggcggtacctgatcacagcacaag

SEQ ID NO: 636287 - DNA, 25 bp, Mus musculus
gggcggtacctgttcacagcacaag

SEQ ID NO: 636288 - DNA, 25 bp, Mus musculus
gggcggtcaccaatgtcaaggtcat

SEQ ID NO: 636289 - DNA, 25 bp, Mus musculus
gggcggtcaccattgtcaaggtcat

SEQ ID NO: 636290 - DNA, 25 bp, Mus musculus
gggcggtctaacctgcagctctctc

SEQ ID NO: 636291 - DNA, 25 bp, Mus musculus
gggcggtctaacgtgcagctctctc

SEQ ID NO: 636292 - DNA, 25 bp, Mus musculus
gggcggtctgaccactaagaatttg

SEQ ID NO: 636293 - DNA, 25 bp, Mus musculus
gggcggtctgacgactaagaatttg

SEQ ID NO: 636294 - DNA, 25 bp, Mus musculus
gggcggtgtccaaatattcatgaat

SEQ ID NO: 636295 - DNA, 25 bp, Mus musculus
gggcggtgtccatatattcatgaat

SEQ ID NO: 636296 - DNA, 25 bp, Mus musculus
gggcggttgtcgatctcatctagaa

SEQ ID NO: 636297 - DNA, 25 bp, Mus musculus
gggcggttgtcgttctcatctagaa

SEQ ID NO: 636298 - DNA, 25 bp, Mus musculus
gggcggttttcaaactcagaatatc

SEQ ID NO: 636299 - DNA, 25 bp, Mus musculus
gggcggttttcatactcagaatatc

SEQ ID NO: 636300 - DNA, 25 bp, Mus musculus
gggcgtaaccaactcaactgacaag

SEQ ID NO: 636301 - DNA, 25 bp, Mus musculus
gggcgtaaccaagtcaactgacaag

SEQ ID NO: 636302 - DNA, 25 bp, Mus musculus
gggcgtaatcacattgagagcacat

SEQ ID NO: 636303 - DNA, 25 bp, Mus musculus
gggcgtaatcactttgagagcacat

SEQ ID NO: 636304 - DNA, 25 bp, Mus musculus
gggcgtacatgcaaagtacccacac

SEQ ID NO: 636305 - DNA, 25 bp, Mus musculus
gggcgtacatgctaagtacccacac

SEQ ID NO: 636306 - DNA, 25 bp, Mus musculus
gggcgtacgcacagaatccgggtca

SEQ ID NO: 636307 - DNA, 25 bp, Mus musculus
gggcgtacgcactgaatccgggtca

SEQ ID NO: 636308 - DNA, 25 bp, Mus musculus
gggcgtactattatcaactataagg

SEQ ID NO: 636309 - DNA, 25 bp, Mus musculus
gggcgtactattttcaactataagg

SEQ ID NO: 636310 - DNA, 25 bp, Mus musculus
gggcgtacttgtctgcaacaatcaa

SEQ ID NO: 636311 - DNA, 25 bp, Mus musculus
gggcgtacttgtgtgcaacaatcaa

SEQ ID NO: 636312 - DNA, 25 bp, Mus musculus
gggcgtatctcaaggcagacatggc

SEQ ID NO: 636313 - DNA, 25 bp, Mus musculus
gggcgtatctcatggcagacatggc

SEQ ID NO: 636314 - DNA, 25 bp, Mus musculus
gggcgtatgatcattgcaggaccaa

SEQ ID NO: 636315 - DNA, 25 bp, Mus musculus
gggcgtatgatctttgcaggaccaa

SEQ ID NO: 636316 - DNA, 25 bp, Mus musculus
gggcgtcaaataaagcttcatgttc

SEQ ID NO: 636317 - DNA, 25 bp, Mus musculus
gggcgtcaaatatagcttcatgttc

SEQ ID NO: 636318 - DNA, 25 bp, Mus musculus
gggcgtcataaccagttcagcagtc

SEQ ID NO: 636319 - DNA, 25 bp, Mus musculus
gggcgtcataacgagttcagcagtc

SEQ ID NO: 636320 - DNA, 25 bp, Mus musculus
gggcgtcatataatagatattctgc

SEQ ID NO: 636321 - DNA, 25 bp, Mus musculus
gggcgtcatatattagatattctgc

SEQ ID NO: 636322 - DNA, 25 bp, Mus musculus
gggcgtcatggtctcccaccgatct

SEQ ID NO: 636323 - DNA, 25 bp, Mus musculus
gggcgtcatggtgtcccaccgatct

SEQ ID NO: 636324 - DNA, 25 bp, Mus musculus
gggcgtccagtcctgatctgtgata

SEQ ID NO: 636325 - DNA, 25 bp, Mus musculus
gggcgtccagtcgtgatctgtgata

SEQ ID NO: 636326 - DNA, 25 bp, Mus musculus
gggcgtccatggattcaaagaaagg

SEQ ID NO: 636327 - DNA, 25 bp, Mus musculus
gggcgtccatggtttcaaagaaagg

SEQ ID NO: 636328 - DNA, 25 bp, Mus musculus
gggcgtccattcatatcaactaaat

SEQ ID NO: 636329 - DNA, 25 bp, Mus musculus
gggcgtccattcttatcaactaaat

SEQ ID NO: 636330 - DNA, 25 bp, Mus musculus
gggcgtccggatctcattaggagtg

SEQ ID NO: 636331 - DNA, 25 bp, Mus musculus
gggcgtccggatgtcattaggagtg

SEQ ID NO: 636332 - DNA, 25 bp, Mus musculus
gggcgtcctcacaatgggcgtttta

SEQ ID NO: 636333 - DNA, 25 bp, Mus musculus
gggcgtcctcactatgggcgtttta

SEQ ID NO: 636334 - DNA, 25 bp, Mus musculus
gggcgtcctggtcaatgaaatcctc

SEQ ID NO: 636335 - DNA, 25 bp, Mus musculus
gggcgtcctggtgaatgaaatcctc

SEQ ID NO: 636336 - DNA, 25 bp, Mus musculus
gggcgtcgccgtcagatctccgatc

SEQ ID NO: 636337 - DNA, 25 bp, Mus musculus
gggcgtcgccgtgagatctccgatc

SEQ ID NO: 636338 - DNA, 25 bp, Mus musculus
gggcgtctacagagaccagccatat

SEQ ID NO: 636339 - DNA, 25 bp, Mus musculus
gggcgtctacagtgaccagccatat

SEQ ID NO: 636340 - DNA, 25 bp, Mus musculus
gggcgtctccaaccagagtaccaag

SEQ ID NO: 636341 - DNA, 25 bp, Mus musculus
gggcgtctccaagcagagtaccaag

SEQ ID NO: 636342 - DNA, 25 bp, Mus musculus
gggcgtctcggcctattctgcttct

SEQ ID NO: 636343 - DNA, 25 bp, Mus musculus
gggcgtctcggcgtattctgcttct

SEQ ID NO: 636344 - DNA, 25 bp, Mus musculus
gggcgtctcgttcttgttctcttct

SEQ ID NO: 636345 - DNA, 25 bp, Mus musculus
gggcgtctcgttgttgttctcttct

SEQ ID NO: 636346 - DNA, 25 bp, Mus musculus
gggcgtctggataccccttcacaga

SEQ ID NO: 636347 - DNA, 25 bp, Mus musculus
gggcgtctggattccccttcacaga

SEQ ID NO: 636348 - DNA, 25 bp, Mus musculus
gggcgtctgggcaatgcaactcaac

SEQ ID NO: 636349 - DNA, 25 bp, Mus musculus
gggcgtctgggctatgcaactcaac

SEQ ID NO: 636350 - DNA, 25 bp, Mus musculus
gggcgtctgtaacgctccctaggct

SEQ ID NO: 636351 - DNA, 25 bp, Mus musculus
gggcgtctgtaaggctccctaggct

SEQ ID NO: 636352 - DNA, 25 bp, Mus musculus
gggcgtctgtatagtcctgtggaat

SEQ ID NO: 636353 - DNA, 25 bp, Mus musculus
gggcgtctgtattgtcctgtggaat

SEQ ID NO: 636354 - DNA, 25 bp, Mus musculus
gggcgtctgtcaatgatccaggacc

SEQ ID NO: 636355 - DNA, 25 bp, Mus musculus
gggcgtctgtcattgatccaggacc

SEQ ID NO: 636356 - DNA, 25 bp, Mus musculus
gggcgtcttcaacaacaagcacagt

SEQ ID NO: 636357 - DNA, 25 bp, Mus musculus
gggcgtcttcaagaacaagcacagt

SEQ ID NO: 636358 - DNA, 25 bp, Mus musculus
gggcgtcttccactattgacccttc

SEQ ID NO: 636359 - DNA, 25 bp, Mus musculus
gggcgtcttccagtattgacccttc

SEQ ID NO: 636360 - DNA, 25 bp, Mus musculus
gggcgtcttgctcgctgttatcttc

SEQ ID NO: 636361 - DNA, 25 bp, Mus musculus
gggcgtcttgctggctgttatcttc

SEQ ID NO: 636362 - DNA, 25 bp, Mus musculus
gggcgtcttgttatactgttgtaag

SEQ ID NO: 636363 - DNA, 25 bp, Mus musculus
gggcgtcttgttttactgttgtaag

SEQ ID NO: 636364 - DNA, 25 bp, Mus musculus
gggcgtgactacatggagtacgctc

SEQ ID NO: 636365 - DNA, 25 bp, Mus musculus
gggcgtgactacttggagtacgctc

SEQ ID NO: 636366 - DNA, 25 bp, Mus musculus
gggcgtgattccaccacaggattat

SEQ ID NO: 636367 - DNA, 25 bp, Mus musculus
gggcgtgattcctccacaggattat

SEQ ID NO: 636368 - DNA, 25 bp, Mus musculus
gggcgtgatttaactccagattagc

SEQ ID NO: 636369 - DNA, 25 bp, Mus musculus
gggcgtgatttatctccagattagc

SEQ ID NO: 636370 - DNA, 25 bp, Mus musculus
gggcgtgcacaaagcttgactactg

SEQ ID NO: 636371 - DNA, 25 bp, Mus musculus
gggcgtgcacaatgcttgactactg

SEQ ID NO: 636372 - DNA, 25 bp, Mus musculus
gggcgtgcactcacagcttttctgc

SEQ ID NO: 636373 - DNA, 25 bp, Mus musculus
gggcgtgcactctcagcttttctgc

SEQ ID NO: 636374 - DNA, 25 bp, Mus musculus
gggcgtgcatttcagcagttctaca

SEQ ID NO: 636375 - DNA, 25 bp, Mus musculus
gggcgtgcatttgagcagttctaca

SEQ ID NO: 636376 - DNA, 25 bp, Mus musculus
gggcgtgccgctctaactcagaaaa

SEQ ID NO: 636377 - DNA, 25 bp, Mus musculus
gggcgtgccgctgtaactcagaaaa

SEQ ID NO: 636378 - DNA, 25 bp, Mus musculus
gggcgtgcctcactttgatcatcag

SEQ ID NO: 636379 - DNA, 25 bp, Mus musculus
gggcgtgcctcagtttgatcatcag

SEQ ID NO: 636380 - DNA, 25 bp, Mus musculus
gggcgtgccttgatgcaattggatt

SEQ ID NO: 636381 - DNA, 25 bp, Mus musculus
gggcgtgccttgttgcaattggatt

SEQ ID NO: 636382 - DNA, 25 bp, Mus musculus
gggcgtgcgcatcttagagactttc

SEQ ID NO: 636383 - DNA, 25 bp, Mus musculus
gggcgtgcgcatgttagagactttc

SEQ ID NO: 636384 - DNA, 25 bp, Mus musculus
gggcgtgctccgagggcggccggtg

SEQ ID NO: 636385 - DNA, 25 bp, Mus musculus
gggcgtgctccgtgggcggccggtg

SEQ ID NO: 636386 - DNA, 25 bp, Mus musculus
gggcgtggaacccttttggaatcat

SEQ ID NO: 636387 - DNA, 25 bp, Mus musculus
gggcgtggaaccgttttggaatcat

SEQ ID NO: 636388 - DNA, 25 bp, Mus musculus
gggcgtggacagatcggaggcaggg

SEQ ID NO: 636389 - DNA, 25 bp, Mus musculus
gggcgtggacagttcggaggcaggg

SEQ ID NO: 636390 - DNA, 25 bp, Mus musculus
gggcgtggagttcacattactacag

SEQ ID NO: 636391 - DNA, 25 bp, Mus musculus
gggcgtggagttgacattactacag

SEQ ID NO: 636392 - DNA, 25 bp, Mus musculus
gggcgtggcccacaaaatatgctct

SEQ ID NO: 636393 - DNA, 25 bp, Mus musculus
gggcgtggcccagaaaatatgctct

SEQ ID NO: 636394 - DNA, 25 bp, Mus musculus
gggcgtggccttctgctgtccatac

SEQ ID NO: 636395 - DNA, 25 bp, Mus musculus
gggcgtggccttgtgctgtccatac

SEQ ID NO: 636396 - DNA, 25 bp, Mus musculus
gggcgtggcgaaattcacctgcagt

SEQ ID NO: 636397 - DNA, 25 bp, Mus musculus
gggcgtggcgaatttcacctgcagt

SEQ ID NO: 636398 - DNA, 25 bp, Mus musculus
gggcgtggtgatcacattgcccacc

SEQ ID NO: 636399 - DNA, 25 bp, Mus musculus
gggcgtggtgatgacattgcccacc

SEQ ID NO: 636400 - DNA, 25 bp, Mus musculus
gggcgtggtggtaaactgcactttt

SEQ ID NO: 636401 - DNA, 25 bp, Mus musculus
gggcgtggtggttaactgcactttt

SEQ ID NO: 636402 - DNA, 25 bp, Mus musculus
gggcgtggttgcatccgcaaacgct

SEQ ID NO: 636403 - DNA, 25 bp, Mus musculus
gggcgtggttgcttccgcaaacgct

SEQ ID NO: 636404 - DNA, 25 bp, Mus musculus
gggcgtgtctacacattagtttttg

SEQ ID NO: 636405 - DNA, 25 bp, Mus musculus
gggcgtgtctactcattagtttttg

SEQ ID NO: 636406 - DNA, 25 bp, Mus musculus
gggcgtgtcttcacatcctatcaga

SEQ ID NO: 636407 - DNA, 25 bp, Mus musculus
gggcgtgtcttctcatcctatcaga

SEQ ID NO: 636408 - DNA, 25 bp, Mus musculus
gggcgtgtgtcaatcttctttaaga

SEQ ID NO: 636409 - DNA, 25 bp, Mus musculus
gggcgtgtgtcattcttctttaaga

SEQ ID NO: 636410 - DNA, 25 bp, Mus musculus
gggcgtgttaaaatgtggctccgta

SEQ ID NO: 636411 - DNA, 25 bp, Mus musculus
gggcgtgttaaattgtggctccgta

SEQ ID NO: 636412 - DNA, 25 bp, Mus musculus
gggcgtgtttctatctctgtgtagc

SEQ ID NO: 636413 - DNA, 25 bp, Mus musculus
gggcgtgtttctttctctgtgtagc

SEQ ID NO: 636414 - DNA, 25 bp, Mus musculus
gggcgttaattcacccatgagtaga

SEQ ID NO: 636415 - DNA, 25 bp, Mus musculus
gggcgttaattctcccatgagtaga

SEQ ID NO: 636416 - DNA, 25 bp, Mus musculus
gggcgttactacattatattacatg

SEQ ID NO: 636417 - DNA, 25 bp, Mus musculus
gggcgttactactttatattacatg

SEQ ID NO: 636418 - DNA, 25 bp, Mus musculus
gggcgttcaccgaacactgacagca

SEQ ID NO: 636419 - DNA, 25 bp, Mus musculus
gggcgttcaccgtacactgacagca

SEQ ID NO: 636420 - DNA, 25 bp, Mus musculus
gggcgttcatctcactcctggaata

SEQ ID NO: 636421 - DNA, 25 bp, Mus musculus
gggcgttcatctgactcctggaata

SEQ ID NO: 636422 - DNA, 25 bp, Mus musculus
gggcgttcctctccctagggtctca

SEQ ID NO: 636423 - DNA, 25 bp, Mus musculus
gggcgttcctctgcctagggtctca

SEQ ID NO: 636424 - DNA, 25 bp, Mus musculus
gggcgttggatgatcccttagctaa

SEQ ID NO: 636425 - DNA, 25 bp, Mus musculus
gggcgttggatgttcccttagctaa

SEQ ID NO: 636426 - DNA, 25 bp, Mus musculus
gggcgttgtatacctcctgtgacca

SEQ ID NO: 636427 - DNA, 25 bp, Mus musculus
gggcgttgtatagctcctgtgacca

SEQ ID NO: 636428 - DNA, 25 bp, Mus musculus
gggcgtttcagacctctattctctg

SEQ ID NO: 636429 - DNA, 25 bp, Mus musculus
gggcgtttcagagctctattctctg

SEQ ID NO: 636430 - DNA, 25 bp, Mus musculus
gggcgtttccttcgagaccagtagt

SEQ ID NO: 636431 - DNA, 25 bp, Mus musculus
gggcgtttccttggagaccagtagt

SEQ ID NO: 636432 - DNA, 25 bp, Mus musculus
gggcgtttgaacactgtcaataaca

SEQ ID NO: 636433 - DNA, 25 bp, Mus musculus
gggcgtttgaactctgtcaataaca

SEQ ID NO: 636434 - DNA, 25 bp, Mus musculus
gggcgtttgaagagaagctgctcac

SEQ ID NO: 636435 - DNA, 25 bp, Mus musculus
gggcgtttgaagtgaagctgctcac

SEQ ID NO: 636436 - DNA, 25 bp, Mus musculus
gggcgtttgggcaagccccacttat

SEQ ID NO: 636437 - DNA, 25 bp, Mus musculus
gggcgtttgggctagccccacttat

SEQ ID NO: 636438 - DNA, 25 bp, Mus musculus
gggcgttttcgtacacacaaacttg

SEQ ID NO: 636439 - DNA, 25 bp, Mus musculus
gggcgttttcgttcacacaaacttg

SEQ ID NO: 636440 - DNA, 25 bp, Mus musculus
gggctaaaaggaataggcacacttt

SEQ ID NO: 636441 - DNA, 25 bp, Mus musculus
gggctaaaaggattaggcacacttt

SEQ ID NO: 636442 - DNA, 25 bp, Mus musculus
gggctaaaatacaatcccattataa

SEQ ID NO: 636443 - DNA, 25 bp, Mus musculus
gggctaaaatactatcccattataa

SEQ ID NO: 636444 - DNA, 25 bp, Mus musculus
gggctaaacttaactctaagctgaa

SEQ ID NO: 636445 - DNA, 25 bp, Mus musculus
gggctaaacttatctctaagctgaa

SEQ ID NO: 636446 - DNA, 25 bp, Mus musculus
gggctaaagatccttgtgtgccact

SEQ ID NO: 636447 - DNA, 25 bp, Mus musculus
gggctaaagatcgttgtgtgccact

SEQ ID NO: 636448 - DNA, 25 bp, Mus musculus
gggctaaagatgagcgccatcccac

SEQ ID NO: 636449 - DNA, 25 bp, Mus musculus
gggctaaagatgtgcgccatcccac

SEQ ID NO: 636450 - DNA, 25 bp, Mus musculus
gggctaaagcgcatccgtgtgaaat

SEQ ID NO: 636451 - DNA, 25 bp, Mus musculus
gggctaaagcgcttccgtgtgaaat

SEQ ID NO: 636452 - DNA, 25 bp, Mus musculus
gggctaaagtctctagtctttcatg

SEQ ID NO: 636453 - DNA, 25 bp, Mus musculus
gggctaaagtctgtagtctttcatg

SEQ ID NO: 636454 - DNA, 25 bp, Mus musculus
gggctaaagtgtagaattgcattct

SEQ ID NO: 636455 - DNA, 25 bp, Mus musculus
gggctaaagtgttgaattgcattct

SEQ ID NO: 636456 - DNA, 25 bp, Mus musculus
gggctaaatccgcagcaaactgccg

SEQ ID NO: 636457 - DNA, 25 bp, Mus musculus
gggctaaatccggagcaaactgccg

SEQ ID NO: 636458 - DNA, 25 bp, Mus musculus
gggctaacaacacttttctacctgt

SEQ ID NO: 636459 - DNA, 25 bp, Mus musculus
gggctaacaacagttttctacctgt

SEQ ID NO: 636460 - DNA, 25 bp, Mus musculus
gggctaacagccagcaccagattga

SEQ ID NO: 636461 - DNA, 25 bp, Mus musculus
gggctaacagcctgcaccagattga

SEQ ID NO: 636462 - DNA, 25 bp, Mus musculus
gggctaacatctcctcaagtatttt

SEQ ID NO: 636463 - DNA, 25 bp, Mus musculus
gggctaacatctgctcaagtatttt

SEQ ID NO: 636464 - DNA, 25 bp, Mus musculus
gggctaaccccaaactgattctatt

SEQ ID NO: 636465 - DNA, 25 bp, Mus musculus
gggctaaccccatactgattctatt

SEQ ID NO: 636466 - DNA, 25 bp, Mus musculus
gggctaaccctgctgctaggacatg

SEQ ID NO: 636467 - DNA, 25 bp, Mus musculus
gggctaaccctggtgctaggacatg

SEQ ID NO: 636468 - DNA, 25 bp, Mus musculus
gggctaacctgcattaagtcagata

SEQ ID NO: 636469 - DNA, 25 bp, Mus musculus
gggctaacctgctttaagtcagata

SEQ ID NO: 636470 - DNA, 25 bp, Mus musculus
gggctaactactctgcagacataca

SEQ ID NO: 636471 - DNA, 25 bp, Mus musculus
gggctaactactgtgcagacataca

SEQ ID NO: 636472 - DNA, 25 bp, Mus musculus
gggctaactatgcatactgtgctgt

SEQ ID NO: 636473 - DNA, 25 bp, Mus musculus
gggctaactatggatactgtgctgt

SEQ ID NO: 636474 - DNA, 25 bp, Mus musculus
gggctaactcaactctttcttccca

SEQ ID NO: 636475 - DNA, 25 bp, Mus musculus
gggctaactcaagtctttcttccca

SEQ ID NO: 636476 - DNA, 25 bp, Mus musculus
gggctaactcatacagtctttgcaa

SEQ ID NO: 636477 - DNA, 25 bp, Mus musculus
gggctaactcattcagtctttgcaa

SEQ ID NO: 636478 - DNA, 25 bp, Mus musculus
gggctaagaagaagcacattccaaa

SEQ ID NO: 636479 - DNA, 25 bp, Mus musculus
gggctaagaagatgcacattccaaa

SEQ ID NO: 636480 - DNA, 25 bp, Mus musculus
gggctaagaatccagggaaccctgt

SEQ ID NO: 636481 - DNA, 25 bp, Mus musculus
gggctaagaatcgagggaaccctgt

SEQ ID NO: 636482 - DNA, 25 bp, Mus musculus
gggctaagacacatgattaaacagt

SEQ ID NO: 636483 - DNA, 25 bp, Mus musculus
gggctaagacacttgattaaacagt

SEQ ID NO: 636484 - DNA, 25 bp, Mus musculus
gggctaagacccagtccaatctatg

SEQ ID NO: 636485 - DNA, 25 bp, Mus musculus
gggctaagaccctgtccaatctatg

SEQ ID NO: 636486 - DNA, 25 bp, Mus musculus
gggctaagcctgagtagtttcctat

SEQ ID NO: 636487 - DNA, 25 bp, Mus musculus
gggctaagcctgtgtagtttcctat

SEQ ID NO: 636488 - DNA, 25 bp, Mus musculus
gggctaaggccaaagctgggcttac

SEQ ID NO: 636489 - DNA, 25 bp, Mus musculus
gggctaaggccatagctgggcttac

SEQ ID NO: 636490 - DNA, 25 bp, Mus musculus
gggctaaggcttagacaaactcctg

SEQ ID NO: 636491 - DNA, 25 bp, Mus musculus
gggctaaggctttgacaaactcctg

SEQ ID NO: 636492 - DNA, 25 bp, Mus musculus
gggctaagggcactaaagcttttct

SEQ ID NO: 636493 - DNA, 25 bp, Mus musculus
gggctaagggcagtaaagcttttct

SEQ ID NO: 636494 - DNA, 25 bp, Mus musculus
gggctaagtccactgtctatattta

SEQ ID NO: 636495 - DNA, 25 bp, Mus musculus
gggctaagtccagtgtctatattta

SEQ ID NO: 636496 - DNA, 25 bp, Mus musculus
gggctaatataaacctcatcttttg

SEQ ID NO: 636497 - DNA, 25 bp, Mus musculus
gggctaatataatcctcatcttttg

SEQ ID NO: 636498 - DNA, 25 bp, Mus musculus
gggctaatcaaaacatgtgtttatt

SEQ ID NO: 636499 - DNA, 25 bp, Mus musculus
gggctaatcaaatcatgtgtttatt

SEQ ID NO: 636500 - DNA, 25 bp, Mus musculus
gggctaatgcacattctcgcctttc

SEQ ID NO: 636501 - DNA, 25 bp, Mus musculus
gggctaatgcactttctcgcctttc

SEQ ID NO: 636502 - DNA, 25 bp, Mus musculus
gggctaatgtcaccatctatagact

SEQ ID NO: 636503 - DNA, 25 bp, Mus musculus
gggctaatgtcagcatctatagact

SEQ ID NO: 636504 - DNA, 25 bp, Mus musculus
gggctaatgtggcatgtttcataca

SEQ ID NO: 636505 - DNA, 25 bp, Mus musculus
gggctaatgtgggatgtttcataca

SEQ ID NO: 636506 - DNA, 25 bp, Mus musculus
gggctaattataaactaccacaggg

SEQ ID NO: 636507 - DNA, 25 bp, Mus musculus
gggctaattatatactaccacaggg

SEQ ID NO: 636508 - DNA, 25 bp, Mus musculus
gggctaatttacaagatctatttct

SEQ ID NO: 636509 - DNA, 25 bp, Mus musculus
gggctaatttactagatctatttct

SEQ ID NO: 636510 - DNA, 25 bp, Mus musculus
gggctacaactacagttagatttaa

SEQ ID NO: 636511 - DNA, 25 bp, Mus musculus
gggctacaactagagttagatttaa

SEQ ID NO: 636512 - DNA, 25 bp, Mus musculus
gggctacaacttagaggacctgaca

SEQ ID NO: 636513 - DNA, 25 bp, Mus musculus
gggctacaactttgaggacctgaca

SEQ ID NO: 636514 - DNA, 25 bp, Mus musculus
gggctacaagagacagtccgactgt

SEQ ID NO: 636515 - DNA, 25 bp, Mus musculus
gggctacaagagtcagtccgactgt

SEQ ID NO: 636516 - DNA, 25 bp, Mus musculus
gggctacaatcaataccttcttagg

SEQ ID NO: 636517 - DNA, 25 bp, Mus musculus
gggctacaatcattaccttcttagg

SEQ ID NO: 636518 - DNA, 25 bp, Mus musculus
gggctacaatcccaacagggtcttc

SEQ ID NO: 636519 - DNA, 25 bp, Mus musculus
gggctacaatccgaacagggtcttc

SEQ ID NO: 636520 - DNA, 25 bp, Mus musculus
gggctacaatgcatttatcgttcca

SEQ ID NO: 636521 - DNA, 25 bp, Mus musculus
gggctacaatgcttttatcgttcca

SEQ ID NO: 636522 - DNA, 25 bp, Mus musculus
gggctacacaagaccacgtctaaaa

SEQ ID NO: 636523 - DNA, 25 bp, Mus musculus
gggctacacaagtccacgtctaaaa

SEQ ID NO: 636524 - DNA, 25 bp, Mus musculus
gggctacacacacaatgcacaccag

SEQ ID NO: 636525 - DNA, 25 bp, Mus musculus
gggctacacacagaatgcacaccag

SEQ ID NO: 636526 - DNA, 25 bp, Mus musculus
gggctacacagcaccctgactttaa

SEQ ID NO: 636527 - DNA, 25 bp, Mus musculus
gggctacacagctccctgactttaa

SEQ ID NO: 636528 - DNA, 25 bp, Mus musculus
gggctacacaggacaggtaaacagt

SEQ ID NO: 636529 - DNA, 25 bp, Mus musculus
gggctacacaggtcaggtaaacagt

SEQ ID NO: 636530 - DNA, 25 bp, Mus musculus
gggctacaccaacatacctgaccag

SEQ ID NO: 636531 - DNA, 25 bp, Mus musculus
gggctacaccaagatacctgaccag

SEQ ID NO: 636532 - DNA, 25 bp, Mus musculus
gggctacacccgctgtctcgatcgg

SEQ ID NO: 636533 - DNA, 25 bp, Mus musculus
gggctacacccggtgtctcgatcgg

SEQ ID NO: 636534 - DNA, 25 bp, Mus musculus
gggctacacgatccttgttcataga

SEQ ID NO: 636535 - DNA, 25 bp, Mus musculus
gggctacacgatgcttgttcataga

SEQ ID NO: 636536 - DNA, 25 bp, Mus musculus
gggctacactataggcttaagttta

SEQ ID NO: 636537 - DNA, 25 bp, Mus musculus
gggctacactattggcttaagttta

SEQ ID NO: 636538 - DNA, 25 bp, Mus musculus
gggctacactgtaagtcattacttt

SEQ ID NO: 636539 - DNA, 25 bp, Mus musculus
gggctacactgttagtcattacttt

SEQ ID NO: 636540 - DNA, 25 bp, Mus musculus
gggctacacttcattgttccttgtt

SEQ ID NO: 636541 - DNA, 25 bp, Mus musculus
gggctacacttctttgttccttgtt

SEQ ID NO: 636542 - DNA, 25 bp, Mus musculus
gggctacagagaattctttccagag

SEQ ID NO: 636543 - DNA, 25 bp, Mus musculus
gggctacagagatttctttccagag

SEQ ID NO: 636544 - DNA, 25 bp, Mus musculus
gggctacagagcagactgacgtcac

SEQ ID NO: 636545 - DNA, 25 bp, Mus musculus
gggctacagagcctatctctgcaag

SEQ ID NO: 636546 - DNA, 25 bp, Mus musculus
gggctacagagcgtatctctgcaag

SEQ ID NO: 636547 - DNA, 25 bp, Mus musculus
gggctacagagctgactgacgtcac

SEQ ID NO: 636548 - DNA, 25 bp, Mus musculus
gggctacagatgactgctgcactca

SEQ ID NO: 636549 - DNA, 25 bp, Mus musculus
gggctacagatgtctgctgcactca

SEQ ID NO: 636550 - DNA, 25 bp, Mus musculus
gggctacagccacaccagaagatac

SEQ ID NO: 636551 - DNA, 25 bp, Mus musculus
gggctacagccagaccagaagatac

SEQ ID NO: 636552 - DNA, 25 bp, Mus musculus
gggctacagctaagctgtccaacag

SEQ ID NO: 636553 - DNA, 25 bp, Mus musculus
gggctacagctatgctgtccaacag

SEQ ID NO: 636554 - DNA, 25 bp, Mus musculus
gggctacagctgatttatatctcat

SEQ ID NO: 636555 - DNA, 25 bp, Mus musculus
gggctacagctgttttatatctcat

SEQ ID NO: 636556 - DNA, 25 bp, Mus musculus
gggctacaggccaccatttagcaat

SEQ ID NO: 636557 - DNA, 25 bp, Mus musculus
gggctacaggcctccatttagcaat

SEQ ID NO: 636558 - DNA, 25 bp, Mus musculus
gggctacaggcgaccacagtaagag

SEQ ID NO: 636559 - DNA, 25 bp, Mus musculus
gggctacaggcgtccacagtaagag

SEQ ID NO: 636560 - DNA, 25 bp, Mus musculus
gggctacaggctccaaggagtcttc

SEQ ID NO: 636561 - DNA, 25 bp, Mus musculus
gggctacaggctgcaaggagtcttc

SEQ ID NO: 636562 - DNA, 25 bp, Mus musculus
gggctacagggtaggataacgcact

SEQ ID NO: 636563 - DNA, 25 bp, Mus musculus
gggctacagggtcagctcttatctc

SEQ ID NO: 636564 - DNA, 25 bp, Mus musculus
gggctacagggtgagctcttatctc

SEQ ID NO: 636565 - DNA, 25 bp, Mus musculus
gggctacagggttggataacgcact

SEQ ID NO: 636566 - DNA, 25 bp, Mus musculus
gggctacagtgcagattggcaattt

SEQ ID NO: 636567 - DNA, 25 bp, Mus musculus
gggctacagtgctgattggcaattt

SEQ ID NO: 636568 - DNA, 25 bp, Mus musculus
gggctacatacaagctagtaattaa

SEQ ID NO: 636569 - DNA, 25 bp, Mus musculus
gggctacatacatgctagtaattaa

SEQ ID NO: 636570 - DNA, 25 bp, Mus musculus
gggctacatataccctatcacaaaa

SEQ ID NO: 636571 - DNA, 25 bp, Mus musculus
gggctacatatagcctatcacaaaa

SEQ ID NO: 636572 - DNA, 25 bp, Mus musculus
gggctacatatcacaagttctctca

SEQ ID NO: 636573 - DNA, 25 bp, Mus musculus
gggctacatatctcaagttctctca

SEQ ID NO: 636574 - DNA, 25 bp, Mus musculus
gggctacatgacatttttacagact

SEQ ID NO: 636575 - DNA, 25 bp, Mus musculus
gggctacatgacttttttacagact

SEQ ID NO: 636576 - DNA, 25 bp, Mus musculus
gggctacatgagctgctgtctgaaa

SEQ ID NO: 636577 - DNA, 25 bp, Mus musculus
gggctacatgaggtgctgtctgaaa

SEQ ID NO: 636578 - DNA, 25 bp, Mus musculus
gggctacatggacagtcccagtatg

SEQ ID NO: 636579 - DNA, 25 bp, Mus musculus
gggctacatggacggaccctgactt

SEQ ID NO: 636580 - DNA, 25 bp, Mus musculus
gggctacatggagagtcccagtatg

SEQ ID NO: 636581 - DNA, 25 bp, Mus musculus
gggctacatggagggaccctgactt

SEQ ID NO: 636582 - DNA, 25 bp, Mus musculus
gggctacatgggagtaactctgcat

SEQ ID NO: 636583 - DNA, 25 bp, Mus musculus
gggctacatgggtgtaactctgcat

SEQ ID NO: 636584 - DNA, 25 bp, Mus musculus
gggctacatgtacatacctcaccaa

SEQ ID NO: 636585 - DNA, 25 bp, Mus musculus
gggctacatgtagatacctcaccaa

SEQ ID NO: 636586 - DNA, 25 bp, Mus musculus
gggctacattatctaagctaacacc

SEQ ID NO: 636587 - DNA, 25 bp, Mus musculus
gggctacattatgtaagctaacacc

SEQ ID NO: 636588 - DNA, 25 bp, Mus musculus
gggctacattcaagagaccagagga

SEQ ID NO: 636589 - DNA, 25 bp, Mus musculus
gggctacattcatgagaccagagga

SEQ ID NO: 636590 - DNA, 25 bp, Mus musculus
gggctaccaataaacttcttctgag

SEQ ID NO: 636591 - DNA, 25 bp, Mus musculus
gggctaccaataagactcaggtggt

SEQ ID NO: 636592 - DNA, 25 bp, Mus musculus
gggctaccaatatacttcttctgag

SEQ ID NO: 636593 - DNA, 25 bp, Mus musculus
gggctaccaatatgactcaggtggt

SEQ ID NO: 636594 - DNA, 25 bp, Mus musculus
gggctaccagtcagagctggtcttt

SEQ ID NO: 636595 - DNA, 25 bp, Mus musculus
gggctaccagtctgagctggtcttt

SEQ ID NO: 636596 - DNA, 25 bp, Mus musculus
gggctaccatgtcgtgcacttctga

SEQ ID NO: 636597 - DNA, 25 bp, Mus musculus
gggctaccatgtggtgcacttctga

SEQ ID NO: 636598 - DNA, 25 bp, Mus musculus
gggctaccattgatatccccgtgga

SEQ ID NO: 636599 - DNA, 25 bp, Mus musculus
gggctaccattgttatccccgtgga

SEQ ID NO: 636600 - DNA, 25 bp, Mus musculus
gggctacccctaaggtgagtggaac

SEQ ID NO: 636601 - DNA, 25 bp, Mus musculus
gggctacccctatggtgagtggaac

SEQ ID NO: 636602 - DNA, 25 bp, Mus musculus
gggctaccctctatgactgaagggt

SEQ ID NO: 636603 - DNA, 25 bp, Mus musculus
gggctaccctctttgactgaagggt

SEQ ID NO: 636604 - DNA, 25 bp, Mus musculus
gggctacctccgatgacagaaacgt

SEQ ID NO: 636605 - DNA, 25 bp, Mus musculus
gggctacctccgttgacagaaacgt

SEQ ID NO: 636606 - DNA, 25 bp, Mus musculus
gggctacctgagagcttacctcaaa

SEQ ID NO: 636607 - DNA, 25 bp, Mus musculus
gggctacctgagtgcttacctcaaa

SEQ ID NO: 636608 - DNA, 25 bp, Mus musculus
gggctacctgccacgtggttagcga

SEQ ID NO: 636609 - DNA, 25 bp, Mus musculus
gggctacctgcctcgtggttagcga

SEQ ID NO: 636610 - DNA, 25 bp, Mus musculus
gggctacctttgagattgtcctgca

SEQ ID NO: 636611 - DNA, 25 bp, Mus musculus
gggctacctttgtgattgtcctgca

SEQ ID NO: 636612 - DNA, 25 bp, Mus musculus
gggctacgacccaccaataaaagtg

SEQ ID NO: 636613 - DNA, 25 bp, Mus musculus
gggctacgaccctccaataaaagtg

SEQ ID NO: 636614 - DNA, 25 bp, Mus musculus
gggctacgagataaccaggacaaca

SEQ ID NO: 636615 - DNA, 25 bp, Mus musculus
gggctacgagattaccaggacaaca

SEQ ID NO: 636616 - DNA, 25 bp, Mus musculus
gggctacgagttacctgaacacgtt

SEQ ID NO: 636617 - DNA, 25 bp, Mus musculus
gggctacgagtttcctgaacacgtt

SEQ ID NO: 636618 - DNA, 25 bp, Mus musculus
gggctacgcagtccatcgttgccta

SEQ ID NO: 636619 - DNA, 25 bp, Mus musculus
gggctacgcagtgcatcgttgccta

SEQ ID NO: 636620 - DNA, 25 bp, Mus musculus
gggctacgggcaacatcaataaaac

SEQ ID NO: 636621 - DNA, 25 bp, Mus musculus
gggctacgggcatcatcaataaaac

SEQ ID NO: 636622 - DNA, 25 bp, Mus musculus
gggctacgtagacacctgtgtaaga

SEQ ID NO: 636623 - DNA, 25 bp, Mus musculus
gggctacgtagagacctgtgtaaga

SEQ ID NO: 636624 - DNA, 25 bp, Mus musculus
gggctacgtgatcctaccaaatgac

SEQ ID NO: 636625 - DNA, 25 bp, Mus musculus
gggctacgtgatgctaccaaatgac

SEQ ID NO: 636626 - DNA, 25 bp, Mus musculus
gggctactcaccagaagatgtcatc

SEQ ID NO: 636627 - DNA, 25 bp, Mus musculus
gggctactcaccctttatattcttg

SEQ ID NO: 636628 - DNA, 25 bp, Mus musculus
gggctactcaccgtttatattcttg

SEQ ID NO: 636629 - DNA, 25 bp, Mus musculus
gggctactcacctgaagatgtcatc

SEQ ID NO: 636630 - DNA, 25 bp, Mus musculus
gggctactcccaagctgaggcacag

SEQ ID NO: 636631 - DNA, 25 bp, Mus musculus
gggctactcccatgctgaggcacag

SEQ ID NO: 636632 - DNA, 25 bp, Mus musculus
gggctactctgacaatacttacagt

SEQ ID NO: 636633 - DNA, 25 bp, Mus musculus
gggctactctgagaatacttacagt

SEQ ID NO: 636634 - DNA, 25 bp, Mus musculus
gggctactctgtcatcataagtaat

SEQ ID NO: 636635 - DNA, 25 bp, Mus musculus
gggctactctgtgatcataagtaat

SEQ ID NO: 636636 - DNA, 25 bp, Mus musculus
gggctactgggacaattcttctccc

SEQ ID NO: 636637 - DNA, 25 bp, Mus musculus
gggctactgggagaattcttctccc

SEQ ID NO: 636638 - DNA, 25 bp, Mus musculus
gggctactgtcaaaacgttattaat

SEQ ID NO: 636639 - DNA, 25 bp, Mus musculus
gggctactgtcataacgttattaat

SEQ ID NO: 636640 - DNA, 25 bp, Mus musculus
gggctactgtcgagtttccacaggt

SEQ ID NO: 636641 - DNA, 25 bp, Mus musculus
gggctactgtcgtgtttccacaggt

SEQ ID NO: 636642 - DNA, 25 bp, Mus musculus
gggctactgttccaacacagtggtt

SEQ ID NO: 636643 - DNA, 25 bp, Mus musculus
gggctactgttcgaacacagtggtt

SEQ ID NO: 636644 - DNA, 25 bp, Mus musculus
gggctacttaataagaccctgctaa

SEQ ID NO: 636645 - DNA, 25 bp, Mus musculus
gggctacttaattagaccctgctaa

SEQ ID NO: 636646 - DNA, 25 bp, Mus musculus
gggctacttagcagaggggatcaca

SEQ ID NO: 636647 - DNA, 25 bp, Mus musculus
gggctacttagctgaggggatcaca

SEQ ID NO: 636648 - DNA, 25 bp, Mus musculus
gggctacttattacttgcaaagcag

SEQ ID NO: 636649 - DNA, 25 bp, Mus musculus
gggctacttatttcttgcaaagcag

SEQ ID NO: 636650 - DNA, 25 bp, Mus musculus
gggctacttcccagagtcagtgact

SEQ ID NO: 636651 - DNA, 25 bp, Mus musculus
gggctacttccctgagtcagtgact

SEQ ID NO: 636652 - DNA, 25 bp, Mus musculus
gggctacttcctcctggttaaaaca

SEQ ID NO: 636653 - DNA, 25 bp, Mus musculus
gggctacttcctgctggttaaaaca

SEQ ID NO: 636654 - DNA, 25 bp, Mus musculus
gggctacttctgatcccatttgcac

SEQ ID NO: 636655 - DNA, 25 bp, Mus musculus
gggctacttctgttcccatttgcac

SEQ ID NO: 636656 - DNA, 25 bp, Mus musculus
gggctacttcttaatgtttccatat

SEQ ID NO: 636657 - DNA, 25 bp, Mus musculus
gggctacttctttatgtttccatat

SEQ ID NO: 636658 - DNA, 25 bp, Mus musculus
gggctacttgccctagatgctaggt

SEQ ID NO: 636659 - DNA, 25 bp, Mus musculus
gggctacttgccgtagatgctaggt

SEQ ID NO: 636660 - DNA, 25 bp, Mus musculus
gggctacttggccaacatggctgat

SEQ ID NO: 636661 - DNA, 25 bp, Mus musculus
gggctacttggcctgaccgactgcc

SEQ ID NO: 636662 - DNA, 25 bp, Mus musculus
gggctacttggcgaacatggctgat

SEQ ID NO: 636663 - DNA, 25 bp, Mus musculus
gggctacttggcgtgaccgactgcc

SEQ ID NO: 636664 - DNA, 25 bp, Mus musculus
gggctacttttgattcccaactgtt

SEQ ID NO: 636665 - DNA, 25 bp, Mus musculus
gggctacttttgtttcccaactgtt

SEQ ID NO: 636666 - DNA, 25 bp, Mus musculus
gggctagaatctaggtttttgccaa

SEQ ID NO: 636667 - DNA, 25 bp, Mus musculus
gggctagaatcttggtttttgccaa

SEQ ID NO: 636668 - DNA, 25 bp, Mus musculus
gggctagaattaccagtgcacacca

SEQ ID NO: 636669 - DNA, 25 bp, Mus musculus
gggctagaattagcagtgcacacca

SEQ ID NO: 636670 - DNA, 25 bp, Mus musculus
gggctagaccccatgcagggaagca

SEQ ID NO: 636671 - DNA, 25 bp, Mus musculus
gggctagaccccttgcagggaagca

SEQ ID NO: 636672 - DNA, 25 bp, Mus musculus
gggctagacggacgccactacacag

SEQ ID NO: 636673 - DNA, 25 bp, Mus musculus
gggctagacggaggccactacacag

SEQ ID NO: 636674 - DNA, 25 bp, Mus musculus
gggctagagcgacatcatggtattc

SEQ ID NO: 636675 - DNA, 25 bp, Mus musculus
gggctagagcgagatcatggtattc

SEQ ID NO: 636676 - DNA, 25 bp, Mus musculus
gggctagatacaataacatgaggtt

SEQ ID NO: 636677 - DNA, 25 bp, Mus musculus
gggctagatacattaacatgaggtt

SEQ ID NO: 636678 - DNA, 25 bp, Mus musculus
gggctagcaaccactttgtgccttt

SEQ ID NO: 636679 - DNA, 25 bp, Mus musculus
gggctagcaacctctttgtgccttt

SEQ ID NO: 636680 - DNA, 25 bp, Mus musculus
gggctagcagcaactccggctatga

SEQ ID NO: 636681 - DNA, 25 bp, Mus musculus
gggctagcagcatctccggctatga

SEQ ID NO: 636682 - DNA, 25 bp, Mus musculus
gggctagcagcgcagctgtacatac

SEQ ID NO: 636683 - DNA, 25 bp, Mus musculus
gggctagcagcggagctgtacatac

SEQ ID NO: 636684 - DNA, 25 bp, Mus musculus
gggctagccaatacctgaagatcat

SEQ ID NO: 636685 - DNA, 25 bp, Mus musculus
gggctagccaattcctgaagatcat

SEQ ID NO: 636686 - DNA, 25 bp, Mus musculus
gggctagccacgaacgctacagcga

SEQ ID NO: 636687 - DNA, 25 bp, Mus musculus
gggctagccacgtacgctacagcga

SEQ ID NO: 636688 - DNA, 25 bp, Mus musculus
gggctagccagacaccataggtaca

SEQ ID NO: 636689 - DNA, 25 bp, Mus musculus
gggctagccagagaccataggtaca

SEQ ID NO: 636690 - DNA, 25 bp, Mus musculus
gggctagcctggcttcataccagcc

SEQ ID NO: 636691 - DNA, 25 bp, Mus musculus
gggctagcctgggttcataccagcc

SEQ ID NO: 636692 - DNA, 25 bp, Mus musculus
gggctagccttacagtatagtccag

SEQ ID NO: 636693 - DNA, 25 bp, Mus musculus
gggctagccttagagtatagtccag

SEQ ID NO: 636694 - DNA, 25 bp, Mus musculus
gggctagctaacaattcttggtcat

SEQ ID NO: 636695 - DNA, 25 bp, Mus musculus
gggctagctaaccacaattgggtaa

SEQ ID NO: 636696 - DNA, 25 bp, Mus musculus
gggctagctaacgacaattgggtaa

SEQ ID NO: 636697 - DNA, 25 bp, Mus musculus
gggctagctaactattcttggtcat

SEQ ID NO: 636698 - DNA, 25 bp, Mus musculus
gggctagctctgagactactaaaat

SEQ ID NO: 636699 - DNA, 25 bp, Mus musculus
gggctagctctgtgactactaaaat

SEQ ID NO: 636700 - DNA, 25 bp, Mus musculus
gggctagcttggactatattaatgg

SEQ ID NO: 636701 - DNA, 25 bp, Mus musculus
gggctagcttggtctatattaatgg

SEQ ID NO: 636702 - DNA, 25 bp, Mus musculus
gggctaggactaaaacttgggcgct

SEQ ID NO: 636703 - DNA, 25 bp, Mus musculus
gggctaggactataacttgggcgct

SEQ ID NO: 636704 - DNA, 25 bp, Mus musculus
gggctaggatacaaacttcccgatt

SEQ ID NO: 636705 - DNA, 25 bp, Mus musculus
gggctaggatactaacttcccgatt

SEQ ID NO: 636706 - DNA, 25 bp, Mus musculus
gggctaggattcagacactttagtt

SEQ ID NO: 636707 - DNA, 25 bp, Mus musculus
gggctaggattctgacactttagtt

SEQ ID NO: 636708 - DNA, 25 bp, Mus musculus
gggctaggccccagccgggtgaatg

SEQ ID NO: 636709 - DNA, 25 bp, Mus musculus
gggctaggcccctgccgggtgaatg

SEQ ID NO: 636710 - DNA, 25 bp, Mus musculus
gggctaggcggtcagagaaagaaat

SEQ ID NO: 636711 - DNA, 25 bp, Mus musculus
gggctaggcggtgagagaaagaaat

SEQ ID NO: 636712 - DNA, 25 bp, Mus musculus
gggctagggacgaatcttcaaactc

SEQ ID NO: 636713 - DNA, 25 bp, Mus musculus
gggctagggacgtatcttcaaactc

SEQ ID NO: 636714 - DNA, 25 bp, Mus musculus
gggctagggcttctaccccataaca

SEQ ID NO: 636715 - DNA, 25 bp, Mus musculus
gggctagggcttgtaccccataaca

SEQ ID NO: 636716 - DNA, 25 bp, Mus musculus
gggctagggtatctgtttatctttc

SEQ ID NO: 636717 - DNA, 25 bp, Mus musculus
gggctagggtatgtgtttatctttc

SEQ ID NO: 636718 - DNA, 25 bp, Mus musculus
gggctaggtggcagcattctgttac

SEQ ID NO: 636719 - DNA, 25 bp, Mus musculus
gggctaggtggctgcattctgttac

SEQ ID NO: 636720 - DNA, 25 bp, Mus musculus
gggctagtccctattgatccttaat

SEQ ID NO: 636721 - DNA, 25 bp, Mus musculus
gggctagtcccttttgatccttaat

SEQ ID NO: 636722 - DNA, 25 bp, Mus musculus
gggctagtctaaatctcttatataa

SEQ ID NO: 636723 - DNA, 25 bp, Mus musculus
gggctagtctaattctcttatataa

SEQ ID NO: 636724 - DNA, 25 bp, Mus musculus
gggctagtctctcggacaccggcca

SEQ ID NO: 636725 - DNA, 25 bp, Mus musculus
gggctagtctctgggacaccggcca

SEQ ID NO: 636726 - DNA, 25 bp, Mus musculus
gggctagtctttcctgaattctaat

SEQ ID NO: 636727 - DNA, 25 bp, Mus musculus
gggctagtctttgctgaattctaat

SEQ ID NO: 636728 - DNA, 25 bp, Mus musculus
gggctagtgcagaactccctaggag

SEQ ID NO: 636729 - DNA, 25 bp, Mus musculus
gggctagtgcagtactccctaggag

SEQ ID NO: 636730 - DNA, 25 bp, Mus musculus
gggctagtgcatcaccaagtgtgct

SEQ ID NO: 636731 - DNA, 25 bp, Mus musculus
gggctagtgcatgaccaagtgtgct

SEQ ID NO: 636732 - DNA, 25 bp, Mus musculus
gggctagtggtcagcacacatgcca

SEQ ID NO: 636733 - DNA, 25 bp, Mus musculus
gggctagtggtctgcacacatgcca

SEQ ID NO: 636734 - DNA, 25 bp, Mus musculus
gggctagttcatactatctttccaa

SEQ ID NO: 636735 - DNA, 25 bp, Mus musculus
gggctagttcattctatctttccaa

SEQ ID NO: 636736 - DNA, 25 bp, Mus musculus
gggctagttgtgctaccatacaccg

SEQ ID NO: 636737 - DNA, 25 bp, Mus musculus
gggctagttgtggtaccatacaccg

SEQ ID NO: 636738 - DNA, 25 bp, Mus musculus
gggctataaacccaagctaggcaca

SEQ ID NO: 636739 - DNA, 25 bp, Mus musculus
gggctataaaccgaagctaggcaca

SEQ ID NO: 636740 - DNA, 25 bp, Mus musculus
gggctataacccaatttttcattga

SEQ ID NO: 636741 - DNA, 25 bp, Mus musculus
gggctataaccctatttttcattga

SEQ ID NO: 636742 - DNA, 25 bp, Mus musculus
gggctataaggtattgcctcaccca

SEQ ID NO: 636743 - DNA, 25 bp, Mus musculus
gggctataaggttttgcctcaccca

SEQ ID NO: 636744 - DNA, 25 bp, Mus musculus
gggctataatctattctatgtaatc

SEQ ID NO: 636745 - DNA, 25 bp, Mus musculus
gggctataatcttttctatgtaatc

SEQ ID NO: 636746 - DNA, 25 bp, Mus musculus
gggctataccaacataattggaccc

SEQ ID NO: 636747 - DNA, 25 bp, Mus musculus
gggctataccaagataattggaccc

SEQ ID NO: 636748 - DNA, 25 bp, Mus musculus
gggctatagactactgtgtccgtaa

SEQ ID NO: 636749 - DNA, 25 bp, Mus musculus
gggctatagacttctgtgtccgtaa

SEQ ID NO: 636750 - DNA, 25 bp, Mus musculus
gggctatagtcacagatcacatctt

SEQ ID NO: 636751 - DNA, 25 bp, Mus musculus
gggctatagtcagagatcacatctt

SEQ ID NO: 636752 - DNA, 25 bp, Mus musculus
gggctatagtgaatacagtacagga

SEQ ID NO: 636753 - DNA, 25 bp, Mus musculus
gggctatagtgattacagtacagga

SEQ ID NO: 636754 - DNA, 25 bp, Mus musculus
gggctatagttcacaattaaaatgc

SEQ ID NO: 636755 - DNA, 25 bp, Mus musculus
gggctatagttctcaattaaaatgc

SEQ ID NO: 636756 - DNA, 25 bp, Mus musculus
gggctatatagacacaccctatgta

SEQ ID NO: 636757 - DNA, 25 bp, Mus musculus
gggctatatagagacaccctatgta

SEQ ID NO: 636758 - DNA, 25 bp, Mus musculus
gggctatatatcagctgattgtcta

SEQ ID NO: 636759 - DNA, 25 bp, Mus musculus
gggctatatatctgctgattgtcta

SEQ ID NO: 636760 - DNA, 25 bp, Mus musculus
gggctatattgtccccagtggtaga

SEQ ID NO: 636761 - DNA, 25 bp, Mus musculus
gggctatattgtgcccagtggtaga

SEQ ID NO: 636762 - DNA, 25 bp, Mus musculus
gggctatcactgaagcattctgaat

SEQ ID NO: 636763 - DNA, 25 bp, Mus musculus
gggctatcactgtagcattctgaat

SEQ ID NO: 636764 - DNA, 25 bp, Mus musculus
gggctatcatcaagtacaacctcgt

SEQ ID NO: 636765 - DNA, 25 bp, Mus musculus
gggctatcatcatgtacaacctcgt

SEQ ID NO: 636766 - DNA, 25 bp, Mus musculus
gggctatcctgtcgcgaaaacgaca

SEQ ID NO: 636767 - DNA, 25 bp, Mus musculus
gggctatcctgtggcgaaaacgaca

SEQ ID NO: 636768 - DNA, 25 bp, Mus musculus
gggctatcgctaaatctgttgtctg

SEQ ID NO: 636769 - DNA, 25 bp, Mus musculus
gggctatcgctatatctgttgtctg

SEQ ID NO: 636770 - DNA, 25 bp, Mus musculus
gggctatctaataggcgaccttcag

SEQ ID NO: 636771 - DNA, 25 bp, Mus musculus
gggctatctaattggcgaccttcag

SEQ ID NO: 636772 - DNA, 25 bp, Mus musculus
gggctatctacacacattctctctg

SEQ ID NO: 636773 - DNA, 25 bp, Mus musculus
gggctatctacagacattctctctg

SEQ ID NO: 636774 - DNA, 25 bp, Mus musculus
gggctatctgcgacttgtggacaaa

SEQ ID NO: 636775 - DNA, 25 bp, Mus musculus
gggctatctgcgtcttgtggacaaa

SEQ ID NO: 636776 - DNA, 25 bp, Mus musculus
gggctatcttatctcatgttggcat

SEQ ID NO: 636777 - DNA, 25 bp, Mus musculus
gggctatcttatgtcatgttggcat

SEQ ID NO: 636778 - DNA, 25 bp, Mus musculus
gggctatcttggacctcaatgtgaa

SEQ ID NO: 636779 - DNA, 25 bp, Mus musculus
gggctatcttggcacccactactaa

SEQ ID NO: 636780 - DNA, 25 bp, Mus musculus
gggctatcttgggacccactactaa

SEQ ID NO: 636781 - DNA, 25 bp, Mus musculus
gggctatcttggtcctcaatgtgaa

SEQ ID NO: 636782 - DNA, 25 bp, Mus musculus
gggctatgacccagtccaaacagtg

SEQ ID NO: 636783 - DNA, 25 bp, Mus musculus
gggctatgaccctgtccaaacagtg

SEQ ID NO: 636784 - DNA, 25 bp, Mus musculus
gggctatgacctaccacttaaaaag

SEQ ID NO: 636785 - DNA, 25 bp, Mus musculus
gggctatgaccttccacttaaaaag

SEQ ID NO: 636786 - DNA, 25 bp, Mus musculus
gggctatgacgtcagacccatctca

SEQ ID NO: 636787 - DNA, 25 bp, Mus musculus
gggctatgacgtccctaatttgtat

SEQ ID NO: 636788 - DNA, 25 bp, Mus musculus
gggctatgacgtgagacccatctca

SEQ ID NO: 636789 - DNA, 25 bp, Mus musculus
gggctatgacgtgcctaatttgtat

SEQ ID NO: 636790 - DNA, 25 bp, Mus musculus
gggctatgaggcatgttacaggaat

SEQ ID NO: 636791 - DNA, 25 bp, Mus musculus
gggctatgaggcttgttacaggaat

SEQ ID NO: 636792 - DNA, 25 bp, Mus musculus
gggctatgatatcccaggaatactc

SEQ ID NO: 636793 - DNA, 25 bp, Mus musculus
gggctatgatatgccaggaatactc

SEQ ID NO: 636794 - DNA, 25 bp, Mus musculus
gggctatgcaaacctactaatacca

SEQ ID NO: 636795 - DNA, 25 bp, Mus musculus
gggctatgcaaagctactaatacca

SEQ ID NO: 636796 - DNA, 25 bp, Mus musculus
gggctatgcagactcccatggtctc

SEQ ID NO: 636797 - DNA, 25 bp, Mus musculus
gggctatgcagagtcccatggtctc

SEQ ID NO: 636798 - DNA, 25 bp, Mus musculus
gggctatgcagccacacagtctaca

SEQ ID NO: 636799 - DNA, 25 bp, Mus musculus
gggctatgcagcgacacagtctaca

SEQ ID NO: 636800 - DNA, 25 bp, Mus musculus
gggctatgcgctatctccagacaga

SEQ ID NO: 636801 - DNA, 25 bp, Mus musculus
gggctatgcgctttctccagacaga

SEQ ID NO: 636802 - DNA, 25 bp, Mus musculus
gggctatggcctatgtgcagatcat

SEQ ID NO: 636803 - DNA, 25 bp, Mus musculus
gggctatggcctttgtgcagatcat

SEQ ID NO: 636804 - DNA, 25 bp, Mus musculus
gggctatggtccaccacatggacac

SEQ ID NO: 636805 - DNA, 25 bp, Mus musculus
gggctatggtcctccacatggacac

SEQ ID NO: 636806 - DNA, 25 bp, Mus musculus
gggctatggtgcatacccctttaat

SEQ ID NO: 636807 - DNA, 25 bp, Mus musculus
gggctatggtgcttacccctttaat

SEQ ID NO: 636808 - DNA, 25 bp, Mus musculus
gggctatggttccaacaagagattg

SEQ ID NO: 636809 - DNA, 25 bp, Mus musculus
gggctatggttcgaacaagagattg

SEQ ID NO: 636810 - DNA, 25 bp, Mus musculus
gggctatgtacgacacacctggtgg

SEQ ID NO: 636811 - DNA, 25 bp, Mus musculus
gggctatgtacgtcacacctggtgg

SEQ ID NO: 636812 - DNA, 25 bp, Mus musculus
gggctatgtattatggtccatcagg

SEQ ID NO: 636813 - DNA, 25 bp, Mus musculus
gggctatgtattttggtccatcagg

SEQ ID NO: 636814 - DNA, 25 bp, Mus musculus
gggctatgtcagaaaacctatagtg

SEQ ID NO: 636815 - DNA, 25 bp, Mus musculus
gggctatgtcagtaaacctatagtg

SEQ ID NO: 636816 - DNA, 25 bp, Mus musculus
gggctatgtctgacaaatctgtcac

SEQ ID NO: 636817 - DNA, 25 bp, Mus musculus
gggctatgtctgtcaaatctgtcac

SEQ ID NO: 636818 - DNA, 25 bp, Mus musculus
gggctattactaatcaagcttggta

SEQ ID NO: 636819 - DNA, 25 bp, Mus musculus
gggctattactattcaagcttggta

SEQ ID NO: 636820 - DNA, 25 bp, Mus musculus
gggctattcagcaagggccacgtag

SEQ ID NO: 636821 - DNA, 25 bp, Mus musculus
gggctattcagctagggccacgtag

SEQ ID NO: 636822 - DNA, 25 bp, Mus musculus
gggctattcatactaagataccatg

SEQ ID NO: 636823 - DNA, 25 bp, Mus musculus
gggctattcatagtaagataccatg

SEQ ID NO: 636824 - DNA, 25 bp, Mus musculus
gggctattccctaacttgagtgatg

SEQ ID NO: 636825 - DNA, 25 bp, Mus musculus
gggctattcccttacttgagtgatg

SEQ ID NO: 636826 - DNA, 25 bp, Mus musculus
gggctattctttaagattctcagta

SEQ ID NO: 636827 - DNA, 25 bp, Mus musculus
gggctattcttttagattctcagta

SEQ ID NO: 636828 - DNA, 25 bp, Mus musculus
gggctattgatgcactgttattttt

SEQ ID NO: 636829 - DNA, 25 bp, Mus musculus
gggctattgatggactgttattttt

SEQ ID NO: 636830 - DNA, 25 bp, Mus musculus
gggctattgtacagctcgccacatt

SEQ ID NO: 636831 - DNA, 25 bp, Mus musculus
gggctattgtactgctcgccacatt

SEQ ID NO: 636832 - DNA, 25 bp, Mus musculus
gggctattgtcccttcagctgatag

SEQ ID NO: 636833 - DNA, 25 bp, Mus musculus
gggctattgtccgttcagctgatag

SEQ ID NO: 636834 - DNA, 25 bp, Mus musculus
gggctatttctaaattcaaattgtc

SEQ ID NO: 636835 - DNA, 25 bp, Mus musculus
gggctatttctaacacagacagagg

SEQ ID NO: 636836 - DNA, 25 bp, Mus musculus
gggctatttctatattcaaattgtc

SEQ ID NO: 636837 - DNA, 25 bp, Mus musculus
gggctatttctatcacagacagagg

SEQ ID NO: 636838 - DNA, 25 bp, Mus musculus
gggctatttgctcttaatctcactt

SEQ ID NO: 636839 - DNA, 25 bp, Mus musculus
gggctatttgctgttaatctcactt

SEQ ID NO: 636840 - DNA, 25 bp, Mus musculus
gggctatttgtaatcaaactgaagt

SEQ ID NO: 636841 - DNA, 25 bp, Mus musculus
gggctatttgtattcaaactgaagt

SEQ ID NO: 636842 - DNA, 25 bp, Mus musculus
gggctattttccattatgtctgaac

SEQ ID NO: 636843 - DNA, 25 bp, Mus musculus
gggctattttcctttatgtctgaac

SEQ ID NO: 636844 - DNA, 25 bp, Mus musculus
gggctattttctctttgctgaccaa

SEQ ID NO: 636845 - DNA, 25 bp, Mus musculus
gggctattttctgtttgctgaccaa

SEQ ID NO: 636846 - DNA, 25 bp, Mus musculus
gggctattttgcctgactccgcaga

SEQ ID NO: 636847 - DNA, 25 bp, Mus musculus
gggctattttgcgtgactccgcaga

SEQ ID NO: 636848 - DNA, 25 bp, Mus musculus
gggctattttgtctcagcttcgaag

SEQ ID NO: 636849 - DNA, 25 bp, Mus musculus
gggctattttgtgtcagcttcgaag

SEQ ID NO: 636850 - DNA, 25 bp, Mus musculus
gggctatttttcattcttcgatgcg

SEQ ID NO: 636851 - DNA, 25 bp, Mus musculus
gggctatttttctttcttcgatgcg

SEQ ID NO: 636852 - DNA, 25 bp, Mus musculus
gggctcaaaacaccagaacacattc

SEQ ID NO: 636853 - DNA, 25 bp, Mus musculus
gggctcaaaacagcagaacacattc

SEQ ID NO: 636854 - DNA, 25 bp, Mus musculus
gggctcaaacacatagggcaggtag

SEQ ID NO: 636855 - DNA, 25 bp, Mus musculus
gggctcaaacacttagggcaggtag

SEQ ID NO: 636856 - DNA, 25 bp, Mus musculus
gggctcaaacatcgtgtctgtctgc

SEQ ID NO: 636857 - DNA, 25 bp, Mus musculus
gggctcaaacatggtgtctgtctgc

SEQ ID NO: 636858 - DNA, 25 bp, Mus musculus
gggctcaaactcaagaactcatgct

SEQ ID NO: 636859 - DNA, 25 bp, Mus musculus
gggctcaaactctagaactcatgct

SEQ ID NO: 636860 - DNA, 25 bp, Mus musculus
gggctcaaagcaataatccagtaac

SEQ ID NO: 636861 - DNA, 25 bp, Mus musculus
gggctcaaagcattaatccagtaac

SEQ ID NO: 636862 - DNA, 25 bp, Mus musculus
gggctcaaaggtctatttccatagt

SEQ ID NO: 636863 - DNA, 25 bp, Mus musculus
gggctcaaaggtgtatttccatagt

SEQ ID NO: 636864 - DNA, 25 bp, Mus musculus
gggctcaaatatctccttgttcact

SEQ ID NO: 636865 - DNA, 25 bp, Mus musculus
gggctcaaatatgtccttgttcact

SEQ ID NO: 636866 - DNA, 25 bp, Mus musculus
gggctcaaatcacatggtcaggctt

SEQ ID NO: 636867 - DNA, 25 bp, Mus musculus
gggctcaaatcagatggtcaggctt

SEQ ID NO: 636868 - DNA, 25 bp, Mus musculus
gggctcaaatccacatcgtgcagag

SEQ ID NO: 636869 - DNA, 25 bp, Mus musculus
gggctcaaatcctcatcgtgcagag

SEQ ID NO: 636870 - DNA, 25 bp, Mus musculus
gggctcaaattgctgcactttattt

SEQ ID NO: 636871 - DNA, 25 bp, Mus musculus
gggctcaaattggtgcactttattt

SEQ ID NO: 636872 - DNA, 25 bp, Mus musculus
gggctcaacattcgctcaagaatgc

SEQ ID NO: 636873 - DNA, 25 bp, Mus musculus
gggctcaacattggctcaagaatgc

SEQ ID NO: 636874 - DNA, 25 bp, Mus musculus
gggctcaacgctagccagtacaaca

SEQ ID NO: 636875 - DNA, 25 bp, Mus musculus
gggctcaacgcttgccagtacaaca

SEQ ID NO: 636876 - DNA, 25 bp, Mus musculus
gggctcaacgtcactatgtagctaa

SEQ ID NO: 636877 - DNA, 25 bp, Mus musculus
gggctcaacgtctctatgtagctaa

SEQ ID NO: 636878 - DNA, 25 bp, Mus musculus
gggctcaagagcaaggatttctaag

SEQ ID NO: 636879 - DNA, 25 bp, Mus musculus
gggctcaagagctaggatttctaag

SEQ ID NO: 636880 - DNA, 25 bp, Mus musculus
gggctcaagcttcaaccatgcagag

SEQ ID NO: 636881 - DNA, 25 bp, Mus musculus
gggctcaagcttgaaccatgcagag

SEQ ID NO: 636882 - DNA, 25 bp, Mus musculus
gggctcaagggccacatccccagca

SEQ ID NO: 636883 - DNA, 25 bp, Mus musculus
gggctcaagggcgacatccccagca

SEQ ID NO: 636884 - DNA, 25 bp, Mus musculus
gggctcaagtgactcccattgtctt

SEQ ID NO: 636885 - DNA, 25 bp, Mus musculus
gggctcaagtgagtcccattgtctt

SEQ ID NO: 636886 - DNA, 25 bp, Mus musculus
gggctcaatcgccttggttactcaa

SEQ ID NO: 636887 - DNA, 25 bp, Mus musculus
gggctcaatcgcgttggttactcaa

SEQ ID NO: 636888 - DNA, 25 bp, Mus musculus
gggctcaatcggcacactgcaaagt

SEQ ID NO: 636889 - DNA, 25 bp, Mus musculus
gggctcaatcgggacactgcaaagt

SEQ ID NO: 636890 - DNA, 25 bp, Mus musculus
gggctcaatgcacagctgtctatgc

SEQ ID NO: 636891 - DNA, 25 bp, Mus musculus
gggctcaatgcagagctgtctatgc

SEQ ID NO: 636892 - DNA, 25 bp, Mus musculus
gggctcaatttcagtcaccaacaaa

SEQ ID NO: 636893 - DNA, 25 bp, Mus musculus
gggctcaatttctgtcaccaacaaa

SEQ ID NO: 636894 - DNA, 25 bp, Mus musculus
gggctcacaaaactcttcagctcgt

SEQ ID NO: 636895 - DNA, 25 bp, Mus musculus
gggctcacaaaagtcttcagctcgt

SEQ ID NO: 636896 - DNA, 25 bp, Mus musculus
gggctcacaaatacattgacttaat

SEQ ID NO: 636897 - DNA, 25 bp, Mus musculus
gggctcacaaattcattgacttaat

SEQ ID NO: 636898 - DNA, 25 bp, Mus musculus
gggctcacaagtccagtccttggac

SEQ ID NO: 636899 - DNA, 25 bp, Mus musculus
gggctcacaagtgcagtccttggac

SEQ ID NO: 636900 - DNA, 25 bp, Mus musculus
gggctcacaatacagcacaagctag

SEQ ID NO: 636901 - DNA, 25 bp, Mus musculus
gggctcacaatagagcacaagctag

SEQ ID NO: 636902 - DNA, 25 bp, Mus musculus
gggctcacagcacgattctgatgca

SEQ ID NO: 636903 - DNA, 25 bp, Mus musculus
gggctcacagcaggattctgatgca

SEQ ID NO: 636904 - DNA, 25 bp, Mus musculus
gggctcacagccatggagtgcaccc

SEQ ID NO: 636905 - DNA, 25 bp, Mus musculus
gggctcacagccttggagtgcaccc

SEQ ID NO: 636906 - DNA, 25 bp, Mus musculus
gggctcacagtgaatggcattatca

SEQ ID NO: 636907 - DNA, 25 bp, Mus musculus
gggctcacagtgtatggcattatca

SEQ ID NO: 636908 - DNA, 25 bp, Mus musculus
gggctcacattgatggctacttttc

SEQ ID NO: 636909 - DNA, 25 bp, Mus musculus
gggctcacattgttggctacttttc

SEQ ID NO: 636910 - DNA, 25 bp, Mus musculus
gggctcaccacaactttgacgagta

SEQ ID NO: 636911 - DNA, 25 bp, Mus musculus
gggctcaccacatctttgacgagta

SEQ ID NO: 636912 - DNA, 25 bp, Mus musculus
gggctcaccagaatctctagagtaa

SEQ ID NO: 636913 - DNA, 25 bp, Mus musculus
gggctcaccagattctctagagtaa

SEQ ID NO: 636914 - DNA, 25 bp, Mus musculus
gggctcaccatcagagatatatttt

SEQ ID NO: 636915 - DNA, 25 bp, Mus musculus
gggctcaccatcagcactatagctt

SEQ ID NO: 636916 - DNA, 25 bp, Mus musculus
gggctcaccatctgagatatatttt

SEQ ID NO: 636917 - DNA, 25 bp, Mus musculus
gggctcaccatctgcactatagctt

SEQ ID NO: 636918 - DNA, 25 bp, Mus musculus
gggctcaccattccatgcaatgact

SEQ ID NO: 636919 - DNA, 25 bp, Mus musculus
gggctcaccattgcatgcaatgact

SEQ ID NO: 636920 - DNA, 25 bp, Mus musculus
gggctcacctggcaacacagatgga

SEQ ID NO: 636921 - DNA, 25 bp, Mus musculus
gggctcacctgggaacacagatgga

SEQ ID NO: 636922 - DNA, 25 bp, Mus musculus
gggctcacctgtagattggtcctca

SEQ ID NO: 636923 - DNA, 25 bp, Mus musculus
gggctcacctgttgattggtcctca

SEQ ID NO: 636924 - DNA, 25 bp, Mus musculus
gggctcacgccaccaatgggatctg

SEQ ID NO: 636925 - DNA, 25 bp, Mus musculus
gggctcacgccagcaatgggatctg

SEQ ID NO: 636926 - DNA, 25 bp, Mus musculus
gggctcacgggtacctggcacgaat

SEQ ID NO: 636927 - DNA, 25 bp, Mus musculus
gggctcacgggttcctggcacgaat

SEQ ID NO: 636928 - DNA, 25 bp, Mus musculus
gggctcactgctatttacctcccgg

SEQ ID NO: 636929 - DNA, 25 bp, Mus musculus
gggctcactgctttttacctcccgg

SEQ ID NO: 636930 - DNA, 25 bp, Mus musculus
gggctcacttcactgtggttactat

SEQ ID NO: 636931 - DNA, 25 bp, Mus musculus
gggctcacttcagtgtggttactat

SEQ ID NO: 636932 - DNA, 25 bp, Mus musculus
gggctcacttttcattgagtcactc

SEQ ID NO: 636933 - DNA, 25 bp, Mus musculus
gggctcacttttgattgagtcactc

SEQ ID NO: 636934 - DNA, 25 bp, Mus musculus
gggctcagaactcctagaatcaaat

SEQ ID NO: 636935 - DNA, 25 bp, Mus musculus
gggctcagaactgctagaatcaaat

SEQ ID NO: 636936 - DNA, 25 bp, Mus musculus
gggctcagaaggaccctcaacatct

SEQ ID NO: 636937 - DNA, 25 bp, Mus musculus
gggctcagaaggtccctcaacatct

SEQ ID NO: 636938 - DNA, 25 bp, Mus musculus
gggctcagaagtcttcacgactggc

SEQ ID NO: 636939 - DNA, 25 bp, Mus musculus
gggctcagaagtgttcacgactggc

SEQ ID NO: 636940 - DNA, 25 bp, Mus musculus
gggctcagacttccaagtttgctga

SEQ ID NO: 636941 - DNA, 25 bp, Mus musculus
gggctcagacttgcaagtttgctga

SEQ ID NO: 636942 - DNA, 25 bp, Mus musculus
gggctcagagctcagtttcagattt

SEQ ID NO: 636943 - DNA, 25 bp, Mus musculus
gggctcagagctgagtttcagattt

SEQ ID NO: 636944 - DNA, 25 bp, Mus musculus
gggctcagaggtcacaacccaggaa

SEQ ID NO: 636945 - DNA, 25 bp, Mus musculus
gggctcagaggtgacaacccaggaa

SEQ ID NO: 636946 - DNA, 25 bp, Mus musculus
gggctcagagttcttacctgaacat

SEQ ID NO: 636947 - DNA, 25 bp, Mus musculus
gggctcagagttgttacctgaacat

SEQ ID NO: 636948 - DNA, 25 bp, Mus musculus
gggctcagattcctggataccctgc

SEQ ID NO: 636949 - DNA, 25 bp, Mus musculus
gggctcagattcgtggataccctgc

SEQ ID NO: 636950 - DNA, 25 bp, Mus musculus
gggctcagcaaaaacctctggttca

SEQ ID NO: 636951 - DNA, 25 bp, Mus musculus
gggctcagcaaatacctctggttca

SEQ ID NO: 636952 - DNA, 25 bp, Mus musculus
gggctcagcaataggttggtaaact

SEQ ID NO: 636953 - DNA, 25 bp, Mus musculus
gggctcagcaatcagactctgctca

SEQ ID NO: 636954 - DNA, 25 bp, Mus musculus
gggctcagcaatgagactctgctca

SEQ ID NO: 636955 - DNA, 25 bp, Mus musculus
gggctcagcaattggttggtaaact

SEQ ID NO: 636956 - DNA, 25 bp, Mus musculus
gggctcagcactatttgctcacttc

SEQ ID NO: 636957 - DNA, 25 bp, Mus musculus
gggctcagcactttttgctcacttc

SEQ ID NO: 636958 - DNA, 25 bp, Mus musculus
gggctcagccagaagagtgattgta

SEQ ID NO: 636959 - DNA, 25 bp, Mus musculus
gggctcagccagtagagtgattgta

SEQ ID NO: 636960 - DNA, 25 bp, Mus musculus
gggctcagcgacagtgcctgttcct

SEQ ID NO: 636961 - DNA, 25 bp, Mus musculus
gggctcagcgactgtgcctgttcct

SEQ ID NO: 636962 - DNA, 25 bp, Mus musculus
gggctcagctacaatctcgcattca

SEQ ID NO: 636963 - DNA, 25 bp, Mus musculus
gggctcagctactatctcgcattca

SEQ ID NO: 636964 - DNA, 25 bp, Mus musculus
gggctcaggaatcttctctgcatac

SEQ ID NO: 636965 - DNA, 25 bp, Mus musculus
gggctcaggaatgttctctgcatac

SEQ ID NO: 636966 - DNA, 25 bp, Mus musculus
gggctcaggagtaagacccctctca

SEQ ID NO: 636967 - DNA, 25 bp, Mus musculus
gggctcaggagttagacccctctca

SEQ ID NO: 636968 - DNA, 25 bp, Mus musculus
gggctcaggcatacactcggaagtg

SEQ ID NO: 636969 - DNA, 25 bp, Mus musculus
gggctcaggcattcactcggaagtg

SEQ ID NO: 636970 - DNA, 25 bp, Mus musculus
gggctcagggcaactggctcccctg

SEQ ID NO: 636971 - DNA, 25 bp, Mus musculus
gggctcagggcatctggctcccctg

SEQ ID NO: 636972 - DNA, 25 bp, Mus musculus
gggctcaggtaccatgtgcccatct

SEQ ID NO: 636973 - DNA, 25 bp, Mus musculus
gggctcaggtacgatgtgcccatct

SEQ ID NO: 636974 - DNA, 25 bp, Mus musculus
gggctcaggtccactcgaagccggc

SEQ ID NO: 636975 - DNA, 25 bp, Mus musculus
gggctcaggtcctctcgaagccggc

SEQ ID NO: 636976 - DNA, 25 bp, Mus musculus
gggctcaggtgaaccatgtgcctca

SEQ ID NO: 636977 - DNA, 25 bp, Mus musculus
gggctcaggtgatccatgtgcctca

SEQ ID NO: 636978 - DNA, 25 bp, Mus musculus
gggctcagtataaatttctcaggtt

SEQ ID NO: 636979 - DNA, 25 bp, Mus musculus
gggctcagtatatatttctcaggtt

SEQ ID NO: 636980 - DNA, 25 bp, Mus musculus
gggctcagtcctagggttcaataaa

SEQ ID NO: 636981 - DNA, 25 bp, Mus musculus
gggctcagtccttgggttcaataaa

SEQ ID NO: 636982 - DNA, 25 bp, Mus musculus
gggctcagttttcgcaacatccctg

SEQ ID NO: 636983 - DNA, 25 bp, Mus musculus
gggctcagttttggcaacatccctg

SEQ ID NO: 636984 - DNA, 25 bp, Mus musculus
gggctcatagtaagacttatgtcaa

SEQ ID NO: 636985 - DNA, 25 bp, Mus musculus
gggctcatagtatgacttatgtcaa

SEQ ID NO: 636986 - DNA, 25 bp, Mus musculus
gggctcatatctactcaattcattt

SEQ ID NO: 636987 - DNA, 25 bp, Mus musculus
gggctcatatcttctcaattcattt

SEQ ID NO: 636988 - DNA, 25 bp, Mus musculus
gggctcatcagcagacactggccac

SEQ ID NO: 636989 - DNA, 25 bp, Mus musculus
gggctcatcagctgacactggccac

SEQ ID NO: 636990 - DNA, 25 bp, Mus musculus
gggctcatcatacatcagtccagac

SEQ ID NO: 636991 - DNA, 25 bp, Mus musculus
gggctcatcatagatcagtccagac

SEQ ID NO: 636992 - DNA, 25 bp, Mus musculus
gggctcatcccaagttaaccttgtg

SEQ ID NO: 636993 - DNA, 25 bp, Mus musculus
gggctcatcccatgttaaccttgtg

SEQ ID NO: 636994 - DNA, 25 bp, Mus musculus
gggctcatctctaaggaagaccaat

SEQ ID NO: 636995 - DNA, 25 bp, Mus musculus
gggctcatctcttaggaagaccaat

SEQ ID NO: 636996 - DNA, 25 bp, Mus musculus
gggctcatgaccacagtccatgcca

SEQ ID NO: 636997 - DNA, 25 bp, Mus musculus
gggctcatgacctcagtccatgcca

SEQ ID NO: 636998 - DNA, 25 bp, Mus musculus
gggctcatggaaatctacaagacga

SEQ ID NO: 636999 - DNA, 25 bp, Mus musculus
gggctcatggaattctacaagacga

SEQ ID NO: 637000 - DNA, 25 bp, Mus musculus
gggctcatggcaattaacatactgt

SEQ ID NO: 637001 - DNA, 25 bp, Mus musculus
gggctcatggcatttaacatactgt

SEQ ID NO: 637002 - DNA, 25 bp, Mus musculus
gggctcatggtcatgctacattttc

SEQ ID NO: 637003 - DNA, 25 bp, Mus musculus
gggctcatggtcttgctacattttc

SEQ ID NO: 637004 - DNA, 25 bp, Mus musculus
gggctcatggttccaacttcatagt

SEQ ID NO: 637005 - DNA, 25 bp, Mus musculus
gggctcatggttgcaacttcatagt

SEQ ID NO: 637006 - DNA, 25 bp, Mus musculus
gggctcatgtgaacagatgggctta

SEQ ID NO: 637007 - DNA, 25 bp, Mus musculus
gggctcatgtgatcagatgggctta

SEQ ID NO: 637008 - DNA, 25 bp, Mus musculus
gggctcattccacgcattgcctgca

SEQ ID NO: 637009 - DNA, 25 bp, Mus musculus
gggctcattccaggcattgcctgca

SEQ ID NO: 637010 - DNA, 25 bp, Mus musculus
gggctcatttccacagatcttatta

SEQ ID NO: 637011 - DNA, 25 bp, Mus musculus
gggctcatttcctcagatcttatta

SEQ ID NO: 637012 - DNA, 25 bp, Mus musculus
gggctcatttgcagtaaggttcatt

SEQ ID NO: 637013 - DNA, 25 bp, Mus musculus
gggctcatttgctgtaaggttcatt

SEQ ID NO: 637014 - DNA, 25 bp, Mus musculus
gggctccaaaatcatattccgggtt

SEQ ID NO: 637015 - DNA, 25 bp, Mus musculus
gggctccaaaatccctagaactgta

SEQ ID NO: 637016 - DNA, 25 bp, Mus musculus
gggctccaaaatgatattccgggtt

SEQ ID NO: 637017 - DNA, 25 bp, Mus musculus
gggctccaaaatgcctagaactgta

SEQ ID NO: 637018 - DNA, 25 bp, Mus musculus
gggctccaaatccttgctcatgacc

SEQ ID NO: 637019 - DNA, 25 bp, Mus musculus
gggctccaaatcgttgctcatgacc

SEQ ID NO: 637020 - DNA, 25 bp, Mus musculus
gggctccaagtcagagatttcattg

SEQ ID NO: 637021 - DNA, 25 bp, Mus musculus
gggctccaagtctgagatttcattg

SEQ ID NO: 637022 - DNA, 25 bp, Mus musculus
gggctccaatggacaaacttctaca

SEQ ID NO: 637023 - DNA, 25 bp, Mus musculus
gggctccaatggtcaaacttctaca

SEQ ID NO: 637024 - DNA, 25 bp, Mus musculus
gggctccacaggcttcgcgattctc

SEQ ID NO: 637025 - DNA, 25 bp, Mus musculus
gggctccacagggttcgcgattctc

SEQ ID NO: 637026 - DNA, 25 bp, Mus musculus
gggctccacatacgccaaaccagtg

SEQ ID NO: 637027 - DNA, 25 bp, Mus musculus
gggctccacataggccaaaccagtg

SEQ ID NO: 637028 - DNA, 25 bp, Mus musculus
gggctccagaaacttttctgagctt

SEQ ID NO: 637029 - DNA, 25 bp, Mus musculus
gggctccagaaagttttctgagctt

SEQ ID NO: 637030 - DNA, 25 bp, Mus musculus
gggctccagacaatgtattttcctt

SEQ ID NO: 637031 - DNA, 25 bp, Mus musculus
gggctccagacattgtattttcctt

SEQ ID NO: 637032 - DNA, 25 bp, Mus musculus
gggctccagagtatctggttggccc

SEQ ID NO: 637033 - DNA, 25 bp, Mus musculus
gggctccagagtttctggttggccc

SEQ ID NO: 637034 - DNA, 25 bp, Mus musculus
gggctccagcagaagcctgcagtgc

SEQ ID NO: 637035 - DNA, 25 bp, Mus musculus
gggctccagcagtagcctgcagtgc

SEQ ID NO: 637036 - DNA, 25 bp, Mus musculus
gggctccagccgactgtaggctctg

SEQ ID NO: 637037 - DNA, 25 bp, Mus musculus
gggctccagccgtctgtaggctctg

SEQ ID NO: 637038 - DNA, 25 bp, Mus musculus
gggctccagcctcaaaacagtggaa

SEQ ID NO: 637039 - DNA, 25 bp, Mus musculus
gggctccagcctgaaaacagtggaa

SEQ ID NO: 637040 - DNA, 25 bp, Mus musculus
gggctccagcgcaactatgaacttg

SEQ ID NO: 637041 - DNA, 25 bp, Mus musculus
gggctccagcgctactatgaacttg

SEQ ID NO: 637042 - DNA, 25 bp, Mus musculus
gggctccaggtgatctggctatcaa

SEQ ID NO: 637043 - DNA, 25 bp, Mus musculus
gggctccaggtgttctggctatcaa

SEQ ID NO: 637044 - DNA, 25 bp, Mus musculus
gggctccagtgcagatttagatcca

SEQ ID NO: 637045 - DNA, 25 bp, Mus musculus
gggctccagtgctgatttagatcca

SEQ ID NO: 637046 - DNA, 25 bp, Mus musculus
gggctccagtgtatgcttctctgat

SEQ ID NO: 637047 - DNA, 25 bp, Mus musculus
gggctccagtgtttgcttctctgat

SEQ ID NO: 637048 - DNA, 25 bp, Mus musculus
gggctccatccgaatgcaacacagt

SEQ ID NO: 637049 - DNA, 25 bp, Mus musculus
gggctccatccgtatgcaacacagt

SEQ ID NO: 637050 - DNA, 25 bp, Mus musculus
gggctccatcttccatgctgctttc

SEQ ID NO: 637051 - DNA, 25 bp, Mus musculus
gggctccatcttgcatgctgctttc

SEQ ID NO: 637052 - DNA, 25 bp, Mus musculus
gggctccatgatccaacaatgggtc

SEQ ID NO: 637053 - DNA, 25 bp, Mus musculus
gggctccatgatgcaacaatgggtc

SEQ ID NO: 637054 - DNA, 25 bp, Mus musculus
gggctccattctcgtgatgcaccag

SEQ ID NO: 637055 - DNA, 25 bp, Mus musculus
gggctccattctggtgatgcaccag

SEQ ID NO: 637056 - DNA, 25 bp, Mus musculus
gggctccattggaactgtatatgaa

SEQ ID NO: 637057 - DNA, 25 bp, Mus musculus
gggctccattggtactgtatatgaa

SEQ ID NO: 637058 - DNA, 25 bp, Mus musculus
gggctccatttacattctttctaaa

SEQ ID NO: 637059 - DNA, 25 bp, Mus musculus
gggctccatttagattctttctaaa

SEQ ID NO: 637060 - DNA, 25 bp, Mus musculus
gggctcccaagaatttggactctaa

SEQ ID NO: 637061 - DNA, 25 bp, Mus musculus
gggctcccaagattttggactctaa

SEQ ID NO: 637062 - DNA, 25 bp, Mus musculus
gggctcccacatatatcaagactct

SEQ ID NO: 637063 - DNA, 25 bp, Mus musculus
gggctcccacatttatcaagactct

SEQ ID NO: 637064 - DNA, 25 bp, Mus musculus
gggctcccacggagacttgtttaca

SEQ ID NO: 637065 - DNA, 25 bp, Mus musculus
gggctcccacggtgacttgtttaca

SEQ ID NO: 637066 - DNA, 25 bp, Mus musculus
gggctcccagacagagtaagaagaa

SEQ ID NO: 637067 - DNA, 25 bp, Mus musculus
gggctcccagactgagtaagaagaa

SEQ ID NO: 637068 - DNA, 25 bp, Mus musculus
gggctcccagagattcttccttgtc

SEQ ID NO: 637069 - DNA, 25 bp, Mus musculus
gggctcccagagtttcttccttgtc

SEQ ID NO: 637070 - DNA, 25 bp, Mus musculus
gggctcccatatacatacaatgaag

SEQ ID NO: 637071 - DNA, 25 bp, Mus musculus
gggctcccatattcatacaatgaag

SEQ ID NO: 637072 - DNA, 25 bp, Mus musculus
gggctcccatgcaaacaaggtgttc

SEQ ID NO: 637073 - DNA, 25 bp, Mus musculus
gggctcccatgctaacaaggtgttc

SEQ ID NO: 637074 - DNA, 25 bp, Mus musculus
gggctccccacacatgaggcacagt

SEQ ID NO: 637075 - DNA, 25 bp, Mus musculus
gggctccccacagatgaggcacagt

SEQ ID NO: 637076 - DNA, 25 bp, Mus musculus
gggctccccataaggaatcatgtct

SEQ ID NO: 637077 - DNA, 25 bp, Mus musculus
gggctccccatatggaatcatgtct

SEQ ID NO: 637078 - DNA, 25 bp, Mus musculus
gggctcccgcagaatgagacatcaa

SEQ ID NO: 637079 - DNA, 25 bp, Mus musculus
gggctcccgcagtatgagacatcaa

SEQ ID NO: 637080 - DNA, 25 bp, Mus musculus
gggctcccggtaacatctcagcggg

SEQ ID NO: 637081 - DNA, 25 bp, Mus musculus
gggctcccggtatcatctcagcggg

SEQ ID NO: 637082 - DNA, 25 bp, Mus musculus
gggctccctgggattagctgatgct

SEQ ID NO: 637083 - DNA, 25 bp, Mus musculus
gggctccctgggtttagctgatgct

SEQ ID NO: 637084 - DNA, 25 bp, Mus musculus
gggctccctgtaatgatcaatgtct

SEQ ID NO: 637085 - DNA, 25 bp, Mus musculus
gggctccctgtattgatcaatgtct

SEQ ID NO: 637086 - DNA, 25 bp, Mus musculus
gggctccctgtgacaggcaagtaca

SEQ ID NO: 637087 - DNA, 25 bp, Mus musculus
gggctccctgtgtcaggcaagtaca

SEQ ID NO: 637088 - DNA, 25 bp, Mus musculus
gggctccctgttagatgtcgatgtg

SEQ ID NO: 637089 - DNA, 25 bp, Mus musculus
gggctccctgtttgatgtcgatgtg

SEQ ID NO: 637090 - DNA, 25 bp, Mus musculus
gggctcccttatagtgtttgcctgc

SEQ ID NO: 637091 - DNA, 25 bp, Mus musculus
gggctcccttattgtgtttgcctgc

SEQ ID NO: 637092 - DNA, 25 bp, Mus musculus
gggctcccttgtcgctggacagcag

SEQ ID NO: 637093 - DNA, 25 bp, Mus musculus
gggctcccttgtggctggacagcag

SEQ ID NO: 637094 - DNA, 25 bp, Mus musculus
gggctccgaagccaacatcaacaac

SEQ ID NO: 637095 - DNA, 25 bp, Mus musculus
gggctccgaagcgaacatcaacaac

SEQ ID NO: 637096 - DNA, 25 bp, Mus musculus
gggctccgacaaagcctggtgacac

SEQ ID NO: 637097 - DNA, 25 bp, Mus musculus
gggctccgacaatgcctggtgacac

SEQ ID NO: 637098 - DNA, 25 bp, Mus musculus
gggctccgcaacagcaggcacatgt

SEQ ID NO: 637099 - DNA, 25 bp, Mus musculus
gggctccgcaactgcaggcacatgt

SEQ ID NO: 637100 - DNA, 25 bp, Mus musculus
gggctccgcggacactgatctatca

SEQ ID NO: 637101 - DNA, 25 bp, Mus musculus
gggctccgcggagactgatctatca

SEQ ID NO: 637102 - DNA, 25 bp, Mus musculus
gggctcctaagaccttcctgtgctt

SEQ ID NO: 637103 - DNA, 25 bp, Mus musculus
gggctcctaagagcttcctgtgctt

SEQ ID NO: 637104 - DNA, 25 bp, Mus musculus
gggctcctaagccagcagctagaac

SEQ ID NO: 637105 - DNA, 25 bp, Mus musculus
gggctcctaagccatgccaggaaaa

SEQ ID NO: 637106 - DNA, 25 bp, Mus musculus
gggctcctaagcgagcagctagaac

SEQ ID NO: 637107 - DNA, 25 bp, Mus musculus
gggctcctaagcgatgccaggaaaa

SEQ ID NO: 637108 - DNA, 25 bp, Mus musculus
gggctcctagccactgagcatagag

SEQ ID NO: 637109 - DNA, 25 bp, Mus musculus
gggctcctagcctctgagcatagag

SEQ ID NO: 637110 - DNA, 25 bp, Mus musculus
gggctcctataaatggcagctgctc

SEQ ID NO: 637111 - DNA, 25 bp, Mus musculus
gggctcctataattggcagctgctc

SEQ ID NO: 637112 - DNA, 25 bp, Mus musculus
gggctcctatagatacgacggaggc

SEQ ID NO: 637113 - DNA, 25 bp, Mus musculus
gggctcctatagttacgacggaggc

SEQ ID NO: 637114 - DNA, 25 bp, Mus musculus
gggctcctatccaggcgttgtctgt

SEQ ID NO: 637115 - DNA, 25 bp, Mus musculus
gggctcctatcctggcgttgtctgt

SEQ ID NO: 637116 - DNA, 25 bp, Mus musculus
gggctcctattcagaactcttcctc

SEQ ID NO: 637117 - DNA, 25 bp, Mus musculus
gggctcctattctgaactcttcctc

SEQ ID NO: 637118 - DNA, 25 bp, Mus musculus
gggctcctcaccagtgaattgtaga

SEQ ID NO: 637119 - DNA, 25 bp, Mus musculus
gggctcctcacctgtgaattgtaga

SEQ ID NO: 637120 - DNA, 25 bp, Mus musculus
gggctcctcagacaccgtctgtaac

SEQ ID NO: 637121 - DNA, 25 bp, Mus musculus
gggctcctcagagaccgtctgtaac

SEQ ID NO: 637122 - DNA, 25 bp, Mus musculus
gggctcctccaaaggactgatacca

SEQ ID NO: 637123 - DNA, 25 bp, Mus musculus
gggctcctccaatggactgatacca

SEQ ID NO: 637124 - DNA, 25 bp, Mus musculus
gggctcctcctgcattggcaaatac

SEQ ID NO: 637125 - DNA, 25 bp, Mus musculus
gggctcctcctggattggcaaatac

SEQ ID NO: 637126 - DNA, 25 bp, Mus musculus
gggctcctctgtcaagaataccatg

SEQ ID NO: 637127 - DNA, 25 bp, Mus musculus
gggctcctctgtgaagaataccatg

SEQ ID NO: 637128 - DNA, 25 bp, Mus musculus
gggctcctgaaaagataacttttga

SEQ ID NO: 637129 - DNA, 25 bp, Mus musculus
gggctcctgaaatgataacttttga

SEQ ID NO: 637130 - DNA, 25 bp, Mus musculus
gggctcctgaagacctgaagaaaga

SEQ ID NO: 637131 - DNA, 25 bp, Mus musculus
gggctcctgaagagctacttgaatt

SEQ ID NO: 637132 - DNA, 25 bp, Mus musculus
gggctcctgaagtcctgaagaaaga

SEQ ID NO: 637133 - DNA, 25 bp, Mus musculus
gggctcctgaagtgctacttgaatt

SEQ ID NO: 637134 - DNA, 25 bp, Mus musculus
gggctcctgactattatgttctagt

SEQ ID NO: 637135 - DNA, 25 bp, Mus musculus
gggctcctgacttttatgttctagt

SEQ ID NO: 637136 - DNA, 25 bp, Mus musculus
gggctcctgatgctaaatgcgctgt

SEQ ID NO: 637137 - DNA, 25 bp, Mus musculus
gggctcctgatggtaaatgcgctgt

SEQ ID NO: 637138 - DNA, 25 bp, Mus musculus
gggctcctgcatcggtatattccta

SEQ ID NO: 637139 - DNA, 25 bp, Mus musculus
gggctcctgcatgggtatattccta

SEQ ID NO: 637140 - DNA, 25 bp, Mus musculus
gggctcctgctgctataaattcaga

SEQ ID NO: 637141 - DNA, 25 bp, Mus musculus
gggctcctgctggtataaattcaga

SEQ ID NO: 637142 - DNA, 25 bp, Mus musculus
gggctcctggaaagaggaacccctg

SEQ ID NO: 637143 - DNA, 25 bp, Mus musculus
gggctcctggaacgctactttgtac

SEQ ID NO: 637144 - DNA, 25 bp, Mus musculus
gggctcctggaaggctactttgtac

SEQ ID NO: 637145 - DNA, 25 bp, Mus musculus
gggctcctggaatgaggaacccctg

SEQ ID NO: 637146 - DNA, 25 bp, Mus musculus
gggctcctggacacatacctacata

SEQ ID NO: 637147 - DNA, 25 bp, Mus musculus
gggctcctggacactacacctacag

SEQ ID NO: 637148 - DNA, 25 bp, Mus musculus
gggctcctggactcatacctacata

SEQ ID NO: 637149 - DNA, 25 bp, Mus musculus
gggctcctggactctacacctacag

SEQ ID NO: 637150 - DNA, 25 bp, Mus musculus
gggctcctggcaaatgttcaattaa

SEQ ID NO: 637151 - DNA, 25 bp, Mus musculus
gggctcctggcatatgttcaattaa

SEQ ID NO: 637152 - DNA, 25 bp, Mus musculus
gggctcctgtagaccacaagtttga

SEQ ID NO: 637153 - DNA, 25 bp, Mus musculus
gggctcctgtagtccacaagtttga

SEQ ID NO: 637154 - DNA, 25 bp, Mus musculus
gggctccttcgcatcttgcgggcgc

SEQ ID NO: 637155 - DNA, 25 bp, Mus musculus
gggctccttcgcttcttgcgggcgc

SEQ ID NO: 637156 - DNA, 25 bp, Mus musculus
gggctccttgagaaactgcctgcct

SEQ ID NO: 637157 - DNA, 25 bp, Mus musculus
gggctccttgagagcagactgatgc

SEQ ID NO: 637158 - DNA, 25 bp, Mus musculus
gggctccttgagtaactgcctgcct

SEQ ID NO: 637159 - DNA, 25 bp, Mus musculus
gggctccttgagtgcagactgatgc

SEQ ID NO: 637160 - DNA, 25 bp, Mus musculus
gggctccttgcaccttgctttagct

SEQ ID NO: 637161 - DNA, 25 bp, Mus musculus
gggctccttgcagcttgctttagct

SEQ ID NO: 637162 - DNA, 25 bp, Mus musculus
gggctccttgctaggccacagatat

SEQ ID NO: 637163 - DNA, 25 bp, Mus musculus
gggctccttgcttggccacagatat

SEQ ID NO: 637164 - DNA, 25 bp, Mus musculus
gggctccttggacttagaactacaa

SEQ ID NO: 637165 - DNA, 25 bp, Mus musculus
gggctccttggagttagaactacaa

SEQ ID NO: 637166 - DNA, 25 bp, Mus musculus
gggctccttggtctaatctgtgtcg

SEQ ID NO: 637167 - DNA, 25 bp, Mus musculus
gggctccttggtgtaatctgtgtcg

SEQ ID NO: 637168 - DNA, 25 bp, Mus musculus
gggctccttgtgagggaattatttt

SEQ ID NO: 637169 - DNA, 25 bp, Mus musculus
gggctccttgtgtgggaattatttt

SEQ ID NO: 637170 - DNA, 25 bp, Mus musculus
gggctcctttcacggaacctgtgga

SEQ ID NO: 637171 - DNA, 25 bp, Mus musculus
gggctcctttcagggaacctgtgga

SEQ ID NO: 637172 - DNA, 25 bp, Mus musculus
gggctcctttccctggatagcagca

SEQ ID NO: 637173 - DNA, 25 bp, Mus musculus
gggctcctttccgtggatagcagca

SEQ ID NO: 637174 - DNA, 25 bp, Mus musculus
gggctcctttgcacctgtgtttggg

SEQ ID NO: 637175 - DNA, 25 bp, Mus musculus
gggctcctttgctcctgtgtttggg

SEQ ID NO: 637176 - DNA, 25 bp, Mus musculus
gggctcgaaacaccatcgttgtcat

SEQ ID NO: 637177 - DNA, 25 bp, Mus musculus
gggctcgaaacagcatcgttgtcat

SEQ ID NO: 637178 - DNA, 25 bp, Mus musculus
gggctcgaatagctctggagactct

SEQ ID NO: 637179 - DNA, 25 bp, Mus musculus
gggctcgaataggtctggagactct

SEQ ID NO: 637180 - DNA, 25 bp, Mus musculus
gggctcgaatcaaccttcttgacac

SEQ ID NO: 637181 - DNA, 25 bp, Mus musculus
gggctcgaatcatccttcttgacac

SEQ ID NO: 637182 - DNA, 25 bp, Mus musculus
gggctcgaggaacgttcattcactt

SEQ ID NO: 637183 - DNA, 25 bp, Mus musculus
gggctcgaggaaggttcattcactt

SEQ ID NO: 637184 - DNA, 25 bp, Mus musculus
gggctcgctatcagcttggagcaaa

SEQ ID NO: 637185 - DNA, 25 bp, Mus musculus
gggctcgctatctgcttggagcaaa

SEQ ID NO: 637186 - DNA, 25 bp, Mus musculus
gggctcgcttgtcatagatattgtg

SEQ ID NO: 637187 - DNA, 25 bp, Mus musculus
gggctcgcttgtgatagatattgtg

SEQ ID NO: 637188 - DNA, 25 bp, Mus musculus
gggctcggcacaatgcagatgttgt

SEQ ID NO: 637189 - DNA, 25 bp, Mus musculus
gggctcggcacattgcagatgttgt

SEQ ID NO: 637190 - DNA, 25 bp, Mus musculus
gggctcggcaggctcagcacatcta

SEQ ID NO: 637191 - DNA, 25 bp, Mus musculus
gggctcggcagggtcagcacatcta

SEQ ID NO: 637192 - DNA, 25 bp, Mus musculus
gggctcggctgtcggctactaccta

SEQ ID NO: 637193 - DNA, 25 bp, Mus musculus
gggctcggctgtgggctactaccta

SEQ ID NO: 637194 - DNA, 25 bp, Mus musculus
gggctcgggacgatttctgtcttga

SEQ ID NO: 637195 - DNA, 25 bp, Mus musculus
gggctcgggacgttttctgtcttga

SEQ ID NO: 637196 - DNA, 25 bp, Mus musculus
gggctcgggcctatagagatcacat

SEQ ID NO: 637197 - DNA, 25 bp, Mus musculus
gggctcgggcctttagagatcacat

SEQ ID NO: 637198 - DNA, 25 bp, Mus musculus
gggctcgtacatcttccagtggaat

SEQ ID NO: 637199 - DNA, 25 bp, Mus musculus
gggctcgtacatgttccagtggaat

SEQ ID NO: 637200 - DNA, 25 bp, Mus musculus
gggctcgtatctattttcacggtga

SEQ ID NO: 637201 - DNA, 25 bp, Mus musculus
gggctcgtatcttttttcacggtga

SEQ ID NO: 637202 - DNA, 25 bp, Mus musculus
gggctcgtcctgagcgcgaccagca

SEQ ID NO: 637203 - DNA, 25 bp, Mus musculus
gggctcgtcctgtgcgcgaccagca

SEQ ID NO: 637204 - DNA, 25 bp, Mus musculus
gggctcgtgatcacatttcacatat

SEQ ID NO: 637205 - DNA, 25 bp, Mus musculus
gggctcgtgatctcatttcacatat

SEQ ID NO: 637206 - DNA, 25 bp, Mus musculus
gggctcgtgtaccatacgtgcgata

SEQ ID NO: 637207 - DNA, 25 bp, Mus musculus
gggctcgtgtacgatacgtgcgata

SEQ ID NO: 637208 - DNA, 25 bp, Mus musculus
gggctcgttcacaagtgtacatcca

SEQ ID NO: 637209 - DNA, 25 bp, Mus musculus
gggctcgttcactagtgtacatcca

SEQ ID NO: 637210 - DNA, 25 bp, Mus musculus
gggctctaaaacactatctgtggca

SEQ ID NO: 637211 - DNA, 25 bp, Mus musculus
gggctctaaaactctatctgtggca

SEQ ID NO: 637212 - DNA, 25 bp, Mus musculus
gggctctaaccacgagtcatagctc

SEQ ID NO: 637213 - DNA, 25 bp, Mus musculus
gggctctaaccaggagtcatagctc

SEQ ID NO: 637214 - DNA, 25 bp, Mus musculus
gggctctaacccaagtggaatgcaa

SEQ ID NO: 637215 - DNA, 25 bp, Mus musculus
gggctctaaccctagtggaatgcaa

SEQ ID NO: 637216 - DNA, 25 bp, Mus musculus
gggctctaacttatgtatcacagtg

SEQ ID NO: 637217 - DNA, 25 bp, Mus musculus
gggctctaacttttgtatcacagtg

SEQ ID NO: 637218 - DNA, 25 bp, Mus musculus
gggctctaagcccttatctcagagt

SEQ ID NO: 637219 - DNA, 25 bp, Mus musculus
gggctctaagccgttatctcagagt

SEQ ID NO: 637220 - DNA, 25 bp, Mus musculus
gggctctaatgtcccaaggcgcttg

SEQ ID NO: 637221 - DNA, 25 bp, Mus musculus
gggctctaatgtgccaaggcgcttg

SEQ ID NO: 637222 - DNA, 25 bp, Mus musculus
gggctctacaccagagtcactactt

SEQ ID NO: 637223 - DNA, 25 bp, Mus musculus
gggctctacacctgagtcactactt

SEQ ID NO: 637224 - DNA, 25 bp, Mus musculus
gggctctactacatgcagaaaaacg

SEQ ID NO: 637225 - DNA, 25 bp, Mus musculus
gggctctactacttgcagaaaaacg

SEQ ID NO: 637226 - DNA, 25 bp, Mus musculus
gggctctactggctacatttccaga

SEQ ID NO: 637227 - DNA, 25 bp, Mus musculus
gggctctactgggtacatttccaga

SEQ ID NO: 637228 - DNA, 25 bp, Mus musculus
gggctctagccaaattcatttttaa

SEQ ID NO: 637229 - DNA, 25 bp, Mus musculus
gggctctagccatattcatttttaa

SEQ ID NO: 637230 - DNA, 25 bp, Mus musculus
gggctctatggtattcacaccacag

SEQ ID NO: 637231 - DNA, 25 bp, Mus musculus
gggctctatggttttcacaccacag

SEQ ID NO: 637232 - DNA, 25 bp, Mus musculus
gggctctattcacagcttatccgga

SEQ ID NO: 637233 - DNA, 25 bp, Mus musculus
gggctctattcagagcttatccgga

SEQ ID NO: 637234 - DNA, 25 bp, Mus musculus
gggctctattttaaatgctcccatt

SEQ ID NO: 637235 - DNA, 25 bp, Mus musculus
gggctctatttttaatgctcccatt

SEQ ID NO: 637236 - DNA, 25 bp, Mus musculus
gggctctcaactcatttgagtggaa

SEQ ID NO: 637237 - DNA, 25 bp, Mus musculus
gggctctcaactgatttgagtggaa

SEQ ID NO: 637238 - DNA, 25 bp, Mus musculus
gggctctcagccctaaaactcactg

SEQ ID NO: 637239 - DNA, 25 bp, Mus musculus
gggctctcagccgtaaaactcactg

SEQ ID NO: 637240 - DNA, 25 bp, Mus musculus
gggctctcagctaaatccagaagga

SEQ ID NO: 637241 - DNA, 25 bp, Mus musculus
gggctctcagcttaatccagaagga

SEQ ID NO: 637242 - DNA, 25 bp, Mus musculus
gggctctcagttacatattgcatgc

SEQ ID NO: 637243 - DNA, 25 bp, Mus musculus
gggctctcagtttcatattgcatgc

SEQ ID NO: 637244 - DNA, 25 bp, Mus musculus
gggctctccagcatcaattactgat

SEQ ID NO: 637245 - DNA, 25 bp, Mus musculus
gggctctccagcttcaattactgat

SEQ ID NO: 637246 - DNA, 25 bp, Mus musculus
gggctctccatcagacatagcaaca

SEQ ID NO: 637247 - DNA, 25 bp, Mus musculus
gggctctccatctgacatagcaaca

SEQ ID NO: 637248 - DNA, 25 bp, Mus musculus
gggctctccatgcatgtagcatatg

SEQ ID NO: 637249 - DNA, 25 bp, Mus musculus
gggctctccatggatgtagcatatg

SEQ ID NO: 637250 - DNA, 25 bp, Mus musculus
gggctctcccagagctctgtgctca

SEQ ID NO: 637251 - DNA, 25 bp, Mus musculus
gggctctcccagtgctctgtgctca

SEQ ID NO: 637252 - DNA, 25 bp, Mus musculus
gggctctcccgtcaattatgtgcaa

SEQ ID NO: 637253 - DNA, 25 bp, Mus musculus
gggctctcccgtgaattatgtgcaa

SEQ ID NO: 637254 - DNA, 25 bp, Mus musculus
gggctctccgagcactgaggacgaa

SEQ ID NO: 637255 - DNA, 25 bp, Mus musculus
gggctctccgaggactgaggacgaa

SEQ ID NO: 637256 - DNA, 25 bp, Mus musculus
gggctctcctttatgaaccttttga

SEQ ID NO: 637257 - DNA, 25 bp, Mus musculus
gggctctcctttttgaaccttttga

SEQ ID NO: 637258 - DNA, 25 bp, Mus musculus
gggctctcgcttctgcttctcatgc

SEQ ID NO: 637259 - DNA, 25 bp, Mus musculus
gggctctcgcttgtgcttctcatgc

SEQ ID NO: 637260 - DNA, 25 bp, Mus musculus
gggctctcggataatcagcatgatc

SEQ ID NO: 637261 - DNA, 25 bp, Mus musculus
gggctctcggattatcagcatgatc

SEQ ID NO: 637262 - DNA, 25 bp, Mus musculus
gggctctctactacgacctgatcac

SEQ ID NO: 637263 - DNA, 25 bp, Mus musculus
gggctctctacttcgacctgatcac

SEQ ID NO: 637264 - DNA, 25 bp, Mus musculus
gggctctctcttaccgcatttatat

SEQ ID NO: 637265 - DNA, 25 bp, Mus musculus
gggctctctctttccgcatttatat

SEQ ID NO: 637266 - DNA, 25 bp, Mus musculus
gggctctctgctctacatattcgag

SEQ ID NO: 637267 - DNA, 25 bp, Mus musculus
gggctctctgctgtacatattcgag

SEQ ID NO: 637268 - DNA, 25 bp, Mus musculus
gggctctctggtacagccagcagtt

SEQ ID NO: 637269 - DNA, 25 bp, Mus musculus
gggctctctggttcagccagcagtt

SEQ ID NO: 637270 - DNA, 25 bp, Mus musculus
gggctctcttccagtgctttgcagc

SEQ ID NO: 637271 - DNA, 25 bp, Mus musculus
gggctctcttcctgtgctttgcagc

SEQ ID NO: 637272 - DNA, 25 bp, Mus musculus
gggctctcttgaccctagagttcaa

SEQ ID NO: 637273 - DNA, 25 bp, Mus musculus
gggctctcttgagcctagagttcaa

SEQ ID NO: 637274 - DNA, 25 bp, Mus musculus
gggctctgaacccacagaactgaca

SEQ ID NO: 637275 - DNA, 25 bp, Mus musculus
gggctctgaaccgacagaactgaca

SEQ ID NO: 637276 - DNA, 25 bp, Mus musculus
gggctctgaacgaggccagaaaata

SEQ ID NO: 637277 - DNA, 25 bp, Mus musculus
gggctctgaacgtggccagaaaata

SEQ ID NO: 637278 - DNA, 25 bp, Mus musculus
gggctctgaatcattgcttaccaca

SEQ ID NO: 637279 - DNA, 25 bp, Mus musculus
gggctctgaatctttgcttaccaca

SEQ ID NO: 637280 - DNA, 25 bp, Mus musculus
gggctctgaatgagctttactctag

SEQ ID NO: 637281 - DNA, 25 bp, Mus musculus
gggctctgaatgtgctttactctag

SEQ ID NO: 637282 - DNA, 25 bp, Mus musculus
gggctctgaccactgaacttaacct

SEQ ID NO: 637283 - DNA, 25 bp, Mus musculus
gggctctgaccactgtatgctgcga

SEQ ID NO: 637284 - DNA, 25 bp, Mus musculus
gggctctgaccagtgaacttaacct

SEQ ID NO: 637285 - DNA, 25 bp, Mus musculus
gggctctgaccagtgtatgctgcga

SEQ ID NO: 637286 - DNA, 25 bp, Mus musculus
gggctctgactcaacataatggaga

SEQ ID NO: 637287 - DNA, 25 bp, Mus musculus
gggctctgactctacataatggaga

SEQ ID NO: 637288 - DNA, 25 bp, Mus musculus
gggctctgacttagtgtggtgacat

SEQ ID NO: 637289 - DNA, 25 bp, Mus musculus
gggctctgactttgtgtggtgacat

SEQ ID NO: 637290 - DNA, 25 bp, Mus musculus
gggctctgagccagcacccgggatg

SEQ ID NO: 637291 - DNA, 25 bp, Mus musculus
gggctctgagcctgcacccgggatg

SEQ ID NO: 637292 - DNA, 25 bp, Mus musculus
gggctctgagtcactggtcttgaga

SEQ ID NO: 637293 - DNA, 25 bp, Mus musculus
gggctctgagtcatatcctctaggt

SEQ ID NO: 637294 - DNA, 25 bp, Mus musculus
gggctctgagtctctggtcttgaga

SEQ ID NO: 637295 - DNA, 25 bp, Mus musculus
gggctctgagtcttatcctctaggt

SEQ ID NO: 637296 - DNA, 25 bp, Mus musculus
gggctctgagtgctccgacacagtc

SEQ ID NO: 637297 - DNA, 25 bp, Mus musculus
gggctctgagtggtccgacacagtc

SEQ ID NO: 637298 - DNA, 25 bp, Mus musculus
gggctctgcactcggcagatcaaga

SEQ ID NO: 637299 - DNA, 25 bp, Mus musculus
gggctctgcactgggcagatcaaga

SEQ ID NO: 637300 - DNA, 25 bp, Mus musculus
gggctctgcagtcggacacaccctg

SEQ ID NO: 637301 - DNA, 25 bp, Mus musculus
gggctctgcagtgggacacaccctg

SEQ ID NO: 637302 - DNA, 25 bp, Mus musculus
gggctctgccatcttacactaattt

SEQ ID NO: 637303 - DNA, 25 bp, Mus musculus
gggctctgccatgttacactaattt

SEQ ID NO: 637304 - DNA, 25 bp, Mus musculus
gggctctgctgtcttttcttacaac

SEQ ID NO: 637305 - DNA, 25 bp, Mus musculus
gggctctgctgtgttttcttacaac

SEQ ID NO: 637306 - DNA, 25 bp, Mus musculus
gggctctggagccattagaaacagc

SEQ ID NO: 637307 - DNA, 25 bp, Mus musculus
gggctctggagcgattagaaacagc

SEQ ID NO: 637308 - DNA, 25 bp, Mus musculus
gggctctggtatccatatgcttcta

SEQ ID NO: 637309 - DNA, 25 bp, Mus musculus
gggctctggtatctcttttagacta

SEQ ID NO: 637310 - DNA, 25 bp, Mus musculus
gggctctggtatgcatatgcttcta

SEQ ID NO: 637311 - DNA, 25 bp, Mus musculus
gggctctggtatgtcttttagacta

SEQ ID NO: 637312 - DNA, 25 bp, Mus musculus
gggctctggtgcatcacgctggcac

SEQ ID NO: 637313 - DNA, 25 bp, Mus musculus
gggctctggtgcttcacgctggcac

SEQ ID NO: 637314 - DNA, 25 bp, Mus musculus
gggctctgtacaaagctatgaagaa

SEQ ID NO: 637315 - DNA, 25 bp, Mus musculus
gggctctgtacatagctatgaagaa

SEQ ID NO: 637316 - DNA, 25 bp, Mus musculus
gggctctgtaggactagttctatgg

SEQ ID NO: 637317 - DNA, 25 bp, Mus musculus
gggctctgtaggtctagttctatgg

SEQ ID NO: 637318 - DNA, 25 bp, Mus musculus
gggctctgtcctatctaaccaggaa

SEQ ID NO: 637319 - DNA, 25 bp, Mus musculus
gggctctgtcctcatttttattcca

SEQ ID NO: 637320 - DNA, 25 bp, Mus musculus
gggctctgtcctgatttttattcca

SEQ ID NO: 637321 - DNA, 25 bp, Mus musculus
gggctctgtcctttctaaccaggaa

SEQ ID NO: 637322 - DNA, 25 bp, Mus musculus
gggctctgtctcctgcttcttagac

SEQ ID NO: 637323 - DNA, 25 bp, Mus musculus
gggctctgtctcgtgcttcttagac

SEQ ID NO: 637324 - DNA, 25 bp, Mus musculus
gggctctgtctgatcatttttaacc

SEQ ID NO: 637325 - DNA, 25 bp, Mus musculus
gggctctgtctgttcatttttaacc

SEQ ID NO: 637326 - DNA, 25 bp, Mus musculus
gggctctgtgcaccctagacaagca

SEQ ID NO: 637327 - DNA, 25 bp, Mus musculus
gggctctgtgcagcctagacaagca

SEQ ID NO: 637328 - DNA, 25 bp, Mus musculus
gggctctgtggtagaatgcttactt

SEQ ID NO: 637329 - DNA, 25 bp, Mus musculus
gggctctgtggttgaatgcttactt

SEQ ID NO: 637330 - DNA, 25 bp, Mus musculus
gggctctgttgtcacccctgcctga

SEQ ID NO: 637331 - DNA, 25 bp, Mus musculus
gggctctgttgtgacccctgcctga

SEQ ID NO: 637332 - DNA, 25 bp, Mus musculus
gggctcttatctattcactgacaga

SEQ ID NO: 637333 - DNA, 25 bp, Mus musculus
gggctcttatcttttcactgacaga

SEQ ID NO: 637334 - DNA, 25 bp, Mus musculus
gggctcttcagaacgcgatgtgtgc

SEQ ID NO: 637335 - DNA, 25 bp, Mus musculus
gggctcttcagatcgcgatgtgtgc

SEQ ID NO: 637336 - DNA, 25 bp, Mus musculus
gggctcttcatgactttgtaatacc

SEQ ID NO: 637337 - DNA, 25 bp, Mus musculus
gggctcttcatgtctttgtaatacc

SEQ ID NO: 637338 - DNA, 25 bp, Mus musculus
gggctcttccctcaaggacttggaa

SEQ ID NO: 637339 - DNA, 25 bp, Mus musculus
gggctcttccctgaaggacttggaa

SEQ ID NO: 637340 - DNA, 25 bp, Mus musculus
gggctcttcctgaacagtgtggctt

SEQ ID NO: 637341 - DNA, 25 bp, Mus musculus
gggctcttcctgtacagtgtggctt

SEQ ID NO: 637342 - DNA, 25 bp, Mus musculus
gggctcttctacaaaaagatcgtca

SEQ ID NO: 637343 - DNA, 25 bp, Mus musculus
gggctcttctactaaaagatcgtca

SEQ ID NO: 637344 - DNA, 25 bp, Mus musculus
gggctcttctttcctaacaggttta

SEQ ID NO: 637345 - DNA, 25 bp, Mus musculus
gggctcttctttgctaacaggttta

SEQ ID NO: 637346 - DNA, 25 bp, Mus musculus
gggctcttgagacataccagactga

SEQ ID NO: 637347 - DNA, 25 bp, Mus musculus
gggctcttgagagataccagactga

SEQ ID NO: 637348 - DNA, 25 bp, Mus musculus
gggctcttgcaacatagctgtgctt

SEQ ID NO: 637349 - DNA, 25 bp, Mus musculus
gggctcttgcaagatagctgtgctt

SEQ ID NO: 637350 - DNA, 25 bp, Mus musculus
gggctcttgtcgatcaaagttcctt

SEQ ID NO: 637351 - DNA, 25 bp, Mus musculus
gggctcttgtcgttcaaagttcctt

SEQ ID NO: 637352 - DNA, 25 bp, Mus musculus
gggctctttcaaatactttctccat

SEQ ID NO: 637353 - DNA, 25 bp, Mus musculus
gggctctttcaattactttctccat

SEQ ID NO: 637354 - DNA, 25 bp, Mus musculus
gggctctttcatagtactctgaagt

SEQ ID NO: 637355 - DNA, 25 bp, Mus musculus
gggctctttcattgtactctgaagt

SEQ ID NO: 637356 - DNA, 25 bp, Mus musculus
gggctctttctgatactgcgacact

SEQ ID NO: 637357 - DNA, 25 bp, Mus musculus
gggctctttctgttactgcgacact

SEQ ID NO: 637358 - DNA, 25 bp, Mus musculus
gggctctttgatcttagctgtgtat

SEQ ID NO: 637359 - DNA, 25 bp, Mus musculus
gggctctttgatgttagctgtgtat

SEQ ID NO: 637360 - DNA, 25 bp, Mus musculus
gggctctttgccatcagtgttgtgg

SEQ ID NO: 637361 - DNA, 25 bp, Mus musculus
gggctctttgccttcagtgttgtgg

SEQ ID NO: 637362 - DNA, 25 bp, Mus musculus
gggctctttgggattcccagaagct

SEQ ID NO: 637363 - DNA, 25 bp, Mus musculus
gggctctttgggtttcccagaagct

SEQ ID NO: 637364 - DNA, 25 bp, Mus musculus
gggctctttgtaaatcactcaactg

SEQ ID NO: 637365 - DNA, 25 bp, Mus musculus
gggctctttgtatatcactcaactg

SEQ ID NO: 637366 - DNA, 25 bp, Mus musculus
gggctctttttgatggagctgaaag

SEQ ID NO: 637367 - DNA, 25 bp, Mus musculus
gggctctttttgcatatcctgctgt

SEQ ID NO: 637368 - DNA, 25 bp, Mus musculus
gggctctttttggatatcctgctgt

SEQ ID NO: 637369 - DNA, 25 bp, Mus musculus
gggctctttttgttggagctgaaag

SEQ ID NO: 637370 - DNA, 25 bp, Mus musculus
gggctgaaacggaacactgggcaca

SEQ ID NO: 637371 - DNA, 25 bp, Mus musculus
gggctgaaacggtacactgggcaca

SEQ ID NO: 637372 - DNA, 25 bp, Mus musculus
gggctgaaagcacaggtggcatatg

SEQ ID NO: 637373 - DNA, 25 bp, Mus musculus
gggctgaaagcagaggtggcatatg

SEQ ID NO: 637374 - DNA, 25 bp, Mus musculus
gggctgaaatgaaacctggctaacc

SEQ ID NO: 637375 - DNA, 25 bp, Mus musculus
gggctgaaatgatacctggctaacc

SEQ ID NO: 637376 - DNA, 25 bp, Mus musculus
gggctgaacatgagccgccagtgct

SEQ ID NO: 637377 - DNA, 25 bp, Mus musculus
gggctgaacatgatgtcctgatcgt

SEQ ID NO: 637378 - DNA, 25 bp, Mus musculus
gggctgaacatgtgccgccagtgct

SEQ ID NO: 637379 - DNA, 25 bp, Mus musculus
gggctgaacatgttgtcctgatcgt

SEQ ID NO: 637380 - DNA, 25 bp, Mus musculus
gggctgaaccatcccagctaagagg

SEQ ID NO: 637381 - DNA, 25 bp, Mus musculus
gggctgaaccatgccagctaagagg

SEQ ID NO: 637382 - DNA, 25 bp, Mus musculus
gggctgaaccctcatatgagacagt

SEQ ID NO: 637383 - DNA, 25 bp, Mus musculus
gggctgaaccctgatatgagacagt

SEQ ID NO: 637384 - DNA, 25 bp, Mus musculus
gggctgaactgaatcgtccccacaa

SEQ ID NO: 637385 - DNA, 25 bp, Mus musculus
gggctgaactgattcgtccccacaa

SEQ ID NO: 637386 - DNA, 25 bp, Mus musculus
gggctgaactgtcagcgagccacac

SEQ ID NO: 637387 - DNA, 25 bp, Mus musculus
gggctgaactgtgagcgagccacac

SEQ ID NO: 637388 - DNA, 25 bp, Mus musculus
gggctgaagaatactccaccttcct

SEQ ID NO: 637389 - DNA, 25 bp, Mus musculus
gggctgaagaattctccaccttcct

SEQ ID NO: 637390 - DNA, 25 bp, Mus musculus
gggctgaagaccctttgaactctgt

SEQ ID NO: 637391 - DNA, 25 bp, Mus musculus
gggctgaagaccgtttgaactctgt

SEQ ID NO: 637392 - DNA, 25 bp, Mus musculus
gggctgaagcagcagcattacctaa

SEQ ID NO: 637393 - DNA, 25 bp, Mus musculus
gggctgaagcaggagcattacctaa

SEQ ID NO: 637394 - DNA, 25 bp, Mus musculus
gggctgaaggaactgtgctccattt

SEQ ID NO: 637395 - DNA, 25 bp, Mus musculus
gggctgaaggaagtgtgctccattt

SEQ ID NO: 637396 - DNA, 25 bp, Mus musculus
gggctgaaggccaacaactccaaag

SEQ ID NO: 637397 - DNA, 25 bp, Mus musculus
gggctgaaggcctacaactccaaag

SEQ ID NO: 637398 - DNA, 25 bp, Mus musculus
gggctgaataatcccaaatacaggt

SEQ ID NO: 637399 - DNA, 25 bp, Mus musculus
gggctgaataatctgcacatttgct

SEQ ID NO: 637400 - DNA, 25 bp, Mus musculus
gggctgaataatgccaaatacaggt

SEQ ID NO: 637401 - DNA, 25 bp, Mus musculus
gggctgaataatgtgcacatttgct

SEQ ID NO: 637402 - DNA, 25 bp, Mus musculus
gggctgaatataagggttacaagtg

SEQ ID NO: 637403 - DNA, 25 bp, Mus musculus
gggctgaatatatgggttacaagtg

SEQ ID NO: 637404 - DNA, 25 bp, Mus musculus
gggctgaatattagtaggttcccag

SEQ ID NO: 637405 - DNA, 25 bp, Mus musculus
gggctgaatatttgtaggttcccag

SEQ ID NO: 637406 - DNA, 25 bp, Mus musculus
gggctgaatcctacaggagtattca

SEQ ID NO: 637407 - DNA, 25 bp, Mus musculus
gggctgaatccttcaggagtattca

SEQ ID NO: 637408 - DNA, 25 bp, Mus musculus
gggctgaatctaagattgccgggca

SEQ ID NO: 637409 - DNA, 25 bp, Mus musculus
gggctgaatctatgattgccgggca

SEQ ID NO: 637410 - DNA, 25 bp, Mus musculus
gggctgaattccatacaagcattta

SEQ ID NO: 637411 - DNA, 25 bp, Mus musculus
gggctgaattccttacaagcattta

SEQ ID NO: 637412 - DNA, 25 bp, Mus musculus
gggctgaatttcaaagtccatacct

SEQ ID NO: 637413 - DNA, 25 bp, Mus musculus
gggctgaatttctaagtccatacct

SEQ ID NO: 637414 - DNA, 25 bp, Mus musculus
gggctgacaacgataaagacaaact

SEQ ID NO: 637415 - DNA, 25 bp, Mus musculus
gggctgacaacgttaaagacaaact

SEQ ID NO: 637416 - DNA, 25 bp, Mus musculus
gggctgacagccagaccattgaaga

SEQ ID NO: 637417 - DNA, 25 bp, Mus musculus
gggctgacagcctgaccattgaaga

SEQ ID NO: 637418 - DNA, 25 bp, Mus musculus
gggctgacagttaggcctgcagaca

SEQ ID NO: 637419 - DNA, 25 bp, Mus musculus
gggctgacagtttggcctgcagaca

SEQ ID NO: 637420 - DNA, 25 bp, Mus musculus
gggctgacatccaaggtttagattt

SEQ ID NO: 637421 - DNA, 25 bp, Mus musculus
gggctgacatcctaggtttagattt

SEQ ID NO: 637422 - DNA, 25 bp, Mus musculus
gggctgacatctcctggccgaaaga

SEQ ID NO: 637423 - DNA, 25 bp, Mus musculus
gggctgacatctgctggccgaaaga

SEQ ID NO: 637424 - DNA, 25 bp, Mus musculus
gggctgacatgactaacctctgtta

SEQ ID NO: 637425 - DNA, 25 bp, Mus musculus
gggctgacatgagtaacctctgtta

SEQ ID NO: 637426 - DNA, 25 bp, Mus musculus
gggctgacatgtaggccaaccccag

SEQ ID NO: 637427 - DNA, 25 bp, Mus musculus
gggctgacatgttggccaaccccag

SEQ ID NO: 637428 - DNA, 25 bp, Mus musculus
gggctgaccactcactgatattgta

SEQ ID NO: 637429 - DNA, 25 bp, Mus musculus
gggctgaccactgactgatattgta

SEQ ID NO: 637430 - DNA, 25 bp, Mus musculus
gggctgaccagcctcatcaatcaga

SEQ ID NO: 637431 - DNA, 25 bp, Mus musculus
gggctgaccagcgtcatcaatcaga

SEQ ID NO: 637432 - DNA, 25 bp, Mus musculus
gggctgaccctaaagagaactcttt

SEQ ID NO: 637433 - DNA, 25 bp, Mus musculus
gggctgaccctatagagaactcttt

SEQ ID NO: 637434 - DNA, 25 bp, Mus musculus
gggctgaccctcacagtccatttag

SEQ ID NO: 637435 - DNA, 25 bp, Mus musculus
gggctgaccctctcagtccatttag

SEQ ID NO: 637436 - DNA, 25 bp, Mus musculus
gggctgacctaacagggaaccctca

SEQ ID NO: 637437 - DNA, 25 bp, Mus musculus
gggctgacctaagagggaaccctca

SEQ ID NO: 637438 - DNA, 25 bp, Mus musculus
gggctgacctcacgaccaggctgtt

SEQ ID NO: 637439 - DNA, 25 bp, Mus musculus
gggctgacctcaggaccaggctgtt

SEQ ID NO: 637440 - DNA, 25 bp, Mus musculus
gggctgacctctattcagagatgtc

SEQ ID NO: 637441 - DNA, 25 bp, Mus musculus
gggctgacctcttttcagagatgtc

SEQ ID NO: 637442 - DNA, 25 bp, Mus musculus
gggctgaccttaaaagacctgaatg

SEQ ID NO: 637443 - DNA, 25 bp, Mus musculus
gggctgaccttataagacctgaatg

SEQ ID NO: 637444 - DNA, 25 bp, Mus musculus
gggctgaccttcaaatccacattaa

SEQ ID NO: 637445 - DNA, 25 bp, Mus musculus
gggctgaccttcaccagagttatca

SEQ ID NO: 637446 - DNA, 25 bp, Mus musculus
gggctgaccttctaatccacattaa

SEQ ID NO: 637447 - DNA, 25 bp, Mus musculus
gggctgaccttctccagagttatca

SEQ ID NO: 637448 - DNA, 25 bp, Mus musculus
gggctgaccttgatcatagctgaga

SEQ ID NO: 637449 - DNA, 25 bp, Mus musculus
gggctgaccttgttcatagctgaga

SEQ ID NO: 637450 - DNA, 25 bp, Mus musculus
gggctgacgctgactcagtttaacc

SEQ ID NO: 637451 - DNA, 25 bp, Mus musculus
gggctgacgctgtctcagtttaacc

SEQ ID NO: 637452 - DNA, 25 bp, Mus musculus
gggctgacgtgaacatcaaggacaa

SEQ ID NO: 637453 - DNA, 25 bp, Mus musculus
gggctgacgtgatcatcaaggacaa

SEQ ID NO: 637454 - DNA, 25 bp, Mus musculus
gggctgactcacattaaaggcagtt

SEQ ID NO: 637455 - DNA, 25 bp, Mus musculus
gggctgactcactttaaaggcagtt

SEQ ID NO: 637456 - DNA, 25 bp, Mus musculus
gggctgactgtcattactactcacc

SEQ ID NO: 637457 - DNA, 25 bp, Mus musculus
gggctgactgtctttactactcacc

SEQ ID NO: 637458 - DNA, 25 bp, Mus musculus
gggctgacttctctggcatgacaac

SEQ ID NO: 637459 - DNA, 25 bp, Mus musculus
gggctgacttctgtggcatgacaac

SEQ ID NO: 637460 - DNA, 25 bp, Mus musculus
gggctgactttcaactttgaaacca

SEQ ID NO: 637461 - DNA, 25 bp, Mus musculus
gggctgactttctactttgaaacca

SEQ ID NO: 637462 - DNA, 25 bp, Mus musculus
gggctgagaagcctctcggttaatt

SEQ ID NO: 637463 - DNA, 25 bp, Mus musculus
gggctgagaagcgtctcggttaatt

SEQ ID NO: 637464 - DNA, 25 bp, Mus musculus
gggctgagagatataaccttcttta

SEQ ID NO: 637465 - DNA, 25 bp, Mus musculus
gggctgagagatttaaccttcttta

SEQ ID NO: 637466 - DNA, 25 bp, Mus musculus
gggctgagccggaccaccagttttt

SEQ ID NO: 637467 - DNA, 25 bp, Mus musculus
gggctgagccggtccaccagttttt

SEQ ID NO: 637468 - DNA, 25 bp, Mus musculus
gggctgagcttgagtgattgtctaa

SEQ ID NO: 637469 - DNA, 25 bp, Mus musculus
gggctgagcttgtgtgattgtctaa

SEQ ID NO: 637470 - DNA, 25 bp, Mus musculus
gggctgaggattaaatacatgttca

SEQ ID NO: 637471 - DNA, 25 bp, Mus musculus
gggctgaggatttaatacatgttca

SEQ ID NO: 637472 - DNA, 25 bp, Mus musculus
gggctgaggccgaactgtctgcatc

SEQ ID NO: 637473 - DNA, 25 bp, Mus musculus
gggctgaggccgtactgtctgcatc

SEQ ID NO: 637474 - DNA, 25 bp, Mus musculus
gggctgagtcaccaggattttgaca

SEQ ID NO: 637475 - DNA, 25 bp, Mus musculus
gggctgagtcacgaggattttgaca

SEQ ID NO: 637476 - DNA, 25 bp, Mus musculus
gggctgagtctaacacgtctgttcc

SEQ ID NO: 637477 - DNA, 25 bp, Mus musculus
gggctgagtctatcacgtctgttcc

SEQ ID NO: 637478 - DNA, 25 bp, Mus musculus
gggctgataagacaaccctgtctca

SEQ ID NO: 637479 - DNA, 25 bp, Mus musculus
gggctgataagagaaccctgtctca

SEQ ID NO: 637480 - DNA, 25 bp, Mus musculus
gggctgatagagatatcctttacaa

SEQ ID NO: 637481 - DNA, 25 bp, Mus musculus
gggctgatagagttatcctttacaa

SEQ ID NO: 637482 - DNA, 25 bp, Mus musculus
gggctgatagctataatacaacact

SEQ ID NO: 637483 - DNA, 25 bp, Mus musculus
gggctgatagctttaatacaacact

SEQ ID NO: 637484 - DNA, 25 bp, Mus musculus
gggctgatatggaaccttctagaag

SEQ ID NO: 637485 - DNA, 25 bp, Mus musculus
gggctgatatggtaccttctagaag

SEQ ID NO: 637486 - DNA, 25 bp, Mus musculus
gggctgatcattagtctagacctct

SEQ ID NO: 637487 - DNA, 25 bp, Mus musculus
gggctgatcatttgtctagacctct

SEQ ID NO: 637488 - DNA, 25 bp, Mus musculus
gggctgatccaaaccacagcagtat

SEQ ID NO: 637489 - DNA, 25 bp, Mus musculus
gggctgatccaatccacagcagtat

SEQ ID NO: 637490 - DNA, 25 bp, Mus musculus
gggctgatccacacgcaggaaacat

SEQ ID NO: 637491 - DNA, 25 bp, Mus musculus
gggctgatccactcgcaggaaacat

SEQ ID NO: 637492 - DNA, 25 bp, Mus musculus
gggctgatccagagtaagctacctt

SEQ ID NO: 637493 - DNA, 25 bp, Mus musculus
gggctgatccagtgtaagctacctt

SEQ ID NO: 637494 - DNA, 25 bp, Mus musculus
gggctgatcctgcttccaagttcca

SEQ ID NO: 637495 - DNA, 25 bp, Mus musculus
gggctgatcctggttccaagttcca

SEQ ID NO: 637496 - DNA, 25 bp, Mus musculus
gggctgatcgcaatctttgtgtcca

SEQ ID NO: 637497 - DNA, 25 bp, Mus musculus
gggctgatcgcattctttgtgtcca

SEQ ID NO: 637498 - DNA, 25 bp, Mus musculus
gggctgatgacaatttctggtcatt

SEQ ID NO: 637499 - DNA, 25 bp, Mus musculus
gggctgatgacactgggcatcctaa

SEQ ID NO: 637500 - DNA, 25 bp, Mus musculus
gggctgatgacagtgggcatcctaa

SEQ ID NO: 637501 - DNA, 25 bp, Mus musculus
gggctgatgacattttctggtcatt

SEQ ID NO: 637502 - DNA, 25 bp, Mus musculus
gggctgatgacgatagctcccaatc

SEQ ID NO: 637503 - DNA, 25 bp, Mus musculus
gggctgatgacgttagctcccaatc

SEQ ID NO: 637504 - DNA, 25 bp, Mus musculus
gggctgatgtgcctttagcaagcat

SEQ ID NO: 637505 - DNA, 25 bp, Mus musculus
gggctgatgtgcgtttagcaagcat

SEQ ID NO: 637506 - DNA, 25 bp, Mus musculus
gggctgatgtggcaccttgcaaata

SEQ ID NO: 637507 - DNA, 25 bp, Mus musculus
gggctgatgtgggaccttgcaaata

SEQ ID NO: 637508 - DNA, 25 bp, Mus musculus
gggctgatgtgtacctcaaaaatta

SEQ ID NO: 637509 - DNA, 25 bp, Mus musculus
gggctgatgtgttcctcaaaaatta

SEQ ID NO: 637510 - DNA, 25 bp, Mus musculus
gggctgatgttgaggacgtggcagt

SEQ ID NO: 637511 - DNA, 25 bp, Mus musculus
gggctgatgttgtggacgtggcagt

SEQ ID NO: 637512 - DNA, 25 bp, Mus musculus
gggctgattcttacttactgtcttt

SEQ ID NO: 637513 - DNA, 25 bp, Mus musculus
gggctgattctttcttactgtcttt

SEQ ID NO: 637514 - DNA, 25 bp, Mus musculus
gggctgattttcacttctaagaacc

SEQ ID NO: 637515 - DNA, 25 bp, Mus musculus
gggctgattttctcttctaagaacc

SEQ ID NO: 637516 - DNA, 25 bp, Mus musculus
gggctgattttgactagctggttca

SEQ ID NO: 637517 - DNA, 25 bp, Mus musculus
gggctgattttgtctagctggttca

SEQ ID NO: 637518 - DNA, 25 bp, Mus musculus
gggctgcaagacacacaaggaagaa

SEQ ID NO: 637519 - DNA, 25 bp, Mus musculus
gggctgcaagactcacaaggaagaa

SEQ ID NO: 637520 - DNA, 25 bp, Mus musculus
gggctgcaattaacagacttgagtt

SEQ ID NO: 637521 - DNA, 25 bp, Mus musculus
gggctgcaattatcagacttgagtt

SEQ ID NO: 637522 - DNA, 25 bp, Mus musculus
gggctgcacacaactaatgggtgtt

SEQ ID NO: 637523 - DNA, 25 bp, Mus musculus
gggctgcacacatctaatgggtgtt

SEQ ID NO: 637524 - DNA, 25 bp, Mus musculus
gggctgcacaggaaagctcttcttt

SEQ ID NO: 637525 - DNA, 25 bp, Mus musculus
gggctgcacaggtaagctcttcttt

SEQ ID NO: 637526 - DNA, 25 bp, Mus musculus
gggctgcacagtaaggctctgtttc

SEQ ID NO: 637527 - DNA, 25 bp, Mus musculus
gggctgcacagttaggctctgtttc

SEQ ID NO: 637528 - DNA, 25 bp, Mus musculus
gggctgcaccacatcatggctgaaa

SEQ ID NO: 637529 - DNA, 25 bp, Mus musculus
gggctgcaccacttcatggctgaaa

SEQ ID NO: 637530 - DNA, 25 bp, Mus musculus
gggctgcacctgactggagacctgc

SEQ ID NO: 637531 - DNA, 25 bp, Mus musculus
gggctgcacctgtctggagacctgc

SEQ ID NO: 637532 - DNA, 25 bp, Mus musculus
gggctgcacgataaatgagtttctc

SEQ ID NO: 637533 - DNA, 25 bp, Mus musculus
gggctgcacgattaatgagtttctc

SEQ ID NO: 637534 - DNA, 25 bp, Mus musculus
gggctgcacgctcctcaaagcacag

SEQ ID NO: 637535 - DNA, 25 bp, Mus musculus
gggctgcacgctgctcaaagcacag

SEQ ID NO: 637536 - DNA, 25 bp, Mus musculus
gggctgcagaaaagcgccctgctga

SEQ ID NO: 637537 - DNA, 25 bp, Mus musculus
gggctgcagaaatgcgccctgctga

SEQ ID NO: 637538 - DNA, 25 bp, Mus musculus
gggctgcaggatccacatctagcgg

SEQ ID NO: 637539 - DNA, 25 bp, Mus musculus
gggctgcaggatgcacatctagcgg

SEQ ID NO: 637540 - DNA, 25 bp, Mus musculus
gggctgcaggtacccctggagttgg

SEQ ID NO: 637541 - DNA, 25 bp, Mus musculus
gggctgcaggtagccctggagttgg

SEQ ID NO: 637542 - DNA, 25 bp, Mus musculus
gggctgcagtaacaattcatgatta

SEQ ID NO: 637543 - DNA, 25 bp, Mus musculus
gggctgcagtaagaattcatgatta

SEQ ID NO: 637544 - DNA, 25 bp, Mus musculus
gggctgcagtgaacaaccgctacaa

SEQ ID NO: 637545 - DNA, 25 bp, Mus musculus
gggctgcagtgatcaaccgctacaa

SEQ ID NO: 637546 - DNA, 25 bp, Mus musculus
gggctgcagtgcaaacggcaaacat

SEQ ID NO: 637547 - DNA, 25 bp, Mus musculus
gggctgcagtgctaacggcaaacat

SEQ ID NO: 637548 - DNA, 25 bp, Mus musculus
gggctgcagttactacacgtgtttt

SEQ ID NO: 637549 - DNA, 25 bp, Mus musculus
gggctgcagttagtacacgtgtttt

SEQ ID NO: 637550 - DNA, 25 bp, Mus musculus
gggctgcatactatagggttaacta

SEQ ID NO: 637551 - DNA, 25 bp, Mus musculus
gggctgcatactttagggttaacta

SEQ ID NO: 637552 - DNA, 25 bp, Mus musculus
gggctgcatgacaatctgctgacta

SEQ ID NO: 637553 - DNA, 25 bp, Mus musculus
gggctgcatgactatctgctgacta

SEQ ID NO: 637554 - DNA, 25 bp, Mus musculus
gggctgcattagactcggaactgtt

SEQ ID NO: 637555 - DNA, 25 bp, Mus musculus
gggctgcattagtctcggaactgtt

SEQ ID NO: 637556 - DNA, 25 bp, Mus musculus
gggctgcattctcctgttggttaaa

SEQ ID NO: 637557 - DNA, 25 bp, Mus musculus
gggctgcattctgctgttggttaaa

SEQ ID NO: 637558 - DNA, 25 bp, Mus musculus
gggctgcatttcagctcacaggaga

SEQ ID NO: 637559 - DNA, 25 bp, Mus musculus
gggctgcatttctgctcacaggaga

SEQ ID NO: 637560 - DNA, 25 bp, Mus musculus
gggctgccaaggactgctcagtctg

SEQ ID NO: 637561 - DNA, 25 bp, Mus musculus
gggctgccaaggtctgctcagtctg

SEQ ID NO: 637562 - DNA, 25 bp, Mus musculus
gggctgccaagtatgtctgaccaag

SEQ ID NO: 637563 - DNA, 25 bp, Mus musculus
gggctgccaagtttgtctgaccaag

SEQ ID NO: 637564 - DNA, 25 bp, Mus musculus
gggctgccactgaaggaaactggac

SEQ ID NO: 637565 - DNA, 25 bp, Mus musculus
gggctgccactgtaggaaactggac

SEQ ID NO: 637566 - DNA, 25 bp, Mus musculus
gggctgccagccaaatagcctggat

SEQ ID NO: 637567 - DNA, 25 bp, Mus musculus
gggctgccagcctaatagcctggat

SEQ ID NO: 637568 - DNA, 25 bp, Mus musculus
gggctgccatttccagtggcaaagt

SEQ ID NO: 637569 - DNA, 25 bp, Mus musculus
gggctgccatttgcagtggcaaagt

SEQ ID NO: 637570 - DNA, 25 bp, Mus musculus
gggctgcccacgcacaagatcgatg

SEQ ID NO: 637571 - DNA, 25 bp, Mus musculus
gggctgcccacggacaagatcgatg

SEQ ID NO: 637572 - DNA, 25 bp, Mus musculus
gggctgcccatcaggtccgcgggct

SEQ ID NO: 637573 - DNA, 25 bp, Mus musculus
gggctgcccatctggtccgcgggct

SEQ ID NO: 637574 - DNA, 25 bp, Mus musculus
gggctgccggacactttctgcaaac

SEQ ID NO: 637575 - DNA, 25 bp, Mus musculus
gggctgccggactctttctgcaaac

SEQ ID NO: 637576 - DNA, 25 bp, Mus musculus
gggctgcctatgctctgaaggcttt

SEQ ID NO: 637577 - DNA, 25 bp, Mus musculus
gggctgcctatggtctgaaggcttt

SEQ ID NO: 637578 - DNA, 25 bp, Mus musculus
gggctgcctattcctgccaggatac

SEQ ID NO: 637579 - DNA, 25 bp, Mus musculus
gggctgcctattgctgccaggatac

SEQ ID NO: 637580 - DNA, 25 bp, Mus musculus
gggctgcctcagatatgagcctgca

SEQ ID NO: 637581 - DNA, 25 bp, Mus musculus
gggctgcctcagttatgagcctgca

SEQ ID NO: 637582 - DNA, 25 bp, Mus musculus
gggctgcctcttccatgtattaatt

SEQ ID NO: 637583 - DNA, 25 bp, Mus musculus
gggctgcctcttgcatgtattaatt

SEQ ID NO: 637584 - DNA, 25 bp, Mus musculus
gggctgcctgcaagaaagctatgct

SEQ ID NO: 637585 - DNA, 25 bp, Mus musculus
gggctgcctgcatgaaagctatgct

SEQ ID NO: 637586 - DNA, 25 bp, Mus musculus
gggctgcctgttcaagcttttgatg

SEQ ID NO: 637587 - DNA, 25 bp, Mus musculus
gggctgcctgttgaagcttttgatg

SEQ ID NO: 637588 - DNA, 25 bp, Mus musculus
gggctgccttgcatgagcctttatc

SEQ ID NO: 637589 - DNA, 25 bp, Mus musculus
gggctgccttgcttgagcctttatc

SEQ ID NO: 637590 - DNA, 25 bp, Mus musculus
gggctgcgaggcaagagaaaccact

SEQ ID NO: 637591 - DNA, 25 bp, Mus musculus
gggctgcgaggctagagaaaccact

SEQ ID NO: 637592 - DNA, 25 bp, Mus musculus
gggctgcggccgagacttcaagcta

SEQ ID NO: 637593 - DNA, 25 bp, Mus musculus
gggctgcggccgtgacttcaagcta

SEQ ID NO: 637594 - DNA, 25 bp, Mus musculus
gggctgcgggtcattgacaaagaaa

SEQ ID NO: 637595 - DNA, 25 bp, Mus musculus
gggctgcgggtctttgacaaagaaa

SEQ ID NO: 637596 - DNA, 25 bp, Mus musculus
gggctgcgtaggaacattagctttt

SEQ ID NO: 637597 - DNA, 25 bp, Mus musculus
gggctgcgtaggtacattagctttt

SEQ ID NO: 637598 - DNA, 25 bp, Mus musculus
gggctgcgtcacagcaactgattat

SEQ ID NO: 637599 - DNA, 25 bp, Mus musculus
gggctgcgtcactgcaactgattat

SEQ ID NO: 637600 - DNA, 25 bp, Mus musculus
gggctgcgttcaattcaattagagg

SEQ ID NO: 637601 - DNA, 25 bp, Mus musculus
gggctgcgttcatttcaattagagg

SEQ ID NO: 637602 - DNA, 25 bp, Mus musculus
gggctgcgttgtctgaaatctgtta

SEQ ID NO: 637603 - DNA, 25 bp, Mus musculus
gggctgcgttgtgtgaaatctgtta

SEQ ID NO: 637604 - DNA, 25 bp, Mus musculus
gggctgctcaacagtggcatttatg

SEQ ID NO: 637605 - DNA, 25 bp, Mus musculus
gggctgctcaactgtggcatttatg

SEQ ID NO: 637606 - DNA, 25 bp, Mus musculus
gggctgctcacgctatttcctctgg

SEQ ID NO: 637607 - DNA, 25 bp, Mus musculus
gggctgctcacggtatttcctctgg

SEQ ID NO: 637608 - DNA, 25 bp, Mus musculus
gggctgctcactcaaattattttca

SEQ ID NO: 637609 - DNA, 25 bp, Mus musculus
gggctgctcactgaaattattttca

SEQ ID NO: 637610 - DNA, 25 bp, Mus musculus
gggctgctccaacaactagcacagt

SEQ ID NO: 637611 - DNA, 25 bp, Mus musculus
gggctgctccaagaactagcacagt

SEQ ID NO: 637612 - DNA, 25 bp, Mus musculus
gggctgctcccaaaatgtacctgtt

SEQ ID NO: 637613 - DNA, 25 bp, Mus musculus
gggctgctcccataatgtacctgtt

SEQ ID NO: 637614 - DNA, 25 bp, Mus musculus
gggctgctccgaagcactggataat

SEQ ID NO: 637615 - DNA, 25 bp, Mus musculus
gggctgctccgatgcactggataat

SEQ ID NO: 637616 - DNA, 25 bp, Mus musculus
gggctgctccttaatacaaatgtag

SEQ ID NO: 637617 - DNA, 25 bp, Mus musculus
gggctgctcctttatacaaatgtag

SEQ ID NO: 637618 - DNA, 25 bp, Mus musculus
gggctgctctaccatgtgaaataga

SEQ ID NO: 637619 - DNA, 25 bp, Mus musculus
gggctgctctacgatgtgaaataga

SEQ ID NO: 637620 - DNA, 25 bp, Mus musculus
gggctgctctcaagtactataagga

SEQ ID NO: 637621 - DNA, 25 bp, Mus musculus
gggctgctctcatgtactataagga

SEQ ID NO: 637622 - DNA, 25 bp, Mus musculus
gggctgctcttcaaccataaacaga

SEQ ID NO: 637623 - DNA, 25 bp, Mus musculus
gggctgctcttctaccataaacaga

SEQ ID NO: 637624 - DNA, 25 bp, Mus musculus
gggctgctgagcacctcttccgagc

SEQ ID NO: 637625 - DNA, 25 bp, Mus musculus
gggctgctgagctcctcttccgagc

SEQ ID NO: 637626 - DNA, 25 bp, Mus musculus
gggctgctgagtacgataacttctt

SEQ ID NO: 637627 - DNA, 25 bp, Mus musculus
gggctgctgagttcgataacttctt

SEQ ID NO: 637628 - DNA, 25 bp, Mus musculus
gggctgctgcatctacaggtaagca

SEQ ID NO: 637629 - DNA, 25 bp, Mus musculus
gggctgctgcatgtacaggtaagca

SEQ ID NO: 637630 - DNA, 25 bp, Mus musculus
gggctgctgctaacttgcatcctga

SEQ ID NO: 637631 - DNA, 25 bp, Mus musculus
gggctgctgctatcttgcatcctga

SEQ ID NO: 637632 - DNA, 25 bp, Mus musculus
gggctgctgcttctgactgttagac

SEQ ID NO: 637633 - DNA, 25 bp, Mus musculus
gggctgctgcttgtgactgttagac

SEQ ID NO: 637634 - DNA, 25 bp, Mus musculus
gggctgctggtaacccagaacccaa

SEQ ID NO: 637635 - DNA, 25 bp, Mus musculus
gggctgctggtatcccagaacccaa

SEQ ID NO: 637636 - DNA, 25 bp, Mus musculus
gggctgctggtccaacaggcaaaaa

SEQ ID NO: 637637 - DNA, 25 bp, Mus musculus
gggctgctggtcgaacaggcaaaaa

SEQ ID NO: 637638 - DNA, 25 bp, Mus musculus
gggctgctgtaaacgggctattctg

SEQ ID NO: 637639 - DNA, 25 bp, Mus musculus
gggctgctgtaatcgggctattctg

SEQ ID NO: 637640 - DNA, 25 bp, Mus musculus
gggctgcttactcggatttgtgttt

SEQ ID NO: 637641 - DNA, 25 bp, Mus musculus
gggctgcttactgggatttgtgttt

SEQ ID NO: 637642 - DNA, 25 bp, Mus musculus
gggctgcttcagactttaatatcca

SEQ ID NO: 637643 - DNA, 25 bp, Mus musculus
gggctgcttcagtctttaatatcca

SEQ ID NO: 637644 - DNA, 25 bp, Mus musculus
gggctgcttctaattccaaagtttt

SEQ ID NO: 637645 - DNA, 25 bp, Mus musculus
gggctgcttctatttccaaagtttt

SEQ ID NO: 637646 - DNA, 25 bp, Mus musculus
gggctgcttggcattgtgctataga

SEQ ID NO: 637647 - DNA, 25 bp, Mus musculus
gggctgcttggctttgtgctataga

SEQ ID NO: 637648 - DNA, 25 bp, Mus musculus
gggctgcttgtgatctctgtctttc

SEQ ID NO: 637649 - DNA, 25 bp, Mus musculus
gggctgcttgtgttctctgtctttc

SEQ ID NO: 637650 - DNA, 25 bp, Mus musculus
gggctgctttcgaggccaaggtgat

SEQ ID NO: 637651 - DNA, 25 bp, Mus musculus
gggctgctttcgtggccaaggtgat

SEQ ID NO: 637652 - DNA, 25 bp, Mus musculus
gggctgctttctcagtccaagggcc

SEQ ID NO: 637653 - DNA, 25 bp, Mus musculus
gggctgctttctgagtccaagggcc

SEQ ID NO: 637654 - DNA, 25 bp, Mus musculus
gggctgcttttcaccgcaggaggaa

SEQ ID NO: 637655 - DNA, 25 bp, Mus musculus
gggctgcttttctccgcaggaggaa

SEQ ID NO: 637656 - DNA, 25 bp, Mus musculus
gggctggaaagactcatttgcttat

SEQ ID NO: 637657 - DNA, 25 bp, Mus musculus
gggctggaaagagtcatttgcttat

SEQ ID NO: 637658 - DNA, 25 bp, Mus musculus
gggctggaaccgaagacatcaacag

SEQ ID NO: 637659 - DNA, 25 bp, Mus musculus
gggctggaaccgtagacatcaacag

SEQ ID NO: 637660 - DNA, 25 bp, Mus musculus
gggctggacatcatactataataaa

SEQ ID NO: 637661 - DNA, 25 bp, Mus musculus
gggctggacatcttactataataaa

SEQ ID NO: 637662 - DNA, 25 bp, Mus musculus
gggctggaccatcagcttgccttct

SEQ ID NO: 637663 - DNA, 25 bp, Mus musculus
gggctggaccatgagcttgccttct

SEQ ID NO: 637664 - DNA, 25 bp, Mus musculus
gggctggacctactagcatctctac

SEQ ID NO: 637665 - DNA, 25 bp, Mus musculus
gggctggacctagtagcatctctac

SEQ ID NO: 637666 - DNA, 25 bp, Mus musculus
gggctggacgatcccattaaccctt

SEQ ID NO: 637667 - DNA, 25 bp, Mus musculus
gggctggacgatgccattaaccctt

SEQ ID NO: 637668 - DNA, 25 bp, Mus musculus
gggctggacggtacattatggcaaa

SEQ ID NO: 637669 - DNA, 25 bp, Mus musculus
gggctggacggttcattatggcaaa

SEQ ID NO: 637670 - DNA, 25 bp, Mus musculus
gggctggactccacaaggttcatat

SEQ ID NO: 637671 - DNA, 25 bp, Mus musculus
gggctggactcctcaaggttcatat

SEQ ID NO: 637672 - DNA, 25 bp, Mus musculus
gggctggactgcaacacatttcggg

SEQ ID NO: 637673 - DNA, 25 bp, Mus musculus
gggctggactgctacacatttcggg

SEQ ID NO: 637674 - DNA, 25 bp, Mus musculus
gggctggagacaaagttctgtttac

SEQ ID NO: 637675 - DNA, 25 bp, Mus musculus
gggctggagacatagttctgtttac

SEQ ID NO: 637676 - DNA, 25 bp, Mus musculus
gggctggagtggacctcctcactgc

SEQ ID NO: 637677 - DNA, 25 bp, Mus musculus
gggctggagtggtcctcctcactgc

SEQ ID NO: 637678 - DNA, 25 bp, Mus musculus
gggctggataaccatgtgatgcaca

SEQ ID NO: 637679 - DNA, 25 bp, Mus musculus
gggctggataacgatgtgatgcaca

SEQ ID NO: 637680 - DNA, 25 bp, Mus musculus
gggctggatccgcatgcagaaccaa

SEQ ID NO: 637681 - DNA, 25 bp, Mus musculus
gggctggatccggatgcagaaccaa

SEQ ID NO: 637682 - DNA, 25 bp, Mus musculus
gggctggatgatccttcactggaaa

SEQ ID NO: 637683 - DNA, 25 bp, Mus musculus
gggctggatgatgcttcactggaaa

SEQ ID NO: 637684 - DNA, 25 bp, Mus musculus
gggctggatgtcagtactcaccttt

SEQ ID NO: 637685 - DNA, 25 bp, Mus musculus
gggctggatgtctgtactcaccttt

SEQ ID NO: 637686 - DNA, 25 bp, Mus musculus
gggctggcaaaactcctcaggattc

SEQ ID NO: 637687 - DNA, 25 bp, Mus musculus
gggctggcaaaagtcctcaggattc

SEQ ID NO: 637688 - DNA, 25 bp, Mus musculus
gggctggcaagaacattcagcatga

SEQ ID NO: 637689 - DNA, 25 bp, Mus musculus
gggctggcaagatcattcagcatga

SEQ ID NO: 637690 - DNA, 25 bp, Mus musculus
gggctggcaataacctgtgaactta

SEQ ID NO: 637691 - DNA, 25 bp, Mus musculus
gggctggcaatatcctgtgaactta

SEQ ID NO: 637692 - DNA, 25 bp, Mus musculus
gggctggcacagacaaggattccca

SEQ ID NO: 637693 - DNA, 25 bp, Mus musculus
gggctggcacagtcaaggattccca

SEQ ID NO: 637694 - DNA, 25 bp, Mus musculus
gggctggcattaactatttaccgct

SEQ ID NO: 637695 - DNA, 25 bp, Mus musculus
gggctggcattatctatttaccgct

SEQ ID NO: 637696 - DNA, 25 bp, Mus musculus
gggctggccaaaacatcaccactac

SEQ ID NO: 637697 - DNA, 25 bp, Mus musculus
gggctggccaaatcatcaccactac

SEQ ID NO: 637698 - DNA, 25 bp, Mus musculus
gggctggccagtatctcatgcatgc

SEQ ID NO: 637699 - DNA, 25 bp, Mus musculus
gggctggccagtttctcatgcatgc

SEQ ID NO: 637700 - DNA, 25 bp, Mus musculus
gggctggcccagaggagtaactcca

SEQ ID NO: 637701 - DNA, 25 bp, Mus musculus
gggctggcccagtggagtaactcca

SEQ ID NO: 637702 - DNA, 25 bp, Mus musculus
gggctggccccaaccggaatggatc

SEQ ID NO: 637703 - DNA, 25 bp, Mus musculus
gggctggccccatccggaatggatc

SEQ ID NO: 637704 - DNA, 25 bp, Mus musculus
gggctggcccttcgattcaggcaca

SEQ ID NO: 637705 - DNA, 25 bp, Mus musculus
gggctggcccttggattcaggcaca

SEQ ID NO: 637706 - DNA, 25 bp, Mus musculus
gggctggcgatcactcatgctggat

SEQ ID NO: 637707 - DNA, 25 bp, Mus musculus
gggctggcgatctctcatgctggat

SEQ ID NO: 637708 - DNA, 25 bp, Mus musculus
gggctggcgcctattccaaatccta

SEQ ID NO: 637709 - DNA, 25 bp, Mus musculus
gggctggcgccttttccaaatccta

SEQ ID NO: 637710 - DNA, 25 bp, Mus musculus
gggctggcgtttataatccagctaa

SEQ ID NO: 637711 - DNA, 25 bp, Mus musculus
gggctggcgtttttaatccagctaa

SEQ ID NO: 637712 - DNA, 25 bp, Mus musculus
gggctggctattactcctcagctgt

SEQ ID NO: 637713 - DNA, 25 bp, Mus musculus
gggctggctatttctcctcagctgt

SEQ ID NO: 637714 - DNA, 25 bp, Mus musculus
gggctggctgagaggatcaatttta

SEQ ID NO: 637715 - DNA, 25 bp, Mus musculus
gggctggctgagtggatcaatttta

SEQ ID NO: 637716 - DNA, 25 bp, Mus musculus
gggctggctgatccaatttgttctg

SEQ ID NO: 637717 - DNA, 25 bp, Mus musculus
gggctggctgatgcaatttgttctg

SEQ ID NO: 637718 - DNA, 25 bp, Mus musculus
gggctggctgcaattcccagggcca

SEQ ID NO: 637719 - DNA, 25 bp, Mus musculus
gggctggctgcatttcccagggcca

SEQ ID NO: 637720 - DNA, 25 bp, Mus musculus
gggctggcttggctgatattcatca

SEQ ID NO: 637721 - DNA, 25 bp, Mus musculus
gggctggcttgggtgatattcatca

SEQ ID NO: 637722 - DNA, 25 bp, Mus musculus
gggctggcttttcggtacaaactga

SEQ ID NO: 637723 - DNA, 25 bp, Mus musculus
gggctggcttttgggtacaaactga

SEQ ID NO: 637724 - DNA, 25 bp, Mus musculus
gggctgggaaagcattctctgtcct

SEQ ID NO: 637725 - DNA, 25 bp, Mus musculus
gggctgggaaaggattctctgtcct

SEQ ID NO: 637726 - DNA, 25 bp, Mus musculus
gggctgggagcaacatttcatttag

SEQ ID NO: 637727 - DNA, 25 bp, Mus musculus
gggctgggagcatcatttcatttag

SEQ ID NO: 637728 - DNA, 25 bp, Mus musculus
gggctgggatacaaatacttctctt

SEQ ID NO: 637729 - DNA, 25 bp, Mus musculus
gggctgggatactaatacttctctt

SEQ ID NO: 637730 - DNA, 25 bp, Mus musculus
gggctgggatagaccactcttggtc

SEQ ID NO: 637731 - DNA, 25 bp, Mus musculus
gggctgggatagtccactcttggtc

SEQ ID NO: 637732 - DNA, 25 bp, Mus musculus
gggctgggattgactatcacctttc

SEQ ID NO: 637733 - DNA, 25 bp, Mus musculus
gggctgggattgtctatcacctttc

SEQ ID NO: 637734 - DNA, 25 bp, Mus musculus
gggctgggcaatcaactttggcact

SEQ ID NO: 637735 - DNA, 25 bp, Mus musculus
gggctgggcaatgaactttggcact

SEQ ID NO: 637736 - DNA, 25 bp, Mus musculus
gggctgggcgccagtattatacttt

SEQ ID NO: 637737 - DNA, 25 bp, Mus musculus
gggctgggcgcctgtattatacttt

SEQ ID NO: 637738 - DNA, 25 bp, Mus musculus
gggctgggctctactctttttgtcc

SEQ ID NO: 637739 - DNA, 25 bp, Mus musculus
gggctgggctcttctctttttgtcc

SEQ ID NO: 637740 - DNA, 25 bp, Mus musculus
gggctgggtacaagtgccaagcctc

SEQ ID NO: 637741 - DNA, 25 bp, Mus musculus
gggctgggtacatgtgccaagcctc

SEQ ID NO: 637742 - DNA, 25 bp, Mus musculus
gggctgggtgagcaatatctatctt

SEQ ID NO: 637743 - DNA, 25 bp, Mus musculus
gggctgggtgaggaatatctatctt

SEQ ID NO: 637744 - DNA, 25 bp, Mus musculus
gggctgggtgccagagctccctaac

SEQ ID NO: 637745 - DNA, 25 bp, Mus musculus
gggctgggtgcctgagctccctaac

SEQ ID NO: 637746 - DNA, 25 bp, Mus musculus
gggctgggttctagcccacaccaag

SEQ ID NO: 637747 - DNA, 25 bp, Mus musculus
gggctgggttcttgcccacaccaag

SEQ ID NO: 637748 - DNA, 25 bp, Mus musculus
gggctggtacaaaccttgtagccac

SEQ ID NO: 637749 - DNA, 25 bp, Mus musculus
gggctggtacaatccttgtagccac

SEQ ID NO: 637750 - DNA, 25 bp, Mus musculus
gggctggtactcaaacacacacctg

SEQ ID NO: 637751 - DNA, 25 bp, Mus musculus
gggctggtactctaacacacacctg

SEQ ID NO: 637752 - DNA, 25 bp, Mus musculus
gggctggtagctattgtagaattga

SEQ ID NO: 637753 - DNA, 25 bp, Mus musculus
gggctggtagcttttgtagaattga

SEQ ID NO: 637754 - DNA, 25 bp, Mus musculus
gggctggtatgcaccccaaaagatc

SEQ ID NO: 637755 - DNA, 25 bp, Mus musculus
gggctggtatgctccccaaaagatc

SEQ ID NO: 637756 - DNA, 25 bp, Mus musculus
gggctggtcatgaggaatgctttaa

SEQ ID NO: 637757 - DNA, 25 bp, Mus musculus
gggctggtcatgtggaatgctttaa

SEQ ID NO: 637758 - DNA, 25 bp, Mus musculus
gggctggtcattaactaagcaccta

SEQ ID NO: 637759 - DNA, 25 bp, Mus musculus
gggctggtcattcctttaggtactt

SEQ ID NO: 637760 - DNA, 25 bp, Mus musculus
gggctggtcattgctttaggtactt

SEQ ID NO: 637761 - DNA, 25 bp, Mus musculus
gggctggtcatttactaagcaccta

SEQ ID NO: 637762 - DNA, 25 bp, Mus musculus
gggctggtcccacagatatgtgaaa

SEQ ID NO: 637763 - DNA, 25 bp, Mus musculus
gggctggtcccagagatatgtgaaa

SEQ ID NO: 637764 - DNA, 25 bp, Mus musculus
gggctggtccccagctttttgcgaa

SEQ ID NO: 637765 - DNA, 25 bp, Mus musculus
gggctggtcccctgctttttgcgaa

SEQ ID NO: 637766 - DNA, 25 bp, Mus musculus
gggctggtctggaagccaccccact

SEQ ID NO: 637767 - DNA, 25 bp, Mus musculus
gggctggtctggcatatctaataag

SEQ ID NO: 637768 - DNA, 25 bp, Mus musculus
gggctggtctgggatatctaataag

SEQ ID NO: 637769 - DNA, 25 bp, Mus musculus
gggctggtctggtagccaccccact

SEQ ID NO: 637770 - DNA, 25 bp, Mus musculus
gggctggtgatcagatattcctaac

SEQ ID NO: 637771 - DNA, 25 bp, Mus musculus
gggctggtgatctgatattcctaac

SEQ ID NO: 637772 - DNA, 25 bp, Mus musculus
gggctggtgctgattctaatgagat

SEQ ID NO: 637773 - DNA, 25 bp, Mus musculus
gggctggtgctgtttctaatgagat

SEQ ID NO: 637774 - DNA, 25 bp, Mus musculus
gggctggtgtccaatccgtttgaca

SEQ ID NO: 637775 - DNA, 25 bp, Mus musculus
gggctggtgtcctatccgtttgaca

SEQ ID NO: 637776 - DNA, 25 bp, Mus musculus
gggctggtgttgacccctggatccc

SEQ ID NO: 637777 - DNA, 25 bp, Mus musculus
gggctggtgttgtcccctggatccc

SEQ ID NO: 637778 - DNA, 25 bp, Mus musculus
gggctggttttgcactcagagctct

SEQ ID NO: 637779 - DNA, 25 bp, Mus musculus
gggctggttttggactcagagctct

SEQ ID NO: 637780 - DNA, 25 bp, Mus musculus
gggctgtaaaagcaggccactccag

SEQ ID NO: 637781 - DNA, 25 bp, Mus musculus
gggctgtaaaaggaggccactccag

SEQ ID NO: 637782 - DNA, 25 bp, Mus musculus
gggctgtaaattactgggctatcat

SEQ ID NO: 637783 - DNA, 25 bp, Mus musculus
gggctgtaaatttctgggctatcat

SEQ ID NO: 637784 - DNA, 25 bp, Mus musculus
gggctgtaacggctctcagcagata

SEQ ID NO: 637785 - DNA, 25 bp, Mus musculus
gggctgtaacgggtctcagcagata

SEQ ID NO: 637786 - DNA, 25 bp, Mus musculus
gggctgtaactaagtggccactcag

SEQ ID NO: 637787 - DNA, 25 bp, Mus musculus
gggctgtaactatgtggccactcag

SEQ ID NO: 637788 - DNA, 25 bp, Mus musculus
gggctgtaatgcatggaaactcact

SEQ ID NO: 637789 - DNA, 25 bp, Mus musculus
gggctgtaatgcttggaaactcact

SEQ ID NO: 637790 - DNA, 25 bp, Mus musculus
gggctgtacagacgcatgacaccca

SEQ ID NO: 637791 - DNA, 25 bp, Mus musculus
gggctgtacagaggcatgacaccca

SEQ ID NO: 637792 - DNA, 25 bp, Mus musculus
gggctgtagaatatcattaccctaa

SEQ ID NO: 637793 - DNA, 25 bp, Mus musculus
gggctgtagaatccacatcccaggc

SEQ ID NO: 637794 - DNA, 25 bp, Mus musculus
gggctgtagaatgcacatcccaggc

SEQ ID NO: 637795 - DNA, 25 bp, Mus musculus
gggctgtagaatttcattaccctaa

SEQ ID NO: 637796 - DNA, 25 bp, Mus musculus
gggctgtagcagagtgttcaaatgt

SEQ ID NO: 637797 - DNA, 25 bp, Mus musculus
gggctgtagcagtgtgttcaaatgt

SEQ ID NO: 637798 - DNA, 25 bp, Mus musculus
gggctgtagtgcatcctattgcact

SEQ ID NO: 637799 - DNA, 25 bp, Mus musculus
gggctgtagtgcttcctattgcact

SEQ ID NO: 637800 - DNA, 25 bp, Mus musculus
gggctgtatagaagaccttttctca

SEQ ID NO: 637801 - DNA, 25 bp, Mus musculus
gggctgtatagatgaccttttctca

SEQ ID NO: 637802 - DNA, 25 bp, Mus musculus
gggctgtatcccactaaccaataaa

SEQ ID NO: 637803 - DNA, 25 bp, Mus musculus
gggctgtatccctctaaccaataaa

SEQ ID NO: 637804 - DNA, 25 bp, Mus musculus
gggctgtcaatcactgcactaataa

SEQ ID NO: 637805 - DNA, 25 bp, Mus musculus
gggctgtcaatctctgcactaataa

SEQ ID NO: 637806 - DNA, 25 bp, Mus musculus
gggctgtcacacagcgaatcaacac

SEQ ID NO: 637807 - DNA, 25 bp, Mus musculus
gggctgtcacactgcgaatcaacac

SEQ ID NO: 637808 - DNA, 25 bp, Mus musculus
gggctgtcattgagtttcccaggat

SEQ ID NO: 637809 - DNA, 25 bp, Mus musculus
gggctgtcattgtgtttcccaggat

SEQ ID NO: 637810 - DNA, 25 bp, Mus musculus
gggctgtccagaaacctttagttag

SEQ ID NO: 637811 - DNA, 25 bp, Mus musculus
gggctgtccagaaggatcagctata

SEQ ID NO: 637812 - DNA, 25 bp, Mus musculus
gggctgtccagatacctttagttag

SEQ ID NO: 637813 - DNA, 25 bp, Mus musculus
gggctgtccagatggatcagctata

SEQ ID NO: 637814 - DNA, 25 bp, Mus musculus
gggctgtcccaactcaatagaaagg

SEQ ID NO: 637815 - DNA, 25 bp, Mus musculus
gggctgtcccaagtcaatagaaagg

SEQ ID NO: 637816 - DNA, 25 bp, Mus musculus
gggctgtcctgcctgttgcccggcg

SEQ ID NO: 637817 - DNA, 25 bp, Mus musculus
gggctgtcctgcgtgttgcccggcg

SEQ ID NO: 637818 - DNA, 25 bp, Mus musculus
gggctgtcctttataggagccagct

SEQ ID NO: 637819 - DNA, 25 bp, Mus musculus
gggctgtcctttttaggagccagct

SEQ ID NO: 637820 - DNA, 25 bp, Mus musculus
gggctgtcgttccacccaggtcagt

SEQ ID NO: 637821 - DNA, 25 bp, Mus musculus
gggctgtcgttcgacccaggtcagt

SEQ ID NO: 637822 - DNA, 25 bp, Mus musculus
gggctgtctaaaaaggatggagaat

SEQ ID NO: 637823 - DNA, 25 bp, Mus musculus
gggctgtctaaataggatggagaat

SEQ ID NO: 637824 - DNA, 25 bp, Mus musculus
gggctgtctatcacctgtaaatatg

SEQ ID NO: 637825 - DNA, 25 bp, Mus musculus
gggctgtctatctcctgtaaatatg

SEQ ID NO: 637826 - DNA, 25 bp, Mus musculus
gggctgtctcatctagtgagatagt

SEQ ID NO: 637827 - DNA, 25 bp, Mus musculus
gggctgtctcatgtagtgagatagt

SEQ ID NO: 637828 - DNA, 25 bp, Mus musculus
gggctgtctgctcagaaggcaccct

SEQ ID NO: 637829 - DNA, 25 bp, Mus musculus
gggctgtctgctgagaaggcaccct

SEQ ID NO: 637830 - DNA, 25 bp, Mus musculus
gggctgtctggtctgttcaaaacca

SEQ ID NO: 637831 - DNA, 25 bp, Mus musculus
gggctgtctggtgtgttcaaaacca

SEQ ID NO: 637832 - DNA, 25 bp, Mus musculus
gggctgtcttttacagggctactat

SEQ ID NO: 637833 - DNA, 25 bp, Mus musculus
gggctgtctttttcagggctactat

SEQ ID NO: 637834 - DNA, 25 bp, Mus musculus
gggctgtgaactaccccgacttctt

SEQ ID NO: 637835 - DNA, 25 bp, Mus musculus
gggctgtgaacttccccgacttctt

SEQ ID NO: 637836 - DNA, 25 bp, Mus musculus
gggctgtgaattcgtctttcctaaa

SEQ ID NO: 637837 - DNA, 25 bp, Mus musculus
gggctgtgaattggtctttcctaaa

SEQ ID NO: 637838 - DNA, 25 bp, Mus musculus
gggctgtgacacatgtagacactgt

SEQ ID NO: 637839 - DNA, 25 bp, Mus musculus
gggctgtgacacttgtagacactgt

SEQ ID NO: 637840 - DNA, 25 bp, Mus musculus
gggctgtgacctctgacatcagcga

SEQ ID NO: 637841 - DNA, 25 bp, Mus musculus
gggctgtgacctgtgacatcagcga

SEQ ID NO: 637842 - DNA, 25 bp, Mus musculus
gggctgtgacttaaagcactcgctt

SEQ ID NO: 637843 - DNA, 25 bp, Mus musculus
gggctgtgactttaagcactcgctt

SEQ ID NO: 637844 - DNA, 25 bp, Mus musculus
gggctgtgatccataggcagagaac

SEQ ID NO: 637845 - DNA, 25 bp, Mus musculus
gggctgtgatccttaggcagagaac

SEQ ID NO: 637846 - DNA, 25 bp, Mus musculus
gggctgtgatctagtgttttaacaa

SEQ ID NO: 637847 - DNA, 25 bp, Mus musculus
gggctgtgatcttgtgttttaacaa

SEQ ID NO: 637848 - DNA, 25 bp, Mus musculus
gggctgtgcacaatgactctcatgg

SEQ ID NO: 637849 - DNA, 25 bp, Mus musculus
gggctgtgcacattgactctcatgg

SEQ ID NO: 637850 - DNA, 25 bp, Mus musculus
gggctgtgccgtctgccacaagcaa

SEQ ID NO: 637851 - DNA, 25 bp, Mus musculus
gggctgtgccgtgtgccacaagcaa

SEQ ID NO: 637852 - DNA, 25 bp, Mus musculus
gggctgtgctgtctcattctgtcat

SEQ ID NO: 637853 - DNA, 25 bp, Mus musculus
gggctgtgctgtgtcattctgtcat

SEQ ID NO: 637854 - DNA, 25 bp, Mus musculus
gggctgtgcttccatgctcctaacc

SEQ ID NO: 637855 - DNA, 25 bp, Mus musculus
gggctgtgcttcgatgctcctaacc

SEQ ID NO: 637856 - DNA, 25 bp, Mus musculus
gggctgtggatacctgcttttattc

SEQ ID NO: 637857 - DNA, 25 bp, Mus musculus
gggctgtggatagctgcttttattc

SEQ ID NO: 637858 - DNA, 25 bp, Mus musculus
gggctgtggatgatcttcctacacc

SEQ ID NO: 637859 - DNA, 25 bp, Mus musculus
gggctgtggatgttcttcctacacc

SEQ ID NO: 637860 - DNA, 25 bp, Mus musculus
gggctgtggccaattgggcaccata

SEQ ID NO: 637861 - DNA, 25 bp, Mus musculus
gggctgtggccatttgggcaccata

SEQ ID NO: 637862 - DNA, 25 bp, Mus musculus
gggctgtgggcacaccaacaactat

SEQ ID NO: 637863 - DNA, 25 bp, Mus musculus
gggctgtgggcagaccaacaactat

SEQ ID NO: 637864 - DNA, 25 bp, Mus musculus
gggctgtgttaaattctcctcttgt

SEQ ID NO: 637865 - DNA, 25 bp, Mus musculus
gggctgtgttaatttctcctcttgt

SEQ ID NO: 637866 - DNA, 25 bp, Mus musculus
gggctgttaaagctaactccatcaa

SEQ ID NO: 637867 - DNA, 25 bp, Mus musculus
gggctgttaaaggtaactccatcaa

SEQ ID NO: 637868 - DNA, 25 bp, Mus musculus
gggctgttacagagtgcatctcggt

SEQ ID NO: 637869 - DNA, 25 bp, Mus musculus
gggctgttacagtgtgcatctcggt

SEQ ID NO: 637870 - DNA, 25 bp, Mus musculus
gggctgttacctagttgatatccta

SEQ ID NO: 637871 - DNA, 25 bp, Mus musculus
gggctgttaccttgttgatatccta

SEQ ID NO: 637872 - DNA, 25 bp, Mus musculus
gggctgttcacaatcctgaggaaga

SEQ ID NO: 637873 - DNA, 25 bp, Mus musculus
gggctgttcacattcctgaggaaga

SEQ ID NO: 637874 - DNA, 25 bp, Mus musculus
gggctgttcagaaacatttaggatt

SEQ ID NO: 637875 - DNA, 25 bp, Mus musculus
gggctgttcagatacatttaggatt

SEQ ID NO: 637876 - DNA, 25 bp, Mus musculus
gggctgttcataaactagccagctg

SEQ ID NO: 637877 - DNA, 25 bp, Mus musculus
gggctgttcataagtgtgcaccatt

SEQ ID NO: 637878 - DNA, 25 bp, Mus musculus
gggctgttcatatactagccagctg

SEQ ID NO: 637879 - DNA, 25 bp, Mus musculus
gggctgttcatatgtgtgcaccatt

SEQ ID NO: 637880 - DNA, 25 bp, Mus musculus
gggctgttcatcaacttcaggaacc

SEQ ID NO: 637881 - DNA, 25 bp, Mus musculus
gggctgttcatctacttcaggaacc

SEQ ID NO: 637882 - DNA, 25 bp, Mus musculus
gggctgttcctgcttacacagtcaa

SEQ ID NO: 637883 - DNA, 25 bp, Mus musculus
gggctgttcctggttacacagtcaa

SEQ ID NO: 637884 - DNA, 25 bp, Mus musculus
gggctgttcgctcttagtttcaacc

SEQ ID NO: 637885 - DNA, 25 bp, Mus musculus
gggctgttcgctgttagtttcaacc

SEQ ID NO: 637886 - DNA, 25 bp, Mus musculus
gggctgttctgtatactgcaaacca

SEQ ID NO: 637887 - DNA, 25 bp, Mus musculus
gggctgttctgtttactgcaaacca

SEQ ID NO: 637888 - DNA, 25 bp, Mus musculus
gggctgttcttgatcacttggtaga

SEQ ID NO: 637889 - DNA, 25 bp, Mus musculus
gggctgttcttgttcacttggtaga

SEQ ID NO: 637890 - DNA, 25 bp, Mus musculus
gggctgttgaaaaacctcaatgcaa

SEQ ID NO: 637891 - DNA, 25 bp, Mus musculus
gggctgttgaaatacctcaatgcaa

SEQ ID NO: 637892 - DNA, 25 bp, Mus musculus
gggctgttgagtaagctgcctagac

SEQ ID NO: 637893 - DNA, 25 bp, Mus musculus
gggctgttgagttagctgcctagac

SEQ ID NO: 637894 - DNA, 25 bp, Mus musculus
gggctgttggcaagaccacctctgg

SEQ ID NO: 637895 - DNA, 25 bp, Mus musculus
gggctgttggcatgaccacctctgg

SEQ ID NO: 637896 - DNA, 25 bp, Mus musculus
gggctgttgtaaccctatgaaccgg

SEQ ID NO: 637897 - DNA, 25 bp, Mus musculus
gggctgttgtaagcctatgaaccgg

SEQ ID NO: 637898 - DNA, 25 bp, Mus musculus
gggctgttgtagagtcgaatcttta

SEQ ID NO: 637899 - DNA, 25 bp, Mus musculus
gggctgttgtagtgtcgaatcttta

SEQ ID NO: 637900 - DNA, 25 bp, Mus musculus
gggctgtttagtcagacctttcttg

SEQ ID NO: 637901 - DNA, 25 bp, Mus musculus
gggctgtttagtgagacctttcttg

SEQ ID NO: 637902 - DNA, 25 bp, Mus musculus
gggctgtttcctataatagctgttc

SEQ ID NO: 637903 - DNA, 25 bp, Mus musculus
gggctgtttcctttaatagctgttc

SEQ ID NO: 637904 - DNA, 25 bp, Mus musculus
gggctgtttctaaactaagttcatg

SEQ ID NO: 637905 - DNA, 25 bp, Mus musculus
gggctgtttctatactaagttcatg

SEQ ID NO: 637906 - DNA, 25 bp, Mus musculus
gggctgtttcttcgccagcgatgac

SEQ ID NO: 637907 - DNA, 25 bp, Mus musculus
gggctgtttcttggccagcgatgac

SEQ ID NO: 637908 - DNA, 25 bp, Mus musculus
gggctgtttgccacagagctctgtg

SEQ ID NO: 637909 - DNA, 25 bp, Mus musculus
gggctgtttgcctcagagctctgtg

SEQ ID NO: 637910 - DNA, 25 bp, Mus musculus
gggctgttttaaccaagagtaggca

SEQ ID NO: 637911 - DNA, 25 bp, Mus musculus
gggctgttttaagcaagagtaggca

SEQ ID NO: 637912 - DNA, 25 bp, Mus musculus
gggctgttttgcactcagagggtaa

SEQ ID NO: 637913 - DNA, 25 bp, Mus musculus
gggctgttttgctctcagagggtaa

SEQ ID NO: 637914 - DNA, 25 bp, Mus musculus
gggctgttttgtagcccaaactctc

SEQ ID NO: 637915 - DNA, 25 bp, Mus musculus
gggctgttttgttgcccaaactctc

SEQ ID NO: 637916 - DNA, 25 bp, Mus musculus
gggcttaacataaacctatctccat

SEQ ID NO: 637917 - DNA, 25 bp, Mus musculus
gggcttaacatatacctatctccat

SEQ ID NO: 637918 - DNA, 25 bp, Mus musculus
gggcttaacccgctagacaatgcat

SEQ ID NO: 637919 - DNA, 25 bp, Mus musculus
gggcttaacccggtagacaatgcat

SEQ ID NO: 637920 - DNA, 25 bp, Mus musculus
gggcttaataggcacgctttctaca

SEQ ID NO: 637921 - DNA, 25 bp, Mus musculus
gggcttaatagggacgctttctaca

SEQ ID NO: 637922 - DNA, 25 bp, Mus musculus
gggcttaatctaagttggctacatc

SEQ ID NO: 637923 - DNA, 25 bp, Mus musculus
gggcttaatctatgttggctacatc

SEQ ID NO: 637924 - DNA, 25 bp, Mus musculus
gggcttaatctcatcagagctgcat

SEQ ID NO: 637925 - DNA, 25 bp, Mus musculus
gggcttaatctcttcagagctgcat

SEQ ID NO: 637926 - DNA, 25 bp, Mus musculus
gggcttaatctgagaaaataccttg

SEQ ID NO: 637927 - DNA, 25 bp, Mus musculus
gggcttaatctgtgaaaataccttg

SEQ ID NO: 637928 - DNA, 25 bp, Mus musculus
gggcttaatgtaaataaagcttgcc

SEQ ID NO: 637929 - DNA, 25 bp, Mus musculus
gggcttaatgtatataaagcttgcc

SEQ ID NO: 637930 - DNA, 25 bp, Mus musculus
gggcttaatgttcggttccctgcac

SEQ ID NO: 637931 - DNA, 25 bp, Mus musculus
gggcttaatgttgggttccctgcac

SEQ ID NO: 637932 - DNA, 25 bp, Mus musculus
gggcttacaagtactgtatgcatct

SEQ ID NO: 637933 - DNA, 25 bp, Mus musculus
gggcttacaagttctgtatgcatct

SEQ ID NO: 637934 - DNA, 25 bp, Mus musculus
gggcttacaccacaatatgcacctt

SEQ ID NO: 637935 - DNA, 25 bp, Mus musculus
gggcttacaccagaatatgcacctt

SEQ ID NO: 637936 - DNA, 25 bp, Mus musculus
gggcttacaggcacagctctggtac

SEQ ID NO: 637937 - DNA, 25 bp, Mus musculus
gggcttacaggctcagctctggtac

SEQ ID NO: 637938 - DNA, 25 bp, Mus musculus
gggcttacatttctggaatttgcaa

SEQ ID NO: 637939 - DNA, 25 bp, Mus musculus
gggcttacatttgtggaatttgcaa

SEQ ID NO: 637940 - DNA, 25 bp, Mus musculus
gggcttacgacaacatgcatcatca

SEQ ID NO: 637941 - DNA, 25 bp, Mus musculus
gggcttacgacatcatgcatcatca

SEQ ID NO: 637942 - DNA, 25 bp, Mus musculus
gggcttacgcgaatggtcaactcag

SEQ ID NO: 637943 - DNA, 25 bp, Mus musculus
gggcttacgcgattggtcaactcag

SEQ ID NO: 637944 - DNA, 25 bp, Mus musculus
gggcttactcacagcagtttaacca

SEQ ID NO: 637945 - DNA, 25 bp, Mus musculus
gggcttactcactgcagtttaacca

SEQ ID NO: 637946 - DNA, 25 bp, Mus musculus
gggcttactgagcatctgtaaagac

SEQ ID NO: 637947 - DNA, 25 bp, Mus musculus
gggcttactgaggatctgtaaagac

SEQ ID NO: 637948 - DNA, 25 bp, Mus musculus
gggcttactggacagcctgactaat

SEQ ID NO: 637949 - DNA, 25 bp, Mus musculus
gggcttactggagagcctgactaat

SEQ ID NO: 637950 - DNA, 25 bp, Mus musculus
gggcttactggtatgttgaaccatt

SEQ ID NO: 637951 - DNA, 25 bp, Mus musculus
gggcttactggtttgttgaaccatt

SEQ ID NO: 637952 - DNA, 25 bp, Mus musculus
gggcttacttgcaactctggagatt

SEQ ID NO: 637953 - DNA, 25 bp, Mus musculus
gggcttacttgctactctggagatt

SEQ ID NO: 637954 - DNA, 25 bp, Mus musculus
gggcttacttggctaacattctcaa

SEQ ID NO: 637955 - DNA, 25 bp, Mus musculus
gggcttacttgggtaacattctcaa

SEQ ID NO: 637956 - DNA, 25 bp, Mus musculus
gggcttagaccaagtacaagttcaa

SEQ ID NO: 637957 - DNA, 25 bp, Mus musculus
gggcttagaccaataaagggaccag

SEQ ID NO: 637958 - DNA, 25 bp, Mus musculus
gggcttagaccatgtacaagttcaa

SEQ ID NO: 637959 - DNA, 25 bp, Mus musculus
gggcttagaccattaaagggaccag

SEQ ID NO: 637960 - DNA, 25 bp, Mus musculus
gggcttagactgcatatggtacagt

SEQ ID NO: 637961 - DNA, 25 bp, Mus musculus
gggcttagactggatatggtacagt

SEQ ID NO: 637962 - DNA, 25 bp, Mus musculus
gggcttagcactccagatggctgac

SEQ ID NO: 637963 - DNA, 25 bp, Mus musculus
gggcttagcactgcagatggctgac

SEQ ID NO: 637964 - DNA, 25 bp, Mus musculus
gggcttagcccaatatctggactat

SEQ ID NO: 637965 - DNA, 25 bp, Mus musculus
gggcttagcccacagtggttaacac

SEQ ID NO: 637966 - DNA, 25 bp, Mus musculus
gggcttagcccagagtggttaacac

SEQ ID NO: 637967 - DNA, 25 bp, Mus musculus
gggcttagcccattatctggactat

SEQ ID NO: 637968 - DNA, 25 bp, Mus musculus
gggcttagctacaggagtttcttgt

SEQ ID NO: 637969 - DNA, 25 bp, Mus musculus
gggcttagctactggagtttcttgt

SEQ ID NO: 637970 - DNA, 25 bp, Mus musculus
gggcttagcttcaagaatgggtctg

SEQ ID NO: 637971 - DNA, 25 bp, Mus musculus
gggcttagcttctagaatgggtctg

SEQ ID NO: 637972 - DNA, 25 bp, Mus musculus
gggcttaggagcacagaatagaaac

SEQ ID NO: 637973 - DNA, 25 bp, Mus musculus
gggcttaggagctcagaatagaaac

SEQ ID NO: 637974 - DNA, 25 bp, Mus musculus
gggcttaggatgatattcgtactgt

SEQ ID NO: 637975 - DNA, 25 bp, Mus musculus
gggcttaggatgttattcgtactgt

SEQ ID NO: 637976 - DNA, 25 bp, Mus musculus
gggcttagggcacatgtccagtata

SEQ ID NO: 637977 - DNA, 25 bp, Mus musculus
gggcttagggcagatgtccagtata

SEQ ID NO: 637978 - DNA, 25 bp, Mus musculus
gggcttaggtgtagcaacctctata

SEQ ID NO: 637979 - DNA, 25 bp, Mus musculus
gggcttaggtgttgcaacctctata

SEQ ID NO: 637980 - DNA, 25 bp, Mus musculus
gggcttaggtttatgttacagaacg

SEQ ID NO: 637981 - DNA, 25 bp, Mus musculus
gggcttaggtttttgttacagaacg

SEQ ID NO: 637982 - DNA, 25 bp, Mus musculus
gggcttagtagaatccgcagctttt

SEQ ID NO: 637983 - DNA, 25 bp, Mus musculus
gggcttagtagattccgcagctttt

SEQ ID NO: 637984 - DNA, 25 bp, Mus musculus
gggcttagttataatcagctcaaca

SEQ ID NO: 637985 - DNA, 25 bp, Mus musculus
gggcttagttattatcagctcaaca

SEQ ID NO: 637986 - DNA, 25 bp, Mus musculus
gggcttagtttactttagaatgcat

SEQ ID NO: 637987 - DNA, 25 bp, Mus musculus
gggcttagtttagtttagaatgcat

SEQ ID NO: 637988 - DNA, 25 bp, Mus musculus
gggcttagtttgatgcattgtatgc

SEQ ID NO: 637989 - DNA, 25 bp, Mus musculus
gggcttagtttgttgcattgtatgc

SEQ ID NO: 637990 - DNA, 25 bp, Mus musculus
gggcttatactgcactaaatcttag

SEQ ID NO: 637991 - DNA, 25 bp, Mus musculus
gggcttatactgctgaatcctttgg

SEQ ID NO: 637992 - DNA, 25 bp, Mus musculus
gggcttatactggactaaatcttag

SEQ ID NO: 637993 - DNA, 25 bp, Mus musculus
gggcttatactggtgaatcctttgg

SEQ ID NO: 637994 - DNA, 25 bp, Mus musculus
gggcttatacttaaagtctgctgca

SEQ ID NO: 637995 - DNA, 25 bp, Mus musculus
gggcttatactttaagtctgctgca

SEQ ID NO: 637996 - DNA, 25 bp, Mus musculus
gggcttatatgactgtctcatggag

SEQ ID NO: 637997 - DNA, 25 bp, Mus musculus
gggcttatatgagtgtctcatggag

SEQ ID NO: 637998 - DNA, 25 bp, Mus musculus
gggcttatatgcagccacaagtgga

SEQ ID NO: 637999 - DNA, 25 bp, Mus musculus
gggcttatatgctgccacaagtgga

SEQ ID NO: 638000 - DNA, 25 bp, Mus musculus
gggcttatatgtcgcgtttactttt

SEQ ID NO: 638001 - DNA, 25 bp, Mus musculus
gggcttatatgtggcgtttactttt

SEQ ID NO: 638002 - DNA, 25 bp, Mus musculus
gggcttatatttcatgttttttgtg

SEQ ID NO: 638003 - DNA, 25 bp, Mus musculus
gggcttatatttgatgttttttgtg

SEQ ID NO: 638004 - DNA, 25 bp, Mus musculus
gggcttatgactctgaatctttgat

SEQ ID NO: 638005 - DNA, 25 bp, Mus musculus
gggcttatgactgtgaatctttgat

SEQ ID NO: 638006 - DNA, 25 bp, Mus musculus
gggcttatgcctagaaccccatagt

SEQ ID NO: 638007 - DNA, 25 bp, Mus musculus
gggcttatgccttgaaccccatagt

SEQ ID NO: 638008 - DNA, 25 bp, Mus musculus
gggcttatggatacggctcttactc

SEQ ID NO: 638009 - DNA, 25 bp, Mus musculus
gggcttatggattcggctcttactc

SEQ ID NO: 638010 - DNA, 25 bp, Mus musculus
gggcttattatgaaccctcttgctg

SEQ ID NO: 638011 - DNA, 25 bp, Mus musculus
gggcttattatgtaccctcttgctg

SEQ ID NO: 638012 - DNA, 25 bp, Mus musculus
gggcttattgaccagctaacatacc

SEQ ID NO: 638013 - DNA, 25 bp, Mus musculus
gggcttattgacgagctaacatacc

SEQ ID NO: 638014 - DNA, 25 bp, Mus musculus
gggcttattgatcgtttatactctc

SEQ ID NO: 638015 - DNA, 25 bp, Mus musculus
gggcttattgatggtttatactctc

SEQ ID NO: 638016 - DNA, 25 bp, Mus musculus
gggcttatttcaacctgtagcttgt

SEQ ID NO: 638017 - DNA, 25 bp, Mus musculus
gggcttatttcatcctgtagcttgt

SEQ ID NO: 638018 - DNA, 25 bp, Mus musculus
gggcttcaaacacctatctagggct

SEQ ID NO: 638019 - DNA, 25 bp, Mus musculus
gggcttcaaacagctatctagggct

SEQ ID NO: 638020 - DNA, 25 bp, Mus musculus
gggcttcaaattaccacttcacatc

SEQ ID NO: 638021 - DNA, 25 bp, Mus musculus
gggcttcaaatttccacttcacatc

SEQ ID NO: 638022 - DNA, 25 bp, Mus musculus
gggcttcaacttaatgcttccttct

SEQ ID NO: 638023 - DNA, 25 bp, Mus musculus
gggcttcaacttatggtcggaaact

SEQ ID NO: 638024 - DNA, 25 bp, Mus musculus
gggcttcaactttatgcttccttct

SEQ ID NO: 638025 - DNA, 25 bp, Mus musculus
gggcttcaacttttggtcggaaact

SEQ ID NO: 638026 - DNA, 25 bp, Mus musculus
gggcttcaagaaagattttgtatgc

SEQ ID NO: 638027 - DNA, 25 bp, Mus musculus
gggcttcaagaatgattttgtatgc

SEQ ID NO: 638028 - DNA, 25 bp, Mus musculus
gggcttcaagacctgaactgagaca

SEQ ID NO: 638029 - DNA, 25 bp, Mus musculus
gggcttcaagacgtgaactgagaca

SEQ ID NO: 638030 - DNA, 25 bp, Mus musculus
gggcttcacaacagcagcaactgcc

SEQ ID NO: 638031 - DNA, 25 bp, Mus musculus
gggcttcacaactgcagcaactgcc

SEQ ID NO: 638032 - DNA, 25 bp, Mus musculus
gggcttcacaagacatgtctccatg

SEQ ID NO: 638033 - DNA, 25 bp, Mus musculus
gggcttcacaagtcatgtctccatg

SEQ ID NO: 638034 - DNA, 25 bp, Mus musculus
gggcttcacacacggctaattggat

SEQ ID NO: 638035 - DNA, 25 bp, Mus musculus
gggcttcacacagggctaattggat

SEQ ID NO: 638036 - DNA, 25 bp, Mus musculus
gggcttcacagcctataggaacttg

SEQ ID NO: 638037 - DNA, 25 bp, Mus musculus
gggcttcacagcgtataggaacttg

SEQ ID NO: 638038 - DNA, 25 bp, Mus musculus
gggcttcaccgcctcaggaattgca

SEQ ID NO: 638039 - DNA, 25 bp, Mus musculus
gggcttcaccgcgtcaggaattgca

SEQ ID NO: 638040 - DNA, 25 bp, Mus musculus
gggcttcactctaacttagctgctt

SEQ ID NO: 638041 - DNA, 25 bp, Mus musculus
gggcttcactcttacttagctgctt

SEQ ID NO: 638042 - DNA, 25 bp, Mus musculus
gggcttcactgacgatcacaaacag

SEQ ID NO: 638043 - DNA, 25 bp, Mus musculus
gggcttcactgaggatcacaaacag

SEQ ID NO: 638044 - DNA, 25 bp, Mus musculus
gggcttcactgtaactcggactttc

SEQ ID NO: 638045 - DNA, 25 bp, Mus musculus
gggcttcactgttactcggactttc

SEQ ID NO: 638046 - DNA, 25 bp, Mus musculus
gggcttcagaaaatcaccagcattg

SEQ ID NO: 638047 - DNA, 25 bp, Mus musculus
gggcttcagaaattcaccagcattg

SEQ ID NO: 638048 - DNA, 25 bp, Mus musculus
gggcttcagattcaagatcctcctg

SEQ ID NO: 638049 - DNA, 25 bp, Mus musculus
gggcttcagattgaagatcctcctg

SEQ ID NO: 638050 - DNA, 25 bp, Mus musculus
gggcttcagcggaggtggcagtgct

SEQ ID NO: 638051 - DNA, 25 bp, Mus musculus
gggcttcagcggtggtggcagtgct

SEQ ID NO: 638052 - DNA, 25 bp, Mus musculus
gggcttcagctgagcagttctcgcc

SEQ ID NO: 638053 - DNA, 25 bp, Mus musculus
gggcttcagctgtgcagttctcgcc

SEQ ID NO: 638054 - DNA, 25 bp, Mus musculus
gggcttcaggaaacaacaggcacaa

SEQ ID NO: 638055 - DNA, 25 bp, Mus musculus
gggcttcaggaatcaacaggcacaa

SEQ ID NO: 638056 - DNA, 25 bp, Mus musculus
gggcttcaggacatcacctccaaag

SEQ ID NO: 638057 - DNA, 25 bp, Mus musculus
gggcttcaggacttcacctccaaag

SEQ ID NO: 638058 - DNA, 25 bp, Mus musculus
gggcttcagtaccaacctgcggtcc

SEQ ID NO: 638059 - DNA, 25 bp, Mus musculus
gggcttcagtacgaacctgcggtcc

SEQ ID NO: 638060 - DNA, 25 bp, Mus musculus
gggcttcagtgactgagtttccctt

SEQ ID NO: 638061 - DNA, 25 bp, Mus musculus
gggcttcagtgagtgagtttccctt

SEQ ID NO: 638062 - DNA, 25 bp, Mus musculus
gggcttcatagcatgtttcaggtca

SEQ ID NO: 638063 - DNA, 25 bp, Mus musculus
gggcttcatagcttgtttcaggtca

SEQ ID NO: 638064 - DNA, 25 bp, Mus musculus
gggcttcatccaaagcaggtcaagt

SEQ ID NO: 638065 - DNA, 25 bp, Mus musculus
gggcttcatccatagcaggtcaagt

SEQ ID NO: 638066 - DNA, 25 bp, Mus musculus
gggcttcatcccaattgggtccaaa

SEQ ID NO: 638067 - DNA, 25 bp, Mus musculus
gggcttcatccctattgggtccaaa

SEQ ID NO: 638068 - DNA, 25 bp, Mus musculus
gggcttcatcgcacgggtctgaagt

SEQ ID NO: 638069 - DNA, 25 bp, Mus musculus
gggcttcatcgctcgggtctgaagt

SEQ ID NO: 638070 - DNA, 25 bp, Mus musculus
gggcttcatctaagcccctgctctt

SEQ ID NO: 638071 - DNA, 25 bp, Mus musculus
gggcttcatctatgcccctgctctt

SEQ ID NO: 638072 - DNA, 25 bp, Mus musculus
gggcttcatcttactagactggaca

SEQ ID NO: 638073 - DNA, 25 bp, Mus musculus
gggcttcatcttagaaccagtcaat

SEQ ID NO: 638074 - DNA, 25 bp, Mus musculus
gggcttcatctttctagactggaca

SEQ ID NO: 638075 - DNA, 25 bp, Mus musculus
gggcttcatctttgaaccagtcaat

SEQ ID NO: 638076 - DNA, 25 bp, Mus musculus
gggcttcatgagcacaatttccttt

SEQ ID NO: 638077 - DNA, 25 bp, Mus musculus
gggcttcatgaggacaatttccttt

SEQ ID NO: 638078 - DNA, 25 bp, Mus musculus
gggcttcatgatctcactatgatcc

SEQ ID NO: 638079 - DNA, 25 bp, Mus musculus
gggcttcatgatgtcactatgatcc

SEQ ID NO: 638080 - DNA, 25 bp, Mus musculus
gggcttccaacaatatccagagata

SEQ ID NO: 638081 - DNA, 25 bp, Mus musculus
gggcttccaacattatccagagata

SEQ ID NO: 638082 - DNA, 25 bp, Mus musculus
gggcttccacagaaacccaagttgt

SEQ ID NO: 638083 - DNA, 25 bp, Mus musculus
gggcttccacagacatgatgggctc

SEQ ID NO: 638084 - DNA, 25 bp, Mus musculus
gggcttccacagtaacccaagttgt

SEQ ID NO: 638085 - DNA, 25 bp, Mus musculus
gggcttccacagtcatgatgggctc

SEQ ID NO: 638086 - DNA, 25 bp, Mus musculus
gggcttccagacctaagcagcatga

SEQ ID NO: 638087 - DNA, 25 bp, Mus musculus
gggcttccagacgtaagcagcatga

SEQ ID NO: 638088 - DNA, 25 bp, Mus musculus
gggcttccagatcatctacaaatca

SEQ ID NO: 638089 - DNA, 25 bp, Mus musculus
gggcttccagatgatctacaaatca

SEQ ID NO: 638090 - DNA, 25 bp, Mus musculus
gggcttccagcaactgagagacagc

SEQ ID NO: 638091 - DNA, 25 bp, Mus musculus
gggcttccagcaagcagtccttaaa

SEQ ID NO: 638092 - DNA, 25 bp, Mus musculus
gggcttccagcatctgagagacagc

SEQ ID NO: 638093 - DNA, 25 bp, Mus musculus
gggcttccagcatgcagtccttaaa

SEQ ID NO: 638094 - DNA, 25 bp, Mus musculus
gggcttccaggcaatccaagcagat

SEQ ID NO: 638095 - DNA, 25 bp, Mus musculus
gggcttccaggctatccaagcagat

SEQ ID NO: 638096 - DNA, 25 bp, Mus musculus
gggcttccagtccatgtagcagctg

SEQ ID NO: 638097 - DNA, 25 bp, Mus musculus
gggcttccagtcgatgtagcagctg

SEQ ID NO: 638098 - DNA, 25 bp, Mus musculus
gggcttccatctcatgacttacttt

SEQ ID NO: 638099 - DNA, 25 bp, Mus musculus
gggcttccatctgatgacttacttt

SEQ ID NO: 638100 - DNA, 25 bp, Mus musculus
gggcttccatgcatctgattatttc

SEQ ID NO: 638101 - DNA, 25 bp, Mus musculus
gggcttccatgcttctgattatttc

SEQ ID NO: 638102 - DNA, 25 bp, Mus musculus
gggcttccatgtcatgtggaaattc

SEQ ID NO: 638103 - DNA, 25 bp, Mus musculus
gggcttccatgtgatgtggaaattc

SEQ ID NO: 638104 - DNA, 25 bp, Mus musculus
gggcttcccaaaccatggagtctgg

SEQ ID NO: 638105 - DNA, 25 bp, Mus musculus
gggcttcccaaagcatggagtctgg

SEQ ID NO: 638106 - DNA, 25 bp, Mus musculus
gggcttcccaatcgtgatccatata

SEQ ID NO: 638107 - DNA, 25 bp, Mus musculus
gggcttcccaatggtgatccatata

SEQ ID NO: 638108 - DNA, 25 bp, Mus musculus
gggcttcccaccacagactgagttc

SEQ ID NO: 638109 - DNA, 25 bp, Mus musculus
gggcttcccacctcagactgagttc

SEQ ID NO: 638110 - DNA, 25 bp, Mus musculus
gggcttccctaccatctattttgct

SEQ ID NO: 638111 - DNA, 25 bp, Mus musculus
gggcttccctacgatctattttgct

SEQ ID NO: 638112 - DNA, 25 bp, Mus musculus
gggcttccctagatggtatgacttg

SEQ ID NO: 638113 - DNA, 25 bp, Mus musculus
gggcttccctagttggtatgacttg

SEQ ID NO: 638114 - DNA, 25 bp, Mus musculus
gggcttccctcgaggtttatcctgg

SEQ ID NO: 638115 - DNA, 25 bp, Mus musculus
gggcttccctcgtggtttatcctgg

SEQ ID NO: 638116 - DNA, 25 bp, Mus musculus
gggcttccctttcttcatatggttc

SEQ ID NO: 638117 - DNA, 25 bp, Mus musculus
gggcttccctttgttcatatggttc

SEQ ID NO: 638118 - DNA, 25 bp, Mus musculus
gggcttccgactaggagaccagtga

SEQ ID NO: 638119 - DNA, 25 bp, Mus musculus
gggcttccgacttggagaccagtga

SEQ ID NO: 638120 - DNA, 25 bp, Mus musculus
gggcttccggatcccctcaaaatga

SEQ ID NO: 638121 - DNA, 25 bp, Mus musculus
gggcttccggatgccctcaaaatga

SEQ ID NO: 638122 - DNA, 25 bp, Mus musculus
gggcttccgtaacctttcaaaccag

SEQ ID NO: 638123 - DNA, 25 bp, Mus musculus
gggcttccgtaagctttcaaaccag

SEQ ID NO: 638124 - DNA, 25 bp, Mus musculus
gggcttcctataaggccatcacagg

SEQ ID NO: 638125 - DNA, 25 bp, Mus musculus
gggcttcctatatggccatcacagg

SEQ ID NO: 638126 - DNA, 25 bp, Mus musculus
gggcttcctcccagaagtcagtcat

SEQ ID NO: 638127 - DNA, 25 bp, Mus musculus
gggcttcctccctgaagtcagtcat

SEQ ID NO: 638128 - DNA, 25 bp, Mus musculus
gggcttcctcctccttaaggaagca

SEQ ID NO: 638129 - DNA, 25 bp, Mus musculus
gggcttcctcctgcttaaggaagca

SEQ ID NO: 638130 - DNA, 25 bp, Mus musculus
gggcttcctgaaccattaccagatg

SEQ ID NO: 638131 - DNA, 25 bp, Mus musculus
gggcttcctgaaccgctttgctgag

SEQ ID NO: 638132 - DNA, 25 bp, Mus musculus
gggcttcctgaagcattaccagatg

SEQ ID NO: 638133 - DNA, 25 bp, Mus musculus
gggcttcctgaagcgctttgctgag

SEQ ID NO: 638134 - DNA, 25 bp, Mus musculus
gggcttcctgctagatagagacatg

SEQ ID NO: 638135 - DNA, 25 bp, Mus musculus
gggcttcctgcttgatagagacatg

SEQ ID NO: 638136 - DNA, 25 bp, Mus musculus
gggcttcctttacttgaggcagcta

SEQ ID NO: 638137 - DNA, 25 bp, Mus musculus
gggcttcctttagttgaggcagcta

SEQ ID NO: 638138 - DNA, 25 bp, Mus musculus
gggcttcgcggtagacaaatctgac

SEQ ID NO: 638139 - DNA, 25 bp, Mus musculus
gggcttcgcggttgacaaatctgac

SEQ ID NO: 638140 - DNA, 25 bp, Mus musculus
gggcttcggagtaataccttctgtt

SEQ ID NO: 638141 - DNA, 25 bp, Mus musculus
gggcttcggagttataccttctgtt

SEQ ID NO: 638142 - DNA, 25 bp, Mus musculus
gggcttcggcacatcccaaagtggg

SEQ ID NO: 638143 - DNA, 25 bp, Mus musculus
gggcttcggcacttcccaaagtggg

SEQ ID NO: 638144 - DNA, 25 bp, Mus musculus
gggcttcgggccactgtttacatgg

SEQ ID NO: 638145 - DNA, 25 bp, Mus musculus
gggcttcgggcctctgtttacatgg

SEQ ID NO: 638146 - DNA, 25 bp, Mus musculus
gggcttcgtgacacagtccttctgg

SEQ ID NO: 638147 - DNA, 25 bp, Mus musculus
gggcttcgtgactcagtccttctgg

SEQ ID NO: 638148 - DNA, 25 bp, Mus musculus
gggcttcgttccagtttatttatca

SEQ ID NO: 638149 - DNA, 25 bp, Mus musculus
gggcttcgttcctgtttatttatca

SEQ ID NO: 638150 - DNA, 25 bp, Mus musculus
gggcttctaccacgagcactgtaac

SEQ ID NO: 638151 - DNA, 25 bp, Mus musculus
gggcttctaccaggagcactgtaac

SEQ ID NO: 638152 - DNA, 25 bp, Mus musculus
gggcttctagcgcagcagcaggaag

SEQ ID NO: 638153 - DNA, 25 bp, Mus musculus
gggcttctagcgcagtgtcagcatc

SEQ ID NO: 638154 - DNA, 25 bp, Mus musculus
gggcttctagcggagcagcaggaag

SEQ ID NO: 638155 - DNA, 25 bp, Mus musculus
gggcttctagcggagtgtcagcatc

SEQ ID NO: 638156 - DNA, 25 bp, Mus musculus
gggcttctagggaggcatgctttca

SEQ ID NO: 638157 - DNA, 25 bp, Mus musculus
gggcttctagggtggcatgctttca

SEQ ID NO: 638158 - DNA, 25 bp, Mus musculus
gggcttctatccagcggatgtgacc

SEQ ID NO: 638159 - DNA, 25 bp, Mus musculus
gggcttctatcctgcggatgtgacc

SEQ ID NO: 638160 - DNA, 25 bp, Mus musculus
gggcttctcacaaaggtgattcttt

SEQ ID NO: 638161 - DNA, 25 bp, Mus musculus
gggcttctcacataggtgattcttt

SEQ ID NO: 638162 - DNA, 25 bp, Mus musculus
gggcttctcagaaccatgtaggaaa

SEQ ID NO: 638163 - DNA, 25 bp, Mus musculus
gggcttctcagaactcagacctatc

SEQ ID NO: 638164 - DNA, 25 bp, Mus musculus
gggcttctcagatccatgtaggaaa

SEQ ID NO: 638165 - DNA, 25 bp, Mus musculus
gggcttctcagatctcagacctatc

SEQ ID NO: 638166 - DNA, 25 bp, Mus musculus
gggcttctcatcatccacactcggg

SEQ ID NO: 638167 - DNA, 25 bp, Mus musculus
gggcttctcatcttccacactcggg

SEQ ID NO: 638168 - DNA, 25 bp, Mus musculus
gggcttctcattcattttaaaggct

SEQ ID NO: 638169 - DNA, 25 bp, Mus musculus
gggcttctcattgattttaaaggct

SEQ ID NO: 638170 - DNA, 25 bp, Mus musculus
gggcttctcccgagtggtcttccta

SEQ ID NO: 638171 - DNA, 25 bp, Mus musculus
gggcttctcccgtgtggtcttccta

SEQ ID NO: 638172 - DNA, 25 bp, Mus musculus
gggcttctccttaatctaggcagtg

SEQ ID NO: 638173 - DNA, 25 bp, Mus musculus
gggcttctcctttatctaggcagtg

SEQ ID NO: 638174 - DNA, 25 bp, Mus musculus
gggcttctcgaccaggtattgtcat

SEQ ID NO: 638175 - DNA, 25 bp, Mus musculus
gggcttctcgacgaggtattgtcat

SEQ ID NO: 638176 - DNA, 25 bp, Mus musculus
gggcttctctaacattaattcctac

SEQ ID NO: 638177 - DNA, 25 bp, Mus musculus
gggcttctctaagattaattcctac

SEQ ID NO: 638178 - DNA, 25 bp, Mus musculus
gggcttctctgtacttctgtgaagt

SEQ ID NO: 638179 - DNA, 25 bp, Mus musculus
gggcttctctgttcttctgtgaagt

SEQ ID NO: 638180 - DNA, 25 bp, Mus musculus
gggcttctcttaacttcaagaattt

SEQ ID NO: 638181 - DNA, 25 bp, Mus musculus
gggcttctcttatcttcaagaattt

SEQ ID NO: 638182 - DNA, 25 bp, Mus musculus
gggcttctgacgagagtaactgcat

SEQ ID NO: 638183 - DNA, 25 bp, Mus musculus
gggcttctgacgtgagtaactgcat

SEQ ID NO: 638184 - DNA, 25 bp, Mus musculus
gggcttctgatccaggaacatacta

SEQ ID NO: 638185 - DNA, 25 bp, Mus musculus
gggcttctgatcgaggaacatacta

SEQ ID NO: 638186 - DNA, 25 bp, Mus musculus
gggcttctgatgatgtttgattcct

SEQ ID NO: 638187 - DNA, 25 bp, Mus musculus
gggcttctgatgttgtttgattcct

SEQ ID NO: 638188 - DNA, 25 bp, Mus musculus
gggcttctgcaaagtgggatctatg

SEQ ID NO: 638189 - DNA, 25 bp, Mus musculus
gggcttctgcaacttcatgcatttg

SEQ ID NO: 638190 - DNA, 25 bp, Mus musculus
gggcttctgcaagttcatgcatttg

SEQ ID NO: 638191 - DNA, 25 bp, Mus musculus
gggcttctgcaatgtgggatctatg

SEQ ID NO: 638192 - DNA, 25 bp, Mus musculus
gggcttctgcacatttgtgcatatt

SEQ ID NO: 638193 - DNA, 25 bp, Mus musculus
gggcttctgcacttttgtgcatatt

SEQ ID NO: 638194 - DNA, 25 bp, Mus musculus
gggcttctgctaaaaaacttcatgg

SEQ ID NO: 638195 - DNA, 25 bp, Mus musculus
gggcttctgctataaaacttcatgg

SEQ ID NO: 638196 - DNA, 25 bp, Mus musculus
gggcttctgctgaaataaaggacca

SEQ ID NO: 638197 - DNA, 25 bp, Mus musculus
gggcttctgctgtaataaaggacca

SEQ ID NO: 638198 - DNA, 25 bp, Mus musculus
gggcttctggagaaatactgggtca

SEQ ID NO: 638199 - DNA, 25 bp, Mus musculus
gggcttctggagagaatcttgaaaa

SEQ ID NO: 638200 - DNA, 25 bp, Mus musculus
gggcttctggagtaatactgggtca

SEQ ID NO: 638201 - DNA, 25 bp, Mus musculus
gggcttctggagtgaatcttgaaaa

SEQ ID NO: 638202 - DNA, 25 bp, Mus musculus
gggcttctggctagattttatagga

SEQ ID NO: 638203 - DNA, 25 bp, Mus musculus
gggcttctggctatgatatgtgaac

SEQ ID NO: 638204 - DNA, 25 bp, Mus musculus
gggcttctggcttgattttatagga

SEQ ID NO: 638205 - DNA, 25 bp, Mus musculus
gggcttctggctttgatatgtgaac

SEQ ID NO: 638206 - DNA, 25 bp, Mus musculus
gggcttctgtacaactgacctggtt

SEQ ID NO: 638207 - DNA, 25 bp, Mus musculus
gggcttctgtactactgacctggtt

SEQ ID NO: 638208 - DNA, 25 bp, Mus musculus
gggcttctgttaagtgctttccaga

SEQ ID NO: 638209 - DNA, 25 bp, Mus musculus
gggcttctgttatgtgctttccaga

SEQ ID NO: 638210 - DNA, 25 bp, Mus musculus
gggcttctgtttacatatcctctca

SEQ ID NO: 638211 - DNA, 25 bp, Mus musculus
gggcttctgttttcatatcctctca

SEQ ID NO: 638212 - DNA, 25 bp, Mus musculus
gggcttcttcacaggctcatgttgt

SEQ ID NO: 638213 - DNA, 25 bp, Mus musculus
gggcttcttcactggctcatgttgt

SEQ ID NO: 638214 - DNA, 25 bp, Mus musculus
gggcttcttcctattgtctaagagt

SEQ ID NO: 638215 - DNA, 25 bp, Mus musculus
gggcttcttccttttgtctaagagt

SEQ ID NO: 638216 - DNA, 25 bp, Mus musculus
gggcttcttgttagtggtcacatgc

SEQ ID NO: 638217 - DNA, 25 bp, Mus musculus
gggcttcttgtttgtggtcacatgc

SEQ ID NO: 638218 - DNA, 25 bp, Mus musculus
gggcttctttttagatcgggatgac

SEQ ID NO: 638219 - DNA, 25 bp, Mus musculus
gggcttcttttttgatcgggatgac

SEQ ID NO: 638220 - DNA, 25 bp, Mus musculus
gggcttgaacccaggactctcaata

SEQ ID NO: 638221 - DNA, 25 bp, Mus musculus
gggcttgaaccctggactctcaata

SEQ ID NO: 638222 - DNA, 25 bp, Mus musculus
gggcttgaagagagtgtccccatcc

SEQ ID NO: 638223 - DNA, 25 bp, Mus musculus
gggcttgaagagtgtgtccccatcc

SEQ ID NO: 638224 - DNA, 25 bp, Mus musculus
gggcttgaaggcaaccctggcaatc

SEQ ID NO: 638225 - DNA, 25 bp, Mus musculus
gggcttgaaggctaccctggcaatc

SEQ ID NO: 638226 - DNA, 25 bp, Mus musculus
gggcttgaaggtaagtccctccgca

SEQ ID NO: 638227 - DNA, 25 bp, Mus musculus
gggcttgaaggttagtccctccgca

SEQ ID NO: 638228 - DNA, 25 bp, Mus musculus
gggcttgaatggcttgctgaaatta

SEQ ID NO: 638229 - DNA, 25 bp, Mus musculus
gggcttgaatgggttgctgaaatta

SEQ ID NO: 638230 - DNA, 25 bp, Mus musculus
gggcttgaatgtacccgctactgta

SEQ ID NO: 638231 - DNA, 25 bp, Mus musculus
gggcttgaatgttcccgctactgta

SEQ ID NO: 638232 - DNA, 25 bp, Mus musculus
gggcttgaattaatttgagggctac

SEQ ID NO: 638233 - DNA, 25 bp, Mus musculus
gggcttgaattattttgagggctac

SEQ ID NO: 638234 - DNA, 25 bp, Mus musculus
gggcttgaatttccatgtctaattc

SEQ ID NO: 638235 - DNA, 25 bp, Mus musculus
gggcttgaatttgcatgtctaattc

SEQ ID NO: 638236 - DNA, 25 bp, Mus musculus
gggcttgacaggcttcgaattttac

SEQ ID NO: 638237 - DNA, 25 bp, Mus musculus
gggcttgacagggttcgaattttac

SEQ ID NO: 638238 - DNA, 25 bp, Mus musculus
gggcttgacagtctagccaaatcag

SEQ ID NO: 638239 - DNA, 25 bp, Mus musculus
gggcttgacagtgtagccaaatcag

SEQ ID NO: 638240 - DNA, 25 bp, Mus musculus
gggcttgacatgcattgttctttga

SEQ ID NO: 638241 - DNA, 25 bp, Mus musculus
gggcttgacatggattgttctttga

SEQ ID NO: 638242 - DNA, 25 bp, Mus musculus
gggcttgacccaattctagtagagt

SEQ ID NO: 638243 - DNA, 25 bp, Mus musculus
gggcttgacccatttctagtagagt

SEQ ID NO: 638244 - DNA, 25 bp, Mus musculus
gggcttgactacagttcacgattta

SEQ ID NO: 638245 - DNA, 25 bp, Mus musculus
gggcttgactactgttcacgattta

SEQ ID NO: 638246 - DNA, 25 bp, Mus musculus
gggcttgactagactgatcctgggt

SEQ ID NO: 638247 - DNA, 25 bp, Mus musculus
gggcttgactagtctgatcctgggt

SEQ ID NO: 638248 - DNA, 25 bp, Mus musculus
gggcttgactcaactcagggaacat

SEQ ID NO: 638249 - DNA, 25 bp, Mus musculus
gggcttgactcatctcagggaacat

SEQ ID NO: 638250 - DNA, 25 bp, Mus musculus
gggcttgacttaatgattcatgttt

SEQ ID NO: 638251 - DNA, 25 bp, Mus musculus
gggcttgacttattgattcatgttt

SEQ ID NO: 638252 - DNA, 25 bp, Mus musculus
gggcttgacttcaccctaccgaagg

SEQ ID NO: 638253 - DNA, 25 bp, Mus musculus
gggcttgacttctccctaccgaagg

SEQ ID NO: 638254 - DNA, 25 bp, Mus musculus
gggcttgagaaaaccgacttcactt

SEQ ID NO: 638255 - DNA, 25 bp, Mus musculus
gggcttgagaaatccgacttcactt

SEQ ID NO: 638256 - DNA, 25 bp, Mus musculus
gggcttgagactccacacatggcat

SEQ ID NO: 638257 - DNA, 25 bp, Mus musculus
gggcttgagactcgtgtctgtttca

SEQ ID NO: 638258 - DNA, 25 bp, Mus musculus
gggcttgagactgcacacatggcat

SEQ ID NO: 638259 - DNA, 25 bp, Mus musculus
gggcttgagactggtgtctgtttca

SEQ ID NO: 638260 - DNA, 25 bp, Mus musculus
gggcttgagagcatggctagtcatt

SEQ ID NO: 638261 - DNA, 25 bp, Mus musculus
gggcttgagagcttggctagtcatt

SEQ ID NO: 638262 - DNA, 25 bp, Mus musculus
gggcttgagtatatgactggcacaa

SEQ ID NO: 638263 - DNA, 25 bp, Mus musculus
gggcttgagtatttgactggcacaa

SEQ ID NO: 638264 - DNA, 25 bp, Mus musculus
gggcttgatataagcgattctcatt

SEQ ID NO: 638265 - DNA, 25 bp, Mus musculus
gggcttgatatatgcgattctcatt

SEQ ID NO: 638266 - DNA, 25 bp, Mus musculus
gggcttgcaacacgttcagtgtcac

SEQ ID NO: 638267 - DNA, 25 bp, Mus musculus
gggcttgcaacaggttcagtgtcac

SEQ ID NO: 638268 - DNA, 25 bp, Mus musculus
gggcttgcacatcagttaaccattg

SEQ ID NO: 638269 - DNA, 25 bp, Mus musculus
gggcttgcacatgagttaaccattg

SEQ ID NO: 638270 - DNA, 25 bp, Mus musculus
gggcttgcacctctgacatcatggg

SEQ ID NO: 638271 - DNA, 25 bp, Mus musculus
gggcttgcacctgtgacatcatggg

SEQ ID NO: 638272 - DNA, 25 bp, Mus musculus
gggcttgcagagctttattcatcag

SEQ ID NO: 638273 - DNA, 25 bp, Mus musculus
gggcttgcagaggtttattcatcag

SEQ ID NO: 638274 - DNA, 25 bp, Mus musculus
gggcttgcagcccactgagtaatgc

SEQ ID NO: 638275 - DNA, 25 bp, Mus musculus
gggcttgcagccgactgagtaatgc

SEQ ID NO: 638276 - DNA, 25 bp, Mus musculus
gggcttgcagtgacaggtctctata

SEQ ID NO: 638277 - DNA, 25 bp, Mus musculus
gggcttgcagtgtcaggtctctata

SEQ ID NO: 638278 - DNA, 25 bp, Mus musculus
gggcttgcatccaccaggaaggaat

SEQ ID NO: 638279 - DNA, 25 bp, Mus musculus
gggcttgcatcctccaggaaggaat

SEQ ID NO: 638280 - DNA, 25 bp, Mus musculus
gggcttgcatctccattatgcagaa

SEQ ID NO: 638281 - DNA, 25 bp, Mus musculus
gggcttgcatctgcattatgcagaa

SEQ ID NO: 638282 - DNA, 25 bp, Mus musculus
gggcttgcatgaacactccaagttg

SEQ ID NO: 638283 - DNA, 25 bp, Mus musculus
gggcttgcatgatcactccaagttg

SEQ ID NO: 638284 - DNA, 25 bp, Mus musculus
gggcttgcatttcctgtacacacag

SEQ ID NO: 638285 - DNA, 25 bp, Mus musculus
gggcttgcatttgctgtacacacag

SEQ ID NO: 638286 - DNA, 25 bp, Mus musculus
gggcttgccaacatctaaaaaatca

SEQ ID NO: 638287 - DNA, 25 bp, Mus musculus
gggcttgccaacttctaaaaaatca

SEQ ID NO: 638288 - DNA, 25 bp, Mus musculus
gggcttgccacaaacttgccaaaag

SEQ ID NO: 638289 - DNA, 25 bp, Mus musculus
gggcttgccacatacttgccaaaag

SEQ ID NO: 638290 - DNA, 25 bp, Mus musculus
gggcttgcccaacgaaagccacctg

SEQ ID NO: 638291 - DNA, 25 bp, Mus musculus
gggcttgcccaaggaaagccacctg

SEQ ID NO: 638292 - DNA, 25 bp, Mus musculus
gggcttgcccagagagatagctgat

SEQ ID NO: 638293 - DNA, 25 bp, Mus musculus
gggcttgcccagtgagatagctgat

SEQ ID NO: 638294 - DNA, 25 bp, Mus musculus
gggcttgcccgtcataaaataactt

SEQ ID NO: 638295 - DNA, 25 bp, Mus musculus
gggcttgcccgtgataaaataactt

SEQ ID NO: 638296 - DNA, 25 bp, Mus musculus
gggcttgccggacaacagtgaaaaa

SEQ ID NO: 638297 - DNA, 25 bp, Mus musculus
gggcttgccggagaacagtgaaaaa

SEQ ID NO: 638298 - DNA, 25 bp, Mus musculus
gggcttgcctaactaaattatattc

SEQ ID NO: 638299 - DNA, 25 bp, Mus musculus
gggcttgcctaagtaaattatattc

SEQ ID NO: 638300 - DNA, 25 bp, Mus musculus
gggcttgcctttatgccaggctctt

SEQ ID NO: 638301 - DNA, 25 bp, Mus musculus
gggcttgcctttattccttcagcgc

SEQ ID NO: 638302 - DNA, 25 bp, Mus musculus
gggcttgcctttcaatgctatagca

SEQ ID NO: 638303 - DNA, 25 bp, Mus musculus
gggcttgcctttgaatgctatagca

SEQ ID NO: 638304 - DNA, 25 bp, Mus musculus
gggcttgcctttttgccaggctctt

SEQ ID NO: 638305 - DNA, 25 bp, Mus musculus
gggcttgccttttttccttcagcgc

SEQ ID NO: 638306 - DNA, 25 bp, Mus musculus
gggcttgctgacaagcctcaagacc

SEQ ID NO: 638307 - DNA, 25 bp, Mus musculus
gggcttgctgactagcctcaagacc

SEQ ID NO: 638308 - DNA, 25 bp, Mus musculus
gggcttgctgcaaaaggacaccttc

SEQ ID NO: 638309 - DNA, 25 bp, Mus musculus
gggcttgctgcataaggacaccttc

SEQ ID NO: 638310 - DNA, 25 bp, Mus musculus
gggcttgctgtcaaactctaaatca

SEQ ID NO: 638311 - DNA, 25 bp, Mus musculus
gggcttgctgtctaactctaaatca

SEQ ID NO: 638312 - DNA, 25 bp, Mus musculus
gggcttgcttagactgtagctcagt

SEQ ID NO: 638313 - DNA, 25 bp, Mus musculus
gggcttgcttagtctgtagctcagt

SEQ ID NO: 638314 - DNA, 25 bp, Mus musculus
gggcttggactactcttatgactta

SEQ ID NO: 638315 - DNA, 25 bp, Mus musculus
gggcttggactagtcttatgactta

SEQ ID NO: 638316 - DNA, 25 bp, Mus musculus
gggcttggcaaaaggaatctataga

SEQ ID NO: 638317 - DNA, 25 bp, Mus musculus
gggcttggcaaatggaatctataga

SEQ ID NO: 638318 - DNA, 25 bp, Mus musculus
gggcttggcattatttgttggctat

SEQ ID NO: 638319 - DNA, 25 bp, Mus musculus
gggcttggcattttttgttggctat

SEQ ID NO: 638320 - DNA, 25 bp, Mus musculus
gggcttggctcaaacagctcaggaa

SEQ ID NO: 638321 - DNA, 25 bp, Mus musculus
gggcttggctcatacagctcaggaa

SEQ ID NO: 638322 - DNA, 25 bp, Mus musculus
gggcttggctccaacgctgcataaa

SEQ ID NO: 638323 - DNA, 25 bp, Mus musculus
gggcttggctcctacgctgcataaa

SEQ ID NO: 638324 - DNA, 25 bp, Mus musculus
gggcttggctctcgtgtagggatgg

SEQ ID NO: 638325 - DNA, 25 bp, Mus musculus
gggcttggctctggtgtagggatgg

SEQ ID NO: 638326 - DNA, 25 bp, Mus musculus
gggcttgggaaaatctgggattctt

SEQ ID NO: 638327 - DNA, 25 bp, Mus musculus
gggcttgggaaattctgggattctt

SEQ ID NO: 638328 - DNA, 25 bp, Mus musculus
gggcttgggatcatctaggagaatt

SEQ ID NO: 638329 - DNA, 25 bp, Mus musculus
gggcttgggatcttctaggagaatt

SEQ ID NO: 638330 - DNA, 25 bp, Mus musculus
gggcttgggcaaatgcttcatgcaa

SEQ ID NO: 638331 - DNA, 25 bp, Mus musculus
gggcttgggcaattgcttcatgcaa

SEQ ID NO: 638332 - DNA, 25 bp, Mus musculus
gggcttgggttcatgtcgtctacag

SEQ ID NO: 638333 - DNA, 25 bp, Mus musculus
gggcttgggttcttgtcgtctacag

SEQ ID NO: 638334 - DNA, 25 bp, Mus musculus
gggcttggttgtagttgctcacacc

SEQ ID NO: 638335 - DNA, 25 bp, Mus musculus
gggcttggttgttgttgctcacacc

SEQ ID NO: 638336 - DNA, 25 bp, Mus musculus
gggcttgtaaccaagattgtgtcat

SEQ ID NO: 638337 - DNA, 25 bp, Mus musculus
gggcttgtaaccataggtctatact

SEQ ID NO: 638338 - DNA, 25 bp, Mus musculus
gggcttgtaacctagattgtgtcat

SEQ ID NO: 638339 - DNA, 25 bp, Mus musculus
gggcttgtaaccttaggtctatact

SEQ ID NO: 638340 - DNA, 25 bp, Mus musculus
gggcttgtaccaacatcaccatggg

SEQ ID NO: 638341 - DNA, 25 bp, Mus musculus
gggcttgtaccaccttagcaccttc

SEQ ID NO: 638342 - DNA, 25 bp, Mus musculus
gggcttgtaccaccttgtgtagtat

SEQ ID NO: 638343 - DNA, 25 bp, Mus musculus
gggcttgtaccagcttagcaccttc

SEQ ID NO: 638344 - DNA, 25 bp, Mus musculus
gggcttgtaccagcttgtgtagtat

SEQ ID NO: 638345 - DNA, 25 bp, Mus musculus
gggcttgtaccatcatcaccatggg

SEQ ID NO: 638346 - DNA, 25 bp, Mus musculus
gggcttgtacttagctttagtagag

SEQ ID NO: 638347 - DNA, 25 bp, Mus musculus
gggcttgtactttgctttagtagag

SEQ ID NO: 638348 - DNA, 25 bp, Mus musculus
gggcttgtagaaactctttgtctct

SEQ ID NO: 638349 - DNA, 25 bp, Mus musculus
gggcttgtagaatctctttgtctct

SEQ ID NO: 638350 - DNA, 25 bp, Mus musculus
gggcttgtaggtagttttcattctt

SEQ ID NO: 638351 - DNA, 25 bp, Mus musculus
gggcttgtaggttgttttcattctt

SEQ ID NO: 638352 - DNA, 25 bp, Mus musculus
gggcttgtataaaccccacagtgtg

SEQ ID NO: 638353 - DNA, 25 bp, Mus musculus
gggcttgtataatccccacagtgtg

SEQ ID NO: 638354 - DNA, 25 bp, Mus musculus
gggcttgtcaccatagtctgatcaa

SEQ ID NO: 638355 - DNA, 25 bp, Mus musculus
gggcttgtcaccttagtctgatcaa

SEQ ID NO: 638356 - DNA, 25 bp, Mus musculus
gggcttgtccagataactccactga

SEQ ID NO: 638357 - DNA, 25 bp, Mus musculus
gggcttgtccagttaactccactga

SEQ ID NO: 638358 - DNA, 25 bp, Mus musculus
gggcttgtccccaggtttgctgtac

SEQ ID NO: 638359 - DNA, 25 bp, Mus musculus
gggcttgtcccctggtttgctgtac

SEQ ID NO: 638360 - DNA, 25 bp, Mus musculus
gggcttgtcgtaagtcgtggcacct

SEQ ID NO: 638361 - DNA, 25 bp, Mus musculus
gggcttgtcgtatgtcgtggcacct

SEQ ID NO: 638362 - DNA, 25 bp, Mus musculus
gggcttgtctaaaatgatacggcta

SEQ ID NO: 638363 - DNA, 25 bp, Mus musculus
gggcttgtctaatatgatacggcta

SEQ ID NO: 638364 - DNA, 25 bp, Mus musculus
gggcttgtctggattgtaacatttc

SEQ ID NO: 638365 - DNA, 25 bp, Mus musculus
gggcttgtctggtttgtaacatttc

SEQ ID NO: 638366 - DNA, 25 bp, Mus musculus
gggcttgtctgtcaagacgaccatg

SEQ ID NO: 638367 - DNA, 25 bp, Mus musculus
gggcttgtctgtgaagacgaccatg

SEQ ID NO: 638368 - DNA, 25 bp, Mus musculus
gggcttgtcttgatggttctgttca

SEQ ID NO: 638369 - DNA, 25 bp, Mus musculus
gggcttgtcttgttggttctgttca

SEQ ID NO: 638370 - DNA, 25 bp, Mus musculus
gggcttgtgaatacttctcctttag

SEQ ID NO: 638371 - DNA, 25 bp, Mus musculus
gggcttgtgaatataggtgcaataa

SEQ ID NO: 638372 - DNA, 25 bp, Mus musculus
gggcttgtgaattcttctcctttag

SEQ ID NO: 638373 - DNA, 25 bp, Mus musculus
gggcttgtgaatttaggtgcaataa

SEQ ID NO: 638374 - DNA, 25 bp, Mus musculus
gggcttgtgagccatgtttttaatc

SEQ ID NO: 638375 - DNA, 25 bp, Mus musculus
gggcttgtgagcgatgtttttaatc

SEQ ID NO: 638376 - DNA, 25 bp, Mus musculus
gggcttgtgcacatagtagaccctc

SEQ ID NO: 638377 - DNA, 25 bp, Mus musculus
gggcttgtgcacttagtagaccctc

SEQ ID NO: 638378 - DNA, 25 bp, Mus musculus
gggcttgtgggaattctcttctgca

SEQ ID NO: 638379 - DNA, 25 bp, Mus musculus
gggcttgtgggatttctcttctgca

SEQ ID NO: 638380 - DNA, 25 bp, Mus musculus
gggcttgtgggcacagttccacact

SEQ ID NO: 638381 - DNA, 25 bp, Mus musculus
gggcttgtgggctcagttccacact

SEQ ID NO: 638382 - DNA, 25 bp, Mus musculus
gggcttgtgtatattggatccttaa

SEQ ID NO: 638383 - DNA, 25 bp, Mus musculus
gggcttgtgtattttggatccttaa

SEQ ID NO: 638384 - DNA, 25 bp, Mus musculus
gggcttgtgtgcattccgagagaat

SEQ ID NO: 638385 - DNA, 25 bp, Mus musculus
gggcttgtgtgctttccgagagaat

SEQ ID NO: 638386 - DNA, 25 bp, Mus musculus
gggcttgttagaaacctcacggatc

SEQ ID NO: 638387 - DNA, 25 bp, Mus musculus
gggcttgttagatacctcacggatc

SEQ ID NO: 638388 - DNA, 25 bp, Mus musculus
gggcttgttcagaatttcccgcaat

SEQ ID NO: 638389 - DNA, 25 bp, Mus musculus
gggcttgttcagtatttcccgcaat

SEQ ID NO: 638390 - DNA, 25 bp, Mus musculus
gggcttgttgccattcccctagatg

SEQ ID NO: 638391 - DNA, 25 bp, Mus musculus
gggcttgttgcctttcccctagatg

SEQ ID NO: 638392 - DNA, 25 bp, Mus musculus
gggcttgttgtgatacctgtaaaat

SEQ ID NO: 638393 - DNA, 25 bp, Mus musculus
gggcttgttgtgttacctgtaaaat

SEQ ID NO: 638394 - DNA, 25 bp, Mus musculus
gggcttgtttagcaggcacagaacc

SEQ ID NO: 638395 - DNA, 25 bp, Mus musculus
gggcttgtttaggaggcacagaacc

SEQ ID NO: 638396 - DNA, 25 bp, Mus musculus
gggcttgtttccctaagctacctgc

SEQ ID NO: 638397 - DNA, 25 bp, Mus musculus
gggcttgtttccgtaagctacctgc

SEQ ID NO: 638398 - DNA, 25 bp, Mus musculus
gggcttgtttctatcagggttttca

SEQ ID NO: 638399 - DNA, 25 bp, Mus musculus
gggcttgtttctttcagggttttca

SEQ ID NO: 638400 - DNA, 25 bp, Mus musculus
gggctttaacagatgctgctagtat

SEQ ID NO: 638401 - DNA, 25 bp, Mus musculus
gggctttaacagttgctgctagtat

SEQ ID NO: 638402 - DNA, 25 bp, Mus musculus
gggctttaattaatcctgttactat

SEQ ID NO: 638403 - DNA, 25 bp, Mus musculus
gggctttaattattcctgttactat

SEQ ID NO: 638404 - DNA, 25 bp, Mus musculus
gggctttacaatagtctggtgctta

SEQ ID NO: 638405 - DNA, 25 bp, Mus musculus
gggctttacaattgtctggtgctta

SEQ ID NO: 638406 - DNA, 25 bp, Mus musculus
gggctttacacgaggcaaactgcta

SEQ ID NO: 638407 - DNA, 25 bp, Mus musculus
gggctttacacgtggcaaactgcta

SEQ ID NO: 638408 - DNA, 25 bp, Mus musculus
gggctttacagtagcagtaaaccct

SEQ ID NO: 638409 - DNA, 25 bp, Mus musculus
gggctttacagttgcagtaaaccct

SEQ ID NO: 638410 - DNA, 25 bp, Mus musculus
gggctttacattaactgcaatcttt

SEQ ID NO: 638411 - DNA, 25 bp, Mus musculus
gggctttacatttactgcaatcttt

SEQ ID NO: 638412 - DNA, 25 bp, Mus musculus
gggctttacgttcacttgcaaggcc

SEQ ID NO: 638413 - DNA, 25 bp, Mus musculus
gggctttacgttgacttgcaaggcc

SEQ ID NO: 638414 - DNA, 25 bp, Mus musculus
gggctttagaagctctgtctcactt

SEQ ID NO: 638415 - DNA, 25 bp, Mus musculus
gggctttagaaggtctgtctcactt

SEQ ID NO: 638416 - DNA, 25 bp, Mus musculus
gggctttaggagctatgttttcatt

SEQ ID NO: 638417 - DNA, 25 bp, Mus musculus
gggctttaggaggtatgttttcatt

SEQ ID NO: 638418 - DNA, 25 bp, Mus musculus
gggctttatatcattgccaataatt

SEQ ID NO: 638419 - DNA, 25 bp, Mus musculus
gggctttatatctttgccaataatt

SEQ ID NO: 638420 - DNA, 25 bp, Mus musculus
gggctttatcatatggcgggtaccg

SEQ ID NO: 638421 - DNA, 25 bp, Mus musculus
gggctttatcatccagacaactgtt

SEQ ID NO: 638422 - DNA, 25 bp, Mus musculus
gggctttatcatgcagacaactgtt

SEQ ID NO: 638423 - DNA, 25 bp, Mus musculus
gggctttatcatttggcgggtaccg

SEQ ID NO: 638424 - DNA, 25 bp, Mus musculus
gggctttatcttattctcagtcgac

SEQ ID NO: 638425 - DNA, 25 bp, Mus musculus
gggctttatctttttctcagtcgac

SEQ ID NO: 638426 - DNA, 25 bp, Mus musculus
gggctttatgcaagctaaggacgag

SEQ ID NO: 638427 - DNA, 25 bp, Mus musculus
gggctttatgcacacctactatgaa

SEQ ID NO: 638428 - DNA, 25 bp, Mus musculus
gggctttatgcagacctactatgaa

SEQ ID NO: 638429 - DNA, 25 bp, Mus musculus
gggctttatgcatgctaaggacgag

SEQ ID NO: 638430 - DNA, 25 bp, Mus musculus
gggctttatgtacttgattccattt

SEQ ID NO: 638431 - DNA, 25 bp, Mus musculus
gggctttatgtagttgattccattt

SEQ ID NO: 638432 - DNA, 25 bp, Mus musculus
gggctttatgtgctagattttaaaa

SEQ ID NO: 638433 - DNA, 25 bp, Mus musculus
gggctttatgtggtagattttaaaa

SEQ ID NO: 638434 - DNA, 25 bp, Mus musculus
gggctttattcacgaccagtactgt

SEQ ID NO: 638435 - DNA, 25 bp, Mus musculus
gggctttattcaggaccagtactgt

SEQ ID NO: 638436 - DNA, 25 bp, Mus musculus
gggctttcaatcaggaattcactgg

SEQ ID NO: 638437 - DNA, 25 bp, Mus musculus
gggctttcaatctggaattcactgg

SEQ ID NO: 638438 - DNA, 25 bp, Mus musculus
gggctttcacatctgctttgagaca

SEQ ID NO: 638439 - DNA, 25 bp, Mus musculus
gggctttcacatgtgctttgagaca

SEQ ID NO: 638440 - DNA, 25 bp, Mus musculus
gggctttcagagaatgttccgtcat

SEQ ID NO: 638441 - DNA, 25 bp, Mus musculus
gggctttcagagtatgttccgtcat

SEQ ID NO: 638442 - DNA, 25 bp, Mus musculus
gggctttcagcccattgttaaggtg

SEQ ID NO: 638443 - DNA, 25 bp, Mus musculus
gggctttcagccgattgttaaggtg

SEQ ID NO: 638444 - DNA, 25 bp, Mus musculus
gggctttcatctcagtaattctctt

SEQ ID NO: 638445 - DNA, 25 bp, Mus musculus
gggctttcatctgagtaattctctt

SEQ ID NO: 638446 - DNA, 25 bp, Mus musculus
gggctttcattactttctctagcag

SEQ ID NO: 638447 - DNA, 25 bp, Mus musculus
gggctttcattagtttctctagcag

SEQ ID NO: 638448 - DNA, 25 bp, Mus musculus
gggctttcattcagacaagagcaga

SEQ ID NO: 638449 - DNA, 25 bp, Mus musculus
gggctttcattctgacaagagcaga

SEQ ID NO: 638450 - DNA, 25 bp, Mus musculus
gggctttccaaacaccagtgggatt

SEQ ID NO: 638451 - DNA, 25 bp, Mus musculus
gggctttccaaagaccagtgggatt

SEQ ID NO: 638452 - DNA, 25 bp, Mus musculus
gggctttccacaagttactcctctg

SEQ ID NO: 638453 - DNA, 25 bp, Mus musculus
gggctttccacatgttactcctctg

SEQ ID NO: 638454 - DNA, 25 bp, Mus musculus
gggctttccagaccgcactttgggt

SEQ ID NO: 638455 - DNA, 25 bp, Mus musculus
gggctttccagagcgcactttgggt

SEQ ID NO: 638456 - DNA, 25 bp, Mus musculus
gggctttccattagcataagctgct

SEQ ID NO: 638457 - DNA, 25 bp, Mus musculus
gggctttccatttgcataagctgct

SEQ ID NO: 638458 - DNA, 25 bp, Mus musculus
gggctttccctgagagcatgaaggc

SEQ ID NO: 638459 - DNA, 25 bp, Mus musculus
gggctttccctgtgagcatgaaggc

SEQ ID NO: 638460 - DNA, 25 bp, Mus musculus
gggctttcctaactctattctgtat

SEQ ID NO: 638461 - DNA, 25 bp, Mus musculus
gggctttcctaagtctattctgtat

SEQ ID NO: 638462 - DNA, 25 bp, Mus musculus
gggctttccttaatgaggagcagaa

SEQ ID NO: 638463 - DNA, 25 bp, Mus musculus
gggctttccttattgaggagcagaa

SEQ ID NO: 638464 - DNA, 25 bp, Mus musculus
gggctttcgcagaggagacttcatt

SEQ ID NO: 638465 - DNA, 25 bp, Mus musculus
gggctttcgcagtggagacttcatt

SEQ ID NO: 638466 - DNA, 25 bp, Mus musculus
gggctttcggccagttggagtaata

SEQ ID NO: 638467 - DNA, 25 bp, Mus musculus
gggctttcggcctgttggagtaata

SEQ ID NO: 638468 - DNA, 25 bp, Mus musculus
gggctttctaagctttgtcagataa

SEQ ID NO: 638469 - DNA, 25 bp, Mus musculus
gggctttctaaggtttgtcagataa

SEQ ID NO: 638470 - DNA, 25 bp, Mus musculus
gggctttctagactttaaattgcct

SEQ ID NO: 638471 - DNA, 25 bp, Mus musculus
gggctttctagagtttaaattgcct

SEQ ID NO: 638472 - DNA, 25 bp, Mus musculus
gggctttctctcatcagcagaaaaa

SEQ ID NO: 638473 - DNA, 25 bp, Mus musculus
gggctttctctcattatatgccttt

SEQ ID NO: 638474 - DNA, 25 bp, Mus musculus
gggctttctctcttcagcagaaaaa

SEQ ID NO: 638475 - DNA, 25 bp, Mus musculus
gggctttctctctttatatgccttt

SEQ ID NO: 638476 - DNA, 25 bp, Mus musculus
gggctttctgacagactacagccat

SEQ ID NO: 638477 - DNA, 25 bp, Mus musculus
gggctttctgactgactacagccat

SEQ ID NO: 638478 - DNA, 25 bp, Mus musculus
gggctttctgagagctaggcaagct

SEQ ID NO: 638479 - DNA, 25 bp, Mus musculus
gggctttctgagtgctaggcaagct

SEQ ID NO: 638480 - DNA, 25 bp, Mus musculus
gggctttctgcaaactctgatgatt

SEQ ID NO: 638481 - DNA, 25 bp, Mus musculus
gggctttctgcatactctgatgatt

SEQ ID NO: 638482 - DNA, 25 bp, Mus musculus
gggctttctgctaagcgctgaaaat

SEQ ID NO: 638483 - DNA, 25 bp, Mus musculus
gggctttctgcttagcgctgaaaat

SEQ ID NO: 638484 - DNA, 25 bp, Mus musculus
gggctttctggaccaagcatctgga

SEQ ID NO: 638485 - DNA, 25 bp, Mus musculus
gggctttctggagcaagcatctgga

SEQ ID NO: 638486 - DNA, 25 bp, Mus musculus
gggctttctggtctttgttcgcact

SEQ ID NO: 638487 - DNA, 25 bp, Mus musculus
gggctttctggtgtttgttcgcact

SEQ ID NO: 638488 - DNA, 25 bp, Mus musculus
gggctttctgttatgggttttcctg

SEQ ID NO: 638489 - DNA, 25 bp, Mus musculus
gggctttctgttttgggttttcctg

SEQ ID NO: 638490 - DNA, 25 bp, Mus musculus
gggctttcttacaaacacacaaata

SEQ ID NO: 638491 - DNA, 25 bp, Mus musculus
gggctttcttacatcatcttttcaa

SEQ ID NO: 638492 - DNA, 25 bp, Mus musculus
gggctttcttactaacacacaaata

SEQ ID NO: 638493 - DNA, 25 bp, Mus musculus
gggctttcttacttcatcttttcaa

SEQ ID NO: 638494 - DNA, 25 bp, Mus musculus
gggctttcttatacatctactttat

SEQ ID NO: 638495 - DNA, 25 bp, Mus musculus
gggctttcttatatgctttacacat

SEQ ID NO: 638496 - DNA, 25 bp, Mus musculus
gggctttcttatcaagcatgtctga

SEQ ID NO: 638497 - DNA, 25 bp, Mus musculus
gggctttcttatgaagcatgtctga

SEQ ID NO: 638498 - DNA, 25 bp, Mus musculus
gggctttcttattcatctactttat

SEQ ID NO: 638499 - DNA, 25 bp, Mus musculus
gggctttcttatttgctttacacat

SEQ ID NO: 638500 - DNA, 25 bp, Mus musculus
gggctttcttgtcttcttagactga

SEQ ID NO: 638501 - DNA, 25 bp, Mus musculus
gggctttcttgtgttcttagactga

SEQ ID NO: 638502 - DNA, 25 bp, Mus musculus
gggctttgaaataacaccacctgtg

SEQ ID NO: 638503 - DNA, 25 bp, Mus musculus
gggctttgaaattacaccacctgtg

SEQ ID NO: 638504 - DNA, 25 bp, Mus musculus
gggctttgaaggatcaatgttttca

SEQ ID NO: 638505 - DNA, 25 bp, Mus musculus
gggctttgaaggttcaatgttttca

SEQ ID NO: 638506 - DNA, 25 bp, Mus musculus
gggctttgaataagcagcacggcca

SEQ ID NO: 638507 - DNA, 25 bp, Mus musculus
gggctttgaatactttcctatgcaa

SEQ ID NO: 638508 - DNA, 25 bp, Mus musculus
gggctttgaatagtttcctatgcaa

SEQ ID NO: 638509 - DNA, 25 bp, Mus musculus
gggctttgaatatgcagcacggcca

SEQ ID NO: 638510 - DNA, 25 bp, Mus musculus
gggctttgacaacgcttatgtggtc

SEQ ID NO: 638511 - DNA, 25 bp, Mus musculus
gggctttgacaaggcttatgtggtc

SEQ ID NO: 638512 - DNA, 25 bp, Mus musculus
gggctttgactgctgagaaactctg

SEQ ID NO: 638513 - DNA, 25 bp, Mus musculus
gggctttgactggtgagaaactctg

SEQ ID NO: 638514 - DNA, 25 bp, Mus musculus
gggctttgagaacgtttcattaatc

SEQ ID NO: 638515 - DNA, 25 bp, Mus musculus
gggctttgagaaggtttcattaatc

SEQ ID NO: 638516 - DNA, 25 bp, Mus musculus
gggctttgagagacctgaattccta

SEQ ID NO: 638517 - DNA, 25 bp, Mus musculus
gggctttgagagcttctgcattcta

SEQ ID NO: 638518 - DNA, 25 bp, Mus musculus
gggctttgagaggttctgcattcta

SEQ ID NO: 638519 - DNA, 25 bp, Mus musculus
gggctttgagagtcctgaattccta

SEQ ID NO: 638520 - DNA, 25 bp, Mus musculus
gggctttgagtgcattttcaatgtt

SEQ ID NO: 638521 - DNA, 25 bp, Mus musculus
gggctttgagtggattttcaatgtt

SEQ ID NO: 638522 - DNA, 25 bp, Mus musculus
gggctttgcaacacaaactattagt

SEQ ID NO: 638523 - DNA, 25 bp, Mus musculus
gggctttgcaactcaaactattagt

SEQ ID NO: 638524 - DNA, 25 bp, Mus musculus
gggctttgcagaaactcctggttga

SEQ ID NO: 638525 - DNA, 25 bp, Mus musculus
gggctttgcagacaaggttccacct

SEQ ID NO: 638526 - DNA, 25 bp, Mus musculus
gggctttgcagagaaggttccacct

SEQ ID NO: 638527 - DNA, 25 bp, Mus musculus
gggctttgcagatactcctggttga

SEQ ID NO: 638528 - DNA, 25 bp, Mus musculus
gggctttgccatagccgaatctttg

SEQ ID NO: 638529 - DNA, 25 bp, Mus musculus
gggctttgccattgccgaatctttg

SEQ ID NO: 638530 - DNA, 25 bp, Mus musculus
gggctttgctacacaacaaggaatg

SEQ ID NO: 638531 - DNA, 25 bp, Mus musculus
gggctttgctactcaacaaggaatg

SEQ ID NO: 638532 - DNA, 25 bp, Mus musculus
gggctttgctcaccttgtttagact

SEQ ID NO: 638533 - DNA, 25 bp, Mus musculus
gggctttgctcagcttgtttagact

SEQ ID NO: 638534 - DNA, 25 bp, Mus musculus
gggctttgctctactttgaaaaggg

SEQ ID NO: 638535 - DNA, 25 bp, Mus musculus
gggctttgctcttctttgaaaaggg

SEQ ID NO: 638536 - DNA, 25 bp, Mus musculus
gggctttgctggattctgcagtgct

SEQ ID NO: 638537 - DNA, 25 bp, Mus musculus
gggctttgctggtttctgcagtgct

SEQ ID NO: 638538 - DNA, 25 bp, Mus musculus
gggctttgctgtacttacatggcta

SEQ ID NO: 638539 - DNA, 25 bp, Mus musculus
gggctttgctgttcttacatggcta

SEQ ID NO: 638540 - DNA, 25 bp, Mus musculus
gggctttgctttcaggcacagagct

SEQ ID NO: 638541 - DNA, 25 bp, Mus musculus
gggctttgctttgaggcacagagct

SEQ ID NO: 638542 - DNA, 25 bp, Mus musculus
gggctttggacacaacggacagaac

SEQ ID NO: 638543 - DNA, 25 bp, Mus musculus
gggctttggacagaacggacagaac

SEQ ID NO: 638544 - DNA, 25 bp, Mus musculus
gggctttggcatacctaccctacat

SEQ ID NO: 638545 - DNA, 25 bp, Mus musculus
gggctttggcattcctaccctacat

SEQ ID NO: 638546 - DNA, 25 bp, Mus musculus
gggctttggctcatacatcagtgaa

SEQ ID NO: 638547 - DNA, 25 bp, Mus musculus
gggctttggctcttacatcagtgaa

SEQ ID NO: 638548 - DNA, 25 bp, Mus musculus
gggctttggcttcagtaacaattca

SEQ ID NO: 638549 - DNA, 25 bp, Mus musculus
gggctttggcttgagtaacaattca

SEQ ID NO: 638550 - DNA, 25 bp, Mus musculus
gggctttgtacaaactgtccttata

SEQ ID NO: 638551 - DNA, 25 bp, Mus musculus
gggctttgtacatactgtccttata

SEQ ID NO: 638552 - DNA, 25 bp, Mus musculus
gggctttgtagaagcaccactccgg

SEQ ID NO: 638553 - DNA, 25 bp, Mus musculus
gggctttgtagatgcaccactccgg

SEQ ID NO: 638554 - DNA, 25 bp, Mus musculus
gggctttgtagcagcctgaagacct

SEQ ID NO: 638555 - DNA, 25 bp, Mus musculus
gggctttgtagctgcctgaagacct

SEQ ID NO: 638556 - DNA, 25 bp, Mus musculus
gggctttgtagtatttgtttaatag

SEQ ID NO: 638557 - DNA, 25 bp, Mus musculus
gggctttgtagtttttgtttaatag

SEQ ID NO: 638558 - DNA, 25 bp, Mus musculus
gggctttgtatacctgtcctagact

SEQ ID NO: 638559 - DNA, 25 bp, Mus musculus
gggctttgtatagctgtcctagact

SEQ ID NO: 638560 - DNA, 25 bp, Mus musculus
gggctttgtccaacatatgccgaaa

SEQ ID NO: 638561 - DNA, 25 bp, Mus musculus
gggctttgtccatcatatgccgaaa

SEQ ID NO: 638562 - DNA, 25 bp, Mus musculus
gggctttgtctcatttgcaagtaag

SEQ ID NO: 638563 - DNA, 25 bp, Mus musculus
gggctttgtctcttttgcaagtaag

SEQ ID NO: 638564 - DNA, 25 bp, Mus musculus
gggctttgtgaaatcactcattggt

SEQ ID NO: 638565 - DNA, 25 bp, Mus musculus
gggctttgtgaattcactcattggt

SEQ ID NO: 638566 - DNA, 25 bp, Mus musculus
gggctttgtggcacaaaggtatgaa

SEQ ID NO: 638567 - DNA, 25 bp, Mus musculus
gggctttgtggctcaaaggtatgaa

SEQ ID NO: 638568 - DNA, 25 bp, Mus musculus
gggctttgtggtcgctgtactctac

SEQ ID NO: 638569 - DNA, 25 bp, Mus musculus
gggctttgtggtggctgtactctac

SEQ ID NO: 638570 - DNA, 25 bp, Mus musculus
gggctttgttcaaatgacacctctt

SEQ ID NO: 638571 - DNA, 25 bp, Mus musculus
gggctttgttcatatgacacctctt

SEQ ID NO: 638572 - DNA, 25 bp, Mus musculus
gggcttttaaaacattactcgcttg

SEQ ID NO: 638573 - DNA, 25 bp, Mus musculus
gggcttttaaaagattactcgcttg

SEQ ID NO: 638574 - DNA, 25 bp, Mus musculus
gggcttttaagcaaattctattttg

SEQ ID NO: 638575 - DNA, 25 bp, Mus musculus
gggcttttaagctaattctattttg

SEQ ID NO: 638576 - DNA, 25 bp, Mus musculus
gggcttttacaaatgacctagagac

SEQ ID NO: 638577 - DNA, 25 bp, Mus musculus
gggcttttacaattgacctagagac

SEQ ID NO: 638578 - DNA, 25 bp, Mus musculus
gggcttttacccactgaacatcttt

SEQ ID NO: 638579 - DNA, 25 bp, Mus musculus
gggcttttaccctctgaacatcttt

SEQ ID NO: 638580 - DNA, 25 bp, Mus musculus
gggcttttactcaagtattcggcag

SEQ ID NO: 638581 - DNA, 25 bp, Mus musculus
gggcttttactctagtattcggcag

SEQ ID NO: 638582 - DNA, 25 bp, Mus musculus
gggcttttagatcttgaactgacaa

SEQ ID NO: 638583 - DNA, 25 bp, Mus musculus
gggcttttagatgttgaactgacaa

SEQ ID NO: 638584 - DNA, 25 bp, Mus musculus
gggcttttcaaactgaatactgctt

SEQ ID NO: 638585 - DNA, 25 bp, Mus musculus
gggcttttcaaagtgaatactgctt

SEQ ID NO: 638586 - DNA, 25 bp, Mus musculus
gggcttttcaggaccagacgctgat

SEQ ID NO: 638587 - DNA, 25 bp, Mus musculus
gggcttttcaggtccagacgctgat

SEQ ID NO: 638588 - DNA, 25 bp, Mus musculus
gggcttttcagtccttgtaactcag

SEQ ID NO: 638589 - DNA, 25 bp, Mus musculus
gggcttttcagtgcttgtaactcag

SEQ ID NO: 638590 - DNA, 25 bp, Mus musculus
gggcttttccaaatttcaggacaga

SEQ ID NO: 638591 - DNA, 25 bp, Mus musculus
gggcttttccaattttcaggacaga

SEQ ID NO: 638592 - DNA, 25 bp, Mus musculus
gggcttttcctgatgcattattcta

SEQ ID NO: 638593 - DNA, 25 bp, Mus musculus
gggcttttcctgttgcattattcta

SEQ ID NO: 638594 - DNA, 25 bp, Mus musculus
gggcttttcggcattgtgctaatac

SEQ ID NO: 638595 - DNA, 25 bp, Mus musculus
gggcttttcggctttgtgctaatac

SEQ ID NO: 638596 - DNA, 25 bp, Mus musculus
gggcttttcgtaattcattctgtct

SEQ ID NO: 638597 - DNA, 25 bp, Mus musculus
gggcttttcgtatttcattctgtct

SEQ ID NO: 638598 - DNA, 25 bp, Mus musculus
gggcttttctatccattacaggaca

SEQ ID NO: 638599 - DNA, 25 bp, Mus musculus
gggcttttctatgcattacaggaca

SEQ ID NO: 638600 - DNA, 25 bp, Mus musculus
gggcttttctcaagcaaaactgcaa

SEQ ID NO: 638601 - DNA, 25 bp, Mus musculus
gggcttttctcatgcaaaactgcaa

SEQ ID NO: 638602 - DNA, 25 bp, Mus musculus
gggcttttctctacccagctccatt

SEQ ID NO: 638603 - DNA, 25 bp, Mus musculus
gggcttttctcttcccagctccatt

SEQ ID NO: 638604 - DNA, 25 bp, Mus musculus
gggcttttcttccatagtctattct

SEQ ID NO: 638605 - DNA, 25 bp, Mus musculus
gggcttttcttcgatagtctattct

SEQ ID NO: 638606 - DNA, 25 bp, Mus musculus
gggcttttgaacaagaatcacatcc

SEQ ID NO: 638607 - DNA, 25 bp, Mus musculus
gggcttttgaactagaatcacatcc

SEQ ID NO: 638608 - DNA, 25 bp, Mus musculus
gggcttttgaatccaacattccata

SEQ ID NO: 638609 - DNA, 25 bp, Mus musculus
gggcttttgaatgcaacattccata

SEQ ID NO: 638610 - DNA, 25 bp, Mus musculus
gggcttttgcctagtgcattaacta

SEQ ID NO: 638611 - DNA, 25 bp, Mus musculus
gggcttttgcctatagggagatcat

SEQ ID NO: 638612 - DNA, 25 bp, Mus musculus
gggcttttgccttgtgcattaacta

SEQ ID NO: 638613 - DNA, 25 bp, Mus musculus
gggcttttgcctttagggagatcat

SEQ ID NO: 638614 - DNA, 25 bp, Mus musculus
gggcttttgcgcagaaggatgacca

SEQ ID NO: 638615 - DNA, 25 bp, Mus musculus
gggcttttgcgctgaaggatgacca

SEQ ID NO: 638616 - DNA, 25 bp, Mus musculus
gggcttttgctactttaatcctctc

SEQ ID NO: 638617 - DNA, 25 bp, Mus musculus
gggcttttgctagtttaatcctctc

SEQ ID NO: 638618 - DNA, 25 bp, Mus musculus
gggcttttggcaaaatctgttctaa

SEQ ID NO: 638619 - DNA, 25 bp, Mus musculus
gggcttttggcataatctgttctaa

SEQ ID NO: 638620 - DNA, 25 bp, Mus musculus
gggcttttgtaacttcacaggtgtg

SEQ ID NO: 638621 - DNA, 25 bp, Mus musculus
gggcttttgtaagttcacaggtgtg

SEQ ID NO: 638622 - DNA, 25 bp, Mus musculus
gggcttttgttgacacttgctgtgc

SEQ ID NO: 638623 - DNA, 25 bp, Mus musculus
gggcttttgttgtcacttgctgtgc

SEQ ID NO: 638624 - DNA, 25 bp, Mus musculus
gggctttttaacacttatatgcata

SEQ ID NO: 638625 - DNA, 25 bp, Mus musculus
gggctttttaactcttatatgcata

SEQ ID NO: 638626 - DNA, 25 bp, Mus musculus
gggctttttcacatcactttgcagt

SEQ ID NO: 638627 - DNA, 25 bp, Mus musculus
gggctttttcacttcactttgcagt

SEQ ID NO: 638628 - DNA, 25 bp, Mus musculus
gggctttttctcaacatctggctcc

SEQ ID NO: 638629 - DNA, 25 bp, Mus musculus
gggctttttctctacatctggctcc

SEQ ID NO: 638630 - DNA, 25 bp, Mus musculus
gggctttttgatcaaaccaccaggg

SEQ ID NO: 638631 - DNA, 25 bp, Mus musculus
gggctttttgatgaaaccaccaggg

SEQ ID NO: 638632 - DNA, 25 bp, Mus musculus
gggctttttgccctcgttcctagag

SEQ ID NO: 638633 - DNA, 25 bp, Mus musculus
gggctttttgccgtcgttcctagag

SEQ ID NO: 638634 - DNA, 25 bp, Mus musculus
ggggaacttagtaaggcagctcctg

SEQ ID NO: 638635 - DNA, 25 bp, Mus musculus
ggggaacttagttaggcagctcctg

SEQ ID NO: 638636 - DNA, 25 bp, Mus musculus
ggggacaaatgtcagttgcctctgc

SEQ ID NO: 638637 - DNA, 25 bp, Mus musculus
ggggacaaatgtgagttgcctctgc

SEQ ID NO: 638638 - DNA, 25 bp, Mus musculus
ggggacggggctagacactacagag

SEQ ID NO: 638639 - DNA, 25 bp, Mus musculus
ggggacggggcttgacactacagag

SEQ ID NO: 638640 - DNA, 25 bp, Mus musculus
ggggagaagctacgagcaccccact

SEQ ID NO: 638641 - DNA, 25 bp, Mus musculus
ggggagaagctaggagcaccccact

SEQ ID NO: 638642 - DNA, 25 bp, Mus musculus
ggggagactctcattcaagtacatg

SEQ ID NO: 638643 - DNA, 25 bp, Mus musculus
ggggagactctctttcaagtacatg

SEQ ID NO: 638644 - DNA, 25 bp, Mus musculus
ggggattcccatatctgcattgcaa

SEQ ID NO: 638645 - DNA, 25 bp, Mus musculus
ggggattcccatttctgcattgcaa

SEQ ID NO: 638646 - DNA, 25 bp, Mus musculus
ggggattctaatatgggttgctaag

SEQ ID NO: 638647 - DNA, 25 bp, Mus musculus
ggggattctaatttgggttgctaag

SEQ ID NO: 638648 - DNA, 25 bp, Mus musculus
ggggatttagctcagtggtagagcg

SEQ ID NO: 638649 - DNA, 25 bp, Mus musculus
ggggatttagctgagtggtagagcg

SEQ ID NO: 638650 - DNA, 25 bp, Mus musculus
ggggcacttgggactattgacattg

SEQ ID NO: 638651 - DNA, 25 bp, Mus musculus
ggggcacttgggtctattgacattg

SEQ ID NO: 638652 - DNA, 25 bp, Mus musculus
ggggcccctaggactgaggaacatt

SEQ ID NO: 638653 - DNA, 25 bp, Mus musculus
ggggcccctaggtctgaggaacatt

SEQ ID NO: 638654 - DNA, 25 bp, Mus musculus
ggggcggcagtacctgctgaggcca

SEQ ID NO: 638655 - DNA, 25 bp, Mus musculus
ggggcggcagtagctgctgaggcca

SEQ ID NO: 638656 - DNA, 25 bp, Mus musculus
ggggctcaaggactgtgcaaaccaa

SEQ ID NO: 638657 - DNA, 25 bp, Mus musculus
ggggctcaaggagtgtgcaaaccaa

SEQ ID NO: 638658 - DNA, 25 bp, Mus musculus
ggggctcagttgacagaatacttgc

SEQ ID NO: 638659 - DNA, 25 bp, Mus musculus
ggggctcagttgtcagaatacttgc

SEQ ID NO: 638660 - DNA, 25 bp, Mus musculus
ggggctgcatttactttcttagagt

SEQ ID NO: 638661 - DNA, 25 bp, Mus musculus
ggggctgcattttctttcttagagt

SEQ ID NO: 638662 - DNA, 25 bp, Mus musculus
ggggcttcgggtcctggacttaggc

SEQ ID NO: 638663 - DNA, 25 bp, Mus musculus
ggggcttcgggtgctggacttaggc

SEQ ID NO: 638664 - DNA, 25 bp, Mus musculus
ggggctttcaaacttgtgtatatct

SEQ ID NO: 638665 - DNA, 25 bp, Mus musculus
ggggctttcaaagttgtgtatatct

SEQ ID NO: 638666 - DNA, 25 bp, Mus musculus
gggggagtctggccattttaatcat

SEQ ID NO: 638667 - DNA, 25 bp, Mus musculus
gggggagtctgggcattttaatcat

SEQ ID NO: 638668 - DNA, 25 bp, Mus musculus
gggggcagcggcacccagatcaact

SEQ ID NO: 638669 - DNA, 25 bp, Mus musculus
gggggcagcggctcccagatcaact

SEQ ID NO: 638670 - DNA, 25 bp, Mus musculus
gggggcgtcgtcaaaccatcaccac

SEQ ID NO: 638671 - DNA, 25 bp, Mus musculus
gggggcgtcgtctaaccatcaccac

SEQ ID NO: 638672 - DNA, 25 bp, Mus musculus
ggggggcccagcaaggtcattcttg

SEQ ID NO: 638673 - DNA, 25 bp, Mus musculus
ggggggcccagctaggtcattcttg

SEQ ID NO: 638674 - DNA, 25 bp, Mus musculus
ggggggtaagcccattatataacat

SEQ ID NO: 638675 - DNA, 25 bp, Mus musculus
ggggggtaagccgattatataacat

SEQ ID NO: 638676 - DNA, 25 bp, Mus musculus
ggggtaatcatgctcatagtgtttc

SEQ ID NO: 638677 - DNA, 25 bp, Mus musculus
ggggtaatcatggtcatagtgtttc

SEQ ID NO: 638678 - DNA, 25 bp, Mus musculus
ggggtcgaaggcacatactctcctt

SEQ ID NO: 638679 - DNA, 25 bp, Mus musculus
ggggtcgaaggctcatactctcctt

SEQ ID NO: 638680 - DNA, 25 bp, Mus musculus
ggggtgggtcataacatgctatctt

SEQ ID NO: 638681 - DNA, 25 bp, Mus musculus
ggggtgggtcattacatgctatctt

SEQ ID NO: 638682 - DNA, 25 bp, Mus musculus
ggggttgtctaacgaaaagctctga

SEQ ID NO: 638683 - DNA, 25 bp, Mus musculus
ggggttgtctaaggaaaagctctga

SEQ ID NO: 638684 - DNA, 25 bp, Mus musculus
gggtaaaaagagatccaagccaaca

SEQ ID NO: 638685 - DNA, 25 bp, Mus musculus
gggtaaaaagagttccaagccaaca

SEQ ID NO: 638686 - DNA, 25 bp, Mus musculus
gggtaaaacacaactctgccctcag

SEQ ID NO: 638687 - DNA, 25 bp, Mus musculus
gggtaaaacacatctctgccctcag

SEQ ID NO: 638688 - DNA, 25 bp, Mus musculus
gggtaaaacgttagcctggctcact

SEQ ID NO: 638689 - DNA, 25 bp, Mus musculus
gggtaaaacgtttgcctggctcact

SEQ ID NO: 638690 - DNA, 25 bp, Mus musculus
gggtaaaagcctctaagcctcaaga

SEQ ID NO: 638691 - DNA, 25 bp, Mus musculus
gggtaaaagcctgtaagcctcaaga

SEQ ID NO: 638692 - DNA, 25 bp, Mus musculus
gggtaaaagcgtcgactgactgcat

SEQ ID NO: 638693 - DNA, 25 bp, Mus musculus
gggtaaaagcgtggactgactgcat

SEQ ID NO: 638694 - DNA, 25 bp, Mus musculus
gggtaaaagctcacacttcttgtgg

SEQ ID NO: 638695 - DNA, 25 bp, Mus musculus
gggtaaaagctctcacttcttgtgg

SEQ ID NO: 638696 - DNA, 25 bp, Mus musculus
gggtaaaatataagcctggtgggtt

SEQ ID NO: 638697 - DNA, 25 bp, Mus musculus
gggtaaaatatatgcctggtgggtt

SEQ ID NO: 638698 - DNA, 25 bp, Mus musculus
gggtaaaatcctcaggctctgcacg

SEQ ID NO: 638699 - DNA, 25 bp, Mus musculus
gggtaaaatcctgaggctctgcacg

SEQ ID NO: 638700 - DNA, 25 bp, Mus musculus
gggtaaacagttatatcatggacaa

SEQ ID NO: 638701 - DNA, 25 bp, Mus musculus
gggtaaacagttttatcatggacaa

SEQ ID NO: 638702 - DNA, 25 bp, Mus musculus
gggtaaaccaagactgatcttttgt

SEQ ID NO: 638703 - DNA, 25 bp, Mus musculus
gggtaaaccaagtctgatcttttgt

SEQ ID NO: 638704 - DNA, 25 bp, Mus musculus
gggtaaacctagatcctcacattct

SEQ ID NO: 638705 - DNA, 25 bp, Mus musculus
gggtaaacctagttcctcacattct

SEQ ID NO: 638706 - DNA, 25 bp, Mus musculus
gggtaaagccagagccagcaataac

SEQ ID NO: 638707 - DNA, 25 bp, Mus musculus
gggtaaagccagtgccagcaataac

SEQ ID NO: 638708 - DNA, 25 bp, Mus musculus
gggtaaaggcacatatctccaaggt

SEQ ID NO: 638709 - DNA, 25 bp, Mus musculus
gggtaaaggcacttatctccaaggt

SEQ ID NO: 638710 - DNA, 25 bp, Mus musculus
gggtaaaggcagcatgggctccagg

SEQ ID NO: 638711 - DNA, 25 bp, Mus musculus
gggtaaaggcaggatgggctccagg

SEQ ID NO: 638712 - DNA, 25 bp, Mus musculus
gggtaaaggtgtatgcctgccacat

SEQ ID NO: 638713 - DNA, 25 bp, Mus musculus
gggtaaaggtgtttgcctgccacat

SEQ ID NO: 638714 - DNA, 25 bp, Mus musculus
gggtaaagtcacctgccatcaagcc

SEQ ID NO: 638715 - DNA, 25 bp, Mus musculus
gggtaaagtcacgtgccatcaagcc

SEQ ID NO: 638716 - DNA, 25 bp, Mus musculus
gggtaaagtcttcaaagcctacaga

SEQ ID NO: 638717 - DNA, 25 bp, Mus musculus
gggtaaagtcttgaaagcctacaga

SEQ ID NO: 638718 - DNA, 25 bp, Mus musculus
gggtaaagttccatgctgcaaagca

SEQ ID NO: 638719 - DNA, 25 bp, Mus musculus
gggtaaagttccttgctgcaaagca

SEQ ID NO: 638720 - DNA, 25 bp, Mus musculus
gggtaaataatgctaactgtcctac

SEQ ID NO: 638721 - DNA, 25 bp, Mus musculus
gggtaaataatggtaactgtcctac

SEQ ID NO: 638722 - DNA, 25 bp, Mus musculus
gggtaaatagtcactcccactagta

SEQ ID NO: 638723 - DNA, 25 bp, Mus musculus
gggtaaatagtctctcccactagta

SEQ ID NO: 638724 - DNA, 25 bp, Mus musculus
gggtaaatataacatcccatgcttt

SEQ ID NO: 638725 - DNA, 25 bp, Mus musculus
gggtaaatataagatcccatgcttt

SEQ ID NO: 638726 - DNA, 25 bp, Mus musculus
gggtaaatcactcatgatcatacaa

SEQ ID NO: 638727 - DNA, 25 bp, Mus musculus
gggtaaatcactgatgatcatacaa

SEQ ID NO: 638728 - DNA, 25 bp, Mus musculus
gggtaaatggatcgactgtctagct

SEQ ID NO: 638729 - DNA, 25 bp, Mus musculus
gggtaaatggatggactgtctagct

SEQ ID NO: 638730 - DNA, 25 bp, Mus musculus
gggtaaatggcccaagtctcttttg

SEQ ID NO: 638731 - DNA, 25 bp, Mus musculus
gggtaaatggccgaagtctcttttg

SEQ ID NO: 638732 - DNA, 25 bp, Mus musculus
gggtaaattccaatgtatcgtctcc

SEQ ID NO: 638733 - DNA, 25 bp, Mus musculus
gggtaaattccattgtatcgtctcc

SEQ ID NO: 638734 - DNA, 25 bp, Mus musculus
gggtaacaaaccatggatctctctt

SEQ ID NO: 638735 - DNA, 25 bp, Mus musculus
gggtaacaaaccttggatctctctt

SEQ ID NO: 638736 - DNA, 25 bp, Mus musculus
gggtaacaatagcacataattcctt

SEQ ID NO: 638737 - DNA, 25 bp, Mus musculus
gggtaacaataggacataattcctt

SEQ ID NO: 638738 - DNA, 25 bp, Mus musculus
gggtaacacacaacatcatccatgg

SEQ ID NO: 638739 - DNA, 25 bp, Mus musculus
gggtaacacacatcatcatccatgg

SEQ ID NO: 638740 - DNA, 25 bp, Mus musculus
gggtaacacaggatctggcaggaaa

SEQ ID NO: 638741 - DNA, 25 bp, Mus musculus
gggtaacacaggttctggcaggaaa

SEQ ID NO: 638742 - DNA, 25 bp, Mus musculus
gggtaacacccaacacttggtgtca

SEQ ID NO: 638743 - DNA, 25 bp, Mus musculus
gggtaacacccatcacttggtgtca

SEQ ID NO: 638744 - DNA, 25 bp, Mus musculus
gggtaacactaaactctccaaacac

SEQ ID NO: 638745 - DNA, 25 bp, Mus musculus
gggtaacactaatctctccaaacac

SEQ ID NO: 638746 - DNA, 25 bp, Mus musculus
gggtaacagagtatttctcttattg

SEQ ID NO: 638747 - DNA, 25 bp, Mus musculus
gggtaacagagtttttctcttattg

SEQ ID NO: 638748 - DNA, 25 bp, Mus musculus
gggtaacagcatccgcacgctcatc

SEQ ID NO: 638749 - DNA, 25 bp, Mus musculus
gggtaacagcatgcgcacgctcatc

SEQ ID NO: 638750 - DNA, 25 bp, Mus musculus
gggtaacaggacaccagctggctta

SEQ ID NO: 638751 - DNA, 25 bp, Mus musculus
gggtaacaggactccagctggctta

SEQ ID NO: 638752 - DNA, 25 bp, Mus musculus
gggtaacaggctagcagcactgcac

SEQ ID NO: 638753 - DNA, 25 bp, Mus musculus
gggtaacaggcttgcagcactgcac

SEQ ID NO: 638754 - DNA, 25 bp, Mus musculus
gggtaacaggtaagcccgtgtctgc

SEQ ID NO: 638755 - DNA, 25 bp, Mus musculus
gggtaacaggtatgcccgtgtctgc

SEQ ID NO: 638756 - DNA, 25 bp, Mus musculus
gggtaacaggttaatccgagatgat

SEQ ID NO: 638757 - DNA, 25 bp, Mus musculus
gggtaacaggtttatccgagatgat

SEQ ID NO: 638758 - DNA, 25 bp, Mus musculus
gggtaacattgtacatcttactggt

SEQ ID NO: 638759 - DNA, 25 bp, Mus musculus
gggtaacattgttcatcttactggt

SEQ ID NO: 638760 - DNA, 25 bp, Mus musculus
gggtaaccaaccatgcatagattat

SEQ ID NO: 638761 - DNA, 25 bp, Mus musculus
gggtaaccaaccttgcatagattat

SEQ ID NO: 638762 - DNA, 25 bp, Mus musculus
gggtaaccaagtacctggtgccctg

SEQ ID NO: 638763 - DNA, 25 bp, Mus musculus
gggtaaccaagttcctggtgccctg

SEQ ID NO: 638764 - DNA, 25 bp, Mus musculus
gggtaaccacaaactacctgtactg

SEQ ID NO: 638765 - DNA, 25 bp, Mus musculus
gggtaaccacaacgatgctgaattc

SEQ ID NO: 638766 - DNA, 25 bp, Mus musculus
gggtaaccacaaggatgctgaattc

SEQ ID NO: 638767 - DNA, 25 bp, Mus musculus
gggtaaccacaatctacctgtactg

SEQ ID NO: 638768 - DNA, 25 bp, Mus musculus
gggtaaccagctcttgagcctagaa

SEQ ID NO: 638769 - DNA, 25 bp, Mus musculus
gggtaaccagctgttgagcctagaa

SEQ ID NO: 638770 - DNA, 25 bp, Mus musculus
gggtaacctggcactaggaccaggt

SEQ ID NO: 638771 - DNA, 25 bp, Mus musculus
gggtaacctggctctaggaccaggt

SEQ ID NO: 638772 - DNA, 25 bp, Mus musculus
gggtaactaaccatgcaggtctcta

SEQ ID NO: 638773 - DNA, 25 bp, Mus musculus
gggtaactaaccttgcaggtctcta

SEQ ID NO: 638774 - DNA, 25 bp, Mus musculus
gggtaactacgccaagcaggacaga

SEQ ID NO: 638775 - DNA, 25 bp, Mus musculus
gggtaactacgcgaagcaggacaga

SEQ ID NO: 638776 - DNA, 25 bp, Mus musculus
gggtaactactgagtgactcctaaa

SEQ ID NO: 638777 - DNA, 25 bp, Mus musculus
gggtaactactgtgtgactcctaaa

SEQ ID NO: 638778 - DNA, 25 bp, Mus musculus
gggtaactctgtctatcttggaact

SEQ ID NO: 638779 - DNA, 25 bp, Mus musculus
gggtaactctgtgtatcttggaact

SEQ ID NO: 638780 - DNA, 25 bp, Mus musculus
gggtaactgggcacgtccatattct

SEQ ID NO: 638781 - DNA, 25 bp, Mus musculus
gggtaactgggctcgtccatattct

SEQ ID NO: 638782 - DNA, 25 bp, Mus musculus
gggtaacttactactgagtatcact

SEQ ID NO: 638783 - DNA, 25 bp, Mus musculus
gggtaacttacttctgagtatcact

SEQ ID NO: 638784 - DNA, 25 bp, Mus musculus
gggtaacttattatctgcactgttc

SEQ ID NO: 638785 - DNA, 25 bp, Mus musculus
gggtaacttattttctgcactgttc

SEQ ID NO: 638786 - DNA, 25 bp, Mus musculus
gggtaacttcgccattgcacagcga

SEQ ID NO: 638787 - DNA, 25 bp, Mus musculus
gggtaacttcgcgattgcacagcga

SEQ ID NO: 638788 - DNA, 25 bp, Mus musculus
gggtaacttctacactagtggacat

SEQ ID NO: 638789 - DNA, 25 bp, Mus musculus
gggtaacttctagactagtggacat

SEQ ID NO: 638790 - DNA, 25 bp, Mus musculus
gggtaagacatcacacccatttcct

SEQ ID NO: 638791 - DNA, 25 bp, Mus musculus
gggtaagacatctcacccatttcct

SEQ ID NO: 638792 - DNA, 25 bp, Mus musculus
gggtaagacctaataatcagttcca

SEQ ID NO: 638793 - DNA, 25 bp, Mus musculus
gggtaagacctattaatcagttcca

SEQ ID NO: 638794 - DNA, 25 bp, Mus musculus
gggtaagactccatgggtgccagct

SEQ ID NO: 638795 - DNA, 25 bp, Mus musculus
gggtaagactccttgggtgccagct

SEQ ID NO: 638796 - DNA, 25 bp, Mus musculus
gggtaagactttccatggactcctg

SEQ ID NO: 638797 - DNA, 25 bp, Mus musculus
gggtaagactttgcatggactcctg

SEQ ID NO: 638798 - DNA, 25 bp, Mus musculus
gggtaagcctcaaatcttgtacttt

SEQ ID NO: 638799 - DNA, 25 bp, Mus musculus
gggtaagcctcatatcttgtacttt

SEQ ID NO: 638800 - DNA, 25 bp, Mus musculus
gggtaagctaacagaatgccttgaa

SEQ ID NO: 638801 - DNA, 25 bp, Mus musculus
gggtaagctaacagatccagtccat

SEQ ID NO: 638802 - DNA, 25 bp, Mus musculus
gggtaagctaactgaatgccttgaa

SEQ ID NO: 638803 - DNA, 25 bp, Mus musculus
gggtaagctaactgatccagtccat

SEQ ID NO: 638804 - DNA, 25 bp, Mus musculus
gggtaagctcgacacacttagatgt

SEQ ID NO: 638805 - DNA, 25 bp, Mus musculus
gggtaagctcgagacacttagatgt

SEQ ID NO: 638806 - DNA, 25 bp, Mus musculus
gggtaaggaccacttctacatactt

SEQ ID NO: 638807 - DNA, 25 bp, Mus musculus
gggtaaggaccagttctacatactt

SEQ ID NO: 638808 - DNA, 25 bp, Mus musculus
gggtaaggcagacgtgtccatccac

SEQ ID NO: 638809 - DNA, 25 bp, Mus musculus
gggtaaggcagaggtgtccatccac

SEQ ID NO: 638810 - DNA, 25 bp, Mus musculus
gggtaagggcttacatctcagtaat

SEQ ID NO: 638811 - DNA, 25 bp, Mus musculus
gggtaagggctttcatctcagtaat

SEQ ID NO: 638812 - DNA, 25 bp, Mus musculus
gggtaagggtccagactccagcagt

SEQ ID NO: 638813 - DNA, 25 bp, Mus musculus
gggtaagggtcctgactccagcagt

SEQ ID NO: 638814 - DNA, 25 bp, Mus musculus
gggtaaggtgacactctccagatcc

SEQ ID NO: 638815 - DNA, 25 bp, Mus musculus
gggtaaggtgactctctccagatcc

SEQ ID NO: 638816 - DNA, 25 bp, Mus musculus
gggtaaggtgccagccatccaatcc

SEQ ID NO: 638817 - DNA, 25 bp, Mus musculus
gggtaaggtgcctgccatccaatcc

SEQ ID NO: 638818 - DNA, 25 bp, Mus musculus
gggtaagtatgcatgtaacacacac

SEQ ID NO: 638819 - DNA, 25 bp, Mus musculus
gggtaagtatgcttgtaacacacac

SEQ ID NO: 638820 - DNA, 25 bp, Mus musculus
gggtaagtcacaattatgcctgctg

SEQ ID NO: 638821 - DNA, 25 bp, Mus musculus
gggtaagtcacatttatgcctgctg

SEQ ID NO: 638822 - DNA, 25 bp, Mus musculus
gggtaagtgaggcccttgcctgact

SEQ ID NO: 638823 - DNA, 25 bp, Mus musculus
gggtaagtgagggccttgcctgact

SEQ ID NO: 638824 - DNA, 25 bp, Mus musculus
gggtaagtgcttacttttagtgcat

SEQ ID NO: 638825 - DNA, 25 bp, Mus musculus
gggtaagtgctttcttttagtgcat

SEQ ID NO: 638826 - DNA, 25 bp, Mus musculus
gggtaagttcagaaccactgtccct

SEQ ID NO: 638827 - DNA, 25 bp, Mus musculus
gggtaagttcagtaccactgtccct

SEQ ID NO: 638828 - DNA, 25 bp, Mus musculus
gggtaagttgcgaatctgaatcatc

SEQ ID NO: 638829 - DNA, 25 bp, Mus musculus
gggtaagttgcgtatctgaatcatc

SEQ ID NO: 638830 - DNA, 25 bp, Mus musculus
gggtaataactcatataaacttgag

SEQ ID NO: 638831 - DNA, 25 bp, Mus musculus
gggtaataactcttataaacttgag

SEQ ID NO: 638832 - DNA, 25 bp, Mus musculus
gggtaatactatcccataagctaag

SEQ ID NO: 638833 - DNA, 25 bp, Mus musculus
gggtaatactatgccataagctaag

SEQ ID NO: 638834 - DNA, 25 bp, Mus musculus
gggtaatagcatcgacagctcagct

SEQ ID NO: 638835 - DNA, 25 bp, Mus musculus
gggtaatagcatcggctgctctccc

SEQ ID NO: 638836 - DNA, 25 bp, Mus musculus
gggtaatagcatggacagctcagct

SEQ ID NO: 638837 - DNA, 25 bp, Mus musculus
gggtaatagcatgggctgctctccc

SEQ ID NO: 638838 - DNA, 25 bp, Mus musculus
gggtaatcaatacttatggctttat

SEQ ID NO: 638839 - DNA, 25 bp, Mus musculus
gggtaatcaatagttatggctttat

SEQ ID NO: 638840 - DNA, 25 bp, Mus musculus
gggtaatcaccacggacttcttgcg

SEQ ID NO: 638841 - DNA, 25 bp, Mus musculus
gggtaatcaccagggacttcttgcg

SEQ ID NO: 638842 - DNA, 25 bp, Mus musculus
gggtaatccacaaatccatttctag

SEQ ID NO: 638843 - DNA, 25 bp, Mus musculus
gggtaatccacatatccatttctag

SEQ ID NO: 638844 - DNA, 25 bp, Mus musculus
gggtaatcccttccttgcgacccat

SEQ ID NO: 638845 - DNA, 25 bp, Mus musculus
gggtaatcccttgcttgcgacccat

SEQ ID NO: 638846 - DNA, 25 bp, Mus musculus
gggtaatccttgcaaatccagaaga

SEQ ID NO: 638847 - DNA, 25 bp, Mus musculus
gggtaatccttggaaatccagaaga

SEQ ID NO: 638848 - DNA, 25 bp, Mus musculus
gggtaatctgggagctgctgctcct

SEQ ID NO: 638849 - DNA, 25 bp, Mus musculus
gggtaatctgggtgctgctgctcct

SEQ ID NO: 638850 - DNA, 25 bp, Mus musculus
gggtaatctgtacttcacgaaatct

SEQ ID NO: 638851 - DNA, 25 bp, Mus musculus
gggtaatctgtagttcacgaaatct

SEQ ID NO: 638852 - DNA, 25 bp, Mus musculus
gggtaatgagcccttaatcgctgcc

SEQ ID NO: 638853 - DNA, 25 bp, Mus musculus
gggtaatgagccgttaatcgctgcc

SEQ ID NO: 638854 - DNA, 25 bp, Mus musculus
gggtaatgccgacgactcacctgac

SEQ ID NO: 638855 - DNA, 25 bp, Mus musculus
gggtaatgccgaggactcacctgac

SEQ ID NO: 638856 - DNA, 25 bp, Mus musculus
gggtaatgcctactgtttgctgatt

SEQ ID NO: 638857 - DNA, 25 bp, Mus musculus
gggtaatgcctagtgtttgctgatt

SEQ ID NO: 638858 - DNA, 25 bp, Mus musculus
gggtaatgcctcacattcctgacgt

SEQ ID NO: 638859 - DNA, 25 bp, Mus musculus
gggtaatgcctctcattcctgacgt

SEQ ID NO: 638860 - DNA, 25 bp, Mus musculus
gggtaatgcctgcaaacatagctaa

SEQ ID NO: 638861 - DNA, 25 bp, Mus musculus
gggtaatgcctggaaacatagctaa

SEQ ID NO: 638862 - DNA, 25 bp, Mus musculus
gggtaatggcaacttttctagaaca

SEQ ID NO: 638863 - DNA, 25 bp, Mus musculus
gggtaatggcaagttttctagaaca

SEQ ID NO: 638864 - DNA, 25 bp, Mus musculus
gggtaatgtctgcatttcctggtac

SEQ ID NO: 638865 - DNA, 25 bp, Mus musculus
gggtaatgtctggatttcctggtac

SEQ ID NO: 638866 - DNA, 25 bp, Mus musculus
gggtaattacatcatcttccttccc

SEQ ID NO: 638867 - DNA, 25 bp, Mus musculus
gggtaattacatgatcttccttccc

SEQ ID NO: 638868 - DNA, 25 bp, Mus musculus
gggtaattaccaaagtccagtgttc

SEQ ID NO: 638869 - DNA, 25 bp, Mus musculus
gggtaattaccatagtccagtgttc

SEQ ID NO: 638870 - DNA, 25 bp, Mus musculus
gggtaattcagccaaagggcaattt

SEQ ID NO: 638871 - DNA, 25 bp, Mus musculus
gggtaattcagcgaaagggcaattt

SEQ ID NO: 638872 - DNA, 25 bp, Mus musculus
gggtaattctgactccatttttgat

SEQ ID NO: 638873 - DNA, 25 bp, Mus musculus
gggtaattctgagtccatttttgat

SEQ ID NO: 638874 - DNA, 25 bp, Mus musculus
gggtaattgcctacagatagcttct

SEQ ID NO: 638875 - DNA, 25 bp, Mus musculus
gggtaattgccttcagatagcttct

SEQ ID NO: 638876 - DNA, 25 bp, Mus musculus
gggtaatttatcaagcattaactta

SEQ ID NO: 638877 - DNA, 25 bp, Mus musculus
gggtaatttatctagcattaactta

SEQ ID NO: 638878 - DNA, 25 bp, Mus musculus
gggtaatttcacattgggaaacatg

SEQ ID NO: 638879 - DNA, 25 bp, Mus musculus
gggtaatttcactttgggaaacatg

SEQ ID NO: 638880 - DNA, 25 bp, Mus musculus
gggtaatttctcaagcttgctaaac

SEQ ID NO: 638881 - DNA, 25 bp, Mus musculus
gggtaatttctcatctctatattcc

SEQ ID NO: 638882 - DNA, 25 bp, Mus musculus
gggtaatttctctagcttgctaaac

SEQ ID NO: 638883 - DNA, 25 bp, Mus musculus
gggtaatttctcttctctatattcc

SEQ ID NO: 638884 - DNA, 25 bp, Mus musculus
gggtacaaacccaatgcaagacatt

SEQ ID NO: 638885 - DNA, 25 bp, Mus musculus
gggtacaaaccctatgcaagacatt

SEQ ID NO: 638886 - DNA, 25 bp, Mus musculus
gggtacaaacttaattcttctcaga

SEQ ID NO: 638887 - DNA, 25 bp, Mus musculus
gggtacaaacttcagcgttccaata

SEQ ID NO: 638888 - DNA, 25 bp, Mus musculus
gggtacaaacttgagcgttccaata

SEQ ID NO: 638889 - DNA, 25 bp, Mus musculus
gggtacaaactttattcttctcaga

SEQ ID NO: 638890 - DNA, 25 bp, Mus musculus
gggtacaaatcacactccagtttcc

SEQ ID NO: 638891 - DNA, 25 bp, Mus musculus
gggtacaaatcagactccagtttcc

SEQ ID NO: 638892 - DNA, 25 bp, Mus musculus
gggtacaaattgaaactcgatctaa

SEQ ID NO: 638893 - DNA, 25 bp, Mus musculus
gggtacaaattgtaactcgatctaa

SEQ ID NO: 638894 - DNA, 25 bp, Mus musculus
gggtacaaccctccacagatgaaca

SEQ ID NO: 638895 - DNA, 25 bp, Mus musculus
gggtacaaccctgcacagatgaaca

SEQ ID NO: 638896 - DNA, 25 bp, Mus musculus
gggtacaaccgcatatactcttttt

SEQ ID NO: 638897 - DNA, 25 bp, Mus musculus
gggtacaaccgcttatactcttttt

SEQ ID NO: 638898 - DNA, 25 bp, Mus musculus
gggtacaagcttagagtctcattgc

SEQ ID NO: 638899 - DNA, 25 bp, Mus musculus
gggtacaagctttgagtctcattgc

SEQ ID NO: 638900 - DNA, 25 bp, Mus musculus
gggtacaagggacacttcctagcca

SEQ ID NO: 638901 - DNA, 25 bp, Mus musculus
gggtacaagggagacttcctagcca

SEQ ID NO: 638902 - DNA, 25 bp, Mus musculus
gggtacaatcaaccatcacctttcc

SEQ ID NO: 638903 - DNA, 25 bp, Mus musculus
gggtacaatcaagcatcacctttcc

SEQ ID NO: 638904 - DNA, 25 bp, Mus musculus
gggtacaatctcatgtgtttcttaa

SEQ ID NO: 638905 - DNA, 25 bp, Mus musculus
gggtacaatctcttgtgtttcttaa

SEQ ID NO: 638906 - DNA, 25 bp, Mus musculus
gggtacaatgccagggacacgctgc

SEQ ID NO: 638907 - DNA, 25 bp, Mus musculus
gggtacaatgcctgggacacgctgc

SEQ ID NO: 638908 - DNA, 25 bp, Mus musculus
gggtacaatgggagcaacgtgacca

SEQ ID NO: 638909 - DNA, 25 bp, Mus musculus
gggtacaatgggagcttgcctatca

SEQ ID NO: 638910 - DNA, 25 bp, Mus musculus
gggtacaatgggtgcaacgtgacca

SEQ ID NO: 638911 - DNA, 25 bp, Mus musculus
gggtacaatgggtgcttgcctatca

SEQ ID NO: 638912 - DNA, 25 bp, Mus musculus
gggtacacacagagccccagagtta

SEQ ID NO: 638913 - DNA, 25 bp, Mus musculus
gggtacacacagtgccccagagtta

SEQ ID NO: 638914 - DNA, 25 bp, Mus musculus
gggtacacagcaccatgtatacaga

SEQ ID NO: 638915 - DNA, 25 bp, Mus musculus
gggtacacagcagcatgtatacaga

SEQ ID NO: 638916 - DNA, 25 bp, Mus musculus
gggtacacagcgaaacaacttacta

SEQ ID NO: 638917 - DNA, 25 bp, Mus musculus
gggtacacagcgtaacaacttacta

SEQ ID NO: 638918 - DNA, 25 bp, Mus musculus
gggtacacatgtaaacttcctttga

SEQ ID NO: 638919 - DNA, 25 bp, Mus musculus
gggtacacatgttaacttcctttga

SEQ ID NO: 638920 - DNA, 25 bp, Mus musculus
gggtacaccagaaaactctcagcag

SEQ ID NO: 638921 - DNA, 25 bp, Mus musculus
gggtacaccagataactctcagcag

SEQ ID NO: 638922 - DNA, 25 bp, Mus musculus
gggtacaccctcaactacaatgagt

SEQ ID NO: 638923 - DNA, 25 bp, Mus musculus
gggtacaccctctactacaatgagt

SEQ ID NO: 638924 - DNA, 25 bp, Mus musculus
gggtacacgctgataatgaagagca

SEQ ID NO: 638925 - DNA, 25 bp, Mus musculus
gggtacacgctgttaatgaagagca

SEQ ID NO: 638926 - DNA, 25 bp, Mus musculus
gggtacacgtgaaccccaaatatgt

SEQ ID NO: 638927 - DNA, 25 bp, Mus musculus
gggtacacgtgatccccaaatatgt

SEQ ID NO: 638928 - DNA, 25 bp, Mus musculus
gggtacactacccagcctgaaagat

SEQ ID NO: 638929 - DNA, 25 bp, Mus musculus
gggtacactaccgagcctgaaagat

SEQ ID NO: 638930 - DNA, 25 bp, Mus musculus
gggtacactataccttctccctcag

SEQ ID NO: 638931 - DNA, 25 bp, Mus musculus
gggtacactatagcttctccctcag

SEQ ID NO: 638932 - DNA, 25 bp, Mus musculus
gggtacactccaccatgctctggag

SEQ ID NO: 638933 - DNA, 25 bp, Mus musculus
gggtacactccagcatgctctggag

SEQ ID NO: 638934 - DNA, 25 bp, Mus musculus
gggtacactttcattttcaattgac

SEQ ID NO: 638935 - DNA, 25 bp, Mus musculus
gggtacactttctttttcaattgac

SEQ ID NO: 638936 - DNA, 25 bp, Mus musculus
gggtacagagacaagtgtgatcaaa

SEQ ID NO: 638937 - DNA, 25 bp, Mus musculus
gggtacagagactagtgtgatcaaa

SEQ ID NO: 638938 - DNA, 25 bp, Mus musculus
gggtacagaggacacttgatcctga

SEQ ID NO: 638939 - DNA, 25 bp, Mus musculus
gggtacagaggagacttgatcctga

SEQ ID NO: 638940 - DNA, 25 bp, Mus musculus
gggtacagaggtcacttgctctatg

SEQ ID NO: 638941 - DNA, 25 bp, Mus musculus
gggtacagaggtgacttgctctatg

SEQ ID NO: 638942 - DNA, 25 bp, Mus musculus
gggtacagatccctaaactacctct

SEQ ID NO: 638943 - DNA, 25 bp, Mus musculus
gggtacagatccgtaaactacctct

SEQ ID NO: 638944 - DNA, 25 bp, Mus musculus
gggtacagcaaacccttagcttgca

SEQ ID NO: 638945 - DNA, 25 bp, Mus musculus
gggtacagcaaagccttagcttgca

SEQ ID NO: 638946 - DNA, 25 bp, Mus musculus
gggtacagcagcctagcttacacta

SEQ ID NO: 638947 - DNA, 25 bp, Mus musculus
gggtacagcagcgtagcttacacta

SEQ ID NO: 638948 - DNA, 25 bp, Mus musculus
gggtacagccaaagaccggagcttt

SEQ ID NO: 638949 - DNA, 25 bp, Mus musculus
gggtacagccaatgaccggagcttt

SEQ ID NO: 638950 - DNA, 25 bp, Mus musculus
gggtacagccacagcctttacatgg

SEQ ID NO: 638951 - DNA, 25 bp, Mus musculus
gggtacagccactgcctttacatgg

SEQ ID NO: 638952 - DNA, 25 bp, Mus musculus
gggtacagctagagccacaacgctt

SEQ ID NO: 638953 - DNA, 25 bp, Mus musculus
gggtacagctagtgccacaacgctt

SEQ ID NO: 638954 - DNA, 25 bp, Mus musculus
gggtacaggaagatgactctcttaa

SEQ ID NO: 638955 - DNA, 25 bp, Mus musculus
gggtacaggaagttgactctcttaa

SEQ ID NO: 638956 - DNA, 25 bp, Mus musculus
gggtacaggagcagcttcaaattag

SEQ ID NO: 638957 - DNA, 25 bp, Mus musculus
gggtacaggagctgcttcaaattag

SEQ ID NO: 638958 - DNA, 25 bp, Mus musculus
gggtacaggctgaatgactacgtgt

SEQ ID NO: 638959 - DNA, 25 bp, Mus musculus
gggtacaggctgtatgactacgtgt

SEQ ID NO: 638960 - DNA, 25 bp, Mus musculus
gggtacaggcttataatttcagcta

SEQ ID NO: 638961 - DNA, 25 bp, Mus musculus
gggtacaggcttttaatttcagcta

SEQ ID NO: 638962 - DNA, 25 bp, Mus musculus
gggtacaggtcactaacttaagctt

SEQ ID NO: 638963 - DNA, 25 bp, Mus musculus
gggtacaggtcagtaacttaagctt

SEQ ID NO: 638964 - DNA, 25 bp, Mus musculus
gggtacagtctaagtcacctgttgt

SEQ ID NO: 638965 - DNA, 25 bp, Mus musculus
gggtacagtctatgtcacctgttgt

SEQ ID NO: 638966 - DNA, 25 bp, Mus musculus
gggtacagtgcacccacagtcactt

SEQ ID NO: 638967 - DNA, 25 bp, Mus musculus
gggtacagtgcagccacagtcactt

SEQ ID NO: 638968 - DNA, 25 bp, Mus musculus
gggtacataagcagttctccatttt

SEQ ID NO: 638969 - DNA, 25 bp, Mus musculus
gggtacataagctgttctccatttt

SEQ ID NO: 638970 - DNA, 25 bp, Mus musculus
gggtacatcaaaaccgtgcatttct

SEQ ID NO: 638971 - DNA, 25 bp, Mus musculus
gggtacatcaaatccgtgcatttct

SEQ ID NO: 638972 - DNA, 25 bp, Mus musculus
gggtacatcagaaattccgggcagt

SEQ ID NO: 638973 - DNA, 25 bp, Mus musculus
gggtacatcagatattccgggcagt

SEQ ID NO: 638974 - DNA, 25 bp, Mus musculus
gggtacatcagcacgtgaagcagtg

SEQ ID NO: 638975 - DNA, 25 bp, Mus musculus
gggtacatcagctcgtgaagcagtg

SEQ ID NO: 638976 - DNA, 25 bp, Mus musculus
gggtacatccacctcacggaagaca

SEQ ID NO: 638977 - DNA, 25 bp, Mus musculus
gggtacatccacgtcacggaagaca

SEQ ID NO: 638978 - DNA, 25 bp, Mus musculus
gggtacatccagaagcaagctcaga

SEQ ID NO: 638979 - DNA, 25 bp, Mus musculus
gggtacatccagtagcaagctcaga

SEQ ID NO: 638980 - DNA, 25 bp, Mus musculus
gggtacatctttcactgtctagaat

SEQ ID NO: 638981 - DNA, 25 bp, Mus musculus
gggtacatctttgactgtctagaat

SEQ ID NO: 638982 - DNA, 25 bp, Mus musculus
gggtacatgacaccccaaaagtcag

SEQ ID NO: 638983 - DNA, 25 bp, Mus musculus
gggtacatgacagcccaaaagtcag

SEQ ID NO: 638984 - DNA, 25 bp, Mus musculus
gggtacatgcacaactgcggaagct

SEQ ID NO: 638985 - DNA, 25 bp, Mus musculus
gggtacatgcactactgcggaagct

SEQ ID NO: 638986 - DNA, 25 bp, Mus musculus
gggtacatgccaagtccagaatctt

SEQ ID NO: 638987 - DNA, 25 bp, Mus musculus
gggtacatgccatgtccagaatctt

SEQ ID NO: 638988 - DNA, 25 bp, Mus musculus
gggtacatgctcacgatgtccttgt

SEQ ID NO: 638989 - DNA, 25 bp, Mus musculus
gggtacatgctctcgatgtccttgt

SEQ ID NO: 638990 - DNA, 25 bp, Mus musculus
gggtacatggtaatttcaggtcaag

SEQ ID NO: 638991 - DNA, 25 bp, Mus musculus
gggtacatggtattttcaggtcaag

SEQ ID NO: 638992 - DNA, 25 bp, Mus musculus
gggtacattcgcctctcaggtgaca

SEQ ID NO: 638993 - DNA, 25 bp, Mus musculus
gggtacattcgcgtctcaggtgaca

SEQ ID NO: 638994 - DNA, 25 bp, Mus musculus
gggtacattgtacagctcaactttt

SEQ ID NO: 638995 - DNA, 25 bp, Mus musculus
gggtacattgtactcttatgacttt

SEQ ID NO: 638996 - DNA, 25 bp, Mus musculus
gggtacattgtagagctcaactttt

SEQ ID NO: 638997 - DNA, 25 bp, Mus musculus
gggtacattgtagtcttatgacttt

SEQ ID NO: 638998 - DNA, 25 bp, Mus musculus
gggtaccaaatcacataacgaggat

SEQ ID NO: 638999 - DNA, 25 bp, Mus musculus
gggtaccaaatctcataacgaggat

SEQ ID NO: 639000 - DNA, 25 bp, Mus musculus
gggtaccaactgatgttaaccactg

SEQ ID NO: 639001 - DNA, 25 bp, Mus musculus
gggtaccaactgttgttaaccactg

SEQ ID NO: 639002 - DNA, 25 bp, Mus musculus
gggtaccaagccagactgggagaca

SEQ ID NO: 639003 - DNA, 25 bp, Mus musculus
gggtaccaagcctgactgggagaca

SEQ ID NO: 639004 - DNA, 25 bp, Mus musculus
gggtaccaatatcccatgggcagaa

SEQ ID NO: 639005 - DNA, 25 bp, Mus musculus
gggtaccaatatgccatgggcagaa

SEQ ID NO: 639006 - DNA, 25 bp, Mus musculus
gggtaccaatggcacttcacttttg

SEQ ID NO: 639007 - DNA, 25 bp, Mus musculus
gggtaccaatgggacttcacttttg

SEQ ID NO: 639008 - DNA, 25 bp, Mus musculus
gggtaccacagaaatagctcttgct

SEQ ID NO: 639009 - DNA, 25 bp, Mus musculus
gggtaccacagatatagctcttgct

SEQ ID NO: 639010 - DNA, 25 bp, Mus musculus
gggtaccacatcaggatcagcaaca

SEQ ID NO: 639011 - DNA, 25 bp, Mus musculus
gggtaccacatctggatcagcaaca

SEQ ID NO: 639012 - DNA, 25 bp, Mus musculus
gggtaccacatgcttctctaaaagg

SEQ ID NO: 639013 - DNA, 25 bp, Mus musculus
gggtaccacatggttctctaaaagg

SEQ ID NO: 639014 - DNA, 25 bp, Mus musculus
gggtaccagacacaacacatgttgc

SEQ ID NO: 639015 - DNA, 25 bp, Mus musculus
gggtaccagacagaacacatgttgc

SEQ ID NO: 639016 - DNA, 25 bp, Mus musculus
gggtaccagcctctatagatgctat

SEQ ID NO: 639017 - DNA, 25 bp, Mus musculus
gggtaccagcctgtatagatgctat

SEQ ID NO: 639018 - DNA, 25 bp, Mus musculus
gggtaccatacacactctgggctat

SEQ ID NO: 639019 - DNA, 25 bp, Mus musculus
gggtaccatacagactctgggctat

SEQ ID NO: 639020 - DNA, 25 bp, Mus musculus
gggtaccatgacagtacaacagtgt

SEQ ID NO: 639021 - DNA, 25 bp, Mus musculus
gggtaccatgactgtacaacagtgt

SEQ ID NO: 639022 - DNA, 25 bp, Mus musculus
gggtaccattacaacttgcaggaaa

SEQ ID NO: 639023 - DNA, 25 bp, Mus musculus
gggtaccattactacttgcaggaaa

SEQ ID NO: 639024 - DNA, 25 bp, Mus musculus
gggtaccattccatgttactgatca

SEQ ID NO: 639025 - DNA, 25 bp, Mus musculus
gggtaccattccttgttactgatca

SEQ ID NO: 639026 - DNA, 25 bp, Mus musculus
gggtacccagaacacattgtctgct

SEQ ID NO: 639027 - DNA, 25 bp, Mus musculus
gggtacccagaagacattgtctgct

SEQ ID NO: 639028 - DNA, 25 bp, Mus musculus
gggtacccaggacgcttattccaga

SEQ ID NO: 639029 - DNA, 25 bp, Mus musculus
gggtacccaggaggcttattccaga

SEQ ID NO: 639030 - DNA, 25 bp, Mus musculus
gggtaccctcttccagaaaacctgt

SEQ ID NO: 639031 - DNA, 25 bp, Mus musculus
gggtaccctcttgcagaaaacctgt

SEQ ID NO: 639032 - DNA, 25 bp, Mus musculus
gggtaccctgctaacagataaggca

SEQ ID NO: 639033 - DNA, 25 bp, Mus musculus
gggtaccctgcttacagataaggca

SEQ ID NO: 639034 - DNA, 25 bp, Mus musculus
gggtaccctgggactccagtgaaag

SEQ ID NO: 639035 - DNA, 25 bp, Mus musculus
gggtaccctgggtctccagtgaaag

SEQ ID NO: 639036 - DNA, 25 bp, Mus musculus
gggtaccctgtaagtcatgtgattt

SEQ ID NO: 639037 - DNA, 25 bp, Mus musculus
gggtaccctgtatgtcatgtgattt

SEQ ID NO: 639038 - DNA, 25 bp, Mus musculus
gggtacccttgactccaatagcaag

SEQ ID NO: 639039 - DNA, 25 bp, Mus musculus
gggtacccttgagtccaatagcaag

SEQ ID NO: 639040 - DNA, 25 bp, Mus musculus
gggtaccgatgcatgctctgtaaaa

SEQ ID NO: 639041 - DNA, 25 bp, Mus musculus
gggtaccgatgcttgctctgtaaaa

SEQ ID NO: 639042 - DNA, 25 bp, Mus musculus
gggtaccgcttaacaggagtctgac

SEQ ID NO: 639043 - DNA, 25 bp, Mus musculus
gggtaccgcttatcaggagtctgac

SEQ ID NO: 639044 - DNA, 25 bp, Mus musculus
gggtacctacccagcaagcagctgc

SEQ ID NO: 639045 - DNA, 25 bp, Mus musculus
gggtacctaccctgcaagcagctgc

SEQ ID NO: 639046 - DNA, 25 bp, Mus musculus
gggtacctagctaaccactgatgat

SEQ ID NO: 639047 - DNA, 25 bp, Mus musculus
gggtacctagcttaccactgatgat

SEQ ID NO: 639048 - DNA, 25 bp, Mus musculus
gggtacctaggtacaggccagaagc

SEQ ID NO: 639049 - DNA, 25 bp, Mus musculus
gggtacctaggttcaggccagaagc

SEQ ID NO: 639050 - DNA, 25 bp, Mus musculus
gggtacctccttctagtaagatctc

SEQ ID NO: 639051 - DNA, 25 bp, Mus musculus
gggtacctccttgtagtaagatctc

SEQ ID NO: 639052 - DNA, 25 bp, Mus musculus
gggtacctctcaaatgtaaccagga

SEQ ID NO: 639053 - DNA, 25 bp, Mus musculus
gggtacctctcatatgtaaccagga

SEQ ID NO: 639054 - DNA, 25 bp, Mus musculus
gggtacctgaagcagctctgtctct

SEQ ID NO: 639055 - DNA, 25 bp, Mus musculus
gggtacctgaaggagctctgtctct

SEQ ID NO: 639056 - DNA, 25 bp, Mus musculus
gggtacctgacaacgggcactaata

SEQ ID NO: 639057 - DNA, 25 bp, Mus musculus
gggtacctgacacaatctgctcctc

SEQ ID NO: 639058 - DNA, 25 bp, Mus musculus
gggtacctgacagaatctgctcctc

SEQ ID NO: 639059 - DNA, 25 bp, Mus musculus
gggtacctgacatcgggcactaata

SEQ ID NO: 639060 - DNA, 25 bp, Mus musculus
gggtacctgcttagagctccgtctc

SEQ ID NO: 639061 - DNA, 25 bp, Mus musculus
gggtacctgctttgagctccgtctc

SEQ ID NO: 639062 - DNA, 25 bp, Mus musculus
gggtacctggtaatgaaaatggaca

SEQ ID NO: 639063 - DNA, 25 bp, Mus musculus
gggtacctggtattgaaaatggaca

SEQ ID NO: 639064 - DNA, 25 bp, Mus musculus
gggtaccttaccaatctgatagtgc

SEQ ID NO: 639065 - DNA, 25 bp, Mus musculus
gggtaccttacctatctgatagtgc

SEQ ID NO: 639066 - DNA, 25 bp, Mus musculus
gggtacgagatgaccaaggcccact

SEQ ID NO: 639067 - DNA, 25 bp, Mus musculus
gggtacgagatgtccaaggcccact

SEQ ID NO: 639068 - DNA, 25 bp, Mus musculus
gggtacgagcctaaaacttgctctt

SEQ ID NO: 639069 - DNA, 25 bp, Mus musculus
gggtacgagccttaaacttgctctt

SEQ ID NO: 639070 - DNA, 25 bp, Mus musculus
gggtacgataacacacctatgatca

SEQ ID NO: 639071 - DNA, 25 bp, Mus musculus
gggtacgataactcacctatgatca

SEQ ID NO: 639072 - DNA, 25 bp, Mus musculus
gggtacgcatttaggactgttaagc

SEQ ID NO: 639073 - DNA, 25 bp, Mus musculus
gggtacgcattttggactgttaagc

SEQ ID NO: 639074 - DNA, 25 bp, Mus musculus
gggtacggacgactctgcaagccac

SEQ ID NO: 639075 - DNA, 25 bp, Mus musculus
gggtacggacgagtctgcaagccac

SEQ ID NO: 639076 - DNA, 25 bp, Mus musculus
gggtacgtagctcaacactgacaat

SEQ ID NO: 639077 - DNA, 25 bp, Mus musculus
gggtacgtagctgaacactgacaat

SEQ ID NO: 639078 - DNA, 25 bp, Mus musculus
gggtacgtgctcagttacattcaac

SEQ ID NO: 639079 - DNA, 25 bp, Mus musculus
gggtacgtgctctgttacattcaac

SEQ ID NO: 639080 - DNA, 25 bp, Mus musculus
gggtactaagtcctgtcatacacat

SEQ ID NO: 639081 - DNA, 25 bp, Mus musculus
gggtactaagtcgtgtcatacacat

SEQ ID NO: 639082 - DNA, 25 bp, Mus musculus
gggtactaccatcccaatgcggttt

SEQ ID NO: 639083 - DNA, 25 bp, Mus musculus
gggtactaccatgccaatgcggttt

SEQ ID NO: 639084 - DNA, 25 bp, Mus musculus
gggtactactagcactatgcctccc

SEQ ID NO: 639085 - DNA, 25 bp, Mus musculus
gggtactactaggactatgcctccc

SEQ ID NO: 639086 - DNA, 25 bp, Mus musculus
gggtactactgactcactgacacaa

SEQ ID NO: 639087 - DNA, 25 bp, Mus musculus
gggtactactgagtcactgacacaa

SEQ ID NO: 639088 - DNA, 25 bp, Mus musculus
gggtactacttgagattccggtgca

SEQ ID NO: 639089 - DNA, 25 bp, Mus musculus
gggtactacttgtgattccggtgca

SEQ ID NO: 639090 - DNA, 25 bp, Mus musculus
gggtactagtaccatgccatgaaaa

SEQ ID NO: 639091 - DNA, 25 bp, Mus musculus
gggtactagtacgatgccatgaaaa

SEQ ID NO: 639092 - DNA, 25 bp, Mus musculus
gggtactagtttattcacacctgaa

SEQ ID NO: 639093 - DNA, 25 bp, Mus musculus
gggtactagttttttcacacctgaa

SEQ ID NO: 639094 - DNA, 25 bp, Mus musculus
gggtactatcaactgaaagcagtat

SEQ ID NO: 639095 - DNA, 25 bp, Mus musculus
gggtactatcaagtgaaagcagtat

SEQ ID NO: 639096 - DNA, 25 bp, Mus musculus
gggtactatcacatggaggccagaa

SEQ ID NO: 639097 - DNA, 25 bp, Mus musculus
gggtactatcacttggaggccagaa

SEQ ID NO: 639098 - DNA, 25 bp, Mus musculus
gggtactcaagtacagtctgtttta

SEQ ID NO: 639099 - DNA, 25 bp, Mus musculus
gggtactcaagttcagtctgtttta

SEQ ID NO: 639100 - DNA, 25 bp, Mus musculus
gggtactcatctccagtcagaaatc

SEQ ID NO: 639101 - DNA, 25 bp, Mus musculus
gggtactcatctgcagtcagaaatc

SEQ ID NO: 639102 - DNA, 25 bp, Mus musculus
gggtactcatgtacaactgtgttga

SEQ ID NO: 639103 - DNA, 25 bp, Mus musculus
gggtactcatgttcaactgtgttga

SEQ ID NO: 639104 - DNA, 25 bp, Mus musculus
gggtactccatcaatcctatagagc

SEQ ID NO: 639105 - DNA, 25 bp, Mus musculus
gggtactccatctatcctatagagc

SEQ ID NO: 639106 - DNA, 25 bp, Mus musculus
gggtactccctacaagggccaattg

SEQ ID NO: 639107 - DNA, 25 bp, Mus musculus
gggtactccctagaagggccaattg

SEQ ID NO: 639108 - DNA, 25 bp, Mus musculus
gggtactcgggactcactaaagaca

SEQ ID NO: 639109 - DNA, 25 bp, Mus musculus
gggtactcgggagtcactaaagaca

SEQ ID NO: 639110 - DNA, 25 bp, Mus musculus
gggtactcgtccactgagatccaca

SEQ ID NO: 639111 - DNA, 25 bp, Mus musculus
gggtactcgtcctctgagatccaca

SEQ ID NO: 639112 - DNA, 25 bp, Mus musculus
gggtactcgttcagcatttagactt

SEQ ID NO: 639113 - DNA, 25 bp, Mus musculus
gggtactcgttctgcatttagactt

SEQ ID NO: 639114 - DNA, 25 bp, Mus musculus
gggtactctatacttgcttccaatc

SEQ ID NO: 639115 - DNA, 25 bp, Mus musculus
gggtactctatagttgcttccaatc

SEQ ID NO: 639116 - DNA, 25 bp, Mus musculus
gggtactctattcaggtcatacacc

SEQ ID NO: 639117 - DNA, 25 bp, Mus musculus
gggtactctattgaggtcatacacc

SEQ ID NO: 639118 - DNA, 25 bp, Mus musculus
gggtactctggcaccaaaacatccc

SEQ ID NO: 639119 - DNA, 25 bp, Mus musculus
gggtactctggctccaaaacatccc

SEQ ID NO: 639120 - DNA, 25 bp, Mus musculus
gggtactcttgcctaaacatatttg

SEQ ID NO: 639121 - DNA, 25 bp, Mus musculus
gggtactcttgcgtaaacatatttg

SEQ ID NO: 639122 - DNA, 25 bp, Mus musculus
gggtactgaaaacatggttcctaag

SEQ ID NO: 639123 - DNA, 25 bp, Mus musculus
gggtactgaaaagatggttcctaag

SEQ ID NO: 639124 - DNA, 25 bp, Mus musculus
gggtactgacagactccttggagta

SEQ ID NO: 639125 - DNA, 25 bp, Mus musculus
gggtactgacagtctccttggagta

SEQ ID NO: 639126 - DNA, 25 bp, Mus musculus
gggtactgactgatgacctagggtc

SEQ ID NO: 639127 - DNA, 25 bp, Mus musculus
gggtactgactgttgacctagggtc

SEQ ID NO: 639128 - DNA, 25 bp, Mus musculus
gggtactgctataccaggcctttcc

SEQ ID NO: 639129 - DNA, 25 bp, Mus musculus
gggtactgctattccaggcctttcc

SEQ ID NO: 639130 - DNA, 25 bp, Mus musculus
gggtactggcaaaacacagtgcatt

SEQ ID NO: 639131 - DNA, 25 bp, Mus musculus
gggtactggcaatacacagtgcatt

SEQ ID NO: 639132 - DNA, 25 bp, Mus musculus
gggtactggctaaataaatctgtaa

SEQ ID NO: 639133 - DNA, 25 bp, Mus musculus
gggtactggctatataaatctgtaa

SEQ ID NO: 639134 - DNA, 25 bp, Mus musculus
gggtactggctccatccgggatacc

SEQ ID NO: 639135 - DNA, 25 bp, Mus musculus
gggtactggctcgatccgggatacc

SEQ ID NO: 639136 - DNA, 25 bp, Mus musculus
gggtactggtatacccttgacccag

SEQ ID NO: 639137 - DNA, 25 bp, Mus musculus
gggtactggtattcccttgacccag

SEQ ID NO: 639138 - DNA, 25 bp, Mus musculus
gggtactgtatgaccctgactgctt

SEQ ID NO: 639139 - DNA, 25 bp, Mus musculus
gggtactgtatgtccctgactgctt

SEQ ID NO: 639140 - DNA, 25 bp, Mus musculus
gggtactgtcttcgaagttgccgcc

SEQ ID NO: 639141 - DNA, 25 bp, Mus musculus
gggtactgtcttggaagttgccgcc

SEQ ID NO: 639142 - DNA, 25 bp, Mus musculus
gggtactgtgtgaacaagagacccc

SEQ ID NO: 639143 - DNA, 25 bp, Mus musculus
gggtactgtgtgtacaagagacccc

SEQ ID NO: 639144 - DNA, 25 bp, Mus musculus
gggtacttactcagtcactgccaag

SEQ ID NO: 639145 - DNA, 25 bp, Mus musculus
gggtacttactctgtcactgccaag

SEQ ID NO: 639146 - DNA, 25 bp, Mus musculus
gggtacttaggaaacaactcagcat

SEQ ID NO: 639147 - DNA, 25 bp, Mus musculus
gggtacttaggatacaactcagcat

SEQ ID NO: 639148 - DNA, 25 bp, Mus musculus
gggtacttcaggactggtgataagt

SEQ ID NO: 639149 - DNA, 25 bp, Mus musculus
gggtacttcaggtctggtgataagt

SEQ ID NO: 639150 - DNA, 25 bp, Mus musculus
gggtacttcccacaaaagctcttgc

SEQ ID NO: 639151 - DNA, 25 bp, Mus musculus
gggtacttcccagaaaagctcttgc

SEQ ID NO: 639152 - DNA, 25 bp, Mus musculus
gggtacttcgagaatatccccaagg

SEQ ID NO: 639153 - DNA, 25 bp, Mus musculus
gggtacttcgagtatatccccaagg

SEQ ID NO: 639154 - DNA, 25 bp, Mus musculus
gggtacttgtgaagtcaccacgttt

SEQ ID NO: 639155 - DNA, 25 bp, Mus musculus
gggtacttgtgatgtcaccacgttt

SEQ ID NO: 639156 - DNA, 25 bp, Mus musculus
gggtactttactcaacacggactat

SEQ ID NO: 639157 - DNA, 25 bp, Mus musculus
gggtactttactgaacacggactat

SEQ ID NO: 639158 - DNA, 25 bp, Mus musculus
gggtactttattctatttatgcttc

SEQ ID NO: 639159 - DNA, 25 bp, Mus musculus
gggtactttattgtatttatgcttc

SEQ ID NO: 639160 - DNA, 25 bp, Mus musculus
gggtactttgctcacagtgtgctgt

SEQ ID NO: 639161 - DNA, 25 bp, Mus musculus
gggtactttgctgacagtgtgctgt

SEQ ID NO: 639162 - DNA, 25 bp, Mus musculus
gggtacttttcaatcttaacttgag

SEQ ID NO: 639163 - DNA, 25 bp, Mus musculus
gggtacttttcattcttaacttgag

SEQ ID NO: 639164 - DNA, 25 bp, Mus musculus
gggtacttttctctggatccagaca

SEQ ID NO: 639165 - DNA, 25 bp, Mus musculus
gggtacttttctgtggatccagaca

SEQ ID NO: 639166 - DNA, 25 bp, Mus musculus
gggtagaaacatattatcctgagat

SEQ ID NO: 639167 - DNA, 25 bp, Mus musculus
gggtagaaacattttatcctgagat

SEQ ID NO: 639168 - DNA, 25 bp, Mus musculus
gggtagaaactgaactggatcattt

SEQ ID NO: 639169 - DNA, 25 bp, Mus musculus
gggtagaaactgtactggatcattt

SEQ ID NO: 639170 - DNA, 25 bp, Mus musculus
gggtagaaagtgctgtccttctgca

SEQ ID NO: 639171 - DNA, 25 bp, Mus musculus
gggtagaaagtggtgtccttctgca

SEQ ID NO: 639172 - DNA, 25 bp, Mus musculus
gggtagaaatgcagcatcccattct

SEQ ID NO: 639173 - DNA, 25 bp, Mus musculus
gggtagaaatgctgcatcccattct

SEQ ID NO: 639174 - DNA, 25 bp, Mus musculus
gggtagaagctaaacatgaaacaga

SEQ ID NO: 639175 - DNA, 25 bp, Mus musculus
gggtagaagctatacatgaaacaga

SEQ ID NO: 639176 - DNA, 25 bp, Mus musculus
gggtagacagatcttccttaaactt

SEQ ID NO: 639177 - DNA, 25 bp, Mus musculus
gggtagacagatgttccttaaactt

SEQ ID NO: 639178 - DNA, 25 bp, Mus musculus
gggtagaccaggcacatacttgcta

SEQ ID NO: 639179 - DNA, 25 bp, Mus musculus
gggtagaccagggacatacttgcta

SEQ ID NO: 639180 - DNA, 25 bp, Mus musculus
gggtagactgacacctgtattcaca

SEQ ID NO: 639181 - DNA, 25 bp, Mus musculus
gggtagactgactcctgtattcaca

SEQ ID NO: 639182 - DNA, 25 bp, Mus musculus
gggtagactgagagccaaggctctt

SEQ ID NO: 639183 - DNA, 25 bp, Mus musculus
gggtagactgagtgccaaggctctt

SEQ ID NO: 639184 - DNA, 25 bp, Mus musculus
gggtagagcaacctctctgagttca

SEQ ID NO: 639185 - DNA, 25 bp, Mus musculus
gggtagagcaacgtctctgagttca

SEQ ID NO: 639186 - DNA, 25 bp, Mus musculus
gggtagagcctaagatcagtttgtc

SEQ ID NO: 639187 - DNA, 25 bp, Mus musculus
gggtagagcctatgatcagtttgtc

SEQ ID NO: 639188 - DNA, 25 bp, Mus musculus
gggtagaggactattgaggccccat

SEQ ID NO: 639189 - DNA, 25 bp, Mus musculus
gggtagaggacttttgaggccccat

SEQ ID NO: 639190 - DNA, 25 bp, Mus musculus
gggtagatcaggatgtagttttata

SEQ ID NO: 639191 - DNA, 25 bp, Mus musculus
gggtagatcaggttgtagttttata

SEQ ID NO: 639192 - DNA, 25 bp, Mus musculus
gggtagatgaacaccgctttttcaa

SEQ ID NO: 639193 - DNA, 25 bp, Mus musculus
gggtagatgaactccgctttttcaa

SEQ ID NO: 639194 - DNA, 25 bp, Mus musculus
gggtagatgcagctgtaatctgtta

SEQ ID NO: 639195 - DNA, 25 bp, Mus musculus
gggtagatgcaggtgtaatctgtta

SEQ ID NO: 639196 - DNA, 25 bp, Mus musculus
gggtagattcgtagcttcccggatc

SEQ ID NO: 639197 - DNA, 25 bp, Mus musculus
gggtagattcgttgcttcccggatc

SEQ ID NO: 639198 - DNA, 25 bp, Mus musculus
gggtagattctcaggtcccatgcca

SEQ ID NO: 639199 - DNA, 25 bp, Mus musculus
gggtagattctctggtcccatgcca

SEQ ID NO: 639200 - DNA, 25 bp, Mus musculus
gggtagcaatggattagtatcaggt

SEQ ID NO: 639201 - DNA, 25 bp, Mus musculus
gggtagcaatggtttagtatcaggt

SEQ ID NO: 639202 - DNA, 25 bp, Mus musculus
gggtagcactatacattccaagtac

SEQ ID NO: 639203 - DNA, 25 bp, Mus musculus
gggtagcactattcattccaagtac

SEQ ID NO: 639204 - DNA, 25 bp, Mus musculus
gggtagcactcaacttaccctcaga

SEQ ID NO: 639205 - DNA, 25 bp, Mus musculus
gggtagcactcatcttaccctcaga

SEQ ID NO: 639206 - DNA, 25 bp, Mus musculus
gggtagcagaccatctcgggtctta

SEQ ID NO: 639207 - DNA, 25 bp, Mus musculus
gggtagcagaccttctcgggtctta

SEQ ID NO: 639208 - DNA, 25 bp, Mus musculus
gggtagcagtagatgattcagtgtt

SEQ ID NO: 639209 - DNA, 25 bp, Mus musculus
gggtagcagtagttgattcagtgtt

SEQ ID NO: 639210 - DNA, 25 bp, Mus musculus
gggtagcattcactcaatactccaa

SEQ ID NO: 639211 - DNA, 25 bp, Mus musculus
gggtagcattcagtcaatactccaa

SEQ ID NO: 639212 - DNA, 25 bp, Mus musculus
gggtagcattgcacttgcacatcac

SEQ ID NO: 639213 - DNA, 25 bp, Mus musculus
gggtagcattgctcttgcacatcac

SEQ ID NO: 639214 - DNA, 25 bp, Mus musculus
gggtagccaaacatcagacctacaa

SEQ ID NO: 639215 - DNA, 25 bp, Mus musculus
gggtagccaaacttcagacctacaa

SEQ ID NO: 639216 - DNA, 25 bp, Mus musculus
gggtagccaaagcaattctaagcag

SEQ ID NO: 639217 - DNA, 25 bp, Mus musculus
gggtagccaaaggaattctaagcag

SEQ ID NO: 639218 - DNA, 25 bp, Mus musculus
gggtagccacctatagatgtgtgca

SEQ ID NO: 639219 - DNA, 25 bp, Mus musculus
gggtagccacctttagatgtgtgca

SEQ ID NO: 639220 - DNA, 25 bp, Mus musculus
gggtagccacgtactgtcttgtcca

SEQ ID NO: 639221 - DNA, 25 bp, Mus musculus
gggtagccacgttctgtcttgtcca

SEQ ID NO: 639222 - DNA, 25 bp, Mus musculus
gggtagccagaaagctccttaaaag

SEQ ID NO: 639223 - DNA, 25 bp, Mus musculus
gggtagccagaatgctccttaaaag

SEQ ID NO: 639224 - DNA, 25 bp, Mus musculus
gggtagccaggcagggttctcctct

SEQ ID NO: 639225 - DNA, 25 bp, Mus musculus
gggtagccaggctgggttctcctct

SEQ ID NO: 639226 - DNA, 25 bp, Mus musculus
gggtagccatttaaagccagaaaca

SEQ ID NO: 639227 - DNA, 25 bp, Mus musculus
gggtagccattttaagccagaaaca

SEQ ID NO: 639228 - DNA, 25 bp, Mus musculus
gggtagcccgtaaatccaagttcat

SEQ ID NO: 639229 - DNA, 25 bp, Mus musculus
gggtagcccgtatatccaagttcat

SEQ ID NO: 639230 - DNA, 25 bp, Mus musculus
gggtagccgagcattgcacaagcct

SEQ ID NO: 639231 - DNA, 25 bp, Mus musculus
gggtagccgagctttgcacaagcct

SEQ ID NO: 639232 - DNA, 25 bp, Mus musculus
gggtagccgcaccagatttagccga

SEQ ID NO: 639233 - DNA, 25 bp, Mus musculus
gggtagccgcacgagatttagccga

SEQ ID NO: 639234 - DNA, 25 bp, Mus musculus
gggtagccggctcaagctctcacac

SEQ ID NO: 639235 - DNA, 25 bp, Mus musculus
gggtagccggctgaagctctcacac

SEQ ID NO: 639236 - DNA, 25 bp, Mus musculus
gggtagcctttcatcattgtctctc

SEQ ID NO: 639237 - DNA, 25 bp, Mus musculus
gggtagcctttcttcattgtctctc

SEQ ID NO: 639238 - DNA, 25 bp, Mus musculus
gggtagcggctcatgcacacgcaca

SEQ ID NO: 639239 - DNA, 25 bp, Mus musculus
gggtagcggctcttgcacacgcaca

SEQ ID NO: 639240 - DNA, 25 bp, Mus musculus
gggtagctagttctatccatgcggt

SEQ ID NO: 639241 - DNA, 25 bp, Mus musculus
gggtagctagttgtatccatgcggt

SEQ ID NO: 639242 - DNA, 25 bp, Mus musculus
gggtagctatctcaattttgacaaa

SEQ ID NO: 639243 - DNA, 25 bp, Mus musculus
gggtagctatctgaattttgacaaa

SEQ ID NO: 639244 - DNA, 25 bp, Mus musculus
gggtagctcacacacagctccatta

SEQ ID NO: 639245 - DNA, 25 bp, Mus musculus
gggtagctcacagacagctccatta

SEQ ID NO: 639246 - DNA, 25 bp, Mus musculus
gggtagctgatccactcttttcata

SEQ ID NO: 639247 - DNA, 25 bp, Mus musculus
gggtagctgatcgactcttttcata

SEQ ID NO: 639248 - DNA, 25 bp, Mus musculus
gggtagctgccacagacaacgctca

SEQ ID NO: 639249 - DNA, 25 bp, Mus musculus
gggtagctgccagagacaacgctca

SEQ ID NO: 639250 - DNA, 25 bp, Mus musculus
gggtagctgtgcactctcagtgaga

SEQ ID NO: 639251 - DNA, 25 bp, Mus musculus
gggtagctgtgctctctcagtgaga

SEQ ID NO: 639252 - DNA, 25 bp, Mus musculus
gggtagcttccacaactcaccctag

SEQ ID NO: 639253 - DNA, 25 bp, Mus musculus
gggtagcttccagaactcaccctag

SEQ ID NO: 639254 - DNA, 25 bp, Mus musculus
gggtagcttcccattgcacgaggga

SEQ ID NO: 639255 - DNA, 25 bp, Mus musculus
gggtagcttccctttgcacgaggga

SEQ ID NO: 639256 - DNA, 25 bp, Mus musculus
gggtagcttggtcgcacagcacttc

SEQ ID NO: 639257 - DNA, 25 bp, Mus musculus
gggtagcttggtggcacagcacttc

SEQ ID NO: 639258 - DNA, 25 bp, Mus musculus
gggtagctttccactccatgttctc

SEQ ID NO: 639259 - DNA, 25 bp, Mus musculus
gggtagctttccatgacctgagggc

SEQ ID NO: 639260 - DNA, 25 bp, Mus musculus
gggtagctttcctctccatgttctc

SEQ ID NO: 639261 - DNA, 25 bp, Mus musculus
gggtagctttccttgacctgagggc

SEQ ID NO: 639262 - DNA, 25 bp, Mus musculus
gggtaggaaccacactgaagatttg

SEQ ID NO: 639263 - DNA, 25 bp, Mus musculus
gggtaggaaccagactgaagatttg

SEQ ID NO: 639264 - DNA, 25 bp, Mus musculus
gggtaggatcagacaccttcgtggc

SEQ ID NO: 639265 - DNA, 25 bp, Mus musculus
gggtaggatcagtcaccttcgtggc

SEQ ID NO: 639266 - DNA, 25 bp, Mus musculus
gggtaggctttgaatcaaatcacat

SEQ ID NO: 639267 - DNA, 25 bp, Mus musculus
gggtaggctttgtatcaaatcacat

SEQ ID NO: 639268 - DNA, 25 bp, Mus musculus
gggtagggaacacctactgagttat

SEQ ID NO: 639269 - DNA, 25 bp, Mus musculus
gggtagggaacagctactgagttat

SEQ ID NO: 639270 - DNA, 25 bp, Mus musculus
gggtagggacacaaagccacaactg

SEQ ID NO: 639271 - DNA, 25 bp, Mus musculus
gggtagggacactaagccacaactg

SEQ ID NO: 639272 - DNA, 25 bp, Mus musculus
gggtagggatacaactcagttggta

SEQ ID NO: 639273 - DNA, 25 bp, Mus musculus
gggtagggatactactcagttggta

SEQ ID NO: 639274 - DNA, 25 bp, Mus musculus
gggtagggcccaacccatagtggtt

SEQ ID NO: 639275 - DNA, 25 bp, Mus musculus
gggtagggcccatcccatagtggtt

SEQ ID NO: 639276 - DNA, 25 bp, Mus musculus
gggtagggcttcatggatcatcctc

SEQ ID NO: 639277 - DNA, 25 bp, Mus musculus
gggtagggcttcttggatcatcctc

SEQ ID NO: 639278 - DNA, 25 bp, Mus musculus
gggtaggtaaccatagctgctgtga

SEQ ID NO: 639279 - DNA, 25 bp, Mus musculus
gggtaggtaaccttagctgctgtga

SEQ ID NO: 639280 - DNA, 25 bp, Mus musculus
gggtaggtaactaaccagccatgtg

SEQ ID NO: 639281 - DNA, 25 bp, Mus musculus
gggtaggtaactacaccactgcaaa

SEQ ID NO: 639282 - DNA, 25 bp, Mus musculus
gggtaggtaacttaccagccatgtg

SEQ ID NO: 639283 - DNA, 25 bp, Mus musculus
gggtaggtaacttcaccactgcaaa

SEQ ID NO: 639284 - DNA, 25 bp, Mus musculus
gggtaggtatgacacctttctgctc

SEQ ID NO: 639285 - DNA, 25 bp, Mus musculus
gggtaggtatgagacctttctgctc

SEQ ID NO: 639286 - DNA, 25 bp, Mus musculus
gggtaggtctcaatctaggcctgca

SEQ ID NO: 639287 - DNA, 25 bp, Mus musculus
gggtaggtctcattctaggcctgca

SEQ ID NO: 639288 - DNA, 25 bp, Mus musculus
gggtaggtggcaactgaagctaatt

SEQ ID NO: 639289 - DNA, 25 bp, Mus musculus
gggtaggtggcatctgaagctaatt

SEQ ID NO: 639290 - DNA, 25 bp, Mus musculus
gggtaggtttggcacacatgtcctt

SEQ ID NO: 639291 - DNA, 25 bp, Mus musculus
gggtaggtttgggacacatgtcctt

SEQ ID NO: 639292 - DNA, 25 bp, Mus musculus
gggtagtaattcacttcatattcac

SEQ ID NO: 639293 - DNA, 25 bp, Mus musculus
gggtagtaattctcttcatattcac

SEQ ID NO: 639294 - DNA, 25 bp, Mus musculus
gggtagtagcttactcttgactttc

SEQ ID NO: 639295 - DNA, 25 bp, Mus musculus
gggtagtagctttctcttgactttc

SEQ ID NO: 639296 - DNA, 25 bp, Mus musculus
gggtagtagggacacgccaccacac

SEQ ID NO: 639297 - DNA, 25 bp, Mus musculus
gggtagtagggagacgccaccacac

SEQ ID NO: 639298 - DNA, 25 bp, Mus musculus
gggtagtcaagaattctctcatttg

SEQ ID NO: 639299 - DNA, 25 bp, Mus musculus
gggtagtcaagatttctctcatttg

SEQ ID NO: 639300 - DNA, 25 bp, Mus musculus
gggtagtcatttcgggcatttgcac

SEQ ID NO: 639301 - DNA, 25 bp, Mus musculus
gggtagtcatttggggcatttgcac

SEQ ID NO: 639302 - DNA, 25 bp, Mus musculus
gggtagtcctgtccatagagtgctt

SEQ ID NO: 639303 - DNA, 25 bp, Mus musculus
gggtagtcctgtgcatagagtgctt

SEQ ID NO: 639304 - DNA, 25 bp, Mus musculus
gggtagtctcaacttctttagaata

SEQ ID NO: 639305 - DNA, 25 bp, Mus musculus
gggtagtctcaagttctttagaata

SEQ ID NO: 639306 - DNA, 25 bp, Mus musculus
gggtagtcttcacgaaccaccctat

SEQ ID NO: 639307 - DNA, 25 bp, Mus musculus
gggtagtcttcaggaaccaccctat

SEQ ID NO: 639308 - DNA, 25 bp, Mus musculus
gggtagtgacataatcgccttcctt

SEQ ID NO: 639309 - DNA, 25 bp, Mus musculus
gggtagtgacattatcgccttcctt

SEQ ID NO: 639310 - DNA, 25 bp, Mus musculus
gggtagtgcctgagcttgtttatat

SEQ ID NO: 639311 - DNA, 25 bp, Mus musculus
gggtagtgcctgtgcttgtttatat

SEQ ID NO: 639312 - DNA, 25 bp, Mus musculus
gggtagtgtctgctgctaacttaaa

SEQ ID NO: 639313 - DNA, 25 bp, Mus musculus
gggtagtgtctggtgctaacttaaa

SEQ ID NO: 639314 - DNA, 25 bp, Mus musculus
gggtagttagctctgtttccagtac

SEQ ID NO: 639315 - DNA, 25 bp, Mus musculus
gggtagttagctgtgtttccagtac

SEQ ID NO: 639316 - DNA, 25 bp, Mus musculus
gggtagttcacactcccctttctag

SEQ ID NO: 639317 - DNA, 25 bp, Mus musculus
gggtagttcacagtcccctttctag

SEQ ID NO: 639318 - DNA, 25 bp, Mus musculus
gggtagttcaccagcctcatctcca

SEQ ID NO: 639319 - DNA, 25 bp, Mus musculus
gggtagttcacctgcctcatctcca

SEQ ID NO: 639320 - DNA, 25 bp, Mus musculus
gggtagttcactccctcctgtaagt

SEQ ID NO: 639321 - DNA, 25 bp, Mus musculus
gggtagttcactgcctcctgtaagt

SEQ ID NO: 639322 - DNA, 25 bp, Mus musculus
gggtagttgacaaagagctgcttct

SEQ ID NO: 639323 - DNA, 25 bp, Mus musculus
gggtagttgacatagagctgcttct

SEQ ID NO: 639324 - DNA, 25 bp, Mus musculus
gggtagttgcagattcctcaagata

SEQ ID NO: 639325 - DNA, 25 bp, Mus musculus
gggtagttgcagtttcctcaagata

SEQ ID NO: 639326 - DNA, 25 bp, Mus musculus
gggtagtttattcggtgtcctctga

SEQ ID NO: 639327 - DNA, 25 bp, Mus musculus
gggtagtttattgggtgtcctctga

SEQ ID NO: 639328 - DNA, 25 bp, Mus musculus
gggtagtttccaaccatagcctctc

SEQ ID NO: 639329 - DNA, 25 bp, Mus musculus
gggtagtttccatccatagcctctc

SEQ ID NO: 639330 - DNA, 25 bp, Mus musculus
gggtagtttcttctgaggacgctca

SEQ ID NO: 639331 - DNA, 25 bp, Mus musculus
gggtagtttcttgtgaggacgctca

SEQ ID NO: 639332 - DNA, 25 bp, Mus musculus
gggtagtttgctaacagtcaggaaa

SEQ ID NO: 639333 - DNA, 25 bp, Mus musculus
gggtagtttgcttacagtcaggaaa

SEQ ID NO: 639334 - DNA, 25 bp, Mus musculus
gggtataaacctacccctcagctga

SEQ ID NO: 639335 - DNA, 25 bp, Mus musculus
gggtataaaccttcccctcagctga

SEQ ID NO: 639336 - DNA, 25 bp, Mus musculus
gggtataaattcactccctctcttt

SEQ ID NO: 639337 - DNA, 25 bp, Mus musculus
gggtataaattctctccctctcttt

SEQ ID NO: 639338 - DNA, 25 bp, Mus musculus
gggtataactcaatggcaactcttt

SEQ ID NO: 639339 - DNA, 25 bp, Mus musculus
gggtataactcattggcaactcttt

SEQ ID NO: 639340 - DNA, 25 bp, Mus musculus
gggtataactttctacactgtctag

SEQ ID NO: 639341 - DNA, 25 bp, Mus musculus
gggtataactttgtacactgtctag

SEQ ID NO: 639342 - DNA, 25 bp, Mus musculus
gggtataagcagagttcaggctcca

SEQ ID NO: 639343 - DNA, 25 bp, Mus musculus
gggtataagcagtgttcaggctcca

SEQ ID NO: 639344 - DNA, 25 bp, Mus musculus
gggtataaggcgaccatcattttta

SEQ ID NO: 639345 - DNA, 25 bp, Mus musculus
gggtataaggcgtccatcattttta

SEQ ID NO: 639346 - DNA, 25 bp, Mus musculus
gggtataaggtgacctctcagaggt

SEQ ID NO: 639347 - DNA, 25 bp, Mus musculus
gggtataaggtgtcctctcagaggt

SEQ ID NO: 639348 - DNA, 25 bp, Mus musculus
gggtataatgatcctttctgagaag

SEQ ID NO: 639349 - DNA, 25 bp, Mus musculus
gggtataatgatgctttctgagaag

SEQ ID NO: 639350 - DNA, 25 bp, Mus musculus
gggtatacactgacatatccatgtc

SEQ ID NO: 639351 - DNA, 25 bp, Mus musculus
gggtatacactgtcatatccatgtc

SEQ ID NO: 639352 - DNA, 25 bp, Mus musculus
gggtatacccaacacaactctgaag

SEQ ID NO: 639353 - DNA, 25 bp, Mus musculus
gggtatacccaacttttacatggca

SEQ ID NO: 639354 - DNA, 25 bp, Mus musculus
gggtatacccaagacaactctgaag

SEQ ID NO: 639355 - DNA, 25 bp, Mus musculus
gggtatacccaagttttacatggca

SEQ ID NO: 639356 - DNA, 25 bp, Mus musculus
gggtatacccatatcgtttcaagat

SEQ ID NO: 639357 - DNA, 25 bp, Mus musculus
gggtatacccatttcgtttcaagat

SEQ ID NO: 639358 - DNA, 25 bp, Mus musculus
gggtatactgtacacaccagaagca

SEQ ID NO: 639359 - DNA, 25 bp, Mus musculus
gggtatactgtagacaccagaagca

SEQ ID NO: 639360 - DNA, 25 bp, Mus musculus
gggtatagactgcatactcagataa

SEQ ID NO: 639361 - DNA, 25 bp, Mus musculus
gggtatagactggatactcagataa

SEQ ID NO: 639362 - DNA, 25 bp, Mus musculus
gggtatagcaccacttgaactgaag

SEQ ID NO: 639363 - DNA, 25 bp, Mus musculus
gggtatagcacctcttgaactgaag

SEQ ID NO: 639364 - DNA, 25 bp, Mus musculus
gggtatagctcaacagtggcatgct

SEQ ID NO: 639365 - DNA, 25 bp, Mus musculus
gggtatagctcatcagtggcatgct

SEQ ID NO: 639366 - DNA, 25 bp, Mus musculus
gggtataggcacatactgctgtttg

SEQ ID NO: 639367 - DNA, 25 bp, Mus musculus
gggtataggcacttactgctgtttg

SEQ ID NO: 639368 - DNA, 25 bp, Mus musculus
gggtataggctgatattgcccctcc

SEQ ID NO: 639369 - DNA, 25 bp, Mus musculus
gggtataggctgttattgcccctcc

SEQ ID NO: 639370 - DNA, 25 bp, Mus musculus
gggtatagggtcactgtgcacttga

SEQ ID NO: 639371 - DNA, 25 bp, Mus musculus
gggtatagggtctctgtgcacttga

SEQ ID NO: 639372 - DNA, 25 bp, Mus musculus
gggtatagggttctctatcactctc

SEQ ID NO: 639373 - DNA, 25 bp, Mus musculus
gggtatagggttgtctatcactctc

SEQ ID NO: 639374 - DNA, 25 bp, Mus musculus
gggtatataatccaacagggccaga

SEQ ID NO: 639375 - DNA, 25 bp, Mus musculus
gggtatataatcgaacagggccaga

SEQ ID NO: 639376 - DNA, 25 bp, Mus musculus
gggtatataccaacatgtacagctg

SEQ ID NO: 639377 - DNA, 25 bp, Mus musculus
gggtatataccatcatgtacagctg

SEQ ID NO: 639378 - DNA, 25 bp, Mus musculus
gggtatatagccacactccagggca

SEQ ID NO: 639379 - DNA, 25 bp, Mus musculus
gggtatatagcctcactccagggca

SEQ ID NO: 639380 - DNA, 25 bp, Mus musculus
gggtatatatacaggtacacacaca

SEQ ID NO: 639381 - DNA, 25 bp, Mus musculus
gggtatatatactggtacacacaca

SEQ ID NO: 639382 - DNA, 25 bp, Mus musculus
gggtatatcacaccactagttttgt

SEQ ID NO: 639383 - DNA, 25 bp, Mus musculus
gggtatatcacagcactagttttgt

SEQ ID NO: 639384 - DNA, 25 bp, Mus musculus
gggtatatgaacatacatcttccta

SEQ ID NO: 639385 - DNA, 25 bp, Mus musculus
gggtatatgaacttacatcttccta

SEQ ID NO: 639386 - DNA, 25 bp, Mus musculus
gggtatatgctgatctaatttccat

SEQ ID NO: 639387 - DNA, 25 bp, Mus musculus
gggtatatgctgttctaatttccat

SEQ ID NO: 639388 - DNA, 25 bp, Mus musculus
gggtatatgcttcacattttcttta

SEQ ID NO: 639389 - DNA, 25 bp, Mus musculus
gggtatatgcttgacattttcttta

SEQ ID NO: 639390 - DNA, 25 bp, Mus musculus
gggtatatgtttcaatgtttcagga

SEQ ID NO: 639391 - DNA, 25 bp, Mus musculus
gggtatatgtttgaatgtttcagga

SEQ ID NO: 639392 - DNA, 25 bp, Mus musculus
gggtatattcagagatcacattttt

SEQ ID NO: 639393 - DNA, 25 bp, Mus musculus
gggtatattcagtgatcacattttt

SEQ ID NO: 639394 - DNA, 25 bp, Mus musculus
gggtatattcatatgctaggacagt

SEQ ID NO: 639395 - DNA, 25 bp, Mus musculus
gggtatattcatttgctaggacagt

SEQ ID NO: 639396 - DNA, 25 bp, Mus musculus
gggtatatttccatctgttatgttg

SEQ ID NO: 639397 - DNA, 25 bp, Mus musculus
gggtatatttccttctgttatgttg

SEQ ID NO: 639398 - DNA, 25 bp, Mus musculus
gggtatcaaggcagtatgattctca

SEQ ID NO: 639399 - DNA, 25 bp, Mus musculus
gggtatcaaggctgtatgattctca

SEQ ID NO: 639400 - DNA, 25 bp, Mus musculus
gggtatcaagtaaatctctggttct

SEQ ID NO: 639401 - DNA, 25 bp, Mus musculus
gggtatcaagtatatctctggttct

SEQ ID NO: 639402 - DNA, 25 bp, Mus musculus
gggtatcaatctcacagctgcagac

SEQ ID NO: 639403 - DNA, 25 bp, Mus musculus
gggtatcaatctgacagctgcagac

SEQ ID NO: 639404 - DNA, 25 bp, Mus musculus
gggtatcaatggcttcccttccagg

SEQ ID NO: 639405 - DNA, 25 bp, Mus musculus
gggtatcaatgggttcccttccagg

SEQ ID NO: 639406 - DNA, 25 bp, Mus musculus
gggtatcaatgtcaaattatgtaca

SEQ ID NO: 639407 - DNA, 25 bp, Mus musculus
gggtatcaatgtgaaattatgtaca

SEQ ID NO: 639408 - DNA, 25 bp, Mus musculus
gggtatcacatgacacaggcagcca

SEQ ID NO: 639409 - DNA, 25 bp, Mus musculus
gggtatcacatgtcacaggcagcca

SEQ ID NO: 639410 - DNA, 25 bp, Mus musculus
gggtatcaccaacctaaggcagaca

SEQ ID NO: 639411 - DNA, 25 bp, Mus musculus
gggtatcaccaagctaaggcagaca

SEQ ID NO: 639412 - DNA, 25 bp, Mus musculus
gggtatcaccacagttcataactct

SEQ ID NO: 639413 - DNA, 25 bp, Mus musculus
gggtatcaccactgttcataactct

SEQ ID NO: 639414 - DNA, 25 bp, Mus musculus
gggtatcacgagacatgtttatagt

SEQ ID NO: 639415 - DNA, 25 bp, Mus musculus
gggtatcacgagtcatgtttatagt

SEQ ID NO: 639416 - DNA, 25 bp, Mus musculus
gggtatcactttctaagagccttga

SEQ ID NO: 639417 - DNA, 25 bp, Mus musculus
gggtatcactttgtaagagccttga

SEQ ID NO: 639418 - DNA, 25 bp, Mus musculus
gggtatcagaaacccctacactgtt

SEQ ID NO: 639419 - DNA, 25 bp, Mus musculus
gggtatcagaaagccctacactgtt

SEQ ID NO: 639420 - DNA, 25 bp, Mus musculus
gggtatcagcatctgcaatccatgg

SEQ ID NO: 639421 - DNA, 25 bp, Mus musculus
gggtatcagcatgtgcaatccatgg

SEQ ID NO: 639422 - DNA, 25 bp, Mus musculus
gggtatcagcctcaggctagacaga

SEQ ID NO: 639423 - DNA, 25 bp, Mus musculus
gggtatcagcctgaggctagacaga

SEQ ID NO: 639424 - DNA, 25 bp, Mus musculus
gggtatcaggaaaggagtcatggag

SEQ ID NO: 639425 - DNA, 25 bp, Mus musculus
gggtatcaggaatggagtcatggag

SEQ ID NO: 639426 - DNA, 25 bp, Mus musculus
gggtatcataccatggaattcaacg

SEQ ID NO: 639427 - DNA, 25 bp, Mus musculus
gggtatcataccttggaattcaacg

SEQ ID NO: 639428 - DNA, 25 bp, Mus musculus
gggtatcatcagatcagattcctaa

SEQ ID NO: 639429 - DNA, 25 bp, Mus musculus
gggtatcatcagttcagattcctaa

SEQ ID NO: 639430 - DNA, 25 bp, Mus musculus
gggtatcatcggacataccctagac

SEQ ID NO: 639431 - DNA, 25 bp, Mus musculus
gggtatcatcggtcataccctagac

SEQ ID NO: 639432 - DNA, 25 bp, Mus musculus
gggtatcatctaactgggaagcagt

SEQ ID NO: 639433 - DNA, 25 bp, Mus musculus
gggtatcatctatctgggaagcagt

SEQ ID NO: 639434 - DNA, 25 bp, Mus musculus
gggtatcatgcacacacagagacat

SEQ ID NO: 639435 - DNA, 25 bp, Mus musculus
gggtatcatgcagacacagagacat

SEQ ID NO: 639436 - DNA, 25 bp, Mus musculus
gggtatcatgctccccagttaactc

SEQ ID NO: 639437 - DNA, 25 bp, Mus musculus
gggtatcatgctgcccagttaactc

SEQ ID NO: 639438 - DNA, 25 bp, Mus musculus
gggtatcatttcactaccttatgac

SEQ ID NO: 639439 - DNA, 25 bp, Mus musculus
gggtatcatttctctaccttatgac

SEQ ID NO: 639440 - DNA, 25 bp, Mus musculus
gggtatccatggatagcctaaaaca

SEQ ID NO: 639441 - DNA, 25 bp, Mus musculus
gggtatccatggttagcctaaaaca

SEQ ID NO: 639442 - DNA, 25 bp, Mus musculus
gggtatccatgtacagctccaaaca

SEQ ID NO: 639443 - DNA, 25 bp, Mus musculus
gggtatccatgttcagctccaaaca

SEQ ID NO: 639444 - DNA, 25 bp, Mus musculus
gggtatcccaggactgctttctgcc

SEQ ID NO: 639445 - DNA, 25 bp, Mus musculus
gggtatcccaggtctgctttctgcc

SEQ ID NO: 639446 - DNA, 25 bp, Mus musculus
gggtatcctaggaacatctgttatt

SEQ ID NO: 639447 - DNA, 25 bp, Mus musculus
gggtatcctaggtacatctgttatt

SEQ ID NO: 639448 - DNA, 25 bp, Mus musculus
gggtatcctccgattgtccacaagt

SEQ ID NO: 639449 - DNA, 25 bp, Mus musculus
gggtatcctccgtttgtccacaagt

SEQ ID NO: 639450 - DNA, 25 bp, Mus musculus
gggtatcctttcattatttgcagct

SEQ ID NO: 639451 - DNA, 25 bp, Mus musculus
gggtatcctttctttatttgcagct

SEQ ID NO: 639452 - DNA, 25 bp, Mus musculus
gggtatcgaccgagacagctacagg

SEQ ID NO: 639453 - DNA, 25 bp, Mus musculus
gggtatcgaccgtgacagctacagg

SEQ ID NO: 639454 - DNA, 25 bp, Mus musculus
gggtatcggcctcagaactccacgg

SEQ ID NO: 639455 - DNA, 25 bp, Mus musculus
gggtatcggcctgagaactccacgg

SEQ ID NO: 639456 - DNA, 25 bp, Mus musculus
gggtatcgtttaagtttccatcata

SEQ ID NO: 639457 - DNA, 25 bp, Mus musculus
gggtatcgtttatgtttccatcata

SEQ ID NO: 639458 - DNA, 25 bp, Mus musculus
gggtatctaataccacccactggca

SEQ ID NO: 639459 - DNA, 25 bp, Mus musculus
gggtatctaatagcacccactggca

SEQ ID NO: 639460 - DNA, 25 bp, Mus musculus
gggtatctaattcatcaggtccagg

SEQ ID NO: 639461 - DNA, 25 bp, Mus musculus
gggtatctaattgatcaggtccagg

SEQ ID NO: 639462 - DNA, 25 bp, Mus musculus
gggtatctacaccttagcagtaaga

SEQ ID NO: 639463 - DNA, 25 bp, Mus musculus
gggtatctacacgttagcagtaaga

SEQ ID NO: 639464 - DNA, 25 bp, Mus musculus
gggtatctactcaagccacagaatt

SEQ ID NO: 639465 - DNA, 25 bp, Mus musculus
gggtatctactctagccacagaatt

SEQ ID NO: 639466 - DNA, 25 bp, Mus musculus
gggtatctatccacagactgtctct

SEQ ID NO: 639467 - DNA, 25 bp, Mus musculus
gggtatctatcctcagactgtctct

SEQ ID NO: 639468 - DNA, 25 bp, Mus musculus
gggtatctatggcagttgcccacag

SEQ ID NO: 639469 - DNA, 25 bp, Mus musculus
gggtatctatgggagttgcccacag

SEQ ID NO: 639470 - DNA, 25 bp, Mus musculus
gggtatctattcacaacccacatac

SEQ ID NO: 639471 - DNA, 25 bp, Mus musculus
gggtatctattctcaacccacatac

SEQ ID NO: 639472 - DNA, 25 bp, Mus musculus
gggtatctcaatcactccaatgttg

SEQ ID NO: 639473 - DNA, 25 bp, Mus musculus
gggtatctcaatgactccaatgttg

SEQ ID NO: 639474 - DNA, 25 bp, Mus musculus
gggtatctcattaactgtagctgta

SEQ ID NO: 639475 - DNA, 25 bp, Mus musculus
gggtatctcatttactgtagctgta

SEQ ID NO: 639476 - DNA, 25 bp, Mus musculus
gggtatctgaacaccaacccacatg

SEQ ID NO: 639477 - DNA, 25 bp, Mus musculus
gggtatctgaactccaacccacatg

SEQ ID NO: 639478 - DNA, 25 bp, Mus musculus
gggtatctgatacctctgtattttg

SEQ ID NO: 639479 - DNA, 25 bp, Mus musculus
gggtatctgatagctctgtattttg

SEQ ID NO: 639480 - DNA, 25 bp, Mus musculus
gggtatctgcatatacttgagtcat

SEQ ID NO: 639481 - DNA, 25 bp, Mus musculus
gggtatctgcatttacttgagtcat

SEQ ID NO: 639482 - DNA, 25 bp, Mus musculus
gggtatctgccaacctcaaatgaac

SEQ ID NO: 639483 - DNA, 25 bp, Mus musculus
gggtatctgccatcctcaaatgaac

SEQ ID NO: 639484 - DNA, 25 bp, Mus musculus
gggtatctggaaccatcactgccac

SEQ ID NO: 639485 - DNA, 25 bp, Mus musculus
gggtatctggaagcatcactgccac

SEQ ID NO: 639486 - DNA, 25 bp, Mus musculus
gggtatctggagatgagcctcctac

SEQ ID NO: 639487 - DNA, 25 bp, Mus musculus
gggtatctggagttgagcctcctac

SEQ ID NO: 639488 - DNA, 25 bp, Mus musculus
gggtatctgtatacagctgcttgct

SEQ ID NO: 639489 - DNA, 25 bp, Mus musculus
gggtatctgtattcagctgcttgct

SEQ ID NO: 639490 - DNA, 25 bp, Mus musculus
gggtatctgtgcacctaagaagccc

SEQ ID NO: 639491 - DNA, 25 bp, Mus musculus
gggtatctgtgctcctaagaagccc

SEQ ID NO: 639492 - DNA, 25 bp, Mus musculus
gggtatcttacaagctgaacttctt

SEQ ID NO: 639493 - DNA, 25 bp, Mus musculus
gggtatcttacatgctgaacttctt

SEQ ID NO: 639494 - DNA, 25 bp, Mus musculus
gggtatcttgaaaaccctgataggc

SEQ ID NO: 639495 - DNA, 25 bp, Mus musculus
gggtatcttgaataccctgataggc

SEQ ID NO: 639496 - DNA, 25 bp, Mus musculus
gggtatcttgatatgcttttcattg

SEQ ID NO: 639497 - DNA, 25 bp, Mus musculus
gggtatcttgatttgcttttcattg

SEQ ID NO: 639498 - DNA, 25 bp, Mus musculus
gggtatcttggcacctgaggacaaa

SEQ ID NO: 639499 - DNA, 25 bp, Mus musculus
gggtatcttggctcctgaggacaaa

SEQ ID NO: 639500 - DNA, 25 bp, Mus musculus
gggtatctttatcttatgttttcta

SEQ ID NO: 639501 - DNA, 25 bp, Mus musculus
gggtatctttatgttatgttttcta

SEQ ID NO: 639502 - DNA, 25 bp, Mus musculus
gggtatgaaactcaggccctccttg

SEQ ID NO: 639503 - DNA, 25 bp, Mus musculus
gggtatgaaactgaggccctccttg

SEQ ID NO: 639504 - DNA, 25 bp, Mus musculus
gggtatgaaatgacactcacttatc

SEQ ID NO: 639505 - DNA, 25 bp, Mus musculus
gggtatgaaatgtcactcacttatc

SEQ ID NO: 639506 - DNA, 25 bp, Mus musculus
gggtatgaacttctctccttcatct

SEQ ID NO: 639507 - DNA, 25 bp, Mus musculus
gggtatgaacttgtctccttcatct

SEQ ID NO: 639508 - DNA, 25 bp, Mus musculus
gggtatgaagaactagctcctgtgt

SEQ ID NO: 639509 - DNA, 25 bp, Mus musculus
gggtatgaagaagtagctcctgtgt

SEQ ID NO: 639510 - DNA, 25 bp, Mus musculus
gggtatgacagccaagtgcacacat

SEQ ID NO: 639511 - DNA, 25 bp, Mus musculus
gggtatgacagcgaagtgcacacat

SEQ ID NO: 639512 - DNA, 25 bp, Mus musculus
gggtatgaccggctccatagtacag

SEQ ID NO: 639513 - DNA, 25 bp, Mus musculus
gggtatgaccgggtccatagtacag

SEQ ID NO: 639514 - DNA, 25 bp, Mus musculus
gggtatgagacaatgtagctcctct

SEQ ID NO: 639515 - DNA, 25 bp, Mus musculus
gggtatgagacattgtagctcctct

SEQ ID NO: 639516 - DNA, 25 bp, Mus musculus
gggtatgagtccacgaaggttcaaa

SEQ ID NO: 639517 - DNA, 25 bp, Mus musculus
gggtatgagtcctcgaaggttcaaa

SEQ ID NO: 639518 - DNA, 25 bp, Mus musculus
gggtatgatcatattgccctgcatc

SEQ ID NO: 639519 - DNA, 25 bp, Mus musculus
gggtatgatcattttgccctgcatc

SEQ ID NO: 639520 - DNA, 25 bp, Mus musculus
gggtatgcattccagacacaggaag

SEQ ID NO: 639521 - DNA, 25 bp, Mus musculus
gggtatgcattcgagacacaggaag

SEQ ID NO: 639522 - DNA, 25 bp, Mus musculus
gggtatgcatttactatctaacatt

SEQ ID NO: 639523 - DNA, 25 bp, Mus musculus
gggtatgcattttctatctaacatt

SEQ ID NO: 639524 - DNA, 25 bp, Mus musculus
gggtatgcccacctaagactgtcta

SEQ ID NO: 639525 - DNA, 25 bp, Mus musculus
gggtatgcccacgtaagactgtcta

SEQ ID NO: 639526 - DNA, 25 bp, Mus musculus
gggtatgcctgcacatgtctgtctg

SEQ ID NO: 639527 - DNA, 25 bp, Mus musculus
gggtatgcctgctcatgtctgtctg

SEQ ID NO: 639528 - DNA, 25 bp, Mus musculus
gggtatgcttgtagatcttactaca

SEQ ID NO: 639529 - DNA, 25 bp, Mus musculus
gggtatgcttgttgatcttactaca

SEQ ID NO: 639530 - DNA, 25 bp, Mus musculus
gggtatggacgcaaggctagtaaaa

SEQ ID NO: 639531 - DNA, 25 bp, Mus musculus
gggtatggacgctaggctagtaaaa

SEQ ID NO: 639532 - DNA, 25 bp, Mus musculus
gggtatggagttcagtccttatcag

SEQ ID NO: 639533 - DNA, 25 bp, Mus musculus
gggtatggagttgagtccttatcag

SEQ ID NO: 639534 - DNA, 25 bp, Mus musculus
gggtatggcacgatagtggccacat

SEQ ID NO: 639535 - DNA, 25 bp, Mus musculus
gggtatggcacgttagtggccacat

SEQ ID NO: 639536 - DNA, 25 bp, Mus musculus
gggtatggctcactacagtgcctaa

SEQ ID NO: 639537 - DNA, 25 bp, Mus musculus
gggtatggctcagtacagtgcctaa

SEQ ID NO: 639538 - DNA, 25 bp, Mus musculus
gggtatggctccaacatagtctgga

SEQ ID NO: 639539 - DNA, 25 bp, Mus musculus
gggtatggctcctacatagtctgga

SEQ ID NO: 639540 - DNA, 25 bp, Mus musculus
gggtatggcttactcatttttactt

SEQ ID NO: 639541 - DNA, 25 bp, Mus musculus
gggtatggcttagtcatttttactt

SEQ ID NO: 639542 - DNA, 25 bp, Mus musculus
gggtatggcttgaacaacttgtgca

SEQ ID NO: 639543 - DNA, 25 bp, Mus musculus
gggtatggcttgtacaacttgtgca

SEQ ID NO: 639544 - DNA, 25 bp, Mus musculus
gggtatggtatcacctacatcttca

SEQ ID NO: 639545 - DNA, 25 bp, Mus musculus
gggtatggtatctcctacatcttca

SEQ ID NO: 639546 - DNA, 25 bp, Mus musculus
gggtatggtgttcactccagacaca

SEQ ID NO: 639547 - DNA, 25 bp, Mus musculus
gggtatggtgttgactccagacaca

SEQ ID NO: 639548 - DNA, 25 bp, Mus musculus
gggtatgtagccagggccccaaaga

SEQ ID NO: 639549 - DNA, 25 bp, Mus musculus
gggtatgtagcctgggccccaaaga

SEQ ID NO: 639550 - DNA, 25 bp, Mus musculus
gggtatgtcacaactaaagaactag

SEQ ID NO: 639551 - DNA, 25 bp, Mus musculus
gggtatgtcacatctaaagaactag

SEQ ID NO: 639552 - DNA, 25 bp, Mus musculus
gggtatgtctcactctgtatgtaac

SEQ ID NO: 639553 - DNA, 25 bp, Mus musculus
gggtatgtctcagtctgtatgtaac

SEQ ID NO: 639554 - DNA, 25 bp, Mus musculus
gggtatgtgctcatgatccagaagc

SEQ ID NO: 639555 - DNA, 25 bp, Mus musculus
gggtatgtgctcttgatccagaagc

SEQ ID NO: 639556 - DNA, 25 bp, Mus musculus
gggtatgtggctacctaatttctaa

SEQ ID NO: 639557 - DNA, 25 bp, Mus musculus
gggtatgtggcttcctaatttctaa

SEQ ID NO: 639558 - DNA, 25 bp, Mus musculus
gggtatgtgttgcagcttattccaa

SEQ ID NO: 639559 - DNA, 25 bp, Mus musculus
gggtatgtgttggagcttattccaa

SEQ ID NO: 639560 - DNA, 25 bp, Mus musculus
gggtatgttctaactctggttttga

SEQ ID NO: 639561 - DNA, 25 bp, Mus musculus
gggtatgttctatctctggttttga

SEQ ID NO: 639562 - DNA, 25 bp, Mus musculus
gggtatgttgaccaccctcggaaca

SEQ ID NO: 639563 - DNA, 25 bp, Mus musculus
gggtatgttgacgaccctcggaaca

SEQ ID NO: 639564 - DNA, 25 bp, Mus musculus
gggtatgttgtgacaccacatgcta

SEQ ID NO: 639565 - DNA, 25 bp, Mus musculus
gggtatgttgtgtcaccacatgcta

SEQ ID NO: 639566 - DNA, 25 bp, Mus musculus
gggtatgtttgcatgaatctaacca

SEQ ID NO: 639567 - DNA, 25 bp, Mus musculus
gggtatgtttgcttgaatctaacca

SEQ ID NO: 639568 - DNA, 25 bp, Mus musculus
gggtattaaccaacagcagacttcc

SEQ ID NO: 639569 - DNA, 25 bp, Mus musculus
gggtattaaccatcagcagacttcc

SEQ ID NO: 639570 - DNA, 25 bp, Mus musculus
gggtattaactgacctgctcaagct

SEQ ID NO: 639571 - DNA, 25 bp, Mus musculus
gggtattaactgtcctgctcaagct

SEQ ID NO: 639572 - DNA, 25 bp, Mus musculus
gggtattacaatagtcaacctcata

SEQ ID NO: 639573 - DNA, 25 bp, Mus musculus
gggtattacaattgtcaacctcata

SEQ ID NO: 639574 - DNA, 25 bp, Mus musculus
gggtattacattaagatggactgtg

SEQ ID NO: 639575 - DNA, 25 bp, Mus musculus
gggtattacatttagatggactgtg

SEQ ID NO: 639576 - DNA, 25 bp, Mus musculus
gggtattagaccattccttacacag

SEQ ID NO: 639577 - DNA, 25 bp, Mus musculus
gggtattagacctttccttacacag

SEQ ID NO: 639578 - DNA, 25 bp, Mus musculus
gggtattagctaatgtgcagccaca

SEQ ID NO: 639579 - DNA, 25 bp, Mus musculus
gggtattagctattgtgcagccaca

SEQ ID NO: 639580 - DNA, 25 bp, Mus musculus
gggtattatgccaaaccaagagcaa

SEQ ID NO: 639581 - DNA, 25 bp, Mus musculus
gggtattatgcctaaccaagagcaa

SEQ ID NO: 639582 - DNA, 25 bp, Mus musculus
gggtattatttccataccattctat

SEQ ID NO: 639583 - DNA, 25 bp, Mus musculus
gggtattatttcgataccattctat

SEQ ID NO: 639584 - DNA, 25 bp, Mus musculus
gggtattcacatatgaagattcctt

SEQ ID NO: 639585 - DNA, 25 bp, Mus musculus
gggtattcacatttgaagattcctt

SEQ ID NO: 639586 - DNA, 25 bp, Mus musculus
gggtattcactaaggtcagctaact

SEQ ID NO: 639587 - DNA, 25 bp, Mus musculus
gggtattcactatggtcagctaact

SEQ ID NO: 639588 - DNA, 25 bp, Mus musculus
gggtattcatgcacagtcctggtta

SEQ ID NO: 639589 - DNA, 25 bp, Mus musculus
gggtattcatgctcagtcctggtta

SEQ ID NO: 639590 - DNA, 25 bp, Mus musculus
gggtattccaagacgcagtataacc

SEQ ID NO: 639591 - DNA, 25 bp, Mus musculus
gggtattccaagtcgcagtataacc

SEQ ID NO: 639592 - DNA, 25 bp, Mus musculus
gggtattccattcccagtcctggag

SEQ ID NO: 639593 - DNA, 25 bp, Mus musculus
gggtattccattgccagtcctggag

SEQ ID NO: 639594 - DNA, 25 bp, Mus musculus
gggtattcctccagcccaaggcgtt

SEQ ID NO: 639595 - DNA, 25 bp, Mus musculus
gggtattcctcctgcccaaggcgtt

SEQ ID NO: 639596 - DNA, 25 bp, Mus musculus
gggtattctagactcctgttcagct

SEQ ID NO: 639597 - DNA, 25 bp, Mus musculus
gggtattctagagtcctgttcagct

SEQ ID NO: 639598 - DNA, 25 bp, Mus musculus
gggtattcttaaagaccaggcagat

SEQ ID NO: 639599 - DNA, 25 bp, Mus musculus
gggtattcttaatgaccaggcagat

SEQ ID NO: 639600 - DNA, 25 bp, Mus musculus
gggtattcttgtcgtccatttagtt

SEQ ID NO: 639601 - DNA, 25 bp, Mus musculus
gggtattcttgtggtccatttagtt

SEQ ID NO: 639602 - DNA, 25 bp, Mus musculus
gggtattgatatcaccaccgttaga

SEQ ID NO: 639603 - DNA, 25 bp, Mus musculus
gggtattgatatgaccaccgttaga

SEQ ID NO: 639604 - DNA, 25 bp, Mus musculus
gggtattgcaacagtgtttcttttg

SEQ ID NO: 639605 - DNA, 25 bp, Mus musculus
gggtattgcaactgtgtttcttttg

SEQ ID NO: 639606 - DNA, 25 bp, Mus musculus
gggtattgcaatatccatctagcct

SEQ ID NO: 639607 - DNA, 25 bp, Mus musculus
gggtattgcaatatccctctttaat

SEQ ID NO: 639608 - DNA, 25 bp, Mus musculus
gggtattgcaatttccatctagcct

SEQ ID NO: 639609 - DNA, 25 bp, Mus musculus
gggtattgcaatttccctctttaat

SEQ ID NO: 639610 - DNA, 25 bp, Mus musculus
gggtattgcattatgttgttcctta

SEQ ID NO: 639611 - DNA, 25 bp, Mus musculus
gggtattgcattttgttgttcctta

SEQ ID NO: 639612 - DNA, 25 bp, Mus musculus
gggtattgcctgctgcatttgcagc

SEQ ID NO: 639613 - DNA, 25 bp, Mus musculus
gggtattgcctggtgcatttgcagc

SEQ ID NO: 639614 - DNA, 25 bp, Mus musculus
gggtattgcttgctacttcatttta

SEQ ID NO: 639615 - DNA, 25 bp, Mus musculus
gggtattgcttggtacttcatttta

SEQ ID NO: 639616 - DNA, 25 bp, Mus musculus
gggtattggtacatcctgggagctc

SEQ ID NO: 639617 - DNA, 25 bp, Mus musculus
gggtattggtacttcctgggagctc

SEQ ID NO: 639618 - DNA, 25 bp, Mus musculus
gggtattgtaatcttccttgacgaa

SEQ ID NO: 639619 - DNA, 25 bp, Mus musculus
gggtattgtaatgttccttgacgaa

SEQ ID NO: 639620 - DNA, 25 bp, Mus musculus
gggtattgtaccatcctcagtaaac

SEQ ID NO: 639621 - DNA, 25 bp, Mus musculus
gggtattgtaccttcctcagtaaac

SEQ ID NO: 639622 - DNA, 25 bp, Mus musculus
gggtattgtaggctcagtttccaag

SEQ ID NO: 639623 - DNA, 25 bp, Mus musculus
gggtattgtagggtcagtttccaag

SEQ ID NO: 639624 - DNA, 25 bp, Mus musculus
gggtattgtttcatagtcccggcct

SEQ ID NO: 639625 - DNA, 25 bp, Mus musculus
gggtattgtttcttagtcccggcct

SEQ ID NO: 639626 - DNA, 25 bp, Mus musculus
gggtatttaaatatgcctttgagta

SEQ ID NO: 639627 - DNA, 25 bp, Mus musculus
gggtatttaaatttgcctttgagta

SEQ ID NO: 639628 - DNA, 25 bp, Mus musculus
gggtatttaaggcatgccccatggt

SEQ ID NO: 639629 - DNA, 25 bp, Mus musculus
gggtatttaagggatgccccatggt

SEQ ID NO: 639630 - DNA, 25 bp, Mus musculus
gggtatttcctgcttggcaagcgcc

SEQ ID NO: 639631 - DNA, 25 bp, Mus musculus
gggtatttcctggttggcaagcgcc

SEQ ID NO: 639632 - DNA, 25 bp, Mus musculus
gggtatttctacaatccacttgggc

SEQ ID NO: 639633 - DNA, 25 bp, Mus musculus
gggtatttctactatccacttgggc

SEQ ID NO: 639634 - DNA, 25 bp, Mus musculus
gggtatttctctcgtcacttggtac

SEQ ID NO: 639635 - DNA, 25 bp, Mus musculus
gggtatttctctggtcacttggtac

SEQ ID NO: 639636 - DNA, 25 bp, Mus musculus
gggtatttcttactggcacagtagg

SEQ ID NO: 639637 - DNA, 25 bp, Mus musculus
gggtatttcttagtggcacagtagg

SEQ ID NO: 639638 - DNA, 25 bp, Mus musculus
gggtatttcttcagtatttcagcat

SEQ ID NO: 639639 - DNA, 25 bp, Mus musculus
gggtatttcttctgtatttcagcat

SEQ ID NO: 639640 - DNA, 25 bp, Mus musculus
gggtatttgctcaactttctttata

SEQ ID NO: 639641 - DNA, 25 bp, Mus musculus
gggtatttgctctactttctttata

SEQ ID NO: 639642 - DNA, 25 bp, Mus musculus
gggtatttgtacacatctgtctgaa

SEQ ID NO: 639643 - DNA, 25 bp, Mus musculus
gggtatttgtactcatctgtctgaa

SEQ ID NO: 639644 - DNA, 25 bp, Mus musculus
gggtatttgtcaatgtctgcacatg

SEQ ID NO: 639645 - DNA, 25 bp, Mus musculus
gggtatttgtcattgtctgcacatg

SEQ ID NO: 639646 - DNA, 25 bp, Mus musculus
gggtattttactacatgaatcttat

SEQ ID NO: 639647 - DNA, 25 bp, Mus musculus
gggtattttacttcatgaatcttat

SEQ ID NO: 639648 - DNA, 25 bp, Mus musculus
gggtattttccacagtctttataga

SEQ ID NO: 639649 - DNA, 25 bp, Mus musculus
gggtattttccagagtctttataga

SEQ ID NO: 639650 - DNA, 25 bp, Mus musculus
gggtattttcccaggctgtatgtct

SEQ ID NO: 639651 - DNA, 25 bp, Mus musculus
gggtattttccctggctgtatgtct

SEQ ID NO: 639652 - DNA, 25 bp, Mus musculus
gggtattttcttcgtgcaaagttgt

SEQ ID NO: 639653 - DNA, 25 bp, Mus musculus
gggtattttcttggtgcaaagttgt

SEQ ID NO: 639654 - DNA, 25 bp, Mus musculus
gggtatttttagacagaatccactc

SEQ ID NO: 639655 - DNA, 25 bp, Mus musculus
gggtatttttagtcagaatccactc

SEQ ID NO: 639656 - DNA, 25 bp, Mus musculus
gggtatttttggagtctatgtcaga

SEQ ID NO: 639657 - DNA, 25 bp, Mus musculus
gggtatttttggtgtctatgtcaga

SEQ ID NO: 639658 - DNA, 25 bp, Mus musculus
gggtattttttacggagagcatcat

SEQ ID NO: 639659 - DNA, 25 bp, Mus musculus
gggtattttttagggagagcatcat

SEQ ID NO: 639660 - DNA, 25 bp, Mus musculus
gggtatttttttctatgtattctgg

SEQ ID NO: 639661 - DNA, 25 bp, Mus musculus
gggtatttttttgtatgtattctgg

SEQ ID NO: 639662 - DNA, 25 bp, Mus musculus
gggtcaaaacctaccagtacaactg

SEQ ID NO: 639663 - DNA, 25 bp, Mus musculus
gggtcaaaaccttccagtacaactg

SEQ ID NO: 639664 - DNA, 25 bp, Mus musculus
gggtcaaaaggcaaccagcttgggt

SEQ ID NO: 639665 - DNA, 25 bp, Mus musculus
gggtcaaaaggctaccagcttgggt

SEQ ID NO: 639666 - DNA, 25 bp, Mus musculus
gggtcaaaatgtatccagggcttaa

SEQ ID NO: 639667 - DNA, 25 bp, Mus musculus
gggtcaaaatgtttccagggcttaa

SEQ ID NO: 639668 - DNA, 25 bp, Mus musculus
gggtcaaacaaacacaggccaattt

SEQ ID NO: 639669 - DNA, 25 bp, Mus musculus
gggtcaaacaaagacaggccaattt

SEQ ID NO: 639670 - DNA, 25 bp, Mus musculus
gggtcaaacactcacgacagatggt

SEQ ID NO: 639671 - DNA, 25 bp, Mus musculus
gggtcaaacactgacgacagatggt

SEQ ID NO: 639672 - DNA, 25 bp, Mus musculus
gggtcaaacagtccacatattcctt

SEQ ID NO: 639673 - DNA, 25 bp, Mus musculus
gggtcaaacagtgcacatattcctt

SEQ ID NO: 639674 - DNA, 25 bp, Mus musculus
gggtcaaactatctccaggaacaag

SEQ ID NO: 639675 - DNA, 25 bp, Mus musculus
gggtcaaactatgtccaggaacaag

SEQ ID NO: 639676 - DNA, 25 bp, Mus musculus
gggtcaaacttcaatacctgggtgg

SEQ ID NO: 639677 - DNA, 25 bp, Mus musculus
gggtcaaacttctatacctgggtgg

SEQ ID NO: 639678 - DNA, 25 bp, Mus musculus
gggtcaaagacaaaactgctcactt

SEQ ID NO: 639679 - DNA, 25 bp, Mus musculus
gggtcaaagacataactgctcactt

SEQ ID NO: 639680 - DNA, 25 bp, Mus musculus
gggtcaaagttaacctctcacgttc

SEQ ID NO: 639681 - DNA, 25 bp, Mus musculus
gggtcaaagttatcctctcacgttc

SEQ ID NO: 639682 - DNA, 25 bp, Mus musculus
gggtcaaataccagacttgttaact

SEQ ID NO: 639683 - DNA, 25 bp, Mus musculus
gggtcaaatacctgacttgttaact

SEQ ID NO: 639684 - DNA, 25 bp, Mus musculus
gggtcaaattacacctatccaacac

SEQ ID NO: 639685 - DNA, 25 bp, Mus musculus
gggtcaaattactcctatccaacac

SEQ ID NO: 639686 - DNA, 25 bp, Mus musculus
gggtcaacaaccatcctaatgaatt

SEQ ID NO: 639687 - DNA, 25 bp, Mus musculus
gggtcaacaaccttcctaatgaatt

SEQ ID NO: 639688 - DNA, 25 bp, Mus musculus
gggtcaacagacactaacattatcc

SEQ ID NO: 639689 - DNA, 25 bp, Mus musculus
gggtcaacagactctaacattatcc

SEQ ID NO: 639690 - DNA, 25 bp, Mus musculus
gggtcaacaggtcagcttcaaccac

SEQ ID NO: 639691 - DNA, 25 bp, Mus musculus
gggtcaacaggtgagcttcaaccac

SEQ ID NO: 639692 - DNA, 25 bp, Mus musculus
gggtcaacagttacaaagggctaca

SEQ ID NO: 639693 - DNA, 25 bp, Mus musculus
gggtcaacagtttcaaagggctaca

SEQ ID NO: 639694 - DNA, 25 bp, Mus musculus
gggtcaacatctacaaggaaggcca

SEQ ID NO: 639695 - DNA, 25 bp, Mus musculus
gggtcaacatcttcaaggaaggcca

SEQ ID NO: 639696 - DNA, 25 bp, Mus musculus
gggtcaacattgaaaaagttcctgg

SEQ ID NO: 639697 - DNA, 25 bp, Mus musculus
gggtcaacattgtaaaagttcctgg

SEQ ID NO: 639698 - DNA, 25 bp, Mus musculus
gggtcaaccccacatggactaattg

SEQ ID NO: 639699 - DNA, 25 bp, Mus musculus
gggtcaaccccagatggactaattg

SEQ ID NO: 639700 - DNA, 25 bp, Mus musculus
gggtcaaccgtgaacacgatgcaaa

SEQ ID NO: 639701 - DNA, 25 bp, Mus musculus
gggtcaaccgtgtacacgatgcaaa

SEQ ID NO: 639702 - DNA, 25 bp, Mus musculus
gggtcaacctgaacatacctgtgaa

SEQ ID NO: 639703 - DNA, 25 bp, Mus musculus
gggtcaacctgatcatacctgtgaa

SEQ ID NO: 639704 - DNA, 25 bp, Mus musculus
gggtcaacggacctgaagacttcaa

SEQ ID NO: 639705 - DNA, 25 bp, Mus musculus
gggtcaacggacgtgaagacttcaa

SEQ ID NO: 639706 - DNA, 25 bp, Mus musculus
gggtcaacgtcactgtgtcccagat

SEQ ID NO: 639707 - DNA, 25 bp, Mus musculus
gggtcaacgtcagtgtgtcccagat

SEQ ID NO: 639708 - DNA, 25 bp, Mus musculus
gggtcaactgacatccattgtatat

SEQ ID NO: 639709 - DNA, 25 bp, Mus musculus
gggtcaactgacttccattgtatat

SEQ ID NO: 639710 - DNA, 25 bp, Mus musculus
gggtcaacttcactaagcttcctct

SEQ ID NO: 639711 - DNA, 25 bp, Mus musculus
gggtcaacttcagtaagcttcctct

SEQ ID NO: 639712 - DNA, 25 bp, Mus musculus
gggtcaacttggcaactcaattctg

SEQ ID NO: 639713 - DNA, 25 bp, Mus musculus
gggtcaacttgggaactcaattctg

SEQ ID NO: 639714 - DNA, 25 bp, Mus musculus
gggtcaacttgtactatttctgcat

SEQ ID NO: 639715 - DNA, 25 bp, Mus musculus
gggtcaacttgttctatttctgcat

SEQ ID NO: 639716 - DNA, 25 bp, Mus musculus
gggtcaagcaggcacccaaggcaac

SEQ ID NO: 639717 - DNA, 25 bp, Mus musculus
gggtcaagcagggacccaaggcaac

SEQ ID NO: 639718 - DNA, 25 bp, Mus musculus
gggtcaagccagcacaacatgacat

SEQ ID NO: 639719 - DNA, 25 bp, Mus musculus
gggtcaagccaggacaacatgacat

SEQ ID NO: 639720 - DNA, 25 bp, Mus musculus
gggtcaagccttagcaaaatattgt

SEQ ID NO: 639721 - DNA, 25 bp, Mus musculus
gggtcaagcctttgcaaaatattgt

SEQ ID NO: 639722 - DNA, 25 bp, Mus musculus
gggtcaaggaaacccctcagcctca

SEQ ID NO: 639723 - DNA, 25 bp, Mus musculus
gggtcaaggaaagccctcagcctca

SEQ ID NO: 639724 - DNA, 25 bp, Mus musculus
gggtcaaggagtccttcctgcacaa

SEQ ID NO: 639725 - DNA, 25 bp, Mus musculus
gggtcaaggagtgcttcctgcacaa

SEQ ID NO: 639726 - DNA, 25 bp, Mus musculus
gggtcaaggcagacatgctgaaact

SEQ ID NO: 639727 - DNA, 25 bp, Mus musculus
gggtcaaggcagtcatgctgaaact

SEQ ID NO: 639728 - DNA, 25 bp, Mus musculus
gggtcaagtcccctcagatccgagg

SEQ ID NO: 639729 - DNA, 25 bp, Mus musculus
gggtcaagtcccgtcagatccgagg

SEQ ID NO: 639730 - DNA, 25 bp, Mus musculus
gggtcaagtgccattgaagcattac

SEQ ID NO: 639731 - DNA, 25 bp, Mus musculus
gggtcaagtgcctttgaagcattac

SEQ ID NO: 639732 - DNA, 25 bp, Mus musculus
gggtcaagtgctcgtctttcgctac

SEQ ID NO: 639733 - DNA, 25 bp, Mus musculus
gggtcaagtgctctttctgaggacc

SEQ ID NO: 639734 - DNA, 25 bp, Mus musculus
gggtcaagtgctggtctttcgctac

SEQ ID NO: 639735 - DNA, 25 bp, Mus musculus
gggtcaagtgctgtttctgaggacc

SEQ ID NO: 639736 - DNA, 25 bp, Mus musculus
gggtcaagttagctgtacttttgat

SEQ ID NO: 639737 - DNA, 25 bp, Mus musculus
gggtcaagttaggtgtacttttgat

SEQ ID NO: 639738 - DNA, 25 bp, Mus musculus
gggtcaagtttaccctggccaagat

SEQ ID NO: 639739 - DNA, 25 bp, Mus musculus
gggtcaagtttagcctggccaagat

SEQ ID NO: 639740 - DNA, 25 bp, Mus musculus
gggtcaataatcattcaggccatga

SEQ ID NO: 639741 - DNA, 25 bp, Mus musculus
gggtcaataatctttcaggccatga

SEQ ID NO: 639742 - DNA, 25 bp, Mus musculus
gggtcaatcaacattatgctatccg

SEQ ID NO: 639743 - DNA, 25 bp, Mus musculus
gggtcaatcaactttatgctatccg

SEQ ID NO: 639744 - DNA, 25 bp, Mus musculus
gggtcaatgaataacctccagcaag

SEQ ID NO: 639745 - DNA, 25 bp, Mus musculus
gggtcaatgaattacctccagcaag

SEQ ID NO: 639746 - DNA, 25 bp, Mus musculus
gggtcaatgatccagatccaaagat

SEQ ID NO: 639747 - DNA, 25 bp, Mus musculus
gggtcaatgatcgagatccaaagat

SEQ ID NO: 639748 - DNA, 25 bp, Mus musculus
gggtcaatggagatttccctccagt

SEQ ID NO: 639749 - DNA, 25 bp, Mus musculus
gggtcaatggagttttccctccagt

SEQ ID NO: 639750 - DNA, 25 bp, Mus musculus
gggtcacaaagtaacaacctccagt

SEQ ID NO: 639751 - DNA, 25 bp, Mus musculus
gggtcacaaagttacaacctccagt

SEQ ID NO: 639752 - DNA, 25 bp, Mus musculus
gggtcacaagacaatcctattcctg

SEQ ID NO: 639753 - DNA, 25 bp, Mus musculus
gggtcacaagactatcctattcctg

SEQ ID NO: 639754 - DNA, 25 bp, Mus musculus
gggtcacacattcacaggaatctgc

SEQ ID NO: 639755 - DNA, 25 bp, Mus musculus
gggtcacacattgacaggaatctgc

SEQ ID NO: 639756 - DNA, 25 bp, Mus musculus
gggtcacaccaaccgaggacactaa

SEQ ID NO: 639757 - DNA, 25 bp, Mus musculus
gggtcacaccaagcgaggacactaa

SEQ ID NO: 639758 - DNA, 25 bp, Mus musculus
gggtcacaccccaaagaactggatt

SEQ ID NO: 639759 - DNA, 25 bp, Mus musculus
gggtcacacccctaagaactggatt

SEQ ID NO: 639760 - DNA, 25 bp, Mus musculus
gggtcacactcgacagttgctgtta

SEQ ID NO: 639761 - DNA, 25 bp, Mus musculus
gggtcacactcgtcagttgctgtta

SEQ ID NO: 639762 - DNA, 25 bp, Mus musculus
gggtcacactgcagaaaccgttgat

SEQ ID NO: 639763 - DNA, 25 bp, Mus musculus
gggtcacactgctgaaaccgttgat

SEQ ID NO: 639764 - DNA, 25 bp, Mus musculus
gggtcacacttactgtgttcctatg

SEQ ID NO: 639765 - DNA, 25 bp, Mus musculus
gggtcacacttagtgtgttcctatg

SEQ ID NO: 639766 - DNA, 25 bp, Mus musculus
gggtcacactttcatacaccgtaaa

SEQ ID NO: 639767 - DNA, 25 bp, Mus musculus
gggtcacactttgatacaccgtaaa

SEQ ID NO: 639768 - DNA, 25 bp, Mus musculus
gggtcacagacgaggaactcatcac

SEQ ID NO: 639769 - DNA, 25 bp, Mus musculus
gggtcacagacgtggaactcatcac

SEQ ID NO: 639770 - DNA, 25 bp, Mus musculus
gggtcacagagaacgtgtgccttga

SEQ ID NO: 639771 - DNA, 25 bp, Mus musculus
gggtcacagagatcgtgtgccttga

SEQ ID NO: 639772 - DNA, 25 bp, Mus musculus
gggtcacagcagcattgtctacaca

SEQ ID NO: 639773 - DNA, 25 bp, Mus musculus
gggtcacagcaggattgtctacaca

SEQ ID NO: 639774 - DNA, 25 bp, Mus musculus
gggtcacagtggatgtgctgatcct

SEQ ID NO: 639775 - DNA, 25 bp, Mus musculus
gggtcacagtggttgtgctgatcct

SEQ ID NO: 639776 - DNA, 25 bp, Mus musculus
gggtcacagttgcttgtgagctact

SEQ ID NO: 639777 - DNA, 25 bp, Mus musculus
gggtcacagttggttgtgagctact

SEQ ID NO: 639778 - DNA, 25 bp, Mus musculus
gggtcacataacatgctttacactc

SEQ ID NO: 639779 - DNA, 25 bp, Mus musculus
gggtcacataacttgctttacactc

SEQ ID NO: 639780 - DNA, 25 bp, Mus musculus
gggtcacatagtcaatctgtccatt

SEQ ID NO: 639781 - DNA, 25 bp, Mus musculus
gggtcacatagtgaatctgtccatt

SEQ ID NO: 639782 - DNA, 25 bp, Mus musculus
gggtcacatcataggtctcaggcaa

SEQ ID NO: 639783 - DNA, 25 bp, Mus musculus
gggtcacatcattggtctcaggcaa

SEQ ID NO: 639784 - DNA, 25 bp, Mus musculus
gggtcacatcgactttttctcctaa

SEQ ID NO: 639785 - DNA, 25 bp, Mus musculus
gggtcacatcgagtttttctcctaa

SEQ ID NO: 639786 - DNA, 25 bp, Mus musculus
gggtcacatcgtctcactgttaact

SEQ ID NO: 639787 - DNA, 25 bp, Mus musculus
gggtcacatcgtgtcactgttaact

SEQ ID NO: 639788 - DNA, 25 bp, Mus musculus
gggtcacatgcaatagtctcactgt

SEQ ID NO: 639789 - DNA, 25 bp, Mus musculus
gggtcacatgcattagtctcactgt

SEQ ID NO: 639790 - DNA, 25 bp, Mus musculus
gggtcacattggattttctctatat

SEQ ID NO: 639791 - DNA, 25 bp, Mus musculus
gggtcacattggtttttctctatat

SEQ ID NO: 639792 - DNA, 25 bp, Mus musculus
gggtcacattgtattcaaaagattc

SEQ ID NO: 639793 - DNA, 25 bp, Mus musculus
gggtcacattgttttcaaaagattc

SEQ ID NO: 639794 - DNA, 25 bp, Mus musculus
gggtcaccaaagaaggcagactgct

SEQ ID NO: 639795 - DNA, 25 bp, Mus musculus
gggtcaccaaagtaggcagactgct

SEQ ID NO: 639796 - DNA, 25 bp, Mus musculus
gggtcaccaagcacaaagtgaattt

SEQ ID NO: 639797 - DNA, 25 bp, Mus musculus
gggtcaccaagcatagcaccatgca

SEQ ID NO: 639798 - DNA, 25 bp, Mus musculus
gggtcaccaagctcaaagtgaattt

SEQ ID NO: 639799 - DNA, 25 bp, Mus musculus
gggtcaccaagcttagcaccatgca

SEQ ID NO: 639800 - DNA, 25 bp, Mus musculus
gggtcaccaatcacgtgtctcaaaa

SEQ ID NO: 639801 - DNA, 25 bp, Mus musculus
gggtcaccaatctcgtgtctcaaaa

SEQ ID NO: 639802 - DNA, 25 bp, Mus musculus
gggtcaccacacctgtgttaaagga

SEQ ID NO: 639803 - DNA, 25 bp, Mus musculus
gggtcaccacacgtgtgttaaagga

SEQ ID NO: 639804 - DNA, 25 bp, Mus musculus
gggtcaccacccataggatgtgaac

SEQ ID NO: 639805 - DNA, 25 bp, Mus musculus
gggtcaccacccttaggatgtgaac

SEQ ID NO: 639806 - DNA, 25 bp, Mus musculus
gggtcaccataacattccgtagatg

SEQ ID NO: 639807 - DNA, 25 bp, Mus musculus
gggtcaccataagattccgtagatg

SEQ ID NO: 639808 - DNA, 25 bp, Mus musculus
gggtcaccatagcacattccagaaa

SEQ ID NO: 639809 - DNA, 25 bp, Mus musculus
gggtcaccataggacattccagaaa

SEQ ID NO: 639810 - DNA, 25 bp, Mus musculus
gggtcaccatgtcggaggccttctc

SEQ ID NO: 639811 - DNA, 25 bp, Mus musculus
gggtcaccatgtgggaggccttctc

SEQ ID NO: 639812 - DNA, 25 bp, Mus musculus
gggtcaccctaactagtgttcaggt

SEQ ID NO: 639813 - DNA, 25 bp, Mus musculus
gggtcaccctaagtagtgttcaggt

SEQ ID NO: 639814 - DNA, 25 bp, Mus musculus
gggtcaccctcacaacatatgaagt

SEQ ID NO: 639815 - DNA, 25 bp, Mus musculus
gggtcaccctcagaacatatgaagt

SEQ ID NO: 639816 - DNA, 25 bp, Mus musculus
gggtcaccgcaaatggagccaaagc

SEQ ID NO: 639817 - DNA, 25 bp, Mus musculus
gggtcaccgcaattggagccaaagc

SEQ ID NO: 639818 - DNA, 25 bp, Mus musculus
gggtcacctaaacccatcggaaagc

SEQ ID NO: 639819 - DNA, 25 bp, Mus musculus
gggtcacctaaagccatcggaaagc

SEQ ID NO: 639820 - DNA, 25 bp, Mus musculus
gggtcacctagcatgcagcatagca

SEQ ID NO: 639821 - DNA, 25 bp, Mus musculus
gggtcacctagcttgcagcatagca

SEQ ID NO: 639822 - DNA, 25 bp, Mus musculus
gggtcacctggaacttcctccaagg

SEQ ID NO: 639823 - DNA, 25 bp, Mus musculus
gggtcacctggatcttcctccaagg

SEQ ID NO: 639824 - DNA, 25 bp, Mus musculus
gggtcacctggtctccaaaccaaga

SEQ ID NO: 639825 - DNA, 25 bp, Mus musculus
gggtcacctggtgtccaaaccaaga

SEQ ID NO: 639826 - DNA, 25 bp, Mus musculus
gggtcacctgtcagggcttatgact

SEQ ID NO: 639827 - DNA, 25 bp, Mus musculus
gggtcacctgtctgggcttatgact

SEQ ID NO: 639828 - DNA, 25 bp, Mus musculus
gggtcaccttttatcacctcttggt

SEQ ID NO: 639829 - DNA, 25 bp, Mus musculus
gggtcaccttttttcacctcttggt

SEQ ID NO: 639830 - DNA, 25 bp, Mus musculus
gggtcacgaaacacagggctgtagc

SEQ ID NO: 639831 - DNA, 25 bp, Mus musculus
gggtcacgaaactcagggctgtagc

SEQ ID NO: 639832 - DNA, 25 bp, Mus musculus
gggtcacgacccacaggttgtgaga

SEQ ID NO: 639833 - DNA, 25 bp, Mus musculus
gggtcacgaccctcaggttgtgaga

SEQ ID NO: 639834 - DNA, 25 bp, Mus musculus
gggtcacgatgaactctgagaacca

SEQ ID NO: 639835 - DNA, 25 bp, Mus musculus
gggtcacgatgatctctgagaacca

SEQ ID NO: 639836 - DNA, 25 bp, Mus musculus
gggtcacgcacacttttgtatgttg

SEQ ID NO: 639837 - DNA, 25 bp, Mus musculus
gggtcacgcacagttttgtatgttg

SEQ ID NO: 639838 - DNA, 25 bp, Mus musculus
gggtcacggactaaggaaacactgc

SEQ ID NO: 639839 - DNA, 25 bp, Mus musculus
gggtcacggacttaggaaacactgc

SEQ ID NO: 639840 - DNA, 25 bp, Mus musculus
gggtcacgtataagatatcttgcat

SEQ ID NO: 639841 - DNA, 25 bp, Mus musculus
gggtcacgtatatgatatcttgcat

SEQ ID NO: 639842 - DNA, 25 bp, Mus musculus
gggtcacgtgctctatggaagccta

SEQ ID NO: 639843 - DNA, 25 bp, Mus musculus
gggtcacgtgctgtatggaagccta

SEQ ID NO: 639844 - DNA, 25 bp, Mus musculus
gggtcactaactcgttctagctcaa

SEQ ID NO: 639845 - DNA, 25 bp, Mus musculus
gggtcactaactggttctagctcaa

SEQ ID NO: 639846 - DNA, 25 bp, Mus musculus
gggtcactacatatcatagaccatc

SEQ ID NO: 639847 - DNA, 25 bp, Mus musculus
gggtcactacatttcatagaccatc

SEQ ID NO: 639848 - DNA, 25 bp, Mus musculus
gggtcactatacaccactggaactc

SEQ ID NO: 639849 - DNA, 25 bp, Mus musculus
gggtcactatactccactggaactc

SEQ ID NO: 639850 - DNA, 25 bp, Mus musculus
gggtcactatcaccaaatccagttg

SEQ ID NO: 639851 - DNA, 25 bp, Mus musculus
gggtcactatcagcaaatccagttg

SEQ ID NO: 639852 - DNA, 25 bp, Mus musculus
gggtcactcagcagctatgggacag

SEQ ID NO: 639853 - DNA, 25 bp, Mus musculus
gggtcactcagctgctatgggacag

SEQ ID NO: 639854 - DNA, 25 bp, Mus musculus
gggtcactccggaaacctgcactga

SEQ ID NO: 639855 - DNA, 25 bp, Mus musculus
gggtcactccggtaacctgcactga

SEQ ID NO: 639856 - DNA, 25 bp, Mus musculus
gggtcactctcacacatttagtaag

SEQ ID NO: 639857 - DNA, 25 bp, Mus musculus
gggtcactctcactagcacagcttt

SEQ ID NO: 639858 - DNA, 25 bp, Mus musculus
gggtcactctcagacatttagtaag

SEQ ID NO: 639859 - DNA, 25 bp, Mus musculus
gggtcactctcagtagcacagcttt

SEQ ID NO: 639860 - DNA, 25 bp, Mus musculus
gggtcactctctctcttgagggaac

SEQ ID NO: 639861 - DNA, 25 bp, Mus musculus
gggtcactctctgtcttgagggaac

SEQ ID NO: 639862 - DNA, 25 bp, Mus musculus
gggtcactcttgagcattggcttga

SEQ ID NO: 639863 - DNA, 25 bp, Mus musculus
gggtcactcttgtgcattggcttga

SEQ ID NO: 639864 - DNA, 25 bp, Mus musculus
gggtcactgaatatggctatgccac

SEQ ID NO: 639865 - DNA, 25 bp, Mus musculus
gggtcactgaatttggctatgccac

SEQ ID NO: 639866 - DNA, 25 bp, Mus musculus
gggtcactgataaaatactgctcta

SEQ ID NO: 639867 - DNA, 25 bp, Mus musculus
gggtcactgatataatactgctcta

SEQ ID NO: 639868 - DNA, 25 bp, Mus musculus
gggtcactgcagactgtcccctggg

SEQ ID NO: 639869 - DNA, 25 bp, Mus musculus
gggtcactgcagtctgtcccctggg

SEQ ID NO: 639870 - DNA, 25 bp, Mus musculus
gggtcactgctacttaaggtcctag

SEQ ID NO: 639871 - DNA, 25 bp, Mus musculus
gggtcactgctagttaaggtcctag

SEQ ID NO: 639872 - DNA, 25 bp, Mus musculus
gggtcactgcttcactagcccaacc

SEQ ID NO: 639873 - DNA, 25 bp, Mus musculus
gggtcactgcttgactagcccaacc

SEQ ID NO: 639874 - DNA, 25 bp, Mus musculus
gggtcactggaccacagtccaggat

SEQ ID NO: 639875 - DNA, 25 bp, Mus musculus
gggtcactggacgacagtccaggat

SEQ ID NO: 639876 - DNA, 25 bp, Mus musculus
gggtcactggatagtttcgtgttta

SEQ ID NO: 639877 - DNA, 25 bp, Mus musculus
gggtcactggatattgtggccactt

SEQ ID NO: 639878 - DNA, 25 bp, Mus musculus
gggtcactggattgtttcgtgttta

SEQ ID NO: 639879 - DNA, 25 bp, Mus musculus
gggtcactggattttgtggccactt

SEQ ID NO: 639880 - DNA, 25 bp, Mus musculus
gggtcactggctcaccaggaaccta

SEQ ID NO: 639881 - DNA, 25 bp, Mus musculus
gggtcactggctgaccaggaaccta

SEQ ID NO: 639882 - DNA, 25 bp, Mus musculus
gggtcactgggcaaaccatatgtta

SEQ ID NO: 639883 - DNA, 25 bp, Mus musculus
gggtcactgggctaaccatatgtta

SEQ ID NO: 639884 - DNA, 25 bp, Mus musculus
gggtcactggtgagagaccatttta

SEQ ID NO: 639885 - DNA, 25 bp, Mus musculus
gggtcactggtgtgagaccatttta

SEQ ID NO: 639886 - DNA, 25 bp, Mus musculus
gggtcactgtcaaacagcggatcat

SEQ ID NO: 639887 - DNA, 25 bp, Mus musculus
gggtcactgtcatacagcggatcat

SEQ ID NO: 639888 - DNA, 25 bp, Mus musculus
gggtcacttaatcaggcgctgcaaa

SEQ ID NO: 639889 - DNA, 25 bp, Mus musculus
gggtcacttaatgaggcgctgcaaa

SEQ ID NO: 639890 - DNA, 25 bp, Mus musculus
gggtcacttagaagcagtcagggca

SEQ ID NO: 639891 - DNA, 25 bp, Mus musculus
gggtcacttagatgcagtcagggca

SEQ ID NO: 639892 - DNA, 25 bp, Mus musculus
gggtcacttctcagcccatgggctc

SEQ ID NO: 639893 - DNA, 25 bp, Mus musculus
gggtcacttctctgcccatgggctc

SEQ ID NO: 639894 - DNA, 25 bp, Mus musculus
gggtcacttgtacttcataatgtat

SEQ ID NO: 639895 - DNA, 25 bp, Mus musculus
gggtcacttgtagttcataatgtat

SEQ ID NO: 639896 - DNA, 25 bp, Mus musculus
gggtcactttccagcaggccctgtg

SEQ ID NO: 639897 - DNA, 25 bp, Mus musculus
gggtcactttcctgcaggccctgtg

SEQ ID NO: 639898 - DNA, 25 bp, Mus musculus
gggtcagaagcaaacggccacgctc

SEQ ID NO: 639899 - DNA, 25 bp, Mus musculus
gggtcagaagcatacggccacgctc

SEQ ID NO: 639900 - DNA, 25 bp, Mus musculus
gggtcagaagccatggagtcagcat

SEQ ID NO: 639901 - DNA, 25 bp, Mus musculus
gggtcagaagccttggagtcagcat

SEQ ID NO: 639902 - DNA, 25 bp, Mus musculus
gggtcagaattcattggccttacac

SEQ ID NO: 639903 - DNA, 25 bp, Mus musculus
gggtcagaattctttggccttacac

SEQ ID NO: 639904 - DNA, 25 bp, Mus musculus
gggtcagaccaacgccatatccatg

SEQ ID NO: 639905 - DNA, 25 bp, Mus musculus
gggtcagaccaaggccatatccatg

SEQ ID NO: 639906 - DNA, 25 bp, Mus musculus
gggtcagacccacatgtgcgttaca

SEQ ID NO: 639907 - DNA, 25 bp, Mus musculus
gggtcagacccagatgtgcgttaca

SEQ ID NO: 639908 - DNA, 25 bp, Mus musculus
gggtcagaccccataactgtgaatg

SEQ ID NO: 639909 - DNA, 25 bp, Mus musculus
gggtcagaccccttaactgtgaatg

SEQ ID NO: 639910 - DNA, 25 bp, Mus musculus
gggtcagacgtacaacggctcctga

SEQ ID NO: 639911 - DNA, 25 bp, Mus musculus
gggtcagacgtagaacggctcctga

SEQ ID NO: 639912 - DNA, 25 bp, Mus musculus
gggtcagactcaaacggcagcagtt

SEQ ID NO: 639913 - DNA, 25 bp, Mus musculus
gggtcagactcatacggcagcagtt

SEQ ID NO: 639914 - DNA, 25 bp, Mus musculus
gggtcagagcagctgccagtccaca

SEQ ID NO: 639915 - DNA, 25 bp, Mus musculus
gggtcagagcaggtgccagtccaca

SEQ ID NO: 639916 - DNA, 25 bp, Mus musculus
gggtcagagctcaaattcccagcat

SEQ ID NO: 639917 - DNA, 25 bp, Mus musculus
gggtcagagctctaattcccagcat

SEQ ID NO: 639918 - DNA, 25 bp, Mus musculus
gggtcagaggcccccatcccaggat

SEQ ID NO: 639919 - DNA, 25 bp, Mus musculus
gggtcagaggccgccatcccaggat

SEQ ID NO: 639920 - DNA, 25 bp, Mus musculus
gggtcagaggctaatggtctccacc

SEQ ID NO: 639921 - DNA, 25 bp, Mus musculus
gggtcagaggcttatggtctccacc

SEQ ID NO: 639922 - DNA, 25 bp, Mus musculus
gggtcagaggtacatttccctactc

SEQ ID NO: 639923 - DNA, 25 bp, Mus musculus
gggtcagaggtagatttccctactc

SEQ ID NO: 639924 - DNA, 25 bp, Mus musculus
gggtcagaggtcaagatcaccatca

SEQ ID NO: 639925 - DNA, 25 bp, Mus musculus
gggtcagaggtctagatcaccatca

SEQ ID NO: 639926 - DNA, 25 bp, Mus musculus
gggtcagaggttcaaacgaagtctc

SEQ ID NO: 639927 - DNA, 25 bp, Mus musculus
gggtcagaggttgaaacgaagtctc

SEQ ID NO: 639928 - DNA, 25 bp, Mus musculus
gggtcagagtccagcaccactacat

SEQ ID NO: 639929 - DNA, 25 bp, Mus musculus
gggtcagagtcctgcaccactacat

SEQ ID NO: 639930 - DNA, 25 bp, Mus musculus
gggtcagagttgcattcctagcacc

SEQ ID NO: 639931 - DNA, 25 bp, Mus musculus
gggtcagagttggattcctagcacc

SEQ ID NO: 639932 - DNA, 25 bp, Mus musculus
gggtcagatattccagacgttaaga

SEQ ID NO: 639933 - DNA, 25 bp, Mus musculus
gggtcagatattgcagacgttaaga

SEQ ID NO: 639934 - DNA, 25 bp, Mus musculus
gggtcagatcttaaactcagtactc

SEQ ID NO: 639935 - DNA, 25 bp, Mus musculus
gggtcagatctttaactcagtactc

SEQ ID NO: 639936 - DNA, 25 bp, Mus musculus
gggtcagatgccaggtccctgccta

SEQ ID NO: 639937 - DNA, 25 bp, Mus musculus
gggtcagatgcctggtccctgccta

SEQ ID NO: 639938 - DNA, 25 bp, Mus musculus
gggtcagcaaccaggctctatgcat

SEQ ID NO: 639939 - DNA, 25 bp, Mus musculus
gggtcagcaacctggctctatgcat

SEQ ID NO: 639940 - DNA, 25 bp, Mus musculus
gggtcagcaagtcatcacgatagtt

SEQ ID NO: 639941 - DNA, 25 bp, Mus musculus
gggtcagcaagtgatcacgatagtt

SEQ ID NO: 639942 - DNA, 25 bp, Mus musculus
gggtcagcacacacatagatggctt

SEQ ID NO: 639943 - DNA, 25 bp, Mus musculus
gggtcagcacactcatagatggctt

SEQ ID NO: 639944 - DNA, 25 bp, Mus musculus
gggtcagcacggaccctcaggccta

SEQ ID NO: 639945 - DNA, 25 bp, Mus musculus
gggtcagcacggtccctcaggccta

SEQ ID NO: 639946 - DNA, 25 bp, Mus musculus
gggtcagcagagatgttgaatctta

SEQ ID NO: 639947 - DNA, 25 bp, Mus musculus
gggtcagcagagttgttgaatctta

SEQ ID NO: 639948 - DNA, 25 bp, Mus musculus
gggtcagcagcaactttgatgtggt

SEQ ID NO: 639949 - DNA, 25 bp, Mus musculus
gggtcagcagcatctttgatgtggt

SEQ ID NO: 639950 - DNA, 25 bp, Mus musculus
gggtcagcaggaagaagacgactta

SEQ ID NO: 639951 - DNA, 25 bp, Mus musculus
gggtcagcaggatgaagacgactta

SEQ ID NO: 639952 - DNA, 25 bp, Mus musculus
gggtcagcagttacatcagcgccgc

SEQ ID NO: 639953 - DNA, 25 bp, Mus musculus
gggtcagcagtttcatcagcgccgc

SEQ ID NO: 639954 - DNA, 25 bp, Mus musculus
gggtcagccatgatgctcagtgatc

SEQ ID NO: 639955 - DNA, 25 bp, Mus musculus
gggtcagccatgcatgatggacagc

SEQ ID NO: 639956 - DNA, 25 bp, Mus musculus
gggtcagccatggatgatggacagc

SEQ ID NO: 639957 - DNA, 25 bp, Mus musculus
gggtcagccatgttgctcagtgatc

SEQ ID NO: 639958 - DNA, 25 bp, Mus musculus
gggtcagccccaactggcaggtgca

SEQ ID NO: 639959 - DNA, 25 bp, Mus musculus
gggtcagccccatctggcaggtgca

SEQ ID NO: 639960 - DNA, 25 bp, Mus musculus
gggtcagctagccaacacacagcct

SEQ ID NO: 639961 - DNA, 25 bp, Mus musculus
gggtcagctagcgaacacacagcct

SEQ ID NO: 639962 - DNA, 25 bp, Mus musculus
gggtcagctgagcatctaaaaccat

SEQ ID NO: 639963 - DNA, 25 bp, Mus musculus
gggtcagctgaggatctaaaaccat

SEQ ID NO: 639964 - DNA, 25 bp, Mus musculus
gggtcagctgtaccaggaacaccat

SEQ ID NO: 639965 - DNA, 25 bp, Mus musculus
gggtcagctgtagcaggaacaccat

SEQ ID NO: 639966 - DNA, 25 bp, Mus musculus
gggtcagcttggatcattgtgcaat

SEQ ID NO: 639967 - DNA, 25 bp, Mus musculus
gggtcagcttggcatcttgctaaag

SEQ ID NO: 639968 - DNA, 25 bp, Mus musculus
gggtcagcttgggatcttgctaaag

SEQ ID NO: 639969 - DNA, 25 bp, Mus musculus
gggtcagcttggttcattgtgcaat

SEQ ID NO: 639970 - DNA, 25 bp, Mus musculus
gggtcagcttgtcctggcatccact

SEQ ID NO: 639971 - DNA, 25 bp, Mus musculus
gggtcagcttgtgctggcatccact

SEQ ID NO: 639972 - DNA, 25 bp, Mus musculus
gggtcagctttcaatcttctggaga

SEQ ID NO: 639973 - DNA, 25 bp, Mus musculus
gggtcagctttctatcttctggaga

SEQ ID NO: 639974 - DNA, 25 bp, Mus musculus
gggtcaggaacaactcagccatcca

SEQ ID NO: 639975 - DNA, 25 bp, Mus musculus
gggtcaggaacactacactgcacag

SEQ ID NO: 639976 - DNA, 25 bp, Mus musculus
gggtcaggaacagtacactgcacag

SEQ ID NO: 639977 - DNA, 25 bp, Mus musculus
gggtcaggaacatctcagccatcca

SEQ ID NO: 639978 - DNA, 25 bp, Mus musculus
gggtcaggattgaaagcttaagcca

SEQ ID NO: 639979 - DNA, 25 bp, Mus musculus
gggtcaggattgtaagcttaagcca

SEQ ID NO: 639980 - DNA, 25 bp, Mus musculus
gggtcaggatttctttcagtgccat

SEQ ID NO: 639981 - DNA, 25 bp, Mus musculus
gggtcaggatttgtttcagtgccat

SEQ ID NO: 639982 - DNA, 25 bp, Mus musculus
gggtcagggttacgcctagcttctt

SEQ ID NO: 639983 - DNA, 25 bp, Mus musculus
gggtcagggttaggcctagcttctt

SEQ ID NO: 639984 - DNA, 25 bp, Mus musculus
gggtcaggtaacaacttgatgctta

SEQ ID NO: 639985 - DNA, 25 bp, Mus musculus
gggtcaggtaactacttgatgctta

SEQ ID NO: 639986 - DNA, 25 bp, Mus musculus
gggtcaggtctgcaatcgcaaacta

SEQ ID NO: 639987 - DNA, 25 bp, Mus musculus
gggtcaggtctggaatcgcaaacta

SEQ ID NO: 639988 - DNA, 25 bp, Mus musculus
gggtcaggtgttacaacatcatcct

SEQ ID NO: 639989 - DNA, 25 bp, Mus musculus
gggtcaggtgtttcaacatcatcct

SEQ ID NO: 639990 - DNA, 25 bp, Mus musculus
gggtcaggttaccacagacctgttt

SEQ ID NO: 639991 - DNA, 25 bp, Mus musculus
gggtcaggttacgacagacctgttt

SEQ ID NO: 639992 - DNA, 25 bp, Mus musculus
gggtcagtacacattatagtcaggc

SEQ ID NO: 639993 - DNA, 25 bp, Mus musculus
gggtcagtacactttatagtcaggc

SEQ ID NO: 639994 - DNA, 25 bp, Mus musculus
gggtcagtacagatgccattacgac

SEQ ID NO: 639995 - DNA, 25 bp, Mus musculus
gggtcagtacagttgccattacgac

SEQ ID NO: 639996 - DNA, 25 bp, Mus musculus
gggtcagtcacaaggccagttttat

SEQ ID NO: 639997 - DNA, 25 bp, Mus musculus
gggtcagtcacatggccagttttat

SEQ ID NO: 639998 - DNA, 25 bp, Mus musculus
gggtcagtcagcaagcactgacatt

SEQ ID NO: 639999 - DNA, 25 bp, Mus musculus
gggtcagtcagcacatctggcagac

SEQ ID NO: 640000 - DNA, 25 bp, Mus musculus
gggtcagtcagctagcactgacatt

SEQ ID NO: 640001 - DNA, 25 bp, Mus musculus
gggtcagtcagctcatctggcagac

SEQ ID NO: 640002 - DNA, 25 bp, Mus musculus
gggtcagtcagtaatgggcactcta

SEQ ID NO: 640003 - DNA, 25 bp, Mus musculus
gggtcagtcagtcgcttttgtaaat

SEQ ID NO: 640004 - DNA, 25 bp, Mus musculus
gggtcagtcagtggcttttgtaaat

SEQ ID NO: 640005 - DNA, 25 bp, Mus musculus
gggtcagtcagttatgggcactcta

SEQ ID NO: 640006 - DNA, 25 bp, Mus musculus
gggtcagtcatccacagtttcaaaa

SEQ ID NO: 640007 - DNA, 25 bp, Mus musculus
gggtcagtcatcctgtgtcagcctt

SEQ ID NO: 640008 - DNA, 25 bp, Mus musculus
gggtcagtcatcgacagtttcaaaa

SEQ ID NO: 640009 - DNA, 25 bp, Mus musculus
gggtcagtcatcgtgtgtcagcctt

SEQ ID NO: 640010 - DNA, 25 bp, Mus musculus
gggtcagtccatcaaactagacttg

SEQ ID NO: 640011 - DNA, 25 bp, Mus musculus
gggtcagtccatgaaactagacttg

SEQ ID NO: 640012 - DNA, 25 bp, Mus musculus
gggtcagtctgtagagcaccagttt

SEQ ID NO: 640013 - DNA, 25 bp, Mus musculus
gggtcagtctgttgagcaccagttt

SEQ ID NO: 640014 - DNA, 25 bp, Mus musculus
gggtcagtcttacagagtagcctct

SEQ ID NO: 640015 - DNA, 25 bp, Mus musculus
gggtcagtcttagagagtagcctct

SEQ ID NO: 640016 - DNA, 25 bp, Mus musculus
gggtcagtgctaaaatcttgaagaa

SEQ ID NO: 640017 - DNA, 25 bp, Mus musculus
gggtcagtgctataatcttgaagaa

SEQ ID NO: 640018 - DNA, 25 bp, Mus musculus
gggtcagtggccagaacaccaaggg

SEQ ID NO: 640019 - DNA, 25 bp, Mus musculus
gggtcagtggcctgaacaccaaggg

SEQ ID NO: 640020 - DNA, 25 bp, Mus musculus
gggtcagtgtaacctgcctggattt

SEQ ID NO: 640021 - DNA, 25 bp, Mus musculus
gggtcagtgtaagctgcctggattt

SEQ ID NO: 640022 - DNA, 25 bp, Mus musculus
gggtcagtgtgaccctaaattcaga

SEQ ID NO: 640023 - DNA, 25 bp, Mus musculus
gggtcagtgtgagcctaaattcaga

SEQ ID NO: 640024 - DNA, 25 bp, Mus musculus
gggtcagttacgaggaaatctattt

SEQ ID NO: 640025 - DNA, 25 bp, Mus musculus
gggtcagttacgtggaaatctattt

SEQ ID NO: 640026 - DNA, 25 bp, Mus musculus
gggtcagttcctagattaatgatct

SEQ ID NO: 640027 - DNA, 25 bp, Mus musculus
gggtcagttccttgattaatgatct

SEQ ID NO: 640028 - DNA, 25 bp, Mus musculus
gggtcagtttgtaaatctctctact

SEQ ID NO: 640029 - DNA, 25 bp, Mus musculus
gggtcagtttgttaatctctctact

SEQ ID NO: 640030 - DNA, 25 bp, Mus musculus
gggtcagttttcctgcatgcgctaa

SEQ ID NO: 640031 - DNA, 25 bp, Mus musculus
gggtcagttttcgtgcatgcgctaa

SEQ ID NO: 640032 - DNA, 25 bp, Mus musculus
gggtcataaatgatccttagttcct

SEQ ID NO: 640033 - DNA, 25 bp, Mus musculus
gggtcataaatgttccttagttcct

SEQ ID NO: 640034 - DNA, 25 bp, Mus musculus
gggtcataactacactttcacggtc

SEQ ID NO: 640035 - DNA, 25 bp, Mus musculus
gggtcataactagactttcacggtc

SEQ ID NO: 640036 - DNA, 25 bp, Mus musculus
gggtcataagctcggcagccttcat

SEQ ID NO: 640037 - DNA, 25 bp, Mus musculus
gggtcataagctgggcagccttcat

SEQ ID NO: 640038 - DNA, 25 bp, Mus musculus
gggtcatacccactggaaactcaag

SEQ ID NO: 640039 - DNA, 25 bp, Mus musculus
gggtcatacccagtggaaactcaag

SEQ ID NO: 640040 - DNA, 25 bp, Mus musculus
gggtcatactccactgagcttgttg

SEQ ID NO: 640041 - DNA, 25 bp, Mus musculus
gggtcatactcctctgagcttgttg

SEQ ID NO: 640042 - DNA, 25 bp, Mus musculus
gggtcatagacacatgcacttagca

SEQ ID NO: 640043 - DNA, 25 bp, Mus musculus
gggtcatagacagatgcacttagca

SEQ ID NO: 640044 - DNA, 25 bp, Mus musculus
gggtcatagaggatcttatcctttg

SEQ ID NO: 640045 - DNA, 25 bp, Mus musculus
gggtcatagaggttcttatcctttg

SEQ ID NO: 640046 - DNA, 25 bp, Mus musculus
gggtcataggaaacagtctattcat

SEQ ID NO: 640047 - DNA, 25 bp, Mus musculus
gggtcataggaaccattgccaccat

SEQ ID NO: 640048 - DNA, 25 bp, Mus musculus
gggtcataggaagcattgccaccat

SEQ ID NO: 640049 - DNA, 25 bp, Mus musculus
gggtcataggaatcagtctattcat

SEQ ID NO: 640050 - DNA, 25 bp, Mus musculus
gggtcataggctctttcccgagaag

SEQ ID NO: 640051 - DNA, 25 bp, Mus musculus
gggtcataggctgtttcccgagaag

SEQ ID NO: 640052 - DNA, 25 bp, Mus musculus
gggtcatataatcacacgagctgtt

SEQ ID NO: 640053 - DNA, 25 bp, Mus musculus
gggtcatataatgacacgagctgtt

SEQ ID NO: 640054 - DNA, 25 bp, Mus musculus
gggtcatataccatagcagccacaa

SEQ ID NO: 640055 - DNA, 25 bp, Mus musculus
gggtcatataccttagcagccacaa

SEQ ID NO: 640056 - DNA, 25 bp, Mus musculus
gggtcatatcctcaagacacctttt

SEQ ID NO: 640057 - DNA, 25 bp, Mus musculus
gggtcatatcctgaagacacctttt

SEQ ID NO: 640058 - DNA, 25 bp, Mus musculus
gggtcatatctgctgctttgtcaaa

SEQ ID NO: 640059 - DNA, 25 bp, Mus musculus
gggtcatatctggtgctttgtcaaa

SEQ ID NO: 640060 - DNA, 25 bp, Mus musculus
gggtcatatttcacgcgcaaagctt

SEQ ID NO: 640061 - DNA, 25 bp, Mus musculus
gggtcatatttctcgcgcaaagctt

SEQ ID NO: 640062 - DNA, 25 bp, Mus musculus
gggtcatcacaccaagtctgtctct

SEQ ID NO: 640063 - DNA, 25 bp, Mus musculus
gggtcatcacacgaagtctgtctct

SEQ ID NO: 640064 - DNA, 25 bp, Mus musculus
gggtcatcacatccatatggaaggc

SEQ ID NO: 640065 - DNA, 25 bp, Mus musculus
gggtcatcacatgcatatggaaggc

SEQ ID NO: 640066 - DNA, 25 bp, Mus musculus
gggtcatcagagcagcacacatcaa

SEQ ID NO: 640067 - DNA, 25 bp, Mus musculus
gggtcatcagaggagcacacatcaa

SEQ ID NO: 640068 - DNA, 25 bp, Mus musculus
gggtcatcaggtatcggtctcgttg

SEQ ID NO: 640069 - DNA, 25 bp, Mus musculus
gggtcatcaggtttcggtctcgttg

SEQ ID NO: 640070 - DNA, 25 bp, Mus musculus
gggtcatcatcccaagttagcccac

SEQ ID NO: 640071 - DNA, 25 bp, Mus musculus
gggtcatcatccgaagttagcccac

SEQ ID NO: 640072 - DNA, 25 bp, Mus musculus
gggtcatccagtattcctttggagc

SEQ ID NO: 640073 - DNA, 25 bp, Mus musculus
gggtcatccagttttcctttggagc

SEQ ID NO: 640074 - DNA, 25 bp, Mus musculus
gggtcatcccataaagaaagcctgt

SEQ ID NO: 640075 - DNA, 25 bp, Mus musculus
gggtcatcccatcggtggcacacca

SEQ ID NO: 640076 - DNA, 25 bp, Mus musculus
gggtcatcccatgggtggcacacca

SEQ ID NO: 640077 - DNA, 25 bp, Mus musculus
gggtcatcccattaagaaagcctgt

SEQ ID NO: 640078 - DNA, 25 bp, Mus musculus
gggtcatccccaagagccgtaagcg

SEQ ID NO: 640079 - DNA, 25 bp, Mus musculus
gggtcatccccatgagccgtaagcg

SEQ ID NO: 640080 - DNA, 25 bp, Mus musculus
gggtcatccctcagggccaatgcaa

SEQ ID NO: 640081 - DNA, 25 bp, Mus musculus
gggtcatccctctgggccaatgcaa

SEQ ID NO: 640082 - DNA, 25 bp, Mus musculus
gggtcatcctaaaagattcctggga

SEQ ID NO: 640083 - DNA, 25 bp, Mus musculus
gggtcatcctaatagattcctggga

SEQ ID NO: 640084 - DNA, 25 bp, Mus musculus
gggtcatccttaccatgagcaggtg

SEQ ID NO: 640085 - DNA, 25 bp, Mus musculus
gggtcatccttagcatgagcaggtg

SEQ ID NO: 640086 - DNA, 25 bp, Mus musculus
gggtcatcgtcgcaatccttcagac

SEQ ID NO: 640087 - DNA, 25 bp, Mus musculus
gggtcatcgtcggaatccttcagac

SEQ ID NO: 640088 - DNA, 25 bp, Mus musculus
gggtcatctataagctcatccaagc

SEQ ID NO: 640089 - DNA, 25 bp, Mus musculus
gggtcatctatatgctcatccaagc

SEQ ID NO: 640090 - DNA, 25 bp, Mus musculus
gggtcatctccaattgtcaggatac

SEQ ID NO: 640091 - DNA, 25 bp, Mus musculus
gggtcatctccatttgtcaggatac

SEQ ID NO: 640092 - DNA, 25 bp, Mus musculus
gggtcatctctaataactcaccatc

SEQ ID NO: 640093 - DNA, 25 bp, Mus musculus
gggtcatctctattaactcaccatc

SEQ ID NO: 640094 - DNA, 25 bp, Mus musculus
gggtcatctgcaatattgtgtttac

SEQ ID NO: 640095 - DNA, 25 bp, Mus musculus
gggtcatctgcattattgtgtttac

SEQ ID NO: 640096 - DNA, 25 bp, Mus musculus
gggtcatctggtctataagttcatt

SEQ ID NO: 640097 - DNA, 25 bp, Mus musculus
gggtcatctggtgtataagttcatt

SEQ ID NO: 640098 - DNA, 25 bp, Mus musculus
gggtcatctgtacgtacacagcagt

SEQ ID NO: 640099 - DNA, 25 bp, Mus musculus
gggtcatctgtaggtacacagcagt

SEQ ID NO: 640100 - DNA, 25 bp, Mus musculus
gggtcatcttctccatagtgagtct

SEQ ID NO: 640101 - DNA, 25 bp, Mus musculus
gggtcatcttctgcatagtgagtct

SEQ ID NO: 640102 - DNA, 25 bp, Mus musculus
gggtcatgacccagcaagtacatca

SEQ ID NO: 640103 - DNA, 25 bp, Mus musculus
gggtcatgaccctgcaagtacatca

SEQ ID NO: 640104 - DNA, 25 bp, Mus musculus
gggtcatgacctagccctccatagg

SEQ ID NO: 640105 - DNA, 25 bp, Mus musculus
gggtcatgaccttgccctccatagg

SEQ ID NO: 640106 - DNA, 25 bp, Mus musculus
gggtcatgataacacgaactatata

SEQ ID NO: 640107 - DNA, 25 bp, Mus musculus
gggtcatgataagacgaactatata

SEQ ID NO: 640108 - DNA, 25 bp, Mus musculus
gggtcatgatatactggaaaccaca

SEQ ID NO: 640109 - DNA, 25 bp, Mus musculus
gggtcatgatattctggaaaccaca

SEQ ID NO: 640110 - DNA, 25 bp, Mus musculus
gggtcatgattcaacagaagttaca

SEQ ID NO: 640111 - DNA, 25 bp, Mus musculus
gggtcatgattctacagaagttaca

SEQ ID NO: 640112 - DNA, 25 bp, Mus musculus
gggtcatgcactcatgactttgtat

SEQ ID NO: 640113 - DNA, 25 bp, Mus musculus
gggtcatgcactgatgactttgtat

SEQ ID NO: 640114 - DNA, 25 bp, Mus musculus
gggtcatgccaactcaggcctgtag

SEQ ID NO: 640115 - DNA, 25 bp, Mus musculus
gggtcatgccaagtcaggcctgtag

SEQ ID NO: 640116 - DNA, 25 bp, Mus musculus
gggtcatgccacactgatgttccgg

SEQ ID NO: 640117 - DNA, 25 bp, Mus musculus
gggtcatgccactctgatgttccgg

SEQ ID NO: 640118 - DNA, 25 bp, Mus musculus
gggtcatgcctgacgccatgagcat

SEQ ID NO: 640119 - DNA, 25 bp, Mus musculus
gggtcatgcctgtcgccatgagcat

SEQ ID NO: 640120 - DNA, 25 bp, Mus musculus
gggtcatgcgcacttactgtagtaa

SEQ ID NO: 640121 - DNA, 25 bp, Mus musculus
gggtcatgcgcagttactgtagtaa

SEQ ID NO: 640122 - DNA, 25 bp, Mus musculus
gggtcatgctccattgggatactag

SEQ ID NO: 640123 - DNA, 25 bp, Mus musculus
gggtcatgctcctttgggatactag

SEQ ID NO: 640124 - DNA, 25 bp, Mus musculus
gggtcatgctctagaagagaaactg

SEQ ID NO: 640125 - DNA, 25 bp, Mus musculus
gggtcatgctcttgaagagaaactg

SEQ ID NO: 640126 - DNA, 25 bp, Mus musculus
gggtcatgggctcaggtccttatcc

SEQ ID NO: 640127 - DNA, 25 bp, Mus musculus
gggtcatgggctgaggtccttatcc

SEQ ID NO: 640128 - DNA, 25 bp, Mus musculus
gggtcatgggttcttcctccatcat

SEQ ID NO: 640129 - DNA, 25 bp, Mus musculus
gggtcatgggttgttcctccatcat

SEQ ID NO: 640130 - DNA, 25 bp, Mus musculus
gggtcatggtaccattacctacaga

SEQ ID NO: 640131 - DNA, 25 bp, Mus musculus
gggtcatggtacgattacctacaga

SEQ ID NO: 640132 - DNA, 25 bp, Mus musculus
gggtcatgtaatacacagcccattg

SEQ ID NO: 640133 - DNA, 25 bp, Mus musculus
gggtcatgtaattcacagcccattg

SEQ ID NO: 640134 - DNA, 25 bp, Mus musculus
gggtcatgtgcaatcttttctaaga

SEQ ID NO: 640135 - DNA, 25 bp, Mus musculus
gggtcatgtgcattcttttctaaga

SEQ ID NO: 640136 - DNA, 25 bp, Mus musculus
gggtcatgttccagtgccagcaaac

SEQ ID NO: 640137 - DNA, 25 bp, Mus musculus
gggtcatgttcctgtgccagcaaac

SEQ ID NO: 640138 - DNA, 25 bp, Mus musculus
gggtcatgttttcagcctcatgtct

SEQ ID NO: 640139 - DNA, 25 bp, Mus musculus
gggtcatgttttgagcctcatgtct

SEQ ID NO: 640140 - DNA, 25 bp, Mus musculus
gggtcattaccgctctggagactca

SEQ ID NO: 640141 - DNA, 25 bp, Mus musculus
gggtcattaccggtctggagactca

SEQ ID NO: 640142 - DNA, 25 bp, Mus musculus
gggtcattactcagtgtactgcatg

SEQ ID NO: 640143 - DNA, 25 bp, Mus musculus
gggtcattactctgtgtactgcatg

SEQ ID NO: 640144 - DNA, 25 bp, Mus musculus
gggtcattagtcagtcaagctcctc

SEQ ID NO: 640145 - DNA, 25 bp, Mus musculus
gggtcattagtctgtcaagctcctc

SEQ ID NO: 640146 - DNA, 25 bp, Mus musculus
gggtcattcattcttattctcacta

SEQ ID NO: 640147 - DNA, 25 bp, Mus musculus
gggtcattcattgttattctcacta

SEQ ID NO: 640148 - DNA, 25 bp, Mus musculus
gggtcattccagactgatgtgcagc

SEQ ID NO: 640149 - DNA, 25 bp, Mus musculus
gggtcattccagtctgatgtgcagc

SEQ ID NO: 640150 - DNA, 25 bp, Mus musculus
gggtcattcctgcactgaaacaaat

SEQ ID NO: 640151 - DNA, 25 bp, Mus musculus
gggtcattcctggactgaaacaaat

SEQ ID NO: 640152 - DNA, 25 bp, Mus musculus
gggtcattcgaaacctgcaggaacg

SEQ ID NO: 640153 - DNA, 25 bp, Mus musculus
gggtcattcgaatcctgcaggaacg

SEQ ID NO: 640154 - DNA, 25 bp, Mus musculus
gggtcattctagacaacgatttctc

SEQ ID NO: 640155 - DNA, 25 bp, Mus musculus
gggtcattctagtcaacgatttctc

SEQ ID NO: 640156 - DNA, 25 bp, Mus musculus
gggtcattctctagaagtgttctta

SEQ ID NO: 640157 - DNA, 25 bp, Mus musculus
gggtcattctcttgaagtgttctta

SEQ ID NO: 640158 - DNA, 25 bp, Mus musculus
gggtcattctgtacgtgctgcaagt

SEQ ID NO: 640159 - DNA, 25 bp, Mus musculus
gggtcattctgttcgtgctgcaagt

SEQ ID NO: 640160 - DNA, 25 bp, Mus musculus
gggtcattgacacaggtttgcccaa

SEQ ID NO: 640161 - DNA, 25 bp, Mus musculus
gggtcattgacagaggtttgcccaa

SEQ ID NO: 640162 - DNA, 25 bp, Mus musculus
gggtcattgagtaactctcccatcc

SEQ ID NO: 640163 - DNA, 25 bp, Mus musculus
gggtcattgagttactctcccatcc

SEQ ID NO: 640164 - DNA, 25 bp, Mus musculus
gggtcattgctgcttattggttatt

SEQ ID NO: 640165 - DNA, 25 bp, Mus musculus
gggtcattgctggttattggttatt

SEQ ID NO: 640166 - DNA, 25 bp, Mus musculus
gggtcattgtctattcacgttggtc

SEQ ID NO: 640167 - DNA, 25 bp, Mus musculus
gggtcattgtcttttcacgttggtc

SEQ ID NO: 640168 - DNA, 25 bp, Mus musculus
gggtcatttctaacagccttcaatg

SEQ ID NO: 640169 - DNA, 25 bp, Mus musculus
gggtcatttctatcagccttcaatg

SEQ ID NO: 640170 - DNA, 25 bp, Mus musculus
gggtcatttgttccttggaggaaaa

SEQ ID NO: 640171 - DNA, 25 bp, Mus musculus
gggtcatttgttgcttggaggaaaa

SEQ ID NO: 640172 - DNA, 25 bp, Mus musculus
gggtcattttatcctgattacaatg

SEQ ID NO: 640173 - DNA, 25 bp, Mus musculus
gggtcattttatgctgattacaatg

SEQ ID NO: 640174 - DNA, 25 bp, Mus musculus
gggtcattttctaactcttatttgt

SEQ ID NO: 640175 - DNA, 25 bp, Mus musculus
gggtcattttcttactcttatttgt

SEQ ID NO: 640176 - DNA, 25 bp, Mus musculus
gggtcattttggcaattctatagca

SEQ ID NO: 640177 - DNA, 25 bp, Mus musculus
gggtcattttgggaattctatagca

SEQ ID NO: 640178 - DNA, 25 bp, Mus musculus
gggtcattttgtaatgcattgagtt

SEQ ID NO: 640179 - DNA, 25 bp, Mus musculus
gggtcattttgttatgcattgagtt

SEQ ID NO: 640180 - DNA, 25 bp, Mus musculus
gggtccaaaacaaatctgtgcagct

SEQ ID NO: 640181 - DNA, 25 bp, Mus musculus
gggtccaaaacatatctgtgcagct

SEQ ID NO: 640182 - DNA, 25 bp, Mus musculus
gggtccaaaagcatatactgaaact

SEQ ID NO: 640183 - DNA, 25 bp, Mus musculus
gggtccaaaagcttatactgaaact

SEQ ID NO: 640184 - DNA, 25 bp, Mus musculus
gggtccaaacccaagcaaactgatc

SEQ ID NO: 640185 - DNA, 25 bp, Mus musculus
gggtccaaaccctagcaaactgatc

SEQ ID NO: 640186 - DNA, 25 bp, Mus musculus
gggtccaaattcactcactacccta

SEQ ID NO: 640187 - DNA, 25 bp, Mus musculus
gggtccaaattctctcactacccta

SEQ ID NO: 640188 - DNA, 25 bp, Mus musculus
gggtccaacctaaagctttgtgtat

SEQ ID NO: 640189 - DNA, 25 bp, Mus musculus
gggtccaacctatagctttgtgtat

SEQ ID NO: 640190 - DNA, 25 bp, Mus musculus
gggtccaacttacatcgtcaggcta

SEQ ID NO: 640191 - DNA, 25 bp, Mus musculus
gggtccaacttagatcgtcaggcta

SEQ ID NO: 640192 - DNA, 25 bp, Mus musculus
gggtccaagaaaaaccagatcattt

SEQ ID NO: 640193 - DNA, 25 bp, Mus musculus
gggtccaagaaataccagatcattt

SEQ ID NO: 640194 - DNA, 25 bp, Mus musculus
gggtccaagaagagggtagccacca

SEQ ID NO: 640195 - DNA, 25 bp, Mus musculus
gggtccaagaagtgggtagccacca

SEQ ID NO: 640196 - DNA, 25 bp, Mus musculus
gggtccaagccacaactctaatgtt

SEQ ID NO: 640197 - DNA, 25 bp, Mus musculus
gggtccaagccagaactctaatgtt

SEQ ID NO: 640198 - DNA, 25 bp, Mus musculus
gggtccaaggaaagacagtacctcc

SEQ ID NO: 640199 - DNA, 25 bp, Mus musculus
gggtccaaggaatgacagtacctcc

SEQ ID NO: 640200 - DNA, 25 bp, Mus musculus
gggtccaagtgacatcagagcccct

SEQ ID NO: 640201 - DNA, 25 bp, Mus musculus
gggtccaagtgacctcaagaatctt

SEQ ID NO: 640202 - DNA, 25 bp, Mus musculus
gggtccaagtgagatcagagcccct

SEQ ID NO: 640203 - DNA, 25 bp, Mus musculus
gggtccaagtgagctcaagaatctt

SEQ ID NO: 640204 - DNA, 25 bp, Mus musculus
gggtccaataccactgattgtgcaa

SEQ ID NO: 640205 - DNA, 25 bp, Mus musculus
gggtccaatacctctgattgtgcaa

SEQ ID NO: 640206 - DNA, 25 bp, Mus musculus
gggtccacaacgcacgctaatgagg

SEQ ID NO: 640207 - DNA, 25 bp, Mus musculus
gggtccacaacggacgctaatgagg

SEQ ID NO: 640208 - DNA, 25 bp, Mus musculus
gggtccacactaaatagagacctta

SEQ ID NO: 640209 - DNA, 25 bp, Mus musculus
gggtccacactatatagagacctta

SEQ ID NO: 640210 - DNA, 25 bp, Mus musculus
gggtccacaggcatcccagcatggg

SEQ ID NO: 640211 - DNA, 25 bp, Mus musculus
gggtccacaggcttcccagcatggg

SEQ ID NO: 640212 - DNA, 25 bp, Mus musculus
gggtccacagtcacacatggtagtt

SEQ ID NO: 640213 - DNA, 25 bp, Mus musculus
gggtccacagtctcacatggtagtt

SEQ ID NO: 640214 - DNA, 25 bp, Mus musculus
gggtccacagtgcagcgaatctcta

SEQ ID NO: 640215 - DNA, 25 bp, Mus musculus
gggtccacagtggagcgaatctcta

SEQ ID NO: 640216 - DNA, 25 bp, Mus musculus
gggtccacataaaagcatgaagagt

SEQ ID NO: 640217 - DNA, 25 bp, Mus musculus
gggtccacataatagcatgaagagt

SEQ ID NO: 640218 - DNA, 25 bp, Mus musculus
gggtccaccaaaagcttcattacag

SEQ ID NO: 640219 - DNA, 25 bp, Mus musculus
gggtccaccaaatgcttcattacag

SEQ ID NO: 640220 - DNA, 25 bp, Mus musculus
gggtccaccaataacagaggcatac

SEQ ID NO: 640221 - DNA, 25 bp, Mus musculus
gggtccaccaattacagaggcatac

SEQ ID NO: 640222 - DNA, 25 bp, Mus musculus
gggtccaccacgcaaggaatcagat

SEQ ID NO: 640223 - DNA, 25 bp, Mus musculus
gggtccaccacggaaggaatcagat

SEQ ID NO: 640224 - DNA, 25 bp, Mus musculus
gggtccacccaaaggtgttcacgtt

SEQ ID NO: 640225 - DNA, 25 bp, Mus musculus
gggtccacccaatggtgttcacgtt

SEQ ID NO: 640226 - DNA, 25 bp, Mus musculus
gggtccacctacaattccaggcagg

SEQ ID NO: 640227 - DNA, 25 bp, Mus musculus
gggtccacctactattccaggcagg

SEQ ID NO: 640228 - DNA, 25 bp, Mus musculus
gggtccactgtccaggtacctggtt

SEQ ID NO: 640229 - DNA, 25 bp, Mus musculus
gggtccactgtcgaggtacctggtt

SEQ ID NO: 640230 - DNA, 25 bp, Mus musculus
gggtccacttttcccaaggctagtt

SEQ ID NO: 640231 - DNA, 25 bp, Mus musculus
gggtccacttttgccaaggctagtt

SEQ ID NO: 640232 - DNA, 25 bp, Mus musculus
gggtccagaataattcatgttgatt

SEQ ID NO: 640233 - DNA, 25 bp, Mus musculus
gggtccagaatatttcatgttgatt

SEQ ID NO: 640234 - DNA, 25 bp, Mus musculus
gggtccagacagcagcaacacagac

SEQ ID NO: 640235 - DNA, 25 bp, Mus musculus
gggtccagacaggagcaacacagac

SEQ ID NO: 640236 - DNA, 25 bp, Mus musculus
gggtccagactgagaatcctgtgct

SEQ ID NO: 640237 - DNA, 25 bp, Mus musculus
gggtccagactgtgaatcctgtgct

SEQ ID NO: 640238 - DNA, 25 bp, Mus musculus
gggtccagagaacatcttcttagta

SEQ ID NO: 640239 - DNA, 25 bp, Mus musculus
gggtccagagaagatcttcttagta

SEQ ID NO: 640240 - DNA, 25 bp, Mus musculus
gggtccagagagatatacttttatc

SEQ ID NO: 640241 - DNA, 25 bp, Mus musculus
gggtccagagagttatacttttatc

SEQ ID NO: 640242 - DNA, 25 bp, Mus musculus
gggtccagatacaacctgagtcttg

SEQ ID NO: 640243 - DNA, 25 bp, Mus musculus
gggtccagatactacctgagtcttg

SEQ ID NO: 640244 - DNA, 25 bp, Mus musculus
gggtccagcctaacttgaacgagca

SEQ ID NO: 640245 - DNA, 25 bp, Mus musculus
gggtccagcctatcttgaacgagca

SEQ ID NO: 640246 - DNA, 25 bp, Mus musculus
gggtccagcgagacaggaagcccca

SEQ ID NO: 640247 - DNA, 25 bp, Mus musculus
gggtccagcgagtcaggaagcccca

SEQ ID NO: 640248 - DNA, 25 bp, Mus musculus
gggtccagcgtaatgctcacatgtt

SEQ ID NO: 640249 - DNA, 25 bp, Mus musculus
gggtccagcgtattgctcacatgtt

SEQ ID NO: 640250 - DNA, 25 bp, Mus musculus
gggtccagctcaaatccattactta

SEQ ID NO: 640251 - DNA, 25 bp, Mus musculus
gggtccagctcatatccattactta

SEQ ID NO: 640252 - DNA, 25 bp, Mus musculus
gggtccaggctcacaatgttccaaa

SEQ ID NO: 640253 - DNA, 25 bp, Mus musculus
gggtccaggctctcaatgttccaaa

SEQ ID NO: 640254 - DNA, 25 bp, Mus musculus
gggtccaggtatcacccactacaga

SEQ ID NO: 640255 - DNA, 25 bp, Mus musculus
gggtccaggtatgacccactacaga

SEQ ID NO: 640256 - DNA, 25 bp, Mus musculus
gggtccagtccaattgattggttgt

SEQ ID NO: 640257 - DNA, 25 bp, Mus musculus
gggtccagtccatttgattggttgt

SEQ ID NO: 640258 - DNA, 25 bp, Mus musculus
gggtccagtggaacagcgaacattt

SEQ ID NO: 640259 - DNA, 25 bp, Mus musculus
gggtccagtggatcagcgaacattt

SEQ ID NO: 640260 - DNA, 25 bp, Mus musculus
gggtccagtgggaattccttacctg

SEQ ID NO: 640261 - DNA, 25 bp, Mus musculus
gggtccagtgggtattccttacctg

SEQ ID NO: 640262 - DNA, 25 bp, Mus musculus
gggtccagtgttacttggcaggtca

SEQ ID NO: 640263 - DNA, 25 bp, Mus musculus
gggtccagtgtttcttggcaggtca

SEQ ID NO: 640264 - DNA, 25 bp, Mus musculus
gggtccagtttaacactatgctaac

SEQ ID NO: 640265 - DNA, 25 bp, Mus musculus
gggtccagtttatcactatgctaac

SEQ ID NO: 640266 - DNA, 25 bp, Mus musculus
gggtccatacagctaagtctttgca

SEQ ID NO: 640267 - DNA, 25 bp, Mus musculus
gggtccatacaggtaagtctttgca

SEQ ID NO: 640268 - DNA, 25 bp, Mus musculus
gggtccatacttcctatacttgaac

SEQ ID NO: 640269 - DNA, 25 bp, Mus musculus
gggtccatacttgctatacttgaac

SEQ ID NO: 640270 - DNA, 25 bp, Mus musculus
gggtccatagttagactccagtggg

SEQ ID NO: 640271 - DNA, 25 bp, Mus musculus
gggtccatagtttgactccagtggg

SEQ ID NO: 640272 - DNA, 25 bp, Mus musculus
gggtccatccaaccgtgagaactgt

SEQ ID NO: 640273 - DNA, 25 bp, Mus musculus
gggtccatccaagcgtgagaactgt

SEQ ID NO: 640274 - DNA, 25 bp, Mus musculus
gggtccatgaacatgctcaacctca

SEQ ID NO: 640275 - DNA, 25 bp, Mus musculus
gggtccatgaacttgctcaacctca

SEQ ID NO: 640276 - DNA, 25 bp, Mus musculus
gggtccatggacacactgatgcccc

SEQ ID NO: 640277 - DNA, 25 bp, Mus musculus
gggtccatggactcactgatgcccc

SEQ ID NO: 640278 - DNA, 25 bp, Mus musculus
gggtccatggtaatctctagtccaa

SEQ ID NO: 640279 - DNA, 25 bp, Mus musculus
gggtccatggtattctctagtccaa

SEQ ID NO: 640280 - DNA, 25 bp, Mus musculus
gggtccatggtgatttctgcagaga

SEQ ID NO: 640281 - DNA, 25 bp, Mus musculus
gggtccatggtgttttctgcagaga

SEQ ID NO: 640282 - DNA, 25 bp, Mus musculus
gggtccatgtcaactttgaccaggt

SEQ ID NO: 640283 - DNA, 25 bp, Mus musculus
gggtccatgtcaccgacacctatgt

SEQ ID NO: 640284 - DNA, 25 bp, Mus musculus
gggtccatgtcagcgacacctatgt

SEQ ID NO: 640285 - DNA, 25 bp, Mus musculus
gggtccatgtcatctttgaccaggt

SEQ ID NO: 640286 - DNA, 25 bp, Mus musculus
gggtccatgtgcagacagactcaca

SEQ ID NO: 640287 - DNA, 25 bp, Mus musculus
gggtccatgtgctgacagactcaca

SEQ ID NO: 640288 - DNA, 25 bp, Mus musculus
gggtccattagaaagtaattcattc

SEQ ID NO: 640289 - DNA, 25 bp, Mus musculus
gggtccattagatagtaattcattc

SEQ ID NO: 640290 - DNA, 25 bp, Mus musculus
gggtccattggcactgtcggtgata

SEQ ID NO: 640291 - DNA, 25 bp, Mus musculus
gggtccattggctctgtcggtgata

SEQ ID NO: 640292 - DNA, 25 bp, Mus musculus
gggtccatttctaacttggtcggag

SEQ ID NO: 640293 - DNA, 25 bp, Mus musculus
gggtccatttcttacttggtcggag

SEQ ID NO: 640294 - DNA, 25 bp, Mus musculus
gggtccatttgaaccttcacaattg

SEQ ID NO: 640295 - DNA, 25 bp, Mus musculus
gggtccatttgatccttcacaattg

SEQ ID NO: 640296 - DNA, 25 bp, Mus musculus
gggtccattttaatgcaggccaggc

SEQ ID NO: 640297 - DNA, 25 bp, Mus musculus
gggtccattttattgcaggccaggc

SEQ ID NO: 640298 - DNA, 25 bp, Mus musculus
gggtcccaaacaagagagcgtctat

SEQ ID NO: 640299 - DNA, 25 bp, Mus musculus
gggtcccaaacatgagagcgtctat

SEQ ID NO: 640300 - DNA, 25 bp, Mus musculus
gggtcccaagccaagaaacctcagt

SEQ ID NO: 640301 - DNA, 25 bp, Mus musculus
gggtcccaagccagagtgagagtca

SEQ ID NO: 640302 - DNA, 25 bp, Mus musculus
gggtcccaagcctagaaacctcagt

SEQ ID NO: 640303 - DNA, 25 bp, Mus musculus
gggtcccaagcctgagtgagagtca

SEQ ID NO: 640304 - DNA, 25 bp, Mus musculus
gggtcccaagctccaagcatagaat

SEQ ID NO: 640305 - DNA, 25 bp, Mus musculus
gggtcccaagctgcaagcatagaat

SEQ ID NO: 640306 - DNA, 25 bp, Mus musculus
gggtcccaaggactaagagcacttt

SEQ ID NO: 640307 - DNA, 25 bp, Mus musculus
gggtcccaaggagtaagagcacttt

SEQ ID NO: 640308 - DNA, 25 bp, Mus musculus
gggtcccaagtaaacatctacattg

SEQ ID NO: 640309 - DNA, 25 bp, Mus musculus
gggtcccaagtatacatctacattg

SEQ ID NO: 640310 - DNA, 25 bp, Mus musculus
gggtcccaatcaagtgctggcagca

SEQ ID NO: 640311 - DNA, 25 bp, Mus musculus
gggtcccaatcatgtgctggcagca

SEQ ID NO: 640312 - DNA, 25 bp, Mus musculus
gggtcccacagccagtaacacggaa

SEQ ID NO: 640313 - DNA, 25 bp, Mus musculus
gggtcccacagcgagtaacacggaa

SEQ ID NO: 640314 - DNA, 25 bp, Mus musculus
gggtcccacatgatgttgccggctt

SEQ ID NO: 640315 - DNA, 25 bp, Mus musculus
gggtcccacatgttgttgccggctt

SEQ ID NO: 640316 - DNA, 25 bp, Mus musculus
gggtcccacattcttgtgtagtttg

SEQ ID NO: 640317 - DNA, 25 bp, Mus musculus
gggtcccacattgttgtgtagtttg

SEQ ID NO: 640318 - DNA, 25 bp, Mus musculus
gggtcccactacaggcaggggcgtg

SEQ ID NO: 640319 - DNA, 25 bp, Mus musculus
gggtcccactactggcaggggcgtg

SEQ ID NO: 640320 - DNA, 25 bp, Mus musculus
gggtcccactatataatcctaactg

SEQ ID NO: 640321 - DNA, 25 bp, Mus musculus
gggtcccactatttaatcctaactg

SEQ ID NO: 640322 - DNA, 25 bp, Mus musculus
gggtcccacttgctcctttatgaca

SEQ ID NO: 640323 - DNA, 25 bp, Mus musculus
gggtcccacttggtcctttatgaca

SEQ ID NO: 640324 - DNA, 25 bp, Mus musculus
gggtcccagaagatcccagtgtcta

SEQ ID NO: 640325 - DNA, 25 bp, Mus musculus
gggtcccagaagttcccagtgtcta

SEQ ID NO: 640326 - DNA, 25 bp, Mus musculus
gggtcccagacaaggatccccagtc

SEQ ID NO: 640327 - DNA, 25 bp, Mus musculus
gggtcccagacatggatccccagtc

SEQ ID NO: 640328 - DNA, 25 bp, Mus musculus
gggtcccagcatcagttcggctact

SEQ ID NO: 640329 - DNA, 25 bp, Mus musculus
gggtcccagcatgagttcggctact

SEQ ID NO: 640330 - DNA, 25 bp, Mus musculus
gggtcccagtctatagtgctatcta

SEQ ID NO: 640331 - DNA, 25 bp, Mus musculus
gggtcccagtctttagtgctatcta

SEQ ID NO: 640332 - DNA, 25 bp, Mus musculus
gggtcccagttgatgcagtcacggc

SEQ ID NO: 640333 - DNA, 25 bp, Mus musculus
gggtcccagttgttgcagtcacggc

SEQ ID NO: 640334 - DNA, 25 bp, Mus musculus
gggtcccataaacgtcgctttgtga

SEQ ID NO: 640335 - DNA, 25 bp, Mus musculus
gggtcccataaaggtcgctttgtga

SEQ ID NO: 640336 - DNA, 25 bp, Mus musculus
gggtcccatggacaaggttccagtc

SEQ ID NO: 640337 - DNA, 25 bp, Mus musculus
gggtcccatggagaaggttccagtc

SEQ ID NO: 640338 - DNA, 25 bp, Mus musculus
gggtcccatggcatcaccagggcta

SEQ ID NO: 640339 - DNA, 25 bp, Mus musculus
gggtcccatggcttcaccagggcta

SEQ ID NO: 640340 - DNA, 25 bp, Mus musculus
gggtcccatgtaagagcaacacagt

SEQ ID NO: 640341 - DNA, 25 bp, Mus musculus
gggtcccatgtatgagcaacacagt

SEQ ID NO: 640342 - DNA, 25 bp, Mus musculus
gggtcccatttaattctgagtgaga

SEQ ID NO: 640343 - DNA, 25 bp, Mus musculus
gggtcccatttatttctgagtgaga

SEQ ID NO: 640344 - DNA, 25 bp, Mus musculus
gggtccccaaaaccaaccgcatcat

SEQ ID NO: 640345 - DNA, 25 bp, Mus musculus
gggtccccaaaagcaaccgcatcat

SEQ ID NO: 640346 - DNA, 25 bp, Mus musculus
gggtccccaaagctgttacgcccat

SEQ ID NO: 640347 - DNA, 25 bp, Mus musculus
gggtccccaaaggtgttacgcccat

SEQ ID NO: 640348 - DNA, 25 bp, Mus musculus
gggtccccaactaacacagaagcta

SEQ ID NO: 640349 - DNA, 25 bp, Mus musculus
gggtccccaacttacacagaagcta

SEQ ID NO: 640350 - DNA, 25 bp, Mus musculus
gggtccccaagtaaattcatctact

SEQ ID NO: 640351 - DNA, 25 bp, Mus musculus
gggtccccaagttaattcatctact

SEQ ID NO: 640352 - DNA, 25 bp, Mus musculus
gggtccccacaaacagtagcgtaat

SEQ ID NO: 640353 - DNA, 25 bp, Mus musculus
gggtccccacaatcagtagcgtaat

SEQ ID NO: 640354 - DNA, 25 bp, Mus musculus
gggtccccacatctgtgtaaataga

SEQ ID NO: 640355 - DNA, 25 bp, Mus musculus
gggtccccacatgtgtgtaaataga

SEQ ID NO: 640356 - DNA, 25 bp, Mus musculus
gggtccccagagaagccagaggact

SEQ ID NO: 640357 - DNA, 25 bp, Mus musculus
gggtccccagagtagccagaggact

SEQ ID NO: 640358 - DNA, 25 bp, Mus musculus
gggtccccaggcatagtctctggaa

SEQ ID NO: 640359 - DNA, 25 bp, Mus musculus
gggtccccaggcttagtctctggaa

SEQ ID NO: 640360 - DNA, 25 bp, Mus musculus
gggtccccagggaatttctgtgcag

SEQ ID NO: 640361 - DNA, 25 bp, Mus musculus
gggtccccagggtatttctgtgcag

SEQ ID NO: 640362 - DNA, 25 bp, Mus musculus
gggtccccagtaagatccagctgat

SEQ ID NO: 640363 - DNA, 25 bp, Mus musculus
gggtccccagtatgatccagctgat

SEQ ID NO: 640364 - DNA, 25 bp, Mus musculus
gggtccccagtgacatccacggaga

SEQ ID NO: 640365 - DNA, 25 bp, Mus musculus
gggtccccagtgtcatccacggaga

SEQ ID NO: 640366 - DNA, 25 bp, Mus musculus
gggtccccataacagctatgcaaat

SEQ ID NO: 640367 - DNA, 25 bp, Mus musculus
gggtccccataagagctatgcaaat

SEQ ID NO: 640368 - DNA, 25 bp, Mus musculus
gggtccccgagaactcaggaatttt

SEQ ID NO: 640369 - DNA, 25 bp, Mus musculus
gggtccccgagatctcaggaatttt

SEQ ID NO: 640370 - DNA, 25 bp, Mus musculus
gggtcccctgcacctctgagtagca

SEQ ID NO: 640371 - DNA, 25 bp, Mus musculus
gggtcccctgcagctctgagtagca

SEQ ID NO: 640372 - DNA, 25 bp, Mus musculus
gggtcccctttgagaaatatcaatg

SEQ ID NO: 640373 - DNA, 25 bp, Mus musculus
gggtcccctttgtgaaatatcaatg

SEQ ID NO: 640374 - DNA, 25 bp, Mus musculus
gggtcccgagtgagccatacatagt

SEQ ID NO: 640375 - DNA, 25 bp, Mus musculus
gggtcccgagtgtgccatacatagt

SEQ ID NO: 640376 - DNA, 25 bp, Mus musculus
gggtcccgcggaatgtacacgtcgc

SEQ ID NO: 640377 - DNA, 25 bp, Mus musculus
gggtcccgcggattgtacacgtcgc

SEQ ID NO: 640378 - DNA, 25 bp, Mus musculus
gggtcccggtgacaaactatgaaga

SEQ ID NO: 640379 - DNA, 25 bp, Mus musculus
gggtcccggtgagaaactatgaaga

SEQ ID NO: 640380 - DNA, 25 bp, Mus musculus
gggtccctaatcactatccagagtt

SEQ ID NO: 640381 - DNA, 25 bp, Mus musculus
gggtccctaatctctatccagagtt

SEQ ID NO: 640382 - DNA, 25 bp, Mus musculus
gggtccctagagctacagttccgac

SEQ ID NO: 640383 - DNA, 25 bp, Mus musculus
gggtccctagagctatttccataga

SEQ ID NO: 640384 - DNA, 25 bp, Mus musculus
gggtccctagaggtacagttccgac

SEQ ID NO: 640385 - DNA, 25 bp, Mus musculus
gggtccctagaggtatttccataga

SEQ ID NO: 640386 - DNA, 25 bp, Mus musculus
gggtccctagggacatagctgtctg

SEQ ID NO: 640387 - DNA, 25 bp, Mus musculus
gggtccctagggtcatagctgtctg

SEQ ID NO: 640388 - DNA, 25 bp, Mus musculus
gggtccctagtactagtgtggccta

SEQ ID NO: 640389 - DNA, 25 bp, Mus musculus
gggtccctagtagtagtgtggccta

SEQ ID NO: 640390 - DNA, 25 bp, Mus musculus
gggtccctagttagagaggtcagca

SEQ ID NO: 640391 - DNA, 25 bp, Mus musculus
gggtccctagtttgagaggtcagca

SEQ ID NO: 640392 - DNA, 25 bp, Mus musculus
gggtccctatttagtaatgtcactt

SEQ ID NO: 640393 - DNA, 25 bp, Mus musculus
gggtccctattttgtaatgtcactt

SEQ ID NO: 640394 - DNA, 25 bp, Mus musculus
gggtccctcagcaagtgcctaaaga

SEQ ID NO: 640395 - DNA, 25 bp, Mus musculus
gggtccctcagctagtgcctaaaga

SEQ ID NO: 640396 - DNA, 25 bp, Mus musculus
gggtccctctagactctgatctatg

SEQ ID NO: 640397 - DNA, 25 bp, Mus musculus
gggtccctctagtctctgatctatg

SEQ ID NO: 640398 - DNA, 25 bp, Mus musculus
gggtccctctgaagtttaattctga

SEQ ID NO: 640399 - DNA, 25 bp, Mus musculus
gggtccctctgatgtttaattctga

SEQ ID NO: 640400 - DNA, 25 bp, Mus musculus
gggtccctgatacccgatgaagagt

SEQ ID NO: 640401 - DNA, 25 bp, Mus musculus
gggtccctgatagccgatgaagagt

SEQ ID NO: 640402 - DNA, 25 bp, Mus musculus
gggtccctgattacagacttttgaa

SEQ ID NO: 640403 - DNA, 25 bp, Mus musculus
gggtccctgatttcagacttttgaa

SEQ ID NO: 640404 - DNA, 25 bp, Mus musculus
gggtccctgcacagctagtgatgga

SEQ ID NO: 640405 - DNA, 25 bp, Mus musculus
gggtccctgcactgctagtgatgga

SEQ ID NO: 640406 - DNA, 25 bp, Mus musculus
gggtccctgggcaggcagctccccc

SEQ ID NO: 640407 - DNA, 25 bp, Mus musculus
gggtccctgggctggcagctccccc

SEQ ID NO: 640408 - DNA, 25 bp, Mus musculus
gggtccctgggtcaaacagcactat

SEQ ID NO: 640409 - DNA, 25 bp, Mus musculus
gggtccctgggtgaaacagcactat

SEQ ID NO: 640410 - DNA, 25 bp, Mus musculus
gggtccctgtttaacttatgcacta

SEQ ID NO: 640411 - DNA, 25 bp, Mus musculus
gggtccctgttttacttatgcacta

SEQ ID NO: 640412 - DNA, 25 bp, Mus musculus
gggtcccttcaaagggtctactgca

SEQ ID NO: 640413 - DNA, 25 bp, Mus musculus
gggtcccttcaatgggtctactgca

SEQ ID NO: 640414 - DNA, 25 bp, Mus musculus
gggtcccttggcacggtactgtctg

SEQ ID NO: 640415 - DNA, 25 bp, Mus musculus
gggtcccttggctcggtactgtctg

SEQ ID NO: 640416 - DNA, 25 bp, Mus musculus
gggtccctttcacaaccatttgaga

SEQ ID NO: 640417 - DNA, 25 bp, Mus musculus
gggtccctttcagaaccatttgaga

SEQ ID NO: 640418 - DNA, 25 bp, Mus musculus
gggtccgaagccaggtcatagccca

SEQ ID NO: 640419 - DNA, 25 bp, Mus musculus
gggtccgaagcctggtcatagccca

SEQ ID NO: 640420 - DNA, 25 bp, Mus musculus
gggtccgagataacaacgaggcttt

SEQ ID NO: 640421 - DNA, 25 bp, Mus musculus
gggtccgagatatcaacgaggcttt

SEQ ID NO: 640422 - DNA, 25 bp, Mus musculus
gggtccgaggatcaagcctcatctg

SEQ ID NO: 640423 - DNA, 25 bp, Mus musculus
gggtccgaggatgaagcctcatctg

SEQ ID NO: 640424 - DNA, 25 bp, Mus musculus
gggtccgataatatctcaggcagaa

SEQ ID NO: 640425 - DNA, 25 bp, Mus musculus
gggtccgataatttctcaggcagaa

SEQ ID NO: 640426 - DNA, 25 bp, Mus musculus
gggtccgattcaccagctgcaagag

SEQ ID NO: 640427 - DNA, 25 bp, Mus musculus
gggtccgattcagcagctgcaagag

SEQ ID NO: 640428 - DNA, 25 bp, Mus musculus
gggtccgcccagaagagctctgtgt

SEQ ID NO: 640429 - DNA, 25 bp, Mus musculus
gggtccgcccagtagagctctgtgt

SEQ ID NO: 640430 - DNA, 25 bp, Mus musculus
gggtccgcttcactccagtgtaact

SEQ ID NO: 640431 - DNA, 25 bp, Mus musculus
gggtccgcttcagtccagtgtaact

SEQ ID NO: 640432 - DNA, 25 bp, Mus musculus
gggtccgggagcctacactgttgcc

SEQ ID NO: 640433 - DNA, 25 bp, Mus musculus
gggtccgggagcgtacactgttgcc

SEQ ID NO: 640434 - DNA, 25 bp, Mus musculus
gggtccggtgtcactgtttacatga

SEQ ID NO: 640435 - DNA, 25 bp, Mus musculus
gggtccggtgtctctgtttacatga

SEQ ID NO: 640436 - DNA, 25 bp, Mus musculus
gggtccgtggtcatccatgaactga

SEQ ID NO: 640437 - DNA, 25 bp, Mus musculus
gggtccgtggtcttccatgaactga

SEQ ID NO: 640438 - DNA, 25 bp, Mus musculus
gggtccgttacaacacgcagagtgg

SEQ ID NO: 640439 - DNA, 25 bp, Mus musculus
gggtccgttacatcacgcagagtgg

SEQ ID NO: 640440 - DNA, 25 bp, Mus musculus
gggtccgttgagatccaacaaaact

SEQ ID NO: 640441 - DNA, 25 bp, Mus musculus
gggtccgttgagttccaacaaaact

SEQ ID NO: 640442 - DNA, 25 bp, Mus musculus
gggtcctaaattcaattcctcttgg

SEQ ID NO: 640443 - DNA, 25 bp, Mus musculus
gggtcctaaattgaattcctcttgg

SEQ ID NO: 640444 - DNA, 25 bp, Mus musculus
gggtcctaactcaacattgtgataa

SEQ ID NO: 640445 - DNA, 25 bp, Mus musculus
gggtcctaactctacattgtgataa

SEQ ID NO: 640446 - DNA, 25 bp, Mus musculus
gggtcctaagtcacttccataatgt

SEQ ID NO: 640447 - DNA, 25 bp, Mus musculus
gggtcctaagtctcttccataatgt

SEQ ID NO: 640448 - DNA, 25 bp, Mus musculus
gggtcctaatggctgctaactttgc

SEQ ID NO: 640449 - DNA, 25 bp, Mus musculus
gggtcctaatgggtgctaactttgc

SEQ ID NO: 640450 - DNA, 25 bp, Mus musculus
gggtcctacagcaagcccggtttgt

SEQ ID NO: 640451 - DNA, 25 bp, Mus musculus
gggtcctacagcaggtatctgcgag

SEQ ID NO: 640452 - DNA, 25 bp, Mus musculus
gggtcctacagctagcccggtttgt

SEQ ID NO: 640453 - DNA, 25 bp, Mus musculus
gggtcctacagctggtatctgcgag

SEQ ID NO: 640454 - DNA, 25 bp, Mus musculus
gggtcctaccatatgtgaaagcact

SEQ ID NO: 640455 - DNA, 25 bp, Mus musculus
gggtcctaccatccctgaagcgtga

SEQ ID NO: 640456 - DNA, 25 bp, Mus musculus
gggtcctaccatgcctgaagcgtga

SEQ ID NO: 640457 - DNA, 25 bp, Mus musculus
gggtcctaccatttgtgaaagcact

SEQ ID NO: 640458 - DNA, 25 bp, Mus musculus
gggtcctactgcaggatgaagccac

SEQ ID NO: 640459 - DNA, 25 bp, Mus musculus
gggtcctactgctggatgaagccac

SEQ ID NO: 640460 - DNA, 25 bp, Mus musculus
gggtcctagagaacaaattcagctt

SEQ ID NO: 640461 - DNA, 25 bp, Mus musculus
gggtcctagagatcaaattcagctt

SEQ ID NO: 640462 - DNA, 25 bp, Mus musculus
gggtcctagattcagtccattgttg

SEQ ID NO: 640463 - DNA, 25 bp, Mus musculus
gggtcctagattgagtccattgttg

SEQ ID NO: 640464 - DNA, 25 bp, Mus musculus
gggtcctagcacacatgtctggtgg

SEQ ID NO: 640465 - DNA, 25 bp, Mus musculus
gggtcctagcactcatgtctggtgg

SEQ ID NO: 640466 - DNA, 25 bp, Mus musculus
gggtcctaggccagtacctcagaga

SEQ ID NO: 640467 - DNA, 25 bp, Mus musculus
gggtcctaggcctgtacctcagaga

SEQ ID NO: 640468 - DNA, 25 bp, Mus musculus
gggtcctaggtactccatctggagt

SEQ ID NO: 640469 - DNA, 25 bp, Mus musculus
gggtcctaggtagtccatctggagt

SEQ ID NO: 640470 - DNA, 25 bp, Mus musculus
gggtcctatgaaaccgctacttagt

SEQ ID NO: 640471 - DNA, 25 bp, Mus musculus
gggtcctatgaatccgctacttagt

SEQ ID NO: 640472 - DNA, 25 bp, Mus musculus
gggtcctatggtactaattgttgaa

SEQ ID NO: 640473 - DNA, 25 bp, Mus musculus
gggtcctatggttctaattgttgaa

SEQ ID NO: 640474 - DNA, 25 bp, Mus musculus
gggtcctattttaccctgaagcaca

SEQ ID NO: 640475 - DNA, 25 bp, Mus musculus
gggtcctatttttccctgaagcaca

SEQ ID NO: 640476 - DNA, 25 bp, Mus musculus
gggtcctcaacaaaatcctgaaagg

SEQ ID NO: 640477 - DNA, 25 bp, Mus musculus
gggtcctcaacataatcctgaaagg

SEQ ID NO: 640478 - DNA, 25 bp, Mus musculus
gggtcctcacacattcacaactaag

SEQ ID NO: 640479 - DNA, 25 bp, Mus musculus
gggtcctcacactttcacaactaag

SEQ ID NO: 640480 - DNA, 25 bp, Mus musculus
gggtcctcacatagatgacacaatg

SEQ ID NO: 640481 - DNA, 25 bp, Mus musculus
gggtcctcacattgatgacacaatg

SEQ ID NO: 640482 - DNA, 25 bp, Mus musculus
gggtcctcacgaagcaagcagactg

SEQ ID NO: 640483 - DNA, 25 bp, Mus musculus
gggtcctcacgatgcaagcagactg

SEQ ID NO: 640484 - DNA, 25 bp, Mus musculus
gggtcctcagacacagttttcaact

SEQ ID NO: 640485 - DNA, 25 bp, Mus musculus
gggtcctcagactcagttttcaact

SEQ ID NO: 640486 - DNA, 25 bp, Mus musculus
gggtcctcagagatccaatacgtat

SEQ ID NO: 640487 - DNA, 25 bp, Mus musculus
gggtcctcagagatcgatctgttta

SEQ ID NO: 640488 - DNA, 25 bp, Mus musculus
gggtcctcagagttccaatacgtat

SEQ ID NO: 640489 - DNA, 25 bp, Mus musculus
gggtcctcagagttcgatctgttta

SEQ ID NO: 640490 - DNA, 25 bp, Mus musculus
gggtcctcaggacactgatcggcac

SEQ ID NO: 640491 - DNA, 25 bp, Mus musculus
gggtcctcaggagactgatcggcac

SEQ ID NO: 640492 - DNA, 25 bp, Mus musculus
gggtcctcagttagatcaggcctct

SEQ ID NO: 640493 - DNA, 25 bp, Mus musculus
gggtcctcagtttgatcaggcctct

SEQ ID NO: 640494 - DNA, 25 bp, Mus musculus
gggtcctcatctctgcacattgtga

SEQ ID NO: 640495 - DNA, 25 bp, Mus musculus
gggtcctcatctgtgcacattgtga

SEQ ID NO: 640496 - DNA, 25 bp, Mus musculus
gggtcctcatgtatgaagtccagcc

SEQ ID NO: 640497 - DNA, 25 bp, Mus musculus
gggtcctcatgtcttatctagtgat

SEQ ID NO: 640498 - DNA, 25 bp, Mus musculus
gggtcctcatgtgttatctagtgat

SEQ ID NO: 640499 - DNA, 25 bp, Mus musculus
gggtcctcatgtttgaagtccagcc

SEQ ID NO: 640500 - DNA, 25 bp, Mus musculus
gggtcctccagactggcagagctaa

SEQ ID NO: 640501 - DNA, 25 bp, Mus musculus
gggtcctccagagtggcagagctaa

SEQ ID NO: 640502 - DNA, 25 bp, Mus musculus
gggtcctccattcttgcttatgaat

SEQ ID NO: 640503 - DNA, 25 bp, Mus musculus
gggtcctccattgttgcttatgaat

SEQ ID NO: 640504 - DNA, 25 bp, Mus musculus
gggtcctcccaaaattgccaaactc

SEQ ID NO: 640505 - DNA, 25 bp, Mus musculus
gggtcctcccaatattgccaaactc

SEQ ID NO: 640506 - DNA, 25 bp, Mus musculus
gggtcctcgactctctaacagggag

SEQ ID NO: 640507 - DNA, 25 bp, Mus musculus
gggtcctcgactgtctaacagggag

SEQ ID NO: 640508 - DNA, 25 bp, Mus musculus
gggtcctcggagctcataaaacaag

SEQ ID NO: 640509 - DNA, 25 bp, Mus musculus
gggtcctcggaggtcataaaacaag

SEQ ID NO: 640510 - DNA, 25 bp, Mus musculus
gggtcctcgtgcacccacagtgtag

SEQ ID NO: 640511 - DNA, 25 bp, Mus musculus
gggtcctcgtgctcccacagtgtag

SEQ ID NO: 640512 - DNA, 25 bp, Mus musculus
gggtcctctaacagcatcttaatag

SEQ ID NO: 640513 - DNA, 25 bp, Mus musculus
gggtcctctaactgcatcttaatag

SEQ ID NO: 640514 - DNA, 25 bp, Mus musculus
gggtcctcttccaggatgacagatg

SEQ ID NO: 640515 - DNA, 25 bp, Mus musculus
gggtcctcttcctggatgacagatg

SEQ ID NO: 640516 - DNA, 25 bp, Mus musculus
gggtcctgaagtattgcttggtcat

SEQ ID NO: 640517 - DNA, 25 bp, Mus musculus
gggtcctgaagttttgcttggtcat

SEQ ID NO: 640518 - DNA, 25 bp, Mus musculus
gggtcctgagaacacacacagtcat

SEQ ID NO: 640519 - DNA, 25 bp, Mus musculus
gggtcctgagaagacacacagtcat

SEQ ID NO: 640520 - DNA, 25 bp, Mus musculus
gggtcctgagtgacttttcaccagt

SEQ ID NO: 640521 - DNA, 25 bp, Mus musculus
gggtcctgagtgtcttttcaccagt

SEQ ID NO: 640522 - DNA, 25 bp, Mus musculus
gggtcctgagttaacaccgtgttga

SEQ ID NO: 640523 - DNA, 25 bp, Mus musculus
gggtcctgagtttacaccgtgttga

SEQ ID NO: 640524 - DNA, 25 bp, Mus musculus
gggtcctgatgaaccccacgattta

SEQ ID NO: 640525 - DNA, 25 bp, Mus musculus
gggtcctgatgatccccacgattta

SEQ ID NO: 640526 - DNA, 25 bp, Mus musculus
gggtcctgatggacatccggtgcca

SEQ ID NO: 640527 - DNA, 25 bp, Mus musculus
gggtcctgatggtcatccggtgcca

SEQ ID NO: 640528 - DNA, 25 bp, Mus musculus
gggtcctgatgtatcttgcggcccc

SEQ ID NO: 640529 - DNA, 25 bp, Mus musculus
gggtcctgatgtttcttgcggcccc

SEQ ID NO: 640530 - DNA, 25 bp, Mus musculus
gggtcctgcaatcactctgtcctca

SEQ ID NO: 640531 - DNA, 25 bp, Mus musculus
gggtcctgcaatgactctgtcctca

SEQ ID NO: 640532 - DNA, 25 bp, Mus musculus
gggtcctgcaggatctttacagcta

SEQ ID NO: 640533 - DNA, 25 bp, Mus musculus
gggtcctgcaggttctttacagcta

SEQ ID NO: 640534 - DNA, 25 bp, Mus musculus
gggtcctgcccaagtggtgtaggaa

SEQ ID NO: 640535 - DNA, 25 bp, Mus musculus
gggtcctgcccatgtggtgtaggaa

SEQ ID NO: 640536 - DNA, 25 bp, Mus musculus
gggtcctgcctgaaaaacctgtgaa

SEQ ID NO: 640537 - DNA, 25 bp, Mus musculus
gggtcctgcctgtaaaacctgtgaa

SEQ ID NO: 640538 - DNA, 25 bp, Mus musculus
gggtcctgctccagaaggatgcaaa

SEQ ID NO: 640539 - DNA, 25 bp, Mus musculus
gggtcctgctcctgaaggatgcaaa

SEQ ID NO: 640540 - DNA, 25 bp, Mus musculus
gggtcctggaatcgcctgtcttttt

SEQ ID NO: 640541 - DNA, 25 bp, Mus musculus
gggtcctggaatggcctgtcttttt

SEQ ID NO: 640542 - DNA, 25 bp, Mus musculus
gggtcctggcagatgtaaattcgga

SEQ ID NO: 640543 - DNA, 25 bp, Mus musculus
gggtcctggcagttgtaaattcgga

SEQ ID NO: 640544 - DNA, 25 bp, Mus musculus
gggtcctggccaagctggctgaaaa

SEQ ID NO: 640545 - DNA, 25 bp, Mus musculus
gggtcctggccatgctggctgaaaa

SEQ ID NO: 640546 - DNA, 25 bp, Mus musculus
gggtcctgggaaattgctattacaa

SEQ ID NO: 640547 - DNA, 25 bp, Mus musculus
gggtcctgggaatttgctattacaa

SEQ ID NO: 640548 - DNA, 25 bp, Mus musculus
gggtcctgggacacaagcagtctgt

SEQ ID NO: 640549 - DNA, 25 bp, Mus musculus
gggtcctgggactcaagcagtctgt

SEQ ID NO: 640550 - DNA, 25 bp, Mus musculus
gggtcctgtgaaactgtgcatataa

SEQ ID NO: 640551 - DNA, 25 bp, Mus musculus
gggtcctgtgaatctgtgcatataa

SEQ ID NO: 640552 - DNA, 25 bp, Mus musculus
gggtcctgtgacaggagcctgcctc

SEQ ID NO: 640553 - DNA, 25 bp, Mus musculus
gggtcctgtgactggagcctgcctc

SEQ ID NO: 640554 - DNA, 25 bp, Mus musculus
gggtcctgtgagacccacaagacac

SEQ ID NO: 640555 - DNA, 25 bp, Mus musculus
gggtcctgtgagtcccacaagacac

SEQ ID NO: 640556 - DNA, 25 bp, Mus musculus
gggtcctgtggacttgtgccccaca

SEQ ID NO: 640557 - DNA, 25 bp, Mus musculus
gggtcctgtggagttgtgccccaca

SEQ ID NO: 640558 - DNA, 25 bp, Mus musculus
gggtcctgtttacatatccaattct

SEQ ID NO: 640559 - DNA, 25 bp, Mus musculus
gggtcctgtttagatatccaattct

SEQ ID NO: 640560 - DNA, 25 bp, Mus musculus
gggtcctgtttgatccagaaagaga

SEQ ID NO: 640561 - DNA, 25 bp, Mus musculus
gggtcctgtttgttccagaaagaga

SEQ ID NO: 640562 - DNA, 25 bp, Mus musculus
gggtcctgttttcttgagaaagcca

SEQ ID NO: 640563 - DNA, 25 bp, Mus musculus
gggtcctgttttgttgagaaagcca

SEQ ID NO: 640564 - DNA, 25 bp, Mus musculus
gggtccttaacaaccgaagagtttg

SEQ ID NO: 640565 - DNA, 25 bp, Mus musculus
gggtccttaacatccgaagagtttg

SEQ ID NO: 640566 - DNA, 25 bp, Mus musculus
gggtccttaagaattgctgctggta

SEQ ID NO: 640567 - DNA, 25 bp, Mus musculus
gggtccttaagatttgctgctggta

SEQ ID NO: 640568 - DNA, 25 bp, Mus musculus
gggtccttacacaacctgggtattg

SEQ ID NO: 640569 - DNA, 25 bp, Mus musculus
gggtccttacactacctgggtattg

SEQ ID NO: 640570 - DNA, 25 bp, Mus musculus
gggtccttacgcagagtgtcactct

SEQ ID NO: 640571 - DNA, 25 bp, Mus musculus
gggtccttacgctgagtgtcactct

SEQ ID NO: 640572 - DNA, 25 bp, Mus musculus
gggtccttatctcccgaagcgagag

SEQ ID NO: 640573 - DNA, 25 bp, Mus musculus
gggtccttatctgccgaagcgagag

SEQ ID NO: 640574 - DNA, 25 bp, Mus musculus
gggtccttcagactgtacgggtaca

SEQ ID NO: 640575 - DNA, 25 bp, Mus musculus
gggtccttcagagtgtacgggtaca

SEQ ID NO: 640576 - DNA, 25 bp, Mus musculus
gggtccttcaggcttcccacatgtg

SEQ ID NO: 640577 - DNA, 25 bp, Mus musculus
gggtccttcagggttcccacatgtg

SEQ ID NO: 640578 - DNA, 25 bp, Mus musculus
gggtccttcatgattgggccatatg

SEQ ID NO: 640579 - DNA, 25 bp, Mus musculus
gggtccttcatgtttgggccatatg

SEQ ID NO: 640580 - DNA, 25 bp, Mus musculus
gggtccttccacatatttgctatat

SEQ ID NO: 640581 - DNA, 25 bp, Mus musculus
gggtccttccacttatttgctatat

SEQ ID NO: 640582 - DNA, 25 bp, Mus musculus
gggtccttccatctctggtaagtaa

SEQ ID NO: 640583 - DNA, 25 bp, Mus musculus
gggtccttccatgtctggtaagtaa

SEQ ID NO: 640584 - DNA, 25 bp, Mus musculus
gggtccttccccattaatcattaag

SEQ ID NO: 640585 - DNA, 25 bp, Mus musculus
gggtccttcccctttaatcattaag

SEQ ID NO: 640586 - DNA, 25 bp, Mus musculus
gggtccttcctacgtaaaacatcag

SEQ ID NO: 640587 - DNA, 25 bp, Mus musculus
gggtccttcctaggtaaaacatcag

SEQ ID NO: 640588 - DNA, 25 bp, Mus musculus
gggtccttgagaagttgtctctcta

SEQ ID NO: 640589 - DNA, 25 bp, Mus musculus
gggtccttgagatgttgtctctcta

SEQ ID NO: 640590 - DNA, 25 bp, Mus musculus
gggtccttgatgcaatgtacagcta

SEQ ID NO: 640591 - DNA, 25 bp, Mus musculus
gggtccttgatggaatgtacagcta

SEQ ID NO: 640592 - DNA, 25 bp, Mus musculus
gggtccttgtctcgtcatagatacc

SEQ ID NO: 640593 - DNA, 25 bp, Mus musculus
gggtccttgtctggtcatagatacc

SEQ ID NO: 640594 - DNA, 25 bp, Mus musculus
gggtcctttaaacacactggctcta

SEQ ID NO: 640595 - DNA, 25 bp, Mus musculus
gggtcctttaaagacactggctcta

SEQ ID NO: 640596 - DNA, 25 bp, Mus musculus
gggtcctttctcctaaggagacaca

SEQ ID NO: 640597 - DNA, 25 bp, Mus musculus
gggtcctttctcgtaaggagacaca

SEQ ID NO: 640598 - DNA, 25 bp, Mus musculus
gggtcctttgaacccgagcgctgcc

SEQ ID NO: 640599 - DNA, 25 bp, Mus musculus
gggtcctttgaagccgagcgctgcc

SEQ ID NO: 640600 - DNA, 25 bp, Mus musculus
gggtcctttgacagagatatcttag

SEQ ID NO: 640601 - DNA, 25 bp, Mus musculus
gggtcctttgactgagatatcttag

SEQ ID NO: 640602 - DNA, 25 bp, Mus musculus
gggtccttttacatcacttttggag

SEQ ID NO: 640603 - DNA, 25 bp, Mus musculus
gggtccttttacttcacttttggag

SEQ ID NO: 640604 - DNA, 25 bp, Mus musculus
gggtccttttcaaacacttcatatg

SEQ ID NO: 640605 - DNA, 25 bp, Mus musculus
gggtccttttcatacacttcatatg

SEQ ID NO: 640606 - DNA, 25 bp, Mus musculus
gggtccttttgtactgaacctgatc

SEQ ID NO: 640607 - DNA, 25 bp, Mus musculus
gggtccttttgtacttgtcatttat

SEQ ID NO: 640608 - DNA, 25 bp, Mus musculus
gggtccttttgtcagtaactagctg

SEQ ID NO: 640609 - DNA, 25 bp, Mus musculus
gggtccttttgtgagtaactagctg

SEQ ID NO: 640610 - DNA, 25 bp, Mus musculus
gggtccttttgttctgaacctgatc

SEQ ID NO: 640611 - DNA, 25 bp, Mus musculus
gggtccttttgttcttgtcatttat

SEQ ID NO: 640612 - DNA, 25 bp, Mus musculus
gggtcgaagattccccattgaggcc

SEQ ID NO: 640613 - DNA, 25 bp, Mus musculus
gggtcgaagattgcccattgaggcc

SEQ ID NO: 640614 - DNA, 25 bp, Mus musculus
gggtcgaatccaacactaagataat

SEQ ID NO: 640615 - DNA, 25 bp, Mus musculus
gggtcgaatccatcactaagataat

SEQ ID NO: 640616 - DNA, 25 bp, Mus musculus
gggtcgacaccacagatgctccaag

SEQ ID NO: 640617 - DNA, 25 bp, Mus musculus
gggtcgacaccagagatgctccaag

SEQ ID NO: 640618 - DNA, 25 bp, Mus musculus
gggtcgacagacatgaatgctagtt

SEQ ID NO: 640619 - DNA, 25 bp, Mus musculus
gggtcgacagacttgaatgctagtt

SEQ ID NO: 640620 - DNA, 25 bp, Mus musculus
gggtcgactgaaagaatgcctctct

SEQ ID NO: 640621 - DNA, 25 bp, Mus musculus
gggtcgactgaatgaatgcctctct

SEQ ID NO: 640622 - DNA, 25 bp, Mus musculus
gggtcgagactgcttgtcattttgt

SEQ ID NO: 640623 - DNA, 25 bp, Mus musculus
gggtcgagactggttgtcattttgt

SEQ ID NO: 640624 - DNA, 25 bp, Mus musculus
gggtcgagcaagcaggccctcacct

SEQ ID NO: 640625 - DNA, 25 bp, Mus musculus
gggtcgagcaaggaggccctcacct

SEQ ID NO: 640626 - DNA, 25 bp, Mus musculus
gggtcgagcacacgtcctttgtaag

SEQ ID NO: 640627 - DNA, 25 bp, Mus musculus
gggtcgagcacaggtcctttgtaag

SEQ ID NO: 640628 - DNA, 25 bp, Mus musculus
gggtcgcacatgcttatcgtcccac

SEQ ID NO: 640629 - DNA, 25 bp, Mus musculus
gggtcgcacatggttatcgtcccac

SEQ ID NO: 640630 - DNA, 25 bp, Mus musculus
gggtcgcacctcattgcttatcttc

SEQ ID NO: 640631 - DNA, 25 bp, Mus musculus
gggtcgcacctctttgcttatcttc

SEQ ID NO: 640632 - DNA, 25 bp, Mus musculus
gggtcgcaggtaatttgtagcactt

SEQ ID NO: 640633 - DNA, 25 bp, Mus musculus
gggtcgcaggtattttgtagcactt

SEQ ID NO: 640634 - DNA, 25 bp, Mus musculus
gggtcgcatttaccagggcactgaa

SEQ ID NO: 640635 - DNA, 25 bp, Mus musculus
gggtcgcatttagcagggcactgaa

SEQ ID NO: 640636 - DNA, 25 bp, Mus musculus
gggtcgccctttctgtgaaaaccat

SEQ ID NO: 640637 - DNA, 25 bp, Mus musculus
gggtcgccctttgtgtgaaaaccat

SEQ ID NO: 640638 - DNA, 25 bp, Mus musculus
gggtcgcctagactggcttgccctc

SEQ ID NO: 640639 - DNA, 25 bp, Mus musculus
gggtcgcctagagtggcttgccctc

SEQ ID NO: 640640 - DNA, 25 bp, Mus musculus
gggtcgcctagtatgtatgttctgt

SEQ ID NO: 640641 - DNA, 25 bp, Mus musculus
gggtcgcctagtttgtatgttctgt

SEQ ID NO: 640642 - DNA, 25 bp, Mus musculus
gggtcgcctgttctgcaataagaga

SEQ ID NO: 640643 - DNA, 25 bp, Mus musculus
gggtcgcctgttgtgcaataagaga

SEQ ID NO: 640644 - DNA, 25 bp, Mus musculus
gggtcgcggagaagccccgggagta

SEQ ID NO: 640645 - DNA, 25 bp, Mus musculus
gggtcgcggagatgccccgggagta

SEQ ID NO: 640646 - DNA, 25 bp, Mus musculus
gggtcgctaactcctgcttggtaag

SEQ ID NO: 640647 - DNA, 25 bp, Mus musculus
gggtcgctaactgctgcttggtaag

SEQ ID NO: 640648 - DNA, 25 bp, Mus musculus
gggtcgctccagaactggccttgac

SEQ ID NO: 640649 - DNA, 25 bp, Mus musculus
gggtcgctccagtactggccttgac

SEQ ID NO: 640650 - DNA, 25 bp, Mus musculus
gggtcgctgtatcatattgattctt

SEQ ID NO: 640651 - DNA, 25 bp, Mus musculus
gggtcgctgtatgatattgattctt

SEQ ID NO: 640652 - DNA, 25 bp, Mus musculus
gggtcggagtacaactgtcacacag

SEQ ID NO: 640653 - DNA, 25 bp, Mus musculus
gggtcggagtactactgtcacacag

SEQ ID NO: 640654 - DNA, 25 bp, Mus musculus
gggtcggatgtacttttcaacttct

SEQ ID NO: 640655 - DNA, 25 bp, Mus musculus
gggtcggatgtagttttcaacttct

SEQ ID NO: 640656 - DNA, 25 bp, Mus musculus
gggtcggcctgtccaaaagtcctgt

SEQ ID NO: 640657 - DNA, 25 bp, Mus musculus
gggtcggcctgtgcaaaagtcctgt

SEQ ID NO: 640658 - DNA, 25 bp, Mus musculus
gggtcggctggaaatgcttccctct

SEQ ID NO: 640659 - DNA, 25 bp, Mus musculus
gggtcggctggatatgcttccctct

SEQ ID NO: 640660 - DNA, 25 bp, Mus musculus
gggtcggctgtgactagcaagtggg

SEQ ID NO: 640661 - DNA, 25 bp, Mus musculus
gggtcggctgtgtctagcaagtggg

SEQ ID NO: 640662 - DNA, 25 bp, Mus musculus
gggtcgggaaaaataaatgatctgt

SEQ ID NO: 640663 - DNA, 25 bp, Mus musculus
gggtcgggaaaattaaatgatctgt

SEQ ID NO: 640664 - DNA, 25 bp, Mus musculus
gggtcgggatgcacaggaatctttc

SEQ ID NO: 640665 - DNA, 25 bp, Mus musculus
gggtcgggatgctcaggaatctttc

SEQ ID NO: 640666 - DNA, 25 bp, Mus musculus
gggtcgggctatctttaacttggat

SEQ ID NO: 640667 - DNA, 25 bp, Mus musculus
gggtcgggctatgtttaacttggat

SEQ ID NO: 640668 - DNA, 25 bp, Mus musculus
gggtcggtctccaaggcgcaagtca

SEQ ID NO: 640669 - DNA, 25 bp, Mus musculus
gggtcggtctcctaggcgcaagtca

SEQ ID NO: 640670 - DNA, 25 bp, Mus musculus
gggtcggttatcaagtgctgtcaca

SEQ ID NO: 640671 - DNA, 25 bp, Mus musculus
gggtcggttatctagtgctgtcaca

SEQ ID NO: 640672 - DNA, 25 bp, Mus musculus
gggtcgtcactgaaatggtttcatg

SEQ ID NO: 640673 - DNA, 25 bp, Mus musculus
gggtcgtcactgtaatggtttcatg

SEQ ID NO: 640674 - DNA, 25 bp, Mus musculus
gggtcgtccaccagaggagccacaa

SEQ ID NO: 640675 - DNA, 25 bp, Mus musculus
gggtcgtccacctgaggagccacaa

SEQ ID NO: 640676 - DNA, 25 bp, Mus musculus
gggtcgtcggtcacactatgaatac

SEQ ID NO: 640677 - DNA, 25 bp, Mus musculus
gggtcgtcggtctcactatgaatac

SEQ ID NO: 640678 - DNA, 25 bp, Mus musculus
gggtcgtctggacatggttctacat

SEQ ID NO: 640679 - DNA, 25 bp, Mus musculus
gggtcgtctggagatggttctacat

SEQ ID NO: 640680 - DNA, 25 bp, Mus musculus
gggtcgtctttgagatttctggtgt

SEQ ID NO: 640681 - DNA, 25 bp, Mus musculus
gggtcgtctttgtgatttctggtgt

SEQ ID NO: 640682 - DNA, 25 bp, Mus musculus
gggtcgtgacctacgccggaaagca

SEQ ID NO: 640683 - DNA, 25 bp, Mus musculus
gggtcgtgaccttcgccggaaagca

SEQ ID NO: 640684 - DNA, 25 bp, Mus musculus
gggtcgtgcctgcttgccagcacac

SEQ ID NO: 640685 - DNA, 25 bp, Mus musculus
gggtcgtgcctggttgccagcacac

SEQ ID NO: 640686 - DNA, 25 bp, Mus musculus
gggtcgttataaacttcatcctggt

SEQ ID NO: 640687 - DNA, 25 bp, Mus musculus
gggtcgttataatcttcatcctggt

SEQ ID NO: 640688 - DNA, 25 bp, Mus musculus
gggtcgttcaacctgtgtgcttcga

SEQ ID NO: 640689 - DNA, 25 bp, Mus musculus
gggtcgttcaacgtgtgtgcttcga

SEQ ID NO: 640690 - DNA, 25 bp, Mus musculus
gggtcgttgtaaataaacatacaca

SEQ ID NO: 640691 - DNA, 25 bp, Mus musculus
gggtcgttgtaattaaacatacaca

SEQ ID NO: 640692 - DNA, 25 bp, Mus musculus
gggtcgtttcgaagtcagatggatt

SEQ ID NO: 640693 - DNA, 25 bp, Mus musculus
gggtcgtttcgatgtcagatggatt

SEQ ID NO: 640694 - DNA, 25 bp, Mus musculus
gggtcgtttttcacttggatattat

SEQ ID NO: 640695 - DNA, 25 bp, Mus musculus
gggtcgtttttctcttggatattat

SEQ ID NO: 640696 - DNA, 25 bp, Mus musculus
gggtctaaatgacttctcaaggaga

SEQ ID NO: 640697 - DNA, 25 bp, Mus musculus
gggtctaaatgagttctcaaggaga

SEQ ID NO: 640698 - DNA, 25 bp, Mus musculus
gggtctaaccatacaccagcattgc

SEQ ID NO: 640699 - DNA, 25 bp, Mus musculus
gggtctaaccattcaccagcattgc

SEQ ID NO: 640700 - DNA, 25 bp, Mus musculus
gggtctaagcacaacagggtttgga

SEQ ID NO: 640701 - DNA, 25 bp, Mus musculus
gggtctaagcactacagggtttgga

SEQ ID NO: 640702 - DNA, 25 bp, Mus musculus
gggtctaagctacgcttcccctggc

SEQ ID NO: 640703 - DNA, 25 bp, Mus musculus
gggtctaagctaggcttcccctggc

SEQ ID NO: 640704 - DNA, 25 bp, Mus musculus
gggtctaaggctagtctgaggtaca

SEQ ID NO: 640705 - DNA, 25 bp, Mus musculus
gggtctaaggcttgtctgaggtaca

SEQ ID NO: 640706 - DNA, 25 bp, Mus musculus
gggtctaattaacgcctacctatct

SEQ ID NO: 640707 - DNA, 25 bp, Mus musculus
gggtctaattaaggcctacctatct

SEQ ID NO: 640708 - DNA, 25 bp, Mus musculus
gggtctaatttaattactgtttcat

SEQ ID NO: 640709 - DNA, 25 bp, Mus musculus
gggtctaatttatttactgtttcat

SEQ ID NO: 640710 - DNA, 25 bp, Mus musculus
gggtctacacaaatatagcctctcc

SEQ ID NO: 640711 - DNA, 25 bp, Mus musculus
gggtctacacaattatagcctctcc

SEQ ID NO: 640712 - DNA, 25 bp, Mus musculus
gggtctacacgaacgtggccaagta

SEQ ID NO: 640713 - DNA, 25 bp, Mus musculus
gggtctacacgatcgtggccaagta

SEQ ID NO: 640714 - DNA, 25 bp, Mus musculus
gggtctacaggcaacctagagacca

SEQ ID NO: 640715 - DNA, 25 bp, Mus musculus
gggtctacaggctacctagagacca

SEQ ID NO: 640716 - DNA, 25 bp, Mus musculus
gggtctaccagcaactgaccttgga

SEQ ID NO: 640717 - DNA, 25 bp, Mus musculus
gggtctaccagctactgaccttgga

SEQ ID NO: 640718 - DNA, 25 bp, Mus musculus
gggtctacccacatcaaatgcttta

SEQ ID NO: 640719 - DNA, 25 bp, Mus musculus
gggtctacccacttcaaatgcttta

SEQ ID NO: 640720 - DNA, 25 bp, Mus musculus
gggtctacctggataaactggtgtt

SEQ ID NO: 640721 - DNA, 25 bp, Mus musculus
gggtctacctggttaaactggtgtt

SEQ ID NO: 640722 - DNA, 25 bp, Mus musculus
gggtctacgcagaatttacataact

SEQ ID NO: 640723 - DNA, 25 bp, Mus musculus
gggtctacgcagtatttacataact

SEQ ID NO: 640724 - DNA, 25 bp, Mus musculus
gggtctactcatccttgagcagtgg

SEQ ID NO: 640725 - DNA, 25 bp, Mus musculus
gggtctactcatgcttgagcagtgg

SEQ ID NO: 640726 - DNA, 25 bp, Mus musculus
gggtctactgaacatcattttccaa

SEQ ID NO: 640727 - DNA, 25 bp, Mus musculus
gggtctactgaagatcattttccaa

SEQ ID NO: 640728 - DNA, 25 bp, Mus musculus
gggtctagcacacaccagtgtctgc

SEQ ID NO: 640729 - DNA, 25 bp, Mus musculus
gggtctagcacagaccagtgtctgc

SEQ ID NO: 640730 - DNA, 25 bp, Mus musculus
gggtctagcccaattcctgttacac

SEQ ID NO: 640731 - DNA, 25 bp, Mus musculus
gggtctagcccatttcctgttacac

SEQ ID NO: 640732 - DNA, 25 bp, Mus musculus
gggtctagcctaccacctgaagata

SEQ ID NO: 640733 - DNA, 25 bp, Mus musculus
gggtctagcctagcacctgaagata

SEQ ID NO: 640734 - DNA, 25 bp, Mus musculus
gggtctagcttaccagtattggaag

SEQ ID NO: 640735 - DNA, 25 bp, Mus musculus
gggtctagcttagcagtattggaag

SEQ ID NO: 640736 - DNA, 25 bp, Mus musculus
gggtctagctttccttcagcaacga

SEQ ID NO: 640737 - DNA, 25 bp, Mus musculus
gggtctagctttgcttcagcaacga

SEQ ID NO: 640738 - DNA, 25 bp, Mus musculus
gggtctaggctgctgtttccacctc

SEQ ID NO: 640739 - DNA, 25 bp, Mus musculus
gggtctaggctggtgtttccacctc

SEQ ID NO: 640740 - DNA, 25 bp, Mus musculus
gggtctagggctctttttcatcttc

SEQ ID NO: 640741 - DNA, 25 bp, Mus musculus
gggtctagggctgtttttcatcttc

SEQ ID NO: 640742 - DNA, 25 bp, Mus musculus
gggtctagtaaccatgctgggcctt

SEQ ID NO: 640743 - DNA, 25 bp, Mus musculus
gggtctagtaacgatgctgggcctt

SEQ ID NO: 640744 - DNA, 25 bp, Mus musculus
gggtctagtgcacttgtgagcatct

SEQ ID NO: 640745 - DNA, 25 bp, Mus musculus
gggtctagtgcagttgtgagcatct

SEQ ID NO: 640746 - DNA, 25 bp, Mus musculus
gggtctagttccaattcactccatc

SEQ ID NO: 640747 - DNA, 25 bp, Mus musculus
gggtctagttcctattcactccatc

SEQ ID NO: 640748 - DNA, 25 bp, Mus musculus
gggtctataacaaccacagtcgaac

SEQ ID NO: 640749 - DNA, 25 bp, Mus musculus
gggtctataacatccacagtcgaac

SEQ ID NO: 640750 - DNA, 25 bp, Mus musculus
gggtctatacaccagtactttgcct

SEQ ID NO: 640751 - DNA, 25 bp, Mus musculus
gggtctatacacgagtactttgcct

SEQ ID NO: 640752 - DNA, 25 bp, Mus musculus
gggtctatacgtatcacgctggcaa

SEQ ID NO: 640753 - DNA, 25 bp, Mus musculus
gggtctatacgtttcacgctggcaa

SEQ ID NO: 640754 - DNA, 25 bp, Mus musculus
gggtctatataaacctgttgaactc

SEQ ID NO: 640755 - DNA, 25 bp, Mus musculus
gggtctatataatcctgttgaactc

SEQ ID NO: 640756 - DNA, 25 bp, Mus musculus
gggtctatccacaagttcgttcctt

SEQ ID NO: 640757 - DNA, 25 bp, Mus musculus
gggtctatccactagttcgttcctt

SEQ ID NO: 640758 - DNA, 25 bp, Mus musculus
gggtctatgcacctgtacagtcctt

SEQ ID NO: 640759 - DNA, 25 bp, Mus musculus
gggtctatgcacgtgtacagtcctt

SEQ ID NO: 640760 - DNA, 25 bp, Mus musculus
gggtctatggctctcactgagacct

SEQ ID NO: 640761 - DNA, 25 bp, Mus musculus
gggtctatggctgtcactgagacct

SEQ ID NO: 640762 - DNA, 25 bp, Mus musculus
gggtctatgtagaacttgctgttct

SEQ ID NO: 640763 - DNA, 25 bp, Mus musculus
gggtctatgtagtacttgctgttct

SEQ ID NO: 640764 - DNA, 25 bp, Mus musculus
gggtctattccacctcattcatttt

SEQ ID NO: 640765 - DNA, 25 bp, Mus musculus
gggtctattccagctcattcatttt

SEQ ID NO: 640766 - DNA, 25 bp, Mus musculus
gggtctatttttaagcttgctagag

SEQ ID NO: 640767 - DNA, 25 bp, Mus musculus
gggtctattttttagcttgctagag

SEQ ID NO: 640768 - DNA, 25 bp, Mus musculus
gggtctcaaacacccacagcaagtg

SEQ ID NO: 640769 - DNA, 25 bp, Mus musculus
gggtctcaaacagccacagcaagtg

SEQ ID NO: 640770 - DNA, 25 bp, Mus musculus
gggtctcaactaagcaatttctact

SEQ ID NO: 640771 - DNA, 25 bp, Mus musculus
gggtctcaactaagtggtttctctt

SEQ ID NO: 640772 - DNA, 25 bp, Mus musculus
gggtctcaactatgcaatttctact

SEQ ID NO: 640773 - DNA, 25 bp, Mus musculus
gggtctcaactatgtggtttctctt

SEQ ID NO: 640774 - DNA, 25 bp, Mus musculus
gggtctcaactgcatttgcccaacg

SEQ ID NO: 640775 - DNA, 25 bp, Mus musculus
gggtctcaactggatttgcccaacg

SEQ ID NO: 640776 - DNA, 25 bp, Mus musculus
gggtctcacatcattgcactgtgcc

SEQ ID NO: 640777 - DNA, 25 bp, Mus musculus
gggtctcacatctttgcactgtgcc

SEQ ID NO: 640778 - DNA, 25 bp, Mus musculus
gggtctcaccgaattattgttcgtt

SEQ ID NO: 640779 - DNA, 25 bp, Mus musculus
gggtctcaccgatttattgttcgtt

SEQ ID NO: 640780 - DNA, 25 bp, Mus musculus
gggtctcactagcttgccttaactg

SEQ ID NO: 640781 - DNA, 25 bp, Mus musculus
gggtctcactaggttgccttaactg

SEQ ID NO: 640782 - DNA, 25 bp, Mus musculus
gggtctcactgactgctgtacagct

SEQ ID NO: 640783 - DNA, 25 bp, Mus musculus
gggtctcactgagtgctgtacagct

SEQ ID NO: 640784 - DNA, 25 bp, Mus musculus
gggtctcactgtaaaggcacaaatt

SEQ ID NO: 640785 - DNA, 25 bp, Mus musculus
gggtctcactgttaaggcacaaatt

SEQ ID NO: 640786 - DNA, 25 bp, Mus musculus
gggtctcagcaaatactcaaggagg

SEQ ID NO: 640787 - DNA, 25 bp, Mus musculus
gggtctcagcaattactcaaggagg

SEQ ID NO: 640788 - DNA, 25 bp, Mus musculus
gggtctcagcctcggatgaccgcat

SEQ ID NO: 640789 - DNA, 25 bp, Mus musculus
gggtctcagcctgggatgaccgcat

SEQ ID NO: 640790 - DNA, 25 bp, Mus musculus
gggtctcagcggagctgtacaccag

SEQ ID NO: 640791 - DNA, 25 bp, Mus musculus
gggtctcagcggtgctgtacaccag

SEQ ID NO: 640792 - DNA, 25 bp, Mus musculus
gggtctcagggccttaagatctcag

SEQ ID NO: 640793 - DNA, 25 bp, Mus musculus
gggtctcagggcgttaagatctcag

SEQ ID NO: 640794 - DNA, 25 bp, Mus musculus
gggtctcaggtcaccgcaggttact

SEQ ID NO: 640795 - DNA, 25 bp, Mus musculus
gggtctcaggtcagtcaagctggaa

SEQ ID NO: 640796 - DNA, 25 bp, Mus musculus
gggtctcaggtcctgctcacaagct

SEQ ID NO: 640797 - DNA, 25 bp, Mus musculus
gggtctcaggtcgtgctcacaagct

SEQ ID NO: 640798 - DNA, 25 bp, Mus musculus
gggtctcaggtctccgcaggttact

SEQ ID NO: 640799 - DNA, 25 bp, Mus musculus
gggtctcaggtctgtcaagctggaa

SEQ ID NO: 640800 - DNA, 25 bp, Mus musculus
gggtctcatacaaggccaacatcag

SEQ ID NO: 640801 - DNA, 25 bp, Mus musculus
gggtctcatacatggccaacatcag

SEQ ID NO: 640802 - DNA, 25 bp, Mus musculus
gggtctcatccaaggacgggtaaca

SEQ ID NO: 640803 - DNA, 25 bp, Mus musculus
gggtctcatccatggacgggtaaca

SEQ ID NO: 640804 - DNA, 25 bp, Mus musculus
gggtctcatgtaaccttagatagcc

SEQ ID NO: 640805 - DNA, 25 bp, Mus musculus
gggtctcatgtatccttagatagcc

SEQ ID NO: 640806 - DNA, 25 bp, Mus musculus
gggtctcattaaaccatgccaacct

SEQ ID NO: 640807 - DNA, 25 bp, Mus musculus
gggtctcattaatccatgccaacct

SEQ ID NO: 640808 - DNA, 25 bp, Mus musculus
gggtctcattgtatattccaggcta

SEQ ID NO: 640809 - DNA, 25 bp, Mus musculus
gggtctcattgtttattccaggcta

SEQ ID NO: 640810 - DNA, 25 bp, Mus musculus
gggtctcattttcatttggcaagga

SEQ ID NO: 640811 - DNA, 25 bp, Mus musculus
gggtctcattttgatttggcaagga

SEQ ID NO: 640812 - DNA, 25 bp, Mus musculus
gggtctccaaggctctcccgggcat

SEQ ID NO: 640813 - DNA, 25 bp, Mus musculus
gggtctccaagggtctcccgggcat

SEQ ID NO: 640814 - DNA, 25 bp, Mus musculus
gggtctccacttcatgcctagagaa

SEQ ID NO: 640815 - DNA, 25 bp, Mus musculus
gggtctccacttgatgcctagagaa

SEQ ID NO: 640816 - DNA, 25 bp, Mus musculus
gggtctccagctagaaacacttcgt

SEQ ID NO: 640817 - DNA, 25 bp, Mus musculus
gggtctccagcttgaaacacttcgt

SEQ ID NO: 640818 - DNA, 25 bp, Mus musculus
gggtctccagtacgcagccctgagc

SEQ ID NO: 640819 - DNA, 25 bp, Mus musculus
gggtctccagtaggcagccctgagc

SEQ ID NO: 640820 - DNA, 25 bp, Mus musculus
gggtctccagtcattgatacatgtc

SEQ ID NO: 640821 - DNA, 25 bp, Mus musculus
gggtctccagtctttgatacatgtc

SEQ ID NO: 640822 - DNA, 25 bp, Mus musculus
gggtctccataacctttatatgttt

SEQ ID NO: 640823 - DNA, 25 bp, Mus musculus
gggtctccataagctttatatgttt

SEQ ID NO: 640824 - DNA, 25 bp, Mus musculus
gggtctccattgagtataatggctg

SEQ ID NO: 640825 - DNA, 25 bp, Mus musculus
gggtctccattgtgtataatggctg

SEQ ID NO: 640826 - DNA, 25 bp, Mus musculus
gggtctcccataacagacaatgtgc

SEQ ID NO: 640827 - DNA, 25 bp, Mus musculus
gggtctcccatatcagacaatgtgc

SEQ ID NO: 640828 - DNA, 25 bp, Mus musculus
gggtctcccatcagaacagcacaga

SEQ ID NO: 640829 - DNA, 25 bp, Mus musculus
gggtctcccatctgaacagcacaga

SEQ ID NO: 640830 - DNA, 25 bp, Mus musculus
gggtctcccatgaaactcccataaa

SEQ ID NO: 640831 - DNA, 25 bp, Mus musculus
gggtctcccatgtaactcccataaa

SEQ ID NO: 640832 - DNA, 25 bp, Mus musculus
gggtctccccaaatactacgcaggg

SEQ ID NO: 640833 - DNA, 25 bp, Mus musculus
gggtctccccaattactacgcaggg

SEQ ID NO: 640834 - DNA, 25 bp, Mus musculus
gggtctccctatagataaaataagg

SEQ ID NO: 640835 - DNA, 25 bp, Mus musculus
gggtctccctattgataaaataagg

SEQ ID NO: 640836 - DNA, 25 bp, Mus musculus
gggtctccgagacgtgtgacattct

SEQ ID NO: 640837 - DNA, 25 bp, Mus musculus
gggtctccgagaggtgtgacattct

SEQ ID NO: 640838 - DNA, 25 bp, Mus musculus
gggtctccggccaagactggcctca

SEQ ID NO: 640839 - DNA, 25 bp, Mus musculus
gggtctccggcctagactggcctca

SEQ ID NO: 640840 - DNA, 25 bp, Mus musculus
gggtctcctaagactaggaaacaca

SEQ ID NO: 640841 - DNA, 25 bp, Mus musculus
gggtctcctaagtctaggaaacaca

SEQ ID NO: 640842 - DNA, 25 bp, Mus musculus
gggtctcctaatacagtttacaact

SEQ ID NO: 640843 - DNA, 25 bp, Mus musculus
gggtctcctaattcagtttacaact

SEQ ID NO: 640844 - DNA, 25 bp, Mus musculus
gggtctcctgcacccttagagaata

SEQ ID NO: 640845 - DNA, 25 bp, Mus musculus
gggtctcctgcagccttagagaata

SEQ ID NO: 640846 - DNA, 25 bp, Mus musculus
gggtctccttaaaatcatacttcat

SEQ ID NO: 640847 - DNA, 25 bp, Mus musculus
gggtctccttaatatcatacttcat

SEQ ID NO: 640848 - DNA, 25 bp, Mus musculus
gggtctccttttagtcaaaagcaag

SEQ ID NO: 640849 - DNA, 25 bp, Mus musculus
gggtctcctttttgtcaaaagcaag

SEQ ID NO: 640850 - DNA, 25 bp, Mus musculus
gggtctcgacctaggaatgataact

SEQ ID NO: 640851 - DNA, 25 bp, Mus musculus
gggtctcgaccttggaatgataact

SEQ ID NO: 640852 - DNA, 25 bp, Mus musculus
gggtctcgatggacgcacctgtgca

SEQ ID NO: 640853 - DNA, 25 bp, Mus musculus
gggtctcgatggtcgcacctgtgca

SEQ ID NO: 640854 - DNA, 25 bp, Mus musculus
gggtctcgtgatcaacaacagaatg

SEQ ID NO: 640855 - DNA, 25 bp, Mus musculus
gggtctcgtgatgaacaacagaatg

SEQ ID NO: 640856 - DNA, 25 bp, Mus musculus
gggtctctaagtctgaggacatcct

SEQ ID NO: 640857 - DNA, 25 bp, Mus musculus
gggtctctaagtgtgaggacatcct

SEQ ID NO: 640858 - DNA, 25 bp, Mus musculus
gggtctctaatgatctcagccaaaa

SEQ ID NO: 640859 - DNA, 25 bp, Mus musculus
gggtctctaatgttctcagccaaaa

SEQ ID NO: 640860 - DNA, 25 bp, Mus musculus
gggtctctaccaagaatatgaacct

SEQ ID NO: 640861 - DNA, 25 bp, Mus musculus
gggtctctaccatgaatatgaacct

SEQ ID NO: 640862 - DNA, 25 bp, Mus musculus
gggtctctacgactggttccaagcc

SEQ ID NO: 640863 - DNA, 25 bp, Mus musculus
gggtctctacgagtggttccaagcc

SEQ ID NO: 640864 - DNA, 25 bp, Mus musculus
gggtctctaggaactcagacttttt

SEQ ID NO: 640865 - DNA, 25 bp, Mus musculus
gggtctctaggatctcagacttttt

SEQ ID NO: 640866 - DNA, 25 bp, Mus musculus
gggtctctaggcatgcagacatgca

SEQ ID NO: 640867 - DNA, 25 bp, Mus musculus
gggtctctaggcttgcagacatgca

SEQ ID NO: 640868 - DNA, 25 bp, Mus musculus
gggtctctagtcactttcaagtata

SEQ ID NO: 640869 - DNA, 25 bp, Mus musculus
gggtctctagtctctttcaagtata

SEQ ID NO: 640870 - DNA, 25 bp, Mus musculus
gggtctctatgaaatctgttcacag

SEQ ID NO: 640871 - DNA, 25 bp, Mus musculus
gggtctctatgatatctgttcacag

SEQ ID NO: 640872 - DNA, 25 bp, Mus musculus
gggtctctatggcagtgtcattgtc

SEQ ID NO: 640873 - DNA, 25 bp, Mus musculus
gggtctctatgggagtgtcattgtc

SEQ ID NO: 640874 - DNA, 25 bp, Mus musculus
gggtctctcaagagttgggtctttt

SEQ ID NO: 640875 - DNA, 25 bp, Mus musculus
gggtctctcaagtgttgggtctttt

SEQ ID NO: 640876 - DNA, 25 bp, Mus musculus
gggtctctcacacgaactcaaccat

SEQ ID NO: 640877 - DNA, 25 bp, Mus musculus
gggtctctcacaggaactcaaccat

SEQ ID NO: 640878 - DNA, 25 bp, Mus musculus
gggtctctcagtcagggttactatt

SEQ ID NO: 640879 - DNA, 25 bp, Mus musculus
gggtctctcagtgagggttactatt

SEQ ID NO: 640880 - DNA, 25 bp, Mus musculus
gggtctctcataaggaagttttcgt

SEQ ID NO: 640881 - DNA, 25 bp, Mus musculus
gggtctctcatatggaagttttcgt

SEQ ID NO: 640882 - DNA, 25 bp, Mus musculus
gggtctctccctatgtgagtggtga

SEQ ID NO: 640883 - DNA, 25 bp, Mus musculus
gggtctctccctttgtgagtggtga

SEQ ID NO: 640884 - DNA, 25 bp, Mus musculus
gggtctctcctgatactcaaggtgg

SEQ ID NO: 640885 - DNA, 25 bp, Mus musculus
gggtctctcctgttactcaaggtgg

SEQ ID NO: 640886 - DNA, 25 bp, Mus musculus
gggtctctccttatcaggacaagtg

SEQ ID NO: 640887 - DNA, 25 bp, Mus musculus
gggtctctccttttcaggacaagtg

SEQ ID NO: 640888 - DNA, 25 bp, Mus musculus
gggtctctctacatatgttctcaac

SEQ ID NO: 640889 - DNA, 25 bp, Mus musculus
gggtctctctacttatgttctcaac

SEQ ID NO: 640890 - DNA, 25 bp, Mus musculus
gggtctctctagcaactgagaagac

SEQ ID NO: 640891 - DNA, 25 bp, Mus musculus
gggtctctctaggaactgagaagac

SEQ ID NO: 640892 - DNA, 25 bp, Mus musculus
gggtctctctatataagattgatta

SEQ ID NO: 640893 - DNA, 25 bp, Mus musculus
gggtctctctatttaagattgatta

SEQ ID NO: 640894 - DNA, 25 bp, Mus musculus
gggtctctcttcctatcatgtaaga

SEQ ID NO: 640895 - DNA, 25 bp, Mus musculus
gggtctctcttcgtatcatgtaaga

SEQ ID NO: 640896 - DNA, 25 bp, Mus musculus
gggtctctgaatctctctggccctg

SEQ ID NO: 640897 - DNA, 25 bp, Mus musculus
gggtctctgaatgtctctggccctg

SEQ ID NO: 640898 - DNA, 25 bp, Mus musculus
gggtctctgacaaattctgaccatt

SEQ ID NO: 640899 - DNA, 25 bp, Mus musculus
gggtctctgacatattctgaccatt

SEQ ID NO: 640900 - DNA, 25 bp, Mus musculus
gggtctctgaggctgctgttcccag

SEQ ID NO: 640901 - DNA, 25 bp, Mus musculus
gggtctctgagggtgctgttcccag

SEQ ID NO: 640902 - DNA, 25 bp, Mus musculus
gggtctctgcatagccagggttatc

SEQ ID NO: 640903 - DNA, 25 bp, Mus musculus
gggtctctgcattgccagggttatc

SEQ ID NO: 640904 - DNA, 25 bp, Mus musculus
gggtctctgtaaccctagtctattg

SEQ ID NO: 640905 - DNA, 25 bp, Mus musculus
gggtctctgtaagcctagtctattg

SEQ ID NO: 640906 - DNA, 25 bp, Mus musculus
gggtctctgtacacttaatcaattt

SEQ ID NO: 640907 - DNA, 25 bp, Mus musculus
gggtctctgtactcttaatcaattt

SEQ ID NO: 640908 - DNA, 25 bp, Mus musculus
gggtctctgtctccttaaacccact

SEQ ID NO: 640909 - DNA, 25 bp, Mus musculus
gggtctctgtctgcttaaacccact

SEQ ID NO: 640910 - DNA, 25 bp, Mus musculus
gggtctcttacaagatcgcaggaga

SEQ ID NO: 640911 - DNA, 25 bp, Mus musculus
gggtctcttacacaaccttgcagta

SEQ ID NO: 640912 - DNA, 25 bp, Mus musculus
gggtctcttacagaaccttgcagta

SEQ ID NO: 640913 - DNA, 25 bp, Mus musculus
gggtctcttacatgatcgcaggaga

SEQ ID NO: 640914 - DNA, 25 bp, Mus musculus
gggtctcttactcaacctagaactt

SEQ ID NO: 640915 - DNA, 25 bp, Mus musculus
gggtctcttactgaacctagaactt

SEQ ID NO: 640916 - DNA, 25 bp, Mus musculus
gggtctcttctcagggctatggatc

SEQ ID NO: 640917 - DNA, 25 bp, Mus musculus
gggtctcttctctgggctatggatc

SEQ ID NO: 640918 - DNA, 25 bp, Mus musculus
gggtctcttgctcaacagggagcct

SEQ ID NO: 640919 - DNA, 25 bp, Mus musculus
gggtctcttgctgaacagggagcct

SEQ ID NO: 640920 - DNA, 25 bp, Mus musculus
gggtctcttgtaacgttggccttga

SEQ ID NO: 640921 - DNA, 25 bp, Mus musculus
gggtctcttgtatcgttggccttga

SEQ ID NO: 640922 - DNA, 25 bp, Mus musculus
gggtctctttgaaaagaatgcagga

SEQ ID NO: 640923 - DNA, 25 bp, Mus musculus
gggtctctttgataagaatgcagga

SEQ ID NO: 640924 - DNA, 25 bp, Mus musculus
gggtctcttttcaggatgctgcaca

SEQ ID NO: 640925 - DNA, 25 bp, Mus musculus
gggtctcttttctggatgctgcaca

SEQ ID NO: 640926 - DNA, 25 bp, Mus musculus
gggtctgaaaaactccagttccttg

SEQ ID NO: 640927 - DNA, 25 bp, Mus musculus
gggtctgaaaaagtccagttccttg

SEQ ID NO: 640928 - DNA, 25 bp, Mus musculus
gggtctgaaagaccacacatgttta

SEQ ID NO: 640929 - DNA, 25 bp, Mus musculus
gggtctgaaagaccagagcttactt

SEQ ID NO: 640930 - DNA, 25 bp, Mus musculus
gggtctgaaagagcacacatgttta

SEQ ID NO: 640931 - DNA, 25 bp, Mus musculus
gggtctgaaagagcagagcttactt

SEQ ID NO: 640932 - DNA, 25 bp, Mus musculus
gggtctgaacaccaagcctctacct

SEQ ID NO: 640933 - DNA, 25 bp, Mus musculus
gggtctgaacacgaagcctctacct

SEQ ID NO: 640934 - DNA, 25 bp, Mus musculus
gggtctgaagaaatcccaaggaaga

SEQ ID NO: 640935 - DNA, 25 bp, Mus musculus
gggtctgaagaattcccaaggaaga

SEQ ID NO: 640936 - DNA, 25 bp, Mus musculus
gggtctgaagcacgccatcccatgt

SEQ ID NO: 640937 - DNA, 25 bp, Mus musculus
gggtctgaagcaggccatcccatgt

SEQ ID NO: 640938 - DNA, 25 bp, Mus musculus
gggtctgaagtgcatctcagctgac

SEQ ID NO: 640939 - DNA, 25 bp, Mus musculus
gggtctgaagtggatctcagctgac

SEQ ID NO: 640940 - DNA, 25 bp, Mus musculus
gggtctgaagttcagccagtcccta

SEQ ID NO: 640941 - DNA, 25 bp, Mus musculus
gggtctgaagttgagccagtcccta

SEQ ID NO: 640942 - DNA, 25 bp, Mus musculus
gggtctgacacaaagctctcataaa

SEQ ID NO: 640943 - DNA, 25 bp, Mus musculus
gggtctgacacatagctctcataaa

SEQ ID NO: 640944 - DNA, 25 bp, Mus musculus
gggtctgacaccagttttgcccact

SEQ ID NO: 640945 - DNA, 25 bp, Mus musculus
gggtctgacacctgttttgcccact

SEQ ID NO: 640946 - DNA, 25 bp, Mus musculus
gggtctgacatgatctgtgctgtgt

SEQ ID NO: 640947 - DNA, 25 bp, Mus musculus
gggtctgacatgttctgtgctgtgt

SEQ ID NO: 640948 - DNA, 25 bp, Mus musculus
gggtctgaccaaatcacctacttag

SEQ ID NO: 640949 - DNA, 25 bp, Mus musculus
gggtctgaccaattcacctacttag

SEQ ID NO: 640950 - DNA, 25 bp, Mus musculus
gggtctgaccagagctctcaatggg

SEQ ID NO: 640951 - DNA, 25 bp, Mus musculus
gggtctgaccagtgctctcaatggg

SEQ ID NO: 640952 - DNA, 25 bp, Mus musculus
gggtctgacctacatgcgagctgtt

SEQ ID NO: 640953 - DNA, 25 bp, Mus musculus
gggtctgacctagatgcgagctgtt

SEQ ID NO: 640954 - DNA, 25 bp, Mus musculus
gggtctgactgacgctactgcacac

SEQ ID NO: 640955 - DNA, 25 bp, Mus musculus
gggtctgactgaggctactgcacac

SEQ ID NO: 640956 - DNA, 25 bp, Mus musculus
gggtctgactgccgctggagatgag

SEQ ID NO: 640957 - DNA, 25 bp, Mus musculus
gggtctgactgcggctggagatgag

SEQ ID NO: 640958 - DNA, 25 bp, Mus musculus
gggtctgagccaccatctgtgacag

SEQ ID NO: 640959 - DNA, 25 bp, Mus musculus
gggtctgagccagcatctgtgacag

SEQ ID NO: 640960 - DNA, 25 bp, Mus musculus
gggtctgagctactgccaaaggcca

SEQ ID NO: 640961 - DNA, 25 bp, Mus musculus
gggtctgagctagtgccaaaggcca

SEQ ID NO: 640962 - DNA, 25 bp, Mus musculus
gggtctgaggctatagtctaggcat

SEQ ID NO: 640963 - DNA, 25 bp, Mus musculus
gggtctgaggctttagtctaggcat

SEQ ID NO: 640964 - DNA, 25 bp, Mus musculus
gggtctgagggtccatccagctcat

SEQ ID NO: 640965 - DNA, 25 bp, Mus musculus
gggtctgagggtgcatccagctcat

SEQ ID NO: 640966 - DNA, 25 bp, Mus musculus
gggtctgagttccttgtgttcaaga

SEQ ID NO: 640967 - DNA, 25 bp, Mus musculus
gggtctgagttcgttgtgttcaaga

SEQ ID NO: 640968 - DNA, 25 bp, Mus musculus
gggtctgatacaagctctactacgt

SEQ ID NO: 640969 - DNA, 25 bp, Mus musculus
gggtctgatacatgctctactacgt

SEQ ID NO: 640970 - DNA, 25 bp, Mus musculus
gggtctgatagcaggcctccagctt

SEQ ID NO: 640971 - DNA, 25 bp, Mus musculus
gggtctgatagctggcctccagctt

SEQ ID NO: 640972 - DNA, 25 bp, Mus musculus
gggtctgattcccaaatcatacaag

SEQ ID NO: 640973 - DNA, 25 bp, Mus musculus
gggtctgattccgaaatcatacaag

SEQ ID NO: 640974 - DNA, 25 bp, Mus musculus
gggtctgatttgctgagacaccagc

SEQ ID NO: 640975 - DNA, 25 bp, Mus musculus
gggtctgatttggtgagacaccagc

SEQ ID NO: 640976 - DNA, 25 bp, Mus musculus
gggtctgcaaccattgtaccagaca

SEQ ID NO: 640977 - DNA, 25 bp, Mus musculus
gggtctgcaacctttgtaccagaca

SEQ ID NO: 640978 - DNA, 25 bp, Mus musculus
gggtctgcagtcaagaacacacaaa

SEQ ID NO: 640979 - DNA, 25 bp, Mus musculus
gggtctgcagtctagaacacacaaa

SEQ ID NO: 640980 - DNA, 25 bp, Mus musculus
gggtctgcagtgaaccctaggtaac

SEQ ID NO: 640981 - DNA, 25 bp, Mus musculus
gggtctgcagtgtaccctaggtaac

SEQ ID NO: 640982 - DNA, 25 bp, Mus musculus
gggtctgcagttctgagagaccaaa

SEQ ID NO: 640983 - DNA, 25 bp, Mus musculus
gggtctgcagttgtgagagaccaaa

SEQ ID NO: 640984 - DNA, 25 bp, Mus musculus
gggtctgcgaggcacaagcttcctt

SEQ ID NO: 640985 - DNA, 25 bp, Mus musculus
gggtctgcgagggacaagcttcctt

SEQ ID NO: 640986 - DNA, 25 bp, Mus musculus
gggtctgcggttattcttataccat

SEQ ID NO: 640987 - DNA, 25 bp, Mus musculus
gggtctgcggtttttcttataccat

SEQ ID NO: 640988 - DNA, 25 bp, Mus musculus
gggtctgctactcactgacaggtgc

SEQ ID NO: 640989 - DNA, 25 bp, Mus musculus
gggtctgctactgactgacaggtgc

SEQ ID NO: 640990 - DNA, 25 bp, Mus musculus
gggtctgctaggactatcttggaga

SEQ ID NO: 640991 - DNA, 25 bp, Mus musculus
gggtctgctaggatcagtgatggca

SEQ ID NO: 640992 - DNA, 25 bp, Mus musculus
gggtctgctaggtctatcttggaga

SEQ ID NO: 640993 - DNA, 25 bp, Mus musculus
gggtctgctaggttcagtgatggca

SEQ ID NO: 640994 - DNA, 25 bp, Mus musculus
gggtctgctcaacccatataatttt

SEQ ID NO: 640995 - DNA, 25 bp, Mus musculus
gggtctgctcaagccatataatttt

SEQ ID NO: 640996 - DNA, 25 bp, Mus musculus
gggtctgctcagaaacaagtggaac

SEQ ID NO: 640997 - DNA, 25 bp, Mus musculus
gggtctgctcagtaacaagtggaac

SEQ ID NO: 640998 - DNA, 25 bp, Mus musculus
gggtctgctcataatagcttttgct

SEQ ID NO: 640999 - DNA, 25 bp, Mus musculus
gggtctgctcattatagcttttgct

SEQ ID NO: 641000 - DNA, 25 bp, Mus musculus
gggtctgctgaaaacaaacctgttc

SEQ ID NO: 641001 - DNA, 25 bp, Mus musculus
gggtctgctgaatacaaacctgttc

SEQ ID NO: 641002 - DNA, 25 bp, Mus musculus
gggtctgcttgcagctttcaaagca

SEQ ID NO: 641003 - DNA, 25 bp, Mus musculus
gggtctgcttgctgctttcaaagca

SEQ ID NO: 641004 - DNA, 25 bp, Mus musculus
gggtctggatccaggtcttggcaac

SEQ ID NO: 641005 - DNA, 25 bp, Mus musculus
gggtctggatcctggtcttggcaac

SEQ ID NO: 641006 - DNA, 25 bp, Mus musculus
gggtctgggacaagccaaggactta

SEQ ID NO: 641007 - DNA, 25 bp, Mus musculus
gggtctgggacatgccaaggactta

SEQ ID NO: 641008 - DNA, 25 bp, Mus musculus
gggtctgggcagctaacacaccaag

SEQ ID NO: 641009 - DNA, 25 bp, Mus musculus
gggtctgggcaggtaacacaccaag

SEQ ID NO: 641010 - DNA, 25 bp, Mus musculus
gggtctgggtttctatattcttctc

SEQ ID NO: 641011 - DNA, 25 bp, Mus musculus
gggtctgggtttgtatattcttctc

SEQ ID NO: 641012 - DNA, 25 bp, Mus musculus
gggtctggtcccaagaaccatatac

SEQ ID NO: 641013 - DNA, 25 bp, Mus musculus
gggtctggtccctagaaccatatac

SEQ ID NO: 641014 - DNA, 25 bp, Mus musculus
gggtctggtcttagaccggcctctg

SEQ ID NO: 641015 - DNA, 25 bp, Mus musculus
gggtctggtcttccattattatacc

SEQ ID NO: 641016 - DNA, 25 bp, Mus musculus
gggtctggtcttgcattattatacc

SEQ ID NO: 641017 - DNA, 25 bp, Mus musculus
gggtctggtctttgaccggcctctg

SEQ ID NO: 641018 - DNA, 25 bp, Mus musculus
gggtctggttacacttgagcttatt

SEQ ID NO: 641019 - DNA, 25 bp, Mus musculus
gggtctggttactcttgagcttatt

SEQ ID NO: 641020 - DNA, 25 bp, Mus musculus
gggtctggttctcatccatggagaa

SEQ ID NO: 641021 - DNA, 25 bp, Mus musculus
gggtctggttctgatccatggagaa

SEQ ID NO: 641022 - DNA, 25 bp, Mus musculus
gggtctgtacaaatgcatccttctg

SEQ ID NO: 641023 - DNA, 25 bp, Mus musculus
gggtctgtacaattgcatccttctg

SEQ ID NO: 641024 - DNA, 25 bp, Mus musculus
gggtctgtacctaacatcttttagt

SEQ ID NO: 641025 - DNA, 25 bp, Mus musculus
gggtctgtaccttacatcttttagt

SEQ ID NO: 641026 - DNA, 25 bp, Mus musculus
gggtctgtactgcaatgcctaaggt

SEQ ID NO: 641027 - DNA, 25 bp, Mus musculus
gggtctgtactggaatgcctaaggt

SEQ ID NO: 641028 - DNA, 25 bp, Mus musculus
gggtctgtagggagccttttcccag

SEQ ID NO: 641029 - DNA, 25 bp, Mus musculus
gggtctgtagggtgccttttcccag

SEQ ID NO: 641030 - DNA, 25 bp, Mus musculus
gggtctgtatatatatatgtggcat

SEQ ID NO: 641031 - DNA, 25 bp, Mus musculus
gggtctgtatatttatatgtggcat

SEQ ID NO: 641032 - DNA, 25 bp, Mus musculus
gggtctgtatcccagaatatctctt

SEQ ID NO: 641033 - DNA, 25 bp, Mus musculus
gggtctgtatccgagaatatctctt

SEQ ID NO: 641034 - DNA, 25 bp, Mus musculus
gggtctgtatctcacgtggtaacac

SEQ ID NO: 641035 - DNA, 25 bp, Mus musculus
gggtctgtatctgacgtggtaacac

SEQ ID NO: 641036 - DNA, 25 bp, Mus musculus
gggtctgtatgcctttatcttatca

SEQ ID NO: 641037 - DNA, 25 bp, Mus musculus
gggtctgtatgcgtttatcttatca

SEQ ID NO: 641038 - DNA, 25 bp, Mus musculus
gggtctgtatgtactgtcattatgt

SEQ ID NO: 641039 - DNA, 25 bp, Mus musculus
gggtctgtatgttctgtcattatgt

SEQ ID NO: 641040 - DNA, 25 bp, Mus musculus
gggtctgtatttagctcattagatg

SEQ ID NO: 641041 - DNA, 25 bp, Mus musculus
gggtctgtattttgctcattagatg

SEQ ID NO: 641042 - DNA, 25 bp, Mus musculus
gggtctgtcacaaaactgtaacttt

SEQ ID NO: 641043 - DNA, 25 bp, Mus musculus
gggtctgtcacataactgtaacttt

SEQ ID NO: 641044 - DNA, 25 bp, Mus musculus
gggtctgtcactcaggaaaacctaa

SEQ ID NO: 641045 - DNA, 25 bp, Mus musculus
gggtctgtcactgaggaaaacctaa

SEQ ID NO: 641046 - DNA, 25 bp, Mus musculus
gggtctgtcagtcttcatttgcgtc

SEQ ID NO: 641047 - DNA, 25 bp, Mus musculus
gggtctgtcagtgttcatttgcgtc

SEQ ID NO: 641048 - DNA, 25 bp, Mus musculus
gggtctgtcctcactgactctgcta

SEQ ID NO: 641049 - DNA, 25 bp, Mus musculus
gggtctgtcctctctgactctgcta

SEQ ID NO: 641050 - DNA, 25 bp, Mus musculus
gggtctgtcctgagtatgtttatca

SEQ ID NO: 641051 - DNA, 25 bp, Mus musculus
gggtctgtcctgtgtatgtttatca

SEQ ID NO: 641052 - DNA, 25 bp, Mus musculus
gggtctgtccttcctgttcctaggg

SEQ ID NO: 641053 - DNA, 25 bp, Mus musculus
gggtctgtccttgctgttcctaggg

SEQ ID NO: 641054 - DNA, 25 bp, Mus musculus
gggtctgtcgacaataacttttact

SEQ ID NO: 641055 - DNA, 25 bp, Mus musculus
gggtctgtcgactataacttttact

SEQ ID NO: 641056 - DNA, 25 bp, Mus musculus
gggtctgtctgaaatgaccacaggc

SEQ ID NO: 641057 - DNA, 25 bp, Mus musculus
gggtctgtctgaattgcaccttatc

SEQ ID NO: 641058 - DNA, 25 bp, Mus musculus
gggtctgtctgatatgaccacaggc

SEQ ID NO: 641059 - DNA, 25 bp, Mus musculus
gggtctgtctgatttgcaccttatc

SEQ ID NO: 641060 - DNA, 25 bp, Mus musculus
gggtctgtgaagagcatatgagcca

SEQ ID NO: 641061 - DNA, 25 bp, Mus musculus
gggtctgtgaagtgcatatgagcca

SEQ ID NO: 641062 - DNA, 25 bp, Mus musculus
gggtctgtgaccctattccatacac

SEQ ID NO: 641063 - DNA, 25 bp, Mus musculus
gggtctgtgaccgtattccatacac

SEQ ID NO: 641064 - DNA, 25 bp, Mus musculus
gggtctgtgactccctagtttgcct

SEQ ID NO: 641065 - DNA, 25 bp, Mus musculus
gggtctgtgactgcctagtttgcct

SEQ ID NO: 641066 - DNA, 25 bp, Mus musculus
gggtctgtggtcacactgcaagtga

SEQ ID NO: 641067 - DNA, 25 bp, Mus musculus
gggtctgtggtctcactgcaagtga

SEQ ID NO: 641068 - DNA, 25 bp, Mus musculus
gggtctgtggttagtgcatctaatt

SEQ ID NO: 641069 - DNA, 25 bp, Mus musculus
gggtctgtggtttgtgcatctaatt

SEQ ID NO: 641070 - DNA, 25 bp, Mus musculus
gggtctgtgtaaagttcatcatcca

SEQ ID NO: 641071 - DNA, 25 bp, Mus musculus
gggtctgtgtaatgttcatcatcca

SEQ ID NO: 641072 - DNA, 25 bp, Mus musculus
gggtctgttatgctattaatttttg

SEQ ID NO: 641073 - DNA, 25 bp, Mus musculus
gggtctgttatggtattaatttttg

SEQ ID NO: 641074 - DNA, 25 bp, Mus musculus
gggtctgttcatacactaggttcaa

SEQ ID NO: 641075 - DNA, 25 bp, Mus musculus
gggtctgttcattcactaggttcaa

SEQ ID NO: 641076 - DNA, 25 bp, Mus musculus
gggtctgttctgcatgtgagctctc

SEQ ID NO: 641077 - DNA, 25 bp, Mus musculus
gggtctgttctggatgtgagctctc

SEQ ID NO: 641078 - DNA, 25 bp, Mus musculus
gggtctgtttccattagcctagatc

SEQ ID NO: 641079 - DNA, 25 bp, Mus musculus
gggtctgtttcctttagcctagatc

SEQ ID NO: 641080 - DNA, 25 bp, Mus musculus
gggtcttaaactcttcaccacgtct

SEQ ID NO: 641081 - DNA, 25 bp, Mus musculus
gggtcttaaactgttcaccacgtct

SEQ ID NO: 641082 - DNA, 25 bp, Mus musculus
gggtcttaatctccttccagtatct

SEQ ID NO: 641083 - DNA, 25 bp, Mus musculus
gggtcttaatctgcttccagtatct

SEQ ID NO: 641084 - DNA, 25 bp, Mus musculus
gggtcttaatgccaagtcagcaggt

SEQ ID NO: 641085 - DNA, 25 bp, Mus musculus
gggtcttaatgcgaagtcagcaggt

SEQ ID NO: 641086 - DNA, 25 bp, Mus musculus
gggtcttaatgtccagctgttttaa

SEQ ID NO: 641087 - DNA, 25 bp, Mus musculus
gggtcttaatgtgcagctgttttaa

SEQ ID NO: 641088 - DNA, 25 bp, Mus musculus
gggtcttacactagttaggcaatca

SEQ ID NO: 641089 - DNA, 25 bp, Mus musculus
gggtcttacacttgttaggcaatca

SEQ ID NO: 641090 - DNA, 25 bp, Mus musculus
gggtcttacagacacacctgaggac

SEQ ID NO: 641091 - DNA, 25 bp, Mus musculus
gggtcttacagagacacctgaggac

SEQ ID NO: 641092 - DNA, 25 bp, Mus musculus
gggtcttacctactaggcaagcgtt

SEQ ID NO: 641093 - DNA, 25 bp, Mus musculus
gggtcttacctagtaggcaagcgtt

SEQ ID NO: 641094 - DNA, 25 bp, Mus musculus
gggtcttactaacttctaggctaat

SEQ ID NO: 641095 - DNA, 25 bp, Mus musculus
gggtcttactaagttctaggctaat

SEQ ID NO: 641096 - DNA, 25 bp, Mus musculus
gggtcttactacatacttctgttga

SEQ ID NO: 641097 - DNA, 25 bp, Mus musculus
gggtcttactacttacttctgttga

SEQ ID NO: 641098 - DNA, 25 bp, Mus musculus
gggtcttactatattactcaggctg

SEQ ID NO: 641099 - DNA, 25 bp, Mus musculus
gggtcttactatctggcctgggaac

SEQ ID NO: 641100 - DNA, 25 bp, Mus musculus
gggtcttactatgtggcctgggaac

SEQ ID NO: 641101 - DNA, 25 bp, Mus musculus
gggtcttactattttactcaggctg

SEQ ID NO: 641102 - DNA, 25 bp, Mus musculus
gggtcttactctctatacaaggttg

SEQ ID NO: 641103 - DNA, 25 bp, Mus musculus
gggtcttactctgtatacaaggttg

SEQ ID NO: 641104 - DNA, 25 bp, Mus musculus
gggtcttagagaacgaattctggtc

SEQ ID NO: 641105 - DNA, 25 bp, Mus musculus
gggtcttagagatcgaattctggtc

SEQ ID NO: 641106 - DNA, 25 bp, Mus musculus
gggtcttagccacgatttcattgct

SEQ ID NO: 641107 - DNA, 25 bp, Mus musculus
gggtcttagccaggatttcattgct

SEQ ID NO: 641108 - DNA, 25 bp, Mus musculus
gggtcttatctgatcatctgtagag

SEQ ID NO: 641109 - DNA, 25 bp, Mus musculus
gggtcttatctgttcatctgtagag

SEQ ID NO: 641110 - DNA, 25 bp, Mus musculus
gggtcttatcttagctgtttatttg

SEQ ID NO: 641111 - DNA, 25 bp, Mus musculus
gggtcttatctttgctgtttatttg

SEQ ID NO: 641112 - DNA, 25 bp, Mus musculus
gggtcttatggcacagatggcatcc

SEQ ID NO: 641113 - DNA, 25 bp, Mus musculus
gggtcttatggctcagatggcatcc

SEQ ID NO: 641114 - DNA, 25 bp, Mus musculus
gggtcttattatcaacctggaggac

SEQ ID NO: 641115 - DNA, 25 bp, Mus musculus
gggtcttattatgaacctggaggac

SEQ ID NO: 641116 - DNA, 25 bp, Mus musculus
gggtcttatttaccaccacgtggat

SEQ ID NO: 641117 - DNA, 25 bp, Mus musculus
gggtcttatttagcaccacgtggat

SEQ ID NO: 641118 - DNA, 25 bp, Mus musculus
gggtcttatttccaggtcaggagat

SEQ ID NO: 641119 - DNA, 25 bp, Mus musculus
gggtcttatttcgaggtcaggagat

SEQ ID NO: 641120 - DNA, 25 bp, Mus musculus
gggtcttcaaatagccactcgtctg

SEQ ID NO: 641121 - DNA, 25 bp, Mus musculus
gggtcttcaaattgccactcgtctg

SEQ ID NO: 641122 - DNA, 25 bp, Mus musculus
gggtcttcacgtccagcaggatctt

SEQ ID NO: 641123 - DNA, 25 bp, Mus musculus
gggtcttcacgtgcagcaggatctt

SEQ ID NO: 641124 - DNA, 25 bp, Mus musculus
gggtcttcaggcactttcccatcac

SEQ ID NO: 641125 - DNA, 25 bp, Mus musculus
gggtcttcaggccttactctcaggc

SEQ ID NO: 641126 - DNA, 25 bp, Mus musculus
gggtcttcaggcgttactctcaggc

SEQ ID NO: 641127 - DNA, 25 bp, Mus musculus
gggtcttcaggctctttcccatcac

SEQ ID NO: 641128 - DNA, 25 bp, Mus musculus
gggtcttcatccaagtgggagtcag

SEQ ID NO: 641129 - DNA, 25 bp, Mus musculus
gggtcttcatcctagtgggagtcag

SEQ ID NO: 641130 - DNA, 25 bp, Mus musculus
gggtcttccacgatgctgcataatg

SEQ ID NO: 641131 - DNA, 25 bp, Mus musculus
gggtcttccacgttgctgcataatg

SEQ ID NO: 641132 - DNA, 25 bp, Mus musculus
gggtcttccagccttgggagcaaac

SEQ ID NO: 641133 - DNA, 25 bp, Mus musculus
gggtcttccagcgttgggagcaaac

SEQ ID NO: 641134 - DNA, 25 bp, Mus musculus
gggtcttccctcagtagatgggtcc

SEQ ID NO: 641135 - DNA, 25 bp, Mus musculus
gggtcttccctctgtagatgggtcc

SEQ ID NO: 641136 - DNA, 25 bp, Mus musculus
gggtcttccgccctgagatgctcct

SEQ ID NO: 641137 - DNA, 25 bp, Mus musculus
gggtcttccgccgtgagatgctcct

SEQ ID NO: 641138 - DNA, 25 bp, Mus musculus
gggtcttcctaacaagggctcactg

SEQ ID NO: 641139 - DNA, 25 bp, Mus musculus
gggtcttcctaagaagggctcactg

SEQ ID NO: 641140 - DNA, 25 bp, Mus musculus
gggtcttccttaattagccagacta

SEQ ID NO: 641141 - DNA, 25 bp, Mus musculus
gggtcttccttatttagccagacta

SEQ ID NO: 641142 - DNA, 25 bp, Mus musculus
gggtcttcggatcggccttacagaa

SEQ ID NO: 641143 - DNA, 25 bp, Mus musculus
gggtcttcggatgggccttacagaa

SEQ ID NO: 641144 - DNA, 25 bp, Mus musculus
gggtcttcggttaaggttgctgaca

SEQ ID NO: 641145 - DNA, 25 bp, Mus musculus
gggtcttcggtttaggttgctgaca

SEQ ID NO: 641146 - DNA, 25 bp, Mus musculus
gggtcttcgtacagtagtaacactt

SEQ ID NO: 641147 - DNA, 25 bp, Mus musculus
gggtcttcgtactgtagtaacactt

SEQ ID NO: 641148 - DNA, 25 bp, Mus musculus
gggtcttctaagctggtttacatga

SEQ ID NO: 641149 - DNA, 25 bp, Mus musculus
gggtcttctaaggtggtttacatga

SEQ ID NO: 641150 - DNA, 25 bp, Mus musculus
gggtcttctcacctcttacacggtt

SEQ ID NO: 641151 - DNA, 25 bp, Mus musculus
gggtcttctcacgtcttacacggtt

SEQ ID NO: 641152 - DNA, 25 bp, Mus musculus
gggtcttctccaagaagcttgggaa

SEQ ID NO: 641153 - DNA, 25 bp, Mus musculus
gggtcttctccatgaagcttgggaa

SEQ ID NO: 641154 - DNA, 25 bp, Mus musculus
gggtcttctgccctagagtcccaaa

SEQ ID NO: 641155 - DNA, 25 bp, Mus musculus
gggtcttctgccgtagagtcccaaa

SEQ ID NO: 641156 - DNA, 25 bp, Mus musculus
gggtcttcttatcaccttcattgag

SEQ ID NO: 641157 - DNA, 25 bp, Mus musculus
gggtcttcttatgaccttcattgag

SEQ ID NO: 641158 - DNA, 25 bp, Mus musculus
gggtcttgaaaacccctctgtcgta

SEQ ID NO: 641159 - DNA, 25 bp, Mus musculus
gggtcttgaaaagccctctgtcgta

SEQ ID NO: 641160 - DNA, 25 bp, Mus musculus
gggtcttgacccacaaagccaggtt

SEQ ID NO: 641161 - DNA, 25 bp, Mus musculus
gggtcttgaccctcaaagccaggtt

SEQ ID NO: 641162 - DNA, 25 bp, Mus musculus
gggtcttgagatatccttatgccta

SEQ ID NO: 641163 - DNA, 25 bp, Mus musculus
gggtcttgagatttccttatgccta

SEQ ID NO: 641164 - DNA, 25 bp, Mus musculus
gggtcttgagttacaagcatgaagt

SEQ ID NO: 641165 - DNA, 25 bp, Mus musculus
gggtcttgagtttcaagcatgaagt

SEQ ID NO: 641166 - DNA, 25 bp, Mus musculus
gggtcttgatgcacttgttgccgct

SEQ ID NO: 641167 - DNA, 25 bp, Mus musculus
gggtcttgatgctcttgttgccgct

SEQ ID NO: 641168 - DNA, 25 bp, Mus musculus
gggtcttgcactcaactctttagta

SEQ ID NO: 641169 - DNA, 25 bp, Mus musculus
gggtcttgcactgaactctttagta

SEQ ID NO: 641170 - DNA, 25 bp, Mus musculus
gggtcttggaccctgctccgtcaga

SEQ ID NO: 641171 - DNA, 25 bp, Mus musculus
gggtcttggaccgtgctccgtcaga

SEQ ID NO: 641172 - DNA, 25 bp, Mus musculus
gggtcttggataccctgcaactgct

SEQ ID NO: 641173 - DNA, 25 bp, Mus musculus
gggtcttggatagcctgcaactgct

SEQ ID NO: 641174 - DNA, 25 bp, Mus musculus
gggtcttggatcacttagcaggctc

SEQ ID NO: 641175 - DNA, 25 bp, Mus musculus
gggtcttggatctcttagcaggctc

SEQ ID NO: 641176 - DNA, 25 bp, Mus musculus
gggtcttggattcccatcttaggga

SEQ ID NO: 641177 - DNA, 25 bp, Mus musculus
gggtcttggattgccatcttaggga

SEQ ID NO: 641178 - DNA, 25 bp, Mus musculus
gggtcttggccactgagtctagtca

SEQ ID NO: 641179 - DNA, 25 bp, Mus musculus
gggtcttggccagtgagtctagtca

SEQ ID NO: 641180 - DNA, 25 bp, Mus musculus
gggtcttggcctacaggaacacatg

SEQ ID NO: 641181 - DNA, 25 bp, Mus musculus
gggtcttggccttcaggaacacatg

SEQ ID NO: 641182 - DNA, 25 bp, Mus musculus
gggtcttggctgagaaactctctct

SEQ ID NO: 641183 - DNA, 25 bp, Mus musculus
gggtcttggctgtgaaactctctct

SEQ ID NO: 641184 - DNA, 25 bp, Mus musculus
gggtcttggtgaaagaacttagaac

SEQ ID NO: 641185 - DNA, 25 bp, Mus musculus
gggtcttggtgatagaacttagaac

SEQ ID NO: 641186 - DNA, 25 bp, Mus musculus
gggtcttgtcacatatgacagatta

SEQ ID NO: 641187 - DNA, 25 bp, Mus musculus
gggtcttgtcacttatgacagatta

SEQ ID NO: 641188 - DNA, 25 bp, Mus musculus
gggtcttgtcagaggcataatctct

SEQ ID NO: 641189 - DNA, 25 bp, Mus musculus
gggtcttgtcagtggcataatctct

SEQ ID NO: 641190 - DNA, 25 bp, Mus musculus
gggtcttgtctccaaatgcgattgc

SEQ ID NO: 641191 - DNA, 25 bp, Mus musculus
gggtcttgtctcgaaatgcgattgc

SEQ ID NO: 641192 - DNA, 25 bp, Mus musculus
gggtcttgtctgctcaaagcctcaa

SEQ ID NO: 641193 - DNA, 25 bp, Mus musculus
gggtcttgtctggtcaaagcctcaa

SEQ ID NO: 641194 - DNA, 25 bp, Mus musculus
gggtcttgtcttaacatcacttgta

SEQ ID NO: 641195 - DNA, 25 bp, Mus musculus
gggtcttgtctttacatcacttgta

SEQ ID NO: 641196 - DNA, 25 bp, Mus musculus
gggtcttgttcacagcacggaccgt

SEQ ID NO: 641197 - DNA, 25 bp, Mus musculus
gggtcttgttcagagcacggaccgt

SEQ ID NO: 641198 - DNA, 25 bp, Mus musculus
gggtcttgtttaatgtatcattcag

SEQ ID NO: 641199 - DNA, 25 bp, Mus musculus
gggtcttgtttattgtatcattcag

SEQ ID NO: 641200 - DNA, 25 bp, Mus musculus
gggtctttaacaaatcgcactttcc

SEQ ID NO: 641201 - DNA, 25 bp, Mus musculus
gggtctttaacatatcgcactttcc

SEQ ID NO: 641202 - DNA, 25 bp, Mus musculus
gggtctttacagaattgcttcaaat

SEQ ID NO: 641203 - DNA, 25 bp, Mus musculus
gggtctttacagtattgcttcaaat

SEQ ID NO: 641204 - DNA, 25 bp, Mus musculus
gggtctttaccacgtcagactcatt

SEQ ID NO: 641205 - DNA, 25 bp, Mus musculus
gggtctttaccaggtcagactcatt

SEQ ID NO: 641206 - DNA, 25 bp, Mus musculus
gggtctttacctagcaccttcttca

SEQ ID NO: 641207 - DNA, 25 bp, Mus musculus
gggtctttaccttgcaccttcttca

SEQ ID NO: 641208 - DNA, 25 bp, Mus musculus
gggtctttaggacatgtccccagat

SEQ ID NO: 641209 - DNA, 25 bp, Mus musculus
gggtctttaggacttgaacagatat

SEQ ID NO: 641210 - DNA, 25 bp, Mus musculus
gggtctttaggagatgtccccagat

SEQ ID NO: 641211 - DNA, 25 bp, Mus musculus
gggtctttaggagttgaacagatat

SEQ ID NO: 641212 - DNA, 25 bp, Mus musculus
gggtctttagtcatacatttgctcc

SEQ ID NO: 641213 - DNA, 25 bp, Mus musculus
gggtctttagtcttacatttgctcc

SEQ ID NO: 641214 - DNA, 25 bp, Mus musculus
gggtctttatatacccttgagacag

SEQ ID NO: 641215 - DNA, 25 bp, Mus musculus
gggtctttatattcccttgagacag

SEQ ID NO: 641216 - DNA, 25 bp, Mus musculus
gggtctttatccagtgtccaataga

SEQ ID NO: 641217 - DNA, 25 bp, Mus musculus
gggtctttatcctgtgtccaataga

SEQ ID NO: 641218 - DNA, 25 bp, Mus musculus
gggtctttcaagatccaatggactt

SEQ ID NO: 641219 - DNA, 25 bp, Mus musculus
gggtctttcaagttccaatggactt

SEQ ID NO: 641220 - DNA, 25 bp, Mus musculus
gggtctttcaccatgttgtaaatgt

SEQ ID NO: 641221 - DNA, 25 bp, Mus musculus
gggtctttcaccttgttgtaaatgt

SEQ ID NO: 641222 - DNA, 25 bp, Mus musculus
gggtctttcattctaggctcaataa

SEQ ID NO: 641223 - DNA, 25 bp, Mus musculus
gggtctttcattgtaggctcaataa

SEQ ID NO: 641224 - DNA, 25 bp, Mus musculus
gggtctttccatcccagttaactta

SEQ ID NO: 641225 - DNA, 25 bp, Mus musculus
gggtctttccatgccagttaactta

SEQ ID NO: 641226 - DNA, 25 bp, Mus musculus
gggtctttccctaggagctgatgtc

SEQ ID NO: 641227 - DNA, 25 bp, Mus musculus
gggtctttcccttggagctgatgtc

SEQ ID NO: 641228 - DNA, 25 bp, Mus musculus
gggtctttcctaagtgtactgccga

SEQ ID NO: 641229 - DNA, 25 bp, Mus musculus
gggtctttcctatgtgtactgccga

SEQ ID NO: 641230 - DNA, 25 bp, Mus musculus
gggtctttcctgaatcacagggcag

SEQ ID NO: 641231 - DNA, 25 bp, Mus musculus
gggtctttcctgtatcacagggcag

SEQ ID NO: 641232 - DNA, 25 bp, Mus musculus
gggtctttctatatagctttggccg

SEQ ID NO: 641233 - DNA, 25 bp, Mus musculus
gggtctttctatctggtatcttcca

SEQ ID NO: 641234 - DNA, 25 bp, Mus musculus
gggtctttctatgtggtatcttcca

SEQ ID NO: 641235 - DNA, 25 bp, Mus musculus
gggtctttctatttagctttggccg

SEQ ID NO: 641236 - DNA, 25 bp, Mus musculus
gggtctttcttgacacagggaagcc

SEQ ID NO: 641237 - DNA, 25 bp, Mus musculus
gggtctttcttgtcacagggaagcc

SEQ ID NO: 641238 - DNA, 25 bp, Mus musculus
gggtctttgtatcctctaggactgg

SEQ ID NO: 641239 - DNA, 25 bp, Mus musculus
gggtctttgtatgctctaggactgg

SEQ ID NO: 641240 - DNA, 25 bp, Mus musculus
gggtctttgtttagtcagcctttag

SEQ ID NO: 641241 - DNA, 25 bp, Mus musculus
gggtctttgttttgtcagcctttag

SEQ ID NO: 641242 - DNA, 25 bp, Mus musculus
gggtcttttgacaactgcatcttcc

SEQ ID NO: 641243 - DNA, 25 bp, Mus musculus
gggtcttttgacatgctcggtgtat

SEQ ID NO: 641244 - DNA, 25 bp, Mus musculus
gggtcttttgactactgcatcttcc

SEQ ID NO: 641245 - DNA, 25 bp, Mus musculus
gggtcttttgacttgctcggtgtat

SEQ ID NO: 641246 - DNA, 25 bp, Mus musculus
gggtcttttgtaatggccaactact

SEQ ID NO: 641247 - DNA, 25 bp, Mus musculus
gggtcttttgtattggccaactact

SEQ ID NO: 641248 - DNA, 25 bp, Mus musculus
gggtgaaaaatacatccgcagggtt

SEQ ID NO: 641249 - DNA, 25 bp, Mus musculus
gggtgaaaaatagatccgcagggtt

SEQ ID NO: 641250 - DNA, 25 bp, Mus musculus
gggtgaaaccagcagttaggcttca

SEQ ID NO: 641251 - DNA, 25 bp, Mus musculus
gggtgaaaccaggagttaggcttca

SEQ ID NO: 641252 - DNA, 25 bp, Mus musculus
gggtgaaacctaagttcatccatct

SEQ ID NO: 641253 - DNA, 25 bp, Mus musculus
gggtgaaacctatgttcatccatct

SEQ ID NO: 641254 - DNA, 25 bp, Mus musculus
gggtgaaactccattaatctgcctt

SEQ ID NO: 641255 - DNA, 25 bp, Mus musculus
gggtgaaactcctttaatctgcctt

SEQ ID NO: 641256 - DNA, 25 bp, Mus musculus
gggtgaaacttgaatccactcacac

SEQ ID NO: 641257 - DNA, 25 bp, Mus musculus
gggtgaaacttgtatccactcacac

SEQ ID NO: 641258 - DNA, 25 bp, Mus musculus
gggtgaaatgaccttgccgattcac

SEQ ID NO: 641259 - DNA, 25 bp, Mus musculus
gggtgaaatgacgttgccgattcac

SEQ ID NO: 641260 - DNA, 25 bp, Mus musculus
gggtgaaattggcaccattttgctt

SEQ ID NO: 641261 - DNA, 25 bp, Mus musculus
gggtgaaattgggaccattttgctt

SEQ ID NO: 641262 - DNA, 25 bp, Mus musculus
gggtgaacaacaactctggtattga

SEQ ID NO: 641263 - DNA, 25 bp, Mus musculus
gggtgaacaacatctctggtattga

SEQ ID NO: 641264 - DNA, 25 bp, Mus musculus
gggtgaacaccgaactgtttctgag

SEQ ID NO: 641265 - DNA, 25 bp, Mus musculus
gggtgaacaccgtactgtttctgag

SEQ ID NO: 641266 - DNA, 25 bp, Mus musculus
gggtgaacagctaccttcatgatga

SEQ ID NO: 641267 - DNA, 25 bp, Mus musculus
gggtgaacagcttccttcatgatga

SEQ ID NO: 641268 - DNA, 25 bp, Mus musculus
gggtgaacatctctagctagcatat

SEQ ID NO: 641269 - DNA, 25 bp, Mus musculus
gggtgaacatctgtagctagcatat

SEQ ID NO: 641270 - DNA, 25 bp, Mus musculus
gggtgaaccaagattcagccacaaa

SEQ ID NO: 641271 - DNA, 25 bp, Mus musculus
gggtgaaccaagtttcagccacaaa

SEQ ID NO: 641272 - DNA, 25 bp, Mus musculus
gggtgaacccacacacatctaataa

SEQ ID NO: 641273 - DNA, 25 bp, Mus musculus
gggtgaacccactcacatctaataa

SEQ ID NO: 641274 - DNA, 25 bp, Mus musculus
gggtgaacccttctgtggtctgtac

SEQ ID NO: 641275 - DNA, 25 bp, Mus musculus
gggtgaacccttgtgtggtctgtac

SEQ ID NO: 641276 - DNA, 25 bp, Mus musculus
gggtgaacctcacatgatttggcct

SEQ ID NO: 641277 - DNA, 25 bp, Mus musculus
gggtgaacctcagatgatttggcct

SEQ ID NO: 641278 - DNA, 25 bp, Mus musculus
gggtgaaccttcagaagttccacat

SEQ ID NO: 641279 - DNA, 25 bp, Mus musculus
gggtgaaccttctgaagttccacat

SEQ ID NO: 641280 - DNA, 25 bp, Mus musculus
gggtgaacggccaagtcggatccct

SEQ ID NO: 641281 - DNA, 25 bp, Mus musculus
gggtgaacggcctagtcggatccct

SEQ ID NO: 641282 - DNA, 25 bp, Mus musculus
gggtgaactgacactttttcttggc

SEQ ID NO: 641283 - DNA, 25 bp, Mus musculus
gggtgaactgactctttttcttggc

SEQ ID NO: 641284 - DNA, 25 bp, Mus musculus
gggtgaactttaacagattgtgaga

SEQ ID NO: 641285 - DNA, 25 bp, Mus musculus
gggtgaactttatcagattgtgaga

SEQ ID NO: 641286 - DNA, 25 bp, Mus musculus
gggtgaagatgacccaccttcccat

SEQ ID NO: 641287 - DNA, 25 bp, Mus musculus
gggtgaagatgagccaccttcccat

SEQ ID NO: 641288 - DNA, 25 bp, Mus musculus
gggtgaagcaatatggccgccccac

SEQ ID NO: 641289 - DNA, 25 bp, Mus musculus
gggtgaagcaatttggccgccccac

SEQ ID NO: 641290 - DNA, 25 bp, Mus musculus
gggtgaagcactagctacacagccc

SEQ ID NO: 641291 - DNA, 25 bp, Mus musculus
gggtgaagcacttgctacacagccc

SEQ ID NO: 641292 - DNA, 25 bp, Mus musculus
gggtgaagcgagacctgcctatcga

SEQ ID NO: 641293 - DNA, 25 bp, Mus musculus
gggtgaagcgagtcctgcctatcga

SEQ ID NO: 641294 - DNA, 25 bp, Mus musculus
gggtgaagctctcaaaggctctcct

SEQ ID NO: 641295 - DNA, 25 bp, Mus musculus
gggtgaagctctgaaaggctctcct

SEQ ID NO: 641296 - DNA, 25 bp, Mus musculus
gggtgaagctgcatacatctgttca

SEQ ID NO: 641297 - DNA, 25 bp, Mus musculus
gggtgaagctgcttacatctgttca

SEQ ID NO: 641298 - DNA, 25 bp, Mus musculus
gggtgaaggcgcacctcacctcgga

SEQ ID NO: 641299 - DNA, 25 bp, Mus musculus
gggtgaaggcgctcctcacctcgga

SEQ ID NO: 641300 - DNA, 25 bp, Mus musculus
gggtgaagtcctcatgccagttcat

SEQ ID NO: 641301 - DNA, 25 bp, Mus musculus
gggtgaagtcctgatgccagttcat

SEQ ID NO: 641302 - DNA, 25 bp, Mus musculus
gggtgaagtcttcttgttccataga

SEQ ID NO: 641303 - DNA, 25 bp, Mus musculus
gggtgaagtcttgttgttccataga

SEQ ID NO: 641304 - DNA, 25 bp, Mus musculus
gggtgaagtgttccccaaagactca

SEQ ID NO: 641305 - DNA, 25 bp, Mus musculus
gggtgaagtgttgcccaaagactca

SEQ ID NO: 641306 - DNA, 25 bp, Mus musculus
gggtgaatagtaccattgttcttat

SEQ ID NO: 641307 - DNA, 25 bp, Mus musculus
gggtgaatagtagcattgttcttat

SEQ ID NO: 641308 - DNA, 25 bp, Mus musculus
gggtgaatatcacactcgtcaaaga

SEQ ID NO: 641309 - DNA, 25 bp, Mus musculus
gggtgaatatcagactcgtcaaaga

SEQ ID NO: 641310 - DNA, 25 bp, Mus musculus
gggtgaatcacaactactataactc

SEQ ID NO: 641311 - DNA, 25 bp, Mus musculus
gggtgaatcacatctactataactc

SEQ ID NO: 641312 - DNA, 25 bp, Mus musculus
gggtgaatccatcggtacaagcaat

SEQ ID NO: 641313 - DNA, 25 bp, Mus musculus
gggtgaatccatgggtacaagcaat

SEQ ID NO: 641314 - DNA, 25 bp, Mus musculus
gggtgaatcttccagtagacaatca

SEQ ID NO: 641315 - DNA, 25 bp, Mus musculus
gggtgaatcttcgagtagacaatca

SEQ ID NO: 641316 - DNA, 25 bp, Mus musculus
gggtgaatgccaactggaccgacca

SEQ ID NO: 641317 - DNA, 25 bp, Mus musculus
gggtgaatgccaatgagtttgtccc

SEQ ID NO: 641318 - DNA, 25 bp, Mus musculus
gggtgaatgccatctggaccgacca

SEQ ID NO: 641319 - DNA, 25 bp, Mus musculus
gggtgaatgccattgagtttgtccc

SEQ ID NO: 641320 - DNA, 25 bp, Mus musculus
gggtgaatgcccaagagacaaatgc

SEQ ID NO: 641321 - DNA, 25 bp, Mus musculus
gggtgaatgccctagagacaaatgc

SEQ ID NO: 641322 - DNA, 25 bp, Mus musculus
gggtgaatgctgcagactgcacaca

SEQ ID NO: 641323 - DNA, 25 bp, Mus musculus
gggtgaatgctggagactgcacaca

SEQ ID NO: 641324 - DNA, 25 bp, Mus musculus
gggtgaattcccatctctaatgtca

SEQ ID NO: 641325 - DNA, 25 bp, Mus musculus
gggtgaattcccttctctaatgtca

SEQ ID NO: 641326 - DNA, 25 bp, Mus musculus
gggtgaattgtcctctattgcagat

SEQ ID NO: 641327 - DNA, 25 bp, Mus musculus
gggtgaattgtcgtctattgcagat

SEQ ID NO: 641328 - DNA, 25 bp, Mus musculus
gggtgaatttgaatgtctatcctaa

SEQ ID NO: 641329 - DNA, 25 bp, Mus musculus
gggtgaatttgattgtctatcctaa

SEQ ID NO: 641330 - DNA, 25 bp, Mus musculus
gggtgacaacatatgctgctacagc

SEQ ID NO: 641331 - DNA, 25 bp, Mus musculus
gggtgacaacatttgctgctacagc

SEQ ID NO: 641332 - DNA, 25 bp, Mus musculus
gggtgacaactgagacttacttttg

SEQ ID NO: 641333 - DNA, 25 bp, Mus musculus
gggtgacaactgtgacttacttttg

SEQ ID NO: 641334 - DNA, 25 bp, Mus musculus
gggtgacaagccacacttctgctgc

SEQ ID NO: 641335 - DNA, 25 bp, Mus musculus
gggtgacaagcctcacttctgctgc

SEQ ID NO: 641336 - DNA, 25 bp, Mus musculus
gggtgacacctccattcagaaggaa

SEQ ID NO: 641337 - DNA, 25 bp, Mus musculus
gggtgacacctcgattcagaaggaa

SEQ ID NO: 641338 - DNA, 25 bp, Mus musculus
gggtgacacgctcggatctatacca

SEQ ID NO: 641339 - DNA, 25 bp, Mus musculus
gggtgacacgctgggatctatacca

SEQ ID NO: 641340 - DNA, 25 bp, Mus musculus
gggtgacactaactctccactcaga

SEQ ID NO: 641341 - DNA, 25 bp, Mus musculus
gggtgacactaagtctccactcaga

SEQ ID NO: 641342 - DNA, 25 bp, Mus musculus
gggtgacactgcacacaacaaaaac

SEQ ID NO: 641343 - DNA, 25 bp, Mus musculus
gggtgacactgctcacaacaaaaac

SEQ ID NO: 641344 - DNA, 25 bp, Mus musculus
gggtgacagtccagtccagaatcct

SEQ ID NO: 641345 - DNA, 25 bp, Mus musculus
gggtgacagtccatacgaggatcct

SEQ ID NO: 641346 - DNA, 25 bp, Mus musculus
gggtgacagtcctgtccagaatcct

SEQ ID NO: 641347 - DNA, 25 bp, Mus musculus
gggtgacagtccttacgaggatcct

SEQ ID NO: 641348 - DNA, 25 bp, Mus musculus
gggtgacagtgtaatagcatcgcct

SEQ ID NO: 641349 - DNA, 25 bp, Mus musculus
gggtgacagtgttatagcatcgcct

SEQ ID NO: 641350 - DNA, 25 bp, Mus musculus
gggtgacagttgctcctccaaaggt

SEQ ID NO: 641351 - DNA, 25 bp, Mus musculus
gggtgacagttggtcctccaaaggt

SEQ ID NO: 641352 - DNA, 25 bp, Mus musculus
gggtgacatagcattccccactgtg

SEQ ID NO: 641353 - DNA, 25 bp, Mus musculus
gggtgacatagctttccccactgtg

SEQ ID NO: 641354 - DNA, 25 bp, Mus musculus
gggtgacatattacaacaagccaga

SEQ ID NO: 641355 - DNA, 25 bp, Mus musculus
gggtgacatatttcaacaagccaga

SEQ ID NO: 641356 - DNA, 25 bp, Mus musculus
gggtgacatcataacatgcttccag

SEQ ID NO: 641357 - DNA, 25 bp, Mus musculus
gggtgacatcatagcacctctggga

SEQ ID NO: 641358 - DNA, 25 bp, Mus musculus
gggtgacatcattacatgcttccag

SEQ ID NO: 641359 - DNA, 25 bp, Mus musculus
gggtgacatcattgcacctctggga

SEQ ID NO: 641360 - DNA, 25 bp, Mus musculus
gggtgacatcgaacacatgactgaa

SEQ ID NO: 641361 - DNA, 25 bp, Mus musculus
gggtgacatcgatcacatgactgaa

SEQ ID NO: 641362 - DNA, 25 bp, Mus musculus
gggtgacatgctactaatcaccttt

SEQ ID NO: 641363 - DNA, 25 bp, Mus musculus
gggtgacatgcttctaatcaccttt

SEQ ID NO: 641364 - DNA, 25 bp, Mus musculus
gggtgacatgttaagctcactaact

SEQ ID NO: 641365 - DNA, 25 bp, Mus musculus
gggtgacatgtttagctcactaact

SEQ ID NO: 641366 - DNA, 25 bp, Mus musculus
gggtgacattatccttagactactt

SEQ ID NO: 641367 - DNA, 25 bp, Mus musculus
gggtgacattatgcttagactactt

SEQ ID NO: 641368 - DNA, 25 bp, Mus musculus
gggtgacattttaccaggcctagaa

SEQ ID NO: 641369 - DNA, 25 bp, Mus musculus
gggtgacatttttccaggcctagaa

SEQ ID NO: 641370 - DNA, 25 bp, Mus musculus
gggtgaccaagcctctatactgaaa

SEQ ID NO: 641371 - DNA, 25 bp, Mus musculus
gggtgaccaagcgtctatactgaaa

SEQ ID NO: 641372 - DNA, 25 bp, Mus musculus
gggtgaccacagatcttagtgtact

SEQ ID NO: 641373 - DNA, 25 bp, Mus musculus
gggtgaccacagttcttagtgtact

SEQ ID NO: 641374 - DNA, 25 bp, Mus musculus
gggtgaccactgatatccaggtgaa

SEQ ID NO: 641375 - DNA, 25 bp, Mus musculus
gggtgaccactgttatccaggtgaa

SEQ ID NO: 641376 - DNA, 25 bp, Mus musculus
gggtgaccagaactttccattacac

SEQ ID NO: 641377 - DNA, 25 bp, Mus musculus
gggtgaccagaagtttccattacac

SEQ ID NO: 641378 - DNA, 25 bp, Mus musculus
gggtgaccagcaaagtcccagtgcc

SEQ ID NO: 641379 - DNA, 25 bp, Mus musculus
gggtgaccagcatagtcccagtgcc

SEQ ID NO: 641380 - DNA, 25 bp, Mus musculus
gggtgaccagtacacagatgacttc

SEQ ID NO: 641381 - DNA, 25 bp, Mus musculus
gggtgaccagtagacagatgacttc

SEQ ID NO: 641382 - DNA, 25 bp, Mus musculus
gggtgaccatgtacatcgattcatt

SEQ ID NO: 641383 - DNA, 25 bp, Mus musculus
gggtgaccatgttcatcgattcatt

SEQ ID NO: 641384 - DNA, 25 bp, Mus musculus
gggtgacccacacacattgtattta

SEQ ID NO: 641385 - DNA, 25 bp, Mus musculus
gggtgacccacagacattgtattta

SEQ ID NO: 641386 - DNA, 25 bp, Mus musculus
gggtgacccagtctgagattgtctt

SEQ ID NO: 641387 - DNA, 25 bp, Mus musculus
gggtgacccagtgtgagattgtctt

SEQ ID NO: 641388 - DNA, 25 bp, Mus musculus
gggtgaccccacaatttgtcttatc

SEQ ID NO: 641389 - DNA, 25 bp, Mus musculus
gggtgaccccactatttgtcttatc

SEQ ID NO: 641390 - DNA, 25 bp, Mus musculus
gggtgaccgaggcatcttagcttaa

SEQ ID NO: 641391 - DNA, 25 bp, Mus musculus
gggtgaccgagggatcttagcttaa

SEQ ID NO: 641392 - DNA, 25 bp, Mus musculus
gggtgaccggcaagtcatgagacag

SEQ ID NO: 641393 - DNA, 25 bp, Mus musculus
gggtgaccggcatgtcatgagacag

SEQ ID NO: 641394 - DNA, 25 bp, Mus musculus
gggtgacctatgagaagcatcttca

SEQ ID NO: 641395 - DNA, 25 bp, Mus musculus
gggtgacctatgtgaagcatcttca

SEQ ID NO: 641396 - DNA, 25 bp, Mus musculus
gggtgacctcggagcctcaagagat

SEQ ID NO: 641397 - DNA, 25 bp, Mus musculus
gggtgacctcggtgcctcaagagat

SEQ ID NO: 641398 - DNA, 25 bp, Mus musculus
gggtgacctgccattcactgtgagt

SEQ ID NO: 641399 - DNA, 25 bp, Mus musculus
gggtgacctgcctttcactgtgagt

SEQ ID NO: 641400 - DNA, 25 bp, Mus musculus
gggtgacctggacttacggcttcca

SEQ ID NO: 641401 - DNA, 25 bp, Mus musculus
gggtgacctggagttacggcttcca

SEQ ID NO: 641402 - DNA, 25 bp, Mus musculus
gggtgacctggcctggcccaggacc

SEQ ID NO: 641403 - DNA, 25 bp, Mus musculus
gggtgacctggcgtggcccaggacc

SEQ ID NO: 641404 - DNA, 25 bp, Mus musculus
gggtgacctttgaaattcatatata

SEQ ID NO: 641405 - DNA, 25 bp, Mus musculus
gggtgacctttgtaattcatatata

SEQ ID NO: 641406 - DNA, 25 bp, Mus musculus
gggtgactaccacattgatgtctgt

SEQ ID NO: 641407 - DNA, 25 bp, Mus musculus
gggtgactaccagattgatgtctgt

SEQ ID NO: 641408 - DNA, 25 bp, Mus musculus
gggtgactagagcttcagttttgtt

SEQ ID NO: 641409 - DNA, 25 bp, Mus musculus
gggtgactagaggttcagttttgtt

SEQ ID NO: 641410 - DNA, 25 bp, Mus musculus
gggtgactatctccagcccaagtac

SEQ ID NO: 641411 - DNA, 25 bp, Mus musculus
gggtgactatctgcagcccaagtac

SEQ ID NO: 641412 - DNA, 25 bp, Mus musculus
gggtgactatgtaccccaggagaac

SEQ ID NO: 641413 - DNA, 25 bp, Mus musculus
gggtgactatgttccccaggagaac

SEQ ID NO: 641414 - DNA, 25 bp, Mus musculus
gggtgactccccaggagtgacagaa

SEQ ID NO: 641415 - DNA, 25 bp, Mus musculus
gggtgactcccctggagtgacagaa

SEQ ID NO: 641416 - DNA, 25 bp, Mus musculus
gggtgactcctgaagcgctgacaag

SEQ ID NO: 641417 - DNA, 25 bp, Mus musculus
gggtgactcctgctggacctacctg

SEQ ID NO: 641418 - DNA, 25 bp, Mus musculus
gggtgactcctggtggacctacctg

SEQ ID NO: 641419 - DNA, 25 bp, Mus musculus
gggtgactcctgtagcgctgacaag

SEQ ID NO: 641420 - DNA, 25 bp, Mus musculus
gggtgactccttagggtgtttcatt

SEQ ID NO: 641421 - DNA, 25 bp, Mus musculus
gggtgactcctttgggtgtttcatt

SEQ ID NO: 641422 - DNA, 25 bp, Mus musculus
gggtgactcggcagtacaaggatca

SEQ ID NO: 641423 - DNA, 25 bp, Mus musculus
gggtgactcggctgtacaaggatca

SEQ ID NO: 641424 - DNA, 25 bp, Mus musculus
gggtgactgaatactcaagtgcctt

SEQ ID NO: 641425 - DNA, 25 bp, Mus musculus
gggtgactgaattctcaagtgcctt

SEQ ID NO: 641426 - DNA, 25 bp, Mus musculus
gggtgactgagtcagcactccagat

SEQ ID NO: 641427 - DNA, 25 bp, Mus musculus
gggtgactgagtgagcactccagat

SEQ ID NO: 641428 - DNA, 25 bp, Mus musculus
gggtgactgatacgattgtcaaact

SEQ ID NO: 641429 - DNA, 25 bp, Mus musculus
gggtgactgataggattgtcaaact

SEQ ID NO: 641430 - DNA, 25 bp, Mus musculus
gggtgactgtcccacgcttgacact

SEQ ID NO: 641431 - DNA, 25 bp, Mus musculus
gggtgactgtccgacgcttgacact

SEQ ID NO: 641432 - DNA, 25 bp, Mus musculus
gggtgacttcacaatgctgcgacgg

SEQ ID NO: 641433 - DNA, 25 bp, Mus musculus
gggtgacttcactatgctgcgacgg

SEQ ID NO: 641434 - DNA, 25 bp, Mus musculus
gggtgacttctgattagttgtgtaa

SEQ ID NO: 641435 - DNA, 25 bp, Mus musculus
gggtgacttctgtttagttgtgtaa

SEQ ID NO: 641436 - DNA, 25 bp, Mus musculus
gggtgacttggtaattactatcctt

SEQ ID NO: 641437 - DNA, 25 bp, Mus musculus
gggtgacttggttattactatcctt

SEQ ID NO: 641438 - DNA, 25 bp, Mus musculus
gggtgacttgtaagctcagaaaaac

SEQ ID NO: 641439 - DNA, 25 bp, Mus musculus
gggtgacttgtatgctcagaaaaac

SEQ ID NO: 641440 - DNA, 25 bp, Mus musculus
gggtgactttcaaaggcgtccatct

SEQ ID NO: 641441 - DNA, 25 bp, Mus musculus
gggtgactttcataggcgtccatct

SEQ ID NO: 641442 - DNA, 25 bp, Mus musculus
gggtgactttcccatatcactgcat

SEQ ID NO: 641443 - DNA, 25 bp, Mus musculus
gggtgactttccgatatcactgcat

SEQ ID NO: 641444 - DNA, 25 bp, Mus musculus
gggtgacttttgacatacgttgaca

SEQ ID NO: 641445 - DNA, 25 bp, Mus musculus
gggtgacttttgtcatacgttgaca

SEQ ID NO: 641446 - DNA, 25 bp, Mus musculus
gggtgactttttacttatcctgatt

SEQ ID NO: 641447 - DNA, 25 bp, Mus musculus
gggtgacttttttcttatcctgatt

SEQ ID NO: 641448 - DNA, 25 bp, Mus musculus
gggtgagaacagactttctggtttc

SEQ ID NO: 641449 - DNA, 25 bp, Mus musculus
gggtgagaacagtctttctggtttc

SEQ ID NO: 641450 - DNA, 25 bp, Mus musculus
gggtgagaagttaccattccctatg

SEQ ID NO: 641451 - DNA, 25 bp, Mus musculus
gggtgagaagtttccattccctatg

SEQ ID NO: 641452 - DNA, 25 bp, Mus musculus
gggtgagaatgccactaactcccca

SEQ ID NO: 641453 - DNA, 25 bp, Mus musculus
gggtgagaatgcgactaactcccca

SEQ ID NO: 641454 - DNA, 25 bp, Mus musculus
gggtgagacccacaaatccgtgcta

SEQ ID NO: 641455 - DNA, 25 bp, Mus musculus
gggtgagacccagaaatccgtgcta

SEQ ID NO: 641456 - DNA, 25 bp, Mus musculus
gggtgagaccctccagctcaaaaat

SEQ ID NO: 641457 - DNA, 25 bp, Mus musculus
gggtgagaccctgcagctcaaaaat

SEQ ID NO: 641458 - DNA, 25 bp, Mus musculus
gggtgagagaccatgtggccactta

SEQ ID NO: 641459 - DNA, 25 bp, Mus musculus
gggtgagagaccttgtggccactta

SEQ ID NO: 641460 - DNA, 25 bp, Mus musculus
gggtgagaggaaccgccacactcat

SEQ ID NO: 641461 - DNA, 25 bp, Mus musculus
gggtgagaggaagcgccacactcat

SEQ ID NO: 641462 - DNA, 25 bp, Mus musculus
gggtgagatatcatccctacctgaa

SEQ ID NO: 641463 - DNA, 25 bp, Mus musculus
gggtgagatatcttccctacctgaa

SEQ ID NO: 641464 - DNA, 25 bp, Mus musculus
gggtgagatcttaggcagtttatat

SEQ ID NO: 641465 - DNA, 25 bp, Mus musculus
gggtgagatctttggcagtttatat

SEQ ID NO: 641466 - DNA, 25 bp, Mus musculus
gggtgagcactaaacctgtggtttt

SEQ ID NO: 641467 - DNA, 25 bp, Mus musculus
gggtgagcactatacctgtggtttt

SEQ ID NO: 641468 - DNA, 25 bp, Mus musculus
gggtgagcagggacgatcacactcc

SEQ ID NO: 641469 - DNA, 25 bp, Mus musculus
gggtgagcagggtcgatcacactcc

SEQ ID NO: 641470 - DNA, 25 bp, Mus musculus
gggtgagcatcaaatccaccacatg

SEQ ID NO: 641471 - DNA, 25 bp, Mus musculus
gggtgagcatcatatccaccacatg

SEQ ID NO: 641472 - DNA, 25 bp, Mus musculus
gggtgagcatctagtcggctgcccc

SEQ ID NO: 641473 - DNA, 25 bp, Mus musculus
gggtgagcatcttgtcggctgcccc

SEQ ID NO: 641474 - DNA, 25 bp, Mus musculus
gggtgagcatgcatctagaatctgt

SEQ ID NO: 641475 - DNA, 25 bp, Mus musculus
gggtgagcatgcttctagaatctgt

SEQ ID NO: 641476 - DNA, 25 bp, Mus musculus
gggtgagccaagatctgctaagact

SEQ ID NO: 641477 - DNA, 25 bp, Mus musculus
gggtgagccaagttctgctaagact

SEQ ID NO: 641478 - DNA, 25 bp, Mus musculus
gggtgagccacacctgtacgagact

SEQ ID NO: 641479 - DNA, 25 bp, Mus musculus
gggtgagccacagctgtacgagact

SEQ ID NO: 641480 - DNA, 25 bp, Mus musculus
gggtgagccatacactcagattctg

SEQ ID NO: 641481 - DNA, 25 bp, Mus musculus
gggtgagccatagactcagattctg

SEQ ID NO: 641482 - DNA, 25 bp, Mus musculus
gggtgagcccagagagttccagcaa

SEQ ID NO: 641483 - DNA, 25 bp, Mus musculus
gggtgagcccagtgagttccagcaa

SEQ ID NO: 641484 - DNA, 25 bp, Mus musculus
gggtgagccccaagtacacaggtca

SEQ ID NO: 641485 - DNA, 25 bp, Mus musculus
gggtgagccccatgtacacaggtca

SEQ ID NO: 641486 - DNA, 25 bp, Mus musculus
gggtgagccctgacatttcaattga

SEQ ID NO: 641487 - DNA, 25 bp, Mus musculus
gggtgagccctgtcatttcaattga

SEQ ID NO: 641488 - DNA, 25 bp, Mus musculus
gggtgagcctgaactgaaccaatca

SEQ ID NO: 641489 - DNA, 25 bp, Mus musculus
gggtgagcctgatctgaaccaatca

SEQ ID NO: 641490 - DNA, 25 bp, Mus musculus
gggtgagctcagagttcccacggat

SEQ ID NO: 641491 - DNA, 25 bp, Mus musculus
gggtgagctcagtgttcccacggat

SEQ ID NO: 641492 - DNA, 25 bp, Mus musculus
gggtgagctgttacaaaagtcatat

SEQ ID NO: 641493 - DNA, 25 bp, Mus musculus
gggtgagctgtttcaaaagtcatat

SEQ ID NO: 641494 - DNA, 25 bp, Mus musculus
gggtgagctttaatcccctcagctg

SEQ ID NO: 641495 - DNA, 25 bp, Mus musculus
gggtgagctttattcccctcagctg

SEQ ID NO: 641496 - DNA, 25 bp, Mus musculus
gggtgaggaacaacacctcttccta

SEQ ID NO: 641497 - DNA, 25 bp, Mus musculus
gggtgaggaacatcacctcttccta

SEQ ID NO: 641498 - DNA, 25 bp, Mus musculus
gggtgaggaataataactttccatg

SEQ ID NO: 641499 - DNA, 25 bp, Mus musculus
gggtgaggaatattaactttccatg

SEQ ID NO: 641500 - DNA, 25 bp, Mus musculus
gggtgaggctctatcatttgaattt

SEQ ID NO: 641501 - DNA, 25 bp, Mus musculus
gggtgaggctctttcatttgaattt

SEQ ID NO: 641502 - DNA, 25 bp, Mus musculus
gggtgaggtgacagttaccattctt

SEQ ID NO: 641503 - DNA, 25 bp, Mus musculus
gggtgaggtgactgttaccattctt

SEQ ID NO: 641504 - DNA, 25 bp, Mus musculus
gggtgaggtgatctttaatcccctt

SEQ ID NO: 641505 - DNA, 25 bp, Mus musculus
gggtgaggtgatgtttaatcccctt

SEQ ID NO: 641506 - DNA, 25 bp, Mus musculus
gggtgaggtggcactttgcctttaa

SEQ ID NO: 641507 - DNA, 25 bp, Mus musculus
gggtgaggtggctctttgcctttaa

SEQ ID NO: 641508 - DNA, 25 bp, Mus musculus
gggtgagtatctcctgcttaggcca

SEQ ID NO: 641509 - DNA, 25 bp, Mus musculus
gggtgagtatctgctgcttaggcca

SEQ ID NO: 641510 - DNA, 25 bp, Mus musculus
gggtgagtcactccatgttagcatc

SEQ ID NO: 641511 - DNA, 25 bp, Mus musculus
gggtgagtcactgcatgttagcatc

SEQ ID NO: 641512 - DNA, 25 bp, Mus musculus
gggtgagtctgtaatcatcttctat

SEQ ID NO: 641513 - DNA, 25 bp, Mus musculus
gggtgagtctgttatcatcttctat

SEQ ID NO: 641514 - DNA, 25 bp, Mus musculus
gggtgagtgcagaccaagggccttt

SEQ ID NO: 641515 - DNA, 25 bp, Mus musculus
gggtgagtgcagtccaagggccttt

SEQ ID NO: 641516 - DNA, 25 bp, Mus musculus
gggtgagtgcatcaagcttttccaa

SEQ ID NO: 641517 - DNA, 25 bp, Mus musculus
gggtgagtgcatgaagcttttccaa

SEQ ID NO: 641518 - DNA, 25 bp, Mus musculus
gggtgagtgtgaccaatacctccct

SEQ ID NO: 641519 - DNA, 25 bp, Mus musculus
gggtgagtgtgagcaatacctccct

SEQ ID NO: 641520 - DNA, 25 bp, Mus musculus
gggtgagtttctctgaacttactga

SEQ ID NO: 641521 - DNA, 25 bp, Mus musculus
gggtgagtttctgtgaacttactga

SEQ ID NO: 641522 - DNA, 25 bp, Mus musculus
gggtgataaaatacagattggctcc

SEQ ID NO: 641523 - DNA, 25 bp, Mus musculus
gggtgataaaattcagattggctcc

SEQ ID NO: 641524 - DNA, 25 bp, Mus musculus
gggtgataaattataatcttcattg

SEQ ID NO: 641525 - DNA, 25 bp, Mus musculus
gggtgataaattttaatcttcattg

SEQ ID NO: 641526 - DNA, 25 bp, Mus musculus
gggtgatacaatactattttaatca

SEQ ID NO: 641527 - DNA, 25 bp, Mus musculus
gggtgatacaattctattttaatca

SEQ ID NO: 641528 - DNA, 25 bp, Mus musculus
gggtgatacacaagcaagcttctga

SEQ ID NO: 641529 - DNA, 25 bp, Mus musculus
gggtgatacacatgcaagcttctga

SEQ ID NO: 641530 - DNA, 25 bp, Mus musculus
gggtgatacagcactttctgtgcat

SEQ ID NO: 641531 - DNA, 25 bp, Mus musculus
gggtgatacagctctttctgtgcat

SEQ ID NO: 641532 - DNA, 25 bp, Mus musculus
gggtgatacctgctttcaagaacat

SEQ ID NO: 641533 - DNA, 25 bp, Mus musculus
gggtgatacctggtttcaagaacat

SEQ ID NO: 641534 - DNA, 25 bp, Mus musculus
gggtgataggaaccgcaactcgcct

SEQ ID NO: 641535 - DNA, 25 bp, Mus musculus
gggtgataggaagcgcaactcgcct

SEQ ID NO: 641536 - DNA, 25 bp, Mus musculus
gggtgatagttccatgatcagttat

SEQ ID NO: 641537 - DNA, 25 bp, Mus musculus
gggtgatagttccttcttattctaa

SEQ ID NO: 641538 - DNA, 25 bp, Mus musculus
gggtgatagttcgatgatcagttat

SEQ ID NO: 641539 - DNA, 25 bp, Mus musculus
gggtgatagttcgttcttattctaa

SEQ ID NO: 641540 - DNA, 25 bp, Mus musculus
gggtgatataatctaatggcttcta

SEQ ID NO: 641541 - DNA, 25 bp, Mus musculus
gggtgatataatgtaatggcttcta

SEQ ID NO: 641542 - DNA, 25 bp, Mus musculus
gggtgatatacgagcctttaacaga

SEQ ID NO: 641543 - DNA, 25 bp, Mus musculus
gggtgatatacgtgcctttaacaga

SEQ ID NO: 641544 - DNA, 25 bp, Mus musculus
gggtgatatgatcctaaactcttat

SEQ ID NO: 641545 - DNA, 25 bp, Mus musculus
gggtgatatgatgctaaactcttat

SEQ ID NO: 641546 - DNA, 25 bp, Mus musculus
gggtgatcaagcagtaccccaggac

SEQ ID NO: 641547 - DNA, 25 bp, Mus musculus
gggtgatcaagctgtaccccaggac

SEQ ID NO: 641548 - DNA, 25 bp, Mus musculus
gggtgatcacccaaggagttaaaca

SEQ ID NO: 641549 - DNA, 25 bp, Mus musculus
gggtgatcaccctaggagttaaaca

SEQ ID NO: 641550 - DNA, 25 bp, Mus musculus
gggtgatcatcgagattctagttac

SEQ ID NO: 641551 - DNA, 25 bp, Mus musculus
gggtgatcatcgtgattctagttac

SEQ ID NO: 641552 - DNA, 25 bp, Mus musculus
gggtgatccaacctatgtgaacata

SEQ ID NO: 641553 - DNA, 25 bp, Mus musculus
gggtgatccaacgtatgtgaacata

SEQ ID NO: 641554 - DNA, 25 bp, Mus musculus
gggtgatcccaaccttctagatgga

SEQ ID NO: 641555 - DNA, 25 bp, Mus musculus
gggtgatcccaagcttctagatgga

SEQ ID NO: 641556 - DNA, 25 bp, Mus musculus
gggtgatcttggaaggttcctattg

SEQ ID NO: 641557 - DNA, 25 bp, Mus musculus
gggtgatcttggtaggttcctattg

SEQ ID NO: 641558 - DNA, 25 bp, Mus musculus
gggtgatcttgtaagacctgcgatt

SEQ ID NO: 641559 - DNA, 25 bp, Mus musculus
gggtgatcttgttagacctgcgatt

SEQ ID NO: 641560 - DNA, 25 bp, Mus musculus
gggtgatgaatgaggccatcctcct

SEQ ID NO: 641561 - DNA, 25 bp, Mus musculus
gggtgatgaatgtggccatcctcct

SEQ ID NO: 641562 - DNA, 25 bp, Mus musculus
gggtgatgccggacacataactgcc

SEQ ID NO: 641563 - DNA, 25 bp, Mus musculus
gggtgatgccggtcacataactgcc

SEQ ID NO: 641564 - DNA, 25 bp, Mus musculus
gggtgatggaatccctgaatttcat

SEQ ID NO: 641565 - DNA, 25 bp, Mus musculus
gggtgatggaatgcctgaatttcat

SEQ ID NO: 641566 - DNA, 25 bp, Mus musculus
gggtgatggccacattatctaccct

SEQ ID NO: 641567 - DNA, 25 bp, Mus musculus
gggtgatggccagattatctaccct

SEQ ID NO: 641568 - DNA, 25 bp, Mus musculus
gggtgatggccgaagtgcccaattt

SEQ ID NO: 641569 - DNA, 25 bp, Mus musculus
gggtgatggccgtagtgcccaattt

SEQ ID NO: 641570 - DNA, 25 bp, Mus musculus
gggtgatggtgacatctccaacttt

SEQ ID NO: 641571 - DNA, 25 bp, Mus musculus
gggtgatggtgagatctccaacttt

SEQ ID NO: 641572 - DNA, 25 bp, Mus musculus
gggtgatgtcaaagccaaggctagc

SEQ ID NO: 641573 - DNA, 25 bp, Mus musculus
gggtgatgtcaatgccaaggctagc

SEQ ID NO: 641574 - DNA, 25 bp, Mus musculus
gggtgatgtcctcatgatgtcatcc

SEQ ID NO: 641575 - DNA, 25 bp, Mus musculus
gggtgatgtcctgatgatgtcatcc

SEQ ID NO: 641576 - DNA, 25 bp, Mus musculus
gggtgatgtgaaaacttgttttctt

SEQ ID NO: 641577 - DNA, 25 bp, Mus musculus
gggtgatgtgaatacttgttttctt

SEQ ID NO: 641578 - DNA, 25 bp, Mus musculus
gggtgatgtgttcaagcctctccca

SEQ ID NO: 641579 - DNA, 25 bp, Mus musculus
gggtgatgtgttgaagcctctccca

SEQ ID NO: 641580 - DNA, 25 bp, Mus musculus
gggtgatgtttcaccttacaaattg

SEQ ID NO: 641581 - DNA, 25 bp, Mus musculus
gggtgatgtttctccttacaaattg

SEQ ID NO: 641582 - DNA, 25 bp, Mus musculus
gggtgattaattactgacactggac

SEQ ID NO: 641583 - DNA, 25 bp, Mus musculus
gggtgattaatttctgacactggac

SEQ ID NO: 641584 - DNA, 25 bp, Mus musculus
gggtgattacataggcatctatgcc

SEQ ID NO: 641585 - DNA, 25 bp, Mus musculus
gggtgattacattggcatctatgcc

SEQ ID NO: 641586 - DNA, 25 bp, Mus musculus
gggtgattcaggaagatctaagatt

SEQ ID NO: 641587 - DNA, 25 bp, Mus musculus
gggtgattcaggtagatctaagatt

SEQ ID NO: 641588 - DNA, 25 bp, Mus musculus
gggtgattcccaatggcagtcataa

SEQ ID NO: 641589 - DNA, 25 bp, Mus musculus
gggtgattcccattggcagtcataa

SEQ ID NO: 641590 - DNA, 25 bp, Mus musculus
gggtgattcctacaaacttcgacat

SEQ ID NO: 641591 - DNA, 25 bp, Mus musculus
gggtgattcctagaaacttcgacat

SEQ ID NO: 641592 - DNA, 25 bp, Mus musculus
gggtgattcgcaacaccaacctgga

SEQ ID NO: 641593 - DNA, 25 bp, Mus musculus
gggtgattcgcatcaccaacctgga

SEQ ID NO: 641594 - DNA, 25 bp, Mus musculus
gggtgatttcatatcgtttctgact

SEQ ID NO: 641595 - DNA, 25 bp, Mus musculus
gggtgatttcatttcgtttctgact

SEQ ID NO: 641596 - DNA, 25 bp, Mus musculus
gggtgatttctccaatgaaaagtca

SEQ ID NO: 641597 - DNA, 25 bp, Mus musculus
gggtgatttctcgaatgaaaagtca

SEQ ID NO: 641598 - DNA, 25 bp, Mus musculus
gggtgatttgcccatgaaactccaa

SEQ ID NO: 641599 - DNA, 25 bp, Mus musculus
gggtgatttgccgatgaaactccaa

SEQ ID NO: 641600 - DNA, 25 bp, Mus musculus
gggtgattttcaatatctacaaagg

SEQ ID NO: 641601 - DNA, 25 bp, Mus musculus
gggtgattttcattatctacaaagg

SEQ ID NO: 641602 - DNA, 25 bp, Mus musculus
gggtgcaaacatcccagagatctga

SEQ ID NO: 641603 - DNA, 25 bp, Mus musculus
gggtgcaaacatgccagagatctga

SEQ ID NO: 641604 - DNA, 25 bp, Mus musculus
gggtgcaaaggcaatctgtgatatt

SEQ ID NO: 641605 - DNA, 25 bp, Mus musculus
gggtgcaaaggctatctgtgatatt

SEQ ID NO: 641606 - DNA, 25 bp, Mus musculus
gggtgcaactgcaaacacttgcttt

SEQ ID NO: 641607 - DNA, 25 bp, Mus musculus
gggtgcaactgctaacacttgcttt

SEQ ID NO: 641608 - DNA, 25 bp, Mus musculus
gggtgcaaggctacgacggcttctt

SEQ ID NO: 641609 - DNA, 25 bp, Mus musculus
gggtgcaaggcttcgacggcttctt

SEQ ID NO: 641610 - DNA, 25 bp, Mus musculus
gggtgcaagttcagcaacagaagaa

SEQ ID NO: 641611 - DNA, 25 bp, Mus musculus
gggtgcaagttctgcaacagaagaa

SEQ ID NO: 641612 - DNA, 25 bp, Mus musculus
gggtgcaagtttcccatacgcatac

SEQ ID NO: 641613 - DNA, 25 bp, Mus musculus
gggtgcaagtttgccatacgcatac

SEQ ID NO: 641614 - DNA, 25 bp, Mus musculus
gggtgcaatcttaggtctatagttt

SEQ ID NO: 641615 - DNA, 25 bp, Mus musculus
gggtgcaatctttggtctatagttt

SEQ ID NO: 641616 - DNA, 25 bp, Mus musculus
gggtgcacaagaaccctctgggttt

SEQ ID NO: 641617 - DNA, 25 bp, Mus musculus
gggtgcacaagatccctctgggttt

SEQ ID NO: 641618 - DNA, 25 bp, Mus musculus
gggtgcacactccagagtacatctg

SEQ ID NO: 641619 - DNA, 25 bp, Mus musculus
gggtgcacactcgagagtacatctg

SEQ ID NO: 641620 - DNA, 25 bp, Mus musculus
gggtgcacaggtccctaacaggcta

SEQ ID NO: 641621 - DNA, 25 bp, Mus musculus
gggtgcacaggtgcctaacaggcta

SEQ ID NO: 641622 - DNA, 25 bp, Mus musculus
gggtgcacatgtatagtgtcctgta

SEQ ID NO: 641623 - DNA, 25 bp, Mus musculus
gggtgcacatgtttagtgtcctgta

SEQ ID NO: 641624 - DNA, 25 bp, Mus musculus
gggtgcacgcagaccgtaccgtcac

SEQ ID NO: 641625 - DNA, 25 bp, Mus musculus
gggtgcacgcagtccgtaccgtcac

SEQ ID NO: 641626 - DNA, 25 bp, Mus musculus
gggtgcactgaaagtctgttctact

SEQ ID NO: 641627 - DNA, 25 bp, Mus musculus
gggtgcactgaatgtctgttctact

SEQ ID NO: 641628 - DNA, 25 bp, Mus musculus
gggtgcactgctaagtaccaggtca

SEQ ID NO: 641629 - DNA, 25 bp, Mus musculus
gggtgcactgcttagtaccaggtca

SEQ ID NO: 641630 - DNA, 25 bp, Mus musculus
gggtgcactgtgcttctagatctga

SEQ ID NO: 641631 - DNA, 25 bp, Mus musculus
gggtgcactgtggttctagatctga

SEQ ID NO: 641632 - DNA, 25 bp, Mus musculus
gggtgcactttaaagtcatcttcgt

SEQ ID NO: 641633 - DNA, 25 bp, Mus musculus
gggtgcactttatagtcatcttcgt

SEQ ID NO: 641634 - DNA, 25 bp, Mus musculus
gggtgcagaaacaattatatttact

SEQ ID NO: 641635 - DNA, 25 bp, Mus musculus
gggtgcagaaactattatatttact

SEQ ID NO: 641636 - DNA, 25 bp, Mus musculus
gggtgcagaaccagatgcgccgcct

SEQ ID NO: 641637 - DNA, 25 bp, Mus musculus
gggtgcagaacctgatgcgccgcct

SEQ ID NO: 641638 - DNA, 25 bp, Mus musculus
gggtgcagactcctgaagtacagaa

SEQ ID NO: 641639 - DNA, 25 bp, Mus musculus
gggtgcagactcgtgaagtacagaa

SEQ ID NO: 641640 - DNA, 25 bp, Mus musculus
gggtgcagagacatcttgagccaag

SEQ ID NO: 641641 - DNA, 25 bp, Mus musculus
gggtgcagagacttcttgagccaag

SEQ ID NO: 641642 - DNA, 25 bp, Mus musculus
gggtgcagcacaatcttacagcgaa

SEQ ID NO: 641643 - DNA, 25 bp, Mus musculus
gggtgcagcacattcttacagcgaa

SEQ ID NO: 641644 - DNA, 25 bp, Mus musculus
gggtgcagccagctgcgcggcgccg

SEQ ID NO: 641645 - DNA, 25 bp, Mus musculus
gggtgcagccaggtgcgcggcgccg

SEQ ID NO: 641646 - DNA, 25 bp, Mus musculus
gggtgcagcctaacttcagtgactt

SEQ ID NO: 641647 - DNA, 25 bp, Mus musculus
gggtgcagcctatcttcagtgactt

SEQ ID NO: 641648 - DNA, 25 bp, Mus musculus
gggtgcagctgaagcgccagcctgc

SEQ ID NO: 641649 - DNA, 25 bp, Mus musculus
gggtgcagctgatgcgccagcctgc

SEQ ID NO: 641650 - DNA, 25 bp, Mus musculus
gggtgcagctgtcatctagcctttc

SEQ ID NO: 641651 - DNA, 25 bp, Mus musculus
gggtgcagctgtgatctagcctttc

SEQ ID NO: 641652 - DNA, 25 bp, Mus musculus
gggtgcaggaagaggcagagtggtc

SEQ ID NO: 641653 - DNA, 25 bp, Mus musculus
gggtgcaggaagtggcagagtggtc

SEQ ID NO: 641654 - DNA, 25 bp, Mus musculus
gggtgcaggcatacacacatggaca

SEQ ID NO: 641655 - DNA, 25 bp, Mus musculus
gggtgcaggcattcacacatggaca

SEQ ID NO: 641656 - DNA, 25 bp, Mus musculus
gggtgcagtaaaatgcctcttcatc

SEQ ID NO: 641657 - DNA, 25 bp, Mus musculus
gggtgcagtaaattgcctcttcatc

SEQ ID NO: 641658 - DNA, 25 bp, Mus musculus
gggtgcagtacacactcttaattcc

SEQ ID NO: 641659 - DNA, 25 bp, Mus musculus
gggtgcagtacagactcttaattcc

SEQ ID NO: 641660 - DNA, 25 bp, Mus musculus
gggtgcagtgtaagcaccctccatt

SEQ ID NO: 641661 - DNA, 25 bp, Mus musculus
gggtgcagtgtatgcaccctccatt

SEQ ID NO: 641662 - DNA, 25 bp, Mus musculus
gggtgcagtgtgctttcccctccct

SEQ ID NO: 641663 - DNA, 25 bp, Mus musculus
gggtgcagtgtggtttcccctccct

SEQ ID NO: 641664 - DNA, 25 bp, Mus musculus
gggtgcagttccatcaggctgcaaa

SEQ ID NO: 641665 - DNA, 25 bp, Mus musculus
gggtgcagttccttcaggctgcaaa

SEQ ID NO: 641666 - DNA, 25 bp, Mus musculus
gggtgcatatctaattctctctggg

SEQ ID NO: 641667 - DNA, 25 bp, Mus musculus
gggtgcatatcttattctctctggg

SEQ ID NO: 641668 - DNA, 25 bp, Mus musculus
gggtgcatcacgctttaccagtcac

SEQ ID NO: 641669 - DNA, 25 bp, Mus musculus
gggtgcatcacggtttaccagtcac

SEQ ID NO: 641670 - DNA, 25 bp, Mus musculus
gggtgcatgataaagccatcaaaca

SEQ ID NO: 641671 - DNA, 25 bp, Mus musculus
gggtgcatgatatagccatcaaaca

SEQ ID NO: 641672 - DNA, 25 bp, Mus musculus
gggtgcatgtctcctattgttaatc

SEQ ID NO: 641673 - DNA, 25 bp, Mus musculus
gggtgcatgtctctaatccttggta

SEQ ID NO: 641674 - DNA, 25 bp, Mus musculus
gggtgcatgtctgctattgttaatc

SEQ ID NO: 641675 - DNA, 25 bp, Mus musculus
gggtgcatgtctgtaatccttggta

SEQ ID NO: 641676 - DNA, 25 bp, Mus musculus
gggtgcatgtgcattaaggcaaaat

SEQ ID NO: 641677 - DNA, 25 bp, Mus musculus
gggtgcatgtgctttaaggcaaaat

SEQ ID NO: 641678 - DNA, 25 bp, Mus musculus
gggtgcattgctaattgaagtcatt

SEQ ID NO: 641679 - DNA, 25 bp, Mus musculus
gggtgcattgcttattgaagtcatt

SEQ ID NO: 641680 - DNA, 25 bp, Mus musculus
gggtgccaacctcacaagatctgtg

SEQ ID NO: 641681 - DNA, 25 bp, Mus musculus
gggtgccaacctgacaagatctgtg

SEQ ID NO: 641682 - DNA, 25 bp, Mus musculus
gggtgccaactacttaatgactttc

SEQ ID NO: 641683 - DNA, 25 bp, Mus musculus
gggtgccaactagttaatgactttc

SEQ ID NO: 641684 - DNA, 25 bp, Mus musculus
gggtgccaagtgaccaagtgccata

SEQ ID NO: 641685 - DNA, 25 bp, Mus musculus
gggtgccaagtgtccaagtgccata

SEQ ID NO: 641686 - DNA, 25 bp, Mus musculus
gggtgccaatcaaccagtgacaagg

SEQ ID NO: 641687 - DNA, 25 bp, Mus musculus
gggtgccaatcatccagtgacaagg

SEQ ID NO: 641688 - DNA, 25 bp, Mus musculus
gggtgccaatgtccagtatatgaga

SEQ ID NO: 641689 - DNA, 25 bp, Mus musculus
gggtgccaatgtgcagtatatgaga

SEQ ID NO: 641690 - DNA, 25 bp, Mus musculus
gggtgccacaatacagcggagctca

SEQ ID NO: 641691 - DNA, 25 bp, Mus musculus
gggtgccacaattcagcggagctca

SEQ ID NO: 641692 - DNA, 25 bp, Mus musculus
gggtgccacactatatagaggcata

SEQ ID NO: 641693 - DNA, 25 bp, Mus musculus
gggtgccacactttatagaggcata

SEQ ID NO: 641694 - DNA, 25 bp, Mus musculus
gggtgccaccatatttgtaagtagt

SEQ ID NO: 641695 - DNA, 25 bp, Mus musculus
gggtgccaccatttttgtaagtagt

SEQ ID NO: 641696 - DNA, 25 bp, Mus musculus
gggtgccactccaaaaacatgaaaa

SEQ ID NO: 641697 - DNA, 25 bp, Mus musculus
gggtgccactcctaaaacatgaaaa

SEQ ID NO: 641698 - DNA, 25 bp, Mus musculus
gggtgccactgtaatttgagacatc

SEQ ID NO: 641699 - DNA, 25 bp, Mus musculus
gggtgccactgttatttgagacatc

SEQ ID NO: 641700 - DNA, 25 bp, Mus musculus
gggtgccagcttccacatcaaaact

SEQ ID NO: 641701 - DNA, 25 bp, Mus musculus
gggtgccagcttgcacatcaaaact

SEQ ID NO: 641702 - DNA, 25 bp, Mus musculus
gggtgccaggcaagacaagactctt

SEQ ID NO: 641703 - DNA, 25 bp, Mus musculus
gggtgccaggcatgacaagactctt

SEQ ID NO: 641704 - DNA, 25 bp, Mus musculus
gggtgccagggaatagaactcaaat

SEQ ID NO: 641705 - DNA, 25 bp, Mus musculus
gggtgccagggattagaactcaaat

SEQ ID NO: 641706 - DNA, 25 bp, Mus musculus
gggtgccaggtgacggatattaact

SEQ ID NO: 641707 - DNA, 25 bp, Mus musculus
gggtgccaggtgtcggatattaact

SEQ ID NO: 641708 - DNA, 25 bp, Mus musculus
gggtgccagtacagtcgtgtctgta

SEQ ID NO: 641709 - DNA, 25 bp, Mus musculus
gggtgccagtactgtcgtgtctgta

SEQ ID NO: 641710 - DNA, 25 bp, Mus musculus
gggtgccagtcaacagtcattcgcc

SEQ ID NO: 641711 - DNA, 25 bp, Mus musculus
gggtgccagtcaaggctctgtgcca

SEQ ID NO: 641712 - DNA, 25 bp, Mus musculus
gggtgccagtcatcagtcattcgcc

SEQ ID NO: 641713 - DNA, 25 bp, Mus musculus
gggtgccagtcatggctctgtgcca

SEQ ID NO: 641714 - DNA, 25 bp, Mus musculus
gggtgccatcagaaatcatgccact

SEQ ID NO: 641715 - DNA, 25 bp, Mus musculus
gggtgccatcagtaatcatgccact

SEQ ID NO: 641716 - DNA, 25 bp, Mus musculus
gggtgccatgaaacaaccgcagact

SEQ ID NO: 641717 - DNA, 25 bp, Mus musculus
gggtgccatgaatcaaccgcagact

SEQ ID NO: 641718 - DNA, 25 bp, Mus musculus
gggtgccatgtacaacctctatgac

SEQ ID NO: 641719 - DNA, 25 bp, Mus musculus
gggtgccatgtagaacctctatgac

SEQ ID NO: 641720 - DNA, 25 bp, Mus musculus
gggtgccattcacagcaaaggccag

SEQ ID NO: 641721 - DNA, 25 bp, Mus musculus
gggtgccattcagagcaaaggccag

SEQ ID NO: 641722 - DNA, 25 bp, Mus musculus
gggtgccattccataaagtggatct

SEQ ID NO: 641723 - DNA, 25 bp, Mus musculus
gggtgccattccttaaagtggatct

SEQ ID NO: 641724 - DNA, 25 bp, Mus musculus
gggtgcccagatacatttaagctat

SEQ ID NO: 641725 - DNA, 25 bp, Mus musculus
gggtgcccagattcatttaagctat

SEQ ID NO: 641726 - DNA, 25 bp, Mus musculus
gggtgcccagctcagagtctatcag

SEQ ID NO: 641727 - DNA, 25 bp, Mus musculus
gggtgcccagctgagagtctatcag

SEQ ID NO: 641728 - DNA, 25 bp, Mus musculus
gggtgcccatagatctgtctaatga

SEQ ID NO: 641729 - DNA, 25 bp, Mus musculus
gggtgcccatagttctgtctaatga

SEQ ID NO: 641730 - DNA, 25 bp, Mus musculus
gggtgccccagtattgatacccagc

SEQ ID NO: 641731 - DNA, 25 bp, Mus musculus
gggtgccccagttttgatacccagc

SEQ ID NO: 641732 - DNA, 25 bp, Mus musculus
gggtgcccctcaatcagtcacatgg

SEQ ID NO: 641733 - DNA, 25 bp, Mus musculus
gggtgcccctcattcagtcacatgg

SEQ ID NO: 641734 - DNA, 25 bp, Mus musculus
gggtgcccctttcatatatgcaaat

SEQ ID NO: 641735 - DNA, 25 bp, Mus musculus
gggtgcccctttgatatatgcaaat

SEQ ID NO: 641736 - DNA, 25 bp, Mus musculus
gggtgccctataatctggatggaaa

SEQ ID NO: 641737 - DNA, 25 bp, Mus musculus
gggtgccctatattctggatggaaa

SEQ ID NO: 641738 - DNA, 25 bp, Mus musculus
gggtgccctggcatttgccttagca

SEQ ID NO: 641739 - DNA, 25 bp, Mus musculus
gggtgccctggcttttgccttagca

SEQ ID NO: 641740 - DNA, 25 bp, Mus musculus
gggtgcccttgaataaccacctcta

SEQ ID NO: 641741 - DNA, 25 bp, Mus musculus
gggtgcccttgattaaccacctcta

SEQ ID NO: 641742 - DNA, 25 bp, Mus musculus
gggtgccctttcagcttatggaaca

SEQ ID NO: 641743 - DNA, 25 bp, Mus musculus
gggtgccctttctgcttatggaaca

SEQ ID NO: 641744 - DNA, 25 bp, Mus musculus
gggtgccgacatcattgtgatcaaa

SEQ ID NO: 641745 - DNA, 25 bp, Mus musculus
gggtgccgacatgattgtgatcaaa

SEQ ID NO: 641746 - DNA, 25 bp, Mus musculus
gggtgccgcctgagggccacaaatc

SEQ ID NO: 641747 - DNA, 25 bp, Mus musculus
gggtgccgcctgtgggccacaaatc

SEQ ID NO: 641748 - DNA, 25 bp, Mus musculus
gggtgcctactgctttcgttctgcc

SEQ ID NO: 641749 - DNA, 25 bp, Mus musculus
gggtgcctactggtttcgttctgcc

SEQ ID NO: 641750 - DNA, 25 bp, Mus musculus
gggtgcctccagcatgccaacgagc

SEQ ID NO: 641751 - DNA, 25 bp, Mus musculus
gggtgcctccaggatgccaacgagc

SEQ ID NO: 641752 - DNA, 25 bp, Mus musculus
gggtgcctctcaagcaaagggaatt

SEQ ID NO: 641753 - DNA, 25 bp, Mus musculus
gggtgcctctcaagggaggcccagt

SEQ ID NO: 641754 - DNA, 25 bp, Mus musculus
gggtgcctctcatgcaaagggaatt

SEQ ID NO: 641755 - DNA, 25 bp, Mus musculus
gggtgcctctcatgggaggcccagt

SEQ ID NO: 641756 - DNA, 25 bp, Mus musculus
gggtgcctgatacccatgaaccaca

SEQ ID NO: 641757 - DNA, 25 bp, Mus musculus
gggtgcctgatagccatgaaccaca

SEQ ID NO: 641758 - DNA, 25 bp, Mus musculus
gggtgccttaaaagctttggaatct

SEQ ID NO: 641759 - DNA, 25 bp, Mus musculus
gggtgccttaaatgctttggaatct

SEQ ID NO: 641760 - DNA, 25 bp, Mus musculus
gggtgccttatgctggacactcaca

SEQ ID NO: 641761 - DNA, 25 bp, Mus musculus
gggtgccttatggtggacactcaca

SEQ ID NO: 641762 - DNA, 25 bp, Mus musculus
gggtgccttgccagattgatagatt

SEQ ID NO: 641763 - DNA, 25 bp, Mus musculus
gggtgccttgcctgattgatagatt

SEQ ID NO: 641764 - DNA, 25 bp, Mus musculus
gggtgccttgtacaattgttactta

SEQ ID NO: 641765 - DNA, 25 bp, Mus musculus
gggtgccttgtagaattgttactta

SEQ ID NO: 641766 - DNA, 25 bp, Mus musculus
gggtgcctttctatagcaacacaga

SEQ ID NO: 641767 - DNA, 25 bp, Mus musculus
gggtgcctttctttagcaacacaga

SEQ ID NO: 641768 - DNA, 25 bp, Mus musculus
gggtgccttttccaagatgtaccac

SEQ ID NO: 641769 - DNA, 25 bp, Mus musculus
gggtgccttttcgaagatgtaccac

SEQ ID NO: 641770 - DNA, 25 bp, Mus musculus
gggtgcgcatgcaggtgagactggt

SEQ ID NO: 641771 - DNA, 25 bp, Mus musculus
gggtgcgcatgctggtgagactggt

SEQ ID NO: 641772 - DNA, 25 bp, Mus musculus
gggtgcgcctccaagtgctgtcagt

SEQ ID NO: 641773 - DNA, 25 bp, Mus musculus
gggtgcgcctcctagtgctgtcagt

SEQ ID NO: 641774 - DNA, 25 bp, Mus musculus
gggtgcgctaaactagtcctgatcc

SEQ ID NO: 641775 - DNA, 25 bp, Mus musculus
gggtgcgctaaagtagtcctgatcc

SEQ ID NO: 641776 - DNA, 25 bp, Mus musculus
gggtgcgctagacaacccaacccat

SEQ ID NO: 641777 - DNA, 25 bp, Mus musculus
gggtgcgctagagaacccaacccat

SEQ ID NO: 641778 - DNA, 25 bp, Mus musculus
gggtgcgctttgcagtagataatca

SEQ ID NO: 641779 - DNA, 25 bp, Mus musculus
gggtgcgctttggagtagataatca

SEQ ID NO: 641780 - DNA, 25 bp, Mus musculus
gggtgcggacttcttcaagcactga

SEQ ID NO: 641781 - DNA, 25 bp, Mus musculus
gggtgcggacttgttcaagcactga

SEQ ID NO: 641782 - DNA, 25 bp, Mus musculus
gggtgcggttatctcacagtccaaa

SEQ ID NO: 641783 - DNA, 25 bp, Mus musculus
gggtgcggttatgtcacagtccaaa

SEQ ID NO: 641784 - DNA, 25 bp, Mus musculus
gggtgcgtgctcagtcacactatgg

SEQ ID NO: 641785 - DNA, 25 bp, Mus musculus
gggtgcgtgctctgtcacactatgg

SEQ ID NO: 641786 - DNA, 25 bp, Mus musculus
gggtgcgtttccattaattcaaaca

SEQ ID NO: 641787 - DNA, 25 bp, Mus musculus
gggtgcgtttcctttaattcaaaca

SEQ ID NO: 641788 - DNA, 25 bp, Mus musculus
gggtgctaaagcagcaattgtctgt

SEQ ID NO: 641789 - DNA, 25 bp, Mus musculus
gggtgctaaagctgcaattgtctgt

SEQ ID NO: 641790 - DNA, 25 bp, Mus musculus
gggtgctaatacagaagctgagtcc

SEQ ID NO: 641791 - DNA, 25 bp, Mus musculus
gggtgctaatactgaagctgagtcc

SEQ ID NO: 641792 - DNA, 25 bp, Mus musculus
gggtgctaattaatggactttgggt

SEQ ID NO: 641793 - DNA, 25 bp, Mus musculus
gggtgctaattattggactttgggt

SEQ ID NO: 641794 - DNA, 25 bp, Mus musculus
gggtgctacacaacacgagtttcat

SEQ ID NO: 641795 - DNA, 25 bp, Mus musculus
gggtgctacacatcacgagtttcat

SEQ ID NO: 641796 - DNA, 25 bp, Mus musculus
gggtgctacagcagctccaggtctt

SEQ ID NO: 641797 - DNA, 25 bp, Mus musculus
gggtgctacagctgctccaggtctt

SEQ ID NO: 641798 - DNA, 25 bp, Mus musculus
gggtgctacatcaagggtcagacta

SEQ ID NO: 641799 - DNA, 25 bp, Mus musculus
gggtgctacatctagggtcagacta

SEQ ID NO: 641800 - DNA, 25 bp, Mus musculus
gggtgctactgaattgaacttatat

SEQ ID NO: 641801 - DNA, 25 bp, Mus musculus
gggtgctactgatttgaacttatat

SEQ ID NO: 641802 - DNA, 25 bp, Mus musculus
gggtgctactgccaaatgttctggt

SEQ ID NO: 641803 - DNA, 25 bp, Mus musculus
gggtgctactgcgaaatgttctggt

SEQ ID NO: 641804 - DNA, 25 bp, Mus musculus
gggtgctagcttagtcttttttatt

SEQ ID NO: 641805 - DNA, 25 bp, Mus musculus
gggtgctagctttgtcttttttatt

SEQ ID NO: 641806 - DNA, 25 bp, Mus musculus
gggtgctaggctcatatagtacact

SEQ ID NO: 641807 - DNA, 25 bp, Mus musculus
gggtgctaggctgatatagtacact

SEQ ID NO: 641808 - DNA, 25 bp, Mus musculus
gggtgctagtaacccataatgctct

SEQ ID NO: 641809 - DNA, 25 bp, Mus musculus
gggtgctagtaagccataatgctct

SEQ ID NO: 641810 - DNA, 25 bp, Mus musculus
gggtgctatagcaagaggatactct

SEQ ID NO: 641811 - DNA, 25 bp, Mus musculus
gggtgctatagctagaggatactct

SEQ ID NO: 641812 - DNA, 25 bp, Mus musculus
gggtgctatcccaaaagaccagcct

SEQ ID NO: 641813 - DNA, 25 bp, Mus musculus
gggtgctatccctaaagaccagcct

SEQ ID NO: 641814 - DNA, 25 bp, Mus musculus
gggtgctatcttcaactcattgtgt

SEQ ID NO: 641815 - DNA, 25 bp, Mus musculus
gggtgctatcttgaactcattgtgt

SEQ ID NO: 641816 - DNA, 25 bp, Mus musculus
gggtgctatgttaattttccttagg

SEQ ID NO: 641817 - DNA, 25 bp, Mus musculus
gggtgctatgtttattttccttagg

SEQ ID NO: 641818 - DNA, 25 bp, Mus musculus
gggtgctcacacatgagagctttgt

SEQ ID NO: 641819 - DNA, 25 bp, Mus musculus
gggtgctcacacttgagagctttgt

SEQ ID NO: 641820 - DNA, 25 bp, Mus musculus
gggtgctcacgcaattttgtacatt

SEQ ID NO: 641821 - DNA, 25 bp, Mus musculus
gggtgctcacgctattttgtacatt

SEQ ID NO: 641822 - DNA, 25 bp, Mus musculus
gggtgctcactacctgggactctct

SEQ ID NO: 641823 - DNA, 25 bp, Mus musculus
gggtgctcactagctgggactctct

SEQ ID NO: 641824 - DNA, 25 bp, Mus musculus
gggtgctcactccaaattgcactgg

SEQ ID NO: 641825 - DNA, 25 bp, Mus musculus
gggtgctcactcgaaattgcactgg

SEQ ID NO: 641826 - DNA, 25 bp, Mus musculus
gggtgctcattcaactctaagactt

SEQ ID NO: 641827 - DNA, 25 bp, Mus musculus
gggtgctcattctactctaagactt

SEQ ID NO: 641828 - DNA, 25 bp, Mus musculus
gggtgctcggataatcacctccatc

SEQ ID NO: 641829 - DNA, 25 bp, Mus musculus
gggtgctcggattatcacctccatc

SEQ ID NO: 641830 - DNA, 25 bp, Mus musculus
gggtgctcggcgcacgcggcacggt

SEQ ID NO: 641831 - DNA, 25 bp, Mus musculus
gggtgctcggcggacgcggcacggt

SEQ ID NO: 641832 - DNA, 25 bp, Mus musculus
gggtgctctatactatcacaagcat

SEQ ID NO: 641833 - DNA, 25 bp, Mus musculus
gggtgctctatagtatcacaagcat

SEQ ID NO: 641834 - DNA, 25 bp, Mus musculus
gggtgctctcaaaattgctctggta

SEQ ID NO: 641835 - DNA, 25 bp, Mus musculus
gggtgctctcaatattgctctggta

SEQ ID NO: 641836 - DNA, 25 bp, Mus musculus
gggtgctctcaccattgtaaagatt

SEQ ID NO: 641837 - DNA, 25 bp, Mus musculus
gggtgctctcacgattgtaaagatt

SEQ ID NO: 641838 - DNA, 25 bp, Mus musculus
gggtgctctgctatgatgcatcact

SEQ ID NO: 641839 - DNA, 25 bp, Mus musculus
gggtgctctgctttgatgcatcact

SEQ ID NO: 641840 - DNA, 25 bp, Mus musculus
gggtgctctggaacaatctgaggat

SEQ ID NO: 641841 - DNA, 25 bp, Mus musculus
gggtgctctggatcaatctgaggat

SEQ ID NO: 641842 - DNA, 25 bp, Mus musculus
gggtgctctgggatgagaccacata

SEQ ID NO: 641843 - DNA, 25 bp, Mus musculus
gggtgctctgggttgagaccacata

SEQ ID NO: 641844 - DNA, 25 bp, Mus musculus
gggtgctcttatattttacacgagg

SEQ ID NO: 641845 - DNA, 25 bp, Mus musculus
gggtgctcttattttttacacgagg

SEQ ID NO: 641846 - DNA, 25 bp, Mus musculus
gggtgctcttcaatggccaaaactc

SEQ ID NO: 641847 - DNA, 25 bp, Mus musculus
gggtgctcttcattggccaaaactc

SEQ ID NO: 641848 - DNA, 25 bp, Mus musculus
gggtgctcttgaattgtgggctcat

SEQ ID NO: 641849 - DNA, 25 bp, Mus musculus
gggtgctcttgatttgtgggctcat

SEQ ID NO: 641850 - DNA, 25 bp, Mus musculus
gggtgctcttgtactaggctcagga

SEQ ID NO: 641851 - DNA, 25 bp, Mus musculus
gggtgctcttgttctaggctcagga

SEQ ID NO: 641852 - DNA, 25 bp, Mus musculus
gggtgctgaaccatgttggtatcag

SEQ ID NO: 641853 - DNA, 25 bp, Mus musculus
gggtgctgaaccttgttggtatcag

SEQ ID NO: 641854 - DNA, 25 bp, Mus musculus
gggtgctgacacagatttttattct

SEQ ID NO: 641855 - DNA, 25 bp, Mus musculus
gggtgctgacactgatttttattct

SEQ ID NO: 641856 - DNA, 25 bp, Mus musculus
gggtgctgaccaaatcctgaaacgc

SEQ ID NO: 641857 - DNA, 25 bp, Mus musculus
gggtgctgaccatatcctgaaacgc

SEQ ID NO: 641858 - DNA, 25 bp, Mus musculus
gggtgctgagccatacactcctgcc

SEQ ID NO: 641859 - DNA, 25 bp, Mus musculus
gggtgctgagccttacactcctgcc

SEQ ID NO: 641860 - DNA, 25 bp, Mus musculus
gggtgctgaggcagttgcccacttt

SEQ ID NO: 641861 - DNA, 25 bp, Mus musculus
gggtgctgaggctgttgcccacttt

SEQ ID NO: 641862 - DNA, 25 bp, Mus musculus
gggtgctgagttctttcacgtgatt

SEQ ID NO: 641863 - DNA, 25 bp, Mus musculus
gggtgctgagttgtttcacgtgatt

SEQ ID NO: 641864 - DNA, 25 bp, Mus musculus
gggtgctgccccaaacatggactgt

SEQ ID NO: 641865 - DNA, 25 bp, Mus musculus
gggtgctgcccctaacatggactgt

SEQ ID NO: 641866 - DNA, 25 bp, Mus musculus
gggtgctgcctgagacaaagatcct

SEQ ID NO: 641867 - DNA, 25 bp, Mus musculus
gggtgctgcctgtgacaaagatcct

SEQ ID NO: 641868 - DNA, 25 bp, Mus musculus
gggtgctgctccactgaggacccac

SEQ ID NO: 641869 - DNA, 25 bp, Mus musculus
gggtgctgctcctctgaggacccac

SEQ ID NO: 641870 - DNA, 25 bp, Mus musculus
gggtgctgctgtctcttgaaagacc

SEQ ID NO: 641871 - DNA, 25 bp, Mus musculus
gggtgctgctgtgtcttgaaagacc

SEQ ID NO: 641872 - DNA, 25 bp, Mus musculus
gggtgctgctttctctgagtgcccc

SEQ ID NO: 641873 - DNA, 25 bp, Mus musculus
gggtgctgctttgtctgagtgcccc

SEQ ID NO: 641874 - DNA, 25 bp, Mus musculus
gggtgctggatcagtcttttgtgct

SEQ ID NO: 641875 - DNA, 25 bp, Mus musculus
gggtgctggatccttctatagcaga

SEQ ID NO: 641876 - DNA, 25 bp, Mus musculus
gggtgctggatcgttctatagcaga

SEQ ID NO: 641877 - DNA, 25 bp, Mus musculus
gggtgctggatctgtcttttgtgct

SEQ ID NO: 641878 - DNA, 25 bp, Mus musculus
gggtgctggcttagactagcatagc

SEQ ID NO: 641879 - DNA, 25 bp, Mus musculus
gggtgctggctttgactagcatagc

SEQ ID NO: 641880 - DNA, 25 bp, Mus musculus
gggtgctgggatcttctccaataaa

SEQ ID NO: 641881 - DNA, 25 bp, Mus musculus
gggtgctgggatgttctccaataaa

SEQ ID NO: 641882 - DNA, 25 bp, Mus musculus
gggtgctggtgtagaactgtatcct

SEQ ID NO: 641883 - DNA, 25 bp, Mus musculus
gggtgctggtgttgaactgtatcct

SEQ ID NO: 641884 - DNA, 25 bp, Mus musculus
gggtgctgtcagcattgtacactat

SEQ ID NO: 641885 - DNA, 25 bp, Mus musculus
gggtgctgtcaggattgtacactat

SEQ ID NO: 641886 - DNA, 25 bp, Mus musculus
gggtgctgtctacattggctgaaat

SEQ ID NO: 641887 - DNA, 25 bp, Mus musculus
gggtgctgtctagattggctgaaat

SEQ ID NO: 641888 - DNA, 25 bp, Mus musculus
gggtgctgtggacatcatcttcaaa

SEQ ID NO: 641889 - DNA, 25 bp, Mus musculus
gggtgctgtggagatcatcttcaaa

SEQ ID NO: 641890 - DNA, 25 bp, Mus musculus
gggtgctgtggtcacagctccacat

SEQ ID NO: 641891 - DNA, 25 bp, Mus musculus
gggtgctgtggtgacagctccacat

SEQ ID NO: 641892 - DNA, 25 bp, Mus musculus
gggtgctgttctcatgccccacagg

SEQ ID NO: 641893 - DNA, 25 bp, Mus musculus
gggtgctgttctgatgccccacagg

SEQ ID NO: 641894 - DNA, 25 bp, Mus musculus
gggtgctgtttacgttagtattaat

SEQ ID NO: 641895 - DNA, 25 bp, Mus musculus
gggtgctgtttaggttagtattaat

SEQ ID NO: 641896 - DNA, 25 bp, Mus musculus
gggtgcttaaatcacttactacaat

SEQ ID NO: 641897 - DNA, 25 bp, Mus musculus
gggtgcttaaatgacttactacaat

SEQ ID NO: 641898 - DNA, 25 bp, Mus musculus
gggtgcttacagcattatctccact

SEQ ID NO: 641899 - DNA, 25 bp, Mus musculus
gggtgcttacaggattatctccact

SEQ ID NO: 641900 - DNA, 25 bp, Mus musculus
gggtgcttagacacaacacagttac

SEQ ID NO: 641901 - DNA, 25 bp, Mus musculus
gggtgcttagactcaacacagttac

SEQ ID NO: 641902 - DNA, 25 bp, Mus musculus
gggtgcttatggcactgctcagccc

SEQ ID NO: 641903 - DNA, 25 bp, Mus musculus
gggtgcttatgggactgctcagccc

SEQ ID NO: 641904 - DNA, 25 bp, Mus musculus
gggtgcttcaatagtattctgtgat

SEQ ID NO: 641905 - DNA, 25 bp, Mus musculus
gggtgcttcaattgtattctgtgat

SEQ ID NO: 641906 - DNA, 25 bp, Mus musculus
gggtgcttccaaagcagaacaactt

SEQ ID NO: 641907 - DNA, 25 bp, Mus musculus
gggtgcttccaatgcagaacaactt

SEQ ID NO: 641908 - DNA, 25 bp, Mus musculus
gggtgcttcttccagctgaatgctg

SEQ ID NO: 641909 - DNA, 25 bp, Mus musculus
gggtgcttcttcgagctgaatgctg

SEQ ID NO: 641910 - DNA, 25 bp, Mus musculus
gggtgcttgagcaagcagcaaacat

SEQ ID NO: 641911 - DNA, 25 bp, Mus musculus
gggtgcttgagctagcagcaaacat

SEQ ID NO: 641912 - DNA, 25 bp, Mus musculus
gggtgcttgatcacaacagtaagaa

SEQ ID NO: 641913 - DNA, 25 bp, Mus musculus
gggtgcttgatcctcagggtttcac

SEQ ID NO: 641914 - DNA, 25 bp, Mus musculus
gggtgcttgatcgtcagggtttcac

SEQ ID NO: 641915 - DNA, 25 bp, Mus musculus
gggtgcttgatctcaacagtaagaa

SEQ ID NO: 641916 - DNA, 25 bp, Mus musculus
gggtgcttgcaaaatgcctgttcct

SEQ ID NO: 641917 - DNA, 25 bp, Mus musculus
gggtgcttgcaatatgcctgttcct

SEQ ID NO: 641918 - DNA, 25 bp, Mus musculus
gggtgcttgctacatctggtacgtt

SEQ ID NO: 641919 - DNA, 25 bp, Mus musculus
gggtgcttgctaccaaacctggcac

SEQ ID NO: 641920 - DNA, 25 bp, Mus musculus
gggtgcttgctagatctggtacgtt

SEQ ID NO: 641921 - DNA, 25 bp, Mus musculus
gggtgcttgctagcaaacctggcac

SEQ ID NO: 641922 - DNA, 25 bp, Mus musculus
gggtgcttgtgtatgctcgttgtac

SEQ ID NO: 641923 - DNA, 25 bp, Mus musculus
gggtgcttgtgtttgctcgttgtac

SEQ ID NO: 641924 - DNA, 25 bp, Mus musculus
gggtgctttatcagcattgggtact

SEQ ID NO: 641925 - DNA, 25 bp, Mus musculus
gggtgctttatctgcattgggtact

SEQ ID NO: 641926 - DNA, 25 bp, Mus musculus
gggtgctttcttcagcctgtctcat

SEQ ID NO: 641927 - DNA, 25 bp, Mus musculus
gggtgctttcttgagcctgtctcat

SEQ ID NO: 641928 - DNA, 25 bp, Mus musculus
gggtgcttttcaaagtcagaacagg

SEQ ID NO: 641929 - DNA, 25 bp, Mus musculus
gggtgcttttcaatagtatctgtac

SEQ ID NO: 641930 - DNA, 25 bp, Mus musculus
gggtgcttttcatagtcagaacagg

SEQ ID NO: 641931 - DNA, 25 bp, Mus musculus
gggtgcttttcattagtatctgtac

SEQ ID NO: 641932 - DNA, 25 bp, Mus musculus
gggtgctttttgacagttgtatagt

SEQ ID NO: 641933 - DNA, 25 bp, Mus musculus
gggtgctttttgtcagttgtatagt

SEQ ID NO: 641934 - DNA, 25 bp, Mus musculus
gggtggaaagccctcagatttattt

SEQ ID NO: 641935 - DNA, 25 bp, Mus musculus
gggtggaaagccgtcagatttattt

SEQ ID NO: 641936 - DNA, 25 bp, Mus musculus
gggtggaacaagatcctgtctgccc

SEQ ID NO: 641937 - DNA, 25 bp, Mus musculus
gggtggaacaagttcctgtctgccc

SEQ ID NO: 641938 - DNA, 25 bp, Mus musculus
gggtggaacagcacatgtacatcaa

SEQ ID NO: 641939 - DNA, 25 bp, Mus musculus
gggtggaacagctcatgtacatcaa

SEQ ID NO: 641940 - DNA, 25 bp, Mus musculus
gggtggaagtctctccccaaggaca

SEQ ID NO: 641941 - DNA, 25 bp, Mus musculus
gggtggaagtctgtccccaaggaca

SEQ ID NO: 641942 - DNA, 25 bp, Mus musculus
gggtggaatacacatgcacagctcc

SEQ ID NO: 641943 - DNA, 25 bp, Mus musculus
gggtggaatacagatgcacagctcc

SEQ ID NO: 641944 - DNA, 25 bp, Mus musculus
gggtggaatggaaaagctattagct

SEQ ID NO: 641945 - DNA, 25 bp, Mus musculus
gggtggaatggataagctattagct

SEQ ID NO: 641946 - DNA, 25 bp, Mus musculus
gggtggacacaacaactgctggatc

SEQ ID NO: 641947 - DNA, 25 bp, Mus musculus
gggtggacacaagaactgctggatc

SEQ ID NO: 641948 - DNA, 25 bp, Mus musculus
gggtggacaccaatatcctagcagg

SEQ ID NO: 641949 - DNA, 25 bp, Mus musculus
gggtggacaccattatcctagcagg

SEQ ID NO: 641950 - DNA, 25 bp, Mus musculus
gggtggacatcaaagtctctgtaaa

SEQ ID NO: 641951 - DNA, 25 bp, Mus musculus
gggtggacatcaccgaccagctcaa

SEQ ID NO: 641952 - DNA, 25 bp, Mus musculus
gggtggacatcagcgaccagctcaa

SEQ ID NO: 641953 - DNA, 25 bp, Mus musculus
gggtggacatcatagtctctgtaaa

SEQ ID NO: 641954 - DNA, 25 bp, Mus musculus
gggtggacatggacccctgtgaaac

SEQ ID NO: 641955 - DNA, 25 bp, Mus musculus
gggtggacatggtcccctgtgaaac

SEQ ID NO: 641956 - DNA, 25 bp, Mus musculus
gggtggacatgtactccagacccag

SEQ ID NO: 641957 - DNA, 25 bp, Mus musculus
gggtggacatgttctccagacccag

SEQ ID NO: 641958 - DNA, 25 bp, Mus musculus
gggtggacccctctagcacctgaca

SEQ ID NO: 641959 - DNA, 25 bp, Mus musculus
gggtggacccctgtagcacctgaca

SEQ ID NO: 641960 - DNA, 25 bp, Mus musculus
gggtggacctatctgtgctacagcc

SEQ ID NO: 641961 - DNA, 25 bp, Mus musculus
gggtggacctatgtgtgctacagcc

SEQ ID NO: 641962 - DNA, 25 bp, Mus musculus
gggtggacctgacatgcagccttat

SEQ ID NO: 641963 - DNA, 25 bp, Mus musculus
gggtggacctgagatgcagccttat

SEQ ID NO: 641964 - DNA, 25 bp, Mus musculus
gggtggactatgcatgccccagatt

SEQ ID NO: 641965 - DNA, 25 bp, Mus musculus
gggtggactatggatgccccagatt

SEQ ID NO: 641966 - DNA, 25 bp, Mus musculus
gggtggactcaacttgctcaaaagt

SEQ ID NO: 641967 - DNA, 25 bp, Mus musculus
gggtggactcaagttgctcaaaagt

SEQ ID NO: 641968 - DNA, 25 bp, Mus musculus
gggtggactctaaccaggtgcacag

SEQ ID NO: 641969 - DNA, 25 bp, Mus musculus
gggtggactctatccaggtgcacag

SEQ ID NO: 641970 - DNA, 25 bp, Mus musculus
gggtggacttaccagtattgtccaa

SEQ ID NO: 641971 - DNA, 25 bp, Mus musculus
gggtggacttacgagtattgtccaa

SEQ ID NO: 641972 - DNA, 25 bp, Mus musculus
gggtggagaaatcccctccgtagct

SEQ ID NO: 641973 - DNA, 25 bp, Mus musculus
gggtggagaaatgccctccgtagct

SEQ ID NO: 641974 - DNA, 25 bp, Mus musculus
gggtggagcaggacatcttcatgtg

SEQ ID NO: 641975 - DNA, 25 bp, Mus musculus
gggtggagcaggtcatcttcatgtg

SEQ ID NO: 641976 - DNA, 25 bp, Mus musculus
gggtggagccaaacgggtcatcatc

SEQ ID NO: 641977 - DNA, 25 bp, Mus musculus
gggtggagccaatcgggtcatcatc

SEQ ID NO: 641978 - DNA, 25 bp, Mus musculus
gggtggagtccacagatcccaatga

SEQ ID NO: 641979 - DNA, 25 bp, Mus musculus
gggtggagtccagagatcccaatga

SEQ ID NO: 641980 - DNA, 25 bp, Mus musculus
gggtggataactacttttgttgcta

SEQ ID NO: 641981 - DNA, 25 bp, Mus musculus
gggtggataacttcttttgttgcta

SEQ ID NO: 641982 - DNA, 25 bp, Mus musculus
gggtggataccaacaaactcatcat

SEQ ID NO: 641983 - DNA, 25 bp, Mus musculus
gggtggataccatcaaactcatcat

SEQ ID NO: 641984 - DNA, 25 bp, Mus musculus
gggtggatacctacacatagttgtt

SEQ ID NO: 641985 - DNA, 25 bp, Mus musculus
gggtggataccttcacatagttgtt

SEQ ID NO: 641986 - DNA, 25 bp, Mus musculus
gggtggatacttatgtgagctaaat

SEQ ID NO: 641987 - DNA, 25 bp, Mus musculus
gggtggatacttttgtgagctaaat

SEQ ID NO: 641988 - DNA, 25 bp, Mus musculus
gggtggatccttctggtcaataaca

SEQ ID NO: 641989 - DNA, 25 bp, Mus musculus
gggtggatccttgtggtcaataaca

SEQ ID NO: 641990 - DNA, 25 bp, Mus musculus
gggtggatcgcaacatccgaagact

SEQ ID NO: 641991 - DNA, 25 bp, Mus musculus
gggtggatcgcatcatccgaagact

SEQ ID NO: 641992 - DNA, 25 bp, Mus musculus
gggtggatctagaatgtcttgctca

SEQ ID NO: 641993 - DNA, 25 bp, Mus musculus
gggtggatctagtatgtcttgctca

SEQ ID NO: 641994 - DNA, 25 bp, Mus musculus
gggtggatggtcacatttctgaaaa

SEQ ID NO: 641995 - DNA, 25 bp, Mus musculus
gggtggatggtcctgcaccatcttt

SEQ ID NO: 641996 - DNA, 25 bp, Mus musculus
gggtggatggtcgtgcaccatcttt

SEQ ID NO: 641997 - DNA, 25 bp, Mus musculus
gggtggatggtctcatttctgaaaa

SEQ ID NO: 641998 - DNA, 25 bp, Mus musculus
gggtggatgtctactaatggtaata

SEQ ID NO: 641999 - DNA, 25 bp, Mus musculus
gggtggatgtcttctaatggtaata

SEQ ID NO: 642000 - DNA, 25 bp, Mus musculus
gggtggattattatccctggatgcg

SEQ ID NO: 642001 - DNA, 25 bp, Mus musculus
gggtggattattttccctggatgcg

SEQ ID NO: 642002 - DNA, 25 bp, Mus musculus
gggtggatttggagctcagcctcct

SEQ ID NO: 642003 - DNA, 25 bp, Mus musculus
gggtggatttggtgctcagcctcct

SEQ ID NO: 642004 - DNA, 25 bp, Mus musculus
gggtggcaagatagtttctgtcccc

SEQ ID NO: 642005 - DNA, 25 bp, Mus musculus
gggtggcaagattgtttctgtcccc

SEQ ID NO: 642006 - DNA, 25 bp, Mus musculus
gggtggcaatgcattcttagggcat

SEQ ID NO: 642007 - DNA, 25 bp, Mus musculus
gggtggcaatgctttcttagggcat

SEQ ID NO: 642008 - DNA, 25 bp, Mus musculus
gggtggcacagcagcttgggtcccc

SEQ ID NO: 642009 - DNA, 25 bp, Mus musculus
gggtggcacagctgcttgggtcccc

SEQ ID NO: 642010 - DNA, 25 bp, Mus musculus
gggtggcaccacatatgagatttct

SEQ ID NO: 642011 - DNA, 25 bp, Mus musculus
gggtggcaccacttatgagatttct

SEQ ID NO: 642012 - DNA, 25 bp, Mus musculus
gggtggcactctaatgtatggctga

SEQ ID NO: 642013 - DNA, 25 bp, Mus musculus
gggtggcactcttatgtatggctga

SEQ ID NO: 642014 - DNA, 25 bp, Mus musculus
gggtggcactttaaagggcctgatc

SEQ ID NO: 642015 - DNA, 25 bp, Mus musculus
gggtggcacttttaagggcctgatc

SEQ ID NO: 642016 - DNA, 25 bp, Mus musculus
gggtggcagagcacttggctaccat

SEQ ID NO: 642017 - DNA, 25 bp, Mus musculus
gggtggcagagctcttggctaccat

SEQ ID NO: 642018 - DNA, 25 bp, Mus musculus
gggtggcagcacacaatgactgcat

SEQ ID NO: 642019 - DNA, 25 bp, Mus musculus
gggtggcagcactcaatgactgcat

SEQ ID NO: 642020 - DNA, 25 bp, Mus musculus
gggtggcagcttcgttagactaact

SEQ ID NO: 642021 - DNA, 25 bp, Mus musculus
gggtggcagcttctctcactaaaac

SEQ ID NO: 642022 - DNA, 25 bp, Mus musculus
gggtggcagcttggttagactaact

SEQ ID NO: 642023 - DNA, 25 bp, Mus musculus
gggtggcagcttgtctcactaaaac

SEQ ID NO: 642024 - DNA, 25 bp, Mus musculus
gggtggcatcacaagcctaagcgta

SEQ ID NO: 642025 - DNA, 25 bp, Mus musculus
gggtggcatcacagtcacatcgggc

SEQ ID NO: 642026 - DNA, 25 bp, Mus musculus
gggtggcatcactagcctaagcgta

SEQ ID NO: 642027 - DNA, 25 bp, Mus musculus
gggtggcatcactgtcacatcgggc

SEQ ID NO: 642028 - DNA, 25 bp, Mus musculus
gggtggcatgcccatctaacatgga

SEQ ID NO: 642029 - DNA, 25 bp, Mus musculus
gggtggcatgccgatctaacatgga

SEQ ID NO: 642030 - DNA, 25 bp, Mus musculus
gggtggcatgctactttgtctggtc

SEQ ID NO: 642031 - DNA, 25 bp, Mus musculus
gggtggcatgcttctttgtctggtc

SEQ ID NO: 642032 - DNA, 25 bp, Mus musculus
gggtggcattcacaattacatttgc

SEQ ID NO: 642033 - DNA, 25 bp, Mus musculus
gggtggcattcagaattacatttgc

SEQ ID NO: 642034 - DNA, 25 bp, Mus musculus
gggtggccaaatcgtcattacacag

SEQ ID NO: 642035 - DNA, 25 bp, Mus musculus
gggtggccaaatggtcattacacag

SEQ ID NO: 642036 - DNA, 25 bp, Mus musculus
gggtggccactcagctacggtttgc

SEQ ID NO: 642037 - DNA, 25 bp, Mus musculus
gggtggccactctgctacggtttgc

SEQ ID NO: 642038 - DNA, 25 bp, Mus musculus
gggtggccagccaggcccttagact

SEQ ID NO: 642039 - DNA, 25 bp, Mus musculus
gggtggccagcctggcccttagact

SEQ ID NO: 642040 - DNA, 25 bp, Mus musculus
gggtggccccacctacaatgagctg

SEQ ID NO: 642041 - DNA, 25 bp, Mus musculus
gggtggccccacgtacaatgagctg

SEQ ID NO: 642042 - DNA, 25 bp, Mus musculus
gggtggccctacatttttgatgcgg

SEQ ID NO: 642043 - DNA, 25 bp, Mus musculus
gggtggccctacttttttgatgcgg

SEQ ID NO: 642044 - DNA, 25 bp, Mus musculus
gggtggccctctagtgtgacatcaa

SEQ ID NO: 642045 - DNA, 25 bp, Mus musculus
gggtggccctcttgtgtgacatcaa

SEQ ID NO: 642046 - DNA, 25 bp, Mus musculus
gggtggccctgaattcatcaggata

SEQ ID NO: 642047 - DNA, 25 bp, Mus musculus
gggtggccctgatttcatcaggata

SEQ ID NO: 642048 - DNA, 25 bp, Mus musculus
gggtggcctactaagatgacattgc

SEQ ID NO: 642049 - DNA, 25 bp, Mus musculus
gggtggcctacttagatgacattgc

SEQ ID NO: 642050 - DNA, 25 bp, Mus musculus
gggtggcctttaagaggattgttca

SEQ ID NO: 642051 - DNA, 25 bp, Mus musculus
gggtggcctttatgaggattgttca

SEQ ID NO: 642052 - DNA, 25 bp, Mus musculus
gggtggcctttgagcaatctgcctt

SEQ ID NO: 642053 - DNA, 25 bp, Mus musculus
gggtggcctttgtgcaatctgcctt

SEQ ID NO: 642054 - DNA, 25 bp, Mus musculus
gggtggcgaataacaactccataaa

SEQ ID NO: 642055 - DNA, 25 bp, Mus musculus
gggtggcgaatatcaactccataaa

SEQ ID NO: 642056 - DNA, 25 bp, Mus musculus
gggtggcgtttgatccagaacgcca

SEQ ID NO: 642057 - DNA, 25 bp, Mus musculus
gggtggcgtttgttccagaacgcca

SEQ ID NO: 642058 - DNA, 25 bp, Mus musculus
gggtggctacaaatcctgcaagaga

SEQ ID NO: 642059 - DNA, 25 bp, Mus musculus
gggtggctacaattcctgcaagaga

SEQ ID NO: 642060 - DNA, 25 bp, Mus musculus
gggtggctaccactcagggcctaaa

SEQ ID NO: 642061 - DNA, 25 bp, Mus musculus
gggtggctaccagtcagggcctaaa

SEQ ID NO: 642062 - DNA, 25 bp, Mus musculus
gggtggctagtgagagacattcccc

SEQ ID NO: 642063 - DNA, 25 bp, Mus musculus
gggtggctagtgtgagacattcccc

SEQ ID NO: 642064 - DNA, 25 bp, Mus musculus
gggtggctcacgaatttattgtcga

SEQ ID NO: 642065 - DNA, 25 bp, Mus musculus
gggtggctcacgtatttattgtcga

SEQ ID NO: 642066 - DNA, 25 bp, Mus musculus
gggtggctccatactatgtaactga

SEQ ID NO: 642067 - DNA, 25 bp, Mus musculus
gggtggctccattctatgtaactga

SEQ ID NO: 642068 - DNA, 25 bp, Mus musculus
gggtggctcttcagtggtttctctg

SEQ ID NO: 642069 - DNA, 25 bp, Mus musculus
gggtggctcttctgtggtttctctg

SEQ ID NO: 642070 - DNA, 25 bp, Mus musculus
gggtggctgcttaggtattactgat

SEQ ID NO: 642071 - DNA, 25 bp, Mus musculus
gggtggctgctttggtattactgat

SEQ ID NO: 642072 - DNA, 25 bp, Mus musculus
gggtggctggagaactacactgcat

SEQ ID NO: 642073 - DNA, 25 bp, Mus musculus
gggtggctggagtactacactgcat

SEQ ID NO: 642074 - DNA, 25 bp, Mus musculus
gggtggctggctatgaaaattgaat

SEQ ID NO: 642075 - DNA, 25 bp, Mus musculus
gggtggctggctttgaaaattgaat

SEQ ID NO: 642076 - DNA, 25 bp, Mus musculus
gggtggctgtaccttcacatatgat

SEQ ID NO: 642077 - DNA, 25 bp, Mus musculus
gggtggctgtacgttcacatatgat

SEQ ID NO: 642078 - DNA, 25 bp, Mus musculus
gggtggcttccacgcatattttgag

SEQ ID NO: 642079 - DNA, 25 bp, Mus musculus
gggtggcttccaggcatattttgag

SEQ ID NO: 642080 - DNA, 25 bp, Mus musculus
gggtggcttcgcatcgttagatact

SEQ ID NO: 642081 - DNA, 25 bp, Mus musculus
gggtggcttcgcttcgttagatact

SEQ ID NO: 642082 - DNA, 25 bp, Mus musculus
gggtggctttcacgtctacattgat

SEQ ID NO: 642083 - DNA, 25 bp, Mus musculus
gggtggctttcactcagatacaagc

SEQ ID NO: 642084 - DNA, 25 bp, Mus musculus
gggtggctttcaggtctacattgat

SEQ ID NO: 642085 - DNA, 25 bp, Mus musculus
gggtggctttcagtcagatacaagc

SEQ ID NO: 642086 - DNA, 25 bp, Mus musculus
gggtggctttccactagtgaagcac

SEQ ID NO: 642087 - DNA, 25 bp, Mus musculus
gggtggctttcctctagtgaagcac

SEQ ID NO: 642088 - DNA, 25 bp, Mus musculus
gggtggctttggaactcagagtcct

SEQ ID NO: 642089 - DNA, 25 bp, Mus musculus
gggtggctttggtactcagagtcct

SEQ ID NO: 642090 - DNA, 25 bp, Mus musculus
gggtggctttttcatactactgtta

SEQ ID NO: 642091 - DNA, 25 bp, Mus musculus
gggtggctttttgatactactgtta

SEQ ID NO: 642092 - DNA, 25 bp, Mus musculus
gggtgggaatcaagccatagctttc

SEQ ID NO: 642093 - DNA, 25 bp, Mus musculus
gggtgggaatcatgccatagctttc

SEQ ID NO: 642094 - DNA, 25 bp, Mus musculus
gggtgggacactctgatcctttctc

SEQ ID NO: 642095 - DNA, 25 bp, Mus musculus
gggtgggacactgtgatcctttctc

SEQ ID NO: 642096 - DNA, 25 bp, Mus musculus
gggtgggaccacagatacaactata

SEQ ID NO: 642097 - DNA, 25 bp, Mus musculus
gggtgggaccactgatacaactata

SEQ ID NO: 642098 - DNA, 25 bp, Mus musculus
gggtgggactgtactcttaaattct

SEQ ID NO: 642099 - DNA, 25 bp, Mus musculus
gggtgggactgttctcttaaattct

SEQ ID NO: 642100 - DNA, 25 bp, Mus musculus
gggtgggactttctgttactaacag

SEQ ID NO: 642101 - DNA, 25 bp, Mus musculus
gggtgggactttgtgttactaacag

SEQ ID NO: 642102 - DNA, 25 bp, Mus musculus
gggtgggagcccatggttccccaca

SEQ ID NO: 642103 - DNA, 25 bp, Mus musculus
gggtgggagcccttggttccccaca

SEQ ID NO: 642104 - DNA, 25 bp, Mus musculus
gggtgggaggacatcacaatctctt

SEQ ID NO: 642105 - DNA, 25 bp, Mus musculus
gggtgggaggacttcacaatctctt

SEQ ID NO: 642106 - DNA, 25 bp, Mus musculus
gggtgggatctaaattaacttacat

SEQ ID NO: 642107 - DNA, 25 bp, Mus musculus
gggtgggatctatattaacttacat

SEQ ID NO: 642108 - DNA, 25 bp, Mus musculus
gggtgggatgtcatgcttatttgaa

SEQ ID NO: 642109 - DNA, 25 bp, Mus musculus
gggtgggatgtcttgcttatttgaa

SEQ ID NO: 642110 - DNA, 25 bp, Mus musculus
gggtgggcaccaatctatggaacag

SEQ ID NO: 642111 - DNA, 25 bp, Mus musculus
gggtgggcaccattctatggaacag

SEQ ID NO: 642112 - DNA, 25 bp, Mus musculus
gggtgggcacgcacatccgcgccaa

SEQ ID NO: 642113 - DNA, 25 bp, Mus musculus
gggtgggcacgctcatccgcgccaa

SEQ ID NO: 642114 - DNA, 25 bp, Mus musculus
gggtgggcacttattcctgttcttt

SEQ ID NO: 642115 - DNA, 25 bp, Mus musculus
gggtgggcactttttcctgttcttt

SEQ ID NO: 642116 - DNA, 25 bp, Mus musculus
gggtgggcaggcaaaactctaaatg

SEQ ID NO: 642117 - DNA, 25 bp, Mus musculus
gggtgggcaggctaaactctaaatg

SEQ ID NO: 642118 - DNA, 25 bp, Mus musculus
gggtgggcagtcaatgtatacatgt

SEQ ID NO: 642119 - DNA, 25 bp, Mus musculus
gggtgggcagtctatgtatacatgt

SEQ ID NO: 642120 - DNA, 25 bp, Mus musculus
gggtgggccgtgacagtccccacag

SEQ ID NO: 642121 - DNA, 25 bp, Mus musculus
gggtgggccgtgtcagtccccacag

SEQ ID NO: 642122 - DNA, 25 bp, Mus musculus
gggtgggcctagcataaactgtaaa

SEQ ID NO: 642123 - DNA, 25 bp, Mus musculus
gggtgggcctaggataaactgtaaa

SEQ ID NO: 642124 - DNA, 25 bp, Mus musculus
gggtgggctggtcacccagcaaggg

SEQ ID NO: 642125 - DNA, 25 bp, Mus musculus
gggtgggctggtgacccagcaaggg

SEQ ID NO: 642126 - DNA, 25 bp, Mus musculus
gggtgggtaagaataatactgtata

SEQ ID NO: 642127 - DNA, 25 bp, Mus musculus
gggtgggtaagattaatactgtata

SEQ ID NO: 642128 - DNA, 25 bp, Mus musculus
gggtgggtaccacccatactgagaa

SEQ ID NO: 642129 - DNA, 25 bp, Mus musculus
gggtgggtaccagccatactgagaa

SEQ ID NO: 642130 - DNA, 25 bp, Mus musculus
gggtgggtcactagcctaatacagc

SEQ ID NO: 642131 - DNA, 25 bp, Mus musculus
gggtgggtcacttgcctaatacagc

SEQ ID NO: 642132 - DNA, 25 bp, Mus musculus
gggtgggtctcactgaaatgcaaca

SEQ ID NO: 642133 - DNA, 25 bp, Mus musculus
gggtgggtctcagtgaaatgcaaca

SEQ ID NO: 642134 - DNA, 25 bp, Mus musculus
gggtgggtcttcagaccgcaaaaca

SEQ ID NO: 642135 - DNA, 25 bp, Mus musculus
gggtgggtcttctgaccgcaaaaca

SEQ ID NO: 642136 - DNA, 25 bp, Mus musculus
gggtgggtgaacaacacattccagg

SEQ ID NO: 642137 - DNA, 25 bp, Mus musculus
gggtgggtgaactacacattccagg

SEQ ID NO: 642138 - DNA, 25 bp, Mus musculus
gggtgggtgcccaggacatacaaat

SEQ ID NO: 642139 - DNA, 25 bp, Mus musculus
gggtgggtgccctggacatacaaat

SEQ ID NO: 642140 - DNA, 25 bp, Mus musculus
gggtgggtgcgccatcttcctttcc

SEQ ID NO: 642141 - DNA, 25 bp, Mus musculus
gggtgggtgcgcgatcttcctttcc

SEQ ID NO: 642142 - DNA, 25 bp, Mus musculus
gggtgggtgctcaaagaccattaca

SEQ ID NO: 642143 - DNA, 25 bp, Mus musculus
gggtgggtgctctaagaccattaca

SEQ ID NO: 642144 - DNA, 25 bp, Mus musculus
gggtgggttccgactctgtctcaaa

SEQ ID NO: 642145 - DNA, 25 bp, Mus musculus
gggtgggttccgtctctgtctcaaa

SEQ ID NO: 642146 - DNA, 25 bp, Mus musculus
gggtgggtttgcattaacatagtgt

SEQ ID NO: 642147 - DNA, 25 bp, Mus musculus
gggtgggtttgctttaacatagtgt

SEQ ID NO: 642148 - DNA, 25 bp, Mus musculus
gggtggtaaatacggccattcctgt

SEQ ID NO: 642149 - DNA, 25 bp, Mus musculus
gggtggtaaatagggccattcctgt

SEQ ID NO: 642150 - DNA, 25 bp, Mus musculus
gggtggtacagtctgttcacgtcac

SEQ ID NO: 642151 - DNA, 25 bp, Mus musculus
gggtggtacagtgtgttcacgtcac

SEQ ID NO: 642152 - DNA, 25 bp, Mus musculus
gggtggtacataaaagcctcctgat

SEQ ID NO: 642153 - DNA, 25 bp, Mus musculus
gggtggtacatataagcctcctgat

SEQ ID NO: 642154 - DNA, 25 bp, Mus musculus
gggtggtacctaaattttaatactg

SEQ ID NO: 642155 - DNA, 25 bp, Mus musculus
gggtggtacctatattttaatactg

SEQ ID NO: 642156 - DNA, 25 bp, Mus musculus
gggtggtactgacactctacaaagt

SEQ ID NO: 642157 - DNA, 25 bp, Mus musculus
gggtggtactgagactctacaaagt

SEQ ID NO: 642158 - DNA, 25 bp, Mus musculus
gggtggtagaatatcactcctgcta

SEQ ID NO: 642159 - DNA, 25 bp, Mus musculus
gggtggtagaatttcactcctgcta

SEQ ID NO: 642160 - DNA, 25 bp, Mus musculus
gggtggtagctcattactttcctgt

SEQ ID NO: 642161 - DNA, 25 bp, Mus musculus
gggtggtagctctttactttcctgt

SEQ ID NO: 642162 - DNA, 25 bp, Mus musculus
gggtggtatcaacctgctattgcgc

SEQ ID NO: 642163 - DNA, 25 bp, Mus musculus
gggtggtatcaagctgctattgcgc

SEQ ID NO: 642164 - DNA, 25 bp, Mus musculus
gggtggtatgtacaacattgtgcat

SEQ ID NO: 642165 - DNA, 25 bp, Mus musculus
gggtggtatgtagaacattgtgcat

SEQ ID NO: 642166 - DNA, 25 bp, Mus musculus
gggtggtcaaccattcctcaatagc

SEQ ID NO: 642167 - DNA, 25 bp, Mus musculus
gggtggtcaacctttcctcaatagc

SEQ ID NO: 642168 - DNA, 25 bp, Mus musculus
gggtggtcacaaatctgggctagcc

SEQ ID NO: 642169 - DNA, 25 bp, Mus musculus
gggtggtcacaattctgggctagcc

SEQ ID NO: 642170 - DNA, 25 bp, Mus musculus
gggtggtcagaaatgtttcccattc

SEQ ID NO: 642171 - DNA, 25 bp, Mus musculus
gggtggtcagaattgtttcccattc

SEQ ID NO: 642172 - DNA, 25 bp, Mus musculus
gggtggtcagcaaacaccatctgtt

SEQ ID NO: 642173 - DNA, 25 bp, Mus musculus
gggtggtcagcatacaccatctgtt

SEQ ID NO: 642174 - DNA, 25 bp, Mus musculus
gggtggtccctgaatttatagaaat

SEQ ID NO: 642175 - DNA, 25 bp, Mus musculus
gggtggtccctgtatttatagaaat

SEQ ID NO: 642176 - DNA, 25 bp, Mus musculus
gggtggtccgctaaaaggtctcctg

SEQ ID NO: 642177 - DNA, 25 bp, Mus musculus
gggtggtccgcttaaaggtctcctg

SEQ ID NO: 642178 - DNA, 25 bp, Mus musculus
gggtggtccggcattatcacagtct

SEQ ID NO: 642179 - DNA, 25 bp, Mus musculus
gggtggtccggctttatcacagtct

SEQ ID NO: 642180 - DNA, 25 bp, Mus musculus
gggtggtcgtcactgtgattaatct

SEQ ID NO: 642181 - DNA, 25 bp, Mus musculus
gggtggtcgtcagtgtgattaatct

SEQ ID NO: 642182 - DNA, 25 bp, Mus musculus
gggtggtctcctaattccatagata

SEQ ID NO: 642183 - DNA, 25 bp, Mus musculus
gggtggtctccttattccatagata

SEQ ID NO: 642184 - DNA, 25 bp, Mus musculus
gggtggtctgctcacagccaaatgt

SEQ ID NO: 642185 - DNA, 25 bp, Mus musculus
gggtggtctgctgacagccaaatgt

SEQ ID NO: 642186 - DNA, 25 bp, Mus musculus
gggtggtcttccaccacagatccta

SEQ ID NO: 642187 - DNA, 25 bp, Mus musculus
gggtggtcttcctccacagatccta

SEQ ID NO: 642188 - DNA, 25 bp, Mus musculus
gggtggtgaccacacttacctgcct

SEQ ID NO: 642189 - DNA, 25 bp, Mus musculus
gggtggtgaccagacttacctgcct

SEQ ID NO: 642190 - DNA, 25 bp, Mus musculus
gggtggtgactcagtggctgcttcc

SEQ ID NO: 642191 - DNA, 25 bp, Mus musculus
gggtggtgactctgtggctgcttcc

SEQ ID NO: 642192 - DNA, 25 bp, Mus musculus
gggtggtgacttaacacgccataat

SEQ ID NO: 642193 - DNA, 25 bp, Mus musculus
gggtggtgactttacacgccataat

SEQ ID NO: 642194 - DNA, 25 bp, Mus musculus
gggtggtgcaggaccagtactccct

SEQ ID NO: 642195 - DNA, 25 bp, Mus musculus
gggtggtgcaggtccagtactccct

SEQ ID NO: 642196 - DNA, 25 bp, Mus musculus
gggtggtgcttcagatgtctctgcc

SEQ ID NO: 642197 - DNA, 25 bp, Mus musculus
gggtggtgcttctgatgtctctgcc

SEQ ID NO: 642198 - DNA, 25 bp, Mus musculus
gggtggtggaaaatcgatcccaaat

SEQ ID NO: 642199 - DNA, 25 bp, Mus musculus
gggtggtggaaattcgatcccaaat

SEQ ID NO: 642200 - DNA, 25 bp, Mus musculus
gggtggtggaccacttggccaaaat

SEQ ID NO: 642201 - DNA, 25 bp, Mus musculus
gggtggtggacctcttggccaaaat

SEQ ID NO: 642202 - DNA, 25 bp, Mus musculus
gggtggtggtacacaacctctcggt

SEQ ID NO: 642203 - DNA, 25 bp, Mus musculus
gggtggtggtactcaacctctcggt

SEQ ID NO: 642204 - DNA, 25 bp, Mus musculus
gggtggtggtctaacatacaacatc

SEQ ID NO: 642205 - DNA, 25 bp, Mus musculus
gggtggtggtcttacatacaacatc

SEQ ID NO: 642206 - DNA, 25 bp, Mus musculus
gggtggtgtaatactggtatctcat

SEQ ID NO: 642207 - DNA, 25 bp, Mus musculus
gggtggtgtaattctggtatctcat

SEQ ID NO: 642208 - DNA, 25 bp, Mus musculus
gggtggtgtttcattagcatagctg

SEQ ID NO: 642209 - DNA, 25 bp, Mus musculus
gggtggtgtttctttagcatagctg

SEQ ID NO: 642210 - DNA, 25 bp, Mus musculus
gggtggttatatcccatgtgtcaac

SEQ ID NO: 642211 - DNA, 25 bp, Mus musculus
gggtggttatatgccatgtgtcaac

SEQ ID NO: 642212 - DNA, 25 bp, Mus musculus
gggtggttattaaacagttcctcaa

SEQ ID NO: 642213 - DNA, 25 bp, Mus musculus
gggtggttattatacagttcctcaa

SEQ ID NO: 642214 - DNA, 25 bp, Mus musculus
gggtggttccacctcgatgtccaca

SEQ ID NO: 642215 - DNA, 25 bp, Mus musculus
gggtggttccacgtcgatgtccaca

SEQ ID NO: 642216 - DNA, 25 bp, Mus musculus
gggtggttccttacctaccatcact

SEQ ID NO: 642217 - DNA, 25 bp, Mus musculus
gggtggttcctttcctaccatcact

SEQ ID NO: 642218 - DNA, 25 bp, Mus musculus
gggtggttcttcataattctgtata

SEQ ID NO: 642219 - DNA, 25 bp, Mus musculus
gggtggttcttcttaattctgtata

SEQ ID NO: 642220 - DNA, 25 bp, Mus musculus
gggtggttggccagggtggcccgag

SEQ ID NO: 642221 - DNA, 25 bp, Mus musculus
gggtggttggcctgggtggcccgag

SEQ ID NO: 642222 - DNA, 25 bp, Mus musculus
gggtggtttcgaagtgtgtcttcct

SEQ ID NO: 642223 - DNA, 25 bp, Mus musculus
gggtggtttcgatgtgtgtcttcct

SEQ ID NO: 642224 - DNA, 25 bp, Mus musculus
gggtggtttgctatgccatgatact

SEQ ID NO: 642225 - DNA, 25 bp, Mus musculus
gggtggtttgctttgccatgatact

SEQ ID NO: 642226 - DNA, 25 bp, Mus musculus
gggtggtttgtacattcaagtttga

SEQ ID NO: 642227 - DNA, 25 bp, Mus musculus
gggtggtttgtagattcaagtttga

SEQ ID NO: 642228 - DNA, 25 bp, Mus musculus
gggtggttttcactgacaactcctt

SEQ ID NO: 642229 - DNA, 25 bp, Mus musculus
gggtggttttcagtgacaactcctt

SEQ ID NO: 642230 - DNA, 25 bp, Mus musculus
gggtggtttttcaacactgggacat

SEQ ID NO: 642231 - DNA, 25 bp, Mus musculus
gggtggtttttctacactgggacat

SEQ ID NO: 642232 - DNA, 25 bp, Mus musculus
gggtgtaaatctaactgctagactg

SEQ ID NO: 642233 - DNA, 25 bp, Mus musculus
gggtgtaaatcttactgctagactg

SEQ ID NO: 642234 - DNA, 25 bp, Mus musculus
gggtgtaaccaaaggctttctcata

SEQ ID NO: 642235 - DNA, 25 bp, Mus musculus
gggtgtaaccaatggctttctcata

SEQ ID NO: 642236 - DNA, 25 bp, Mus musculus
gggtgtaaccttcagaccatatacc

SEQ ID NO: 642237 - DNA, 25 bp, Mus musculus
gggtgtaaccttgagaccatatacc

SEQ ID NO: 642238 - DNA, 25 bp, Mus musculus
gggtgtaactagctctggaggcagt

SEQ ID NO: 642239 - DNA, 25 bp, Mus musculus
gggtgtaactaggtctggaggcagt

SEQ ID NO: 642240 - DNA, 25 bp, Mus musculus
gggtgtaactccactctgcgtgcac

SEQ ID NO: 642241 - DNA, 25 bp, Mus musculus
gggtgtaactcctctctgcgtgcac

SEQ ID NO: 642242 - DNA, 25 bp, Mus musculus
gggtgtaactgacttccttgggcca

SEQ ID NO: 642243 - DNA, 25 bp, Mus musculus
gggtgtaactgagttccttgggcca

SEQ ID NO: 642244 - DNA, 25 bp, Mus musculus
gggtgtaagagtctcctgcattcat

SEQ ID NO: 642245 - DNA, 25 bp, Mus musculus
gggtgtaagagtgtcctgcattcat

SEQ ID NO: 642246 - DNA, 25 bp, Mus musculus
gggtgtacaacaccgcttgcaagag

SEQ ID NO: 642247 - DNA, 25 bp, Mus musculus
gggtgtacaacagcgcttgcaagag

SEQ ID NO: 642248 - DNA, 25 bp, Mus musculus
gggtgtacaactcaggttcttccag

SEQ ID NO: 642249 - DNA, 25 bp, Mus musculus
gggtgtacaactgaggttcttccag

SEQ ID NO: 642250 - DNA, 25 bp, Mus musculus
gggtgtacacagatgaggtcatcag

SEQ ID NO: 642251 - DNA, 25 bp, Mus musculus
gggtgtacacagttgaggtcatcag

SEQ ID NO: 642252 - DNA, 25 bp, Mus musculus
gggtgtacagcacactcagtgtttt

SEQ ID NO: 642253 - DNA, 25 bp, Mus musculus
gggtgtacagcagactcagtgtttt

SEQ ID NO: 642254 - DNA, 25 bp, Mus musculus
gggtgtacatagacttcatagagct

SEQ ID NO: 642255 - DNA, 25 bp, Mus musculus
gggtgtacatagtcttcatagagct

SEQ ID NO: 642256 - DNA, 25 bp, Mus musculus
gggtgtacattcagtccatatgttc

SEQ ID NO: 642257 - DNA, 25 bp, Mus musculus
gggtgtacattctgtccatatgttc

SEQ ID NO: 642258 - DNA, 25 bp, Mus musculus
gggtgtacatttaccagattgttgc

SEQ ID NO: 642259 - DNA, 25 bp, Mus musculus
gggtgtacattttccagattgttgc

SEQ ID NO: 642260 - DNA, 25 bp, Mus musculus
gggtgtactgggatccaactcaata

SEQ ID NO: 642261 - DNA, 25 bp, Mus musculus
gggtgtactgggttccaactcaata

SEQ ID NO: 642262 - DNA, 25 bp, Mus musculus
gggtgtagacacaactgaaaacgtg

SEQ ID NO: 642263 - DNA, 25 bp, Mus musculus
gggtgtagacactactgaaaacgtg

SEQ ID NO: 642264 - DNA, 25 bp, Mus musculus
gggtgtagaccccatagtctccttt

SEQ ID NO: 642265 - DNA, 25 bp, Mus musculus
gggtgtagacccgatagtctccttt

SEQ ID NO: 642266 - DNA, 25 bp, Mus musculus
gggtgtagactgatgcagtgccttc

SEQ ID NO: 642267 - DNA, 25 bp, Mus musculus
gggtgtagactgttgcagtgccttc

SEQ ID NO: 642268 - DNA, 25 bp, Mus musculus
gggtgtagcactaggcactgcaatt

SEQ ID NO: 642269 - DNA, 25 bp, Mus musculus
gggtgtagcacttggcactgcaatt

SEQ ID NO: 642270 - DNA, 25 bp, Mus musculus
gggtgtagcgagatcagcatcgccc

SEQ ID NO: 642271 - DNA, 25 bp, Mus musculus
gggtgtagcgagttcagcatcgccc

SEQ ID NO: 642272 - DNA, 25 bp, Mus musculus
gggtgtagctcgatatactagagtt

SEQ ID NO: 642273 - DNA, 25 bp, Mus musculus
gggtgtagctcgttatactagagtt

SEQ ID NO: 642274 - DNA, 25 bp, Mus musculus
gggtgtagcttcacggcagagcact

SEQ ID NO: 642275 - DNA, 25 bp, Mus musculus
gggtgtagcttctcggcagagcact

SEQ ID NO: 642276 - DNA, 25 bp, Mus musculus
gggtgtaggctgagttcttctgtaa

SEQ ID NO: 642277 - DNA, 25 bp, Mus musculus
gggtgtaggctgtgttcttctgtaa

SEQ ID NO: 642278 - DNA, 25 bp, Mus musculus
gggtgtagtcccatatcagcatggc

SEQ ID NO: 642279 - DNA, 25 bp, Mus musculus
gggtgtagtcccttatcagcatggc

SEQ ID NO: 642280 - DNA, 25 bp, Mus musculus
gggtgtagtctgattagaatccgta

SEQ ID NO: 642281 - DNA, 25 bp, Mus musculus
gggtgtagtctgtttagaatccgta

SEQ ID NO: 642282 - DNA, 25 bp, Mus musculus
gggtgtagtggaacatacctataac

SEQ ID NO: 642283 - DNA, 25 bp, Mus musculus
gggtgtagtggatcatacctataac

SEQ ID NO: 642284 - DNA, 25 bp, Mus musculus
gggtgtatagggaattctctggcaa

SEQ ID NO: 642285 - DNA, 25 bp, Mus musculus
gggtgtatagggtattctctggcaa

SEQ ID NO: 642286 - DNA, 25 bp, Mus musculus
gggtgtatcctacacagaagccata

SEQ ID NO: 642287 - DNA, 25 bp, Mus musculus
gggtgtatcctagacagaagccata

SEQ ID NO: 642288 - DNA, 25 bp, Mus musculus
gggtgtatgcttctattttgtctga

SEQ ID NO: 642289 - DNA, 25 bp, Mus musculus
gggtgtatgcttgtattttgtctga

SEQ ID NO: 642290 - DNA, 25 bp, Mus musculus
gggtgtattgccatcttaatcttta

SEQ ID NO: 642291 - DNA, 25 bp, Mus musculus
gggtgtattgccttcttaatcttta

SEQ ID NO: 642292 - DNA, 25 bp, Mus musculus
gggtgtcaacgtacagttattaatc

SEQ ID NO: 642293 - DNA, 25 bp, Mus musculus
gggtgtcaacgttcagttattaatc

SEQ ID NO: 642294 - DNA, 25 bp, Mus musculus
gggtgtcaactcacattgtcttgcg

SEQ ID NO: 642295 - DNA, 25 bp, Mus musculus
gggtgtcaactctcattgtcttgcg

SEQ ID NO: 642296 - DNA, 25 bp, Mus musculus
gggtgtcaacttatcatcttctgag

SEQ ID NO: 642297 - DNA, 25 bp, Mus musculus
gggtgtcaacttttcatcttctgag

SEQ ID NO: 642298 - DNA, 25 bp, Mus musculus
gggtgtcaagataggcgtcaaagct

SEQ ID NO: 642299 - DNA, 25 bp, Mus musculus
gggtgtcaagattggcgtcaaagct

SEQ ID NO: 642300 - DNA, 25 bp, Mus musculus
gggtgtcacacaaggccatcgtgga

SEQ ID NO: 642301 - DNA, 25 bp, Mus musculus
gggtgtcacacatggccatcgtgga

SEQ ID NO: 642302 - DNA, 25 bp, Mus musculus
gggtgtcaccaacaagtggccccaa

SEQ ID NO: 642303 - DNA, 25 bp, Mus musculus
gggtgtcaccaagaagtggccccaa

SEQ ID NO: 642304 - DNA, 25 bp, Mus musculus
gggtgtcaccataaggccaaagcat

SEQ ID NO: 642305 - DNA, 25 bp, Mus musculus
gggtgtcaccattaggccaaagcat

SEQ ID NO: 642306 - DNA, 25 bp, Mus musculus
gggtgtcagatcctggcattaagac

SEQ ID NO: 642307 - DNA, 25 bp, Mus musculus
gggtgtcagatcgtggcattaagac

SEQ ID NO: 642308 - DNA, 25 bp, Mus musculus
gggtgtcagctcataacatctctaa

SEQ ID NO: 642309 - DNA, 25 bp, Mus musculus
gggtgtcagctcttaacatctctaa

SEQ ID NO: 642310 - DNA, 25 bp, Mus musculus
gggtgtcaggcactcattttagatc

SEQ ID NO: 642311 - DNA, 25 bp, Mus musculus
gggtgtcaggcagtcattttagatc

SEQ ID NO: 642312 - DNA, 25 bp, Mus musculus
gggtgtcataatatccatttgagac

SEQ ID NO: 642313 - DNA, 25 bp, Mus musculus
gggtgtcataatttccatttgagac

SEQ ID NO: 642314 - DNA, 25 bp, Mus musculus
gggtgtcatctcctatagcttcgga

SEQ ID NO: 642315 - DNA, 25 bp, Mus musculus
gggtgtcatctcgtatagcttcgga

SEQ ID NO: 642316 - DNA, 25 bp, Mus musculus
gggtgtcatgaacctccactgagtg

SEQ ID NO: 642317 - DNA, 25 bp, Mus musculus
gggtgtcatgaagctccactgagtg

SEQ ID NO: 642318 - DNA, 25 bp, Mus musculus
gggtgtcatggcactggctaacctc

SEQ ID NO: 642319 - DNA, 25 bp, Mus musculus
gggtgtcatggctctggctaacctc

SEQ ID NO: 642320 - DNA, 25 bp, Mus musculus
gggtgtcatgtacttatgacgcctt

SEQ ID NO: 642321 - DNA, 25 bp, Mus musculus
gggtgtcatgtagttatgacgcctt

SEQ ID NO: 642322 - DNA, 25 bp, Mus musculus
gggtgtcattgcacatagttctttc

SEQ ID NO: 642323 - DNA, 25 bp, Mus musculus
gggtgtcattgctcatagttctttc

SEQ ID NO: 642324 - DNA, 25 bp, Mus musculus
gggtgtccaaacagcatcgagtgct

SEQ ID NO: 642325 - DNA, 25 bp, Mus musculus
gggtgtccaaactgcatcgagtgct

SEQ ID NO: 642326 - DNA, 25 bp, Mus musculus
gggtgtccaaccagcgctacaacca

SEQ ID NO: 642327 - DNA, 25 bp, Mus musculus
gggtgtccaacctgcgctacaacca

SEQ ID NO: 642328 - DNA, 25 bp, Mus musculus
gggtgtccaattcctagctacgaag

SEQ ID NO: 642329 - DNA, 25 bp, Mus musculus
gggtgtccaattgctagctacgaag

SEQ ID NO: 642330 - DNA, 25 bp, Mus musculus
gggtgtccacacctgagagactgac

SEQ ID NO: 642331 - DNA, 25 bp, Mus musculus
gggtgtccacacgtgagagactgac

SEQ ID NO: 642332 - DNA, 25 bp, Mus musculus
gggtgtccatgacctgctgatcaga

SEQ ID NO: 642333 - DNA, 25 bp, Mus musculus
gggtgtccatgagctgctgatcaga

SEQ ID NO: 642334 - DNA, 25 bp, Mus musculus
gggtgtccccaaaaatgcagttact

SEQ ID NO: 642335 - DNA, 25 bp, Mus musculus
gggtgtccccaataatgcagttact

SEQ ID NO: 642336 - DNA, 25 bp, Mus musculus
gggtgtccctatccctagactactt

SEQ ID NO: 642337 - DNA, 25 bp, Mus musculus
gggtgtccctatgcctagactactt

SEQ ID NO: 642338 - DNA, 25 bp, Mus musculus
gggtgtcctatgatgactctggttg

SEQ ID NO: 642339 - DNA, 25 bp, Mus musculus
gggtgtcctatgttgactctggttg

SEQ ID NO: 642340 - DNA, 25 bp, Mus musculus
gggtgtcctgatcattttcgatgaa

SEQ ID NO: 642341 - DNA, 25 bp, Mus musculus
gggtgtcctgatgattttcgatgaa

SEQ ID NO: 642342 - DNA, 25 bp, Mus musculus
gggtgtcctggcaactacacttggc

SEQ ID NO: 642343 - DNA, 25 bp, Mus musculus
gggtgtcctggctactacacttggc

SEQ ID NO: 642344 - DNA, 25 bp, Mus musculus
gggtgtccttgaagatttggaaatt

SEQ ID NO: 642345 - DNA, 25 bp, Mus musculus
gggtgtccttgatgatttggaaatt

SEQ ID NO: 642346 - DNA, 25 bp, Mus musculus
gggtgtcctttccaagctgctctgt

SEQ ID NO: 642347 - DNA, 25 bp, Mus musculus
gggtgtcctttcgaagctgctctgt

SEQ ID NO: 642348 - DNA, 25 bp, Mus musculus
gggtgtccttttctgggcagtattc

SEQ ID NO: 642349 - DNA, 25 bp, Mus musculus
gggtgtccttttgtgggcagtattc

SEQ ID NO: 642350 - DNA, 25 bp, Mus musculus
gggtgtcgagacatatctgcctagg

SEQ ID NO: 642351 - DNA, 25 bp, Mus musculus
gggtgtcgagacttatctgcctagg

SEQ ID NO: 642352 - DNA, 25 bp, Mus musculus
gggtgtcgccttccttgaagatcaa

SEQ ID NO: 642353 - DNA, 25 bp, Mus musculus
gggtgtcgccttgcttgaagatcaa

SEQ ID NO: 642354 - DNA, 25 bp, Mus musculus
gggtgtcgttttctagccagctacc

SEQ ID NO: 642355 - DNA, 25 bp, Mus musculus
gggtgtcgttttgtagccagctacc

SEQ ID NO: 642356 - DNA, 25 bp, Mus musculus
gggtgtctacaaaacacacaacaga

SEQ ID NO: 642357 - DNA, 25 bp, Mus musculus
gggtgtctacaatacacacaacaga

SEQ ID NO: 642358 - DNA, 25 bp, Mus musculus
gggtgtctacccataaaggagctct

SEQ ID NO: 642359 - DNA, 25 bp, Mus musculus
gggtgtctacccttaaaggagctct

SEQ ID NO: 642360 - DNA, 25 bp, Mus musculus
gggtgtctagaacccagtgttgttt

SEQ ID NO: 642361 - DNA, 25 bp, Mus musculus
gggtgtctagaagccagtgttgttt

SEQ ID NO: 642362 - DNA, 25 bp, Mus musculus
gggtgtctcagtaacaaagcctatt

SEQ ID NO: 642363 - DNA, 25 bp, Mus musculus
gggtgtctcagttacaaagcctatt

SEQ ID NO: 642364 - DNA, 25 bp, Mus musculus
gggtgtctccatccacactttgagg

SEQ ID NO: 642365 - DNA, 25 bp, Mus musculus
gggtgtctccatgcacactttgagg

SEQ ID NO: 642366 - DNA, 25 bp, Mus musculus
gggtgtctcttgctactcaccaata

SEQ ID NO: 642367 - DNA, 25 bp, Mus musculus
gggtgtctcttggtactcaccaata

SEQ ID NO: 642368 - DNA, 25 bp, Mus musculus
gggtgtctgaaactagccttttgcc

SEQ ID NO: 642369 - DNA, 25 bp, Mus musculus
gggtgtctgaaagtagccttttgcc

SEQ ID NO: 642370 - DNA, 25 bp, Mus musculus
gggtgtctgggcagctgttttccta

SEQ ID NO: 642371 - DNA, 25 bp, Mus musculus
gggtgtctgggctgctgttttccta

SEQ ID NO: 642372 - DNA, 25 bp, Mus musculus
gggtgtctgtaaacttaccacttaa

SEQ ID NO: 642373 - DNA, 25 bp, Mus musculus
gggtgtctgtaatcttaccacttaa

SEQ ID NO: 642374 - DNA, 25 bp, Mus musculus
gggtgtcttattccctatgataaga

SEQ ID NO: 642375 - DNA, 25 bp, Mus musculus
gggtgtcttattgcctatgataaga

SEQ ID NO: 642376 - DNA, 25 bp, Mus musculus
gggtgtcttctacccattcttagag

SEQ ID NO: 642377 - DNA, 25 bp, Mus musculus
gggtgtcttctagccattcttagag

SEQ ID NO: 642378 - DNA, 25 bp, Mus musculus
gggtgtcttcttcaactgttgacct

SEQ ID NO: 642379 - DNA, 25 bp, Mus musculus
gggtgtcttcttgaactgttgacct

SEQ ID NO: 642380 - DNA, 25 bp, Mus musculus
gggtgtcttggaattcccagagatc

SEQ ID NO: 642381 - DNA, 25 bp, Mus musculus
gggtgtcttggatttcccagagatc

SEQ ID NO: 642382 - DNA, 25 bp, Mus musculus
gggtgtcttttacttctaatttgct

SEQ ID NO: 642383 - DNA, 25 bp, Mus musculus
gggtgtcttttagttctaatttgct

SEQ ID NO: 642384 - DNA, 25 bp, Mus musculus
gggtgtgaaaaccatagctgtcata

SEQ ID NO: 642385 - DNA, 25 bp, Mus musculus
gggtgtgaaaacgatagctgtcata

SEQ ID NO: 642386 - DNA, 25 bp, Mus musculus
gggtgtgaacctccagaaacttcta

SEQ ID NO: 642387 - DNA, 25 bp, Mus musculus
gggtgtgaacctcgtagcccatttt

SEQ ID NO: 642388 - DNA, 25 bp, Mus musculus
gggtgtgaacctgcagaaacttcta

SEQ ID NO: 642389 - DNA, 25 bp, Mus musculus
gggtgtgaacctggtagcccatttt

SEQ ID NO: 642390 - DNA, 25 bp, Mus musculus
gggtgtgaacttcctgggccacttc

SEQ ID NO: 642391 - DNA, 25 bp, Mus musculus
gggtgtgaacttgctgggccacttc

SEQ ID NO: 642392 - DNA, 25 bp, Mus musculus
gggtgtgaatcaaacctgcttctca

SEQ ID NO: 642393 - DNA, 25 bp, Mus musculus
gggtgtgaatcatacctgcttctca

SEQ ID NO: 642394 - DNA, 25 bp, Mus musculus
gggtgtgacaacatgacgtgcatca

SEQ ID NO: 642395 - DNA, 25 bp, Mus musculus
gggtgtgacaacttgacgtgcatca

SEQ ID NO: 642396 - DNA, 25 bp, Mus musculus
gggtgtgaccaacttacagcaaaat

SEQ ID NO: 642397 - DNA, 25 bp, Mus musculus
gggtgtgaccaagttacagcaaaat

SEQ ID NO: 642398 - DNA, 25 bp, Mus musculus
gggtgtgaccctagtagacactaca

SEQ ID NO: 642399 - DNA, 25 bp, Mus musculus
gggtgtgacccttgtagacactaca

SEQ ID NO: 642400 - DNA, 25 bp, Mus musculus
gggtgtgactgaccacagtaacagc

SEQ ID NO: 642401 - DNA, 25 bp, Mus musculus
gggtgtgactgagcacagtaacagc

SEQ ID NO: 642402 - DNA, 25 bp, Mus musculus
gggtgtgacttcatggagaacctca

SEQ ID NO: 642403 - DNA, 25 bp, Mus musculus
gggtgtgacttcttggagaacctca

SEQ ID NO: 642404 - DNA, 25 bp, Mus musculus
gggtgtgactttcccctacgtatcg

SEQ ID NO: 642405 - DNA, 25 bp, Mus musculus
gggtgtgactttgccctacgtatcg

SEQ ID NO: 642406 - DNA, 25 bp, Mus musculus
gggtgtgatacaatttccaggctat

SEQ ID NO: 642407 - DNA, 25 bp, Mus musculus
gggtgtgatacattttccaggctat

SEQ ID NO: 642408 - DNA, 25 bp, Mus musculus
gggtgtgatcttctaccagtgtctt

SEQ ID NO: 642409 - DNA, 25 bp, Mus musculus
gggtgtgatcttgtaccagtgtctt

SEQ ID NO: 642410 - DNA, 25 bp, Mus musculus
gggtgtgatgaaattgcgttgattt

SEQ ID NO: 642411 - DNA, 25 bp, Mus musculus
gggtgtgatgaatttgcgttgattt

SEQ ID NO: 642412 - DNA, 25 bp, Mus musculus
gggtgtgcacctcacctagcagtga

SEQ ID NO: 642413 - DNA, 25 bp, Mus musculus
gggtgtgcacctgacctagcagtga

SEQ ID NO: 642414 - DNA, 25 bp, Mus musculus
gggtgtgcagtcatgtgaaaaatca

SEQ ID NO: 642415 - DNA, 25 bp, Mus musculus
gggtgtgcagtcttgtgaaaaatca

SEQ ID NO: 642416 - DNA, 25 bp, Mus musculus
gggtgtgcagttaactctgttaaca

SEQ ID NO: 642417 - DNA, 25 bp, Mus musculus
gggtgtgcagtttactctgttaaca

SEQ ID NO: 642418 - DNA, 25 bp, Mus musculus
gggtgtgcatccacacagtggcagc

SEQ ID NO: 642419 - DNA, 25 bp, Mus musculus
gggtgtgcatcctcacagtggcagc

SEQ ID NO: 642420 - DNA, 25 bp, Mus musculus
gggtgtgccagaataaaccacttca

SEQ ID NO: 642421 - DNA, 25 bp, Mus musculus
gggtgtgccagattaaaccacttca

SEQ ID NO: 642422 - DNA, 25 bp, Mus musculus
gggtgtgcctgtacatattgtgaca

SEQ ID NO: 642423 - DNA, 25 bp, Mus musculus
gggtgtgcctgttcatattgtgaca

SEQ ID NO: 642424 - DNA, 25 bp, Mus musculus
gggtgtgcgtgacgaccgcgcccac

SEQ ID NO: 642425 - DNA, 25 bp, Mus musculus
gggtgtgcgtgaggaccgcgcccac

SEQ ID NO: 642426 - DNA, 25 bp, Mus musculus
gggtgtgcgttgagaccttgcaaat

SEQ ID NO: 642427 - DNA, 25 bp, Mus musculus
gggtgtgcgttgtgaccttgcaaat

SEQ ID NO: 642428 - DNA, 25 bp, Mus musculus
gggtgtgctacgctgtgttcacctt

SEQ ID NO: 642429 - DNA, 25 bp, Mus musculus
gggtgtgctacggtgtgttcacctt

SEQ ID NO: 642430 - DNA, 25 bp, Mus musculus
gggtgtgctctgaatttgtatctac

SEQ ID NO: 642431 - DNA, 25 bp, Mus musculus
gggtgtgctctgtatttgtatctac

SEQ ID NO: 642432 - DNA, 25 bp, Mus musculus
gggtgtgctggaacactacacctat

SEQ ID NO: 642433 - DNA, 25 bp, Mus musculus
gggtgtgctggatcactacacctat

SEQ ID NO: 642434 - DNA, 25 bp, Mus musculus
gggtgtgcttgccagacgaaattta

SEQ ID NO: 642435 - DNA, 25 bp, Mus musculus
gggtgtgcttgcgagacgaaattta

SEQ ID NO: 642436 - DNA, 25 bp, Mus musculus
gggtgtgctttaaagctccagcttc

SEQ ID NO: 642437 - DNA, 25 bp, Mus musculus
gggtgtgctttatagctccagcttc

SEQ ID NO: 642438 - DNA, 25 bp, Mus musculus
gggtgtggacaaaccattagcgaaa

SEQ ID NO: 642439 - DNA, 25 bp, Mus musculus
gggtgtggacaaccaccagctgcct

SEQ ID NO: 642440 - DNA, 25 bp, Mus musculus
gggtgtggacaagcaccagctgcct

SEQ ID NO: 642441 - DNA, 25 bp, Mus musculus
gggtgtggacaatccattagcgaaa

SEQ ID NO: 642442 - DNA, 25 bp, Mus musculus
gggtgtggacacaggcaacaacaaa

SEQ ID NO: 642443 - DNA, 25 bp, Mus musculus
gggtgtggacactggcaacaacaaa

SEQ ID NO: 642444 - DNA, 25 bp, Mus musculus
gggtgtggccatatccatcctttac

SEQ ID NO: 642445 - DNA, 25 bp, Mus musculus
gggtgtggccatttccatcctttac

SEQ ID NO: 642446 - DNA, 25 bp, Mus musculus
gggtgtggcctgattgtttccatcc

SEQ ID NO: 642447 - DNA, 25 bp, Mus musculus
gggtgtggcctgtttgtttccatcc

SEQ ID NO: 642448 - DNA, 25 bp, Mus musculus
gggtgtggctgtatttgtctcaata

SEQ ID NO: 642449 - DNA, 25 bp, Mus musculus
gggtgtggctgtttttgtctcaata

SEQ ID NO: 642450 - DNA, 25 bp, Mus musculus
gggtgtgggataatcctccctacga

SEQ ID NO: 642451 - DNA, 25 bp, Mus musculus
gggtgtgggatattcctccctacga

SEQ ID NO: 642452 - DNA, 25 bp, Mus musculus
gggtgtggtaagatgtccccactct

SEQ ID NO: 642453 - DNA, 25 bp, Mus musculus
gggtgtggtaagttgtccccactct

SEQ ID NO: 642454 - DNA, 25 bp, Mus musculus
gggtgtggtatgaatgccccttgaa

SEQ ID NO: 642455 - DNA, 25 bp, Mus musculus
gggtgtggtatgtatgccccttgaa

SEQ ID NO: 642456 - DNA, 25 bp, Mus musculus
gggtgtggtcatctgattgtttcaa

SEQ ID NO: 642457 - DNA, 25 bp, Mus musculus
gggtgtggtcatgtgattgtttcaa

SEQ ID NO: 642458 - DNA, 25 bp, Mus musculus
gggtgtggtcttcccagacagcata

SEQ ID NO: 642459 - DNA, 25 bp, Mus musculus
gggtgtggtcttgccagacagcata

SEQ ID NO: 642460 - DNA, 25 bp, Mus musculus
gggtgtggtgacaacaattttattt

SEQ ID NO: 642461 - DNA, 25 bp, Mus musculus
gggtgtggtgactacaattttattt

SEQ ID NO: 642462 - DNA, 25 bp, Mus musculus
gggtgtggtttacagaccctcacat

SEQ ID NO: 642463 - DNA, 25 bp, Mus musculus
gggtgtggtttagagaccctcacat

SEQ ID NO: 642464 - DNA, 25 bp, Mus musculus
gggtgtgtacacaccagtggagtca

SEQ ID NO: 642465 - DNA, 25 bp, Mus musculus
gggtgtgtacactccagtggagtca

SEQ ID NO: 642466 - DNA, 25 bp, Mus musculus
gggtgtgtacatagggaaacttcta

SEQ ID NO: 642467 - DNA, 25 bp, Mus musculus
gggtgtgtacattgggaaacttcta

SEQ ID NO: 642468 - DNA, 25 bp, Mus musculus
gggtgtgtcaaaacatgtatttcca

SEQ ID NO: 642469 - DNA, 25 bp, Mus musculus
gggtgtgtcaaatcatgtatttcca

SEQ ID NO: 642470 - DNA, 25 bp, Mus musculus
gggtgtgtccacattcttctcattc

SEQ ID NO: 642471 - DNA, 25 bp, Mus musculus
gggtgtgtccactttcttctcattc

SEQ ID NO: 642472 - DNA, 25 bp, Mus musculus
gggtgtgtgctaaaagtcactatat

SEQ ID NO: 642473 - DNA, 25 bp, Mus musculus
gggtgtgtgctataagtcactatat

SEQ ID NO: 642474 - DNA, 25 bp, Mus musculus
gggtgtgtgttcatactggtctgca

SEQ ID NO: 642475 - DNA, 25 bp, Mus musculus
gggtgtgtgttcttactggtctgca

SEQ ID NO: 642476 - DNA, 25 bp, Mus musculus
gggtgtgttacactagtgagccact

SEQ ID NO: 642477 - DNA, 25 bp, Mus musculus
gggtgtgttacagtagtgagccact

SEQ ID NO: 642478 - DNA, 25 bp, Mus musculus
gggtgtgttctaaattccaaattaa

SEQ ID NO: 642479 - DNA, 25 bp, Mus musculus
gggtgtgttctatattccaaattaa

SEQ ID NO: 642480 - DNA, 25 bp, Mus musculus
gggtgtgttgtgcagatcttaaaac

SEQ ID NO: 642481 - DNA, 25 bp, Mus musculus
gggtgtgttgtggagatcttaaaac

SEQ ID NO: 642482 - DNA, 25 bp, Mus musculus
gggtgtgttttaacatctcacaaca

SEQ ID NO: 642483 - DNA, 25 bp, Mus musculus
gggtgtgttttatcatctcacaaca

SEQ ID NO: 642484 - DNA, 25 bp, Mus musculus
gggtgtgttttcactgacagactgg

SEQ ID NO: 642485 - DNA, 25 bp, Mus musculus
gggtgtgttttctctgacagactgg

SEQ ID NO: 642486 - DNA, 25 bp, Mus musculus
gggtgttaatcaaagttttcattcc

SEQ ID NO: 642487 - DNA, 25 bp, Mus musculus
gggtgttaatcaccatctatcaagg

SEQ ID NO: 642488 - DNA, 25 bp, Mus musculus
gggtgttaatcagcatctatcaagg

SEQ ID NO: 642489 - DNA, 25 bp, Mus musculus
gggtgttaatcatagttttcattcc

SEQ ID NO: 642490 - DNA, 25 bp, Mus musculus
gggtgttaatgcacgaatgtgatac

SEQ ID NO: 642491 - DNA, 25 bp, Mus musculus
gggtgttaatgctcgaatgtgatac

SEQ ID NO: 642492 - DNA, 25 bp, Mus musculus
gggtgttaccttatatggtgtcttc

SEQ ID NO: 642493 - DNA, 25 bp, Mus musculus
gggtgttaccttttatggtgtcttc

SEQ ID NO: 642494 - DNA, 25 bp, Mus musculus
gggtgttagcacacaggcatctcta

SEQ ID NO: 642495 - DNA, 25 bp, Mus musculus
gggtgttagcactcaggcatctcta

SEQ ID NO: 642496 - DNA, 25 bp, Mus musculus
gggtgttagcttaatctaaattggc

SEQ ID NO: 642497 - DNA, 25 bp, Mus musculus
gggtgttagctttatctaaattggc

SEQ ID NO: 642498 - DNA, 25 bp, Mus musculus
gggtgttatattcgttttctctagt

SEQ ID NO: 642499 - DNA, 25 bp, Mus musculus
gggtgttatattggttttctctagt

SEQ ID NO: 642500 - DNA, 25 bp, Mus musculus
gggtgttatgctactgtgctcaata

SEQ ID NO: 642501 - DNA, 25 bp, Mus musculus
gggtgttatgcttctgtgctcaata

SEQ ID NO: 642502 - DNA, 25 bp, Mus musculus
gggtgttatggcatactgtcagaaa

SEQ ID NO: 642503 - DNA, 25 bp, Mus musculus
gggtgttatggcttactgtcagaaa

SEQ ID NO: 642504 - DNA, 25 bp, Mus musculus
gggtgttcacagaaccactgtagcg

SEQ ID NO: 642505 - DNA, 25 bp, Mus musculus
gggtgttcacagtaccactgtagcg

SEQ ID NO: 642506 - DNA, 25 bp, Mus musculus
gggtgttcacttctgggtgccaaac

SEQ ID NO: 642507 - DNA, 25 bp, Mus musculus
gggtgttcacttgtgggtgccaaac

SEQ ID NO: 642508 - DNA, 25 bp, Mus musculus
gggtgttcagatagcctttccaaag

SEQ ID NO: 642509 - DNA, 25 bp, Mus musculus
gggtgttcagattgcctttccaaag

SEQ ID NO: 642510 - DNA, 25 bp, Mus musculus
gggtgttcaggcatctgttgactgc

SEQ ID NO: 642511 - DNA, 25 bp, Mus musculus
gggtgttcaggcttctgttgactgc

SEQ ID NO: 642512 - DNA, 25 bp, Mus musculus
gggtgttcatttccagaaaagcctg

SEQ ID NO: 642513 - DNA, 25 bp, Mus musculus
gggtgttcatttgcagaaaagcctg

SEQ ID NO: 642514 - DNA, 25 bp, Mus musculus
gggtgttccatgactcaagagggca

SEQ ID NO: 642515 - DNA, 25 bp, Mus musculus
gggtgttccatgtctcaagagggca

SEQ ID NO: 642516 - DNA, 25 bp, Mus musculus
gggtgttccgttagttggtctgctt

SEQ ID NO: 642517 - DNA, 25 bp, Mus musculus
gggtgttccgtttgttggtctgctt

SEQ ID NO: 642518 - DNA, 25 bp, Mus musculus
gggtgttcctcaaccagcgtaagga

SEQ ID NO: 642519 - DNA, 25 bp, Mus musculus
gggtgttcctcacaatgccgaggaa

SEQ ID NO: 642520 - DNA, 25 bp, Mus musculus
gggtgttcctcagaatgccgaggaa

SEQ ID NO: 642521 - DNA, 25 bp, Mus musculus
gggtgttcctcatccagcgtaagga

SEQ ID NO: 642522 - DNA, 25 bp, Mus musculus
gggtgttcctttagctcttgagaca

SEQ ID NO: 642523 - DNA, 25 bp, Mus musculus
gggtgttccttttgctcttgagaca

SEQ ID NO: 642524 - DNA, 25 bp, Mus musculus
gggtgttcgacaagatcccaacatg

SEQ ID NO: 642525 - DNA, 25 bp, Mus musculus
gggtgttcgacatgatcccaacatg

SEQ ID NO: 642526 - DNA, 25 bp, Mus musculus
gggtgttctaatagggatttctttg

SEQ ID NO: 642527 - DNA, 25 bp, Mus musculus
gggtgttctaattgggatttctttg

SEQ ID NO: 642528 - DNA, 25 bp, Mus musculus
gggtgttctcacagactctagttaa

SEQ ID NO: 642529 - DNA, 25 bp, Mus musculus
gggtgttctcactgactctagttaa

SEQ ID NO: 642530 - DNA, 25 bp, Mus musculus
gggtgttctgaactaatctgcataa

SEQ ID NO: 642531 - DNA, 25 bp, Mus musculus
gggtgttctgaagtaatctgcataa

SEQ ID NO: 642532 - DNA, 25 bp, Mus musculus
gggtgttctgccatcacatttccac

SEQ ID NO: 642533 - DNA, 25 bp, Mus musculus
gggtgttctgccttcacatttccac

SEQ ID NO: 642534 - DNA, 25 bp, Mus musculus
gggtgttctggaagtggccttccac

SEQ ID NO: 642535 - DNA, 25 bp, Mus musculus
gggtgttctggatgtggccttccac

SEQ ID NO: 642536 - DNA, 25 bp, Mus musculus
gggtgttgaaacaagctttgcctgt

SEQ ID NO: 642537 - DNA, 25 bp, Mus musculus
gggtgttgaaactagctttgcctgt

SEQ ID NO: 642538 - DNA, 25 bp, Mus musculus
gggtgttgaaccagccagcaagcat

SEQ ID NO: 642539 - DNA, 25 bp, Mus musculus
gggtgttgaacctgccagcaagcat

SEQ ID NO: 642540 - DNA, 25 bp, Mus musculus
gggtgttgaagtagagccctcccac

SEQ ID NO: 642541 - DNA, 25 bp, Mus musculus
gggtgttgaagttgagccctcccac

SEQ ID NO: 642542 - DNA, 25 bp, Mus musculus
gggtgttgaccacatggatttgttt

SEQ ID NO: 642543 - DNA, 25 bp, Mus musculus
gggtgttgaccagatggatttgttt

SEQ ID NO: 642544 - DNA, 25 bp, Mus musculus
gggtgttgtaacctcagcaataaag

SEQ ID NO: 642545 - DNA, 25 bp, Mus musculus
gggtgttgtaacgtcagcaataaag

SEQ ID NO: 642546 - DNA, 25 bp, Mus musculus
gggtgtttatagagtctttggagca

SEQ ID NO: 642547 - DNA, 25 bp, Mus musculus
gggtgtttatagtgtctttggagca

SEQ ID NO: 642548 - DNA, 25 bp, Mus musculus
gggtgtttattaaattattctgtag

SEQ ID NO: 642549 - DNA, 25 bp, Mus musculus
gggtgtttattatattattctgtag

SEQ ID NO: 642550 - DNA, 25 bp, Mus musculus
gggtgtttcacacacgatctgccat

SEQ ID NO: 642551 - DNA, 25 bp, Mus musculus
gggtgtttcacagacgatctgccat

SEQ ID NO: 642552 - DNA, 25 bp, Mus musculus
gggtgtttcagtagccatctcagga

SEQ ID NO: 642553 - DNA, 25 bp, Mus musculus
gggtgtttcagttgccatctcagga

SEQ ID NO: 642554 - DNA, 25 bp, Mus musculus
gggtgtttccatctaattgccaagt

SEQ ID NO: 642555 - DNA, 25 bp, Mus musculus
gggtgtttccatgtaattgccaagt

SEQ ID NO: 642556 - DNA, 25 bp, Mus musculus
gggtgtttctcaccgagcctaagaa

SEQ ID NO: 642557 - DNA, 25 bp, Mus musculus
gggtgtttctcagcgagcctaagaa

SEQ ID NO: 642558 - DNA, 25 bp, Mus musculus
gggtgtttctctacaaaattgtcta

SEQ ID NO: 642559 - DNA, 25 bp, Mus musculus
gggtgtttctcttcaaaattgtcta

SEQ ID NO: 642560 - DNA, 25 bp, Mus musculus
gggtgtttgtagatcactgtattta

SEQ ID NO: 642561 - DNA, 25 bp, Mus musculus
gggtgtttgtagttcactgtattta

SEQ ID NO: 642562 - DNA, 25 bp, Mus musculus
gggtgttttactccaaagacagatc

SEQ ID NO: 642563 - DNA, 25 bp, Mus musculus
gggtgttttactgcaaagacagatc

SEQ ID NO: 642564 - DNA, 25 bp, Mus musculus
gggtgttttcacacgtgtgactgct

SEQ ID NO: 642565 - DNA, 25 bp, Mus musculus
gggtgttttcactcgtgtgactgct

SEQ ID NO: 642566 - DNA, 25 bp, Mus musculus
gggtgttttcagctgtgcctaaatg

SEQ ID NO: 642567 - DNA, 25 bp, Mus musculus
gggtgttttcaggtgtgcctaaatg

SEQ ID NO: 642568 - DNA, 25 bp, Mus musculus
gggtgttttcttctgccataagggc

SEQ ID NO: 642569 - DNA, 25 bp, Mus musculus
gggtgttttcttgtgccataagggc

SEQ ID NO: 642570 - DNA, 25 bp, Mus musculus
gggtgttttgagaccacagttgatt

SEQ ID NO: 642571 - DNA, 25 bp, Mus musculus
gggtgttttgagtccacagttgatt

SEQ ID NO: 642572 - DNA, 25 bp, Mus musculus
gggtgttttgttagatgagttctga

SEQ ID NO: 642573 - DNA, 25 bp, Mus musculus
gggtgttttgtttgatgagttctga

SEQ ID NO: 642574 - DNA, 25 bp, Mus musculus
gggttaaaagtgcatctcccaacaa

SEQ ID NO: 642575 - DNA, 25 bp, Mus musculus
gggttaaaagtggatctcccaacaa

SEQ ID NO: 642576 - DNA, 25 bp, Mus musculus
gggttaaacactatggccaggccac

SEQ ID NO: 642577 - DNA, 25 bp, Mus musculus
gggttaaacactttggccaggccac

SEQ ID NO: 642578 - DNA, 25 bp, Mus musculus
gggttaaactggactcacttgagtt

SEQ ID NO: 642579 - DNA, 25 bp, Mus musculus
gggttaaactggtctcacttgagtt

SEQ ID NO: 642580 - DNA, 25 bp, Mus musculus
gggttaaagccaacgagaatcatgc

SEQ ID NO: 642581 - DNA, 25 bp, Mus musculus
gggttaaagccatcgagaatcatgc

SEQ ID NO: 642582 - DNA, 25 bp, Mus musculus
gggttaaaggcgctcaccaccatta

SEQ ID NO: 642583 - DNA, 25 bp, Mus musculus
gggttaaaggcggtcaccaccatta

SEQ ID NO: 642584 - DNA, 25 bp, Mus musculus
gggttaaatcacatttgcttgtgtt

SEQ ID NO: 642585 - DNA, 25 bp, Mus musculus
gggttaaatcacttttgcttgtgtt

SEQ ID NO: 642586 - DNA, 25 bp, Mus musculus
gggttaacacatcagaaattaggca

SEQ ID NO: 642587 - DNA, 25 bp, Mus musculus
gggttaacacatgagaaattaggca

SEQ ID NO: 642588 - DNA, 25 bp, Mus musculus
gggttaactggcatctctaatactt

SEQ ID NO: 642589 - DNA, 25 bp, Mus musculus
gggttaactggcttctctaatactt

SEQ ID NO: 642590 - DNA, 25 bp, Mus musculus
gggttaacttataacctgagagtga

SEQ ID NO: 642591 - DNA, 25 bp, Mus musculus
gggttaacttattacctgagagtga

SEQ ID NO: 642592 - DNA, 25 bp, Mus musculus
gggttaagaggcatctctccttacc

SEQ ID NO: 642593 - DNA, 25 bp, Mus musculus
gggttaagaggcttctctccttacc

SEQ ID NO: 642594 - DNA, 25 bp, Mus musculus
gggttaaggcacatttttactcatt

SEQ ID NO: 642595 - DNA, 25 bp, Mus musculus
gggttaaggcacttttttactcatt

SEQ ID NO: 642596 - DNA, 25 bp, Mus musculus
gggttaagtgatcgaagctacctct

SEQ ID NO: 642597 - DNA, 25 bp, Mus musculus
gggttaagtgatggaagctacctct

SEQ ID NO: 642598 - DNA, 25 bp, Mus musculus
gggttaatccagaggcagggccatt

SEQ ID NO: 642599 - DNA, 25 bp, Mus musculus
gggttaatccagtggcagggccatt

SEQ ID NO: 642600 - DNA, 25 bp, Mus musculus
gggttaatccttagcagaaatttca

SEQ ID NO: 642601 - DNA, 25 bp, Mus musculus
gggttaatcctttgcagaaatttca

SEQ ID NO: 642602 - DNA, 25 bp, Mus musculus
gggttaatctccaccggtattgcta

SEQ ID NO: 642603 - DNA, 25 bp, Mus musculus
gggttaatctcctccggtattgcta

SEQ ID NO: 642604 - DNA, 25 bp, Mus musculus
gggttaatgcccacatgagcaccat

SEQ ID NO: 642605 - DNA, 25 bp, Mus musculus
gggttaatgccctcatgagcaccat

SEQ ID NO: 642606 - DNA, 25 bp, Mus musculus
gggttaatgcgacatgatacactac

SEQ ID NO: 642607 - DNA, 25 bp, Mus musculus
gggttaatgcgagatgatacactac

SEQ ID NO: 642608 - DNA, 25 bp, Mus musculus
gggttaatggctagtatcctgtatt

SEQ ID NO: 642609 - DNA, 25 bp, Mus musculus
gggttaatggcttgtatcctgtatt

SEQ ID NO: 642610 - DNA, 25 bp, Mus musculus
gggttaattcaccttctgttctatg

SEQ ID NO: 642611 - DNA, 25 bp, Mus musculus
gggttaattcacgttctgttctatg

SEQ ID NO: 642612 - DNA, 25 bp, Mus musculus
gggttaatttcccagcacctaatgg

SEQ ID NO: 642613 - DNA, 25 bp, Mus musculus
gggttaatttccgagcacctaatgg

SEQ ID NO: 642614 - DNA, 25 bp, Mus musculus
gggttacaaactcaagctctgtggt

SEQ ID NO: 642615 - DNA, 25 bp, Mus musculus
gggttacaaactcattttgaggcca

SEQ ID NO: 642616 - DNA, 25 bp, Mus musculus
gggttacaaactgaagctctgtggt

SEQ ID NO: 642617 - DNA, 25 bp, Mus musculus
gggttacaaactgattttgaggcca

SEQ ID NO: 642618 - DNA, 25 bp, Mus musculus
gggttacaactaatagactagtgga

SEQ ID NO: 642619 - DNA, 25 bp, Mus musculus
gggttacaactattagactagtgga

SEQ ID NO: 642620 - DNA, 25 bp, Mus musculus
gggttacaagtcagtccagcctggg

SEQ ID NO: 642621 - DNA, 25 bp, Mus musculus
gggttacaagtctgtccagcctggg

SEQ ID NO: 642622 - DNA, 25 bp, Mus musculus
gggttacaatatatcctatgcatcc

SEQ ID NO: 642623 - DNA, 25 bp, Mus musculus
gggttacaatatcacagtccccacc

SEQ ID NO: 642624 - DNA, 25 bp, Mus musculus
gggttacaatatgacagtccccacc

SEQ ID NO: 642625 - DNA, 25 bp, Mus musculus
gggttacaatatttcctatgcatcc

SEQ ID NO: 642626 - DNA, 25 bp, Mus musculus
gggttacaatccaccatgattgggt

SEQ ID NO: 642627 - DNA, 25 bp, Mus musculus
gggttacaatcctccatgattgggt

SEQ ID NO: 642628 - DNA, 25 bp, Mus musculus
gggttacaccgactctatggctgcc

SEQ ID NO: 642629 - DNA, 25 bp, Mus musculus
gggttacaccgagtctatggctgcc

SEQ ID NO: 642630 - DNA, 25 bp, Mus musculus
gggttacactaacccttccacatgc

SEQ ID NO: 642631 - DNA, 25 bp, Mus musculus
gggttacactaagccttccacatgc

SEQ ID NO: 642632 - DNA, 25 bp, Mus musculus
gggttacagacacaagctactacat

SEQ ID NO: 642633 - DNA, 25 bp, Mus musculus
gggttacagacagaagctactacat

SEQ ID NO: 642634 - DNA, 25 bp, Mus musculus
gggttacagctcatcttcatccagc

SEQ ID NO: 642635 - DNA, 25 bp, Mus musculus
gggttacagctcttcttcatccagc

SEQ ID NO: 642636 - DNA, 25 bp, Mus musculus
gggttacagtgccaaagccatttct

SEQ ID NO: 642637 - DNA, 25 bp, Mus musculus
gggttacagtgcgaaagccatttct

SEQ ID NO: 642638 - DNA, 25 bp, Mus musculus
gggttacataaaagccagcatatta

SEQ ID NO: 642639 - DNA, 25 bp, Mus musculus
gggttacataaatgccagcatatta

SEQ ID NO: 642640 - DNA, 25 bp, Mus musculus
gggttacataatcaattcctgccaa

SEQ ID NO: 642641 - DNA, 25 bp, Mus musculus
gggttacataatgaattcctgccaa

SEQ ID NO: 642642 - DNA, 25 bp, Mus musculus
gggttacatagcagcttccaggaca

SEQ ID NO: 642643 - DNA, 25 bp, Mus musculus
gggttacatagctgcttccaggaca

SEQ ID NO: 642644 - DNA, 25 bp, Mus musculus
gggttaccacagactggctcggctg

SEQ ID NO: 642645 - DNA, 25 bp, Mus musculus
gggttaccacagtctggctcggctg

SEQ ID NO: 642646 - DNA, 25 bp, Mus musculus
gggttaccagacacattcttttcat

SEQ ID NO: 642647 - DNA, 25 bp, Mus musculus
gggttaccagactcattcttttcat

SEQ ID NO: 642648 - DNA, 25 bp, Mus musculus
gggttaccagcccagaagtattagg

SEQ ID NO: 642649 - DNA, 25 bp, Mus musculus
gggttaccagccgagaagtattagg

SEQ ID NO: 642650 - DNA, 25 bp, Mus musculus
gggttacccagacaagatactacat

SEQ ID NO: 642651 - DNA, 25 bp, Mus musculus
gggttacccagagaagatactacat

SEQ ID NO: 642652 - DNA, 25 bp, Mus musculus
gggttaccctaacaccatcacaagt

SEQ ID NO: 642653 - DNA, 25 bp, Mus musculus
gggttaccctaagaccatcacaagt

SEQ ID NO: 642654 - DNA, 25 bp, Mus musculus
gggttaccctgaagaaaccaattca

SEQ ID NO: 642655 - DNA, 25 bp, Mus musculus
gggttaccctgatgaaaccaattca

SEQ ID NO: 642656 - DNA, 25 bp, Mus musculus
gggttaccgctgagtggacaccaac

SEQ ID NO: 642657 - DNA, 25 bp, Mus musculus
gggttaccgctgtgtggacaccaac

SEQ ID NO: 642658 - DNA, 25 bp, Mus musculus
gggttacctagcaggacacgtgcct

SEQ ID NO: 642659 - DNA, 25 bp, Mus musculus
gggttacctagctggacacgtgcct

SEQ ID NO: 642660 - DNA, 25 bp, Mus musculus
gggttacctgataaagctcttgagt

SEQ ID NO: 642661 - DNA, 25 bp, Mus musculus
gggttacctgattaagctcttgagt

SEQ ID NO: 642662 - DNA, 25 bp, Mus musculus
gggttacctttacagctcagcagtg

SEQ ID NO: 642663 - DNA, 25 bp, Mus musculus
gggttacctttagagctcagcagtg

SEQ ID NO: 642664 - DNA, 25 bp, Mus musculus
gggttacgagaaatccgcgcttggc

SEQ ID NO: 642665 - DNA, 25 bp, Mus musculus
gggttacgagaattccgcgcttggc

SEQ ID NO: 642666 - DNA, 25 bp, Mus musculus
gggttacgagagacactatccgaaa

SEQ ID NO: 642667 - DNA, 25 bp, Mus musculus
gggttacgagagtcactatccgaaa

SEQ ID NO: 642668 - DNA, 25 bp, Mus musculus
gggttactaaataccagtctaggct

SEQ ID NO: 642669 - DNA, 25 bp, Mus musculus
gggttactaaattccagtctaggct

SEQ ID NO: 642670 - DNA, 25 bp, Mus musculus
gggttactagctactttgtagagat

SEQ ID NO: 642671 - DNA, 25 bp, Mus musculus
gggttactagcttctttgtagagat

SEQ ID NO: 642672 - DNA, 25 bp, Mus musculus
gggttactatggaagctcagtcaat

SEQ ID NO: 642673 - DNA, 25 bp, Mus musculus
gggttactatggtagctcagtcaat

SEQ ID NO: 642674 - DNA, 25 bp, Mus musculus
gggttactcacacttctgatgcatt

SEQ ID NO: 642675 - DNA, 25 bp, Mus musculus
gggttactcacagttctgatgcatt

SEQ ID NO: 642676 - DNA, 25 bp, Mus musculus
gggttactctgcatgaagccttagt

SEQ ID NO: 642677 - DNA, 25 bp, Mus musculus
gggttactctgcttgaagccttagt

SEQ ID NO: 642678 - DNA, 25 bp, Mus musculus
gggttactgcagactacatccccag

SEQ ID NO: 642679 - DNA, 25 bp, Mus musculus
gggttactgcagtctacatccccag

SEQ ID NO: 642680 - DNA, 25 bp, Mus musculus
gggttactgcgccagattctggaca

SEQ ID NO: 642681 - DNA, 25 bp, Mus musculus
gggttactgcgcgagattctggaca

SEQ ID NO: 642682 - DNA, 25 bp, Mus musculus
gggttactgcttagatagttacttt

SEQ ID NO: 642683 - DNA, 25 bp, Mus musculus
gggttactgctttgatagttacttt

SEQ ID NO: 642684 - DNA, 25 bp, Mus musculus
gggttactggaacctctgtctggtc

SEQ ID NO: 642685 - DNA, 25 bp, Mus musculus
gggttactggaagctctgtctggtc

SEQ ID NO: 642686 - DNA, 25 bp, Mus musculus
gggttactgtacaatgaactccctg

SEQ ID NO: 642687 - DNA, 25 bp, Mus musculus
gggttactgtactatgaactccctg

SEQ ID NO: 642688 - DNA, 25 bp, Mus musculus
gggttacttaacactcagcacttaa

SEQ ID NO: 642689 - DNA, 25 bp, Mus musculus
gggttacttaactctcagcacttaa

SEQ ID NO: 642690 - DNA, 25 bp, Mus musculus
gggttacttagacattcttctttca

SEQ ID NO: 642691 - DNA, 25 bp, Mus musculus
gggttacttagagattcttctttca

SEQ ID NO: 642692 - DNA, 25 bp, Mus musculus
gggttacttcaaccaagttcctgat

SEQ ID NO: 642693 - DNA, 25 bp, Mus musculus
gggttacttcaagcaagttcctgat

SEQ ID NO: 642694 - DNA, 25 bp, Mus musculus
gggttactttcaagatagacttttg

SEQ ID NO: 642695 - DNA, 25 bp, Mus musculus
gggttactttcatgatagacttttg

SEQ ID NO: 642696 - DNA, 25 bp, Mus musculus
gggttagaagtccgcccactgccct

SEQ ID NO: 642697 - DNA, 25 bp, Mus musculus
gggttagaagtcggcccactgccct

SEQ ID NO: 642698 - DNA, 25 bp, Mus musculus
gggttagaatacaagctgctcctct

SEQ ID NO: 642699 - DNA, 25 bp, Mus musculus
gggttagaatactagctgctcctct

SEQ ID NO: 642700 - DNA, 25 bp, Mus musculus
gggttagacgtgactggatccagtt

SEQ ID NO: 642701 - DNA, 25 bp, Mus musculus
gggttagacgtgtctggatccagtt

SEQ ID NO: 642702 - DNA, 25 bp, Mus musculus
gggttagagccacctctgacatggg

SEQ ID NO: 642703 - DNA, 25 bp, Mus musculus
gggttagagccagctctgacatggg

SEQ ID NO: 642704 - DNA, 25 bp, Mus musculus
gggttagatccacgctcttgtgcct

SEQ ID NO: 642705 - DNA, 25 bp, Mus musculus
gggttagatccaggctcttgtgcct

SEQ ID NO: 642706 - DNA, 25 bp, Mus musculus
gggttagattcaccagcactgcaaa

SEQ ID NO: 642707 - DNA, 25 bp, Mus musculus
gggttagattcagcagcactgcaaa

SEQ ID NO: 642708 - DNA, 25 bp, Mus musculus
gggttagcaagcacgtggcactaca

SEQ ID NO: 642709 - DNA, 25 bp, Mus musculus
gggttagcaagctcgtggcactaca

SEQ ID NO: 642710 - DNA, 25 bp, Mus musculus
gggttagcactaactgagcccttta

SEQ ID NO: 642711 - DNA, 25 bp, Mus musculus
gggttagcactactccagtgggata

SEQ ID NO: 642712 - DNA, 25 bp, Mus musculus
gggttagcactagtccagtgggata

SEQ ID NO: 642713 - DNA, 25 bp, Mus musculus
gggttagcactatctgagcccttta

SEQ ID NO: 642714 - DNA, 25 bp, Mus musculus
gggttagctttgattcagtctttct

SEQ ID NO: 642715 - DNA, 25 bp, Mus musculus
gggttagctttgtttcagtctttct

SEQ ID NO: 642716 - DNA, 25 bp, Mus musculus
gggttaggaacaacttttcattgta

SEQ ID NO: 642717 - DNA, 25 bp, Mus musculus
gggttaggaacatcttttcattgta

SEQ ID NO: 642718 - DNA, 25 bp, Mus musculus
gggttaggaactcttgtcccatgcc

SEQ ID NO: 642719 - DNA, 25 bp, Mus musculus
gggttaggaactgttgtcccatgcc

SEQ ID NO: 642720 - DNA, 25 bp, Mus musculus
gggttaggaccaactgcaagttaat

SEQ ID NO: 642721 - DNA, 25 bp, Mus musculus
gggttaggaccatctgcaagttaat

SEQ ID NO: 642722 - DNA, 25 bp, Mus musculus
gggttaggcactacccagttgataa

SEQ ID NO: 642723 - DNA, 25 bp, Mus musculus
gggttaggcacttcccagttgataa

SEQ ID NO: 642724 - DNA, 25 bp, Mus musculus
gggttaggcatcatcctgagggata

SEQ ID NO: 642725 - DNA, 25 bp, Mus musculus
gggttaggcatcttcctgagggata

SEQ ID NO: 642726 - DNA, 25 bp, Mus musculus
gggttaggcctgagtgccccctcaa

SEQ ID NO: 642727 - DNA, 25 bp, Mus musculus
gggttaggcctgtgtgccccctcaa

SEQ ID NO: 642728 - DNA, 25 bp, Mus musculus
gggttagggtctctatccctgaaca

SEQ ID NO: 642729 - DNA, 25 bp, Mus musculus
gggttagggtctgtatccctgaaca

SEQ ID NO: 642730 - DNA, 25 bp, Mus musculus
gggttaggttcacactctcctgaga

SEQ ID NO: 642731 - DNA, 25 bp, Mus musculus
gggttaggttcagactctcctgaga

SEQ ID NO: 642732 - DNA, 25 bp, Mus musculus
gggttagtaaacagaaggttctgag

SEQ ID NO: 642733 - DNA, 25 bp, Mus musculus
gggttagtaaactgaaggttctgag

SEQ ID NO: 642734 - DNA, 25 bp, Mus musculus
gggttagtctcaaagcatcccttct

SEQ ID NO: 642735 - DNA, 25 bp, Mus musculus
gggttagtctcatagcatcccttct

SEQ ID NO: 642736 - DNA, 25 bp, Mus musculus
gggttagttacccagagatacctat

SEQ ID NO: 642737 - DNA, 25 bp, Mus musculus
gggttagttaccgagagatacctat

SEQ ID NO: 642738 - DNA, 25 bp, Mus musculus
gggttagttttgactccatgactca

SEQ ID NO: 642739 - DNA, 25 bp, Mus musculus
gggttagttttgtctccatgactca

SEQ ID NO: 642740 - DNA, 25 bp, Mus musculus
gggttataaacacacgctcttgaca

SEQ ID NO: 642741 - DNA, 25 bp, Mus musculus
gggttataaacagacgctcttgaca

SEQ ID NO: 642742 - DNA, 25 bp, Mus musculus
gggttatacaaccaggctcaacaaa

SEQ ID NO: 642743 - DNA, 25 bp, Mus musculus
gggttatacaacgaggctcaacaaa

SEQ ID NO: 642744 - DNA, 25 bp, Mus musculus
gggttatacacacatgatggttttt

SEQ ID NO: 642745 - DNA, 25 bp, Mus musculus
gggttatacacagatgatggttttt

SEQ ID NO: 642746 - DNA, 25 bp, Mus musculus
gggttatacatgatttctctactta

SEQ ID NO: 642747 - DNA, 25 bp, Mus musculus
gggttatacatgttttctctactta

SEQ ID NO: 642748 - DNA, 25 bp, Mus musculus
gggttatactacattccatcaagtc

SEQ ID NO: 642749 - DNA, 25 bp, Mus musculus
gggttatactactttccatcaagtc

SEQ ID NO: 642750 - DNA, 25 bp, Mus musculus
gggttatactctcggtgagcttcct

SEQ ID NO: 642751 - DNA, 25 bp, Mus musculus
gggttatactctgggtgagcttcct

SEQ ID NO: 642752 - DNA, 25 bp, Mus musculus
gggttataggttagcaccatgacac

SEQ ID NO: 642753 - DNA, 25 bp, Mus musculus
gggttataggttcaacacatgattc

SEQ ID NO: 642754 - DNA, 25 bp, Mus musculus
gggttataggttgaacacatgattc

SEQ ID NO: 642755 - DNA, 25 bp, Mus musculus
gggttataggtttgcaccatgacac

SEQ ID NO: 642756 - DNA, 25 bp, Mus musculus
gggttatatatcctctgtcctcagc

SEQ ID NO: 642757 - DNA, 25 bp, Mus musculus
gggttatatatcgtctgtcctcagc

SEQ ID NO: 642758 - DNA, 25 bp, Mus musculus
gggttatatcccaaaggtcagagtt

SEQ ID NO: 642759 - DNA, 25 bp, Mus musculus
gggttatatccctaaggtcagagtt

SEQ ID NO: 642760 - DNA, 25 bp, Mus musculus
gggttatatctcaaccagctgctgt

SEQ ID NO: 642761 - DNA, 25 bp, Mus musculus
gggttatatctctaccagctgctgt

SEQ ID NO: 642762 - DNA, 25 bp, Mus musculus
gggttatcaactacgtctcctggat

SEQ ID NO: 642763 - DNA, 25 bp, Mus musculus
gggttatcaacttcgtctcctggat

SEQ ID NO: 642764 - DNA, 25 bp, Mus musculus
gggttatcacacatgccacacaagc

SEQ ID NO: 642765 - DNA, 25 bp, Mus musculus
gggttatcacacttgccacacaagc

SEQ ID NO: 642766 - DNA, 25 bp, Mus musculus
gggttatcagcacaactcgctttaa

SEQ ID NO: 642767 - DNA, 25 bp, Mus musculus
gggttatcagcagaactcgctttaa

SEQ ID NO: 642768 - DNA, 25 bp, Mus musculus
gggttatcatcacttctgaaggcca

SEQ ID NO: 642769 - DNA, 25 bp, Mus musculus
gggttatcatcagttctgaaggcca

SEQ ID NO: 642770 - DNA, 25 bp, Mus musculus
gggttatccagaagcgagtccctaa

SEQ ID NO: 642771 - DNA, 25 bp, Mus musculus
gggttatccagatgcgagtccctaa

SEQ ID NO: 642772 - DNA, 25 bp, Mus musculus
gggttatccatgagggtcaccctaa

SEQ ID NO: 642773 - DNA, 25 bp, Mus musculus
gggttatccatgtgggtcaccctaa

SEQ ID NO: 642774 - DNA, 25 bp, Mus musculus
gggttatccgtgcaattctcacaaa

SEQ ID NO: 642775 - DNA, 25 bp, Mus musculus
gggttatccgtggaattctcacaaa

SEQ ID NO: 642776 - DNA, 25 bp, Mus musculus
gggttatcctcaacaagcctgttca

SEQ ID NO: 642777 - DNA, 25 bp, Mus musculus
gggttatcctcatcaagcctgttca

SEQ ID NO: 642778 - DNA, 25 bp, Mus musculus
gggttatctagtatccttcatcttc

SEQ ID NO: 642779 - DNA, 25 bp, Mus musculus
gggttatctagtttccttcatcttc

SEQ ID NO: 642780 - DNA, 25 bp, Mus musculus
gggttatctcaacaactgtcagttt

SEQ ID NO: 642781 - DNA, 25 bp, Mus musculus
gggttatctcaagaactgtcagttt

SEQ ID NO: 642782 - DNA, 25 bp, Mus musculus
gggttatctcttaatggcacatgct

SEQ ID NO: 642783 - DNA, 25 bp, Mus musculus
gggttatctctttatggcacatgct

SEQ ID NO: 642784 - DNA, 25 bp, Mus musculus
gggttatgacccacgagttgcaaac

SEQ ID NO: 642785 - DNA, 25 bp, Mus musculus
gggttatgaccctcgagttgcaaac

SEQ ID NO: 642786 - DNA, 25 bp, Mus musculus
gggttatgacttctctattcagcac

SEQ ID NO: 642787 - DNA, 25 bp, Mus musculus
gggttatgacttgtctattcagcac

SEQ ID NO: 642788 - DNA, 25 bp, Mus musculus
gggttatgatataggcaacgacccc

SEQ ID NO: 642789 - DNA, 25 bp, Mus musculus
gggttatgatattggcaacgacccc

SEQ ID NO: 642790 - DNA, 25 bp, Mus musculus
gggttatgccagaggatctcacgcc

SEQ ID NO: 642791 - DNA, 25 bp, Mus musculus
gggttatgccagtggatctcacgcc

SEQ ID NO: 642792 - DNA, 25 bp, Mus musculus
gggttatgccccatgtgaagtatac

SEQ ID NO: 642793 - DNA, 25 bp, Mus musculus
gggttatgccccttgtgaagtatac

SEQ ID NO: 642794 - DNA, 25 bp, Mus musculus
gggttatgctgcagttccctggtac

SEQ ID NO: 642795 - DNA, 25 bp, Mus musculus
gggttatgctgctgttccctggtac

SEQ ID NO: 642796 - DNA, 25 bp, Mus musculus
gggttatggagtatatacatgtact

SEQ ID NO: 642797 - DNA, 25 bp, Mus musculus
gggttatggagtttatacatgtact

SEQ ID NO: 642798 - DNA, 25 bp, Mus musculus
gggttatggctgatgactacataca

SEQ ID NO: 642799 - DNA, 25 bp, Mus musculus
gggttatggctgttgactacataca

SEQ ID NO: 642800 - DNA, 25 bp, Mus musculus
gggttatgggagactgcctaccctc

SEQ ID NO: 642801 - DNA, 25 bp, Mus musculus
gggttatgggagtctgcctaccctc

SEQ ID NO: 642802 - DNA, 25 bp, Mus musculus
gggttatgtcatcttactctcttat

SEQ ID NO: 642803 - DNA, 25 bp, Mus musculus
gggttatgtcatgttactctcttat

SEQ ID NO: 642804 - DNA, 25 bp, Mus musculus
gggttatgttgtctccacagacaca

SEQ ID NO: 642805 - DNA, 25 bp, Mus musculus
gggttatgttgtgtccacagacaca

SEQ ID NO: 642806 - DNA, 25 bp, Mus musculus
gggttatgtttgagcttctccaatc

SEQ ID NO: 642807 - DNA, 25 bp, Mus musculus
gggttatgtttgtgcttctccaatc

SEQ ID NO: 642808 - DNA, 25 bp, Mus musculus
gggttattatggattttggatactg

SEQ ID NO: 642809 - DNA, 25 bp, Mus musculus
gggttattatggtttttggatactg

SEQ ID NO: 642810 - DNA, 25 bp, Mus musculus
gggttattcaaaaagccttcttcta

SEQ ID NO: 642811 - DNA, 25 bp, Mus musculus
gggttattcaaatagccttcttcta

SEQ ID NO: 642812 - DNA, 25 bp, Mus musculus
gggttattcaagacatccatggaaa

SEQ ID NO: 642813 - DNA, 25 bp, Mus musculus
gggttattcaagtcatccatggaaa

SEQ ID NO: 642814 - DNA, 25 bp, Mus musculus
gggttattcataatccttgggattt

SEQ ID NO: 642815 - DNA, 25 bp, Mus musculus
gggttattcatattccttgggattt

SEQ ID NO: 642816 - DNA, 25 bp, Mus musculus
gggttattcctgcactttgcagttt

SEQ ID NO: 642817 - DNA, 25 bp, Mus musculus
gggttattcctggactttgcagttt

SEQ ID NO: 642818 - DNA, 25 bp, Mus musculus
gggttattctgcaccatagagagat

SEQ ID NO: 642819 - DNA, 25 bp, Mus musculus
gggttattctgctccatagagagat

SEQ ID NO: 642820 - DNA, 25 bp, Mus musculus
gggttattgcccaacactggattta

SEQ ID NO: 642821 - DNA, 25 bp, Mus musculus
gggttattgccctacactggattta

SEQ ID NO: 642822 - DNA, 25 bp, Mus musculus
gggttattgctcaccatccacacta

SEQ ID NO: 642823 - DNA, 25 bp, Mus musculus
gggttattgctctccatccacacta

SEQ ID NO: 642824 - DNA, 25 bp, Mus musculus
gggttattgcttataggaactctgg

SEQ ID NO: 642825 - DNA, 25 bp, Mus musculus
gggttattgcttttaggaactctgg

SEQ ID NO: 642826 - DNA, 25 bp, Mus musculus
gggttattggttctcttatgtgtaa

SEQ ID NO: 642827 - DNA, 25 bp, Mus musculus
gggttattggttgtcttatgtgtaa

SEQ ID NO: 642828 - DNA, 25 bp, Mus musculus
gggttattgtgactcatcagagcat

SEQ ID NO: 642829 - DNA, 25 bp, Mus musculus
gggttattgtgagtcatcagagcat

SEQ ID NO: 642830 - DNA, 25 bp, Mus musculus
gggttatttaatagcactttccagc

SEQ ID NO: 642831 - DNA, 25 bp, Mus musculus
gggttatttaattgcactttccagc

SEQ ID NO: 642832 - DNA, 25 bp, Mus musculus
gggttatttaccataacctgttcat

SEQ ID NO: 642833 - DNA, 25 bp, Mus musculus
gggttatttaccttaacctgttcat

SEQ ID NO: 642834 - DNA, 25 bp, Mus musculus
gggttattttccactcatcttgatc

SEQ ID NO: 642835 - DNA, 25 bp, Mus musculus
gggttattttcctctcatcttgatc

SEQ ID NO: 642836 - DNA, 25 bp, Mus musculus
gggttcaaacgtacatattcacttt

SEQ ID NO: 642837 - DNA, 25 bp, Mus musculus
gggttcaaacgttcatattcacttt

SEQ ID NO: 642838 - DNA, 25 bp, Mus musculus
gggttcaaactcaagaccttcacct

SEQ ID NO: 642839 - DNA, 25 bp, Mus musculus
gggttcaaactctagaccttcacct

SEQ ID NO: 642840 - DNA, 25 bp, Mus musculus
gggttcaaataacttcttggtcaca

SEQ ID NO: 642841 - DNA, 25 bp, Mus musculus
gggttcaaataagttcttggtcaca

SEQ ID NO: 642842 - DNA, 25 bp, Mus musculus
gggttcaaatgtccagcactgtaga

SEQ ID NO: 642843 - DNA, 25 bp, Mus musculus
gggttcaaatgtgcagcactgtaga

SEQ ID NO: 642844 - DNA, 25 bp, Mus musculus
gggttcaacacccagtttgctatcc

SEQ ID NO: 642845 - DNA, 25 bp, Mus musculus
gggttcaacaccgagtttgctatcc

SEQ ID NO: 642846 - DNA, 25 bp, Mus musculus
gggttcaaccacatgagtcccttaa

SEQ ID NO: 642847 - DNA, 25 bp, Mus musculus
gggttcaaccacttgagtcccttaa

SEQ ID NO: 642848 - DNA, 25 bp, Mus musculus
gggttcaactctcttactcagtgaa

SEQ ID NO: 642849 - DNA, 25 bp, Mus musculus
gggttcaactctgttactcagtgaa

SEQ ID NO: 642850 - DNA, 25 bp, Mus musculus
gggttcaactgccaagcctgcgttt

SEQ ID NO: 642851 - DNA, 25 bp, Mus musculus
gggttcaactgcgaagcctgcgttt

SEQ ID NO: 642852 - DNA, 25 bp, Mus musculus
gggttcaacttgacagtgtacttcg

SEQ ID NO: 642853 - DNA, 25 bp, Mus musculus
gggttcaacttgtcagtgtacttcg

SEQ ID NO: 642854 - DNA, 25 bp, Mus musculus
gggttcaagagtcctggcctatgat

SEQ ID NO: 642855 - DNA, 25 bp, Mus musculus
gggttcaagagtgctggcctatgat

SEQ ID NO: 642856 - DNA, 25 bp, Mus musculus
gggttcaatcagacccagtcttctg

SEQ ID NO: 642857 - DNA, 25 bp, Mus musculus
gggttcaatcagtcccagtcttctg

SEQ ID NO: 642858 - DNA, 25 bp, Mus musculus
gggttcaatgcccaacaactccagc

SEQ ID NO: 642859 - DNA, 25 bp, Mus musculus
gggttcaatgccgaacaactccagc

SEQ ID NO: 642860 - DNA, 25 bp, Mus musculus
gggttcaattagatattaaaaggct

SEQ ID NO: 642861 - DNA, 25 bp, Mus musculus
gggttcaattagttattaaaaggct

SEQ ID NO: 642862 - DNA, 25 bp, Mus musculus
gggttcaattccaaggaccaccctg

SEQ ID NO: 642863 - DNA, 25 bp, Mus musculus
gggttcaattccagtgccataaaga

SEQ ID NO: 642864 - DNA, 25 bp, Mus musculus
gggttcaattcctaggaccaccctg

SEQ ID NO: 642865 - DNA, 25 bp, Mus musculus
gggttcaattcctgtgccataaaga

SEQ ID NO: 642866 - DNA, 25 bp, Mus musculus
gggttcacaagtccacacttggagc

SEQ ID NO: 642867 - DNA, 25 bp, Mus musculus
gggttcacaagtgcacacttggagc

SEQ ID NO: 642868 - DNA, 25 bp, Mus musculus
gggttcacagctacactgaaaaatt

SEQ ID NO: 642869 - DNA, 25 bp, Mus musculus
gggttcacagcttcactgaaaaatt

SEQ ID NO: 642870 - DNA, 25 bp, Mus musculus
gggttcacatccagggatctcagaa

SEQ ID NO: 642871 - DNA, 25 bp, Mus musculus
gggttcacatcctgggatctcagaa

SEQ ID NO: 642872 - DNA, 25 bp, Mus musculus
gggttcacattaaacttgtttccat

SEQ ID NO: 642873 - DNA, 25 bp, Mus musculus
gggttcacattatacttgtttccat

SEQ ID NO: 642874 - DNA, 25 bp, Mus musculus
gggttcaccagtctctagtaagttc

SEQ ID NO: 642875 - DNA, 25 bp, Mus musculus
gggttcaccagtgtctagtaagttc

SEQ ID NO: 642876 - DNA, 25 bp, Mus musculus
gggttcacctagagtgttagtgact

SEQ ID NO: 642877 - DNA, 25 bp, Mus musculus
gggttcacctagtgtgttagtgact

SEQ ID NO: 642878 - DNA, 25 bp, Mus musculus
gggttcacctgtcataactaccgag

SEQ ID NO: 642879 - DNA, 25 bp, Mus musculus
gggttcacctgtgataactaccgag

SEQ ID NO: 642880 - DNA, 25 bp, Mus musculus
gggttcaccttgcaagtagacgatt

SEQ ID NO: 642881 - DNA, 25 bp, Mus musculus
gggttcaccttggaagtagacgatt

SEQ ID NO: 642882 - DNA, 25 bp, Mus musculus
gggttcactgggacctttctaggtg

SEQ ID NO: 642883 - DNA, 25 bp, Mus musculus
gggttcactgggtcctttctaggtg

SEQ ID NO: 642884 - DNA, 25 bp, Mus musculus
gggttcactgttaagtgggctccac

SEQ ID NO: 642885 - DNA, 25 bp, Mus musculus
gggttcactgtttagtgggctccac

SEQ ID NO: 642886 - DNA, 25 bp, Mus musculus
gggttcacttgaagcactgtatttc

SEQ ID NO: 642887 - DNA, 25 bp, Mus musculus
gggttcacttgatgcactgtatttc

SEQ ID NO: 642888 - DNA, 25 bp, Mus musculus
gggttcagaatcaacatatgctgga

SEQ ID NO: 642889 - DNA, 25 bp, Mus musculus
gggttcagaatctacatatgctgga

SEQ ID NO: 642890 - DNA, 25 bp, Mus musculus
gggttcagactccttagctctctca

SEQ ID NO: 642891 - DNA, 25 bp, Mus musculus
gggttcagactcgttagctctctca

SEQ ID NO: 642892 - DNA, 25 bp, Mus musculus
gggttcagaggtcgcaaacttctca

SEQ ID NO: 642893 - DNA, 25 bp, Mus musculus
gggttcagaggtggcaaacttctca

SEQ ID NO: 642894 - DNA, 25 bp, Mus musculus
gggttcagatatattattattggct

SEQ ID NO: 642895 - DNA, 25 bp, Mus musculus
gggttcagatattttattattggct

SEQ ID NO: 642896 - DNA, 25 bp, Mus musculus
gggttcagattgaccatactttgct

SEQ ID NO: 642897 - DNA, 25 bp, Mus musculus
gggttcagattgtccatactttgct

SEQ ID NO: 642898 - DNA, 25 bp, Mus musculus
gggttcagccctcgatgccaacaga

SEQ ID NO: 642899 - DNA, 25 bp, Mus musculus
gggttcagccctggatgccaacaga

SEQ ID NO: 642900 - DNA, 25 bp, Mus musculus
gggttcagccgcataagctgccttt

SEQ ID NO: 642901 - DNA, 25 bp, Mus musculus
gggttcagccgcttaagctgccttt

SEQ ID NO: 642902 - DNA, 25 bp, Mus musculus
gggttcagccttattataccatgag

SEQ ID NO: 642903 - DNA, 25 bp, Mus musculus
gggttcagcctttttataccatgag

SEQ ID NO: 642904 - DNA, 25 bp, Mus musculus
gggttcagctgtagattcccagaat

SEQ ID NO: 642905 - DNA, 25 bp, Mus musculus
gggttcagctgttgattcccagaat

SEQ ID NO: 642906 - DNA, 25 bp, Mus musculus
gggttcagcttgactctatgtatat

SEQ ID NO: 642907 - DNA, 25 bp, Mus musculus
gggttcagcttgtctctatgtatat

SEQ ID NO: 642908 - DNA, 25 bp, Mus musculus
gggttcaggacaagaggtgcccctc

SEQ ID NO: 642909 - DNA, 25 bp, Mus musculus
gggttcaggacatgaggtgcccctc

SEQ ID NO: 642910 - DNA, 25 bp, Mus musculus
gggttcaggcatagtctttttccct

SEQ ID NO: 642911 - DNA, 25 bp, Mus musculus
gggttcaggcattgtctttttccct

SEQ ID NO: 642912 - DNA, 25 bp, Mus musculus
gggttcaggctccaggatcaattta

SEQ ID NO: 642913 - DNA, 25 bp, Mus musculus
gggttcaggctcgaggatcaattta

SEQ ID NO: 642914 - DNA, 25 bp, Mus musculus
gggttcaggtccacctgacaatagt

SEQ ID NO: 642915 - DNA, 25 bp, Mus musculus
gggttcaggtcctcctgacaatagt

SEQ ID NO: 642916 - DNA, 25 bp, Mus musculus
gggttcaggttcagctctgaagaga

SEQ ID NO: 642917 - DNA, 25 bp, Mus musculus
gggttcaggttctgctctgaagaga

SEQ ID NO: 642918 - DNA, 25 bp, Mus musculus
gggttcagtccaaatgcgttcacag

SEQ ID NO: 642919 - DNA, 25 bp, Mus musculus
gggttcagtccatatgcgttcacag

SEQ ID NO: 642920 - DNA, 25 bp, Mus musculus
gggttcagttgccagctcaaagcaa

SEQ ID NO: 642921 - DNA, 25 bp, Mus musculus
gggttcagttgcgagctcaaagcaa

SEQ ID NO: 642922 - DNA, 25 bp, Mus musculus
gggttcataaccagtggctcacaac

SEQ ID NO: 642923 - DNA, 25 bp, Mus musculus
gggttcataacctgtggctcacaac

SEQ ID NO: 642924 - DNA, 25 bp, Mus musculus
gggttcatactcagctatcaagacg

SEQ ID NO: 642925 - DNA, 25 bp, Mus musculus
gggttcatactctgctatcaagacg

SEQ ID NO: 642926 - DNA, 25 bp, Mus musculus
gggttcatagaacagtcagtcctag

SEQ ID NO: 642927 - DNA, 25 bp, Mus musculus
gggttcatagaagagtcagtcctag

SEQ ID NO: 642928 - DNA, 25 bp, Mus musculus
gggttcatagatcttttgaccatta

SEQ ID NO: 642929 - DNA, 25 bp, Mus musculus
gggttcatagatgttttgaccatta

SEQ ID NO: 642930 - DNA, 25 bp, Mus musculus
gggttcatattgctggcgcattcat

SEQ ID NO: 642931 - DNA, 25 bp, Mus musculus
gggttcatattggtggcgcattcat

SEQ ID NO: 642932 - DNA, 25 bp, Mus musculus
gggttcatcatcctcccagaggcca

SEQ ID NO: 642933 - DNA, 25 bp, Mus musculus
gggttcatcatcgtcccagaggcca

SEQ ID NO: 642934 - DNA, 25 bp, Mus musculus
gggttcatcatgcacctgagtactg

SEQ ID NO: 642935 - DNA, 25 bp, Mus musculus
gggttcatcatggacctgagtactg

SEQ ID NO: 642936 - DNA, 25 bp, Mus musculus
gggttcatccagattagagggctca

SEQ ID NO: 642937 - DNA, 25 bp, Mus musculus
gggttcatccagtttagagggctca

SEQ ID NO: 642938 - DNA, 25 bp, Mus musculus
gggttcatcgacctgatcttagtag

SEQ ID NO: 642939 - DNA, 25 bp, Mus musculus
gggttcatcgacgtgatcttagtag

SEQ ID NO: 642940 - DNA, 25 bp, Mus musculus
gggttcatctgcagtaccgctaaga

SEQ ID NO: 642941 - DNA, 25 bp, Mus musculus
gggttcatctgctgtaccgctaaga

SEQ ID NO: 642942 - DNA, 25 bp, Mus musculus
gggttcatcttcaaatattgttact

SEQ ID NO: 642943 - DNA, 25 bp, Mus musculus
gggttcatcttctaatattgttact

SEQ ID NO: 642944 - DNA, 25 bp, Mus musculus
gggttcatgatcattcttagtcaca

SEQ ID NO: 642945 - DNA, 25 bp, Mus musculus
gggttcatgatctttcttagtcaca

SEQ ID NO: 642946 - DNA, 25 bp, Mus musculus
gggttcatgcctaactgactgtatt

SEQ ID NO: 642947 - DNA, 25 bp, Mus musculus
gggttcatgccttactgactgtatt

SEQ ID NO: 642948 - DNA, 25 bp, Mus musculus
gggttcattaacactgggatcttaa

SEQ ID NO: 642949 - DNA, 25 bp, Mus musculus
gggttcattaactctgggatcttaa

SEQ ID NO: 642950 - DNA, 25 bp, Mus musculus
gggttcattcagatccgggagaagc

SEQ ID NO: 642951 - DNA, 25 bp, Mus musculus
gggttcattcagttccgggagaagc

SEQ ID NO: 642952 - DNA, 25 bp, Mus musculus
gggttcattgttatcatctgtgttc

SEQ ID NO: 642953 - DNA, 25 bp, Mus musculus
gggttcattgttttcatctgtgttc

SEQ ID NO: 642954 - DNA, 25 bp, Mus musculus
gggttcatttaacatagaatcatct

SEQ ID NO: 642955 - DNA, 25 bp, Mus musculus
gggttcatttaagatagaatcatct

SEQ ID NO: 642956 - DNA, 25 bp, Mus musculus
gggttcatttctcaaaatttagtca

SEQ ID NO: 642957 - DNA, 25 bp, Mus musculus
gggttcatttctgaaaatttagtca

SEQ ID NO: 642958 - DNA, 25 bp, Mus musculus
gggttcattttaccatggctacact

SEQ ID NO: 642959 - DNA, 25 bp, Mus musculus
gggttcattttagcatggctacact

SEQ ID NO: 642960 - DNA, 25 bp, Mus musculus
gggttcattttgcatttctgtcact

SEQ ID NO: 642961 - DNA, 25 bp, Mus musculus
gggttcattttggatttctgtcact

SEQ ID NO: 642962 - DNA, 25 bp, Mus musculus
gggttccaaaatcgcactgcagttt

SEQ ID NO: 642963 - DNA, 25 bp, Mus musculus
gggttccaaaatggcactgcagttt

SEQ ID NO: 642964 - DNA, 25 bp, Mus musculus
gggttccaaatgatatacgccgatt

SEQ ID NO: 642965 - DNA, 25 bp, Mus musculus
gggttccaaatgttatacgccgatt

SEQ ID NO: 642966 - DNA, 25 bp, Mus musculus
gggttccaacaactgaattatgtaa

SEQ ID NO: 642967 - DNA, 25 bp, Mus musculus
gggttccaacaagtgaattatgtaa

SEQ ID NO: 642968 - DNA, 25 bp, Mus musculus
gggttccaacagagtgtttcctcca

SEQ ID NO: 642969 - DNA, 25 bp, Mus musculus
gggttccaacagtgtgtttcctcca

SEQ ID NO: 642970 - DNA, 25 bp, Mus musculus
gggttccaacatccatatttcacat

SEQ ID NO: 642971 - DNA, 25 bp, Mus musculus
gggttccaacatgcatatttcacat

SEQ ID NO: 642972 - DNA, 25 bp, Mus musculus
gggttccaattcaaaacagctagag

SEQ ID NO: 642973 - DNA, 25 bp, Mus musculus
gggttccaattcatcaggacttgac

SEQ ID NO: 642974 - DNA, 25 bp, Mus musculus
gggttccaattctaaacagctagag

SEQ ID NO: 642975 - DNA, 25 bp, Mus musculus
gggttccaattcttcaggacttgac

SEQ ID NO: 642976 - DNA, 25 bp, Mus musculus
gggttccaattgagctctttcagta

SEQ ID NO: 642977 - DNA, 25 bp, Mus musculus
gggttccaattgtgctctttcagta

SEQ ID NO: 642978 - DNA, 25 bp, Mus musculus
gggttccacaccacgcactggtagg

SEQ ID NO: 642979 - DNA, 25 bp, Mus musculus
gggttccacacctcgcactggtagg

SEQ ID NO: 642980 - DNA, 25 bp, Mus musculus
gggttccacactaggagtcgcgtag

SEQ ID NO: 642981 - DNA, 25 bp, Mus musculus
gggttccacacttggagtcgcgtag

SEQ ID NO: 642982 - DNA, 25 bp, Mus musculus
gggttccacataatcatttgcgaaa

SEQ ID NO: 642983 - DNA, 25 bp, Mus musculus
gggttccacatattcatttgcgaaa

SEQ ID NO: 642984 - DNA, 25 bp, Mus musculus
gggttccactcaaatataccagtta

SEQ ID NO: 642985 - DNA, 25 bp, Mus musculus
gggttccactcatatataccagtta

SEQ ID NO: 642986 - DNA, 25 bp, Mus musculus
gggttccactccaaaggactgtcca

SEQ ID NO: 642987 - DNA, 25 bp, Mus musculus
gggttccactcctaaggactgtcca

SEQ ID NO: 642988 - DNA, 25 bp, Mus musculus
gggttccagatacccctgagcgacg

SEQ ID NO: 642989 - DNA, 25 bp, Mus musculus
gggttccagatagccctgagcgacg

SEQ ID NO: 642990 - DNA, 25 bp, Mus musculus
gggttccagatcatactcatctttg

SEQ ID NO: 642991 - DNA, 25 bp, Mus musculus
gggttccagatcttactcatctttg

SEQ ID NO: 642992 - DNA, 25 bp, Mus musculus
gggttccagcacagctgtatcaatg

SEQ ID NO: 642993 - DNA, 25 bp, Mus musculus
gggttccagcactgctgtatcaatg

SEQ ID NO: 642994 - DNA, 25 bp, Mus musculus
gggttccagcagcaggaaatcagca

SEQ ID NO: 642995 - DNA, 25 bp, Mus musculus
gggttccagcaggaggaaatcagca

SEQ ID NO: 642996 - DNA, 25 bp, Mus musculus
gggttccagccaatgtgacattgaa

SEQ ID NO: 642997 - DNA, 25 bp, Mus musculus
gggttccagccattgtgacattgaa

SEQ ID NO: 642998 - DNA, 25 bp, Mus musculus
gggttccagcctcaaagagcagctc

SEQ ID NO: 642999 - DNA, 25 bp, Mus musculus
gggttccagcctgaaagagcagctc

SEQ ID NO: 643000 - DNA, 25 bp, Mus musculus
gggttccagtatattcataggctgt

SEQ ID NO: 643001 - DNA, 25 bp, Mus musculus
gggttccagtattttcataggctgt

SEQ ID NO: 643002 - DNA, 25 bp, Mus musculus
gggttccagtgacaacacatctgtc

SEQ ID NO: 643003 - DNA, 25 bp, Mus musculus
gggttccagtgagaacacatctgtc

SEQ ID NO: 643004 - DNA, 25 bp, Mus musculus
gggttccagtgcagacatatccagt

SEQ ID NO: 643005 - DNA, 25 bp, Mus musculus
gggttccagtgctgacatatccagt

SEQ ID NO: 643006 - DNA, 25 bp, Mus musculus
gggttccatacaagaagacttaaag

SEQ ID NO: 643007 - DNA, 25 bp, Mus musculus
gggttccatacatgaagacttaaag

SEQ ID NO: 643008 - DNA, 25 bp, Mus musculus
gggttccatattcagcttacatcat

SEQ ID NO: 643009 - DNA, 25 bp, Mus musculus
gggttccatattgagcttacatcat

SEQ ID NO: 643010 - DNA, 25 bp, Mus musculus
gggttccatcatccccaagaagggt

SEQ ID NO: 643011 - DNA, 25 bp, Mus musculus
gggttccatcatgcccaagaagggt

SEQ ID NO: 643012 - DNA, 25 bp, Mus musculus
gggttccatccaaataaagactctt

SEQ ID NO: 643013 - DNA, 25 bp, Mus musculus
gggttccatccatataaagactctt

SEQ ID NO: 643014 - DNA, 25 bp, Mus musculus
gggttccatcccctaaaatgtggca

SEQ ID NO: 643015 - DNA, 25 bp, Mus musculus
gggttccatcccgtaaaatgtggca

SEQ ID NO: 643016 - DNA, 25 bp, Mus musculus
gggttccatgcgcatactctctgga

SEQ ID NO: 643017 - DNA, 25 bp, Mus musculus
gggttccatgcggatactctctgga

SEQ ID NO: 643018 - DNA, 25 bp, Mus musculus
gggttccatttgactgtttgcattg

SEQ ID NO: 643019 - DNA, 25 bp, Mus musculus
gggttccatttgtctgtttgcattg

SEQ ID NO: 643020 - DNA, 25 bp, Mus musculus
gggttcccaaagcatcagttgttca

SEQ ID NO: 643021 - DNA, 25 bp, Mus musculus
gggttcccaaaggatcagttgttca

SEQ ID NO: 643022 - DNA, 25 bp, Mus musculus
gggttcccaactctcaataaagctg

SEQ ID NO: 643023 - DNA, 25 bp, Mus musculus
gggttcccaactgtcaataaagctg

SEQ ID NO: 643024 - DNA, 25 bp, Mus musculus
gggttcccagaaatccatgcattga

SEQ ID NO: 643025 - DNA, 25 bp, Mus musculus
gggttcccagaattccatgcattga

SEQ ID NO: 643026 - DNA, 25 bp, Mus musculus
gggttcccaggcaattgctgatcaa

SEQ ID NO: 643027 - DNA, 25 bp, Mus musculus
gggttcccaggctattgctgatcaa

SEQ ID NO: 643028 - DNA, 25 bp, Mus musculus
gggttcccagtacccactgtgcaaa

SEQ ID NO: 643029 - DNA, 25 bp, Mus musculus
gggttcccagtagccactgtgcaaa

SEQ ID NO: 643030 - DNA, 25 bp, Mus musculus
gggttcccatcgcagcagcagatct

SEQ ID NO: 643031 - DNA, 25 bp, Mus musculus
gggttcccatcgcattgaacataca

SEQ ID NO: 643032 - DNA, 25 bp, Mus musculus
gggttcccatcggagcagcagatct

SEQ ID NO: 643033 - DNA, 25 bp, Mus musculus
gggttcccatcggattgaacataca

SEQ ID NO: 643034 - DNA, 25 bp, Mus musculus
gggttccccagtacagatgttaatc

SEQ ID NO: 643035 - DNA, 25 bp, Mus musculus
gggttccccagttcagatgttaatc

SEQ ID NO: 643036 - DNA, 25 bp, Mus musculus
gggttcccctgtcaagaatgcagac

SEQ ID NO: 643037 - DNA, 25 bp, Mus musculus
gggttcccctgtgaagaatgcagac

SEQ ID NO: 643038 - DNA, 25 bp, Mus musculus
gggttcccgttgagagtatgctgaa

SEQ ID NO: 643039 - DNA, 25 bp, Mus musculus
gggttcccgttgtgagtatgctgaa

SEQ ID NO: 643040 - DNA, 25 bp, Mus musculus
gggttccctagacactctggtatag

SEQ ID NO: 643041 - DNA, 25 bp, Mus musculus
gggttccctagagactctggtatag

SEQ ID NO: 643042 - DNA, 25 bp, Mus musculus
gggttccctccgcatgaacttggac

SEQ ID NO: 643043 - DNA, 25 bp, Mus musculus
gggttccctccggatgaacttggac

SEQ ID NO: 643044 - DNA, 25 bp, Mus musculus
gggttccctttcaatagacaggaga

SEQ ID NO: 643045 - DNA, 25 bp, Mus musculus
gggttccctttctatagacaggaga

SEQ ID NO: 643046 - DNA, 25 bp, Mus musculus
gggttccgctttaagccactaggtg

SEQ ID NO: 643047 - DNA, 25 bp, Mus musculus
gggttccgcttttagccactaggtg

SEQ ID NO: 643048 - DNA, 25 bp, Mus musculus
gggttcctaaggaccagtcacaact

SEQ ID NO: 643049 - DNA, 25 bp, Mus musculus
gggttcctaaggtccagtcacaact

SEQ ID NO: 643050 - DNA, 25 bp, Mus musculus
gggttcctacagaggataatcttgt

SEQ ID NO: 643051 - DNA, 25 bp, Mus musculus
gggttcctacagtggataatcttgt

SEQ ID NO: 643052 - DNA, 25 bp, Mus musculus
gggttcctagagcatttggtaaact

SEQ ID NO: 643053 - DNA, 25 bp, Mus musculus
gggttcctagaggatttggtaaact

SEQ ID NO: 643054 - DNA, 25 bp, Mus musculus
gggttcctatgtcgattaacctatc

SEQ ID NO: 643055 - DNA, 25 bp, Mus musculus
gggttcctatgtggattaacctatc

SEQ ID NO: 643056 - DNA, 25 bp, Mus musculus
gggttcctattcctacacacaggtg

SEQ ID NO: 643057 - DNA, 25 bp, Mus musculus
gggttcctattcgtacacacaggtg

SEQ ID NO: 643058 - DNA, 25 bp, Mus musculus
gggttcctcaatcccaatggaagca

SEQ ID NO: 643059 - DNA, 25 bp, Mus musculus
gggttcctcaatgccaatggaagca

SEQ ID NO: 643060 - DNA, 25 bp, Mus musculus
gggttcctcataactgcaccaagag

SEQ ID NO: 643061 - DNA, 25 bp, Mus musculus
gggttcctcatatctgcaccaagag

SEQ ID NO: 643062 - DNA, 25 bp, Mus musculus
gggttcctccgtcaagaagaccatg

SEQ ID NO: 643063 - DNA, 25 bp, Mus musculus
gggttcctccgtgaagaagaccatg

SEQ ID NO: 643064 - DNA, 25 bp, Mus musculus
gggttcctcctgaccaccagggaat

SEQ ID NO: 643065 - DNA, 25 bp, Mus musculus
gggttcctcctgtccaccagggaat

SEQ ID NO: 643066 - DNA, 25 bp, Mus musculus
gggttcctccttaaagcagattgcc

SEQ ID NO: 643067 - DNA, 25 bp, Mus musculus
gggttcctccttacacagaattatt

SEQ ID NO: 643068 - DNA, 25 bp, Mus musculus
gggttcctcctttaagcagattgcc

SEQ ID NO: 643069 - DNA, 25 bp, Mus musculus
gggttcctcctttcacagaattatt

SEQ ID NO: 643070 - DNA, 25 bp, Mus musculus
gggttcctgaatccaccataattgc

SEQ ID NO: 643071 - DNA, 25 bp, Mus musculus
gggttcctgaatgcaccataattgc

SEQ ID NO: 643072 - DNA, 25 bp, Mus musculus
gggttcctggccactggagggtgtc

SEQ ID NO: 643073 - DNA, 25 bp, Mus musculus
gggttcctggcctctggagggtgtc

SEQ ID NO: 643074 - DNA, 25 bp, Mus musculus
gggttcctgtacagaagggtccaat

SEQ ID NO: 643075 - DNA, 25 bp, Mus musculus
gggttcctgtactgaagggtccaat

SEQ ID NO: 643076 - DNA, 25 bp, Mus musculus
gggttcctgtcactgaatcgagtcg

SEQ ID NO: 643077 - DNA, 25 bp, Mus musculus
gggttcctgtcagtgaatcgagtcg

SEQ ID NO: 643078 - DNA, 25 bp, Mus musculus
gggttccttactctagtaacttcag

SEQ ID NO: 643079 - DNA, 25 bp, Mus musculus
gggttccttactgtagtaacttcag

SEQ ID NO: 643080 - DNA, 25 bp, Mus musculus
gggttccttcatcggcacctggcaa

SEQ ID NO: 643081 - DNA, 25 bp, Mus musculus
gggttccttcatgggcacctggcaa

SEQ ID NO: 643082 - DNA, 25 bp, Mus musculus
gggttccttgttacagccaacagga

SEQ ID NO: 643083 - DNA, 25 bp, Mus musculus
gggttccttgtttcagccaacagga

SEQ ID NO: 643084 - DNA, 25 bp, Mus musculus
gggttcgaacaaaggcgccatcatc

SEQ ID NO: 643085 - DNA, 25 bp, Mus musculus
gggttcgaacaatggcgccatcatc

SEQ ID NO: 643086 - DNA, 25 bp, Mus musculus
gggttcgacgtaatcaatgcactgg

SEQ ID NO: 643087 - DNA, 25 bp, Mus musculus
gggttcgacgtattcaatgcactgg

SEQ ID NO: 643088 - DNA, 25 bp, Mus musculus
gggttcgacgtgagataaggtatcc

SEQ ID NO: 643089 - DNA, 25 bp, Mus musculus
gggttcgacgtgtgataaggtatcc

SEQ ID NO: 643090 - DNA, 25 bp, Mus musculus
gggttcgagcccaattttacattgt

SEQ ID NO: 643091 - DNA, 25 bp, Mus musculus
gggttcgagccctattttacattgt

SEQ ID NO: 643092 - DNA, 25 bp, Mus musculus
gggttcgagcttctaccataaatac

SEQ ID NO: 643093 - DNA, 25 bp, Mus musculus
gggttcgagcttgtaccataaatac

SEQ ID NO: 643094 - DNA, 25 bp, Mus musculus
gggttcgagtttatggctgctctat

SEQ ID NO: 643095 - DNA, 25 bp, Mus musculus
gggttcgagtttttggctgctctat

SEQ ID NO: 643096 - DNA, 25 bp, Mus musculus
gggttcgatgttcaaaaagccaaga

SEQ ID NO: 643097 - DNA, 25 bp, Mus musculus
gggttcgatgttgaaaaagccaaga

SEQ ID NO: 643098 - DNA, 25 bp, Mus musculus
gggttcgcagttatagcaccggcac

SEQ ID NO: 643099 - DNA, 25 bp, Mus musculus
gggttcgcagttttagcaccggcac

SEQ ID NO: 643100 - DNA, 25 bp, Mus musculus
gggttcgcttctatatccccggagt

SEQ ID NO: 643101 - DNA, 25 bp, Mus musculus
gggttcgcttctttatccccggagt

SEQ ID NO: 643102 - DNA, 25 bp, Mus musculus
gggttcgtatccaagcaacatcaat

SEQ ID NO: 643103 - DNA, 25 bp, Mus musculus
gggttcgtatcctagcaacatcaat

SEQ ID NO: 643104 - DNA, 25 bp, Mus musculus
gggttcgtccagaagttttgattgt

SEQ ID NO: 643105 - DNA, 25 bp, Mus musculus
gggttcgtccagtagttttgattgt

SEQ ID NO: 643106 - DNA, 25 bp, Mus musculus
gggttcgtctctatggaatcaacaa

SEQ ID NO: 643107 - DNA, 25 bp, Mus musculus
gggttcgtctctttggaatcaacaa

SEQ ID NO: 643108 - DNA, 25 bp, Mus musculus
gggttcgtctggctagtataagcaa

SEQ ID NO: 643109 - DNA, 25 bp, Mus musculus
gggttcgtctgggtagtataagcaa

SEQ ID NO: 643110 - DNA, 25 bp, Mus musculus
gggttctaaatcaccattacagtga

SEQ ID NO: 643111 - DNA, 25 bp, Mus musculus
gggttctaaatcctacaggctggtc

SEQ ID NO: 643112 - DNA, 25 bp, Mus musculus
gggttctaaatcgtacaggctggtc

SEQ ID NO: 643113 - DNA, 25 bp, Mus musculus
gggttctaaatctccattacagtga

SEQ ID NO: 643114 - DNA, 25 bp, Mus musculus
gggttctaactgatctaccttggcc

SEQ ID NO: 643115 - DNA, 25 bp, Mus musculus
gggttctaactgttctaccttggcc

SEQ ID NO: 643116 - DNA, 25 bp, Mus musculus
gggttctaatccagtacatgactct

SEQ ID NO: 643117 - DNA, 25 bp, Mus musculus
gggttctaatcctgtacatgactct

SEQ ID NO: 643118 - DNA, 25 bp, Mus musculus
gggttctacactctcttatttgcac

SEQ ID NO: 643119 - DNA, 25 bp, Mus musculus
gggttctacactgtcttatttgcac

SEQ ID NO: 643120 - DNA, 25 bp, Mus musculus
gggttctacctcaactggaagcatt

SEQ ID NO: 643121 - DNA, 25 bp, Mus musculus
gggttctacctccttgtgcaaaggg

SEQ ID NO: 643122 - DNA, 25 bp, Mus musculus
gggttctacctcgttgtgcaaaggg

SEQ ID NO: 643123 - DNA, 25 bp, Mus musculus
gggttctacctctactggaagcatt

SEQ ID NO: 643124 - DNA, 25 bp, Mus musculus
gggttctactcgaattcctcggatc

SEQ ID NO: 643125 - DNA, 25 bp, Mus musculus
gggttctactcgtattcctcggatc

SEQ ID NO: 643126 - DNA, 25 bp, Mus musculus
gggttctagaaccactttctgctag

SEQ ID NO: 643127 - DNA, 25 bp, Mus musculus
gggttctagaacgactttctgctag

SEQ ID NO: 643128 - DNA, 25 bp, Mus musculus
gggttctagaagctgctgcctttca

SEQ ID NO: 643129 - DNA, 25 bp, Mus musculus
gggttctagaaggtgctgcctttca

SEQ ID NO: 643130 - DNA, 25 bp, Mus musculus
gggttctagagcagcattgtccgga

SEQ ID NO: 643131 - DNA, 25 bp, Mus musculus
gggttctagagctgcattgtccgga

SEQ ID NO: 643132 - DNA, 25 bp, Mus musculus
gggttctagcttcgacttgttctgg

SEQ ID NO: 643133 - DNA, 25 bp, Mus musculus
gggttctagcttggacttgttctgg

SEQ ID NO: 643134 - DNA, 25 bp, Mus musculus
gggttctaggctatcatgtatcaga

SEQ ID NO: 643135 - DNA, 25 bp, Mus musculus
gggttctaggctttcatgtatcaga

SEQ ID NO: 643136 - DNA, 25 bp, Mus musculus
gggttctagtcaaagcttcttgctt

SEQ ID NO: 643137 - DNA, 25 bp, Mus musculus
gggttctagtcatagcttcttgctt

SEQ ID NO: 643138 - DNA, 25 bp, Mus musculus
gggttctagtgtcggcttcaaactc

SEQ ID NO: 643139 - DNA, 25 bp, Mus musculus
gggttctagtgtgggcttcaaactc

SEQ ID NO: 643140 - DNA, 25 bp, Mus musculus
gggttctagtttctgatgttggctt

SEQ ID NO: 643141 - DNA, 25 bp, Mus musculus
gggttctagtttgtgatgttggctt

SEQ ID NO: 643142 - DNA, 25 bp, Mus musculus
gggttctatactcagatcctgataa

SEQ ID NO: 643143 - DNA, 25 bp, Mus musculus
gggttctatactgagatcctgataa

SEQ ID NO: 643144 - DNA, 25 bp, Mus musculus
gggttctatgcactgtatcgtgttg

SEQ ID NO: 643145 - DNA, 25 bp, Mus musculus
gggttctatgcagtgtatcgtgttg

SEQ ID NO: 643146 - DNA, 25 bp, Mus musculus
gggttctatttcatcagtttgcggg

SEQ ID NO: 643147 - DNA, 25 bp, Mus musculus
gggttctatttcttcagtttgcggg

SEQ ID NO: 643148 - DNA, 25 bp, Mus musculus
gggttctcaattcgttccgagtgcc

SEQ ID NO: 643149 - DNA, 25 bp, Mus musculus
gggttctcaattggttccgagtgcc

SEQ ID NO: 643150 - DNA, 25 bp, Mus musculus
gggttctcagccacttggacgtcac

SEQ ID NO: 643151 - DNA, 25 bp, Mus musculus
gggttctcagcctcttggacgtcac

SEQ ID NO: 643152 - DNA, 25 bp, Mus musculus
gggttctcaggaaacaggaccacct

SEQ ID NO: 643153 - DNA, 25 bp, Mus musculus
gggttctcaggatacaggaccacct

SEQ ID NO: 643154 - DNA, 25 bp, Mus musculus
gggttctcaggtattgacttttcct

SEQ ID NO: 643155 - DNA, 25 bp, Mus musculus
gggttctcaggttttgacttttcct

SEQ ID NO: 643156 - DNA, 25 bp, Mus musculus
gggttctccaagaggtcattcatca

SEQ ID NO: 643157 - DNA, 25 bp, Mus musculus
gggttctccaagtggtcattcatca

SEQ ID NO: 643158 - DNA, 25 bp, Mus musculus
gggttctccagcaagaaggcggatc

SEQ ID NO: 643159 - DNA, 25 bp, Mus musculus
gggttctccagctagaaggcggatc

SEQ ID NO: 643160 - DNA, 25 bp, Mus musculus
gggttctccgaaccgcatggtcaga

SEQ ID NO: 643161 - DNA, 25 bp, Mus musculus
gggttctccgaagcgcatggtcaga

SEQ ID NO: 643162 - DNA, 25 bp, Mus musculus
gggttctcctgtccttgaccccttt

SEQ ID NO: 643163 - DNA, 25 bp, Mus musculus
gggttctcctgtgcttgaccccttt

SEQ ID NO: 643164 - DNA, 25 bp, Mus musculus
gggttctcgcgcaagattgagcatg

SEQ ID NO: 643165 - DNA, 25 bp, Mus musculus
gggttctcgcgctagattgagcatg

SEQ ID NO: 643166 - DNA, 25 bp, Mus musculus
gggttctctataatcaggcagtttt

SEQ ID NO: 643167 - DNA, 25 bp, Mus musculus
gggttctctatattcaggcagtttt

SEQ ID NO: 643168 - DNA, 25 bp, Mus musculus
gggttctctcagcacttgtgaatga

SEQ ID NO: 643169 - DNA, 25 bp, Mus musculus
gggttctctcaggacttgtgaatga

SEQ ID NO: 643170 - DNA, 25 bp, Mus musculus
gggttctctcataatctgtgttttt

SEQ ID NO: 643171 - DNA, 25 bp, Mus musculus
gggttctctcattatctgtgttttt

SEQ ID NO: 643172 - DNA, 25 bp, Mus musculus
gggttctctgtcaagtggcggtaaa

SEQ ID NO: 643173 - DNA, 25 bp, Mus musculus
gggttctctgtctagtggcggtaaa

SEQ ID NO: 643174 - DNA, 25 bp, Mus musculus
gggttctcttctcgtccggaacagt

SEQ ID NO: 643175 - DNA, 25 bp, Mus musculus
gggttctcttctggtccggaacagt

SEQ ID NO: 643176 - DNA, 25 bp, Mus musculus
gggttctgaagtacagtcccattat

SEQ ID NO: 643177 - DNA, 25 bp, Mus musculus
gggttctgaagttcagtcccattat

SEQ ID NO: 643178 - DNA, 25 bp, Mus musculus
gggttctgagcactgcctcttgtct

SEQ ID NO: 643179 - DNA, 25 bp, Mus musculus
gggttctgagcagtgcctcttgtct

SEQ ID NO: 643180 - DNA, 25 bp, Mus musculus
gggttctgaggaccctgcatacttg

SEQ ID NO: 643181 - DNA, 25 bp, Mus musculus
gggttctgaggagcctgcatacttg

SEQ ID NO: 643182 - DNA, 25 bp, Mus musculus
gggttctgcaccatgatacacagtt

SEQ ID NO: 643183 - DNA, 25 bp, Mus musculus
gggttctgcaccttgatacacagtt

SEQ ID NO: 643184 - DNA, 25 bp, Mus musculus
gggttctgcactagaggcctggaca

SEQ ID NO: 643185 - DNA, 25 bp, Mus musculus
gggttctgcacttgaggcctggaca

SEQ ID NO: 643186 - DNA, 25 bp, Mus musculus
gggttctgcaggattctacgccaaa

SEQ ID NO: 643187 - DNA, 25 bp, Mus musculus
gggttctgcaggtttctacgccaaa

SEQ ID NO: 643188 - DNA, 25 bp, Mus musculus
gggttctgcataatgagacgccgct

SEQ ID NO: 643189 - DNA, 25 bp, Mus musculus
gggttctgcatattgagacgccgct

SEQ ID NO: 643190 - DNA, 25 bp, Mus musculus
gggttctgccaaaaaatgccattcc

SEQ ID NO: 643191 - DNA, 25 bp, Mus musculus
gggttctgccaataaatgccattcc

SEQ ID NO: 643192 - DNA, 25 bp, Mus musculus
gggttctgccacatgctatttattt

SEQ ID NO: 643193 - DNA, 25 bp, Mus musculus
gggttctgccacttgctatttattt

SEQ ID NO: 643194 - DNA, 25 bp, Mus musculus
gggttctgccagagactgttctgaa

SEQ ID NO: 643195 - DNA, 25 bp, Mus musculus
gggttctgccagtgactgttctgaa

SEQ ID NO: 643196 - DNA, 25 bp, Mus musculus
gggttctgctagagaccagttttca

SEQ ID NO: 643197 - DNA, 25 bp, Mus musculus
gggttctgctagtgaccagttttca

SEQ ID NO: 643198 - DNA, 25 bp, Mus musculus
gggttctgctatcttgctttgccag

SEQ ID NO: 643199 - DNA, 25 bp, Mus musculus
gggttctgctatgttgctttgccag

SEQ ID NO: 643200 - DNA, 25 bp, Mus musculus
gggttctgcttccttgaatatgagg

SEQ ID NO: 643201 - DNA, 25 bp, Mus musculus
gggttctgcttcgttgaatatgagg

SEQ ID NO: 643202 - DNA, 25 bp, Mus musculus
gggttctggataaccactacttagc

SEQ ID NO: 643203 - DNA, 25 bp, Mus musculus
gggttctggatatccactacttagc

SEQ ID NO: 643204 - DNA, 25 bp, Mus musculus
gggttctgggctataaactctgctc

SEQ ID NO: 643205 - DNA, 25 bp, Mus musculus
gggttctgggctttaaactctgctc

SEQ ID NO: 643206 - DNA, 25 bp, Mus musculus
gggttctgtcacaataatatttgtc

SEQ ID NO: 643207 - DNA, 25 bp, Mus musculus
gggttctgtcactataatatttgtc

SEQ ID NO: 643208 - DNA, 25 bp, Mus musculus
gggttctgtcttacacatatgcctt

SEQ ID NO: 643209 - DNA, 25 bp, Mus musculus
gggttctgtctttcacatatgcctt

SEQ ID NO: 643210 - DNA, 25 bp, Mus musculus
gggttctgttctaaccctctctgta

SEQ ID NO: 643211 - DNA, 25 bp, Mus musculus
gggttctgttcttaccctctctgta

SEQ ID NO: 643212 - DNA, 25 bp, Mus musculus
gggttcttaccaaaactaagtgcct

SEQ ID NO: 643213 - DNA, 25 bp, Mus musculus
gggttcttaccataactaagtgcct

SEQ ID NO: 643214 - DNA, 25 bp, Mus musculus
gggttcttcaagctctggtttcctg

SEQ ID NO: 643215 - DNA, 25 bp, Mus musculus
gggttcttcaaggtctggtttcctg

SEQ ID NO: 643216 - DNA, 25 bp, Mus musculus
gggttcttcagacgataaatgttag

SEQ ID NO: 643217 - DNA, 25 bp, Mus musculus
gggttcttcagaggataaatgttag

SEQ ID NO: 643218 - DNA, 25 bp, Mus musculus
gggttcttcatcaacgaagtgcctg

SEQ ID NO: 643219 - DNA, 25 bp, Mus musculus
gggttcttcatcagtttgcaatcaa

SEQ ID NO: 643220 - DNA, 25 bp, Mus musculus
gggttcttcatctacgaagtgcctg

SEQ ID NO: 643221 - DNA, 25 bp, Mus musculus
gggttcttcatctgtttgcaatcaa

SEQ ID NO: 643222 - DNA, 25 bp, Mus musculus
gggttcttccttctagatatcctaa

SEQ ID NO: 643223 - DNA, 25 bp, Mus musculus
gggttcttccttgtagatatcctaa

SEQ ID NO: 643224 - DNA, 25 bp, Mus musculus
gggttcttcgccagtggattcaaac

SEQ ID NO: 643225 - DNA, 25 bp, Mus musculus
gggttcttcgcctgtggattcaaac

SEQ ID NO: 643226 - DNA, 25 bp, Mus musculus
gggttcttctaacgatcagttttga

SEQ ID NO: 643227 - DNA, 25 bp, Mus musculus
gggttcttctaaggatcagttttga

SEQ ID NO: 643228 - DNA, 25 bp, Mus musculus
gggttcttgattactggatacatgt

SEQ ID NO: 643229 - DNA, 25 bp, Mus musculus
gggttcttgatttctggatacatgt

SEQ ID NO: 643230 - DNA, 25 bp, Mus musculus
gggttcttgctcctcgttggacact

SEQ ID NO: 643231 - DNA, 25 bp, Mus musculus
gggttcttgctcgtcgttggacact

SEQ ID NO: 643232 - DNA, 25 bp, Mus musculus
gggttcttgggcatctgtttgttac

SEQ ID NO: 643233 - DNA, 25 bp, Mus musculus
gggttcttgggcttctgtttgttac

SEQ ID NO: 643234 - DNA, 25 bp, Mus musculus
gggttctttaggcttagttgtcagt

SEQ ID NO: 643235 - DNA, 25 bp, Mus musculus
gggttctttagggttagttgtcagt

SEQ ID NO: 643236 - DNA, 25 bp, Mus musculus
gggttctttcatcagtggactgtgt

SEQ ID NO: 643237 - DNA, 25 bp, Mus musculus
gggttctttcatgagtggactgtgt

SEQ ID NO: 643238 - DNA, 25 bp, Mus musculus
gggttctttctactgtcagccttca

SEQ ID NO: 643239 - DNA, 25 bp, Mus musculus
gggttctttctagtgtcagccttca

SEQ ID NO: 643240 - DNA, 25 bp, Mus musculus
gggttctttcttcagatcctcctgc

SEQ ID NO: 643241 - DNA, 25 bp, Mus musculus
gggttctttcttgagatcctcctgc

SEQ ID NO: 643242 - DNA, 25 bp, Mus musculus
gggttctttgtaatggcactttgca

SEQ ID NO: 643243 - DNA, 25 bp, Mus musculus
gggttctttgtattggcactttgca

SEQ ID NO: 643244 - DNA, 25 bp, Mus musculus
gggttctttgtgaggactacagcag

SEQ ID NO: 643245 - DNA, 25 bp, Mus musculus
gggttctttgtgtggactacagcag

SEQ ID NO: 643246 - DNA, 25 bp, Mus musculus
gggttcttttaaatccaagcataca

SEQ ID NO: 643247 - DNA, 25 bp, Mus musculus
gggttcttttaattccaagcataca

SEQ ID NO: 643248 - DNA, 25 bp, Mus musculus
gggttcttttgcaagcctggctatc

SEQ ID NO: 643249 - DNA, 25 bp, Mus musculus
gggttcttttgctagcctggctatc

SEQ ID NO: 643250 - DNA, 25 bp, Mus musculus
gggttcttttggaaattctgcacat

SEQ ID NO: 643251 - DNA, 25 bp, Mus musculus
gggttcttttggtaattctgcacat

SEQ ID NO: 643252 - DNA, 25 bp, Mus musculus
gggttgaaaaggctcttcctggcaa

SEQ ID NO: 643253 - DNA, 25 bp, Mus musculus
gggttgaaaagggtcttcctggcaa

SEQ ID NO: 643254 - DNA, 25 bp, Mus musculus
gggttgaacacgcattaccgataca

SEQ ID NO: 643255 - DNA, 25 bp, Mus musculus
gggttgaacacggattaccgataca

SEQ ID NO: 643256 - DNA, 25 bp, Mus musculus
gggttgaagcatcacactcttagaa

SEQ ID NO: 643257 - DNA, 25 bp, Mus musculus
gggttgaagcatgacactcttagaa

SEQ ID NO: 643258 - DNA, 25 bp, Mus musculus
gggttgaatcacattgttcctgaca

SEQ ID NO: 643259 - DNA, 25 bp, Mus musculus
gggttgaatcactttgttcctgaca

SEQ ID NO: 643260 - DNA, 25 bp, Mus musculus
gggttgaatcagacactccaaagta

SEQ ID NO: 643261 - DNA, 25 bp, Mus musculus
gggttgaatcagagttcccttgcac

SEQ ID NO: 643262 - DNA, 25 bp, Mus musculus
gggttgaatcagtcactccaaagta

SEQ ID NO: 643263 - DNA, 25 bp, Mus musculus
gggttgaatcagtgttcccttgcac

SEQ ID NO: 643264 - DNA, 25 bp, Mus musculus
gggttgaatgcaagcgtggaaattt

SEQ ID NO: 643265 - DNA, 25 bp, Mus musculus
gggttgaatgcatgcgtggaaattt

SEQ ID NO: 643266 - DNA, 25 bp, Mus musculus
gggttgacaccccatgccttatgtg

SEQ ID NO: 643267 - DNA, 25 bp, Mus musculus
gggttgacacccgatgccttatgtg

SEQ ID NO: 643268 - DNA, 25 bp, Mus musculus
gggttgacaggacctatttctcatt

SEQ ID NO: 643269 - DNA, 25 bp, Mus musculus
gggttgacaggagctatttctcatt

SEQ ID NO: 643270 - DNA, 25 bp, Mus musculus
gggttgacagtaatcctgtctgaga

SEQ ID NO: 643271 - DNA, 25 bp, Mus musculus
gggttgacagtattcctgtctgaga

SEQ ID NO: 643272 - DNA, 25 bp, Mus musculus
gggttgacattaactcatgcatctt

SEQ ID NO: 643273 - DNA, 25 bp, Mus musculus
gggttgacattatctcatgcatctt

SEQ ID NO: 643274 - DNA, 25 bp, Mus musculus
gggttgaccgcaacttgtatgggaa

SEQ ID NO: 643275 - DNA, 25 bp, Mus musculus
gggttgaccgcatcttgtatgggaa

SEQ ID NO: 643276 - DNA, 25 bp, Mus musculus
gggttgacgctacaaatctgggtac

SEQ ID NO: 643277 - DNA, 25 bp, Mus musculus
gggttgacgctagaaatctgggtac

SEQ ID NO: 643278 - DNA, 25 bp, Mus musculus
gggttgactccaattgccagctaat

SEQ ID NO: 643279 - DNA, 25 bp, Mus musculus
gggttgactccatttgccagctaat

SEQ ID NO: 643280 - DNA, 25 bp, Mus musculus
gggttgactcgacaaacacaagcag

SEQ ID NO: 643281 - DNA, 25 bp, Mus musculus
gggttgactcgagaaacacaagcag

SEQ ID NO: 643282 - DNA, 25 bp, Mus musculus
gggttgactttacttggcaccgcac

SEQ ID NO: 643283 - DNA, 25 bp, Mus musculus
gggttgactttagttggcaccgcac

SEQ ID NO: 643284 - DNA, 25 bp, Mus musculus
gggttgagatccattttccctcctg

SEQ ID NO: 643285 - DNA, 25 bp, Mus musculus
gggttgagatcctttttccctcctg

SEQ ID NO: 643286 - DNA, 25 bp, Mus musculus
gggttgagcactcccttaaggagat

SEQ ID NO: 643287 - DNA, 25 bp, Mus musculus
gggttgagcactgccttaaggagat

SEQ ID NO: 643288 - DNA, 25 bp, Mus musculus
gggttgaggctacaactccgtagta

SEQ ID NO: 643289 - DNA, 25 bp, Mus musculus
gggttgaggctagaactccgtagta

SEQ ID NO: 643290 - DNA, 25 bp, Mus musculus
gggttgagtcacatgagcatccaaa

SEQ ID NO: 643291 - DNA, 25 bp, Mus musculus
gggttgagtcacttgagcatccaaa

SEQ ID NO: 643292 - DNA, 25 bp, Mus musculus
gggttgagtcttcattccgagcaca

SEQ ID NO: 643293 - DNA, 25 bp, Mus musculus
gggttgagtcttcttcatttcctaa

SEQ ID NO: 643294 - DNA, 25 bp, Mus musculus
gggttgagtcttgattccgagcaca

SEQ ID NO: 643295 - DNA, 25 bp, Mus musculus
gggttgagtcttgttcatttcctaa

SEQ ID NO: 643296 - DNA, 25 bp, Mus musculus
gggttgagtgttaacgtgacattct

SEQ ID NO: 643297 - DNA, 25 bp, Mus musculus
gggttgagtgtttacgtgacattct

SEQ ID NO: 643298 - DNA, 25 bp, Mus musculus
gggttgatacttattattcctgctt

SEQ ID NO: 643299 - DNA, 25 bp, Mus musculus
gggttgatactttttattcctgctt

SEQ ID NO: 643300 - DNA, 25 bp, Mus musculus
gggttgatcagacctctcctgttct

SEQ ID NO: 643301 - DNA, 25 bp, Mus musculus
gggttgatcagagctctcctgttct

SEQ ID NO: 643302 - DNA, 25 bp, Mus musculus
gggttgatcattctagcctcaggaa

SEQ ID NO: 643303 - DNA, 25 bp, Mus musculus
gggttgatcattgtagcctcaggaa

SEQ ID NO: 643304 - DNA, 25 bp, Mus musculus
gggttgatcttgaactttgtccaaa

SEQ ID NO: 643305 - DNA, 25 bp, Mus musculus
gggttgatcttgtactttgtccaaa

SEQ ID NO: 643306 - DNA, 25 bp, Mus musculus
gggttgatctttacaattcctggta

SEQ ID NO: 643307 - DNA, 25 bp, Mus musculus
gggttgatcttttcaattcctggta

SEQ ID NO: 643308 - DNA, 25 bp, Mus musculus
gggttgatgggaccttcaccctctg

SEQ ID NO: 643309 - DNA, 25 bp, Mus musculus
gggttgatgggagcttcaccctctg

SEQ ID NO: 643310 - DNA, 25 bp, Mus musculus
gggttgattacactgtgcattctgt

SEQ ID NO: 643311 - DNA, 25 bp, Mus musculus
gggttgattacagtgtgcattctgt

SEQ ID NO: 643312 - DNA, 25 bp, Mus musculus
gggttgattatcctctgtctggtac

SEQ ID NO: 643313 - DNA, 25 bp, Mus musculus
gggttgattatcgtctgtctggtac

SEQ ID NO: 643314 - DNA, 25 bp, Mus musculus
gggttgattcataagcaggtctctt

SEQ ID NO: 643315 - DNA, 25 bp, Mus musculus
gggttgattcattagcaggtctctt

SEQ ID NO: 643316 - DNA, 25 bp, Mus musculus
gggttgatttctcacacaaataaat

SEQ ID NO: 643317 - DNA, 25 bp, Mus musculus
gggttgatttctgacacaaataaat

SEQ ID NO: 643318 - DNA, 25 bp, Mus musculus
gggttgatttggacttatactttga

SEQ ID NO: 643319 - DNA, 25 bp, Mus musculus
gggttgatttggctgactcttaaac

SEQ ID NO: 643320 - DNA, 25 bp, Mus musculus
gggttgatttgggtgactcttaaac

SEQ ID NO: 643321 - DNA, 25 bp, Mus musculus
gggttgatttggtcttatactttga

SEQ ID NO: 643322 - DNA, 25 bp, Mus musculus
gggttgcagcttacatatacgaaga

SEQ ID NO: 643323 - DNA, 25 bp, Mus musculus
gggttgcagctttcatatacgaaga

SEQ ID NO: 643324 - DNA, 25 bp, Mus musculus
gggttgcaggcacacatctttgcca

SEQ ID NO: 643325 - DNA, 25 bp, Mus musculus
gggttgcaggcagacatctttgcca

SEQ ID NO: 643326 - DNA, 25 bp, Mus musculus
gggttgcaggtgaaccctgtgacac

SEQ ID NO: 643327 - DNA, 25 bp, Mus musculus
gggttgcaggtgtaccctgtgacac

SEQ ID NO: 643328 - DNA, 25 bp, Mus musculus
gggttgcaggttccgtgcttaccaa

SEQ ID NO: 643329 - DNA, 25 bp, Mus musculus
gggttgcaggttgcgtgcttaccaa

SEQ ID NO: 643330 - DNA, 25 bp, Mus musculus
gggttgcatcacaatcataggtggt

SEQ ID NO: 643331 - DNA, 25 bp, Mus musculus
gggttgcatcactatcataggtggt

SEQ ID NO: 643332 - DNA, 25 bp, Mus musculus
gggttgcatcatcacacctggttga

SEQ ID NO: 643333 - DNA, 25 bp, Mus musculus
gggttgcatcatgacacctggttga

SEQ ID NO: 643334 - DNA, 25 bp, Mus musculus
gggttgcattctaccatttatgtaa

SEQ ID NO: 643335 - DNA, 25 bp, Mus musculus
gggttgcattcttccatttatgtaa

SEQ ID NO: 643336 - DNA, 25 bp, Mus musculus
gggttgccaactagtgcttcggccg

SEQ ID NO: 643337 - DNA, 25 bp, Mus musculus
gggttgccaacttgtgcttcggccg

SEQ ID NO: 643338 - DNA, 25 bp, Mus musculus
gggttgcccacaattaggattacaa

SEQ ID NO: 643339 - DNA, 25 bp, Mus musculus
gggttgcccacatttaggattacaa

SEQ ID NO: 643340 - DNA, 25 bp, Mus musculus
gggttgccgagtaaagtagctcttc

SEQ ID NO: 643341 - DNA, 25 bp, Mus musculus
gggttgccgagttaagtagctcttc

SEQ ID NO: 643342 - DNA, 25 bp, Mus musculus
gggttgccgccacattctactcaga

SEQ ID NO: 643343 - DNA, 25 bp, Mus musculus
gggttgccgccagattctactcaga

SEQ ID NO: 643344 - DNA, 25 bp, Mus musculus
gggttgccggtcagattttatgatt

SEQ ID NO: 643345 - DNA, 25 bp, Mus musculus
gggttgccggtctgattttatgatt

SEQ ID NO: 643346 - DNA, 25 bp, Mus musculus
gggttgcctaggacaggtctcctaa

SEQ ID NO: 643347 - DNA, 25 bp, Mus musculus
gggttgcctaggtcaggtctcctaa

SEQ ID NO: 643348 - DNA, 25 bp, Mus musculus
gggttgcctgcaatgctatagcatt

SEQ ID NO: 643349 - DNA, 25 bp, Mus musculus
gggttgcctgcattgctatagcatt

SEQ ID NO: 643350 - DNA, 25 bp, Mus musculus
gggttgcgataacttcatccacaga

SEQ ID NO: 643351 - DNA, 25 bp, Mus musculus
gggttgcgataagttcatccacaga

SEQ ID NO: 643352 - DNA, 25 bp, Mus musculus
gggttgcgatgcagcagctacatga

SEQ ID NO: 643353 - DNA, 25 bp, Mus musculus
gggttgcgatgctgcagctacatga

SEQ ID NO: 643354 - DNA, 25 bp, Mus musculus
gggttgcgcctacagcaagacttat

SEQ ID NO: 643355 - DNA, 25 bp, Mus musculus
gggttgcgcctagagcaagacttat

SEQ ID NO: 643356 - DNA, 25 bp, Mus musculus
gggttgcgcttcacactaggttggc

SEQ ID NO: 643357 - DNA, 25 bp, Mus musculus
gggttgcgcttctcactaggttggc

SEQ ID NO: 643358 - DNA, 25 bp, Mus musculus
gggttgcggcttaattaatgctcag

SEQ ID NO: 643359 - DNA, 25 bp, Mus musculus
gggttgcggctttattaatgctcag

SEQ ID NO: 643360 - DNA, 25 bp, Mus musculus
gggttgctaacaacagagctcatgt

SEQ ID NO: 643361 - DNA, 25 bp, Mus musculus
gggttgctaacatcagagctcatgt

SEQ ID NO: 643362 - DNA, 25 bp, Mus musculus
gggttgctcagtctatatatcaact

SEQ ID NO: 643363 - DNA, 25 bp, Mus musculus
gggttgctcagtgtatatatcaact

SEQ ID NO: 643364 - DNA, 25 bp, Mus musculus
gggttgctcccgacagacaggactg

SEQ ID NO: 643365 - DNA, 25 bp, Mus musculus
gggttgctcccgtcagacaggactg

SEQ ID NO: 643366 - DNA, 25 bp, Mus musculus
gggttgctgcagagaccctgtgtac

SEQ ID NO: 643367 - DNA, 25 bp, Mus musculus
gggttgctgcagtgaccctgtgtac

SEQ ID NO: 643368 - DNA, 25 bp, Mus musculus
gggttgctggaaagttgtcttcaca

SEQ ID NO: 643369 - DNA, 25 bp, Mus musculus
gggttgctggaatgttgtcttcaca

SEQ ID NO: 643370 - DNA, 25 bp, Mus musculus
gggttgctggctattcttcaataca

SEQ ID NO: 643371 - DNA, 25 bp, Mus musculus
gggttgctggcttttcttcaataca

SEQ ID NO: 643372 - DNA, 25 bp, Mus musculus
gggttgctgtgaaccaagtgactca

SEQ ID NO: 643373 - DNA, 25 bp, Mus musculus
gggttgctgtgatccaagtgactca

SEQ ID NO: 643374 - DNA, 25 bp, Mus musculus
gggttgctgtgtcgtgaaggtctga

SEQ ID NO: 643375 - DNA, 25 bp, Mus musculus
gggttgctgtgtggtgaaggtctga

SEQ ID NO: 643376 - DNA, 25 bp, Mus musculus
gggttgcttcaacttttagctctgc

SEQ ID NO: 643377 - DNA, 25 bp, Mus musculus
gggttgcttcaagttttagctctgc

SEQ ID NO: 643378 - DNA, 25 bp, Mus musculus
gggttgcttctaagtttgcagcttg

SEQ ID NO: 643379 - DNA, 25 bp, Mus musculus
gggttgcttctatgtttgcagcttg

SEQ ID NO: 643380 - DNA, 25 bp, Mus musculus
gggttgcttctcaatttattgacag

SEQ ID NO: 643381 - DNA, 25 bp, Mus musculus
gggttgcttctctatttattgacag

SEQ ID NO: 643382 - DNA, 25 bp, Mus musculus
gggttgcttgcgagattgtcaccaa

SEQ ID NO: 643383 - DNA, 25 bp, Mus musculus
gggttgcttgcgtgattgtcaccaa

SEQ ID NO: 643384 - DNA, 25 bp, Mus musculus
gggttgctttgtctctcttaacgtt

SEQ ID NO: 643385 - DNA, 25 bp, Mus musculus
gggttgctttgtgtctcttaacgtt

SEQ ID NO: 643386 - DNA, 25 bp, Mus musculus
gggttggaacctcacgcaacgtctt

SEQ ID NO: 643387 - DNA, 25 bp, Mus musculus
gggttggaacctgacgcaacgtctt

SEQ ID NO: 643388 - DNA, 25 bp, Mus musculus
gggttggaatatcagcttttatacg

SEQ ID NO: 643389 - DNA, 25 bp, Mus musculus
gggttggaatatgagcttttatacg

SEQ ID NO: 643390 - DNA, 25 bp, Mus musculus
gggttggacaacaggatggcatcct

SEQ ID NO: 643391 - DNA, 25 bp, Mus musculus
gggttggacaactggatggcatcct

SEQ ID NO: 643392 - DNA, 25 bp, Mus musculus
gggttggacccaacagagcacaaga

SEQ ID NO: 643393 - DNA, 25 bp, Mus musculus
gggttggacccatcagagcacaaga

SEQ ID NO: 643394 - DNA, 25 bp, Mus musculus
gggttggactttagtgcctttgata

SEQ ID NO: 643395 - DNA, 25 bp, Mus musculus
gggttggacttttgtgcctttgata

SEQ ID NO: 643396 - DNA, 25 bp, Mus musculus
gggttggagacaatctacttttcat

SEQ ID NO: 643397 - DNA, 25 bp, Mus musculus
gggttggagacattctacttttcat

SEQ ID NO: 643398 - DNA, 25 bp, Mus musculus
gggttggagcacaaccgtttcttgt

SEQ ID NO: 643399 - DNA, 25 bp, Mus musculus
gggttggagcactaccgtttcttgt

SEQ ID NO: 643400 - DNA, 25 bp, Mus musculus
gggttggagttcctttacacactgc

SEQ ID NO: 643401 - DNA, 25 bp, Mus musculus
gggttggagttcgtttacacactgc

SEQ ID NO: 643402 - DNA, 25 bp, Mus musculus
gggttggattccatgttacatggta

SEQ ID NO: 643403 - DNA, 25 bp, Mus musculus
gggttggattccttgttacatggta

SEQ ID NO: 643404 - DNA, 25 bp, Mus musculus
gggttggcacagacttgaaagataa

SEQ ID NO: 643405 - DNA, 25 bp, Mus musculus
gggttggcacagtcttgaaagataa

SEQ ID NO: 643406 - DNA, 25 bp, Mus musculus
gggttggcaccaatgcagtatggaa

SEQ ID NO: 643407 - DNA, 25 bp, Mus musculus
gggttggcaccattgcagtatggaa

SEQ ID NO: 643408 - DNA, 25 bp, Mus musculus
gggttggcagctagcataacacttt

SEQ ID NO: 643409 - DNA, 25 bp, Mus musculus
gggttggcagcttgcataacacttt

SEQ ID NO: 643410 - DNA, 25 bp, Mus musculus
gggttggccatacctgcatagtgaa

SEQ ID NO: 643411 - DNA, 25 bp, Mus musculus
gggttggccatagctgcatagtgaa

SEQ ID NO: 643412 - DNA, 25 bp, Mus musculus
gggttggctactaagctcagattga

SEQ ID NO: 643413 - DNA, 25 bp, Mus musculus
gggttggctacttagctcagattga

SEQ ID NO: 643414 - DNA, 25 bp, Mus musculus
gggttggctggaccaatctcattaa

SEQ ID NO: 643415 - DNA, 25 bp, Mus musculus
gggttggctggagcaatctcattaa

SEQ ID NO: 643416 - DNA, 25 bp, Mus musculus
gggttggctttaagtctgcagtatc

SEQ ID NO: 643417 - DNA, 25 bp, Mus musculus
gggttggctttatgtctgcagtatc

SEQ ID NO: 643418 - DNA, 25 bp, Mus musculus
gggttggctttcactttggacatgg

SEQ ID NO: 643419 - DNA, 25 bp, Mus musculus
gggttggctttctctttggacatgg

SEQ ID NO: 643420 - DNA, 25 bp, Mus musculus
gggttgggacgacaactcttgcctt

SEQ ID NO: 643421 - DNA, 25 bp, Mus musculus
gggttgggacgagaactcttgcctt

SEQ ID NO: 643422 - DNA, 25 bp, Mus musculus
gggttgggcaacacattctatttat

SEQ ID NO: 643423 - DNA, 25 bp, Mus musculus
gggttgggcaactcattctatttat

SEQ ID NO: 643424 - DNA, 25 bp, Mus musculus
gggttgggccagcacatcacctaaa

SEQ ID NO: 643425 - DNA, 25 bp, Mus musculus
gggttgggccaggacatcacctaaa

SEQ ID NO: 643426 - DNA, 25 bp, Mus musculus
gggttgggcctcaaatagctaagac

SEQ ID NO: 643427 - DNA, 25 bp, Mus musculus
gggttgggcctctaatagctaagac

SEQ ID NO: 643428 - DNA, 25 bp, Mus musculus
gggttgggctgtccatgctcccttc

SEQ ID NO: 643429 - DNA, 25 bp, Mus musculus
gggttgggctgtgcatgctcccttc

SEQ ID NO: 643430 - DNA, 25 bp, Mus musculus
gggttggtataacttcatcagtaat

SEQ ID NO: 643431 - DNA, 25 bp, Mus musculus
gggttggtataagttcatcagtaat

SEQ ID NO: 643432 - DNA, 25 bp, Mus musculus
gggttggtatcacagaccttactag

SEQ ID NO: 643433 - DNA, 25 bp, Mus musculus
gggttggtatcagagaccttactag

SEQ ID NO: 643434 - DNA, 25 bp, Mus musculus
gggttggtcgagaaatgctctccct

SEQ ID NO: 643435 - DNA, 25 bp, Mus musculus
gggttggtcgagtaatgctctccct

SEQ ID NO: 643436 - DNA, 25 bp, Mus musculus
gggttggtcttcctcgttagcacct

SEQ ID NO: 643437 - DNA, 25 bp, Mus musculus
gggttggtcttcgtcgttagcacct

SEQ ID NO: 643438 - DNA, 25 bp, Mus musculus
gggttggtgcctctgaagccaccaa

SEQ ID NO: 643439 - DNA, 25 bp, Mus musculus
gggttggtgcctgtgaagccaccaa

SEQ ID NO: 643440 - DNA, 25 bp, Mus musculus
gggttggtgttcctaatgagacttt

SEQ ID NO: 643441 - DNA, 25 bp, Mus musculus
gggttggtgttcgtaatgagacttt

SEQ ID NO: 643442 - DNA, 25 bp, Mus musculus
gggttggttcataggacacacatca

SEQ ID NO: 643443 - DNA, 25 bp, Mus musculus
gggttggttcattggacacacatca

SEQ ID NO: 643444 - DNA, 25 bp, Mus musculus
gggttggttgtaatcagcctgaacc

SEQ ID NO: 643445 - DNA, 25 bp, Mus musculus
gggttggttgtattcagcctgaacc

SEQ ID NO: 643446 - DNA, 25 bp, Mus musculus
gggttggtttctctacactctcatt

SEQ ID NO: 643447 - DNA, 25 bp, Mus musculus
gggttggtttctgtacactctcatt

SEQ ID NO: 643448 - DNA, 25 bp, Mus musculus
gggttggtttttccccatctacatt

SEQ ID NO: 643449 - DNA, 25 bp, Mus musculus
gggttggtttttgcccatctacatt

SEQ ID NO: 643450 - DNA, 25 bp, Mus musculus
gggttgtaaagtcccacctgtcagt

SEQ ID NO: 643451 - DNA, 25 bp, Mus musculus
gggttgtaaagtgccacctgtcagt

SEQ ID NO: 643452 - DNA, 25 bp, Mus musculus
gggttgtaaatcagtatctcactga

SEQ ID NO: 643453 - DNA, 25 bp, Mus musculus
gggttgtaaatctgtatctcactga

SEQ ID NO: 643454 - DNA, 25 bp, Mus musculus
gggttgtaatctctcctatgggtgc

SEQ ID NO: 643455 - DNA, 25 bp, Mus musculus
gggttgtaatctgtcctatgggtgc

SEQ ID NO: 643456 - DNA, 25 bp, Mus musculus
gggttgtagatcagccaccctacca

SEQ ID NO: 643457 - DNA, 25 bp, Mus musculus
gggttgtagatctgccaccctacca

SEQ ID NO: 643458 - DNA, 25 bp, Mus musculus
gggttgtaggttcctctggatttca

SEQ ID NO: 643459 - DNA, 25 bp, Mus musculus
gggttgtaggttgctctggatttca

SEQ ID NO: 643460 - DNA, 25 bp, Mus musculus
gggttgtataagatcaaaagtgtga

SEQ ID NO: 643461 - DNA, 25 bp, Mus musculus
gggttgtataagttcaaaagtgtga

SEQ ID NO: 643462 - DNA, 25 bp, Mus musculus
gggttgtattgcatcataggtcaaa

SEQ ID NO: 643463 - DNA, 25 bp, Mus musculus
gggttgtattgcttcataggtcaaa

SEQ ID NO: 643464 - DNA, 25 bp, Mus musculus
gggttgtcacctaacaggtacatgt

SEQ ID NO: 643465 - DNA, 25 bp, Mus musculus
gggttgtcaccttacaggtacatgt

SEQ ID NO: 643466 - DNA, 25 bp, Mus musculus
gggttgtcattccacagttataagt

SEQ ID NO: 643467 - DNA, 25 bp, Mus musculus
gggttgtcattcgacagttataagt

SEQ ID NO: 643468 - DNA, 25 bp, Mus musculus
gggttgtcccagatcaacagtgctg

SEQ ID NO: 643469 - DNA, 25 bp, Mus musculus
gggttgtcccagttcaacagtgctg

SEQ ID NO: 643470 - DNA, 25 bp, Mus musculus
gggttgtccttcacgacacagatga

SEQ ID NO: 643471 - DNA, 25 bp, Mus musculus
gggttgtccttctcgacacagatga

SEQ ID NO: 643472 - DNA, 25 bp, Mus musculus
gggttgtcgcctcatctcctctgac

SEQ ID NO: 643473 - DNA, 25 bp, Mus musculus
gggttgtcgcctgatctcctctgac

SEQ ID NO: 643474 - DNA, 25 bp, Mus musculus
gggttgtctctgactcttttgccag

SEQ ID NO: 643475 - DNA, 25 bp, Mus musculus
gggttgtctctgtctcttttgccag

SEQ ID NO: 643476 - DNA, 25 bp, Mus musculus
gggttgtgcctactctgtctgccaa

SEQ ID NO: 643477 - DNA, 25 bp, Mus musculus
gggttgtgcctagtctgtctgccaa

SEQ ID NO: 643478 - DNA, 25 bp, Mus musculus
gggttgtgctggagtgttctcccca

SEQ ID NO: 643479 - DNA, 25 bp, Mus musculus
gggttgtgctggtgtgttctcccca

SEQ ID NO: 643480 - DNA, 25 bp, Mus musculus
gggttgtggaccaggctggatgagc

SEQ ID NO: 643481 - DNA, 25 bp, Mus musculus
gggttgtggacctggctggatgagc

SEQ ID NO: 643482 - DNA, 25 bp, Mus musculus
gggttgtgtagtactctattccata

SEQ ID NO: 643483 - DNA, 25 bp, Mus musculus
gggttgtgtagttctctattccata

SEQ ID NO: 643484 - DNA, 25 bp, Mus musculus
gggttgtgtgttccccatacatgtg

SEQ ID NO: 643485 - DNA, 25 bp, Mus musculus
gggttgtgtgttgcccatacatgtg

SEQ ID NO: 643486 - DNA, 25 bp, Mus musculus
gggttgttaaccacaggagcacgca

SEQ ID NO: 643487 - DNA, 25 bp, Mus musculus
gggttgttaacctcaggagcacgca

SEQ ID NO: 643488 - DNA, 25 bp, Mus musculus
gggttgttacaactgagcaagagtc

SEQ ID NO: 643489 - DNA, 25 bp, Mus musculus
gggttgttacaagtgagcaagagtc

SEQ ID NO: 643490 - DNA, 25 bp, Mus musculus
gggttgttaggcaacagccactcca

SEQ ID NO: 643491 - DNA, 25 bp, Mus musculus
gggttgttaggctacagccactcca

SEQ ID NO: 643492 - DNA, 25 bp, Mus musculus
gggttgttatacagtactctacatt

SEQ ID NO: 643493 - DNA, 25 bp, Mus musculus
gggttgttatactgtactctacatt

SEQ ID NO: 643494 - DNA, 25 bp, Mus musculus
gggttgttattcatgtgtcagaggt

SEQ ID NO: 643495 - DNA, 25 bp, Mus musculus
gggttgttattcttgtgtcagaggt

SEQ ID NO: 643496 - DNA, 25 bp, Mus musculus
gggttgttccaaatgctagttgcac

SEQ ID NO: 643497 - DNA, 25 bp, Mus musculus
gggttgttccaattgctagttgcac

SEQ ID NO: 643498 - DNA, 25 bp, Mus musculus
gggttgttccacagccaagaaaact

SEQ ID NO: 643499 - DNA, 25 bp, Mus musculus
gggttgttccactgccaagaaaact

SEQ ID NO: 643500 - DNA, 25 bp, Mus musculus
gggttgttgagacttccactttgga

SEQ ID NO: 643501 - DNA, 25 bp, Mus musculus
gggttgttgagagttccactttgga

SEQ ID NO: 643502 - DNA, 25 bp, Mus musculus
gggtttaaacctccatacccaggag

SEQ ID NO: 643503 - DNA, 25 bp, Mus musculus
gggtttaaacctgcatacccaggag

SEQ ID NO: 643504 - DNA, 25 bp, Mus musculus
gggtttaaagtcagggagcaagcaa

SEQ ID NO: 643505 - DNA, 25 bp, Mus musculus
gggtttaaagtctgggagcaagcaa

SEQ ID NO: 643506 - DNA, 25 bp, Mus musculus
gggtttaaatgacatcccagttcat

SEQ ID NO: 643507 - DNA, 25 bp, Mus musculus
gggtttaaatgagatcccagttcat

SEQ ID NO: 643508 - DNA, 25 bp, Mus musculus
gggtttaacatacagacatggccat

SEQ ID NO: 643509 - DNA, 25 bp, Mus musculus
gggtttaacatagagacatggccat

SEQ ID NO: 643510 - DNA, 25 bp, Mus musculus
gggtttaacccaagatctgtatgag

SEQ ID NO: 643511 - DNA, 25 bp, Mus musculus
gggtttaacccatgatctgtatgag

SEQ ID NO: 643512 - DNA, 25 bp, Mus musculus
gggtttaactgcattcttattcaat

SEQ ID NO: 643513 - DNA, 25 bp, Mus musculus
gggtttaactgctttcttattcaat

SEQ ID NO: 643514 - DNA, 25 bp, Mus musculus
gggtttaagcagagcctctcctgat

SEQ ID NO: 643515 - DNA, 25 bp, Mus musculus
gggtttaagcagtgcctctcctgat

SEQ ID NO: 643516 - DNA, 25 bp, Mus musculus
gggtttaagcccagtcagcttcttg

SEQ ID NO: 643517 - DNA, 25 bp, Mus musculus
gggtttaagccctgtcagcttcttg

SEQ ID NO: 643518 - DNA, 25 bp, Mus musculus
gggtttaagtctccagcattgctga

SEQ ID NO: 643519 - DNA, 25 bp, Mus musculus
gggtttaagtctgcagcattgctga

SEQ ID NO: 643520 - DNA, 25 bp, Mus musculus
gggtttaatccccagtactgctgaa

SEQ ID NO: 643521 - DNA, 25 bp, Mus musculus
gggtttaatcccgagtactgctgaa

SEQ ID NO: 643522 - DNA, 25 bp, Mus musculus
gggtttaatctccagcataaactgg

SEQ ID NO: 643523 - DNA, 25 bp, Mus musculus
gggtttaatctcgagcataaactgg

SEQ ID NO: 643524 - DNA, 25 bp, Mus musculus
gggtttacagccactgtgtctaaac

SEQ ID NO: 643525 - DNA, 25 bp, Mus musculus
gggtttacagccatgggaccaccat

SEQ ID NO: 643526 - DNA, 25 bp, Mus musculus
gggtttacagcctctgtgtctaaac

SEQ ID NO: 643527 - DNA, 25 bp, Mus musculus
gggtttacagccttgggaccaccat

SEQ ID NO: 643528 - DNA, 25 bp, Mus musculus
gggtttaccaggatcataccaaagt

SEQ ID NO: 643529 - DNA, 25 bp, Mus musculus
gggtttaccaggttcataccaaagt

SEQ ID NO: 643530 - DNA, 25 bp, Mus musculus
gggtttactcagcagcttgttttca

SEQ ID NO: 643531 - DNA, 25 bp, Mus musculus
gggtttactcaggagcttgttttca

SEQ ID NO: 643532 - DNA, 25 bp, Mus musculus
gggtttactggcagtgttctctggc

SEQ ID NO: 643533 - DNA, 25 bp, Mus musculus
gggtttactggctgtgttctctggc

SEQ ID NO: 643534 - DNA, 25 bp, Mus musculus
gggtttactgtaaatgctgtgggta

SEQ ID NO: 643535 - DNA, 25 bp, Mus musculus
gggtttactgtatatgctgtgggta

SEQ ID NO: 643536 - DNA, 25 bp, Mus musculus
gggtttacttcccagctgctgttaa

SEQ ID NO: 643537 - DNA, 25 bp, Mus musculus
gggtttacttccgagctgctgttaa

SEQ ID NO: 643538 - DNA, 25 bp, Mus musculus
gggtttagaattcagcaagattgta

SEQ ID NO: 643539 - DNA, 25 bp, Mus musculus
gggtttagaattgagcaagattgta

SEQ ID NO: 643540 - DNA, 25 bp, Mus musculus
gggtttagactccatactcacatga

SEQ ID NO: 643541 - DNA, 25 bp, Mus musculus
gggtttagactcgatactcacatga

SEQ ID NO: 643542 - DNA, 25 bp, Mus musculus
gggtttagccttatgagagcagcat

SEQ ID NO: 643543 - DNA, 25 bp, Mus musculus
gggtttagccttttgagagcagcat

SEQ ID NO: 643544 - DNA, 25 bp, Mus musculus
gggtttagctcaattcacaatcaca

SEQ ID NO: 643545 - DNA, 25 bp, Mus musculus
gggtttagctcatttcacaatcaca

SEQ ID NO: 643546 - DNA, 25 bp, Mus musculus
gggtttaggtccaaaggcaagtcag

SEQ ID NO: 643547 - DNA, 25 bp, Mus musculus
gggtttaggtcctaaggcaagtcag

SEQ ID NO: 643548 - DNA, 25 bp, Mus musculus
gggtttagtagcatcactcacccct

SEQ ID NO: 643549 - DNA, 25 bp, Mus musculus
gggtttagtagcttcactcacccct

SEQ ID NO: 643550 - DNA, 25 bp, Mus musculus
gggtttagtcctcagtagcagcaaa

SEQ ID NO: 643551 - DNA, 25 bp, Mus musculus
gggtttagtcctgagtagcagcaaa

SEQ ID NO: 643552 - DNA, 25 bp, Mus musculus
gggtttataaacacctacctcgcag

SEQ ID NO: 643553 - DNA, 25 bp, Mus musculus
gggtttataaactcctacctcgcag

SEQ ID NO: 643554 - DNA, 25 bp, Mus musculus
gggtttatatacagcatcacttctt

SEQ ID NO: 643555 - DNA, 25 bp, Mus musculus
gggtttatatactgcatcacttctt

SEQ ID NO: 643556 - DNA, 25 bp, Mus musculus
gggtttatccacatcaatcgctagc

SEQ ID NO: 643557 - DNA, 25 bp, Mus musculus
gggtttatccacttcaatcgctagc

SEQ ID NO: 643558 - DNA, 25 bp, Mus musculus
gggtttatgactaggcatcctgaca

SEQ ID NO: 643559 - DNA, 25 bp, Mus musculus
gggtttatgacttggcatcctgaca

SEQ ID NO: 643560 - DNA, 25 bp, Mus musculus
gggtttatgaggctccacacatcac

SEQ ID NO: 643561 - DNA, 25 bp, Mus musculus
gggtttatgagggtccacacatcac

SEQ ID NO: 643562 - DNA, 25 bp, Mus musculus
gggtttatgataatttggcttctgg

SEQ ID NO: 643563 - DNA, 25 bp, Mus musculus
gggtttatgatattttggcttctgg

SEQ ID NO: 643564 - DNA, 25 bp, Mus musculus
gggtttatgctcaatctgtgttcta

SEQ ID NO: 643565 - DNA, 25 bp, Mus musculus
gggtttatgctctatctgtgttcta

SEQ ID NO: 643566 - DNA, 25 bp, Mus musculus
gggtttatgctgagaaccacaccaa

SEQ ID NO: 643567 - DNA, 25 bp, Mus musculus
gggtttatgctgtgaaccacaccaa

SEQ ID NO: 643568 - DNA, 25 bp, Mus musculus
gggtttatggtgactctcctatgga

SEQ ID NO: 643569 - DNA, 25 bp, Mus musculus
gggtttatggtgtctctcctatgga

SEQ ID NO: 643570 - DNA, 25 bp, Mus musculus
gggtttatgtcactttcatctcaat

SEQ ID NO: 643571 - DNA, 25 bp, Mus musculus
gggtttatgtcagtttcatctcaat

SEQ ID NO: 643572 - DNA, 25 bp, Mus musculus
gggtttcaaagtccatcgtcaaatg

SEQ ID NO: 643573 - DNA, 25 bp, Mus musculus
gggtttcaaagtgcatcgtcaaatg

SEQ ID NO: 643574 - DNA, 25 bp, Mus musculus
gggtttcacaaacgcatttacatac

SEQ ID NO: 643575 - DNA, 25 bp, Mus musculus
gggtttcacaaaggcatttacatac

SEQ ID NO: 643576 - DNA, 25 bp, Mus musculus
gggtttcacatccacgcaagaggca

SEQ ID NO: 643577 - DNA, 25 bp, Mus musculus
gggtttcacatcgacgcaagaggca

SEQ ID NO: 643578 - DNA, 25 bp, Mus musculus
gggtttcacggaactccagaggctg

SEQ ID NO: 643579 - DNA, 25 bp, Mus musculus
gggtttcacggatctccagaggctg

SEQ ID NO: 643580 - DNA, 25 bp, Mus musculus
gggtttcactcaaacagtgctgttg

SEQ ID NO: 643581 - DNA, 25 bp, Mus musculus
gggtttcactcatacagtgctgttg

SEQ ID NO: 643582 - DNA, 25 bp, Mus musculus
gggtttcactgacctttagcagact

SEQ ID NO: 643583 - DNA, 25 bp, Mus musculus
gggtttcactgagctttagcagact

SEQ ID NO: 643584 - DNA, 25 bp, Mus musculus
gggtttcagaacagatcgcgcttca

SEQ ID NO: 643585 - DNA, 25 bp, Mus musculus
gggtttcagaactgatcgcgcttca

SEQ ID NO: 643586 - DNA, 25 bp, Mus musculus
gggtttcagatcccctataacgaga

SEQ ID NO: 643587 - DNA, 25 bp, Mus musculus
gggtttcagatcgcctataacgaga

SEQ ID NO: 643588 - DNA, 25 bp, Mus musculus
gggtttcaggtaaagcaccacacca

SEQ ID NO: 643589 - DNA, 25 bp, Mus musculus
gggtttcaggtacctcacaccaaca

SEQ ID NO: 643590 - DNA, 25 bp, Mus musculus
gggtttcaggtagctcacaccaaca

SEQ ID NO: 643591 - DNA, 25 bp, Mus musculus
gggtttcaggtatagcaccacacca

SEQ ID NO: 643592 - DNA, 25 bp, Mus musculus
gggtttcagtgacagcttctacagg

SEQ ID NO: 643593 - DNA, 25 bp, Mus musculus
gggtttcagtgagagcttctacagg

SEQ ID NO: 643594 - DNA, 25 bp, Mus musculus
gggtttcagttgaatcatgttcagt

SEQ ID NO: 643595 - DNA, 25 bp, Mus musculus
gggtttcagttgtatcatgttcagt

SEQ ID NO: 643596 - DNA, 25 bp, Mus musculus
gggtttcagtttcatcccttccctg

SEQ ID NO: 643597 - DNA, 25 bp, Mus musculus
gggtttcagtttgatcccttccctg

SEQ ID NO: 643598 - DNA, 25 bp, Mus musculus
gggtttcataccatcttcatgtttc

SEQ ID NO: 643599 - DNA, 25 bp, Mus musculus
gggtttcataccttcttcatgtttc

SEQ ID NO: 643600 - DNA, 25 bp, Mus musculus
gggtttcatcctcataacacataca

SEQ ID NO: 643601 - DNA, 25 bp, Mus musculus
gggtttcatcctgataacacataca

SEQ ID NO: 643602 - DNA, 25 bp, Mus musculus
gggtttcatctaaggcccacccact

SEQ ID NO: 643603 - DNA, 25 bp, Mus musculus
gggtttcatctatggcccacccact

SEQ ID NO: 643604 - DNA, 25 bp, Mus musculus
gggtttcatgcaagccagcaaacat

SEQ ID NO: 643605 - DNA, 25 bp, Mus musculus
gggtttcatgcatgccagcaaacat

SEQ ID NO: 643606 - DNA, 25 bp, Mus musculus
gggtttcatgtacaatcgatgtgct

SEQ ID NO: 643607 - DNA, 25 bp, Mus musculus
gggtttcatgtagaatcgatgtgct

SEQ ID NO: 643608 - DNA, 25 bp, Mus musculus
gggtttcattaaaacagagcttctg

SEQ ID NO: 643609 - DNA, 25 bp, Mus musculus
gggtttcattaatacagagcttctg

SEQ ID NO: 643610 - DNA, 25 bp, Mus musculus
gggtttcattgaatccacgttccaa

SEQ ID NO: 643611 - DNA, 25 bp, Mus musculus
gggtttcattgattccacgttccaa

SEQ ID NO: 643612 - DNA, 25 bp, Mus musculus
gggtttccaaaacacttctgtccag

SEQ ID NO: 643613 - DNA, 25 bp, Mus musculus
gggtttccaaaagacttctgtccag

SEQ ID NO: 643614 - DNA, 25 bp, Mus musculus
gggtttccaattcctgagcttgaaa

SEQ ID NO: 643615 - DNA, 25 bp, Mus musculus
gggtttccaattgctgagcttgaaa

SEQ ID NO: 643616 - DNA, 25 bp, Mus musculus
gggtttccacagatggattccggca

SEQ ID NO: 643617 - DNA, 25 bp, Mus musculus
gggtttccacagttggattccggca

SEQ ID NO: 643618 - DNA, 25 bp, Mus musculus
gggtttccaccacatgtttctatta

SEQ ID NO: 643619 - DNA, 25 bp, Mus musculus
gggtttccaccagatgtttctatta

SEQ ID NO: 643620 - DNA, 25 bp, Mus musculus
gggtttccactgatgaatcttccat

SEQ ID NO: 643621 - DNA, 25 bp, Mus musculus
gggtttccactgttgaatcttccat

SEQ ID NO: 643622 - DNA, 25 bp, Mus musculus
gggtttccagatcctatttgagagt

SEQ ID NO: 643623 - DNA, 25 bp, Mus musculus
gggtttccagatgctatttgagagt

SEQ ID NO: 643624 - DNA, 25 bp, Mus musculus
gggtttccagccacgaagtactgat

SEQ ID NO: 643625 - DNA, 25 bp, Mus musculus
gggtttccagcctcgaagtactgat

SEQ ID NO: 643626 - DNA, 25 bp, Mus musculus
gggtttccagtgagaatcctatttt

SEQ ID NO: 643627 - DNA, 25 bp, Mus musculus
gggtttccagtgcaatccgttaaca

SEQ ID NO: 643628 - DNA, 25 bp, Mus musculus
gggtttccagtggaatccgttaaca

SEQ ID NO: 643629 - DNA, 25 bp, Mus musculus
gggtttccagtgtgaatcctatttt

SEQ ID NO: 643630 - DNA, 25 bp, Mus musculus
gggtttccattgaccatgaaatgtc

SEQ ID NO: 643631 - DNA, 25 bp, Mus musculus
gggtttccattgtccatgaaatgtc

SEQ ID NO: 643632 - DNA, 25 bp, Mus musculus
gggtttcccagcataaccaggaatg

SEQ ID NO: 643633 - DNA, 25 bp, Mus musculus
gggtttcccagcttaaccaggaatg

SEQ ID NO: 643634 - DNA, 25 bp, Mus musculus
gggtttccccacaagatctaacact

SEQ ID NO: 643635 - DNA, 25 bp, Mus musculus
gggtttccccactagatctaacact

SEQ ID NO: 643636 - DNA, 25 bp, Mus musculus
gggtttcccctaagacatctgagat

SEQ ID NO: 643637 - DNA, 25 bp, Mus musculus
gggtttcccctatgacatctgagat

SEQ ID NO: 643638 - DNA, 25 bp, Mus musculus
gggtttcctattatagcctttcttg

SEQ ID NO: 643639 - DNA, 25 bp, Mus musculus
gggtttcctattttagcctttcttg

SEQ ID NO: 643640 - DNA, 25 bp, Mus musculus
gggtttcctcacataatactacttt

SEQ ID NO: 643641 - DNA, 25 bp, Mus musculus
gggtttcctcacttaatactacttt

SEQ ID NO: 643642 - DNA, 25 bp, Mus musculus
gggtttcctcgaagaatttcttttg

SEQ ID NO: 643643 - DNA, 25 bp, Mus musculus
gggtttcctcgatgaatttcttttg

SEQ ID NO: 643644 - DNA, 25 bp, Mus musculus
gggtttcctgaaagtttacattgca

SEQ ID NO: 643645 - DNA, 25 bp, Mus musculus
gggtttcctgaatgtttacattgca

SEQ ID NO: 643646 - DNA, 25 bp, Mus musculus
gggtttcctggtctcactgacatac

SEQ ID NO: 643647 - DNA, 25 bp, Mus musculus
gggtttcctggtgtcactgacatac

SEQ ID NO: 643648 - DNA, 25 bp, Mus musculus
gggtttcgccacatagccaagacaa

SEQ ID NO: 643649 - DNA, 25 bp, Mus musculus
gggtttcgccacttagccaagacaa

SEQ ID NO: 643650 - DNA, 25 bp, Mus musculus
gggtttcgggcaaatgttacagtat

SEQ ID NO: 643651 - DNA, 25 bp, Mus musculus
gggtttcgggcatatgttacagtat

SEQ ID NO: 643652 - DNA, 25 bp, Mus musculus
gggtttcgttctctctcctctcttg

SEQ ID NO: 643653 - DNA, 25 bp, Mus musculus
gggtttcgttctgtctcctctcttg

SEQ ID NO: 643654 - DNA, 25 bp, Mus musculus
gggtttctaaccaagcacctttatg

SEQ ID NO: 643655 - DNA, 25 bp, Mus musculus
gggtttctaacctagcacctttatg

SEQ ID NO: 643656 - DNA, 25 bp, Mus musculus
gggtttctacatatggagatttgcc

SEQ ID NO: 643657 - DNA, 25 bp, Mus musculus
gggtttctacatttggagatttgcc

SEQ ID NO: 643658 - DNA, 25 bp, Mus musculus
gggtttctaccaagaatgaaatgaa

SEQ ID NO: 643659 - DNA, 25 bp, Mus musculus
gggtttctaccatgaatgaaatgaa

SEQ ID NO: 643660 - DNA, 25 bp, Mus musculus
gggtttctagaccttaagccattct

SEQ ID NO: 643661 - DNA, 25 bp, Mus musculus
gggtttctagacgttaagccattct

SEQ ID NO: 643662 - DNA, 25 bp, Mus musculus
gggtttctcaatctcttttgctttc

SEQ ID NO: 643663 - DNA, 25 bp, Mus musculus
gggtttctcaatgtcttttgctttc

SEQ ID NO: 643664 - DNA, 25 bp, Mus musculus
gggtttctcagaacagcccttggaa

SEQ ID NO: 643665 - DNA, 25 bp, Mus musculus
gggtttctcagatcagcccttggaa

SEQ ID NO: 643666 - DNA, 25 bp, Mus musculus
gggtttctcataagtatcctagttc

SEQ ID NO: 643667 - DNA, 25 bp, Mus musculus
gggtttctcatatgtatcctagttc

SEQ ID NO: 643668 - DNA, 25 bp, Mus musculus
gggtttctcatccaggctgtcgaca

SEQ ID NO: 643669 - DNA, 25 bp, Mus musculus
gggtttctcatcgaggctgtcgaca

SEQ ID NO: 643670 - DNA, 25 bp, Mus musculus
gggtttctgacgcacaagcttgtga

SEQ ID NO: 643671 - DNA, 25 bp, Mus musculus
gggtttctgacggacaagcttgtga

SEQ ID NO: 643672 - DNA, 25 bp, Mus musculus
gggtttctgatacttgtggatgttt

SEQ ID NO: 643673 - DNA, 25 bp, Mus musculus
gggtttctgatagttgtggatgttt

SEQ ID NO: 643674 - DNA, 25 bp, Mus musculus
gggtttctgccaagctttgagactg

SEQ ID NO: 643675 - DNA, 25 bp, Mus musculus
gggtttctgccatgctttgagactg

SEQ ID NO: 643676 - DNA, 25 bp, Mus musculus
gggtttctggaacggctgattccct

SEQ ID NO: 643677 - DNA, 25 bp, Mus musculus
gggtttctggaagggctgattccct

SEQ ID NO: 643678 - DNA, 25 bp, Mus musculus
gggtttctggatacttggcaacatt

SEQ ID NO: 643679 - DNA, 25 bp, Mus musculus
gggtttctggattcttggcaacatt

SEQ ID NO: 643680 - DNA, 25 bp, Mus musculus
gggtttctggtcacattgtttcaga

SEQ ID NO: 643681 - DNA, 25 bp, Mus musculus
gggtttctggtctcattgtttcaga

SEQ ID NO: 643682 - DNA, 25 bp, Mus musculus
gggtttctgtaccatcagaggctca
